United States Patent 7,888,497 (BIOINFORMATICALLY DETECTABLE GROUP OF NOVEL REGULATORY OLIGONUCLEOTIDES AND USES THEREOF) - sequence listing, part 78

SEQ ID NO: 3289991 - DNA, 22 bp, Homo sapiens
cagccacggccaggccagaggg

SEQ ID NO: 3289992 - DNA, 12 bp, Homo sapiens
cagccactggct

SEQ ID NO: 3289993 - DNA, 12 bp, Homo sapiens
cagccagagctg

SEQ ID NO: 3289994 - DNA, 13 bp, Homo sapiens
cagccagagctgg

SEQ ID NO: 3289995 - DNA, 16 bp, Homo sapiens
cagccagagctgggtg

SEQ ID NO: 3289996 - DNA, 20 bp, Homo sapiens
cagccagcaatgatgtccag

SEQ ID NO: 3289997 - DNA, 12 bp, Homo sapiens
cagccagcagag

SEQ ID NO: 3289998 - DNA, 15 bp, Homo sapiens
cagccagcagagggg

SEQ ID NO: 3289999 - DNA, 14 bp, Homo sapiens
cagccagccagtct

SEQ ID NO: 3290000 - DNA, 20 bp, Homo sapiens
cagccagcccatggccccca

SEQ ID NO: 3290001 - DNA, 19 bp, Homo sapiens
cagccagccgccctgggct

SEQ ID NO: 3290002 - DNA, 23 bp, Homo sapiens
cagccagccgccctgggctgtct

SEQ ID NO: 3290003 - DNA, 18 bp, Homo sapiens
cagccagccggtgcctgg

SEQ ID NO: 3290004 - DNA, 15 bp, Homo sapiens
cagctgagagccctg

SEQ ID NO: 3290005 - DNA, 16 bp, Homo sapiens
cagctgagagccctgc

SEQ ID NO: 3290006 - DNA, 11 bp, Homo sapiens
cagctgagccc

SEQ ID NO: 3290007 - DNA, 14 bp, Homo sapiens
cagctgagccctgg

SEQ ID NO: 3290008 - DNA, 22 bp, Homo sapiens
cagctgaggacacaccccacac

SEQ ID NO: 3290009 - DNA, 20 bp, Homo sapiens
cagctgatacttcatttaaa

SEQ ID NO: 3290010 - DNA, 16 bp, Homo sapiens
cagctgcacctgccag

SEQ ID NO: 3290011 - DNA, 18 bp, Homo sapiens
cagctgcacctgccagcc

SEQ ID NO: 3290012 - DNA, 22 bp, Homo sapiens
cagctgcacctgccagcctggc

SEQ ID NO: 3290013 - DNA, 18 bp, Homo sapiens
cagctgcagctgggcccc

SEQ ID NO: 3290014 - DNA, 19 bp, Homo sapiens
cagctgccccggcccctcc

SEQ ID NO: 3290015 - DNA, 18 bp, Homo sapiens
cagctgccgaccagagcc

SEQ ID NO: 3290016 - DNA, 12 bp, Homo sapiens
cagctgcctctg

SEQ ID NO: 3290017 - DNA, 17 bp, Homo sapiens
cagctgcctctgctccc

SEQ ID NO: 3290018 - DNA, 13 bp, Homo sapiens
cagctgcctggag

SEQ ID NO: 3290019 - DNA, 16 bp, Homo sapiens
cagctgcctggagagg

SEQ ID NO: 3290020 - DNA, 21 bp, Homo sapiens
cagctgcctggagagggtctc

SEQ ID NO: 3290021 - DNA, 21 bp, Homo sapiens
cagctgcctgtgcctgccatg

SEQ ID NO: 3290022 - DNA, 10 bp, Homo sapiens
cagctgcctt

SEQ ID NO: 3290023 - DNA, 18 bp, Homo sapiens
cagctgccttcctcatcc

SEQ ID NO: 3290024 - DNA, 17 bp, Homo sapiens
cagctgcgcttgctttt

SEQ ID NO: 3290025 - DNA, 14 bp, Homo sapiens
cagctgcgggtctg

SEQ ID NO: 3290026 - DNA, 19 bp, Homo sapiens
cagctgcggtccacccagg

SEQ ID NO: 3290027 - DNA, 21 bp, Homo sapiens
cagctgcggtccacccaggag

SEQ ID NO: 3290028 - DNA, 17 bp, Homo sapiens
cagctgctactactcct

SEQ ID NO: 3290029 - DNA, 22 bp, Homo sapiens
cagctgctatttattttcctaa

SEQ ID NO: 3290030 - DNA, 13 bp, Homo sapiens
cagctgctcagaa

SEQ ID NO: 3290031 - DNA, 14 bp, Homo sapiens
cagctgctcagaat

SEQ ID NO: 3290032 - DNA, 15 bp, Homo sapiens
cagctgctctgcccc

SEQ ID NO: 3290033 - DNA, 17 bp, Homo sapiens
cagctgctctgcccctt

SEQ ID NO: 3290034 - DNA, 21 bp, Homo sapiens
cagctgctctgccccttgggc

SEQ ID NO: 3290035 - DNA, 16 bp, Homo sapiens
cagctgctcttagtgc

SEQ ID NO: 3290036 - DNA, 14 bp, Homo sapiens
cagctgctttttgt

SEQ ID NO: 3290037 - DNA, 20 bp, Homo sapiens
cagctggaagtctacctgct

SEQ ID NO: 3290038 - DNA, 23 bp, Homo sapiens
cagctggaagtctacctgctgga

SEQ ID NO: 3290039 - DNA, 17 bp, Homo sapiens
cagctggactctgcatc

SEQ ID NO: 3290040 - DNA, 21 bp, Homo sapiens
cagctggatgagacttccaaa

SEQ ID NO: 3290041 - DNA, 13 bp, Homo sapiens
cagctggctgtat

SEQ ID NO: 3290042 - DNA, 16 bp, Homo sapiens
cagctgggaagccctt

SEQ ID NO: 3290043 - DNA, 17 bp, Homo sapiens
cagctgggaagcccttt

SEQ ID NO: 3290044 - DNA, 11 bp, Homo sapiens
cagctgggcaa

SEQ ID NO: 3290045 - DNA, 15 bp, Homo sapiens
cagctgggccccatg

SEQ ID NO: 3290046 - DNA, 22 bp, Homo sapiens
cagctgggccccatgctctgcc

SEQ ID NO: 3290047 - DNA, 18 bp, Homo sapiens
cagctggttactcagggt

SEQ ID NO: 3290048 - DNA, 19 bp, Homo sapiens
cagctgtaagaagagactg

SEQ ID NO: 3290049 - DNA, 22 bp, Homo sapiens
cagctgtaagaagagactggga

SEQ ID NO: 3290050 - DNA, 17 bp, Homo sapiens
cagctgtagccatggct

SEQ ID NO: 3290051 - DNA, 22 bp, Homo sapiens
cagctgtagccatggctcaggc

SEQ ID NO: 3290052 - DNA, 15 bp, Homo sapiens
cagctgtgagccttg

SEQ ID NO: 3290053 - DNA, 20 bp, Homo sapiens
cagctgtgctctggacaggc

SEQ ID NO: 3290054 - DNA, 16 bp, Homo sapiens
cagctgtggcagagtt

SEQ ID NO: 3290055 - DNA, 14 bp, Homo sapiens
cagctgtttgtcat

SEQ ID NO: 3290056 - DNA, 15 bp, Homo sapiens
cagctgtttgtcata

SEQ ID NO: 3290057 - DNA, 14 bp, Homo sapiens
cagcttaagcgttc

SEQ ID NO: 3290058 - DNA, 16 bp, Homo sapiens
cagcttatctctttta

SEQ ID NO: 3290059 - DNA, 15 bp, Homo sapiens
cagcttcaagtgcct

SEQ ID NO: 3290060 - DNA, 14 bp, Homo sapiens
cagcttcaccagag

SEQ ID NO: 3290061 - DNA, 16 bp, Homo sapiens
cagcttcaccagagca

SEQ ID NO: 3290062 - DNA, 17 bp, Homo sapiens
cagcttcaccctgtcaa

SEQ ID NO: 3290063 - DNA, 13 bp, Homo sapiens
cagcttcaggcac

SEQ ID NO: 3290064 - DNA, 22 bp, Homo sapiens
cagcttcaggcaccagcatcca

SEQ ID NO: 3290065 - DNA, 21 bp, Homo sapiens
cagcttcattatctgagttgc

SEQ ID NO: 3290066 - DNA, 23 bp, Homo sapiens
cagcttcattatctgagttgcat

SEQ ID NO: 3290067 - DNA, 18 bp, Homo sapiens
cagcttcatttcctgtgt

SEQ ID NO: 3290068 - DNA, 19 bp, Homo sapiens
cagcttcatttcctgtgtc

SEQ ID NO: 3290069 - DNA, 12 bp, Homo sapiens
cagcttcccagc

SEQ ID NO: 3290070 - DNA, 21 bp, Homo sapiens
cagcttcccagccatgcccag

SEQ ID NO: 3290071 - DNA, 15 bp, Homo sapiens
cagcttcctggtgta

SEQ ID NO: 3290072 - DNA, 20 bp, Homo sapiens
cagcttcggagggcccctgc

SEQ ID NO: 3290073 - DNA, 21 bp, Homo sapiens
cagcttcggagggcccctgcg

SEQ ID NO: 3290074 - DNA, 12 bp, Homo sapiens
cagcttctctgc

SEQ ID NO: 3290075 - DNA, 22 bp, Homo sapiens
cagcttctggtactctcctaga

SEQ ID NO: 3290076 - DNA, 14 bp, Homo sapiens
cagcttcttgcact

SEQ ID NO: 3290077 - DNA, 17 bp, Homo sapiens
cagcttcttttgtctcc

SEQ ID NO: 3290078 - DNA, 23 bp, Homo sapiens
cagcttgacctgaggctgtggtc

SEQ ID NO: 3290079 - DNA, 21 bp, Homo sapiens
cagcttgagccgggcccctgg

SEQ ID NO: 3290080 - DNA, 14 bp, Homo sapiens
cagcttgagggttg

SEQ ID NO: 3290081 - DNA, 19 bp, Homo sapiens
cagcttgagggttgggctg

SEQ ID NO: 3290082 - DNA, 12 bp, Homo sapiens
cagcttgccccg

SEQ ID NO: 3290083 - DNA, 13 bp, Homo sapiens
cagcttgccccgg

SEQ ID NO: 3290084 - DNA, 17 bp, Homo sapiens
cagcttggccctttcct

SEQ ID NO: 3290085 - DNA, 14 bp, Homo sapiens
cagcttgggagagc

SEQ ID NO: 3290086 - DNA, 18 bp, Homo sapiens
cagcttgggagagcccct

SEQ ID NO: 3290087 - DNA, 21 bp, Homo sapiens
cagcttgtaaatagctcaggt

SEQ ID NO: 3290088 - DNA, 15 bp, Homo sapiens
cagcttgtaggagct

SEQ ID NO: 3290089 - DNA, 16 bp, Homo sapiens
cagcttgtaggagctg

SEQ ID NO: 3290090 - DNA, 13 bp, Homo sapiens
cagctttaaacaa

SEQ ID NO: 3290091 - DNA, 19 bp, Homo sapiens
cagctttaaactcagggac

SEQ ID NO: 3290092 - DNA, 17 bp, Homo sapiens
cagctttcaagtgcctt

SEQ ID NO: 3290093 - DNA, 16 bp, Homo sapiens
cagctttcagggccat

SEQ ID NO: 3290094 - DNA, 17 bp, Homo sapiens
cagctttcatgattagc

SEQ ID NO: 3290095 - DNA, 23 bp, Homo sapiens
cagctttcttgctcccttcagcc

SEQ ID NO: 3290096 - DNA, 23 bp, Homo sapiens
cagctttgactttatctcctgct

SEQ ID NO: 3290097 - DNA, 16 bp, Homo sapiens
cagctttgagaagcct

SEQ ID NO: 3290098 - DNA, 18 bp, Homo sapiens
cagctttgagaagccttc

SEQ ID NO: 3290099 - DNA, 19 bp, Homo sapiens
cagctttgagaagccttca

SEQ ID NO: 3290100 - DNA, 17 bp, Homo sapiens
cagctttgatccctgac

SEQ ID NO: 3290101 - DNA, 22 bp, Homo sapiens
cagctttgcccaacaccagccc

SEQ ID NO: 3290102 - DNA, 16 bp, Homo sapiens
cagcttttcctccctt

SEQ ID NO: 3290103 - DNA, 16 bp, Homo sapiens
cagctttttattccct

SEQ ID NO: 3290104 - DNA, 22 bp, Homo sapiens
caggaaaaaaaattctgttgtt

SEQ ID NO: 3290105 - DNA, 23 bp, Homo sapiens
caggaaaaaaaattctgttgttc

SEQ ID NO: 3290106 - DNA, 19 bp, Homo sapiens
caggaaaagctgctgacag

SEQ ID NO: 3290107 - DNA, 13 bp, Homo sapiens
caggaaaccaaca

SEQ ID NO: 3290108 - DNA, 21 bp, Homo sapiens
caggaaactccacatctgcct

SEQ ID NO: 3290109 - DNA, 15 bp, Homo sapiens
caggaaagccctccc

SEQ ID NO: 3290110 - DNA, 19 bp, Homo sapiens
caggaaagccctccccctt

SEQ ID NO: 3290111 - DNA, 19 bp, Homo sapiens
caggaaagctcagctactg

SEQ ID NO: 3290112 - DNA, 18 bp, Homo sapiens
caggaaagtgttattttt

SEQ ID NO: 3290113 - DNA, 23 bp, Homo sapiens
caggaaatatatatgtgtgtgta

SEQ ID NO: 3290114 - DNA, 15 bp, Homo sapiens
caggaacaaacaggg

SEQ ID NO: 3290115 - DNA, 23 bp, Homo sapiens
caggaacagctatgggagcccca

SEQ ID NO: 3290116 - DNA, 14 bp, Homo sapiens
caggaacgagcact

SEQ ID NO: 3290117 - DNA, 15 bp, Homo sapiens
caggaacgagcactg

SEQ ID NO: 3290118 - DNA, 22 bp, Homo sapiens
caggaacgagcactggccagag

SEQ ID NO: 3290119 - DNA, 19 bp, Homo sapiens
caggaactagactgcctgg

SEQ ID NO: 3290120 - DNA, 12 bp, Homo sapiens
caggaactgggc

SEQ ID NO: 3290121 - DNA, 19 bp, Homo sapiens
caggaactgggctgggcct

SEQ ID NO: 3290122 - DNA, 17 bp, Homo sapiens
caggaagcaccccatgc

SEQ ID NO: 3290123 - DNA, 19 bp, Homo sapiens
caggaagcattcagagagc

SEQ ID NO: 3290124 - DNA, 22 bp, Homo sapiens
caggaagcattcagagagcagc

SEQ ID NO: 3290125 - DNA, 15 bp, Homo sapiens
caggaaggaaaacta

SEQ ID NO: 3290126 - DNA, 17 bp, Homo sapiens
caggaaggaaaactatg

SEQ ID NO: 3290127 - DNA, 15 bp, Homo sapiens
caggaaggacagact

SEQ ID NO: 3290128 - DNA, 12 bp, Homo sapiens
caggaaggagag

SEQ ID NO: 3290129 - DNA, 14 bp, Homo sapiens
caggaaggagagcc

SEQ ID NO: 3290130 - DNA, 21 bp, Homo sapiens
caggagttcaataaatgtctg

SEQ ID NO: 3290131 - DNA, 19 bp, Homo sapiens
caggagttggagaccaggc

SEQ ID NO: 3290132 - DNA, 24 bp, Homo sapiens
caggagtttgagacaagccctggc

SEQ ID NO: 3290133 - DNA, 20 bp, Homo sapiens
caggagtttgaggctgcagc

SEQ ID NO: 3290134 - DNA, 18 bp, Homo sapiens
caggataaactgaaaact

SEQ ID NO: 3290135 - DNA, 22 bp, Homo sapiens
caggataaggagactgaggctt

SEQ ID NO: 3290136 - DNA, 23 bp, Homo sapiens
caggatactctgtcagatgggaa

SEQ ID NO: 3290137 - DNA, 17 bp, Homo sapiens
caggatactggcacaga

SEQ ID NO: 3290138 - DNA, 20 bp, Homo sapiens
caggatactggcacagaggt

SEQ ID NO: 3290139 - DNA, 20 bp, Homo sapiens
caggatatccttatcagagc

SEQ ID NO: 3290140 - DNA, 22 bp, Homo sapiens
caggatatccttatcagagcta

SEQ ID NO: 3290141 - DNA, 13 bp, Homo sapiens
caggatattagtt

SEQ ID NO: 3290142 - DNA, 22 bp, Homo sapiens
caggatattagttaatgagcca

SEQ ID NO: 3290143 - DNA, 14 bp, Homo sapiens
caggatcagtctga

SEQ ID NO: 3290144 - DNA, 15 bp, Homo sapiens
caggatcatggtgta

SEQ ID NO: 3290145 - DNA, 15 bp, Homo sapiens
caggatccgctgcca

SEQ ID NO: 3290146 - DNA, 20 bp, Homo sapiens
caggatcctctcctttgaaa

SEQ ID NO: 3290147 - DNA, 16 bp, Homo sapiens
caggatctttgactga

SEQ ID NO: 3290148 - DNA, 15 bp, Homo sapiens
caggatgaacccagg

SEQ ID NO: 3290149 - DNA, 17 bp, Homo sapiens
caggatgaacccaggac

SEQ ID NO: 3290150 - DNA, 15 bp, Homo sapiens
caggatgaccctgcg

SEQ ID NO: 3290151 - DNA, 17 bp, Homo sapiens
caggatgacctggataa

SEQ ID NO: 3290152 - DNA, 16 bp, Homo sapiens
caggatgcacatttct

SEQ ID NO: 3290153 - DNA, 20 bp, Homo sapiens
caggatgcacatttctggat

SEQ ID NO: 3290154 - DNA, 15 bp, Homo sapiens
caggatgccagcccc

SEQ ID NO: 3290155 - DNA, 23 bp, Homo sapiens
caggatgccagcccctgcctggg

SEQ ID NO: 3290156 - DNA, 22 bp, Homo sapiens
caggatgcccagatgaactgac

SEQ ID NO: 3290157 - DNA, 13 bp, Homo sapiens
caggatgctgagc

SEQ ID NO: 3290158 - DNA, 14 bp, Homo sapiens
caggatgctgagct

SEQ ID NO: 3290159 - DNA, 15 bp, Homo sapiens
caggatgctgagctt

SEQ ID NO: 3290160 - DNA, 13 bp, Homo sapiens
caggatgctggcc

SEQ ID NO: 3290161 - DNA, 22 bp, Homo sapiens
caggatggaggggtggtcctga

SEQ ID NO: 3290162 - DNA, 18 bp, Homo sapiens
caggatgggggctggcct

SEQ ID NO: 3290163 - DNA, 22 bp, Homo sapiens
caggatggtctcgatctcctga

SEQ ID NO: 3290164 - DNA, 18 bp, Homo sapiens
caggattacagtgtagct

SEQ ID NO: 3290165 - DNA, 16 bp, Homo sapiens
caggattgatcattct

SEQ ID NO: 3290166 - DNA, 21 bp, Homo sapiens
caggcaaaaaagggacagcat

SEQ ID NO: 3290167 - DNA, 22 bp, Homo sapiens
caggcaacgcacaaaacagaaa

SEQ ID NO: 3290168 - DNA, 19 bp, Homo sapiens
caggcaacttcagtcctgg

SEQ ID NO: 3290169 - DNA, 22 bp, Homo sapiens
caggcaacttcagtcctgggag

SEQ ID NO: 3290170 - DNA, 16 bp, Homo sapiens
caggcaagcacctcct

SEQ ID NO: 3290171 - DNA, 18 bp, Homo sapiens
caggcaagcccctcagcc

SEQ ID NO: 3290172 - DNA, 19 bp, Homo sapiens
caggcaagcccctcagccc

SEQ ID NO: 3290173 - DNA, 22 bp, Homo sapiens
caggcaagcccctcagcccttg

SEQ ID NO: 3290174 - DNA, 21 bp, Homo sapiens
caggcaatgctggctgttggc

SEQ ID NO: 3290175 - DNA, 14 bp, Homo sapiens
caggcaatgctgta

SEQ ID NO: 3290176 - DNA, 12 bp, Homo sapiens
caggcaattccg

SEQ ID NO: 3290177 - DNA, 13 bp, Homo sapiens
caggcacacagct

SEQ ID NO: 3290178 - DNA, 23 bp, Homo sapiens
caggcacacagctactctcccca

SEQ ID NO: 3290179 - DNA, 13 bp, Homo sapiens
caggcacagggcc

SEQ ID NO: 3290180 - DNA, 15 bp, Homo sapiens
caggcacagggcccg

SEQ ID NO: 3290181 - DNA, 17 bp, Homo sapiens
caggcacagggcccgca

SEQ ID NO: 3290182 - DNA, 23 bp, Homo sapiens
caggcacagggcccgcagtgctg

SEQ ID NO: 3290183 - DNA, 16 bp, Homo sapiens
caggcaccagcatcca

SEQ ID NO: 3290184 - DNA, 20 bp, Homo sapiens
caggcacccggggccagaga

SEQ ID NO: 3290185 - DNA, 22 bp, Homo sapiens
caggcaccgccacgtcccagca

SEQ ID NO: 3290186 - DNA, 15 bp, Homo sapiens
caggcacctcttcct

SEQ ID NO: 3290187 - DNA, 14 bp, Homo sapiens
caggcacctggcct

SEQ ID NO: 3290188 - DNA, 19 bp, Homo sapiens
caggcacctggcctgctgg

SEQ ID NO: 3290189 - DNA, 16 bp, Homo sapiens
caggcacgggtggtcc

SEQ ID NO: 3290190 - DNA, 17 bp, Homo sapiens
caggcacgggtggtccc

SEQ ID NO: 3290191 - DNA, 14 bp, Homo sapiens
caggcacggtttgg

SEQ ID NO: 3290192 - DNA, 22 bp, Homo sapiens
caggcactagcctttggctctg

SEQ ID NO: 3290193 - DNA, 16 bp, Homo sapiens
caggcagactacacag

SEQ ID NO: 3290194 - DNA, 18 bp, Homo sapiens
caggcagatacaggaaaa

SEQ ID NO: 3290195 - DNA, 17 bp, Homo sapiens
caggcagatctgtgccc

SEQ ID NO: 3290196 - DNA, 21 bp, Homo sapiens
caggcagatctgtgccccatg

SEQ ID NO: 3290197 - DNA, 22 bp, Homo sapiens
caggcagatctgtgccccatgc

SEQ ID NO: 3290198 - DNA, 14 bp, Homo sapiens
caggcagcgccaag

SEQ ID NO: 3290199 - DNA, 19 bp, Homo sapiens
caggcagcgccaagtgcgt

SEQ ID NO: 3290200 - DNA, 18 bp, Homo sapiens
caggcagctggatgagac

SEQ ID NO: 3290201 - DNA, 13 bp, Homo sapiens
caggcaggaacaa

SEQ ID NO: 3290202 - DNA, 18 bp, Homo sapiens
caggcaggaagggcagga

SEQ ID NO: 3290203 - DNA, 19 bp, Homo sapiens
caggcaggaagggcaggaa

SEQ ID NO: 3290204 - DNA, 23 bp, Homo sapiens
caggcaggggtgggggtggaggc

SEQ ID NO: 3290205 - DNA, 12 bp, Homo sapiens
caggcaggtctt

SEQ ID NO: 3290206 - DNA, 13 bp, Homo sapiens
caggcaggtcttg

SEQ ID NO: 3290207 - DNA, 16 bp, Homo sapiens
caggcaggtgcctgga

SEQ ID NO: 3290208 - DNA, 16 bp, Homo sapiens
caggcagtcgggggct

SEQ ID NO: 3290209 - DNA, 23 bp, Homo sapiens
caggcagtcgggggctggcctag

SEQ ID NO: 3290210 - DNA, 24 bp, Homo sapiens
caggcagtcgggggctggcctagg

SEQ ID NO: 3290211 - DNA, 20 bp, Homo sapiens
caggcagtgtttaaaatgat

SEQ ID NO: 3290212 - DNA, 17 bp, Homo sapiens
caggcatagaggcttct

SEQ ID NO: 3290213 - DNA, 14 bp, Homo sapiens
caggcataggcctg

SEQ ID NO: 3290214 - DNA, 16 bp, Homo sapiens
caggcataggcctggg

SEQ ID NO: 3290215 - DNA, 19 bp, Homo sapiens
caggcataggcctgggtgc

SEQ ID NO: 3290216 - DNA, 14 bp, Homo sapiens
caggcatccggccc

SEQ ID NO: 3290217 - DNA, 13 bp, Homo sapiens
caggcatctcctt

SEQ ID NO: 3290218 - DNA, 16 bp, Homo sapiens
caggcatctccttggg

SEQ ID NO: 3290219 - DNA, 15 bp, Homo sapiens
caggcatgttctctg

SEQ ID NO: 3290220 - DNA, 19 bp, Homo sapiens
caggcatgttctctgagga

SEQ ID NO: 3290221 - DNA, 22 bp, Homo sapiens
caggccaaagagtctccagttt

SEQ ID NO: 3290222 - DNA, 19 bp, Homo sapiens
caggccaagagcagaggca

SEQ ID NO: 3290223 - DNA, 21 bp, Homo sapiens
caggccaagagcagaggcagc

SEQ ID NO: 3290224 - DNA, 11 bp, Homo sapiens
caggccacctc

SEQ ID NO: 3290225 - DNA, 19 bp, Homo sapiens
caggccacctccccagcat

SEQ ID NO: 3290226 - DNA, 20 bp, Homo sapiens
caggccacctccccagcatt

SEQ ID NO: 3290227 - DNA, 13 bp, Homo sapiens
caggccactgtgg

SEQ ID NO: 3290228 - DNA, 15 bp, Homo sapiens
caggccactgtggcc

SEQ ID NO: 3290229 - DNA, 23 bp, Homo sapiens
caggccactgtggccagagctgg

SEQ ID NO: 3290230 - DNA, 15 bp, Homo sapiens
caggccagcccagcc

SEQ ID NO: 3290231 - DNA, 16 bp, Homo sapiens
caggccagcccagcca

SEQ ID NO: 3290232 - DNA, 11 bp, Homo sapiens
caggccagcct

SEQ ID NO: 3290233 - DNA, 13 bp, Homo sapiens
caggccagcctcc

SEQ ID NO: 3290234 - DNA, 21 bp, Homo sapiens
caggccagcctccgagaggga

SEQ ID NO: 3290235 - DNA, 15 bp, Homo sapiens
caggccaggaccaca

SEQ ID NO: 3290236 - DNA, 23 bp, Homo sapiens
caggccaggaccacacagtcccc

SEQ ID NO: 3290237 - DNA, 16 bp, Homo sapiens
caggccaggtgcagtg

SEQ ID NO: 3290238 - DNA, 15 bp, Homo sapiens
caggccagtgtctgg

SEQ ID NO: 3290239 - DNA, 17 bp, Homo sapiens
caggccatgtgagccac

SEQ ID NO: 3290240 - DNA, 15 bp, Homo sapiens
caggcccaactgtga

SEQ ID NO: 3290241 - DNA, 22 bp, Homo sapiens
caggcccacagcgtgggaactc

SEQ ID NO: 3290242 - DNA, 10 bp, Homo sapiens
caggcccacc

SEQ ID NO: 3290243 - DNA, 13 bp, Homo sapiens
caggcccaccatc

SEQ ID NO: 3290244 - DNA, 15 bp, Homo sapiens
caggcccagagaagc

SEQ ID NO: 3290245 - DNA, 19 bp, Homo sapiens
caggcccagcattgctggt

SEQ ID NO: 3290246 - DNA, 20 bp, Homo sapiens
caggcccagcattgctggtt

SEQ ID NO: 3290247 - DNA, 13 bp, Homo sapiens
caggcccagccag

SEQ ID NO: 3290248 - DNA, 11 bp, Homo sapiens
caggcccagcg

SEQ ID NO: 3290249 - DNA, 20 bp, Homo sapiens
caggcccagcgcggccagcg

SEQ ID NO: 3290250 - DNA, 21 bp, Homo sapiens
caggcccagcgcggccagcgt

SEQ ID NO: 3290251 - DNA, 22 bp, Homo sapiens
caggcccagcgcggccagcgtc

SEQ ID NO: 3290252 - DNA, 14 bp, Homo sapiens
caggcccaggcaga

SEQ ID NO: 3290253 - DNA, 22 bp, Homo sapiens
caggcccaggcagagctgacgg

SEQ ID NO: 3290254 - DNA, 18 bp, Homo sapiens
caggcccagtgacaaaga

SEQ ID NO: 3290255 - DNA, 17 bp, Homo sapiens
cagtcacatgacctgat

SEQ ID NO: 3290256 - DNA, 23 bp, Homo sapiens
cagtcaccaccacccgaaatgcc

SEQ ID NO: 3290257 - DNA, 18 bp, Homo sapiens
cagtcactgccactttgc

SEQ ID NO: 3290258 - DNA, 22 bp, Homo sapiens
cagtcactgccactttgcacat

SEQ ID NO: 3290259 - DNA, 23 bp, Homo sapiens
cagtcactggaggttgaagccaa

SEQ ID NO: 3290260 - DNA, 19 bp, Homo sapiens
cagtcagaaaactttaaaa

SEQ ID NO: 3290261 - DNA, 15 bp, Homo sapiens
cagtcagatttttaa

SEQ ID NO: 3290262 - DNA, 23 bp, Homo sapiens
cagtcagttcccggagcacagcc

SEQ ID NO: 3290263 - DNA, 16 bp, Homo sapiens
cagtcatcatcagggc

SEQ ID NO: 3290264 - DNA, 17 bp, Homo sapiens
cagtcatcatcagggcc

SEQ ID NO: 3290265 - DNA, 13 bp, Homo sapiens
cagtcatgcataa

SEQ ID NO: 3290266 - DNA, 17 bp, Homo sapiens
cagtcatgcataaatat

SEQ ID NO: 3290267 - DNA, 18 bp, Homo sapiens
cagtcatgcataaatatg

SEQ ID NO: 3290268 - DNA, 19 bp, Homo sapiens
cagtcatgcataaatatgc

SEQ ID NO: 3290269 - DNA, 23 bp, Homo sapiens
cagtcatgcataaatatgcagtg

SEQ ID NO: 3290270 - DNA, 22 bp, Homo sapiens
cagtcattcagcagcaaatttt

SEQ ID NO: 3290271 - DNA, 12 bp, Homo sapiens
cagtcatttaaa

SEQ ID NO: 3290272 - DNA, 22 bp, Homo sapiens
cagtccaaatgtcctccagaag

SEQ ID NO: 3290273 - DNA, 23 bp, Homo sapiens
cagtccagtgtcacctctctcag

SEQ ID NO: 3290274 - DNA, 21 bp, Homo sapiens
cagtcccagacaattccattc

SEQ ID NO: 3290275 - DNA, 12 bp, Homo sapiens
cagtccccaccc

SEQ ID NO: 3290276 - DNA, 14 bp, Homo sapiens
cagtccccagccct

SEQ ID NO: 3290277 - DNA, 19 bp, Homo sapiens
cagtccccctatccttggc

SEQ ID NO: 3290278 - DNA, 21 bp, Homo sapiens
cagtccccctatccttggcac

SEQ ID NO: 3290279 - DNA, 23 bp, Homo sapiens
cagtccccctatccttggcacca

SEQ ID NO: 3290280 - DNA, 16 bp, Homo sapiens
cagtccccctgcccca

SEQ ID NO: 3290281 - DNA, 12 bp, Homo sapiens
cagtccccgagg

SEQ ID NO: 3290282 - DNA, 22 bp, Homo sapiens
cagtccccgaggagctgggccc

SEQ ID NO: 3290283 - DNA, 19 bp, Homo sapiens
cagtcccctcccatctggg

SEQ ID NO: 3290284 - DNA, 23 bp, Homo sapiens
cagtcctccactcgacccagaat

SEQ ID NO: 3290285 - DNA, 18 bp, Homo sapiens
cagtcctccagaccacca

SEQ ID NO: 3290286 - DNA, 21 bp, Homo sapiens
cagtcctccagaccaccagcc

SEQ ID NO: 3290287 - DNA, 12 bp, Homo sapiens
cagtcctcccct

SEQ ID NO: 3290288 - DNA, 18 bp, Homo sapiens
cagtcctcccctcacagc

SEQ ID NO: 3290289 - DNA, 21 bp, Homo sapiens
cagtcctcccctcacagcctc

SEQ ID NO: 3290290 - DNA, 22 bp, Homo sapiens
cagtcctcccctcacagcctct

SEQ ID NO: 3290291 - DNA, 14 bp, Homo sapiens
cagtcctcctggga

SEQ ID NO: 3290292 - DNA, 15 bp, Homo sapiens
cagtcctcctgggag

SEQ ID NO: 3290293 - DNA, 15 bp, Homo sapiens
cagtcctgaggagag

SEQ ID NO: 3290294 - DNA, 13 bp, Homo sapiens
cagtcctgcagga

SEQ ID NO: 3290295 - DNA, 19 bp, Homo sapiens
cagtcctgcctcagcctcc

SEQ ID NO: 3290296 - DNA, 16 bp, Homo sapiens
cagtcctgcctggcca

SEQ ID NO: 3290297 - DNA, 17 bp, Homo sapiens
cagtcctgcctggccag

SEQ ID NO: 3290298 - DNA, 13 bp, Homo sapiens
cagtcctgctcca

SEQ ID NO: 3290299 - DNA, 12 bp, Homo sapiens
cagtcctgggag

SEQ ID NO: 3290300 - DNA, 13 bp, Homo sapiens
cagtcctgggaga

SEQ ID NO: 3290301 - DNA, 21 bp, Homo sapiens
cagtcctttcccaccattcct

SEQ ID NO: 3290302 - DNA, 22 bp, Homo sapiens
cagtcgaccgcacttatggtaa

SEQ ID NO: 3290303 - DNA, 23 bp, Homo sapiens
cagtcgcaggatccgctgccacc

SEQ ID NO: 3290304 - DNA, 19 bp, Homo sapiens
cagtcgcgagcacatgttc

SEQ ID NO: 3290305 - DNA, 17 bp, Homo sapiens
cagtcgggggctggcct

SEQ ID NO: 3290306 - DNA, 17 bp, Homo sapiens
cagtcgtcgcacagtct

SEQ ID NO: 3290307 - DNA, 18 bp, Homo sapiens
cagtcgtcgcacagtctc

SEQ ID NO: 3290308 - DNA, 20 bp, Homo sapiens
cagtcgtcgcacagtctctc

SEQ ID NO: 3290309 - DNA, 13 bp, Homo sapiens
cagtcgtgcctgt

SEQ ID NO: 3290310 - DNA, 21 bp, Homo sapiens
cagtcgtggctttggcagtgt

SEQ ID NO: 3290311 - DNA, 20 bp, Homo sapiens
cagtcgtgtaattggcccaa

SEQ ID NO: 3290312 - DNA, 22 bp, Homo sapiens
cagtctatccacagagagtccc

SEQ ID NO: 3290313 - DNA, 21 bp, Homo sapiens
cagtctcaagaggcagagttc

SEQ ID NO: 3290314 - DNA, 13 bp, Homo sapiens
cagtctcaggagc

SEQ ID NO: 3290315 - DNA, 14 bp, Homo sapiens
cagtctcaggagca

SEQ ID NO: 3290316 - DNA, 13 bp, Homo sapiens
cagtctcccaggc

SEQ ID NO: 3290317 - DNA, 14 bp, Homo sapiens
cagtctcccaggcc

SEQ ID NO: 3290318 - DNA, 18 bp, Homo sapiens
cagtctcccaggccccct

SEQ ID NO: 3290319 - DNA, 20 bp, Homo sapiens
cagtctcccaggccccctgc

SEQ ID NO: 3290320 - DNA, 11 bp, Homo sapiens
cagtctccctt

SEQ ID NO: 3290321 - DNA, 14 bp, Homo sapiens
cagtctcctcactc

SEQ ID NO: 3290322 - DNA, 21 bp, Homo sapiens
cagtctctctctctctctccc

SEQ ID NO: 3290323 - DNA, 14 bp, Homo sapiens
cagtctctcttaaa

SEQ ID NO: 3290324 - DNA, 19 bp, Homo sapiens
cagtctctttaatcttcag

SEQ ID NO: 3290325 - DNA, 15 bp, Homo sapiens
cagtctctttctgta

SEQ ID NO: 3290326 - DNA, 17 bp, Homo sapiens
cagtctctttcttcctt

SEQ ID NO: 3290327 - DNA, 18 bp, Homo sapiens
cagtctctttcttccttt

SEQ ID NO: 3290328 - DNA, 21 bp, Homo sapiens
cagtctctttcttcctttcta

SEQ ID NO: 3290329 - DNA, 16 bp, Homo sapiens
cagtctgaatgctgcc

SEQ ID NO: 3290330 - DNA, 19 bp, Homo sapiens
cagtctgattcccaagctc

SEQ ID NO: 3290331 - DNA, 21 bp, Homo sapiens
cagtctgattcccaagctctg

SEQ ID NO: 3290332 - DNA, 22 bp, Homo sapiens
cagtctgattcccaagctctgc

SEQ ID NO: 3290333 - DNA, 20 bp, Homo sapiens
cagtctgcccacgcagagga

SEQ ID NO: 3290334 - DNA, 21 bp, Homo sapiens
cagtctgcccacgcagaggac

SEQ ID NO: 3290335 - DNA, 19 bp, Homo sapiens
cagtctggaatgcagtggt

SEQ ID NO: 3290336 - DNA, 18 bp, Homo sapiens
cagtctgtctactgtggt

SEQ ID NO: 3290337 - DNA, 16 bp, Homo sapiens
cagtcttccttgtctc

SEQ ID NO: 3290338 - DNA, 14 bp, Homo sapiens
cagtcttgcctagg

SEQ ID NO: 3290339 - DNA, 15 bp, Homo sapiens
cagtcttgcctaggc

SEQ ID NO: 3290340 - DNA, 17 bp, Homo sapiens
cagtctttaaaggccca

SEQ ID NO: 3290341 - DNA, 21 bp, Homo sapiens
cagtctttaaaggcccagccc

SEQ ID NO: 3290342 - DNA, 22 bp, Homo sapiens
cagtctttaaaggcccagcccc

SEQ ID NO: 3290343 - DNA, 14 bp, Homo sapiens
cagtctttttctgt

SEQ ID NO: 3290344 - DNA, 16 bp, Homo sapiens
cagtctttttctgttg

SEQ ID NO: 3290345 - DNA, 18 bp, Homo sapiens
cagtctttttctgttgta

SEQ ID NO: 3290346 - DNA, 19 bp, Homo sapiens
cagtctttttctgttgtaa

SEQ ID NO: 3290347 - DNA, 15 bp, Homo sapiens
cagtgaaaatgtaag

SEQ ID NO: 3290348 - DNA, 18 bp, Homo sapiens
cagtgaaaatgtaagctg

SEQ ID NO: 3290349 - DNA, 19 bp, Homo sapiens
cagtgaaacgcaattttac

SEQ ID NO: 3290350 - DNA, 13 bp, Homo sapiens
cagtgaaagaagc

SEQ ID NO: 3290351 - DNA, 14 bp, Homo sapiens
cagtgaaatgtgaa

SEQ ID NO: 3290352 - DNA, 15 bp, Homo sapiens
cagtgaaatgtgaag

SEQ ID NO: 3290353 - DNA, 16 bp, Homo sapiens
cagtgaatctgtttca

SEQ ID NO: 3290354 - DNA, 12 bp, Homo sapiens
cagtgaattgtc

SEQ ID NO: 3290355 - DNA, 14 bp, Homo sapiens
cagtgacaaaccat

SEQ ID NO: 3290356 - DNA, 22 bp, Homo sapiens
cagtgacaaagactcctctggg

SEQ ID NO: 3290357 - DNA, 19 bp, Homo sapiens
cagtgacacttcagagagc

SEQ ID NO: 3290358 - DNA, 22 bp, Homo sapiens
cagtgacacttcagagagctgg

SEQ ID NO: 3290359 - DNA, 19 bp, Homo sapiens
cagtgacatcaaagcctgg

SEQ ID NO: 3290360 - DNA, 15 bp, Homo sapiens
cagtgaccacttatt

SEQ ID NO: 3290361 - DNA, 17 bp, Homo sapiens
cagtgaccttttcttca

SEQ ID NO: 3290362 - DNA, 22 bp, Homo sapiens
cagtgacgtgcacctgtactca

SEQ ID NO: 3290363 - DNA, 17 bp, Homo sapiens
cagtgactcctgctggt

SEQ ID NO: 3290364 - DNA, 19 bp, Homo sapiens
cagtgactcctgctggtac

SEQ ID NO: 3290365 - DNA, 18 bp, Homo sapiens
cagtgactggcaggtgca

SEQ ID NO: 3290366 - DNA, 11 bp, Homo sapiens
cagtgactttg

SEQ ID NO: 3290367 - DNA, 22 bp, Homo sapiens
cagtgactttttctgagctttt

SEQ ID NO: 3290368 - DNA, 20 bp, Homo sapiens
cagtgagaaaaagctcctgt

SEQ ID NO: 3290369 - DNA, 19 bp, Homo sapiens
cagtgagacagtctggaaa

SEQ ID NO: 3290370 - DNA, 20 bp, Homo sapiens
cagtgagacagtctggaaag

SEQ ID NO: 3290371 - DNA, 21 bp, Homo sapiens
cagtgagacagtctggaaagt

SEQ ID NO: 3290372 - DNA, 18 bp, Homo sapiens
cagtgagattacagagga

SEQ ID NO: 3290373 - DNA, 20 bp, Homo sapiens
cagtgagattacagaggaag

SEQ ID NO: 3290374 - DNA, 17 bp, Homo sapiens
cagtgagcggagatcgc

SEQ ID NO: 3290375 - DNA, 13 bp, Homo sapiens
cagtgaggagggt

SEQ ID NO: 3290376 - DNA, 14 bp, Homo sapiens
cagtgaggagggtg

SEQ ID NO: 3290377 - DNA, 23 bp, Homo sapiens
cagtgagggtcttcttacatgca

SEQ ID NO: 3290378 - DNA, 22 bp, Homo sapiens
cagtgagtcgaggacagggagg

SEQ ID NO: 3290379 - DNA, 20 bp, Homo sapiens
cagtgagtgagcctggctct

SEQ ID NO: 3290380 - DNA, 18 bp, Homo sapiens
catagtaccaatcatttt

SEQ ID NO: 3290381 - DNA, 17 bp, Homo sapiens
catagtagtttttacag

SEQ ID NO: 3290382 - DNA, 17 bp, Homo sapiens
catagtatggtggctgg

SEQ ID NO: 3290383 - DNA, 19 bp, Homo sapiens
catagtatggtggctgggt

SEQ ID NO: 3290384 - DNA, 13 bp, Homo sapiens
catagtcccagct

SEQ ID NO: 3290385 - DNA, 21 bp, Homo sapiens
catagtgagacccctgtctcc

SEQ ID NO: 3290386 - DNA, 15 bp, Homo sapiens
catagtgagatccca

SEQ ID NO: 3290387 - DNA, 18 bp, Homo sapiens
catagtgatggttcccct

SEQ ID NO: 3290388 - DNA, 19 bp, Homo sapiens
catagtgatggttcccctg

SEQ ID NO: 3290389 - DNA, 22 bp, Homo sapiens
catagtggcttaaaacaacact

SEQ ID NO: 3290390 - DNA, 18 bp, Homo sapiens
catagttctgaggtccct

SEQ ID NO: 3290391 - DNA, 17 bp, Homo sapiens
catagtttgggtatttt

SEQ ID NO: 3290392 - DNA, 12 bp, Homo sapiens
catagtttttcc

SEQ ID NO: 3290393 - DNA, 15 bp, Homo sapiens
catagtttttcctgg

SEQ ID NO: 3290394 - DNA, 17 bp, Homo sapiens
catagtttttcctgggt

SEQ ID NO: 3290395 - DNA, 15 bp, Homo sapiens
catataaatatattt

SEQ ID NO: 3290396 - DNA, 15 bp, Homo sapiens
catataagtttgaag

SEQ ID NO: 3290397 - DNA, 15 bp, Homo sapiens
catatacctataatg

SEQ ID NO: 3290398 - DNA, 19 bp, Homo sapiens
catatacctataatgtgtg

SEQ ID NO: 3290399 - DNA, 20 bp, Homo sapiens
catatacctataatgtgtgt

SEQ ID NO: 3290400 - DNA, 23 bp, Homo sapiens
catatagcattgataatcttcag

SEQ ID NO: 3290401 - DNA, 18 bp, Homo sapiens
catataggtgatgtttgc

SEQ ID NO: 3290402 - DNA, 18 bp, Homo sapiens
catatagtcaatgtaaaa

SEQ ID NO: 3290403 - DNA, 19 bp, Homo sapiens
catatataacagatacatt

SEQ ID NO: 3290404 - DNA, 23 bp, Homo sapiens
catatatatgttttaagaggcag

SEQ ID NO: 3290405 - DNA, 16 bp, Homo sapiens
catatatcttatgtta

SEQ ID NO: 3290406 - DNA, 22 bp, Homo sapiens
catatcaattggcagtgacttt

SEQ ID NO: 3290407 - DNA, 16 bp, Homo sapiens
catatccaccacctcc

SEQ ID NO: 3290408 - DNA, 20 bp, Homo sapiens
catatcccctgtgccctgca

SEQ ID NO: 3290409 - DNA, 15 bp, Homo sapiens
catatcctgagccat

SEQ ID NO: 3290410 - DNA, 17 bp, Homo sapiens
catatcgctgacttcat

SEQ ID NO: 3290411 - DNA, 22 bp, Homo sapiens
catatcgctgacttcatggaat

SEQ ID NO: 3290412 - DNA, 24 bp, Homo sapiens
catatcttctatatctgaagagta

SEQ ID NO: 3290413 - DNA, 14 bp, Homo sapiens
catatcttgccttc

SEQ ID NO: 3290414 - DNA, 21 bp, Homo sapiens
catatcttgcgaatccaagct

SEQ ID NO: 3290415 - DNA, 23 bp, Homo sapiens
catatcttgcgaatccaagctcc

SEQ ID NO: 3290416 - DNA, 16 bp, Homo sapiens
catatctttattaatc

SEQ ID NO: 3290417 - DNA, 17 bp, Homo sapiens
catatgaattgtacaga

SEQ ID NO: 3290418 - DNA, 20 bp, Homo sapiens
catatgatttcactagaaaa

SEQ ID NO: 3290419 - DNA, 13 bp, Homo sapiens
catatgcagaaat

SEQ ID NO: 3290420 - DNA, 21 bp, Homo sapiens
catatgccaccccatgtgcct

SEQ ID NO: 3290421 - DNA, 21 bp, Homo sapiens
catatgcctgaccccttgctc

SEQ ID NO: 3290422 - DNA, 14 bp, Homo sapiens
catatgctccagga

SEQ ID NO: 3290423 - DNA, 13 bp, Homo sapiens
catatgctctgct

SEQ ID NO: 3290424 - DNA, 14 bp, Homo sapiens
catatgctctgctt

SEQ ID NO: 3290425 - DNA, 18 bp, Homo sapiens
catatggactctgcacat

SEQ ID NO: 3290426 - DNA, 20 bp, Homo sapiens
catatggattttctattgtt

SEQ ID NO: 3290427 - DNA, 22 bp, Homo sapiens
catatgggatattcccaagccg

SEQ ID NO: 3290428 - DNA, 19 bp, Homo sapiens
catatgtagactatataca

SEQ ID NO: 3290429 - DNA, 23 bp, Homo sapiens
catatgtagactatatacatgtg

SEQ ID NO: 3290430 - DNA, 17 bp, Homo sapiens
catatgtgttacttcaa

SEQ ID NO: 3290431 - DNA, 15 bp, Homo sapiens
catatgttacactaa

SEQ ID NO: 3290432 - DNA, 16 bp, Homo sapiens
catatgttgaatactt

SEQ ID NO: 3290433 - DNA, 17 bp, Homo sapiens
catatgttgaatacttt

SEQ ID NO: 3290434 - DNA, 14 bp, Homo sapiens
catattaagacagt

SEQ ID NO: 3290435 - DNA, 20 bp, Homo sapiens
catattaagacagtgtacaa

SEQ ID NO: 3290436 - DNA, 14 bp, Homo sapiens
catattatgcctga

SEQ ID NO: 3290437 - DNA, 14 bp, Homo sapiens
catattcaaagcag

SEQ ID NO: 3290438 - DNA, 21 bp, Homo sapiens
catattcaaagcagcagccac

SEQ ID NO: 3290439 - DNA, 15 bp, Homo sapiens
catattctaaaacca

SEQ ID NO: 3290440 - DNA, 21 bp, Homo sapiens
catattctattgtattatttg

SEQ ID NO: 3290441 - DNA, 16 bp, Homo sapiens
catattctgttggaag

SEQ ID NO: 3290442 - DNA, 17 bp, Homo sapiens
catattctgttggccag

SEQ ID NO: 3290443 - DNA, 16 bp, Homo sapiens
catattgaatgtttcc

SEQ ID NO: 3290444 - DNA, 14 bp, Homo sapiens
catattgatgaaaa

SEQ ID NO: 3290445 - DNA, 15 bp, Homo sapiens
catattgatgaaaag

SEQ ID NO: 3290446 - DNA, 19 bp, Homo sapiens
catattgcaggagacattt

SEQ ID NO: 3290447 - DNA, 17 bp, Homo sapiens
catattgctgagagaaa

SEQ ID NO: 3290448 - DNA, 14 bp, Homo sapiens
catattggtattca

SEQ ID NO: 3290449 - DNA, 13 bp, Homo sapiens
catattgtgccaa

SEQ ID NO: 3290450 - DNA, 21 bp, Homo sapiens
catattgtgccaatatgtatt

SEQ ID NO: 3290451 - DNA, 13 bp, Homo sapiens
catattgttgaaa

SEQ ID NO: 3290452 - DNA, 12 bp, Homo sapiens
catattgtttga

SEQ ID NO: 3290453 - DNA, 14 bp, Homo sapiens
catatttaaagaca

SEQ ID NO: 3290454 - DNA, 18 bp, Homo sapiens
catatttactctttctaa

SEQ ID NO: 3290455 - DNA, 14 bp, Homo sapiens
catatttacttctt

SEQ ID NO: 3290456 - DNA, 21 bp, Homo sapiens
catatttattgcattgctggt

SEQ ID NO: 3290457 - DNA, 17 bp, Homo sapiens
catatttcattttaaca

SEQ ID NO: 3290458 - DNA, 21 bp, Homo sapiens
catatttccccttggacactt

SEQ ID NO: 3290459 - DNA, 13 bp, Homo sapiens
catatttgaaaac

SEQ ID NO: 3290460 - DNA, 10 bp, Homo sapiens
catatttgag

SEQ ID NO: 3290461 - DNA, 15 bp, Homo sapiens
catatttgagactag

SEQ ID NO: 3290462 - DNA, 21 bp, Homo sapiens
catatttgccaataaagcttt

SEQ ID NO: 3290463 - DNA, 12 bp, Homo sapiens
catatttggaag

SEQ ID NO: 3290464 - DNA, 13 bp, Homo sapiens
catatttggaaga

SEQ ID NO: 3290465 - DNA, 21 bp, Homo sapiens
catatttgtggcccgtgcagc

SEQ ID NO: 3290466 - DNA, 18 bp, Homo sapiens
catattttattgtatttt

SEQ ID NO: 3290467 - DNA, 23 bp, Homo sapiens
catattttattgtattttgatga

SEQ ID NO: 3290468 - DNA, 16 bp, Homo sapiens
catattttcctttaga

SEQ ID NO: 3290469 - DNA, 20 bp, Homo sapiens
catattttgattattgtatt

SEQ ID NO: 3290470 - DNA, 13 bp, Homo sapiens
catattttgctgg

SEQ ID NO: 3290471 - DNA, 16 bp, Homo sapiens
catcaaaaagaaaaat

SEQ ID NO: 3290472 - DNA, 19 bp, Homo sapiens
catcaaacctactataaaa

SEQ ID NO: 3290473 - DNA, 18 bp, Homo sapiens
catcaaacctttgagtag

SEQ ID NO: 3290474 - DNA, 17 bp, Homo sapiens
catcaaagcctggccta

SEQ ID NO: 3290475 - DNA, 13 bp, Homo sapiens
catcaaataaatt

SEQ ID NO: 3290476 - DNA, 14 bp, Homo sapiens
catcaaataaattt

SEQ ID NO: 3290477 - DNA, 16 bp, Homo sapiens
catcaaataaatttct

SEQ ID NO: 3290478 - DNA, 17 bp, Homo sapiens
catcaagaaatactttc

SEQ ID NO: 3290479 - DNA, 20 bp, Homo sapiens
catcaagcaggaattatgtc

SEQ ID NO: 3290480 - DNA, 11 bp, Homo sapiens
catcaataaat

SEQ ID NO: 3290481 - DNA, 19 bp, Homo sapiens
catcaatatccctcttgta

SEQ ID NO: 3290482 - DNA, 21 bp, Homo sapiens
catcaatcctggtaaccaaat

SEQ ID NO: 3290483 - DNA, 15 bp, Homo sapiens
catcaatgtgacatt

SEQ ID NO: 3290484 - DNA, 11 bp, Homo sapiens
catcaattccc

SEQ ID NO: 3290485 - DNA, 14 bp, Homo sapiens
catcaattcccatt

SEQ ID NO: 3290486 - DNA, 19 bp, Homo sapiens
catcacactgggtggtggc

SEQ ID NO: 3290487 - DNA, 17 bp, Homo sapiens
catcacaggatgccagc

SEQ ID NO: 3290488 - DNA, 18 bp, Homo sapiens
catcacaggatgccagcc

SEQ ID NO: 3290489 - DNA, 19 bp, Homo sapiens
catcacaggatgccagccc

SEQ ID NO: 3290490 - DNA, 23 bp, Homo sapiens
catcacaggatgccagcccctgc

SEQ ID NO: 3290491 - DNA, 19 bp, Homo sapiens
catcaccaccgcctctggc

SEQ ID NO: 3290492 - DNA, 13 bp, Homo sapiens
catcaccgctggg

SEQ ID NO: 3290493 - DNA, 12 bp, Homo sapiens
catcacctcagg

SEQ ID NO: 3290494 - DNA, 13 bp, Homo sapiens
catcacctcaggc

SEQ ID NO: 3290495 - DNA, 13 bp, Homo sapiens
catcacctctgta

SEQ ID NO: 3290496 - DNA, 18 bp, Homo sapiens
catcacgtaccccactgg

SEQ ID NO: 3290497 - DNA, 19 bp, Homo sapiens
catcacgtaccccactggg

SEQ ID NO: 3290498 - DNA, 24 bp, Homo sapiens
catcacgtaccccactgggccagc

SEQ ID NO: 3290499 - DNA, 15 bp, Homo sapiens
catcactagaagaaa

SEQ ID NO: 3290500 - DNA, 23 bp, Homo sapiens
catcactagaagaaaagcccatt

SEQ ID NO: 3290501 - DNA, 16 bp, Homo sapiens
catcactatccatgca

SEQ ID NO: 3290502 - DNA, 13 bp, Homo sapiens
catcactcttgta

SEQ ID NO: 3290503 - DNA, 12 bp, Homo sapiens
catcactgtatc

SEQ ID NO: 3290504 - DNA, 12 bp, Homo sapiens
catcacttccct

SEQ ID NO: 3290505 - DNA, 19 bp, Homo sapiens
catcacttgtacaaaataa

SEQ ID NO: 3290506 - DNA, 17 bp, Homo sapiens
catgcagttcctggccc

SEQ ID NO: 3290507 - DNA, 12 bp, Homo sapiens
catgcataaata

SEQ ID NO: 3290508 - DNA, 19 bp, Homo sapiens
catgcataaatatgcagtg

SEQ ID NO: 3290509 - DNA, 22 bp, Homo sapiens
catgcataaatatgcagtgata

SEQ ID NO: 3290510 - DNA, 15 bp, Homo sapiens
catgcatactttatt

SEQ ID NO: 3290511 - DNA, 18 bp, Homo sapiens
catgcatagtcccagcta

SEQ ID NO: 3290512 - DNA, 17 bp, Homo sapiens
catgcatgtcctgtaaa

SEQ ID NO: 3290513 - DNA, 18 bp, Homo sapiens
catgcatgtcctgtaaag

SEQ ID NO: 3290514 - DNA, 11 bp, Homo sapiens
catgcattgtt

SEQ ID NO: 3290515 - DNA, 12 bp, Homo sapiens
catgcattgttg

SEQ ID NO: 3290516 - DNA, 16 bp, Homo sapiens
catgcattttcttgta

SEQ ID NO: 3290517 - DNA, 19 bp, Homo sapiens
catgccactacactccagc

SEQ ID NO: 3290518 - DNA, 13 bp, Homo sapiens
catgccactgcca

SEQ ID NO: 3290519 - DNA, 20 bp, Homo sapiens
catgccactgccaggcacct

SEQ ID NO: 3290520 - DNA, 21 bp, Homo sapiens
catgccagctacttcctcctc

SEQ ID NO: 3290521 - DNA, 13 bp, Homo sapiens
catgccaggaacc

SEQ ID NO: 3290522 - DNA, 14 bp, Homo sapiens
catgccagtatttt

SEQ ID NO: 3290523 - DNA, 19 bp, Homo sapiens
catgccagtatttttaaag

SEQ ID NO: 3290524 - DNA, 17 bp, Homo sapiens
catgccagtgacacttc

SEQ ID NO: 3290525 - DNA, 13 bp, Homo sapiens
catgcccaccccc

SEQ ID NO: 3290526 - DNA, 20 bp, Homo sapiens
catgcccaccccctgccctg

SEQ ID NO: 3290527 - DNA, 21 bp, Homo sapiens
catgcccaccccctgccctgc

SEQ ID NO: 3290528 - DNA, 21 bp, Homo sapiens
catgcccacctgcccatcaca

SEQ ID NO: 3290529 - DNA, 12 bp, Homo sapiens
catgcccaggac

SEQ ID NO: 3290530 - DNA, 12 bp, Homo sapiens
catgccccagtc

SEQ ID NO: 3290531 - DNA, 14 bp, Homo sapiens
catgccccctgcag

SEQ ID NO: 3290532 - DNA, 15 bp, Homo sapiens
catgccccctttcag

SEQ ID NO: 3290533 - DNA, 16 bp, Homo sapiens
catgccccggccacct

SEQ ID NO: 3290534 - DNA, 17 bp, Homo sapiens
catgccccggccacctc

SEQ ID NO: 3290535 - DNA, 13 bp, Homo sapiens
catgccccttggc

SEQ ID NO: 3290536 - DNA, 16 bp, Homo sapiens
catgccccttggctgg

SEQ ID NO: 3290537 - DNA, 17 bp, Homo sapiens
catgcccggtcccaccc

SEQ ID NO: 3290538 - DNA, 15 bp, Homo sapiens
catgccctcctggac

SEQ ID NO: 3290539 - DNA, 12 bp, Homo sapiens
catgcccttctg

SEQ ID NO: 3290540 - DNA, 23 bp, Homo sapiens
catgccgggcccctccatccacc

SEQ ID NO: 3290541 - DNA, 16 bp, Homo sapiens
catgcctcatgccaca

SEQ ID NO: 3290542 - DNA, 17 bp, Homo sapiens
catgcctcatgccacac

SEQ ID NO: 3290543 - DNA, 22 bp, Homo sapiens
catgcctctgatatgggactga

SEQ ID NO: 3290544 - DNA, 16 bp, Homo sapiens
catgcctctggaggcc

SEQ ID NO: 3290545 - DNA, 21 bp, Homo sapiens
catgcctctggaggcctctgg

SEQ ID NO: 3290546 - DNA, 15 bp, Homo sapiens
catgcctgagggtgg

SEQ ID NO: 3290547 - DNA, 17 bp, Homo sapiens
catgcctgtccagcctg

SEQ ID NO: 3290548 - DNA, 14 bp, Homo sapiens
catgcctgtctctg

SEQ ID NO: 3290549 - DNA, 14 bp, Homo sapiens
catgccttaaattt

SEQ ID NO: 3290550 - DNA, 23 bp, Homo sapiens
catgcgctcagggccatgctgag

SEQ ID NO: 3290551 - DNA, 17 bp, Homo sapiens
catgcgtgtttctgact

SEQ ID NO: 3290552 - DNA, 16 bp, Homo sapiens
catgctatctctgtgt

SEQ ID NO: 3290553 - DNA, 18 bp, Homo sapiens
catgctattcacaattat

SEQ ID NO: 3290554 - DNA, 18 bp, Homo sapiens
catgctcatctgctggtc

SEQ ID NO: 3290555 - DNA, 19 bp, Homo sapiens
catgctcatctgctggtcc

SEQ ID NO: 3290556 - DNA, 20 bp, Homo sapiens
catgctcctcactgcccgca

SEQ ID NO: 3290557 - DNA, 20 bp, Homo sapiens
catgctctcatatatatttt

SEQ ID NO: 3290558 - DNA, 19 bp, Homo sapiens
catgctctgccccaagccc

SEQ ID NO: 3290559 - DNA, 15 bp, Homo sapiens
catgctgaaaaatat

SEQ ID NO: 3290560 - DNA, 15 bp, Homo sapiens
catgctgaggcctgg

SEQ ID NO: 3290561 - DNA, 14 bp, Homo sapiens
catgctgagtctcc

SEQ ID NO: 3290562 - DNA, 19 bp, Homo sapiens
catgctgagtctcccaagg

SEQ ID NO: 3290563 - DNA, 13 bp, Homo sapiens
catgctgcagtgg

SEQ ID NO: 3290564 - DNA, 15 bp, Homo sapiens
catgctgcagtgggt

SEQ ID NO: 3290565 - DNA, 12 bp, Homo sapiens
catgctgctttg

SEQ ID NO: 3290566 - DNA, 21 bp, Homo sapiens
catgctgctttttggcacagt

SEQ ID NO: 3290567 - DNA, 18 bp, Homo sapiens
catgctggagggaggctg

SEQ ID NO: 3290568 - DNA, 20 bp, Homo sapiens
catgctgggaagacgcctga

SEQ ID NO: 3290569 - DNA, 14 bp, Homo sapiens
catgctgggccact

SEQ ID NO: 3290570 - DNA, 19 bp, Homo sapiens
catgctgggccactgggga

SEQ ID NO: 3290571 - DNA, 16 bp, Homo sapiens
catgctggtcagagac

SEQ ID NO: 3290572 - DNA, 13 bp, Homo sapiens
catgcttaaattt

SEQ ID NO: 3290573 - DNA, 14 bp, Homo sapiens
catgcttaaatttt

SEQ ID NO: 3290574 - DNA, 12 bp, Homo sapiens
catgcttagctt

SEQ ID NO: 3290575 - DNA, 16 bp, Homo sapiens
catgcttcacaatgtt

SEQ ID NO: 3290576 - DNA, 16 bp, Homo sapiens
catgcttcccagaggg

SEQ ID NO: 3290577 - DNA, 21 bp, Homo sapiens
catgcttcccagagggagcag

SEQ ID NO: 3290578 - DNA, 15 bp, Homo sapiens
catgcttgggctgac

SEQ ID NO: 3290579 - DNA, 23 bp, Homo sapiens
catgcttgggctgacccagcatc

SEQ ID NO: 3290580 - DNA, 22 bp, Homo sapiens
catgctttgctgctatgaaaat

SEQ ID NO: 3290581 - DNA, 15 bp, Homo sapiens
catgcttttctgcca

SEQ ID NO: 3290582 - DNA, 17 bp, Homo sapiens
catgcttttctgccact

SEQ ID NO: 3290583 - DNA, 15 bp, Homo sapiens
catggaaaaatggtt

SEQ ID NO: 3290584 - DNA, 16 bp, Homo sapiens
catggaaaaatggttg

SEQ ID NO: 3290585 - DNA, 23 bp, Homo sapiens
catggaaaaatggttgatggaaa

SEQ ID NO: 3290586 - DNA, 18 bp, Homo sapiens
catggaaacctgaaaaaa

SEQ ID NO: 3290587 - DNA, 18 bp, Homo sapiens
catggacatgatcttctt

SEQ ID NO: 3290588 - DNA, 21 bp, Homo sapiens
catggacccaagataaaagaa

SEQ ID NO: 3290589 - DNA, 16 bp, Homo sapiens
catggacctaacattc

SEQ ID NO: 3290590 - DNA, 22 bp, Homo sapiens
catggacttgtatatttgtaca

SEQ ID NO: 3290591 - DNA, 16 bp, Homo sapiens
catggagacgcatttc

SEQ ID NO: 3290592 - DNA, 16 bp, Homo sapiens
catggagactcctgcc

SEQ ID NO: 3290593 - DNA, 19 bp, Homo sapiens
catggagactcctgccctg

SEQ ID NO: 3290594 - DNA, 20 bp, Homo sapiens
catggagactcctgccctgt

SEQ ID NO: 3290595 - DNA, 10 bp, Homo sapiens
catggagcca

SEQ ID NO: 3290596 - DNA, 15 bp, Homo sapiens
catggagccccctct

SEQ ID NO: 3290597 - DNA, 19 bp, Homo sapiens
catggagccccctctgccg

SEQ ID NO: 3290598 - DNA, 15 bp, Homo sapiens
catggagctgggcta

SEQ ID NO: 3290599 - DNA, 19 bp, Homo sapiens
catggaggaggagggaggc

SEQ ID NO: 3290600 - DNA, 18 bp, Homo sapiens
catggaggccctcctgtg

SEQ ID NO: 3290601 - DNA, 17 bp, Homo sapiens
catggaggttctaaggc

SEQ ID NO: 3290602 - DNA, 22 bp, Homo sapiens
catggagtgtgtattgttccca

SEQ ID NO: 3290603 - DNA, 18 bp, Homo sapiens
catggatatagttttact

SEQ ID NO: 3290604 - DNA, 22 bp, Homo sapiens
catggatgcatttcaaatgtta

SEQ ID NO: 3290605 - DNA, 17 bp, Homo sapiens
catggatgcgaggacca

SEQ ID NO: 3290606 - DNA, 20 bp, Homo sapiens
catggatgcgaggaccactt

SEQ ID NO: 3290607 - DNA, 23 bp, Homo sapiens
catggattttggataaatcattt

SEQ ID NO: 3290608 - DNA, 12 bp, Homo sapiens
catggcaccagc

SEQ ID NO: 3290609 - DNA, 23 bp, Homo sapiens
catggcaccttcagactttgctt

SEQ ID NO: 3290610 - DNA, 14 bp, Homo sapiens
catggcaggctggg

SEQ ID NO: 3290611 - DNA, 17 bp, Homo sapiens
catggcaggctgggtga

SEQ ID NO: 3290612 - DNA, 17 bp, Homo sapiens
catggcatagccccggc

SEQ ID NO: 3290613 - DNA, 22 bp, Homo sapiens
catggccacttgggtcttccct

SEQ ID NO: 3290614 - DNA, 20 bp, Homo sapiens
catggccccatcccagttgg

SEQ ID NO: 3290615 - DNA, 12 bp, Homo sapiens
catggcccccaa

SEQ ID NO: 3290616 - DNA, 19 bp, Homo sapiens
catggcccccaataaaggc

SEQ ID NO: 3290617 - DNA, 21 bp, Homo sapiens
catggcccccaataaaggcag

SEQ ID NO: 3290618 - DNA, 14 bp, Homo sapiens
catggcccccaggg

SEQ ID NO: 3290619 - DNA, 18 bp, Homo sapiens
catggcccccaggggcag

SEQ ID NO: 3290620 - DNA, 19 bp, Homo sapiens
catggcccccaggggcagg

SEQ ID NO: 3290621 - DNA, 14 bp, Homo sapiens
catggccctggggt

SEQ ID NO: 3290622 - DNA, 14 bp, Homo sapiens
catggccctgtgct

SEQ ID NO: 3290623 - DNA, 17 bp, Homo sapiens
catggcctatgcacata

SEQ ID NO: 3290624 - DNA, 21 bp, Homo sapiens
catggcctattatattaaaat

SEQ ID NO: 3290625 - DNA, 19 bp, Homo sapiens
catggccttatgaggcagg

SEQ ID NO: 3290626 - DNA, 13 bp, Homo sapiens
catggcctttcta

SEQ ID NO: 3290627 - DNA, 21 bp, Homo sapiens
catggcctttctaataaactg

SEQ ID NO: 3290628 - DNA, 18 bp, Homo sapiens
catggcgtaatgggcctg

SEQ ID NO: 3290629 - DNA, 20 bp, Homo sapiens
catggcgtggaggaggaggg

SEQ ID NO: 3290630 - DNA, 18 bp, Homo sapiens
catggctaatttaacacc

SEQ ID NO: 3290631 - DNA, 15 bp, Homo sapiens
catggctcagagctt

SEQ ID NO: 3290632 - DNA, 23 bp, Homo sapiens
cattttcttattgcgctgctacc

SEQ ID NO: 3290633 - DNA, 12 bp, Homo sapiens
cattttgaagtg

SEQ ID NO: 3290634 - DNA, 14 bp, Homo sapiens
cattttgacctact

SEQ ID NO: 3290635 - DNA, 12 bp, Homo sapiens
cattttgcaaaa

SEQ ID NO: 3290636 - DNA, 15 bp, Homo sapiens
cattttgcagcagtg

SEQ ID NO: 3290637 - DNA, 20 bp, Homo sapiens
cattttgcagcagtgagtct

SEQ ID NO: 3290638 - DNA, 21 bp, Homo sapiens
cattttggcgctattacaaat

SEQ ID NO: 3290639 - DNA, 23 bp, Homo sapiens
cattttggtaagagacagaatgt

SEQ ID NO: 3290640 - DNA, 18 bp, Homo sapiens
cattttggtttatttttg

SEQ ID NO: 3290641 - DNA, 19 bp, Homo sapiens
cattttggtttatttttgt

SEQ ID NO: 3290642 - DNA, 15 bp, Homo sapiens
cattttgtgaatgga

SEQ ID NO: 3290643 - DNA, 21 bp, Homo sapiens
cattttgtgaatggattggat

SEQ ID NO: 3290644 - DNA, 17 bp, Homo sapiens
cattttgttatagaata

SEQ ID NO: 3290645 - DNA, 15 bp, Homo sapiens
cattttgttgtaaaa

SEQ ID NO: 3290646 - DNA, 22 bp, Homo sapiens
catttttaatattactgtcttt

SEQ ID NO: 3290647 - DNA, 19 bp, Homo sapiens
catttttaatgatctcgga

SEQ ID NO: 3290648 - DNA, 15 bp, Homo sapiens
catttttacaataaa

SEQ ID NO: 3290649 - DNA, 13 bp, Homo sapiens
catttttcattca

SEQ ID NO: 3290650 - DNA, 17 bp, Homo sapiens
catttttgatttatgca

SEQ ID NO: 3290651 - DNA, 20 bp, Homo sapiens
catttttgtacagtttgctg

SEQ ID NO: 3290652 - DNA, 20 bp, Homo sapiens
catttttgtactaactagca

SEQ ID NO: 3290653 - DNA, 18 bp, Homo sapiens
cattttttaaggaaacaa

SEQ ID NO: 3290654 - DNA, 23 bp, Homo sapiens
cattttttaatttacttgttttg

SEQ ID NO: 3290655 - DNA, 21 bp, Homo sapiens
cattttttttatattgcctta

SEQ ID NO: 3290656 - DNA, 21 bp, Homo sapiens
catttttttttcaatcaactt

SEQ ID NO: 3290657 - DNA, 22 bp, Homo sapiens
catttttttttcaatcaacttt

SEQ ID NO: 3290658 - DNA, 13 bp, Homo sapiens
ccaaaaaaaaaag

SEQ ID NO: 3290659 - DNA, 20 bp, Homo sapiens
ccaaaaaattctacaacaca

SEQ ID NO: 3290660 - DNA, 19 bp, Homo sapiens
ccaaaaagattttcagaaa

SEQ ID NO: 3290661 - DNA, 18 bp, Homo sapiens
ccaaaacatttctggaca

SEQ ID NO: 3290662 - DNA, 16 bp, Homo sapiens
ccaaaagattgctgaa

SEQ ID NO: 3290663 - DNA, 14 bp, Homo sapiens
ccaaaagcacttac

SEQ ID NO: 3290664 - DNA, 17 bp, Homo sapiens
ccaaaataccagagcct

SEQ ID NO: 3290665 - DNA, 23 bp, Homo sapiens
ccaaaatgtaggcttagtttgtg

SEQ ID NO: 3290666 - DNA, 21 bp, Homo sapiens
ccaaaatgttggtcattttat

SEQ ID NO: 3290667 - DNA, 14 bp, Homo sapiens
ccaaacaagcctta

SEQ ID NO: 3290668 - DNA, 19 bp, Homo sapiens
ccaaacaccttccagctcc

SEQ ID NO: 3290669 - DNA, 13 bp, Homo sapiens
ccaaacatcagac

SEQ ID NO: 3290670 - DNA, 15 bp, Homo sapiens
ccaaacatcagacct

SEQ ID NO: 3290671 - DNA, 13 bp, Homo sapiens
ccaaaccagcctt

SEQ ID NO: 3290672 - DNA, 12 bp, Homo sapiens
ccaaaccataaa

SEQ ID NO: 3290673 - DNA, 15 bp, Homo sapiens
ccaaacccagaaaga

SEQ ID NO: 3290674 - DNA, 13 bp, Homo sapiens
ccaaaccctaggt

SEQ ID NO: 3290675 - DNA, 14 bp, Homo sapiens
ccaaaccctcacaa

SEQ ID NO: 3290676 - DNA, 18 bp, Homo sapiens
ccaaacccttaactgaca

SEQ ID NO: 3290677 - DNA, 19 bp, Homo sapiens
ccaaacccttaactgacat

SEQ ID NO: 3290678 - DNA, 18 bp, Homo sapiens
ccaaacctacaagaacta

SEQ ID NO: 3290679 - DNA, 15 bp, Homo sapiens
ccaaacctgacagat

SEQ ID NO: 3290680 - DNA, 14 bp, Homo sapiens
ccaaacctgggacc

SEQ ID NO: 3290681 - DNA, 13 bp, Homo sapiens
ccaaacctggttc

SEQ ID NO: 3290682 - DNA, 13 bp, Homo sapiens
ccaaacctgtctt

SEQ ID NO: 3290683 - DNA, 22 bp, Homo sapiens
ccaaacgccctttcctcctcag

SEQ ID NO: 3290684 - DNA, 21 bp, Homo sapiens
ccaaactgttctgagaaggtg

SEQ ID NO: 3290685 - DNA, 18 bp, Homo sapiens
ccaaacttggatttttga

SEQ ID NO: 3290686 - DNA, 16 bp, Homo sapiens
ccaaacttgttcattt

SEQ ID NO: 3290687 - DNA, 18 bp, Homo sapiens
ccaaagaaacaagctgtg

SEQ ID NO: 3290688 - DNA, 12 bp, Homo sapiens
ccaaagaaagtt

SEQ ID NO: 3290689 - DNA, 17 bp, Homo sapiens
ccaaagaaatgaacatt

SEQ ID NO: 3290690 - DNA, 19 bp, Homo sapiens
ccaaagactgtactggcca

SEQ ID NO: 3290691 - DNA, 17 bp, Homo sapiens
ccaaagaggctgcccct

SEQ ID NO: 3290692 - DNA, 20 bp, Homo sapiens
ccaaagaggctgcccctctc

SEQ ID NO: 3290693 - DNA, 16 bp, Homo sapiens
ccaaagagggcttcct

SEQ ID NO: 3290694 - DNA, 17 bp, Homo sapiens
ccaaagagggcttcctc

SEQ ID NO: 3290695 - DNA, 15 bp, Homo sapiens
ccaaagataaggact

SEQ ID NO: 3290696 - DNA, 16 bp, Homo sapiens
ccaaagatgcagccgc

SEQ ID NO: 3290697 - DNA, 18 bp, Homo sapiens
ccaaagatgcagccgcct

SEQ ID NO: 3290698 - DNA, 23 bp, Homo sapiens
ccaaagcaatgtgagtcccagag

SEQ ID NO: 3290699 - DNA, 22 bp, Homo sapiens
ccaaagcacatgcttagcttat

SEQ ID NO: 3290700 - DNA, 20 bp, Homo sapiens
ccaaagccacctctgtcatt

SEQ ID NO: 3290701 - DNA, 13 bp, Homo sapiens
ccaaagccagtga

SEQ ID NO: 3290702 - DNA, 23 bp, Homo sapiens
ccaaagccccttgctctcccctg

SEQ ID NO: 3290703 - DNA, 13 bp, Homo sapiens
ccaaagccctggt

SEQ ID NO: 3290704 - DNA, 16 bp, Homo sapiens
ccaaagctaggcctgg

SEQ ID NO: 3290705 - DNA, 18 bp, Homo sapiens
ccaaagctagggtggccc

SEQ ID NO: 3290706 - DNA, 19 bp, Homo sapiens
ccaaagctagggtggccct

SEQ ID NO: 3290707 - DNA, 14 bp, Homo sapiens
ccaaaggaaggaac

SEQ ID NO: 3290708 - DNA, 20 bp, Homo sapiens
ccaaaggaataacctttctg

SEQ ID NO: 3290709 - DNA, 16 bp, Homo sapiens
ccaaaggaggctggca

SEQ ID NO: 3290710 - DNA, 18 bp, Homo sapiens
ccaaaggaggctggcagg

SEQ ID NO: 3290711 - DNA, 19 bp, Homo sapiens
ccaaaggatgtgatatata

SEQ ID NO: 3290712 - DNA, 21 bp, Homo sapiens
ccaaaggctggtggcaagtgc

SEQ ID NO: 3290713 - DNA, 15 bp, Homo sapiens
ccaaaggggctgctg

SEQ ID NO: 3290714 - DNA, 21 bp, Homo sapiens
ccaaagggtgaagctatttat

SEQ ID NO: 3290715 - DNA, 13 bp, Homo sapiens
ccaaagtattttt

SEQ ID NO: 3290716 - DNA, 14 bp, Homo sapiens
ccaaagtctccctt

SEQ ID NO: 3290717 - DNA, 15 bp, Homo sapiens
ccaaagtctctaatt

SEQ ID NO: 3290718 - DNA, 15 bp, Homo sapiens
ccaaagtgctgagat

SEQ ID NO: 3290719 - DNA, 12 bp, Homo sapiens
ccaaagttctaa

SEQ ID NO: 3290720 - DNA, 23 bp, Homo sapiens
ccaaagttgttgtaacctgctgt

SEQ ID NO: 3290721 - DNA, 11 bp, Homo sapiens
ccaaataaaaa

SEQ ID NO: 3290722 - DNA, 16 bp, Homo sapiens
ccaaataaaaactaaa

SEQ ID NO: 3290723 - DNA, 12 bp, Homo sapiens
ccaaataaacag

SEQ ID NO: 3290724 - DNA, 14 bp, Homo sapiens
ccaaataaacagct

SEQ ID NO: 3290725 - DNA, 18 bp, Homo sapiens
ccaaataacttcagtcct

SEQ ID NO: 3290726 - DNA, 17 bp, Homo sapiens
ccaaataagaaacctaa

SEQ ID NO: 3290727 - DNA, 13 bp, Homo sapiens
ccaaataataaag

SEQ ID NO: 3290728 - DNA, 16 bp, Homo sapiens
ccaaatacacatttca

SEQ ID NO: 3290729 - DNA, 17 bp, Homo sapiens
ccaaatacacatttcac

SEQ ID NO: 3290730 - DNA, 20 bp, Homo sapiens
ccaaatacacatttcacatt

SEQ ID NO: 3290731 - DNA, 13 bp, Homo sapiens
ccaaatatgtcct

SEQ ID NO: 3290732 - DNA, 15 bp, Homo sapiens
ccaaatatgtcctgg

SEQ ID NO: 3290733 - DNA, 20 bp, Homo sapiens
ccaaatcaataagaaggtag

SEQ ID NO: 3290734 - DNA, 15 bp, Homo sapiens
ccaaatcagctgcta

SEQ ID NO: 3290735 - DNA, 20 bp, Homo sapiens
ccaaatctcttgcttgtcat

SEQ ID NO: 3290736 - DNA, 14 bp, Homo sapiens
ccaaatctggaagc

SEQ ID NO: 3290737 - DNA, 19 bp, Homo sapiens
ccaaatcttgaatttctgc

SEQ ID NO: 3290738 - DNA, 17 bp, Homo sapiens
ccaaatgcacaagctca

SEQ ID NO: 3290739 - DNA, 21 bp, Homo sapiens
ccaaatgcagggaggggaggc

SEQ ID NO: 3290740 - DNA, 23 bp, Homo sapiens
ccaaatggttcttacttttcctg

SEQ ID NO: 3290741 - DNA, 13 bp, Homo sapiens
ccaaattagccag

SEQ ID NO: 3290742 - DNA, 12 bp, Homo sapiens
ccaaattatttg

SEQ ID NO: 3290743 - DNA, 13 bp, Homo sapiens
ccaaattcagttt

SEQ ID NO: 3290744 - DNA, 15 bp, Homo sapiens
ccaaattctttcagt

SEQ ID NO: 3290745 - DNA, 16 bp, Homo sapiens
ccaaattgcactgaag

SEQ ID NO: 3290746 - DNA, 11 bp, Homo sapiens
ccaaatttaaa

SEQ ID NO: 3290747 - DNA, 18 bp, Homo sapiens
ccaaatttaaaactgttg

SEQ ID NO: 3290748 - DNA, 20 bp, Homo sapiens
ccaaatttgattgatttgaa

SEQ ID NO: 3290749 - DNA, 21 bp, Homo sapiens
ccaaatttggctcacttgcct

SEQ ID NO: 3290750 - DNA, 23 bp, Homo sapiens
ccaaattttaatttttgctttta

SEQ ID NO: 3290751 - DNA, 13 bp, Homo sapiens
ccaacaaaccatc

SEQ ID NO: 3290752 - DNA, 22 bp, Homo sapiens
ccaacaaggttggcaccccagc

SEQ ID NO: 3290753 - DNA, 16 bp, Homo sapiens
ccaacaataaacagga

SEQ ID NO: 3290754 - DNA, 22 bp, Homo sapiens
ccaacaataaacaggaatttta

SEQ ID NO: 3290755 - DNA, 14 bp, Homo sapiens
ccaacacacacaac

SEQ ID NO: 3290756 - DNA, 15 bp, Homo sapiens
ccaacaccacagaca

SEQ ID NO: 3290757 - DNA, 18 bp, Homo sapiens
ccaacaccacagacacac

SEQ ID NO: 3290758 - DNA, 15 bp, Homo sapiens
ccacaatcccaccta

SEQ ID NO: 3290759 - DNA, 13 bp, Homo sapiens
ccacaatctggct

SEQ ID NO: 3290760 - DNA, 20 bp, Homo sapiens
ccacacaaagattttctaag

SEQ ID NO: 3290761 - DNA, 13 bp, Homo sapiens
ccacacagtcccc

SEQ ID NO: 3290762 - DNA, 19 bp, Homo sapiens
ccacacagtccccagactc

SEQ ID NO: 3290763 - DNA, 21 bp, Homo sapiens
ccacacagtccccagactcag

SEQ ID NO: 3290764 - DNA, 12 bp, Homo sapiens
ccacacccagcc

SEQ ID NO: 3290765 - DNA, 13 bp, Homo sapiens
ccacacccagccc

SEQ ID NO: 3290766 - DNA, 14 bp, Homo sapiens
ccacacccagcctc

SEQ ID NO: 3290767 - DNA, 17 bp, Homo sapiens
ccacacccagcctcagt

SEQ ID NO: 3290768 - DNA, 16 bp, Homo sapiens
ccacacccagctcagc

SEQ ID NO: 3290769 - DNA, 16 bp, Homo sapiens
ccacaccccagcccac

SEQ ID NO: 3290770 - DNA, 11 bp, Homo sapiens
ccacaccctcc

SEQ ID NO: 3290771 - DNA, 18 bp, Homo sapiens
ccacaccgcagggacaag

SEQ ID NO: 3290772 - DNA, 16 bp, Homo sapiens
ccacaccgtcttcctt

SEQ ID NO: 3290773 - DNA, 17 bp, Homo sapiens
ccacaccgtcttccttc

SEQ ID NO: 3290774 - DNA, 17 bp, Homo sapiens
ccacacctccacagttc

SEQ ID NO: 3290775 - DNA, 23 bp, Homo sapiens
ccacacctccacagttcagtggc

SEQ ID NO: 3290776 - DNA, 13 bp, Homo sapiens
ccacacctccacc

SEQ ID NO: 3290777 - DNA, 14 bp, Homo sapiens
ccacacctccaccg

SEQ ID NO: 3290778 - DNA, 14 bp, Homo sapiens
ccacacctccctac

SEQ ID NO: 3290779 - DNA, 15 bp, Homo sapiens
ccacacctccctact

SEQ ID NO: 3290780 - DNA, 14 bp, Homo sapiens
ccacacctggcctt

SEQ ID NO: 3290781 - DNA, 16 bp, Homo sapiens
ccacaccttccagggc

SEQ ID NO: 3290782 - DNA, 22 bp, Homo sapiens
ccacaccttccagggccctagg

SEQ ID NO: 3290783 - DNA, 18 bp, Homo sapiens
ccacacgattagctttat

SEQ ID NO: 3290784 - DNA, 23 bp, Homo sapiens
ccacacggactcccgggccacgc

SEQ ID NO: 3290785 - DNA, 15 bp, Homo sapiens
ccacactacacagca

SEQ ID NO: 3290786 - DNA, 17 bp, Homo sapiens
ccacactatgcacagag

SEQ ID NO: 3290787 - DNA, 20 bp, Homo sapiens
ccacactatgcacagagccc

SEQ ID NO: 3290788 - DNA, 21 bp, Homo sapiens
ccacactatgcacagagccca

SEQ ID NO: 3290789 - DNA, 16 bp, Homo sapiens
ccacacttcaggctct

SEQ ID NO: 3290790 - DNA, 20 bp, Homo sapiens
ccacacttcaggctcttctc

SEQ ID NO: 3290791 - DNA, 22 bp, Homo sapiens
ccacacttcaggctcttctcct

SEQ ID NO: 3290792 - DNA, 16 bp, Homo sapiens
ccacacttgaaacctt

SEQ ID NO: 3290793 - DNA, 13 bp, Homo sapiens
ccacacttgctgg

SEQ ID NO: 3290794 - DNA, 17 bp, Homo sapiens
ccacacttgctggggct

SEQ ID NO: 3290795 - DNA, 21 bp, Homo sapiens
ccacacttgttccagctcttt

SEQ ID NO: 3290796 - DNA, 22 bp, Homo sapiens
ccacactttgggacttgggagc

SEQ ID NO: 3290797 - DNA, 20 bp, Homo sapiens
ccacagaagacttcccagct

SEQ ID NO: 3290798 - DNA, 15 bp, Homo sapiens
ccacagacacacaca

SEQ ID NO: 3290799 - DNA, 19 bp, Homo sapiens
ccacagactccggcctgta

SEQ ID NO: 3290800 - DNA, 16 bp, Homo sapiens
ccacagactggttttg

SEQ ID NO: 3290801 - DNA, 17 bp, Homo sapiens
ccacagagtgctggact

SEQ ID NO: 3290802 - DNA, 22 bp, Homo sapiens
ccacagataccagacctcttct

SEQ ID NO: 3290803 - DNA, 14 bp, Homo sapiens
ccacagatatcttt

SEQ ID NO: 3290804 - DNA, 20 bp, Homo sapiens
ccacagcacagctccctgcc

SEQ ID NO: 3290805 - DNA, 15 bp, Homo sapiens
ccacagccagcacct

SEQ ID NO: 3290806 - DNA, 17 bp, Homo sapiens
ccacagccagcacctgg

SEQ ID NO: 3290807 - DNA, 16 bp, Homo sapiens
ccacagcctctggctc

SEQ ID NO: 3290808 - DNA, 17 bp, Homo sapiens
ccacagcctctggctcc

SEQ ID NO: 3290809 - DNA, 19 bp, Homo sapiens
ccacagcctctggctccac

SEQ ID NO: 3290810 - DNA, 19 bp, Homo sapiens
ccacagccttcggacagac

SEQ ID NO: 3290811 - DNA, 15 bp, Homo sapiens
ccacagcgagggcag

SEQ ID NO: 3290812 - DNA, 18 bp, Homo sapiens
ccacagcgagggcagctg

SEQ ID NO: 3290813 - DNA, 20 bp, Homo sapiens
ccacagcgagggcagctgct

SEQ ID NO: 3290814 - DNA, 12 bp, Homo sapiens
ccacagcgtccc

SEQ ID NO: 3290815 - DNA, 16 bp, Homo sapiens
ccacagcgtccctggc

SEQ ID NO: 3290816 - DNA, 21 bp, Homo sapiens
ccacagcgtccctggcgcagg

SEQ ID NO: 3290817 - DNA, 16 bp, Homo sapiens
ccacagctgagaatgt

SEQ ID NO: 3290818 - DNA, 13 bp, Homo sapiens
ccacagcttttgc

SEQ ID NO: 3290819 - DNA, 15 bp, Homo sapiens
ccacagcttttgcaa

SEQ ID NO: 3290820 - DNA, 23 bp, Homo sapiens
ccacaggaagcctgcagtcctgg

SEQ ID NO: 3290821 - DNA, 22 bp, Homo sapiens
ccacaggaggcaagcaagctct

SEQ ID NO: 3290822 - DNA, 20 bp, Homo sapiens
ccacaggagtgggaaaacac

SEQ ID NO: 3290823 - DNA, 17 bp, Homo sapiens
ccacaggcaaaactcag

SEQ ID NO: 3290824 - DNA, 19 bp, Homo sapiens
ccacaggcacacaggtctc

SEQ ID NO: 3290825 - DNA, 15 bp, Homo sapiens
ccacaggcccttcct

SEQ ID NO: 3290826 - DNA, 19 bp, Homo sapiens
ccacaggcccttcctctcc

SEQ ID NO: 3290827 - DNA, 15 bp, Homo sapiens
ccacaggcctccctg

SEQ ID NO: 3290828 - DNA, 16 bp, Homo sapiens
ccacaggcctccctgt

SEQ ID NO: 3290829 - DNA, 18 bp, Homo sapiens
ccacaggcctccctgttt

SEQ ID NO: 3290830 - DNA, 16 bp, Homo sapiens
ccacaggctagatccc

SEQ ID NO: 3290831 - DNA, 12 bp, Homo sapiens
ccacagggccag

SEQ ID NO: 3290832 - DNA, 20 bp, Homo sapiens
ccacagggccagagggagct

SEQ ID NO: 3290833 - DNA, 17 bp, Homo sapiens
ccacaggggcaggcctg

SEQ ID NO: 3290834 - DNA, 19 bp, Homo sapiens
ccacaggttttagcattgt

SEQ ID NO: 3290835 - DNA, 14 bp, Homo sapiens
ccacagtcaaagaa

SEQ ID NO: 3290836 - DNA, 16 bp, Homo sapiens
ccacagtcaaagaagg

SEQ ID NO: 3290837 - DNA, 14 bp, Homo sapiens
ccacagtgaaagtt

SEQ ID NO: 3290838 - DNA, 14 bp, Homo sapiens
ccacagtgctgctt

SEQ ID NO: 3290839 - DNA, 14 bp, Homo sapiens
ccacagtgggtggc

SEQ ID NO: 3290840 - DNA, 19 bp, Homo sapiens
ccacagtgggtggcacctc

SEQ ID NO: 3290841 - DNA, 22 bp, Homo sapiens
ccacagtgggtggcacctcctg

SEQ ID NO: 3290842 - DNA, 15 bp, Homo sapiens
ccacagttcagtggc

SEQ ID NO: 3290843 - DNA, 16 bp, Homo sapiens
ccacagttgccaccac

SEQ ID NO: 3290844 - DNA, 23 bp, Homo sapiens
ccacagttgccaccacctctgtg

SEQ ID NO: 3290845 - DNA, 21 bp, Homo sapiens
ccacagttgtgttcatgctga

SEQ ID NO: 3290846 - DNA, 24 bp, Homo sapiens
ccacagttttagttggtgctgatg

SEQ ID NO: 3290847 - DNA, 14 bp, Homo sapiens
ccacatcaaacctt

SEQ ID NO: 3290848 - DNA, 18 bp, Homo sapiens
ccacatccaactccagca

SEQ ID NO: 3290849 - DNA, 12 bp, Homo sapiens
ccacatcccagc

SEQ ID NO: 3290850 - DNA, 14 bp, Homo sapiens
ccacatcccagcag

SEQ ID NO: 3290851 - DNA, 19 bp, Homo sapiens
ccacatcctccgtccagcc

SEQ ID NO: 3290852 - DNA, 16 bp, Homo sapiens
ccacatctgccagacc

SEQ ID NO: 3290853 - DNA, 23 bp, Homo sapiens
ccacatctgccttaaaaccaaag

SEQ ID NO: 3290854 - DNA, 19 bp, Homo sapiens
ccacatcttgctctgctga

SEQ ID NO: 3290855 - DNA, 19 bp, Homo sapiens
ccacatgtgacacatatgc

SEQ ID NO: 3290856 - DNA, 18 bp, Homo sapiens
ccacatttctgatcagag

SEQ ID NO: 3290857 - DNA, 20 bp, Homo sapiens
ccacatttctgatcagaggt

SEQ ID NO: 3290858 - DNA, 16 bp, Homo sapiens
ccaccaaactgcacac

SEQ ID NO: 3290859 - DNA, 24 bp, Homo sapiens
ccaccaaactgcacacacagctcc

SEQ ID NO: 3290860 - DNA, 13 bp, Homo sapiens
ccaccaaagctgc

SEQ ID NO: 3290861 - DNA, 14 bp, Homo sapiens
ccaccaaagctgcc

SEQ ID NO: 3290862 - DNA, 14 bp, Homo sapiens
ccaccacacccagc

SEQ ID NO: 3290863 - DNA, 21 bp, Homo sapiens
ccaccacagccagcacctggc

SEQ ID NO: 3290864 - DNA, 13 bp, Homo sapiens
ccaccacaggcat

SEQ ID NO: 3290865 - DNA, 13 bp, Homo sapiens
ccaccacccaacc

SEQ ID NO: 3290866 - DNA, 14 bp, Homo sapiens
ccaccaccctgccc

SEQ ID NO: 3290867 - DNA, 15 bp, Homo sapiens
ccaccacctctgtgg

SEQ ID NO: 3290868 - DNA, 14 bp, Homo sapiens
ccaccacgtctgcc

SEQ ID NO: 3290869 - DNA, 16 bp, Homo sapiens
ccaccacgtctgccag

SEQ ID NO: 3290870 - DNA, 17 bp, Homo sapiens
ccaccacgtctgccagg

SEQ ID NO: 3290871 - DNA, 15 bp, Homo sapiens
ccaccactggccacc

SEQ ID NO: 3290872 - DNA, 19 bp, Homo sapiens
ccaccactggccaccaggc

SEQ ID NO: 3290873 - DNA, 21 bp, Homo sapiens
ccaccactggccaccaggctg

SEQ ID NO: 3290874 - DNA, 15 bp, Homo sapiens
ccaccacttcagggg

SEQ ID NO: 3290875 - DNA, 22 bp, Homo sapiens
ccaccagagaccgtcctcaccc

SEQ ID NO: 3290876 - DNA, 18 bp, Homo sapiens
ccaccagatagcagaggg

SEQ ID NO: 3290877 - DNA, 15 bp, Homo sapiens
ccaccagatgctgaa

SEQ ID NO: 3290878 - DNA, 12 bp, Homo sapiens
ccaccagcagca

SEQ ID NO: 3290879 - DNA, 19 bp, Homo sapiens
ccaccagcccgcaactctc

SEQ ID NO: 3290880 - DNA, 20 bp, Homo sapiens
ccaccagccgccccagcccc

SEQ ID NO: 3290881 - DNA, 12 bp, Homo sapiens
ccaccaggctgg

SEQ ID NO: 3290882 - DNA, 19 bp, Homo sapiens
ccaccaggctggcgcagcc

SEQ ID NO: 3290883 - DNA, 12 bp, Homo sapiens
ccaccagtgcct

SEQ ID NO: 3290884 - DNA, 13 bp, Homo sapiens
ccaccagtgcctt

SEQ ID NO: 3290885 - DNA, 19 bp, Homo sapiens
ccagagagaggatgtggaa

SEQ ID NO: 3290886 - DNA, 20 bp, Homo sapiens
ccagagagcaactctgagat

SEQ ID NO: 3290887 - DNA, 14 bp, Homo sapiens
ccagagaggagcac

SEQ ID NO: 3290888 - DNA, 19 bp, Homo sapiens
ccagagagggcccagctgt

SEQ ID NO: 3290889 - DNA, 13 bp, Homo sapiens
ccagagagggtgg

SEQ ID NO: 3290890 - DNA, 21 bp, Homo sapiens
ccagagagggtggtgacctct

SEQ ID NO: 3290891 - DNA, 16 bp, Homo sapiens
ccagagagtggctcct

SEQ ID NO: 3290892 - DNA, 14 bp, Homo sapiens
ccagagatgcaata

SEQ ID NO: 3290893 - DNA, 15 bp, Homo sapiens
ccagagcaacctctc

SEQ ID NO: 3290894 - DNA, 16 bp, Homo sapiens
ccagagcaacctctca

SEQ ID NO: 3290895 - DNA, 19 bp, Homo sapiens
ccagagcaacctctcactc

SEQ ID NO: 3290896 - DNA, 22 bp, Homo sapiens
ccagagcacccccaagcctggg

SEQ ID NO: 3290897 - DNA, 16 bp, Homo sapiens
ccagagcagatgcaga

SEQ ID NO: 3290898 - DNA, 23 bp, Homo sapiens
ccagagcagatgcagagagccat

SEQ ID NO: 3290899 - DNA, 14 bp, Homo sapiens
ccagagcagggtgt

SEQ ID NO: 3290900 - DNA, 15 bp, Homo sapiens
ccagagccacctgga

SEQ ID NO: 3290901 - DNA, 16 bp, Homo sapiens
ccagagccagatgcag

SEQ ID NO: 3290902 - DNA, 19 bp, Homo sapiens
ccagagccagatgcaggac

SEQ ID NO: 3290903 - DNA, 21 bp, Homo sapiens
ccagagccagatgcaggacag

SEQ ID NO: 3290904 - DNA, 12 bp, Homo sapiens
ccagagccagcc

SEQ ID NO: 3290905 - DNA, 15 bp, Homo sapiens
ccagagccagcctgg

SEQ ID NO: 3290906 - DNA, 17 bp, Homo sapiens
ccagagccagcctggga

SEQ ID NO: 3290907 - DNA, 21 bp, Homo sapiens
ccagagcccctcctccagccc

SEQ ID NO: 3290908 - DNA, 18 bp, Homo sapiens
ccagagcccttcactgcc

SEQ ID NO: 3290909 - DNA, 20 bp, Homo sapiens
ccagagcccttcactgccat

SEQ ID NO: 3290910 - DNA, 21 bp, Homo sapiens
ccagagcctggctgcccatca

SEQ ID NO: 3290911 - DNA, 17 bp, Homo sapiens
ccagagccttcaagtgc

SEQ ID NO: 3290912 - DNA, 18 bp, Homo sapiens
ccagagccttcaagtgcc

SEQ ID NO: 3290913 - DNA, 12 bp, Homo sapiens
ccagagctagtt

SEQ ID NO: 3290914 - DNA, 23 bp, Homo sapiens
ccagagctgccgacttggagact

SEQ ID NO: 3290915 - DNA, 12 bp, Homo sapiens
ccagagctggaa

SEQ ID NO: 3290916 - DNA, 18 bp, Homo sapiens
ccagagctggaaggcagg

SEQ ID NO: 3290917 - DNA, 19 bp, Homo sapiens
ccagagctggaaggcaggg

SEQ ID NO: 3290918 - DNA, 14 bp, Homo sapiens
ccagagctgggagg

SEQ ID NO: 3290919 - DNA, 23 bp, Homo sapiens
ccagagctgtctgaactcacgtg

SEQ ID NO: 3290920 - DNA, 17 bp, Homo sapiens
ccagagctgtgccagca

SEQ ID NO: 3290921 - DNA, 20 bp, Homo sapiens
ccagagctgtttatggcctc

SEQ ID NO: 3290922 - DNA, 21 bp, Homo sapiens
ccagagctgtttatggcctca

SEQ ID NO: 3290923 - DNA, 22 bp, Homo sapiens
ccagagctgtttatggcctcag

SEQ ID NO: 3290924 - DNA, 23 bp, Homo sapiens
ccagagctgtttatggcctcagc

SEQ ID NO: 3290925 - DNA, 14 bp, Homo sapiens
ccagagcttggaga

SEQ ID NO: 3290926 - DNA, 20 bp, Homo sapiens
ccagaggaactgtccagaga

SEQ ID NO: 3290927 - DNA, 21 bp, Homo sapiens
ccagaggaactgtccagagag

SEQ ID NO: 3290928 - DNA, 22 bp, Homo sapiens
ccagaggaactgtccagagagc

SEQ ID NO: 3290929 - DNA, 17 bp, Homo sapiens
ccagaggaaggaaaagg

SEQ ID NO: 3290930 - DNA, 15 bp, Homo sapiens
ccagaggactcccaa

SEQ ID NO: 3290931 - DNA, 21 bp, Homo sapiens
ccagaggagccaccagttctc

SEQ ID NO: 3290932 - DNA, 16 bp, Homo sapiens
ccagaggcagagcctg

SEQ ID NO: 3290933 - DNA, 15 bp, Homo sapiens
ccagaggcccccagc

SEQ ID NO: 3290934 - DNA, 14 bp, Homo sapiens
ccagaggccctgga

SEQ ID NO: 3290935 - DNA, 20 bp, Homo sapiens
ccagaggccgaaggtgcctc

SEQ ID NO: 3290936 - DNA, 23 bp, Homo sapiens
ccagaggccgaaggtgcctcaga

SEQ ID NO: 3290937 - DNA, 15 bp, Homo sapiens
ccagaggctgggttc

SEQ ID NO: 3290938 - DNA, 16 bp, Homo sapiens
ccagaggctgggttca

SEQ ID NO: 3290939 - DNA, 16 bp, Homo sapiens
ccagagggagtgacag

SEQ ID NO: 3290940 - DNA, 17 bp, Homo sapiens
ccagagggagtgacaga

SEQ ID NO: 3290941 - DNA, 20 bp, Homo sapiens
ccagagggagtgacagaggc

SEQ ID NO: 3290942 - DNA, 21 bp, Homo sapiens
ccagagggagtgacagaggca

SEQ ID NO: 3290943 - DNA, 15 bp, Homo sapiens
ccagagggcccaggc

SEQ ID NO: 3290944 - DNA, 18 bp, Homo sapiens
ccagagggcccaggcagg

SEQ ID NO: 3290945 - DNA, 17 bp, Homo sapiens
ccagagggtagggcaca

SEQ ID NO: 3290946 - DNA, 18 bp, Homo sapiens
ccagaggtaacagaacag

SEQ ID NO: 3290947 - DNA, 19 bp, Homo sapiens
ccagaggtaacagaacagc

SEQ ID NO: 3290948 - DNA, 21 bp, Homo sapiens
ccagaggtaacagaacagctt

SEQ ID NO: 3290949 - DNA, 16 bp, Homo sapiens
ccagaggtccagccca

SEQ ID NO: 3290950 - DNA, 21 bp, Homo sapiens
ccagaggtgggatcctccctc

SEQ ID NO: 3290951 - DNA, 15 bp, Homo sapiens
ccagaggtgggcagg

SEQ ID NO: 3290952 - DNA, 17 bp, Homo sapiens
ccagaggtgggcaggtg

SEQ ID NO: 3290953 - DNA, 18 bp, Homo sapiens
ccagaggtgggcaggtgg

SEQ ID NO: 3290954 - DNA, 20 bp, Homo sapiens
ccagaggttatctgcctggc

SEQ ID NO: 3290955 - DNA, 21 bp, Homo sapiens
ccagaggttatctgcctggcc

SEQ ID NO: 3290956 - DNA, 13 bp, Homo sapiens
ccagagtctgagc

SEQ ID NO: 3290957 - DNA, 19 bp, Homo sapiens
ccagagtgaaagggctatg

SEQ ID NO: 3290958 - DNA, 21 bp, Homo sapiens
ccagagtggagtctgagtctg

SEQ ID NO: 3290959 - DNA, 14 bp, Homo sapiens
ccagagtggcctgg

SEQ ID NO: 3290960 - DNA, 15 bp, Homo sapiens
ccagagtggcctggc

SEQ ID NO: 3290961 - DNA, 18 bp, Homo sapiens
ccagagtggcctggccag

SEQ ID NO: 3290962 - DNA, 19 bp, Homo sapiens
ccagagtggcctggccagg

SEQ ID NO: 3290963 - DNA, 23 bp, Homo sapiens
ccagagtggcctggccaggagct

SEQ ID NO: 3290964 - DNA, 22 bp, Homo sapiens
ccagataaaatgttcagtgcaa

SEQ ID NO: 3290965 - DNA, 20 bp, Homo sapiens
ccagataccagcccctgtat

SEQ ID NO: 3290966 - DNA, 14 bp, Homo sapiens
ccagatagagctgg

SEQ ID NO: 3290967 - DNA, 18 bp, Homo sapiens
ccagatcaccagcccggc

SEQ ID NO: 3290968 - DNA, 13 bp, Homo sapiens
ccagatcagtcag

SEQ ID NO: 3290969 - DNA, 18 bp, Homo sapiens
ccagatccagtatcttgt

SEQ ID NO: 3290970 - DNA, 12 bp, Homo sapiens
ccagatcctggg

SEQ ID NO: 3290971 - DNA, 13 bp, Homo sapiens
ccagatcctgggt

SEQ ID NO: 3290972 - DNA, 12 bp, Homo sapiens
ccagatctccca

SEQ ID NO: 3290973 - DNA, 13 bp, Homo sapiens
ccagatctgcctg

SEQ ID NO: 3290974 - DNA, 21 bp, Homo sapiens
ccagatctgcctgggcctgtg

SEQ ID NO: 3290975 - DNA, 19 bp, Homo sapiens
ccagatctggtcccttgca

SEQ ID NO: 3290976 - DNA, 17 bp, Homo sapiens
ccagatgcaacctcact

SEQ ID NO: 3290977 - DNA, 15 bp, Homo sapiens
ccagatgcaggacag

SEQ ID NO: 3290978 - DNA, 16 bp, Homo sapiens
ccagatgcaggacagg

SEQ ID NO: 3290979 - DNA, 20 bp, Homo sapiens
ccagatgcaggacaggaggc

SEQ ID NO: 3290980 - DNA, 17 bp, Homo sapiens
ccagatggcccctccac

SEQ ID NO: 3290981 - DNA, 23 bp, Homo sapiens
ccagatggcccggatgctgcttc

SEQ ID NO: 3290982 - DNA, 21 bp, Homo sapiens
ccagatggcctgaagcaactg

SEQ ID NO: 3290983 - DNA, 23 bp, Homo sapiens
ccagatgtttccagacttccttg

SEQ ID NO: 3290984 - DNA, 22 bp, Homo sapiens
ccagattacaggaatgaagaac

SEQ ID NO: 3290985 - DNA, 15 bp, Homo sapiens
ccagattctcttgaa

SEQ ID NO: 3290986 - DNA, 13 bp, Homo sapiens
ccagattgacgac

SEQ ID NO: 3290987 - DNA, 18 bp, Homo sapiens
ccagattgcaacaggctg

SEQ ID NO: 3290988 - DNA, 19 bp, Homo sapiens
ccagattgcaacaggctgg

SEQ ID NO: 3290989 - DNA, 20 bp, Homo sapiens
ccagattgcaacaggctggg

SEQ ID NO: 3290990 - DNA, 23 bp, Homo sapiens
ccagatttggggtataggtctca

SEQ ID NO: 3290991 - DNA, 12 bp, Homo sapiens
ccagatttgtct

SEQ ID NO: 3290992 - DNA, 23 bp, Homo sapiens
ccagatttgtctttttgttgtaa

SEQ ID NO: 3290993 - DNA, 14 bp, Homo sapiens
ccagattttattta

SEQ ID NO: 3290994 - DNA, 23 bp, Homo sapiens
ccagattttatttatatctttat

SEQ ID NO: 3290995 - DNA, 18 bp, Homo sapiens
ccagatttttcggaggcc

SEQ ID NO: 3290996 - DNA, 22 bp, Homo sapiens
ccagatttttcggaggccccac

SEQ ID NO: 3290997 - DNA, 23 bp, Homo sapiens
ccagcaacttcttctccatccct

SEQ ID NO: 3290998 - DNA, 19 bp, Homo sapiens
ccagcaagaataaaaaaga

SEQ ID NO: 3290999 - DNA, 14 bp, Homo sapiens
ccagcaagacctca

SEQ ID NO: 3291000 - DNA, 17 bp, Homo sapiens
ccagcaagagaaccccg

SEQ ID NO: 3291001 - DNA, 20 bp, Homo sapiens
ccagcaagagggaacaaaac

SEQ ID NO: 3291002 - DNA, 17 bp, Homo sapiens
ccagcaagcgggagccc

SEQ ID NO: 3291003 - DNA, 14 bp, Homo sapiens
ccagcaaggcaggt

SEQ ID NO: 3291004 - DNA, 15 bp, Homo sapiens
ccagcaaggcaggtt

SEQ ID NO: 3291005 - DNA, 17 bp, Homo sapiens
ccagcaagtgagagctg

SEQ ID NO: 3291006 - DNA, 18 bp, Homo sapiens
ccagcaagtgagagctgg

SEQ ID NO: 3291007 - DNA, 19 bp, Homo sapiens
ccagcaagtgagagctggg

SEQ ID NO: 3291008 - DNA, 17 bp, Homo sapiens
ccagcaatatgtaaata

SEQ ID NO: 3291009 - DNA, 12 bp, Homo sapiens
ccagcaatgaca

SEQ ID NO: 3291010 - DNA, 21 bp, Homo sapiens
ccaggctgctaacctggaaag

SEQ ID NO: 3291011 - DNA, 21 bp, Homo sapiens
ccaggctggacatgctgactg

SEQ ID NO: 3291012 - DNA, 21 bp, Homo sapiens
ccaggctggcgcagccaaggc

SEQ ID NO: 3291013 - DNA, 17 bp, Homo sapiens
ccaggctggcgtgcagt

SEQ ID NO: 3291014 - DNA, 23 bp, Homo sapiens
ccaggctggtccgagctgaggac

SEQ ID NO: 3291015 - DNA, 16 bp, Homo sapiens
ccaggctggtctaaaa

SEQ ID NO: 3291016 - DNA, 17 bp, Homo sapiens
ccaggctggtctaaaac

SEQ ID NO: 3291017 - DNA, 19 bp, Homo sapiens
ccaggctggtctcaaactc

SEQ ID NO: 3291018 - DNA, 20 bp, Homo sapiens
ccaggctgtgcagcgcagct

SEQ ID NO: 3291019 - DNA, 18 bp, Homo sapiens
ccaggctttgtacagagt

SEQ ID NO: 3291020 - DNA, 18 bp, Homo sapiens
ccagggaagctggccgag

SEQ ID NO: 3291021 - DNA, 10 bp, Homo sapiens
ccagggaagg

SEQ ID NO: 3291022 - DNA, 13 bp, Homo sapiens
ccagggaaggaaa

SEQ ID NO: 3291023 - DNA, 14 bp, Homo sapiens
ccagggaaggtggg

SEQ ID NO: 3291024 - DNA, 17 bp, Homo sapiens
ccagggaaggtggggcc

SEQ ID NO: 3291025 - DNA, 15 bp, Homo sapiens
ccagggaatccaagc

SEQ ID NO: 3291026 - DNA, 21 bp, Homo sapiens
ccagggaatccaagcctccac

SEQ ID NO: 3291027 - DNA, 22 bp, Homo sapiens
ccagggaccactgggtgagaga

SEQ ID NO: 3291028 - DNA, 15 bp, Homo sapiens
ccagggagattttga

SEQ ID NO: 3291029 - DNA, 17 bp, Homo sapiens
ccagggagcaagacaga

SEQ ID NO: 3291030 - DNA, 14 bp, Homo sapiens
ccagggagcctaga

SEQ ID NO: 3291031 - DNA, 13 bp, Homo sapiens
ccagggagccttt

SEQ ID NO: 3291032 - DNA, 22 bp, Homo sapiens
ccagggagcctttggttctggc

SEQ ID NO: 3291033 - DNA, 22 bp, Homo sapiens
ccagggagcttgaaagttttca

SEQ ID NO: 3291034 - DNA, 15 bp, Homo sapiens
ccagggatctctcta

SEQ ID NO: 3291035 - DNA, 12 bp, Homo sapiens
ccagggatgctg

SEQ ID NO: 3291036 - DNA, 23 bp, Homo sapiens
ccagggatgctgggctgggccct

SEQ ID NO: 3291037 - DNA, 17 bp, Homo sapiens
ccagggatgggggatgg

SEQ ID NO: 3291038 - DNA, 21 bp, Homo sapiens
ccagggatgggggatgggcca

SEQ ID NO: 3291039 - DNA, 22 bp, Homo sapiens
ccagggcaccctgtggccctgg

SEQ ID NO: 3291040 - DNA, 15 bp, Homo sapiens
ccagggcagggccac

SEQ ID NO: 3291041 - DNA, 22 bp, Homo sapiens
ccagggcattcgggccacaggg

SEQ ID NO: 3291042 - DNA, 14 bp, Homo sapiens
ccagggccacgctc

SEQ ID NO: 3291043 - DNA, 12 bp, Homo sapiens
ccagggcccctc

SEQ ID NO: 3291044 - DNA, 17 bp, Homo sapiens
ccagggcccctccctct

SEQ ID NO: 3291045 - DNA, 18 bp, Homo sapiens
ccagggccctaggcccct

SEQ ID NO: 3291046 - DNA, 14 bp, Homo sapiens
ccagggccctgcag

SEQ ID NO: 3291047 - DNA, 15 bp, Homo sapiens
ccagggccctgcaga

SEQ ID NO: 3291048 - DNA, 14 bp, Homo sapiens
ccagggccctggat

SEQ ID NO: 3291049 - DNA, 15 bp, Homo sapiens
ccagggccctggatg

SEQ ID NO: 3291050 - DNA, 17 bp, Homo sapiens
ccagggcgctgggaagg

SEQ ID NO: 3291051 - DNA, 12 bp, Homo sapiens
ccagggctcctg

SEQ ID NO: 3291052 - DNA, 14 bp, Homo sapiens
ccagggctctgccc

SEQ ID NO: 3291053 - DNA, 17 bp, Homo sapiens
ccagggctctgccccag

SEQ ID NO: 3291054 - DNA, 18 bp, Homo sapiens
ccagggctgccctgagaa

SEQ ID NO: 3291055 - DNA, 12 bp, Homo sapiens
ccagggctggct

SEQ ID NO: 3291056 - DNA, 18 bp, Homo sapiens
ccagggctggctctgcac

SEQ ID NO: 3291057 - DNA, 11 bp, Homo sapiens
ccagggctggg

SEQ ID NO: 3291058 - DNA, 14 bp, Homo sapiens
ccagggctggggac

SEQ ID NO: 3291059 - DNA, 12 bp, Homo sapiens
ccaggggaacct

SEQ ID NO: 3291060 - DNA, 17 bp, Homo sapiens
ccaggggaacctgccat

SEQ ID NO: 3291061 - DNA, 13 bp, Homo sapiens
ccaggggaccaca

SEQ ID NO: 3291062 - DNA, 18 bp, Homo sapiens
ccaggggaccacacctcc

SEQ ID NO: 3291063 - DNA, 16 bp, Homo sapiens
ccaggggaggagcctg

SEQ ID NO: 3291064 - DNA, 17 bp, Homo sapiens
ccaggggaggagcctgt

SEQ ID NO: 3291065 - DNA, 22 bp, Homo sapiens
ccaggggattgtctcagggccg

SEQ ID NO: 3291066 - DNA, 12 bp, Homo sapiens
ccaggggcagga

SEQ ID NO: 3291067 - DNA, 22 bp, Homo sapiens
ccaggggcccttgggacagcca

SEQ ID NO: 3291068 - DNA, 16 bp, Homo sapiens
ccaggggcctgcagaa

SEQ ID NO: 3291069 - DNA, 20 bp, Homo sapiens
ccaggggcctgcagaaggaa

SEQ ID NO: 3291070 - DNA, 22 bp, Homo sapiens
ccaggggctgcttcctcctgga

SEQ ID NO: 3291071 - DNA, 23 bp, Homo sapiens
ccaggggctgcttcctcctggaa

SEQ ID NO: 3291072 - DNA, 21 bp, Homo sapiens
ccaggggctgggctccctgat

SEQ ID NO: 3291073 - DNA, 23 bp, Homo sapiens
ccaggggctgggctccctgatga

SEQ ID NO: 3291074 - DNA, 19 bp, Homo sapiens
ccagggggactagcccctg

SEQ ID NO: 3291075 - DNA, 18 bp, Homo sapiens
ccagggggatgccactcc

SEQ ID NO: 3291076 - DNA, 15 bp, Homo sapiens
ccaggggggcctcct

SEQ ID NO: 3291077 - DNA, 16 bp, Homo sapiens
ccaggggggcctcctc

SEQ ID NO: 3291078 - DNA, 14 bp, Homo sapiens
ccaggggtcccagc

SEQ ID NO: 3291079 - DNA, 18 bp, Homo sapiens
ccaggggtcccagccacc

SEQ ID NO: 3291080 - DNA, 18 bp, Homo sapiens
ccagggtacccgcctgag

SEQ ID NO: 3291081 - DNA, 16 bp, Homo sapiens
ccagggtccctctgtg

SEQ ID NO: 3291082 - DNA, 14 bp, Homo sapiens
ccagggtccgcacc

SEQ ID NO: 3291083 - DNA, 16 bp, Homo sapiens
ccagggtctctccctc

SEQ ID NO: 3291084 - DNA, 20 bp, Homo sapiens
ccagggtctgtgtgaatgtg

SEQ ID NO: 3291085 - DNA, 22 bp, Homo sapiens
ccagggtctgtgtgaatgtggg

SEQ ID NO: 3291086 - DNA, 23 bp, Homo sapiens
ccagggtcttccctacctcaggc

SEQ ID NO: 3291087 - DNA, 17 bp, Homo sapiens
ccagggtcttgggctac

SEQ ID NO: 3291088 - DNA, 21 bp, Homo sapiens
ccagggtcttgggctactggc

SEQ ID NO: 3291089 - DNA, 20 bp, Homo sapiens
ccagggtggacttagaaagc

SEQ ID NO: 3291090 - DNA, 21 bp, Homo sapiens
ccagggtggacttagaaagca

SEQ ID NO: 3291091 - DNA, 21 bp, Homo sapiens
ccagggttttgccccaagtcc

SEQ ID NO: 3291092 - DNA, 19 bp, Homo sapiens
ccaggtaccagctgcgctt

SEQ ID NO: 3291093 - DNA, 22 bp, Homo sapiens
ccaggtactgcattctctccca

SEQ ID NO: 3291094 - DNA, 11 bp, Homo sapiens
ccaggtcagga

SEQ ID NO: 3291095 - DNA, 19 bp, Homo sapiens
ccaggtcaggatgcacatt

SEQ ID NO: 3291096 - DNA, 22 bp, Homo sapiens
ccaggtcaggatgcacatttct

SEQ ID NO: 3291097 - DNA, 17 bp, Homo sapiens
ccaggtccagctctgga

SEQ ID NO: 3291098 - DNA, 18 bp, Homo sapiens
ccaggtccagctctggag

SEQ ID NO: 3291099 - DNA, 15 bp, Homo sapiens
ccaggtccattttgc

SEQ ID NO: 3291100 - DNA, 14 bp, Homo sapiens
ccaggtccttcctt

SEQ ID NO: 3291101 - DNA, 23 bp, Homo sapiens
ccaggtctcacgggcatgggcac

SEQ ID NO: 3291102 - DNA, 13 bp, Homo sapiens
ccaggtcttccag

SEQ ID NO: 3291103 - DNA, 16 bp, Homo sapiens
ccaggtcttccagacc

SEQ ID NO: 3291104 - DNA, 17 bp, Homo sapiens
ccaggtcttccagacct

SEQ ID NO: 3291105 - DNA, 20 bp, Homo sapiens
ccaggtcttccagacctgct

SEQ ID NO: 3291106 - DNA, 20 bp, Homo sapiens
ccaggtgaggcccaagagcc

SEQ ID NO: 3291107 - DNA, 19 bp, Homo sapiens
ccaggtgaggtccaccggc

SEQ ID NO: 3291108 - DNA, 14 bp, Homo sapiens
ccaggtgcagtggc

SEQ ID NO: 3291109 - DNA, 15 bp, Homo sapiens
ccaggtggaaggcag

SEQ ID NO: 3291110 - DNA, 20 bp, Homo sapiens
ccaggtggaaggcagacagc

SEQ ID NO: 3291111 - DNA, 22 bp, Homo sapiens
ccaggtggagggcacagccctc

SEQ ID NO: 3291112 - DNA, 21 bp, Homo sapiens
ccaggtggccactccagaccc

SEQ ID NO: 3291113 - DNA, 23 bp, Homo sapiens
ccaggtgtgcacgtggcatgtgg

SEQ ID NO: 3291114 - DNA, 14 bp, Homo sapiens
ccaggtgtgcctgg

SEQ ID NO: 3291115 - DNA, 23 bp, Homo sapiens
ccaggtgtggctgtcaggacacc

SEQ ID NO: 3291116 - DNA, 19 bp, Homo sapiens
ccaggttcacactcagaaa

SEQ ID NO: 3291117 - DNA, 17 bp, Homo sapiens
ccaggttcccccagcaa

SEQ ID NO: 3291118 - DNA, 19 bp, Homo sapiens
ccaggttcccccagcaagc

SEQ ID NO: 3291119 - DNA, 22 bp, Homo sapiens
ccaggttctccgttagctcctg

SEQ ID NO: 3291120 - DNA, 23 bp, Homo sapiens
ccaggttctccgttagctcctgt

SEQ ID NO: 3291121 - DNA, 16 bp, Homo sapiens
ccaggtttagacagta

SEQ ID NO: 3291122 - DNA, 16 bp, Homo sapiens
ccaggtttctatgtgt

SEQ ID NO: 3291123 - DNA, 20 bp, Homo sapiens
ccagtaacgcgtcttcctga

SEQ ID NO: 3291124 - DNA, 21 bp, Homo sapiens
ccagtaacgcgtcttcctgag

SEQ ID NO: 3291125 - DNA, 16 bp, Homo sapiens
ccagtaacttttttgt

SEQ ID NO: 3291126 - DNA, 23 bp, Homo sapiens
ccagtaacttttttgtgtatgta

SEQ ID NO: 3291127 - DNA, 14 bp, Homo sapiens
ccagtaccttgctt

SEQ ID NO: 3291128 - DNA, 16 bp, Homo sapiens
ccagtacctttgtcac

SEQ ID NO: 3291129 - DNA, 16 bp, Homo sapiens
ccagtacgtgctaaca

SEQ ID NO: 3291130 - DNA, 21 bp, Homo sapiens
ccagtatacctcatttttcat

SEQ ID NO: 3291131 - DNA, 23 bp, Homo sapiens
ccagtatacctcatttttcatac

SEQ ID NO: 3291132 - DNA, 18 bp, Homo sapiens
ccagtatctatatatgtg

SEQ ID NO: 3291133 - DNA, 14 bp, Homo sapiens
ccagtattagactg

SEQ ID NO: 3291134 - DNA, 16 bp, Homo sapiens
ccagtattctcagagc

SEQ ID NO: 3291135 - DNA, 17 bp, Homo sapiens
ccattcccgtggtctcc

SEQ ID NO: 3291136 - DNA, 13 bp, Homo sapiens
ccattcctccctc

SEQ ID NO: 3291137 - DNA, 13 bp, Homo sapiens
ccattcctgcctt

SEQ ID NO: 3291138 - DNA, 17 bp, Homo sapiens
ccattcctggtacccag

SEQ ID NO: 3291139 - DNA, 21 bp, Homo sapiens
ccattcctggtacccagccat

SEQ ID NO: 3291140 - DNA, 24 bp, Homo sapiens
ccattcctggtacccagccatctg

SEQ ID NO: 3291141 - DNA, 17 bp, Homo sapiens
ccattcggggctgacga

SEQ ID NO: 3291142 - DNA, 22 bp, Homo sapiens
ccattctcccaggtaccagctg

SEQ ID NO: 3291143 - DNA, 12 bp, Homo sapiens
ccattctcctgc

SEQ ID NO: 3291144 - DNA, 17 bp, Homo sapiens
ccattctcctgcctcac

SEQ ID NO: 3291145 - DNA, 19 bp, Homo sapiens
ccattctcctgcctcaccc

SEQ ID NO: 3291146 - DNA, 12 bp, Homo sapiens
ccattctgactc

SEQ ID NO: 3291147 - DNA, 22 bp, Homo sapiens
ccattctgccgccccctcctga

SEQ ID NO: 3291148 - DNA, 16 bp, Homo sapiens
ccattctgcctgccca

SEQ ID NO: 3291149 - DNA, 18 bp, Homo sapiens
ccattctgcctgcccagg

SEQ ID NO: 3291150 - DNA, 19 bp, Homo sapiens
ccattctgcctgcccaggc

SEQ ID NO: 3291151 - DNA, 22 bp, Homo sapiens
ccattctgtgaccaaaatacct

SEQ ID NO: 3291152 - DNA, 14 bp, Homo sapiens
ccattcttctggtg

SEQ ID NO: 3291153 - DNA, 15 bp, Homo sapiens
ccattcttctggtgc

SEQ ID NO: 3291154 - DNA, 13 bp, Homo sapiens
ccattctttgctt

SEQ ID NO: 3291155 - DNA, 22 bp, Homo sapiens
ccattctttgcttgaacacagt

SEQ ID NO: 3291156 - DNA, 19 bp, Homo sapiens
ccattctttttttcttggc

SEQ ID NO: 3291157 - DNA, 12 bp, Homo sapiens
ccattgaaggct

SEQ ID NO: 3291158 - DNA, 20 bp, Homo sapiens
ccattgcatcacctctgtaa

SEQ ID NO: 3291159 - DNA, 16 bp, Homo sapiens
ccattgcggccccagg

SEQ ID NO: 3291160 - DNA, 11 bp, Homo sapiens
ccattgggacc

SEQ ID NO: 3291161 - DNA, 17 bp, Homo sapiens
ccattgggaccctccag

SEQ ID NO: 3291162 - DNA, 15 bp, Homo sapiens
ccattgtcttgttct

SEQ ID NO: 3291163 - DNA, 22 bp, Homo sapiens
ccattgtctttatatgaacata

SEQ ID NO: 3291164 - DNA, 23 bp, Homo sapiens
ccattgtctttatatgaacatag

SEQ ID NO: 3291165 - DNA, 19 bp, Homo sapiens
ccattgtgaagcacctact

SEQ ID NO: 3291166 - DNA, 14 bp, Homo sapiens
ccatttaaaaagtt

SEQ ID NO: 3291167 - DNA, 19 bp, Homo sapiens
ccatttaaatttttttcct

SEQ ID NO: 3291168 - DNA, 18 bp, Homo sapiens
ccatttacacttttgaga

SEQ ID NO: 3291169 - DNA, 20 bp, Homo sapiens
ccatttacagtctctttctt

SEQ ID NO: 3291170 - DNA, 22 bp, Homo sapiens
ccatttacagtctctttcttcc

SEQ ID NO: 3291171 - DNA, 18 bp, Homo sapiens
ccatttacgtgtctgaat

SEQ ID NO: 3291172 - DNA, 21 bp, Homo sapiens
ccatttataaccccagcctga

SEQ ID NO: 3291173 - DNA, 13 bp, Homo sapiens
ccatttcagagag

SEQ ID NO: 3291174 - DNA, 20 bp, Homo sapiens
ccatttcaggaatttaaaat

SEQ ID NO: 3291175 - DNA, 14 bp, Homo sapiens
ccatttcccatctg

SEQ ID NO: 3291176 - DNA, 15 bp, Homo sapiens
ccatttcccatctgc

SEQ ID NO: 3291177 - DNA, 19 bp, Homo sapiens
ccatttcctcagcttatct

SEQ ID NO: 3291178 - DNA, 13 bp, Homo sapiens
ccatttctattta

SEQ ID NO: 3291179 - DNA, 14 bp, Homo sapiens
ccatttctctacac

SEQ ID NO: 3291180 - DNA, 17 bp, Homo sapiens
ccatttctctacactaa

SEQ ID NO: 3291181 - DNA, 21 bp, Homo sapiens
ccatttgatacccctggggaa

SEQ ID NO: 3291182 - DNA, 19 bp, Homo sapiens
ccatttgcctttctgggag

SEQ ID NO: 3291183 - DNA, 16 bp, Homo sapiens
ccatttgtaattaaat

SEQ ID NO: 3291184 - DNA, 18 bp, Homo sapiens
ccatttgtgccagaggaa

SEQ ID NO: 3291185 - DNA, 12 bp, Homo sapiens
ccatttgtttat

SEQ ID NO: 3291186 - DNA, 13 bp, Homo sapiens
ccatttgtttatt

SEQ ID NO: 3291187 - DNA, 17 bp, Homo sapiens
ccattttaacgctgcct

SEQ ID NO: 3291188 - DNA, 12 bp, Homo sapiens
ccattttatgca

SEQ ID NO: 3291189 - DNA, 19 bp, Homo sapiens
ccattttcaactgctttga

SEQ ID NO: 3291190 - DNA, 22 bp, Homo sapiens
ccattttcccccactactgcag

SEQ ID NO: 3291191 - DNA, 13 bp, Homo sapiens
ccattttcccctt

SEQ ID NO: 3291192 - DNA, 16 bp, Homo sapiens
ccattttccccttcct

SEQ ID NO: 3291193 - DNA, 10 bp, Homo sapiens
ccattttcta

SEQ ID NO: 3291194 - DNA, 17 bp, Homo sapiens
ccattttctatcatgga

SEQ ID NO: 3291195 - DNA, 21 bp, Homo sapiens
ccattttgcaaaatttccagt

SEQ ID NO: 3291196 - DNA, 22 bp, Homo sapiens
ccattttggggtacccactgct

SEQ ID NO: 3291197 - DNA, 12 bp, Homo sapiens
ccattttgtgaa

SEQ ID NO: 3291198 - DNA, 16 bp, Homo sapiens
ccatttttcctctgtt

SEQ ID NO: 3291199 - DNA, 17 bp, Homo sapiens
ccattttttcttccctt

SEQ ID NO: 3291200 - DNA, 14 bp, Homo sapiens
cccaaaacccaggg

SEQ ID NO: 3291201 - DNA, 19 bp, Homo sapiens
cccaaaacccttacagtga

SEQ ID NO: 3291202 - DNA, 17 bp, Homo sapiens
cccaaacaaatatgcaa

SEQ ID NO: 3291203 - DNA, 22 bp, Homo sapiens
cccaaacaccttccagctcctg

SEQ ID NO: 3291204 - DNA, 14 bp, Homo sapiens
cccaaacatagccc

SEQ ID NO: 3291205 - DNA, 23 bp, Homo sapiens
cccaaactgttgattattagcca

SEQ ID NO: 3291206 - DNA, 16 bp, Homo sapiens
cccaaagctttcctgc

SEQ ID NO: 3291207 - DNA, 17 bp, Homo sapiens
cccaaagctttcctgcc

SEQ ID NO: 3291208 - DNA, 20 bp, Homo sapiens
cccaaagctttcctgcccca

SEQ ID NO: 3291209 - DNA, 17 bp, Homo sapiens
cccaaaggaaaaagcac

SEQ ID NO: 3291210 - DNA, 16 bp, Homo sapiens
cccaaagtctgtgtga

SEQ ID NO: 3291211 - DNA, 20 bp, Homo sapiens
cccaaagtgctaagattaca

SEQ ID NO: 3291212 - DNA, 16 bp, Homo sapiens
cccaaagtgctgggat

SEQ ID NO: 3291213 - DNA, 23 bp, Homo sapiens
cccaaagttgttgtaacctgctg

SEQ ID NO: 3291214 - DNA, 17 bp, Homo sapiens
cccaacaaaccatccag

SEQ ID NO: 3291215 - DNA, 16 bp, Homo sapiens
cccaacaccagcccct

SEQ ID NO: 3291216 - DNA, 17 bp, Homo sapiens
cccaacaccagcccctg

SEQ ID NO: 3291217 - DNA, 20 bp, Homo sapiens
cccaacaccagcccctgccc

SEQ ID NO: 3291218 - DNA, 13 bp, Homo sapiens
cccaacactgtgc

SEQ ID NO: 3291219 - DNA, 18 bp, Homo sapiens
cccaacactgtgccctgg

SEQ ID NO: 3291220 - DNA, 12 bp, Homo sapiens
cccaaccagtgc

SEQ ID NO: 3291221 - DNA, 16 bp, Homo sapiens
cccaaccatcttcact

SEQ ID NO: 3291222 - DNA, 20 bp, Homo sapiens
cccaacccattcactacagg

SEQ ID NO: 3291223 - DNA, 12 bp, Homo sapiens
cccaaccccagc

SEQ ID NO: 3291224 - DNA, 12 bp, Homo sapiens
cccaacccccac

SEQ ID NO: 3291225 - DNA, 14 bp, Homo sapiens
cccaacccccaccc

SEQ ID NO: 3291226 - DNA, 16 bp, Homo sapiens
cccaacccccctcctg

SEQ ID NO: 3291227 - DNA, 21 bp, Homo sapiens
cccaacccccctcctgctcct

SEQ ID NO: 3291228 - DNA, 21 bp, Homo sapiens
cccaaccccgcggtgctctgg

SEQ ID NO: 3291229 - DNA, 13 bp, Homo sapiens
cccaacccctgag

SEQ ID NO: 3291230 - DNA, 20 bp, Homo sapiens
cccaaccctatctcctgaca

SEQ ID NO: 3291231 - DNA, 14 bp, Homo sapiens
cccaacctgctctc

SEQ ID NO: 3291232 - DNA, 15 bp, Homo sapiens
cccaacgcacaggaa

SEQ ID NO: 3291233 - DNA, 16 bp, Homo sapiens
cccaacgcacaggaaa

SEQ ID NO: 3291234 - DNA, 19 bp, Homo sapiens
cccaactactgagctgaga

SEQ ID NO: 3291235 - DNA, 18 bp, Homo sapiens
cccaactctgagcccatg

SEQ ID NO: 3291236 - DNA, 20 bp, Homo sapiens
cccaagaatagatgctgact

SEQ ID NO: 3291237 - DNA, 21 bp, Homo sapiens
cccaagaatagatgctgactg

SEQ ID NO: 3291238 - DNA, 20 bp, Homo sapiens
cccaagacagatgccccaga

SEQ ID NO: 3291239 - DNA, 20 bp, Homo sapiens
cccaagacttcattgtccct

SEQ ID NO: 3291240 - DNA, 17 bp, Homo sapiens
cccaagagatgaagagt

SEQ ID NO: 3291241 - DNA, 22 bp, Homo sapiens
cccaagagcagagtctgggcct

SEQ ID NO: 3291242 - DNA, 17 bp, Homo sapiens
cccaagagccctgtggc

SEQ ID NO: 3291243 - DNA, 21 bp, Homo sapiens
cccaagagccctgtggccgcc

SEQ ID NO: 3291244 - DNA, 18 bp, Homo sapiens
cccaagaggactgagact

SEQ ID NO: 3291245 - DNA, 12 bp, Homo sapiens
cccaagcagcca

SEQ ID NO: 3291246 - DNA, 14 bp, Homo sapiens
cccaagcagccagc

SEQ ID NO: 3291247 - DNA, 15 bp, Homo sapiens
cccaagcagccagcc

SEQ ID NO: 3291248 - DNA, 16 bp, Homo sapiens
cccaagcagccagcca

SEQ ID NO: 3291249 - DNA, 15 bp, Homo sapiens
cccaagccccatctc

SEQ ID NO: 3291250 - DNA, 20 bp, Homo sapiens
cccaagccccatctcatcct

SEQ ID NO: 3291251 - DNA, 15 bp, Homo sapiens
cccaagcctgctggc

SEQ ID NO: 3291252 - DNA, 17 bp, Homo sapiens
cccaagcctgctggctg

SEQ ID NO: 3291253 - DNA, 12 bp, Homo sapiens
cccaagctcctc

SEQ ID NO: 3291254 - DNA, 12 bp, Homo sapiens
cccaagctctgc

SEQ ID NO: 3291255 - DNA, 15 bp, Homo sapiens
cccaagctctgctcc

SEQ ID NO: 3291256 - DNA, 16 bp, Homo sapiens
cccaagctgcctctgg

SEQ ID NO: 3291257 - DNA, 12 bp, Homo sapiens
cccaaggagctg

SEQ ID NO: 3291258 - DNA, 14 bp, Homo sapiens
cccaaggagctgat

SEQ ID NO: 3291259 - DNA, 15 bp, Homo sapiens
cccaaggctgcgtct

SEQ ID NO: 3291260 - DNA, 12 bp, Homo sapiens
cccaagggccct

SEQ ID NO: 3291261 - DNA, 19 bp, Homo sapiens
cccaaggtcccctccacat

SEQ ID NO: 3291262 - DNA, 17 bp, Homo sapiens
cccagggctcccttatg

SEQ ID NO: 3291263 - DNA, 15 bp, Homo sapiens
cccagggctcctgca

SEQ ID NO: 3291264 - DNA, 17 bp, Homo sapiens
cccagggctctgcccca

SEQ ID NO: 3291265 - DNA, 18 bp, Homo sapiens
cccagggctctgccccag

SEQ ID NO: 3291266 - DNA, 13 bp, Homo sapiens
cccaggggcagga

SEQ ID NO: 3291267 - DNA, 13 bp, Homo sapiens
cccaggggggcct

SEQ ID NO: 3291268 - DNA, 15 bp, Homo sapiens
cccaggggggcctcc

SEQ ID NO: 3291269 - DNA, 17 bp, Homo sapiens
cccaggggtctccctgg

SEQ ID NO: 3291270 - DNA, 19 bp, Homo sapiens
cccaggggtctccctggct

SEQ ID NO: 3291271 - DNA, 20 bp, Homo sapiens
cccaggggtctccctggctc

SEQ ID NO: 3291272 - DNA, 22 bp, Homo sapiens
cccaggggtctccctggctccc

SEQ ID NO: 3291273 - DNA, 23 bp, Homo sapiens
cccaggggtctccctggctccct

SEQ ID NO: 3291274 - DNA, 17 bp, Homo sapiens
cccaggggtgccccctc

SEQ ID NO: 3291275 - DNA, 19 bp, Homo sapiens
cccaggggtgccccctcct

SEQ ID NO: 3291276 - DNA, 14 bp, Homo sapiens
cccaggtaccagct

SEQ ID NO: 3291277 - DNA, 16 bp, Homo sapiens
cccaggtaccagctgc

SEQ ID NO: 3291278 - DNA, 14 bp, Homo sapiens
cccaggtccagctc

SEQ ID NO: 3291279 - DNA, 18 bp, Homo sapiens
cccaggtccagctctgga

SEQ ID NO: 3291280 - DNA, 13 bp, Homo sapiens
cccaggtccttcc

SEQ ID NO: 3291281 - DNA, 16 bp, Homo sapiens
cccaggtggagggcac

SEQ ID NO: 3291282 - DNA, 19 bp, Homo sapiens
cccaggttcccccagcaag

SEQ ID NO: 3291283 - DNA, 19 bp, Homo sapiens
cccaggttgacaccattct

SEQ ID NO: 3291284 - DNA, 16 bp, Homo sapiens
cccagtagaccttgtt

SEQ ID NO: 3291285 - DNA, 19 bp, Homo sapiens
cccagtatacctcattttt

SEQ ID NO: 3291286 - DNA, 14 bp, Homo sapiens
cccagtcccaggga

SEQ ID NO: 3291287 - DNA, 13 bp, Homo sapiens
cccagtccccacc

SEQ ID NO: 3291288 - DNA, 15 bp, Homo sapiens
cccagtccccacccc

SEQ ID NO: 3291289 - DNA, 19 bp, Homo sapiens
cccagtccccacccctgcc

SEQ ID NO: 3291290 - DNA, 23 bp, Homo sapiens
cccagtccccacccctgccccca

SEQ ID NO: 3291291 - DNA, 21 bp, Homo sapiens
cccagtctctcttaaagttgg

SEQ ID NO: 3291292 - DNA, 18 bp, Homo sapiens
cccagtgacacttcagag

SEQ ID NO: 3291293 - DNA, 22 bp, Homo sapiens
cccagtgacacttcagagagct

SEQ ID NO: 3291294 - DNA, 13 bp, Homo sapiens
cccagtgctgcca

SEQ ID NO: 3291295 - DNA, 19 bp, Homo sapiens
cccagtgctgccatgccac

SEQ ID NO: 3291296 - DNA, 20 bp, Homo sapiens
cccagtgctgccatgccact

SEQ ID NO: 3291297 - DNA, 21 bp, Homo sapiens
cccagtgctgccatgccactg

SEQ ID NO: 3291298 - DNA, 12 bp, Homo sapiens
cccagtgggagg

SEQ ID NO: 3291299 - DNA, 14 bp, Homo sapiens
cccagtgggagggg

SEQ ID NO: 3291300 - DNA, 16 bp, Homo sapiens
cccagtgggaggggca

SEQ ID NO: 3291301 - DNA, 22 bp, Homo sapiens
cccagtgggaggggcaggctga

SEQ ID NO: 3291302 - DNA, 15 bp, Homo sapiens
cccagttctgctcct

SEQ ID NO: 3291303 - DNA, 22 bp, Homo sapiens
cccagttctgctcctctccagg

SEQ ID NO: 3291304 - DNA, 23 bp, Homo sapiens
cccagttctgctcctctccaggc

SEQ ID NO: 3291305 - DNA, 19 bp, Homo sapiens
cccagttgcactcaggtga

SEQ ID NO: 3291306 - DNA, 17 bp, Homo sapiens
cccagtttcttcttaca

SEQ ID NO: 3291307 - DNA, 23 bp, Homo sapiens
cccataatagttagccctcagtc

SEQ ID NO: 3291308 - DNA, 21 bp, Homo sapiens
cccataattgctttgccaaaa

SEQ ID NO: 3291309 - DNA, 19 bp, Homo sapiens
cccataattttcttcatgc

SEQ ID NO: 3291310 - DNA, 16 bp, Homo sapiens
cccatagatcttctga

SEQ ID NO: 3291311 - DNA, 20 bp, Homo sapiens
cccatagcagccagttcaaa

SEQ ID NO: 3291312 - DNA, 12 bp, Homo sapiens
cccatcatccca

SEQ ID NO: 3291313 - DNA, 15 bp, Homo sapiens
cccatcccacaccct

SEQ ID NO: 3291314 - DNA, 14 bp, Homo sapiens
cccatccccaccag

SEQ ID NO: 3291315 - DNA, 15 bp, Homo sapiens
cccatccccaccagc

SEQ ID NO: 3291316 - DNA, 16 bp, Homo sapiens
cccatccccaccagct

SEQ ID NO: 3291317 - DNA, 15 bp, Homo sapiens
cccatccccctgccc

SEQ ID NO: 3291318 - DNA, 16 bp, Homo sapiens
cccatccctccccagt

SEQ ID NO: 3291319 - DNA, 13 bp, Homo sapiens
cccatccctcggg

SEQ ID NO: 3291320 - DNA, 23 bp, Homo sapiens
cccatccctcgggaagcagccag

SEQ ID NO: 3291321 - DNA, 14 bp, Homo sapiens
cccatccctgcctg

SEQ ID NO: 3291322 - DNA, 17 bp, Homo sapiens
cccatccctgtcatttt

SEQ ID NO: 3291323 - DNA, 12 bp, Homo sapiens
cccatcctaccc

SEQ ID NO: 3291324 - DNA, 13 bp, Homo sapiens
cccatcctaccct

SEQ ID NO: 3291325 - DNA, 18 bp, Homo sapiens
cccatcctcatccctgac

SEQ ID NO: 3291326 - DNA, 15 bp, Homo sapiens
cccatcctccagctt

SEQ ID NO: 3291327 - DNA, 16 bp, Homo sapiens
cccatcctccagcttc

SEQ ID NO: 3291328 - DNA, 14 bp, Homo sapiens
cccatcctggggca

SEQ ID NO: 3291329 - DNA, 14 bp, Homo sapiens
cccatctcagcctc

SEQ ID NO: 3291330 - DNA, 16 bp, Homo sapiens
cccatctcaggtgcca

SEQ ID NO: 3291331 - DNA, 16 bp, Homo sapiens
cccatctccccaggcc

SEQ ID NO: 3291332 - DNA, 17 bp, Homo sapiens
cccatctccccaggcct

SEQ ID NO: 3291333 - DNA, 19 bp, Homo sapiens
cccatctccccaggcctcc

SEQ ID NO: 3291334 - DNA, 15 bp, Homo sapiens
cccatctccctgcct

SEQ ID NO: 3291335 - DNA, 17 bp, Homo sapiens
cccatctccctgcctgg

SEQ ID NO: 3291336 - DNA, 20 bp, Homo sapiens
cccatctccctgcctggccc

SEQ ID NO: 3291337 - DNA, 18 bp, Homo sapiens
cccatctcggagcatccc

SEQ ID NO: 3291338 - DNA, 15 bp, Homo sapiens
cccatcttactggaa

SEQ ID NO: 3291339 - DNA, 15 bp, Homo sapiens
cccatcttccacctg

SEQ ID NO: 3291340 - DNA, 17 bp, Homo sapiens
cccatcttcctgctgct

SEQ ID NO: 3291341 - DNA, 13 bp, Homo sapiens
cccatgacccacc

SEQ ID NO: 3291342 - DNA, 17 bp, Homo sapiens
cccatgacccacccctg

SEQ ID NO: 3291343 - DNA, 21 bp, Homo sapiens
cccatgacccacccctgtgct

SEQ ID NO: 3291344 - DNA, 19 bp, Homo sapiens
cccatgactgcacccagct

SEQ ID NO: 3291345 - DNA, 20 bp, Homo sapiens
cccatgactgcacccagctc

SEQ ID NO: 3291346 - DNA, 22 bp, Homo sapiens
cccatgactttatatggatgat

SEQ ID NO: 3291347 - DNA, 15 bp, Homo sapiens
cccatgagcctgccc

SEQ ID NO: 3291348 - DNA, 16 bp, Homo sapiens
cccatgagcctgcccg

SEQ ID NO: 3291349 - DNA, 14 bp, Homo sapiens
cccatgcaggccct

SEQ ID NO: 3291350 - DNA, 19 bp, Homo sapiens
cccatgcctgtccagcctg

SEQ ID NO: 3291351 - DNA, 20 bp, Homo sapiens
cccatgcctgtccagcctgg

SEQ ID NO: 3291352 - DNA, 13 bp, Homo sapiens
cccatgcctgtct

SEQ ID NO: 3291353 - DNA, 21 bp, Homo sapiens
cccatgcgtgccgcctgctcc

SEQ ID NO: 3291354 - DNA, 17 bp, Homo sapiens
cccatgctctgccccaa

SEQ ID NO: 3291355 - DNA, 20 bp, Homo sapiens
cccatgctctgccccaagcc

SEQ ID NO: 3291356 - DNA, 13 bp, Homo sapiens
cccatggaatatt

SEQ ID NO: 3291357 - DNA, 22 bp, Homo sapiens
cccatggacactccagtgccag

SEQ ID NO: 3291358 - DNA, 22 bp, Homo sapiens
cccatggcccccaataaaggca

SEQ ID NO: 3291359 - DNA, 21 bp, Homo sapiens
cccatgggctgagtggggagc

SEQ ID NO: 3291360 - DNA, 21 bp, Homo sapiens
cccatgggcttggacttcctg

SEQ ID NO: 3291361 - DNA, 15 bp, Homo sapiens
cccatgtaaatacca

SEQ ID NO: 3291362 - DNA, 21 bp, Homo sapiens
cccatgtcaccggtcagtgcc

SEQ ID NO: 3291363 - DNA, 22 bp, Homo sapiens
cccatgtgcctgcaccaggaga

SEQ ID NO: 3291364 - DNA, 16 bp, Homo sapiens
cccatgtggctgaaga

SEQ ID NO: 3291365 - DNA, 17 bp, Homo sapiens
cccatgtggctgaagac

SEQ ID NO: 3291366 - DNA, 22 bp, Homo sapiens
cccatgtgtcccctcactctgt

SEQ ID NO: 3291367 - DNA, 16 bp, Homo sapiens
cccattaggacaatca

SEQ ID NO: 3291368 - DNA, 22 bp, Homo sapiens
cccattcacttctgcattcctg

SEQ ID NO: 3291369 - DNA, 18 bp, Homo sapiens
cccattcagagactgtcc

SEQ ID NO: 3291370 - DNA, 20 bp, Homo sapiens
cccattcatattaagacagt

SEQ ID NO: 3291371 - DNA, 13 bp, Homo sapiens
cccattcccacca

SEQ ID NO: 3291372 - DNA, 14 bp, Homo sapiens
cccattcctccctc

SEQ ID NO: 3291373 - DNA, 21 bp, Homo sapiens
cccattcggtgtggtgcagtg

SEQ ID NO: 3291374 - DNA, 13 bp, Homo sapiens
cccattctgcctg

SEQ ID NO: 3291375 - DNA, 14 bp, Homo sapiens
cccattctgcctgc

SEQ ID NO: 3291376 - DNA, 22 bp, Homo sapiens
cccattctgcctgcccaggccc

SEQ ID NO: 3291377 - DNA, 21 bp, Homo sapiens
cccattgcatcacctctgtaa

SEQ ID NO: 3291378 - DNA, 21 bp, Homo sapiens
cccattggtgttgtcattgta

SEQ ID NO: 3291379 - DNA, 12 bp, Homo sapiens
cccatttcagct

SEQ ID NO: 3291380 - DNA, 13 bp, Homo sapiens
cccatttcaggaa

SEQ ID NO: 3291381 - DNA, 14 bp, Homo sapiens
cccatttcccatct

SEQ ID NO: 3291382 - DNA, 15 bp, Homo sapiens
cccatttcccatctg

SEQ ID NO: 3291383 - DNA, 19 bp, Homo sapiens
cccatttctatttatttac

SEQ ID NO: 3291384 - DNA, 14 bp, Homo sapiens
cccattttcccctt

SEQ ID NO: 3291385 - DNA, 20 bp, Homo sapiens
cccattttccccttcctcat

SEQ ID NO: 3291386 - DNA, 22 bp, Homo sapiens
cccatttttgctctatgggaaa

SEQ ID NO: 3291387 - DNA, 17 bp, Homo sapiens
ccccaaacatagcccct

SEQ ID NO: 3291388 - DNA, 23 bp, Homo sapiens
ccccttgccctccgcctgggatc

SEQ ID NO: 3291389 - DNA, 17 bp, Homo sapiens
ccccttgcccttgccct

SEQ ID NO: 3291390 - DNA, 13 bp, Homo sapiens
ccccttgggcatc

SEQ ID NO: 3291391 - DNA, 24 bp, Homo sapiens
cccctttcagatgtcttctgcctg

SEQ ID NO: 3291392 - DNA, 22 bp, Homo sapiens
cccctttcctaaagccatcatg

SEQ ID NO: 3291393 - DNA, 12 bp, Homo sapiens
cccctttgtgct

SEQ ID NO: 3291394 - DNA, 16 bp, Homo sapiens
cccctttgtgctgtgg

SEQ ID NO: 3291395 - DNA, 15 bp, Homo sapiens
ccccttttcttttct

SEQ ID NO: 3291396 - DNA, 20 bp, Homo sapiens
ccccttttcttttctaccct

SEQ ID NO: 3291397 - DNA, 23 bp, Homo sapiens
ccccttttcttttctaccctagc

SEQ ID NO: 3291398 - DNA, 19 bp, Homo sapiens
cccgaaactccacccgttc

SEQ ID NO: 3291399 - DNA, 19 bp, Homo sapiens
cccgaactgtgccttcgct

SEQ ID NO: 3291400 - DNA, 20 bp, Homo sapiens
cccgaagaatggagaggaac

SEQ ID NO: 3291401 - DNA, 22 bp, Homo sapiens
cccgaaggttatggtcaatccc

SEQ ID NO: 3291402 - DNA, 12 bp, Homo sapiens
cccgaagttcag

SEQ ID NO: 3291403 - DNA, 14 bp, Homo sapiens
cccgactcctcaaa

SEQ ID NO: 3291404 - DNA, 22 bp, Homo sapiens
cccgagatgtgacccaccagtg

SEQ ID NO: 3291405 - DNA, 13 bp, Homo sapiens
cccgagctcttgg

SEQ ID NO: 3291406 - DNA, 16 bp, Homo sapiens
cccgagctcttggcct

SEQ ID NO: 3291407 - DNA, 22 bp, Homo sapiens
cccgagctggtgcattacagag

SEQ ID NO: 3291408 - DNA, 14 bp, Homo sapiens
cccgagctgtcccc

SEQ ID NO: 3291409 - DNA, 15 bp, Homo sapiens
cccgaggagctgggc

SEQ ID NO: 3291410 - DNA, 19 bp, Homo sapiens
cccgaggagctgggcccct

SEQ ID NO: 3291411 - DNA, 19 bp, Homo sapiens
cccgaggccgcgtgcgtga

SEQ ID NO: 3291412 - DNA, 15 bp, Homo sapiens
cccgagtagctggga

SEQ ID NO: 3291413 - DNA, 18 bp, Homo sapiens
cccgagtagctgggacta

SEQ ID NO: 3291414 - DNA, 21 bp, Homo sapiens
cccgagtagctgggactacag

SEQ ID NO: 3291415 - DNA, 18 bp, Homo sapiens
cccgagtgcggcgtggag

SEQ ID NO: 3291416 - DNA, 20 bp, Homo sapiens
cccgatatattttagcattt

SEQ ID NO: 3291417 - DNA, 22 bp, Homo sapiens
cccgatgctgctttcccctgtg

SEQ ID NO: 3291418 - DNA, 15 bp, Homo sapiens
cccgatgtcccctgc

SEQ ID NO: 3291419 - DNA, 16 bp, Homo sapiens
cccgatgtcccctgcg

SEQ ID NO: 3291420 - DNA, 16 bp, Homo sapiens
cccgatgtggacctct

SEQ ID NO: 3291421 - DNA, 19 bp, Homo sapiens
cccgcaaaccccctttgtg

SEQ ID NO: 3291422 - DNA, 16 bp, Homo sapiens
cccgcacagcagcctg

SEQ ID NO: 3291423 - DNA, 15 bp, Homo sapiens
cccgcacagccaccc

SEQ ID NO: 3291424 - DNA, 16 bp, Homo sapiens
cccgcacagccacccg

SEQ ID NO: 3291425 - DNA, 19 bp, Homo sapiens
cccgcaccccccaagctgt

SEQ ID NO: 3291426 - DNA, 12 bp, Homo sapiens
cccgcacccccg

SEQ ID NO: 3291427 - DNA, 18 bp, Homo sapiens
cccgcaccccggcctcag

SEQ ID NO: 3291428 - DNA, 14 bp, Homo sapiens
cccgcagacctccc

SEQ ID NO: 3291429 - DNA, 19 bp, Homo sapiens
cccgcagacctccccagcc

SEQ ID NO: 3291430 - DNA, 18 bp, Homo sapiens
cccgcaggaactgggctg

SEQ ID NO: 3291431 - DNA, 22 bp, Homo sapiens
cccgcaggaactgggctgggcc

SEQ ID NO: 3291432 - DNA, 14 bp, Homo sapiens
cccgcagtccccag

SEQ ID NO: 3291433 - DNA, 21 bp, Homo sapiens
cccgcagtgctgggaccagag

SEQ ID NO: 3291434 - DNA, 22 bp, Homo sapiens
cccgcagtgctgggaccagagc

SEQ ID NO: 3291435 - DNA, 24 bp, Homo sapiens
cccgcagtgctgggaccagagcca

SEQ ID NO: 3291436 - DNA, 15 bp, Homo sapiens
cccgccacctcaggg

SEQ ID NO: 3291437 - DNA, 16 bp, Homo sapiens
cccgccacctcagggc

SEQ ID NO: 3291438 - DNA, 11 bp, Homo sapiens
cccgccagggc

SEQ ID NO: 3291439 - DNA, 12 bp, Homo sapiens
cccgccagggct

SEQ ID NO: 3291440 - DNA, 13 bp, Homo sapiens
cccgcccagctgc

SEQ ID NO: 3291441 - DNA, 15 bp, Homo sapiens
cccgcccctgcagca

SEQ ID NO: 3291442 - DNA, 17 bp, Homo sapiens
cccgcccctgcagcacg

SEQ ID NO: 3291443 - DNA, 13 bp, Homo sapiens
cccgccctcaggc

SEQ ID NO: 3291444 - DNA, 16 bp, Homo sapiens
cccgccgcctcccacg

SEQ ID NO: 3291445 - DNA, 19 bp, Homo sapiens
cccgccgcttttctcctct

SEQ ID NO: 3291446 - DNA, 13 bp, Homo sapiens
cccgcctctcccg

SEQ ID NO: 3291447 - DNA, 21 bp, Homo sapiens
cccgcctctcccgtcagggcc

SEQ ID NO: 3291448 - DNA, 12 bp, Homo sapiens
cccgcctgccct

SEQ ID NO: 3291449 - DNA, 21 bp, Homo sapiens
cccgcctggccagggcagggc

SEQ ID NO: 3291450 - DNA, 16 bp, Homo sapiens
cccgcggtgctctggc

SEQ ID NO: 3291451 - DNA, 13 bp, Homo sapiens
cccgctaaggaag

SEQ ID NO: 3291452 - DNA, 13 bp, Homo sapiens
cccgctcagccct

SEQ ID NO: 3291453 - DNA, 19 bp, Homo sapiens
cccgctcagccctccctgc

SEQ ID NO: 3291454 - DNA, 23 bp, Homo sapiens
cccgctcagccctccctgcccct

SEQ ID NO: 3291455 - DNA, 18 bp, Homo sapiens
cccgctgagctgagtggc

SEQ ID NO: 3291456 - DNA, 19 bp, Homo sapiens
cccgctgcaatgcctagac

SEQ ID NO: 3291457 - DNA, 21 bp, Homo sapiens
cccgctgggatttcttcgctg

SEQ ID NO: 3291458 - DNA, 19 bp, Homo sapiens
cccggagattggacggcct

SEQ ID NO: 3291459 - DNA, 15 bp, Homo sapiens
cccggagcacagccc

SEQ ID NO: 3291460 - DNA, 17 bp, Homo sapiens
cccggagcacagccctg

SEQ ID NO: 3291461 - DNA, 18 bp, Homo sapiens
cccggagcacagccctgg

SEQ ID NO: 3291462 - DNA, 14 bp, Homo sapiens
cccggaggaaatct

SEQ ID NO: 3291463 - DNA, 15 bp, Homo sapiens
cccggaggaaatctg

SEQ ID NO: 3291464 - DNA, 16 bp, Homo sapiens
cccggaggaaatctgc

SEQ ID NO: 3291465 - DNA, 18 bp, Homo sapiens
cccggaggggcctggcag

SEQ ID NO: 3291466 - DNA, 14 bp, Homo sapiens
cccggatcagagca

SEQ ID NO: 3291467 - DNA, 19 bp, Homo sapiens
cccggcaccctctggccgc

SEQ ID NO: 3291468 - DNA, 13 bp, Homo sapiens
cccggcaggccct

SEQ ID NO: 3291469 - DNA, 14 bp, Homo sapiens
cccggcaggccctg

SEQ ID NO: 3291470 - DNA, 15 bp, Homo sapiens
cccggcaggccctgc

SEQ ID NO: 3291471 - DNA, 16 bp, Homo sapiens
cccggcaggccctgca

SEQ ID NO: 3291472 - DNA, 19 bp, Homo sapiens
cccggcaggccctgcagtg

SEQ ID NO: 3291473 - DNA, 14 bp, Homo sapiens
cccggccacctctg

SEQ ID NO: 3291474 - DNA, 21 bp, Homo sapiens
cccggccacctctgcggaccc

SEQ ID NO: 3291475 - DNA, 17 bp, Homo sapiens
cccggccagcgggcaca

SEQ ID NO: 3291476 - DNA, 19 bp, Homo sapiens
cccggccagcgggcacagg

SEQ ID NO: 3291477 - DNA, 14 bp, Homo sapiens
cccggccccagcca

SEQ ID NO: 3291478 - DNA, 15 bp, Homo sapiens
cccggccccagccag

SEQ ID NO: 3291479 - DNA, 16 bp, Homo sapiens
cccggccccagccaga

SEQ ID NO: 3291480 - DNA, 14 bp, Homo sapiens
cccggccggcctgg

SEQ ID NO: 3291481 - DNA, 12 bp, Homo sapiens
cccggcctcagg

SEQ ID NO: 3291482 - DNA, 16 bp, Homo sapiens
cccggcctcagggcgc

SEQ ID NO: 3291483 - DNA, 22 bp, Homo sapiens
cccggcctcctcggagagcagc

SEQ ID NO: 3291484 - DNA, 11 bp, Homo sapiens
cccggcctctt

SEQ ID NO: 3291485 - DNA, 15 bp, Homo sapiens
cccggcctcttccac

SEQ ID NO: 3291486 - DNA, 20 bp, Homo sapiens
cccggcctgctcccagcagc

SEQ ID NO: 3291487 - DNA, 14 bp, Homo sapiens
cccggcgccgggca

SEQ ID NO: 3291488 - DNA, 16 bp, Homo sapiens
cccggcgccgggcacc

SEQ ID NO: 3291489 - DNA, 12 bp, Homo sapiens
cccggctccagg

SEQ ID NO: 3291490 - DNA, 22 bp, Homo sapiens
cccggctcgagcagtcctgcct

SEQ ID NO: 3291491 - DNA, 16 bp, Homo sapiens
cccggctgcagaggcc

SEQ ID NO: 3291492 - DNA, 14 bp, Homo sapiens
cccggctgcctgcc

SEQ ID NO: 3291493 - DNA, 15 bp, Homo sapiens
cccggcttcctgtgc

SEQ ID NO: 3291494 - DNA, 20 bp, Homo sapiens
cccgggacccacggagccct

SEQ ID NO: 3291495 - DNA, 23 bp, Homo sapiens
cccgggacgcaggggttgcagtg

SEQ ID NO: 3291496 - DNA, 16 bp, Homo sapiens
cccgggcaaagggtct

SEQ ID NO: 3291497 - DNA, 22 bp, Homo sapiens
cccggggaaaggcaaggtccgg

SEQ ID NO: 3291498 - DNA, 16 bp, Homo sapiens
cccggggacccccaac

SEQ ID NO: 3291499 - DNA, 16 bp, Homo sapiens
cccggggaccctgtga

SEQ ID NO: 3291500 - DNA, 17 bp, Homo sapiens
cccggggccagagacat

SEQ ID NO: 3291501 - DNA, 17 bp, Homo sapiens
cccggtcccgagtacag

SEQ ID NO: 3291502 - DNA, 13 bp, Homo sapiens
cccggtggcggca

SEQ ID NO: 3291503 - DNA, 18 bp, Homo sapiens
cccggtggcggcagggcc

SEQ ID NO: 3291504 - DNA, 21 bp, Homo sapiens
cccgtacctcttcccatgact

SEQ ID NO: 3291505 - DNA, 15 bp, Homo sapiens
cccgtcctgcctgtg

SEQ ID NO: 3291506 - DNA, 17 bp, Homo sapiens
cccgtcctgcctgtggc

SEQ ID NO: 3291507 - DNA, 17 bp, Homo sapiens
cccgtctggcccaccag

SEQ ID NO: 3291508 - DNA, 14 bp, Homo sapiens
cccgtgaagcagtg

SEQ ID NO: 3291509 - DNA, 18 bp, Homo sapiens
cccgtgaagcagtgcctc

SEQ ID NO: 3291510 - DNA, 19 bp, Homo sapiens
cccgtgaagcagtgcctcg

SEQ ID NO: 3291511 - DNA, 17 bp, Homo sapiens
cccgtgcagtacaggca

SEQ ID NO: 3291512 - DNA, 19 bp, Homo sapiens
cccgtggccatccctgtga

SEQ ID NO: 3291513 - DNA, 12 bp, Homo sapiens
cccgtggtctct

SEQ ID NO: 3291514 - DNA, 16 bp, Homo sapiens
cccgttccctgtcaga

SEQ ID NO: 3291515 - DNA, 20 bp, Homo sapiens
ccctcgacagcgcccctgct

SEQ ID NO: 3291516 - DNA, 17 bp, Homo sapiens
ccctcgatcatatttcc

SEQ ID NO: 3291517 - DNA, 17 bp, Homo sapiens
ccctcggaagccgtctg

SEQ ID NO: 3291518 - DNA, 23 bp, Homo sapiens
ccctcggaagccgtctgactcca

SEQ ID NO: 3291519 - DNA, 17 bp, Homo sapiens
ccctcgggaagcagcca

SEQ ID NO: 3291520 - DNA, 19 bp, Homo sapiens
ccctcgggccccatcctca

SEQ ID NO: 3291521 - DNA, 20 bp, Homo sapiens
ccctcggggggtcacaggcc

SEQ ID NO: 3291522 - DNA, 14 bp, Homo sapiens
ccctcggtggctgc

SEQ ID NO: 3291523 - DNA, 16 bp, Homo sapiens
ccctcggtggctgcac

SEQ ID NO: 3291524 - DNA, 19 bp, Homo sapiens
ccctcgtccacaggggcag

SEQ ID NO: 3291525 - DNA, 23 bp, Homo sapiens
ccctcgtccacaggggcaggcct

SEQ ID NO: 3291526 - DNA, 16 bp, Homo sapiens
ccctcgtcctgtccca

SEQ ID NO: 3291527 - DNA, 20 bp, Homo sapiens
ccctcgtggccagcccggct

SEQ ID NO: 3291528 - DNA, 18 bp, Homo sapiens
ccctcgtggtccccaaca

SEQ ID NO: 3291529 - DNA, 22 bp, Homo sapiens
ccctcgtgtcagctcaggcagc

SEQ ID NO: 3291530 - DNA, 13 bp, Homo sapiens
ccctctatttatt

SEQ ID NO: 3291531 - DNA, 23 bp, Homo sapiens
ccctctcagaggcctgctgccag

SEQ ID NO: 3291532 - DNA, 13 bp, Homo sapiens
ccctctcagctcc

SEQ ID NO: 3291533 - DNA, 12 bp, Homo sapiens
ccctctcctgcc

SEQ ID NO: 3291534 - DNA, 11 bp, Homo sapiens
ccctctcctgt

SEQ ID NO: 3291535 - DNA, 17 bp, Homo sapiens
ccctctctcttctgctc

SEQ ID NO: 3291536 - DNA, 18 bp, Homo sapiens
ccctctctcttctgctcc

SEQ ID NO: 3291537 - DNA, 22 bp, Homo sapiens
ccctctctcttctgctccaccc

SEQ ID NO: 3291538 - DNA, 10 bp, Homo sapiens
ccctctctgc

SEQ ID NO: 3291539 - DNA, 20 bp, Homo sapiens
ccctctctgcagacttccca

SEQ ID NO: 3291540 - DNA, 13 bp, Homo sapiens
ccctctctgctcc

SEQ ID NO: 3291541 - DNA, 14 bp, Homo sapiens
ccctctctgctcct

SEQ ID NO: 3291542 - DNA, 18 bp, Homo sapiens
ccctctctgctccttcac

SEQ ID NO: 3291543 - DNA, 10 bp, Homo sapiens
ccctctgagg

SEQ ID NO: 3291544 - DNA, 12 bp, Homo sapiens
ccctctgcagaa

SEQ ID NO: 3291545 - DNA, 9 bp, Homo sapiens
ccctctgcc

SEQ ID NO: 3291546 - DNA, 19 bp, Homo sapiens
ccctctgccaccagagacc

SEQ ID NO: 3291547 - DNA, 17 bp, Homo sapiens
ccctctgccccaagcag

SEQ ID NO: 3291548 - DNA, 20 bp, Homo sapiens
ccctctgccccaagcagcca

SEQ ID NO: 3291549 - DNA, 20 bp, Homo sapiens
ccctctgccggtcgggcagc

SEQ ID NO: 3291550 - DNA, 22 bp, Homo sapiens
ccctctgccggtcgggcagcca

SEQ ID NO: 3291551 - DNA, 22 bp, Homo sapiens
ccctctggaggggtgtggctcc

SEQ ID NO: 3291552 - DNA, 12 bp, Homo sapiens
ccctctggcttc

SEQ ID NO: 3291553 - DNA, 15 bp, Homo sapiens
ccctctggcttccca

SEQ ID NO: 3291554 - DNA, 18 bp, Homo sapiens
ccctctgtgtatttgctt

SEQ ID NO: 3291555 - DNA, 20 bp, Homo sapiens
ccctctgtgtatttgctttt

SEQ ID NO: 3291556 - DNA, 11 bp, Homo sapiens
ccctcttcctg

SEQ ID NO: 3291557 - DNA, 15 bp, Homo sapiens
ccctcttcctgacga

SEQ ID NO: 3291558 - DNA, 15 bp, Homo sapiens
ccctcttcctgtgat

SEQ ID NO: 3291559 - DNA, 21 bp, Homo sapiens
ccctcttcggtgttcttcttc

SEQ ID NO: 3291560 - DNA, 21 bp, Homo sapiens
ccctcttcttctttccttcca

SEQ ID NO: 3291561 - DNA, 12 bp, Homo sapiens
ccctcttgtaag

SEQ ID NO: 3291562 - DNA, 21 bp, Homo sapiens
ccctcttgtccctttccctac

SEQ ID NO: 3291563 - DNA, 16 bp, Homo sapiens
ccctctttccctgcga

SEQ ID NO: 3291564 - DNA, 18 bp, Homo sapiens
ccctctttccctgcgaga

SEQ ID NO: 3291565 - DNA, 21 bp, Homo sapiens
ccctctttggctcccctgtac

SEQ ID NO: 3291566 - DNA, 12 bp, Homo sapiens
ccctgaaacacg

SEQ ID NO: 3291567 - DNA, 19 bp, Homo sapiens
ccctgaaacacgaaacttg

SEQ ID NO: 3291568 - DNA, 21 bp, Homo sapiens
ccctgaaacctagtactgccc

SEQ ID NO: 3291569 - DNA, 17 bp, Homo sapiens
ccctgaagccagccttc

SEQ ID NO: 3291570 - DNA, 20 bp, Homo sapiens
ccctgaatggttccatgcct

SEQ ID NO: 3291571 - DNA, 22 bp, Homo sapiens
ccctgacctcccagccctatgg

SEQ ID NO: 3291572 - DNA, 15 bp, Homo sapiens
ccctgacctccgccc

SEQ ID NO: 3291573 - DNA, 16 bp, Homo sapiens
ccctgagatcccctga

SEQ ID NO: 3291574 - DNA, 22 bp, Homo sapiens
ccctgagcgcctggatttctgg

SEQ ID NO: 3291575 - DNA, 22 bp, Homo sapiens
ccctgaggaaggaggggaagct

SEQ ID NO: 3291576 - DNA, 14 bp, Homo sapiens
ccctgaggactgga

SEQ ID NO: 3291577 - DNA, 18 bp, Homo sapiens
ccctgaggactggagacc

SEQ ID NO: 3291578 - DNA, 16 bp, Homo sapiens
ccctgaggcctagact

SEQ ID NO: 3291579 - DNA, 17 bp, Homo sapiens
ccctgaggcctgaggcc

SEQ ID NO: 3291580 - DNA, 18 bp, Homo sapiens
ccctgaggcctgaggcct

SEQ ID NO: 3291581 - DNA, 20 bp, Homo sapiens
ccctgaggtgaaagggagct

SEQ ID NO: 3291582 - DNA, 19 bp, Homo sapiens
ccctgaggtgtgggggctg

SEQ ID NO: 3291583 - DNA, 21 bp, Homo sapiens
ccctgaggtgtgggggctgca

SEQ ID NO: 3291584 - DNA, 23 bp, Homo sapiens
ccctgaggtgtgggggctgcagc

SEQ ID NO: 3291585 - DNA, 20 bp, Homo sapiens
ccctgagttcatccaggccc

SEQ ID NO: 3291586 - DNA, 17 bp, Homo sapiens
ccctgatcactcccagc

SEQ ID NO: 3291587 - DNA, 18 bp, Homo sapiens
ccctgatcactcccagca

SEQ ID NO: 3291588 - DNA, 20 bp, Homo sapiens
ccctgatgacacccaccctg

SEQ ID NO: 3291589 - DNA, 19 bp, Homo sapiens
ccctgatgtgacattccat

SEQ ID NO: 3291590 - DNA, 17 bp, Homo sapiens
ccctgattgacctgctc

SEQ ID NO: 3291591 - DNA, 22 bp, Homo sapiens
ccctgattgacctgctccgctg

SEQ ID NO: 3291592 - DNA, 16 bp, Homo sapiens
ccctgatttcttgctt

SEQ ID NO: 3291593 - DNA, 18 bp, Homo sapiens
ccctgcaaacagaacagg

SEQ ID NO: 3291594 - DNA, 22 bp, Homo sapiens
ccctgcaaacagaacagggtca

SEQ ID NO: 3291595 - DNA, 24 bp, Homo sapiens
ccctgcaaacagaacagggtcatg

SEQ ID NO: 3291596 - DNA, 21 bp, Homo sapiens
ccctgcaacttccgctgaggg

SEQ ID NO: 3291597 - DNA, 15 bp, Homo sapiens
ccctgcaaggcccac

SEQ ID NO: 3291598 - DNA, 18 bp, Homo sapiens
ccctgcaaggcccacagg

SEQ ID NO: 3291599 - DNA, 21 bp, Homo sapiens
ccctgcaaggcccacaggagg

SEQ ID NO: 3291600 - DNA, 18 bp, Homo sapiens
ccctgcaccctggaaagg

SEQ ID NO: 3291601 - DNA, 13 bp, Homo sapiens
ccctgcacctgct

SEQ ID NO: 3291602 - DNA, 21 bp, Homo sapiens
ccctgcactaaagccagcctg

SEQ ID NO: 3291603 - DNA, 12 bp, Homo sapiens
ccctgcacttgc

SEQ ID NO: 3291604 - DNA, 22 bp, Homo sapiens
ccctgcagcccaaaacccaggg

SEQ ID NO: 3291605 - DNA, 22 bp, Homo sapiens
ccctgcagggccatctgactgc

SEQ ID NO: 3291606 - DNA, 21 bp, Homo sapiens
ccctgcagggcgcccctggga

SEQ ID NO: 3291607 - DNA, 21 bp, Homo sapiens
ccctgcagtgttcgcttggct

SEQ ID NO: 3291608 - DNA, 18 bp, Homo sapiens
ccctgccaagactcctca

SEQ ID NO: 3291609 - DNA, 20 bp, Homo sapiens
ccctgccacatacaggtgct

SEQ ID NO: 3291610 - DNA, 21 bp, Homo sapiens
ccctgccacatacaggtgctc

SEQ ID NO: 3291611 - DNA, 12 bp, Homo sapiens
ccctgccaccct

SEQ ID NO: 3291612 - DNA, 19 bp, Homo sapiens
ccctgccactcactaggcc

SEQ ID NO: 3291613 - DNA, 10 bp, Homo sapiens
ccctgcccaa

SEQ ID NO: 3291614 - DNA, 20 bp, Homo sapiens
ccctgcccaaacccttaact

SEQ ID NO: 3291615 - DNA, 15 bp, Homo sapiens
ccctgcccaggccgg

SEQ ID NO: 3291616 - DNA, 18 bp, Homo sapiens
ccctgcccaggccggcca

SEQ ID NO: 3291617 - DNA, 13 bp, Homo sapiens
ccctgcccatgct

SEQ ID NO: 3291618 - DNA, 12 bp, Homo sapiens
ccctgccccaaa

SEQ ID NO: 3291619 - DNA, 13 bp, Homo sapiens
ccctgccccaaat

SEQ ID NO: 3291620 - DNA, 17 bp, Homo sapiens
ccctgccccagcccaag

SEQ ID NO: 3291621 - DNA, 18 bp, Homo sapiens
ccctgcccccagccccgg

SEQ ID NO: 3291622 - DNA, 15 bp, Homo sapiens
ccctgcccccatctc

SEQ ID NO: 3291623 - DNA, 16 bp, Homo sapiens
ccctgcccccatctcc

SEQ ID NO: 3291624 - DNA, 20 bp, Homo sapiens
ccctgcccccatctccccag

SEQ ID NO: 3291625 - DNA, 22 bp, Homo sapiens
ccctgccccccaaggttctggt

SEQ ID NO: 3291626 - DNA, 16 bp, Homo sapiens
ccctgccccccagcct

SEQ ID NO: 3291627 - DNA, 19 bp, Homo sapiens
ccctgccccccagcctctg

SEQ ID NO: 3291628 - DNA, 18 bp, Homo sapiens
ccctgccccctcccactc

SEQ ID NO: 3291629 - DNA, 20 bp, Homo sapiens
ccctgccccctggctgactg

SEQ ID NO: 3291630 - DNA, 18 bp, Homo sapiens
ccctgccccggaggaagc

SEQ ID NO: 3291631 - DNA, 11 bp, Homo sapiens
ccctgccccta

SEQ ID NO: 3291632 - DNA, 15 bp, Homo sapiens
ccctgcccctaggat

SEQ ID NO: 3291633 - DNA, 23 bp, Homo sapiens
ccctgcccctaggatgctgcagc

SEQ ID NO: 3291634 - DNA, 23 bp, Homo sapiens
ccctgcccctcccttcaaccatt

SEQ ID NO: 3291635 - DNA, 23 bp, Homo sapiens
ccctgcccggtggtttgccatgt

SEQ ID NO: 3291636 - DNA, 17 bp, Homo sapiens
ccctgccctcgtggcca

SEQ ID NO: 3291637 - DNA, 18 bp, Homo sapiens
ccctgccctcgtggccag

SEQ ID NO: 3291638 - DNA, 20 bp, Homo sapiens
ccctgccctcgtggccagcc

SEQ ID NO: 3291639 - DNA, 21 bp, Homo sapiens
ccctgccctcgtggccagccc

SEQ ID NO: 3291640 - DNA, 14 bp, Homo sapiens
ccgccattgccacc

SEQ ID NO: 3291641 - DNA, 14 bp, Homo sapiens
ccgcccacaccctc

SEQ ID NO: 3291642 - DNA, 22 bp, Homo sapiens
ccgcccagctgcacctgccagc

SEQ ID NO: 3291643 - DNA, 17 bp, Homo sapiens
ccgccccagccccttct

SEQ ID NO: 3291644 - DNA, 13 bp, Homo sapiens
ccgcccccagtcc

SEQ ID NO: 3291645 - DNA, 17 bp, Homo sapiens
ccgcccctgcagcacgg

SEQ ID NO: 3291646 - DNA, 18 bp, Homo sapiens
ccgccccttcccttccct

SEQ ID NO: 3291647 - DNA, 13 bp, Homo sapiens
ccgcccgaccagg

SEQ ID NO: 3291648 - DNA, 13 bp, Homo sapiens
ccgccctcctcgg

SEQ ID NO: 3291649 - DNA, 20 bp, Homo sapiens
ccgccctcctcgggccgagg

SEQ ID NO: 3291650 - DNA, 14 bp, Homo sapiens
ccgccctcttcctg

SEQ ID NO: 3291651 - DNA, 18 bp, Homo sapiens
ccgccctgctcctccctg

SEQ ID NO: 3291652 - DNA, 22 bp, Homo sapiens
ccgccctgctcctccctggctg

SEQ ID NO: 3291653 - DNA, 20 bp, Homo sapiens
ccgccgactttgtacccccc

SEQ ID NO: 3291654 - DNA, 13 bp, Homo sapiens
ccgccgccaccag

SEQ ID NO: 3291655 - DNA, 15 bp, Homo sapiens
ccgccgccaccagcc

SEQ ID NO: 3291656 - DNA, 15 bp, Homo sapiens
ccgccgcctcccacg

SEQ ID NO: 3291657 - DNA, 17 bp, Homo sapiens
ccgcctatcccaaacct

SEQ ID NO: 3291658 - DNA, 21 bp, Homo sapiens
ccgcctccctctcagaggcct

SEQ ID NO: 3291659 - DNA, 20 bp, Homo sapiens
ccgcctctcccgtcagggcc

SEQ ID NO: 3291660 - DNA, 14 bp, Homo sapiens
ccgcctgccctcat

SEQ ID NO: 3291661 - DNA, 16 bp, Homo sapiens
ccgcctgccctcatgg

SEQ ID NO: 3291662 - DNA, 22 bp, Homo sapiens
ccgcctgctccctgcacccatg

SEQ ID NO: 3291663 - DNA, 12 bp, Homo sapiens
ccgcctgctcct

SEQ ID NO: 3291664 - DNA, 18 bp, Homo sapiens
ccgcctgctcctcactgg

SEQ ID NO: 3291665 - DNA, 14 bp, Homo sapiens
ccgcctggccagga

SEQ ID NO: 3291666 - DNA, 23 bp, Homo sapiens
ccgcctggccaggagcaggcacg

SEQ ID NO: 3291667 - DNA, 23 bp, Homo sapiens
ccgcctgtctctttaagggcatg

SEQ ID NO: 3291668 - DNA, 16 bp, Homo sapiens
ccgccttcctcctcca

SEQ ID NO: 3291669 - DNA, 16 bp, Homo sapiens
ccgccttctcccacat

SEQ ID NO: 3291670 - DNA, 22 bp, Homo sapiens
ccgcctttgggttccatcttgc

SEQ ID NO: 3291671 - DNA, 23 bp, Homo sapiens
ccgcgcctacccttcccgcctcc

SEQ ID NO: 3291672 - DNA, 19 bp, Homo sapiens
ccgcgctcgcccagcagga

SEQ ID NO: 3291673 - DNA, 18 bp, Homo sapiens
ccgcgctctttcttccct

SEQ ID NO: 3291674 - DNA, 21 bp, Homo sapiens
ccgcgggagacagcttctctg

SEQ ID NO: 3291675 - DNA, 12 bp, Homo sapiens
ccgcggtgctct

SEQ ID NO: 3291676 - DNA, 15 bp, Homo sapiens
ccgcggtgctctggc

SEQ ID NO: 3291677 - DNA, 16 bp, Homo sapiens
ccgctacctccctccc

SEQ ID NO: 3291678 - DNA, 13 bp, Homo sapiens
ccgctcagccctc

SEQ ID NO: 3291679 - DNA, 16 bp, Homo sapiens
ccgctcccaccgcccc

SEQ ID NO: 3291680 - DNA, 18 bp, Homo sapiens
ccgctcccgctcccaggt

SEQ ID NO: 3291681 - DNA, 18 bp, Homo sapiens
ccgctctacatcttctgc

SEQ ID NO: 3291682 - DNA, 15 bp, Homo sapiens
ccgctgcaccacggc

SEQ ID NO: 3291683 - DNA, 17 bp, Homo sapiens
ccgctgcagggctccca

SEQ ID NO: 3291684 - DNA, 21 bp, Homo sapiens
ccgctgccaccacgtctgcca

SEQ ID NO: 3291685 - DNA, 22 bp, Homo sapiens
ccgctgccaccacgtctgccag

SEQ ID NO: 3291686 - DNA, 23 bp, Homo sapiens
ccgctgccaccacgtctgccagg

SEQ ID NO: 3291687 - DNA, 20 bp, Homo sapiens
ccgctgccacgttggagaag

SEQ ID NO: 3291688 - DNA, 12 bp, Homo sapiens
ccgctgccagca

SEQ ID NO: 3291689 - DNA, 18 bp, Homo sapiens
ccgctgccagcacagagc

SEQ ID NO: 3291690 - DNA, 13 bp, Homo sapiens
ccgctgccagcct

SEQ ID NO: 3291691 - DNA, 16 bp, Homo sapiens
ccgctgccgctgcacc

SEQ ID NO: 3291692 - DNA, 15 bp, Homo sapiens
ccgctgctccacgcg

SEQ ID NO: 3291693 - DNA, 17 bp, Homo sapiens
ccgctgctccacgcgct

SEQ ID NO: 3291694 - DNA, 20 bp, Homo sapiens
ccgctggccgggggaggtgg

SEQ ID NO: 3291695 - DNA, 23 bp, Homo sapiens
ccgctggctttgggaaagcccag

SEQ ID NO: 3291696 - DNA, 20 bp, Homo sapiens
ccgctgtaagctcctttgtg

SEQ ID NO: 3291697 - DNA, 15 bp, Homo sapiens
ccgctgtgagcccct

SEQ ID NO: 3291698 - DNA, 20 bp, Homo sapiens
ccgctgtgagcccctggtcc

SEQ ID NO: 3291699 - DNA, 17 bp, Homo sapiens
ccgcttcacccctgcac

SEQ ID NO: 3291700 - DNA, 16 bp, Homo sapiens
ccgcttccctcctgcc

SEQ ID NO: 3291701 - DNA, 12 bp, Homo sapiens
ccgcttccttag

SEQ ID NO: 3291702 - DNA, 23 bp, Homo sapiens
ccgcttgaaaagctagtgtacct

SEQ ID NO: 3291703 - DNA, 16 bp, Homo sapiens
ccgcttgtggggaccc

SEQ ID NO: 3291704 - DNA, 13 bp, Homo sapiens
ccgcttttgttct

SEQ ID NO: 3291705 - DNA, 17 bp, Homo sapiens
ccggaaccacagggcca

SEQ ID NO: 3291706 - DNA, 21 bp, Homo sapiens
ccggaaggaggccaaccagcc

SEQ ID NO: 3291707 - DNA, 16 bp, Homo sapiens
ccggacttttctgcaa

SEQ ID NO: 3291708 - DNA, 17 bp, Homo sapiens
ccggagatgtagcaaaa

SEQ ID NO: 3291709 - DNA, 15 bp, Homo sapiens
ccggagcacagccct

SEQ ID NO: 3291710 - DNA, 21 bp, Homo sapiens
ccggagctttcaaagaaggaa

SEQ ID NO: 3291711 - DNA, 17 bp, Homo sapiens
ccggagggaagggacgg

SEQ ID NO: 3291712 - DNA, 16 bp, Homo sapiens
ccggaggggcctggca

SEQ ID NO: 3291713 - DNA, 17 bp, Homo sapiens
ccggaggggcctggcag

SEQ ID NO: 3291714 - DNA, 21 bp, Homo sapiens
ccggaggggcctggcagccgt

SEQ ID NO: 3291715 - DNA, 16 bp, Homo sapiens
ccggaggtcactccac

SEQ ID NO: 3291716 - DNA, 20 bp, Homo sapiens
ccggcacagggtctgctctt

SEQ ID NO: 3291717 - DNA, 15 bp, Homo sapiens
ccggcagcgggcgga

SEQ ID NO: 3291718 - DNA, 20 bp, Homo sapiens
ccggcagcgggcggagggga

SEQ ID NO: 3291719 - DNA, 11 bp, Homo sapiens
ccggcaggccc

SEQ ID NO: 3291720 - DNA, 12 bp, Homo sapiens
ccggcaggccct

SEQ ID NO: 3291721 - DNA, 14 bp, Homo sapiens
ccggcaggccctgc

SEQ ID NO: 3291722 - DNA, 15 bp, Homo sapiens
ccggcaggccctgca

SEQ ID NO: 3291723 - DNA, 20 bp, Homo sapiens
ccggcaggccctgcagtgtt

SEQ ID NO: 3291724 - DNA, 14 bp, Homo sapiens
ccggcatgggaaag

SEQ ID NO: 3291725 - DNA, 18 bp, Homo sapiens
ccggcatgtttccagcag

SEQ ID NO: 3291726 - DNA, 16 bp, Homo sapiens
ccggccaatggaaacc

SEQ ID NO: 3291727 - DNA, 18 bp, Homo sapiens
ccggccaccagatgctga

SEQ ID NO: 3291728 - DNA, 12 bp, Homo sapiens
ccggccacctct

SEQ ID NO: 3291729 - DNA, 15 bp, Homo sapiens
ccggccacctctgcg

SEQ ID NO: 3291730 - DNA, 17 bp, Homo sapiens
ccggccagcgggcacag

SEQ ID NO: 3291731 - DNA, 21 bp, Homo sapiens
ccggccagcgggcacagggca

SEQ ID NO: 3291732 - DNA, 16 bp, Homo sapiens
ccggccatactgcctt

SEQ ID NO: 3291733 - DNA, 16 bp, Homo sapiens
ccggcccagtgccact

SEQ ID NO: 3291734 - DNA, 14 bp, Homo sapiens
ccggcccctggcag

SEQ ID NO: 3291735 - DNA, 20 bp, Homo sapiens
ccggcccctggcagcacagc

SEQ ID NO: 3291736 - DNA, 14 bp, Homo sapiens
ccggccctagccca

SEQ ID NO: 3291737 - DNA, 16 bp, Homo sapiens
ccggccggcctggcac

SEQ ID NO: 3291738 - DNA, 11 bp, Homo sapiens
ccggcctcctc

SEQ ID NO: 3291739 - DNA, 16 bp, Homo sapiens
ccggcctctctggcct

SEQ ID NO: 3291740 - DNA, 21 bp, Homo sapiens
ccggcctctctggcctcccac

SEQ ID NO: 3291741 - DNA, 22 bp, Homo sapiens
ccggcctctctggcctcccacc

SEQ ID NO: 3291742 - DNA, 20 bp, Homo sapiens
ccggcctgctcccagcagcc

SEQ ID NO: 3291743 - DNA, 13 bp, Homo sapiens
ccggcctggcacc

SEQ ID NO: 3291744 - DNA, 23 bp, Homo sapiens
ccggcctgtaatcagctctcctg

SEQ ID NO: 3291745 - DNA, 14 bp, Homo sapiens
ccggcgctgcaggt

SEQ ID NO: 3291746 - DNA, 15 bp, Homo sapiens
ccggcgctgcaggta

SEQ ID NO: 3291747 - DNA, 19 bp, Homo sapiens
ccggctcgtgtatttatta

SEQ ID NO: 3291748 - DNA, 22 bp, Homo sapiens
ccggctcgtgtatttattaccg

SEQ ID NO: 3291749 - DNA, 17 bp, Homo sapiens
ccggctctttccttgct

SEQ ID NO: 3291750 - DNA, 15 bp, Homo sapiens
ccggctgcagaggcc

SEQ ID NO: 3291751 - DNA, 11 bp, Homo sapiens
ccggctggtga

SEQ ID NO: 3291752 - DNA, 23 bp, Homo sapiens
ccggctggttttgtaagatgctg

SEQ ID NO: 3291753 - DNA, 14 bp, Homo sapiens
ccggctgtggagca

SEQ ID NO: 3291754 - DNA, 15 bp, Homo sapiens
ccggctgtggagcaa

SEQ ID NO: 3291755 - DNA, 22 bp, Homo sapiens
ccgggaccaaactcacggacca

SEQ ID NO: 3291756 - DNA, 17 bp, Homo sapiens
ccgggagcctaggacca

SEQ ID NO: 3291757 - DNA, 15 bp, Homo sapiens
ccgggagcctccccc

SEQ ID NO: 3291758 - DNA, 19 bp, Homo sapiens
ccgggagcctccccctcag

SEQ ID NO: 3291759 - DNA, 22 bp, Homo sapiens
ccgggagcctccccctcagatg

SEQ ID NO: 3291760 - DNA, 15 bp, Homo sapiens
ccgggcaaagggtct

SEQ ID NO: 3291761 - DNA, 22 bp, Homo sapiens
ccgggcaaatggctgagatgga

SEQ ID NO: 3291762 - DNA, 18 bp, Homo sapiens
ccgggcaggcgtgactca

SEQ ID NO: 3291763 - DNA, 21 bp, Homo sapiens
ccgggccacgccccagcccga

SEQ ID NO: 3291764 - DNA, 16 bp, Homo sapiens
ccgggcccctgggctt

SEQ ID NO: 3291765 - DNA, 21 bp, Homo sapiens
ccgggcccctgggcttggcct

SEQ ID NO: 3291766 - DNA, 22 bp, Homo sapiens
cctagctttagaccctgggtgg

SEQ ID NO: 3291767 - DNA, 23 bp, Homo sapiens
cctagctttagaccctgggtggg

SEQ ID NO: 3291768 - DNA, 19 bp, Homo sapiens
cctaggaccactcagcccc

SEQ ID NO: 3291769 - DNA, 20 bp, Homo sapiens
cctaggaccactcagcccct

SEQ ID NO: 3291770 - DNA, 21 bp, Homo sapiens
cctaggaccactcagccccta

SEQ ID NO: 3291771 - DNA, 14 bp, Homo sapiens
cctaggagagccaa

SEQ ID NO: 3291772 - DNA, 22 bp, Homo sapiens
cctaggagagtttactgatgaa

SEQ ID NO: 3291773 - DNA, 22 bp, Homo sapiens
cctaggagatatctgagggagg

SEQ ID NO: 3291774 - DNA, 22 bp, Homo sapiens
cctaggagttgagtacagtgag

SEQ ID NO: 3291775 - DNA, 15 bp, Homo sapiens
cctaggatgctgcag

SEQ ID NO: 3291776 - DNA, 17 bp, Homo sapiens
cctaggatgctgcagca

SEQ ID NO: 3291777 - DNA, 23 bp, Homo sapiens
cctaggccaaatgcacaagctca

SEQ ID NO: 3291778 - DNA, 23 bp, Homo sapiens
cctaggccacaccatctcctttc

SEQ ID NO: 3291779 - DNA, 17 bp, Homo sapiens
cctaggctccaccccat

SEQ ID NO: 3291780 - DNA, 14 bp, Homo sapiens
cctagggaaaagtt

SEQ ID NO: 3291781 - DNA, 20 bp, Homo sapiens
cctagggtcttgggggtcag

SEQ ID NO: 3291782 - DNA, 15 bp, Homo sapiens
cctaggtgacagagt

SEQ ID NO: 3291783 - DNA, 18 bp, Homo sapiens
cctaggtgacagagtgag

SEQ ID NO: 3291784 - DNA, 15 bp, Homo sapiens
cctaggtgcagctcc

SEQ ID NO: 3291785 - DNA, 21 bp, Homo sapiens
cctaggtgcagctcctcagcg

SEQ ID NO: 3291786 - DNA, 19 bp, Homo sapiens
cctaggttcccggtcccga

SEQ ID NO: 3291787 - DNA, 21 bp, Homo sapiens
cctaggttccctgttcttcct

SEQ ID NO: 3291788 - DNA, 22 bp, Homo sapiens
cctaggtttttcctactgtcct

SEQ ID NO: 3291789 - DNA, 20 bp, Homo sapiens
cctagtaaaaccttgttcta

SEQ ID NO: 3291790 - DNA, 15 bp, Homo sapiens
cctagtactctctgc

SEQ ID NO: 3291791 - DNA, 23 bp, Homo sapiens
cctagtcaaaactatttttgtaa

SEQ ID NO: 3291792 - DNA, 21 bp, Homo sapiens
cctagtcccttcccctccctg

SEQ ID NO: 3291793 - DNA, 20 bp, Homo sapiens
cctagttccctctgctcagc

SEQ ID NO: 3291794 - DNA, 22 bp, Homo sapiens
cctagttccctctgctcagcca

SEQ ID NO: 3291795 - DNA, 13 bp, Homo sapiens
cctagttctctta

SEQ ID NO: 3291796 - DNA, 14 bp, Homo sapiens
cctagttctcttat

SEQ ID NO: 3291797 - DNA, 15 bp, Homo sapiens
cctagttctcttatc

SEQ ID NO: 3291798 - DNA, 16 bp, Homo sapiens
cctagtttcctctcct

SEQ ID NO: 3291799 - DNA, 18 bp, Homo sapiens
cctataaaattaaatgcc

SEQ ID NO: 3291800 - DNA, 17 bp, Homo sapiens
cctataaagtaaagcta

SEQ ID NO: 3291801 - DNA, 18 bp, Homo sapiens
cctataacttcttcctgc

SEQ ID NO: 3291802 - DNA, 20 bp, Homo sapiens
cctataacttcttcctgctg

SEQ ID NO: 3291803 - DNA, 16 bp, Homo sapiens
cctataagaagcctta

SEQ ID NO: 3291804 - DNA, 22 bp, Homo sapiens
cctataaggagagttcaagcct

SEQ ID NO: 3291805 - DNA, 15 bp, Homo sapiens
cctataatacaaata

SEQ ID NO: 3291806 - DNA, 18 bp, Homo sapiens
cctataatccttgataat

SEQ ID NO: 3291807 - DNA, 17 bp, Homo sapiens
cctataatcttatacaa

SEQ ID NO: 3291808 - DNA, 13 bp, Homo sapiens
cctatagagaggg

SEQ ID NO: 3291809 - DNA, 21 bp, Homo sapiens
cctatagagagggggctctcc

SEQ ID NO: 3291810 - DNA, 14 bp, Homo sapiens
cctatagtcccagc

SEQ ID NO: 3291811 - DNA, 18 bp, Homo sapiens
cctatataataaagctac

SEQ ID NO: 3291812 - DNA, 18 bp, Homo sapiens
cctatatgatttatagtt

SEQ ID NO: 3291813 - DNA, 18 bp, Homo sapiens
cctatattgttttcagtg

SEQ ID NO: 3291814 - DNA, 17 bp, Homo sapiens
cctatcacctatttcca

SEQ ID NO: 3291815 - DNA, 20 bp, Homo sapiens
cctatcatttattctgcttc

SEQ ID NO: 3291816 - DNA, 13 bp, Homo sapiens
cctatcccacctc

SEQ ID NO: 3291817 - DNA, 14 bp, Homo sapiens
cctatccctctcct

SEQ ID NO: 3291818 - DNA, 17 bp, Homo sapiens
cctatccgctgccagcc

SEQ ID NO: 3291819 - DNA, 15 bp, Homo sapiens
cctatcctcactgcc

SEQ ID NO: 3291820 - DNA, 13 bp, Homo sapiens
cctatccttggca

SEQ ID NO: 3291821 - DNA, 16 bp, Homo sapiens
cctatccttggcacca

SEQ ID NO: 3291822 - DNA, 19 bp, Homo sapiens
cctatccttggcaccaaag

SEQ ID NO: 3291823 - DNA, 22 bp, Homo sapiens
cctatcgccccctacgcgcctt

SEQ ID NO: 3291824 - DNA, 18 bp, Homo sapiens
cctatctaaccctcccat

SEQ ID NO: 3291825 - DNA, 16 bp, Homo sapiens
cctatctatcttccaa

SEQ ID NO: 3291826 - DNA, 18 bp, Homo sapiens
cctatctcgtgggagagc

SEQ ID NO: 3291827 - DNA, 16 bp, Homo sapiens
cctatctggggagctc

SEQ ID NO: 3291828 - DNA, 21 bp, Homo sapiens
cctatctggggagctcctggc

SEQ ID NO: 3291829 - DNA, 22 bp, Homo sapiens
cctatgaagttggcacatttca

SEQ ID NO: 3291830 - DNA, 17 bp, Homo sapiens
cctatgatattttctgt

SEQ ID NO: 3291831 - DNA, 15 bp, Homo sapiens
cctatgatggatggc

SEQ ID NO: 3291832 - DNA, 20 bp, Homo sapiens
cctatgcacatatggactct

SEQ ID NO: 3291833 - DNA, 16 bp, Homo sapiens
cctatgcccaggtacc

SEQ ID NO: 3291834 - DNA, 13 bp, Homo sapiens
cctatggaaaaaa

SEQ ID NO: 3291835 - DNA, 14 bp, Homo sapiens
cctatggagaattt

SEQ ID NO: 3291836 - DNA, 23 bp, Homo sapiens
cctatggctggccactgcacaga

SEQ ID NO: 3291837 - DNA, 20 bp, Homo sapiens
cctatgtcctaaggacacac

SEQ ID NO: 3291838 - DNA, 23 bp, Homo sapiens
cctatgtttgtctcacttttcat

SEQ ID NO: 3291839 - DNA, 16 bp, Homo sapiens
cctattcaccctccac

SEQ ID NO: 3291840 - DNA, 17 bp, Homo sapiens
cctattcaccctccact

SEQ ID NO: 3291841 - DNA, 22 bp, Homo sapiens
cctattcccacacctccacagt

SEQ ID NO: 3291842 - DNA, 16 bp, Homo sapiens
cctattctataaaact

SEQ ID NO: 3291843 - DNA, 15 bp, Homo sapiens
cctattttcatttgt

SEQ ID NO: 3291844 - DNA, 16 bp, Homo sapiens
cctattttcatttgta

SEQ ID NO: 3291845 - DNA, 14 bp, Homo sapiens
cctatttttgtaaa

SEQ ID NO: 3291846 - DNA, 13 bp, Homo sapiens
cctcaaacctcct

SEQ ID NO: 3291847 - DNA, 18 bp, Homo sapiens
cctcaaacctcctcttct

SEQ ID NO: 3291848 - DNA, 17 bp, Homo sapiens
cctcaaactcattgcag

SEQ ID NO: 3291849 - DNA, 14 bp, Homo sapiens
cctcaaagaaagtg

SEQ ID NO: 3291850 - DNA, 15 bp, Homo sapiens
cctcaacaagggaga

SEQ ID NO: 3291851 - DNA, 18 bp, Homo sapiens
cctcaacaagggagagac

SEQ ID NO: 3291852 - DNA, 19 bp, Homo sapiens
cctcaacagccaagtgtga

SEQ ID NO: 3291853 - DNA, 16 bp, Homo sapiens
cctcaacaggcccagg

SEQ ID NO: 3291854 - DNA, 15 bp, Homo sapiens
cctcaacctcctggg

SEQ ID NO: 3291855 - DNA, 18 bp, Homo sapiens
cctcaagccaatcccctc

SEQ ID NO: 3291856 - DNA, 20 bp, Homo sapiens
cctcaagccccagcagccct

SEQ ID NO: 3291857 - DNA, 13 bp, Homo sapiens
cctcaagccctga

SEQ ID NO: 3291858 - DNA, 13 bp, Homo sapiens
cctcaaggacttg

SEQ ID NO: 3291859 - DNA, 23 bp, Homo sapiens
cctcaaggttttaggttctaaag

SEQ ID NO: 3291860 - DNA, 16 bp, Homo sapiens
cctcaagtaaaagaaa

SEQ ID NO: 3291861 - DNA, 16 bp, Homo sapiens
cctcaagtagcactga

SEQ ID NO: 3291862 - DNA, 23 bp, Homo sapiens
cctcaagtgattctcctgcctca

SEQ ID NO: 3291863 - DNA, 13 bp, Homo sapiens
cctcaatgtttga

SEQ ID NO: 3291864 - DNA, 21 bp, Homo sapiens
cctcaatttttgtctcagaag

SEQ ID NO: 3291865 - DNA, 21 bp, Homo sapiens
cctcacaagcgctcccagcct

SEQ ID NO: 3291866 - DNA, 15 bp, Homo sapiens
cctcacacacacagc

SEQ ID NO: 3291867 - DNA, 15 bp, Homo sapiens
cctcacagcctctga

SEQ ID NO: 3291868 - DNA, 20 bp, Homo sapiens
cctcacagcctctgacccct

SEQ ID NO: 3291869 - DNA, 24 bp, Homo sapiens
cctcacagtgacccttcccaatca

SEQ ID NO: 3291870 - DNA, 21 bp, Homo sapiens
cctcacatagctacccaaaag

SEQ ID NO: 3291871 - DNA, 16 bp, Homo sapiens
cctcacccacccctgc

SEQ ID NO: 3291872 - DNA, 21 bp, Homo sapiens
cctcacccacccctgcacagt

SEQ ID NO: 3291873 - DNA, 17 bp, Homo sapiens
cctcacccccagctttg

SEQ ID NO: 3291874 - DNA, 24 bp, Homo sapiens
cctcaccccctcctggcaatcaat

SEQ ID NO: 3291875 - DNA, 19 bp, Homo sapiens
cctcacccctgtcctcact

SEQ ID NO: 3291876 - DNA, 23 bp, Homo sapiens
cctcacctcatgcccaccccctg

SEQ ID NO: 3291877 - DNA, 13 bp, Homo sapiens
cctcacctctacc

SEQ ID NO: 3291878 - DNA, 14 bp, Homo sapiens
cctcacctctaccc

SEQ ID NO: 3291879 - DNA, 17 bp, Homo sapiens
cctcacctttcccatct

SEQ ID NO: 3291880 - DNA, 13 bp, Homo sapiens
cctcacgctgggt

SEQ ID NO: 3291881 - DNA, 22 bp, Homo sapiens
cctcactactacatctgtgatg

SEQ ID NO: 3291882 - DNA, 21 bp, Homo sapiens
cctcactatggtatgctggcc

SEQ ID NO: 3291883 - DNA, 22 bp, Homo sapiens
cctcactatggtatgctggcca

SEQ ID NO: 3291884 - DNA, 16 bp, Homo sapiens
cctcactccacagagt

SEQ ID NO: 3291885 - DNA, 12 bp, Homo sapiens
cctcactcctgt

SEQ ID NO: 3291886 - DNA, 13 bp, Homo sapiens
cctcactctgcca

SEQ ID NO: 3291887 - DNA, 19 bp, Homo sapiens
cctcactctgtcagccagc

SEQ ID NO: 3291888 - DNA, 22 bp, Homo sapiens
cctcactctgtcagccagccgc

SEQ ID NO: 3291889 - DNA, 18 bp, Homo sapiens
cctcactctgtccctgtc

SEQ ID NO: 3291890 - DNA, 13 bp, Homo sapiens
cctcactgagagg

SEQ ID NO: 3291891 - DNA, 17 bp, Homo sapiens
cctctcaagctagccag

SEQ ID NO: 3291892 - DNA, 13 bp, Homo sapiens
cctctcacacaca

SEQ ID NO: 3291893 - DNA, 14 bp, Homo sapiens
cctctcacacacat

SEQ ID NO: 3291894 - DNA, 16 bp, Homo sapiens
cctctcactaaacttt

SEQ ID NO: 3291895 - DNA, 14 bp, Homo sapiens
cctctcactcccca

SEQ ID NO: 3291896 - DNA, 20 bp, Homo sapiens
cctctcactccccagcccca

SEQ ID NO: 3291897 - DNA, 14 bp, Homo sapiens
cctctcactcctgc

SEQ ID NO: 3291898 - DNA, 19 bp, Homo sapiens
cctctcagaggcctgctgc

SEQ ID NO: 3291899 - DNA, 16 bp, Homo sapiens
cctctcagctccaggt

SEQ ID NO: 3291900 - DNA, 15 bp, Homo sapiens
cctctcagggcctgg

SEQ ID NO: 3291901 - DNA, 17 bp, Homo sapiens
cctctcagggcctggca

SEQ ID NO: 3291902 - DNA, 22 bp, Homo sapiens
cctctcagttctctcccttcct

SEQ ID NO: 3291903 - DNA, 12 bp, Homo sapiens
cctctccactgc

SEQ ID NO: 3291904 - DNA, 14 bp, Homo sapiens
cctctccactgcct

SEQ ID NO: 3291905 - DNA, 16 bp, Homo sapiens
cctctccactgccttc

SEQ ID NO: 3291906 - DNA, 13 bp, Homo sapiens
cctctccaggcac

SEQ ID NO: 3291907 - DNA, 18 bp, Homo sapiens
cctctccagtttgcacct

SEQ ID NO: 3291908 - DNA, 19 bp, Homo sapiens
cctctccagtttgcacctg

SEQ ID NO: 3291909 - DNA, 20 bp, Homo sapiens
cctctccagtttgcacctgt

SEQ ID NO: 3291910 - DNA, 20 bp, Homo sapiens
cctctccatatctccttccc

SEQ ID NO: 3291911 - DNA, 23 bp, Homo sapiens
cctctcccacagagtgctggact

SEQ ID NO: 3291912 - DNA, 18 bp, Homo sapiens
cctctcccaggcccgaga

SEQ ID NO: 3291913 - DNA, 12 bp, Homo sapiens
cctctcccatca

SEQ ID NO: 3291914 - DNA, 18 bp, Homo sapiens
cctctcccatccccctgc

SEQ ID NO: 3291915 - DNA, 19 bp, Homo sapiens
cctctcccatccccctgcc

SEQ ID NO: 3291916 - DNA, 19 bp, Homo sapiens
cctctccccattcggtgtg

SEQ ID NO: 3291917 - DNA, 16 bp, Homo sapiens
cctctcccctccagcc

SEQ ID NO: 3291918 - DNA, 17 bp, Homo sapiens
cctctcccctccagcct

SEQ ID NO: 3291919 - DNA, 12 bp, Homo sapiens
cctctcccggct

SEQ ID NO: 3291920 - DNA, 14 bp, Homo sapiens
cctctcccggctgc

SEQ ID NO: 3291921 - DNA, 18 bp, Homo sapiens
cctctcccggctgcctgc

SEQ ID NO: 3291922 - DNA, 20 bp, Homo sapiens
cctctcccggctgcctgccg

SEQ ID NO: 3291923 - DNA, 22 bp, Homo sapiens
cctctcccgtcagggcccaagt

SEQ ID NO: 3291924 - DNA, 23 bp, Homo sapiens
cctctcccgtcagggcccaagtc

SEQ ID NO: 3291925 - DNA, 11 bp, Homo sapiens
cctctccctca

SEQ ID NO: 3291926 - DNA, 14 bp, Homo sapiens
cctctccctgccaa

SEQ ID NO: 3291927 - DNA, 13 bp, Homo sapiens
cctctcctgccca

SEQ ID NO: 3291928 - DNA, 16 bp, Homo sapiens
cctctcctgcccagat

SEQ ID NO: 3291929 - DNA, 12 bp, Homo sapiens
cctctcctgggg

SEQ ID NO: 3291930 - DNA, 14 bp, Homo sapiens
cctctcctgggggt

SEQ ID NO: 3291931 - DNA, 15 bp, Homo sapiens
cctctcgagcccaga

SEQ ID NO: 3291932 - DNA, 16 bp, Homo sapiens
cctctcgagcccagat

SEQ ID NO: 3291933 - DNA, 20 bp, Homo sapiens
cctctcgctcctcaacccct

SEQ ID NO: 3291934 - DNA, 21 bp, Homo sapiens
cctctcggaaggctggctggg

SEQ ID NO: 3291935 - DNA, 14 bp, Homo sapiens
cctctctagaacct

SEQ ID NO: 3291936 - DNA, 15 bp, Homo sapiens
cctctctcagagcat

SEQ ID NO: 3291937 - DNA, 21 bp, Homo sapiens
cctctctcagagcatctggct

SEQ ID NO: 3291938 - DNA, 22 bp, Homo sapiens
cctctctcagagcatctggctg

SEQ ID NO: 3291939 - DNA, 19 bp, Homo sapiens
cctctctcaggagtatctt

SEQ ID NO: 3291940 - DNA, 22 bp, Homo sapiens
cctctctgatcttgtgctcagc

SEQ ID NO: 3291941 - DNA, 17 bp, Homo sapiens
cctctctgcagacttcc

SEQ ID NO: 3291942 - DNA, 22 bp, Homo sapiens
cctctctgcagacttcccagct

SEQ ID NO: 3291943 - DNA, 13 bp, Homo sapiens
cctctctgcccct

SEQ ID NO: 3291944 - DNA, 13 bp, Homo sapiens
cctctctgctcct

SEQ ID NO: 3291945 - DNA, 13 bp, Homo sapiens
cctctctggcctc

SEQ ID NO: 3291946 - DNA, 16 bp, Homo sapiens
cctctctggcctccca

SEQ ID NO: 3291947 - DNA, 19 bp, Homo sapiens
cctctctggcctcccaccc

SEQ ID NO: 3291948 - DNA, 12 bp, Homo sapiens
cctctctgggcc

SEQ ID NO: 3291949 - DNA, 13 bp, Homo sapiens
cctctctgggcct

SEQ ID NO: 3291950 - DNA, 22 bp, Homo sapiens
cctctctggtttcctatttgca

SEQ ID NO: 3291951 - DNA, 23 bp, Homo sapiens
cctctctggtttcctatttgcag

SEQ ID NO: 3291952 - DNA, 12 bp, Homo sapiens
cctctctgtccc

SEQ ID NO: 3291953 - DNA, 13 bp, Homo sapiens
cctctcttgcacc

SEQ ID NO: 3291954 - DNA, 23 bp, Homo sapiens
cctctcttgcacccgcctctccc

SEQ ID NO: 3291955 - DNA, 18 bp, Homo sapiens
cctctctttgttctcagc

SEQ ID NO: 3291956 - DNA, 20 bp, Homo sapiens
cctctctttgttctcagctc

SEQ ID NO: 3291957 - DNA, 18 bp, Homo sapiens
cctctgaaaagtgtgtat

SEQ ID NO: 3291958 - DNA, 19 bp, Homo sapiens
cctctgacacacagctctg

SEQ ID NO: 3291959 - DNA, 18 bp, Homo sapiens
cctctgacccctcctcac

SEQ ID NO: 3291960 - DNA, 19 bp, Homo sapiens
cctctgacccctcctcact

SEQ ID NO: 3291961 - DNA, 20 bp, Homo sapiens
cctctgacccctcctcactg

SEQ ID NO: 3291962 - DNA, 22 bp, Homo sapiens
cctctgaccctagctctttcct

SEQ ID NO: 3291963 - DNA, 14 bp, Homo sapiens
cctctgacctgcac

SEQ ID NO: 3291964 - DNA, 16 bp, Homo sapiens
cctctgacctgcactg

SEQ ID NO: 3291965 - DNA, 17 bp, Homo sapiens
cctctgacctgcaggcc

SEQ ID NO: 3291966 - DNA, 14 bp, Homo sapiens
cctctgactctgag

SEQ ID NO: 3291967 - DNA, 17 bp, Homo sapiens
cctctgagcccaagcta

SEQ ID NO: 3291968 - DNA, 22 bp, Homo sapiens
cctctgagcccagctgcctgga

SEQ ID NO: 3291969 - DNA, 18 bp, Homo sapiens
cctctgatatgggactga

SEQ ID NO: 3291970 - DNA, 20 bp, Homo sapiens
cctctgcactactgacatgt

SEQ ID NO: 3291971 - DNA, 21 bp, Homo sapiens
cctctgcactactgacatgtg

SEQ ID NO: 3291972 - DNA, 16 bp, Homo sapiens
cctctgcactcccacc

SEQ ID NO: 3291973 - DNA, 19 bp, Homo sapiens
cctctgccaccagagaccg

SEQ ID NO: 3291974 - DNA, 24 bp, Homo sapiens
cctctgccaccagagaccgtcctc

SEQ ID NO: 3291975 - DNA, 20 bp, Homo sapiens
cctctgccccaagcagccag

SEQ ID NO: 3291976 - DNA, 19 bp, Homo sapiens
cctctgcccttcctgcagg

SEQ ID NO: 3291977 - DNA, 20 bp, Homo sapiens
cctctgccggtcgggcagcc

SEQ ID NO: 3291978 - DNA, 23 bp, Homo sapiens
cctctgccggtcgggcagccagc

SEQ ID NO: 3291979 - DNA, 21 bp, Homo sapiens
cctctgcctgaagtcacacag

SEQ ID NO: 3291980 - DNA, 22 bp, Homo sapiens
cctctgcctgaagtcacacagt

SEQ ID NO: 3291981 - DNA, 11 bp, Homo sapiens
cctctgcctgc

SEQ ID NO: 3291982 - DNA, 16 bp, Homo sapiens
cctctgcctgccccgc

SEQ ID NO: 3291983 - DNA, 14 bp, Homo sapiens
cctctgccttcagg

SEQ ID NO: 3291984 - DNA, 17 bp, Homo sapiens
cctctgccttcaggctt

SEQ ID NO: 3291985 - DNA, 19 bp, Homo sapiens
cctctgccttcaggcttct

SEQ ID NO: 3291986 - DNA, 16 bp, Homo sapiens
cctctgcggaccccag

SEQ ID NO: 3291987 - DNA, 17 bp, Homo sapiens
cctctgcggaccccagc

SEQ ID NO: 3291988 - DNA, 18 bp, Homo sapiens
cctctgcggggcagggcc

SEQ ID NO: 3291989 - DNA, 13 bp, Homo sapiens
cctctgctcaccg

SEQ ID NO: 3291990 - DNA, 18 bp, Homo sapiens
cctctgctcaccgcccat

SEQ ID NO: 3291991 - DNA, 12 bp, Homo sapiens
cctctgctcagc

SEQ ID NO: 3291992 - DNA, 14 bp, Homo sapiens
cctctgctccccag

SEQ ID NO: 3291993 - DNA, 13 bp, Homo sapiens
cctctgctccctc

SEQ ID NO: 3291994 - DNA, 18 bp, Homo sapiens
cctctgctcctggagcct

SEQ ID NO: 3291995 - DNA, 14 bp, Homo sapiens
cctctgctgccatg

SEQ ID NO: 3291996 - DNA, 20 bp, Homo sapiens
cctctgctggttcctgactg

SEQ ID NO: 3291997 - DNA, 12 bp, Homo sapiens
cctctggacagt

SEQ ID NO: 3291998 - DNA, 16 bp, Homo sapiens
cctctggacagttgtg

SEQ ID NO: 3291999 - DNA, 22 bp, Homo sapiens
cctctggacggcaggctcactg

SEQ ID NO: 3292000 - DNA, 18 bp, Homo sapiens
cctctggactggctagag

SEQ ID NO: 3292001 - DNA, 15 bp, Homo sapiens
cctctggaggcctct

SEQ ID NO: 3292002 - DNA, 17 bp, Homo sapiens
cctctggaggcctctgg

SEQ ID NO: 3292003 - DNA, 20 bp, Homo sapiens
cctctggaggcctctggccc

SEQ ID NO: 3292004 - DNA, 22 bp, Homo sapiens
cctctggaggcctctggccctc

SEQ ID NO: 3292005 - DNA, 23 bp, Homo sapiens
cctctggcattagaattatttaa

SEQ ID NO: 3292006 - DNA, 15 bp, Homo sapiens
cctctggccaggatg

SEQ ID NO: 3292007 - DNA, 10 bp, Homo sapiens
cctctggccc

SEQ ID NO: 3292008 - DNA, 21 bp, Homo sapiens
cctctggccctcggtggctgc

SEQ ID NO: 3292009 - DNA, 12 bp, Homo sapiens
cctctggccctg

SEQ ID NO: 3292010 - DNA, 14 bp, Homo sapiens
cctctggcccttgg

SEQ ID NO: 3292011 - DNA, 15 bp, Homo sapiens
cctctggcccttgga

SEQ ID NO: 3292012 - DNA, 19 bp, Homo sapiens
cctctggcccttggaataa

SEQ ID NO: 3292013 - DNA, 17 bp, Homo sapiens
cctctggccgcctaggc

SEQ ID NO: 3292014 - DNA, 12 bp, Homo sapiens
cctctggctaga

SEQ ID NO: 3292015 - DNA, 14 bp, Homo sapiens
cctctggcttccca

SEQ ID NO: 3292016 - DNA, 19 bp, Homo sapiens
cctctgggaacctcccaga

SEQ ID NO: 3292017 - DNA, 15 bp, Homo sapiens
cctgctgcccaggct

SEQ ID NO: 3292018 - DNA, 22 bp, Homo sapiens
cctgctgcccaggctgtgcagc

SEQ ID NO: 3292019 - DNA, 17 bp, Homo sapiens
cctgctgccccagctga

SEQ ID NO: 3292020 - DNA, 22 bp, Homo sapiens
cctgctgccccagctgactgtg

SEQ ID NO: 3292021 - DNA, 22 bp, Homo sapiens
cctgctgccgcctcccagcctg

SEQ ID NO: 3292022 - DNA, 23 bp, Homo sapiens
cctgctgccgcctcccagcctgg

SEQ ID NO: 3292023 - DNA, 14 bp, Homo sapiens
cctgctgcgtcccc

SEQ ID NO: 3292024 - DNA, 15 bp, Homo sapiens
cctgctgcgtcccca

SEQ ID NO: 3292025 - DNA, 17 bp, Homo sapiens
cctgctgcgtccccact

SEQ ID NO: 3292026 - DNA, 18 bp, Homo sapiens
cctgctgcgtccccactc

SEQ ID NO: 3292027 - DNA, 19 bp, Homo sapiens
cctgctgcgtccccactcc

SEQ ID NO: 3292028 - DNA, 18 bp, Homo sapiens
cctgctgctgccagggct

SEQ ID NO: 3292029 - DNA, 13 bp, Homo sapiens
cctgctggctgcg

SEQ ID NO: 3292030 - DNA, 18 bp, Homo sapiens
cctgctggctgcggcccc

SEQ ID NO: 3292031 - DNA, 21 bp, Homo sapiens
cctgctggctgcggccccctc

SEQ ID NO: 3292032 - DNA, 20 bp, Homo sapiens
cctgctggggccgccacggc

SEQ ID NO: 3292033 - DNA, 15 bp, Homo sapiens
cctgctgggtaaact

SEQ ID NO: 3292034 - DNA, 17 bp, Homo sapiens
cctgctgggtaaactgt

SEQ ID NO: 3292035 - DNA, 17 bp, Homo sapiens
cctgctggtacctgccc

SEQ ID NO: 3292036 - DNA, 18 bp, Homo sapiens
cctgctggtacctgccct

SEQ ID NO: 3292037 - DNA, 20 bp, Homo sapiens
cctgctggtacctgccctct

SEQ ID NO: 3292038 - DNA, 13 bp, Homo sapiens
cctgctggttcag

SEQ ID NO: 3292039 - DNA, 14 bp, Homo sapiens
cctgctgtagtcct

SEQ ID NO: 3292040 - DNA, 17 bp, Homo sapiens
cctgctgtagtcctttc

SEQ ID NO: 3292041 - DNA, 16 bp, Homo sapiens
cctgctgtcttcccca

SEQ ID NO: 3292042 - DNA, 14 bp, Homo sapiens
cctgctgtgctgct

SEQ ID NO: 3292043 - DNA, 17 bp, Homo sapiens
cctgctgtgctgctcaa

SEQ ID NO: 3292044 - DNA, 23 bp, Homo sapiens
cctgcttaatcttcaaagccttc

SEQ ID NO: 3292045 - DNA, 14 bp, Homo sapiens
cctgcttccaggaa

SEQ ID NO: 3292046 - DNA, 12 bp, Homo sapiens
cctgcttcccac

SEQ ID NO: 3292047 - DNA, 14 bp, Homo sapiens
cctgcttcccacct

SEQ ID NO: 3292048 - DNA, 18 bp, Homo sapiens
cctgcttccccttcctaa

SEQ ID NO: 3292049 - DNA, 19 bp, Homo sapiens
cctgcttccccttcctaag

SEQ ID NO: 3292050 - DNA, 21 bp, Homo sapiens
cctgcttcctgaaataaacac

SEQ ID NO: 3292051 - DNA, 22 bp, Homo sapiens
cctgcttcctgaaataaacact

SEQ ID NO: 3292052 - DNA, 15 bp, Homo sapiens
cctgcttctccagcc

SEQ ID NO: 3292053 - DNA, 16 bp, Homo sapiens
cctgcttctccagcct

SEQ ID NO: 3292054 - DNA, 20 bp, Homo sapiens
cctgcttggcccggccggcc

SEQ ID NO: 3292055 - DNA, 17 bp, Homo sapiens
cctgctttggctgaggg

SEQ ID NO: 3292056 - DNA, 20 bp, Homo sapiens
cctgctttggctgaggggct

SEQ ID NO: 3292057 - DNA, 19 bp, Homo sapiens
cctgctttgggctgccctg

SEQ ID NO: 3292058 - DNA, 22 bp, Homo sapiens
cctgctttgggctgccctggtg

SEQ ID NO: 3292059 - DNA, 18 bp, Homo sapiens
cctgcttttccaggatcc

SEQ ID NO: 3292060 - DNA, 20 bp, Homo sapiens
cctgcttttgcataatgcaa

SEQ ID NO: 3292061 - DNA, 23 bp, Homo sapiens
cctgctttttgaaatgaaattta

SEQ ID NO: 3292062 - DNA, 15 bp, Homo sapiens
cctgctttttttctt

SEQ ID NO: 3292063 - DNA, 19 bp, Homo sapiens
cctgctttttttcttaaaa

SEQ ID NO: 3292064 - DNA, 16 bp, Homo sapiens
cctggaaaccacagtc

SEQ ID NO: 3292065 - DNA, 19 bp, Homo sapiens
cctggaaagcaggatgtag

SEQ ID NO: 3292066 - DNA, 15 bp, Homo sapiens
cctggaaccagggag

SEQ ID NO: 3292067 - DNA, 17 bp, Homo sapiens
cctggaaccttgctgtc

SEQ ID NO: 3292068 - DNA, 16 bp, Homo sapiens
cctggaagcaggtgct

SEQ ID NO: 3292069 - DNA, 17 bp, Homo sapiens
cctggaagccagctttc

SEQ ID NO: 3292070 - DNA, 20 bp, Homo sapiens
cctggaagcgacccagggga

SEQ ID NO: 3292071 - DNA, 17 bp, Homo sapiens
cctggaattcagcaccc

SEQ ID NO: 3292072 - DNA, 22 bp, Homo sapiens
cctggaattcagcaccctgggt

SEQ ID NO: 3292073 - DNA, 23 bp, Homo sapiens
cctggaattcagcaccctgggtg

SEQ ID NO: 3292074 - DNA, 17 bp, Homo sapiens
cctggacacagctcttc

SEQ ID NO: 3292075 - DNA, 19 bp, Homo sapiens
cctggacacagctcttcat

SEQ ID NO: 3292076 - DNA, 20 bp, Homo sapiens
cctggacacccctgctctac

SEQ ID NO: 3292077 - DNA, 17 bp, Homo sapiens
cctggacactcagacct

SEQ ID NO: 3292078 - DNA, 21 bp, Homo sapiens
cctggacatttgccttgctgg

SEQ ID NO: 3292079 - DNA, 12 bp, Homo sapiens
cctggaccccca

SEQ ID NO: 3292080 - DNA, 15 bp, Homo sapiens
cctggacccccagct

SEQ ID NO: 3292081 - DNA, 16 bp, Homo sapiens
cctggacccccagctt

SEQ ID NO: 3292082 - DNA, 17 bp, Homo sapiens
cctggacccccagcttt

SEQ ID NO: 3292083 - DNA, 21 bp, Homo sapiens
cctggacctgccctgggccac

SEQ ID NO: 3292084 - DNA, 14 bp, Homo sapiens
cctggactctgccc

SEQ ID NO: 3292085 - DNA, 17 bp, Homo sapiens
cctggactgagccaagg

SEQ ID NO: 3292086 - DNA, 23 bp, Homo sapiens
cctggactgagccaaggaggcct

SEQ ID NO: 3292087 - DNA, 18 bp, Homo sapiens
cctggactgggaggtaga

SEQ ID NO: 3292088 - DNA, 17 bp, Homo sapiens
cctggactggtggcccc

SEQ ID NO: 3292089 - DNA, 16 bp, Homo sapiens
cctggacttaaagaaa

SEQ ID NO: 3292090 - DNA, 20 bp, Homo sapiens
cctggacttaagcatctggc

SEQ ID NO: 3292091 - DNA, 13 bp, Homo sapiens
cctggacttgcct

SEQ ID NO: 3292092 - DNA, 16 bp, Homo sapiens
cctggacttgcctctg

SEQ ID NO: 3292093 - DNA, 16 bp, Homo sapiens
cctggactttcctgca

SEQ ID NO: 3292094 - DNA, 13 bp, Homo sapiens
cctggagaactag

SEQ ID NO: 3292095 - DNA, 14 bp, Homo sapiens
cctggagaaggaag

SEQ ID NO: 3292096 - DNA, 20 bp, Homo sapiens
cctggagaaggaagctgcct

SEQ ID NO: 3292097 - DNA, 21 bp, Homo sapiens
cctggagacccaccccacctg

SEQ ID NO: 3292098 - DNA, 19 bp, Homo sapiens
cctggagacttagggcacc

SEQ ID NO: 3292099 - DNA, 18 bp, Homo sapiens
cctggagagcgaggaggc

SEQ ID NO: 3292100 - DNA, 14 bp, Homo sapiens
cctggagagggtct

SEQ ID NO: 3292101 - DNA, 17 bp, Homo sapiens
cctggagatcctcctgc

SEQ ID NO: 3292102 - DNA, 18 bp, Homo sapiens
cctggagatcctcctgca

SEQ ID NO: 3292103 - DNA, 17 bp, Homo sapiens
cctggagcaggagcccc

SEQ ID NO: 3292104 - DNA, 18 bp, Homo sapiens
cctggagcaggagccccg

SEQ ID NO: 3292105 - DNA, 23 bp, Homo sapiens
cctggagcaggagccccgccaca

SEQ ID NO: 3292106 - DNA, 17 bp, Homo sapiens
cctggagcccacaacct

SEQ ID NO: 3292107 - DNA, 13 bp, Homo sapiens
cctggagcccctg

SEQ ID NO: 3292108 - DNA, 11 bp, Homo sapiens
cctggagccct

SEQ ID NO: 3292109 - DNA, 14 bp, Homo sapiens
cctggaggcactga

SEQ ID NO: 3292110 - DNA, 22 bp, Homo sapiens
cctggaggcactgaagtgctta

SEQ ID NO: 3292111 - DNA, 23 bp, Homo sapiens
cctggagtcccgtccctgcccag

SEQ ID NO: 3292112 - DNA, 19 bp, Homo sapiens
cctggagtgcccaccctgg

SEQ ID NO: 3292113 - DNA, 19 bp, Homo sapiens
cctggatcacgacgctgca

SEQ ID NO: 3292114 - DNA, 21 bp, Homo sapiens
cctggatccatcaggccactt

SEQ ID NO: 3292115 - DNA, 20 bp, Homo sapiens
cctggatctatccctgcggc

SEQ ID NO: 3292116 - DNA, 21 bp, Homo sapiens
cctggatgatttcatcttctg

SEQ ID NO: 3292117 - DNA, 13 bp, Homo sapiens
cctggatgccaag

SEQ ID NO: 3292118 - DNA, 18 bp, Homo sapiens
cctggatgccaaggagcc

SEQ ID NO: 3292119 - DNA, 20 bp, Homo sapiens
cctggatgggcattgggctg

SEQ ID NO: 3292120 - DNA, 13 bp, Homo sapiens
cctggatttatag

SEQ ID NO: 3292121 - DNA, 21 bp, Homo sapiens
cctggatttatagtatgtgac

SEQ ID NO: 3292122 - DNA, 12 bp, Homo sapiens
cctggcacacat

SEQ ID NO: 3292123 - DNA, 13 bp, Homo sapiens
cctggcacacatc

SEQ ID NO: 3292124 - DNA, 15 bp, Homo sapiens
cctggcacacatcag

SEQ ID NO: 3292125 - DNA, 14 bp, Homo sapiens
cctggcacatttca

SEQ ID NO: 3292126 - DNA, 18 bp, Homo sapiens
cctggcacatttcaggga

SEQ ID NO: 3292127 - DNA, 22 bp, Homo sapiens
cctggcacatttcagggagaaa

SEQ ID NO: 3292128 - DNA, 21 bp, Homo sapiens
cctggcacccggcccctgctg

SEQ ID NO: 3292129 - DNA, 22 bp, Homo sapiens
cctggcactataatgtaagctc

SEQ ID NO: 3292130 - DNA, 13 bp, Homo sapiens
cctggcagacaca

SEQ ID NO: 3292131 - DNA, 14 bp, Homo sapiens
cctggcagcacagc

SEQ ID NO: 3292132 - DNA, 20 bp, Homo sapiens
cctggcagcacagcccaggg

SEQ ID NO: 3292133 - DNA, 18 bp, Homo sapiens
cctggcagccgtgccttc

SEQ ID NO: 3292134 - DNA, 19 bp, Homo sapiens
cctggcagccgtgccttca

SEQ ID NO: 3292135 - DNA, 22 bp, Homo sapiens
cctggcagccgtgccttcagct

SEQ ID NO: 3292136 - DNA, 22 bp, Homo sapiens
cctggcaggatgaccctgcgaa

SEQ ID NO: 3292137 - DNA, 15 bp, Homo sapiens
cctggcaggatgctg

SEQ ID NO: 3292138 - DNA, 18 bp, Homo sapiens
cctggcaggatgctgagc

SEQ ID NO: 3292139 - DNA, 19 bp, Homo sapiens
cctggcaggatgctgagct

SEQ ID NO: 3292140 - DNA, 15 bp, Homo sapiens
cctggcaggccagtg

SEQ ID NO: 3292141 - DNA, 16 bp, Homo sapiens
cctggcaggccagtgt

SEQ ID NO: 3292142 - DNA, 13 bp, Homo sapiens
ccttcctcctgca

SEQ ID NO: 3292143 - DNA, 14 bp, Homo sapiens
ccttcctcctgcag

SEQ ID NO: 3292144 - DNA, 17 bp, Homo sapiens
ccttcctctcactcctg

SEQ ID NO: 3292145 - DNA, 21 bp, Homo sapiens
ccttcctctccactgccttcg

SEQ ID NO: 3292146 - DNA, 16 bp, Homo sapiens
ccttcctggaaacagc

SEQ ID NO: 3292147 - DNA, 17 bp, Homo sapiens
ccttcctggcctcactg

SEQ ID NO: 3292148 - DNA, 22 bp, Homo sapiens
ccttcctggcctcactggctgg

SEQ ID NO: 3292149 - DNA, 21 bp, Homo sapiens
ccttcctgggaggacaggcag

SEQ ID NO: 3292150 - DNA, 19 bp, Homo sapiens
ccttcctggggcatctggc

SEQ ID NO: 3292151 - DNA, 22 bp, Homo sapiens
ccttcctgtttttcacattttc

SEQ ID NO: 3292152 - DNA, 21 bp, Homo sapiens
ccttcctttggtgcctcactg

SEQ ID NO: 3292153 - DNA, 15 bp, Homo sapiens
ccttccttttccctg

SEQ ID NO: 3292154 - DNA, 16 bp, Homo sapiens
ccttccttttccctgc

SEQ ID NO: 3292155 - DNA, 19 bp, Homo sapiens
ccttccttttccctgcttc

SEQ ID NO: 3292156 - DNA, 14 bp, Homo sapiens
ccttcgctcctgtg

SEQ ID NO: 3292157 - DNA, 18 bp, Homo sapiens
ccttcgctcctgtgtctt

SEQ ID NO: 3292158 - DNA, 16 bp, Homo sapiens
ccttcgcttcttgcct

SEQ ID NO: 3292159 - DNA, 17 bp, Homo sapiens
ccttcgcttcttgcctc

SEQ ID NO: 3292160 - DNA, 18 bp, Homo sapiens
ccttcgcttcttgcctct

SEQ ID NO: 3292161 - DNA, 21 bp, Homo sapiens
ccttcgcttcttgcctctgtg

SEQ ID NO: 3292162 - DNA, 20 bp, Homo sapiens
ccttcggggcgatgctccct

SEQ ID NO: 3292163 - DNA, 16 bp, Homo sapiens
ccttcggtcttttgta

SEQ ID NO: 3292164 - DNA, 19 bp, Homo sapiens
ccttcgtccccagttgccg

SEQ ID NO: 3292165 - DNA, 13 bp, Homo sapiens
ccttcgtgtctct

SEQ ID NO: 3292166 - DNA, 17 bp, Homo sapiens
ccttcgtgtctctccca

SEQ ID NO: 3292167 - DNA, 22 bp, Homo sapiens
ccttcgtgtctctcccaccccg

SEQ ID NO: 3292168 - DNA, 17 bp, Homo sapiens
ccttcgttaactgtgta

SEQ ID NO: 3292169 - DNA, 22 bp, Homo sapiens
ccttctagaacctgggctgtgc

SEQ ID NO: 3292170 - DNA, 22 bp, Homo sapiens
ccttctagtcttggccagccaa

SEQ ID NO: 3292171 - DNA, 15 bp, Homo sapiens
ccttctattggtctc

SEQ ID NO: 3292172 - DNA, 20 bp, Homo sapiens
ccttctcccctccccgcctg

SEQ ID NO: 3292173 - DNA, 22 bp, Homo sapiens
ccttctccctagctcctcccct

SEQ ID NO: 3292174 - DNA, 14 bp, Homo sapiens
ccttctcctctctg

SEQ ID NO: 3292175 - DNA, 19 bp, Homo sapiens
ccttctcctctctgggcct

SEQ ID NO: 3292176 - DNA, 14 bp, Homo sapiens
ccttctccttccca

SEQ ID NO: 3292177 - DNA, 18 bp, Homo sapiens
ccttctccttccccagga

SEQ ID NO: 3292178 - DNA, 15 bp, Homo sapiens
ccttctctcctcccc

SEQ ID NO: 3292179 - DNA, 16 bp, Homo sapiens
ccttctctcctcccca

SEQ ID NO: 3292180 - DNA, 20 bp, Homo sapiens
ccttctctcctccccaaatc

SEQ ID NO: 3292181 - DNA, 13 bp, Homo sapiens
ccttctctgaaca

SEQ ID NO: 3292182 - DNA, 18 bp, Homo sapiens
ccttctctgaacacaggc

SEQ ID NO: 3292183 - DNA, 20 bp, Homo sapiens
ccttctctgaacacaggcag

SEQ ID NO: 3292184 - DNA, 14 bp, Homo sapiens
ccttctctgctcca

SEQ ID NO: 3292185 - DNA, 17 bp, Homo sapiens
ccttctctgctccacca

SEQ ID NO: 3292186 - DNA, 14 bp, Homo sapiens
ccttctcttaattt

SEQ ID NO: 3292187 - DNA, 17 bp, Homo sapiens
ccttctgacggccctgc

SEQ ID NO: 3292188 - DNA, 14 bp, Homo sapiens
ccttctgcagcagg

SEQ ID NO: 3292189 - DNA, 18 bp, Homo sapiens
ccttctgctgcccaggcc

SEQ ID NO: 3292190 - DNA, 19 bp, Homo sapiens
ccttctgctgcccaggcca

SEQ ID NO: 3292191 - DNA, 10 bp, Homo sapiens
ccttctggcc

SEQ ID NO: 3292192 - DNA, 16 bp, Homo sapiens
ccttctggccttgtaa

SEQ ID NO: 3292193 - DNA, 19 bp, Homo sapiens
ccttctgggactggacagc

SEQ ID NO: 3292194 - DNA, 22 bp, Homo sapiens
ccttctgggcatctgttctggt

SEQ ID NO: 3292195 - DNA, 13 bp, Homo sapiens
ccttctgggcttt

SEQ ID NO: 3292196 - DNA, 16 bp, Homo sapiens
ccttctgggctttttc

SEQ ID NO: 3292197 - DNA, 17 bp, Homo sapiens
ccttctgggctttttct

SEQ ID NO: 3292198 - DNA, 16 bp, Homo sapiens
ccttctgtccccagcc

SEQ ID NO: 3292199 - DNA, 15 bp, Homo sapiens
ccttctgtcctggtg

SEQ ID NO: 3292200 - DNA, 16 bp, Homo sapiens
ccttctgtcctggtgt

SEQ ID NO: 3292201 - DNA, 15 bp, Homo sapiens
ccttctgtgaaagta

SEQ ID NO: 3292202 - DNA, 14 bp, Homo sapiens
ccttctgtggctca

SEQ ID NO: 3292203 - DNA, 12 bp, Homo sapiens
ccttctgtgtca

SEQ ID NO: 3292204 - DNA, 16 bp, Homo sapiens
ccttcttccatcccag

SEQ ID NO: 3292205 - DNA, 22 bp, Homo sapiens
ccttcttccatcccaggacacc

SEQ ID NO: 3292206 - DNA, 23 bp, Homo sapiens
ccttcttcccaatagcaaggctg

SEQ ID NO: 3292207 - DNA, 20 bp, Homo sapiens
ccttcttctttttgctgttg

SEQ ID NO: 3292208 - DNA, 23 bp, Homo sapiens
ccttctttcactctgtcatcttt

SEQ ID NO: 3292209 - DNA, 17 bp, Homo sapiens
ccttctttcctcttccc

SEQ ID NO: 3292210 - DNA, 14 bp, Homo sapiens
ccttctttctggac

SEQ ID NO: 3292211 - DNA, 18 bp, Homo sapiens
ccttctttgataatgtta

SEQ ID NO: 3292212 - DNA, 20 bp, Homo sapiens
ccttctttgataatgttaaa

SEQ ID NO: 3292213 - DNA, 15 bp, Homo sapiens
ccttctttgcagggc

SEQ ID NO: 3292214 - DNA, 24 bp, Homo sapiens
ccttcttttatgagcagaaggaaa

SEQ ID NO: 3292215 - DNA, 16 bp, Homo sapiens
ccttgaaacagttcca

SEQ ID NO: 3292216 - DNA, 14 bp, Homo sapiens
ccttgaactgggta

SEQ ID NO: 3292217 - DNA, 16 bp, Homo sapiens
ccttgaactgggtact

SEQ ID NO: 3292218 - DNA, 18 bp, Homo sapiens
ccttgaagaacctctcac

SEQ ID NO: 3292219 - DNA, 18 bp, Homo sapiens
ccttgaagaactgcaggc

SEQ ID NO: 3292220 - DNA, 15 bp, Homo sapiens
ccttgacagggcaca

SEQ ID NO: 3292221 - DNA, 17 bp, Homo sapiens
ccttgacagggcacacc

SEQ ID NO: 3292222 - DNA, 22 bp, Homo sapiens
ccttgaccaaaatcagctttgt

SEQ ID NO: 3292223 - DNA, 13 bp, Homo sapiens
ccttgaccttcct

SEQ ID NO: 3292224 - DNA, 22 bp, Homo sapiens
ccttgactgccgcatcatggga

SEQ ID NO: 3292225 - DNA, 13 bp, Homo sapiens
ccttgagactgga

SEQ ID NO: 3292226 - DNA, 14 bp, Homo sapiens
ccttgagactggag

SEQ ID NO: 3292227 - DNA, 16 bp, Homo sapiens
ccttgagccctggctg

SEQ ID NO: 3292228 - DNA, 21 bp, Homo sapiens
ccttgagggtgcttgttccct

SEQ ID NO: 3292229 - DNA, 19 bp, Homo sapiens
ccttgatggagatatttac

SEQ ID NO: 3292230 - DNA, 13 bp, Homo sapiens
ccttgatttcaaa

SEQ ID NO: 3292231 - DNA, 18 bp, Homo sapiens
ccttgatttgttcttaca

SEQ ID NO: 3292232 - DNA, 20 bp, Homo sapiens
ccttgattttgccccctgag

SEQ ID NO: 3292233 - DNA, 13 bp, Homo sapiens
ccttgcagaactg

SEQ ID NO: 3292234 - DNA, 16 bp, Homo sapiens
ccttgcagaactgcca

SEQ ID NO: 3292235 - DNA, 15 bp, Homo sapiens
ccttgcagccacatg

SEQ ID NO: 3292236 - DNA, 18 bp, Homo sapiens
ccttgcagccacatggcc

SEQ ID NO: 3292237 - DNA, 19 bp, Homo sapiens
ccttgcaggggtcccccct

SEQ ID NO: 3292238 - DNA, 20 bp, Homo sapiens
ccttgcagttcagcaccacc

SEQ ID NO: 3292239 - DNA, 23 bp, Homo sapiens
ccttgcagttcagcaccacccta

SEQ ID NO: 3292240 - DNA, 20 bp, Homo sapiens
ccttgcccagactacagggc

SEQ ID NO: 3292241 - DNA, 14 bp, Homo sapiens
ccttgccccacagt

SEQ ID NO: 3292242 - DNA, 19 bp, Homo sapiens
ccttgccccacagttgtgt

SEQ ID NO: 3292243 - DNA, 18 bp, Homo sapiens
ccttgcccggattctggg

SEQ ID NO: 3292244 - DNA, 19 bp, Homo sapiens
ccttgccctgacctcccag

SEQ ID NO: 3292245 - DNA, 16 bp, Homo sapiens
ccttgcccttgccctg

SEQ ID NO: 3292246 - DNA, 22 bp, Homo sapiens
ccttgcctaaatttaatgctgc

SEQ ID NO: 3292247 - DNA, 15 bp, Homo sapiens
ccttgcctcaatgcc

SEQ ID NO: 3292248 - DNA, 20 bp, Homo sapiens
ccttgcctcaatgccagtaa

SEQ ID NO: 3292249 - DNA, 22 bp, Homo sapiens
ccttgcctccccatttcccatc

SEQ ID NO: 3292250 - DNA, 15 bp, Homo sapiens
ccttgccttcccctg

SEQ ID NO: 3292251 - DNA, 16 bp, Homo sapiens
ccttgccttcccctgt

SEQ ID NO: 3292252 - DNA, 15 bp, Homo sapiens
ccttgcctttgtggc

SEQ ID NO: 3292253 - DNA, 11 bp, Homo sapiens
ccttgctacct

SEQ ID NO: 3292254 - DNA, 15 bp, Homo sapiens
ccttgctctccctct

SEQ ID NO: 3292255 - DNA, 17 bp, Homo sapiens
ccttgctctccctcttc

SEQ ID NO: 3292256 - DNA, 19 bp, Homo sapiens
ccttgctctccctcttctc

SEQ ID NO: 3292257 - DNA, 22 bp, Homo sapiens
ccttgctgagtggcgcaaggcc

SEQ ID NO: 3292258 - DNA, 23 bp, Homo sapiens
ccttgctgcccgcgggagacagc

SEQ ID NO: 3292259 - DNA, 20 bp, Homo sapiens
ccttgctgctgctgcaccca

SEQ ID NO: 3292260 - DNA, 22 bp, Homo sapiens
ccttgctggacggggactgggg

SEQ ID NO: 3292261 - DNA, 12 bp, Homo sapiens
ccttgctggccc

SEQ ID NO: 3292262 - DNA, 15 bp, Homo sapiens
ccttgctggccccag

SEQ ID NO: 3292263 - DNA, 16 bp, Homo sapiens
ccttgctggccccagc

SEQ ID NO: 3292264 - DNA, 22 bp, Homo sapiens
ccttgctggccccagccctgct

SEQ ID NO: 3292265 - DNA, 21 bp, Homo sapiens
ccttgctgtatgctgatcatc

SEQ ID NO: 3292266 - DNA, 20 bp, Homo sapiens
ccttgcttcttactgataat

SEQ ID NO: 3292267 - DNA, 21 bp, Homo sapiens
ccttgctttcggagctcctgt

SEQ ID NO: 3292268 - DNA, 15 bp, Homo sapiens
cgcacgcacacacac

SEQ ID NO: 3292269 - DNA, 22 bp, Homo sapiens
cgcactacatgtggtttataga

SEQ ID NO: 3292270 - DNA, 14 bp, Homo sapiens
cgcactctgccccc

SEQ ID NO: 3292271 - DNA, 16 bp, Homo sapiens
cgcactgggccacgga

SEQ ID NO: 3292272 - DNA, 13 bp, Homo sapiens
cgcagaagccctg

SEQ ID NO: 3292273 - DNA, 12 bp, Homo sapiens
cgcagacctccc

SEQ ID NO: 3292274 - DNA, 17 bp, Homo sapiens
cgcagacctccccagcc

SEQ ID NO: 3292275 - DNA, 15 bp, Homo sapiens
cgcagacgggcacag

SEQ ID NO: 3292276 - DNA, 21 bp, Homo sapiens
cgcagacgggcacagacacgc

SEQ ID NO: 3292277 - DNA, 19 bp, Homo sapiens
cgcagaggacgcacgctcg

SEQ ID NO: 3292278 - DNA, 21 bp, Homo sapiens
cgcagccaaggccgaagctct

SEQ ID NO: 3292279 - DNA, 21 bp, Homo sapiens
cgcagcccgtgaagcagtgcc

SEQ ID NO: 3292280 - DNA, 23 bp, Homo sapiens
cgcagcccgtgaagcagtgcctc

SEQ ID NO: 3292281 - DNA, 10 bp, Homo sapiens
cgcagccctg

SEQ ID NO: 3292282 - DNA, 16 bp, Homo sapiens
cgcagcctccctctga

SEQ ID NO: 3292283 - DNA, 13 bp, Homo sapiens
cgcagctcttgcc

SEQ ID NO: 3292284 - DNA, 17 bp, Homo sapiens
cgcagctcttgcccttc

SEQ ID NO: 3292285 - DNA, 11 bp, Homo sapiens
cgcaggaatgg

SEQ ID NO: 3292286 - DNA, 22 bp, Homo sapiens
cgcaggaccagtttgattgagg

SEQ ID NO: 3292287 - DNA, 20 bp, Homo sapiens
cgcaggagaatcactgcagc

SEQ ID NO: 3292288 - DNA, 21 bp, Homo sapiens
cgcaggagtctctgccaccca

SEQ ID NO: 3292289 - DNA, 19 bp, Homo sapiens
cgcaggatccgctgccacc

SEQ ID NO: 3292290 - DNA, 11 bp, Homo sapiens
cgcaggcccag

SEQ ID NO: 3292291 - DNA, 12 bp, Homo sapiens
cgcaggcccagt

SEQ ID NO: 3292292 - DNA, 13 bp, Homo sapiens
cgcaggcccagtg

SEQ ID NO: 3292293 - DNA, 18 bp, Homo sapiens
cgcaggcgaccgggcctc

SEQ ID NO: 3292294 - DNA, 20 bp, Homo sapiens
cgcaggcgaccgggcctccc

SEQ ID NO: 3292295 - DNA, 21 bp, Homo sapiens
cgcaggctatttgttcagaga

SEQ ID NO: 3292296 - DNA, 13 bp, Homo sapiens
cgcaggtgggctg

SEQ ID NO: 3292297 - DNA, 20 bp, Homo sapiens
cgcagtagtttggtttgact

SEQ ID NO: 3292298 - DNA, 16 bp, Homo sapiens
cgcagtccccagccct

SEQ ID NO: 3292299 - DNA, 21 bp, Homo sapiens
cgcagtccccagcccttctgc

SEQ ID NO: 3292300 - DNA, 23 bp, Homo sapiens
cgcagtcgcaggatccgctgcca

SEQ ID NO: 3292301 - DNA, 15 bp, Homo sapiens
cgcagtcgtcgcaca

SEQ ID NO: 3292302 - DNA, 17 bp, Homo sapiens
cgcagtcgtcgcacagt

SEQ ID NO: 3292303 - DNA, 21 bp, Homo sapiens
cgcagtcgtcgcacagtctct

SEQ ID NO: 3292304 - DNA, 13 bp, Homo sapiens
cgcagtctggcct

SEQ ID NO: 3292305 - DNA, 15 bp, Homo sapiens
cgcagtctggcctgg

SEQ ID NO: 3292306 - DNA, 21 bp, Homo sapiens
cgcagtgctgggaccagagcc

SEQ ID NO: 3292307 - DNA, 22 bp, Homo sapiens
cgcatacacacatgccctcctg

SEQ ID NO: 3292308 - DNA, 22 bp, Homo sapiens
cgcatagactgaggtataaaga

SEQ ID NO: 3292309 - DNA, 22 bp, Homo sapiens
cgcatggagtgtgtattgttcc

SEQ ID NO: 3292310 - DNA, 23 bp, Homo sapiens
cgcatggagtgtgtattgttccc

SEQ ID NO: 3292311 - DNA, 19 bp, Homo sapiens
cgcatggtcacacactgat

SEQ ID NO: 3292312 - DNA, 19 bp, Homo sapiens
cgccaacgttcgatttcta

SEQ ID NO: 3292313 - DNA, 15 bp, Homo sapiens
cgccaccagcccgca

SEQ ID NO: 3292314 - DNA, 23 bp, Homo sapiens
cgccaccatcctgcagcctcctc

SEQ ID NO: 3292315 - DNA, 14 bp, Homo sapiens
cgccacccccatct

SEQ ID NO: 3292316 - DNA, 17 bp, Homo sapiens
cgccacccccatcttcc

SEQ ID NO: 3292317 - DNA, 20 bp, Homo sapiens
cgccacccccatcttccacc

SEQ ID NO: 3292318 - DNA, 22 bp, Homo sapiens
cgccacccccatcttccacctg

SEQ ID NO: 3292319 - DNA, 13 bp, Homo sapiens
cgccacctcaggg

SEQ ID NO: 3292320 - DNA, 15 bp, Homo sapiens
cgccacctcagggca

SEQ ID NO: 3292321 - DNA, 16 bp, Homo sapiens
cgccacctcagggcac

SEQ ID NO: 3292322 - DNA, 17 bp, Homo sapiens
cgccacgtcccagcatc

SEQ ID NO: 3292323 - DNA, 21 bp, Homo sapiens
cgccactacactccagcctga

SEQ ID NO: 3292324 - DNA, 22 bp, Homo sapiens
cgccactacactccagcctgag

SEQ ID NO: 3292325 - DNA, 15 bp, Homo sapiens
cgccactcctgaacc

SEQ ID NO: 3292326 - DNA, 15 bp, Homo sapiens
cgccactcgcttccc

SEQ ID NO: 3292327 - DNA, 21 bp, Homo sapiens
cgccactgcactccagcctgg

SEQ ID NO: 3292328 - DNA, 12 bp, Homo sapiens
cgccacttcctt

SEQ ID NO: 3292329 - DNA, 15 bp, Homo sapiens
cgccagcctcctctg

SEQ ID NO: 3292330 - DNA, 17 bp, Homo sapiens
cgccagcctcctctgga

SEQ ID NO: 3292331 - DNA, 14 bp, Homo sapiens
cgccagctgggagc

SEQ ID NO: 3292332 - DNA, 20 bp, Homo sapiens
cgccagctgggagcactggt

SEQ ID NO: 3292333 - DNA, 17 bp, Homo sapiens
cgccagcttctcctgcg

SEQ ID NO: 3292334 - DNA, 12 bp, Homo sapiens
cgccagggctgg

SEQ ID NO: 3292335 - DNA, 13 bp, Homo sapiens
cgccagggctggg

SEQ ID NO: 3292336 - DNA, 21 bp, Homo sapiens
cgccagggctggggacagagg

SEQ ID NO: 3292337 - DNA, 14 bp, Homo sapiens
cgccagtctcccag

SEQ ID NO: 3292338 - DNA, 14 bp, Homo sapiens
cgccatcttccatt

SEQ ID NO: 3292339 - DNA, 21 bp, Homo sapiens
cgccatgttgacgagactggt

SEQ ID NO: 3292340 - DNA, 17 bp, Homo sapiens
cgccattgccaccagga

SEQ ID NO: 3292341 - DNA, 18 bp, Homo sapiens
cgcccacaggaagcctgc

SEQ ID NO: 3292342 - DNA, 23 bp, Homo sapiens
cgcccaccgtgggcagtgccacc

SEQ ID NO: 3292343 - DNA, 12 bp, Homo sapiens
cgcccacctccc

SEQ ID NO: 3292344 - DNA, 22 bp, Homo sapiens
cgcccagagacccaagctgcct

SEQ ID NO: 3292345 - DNA, 20 bp, Homo sapiens
cgcccagctgcacctgccag

SEQ ID NO: 3292346 - DNA, 20 bp, Homo sapiens
cgcccaggctggagtgcagt

SEQ ID NO: 3292347 - DNA, 15 bp, Homo sapiens
cgcccaggggcccgg

SEQ ID NO: 3292348 - DNA, 19 bp, Homo sapiens
cgcccagtctggaatgcag

SEQ ID NO: 3292349 - DNA, 23 bp, Homo sapiens
cgcccagttgggtggatgcctgg

SEQ ID NO: 3292350 - DNA, 20 bp, Homo sapiens
cgccccacctccacctgtga

SEQ ID NO: 3292351 - DNA, 12 bp, Homo sapiens
cgccccaggccc

SEQ ID NO: 3292352 - DNA, 12 bp, Homo sapiens
cgcccccagtgt

SEQ ID NO: 3292353 - DNA, 20 bp, Homo sapiens
cgccccctccgccctgccac

SEQ ID NO: 3292354 - DNA, 19 bp, Homo sapiens
cgccccgggcaaagggtct

SEQ ID NO: 3292355 - DNA, 10 bp, Homo sapiens
cgcccctccc

SEQ ID NO: 3292356 - DNA, 13 bp, Homo sapiens
cgcccctgctgtc

SEQ ID NO: 3292357 - DNA, 15 bp, Homo sapiens
cgcccctgtggccaa

SEQ ID NO: 3292358 - DNA, 14 bp, Homo sapiens
cgcccgtcctgcct

SEQ ID NO: 3292359 - DNA, 11 bp, Homo sapiens
cgccctcaggc

SEQ ID NO: 3292360 - DNA, 14 bp, Homo sapiens
cgccctcccctccc

SEQ ID NO: 3292361 - DNA, 16 bp, Homo sapiens
cgccctcccctcccct

SEQ ID NO: 3292362 - DNA, 18 bp, Homo sapiens
cgccctcccctcccctgc

SEQ ID NO: 3292363 - DNA, 23 bp, Homo sapiens
cgccctccctctcccaggcccga

SEQ ID NO: 3292364 - DNA, 16 bp, Homo sapiens
cgccctcctttctgtg

SEQ ID NO: 3292365 - DNA, 22 bp, Homo sapiens
cgccctctctgctccttcactg

SEQ ID NO: 3292366 - DNA, 13 bp, Homo sapiens
cgccctcttcctg

SEQ ID NO: 3292367 - DNA, 12 bp, Homo sapiens
cgccctgcactc

SEQ ID NO: 3292368 - DNA, 13 bp, Homo sapiens
cgccctgcactcc

SEQ ID NO: 3292369 - DNA, 15 bp, Homo sapiens
cgccctgcagaggga

SEQ ID NO: 3292370 - DNA, 18 bp, Homo sapiens
cgccctgcgttggagcca

SEQ ID NO: 3292371 - DNA, 12 bp, Homo sapiens
cgccctggactt

SEQ ID NO: 3292372 - DNA, 14 bp, Homo sapiens
cgccctgggctgga

SEQ ID NO: 3292373 - DNA, 17 bp, Homo sapiens
cgccctgggctggactg

SEQ ID NO: 3292374 - DNA, 20 bp, Homo sapiens
cgccctttcctcctcaggca

SEQ ID NO: 3292375 - DNA, 12 bp, Homo sapiens
cgccgcctcttt

SEQ ID NO: 3292376 - DNA, 13 bp, Homo sapiens
cgccgggcaccaa

SEQ ID NO: 3292377 - DNA, 20 bp, Homo sapiens
cgcctaaggtcacagctagt

SEQ ID NO: 3292378 - DNA, 21 bp, Homo sapiens
cgcctactcttcagggtctaa

SEQ ID NO: 3292379 - DNA, 16 bp, Homo sapiens
cgcctccatccaaggc

SEQ ID NO: 3292380 - DNA, 24 bp, Homo sapiens
cgcctccccacggccgctccaggg

SEQ ID NO: 3292381 - DNA, 16 bp, Homo sapiens
cgcctcccctgcccca

SEQ ID NO: 3292382 - DNA, 15 bp, Homo sapiens
cgcctccctctcaga

SEQ ID NO: 3292383 - DNA, 13 bp, Homo sapiens
cgcctcctggcca

SEQ ID NO: 3292384 - DNA, 15 bp, Homo sapiens
cgcctcctggccaga

SEQ ID NO: 3292385 - DNA, 16 bp, Homo sapiens
cgcctcctggccagac

SEQ ID NO: 3292386 - DNA, 13 bp, Homo sapiens
cgcctctggccgc

SEQ ID NO: 3292387 - DNA, 19 bp, Homo sapiens
cgcctcttcttcttcagaa

SEQ ID NO: 3292388 - DNA, 16 bp, Homo sapiens
cgcctcttttccctct

SEQ ID NO: 3292389 - DNA, 16 bp, Homo sapiens
cgcctgaaagccacaa

SEQ ID NO: 3292390 - DNA, 20 bp, Homo sapiens
cgcctgacaaccactggtct

SEQ ID NO: 3292391 - DNA, 16 bp, Homo sapiens
cgcctgacagaaacca

SEQ ID NO: 3292392 - DNA, 16 bp, Homo sapiens
cgcctgagctcactcg

SEQ ID NO: 3292393 - DNA, 17 bp, Homo sapiens
cgcctgaggcaattaga

SEQ ID NO: 3292394 - DNA, 14 bp, Homo sapiens
cgcctgagggaaga

SEQ ID NO: 3292395 - DNA, 17 bp, Homo sapiens
cgtctgactccagagtc

SEQ ID NO: 3292396 - DNA, 13 bp, Homo sapiens
cgtctgccaggcc

SEQ ID NO: 3292397 - DNA, 15 bp, Homo sapiens
cgtctgccaggccca

SEQ ID NO: 3292398 - DNA, 14 bp, Homo sapiens
cgtctggaggggcc

SEQ ID NO: 3292399 - DNA, 14 bp, Homo sapiens
cgtctttaagagac

SEQ ID NO: 3292400 - DNA, 15 bp, Homo sapiens
cgtctttaagagact

SEQ ID NO: 3292401 - DNA, 17 bp, Homo sapiens
cgtctttaagagactca

SEQ ID NO: 3292402 - DNA, 18 bp, Homo sapiens
cgtgaaaacggagctgaa

SEQ ID NO: 3292403 - DNA, 16 bp, Homo sapiens
cgtgaaacacaccagg

SEQ ID NO: 3292404 - DNA, 22 bp, Homo sapiens
cgtgaaacacaccaggctgtgg

SEQ ID NO: 3292405 - DNA, 24 bp, Homo sapiens
cgtgaaacacaccaggctgtgggc

SEQ ID NO: 3292406 - DNA, 17 bp, Homo sapiens
cgtgaaaccccgtctct

SEQ ID NO: 3292407 - DNA, 11 bp, Homo sapiens
cgtgaacaaac

SEQ ID NO: 3292408 - DNA, 16 bp, Homo sapiens
cgtgaagcagtgcctc

SEQ ID NO: 3292409 - DNA, 17 bp, Homo sapiens
cgtgaagcagtgcctcg

SEQ ID NO: 3292410 - DNA, 14 bp, Homo sapiens
cgtgaattctcgga

SEQ ID NO: 3292411 - DNA, 14 bp, Homo sapiens
cgtgacaacacttg

SEQ ID NO: 3292412 - DNA, 23 bp, Homo sapiens
cgtgaccaactagacattctgtc

SEQ ID NO: 3292413 - DNA, 14 bp, Homo sapiens
cgtgacccttcagg

SEQ ID NO: 3292414 - DNA, 16 bp, Homo sapiens
cgtgacccttcagggc

SEQ ID NO: 3292415 - DNA, 20 bp, Homo sapiens
cgtgacccttcagggccaga

SEQ ID NO: 3292416 - DNA, 20 bp, Homo sapiens
cgtgacctattcaccctcca

SEQ ID NO: 3292417 - DNA, 22 bp, Homo sapiens
cgtgacggagcccacactgcca

SEQ ID NO: 3292418 - DNA, 14 bp, Homo sapiens
cgtgactcagcagc

SEQ ID NO: 3292419 - DNA, 18 bp, Homo sapiens
cgtgactcagcagcctgc

SEQ ID NO: 3292420 - DNA, 19 bp, Homo sapiens
cgtgagctggggactcagg

SEQ ID NO: 3292421 - DNA, 22 bp, Homo sapiens
cgtgagctggggactcagggac

SEQ ID NO: 3292422 - DNA, 20 bp, Homo sapiens
cgtgaggggcaagctaggcc

SEQ ID NO: 3292423 - DNA, 19 bp, Homo sapiens
cgtgagtgaaccatcatta

SEQ ID NO: 3292424 - DNA, 16 bp, Homo sapiens
cgtgagttctcagggc

SEQ ID NO: 3292425 - DNA, 18 bp, Homo sapiens
cgtgatccacccacctcg

SEQ ID NO: 3292426 - DNA, 22 bp, Homo sapiens
cgtgatccatccatctccaggg

SEQ ID NO: 3292427 - DNA, 17 bp, Homo sapiens
cgtgatccgcctgcctc

SEQ ID NO: 3292428 - DNA, 21 bp, Homo sapiens
cgtgatccgcctgcctctgcc

SEQ ID NO: 3292429 - DNA, 16 bp, Homo sapiens
cgtgcacacaccagag

SEQ ID NO: 3292430 - DNA, 19 bp, Homo sapiens
cgtgcacacaccagagccc

SEQ ID NO: 3292431 - DNA, 20 bp, Homo sapiens
cgtgcacacaccagagccca

SEQ ID NO: 3292432 - DNA, 22 bp, Homo sapiens
cgtgcacacaccagagcccacc

SEQ ID NO: 3292433 - DNA, 10 bp, Homo sapiens
cgtgcacagg

SEQ ID NO: 3292434 - DNA, 17 bp, Homo sapiens
cgtgcactctgctaatc

SEQ ID NO: 3292435 - DNA, 20 bp, Homo sapiens
cgtgcagagctgcacttggc

SEQ ID NO: 3292436 - DNA, 19 bp, Homo sapiens
cgtgcagcgcccctctgca

SEQ ID NO: 3292437 - DNA, 16 bp, Homo sapiens
cgtgcagcttccaaat

SEQ ID NO: 3292438 - DNA, 16 bp, Homo sapiens
cgtgcagtacaggcaa

SEQ ID NO: 3292439 - DNA, 15 bp, Homo sapiens
cgtgccagtcctggg

SEQ ID NO: 3292440 - DNA, 16 bp, Homo sapiens
cgtgccatgatctgta

SEQ ID NO: 3292441 - DNA, 17 bp, Homo sapiens
cgtgccccgcctccccg

SEQ ID NO: 3292442 - DNA, 18 bp, Homo sapiens
cgtgccgcctgctcctca

SEQ ID NO: 3292443 - DNA, 21 bp, Homo sapiens
cgtgcctccaccaccactggc

SEQ ID NO: 3292444 - DNA, 23 bp, Homo sapiens
cgtgcctccaccaccactggcca

SEQ ID NO: 3292445 - DNA, 20 bp, Homo sapiens
cgtgcctccttccacctccc

SEQ ID NO: 3292446 - DNA, 17 bp, Homo sapiens
cgtgcctgggggagaga

SEQ ID NO: 3292447 - DNA, 14 bp, Homo sapiens
cgtgcctgtgtcca

SEQ ID NO: 3292448 - DNA, 16 bp, Homo sapiens
cgtgccttcagctcta

SEQ ID NO: 3292449 - DNA, 19 bp, Homo sapiens
cgtgccttttgcacccctc

SEQ ID NO: 3292450 - DNA, 23 bp, Homo sapiens
cgtgccttttgcacccctcccat

SEQ ID NO: 3292451 - DNA, 15 bp, Homo sapiens
cgtgcgacagagaga

SEQ ID NO: 3292452 - DNA, 19 bp, Homo sapiens
cgtgcgtgtgtgtgtgttt

SEQ ID NO: 3292453 - DNA, 13 bp, Homo sapiens
cgtgctgtaaata

SEQ ID NO: 3292454 - DNA, 16 bp, Homo sapiens
cgtgctgtctcctttg

SEQ ID NO: 3292455 - DNA, 16 bp, Homo sapiens
cgtgctgtcttctggt

SEQ ID NO: 3292456 - DNA, 19 bp, Homo sapiens
cgtggaacctctgtctcat

SEQ ID NO: 3292457 - DNA, 11 bp, Homo sapiens
cgtggacaggc

SEQ ID NO: 3292458 - DNA, 13 bp, Homo sapiens
cgtggacaggccc

SEQ ID NO: 3292459 - DNA, 13 bp, Homo sapiens
cgtggactctgca

SEQ ID NO: 3292460 - DNA, 20 bp, Homo sapiens
cgtggagagctggtgcccgg

SEQ ID NO: 3292461 - DNA, 16 bp, Homo sapiens
cgtggagccagggagc

SEQ ID NO: 3292462 - DNA, 22 bp, Homo sapiens
cgtggagcggggtatgaagagc

SEQ ID NO: 3292463 - DNA, 15 bp, Homo sapiens
cgtggcaaatataaa

SEQ ID NO: 3292464 - DNA, 17 bp, Homo sapiens
cgtggcacctcttccga

SEQ ID NO: 3292465 - DNA, 20 bp, Homo sapiens
cgtggcagataatcagcctc

SEQ ID NO: 3292466 - DNA, 16 bp, Homo sapiens
cgtggcatgtggcctg

SEQ ID NO: 3292467 - DNA, 19 bp, Homo sapiens
cgtggcatgtggcctgtgg

SEQ ID NO: 3292468 - DNA, 16 bp, Homo sapiens
cgtggccatccctgtg

SEQ ID NO: 3292469 - DNA, 21 bp, Homo sapiens
cgtggcctcgtgaggggcaag

SEQ ID NO: 3292470 - DNA, 15 bp, Homo sapiens
cgtggcctcttgagc

SEQ ID NO: 3292471 - DNA, 16 bp, Homo sapiens
cgtggcctcttgagca

SEQ ID NO: 3292472 - DNA, 20 bp, Homo sapiens
cgtggcctgagtcctggtcc

SEQ ID NO: 3292473 - DNA, 22 bp, Homo sapiens
cgtgggagacaagaaatccctg

SEQ ID NO: 3292474 - DNA, 18 bp, Homo sapiens
cgtggtagaggcctgggg

SEQ ID NO: 3292475 - DNA, 20 bp, Homo sapiens
cgtggtagaggcctggggcc

SEQ ID NO: 3292476 - DNA, 18 bp, Homo sapiens
cgtggtcactgtgcactg

SEQ ID NO: 3292477 - DNA, 21 bp, Homo sapiens
cgtggtgatcaattaaatgta

SEQ ID NO: 3292478 - DNA, 20 bp, Homo sapiens
cgtggtgtgtccctggacac

SEQ ID NO: 3292479 - DNA, 22 bp, Homo sapiens
cgtggtgtgtccctggacacag

SEQ ID NO: 3292480 - DNA, 17 bp, Homo sapiens
cgtgtatagtatctgta

SEQ ID NO: 3292481 - DNA, 22 bp, Homo sapiens
cgtgtatagtgcctaaaattgt

SEQ ID NO: 3292482 - DNA, 23 bp, Homo sapiens
cgtgtatagtgcctaaaattgta

SEQ ID NO: 3292483 - DNA, 17 bp, Homo sapiens
cgtgtatttggctgggc

SEQ ID NO: 3292484 - DNA, 18 bp, Homo sapiens
cgtgtatttggctgggct

SEQ ID NO: 3292485 - DNA, 16 bp, Homo sapiens
cgtgtattttcattac

SEQ ID NO: 3292486 - DNA, 16 bp, Homo sapiens
cgtgtcaatttccctc

SEQ ID NO: 3292487 - DNA, 14 bp, Homo sapiens
cgtgtcacacttgt

SEQ ID NO: 3292488 - DNA, 15 bp, Homo sapiens
cgtgtcacacttgtg

SEQ ID NO: 3292489 - DNA, 17 bp, Homo sapiens
cgtgtcacacttgtgac

SEQ ID NO: 3292490 - DNA, 23 bp, Homo sapiens
cgtgtctctcccaccccggcctc

SEQ ID NO: 3292491 - DNA, 22 bp, Homo sapiens
cgtgtctgtatttatgtgtgag

SEQ ID NO: 3292492 - DNA, 20 bp, Homo sapiens
cgtgtcttccactttgcata

SEQ ID NO: 3292493 - DNA, 17 bp, Homo sapiens
cgtgtgagtgtgacagg

SEQ ID NO: 3292494 - DNA, 21 bp, Homo sapiens
cgtgtgagtgtgacagggcca

SEQ ID NO: 3292495 - DNA, 20 bp, Homo sapiens
cgtgtgtaaatatgtacatt

SEQ ID NO: 3292496 - DNA, 16 bp, Homo sapiens
cgtgtgtgttgtctga

SEQ ID NO: 3292497 - DNA, 16 bp, Homo sapiens
cgtgttctccttttcc

SEQ ID NO: 3292498 - DNA, 20 bp, Homo sapiens
cgtgtttctgactctgagct

SEQ ID NO: 3292499 - DNA, 21 bp, Homo sapiens
cgtgttttattcctgtatgtt

SEQ ID NO: 3292500 - DNA, 15 bp, Homo sapiens
cgttaagggcagagt

SEQ ID NO: 3292501 - DNA, 16 bp, Homo sapiens
cgttagaccgctctct

SEQ ID NO: 3292502 - DNA, 13 bp, Homo sapiens
cgttagctcctgt

SEQ ID NO: 3292503 - DNA, 14 bp, Homo sapiens
cgttagctcctgtg

SEQ ID NO: 3292504 - DNA, 14 bp, Homo sapiens
cgttattataattg

SEQ ID NO: 3292505 - DNA, 13 bp, Homo sapiens
cgttatttatgga

SEQ ID NO: 3292506 - DNA, 17 bp, Homo sapiens
cgttcaaaacattccaa

SEQ ID NO: 3292507 - DNA, 12 bp, Homo sapiens
cgttccacagtt

SEQ ID NO: 3292508 - DNA, 14 bp, Homo sapiens
cgttccacagttgc

SEQ ID NO: 3292509 - DNA, 17 bp, Homo sapiens
cgttccacagttgccac

SEQ ID NO: 3292510 - DNA, 19 bp, Homo sapiens
cgttccacagttgccacca

SEQ ID NO: 3292511 - DNA, 21 bp, Homo sapiens
cgttccaccccaagagaactc

SEQ ID NO: 3292512 - DNA, 12 bp, Homo sapiens
cgttcccagcag

SEQ ID NO: 3292513 - DNA, 14 bp, Homo sapiens
cgttcccagcaggg

SEQ ID NO: 3292514 - DNA, 21 bp, Homo sapiens
cgttccccttggcttcctccg

SEQ ID NO: 3292515 - DNA, 18 bp, Homo sapiens
cgttccctgattatttat

SEQ ID NO: 3292516 - DNA, 21 bp, Homo sapiens
cgttcctgacatcacagcagc

SEQ ID NO: 3292517 - DNA, 19 bp, Homo sapiens
cgttcgatttctacctcag

SEQ ID NO: 3292518 - DNA, 22 bp, Homo sapiens
cgttctctgccccgtttcttgc

SEQ ID NO: 3292519 - DNA, 17 bp, Homo sapiens
cgttctctgtcctactt

SEQ ID NO: 3292520 - DNA, 19 bp, Homo sapiens
ctaccaggtgtgcctggaa

SEQ ID NO: 3292521 - DNA, 20 bp, Homo sapiens
ctaccaggtgtgcctggaag

SEQ ID NO: 3292522 - DNA, 14 bp, Homo sapiens
ctaccatcagggac

SEQ ID NO: 3292523 - DNA, 18 bp, Homo sapiens
ctaccatcagggacagga

SEQ ID NO: 3292524 - DNA, 19 bp, Homo sapiens
ctaccatgaacagaaaaca

SEQ ID NO: 3292525 - DNA, 12 bp, Homo sapiens
ctaccatttcag

SEQ ID NO: 3292526 - DNA, 13 bp, Homo sapiens
ctaccatttcaga

SEQ ID NO: 3292527 - DNA, 20 bp, Homo sapiens
ctaccatttgtgttttgaaa

SEQ ID NO: 3292528 - DNA, 14 bp, Homo sapiens
ctacccaaccactc

SEQ ID NO: 3292529 - DNA, 13 bp, Homo sapiens
ctacccaccctcc

SEQ ID NO: 3292530 - DNA, 17 bp, Homo sapiens
ctacccaccctcctttc

SEQ ID NO: 3292531 - DNA, 17 bp, Homo sapiens
ctacccaccgatggagc

SEQ ID NO: 3292532 - DNA, 23 bp, Homo sapiens
ctacccacgttctcacacccacc

SEQ ID NO: 3292533 - DNA, 15 bp, Homo sapiens
ctacccactatcctt

SEQ ID NO: 3292534 - DNA, 21 bp, Homo sapiens
ctacccagagattgcttctca

SEQ ID NO: 3292535 - DNA, 19 bp, Homo sapiens
ctacccagatggaaaaata

SEQ ID NO: 3292536 - DNA, 17 bp, Homo sapiens
ctacccagcgagccctg

SEQ ID NO: 3292537 - DNA, 18 bp, Homo sapiens
ctacccagcgagccctgg

SEQ ID NO: 3292538 - DNA, 19 bp, Homo sapiens
ctacccagcgagccctggt

SEQ ID NO: 3292539 - DNA, 18 bp, Homo sapiens
ctacccagcgtggcctcc

SEQ ID NO: 3292540 - DNA, 19 bp, Homo sapiens
ctacccaggaggctgaggt

SEQ ID NO: 3292541 - DNA, 17 bp, Homo sapiens
ctacccatgagcctgcc

SEQ ID NO: 3292542 - DNA, 13 bp, Homo sapiens
ctaccccagtccc

SEQ ID NO: 3292543 - DNA, 18 bp, Homo sapiens
ctaccccagtcccaggga

SEQ ID NO: 3292544 - DNA, 21 bp, Homo sapiens
ctacccccttttcagctgagc

SEQ ID NO: 3292545 - DNA, 15 bp, Homo sapiens
ctacccctgctccca

SEQ ID NO: 3292546 - DNA, 16 bp, Homo sapiens
ctacccctttcttctc

SEQ ID NO: 3292547 - DNA, 18 bp, Homo sapiens
ctaccctagccattcctg

SEQ ID NO: 3292548 - DNA, 19 bp, Homo sapiens
ctaccctcgggcccacctg

SEQ ID NO: 3292549 - DNA, 20 bp, Homo sapiens
ctaccctcgggcccacctgg

SEQ ID NO: 3292550 - DNA, 16 bp, Homo sapiens
ctaccctttttctcca

SEQ ID NO: 3292551 - DNA, 17 bp, Homo sapiens
ctaccgagtctcttctc

SEQ ID NO: 3292552 - DNA, 22 bp, Homo sapiens
ctaccgagtctcttctccactg

SEQ ID NO: 3292553 - DNA, 14 bp, Homo sapiens
ctaccgagttcaag

SEQ ID NO: 3292554 - DNA, 19 bp, Homo sapiens
ctacctcactactacatct

SEQ ID NO: 3292555 - DNA, 15 bp, Homo sapiens
ctacctcagcctaga

SEQ ID NO: 3292556 - DNA, 20 bp, Homo sapiens
ctacctcaggcaggaagggc

SEQ ID NO: 3292557 - DNA, 22 bp, Homo sapiens
ctacctcaggttgctggttgct

SEQ ID NO: 3292558 - DNA, 23 bp, Homo sapiens
ctacctccctccccgtctcattc

SEQ ID NO: 3292559 - DNA, 14 bp, Homo sapiens
ctacctccttagct

SEQ ID NO: 3292560 - DNA, 13 bp, Homo sapiens
ctacctctctgtc

SEQ ID NO: 3292561 - DNA, 16 bp, Homo sapiens
ctacctctgagaagac

SEQ ID NO: 3292562 - DNA, 16 bp, Homo sapiens
ctacctgccctcaagg

SEQ ID NO: 3292563 - DNA, 11 bp, Homo sapiens
ctacctgctgg

SEQ ID NO: 3292564 - DNA, 14 bp, Homo sapiens
ctacctgctggaca

SEQ ID NO: 3292565 - DNA, 15 bp, Homo sapiens
ctacctgtgtggtac

SEQ ID NO: 3292566 - DNA, 19 bp, Homo sapiens
ctaccttaaaatgtaaaac

SEQ ID NO: 3292567 - DNA, 19 bp, Homo sapiens
ctaccttgaaaataagaat

SEQ ID NO: 3292568 - DNA, 22 bp, Homo sapiens
ctaccttgaggtcttttgacat

SEQ ID NO: 3292569 - DNA, 21 bp, Homo sapiens
ctacgagggaggaacacctga

SEQ ID NO: 3292570 - DNA, 14 bp, Homo sapiens
ctactaaagtgcct

SEQ ID NO: 3292571 - DNA, 20 bp, Homo sapiens
ctactaagttcacattagaa

SEQ ID NO: 3292572 - DNA, 15 bp, Homo sapiens
ctactaattccacac

SEQ ID NO: 3292573 - DNA, 13 bp, Homo sapiens
ctactacatctgt

SEQ ID NO: 3292574 - DNA, 19 bp, Homo sapiens
ctactaccacaaggaaaat

SEQ ID NO: 3292575 - DNA, 22 bp, Homo sapiens
ctactagagtctgaacagctgt

SEQ ID NO: 3292576 - DNA, 14 bp, Homo sapiens
ctactataaagaga

SEQ ID NO: 3292577 - DNA, 13 bp, Homo sapiens
ctactataatcaa

SEQ ID NO: 3292578 - DNA, 17 bp, Homo sapiens
ctactataatcaaatga

SEQ ID NO: 3292579 - DNA, 18 bp, Homo sapiens
ctactatgccagatgcct

SEQ ID NO: 3292580 - DNA, 18 bp, Homo sapiens
ctactattcatgttttga

SEQ ID NO: 3292581 - DNA, 18 bp, Homo sapiens
ctactcacagtctcttta

SEQ ID NO: 3292582 - DNA, 13 bp, Homo sapiens
ctactcagaagcc

SEQ ID NO: 3292583 - DNA, 16 bp, Homo sapiens
ctactcagaagcctga

SEQ ID NO: 3292584 - DNA, 21 bp, Homo sapiens
ctactcagaagcctgaggctg

SEQ ID NO: 3292585 - DNA, 12 bp, Homo sapiens
ctactccactgc

SEQ ID NO: 3292586 - DNA, 11 bp, Homo sapiens
ctactccctct

SEQ ID NO: 3292587 - DNA, 14 bp, Homo sapiens
ctactccctgcaga

SEQ ID NO: 3292588 - DNA, 18 bp, Homo sapiens
ctactccctgcagatgcc

SEQ ID NO: 3292589 - DNA, 11 bp, Homo sapiens
ctactcctgac

SEQ ID NO: 3292590 - DNA, 19 bp, Homo sapiens
ctactctccccacgagggc

SEQ ID NO: 3292591 - DNA, 21 bp, Homo sapiens
ctactctccccacgagggctg

SEQ ID NO: 3292592 - DNA, 17 bp, Homo sapiens
ctactctcctcggcccc

SEQ ID NO: 3292593 - DNA, 14 bp, Homo sapiens
ctactctgtccagg

SEQ ID NO: 3292594 - DNA, 16 bp, Homo sapiens
ctactctgtccaggcc

SEQ ID NO: 3292595 - DNA, 17 bp, Homo sapiens
ctactctgtccaggcca

SEQ ID NO: 3292596 - DNA, 13 bp, Homo sapiens
ctactctgtgtca

SEQ ID NO: 3292597 - DNA, 16 bp, Homo sapiens
ctactctgtgtcaggt

SEQ ID NO: 3292598 - DNA, 14 bp, Homo sapiens
ctactcttgtcatt

SEQ ID NO: 3292599 - DNA, 22 bp, Homo sapiens
ctactgaaacagatttcatacc

SEQ ID NO: 3292600 - DNA, 14 bp, Homo sapiens
ctactgacatgtgg

SEQ ID NO: 3292601 - DNA, 15 bp, Homo sapiens
ctactgacatgtggg

SEQ ID NO: 3292602 - DNA, 20 bp, Homo sapiens
ctactgagctgagaccactg

SEQ ID NO: 3292603 - DNA, 16 bp, Homo sapiens
ctactgattgtttcat

SEQ ID NO: 3292604 - DNA, 20 bp, Homo sapiens
ctactgcactccagcctggg

SEQ ID NO: 3292605 - DNA, 23 bp, Homo sapiens
ctactgcactccagcctggggga

SEQ ID NO: 3292606 - DNA, 13 bp, Homo sapiens
ctactgcagcacc

SEQ ID NO: 3292607 - DNA, 20 bp, Homo sapiens
ctactgcagcacctccaggc

SEQ ID NO: 3292608 - DNA, 22 bp, Homo sapiens
ctactgcagcacctccaggcct

SEQ ID NO: 3292609 - DNA, 14 bp, Homo sapiens
ctactggattctta

SEQ ID NO: 3292610 - DNA, 19 bp, Homo sapiens
ctactgtaattttatatga

SEQ ID NO: 3292611 - DNA, 13 bp, Homo sapiens
ctactgtacataa

SEQ ID NO: 3292612 - DNA, 20 bp, Homo sapiens
ctactgtacataaacaatga

SEQ ID NO: 3292613 - DNA, 17 bp, Homo sapiens
ctactgtactttgccat

SEQ ID NO: 3292614 - DNA, 17 bp, Homo sapiens
ctactgtctttggaaaa

SEQ ID NO: 3292615 - DNA, 16 bp, Homo sapiens
ctactgtgcatctcct

SEQ ID NO: 3292616 - DNA, 13 bp, Homo sapiens
ctactgtgttcct

SEQ ID NO: 3292617 - DNA, 15 bp, Homo sapiens
ctactgtgttcctgg

SEQ ID NO: 3292618 - DNA, 14 bp, Homo sapiens
ctactgttcctttc

SEQ ID NO: 3292619 - DNA, 15 bp, Homo sapiens
ctactgttcctttca

SEQ ID NO: 3292620 - DNA, 14 bp, Homo sapiens
ctactgttctaaag

SEQ ID NO: 3292621 - DNA, 18 bp, Homo sapiens
ctactgttctaaagctct

SEQ ID NO: 3292622 - DNA, 22 bp, Homo sapiens
ctactgttgtaagaattctgat

SEQ ID NO: 3292623 - DNA, 15 bp, Homo sapiens
ctacttaattccttt

SEQ ID NO: 3292624 - DNA, 16 bp, Homo sapiens
ctacttcatagctcct

SEQ ID NO: 3292625 - DNA, 20 bp, Homo sapiens
ctacttcctgtgacttcagc

SEQ ID NO: 3292626 - DNA, 23 bp, Homo sapiens
ctacttgggaggctgaggcagga

SEQ ID NO: 3292627 - DNA, 15 bp, Homo sapiens
ctactttaagcacta

SEQ ID NO: 3292628 - DNA, 18 bp, Homo sapiens
ctactttgactttttgca

SEQ ID NO: 3292629 - DNA, 20 bp, Homo sapiens
ctactttgactttttgcatt

SEQ ID NO: 3292630 - DNA, 21 bp, Homo sapiens
ctactttgactttttgcattt

SEQ ID NO: 3292631 - DNA, 19 bp, Homo sapiens
ctactttgcttccgccact

SEQ ID NO: 3292632 - DNA, 17 bp, Homo sapiens
ctactttgtggcaatct

SEQ ID NO: 3292633 - DNA, 22 bp, Homo sapiens
ctagaaaacttgactccatttc

SEQ ID NO: 3292634 - DNA, 18 bp, Homo sapiens
ctagaaaagctgatcata

SEQ ID NO: 3292635 - DNA, 17 bp, Homo sapiens
ctagaaacccaagctcc

SEQ ID NO: 3292636 - DNA, 23 bp, Homo sapiens
ctagaaacccaagctcctcctcg

SEQ ID NO: 3292637 - DNA, 14 bp, Homo sapiens
ctagaaagaaaaga

SEQ ID NO: 3292638 - DNA, 20 bp, Homo sapiens
ctagaaagaagctcgcccca

SEQ ID NO: 3292639 - DNA, 22 bp, Homo sapiens
ctagaaagcctgttcccctcac

SEQ ID NO: 3292640 - DNA, 16 bp, Homo sapiens
ctagaaattgacacaa

SEQ ID NO: 3292641 - DNA, 13 bp, Homo sapiens
ctagaaattttca

SEQ ID NO: 3292642 - DNA, 21 bp, Homo sapiens
ctagaacacaggcaaaatcct

SEQ ID NO: 3292643 - DNA, 22 bp, Homo sapiens
ctagaacactaactcaccagcc

SEQ ID NO: 3292644 - DNA, 13 bp, Homo sapiens
ctagaacctgggc

SEQ ID NO: 3292645 - DNA, 16 bp, Homo sapiens
ctagaactccctttca

SEQ ID NO: 3292646 - DNA, 16 bp, Homo sapiens
ctatataatttatttc

SEQ ID NO: 3292647 - DNA, 20 bp, Homo sapiens
ctatataatttatttccact

SEQ ID NO: 3292648 - DNA, 17 bp, Homo sapiens
ctatatacatgtgtgta

SEQ ID NO: 3292649 - DNA, 14 bp, Homo sapiens
ctatatagagatgt

SEQ ID NO: 3292650 - DNA, 16 bp, Homo sapiens
ctatatataattctgt

SEQ ID NO: 3292651 - DNA, 21 bp, Homo sapiens
ctatatataattctgtacata

SEQ ID NO: 3292652 - DNA, 17 bp, Homo sapiens
ctatatatataaatgta

SEQ ID NO: 3292653 - DNA, 13 bp, Homo sapiens
ctatatatttcta

SEQ ID NO: 3292654 - DNA, 16 bp, Homo sapiens
ctatatattttatgat

SEQ ID NO: 3292655 - DNA, 14 bp, Homo sapiens
ctatatcatgcttt

SEQ ID NO: 3292656 - DNA, 12 bp, Homo sapiens
ctatatccatgt

SEQ ID NO: 3292657 - DNA, 13 bp, Homo sapiens
ctatatccatgta

SEQ ID NO: 3292658 - DNA, 13 bp, Homo sapiens
ctatatctatata

SEQ ID NO: 3292659 - DNA, 15 bp, Homo sapiens
ctatatgaaaaacaa

SEQ ID NO: 3292660 - DNA, 23 bp, Homo sapiens
ctatatgaatttaaatataattc

SEQ ID NO: 3292661 - DNA, 13 bp, Homo sapiens
ctatatgatttat

SEQ ID NO: 3292662 - DNA, 19 bp, Homo sapiens
ctatatggcaagaaagctg

SEQ ID NO: 3292663 - DNA, 21 bp, Homo sapiens
ctatatgtacagctctcccct

SEQ ID NO: 3292664 - DNA, 12 bp, Homo sapiens
ctatatgtgaat

SEQ ID NO: 3292665 - DNA, 17 bp, Homo sapiens
ctatattagatcaaata

SEQ ID NO: 3292666 - DNA, 20 bp, Homo sapiens
ctatattatgtcttcttttg

SEQ ID NO: 3292667 - DNA, 16 bp, Homo sapiens
ctatattattatatat

SEQ ID NO: 3292668 - DNA, 11 bp, Homo sapiens
ctatattctat

SEQ ID NO: 3292669 - DNA, 12 bp, Homo sapiens
ctatattctata

SEQ ID NO: 3292670 - DNA, 16 bp, Homo sapiens
ctatatttaacaagat

SEQ ID NO: 3292671 - DNA, 13 bp, Homo sapiens
ctatatttacaaa

SEQ ID NO: 3292672 - DNA, 16 bp, Homo sapiens
ctatatttacagtgaa

SEQ ID NO: 3292673 - DNA, 15 bp, Homo sapiens
ctatcaaaagaaata

SEQ ID NO: 3292674 - DNA, 18 bp, Homo sapiens
ctatcaaaagaaatagaa

SEQ ID NO: 3292675 - DNA, 20 bp, Homo sapiens
ctatcaaaagaaatagaaaa

SEQ ID NO: 3292676 - DNA, 15 bp, Homo sapiens
ctatcaacaataaaa

SEQ ID NO: 3292677 - DNA, 19 bp, Homo sapiens
ctatcaacaataaaatttt

SEQ ID NO: 3292678 - DNA, 14 bp, Homo sapiens
ctatcaagcactaa

SEQ ID NO: 3292679 - DNA, 15 bp, Homo sapiens
ctatcaagtcaatca

SEQ ID NO: 3292680 - DNA, 19 bp, Homo sapiens
ctatcaagtcaatcatttc

SEQ ID NO: 3292681 - DNA, 19 bp, Homo sapiens
ctatcagcaatactcatca

SEQ ID NO: 3292682 - DNA, 22 bp, Homo sapiens
ctatcagcaatactcatcagag

SEQ ID NO: 3292683 - DNA, 14 bp, Homo sapiens
ctatcattctcagt

SEQ ID NO: 3292684 - DNA, 15 bp, Homo sapiens
ctatcattctcagtg

SEQ ID NO: 3292685 - DNA, 19 bp, Homo sapiens
ctatcattgcttcctcctc

SEQ ID NO: 3292686 - DNA, 20 bp, Homo sapiens
ctatcatttccgttttgcct

SEQ ID NO: 3292687 - DNA, 22 bp, Homo sapiens
ctatcatttttgtacagtttgc

SEQ ID NO: 3292688 - DNA, 23 bp, Homo sapiens
ctatcatttttgtacagtttgct

SEQ ID NO: 3292689 - DNA, 19 bp, Homo sapiens
ctatccaaacatgtattta

SEQ ID NO: 3292690 - DNA, 15 bp, Homo sapiens
ctatccacagagagt

SEQ ID NO: 3292691 - DNA, 14 bp, Homo sapiens
ctatcccaaaccta

SEQ ID NO: 3292692 - DNA, 14 bp, Homo sapiens
ctatcccattctgc

SEQ ID NO: 3292693 - DNA, 19 bp, Homo sapiens
ctatccccatctccctgcc

SEQ ID NO: 3292694 - DNA, 22 bp, Homo sapiens
ctatccccatctccctgcctgg

SEQ ID NO: 3292695 - DNA, 14 bp, Homo sapiens
ctatccctcacaca

SEQ ID NO: 3292696 - DNA, 17 bp, Homo sapiens
ctatccgctgccagcct

SEQ ID NO: 3292697 - DNA, 17 bp, Homo sapiens
ctatcctgcgggtttta

SEQ ID NO: 3292698 - DNA, 19 bp, Homo sapiens
ctatccttccagtggctcg

SEQ ID NO: 3292699 - DNA, 12 bp, Homo sapiens
ctatccttggca

SEQ ID NO: 3292700 - DNA, 17 bp, Homo sapiens
ctatccttggcaccaaa

SEQ ID NO: 3292701 - DNA, 20 bp, Homo sapiens
ctatccttggcaccaaagat

SEQ ID NO: 3292702 - DNA, 20 bp, Homo sapiens
ctatcgagtttgcaatgtca

SEQ ID NO: 3292703 - DNA, 14 bp, Homo sapiens
ctatctaaagtttg

SEQ ID NO: 3292704 - DNA, 15 bp, Homo sapiens
ctatctatcttccaa

SEQ ID NO: 3292705 - DNA, 19 bp, Homo sapiens
ctatctcctgacagaaggt

SEQ ID NO: 3292706 - DNA, 17 bp, Homo sapiens
ctatctcgtgggagagc

SEQ ID NO: 3292707 - DNA, 17 bp, Homo sapiens
ctatctgattttgtgca

SEQ ID NO: 3292708 - DNA, 12 bp, Homo sapiens
ctatctgggcct

SEQ ID NO: 3292709 - DNA, 15 bp, Homo sapiens
ctatctgggcctggg

SEQ ID NO: 3292710 - DNA, 21 bp, Homo sapiens
ctatctgggcctgggctaggg

SEQ ID NO: 3292711 - DNA, 16 bp, Homo sapiens
ctatctggggagctcc

SEQ ID NO: 3292712 - DNA, 19 bp, Homo sapiens
ctatctggggagctcctgg

SEQ ID NO: 3292713 - DNA, 20 bp, Homo sapiens
ctatctggggagctcctggc

SEQ ID NO: 3292714 - DNA, 12 bp, Homo sapiens
ctatctgtattc

SEQ ID NO: 3292715 - DNA, 16 bp, Homo sapiens
ctatctgtatttatta

SEQ ID NO: 3292716 - DNA, 14 bp, Homo sapiens
ctatctgtctggtg

SEQ ID NO: 3292717 - DNA, 17 bp, Homo sapiens
ctatctgtctggtggcc

SEQ ID NO: 3292718 - DNA, 21 bp, Homo sapiens
ctatctgtctggtggccccgt

SEQ ID NO: 3292719 - DNA, 17 bp, Homo sapiens
ctatgaacttctctcag

SEQ ID NO: 3292720 - DNA, 16 bp, Homo sapiens
ctatgaagttgctgtt

SEQ ID NO: 3292721 - DNA, 22 bp, Homo sapiens
ctatgaagttgctgtttatttt

SEQ ID NO: 3292722 - DNA, 19 bp, Homo sapiens
ctatgaagttggcacattt

SEQ ID NO: 3292723 - DNA, 14 bp, Homo sapiens
ctatgacatttcta

SEQ ID NO: 3292724 - DNA, 15 bp, Homo sapiens
ctatgactgctcccc

SEQ ID NO: 3292725 - DNA, 16 bp, Homo sapiens
ctatgactgtatcttg

SEQ ID NO: 3292726 - DNA, 22 bp, Homo sapiens
ctatgagcatcctgagccccgc

SEQ ID NO: 3292727 - DNA, 14 bp, Homo sapiens
ctatgaggaaaggt

SEQ ID NO: 3292728 - DNA, 22 bp, Homo sapiens
ctatgaggaataattatttatt

SEQ ID NO: 3292729 - DNA, 22 bp, Homo sapiens
ctatgagggccttgtaataaat

SEQ ID NO: 3292730 - DNA, 17 bp, Homo sapiens
ctatgagggtgtttcct

SEQ ID NO: 3292731 - DNA, 20 bp, Homo sapiens
ctatgagggtgtttcctcta

SEQ ID NO: 3292732 - DNA, 14 bp, Homo sapiens
ctatgagtctagat

SEQ ID NO: 3292733 - DNA, 19 bp, Homo sapiens
ctatgagtctagatgttta

SEQ ID NO: 3292734 - DNA, 15 bp, Homo sapiens
ctatgagttggactt

SEQ ID NO: 3292735 - DNA, 17 bp, Homo sapiens
ctatgataaattatgat

SEQ ID NO: 3292736 - DNA, 18 bp, Homo sapiens
ctatgattatgccactgc

SEQ ID NO: 3292737 - DNA, 18 bp, Homo sapiens
ctatgatttttttttcca

SEQ ID NO: 3292738 - DNA, 19 bp, Homo sapiens
ctatgcacagagcccaatg

SEQ ID NO: 3292739 - DNA, 21 bp, Homo sapiens
ctatgcacatatggactctgc

SEQ ID NO: 3292740 - DNA, 15 bp, Homo sapiens
ctatgcccaggtacc

SEQ ID NO: 3292741 - DNA, 20 bp, Homo sapiens
ctatgcccaggtaccaccct

SEQ ID NO: 3292742 - DNA, 23 bp, Homo sapiens
ctatgcgcaaaactgcctgaaag

SEQ ID NO: 3292743 - DNA, 16 bp, Homo sapiens
ctatggaagtggttct

SEQ ID NO: 3292744 - DNA, 14 bp, Homo sapiens
ctatggacaactta

SEQ ID NO: 3292745 - DNA, 23 bp, Homo sapiens
ctatggagcctggcacaggactg

SEQ ID NO: 3292746 - DNA, 15 bp, Homo sapiens
ctatggatggcttct

SEQ ID NO: 3292747 - DNA, 16 bp, Homo sapiens
ctatggatggcttcta

SEQ ID NO: 3292748 - DNA, 11 bp, Homo sapiens
ctatggatgtg

SEQ ID NO: 3292749 - DNA, 17 bp, Homo sapiens
ctatggctggccactgc

SEQ ID NO: 3292750 - DNA, 14 bp, Homo sapiens
ctatggctttcaaa

SEQ ID NO: 3292751 - DNA, 13 bp, Homo sapiens
ctatgggaacaat

SEQ ID NO: 3292752 - DNA, 22 bp, Homo sapiens
ctatgggactcaatgcactgac

SEQ ID NO: 3292753 - DNA, 14 bp, Homo sapiens
ctatgggagcccca

SEQ ID NO: 3292754 - DNA, 15 bp, Homo sapiens
ctatgggagccccag

SEQ ID NO: 3292755 - DNA, 16 bp, Homo sapiens
ctatgggagccccagg

SEQ ID NO: 3292756 - DNA, 22 bp, Homo sapiens
ctatggggagaggaactccttg

SEQ ID NO: 3292757 - DNA, 19 bp, Homo sapiens
ctatgggtctaggacacag

SEQ ID NO: 3292758 - DNA, 17 bp, Homo sapiens
ctatggtatgctggcca

SEQ ID NO: 3292759 - DNA, 18 bp, Homo sapiens
ctatggtatgctggccag

SEQ ID NO: 3292760 - DNA, 21 bp, Homo sapiens
ctatggtcgggagacagcatc

SEQ ID NO: 3292761 - DNA, 14 bp, Homo sapiens
ctatggttatgaaa

SEQ ID NO: 3292762 - DNA, 16 bp, Homo sapiens
ctatggttatgaaaga

SEQ ID NO: 3292763 - DNA, 20 bp, Homo sapiens
ctatggttgccaccccaacc

SEQ ID NO: 3292764 - DNA, 19 bp, Homo sapiens
ctatggtttgccattattt

SEQ ID NO: 3292765 - DNA, 23 bp, Homo sapiens
ctatggtttgccattatttaata

SEQ ID NO: 3292766 - DNA, 13 bp, Homo sapiens
ctatgtatcaatg

SEQ ID NO: 3292767 - DNA, 16 bp, Homo sapiens
ctatgtatcaatgagt

SEQ ID NO: 3292768 - DNA, 19 bp, Homo sapiens
ctatgtatcaatgagtaac

SEQ ID NO: 3292769 - DNA, 13 bp, Homo sapiens
ctatgtatttgca

SEQ ID NO: 3292770 - DNA, 18 bp, Homo sapiens
ctatgtcctaaggacaca

SEQ ID NO: 3292771 - DNA, 20 bp, Homo sapiens
ctatgtcctaaggacacact

SEQ ID NO: 3292772 - DNA, 19 bp, Homo sapiens
ctatgtgccttatgttgaa

SEQ ID NO: 3292773 - DNA, 16 bp, Homo sapiens
ctcagggccaggaagg

SEQ ID NO: 3292774 - DNA, 15 bp, Homo sapiens
ctcagggccatgctg

SEQ ID NO: 3292775 - DNA, 17 bp, Homo sapiens
ctcagggccatgctgag

SEQ ID NO: 3292776 - DNA, 16 bp, Homo sapiens
ctcagggcctggcagg

SEQ ID NO: 3292777 - DNA, 19 bp, Homo sapiens
ctcagggcctggcaggcca

SEQ ID NO: 3292778 - DNA, 20 bp, Homo sapiens
ctcagggcctggcaggccag

SEQ ID NO: 3292779 - DNA, 16 bp, Homo sapiens
ctcagggctcctccca

SEQ ID NO: 3292780 - DNA, 18 bp, Homo sapiens
ctcagggctcctcccagc

SEQ ID NO: 3292781 - DNA, 16 bp, Homo sapiens
ctcagggctcctgcct

SEQ ID NO: 3292782 - DNA, 13 bp, Homo sapiens
ctcaggggcagct

SEQ ID NO: 3292783 - DNA, 20 bp, Homo sapiens
ctcaggggccagaggaactg

SEQ ID NO: 3292784 - DNA, 19 bp, Homo sapiens
ctcagggggtcagcagagt

SEQ ID NO: 3292785 - DNA, 20 bp, Homo sapiens
ctcagggggtcagcagagtt

SEQ ID NO: 3292786 - DNA, 16 bp, Homo sapiens
ctcagggtgcagaggt

SEQ ID NO: 3292787 - DNA, 17 bp, Homo sapiens
ctcagggttcatctgtc

SEQ ID NO: 3292788 - DNA, 20 bp, Homo sapiens
ctcagggttcatctgtccat

SEQ ID NO: 3292789 - DNA, 21 bp, Homo sapiens
ctcaggtacggagaagaatag

SEQ ID NO: 3292790 - DNA, 18 bp, Homo sapiens
ctcaggtgatccacccac

SEQ ID NO: 3292791 - DNA, 22 bp, Homo sapiens
ctcaggtgatccacccacctca

SEQ ID NO: 3292792 - DNA, 23 bp, Homo sapiens
ctcaggtgatccacccacctcag

SEQ ID NO: 3292793 - DNA, 23 bp, Homo sapiens
ctcaggtgccactccctgagctt

SEQ ID NO: 3292794 - DNA, 21 bp, Homo sapiens
ctcaggtggccagcctggatc

SEQ ID NO: 3292795 - DNA, 15 bp, Homo sapiens
ctcaggtgtccctgc

SEQ ID NO: 3292796 - DNA, 17 bp, Homo sapiens
ctcaggtgtccctgcac

SEQ ID NO: 3292797 - DNA, 14 bp, Homo sapiens
ctcaggttctattt

SEQ ID NO: 3292798 - DNA, 20 bp, Homo sapiens
ctcaggttgctggttgctgt

SEQ ID NO: 3292799 - DNA, 21 bp, Homo sapiens
ctcaggttgctggttgctgtg

SEQ ID NO: 3292800 - DNA, 22 bp, Homo sapiens
ctcaggttgctggttgctgtgt

SEQ ID NO: 3292801 - DNA, 18 bp, Homo sapiens
ctcagtcatgcataaata

SEQ ID NO: 3292802 - DNA, 17 bp, Homo sapiens
ctcagtcctcccctcac

SEQ ID NO: 3292803 - DNA, 21 bp, Homo sapiens
ctcagtcctcccctcacagcc

SEQ ID NO: 3292804 - DNA, 14 bp, Homo sapiens
ctcagtctcccttt

SEQ ID NO: 3292805 - DNA, 17 bp, Homo sapiens
ctcagtctctcttctct

SEQ ID NO: 3292806 - DNA, 20 bp, Homo sapiens
ctcagtgttagagaaatcct

SEQ ID NO: 3292807 - DNA, 19 bp, Homo sapiens
ctcagtgttggtatatttt

SEQ ID NO: 3292808 - DNA, 23 bp, Homo sapiens
ctcagtgttttggactccatctc

SEQ ID NO: 3292809 - DNA, 18 bp, Homo sapiens
ctcagttcaacctggtgg

SEQ ID NO: 3292810 - DNA, 17 bp, Homo sapiens
ctcagttcccagctccc

SEQ ID NO: 3292811 - DNA, 14 bp, Homo sapiens
ctcagttcccttgg

SEQ ID NO: 3292812 - DNA, 15 bp, Homo sapiens
ctcagttcccttggc

SEQ ID NO: 3292813 - DNA, 16 bp, Homo sapiens
ctcagttcccttggcc

SEQ ID NO: 3292814 - DNA, 18 bp, Homo sapiens
ctcagttcccttggcctc

SEQ ID NO: 3292815 - DNA, 21 bp, Homo sapiens
ctcagttcccttggcctcaga

SEQ ID NO: 3292816 - DNA, 22 bp, Homo sapiens
ctcagttcccttggcctcagaa

SEQ ID NO: 3292817 - DNA, 22 bp, Homo sapiens
ctcagttctctcccttcctctc

SEQ ID NO: 3292818 - DNA, 23 bp, Homo sapiens
ctcagttctctcccttcctctct

SEQ ID NO: 3292819 - DNA, 18 bp, Homo sapiens
ctcagttttatcattttc

SEQ ID NO: 3292820 - DNA, 14 bp, Homo sapiens
ctcataaaaagcaa

SEQ ID NO: 3292821 - DNA, 21 bp, Homo sapiens
ctcataaaaagcctgcaattt

SEQ ID NO: 3292822 - DNA, 15 bp, Homo sapiens
ctcataaaaataaaa

SEQ ID NO: 3292823 - DNA, 16 bp, Homo sapiens
ctcataaaaataaaag

SEQ ID NO: 3292824 - DNA, 18 bp, Homo sapiens
ctcataagtttgtttaaa

SEQ ID NO: 3292825 - DNA, 15 bp, Homo sapiens
ctcataatgctttgt

SEQ ID NO: 3292826 - DNA, 15 bp, Homo sapiens
ctcatacctctgacc

SEQ ID NO: 3292827 - DNA, 16 bp, Homo sapiens
ctcatacctttaaagg

SEQ ID NO: 3292828 - DNA, 14 bp, Homo sapiens
ctcatactgtctgg

SEQ ID NO: 3292829 - DNA, 21 bp, Homo sapiens
ctcataggaaaagtacattta

SEQ ID NO: 3292830 - DNA, 16 bp, Homo sapiens
ctcataggagactgcg

SEQ ID NO: 3292831 - DNA, 20 bp, Homo sapiens
ctcatagtatggtggctggg

SEQ ID NO: 3292832 - DNA, 19 bp, Homo sapiens
ctcatatatattttaaaaa

SEQ ID NO: 3292833 - DNA, 23 bp, Homo sapiens
ctcatatatattttaaaaacact

SEQ ID NO: 3292834 - DNA, 15 bp, Homo sapiens
ctcatatcagtttgc

SEQ ID NO: 3292835 - DNA, 19 bp, Homo sapiens
ctcatattgtgattctgcc

SEQ ID NO: 3292836 - DNA, 21 bp, Homo sapiens
ctcatattgtgattctgcctt

SEQ ID NO: 3292837 - DNA, 13 bp, Homo sapiens
ctcatatttaaag

SEQ ID NO: 3292838 - DNA, 13 bp, Homo sapiens
ctcatattttgta

SEQ ID NO: 3292839 - DNA, 13 bp, Homo sapiens
ctcatcaactgaa

SEQ ID NO: 3292840 - DNA, 14 bp, Homo sapiens
ctcatcaactgaat

SEQ ID NO: 3292841 - DNA, 21 bp, Homo sapiens
ctcatcaatcaaataagtatt

SEQ ID NO: 3292842 - DNA, 15 bp, Homo sapiens
ctcatcactggatga

SEQ ID NO: 3292843 - DNA, 20 bp, Homo sapiens
ctcatcaggatgaacccagg

SEQ ID NO: 3292844 - DNA, 13 bp, Homo sapiens
ctcatccacccca

SEQ ID NO: 3292845 - DNA, 16 bp, Homo sapiens
ctcatccaccccatcc

SEQ ID NO: 3292846 - DNA, 19 bp, Homo sapiens
ctcatcccacgcactccat

SEQ ID NO: 3292847 - DNA, 17 bp, Homo sapiens
ctcatcccctcgtcctg

SEQ ID NO: 3292848 - DNA, 15 bp, Homo sapiens
ctcatcctcctggaa

SEQ ID NO: 3292849 - DNA, 23 bp, Homo sapiens
ctcatcctcctggaaccttgctg

SEQ ID NO: 3292850 - DNA, 16 bp, Homo sapiens
ctcatcgcgtcctcct

SEQ ID NO: 3292851 - DNA, 15 bp, Homo sapiens
ctcatctatgaggaa

SEQ ID NO: 3292852 - DNA, 23 bp, Homo sapiens
ctcatctccaaggatcctctcca

SEQ ID NO: 3292853 - DNA, 17 bp, Homo sapiens
ctcatctgtggagctgc

SEQ ID NO: 3292854 - DNA, 21 bp, Homo sapiens
ctcatctgtggagctgccaca

SEQ ID NO: 3292855 - DNA, 12 bp, Homo sapiens
ctcatctttaaa

SEQ ID NO: 3292856 - DNA, 21 bp, Homo sapiens
ctcatgataccacctttactg

SEQ ID NO: 3292857 - DNA, 19 bp, Homo sapiens
ctcatgcaaatcaattact

SEQ ID NO: 3292858 - DNA, 20 bp, Homo sapiens
ctcatgcaaatcaattactg

SEQ ID NO: 3292859 - DNA, 19 bp, Homo sapiens
ctcatgcatagtcccagct

SEQ ID NO: 3292860 - DNA, 20 bp, Homo sapiens
ctcatgcatagtcccagcta

SEQ ID NO: 3292861 - DNA, 17 bp, Homo sapiens
ctcatgcccaccccctg

SEQ ID NO: 3292862 - DNA, 19 bp, Homo sapiens
ctcatgcccaccccctgcc

SEQ ID NO: 3292863 - DNA, 20 bp, Homo sapiens
ctcatgcccaccccctgccc

SEQ ID NO: 3292864 - DNA, 12 bp, Homo sapiens
ctcatgcctcag

SEQ ID NO: 3292865 - DNA, 14 bp, Homo sapiens
ctcatgcctgctga

SEQ ID NO: 3292866 - DNA, 15 bp, Homo sapiens
ctcatgcctgctgag

SEQ ID NO: 3292867 - DNA, 14 bp, Homo sapiens
ctcatgctgttgct

SEQ ID NO: 3292868 - DNA, 14 bp, Homo sapiens
ctcatggcccctct

SEQ ID NO: 3292869 - DNA, 17 bp, Homo sapiens
ctcatggcccctctgac

SEQ ID NO: 3292870 - DNA, 19 bp, Homo sapiens
ctcatggcgtaatgggcct

SEQ ID NO: 3292871 - DNA, 21 bp, Homo sapiens
ctcatggcgtaatgggcctgc

SEQ ID NO: 3292872 - DNA, 22 bp, Homo sapiens
ctcatggcgtaatgggcctgcc

SEQ ID NO: 3292873 - DNA, 16 bp, Homo sapiens
ctcatggggtccaagt

SEQ ID NO: 3292874 - DNA, 14 bp, Homo sapiens
ctcatgggtggcac

SEQ ID NO: 3292875 - DNA, 19 bp, Homo sapiens
ctcatggtgcatataaata

SEQ ID NO: 3292876 - DNA, 20 bp, Homo sapiens
ctcatggtgcatataaatat

SEQ ID NO: 3292877 - DNA, 13 bp, Homo sapiens
ctcatgtaacatt

SEQ ID NO: 3292878 - DNA, 17 bp, Homo sapiens
ctcatgtaacattggtg

SEQ ID NO: 3292879 - DNA, 16 bp, Homo sapiens
ctcatgtacataccct

SEQ ID NO: 3292880 - DNA, 16 bp, Homo sapiens
ctcatgtcctgctggc

SEQ ID NO: 3292881 - DNA, 17 bp, Homo sapiens
ctcatgtcctgctggct

SEQ ID NO: 3292882 - DNA, 18 bp, Homo sapiens
ctcatgtcctgctggctt

SEQ ID NO: 3292883 - DNA, 13 bp, Homo sapiens
ctcatgtggctgg

SEQ ID NO: 3292884 - DNA, 13 bp, Homo sapiens
ctcatgttggcca

SEQ ID NO: 3292885 - DNA, 13 bp, Homo sapiens
ctcatgtttatga

SEQ ID NO: 3292886 - DNA, 17 bp, Homo sapiens
ctcatgtttatgaaaat

SEQ ID NO: 3292887 - DNA, 15 bp, Homo sapiens
ctcattactgggcct

SEQ ID NO: 3292888 - DNA, 16 bp, Homo sapiens
ctcattactgggcctt

SEQ ID NO: 3292889 - DNA, 14 bp, Homo sapiens
ctcattcagtatta

SEQ ID NO: 3292890 - DNA, 17 bp, Homo sapiens
ctcattcagtattaaag

SEQ ID NO: 3292891 - DNA, 18 bp, Homo sapiens
ctcattccaccttcccat

SEQ ID NO: 3292892 - DNA, 17 bp, Homo sapiens
ctcattctatccccaat

SEQ ID NO: 3292893 - DNA, 18 bp, Homo sapiens
ctcattctgaattaatta

SEQ ID NO: 3292894 - DNA, 18 bp, Homo sapiens
ctcattgcccccacctct

SEQ ID NO: 3292895 - DNA, 20 bp, Homo sapiens
ctcattgcccccacctctgg

SEQ ID NO: 3292896 - DNA, 15 bp, Homo sapiens
ctcattgcctcctgt

SEQ ID NO: 3292897 - DNA, 18 bp, Homo sapiens
ctcattgcctcctgttct

SEQ ID NO: 3292898 - DNA, 14 bp, Homo sapiens
ctcctccctggctg

SEQ ID NO: 3292899 - DNA, 17 bp, Homo sapiens
ctcctccctggctgccc

SEQ ID NO: 3292900 - DNA, 21 bp, Homo sapiens
ctcctccctggctgccctggc

SEQ ID NO: 3292901 - DNA, 22 bp, Homo sapiens
ctcctccctggctgccctggcc

SEQ ID NO: 3292902 - DNA, 14 bp, Homo sapiens
ctcctcccttcctt

SEQ ID NO: 3292903 - DNA, 15 bp, Homo sapiens
ctcctcccttccttt

SEQ ID NO: 3292904 - DNA, 22 bp, Homo sapiens
ctcctcccttccttttccctgc

SEQ ID NO: 3292905 - DNA, 18 bp, Homo sapiens
ctcctccctttccttcct

SEQ ID NO: 3292906 - DNA, 22 bp, Homo sapiens
ctcctccgaggtggttttaaag

SEQ ID NO: 3292907 - DNA, 15 bp, Homo sapiens
ctcctcctcccccag

SEQ ID NO: 3292908 - DNA, 14 bp, Homo sapiens
ctcctcctgccctg

SEQ ID NO: 3292909 - DNA, 19 bp, Homo sapiens
ctcctccttggtgcctggc

SEQ ID NO: 3292910 - DNA, 23 bp, Homo sapiens
ctcctcggaaccgctcacctaga

SEQ ID NO: 3292911 - DNA, 23 bp, Homo sapiens
ctcctcggagagcagcagcacca

SEQ ID NO: 3292912 - DNA, 18 bp, Homo sapiens
ctcctcggccccctccat

SEQ ID NO: 3292913 - DNA, 20 bp, Homo sapiens
ctcctcggccccctccatcg

SEQ ID NO: 3292914 - DNA, 15 bp, Homo sapiens
ctcctcgggccgagg

SEQ ID NO: 3292915 - DNA, 18 bp, Homo sapiens
ctcctctagctgtggggg

SEQ ID NO: 3292916 - DNA, 12 bp, Homo sapiens
ctcctctccagg

SEQ ID NO: 3292917 - DNA, 15 bp, Homo sapiens
ctcctctccaggcac

SEQ ID NO: 3292918 - DNA, 15 bp, Homo sapiens
ctcctctcccatccc

SEQ ID NO: 3292919 - DNA, 21 bp, Homo sapiens
ctcctctcccatccccctgcc

SEQ ID NO: 3292920 - DNA, 15 bp, Homo sapiens
ctcctctccccagca

SEQ ID NO: 3292921 - DNA, 23 bp, Homo sapiens
ctcctctccttgggctcctggct

SEQ ID NO: 3292922 - DNA, 13 bp, Homo sapiens
ctcctctctagaa

SEQ ID NO: 3292923 - DNA, 12 bp, Homo sapiens
ctcctctctggg

SEQ ID NO: 3292924 - DNA, 13 bp, Homo sapiens
ctcctctctgggc

SEQ ID NO: 3292925 - DNA, 14 bp, Homo sapiens
ctcctctctgggcc

SEQ ID NO: 3292926 - DNA, 16 bp, Homo sapiens
ctcctctgcagtgcct

SEQ ID NO: 3292927 - DNA, 15 bp, Homo sapiens
ctcctctgggcctgg

SEQ ID NO: 3292928 - DNA, 22 bp, Homo sapiens
ctcctctgggcctggggtgcat

SEQ ID NO: 3292929 - DNA, 16 bp, Homo sapiens
ctcctctgtcctgctt

SEQ ID NO: 3292930 - DNA, 18 bp, Homo sapiens
ctcctcttcaactgacca

SEQ ID NO: 3292931 - DNA, 19 bp, Homo sapiens
ctcctcttcaccccggcag

SEQ ID NO: 3292932 - DNA, 20 bp, Homo sapiens
ctcctcttcaccccggcagg

SEQ ID NO: 3292933 - DNA, 19 bp, Homo sapiens
ctcctcttctgacgtgcct

SEQ ID NO: 3292934 - DNA, 18 bp, Homo sapiens
ctcctcttgccactgcct

SEQ ID NO: 3292935 - DNA, 19 bp, Homo sapiens
ctcctcttgccactgcctc

SEQ ID NO: 3292936 - DNA, 12 bp, Homo sapiens
ctcctcttggaa

SEQ ID NO: 3292937 - DNA, 17 bp, Homo sapiens
ctcctctttcctctctt

SEQ ID NO: 3292938 - DNA, 22 bp, Homo sapiens
ctcctctttcctctctttgttc

SEQ ID NO: 3292939 - DNA, 18 bp, Homo sapiens
ctcctgaaccgcacagct

SEQ ID NO: 3292940 - DNA, 19 bp, Homo sapiens
ctcctgacctcaggtgatt

SEQ ID NO: 3292941 - DNA, 16 bp, Homo sapiens
ctcctgacctgtcacc

SEQ ID NO: 3292942 - DNA, 16 bp, Homo sapiens
ctcctgagaaatgtta

SEQ ID NO: 3292943 - DNA, 20 bp, Homo sapiens
ctcctgagaaggcgaggaga

SEQ ID NO: 3292944 - DNA, 21 bp, Homo sapiens
ctcctgagaaggcgaggagag

SEQ ID NO: 3292945 - DNA, 22 bp, Homo sapiens
ctcctgagaaggcgaggagagt

SEQ ID NO: 3292946 - DNA, 16 bp, Homo sapiens
ctcctgaggctttgga

SEQ ID NO: 3292947 - DNA, 20 bp, Homo sapiens
ctcctgaggggcatctgccc

SEQ ID NO: 3292948 - DNA, 23 bp, Homo sapiens
ctcctgaggggcatctgcccctc

SEQ ID NO: 3292949 - DNA, 13 bp, Homo sapiens
ctcctgatggcca

SEQ ID NO: 3292950 - DNA, 19 bp, Homo sapiens
ctcctgatggccaagagca

SEQ ID NO: 3292951 - DNA, 18 bp, Homo sapiens
ctcctgcacttacttgct

SEQ ID NO: 3292952 - DNA, 20 bp, Homo sapiens
ctcctgcacttacttgctta

SEQ ID NO: 3292953 - DNA, 18 bp, Homo sapiens
ctcctgccacatggagcc

SEQ ID NO: 3292954 - DNA, 13 bp, Homo sapiens
ctcctgcccacgg

SEQ ID NO: 3292955 - DNA, 13 bp, Homo sapiens
ctcctgcccagat

SEQ ID NO: 3292956 - DNA, 14 bp, Homo sapiens
ctcctgcccagtcc

SEQ ID NO: 3292957 - DNA, 17 bp, Homo sapiens
ctcctgcccagtccccc

SEQ ID NO: 3292958 - DNA, 18 bp, Homo sapiens
ctcctgcccagtccccca

SEQ ID NO: 3292959 - DNA, 21 bp, Homo sapiens
ctcctgccgcagacgggcaca

SEQ ID NO: 3292960 - DNA, 23 bp, Homo sapiens
ctcctgccgcagacgggcacaga

SEQ ID NO: 3292961 - DNA, 14 bp, Homo sapiens
ctcctgcctcagcc

SEQ ID NO: 3292962 - DNA, 16 bp, Homo sapiens
ctcctgcctcagcctc

SEQ ID NO: 3292963 - DNA, 14 bp, Homo sapiens
ctcctgcctgtagc

SEQ ID NO: 3292964 - DNA, 15 bp, Homo sapiens
ctcctgcctgtagca

SEQ ID NO: 3292965 - DNA, 16 bp, Homo sapiens
ctcctgcctgtagcag

SEQ ID NO: 3292966 - DNA, 16 bp, Homo sapiens
ctcctgccttctgtcc

SEQ ID NO: 3292967 - DNA, 17 bp, Homo sapiens
ctcctgcgccccgccca

SEQ ID NO: 3292968 - DNA, 16 bp, Homo sapiens
ctcctgctcctccctg

SEQ ID NO: 3292969 - DNA, 18 bp, Homo sapiens
ctcctgctcctccctgcc

SEQ ID NO: 3292970 - DNA, 21 bp, Homo sapiens
ctcctgctcctccctgccccc

SEQ ID NO: 3292971 - DNA, 23 bp, Homo sapiens
ctcctgctcctccctgcccccca

SEQ ID NO: 3292972 - DNA, 14 bp, Homo sapiens
ctcctgctggctct

SEQ ID NO: 3292973 - DNA, 14 bp, Homo sapiens
ctcctgctggtacc

SEQ ID NO: 3292974 - DNA, 15 bp, Homo sapiens
ctcctgctggtacct

SEQ ID NO: 3292975 - DNA, 20 bp, Homo sapiens
ctcctgctggtacctgccct

SEQ ID NO: 3292976 - DNA, 18 bp, Homo sapiens
ctcctggaaaggctcagt

SEQ ID NO: 3292977 - DNA, 19 bp, Homo sapiens
ctcctggaaaggctcagtc

SEQ ID NO: 3292978 - DNA, 20 bp, Homo sapiens
ctcctggaaaggctcagtct

SEQ ID NO: 3292979 - DNA, 23 bp, Homo sapiens
ctcctggaaaggctcagtctcag

SEQ ID NO: 3292980 - DNA, 18 bp, Homo sapiens
ctcctggaaccttgctgt

SEQ ID NO: 3292981 - DNA, 21 bp, Homo sapiens
ctcctggcaatcaatacagct

SEQ ID NO: 3292982 - DNA, 13 bp, Homo sapiens
ctcctggcctatc

SEQ ID NO: 3292983 - DNA, 18 bp, Homo sapiens
ctcctggcctatccgctg

SEQ ID NO: 3292984 - DNA, 14 bp, Homo sapiens
ctcctggcctcaag

SEQ ID NO: 3292985 - DNA, 16 bp, Homo sapiens
ctcctggctaagcctc

SEQ ID NO: 3292986 - DNA, 14 bp, Homo sapiens
ctcctggctccctc

SEQ ID NO: 3292987 - DNA, 22 bp, Homo sapiens
ctcctggctcttgatacccccc

SEQ ID NO: 3292988 - DNA, 17 bp, Homo sapiens
ctcctgggaagatgagg

SEQ ID NO: 3292989 - DNA, 20 bp, Homo sapiens
ctcctgggaagatgaggttc

SEQ ID NO: 3292990 - DNA, 18 bp, Homo sapiens
ctcctgggctaagtgatc

SEQ ID NO: 3292991 - DNA, 15 bp, Homo sapiens
ctcctgggggtggca

SEQ ID NO: 3292992 - DNA, 20 bp, Homo sapiens
ctcctgggggttctttcttc

SEQ ID NO: 3292993 - DNA, 22 bp, Homo sapiens
ctcctgggggttctttcttcct

SEQ ID NO: 3292994 - DNA, 21 bp, Homo sapiens
ctcctgggtgtgtttggcttg

SEQ ID NO: 3292995 - DNA, 23 bp, Homo sapiens
ctcctggtcttgagatgtcttct

SEQ ID NO: 3292996 - DNA, 21 bp, Homo sapiens
ctcctggtgcccctcgccagc

SEQ ID NO: 3292997 - DNA, 22 bp, Homo sapiens
ctcctggtgcccctcgccagct

SEQ ID NO: 3292998 - DNA, 21 bp, Homo sapiens
ctcctggtggccttctgctgc

SEQ ID NO: 3292999 - DNA, 20 bp, Homo sapiens
ctcctgtaagccaaagaaat

SEQ ID NO: 3293000 - DNA, 21 bp, Homo sapiens
ctcctgtcctcccatcccctg

SEQ ID NO: 3293001 - DNA, 11 bp, Homo sapiens
ctcctgtctgc

SEQ ID NO: 3293002 - DNA, 19 bp, Homo sapiens
ctcctgtctgccctctggg

SEQ ID NO: 3293003 - DNA, 16 bp, Homo sapiens
ctcctgtgaatggagg

SEQ ID NO: 3293004 - DNA, 20 bp, Homo sapiens
ctcctgtgaatggaggcaga

SEQ ID NO: 3293005 - DNA, 16 bp, Homo sapiens
ctcctgtgcatgggtg

SEQ ID NO: 3293006 - DNA, 17 bp, Homo sapiens
ctcctgtgcatgggtga

SEQ ID NO: 3293007 - DNA, 11 bp, Homo sapiens
ctcctgtgcta

SEQ ID NO: 3293008 - DNA, 19 bp, Homo sapiens
ctcctgtggccccaccctg

SEQ ID NO: 3293009 - DNA, 11 bp, Homo sapiens
ctcctgtgtgt

SEQ ID NO: 3293010 - DNA, 19 bp, Homo sapiens
ctcctgtgtgtgcgcctac

SEQ ID NO: 3293011 - DNA, 16 bp, Homo sapiens
ctcctgttctgcccac

SEQ ID NO: 3293012 - DNA, 20 bp, Homo sapiens
ctcctgtttcccttcccttc

SEQ ID NO: 3293013 - DNA, 23 bp, Homo sapiens
ctccttaagctgcagagatttct

SEQ ID NO: 3293014 - DNA, 23 bp, Homo sapiens
ctccttactctgagcccaggccg

SEQ ID NO: 3293015 - DNA, 14 bp, Homo sapiens
ctccttactgtgtt

SEQ ID NO: 3293016 - DNA, 22 bp, Homo sapiens
ctccttagccctgtctgctagg

SEQ ID NO: 3293017 - DNA, 21 bp, Homo sapiens
ctccttagctttccctgtgcc

SEQ ID NO: 3293018 - DNA, 22 bp, Homo sapiens
ctccttagctttccctgtgcca

SEQ ID NO: 3293019 - DNA, 15 bp, Homo sapiens
ctccttcactgttcc

SEQ ID NO: 3293020 - DNA, 17 bp, Homo sapiens
ctccttcactgttccct

SEQ ID NO: 3293021 - DNA, 12 bp, Homo sapiens
ctccttcagcac

SEQ ID NO: 3293022 - DNA, 13 bp, Homo sapiens
ctccttcagcacg

SEQ ID NO: 3293023 - DNA, 22 bp, Homo sapiens
ctctgagcccatgttctgcccc

SEQ ID NO: 3293024 - DNA, 13 bp, Homo sapiens
ctctgagcgcctc

SEQ ID NO: 3293025 - DNA, 15 bp, Homo sapiens
ctctgagcgggaggc

SEQ ID NO: 3293026 - DNA, 17 bp, Homo sapiens
ctctgagcgggaggcag

SEQ ID NO: 3293027 - DNA, 17 bp, Homo sapiens
ctctgagctgctcaccg

SEQ ID NO: 3293028 - DNA, 12 bp, Homo sapiens
ctctgaggacac

SEQ ID NO: 3293029 - DNA, 19 bp, Homo sapiens
ctctgaggctctttctggg

SEQ ID NO: 3293030 - DNA, 17 bp, Homo sapiens
ctctgagtccactgctc

SEQ ID NO: 3293031 - DNA, 15 bp, Homo sapiens
ctctgagtcctttgc

SEQ ID NO: 3293032 - DNA, 16 bp, Homo sapiens
ctctgagtctctgaat

SEQ ID NO: 3293033 - DNA, 12 bp, Homo sapiens
ctctgagtgtga

SEQ ID NO: 3293034 - DNA, 17 bp, Homo sapiens
ctctgagtttaccattt

SEQ ID NO: 3293035 - DNA, 18 bp, Homo sapiens
ctctgagtttaccatttg

SEQ ID NO: 3293036 - DNA, 20 bp, Homo sapiens
ctctgagtttaccatttgta

SEQ ID NO: 3293037 - DNA, 21 bp, Homo sapiens
ctctgagtttaccatttgtaa

SEQ ID NO: 3293038 - DNA, 15 bp, Homo sapiens
ctctgatatgggact

SEQ ID NO: 3293039 - DNA, 16 bp, Homo sapiens
ctctgatatgggactg

SEQ ID NO: 3293040 - DNA, 21 bp, Homo sapiens
ctctgatatgggactgagcct

SEQ ID NO: 3293041 - DNA, 15 bp, Homo sapiens
ctctgatcaaaatta

SEQ ID NO: 3293042 - DNA, 16 bp, Homo sapiens
ctctgatcttgtgctc

SEQ ID NO: 3293043 - DNA, 16 bp, Homo sapiens
ctctgatgcaatagtg

SEQ ID NO: 3293044 - DNA, 22 bp, Homo sapiens
ctctgatggttcttcacctcct

SEQ ID NO: 3293045 - DNA, 15 bp, Homo sapiens
ctctgcaaaggcctg

SEQ ID NO: 3293046 - DNA, 12 bp, Homo sapiens
ctctgcaatgct

SEQ ID NO: 3293047 - DNA, 15 bp, Homo sapiens
ctctgcaattcccct

SEQ ID NO: 3293048 - DNA, 19 bp, Homo sapiens
ctctgcaattcccctctgc

SEQ ID NO: 3293049 - DNA, 22 bp, Homo sapiens
ctctgcaattcccctctgctgc

SEQ ID NO: 3293050 - DNA, 13 bp, Homo sapiens
ctctgcacatgtc

SEQ ID NO: 3293051 - DNA, 15 bp, Homo sapiens
ctctgcacccctctg

SEQ ID NO: 3293052 - DNA, 23 bp, Homo sapiens
ctctgcactactcctctgcagtg

SEQ ID NO: 3293053 - DNA, 20 bp, Homo sapiens
ctctgcactactgacatgtg

SEQ ID NO: 3293054 - DNA, 19 bp, Homo sapiens
ctctgcactcccacctgac

SEQ ID NO: 3293055 - DNA, 20 bp, Homo sapiens
ctctgcactcccacctgaca

SEQ ID NO: 3293056 - DNA, 14 bp, Homo sapiens
ctctgcagaacagt

SEQ ID NO: 3293057 - DNA, 16 bp, Homo sapiens
ctctgcagactgctag

SEQ ID NO: 3293058 - DNA, 18 bp, Homo sapiens
ctctgcagacttcccagc

SEQ ID NO: 3293059 - DNA, 23 bp, Homo sapiens
ctctgcaggcttaataaaaatga

SEQ ID NO: 3293060 - DNA, 13 bp, Homo sapiens
ctctgcagtaaaa

SEQ ID NO: 3293061 - DNA, 19 bp, Homo sapiens
ctctgcatcccagcacctg

SEQ ID NO: 3293062 - DNA, 14 bp, Homo sapiens
ctctgcattctagt

SEQ ID NO: 3293063 - DNA, 15 bp, Homo sapiens
ctctgcattctagta

SEQ ID NO: 3293064 - DNA, 14 bp, Homo sapiens
ctctgccaaaggat

SEQ ID NO: 3293065 - DNA, 11 bp, Homo sapiens
ctctgccacca

SEQ ID NO: 3293066 - DNA, 23 bp, Homo sapiens
ctctgccaccagagaccgtcctc

SEQ ID NO: 3293067 - DNA, 16 bp, Homo sapiens
ctctgccacccactca

SEQ ID NO: 3293068 - DNA, 16 bp, Homo sapiens
ctctgccagcaaagag

SEQ ID NO: 3293069 - DNA, 22 bp, Homo sapiens
ctctgccagggcagtgctagtg

SEQ ID NO: 3293070 - DNA, 21 bp, Homo sapiens
ctctgccagtggatcccctgc

SEQ ID NO: 3293071 - DNA, 21 bp, Homo sapiens
ctctgccccaagcagccagcc

SEQ ID NO: 3293072 - DNA, 15 bp, Homo sapiens
ctctgccccaagccc

SEQ ID NO: 3293073 - DNA, 16 bp, Homo sapiens
ctctgccccaagcccc

SEQ ID NO: 3293074 - DNA, 18 bp, Homo sapiens
ctctgccccaagccccca

SEQ ID NO: 3293075 - DNA, 19 bp, Homo sapiens
ctctgccccagctctggct

SEQ ID NO: 3293076 - DNA, 19 bp, Homo sapiens
ctctgccccgtttcttgcc

SEQ ID NO: 3293077 - DNA, 10 bp, Homo sapiens
ctctgcccct

SEQ ID NO: 3293078 - DNA, 21 bp, Homo sapiens
ctctgcccctattgggagagg

SEQ ID NO: 3293079 - DNA, 18 bp, Homo sapiens
ctctgcccctcccaaccc

SEQ ID NO: 3293080 - DNA, 20 bp, Homo sapiens
ctctgcccctcccaacccag

SEQ ID NO: 3293081 - DNA, 11 bp, Homo sapiens
ctctgcccctg

SEQ ID NO: 3293082 - DNA, 12 bp, Homo sapiens
ctctgcccctga

SEQ ID NO: 3293083 - DNA, 22 bp, Homo sapiens
ctctgccctcattactgggcct

SEQ ID NO: 3293084 - DNA, 20 bp, Homo sapiens
ctctgccctccctccttcct

SEQ ID NO: 3293085 - DNA, 15 bp, Homo sapiens
ctctgccgctacctc

SEQ ID NO: 3293086 - DNA, 20 bp, Homo sapiens
ctctgccggctctttccttg

SEQ ID NO: 3293087 - DNA, 23 bp, Homo sapiens
ctctgccggctctttccttgctc

SEQ ID NO: 3293088 - DNA, 18 bp, Homo sapiens
ctctgccggtcgggcagc

SEQ ID NO: 3293089 - DNA, 20 bp, Homo sapiens
ctctgccggtcgggcagcca

SEQ ID NO: 3293090 - DNA, 13 bp, Homo sapiens
ctctgcctccctc

SEQ ID NO: 3293091 - DNA, 12 bp, Homo sapiens
ctctgcctgccc

SEQ ID NO: 3293092 - DNA, 15 bp, Homo sapiens
ctctgcctgccccgc

SEQ ID NO: 3293093 - DNA, 20 bp, Homo sapiens
ctctgcctgccccgccccca

SEQ ID NO: 3293094 - DNA, 23 bp, Homo sapiens
ctctgcctggtggtcagatgcag

SEQ ID NO: 3293095 - DNA, 23 bp, Homo sapiens
ctctgcctttgacatttaattta

SEQ ID NO: 3293096 - DNA, 15 bp, Homo sapiens
ctctgcggaccccag

SEQ ID NO: 3293097 - DNA, 19 bp, Homo sapiens
ctctgcggaccccagctgt

SEQ ID NO: 3293098 - DNA, 20 bp, Homo sapiens
ctctgcggaccccagctgtg

SEQ ID NO: 3293099 - DNA, 16 bp, Homo sapiens
ctctgctaatcatgtg

SEQ ID NO: 3293100 - DNA, 14 bp, Homo sapiens
ctctgctagatttc

SEQ ID NO: 3293101 - DNA, 20 bp, Homo sapiens
ctctgctatttctcttgctg

SEQ ID NO: 3293102 - DNA, 22 bp, Homo sapiens
ctctgctatttctcttgctgga

SEQ ID NO: 3293103 - DNA, 14 bp, Homo sapiens
ctctgctccaccac

SEQ ID NO: 3293104 - DNA, 15 bp, Homo sapiens
ctctgctccaccaca

SEQ ID NO: 3293105 - DNA, 13 bp, Homo sapiens
ctctgctccccag

SEQ ID NO: 3293106 - DNA, 17 bp, Homo sapiens
ctctgctcctggagcct

SEQ ID NO: 3293107 - DNA, 17 bp, Homo sapiens
ctctgctcgccctcctt

SEQ ID NO: 3293108 - DNA, 15 bp, Homo sapiens
ctctgctctagccag

SEQ ID NO: 3293109 - DNA, 19 bp, Homo sapiens
ctctgctctagccaggagt

SEQ ID NO: 3293110 - DNA, 23 bp, Homo sapiens
ctctgctctagccaggagtctgt

SEQ ID NO: 3293111 - DNA, 14 bp, Homo sapiens
ctctgctctctatg

SEQ ID NO: 3293112 - DNA, 15 bp, Homo sapiens
ctctgctctctatgt

SEQ ID NO: 3293113 - DNA, 14 bp, Homo sapiens
ctctgctgacagac

SEQ ID NO: 3293114 - DNA, 15 bp, Homo sapiens
ctctgctgagctggg

SEQ ID NO: 3293115 - DNA, 16 bp, Homo sapiens
ctctgctgagctgggc

SEQ ID NO: 3293116 - DNA, 19 bp, Homo sapiens
ctctgctgagctgggccca

SEQ ID NO: 3293117 - DNA, 13 bp, Homo sapiens
ctctgctgccatg

SEQ ID NO: 3293118 - DNA, 14 bp, Homo sapiens
ctctgctggcccag

SEQ ID NO: 3293119 - DNA, 21 bp, Homo sapiens
ctctgctggcctggccggcaa

SEQ ID NO: 3293120 - DNA, 17 bp, Homo sapiens
ctctgcttctctcacct

SEQ ID NO: 3293121 - DNA, 13 bp, Homo sapiens
ctctgcttctctg

SEQ ID NO: 3293122 - DNA, 14 bp, Homo sapiens
ctctgcttctctga

SEQ ID NO: 3293123 - DNA, 16 bp, Homo sapiens
ctctgcttctctgact

SEQ ID NO: 3293124 - DNA, 18 bp, Homo sapiens
ctctgcttgcctggagac

SEQ ID NO: 3293125 - DNA, 22 bp, Homo sapiens
ctctggaataaagttgcagatg

SEQ ID NO: 3293126 - DNA, 14 bp, Homo sapiens
ctctggacaggcat

SEQ ID NO: 3293127 - DNA, 16 bp, Homo sapiens
ctctggacaggcatgt

SEQ ID NO: 3293128 - DNA, 16 bp, Homo sapiens
ctctggacggcaggct

SEQ ID NO: 3293129 - DNA, 17 bp, Homo sapiens
ctctggacggcaggctc

SEQ ID NO: 3293130 - DNA, 15 bp, Homo sapiens
ctctggactggctag

SEQ ID NO: 3293131 - DNA, 13 bp, Homo sapiens
ctctggagaacag

SEQ ID NO: 3293132 - DNA, 18 bp, Homo sapiens
ctctggagaacagtggtt

SEQ ID NO: 3293133 - DNA, 15 bp, Homo sapiens
ctctggagacagccc

SEQ ID NO: 3293134 - DNA, 20 bp, Homo sapiens
ctctggaggcctctggccct

SEQ ID NO: 3293135 - DNA, 21 bp, Homo sapiens
ctctggaggcctctggccctc

SEQ ID NO: 3293136 - DNA, 18 bp, Homo sapiens
ctctggcattagaattat

SEQ ID NO: 3293137 - DNA, 20 bp, Homo sapiens
ctctggcattagaattattt

SEQ ID NO: 3293138 - DNA, 13 bp, Homo sapiens
ctctggcatttgt

SEQ ID NO: 3293139 - DNA, 14 bp, Homo sapiens
ctctggccacaaca

SEQ ID NO: 3293140 - DNA, 16 bp, Homo sapiens
ctctggccctggccct

SEQ ID NO: 3293141 - DNA, 14 bp, Homo sapiens
ctctggcccttgcc

SEQ ID NO: 3293142 - DNA, 14 bp, Homo sapiens
ctctggcccttgga

SEQ ID NO: 3293143 - DNA, 19 bp, Homo sapiens
ctctggccttcggcctcca

SEQ ID NO: 3293144 - DNA, 16 bp, Homo sapiens
ctctggcggcttcctg

SEQ ID NO: 3293145 - DNA, 20 bp, Homo sapiens
ctctggctagaggccagccc

SEQ ID NO: 3293146 - DNA, 14 bp, Homo sapiens
ctctggctccacac

SEQ ID NO: 3293147 - DNA, 16 bp, Homo sapiens
ctctggctctcatggg

SEQ ID NO: 3293148 - DNA, 17 bp, Homo sapiens
ctctggctgaaccctgt

SEQ ID NO: 3293149 - DNA, 18 bp, Homo sapiens
ctctggctgaaccctgtg

SEQ ID NO: 3293150 - DNA, 23 bp, Homo sapiens
ctgaaagggcacttaatttgtaa

SEQ ID NO: 3293151 - DNA, 23 bp, Homo sapiens
ctgaaagtgttttactctttttc

SEQ ID NO: 3293152 - DNA, 13 bp, Homo sapiens
ctgaaagttaccc

SEQ ID NO: 3293153 - DNA, 17 bp, Homo sapiens
ctgaaataaaatgccat

SEQ ID NO: 3293154 - DNA, 13 bp, Homo sapiens
ctgaaataaacac

SEQ ID NO: 3293155 - DNA, 17 bp, Homo sapiens
ctgaaataaacactggt

SEQ ID NO: 3293156 - DNA, 21 bp, Homo sapiens
ctgaaatcttcccatgcattc

SEQ ID NO: 3293157 - DNA, 23 bp, Homo sapiens
ctgaaatcttcccatgcattctg

SEQ ID NO: 3293158 - DNA, 22 bp, Homo sapiens
ctgaaatgagcatgcattttct

SEQ ID NO: 3293159 - DNA, 17 bp, Homo sapiens
ctgaaattacatattgc

SEQ ID NO: 3293160 - DNA, 13 bp, Homo sapiens
ctgaaattatttt

SEQ ID NO: 3293161 - DNA, 15 bp, Homo sapiens
ctgaaattattttct

SEQ ID NO: 3293162 - DNA, 14 bp, Homo sapiens
ctgaaattccaaag

SEQ ID NO: 3293163 - DNA, 15 bp, Homo sapiens
ctgaaattccaaagt

SEQ ID NO: 3293164 - DNA, 14 bp, Homo sapiens
ctgaaattctaaag

SEQ ID NO: 3293165 - DNA, 20 bp, Homo sapiens
ctgaaattctcctggaggtc

SEQ ID NO: 3293166 - DNA, 23 bp, Homo sapiens
ctgaaatttgttatacttcaaaa

SEQ ID NO: 3293167 - DNA, 13 bp, Homo sapiens
ctgaaattttata

SEQ ID NO: 3293168 - DNA, 19 bp, Homo sapiens
ctgaaattttatatgctta

SEQ ID NO: 3293169 - DNA, 18 bp, Homo sapiens
ctgaaatttttttcctaa

SEQ ID NO: 3293170 - DNA, 19 bp, Homo sapiens
ctgaaatttttttcctaag

SEQ ID NO: 3293171 - DNA, 16 bp, Homo sapiens
ctgaacaaaaaataaa

SEQ ID NO: 3293172 - DNA, 20 bp, Homo sapiens
ctgaacaaatcttgggtggg

SEQ ID NO: 3293173 - DNA, 13 bp, Homo sapiens
ctgaacaagaatt

SEQ ID NO: 3293174 - DNA, 16 bp, Homo sapiens
ctgaacacaggcagct

SEQ ID NO: 3293175 - DNA, 19 bp, Homo sapiens
ctgaacaccattgaaggct

SEQ ID NO: 3293176 - DNA, 12 bp, Homo sapiens
ctgaacagtgga

SEQ ID NO: 3293177 - DNA, 12 bp, Homo sapiens
ctgaacatgttt

SEQ ID NO: 3293178 - DNA, 15 bp, Homo sapiens
ctgaacatgtttaca

SEQ ID NO: 3293179 - DNA, 16 bp, Homo sapiens
ctgaaccaaagcctct

SEQ ID NO: 3293180 - DNA, 12 bp, Homo sapiens
ctgaaccaaatt

SEQ ID NO: 3293181 - DNA, 19 bp, Homo sapiens
ctgaaccaaattgcactga

SEQ ID NO: 3293182 - DNA, 14 bp, Homo sapiens
ctgaaccatccctg

SEQ ID NO: 3293183 - DNA, 14 bp, Homo sapiens
ctgaaccccatggg

SEQ ID NO: 3293184 - DNA, 14 bp, Homo sapiens
ctgaaccctgtgct

SEQ ID NO: 3293185 - DNA, 15 bp, Homo sapiens
ctgaaccctgtgctg

SEQ ID NO: 3293186 - DNA, 18 bp, Homo sapiens
ctgaaccctgtgctggtg

SEQ ID NO: 3293187 - DNA, 23 bp, Homo sapiens
ctgaaccctgtgctggtgtcctg

SEQ ID NO: 3293188 - DNA, 15 bp, Homo sapiens
ctgaaccgcacagct

SEQ ID NO: 3293189 - DNA, 17 bp, Homo sapiens
ctgaaccgcacagctca

SEQ ID NO: 3293190 - DNA, 18 bp, Homo sapiens
ctgaaccgcacagctcag

SEQ ID NO: 3293191 - DNA, 20 bp, Homo sapiens
ctgaaccgcacagctcagga

SEQ ID NO: 3293192 - DNA, 21 bp, Homo sapiens
ctgaaccgcacagctcaggag

SEQ ID NO: 3293193 - DNA, 14 bp, Homo sapiens
ctgaacgcagaaga

SEQ ID NO: 3293194 - DNA, 15 bp, Homo sapiens
ctgaactcaaactga

SEQ ID NO: 3293195 - DNA, 13 bp, Homo sapiens
ctgaactcacttt

SEQ ID NO: 3293196 - DNA, 12 bp, Homo sapiens
ctgaactctcaa

SEQ ID NO: 3293197 - DNA, 13 bp, Homo sapiens
ctgaactctcaaa

SEQ ID NO: 3293198 - DNA, 12 bp, Homo sapiens
ctgaactgagga

SEQ ID NO: 3293199 - DNA, 16 bp, Homo sapiens
ctgaacttcagagcat

SEQ ID NO: 3293200 - DNA, 17 bp, Homo sapiens
ctgaacttgcattgtga

SEQ ID NO: 3293201 - DNA, 13 bp, Homo sapiens
ctgaactttcatt

SEQ ID NO: 3293202 - DNA, 18 bp, Homo sapiens
ctgaactttcattggatt

SEQ ID NO: 3293203 - DNA, 15 bp, Homo sapiens
ctgaactttctccct

SEQ ID NO: 3293204 - DNA, 13 bp, Homo sapiens
ctgaactttggag

SEQ ID NO: 3293205 - DNA, 17 bp, Homo sapiens
ctgaagaattaagatac

SEQ ID NO: 3293206 - DNA, 20 bp, Homo sapiens
ctgaagaattaagatacaaa

SEQ ID NO: 3293207 - DNA, 19 bp, Homo sapiens
ctgaagactcattcttctg

SEQ ID NO: 3293208 - DNA, 17 bp, Homo sapiens
ctgaagactgagaactt

SEQ ID NO: 3293209 - DNA, 21 bp, Homo sapiens
ctgaagactgagaactttttt

SEQ ID NO: 3293210 - DNA, 14 bp, Homo sapiens
ctgaagactgagga

SEQ ID NO: 3293211 - DNA, 22 bp, Homo sapiens
ctgaagagacagttatttatag

SEQ ID NO: 3293212 - DNA, 19 bp, Homo sapiens
ctgaagaggaactgggcct

SEQ ID NO: 3293213 - DNA, 19 bp, Homo sapiens
ctgaagaggaagaggagga

SEQ ID NO: 3293214 - DNA, 18 bp, Homo sapiens
ctgaagaggcgggccagc

SEQ ID NO: 3293215 - DNA, 20 bp, Homo sapiens
ctgaagaggcgggccagcca

SEQ ID NO: 3293216 - DNA, 22 bp, Homo sapiens
ctgaagaggcgggccagccagg

SEQ ID NO: 3293217 - DNA, 14 bp, Homo sapiens
ctgaagaggcttct

SEQ ID NO: 3293218 - DNA, 16 bp, Homo sapiens
ctgaagcagcctctcc

SEQ ID NO: 3293219 - DNA, 13 bp, Homo sapiens
ctgaagcatgttt

SEQ ID NO: 3293220 - DNA, 23 bp, Homo sapiens
ctgaagcatgtttcatgttttgt

SEQ ID NO: 3293221 - DNA, 15 bp, Homo sapiens
ctgaagccaaatgaa

SEQ ID NO: 3293222 - DNA, 13 bp, Homo sapiens
ctgaagccagcct

SEQ ID NO: 3293223 - DNA, 13 bp, Homo sapiens
ctgaagcctgcag

SEQ ID NO: 3293224 - DNA, 15 bp, Homo sapiens
ctgaagcctgcagga

SEQ ID NO: 3293225 - DNA, 14 bp, Homo sapiens
ctgaagcttgactc

SEQ ID NO: 3293226 - DNA, 20 bp, Homo sapiens
ctgaagcttgactcccaagt

SEQ ID NO: 3293227 - DNA, 14 bp, Homo sapiens
ctgaaggaaaaaca

SEQ ID NO: 3293228 - DNA, 16 bp, Homo sapiens
ctgaaggaaaaacaca

SEQ ID NO: 3293229 - DNA, 18 bp, Homo sapiens
ctgaaggaaaaacacaag

SEQ ID NO: 3293230 - DNA, 22 bp, Homo sapiens
ctgaaggaaaagcaagaaacag

SEQ ID NO: 3293231 - DNA, 15 bp, Homo sapiens
ctgaaggaagagaag

SEQ ID NO: 3293232 - DNA, 17 bp, Homo sapiens
ctgaaggaatagccaga

SEQ ID NO: 3293233 - DNA, 18 bp, Homo sapiens
ctgaaggaatagccagag

SEQ ID NO: 3293234 - DNA, 19 bp, Homo sapiens
ctgaaggaatagccagaga

SEQ ID NO: 3293235 - DNA, 23 bp, Homo sapiens
ctgaaggaatagccagagaggag

SEQ ID NO: 3293236 - DNA, 12 bp, Homo sapiens
ctgaaggactgg

SEQ ID NO: 3293237 - DNA, 11 bp, Homo sapiens
ctgaaggcagt

SEQ ID NO: 3293238 - DNA, 15 bp, Homo sapiens
ctgaaggcagtggca

SEQ ID NO: 3293239 - DNA, 16 bp, Homo sapiens
ctgaaggcagtggcag

SEQ ID NO: 3293240 - DNA, 20 bp, Homo sapiens
ctgaaggggcacaccactgc

SEQ ID NO: 3293241 - DNA, 21 bp, Homo sapiens
ctgaaggggcacaccactgcc

SEQ ID NO: 3293242 - DNA, 22 bp, Homo sapiens
ctgaaggtggccactttaagag

SEQ ID NO: 3293243 - DNA, 12 bp, Homo sapiens
ctgaataaatgg

SEQ ID NO: 3293244 - DNA, 14 bp, Homo sapiens
ctgaataacttgaa

SEQ ID NO: 3293245 - DNA, 13 bp, Homo sapiens
ctgaataatttct

SEQ ID NO: 3293246 - DNA, 15 bp, Homo sapiens
ctgaatagaaatggg

SEQ ID NO: 3293247 - DNA, 15 bp, Homo sapiens
ctgaatatctgttca

SEQ ID NO: 3293248 - DNA, 16 bp, Homo sapiens
ctgaatatttatattt

SEQ ID NO: 3293249 - DNA, 20 bp, Homo sapiens
ctgaatatttatatttcact

SEQ ID NO: 3293250 - DNA, 21 bp, Homo sapiens
ctgaatatttatatttcacta

SEQ ID NO: 3293251 - DNA, 14 bp, Homo sapiens
ctgaatattttgga

SEQ ID NO: 3293252 - DNA, 18 bp, Homo sapiens
ctgaatattttggaaact

SEQ ID NO: 3293253 - DNA, 20 bp, Homo sapiens
ctgaatattttttatttcta

SEQ ID NO: 3293254 - DNA, 17 bp, Homo sapiens
ctgaatccacctcggag

SEQ ID NO: 3293255 - DNA, 22 bp, Homo sapiens
ctgaatccacctcggagcatgg

SEQ ID NO: 3293256 - DNA, 23 bp, Homo sapiens
ctgaatccacctcggagcatggt

SEQ ID NO: 3293257 - DNA, 17 bp, Homo sapiens
ctgaatctgctaccaaa

SEQ ID NO: 3293258 - DNA, 22 bp, Homo sapiens
ctgaatgaaaataactgaacca

SEQ ID NO: 3293259 - DNA, 16 bp, Homo sapiens
ctgaatgcagaacggt

SEQ ID NO: 3293260 - DNA, 18 bp, Homo sapiens
ctgaatgcataaataaat

SEQ ID NO: 3293261 - DNA, 17 bp, Homo sapiens
ctgaatgcctcctgtgg

SEQ ID NO: 3293262 - DNA, 19 bp, Homo sapiens
ctgaatgcctcgctccctt

SEQ ID NO: 3293263 - DNA, 12 bp, Homo sapiens
ctgaatgctctg

SEQ ID NO: 3293264 - DNA, 22 bp, Homo sapiens
ctgaatggttccatgcctgagg

SEQ ID NO: 3293265 - DNA, 16 bp, Homo sapiens
ctgaatgtaaaagaaa

SEQ ID NO: 3293266 - DNA, 17 bp, Homo sapiens
ctgaatgtaaaagaaaa

SEQ ID NO: 3293267 - DNA, 16 bp, Homo sapiens
ctgaatgtaatttgtg

SEQ ID NO: 3293268 - DNA, 18 bp, Homo sapiens
ctgaatgtaatttgtgta

SEQ ID NO: 3293269 - DNA, 21 bp, Homo sapiens
ctgaatgtatttatgtgtata

SEQ ID NO: 3293270 - DNA, 23 bp, Homo sapiens
ctgaatgtatttatgtgtatatt

SEQ ID NO: 3293271 - DNA, 13 bp, Homo sapiens
ctgaatgtgccta

SEQ ID NO: 3293272 - DNA, 11 bp, Homo sapiens
ctgaatgttct

SEQ ID NO: 3293273 - DNA, 20 bp, Homo sapiens
ctgaatgttctgacattaac

SEQ ID NO: 3293274 - DNA, 16 bp, Homo sapiens
ctgaatgtttattcct

SEQ ID NO: 3293275 - DNA, 18 bp, Homo sapiens
ctgaatgtttattccttg

SEQ ID NO: 3293276 - DNA, 18 bp, Homo sapiens
ctgaattaaacatgaaag

SEQ ID NO: 3293277 - DNA, 20 bp, Homo sapiens
ctgcagaaggaaagaagggg

SEQ ID NO: 3293278 - DNA, 18 bp, Homo sapiens
ctgcagaatgactccacc

SEQ ID NO: 3293279 - DNA, 15 bp, Homo sapiens
ctgcagacttcccag

SEQ ID NO: 3293280 - DNA, 14 bp, Homo sapiens
ctgcagagatttct

SEQ ID NO: 3293281 - DNA, 15 bp, Homo sapiens
ctgcagagcaccttt

SEQ ID NO: 3293282 - DNA, 20 bp, Homo sapiens
ctgcagagcaggaaacatga

SEQ ID NO: 3293283 - DNA, 13 bp, Homo sapiens
ctgcagaggccag

SEQ ID NO: 3293284 - DNA, 13 bp, Homo sapiens
ctgcagagggacc

SEQ ID NO: 3293285 - DNA, 19 bp, Homo sapiens
ctgcagaggggctttctgg

SEQ ID NO: 3293286 - DNA, 20 bp, Homo sapiens
ctgcagaggggctttctgga

SEQ ID NO: 3293287 - DNA, 22 bp, Homo sapiens
ctgcagaggggctttctggaga

SEQ ID NO: 3293288 - DNA, 22 bp, Homo sapiens
ctgcagagggttaggagtgggt

SEQ ID NO: 3293289 - DNA, 17 bp, Homo sapiens
ctgcagatcttccgtgg

SEQ ID NO: 3293290 - DNA, 21 bp, Homo sapiens
ctgcagatgccaccctagcca

SEQ ID NO: 3293291 - DNA, 14 bp, Homo sapiens
ctgcagcacctcca

SEQ ID NO: 3293292 - DNA, 17 bp, Homo sapiens
ctgcagcacctccaggc

SEQ ID NO: 3293293 - DNA, 14 bp, Homo sapiens
ctgcagcagagtga

SEQ ID NO: 3293294 - DNA, 21 bp, Homo sapiens
ctgcagcaggaactctggacc

SEQ ID NO: 3293295 - DNA, 11 bp, Homo sapiens
ctgcagcatga

SEQ ID NO: 3293296 - DNA, 17 bp, Homo sapiens
ctgcagcatgacctgtg

SEQ ID NO: 3293297 - DNA, 18 bp, Homo sapiens
ctgcagcatgttgctgag

SEQ ID NO: 3293298 - DNA, 12 bp, Homo sapiens
ctgcagccagct

SEQ ID NO: 3293299 - DNA, 22 bp, Homo sapiens
ctgcagccagctcacgtccagg

SEQ ID NO: 3293300 - DNA, 21 bp, Homo sapiens
ctgcagcccaaaacccagggc

SEQ ID NO: 3293301 - DNA, 23 bp, Homo sapiens
ctgcagcccaaaacccagggcaa

SEQ ID NO: 3293302 - DNA, 16 bp, Homo sapiens
ctgcagcccaggaggc

SEQ ID NO: 3293303 - DNA, 13 bp, Homo sapiens
ctgcagcccttgg

SEQ ID NO: 3293304 - DNA, 17 bp, Homo sapiens
ctgcagcccttgggcag

SEQ ID NO: 3293305 - DNA, 20 bp, Homo sapiens
ctgcagcccttgggcagttc

SEQ ID NO: 3293306 - DNA, 11 bp, Homo sapiens
ctgcagcctca

SEQ ID NO: 3293307 - DNA, 23 bp, Homo sapiens
ctgcagcctcaacctcctgggct

SEQ ID NO: 3293308 - DNA, 16 bp, Homo sapiens
ctgcagcctcctcctg

SEQ ID NO: 3293309 - DNA, 22 bp, Homo sapiens
ctgcagctatgcgcaatgtggc

SEQ ID NO: 3293310 - DNA, 14 bp, Homo sapiens
ctgcagctgggccc

SEQ ID NO: 3293311 - DNA, 21 bp, Homo sapiens
ctgcagctttacatgcaattt

SEQ ID NO: 3293312 - DNA, 22 bp, Homo sapiens
ctgcaggaacgagcactggcca

SEQ ID NO: 3293313 - DNA, 16 bp, Homo sapiens
ctgcaggagtgctggc

SEQ ID NO: 3293314 - DNA, 20 bp, Homo sapiens
ctgcaggagtgtcctgccca

SEQ ID NO: 3293315 - DNA, 24 bp, Homo sapiens
ctgcaggccaagagcagaggcagc

SEQ ID NO: 3293316 - DNA, 14 bp, Homo sapiens
ctgcaggccctggc

SEQ ID NO: 3293317 - DNA, 17 bp, Homo sapiens
ctgcaggccctggcctc

SEQ ID NO: 3293318 - DNA, 15 bp, Homo sapiens
ctgcaggcttaataa

SEQ ID NO: 3293319 - DNA, 16 bp, Homo sapiens
ctgcagggccaagcac

SEQ ID NO: 3293320 - DNA, 19 bp, Homo sapiens
ctgcagggcgcccctggga

SEQ ID NO: 3293321 - DNA, 15 bp, Homo sapiens
ctgcaggggctctgg

SEQ ID NO: 3293322 - DNA, 22 bp, Homo sapiens
ctgcaggggctctggagagaaa

SEQ ID NO: 3293323 - DNA, 17 bp, Homo sapiens
ctgcagggggtgtgtct

SEQ ID NO: 3293324 - DNA, 19 bp, Homo sapiens
ctgcaggtacttcctcctg

SEQ ID NO: 3293325 - DNA, 23 bp, Homo sapiens
ctgcaggtacttcctcctgatgg

SEQ ID NO: 3293326 - DNA, 19 bp, Homo sapiens
ctgcaggttggaccccaga

SEQ ID NO: 3293327 - DNA, 14 bp, Homo sapiens
ctgcagtccgcagt

SEQ ID NO: 3293328 - DNA, 21 bp, Homo sapiens
ctgcagtccgcagtctggcct

SEQ ID NO: 3293329 - DNA, 13 bp, Homo sapiens
ctgcagtcctgga

SEQ ID NO: 3293330 - DNA, 17 bp, Homo sapiens
ctgcagtcttatttcca

SEQ ID NO: 3293331 - DNA, 15 bp, Homo sapiens
ctgcagtgagctgtg

SEQ ID NO: 3293332 - DNA, 17 bp, Homo sapiens
ctgcagttctttttgta

SEQ ID NO: 3293333 - DNA, 21 bp, Homo sapiens
ctgcagttctttttgtacact

SEQ ID NO: 3293334 - DNA, 17 bp, Homo sapiens
ctgcagttgactttctc

SEQ ID NO: 3293335 - DNA, 19 bp, Homo sapiens
ctgcagtttgagacaggag

SEQ ID NO: 3293336 - DNA, 21 bp, Homo sapiens
ctgcagtttgagacaggagac

SEQ ID NO: 3293337 - DNA, 21 bp, Homo sapiens
ctgcagttttgctatctgggc

SEQ ID NO: 3293338 - DNA, 22 bp, Homo sapiens
ctgcagttttgctatctgggct

SEQ ID NO: 3293339 - DNA, 15 bp, Homo sapiens
ctgcataatgtttct

SEQ ID NO: 3293340 - DNA, 22 bp, Homo sapiens
ctgcataatgtttctggatttc

SEQ ID NO: 3293341 - DNA, 14 bp, Homo sapiens
ctgcatacttttta

SEQ ID NO: 3293342 - DNA, 20 bp, Homo sapiens
ctgcatactttttaaatgta

SEQ ID NO: 3293343 - DNA, 15 bp, Homo sapiens
ctgcatatgaaagga

SEQ ID NO: 3293344 - DNA, 16 bp, Homo sapiens
ctgcatcccagcacct

SEQ ID NO: 3293345 - DNA, 15 bp, Homo sapiens
ctgcatccccttggc

SEQ ID NO: 3293346 - DNA, 16 bp, Homo sapiens
ctgcatccccttggct

SEQ ID NO: 3293347 - DNA, 18 bp, Homo sapiens
ctgcatctggggcccata

SEQ ID NO: 3293348 - DNA, 22 bp, Homo sapiens
ctgcatcttatagcactttgaa

SEQ ID NO: 3293349 - DNA, 23 bp, Homo sapiens
ctgcatcttatagcactttgaaa

SEQ ID NO: 3293350 - DNA, 13 bp, Homo sapiens
ctgcatgaaaaat

SEQ ID NO: 3293351 - DNA, 16 bp, Homo sapiens
ctgcatgaatatcata

SEQ ID NO: 3293352 - DNA, 18 bp, Homo sapiens
ctgcatgcaaacaagaaa

SEQ ID NO: 3293353 - DNA, 17 bp, Homo sapiens
ctgcatggacctaacat

SEQ ID NO: 3293354 - DNA, 19 bp, Homo sapiens
ctgcatggacctaacattc

SEQ ID NO: 3293355 - DNA, 13 bp, Homo sapiens
ctgcattagaaaa

SEQ ID NO: 3293356 - DNA, 16 bp, Homo sapiens
ctgcattcatttttat

SEQ ID NO: 3293357 - DNA, 21 bp, Homo sapiens
ctgcattcctgtaacttttaa

SEQ ID NO: 3293358 - DNA, 13 bp, Homo sapiens
ctgcattctctcc

SEQ ID NO: 3293359 - DNA, 19 bp, Homo sapiens
ctgcattctctcccatcct

SEQ ID NO: 3293360 - DNA, 20 bp, Homo sapiens
ctgcattctctcccatcctg

SEQ ID NO: 3293361 - DNA, 21 bp, Homo sapiens
ctgcattctctcccatcctgg

SEQ ID NO: 3293362 - DNA, 21 bp, Homo sapiens
ctgcattctgcctctctagga

SEQ ID NO: 3293363 - DNA, 23 bp, Homo sapiens
ctgcattgagcttgcatgcttgc

SEQ ID NO: 3293364 - DNA, 19 bp, Homo sapiens
ctgcattgttattgtggaa

SEQ ID NO: 3293365 - DNA, 17 bp, Homo sapiens
ctgcatttagcacaaaa

SEQ ID NO: 3293366 - DNA, 14 bp, Homo sapiens
ctgcatttctgagt

SEQ ID NO: 3293367 - DNA, 14 bp, Homo sapiens
ctgcatttgtgaaa

SEQ ID NO: 3293368 - DNA, 17 bp, Homo sapiens
ctgcatttgtgaaatga

SEQ ID NO: 3293369 - DNA, 17 bp, Homo sapiens
ctgcattttcaccccac

SEQ ID NO: 3293370 - DNA, 22 bp, Homo sapiens
ctgcatttttcactttgctctc

SEQ ID NO: 3293371 - DNA, 23 bp, Homo sapiens
ctgcatttttcactttgctctca

SEQ ID NO: 3293372 - DNA, 21 bp, Homo sapiens
ctgccaaagggaaatatcatt

SEQ ID NO: 3293373 - DNA, 19 bp, Homo sapiens
ctgccaaataaacagctat

SEQ ID NO: 3293374 - DNA, 17 bp, Homo sapiens
ctgccaagccagattct

SEQ ID NO: 3293375 - DNA, 22 bp, Homo sapiens
ctgccaagccagattctcttga

SEQ ID NO: 3293376 - DNA, 23 bp, Homo sapiens
ctgccaagccagattctcttgaa

SEQ ID NO: 3293377 - DNA, 15 bp, Homo sapiens
ctgccaaggccagag

SEQ ID NO: 3293378 - DNA, 18 bp, Homo sapiens
ctgccaaggccagagtgg

SEQ ID NO: 3293379 - DNA, 19 bp, Homo sapiens
ctgccaagtctcagaagag

SEQ ID NO: 3293380 - DNA, 23 bp, Homo sapiens
ctgccaagtggggatggggcctc

SEQ ID NO: 3293381 - DNA, 23 bp, Homo sapiens
ctgccaattgctaccgagaaggt

SEQ ID NO: 3293382 - DNA, 17 bp, Homo sapiens
ctgccacaacagaataa

SEQ ID NO: 3293383 - DNA, 18 bp, Homo sapiens
ctgccacaacagaataaa

SEQ ID NO: 3293384 - DNA, 18 bp, Homo sapiens
ctgccacactctgacgca

SEQ ID NO: 3293385 - DNA, 13 bp, Homo sapiens
ctgccacagagaa

SEQ ID NO: 3293386 - DNA, 17 bp, Homo sapiens
ctgccacatacaggtgc

SEQ ID NO: 3293387 - DNA, 23 bp, Homo sapiens
ctgccacatggagccccctctgc

SEQ ID NO: 3293388 - DNA, 14 bp, Homo sapiens
ctgccaccacgtct

SEQ ID NO: 3293389 - DNA, 18 bp, Homo sapiens
ctgccaccacgtctgcca

SEQ ID NO: 3293390 - DNA, 15 bp, Homo sapiens
ctgccaccaggccac

SEQ ID NO: 3293391 - DNA, 18 bp, Homo sapiens
ctgccacccactcaggat

SEQ ID NO: 3293392 - DNA, 23 bp, Homo sapiens
ctgccacccgcttcctgtttctt

SEQ ID NO: 3293393 - DNA, 14 bp, Homo sapiens
ctgccaccctgggg

SEQ ID NO: 3293394 - DNA, 15 bp, Homo sapiens
ctgccaccctgggga

SEQ ID NO: 3293395 - DNA, 15 bp, Homo sapiens
ctgccaccctgtagc

SEQ ID NO: 3293396 - DNA, 23 bp, Homo sapiens
ctgccaccggaggtcactccacc

SEQ ID NO: 3293397 - DNA, 15 bp, Homo sapiens
ctgccaccttgtggc

SEQ ID NO: 3293398 - DNA, 16 bp, Homo sapiens
ctgccactcactaggc

SEQ ID NO: 3293399 - DNA, 14 bp, Homo sapiens
ctgccagcacagag

SEQ ID NO: 3293400 - DNA, 17 bp, Homo sapiens
ctgccagcagcagcagg

SEQ ID NO: 3293401 - DNA, 19 bp, Homo sapiens
ctgccagcagcagcaggtg

SEQ ID NO: 3293402 - DNA, 19 bp, Homo sapiens
ctgcctgttcagctccagc

SEQ ID NO: 3293403 - DNA, 20 bp, Homo sapiens
ctgcctgttcagctccagct

SEQ ID NO: 3293404 - DNA, 19 bp, Homo sapiens
ctgcctgttcccattcttg

SEQ ID NO: 3293405 - DNA, 18 bp, Homo sapiens
ctgcctgttctgaggatt

SEQ ID NO: 3293406 - DNA, 19 bp, Homo sapiens
ctgccttaaaaccaaagag

SEQ ID NO: 3293407 - DNA, 22 bp, Homo sapiens
ctgccttaaaaccaaagagggc

SEQ ID NO: 3293408 - DNA, 20 bp, Homo sapiens
ctgccttactggtttcccca

SEQ ID NO: 3293409 - DNA, 16 bp, Homo sapiens
ctgccttagaggagcc

SEQ ID NO: 3293410 - DNA, 19 bp, Homo sapiens
ctgccttaggcctacctga

SEQ ID NO: 3293411 - DNA, 12 bp, Homo sapiens
ctgccttcccta

SEQ ID NO: 3293412 - DNA, 16 bp, Homo sapiens
ctgccttccctagctt

SEQ ID NO: 3293413 - DNA, 17 bp, Homo sapiens
ctgccttccctagcttt

SEQ ID NO: 3293414 - DNA, 16 bp, Homo sapiens
ctgccttcctcatccc

SEQ ID NO: 3293415 - DNA, 14 bp, Homo sapiens
ctgccttcctcctt

SEQ ID NO: 3293416 - DNA, 20 bp, Homo sapiens
ctgccttcgcttcttgcctc

SEQ ID NO: 3293417 - DNA, 13 bp, Homo sapiens
ctgccttcgttaa

SEQ ID NO: 3293418 - DNA, 19 bp, Homo sapiens
ctgccttcgttaactgtgt

SEQ ID NO: 3293419 - DNA, 17 bp, Homo sapiens
ctgccttctcctctctg

SEQ ID NO: 3293420 - DNA, 22 bp, Homo sapiens
ctgccttctcctctctgggcct

SEQ ID NO: 3293421 - DNA, 20 bp, Homo sapiens
ctgccttctgacggccctgc

SEQ ID NO: 3293422 - DNA, 15 bp, Homo sapiens
ctgccttctgtcctg

SEQ ID NO: 3293423 - DNA, 22 bp, Homo sapiens
ctgccttcttctttttgctgtt

SEQ ID NO: 3293424 - DNA, 20 bp, Homo sapiens
ctgccttgaagccactgaag

SEQ ID NO: 3293425 - DNA, 13 bp, Homo sapiens
ctgccttgagcta

SEQ ID NO: 3293426 - DNA, 21 bp, Homo sapiens
ctgccttgagctaaccccaag

SEQ ID NO: 3293427 - DNA, 12 bp, Homo sapiens
ctgccttgctcc

SEQ ID NO: 3293428 - DNA, 17 bp, Homo sapiens
ctgccttggcctcccaa

SEQ ID NO: 3293429 - DNA, 20 bp, Homo sapiens
ctgccttgggccttgctgct

SEQ ID NO: 3293430 - DNA, 16 bp, Homo sapiens
ctgcctttaagccaaa

SEQ ID NO: 3293431 - DNA, 23 bp, Homo sapiens
ctgcctttctcccccgacactgc

SEQ ID NO: 3293432 - DNA, 21 bp, Homo sapiens
ctgcctttgacatttaattta

SEQ ID NO: 3293433 - DNA, 17 bp, Homo sapiens
ctgcgaaggggccctgg

SEQ ID NO: 3293434 - DNA, 18 bp, Homo sapiens
ctgcgaaggggccctggt

SEQ ID NO: 3293435 - DNA, 16 bp, Homo sapiens
ctgcgactttctgcct

SEQ ID NO: 3293436 - DNA, 22 bp, Homo sapiens
ctgcgagacgcacacagctgag

SEQ ID NO: 3293437 - DNA, 18 bp, Homo sapiens
ctgcgcaccaatgcccag

SEQ ID NO: 3293438 - DNA, 15 bp, Homo sapiens
ctgcgccacttcctt

SEQ ID NO: 3293439 - DNA, 17 bp, Homo sapiens
ctgcgccccgcccacac

SEQ ID NO: 3293440 - DNA, 18 bp, Homo sapiens
ctgcgccccgcccacacc

SEQ ID NO: 3293441 - DNA, 12 bp, Homo sapiens
ctgcgcctcagg

SEQ ID NO: 3293442 - DNA, 20 bp, Homo sapiens
ctgcgctggacgatagcttg

SEQ ID NO: 3293443 - DNA, 13 bp, Homo sapiens
ctgcgcttgcttt

SEQ ID NO: 3293444 - DNA, 20 bp, Homo sapiens
ctgcggaatgaaccacatct

SEQ ID NO: 3293445 - DNA, 21 bp, Homo sapiens
ctgcggaatgaaccacatctt

SEQ ID NO: 3293446 - DNA, 15 bp, Homo sapiens
ctgcggaccaaggga

SEQ ID NO: 3293447 - DNA, 20 bp, Homo sapiens
ctgcggaccaagggactcca

SEQ ID NO: 3293448 - DNA, 21 bp, Homo sapiens
ctgcggagtgaagaggggcag

SEQ ID NO: 3293449 - DNA, 14 bp, Homo sapiens
ctgcggctgtctcc

SEQ ID NO: 3293450 - DNA, 14 bp, Homo sapiens
ctgcgggaggccct

SEQ ID NO: 3293451 - DNA, 17 bp, Homo sapiens
ctgcgggaggccctggc

SEQ ID NO: 3293452 - DNA, 19 bp, Homo sapiens
ctgcgggaggccctggccc

SEQ ID NO: 3293453 - DNA, 20 bp, Homo sapiens
ctgcgggaggccctggccct

SEQ ID NO: 3293454 - DNA, 18 bp, Homo sapiens
ctgcgggatggtcctggg

SEQ ID NO: 3293455 - DNA, 19 bp, Homo sapiens
ctgcgggatggtcctgggg

SEQ ID NO: 3293456 - DNA, 20 bp, Homo sapiens
ctgcgggcgcgggcagccac

SEQ ID NO: 3293457 - DNA, 18 bp, Homo sapiens
ctgcgggctccctggcag

SEQ ID NO: 3293458 - DNA, 20 bp, Homo sapiens
ctgcgggctccctggcagga

SEQ ID NO: 3293459 - DNA, 14 bp, Homo sapiens
ctgcggggagacag

SEQ ID NO: 3293460 - DNA, 19 bp, Homo sapiens
ctgcggggagacagaagcc

SEQ ID NO: 3293461 - DNA, 14 bp, Homo sapiens
ctgcgggttttaat

SEQ ID NO: 3293462 - DNA, 14 bp, Homo sapiens
ctgcggtcaggctg

SEQ ID NO: 3293463 - DNA, 19 bp, Homo sapiens
ctgcggtccacccaggagc

SEQ ID NO: 3293464 - DNA, 23 bp, Homo sapiens
ctgcggtccacccaggagccccg

SEQ ID NO: 3293465 - DNA, 22 bp, Homo sapiens
ctgcggtttgttggatcttcaa

SEQ ID NO: 3293466 - DNA, 15 bp, Homo sapiens
ctgcgtccccactcc

SEQ ID NO: 3293467 - DNA, 17 bp, Homo sapiens
ctgcgtccccactccct

SEQ ID NO: 3293468 - DNA, 22 bp, Homo sapiens
ctgcgtctggaggggcccctgc

SEQ ID NO: 3293469 - DNA, 21 bp, Homo sapiens
ctgcgtggcctgagtcctggt

SEQ ID NO: 3293470 - DNA, 17 bp, Homo sapiens
ctgcgttggtccagagc

SEQ ID NO: 3293471 - DNA, 19 bp, Homo sapiens
ctgctaaatctcctatttt

SEQ ID NO: 3293472 - DNA, 20 bp, Homo sapiens
ctgctaaatctcctattttt

SEQ ID NO: 3293473 - DNA, 16 bp, Homo sapiens
ctgctaacctggaaag

SEQ ID NO: 3293474 - DNA, 20 bp, Homo sapiens
ctgctacagcaatttctaat

SEQ ID NO: 3293475 - DNA, 17 bp, Homo sapiens
ctgctaccgccctgggc

SEQ ID NO: 3293476 - DNA, 20 bp, Homo sapiens
ctgctacctctgagaagaca

SEQ ID NO: 3293477 - DNA, 15 bp, Homo sapiens
ctgctacctgttctt

SEQ ID NO: 3293478 - DNA, 17 bp, Homo sapiens
ctgctactcctgtgctc

SEQ ID NO: 3293479 - DNA, 22 bp, Homo sapiens
ctgctagaacttttttaaataa

SEQ ID NO: 3293480 - DNA, 14 bp, Homo sapiens
ctgctagagcaacc

SEQ ID NO: 3293481 - DNA, 14 bp, Homo sapiens
ctgctagatttcta

SEQ ID NO: 3293482 - DNA, 17 bp, Homo sapiens
ctgctagatttctacat

SEQ ID NO: 3293483 - DNA, 14 bp, Homo sapiens
ctgctagattttaa

SEQ ID NO: 3293484 - DNA, 16 bp, Homo sapiens
ctgctagattttaatt

SEQ ID NO: 3293485 - DNA, 21 bp, Homo sapiens
ctgctagattttaatttattt

SEQ ID NO: 3293486 - DNA, 22 bp, Homo sapiens
ctgctagattttaatttatttg

SEQ ID NO: 3293487 - DNA, 13 bp, Homo sapiens
ctgctatacacaa

SEQ ID NO: 3293488 - DNA, 16 bp, Homo sapiens
ctgctatcctgccaaa

SEQ ID NO: 3293489 - DNA, 23 bp, Homo sapiens
ctgctatgcagatgtctaagaca

SEQ ID NO: 3293490 - DNA, 14 bp, Homo sapiens
ctgctattaacctt

SEQ ID NO: 3293491 - DNA, 15 bp, Homo sapiens
ctgctattaaccttg

SEQ ID NO: 3293492 - DNA, 16 bp, Homo sapiens
ctgctcacatatctgt

SEQ ID NO: 3293493 - DNA, 19 bp, Homo sapiens
ctgctcacatatctgtcat

SEQ ID NO: 3293494 - DNA, 18 bp, Homo sapiens
ctgctcacgtcaaatgca

SEQ ID NO: 3293495 - DNA, 12 bp, Homo sapiens
ctgctcacttta

SEQ ID NO: 3293496 - DNA, 18 bp, Homo sapiens
ctgctcactttaaacctg

SEQ ID NO: 3293497 - DNA, 13 bp, Homo sapiens
ctgctcagaattc

SEQ ID NO: 3293498 - DNA, 15 bp, Homo sapiens
ctgctcagccaagct

SEQ ID NO: 3293499 - DNA, 16 bp, Homo sapiens
ctgctcagccaagctt

SEQ ID NO: 3293500 - DNA, 23 bp, Homo sapiens
ctgctcagtgcttgggctccacg

SEQ ID NO: 3293501 - DNA, 23 bp, Homo sapiens
ctgctccaacccccgccacctca

SEQ ID NO: 3293502 - DNA, 13 bp, Homo sapiens
ctgctccaccaca

SEQ ID NO: 3293503 - DNA, 16 bp, Homo sapiens
ctgctccaccacatcc

SEQ ID NO: 3293504 - DNA, 15 bp, Homo sapiens
ctgctccaccagcag

SEQ ID NO: 3293505 - DNA, 16 bp, Homo sapiens
ctgctccaccagcagc

SEQ ID NO: 3293506 - DNA, 14 bp, Homo sapiens
ctgctccacccttg

SEQ ID NO: 3293507 - DNA, 16 bp, Homo sapiens
ctgctccacccttggc

SEQ ID NO: 3293508 - DNA, 18 bp, Homo sapiens
ctgctccacccttggcct

SEQ ID NO: 3293509 - DNA, 20 bp, Homo sapiens
ctgctccacccttggcctgt

SEQ ID NO: 3293510 - DNA, 21 bp, Homo sapiens
ctgctccacccttggcctgtc

SEQ ID NO: 3293511 - DNA, 16 bp, Homo sapiens
ctgctccacgaagcct

SEQ ID NO: 3293512 - DNA, 12 bp, Homo sapiens
ctgctccacgcg

SEQ ID NO: 3293513 - DNA, 14 bp, Homo sapiens
ctgctccacgcgct

SEQ ID NO: 3293514 - DNA, 14 bp, Homo sapiens
ctgctccaggcctg

SEQ ID NO: 3293515 - DNA, 21 bp, Homo sapiens
ctgctccatttataaccccag

SEQ ID NO: 3293516 - DNA, 17 bp, Homo sapiens
ctgctcccagcagccct

SEQ ID NO: 3293517 - DNA, 18 bp, Homo sapiens
ctgctcccagcctgctga

SEQ ID NO: 3293518 - DNA, 14 bp, Homo sapiens
ctgctcccattcct

SEQ ID NO: 3293519 - DNA, 17 bp, Homo sapiens
ctgctccccagccctgg

SEQ ID NO: 3293520 - DNA, 16 bp, Homo sapiens
ctgctccccaggggag

SEQ ID NO: 3293521 - DNA, 14 bp, Homo sapiens
ctgctcccctaacc

SEQ ID NO: 3293522 - DNA, 16 bp, Homo sapiens
ctgctccctgaagcca

SEQ ID NO: 3293523 - DNA, 19 bp, Homo sapiens
ctgctccctgaagccagcc

SEQ ID NO: 3293524 - DNA, 20 bp, Homo sapiens
ctgctccctgaagccagcct

SEQ ID NO: 3293525 - DNA, 22 bp, Homo sapiens
ctgctccctgaagccagccttc

SEQ ID NO: 3293526 - DNA, 21 bp, Homo sapiens
ctgctccgctgctccttggct

SEQ ID NO: 3293527 - DNA, 20 bp, Homo sapiens
ctgtggccgtctcctccctc

SEQ ID NO: 3293528 - DNA, 20 bp, Homo sapiens
ctgtggccgttatctggaag

SEQ ID NO: 3293529 - DNA, 14 bp, Homo sapiens
ctgtggcctcaccc

SEQ ID NO: 3293530 - DNA, 17 bp, Homo sapiens
ctgtggcctcaccctga

SEQ ID NO: 3293531 - DNA, 16 bp, Homo sapiens
ctgtggcctgggcaag

SEQ ID NO: 3293532 - DNA, 15 bp, Homo sapiens
ctgtggcctgtgtcc

SEQ ID NO: 3293533 - DNA, 16 bp, Homo sapiens
ctgtggcctgtgtcca

SEQ ID NO: 3293534 - DNA, 19 bp, Homo sapiens
ctgtggcctgtgtccagca

SEQ ID NO: 3293535 - DNA, 20 bp, Homo sapiens
ctgtggcctgtgtccagcag

SEQ ID NO: 3293536 - DNA, 21 bp, Homo sapiens
ctgtggcctgtgtccagcagc

SEQ ID NO: 3293537 - DNA, 16 bp, Homo sapiens
ctgtgggaaggccagc

SEQ ID NO: 3293538 - DNA, 15 bp, Homo sapiens
ctgtgggattctgat

SEQ ID NO: 3293539 - DNA, 20 bp, Homo sapiens
ctgtgggattctgatttgta

SEQ ID NO: 3293540 - DNA, 15 bp, Homo sapiens
ctgtgggcagcaccc

SEQ ID NO: 3293541 - DNA, 14 bp, Homo sapiens
ctgtgggcctcaag

SEQ ID NO: 3293542 - DNA, 14 bp, Homo sapiens
ctgtggggaaaggg

SEQ ID NO: 3293543 - DNA, 21 bp, Homo sapiens
ctgtggggaggggttgttttg

SEQ ID NO: 3293544 - DNA, 14 bp, Homo sapiens
ctgtggggctggta

SEQ ID NO: 3293545 - DNA, 23 bp, Homo sapiens
ctgtgggggtgagggtcccatgt

SEQ ID NO: 3293546 - DNA, 24 bp, Homo sapiens
ctgtgggggtgagggtcccatgtg

SEQ ID NO: 3293547 - DNA, 20 bp, Homo sapiens
ctgtgggggtggccatccct

SEQ ID NO: 3293548 - DNA, 21 bp, Homo sapiens
ctgtgggggtggccatccctg

SEQ ID NO: 3293549 - DNA, 19 bp, Homo sapiens
ctgtgggtccgataatatc

SEQ ID NO: 3293550 - DNA, 23 bp, Homo sapiens
ctgtggtagtactcctgcaaaat

SEQ ID NO: 3293551 - DNA, 16 bp, Homo sapiens
ctgtggttcctctgct

SEQ ID NO: 3293552 - DNA, 17 bp, Homo sapiens
ctgtgtaaatatatgtc

SEQ ID NO: 3293553 - DNA, 19 bp, Homo sapiens
ctgtgtacataactgaaaa

SEQ ID NO: 3293554 - DNA, 23 bp, Homo sapiens
ctgtgtacattttaaaggataat

SEQ ID NO: 3293555 - DNA, 14 bp, Homo sapiens
ctgtgtactgtgtc

SEQ ID NO: 3293556 - DNA, 13 bp, Homo sapiens
ctgtgtatatctc

SEQ ID NO: 3293557 - DNA, 21 bp, Homo sapiens
ctgtgtatatctcttggaaaa

SEQ ID NO: 3293558 - DNA, 17 bp, Homo sapiens
ctgtgtatattatttgg

SEQ ID NO: 3293559 - DNA, 18 bp, Homo sapiens
ctgtgtatattatttggc

SEQ ID NO: 3293560 - DNA, 15 bp, Homo sapiens
ctgtgtatggaaaaa

SEQ ID NO: 3293561 - DNA, 14 bp, Homo sapiens
ctgtgtatgtacat

SEQ ID NO: 3293562 - DNA, 19 bp, Homo sapiens
ctgtgtattccaagacatg

SEQ ID NO: 3293563 - DNA, 13 bp, Homo sapiens
ctgtgtatttaat

SEQ ID NO: 3293564 - DNA, 17 bp, Homo sapiens
ctgtgtatttaattgta

SEQ ID NO: 3293565 - DNA, 14 bp, Homo sapiens
ctgtgtatttgctt

SEQ ID NO: 3293566 - DNA, 16 bp, Homo sapiens
ctgtgtatttgctttt

SEQ ID NO: 3293567 - DNA, 21 bp, Homo sapiens
ctgtgtcagaaaccctggtct

SEQ ID NO: 3293568 - DNA, 22 bp, Homo sapiens
ctgtgtcagaaaccctggtctc

SEQ ID NO: 3293569 - DNA, 23 bp, Homo sapiens
ctgtgtcataaacagatgaataa

SEQ ID NO: 3293570 - DNA, 18 bp, Homo sapiens
ctgtgtccagcagctgcg

SEQ ID NO: 3293571 - DNA, 13 bp, Homo sapiens
ctgtgtccatgcg

SEQ ID NO: 3293572 - DNA, 19 bp, Homo sapiens
ctgtgtcccatgacccacc

SEQ ID NO: 3293573 - DNA, 20 bp, Homo sapiens
ctgtgtcccatgacccaccc

SEQ ID NO: 3293574 - DNA, 21 bp, Homo sapiens
ctgtgtcccatgacccacccc

SEQ ID NO: 3293575 - DNA, 23 bp, Homo sapiens
ctgtgtcccatgacccacccctg

SEQ ID NO: 3293576 - DNA, 16 bp, Homo sapiens
ctgtgtcccttttgca

SEQ ID NO: 3293577 - DNA, 16 bp, Homo sapiens
ctgtgtctaagattct

SEQ ID NO: 3293578 - DNA, 21 bp, Homo sapiens
ctgtgtcttgcaatggcagcc

SEQ ID NO: 3293579 - DNA, 22 bp, Homo sapiens
ctgtgtcttgcaatggcagcct

SEQ ID NO: 3293580 - DNA, 12 bp, Homo sapiens
ctgtgtgaaata

SEQ ID NO: 3293581 - DNA, 19 bp, Homo sapiens
ctgtgtgaaataccagtgt

SEQ ID NO: 3293582 - DNA, 15 bp, Homo sapiens
ctgtgtgaatttttc

SEQ ID NO: 3293583 - DNA, 17 bp, Homo sapiens
ctgtgtgaatttttcta

SEQ ID NO: 3293584 - DNA, 22 bp, Homo sapiens
ctgtgtgactggcaagaggcct

SEQ ID NO: 3293585 - DNA, 16 bp, Homo sapiens
ctgtgtgatgaacttt

SEQ ID NO: 3293586 - DNA, 15 bp, Homo sapiens
ctgtgtgcagtgaag

SEQ ID NO: 3293587 - DNA, 18 bp, Homo sapiens
ctgtgtgctcctccttgg

SEQ ID NO: 3293588 - DNA, 16 bp, Homo sapiens
ctgtgtggactgtgat

SEQ ID NO: 3293589 - DNA, 21 bp, Homo sapiens
ctgtgtgggactgtacacact

SEQ ID NO: 3293590 - DNA, 11 bp, Homo sapiens
ctgtgtggttg

SEQ ID NO: 3293591 - DNA, 15 bp, Homo sapiens
ctgtgtgtaggctgg

SEQ ID NO: 3293592 - DNA, 16 bp, Homo sapiens
ctgtgtgtaggctggg

SEQ ID NO: 3293593 - DNA, 15 bp, Homo sapiens
ctgtgtgtccaaaac

SEQ ID NO: 3293594 - DNA, 19 bp, Homo sapiens
ctgtgtgtccaaaactgcc

SEQ ID NO: 3293595 - DNA, 15 bp, Homo sapiens
ctgtgtgtgtatgag

SEQ ID NO: 3293596 - DNA, 14 bp, Homo sapiens
ctgtgtgtgttctt

SEQ ID NO: 3293597 - DNA, 15 bp, Homo sapiens
ctgtgtgtgttcttc

SEQ ID NO: 3293598 - DNA, 16 bp, Homo sapiens
ctgtgttcatggtcta

SEQ ID NO: 3293599 - DNA, 11 bp, Homo sapiens
ctgtgttcatt

SEQ ID NO: 3293600 - DNA, 23 bp, Homo sapiens
ctgtgttcatttggtgttcctgg

SEQ ID NO: 3293601 - DNA, 22 bp, Homo sapiens
ctgtgttcttgccactgcactc

SEQ ID NO: 3293602 - DNA, 23 bp, Homo sapiens
ctgtgttgcattattcatttagt

SEQ ID NO: 3293603 - DNA, 23 bp, Homo sapiens
ctgtgttgccacagtagaactgt

SEQ ID NO: 3293604 - DNA, 14 bp, Homo sapiens
ctgtgttgccatgt

SEQ ID NO: 3293605 - DNA, 20 bp, Homo sapiens
ctgtgttgcgtgtcgtgggt

SEQ ID NO: 3293606 - DNA, 16 bp, Homo sapiens
ctgtgttgctgtttag

SEQ ID NO: 3293607 - DNA, 17 bp, Homo sapiens
ctgtgttgctgtttaga

SEQ ID NO: 3293608 - DNA, 19 bp, Homo sapiens
ctgtgttgctgtttagagt

SEQ ID NO: 3293609 - DNA, 21 bp, Homo sapiens
ctgtgttgctgtttagagtaa

SEQ ID NO: 3293610 - DNA, 15 bp, Homo sapiens
ctgtgttgtacagct

SEQ ID NO: 3293611 - DNA, 18 bp, Homo sapiens
ctgtgttgtattaacaaa

SEQ ID NO: 3293612 - DNA, 19 bp, Homo sapiens
ctgtgttgtattaacaaaa

SEQ ID NO: 3293613 - DNA, 14 bp, Homo sapiens
ctgtgttgtctcta

SEQ ID NO: 3293614 - DNA, 18 bp, Homo sapiens
ctgtgtttaatttcttca

SEQ ID NO: 3293615 - DNA, 20 bp, Homo sapiens
ctgtgtttacagacagaaga

SEQ ID NO: 3293616 - DNA, 16 bp, Homo sapiens
ctgtgtttatatggaa

SEQ ID NO: 3293617 - DNA, 22 bp, Homo sapiens
ctgtgtttatatggaagaaagt

SEQ ID NO: 3293618 - DNA, 19 bp, Homo sapiens
ctgtgtttcaagtggggct

SEQ ID NO: 3293619 - DNA, 14 bp, Homo sapiens
ctgtgtttcagcat

SEQ ID NO: 3293620 - DNA, 15 bp, Homo sapiens
ctgtgtttgcagcct

SEQ ID NO: 3293621 - DNA, 22 bp, Homo sapiens
ctgtgttttgaatggtgttgta

SEQ ID NO: 3293622 - DNA, 23 bp, Homo sapiens
ctgttaaactgttagcactgttg

SEQ ID NO: 3293623 - DNA, 12 bp, Homo sapiens
ctgttaaccatt

SEQ ID NO: 3293624 - DNA, 22 bp, Homo sapiens
ctgttaactgtgcgttaaataa

SEQ ID NO: 3293625 - DNA, 17 bp, Homo sapiens
ctgttaaggttgaactt

SEQ ID NO: 3293626 - DNA, 19 bp, Homo sapiens
ctgttaaggttgaactttg

SEQ ID NO: 3293627 - DNA, 14 bp, Homo sapiens
ctgttaatacacag

SEQ ID NO: 3293628 - DNA, 16 bp, Homo sapiens
ctgttaatagttcagg

SEQ ID NO: 3293629 - DNA, 19 bp, Homo sapiens
ctgttaatgtatttgttca

SEQ ID NO: 3293630 - DNA, 23 bp, Homo sapiens
ctgttacataacaagaaaatcaa

SEQ ID NO: 3293631 - DNA, 15 bp, Homo sapiens
ctgttaccattcaca

SEQ ID NO: 3293632 - DNA, 17 bp, Homo sapiens
ctgttacccaggctgga

SEQ ID NO: 3293633 - DNA, 16 bp, Homo sapiens
ctgttaccgcctgtct

SEQ ID NO: 3293634 - DNA, 17 bp, Homo sapiens
ctgttaccgcctgtctc

SEQ ID NO: 3293635 - DNA, 18 bp, Homo sapiens
ctgttactgttaaccatt

SEQ ID NO: 3293636 - DNA, 15 bp, Homo sapiens
ctgttactttctttc

SEQ ID NO: 3293637 - DNA, 23 bp, Homo sapiens
ctgttactttctttcagatgttt

SEQ ID NO: 3293638 - DNA, 22 bp, Homo sapiens
ctgttagaacactattttcaga

SEQ ID NO: 3293639 - DNA, 14 bp, Homo sapiens
ctgttagatgctga

SEQ ID NO: 3293640 - DNA, 17 bp, Homo sapiens
ctgttagcactgttgat

SEQ ID NO: 3293641 - DNA, 18 bp, Homo sapiens
ctgttagcactgttgatg

SEQ ID NO: 3293642 - DNA, 14 bp, Homo sapiens
ctgttagtcatttg

SEQ ID NO: 3293643 - DNA, 19 bp, Homo sapiens
ctgttatcaaaactttctt

SEQ ID NO: 3293644 - DNA, 19 bp, Homo sapiens
ctgttatgctgtgacacat

SEQ ID NO: 3293645 - DNA, 21 bp, Homo sapiens
ctgttcacaaactacctctgg

SEQ ID NO: 3293646 - DNA, 16 bp, Homo sapiens
ctgttcacagaaaaag

SEQ ID NO: 3293647 - DNA, 16 bp, Homo sapiens
ctgttcacttttcctc

SEQ ID NO: 3293648 - DNA, 14 bp, Homo sapiens
ctgttcagcattct

SEQ ID NO: 3293649 - DNA, 18 bp, Homo sapiens
ctgttcatgtgcctctgc

SEQ ID NO: 3293650 - DNA, 21 bp, Homo sapiens
ctgttccaaattcagtttcat

SEQ ID NO: 3293651 - DNA, 15 bp, Homo sapiens
ctgttccagattcct

SEQ ID NO: 3293652 - DNA, 12 bp, Homo sapiens
cttcatgcaatg

SEQ ID NO: 3293653 - DNA, 16 bp, Homo sapiens
cttcatgcctttgtaa

SEQ ID NO: 3293654 - DNA, 20 bp, Homo sapiens
cttcatgcttttgcttgcaa

SEQ ID NO: 3293655 - DNA, 21 bp, Homo sapiens
cttcatgtaattttattttaa

SEQ ID NO: 3293656 - DNA, 23 bp, Homo sapiens
cttcatgtcaacttctggctcct

SEQ ID NO: 3293657 - DNA, 15 bp, Homo sapiens
cttcattctgcaggg

SEQ ID NO: 3293658 - DNA, 20 bp, Homo sapiens
cttcattcttgaaagctgtg

SEQ ID NO: 3293659 - DNA, 21 bp, Homo sapiens
cttcattcttgaaagctgtgg

SEQ ID NO: 3293660 - DNA, 23 bp, Homo sapiens
cttcattgagagttttgtcttga

SEQ ID NO: 3293661 - DNA, 22 bp, Homo sapiens
cttcattgtactacctgtgtat

SEQ ID NO: 3293662 - DNA, 15 bp, Homo sapiens
cttcattgtccctct

SEQ ID NO: 3293663 - DNA, 17 bp, Homo sapiens
cttcattgtccctcttc

SEQ ID NO: 3293664 - DNA, 14 bp, Homo sapiens
cttcatttaaaaaa

SEQ ID NO: 3293665 - DNA, 12 bp, Homo sapiens
cttcatttcaat

SEQ ID NO: 3293666 - DNA, 13 bp, Homo sapiens
cttcatttcaatc

SEQ ID NO: 3293667 - DNA, 14 bp, Homo sapiens
cttcatttcattgt

SEQ ID NO: 3293668 - DNA, 16 bp, Homo sapiens
cttcatttcattgtat

SEQ ID NO: 3293669 - DNA, 19 bp, Homo sapiens
cttcatttcattgtatgat

SEQ ID NO: 3293670 - DNA, 18 bp, Homo sapiens
cttcatttcctgtgtctt

SEQ ID NO: 3293671 - DNA, 13 bp, Homo sapiens
cttcatttggaga

SEQ ID NO: 3293672 - DNA, 14 bp, Homo sapiens
cttcatttggagat

SEQ ID NO: 3293673 - DNA, 18 bp, Homo sapiens
cttcatttgtgtcaatgg

SEQ ID NO: 3293674 - DNA, 18 bp, Homo sapiens
cttcattttatatttaaa

SEQ ID NO: 3293675 - DNA, 19 bp, Homo sapiens
cttcattttatatttaaaa

SEQ ID NO: 3293676 - DNA, 20 bp, Homo sapiens
cttcattttcaggaaatcta

SEQ ID NO: 3293677 - DNA, 21 bp, Homo sapiens
cttcattttcaggaaatctac

SEQ ID NO: 3293678 - DNA, 15 bp, Homo sapiens
cttccaaaaaattaa

SEQ ID NO: 3293679 - DNA, 13 bp, Homo sapiens
cttccaaacaaaa

SEQ ID NO: 3293680 - DNA, 17 bp, Homo sapiens
cttccaaagaattctta

SEQ ID NO: 3293681 - DNA, 15 bp, Homo sapiens
cttccaaataataaa

SEQ ID NO: 3293682 - DNA, 17 bp, Homo sapiens
cttccaaataataaagt

SEQ ID NO: 3293683 - DNA, 20 bp, Homo sapiens
cttccaaataataaagtcta

SEQ ID NO: 3293684 - DNA, 13 bp, Homo sapiens
cttccaaggagac

SEQ ID NO: 3293685 - DNA, 14 bp, Homo sapiens
cttccaaggagacc

SEQ ID NO: 3293686 - DNA, 21 bp, Homo sapiens
cttccaaggagaccaagtcct

SEQ ID NO: 3293687 - DNA, 12 bp, Homo sapiens
cttccaaggccc

SEQ ID NO: 3293688 - DNA, 15 bp, Homo sapiens
cttccaaggccctgc

SEQ ID NO: 3293689 - DNA, 17 bp, Homo sapiens
cttccaattaatgcttt

SEQ ID NO: 3293690 - DNA, 17 bp, Homo sapiens
cttccacagttatctta

SEQ ID NO: 3293691 - DNA, 13 bp, Homo sapiens
cttccacatgtac

SEQ ID NO: 3293692 - DNA, 23 bp, Homo sapiens
cttccacccgtctctctgcccac

SEQ ID NO: 3293693 - DNA, 20 bp, Homo sapiens
cttccacccttttttctaag

SEQ ID NO: 3293694 - DNA, 13 bp, Homo sapiens
cttccacctccct

SEQ ID NO: 3293695 - DNA, 14 bp, Homo sapiens
cttccacctccctc

SEQ ID NO: 3293696 - DNA, 15 bp, Homo sapiens
cttccacctccctcc

SEQ ID NO: 3293697 - DNA, 17 bp, Homo sapiens
cttccacctcctagagg

SEQ ID NO: 3293698 - DNA, 19 bp, Homo sapiens
cttccacctgtgccctcac

SEQ ID NO: 3293699 - DNA, 16 bp, Homo sapiens
cttccactgcctctgc

SEQ ID NO: 3293700 - DNA, 16 bp, Homo sapiens
cttccacttgagtgtc

SEQ ID NO: 3293701 - DNA, 12 bp, Homo sapiens
cttccagacctg

SEQ ID NO: 3293702 - DNA, 17 bp, Homo sapiens
cttccagacctgcttcc

SEQ ID NO: 3293703 - DNA, 22 bp, Homo sapiens
cttccagacctgcttcctgaaa

SEQ ID NO: 3293704 - DNA, 23 bp, Homo sapiens
cttccagacctgcttcctgaaat

SEQ ID NO: 3293705 - DNA, 15 bp, Homo sapiens
cttccagatcactgc

SEQ ID NO: 3293706 - DNA, 12 bp, Homo sapiens
cttccagctcct

SEQ ID NO: 3293707 - DNA, 15 bp, Homo sapiens
cttccagctcctgta

SEQ ID NO: 3293708 - DNA, 17 bp, Homo sapiens
cttccagcttcaggcac

SEQ ID NO: 3293709 - DNA, 20 bp, Homo sapiens
cttccagcttcaggcaccag

SEQ ID NO: 3293710 - DNA, 17 bp, Homo sapiens
cttccaggaaactccac

SEQ ID NO: 3293711 - DNA, 23 bp, Homo sapiens
cttccaggctcttcctggacctg

SEQ ID NO: 3293712 - DNA, 21 bp, Homo sapiens
cttccagtcttcctgacactt

SEQ ID NO: 3293713 - DNA, 22 bp, Homo sapiens
cttccagtggctggtttctgag

SEQ ID NO: 3293714 - DNA, 11 bp, Homo sapiens
cttccataatc

SEQ ID NO: 3293715 - DNA, 14 bp, Homo sapiens
cttccataattatg

SEQ ID NO: 3293716 - DNA, 16 bp, Homo sapiens
cttccatacagctcta

SEQ ID NO: 3293717 - DNA, 22 bp, Homo sapiens
cttccatagcctaatccctggg

SEQ ID NO: 3293718 - DNA, 21 bp, Homo sapiens
cttccatcccaaccagtgcca

SEQ ID NO: 3293719 - DNA, 14 bp, Homo sapiens
cttccatcccagga

SEQ ID NO: 3293720 - DNA, 15 bp, Homo sapiens
cttccatccctaccc

SEQ ID NO: 3293721 - DNA, 17 bp, Homo sapiens
cttccatccctaccccc

SEQ ID NO: 3293722 - DNA, 19 bp, Homo sapiens
cttccatccctacccccta

SEQ ID NO: 3293723 - DNA, 17 bp, Homo sapiens
cttccatgattctattt

SEQ ID NO: 3293724 - DNA, 17 bp, Homo sapiens
cttccatgtcgcctctg

SEQ ID NO: 3293725 - DNA, 18 bp, Homo sapiens
cttccatgtggagaaagg

SEQ ID NO: 3293726 - DNA, 16 bp, Homo sapiens
cttccattttaatttt

SEQ ID NO: 3293727 - DNA, 14 bp, Homo sapiens
cttccattttcccc

SEQ ID NO: 3293728 - DNA, 19 bp, Homo sapiens
cttccattttcccccacta

SEQ ID NO: 3293729 - DNA, 23 bp, Homo sapiens
cttccattttcccccactactgc

SEQ ID NO: 3293730 - DNA, 22 bp, Homo sapiens
cttcccaacagccttagctgcc

SEQ ID NO: 3293731 - DNA, 11 bp, Homo sapiens
cttcccacacg

SEQ ID NO: 3293732 - DNA, 22 bp, Homo sapiens
cttcccacacgattagctttat

SEQ ID NO: 3293733 - DNA, 19 bp, Homo sapiens
cttcccacctccctgccca

SEQ ID NO: 3293734 - DNA, 15 bp, Homo sapiens
cttcccagaggcaga

SEQ ID NO: 3293735 - DNA, 17 bp, Homo sapiens
cttcccagccatgccca

SEQ ID NO: 3293736 - DNA, 22 bp, Homo sapiens
cttcccagccatgcccaggacg

SEQ ID NO: 3293737 - DNA, 11 bp, Homo sapiens
cttcccagctt

SEQ ID NO: 3293738 - DNA, 16 bp, Homo sapiens
cttcccatagtggggc

SEQ ID NO: 3293739 - DNA, 17 bp, Homo sapiens
cttcccatagtggggcc

SEQ ID NO: 3293740 - DNA, 15 bp, Homo sapiens
cttcccatcgctgtc

SEQ ID NO: 3293741 - DNA, 13 bp, Homo sapiens
cttcccatgcatt

SEQ ID NO: 3293742 - DNA, 21 bp, Homo sapiens
cttcccatgcctgtctctgtt

SEQ ID NO: 3293743 - DNA, 15 bp, Homo sapiens
cttcccatttctcta

SEQ ID NO: 3293744 - DNA, 18 bp, Homo sapiens
cttcccatttctctacac

SEQ ID NO: 3293745 - DNA, 22 bp, Homo sapiens
cttcccatttctctacactaag

SEQ ID NO: 3293746 - DNA, 15 bp, Homo sapiens
cttccccaggcccac

SEQ ID NO: 3293747 - DNA, 18 bp, Homo sapiens
cttcccccatagccaccc

SEQ ID NO: 3293748 - DNA, 12 bp, Homo sapiens
cttccccctcca

SEQ ID NO: 3293749 - DNA, 13 bp, Homo sapiens
cttcccccttcca

SEQ ID NO: 3293750 - DNA, 20 bp, Homo sapiens
cttccccgctcttgccctgc

SEQ ID NO: 3293751 - DNA, 13 bp, Homo sapiens
cttcccctcccct

SEQ ID NO: 3293752 - DNA, 17 bp, Homo sapiens
cttcccctcccctcctt

SEQ ID NO: 3293753 - DNA, 14 bp, Homo sapiens
cttcccctccctgg

SEQ ID NO: 3293754 - DNA, 14 bp, Homo sapiens
cttcccctgtcttc

SEQ ID NO: 3293755 - DNA, 14 bp, Homo sapiens
cttccccttctgtg

SEQ ID NO: 3293756 - DNA, 18 bp, Homo sapiens
cttccccttctgtgtcac

SEQ ID NO: 3293757 - DNA, 21 bp, Homo sapiens
cttccccttttgcctggctgt

SEQ ID NO: 3293758 - DNA, 16 bp, Homo sapiens
cttcccgctcagccct

SEQ ID NO: 3293759 - DNA, 18 bp, Homo sapiens
cttcccgctcagccctcc

SEQ ID NO: 3293760 - DNA, 13 bp, Homo sapiens
cttccctacctca

SEQ ID NO: 3293761 - DNA, 20 bp, Homo sapiens
cttccctagagggttcctgt

SEQ ID NO: 3293762 - DNA, 12 bp, Homo sapiens
cttccctcaggc

SEQ ID NO: 3293763 - DNA, 15 bp, Homo sapiens
cttccctccctatct

SEQ ID NO: 3293764 - DNA, 17 bp, Homo sapiens
cttccctccgccttctc

SEQ ID NO: 3293765 - DNA, 18 bp, Homo sapiens
cttccctgacttgcttta

SEQ ID NO: 3293766 - DNA, 19 bp, Homo sapiens
cttccctgattgacctgct

SEQ ID NO: 3293767 - DNA, 16 bp, Homo sapiens
cttccctgtccctcta

SEQ ID NO: 3293768 - DNA, 16 bp, Homo sapiens
cttccctttccccagc

SEQ ID NO: 3293769 - DNA, 13 bp, Homo sapiens
cttccctttctgc

SEQ ID NO: 3293770 - DNA, 13 bp, Homo sapiens
cttccgaccctct

SEQ ID NO: 3293771 - DNA, 15 bp, Homo sapiens
cttccgaccctctgg

SEQ ID NO: 3293772 - DNA, 17 bp, Homo sapiens
cttccgaccctctggga

SEQ ID NO: 3293773 - DNA, 23 bp, Homo sapiens
cttccgaccctctgggaacctcc

SEQ ID NO: 3293774 - DNA, 15 bp, Homo sapiens
cttccgccccttccc

SEQ ID NO: 3293775 - DNA, 12 bp, Homo sapiens
cttccgctgagg

SEQ ID NO: 3293776 - DNA, 13 bp, Homo sapiens
cttccgctgaggg

SEQ ID NO: 3293777 - DNA, 21 bp, Homo sapiens
cttccgctgaggggtctcgga

SEQ ID NO: 3293778 - DNA, 22 bp, Homo sapiens
cttccgctgaggggtctcggat

SEQ ID NO: 3293779 - DNA, 21 bp, Homo sapiens
cttgcataggctcttaagcag

SEQ ID NO: 3293780 - DNA, 20 bp, Homo sapiens
cttgcatccttcctataact

SEQ ID NO: 3293781 - DNA, 14 bp, Homo sapiens
cttgcatgaagaga

SEQ ID NO: 3293782 - DNA, 13 bp, Homo sapiens
cttgcattcattt

SEQ ID NO: 3293783 - DNA, 20 bp, Homo sapiens
cttgcattcattttctgaca

SEQ ID NO: 3293784 - DNA, 20 bp, Homo sapiens
cttgccaaaaaatagcacac

SEQ ID NO: 3293785 - DNA, 17 bp, Homo sapiens
cttgccaagaaaatgaa

SEQ ID NO: 3293786 - DNA, 15 bp, Homo sapiens
cttgccactgcactc

SEQ ID NO: 3293787 - DNA, 15 bp, Homo sapiens
cttgcccaagtccca

SEQ ID NO: 3293788 - DNA, 12 bp, Homo sapiens
cttgcccatcct

SEQ ID NO: 3293789 - DNA, 14 bp, Homo sapiens
cttgcccatcctga

SEQ ID NO: 3293790 - DNA, 16 bp, Homo sapiens
cttgcccatcctgact

SEQ ID NO: 3293791 - DNA, 18 bp, Homo sapiens
cttgcccatcctgactga

SEQ ID NO: 3293792 - DNA, 14 bp, Homo sapiens
cttgccccacagtt

SEQ ID NO: 3293793 - DNA, 15 bp, Homo sapiens
cttgccccacagttg

SEQ ID NO: 3293794 - DNA, 16 bp, Homo sapiens
cttgccctccgcctgg

SEQ ID NO: 3293795 - DNA, 21 bp, Homo sapiens
cttgccctccgcctgggatct

SEQ ID NO: 3293796 - DNA, 12 bp, Homo sapiens
cttgccctgacc

SEQ ID NO: 3293797 - DNA, 17 bp, Homo sapiens
cttgcccttccctgtcc

SEQ ID NO: 3293798 - DNA, 19 bp, Homo sapiens
cttgcccttccctgtccct

SEQ ID NO: 3293799 - DNA, 15 bp, Homo sapiens
cttgcccttgccctg

SEQ ID NO: 3293800 - DNA, 16 bp, Homo sapiens
cttgcccttgccctga

SEQ ID NO: 3293801 - DNA, 17 bp, Homo sapiens
cttgcccttgccctgac

SEQ ID NO: 3293802 - DNA, 14 bp, Homo sapiens
cttgccctttccat

SEQ ID NO: 3293803 - DNA, 16 bp, Homo sapiens
cttgccctttccatat

SEQ ID NO: 3293804 - DNA, 23 bp, Homo sapiens
cttgccgagcctaatgaaaggga

SEQ ID NO: 3293805 - DNA, 22 bp, Homo sapiens
cttgcctaaatttaatgctgcc

SEQ ID NO: 3293806 - DNA, 14 bp, Homo sapiens
cttgcctaggccaa

SEQ ID NO: 3293807 - DNA, 12 bp, Homo sapiens
cttgcctcccca

SEQ ID NO: 3293808 - DNA, 14 bp, Homo sapiens
cttgcctccccatt

SEQ ID NO: 3293809 - DNA, 14 bp, Homo sapiens
cttgcctctctcag

SEQ ID NO: 3293810 - DNA, 14 bp, Homo sapiens
cttgcctctgtgct

SEQ ID NO: 3293811 - DNA, 18 bp, Homo sapiens
cttgcctcttccttgaag

SEQ ID NO: 3293812 - DNA, 13 bp, Homo sapiens
cttgcctggggtc

SEQ ID NO: 3293813 - DNA, 21 bp, Homo sapiens
cttgcctggggtctgagcatg

SEQ ID NO: 3293814 - DNA, 15 bp, Homo sapiens
cttgccttcccctgt

SEQ ID NO: 3293815 - DNA, 18 bp, Homo sapiens
cttgccttcccctgtctt

SEQ ID NO: 3293816 - DNA, 21 bp, Homo sapiens
cttgccttcccctgtcttcac

SEQ ID NO: 3293817 - DNA, 15 bp, Homo sapiens
cttgcctttgtggcc

SEQ ID NO: 3293818 - DNA, 16 bp, Homo sapiens
cttgcctttgtggcct

SEQ ID NO: 3293819 - DNA, 18 bp, Homo sapiens
cttgcctttgtggccttc

SEQ ID NO: 3293820 - DNA, 17 bp, Homo sapiens
cttgcggcaaaaggaaa

SEQ ID NO: 3293821 - DNA, 19 bp, Homo sapiens
cttgcgtcctgcagaggac

SEQ ID NO: 3293822 - DNA, 14 bp, Homo sapiens
cttgctaaagcact

SEQ ID NO: 3293823 - DNA, 17 bp, Homo sapiens
cttgctaaagcactttg

SEQ ID NO: 3293824 - DNA, 21 bp, Homo sapiens
cttgctaaagcactttgcact

SEQ ID NO: 3293825 - DNA, 22 bp, Homo sapiens
cttgctaataaacactggctct

SEQ ID NO: 3293826 - DNA, 23 bp, Homo sapiens
cttgctaataaacactggctctg

SEQ ID NO: 3293827 - DNA, 18 bp, Homo sapiens
cttgctaatcagtgtctc

SEQ ID NO: 3293828 - DNA, 13 bp, Homo sapiens
cttgctaccagta

SEQ ID NO: 3293829 - DNA, 17 bp, Homo sapiens
cttgctaccagtattta

SEQ ID NO: 3293830 - DNA, 20 bp, Homo sapiens
cttgctagctatgtgacctt

SEQ ID NO: 3293831 - DNA, 21 bp, Homo sapiens
cttgctagtattcgctgtgtt

SEQ ID NO: 3293832 - DNA, 22 bp, Homo sapiens
cttgctagtattcgctgtgttc

SEQ ID NO: 3293833 - DNA, 12 bp, Homo sapiens
cttgctccaggg

SEQ ID NO: 3293834 - DNA, 15 bp, Homo sapiens
cttgctccagggtct

SEQ ID NO: 3293835 - DNA, 16 bp, Homo sapiens
cttgctcccaacccat

SEQ ID NO: 3293836 - DNA, 18 bp, Homo sapiens
cttgctcccttcagcccc

SEQ ID NO: 3293837 - DNA, 23 bp, Homo sapiens
cttgctcccttcagcccccagcc

SEQ ID NO: 3293838 - DNA, 15 bp, Homo sapiens
cttgctctccctctt

SEQ ID NO: 3293839 - DNA, 23 bp, Homo sapiens
cttgctgatggcttgacatgtgc

SEQ ID NO: 3293840 - DNA, 16 bp, Homo sapiens
cttgctgctgctgcac

SEQ ID NO: 3293841 - DNA, 21 bp, Homo sapiens
cttgctggacggggactgggg

SEQ ID NO: 3293842 - DNA, 13 bp, Homo sapiens
cttgctggcccca

SEQ ID NO: 3293843 - DNA, 15 bp, Homo sapiens
cttgctggccccagc

SEQ ID NO: 3293844 - DNA, 18 bp, Homo sapiens
cttgctggccccagccct

SEQ ID NO: 3293845 - DNA, 22 bp, Homo sapiens
cttgctggccccagccctgctg

SEQ ID NO: 3293846 - DNA, 16 bp, Homo sapiens
cttgctggctctgaga

SEQ ID NO: 3293847 - DNA, 18 bp, Homo sapiens
cttgctggctctgagaat

SEQ ID NO: 3293848 - DNA, 19 bp, Homo sapiens
cttgctgtatgctgatcat

SEQ ID NO: 3293849 - DNA, 16 bp, Homo sapiens
cttgctgtcctgatct

SEQ ID NO: 3293850 - DNA, 17 bp, Homo sapiens
cttgctgtcctgatctg

SEQ ID NO: 3293851 - DNA, 18 bp, Homo sapiens
cttgctgtcctgatctgt

SEQ ID NO: 3293852 - DNA, 14 bp, Homo sapiens
cttgctgtctctgc

SEQ ID NO: 3293853 - DNA, 19 bp, Homo sapiens
cttgctgtttgtcctgaga

SEQ ID NO: 3293854 - DNA, 18 bp, Homo sapiens
cttgcttacaatctttat

SEQ ID NO: 3293855 - DNA, 16 bp, Homo sapiens
cttgcttattacattt

SEQ ID NO: 3293856 - DNA, 19 bp, Homo sapiens
cttgcttattacatttaaa

SEQ ID NO: 3293857 - DNA, 15 bp, Homo sapiens
cttgcttatttgaca

SEQ ID NO: 3293858 - DNA, 17 bp, Homo sapiens
cttgcttccctaatcta

SEQ ID NO: 3293859 - DNA, 19 bp, Homo sapiens
cttgcttctctagctctct

SEQ ID NO: 3293860 - DNA, 14 bp, Homo sapiens
cttgcttctttcta

SEQ ID NO: 3293861 - DNA, 19 bp, Homo sapiens
cttgcttctttctagaaag

SEQ ID NO: 3293862 - DNA, 14 bp, Homo sapiens
cttgcttgccaact

SEQ ID NO: 3293863 - DNA, 19 bp, Homo sapiens
cttgcttgccgagcctaat

SEQ ID NO: 3293864 - DNA, 15 bp, Homo sapiens
cttgcttggaagcca

SEQ ID NO: 3293865 - DNA, 17 bp, Homo sapiens
cttgcttggaagccagg

SEQ ID NO: 3293866 - DNA, 21 bp, Homo sapiens
cttgcttgttgggattcctga

SEQ ID NO: 3293867 - DNA, 22 bp, Homo sapiens
cttgcttgttgggattcctgac

SEQ ID NO: 3293868 - DNA, 13 bp, Homo sapiens
cttgctttcaatt

SEQ ID NO: 3293869 - DNA, 15 bp, Homo sapiens
cttgctttcaattga

SEQ ID NO: 3293870 - DNA, 15 bp, Homo sapiens
cttgctttcctgggc

SEQ ID NO: 3293871 - DNA, 16 bp, Homo sapiens
cttgctttcctgggcc

SEQ ID NO: 3293872 - DNA, 24 bp, Homo sapiens
cttgctttcggagctcctgtccaa

SEQ ID NO: 3293873 - DNA, 14 bp, Homo sapiens
cttgctttgattta

SEQ ID NO: 3293874 - DNA, 12 bp, Homo sapiens
cttgctttgggc

SEQ ID NO: 3293875 - DNA, 23 bp, Homo sapiens
cttgctttgggctttgcaggctc

SEQ ID NO: 3293876 - DNA, 20 bp, Homo sapiens
cttgctttgttttaataaac

SEQ ID NO: 3293877 - DNA, 15 bp, Homo sapiens
cttggaaaataagac

SEQ ID NO: 3293878 - DNA, 22 bp, Homo sapiens
cttggaaagcatcacctcaggc

SEQ ID NO: 3293879 - DNA, 20 bp, Homo sapiens
cttggaaattcctgtactgt

SEQ ID NO: 3293880 - DNA, 16 bp, Homo sapiens
cttggaaattccttgc

SEQ ID NO: 3293881 - DNA, 16 bp, Homo sapiens
cttggaacaccttggg

SEQ ID NO: 3293882 - DNA, 21 bp, Homo sapiens
cttggaagaaggaaacggaag

SEQ ID NO: 3293883 - DNA, 13 bp, Homo sapiens
cttggaagccagg

SEQ ID NO: 3293884 - DNA, 20 bp, Homo sapiens
cttggaagctccgctttcta

SEQ ID NO: 3293885 - DNA, 19 bp, Homo sapiens
cttggaagctgtttggaaa

SEQ ID NO: 3293886 - DNA, 20 bp, Homo sapiens
cttggaagctgtttggaaaa

SEQ ID NO: 3293887 - DNA, 16 bp, Homo sapiens
cttggaagtacatgaa

SEQ ID NO: 3293888 - DNA, 13 bp, Homo sapiens
cttggacacttgg

SEQ ID NO: 3293889 - DNA, 21 bp, Homo sapiens
cttggacaggagtcagtgtct

SEQ ID NO: 3293890 - DNA, 21 bp, Homo sapiens
cttggacatcctcctcccacc

SEQ ID NO: 3293891 - DNA, 22 bp, Homo sapiens
cttggacatcctcctcccaccc

SEQ ID NO: 3293892 - DNA, 14 bp, Homo sapiens
cttggacttcctgg

SEQ ID NO: 3293893 - DNA, 17 bp, Homo sapiens
cttggacttcctggggc

SEQ ID NO: 3293894 - DNA, 18 bp, Homo sapiens
cttggacttcctggggcc

SEQ ID NO: 3293895 - DNA, 19 bp, Homo sapiens
cttggacttcctggggccc

SEQ ID NO: 3293896 - DNA, 21 bp, Homo sapiens
cttggacttcctggggccccg

SEQ ID NO: 3293897 - DNA, 22 bp, Homo sapiens
cttggagagtcttgggcctggc

SEQ ID NO: 3293898 - DNA, 22 bp, Homo sapiens
cttggagccaatggagactgtc

SEQ ID NO: 3293899 - DNA, 15 bp, Homo sapiens
cttggagcccgtgca

SEQ ID NO: 3293900 - DNA, 16 bp, Homo sapiens
cttggaggagagagac

SEQ ID NO: 3293901 - DNA, 22 bp, Homo sapiens
cttggagtttttcattgtcgct

SEQ ID NO: 3293902 - DNA, 22 bp, Homo sapiens
cttggatcgctaagctggctct

SEQ ID NO: 3293903 - DNA, 18 bp, Homo sapiens
cttggcaaaagccttgtg

SEQ ID NO: 3293904 - DNA, 20 bp, Homo sapiens
cttggcaacagaagcagttg

SEQ ID NO: 3293905 - DNA, 17 bp, Homo sapiens
ctttccccttcccctcc

SEQ ID NO: 3293906 - DNA, 18 bp, Homo sapiens
ctttccccttcccctccc

SEQ ID NO: 3293907 - DNA, 13 bp, Homo sapiens
ctttccctgcctc

SEQ ID NO: 3293908 - DNA, 16 bp, Homo sapiens
ctttcccttttctgtt

SEQ ID NO: 3293909 - DNA, 20 bp, Homo sapiens
ctttccgctgtcgccccagg

SEQ ID NO: 3293910 - DNA, 21 bp, Homo sapiens
ctttccgctgtcgccccaggc

SEQ ID NO: 3293911 - DNA, 16 bp, Homo sapiens
ctttccggcacactgc

SEQ ID NO: 3293912 - DNA, 15 bp, Homo sapiens
ctttcctaaatgttt

SEQ ID NO: 3293913 - DNA, 19 bp, Homo sapiens
ctttcctccccctgcaact

SEQ ID NO: 3293914 - DNA, 23 bp, Homo sapiens
ctttcctcctaccttttgtctct

SEQ ID NO: 3293915 - DNA, 18 bp, Homo sapiens
ctttcctccttcactgtt

SEQ ID NO: 3293916 - DNA, 17 bp, Homo sapiens
ctttcctcctttatcac

SEQ ID NO: 3293917 - DNA, 10 bp, Homo sapiens
ctttcctgcc

SEQ ID NO: 3293918 - DNA, 14 bp, Homo sapiens
ctttcctgccccag

SEQ ID NO: 3293919 - DNA, 18 bp, Homo sapiens
ctttcctgccccaggcct

SEQ ID NO: 3293920 - DNA, 16 bp, Homo sapiens
ctttcctgttcagcat

SEQ ID NO: 3293921 - DNA, 17 bp, Homo sapiens
ctttcctgttcagcatt

SEQ ID NO: 3293922 - DNA, 17 bp, Homo sapiens
ctttcctgtttccaggg

SEQ ID NO: 3293923 - DNA, 20 bp, Homo sapiens
ctttcctgtttccagggtct

SEQ ID NO: 3293924 - DNA, 15 bp, Homo sapiens
ctttccttccatccc

SEQ ID NO: 3293925 - DNA, 15 bp, Homo sapiens
ctttccttggcttta

SEQ ID NO: 3293926 - DNA, 17 bp, Homo sapiens
ctttccttggctttatg

SEQ ID NO: 3293927 - DNA, 19 bp, Homo sapiens
ctttccttgtggcagagga

SEQ ID NO: 3293928 - DNA, 20 bp, Homo sapiens
ctttcctttccccagcccag

SEQ ID NO: 3293929 - DNA, 21 bp, Homo sapiens
ctttcctttttcccaataaat

SEQ ID NO: 3293930 - DNA, 19 bp, Homo sapiens
ctttcgatacccaggacca

SEQ ID NO: 3293931 - DNA, 15 bp, Homo sapiens
ctttcggagctcctg

SEQ ID NO: 3293932 - DNA, 14 bp, Homo sapiens
ctttcgggccatgt

SEQ ID NO: 3293933 - DNA, 20 bp, Homo sapiens
ctttcgggccatgttgcccc

SEQ ID NO: 3293934 - DNA, 14 bp, Homo sapiens
ctttcgtcaccctt

SEQ ID NO: 3293935 - DNA, 14 bp, Homo sapiens
ctttctaagaaatc

SEQ ID NO: 3293936 - DNA, 16 bp, Homo sapiens
ctttctaagaaatcaa

SEQ ID NO: 3293937 - DNA, 22 bp, Homo sapiens
ctttctaatcctatctggggag

SEQ ID NO: 3293938 - DNA, 20 bp, Homo sapiens
ctttctacatgactgggcct

SEQ ID NO: 3293939 - DNA, 22 bp, Homo sapiens
ctttctacatgactgggcctcc

SEQ ID NO: 3293940 - DNA, 15 bp, Homo sapiens
ctttctacccagcga

SEQ ID NO: 3293941 - DNA, 17 bp, Homo sapiens
ctttctacccagcgagc

SEQ ID NO: 3293942 - DNA, 22 bp, Homo sapiens
ctttctagaaagagaaacagtt

SEQ ID NO: 3293943 - DNA, 18 bp, Homo sapiens
ctttctagggacatgaaa

SEQ ID NO: 3293944 - DNA, 23 bp, Homo sapiens
ctttctagtggtctttgtaagag

SEQ ID NO: 3293945 - DNA, 13 bp, Homo sapiens
ctttctagttcaa

SEQ ID NO: 3293946 - DNA, 20 bp, Homo sapiens
ctttctagttcaatgcctca

SEQ ID NO: 3293947 - DNA, 24 bp, Homo sapiens
ctttctcagggggtcagcagagtt

SEQ ID NO: 3293948 - DNA, 15 bp, Homo sapiens
ctttctcagttttca

SEQ ID NO: 3293949 - DNA, 16 bp, Homo sapiens
ctttctcagttttcat

SEQ ID NO: 3293950 - DNA, 19 bp, Homo sapiens
ctttctccagccagcaatg

SEQ ID NO: 3293951 - DNA, 15 bp, Homo sapiens
ctttctccaggacca

SEQ ID NO: 3293952 - DNA, 19 bp, Homo sapiens
ctttctcccccgacactgc

SEQ ID NO: 3293953 - DNA, 23 bp, Homo sapiens
ctttctcccccgacactgctgca

SEQ ID NO: 3293954 - DNA, 20 bp, Homo sapiens
ctttctccccgctaaggaag

SEQ ID NO: 3293955 - DNA, 16 bp, Homo sapiens
ctttctcctgtgaatg

SEQ ID NO: 3293956 - DNA, 18 bp, Homo sapiens
ctttctcgattttatctt

SEQ ID NO: 3293957 - DNA, 16 bp, Homo sapiens
ctttctctcctttctt

SEQ ID NO: 3293958 - DNA, 20 bp, Homo sapiens
ctttctctctcctctctgct

SEQ ID NO: 3293959 - DNA, 17 bp, Homo sapiens
ctttctctctctctctt

SEQ ID NO: 3293960 - DNA, 13 bp, Homo sapiens
ctttctctcttcc

SEQ ID NO: 3293961 - DNA, 15 bp, Homo sapiens
ctttctctgtagttc

SEQ ID NO: 3293962 - DNA, 20 bp, Homo sapiens
ctttctgagcacactttagt

SEQ ID NO: 3293963 - DNA, 19 bp, Homo sapiens
ctttctgcagtttttcagg

SEQ ID NO: 3293964 - DNA, 14 bp, Homo sapiens
ctttctgcctggag

SEQ ID NO: 3293965 - DNA, 17 bp, Homo sapiens
ctttctgccttggcctc

SEQ ID NO: 3293966 - DNA, 23 bp, Homo sapiens
ctttctggactggcgttcacctc

SEQ ID NO: 3293967 - DNA, 14 bp, Homo sapiens
ctttctgggccaag

SEQ ID NO: 3293968 - DNA, 12 bp, Homo sapiens
ctttctgtgtgc

SEQ ID NO: 3293969 - DNA, 13 bp, Homo sapiens
ctttctgttccaa

SEQ ID NO: 3293970 - DNA, 14 bp, Homo sapiens
ctttctgttccaaa

SEQ ID NO: 3293971 - DNA, 16 bp, Homo sapiens
ctttctgttccaaatt

SEQ ID NO: 3293972 - DNA, 20 bp, Homo sapiens
ctttctgttccaaattcagt

SEQ ID NO: 3293973 - DNA, 16 bp, Homo sapiens
ctttctgttgccacaa

SEQ ID NO: 3293974 - DNA, 19 bp, Homo sapiens
ctttcttaattttgtcttt

SEQ ID NO: 3293975 - DNA, 21 bp, Homo sapiens
ctttcttataatactctgttg

SEQ ID NO: 3293976 - DNA, 11 bp, Homo sapiens
ctttcttcctc

SEQ ID NO: 3293977 - DNA, 14 bp, Homo sapiens
ctttcttcctctgc

SEQ ID NO: 3293978 - DNA, 15 bp, Homo sapiens
ctttcttcctctgct

SEQ ID NO: 3293979 - DNA, 13 bp, Homo sapiens
ctttcttcctttc

SEQ ID NO: 3293980 - DNA, 14 bp, Homo sapiens
ctttcttcctttct

SEQ ID NO: 3293981 - DNA, 15 bp, Homo sapiens
ctttcttcctttcta

SEQ ID NO: 3293982 - DNA, 13 bp, Homo sapiens
ctttcttctgccc

SEQ ID NO: 3293983 - DNA, 16 bp, Homo sapiens
ctttcttgctcccttc

SEQ ID NO: 3293984 - DNA, 17 bp, Homo sapiens
ctttcttgctcccttca

SEQ ID NO: 3293985 - DNA, 19 bp, Homo sapiens
ctttcttgctcccttcagc

SEQ ID NO: 3293986 - DNA, 17 bp, Homo sapiens
ctttctttacctgagac

SEQ ID NO: 3293987 - DNA, 15 bp, Homo sapiens
ctttctttccttaat

SEQ ID NO: 3293988 - DNA, 18 bp, Homo sapiens
ctttctttgcaccaaaga

SEQ ID NO: 3293989 - DNA, 20 bp, Homo sapiens
ctttctttgcacttaaaaat

SEQ ID NO: 3293990 - DNA, 22 bp, Homo sapiens
ctttcttttctggaatgtaatc

SEQ ID NO: 3293991 - DNA, 15 bp, Homo sapiens
ctttctttttcttct

SEQ ID NO: 3293992 - DNA, 16 bp, Homo sapiens
ctttctttttcttctt

SEQ ID NO: 3293993 - DNA, 16 bp, Homo sapiens
ctttctttttttcccc

SEQ ID NO: 3293994 - DNA, 19 bp, Homo sapiens
ctttctttttttccccccc

SEQ ID NO: 3293995 - DNA, 17 bp, Homo sapiens
ctttgaaacctgctctg

SEQ ID NO: 3293996 - DNA, 22 bp, Homo sapiens
ctttgaaactggaataagtgtt

SEQ ID NO: 3293997 - DNA, 13 bp, Homo sapiens
ctttgaaagaagc

SEQ ID NO: 3293998 - DNA, 15 bp, Homo sapiens
ctttgaaatacctca

SEQ ID NO: 3293999 - DNA, 18 bp, Homo sapiens
ctttgaaatacctcatgt

SEQ ID NO: 3294000 - DNA, 14 bp, Homo sapiens
ctttgaagcagttg

SEQ ID NO: 3294001 - DNA, 13 bp, Homo sapiens
ctttgaagcctca

SEQ ID NO: 3294002 - DNA, 19 bp, Homo sapiens
ctttgaagctgaaaatata

SEQ ID NO: 3294003 - DNA, 18 bp, Homo sapiens
ctttgaaggggcctcacc

SEQ ID NO: 3294004 - DNA, 18 bp, Homo sapiens
ctttgaataaaaatgcac

SEQ ID NO: 3294005 - DNA, 14 bp, Homo sapiens
ctttgacactctgc

SEQ ID NO: 3294006 - DNA, 21 bp, Homo sapiens
ctttgacctaaattatttact

SEQ ID NO: 3294007 - DNA, 21 bp, Homo sapiens
ctttgacgagtcaccttccag

SEQ ID NO: 3294008 - DNA, 17 bp, Homo sapiens
ctttgactcagaggctg

SEQ ID NO: 3294009 - DNA, 21 bp, Homo sapiens
ctttgactcttttgccattaa

SEQ ID NO: 3294010 - DNA, 12 bp, Homo sapiens
ctttgactgaaa

SEQ ID NO: 3294011 - DNA, 22 bp, Homo sapiens
ctttgacttcagctgcctgaaa

SEQ ID NO: 3294012 - DNA, 22 bp, Homo sapiens
ctttgacttcttgcttcagtca

SEQ ID NO: 3294013 - DNA, 17 bp, Homo sapiens
ctttgactttatctcct

SEQ ID NO: 3294014 - DNA, 22 bp, Homo sapiens
ctttgactttatctcctgctct

SEQ ID NO: 3294015 - DNA, 14 bp, Homo sapiens
ctttgactttttgc

SEQ ID NO: 3294016 - DNA, 16 bp, Homo sapiens
ctttgagacagtttct

SEQ ID NO: 3294017 - DNA, 20 bp, Homo sapiens
ctttgagatgtgttcctcct

SEQ ID NO: 3294018 - DNA, 21 bp, Homo sapiens
ctttgagatgtgttcctcctg

SEQ ID NO: 3294019 - DNA, 13 bp, Homo sapiens
ctttgagcatttt

SEQ ID NO: 3294020 - DNA, 15 bp, Homo sapiens
ctttgataatgttaa

SEQ ID NO: 3294021 - DNA, 16 bp, Homo sapiens
ctttgataatgttaaa

SEQ ID NO: 3294022 - DNA, 22 bp, Homo sapiens
ctttgatattttcaacgcagcc

SEQ ID NO: 3294023 - DNA, 15 bp, Homo sapiens
ctttgatcatcatgt

SEQ ID NO: 3294024 - DNA, 20 bp, Homo sapiens
ctttgatcgtatatttctca

SEQ ID NO: 3294025 - DNA, 14 bp, Homo sapiens
ctttgatgagcatt

SEQ ID NO: 3294026 - DNA, 21 bp, Homo sapiens
ctttgattcatagtaacttct

SEQ ID NO: 3294027 - DNA, 14 bp, Homo sapiens
ctttgatttagatt

SEQ ID NO: 3294028 - DNA, 12 bp, Homo sapiens
ctttgatttcca

SEQ ID NO: 3294029 - DNA, 19 bp, Homo sapiens
ctttgcaatagcagttata

SEQ ID NO: 3294030 - DNA, 18 bp, Homo sapiens
ctttgcacagctctccgg

SEQ ID NO: 3294031 - DNA, 18 bp, Homo sapiens
ctttgtttcgtggggagg

SEQ ID NO: 3294032 - DNA, 13 bp, Homo sapiens
ctttgtttcttgt

SEQ ID NO: 3294033 - DNA, 17 bp, Homo sapiens
ctttgtttcttgtttat

SEQ ID NO: 3294034 - DNA, 22 bp, Homo sapiens
ctttgtttctttttacagcatt

SEQ ID NO: 3294035 - DNA, 20 bp, Homo sapiens
ctttgtttggatgtaattta

SEQ ID NO: 3294036 - DNA, 21 bp, Homo sapiens
ctttgtttggatgtaatttag

SEQ ID NO: 3294037 - DNA, 17 bp, Homo sapiens
ctttgttttaataaaca

SEQ ID NO: 3294038 - DNA, 14 bp, Homo sapiens
ctttgttttctaaa

SEQ ID NO: 3294039 - DNA, 20 bp, Homo sapiens
ctttgttttctgactaatta

SEQ ID NO: 3294040 - DNA, 21 bp, Homo sapiens
cttttaaaaaatactctgcta

SEQ ID NO: 3294041 - DNA, 14 bp, Homo sapiens
cttttaaaaatgta

SEQ ID NO: 3294042 - DNA, 20 bp, Homo sapiens
cttttaaacctcacctttgt

SEQ ID NO: 3294043 - DNA, 20 bp, Homo sapiens
cttttaaagaaaaatatgat

SEQ ID NO: 3294044 - DNA, 13 bp, Homo sapiens
cttttaaatcatc

SEQ ID NO: 3294045 - DNA, 16 bp, Homo sapiens
cttttaaatgctctct

SEQ ID NO: 3294046 - DNA, 18 bp, Homo sapiens
cttttaacattttgttct

SEQ ID NO: 3294047 - DNA, 20 bp, Homo sapiens
cttttaacattttgttctta

SEQ ID NO: 3294048 - DNA, 21 bp, Homo sapiens
cttttaagacattttcatgct

SEQ ID NO: 3294049 - DNA, 22 bp, Homo sapiens
cttttaatccctatgtttgtct

SEQ ID NO: 3294050 - DNA, 14 bp, Homo sapiens
cttttaattttcct

SEQ ID NO: 3294051 - DNA, 12 bp, Homo sapiens
cttttaccatta

SEQ ID NO: 3294052 - DNA, 23 bp, Homo sapiens
cttttaccgttggggcccttaac

SEQ ID NO: 3294053 - DNA, 23 bp, Homo sapiens
cttttagaaatactgcaagaaaa

SEQ ID NO: 3294054 - DNA, 16 bp, Homo sapiens
cttttagacaactaga

SEQ ID NO: 3294055 - DNA, 20 bp, Homo sapiens
cttttaggaaaatcactttg

SEQ ID NO: 3294056 - DNA, 20 bp, Homo sapiens
cttttagggagagtcatatt

SEQ ID NO: 3294057 - DNA, 19 bp, Homo sapiens
cttttagtcacgtgtattt

SEQ ID NO: 3294058 - DNA, 18 bp, Homo sapiens
cttttagttcatatatac

SEQ ID NO: 3294059 - DNA, 18 bp, Homo sapiens
cttttagttgactcacag

SEQ ID NO: 3294060 - DNA, 19 bp, Homo sapiens
cttttagttgactcacagg

SEQ ID NO: 3294061 - DNA, 22 bp, Homo sapiens
cttttagttttagttgcagaaa

SEQ ID NO: 3294062 - DNA, 13 bp, Homo sapiens
cttttataaagca

SEQ ID NO: 3294063 - DNA, 17 bp, Homo sapiens
cttttatactctttctg

SEQ ID NO: 3294064 - DNA, 20 bp, Homo sapiens
cttttatactctttctgtat

SEQ ID NO: 3294065 - DNA, 17 bp, Homo sapiens
cttttatagactgattt

SEQ ID NO: 3294066 - DNA, 17 bp, Homo sapiens
cttttatagctattact

SEQ ID NO: 3294067 - DNA, 19 bp, Homo sapiens
cttttatagctattactgt

SEQ ID NO: 3294068 - DNA, 19 bp, Homo sapiens
cttttataggtgagaaaaa

SEQ ID NO: 3294069 - DNA, 15 bp, Homo sapiens
cttttatatggccca

SEQ ID NO: 3294070 - DNA, 14 bp, Homo sapiens
cttttatatttgta

SEQ ID NO: 3294071 - DNA, 16 bp, Homo sapiens
cttttatatttgtatc

SEQ ID NO: 3294072 - DNA, 16 bp, Homo sapiens
cttttatcaaaatccc

SEQ ID NO: 3294073 - DNA, 22 bp, Homo sapiens
cttttatcccaaagttgttgta

SEQ ID NO: 3294074 - DNA, 17 bp, Homo sapiens
cttttatctatttgaga

SEQ ID NO: 3294075 - DNA, 12 bp, Homo sapiens
cttttatggatg

SEQ ID NO: 3294076 - DNA, 13 bp, Homo sapiens
cttttatggatga

SEQ ID NO: 3294077 - DNA, 14 bp, Homo sapiens
cttttatgtagcac

SEQ ID NO: 3294078 - DNA, 15 bp, Homo sapiens
cttttatgtagtaat

SEQ ID NO: 3294079 - DNA, 22 bp, Homo sapiens
cttttattagccagtgaaacac

SEQ ID NO: 3294080 - DNA, 17 bp, Homo sapiens
cttttattcatttgagt

SEQ ID NO: 3294081 - DNA, 13 bp, Homo sapiens
cttttattgtata

SEQ ID NO: 3294082 - DNA, 21 bp, Homo sapiens
cttttattgtataaactatca

SEQ ID NO: 3294083 - DNA, 13 bp, Homo sapiens
cttttattgtcag

SEQ ID NO: 3294084 - DNA, 16 bp, Homo sapiens
cttttattttaatatt

SEQ ID NO: 3294085 - DNA, 19 bp, Homo sapiens
cttttattttgaaaagctt

SEQ ID NO: 3294086 - DNA, 21 bp, Homo sapiens
cttttattttttcttttgtaa

SEQ ID NO: 3294087 - DNA, 18 bp, Homo sapiens
cttttcaaacaagaatgt

SEQ ID NO: 3294088 - DNA, 21 bp, Homo sapiens
cttttcaaggaaaaatgctgc

SEQ ID NO: 3294089 - DNA, 15 bp, Homo sapiens
cttttcaatgacatt

SEQ ID NO: 3294090 - DNA, 21 bp, Homo sapiens
cttttcacatccatttcccct

SEQ ID NO: 3294091 - DNA, 21 bp, Homo sapiens
cttttcaccaaaatttctaca

SEQ ID NO: 3294092 - DNA, 16 bp, Homo sapiens
cttttcactgcctgta

SEQ ID NO: 3294093 - DNA, 12 bp, Homo sapiens
cttttcactgct

SEQ ID NO: 3294094 - DNA, 18 bp, Homo sapiens
cttttcactgctggctgc

SEQ ID NO: 3294095 - DNA, 21 bp, Homo sapiens
cttttcaggtttgtcatcaga

SEQ ID NO: 3294096 - DNA, 16 bp, Homo sapiens
cttttcatccttcccc

SEQ ID NO: 3294097 - DNA, 18 bp, Homo sapiens
cttttcatgcgtgtgtgt

SEQ ID NO: 3294098 - DNA, 15 bp, Homo sapiens
cttttcattgtgtat

SEQ ID NO: 3294099 - DNA, 19 bp, Homo sapiens
cttttccccaaccacagag

SEQ ID NO: 3294100 - DNA, 14 bp, Homo sapiens
cttttcccctgtcc

SEQ ID NO: 3294101 - DNA, 18 bp, Homo sapiens
cttttcccctgttaaaca

SEQ ID NO: 3294102 - DNA, 20 bp, Homo sapiens
cttttccctgcttccaggaa

SEQ ID NO: 3294103 - DNA, 15 bp, Homo sapiens
cttttcctcaagcaa

SEQ ID NO: 3294104 - DNA, 16 bp, Homo sapiens
cttttcctcaagcaat

SEQ ID NO: 3294105 - DNA, 23 bp, Homo sapiens
cttttcctcccttgggttctgat

SEQ ID NO: 3294106 - DNA, 18 bp, Homo sapiens
cttttcctctctcccgga

SEQ ID NO: 3294107 - DNA, 19 bp, Homo sapiens
cttttcctgataaagcaca

SEQ ID NO: 3294108 - DNA, 22 bp, Homo sapiens
cttttcctgggtttcctgcagg

SEQ ID NO: 3294109 - DNA, 22 bp, Homo sapiens
cttttcctgtcagtgtttttga

SEQ ID NO: 3294110 - DNA, 20 bp, Homo sapiens
cttttccttcccttttctgt

SEQ ID NO: 3294111 - DNA, 16 bp, Homo sapiens
cttttctaccctagcc

SEQ ID NO: 3294112 - DNA, 14 bp, Homo sapiens
cttttctcccatat

SEQ ID NO: 3294113 - DNA, 15 bp, Homo sapiens
cttttctcttctaca

SEQ ID NO: 3294114 - DNA, 17 bp, Homo sapiens
cttttctcttttgcttt

SEQ ID NO: 3294115 - DNA, 23 bp, Homo sapiens
cttttctgcatcatctgtagata

SEQ ID NO: 3294116 - DNA, 16 bp, Homo sapiens
cttttctgccactcca

SEQ ID NO: 3294117 - DNA, 17 bp, Homo sapiens
cttttctgccactccat

SEQ ID NO: 3294118 - DNA, 14 bp, Homo sapiens
cttttctgccctgg

SEQ ID NO: 3294119 - DNA, 17 bp, Homo sapiens
cttttctgccctggctg

SEQ ID NO: 3294120 - DNA, 18 bp, Homo sapiens
cttttctggaatgtaatc

SEQ ID NO: 3294121 - DNA, 21 bp, Homo sapiens
cttttctgtagatgttgtctt

SEQ ID NO: 3294122 - DNA, 16 bp, Homo sapiens
cttttctgttctagtt

SEQ ID NO: 3294123 - DNA, 15 bp, Homo sapiens
cttttctgtttagga

SEQ ID NO: 3294124 - DNA, 16 bp, Homo sapiens
cttttctgtttaggaa

SEQ ID NO: 3294125 - DNA, 13 bp, Homo sapiens
cttttcttaacaa

SEQ ID NO: 3294126 - DNA, 11 bp, Homo sapiens
cttttcttatt

SEQ ID NO: 3294127 - DNA, 17 bp, Homo sapiens
cttttcttatttttgta

SEQ ID NO: 3294128 - DNA, 12 bp, Homo sapiens
cttttcttcaaa

SEQ ID NO: 3294129 - DNA, 11 bp, Homo sapiens
cttttcttggc

SEQ ID NO: 3294130 - DNA, 22 bp, Homo sapiens
cttttcttggcaaaagccttgt

SEQ ID NO: 3294131 - DNA, 15 bp, Homo sapiens
cttttctttaacttt

SEQ ID NO: 3294132 - DNA, 22 bp, Homo sapiens
cttttctttagagcattgccat

SEQ ID NO: 3294133 - DNA, 13 bp, Homo sapiens
cttttcttttgtt

SEQ ID NO: 3294134 - DNA, 19 bp, Homo sapiens
cttttcttttgttactgtt

SEQ ID NO: 3294135 - DNA, 14 bp, Homo sapiens
cttttctttttctc

SEQ ID NO: 3294136 - DNA, 22 bp, Homo sapiens
cttttgaactggcaattgtcta

SEQ ID NO: 3294137 - DNA, 22 bp, Homo sapiens
cttttgaagtagtttgtataac

SEQ ID NO: 3294138 - DNA, 17 bp, Homo sapiens
cttttgacactgctcta

SEQ ID NO: 3294139 - DNA, 19 bp, Homo sapiens
cttttgactccttttggaa

SEQ ID NO: 3294140 - DNA, 16 bp, Homo sapiens
cttttgaggcttctcc

SEQ ID NO: 3294141 - DNA, 17 bp, Homo sapiens
cttttgaggcttctgtt

SEQ ID NO: 3294142 - DNA, 12 bp, Homo sapiens
cttttgcaaaat

SEQ ID NO: 3294143 - DNA, 22 bp, Homo sapiens
cttttgcataagattaaaggaa

SEQ ID NO: 3294144 - DNA, 20 bp, Homo sapiens
cttttgcataatgcaatcaa

SEQ ID NO: 3294145 - DNA, 21 bp, Homo sapiens
cttttgcataatgcaatcaaa

SEQ ID NO: 3294146 - DNA, 22 bp, Homo sapiens
cttttgcataatgcaatcaaaa

SEQ ID NO: 3294147 - DNA, 20 bp, Homo sapiens
cttttgcccttcacagtgtt

SEQ ID NO: 3294148 - DNA, 21 bp, Homo sapiens
cttttgcccttcacagtgttt

SEQ ID NO: 3294149 - DNA, 14 bp, Homo sapiens
cttttgcctggctg

SEQ ID NO: 3294150 - DNA, 15 bp, Homo sapiens
cttttgctactaagt

SEQ ID NO: 3294151 - DNA, 21 bp, Homo sapiens
cttttgctgcgcaccaatgcc

SEQ ID NO: 3294152 - DNA, 14 bp, Homo sapiens
cttttgctttattc

SEQ ID NO: 3294153 - DNA, 11 bp, Homo sapiens
cttttgctttt

SEQ ID NO: 3294154 - DNA, 17 bp, Homo sapiens
cttttgcttttggcaaa

SEQ ID NO: 3294155 - DNA, 20 bp, Homo sapiens
cttttggaacatttctttct

SEQ ID NO: 3294156 - DNA, 22 bp, Homo sapiens
gaaacacgaaacttgttattgt

SEQ ID NO: 3294157 - DNA, 13 bp, Homo sapiens
gaaacactcttat

SEQ ID NO: 3294158 - DNA, 17 bp, Homo sapiens
gaaacactgactcctgt

SEQ ID NO: 3294159 - DNA, 14 bp, Homo sapiens
gaaacacttgcttg

SEQ ID NO: 3294160 - DNA, 14 bp, Homo sapiens
gaaacactttctct

SEQ ID NO: 3294161 - DNA, 18 bp, Homo sapiens
gaaacactttgcctcctg

SEQ ID NO: 3294162 - DNA, 20 bp, Homo sapiens
gaaacactttgcctcctgtg

SEQ ID NO: 3294163 - DNA, 12 bp, Homo sapiens
gaaacagaaaaa

SEQ ID NO: 3294164 - DNA, 13 bp, Homo sapiens
gaaacagaaaaat

SEQ ID NO: 3294165 - DNA, 17 bp, Homo sapiens
gaaacagagtggcctcc

SEQ ID NO: 3294166 - DNA, 20 bp, Homo sapiens
gaaacagagtggcctccctg

SEQ ID NO: 3294167 - DNA, 20 bp, Homo sapiens
gaaacagattcaggccagcc

SEQ ID NO: 3294168 - DNA, 21 bp, Homo sapiens
gaaacagattcaggccagccc

SEQ ID NO: 3294169 - DNA, 12 bp, Homo sapiens
gaaacagcatga

SEQ ID NO: 3294170 - DNA, 13 bp, Homo sapiens
gaaacagcatgaa

SEQ ID NO: 3294171 - DNA, 15 bp, Homo sapiens
gaaacagcatgaata

SEQ ID NO: 3294172 - DNA, 12 bp, Homo sapiens
gaaacagccagc

SEQ ID NO: 3294173 - DNA, 22 bp, Homo sapiens
gaaacagccattgcggccccag

SEQ ID NO: 3294174 - DNA, 16 bp, Homo sapiens
gaaacagctcagccag

SEQ ID NO: 3294175 - DNA, 17 bp, Homo sapiens
gaaacagctcagccagt

SEQ ID NO: 3294176 - DNA, 22 bp, Homo sapiens
gaaacaggaccacaaaaatgaa

SEQ ID NO: 3294177 - DNA, 18 bp, Homo sapiens
gaaacagtgggagccctg

SEQ ID NO: 3294178 - DNA, 12 bp, Homo sapiens
gaaacagttcca

SEQ ID NO: 3294179 - DNA, 20 bp, Homo sapiens
gaaacagttggtaacttttg

SEQ ID NO: 3294180 - DNA, 17 bp, Homo sapiens
gaaacattacagttcat

SEQ ID NO: 3294181 - DNA, 17 bp, Homo sapiens
gaaaccacagtttcatt

SEQ ID NO: 3294182 - DNA, 20 bp, Homo sapiens
gaaacccaaagccctggtaa

SEQ ID NO: 3294183 - DNA, 17 bp, Homo sapiens
gaaacccaagctcctcc

SEQ ID NO: 3294184 - DNA, 15 bp, Homo sapiens
gaaacccacagtttt

SEQ ID NO: 3294185 - DNA, 18 bp, Homo sapiens
gaaacccacagttttagt

SEQ ID NO: 3294186 - DNA, 18 bp, Homo sapiens
gaaacccggcttcctgtg

SEQ ID NO: 3294187 - DNA, 23 bp, Homo sapiens
gaaaccctatggagaatttatcc

SEQ ID NO: 3294188 - DNA, 21 bp, Homo sapiens
gaaaccgggagaaggcatgag

SEQ ID NO: 3294189 - DNA, 17 bp, Homo sapiens
gaaacctacaagatttc

SEQ ID NO: 3294190 - DNA, 18 bp, Homo sapiens
gaaacctacaagatttcc

SEQ ID NO: 3294191 - DNA, 18 bp, Homo sapiens
gaaacctgaaaaaaagtt

SEQ ID NO: 3294192 - DNA, 19 bp, Homo sapiens
gaaacctgctctgtaggag

SEQ ID NO: 3294193 - DNA, 17 bp, Homo sapiens
gaaaccttattgtacct

SEQ ID NO: 3294194 - DNA, 18 bp, Homo sapiens
gaaacctttagggcagct

SEQ ID NO: 3294195 - DNA, 19 bp, Homo sapiens
gaaacctttagggcagctt

SEQ ID NO: 3294196 - DNA, 18 bp, Homo sapiens
gaaaccttttttaagatt

SEQ ID NO: 3294197 - DNA, 21 bp, Homo sapiens
gaaaccttttttaagattttt

SEQ ID NO: 3294198 - DNA, 22 bp, Homo sapiens
gaaacgccccgggcaaagggtc

SEQ ID NO: 3294199 - DNA, 20 bp, Homo sapiens
gaaacgctacctctctgtcc

SEQ ID NO: 3294200 - DNA, 13 bp, Homo sapiens
gaaacggacagct

SEQ ID NO: 3294201 - DNA, 19 bp, Homo sapiens
gaaacgtgttaaaggtttt

SEQ ID NO: 3294202 - DNA, 15 bp, Homo sapiens
gaaactaaaaatata

SEQ ID NO: 3294203 - DNA, 12 bp, Homo sapiens
gaaactaacaga

SEQ ID NO: 3294204 - DNA, 17 bp, Homo sapiens
gaaactaagattctttt

SEQ ID NO: 3294205 - DNA, 20 bp, Homo sapiens
gaaactatgtgtttttctca

SEQ ID NO: 3294206 - DNA, 19 bp, Homo sapiens
gaaactcaaaaccatctct

SEQ ID NO: 3294207 - DNA, 20 bp, Homo sapiens
gaaactcaaaaccatctctc

SEQ ID NO: 3294208 - DNA, 21 bp, Homo sapiens
gaaactcacactcccctaggg

SEQ ID NO: 3294209 - DNA, 16 bp, Homo sapiens
gaaactccacatctgc

SEQ ID NO: 3294210 - DNA, 19 bp, Homo sapiens
gaaactccacatctgcctt

SEQ ID NO: 3294211 - DNA, 19 bp, Homo sapiens
gaaactccgaagaaaagaa

SEQ ID NO: 3294212 - DNA, 22 bp, Homo sapiens
gaaactcctgattttgtagtta

SEQ ID NO: 3294213 - DNA, 16 bp, Homo sapiens
gaaactctacatttaa

SEQ ID NO: 3294214 - DNA, 23 bp, Homo sapiens
gaaactcttatctcagtcatgca

SEQ ID NO: 3294215 - DNA, 16 bp, Homo sapiens
gaaactgaaagtgttt

SEQ ID NO: 3294216 - DNA, 18 bp, Homo sapiens
gaaactgaaagtgtttta

SEQ ID NO: 3294217 - DNA, 13 bp, Homo sapiens
gaaactgatgcca

SEQ ID NO: 3294218 - DNA, 17 bp, Homo sapiens
gaaactgatgccaaggg

SEQ ID NO: 3294219 - DNA, 15 bp, Homo sapiens
gaaactgatttcttc

SEQ ID NO: 3294220 - DNA, 20 bp, Homo sapiens
gaaactggattaaaacaatt

SEQ ID NO: 3294221 - DNA, 17 bp, Homo sapiens
gaaactggcactgaatt

SEQ ID NO: 3294222 - DNA, 15 bp, Homo sapiens
gaaactggccccgga

SEQ ID NO: 3294223 - DNA, 16 bp, Homo sapiens
gaaacttagaggaaaa

SEQ ID NO: 3294224 - DNA, 23 bp, Homo sapiens
gaaacttatagttaatattttgt

SEQ ID NO: 3294225 - DNA, 19 bp, Homo sapiens
gaaacttcagttgatcttc

SEQ ID NO: 3294226 - DNA, 21 bp, Homo sapiens
gaaacttcagttgatcttctt

SEQ ID NO: 3294227 - DNA, 13 bp, Homo sapiens
gaaacttgttatt

SEQ ID NO: 3294228 - DNA, 16 bp, Homo sapiens
gaaacttgttattgtg

SEQ ID NO: 3294229 - DNA, 19 bp, Homo sapiens
gaaacttgttattgtgaat

SEQ ID NO: 3294230 - DNA, 13 bp, Homo sapiens
gaaactttgtgct

SEQ ID NO: 3294231 - DNA, 19 bp, Homo sapiens
gaaacttttaactgagaaa

SEQ ID NO: 3294232 - DNA, 15 bp, Homo sapiens
gaaacttttgtaaag

SEQ ID NO: 3294233 - DNA, 23 bp, Homo sapiens
gaaacttttgtaaagaaatttac

SEQ ID NO: 3294234 - DNA, 24 bp, Homo sapiens
gaaagaaaaataccatgtctctaa

SEQ ID NO: 3294235 - DNA, 21 bp, Homo sapiens
gaaagaaaagaccctgagact

SEQ ID NO: 3294236 - DNA, 21 bp, Homo sapiens
gaaagaaagggaaaagggaga

SEQ ID NO: 3294237 - DNA, 23 bp, Homo sapiens
gaaagaacatggacttgtatatt

SEQ ID NO: 3294238 - DNA, 16 bp, Homo sapiens
gaaagaagcaagacac

SEQ ID NO: 3294239 - DNA, 14 bp, Homo sapiens
gaaagaagggggcc

SEQ ID NO: 3294240 - DNA, 17 bp, Homo sapiens
gaaagaagggggccctg

SEQ ID NO: 3294241 - DNA, 18 bp, Homo sapiens
gaaagaatatatttattt

SEQ ID NO: 3294242 - DNA, 18 bp, Homo sapiens
gaaagactatctaaatgt

SEQ ID NO: 3294243 - DNA, 18 bp, Homo sapiens
gaaagagaaacagttggt

SEQ ID NO: 3294244 - DNA, 10 bp, Homo sapiens
gaaagagacc

SEQ ID NO: 3294245 - DNA, 20 bp, Homo sapiens
gaaagagagaagccagccac

SEQ ID NO: 3294246 - DNA, 16 bp, Homo sapiens
gaaagagatacagagg

SEQ ID NO: 3294247 - DNA, 20 bp, Homo sapiens
gaaagagattagaacattta

SEQ ID NO: 3294248 - DNA, 19 bp, Homo sapiens
gaaagagctgcctggatga

SEQ ID NO: 3294249 - DNA, 19 bp, Homo sapiens
gaaagaggagtattttgtc

SEQ ID NO: 3294250 - DNA, 21 bp, Homo sapiens
gaaagaggctgaggcctggac

SEQ ID NO: 3294251 - DNA, 20 bp, Homo sapiens
gaaagaggtctccccatccc

SEQ ID NO: 3294252 - DNA, 22 bp, Homo sapiens
gaaagaggtctccccatcccca

SEQ ID NO: 3294253 - DNA, 16 bp, Homo sapiens
gaaagaggtgaaaatg

SEQ ID NO: 3294254 - DNA, 18 bp, Homo sapiens
gaaagaggttaggagtag

SEQ ID NO: 3294255 - DNA, 17 bp, Homo sapiens
gaaagagttaagaatgt

SEQ ID NO: 3294256 - DNA, 16 bp, Homo sapiens
gaaagatggataaact

SEQ ID NO: 3294257 - DNA, 17 bp, Homo sapiens
gaaagattttattgtat

SEQ ID NO: 3294258 - DNA, 19 bp, Homo sapiens
gaaagattttattgtataa

SEQ ID NO: 3294259 - DNA, 15 bp, Homo sapiens
gaaagcactttttgg

SEQ ID NO: 3294260 - DNA, 22 bp, Homo sapiens
gaaagcagagttttcattaaat

SEQ ID NO: 3294261 - DNA, 12 bp, Homo sapiens
gaaagcaggggc

SEQ ID NO: 3294262 - DNA, 13 bp, Homo sapiens
gaaagcaggggct

SEQ ID NO: 3294263 - DNA, 19 bp, Homo sapiens
gaaagcaggggctacaaga

SEQ ID NO: 3294264 - DNA, 23 bp, Homo sapiens
gaaagcaggggctacaagaggga

SEQ ID NO: 3294265 - DNA, 16 bp, Homo sapiens
gaaagcatcacctcag

SEQ ID NO: 3294266 - DNA, 17 bp, Homo sapiens
gaaagcatccatgtgtg

SEQ ID NO: 3294267 - DNA, 11 bp, Homo sapiens
gaaagccaggc

SEQ ID NO: 3294268 - DNA, 23 bp, Homo sapiens
gaaagccaggcaggtagccaggg

SEQ ID NO: 3294269 - DNA, 13 bp, Homo sapiens
gaaagcccaaggt

SEQ ID NO: 3294270 - DNA, 19 bp, Homo sapiens
gaaagcccaaggtgctgat

SEQ ID NO: 3294271 - DNA, 18 bp, Homo sapiens
gaaagcccagactttagt

SEQ ID NO: 3294272 - DNA, 15 bp, Homo sapiens
gaaagcctctgctgc

SEQ ID NO: 3294273 - DNA, 16 bp, Homo sapiens
gaaagcctctgctgcc

SEQ ID NO: 3294274 - DNA, 15 bp, Homo sapiens
gaaagccttaaaaat

SEQ ID NO: 3294275 - DNA, 12 bp, Homo sapiens
gaaagctctaga

SEQ ID NO: 3294276 - DNA, 24 bp, Homo sapiens
gaaagctgtgaacaggctgggctg

SEQ ID NO: 3294277 - DNA, 12 bp, Homo sapiens
gaaaggaaaaga

SEQ ID NO: 3294278 - DNA, 18 bp, Homo sapiens
gaaaggaagctccactgt

SEQ ID NO: 3294279 - DNA, 22 bp, Homo sapiens
gaaaggaagctccactgtcacc

SEQ ID NO: 3294280 - DNA, 12 bp, Homo sapiens
gaaaggagatgt

SEQ ID NO: 3294281 - DNA, 17 bp, Homo sapiens
gaactccttattttgta

SEQ ID NO: 3294282 - DNA, 20 bp, Homo sapiens
gaactccttggcctagccca

SEQ ID NO: 3294283 - DNA, 17 bp, Homo sapiens
gaactcgcgctcagtaa

SEQ ID NO: 3294284 - DNA, 18 bp, Homo sapiens
gaactcgcgctcagtaaa

SEQ ID NO: 3294285 - DNA, 19 bp, Homo sapiens
gaactctatctgggcctgg

SEQ ID NO: 3294286 - DNA, 20 bp, Homo sapiens
gaactctatctgggcctggg

SEQ ID NO: 3294287 - DNA, 15 bp, Homo sapiens
gaactctgacaaggg

SEQ ID NO: 3294288 - DNA, 19 bp, Homo sapiens
gaactctgacaagggctga

SEQ ID NO: 3294289 - DNA, 22 bp, Homo sapiens
gaactctggacccctgggcctc

SEQ ID NO: 3294290 - DNA, 13 bp, Homo sapiens
gaactcttaatca

SEQ ID NO: 3294291 - DNA, 20 bp, Homo sapiens
gaactcttaatcaaatagca

SEQ ID NO: 3294292 - DNA, 15 bp, Homo sapiens
gaactcttagaaatg

SEQ ID NO: 3294293 - DNA, 18 bp, Homo sapiens
gaactcttagaaatgaag

SEQ ID NO: 3294294 - DNA, 23 bp, Homo sapiens
gaactcttcagaacacacagact

SEQ ID NO: 3294295 - DNA, 13 bp, Homo sapiens
gaactgaaataaa

SEQ ID NO: 3294296 - DNA, 16 bp, Homo sapiens
gaactgaaataaaaaa

SEQ ID NO: 3294297 - DNA, 22 bp, Homo sapiens
gaactgaacaccattgaaggct

SEQ ID NO: 3294298 - DNA, 18 bp, Homo sapiens
gaactgaattttgggact

SEQ ID NO: 3294299 - DNA, 17 bp, Homo sapiens
gaactgaccccctcccc

SEQ ID NO: 3294300 - DNA, 17 bp, Homo sapiens
gaactgagctgggcagg

SEQ ID NO: 3294301 - DNA, 11 bp, Homo sapiens
gaactgaggag

SEQ ID NO: 3294302 - DNA, 22 bp, Homo sapiens
gaactgaggagatgaccaggga

SEQ ID NO: 3294303 - DNA, 23 bp, Homo sapiens
gaactgaggagatgaccagggat

SEQ ID NO: 3294304 - DNA, 13 bp, Homo sapiens
gaactgagtcacg

SEQ ID NO: 3294305 - DNA, 17 bp, Homo sapiens
gaactgcaggccctggc

SEQ ID NO: 3294306 - DNA, 18 bp, Homo sapiens
gaactgcaggccctggcc

SEQ ID NO: 3294307 - DNA, 15 bp, Homo sapiens
gaactgcatggacct

SEQ ID NO: 3294308 - DNA, 22 bp, Homo sapiens
gaactgcatggacctaacattc

SEQ ID NO: 3294309 - DNA, 18 bp, Homo sapiens
gaactgccattattttct

SEQ ID NO: 3294310 - DNA, 19 bp, Homo sapiens
gaactgccattattttctg

SEQ ID NO: 3294311 - DNA, 19 bp, Homo sapiens
gaactgctggagtctggct

SEQ ID NO: 3294312 - DNA, 15 bp, Homo sapiens
gaactgcttcatgtg

SEQ ID NO: 3294313 - DNA, 15 bp, Homo sapiens
gaactgctttcaagt

SEQ ID NO: 3294314 - DNA, 21 bp, Homo sapiens
gaactgcttttcctcaagcaa

SEQ ID NO: 3294315 - DNA, 23 bp, Homo sapiens
gaactgcttttcctcaagcaata

SEQ ID NO: 3294316 - DNA, 14 bp, Homo sapiens
gaactggaagaaag

SEQ ID NO: 3294317 - DNA, 11 bp, Homo sapiens
gaactggctgc

SEQ ID NO: 3294318 - DNA, 12 bp, Homo sapiens
gaactggctgca

SEQ ID NO: 3294319 - DNA, 22 bp, Homo sapiens
gaactggctgtgaagacccagg

SEQ ID NO: 3294320 - DNA, 15 bp, Homo sapiens
gaactgggctgggcc

SEQ ID NO: 3294321 - DNA, 21 bp, Homo sapiens
gaactggggctttgccttgca

SEQ ID NO: 3294322 - DNA, 22 bp, Homo sapiens
gaactggggctttgccttgcag

SEQ ID NO: 3294323 - DNA, 22 bp, Homo sapiens
gaactgggtacttgtggacaca

SEQ ID NO: 3294324 - DNA, 15 bp, Homo sapiens
gaactgtccagagag

SEQ ID NO: 3294325 - DNA, 16 bp, Homo sapiens
gaactgtccagagagc

SEQ ID NO: 3294326 - DNA, 17 bp, Homo sapiens
gaactgtccagagagca

SEQ ID NO: 3294327 - DNA, 18 bp, Homo sapiens
gaactgtccagagagcaa

SEQ ID NO: 3294328 - DNA, 19 bp, Homo sapiens
gaactgtgcatagtgctgg

SEQ ID NO: 3294329 - DNA, 14 bp, Homo sapiens
gaactgtgcctagt

SEQ ID NO: 3294330 - DNA, 17 bp, Homo sapiens
gaacttacacttggagc

SEQ ID NO: 3294331 - DNA, 19 bp, Homo sapiens
gaacttacacttggagccc

SEQ ID NO: 3294332 - DNA, 21 bp, Homo sapiens
gaacttacacttggagcccgt

SEQ ID NO: 3294333 - DNA, 23 bp, Homo sapiens
gaacttacacttggagcccgtgc

SEQ ID NO: 3294334 - DNA, 13 bp, Homo sapiens
gaacttctaatat

SEQ ID NO: 3294335 - DNA, 17 bp, Homo sapiens
gaacttctctcagactt

SEQ ID NO: 3294336 - DNA, 13 bp, Homo sapiens
gaacttgatttgc

SEQ ID NO: 3294337 - DNA, 16 bp, Homo sapiens
gaacttgatttgcatg

SEQ ID NO: 3294338 - DNA, 24 bp, Homo sapiens
gaacttgcgagaaattcgtgtgtt

SEQ ID NO: 3294339 - DNA, 22 bp, Homo sapiens
gaacttgctgctgagtgcacca

SEQ ID NO: 3294340 - DNA, 14 bp, Homo sapiens
gaactttttgtagg

SEQ ID NO: 3294341 - DNA, 19 bp, Homo sapiens
gaacttttttaaataaact

SEQ ID NO: 3294342 - DNA, 20 bp, Homo sapiens
gaacttttttaaataaactt

SEQ ID NO: 3294343 - DNA, 22 bp, Homo sapiens
gaagaaaactatcctgcgggtt

SEQ ID NO: 3294344 - DNA, 13 bp, Homo sapiens
gaagaaaagcact

SEQ ID NO: 3294345 - DNA, 19 bp, Homo sapiens
gaagaaacacgtggtcatg

SEQ ID NO: 3294346 - DNA, 17 bp, Homo sapiens
gaagaaacactttctct

SEQ ID NO: 3294347 - DNA, 12 bp, Homo sapiens
gaagaaagatgt

SEQ ID NO: 3294348 - DNA, 13 bp, Homo sapiens
gaagaacacagca

SEQ ID NO: 3294349 - DNA, 16 bp, Homo sapiens
gaagaacacagcatgt

SEQ ID NO: 3294350 - DNA, 16 bp, Homo sapiens
gaagaacttgcatgga

SEQ ID NO: 3294351 - DNA, 14 bp, Homo sapiens
gaagaagagatgca

SEQ ID NO: 3294352 - DNA, 21 bp, Homo sapiens
gaagaaggaagctgtgttgaa

SEQ ID NO: 3294353 - DNA, 17 bp, Homo sapiens
gaagaagggagaagaaa

SEQ ID NO: 3294354 - DNA, 19 bp, Homo sapiens
gaagaagggagaagaaagg

SEQ ID NO: 3294355 - DNA, 13 bp, Homo sapiens
gaagaatagaggt

SEQ ID NO: 3294356 - DNA, 17 bp, Homo sapiens
gaagaatattcaggact

SEQ ID NO: 3294357 - DNA, 21 bp, Homo sapiens
gaagaatatttaagaaaagca

SEQ ID NO: 3294358 - DNA, 12 bp, Homo sapiens
gaagaatgaaag

SEQ ID NO: 3294359 - DNA, 13 bp, Homo sapiens
gaagaatttgtta

SEQ ID NO: 3294360 - DNA, 20 bp, Homo sapiens
gaagacaaaaagacaaacat

SEQ ID NO: 3294361 - DNA, 21 bp, Homo sapiens
gaagacaccagagcagatgca

SEQ ID NO: 3294362 - DNA, 21 bp, Homo sapiens
gaagacactgatgggcaaccc

SEQ ID NO: 3294363 - DNA, 16 bp, Homo sapiens
gaagacactgcagtga

SEQ ID NO: 3294364 - DNA, 23 bp, Homo sapiens
gaagacactgcagtgaccactta

SEQ ID NO: 3294365 - DNA, 20 bp, Homo sapiens
gaagacatggagactcctgc

SEQ ID NO: 3294366 - DNA, 19 bp, Homo sapiens
gaagacattaagcagcctt

SEQ ID NO: 3294367 - DNA, 18 bp, Homo sapiens
gaagaccaaaggaaggaa

SEQ ID NO: 3294368 - DNA, 20 bp, Homo sapiens
gaagaccagctttgcagtga

SEQ ID NO: 3294369 - DNA, 15 bp, Homo sapiens
gaagacccacgtgct

SEQ ID NO: 3294370 - DNA, 23 bp, Homo sapiens
gaagaccctcttgcccatcctga

SEQ ID NO: 3294371 - DNA, 16 bp, Homo sapiens
gaagactggaagctaa

SEQ ID NO: 3294372 - DNA, 12 bp, Homo sapiens
gaagagaaacca

SEQ ID NO: 3294373 - DNA, 12 bp, Homo sapiens
gaagagagagcc

SEQ ID NO: 3294374 - DNA, 20 bp, Homo sapiens
gaagagagttccgggaaaca

SEQ ID NO: 3294375 - DNA, 17 bp, Homo sapiens
gaagagcaaaaatatcc

SEQ ID NO: 3294376 - DNA, 18 bp, Homo sapiens
gaagagcaggactccagg

SEQ ID NO: 3294377 - DNA, 22 bp, Homo sapiens
gaagagcaggactccaggccca

SEQ ID NO: 3294378 - DNA, 15 bp, Homo sapiens
gaagagcaggcacat

SEQ ID NO: 3294379 - DNA, 15 bp, Homo sapiens
gaagagccctggaca

SEQ ID NO: 3294380 - DNA, 16 bp, Homo sapiens
gaagagccgagcacct

SEQ ID NO: 3294381 - DNA, 16 bp, Homo sapiens
gaagagcttgctttga

SEQ ID NO: 3294382 - DNA, 20 bp, Homo sapiens
gaagagcttgctttgattta

SEQ ID NO: 3294383 - DNA, 14 bp, Homo sapiens
gaagaggaacagtg

SEQ ID NO: 3294384 - DNA, 17 bp, Homo sapiens
gaagaggcatcctgcct

SEQ ID NO: 3294385 - DNA, 16 bp, Homo sapiens
gaagaggcttctcctg

SEQ ID NO: 3294386 - DNA, 21 bp, Homo sapiens
gaagagggaatggatggggag

SEQ ID NO: 3294387 - DNA, 22 bp, Homo sapiens
gaagagggaatggatggggaga

SEQ ID NO: 3294388 - DNA, 18 bp, Homo sapiens
gaagagggcccagcccag

SEQ ID NO: 3294389 - DNA, 13 bp, Homo sapiens
gaagagggcctgt

SEQ ID NO: 3294390 - DNA, 15 bp, Homo sapiens
gaagaggggcagccc

SEQ ID NO: 3294391 - DNA, 16 bp, Homo sapiens
gaagaggggcagcttt

SEQ ID NO: 3294392 - DNA, 20 bp, Homo sapiens
gaagagggtgaaaggcaggg

SEQ ID NO: 3294393 - DNA, 22 bp, Homo sapiens
gaagagttccaagttgaaggga

SEQ ID NO: 3294394 - DNA, 20 bp, Homo sapiens
gaagagttcccttgaaactt

SEQ ID NO: 3294395 - DNA, 21 bp, Homo sapiens
gaagagttcccttgaaacttt

SEQ ID NO: 3294396 - DNA, 14 bp, Homo sapiens
gaagagttgaggaa

SEQ ID NO: 3294397 - DNA, 15 bp, Homo sapiens
gaagagttttagaga

SEQ ID NO: 3294398 - DNA, 13 bp, Homo sapiens
gaagataattgtt

SEQ ID NO: 3294399 - DNA, 15 bp, Homo sapiens
gaagataatttgcat

SEQ ID NO: 3294400 - DNA, 13 bp, Homo sapiens
gaagataggctct

SEQ ID NO: 3294401 - DNA, 18 bp, Homo sapiens
gaagataggctctgcaca

SEQ ID NO: 3294402 - DNA, 20 bp, Homo sapiens
gaagataggctctgcacaga

SEQ ID NO: 3294403 - DNA, 17 bp, Homo sapiens
gaagatatatttcactt

SEQ ID NO: 3294404 - DNA, 16 bp, Homo sapiens
gaagatcacgctcccc

SEQ ID NO: 3294405 - DNA, 18 bp, Homo sapiens
gaagatcacgctccccgc

SEQ ID NO: 3294406 - DNA, 14 bp, Homo sapiens
gaagatcagaacat

SEQ ID NO: 3294407 - DNA, 20 bp, Homo sapiens
gaatgtgggcactggcccag

SEQ ID NO: 3294408 - DNA, 14 bp, Homo sapiens
gaatgttccctgca

SEQ ID NO: 3294409 - DNA, 20 bp, Homo sapiens
gaatgttccctgcaccctgg

SEQ ID NO: 3294410 - DNA, 20 bp, Homo sapiens
gaatgttggtttactttcaa

SEQ ID NO: 3294411 - DNA, 14 bp, Homo sapiens
gaatgtttattcct

SEQ ID NO: 3294412 - DNA, 16 bp, Homo sapiens
gaatgtttgcctctgc

SEQ ID NO: 3294413 - DNA, 19 bp, Homo sapiens
gaatgtttgcctctgcctc

SEQ ID NO: 3294414 - DNA, 16 bp, Homo sapiens
gaatgttttaaattct

SEQ ID NO: 3294415 - DNA, 20 bp, Homo sapiens
gaattaaaaggatagtattt

SEQ ID NO: 3294416 - DNA, 13 bp, Homo sapiens
gaattaaactttt

SEQ ID NO: 3294417 - DNA, 20 bp, Homo sapiens
gaattaaataaacccttcct

SEQ ID NO: 3294418 - DNA, 18 bp, Homo sapiens
gaattaaatattgaaaca

SEQ ID NO: 3294419 - DNA, 22 bp, Homo sapiens
gaattaacctggtgctggatat

SEQ ID NO: 3294420 - DNA, 15 bp, Homo sapiens
gaattaatagctttt

SEQ ID NO: 3294421 - DNA, 22 bp, Homo sapiens
gaattaatatccctacatgtat

SEQ ID NO: 3294422 - DNA, 17 bp, Homo sapiens
gaattaattaatttgga

SEQ ID NO: 3294423 - DNA, 11 bp, Homo sapiens
gaattacagta

SEQ ID NO: 3294424 - DNA, 19 bp, Homo sapiens
gaattaccattaattacat

SEQ ID NO: 3294425 - DNA, 21 bp, Homo sapiens
gaattactgaaaaaggtgatt

SEQ ID NO: 3294426 - DNA, 14 bp, Homo sapiens
gaattataactgta

SEQ ID NO: 3294427 - DNA, 16 bp, Homo sapiens
gaattatcagcaaaga

SEQ ID NO: 3294428 - DNA, 13 bp, Homo sapiens
gaattatgcttcc

SEQ ID NO: 3294429 - DNA, 16 bp, Homo sapiens
gaattatgtaatatat

SEQ ID NO: 3294430 - DNA, 20 bp, Homo sapiens
gaattatgtaatatattgta

SEQ ID NO: 3294431 - DNA, 13 bp, Homo sapiens
gaattattttgaa

SEQ ID NO: 3294432 - DNA, 16 bp, Homo sapiens
gaattcagattttaaa

SEQ ID NO: 3294433 - DNA, 19 bp, Homo sapiens
gaattcagcaccctgggtg

SEQ ID NO: 3294434 - DNA, 15 bp, Homo sapiens
gaattccaattaaat

SEQ ID NO: 3294435 - DNA, 17 bp, Homo sapiens
gaattccaattaaattt

SEQ ID NO: 3294436 - DNA, 18 bp, Homo sapiens
gaattcctaacttttcaa

SEQ ID NO: 3294437 - DNA, 23 bp, Homo sapiens
gaattctaggcatcccaggggac

SEQ ID NO: 3294438 - DNA, 23 bp, Homo sapiens
gaattctgcaactagccaaggct

SEQ ID NO: 3294439 - DNA, 18 bp, Homo sapiens
gaattcttgaaggaaaat

SEQ ID NO: 3294440 - DNA, 14 bp, Homo sapiens
gaattgaaaagttt

SEQ ID NO: 3294441 - DNA, 16 bp, Homo sapiens
gaattgagtaatggtg

SEQ ID NO: 3294442 - DNA, 12 bp, Homo sapiens
gaattgatttgc

SEQ ID NO: 3294443 - DNA, 13 bp, Homo sapiens
gaattgatttgca

SEQ ID NO: 3294444 - DNA, 18 bp, Homo sapiens
gaattgatttgcattgaa

SEQ ID NO: 3294445 - DNA, 12 bp, Homo sapiens
gaattgcattga

SEQ ID NO: 3294446 - DNA, 17 bp, Homo sapiens
gaattgggagcttggga

SEQ ID NO: 3294447 - DNA, 20 bp, Homo sapiens
gaattgtagactgatgtttt

SEQ ID NO: 3294448 - DNA, 18 bp, Homo sapiens
gaattgtgaccaagttat

SEQ ID NO: 3294449 - DNA, 21 bp, Homo sapiens
gaatttaaaattaagtagaac

SEQ ID NO: 3294450 - DNA, 22 bp, Homo sapiens
gaatttaaatataattctgtaa

SEQ ID NO: 3294451 - DNA, 19 bp, Homo sapiens
gaatttaagctgtaaatta

SEQ ID NO: 3294452 - DNA, 16 bp, Homo sapiens
gaatttaatgctgaat

SEQ ID NO: 3294453 - DNA, 16 bp, Homo sapiens
gaatttaggtttttat

SEQ ID NO: 3294454 - DNA, 13 bp, Homo sapiens
gaatttataacaa

SEQ ID NO: 3294455 - DNA, 23 bp, Homo sapiens
gaatttatacctacctgtgtggt

SEQ ID NO: 3294456 - DNA, 22 bp, Homo sapiens
gaatttatcacacttctgtgag

SEQ ID NO: 3294457 - DNA, 15 bp, Homo sapiens
gaatttatcccttta

SEQ ID NO: 3294458 - DNA, 13 bp, Homo sapiens
gaatttattcaat

SEQ ID NO: 3294459 - DNA, 17 bp, Homo sapiens
gaatttattcaattcct

SEQ ID NO: 3294460 - DNA, 23 bp, Homo sapiens
gaatttattcaattcctctggga

SEQ ID NO: 3294461 - DNA, 12 bp, Homo sapiens
gaatttcacaag

SEQ ID NO: 3294462 - DNA, 21 bp, Homo sapiens
gaatttcacctgtaaacctga

SEQ ID NO: 3294463 - DNA, 16 bp, Homo sapiens
gaatttcactgtcttt

SEQ ID NO: 3294464 - DNA, 17 bp, Homo sapiens
gaatttcttaacttctt

SEQ ID NO: 3294465 - DNA, 18 bp, Homo sapiens
gaatttcttaacttcttg

SEQ ID NO: 3294466 - DNA, 20 bp, Homo sapiens
gaatttcttcactgttgaaa

SEQ ID NO: 3294467 - DNA, 22 bp, Homo sapiens
gaatttcttttccttcattcat

SEQ ID NO: 3294468 - DNA, 19 bp, Homo sapiens
gaatttgaatgaaaaattt

SEQ ID NO: 3294469 - DNA, 22 bp, Homo sapiens
gaatttgacctaggcaagtttg

SEQ ID NO: 3294470 - DNA, 13 bp, Homo sapiens
gaatttggaaatc

SEQ ID NO: 3294471 - DNA, 16 bp, Homo sapiens
gaatttgtaacctcag

SEQ ID NO: 3294472 - DNA, 21 bp, Homo sapiens
gaatttgtaacctcagctctg

SEQ ID NO: 3294473 - DNA, 13 bp, Homo sapiens
gaattttaaagta

SEQ ID NO: 3294474 - DNA, 15 bp, Homo sapiens
gaattttaaagtatg

SEQ ID NO: 3294475 - DNA, 13 bp, Homo sapiens
gaattttaatgtg

SEQ ID NO: 3294476 - DNA, 17 bp, Homo sapiens
gaattttaatgtgaaga

SEQ ID NO: 3294477 - DNA, 15 bp, Homo sapiens
gaattttctaaaagc

SEQ ID NO: 3294478 - DNA, 21 bp, Homo sapiens
gaatttttatttctttttaat

SEQ ID NO: 3294479 - DNA, 24 bp, Homo sapiens
gaatttttccctccactccatccc

SEQ ID NO: 3294480 - DNA, 22 bp, Homo sapiens
gaatttttttttcctagccctc

SEQ ID NO: 3294481 - DNA, 17 bp, Homo sapiens
gacaaaaaaatttaaaa

SEQ ID NO: 3294482 - DNA, 16 bp, Homo sapiens
gacaaaaagtatatta

SEQ ID NO: 3294483 - DNA, 13 bp, Homo sapiens
gacaaaacttctt

SEQ ID NO: 3294484 - DNA, 19 bp, Homo sapiens
gacaaaacttcttgtcaga

SEQ ID NO: 3294485 - DNA, 21 bp, Homo sapiens
gacaaaacttcttgtcagaca

SEQ ID NO: 3294486 - DNA, 14 bp, Homo sapiens
gacaaaagtctgtc

SEQ ID NO: 3294487 - DNA, 18 bp, Homo sapiens
gacaaaattttataagca

SEQ ID NO: 3294488 - DNA, 16 bp, Homo sapiens
gacaaaccttaaaaca

SEQ ID NO: 3294489 - DNA, 17 bp, Homo sapiens
gacaaactggagtctgg

SEQ ID NO: 3294490 - DNA, 18 bp, Homo sapiens
gacaaagctgctaaatct

SEQ ID NO: 3294491 - DNA, 20 bp, Homo sapiens
gacaaagctgctaaatctcc

SEQ ID NO: 3294492 - DNA, 15 bp, Homo sapiens
gacaaaggatgaaga

SEQ ID NO: 3294493 - DNA, 17 bp, Homo sapiens
gacaaatagaaaatggt

SEQ ID NO: 3294494 - DNA, 18 bp, Homo sapiens
gacaaatagaaaatggtc

SEQ ID NO: 3294495 - DNA, 13 bp, Homo sapiens
gacaaatcaacag

SEQ ID NO: 3294496 - DNA, 17 bp, Homo sapiens
gacaaatcaacagaagc

SEQ ID NO: 3294497 - DNA, 19 bp, Homo sapiens
gacaaatcaacagaagcat

SEQ ID NO: 3294498 - DNA, 15 bp, Homo sapiens
gacaaattatatttg

SEQ ID NO: 3294499 - DNA, 15 bp, Homo sapiens
gacaacaccttcctc

SEQ ID NO: 3294500 - DNA, 18 bp, Homo sapiens
gacaacaccttcctcctg

SEQ ID NO: 3294501 - DNA, 20 bp, Homo sapiens
gacaacaccttcctcctgca

SEQ ID NO: 3294502 - DNA, 20 bp, Homo sapiens
gacaacacttcattttcagg

SEQ ID NO: 3294503 - DNA, 13 bp, Homo sapiens
gacaacagaaaaa

SEQ ID NO: 3294504 - DNA, 23 bp, Homo sapiens
gacaacagaaaaacaatcttatt

SEQ ID NO: 3294505 - DNA, 15 bp, Homo sapiens
gacaaccactggtct

SEQ ID NO: 3294506 - DNA, 16 bp, Homo sapiens
gacaaccattaaagtc

SEQ ID NO: 3294507 - DNA, 22 bp, Homo sapiens
gacaactaaaattaggactgta

SEQ ID NO: 3294508 - DNA, 16 bp, Homo sapiens
gacaactagatttgtc

SEQ ID NO: 3294509 - DNA, 22 bp, Homo sapiens
gacaacttatttaaaaatattt

SEQ ID NO: 3294510 - DNA, 15 bp, Homo sapiens
gacaagaaatccctg

SEQ ID NO: 3294511 - DNA, 16 bp, Homo sapiens
gacaagaaatccctgt

SEQ ID NO: 3294512 - DNA, 21 bp, Homo sapiens
gacaagacaaaccaagtcgga

SEQ ID NO: 3294513 - DNA, 15 bp, Homo sapiens
gacaagacccccagc

SEQ ID NO: 3294514 - DNA, 16 bp, Homo sapiens
gacaagacccccagca

SEQ ID NO: 3294515 - DNA, 22 bp, Homo sapiens
gacaagagttggggacagaact

SEQ ID NO: 3294516 - DNA, 12 bp, Homo sapiens
gacaagccctgg

SEQ ID NO: 3294517 - DNA, 13 bp, Homo sapiens
gacaagccctggc

SEQ ID NO: 3294518 - DNA, 20 bp, Homo sapiens
gacaagctgacttggcactt

SEQ ID NO: 3294519 - DNA, 18 bp, Homo sapiens
gacaagggattctgggaa

SEQ ID NO: 3294520 - DNA, 19 bp, Homo sapiens
gacaagggattctgggaag

SEQ ID NO: 3294521 - DNA, 15 bp, Homo sapiens
gacaagggctgacct

SEQ ID NO: 3294522 - DNA, 19 bp, Homo sapiens
gacaagggctgacctgcct

SEQ ID NO: 3294523 - DNA, 20 bp, Homo sapiens
gacaagtgctgaacagtgga

SEQ ID NO: 3294524 - DNA, 20 bp, Homo sapiens
gacaataaacatctgagcag

SEQ ID NO: 3294525 - DNA, 16 bp, Homo sapiens
gacaatacaccttccc

SEQ ID NO: 3294526 - DNA, 13 bp, Homo sapiens
gacaatacagtaa

SEQ ID NO: 3294527 - DNA, 18 bp, Homo sapiens
gacaatacagtaagcata

SEQ ID NO: 3294528 - DNA, 19 bp, Homo sapiens
gacaatcagtcccctccca

SEQ ID NO: 3294529 - DNA, 14 bp, Homo sapiens
gacaatcattgttt

SEQ ID NO: 3294530 - DNA, 17 bp, Homo sapiens
gacaatcattgttttga

SEQ ID NO: 3294531 - DNA, 22 bp, Homo sapiens
gacaatgcacctagctgtgcaa

SEQ ID NO: 3294532 - DNA, 20 bp, Homo sapiens
gacaatggacctctcagcag

SEQ ID NO: 3294533 - DNA, 22 bp, Homo sapiens
gaccccagctgtgagccttggc

SEQ ID NO: 3294534 - DNA, 12 bp, Homo sapiens
gaccccatctct

SEQ ID NO: 3294535 - DNA, 11 bp, Homo sapiens
gacccccaggc

SEQ ID NO: 3294536 - DNA, 20 bp, Homo sapiens
gaccccgcacccggctcgtg

SEQ ID NO: 3294537 - DNA, 14 bp, Homo sapiens
gacccctagttccc

SEQ ID NO: 3294538 - DNA, 14 bp, Homo sapiens
gacccctccatgtg

SEQ ID NO: 3294539 - DNA, 19 bp, Homo sapiens
gacccctcctcactggcca

SEQ ID NO: 3294540 - DNA, 23 bp, Homo sapiens
gacccctcctcactggccatccc

SEQ ID NO: 3294541 - DNA, 18 bp, Homo sapiens
gacccctctggccaggat

SEQ ID NO: 3294542 - DNA, 23 bp, Homo sapiens
gacccctgctcagtaaagcactt

SEQ ID NO: 3294543 - DNA, 22 bp, Homo sapiens
gacccctgctcccagcctgctg

SEQ ID NO: 3294544 - DNA, 23 bp, Homo sapiens
gacccctgctcccagcctgctga

SEQ ID NO: 3294545 - DNA, 13 bp, Homo sapiens
gacccctggcttt

SEQ ID NO: 3294546 - DNA, 22 bp, Homo sapiens
gacccctggcttttcactgctg

SEQ ID NO: 3294547 - DNA, 12 bp, Homo sapiens
gacccctgggag

SEQ ID NO: 3294548 - DNA, 16 bp, Homo sapiens
gacccctgggcctcat

SEQ ID NO: 3294549 - DNA, 17 bp, Homo sapiens
gacccggaggggcctgg

SEQ ID NO: 3294550 - DNA, 20 bp, Homo sapiens
gacccggaggggcctggcag

SEQ ID NO: 3294551 - DNA, 12 bp, Homo sapiens
gacccggctgcg

SEQ ID NO: 3294552 - DNA, 22 bp, Homo sapiens
gacccggctgggtcggccctgc

SEQ ID NO: 3294553 - DNA, 15 bp, Homo sapiens
gaccctacaggagag

SEQ ID NO: 3294554 - DNA, 22 bp, Homo sapiens
gaccctactcccttgccctaga

SEQ ID NO: 3294555 - DNA, 20 bp, Homo sapiens
gaccctatgggtctaggaca

SEQ ID NO: 3294556 - DNA, 15 bp, Homo sapiens
gaccctccccgcacc

SEQ ID NO: 3294557 - DNA, 17 bp, Homo sapiens
gaccctccccgcacccc

SEQ ID NO: 3294558 - DNA, 22 bp, Homo sapiens
gaccctcctcctcccccagagg

SEQ ID NO: 3294559 - DNA, 14 bp, Homo sapiens
gaccctctgccacc

SEQ ID NO: 3294560 - DNA, 22 bp, Homo sapiens
gaccctctgggaacctcccaga

SEQ ID NO: 3294561 - DNA, 21 bp, Homo sapiens
gaccctgaaaagaaggacggg

SEQ ID NO: 3294562 - DNA, 22 bp, Homo sapiens
gaccctgacctccgcccctgcc

SEQ ID NO: 3294563 - DNA, 16 bp, Homo sapiens
gaccctgagactccag

SEQ ID NO: 3294564 - DNA, 22 bp, Homo sapiens
gaccctgcaaacagaacagggt

SEQ ID NO: 3294565 - DNA, 11 bp, Homo sapiens
gaccctggaat

SEQ ID NO: 3294566 - DNA, 20 bp, Homo sapiens
gaccctggaattcagcaccc

SEQ ID NO: 3294567 - DNA, 15 bp, Homo sapiens
gaccctgggagagaa

SEQ ID NO: 3294568 - DNA, 17 bp, Homo sapiens
gaccctgggtgggctct

SEQ ID NO: 3294569 - DNA, 21 bp, Homo sapiens
gaccctgggtgggctctgtgc

SEQ ID NO: 3294570 - DNA, 22 bp, Homo sapiens
gaccctgggtgggctctgtgca

SEQ ID NO: 3294571 - DNA, 18 bp, Homo sapiens
gaccctggtgcctggctc

SEQ ID NO: 3294572 - DNA, 17 bp, Homo sapiens
gaccctgtccggcccag

SEQ ID NO: 3294573 - DNA, 23 bp, Homo sapiens
gaccctgtccggcccagtgccac

SEQ ID NO: 3294574 - DNA, 17 bp, Homo sapiens
gaccctgtcttctgggc

SEQ ID NO: 3294575 - DNA, 21 bp, Homo sapiens
gaccctgtgacatggtgcctg

SEQ ID NO: 3294576 - DNA, 16 bp, Homo sapiens
gacccttcagggccag

SEQ ID NO: 3294577 - DNA, 17 bp, Homo sapiens
gacccttccagacatac

SEQ ID NO: 3294578 - DNA, 23 bp, Homo sapiens
gacccttcccaatcagcactgaa

SEQ ID NO: 3294579 - DNA, 15 bp, Homo sapiens
gacccttgggcctgg

SEQ ID NO: 3294580 - DNA, 15 bp, Homo sapiens
gaccgccccctcctc

SEQ ID NO: 3294581 - DNA, 16 bp, Homo sapiens
gaccgccccctcctct

SEQ ID NO: 3294582 - DNA, 16 bp, Homo sapiens
gaccgctgataagcat

SEQ ID NO: 3294583 - DNA, 18 bp, Homo sapiens
gaccgcttcacccctgca

SEQ ID NO: 3294584 - DNA, 21 bp, Homo sapiens
gaccgcttgtggggacccagg

SEQ ID NO: 3294585 - DNA, 17 bp, Homo sapiens
gaccggacttttctgca

SEQ ID NO: 3294586 - DNA, 15 bp, Homo sapiens
gaccggtgctgcagg

SEQ ID NO: 3294587 - DNA, 16 bp, Homo sapiens
gaccggtgctgcagga

SEQ ID NO: 3294588 - DNA, 14 bp, Homo sapiens
gaccgtactctcac

SEQ ID NO: 3294589 - DNA, 15 bp, Homo sapiens
gaccgtggacaggcc

SEQ ID NO: 3294590 - DNA, 16 bp, Homo sapiens
gaccgtggacaggccc

SEQ ID NO: 3294591 - DNA, 18 bp, Homo sapiens
gaccgtggacaggcccag

SEQ ID NO: 3294592 - DNA, 22 bp, Homo sapiens
gaccgttcagtgtcccaggcag

SEQ ID NO: 3294593 - DNA, 18 bp, Homo sapiens
gaccgtttccaagctgcg

SEQ ID NO: 3294594 - DNA, 14 bp, Homo sapiens
gacctaggcaagtt

SEQ ID NO: 3294595 - DNA, 21 bp, Homo sapiens
gacctattcaccctccacttc

SEQ ID NO: 3294596 - DNA, 17 bp, Homo sapiens
gacctcaagtgatctgc

SEQ ID NO: 3294597 - DNA, 21 bp, Homo sapiens
gacctcaggcactagcctttg

SEQ ID NO: 3294598 - DNA, 19 bp, Homo sapiens
gacctcaggtgatccaccc

SEQ ID NO: 3294599 - DNA, 23 bp, Homo sapiens
gacctcatcaggatgaacccagg

SEQ ID NO: 3294600 - DNA, 19 bp, Homo sapiens
gacctcccttccgaccctc

SEQ ID NO: 3294601 - DNA, 21 bp, Homo sapiens
gacctcgagcagatgatgcca

SEQ ID NO: 3294602 - DNA, 22 bp, Homo sapiens
gacctcgtgatccgcctgcctc

SEQ ID NO: 3294603 - DNA, 16 bp, Homo sapiens
gacctctcagggcctg

SEQ ID NO: 3294604 - DNA, 17 bp, Homo sapiens
gacctctcagggcctgg

SEQ ID NO: 3294605 - DNA, 12 bp, Homo sapiens
gacctcttgctg

SEQ ID NO: 3294606 - DNA, 15 bp, Homo sapiens
gacctgaaattccaa

SEQ ID NO: 3294607 - DNA, 23 bp, Homo sapiens
gacctgaaattccaaagtctcta

SEQ ID NO: 3294608 - DNA, 17 bp, Homo sapiens
gacctgaggctgtggtc

SEQ ID NO: 3294609 - DNA, 16 bp, Homo sapiens
gacctgcactggggag

SEQ ID NO: 3294610 - DNA, 13 bp, Homo sapiens
gacctgcaggcca

SEQ ID NO: 3294611 - DNA, 16 bp, Homo sapiens
gacctgccaggcaggg

SEQ ID NO: 3294612 - DNA, 19 bp, Homo sapiens
gacctgctccgctgctcct

SEQ ID NO: 3294613 - DNA, 19 bp, Homo sapiens
gacctgcttcctgaaataa

SEQ ID NO: 3294614 - DNA, 20 bp, Homo sapiens
gacctgcttcctgaaataaa

SEQ ID NO: 3294615 - DNA, 13 bp, Homo sapiens
gacctgctttttg

SEQ ID NO: 3294616 - DNA, 17 bp, Homo sapiens
gacctgctttttgaaat

SEQ ID NO: 3294617 - DNA, 13 bp, Homo sapiens
gacctggagcccc

SEQ ID NO: 3294618 - DNA, 17 bp, Homo sapiens
gacctggagcccctggg

SEQ ID NO: 3294619 - DNA, 17 bp, Homo sapiens
gacctggataacttagg

SEQ ID NO: 3294620 - DNA, 18 bp, Homo sapiens
gacctggcactggatgca

SEQ ID NO: 3294621 - DNA, 19 bp, Homo sapiens
gacctggtaccctcctggc

SEQ ID NO: 3294622 - DNA, 21 bp, Homo sapiens
gacctggtaccctcctggctc

SEQ ID NO: 3294623 - DNA, 14 bp, Homo sapiens
gacctggttcccac

SEQ ID NO: 3294624 - DNA, 15 bp, Homo sapiens
gacctgtcatgcccc

SEQ ID NO: 3294625 - DNA, 13 bp, Homo sapiens
gacctgtgctagt

SEQ ID NO: 3294626 - DNA, 20 bp, Homo sapiens
gacctgtgctagttttacag

SEQ ID NO: 3294627 - DNA, 15 bp, Homo sapiens
gacctgttggttcca

SEQ ID NO: 3294628 - DNA, 23 bp, Homo sapiens
gaccttaatttatattctccttc

SEQ ID NO: 3294629 - DNA, 19 bp, Homo sapiens
gaccttagaaatcattgta

SEQ ID NO: 3294630 - DNA, 15 bp, Homo sapiens
gaccttaggccttcc

SEQ ID NO: 3294631 - DNA, 18 bp, Homo sapiens
gaccttaggccttcctct

SEQ ID NO: 3294632 - DNA, 21 bp, Homo sapiens
gaccttaggccttcctctctc

SEQ ID NO: 3294633 - DNA, 14 bp, Homo sapiens
gaccttatctgtgc

SEQ ID NO: 3294634 - DNA, 21 bp, Homo sapiens
gaccttcatgcccttctgatt

SEQ ID NO: 3294635 - DNA, 22 bp, Homo sapiens
gaccttccataatgctactgtc

SEQ ID NO: 3294636 - DNA, 16 bp, Homo sapiens
gaccttccctccgcct

SEQ ID NO: 3294637 - DNA, 14 bp, Homo sapiens
gaccttcctcatcc

SEQ ID NO: 3294638 - DNA, 21 bp, Homo sapiens
gaccttcctctggggctctag

SEQ ID NO: 3294639 - DNA, 19 bp, Homo sapiens
gaccttcgggctgtgcccg

SEQ ID NO: 3294640 - DNA, 18 bp, Homo sapiens
gaccttctccaaatgaga

SEQ ID NO: 3294641 - DNA, 23 bp, Homo sapiens
gaccttgaactgggtacttgtgg

SEQ ID NO: 3294642 - DNA, 12 bp, Homo sapiens
gaccttggtctg

SEQ ID NO: 3294643 - DNA, 21 bp, Homo sapiens
gacctttccaccacagccagc

SEQ ID NO: 3294644 - DNA, 23 bp, Homo sapiens
gacctttccaccacagccagcac

SEQ ID NO: 3294645 - DNA, 18 bp, Homo sapiens
gaccttttcttcattttg

SEQ ID NO: 3294646 - DNA, 21 bp, Homo sapiens
gacgaacatccaaccttccca

SEQ ID NO: 3294647 - DNA, 12 bp, Homo sapiens
gacgaggggcag

SEQ ID NO: 3294648 - DNA, 18 bp, Homo sapiens
gacgaggggtgtcttggg

SEQ ID NO: 3294649 - DNA, 20 bp, Homo sapiens
gacgatggggggctgatggc

SEQ ID NO: 3294650 - DNA, 16 bp, Homo sapiens
gacgcacacagctgag

SEQ ID NO: 3294651 - DNA, 16 bp, Homo sapiens
gacgcaccgccgccac

SEQ ID NO: 3294652 - DNA, 18 bp, Homo sapiens
gacgcacgctcgctgcca

SEQ ID NO: 3294653 - DNA, 13 bp, Homo sapiens
gacgcaggaatgg

SEQ ID NO: 3294654 - DNA, 16 bp, Homo sapiens
gacgcatagactgagg

SEQ ID NO: 3294655 - DNA, 15 bp, Homo sapiens
gacgccaccattcct

SEQ ID NO: 3294656 - DNA, 16 bp, Homo sapiens
gacgccaccattcctg

SEQ ID NO: 3294657 - DNA, 11 bp, Homo sapiens
gacgccctgcg

SEQ ID NO: 3294658 - DNA, 16 bp, Homo sapiens
gagaagtgccttctcc

SEQ ID NO: 3294659 - DNA, 17 bp, Homo sapiens
gagaagttctcaaagtt

SEQ ID NO: 3294660 - DNA, 19 bp, Homo sapiens
gagaataactcagaatatt

SEQ ID NO: 3294661 - DNA, 18 bp, Homo sapiens
gagaataagagaaagaaa

SEQ ID NO: 3294662 - DNA, 18 bp, Homo sapiens
gagaatcccttaaaatta

SEQ ID NO: 3294663 - DNA, 22 bp, Homo sapiens
gagaatctatatttaacaagat

SEQ ID NO: 3294664 - DNA, 18 bp, Homo sapiens
gagaatctcaagattcta

SEQ ID NO: 3294665 - DNA, 13 bp, Homo sapiens
gagaatgagcctc

SEQ ID NO: 3294666 - DNA, 17 bp, Homo sapiens
gagaatgcacagatata

SEQ ID NO: 3294667 - DNA, 19 bp, Homo sapiens
gagaatggctgggtcaggg

SEQ ID NO: 3294668 - DNA, 23 bp, Homo sapiens
gagaatggtgtgaacccgggagc

SEQ ID NO: 3294669 - DNA, 15 bp, Homo sapiens
gagaattgcacacag

SEQ ID NO: 3294670 - DNA, 21 bp, Homo sapiens
gagaattgtatcatttgaaca

SEQ ID NO: 3294671 - DNA, 12 bp, Homo sapiens
gagaatttctaa

SEQ ID NO: 3294672 - DNA, 16 bp, Homo sapiens
gagacaaaattttagt

SEQ ID NO: 3294673 - DNA, 19 bp, Homo sapiens
gagacaaacacctcccagg

SEQ ID NO: 3294674 - DNA, 13 bp, Homo sapiens
gagacaaatcttt

SEQ ID NO: 3294675 - DNA, 22 bp, Homo sapiens
gagacaactggacaagatttcc

SEQ ID NO: 3294676 - DNA, 15 bp, Homo sapiens
gagacaagccctggc

SEQ ID NO: 3294677 - DNA, 17 bp, Homo sapiens
gagacaagccctggcaa

SEQ ID NO: 3294678 - DNA, 22 bp, Homo sapiens
gagacacaggcacgggtccctg

SEQ ID NO: 3294679 - DNA, 17 bp, Homo sapiens
gagacacgctggcgaca

SEQ ID NO: 3294680 - DNA, 14 bp, Homo sapiens
gagacagaatgtat

SEQ ID NO: 3294681 - DNA, 18 bp, Homo sapiens
gagacagaatgtatctgt

SEQ ID NO: 3294682 - DNA, 20 bp, Homo sapiens
gagacagaatgtatctgtga

SEQ ID NO: 3294683 - DNA, 21 bp, Homo sapiens
gagacagaatgtatctgtgaa

SEQ ID NO: 3294684 - DNA, 20 bp, Homo sapiens
gagacagacagagaaggcag

SEQ ID NO: 3294685 - DNA, 22 bp, Homo sapiens
gagacagaccacttgccacgct

SEQ ID NO: 3294686 - DNA, 18 bp, Homo sapiens
gagacagccacttggttt

SEQ ID NO: 3294687 - DNA, 13 bp, Homo sapiens
gagacagcccagg

SEQ ID NO: 3294688 - DNA, 21 bp, Homo sapiens
gagacagctgatacttcattt

SEQ ID NO: 3294689 - DNA, 21 bp, Homo sapiens
gagacagcttctctgcagtaa

SEQ ID NO: 3294690 - DNA, 19 bp, Homo sapiens
gagacagggtaggaaaggg

SEQ ID NO: 3294691 - DNA, 17 bp, Homo sapiens
gagacagtccagtgtca

SEQ ID NO: 3294692 - DNA, 21 bp, Homo sapiens
gagacagtttcttagcttttt

SEQ ID NO: 3294693 - DNA, 15 bp, Homo sapiens
gagacatggaagaga

SEQ ID NO: 3294694 - DNA, 18 bp, Homo sapiens
gagacatgtaccttgacc

SEQ ID NO: 3294695 - DNA, 17 bp, Homo sapiens
gagacattctgtctttc

SEQ ID NO: 3294696 - DNA, 21 bp, Homo sapiens
gagaccacacaccctttggga

SEQ ID NO: 3294697 - DNA, 20 bp, Homo sapiens
gagaccagttgggagcactg

SEQ ID NO: 3294698 - DNA, 14 bp, Homo sapiens
gagaccatcctggc

SEQ ID NO: 3294699 - DNA, 16 bp, Homo sapiens
gagaccatcctggcta

SEQ ID NO: 3294700 - DNA, 23 bp, Homo sapiens
gagacccccacacctcagttccc

SEQ ID NO: 3294701 - DNA, 13 bp, Homo sapiens
gagacccccaggc

SEQ ID NO: 3294702 - DNA, 13 bp, Homo sapiens
gagaccccgcacc

SEQ ID NO: 3294703 - DNA, 13 bp, Homo sapiens
gagacccctgtct

SEQ ID NO: 3294704 - DNA, 15 bp, Homo sapiens
gagaccctctgccac

SEQ ID NO: 3294705 - DNA, 18 bp, Homo sapiens
gagaccctggaattcagc

SEQ ID NO: 3294706 - DNA, 22 bp, Homo sapiens
gagaccctggaattcagcaccc

SEQ ID NO: 3294707 - DNA, 14 bp, Homo sapiens
gagaccgagtgaac

SEQ ID NO: 3294708 - DNA, 20 bp, Homo sapiens
gagaccgcttcacccctgca

SEQ ID NO: 3294709 - DNA, 21 bp, Homo sapiens
gagaccgcttcacccctgcac

SEQ ID NO: 3294710 - DNA, 14 bp, Homo sapiens
gagacctacctcag

SEQ ID NO: 3294711 - DNA, 18 bp, Homo sapiens
gagacctacctcaggttg

SEQ ID NO: 3294712 - DNA, 21 bp, Homo sapiens
gagacctacctcaggttgctg

SEQ ID NO: 3294713 - DNA, 19 bp, Homo sapiens
gagacctcaagccctgagg

SEQ ID NO: 3294714 - DNA, 18 bp, Homo sapiens
gagacctcatcaggatga

SEQ ID NO: 3294715 - DNA, 19 bp, Homo sapiens
gagacctggcactggatgc

SEQ ID NO: 3294716 - DNA, 17 bp, Homo sapiens
gagaccttaatttatat

SEQ ID NO: 3294717 - DNA, 19 bp, Homo sapiens
gagacgcacacagctgagc

SEQ ID NO: 3294718 - DNA, 21 bp, Homo sapiens
gagacgcacacagctgagcac

SEQ ID NO: 3294719 - DNA, 16 bp, Homo sapiens
gagacggagtcccacc

SEQ ID NO: 3294720 - DNA, 21 bp, Homo sapiens
gagacggcagaaaacagagcc

SEQ ID NO: 3294721 - DNA, 18 bp, Homo sapiens
gagacgggtgggcggctg

SEQ ID NO: 3294722 - DNA, 20 bp, Homo sapiens
gagacgtggaacctctgtct

SEQ ID NO: 3294723 - DNA, 21 bp, Homo sapiens
gagacgtggaacctctgtctc

SEQ ID NO: 3294724 - DNA, 23 bp, Homo sapiens
gagacgtttataaacagaaatgg

SEQ ID NO: 3294725 - DNA, 22 bp, Homo sapiens
gagacgtttttggaagagtagt

SEQ ID NO: 3294726 - DNA, 22 bp, Homo sapiens
gagactaagccctgtcgagaca

SEQ ID NO: 3294727 - DNA, 13 bp, Homo sapiens
gagactatttaaa

SEQ ID NO: 3294728 - DNA, 15 bp, Homo sapiens
gagactcacaggaag

SEQ ID NO: 3294729 - DNA, 13 bp, Homo sapiens
gagactcagatga

SEQ ID NO: 3294730 - DNA, 21 bp, Homo sapiens
gagactcagcgctcctcctgt

SEQ ID NO: 3294731 - DNA, 19 bp, Homo sapiens
gagactccagaatctgctg

SEQ ID NO: 3294732 - DNA, 15 bp, Homo sapiens
gagactcctggtctg

SEQ ID NO: 3294733 - DNA, 19 bp, Homo sapiens
gagactctagggtccagtg

SEQ ID NO: 3294734 - DNA, 13 bp, Homo sapiens
gagactctgtctc

SEQ ID NO: 3294735 - DNA, 12 bp, Homo sapiens
gagactctgtgg

SEQ ID NO: 3294736 - DNA, 19 bp, Homo sapiens
gagactgaaagcagcagct

SEQ ID NO: 3294737 - DNA, 16 bp, Homo sapiens
gagactgagcagccgc

SEQ ID NO: 3294738 - DNA, 22 bp, Homo sapiens
gagactgaggcttagagagagg

SEQ ID NO: 3294739 - DNA, 22 bp, Homo sapiens
gagactgataacttggggaggc

SEQ ID NO: 3294740 - DNA, 22 bp, Homo sapiens
gagactgcgggatggtcctggg

SEQ ID NO: 3294741 - DNA, 23 bp, Homo sapiens
gagactgcgggatggtcctgggg

SEQ ID NO: 3294742 - DNA, 14 bp, Homo sapiens
gagactgcttccca

SEQ ID NO: 3294743 - DNA, 13 bp, Homo sapiens
gagactgggaaga

SEQ ID NO: 3294744 - DNA, 14 bp, Homo sapiens
gagactgggaaggc

SEQ ID NO: 3294745 - DNA, 17 bp, Homo sapiens
gagactgggaaggcttg

SEQ ID NO: 3294746 - DNA, 16 bp, Homo sapiens
gagactggggggcttg

SEQ ID NO: 3294747 - DNA, 19 bp, Homo sapiens
gagactggggggcttgaaa

SEQ ID NO: 3294748 - DNA, 23 bp, Homo sapiens
gagactggtcctgtgtgcagtga

SEQ ID NO: 3294749 - DNA, 23 bp, Homo sapiens
gagactggtctcgaactcctggc

SEQ ID NO: 3294750 - DNA, 23 bp, Homo sapiens
gagactgtagattgcttctgtag

SEQ ID NO: 3294751 - DNA, 13 bp, Homo sapiens
gagactgtccctg

SEQ ID NO: 3294752 - DNA, 20 bp, Homo sapiens
gagactgtcggagaggctgt

SEQ ID NO: 3294753 - DNA, 14 bp, Homo sapiens
gagacttactgggt

SEQ ID NO: 3294754 - DNA, 15 bp, Homo sapiens
gagacttactgggtg

SEQ ID NO: 3294755 - DNA, 22 bp, Homo sapiens
gagacttttaatcagacaaagt

SEQ ID NO: 3294756 - DNA, 21 bp, Homo sapiens
gagactttttggtggatgtaa

SEQ ID NO: 3294757 - DNA, 11 bp, Homo sapiens
gagagaaagaa

SEQ ID NO: 3294758 - DNA, 19 bp, Homo sapiens
gagagaaagccaggcaggt

SEQ ID NO: 3294759 - DNA, 18 bp, Homo sapiens
gagagaaagtgggtgaga

SEQ ID NO: 3294760 - DNA, 22 bp, Homo sapiens
gagagaaagtgtgagcaaacta

SEQ ID NO: 3294761 - DNA, 13 bp, Homo sapiens
gagagaaattctg

SEQ ID NO: 3294762 - DNA, 14 bp, Homo sapiens
gagagaaattctgt

SEQ ID NO: 3294763 - DNA, 14 bp, Homo sapiens
gagagaagccagcc

SEQ ID NO: 3294764 - DNA, 18 bp, Homo sapiens
gagagaagccagccacag

SEQ ID NO: 3294765 - DNA, 13 bp, Homo sapiens
gagagaagctgat

SEQ ID NO: 3294766 - DNA, 16 bp, Homo sapiens
gagagaattggctcaa

SEQ ID NO: 3294767 - DNA, 13 bp, Homo sapiens
gagagacaagaag

SEQ ID NO: 3294768 - DNA, 19 bp, Homo sapiens
gagagaccccgcacccggc

SEQ ID NO: 3294769 - DNA, 14 bp, Homo sapiens
gagagactaacctt

SEQ ID NO: 3294770 - DNA, 16 bp, Homo sapiens
gagagactgaaagcag

SEQ ID NO: 3294771 - DNA, 19 bp, Homo sapiens
gagagactgaaagcagcag

SEQ ID NO: 3294772 - DNA, 13 bp, Homo sapiens
gagagagaaaaaa

SEQ ID NO: 3294773 - DNA, 12 bp, Homo sapiens
gagagagaaagc

SEQ ID NO: 3294774 - DNA, 20 bp, Homo sapiens
gagagagaaattctgttaaa

SEQ ID NO: 3294775 - DNA, 10 bp, Homo sapiens
gagagagaca

SEQ ID NO: 3294776 - DNA, 12 bp, Homo sapiens
gagagagagaga

SEQ ID NO: 3294777 - DNA, 12 bp, Homo sapiens
gagagagaggac

SEQ ID NO: 3294778 - DNA, 13 bp, Homo sapiens
gagagagaggaca

SEQ ID NO: 3294779 - DNA, 13 bp, Homo sapiens
gagagagccagga

SEQ ID NO: 3294780 - DNA, 15 bp, Homo sapiens
gagagaggcagagag

SEQ ID NO: 3294781 - DNA, 14 bp, Homo sapiens
gagagatcaaagat

SEQ ID NO: 3294782 - DNA, 13 bp, Homo sapiens
gagagcaactctg

SEQ ID NO: 3294783 - DNA, 11 bp, Homo sapiens
gagagccagta

SEQ ID NO: 3294784 - DNA, 20 bp, Homo sapiens
gagcccttcactgccatgat

SEQ ID NO: 3294785 - DNA, 16 bp, Homo sapiens
gagcccttgcctcccc

SEQ ID NO: 3294786 - DNA, 17 bp, Homo sapiens
gagcccttgcctcccca

SEQ ID NO: 3294787 - DNA, 12 bp, Homo sapiens
gagcccttggcc

SEQ ID NO: 3294788 - DNA, 22 bp, Homo sapiens
gagccgagatcacgccactgca

SEQ ID NO: 3294789 - DNA, 22 bp, Homo sapiens
gagccgagattgcaccactgca

SEQ ID NO: 3294790 - DNA, 19 bp, Homo sapiens
gagccgctgtgagcccctg

SEQ ID NO: 3294791 - DNA, 20 bp, Homo sapiens
gagccgctgtgagcccctgg

SEQ ID NO: 3294792 - DNA, 15 bp, Homo sapiens
gagccgggcccctgg

SEQ ID NO: 3294793 - DNA, 13 bp, Homo sapiens
gagccgggcctgg

SEQ ID NO: 3294794 - DNA, 20 bp, Homo sapiens
gagccgggcctggggctcct

SEQ ID NO: 3294795 - DNA, 19 bp, Homo sapiens
gagccggggagtttctttc

SEQ ID NO: 3294796 - DNA, 17 bp, Homo sapiens
gagccgtgaactgtgca

SEQ ID NO: 3294797 - DNA, 19 bp, Homo sapiens
gagcctagcggagcccagc

SEQ ID NO: 3294798 - DNA, 16 bp, Homo sapiens
gagcctagctcctgcc

SEQ ID NO: 3294799 - DNA, 15 bp, Homo sapiens
gagcctaggaccact

SEQ ID NO: 3294800 - DNA, 19 bp, Homo sapiens
gagcctaggaccactcagc

SEQ ID NO: 3294801 - DNA, 11 bp, Homo sapiens
gagcctatgat

SEQ ID NO: 3294802 - DNA, 19 bp, Homo sapiens
gagcctcagcatcctggca

SEQ ID NO: 3294803 - DNA, 12 bp, Homo sapiens
gagcctccccca

SEQ ID NO: 3294804 - DNA, 16 bp, Homo sapiens
gagcctcccccaaagc

SEQ ID NO: 3294805 - DNA, 12 bp, Homo sapiens
gagcctccccct

SEQ ID NO: 3294806 - DNA, 13 bp, Homo sapiens
gagcctccccctc

SEQ ID NO: 3294807 - DNA, 14 bp, Homo sapiens
gagcctccccctca

SEQ ID NO: 3294808 - DNA, 22 bp, Homo sapiens
gagcctcctctctcaaactggg

SEQ ID NO: 3294809 - DNA, 17 bp, Homo sapiens
gagcctcctgcccagtc

SEQ ID NO: 3294810 - DNA, 18 bp, Homo sapiens
gagcctcctgcccagtcc

SEQ ID NO: 3294811 - DNA, 16 bp, Homo sapiens
gagcctctgctcccca

SEQ ID NO: 3294812 - DNA, 17 bp, Homo sapiens
gagcctctgctccccag

SEQ ID NO: 3294813 - DNA, 19 bp, Homo sapiens
gagcctgaattttgttgct

SEQ ID NO: 3294814 - DNA, 15 bp, Homo sapiens
gagcctgagtcaggg

SEQ ID NO: 3294815 - DNA, 21 bp, Homo sapiens
gagcctgcaaactcactgctc

SEQ ID NO: 3294816 - DNA, 20 bp, Homo sapiens
gagcctgcctaaccaggccc

SEQ ID NO: 3294817 - DNA, 22 bp, Homo sapiens
gagcctgcctaaccaggcccag

SEQ ID NO: 3294818 - DNA, 11 bp, Homo sapiens
gagcctgctgg

SEQ ID NO: 3294819 - DNA, 12 bp, Homo sapiens
gagcctgctggc

SEQ ID NO: 3294820 - DNA, 18 bp, Homo sapiens
gagcctggcacaggactg

SEQ ID NO: 3294821 - DNA, 16 bp, Homo sapiens
gagcctggctgcccat

SEQ ID NO: 3294822 - DNA, 19 bp, Homo sapiens
gagcctgtgcctcctcacc

SEQ ID NO: 3294823 - DNA, 19 bp, Homo sapiens
gagcctgtgcgtcccagct

SEQ ID NO: 3294824 - DNA, 11 bp, Homo sapiens
gagccttagct

SEQ ID NO: 3294825 - DNA, 15 bp, Homo sapiens
gagccttagctccca

SEQ ID NO: 3294826 - DNA, 17 bp, Homo sapiens
gagccttagctcccagc

SEQ ID NO: 3294827 - DNA, 18 bp, Homo sapiens
gagccttcaagtgccaaa

SEQ ID NO: 3294828 - DNA, 21 bp, Homo sapiens
gagccttcagaatgctcctga

SEQ ID NO: 3294829 - DNA, 20 bp, Homo sapiens
gagccttttatctgcagaac

SEQ ID NO: 3294830 - DNA, 23 bp, Homo sapiens
gagccttttccctctttggctcc

SEQ ID NO: 3294831 - DNA, 17 bp, Homo sapiens
gagcgagagatcaaaga

SEQ ID NO: 3294832 - DNA, 20 bp, Homo sapiens
gagcgagagatcaaagatga

SEQ ID NO: 3294833 - DNA, 13 bp, Homo sapiens
gagcgaggaggcg

SEQ ID NO: 3294834 - DNA, 18 bp, Homo sapiens
gagcgcacctgccccctg

SEQ ID NO: 3294835 - DNA, 15 bp, Homo sapiens
gagcgcatggcaagt

SEQ ID NO: 3294836 - DNA, 21 bp, Homo sapiens
gagcgccgtgagttctcaggg

SEQ ID NO: 3294837 - DNA, 23 bp, Homo sapiens
gagcgcctccatccaaggccagg

SEQ ID NO: 3294838 - DNA, 14 bp, Homo sapiens
gagcgcggctggct

SEQ ID NO: 3294839 - DNA, 15 bp, Homo sapiens
gagcggcgccctgga

SEQ ID NO: 3294840 - DNA, 12 bp, Homo sapiens
gagcggctgctc

SEQ ID NO: 3294841 - DNA, 22 bp, Homo sapiens
gagcggctgctcgcccaggaag

SEQ ID NO: 3294842 - DNA, 14 bp, Homo sapiens
gagcgggaggcaga

SEQ ID NO: 3294843 - DNA, 16 bp, Homo sapiens
gagcgggaggcagagt

SEQ ID NO: 3294844 - DNA, 20 bp, Homo sapiens
gagcggggctgggaggaagg

SEQ ID NO: 3294845 - DNA, 17 bp, Homo sapiens
gagcggtctcaggctgg

SEQ ID NO: 3294846 - DNA, 22 bp, Homo sapiens
gagcggtctcaggctggtggga

SEQ ID NO: 3294847 - DNA, 14 bp, Homo sapiens
gagcggtggccctg

SEQ ID NO: 3294848 - DNA, 13 bp, Homo sapiens
gagcggtggggga

SEQ ID NO: 3294849 - DNA, 23 bp, Homo sapiens
gagcgtcagggttggtgtgctga

SEQ ID NO: 3294850 - DNA, 14 bp, Homo sapiens
gagcgttcccagca

SEQ ID NO: 3294851 - DNA, 16 bp, Homo sapiens
gagcgttctctgtcct

SEQ ID NO: 3294852 - DNA, 21 bp, Homo sapiens
gagctaaattacaattgtcat

SEQ ID NO: 3294853 - DNA, 23 bp, Homo sapiens
gagctaaccccaagctgcctctg

SEQ ID NO: 3294854 - DNA, 18 bp, Homo sapiens
gagctaagggtgggtgct

SEQ ID NO: 3294855 - DNA, 20 bp, Homo sapiens
gagctacaacaaaaggactt

SEQ ID NO: 3294856 - DNA, 17 bp, Homo sapiens
gagctagcgatttcaga

SEQ ID NO: 3294857 - DNA, 20 bp, Homo sapiens
gagctagcgatttcagacct

SEQ ID NO: 3294858 - DNA, 13 bp, Homo sapiens
gagctattgctgt

SEQ ID NO: 3294859 - DNA, 18 bp, Homo sapiens
gagctatttccattccag

SEQ ID NO: 3294860 - DNA, 20 bp, Homo sapiens
gagctatttccattccagaa

SEQ ID NO: 3294861 - DNA, 20 bp, Homo sapiens
gagctcaagcccttggggag

SEQ ID NO: 3294862 - DNA, 21 bp, Homo sapiens
gagctcaccctgcccgctccc

SEQ ID NO: 3294863 - DNA, 16 bp, Homo sapiens
gagctcactcggcacc

SEQ ID NO: 3294864 - DNA, 17 bp, Homo sapiens
gagctccccagatctcc

SEQ ID NO: 3294865 - DNA, 21 bp, Homo sapiens
gagctcctctgtcctgcttct

SEQ ID NO: 3294866 - DNA, 16 bp, Homo sapiens
gagctctaccctgctc

SEQ ID NO: 3294867 - DNA, 13 bp, Homo sapiens
gagctctccagct

SEQ ID NO: 3294868 - DNA, 21 bp, Homo sapiens
gagctctgacccttgggcctg

SEQ ID NO: 3294869 - DNA, 19 bp, Homo sapiens
gagctcttcaggcctccct

SEQ ID NO: 3294870 - DNA, 13 bp, Homo sapiens
gagctcttggcct

SEQ ID NO: 3294871 - DNA, 20 bp, Homo sapiens
gagctcttggcctttgcatt

SEQ ID NO: 3294872 - DNA, 15 bp, Homo sapiens
gagctgacgggaggc

SEQ ID NO: 3294873 - DNA, 13 bp, Homo sapiens
gagctgagctgga

SEQ ID NO: 3294874 - DNA, 17 bp, Homo sapiens
gagctgatataaattct

SEQ ID NO: 3294875 - DNA, 14 bp, Homo sapiens
gagctgatgaaact

SEQ ID NO: 3294876 - DNA, 21 bp, Homo sapiens
gagctgatgaaactcacaaat

SEQ ID NO: 3294877 - DNA, 17 bp, Homo sapiens
gagctgatttccaggcc

SEQ ID NO: 3294878 - DNA, 19 bp, Homo sapiens
gagctgatttccaggcccc

SEQ ID NO: 3294879 - DNA, 20 bp, Homo sapiens
gagctgcctgcttggcccgg

SEQ ID NO: 3294880 - DNA, 22 bp, Homo sapiens
gagctgcctgcttggcccggcc

SEQ ID NO: 3294881 - DNA, 19 bp, Homo sapiens
gagctgcctgttcagctcc

SEQ ID NO: 3294882 - DNA, 20 bp, Homo sapiens
gagctgcctgttcagctcca

SEQ ID NO: 3294883 - DNA, 18 bp, Homo sapiens
gagctgccttggctcaga

SEQ ID NO: 3294884 - DNA, 21 bp, Homo sapiens
gagctgccttggctcagacat

SEQ ID NO: 3294885 - DNA, 18 bp, Homo sapiens
gagctgctcaccggagtc

SEQ ID NO: 3294886 - DNA, 21 bp, Homo sapiens
gagctgctggcttgcagtgcg

SEQ ID NO: 3294887 - DNA, 19 bp, Homo sapiens
gagctggaaggcagggcag

SEQ ID NO: 3294888 - DNA, 21 bp, Homo sapiens
gagctggaaggcagggcagag

SEQ ID NO: 3294889 - DNA, 11 bp, Homo sapiens
gagctggcctc

SEQ ID NO: 3294890 - DNA, 16 bp, Homo sapiens
gagctggcctctctag

SEQ ID NO: 3294891 - DNA, 12 bp, Homo sapiens
gagctggctctg

SEQ ID NO: 3294892 - DNA, 23 bp, Homo sapiens
gagctgggaagctgtactcagag

SEQ ID NO: 3294893 - DNA, 16 bp, Homo sapiens
gagctgggcaggaagg

SEQ ID NO: 3294894 - DNA, 14 bp, Homo sapiens
gagctgggcatggt

SEQ ID NO: 3294895 - DNA, 12 bp, Homo sapiens
gagctgggccca

SEQ ID NO: 3294896 - DNA, 13 bp, Homo sapiens
gagctgggcccag

SEQ ID NO: 3294897 - DNA, 16 bp, Homo sapiens
gagctgggcccagccc

SEQ ID NO: 3294898 - DNA, 18 bp, Homo sapiens
gagctgggcccagcccct

SEQ ID NO: 3294899 - DNA, 22 bp, Homo sapiens
gagctgggcccagcccctccac

SEQ ID NO: 3294900 - DNA, 13 bp, Homo sapiens
gagctgggcccct

SEQ ID NO: 3294901 - DNA, 14 bp, Homo sapiens
gagctggggccaca

SEQ ID NO: 3294902 - DNA, 21 bp, Homo sapiens
gagctggggctgaagttgctc

SEQ ID NO: 3294903 - DNA, 24 bp, Homo sapiens
gagctgggtggcctgtttctgcag

SEQ ID NO: 3294904 - DNA, 11 bp, Homo sapiens
gagctggtgca

SEQ ID NO: 3294905 - DNA, 14 bp, Homo sapiens
gagctggtgcatta

SEQ ID NO: 3294906 - DNA, 16 bp, Homo sapiens
gagctggtgcattaca

SEQ ID NO: 3294907 - DNA, 18 bp, Homo sapiens
gagctggtgcattacaga

SEQ ID NO: 3294908 - DNA, 15 bp, Homo sapiens
gagctggtgcccgga

SEQ ID NO: 3294909 - DNA, 16 bp, Homo sapiens
gagctggtgcccggag

SEQ ID NO: 3294910 - DNA, 13 bp, Homo sapiens
gaggttgcagtga

SEQ ID NO: 3294911 - DNA, 15 bp, Homo sapiens
gaggttgcagtgagc

SEQ ID NO: 3294912 - DNA, 20 bp, Homo sapiens
gaggttgcagtgagccgaga

SEQ ID NO: 3294913 - DNA, 17 bp, Homo sapiens
gaggttggggtgtacta

SEQ ID NO: 3294914 - DNA, 14 bp, Homo sapiens
gaggttgggtgggc

SEQ ID NO: 3294915 - DNA, 19 bp, Homo sapiens
gaggtttggaagagtgaag

SEQ ID NO: 3294916 - DNA, 23 bp, Homo sapiens
gaggttttattctgacttcctct

SEQ ID NO: 3294917 - DNA, 14 bp, Homo sapiens
gagtaaataaactg

SEQ ID NO: 3294918 - DNA, 20 bp, Homo sapiens
gagtaaataaactgtttata

SEQ ID NO: 3294919 - DNA, 20 bp, Homo sapiens
gagtactagaatttgtattt

SEQ ID NO: 3294920 - DNA, 16 bp, Homo sapiens
gagtactatatttaca

SEQ ID NO: 3294921 - DNA, 17 bp, Homo sapiens
gagtagaattgcattga

SEQ ID NO: 3294922 - DNA, 22 bp, Homo sapiens
gagtagctgggactacaggcac

SEQ ID NO: 3294923 - DNA, 18 bp, Homo sapiens
gagtatacaatatataaa

SEQ ID NO: 3294924 - DNA, 14 bp, Homo sapiens
gagtatatgcactt

SEQ ID NO: 3294925 - DNA, 11 bp, Homo sapiens
gagtatatgtc

SEQ ID NO: 3294926 - DNA, 14 bp, Homo sapiens
gagtatccttcctt

SEQ ID NO: 3294927 - DNA, 16 bp, Homo sapiens
gagtatgtagtggctt

SEQ ID NO: 3294928 - DNA, 20 bp, Homo sapiens
gagtattgtttaaaatgtaa

SEQ ID NO: 3294929 - DNA, 21 bp, Homo sapiens
gagtattgtttaaaatgtaat

SEQ ID NO: 3294930 - DNA, 19 bp, Homo sapiens
gagtcaaaactacaaatca

SEQ ID NO: 3294931 - DNA, 21 bp, Homo sapiens
gagtcaaagctgaccatggat

SEQ ID NO: 3294932 - DNA, 14 bp, Homo sapiens
gagtcaacaggtca

SEQ ID NO: 3294933 - DNA, 12 bp, Homo sapiens
gagtcacacagt

SEQ ID NO: 3294934 - DNA, 13 bp, Homo sapiens
gagtcaccaagcc

SEQ ID NO: 3294935 - DNA, 17 bp, Homo sapiens
gagtcaccaagcccagt

SEQ ID NO: 3294936 - DNA, 22 bp, Homo sapiens
gagtcacctgcaagccccaggg

SEQ ID NO: 3294937 - DNA, 23 bp, Homo sapiens
gagtcacctgcaagccccagggc

SEQ ID NO: 3294938 - DNA, 14 bp, Homo sapiens
gagtcaccttccag

SEQ ID NO: 3294939 - DNA, 18 bp, Homo sapiens
gagtcaccttccaggacc

SEQ ID NO: 3294940 - DNA, 16 bp, Homo sapiens
gagtcacgctggggct

SEQ ID NO: 3294941 - DNA, 21 bp, Homo sapiens
gagtcacgctggggctctctg

SEQ ID NO: 3294942 - DNA, 13 bp, Homo sapiens
gagtcagcacagg

SEQ ID NO: 3294943 - DNA, 23 bp, Homo sapiens
gagtcagtctctttctgtacaag

SEQ ID NO: 3294944 - DNA, 16 bp, Homo sapiens
gagtcagtgtctggct

SEQ ID NO: 3294945 - DNA, 14 bp, Homo sapiens
gagtcatattttga

SEQ ID NO: 3294946 - DNA, 13 bp, Homo sapiens
gagtcatctccat

SEQ ID NO: 3294947 - DNA, 16 bp, Homo sapiens
gagtccaatttaagga

SEQ ID NO: 3294948 - DNA, 15 bp, Homo sapiens
gagtccactgctcca

SEQ ID NO: 3294949 - DNA, 17 bp, Homo sapiens
gagtccactgtggcact

SEQ ID NO: 3294950 - DNA, 22 bp, Homo sapiens
gagtccactttgtttcgtgggg

SEQ ID NO: 3294951 - DNA, 12 bp, Homo sapiens
gagtccagggaa

SEQ ID NO: 3294952 - DNA, 17 bp, Homo sapiens
gagtccattctcccagg

SEQ ID NO: 3294953 - DNA, 18 bp, Homo sapiens
gagtccattctcccaggt

SEQ ID NO: 3294954 - DNA, 21 bp, Homo sapiens
gagtccatttcccacatcttt

SEQ ID NO: 3294955 - DNA, 20 bp, Homo sapiens
gagtcccccctcccacctcc

SEQ ID NO: 3294956 - DNA, 22 bp, Homo sapiens
gagtcccccctcccacctccag

SEQ ID NO: 3294957 - DNA, 18 bp, Homo sapiens
gagtcccctcacctcctc

SEQ ID NO: 3294958 - DNA, 14 bp, Homo sapiens
gagtccctttgaag

SEQ ID NO: 3294959 - DNA, 16 bp, Homo sapiens
gagtcctctagcaggc

SEQ ID NO: 3294960 - DNA, 18 bp, Homo sapiens
gagtcctggtccctctga

SEQ ID NO: 3294961 - DNA, 15 bp, Homo sapiens
gagtcctgtctctgc

SEQ ID NO: 3294962 - DNA, 18 bp, Homo sapiens
gagtccttattcttctca

SEQ ID NO: 3294963 - DNA, 17 bp, Homo sapiens
gagtcgaggacagggag

SEQ ID NO: 3294964 - DNA, 23 bp, Homo sapiens
gagtcgtcatcacttttcagtga

SEQ ID NO: 3294965 - DNA, 16 bp, Homo sapiens
gagtcgttggagactg

SEQ ID NO: 3294966 - DNA, 13 bp, Homo sapiens
gagtctaaagatg

SEQ ID NO: 3294967 - DNA, 16 bp, Homo sapiens
gagtctagatgtttat

SEQ ID NO: 3294968 - DNA, 11 bp, Homo sapiens
gagtctagatt

SEQ ID NO: 3294969 - DNA, 17 bp, Homo sapiens
gagtctagattcaaagg

SEQ ID NO: 3294970 - DNA, 16 bp, Homo sapiens
gagtctagcactcatt

SEQ ID NO: 3294971 - DNA, 21 bp, Homo sapiens
gagtctcactgttgcccaggc

SEQ ID NO: 3294972 - DNA, 23 bp, Homo sapiens
gagtctcactgttgcccaggctg

SEQ ID NO: 3294973 - DNA, 22 bp, Homo sapiens
gagtctcagaaactcccctggg

SEQ ID NO: 3294974 - DNA, 13 bp, Homo sapiens
gagtctcccaagg

SEQ ID NO: 3294975 - DNA, 20 bp, Homo sapiens
gagtctctcactgtcgccca

SEQ ID NO: 3294976 - DNA, 19 bp, Homo sapiens
gagtctctgccacccactc

SEQ ID NO: 3294977 - DNA, 18 bp, Homo sapiens
gagtctcttctccactgg

SEQ ID NO: 3294978 - DNA, 12 bp, Homo sapiens
gagtctgagccc

SEQ ID NO: 3294979 - DNA, 14 bp, Homo sapiens
gagtctgagtcctg

SEQ ID NO: 3294980 - DNA, 15 bp, Homo sapiens
gagtctgagtcctgt

SEQ ID NO: 3294981 - DNA, 18 bp, Homo sapiens
gagtctgagtctgagtcc

SEQ ID NO: 3294982 - DNA, 18 bp, Homo sapiens
gagtctgggcctctgact

SEQ ID NO: 3294983 - DNA, 23 bp, Homo sapiens
gagtctggtgaagctcacttctg

SEQ ID NO: 3294984 - DNA, 12 bp, Homo sapiens
gagtctgtctca

SEQ ID NO: 3294985 - DNA, 20 bp, Homo sapiens
gagtcttacaatcaaatctc

SEQ ID NO: 3294986 - DNA, 22 bp, Homo sapiens
gagtctttgaagctgaaaatat

SEQ ID NO: 3294987 - DNA, 14 bp, Homo sapiens
gagtctttggttct

SEQ ID NO: 3294988 - DNA, 22 bp, Homo sapiens
gagtctttggttctaaggacct

SEQ ID NO: 3294989 - DNA, 23 bp, Homo sapiens
gagtgaaacctttagggcagctt

SEQ ID NO: 3294990 - DNA, 22 bp, Homo sapiens
gagtgaaagggctatggcaagg

SEQ ID NO: 3294991 - DNA, 16 bp, Homo sapiens
gagtgaacctaccttc

SEQ ID NO: 3294992 - DNA, 14 bp, Homo sapiens
gagtgaataaatgt

SEQ ID NO: 3294993 - DNA, 17 bp, Homo sapiens
gagtgaatttgacctag

SEQ ID NO: 3294994 - DNA, 14 bp, Homo sapiens
gagtgacagaggca

SEQ ID NO: 3294995 - DNA, 18 bp, Homo sapiens
gagtgacttattttgtct

SEQ ID NO: 3294996 - DNA, 13 bp, Homo sapiens
gagtgagaccctg

SEQ ID NO: 3294997 - DNA, 14 bp, Homo sapiens
gagtgagactctgt

SEQ ID NO: 3294998 - DNA, 18 bp, Homo sapiens
gagtgagcaagggggccc

SEQ ID NO: 3294999 - DNA, 19 bp, Homo sapiens
gagtgagcaagggggccca

SEQ ID NO: 3295000 - DNA, 15 bp, Homo sapiens
gagtgaggcttccag

SEQ ID NO: 3295001 - DNA, 20 bp, Homo sapiens
gagtgaggcttccaggctct

SEQ ID NO: 3295002 - DNA, 16 bp, Homo sapiens
gagtgaggtgcaggga

SEQ ID NO: 3295003 - DNA, 14 bp, Homo sapiens
gagtgatgatttgg

SEQ ID NO: 3295004 - DNA, 24 bp, Homo sapiens
gagtgattgaaccagctcatctcc

SEQ ID NO: 3295005 - DNA, 22 bp, Homo sapiens
gagtgatttccatctctggtaa

SEQ ID NO: 3295006 - DNA, 12 bp, Homo sapiens
gagtgcacagct

SEQ ID NO: 3295007 - DNA, 16 bp, Homo sapiens
gagtgcacagctgtcc

SEQ ID NO: 3295008 - DNA, 11 bp, Homo sapiens
gagtgcagtga

SEQ ID NO: 3295009 - DNA, 23 bp, Homo sapiens
gagtgcccaccctgggagacaga

SEQ ID NO: 3295010 - DNA, 14 bp, Homo sapiens
gagtgccttttgca

SEQ ID NO: 3295011 - DNA, 14 bp, Homo sapiens
gagtgctggactgt

SEQ ID NO: 3295012 - DNA, 18 bp, Homo sapiens
gagtgctggctcacagta

SEQ ID NO: 3295013 - DNA, 22 bp, Homo sapiens
gagtgctggctcacagtacagc

SEQ ID NO: 3295014 - DNA, 20 bp, Homo sapiens
gagtggaggtgggctgggcc

SEQ ID NO: 3295015 - DNA, 13 bp, Homo sapiens
gagtggcagccat

SEQ ID NO: 3295016 - DNA, 18 bp, Homo sapiens
gagtggcagccatgcctc

SEQ ID NO: 3295017 - DNA, 18 bp, Homo sapiens
gagtggcctcatttcact

SEQ ID NO: 3295018 - DNA, 11 bp, Homo sapiens
gagtggcctcc

SEQ ID NO: 3295019 - DNA, 14 bp, Homo sapiens
gagtggcctccctg

SEQ ID NO: 3295020 - DNA, 15 bp, Homo sapiens
gagtggcctccctgc

SEQ ID NO: 3295021 - DNA, 12 bp, Homo sapiens
gagtggcctggc

SEQ ID NO: 3295022 - DNA, 18 bp, Homo sapiens
gagtggcctggccaggag

SEQ ID NO: 3295023 - DNA, 15 bp, Homo sapiens
gagtgggcacctcag

SEQ ID NO: 3295024 - DNA, 13 bp, Homo sapiens
gagtgggcagagc

SEQ ID NO: 3295025 - DNA, 23 bp, Homo sapiens
gagtgggcagagcccccaggaag

SEQ ID NO: 3295026 - DNA, 19 bp, Homo sapiens
gagtgggggagagcaggct

SEQ ID NO: 3295027 - DNA, 14 bp, Homo sapiens
gagtggggggacag

SEQ ID NO: 3295028 - DNA, 19 bp, Homo sapiens
gagtgggtgacaagagcct

SEQ ID NO: 3295029 - DNA, 16 bp, Homo sapiens
gagtggtgcagacaga

SEQ ID NO: 3295030 - DNA, 13 bp, Homo sapiens
gagtggtggttcc

SEQ ID NO: 3295031 - DNA, 15 bp, Homo sapiens
gagtggttgttgcca

SEQ ID NO: 3295032 - DNA, 17 bp, Homo sapiens
gagtgtaatgtttgtta

SEQ ID NO: 3295033 - DNA, 18 bp, Homo sapiens
gagtgtacttaactattc

SEQ ID NO: 3295034 - DNA, 11 bp, Homo sapiens
gagtgtagaag

SEQ ID NO: 3295035 - DNA, 14 bp, Homo sapiens
gagtgtagaagcat

SEQ ID NO: 3295036 - DNA, 15 bp, Homo sapiens
gagtgtagactgtgg

SEQ ID NO: 3295037 - DNA, 23 bp, Homo sapiens
gatgattaaataagattctaacg

SEQ ID NO: 3295038 - DNA, 12 bp, Homo sapiens
gatgattaaatt

SEQ ID NO: 3295039 - DNA, 19 bp, Homo sapiens
gatgattgcgcagggaggg

SEQ ID NO: 3295040 - DNA, 17 bp, Homo sapiens
gatgatttcatcttctg

SEQ ID NO: 3295041 - DNA, 23 bp, Homo sapiens
gatgattttgcaaaatgagttgt

SEQ ID NO: 3295042 - DNA, 15 bp, Homo sapiens
gatgatttttaactt

SEQ ID NO: 3295043 - DNA, 14 bp, Homo sapiens
gatgatttttgtca

SEQ ID NO: 3295044 - DNA, 17 bp, Homo sapiens
gatgcaagatatttata

SEQ ID NO: 3295045 - DNA, 18 bp, Homo sapiens
gatgcaaggaccaggact

SEQ ID NO: 3295046 - DNA, 22 bp, Homo sapiens
gatgcaaggattacagaaactg

SEQ ID NO: 3295047 - DNA, 16 bp, Homo sapiens
gatgcacatccctgga

SEQ ID NO: 3295048 - DNA, 14 bp, Homo sapiens
gatgcacatttctg

SEQ ID NO: 3295049 - DNA, 18 bp, Homo sapiens
gatgcacatttctggatt

SEQ ID NO: 3295050 - DNA, 14 bp, Homo sapiens
gatgcaccagccct

SEQ ID NO: 3295051 - DNA, 23 bp, Homo sapiens
gatgcaccagcccttagcaggga

SEQ ID NO: 3295052 - DNA, 23 bp, Homo sapiens
gatgcagagagccattttgtgaa

SEQ ID NO: 3295053 - DNA, 14 bp, Homo sapiens
gatgcagccgcctt

SEQ ID NO: 3295054 - DNA, 14 bp, Homo sapiens
gatgcaggacagga

SEQ ID NO: 3295055 - DNA, 16 bp, Homo sapiens
gatgcaggacaggagg

SEQ ID NO: 3295056 - DNA, 20 bp, Homo sapiens
gatgcaggacaggaggcggc

SEQ ID NO: 3295057 - DNA, 23 bp, Homo sapiens
gatgcaggacaggaggcggcccg

SEQ ID NO: 3295058 - DNA, 21 bp, Homo sapiens
gatgcaggcacttattgtaaa

SEQ ID NO: 3295059 - DNA, 22 bp, Homo sapiens
gatgcaggttggaaggggcctt

SEQ ID NO: 3295060 - DNA, 14 bp, Homo sapiens
gatgcagtgcttcc

SEQ ID NO: 3295061 - DNA, 22 bp, Homo sapiens
gatgcatcactgggtgttgatc

SEQ ID NO: 3295062 - DNA, 17 bp, Homo sapiens
gatgcatcgggaaagaa

SEQ ID NO: 3295063 - DNA, 17 bp, Homo sapiens
gatgcatgtcttttaaa

SEQ ID NO: 3295064 - DNA, 19 bp, Homo sapiens
gatgcatttaataaagatg

SEQ ID NO: 3295065 - DNA, 16 bp, Homo sapiens
gatgccaccctagcca

SEQ ID NO: 3295066 - DNA, 22 bp, Homo sapiens
gatgccacgctttgctgctacc

SEQ ID NO: 3295067 - DNA, 18 bp, Homo sapiens
gatgccactcctccctcc

SEQ ID NO: 3295068 - DNA, 24 bp, Homo sapiens
gatgccacttcccagaggcagagc

SEQ ID NO: 3295069 - DNA, 17 bp, Homo sapiens
gatgccagcccctgcct

SEQ ID NO: 3295070 - DNA, 19 bp, Homo sapiens
gatgccagcccctgcctgg

SEQ ID NO: 3295071 - DNA, 15 bp, Homo sapiens
gatgccagcccttca

SEQ ID NO: 3295072 - DNA, 16 bp, Homo sapiens
gatgccatctgtgtcc

SEQ ID NO: 3295073 - DNA, 17 bp, Homo sapiens
gatgccatctgtgtcct

SEQ ID NO: 3295074 - DNA, 18 bp, Homo sapiens
gatgcccagaggactccc

SEQ ID NO: 3295075 - DNA, 19 bp, Homo sapiens
gatgcccagagggcccagg

SEQ ID NO: 3295076 - DNA, 12 bp, Homo sapiens
gatgccccagag

SEQ ID NO: 3295077 - DNA, 16 bp, Homo sapiens
gatgccccagagctgt

SEQ ID NO: 3295078 - DNA, 18 bp, Homo sapiens
gatgccccctccaggaga

SEQ ID NO: 3295079 - DNA, 23 bp, Homo sapiens
gatgccccctccaggagagagcc

SEQ ID NO: 3295080 - DNA, 23 bp, Homo sapiens
gatgcctacaaccatccctgcca

SEQ ID NO: 3295081 - DNA, 15 bp, Homo sapiens
gatgcctggtggcag

SEQ ID NO: 3295082 - DNA, 17 bp, Homo sapiens
gatgcctggtggcagct

SEQ ID NO: 3295083 - DNA, 19 bp, Homo sapiens
gatgcctggtggcagctgc

SEQ ID NO: 3295084 - DNA, 22 bp, Homo sapiens
gatgccttttttgtagtttttt

SEQ ID NO: 3295085 - DNA, 15 bp, Homo sapiens
gatgcggatcctgct

SEQ ID NO: 3295086 - DNA, 21 bp, Homo sapiens
gatgcggtggctcacgcctgt

SEQ ID NO: 3295087 - DNA, 15 bp, Homo sapiens
gatgctatttatgca

SEQ ID NO: 3295088 - DNA, 23 bp, Homo sapiens
gatgctatttatgcaagttaggg

SEQ ID NO: 3295089 - DNA, 20 bp, Homo sapiens
gatgctccaagattctagat

SEQ ID NO: 3295090 - DNA, 22 bp, Homo sapiens
gatgctccaagattctagatga

SEQ ID NO: 3295091 - DNA, 22 bp, Homo sapiens
gatgctccctcagcctcagagg

SEQ ID NO: 3295092 - DNA, 13 bp, Homo sapiens
gatgctccctccc

SEQ ID NO: 3295093 - DNA, 20 bp, Homo sapiens
gatgctccctcccctgccct

SEQ ID NO: 3295094 - DNA, 23 bp, Homo sapiens
gatgctccctcccctgccctggt

SEQ ID NO: 3295095 - DNA, 23 bp, Homo sapiens
gatgctgccagggcgccatcgcc

SEQ ID NO: 3295096 - DNA, 19 bp, Homo sapiens
gatgctgccccgttccctg

SEQ ID NO: 3295097 - DNA, 23 bp, Homo sapiens
gatgctgccccgttccctgtcag

SEQ ID NO: 3295098 - DNA, 15 bp, Homo sapiens
gatgctgctccgccc

SEQ ID NO: 3295099 - DNA, 12 bp, Homo sapiens
gatgctgctttc

SEQ ID NO: 3295100 - DNA, 16 bp, Homo sapiens
gatgctggagaagaga

SEQ ID NO: 3295101 - DNA, 16 bp, Homo sapiens
gatgctggagaggtta

SEQ ID NO: 3295102 - DNA, 13 bp, Homo sapiens
gatgctgggaccc

SEQ ID NO: 3295103 - DNA, 23 bp, Homo sapiens
gatgctgggcacttcatctgatc

SEQ ID NO: 3295104 - DNA, 13 bp, Homo sapiens
gatgctgggctgg

SEQ ID NO: 3295105 - DNA, 20 bp, Homo sapiens
gatgctgggttggtgcacag

SEQ ID NO: 3295106 - DNA, 20 bp, Homo sapiens
gatgctggtaatggccatgg

SEQ ID NO: 3295107 - DNA, 15 bp, Homo sapiens
gatgcttctgggaga

SEQ ID NO: 3295108 - DNA, 16 bp, Homo sapiens
gatggaaaataaacat

SEQ ID NO: 3295109 - DNA, 18 bp, Homo sapiens
gatggaaaataaacatca

SEQ ID NO: 3295110 - DNA, 23 bp, Homo sapiens
gatggaaaggattgtaggtgcaa

SEQ ID NO: 3295111 - DNA, 22 bp, Homo sapiens
gatggaccgggtgggcctggcc

SEQ ID NO: 3295112 - DNA, 14 bp, Homo sapiens
gatggactctgaaa

SEQ ID NO: 3295113 - DNA, 18 bp, Homo sapiens
gatggagaaagaagtgga

SEQ ID NO: 3295114 - DNA, 14 bp, Homo sapiens
gatggagaggacag

SEQ ID NO: 3295115 - DNA, 15 bp, Homo sapiens
gatggagaggcggcc

SEQ ID NO: 3295116 - DNA, 14 bp, Homo sapiens
gatggagcccaggc

SEQ ID NO: 3295117 - DNA, 12 bp, Homo sapiens
gatggagcccat

SEQ ID NO: 3295118 - DNA, 23 bp, Homo sapiens
gatggagcccccagatagagctg

SEQ ID NO: 3295119 - DNA, 22 bp, Homo sapiens
gatggagcgcacctgccccctg

SEQ ID NO: 3295120 - DNA, 12 bp, Homo sapiens
gatggaggaaaa

SEQ ID NO: 3295121 - DNA, 20 bp, Homo sapiens
gatggagggagggggaagtc

SEQ ID NO: 3295122 - DNA, 15 bp, Homo sapiens
gatggagggcttggc

SEQ ID NO: 3295123 - DNA, 17 bp, Homo sapiens
gatggaggttctcagag

SEQ ID NO: 3295124 - DNA, 16 bp, Homo sapiens
gatggagttcttgtgc

SEQ ID NO: 3295125 - DNA, 13 bp, Homo sapiens
gatggagtttcta

SEQ ID NO: 3295126 - DNA, 17 bp, Homo sapiens
gatggataaactgagcc

SEQ ID NO: 3295127 - DNA, 17 bp, Homo sapiens
gatggatggcacaatga

SEQ ID NO: 3295128 - DNA, 16 bp, Homo sapiens
gatggatggcagactc

SEQ ID NO: 3295129 - DNA, 18 bp, Homo sapiens
gatggattctcagatatt

SEQ ID NO: 3295130 - DNA, 13 bp, Homo sapiens
gatggcacaatga

SEQ ID NO: 3295131 - DNA, 13 bp, Homo sapiens
gatggcagactct

SEQ ID NO: 3295132 - DNA, 23 bp, Homo sapiens
gatggcagactctttaataaatt

SEQ ID NO: 3295133 - DNA, 11 bp, Homo sapiens
gatggcagagg

SEQ ID NO: 3295134 - DNA, 15 bp, Homo sapiens
gatggcagaggagct

SEQ ID NO: 3295135 - DNA, 12 bp, Homo sapiens
gatggccccagc

SEQ ID NO: 3295136 - DNA, 14 bp, Homo sapiens
gatggccccagcac

SEQ ID NO: 3295137 - DNA, 16 bp, Homo sapiens
gatggcccctccactg

SEQ ID NO: 3295138 - DNA, 13 bp, Homo sapiens
gatggctgcccct

SEQ ID NO: 3295139 - DNA, 15 bp, Homo sapiens
gatggctgcccctgc

SEQ ID NO: 3295140 - DNA, 19 bp, Homo sapiens
gatggctgtgcctctgcct

SEQ ID NO: 3295141 - DNA, 23 bp, Homo sapiens
gatggcttattttttaaaatatt

SEQ ID NO: 3295142 - DNA, 17 bp, Homo sapiens
gatggcttgacatgtgc

SEQ ID NO: 3295143 - DNA, 18 bp, Homo sapiens
gatgggaaaatatttcct

SEQ ID NO: 3295144 - DNA, 14 bp, Homo sapiens
gatgggaccaggga

SEQ ID NO: 3295145 - DNA, 15 bp, Homo sapiens
gatgggagtgagaca

SEQ ID NO: 3295146 - DNA, 14 bp, Homo sapiens
gatgggagtgggca

SEQ ID NO: 3295147 - DNA, 20 bp, Homo sapiens
gatgggagtgggcacctcag

SEQ ID NO: 3295148 - DNA, 16 bp, Homo sapiens
gatgggcaaagcttgt

SEQ ID NO: 3295149 - DNA, 18 bp, Homo sapiens
gatgggcaaagcttgtca

SEQ ID NO: 3295150 - DNA, 15 bp, Homo sapiens
gatgggcacttgaga

SEQ ID NO: 3295151 - DNA, 13 bp, Homo sapiens
gatgggccaccgc

SEQ ID NO: 3295152 - DNA, 19 bp, Homo sapiens
gatgggcggacggctgtgg

SEQ ID NO: 3295153 - DNA, 22 bp, Homo sapiens
gatggggcctccctccttgggt

SEQ ID NO: 3295154 - DNA, 21 bp, Homo sapiens
gatggggctggcatgttttct

SEQ ID NO: 3295155 - DNA, 14 bp, Homo sapiens
gatgggggaaaaaa

SEQ ID NO: 3295156 - DNA, 16 bp, Homo sapiens
gatgggggaactgtga

SEQ ID NO: 3295157 - DNA, 18 bp, Homo sapiens
gatggggggctgatggct

SEQ ID NO: 3295158 - DNA, 12 bp, Homo sapiens
gatgggggtggc

SEQ ID NO: 3295159 - DNA, 15 bp, Homo sapiens
gatgggggtggctgg

SEQ ID NO: 3295160 - DNA, 16 bp, Homo sapiens
gatgggtgctggtcct

SEQ ID NO: 3295161 - DNA, 19 bp, Homo sapiens
gatgggtgctggtcctgtt

SEQ ID NO: 3295162 - DNA, 13 bp, Homo sapiens
gatgggtgggggc

SEQ ID NO: 3295163 - DNA, 17 bp, Homo sapiens
gcaagaggggtggagac

SEQ ID NO: 3295164 - DNA, 17 bp, Homo sapiens
gcaagcaagctctcttg

SEQ ID NO: 3295165 - DNA, 14 bp, Homo sapiens
gcaagcagggaaag

SEQ ID NO: 3295166 - DNA, 22 bp, Homo sapiens
gcaagcagggaaagctccacgg

SEQ ID NO: 3295167 - DNA, 20 bp, Homo sapiens
gcaagcatttatgtttattt

SEQ ID NO: 3295168 - DNA, 17 bp, Homo sapiens
gcaagcccctcagccct

SEQ ID NO: 3295169 - DNA, 23 bp, Homo sapiens
gcaagcccctcagcccttgcccc

SEQ ID NO: 3295170 - DNA, 20 bp, Homo sapiens
gcaagcccttcggtcacctg

SEQ ID NO: 3295171 - DNA, 22 bp, Homo sapiens
gcaagctgccgaaccaaaagaa

SEQ ID NO: 3295172 - DNA, 16 bp, Homo sapiens
gcaaggaaaaacaggt

SEQ ID NO: 3295173 - DNA, 14 bp, Homo sapiens
gcaaggattacaga

SEQ ID NO: 3295174 - DNA, 13 bp, Homo sapiens
gcaaggcaggtgc

SEQ ID NO: 3295175 - DNA, 18 bp, Homo sapiens
gcaaggcaggtgcctcca

SEQ ID NO: 3295176 - DNA, 15 bp, Homo sapiens
gcaaggcaggttgga

SEQ ID NO: 3295177 - DNA, 19 bp, Homo sapiens
gcaaggcaggttggatggg

SEQ ID NO: 3295178 - DNA, 21 bp, Homo sapiens
gcaaggcagtctctatattat

SEQ ID NO: 3295179 - DNA, 13 bp, Homo sapiens
gcaaggcccacag

SEQ ID NO: 3295180 - DNA, 16 bp, Homo sapiens
gcaaggcccacaggag

SEQ ID NO: 3295181 - DNA, 14 bp, Homo sapiens
gcaaggccctgctg

SEQ ID NO: 3295182 - DNA, 15 bp, Homo sapiens
gcaaggctatgtgat

SEQ ID NO: 3295183 - DNA, 13 bp, Homo sapiens
gcaagggaccttc

SEQ ID NO: 3295184 - DNA, 15 bp, Homo sapiens
gcaagggagaaaaga

SEQ ID NO: 3295185 - DNA, 19 bp, Homo sapiens
gcaagggagaaaagagaaa

SEQ ID NO: 3295186 - DNA, 18 bp, Homo sapiens
gcaagggcatcaggcact

SEQ ID NO: 3295187 - DNA, 10 bp, Homo sapiens
gcaagggctc

SEQ ID NO: 3295188 - DNA, 13 bp, Homo sapiens
gcaagggctccag

SEQ ID NO: 3295189 - DNA, 14 bp, Homo sapiens
gcaagggctccagc

SEQ ID NO: 3295190 - DNA, 17 bp, Homo sapiens
gcaagggctccagcatc

SEQ ID NO: 3295191 - DNA, 19 bp, Homo sapiens
gcaagggctccagcatcca

SEQ ID NO: 3295192 - DNA, 14 bp, Homo sapiens
gcaaggggctctgc

SEQ ID NO: 3295193 - DNA, 17 bp, Homo sapiens
gcaaggtactctggtga

SEQ ID NO: 3295194 - DNA, 15 bp, Homo sapiens
gcaaggtagcatggg

SEQ ID NO: 3295195 - DNA, 15 bp, Homo sapiens
gcaaggtcatttctt

SEQ ID NO: 3295196 - DNA, 18 bp, Homo sapiens
gcaaggtccggcccatcc

SEQ ID NO: 3295197 - DNA, 14 bp, Homo sapiens
gcaaggtgctcaca

SEQ ID NO: 3295198 - DNA, 19 bp, Homo sapiens
gcaaggttaagcaaggtgg

SEQ ID NO: 3295199 - DNA, 14 bp, Homo sapiens
gcaagtagataaat

SEQ ID NO: 3295200 - DNA, 19 bp, Homo sapiens
gcaagtcagaggatggcca

SEQ ID NO: 3295201 - DNA, 19 bp, Homo sapiens
gcaagtcagattgctggga

SEQ ID NO: 3295202 - DNA, 20 bp, Homo sapiens
gcaagtcagattgctgggag

SEQ ID NO: 3295203 - DNA, 21 bp, Homo sapiens
gcaagtctgcagcccggcgcc

SEQ ID NO: 3295204 - DNA, 23 bp, Homo sapiens
gcaagtctgtgagtgcgtctgag

SEQ ID NO: 3295205 - DNA, 13 bp, Homo sapiens
gcaagtgtctgga

SEQ ID NO: 3295206 - DNA, 16 bp, Homo sapiens
gcaagtgtctggagcg

SEQ ID NO: 3295207 - DNA, 22 bp, Homo sapiens
gcaagtgtggggggtccttctc

SEQ ID NO: 3295208 - DNA, 22 bp, Homo sapiens
gcaagttatattagtgaagatg

SEQ ID NO: 3295209 - DNA, 13 bp, Homo sapiens
gcaataaaaaaat

SEQ ID NO: 3295210 - DNA, 15 bp, Homo sapiens
gcaataaaatttaaa

SEQ ID NO: 3295211 - DNA, 11 bp, Homo sapiens
gcaataaactc

SEQ ID NO: 3295212 - DNA, 14 bp, Homo sapiens
gcaataaataacac

SEQ ID NO: 3295213 - DNA, 17 bp, Homo sapiens
gcaataaatttatatac

SEQ ID NO: 3295214 - DNA, 14 bp, Homo sapiens
gcaataacttctga

SEQ ID NO: 3295215 - DNA, 20 bp, Homo sapiens
gcaataatggtcccatccag

SEQ ID NO: 3295216 - DNA, 13 bp, Homo sapiens
gcaataattgttt

SEQ ID NO: 3295217 - DNA, 15 bp, Homo sapiens
gcaatactcatcaga

SEQ ID NO: 3295218 - DNA, 16 bp, Homo sapiens
gcaatactcatcagag

SEQ ID NO: 3295219 - DNA, 15 bp, Homo sapiens
gcaatagagactgta

SEQ ID NO: 3295220 - DNA, 18 bp, Homo sapiens
gcaatagcagttataaca

SEQ ID NO: 3295221 - DNA, 20 bp, Homo sapiens
gcaatagcagttataacaga

SEQ ID NO: 3295222 - DNA, 21 bp, Homo sapiens
gcaataggtaaatggggccca

SEQ ID NO: 3295223 - DNA, 17 bp, Homo sapiens
gcaatagtgggccctcc

SEQ ID NO: 3295224 - DNA, 20 bp, Homo sapiens
gcaatagtgtgttctgatta

SEQ ID NO: 3295225 - DNA, 16 bp, Homo sapiens
gcaatagttttttact

SEQ ID NO: 3295226 - DNA, 21 bp, Homo sapiens
gcaatagttttttacttctct

SEQ ID NO: 3295227 - DNA, 14 bp, Homo sapiens
gcaatatgtaaata

SEQ ID NO: 3295228 - DNA, 22 bp, Homo sapiens
gcaatattgtatatttttatct

SEQ ID NO: 3295229 - DNA, 23 bp, Homo sapiens
gcaatcaaaaatatgtgttttta

SEQ ID NO: 3295230 - DNA, 13 bp, Homo sapiens
gcaatccatgtta

SEQ ID NO: 3295231 - DNA, 20 bp, Homo sapiens
gcaatccatgttagttttta

SEQ ID NO: 3295232 - DNA, 21 bp, Homo sapiens
gcaatctccccttgatttaaa

SEQ ID NO: 3295233 - DNA, 19 bp, Homo sapiens
gcaatctcggctcactgca

SEQ ID NO: 3295234 - DNA, 22 bp, Homo sapiens
gcaatctgaccctatgggtcta

SEQ ID NO: 3295235 - DNA, 14 bp, Homo sapiens
gcaatcttctactt

SEQ ID NO: 3295236 - DNA, 13 bp, Homo sapiens
gcaatgaaggaaa

SEQ ID NO: 3295237 - DNA, 19 bp, Homo sapiens
gcaatgacaggtaaattaa

SEQ ID NO: 3295238 - DNA, 16 bp, Homo sapiens
gcaatgatgaatgaga

SEQ ID NO: 3295239 - DNA, 21 bp, Homo sapiens
gcaatgcctagacttcccaac

SEQ ID NO: 3295240 - DNA, 14 bp, Homo sapiens
gcaatgctggctgt

SEQ ID NO: 3295241 - DNA, 15 bp, Homo sapiens
gcaatgctgtacttt

SEQ ID NO: 3295242 - DNA, 17 bp, Homo sapiens
gcaatgcttaaactaaa

SEQ ID NO: 3295243 - DNA, 18 bp, Homo sapiens
gcaatgcttaaactaaat

SEQ ID NO: 3295244 - DNA, 20 bp, Homo sapiens
gcaatgcttcgttttctaaa

SEQ ID NO: 3295245 - DNA, 15 bp, Homo sapiens
gcaatgcttctgtag

SEQ ID NO: 3295246 - DNA, 16 bp, Homo sapiens
gcaatgcttctgtagc

SEQ ID NO: 3295247 - DNA, 12 bp, Homo sapiens
gcaatggcagcc

SEQ ID NO: 3295248 - DNA, 13 bp, Homo sapiens
gcaatggcagcct

SEQ ID NO: 3295249 - DNA, 15 bp, Homo sapiens
gcaatggcagccttg

SEQ ID NO: 3295250 - DNA, 22 bp, Homo sapiens
gcaatggtgtcagtatccaggc

SEQ ID NO: 3295251 - DNA, 23 bp, Homo sapiens
gcaatggtgtcagtatccaggct

SEQ ID NO: 3295252 - DNA, 18 bp, Homo sapiens
gcaatgtcacaacctctc

SEQ ID NO: 3295253 - DNA, 14 bp, Homo sapiens
gcaatgtgaaaaat

SEQ ID NO: 3295254 - DNA, 14 bp, Homo sapiens
gcaatgtgctactg

SEQ ID NO: 3295255 - DNA, 22 bp, Homo sapiens
gcaattcaaaagttccaagagt

SEQ ID NO: 3295256 - DNA, 14 bp, Homo sapiens
gcaattcataaaaa

SEQ ID NO: 3295257 - DNA, 15 bp, Homo sapiens
gcaattccgcattta

SEQ ID NO: 3295258 - DNA, 23 bp, Homo sapiens
gcaattctcctgcctcagcctcc

SEQ ID NO: 3295259 - DNA, 14 bp, Homo sapiens
gcaattgccctgta

SEQ ID NO: 3295260 - DNA, 22 bp, Homo sapiens
gcaattgtctatttatctttta

SEQ ID NO: 3295261 - DNA, 13 bp, Homo sapiens
gcaatttcaaggt

SEQ ID NO: 3295262 - DNA, 18 bp, Homo sapiens
gcaatttcaaggttctaa

SEQ ID NO: 3295263 - DNA, 18 bp, Homo sapiens
gcaatttccttttttgtt

SEQ ID NO: 3295264 - DNA, 17 bp, Homo sapiens
gcaatttctaattttta

SEQ ID NO: 3295265 - DNA, 22 bp, Homo sapiens
gcaatttctaatttttaagaat

SEQ ID NO: 3295266 - DNA, 23 bp, Homo sapiens
gcaatttttccatgaagtttgaa

SEQ ID NO: 3295267 - DNA, 14 bp, Homo sapiens
gcacaaatatttat

SEQ ID NO: 3295268 - DNA, 24 bp, Homo sapiens
gcacaagaagcgtgagacgccacc

SEQ ID NO: 3295269 - DNA, 14 bp, Homo sapiens
gcacaagcagagtg

SEQ ID NO: 3295270 - DNA, 21 bp, Homo sapiens
gcacaagcagagtgcacagct

SEQ ID NO: 3295271 - DNA, 22 bp, Homo sapiens
gcacaagcagagtgcacagctg

SEQ ID NO: 3295272 - DNA, 22 bp, Homo sapiens
gcacaagctcagaatagatctg

SEQ ID NO: 3295273 - DNA, 23 bp, Homo sapiens
gcacaaggaaagttattttcaga

SEQ ID NO: 3295274 - DNA, 18 bp, Homo sapiens
gcacaatcactaaacttt

SEQ ID NO: 3295275 - DNA, 15 bp, Homo sapiens
gcacaatgaatgtat

SEQ ID NO: 3295276 - DNA, 12 bp, Homo sapiens
gcacaatttgca

SEQ ID NO: 3295277 - DNA, 19 bp, Homo sapiens
gcacaatttgcactaaatc

SEQ ID NO: 3295278 - DNA, 21 bp, Homo sapiens
gcacacacacacacatgcaca

SEQ ID NO: 3295279 - DNA, 22 bp, Homo sapiens
gcacacacacacacatgcacac

SEQ ID NO: 3295280 - DNA, 13 bp, Homo sapiens
gcacacacagctc

SEQ ID NO: 3295281 - DNA, 16 bp, Homo sapiens
gcacacacagctcctc

SEQ ID NO: 3295282 - DNA, 19 bp, Homo sapiens
gcacacaccagagcccacc

SEQ ID NO: 3295283 - DNA, 17 bp, Homo sapiens
gcacacacctccgagac

SEQ ID NO: 3295284 - DNA, 15 bp, Homo sapiens
gcacacactcagtgc

SEQ ID NO: 3295285 - DNA, 14 bp, Homo sapiens
gcacacagaaatat

SEQ ID NO: 3295286 - DNA, 22 bp, Homo sapiens
gcacacagaaatatatatacat

SEQ ID NO: 3295287 - DNA, 12 bp, Homo sapiens
gcacacagcagc

SEQ ID NO: 3295288 - DNA, 13 bp, Homo sapiens
gcacacagcagcc

SEQ ID NO: 3295289 - DNA, 15 bp, Homo sapiens
gcagaggggccaggc

SEQ ID NO: 3295290 - DNA, 21 bp, Homo sapiens
gcagaggggctttctggagag

SEQ ID NO: 3295291 - DNA, 18 bp, Homo sapiens
gcagagggggagtagcca

SEQ ID NO: 3295292 - DNA, 20 bp, Homo sapiens
gcagagtcgttggagactga

SEQ ID NO: 3295293 - DNA, 15 bp, Homo sapiens
gcagagtctgggcct

SEQ ID NO: 3295294 - DNA, 20 bp, Homo sapiens
gcagagtgagcaagggggcc

SEQ ID NO: 3295295 - DNA, 16 bp, Homo sapiens
gcagagtgcacagctg

SEQ ID NO: 3295296 - DNA, 18 bp, Homo sapiens
gcagagtgcacagctgtc

SEQ ID NO: 3295297 - DNA, 14 bp, Homo sapiens
gcagagtggactgc

SEQ ID NO: 3295298 - DNA, 19 bp, Homo sapiens
gcagagtggactgcattta

SEQ ID NO: 3295299 - DNA, 21 bp, Homo sapiens
gcagagttacagttctgtggt

SEQ ID NO: 3295300 - DNA, 13 bp, Homo sapiens
gcagagtttgcct

SEQ ID NO: 3295301 - DNA, 21 bp, Homo sapiens
gcagataacaatgcagcaagg

SEQ ID NO: 3295302 - DNA, 14 bp, Homo sapiens
gcagataacttttt

SEQ ID NO: 3295303 - DNA, 22 bp, Homo sapiens
gcagatacaggaaaagctgctg

SEQ ID NO: 3295304 - DNA, 21 bp, Homo sapiens
gcagatcgctcactgttgtga

SEQ ID NO: 3295305 - DNA, 13 bp, Homo sapiens
gcagatctgtgcc

SEQ ID NO: 3295306 - DNA, 22 bp, Homo sapiens
gcagatctgtgccccatgcctg

SEQ ID NO: 3295307 - DNA, 22 bp, Homo sapiens
gcagatgacacgcgctctccac

SEQ ID NO: 3295308 - DNA, 13 bp, Homo sapiens
gcagatgatccat

SEQ ID NO: 3295309 - DNA, 22 bp, Homo sapiens
gcagatggaatgctgtgttaaa

SEQ ID NO: 3295310 - DNA, 15 bp, Homo sapiens
gcagatgggcggacg

SEQ ID NO: 3295311 - DNA, 15 bp, Homo sapiens
gcagattcctgggcc

SEQ ID NO: 3295312 - DNA, 21 bp, Homo sapiens
gcagattttcagcaaactctt

SEQ ID NO: 3295313 - DNA, 14 bp, Homo sapiens
gcagcaaaaatata

SEQ ID NO: 3295314 - DNA, 18 bp, Homo sapiens
gcagcaaaaatataaaat

SEQ ID NO: 3295315 - DNA, 13 bp, Homo sapiens
gcagcacagccca

SEQ ID NO: 3295316 - DNA, 17 bp, Homo sapiens
gcagcacagcccagggc

SEQ ID NO: 3295317 - DNA, 19 bp, Homo sapiens
gcagcacagcccagggcct

SEQ ID NO: 3295318 - DNA, 17 bp, Homo sapiens
gcagcaccaaccacagc

SEQ ID NO: 3295319 - DNA, 15 bp, Homo sapiens
gcagcacctccaggc

SEQ ID NO: 3295320 - DNA, 19 bp, Homo sapiens
gcagcacctccaggcctgt

SEQ ID NO: 3295321 - DNA, 12 bp, Homo sapiens
gcagcacctcct

SEQ ID NO: 3295322 - DNA, 18 bp, Homo sapiens
gcagcacggacaataaac

SEQ ID NO: 3295323 - DNA, 21 bp, Homo sapiens
gcagcactccccagagctgtg

SEQ ID NO: 3295324 - DNA, 15 bp, Homo sapiens
gcagcagataacttt

SEQ ID NO: 3295325 - DNA, 11 bp, Homo sapiens
gcagcagccac

SEQ ID NO: 3295326 - DNA, 22 bp, Homo sapiens
gcagcagccatcataggaaggg

SEQ ID NO: 3295327 - DNA, 19 bp, Homo sapiens
gcagcagcccagcttcctg

SEQ ID NO: 3295328 - DNA, 23 bp, Homo sapiens
gcagcagcttttaatacagggta

SEQ ID NO: 3295329 - DNA, 15 bp, Homo sapiens
gcagcaggtgtggcc

SEQ ID NO: 3295330 - DNA, 20 bp, Homo sapiens
gcagcagtagctttggggaa

SEQ ID NO: 3295331 - DNA, 17 bp, Homo sapiens
gcagcagtgagtctctt

SEQ ID NO: 3295332 - DNA, 15 bp, Homo sapiens
gcagcatcttcaaac

SEQ ID NO: 3295333 - DNA, 21 bp, Homo sapiens
gcagcatcttcaaacatgtac

SEQ ID NO: 3295334 - DNA, 20 bp, Homo sapiens
gcagcatgcttgggctgacc

SEQ ID NO: 3295335 - DNA, 23 bp, Homo sapiens
gcagcatgcttgggctgacccag

SEQ ID NO: 3295336 - DNA, 15 bp, Homo sapiens
gcagcatggaaaaat

SEQ ID NO: 3295337 - DNA, 23 bp, Homo sapiens
gcagcatggaaaaatggttgatg

SEQ ID NO: 3295338 - DNA, 14 bp, Homo sapiens
gcagcatggcatag

SEQ ID NO: 3295339 - DNA, 16 bp, Homo sapiens
gcagcatggcatagcc

SEQ ID NO: 3295340 - DNA, 20 bp, Homo sapiens
gcagcatggtccctgcctta

SEQ ID NO: 3295341 - DNA, 21 bp, Homo sapiens
gcagccaaggccgaagctctg

SEQ ID NO: 3295342 - DNA, 23 bp, Homo sapiens
gcagccaaggccgaagctctggc

SEQ ID NO: 3295343 - DNA, 19 bp, Homo sapiens
gcagccacccaagcctgct

SEQ ID NO: 3295344 - DNA, 12 bp, Homo sapiens
gcagccagcaga

SEQ ID NO: 3295345 - DNA, 15 bp, Homo sapiens
gcagccagccagtct

SEQ ID NO: 3295346 - DNA, 20 bp, Homo sapiens
gcagccagccggtgcctggc

SEQ ID NO: 3295347 - DNA, 12 bp, Homo sapiens
gcagccaggctg

SEQ ID NO: 3295348 - DNA, 13 bp, Homo sapiens
gcagccagttcaa

SEQ ID NO: 3295349 - DNA, 11 bp, Homo sapiens
gcagccatgcc

SEQ ID NO: 3295350 - DNA, 18 bp, Homo sapiens
gcagccatgcctcatgcc

SEQ ID NO: 3295351 - DNA, 13 bp, Homo sapiens
gcagcccagcttc

SEQ ID NO: 3295352 - DNA, 19 bp, Homo sapiens
gcagcccagcttcctggtg

SEQ ID NO: 3295353 - DNA, 15 bp, Homo sapiens
gcagcccatgcccac

SEQ ID NO: 3295354 - DNA, 14 bp, Homo sapiens
gcagccccagagag

SEQ ID NO: 3295355 - DNA, 18 bp, Homo sapiens
gcagccccattctgcctg

SEQ ID NO: 3295356 - DNA, 19 bp, Homo sapiens
gcagccccattctgcctgc

SEQ ID NO: 3295357 - DNA, 24 bp, Homo sapiens
gcagccccattctgcctgcccagg

SEQ ID NO: 3295358 - DNA, 15 bp, Homo sapiens
gcagccccccagcac

SEQ ID NO: 3295359 - DNA, 13 bp, Homo sapiens
gcagccccctcca

SEQ ID NO: 3295360 - DNA, 16 bp, Homo sapiens
gcagccccctccacac

SEQ ID NO: 3295361 - DNA, 19 bp, Homo sapiens
gcagccccctccacaccag

SEQ ID NO: 3295362 - DNA, 23 bp, Homo sapiens
gcagccccgcgcctccttccttg

SEQ ID NO: 3295363 - DNA, 15 bp, Homo sapiens
gcagcccgtgaagca

SEQ ID NO: 3295364 - DNA, 15 bp, Homo sapiens
gcagccctcaacagg

SEQ ID NO: 3295365 - DNA, 23 bp, Homo sapiens
gcagccctcaacaggcccaggga

SEQ ID NO: 3295366 - DNA, 24 bp, Homo sapiens
gcagccctgctttgggctgccctg

SEQ ID NO: 3295367 - DNA, 14 bp, Homo sapiens
gcagccgccagctg

SEQ ID NO: 3295368 - DNA, 14 bp, Homo sapiens
gcagccgccttcct

SEQ ID NO: 3295369 - DNA, 18 bp, Homo sapiens
gcagccgccttccttgac

SEQ ID NO: 3295370 - DNA, 20 bp, Homo sapiens
gcagccgccttccttgacct

SEQ ID NO: 3295371 - DNA, 18 bp, Homo sapiens
gcagccggcacagggtct

SEQ ID NO: 3295372 - DNA, 17 bp, Homo sapiens
gcagccgtgccttcagc

SEQ ID NO: 3295373 - DNA, 20 bp, Homo sapiens
gcagcctatgggggctctcg

SEQ ID NO: 3295374 - DNA, 19 bp, Homo sapiens
gcagcctcaacctcctggg

SEQ ID NO: 3295375 - DNA, 20 bp, Homo sapiens
gcagcctcaacctcctgggc

SEQ ID NO: 3295376 - DNA, 22 bp, Homo sapiens
gcagcctcaacctcctgggcta

SEQ ID NO: 3295377 - DNA, 14 bp, Homo sapiens
gcagcctccagagc

SEQ ID NO: 3295378 - DNA, 17 bp, Homo sapiens
gcagcctccagagccag

SEQ ID NO: 3295379 - DNA, 19 bp, Homo sapiens
gcagcctccagagccagcc

SEQ ID NO: 3295380 - DNA, 23 bp, Homo sapiens
gcagcctccagagccagcctggg

SEQ ID NO: 3295381 - DNA, 14 bp, Homo sapiens
gcagcctccctctg

SEQ ID NO: 3295382 - DNA, 22 bp, Homo sapiens
gcagcctccctctgacctgcag

SEQ ID NO: 3295383 - DNA, 18 bp, Homo sapiens
gcagcctcctcctgacca

SEQ ID NO: 3295384 - DNA, 15 bp, Homo sapiens
gcagcctgatggcca

SEQ ID NO: 3295385 - DNA, 19 bp, Homo sapiens
gcagcctgatggccaaggg

SEQ ID NO: 3295386 - DNA, 23 bp, Homo sapiens
gcagcctgcgccaccgcccagag

SEQ ID NO: 3295387 - DNA, 20 bp, Homo sapiens
gcagcctgcgctcggcagga

SEQ ID NO: 3295388 - DNA, 16 bp, Homo sapiens
gcagcctgctctagtg

SEQ ID NO: 3295389 - DNA, 14 bp, Homo sapiens
gcagcctgtggcat

SEQ ID NO: 3295390 - DNA, 15 bp, Homo sapiens
gcagccttggcaaac

SEQ ID NO: 3295391 - DNA, 15 bp, Homo sapiens
gcagcctttaatgca

SEQ ID NO: 3295392 - DNA, 18 bp, Homo sapiens
gcagcctttgcctccccg

SEQ ID NO: 3295393 - DNA, 21 bp, Homo sapiens
gcagcgagggcggagccggcc

SEQ ID NO: 3295394 - DNA, 24 bp, Homo sapiens
gcagcgagttgtggaaagcctctg

SEQ ID NO: 3295395 - DNA, 18 bp, Homo sapiens
gcagcgccaagcaacctg

SEQ ID NO: 3295396 - DNA, 16 bp, Homo sapiens
gcagcgcccctctgca

SEQ ID NO: 3295397 - DNA, 12 bp, Homo sapiens
gcagcgggccag

SEQ ID NO: 3295398 - DNA, 15 bp, Homo sapiens
gcagcgggccaggcc

SEQ ID NO: 3295399 - DNA, 15 bp, Homo sapiens
gcagcgggcggaggg

SEQ ID NO: 3295400 - DNA, 21 bp, Homo sapiens
gcagcggggcgaagcccaggc

SEQ ID NO: 3295401 - DNA, 17 bp, Homo sapiens
gcagctaacaatgtctg

SEQ ID NO: 3295402 - DNA, 22 bp, Homo sapiens
gcagctagactggagtgaggct

SEQ ID NO: 3295403 - DNA, 14 bp, Homo sapiens
gcagctaggactga

SEQ ID NO: 3295404 - DNA, 18 bp, Homo sapiens
gcagctaggactgaggag

SEQ ID NO: 3295405 - DNA, 13 bp, Homo sapiens
gcagctagtgcct

SEQ ID NO: 3295406 - DNA, 14 bp, Homo sapiens
gcagctagttttct

SEQ ID NO: 3295407 - DNA, 21 bp, Homo sapiens
gcagctatgcgcaatgtggca

SEQ ID NO: 3295408 - DNA, 13 bp, Homo sapiens
gcagctcacccct

SEQ ID NO: 3295409 - DNA, 17 bp, Homo sapiens
gcagctcacccctgggc

SEQ ID NO: 3295410 - DNA, 13 bp, Homo sapiens
gcagctcctcagc

SEQ ID NO: 3295411 - DNA, 13 bp, Homo sapiens
gcagctcctctcc

SEQ ID NO: 3295412 - DNA, 17 bp, Homo sapiens
gcagctcctctccttgg

SEQ ID NO: 3295413 - DNA, 19 bp, Homo sapiens
gcagctcctctccttgggc

SEQ ID NO: 3295414 - DNA, 15 bp, Homo sapiens
gcagctctccagtca

SEQ ID NO: 3295415 - DNA, 16 bp, Homo sapiens
gcatagcagaggggcc

SEQ ID NO: 3295416 - DNA, 18 bp, Homo sapiens
gcatagcagaggggccag

SEQ ID NO: 3295417 - DNA, 22 bp, Homo sapiens
gcatagcagaggggccaggccc

SEQ ID NO: 3295418 - DNA, 22 bp, Homo sapiens
gcatagctactaaaatcagtga

SEQ ID NO: 3295419 - DNA, 19 bp, Homo sapiens
gcataggacctttccacca

SEQ ID NO: 3295420 - DNA, 24 bp, Homo sapiens
gcataggctcttaagcagcatgga

SEQ ID NO: 3295421 - DNA, 20 bp, Homo sapiens
gcatataattttcacttctg

SEQ ID NO: 3295422 - DNA, 17 bp, Homo sapiens
gcatataggtgatgttt

SEQ ID NO: 3295423 - DNA, 19 bp, Homo sapiens
gcatataggtgatgtttgc

SEQ ID NO: 3295424 - DNA, 15 bp, Homo sapiens
gcatatatgttcttc

SEQ ID NO: 3295425 - DNA, 16 bp, Homo sapiens
gcatatcctgagccat

SEQ ID NO: 3295426 - DNA, 21 bp, Homo sapiens
gcatatctggtcagaactgca

SEQ ID NO: 3295427 - DNA, 15 bp, Homo sapiens
gcatatgtgttactt

SEQ ID NO: 3295428 - DNA, 21 bp, Homo sapiens
gcatatgttgaatacttttta

SEQ ID NO: 3295429 - DNA, 20 bp, Homo sapiens
gcatattcctttctatcatt

SEQ ID NO: 3295430 - DNA, 22 bp, Homo sapiens
gcatattcttttctgcaaaata

SEQ ID NO: 3295431 - DNA, 19 bp, Homo sapiens
gcatattgttggcacagaa

SEQ ID NO: 3295432 - DNA, 23 bp, Homo sapiens
gcatatttatagcaatccatgtt

SEQ ID NO: 3295433 - DNA, 18 bp, Homo sapiens
gcatatttgccaataaag

SEQ ID NO: 3295434 - DNA, 15 bp, Homo sapiens
gcatattttgctggt

SEQ ID NO: 3295435 - DNA, 13 bp, Homo sapiens
gcatcaatacaac

SEQ ID NO: 3295436 - DNA, 14 bp, Homo sapiens
gcatcacagggcag

SEQ ID NO: 3295437 - DNA, 15 bp, Homo sapiens
gcatcacagggcaga

SEQ ID NO: 3295438 - DNA, 19 bp, Homo sapiens
gcatcagaggtttgcttcc

SEQ ID NO: 3295439 - DNA, 12 bp, Homo sapiens
gcatcaggcact

SEQ ID NO: 3295440 - DNA, 13 bp, Homo sapiens
gcatcaggcactg

SEQ ID NO: 3295441 - DNA, 15 bp, Homo sapiens
gcatcaggcactggt

SEQ ID NO: 3295442 - DNA, 20 bp, Homo sapiens
gcatcatctgtagatactag

SEQ ID NO: 3295443 - DNA, 18 bp, Homo sapiens
gcatccaatctcaaggaa

SEQ ID NO: 3295444 - DNA, 19 bp, Homo sapiens
gcatccaatctcaaggaat

SEQ ID NO: 3295445 - DNA, 21 bp, Homo sapiens
gcatccacccagtgctgccat

SEQ ID NO: 3295446 - DNA, 24 bp, Homo sapiens
gcatccacccagtgctgccatgcc

SEQ ID NO: 3295447 - DNA, 15 bp, Homo sapiens
gcatccaccttggct

SEQ ID NO: 3295448 - DNA, 15 bp, Homo sapiens
gcatccagcctgtgt

SEQ ID NO: 3295449 - DNA, 21 bp, Homo sapiens
gcatcccagcacctgcctcct

SEQ ID NO: 3295450 - DNA, 15 bp, Homo sapiens
gcatcccaggggacc

SEQ ID NO: 3295451 - DNA, 16 bp, Homo sapiens
gcatcccaggggacca

SEQ ID NO: 3295452 - DNA, 13 bp, Homo sapiens
gcatcccggagga

SEQ ID NO: 3295453 - DNA, 16 bp, Homo sapiens
gcatcccggaggaaat

SEQ ID NO: 3295454 - DNA, 18 bp, Homo sapiens
gcatcccggaggaaatct

SEQ ID NO: 3295455 - DNA, 20 bp, Homo sapiens
gcatccctggagcaggagcc

SEQ ID NO: 3295456 - DNA, 21 bp, Homo sapiens
gcatccctggagcaggagccc

SEQ ID NO: 3295457 - DNA, 16 bp, Homo sapiens
gcatccgcaggtgctg

SEQ ID NO: 3295458 - DNA, 18 bp, Homo sapiens
gcatccgcaggtgctggt

SEQ ID NO: 3295459 - DNA, 16 bp, Homo sapiens
gcatcctcctcagccc

SEQ ID NO: 3295460 - DNA, 18 bp, Homo sapiens
gcatcctcctcagccccc

SEQ ID NO: 3295461 - DNA, 14 bp, Homo sapiens
gcatcctgagcccc

SEQ ID NO: 3295462 - DNA, 14 bp, Homo sapiens
gcatcctgcctggg

SEQ ID NO: 3295463 - DNA, 23 bp, Homo sapiens
gcatcctgcctgggtgggacagc

SEQ ID NO: 3295464 - DNA, 21 bp, Homo sapiens
gcatcctggcacccggcccct

SEQ ID NO: 3295465 - DNA, 22 bp, Homo sapiens
gcatcctggcacccggcccctg

SEQ ID NO: 3295466 - DNA, 23 bp, Homo sapiens
gcatcctggcacccggcccctgc

SEQ ID NO: 3295467 - DNA, 15 bp, Homo sapiens
gcatccttcctataa

SEQ ID NO: 3295468 - DNA, 18 bp, Homo sapiens
gcatcgcaccattctgac

SEQ ID NO: 3295469 - DNA, 21 bp, Homo sapiens
gcatcgcaggagtctctgcca

SEQ ID NO: 3295470 - DNA, 20 bp, Homo sapiens
gcatcggactaaactatctg

SEQ ID NO: 3295471 - DNA, 19 bp, Homo sapiens
gcatcgggagcacccagag

SEQ ID NO: 3295472 - DNA, 18 bp, Homo sapiens
gcatcgtgacccttcagg

SEQ ID NO: 3295473 - DNA, 19 bp, Homo sapiens
gcatctaagttataagact

SEQ ID NO: 3295474 - DNA, 22 bp, Homo sapiens
gcatctaagttataagactctc

SEQ ID NO: 3295475 - DNA, 14 bp, Homo sapiens
gcatctatctcatc

SEQ ID NO: 3295476 - DNA, 14 bp, Homo sapiens
gcatctcagcccac

SEQ ID NO: 3295477 - DNA, 15 bp, Homo sapiens
gcatctcagcccaca

SEQ ID NO: 3295478 - DNA, 18 bp, Homo sapiens
gcatctcctgtcctgggc

SEQ ID NO: 3295479 - DNA, 14 bp, Homo sapiens
gcatctccttgact

SEQ ID NO: 3295480 - DNA, 22 bp, Homo sapiens
gcatctgaatgaaaataactga

SEQ ID NO: 3295481 - DNA, 14 bp, Homo sapiens
gcatctgacacaaa

SEQ ID NO: 3295482 - DNA, 12 bp, Homo sapiens
gcatctgcaccc

SEQ ID NO: 3295483 - DNA, 12 bp, Homo sapiens
gcatctgcccct

SEQ ID NO: 3295484 - DNA, 12 bp, Homo sapiens
gcatctggggcc

SEQ ID NO: 3295485 - DNA, 20 bp, Homo sapiens
gcatctggggcccatactgg

SEQ ID NO: 3295486 - DNA, 13 bp, Homo sapiens
gcatctgttctgg

SEQ ID NO: 3295487 - DNA, 16 bp, Homo sapiens
gcatcttatagcactt

SEQ ID NO: 3295488 - DNA, 15 bp, Homo sapiens
gcatcttctggcttg

SEQ ID NO: 3295489 - DNA, 22 bp, Homo sapiens
gcatctttgccttgggctgctc

SEQ ID NO: 3295490 - DNA, 24 bp, Homo sapiens
gcatgaaattgtatctcagtctaa

SEQ ID NO: 3295491 - DNA, 17 bp, Homo sapiens
gcatgaacaagttttaa

SEQ ID NO: 3295492 - DNA, 18 bp, Homo sapiens
gcatgaagagcaaaaata

SEQ ID NO: 3295493 - DNA, 20 bp, Homo sapiens
gcatgaagagcaaaaatatc

SEQ ID NO: 3295494 - DNA, 22 bp, Homo sapiens
gcatgacctaccaggacagaac

SEQ ID NO: 3295495 - DNA, 22 bp, Homo sapiens
gcatgacttgtgtgtgatgaga

SEQ ID NO: 3295496 - DNA, 22 bp, Homo sapiens
gcatgagccactgagcctggcc

SEQ ID NO: 3295497 - DNA, 23 bp, Homo sapiens
gcatgagtgctggatattttact

SEQ ID NO: 3295498 - DNA, 15 bp, Homo sapiens
gcatgatgggaaaat

SEQ ID NO: 3295499 - DNA, 16 bp, Homo sapiens
gcatgatgggaaaata

SEQ ID NO: 3295500 - DNA, 17 bp, Homo sapiens
gcatgatggtgagagcc

SEQ ID NO: 3295501 - DNA, 17 bp, Homo sapiens
gcatgcaaacaagaaac

SEQ ID NO: 3295502 - DNA, 16 bp, Homo sapiens
gcatgcaaatgagctc

SEQ ID NO: 3295503 - DNA, 21 bp, Homo sapiens
gcatgcaaatgagctctgaaa

SEQ ID NO: 3295504 - DNA, 14 bp, Homo sapiens
gcatgcagctttgc

SEQ ID NO: 3295505 - DNA, 14 bp, Homo sapiens
gcatgcatgcaaat

SEQ ID NO: 3295506 - DNA, 21 bp, Homo sapiens
gcatgcattttgcagcagtga

SEQ ID NO: 3295507 - DNA, 12 bp, Homo sapiens
gcatgccaccct

SEQ ID NO: 3295508 - DNA, 18 bp, Homo sapiens
gcatgccccggccacctc

SEQ ID NO: 3295509 - DNA, 22 bp, Homo sapiens
gcatgccccggccacctctgcg

SEQ ID NO: 3295510 - DNA, 13 bp, Homo sapiens
gcatgccccttgg

SEQ ID NO: 3295511 - DNA, 17 bp, Homo sapiens
gcatgccccttggctgg

SEQ ID NO: 3295512 - DNA, 14 bp, Homo sapiens
gcatgcgcacaagg

SEQ ID NO: 3295513 - DNA, 16 bp, Homo sapiens
gcatgctggggcaagt

SEQ ID NO: 3295514 - DNA, 18 bp, Homo sapiens
gcatgcttcccagaggga

SEQ ID NO: 3295515 - DNA, 22 bp, Homo sapiens
gcatgcttgggctgacccagca

SEQ ID NO: 3295516 - DNA, 17 bp, Homo sapiens
gcatgctttgctgctat

SEQ ID NO: 3295517 - DNA, 23 bp, Homo sapiens
gcatgctttgctgctatgaaaat

SEQ ID NO: 3295518 - DNA, 14 bp, Homo sapiens
gcatggaaaaatgg

SEQ ID NO: 3295519 - DNA, 20 bp, Homo sapiens
gcatggacatttagaagaaa

SEQ ID NO: 3295520 - DNA, 18 bp, Homo sapiens
gcatggacctaacattcg

SEQ ID NO: 3295521 - DNA, 16 bp, Homo sapiens
gcatggagacgcattt

SEQ ID NO: 3295522 - DNA, 16 bp, Homo sapiens
gcatggaggccctcct

SEQ ID NO: 3295523 - DNA, 23 bp, Homo sapiens
gcatggagtgtgtattgttccca

SEQ ID NO: 3295524 - DNA, 20 bp, Homo sapiens
gcatggatatagttttactt

SEQ ID NO: 3295525 - DNA, 22 bp, Homo sapiens
gcatggatgcatttcaaatgtt

SEQ ID NO: 3295526 - DNA, 18 bp, Homo sapiens
gcatggattttggataaa

SEQ ID NO: 3295527 - DNA, 20 bp, Homo sapiens
gcatggcaaggactgcaggg

SEQ ID NO: 3295528 - DNA, 21 bp, Homo sapiens
gcatggcaagtcacatgcgta

SEQ ID NO: 3295529 - DNA, 13 bp, Homo sapiens
gcatggccaggtg

SEQ ID NO: 3295530 - DNA, 16 bp, Homo sapiens
gcatggcgtggaggag

SEQ ID NO: 3295531 - DNA, 15 bp, Homo sapiens
gcatggctcagagct

SEQ ID NO: 3295532 - DNA, 18 bp, Homo sapiens
gcatggctccagaaatgt

SEQ ID NO: 3295533 - DNA, 15 bp, Homo sapiens
gcatgggcactccct

SEQ ID NO: 3295534 - DNA, 18 bp, Homo sapiens
gcatgggcgcaggcccag

SEQ ID NO: 3295535 - DNA, 20 bp, Homo sapiens
gcatgggcgcaggcccagtg

SEQ ID NO: 3295536 - DNA, 18 bp, Homo sapiens
gcatggggggtgggggga

SEQ ID NO: 3295537 - DNA, 16 bp, Homo sapiens
gcatgggtccaagaga

SEQ ID NO: 3295538 - DNA, 17 bp, Homo sapiens
gcatggtaccagccctg

SEQ ID NO: 3295539 - DNA, 23 bp, Homo sapiens
gcatggtaccagccctggggctg

SEQ ID NO: 3295540 - DNA, 20 bp, Homo sapiens
gccaggaccacacagtcccc

SEQ ID NO: 3295541 - DNA, 21 bp, Homo sapiens
gccaggaccacacagtcccca

SEQ ID NO: 3295542 - DNA, 22 bp, Homo sapiens
gccaggaccacacagtccccag

SEQ ID NO: 3295543 - DNA, 23 bp, Homo sapiens
gccaggaccctgacctccgcccc

SEQ ID NO: 3295544 - DNA, 19 bp, Homo sapiens
gccaggaccttggtgagat

SEQ ID NO: 3295545 - DNA, 22 bp, Homo sapiens
gccaggacgtctggggtgtggg

SEQ ID NO: 3295546 - DNA, 19 bp, Homo sapiens
gccaggactgagccccgca

SEQ ID NO: 3295547 - DNA, 17 bp, Homo sapiens
gccaggaggtagtttct

SEQ ID NO: 3295548 - DNA, 20 bp, Homo sapiens
gccaggaggttggtgactga

SEQ ID NO: 3295549 - DNA, 17 bp, Homo sapiens
gccaggagtctgtgctc

SEQ ID NO: 3295550 - DNA, 17 bp, Homo sapiens
gccaggatcatggtgta

SEQ ID NO: 3295551 - DNA, 19 bp, Homo sapiens
gccaggatcatggtgtaat

SEQ ID NO: 3295552 - DNA, 24 bp, Homo sapiens
gccaggatcatggtgtaataagac

SEQ ID NO: 3295553 - DNA, 14 bp, Homo sapiens
gccaggatgcccag

SEQ ID NO: 3295554 - DNA, 12 bp, Homo sapiens
gccaggcacagg

SEQ ID NO: 3295555 - DNA, 17 bp, Homo sapiens
gccaggcacctggcctg

SEQ ID NO: 3295556 - DNA, 14 bp, Homo sapiens
gccaggcagatctg

SEQ ID NO: 3295557 - DNA, 15 bp, Homo sapiens
gccaggcagatctgt

SEQ ID NO: 3295558 - DNA, 23 bp, Homo sapiens
gccaggcagatctgtgccccatg

SEQ ID NO: 3295559 - DNA, 14 bp, Homo sapiens
gccaggcaggggtg

SEQ ID NO: 3295560 - DNA, 17 bp, Homo sapiens
gccaggcaggggtgggg

SEQ ID NO: 3295561 - DNA, 22 bp, Homo sapiens
gccaggccaacagcacctcccc

SEQ ID NO: 3295562 - DNA, 13 bp, Homo sapiens
gccaggccagagg

SEQ ID NO: 3295563 - DNA, 12 bp, Homo sapiens
gccaggccagcc

SEQ ID NO: 3295564 - DNA, 14 bp, Homo sapiens
gccaggccagcctc

SEQ ID NO: 3295565 - DNA, 17 bp, Homo sapiens
gccaggcccatctcagg

SEQ ID NO: 3295566 - DNA, 21 bp, Homo sapiens
gccaggcccatctcaggtgcc

SEQ ID NO: 3295567 - DNA, 22 bp, Homo sapiens
gccaggcccatctcaggtgcca

SEQ ID NO: 3295568 - DNA, 13 bp, Homo sapiens
gccaggcccgcac

SEQ ID NO: 3295569 - DNA, 23 bp, Homo sapiens
gccaggcccgcaccccggcctca

SEQ ID NO: 3295570 - DNA, 17 bp, Homo sapiens
gccaggcctcttggcag

SEQ ID NO: 3295571 - DNA, 15 bp, Homo sapiens
gccaggcgttggtgc

SEQ ID NO: 3295572 - DNA, 20 bp, Homo sapiens
gccaggcgttggtgccactt

SEQ ID NO: 3295573 - DNA, 20 bp, Homo sapiens
gccaggctatggttgccacc

SEQ ID NO: 3295574 - DNA, 18 bp, Homo sapiens
gccaggctcaggccatgg

SEQ ID NO: 3295575 - DNA, 14 bp, Homo sapiens
gccaggctgctaac

SEQ ID NO: 3295576 - DNA, 17 bp, Homo sapiens
gccaggctggtctaaaa

SEQ ID NO: 3295577 - DNA, 11 bp, Homo sapiens
gccagggagct

SEQ ID NO: 3295578 - DNA, 10 bp, Homo sapiens
gccagggcag

SEQ ID NO: 3295579 - DNA, 14 bp, Homo sapiens
gccagggcagggcc

SEQ ID NO: 3295580 - DNA, 16 bp, Homo sapiens
gccagggcagggccac

SEQ ID NO: 3295581 - DNA, 15 bp, Homo sapiens
gccagggccacgctc

SEQ ID NO: 3295582 - DNA, 13 bp, Homo sapiens
gccagggccctgc

SEQ ID NO: 3295583 - DNA, 15 bp, Homo sapiens
gccagggccctgcag

SEQ ID NO: 3295584 - DNA, 16 bp, Homo sapiens
gccagggccctgcaga

SEQ ID NO: 3295585 - DNA, 12 bp, Homo sapiens
gccagggctggg

SEQ ID NO: 3295586 - DNA, 15 bp, Homo sapiens
gccagggggatgcca

SEQ ID NO: 3295587 - DNA, 18 bp, Homo sapiens
gccagggtctctccctca

SEQ ID NO: 3295588 - DNA, 19 bp, Homo sapiens
gccagggtctctccctcag

SEQ ID NO: 3295589 - DNA, 22 bp, Homo sapiens
gccagggtctctccctcaggtg

SEQ ID NO: 3295590 - DNA, 23 bp, Homo sapiens
gccagggtctctccctcaggtgt

SEQ ID NO: 3295591 - DNA, 19 bp, Homo sapiens
gccaggtacaggagaggca

SEQ ID NO: 3295592 - DNA, 23 bp, Homo sapiens
gccaggtactgcattctctccca

SEQ ID NO: 3295593 - DNA, 20 bp, Homo sapiens
gccaggtgaggtccaccggc

SEQ ID NO: 3295594 - DNA, 23 bp, Homo sapiens
gccaggtgaggtccaccggcccc

SEQ ID NO: 3295595 - DNA, 18 bp, Homo sapiens
gccaggtggccactccag

SEQ ID NO: 3295596 - DNA, 20 bp, Homo sapiens
gccagtaacgcgtcttcctg

SEQ ID NO: 3295597 - DNA, 21 bp, Homo sapiens
gccagtatctatatatgtgta

SEQ ID NO: 3295598 - DNA, 22 bp, Homo sapiens
gccagtatctatatatgtgtat

SEQ ID NO: 3295599 - DNA, 17 bp, Homo sapiens
gccagtattagactgga

SEQ ID NO: 3295600 - DNA, 14 bp, Homo sapiens
gccagtccaggctg

SEQ ID NO: 3295601 - DNA, 20 bp, Homo sapiens
gccagtccaggctgccgtgg

SEQ ID NO: 3295602 - DNA, 15 bp, Homo sapiens
gccagtcctcctggg

SEQ ID NO: 3295603 - DNA, 21 bp, Homo sapiens
gccagtcctcctgggagcccc

SEQ ID NO: 3295604 - DNA, 22 bp, Homo sapiens
gccagtctcactgtgggaaggc

SEQ ID NO: 3295605 - DNA, 13 bp, Homo sapiens
gccagtctcccag

SEQ ID NO: 3295606 - DNA, 13 bp, Homo sapiens
gccagtctgggct

SEQ ID NO: 3295607 - DNA, 23 bp, Homo sapiens
gccagtcttgcctaggccaaatg

SEQ ID NO: 3295608 - DNA, 13 bp, Homo sapiens
gccagtgaaatgt

SEQ ID NO: 3295609 - DNA, 18 bp, Homo sapiens
gccagtgaaatgtgaagg

SEQ ID NO: 3295610 - DNA, 21 bp, Homo sapiens
gccagtgaaatgtgaaggaaa

SEQ ID NO: 3295611 - DNA, 19 bp, Homo sapiens
gccagtgaacttggctttc

SEQ ID NO: 3295612 - DNA, 15 bp, Homo sapiens
gccagtgagggcagt

SEQ ID NO: 3295613 - DNA, 17 bp, Homo sapiens
gccagtggaagaaacac

SEQ ID NO: 3295614 - DNA, 21 bp, Homo sapiens
gccagtgggcgggccatgagg

SEQ ID NO: 3295615 - DNA, 17 bp, Homo sapiens
gccagtggggcctgtgg

SEQ ID NO: 3295616 - DNA, 18 bp, Homo sapiens
gccagtggggcctgtgga

SEQ ID NO: 3295617 - DNA, 21 bp, Homo sapiens
gccagtggggcctgtggaatg

SEQ ID NO: 3295618 - DNA, 18 bp, Homo sapiens
gccagtgtaatcccccag

SEQ ID NO: 3295619 - DNA, 20 bp, Homo sapiens
gccagtgtaatcccccagga

SEQ ID NO: 3295620 - DNA, 15 bp, Homo sapiens
gccagtgtctgtccc

SEQ ID NO: 3295621 - DNA, 15 bp, Homo sapiens
gccagtgtctttctt

SEQ ID NO: 3295622 - DNA, 13 bp, Homo sapiens
gccagtgtgacaa

SEQ ID NO: 3295623 - DNA, 21 bp, Homo sapiens
gccagttctttccataataaa

SEQ ID NO: 3295624 - DNA, 13 bp, Homo sapiens
gccagttgcccag

SEQ ID NO: 3295625 - DNA, 16 bp, Homo sapiens
gccagttgcccagagc

SEQ ID NO: 3295626 - DNA, 23 bp, Homo sapiens
gccagttggtggggccaggccag

SEQ ID NO: 3295627 - DNA, 16 bp, Homo sapiens
gccagttggtgttcct

SEQ ID NO: 3295628 - DNA, 16 bp, Homo sapiens
gccataaaagcattgt

SEQ ID NO: 3295629 - DNA, 16 bp, Homo sapiens
gccataaacggttcct

SEQ ID NO: 3295630 - DNA, 17 bp, Homo sapiens
gccataaacggttcctg

SEQ ID NO: 3295631 - DNA, 15 bp, Homo sapiens
gccataacttgaaaa

SEQ ID NO: 3295632 - DNA, 22 bp, Homo sapiens
gccataattctaagttatttac

SEQ ID NO: 3295633 - DNA, 17 bp, Homo sapiens
gccatagctgatcatgt

SEQ ID NO: 3295634 - DNA, 19 bp, Homo sapiens
gccatataagtttgaagga

SEQ ID NO: 3295635 - DNA, 19 bp, Homo sapiens
gccatcaaaatgcttttta

SEQ ID NO: 3295636 - DNA, 13 bp, Homo sapiens
gccatcacaggat

SEQ ID NO: 3295637 - DNA, 23 bp, Homo sapiens
gccatcacaggatgccagcccct

SEQ ID NO: 3295638 - DNA, 19 bp, Homo sapiens
gccatcactagaagaaaag

SEQ ID NO: 3295639 - DNA, 19 bp, Homo sapiens
gccatcataggaagggacc

SEQ ID NO: 3295640 - DNA, 15 bp, Homo sapiens
gccatcatgccttga

SEQ ID NO: 3295641 - DNA, 17 bp, Homo sapiens
gccatcatgccttgata

SEQ ID NO: 3295642 - DNA, 21 bp, Homo sapiens
gccatccaaataagaaaccta

SEQ ID NO: 3295643 - DNA, 14 bp, Homo sapiens
gccatccaggttca

SEQ ID NO: 3295644 - DNA, 22 bp, Homo sapiens
gccatccccaccttcacctcgg

SEQ ID NO: 3295645 - DNA, 12 bp, Homo sapiens
gccatccctggg

SEQ ID NO: 3295646 - DNA, 19 bp, Homo sapiens
gccatccctgggcccctcc

SEQ ID NO: 3295647 - DNA, 20 bp, Homo sapiens
gccatccctgggcccctcca

SEQ ID NO: 3295648 - DNA, 18 bp, Homo sapiens
gccatccctttttttaca

SEQ ID NO: 3295649 - DNA, 18 bp, Homo sapiens
gccatccggtcccctgcc

SEQ ID NO: 3295650 - DNA, 23 bp, Homo sapiens
gccatccggtcccctgcctggaa

SEQ ID NO: 3295651 - DNA, 13 bp, Homo sapiens
gccatcgtcctgg

SEQ ID NO: 3295652 - DNA, 14 bp, Homo sapiens
gccatcgtcctggg

SEQ ID NO: 3295653 - DNA, 18 bp, Homo sapiens
gccatctaatgcttgttt

SEQ ID NO: 3295654 - DNA, 19 bp, Homo sapiens
gccatctaatgcttgttta

SEQ ID NO: 3295655 - DNA, 22 bp, Homo sapiens
gccatctcaggagatggagggc

SEQ ID NO: 3295656 - DNA, 15 bp, Homo sapiens
gccatctccctcccc

SEQ ID NO: 3295657 - DNA, 12 bp, Homo sapiens
gccatctgccca

SEQ ID NO: 3295658 - DNA, 14 bp, Homo sapiens
gccatctgcccagg

SEQ ID NO: 3295659 - DNA, 17 bp, Homo sapiens
gccatctgcccaggggt

SEQ ID NO: 3295660 - DNA, 20 bp, Homo sapiens
gccatctgcccaggggtgcc

SEQ ID NO: 3295661 - DNA, 20 bp, Homo sapiens
gccatctgtacatattactg

SEQ ID NO: 3295662 - DNA, 21 bp, Homo sapiens
gccatgaaccaaatggttctt

SEQ ID NO: 3295663 - DNA, 20 bp, Homo sapiens
gccatgaagtcaccgggatg

SEQ ID NO: 3295664 - DNA, 20 bp, Homo sapiens
gccatgatttgtcccagcct

SEQ ID NO: 3295665 - DNA, 21 bp, Homo sapiens
gcccctcagcccttgccccca

SEQ ID NO: 3295666 - DNA, 16 bp, Homo sapiens
gcccctccacgcctcc

SEQ ID NO: 3295667 - DNA, 17 bp, Homo sapiens
gcccctccacgcctcct

SEQ ID NO: 3295668 - DNA, 15 bp, Homo sapiens
gcccctccacgtgat

SEQ ID NO: 3295669 - DNA, 16 bp, Homo sapiens
gcccctccatccaccc

SEQ ID NO: 3295670 - DNA, 12 bp, Homo sapiens
gcccctccccca

SEQ ID NO: 3295671 - DNA, 22 bp, Homo sapiens
gcccctcccccaacccccaccc

SEQ ID NO: 3295672 - DNA, 20 bp, Homo sapiens
gcccctccctctgccccaag

SEQ ID NO: 3295673 - DNA, 14 bp, Homo sapiens
gcccctcccttcaa

SEQ ID NO: 3295674 - DNA, 20 bp, Homo sapiens
gcccctcctaccccggctgc

SEQ ID NO: 3295675 - DNA, 20 bp, Homo sapiens
gcccctcctagacccaggtg

SEQ ID NO: 3295676 - DNA, 21 bp, Homo sapiens
gcccctcctagacccaggtgg

SEQ ID NO: 3295677 - DNA, 21 bp, Homo sapiens
gcccctcgccagcttctcctg

SEQ ID NO: 3295678 - DNA, 15 bp, Homo sapiens
gcccctcgcctgtgg

SEQ ID NO: 3295679 - DNA, 22 bp, Homo sapiens
gcccctctccaaacaccggcag

SEQ ID NO: 3295680 - DNA, 14 bp, Homo sapiens
gcccctctggtcgc

SEQ ID NO: 3295681 - DNA, 20 bp, Homo sapiens
gcccctctggtcgctcctgc

SEQ ID NO: 3295682 - DNA, 22 bp, Homo sapiens
gcccctcttattcctctaggca

SEQ ID NO: 3295683 - DNA, 14 bp, Homo sapiens
gcccctcttcccca

SEQ ID NO: 3295684 - DNA, 16 bp, Homo sapiens
gcccctgaggactgga

SEQ ID NO: 3295685 - DNA, 19 bp, Homo sapiens
gcccctgaggactggagac

SEQ ID NO: 3295686 - DNA, 20 bp, Homo sapiens
gcccctgatcactcccagca

SEQ ID NO: 3295687 - DNA, 21 bp, Homo sapiens
gcccctgatcactcccagcac

SEQ ID NO: 3295688 - DNA, 23 bp, Homo sapiens
gcccctgatcactcccagcactc

SEQ ID NO: 3295689 - DNA, 16 bp, Homo sapiens
gcccctgcaaagacag

SEQ ID NO: 3295690 - DNA, 15 bp, Homo sapiens
gcccctgccccagcc

SEQ ID NO: 3295691 - DNA, 15 bp, Homo sapiens
gcccctgcccggctg

SEQ ID NO: 3295692 - DNA, 12 bp, Homo sapiens
gcccctgcctgg

SEQ ID NO: 3295693 - DNA, 15 bp, Homo sapiens
gcccctgcctgggtt

SEQ ID NO: 3295694 - DNA, 19 bp, Homo sapiens
gcccctgcgtggcctgagt

SEQ ID NO: 3295695 - DNA, 22 bp, Homo sapiens
gcccctgctggttcagggttgg

SEQ ID NO: 3295696 - DNA, 12 bp, Homo sapiens
gcccctgctgtc

SEQ ID NO: 3295697 - DNA, 20 bp, Homo sapiens
gcccctgctgtgctgctcaa

SEQ ID NO: 3295698 - DNA, 19 bp, Homo sapiens
gcccctgcttctccagcct

SEQ ID NO: 3295699 - DNA, 13 bp, Homo sapiens
gcccctggagcca

SEQ ID NO: 3295700 - DNA, 22 bp, Homo sapiens
gcccctggcagcacagcccagg

SEQ ID NO: 3295701 - DNA, 16 bp, Homo sapiens
gcccctggcccatctc

SEQ ID NO: 3295702 - DNA, 21 bp, Homo sapiens
gcccctggcccatctcagcct

SEQ ID NO: 3295703 - DNA, 19 bp, Homo sapiens
gcccctgggcttggcctgc

SEQ ID NO: 3295704 - DNA, 16 bp, Homo sapiens
gcccctggggcctaga

SEQ ID NO: 3295705 - DNA, 16 bp, Homo sapiens
gcccctggtcctgagg

SEQ ID NO: 3295706 - DNA, 17 bp, Homo sapiens
gcccctgtatggcactg

SEQ ID NO: 3295707 - DNA, 13 bp, Homo sapiens
gcccctgtggcca

SEQ ID NO: 3295708 - DNA, 15 bp, Homo sapiens
gcccctgtggccaac

SEQ ID NO: 3295709 - DNA, 21 bp, Homo sapiens
gcccctgtggccaactgcaaa

SEQ ID NO: 3295710 - DNA, 18 bp, Homo sapiens
gccccttaagggttgaag

SEQ ID NO: 3295711 - DNA, 20 bp, Homo sapiens
gccccttaagggttgaaggc

SEQ ID NO: 3295712 - DNA, 15 bp, Homo sapiens
gccccttcccatctc

SEQ ID NO: 3295713 - DNA, 12 bp, Homo sapiens
gccccttccccc

SEQ ID NO: 3295714 - DNA, 17 bp, Homo sapiens
gccccttccccctccaa

SEQ ID NO: 3295715 - DNA, 12 bp, Homo sapiens
gccccttccctt

SEQ ID NO: 3295716 - DNA, 22 bp, Homo sapiens
gccccttcttgggccccagacc

SEQ ID NO: 3295717 - DNA, 20 bp, Homo sapiens
gccccttgctctcccctgcc

SEQ ID NO: 3295718 - DNA, 18 bp, Homo sapiens
gccccttggctggatcag

SEQ ID NO: 3295719 - DNA, 13 bp, Homo sapiens
gccccttgggcat

SEQ ID NO: 3295720 - DNA, 23 bp, Homo sapiens
gccccttgggcatccacccagtg

SEQ ID NO: 3295721 - DNA, 23 bp, Homo sapiens
gcccctttttcatatgttgctca

SEQ ID NO: 3295722 - DNA, 16 bp, Homo sapiens
gcccgacagcctggca

SEQ ID NO: 3295723 - DNA, 17 bp, Homo sapiens
gcccgacagcctggcac

SEQ ID NO: 3295724 - DNA, 14 bp, Homo sapiens
gcccgacagtgcca

SEQ ID NO: 3295725 - DNA, 16 bp, Homo sapiens
gcccgacagtgccatc

SEQ ID NO: 3295726 - DNA, 23 bp, Homo sapiens
gcccgacagtgccatccccacct

SEQ ID NO: 3295727 - DNA, 12 bp, Homo sapiens
gcccgagctggt

SEQ ID NO: 3295728 - DNA, 13 bp, Homo sapiens
gcccgagctggtg

SEQ ID NO: 3295729 - DNA, 22 bp, Homo sapiens
gcccgagctggtgcattacaga

SEQ ID NO: 3295730 - DNA, 17 bp, Homo sapiens
gcccgagtgcggcgtgg

SEQ ID NO: 3295731 - DNA, 18 bp, Homo sapiens
gcccgcaactctccagcc

SEQ ID NO: 3295732 - DNA, 14 bp, Homo sapiens
gcccgcacaccctc

SEQ ID NO: 3295733 - DNA, 24 bp, Homo sapiens
gcccgcacaccctcactctgccag

SEQ ID NO: 3295734 - DNA, 13 bp, Homo sapiens
gcccgcacacctg

SEQ ID NO: 3295735 - DNA, 14 bp, Homo sapiens
gcccgcacagcagc

SEQ ID NO: 3295736 - DNA, 15 bp, Homo sapiens
gcccgcacagcagcc

SEQ ID NO: 3295737 - DNA, 12 bp, Homo sapiens
gcccgcaccccc

SEQ ID NO: 3295738 - DNA, 15 bp, Homo sapiens
gcccgcaccccggcc

SEQ ID NO: 3295739 - DNA, 19 bp, Homo sapiens
gcccgcaggaactgggctg

SEQ ID NO: 3295740 - DNA, 23 bp, Homo sapiens
gcccgcaggaactgggctgggcc

SEQ ID NO: 3295741 - DNA, 17 bp, Homo sapiens
gcccgcagtgctgggac

SEQ ID NO: 3295742 - DNA, 23 bp, Homo sapiens
gcccgcagtgctgggaccagagc

SEQ ID NO: 3295743 - DNA, 16 bp, Homo sapiens
gcccgctcctgccgca

SEQ ID NO: 3295744 - DNA, 17 bp, Homo sapiens
gcccgctcctgccgcag

SEQ ID NO: 3295745 - DNA, 19 bp, Homo sapiens
gcccgctcctgccgcagac

SEQ ID NO: 3295746 - DNA, 16 bp, Homo sapiens
gcccggatgctgcttc

SEQ ID NO: 3295747 - DNA, 14 bp, Homo sapiens
gcccggatgcttct

SEQ ID NO: 3295748 - DNA, 17 bp, Homo sapiens
gcccggattctgggagg

SEQ ID NO: 3295749 - DNA, 15 bp, Homo sapiens
gcccggcagggcggg

SEQ ID NO: 3295750 - DNA, 13 bp, Homo sapiens
gcccggccagcgg

SEQ ID NO: 3295751 - DNA, 20 bp, Homo sapiens
gcccggccagcgggcacagg

SEQ ID NO: 3295752 - DNA, 21 bp, Homo sapiens
gcccggcgccgggcaccaact

SEQ ID NO: 3295753 - DNA, 22 bp, Homo sapiens
gcccggcggggaccttggtctg

SEQ ID NO: 3295754 - DNA, 18 bp, Homo sapiens
gcccggctaatttttgta

SEQ ID NO: 3295755 - DNA, 16 bp, Homo sapiens
gcccggctccaggctc

SEQ ID NO: 3295756 - DNA, 18 bp, Homo sapiens
gcccggctccaggctcct

SEQ ID NO: 3295757 - DNA, 14 bp, Homo sapiens
gcccggctggtttt

SEQ ID NO: 3295758 - DNA, 20 bp, Homo sapiens
gcccgggaactcctgccaca

SEQ ID NO: 3295759 - DNA, 15 bp, Homo sapiens
gcccgggagcctagg

SEQ ID NO: 3295760 - DNA, 20 bp, Homo sapiens
gcccgggagcctaggaccac

SEQ ID NO: 3295761 - DNA, 14 bp, Homo sapiens
gcccgggctgcctg

SEQ ID NO: 3295762 - DNA, 15 bp, Homo sapiens
gcccgggctgcctgg

SEQ ID NO: 3295763 - DNA, 17 bp, Homo sapiens
gcccgggctgcctgggc

SEQ ID NO: 3295764 - DNA, 16 bp, Homo sapiens
gcccggtcccacccct

SEQ ID NO: 3295765 - DNA, 16 bp, Homo sapiens
gcccggtggcggcagg

SEQ ID NO: 3295766 - DNA, 22 bp, Homo sapiens
gcccggtggcggcagggccagg

SEQ ID NO: 3295767 - DNA, 18 bp, Homo sapiens
gcccggtggtttgccatg

SEQ ID NO: 3295768 - DNA, 19 bp, Homo sapiens
gcccggtggtttgccatgt

SEQ ID NO: 3295769 - DNA, 13 bp, Homo sapiens
gcccgtctcagtg

SEQ ID NO: 3295770 - DNA, 14 bp, Homo sapiens
gcccgtgaagcagt

SEQ ID NO: 3295771 - DNA, 18 bp, Homo sapiens
gcccgtgaagcagtgcct

SEQ ID NO: 3295772 - DNA, 20 bp, Homo sapiens
gcccgtgaagcagtgcctcg

SEQ ID NO: 3295773 - DNA, 21 bp, Homo sapiens
gcccgtgaagcagtgcctcga

SEQ ID NO: 3295774 - DNA, 12 bp, Homo sapiens
gcccgtgcagta

SEQ ID NO: 3295775 - DNA, 17 bp, Homo sapiens
gcccgtgcagtacaggc

SEQ ID NO: 3295776 - DNA, 23 bp, Homo sapiens
gcccgtgcccccgcctgccaccg

SEQ ID NO: 3295777 - DNA, 17 bp, Homo sapiens
gcccgtggggtctgcgc

SEQ ID NO: 3295778 - DNA, 18 bp, Homo sapiens
gccctaaccccttccaga

SEQ ID NO: 3295779 - DNA, 14 bp, Homo sapiens
gccctaagggactt

SEQ ID NO: 3295780 - DNA, 20 bp, Homo sapiens
gccctacagaggtctctgcc

SEQ ID NO: 3295781 - DNA, 16 bp, Homo sapiens
gccctactccctgcag

SEQ ID NO: 3295782 - DNA, 14 bp, Homo sapiens
gccctagcccagac

SEQ ID NO: 3295783 - DNA, 21 bp, Homo sapiens
gccctagcccagactctgagc

SEQ ID NO: 3295784 - DNA, 22 bp, Homo sapiens
gccctagcccagactctgagct

SEQ ID NO: 3295785 - DNA, 13 bp, Homo sapiens
gccctatggatgt

SEQ ID NO: 3295786 - DNA, 14 bp, Homo sapiens
gccctatggatgtg

SEQ ID NO: 3295787 - DNA, 15 bp, Homo sapiens
gccctcaacaggccc

SEQ ID NO: 3295788 - DNA, 21 bp, Homo sapiens
gccctcaactattctgttcca

SEQ ID NO: 3295789 - DNA, 17 bp, Homo sapiens
gccctcaagtaaaagaa

SEQ ID NO: 3295790 - DNA, 12 bp, Homo sapiens
gccctcaccacc

SEQ ID NO: 3295791 - DNA, 19 bp, Homo sapiens
gcctgccctccagctgctg

SEQ ID NO: 3295792 - DNA, 17 bp, Homo sapiens
gcctgccctccccagag

SEQ ID NO: 3295793 - DNA, 21 bp, Homo sapiens
gcctgccctccccagagcact

SEQ ID NO: 3295794 - DNA, 18 bp, Homo sapiens
gcctgcctaaccaggccc

SEQ ID NO: 3295795 - DNA, 18 bp, Homo sapiens
gcctgcctcagtggcagc

SEQ ID NO: 3295796 - DNA, 19 bp, Homo sapiens
gcctgcctcagtggcagca

SEQ ID NO: 3295797 - DNA, 18 bp, Homo sapiens
gcctgcctcccaaggtcc

SEQ ID NO: 3295798 - DNA, 14 bp, Homo sapiens
gcctgcctggaaga

SEQ ID NO: 3295799 - DNA, 17 bp, Homo sapiens
gcctgcctggcaggctg

SEQ ID NO: 3295800 - DNA, 14 bp, Homo sapiens
gcctgcctggcccc

SEQ ID NO: 3295801 - DNA, 15 bp, Homo sapiens
gcctgccttcgttaa

SEQ ID NO: 3295802 - DNA, 23 bp, Homo sapiens
gcctgccttgaagccactgaagc

SEQ ID NO: 3295803 - DNA, 14 bp, Homo sapiens
gcctgcgctcggca

SEQ ID NO: 3295804 - DNA, 23 bp, Homo sapiens
gcctgctagagcaacccctgtac

SEQ ID NO: 3295805 - DNA, 10 bp, Homo sapiens
gcctgctgca

SEQ ID NO: 3295806 - DNA, 12 bp, Homo sapiens
gcctgctgccag

SEQ ID NO: 3295807 - DNA, 19 bp, Homo sapiens
gcctgctgccagtgcagcc

SEQ ID NO: 3295808 - DNA, 23 bp, Homo sapiens
gcctgctgccagtgcagccactg

SEQ ID NO: 3295809 - DNA, 10 bp, Homo sapiens
gcctgctggc

SEQ ID NO: 3295810 - DNA, 19 bp, Homo sapiens
gcctgctggctgcggcccc

SEQ ID NO: 3295811 - DNA, 21 bp, Homo sapiens
gcctgctggctgcggccccct

SEQ ID NO: 3295812 - DNA, 21 bp, Homo sapiens
gcctgctgggaaccccgcagc

SEQ ID NO: 3295813 - DNA, 23 bp, Homo sapiens
gcctgctgggaaccccgcagccc

SEQ ID NO: 3295814 - DNA, 21 bp, Homo sapiens
gcctgcttcccacctccctgc

SEQ ID NO: 3295815 - DNA, 20 bp, Homo sapiens
gcctgcttccccttcctaag

SEQ ID NO: 3295816 - DNA, 15 bp, Homo sapiens
gcctgcttggcccgg

SEQ ID NO: 3295817 - DNA, 19 bp, Homo sapiens
gcctgcttttccaggatcc

SEQ ID NO: 3295818 - DNA, 12 bp, Homo sapiens
gcctggaaccag

SEQ ID NO: 3295819 - DNA, 15 bp, Homo sapiens
gcctggaaccaggga

SEQ ID NO: 3295820 - DNA, 20 bp, Homo sapiens
gcctggaaccagggaggaga

SEQ ID NO: 3295821 - DNA, 21 bp, Homo sapiens
gcctggaactggctgtgaaga

SEQ ID NO: 3295822 - DNA, 22 bp, Homo sapiens
gcctggacagtatcccacatcc

SEQ ID NO: 3295823 - DNA, 13 bp, Homo sapiens
gcctggactctgc

SEQ ID NO: 3295824 - DNA, 17 bp, Homo sapiens
gcctggactctgcccca

SEQ ID NO: 3295825 - DNA, 14 bp, Homo sapiens
gcctggactttcct

SEQ ID NO: 3295826 - DNA, 15 bp, Homo sapiens
gcctggactttcctg

SEQ ID NO: 3295827 - DNA, 23 bp, Homo sapiens
gcctggagacttagggcaccagg

SEQ ID NO: 3295828 - DNA, 15 bp, Homo sapiens
gcctggagagcgagg

SEQ ID NO: 3295829 - DNA, 17 bp, Homo sapiens
gcctggagatcctcctg

SEQ ID NO: 3295830 - DNA, 12 bp, Homo sapiens
gcctggagcccc

SEQ ID NO: 3295831 - DNA, 13 bp, Homo sapiens
gcctggagcccca

SEQ ID NO: 3295832 - DNA, 24 bp, Homo sapiens
gcctggagtgtatgactgcacatg

SEQ ID NO: 3295833 - DNA, 13 bp, Homo sapiens
gcctggcacacat

SEQ ID NO: 3295834 - DNA, 16 bp, Homo sapiens
gcctggcacatttcag

SEQ ID NO: 3295835 - DNA, 20 bp, Homo sapiens
gcctggcagccgtgccttca

SEQ ID NO: 3295836 - DNA, 13 bp, Homo sapiens
gcctggcaggcca

SEQ ID NO: 3295837 - DNA, 20 bp, Homo sapiens
gcctggcagttgaacagagg

SEQ ID NO: 3295838 - DNA, 16 bp, Homo sapiens
gcctggccagatgcac

SEQ ID NO: 3295839 - DNA, 14 bp, Homo sapiens
gcctggccaggagc

SEQ ID NO: 3295840 - DNA, 15 bp, Homo sapiens
gcctggccaggagct

SEQ ID NO: 3295841 - DNA, 15 bp, Homo sapiens
gcctggccaggcaga

SEQ ID NO: 3295842 - DNA, 17 bp, Homo sapiens
gcctggccaggcagatc

SEQ ID NO: 3295843 - DNA, 23 bp, Homo sapiens
gcctggccaggcagatctgtgcc

SEQ ID NO: 3295844 - DNA, 21 bp, Homo sapiens
gcctggccagggcagggccac

SEQ ID NO: 3295845 - DNA, 17 bp, Homo sapiens
gcctggcccacgccctc

SEQ ID NO: 3295846 - DNA, 15 bp, Homo sapiens
gcctggccggcaacc

SEQ ID NO: 3295847 - DNA, 11 bp, Homo sapiens
gcctggcctga

SEQ ID NO: 3295848 - DNA, 12 bp, Homo sapiens
gcctggcctgag

SEQ ID NO: 3295849 - DNA, 16 bp, Homo sapiens
gcctggcctgagctgg

SEQ ID NO: 3295850 - DNA, 16 bp, Homo sapiens
gcctggcctggccctg

SEQ ID NO: 3295851 - DNA, 17 bp, Homo sapiens
gcctggcctggccctgc

SEQ ID NO: 3295852 - DNA, 15 bp, Homo sapiens
gcctggcgggatggg

SEQ ID NO: 3295853 - DNA, 21 bp, Homo sapiens
gcctggcgggatgggccaccg

SEQ ID NO: 3295854 - DNA, 23 bp, Homo sapiens
gcctggcgggatgggccaccgcc

SEQ ID NO: 3295855 - DNA, 12 bp, Homo sapiens
gcctggctcccc

SEQ ID NO: 3295856 - DNA, 22 bp, Homo sapiens
gcctggctccccacgagtcacc

SEQ ID NO: 3295857 - DNA, 16 bp, Homo sapiens
gcctggctccgtccag

SEQ ID NO: 3295858 - DNA, 10 bp, Homo sapiens
gcctggctct

SEQ ID NO: 3295859 - DNA, 19 bp, Homo sapiens
gcctggctcttgtgctgga

SEQ ID NO: 3295860 - DNA, 10 bp, Homo sapiens
gcctggctgt

SEQ ID NO: 3295861 - DNA, 14 bp, Homo sapiens
gcctggcttctgga

SEQ ID NO: 3295862 - DNA, 16 bp, Homo sapiens
gcctggcttctggagc

SEQ ID NO: 3295863 - DNA, 17 bp, Homo sapiens
gcctggcttctggagcc

SEQ ID NO: 3295864 - DNA, 19 bp, Homo sapiens
gcctggcttgctccagggt

SEQ ID NO: 3295865 - DNA, 23 bp, Homo sapiens
gcctgggaatgtattattctgca

SEQ ID NO: 3295866 - DNA, 15 bp, Homo sapiens
gcctgggacccagct

SEQ ID NO: 3295867 - DNA, 14 bp, Homo sapiens
gcctgggagcccag

SEQ ID NO: 3295868 - DNA, 17 bp, Homo sapiens
gcctgggatgctagccc

SEQ ID NO: 3295869 - DNA, 21 bp, Homo sapiens
gcctgggatgctagccccaga

SEQ ID NO: 3295870 - DNA, 22 bp, Homo sapiens
gcctgggcaacatagtgagacc

SEQ ID NO: 3295871 - DNA, 20 bp, Homo sapiens
gcctgggcagccaggctgcc

SEQ ID NO: 3295872 - DNA, 23 bp, Homo sapiens
gcctgggcagccaggctgccaag

SEQ ID NO: 3295873 - DNA, 16 bp, Homo sapiens
gcctgggcctctgccc

SEQ ID NO: 3295874 - DNA, 13 bp, Homo sapiens
gcctgggcctgct

SEQ ID NO: 3295875 - DNA, 13 bp, Homo sapiens
gcctgggcctgtg

SEQ ID NO: 3295876 - DNA, 17 bp, Homo sapiens
gcctgggcctgtgcagc

SEQ ID NO: 3295877 - DNA, 20 bp, Homo sapiens
gcctgggcctgtgcagcagc

SEQ ID NO: 3295878 - DNA, 23 bp, Homo sapiens
gcctgggcctgtgcagcagccca

SEQ ID NO: 3295879 - DNA, 20 bp, Homo sapiens
gcctgggcgacagagcgaga

SEQ ID NO: 3295880 - DNA, 20 bp, Homo sapiens
gcctgggctgttggcactca

SEQ ID NO: 3295881 - DNA, 15 bp, Homo sapiens
gcctggggaggccct

SEQ ID NO: 3295882 - DNA, 22 bp, Homo sapiens
gcctggggccggtagaggctcc

SEQ ID NO: 3295883 - DNA, 13 bp, Homo sapiens
gcctggggcctga

SEQ ID NO: 3295884 - DNA, 16 bp, Homo sapiens
gcctggggcctgagag

SEQ ID NO: 3295885 - DNA, 14 bp, Homo sapiens
gcctggggctccct

SEQ ID NO: 3295886 - DNA, 22 bp, Homo sapiens
gcctggggctcctttctccagc

SEQ ID NO: 3295887 - DNA, 20 bp, Homo sapiens
gcctgggggacagaaagaga

SEQ ID NO: 3295888 - DNA, 21 bp, Homo sapiens
gcctgggggagttttcctcta

SEQ ID NO: 3295889 - DNA, 17 bp, Homo sapiens
gcctgggggcagtgact

SEQ ID NO: 3295890 - DNA, 19 bp, Homo sapiens
gcctgggggcagtgactgg

SEQ ID NO: 3295891 - DNA, 21 bp, Homo sapiens
gcctgggggcagtgactggca

SEQ ID NO: 3295892 - DNA, 22 bp, Homo sapiens
gcctgggggcagtgactggcag

SEQ ID NO: 3295893 - DNA, 21 bp, Homo sapiens
gcctggggtgcatcctcctca

SEQ ID NO: 3295894 - DNA, 23 bp, Homo sapiens
gcctgggtctgtgtctcttttct

SEQ ID NO: 3295895 - DNA, 20 bp, Homo sapiens
gcctgggtgacagagcaaga

SEQ ID NO: 3295896 - DNA, 19 bp, Homo sapiens
gcctgggtggatcggcctc

SEQ ID NO: 3295897 - DNA, 23 bp, Homo sapiens
gcctgggtggatcggcctcctct

SEQ ID NO: 3295898 - DNA, 16 bp, Homo sapiens
gcctgggtgggacagc

SEQ ID NO: 3295899 - DNA, 17 bp, Homo sapiens
gcctgggtgggacagcc

SEQ ID NO: 3295900 - DNA, 15 bp, Homo sapiens
gcctgggttgggggc

SEQ ID NO: 3295901 - DNA, 16 bp, Homo sapiens
gcctgggttgggggca

SEQ ID NO: 3295902 - DNA, 23 bp, Homo sapiens
gcctgggttgggggcactcagcc

SEQ ID NO: 3295903 - DNA, 14 bp, Homo sapiens
gcctggtccctggg

SEQ ID NO: 3295904 - DNA, 15 bp, Homo sapiens
gcctggtccctggga

SEQ ID NO: 3295905 - DNA, 16 bp, Homo sapiens
gcctggtccctgggag

SEQ ID NO: 3295906 - DNA, 14 bp, Homo sapiens
gcctggtggcagct

SEQ ID NO: 3295907 - DNA, 20 bp, Homo sapiens
gcctgtaatcccagcacttt

SEQ ID NO: 3295908 - DNA, 15 bp, Homo sapiens
gcctgtagagttgct

SEQ ID NO: 3295909 - DNA, 16 bp, Homo sapiens
gcctgtagttaggaaa

SEQ ID NO: 3295910 - DNA, 18 bp, Homo sapiens
gcctgtagttaggaaata

SEQ ID NO: 3295911 - DNA, 22 bp, Homo sapiens
gcctgtagttaggaaataaaac

SEQ ID NO: 3295912 - DNA, 16 bp, Homo sapiens
gcctgtcaggctctgg

SEQ ID NO: 3295913 - DNA, 13 bp, Homo sapiens
gcctgtccagcct

SEQ ID NO: 3295914 - DNA, 20 bp, Homo sapiens
gcctgtcccacccccacccc

SEQ ID NO: 3295915 - DNA, 16 bp, Homo sapiens
gcctgtcccccaaggt

SEQ ID NO: 3295916 - DNA, 17 bp, Homo sapiens
gcctgtcctcctggaag

SEQ ID NO: 3295917 - DNA, 22 bp, Homo sapiens
gctaagatgagatttgccagca

SEQ ID NO: 3295918 - DNA, 17 bp, Homo sapiens
gctaaggacatttccca

SEQ ID NO: 3295919 - DNA, 20 bp, Homo sapiens
gctaaggacatttcccaggg

SEQ ID NO: 3295920 - DNA, 20 bp, Homo sapiens
gctaagggtgggtgctcaga

SEQ ID NO: 3295921 - DNA, 21 bp, Homo sapiens
gctaagggtgggtgctcagaa

SEQ ID NO: 3295922 - DNA, 14 bp, Homo sapiens
gctaaggttctaag

SEQ ID NO: 3295923 - DNA, 15 bp, Homo sapiens
gctaaggttctaagg

SEQ ID NO: 3295924 - DNA, 15 bp, Homo sapiens
gctaagtccatcacc

SEQ ID NO: 3295925 - DNA, 16 bp, Homo sapiens
gctaagtccatcaccc

SEQ ID NO: 3295926 - DNA, 22 bp, Homo sapiens
gctaagtgatcctcccacctca

SEQ ID NO: 3295927 - DNA, 14 bp, Homo sapiens
gctaagtgcttatt

SEQ ID NO: 3295928 - DNA, 16 bp, Homo sapiens
gctaataaacactggc

SEQ ID NO: 3295929 - DNA, 23 bp, Homo sapiens
gctaataaacactggctctggga

SEQ ID NO: 3295930 - DNA, 20 bp, Homo sapiens
gctaataaactgtattaaat

SEQ ID NO: 3295931 - DNA, 20 bp, Homo sapiens
gctaatcaaagccagggtct

SEQ ID NO: 3295932 - DNA, 21 bp, Homo sapiens
gctaatcaaagccagggtctc

SEQ ID NO: 3295933 - DNA, 17 bp, Homo sapiens
gctaatcagcattctca

SEQ ID NO: 3295934 - DNA, 20 bp, Homo sapiens
gctaatgcaaattaaaacat

SEQ ID NO: 3295935 - DNA, 19 bp, Homo sapiens
gctaatgtaggactgtata

SEQ ID NO: 3295936 - DNA, 17 bp, Homo sapiens
gctaattcaaggaattt

SEQ ID NO: 3295937 - DNA, 15 bp, Homo sapiens
gctaatttaaagaga

SEQ ID NO: 3295938 - DNA, 15 bp, Homo sapiens
gctaatttatagcaa

SEQ ID NO: 3295939 - DNA, 20 bp, Homo sapiens
gctaatttgttttggatata

SEQ ID NO: 3295940 - DNA, 14 bp, Homo sapiens
gctaattttctcaa

SEQ ID NO: 3295941 - DNA, 16 bp, Homo sapiens
gctaatttttgtaatt

SEQ ID NO: 3295942 - DNA, 20 bp, Homo sapiens
gctacaaatactcttaggaa

SEQ ID NO: 3295943 - DNA, 16 bp, Homo sapiens
gctacaaatttatgca

SEQ ID NO: 3295944 - DNA, 18 bp, Homo sapiens
gctacaaatttatgcatt

SEQ ID NO: 3295945 - DNA, 20 bp, Homo sapiens
gctacaaatttatgcatttc

SEQ ID NO: 3295946 - DNA, 15 bp, Homo sapiens
gctacaacttcagca

SEQ ID NO: 3295947 - DNA, 16 bp, Homo sapiens
gctacaatttgttaat

SEQ ID NO: 3295948 - DNA, 19 bp, Homo sapiens
gctacaggaagcaccccat

SEQ ID NO: 3295949 - DNA, 20 bp, Homo sapiens
gctacaggaagcaccccatg

SEQ ID NO: 3295950 - DNA, 22 bp, Homo sapiens
gctacaggaagcaccccatgcc

SEQ ID NO: 3295951 - DNA, 23 bp, Homo sapiens
gctacaggaagcaccccatgcca

SEQ ID NO: 3295952 - DNA, 12 bp, Homo sapiens
gctacaggaggg

SEQ ID NO: 3295953 - DNA, 20 bp, Homo sapiens
gctacaggaggggtctcatg

SEQ ID NO: 3295954 - DNA, 23 bp, Homo sapiens
gctacagggcgagactctgtctc

SEQ ID NO: 3295955 - DNA, 13 bp, Homo sapiens
gctacatcagttt

SEQ ID NO: 3295956 - DNA, 23 bp, Homo sapiens
gctacatgacgacaaagctgcta

SEQ ID NO: 3295957 - DNA, 16 bp, Homo sapiens
gctacccaaaagagaa

SEQ ID NO: 3295958 - DNA, 21 bp, Homo sapiens
gctaccctttttctccagctg

SEQ ID NO: 3295959 - DNA, 22 bp, Homo sapiens
gctaccctttttctccagctgg

SEQ ID NO: 3295960 - DNA, 14 bp, Homo sapiens
gctaccgccctggg

SEQ ID NO: 3295961 - DNA, 16 bp, Homo sapiens
gctaccgccctgggct

SEQ ID NO: 3295962 - DNA, 18 bp, Homo sapiens
gctaccgccctgggctgg

SEQ ID NO: 3295963 - DNA, 22 bp, Homo sapiens
gctaccgccctgggctggactg

SEQ ID NO: 3295964 - DNA, 17 bp, Homo sapiens
gctacctcaagggggac

SEQ ID NO: 3295965 - DNA, 12 bp, Homo sapiens
gctacctccctc

SEQ ID NO: 3295966 - DNA, 15 bp, Homo sapiens
gctacctctgagaag

SEQ ID NO: 3295967 - DNA, 14 bp, Homo sapiens
gctacgaatcttcc

SEQ ID NO: 3295968 - DNA, 21 bp, Homo sapiens
gctactaagttcacattagaa

SEQ ID NO: 3295969 - DNA, 16 bp, Homo sapiens
gctactaatgatgttt

SEQ ID NO: 3295970 - DNA, 19 bp, Homo sapiens
gctactataatcaaatgat

SEQ ID NO: 3295971 - DNA, 22 bp, Homo sapiens
gctactctccccacgagggctg

SEQ ID NO: 3295972 - DNA, 23 bp, Homo sapiens
gctactctccccacgagggctgg

SEQ ID NO: 3295973 - DNA, 15 bp, Homo sapiens
gctactctgtccagg

SEQ ID NO: 3295974 - DNA, 17 bp, Homo sapiens
gctactctgtccaggcc

SEQ ID NO: 3295975 - DNA, 17 bp, Homo sapiens
gctactgatttcctttg

SEQ ID NO: 3295976 - DNA, 20 bp, Homo sapiens
gctactgatttcctttggag

SEQ ID NO: 3295977 - DNA, 16 bp, Homo sapiens
gctactgatttttgtg

SEQ ID NO: 3295978 - DNA, 17 bp, Homo sapiens
gctactgatttttgtga

SEQ ID NO: 3295979 - DNA, 18 bp, Homo sapiens
gctactgcagctttacat

SEQ ID NO: 3295980 - DNA, 12 bp, Homo sapiens
gctactggcagc

SEQ ID NO: 3295981 - DNA, 13 bp, Homo sapiens
gctactggcagct

SEQ ID NO: 3295982 - DNA, 14 bp, Homo sapiens
gctactggcagctc

SEQ ID NO: 3295983 - DNA, 16 bp, Homo sapiens
gctactggcagctcct

SEQ ID NO: 3295984 - DNA, 20 bp, Homo sapiens
gctactggcagctcctctcc

SEQ ID NO: 3295985 - DNA, 22 bp, Homo sapiens
gctactgtaattttatatgaag

SEQ ID NO: 3295986 - DNA, 19 bp, Homo sapiens
gctactgtcctacccaccc

SEQ ID NO: 3295987 - DNA, 20 bp, Homo sapiens
gctactgtcctacccaccct

SEQ ID NO: 3295988 - DNA, 14 bp, Homo sapiens
gctactgtcttact

SEQ ID NO: 3295989 - DNA, 15 bp, Homo sapiens
gctactgtgtgtgtg

SEQ ID NO: 3295990 - DNA, 19 bp, Homo sapiens
gctactgtgtgtgtgaatg

SEQ ID NO: 3295991 - DNA, 19 bp, Homo sapiens
gctacttcctcctccccac

SEQ ID NO: 3295992 - DNA, 13 bp, Homo sapiens
gctacttgggagg

SEQ ID NO: 3295993 - DNA, 22 bp, Homo sapiens
gctacttgggaggctgaggcag

SEQ ID NO: 3295994 - DNA, 14 bp, Homo sapiens
gctactttccattt

SEQ ID NO: 3295995 - DNA, 22 bp, Homo sapiens
gctactttggtttctgtctgta

SEQ ID NO: 3295996 - DNA, 23 bp, Homo sapiens
gctacttttttttagttcaatac

SEQ ID NO: 3295997 - DNA, 14 bp, Homo sapiens
gctagaactccctt

SEQ ID NO: 3295998 - DNA, 18 bp, Homo sapiens
gctagaactccctttcaa

SEQ ID NO: 3295999 - DNA, 19 bp, Homo sapiens
gctagaactccctttcaac

SEQ ID NO: 3296000 - DNA, 11 bp, Homo sapiens
gctagaacttt

SEQ ID NO: 3296001 - DNA, 15 bp, Homo sapiens
gctagacacccattt

SEQ ID NO: 3296002 - DNA, 20 bp, Homo sapiens
gctagagcaacccctgtacc

SEQ ID NO: 3296003 - DNA, 21 bp, Homo sapiens
gctagagcaacccctgtaccc

SEQ ID NO: 3296004 - DNA, 23 bp, Homo sapiens
gctagagcagcccaaatttttct

SEQ ID NO: 3296005 - DNA, 13 bp, Homo sapiens
gctagagtcctca

SEQ ID NO: 3296006 - DNA, 20 bp, Homo sapiens
gctagagtcctcactcccag

SEQ ID NO: 3296007 - DNA, 15 bp, Homo sapiens
gctagcttctgcttt

SEQ ID NO: 3296008 - DNA, 23 bp, Homo sapiens
gctagcttgacacagtcagcatg

SEQ ID NO: 3296009 - DNA, 16 bp, Homo sapiens
gctagcttttaggaaa

SEQ ID NO: 3296010 - DNA, 12 bp, Homo sapiens
gctaggaatgaa

SEQ ID NO: 3296011 - DNA, 18 bp, Homo sapiens
gctaggactgaggagtgg

SEQ ID NO: 3296012 - DNA, 18 bp, Homo sapiens
gctaggatgttgctcaga

SEQ ID NO: 3296013 - DNA, 15 bp, Homo sapiens
gctaggccccagagg

SEQ ID NO: 3296014 - DNA, 16 bp, Homo sapiens
gctaggccccagaggc

SEQ ID NO: 3296015 - DNA, 19 bp, Homo sapiens
gctaggccccagaggccct

SEQ ID NO: 3296016 - DNA, 15 bp, Homo sapiens
gctaggcctggccag

SEQ ID NO: 3296017 - DNA, 16 bp, Homo sapiens
gctagggggcgttatt

SEQ ID NO: 3296018 - DNA, 15 bp, Homo sapiens
gctagggtggccctt

SEQ ID NO: 3296019 - DNA, 17 bp, Homo sapiens
gctagtatcttcaaact

SEQ ID NO: 3296020 - DNA, 21 bp, Homo sapiens
gctagtatcttcaaactttca

SEQ ID NO: 3296021 - DNA, 14 bp, Homo sapiens
gctagtgacttgtg

SEQ ID NO: 3296022 - DNA, 11 bp, Homo sapiens
gctagtgcctt

SEQ ID NO: 3296023 - DNA, 13 bp, Homo sapiens
gctagtgccttta

SEQ ID NO: 3296024 - DNA, 23 bp, Homo sapiens
gctagtgggccctctctctgggc

SEQ ID NO: 3296025 - DNA, 17 bp, Homo sapiens
gctagtgtacctcctct

SEQ ID NO: 3296026 - DNA, 14 bp, Homo sapiens
gctagtgttctgtc

SEQ ID NO: 3296027 - DNA, 22 bp, Homo sapiens
gctagttatacttatttgtata

SEQ ID NO: 3296028 - DNA, 16 bp, Homo sapiens
gctataaagtatatat

SEQ ID NO: 3296029 - DNA, 17 bp, Homo sapiens
gctataaattttttgaa

SEQ ID NO: 3296030 - DNA, 11 bp, Homo sapiens
gctataatcat

SEQ ID NO: 3296031 - DNA, 23 bp, Homo sapiens
gctataatcattagttttagagg

SEQ ID NO: 3296032 - DNA, 18 bp, Homo sapiens
gctatactggaaatgtaa

SEQ ID NO: 3296033 - DNA, 13 bp, Homo sapiens
gctatatatataa

SEQ ID NO: 3296034 - DNA, 14 bp, Homo sapiens
gctatcacctagca

SEQ ID NO: 3296035 - DNA, 23 bp, Homo sapiens
gctatccccatctccctgcctgg

SEQ ID NO: 3296036 - DNA, 16 bp, Homo sapiens
gctatctctgtgtgca

SEQ ID NO: 3296037 - DNA, 20 bp, Homo sapiens
gctatgattatgccactgct

SEQ ID NO: 3296038 - DNA, 19 bp, Homo sapiens
gctatggagagaattaaaa

SEQ ID NO: 3296039 - DNA, 18 bp, Homo sapiens
gctatggatggcttctaa

SEQ ID NO: 3296040 - DNA, 13 bp, Homo sapiens
gctatgtaagggt

SEQ ID NO: 3296041 - DNA, 12 bp, Homo sapiens
gctattaaaaaa

SEQ ID NO: 3296042 - DNA, 12 bp, Homo sapiens
gctattacaaat

SEQ ID NO: 3296043 - DNA, 24 bp, Homo sapiens
gctccaggctcctttagcgcccag

SEQ ID NO: 3296044 - DNA, 20 bp, Homo sapiens
gctccagggaatccaagcct

SEQ ID NO: 3296045 - DNA, 22 bp, Homo sapiens
gctccagggaatccaagcctcc

SEQ ID NO: 3296046 - DNA, 23 bp, Homo sapiens
gctccagggaatccaagcctcca

SEQ ID NO: 3296047 - DNA, 21 bp, Homo sapiens
gctccaggggcccttgggaca

SEQ ID NO: 3296048 - DNA, 22 bp, Homo sapiens
gctccagggtcttgggctactg

SEQ ID NO: 3296049 - DNA, 18 bp, Homo sapiens
gctccaggtggctctgag

SEQ ID NO: 3296050 - DNA, 21 bp, Homo sapiens
gctccaggtggctctgaggtg

SEQ ID NO: 3296051 - DNA, 14 bp, Homo sapiens
gctccatgcctctg

SEQ ID NO: 3296052 - DNA, 16 bp, Homo sapiens
gctccatgcctctgga

SEQ ID NO: 3296053 - DNA, 20 bp, Homo sapiens
gctccatttataaccccagc

SEQ ID NO: 3296054 - DNA, 22 bp, Homo sapiens
gctccatttataaccccagcct

SEQ ID NO: 3296055 - DNA, 14 bp, Homo sapiens
gctccattttttct

SEQ ID NO: 3296056 - DNA, 18 bp, Homo sapiens
gctcccaacccccctcct

SEQ ID NO: 3296057 - DNA, 19 bp, Homo sapiens
gctcccaacccccctcctg

SEQ ID NO: 3296058 - DNA, 13 bp, Homo sapiens
gctcccacagaac

SEQ ID NO: 3296059 - DNA, 15 bp, Homo sapiens
gctcccacaggccct

SEQ ID NO: 3296060 - DNA, 16 bp, Homo sapiens
gctcccacaggccctt

SEQ ID NO: 3296061 - DNA, 20 bp, Homo sapiens
gctcccacaggcccttcctc

SEQ ID NO: 3296062 - DNA, 16 bp, Homo sapiens
gctcccacattctgat

SEQ ID NO: 3296063 - DNA, 21 bp, Homo sapiens
gctcccaccgcccccacccct

SEQ ID NO: 3296064 - DNA, 23 bp, Homo sapiens
gctcccagcagccctaaggatct

SEQ ID NO: 3296065 - DNA, 19 bp, Homo sapiens
gctcccagcctgccctcca

SEQ ID NO: 3296066 - DNA, 22 bp, Homo sapiens
gctcccagcctgccctccagct

SEQ ID NO: 3296067 - DNA, 14 bp, Homo sapiens
gctcccagcctgct

SEQ ID NO: 3296068 - DNA, 13 bp, Homo sapiens
gctcccagctgtg

SEQ ID NO: 3296069 - DNA, 16 bp, Homo sapiens
gctcccaggggtctcc

SEQ ID NO: 3296070 - DNA, 21 bp, Homo sapiens
gctcccaggggtctccctggc

SEQ ID NO: 3296071 - DNA, 21 bp, Homo sapiens
gctccccacaccttccagggc

SEQ ID NO: 3296072 - DNA, 19 bp, Homo sapiens
gctccccacagcgtccctg

SEQ ID NO: 3296073 - DNA, 14 bp, Homo sapiens
gctccccagccctg

SEQ ID NO: 3296074 - DNA, 15 bp, Homo sapiens
gctccccagccctgg

SEQ ID NO: 3296075 - DNA, 19 bp, Homo sapiens
gctccccagccctggctct

SEQ ID NO: 3296076 - DNA, 22 bp, Homo sapiens
gctccccagccctggctctgca

SEQ ID NO: 3296077 - DNA, 14 bp, Homo sapiens
gctccccagggctc

SEQ ID NO: 3296078 - DNA, 14 bp, Homo sapiens
gctccccatgtgtc

SEQ ID NO: 3296079 - DNA, 18 bp, Homo sapiens
gctccccccgcccaccca

SEQ ID NO: 3296080 - DNA, 20 bp, Homo sapiens
gctccccccgcccacccacg

SEQ ID NO: 3296081 - DNA, 12 bp, Homo sapiens
gctccccctgtc

SEQ ID NO: 3296082 - DNA, 18 bp, Homo sapiens
gctccccctgtcccctca

SEQ ID NO: 3296083 - DNA, 20 bp, Homo sapiens
gctccccgcctgttcccccg

SEQ ID NO: 3296084 - DNA, 22 bp, Homo sapiens
gctccccggacatactctctgc

SEQ ID NO: 3296085 - DNA, 18 bp, Homo sapiens
gctcccctaaccctactt

SEQ ID NO: 3296086 - DNA, 15 bp, Homo sapiens
gctcccgctcccagg

SEQ ID NO: 3296087 - DNA, 21 bp, Homo sapiens
gctccctagactgcatcccgt

SEQ ID NO: 3296088 - DNA, 12 bp, Homo sapiens
gctccctcagcc

SEQ ID NO: 3296089 - DNA, 18 bp, Homo sapiens
gctccctcagcctcagag

SEQ ID NO: 3296090 - DNA, 19 bp, Homo sapiens
gctccctcagcctcagagg

SEQ ID NO: 3296091 - DNA, 20 bp, Homo sapiens
gctccctcagcctcagagga

SEQ ID NO: 3296092 - DNA, 20 bp, Homo sapiens
gctccctcccctgccctggt

SEQ ID NO: 3296093 - DNA, 22 bp, Homo sapiens
gctccctcccgtagtctcctgg

SEQ ID NO: 3296094 - DNA, 24 bp, Homo sapiens
gctccctgaagccagccttcttcc

SEQ ID NO: 3296095 - DNA, 23 bp, Homo sapiens
gctccctgatgacacccaccctg

SEQ ID NO: 3296096 - DNA, 16 bp, Homo sapiens
gctccctggagccctg

SEQ ID NO: 3296097 - DNA, 18 bp, Homo sapiens
gctccctggcaggatgct

SEQ ID NO: 3296098 - DNA, 22 bp, Homo sapiens
gctccctgtgacaaaattttat

SEQ ID NO: 3296099 - DNA, 22 bp, Homo sapiens
gctccctgtgtccacctgtggg

SEQ ID NO: 3296100 - DNA, 19 bp, Homo sapiens
gctcccttcaatgctagaa

SEQ ID NO: 3296101 - DNA, 16 bp, Homo sapiens
gctcccttctctgtag

SEQ ID NO: 3296102 - DNA, 13 bp, Homo sapiens
gctccgctcccac

SEQ ID NO: 3296103 - DNA, 18 bp, Homo sapiens
gctccgctttctacccag

SEQ ID NO: 3296104 - DNA, 21 bp, Homo sapiens
gctccgctttctacccagcga

SEQ ID NO: 3296105 - DNA, 23 bp, Homo sapiens
gctccgctttctacccagcgagc

SEQ ID NO: 3296106 - DNA, 24 bp, Homo sapiens
gctccgctttctacccagcgagcc

SEQ ID NO: 3296107 - DNA, 15 bp, Homo sapiens
gctcctaactccacc

SEQ ID NO: 3296108 - DNA, 16 bp, Homo sapiens
gctcctaactccaccg

SEQ ID NO: 3296109 - DNA, 17 bp, Homo sapiens
gctcctaactccaccgc

SEQ ID NO: 3296110 - DNA, 21 bp, Homo sapiens
gctcctcaacccctcccctcc

SEQ ID NO: 3296111 - DNA, 23 bp, Homo sapiens
gctcctcactgcccgcacaccct

SEQ ID NO: 3296112 - DNA, 16 bp, Homo sapiens
gctcctcagcggctcc

SEQ ID NO: 3296113 - DNA, 19 bp, Homo sapiens
gctcctcatggtgggttca

SEQ ID NO: 3296114 - DNA, 13 bp, Homo sapiens
gctcctcccagct

SEQ ID NO: 3296115 - DNA, 23 bp, Homo sapiens
gctcctcccagcttgtaggagct

SEQ ID NO: 3296116 - DNA, 15 bp, Homo sapiens
gctcctcccctcttg

SEQ ID NO: 3296117 - DNA, 17 bp, Homo sapiens
gctcctccctgcccccc

SEQ ID NO: 3296118 - DNA, 22 bp, Homo sapiens
gctcctccctgccccccaaggt

SEQ ID NO: 3296119 - DNA, 13 bp, Homo sapiens
gctcctccctggc

SEQ ID NO: 3296120 - DNA, 14 bp, Homo sapiens
gctcctccctggct

SEQ ID NO: 3296121 - DNA, 15 bp, Homo sapiens
gctcctccctggctg

SEQ ID NO: 3296122 - DNA, 19 bp, Homo sapiens
gctcctccctggctgccct

SEQ ID NO: 3296123 - DNA, 18 bp, Homo sapiens
gctcctcctgccctgtcc

SEQ ID NO: 3296124 - DNA, 14 bp, Homo sapiens
gctcctcctgtgtg

SEQ ID NO: 3296125 - DNA, 17 bp, Homo sapiens
gctcctcctgtgtgact

SEQ ID NO: 3296126 - DNA, 12 bp, Homo sapiens
gctcctctccag

SEQ ID NO: 3296127 - DNA, 17 bp, Homo sapiens
gctcctctccaggcacc

SEQ ID NO: 3296128 - DNA, 16 bp, Homo sapiens
gctcctctccccagca

SEQ ID NO: 3296129 - DNA, 16 bp, Homo sapiens
gctcctctccctcaca

SEQ ID NO: 3296130 - DNA, 19 bp, Homo sapiens
gctcctctccctcacaagc

SEQ ID NO: 3296131 - DNA, 20 bp, Homo sapiens
gctcctctccttgggctcct

SEQ ID NO: 3296132 - DNA, 21 bp, Homo sapiens
gctcctgagaaaggtgaggag

SEQ ID NO: 3296133 - DNA, 19 bp, Homo sapiens
gctcctgccagtgtggaac

SEQ ID NO: 3296134 - DNA, 12 bp, Homo sapiens
gctcctgcccac

SEQ ID NO: 3296135 - DNA, 21 bp, Homo sapiens
gctcctgccgcagacgggcac

SEQ ID NO: 3296136 - DNA, 13 bp, Homo sapiens
gctcctgctgcgg

SEQ ID NO: 3296137 - DNA, 23 bp, Homo sapiens
gctcctggaaaggctcagtctca

SEQ ID NO: 3296138 - DNA, 11 bp, Homo sapiens
gctcctggctg

SEQ ID NO: 3296139 - DNA, 13 bp, Homo sapiens
gctcctggctgcc

SEQ ID NO: 3296140 - DNA, 17 bp, Homo sapiens
gctcctggctgccaggc

SEQ ID NO: 3296141 - DNA, 19 bp, Homo sapiens
gctcctggctgccaggcgt

SEQ ID NO: 3296142 - DNA, 23 bp, Homo sapiens
gctcctgggggttctttcttcct

SEQ ID NO: 3296143 - DNA, 19 bp, Homo sapiens
gctcctggtggccttctgc

SEQ ID NO: 3296144 - DNA, 13 bp, Homo sapiens
gctcctgtcctcc

SEQ ID NO: 3296145 - DNA, 13 bp, Homo sapiens
gctcctgtggccc

SEQ ID NO: 3296146 - DNA, 20 bp, Homo sapiens
gctcctgtggccccaccctg

SEQ ID NO: 3296147 - DNA, 21 bp, Homo sapiens
gctcctgtggccccaccctgg

SEQ ID NO: 3296148 - DNA, 13 bp, Homo sapiens
gctcctgtgtctt

SEQ ID NO: 3296149 - DNA, 17 bp, Homo sapiens
gctccttcactgttccc

SEQ ID NO: 3296150 - DNA, 13 bp, Homo sapiens
gctccttcccatc

SEQ ID NO: 3296151 - DNA, 17 bp, Homo sapiens
gctccttgagtaaaaag

SEQ ID NO: 3296152 - DNA, 18 bp, Homo sapiens
gctccttgagtaaaaagg

SEQ ID NO: 3296153 - DNA, 15 bp, Homo sapiens
gctccttgattgcct

SEQ ID NO: 3296154 - DNA, 16 bp, Homo sapiens
gctcctttctccagcc

SEQ ID NO: 3296155 - DNA, 14 bp, Homo sapiens
gctcctttctcctg

SEQ ID NO: 3296156 - DNA, 19 bp, Homo sapiens
gctcctttctcctgtgaat

SEQ ID NO: 3296157 - DNA, 20 bp, Homo sapiens
gctccttttccgttctgttc

SEQ ID NO: 3296158 - DNA, 19 bp, Homo sapiens
gctccttttgtatcttcct

SEQ ID NO: 3296159 - DNA, 20 bp, Homo sapiens
gctccttttgtatcttcctt

SEQ ID NO: 3296160 - DNA, 20 bp, Homo sapiens
gctccttttgtccccagggc

SEQ ID NO: 3296161 - DNA, 21 bp, Homo sapiens
gctccttttgtccccagggcc

SEQ ID NO: 3296162 - DNA, 21 bp, Homo sapiens
gctcgatccaaattgtgcttc

SEQ ID NO: 3296163 - DNA, 13 bp, Homo sapiens
gctcgccatgccg

SEQ ID NO: 3296164 - DNA, 16 bp, Homo sapiens
gctcgcccaggaaggc

SEQ ID NO: 3296165 - DNA, 16 bp, Homo sapiens
gctcgccctcctttct

SEQ ID NO: 3296166 - DNA, 19 bp, Homo sapiens
gctcgccctcctttctgtg

SEQ ID NO: 3296167 - DNA, 20 bp, Homo sapiens
gctcgccctcctttctgtgc

SEQ ID NO: 3296168 - DNA, 16 bp, Homo sapiens
gctggtaacagttcat

SEQ ID NO: 3296169 - DNA, 22 bp, Homo sapiens
gctggtaacagttcatgtttgc

SEQ ID NO: 3296170 - DNA, 17 bp, Homo sapiens
gctggtacctgccctct

SEQ ID NO: 3296171 - DNA, 14 bp, Homo sapiens
gctggtagctcagg

SEQ ID NO: 3296172 - DNA, 15 bp, Homo sapiens
gctggtagctcaggt

SEQ ID NO: 3296173 - DNA, 16 bp, Homo sapiens
gctggtagctcaggtg

SEQ ID NO: 3296174 - DNA, 19 bp, Homo sapiens
gctggtagctcaggtgggc

SEQ ID NO: 3296175 - DNA, 19 bp, Homo sapiens
gctggtaggctcctgccag

SEQ ID NO: 3296176 - DNA, 16 bp, Homo sapiens
gctggtatctcagaaa

SEQ ID NO: 3296177 - DNA, 24 bp, Homo sapiens
gctggtatctcagaaagtgcctga

SEQ ID NO: 3296178 - DNA, 23 bp, Homo sapiens
gctggtcactaaccaacaaggtt

SEQ ID NO: 3296179 - DNA, 16 bp, Homo sapiens
gctggtcccctcctca

SEQ ID NO: 3296180 - DNA, 20 bp, Homo sapiens
gctggtcccctcctcagtga

SEQ ID NO: 3296181 - DNA, 18 bp, Homo sapiens
gctggtccgagctgagga

SEQ ID NO: 3296182 - DNA, 13 bp, Homo sapiens
gctggtgcattac

SEQ ID NO: 3296183 - DNA, 20 bp, Homo sapiens
gctggtgcattacagagagg

SEQ ID NO: 3296184 - DNA, 15 bp, Homo sapiens
gctggtgccaggcgc

SEQ ID NO: 3296185 - DNA, 14 bp, Homo sapiens
gctggtgccccaca

SEQ ID NO: 3296186 - DNA, 16 bp, Homo sapiens
gctggtgccccacagc

SEQ ID NO: 3296187 - DNA, 14 bp, Homo sapiens
gctggtgcccggag

SEQ ID NO: 3296188 - DNA, 12 bp, Homo sapiens
gctggtgggagg

SEQ ID NO: 3296189 - DNA, 13 bp, Homo sapiens
gctggtgggaggg

SEQ ID NO: 3296190 - DNA, 14 bp, Homo sapiens
gctggtgggagggg

SEQ ID NO: 3296191 - DNA, 17 bp, Homo sapiens
gctggtgtcctgaccac

SEQ ID NO: 3296192 - DNA, 16 bp, Homo sapiens
gctggttactcagggt

SEQ ID NO: 3296193 - DNA, 23 bp, Homo sapiens
gctggttactcagggttcatctg

SEQ ID NO: 3296194 - DNA, 22 bp, Homo sapiens
gctggttcagggttggcccctg

SEQ ID NO: 3296195 - DNA, 13 bp, Homo sapiens
gctggttgctgtg

SEQ ID NO: 3296196 - DNA, 14 bp, Homo sapiens
gctggttgtcttta

SEQ ID NO: 3296197 - DNA, 16 bp, Homo sapiens
gctgtaaaatgcatga

SEQ ID NO: 3296198 - DNA, 22 bp, Homo sapiens
gctgtaaaattataaactttta

SEQ ID NO: 3296199 - DNA, 18 bp, Homo sapiens
gctgtaacgtggcactgg

SEQ ID NO: 3296200 - DNA, 16 bp, Homo sapiens
gctgtaactgctgagc

SEQ ID NO: 3296201 - DNA, 18 bp, Homo sapiens
gctgtaactgctgagcca

SEQ ID NO: 3296202 - DNA, 19 bp, Homo sapiens
gctgtaactgctgagccac

SEQ ID NO: 3296203 - DNA, 14 bp, Homo sapiens
gctgtaagctcctt

SEQ ID NO: 3296204 - DNA, 16 bp, Homo sapiens
gctgtaaggctctaga

SEQ ID NO: 3296205 - DNA, 19 bp, Homo sapiens
gctgtaagggcagtgccca

SEQ ID NO: 3296206 - DNA, 12 bp, Homo sapiens
gctgtacatcta

SEQ ID NO: 3296207 - DNA, 15 bp, Homo sapiens
gctgtacccagatgc

SEQ ID NO: 3296208 - DNA, 15 bp, Homo sapiens
gctgtacccttccac

SEQ ID NO: 3296209 - DNA, 17 bp, Homo sapiens
gctgtacccttccacct

SEQ ID NO: 3296210 - DNA, 17 bp, Homo sapiens
gctgtaccctttaagat

SEQ ID NO: 3296211 - DNA, 20 bp, Homo sapiens
gctgtacgcgtttgtctcgt

SEQ ID NO: 3296212 - DNA, 15 bp, Homo sapiens
gctgtactataagta

SEQ ID NO: 3296213 - DNA, 16 bp, Homo sapiens
gctgtactcagagcag

SEQ ID NO: 3296214 - DNA, 20 bp, Homo sapiens
gctgtacttcgtcttctaat

SEQ ID NO: 3296215 - DNA, 17 bp, Homo sapiens
gctgtacttcttgaata

SEQ ID NO: 3296216 - DNA, 20 bp, Homo sapiens
gctgtacttcttgaatataa

SEQ ID NO: 3296217 - DNA, 21 bp, Homo sapiens
gctgtagccatggctcaggca

SEQ ID NO: 3296218 - DNA, 20 bp, Homo sapiens
gctgtagctacaagggaagc

SEQ ID NO: 3296219 - DNA, 20 bp, Homo sapiens
gctgtagtcctcataaaaag

SEQ ID NO: 3296220 - DNA, 19 bp, Homo sapiens
gctgtagtcctttctgcct

SEQ ID NO: 3296221 - DNA, 17 bp, Homo sapiens
gctgtatcccatgagcc

SEQ ID NO: 3296222 - DNA, 19 bp, Homo sapiens
gctgtatcccatgagcctc

SEQ ID NO: 3296223 - DNA, 20 bp, Homo sapiens
gctgtatcccatgagcctca

SEQ ID NO: 3296224 - DNA, 21 bp, Homo sapiens
gctgtatgatttgttttgaat

SEQ ID NO: 3296225 - DNA, 15 bp, Homo sapiens
gctgtatgctgatca

SEQ ID NO: 3296226 - DNA, 14 bp, Homo sapiens
gctgtattgtctga

SEQ ID NO: 3296227 - DNA, 15 bp, Homo sapiens
gctgtattttaacac

SEQ ID NO: 3296228 - DNA, 13 bp, Homo sapiens
gctgtcacaggcg

SEQ ID NO: 3296229 - DNA, 16 bp, Homo sapiens
gctgtcaccaaggaaa

SEQ ID NO: 3296230 - DNA, 17 bp, Homo sapiens
gctgtcaccaaggaaac

SEQ ID NO: 3296231 - DNA, 13 bp, Homo sapiens
gctgtcactggct

SEQ ID NO: 3296232 - DNA, 15 bp, Homo sapiens
gctgtcactggctgg

SEQ ID NO: 3296233 - DNA, 16 bp, Homo sapiens
gctgtcactggctggc

SEQ ID NO: 3296234 - DNA, 17 bp, Homo sapiens
gctgtcactggctggct

SEQ ID NO: 3296235 - DNA, 20 bp, Homo sapiens
gctgtcactggctggctcct

SEQ ID NO: 3296236 - DNA, 21 bp, Homo sapiens
gctgtcagtgtatggggcagc

SEQ ID NO: 3296237 - DNA, 21 bp, Homo sapiens
gctgtcattgcacataagctt

SEQ ID NO: 3296238 - DNA, 16 bp, Homo sapiens
gctgtccagagaaaag

SEQ ID NO: 3296239 - DNA, 16 bp, Homo sapiens
gctgtccatgcttctc

SEQ ID NO: 3296240 - DNA, 13 bp, Homo sapiens
gctgtccctcact

SEQ ID NO: 3296241 - DNA, 15 bp, Homo sapiens
gctgtccctccccct

SEQ ID NO: 3296242 - DNA, 16 bp, Homo sapiens
gctgtccctccccctt

SEQ ID NO: 3296243 - DNA, 13 bp, Homo sapiens
gctgtccctgcag

SEQ ID NO: 3296244 - DNA, 14 bp, Homo sapiens
gctgtccctgcagg

SEQ ID NO: 3296245 - DNA, 15 bp, Homo sapiens
gctgtcctccctcca

SEQ ID NO: 3296246 - DNA, 17 bp, Homo sapiens
gctgtcctctcgagccc

SEQ ID NO: 3296247 - DNA, 20 bp, Homo sapiens
gctgtcctctcgagcccaga

SEQ ID NO: 3296248 - DNA, 15 bp, Homo sapiens
gctgtcgccccaggc

SEQ ID NO: 3296249 - DNA, 19 bp, Homo sapiens
gctgtcgccccaggccctc

SEQ ID NO: 3296250 - DNA, 21 bp, Homo sapiens
gctgtcgccccaggccctccc

SEQ ID NO: 3296251 - DNA, 19 bp, Homo sapiens
gctgtctatgattgtactt

SEQ ID NO: 3296252 - DNA, 19 bp, Homo sapiens
gctgtctatgcagcctgct

SEQ ID NO: 3296253 - DNA, 21 bp, Homo sapiens
gctgtctatgcagcctgctct

SEQ ID NO: 3296254 - DNA, 17 bp, Homo sapiens
gctgtctccatgtttga

SEQ ID NO: 3296255 - DNA, 12 bp, Homo sapiens
gctgtctgcctg

SEQ ID NO: 3296256 - DNA, 13 bp, Homo sapiens
gctgtctgtcacc

SEQ ID NO: 3296257 - DNA, 21 bp, Homo sapiens
gctgtctgtcaccagctatct

SEQ ID NO: 3296258 - DNA, 21 bp, Homo sapiens
gctgtcttaaactaaatgtgc

SEQ ID NO: 3296259 - DNA, 19 bp, Homo sapiens
gctgtcttctggtctgtgt

SEQ ID NO: 3296260 - DNA, 20 bp, Homo sapiens
gctgtcttgatgactgctga

SEQ ID NO: 3296261 - DNA, 16 bp, Homo sapiens
gctgtgaacaggctgg

SEQ ID NO: 3296262 - DNA, 15 bp, Homo sapiens
gctgtgagcccctgg

SEQ ID NO: 3296263 - DNA, 16 bp, Homo sapiens
gctgtgagcccctggt

SEQ ID NO: 3296264 - DNA, 11 bp, Homo sapiens
gctgtgaggaa

SEQ ID NO: 3296265 - DNA, 18 bp, Homo sapiens
gctgtgaggcccctggac

SEQ ID NO: 3296266 - DNA, 15 bp, Homo sapiens
gctgtgaggctgtcc

SEQ ID NO: 3296267 - DNA, 20 bp, Homo sapiens
gctgtgatacgatgcttcaa

SEQ ID NO: 3296268 - DNA, 14 bp, Homo sapiens
gctgtgccagcagg

SEQ ID NO: 3296269 - DNA, 13 bp, Homo sapiens
gctgtgcctgcta

SEQ ID NO: 3296270 - DNA, 15 bp, Homo sapiens
gctgtgctatgaatt

SEQ ID NO: 3296271 - DNA, 14 bp, Homo sapiens
gctgtgctcagaga

SEQ ID NO: 3296272 - DNA, 19 bp, Homo sapiens
gctgtgctctcaccagctg

SEQ ID NO: 3296273 - DNA, 13 bp, Homo sapiens
gctgtgctctgga

SEQ ID NO: 3296274 - DNA, 21 bp, Homo sapiens
gctgtgctctggacaggcatg

SEQ ID NO: 3296275 - DNA, 13 bp, Homo sapiens
gctgtgctgctca

SEQ ID NO: 3296276 - DNA, 14 bp, Homo sapiens
gctgtgctgctttt

SEQ ID NO: 3296277 - DNA, 22 bp, Homo sapiens
gctgtggaccgtggacaggccc

SEQ ID NO: 3296278 - DNA, 16 bp, Homo sapiens
gctgtggaggcctgat

SEQ ID NO: 3296279 - DNA, 22 bp, Homo sapiens
gctgtggaggcctgatgctgcc

SEQ ID NO: 3296280 - DNA, 13 bp, Homo sapiens
gctgtggcacaga

SEQ ID NO: 3296281 - DNA, 15 bp, Homo sapiens
gctgtggcacagact

SEQ ID NO: 3296282 - DNA, 15 bp, Homo sapiens
gctgtggcctcaccc

SEQ ID NO: 3296283 - DNA, 13 bp, Homo sapiens
gctgtgggcagca

SEQ ID NO: 3296284 - DNA, 16 bp, Homo sapiens
gctgtgggcagcaccc

SEQ ID NO: 3296285 - DNA, 16 bp, Homo sapiens
gctgtggggctggtag

SEQ ID NO: 3296286 - DNA, 18 bp, Homo sapiens
gctgtgtgaatacctgct

SEQ ID NO: 3296287 - DNA, 12 bp, Homo sapiens
gctgtgtgcagg

SEQ ID NO: 3296288 - DNA, 12 bp, Homo sapiens
gctgtgtgtgag

SEQ ID NO: 3296289 - DNA, 12 bp, Homo sapiens
gctgttaaactg

SEQ ID NO: 3296290 - DNA, 14 bp, Homo sapiens
gctgttaaactgtt

SEQ ID NO: 3296291 - DNA, 18 bp, Homo sapiens
gctgttaatagatcttag

SEQ ID NO: 3296292 - DNA, 18 bp, Homo sapiens
gctgttactgttaaccat

SEQ ID NO: 3296293 - DNA, 13 bp, Homo sapiens
gctgttcctgaga

SEQ ID NO: 3296294 - DNA, 18 bp, Homo sapiens
gctgttcctgctccatga

SEQ ID NO: 3296295 - DNA, 16 bp, Homo sapiens
ggaaactaagattctt

SEQ ID NO: 3296296 - DNA, 17 bp, Homo sapiens
ggaaactaagattcttt

SEQ ID NO: 3296297 - DNA, 19 bp, Homo sapiens
ggaaactaagattctttta

SEQ ID NO: 3296298 - DNA, 17 bp, Homo sapiens
ggaaactaccaggtgtg

SEQ ID NO: 3296299 - DNA, 18 bp, Homo sapiens
ggaaactcacactcccct

SEQ ID NO: 3296300 - DNA, 20 bp, Homo sapiens
ggaaactccacatctgcctt

SEQ ID NO: 3296301 - DNA, 17 bp, Homo sapiens
ggaaactcttatctcag

SEQ ID NO: 3296302 - DNA, 21 bp, Homo sapiens
ggaaagaagggggccctgcta

SEQ ID NO: 3296303 - DNA, 14 bp, Homo sapiens
ggaaagatggataa

SEQ ID NO: 3296304 - DNA, 15 bp, Homo sapiens
ggaaagatggataaa

SEQ ID NO: 3296305 - DNA, 15 bp, Homo sapiens
ggaaagcaggatgta

SEQ ID NO: 3296306 - DNA, 20 bp, Homo sapiens
ggaaagccacctctccctca

SEQ ID NO: 3296307 - DNA, 14 bp, Homo sapiens
ggaaagcccagact

SEQ ID NO: 3296308 - DNA, 13 bp, Homo sapiens
ggaaagcctctgc

SEQ ID NO: 3296309 - DNA, 20 bp, Homo sapiens
ggaaaggatcctacaatatt

SEQ ID NO: 3296310 - DNA, 19 bp, Homo sapiens
ggaaaggctcagtctcagg

SEQ ID NO: 3296311 - DNA, 14 bp, Homo sapiens
ggaaaggggagagc

SEQ ID NO: 3296312 - DNA, 20 bp, Homo sapiens
ggaaaggtgtgagactggga

SEQ ID NO: 3296313 - DNA, 19 bp, Homo sapiens
ggaaagtgctgtcttaaac

SEQ ID NO: 3296314 - DNA, 15 bp, Homo sapiens
ggaaataaaaaagtc

SEQ ID NO: 3296315 - DNA, 22 bp, Homo sapiens
ggaaataaaaaagtctctattt

SEQ ID NO: 3296316 - DNA, 16 bp, Homo sapiens
ggaaataaaacctttc

SEQ ID NO: 3296317 - DNA, 20 bp, Homo sapiens
ggaaataaaacctttcaaat

SEQ ID NO: 3296318 - DNA, 18 bp, Homo sapiens
ggaaatacacttcttttg

SEQ ID NO: 3296319 - DNA, 18 bp, Homo sapiens
ggaaatacagttctgctc

SEQ ID NO: 3296320 - DNA, 19 bp, Homo sapiens
ggaaatacagttctgctct

SEQ ID NO: 3296321 - DNA, 14 bp, Homo sapiens
ggaaatatatatgt

SEQ ID NO: 3296322 - DNA, 16 bp, Homo sapiens
ggaaatcaaccctctc

SEQ ID NO: 3296323 - DNA, 19 bp, Homo sapiens
ggaaatcaaccctctcctg

SEQ ID NO: 3296324 - DNA, 22 bp, Homo sapiens
ggaaatcctagtttcctctcct

SEQ ID NO: 3296325 - DNA, 18 bp, Homo sapiens
ggaaatctcaccccatcc

SEQ ID NO: 3296326 - DNA, 15 bp, Homo sapiens
ggaaatgtacttttg

SEQ ID NO: 3296327 - DNA, 15 bp, Homo sapiens
ggaaattccttgccc

SEQ ID NO: 3296328 - DNA, 22 bp, Homo sapiens
ggaaattccttgccccacagtt

SEQ ID NO: 3296329 - DNA, 17 bp, Homo sapiens
ggaaattggaagagcac

SEQ ID NO: 3296330 - DNA, 14 bp, Homo sapiens
ggaacaaacagggc

SEQ ID NO: 3296331 - DNA, 15 bp, Homo sapiens
ggaacaaattatttt

SEQ ID NO: 3296332 - DNA, 15 bp, Homo sapiens
ggaacaattgaagta

SEQ ID NO: 3296333 - DNA, 21 bp, Homo sapiens
ggaacaattgaagtaaacttt

SEQ ID NO: 3296334 - DNA, 22 bp, Homo sapiens
ggaacactggtgggcagctgag

SEQ ID NO: 3296335 - DNA, 14 bp, Homo sapiens
ggaacagaccagtg

SEQ ID NO: 3296336 - DNA, 15 bp, Homo sapiens
ggaacagaccagtga

SEQ ID NO: 3296337 - DNA, 17 bp, Homo sapiens
ggaacagactggaagca

SEQ ID NO: 3296338 - DNA, 23 bp, Homo sapiens
ggaacagctatgggagccccagg

SEQ ID NO: 3296339 - DNA, 23 bp, Homo sapiens
ggaacagtgtttcccataatttt

SEQ ID NO: 3296340 - DNA, 15 bp, Homo sapiens
ggaacatcctttgca

SEQ ID NO: 3296341 - DNA, 21 bp, Homo sapiens
ggaacatcctttgcagggcag

SEQ ID NO: 3296342 - DNA, 22 bp, Homo sapiens
ggaacatcctttgcagggcagc

SEQ ID NO: 3296343 - DNA, 23 bp, Homo sapiens
ggaacatcctttgcagggcagcc

SEQ ID NO: 3296344 - DNA, 14 bp, Homo sapiens
ggaacatgccccct

SEQ ID NO: 3296345 - DNA, 21 bp, Homo sapiens
ggaacatttctgtaaatacca

SEQ ID NO: 3296346 - DNA, 22 bp, Homo sapiens
ggaacatttgatatttttccat

SEQ ID NO: 3296347 - DNA, 15 bp, Homo sapiens
ggaaccaagcaggag

SEQ ID NO: 3296348 - DNA, 12 bp, Homo sapiens
ggaaccacaggg

SEQ ID NO: 3296349 - DNA, 13 bp, Homo sapiens
ggaaccacagggc

SEQ ID NO: 3296350 - DNA, 14 bp, Homo sapiens
ggaaccactcccac

SEQ ID NO: 3296351 - DNA, 20 bp, Homo sapiens
ggaacccagcagttctgtta

SEQ ID NO: 3296352 - DNA, 14 bp, Homo sapiens
ggaaccgctcacct

SEQ ID NO: 3296353 - DNA, 19 bp, Homo sapiens
ggaaccgctcacctagagc

SEQ ID NO: 3296354 - DNA, 22 bp, Homo sapiens
ggaacctagtactctctgctct

SEQ ID NO: 3296355 - DNA, 15 bp, Homo sapiens
ggaacctctgtctca

SEQ ID NO: 3296356 - DNA, 22 bp, Homo sapiens
ggaacctgtcctaaggaacctt

SEQ ID NO: 3296357 - DNA, 21 bp, Homo sapiens
ggaaccttccttcctgcttga

SEQ ID NO: 3296358 - DNA, 15 bp, Homo sapiens
ggaaccttgctgtcc

SEQ ID NO: 3296359 - DNA, 22 bp, Homo sapiens
ggaacgagcactggccagagag

SEQ ID NO: 3296360 - DNA, 18 bp, Homo sapiens
ggaacgggcagcctgggc

SEQ ID NO: 3296361 - DNA, 20 bp, Homo sapiens
ggaactagactgcctgggtt

SEQ ID NO: 3296362 - DNA, 17 bp, Homo sapiens
ggaactcatctggttga

SEQ ID NO: 3296363 - DNA, 13 bp, Homo sapiens
ggaactccactct

SEQ ID NO: 3296364 - DNA, 16 bp, Homo sapiens
ggaactccttggccta

SEQ ID NO: 3296365 - DNA, 19 bp, Homo sapiens
ggaactctatctgggcctg

SEQ ID NO: 3296366 - DNA, 11 bp, Homo sapiens
ggaactctgac

SEQ ID NO: 3296367 - DNA, 19 bp, Homo sapiens
ggaactctggacccctggg

SEQ ID NO: 3296368 - DNA, 12 bp, Homo sapiens
ggaactgggctg

SEQ ID NO: 3296369 - DNA, 18 bp, Homo sapiens
ggaactgtccagagagca

SEQ ID NO: 3296370 - DNA, 23 bp, Homo sapiens
ggaagaaaaaaatcttctccaga

SEQ ID NO: 3296371 - DNA, 16 bp, Homo sapiens
ggaagaaaactatcct

SEQ ID NO: 3296372 - DNA, 13 bp, Homo sapiens
ggaagaacataga

SEQ ID NO: 3296373 - DNA, 14 bp, Homo sapiens
ggaagaacatagaa

SEQ ID NO: 3296374 - DNA, 15 bp, Homo sapiens
ggaagaagggagaag

SEQ ID NO: 3296375 - DNA, 18 bp, Homo sapiens
ggaagaagggagaagaaa

SEQ ID NO: 3296376 - DNA, 13 bp, Homo sapiens
ggaagaatgaaag

SEQ ID NO: 3296377 - DNA, 15 bp, Homo sapiens
ggaagacacttcaga

SEQ ID NO: 3296378 - DNA, 22 bp, Homo sapiens
ggaagacacttcagatctgagg

SEQ ID NO: 3296379 - DNA, 17 bp, Homo sapiens
ggaagacagcatttaaa

SEQ ID NO: 3296380 - DNA, 15 bp, Homo sapiens
ggaagacatttttcc

SEQ ID NO: 3296381 - DNA, 21 bp, Homo sapiens
ggaagagaagagggcccagcc

SEQ ID NO: 3296382 - DNA, 12 bp, Homo sapiens
ggaagagcagcc

SEQ ID NO: 3296383 - DNA, 13 bp, Homo sapiens
ggaagagcaggac

SEQ ID NO: 3296384 - DNA, 18 bp, Homo sapiens
ggaagagccgagcacctg

SEQ ID NO: 3296385 - DNA, 22 bp, Homo sapiens
ggaagaggcatcgcctgcagga

SEQ ID NO: 3296386 - DNA, 23 bp, Homo sapiens
ggaagagggaccagggtgggaga

SEQ ID NO: 3296387 - DNA, 21 bp, Homo sapiens
ggaagagggcagtacctggga

SEQ ID NO: 3296388 - DNA, 19 bp, Homo sapiens
ggaagagggctgagctgag

SEQ ID NO: 3296389 - DNA, 22 bp, Homo sapiens
ggaagagggctgagctgagctt

SEQ ID NO: 3296390 - DNA, 17 bp, Homo sapiens
ggaagaggggctggggc

SEQ ID NO: 3296391 - DNA, 18 bp, Homo sapiens
ggaagaggggctggggca

SEQ ID NO: 3296392 - DNA, 18 bp, Homo sapiens
ggaagataggctctgcac

SEQ ID NO: 3296393 - DNA, 18 bp, Homo sapiens
ggaagatgaggttctgag

SEQ ID NO: 3296394 - DNA, 18 bp, Homo sapiens
ggaagatgggggcaagaa

SEQ ID NO: 3296395 - DNA, 21 bp, Homo sapiens
ggaagatttaccttttctgtt

SEQ ID NO: 3296396 - DNA, 13 bp, Homo sapiens
ggaagcaccccat

SEQ ID NO: 3296397 - DNA, 13 bp, Homo sapiens
ggaagcagccagc

SEQ ID NO: 3296398 - DNA, 20 bp, Homo sapiens
ggaagcagtgccttccataa

SEQ ID NO: 3296399 - DNA, 21 bp, Homo sapiens
ggaagcagtgccttccataat

SEQ ID NO: 3296400 - DNA, 10 bp, Homo sapiens
ggaagccagg

SEQ ID NO: 3296401 - DNA, 21 bp, Homo sapiens
ggaagccaggtacaggagagg

SEQ ID NO: 3296402 - DNA, 15 bp, Homo sapiens
ggaagccaggtgagc

SEQ ID NO: 3296403 - DNA, 20 bp, Homo sapiens
ggaagccatcccttttttta

SEQ ID NO: 3296404 - DNA, 13 bp, Homo sapiens
ggaagcccctggg

SEQ ID NO: 3296405 - DNA, 15 bp, Homo sapiens
ggaagccgtctgact

SEQ ID NO: 3296406 - DNA, 17 bp, Homo sapiens
ggaagccgtctgactcc

SEQ ID NO: 3296407 - DNA, 20 bp, Homo sapiens
ggaagccgtctgactccaga

SEQ ID NO: 3296408 - DNA, 21 bp, Homo sapiens
ggaagccgtctgactccagag

SEQ ID NO: 3296409 - DNA, 22 bp, Homo sapiens
ggaagccgtctgactccagagt

SEQ ID NO: 3296410 - DNA, 16 bp, Homo sapiens
ggaagctaatttgcat

SEQ ID NO: 3296411 - DNA, 11 bp, Homo sapiens
ggaagctccgc

SEQ ID NO: 3296412 - DNA, 13 bp, Homo sapiens
ggaagctgaggcg

SEQ ID NO: 3296413 - DNA, 13 bp, Homo sapiens
ggaagctgcagct

SEQ ID NO: 3296414 - DNA, 15 bp, Homo sapiens
ggaagctgccagccc

SEQ ID NO: 3296415 - DNA, 20 bp, Homo sapiens
ggaagctgccagcccagaac

SEQ ID NO: 3296416 - DNA, 18 bp, Homo sapiens
ggaagctgtgttgaaaca

SEQ ID NO: 3296417 - DNA, 20 bp, Homo sapiens
ggaagctgtgttgaaacaga

SEQ ID NO: 3296418 - DNA, 21 bp, Homo sapiens
ggaagctgtgttgaaacagaa

SEQ ID NO: 3296419 - DNA, 17 bp, Homo sapiens
ggaagcttgagcctccc

SEQ ID NO: 3296420 - DNA, 19 bp, Homo sapiens
ggaaggacaggaccctcag

SEQ ID NO: 3296421 - DNA, 18 bp, Homo sapiens
ggagaaaaaaattgctct

SEQ ID NO: 3296422 - DNA, 19 bp, Homo sapiens
ggagaaaaaaattgctctg

SEQ ID NO: 3296423 - DNA, 16 bp, Homo sapiens
ggagaaacagagacag

SEQ ID NO: 3296424 - DNA, 15 bp, Homo sapiens
ggagaaactccaaag

SEQ ID NO: 3296425 - DNA, 21 bp, Homo sapiens
ggagaacagtggttgcctggg

SEQ ID NO: 3296426 - DNA, 23 bp, Homo sapiens
ggagaacatctttgacactctgc

SEQ ID NO: 3296427 - DNA, 20 bp, Homo sapiens
ggagaaccaaatctggaagc

SEQ ID NO: 3296428 - DNA, 14 bp, Homo sapiens
ggagaagacactgc

SEQ ID NO: 3296429 - DNA, 15 bp, Homo sapiens
ggagaagacactgca

SEQ ID NO: 3296430 - DNA, 19 bp, Homo sapiens
ggagaagacactgcagtga

SEQ ID NO: 3296431 - DNA, 15 bp, Homo sapiens
ggagaagagaggaga

SEQ ID NO: 3296432 - DNA, 13 bp, Homo sapiens
ggagaagagccct

SEQ ID NO: 3296433 - DNA, 19 bp, Homo sapiens
ggagaagaggcatcctgcc

SEQ ID NO: 3296434 - DNA, 21 bp, Homo sapiens
ggagaagaggcatcctgcctg

SEQ ID NO: 3296435 - DNA, 20 bp, Homo sapiens
ggagaagagttgaggaactg

SEQ ID NO: 3296436 - DNA, 13 bp, Homo sapiens
ggagaagcatgaa

SEQ ID NO: 3296437 - DNA, 17 bp, Homo sapiens
ggagaaggaagggcaga

SEQ ID NO: 3296438 - DNA, 15 bp, Homo sapiens
ggagaaggggagtga

SEQ ID NO: 3296439 - DNA, 17 bp, Homo sapiens
ggagaatcatgtgaacc

SEQ ID NO: 3296440 - DNA, 22 bp, Homo sapiens
ggagaatggtgttccattgcct

SEQ ID NO: 3296441 - DNA, 22 bp, Homo sapiens
ggagaatttaggtttttattag

SEQ ID NO: 3296442 - DNA, 20 bp, Homo sapiens
ggagacactggcccctcaaa

SEQ ID NO: 3296443 - DNA, 14 bp, Homo sapiens
ggagacagcatcag

SEQ ID NO: 3296444 - DNA, 18 bp, Homo sapiens
ggagacagcatcagggtt

SEQ ID NO: 3296445 - DNA, 14 bp, Homo sapiens
ggagacagccccag

SEQ ID NO: 3296446 - DNA, 19 bp, Homo sapiens
ggagacagccccagagcag

SEQ ID NO: 3296447 - DNA, 20 bp, Homo sapiens
ggagacagccccagagcagg

SEQ ID NO: 3296448 - DNA, 13 bp, Homo sapiens
ggagacagtgatc

SEQ ID NO: 3296449 - DNA, 14 bp, Homo sapiens
ggagacatgtgaca

SEQ ID NO: 3296450 - DNA, 18 bp, Homo sapiens
ggagaccatgcagagcgc

SEQ ID NO: 3296451 - DNA, 19 bp, Homo sapiens
ggagacccaccccacctgc

SEQ ID NO: 3296452 - DNA, 20 bp, Homo sapiens
ggagacccaccccacctgca

SEQ ID NO: 3296453 - DNA, 13 bp, Homo sapiens
ggagaccctgcaa

SEQ ID NO: 3296454 - DNA, 21 bp, Homo sapiens
ggagaccctgcaaacagaaca

SEQ ID NO: 3296455 - DNA, 15 bp, Homo sapiens
ggagaccgcttcacc

SEQ ID NO: 3296456 - DNA, 19 bp, Homo sapiens
ggagaccgcttcacccctg

SEQ ID NO: 3296457 - DNA, 20 bp, Homo sapiens
ggagaccgcttcacccctgc

SEQ ID NO: 3296458 - DNA, 20 bp, Homo sapiens
ggagaccggggtatcctggg

SEQ ID NO: 3296459 - DNA, 12 bp, Homo sapiens
ggagacctgtgc

SEQ ID NO: 3296460 - DNA, 14 bp, Homo sapiens
ggagacctgtgcta

SEQ ID NO: 3296461 - DNA, 19 bp, Homo sapiens
ggagacgtggaacctctgt

SEQ ID NO: 3296462 - DNA, 14 bp, Homo sapiens
ggagactagattgc

SEQ ID NO: 3296463 - DNA, 19 bp, Homo sapiens
ggagactagattgcctttg

SEQ ID NO: 3296464 - DNA, 17 bp, Homo sapiens
ggagactcctgccctgt

SEQ ID NO: 3296465 - DNA, 17 bp, Homo sapiens
ggagactcctggtctgt

SEQ ID NO: 3296466 - DNA, 14 bp, Homo sapiens
ggagactgcttccc

SEQ ID NO: 3296467 - DNA, 15 bp, Homo sapiens
ggagactgcttccca

SEQ ID NO: 3296468 - DNA, 13 bp, Homo sapiens
ggagactggcagg

SEQ ID NO: 3296469 - DNA, 15 bp, Homo sapiens
ggagactggggggct

SEQ ID NO: 3296470 - DNA, 16 bp, Homo sapiens
ggagactggggtggcc

SEQ ID NO: 3296471 - DNA, 18 bp, Homo sapiens
ggagactggggtggcctc

SEQ ID NO: 3296472 - DNA, 20 bp, Homo sapiens
ggagactggtcctgtgtgca

SEQ ID NO: 3296473 - DNA, 12 bp, Homo sapiens
ggagagaaaaaa

SEQ ID NO: 3296474 - DNA, 16 bp, Homo sapiens
ggagagaaagtgggtg

SEQ ID NO: 3296475 - DNA, 18 bp, Homo sapiens
ggagagaaagtgggtgag

SEQ ID NO: 3296476 - DNA, 24 bp, Homo sapiens
ggagagaaagtgggtgagatgctg

SEQ ID NO: 3296477 - DNA, 18 bp, Homo sapiens
ggagagaattaaaactca

SEQ ID NO: 3296478 - DNA, 15 bp, Homo sapiens
ggagagacctcatca

SEQ ID NO: 3296479 - DNA, 20 bp, Homo sapiens
ggagagacggtgttgggagc

SEQ ID NO: 3296480 - DNA, 18 bp, Homo sapiens
ggagagactgaaagcagc

SEQ ID NO: 3296481 - DNA, 20 bp, Homo sapiens
ggagagactgaaagcagcag

SEQ ID NO: 3296482 - DNA, 16 bp, Homo sapiens
ggagagactgagcagc

SEQ ID NO: 3296483 - DNA, 19 bp, Homo sapiens
ggagagactgagcagccgc

SEQ ID NO: 3296484 - DNA, 15 bp, Homo sapiens
ggagagagaccccgc

SEQ ID NO: 3296485 - DNA, 22 bp, Homo sapiens
ggagagagccaggatgcccaga

SEQ ID NO: 3296486 - DNA, 10 bp, Homo sapiens
ggagagaggc

SEQ ID NO: 3296487 - DNA, 12 bp, Homo sapiens
ggagagcagcag

SEQ ID NO: 3296488 - DNA, 13 bp, Homo sapiens
ggagagcagcagc

SEQ ID NO: 3296489 - DNA, 16 bp, Homo sapiens
ggagagcaggctggca

SEQ ID NO: 3296490 - DNA, 15 bp, Homo sapiens
ggagagcggctgccc

SEQ ID NO: 3296491 - DNA, 22 bp, Homo sapiens
ggagagctgattgcagaaagga

SEQ ID NO: 3296492 - DNA, 15 bp, Homo sapiens
ggagagctggtgccc

SEQ ID NO: 3296493 - DNA, 17 bp, Homo sapiens
ggagaggaaaagtaagg

SEQ ID NO: 3296494 - DNA, 17 bp, Homo sapiens
ggagaggaactccttgg

SEQ ID NO: 3296495 - DNA, 17 bp, Homo sapiens
ggagaggacagagcagg

SEQ ID NO: 3296496 - DNA, 17 bp, Homo sapiens
ggagaggaggaggatga

SEQ ID NO: 3296497 - DNA, 21 bp, Homo sapiens
ggagaggatgagagcccagag

SEQ ID NO: 3296498 - DNA, 15 bp, Homo sapiens
ggagaggcagcatgc

SEQ ID NO: 3296499 - DNA, 14 bp, Homo sapiens
ggagaggcggcctc

SEQ ID NO: 3296500 - DNA, 17 bp, Homo sapiens
ggagaggcggcctcgtg

SEQ ID NO: 3296501 - DNA, 13 bp, Homo sapiens
ggagaggctgggc

SEQ ID NO: 3296502 - DNA, 13 bp, Homo sapiens
ggagaggctgtct

SEQ ID NO: 3296503 - DNA, 19 bp, Homo sapiens
ggagagggacagcccactg

SEQ ID NO: 3296504 - DNA, 17 bp, Homo sapiens
ggagagggaggtcactg

SEQ ID NO: 3296505 - DNA, 21 bp, Homo sapiens
ggagaggttacccgagaagca

SEQ ID NO: 3296506 - DNA, 21 bp, Homo sapiens
ggagaggttataggtcactcc

SEQ ID NO: 3296507 - DNA, 14 bp, Homo sapiens
ggagagtgcttggg

SEQ ID NO: 3296508 - DNA, 21 bp, Homo sapiens
ggagagtggccattctttttt

SEQ ID NO: 3296509 - DNA, 18 bp, Homo sapiens
ggagagtggttgttgcca

SEQ ID NO: 3296510 - DNA, 18 bp, Homo sapiens
ggagatcgagaccatcct

SEQ ID NO: 3296511 - DNA, 14 bp, Homo sapiens
ggagatgaccaggg

SEQ ID NO: 3296512 - DNA, 18 bp, Homo sapiens
ggagatgggccttttgga

SEQ ID NO: 3296513 - DNA, 22 bp, Homo sapiens
ggagatggtcagtgtggagagg

SEQ ID NO: 3296514 - DNA, 14 bp, Homo sapiens
ggagattgagaagg

SEQ ID NO: 3296515 - DNA, 16 bp, Homo sapiens
ggagattgagaaggag

SEQ ID NO: 3296516 - DNA, 16 bp, Homo sapiens
ggagattttaggtgtt

SEQ ID NO: 3296517 - DNA, 19 bp, Homo sapiens
ggagattttaggtgttgat

SEQ ID NO: 3296518 - DNA, 22 bp, Homo sapiens
ggagatttttttgagtcaaaga

SEQ ID NO: 3296519 - DNA, 18 bp, Homo sapiens
ggagcaaaaggcagctca

SEQ ID NO: 3296520 - DNA, 22 bp, Homo sapiens
ggagcaaaaggcagctcacccc

SEQ ID NO: 3296521 - DNA, 15 bp, Homo sapiens
ggagcaaaccattat

SEQ ID NO: 3296522 - DNA, 14 bp, Homo sapiens
ggagcaagccctac

SEQ ID NO: 3296523 - DNA, 15 bp, Homo sapiens
ggagcaagccctact

SEQ ID NO: 3296524 - DNA, 14 bp, Homo sapiens
ggagcacagccctg

SEQ ID NO: 3296525 - DNA, 15 bp, Homo sapiens
ggagcacagccctgg

SEQ ID NO: 3296526 - DNA, 14 bp, Homo sapiens
ggagcacaggtccc

SEQ ID NO: 3296527 - DNA, 14 bp, Homo sapiens
ggagcacccagagc

SEQ ID NO: 3296528 - DNA, 23 bp, Homo sapiens
ggagcacccagagcaccccctgc

SEQ ID NO: 3296529 - DNA, 17 bp, Homo sapiens
ggagcagaaacagccat

SEQ ID NO: 3296530 - DNA, 20 bp, Homo sapiens
ggagcagacaggaggaatca

SEQ ID NO: 3296531 - DNA, 20 bp, Homo sapiens
ggagcagcttccttctggga

SEQ ID NO: 3296532 - DNA, 15 bp, Homo sapiens
ggagcaggagattga

SEQ ID NO: 3296533 - DNA, 18 bp, Homo sapiens
ggagcaggaggccaataa

SEQ ID NO: 3296534 - DNA, 20 bp, Homo sapiens
ggagcaggaggccaataaaa

SEQ ID NO: 3296535 - DNA, 21 bp, Homo sapiens
ggagcaggcggtggggagaga

SEQ ID NO: 3296536 - DNA, 17 bp, Homo sapiens
ggagcagggaaggcctg

SEQ ID NO: 3296537 - DNA, 18 bp, Homo sapiens
ggagcaggttccccaagg

SEQ ID NO: 3296538 - DNA, 24 bp, Homo sapiens
ggagcaggttccccaagggccctg

SEQ ID NO: 3296539 - DNA, 12 bp, Homo sapiens
ggagcagtgtct

SEQ ID NO: 3296540 - DNA, 22 bp, Homo sapiens
ggagcagttttcccctggcctc

SEQ ID NO: 3296541 - DNA, 21 bp, Homo sapiens
ggagcatagcagaggggccag

SEQ ID NO: 3296542 - DNA, 13 bp, Homo sapiens
ggagcatcccgga

SEQ ID NO: 3296543 - DNA, 14 bp, Homo sapiens
ggagcatcccggag

SEQ ID NO: 3296544 - DNA, 19 bp, Homo sapiens
ggagcatgttttgtataca

SEQ ID NO: 3296545 - DNA, 20 bp, Homo sapiens
ggagcatgttttgtatacaa

SEQ ID NO: 3296546 - DNA, 20 bp, Homo sapiens
ggagccaacagaagcttcca

SEQ ID NO: 3296547 - DNA, 17 bp, Homo sapiens
ggcaacccccagcctgc

SEQ ID NO: 3296548 - DNA, 18 bp, Homo sapiens
ggcaacccccagcctgct

SEQ ID NO: 3296549 - DNA, 18 bp, Homo sapiens
ggcaacctgattgtaaac

SEQ ID NO: 3296550 - DNA, 21 bp, Homo sapiens
ggcaacgtgtgaactgcaaca

SEQ ID NO: 3296551 - DNA, 18 bp, Homo sapiens
ggcaactaagcagtccct

SEQ ID NO: 3296552 - DNA, 19 bp, Homo sapiens
ggcaactaagcagtccctg

SEQ ID NO: 3296553 - DNA, 12 bp, Homo sapiens
ggcaagaaaagg

SEQ ID NO: 3296554 - DNA, 16 bp, Homo sapiens
ggcaagaacagtgggc

SEQ ID NO: 3296555 - DNA, 14 bp, Homo sapiens
ggcaagaacttgtt

SEQ ID NO: 3296556 - DNA, 15 bp, Homo sapiens
ggcaagaacttgttt

SEQ ID NO: 3296557 - DNA, 16 bp, Homo sapiens
ggcaagaacttgttta

SEQ ID NO: 3296558 - DNA, 20 bp, Homo sapiens
ggcaagactgcaaacttttt

SEQ ID NO: 3296559 - DNA, 17 bp, Homo sapiens
ggcaagagactgggagc

SEQ ID NO: 3296560 - DNA, 12 bp, Homo sapiens
ggcaagaggcct

SEQ ID NO: 3296561 - DNA, 17 bp, Homo sapiens
ggcaagaggcctcatgc

SEQ ID NO: 3296562 - DNA, 22 bp, Homo sapiens
ggcaagaggcctcatgcctgct

SEQ ID NO: 3296563 - DNA, 14 bp, Homo sapiens
ggcaagcagcgggc

SEQ ID NO: 3296564 - DNA, 14 bp, Homo sapiens
ggcaagcaggacct

SEQ ID NO: 3296565 - DNA, 19 bp, Homo sapiens
ggcaagcccctcagccctt

SEQ ID NO: 3296566 - DNA, 16 bp, Homo sapiens
ggcaagctaggcccca

SEQ ID NO: 3296567 - DNA, 21 bp, Homo sapiens
ggcaagctaggccccagaggc

SEQ ID NO: 3296568 - DNA, 23 bp, Homo sapiens
ggcaagctgtgacttctccaggt

SEQ ID NO: 3296569 - DNA, 12 bp, Homo sapiens
ggcaaggcaggt

SEQ ID NO: 3296570 - DNA, 23 bp, Homo sapiens
ggcaaggtctccttactctgagc

SEQ ID NO: 3296571 - DNA, 22 bp, Homo sapiens
ggcaagtccctgactctctgtg

SEQ ID NO: 3296572 - DNA, 16 bp, Homo sapiens
ggcaatagggtagaat

SEQ ID NO: 3296573 - DNA, 13 bp, Homo sapiens
ggcaatctctctc

SEQ ID NO: 3296574 - DNA, 14 bp, Homo sapiens
ggcaatctctctct

SEQ ID NO: 3296575 - DNA, 15 bp, Homo sapiens
ggcaatgatggcaat

SEQ ID NO: 3296576 - DNA, 18 bp, Homo sapiens
ggcaatgcttaaactaaa

SEQ ID NO: 3296577 - DNA, 13 bp, Homo sapiens
ggcaattggaaca

SEQ ID NO: 3296578 - DNA, 13 bp, Homo sapiens
ggcaattgtctat

SEQ ID NO: 3296579 - DNA, 14 bp, Homo sapiens
ggcaatttcctggc

SEQ ID NO: 3296580 - DNA, 18 bp, Homo sapiens
ggcaatttcctggccctc

SEQ ID NO: 3296581 - DNA, 17 bp, Homo sapiens
ggcacacagcagccccc

SEQ ID NO: 3296582 - DNA, 14 bp, Homo sapiens
ggcacacagctact

SEQ ID NO: 3296583 - DNA, 13 bp, Homo sapiens
ggcacaccactgc

SEQ ID NO: 3296584 - DNA, 17 bp, Homo sapiens
ggcacaccactgccctg

SEQ ID NO: 3296585 - DNA, 15 bp, Homo sapiens
ggcacactctgccag

SEQ ID NO: 3296586 - DNA, 12 bp, Homo sapiens
ggcacactgcca

SEQ ID NO: 3296587 - DNA, 20 bp, Homo sapiens
ggcacactgccaaataaaca

SEQ ID NO: 3296588 - DNA, 21 bp, Homo sapiens
ggcacactgccaaataaacag

SEQ ID NO: 3296589 - DNA, 13 bp, Homo sapiens
ggcacagccctcc

SEQ ID NO: 3296590 - DNA, 18 bp, Homo sapiens
ggcacagcggggccccag

SEQ ID NO: 3296591 - DNA, 19 bp, Homo sapiens
ggcacaggagtgtcctctt

SEQ ID NO: 3296592 - DNA, 14 bp, Homo sapiens
ggcacaggccccct

SEQ ID NO: 3296593 - DNA, 15 bp, Homo sapiens
ggcacaggccccctt

SEQ ID NO: 3296594 - DNA, 17 bp, Homo sapiens
ggcacagggtctgctct

SEQ ID NO: 3296595 - DNA, 19 bp, Homo sapiens
ggcacagggtctgctcttt

SEQ ID NO: 3296596 - DNA, 17 bp, Homo sapiens
ggcacaggtcgggcgca

SEQ ID NO: 3296597 - DNA, 16 bp, Homo sapiens
ggcacagtgggagctg

SEQ ID NO: 3296598 - DNA, 19 bp, Homo sapiens
ggcacagtgggagctgagc

SEQ ID NO: 3296599 - DNA, 12 bp, Homo sapiens
ggcacatagaga

SEQ ID NO: 3296600 - DNA, 14 bp, Homo sapiens
ggcacatggaggag

SEQ ID NO: 3296601 - DNA, 15 bp, Homo sapiens
ggcacatttcatgag

SEQ ID NO: 3296602 - DNA, 17 bp, Homo sapiens
ggcaccaaagatgcagc

SEQ ID NO: 3296603 - DNA, 18 bp, Homo sapiens
ggcaccagatgcaacctc

SEQ ID NO: 3296604 - DNA, 15 bp, Homo sapiens
ggcaccagccccctg

SEQ ID NO: 3296605 - DNA, 17 bp, Homo sapiens
ggcaccaggggtttctc

SEQ ID NO: 3296606 - DNA, 16 bp, Homo sapiens
ggcacccacaaataaa

SEQ ID NO: 3296607 - DNA, 23 bp, Homo sapiens
ggcacccaccatcatgtctggct

SEQ ID NO: 3296608 - DNA, 20 bp, Homo sapiens
ggcacccaccgtggaggagg

SEQ ID NO: 3296609 - DNA, 17 bp, Homo sapiens
ggcacccccacaagctg

SEQ ID NO: 3296610 - DNA, 15 bp, Homo sapiens
ggcacccggcccctg

SEQ ID NO: 3296611 - DNA, 19 bp, Homo sapiens
ggcaccctgtggccctggc

SEQ ID NO: 3296612 - DNA, 12 bp, Homo sapiens
ggcacccttctt

SEQ ID NO: 3296613 - DNA, 22 bp, Homo sapiens
ggcacccttctttcctcttccc

SEQ ID NO: 3296614 - DNA, 14 bp, Homo sapiens
ggcaccgagaatgt

SEQ ID NO: 3296615 - DNA, 14 bp, Homo sapiens
ggcaccggcgctgc

SEQ ID NO: 3296616 - DNA, 19 bp, Homo sapiens
ggcaccggcgctgcaggta

SEQ ID NO: 3296617 - DNA, 14 bp, Homo sapiens
ggcaccgggctcca

SEQ ID NO: 3296618 - DNA, 16 bp, Homo sapiens
ggcaccgggctccatg

SEQ ID NO: 3296619 - DNA, 19 bp, Homo sapiens
ggcaccgggctccatgcct

SEQ ID NO: 3296620 - DNA, 13 bp, Homo sapiens
ggcacctcctgag

SEQ ID NO: 3296621 - DNA, 20 bp, Homo sapiens
ggcacctcggggacaccaga

SEQ ID NO: 3296622 - DNA, 22 bp, Homo sapiens
ggcacctcggggacaccagagc

SEQ ID NO: 3296623 - DNA, 19 bp, Homo sapiens
ggcacctggcctgctggga

SEQ ID NO: 3296624 - DNA, 21 bp, Homo sapiens
ggcacgccctactccactgcc

SEQ ID NO: 3296625 - DNA, 15 bp, Homo sapiens
ggcacgctcctgcct

SEQ ID NO: 3296626 - DNA, 15 bp, Homo sapiens
ggcacggactgtcca

SEQ ID NO: 3296627 - DNA, 19 bp, Homo sapiens
ggcacggactgtccacctt

SEQ ID NO: 3296628 - DNA, 21 bp, Homo sapiens
ggcactagcctttggctctgg

SEQ ID NO: 3296629 - DNA, 17 bp, Homo sapiens
ggcactcacagacctgg

SEQ ID NO: 3296630 - DNA, 18 bp, Homo sapiens
ggcactcagaagacactg

SEQ ID NO: 3296631 - DNA, 20 bp, Homo sapiens
ggcactcagccacgaccagc

SEQ ID NO: 3296632 - DNA, 20 bp, Homo sapiens
ggcactccaaacctgtcttg

SEQ ID NO: 3296633 - DNA, 22 bp, Homo sapiens
ggcactctgttatttagactca

SEQ ID NO: 3296634 - DNA, 17 bp, Homo sapiens
ggcactgagatatttat

SEQ ID NO: 3296635 - DNA, 13 bp, Homo sapiens
ggcactgccttct

SEQ ID NO: 3296636 - DNA, 21 bp, Homo sapiens
ggcactggcattgtccctgtg

SEQ ID NO: 3296637 - DNA, 19 bp, Homo sapiens
ggcactgggatgagccgct

SEQ ID NO: 3296638 - DNA, 12 bp, Homo sapiens
ggcactgggctg

SEQ ID NO: 3296639 - DNA, 20 bp, Homo sapiens
ggcactggtttgttccctgt

SEQ ID NO: 3296640 - DNA, 24 bp, Homo sapiens
ggcactgtactaggcgtgagaagc

SEQ ID NO: 3296641 - DNA, 17 bp, Homo sapiens
ggcactgtagttctaag

SEQ ID NO: 3296642 - DNA, 17 bp, Homo sapiens
ggcacttaagtgcactt

SEQ ID NO: 3296643 - DNA, 21 bp, Homo sapiens
ggcacttaatttgtaaacttc

SEQ ID NO: 3296644 - DNA, 22 bp, Homo sapiens
ggcacttagcccaagaggtctg

SEQ ID NO: 3296645 - DNA, 22 bp, Homo sapiens
ggcacttattgtaaattttaga

SEQ ID NO: 3296646 - DNA, 22 bp, Homo sapiens
ggcactttgagatgtgttcctc

SEQ ID NO: 3296647 - DNA, 12 bp, Homo sapiens
ggcactttgggg

SEQ ID NO: 3296648 - DNA, 17 bp, Homo sapiens
ggcactttttcgtgtgg

SEQ ID NO: 3296649 - DNA, 16 bp, Homo sapiens
ggcagaaaacagagcc

SEQ ID NO: 3296650 - DNA, 18 bp, Homo sapiens
ggcagaaaacagagcctg

SEQ ID NO: 3296651 - DNA, 23 bp, Homo sapiens
ggcagaaaacagagcctgcctaa

SEQ ID NO: 3296652 - DNA, 16 bp, Homo sapiens
ggcagaaaagaggaga

SEQ ID NO: 3296653 - DNA, 14 bp, Homo sapiens
ggcagaaagtggcc

SEQ ID NO: 3296654 - DNA, 21 bp, Homo sapiens
ggcagaagacaccagagcaga

SEQ ID NO: 3296655 - DNA, 22 bp, Homo sapiens
ggcagaagacaccagagcagat

SEQ ID NO: 3296656 - DNA, 14 bp, Homo sapiens
ggcagaagggaatt

SEQ ID NO: 3296657 - DNA, 14 bp, Homo sapiens
ggcagacacaaccc

SEQ ID NO: 3296658 - DNA, 16 bp, Homo sapiens
ggcagacgggagggga

SEQ ID NO: 3296659 - DNA, 15 bp, Homo sapiens
ggcagactacacagg

SEQ ID NO: 3296660 - DNA, 23 bp, Homo sapiens
ggcagactctttaataaattgct

SEQ ID NO: 3296661 - DNA, 16 bp, Homo sapiens
ggcagagaaggcctct

SEQ ID NO: 3296662 - DNA, 21 bp, Homo sapiens
ggcagagaatggctgggtcag

SEQ ID NO: 3296663 - DNA, 11 bp, Homo sapiens
ggcagagagag

SEQ ID NO: 3296664 - DNA, 23 bp, Homo sapiens
ggcagagcagtctaaacagagtc

SEQ ID NO: 3296665 - DNA, 13 bp, Homo sapiens
ggcagagccatgg

SEQ ID NO: 3296666 - DNA, 18 bp, Homo sapiens
ggcagagccatgggcctg

SEQ ID NO: 3296667 - DNA, 19 bp, Homo sapiens
ggcagagccatgggcctgg

SEQ ID NO: 3296668 - DNA, 22 bp, Homo sapiens
ggcagagccatgggcctgggcc

SEQ ID NO: 3296669 - DNA, 23 bp, Homo sapiens
ggcagagctgacgggaggcccca

SEQ ID NO: 3296670 - DNA, 14 bp, Homo sapiens
ggcagagctgcatc

SEQ ID NO: 3296671 - DNA, 16 bp, Homo sapiens
ggcagagctggctctg

SEQ ID NO: 3296672 - DNA, 20 bp, Homo sapiens
ggcagaggaccaggctgtag

SEQ ID NO: 3296673 - DNA, 15 bp, Homo sapiens
ggcctaggattctaa

SEQ ID NO: 3296674 - DNA, 22 bp, Homo sapiens
ggcctataaaattaaatgcctt

SEQ ID NO: 3296675 - DNA, 15 bp, Homo sapiens
ggcctcaaaacagaa

SEQ ID NO: 3296676 - DNA, 22 bp, Homo sapiens
ggcctcaaagttggggcaggct

SEQ ID NO: 3296677 - DNA, 21 bp, Homo sapiens
ggcctcaagagcacacagaga

SEQ ID NO: 3296678 - DNA, 12 bp, Homo sapiens
ggcctcacccac

SEQ ID NO: 3296679 - DNA, 18 bp, Homo sapiens
ggcctcaccgagtggggg

SEQ ID NO: 3296680 - DNA, 15 bp, Homo sapiens
ggcctcactggctgg

SEQ ID NO: 3296681 - DNA, 12 bp, Homo sapiens
ggcctcagccct

SEQ ID NO: 3296682 - DNA, 15 bp, Homo sapiens
ggcctcagctgcctc

SEQ ID NO: 3296683 - DNA, 13 bp, Homo sapiens
ggcctcaggctct

SEQ ID NO: 3296684 - DNA, 22 bp, Homo sapiens
ggcctcagggcgctcagacggc

SEQ ID NO: 3296685 - DNA, 14 bp, Homo sapiens
ggcctcagttccca

SEQ ID NO: 3296686 - DNA, 17 bp, Homo sapiens
ggcctcagttcccagct

SEQ ID NO: 3296687 - DNA, 20 bp, Homo sapiens
ggcctcagttcccagctccc

SEQ ID NO: 3296688 - DNA, 23 bp, Homo sapiens
ggcctcagttcccagctcccccc

SEQ ID NO: 3296689 - DNA, 14 bp, Homo sapiens
ggcctcatccctcg

SEQ ID NO: 3296690 - DNA, 21 bp, Homo sapiens
ggcctcatccctcggaagccg

SEQ ID NO: 3296691 - DNA, 17 bp, Homo sapiens
ggcctcatgcctgctga

SEQ ID NO: 3296692 - DNA, 17 bp, Homo sapiens
ggcctcatgtggctgga

SEQ ID NO: 3296693 - DNA, 20 bp, Homo sapiens
ggcctcatgtggctggaaga

SEQ ID NO: 3296694 - DNA, 19 bp, Homo sapiens
ggcctccaacgcccctgtg

SEQ ID NO: 3296695 - DNA, 21 bp, Homo sapiens
ggcctccactcccccacctga

SEQ ID NO: 3296696 - DNA, 22 bp, Homo sapiens
ggcctccactcccccacctgac

SEQ ID NO: 3296697 - DNA, 13 bp, Homo sapiens
ggcctccagcctc

SEQ ID NO: 3296698 - DNA, 14 bp, Homo sapiens
ggcctccagcctct

SEQ ID NO: 3296699 - DNA, 16 bp, Homo sapiens
ggcctcccaaagtgct

SEQ ID NO: 3296700 - DNA, 18 bp, Homo sapiens
ggcctcccctccatgggc

SEQ ID NO: 3296701 - DNA, 15 bp, Homo sapiens
ggcctcccctgccac

SEQ ID NO: 3296702 - DNA, 19 bp, Homo sapiens
ggcctcccctgccaccagg

SEQ ID NO: 3296703 - DNA, 12 bp, Homo sapiens
ggcctccctcct

SEQ ID NO: 3296704 - DNA, 13 bp, Homo sapiens
ggcctccctcctt

SEQ ID NO: 3296705 - DNA, 15 bp, Homo sapiens
ggcctccctccttgg

SEQ ID NO: 3296706 - DNA, 13 bp, Homo sapiens
ggcctccctgctg

SEQ ID NO: 3296707 - DNA, 22 bp, Homo sapiens
ggcctccctgctgtgccatgct

SEQ ID NO: 3296708 - DNA, 14 bp, Homo sapiens
ggcctcctcctagg

SEQ ID NO: 3296709 - DNA, 18 bp, Homo sapiens
ggcctcctcggagagcag

SEQ ID NO: 3296710 - DNA, 14 bp, Homo sapiens
ggcctcctcttcac

SEQ ID NO: 3296711 - DNA, 23 bp, Homo sapiens
ggcctcctcttcaccccggcagg

SEQ ID NO: 3296712 - DNA, 15 bp, Homo sapiens
ggcctcgcctcccca

SEQ ID NO: 3296713 - DNA, 16 bp, Homo sapiens
ggcctcggcgggcttt

SEQ ID NO: 3296714 - DNA, 23 bp, Homo sapiens
ggcctcgggacacctgccctgcc

SEQ ID NO: 3296715 - DNA, 16 bp, Homo sapiens
ggcctcgtgaggggca

SEQ ID NO: 3296716 - DNA, 20 bp, Homo sapiens
ggcctcgtgccatgatctgt

SEQ ID NO: 3296717 - DNA, 17 bp, Homo sapiens
ggcctctctggcctccc

SEQ ID NO: 3296718 - DNA, 20 bp, Homo sapiens
ggcctctctggcctcccacc

SEQ ID NO: 3296719 - DNA, 19 bp, Homo sapiens
ggcctctcttttccccgcc

SEQ ID NO: 3296720 - DNA, 17 bp, Homo sapiens
ggcctctgactctgagt

SEQ ID NO: 3296721 - DNA, 13 bp, Homo sapiens
ggcctctgagccc

SEQ ID NO: 3296722 - DNA, 14 bp, Homo sapiens
ggcctctgagccca

SEQ ID NO: 3296723 - DNA, 16 bp, Homo sapiens
ggcctcttccacccat

SEQ ID NO: 3296724 - DNA, 19 bp, Homo sapiens
ggcctcttccgtgacgtca

SEQ ID NO: 3296725 - DNA, 13 bp, Homo sapiens
ggcctcttggcag

SEQ ID NO: 3296726 - DNA, 16 bp, Homo sapiens
ggcctcttgtgctcac

SEQ ID NO: 3296727 - DNA, 23 bp, Homo sapiens
ggcctgaaagaggctgaggcctg

SEQ ID NO: 3296728 - DNA, 21 bp, Homo sapiens
ggcctgagcgtccagaaatgg

SEQ ID NO: 3296729 - DNA, 13 bp, Homo sapiens
ggcctgagtcctg

SEQ ID NO: 3296730 - DNA, 22 bp, Homo sapiens
ggcctgagtcctggtccctctg

SEQ ID NO: 3296731 - DNA, 18 bp, Homo sapiens
ggcctgatgctccctccc

SEQ ID NO: 3296732 - DNA, 23 bp, Homo sapiens
ggcctgcaaaccttcctgggagg

SEQ ID NO: 3296733 - DNA, 20 bp, Homo sapiens
ggcctgcagaaggaaagaag

SEQ ID NO: 3296734 - DNA, 15 bp, Homo sapiens
ggcctgcccaatgct

SEQ ID NO: 3296735 - DNA, 13 bp, Homo sapiens
ggcctgcccctgt

SEQ ID NO: 3296736 - DNA, 14 bp, Homo sapiens
ggcctgcctggccc

SEQ ID NO: 3296737 - DNA, 23 bp, Homo sapiens
ggcctgcctggcccctcgcctgt

SEQ ID NO: 3296738 - DNA, 21 bp, Homo sapiens
ggcctgctaaggctcctcctt

SEQ ID NO: 3296739 - DNA, 17 bp, Homo sapiens
ggcctgctgccagtgca

SEQ ID NO: 3296740 - DNA, 18 bp, Homo sapiens
ggcctgctgccagtgcag

SEQ ID NO: 3296741 - DNA, 21 bp, Homo sapiens
ggcctgctgggaaccccgcag

SEQ ID NO: 3296742 - DNA, 23 bp, Homo sapiens
ggcctgctgggaaccccgcagcc

SEQ ID NO: 3296743 - DNA, 10 bp, Homo sapiens
ggcctgctgt

SEQ ID NO: 3296744 - DNA, 24 bp, Homo sapiens
ggcctgcttttccaggatcctgca

SEQ ID NO: 3296745 - DNA, 19 bp, Homo sapiens
ggcctggagatcctcctgc

SEQ ID NO: 3296746 - DNA, 20 bp, Homo sapiens
ggcctggcaaaataaaacat

SEQ ID NO: 3296747 - DNA, 16 bp, Homo sapiens
ggcctggcaggccagt

SEQ ID NO: 3296748 - DNA, 15 bp, Homo sapiens
ggcctggcagggagg

SEQ ID NO: 3296749 - DNA, 15 bp, Homo sapiens
ggcctggccaggagc

SEQ ID NO: 3296750 - DNA, 14 bp, Homo sapiens
ggcctggcctgagc

SEQ ID NO: 3296751 - DNA, 17 bp, Homo sapiens
ggcctggcctgagctgg

SEQ ID NO: 3296752 - DNA, 17 bp, Homo sapiens
ggcctggcctggccctg

SEQ ID NO: 3296753 - DNA, 23 bp, Homo sapiens
ggcctggctccccacgagtcacc

SEQ ID NO: 3296754 - DNA, 16 bp, Homo sapiens
ggcctggctggtggga

SEQ ID NO: 3296755 - DNA, 18 bp, Homo sapiens
ggcctggcttgctccagg

SEQ ID NO: 3296756 - DNA, 19 bp, Homo sapiens
ggcctggcttgctccaggg

SEQ ID NO: 3296757 - DNA, 20 bp, Homo sapiens
ggcctggcttgctccagggt

SEQ ID NO: 3296758 - DNA, 21 bp, Homo sapiens
ggcctggcttgctccagggtc

SEQ ID NO: 3296759 - DNA, 11 bp, Homo sapiens
ggcctgggagg

SEQ ID NO: 3296760 - DNA, 21 bp, Homo sapiens
ggcctgggagggttcccctgg

SEQ ID NO: 3296761 - DNA, 14 bp, Homo sapiens
ggcctgggcctctg

SEQ ID NO: 3296762 - DNA, 13 bp, Homo sapiens
ggcctgggctagg

SEQ ID NO: 3296763 - DNA, 17 bp, Homo sapiens
ggcctgggctaggggac

SEQ ID NO: 3296764 - DNA, 15 bp, Homo sapiens
ggcctgggctggcct

SEQ ID NO: 3296765 - DNA, 15 bp, Homo sapiens
ggcctggggcctgag

SEQ ID NO: 3296766 - DNA, 17 bp, Homo sapiens
ggcctggggcctgagag

SEQ ID NO: 3296767 - DNA, 16 bp, Homo sapiens
ggcctggggctccttt

SEQ ID NO: 3296768 - DNA, 21 bp, Homo sapiens
ggcctgtaatcagctctcctg

SEQ ID NO: 3296769 - DNA, 17 bp, Homo sapiens
ggcctgtagagttgctg

SEQ ID NO: 3296770 - DNA, 23 bp, Homo sapiens
ggcctgtatcctccctggcagac

SEQ ID NO: 3296771 - DNA, 16 bp, Homo sapiens
ggcctgtccaccctgc

SEQ ID NO: 3296772 - DNA, 13 bp, Homo sapiens
ggcctgtccccca

SEQ ID NO: 3296773 - DNA, 15 bp, Homo sapiens
ggcctgtgcagcagc

SEQ ID NO: 3296774 - DNA, 17 bp, Homo sapiens
ggcctgtgggagcctgc

SEQ ID NO: 3296775 - DNA, 15 bp, Homo sapiens
ggcctgtgtccagca

SEQ ID NO: 3296776 - DNA, 20 bp, Homo sapiens
ggcctgtgtccagcagctgc

SEQ ID NO: 3296777 - DNA, 22 bp, Homo sapiens
ggcctgtgtcccatgacccacc

SEQ ID NO: 3296778 - DNA, 19 bp, Homo sapiens
ggcctgtttctgcagccct

SEQ ID NO: 3296779 - DNA, 22 bp, Homo sapiens
ggccttaaaaggggcccaagcc

SEQ ID NO: 3296780 - DNA, 15 bp, Homo sapiens
ggccttagggcactg

SEQ ID NO: 3296781 - DNA, 21 bp, Homo sapiens
ggccttaggggtcatgtatga

SEQ ID NO: 3296782 - DNA, 21 bp, Homo sapiens
ggccttagtgggccagggctg

SEQ ID NO: 3296783 - DNA, 22 bp, Homo sapiens
ggccttagtgggccagggctgc

SEQ ID NO: 3296784 - DNA, 19 bp, Homo sapiens
ggccttccccttttgcctg

SEQ ID NO: 3296785 - DNA, 23 bp, Homo sapiens
ggccttccccttttgcctggctg

SEQ ID NO: 3296786 - DNA, 14 bp, Homo sapiens
ggccttcctgccct

SEQ ID NO: 3296787 - DNA, 16 bp, Homo sapiens
ggccttctctgaagga

SEQ ID NO: 3296788 - DNA, 22 bp, Homo sapiens
ggccttctgctgcccaggccac

SEQ ID NO: 3296789 - DNA, 23 bp, Homo sapiens
ggccttctgctgcccaggccaca

SEQ ID NO: 3296790 - DNA, 23 bp, Homo sapiens
ggccttgacatcagttcctttgt

SEQ ID NO: 3296791 - DNA, 13 bp, Homo sapiens
ggccttgctgctg

SEQ ID NO: 3296792 - DNA, 16 bp, Homo sapiens
ggccttgctgctgctg

SEQ ID NO: 3296793 - DNA, 19 bp, Homo sapiens
ggccttggcatgggcgcag

SEQ ID NO: 3296794 - DNA, 21 bp, Homo sapiens
ggccttgtaataaatttctaa

SEQ ID NO: 3296795 - DNA, 12 bp, Homo sapiens
ggcctttcctct

SEQ ID NO: 3296796 - DNA, 19 bp, Homo sapiens
ggcctttgagcccacaaag

SEQ ID NO: 3296797 - DNA, 19 bp, Homo sapiens
ggcctttgcaagatgcttg

SEQ ID NO: 3296798 - DNA, 13 bp, Homo sapiens
ggcttgtgggctg

SEQ ID NO: 3296799 - DNA, 17 bp, Homo sapiens
ggcttgtttacctttct

SEQ ID NO: 3296800 - DNA, 13 bp, Homo sapiens
ggctttaattgta

SEQ ID NO: 3296801 - DNA, 16 bp, Homo sapiens
ggctttaattgtataa

SEQ ID NO: 3296802 - DNA, 20 bp, Homo sapiens
ggctttatgataatagattc

SEQ ID NO: 3296803 - DNA, 11 bp, Homo sapiens
ggctttcaaag

SEQ ID NO: 3296804 - DNA, 23 bp, Homo sapiens
ggctttctccggggtctgtgctg

SEQ ID NO: 3296805 - DNA, 13 bp, Homo sapiens
ggctttgcaggct

SEQ ID NO: 3296806 - DNA, 17 bp, Homo sapiens
ggctttgcaggctctgg

SEQ ID NO: 3296807 - DNA, 19 bp, Homo sapiens
ggctttgcaggctctgggc

SEQ ID NO: 3296808 - DNA, 22 bp, Homo sapiens
ggctttgccttgcagccacatg

SEQ ID NO: 3296809 - DNA, 20 bp, Homo sapiens
ggctttgggaaagcccagac

SEQ ID NO: 3296810 - DNA, 13 bp, Homo sapiens
ggcttttcactgc

SEQ ID NO: 3296811 - DNA, 15 bp, Homo sapiens
ggcttttcactgctg

SEQ ID NO: 3296812 - DNA, 20 bp, Homo sapiens
ggcttttctggggcccagga

SEQ ID NO: 3296813 - DNA, 21 bp, Homo sapiens
ggcttttctggggcccaggaa

SEQ ID NO: 3296814 - DNA, 22 bp, Homo sapiens
ggcttttctggggcccaggaag

SEQ ID NO: 3296815 - DNA, 19 bp, Homo sapiens
ggctttttcctctgagccc

SEQ ID NO: 3296816 - DNA, 17 bp, Homo sapiens
ggctttttttttctctt

SEQ ID NO: 3296817 - DNA, 17 bp, Homo sapiens
gggaaaatatttcctga

SEQ ID NO: 3296818 - DNA, 20 bp, Homo sapiens
gggaaacctagagaagataa

SEQ ID NO: 3296819 - DNA, 15 bp, Homo sapiens
gggaaagcccagact

SEQ ID NO: 3296820 - DNA, 15 bp, Homo sapiens
gggaaaggatatttt

SEQ ID NO: 3296821 - DNA, 22 bp, Homo sapiens
gggaaaggctctgaaagccagc

SEQ ID NO: 3296822 - DNA, 14 bp, Homo sapiens
gggaaagggaagca

SEQ ID NO: 3296823 - DNA, 23 bp, Homo sapiens
gggaaagtcagctttcagagcca

SEQ ID NO: 3296824 - DNA, 14 bp, Homo sapiens
gggaaataagagag

SEQ ID NO: 3296825 - DNA, 12 bp, Homo sapiens
gggaacagtgtt

SEQ ID NO: 3296826 - DNA, 18 bp, Homo sapiens
gggaacatttccgaataa

SEQ ID NO: 3296827 - DNA, 19 bp, Homo sapiens
gggaacatttctgtaaata

SEQ ID NO: 3296828 - DNA, 20 bp, Homo sapiens
gggaacctagtactctctgc

SEQ ID NO: 3296829 - DNA, 21 bp, Homo sapiens
gggaacctagtactctctgct

SEQ ID NO: 3296830 - DNA, 15 bp, Homo sapiens
gggaacctgtgtccg

SEQ ID NO: 3296831 - DNA, 14 bp, Homo sapiens
gggaactctgacaa

SEQ ID NO: 3296832 - DNA, 21 bp, Homo sapiens
gggaagaaacactttctcttc

SEQ ID NO: 3296833 - DNA, 23 bp, Homo sapiens
gggaagagaagagggcccagccc

SEQ ID NO: 3296834 - DNA, 21 bp, Homo sapiens
gggaagagggcagtacctggg

SEQ ID NO: 3296835 - DNA, 15 bp, Homo sapiens
gggaagaggggctgg

SEQ ID NO: 3296836 - DNA, 14 bp, Homo sapiens
gggaagagtagctg

SEQ ID NO: 3296837 - DNA, 23 bp, Homo sapiens
gggaagatgaggttctgagacca

SEQ ID NO: 3296838 - DNA, 14 bp, Homo sapiens
gggaagctgccagc

SEQ ID NO: 3296839 - DNA, 21 bp, Homo sapiens
gggaagcttgagcctccccca

SEQ ID NO: 3296840 - DNA, 22 bp, Homo sapiens
gggaagcttgagcctcccccaa

SEQ ID NO: 3296841 - DNA, 19 bp, Homo sapiens
gggaaggacagaaaggaga

SEQ ID NO: 3296842 - DNA, 22 bp, Homo sapiens
gggaaggacaggaccctcagga

SEQ ID NO: 3296843 - DNA, 18 bp, Homo sapiens
gggaaggcacagggagaa

SEQ ID NO: 3296844 - DNA, 12 bp, Homo sapiens
gggaaggccagc

SEQ ID NO: 3296845 - DNA, 14 bp, Homo sapiens
gggaagggacacac

SEQ ID NO: 3296846 - DNA, 16 bp, Homo sapiens
gggaagggcctgccca

SEQ ID NO: 3296847 - DNA, 19 bp, Homo sapiens
gggaagtccctgggaggcc

SEQ ID NO: 3296848 - DNA, 23 bp, Homo sapiens
gggaagtgaagactggaagctaa

SEQ ID NO: 3296849 - DNA, 22 bp, Homo sapiens
gggaagttgcattcctttgtct

SEQ ID NO: 3296850 - DNA, 17 bp, Homo sapiens
gggaatagggagacagg

SEQ ID NO: 3296851 - DNA, 15 bp, Homo sapiens
gggaatccaagcctc

SEQ ID NO: 3296852 - DNA, 22 bp, Homo sapiens
gggaatccaagcctccacagcg

SEQ ID NO: 3296853 - DNA, 14 bp, Homo sapiens
gggaatctggatta

SEQ ID NO: 3296854 - DNA, 16 bp, Homo sapiens
gggaatgagcccagag

SEQ ID NO: 3296855 - DNA, 14 bp, Homo sapiens
gggaatgggagagg

SEQ ID NO: 3296856 - DNA, 21 bp, Homo sapiens
gggaatgttccctgcaccctg

SEQ ID NO: 3296857 - DNA, 17 bp, Homo sapiens
gggacaccagggaagaa

SEQ ID NO: 3296858 - DNA, 17 bp, Homo sapiens
gggacagccagagctgg

SEQ ID NO: 3296859 - DNA, 20 bp, Homo sapiens
gggacagccagagctgggtg

SEQ ID NO: 3296860 - DNA, 16 bp, Homo sapiens
gggacagcccagagcc

SEQ ID NO: 3296861 - DNA, 21 bp, Homo sapiens
gggacagcccagagcctggct

SEQ ID NO: 3296862 - DNA, 19 bp, Homo sapiens
gggacagtgataggcccaa

SEQ ID NO: 3296863 - DNA, 20 bp, Homo sapiens
gggaccaaactcacggacca

SEQ ID NO: 3296864 - DNA, 18 bp, Homo sapiens
gggaccaaccctggggaa

SEQ ID NO: 3296865 - DNA, 16 bp, Homo sapiens
gggaccaactgggccc

SEQ ID NO: 3296866 - DNA, 16 bp, Homo sapiens
gggaccactgggtgag

SEQ ID NO: 3296867 - DNA, 20 bp, Homo sapiens
gggaccagagccagatgcag

SEQ ID NO: 3296868 - DNA, 17 bp, Homo sapiens
gggaccatgtgtcactt

SEQ ID NO: 3296869 - DNA, 21 bp, Homo sapiens
gggacccaatgtaggagctgc

SEQ ID NO: 3296870 - DNA, 22 bp, Homo sapiens
gggacccacggagccctcccta

SEQ ID NO: 3296871 - DNA, 17 bp, Homo sapiens
gggacccaggctccgcc

SEQ ID NO: 3296872 - DNA, 21 bp, Homo sapiens
gggaccccactccctgctcta

SEQ ID NO: 3296873 - DNA, 22 bp, Homo sapiens
gggacccccaacattctgccct

SEQ ID NO: 3296874 - DNA, 18 bp, Homo sapiens
gggaccccctggccctgc

SEQ ID NO: 3296875 - DNA, 17 bp, Homo sapiens
gggacctgccaggcagg

SEQ ID NO: 3296876 - DNA, 18 bp, Homo sapiens
gggacctgccaggcaggg

SEQ ID NO: 3296877 - DNA, 18 bp, Homo sapiens
gggacctggtaccctcct

SEQ ID NO: 3296878 - DNA, 13 bp, Homo sapiens
gggaccttagaaa

SEQ ID NO: 3296879 - DNA, 13 bp, Homo sapiens
gggaccttggtct

SEQ ID NO: 3296880 - DNA, 22 bp, Homo sapiens
gggacgttcgtggtcctgcgct

SEQ ID NO: 3296881 - DNA, 20 bp, Homo sapiens
gggactacccatagacatga

SEQ ID NO: 3296882 - DNA, 17 bp, Homo sapiens
gggactcagccctgagg

SEQ ID NO: 3296883 - DNA, 22 bp, Homo sapiens
gggactcagccttcagacagag

SEQ ID NO: 3296884 - DNA, 21 bp, Homo sapiens
gggactctgagcgggaggcag

SEQ ID NO: 3296885 - DNA, 14 bp, Homo sapiens
gggactgcctctgc

SEQ ID NO: 3296886 - DNA, 15 bp, Homo sapiens
gggactgcctctgcc

SEQ ID NO: 3296887 - DNA, 23 bp, Homo sapiens
gggactggacagctttgctccgc

SEQ ID NO: 3296888 - DNA, 15 bp, Homo sapiens
gggactgggagtcag

SEQ ID NO: 3296889 - DNA, 18 bp, Homo sapiens
gggactgggagtcagagc

SEQ ID NO: 3296890 - DNA, 20 bp, Homo sapiens
gggactgggtttggacccca

SEQ ID NO: 3296891 - DNA, 21 bp, Homo sapiens
gggactgggtttggaccccag

SEQ ID NO: 3296892 - DNA, 21 bp, Homo sapiens
gggactgtctttcagatacat

SEQ ID NO: 3296893 - DNA, 19 bp, Homo sapiens
gggacttccttgctctccc

SEQ ID NO: 3296894 - DNA, 21 bp, Homo sapiens
gggacttcttacccaaagcac

SEQ ID NO: 3296895 - DNA, 23 bp, Homo sapiens
gggacttggaagctccgctttct

SEQ ID NO: 3296896 - DNA, 13 bp, Homo sapiens
gggacttgtgtct

SEQ ID NO: 3296897 - DNA, 15 bp, Homo sapiens
gggacttgtgtctgc

SEQ ID NO: 3296898 - DNA, 23 bp, Homo sapiens
gggactttgctgatttcccctct

SEQ ID NO: 3296899 - DNA, 15 bp, Homo sapiens
gggagaaaaagaaac

SEQ ID NO: 3296900 - DNA, 19 bp, Homo sapiens
gggagaaaaagaaacacaa

SEQ ID NO: 3296901 - DNA, 19 bp, Homo sapiens
gggagaaactgaaagtgtt

SEQ ID NO: 3296902 - DNA, 15 bp, Homo sapiens
gggagaacctcaggc

SEQ ID NO: 3296903 - DNA, 20 bp, Homo sapiens
gggagaagctttttttcttg

SEQ ID NO: 3296904 - DNA, 21 bp, Homo sapiens
gggagaaggcatgagaaagaa

SEQ ID NO: 3296905 - DNA, 15 bp, Homo sapiens
gggagaatcatgtga

SEQ ID NO: 3296906 - DNA, 23 bp, Homo sapiens
gggagaattgcacacagatgtga

SEQ ID NO: 3296907 - DNA, 18 bp, Homo sapiens
gggagacagaagcctgga

SEQ ID NO: 3296908 - DNA, 19 bp, Homo sapiens
gggagacagcttctctgca

SEQ ID NO: 3296909 - DNA, 23 bp, Homo sapiens
gggagacagcttctctgcagtaa

SEQ ID NO: 3296910 - DNA, 14 bp, Homo sapiens
gggagacagggtag

SEQ ID NO: 3296911 - DNA, 14 bp, Homo sapiens
gggagagagagaga

SEQ ID NO: 3296912 - DNA, 22 bp, Homo sapiens
gggagagagagagagagaggac

SEQ ID NO: 3296913 - DNA, 15 bp, Homo sapiens
gggagagcaggctgg

SEQ ID NO: 3296914 - DNA, 15 bp, Homo sapiens
gggagagctgagcca

SEQ ID NO: 3296915 - DNA, 13 bp, Homo sapiens
gggagaggaaaga

SEQ ID NO: 3296916 - DNA, 19 bp, Homo sapiens
gggagatggagttcttgtg

SEQ ID NO: 3296917 - DNA, 14 bp, Homo sapiens
gggagcactggagt

SEQ ID NO: 3296918 - DNA, 13 bp, Homo sapiens
gggagcagagaca

SEQ ID NO: 3296919 - DNA, 22 bp, Homo sapiens
gggagcaggccggaaccacagg

SEQ ID NO: 3296920 - DNA, 23 bp, Homo sapiens
gggagcaggttccccaagggccc

SEQ ID NO: 3296921 - DNA, 11 bp, Homo sapiens
gggagcagtgt

SEQ ID NO: 3296922 - DNA, 21 bp, Homo sapiens
gggagcagttttcccctggcc

SEQ ID NO: 3296923 - DNA, 19 bp, Homo sapiens
ggggtacaggtttggggag

SEQ ID NO: 3296924 - DNA, 15 bp, Homo sapiens
ggggtagcagctgga

SEQ ID NO: 3296925 - DNA, 18 bp, Homo sapiens
ggggtcagagcactccct

SEQ ID NO: 3296926 - DNA, 23 bp, Homo sapiens
ggggtccccatcatcccagctgc

SEQ ID NO: 3296927 - DNA, 18 bp, Homo sapiens
ggggtccctccaccccac

SEQ ID NO: 3296928 - DNA, 19 bp, Homo sapiens
ggggtcctggagcagacca

SEQ ID NO: 3296929 - DNA, 19 bp, Homo sapiens
ggggtctcatgtcctgctg

SEQ ID NO: 3296930 - DNA, 21 bp, Homo sapiens
ggggtctcatgtcctgctggc

SEQ ID NO: 3296931 - DNA, 18 bp, Homo sapiens
ggggtgaatacttatttt

SEQ ID NO: 3296932 - DNA, 13 bp, Homo sapiens
ggggtgaggacca

SEQ ID NO: 3296933 - DNA, 23 bp, Homo sapiens
ggggtgccccctcctctcccatc

SEQ ID NO: 3296934 - DNA, 13 bp, Homo sapiens
ggggtgtcttttt

SEQ ID NO: 3296935 - DNA, 21 bp, Homo sapiens
ggggtgtgttccaactgcccc

SEQ ID NO: 3296936 - DNA, 17 bp, Homo sapiens
ggggttacaaactgcaa

SEQ ID NO: 3296937 - DNA, 18 bp, Homo sapiens
ggggtttgccatttgata

SEQ ID NO: 3296938 - DNA, 23 bp, Homo sapiens
ggggtttgggcccctcagagccc

SEQ ID NO: 3296939 - DNA, 14 bp, Homo sapiens
gggtaagccagagc

SEQ ID NO: 3296940 - DNA, 19 bp, Homo sapiens
gggtaagccagagcctggg

SEQ ID NO: 3296941 - DNA, 21 bp, Homo sapiens
gggtaagggatttcttagggg

SEQ ID NO: 3296942 - DNA, 20 bp, Homo sapiens
gggtacagcgcggaggagga

SEQ ID NO: 3296943 - DNA, 15 bp, Homo sapiens
gggtacagctgggct

SEQ ID NO: 3296944 - DNA, 19 bp, Homo sapiens
gggtacatttctctgagca

SEQ ID NO: 3296945 - DNA, 13 bp, Homo sapiens
gggtacccactgc

SEQ ID NO: 3296946 - DNA, 15 bp, Homo sapiens
gggtacccactgctc

SEQ ID NO: 3296947 - DNA, 19 bp, Homo sapiens
gggtactcttgatgtgaag

SEQ ID NO: 3296948 - DNA, 16 bp, Homo sapiens
gggtacttttcctggg

SEQ ID NO: 3296949 - DNA, 15 bp, Homo sapiens
gggtagcagctggac

SEQ ID NO: 3296950 - DNA, 17 bp, Homo sapiens
gggtagcagctggacta

SEQ ID NO: 3296951 - DNA, 22 bp, Homo sapiens
gggtagcagctggactacccac

SEQ ID NO: 3296952 - DNA, 15 bp, Homo sapiens
gggtagggtaaatca

SEQ ID NO: 3296953 - DNA, 22 bp, Homo sapiens
gggtataggtctcatctcttca

SEQ ID NO: 3296954 - DNA, 17 bp, Homo sapiens
gggtcacaggcccagaa

SEQ ID NO: 3296955 - DNA, 18 bp, Homo sapiens
gggtcacaggcccagaag

SEQ ID NO: 3296956 - DNA, 20 bp, Homo sapiens
gggtcagccatttttaatga

SEQ ID NO: 3296957 - DNA, 21 bp, Homo sapiens
gggtcaggaacagtggctggg

SEQ ID NO: 3296958 - DNA, 12 bp, Homo sapiens
gggtcaggctcc

SEQ ID NO: 3296959 - DNA, 19 bp, Homo sapiens
gggtcagtgcagcagagga

SEQ ID NO: 3296960 - DNA, 21 bp, Homo sapiens
gggtcatcctgtgctcggagg

SEQ ID NO: 3296961 - DNA, 15 bp, Homo sapiens
gggtcattgacctct

SEQ ID NO: 3296962 - DNA, 21 bp, Homo sapiens
gggtcattgacctctcagggc

SEQ ID NO: 3296963 - DNA, 24 bp, Homo sapiens
gggtcattgacctctcagggcctg

SEQ ID NO: 3296964 - DNA, 16 bp, Homo sapiens
gggtcccagccacccc

SEQ ID NO: 3296965 - DNA, 17 bp, Homo sapiens
gggtcccagtgggaggg

SEQ ID NO: 3296966 - DNA, 13 bp, Homo sapiens
gggtccctccacc

SEQ ID NO: 3296967 - DNA, 12 bp, Homo sapiens
gggtccctcctc

SEQ ID NO: 3296968 - DNA, 20 bp, Homo sapiens
gggtcccttgaaggaagagg

SEQ ID NO: 3296969 - DNA, 18 bp, Homo sapiens
gggtccgcaccagctgct

SEQ ID NO: 3296970 - DNA, 23 bp, Homo sapiens
gggtccgcaccagctgctctgcc

SEQ ID NO: 3296971 - DNA, 23 bp, Homo sapiens
gggtcctgtggcaggcagcgcca

SEQ ID NO: 3296972 - DNA, 20 bp, Homo sapiens
gggtcgtcaccacctctcct

SEQ ID NO: 3296973 - DNA, 22 bp, Homo sapiens
gggtctcactatgttgcccagg

SEQ ID NO: 3296974 - DNA, 14 bp, Homo sapiens
gggtctcactctgt

SEQ ID NO: 3296975 - DNA, 17 bp, Homo sapiens
gggtctcgctgtcactg

SEQ ID NO: 3296976 - DNA, 17 bp, Homo sapiens
gggtctcttttgtaaat

SEQ ID NO: 3296977 - DNA, 23 bp, Homo sapiens
gggtctgaaggaatagccagaga

SEQ ID NO: 3296978 - DNA, 21 bp, Homo sapiens
gggtctgaggaatccagaccc

SEQ ID NO: 3296979 - DNA, 18 bp, Homo sapiens
gggtctgcgcttggtctt

SEQ ID NO: 3296980 - DNA, 20 bp, Homo sapiens
gggtctgctctttctctgcc

SEQ ID NO: 3296981 - DNA, 18 bp, Homo sapiens
gggtctgtgctgtgcctg

SEQ ID NO: 3296982 - DNA, 19 bp, Homo sapiens
gggtctgtgctgtgcctgc

SEQ ID NO: 3296983 - DNA, 15 bp, Homo sapiens
gggtctgtgtctctt

SEQ ID NO: 3296984 - DNA, 14 bp, Homo sapiens
gggtcttaggatgt

SEQ ID NO: 3296985 - DNA, 17 bp, Homo sapiens
gggtcttgggctactgg

SEQ ID NO: 3296986 - DNA, 22 bp, Homo sapiens
gggtctttgtggtagcttatct

SEQ ID NO: 3296987 - DNA, 13 bp, Homo sapiens
gggtgaagggaga

SEQ ID NO: 3296988 - DNA, 14 bp, Homo sapiens
gggtgaagggagag

SEQ ID NO: 3296989 - DNA, 12 bp, Homo sapiens
gggtgaatcttg

SEQ ID NO: 3296990 - DNA, 16 bp, Homo sapiens
gggtgacaagagcctg

SEQ ID NO: 3296991 - DNA, 21 bp, Homo sapiens
gggtgacagagcaagaccctg

SEQ ID NO: 3296992 - DNA, 18 bp, Homo sapiens
gggtgacagtcatcatca

SEQ ID NO: 3296993 - DNA, 13 bp, Homo sapiens
gggtgacggccct

SEQ ID NO: 3296994 - DNA, 13 bp, Homo sapiens
gggtgagagagga

SEQ ID NO: 3296995 - DNA, 14 bp, Homo sapiens
gggtgaggataaca

SEQ ID NO: 3296996 - DNA, 13 bp, Homo sapiens
gggtgattcctaa

SEQ ID NO: 3296997 - DNA, 19 bp, Homo sapiens
gggtgcacccactcaccag

SEQ ID NO: 3296998 - DNA, 23 bp, Homo sapiens
gggtgcacccactcaccagggtc

SEQ ID NO: 3296999 - DNA, 13 bp, Homo sapiens
gggtgcaggtggg

SEQ ID NO: 3297000 - DNA, 22 bp, Homo sapiens
gggtgcatcctcctcagccccc

SEQ ID NO: 3297001 - DNA, 23 bp, Homo sapiens
gggtgcatcctcctcagccccca

SEQ ID NO: 3297002 - DNA, 20 bp, Homo sapiens
gggtgcatttgagagaagcc

SEQ ID NO: 3297003 - DNA, 12 bp, Homo sapiens
gggtgccccctc

SEQ ID NO: 3297004 - DNA, 13 bp, Homo sapiens
gggtgctcagaat

SEQ ID NO: 3297005 - DNA, 13 bp, Homo sapiens
gggtgctgccctg

SEQ ID NO: 3297006 - DNA, 15 bp, Homo sapiens
gggtgctgccctgtg

SEQ ID NO: 3297007 - DNA, 20 bp, Homo sapiens
gggtgctgctggtaacagtg

SEQ ID NO: 3297008 - DNA, 18 bp, Homo sapiens
gggtgctggcccccagga

SEQ ID NO: 3297009 - DNA, 15 bp, Homo sapiens
gggtgctgggaggag

SEQ ID NO: 3297010 - DNA, 14 bp, Homo sapiens
gggtggaggggtgt

SEQ ID NO: 3297011 - DNA, 17 bp, Homo sapiens
gggtggatgcctggtgg

SEQ ID NO: 3297012 - DNA, 20 bp, Homo sapiens
gggtggcacctcctgagaag

SEQ ID NO: 3297013 - DNA, 13 bp, Homo sapiens
gggtggccatccc

SEQ ID NO: 3297014 - DNA, 17 bp, Homo sapiens
gggtggccgctgagtgg

SEQ ID NO: 3297015 - DNA, 11 bp, Homo sapiens
gggtggcctcg

SEQ ID NO: 3297016 - DNA, 19 bp, Homo sapiens
gggtggctttaattgtata

SEQ ID NO: 3297017 - DNA, 14 bp, Homo sapiens
gggtgggaagaaag

SEQ ID NO: 3297018 - DNA, 17 bp, Homo sapiens
gggtgggacagcctctt

SEQ ID NO: 3297019 - DNA, 18 bp, Homo sapiens
gggtgggacagcctcttc

SEQ ID NO: 3297020 - DNA, 17 bp, Homo sapiens
gggtgggcagcctatgg

SEQ ID NO: 3297021 - DNA, 15 bp, Homo sapiens
gggtgggcagttttt

SEQ ID NO: 3297022 - DNA, 21 bp, Homo sapiens
gggtgggcccagaactgcccc

SEQ ID NO: 3297023 - DNA, 12 bp, Homo sapiens
gggtgggcctgg

SEQ ID NO: 3297024 - DNA, 14 bp, Homo sapiens
gggtgggcctggcc

SEQ ID NO: 3297025 - DNA, 16 bp, Homo sapiens
gggtggggtagggctg

SEQ ID NO: 3297026 - DNA, 12 bp, Homo sapiens
gggtggggtggg

SEQ ID NO: 3297027 - DNA, 20 bp, Homo sapiens
gggtggtggagggggctggg

SEQ ID NO: 3297028 - DNA, 15 bp, Homo sapiens
gggtggtggcctggt

SEQ ID NO: 3297029 - DNA, 15 bp, Homo sapiens
gggtgtcttgggcag

SEQ ID NO: 3297030 - DNA, 23 bp, Homo sapiens
gggtgtcttgggcagagctggct

SEQ ID NO: 3297031 - DNA, 12 bp, Homo sapiens
gggtgtgccctt

SEQ ID NO: 3297032 - DNA, 13 bp, Homo sapiens
gggtgtgctggga

SEQ ID NO: 3297033 - DNA, 11 bp, Homo sapiens
gggtgtggcct

SEQ ID NO: 3297034 - DNA, 12 bp, Homo sapiens
gggtgtggcctc

SEQ ID NO: 3297035 - DNA, 15 bp, Homo sapiens
gggtgtggcctcagc

SEQ ID NO: 3297036 - DNA, 18 bp, Homo sapiens
gggtgtggcctcagccct

SEQ ID NO: 3297037 - DNA, 15 bp, Homo sapiens
gggtgtgggtggaag

SEQ ID NO: 3297038 - DNA, 21 bp, Homo sapiens
gggtgtgtttggcttggcctt

SEQ ID NO: 3297039 - DNA, 18 bp, Homo sapiens
gggtgttgtatggggagg

SEQ ID NO: 3297040 - DNA, 16 bp, Homo sapiens
gggttacaaactgcaa

SEQ ID NO: 3297041 - DNA, 13 bp, Homo sapiens
gggttatctctgt

SEQ ID NO: 3297042 - DNA, 13 bp, Homo sapiens
gggttcaggggac

SEQ ID NO: 3297043 - DNA, 21 bp, Homo sapiens
gggttcataggtcactggctc

SEQ ID NO: 3297044 - DNA, 13 bp, Homo sapiens
gggttcatttgtg

SEQ ID NO: 3297045 - DNA, 13 bp, Homo sapiens
gggttcccctggc

SEQ ID NO: 3297046 - DNA, 18 bp, Homo sapiens
gggttccctttccttcca

SEQ ID NO: 3297047 - DNA, 19 bp, Homo sapiens
gggttctttcttcctctgc

SEQ ID NO: 3297048 - DNA, 23 bp, Homo sapiens
gggttgaaaattcaaaaagtgtt

SEQ ID NO: 3297049 - DNA, 13 bp, Homo sapiens
ggtgtgtttttgg

SEQ ID NO: 3297050 - DNA, 22 bp, Homo sapiens
ggtgtgtttttgggatgtctta

SEQ ID NO: 3297051 - DNA, 20 bp, Homo sapiens
ggtgttacacagcccaagag

SEQ ID NO: 3297052 - DNA, 12 bp, Homo sapiens
ggtgttatttgg

SEQ ID NO: 3297053 - DNA, 19 bp, Homo sapiens
ggtgttcaccaaaaccaaa

SEQ ID NO: 3297054 - DNA, 12 bp, Homo sapiens
ggtgttcctgga

SEQ ID NO: 3297055 - DNA, 15 bp, Homo sapiens
ggtgttcctggaagc

SEQ ID NO: 3297056 - DNA, 21 bp, Homo sapiens
ggtgttgccaaatatgtcctg

SEQ ID NO: 3297057 - DNA, 22 bp, Homo sapiens
ggtgttgccaaatatgtcctgg

SEQ ID NO: 3297058 - DNA, 17 bp, Homo sapiens
ggtgttgtatgccttta

SEQ ID NO: 3297059 - DNA, 20 bp, Homo sapiens
ggttaacaataaagtgacaa

SEQ ID NO: 3297060 - DNA, 18 bp, Homo sapiens
ggttaataaaactgcaca

SEQ ID NO: 3297061 - DNA, 17 bp, Homo sapiens
ggttaatggctagtact

SEQ ID NO: 3297062 - DNA, 15 bp, Homo sapiens
ggttacactgttaga

SEQ ID NO: 3297063 - DNA, 14 bp, Homo sapiens
ggttacgaagacaa

SEQ ID NO: 3297064 - DNA, 21 bp, Homo sapiens
ggttagacgccttccaggtca

SEQ ID NO: 3297065 - DNA, 16 bp, Homo sapiens
ggttaggatttaacag

SEQ ID NO: 3297066 - DNA, 14 bp, Homo sapiens
ggttatctgcctgg

SEQ ID NO: 3297067 - DNA, 16 bp, Homo sapiens
ggttatctttttaaaa

SEQ ID NO: 3297068 - DNA, 18 bp, Homo sapiens
ggttattagcaaggctgg

SEQ ID NO: 3297069 - DNA, 20 bp, Homo sapiens
ggttattttaaatataaata

SEQ ID NO: 3297070 - DNA, 14 bp, Homo sapiens
ggttattttgcttt

SEQ ID NO: 3297071 - DNA, 23 bp, Homo sapiens
ggttcaacaaagaaacaaagatg

SEQ ID NO: 3297072 - DNA, 22 bp, Homo sapiens
ggttcaagcgattcttctgctt

SEQ ID NO: 3297073 - DNA, 18 bp, Homo sapiens
ggttcaattccctgaagg

SEQ ID NO: 3297074 - DNA, 15 bp, Homo sapiens
ggttcactaaagcag

SEQ ID NO: 3297075 - DNA, 16 bp, Homo sapiens
ggttcagacccctgcc

SEQ ID NO: 3297076 - DNA, 18 bp, Homo sapiens
ggttcagacccctgcctg

SEQ ID NO: 3297077 - DNA, 19 bp, Homo sapiens
ggttcagctactttccatt

SEQ ID NO: 3297078 - DNA, 12 bp, Homo sapiens
ggttcagcttgt

SEQ ID NO: 3297079 - DNA, 22 bp, Homo sapiens
ggttcatcagtgttaaaaaatt

SEQ ID NO: 3297080 - DNA, 22 bp, Homo sapiens
ggttcatctgtccatggccttt

SEQ ID NO: 3297081 - DNA, 21 bp, Homo sapiens
ggttcatgtagagaaaagcac

SEQ ID NO: 3297082 - DNA, 16 bp, Homo sapiens
ggttccaatcctggct

SEQ ID NO: 3297083 - DNA, 18 bp, Homo sapiens
ggttccaatcctggctct

SEQ ID NO: 3297084 - DNA, 13 bp, Homo sapiens
ggttccatgcctg

SEQ ID NO: 3297085 - DNA, 14 bp, Homo sapiens
ggttcccctggcct

SEQ ID NO: 3297086 - DNA, 15 bp, Homo sapiens
ggttcccctgttcac

SEQ ID NO: 3297087 - DNA, 16 bp, Homo sapiens
ggttcccggtcccgag

SEQ ID NO: 3297088 - DNA, 17 bp, Homo sapiens
ggttcccgtttctccac

SEQ ID NO: 3297089 - DNA, 14 bp, Homo sapiens
ggttcctctctggt

SEQ ID NO: 3297090 - DNA, 14 bp, Homo sapiens
ggttcctctgcctg

SEQ ID NO: 3297091 - DNA, 17 bp, Homo sapiens
ggttcctctgcctgccc

SEQ ID NO: 3297092 - DNA, 19 bp, Homo sapiens
ggttccttcctatgcccag

SEQ ID NO: 3297093 - DNA, 20 bp, Homo sapiens
ggttccttcctatgcccagg

SEQ ID NO: 3297094 - DNA, 14 bp, Homo sapiens
ggttctaaagttct

SEQ ID NO: 3297095 - DNA, 12 bp, Homo sapiens
ggttctaaggcc

SEQ ID NO: 3297096 - DNA, 16 bp, Homo sapiens
ggttctaagtgggaga

SEQ ID NO: 3297097 - DNA, 23 bp, Homo sapiens
ggttctagtctcctttgcactga

SEQ ID NO: 3297098 - DNA, 11 bp, Homo sapiens
ggttctatttt

SEQ ID NO: 3297099 - DNA, 22 bp, Homo sapiens
ggttctattttactttgtactt

SEQ ID NO: 3297100 - DNA, 16 bp, Homo sapiens
ggttctattttcttaa

SEQ ID NO: 3297101 - DNA, 14 bp, Homo sapiens
ggttctgagaccag

SEQ ID NO: 3297102 - DNA, 13 bp, Homo sapiens
ggttctgcctgct

SEQ ID NO: 3297103 - DNA, 14 bp, Homo sapiens
ggttcttaaatgtt

SEQ ID NO: 3297104 - DNA, 16 bp, Homo sapiens
ggttcttagtgtcact

SEQ ID NO: 3297105 - DNA, 19 bp, Homo sapiens
ggttcttcagggccagtcc

SEQ ID NO: 3297106 - DNA, 17 bp, Homo sapiens
ggttcttggtagagatt

SEQ ID NO: 3297107 - DNA, 23 bp, Homo sapiens
ggttctttgagggactgcctctg

SEQ ID NO: 3297108 - DNA, 15 bp, Homo sapiens
ggttctttgttttaa

SEQ ID NO: 3297109 - DNA, 22 bp, Homo sapiens
ggttgaactctggtggcacagg

SEQ ID NO: 3297110 - DNA, 21 bp, Homo sapiens
ggttgaagaaaggaacctggg

SEQ ID NO: 3297111 - DNA, 15 bp, Homo sapiens
ggttgaaggcagtct

SEQ ID NO: 3297112 - DNA, 21 bp, Homo sapiens
ggttgaatatagcctgcctca

SEQ ID NO: 3297113 - DNA, 21 bp, Homo sapiens
ggttgacaccattctcctgcc

SEQ ID NO: 3297114 - DNA, 23 bp, Homo sapiens
ggttgaccccaatccaacccggg

SEQ ID NO: 3297115 - DNA, 23 bp, Homo sapiens
ggttgacctgtttctctttgtct

SEQ ID NO: 3297116 - DNA, 23 bp, Homo sapiens
ggttgagaatggaaaccacaact

SEQ ID NO: 3297117 - DNA, 18 bp, Homo sapiens
ggttgaggggctcctgga

SEQ ID NO: 3297118 - DNA, 15 bp, Homo sapiens
ggttgatggaaaata

SEQ ID NO: 3297119 - DNA, 14 bp, Homo sapiens
ggttgcaaccactg

SEQ ID NO: 3297120 - DNA, 12 bp, Homo sapiens
ggttgccacagg

SEQ ID NO: 3297121 - DNA, 13 bp, Homo sapiens
ggttgccacaggc

SEQ ID NO: 3297122 - DNA, 18 bp, Homo sapiens
ggttgccacaggcctccc

SEQ ID NO: 3297123 - DNA, 13 bp, Homo sapiens
ggttgccacccca

SEQ ID NO: 3297124 - DNA, 21 bp, Homo sapiens
ggttgcgtcctgacggcgccc

SEQ ID NO: 3297125 - DNA, 16 bp, Homo sapiens
ggttgctggttgctgt

SEQ ID NO: 3297126 - DNA, 15 bp, Homo sapiens
ggttggacagccccc

SEQ ID NO: 3297127 - DNA, 17 bp, Homo sapiens
ggttggatgggagtggg

SEQ ID NO: 3297128 - DNA, 14 bp, Homo sapiens
ggttggattaatct

SEQ ID NO: 3297129 - DNA, 19 bp, Homo sapiens
ggttgggggcactcagcca

SEQ ID NO: 3297130 - DNA, 13 bp, Homo sapiens
ggttggtagggtg

SEQ ID NO: 3297131 - DNA, 23 bp, Homo sapiens
ggttggtccttgtctgcaccctc

SEQ ID NO: 3297132 - DNA, 14 bp, Homo sapiens
ggttggtgcacagt

SEQ ID NO: 3297133 - DNA, 20 bp, Homo sapiens
ggttgtaaatactttgtcct

SEQ ID NO: 3297134 - DNA, 13 bp, Homo sapiens
ggttgtatttcta

SEQ ID NO: 3297135 - DNA, 21 bp, Homo sapiens
ggttgttgcaccatctgcttg

SEQ ID NO: 3297136 - DNA, 22 bp, Homo sapiens
ggttgttgccaactaagccctc

SEQ ID NO: 3297137 - DNA, 12 bp, Homo sapiens
ggttgtttctgt

SEQ ID NO: 3297138 - DNA, 16 bp, Homo sapiens
ggtttaaaagaaaaaa

SEQ ID NO: 3297139 - DNA, 17 bp, Homo sapiens
ggtttaaccacattaat

SEQ ID NO: 3297140 - DNA, 14 bp, Homo sapiens
ggtttacccagtgg

SEQ ID NO: 3297141 - DNA, 12 bp, Homo sapiens
ggtttactttca

SEQ ID NO: 3297142 - DNA, 18 bp, Homo sapiens
ggtttataattttctgaa

SEQ ID NO: 3297143 - DNA, 16 bp, Homo sapiens
ggtttatttttgtaat

SEQ ID NO: 3297144 - DNA, 19 bp, Homo sapiens
ggtttcaccatgttgccca

SEQ ID NO: 3297145 - DNA, 20 bp, Homo sapiens
ggtttcagttctgtgtacat

SEQ ID NO: 3297146 - DNA, 23 bp, Homo sapiens
ggtttccccagggaaggaaaaat

SEQ ID NO: 3297147 - DNA, 19 bp, Homo sapiens
ggtttccttaaaattttta

SEQ ID NO: 3297148 - DNA, 14 bp, Homo sapiens
ggtttcgactggtc

SEQ ID NO: 3297149 - DNA, 19 bp, Homo sapiens
ggtttcgactggtccagct

SEQ ID NO: 3297150 - DNA, 17 bp, Homo sapiens
ggtttcgtttctgtata

SEQ ID NO: 3297151 - DNA, 21 bp, Homo sapiens
ggtttctcgcataggaccttt

SEQ ID NO: 3297152 - DNA, 20 bp, Homo sapiens
ggtttctttttttttccttt

SEQ ID NO: 3297153 - DNA, 19 bp, Homo sapiens
ggtttgaaagatgcagtgg

SEQ ID NO: 3297154 - DNA, 22 bp, Homo sapiens
ggtttgagattgccccaggtct

SEQ ID NO: 3297155 - DNA, 13 bp, Homo sapiens
ggtttgagggtgg

SEQ ID NO: 3297156 - DNA, 15 bp, Homo sapiens
ggtttgatcatttct

SEQ ID NO: 3297157 - DNA, 20 bp, Homo sapiens
ggtttggcaagaacttgttt

SEQ ID NO: 3297158 - DNA, 17 bp, Homo sapiens
ggtttgggaaagatgga

SEQ ID NO: 3297159 - DNA, 14 bp, Homo sapiens
ggtttgggcagagc

SEQ ID NO: 3297160 - DNA, 20 bp, Homo sapiens
ggtttgggggcgccctctct

SEQ ID NO: 3297161 - DNA, 14 bp, Homo sapiens
ggtttggtgctttt

SEQ ID NO: 3297162 - DNA, 17 bp, Homo sapiens
ggtttggttcctctctg

SEQ ID NO: 3297163 - DNA, 19 bp, Homo sapiens
ggtttgtgtttgagtttta

SEQ ID NO: 3297164 - DNA, 20 bp, Homo sapiens
ggttttacttacaaaaatgg

SEQ ID NO: 3297165 - DNA, 16 bp, Homo sapiens
ggttttaggttctaaa

SEQ ID NO: 3297166 - DNA, 12 bp, Homo sapiens
ggttttcatcta

SEQ ID NO: 3297167 - DNA, 23 bp, Homo sapiens
ggttttgccatgttggccaggct

SEQ ID NO: 3297168 - DNA, 21 bp, Homo sapiens
ggtttttaatctttgtgacag

SEQ ID NO: 3297169 - DNA, 16 bp, Homo sapiens
ggtttttggctctttc

SEQ ID NO: 3297170 - DNA, 23 bp, Homo sapiens
ggtttttgtttgtttcctttgtt

SEQ ID NO: 3297171 - DNA, 14 bp, Homo sapiens
ggttttttccccct

SEQ ID NO: 3297172 - DNA, 23 bp, Homo sapiens
gtaaaaaaaaatgcctttgagac

SEQ ID NO: 3297173 - DNA, 14 bp, Homo sapiens
gtaaaaaaagcaaa

SEQ ID NO: 3297174 - DNA, 18 bp, Homo sapiens
gtaaaaacagcattgctt

SEQ ID NO: 3297175 - DNA, 16 bp, Homo sapiens
gtagattgcttctgta

SEQ ID NO: 3297176 - DNA, 12 bp, Homo sapiens
gtagcagctgga

SEQ ID NO: 3297177 - DNA, 19 bp, Homo sapiens
gtagcagggtcgggaaagg

SEQ ID NO: 3297178 - DNA, 14 bp, Homo sapiens
gtagcataactgta

SEQ ID NO: 3297179 - DNA, 22 bp, Homo sapiens
gtagcatgggtccaagagacat

SEQ ID NO: 3297180 - DNA, 21 bp, Homo sapiens
gtagcatgttgagccaggcct

SEQ ID NO: 3297181 - DNA, 13 bp, Homo sapiens
gtagcatttcatt

SEQ ID NO: 3297182 - DNA, 17 bp, Homo sapiens
gtagcatttcattcttc

SEQ ID NO: 3297183 - DNA, 19 bp, Homo sapiens
gtagcatttcattcttctc

SEQ ID NO: 3297184 - DNA, 23 bp, Homo sapiens
gtagccagggggactagcccctg

SEQ ID NO: 3297185 - DNA, 13 bp, Homo sapiens
gtagccatctgca

SEQ ID NO: 3297186 - DNA, 22 bp, Homo sapiens
gtagccatgatttgtcccagcc

SEQ ID NO: 3297187 - DNA, 17 bp, Homo sapiens
gtagccatggctcaggc

SEQ ID NO: 3297188 - DNA, 20 bp, Homo sapiens
gtagccatggctcaggcaag

SEQ ID NO: 3297189 - DNA, 21 bp, Homo sapiens
gtagccatggctcaggcaagc

SEQ ID NO: 3297190 - DNA, 17 bp, Homo sapiens
gtagccccctggcctct

SEQ ID NO: 3297191 - DNA, 22 bp, Homo sapiens
gtagcctggatattattcttgt

SEQ ID NO: 3297192 - DNA, 12 bp, Homo sapiens
gtagcctgtgca

SEQ ID NO: 3297193 - DNA, 21 bp, Homo sapiens
gtagcgtacgggttgttttgg

SEQ ID NO: 3297194 - DNA, 17 bp, Homo sapiens
gtagctacaagggaagc

SEQ ID NO: 3297195 - DNA, 11 bp, Homo sapiens
gtagctcaggt

SEQ ID NO: 3297196 - DNA, 12 bp, Homo sapiens
gtagctcaggtg

SEQ ID NO: 3297197 - DNA, 14 bp, Homo sapiens
gtagctcaggtggg

SEQ ID NO: 3297198 - DNA, 22 bp, Homo sapiens
gtagctgggaaagcataaagct

SEQ ID NO: 3297199 - DNA, 19 bp, Homo sapiens
gtagcttacctgacacaag

SEQ ID NO: 3297200 - DNA, 14 bp, Homo sapiens
gtagctttcctggt

SEQ ID NO: 3297201 - DNA, 19 bp, Homo sapiens
gtaggactttcctaaatgt

SEQ ID NO: 3297202 - DNA, 14 bp, Homo sapiens
gtaggaggtttgga

SEQ ID NO: 3297203 - DNA, 17 bp, Homo sapiens
gtaggattcaagtctgc

SEQ ID NO: 3297204 - DNA, 20 bp, Homo sapiens
gtaggcatgagggatcacag

SEQ ID NO: 3297205 - DNA, 14 bp, Homo sapiens
gtaggcatttccta

SEQ ID NO: 3297206 - DNA, 17 bp, Homo sapiens
gtaggcccttgtcctgc

SEQ ID NO: 3297207 - DNA, 19 bp, Homo sapiens
gtaggcccttgtcctgcca

SEQ ID NO: 3297208 - DNA, 21 bp, Homo sapiens
gtaggcccttgtcctgccagc

SEQ ID NO: 3297209 - DNA, 17 bp, Homo sapiens
gtaggcggcgatttttg

SEQ ID NO: 3297210 - DNA, 21 bp, Homo sapiens
gtaggctggggcggggcccag

SEQ ID NO: 3297211 - DNA, 13 bp, Homo sapiens
gtaggctggttta

SEQ ID NO: 3297212 - DNA, 16 bp, Homo sapiens
gtagggaggcagcctc

SEQ ID NO: 3297213 - DNA, 20 bp, Homo sapiens
gtagggatgcggatcctgct

SEQ ID NO: 3297214 - DNA, 22 bp, Homo sapiens
gtagggatgcggatcctgctgg

SEQ ID NO: 3297215 - DNA, 22 bp, Homo sapiens
gtagggcgggaggatgttctgg

SEQ ID NO: 3297216 - DNA, 12 bp, Homo sapiens
gtagggctgact

SEQ ID NO: 3297217 - DNA, 21 bp, Homo sapiens
gtagggctgccaccaaggtga

SEQ ID NO: 3297218 - DNA, 15 bp, Homo sapiens
gtaggggtgtgtgtg

SEQ ID NO: 3297219 - DNA, 22 bp, Homo sapiens
gtagggtaaatcagtaagaggt

SEQ ID NO: 3297220 - DNA, 12 bp, Homo sapiens
gtagggtgggag

SEQ ID NO: 3297221 - DNA, 18 bp, Homo sapiens
gtaggtaaaatgtatttt

SEQ ID NO: 3297222 - DNA, 13 bp, Homo sapiens
gtaggtaagactg

SEQ ID NO: 3297223 - DNA, 14 bp, Homo sapiens
gtaggtccaagggc

SEQ ID NO: 3297224 - DNA, 15 bp, Homo sapiens
gtaggtccaagggcc

SEQ ID NO: 3297225 - DNA, 15 bp, Homo sapiens
gtaggttcagccaag

SEQ ID NO: 3297226 - DNA, 17 bp, Homo sapiens
gtagtagccctttctgt

SEQ ID NO: 3297227 - DNA, 21 bp, Homo sapiens
gtagtagccctttctgtgtgc

SEQ ID NO: 3297228 - DNA, 15 bp, Homo sapiens
gtagtattttttgta

SEQ ID NO: 3297229 - DNA, 19 bp, Homo sapiens
gtagtattttttgtataat

SEQ ID NO: 3297230 - DNA, 17 bp, Homo sapiens
gtagtcaggttcaggag

SEQ ID NO: 3297231 - DNA, 21 bp, Homo sapiens
gtagtcattcttacaattgca

SEQ ID NO: 3297232 - DNA, 17 bp, Homo sapiens
gtagtcatttactaaac

SEQ ID NO: 3297233 - DNA, 23 bp, Homo sapiens
gtagtcccagctacttgggaggc

SEQ ID NO: 3297234 - DNA, 22 bp, Homo sapiens
gtagtcctcataaaaagcaaaa

SEQ ID NO: 3297235 - DNA, 15 bp, Homo sapiens
gtagtcctttctgcc

SEQ ID NO: 3297236 - DNA, 19 bp, Homo sapiens
gtagtcctttctgccttgg

SEQ ID NO: 3297237 - DNA, 20 bp, Homo sapiens
gtagtctcactgcttgaact

SEQ ID NO: 3297238 - DNA, 13 bp, Homo sapiens
gtagtctgctcac

SEQ ID NO: 3297239 - DNA, 16 bp, Homo sapiens
gtagtcttgatgacca

SEQ ID NO: 3297240 - DNA, 13 bp, Homo sapiens
gtagtggaagagc

SEQ ID NO: 3297241 - DNA, 18 bp, Homo sapiens
gtagtggaagagcagcct

SEQ ID NO: 3297242 - DNA, 19 bp, Homo sapiens
gtagtggaagagcagcctg

SEQ ID NO: 3297243 - DNA, 15 bp, Homo sapiens
gtagttaatttatct

SEQ ID NO: 3297244 - DNA, 11 bp, Homo sapiens
gtagttaggaa

SEQ ID NO: 3297245 - DNA, 14 bp, Homo sapiens
gtagttaggaaata

SEQ ID NO: 3297246 - DNA, 16 bp, Homo sapiens
gtagttaggaaataaa

SEQ ID NO: 3297247 - DNA, 15 bp, Homo sapiens
gtagttcctgctaca

SEQ ID NO: 3297248 - DNA, 13 bp, Homo sapiens
gtagttctaagac

SEQ ID NO: 3297249 - DNA, 17 bp, Homo sapiens
gtagttctgtgtacttt

SEQ ID NO: 3297250 - DNA, 21 bp, Homo sapiens
gtagttctgtttggtgtgtcc

SEQ ID NO: 3297251 - DNA, 14 bp, Homo sapiens
gtagttgacataaa

SEQ ID NO: 3297252 - DNA, 20 bp, Homo sapiens
gtagttgtattcttctgtat

SEQ ID NO: 3297253 - DNA, 23 bp, Homo sapiens
gtagttttttttttttttatgtg

SEQ ID NO: 3297254 - DNA, 18 bp, Homo sapiens
gtataaaaacatgagtta

SEQ ID NO: 3297255 - DNA, 16 bp, Homo sapiens
gtataaaactttcctc

SEQ ID NO: 3297256 - DNA, 11 bp, Homo sapiens
gtataaacatt

SEQ ID NO: 3297257 - DNA, 13 bp, Homo sapiens
gtataaacattaa

SEQ ID NO: 3297258 - DNA, 13 bp, Homo sapiens
gtataaagacaag

SEQ ID NO: 3297259 - DNA, 18 bp, Homo sapiens
gtataaagattgtactta

SEQ ID NO: 3297260 - DNA, 23 bp, Homo sapiens
gtataaagcaactgttatgaaat

SEQ ID NO: 3297261 - DNA, 16 bp, Homo sapiens
gtataaagctcagaag

SEQ ID NO: 3297262 - DNA, 11 bp, Homo sapiens
gtataaatgta

SEQ ID NO: 3297263 - DNA, 18 bp, Homo sapiens
gtataaatgtatatacac

SEQ ID NO: 3297264 - DNA, 22 bp, Homo sapiens
gtataaatgtatatacacatat

SEQ ID NO: 3297265 - DNA, 15 bp, Homo sapiens
gtataaccaagtgtg

SEQ ID NO: 3297266 - DNA, 18 bp, Homo sapiens
gtataagatcctagatcc

SEQ ID NO: 3297267 - DNA, 17 bp, Homo sapiens
gtataagcactgaaaaa

SEQ ID NO: 3297268 - DNA, 14 bp, Homo sapiens
gtataagtcaagca

SEQ ID NO: 3297269 - DNA, 17 bp, Homo sapiens
gtataagtcaagcacat

SEQ ID NO: 3297270 - DNA, 13 bp, Homo sapiens
gtataatattgaa

SEQ ID NO: 3297271 - DNA, 17 bp, Homo sapiens
gtataatcttgtagaca

SEQ ID NO: 3297272 - DNA, 18 bp, Homo sapiens
gtataatcttgtagacac

SEQ ID NO: 3297273 - DNA, 14 bp, Homo sapiens
gtataatctttcta

SEQ ID NO: 3297274 - DNA, 21 bp, Homo sapiens
gtataatctttctatagccaa

SEQ ID NO: 3297275 - DNA, 18 bp, Homo sapiens
gtataatgtttaaatcat

SEQ ID NO: 3297276 - DNA, 14 bp, Homo sapiens
gtataattaaactt

SEQ ID NO: 3297277 - DNA, 18 bp, Homo sapiens
gtataatttcgagatttg

SEQ ID NO: 3297278 - DNA, 22 bp, Homo sapiens
gtataattttttaaagttactt

SEQ ID NO: 3297279 - DNA, 19 bp, Homo sapiens
gtatacaaccctggcatta

SEQ ID NO: 3297280 - DNA, 14 bp, Homo sapiens
gtatacaatatata

SEQ ID NO: 3297281 - DNA, 15 bp, Homo sapiens
gtatacaatatataa

SEQ ID NO: 3297282 - DNA, 17 bp, Homo sapiens
gtatacaatatataaaa

SEQ ID NO: 3297283 - DNA, 19 bp, Homo sapiens
gtatacagttcaataaact

SEQ ID NO: 3297284 - DNA, 20 bp, Homo sapiens
gtatacatcctgggtaatga

SEQ ID NO: 3297285 - DNA, 15 bp, Homo sapiens
gtatacctgattttt

SEQ ID NO: 3297286 - DNA, 12 bp, Homo sapiens
gtatactttagt

SEQ ID NO: 3297287 - DNA, 20 bp, Homo sapiens
gtatagatataatgaacaaa

SEQ ID NO: 3297288 - DNA, 18 bp, Homo sapiens
gtatagatgcaagatatt

SEQ ID NO: 3297289 - DNA, 16 bp, Homo sapiens
gtatagtgtaaaataa

SEQ ID NO: 3297290 - DNA, 12 bp, Homo sapiens
gtatatacacat

SEQ ID NO: 3297291 - DNA, 14 bp, Homo sapiens
gtatatacacatat

SEQ ID NO: 3297292 - DNA, 12 bp, Homo sapiens
gtatatacagtt

SEQ ID NO: 3297293 - DNA, 19 bp, Homo sapiens
gtatatacagttattttgg

SEQ ID NO: 3297294 - DNA, 12 bp, Homo sapiens
gtatatactttg

SEQ ID NO: 3297295 - DNA, 14 bp, Homo sapiens
gtatatacttttaa

SEQ ID NO: 3297296 - DNA, 23 bp, Homo sapiens
gtatatataaacagaactccctt

SEQ ID NO: 3297297 - DNA, 13 bp, Homo sapiens
gtatatatgtgta

SEQ ID NO: 3297298 - DNA, 14 bp, Homo sapiens
gtatatatgtgtat

SEQ ID NO: 3297299 - DNA, 16 bp, Homo sapiens
gtatatatgtgtatat

SEQ ID NO: 3297300 - DNA, 13 bp, Homo sapiens
gtatatattccca

SEQ ID NO: 3297301 - DNA, 11 bp, Homo sapiens
gtatatattta

SEQ ID NO: 3297302 - DNA, 21 bp, Homo sapiens
gtccagtgtcacctctctcag

SEQ ID NO: 3297303 - DNA, 16 bp, Homo sapiens
gtccatattttcacag

SEQ ID NO: 3297304 - DNA, 11 bp, Homo sapiens
gtccatccctt

SEQ ID NO: 3297305 - DNA, 19 bp, Homo sapiens
gtccatcccttttcctgtc

SEQ ID NO: 3297306 - DNA, 15 bp, Homo sapiens
gtccatccgactgcc

SEQ ID NO: 3297307 - DNA, 15 bp, Homo sapiens
gtccatgctgatgat

SEQ ID NO: 3297308 - DNA, 20 bp, Homo sapiens
gtccatggcaccagccccct

SEQ ID NO: 3297309 - DNA, 13 bp, Homo sapiens
gtccattctccca

SEQ ID NO: 3297310 - DNA, 15 bp, Homo sapiens
gtccattctcccagg

SEQ ID NO: 3297311 - DNA, 13 bp, Homo sapiens
gtccatttgtaaa

SEQ ID NO: 3297312 - DNA, 16 bp, Homo sapiens
gtccatttgtaaaact

SEQ ID NO: 3297313 - DNA, 14 bp, Homo sapiens
gtcccaaaaccctt

SEQ ID NO: 3297314 - DNA, 15 bp, Homo sapiens
gtcccaaggagctga

SEQ ID NO: 3297315 - DNA, 16 bp, Homo sapiens
gtcccaaggagctgat

SEQ ID NO: 3297316 - DNA, 23 bp, Homo sapiens
gtcccaaggagctgatttccagg

SEQ ID NO: 3297317 - DNA, 23 bp, Homo sapiens
gtcccaatgcacatccattccca

SEQ ID NO: 3297318 - DNA, 13 bp, Homo sapiens
gtcccacccaccc

SEQ ID NO: 3297319 - DNA, 22 bp, Homo sapiens
gtcccacccccacccccagctc

SEQ ID NO: 3297320 - DNA, 23 bp, Homo sapiens
gtcccacccccacccccagctca

SEQ ID NO: 3297321 - DNA, 19 bp, Homo sapiens
gtcccaccgggagcctccc

SEQ ID NO: 3297322 - DNA, 18 bp, Homo sapiens
gtcccaccttggctgcag

SEQ ID NO: 3297323 - DNA, 20 bp, Homo sapiens
gtcccacgtctggccaggca

SEQ ID NO: 3297324 - DNA, 18 bp, Homo sapiens
gtcccagagcacctcacc

SEQ ID NO: 3297325 - DNA, 20 bp, Homo sapiens
gtcccagaggttatctgcct

SEQ ID NO: 3297326 - DNA, 21 bp, Homo sapiens
gtcccagaggttatctgcctg

SEQ ID NO: 3297327 - DNA, 22 bp, Homo sapiens
gtcccagaggttatctgcctgg

SEQ ID NO: 3297328 - DNA, 23 bp, Homo sapiens
gtcccagaggttatctgcctggc

SEQ ID NO: 3297329 - DNA, 17 bp, Homo sapiens
gtcccagcatccctgga

SEQ ID NO: 3297330 - DNA, 18 bp, Homo sapiens
gtcccagcatccctggag

SEQ ID NO: 3297331 - DNA, 22 bp, Homo sapiens
gtcccagcatccctggagcagg

SEQ ID NO: 3297332 - DNA, 23 bp, Homo sapiens
gtcccagccaccccgggctctct

SEQ ID NO: 3297333 - DNA, 15 bp, Homo sapiens
gtcccagcctggggc

SEQ ID NO: 3297334 - DNA, 20 bp, Homo sapiens
gtcccagcctggggctccct

SEQ ID NO: 3297335 - DNA, 23 bp, Homo sapiens
gtcccagcctggggctccctctc

SEQ ID NO: 3297336 - DNA, 22 bp, Homo sapiens
gtcccagctgaaggcagtggca

SEQ ID NO: 3297337 - DNA, 12 bp, Homo sapiens
gtcccagggccc

SEQ ID NO: 3297338 - DNA, 17 bp, Homo sapiens
gtcccagggccctggat

SEQ ID NO: 3297339 - DNA, 21 bp, Homo sapiens
gtcccagtgggaggggcaggc

SEQ ID NO: 3297340 - DNA, 22 bp, Homo sapiens
gtcccagtgggaggggcaggct

SEQ ID NO: 3297341 - DNA, 23 bp, Homo sapiens
gtcccagtgggaggggcaggctg

SEQ ID NO: 3297342 - DNA, 14 bp, Homo sapiens
gtcccatccaggca

SEQ ID NO: 3297343 - DNA, 19 bp, Homo sapiens
gtcccatgacccacccctg

SEQ ID NO: 3297344 - DNA, 16 bp, Homo sapiens
gtcccatttctcactg

SEQ ID NO: 3297345 - DNA, 21 bp, Homo sapiens
gtccccaaagtaccacactga

SEQ ID NO: 3297346 - DNA, 16 bp, Homo sapiens
gtccccaacctgcact

SEQ ID NO: 3297347 - DNA, 21 bp, Homo sapiens
gtccccaagattcacacctga

SEQ ID NO: 3297348 - DNA, 15 bp, Homo sapiens
gtccccacccctgcc

SEQ ID NO: 3297349 - DNA, 16 bp, Homo sapiens
gtccccacccctgccc

SEQ ID NO: 3297350 - DNA, 16 bp, Homo sapiens
gtccccaccctccact

SEQ ID NO: 3297351 - DNA, 18 bp, Homo sapiens
gtccccaccctccactca

SEQ ID NO: 3297352 - DNA, 14 bp, Homo sapiens
gtccccacctggga

SEQ ID NO: 3297353 - DNA, 16 bp, Homo sapiens
gtccccagactcagct

SEQ ID NO: 3297354 - DNA, 21 bp, Homo sapiens
gtccccagactcagctggaag

SEQ ID NO: 3297355 - DNA, 18 bp, Homo sapiens
gtccccagagaccaggct

SEQ ID NO: 3297356 - DNA, 17 bp, Homo sapiens
gtccccagccctgtcct

SEQ ID NO: 3297357 - DNA, 13 bp, Homo sapiens
gtccccagccctt

SEQ ID NO: 3297358 - DNA, 20 bp, Homo sapiens
gtccccagcccttctgcctt

SEQ ID NO: 3297359 - DNA, 14 bp, Homo sapiens
gtccccagttgccg

SEQ ID NO: 3297360 - DNA, 17 bp, Homo sapiens
gtccccatcatcccagc

SEQ ID NO: 3297361 - DNA, 19 bp, Homo sapiens
gtccccatccccaccagct

SEQ ID NO: 3297362 - DNA, 19 bp, Homo sapiens
gtcccccaactctgagccc

SEQ ID NO: 3297363 - DNA, 13 bp, Homo sapiens
gtcccccagctct

SEQ ID NO: 3297364 - DNA, 15 bp, Homo sapiens
gtcccccagctctgg

SEQ ID NO: 3297365 - DNA, 22 bp, Homo sapiens
gtccccctggggcttctcctga

SEQ ID NO: 3297366 - DNA, 20 bp, Homo sapiens
gtccccgaggagctgggccc

SEQ ID NO: 3297367 - DNA, 17 bp, Homo sapiens
gtccccgagtgcctagg

SEQ ID NO: 3297368 - DNA, 19 bp, Homo sapiens
gtccccgagtgcctaggtt

SEQ ID NO: 3297369 - DNA, 22 bp, Homo sapiens
gtccccgtgccccgcctccccg

SEQ ID NO: 3297370 - DNA, 18 bp, Homo sapiens
gtccccgtggccatccct

SEQ ID NO: 3297371 - DNA, 11 bp, Homo sapiens
gtcccctactc

SEQ ID NO: 3297372 - DNA, 15 bp, Homo sapiens
gtcccctcactctgt

SEQ ID NO: 3297373 - DNA, 20 bp, Homo sapiens
gtcccctcactctgtcagcc

SEQ ID NO: 3297374 - DNA, 23 bp, Homo sapiens
gtcccctcactctgtcagccagc

SEQ ID NO: 3297375 - DNA, 14 bp, Homo sapiens
gtcccctcagctcc

SEQ ID NO: 3297376 - DNA, 16 bp, Homo sapiens
gtcccctcccatctgg

SEQ ID NO: 3297377 - DNA, 17 bp, Homo sapiens
gtcccctcccatctggg

SEQ ID NO: 3297378 - DNA, 19 bp, Homo sapiens
gtcccctcccatctgggag

SEQ ID NO: 3297379 - DNA, 21 bp, Homo sapiens
gtcccctctgtcatcactccc

SEQ ID NO: 3297380 - DNA, 23 bp, Homo sapiens
gtcccctctgtcatcactccctg

SEQ ID NO: 3297381 - DNA, 12 bp, Homo sapiens
gtcccctgcggg

SEQ ID NO: 3297382 - DNA, 23 bp, Homo sapiens
gtcccctgtcgagttcggctctg

SEQ ID NO: 3297383 - DNA, 15 bp, Homo sapiens
gtcccgaatccacag

SEQ ID NO: 3297384 - DNA, 19 bp, Homo sapiens
gtcccgatagggtatttga

SEQ ID NO: 3297385 - DNA, 14 bp, Homo sapiens
gtcccgcactctgc

SEQ ID NO: 3297386 - DNA, 16 bp, Homo sapiens
gtcccgcactctgccc

SEQ ID NO: 3297387 - DNA, 15 bp, Homo sapiens
gtcccggggccagca

SEQ ID NO: 3297388 - DNA, 14 bp, Homo sapiens
gtcccggggtcctg

SEQ ID NO: 3297389 - DNA, 21 bp, Homo sapiens
gtcccggttcagacccctgcc

SEQ ID NO: 3297390 - DNA, 22 bp, Homo sapiens
gtcccggttcagacccctgcct

SEQ ID NO: 3297391 - DNA, 23 bp, Homo sapiens
gtccctaccgagtctcttctcca

SEQ ID NO: 3297392 - DNA, 12 bp, Homo sapiens
gtccctcccacc

SEQ ID NO: 3297393 - DNA, 17 bp, Homo sapiens
gtccctcccacctctgt

SEQ ID NO: 3297394 - DNA, 21 bp, Homo sapiens
gtccctcccacctctgtgacc

SEQ ID NO: 3297395 - DNA, 16 bp, Homo sapiens
gtccctcccccttgtc

SEQ ID NO: 3297396 - DNA, 12 bp, Homo sapiens
gtccctctgagg

SEQ ID NO: 3297397 - DNA, 14 bp, Homo sapiens
gtccctctgtgtat

SEQ ID NO: 3297398 - DNA, 12 bp, Homo sapiens
gtccctgcaggg

SEQ ID NO: 3297399 - DNA, 15 bp, Homo sapiens
gtccctgcagggcca

SEQ ID NO: 3297400 - DNA, 23 bp, Homo sapiens
gtccctgctgctgccagggcttc

SEQ ID NO: 3297401 - DNA, 19 bp, Homo sapiens
gtccctggacacagctctt

SEQ ID NO: 3297402 - DNA, 19 bp, Homo sapiens
gtccctgggccagggtctg

SEQ ID NO: 3297403 - DNA, 15 bp, Homo sapiens
gtccctggtccctcg

SEQ ID NO: 3297404 - DNA, 16 bp, Homo sapiens
gtccctgtccctctag

SEQ ID NO: 3297405 - DNA, 20 bp, Homo sapiens
gtccctgtgtgtaggctggg

SEQ ID NO: 3297406 - DNA, 14 bp, Homo sapiens
gtcccttcccctcc

SEQ ID NO: 3297407 - DNA, 19 bp, Homo sapiens
gtcccttcccctccctggc

SEQ ID NO: 3297408 - DNA, 13 bp, Homo sapiens
gtcccttgcctca

SEQ ID NO: 3297409 - DNA, 20 bp, Homo sapiens
gtcccttgtttccagctaga

SEQ ID NO: 3297410 - DNA, 17 bp, Homo sapiens
gtccctttcagagacag

SEQ ID NO: 3297411 - DNA, 17 bp, Homo sapiens
gtccctttccctacctt

SEQ ID NO: 3297412 - DNA, 22 bp, Homo sapiens
gtccctttcttggccagttatc

SEQ ID NO: 3297413 - DNA, 22 bp, Homo sapiens
gtccgaaagggacttggaagct

SEQ ID NO: 3297414 - DNA, 15 bp, Homo sapiens
gtccgatctttgact

SEQ ID NO: 3297415 - DNA, 17 bp, Homo sapiens
gtccgcaccagctgctc

SEQ ID NO: 3297416 - DNA, 18 bp, Homo sapiens
gtccgcaccagctgctct

SEQ ID NO: 3297417 - DNA, 20 bp, Homo sapiens
gtccgcaccagctgctctgc

SEQ ID NO: 3297418 - DNA, 23 bp, Homo sapiens
gtccgcaccagctgctctgcccc

SEQ ID NO: 3297419 - DNA, 14 bp, Homo sapiens
gtccggtgttctaa

SEQ ID NO: 3297420 - DNA, 15 bp, Homo sapiens
gtccggtgttctaag

SEQ ID NO: 3297421 - DNA, 13 bp, Homo sapiens
gtcctaagagatt

SEQ ID NO: 3297422 - DNA, 19 bp, Homo sapiens
gtcctaagagatttatctt

SEQ ID NO: 3297423 - DNA, 20 bp, Homo sapiens
gtcctaagagatttatcttt

SEQ ID NO: 3297424 - DNA, 18 bp, Homo sapiens
gtcctaccagttgcccta

SEQ ID NO: 3297425 - DNA, 18 bp, Homo sapiens
gtcctacttctgacttta

SEQ ID NO: 3297426 - DNA, 16 bp, Homo sapiens
gtcctagctcttacac

SEQ ID NO: 3297427 - DNA, 23 bp, Homo sapiens
gtgaaacacaccaggctgtgggc

SEQ ID NO: 3297428 - DNA, 16 bp, Homo sapiens
gtgaaacacagctgtt

SEQ ID NO: 3297429 - DNA, 18 bp, Homo sapiens
gtgaaaccttttttaaga

SEQ ID NO: 3297430 - DNA, 21 bp, Homo sapiens
gtgaaaccttttttaagattt

SEQ ID NO: 3297431 - DNA, 13 bp, Homo sapiens
gtgaaagtgtaaa

SEQ ID NO: 3297432 - DNA, 15 bp, Homo sapiens
gtgaaagtgtaaaat

SEQ ID NO: 3297433 - DNA, 18 bp, Homo sapiens
gtgaaataccacaagcct

SEQ ID NO: 3297434 - DNA, 20 bp, Homo sapiens
gtgaaatatgatgagattca

SEQ ID NO: 3297435 - DNA, 15 bp, Homo sapiens
gtgaaatggatacta

SEQ ID NO: 3297436 - DNA, 19 bp, Homo sapiens
gtgaaatggatactacatc

SEQ ID NO: 3297437 - DNA, 17 bp, Homo sapiens
gtgaaatgtgaaggaaa

SEQ ID NO: 3297438 - DNA, 20 bp, Homo sapiens
gtgaaattttggtgaatgtg

SEQ ID NO: 3297439 - DNA, 15 bp, Homo sapiens
gtgaaccacaggttt

SEQ ID NO: 3297440 - DNA, 19 bp, Homo sapiens
gtgaaccaccacacccagc

SEQ ID NO: 3297441 - DNA, 18 bp, Homo sapiens
gtgaaccacttcattctg

SEQ ID NO: 3297442 - DNA, 16 bp, Homo sapiens
gtgaacgatttagaaa

SEQ ID NO: 3297443 - DNA, 19 bp, Homo sapiens
gtgaactatttctacacag

SEQ ID NO: 3297444 - DNA, 21 bp, Homo sapiens
gtgaactgctggagtctggct

SEQ ID NO: 3297445 - DNA, 15 bp, Homo sapiens
gtgaactggaagaaa

SEQ ID NO: 3297446 - DNA, 16 bp, Homo sapiens
gtgaacttgactgggt

SEQ ID NO: 3297447 - DNA, 9 bp, Homo sapiens
gtgaagaat

SEQ ID NO: 3297448 - DNA, 21 bp, Homo sapiens
gtgaagaatgcacaagaatgg

SEQ ID NO: 3297449 - DNA, 18 bp, Homo sapiens
gtgaagactgggtgagga

SEQ ID NO: 3297450 - DNA, 19 bp, Homo sapiens
gtgaagagggagaagcatg

SEQ ID NO: 3297451 - DNA, 18 bp, Homo sapiens
gtgaagataatttgcata

SEQ ID NO: 3297452 - DNA, 22 bp, Homo sapiens
gtgaagcagtgcctcgaggcac

SEQ ID NO: 3297453 - DNA, 23 bp, Homo sapiens
gtgaagcagtgcctcgaggcacc

SEQ ID NO: 3297454 - DNA, 16 bp, Homo sapiens
gtgaaggcctggctgg

SEQ ID NO: 3297455 - DNA, 16 bp, Homo sapiens
gtgaagtgaatgaaac

SEQ ID NO: 3297456 - DNA, 13 bp, Homo sapiens
gtgaataaaggat

SEQ ID NO: 3297457 - DNA, 14 bp, Homo sapiens
gtgaatacaattaa

SEQ ID NO: 3297458 - DNA, 17 bp, Homo sapiens
gtgaatacaattaaagg

SEQ ID NO: 3297459 - DNA, 19 bp, Homo sapiens
gtgaatactgctacagcaa

SEQ ID NO: 3297460 - DNA, 17 bp, Homo sapiens
gtgaatacttactataa

SEQ ID NO: 3297461 - DNA, 22 bp, Homo sapiens
gtgaatacttattttcagtgca

SEQ ID NO: 3297462 - DNA, 17 bp, Homo sapiens
gtgaatagattttagca

SEQ ID NO: 3297463 - DNA, 17 bp, Homo sapiens
gtgaatagtcatctcct

SEQ ID NO: 3297464 - DNA, 13 bp, Homo sapiens
gtgaatattgctt

SEQ ID NO: 3297465 - DNA, 14 bp, Homo sapiens
gtgaatcagagcac

SEQ ID NO: 3297466 - DNA, 14 bp, Homo sapiens
gtgaatctgtttca

SEQ ID NO: 3297467 - DNA, 23 bp, Homo sapiens
gtgaatgattcatgttatattta

SEQ ID NO: 3297468 - DNA, 13 bp, Homo sapiens
gtgaatgctggga

SEQ ID NO: 3297469 - DNA, 13 bp, Homo sapiens
gtgaatggaggca

SEQ ID NO: 3297470 - DNA, 15 bp, Homo sapiens
gtgaatggaggcaga

SEQ ID NO: 3297471 - DNA, 17 bp, Homo sapiens
gtgaatggaggcagaga

SEQ ID NO: 3297472 - DNA, 14 bp, Homo sapiens
gtgaatggattgga

SEQ ID NO: 3297473 - DNA, 15 bp, Homo sapiens
gtgaatggattggat

SEQ ID NO: 3297474 - DNA, 23 bp, Homo sapiens
gtgaatgtgggcactggcccagg

SEQ ID NO: 3297475 - DNA, 22 bp, Homo sapiens
gtgaattaggctgtaactactt

SEQ ID NO: 3297476 - DNA, 12 bp, Homo sapiens
gtgaatttttat

SEQ ID NO: 3297477 - DNA, 13 bp, Homo sapiens
gtgaatttttatt

SEQ ID NO: 3297478 - DNA, 16 bp, Homo sapiens
gtgacaaaccatccag

SEQ ID NO: 3297479 - DNA, 17 bp, Homo sapiens
gtgacaaagactcctct

SEQ ID NO: 3297480 - DNA, 20 bp, Homo sapiens
gtgacaaagactcctctggg

SEQ ID NO: 3297481 - DNA, 21 bp, Homo sapiens
gtgacaaagactcctctgggc

SEQ ID NO: 3297482 - DNA, 23 bp, Homo sapiens
gtgacaagctcctggtcttgaga

SEQ ID NO: 3297483 - DNA, 15 bp, Homo sapiens
gtgacaagtgaagaa

SEQ ID NO: 3297484 - DNA, 16 bp, Homo sapiens
gtgacaattctgtttt

SEQ ID NO: 3297485 - DNA, 19 bp, Homo sapiens
gtgacacagcagcttcacc

SEQ ID NO: 3297486 - DNA, 22 bp, Homo sapiens
gtgacacatcaagcttttctgt

SEQ ID NO: 3297487 - DNA, 19 bp, Homo sapiens
gtgacacattacaaagcca

SEQ ID NO: 3297488 - DNA, 20 bp, Homo sapiens
gtgacacccacaatcccacc

SEQ ID NO: 3297489 - DNA, 20 bp, Homo sapiens
gtgacacttcagagagctgg

SEQ ID NO: 3297490 - DNA, 15 bp, Homo sapiens
gtgacagacaggctc

SEQ ID NO: 3297491 - DNA, 20 bp, Homo sapiens
gtgacagagtgagactctgt

SEQ ID NO: 3297492 - DNA, 22 bp, Homo sapiens
gtgacagagtgagactctgtct

SEQ ID NO: 3297493 - DNA, 17 bp, Homo sapiens
gtgacagagttcactat

SEQ ID NO: 3297494 - DNA, 16 bp, Homo sapiens
gtgacaggaaagccct

SEQ ID NO: 3297495 - DNA, 23 bp, Homo sapiens
gtgacagggccagtggggcctgt

SEQ ID NO: 3297496 - DNA, 19 bp, Homo sapiens
gtgacagtcatcatcaggg

SEQ ID NO: 3297497 - DNA, 22 bp, Homo sapiens
gtgacagtcatcatcagggcct

SEQ ID NO: 3297498 - DNA, 17 bp, Homo sapiens
gtgacagtgccttctct

SEQ ID NO: 3297499 - DNA, 16 bp, Homo sapiens
gtgacatggtgcctga

SEQ ID NO: 3297500 - DNA, 22 bp, Homo sapiens
gtgacatggtgcctgagaggca

SEQ ID NO: 3297501 - DNA, 14 bp, Homo sapiens
gtgacatgtgaaac

SEQ ID NO: 3297502 - DNA, 15 bp, Homo sapiens
gtgacatgtgaaacc

SEQ ID NO: 3297503 - DNA, 19 bp, Homo sapiens
gtgacatgtgaaacctttt

SEQ ID NO: 3297504 - DNA, 23 bp, Homo sapiens
gtgacatttcccaagtcagacag

SEQ ID NO: 3297505 - DNA, 23 bp, Homo sapiens
gtgaccaactagacattctgtcg

SEQ ID NO: 3297506 - DNA, 13 bp, Homo sapiens
gtgaccaactgtg

SEQ ID NO: 3297507 - DNA, 20 bp, Homo sapiens
gtgaccaactgtgttgtatt

SEQ ID NO: 3297508 - DNA, 22 bp, Homo sapiens
gtgaccatcttcataatttgct

SEQ ID NO: 3297509 - DNA, 12 bp, Homo sapiens
gtgaccatgttc

SEQ ID NO: 3297510 - DNA, 17 bp, Homo sapiens
gtgacccaccagtgcct

SEQ ID NO: 3297511 - DNA, 13 bp, Homo sapiens
gtgaccccactgc

SEQ ID NO: 3297512 - DNA, 19 bp, Homo sapiens
gtgaccgactaccccagtc

SEQ ID NO: 3297513 - DNA, 22 bp, Homo sapiens
gtgaccgactaccccagtccca

SEQ ID NO: 3297514 - DNA, 20 bp, Homo sapiens
gtgacctatcagttattaat

SEQ ID NO: 3297515 - DNA, 20 bp, Homo sapiens
gtgacctattcaccctccac

SEQ ID NO: 3297516 - DNA, 12 bp, Homo sapiens
gtgacctcaggc

SEQ ID NO: 3297517 - DNA, 19 bp, Homo sapiens
gtgacctcaggcactagcc

SEQ ID NO: 3297518 - DNA, 12 bp, Homo sapiens
gtgacctctgcc

SEQ ID NO: 3297519 - DNA, 23 bp, Homo sapiens
gtgacctgatttcagaagagact

SEQ ID NO: 3297520 - DNA, 17 bp, Homo sapiens
gtgacgcctgccctccc

SEQ ID NO: 3297521 - DNA, 16 bp, Homo sapiens
gtgacggccctcatct

SEQ ID NO: 3297522 - DNA, 23 bp, Homo sapiens
gtgactaactagacaccaaagtt

SEQ ID NO: 3297523 - DNA, 15 bp, Homo sapiens
gtgactatatagaga

SEQ ID NO: 3297524 - DNA, 21 bp, Homo sapiens
gtgactcacttcaatgtgtca

SEQ ID NO: 3297525 - DNA, 14 bp, Homo sapiens
gtgactcctgctgg

SEQ ID NO: 3297526 - DNA, 16 bp, Homo sapiens
gtgactcctgctggta

SEQ ID NO: 3297527 - DNA, 19 bp, Homo sapiens
gtgactgaaaccattttcc

SEQ ID NO: 3297528 - DNA, 21 bp, Homo sapiens
gtgactgaaggggcacaccac

SEQ ID NO: 3297529 - DNA, 19 bp, Homo sapiens
gtgactggcaagaggcctc

SEQ ID NO: 3297530 - DNA, 21 bp, Homo sapiens
gtgactggcaggtgcagatgg

SEQ ID NO: 3297531 - DNA, 12 bp, Homo sapiens
gtgactgtccca

SEQ ID NO: 3297532 - DNA, 23 bp, Homo sapiens
gtgactgtcccaccgggagcctc

SEQ ID NO: 3297533 - DNA, 17 bp, Homo sapiens
gtgacttgtgtcccatg

SEQ ID NO: 3297534 - DNA, 16 bp, Homo sapiens
gtgactttaaaagaaa

SEQ ID NO: 3297535 - DNA, 13 bp, Homo sapiens
gtgacttttctga

SEQ ID NO: 3297536 - DNA, 14 bp, Homo sapiens
gtgacttttctgat

SEQ ID NO: 3297537 - DNA, 16 bp, Homo sapiens
gtgagaaaatgcctca

SEQ ID NO: 3297538 - DNA, 20 bp, Homo sapiens
gtgagaagtgaatgctggga

SEQ ID NO: 3297539 - DNA, 18 bp, Homo sapiens
gtgagacagtctggaaag

SEQ ID NO: 3297540 - DNA, 14 bp, Homo sapiens
gtgagacccccaca

SEQ ID NO: 3297541 - DNA, 17 bp, Homo sapiens
gtgagacccccacacct

SEQ ID NO: 3297542 - DNA, 14 bp, Homo sapiens
gtgagactctgtct

SEQ ID NO: 3297543 - DNA, 16 bp, Homo sapiens
gtgagactctgtctca

SEQ ID NO: 3297544 - DNA, 18 bp, Homo sapiens
gtgagactctgtctcaaa

SEQ ID NO: 3297545 - DNA, 23 bp, Homo sapiens
gtgagactgggaaggcttgggat

SEQ ID NO: 3297546 - DNA, 16 bp, Homo sapiens
gtgagagaaagagaga

SEQ ID NO: 3297547 - DNA, 17 bp, Homo sapiens
gtgagagaaagagagaa

SEQ ID NO: 3297548 - DNA, 23 bp, Homo sapiens
gtgagagaaagagagaagccagc

SEQ ID NO: 3297549 - DNA, 16 bp, Homo sapiens
gtgagagaatttatca

SEQ ID NO: 3297550 - DNA, 11 bp, Homo sapiens
gtgagagagac

SEQ ID NO: 3297551 - DNA, 12 bp, Homo sapiens
gtgagagcccat

SEQ ID NO: 3297552 - DNA, 18 bp, Homo sapiens
gtggattctgaggccctg

SEQ ID NO: 3297553 - DNA, 13 bp, Homo sapiens
gtggattctttaa

SEQ ID NO: 3297554 - DNA, 13 bp, Homo sapiens
gtggattgagggt

SEQ ID NO: 3297555 - DNA, 19 bp, Homo sapiens
gtggattgcacgtggcctc

SEQ ID NO: 3297556 - DNA, 20 bp, Homo sapiens
gtggattttctactgtaaga

SEQ ID NO: 3297557 - DNA, 16 bp, Homo sapiens
gtggcaatctgtgggc

SEQ ID NO: 3297558 - DNA, 13 bp, Homo sapiens
gtggcacaccacc

SEQ ID NO: 3297559 - DNA, 22 bp, Homo sapiens
gtggcacagacttctggaaggc

SEQ ID NO: 3297560 - DNA, 16 bp, Homo sapiens
gtggcacaggccccct

SEQ ID NO: 3297561 - DNA, 16 bp, Homo sapiens
gtggcacctcctgaga

SEQ ID NO: 3297562 - DNA, 15 bp, Homo sapiens
gtggcactgagcccc

SEQ ID NO: 3297563 - DNA, 21 bp, Homo sapiens
gtggcactggtaggttgggac

SEQ ID NO: 3297564 - DNA, 22 bp, Homo sapiens
gtggcactggtaggttgggaca

SEQ ID NO: 3297565 - DNA, 18 bp, Homo sapiens
gtggcagaaaagaggaga

SEQ ID NO: 3297566 - DNA, 19 bp, Homo sapiens
gtggcagaaaagaggagac

SEQ ID NO: 3297567 - DNA, 24 bp, Homo sapiens
gtggcagaaaagaggagaccctgg

SEQ ID NO: 3297568 - DNA, 23 bp, Homo sapiens
gtggcagataatcagcctcttaa

SEQ ID NO: 3297569 - DNA, 13 bp, Homo sapiens
gtggcagccatgc

SEQ ID NO: 3297570 - DNA, 14 bp, Homo sapiens
gtggcagccatgcc

SEQ ID NO: 3297571 - DNA, 20 bp, Homo sapiens
gtggcagccatgcctcatgc

SEQ ID NO: 3297572 - DNA, 19 bp, Homo sapiens
gtggcagctgcttttgtct

SEQ ID NO: 3297573 - DNA, 19 bp, Homo sapiens
gtggcaggcacacagcagc

SEQ ID NO: 3297574 - DNA, 20 bp, Homo sapiens
gtggcaggcacacagcagcc

SEQ ID NO: 3297575 - DNA, 23 bp, Homo sapiens
gtggcaggcacacagcagccccc

SEQ ID NO: 3297576 - DNA, 13 bp, Homo sapiens
gtggcagggctca

SEQ ID NO: 3297577 - DNA, 17 bp, Homo sapiens
gtggcagggctcaggat

SEQ ID NO: 3297578 - DNA, 20 bp, Homo sapiens
gtggcaggggacaggagtcc

SEQ ID NO: 3297579 - DNA, 15 bp, Homo sapiens
gtggcaggggagcag

SEQ ID NO: 3297580 - DNA, 18 bp, Homo sapiens
gtggcagggggccccgcc

SEQ ID NO: 3297581 - DNA, 23 bp, Homo sapiens
gtggcagggggccccgccagggc

SEQ ID NO: 3297582 - DNA, 18 bp, Homo sapiens
gtggcagtggaggtgggg

SEQ ID NO: 3297583 - DNA, 16 bp, Homo sapiens
gtggcagtgggagctg

SEQ ID NO: 3297584 - DNA, 17 bp, Homo sapiens
gtggcagtgggagctgc

SEQ ID NO: 3297585 - DNA, 19 bp, Homo sapiens
gtggcagtgggagctgcct

SEQ ID NO: 3297586 - DNA, 20 bp, Homo sapiens
gtggcatcctccggagagag

SEQ ID NO: 3297587 - DNA, 16 bp, Homo sapiens
gtggcatgtgctgtga

SEQ ID NO: 3297588 - DNA, 15 bp, Homo sapiens
gtggcatgtggcctg

SEQ ID NO: 3297589 - DNA, 19 bp, Homo sapiens
gtggccaaaagctagacag

SEQ ID NO: 3297590 - DNA, 19 bp, Homo sapiens
gtggccaaattatttgtgt

SEQ ID NO: 3297591 - DNA, 14 bp, Homo sapiens
gtggccacagcccc

SEQ ID NO: 3297592 - DNA, 15 bp, Homo sapiens
gtggccacagccccc

SEQ ID NO: 3297593 - DNA, 16 bp, Homo sapiens
gtggccacagccccct

SEQ ID NO: 3297594 - DNA, 19 bp, Homo sapiens
gtggccacagcccccttgc

SEQ ID NO: 3297595 - DNA, 21 bp, Homo sapiens
gtggccacagcccccttgccc

SEQ ID NO: 3297596 - DNA, 13 bp, Homo sapiens
gtggccaccagta

SEQ ID NO: 3297597 - DNA, 11 bp, Homo sapiens
gtggccagagc

SEQ ID NO: 3297598 - DNA, 13 bp, Homo sapiens
gtggccagagctg

SEQ ID NO: 3297599 - DNA, 14 bp, Homo sapiens
gtggccagagctgg

SEQ ID NO: 3297600 - DNA, 23 bp, Homo sapiens
gtggccagagctgggaggcatgg

SEQ ID NO: 3297601 - DNA, 15 bp, Homo sapiens
gtggccagcccggct

SEQ ID NO: 3297602 - DNA, 14 bp, Homo sapiens
gtggccatccctgg

SEQ ID NO: 3297603 - DNA, 16 bp, Homo sapiens
gtggccatccctgggc

SEQ ID NO: 3297604 - DNA, 20 bp, Homo sapiens
gtggccatccctgggcccct

SEQ ID NO: 3297605 - DNA, 22 bp, Homo sapiens
gtggccatccctgggcccctcc

SEQ ID NO: 3297606 - DNA, 15 bp, Homo sapiens
gtggccatccctgtg

SEQ ID NO: 3297607 - DNA, 19 bp, Homo sapiens
gtggccccaccctgggccc

SEQ ID NO: 3297608 - DNA, 20 bp, Homo sapiens
gtggccccaccctgggccct

SEQ ID NO: 3297609 - DNA, 16 bp, Homo sapiens
gtggccccgtttctgg

SEQ ID NO: 3297610 - DNA, 23 bp, Homo sapiens
gtggccccgtttctggtggtctg

SEQ ID NO: 3297611 - DNA, 18 bp, Homo sapiens
gtggcccgacagcctggc

SEQ ID NO: 3297612 - DNA, 17 bp, Homo sapiens
gtggccctgccctctcc

SEQ ID NO: 3297613 - DNA, 17 bp, Homo sapiens
gtggccctgtccctccc

SEQ ID NO: 3297614 - DNA, 21 bp, Homo sapiens
gtggcctcaagagcacacaga

SEQ ID NO: 3297615 - DNA, 13 bp, Homo sapiens
gtggcctcagaat

SEQ ID NO: 3297616 - DNA, 14 bp, Homo sapiens
gtggcctccctgct

SEQ ID NO: 3297617 - DNA, 18 bp, Homo sapiens
gtggcctggccaggagct

SEQ ID NO: 3297618 - DNA, 21 bp, Homo sapiens
gtggcctggccaggagctctt

SEQ ID NO: 3297619 - DNA, 20 bp, Homo sapiens
gtggcctgtgtccagcagct

SEQ ID NO: 3297620 - DNA, 19 bp, Homo sapiens
gtggcctgtgtcccatgac

SEQ ID NO: 3297621 - DNA, 13 bp, Homo sapiens
gtggcctgtttct

SEQ ID NO: 3297622 - DNA, 17 bp, Homo sapiens
gtggccttcccccttcc

SEQ ID NO: 3297623 - DNA, 22 bp, Homo sapiens
gtggccttccccttttgcctgg

SEQ ID NO: 3297624 - DNA, 21 bp, Homo sapiens
gtggccttggccggctgtgct

SEQ ID NO: 3297625 - DNA, 17 bp, Homo sapiens
gtggcgccgtctccagg

SEQ ID NO: 3297626 - DNA, 21 bp, Homo sapiens
gtggcgccgtctccaggggct

SEQ ID NO: 3297627 - DNA, 18 bp, Homo sapiens
gtggcgtgggagccagcc

SEQ ID NO: 3297628 - DNA, 18 bp, Homo sapiens
gtggctaggcctttcctg

SEQ ID NO: 3297629 - DNA, 22 bp, Homo sapiens
gtggctcatggcgtaatgggcc

SEQ ID NO: 3297630 - DNA, 13 bp, Homo sapiens
gtggctccttccc

SEQ ID NO: 3297631 - DNA, 13 bp, Homo sapiens
gtggctgccccgg

SEQ ID NO: 3297632 - DNA, 17 bp, Homo sapiens
gtggctggaagatcctg

SEQ ID NO: 3297633 - DNA, 15 bp, Homo sapiens
gtggctggcgcctgt

SEQ ID NO: 3297634 - DNA, 11 bp, Homo sapiens
gtggctgggca

SEQ ID NO: 3297635 - DNA, 11 bp, Homo sapiens
gtggctggggg

SEQ ID NO: 3297636 - DNA, 16 bp, Homo sapiens
gtggctgggggcagga

SEQ ID NO: 3297637 - DNA, 20 bp, Homo sapiens
gtggctgggtgggcccagaa

SEQ ID NO: 3297638 - DNA, 19 bp, Homo sapiens
gtggctgggttggagggtg

SEQ ID NO: 3297639 - DNA, 15 bp, Homo sapiens
gtggctggtccaggg

SEQ ID NO: 3297640 - DNA, 13 bp, Homo sapiens
gtggcttcccagc

SEQ ID NO: 3297641 - DNA, 18 bp, Homo sapiens
gtggcttcccgctcagcc

SEQ ID NO: 3297642 - DNA, 21 bp, Homo sapiens
gtggctttccttgtggcagag

SEQ ID NO: 3297643 - DNA, 23 bp, Homo sapiens
gtggctttccttgtggcagagga

SEQ ID NO: 3297644 - DNA, 16 bp, Homo sapiens
gtggctttggcagtgt

SEQ ID NO: 3297645 - DNA, 17 bp, Homo sapiens
gtgggaactcactttcc

SEQ ID NO: 3297646 - DNA, 18 bp, Homo sapiens
gtgggacagcccagagcc

SEQ ID NO: 3297647 - DNA, 23 bp, Homo sapiens
gtgggacagcctcttcagcccct

SEQ ID NO: 3297648 - DNA, 22 bp, Homo sapiens
gtgggactgtacacactttatt

SEQ ID NO: 3297649 - DNA, 19 bp, Homo sapiens
gtgggagcagcggtttggg

SEQ ID NO: 3297650 - DNA, 13 bp, Homo sapiens
gtgggagcaggag

SEQ ID NO: 3297651 - DNA, 22 bp, Homo sapiens
gtgggagcaggagattgagaag

SEQ ID NO: 3297652 - DNA, 21 bp, Homo sapiens
gtgggagccctgaccttggct

SEQ ID NO: 3297653 - DNA, 17 bp, Homo sapiens
gtgggagctgagctgga

SEQ ID NO: 3297654 - DNA, 14 bp, Homo sapiens
gtgggagctgcctg

SEQ ID NO: 3297655 - DNA, 14 bp, Homo sapiens
gtgggaggaggcct

SEQ ID NO: 3297656 - DNA, 19 bp, Homo sapiens
gtgggagggagcagacagg

SEQ ID NO: 3297657 - DNA, 13 bp, Homo sapiens
gtgggaggggcag

SEQ ID NO: 3297658 - DNA, 17 bp, Homo sapiens
gtgggaggtggaagaag

SEQ ID NO: 3297659 - DNA, 24 bp, Homo sapiens
gtgggatgttcagcactgtccctt

SEQ ID NO: 3297660 - DNA, 17 bp, Homo sapiens
gtgggcaaacaggcagt

SEQ ID NO: 3297661 - DNA, 17 bp, Homo sapiens
gtgggcagcaccctccc

SEQ ID NO: 3297662 - DNA, 14 bp, Homo sapiens
gtgggcagctgagg

SEQ ID NO: 3297663 - DNA, 12 bp, Homo sapiens
gtgggcaggtgg

SEQ ID NO: 3297664 - DNA, 20 bp, Homo sapiens
gtgggcatttcttgcgagcc

SEQ ID NO: 3297665 - DNA, 21 bp, Homo sapiens
gtgggccaccatgtctggcta

SEQ ID NO: 3297666 - DNA, 21 bp, Homo sapiens
gtgggccagggctgccctgag

SEQ ID NO: 3297667 - DNA, 17 bp, Homo sapiens
gtgggccagtctgtgga

SEQ ID NO: 3297668 - DNA, 18 bp, Homo sapiens
gtgggccagtctgtggat

SEQ ID NO: 3297669 - DNA, 19 bp, Homo sapiens
gtgggcccaggaccagctg

SEQ ID NO: 3297670 - DNA, 15 bp, Homo sapiens
gtgggccccgggctg

SEQ ID NO: 3297671 - DNA, 21 bp, Homo sapiens
gtgggccccgggctggagaaa

SEQ ID NO: 3297672 - DNA, 21 bp, Homo sapiens
gtgggcccctcaacagccaag

SEQ ID NO: 3297673 - DNA, 12 bp, Homo sapiens
gtgggcctggcc

SEQ ID NO: 3297674 - DNA, 13 bp, Homo sapiens
gtgggcctggcct

SEQ ID NO: 3297675 - DNA, 14 bp, Homo sapiens
gtgggcctggcctg

SEQ ID NO: 3297676 - DNA, 18 bp, Homo sapiens
gtgggcctggcctgagct

SEQ ID NO: 3297677 - DNA, 19 bp, Homo sapiens
gtgggctacatgctggggt

SEQ ID NO: 3297678 - DNA, 14 bp, Homo sapiens
gttacagttctgtg

SEQ ID NO: 3297679 - DNA, 19 bp, Homo sapiens
gttacataagataaatgtg

SEQ ID NO: 3297680 - DNA, 16 bp, Homo sapiens
gttacattaatgttaa

SEQ ID NO: 3297681 - DNA, 22 bp, Homo sapiens
gttaccaaatacacatttcaca

SEQ ID NO: 3297682 - DNA, 23 bp, Homo sapiens
gttaccacacatctatgatataa

SEQ ID NO: 3297683 - DNA, 18 bp, Homo sapiens
gttaccatgtcactgtgg

SEQ ID NO: 3297684 - DNA, 16 bp, Homo sapiens
gttaccatttacatgt

SEQ ID NO: 3297685 - DNA, 21 bp, Homo sapiens
gttaccattttaacgctgcct

SEQ ID NO: 3297686 - DNA, 15 bp, Homo sapiens
gttacccaggctgga

SEQ ID NO: 3297687 - DNA, 22 bp, Homo sapiens
gttacctccaacagaactaaat

SEQ ID NO: 3297688 - DNA, 15 bp, Homo sapiens
gttacctcctataaa

SEQ ID NO: 3297689 - DNA, 17 bp, Homo sapiens
gttacctcctataaact

SEQ ID NO: 3297690 - DNA, 15 bp, Homo sapiens
gttaccttatagtta

SEQ ID NO: 3297691 - DNA, 16 bp, Homo sapiens
gttactaatatgccta

SEQ ID NO: 3297692 - DNA, 16 bp, Homo sapiens
gttactaggtaacttc

SEQ ID NO: 3297693 - DNA, 22 bp, Homo sapiens
gttactcagggctcctcccagc

SEQ ID NO: 3297694 - DNA, 12 bp, Homo sapiens
gttactcagggt

SEQ ID NO: 3297695 - DNA, 15 bp, Homo sapiens
gttactcagggttca

SEQ ID NO: 3297696 - DNA, 20 bp, Homo sapiens
gttactcagtgttagagaaa

SEQ ID NO: 3297697 - DNA, 20 bp, Homo sapiens
gttactccctacactgatgc

SEQ ID NO: 3297698 - DNA, 19 bp, Homo sapiens
gttactgatcatgcattgt

SEQ ID NO: 3297699 - DNA, 18 bp, Homo sapiens
gttactgttaaccattta

SEQ ID NO: 3297700 - DNA, 11 bp, Homo sapiens
gttactgttct

SEQ ID NO: 3297701 - DNA, 13 bp, Homo sapiens
gttactgttcttg

SEQ ID NO: 3297702 - DNA, 18 bp, Homo sapiens
gttactgttcttgctgct

SEQ ID NO: 3297703 - DNA, 19 bp, Homo sapiens
gttactgttcttgctgcta

SEQ ID NO: 3297704 - DNA, 20 bp, Homo sapiens
gttactgttcttgctgctag

SEQ ID NO: 3297705 - DNA, 22 bp, Homo sapiens
gttactgttcttgctgctagaa

SEQ ID NO: 3297706 - DNA, 23 bp, Homo sapiens
gttactgttcttgctgctagaac

SEQ ID NO: 3297707 - DNA, 17 bp, Homo sapiens
gttacttgtctgaggcc

SEQ ID NO: 3297708 - DNA, 18 bp, Homo sapiens
gttacttgtctgaggcct

SEQ ID NO: 3297709 - DNA, 12 bp, Homo sapiens
gttactttggca

SEQ ID NO: 3297710 - DNA, 13 bp, Homo sapiens
gttactttgtaat

SEQ ID NO: 3297711 - DNA, 19 bp, Homo sapiens
gttactttgtaatttttgg

SEQ ID NO: 3297712 - DNA, 16 bp, Homo sapiens
gttagaaaatgactta

SEQ ID NO: 3297713 - DNA, 19 bp, Homo sapiens
gttagaacactattttcag

SEQ ID NO: 3297714 - DNA, 22 bp, Homo sapiens
gttagacgccttccaggtcagg

SEQ ID NO: 3297715 - DNA, 22 bp, Homo sapiens
gttagactgacttgtttgtctt

SEQ ID NO: 3297716 - DNA, 20 bp, Homo sapiens
gttagagagggaccatgtgt

SEQ ID NO: 3297717 - DNA, 22 bp, Homo sapiens
gttagagagggaccatgtgtca

SEQ ID NO: 3297718 - DNA, 23 bp, Homo sapiens
gttagagagggaccatgtgtcac

SEQ ID NO: 3297719 - DNA, 20 bp, Homo sapiens
gttagatgctgaatatctgt

SEQ ID NO: 3297720 - DNA, 23 bp, Homo sapiens
gttagattcctcttgcctctctc

SEQ ID NO: 3297721 - DNA, 14 bp, Homo sapiens
gttagccccaggga

SEQ ID NO: 3297722 - DNA, 20 bp, Homo sapiens
gttagctcctgtggccccac

SEQ ID NO: 3297723 - DNA, 17 bp, Homo sapiens
gttaggaaataaaacct

SEQ ID NO: 3297724 - DNA, 18 bp, Homo sapiens
gttaggaaataaaacctt

SEQ ID NO: 3297725 - DNA, 19 bp, Homo sapiens
gttaggaaataaaaccttt

SEQ ID NO: 3297726 - DNA, 21 bp, Homo sapiens
gttaggaaataaaacctttca

SEQ ID NO: 3297727 - DNA, 23 bp, Homo sapiens
gttaggggcctggcccaaagcag

SEQ ID NO: 3297728 - DNA, 17 bp, Homo sapiens
gttagggtcagccattt

SEQ ID NO: 3297729 - DNA, 21 bp, Homo sapiens
gttaggtagagggagttgtca

SEQ ID NO: 3297730 - DNA, 17 bp, Homo sapiens
gttaggttgtctccagg

SEQ ID NO: 3297731 - DNA, 16 bp, Homo sapiens
gttagtagcatgttga

SEQ ID NO: 3297732 - DNA, 21 bp, Homo sapiens
gttagtagcatgttgagccag

SEQ ID NO: 3297733 - DNA, 21 bp, Homo sapiens
gttagtattttaatcctgtac

SEQ ID NO: 3297734 - DNA, 12 bp, Homo sapiens
gttagtcatttg

SEQ ID NO: 3297735 - DNA, 22 bp, Homo sapiens
gttagtctcttgtattaaactc

SEQ ID NO: 3297736 - DNA, 15 bp, Homo sapiens
gttagtttagtgtgt

SEQ ID NO: 3297737 - DNA, 22 bp, Homo sapiens
gttagtttagtgtgtgtgcaga

SEQ ID NO: 3297738 - DNA, 18 bp, Homo sapiens
gttataacagatgtgaaa

SEQ ID NO: 3297739 - DNA, 13 bp, Homo sapiens
gttataagaagaa

SEQ ID NO: 3297740 - DNA, 18 bp, Homo sapiens
gttatacagttataaaat

SEQ ID NO: 3297741 - DNA, 20 bp, Homo sapiens
gttatacagttataaaatta

SEQ ID NO: 3297742 - DNA, 17 bp, Homo sapiens
gttataggtcactcctg

SEQ ID NO: 3297743 - DNA, 15 bp, Homo sapiens
gttatagtatatctg

SEQ ID NO: 3297744 - DNA, 16 bp, Homo sapiens
gttatataattcactc

SEQ ID NO: 3297745 - DNA, 18 bp, Homo sapiens
gttatattagtgaagatg

SEQ ID NO: 3297746 - DNA, 17 bp, Homo sapiens
gttatatttaatgcatt

SEQ ID NO: 3297747 - DNA, 16 bp, Homo sapiens
gttatcacttatatat

SEQ ID NO: 3297748 - DNA, 16 bp, Homo sapiens
gttatcagttaacatt

SEQ ID NO: 3297749 - DNA, 17 bp, Homo sapiens
gttatcagttaacatta

SEQ ID NO: 3297750 - DNA, 13 bp, Homo sapiens
gttatcatgaatt

SEQ ID NO: 3297751 - DNA, 17 bp, Homo sapiens
gttatcatgaattttaa

SEQ ID NO: 3297752 - DNA, 20 bp, Homo sapiens
gttatcatgaattttaaagt

SEQ ID NO: 3297753 - DNA, 23 bp, Homo sapiens
gttatcctttgtgagcctatgat

SEQ ID NO: 3297754 - DNA, 12 bp, Homo sapiens
gttatctctgtg

SEQ ID NO: 3297755 - DNA, 18 bp, Homo sapiens
gttatctgcctggcctgg

SEQ ID NO: 3297756 - DNA, 13 bp, Homo sapiens
gttatcttagctg

SEQ ID NO: 3297757 - DNA, 18 bp, Homo sapiens
gttatcttctcaagttct

SEQ ID NO: 3297758 - DNA, 19 bp, Homo sapiens
gttatcttctcaagttcta

SEQ ID NO: 3297759 - DNA, 14 bp, Homo sapiens
gttatctttccctc

SEQ ID NO: 3297760 - DNA, 13 bp, Homo sapiens
gttatgaaagaat

SEQ ID NO: 3297761 - DNA, 18 bp, Homo sapiens
gttatgaaagaatatatt

SEQ ID NO: 3297762 - DNA, 20 bp, Homo sapiens
gttatgaaagaatatattta

SEQ ID NO: 3297763 - DNA, 15 bp, Homo sapiens
gttatgaaataaaga

SEQ ID NO: 3297764 - DNA, 18 bp, Homo sapiens
gttatgacagccatttgt

SEQ ID NO: 3297765 - DNA, 13 bp, Homo sapiens
gttatgatttgta

SEQ ID NO: 3297766 - DNA, 13 bp, Homo sapiens
gttatgtaaaact

SEQ ID NO: 3297767 - DNA, 17 bp, Homo sapiens
gttatgtactagtgttc

SEQ ID NO: 3297768 - DNA, 14 bp, Homo sapiens
gttatgtactgtac

SEQ ID NO: 3297769 - DNA, 15 bp, Homo sapiens
gttatgtactgtact

SEQ ID NO: 3297770 - DNA, 22 bp, Homo sapiens
gttatgtttgcactttgtatat

SEQ ID NO: 3297771 - DNA, 17 bp, Homo sapiens
gttattagcaaggctgg

SEQ ID NO: 3297772 - DNA, 14 bp, Homo sapiens
gttattataattgt

SEQ ID NO: 3297773 - DNA, 16 bp, Homo sapiens
gttattataattgtat

SEQ ID NO: 3297774 - DNA, 18 bp, Homo sapiens
gttattataattgtatca

SEQ ID NO: 3297775 - DNA, 19 bp, Homo sapiens
gttattcaaatttgtacag

SEQ ID NO: 3297776 - DNA, 19 bp, Homo sapiens
gttattccatcaataaatg

SEQ ID NO: 3297777 - DNA, 20 bp, Homo sapiens
gttattgggcaagtgattga

SEQ ID NO: 3297778 - DNA, 21 bp, Homo sapiens
gttattgttgaacatacttca

SEQ ID NO: 3297779 - DNA, 12 bp, Homo sapiens
gttatttagact

SEQ ID NO: 3297780 - DNA, 15 bp, Homo sapiens
gttatttattcttta

SEQ ID NO: 3297781 - DNA, 19 bp, Homo sapiens
gttatttgttattttcagt

SEQ ID NO: 3297782 - DNA, 16 bp, Homo sapiens
gttatttgttcattat

SEQ ID NO: 3297783 - DNA, 19 bp, Homo sapiens
gttattttaaatataaata

SEQ ID NO: 3297784 - DNA, 14 bp, Homo sapiens
gttattttcagtat

SEQ ID NO: 3297785 - DNA, 15 bp, Homo sapiens
gttattttcagtatt

SEQ ID NO: 3297786 - DNA, 15 bp, Homo sapiens
gttattttctacagt

SEQ ID NO: 3297787 - DNA, 15 bp, Homo sapiens
gttattttgataaca

SEQ ID NO: 3297788 - DNA, 19 bp, Homo sapiens
gttattttggatatattat

SEQ ID NO: 3297789 - DNA, 20 bp, Homo sapiens
gttattttgtgtacaagttg

SEQ ID NO: 3297790 - DNA, 16 bp, Homo sapiens
gttatttttatatcag

SEQ ID NO: 3297791 - DNA, 18 bp, Homo sapiens
gttatttttcaaggaagg

SEQ ID NO: 3297792 - DNA, 14 bp, Homo sapiens
gttatttttgtaca

SEQ ID NO: 3297793 - DNA, 13 bp, Homo sapiens
gttcaaaatgtct

SEQ ID NO: 3297794 - DNA, 13 bp, Homo sapiens
gttcaaagtgtat

SEQ ID NO: 3297795 - DNA, 15 bp, Homo sapiens
gttcaaagtgtatat

SEQ ID NO: 3297796 - DNA, 20 bp, Homo sapiens
gttcaaagtgtatatttatt

SEQ ID NO: 3297797 - DNA, 12 bp, Homo sapiens
gttcaaattctc

SEQ ID NO: 3297798 - DNA, 16 bp, Homo sapiens
gttcaacccacagcta

SEQ ID NO: 3297799 - DNA, 12 bp, Homo sapiens
gttcaactattt

SEQ ID NO: 3297800 - DNA, 20 bp, Homo sapiens
gttcaagcctgtgggagtag

SEQ ID NO: 3297801 - DNA, 18 bp, Homo sapiens
gttcaagcgattcttctg

SEQ ID NO: 3297802 - DNA, 18 bp, Homo sapiens
gttcaataataaatattt

SEQ ID NO: 3297803 - DNA, 17 bp, Homo sapiens
gttcaattccctgaagg

SEQ ID NO: 3297804 - DNA, 20 bp, Homo sapiens
gtttgcactgtatgctggac

SEQ ID NO: 3297805 - DNA, 22 bp, Homo sapiens
gtttgcactgtatgctggacgg

SEQ ID NO: 3297806 - DNA, 11 bp, Homo sapiens
gtttgcagcct

SEQ ID NO: 3297807 - DNA, 16 bp, Homo sapiens
gtttgcctctgcctct

SEQ ID NO: 3297808 - DNA, 17 bp, Homo sapiens
gtttgcctctgcctctg

SEQ ID NO: 3297809 - DNA, 18 bp, Homo sapiens
gtttgccttcctttctcc

SEQ ID NO: 3297810 - DNA, 17 bp, Homo sapiens
gtttgctattagagcat

SEQ ID NO: 3297811 - DNA, 19 bp, Homo sapiens
gtttgctgaacaccttgtg

SEQ ID NO: 3297812 - DNA, 21 bp, Homo sapiens
gtttgcttaaacaaagtgact

SEQ ID NO: 3297813 - DNA, 14 bp, Homo sapiens
gtttgcttattgtt

SEQ ID NO: 3297814 - DNA, 15 bp, Homo sapiens
gtttgcttattgttc

SEQ ID NO: 3297815 - DNA, 15 bp, Homo sapiens
gtttgcttgaatgct

SEQ ID NO: 3297816 - DNA, 19 bp, Homo sapiens
gtttggaaataaactgtgc

SEQ ID NO: 3297817 - DNA, 18 bp, Homo sapiens
gtttggaccccagctggg

SEQ ID NO: 3297818 - DNA, 15 bp, Homo sapiens
gtttggcaatagttt

SEQ ID NO: 3297819 - DNA, 14 bp, Homo sapiens
gtttggcttcctcc

SEQ ID NO: 3297820 - DNA, 15 bp, Homo sapiens
gtttggggagcagag

SEQ ID NO: 3297821 - DNA, 19 bp, Homo sapiens
gtttggggcagaaaggact

SEQ ID NO: 3297822 - DNA, 20 bp, Homo sapiens
gtttgggggacgtttctcat

SEQ ID NO: 3297823 - DNA, 18 bp, Homo sapiens
gtttgggggcgccctctc

SEQ ID NO: 3297824 - DNA, 22 bp, Homo sapiens
gtttgggggcgccctctctgct

SEQ ID NO: 3297825 - DNA, 20 bp, Homo sapiens
gtttgggtaaaatactttta

SEQ ID NO: 3297826 - DNA, 17 bp, Homo sapiens
gtttgggtgattcctaa

SEQ ID NO: 3297827 - DNA, 16 bp, Homo sapiens
gtttggttagaggaag

SEQ ID NO: 3297828 - DNA, 13 bp, Homo sapiens
gtttgtaaaacta

SEQ ID NO: 3297829 - DNA, 17 bp, Homo sapiens
gtttgtaaataagagat

SEQ ID NO: 3297830 - DNA, 18 bp, Homo sapiens
gtttgtaaataagagatt

SEQ ID NO: 3297831 - DNA, 13 bp, Homo sapiens
gtttgtaaatgcc

SEQ ID NO: 3297832 - DNA, 14 bp, Homo sapiens
gtttgtaccattta

SEQ ID NO: 3297833 - DNA, 14 bp, Homo sapiens
gtttgtagccaggt

SEQ ID NO: 3297834 - DNA, 22 bp, Homo sapiens
gtttgtagtgccactgttgttt

SEQ ID NO: 3297835 - DNA, 16 bp, Homo sapiens
gtttgtataacttctt

SEQ ID NO: 3297836 - DNA, 13 bp, Homo sapiens
gtttgtatattgt

SEQ ID NO: 3297837 - DNA, 20 bp, Homo sapiens
gtttgtatgagatggttaaa

SEQ ID NO: 3297838 - DNA, 14 bp, Homo sapiens
gtttgtatttttta

SEQ ID NO: 3297839 - DNA, 15 bp, Homo sapiens
gtttgtctcactttt

SEQ ID NO: 3297840 - DNA, 19 bp, Homo sapiens
gtttgtctcagttggaaat

SEQ ID NO: 3297841 - DNA, 18 bp, Homo sapiens
gtttgtctctccttttct

SEQ ID NO: 3297842 - DNA, 15 bp, Homo sapiens
gtttgtctgtcttca

SEQ ID NO: 3297843 - DNA, 18 bp, Homo sapiens
gtttgtctgtcttcatag

SEQ ID NO: 3297844 - DNA, 14 bp, Homo sapiens
gtttgtgcatcctg

SEQ ID NO: 3297845 - DNA, 16 bp, Homo sapiens
gtttgtggcctcagaa

SEQ ID NO: 3297846 - DNA, 18 bp, Homo sapiens
gtttgtgtgatttcctaa

SEQ ID NO: 3297847 - DNA, 15 bp, Homo sapiens
gtttgtgtgtcttaa

SEQ ID NO: 3297848 - DNA, 20 bp, Homo sapiens
gtttgtgtgttgtctcttga

SEQ ID NO: 3297849 - DNA, 16 bp, Homo sapiens
gtttgttaaaaataaa

SEQ ID NO: 3297850 - DNA, 13 bp, Homo sapiens
gtttgttaaaact

SEQ ID NO: 3297851 - DNA, 14 bp, Homo sapiens
gtttgttaaaactg

SEQ ID NO: 3297852 - DNA, 17 bp, Homo sapiens
gtttgttaaaactggca

SEQ ID NO: 3297853 - DNA, 17 bp, Homo sapiens
gtttgttacataggtat

SEQ ID NO: 3297854 - DNA, 12 bp, Homo sapiens
gtttgttctccg

SEQ ID NO: 3297855 - DNA, 17 bp, Homo sapiens
gtttgttctgttctggg

SEQ ID NO: 3297856 - DNA, 18 bp, Homo sapiens
gtttgtttctccccctgg

SEQ ID NO: 3297857 - DNA, 15 bp, Homo sapiens
gttttaaagtgatta

SEQ ID NO: 3297858 - DNA, 20 bp, Homo sapiens
gttttaaagttcattgcaat

SEQ ID NO: 3297859 - DNA, 20 bp, Homo sapiens
gttttaacaatccattcaca

SEQ ID NO: 3297860 - DNA, 19 bp, Homo sapiens
gttttaactagaatttatt

SEQ ID NO: 3297861 - DNA, 16 bp, Homo sapiens
gttttaactgtggata

SEQ ID NO: 3297862 - DNA, 14 bp, Homo sapiens
gttttaagaggcag

SEQ ID NO: 3297863 - DNA, 16 bp, Homo sapiens
gttttaataaacagta

SEQ ID NO: 3297864 - DNA, 14 bp, Homo sapiens
gttttaatctgaaa

SEQ ID NO: 3297865 - DNA, 20 bp, Homo sapiens
gttttaccaagtgctgtctt

SEQ ID NO: 3297866 - DNA, 14 bp, Homo sapiens
gttttactgtgaaa

SEQ ID NO: 3297867 - DNA, 17 bp, Homo sapiens
gttttactgttttaatt

SEQ ID NO: 3297868 - DNA, 15 bp, Homo sapiens
gttttacttacaaaa

SEQ ID NO: 3297869 - DNA, 16 bp, Homo sapiens
gttttacttacaaaaa

SEQ ID NO: 3297870 - DNA, 23 bp, Homo sapiens
gttttagaagagagcctttttct

SEQ ID NO: 3297871 - DNA, 20 bp, Homo sapiens
gttttagattttctggttct

SEQ ID NO: 3297872 - DNA, 17 bp, Homo sapiens
gttttagcattgtcttg

SEQ ID NO: 3297873 - DNA, 17 bp, Homo sapiens
gttttaggtagaaaaac

SEQ ID NO: 3297874 - DNA, 13 bp, Homo sapiens
gttttaggttcta

SEQ ID NO: 3297875 - DNA, 21 bp, Homo sapiens
gttttaggttctaaagttcta

SEQ ID NO: 3297876 - DNA, 14 bp, Homo sapiens
gttttagttgcaga

SEQ ID NO: 3297877 - DNA, 23 bp, Homo sapiens
gttttatatattatgtgaagaat

SEQ ID NO: 3297878 - DNA, 16 bp, Homo sapiens
gttttattataaattc

SEQ ID NO: 3297879 - DNA, 21 bp, Homo sapiens
gttttattatttctattaaat

SEQ ID NO: 3297880 - DNA, 14 bp, Homo sapiens
gttttattcctgta

SEQ ID NO: 3297881 - DNA, 22 bp, Homo sapiens
gttttcaaccggaaggaggcca

SEQ ID NO: 3297882 - DNA, 18 bp, Homo sapiens
gttttcaagtcaaattaa

SEQ ID NO: 3297883 - DNA, 19 bp, Homo sapiens
gttttcacatacactcaaa

SEQ ID NO: 3297884 - DNA, 12 bp, Homo sapiens
gttttcactctt

SEQ ID NO: 3297885 - DNA, 14 bp, Homo sapiens
gttttcacttgtat

SEQ ID NO: 3297886 - DNA, 21 bp, Homo sapiens
gttttcagaacctcttcccca

SEQ ID NO: 3297887 - DNA, 18 bp, Homo sapiens
gttttcaggacaacactt

SEQ ID NO: 3297888 - DNA, 10 bp, Homo sapiens
gttttcatgg

SEQ ID NO: 3297889 - DNA, 23 bp, Homo sapiens
gttttcatggtgaaaatgtactg

SEQ ID NO: 3297890 - DNA, 22 bp, Homo sapiens
gttttcattatgttcatgtaag

SEQ ID NO: 3297891 - DNA, 17 bp, Homo sapiens
gttttcatttggttcat

SEQ ID NO: 3297892 - DNA, 16 bp, Homo sapiens
gttttccaccctggaa

SEQ ID NO: 3297893 - DNA, 17 bp, Homo sapiens
gttttccatgaaaacgt

SEQ ID NO: 3297894 - DNA, 18 bp, Homo sapiens
gttttccatgaaaacgtt

SEQ ID NO: 3297895 - DNA, 17 bp, Homo sapiens
gttttcctaaatgcagt

SEQ ID NO: 3297896 - DNA, 16 bp, Homo sapiens
gttttcctttctcacc

SEQ ID NO: 3297897 - DNA, 22 bp, Homo sapiens
gttttctaaaggatgctgctgt

SEQ ID NO: 3297898 - DNA, 21 bp, Homo sapiens
gttttctagcaattttctttg

SEQ ID NO: 3297899 - DNA, 20 bp, Homo sapiens
gttttctcagaacagctgaa

SEQ ID NO: 3297900 - DNA, 18 bp, Homo sapiens
gttttctcctcccaggaa

SEQ ID NO: 3297901 - DNA, 17 bp, Homo sapiens
gttttctctcggctccc

SEQ ID NO: 3297902 - DNA, 17 bp, Homo sapiens
gttttctgagcccgggc

SEQ ID NO: 3297903 - DNA, 16 bp, Homo sapiens
gttttctgggtgtcca

SEQ ID NO: 3297904 - DNA, 17 bp, Homo sapiens
gttttctgggtgtccaa

SEQ ID NO: 3297905 - DNA, 14 bp, Homo sapiens
gttttctttagtat

SEQ ID NO: 3297906 - DNA, 21 bp, Homo sapiens
gttttgaaaagctattagcca

SEQ ID NO: 3297907 - DNA, 17 bp, Homo sapiens
gttttgaactaataaaa

SEQ ID NO: 3297908 - DNA, 23 bp, Homo sapiens
gttttgaactaataaaagcataa

SEQ ID NO: 3297909 - DNA, 16 bp, Homo sapiens
gttttgacataagatg

SEQ ID NO: 3297910 - DNA, 21 bp, Homo sapiens
gttttgagctactggattctt

SEQ ID NO: 3297911 - DNA, 16 bp, Homo sapiens
gttttgatatgagtat

SEQ ID NO: 3297912 - DNA, 21 bp, Homo sapiens
gttttgatgtttgtggcctca

SEQ ID NO: 3297913 - DNA, 19 bp, Homo sapiens
gttttgatttgtactgaaa

SEQ ID NO: 3297914 - DNA, 22 bp, Homo sapiens
gttttgatttgtagcactgagg

SEQ ID NO: 3297915 - DNA, 16 bp, Homo sapiens
gttttgcaataacttc

SEQ ID NO: 3297916 - DNA, 19 bp, Homo sapiens
gttttgctattagactgta

SEQ ID NO: 3297917 - DNA, 17 bp, Homo sapiens
gttttggacagtttacc

SEQ ID NO: 3297918 - DNA, 19 bp, Homo sapiens
gttttggatcttgaatgtg

SEQ ID NO: 3297919 - DNA, 20 bp, Homo sapiens
gttttggctgaaattctcct

SEQ ID NO: 3297920 - DNA, 23 bp, Homo sapiens
gttttggctgaaattctcctgga

SEQ ID NO: 3297921 - DNA, 16 bp, Homo sapiens
gttttggggactcatt

SEQ ID NO: 3297922 - DNA, 20 bp, Homo sapiens
gttttgggtgaatcttgagg

SEQ ID NO: 3297923 - DNA, 16 bp, Homo sapiens
gttttgtaagatgctg

SEQ ID NO: 3297924 - DNA, 17 bp, Homo sapiens
gttttgtaagatgctgg

SEQ ID NO: 3297925 - DNA, 19 bp, Homo sapiens
gttttgtataaataataaa

SEQ ID NO: 3297926 - DNA, 12 bp, Homo sapiens
gttttgtataca

SEQ ID NO: 3297927 - DNA, 22 bp, Homo sapiens
gttttgtattttttaaaacact

SEQ ID NO: 3297928 - DNA, 21 bp, Homo sapiens
gttttgtctgtgttgctgttt

SEQ ID NO: 3297929 - DNA, 17 bp, Homo sapiens
gttttgtggtttggaat

SEQ ID NO: 3297930 - DNA, 18 bp, Homo sapiens
taaacaatataagaagga

SEQ ID NO: 3297931 - DNA, 20 bp, Homo sapiens
taaacaatataagaaggaaa

SEQ ID NO: 3297932 - DNA, 21 bp, Homo sapiens
taaacaatataagaaggaaaa

SEQ ID NO: 3297933 - DNA, 22 bp, Homo sapiens
taaacaatgccaagtcactctt

SEQ ID NO: 3297934 - DNA, 20 bp, Homo sapiens
taaacaatgtataaagattg

SEQ ID NO: 3297935 - DNA, 22 bp, Homo sapiens
taaacacacagatacacacaca

SEQ ID NO: 3297936 - DNA, 21 bp, Homo sapiens
taaacacaggggacacagctt

SEQ ID NO: 3297937 - DNA, 18 bp, Homo sapiens
taaacacccttcacatac

SEQ ID NO: 3297938 - DNA, 15 bp, Homo sapiens
taaacactggctctg

SEQ ID NO: 3297939 - DNA, 19 bp, Homo sapiens
taaacacttatcttctgga

SEQ ID NO: 3297940 - DNA, 19 bp, Homo sapiens
taaacagagtccgggagaa

SEQ ID NO: 3297941 - DNA, 19 bp, Homo sapiens
taaacagatgatgagaatt

SEQ ID NO: 3297942 - DNA, 19 bp, Homo sapiens
taaacagatttttacaaat

SEQ ID NO: 3297943 - DNA, 20 bp, Homo sapiens
taaacagatttttacaaatg

SEQ ID NO: 3297944 - DNA, 11 bp, Homo sapiens
taaacagctat

SEQ ID NO: 3297945 - DNA, 13 bp, Homo sapiens
taaacagctattt

SEQ ID NO: 3297946 - DNA, 18 bp, Homo sapiens
taaacagcttcatgcctt

SEQ ID NO: 3297947 - DNA, 23 bp, Homo sapiens
taaacagcttcatgcctttgtaa

SEQ ID NO: 3297948 - DNA, 22 bp, Homo sapiens
taaacaggaattttattttgct

SEQ ID NO: 3297949 - DNA, 18 bp, Homo sapiens
taaacaggagacaggaag

SEQ ID NO: 3297950 - DNA, 23 bp, Homo sapiens
taaacaggcccagcattgctggt

SEQ ID NO: 3297951 - DNA, 16 bp, Homo sapiens
taaacagtatattctt

SEQ ID NO: 3297952 - DNA, 20 bp, Homo sapiens
taaacagtgagcctgaattt

SEQ ID NO: 3297953 - DNA, 22 bp, Homo sapiens
taaacataataaatcacacatt

SEQ ID NO: 3297954 - DNA, 23 bp, Homo sapiens
taaacataataaatcacacattc

SEQ ID NO: 3297955 - DNA, 13 bp, Homo sapiens
taaacataattgt

SEQ ID NO: 3297956 - DNA, 14 bp, Homo sapiens
taaacataattgtg

SEQ ID NO: 3297957 - DNA, 19 bp, Homo sapiens
taaacataattgtggatta

SEQ ID NO: 3297958 - DNA, 15 bp, Homo sapiens
taaacatcagtttct

SEQ ID NO: 3297959 - DNA, 20 bp, Homo sapiens
taaaccaacctttaaaattg

SEQ ID NO: 3297960 - DNA, 16 bp, Homo sapiens
taaaccaactctaata

SEQ ID NO: 3297961 - DNA, 18 bp, Homo sapiens
taaaccagtttagatttc

SEQ ID NO: 3297962 - DNA, 15 bp, Homo sapiens
taaaccattgtaact

SEQ ID NO: 3297963 - DNA, 14 bp, Homo sapiens
taaacccctgtccc

SEQ ID NO: 3297964 - DNA, 19 bp, Homo sapiens
taaaccgtttttaacacat

SEQ ID NO: 3297965 - DNA, 18 bp, Homo sapiens
taaacctgggctcagcct

SEQ ID NO: 3297966 - DNA, 20 bp, Homo sapiens
taaacctgtttttttttcat

SEQ ID NO: 3297967 - DNA, 22 bp, Homo sapiens
taaacctttttcttgatcttaa

SEQ ID NO: 3297968 - DNA, 20 bp, Homo sapiens
taaacggttcagtttcttct

SEQ ID NO: 3297969 - DNA, 15 bp, Homo sapiens
taaacgtggtcacct

SEQ ID NO: 3297970 - DNA, 19 bp, Homo sapiens
taaacgtggtcaccttcga

SEQ ID NO: 3297971 - DNA, 15 bp, Homo sapiens
taaacgtttcagtaa

SEQ ID NO: 3297972 - DNA, 22 bp, Homo sapiens
taaacgtttcagtaataaaaca

SEQ ID NO: 3297973 - DNA, 12 bp, Homo sapiens
taaactaaaaaa

SEQ ID NO: 3297974 - DNA, 20 bp, Homo sapiens
taaactaaaaaaaaaaaggc

SEQ ID NO: 3297975 - DNA, 13 bp, Homo sapiens
taaactaaataat

SEQ ID NO: 3297976 - DNA, 15 bp, Homo sapiens
taaactaaataatga

SEQ ID NO: 3297977 - DNA, 14 bp, Homo sapiens
taaactatattttc

SEQ ID NO: 3297978 - DNA, 14 bp, Homo sapiens
taaactatctgtat

SEQ ID NO: 3297979 - DNA, 17 bp, Homo sapiens
taaactatgataaatta

SEQ ID NO: 3297980 - DNA, 20 bp, Homo sapiens
taaactatgataaattatga

SEQ ID NO: 3297981 - DNA, 19 bp, Homo sapiens
taaactcaaaatatttgta

SEQ ID NO: 3297982 - DNA, 22 bp, Homo sapiens
taaactcaaaatatttgtacat

SEQ ID NO: 3297983 - DNA, 23 bp, Homo sapiens
taaactcaaaatatttgtacata

SEQ ID NO: 3297984 - DNA, 15 bp, Homo sapiens
taaactcaagacaat

SEQ ID NO: 3297985 - DNA, 17 bp, Homo sapiens
taaactgaatattttgg

SEQ ID NO: 3297986 - DNA, 20 bp, Homo sapiens
taaactgaatattttggaaa

SEQ ID NO: 3297987 - DNA, 15 bp, Homo sapiens
taaactgactttatc

SEQ ID NO: 3297988 - DNA, 13 bp, Homo sapiens
taaactgactttt

SEQ ID NO: 3297989 - DNA, 20 bp, Homo sapiens
taaactgtactagtctgtgt

SEQ ID NO: 3297990 - DNA, 22 bp, Homo sapiens
taaactgtatcaaatctgtata

SEQ ID NO: 3297991 - DNA, 12 bp, Homo sapiens
taaactgtatta

SEQ ID NO: 3297992 - DNA, 17 bp, Homo sapiens
taaactgtattaaatct

SEQ ID NO: 3297993 - DNA, 15 bp, Homo sapiens
taaactgtgtacata

SEQ ID NO: 3297994 - DNA, 18 bp, Homo sapiens
taaactgtgtacataact

SEQ ID NO: 3297995 - DNA, 17 bp, Homo sapiens
taaactgtgtattccaa

SEQ ID NO: 3297996 - DNA, 12 bp, Homo sapiens
taaactgtgttt

SEQ ID NO: 3297997 - DNA, 17 bp, Homo sapiens
taaactgttagcactgt

SEQ ID NO: 3297998 - DNA, 19 bp, Homo sapiens
taaactgttagcactgttg

SEQ ID NO: 3297999 - DNA, 20 bp, Homo sapiens
taaactgttagcactgttga

SEQ ID NO: 3298000 - DNA, 17 bp, Homo sapiens
taaactgtttatataaa

SEQ ID NO: 3298001 - DNA, 20 bp, Homo sapiens
taaacttaactttaactgaa

SEQ ID NO: 3298002 - DNA, 17 bp, Homo sapiens
taaacttagaggaaaat

SEQ ID NO: 3298003 - DNA, 18 bp, Homo sapiens
taaacttagaggaaaatg

SEQ ID NO: 3298004 - DNA, 15 bp, Homo sapiens
taaacttataaatca

SEQ ID NO: 3298005 - DNA, 15 bp, Homo sapiens
taaacttccaaagaa

SEQ ID NO: 3298006 - DNA, 20 bp, Homo sapiens
taaacttctgaagactgaga

SEQ ID NO: 3298007 - DNA, 23 bp, Homo sapiens
taaacttctgaagactgagaact

SEQ ID NO: 3298008 - DNA, 22 bp, Homo sapiens
taaacttctgcaacaagcatgc

SEQ ID NO: 3298009 - DNA, 22 bp, Homo sapiens
taaacttcttttctcttctaca

SEQ ID NO: 3298010 - DNA, 16 bp, Homo sapiens
taaacttgaagcagtc

SEQ ID NO: 3298011 - DNA, 11 bp, Homo sapiens
taaactttatt

SEQ ID NO: 3298012 - DNA, 22 bp, Homo sapiens
taaactttatttgtaaaccatt

SEQ ID NO: 3298013 - DNA, 17 bp, Homo sapiens
taaactttttgttctgg

SEQ ID NO: 3298014 - DNA, 14 bp, Homo sapiens
taaactttttttca

SEQ ID NO: 3298015 - DNA, 20 bp, Homo sapiens
taaactttttttctgtacca

SEQ ID NO: 3298016 - DNA, 17 bp, Homo sapiens
taaagaaagtcgaatta

SEQ ID NO: 3298017 - DNA, 14 bp, Homo sapiens
taaagaaagtgtat

SEQ ID NO: 3298018 - DNA, 15 bp, Homo sapiens
taaagaaagtgtatt

SEQ ID NO: 3298019 - DNA, 17 bp, Homo sapiens
taaagaaagtgtatttg

SEQ ID NO: 3298020 - DNA, 17 bp, Homo sapiens
taaagaaattgcaataa

SEQ ID NO: 3298021 - DNA, 19 bp, Homo sapiens
taaagaaatttactatata

SEQ ID NO: 3298022 - DNA, 19 bp, Homo sapiens
taaagaacaccctatattt

SEQ ID NO: 3298023 - DNA, 17 bp, Homo sapiens
taaagaactccttattt

SEQ ID NO: 3298024 - DNA, 19 bp, Homo sapiens
taaagaactccttattttg

SEQ ID NO: 3298025 - DNA, 23 bp, Homo sapiens
taaagaactccttattttgtatt

SEQ ID NO: 3298026 - DNA, 14 bp, Homo sapiens
taaagaacttaaat

SEQ ID NO: 3298027 - DNA, 12 bp, Homo sapiens
taaagaaggggg

SEQ ID NO: 3298028 - DNA, 17 bp, Homo sapiens
taaagaagttgaagttt

SEQ ID NO: 3298029 - DNA, 14 bp, Homo sapiens
taaagaatatatat

SEQ ID NO: 3298030 - DNA, 10 bp, Homo sapiens
taaagacaag

SEQ ID NO: 3298031 - DNA, 19 bp, Homo sapiens
taaagacccagggggagaa

SEQ ID NO: 3298032 - DNA, 21 bp, Homo sapiens
taaagacccagggggagaatg

SEQ ID NO: 3298033 - DNA, 23 bp, Homo sapiens
taaagaccctcctattctataaa

SEQ ID NO: 3298034 - DNA, 13 bp, Homo sapiens
taaagagaaaatg

SEQ ID NO: 3298035 - DNA, 12 bp, Homo sapiens
taaagagaatga

SEQ ID NO: 3298036 - DNA, 22 bp, Homo sapiens
taaagagacctacctcaggttg

SEQ ID NO: 3298037 - DNA, 18 bp, Homo sapiens
taaagagattcacacaca

SEQ ID NO: 3298038 - DNA, 17 bp, Homo sapiens
taaagaggctgaaagag

SEQ ID NO: 3298039 - DNA, 13 bp, Homo sapiens
taaagagtctaga

SEQ ID NO: 3298040 - DNA, 15 bp, Homo sapiens
taaagagtctagatt

SEQ ID NO: 3298041 - DNA, 12 bp, Homo sapiens
taaagagttctt

SEQ ID NO: 3298042 - DNA, 21 bp, Homo sapiens
taaagataacccttattccat

SEQ ID NO: 3298043 - DNA, 15 bp, Homo sapiens
taaagataatattac

SEQ ID NO: 3298044 - DNA, 19 bp, Homo sapiens
taaagataatattactgtt

SEQ ID NO: 3298045 - DNA, 14 bp, Homo sapiens
taaagataattgct

SEQ ID NO: 3298046 - DNA, 17 bp, Homo sapiens
taaagataattgctatt

SEQ ID NO: 3298047 - DNA, 24 bp, Homo sapiens
taaagatatggagaattgctgaag

SEQ ID NO: 3298048 - DNA, 21 bp, Homo sapiens
taaagatatttttatctttat

SEQ ID NO: 3298049 - DNA, 11 bp, Homo sapiens
taaagatgatc

SEQ ID NO: 3298050 - DNA, 21 bp, Homo sapiens
taaagatggagtttctaaggt

SEQ ID NO: 3298051 - DNA, 17 bp, Homo sapiens
taaagatggtcgtgtgt

SEQ ID NO: 3298052 - DNA, 24 bp, Homo sapiens
taaagattctatagttctagacat

SEQ ID NO: 3298053 - DNA, 20 bp, Homo sapiens
taaagattctctttaaaaaa

SEQ ID NO: 3298054 - DNA, 13 bp, Homo sapiens
taaagatttgggt

SEQ ID NO: 3298055 - DNA, 15 bp, Homo sapiens
taactagaatttatt

SEQ ID NO: 3298056 - DNA, 17 bp, Homo sapiens
taactagacaccaaagt

SEQ ID NO: 3298057 - DNA, 18 bp, Homo sapiens
taactagacaccaaagtt

SEQ ID NO: 3298058 - DNA, 21 bp, Homo sapiens
taactagacaccaaagttcta

SEQ ID NO: 3298059 - DNA, 18 bp, Homo sapiens
taactatatttgcttttt

SEQ ID NO: 3298060 - DNA, 14 bp, Homo sapiens
taactatgacagat

SEQ ID NO: 3298061 - DNA, 23 bp, Homo sapiens
taactatgacagatatatttaag

SEQ ID NO: 3298062 - DNA, 14 bp, Homo sapiens
taactattaacctt

SEQ ID NO: 3298063 - DNA, 16 bp, Homo sapiens
taactcaccagcccca

SEQ ID NO: 3298064 - DNA, 15 bp, Homo sapiens
taactcatcataaaa

SEQ ID NO: 3298065 - DNA, 16 bp, Homo sapiens
taactcatcataaaat

SEQ ID NO: 3298066 - DNA, 17 bp, Homo sapiens
taactcatcataaaata

SEQ ID NO: 3298067 - DNA, 12 bp, Homo sapiens
taactcatttgt

SEQ ID NO: 3298068 - DNA, 16 bp, Homo sapiens
taactccactggctcc

SEQ ID NO: 3298069 - DNA, 16 bp, Homo sapiens
taactcccctgtttca

SEQ ID NO: 3298070 - DNA, 19 bp, Homo sapiens
taactcccctgtttcaatc

SEQ ID NO: 3298071 - DNA, 19 bp, Homo sapiens
taactcctgagaaatgtta

SEQ ID NO: 3298072 - DNA, 13 bp, Homo sapiens
taactgaaaatgt

SEQ ID NO: 3298073 - DNA, 17 bp, Homo sapiens
taactgaaaatgtaaat

SEQ ID NO: 3298074 - DNA, 18 bp, Homo sapiens
taactgaaaatgtaaatt

SEQ ID NO: 3298075 - DNA, 20 bp, Homo sapiens
taactgaaaatgtgctatac

SEQ ID NO: 3298076 - DNA, 13 bp, Homo sapiens
taactgaatttgg

SEQ ID NO: 3298077 - DNA, 19 bp, Homo sapiens
taactgattacctgccaat

SEQ ID NO: 3298078 - DNA, 12 bp, Homo sapiens
taactgatttct

SEQ ID NO: 3298079 - DNA, 16 bp, Homo sapiens
taactgatttctatgg

SEQ ID NO: 3298080 - DNA, 17 bp, Homo sapiens
taactgatttctatggc

SEQ ID NO: 3298081 - DNA, 23 bp, Homo sapiens
taactgcaaccttgtttattaaa

SEQ ID NO: 3298082 - DNA, 20 bp, Homo sapiens
taactgcagttgactttctc

SEQ ID NO: 3298083 - DNA, 20 bp, Homo sapiens
taactgctttctgttccaaa

SEQ ID NO: 3298084 - DNA, 13 bp, Homo sapiens
taactggtataga

SEQ ID NO: 3298085 - DNA, 19 bp, Homo sapiens
taactgtagctcaagttta

SEQ ID NO: 3298086 - DNA, 21 bp, Homo sapiens
taactgtagctcaagtttaaa

SEQ ID NO: 3298087 - DNA, 21 bp, Homo sapiens
taactgtgcgttaaataagca

SEQ ID NO: 3298088 - DNA, 16 bp, Homo sapiens
taactgtgctgaatgc

SEQ ID NO: 3298089 - DNA, 17 bp, Homo sapiens
taactgtgctgaatgct

SEQ ID NO: 3298090 - DNA, 13 bp, Homo sapiens
taactgtgtatgt

SEQ ID NO: 3298091 - DNA, 22 bp, Homo sapiens
taactgtgtatgtacatatata

SEQ ID NO: 3298092 - DNA, 19 bp, Homo sapiens
taacttaaaaatgtaaata

SEQ ID NO: 3298093 - DNA, 20 bp, Homo sapiens
taacttaaaaatgtaaatat

SEQ ID NO: 3298094 - DNA, 16 bp, Homo sapiens
taacttaaaatatttt

SEQ ID NO: 3298095 - DNA, 16 bp, Homo sapiens
taacttactgtatatg

SEQ ID NO: 3298096 - DNA, 15 bp, Homo sapiens
taacttagcatgtgt

SEQ ID NO: 3298097 - DNA, 17 bp, Homo sapiens
taacttagtattttacc

SEQ ID NO: 3298098 - DNA, 22 bp, Homo sapiens
taacttatctagaaagaaaaga

SEQ ID NO: 3298099 - DNA, 19 bp, Homo sapiens
taacttatgtacaaggatg

SEQ ID NO: 3298100 - DNA, 15 bp, Homo sapiens
taacttatgtagata

SEQ ID NO: 3298101 - DNA, 22 bp, Homo sapiens
taacttatgtagatatttggct

SEQ ID NO: 3298102 - DNA, 14 bp, Homo sapiens
taacttattagcag

SEQ ID NO: 3298103 - DNA, 14 bp, Homo sapiens
taacttcctgtact

SEQ ID NO: 3298104 - DNA, 23 bp, Homo sapiens
taacttctatattttaatagaaa

SEQ ID NO: 3298105 - DNA, 23 bp, Homo sapiens
taacttcttatggaattgatttg

SEQ ID NO: 3298106 - DNA, 13 bp, Homo sapiens
taacttgatgcat

SEQ ID NO: 3298107 - DNA, 23 bp, Homo sapiens
taacttgatggcttaaaaatact

SEQ ID NO: 3298108 - DNA, 17 bp, Homo sapiens
taacttggtcagagcca

SEQ ID NO: 3298109 - DNA, 21 bp, Homo sapiens
taacttggtcagagccactct

SEQ ID NO: 3298110 - DNA, 14 bp, Homo sapiens
taactttacagaaa

SEQ ID NO: 3298111 - DNA, 22 bp, Homo sapiens
taactttagaagtgcatttctg

SEQ ID NO: 3298112 - DNA, 17 bp, Homo sapiens
taactttatcacattat

SEQ ID NO: 3298113 - DNA, 15 bp, Homo sapiens
taactttatgtgtaa

SEQ ID NO: 3298114 - DNA, 16 bp, Homo sapiens
taactttatgtgtaaa

SEQ ID NO: 3298115 - DNA, 18 bp, Homo sapiens
taactttatgtgtaaata

SEQ ID NO: 3298116 - DNA, 13 bp, Homo sapiens
taactttcagaag

SEQ ID NO: 3298117 - DNA, 21 bp, Homo sapiens
taacttttaatccctatgttt

SEQ ID NO: 3298118 - DNA, 13 bp, Homo sapiens
taacttttctacc

SEQ ID NO: 3298119 - DNA, 19 bp, Homo sapiens
taacttttctaccatttct

SEQ ID NO: 3298120 - DNA, 16 bp, Homo sapiens
taacttttgtgaatta

SEQ ID NO: 3298121 - DNA, 22 bp, Homo sapiens
taacttttgtgaattaggctgt

SEQ ID NO: 3298122 - DNA, 15 bp, Homo sapiens
taactttttatttct

SEQ ID NO: 3298123 - DNA, 19 bp, Homo sapiens
taacttttttgagtcattg

SEQ ID NO: 3298124 - DNA, 16 bp, Homo sapiens
taacttttttgtgtat

SEQ ID NO: 3298125 - DNA, 17 bp, Homo sapiens
taacttttttgtgtatg

SEQ ID NO: 3298126 - DNA, 19 bp, Homo sapiens
taacttttttgtgtatgta

SEQ ID NO: 3298127 - DNA, 20 bp, Homo sapiens
taacttttttgtgtatgtac

SEQ ID NO: 3298128 - DNA, 18 bp, Homo sapiens
taagaaaacaaactaaat

SEQ ID NO: 3298129 - DNA, 12 bp, Homo sapiens
taagaaaagatt

SEQ ID NO: 3298130 - DNA, 15 bp, Homo sapiens
taagaaaagcacttt

SEQ ID NO: 3298131 - DNA, 20 bp, Homo sapiens
taagaaaagcacttttgtta

SEQ ID NO: 3298132 - DNA, 18 bp, Homo sapiens
taagaaaatacaataaac

SEQ ID NO: 3298133 - DNA, 23 bp, Homo sapiens
taagaaacacagggttttgtatt

SEQ ID NO: 3298134 - DNA, 15 bp, Homo sapiens
taagaaacttttgta

SEQ ID NO: 3298135 - DNA, 18 bp, Homo sapiens
taagaaacttttgtaaag

SEQ ID NO: 3298136 - DNA, 15 bp, Homo sapiens
taagaaagtgaagca

SEQ ID NO: 3298137 - DNA, 18 bp, Homo sapiens
taagaaagtgaagcaaat

SEQ ID NO: 3298138 - DNA, 22 bp, Homo sapiens
taagaaagtgaagcaaatcaga

SEQ ID NO: 3298139 - DNA, 13 bp, Homo sapiens
taagaaatactag

SEQ ID NO: 3298140 - DNA, 19 bp, Homo sapiens
taagaaatcaaagagagaa

SEQ ID NO: 3298141 - DNA, 14 bp, Homo sapiens
taagaaatcaagta

SEQ ID NO: 3298142 - DNA, 15 bp, Homo sapiens
taagaaatcaagtaa

SEQ ID NO: 3298143 - DNA, 16 bp, Homo sapiens
taagaacaactacctg

SEQ ID NO: 3298144 - DNA, 17 bp, Homo sapiens
taagaaccttaatgaca

SEQ ID NO: 3298145 - DNA, 22 bp, Homo sapiens
taagaactgcttcatgtgaaca

SEQ ID NO: 3298146 - DNA, 14 bp, Homo sapiens
taagaagaaagcaa

SEQ ID NO: 3298147 - DNA, 22 bp, Homo sapiens
taagaagaagttcatgtccaaa

SEQ ID NO: 3298148 - DNA, 14 bp, Homo sapiens
taagaagagactgg

SEQ ID NO: 3298149 - DNA, 19 bp, Homo sapiens
taagaagccccttattttt

SEQ ID NO: 3298150 - DNA, 15 bp, Homo sapiens
taagaagctgttgta

SEQ ID NO: 3298151 - DNA, 19 bp, Homo sapiens
taagaagctgttgtacatt

SEQ ID NO: 3298152 - DNA, 19 bp, Homo sapiens
taagaagcttctaataaat

SEQ ID NO: 3298153 - DNA, 17 bp, Homo sapiens
taagaaggcaaaaatgt

SEQ ID NO: 3298154 - DNA, 18 bp, Homo sapiens
taagaaggcaaaaatgta

SEQ ID NO: 3298155 - DNA, 15 bp, Homo sapiens
taagaagttttaaaa

SEQ ID NO: 3298156 - DNA, 21 bp, Homo sapiens
taagaagttttaaaaagccag

SEQ ID NO: 3298157 - DNA, 17 bp, Homo sapiens
taagaataataaaatca

SEQ ID NO: 3298158 - DNA, 18 bp, Homo sapiens
taagaataccacatcaaa

SEQ ID NO: 3298159 - DNA, 19 bp, Homo sapiens
taagaatagttctaaaatt

SEQ ID NO: 3298160 - DNA, 22 bp, Homo sapiens
taagaatgctggttttcctaaa

SEQ ID NO: 3298161 - DNA, 22 bp, Homo sapiens
taagaattgaccatctgctttt

SEQ ID NO: 3298162 - DNA, 16 bp, Homo sapiens
taagaatttagggaga

SEQ ID NO: 3298163 - DNA, 20 bp, Homo sapiens
taagacaatagtatttctcc

SEQ ID NO: 3298164 - DNA, 23 bp, Homo sapiens
taagacacaaatgcatgaacaag

SEQ ID NO: 3298165 - DNA, 20 bp, Homo sapiens
taagacactgaaaaatctaa

SEQ ID NO: 3298166 - DNA, 19 bp, Homo sapiens
taagacagtcccatcaaaa

SEQ ID NO: 3298167 - DNA, 21 bp, Homo sapiens
taagacagtgtacaaaactgt

SEQ ID NO: 3298168 - DNA, 16 bp, Homo sapiens
taagacataacgtttt

SEQ ID NO: 3298169 - DNA, 22 bp, Homo sapiens
taagacataacgtttttccttt

SEQ ID NO: 3298170 - DNA, 16 bp, Homo sapiens
taagacatatctctaa

SEQ ID NO: 3298171 - DNA, 17 bp, Homo sapiens
taagacatgatttcctt

SEQ ID NO: 3298172 - DNA, 19 bp, Homo sapiens
taagacatgatttccttga

SEQ ID NO: 3298173 - DNA, 21 bp, Homo sapiens
taagacatgatttccttgaat

SEQ ID NO: 3298174 - DNA, 21 bp, Homo sapiens
taagacatgcactatgaggaa

SEQ ID NO: 3298175 - DNA, 20 bp, Homo sapiens
taagacatgtgaggaggaaa

SEQ ID NO: 3298176 - DNA, 13 bp, Homo sapiens
taagacatttgta

SEQ ID NO: 3298177 - DNA, 14 bp, Homo sapiens
taagaccagcctgg

SEQ ID NO: 3298178 - DNA, 23 bp, Homo sapiens
taagaccgtgtcccaaggagctg

SEQ ID NO: 3298179 - DNA, 19 bp, Homo sapiens
taagacctactgttctaaa

SEQ ID NO: 3298180 - DNA, 12 bp, Homo sapiens
taatgatactga

SEQ ID NO: 3298181 - DNA, 18 bp, Homo sapiens
taatgatactgattatga

SEQ ID NO: 3298182 - DNA, 22 bp, Homo sapiens
taatgatcaacaatttaatgta

SEQ ID NO: 3298183 - DNA, 18 bp, Homo sapiens
taatgatcgaaaaaataa

SEQ ID NO: 3298184 - DNA, 19 bp, Homo sapiens
taatgatcgaaaaaataat

SEQ ID NO: 3298185 - DNA, 13 bp, Homo sapiens
taatgatggcaga

SEQ ID NO: 3298186 - DNA, 16 bp, Homo sapiens
taatgatttgctcttt

SEQ ID NO: 3298187 - DNA, 22 bp, Homo sapiens
taatgcattaaacctgtctcca

SEQ ID NO: 3298188 - DNA, 19 bp, Homo sapiens
taatgcattcttctctgtt

SEQ ID NO: 3298189 - DNA, 15 bp, Homo sapiens
taatgcctgcttttt

SEQ ID NO: 3298190 - DNA, 20 bp, Homo sapiens
taatgcctgctttttggaaa

SEQ ID NO: 3298191 - DNA, 19 bp, Homo sapiens
taatgctctatgtttgtat

SEQ ID NO: 3298192 - DNA, 22 bp, Homo sapiens
taatgctctatgtttgtatttg

SEQ ID NO: 3298193 - DNA, 16 bp, Homo sapiens
taatgctgcacttcct

SEQ ID NO: 3298194 - DNA, 19 bp, Homo sapiens
taatgcttagagaatgttc

SEQ ID NO: 3298195 - DNA, 20 bp, Homo sapiens
taatgcttagagaatgttct

SEQ ID NO: 3298196 - DNA, 16 bp, Homo sapiens
taatgcttcaagtgtt

SEQ ID NO: 3298197 - DNA, 16 bp, Homo sapiens
taatgcttggaatggc

SEQ ID NO: 3298198 - DNA, 19 bp, Homo sapiens
taatgcttgtttatgatat

SEQ ID NO: 3298199 - DNA, 17 bp, Homo sapiens
taatgctttcacaacat

SEQ ID NO: 3298200 - DNA, 13 bp, Homo sapiens
taatgctttggaa

SEQ ID NO: 3298201 - DNA, 16 bp, Homo sapiens
taatgctttgttaaat

SEQ ID NO: 3298202 - DNA, 14 bp, Homo sapiens
taatgcttttatat

SEQ ID NO: 3298203 - DNA, 11 bp, Homo sapiens
taatggaaaca

SEQ ID NO: 3298204 - DNA, 13 bp, Homo sapiens
taatggaagagaa

SEQ ID NO: 3298205 - DNA, 17 bp, Homo sapiens
taatggaagagaaatct

SEQ ID NO: 3298206 - DNA, 19 bp, Homo sapiens
taatggacatgagataatg

SEQ ID NO: 3298207 - DNA, 17 bp, Homo sapiens
taatggcagctagtgcc

SEQ ID NO: 3298208 - DNA, 19 bp, Homo sapiens
taatggcagctagtgcctt

SEQ ID NO: 3298209 - DNA, 20 bp, Homo sapiens
taatggcagctagtgccttt

SEQ ID NO: 3298210 - DNA, 21 bp, Homo sapiens
taatggccatggtaccccctt

SEQ ID NO: 3298211 - DNA, 18 bp, Homo sapiens
taatggctagtactgtat

SEQ ID NO: 3298212 - DNA, 17 bp, Homo sapiens
taatgggggtagcagct

SEQ ID NO: 3298213 - DNA, 19 bp, Homo sapiens
taatggtactgactttgct

SEQ ID NO: 3298214 - DNA, 18 bp, Homo sapiens
taatggtatcctactgag

SEQ ID NO: 3298215 - DNA, 15 bp, Homo sapiens
taatggtcccatcca

SEQ ID NO: 3298216 - DNA, 20 bp, Homo sapiens
taatggtcccatccaggcag

SEQ ID NO: 3298217 - DNA, 21 bp, Homo sapiens
taatggtcccatccaggcagt

SEQ ID NO: 3298218 - DNA, 17 bp, Homo sapiens
taatggtctaaaaataa

SEQ ID NO: 3298219 - DNA, 13 bp, Homo sapiens
taatggtgaacat

SEQ ID NO: 3298220 - DNA, 16 bp, Homo sapiens
taatggtgaacatttt

SEQ ID NO: 3298221 - DNA, 19 bp, Homo sapiens
taatggtgtagaacactaa

SEQ ID NO: 3298222 - DNA, 17 bp, Homo sapiens
taatgtaaaatgttgaa

SEQ ID NO: 3298223 - DNA, 11 bp, Homo sapiens
taatgtaaact

SEQ ID NO: 3298224 - DNA, 19 bp, Homo sapiens
taatgtaaactttgtcatg

SEQ ID NO: 3298225 - DNA, 19 bp, Homo sapiens
taatgtaaagaacttaaat

SEQ ID NO: 3298226 - DNA, 22 bp, Homo sapiens
taatgtaagaaaatttgaagta

SEQ ID NO: 3298227 - DNA, 17 bp, Homo sapiens
taatgtaataactgtga

SEQ ID NO: 3298228 - DNA, 18 bp, Homo sapiens
taatgtaataactgtgaa

SEQ ID NO: 3298229 - DNA, 16 bp, Homo sapiens
taatgtacaagttttg

SEQ ID NO: 3298230 - DNA, 19 bp, Homo sapiens
taatgtacaagttttgtat

SEQ ID NO: 3298231 - DNA, 20 bp, Homo sapiens
taatgtagcgtgtttacatg

SEQ ID NO: 3298232 - DNA, 14 bp, Homo sapiens
taatgtaggactgt

SEQ ID NO: 3298233 - DNA, 16 bp, Homo sapiens
taatgtaggactgtat

SEQ ID NO: 3298234 - DNA, 14 bp, Homo sapiens
taatgtatataaaa

SEQ ID NO: 3298235 - DNA, 16 bp, Homo sapiens
taatgtatataaaaat

SEQ ID NO: 3298236 - DNA, 15 bp, Homo sapiens
taatgtatgtacagc

SEQ ID NO: 3298237 - DNA, 20 bp, Homo sapiens
taatgtatttgttcatgttt

SEQ ID NO: 3298238 - DNA, 16 bp, Homo sapiens
taatgtcacaggcagg

SEQ ID NO: 3298239 - DNA, 15 bp, Homo sapiens
taatgtctcactgtt

SEQ ID NO: 3298240 - DNA, 16 bp, Homo sapiens
taatgtctcactgttc

SEQ ID NO: 3298241 - DNA, 17 bp, Homo sapiens
taatgtctcactgttct

SEQ ID NO: 3298242 - DNA, 22 bp, Homo sapiens
taatgtctcactgttctgcaaa

SEQ ID NO: 3298243 - DNA, 16 bp, Homo sapiens
taatgtctcctttgct

SEQ ID NO: 3298244 - DNA, 19 bp, Homo sapiens
taatgtcttcatttcattg

SEQ ID NO: 3298245 - DNA, 14 bp, Homo sapiens
taatgtgaaaagta

SEQ ID NO: 3298246 - DNA, 18 bp, Homo sapiens
taatgtgaacttgtagct

SEQ ID NO: 3298247 - DNA, 15 bp, Homo sapiens
taatgtgaagacatt

SEQ ID NO: 3298248 - DNA, 16 bp, Homo sapiens
taatgtgaaggcccaa

SEQ ID NO: 3298249 - DNA, 17 bp, Homo sapiens
taatgtggaagaaaatg

SEQ ID NO: 3298250 - DNA, 18 bp, Homo sapiens
taatgtgtatttactgta

SEQ ID NO: 3298251 - DNA, 21 bp, Homo sapiens
taatgtgtatttactgtacta

SEQ ID NO: 3298252 - DNA, 13 bp, Homo sapiens
taatgtgtgaaaa

SEQ ID NO: 3298253 - DNA, 17 bp, Homo sapiens
taatgtgtgtatgtgta

SEQ ID NO: 3298254 - DNA, 19 bp, Homo sapiens
taatgtgtgtatgtgtatt

SEQ ID NO: 3298255 - DNA, 17 bp, Homo sapiens
taatgttaaatttgtaa

SEQ ID NO: 3298256 - DNA, 18 bp, Homo sapiens
taatgttaaatttgtaag

SEQ ID NO: 3298257 - DNA, 22 bp, Homo sapiens
taatgttaaatttgtaagtttc

SEQ ID NO: 3298258 - DNA, 12 bp, Homo sapiens
taatgttactga

SEQ ID NO: 3298259 - DNA, 18 bp, Homo sapiens
taatgttgttatttaaag

SEQ ID NO: 3298260 - DNA, 12 bp, Homo sapiens
taatgtttaaat

SEQ ID NO: 3298261 - DNA, 15 bp, Homo sapiens
taatgtttaaatcat

SEQ ID NO: 3298262 - DNA, 19 bp, Homo sapiens
taatgtttaaatcatgtat

SEQ ID NO: 3298263 - DNA, 22 bp, Homo sapiens
taatgtttctggatttcatact

SEQ ID NO: 3298264 - DNA, 19 bp, Homo sapiens
taatgtttcttaaatggaa

SEQ ID NO: 3298265 - DNA, 14 bp, Homo sapiens
taatgttttcaaaa

SEQ ID NO: 3298266 - DNA, 15 bp, Homo sapiens
taatgttttcattat

SEQ ID NO: 3298267 - DNA, 16 bp, Homo sapiens
taatgttttgtacaat

SEQ ID NO: 3298268 - DNA, 17 bp, Homo sapiens
taatgttttgtacaatt

SEQ ID NO: 3298269 - DNA, 13 bp, Homo sapiens
taatgttttgtat

SEQ ID NO: 3298270 - DNA, 21 bp, Homo sapiens
taatgttttttgccacagctt

SEQ ID NO: 3298271 - DNA, 22 bp, Homo sapiens
taattaaaaaccactgaacatt

SEQ ID NO: 3298272 - DNA, 22 bp, Homo sapiens
taattaaataaatcattaatac

SEQ ID NO: 3298273 - DNA, 14 bp, Homo sapiens
taattaaataaatg

SEQ ID NO: 3298274 - DNA, 16 bp, Homo sapiens
taattaaatctcaaat

SEQ ID NO: 3298275 - DNA, 14 bp, Homo sapiens
taattaaattatgg

SEQ ID NO: 3298276 - DNA, 14 bp, Homo sapiens
taattaaatttaac

SEQ ID NO: 3298277 - DNA, 19 bp, Homo sapiens
taattaaccttactaatta

SEQ ID NO: 3298278 - DNA, 18 bp, Homo sapiens
taattaagtatctgggat

SEQ ID NO: 3298279 - DNA, 22 bp, Homo sapiens
taattaatatattaaaattcca

SEQ ID NO: 3298280 - DNA, 22 bp, Homo sapiens
taattaatttgattaacaaata

SEQ ID NO: 3298281 - DNA, 19 bp, Homo sapiens
taattacaggagggaacat

SEQ ID NO: 3298282 - DNA, 23 bp, Homo sapiens
taattacaggagggaacatttcc

SEQ ID NO: 3298283 - DNA, 21 bp, Homo sapiens
taattaccaacctgttaccta

SEQ ID NO: 3298284 - DNA, 18 bp, Homo sapiens
taattaccttattggata

SEQ ID NO: 3298285 - DNA, 19 bp, Homo sapiens
taattactgttttcttttt

SEQ ID NO: 3298286 - DNA, 22 bp, Homo sapiens
taattactgttttcttttttct

SEQ ID NO: 3298287 - DNA, 13 bp, Homo sapiens
taattagctctgg

SEQ ID NO: 3298288 - DNA, 13 bp, Homo sapiens
taattagctgtgc

SEQ ID NO: 3298289 - DNA, 17 bp, Homo sapiens
taattaggggttgctaa

SEQ ID NO: 3298290 - DNA, 15 bp, Homo sapiens
taattagggtacatt

SEQ ID NO: 3298291 - DNA, 16 bp, Homo sapiens
taattaggttaacatt

SEQ ID NO: 3298292 - DNA, 19 bp, Homo sapiens
taattagtgccacttaatg

SEQ ID NO: 3298293 - DNA, 21 bp, Homo sapiens
taattataaacccacattctt

SEQ ID NO: 3298294 - DNA, 17 bp, Homo sapiens
taattatcggaagcagt

SEQ ID NO: 3298295 - DNA, 18 bp, Homo sapiens
taattatcgggaacagtg

SEQ ID NO: 3298296 - DNA, 20 bp, Homo sapiens
taattatcgggaacagtgtt

SEQ ID NO: 3298297 - DNA, 21 bp, Homo sapiens
taattatcgggaacagtgttt

SEQ ID NO: 3298298 - DNA, 23 bp, Homo sapiens
taattatcgggaacagtgtttcc

SEQ ID NO: 3298299 - DNA, 19 bp, Homo sapiens
taattatctcctaattgta

SEQ ID NO: 3298300 - DNA, 21 bp, Homo sapiens
taattatgacagttatactgt

SEQ ID NO: 3298301 - DNA, 19 bp, Homo sapiens
taattattaactacattta

SEQ ID NO: 3298302 - DNA, 15 bp, Homo sapiens
taattattataaaaa

SEQ ID NO: 3298303 - DNA, 14 bp, Homo sapiens
taattattatttat

SEQ ID NO: 3298304 - DNA, 17 bp, Homo sapiens
taattattatttgtgtt

SEQ ID NO: 3298305 - DNA, 14 bp, Homo sapiens
taattattttaaaa

SEQ ID NO: 3298306 - DNA, 19 bp, Homo sapiens
tacagactgttttactgtt

SEQ ID NO: 3298307 - DNA, 18 bp, Homo sapiens
tacagagccaaaatgcca

SEQ ID NO: 3298308 - DNA, 18 bp, Homo sapiens
tacagaggccatgggcct

SEQ ID NO: 3298309 - DNA, 19 bp, Homo sapiens
tacagagtgtggactctgg

SEQ ID NO: 3298310 - DNA, 15 bp, Homo sapiens
tacagataacattag

SEQ ID NO: 3298311 - DNA, 15 bp, Homo sapiens
tacagataattcatt

SEQ ID NO: 3298312 - DNA, 20 bp, Homo sapiens
tacagataattcatttgtat

SEQ ID NO: 3298313 - DNA, 22 bp, Homo sapiens
tacagataattcatttgtattg

SEQ ID NO: 3298314 - DNA, 18 bp, Homo sapiens
tacagatcaggcagtgtt

SEQ ID NO: 3298315 - DNA, 20 bp, Homo sapiens
tacagatcaggcagtgttta

SEQ ID NO: 3298316 - DNA, 18 bp, Homo sapiens
tacagatcctttttccat

SEQ ID NO: 3298317 - DNA, 20 bp, Homo sapiens
tacagatcctttttccatca

SEQ ID NO: 3298318 - DNA, 12 bp, Homo sapiens
tacagatgaaaa

SEQ ID NO: 3298319 - DNA, 13 bp, Homo sapiens
tacagatgtgaaa

SEQ ID NO: 3298320 - DNA, 13 bp, Homo sapiens
tacagatttaata

SEQ ID NO: 3298321 - DNA, 14 bp, Homo sapiens
tacagcactactct

SEQ ID NO: 3298322 - DNA, 17 bp, Homo sapiens
tacagcactactctgtg

SEQ ID NO: 3298323 - DNA, 13 bp, Homo sapiens
tacagcactttga

SEQ ID NO: 3298324 - DNA, 16 bp, Homo sapiens
tacagcattgtctttg

SEQ ID NO: 3298325 - DNA, 23 bp, Homo sapiens
tacagcattgtctttgctgtact

SEQ ID NO: 3298326 - DNA, 18 bp, Homo sapiens
tacagctcccttccctgc

SEQ ID NO: 3298327 - DNA, 20 bp, Homo sapiens
tacagctctggccacaacag

SEQ ID NO: 3298328 - DNA, 12 bp, Homo sapiens
tacagctgtgtt

SEQ ID NO: 3298329 - DNA, 15 bp, Homo sapiens
tacagcttcaccctg

SEQ ID NO: 3298330 - DNA, 14 bp, Homo sapiens
tacagcttttatgg

SEQ ID NO: 3298331 - DNA, 15 bp, Homo sapiens
tacagcttttatgga

SEQ ID NO: 3298332 - DNA, 21 bp, Homo sapiens
tacaggaaaaaaaattctgtt

SEQ ID NO: 3298333 - DNA, 13 bp, Homo sapiens
tacaggaacttca

SEQ ID NO: 3298334 - DNA, 18 bp, Homo sapiens
tacaggaaggtagaaata

SEQ ID NO: 3298335 - DNA, 17 bp, Homo sapiens
tacaggaatgaagaact

SEQ ID NO: 3298336 - DNA, 13 bp, Homo sapiens
tacaggagaggca

SEQ ID NO: 3298337 - DNA, 20 bp, Homo sapiens
tacaggcaaaacacgcaagg

SEQ ID NO: 3298338 - DNA, 13 bp, Homo sapiens
tacaggcaattcc

SEQ ID NO: 3298339 - DNA, 19 bp, Homo sapiens
tacaggcaccgagaatgtt

SEQ ID NO: 3298340 - DNA, 23 bp, Homo sapiens
tacagggagaaaatccaggtcat

SEQ ID NO: 3298341 - DNA, 16 bp, Homo sapiens
tacagggagcctcctg

SEQ ID NO: 3298342 - DNA, 21 bp, Homo sapiens
tacagggagcctcctgcccag

SEQ ID NO: 3298343 - DNA, 24 bp, Homo sapiens
tacagggtaactgtgctgaatgct

SEQ ID NO: 3298344 - DNA, 18 bp, Homo sapiens
tacagggtctcttccttc

SEQ ID NO: 3298345 - DNA, 17 bp, Homo sapiens
tacagtaactttatgtg

SEQ ID NO: 3298346 - DNA, 23 bp, Homo sapiens
tacagtaactttatgtgtaaata

SEQ ID NO: 3298347 - DNA, 21 bp, Homo sapiens
tacagtaagctgctctattgt

SEQ ID NO: 3298348 - DNA, 18 bp, Homo sapiens
tacagtacacagatacct

SEQ ID NO: 3298349 - DNA, 15 bp, Homo sapiens
tacagtatagatttt

SEQ ID NO: 3298350 - DNA, 23 bp, Homo sapiens
tacagtattgaaaaattatcagt

SEQ ID NO: 3298351 - DNA, 18 bp, Homo sapiens
tacagtcaagatagaaag

SEQ ID NO: 3298352 - DNA, 19 bp, Homo sapiens
tacagtccttcaaaatcct

SEQ ID NO: 3298353 - DNA, 13 bp, Homo sapiens
tacagtctctttc

SEQ ID NO: 3298354 - DNA, 16 bp, Homo sapiens
tacagtctctttcttc

SEQ ID NO: 3298355 - DNA, 17 bp, Homo sapiens
tacagtctctttcttcc

SEQ ID NO: 3298356 - DNA, 19 bp, Homo sapiens
tacagtctctttcttcctt

SEQ ID NO: 3298357 - DNA, 23 bp, Homo sapiens
tacagtctctttcttcctttcta

SEQ ID NO: 3298358 - DNA, 18 bp, Homo sapiens
tacagtgaattgtctttt

SEQ ID NO: 3298359 - DNA, 13 bp, Homo sapiens
tacagtgaggagg

SEQ ID NO: 3298360 - DNA, 14 bp, Homo sapiens
tacagtgcagacag

SEQ ID NO: 3298361 - DNA, 13 bp, Homo sapiens
tacagtgccttgc

SEQ ID NO: 3298362 - DNA, 14 bp, Homo sapiens
tacagtgccttgct

SEQ ID NO: 3298363 - DNA, 18 bp, Homo sapiens
tacagtgtctgtgccatg

SEQ ID NO: 3298364 - DNA, 12 bp, Homo sapiens
tacagtgttacc

SEQ ID NO: 3298365 - DNA, 18 bp, Homo sapiens
tacagttagggttttgca

SEQ ID NO: 3298366 - DNA, 16 bp, Homo sapiens
tacagttcaataaact

SEQ ID NO: 3298367 - DNA, 20 bp, Homo sapiens
tacagttctgctctggttgt

SEQ ID NO: 3298368 - DNA, 15 bp, Homo sapiens
tacagttctgtggtt

SEQ ID NO: 3298369 - DNA, 17 bp, Homo sapiens
tacagttgaaataactg

SEQ ID NO: 3298370 - DNA, 13 bp, Homo sapiens
tacagttgcagga

SEQ ID NO: 3298371 - DNA, 15 bp, Homo sapiens
tacagttgcaggagc

SEQ ID NO: 3298372 - DNA, 17 bp, Homo sapiens
tacagttgcaggagcgt

SEQ ID NO: 3298373 - DNA, 19 bp, Homo sapiens
tacagttgcaggagcgtga

SEQ ID NO: 3298374 - DNA, 20 bp, Homo sapiens
tacagttgttttttgaaaac

SEQ ID NO: 3298375 - DNA, 15 bp, Homo sapiens
tacagtttgctgtac

SEQ ID NO: 3298376 - DNA, 14 bp, Homo sapiens
tacagttttaactg

SEQ ID NO: 3298377 - DNA, 15 bp, Homo sapiens
tacagttttaactgt

SEQ ID NO: 3298378 - DNA, 19 bp, Homo sapiens
tacagttttaactgtggat

SEQ ID NO: 3298379 - DNA, 17 bp, Homo sapiens
tacagttttatgctctt

SEQ ID NO: 3298380 - DNA, 18 bp, Homo sapiens
tacagttttatgctcttt

SEQ ID NO: 3298381 - DNA, 20 bp, Homo sapiens
tacagttttctagcaatttt

SEQ ID NO: 3298382 - DNA, 23 bp, Homo sapiens
tacataaaccatttttgttactc

SEQ ID NO: 3298383 - DNA, 22 bp, Homo sapiens
tacataaattgcataaagcata

SEQ ID NO: 3298384 - DNA, 13 bp, Homo sapiens
tacataacaagaa

SEQ ID NO: 3298385 - DNA, 18 bp, Homo sapiens
tacataacaagaaaatca

SEQ ID NO: 3298386 - DNA, 19 bp, Homo sapiens
tacataacaagaaaatcaa

SEQ ID NO: 3298387 - DNA, 18 bp, Homo sapiens
tacataactaaatttgat

SEQ ID NO: 3298388 - DNA, 15 bp, Homo sapiens
tacataactgaaaat

SEQ ID NO: 3298389 - DNA, 15 bp, Homo sapiens
tacataagaaatgta

SEQ ID NO: 3298390 - DNA, 16 bp, Homo sapiens
tacataagataaatgt

SEQ ID NO: 3298391 - DNA, 22 bp, Homo sapiens
tacataagataaatgtgctgaa

SEQ ID NO: 3298392 - DNA, 15 bp, Homo sapiens
tacataagtttagga

SEQ ID NO: 3298393 - DNA, 21 bp, Homo sapiens
tacataatgcttaatttctaa

SEQ ID NO: 3298394 - DNA, 22 bp, Homo sapiens
tacataattttttattcaagtt

SEQ ID NO: 3298395 - DNA, 15 bp, Homo sapiens
tacatactgcatctt

SEQ ID NO: 3298396 - DNA, 19 bp, Homo sapiens
tacatactttatcaatgtg

SEQ ID NO: 3298397 - DNA, 23 bp, Homo sapiens
tacatactttatcaatgtgtctt

SEQ ID NO: 3298398 - DNA, 13 bp, Homo sapiens
tacatacttttgc

SEQ ID NO: 3298399 - DNA, 14 bp, Homo sapiens
tacatacttttgca

SEQ ID NO: 3298400 - DNA, 22 bp, Homo sapiens
tacatagagatctattttttct

SEQ ID NO: 3298401 - DNA, 17 bp, Homo sapiens
tacatagatgcttagtc

SEQ ID NO: 3298402 - DNA, 12 bp, Homo sapiens
tacatagtgtaa

SEQ ID NO: 3298403 - DNA, 12 bp, Homo sapiens
tacatatatatt

SEQ ID NO: 3298404 - DNA, 15 bp, Homo sapiens
tacatatgtagaaac

SEQ ID NO: 3298405 - DNA, 20 bp, Homo sapiens
tacatatgtagactatatac

SEQ ID NO: 3298406 - DNA, 21 bp, Homo sapiens
tacatatgtagactatataca

SEQ ID NO: 3298407 - DNA, 22 bp, Homo sapiens
tacatatgtagactatatacat

SEQ ID NO: 3298408 - DNA, 15 bp, Homo sapiens
tacatattactgttg

SEQ ID NO: 3298409 - DNA, 23 bp, Homo sapiens
tacatattactgttgcatttact

SEQ ID NO: 3298410 - DNA, 21 bp, Homo sapiens
tacatattgcaggagacattt

SEQ ID NO: 3298411 - DNA, 23 bp, Homo sapiens
tacatattgcaggagacattttc

SEQ ID NO: 3298412 - DNA, 22 bp, Homo sapiens
tacatattgttagggtcagcca

SEQ ID NO: 3298413 - DNA, 17 bp, Homo sapiens
tacatatttgtggaata

SEQ ID NO: 3298414 - DNA, 12 bp, Homo sapiens
tacatcactgct

SEQ ID NO: 3298415 - DNA, 19 bp, Homo sapiens
tacatcactgcttgatgaa

SEQ ID NO: 3298416 - DNA, 22 bp, Homo sapiens
tacatcactgcttgatgaagca

SEQ ID NO: 3298417 - DNA, 13 bp, Homo sapiens
tacatcagtttga

SEQ ID NO: 3298418 - DNA, 14 bp, Homo sapiens
tacatcagtttgat

SEQ ID NO: 3298419 - DNA, 16 bp, Homo sapiens
tacatcagtttgatac

SEQ ID NO: 3298420 - DNA, 15 bp, Homo sapiens
tacatccagagttct

SEQ ID NO: 3298421 - DNA, 22 bp, Homo sapiens
tacatctattttggattgtata

SEQ ID NO: 3298422 - DNA, 15 bp, Homo sapiens
tacatctctccccaa

SEQ ID NO: 3298423 - DNA, 14 bp, Homo sapiens
tacatctggcttat

SEQ ID NO: 3298424 - DNA, 15 bp, Homo sapiens
tacatctggcttatt

SEQ ID NO: 3298425 - DNA, 21 bp, Homo sapiens
tacatctggcttattttaatg

SEQ ID NO: 3298426 - DNA, 23 bp, Homo sapiens
tacatctggcttattttaatgtg

SEQ ID NO: 3298427 - DNA, 22 bp, Homo sapiens
tacatcttctgtgaaatataat

SEQ ID NO: 3298428 - DNA, 12 bp, Homo sapiens
tacatgaaacag

SEQ ID NO: 3298429 - DNA, 17 bp, Homo sapiens
tacatgactgggcctcc

SEQ ID NO: 3298430 - DNA, 19 bp, Homo sapiens
tacatgcaatttattaaaa

SEQ ID NO: 3298431 - DNA, 22 bp, Homo sapiens
tacatgcaatttattaaaatga

SEQ ID NO: 3298432 - DNA, 20 bp, Homo sapiens
tactagatgcatcactgggt

SEQ ID NO: 3298433 - DNA, 23 bp, Homo sapiens
tactagcttttcaaacaagaatg

SEQ ID NO: 3298434 - DNA, 23 bp, Homo sapiens
tactaggaagaacgttttttcct

SEQ ID NO: 3298435 - DNA, 23 bp, Homo sapiens
tactaggatacagaaatgcaaaa

SEQ ID NO: 3298436 - DNA, 13 bp, Homo sapiens
tactaggtaactt

SEQ ID NO: 3298437 - DNA, 19 bp, Homo sapiens
tactaggtaacttcatatt

SEQ ID NO: 3298438 - DNA, 20 bp, Homo sapiens
tactaggttggacagccccc

SEQ ID NO: 3298439 - DNA, 17 bp, Homo sapiens
tactagtctgtgtggga

SEQ ID NO: 3298440 - DNA, 9 bp, Homo sapiens
tactagtgt

SEQ ID NO: 3298441 - DNA, 16 bp, Homo sapiens
tactagtgtggtgtgt

SEQ ID NO: 3298442 - DNA, 17 bp, Homo sapiens
tactagtgtggtgtgtt

SEQ ID NO: 3298443 - DNA, 14 bp, Homo sapiens
tactagtgttctgt

SEQ ID NO: 3298444 - DNA, 16 bp, Homo sapiens
tactagtgttctgttt

SEQ ID NO: 3298445 - DNA, 19 bp, Homo sapiens
tactagttacacatcttca

SEQ ID NO: 3298446 - DNA, 14 bp, Homo sapiens
tactataagtagtt

SEQ ID NO: 3298447 - DNA, 22 bp, Homo sapiens
tactataagtagttggtttgta

SEQ ID NO: 3298448 - DNA, 18 bp, Homo sapiens
tactataatcaaatgatt

SEQ ID NO: 3298449 - DNA, 18 bp, Homo sapiens
tactatagatataactgt

SEQ ID NO: 3298450 - DNA, 15 bp, Homo sapiens
tactatatacatata

SEQ ID NO: 3298451 - DNA, 21 bp, Homo sapiens
tactatcatactactgaaaca

SEQ ID NO: 3298452 - DNA, 16 bp, Homo sapiens
tactatggctgagttc

SEQ ID NO: 3298453 - DNA, 14 bp, Homo sapiens
tactatgtgctggg

SEQ ID NO: 3298454 - DNA, 22 bp, Homo sapiens
tactattcagtggcgagaaata

SEQ ID NO: 3298455 - DNA, 22 bp, Homo sapiens
tactattcatgttttgagacat

SEQ ID NO: 3298456 - DNA, 23 bp, Homo sapiens
tactattccctttgacttcagct

SEQ ID NO: 3298457 - DNA, 13 bp, Homo sapiens
tactatttagatt

SEQ ID NO: 3298458 - DNA, 17 bp, Homo sapiens
tactattttgacagtta

SEQ ID NO: 3298459 - DNA, 18 bp, Homo sapiens
tactcaaatgagtaacat

SEQ ID NO: 3298460 - DNA, 18 bp, Homo sapiens
tactcaaattcaatgatt

SEQ ID NO: 3298461 - DNA, 13 bp, Homo sapiens
tactcaagtacca

SEQ ID NO: 3298462 - DNA, 16 bp, Homo sapiens
tactcaagtttcaggt

SEQ ID NO: 3298463 - DNA, 12 bp, Homo sapiens
tactcagagcag

SEQ ID NO: 3298464 - DNA, 13 bp, Homo sapiens
tactcagagcaga

SEQ ID NO: 3298465 - DNA, 15 bp, Homo sapiens
tactcagagcagagc

SEQ ID NO: 3298466 - DNA, 13 bp, Homo sapiens
tactcagcctgct

SEQ ID NO: 3298467 - DNA, 17 bp, Homo sapiens
tactcagggctcctccc

SEQ ID NO: 3298468 - DNA, 15 bp, Homo sapiens
tactcattactgcaa

SEQ ID NO: 3298469 - DNA, 16 bp, Homo sapiens
tactcattactgcaaa

SEQ ID NO: 3298470 - DNA, 14 bp, Homo sapiens
tactcattgaaatg

SEQ ID NO: 3298471 - DNA, 15 bp, Homo sapiens
tactcattgaaatgt

SEQ ID NO: 3298472 - DNA, 19 bp, Homo sapiens
tactcattgcccccacctc

SEQ ID NO: 3298473 - DNA, 12 bp, Homo sapiens
tactccactgcc

SEQ ID NO: 3298474 - DNA, 14 bp, Homo sapiens
tactccctctcagg

SEQ ID NO: 3298475 - DNA, 19 bp, Homo sapiens
tactccctgcagatgccac

SEQ ID NO: 3298476 - DNA, 15 bp, Homo sapiens
tactcccttcctggc

SEQ ID NO: 3298477 - DNA, 18 bp, Homo sapiens
tactcccttcctggcctc

SEQ ID NO: 3298478 - DNA, 15 bp, Homo sapiens
tactcccttgcccta

SEQ ID NO: 3298479 - DNA, 16 bp, Homo sapiens
tactcctacctcagcc

SEQ ID NO: 3298480 - DNA, 14 bp, Homo sapiens
tactcctctgcagt

SEQ ID NO: 3298481 - DNA, 16 bp, Homo sapiens
tactcctctgcagtgc

SEQ ID NO: 3298482 - DNA, 12 bp, Homo sapiens
tactcctgactc

SEQ ID NO: 3298483 - DNA, 13 bp, Homo sapiens
tactcctgactcc

SEQ ID NO: 3298484 - DNA, 14 bp, Homo sapiens
tactcctgcaaaat

SEQ ID NO: 3298485 - DNA, 16 bp, Homo sapiens
tactcctgtgctctgg

SEQ ID NO: 3298486 - DNA, 21 bp, Homo sapiens
tactccttaagaacacaaagc

SEQ ID NO: 3298487 - DNA, 22 bp, Homo sapiens
tactccttaagaacacaaagcg

SEQ ID NO: 3298488 - DNA, 22 bp, Homo sapiens
tactctaagatcttagattctc

SEQ ID NO: 3298489 - DNA, 22 bp, Homo sapiens
tactctagcctgggccagagaa

SEQ ID NO: 3298490 - DNA, 15 bp, Homo sapiens
tactctcacatgtgg

SEQ ID NO: 3298491 - DNA, 15 bp, Homo sapiens
tactctccccacgag

SEQ ID NO: 3298492 - DNA, 20 bp, Homo sapiens
tactctccccacgagggctg

SEQ ID NO: 3298493 - DNA, 12 bp, Homo sapiens
tactctcctaga

SEQ ID NO: 3298494 - DNA, 20 bp, Homo sapiens
tactctcctcggccccctcc

SEQ ID NO: 3298495 - DNA, 16 bp, Homo sapiens
tactctctgctctagc

SEQ ID NO: 3298496 - DNA, 11 bp, Homo sapiens
tactctgagcc

SEQ ID NO: 3298497 - DNA, 12 bp, Homo sapiens
tactctgagccc

SEQ ID NO: 3298498 - DNA, 14 bp, Homo sapiens
tactctgtccaggc

SEQ ID NO: 3298499 - DNA, 15 bp, Homo sapiens
tactctgtccaggcc

SEQ ID NO: 3298500 - DNA, 19 bp, Homo sapiens
tactctgtccatttatcca

SEQ ID NO: 3298501 - DNA, 17 bp, Homo sapiens
tactctgtgtgtgtatg

SEQ ID NO: 3298502 - DNA, 15 bp, Homo sapiens
tactctgtgtttaaa

SEQ ID NO: 3298503 - DNA, 14 bp, Homo sapiens
tactcttaggatat

SEQ ID NO: 3298504 - DNA, 14 bp, Homo sapiens
tactcttcttgaaa

SEQ ID NO: 3298505 - DNA, 14 bp, Homo sapiens
tactcttgtcattt

SEQ ID NO: 3298506 - DNA, 13 bp, Homo sapiens
tactctttctgta

SEQ ID NO: 3298507 - DNA, 14 bp, Homo sapiens
tactctttgtgggg

SEQ ID NO: 3298508 - DNA, 18 bp, Homo sapiens
tactctttttctaaagtg

SEQ ID NO: 3298509 - DNA, 14 bp, Homo sapiens
tactgaaaatccaa

SEQ ID NO: 3298510 - DNA, 14 bp, Homo sapiens
tactgaaacagatt

SEQ ID NO: 3298511 - DNA, 17 bp, Homo sapiens
tactgaagccaaatgaa

SEQ ID NO: 3298512 - DNA, 13 bp, Homo sapiens
tactgaaggaaaa

SEQ ID NO: 3298513 - DNA, 18 bp, Homo sapiens
tactgaaggaaaaacaca

SEQ ID NO: 3298514 - DNA, 18 bp, Homo sapiens
tactgaatgcataaataa

SEQ ID NO: 3298515 - DNA, 20 bp, Homo sapiens
tactgaatgcataaataaat

SEQ ID NO: 3298516 - DNA, 13 bp, Homo sapiens
tactgacatgtgg

SEQ ID NO: 3298517 - DNA, 16 bp, Homo sapiens
tactgacatttcttct

SEQ ID NO: 3298518 - DNA, 17 bp, Homo sapiens
tactgactttgcttgct

SEQ ID NO: 3298519 - DNA, 20 bp, Homo sapiens
tactgactttgcttgctttg

SEQ ID NO: 3298520 - DNA, 22 bp, Homo sapiens
tactgaggcctaaaagtaaaca

SEQ ID NO: 3298521 - DNA, 23 bp, Homo sapiens
tactgagggaccaactgggccca

SEQ ID NO: 3298522 - DNA, 14 bp, Homo sapiens
tactgatatatttt

SEQ ID NO: 3298523 - DNA, 22 bp, Homo sapiens
tactgatgaaacagcctctgca

SEQ ID NO: 3298524 - DNA, 13 bp, Homo sapiens
tactgattatgaa

SEQ ID NO: 3298525 - DNA, 15 bp, Homo sapiens
tactgattgtttcat

SEQ ID NO: 3298526 - DNA, 17 bp, Homo sapiens
tactgatttttgtgatt

SEQ ID NO: 3298527 - DNA, 14 bp, Homo sapiens
tactgcaaattgat

SEQ ID NO: 3298528 - DNA, 15 bp, Homo sapiens
tactgcaagaaaatg

SEQ ID NO: 3298529 - DNA, 17 bp, Homo sapiens
tactgcactccagcctg

SEQ ID NO: 3298530 - DNA, 19 bp, Homo sapiens
tactgcagctttacatgca

SEQ ID NO: 3298531 - DNA, 23 bp, Homo sapiens
tactgcagctttacatgcaattt

SEQ ID NO: 3298532 - DNA, 14 bp, Homo sapiens
tactgcagggccag

SEQ ID NO: 3298533 - DNA, 18 bp, Homo sapiens
tactgcagggccaggact

SEQ ID NO: 3298534 - DNA, 13 bp, Homo sapiens
tactgcatacttt

SEQ ID NO: 3298535 - DNA, 17 bp, Homo sapiens
tactgcatatgaaagga

SEQ ID NO: 3298536 - DNA, 21 bp, Homo sapiens
tactgcccaggcctgcctgtt

SEQ ID NO: 3298537 - DNA, 21 bp, Homo sapiens
tactgcctataatcttataca

SEQ ID NO: 3298538 - DNA, 19 bp, Homo sapiens
tactgccttcctccttatc

SEQ ID NO: 3298539 - DNA, 17 bp, Homo sapiens
tactgcgactttctgcc

SEQ ID NO: 3298540 - DNA, 18 bp, Homo sapiens
tactgcgactttctgcct

SEQ ID NO: 3298541 - DNA, 20 bp, Homo sapiens
tactgctacagcaatttcta

SEQ ID NO: 3298542 - DNA, 20 bp, Homo sapiens
tactgctactgtaattttat

SEQ ID NO: 3298543 - DNA, 22 bp, Homo sapiens
tactgcttgaccgtactctcac

SEQ ID NO: 3298544 - DNA, 13 bp, Homo sapiens
tactgcttgctta

SEQ ID NO: 3298545 - DNA, 17 bp, Homo sapiens
tactgcttgcttacaat

SEQ ID NO: 3298546 - DNA, 17 bp, Homo sapiens
tactgctttaatcagaa

SEQ ID NO: 3298547 - DNA, 17 bp, Homo sapiens
tactggaagttttgcat

SEQ ID NO: 3298548 - DNA, 18 bp, Homo sapiens
tactggaagttttgcatt

SEQ ID NO: 3298549 - DNA, 19 bp, Homo sapiens
tactggagtggaaggtcta

SEQ ID NO: 3298550 - DNA, 22 bp, Homo sapiens
tactggagttgggggcggcttg

SEQ ID NO: 3298551 - DNA, 17 bp, Homo sapiens
tactggataaattgttt

SEQ ID NO: 3298552 - DNA, 11 bp, Homo sapiens
tactggcagct

SEQ ID NO: 3298553 - DNA, 19 bp, Homo sapiens
tactggcagctcctctcct

SEQ ID NO: 3298554 - DNA, 15 bp, Homo sapiens
tactggccagtgtca

SEQ ID NO: 3298555 - DNA, 18 bp, Homo sapiens
tactggcctttttcattt

SEQ ID NO: 3298556 - DNA, 18 bp, Homo sapiens
tactggcttacctcctca

SEQ ID NO: 3298557 - DNA, 22 bp, Homo sapiens
tactgggtaaaagcagggcagc

SEQ ID NO: 3298558 - DNA, 19 bp, Homo sapiens
tactgggtgaggaaatcca

SEQ ID NO: 3298559 - DNA, 17 bp, Homo sapiens
tagacaatcattgtttt

SEQ ID NO: 3298560 - DNA, 14 bp, Homo sapiens
tagacaccaaagtt

SEQ ID NO: 3298561 - DNA, 17 bp, Homo sapiens
tagacacccattttcac

SEQ ID NO: 3298562 - DNA, 16 bp, Homo sapiens
tagacacttacttgat

SEQ ID NO: 3298563 - DNA, 21 bp, Homo sapiens
tagacatcaatcctggtaacc

SEQ ID NO: 3298564 - DNA, 11 bp, Homo sapiens
tagacatgaaa

SEQ ID NO: 3298565 - DNA, 12 bp, Homo sapiens
tagacatgaaag

SEQ ID NO: 3298566 - DNA, 20 bp, Homo sapiens
tagacatggaggttctaagg

SEQ ID NO: 3298567 - DNA, 23 bp, Homo sapiens
tagacatggaggttctaaggcct

SEQ ID NO: 3298568 - DNA, 17 bp, Homo sapiens
tagacatgtcatggtcc

SEQ ID NO: 3298569 - DNA, 15 bp, Homo sapiens
tagaccaaggaacaa

SEQ ID NO: 3298570 - DNA, 18 bp, Homo sapiens
tagaccaaggaacaaaaa

SEQ ID NO: 3298571 - DNA, 20 bp, Homo sapiens
tagacccaggtggagggcac

SEQ ID NO: 3298572 - DNA, 22 bp, Homo sapiens
tagacccaggtggagggcacag

SEQ ID NO: 3298573 - DNA, 16 bp, Homo sapiens
tagacccatgctggtc

SEQ ID NO: 3298574 - DNA, 12 bp, Homo sapiens
tagaccctgggt

SEQ ID NO: 3298575 - DNA, 22 bp, Homo sapiens
tagacctagggaggaccttatc

SEQ ID NO: 3298576 - DNA, 13 bp, Homo sapiens
tagactagagaaa

SEQ ID NO: 3298577 - DNA, 14 bp, Homo sapiens
tagactatatacat

SEQ ID NO: 3298578 - DNA, 20 bp, Homo sapiens
tagactatatacatgtgtgt

SEQ ID NO: 3298579 - DNA, 21 bp, Homo sapiens
tagactcatcttactgtacct

SEQ ID NO: 3298580 - DNA, 22 bp, Homo sapiens
tagactgacttgtttgtcttcc

SEQ ID NO: 3298581 - DNA, 19 bp, Homo sapiens
tagactgatgttttagcat

SEQ ID NO: 3298582 - DNA, 17 bp, Homo sapiens
tagactgccgtgcatta

SEQ ID NO: 3298583 - DNA, 19 bp, Homo sapiens
tagactggaaaaaatgagc

SEQ ID NO: 3298584 - DNA, 16 bp, Homo sapiens
tagactggaagttcat

SEQ ID NO: 3298585 - DNA, 19 bp, Homo sapiens
tagacttcccaacagcctt

SEQ ID NO: 3298586 - DNA, 20 bp, Homo sapiens
tagacttcgactcaggatcc

SEQ ID NO: 3298587 - DNA, 13 bp, Homo sapiens
tagacttctggtt

SEQ ID NO: 3298588 - DNA, 18 bp, Homo sapiens
tagactttagaaataaat

SEQ ID NO: 3298589 - DNA, 19 bp, Homo sapiens
tagactttagaaataaatg

SEQ ID NO: 3298590 - DNA, 11 bp, Homo sapiens
tagactttctg

SEQ ID NO: 3298591 - DNA, 13 bp, Homo sapiens
tagagaaaaggct

SEQ ID NO: 3298592 - DNA, 14 bp, Homo sapiens
tagagaaaagtgta

SEQ ID NO: 3298593 - DNA, 17 bp, Homo sapiens
tagagaactaaactagt

SEQ ID NO: 3298594 - DNA, 14 bp, Homo sapiens
tagagaagataatt

SEQ ID NO: 3298595 - DNA, 22 bp, Homo sapiens
tagagaatgcacagatatactt

SEQ ID NO: 3298596 - DNA, 14 bp, Homo sapiens
tagagacagaagca

SEQ ID NO: 3298597 - DNA, 18 bp, Homo sapiens
tagagacagaagcaggct

SEQ ID NO: 3298598 - DNA, 11 bp, Homo sapiens
tagagacaggg

SEQ ID NO: 3298599 - DNA, 14 bp, Homo sapiens
tagagactgtagat

SEQ ID NO: 3298600 - DNA, 14 bp, Homo sapiens
tagagagaaagaga

SEQ ID NO: 3298601 - DNA, 16 bp, Homo sapiens
tagagagagaccactt

SEQ ID NO: 3298602 - DNA, 18 bp, Homo sapiens
tagagagaggaggcagcc

SEQ ID NO: 3298603 - DNA, 21 bp, Homo sapiens
tagagagaggaggcagccccc

SEQ ID NO: 3298604 - DNA, 21 bp, Homo sapiens
tagagagttgttgtgtacaga

SEQ ID NO: 3298605 - DNA, 21 bp, Homo sapiens
tagagatctggttttgctatt

SEQ ID NO: 3298606 - DNA, 14 bp, Homo sapiens
tagagatgcattca

SEQ ID NO: 3298607 - DNA, 21 bp, Homo sapiens
tagagatgtgcaattgatttc

SEQ ID NO: 3298608 - DNA, 12 bp, Homo sapiens
tagagatgtttt

SEQ ID NO: 3298609 - DNA, 20 bp, Homo sapiens
tagagatgtttttaaaagtt

SEQ ID NO: 3298610 - DNA, 23 bp, Homo sapiens
tagagatgtttttaaaagtttca

SEQ ID NO: 3298611 - DNA, 16 bp, Homo sapiens
tagagatttgtctaat

SEQ ID NO: 3298612 - DNA, 20 bp, Homo sapiens
tagagatttgtctaattgca

SEQ ID NO: 3298613 - DNA, 20 bp, Homo sapiens
tagagcacctagtccagtga

SEQ ID NO: 3298614 - DNA, 12 bp, Homo sapiens
tagagcagccca

SEQ ID NO: 3298615 - DNA, 23 bp, Homo sapiens
tagagcagggattaacctctgca

SEQ ID NO: 3298616 - DNA, 15 bp, Homo sapiens
tagagcattgccatt

SEQ ID NO: 3298617 - DNA, 16 bp, Homo sapiens
tagagcattgccattc

SEQ ID NO: 3298618 - DNA, 20 bp, Homo sapiens
tagagccctggccagccctt

SEQ ID NO: 3298619 - DNA, 23 bp, Homo sapiens
tagagccctggccagcccttcct

SEQ ID NO: 3298620 - DNA, 18 bp, Homo sapiens
tagagcttgtaataaata

SEQ ID NO: 3298621 - DNA, 18 bp, Homo sapiens
tagaggaaaaaaatgact

SEQ ID NO: 3298622 - DNA, 12 bp, Homo sapiens
tagaggaaaggg

SEQ ID NO: 3298623 - DNA, 21 bp, Homo sapiens
tagaggaaagggatggtaagt

SEQ ID NO: 3298624 - DNA, 22 bp, Homo sapiens
tagaggcaacaggattgatcat

SEQ ID NO: 3298625 - DNA, 13 bp, Homo sapiens
tagaggcctgggg

SEQ ID NO: 3298626 - DNA, 15 bp, Homo sapiens
tagaggctccccagg

SEQ ID NO: 3298627 - DNA, 14 bp, Homo sapiens
tagaggcttctccg

SEQ ID NO: 3298628 - DNA, 18 bp, Homo sapiens
tagaggcttctccgccag

SEQ ID NO: 3298629 - DNA, 20 bp, Homo sapiens
tagaggcttctccgccagcc

SEQ ID NO: 3298630 - DNA, 23 bp, Homo sapiens
tagagggaggagaatgagcctcg

SEQ ID NO: 3298631 - DNA, 19 bp, Homo sapiens
tagaggtcctctggagccc

SEQ ID NO: 3298632 - DNA, 20 bp, Homo sapiens
tagaggtcctctggagccct

SEQ ID NO: 3298633 - DNA, 19 bp, Homo sapiens
tagaggtgggcagctgggc

SEQ ID NO: 3298634 - DNA, 15 bp, Homo sapiens
tagaggttttaaagt

SEQ ID NO: 3298635 - DNA, 19 bp, Homo sapiens
tagaggttttaaagtgatt

SEQ ID NO: 3298636 - DNA, 19 bp, Homo sapiens
tagaggttttgttgtttta

SEQ ID NO: 3298637 - DNA, 16 bp, Homo sapiens
tagagtaaataaactg

SEQ ID NO: 3298638 - DNA, 14 bp, Homo sapiens
tagagtatatgcac

SEQ ID NO: 3298639 - DNA, 18 bp, Homo sapiens
tagagtcaactacacaaa

SEQ ID NO: 3298640 - DNA, 22 bp, Homo sapiens
tagagtcttacaatcaaatctc

SEQ ID NO: 3298641 - DNA, 13 bp, Homo sapiens
tagagtgtagcct

SEQ ID NO: 3298642 - DNA, 20 bp, Homo sapiens
tagagtgtagcctaaagggc

SEQ ID NO: 3298643 - DNA, 21 bp, Homo sapiens
tagagtgtagcctaaagggca

SEQ ID NO: 3298644 - DNA, 22 bp, Homo sapiens
tagagtgtagcctaaagggcag

SEQ ID NO: 3298645 - DNA, 15 bp, Homo sapiens
tagagtgtagctgta

SEQ ID NO: 3298646 - DNA, 18 bp, Homo sapiens
tagagtgtagctgtaagg

SEQ ID NO: 3298647 - DNA, 14 bp, Homo sapiens
tagagttgctgaga

SEQ ID NO: 3298648 - DNA, 12 bp, Homo sapiens
tagagtttaaca

SEQ ID NO: 3298649 - DNA, 13 bp, Homo sapiens
tagagtttaacac

SEQ ID NO: 3298650 - DNA, 17 bp, Homo sapiens
tagagtttgctattaga

SEQ ID NO: 3298651 - DNA, 16 bp, Homo sapiens
tagataaatatttgac

SEQ ID NO: 3298652 - DNA, 13 bp, Homo sapiens
tagataatattgt

SEQ ID NO: 3298653 - DNA, 13 bp, Homo sapiens
tagatactacttt

SEQ ID NO: 3298654 - DNA, 16 bp, Homo sapiens
tagatactactttctc

SEQ ID NO: 3298655 - DNA, 23 bp, Homo sapiens
tagatagaaataaatagctatat

SEQ ID NO: 3298656 - DNA, 20 bp, Homo sapiens
tagatataatgaacaaaatt

SEQ ID NO: 3298657 - DNA, 23 bp, Homo sapiens
tagatataatgaacaaaattatt

SEQ ID NO: 3298658 - DNA, 14 bp, Homo sapiens
tagatattacttta

SEQ ID NO: 3298659 - DNA, 14 bp, Homo sapiens
tagatattgctact

SEQ ID NO: 3298660 - DNA, 13 bp, Homo sapiens
tagatatttggct

SEQ ID NO: 3298661 - DNA, 14 bp, Homo sapiens
tagatatttggctt

SEQ ID NO: 3298662 - DNA, 21 bp, Homo sapiens
tagatatttggcttaaatata

SEQ ID NO: 3298663 - DNA, 12 bp, Homo sapiens
tagatattttca

SEQ ID NO: 3298664 - DNA, 15 bp, Homo sapiens
tagatattttcacaa

SEQ ID NO: 3298665 - DNA, 18 bp, Homo sapiens
tagatcaaatagttgcat

SEQ ID NO: 3298666 - DNA, 20 bp, Homo sapiens
tagatcaaatagttgcatag

SEQ ID NO: 3298667 - DNA, 18 bp, Homo sapiens
tagatcaaggcaaaaata

SEQ ID NO: 3298668 - DNA, 14 bp, Homo sapiens
tagatcactgtgct

SEQ ID NO: 3298669 - DNA, 18 bp, Homo sapiens
tagatcagatgctccaag

SEQ ID NO: 3298670 - DNA, 20 bp, Homo sapiens
tagatcagatgctccaagat

SEQ ID NO: 3298671 - DNA, 15 bp, Homo sapiens
tagatcagtatttca

SEQ ID NO: 3298672 - DNA, 15 bp, Homo sapiens
tagatcctgagatga

SEQ ID NO: 3298673 - DNA, 12 bp, Homo sapiens
tagatctccagc

SEQ ID NO: 3298674 - DNA, 12 bp, Homo sapiens
tagatcttctga

SEQ ID NO: 3298675 - DNA, 13 bp, Homo sapiens
tagatcttctgaa

SEQ ID NO: 3298676 - DNA, 16 bp, Homo sapiens
tagatcttctgaaatg

SEQ ID NO: 3298677 - DNA, 15 bp, Homo sapiens
tagatgaactcaact

SEQ ID NO: 3298678 - DNA, 15 bp, Homo sapiens
tagatgactttgcag

SEQ ID NO: 3298679 - DNA, 21 bp, Homo sapiens
tagatgagattgttttatcat

SEQ ID NO: 3298680 - DNA, 17 bp, Homo sapiens
tagatgagggtgactgt

SEQ ID NO: 3298681 - DNA, 12 bp, Homo sapiens
tagatgataaag

SEQ ID NO: 3298682 - DNA, 22 bp, Homo sapiens
tagatgcaaaaaactaatgtga

SEQ ID NO: 3298683 - DNA, 20 bp, Homo sapiens
tagatgctgaatatctgttc

SEQ ID NO: 3298684 - DNA, 15 bp, Homo sapiens
tagatgggtgggggc

SEQ ID NO: 3298685 - DNA, 17 bp, Homo sapiens
tagtctctgttcttcat

SEQ ID NO: 3298686 - DNA, 13 bp, Homo sapiens
tagtctggtttct

SEQ ID NO: 3298687 - DNA, 22 bp, Homo sapiens
tagtctgtgtgggactgtacac

SEQ ID NO: 3298688 - DNA, 18 bp, Homo sapiens
tagtcttctcatagcatt

SEQ ID NO: 3298689 - DNA, 19 bp, Homo sapiens
tagtcttctcatagcatta

SEQ ID NO: 3298690 - DNA, 15 bp, Homo sapiens
tagtcttttgcatgt

SEQ ID NO: 3298691 - DNA, 19 bp, Homo sapiens
tagtcttttgcatgtcgca

SEQ ID NO: 3298692 - DNA, 15 bp, Homo sapiens
tagtcttttgctttt

SEQ ID NO: 3298693 - DNA, 16 bp, Homo sapiens
tagtgaaaattctgtt

SEQ ID NO: 3298694 - DNA, 17 bp, Homo sapiens
tagtgaaccacaggttt

SEQ ID NO: 3298695 - DNA, 18 bp, Homo sapiens
tagtgaatactgctacag

SEQ ID NO: 3298696 - DNA, 12 bp, Homo sapiens
tagtgaatgact

SEQ ID NO: 3298697 - DNA, 15 bp, Homo sapiens
tagtgatcatttaaa

SEQ ID NO: 3298698 - DNA, 17 bp, Homo sapiens
tagtgatcatttaaaaa

SEQ ID NO: 3298699 - DNA, 13 bp, Homo sapiens
tagtgattctgat

SEQ ID NO: 3298700 - DNA, 20 bp, Homo sapiens
tagtgattctgatttcagtt

SEQ ID NO: 3298701 - DNA, 12 bp, Homo sapiens
tagtgcagctga

SEQ ID NO: 3298702 - DNA, 18 bp, Homo sapiens
tagtgcagctgattttaa

SEQ ID NO: 3298703 - DNA, 19 bp, Homo sapiens
tagtgcagctgattttaac

SEQ ID NO: 3298704 - DNA, 16 bp, Homo sapiens
tagtgccacccacctt

SEQ ID NO: 3298705 - DNA, 20 bp, Homo sapiens
tagtgccagaattttaggaa

SEQ ID NO: 3298706 - DNA, 14 bp, Homo sapiens
tagtgcccgcctag

SEQ ID NO: 3298707 - DNA, 13 bp, Homo sapiens
tagtgccctgccc

SEQ ID NO: 3298708 - DNA, 14 bp, Homo sapiens
tagtgccctgcccc

SEQ ID NO: 3298709 - DNA, 19 bp, Homo sapiens
tagtgccctgccccctggc

SEQ ID NO: 3298710 - DNA, 14 bp, Homo sapiens
tagtgcctaaaatt

SEQ ID NO: 3298711 - DNA, 21 bp, Homo sapiens
tagtgcgatgtttcaggaggc

SEQ ID NO: 3298712 - DNA, 14 bp, Homo sapiens
tagtgcggacaagt

SEQ ID NO: 3298713 - DNA, 14 bp, Homo sapiens
tagtgctatatata

SEQ ID NO: 3298714 - DNA, 22 bp, Homo sapiens
tagtgctatatatataaatatt

SEQ ID NO: 3298715 - DNA, 15 bp, Homo sapiens
tagtgcttcagagtt

SEQ ID NO: 3298716 - DNA, 23 bp, Homo sapiens
tagtggaagagcagcctgatggc

SEQ ID NO: 3298717 - DNA, 23 bp, Homo sapiens
tagtggatgactgttgatgaagt

SEQ ID NO: 3298718 - DNA, 23 bp, Homo sapiens
tagtggattactgccattcactt

SEQ ID NO: 3298719 - DNA, 21 bp, Homo sapiens
tagtggcttcttttgaactgt

SEQ ID NO: 3298720 - DNA, 18 bp, Homo sapiens
tagtgggcaccccactgc

SEQ ID NO: 3298721 - DNA, 15 bp, Homo sapiens
tagtgggccagggct

SEQ ID NO: 3298722 - DNA, 16 bp, Homo sapiens
tagtggggcctgggag

SEQ ID NO: 3298723 - DNA, 14 bp, Homo sapiens
tagtggtctttgta

SEQ ID NO: 3298724 - DNA, 23 bp, Homo sapiens
tagtggtctttgtaagagtgtag

SEQ ID NO: 3298725 - DNA, 13 bp, Homo sapiens
tagtgtaaaataa

SEQ ID NO: 3298726 - DNA, 22 bp, Homo sapiens
tagtgtaaaataagaatgattt

SEQ ID NO: 3298727 - DNA, 17 bp, Homo sapiens
tagtgtattatcactgt

SEQ ID NO: 3298728 - DNA, 17 bp, Homo sapiens
tagtgtcacttacctag

SEQ ID NO: 3298729 - DNA, 11 bp, Homo sapiens
tagtgtgaaat

SEQ ID NO: 3298730 - DNA, 17 bp, Homo sapiens
tagtgtgagtggcagcc

SEQ ID NO: 3298731 - DNA, 21 bp, Homo sapiens
tagtgtgagtggcagccatgc

SEQ ID NO: 3298732 - DNA, 20 bp, Homo sapiens
tagtgtgtgtgcagagtcca

SEQ ID NO: 3298733 - DNA, 12 bp, Homo sapiens
tagtgttctgtt

SEQ ID NO: 3298734 - DNA, 15 bp, Homo sapiens
tagtgttctgtttgt

SEQ ID NO: 3298735 - DNA, 18 bp, Homo sapiens
tagttaaagaaaggaaaa

SEQ ID NO: 3298736 - DNA, 19 bp, Homo sapiens
tagttaaattgaagaaagt

SEQ ID NO: 3298737 - DNA, 20 bp, Homo sapiens
tagttaataatctatgatga

SEQ ID NO: 3298738 - DNA, 15 bp, Homo sapiens
tagttaatttatcta

SEQ ID NO: 3298739 - DNA, 16 bp, Homo sapiens
tagttacctactgagt

SEQ ID NO: 3298740 - DNA, 12 bp, Homo sapiens
tagttaccttat

SEQ ID NO: 3298741 - DNA, 21 bp, Homo sapiens
tagttaccttatagttactgt

SEQ ID NO: 3298742 - DNA, 22 bp, Homo sapiens
tagttaccttatagttactgtg

SEQ ID NO: 3298743 - DNA, 19 bp, Homo sapiens
tagttactgtgtaattagt

SEQ ID NO: 3298744 - DNA, 21 bp, Homo sapiens
tagttaggaaataaaaccttt

SEQ ID NO: 3298745 - DNA, 22 bp, Homo sapiens
tagttaggaaataaaacctttc

SEQ ID NO: 3298746 - DNA, 20 bp, Homo sapiens
tagttaggatagcatttttg

SEQ ID NO: 3298747 - DNA, 23 bp, Homo sapiens
tagttcagaatttagtgtatcca

SEQ ID NO: 3298748 - DNA, 18 bp, Homo sapiens
tagttcaggtaacaggca

SEQ ID NO: 3298749 - DNA, 14 bp, Homo sapiens
tagttcatatatac

SEQ ID NO: 3298750 - DNA, 20 bp, Homo sapiens
tagttcatccaatcctcact

SEQ ID NO: 3298751 - DNA, 21 bp, Homo sapiens
tagttccccaaatacaaagtt

SEQ ID NO: 3298752 - DNA, 18 bp, Homo sapiens
tagttccctctgctcagc

SEQ ID NO: 3298753 - DNA, 12 bp, Homo sapiens
tagttccctttg

SEQ ID NO: 3298754 - DNA, 14 bp, Homo sapiens
tagttcctaagaag

SEQ ID NO: 3298755 - DNA, 16 bp, Homo sapiens
tagttcctgctacaac

SEQ ID NO: 3298756 - DNA, 16 bp, Homo sapiens
tagttcctgtggccag

SEQ ID NO: 3298757 - DNA, 13 bp, Homo sapiens
tagttctaagact

SEQ ID NO: 3298758 - DNA, 14 bp, Homo sapiens
tagttctaagactc

SEQ ID NO: 3298759 - DNA, 12 bp, Homo sapiens
tagttctagaca

SEQ ID NO: 3298760 - DNA, 17 bp, Homo sapiens
tagttctgaggtccctg

SEQ ID NO: 3298761 - DNA, 16 bp, Homo sapiens
tagttctgccaggcaa

SEQ ID NO: 3298762 - DNA, 16 bp, Homo sapiens
tagttctgtgtacttt

SEQ ID NO: 3298763 - DNA, 18 bp, Homo sapiens
tagttctgtgtacttttt

SEQ ID NO: 3298764 - DNA, 13 bp, Homo sapiens
tagttgagcccca

SEQ ID NO: 3298765 - DNA, 21 bp, Homo sapiens
tagttgattgctgttgagatg

SEQ ID NO: 3298766 - DNA, 16 bp, Homo sapiens
tagttgcaattgaatt

SEQ ID NO: 3298767 - DNA, 23 bp, Homo sapiens
tagttgcagactcagtttgtcag

SEQ ID NO: 3298768 - DNA, 21 bp, Homo sapiens
tagttgccaaatctggctcct

SEQ ID NO: 3298769 - DNA, 18 bp, Homo sapiens
tagttggtgctgatggag

SEQ ID NO: 3298770 - DNA, 20 bp, Homo sapiens
tagttgtagacaaagtacat

SEQ ID NO: 3298771 - DNA, 14 bp, Homo sapiens
tagttgtattcttc

SEQ ID NO: 3298772 - DNA, 17 bp, Homo sapiens
tagttgtctctcttcag

SEQ ID NO: 3298773 - DNA, 17 bp, Homo sapiens
tagttgtctttcctggc

SEQ ID NO: 3298774 - DNA, 14 bp, Homo sapiens
tagtttaggagaaa

SEQ ID NO: 3298775 - DNA, 18 bp, Homo sapiens
tagtttaggagaaaccag

SEQ ID NO: 3298776 - DNA, 21 bp, Homo sapiens
tagtttcagtagattgcagaa

SEQ ID NO: 3298777 - DNA, 13 bp, Homo sapiens
tagtttccttttt

SEQ ID NO: 3298778 - DNA, 16 bp, Homo sapiens
tagtttctagaggcct

SEQ ID NO: 3298779 - DNA, 17 bp, Homo sapiens
tagtttgaattcagtaa

SEQ ID NO: 3298780 - DNA, 15 bp, Homo sapiens
tagtttggatatttt

SEQ ID NO: 3298781 - DNA, 18 bp, Homo sapiens
tagtttggggcaaaaatc

SEQ ID NO: 3298782 - DNA, 16 bp, Homo sapiens
tagtttgggtattttt

SEQ ID NO: 3298783 - DNA, 19 bp, Homo sapiens
tagtttgtgtgttgtctct

SEQ ID NO: 3298784 - DNA, 14 bp, Homo sapiens
tagttttaaactca

SEQ ID NO: 3298785 - DNA, 14 bp, Homo sapiens
tagttttactttta

SEQ ID NO: 3298786 - DNA, 14 bp, Homo sapiens
tagttttagaggca

SEQ ID NO: 3298787 - DNA, 20 bp, Homo sapiens
tagttttagaggcattgtta

SEQ ID NO: 3298788 - DNA, 16 bp, Homo sapiens
tagttttatactatat

SEQ ID NO: 3298789 - DNA, 15 bp, Homo sapiens
tagttttgattttgg

SEQ ID NO: 3298790 - DNA, 13 bp, Homo sapiens
tagttttgtcaaa

SEQ ID NO: 3298791 - DNA, 18 bp, Homo sapiens
tagtttttacctaccaca

SEQ ID NO: 3298792 - DNA, 21 bp, Homo sapiens
tagtttttcctatcatgttaa

SEQ ID NO: 3298793 - DNA, 13 bp, Homo sapiens
tagtttttgttct

SEQ ID NO: 3298794 - DNA, 21 bp, Homo sapiens
tagtttttgttcttaattgca

SEQ ID NO: 3298795 - DNA, 21 bp, Homo sapiens
tagttttttttgtaaactgta

SEQ ID NO: 3298796 - DNA, 16 bp, Homo sapiens
tataaaaaatgtaaca

SEQ ID NO: 3298797 - DNA, 20 bp, Homo sapiens
tataaaaaccccaaactgtt

SEQ ID NO: 3298798 - DNA, 21 bp, Homo sapiens
tataaaaagaaaagataaaga

SEQ ID NO: 3298799 - DNA, 23 bp, Homo sapiens
tataaaaagaaaagataaagatg

SEQ ID NO: 3298800 - DNA, 12 bp, Homo sapiens
tataaaaagcca

SEQ ID NO: 3298801 - DNA, 13 bp, Homo sapiens
tataaaaatatat

SEQ ID NO: 3298802 - DNA, 15 bp, Homo sapiens
tataaaactttcctc

SEQ ID NO: 3298803 - DNA, 17 bp, Homo sapiens
tataaaatatctatatt

SEQ ID NO: 3298804 - DNA, 14 bp, Homo sapiens
tataaaatgggaag

SEQ ID NO: 3298805 - DNA, 16 bp, Homo sapiens
tataaacagaaatgga

SEQ ID NO: 3298806 - DNA, 18 bp, Homo sapiens
tataaacattaaatgtct

SEQ ID NO: 3298807 - DNA, 19 bp, Homo sapiens
tataaacattaaatgtctt

SEQ ID NO: 3298808 - DNA, 20 bp, Homo sapiens
tataaaccaatcttaaacat

SEQ ID NO: 3298809 - DNA, 23 bp, Homo sapiens
tataaacttagtgcggacaagtt

SEQ ID NO: 3298810 - DNA, 13 bp, Homo sapiens
tataaacttcaga

SEQ ID NO: 3298811 - DNA, 20 bp, Homo sapiens
tatgaagttggcacatttca

SEQ ID NO: 3298812 - DNA, 22 bp, Homo sapiens
tatgaagttggcacatttcatg

SEQ ID NO: 3298813 - DNA, 16 bp, Homo sapiens
tatgaatacagggcat

SEQ ID NO: 3298814 - DNA, 13 bp, Homo sapiens
tatgaatatcatt

SEQ ID NO: 3298815 - DNA, 18 bp, Homo sapiens
tatgaatatcattgattt

SEQ ID NO: 3298816 - DNA, 14 bp, Homo sapiens
tatgaattgtacag

SEQ ID NO: 3298817 - DNA, 13 bp, Homo sapiens
tatgacagccatt

SEQ ID NO: 3298818 - DNA, 21 bp, Homo sapiens
tatgacagccatttgtaatga

SEQ ID NO: 3298819 - DNA, 16 bp, Homo sapiens
tatgacatgaaaagtt

SEQ ID NO: 3298820 - DNA, 22 bp, Homo sapiens
tatgacatttaaatgtaactta

SEQ ID NO: 3298821 - DNA, 12 bp, Homo sapiens
tatgacatttct

SEQ ID NO: 3298822 - DNA, 20 bp, Homo sapiens
tatgacgcggctcaaaagga

SEQ ID NO: 3298823 - DNA, 15 bp, Homo sapiens
tatgacgctgataca

SEQ ID NO: 3298824 - DNA, 16 bp, Homo sapiens
tatgacggaagaacat

SEQ ID NO: 3298825 - DNA, 13 bp, Homo sapiens
tatgactaaagag

SEQ ID NO: 3298826 - DNA, 17 bp, Homo sapiens
tatgactaaagagagaa

SEQ ID NO: 3298827 - DNA, 18 bp, Homo sapiens
tatgactaaagagagaat

SEQ ID NO: 3298828 - DNA, 19 bp, Homo sapiens
tatgactaaagagagaatg

SEQ ID NO: 3298829 - DNA, 21 bp, Homo sapiens
tatgactaaagagagaatgta

SEQ ID NO: 3298830 - DNA, 19 bp, Homo sapiens
tatgactttttataaaatg

SEQ ID NO: 3298831 - DNA, 19 bp, Homo sapiens
tatgagatctaatgtgaaa

SEQ ID NO: 3298832 - DNA, 18 bp, Homo sapiens
tatgagatggttaaaaag

SEQ ID NO: 3298833 - DNA, 21 bp, Homo sapiens
tatgagatggttaaaaaggcc

SEQ ID NO: 3298834 - DNA, 22 bp, Homo sapiens
tatgagatggttaaaaaggcca

SEQ ID NO: 3298835 - DNA, 21 bp, Homo sapiens
tatgagattggttttcctgtg

SEQ ID NO: 3298836 - DNA, 13 bp, Homo sapiens
tatgagcagaagg

SEQ ID NO: 3298837 - DNA, 15 bp, Homo sapiens
tatgagcagaaggaa

SEQ ID NO: 3298838 - DNA, 17 bp, Homo sapiens
tatgagcatcctgagcc

SEQ ID NO: 3298839 - DNA, 18 bp, Homo sapiens
tatgagcatcctgagccc

SEQ ID NO: 3298840 - DNA, 20 bp, Homo sapiens
tatgagcatcctgagccccg

SEQ ID NO: 3298841 - DNA, 22 bp, Homo sapiens
tatgagcatcctgagccccgcc

SEQ ID NO: 3298842 - DNA, 17 bp, Homo sapiens
tatgagccagacaaatg

SEQ ID NO: 3298843 - DNA, 18 bp, Homo sapiens
tatgagcttccttctgtg

SEQ ID NO: 3298844 - DNA, 17 bp, Homo sapiens
tatgaggacaaggtata

SEQ ID NO: 3298845 - DNA, 20 bp, Homo sapiens
tatgaggacaaggtatacac

SEQ ID NO: 3298846 - DNA, 17 bp, Homo sapiens
tatgaggacttgtgtct

SEQ ID NO: 3298847 - DNA, 14 bp, Homo sapiens
tatgagtatacaat

SEQ ID NO: 3298848 - DNA, 15 bp, Homo sapiens
tatgagtatacaata

SEQ ID NO: 3298849 - DNA, 23 bp, Homo sapiens
tatgagtatacaatatataaaaa

SEQ ID NO: 3298850 - DNA, 16 bp, Homo sapiens
tatgagtcaatgtgca

SEQ ID NO: 3298851 - DNA, 23 bp, Homo sapiens
tatgagtcaatgtgcagtgtagc

SEQ ID NO: 3298852 - DNA, 15 bp, Homo sapiens
tatgataaaacactg

SEQ ID NO: 3298853 - DNA, 16 bp, Homo sapiens
tatgataatagattct

SEQ ID NO: 3298854 - DNA, 17 bp, Homo sapiens
tatgataatagattctc

SEQ ID NO: 3298855 - DNA, 13 bp, Homo sapiens
tatgataatatat

SEQ ID NO: 3298856 - DNA, 13 bp, Homo sapiens
tatgatattgttt

SEQ ID NO: 3298857 - DNA, 19 bp, Homo sapiens
tatgatatttcttgctttc

SEQ ID NO: 3298858 - DNA, 22 bp, Homo sapiens
tatgatattttctgtgcctgaa

SEQ ID NO: 3298859 - DNA, 19 bp, Homo sapiens
tatgatcagtactgacttt

SEQ ID NO: 3298860 - DNA, 18 bp, Homo sapiens
tatgatcagtgttactgc

SEQ ID NO: 3298861 - DNA, 15 bp, Homo sapiens
tatgatcccagcact

SEQ ID NO: 3298862 - DNA, 13 bp, Homo sapiens
tatgatccttttt

SEQ ID NO: 3298863 - DNA, 18 bp, Homo sapiens
tatgatgagattcactta

SEQ ID NO: 3298864 - DNA, 22 bp, Homo sapiens
tatgatgatacaagattagaag

SEQ ID NO: 3298865 - DNA, 23 bp, Homo sapiens
tatgatgcatacagttttctagc

SEQ ID NO: 3298866 - DNA, 13 bp, Homo sapiens
tatgatggatggc

SEQ ID NO: 3298867 - DNA, 17 bp, Homo sapiens
tatgatgtgttgtgata

SEQ ID NO: 3298868 - DNA, 18 bp, Homo sapiens
tatgatgtgttgtgatag

SEQ ID NO: 3298869 - DNA, 12 bp, Homo sapiens
tatgattattaa

SEQ ID NO: 3298870 - DNA, 22 bp, Homo sapiens
tatgattcactatttaaactat

SEQ ID NO: 3298871 - DNA, 18 bp, Homo sapiens
tatgattccaatctctgt

SEQ ID NO: 3298872 - DNA, 15 bp, Homo sapiens
tatgattctattata

SEQ ID NO: 3298873 - DNA, 18 bp, Homo sapiens
tatgatttatagtttgta

SEQ ID NO: 3298874 - DNA, 19 bp, Homo sapiens
tatgatttgttttgaattt

SEQ ID NO: 3298875 - DNA, 17 bp, Homo sapiens
tatgatttttttttcat

SEQ ID NO: 3298876 - DNA, 19 bp, Homo sapiens
tatgatttttttttcatac

SEQ ID NO: 3298877 - DNA, 14 bp, Homo sapiens
tatgcaagcagctt

SEQ ID NO: 3298878 - DNA, 19 bp, Homo sapiens
tatgcaagcagctttttat

SEQ ID NO: 3298879 - DNA, 21 bp, Homo sapiens
tatgcaaggtatttctccagt

SEQ ID NO: 3298880 - DNA, 14 bp, Homo sapiens
tatgcaagtctgtg

SEQ ID NO: 3298881 - DNA, 16 bp, Homo sapiens
tatgcaatttcctttt

SEQ ID NO: 3298882 - DNA, 21 bp, Homo sapiens
tatgcacacctcccaccccct

SEQ ID NO: 3298883 - DNA, 13 bp, Homo sapiens
tatgcacagagcc

SEQ ID NO: 3298884 - DNA, 22 bp, Homo sapiens
tatgcacagagcccaatgcata

SEQ ID NO: 3298885 - DNA, 19 bp, Homo sapiens
tatgcacatatggactctg

SEQ ID NO: 3298886 - DNA, 20 bp, Homo sapiens
tatgcacatatggactctgc

SEQ ID NO: 3298887 - DNA, 15 bp, Homo sapiens
tatgcactaaatatg

SEQ ID NO: 3298888 - DNA, 20 bp, Homo sapiens
tatgcagaaatagacaaaaa

SEQ ID NO: 3298889 - DNA, 22 bp, Homo sapiens
tatgcagaaatagacaaaaagt

SEQ ID NO: 3298890 - DNA, 17 bp, Homo sapiens
tatgcagaagcatattt

SEQ ID NO: 3298891 - DNA, 17 bp, Homo sapiens
tatgcagatagaatcaa

SEQ ID NO: 3298892 - DNA, 15 bp, Homo sapiens
tatgcagcctgctct

SEQ ID NO: 3298893 - DNA, 19 bp, Homo sapiens
tatgcagtgatatggcaga

SEQ ID NO: 3298894 - DNA, 15 bp, Homo sapiens
tatgcattcttataa

SEQ ID NO: 3298895 - DNA, 14 bp, Homo sapiens
tatgcatttcattc

SEQ ID NO: 3298896 - DNA, 18 bp, Homo sapiens
tatgccacacctggcctt

SEQ ID NO: 3298897 - DNA, 21 bp, Homo sapiens
tatgccaccccatgtgccttt

SEQ ID NO: 3298898 - DNA, 14 bp, Homo sapiens
tatgccatgatgga

SEQ ID NO: 3298899 - DNA, 14 bp, Homo sapiens
tatgccatttgttt

SEQ ID NO: 3298900 - DNA, 23 bp, Homo sapiens
tatgccccttcttgggccccaga

SEQ ID NO: 3298901 - DNA, 13 bp, Homo sapiens
tatgcctgaatga

SEQ ID NO: 3298902 - DNA, 18 bp, Homo sapiens
tatgccttggggaggaca

SEQ ID NO: 3298903 - DNA, 16 bp, Homo sapiens
tatgcctttaaatctg

SEQ ID NO: 3298904 - DNA, 22 bp, Homo sapiens
tatgctaaattaattacaatta

SEQ ID NO: 3298905 - DNA, 18 bp, Homo sapiens
tatgctctcactgtttgt

SEQ ID NO: 3298906 - DNA, 16 bp, Homo sapiens
tatgctcttttttact

SEQ ID NO: 3298907 - DNA, 22 bp, Homo sapiens
tatgctgatcatcgccagaggt

SEQ ID NO: 3298908 - DNA, 15 bp, Homo sapiens
tatgctgatgatcaa

SEQ ID NO: 3298909 - DNA, 15 bp, Homo sapiens
tatgctgatttattt

SEQ ID NO: 3298910 - DNA, 18 bp, Homo sapiens
tatgctggccagcaccct

SEQ ID NO: 3298911 - DNA, 19 bp, Homo sapiens
tatgctggccagcaccctc

SEQ ID NO: 3298912 - DNA, 22 bp, Homo sapiens
tatgctggccagcaccctctcc

SEQ ID NO: 3298913 - DNA, 14 bp, Homo sapiens
tatgctgtatttta

SEQ ID NO: 3298914 - DNA, 15 bp, Homo sapiens
tatgctgtcatggtc

SEQ ID NO: 3298915 - DNA, 13 bp, Homo sapiens
tatgcttaaaata

SEQ ID NO: 3298916 - DNA, 15 bp, Homo sapiens
tatgcttactgatat

SEQ ID NO: 3298917 - DNA, 16 bp, Homo sapiens
tatgcttactgatata

SEQ ID NO: 3298918 - DNA, 18 bp, Homo sapiens
tatgcttccacaggcaaa

SEQ ID NO: 3298919 - DNA, 14 bp, Homo sapiens
tatggaaaaataaa

SEQ ID NO: 3298920 - DNA, 23 bp, Homo sapiens
tatggaaacactgattttgtaaa

SEQ ID NO: 3298921 - DNA, 17 bp, Homo sapiens
tatggaaataaatgtat

SEQ ID NO: 3298922 - DNA, 20 bp, Homo sapiens
tatggaaccttccctccaaa

SEQ ID NO: 3298923 - DNA, 13 bp, Homo sapiens
tatggaacttcta

SEQ ID NO: 3298924 - DNA, 17 bp, Homo sapiens
tatggaacttctaatat

SEQ ID NO: 3298925 - DNA, 20 bp, Homo sapiens
tatggaacttctaatatatt

SEQ ID NO: 3298926 - DNA, 13 bp, Homo sapiens
tatggaagaaagt

SEQ ID NO: 3298927 - DNA, 18 bp, Homo sapiens
tatggaagttgcataatt

SEQ ID NO: 3298928 - DNA, 23 bp, Homo sapiens
tatggaatacagtgttattttct

SEQ ID NO: 3298929 - DNA, 24 bp, Homo sapiens
tatggaatacagtgttattttctt

SEQ ID NO: 3298930 - DNA, 18 bp, Homo sapiens
tatggaattacatgtaaa

SEQ ID NO: 3298931 - DNA, 22 bp, Homo sapiens
tatggaattacatgtaaaacat

SEQ ID NO: 3298932 - DNA, 11 bp, Homo sapiens
tatggaattga

SEQ ID NO: 3298933 - DNA, 22 bp, Homo sapiens
tatggacaacttatttaaaaat

SEQ ID NO: 3298934 - DNA, 18 bp, Homo sapiens
tatggacagggctgtctc

SEQ ID NO: 3298935 - DNA, 21 bp, Homo sapiens
tatggactatctgtctggtgg

SEQ ID NO: 3298936 - DNA, 15 bp, Homo sapiens
tatttgggaagtgaa

SEQ ID NO: 3298937 - DNA, 20 bp, Homo sapiens
tatttgggggaactggacac

SEQ ID NO: 3298938 - DNA, 19 bp, Homo sapiens
tatttgtaaaccattgtaa

SEQ ID NO: 3298939 - DNA, 18 bp, Homo sapiens
tatttgtataaaagtgtg

SEQ ID NO: 3298940 - DNA, 15 bp, Homo sapiens
tatttgtatctctga

SEQ ID NO: 3298941 - DNA, 13 bp, Homo sapiens
tatttgtattaat

SEQ ID NO: 3298942 - DNA, 14 bp, Homo sapiens
tatttgtattaata

SEQ ID NO: 3298943 - DNA, 20 bp, Homo sapiens
tatttgtattaataaagcat

SEQ ID NO: 3298944 - DNA, 15 bp, Homo sapiens
tatttgtgagactgt

SEQ ID NO: 3298945 - DNA, 14 bp, Homo sapiens
tatttgtggaataa

SEQ ID NO: 3298946 - DNA, 13 bp, Homo sapiens
tatttgtgtaata

SEQ ID NO: 3298947 - DNA, 19 bp, Homo sapiens
tatttgtgtattttcctgg

SEQ ID NO: 3298948 - DNA, 12 bp, Homo sapiens
tatttgtgtttt

SEQ ID NO: 3298949 - DNA, 21 bp, Homo sapiens
tatttgtgttttaatttaaac

SEQ ID NO: 3298950 - DNA, 17 bp, Homo sapiens
tatttgttattttcagt

SEQ ID NO: 3298951 - DNA, 14 bp, Homo sapiens
tatttgttcagaga

SEQ ID NO: 3298952 - DNA, 14 bp, Homo sapiens
tatttgttcattat

SEQ ID NO: 3298953 - DNA, 20 bp, Homo sapiens
tatttgttcattatttgtgc

SEQ ID NO: 3298954 - DNA, 14 bp, Homo sapiens
tatttgttttcatg

SEQ ID NO: 3298955 - DNA, 19 bp, Homo sapiens
tattttaaacaaaatagaa

SEQ ID NO: 3298956 - DNA, 20 bp, Homo sapiens
tattttaaatataaatagct

SEQ ID NO: 3298957 - DNA, 17 bp, Homo sapiens
tattttaacactttgta

SEQ ID NO: 3298958 - DNA, 18 bp, Homo sapiens
tattttaagactgatttt

SEQ ID NO: 3298959 - DNA, 23 bp, Homo sapiens
tattttaagactgattttaatag

SEQ ID NO: 3298960 - DNA, 13 bp, Homo sapiens
tattttaatagaa

SEQ ID NO: 3298961 - DNA, 17 bp, Homo sapiens
tattttaatattgatgt

SEQ ID NO: 3298962 - DNA, 13 bp, Homo sapiens
tattttaatcctg

SEQ ID NO: 3298963 - DNA, 14 bp, Homo sapiens
tattttaatcctgt

SEQ ID NO: 3298964 - DNA, 15 bp, Homo sapiens
tattttaatgaatat

SEQ ID NO: 3298965 - DNA, 13 bp, Homo sapiens
tattttaatgtga

SEQ ID NO: 3298966 - DNA, 14 bp, Homo sapiens
tattttacaatttt

SEQ ID NO: 3298967 - DNA, 23 bp, Homo sapiens
tattttacaattttttatcatgc

SEQ ID NO: 3298968 - DNA, 22 bp, Homo sapiens
tattttacatgaagctgtataa

SEQ ID NO: 3298969 - DNA, 17 bp, Homo sapiens
tattttactattggaat

SEQ ID NO: 3298970 - DNA, 14 bp, Homo sapiens
tattttacttgaat

SEQ ID NO: 3298971 - DNA, 22 bp, Homo sapiens
tattttaggcactgttcaatac

SEQ ID NO: 3298972 - DNA, 19 bp, Homo sapiens
tattttcaacgcagccctg

SEQ ID NO: 3298973 - DNA, 11 bp, Homo sapiens
tattttcaaga

SEQ ID NO: 3298974 - DNA, 12 bp, Homo sapiens
tattttcaagag

SEQ ID NO: 3298975 - DNA, 16 bp, Homo sapiens
tattttcacaatgtca

SEQ ID NO: 3298976 - DNA, 12 bp, Homo sapiens
tattttcagaat

SEQ ID NO: 3298977 - DNA, 13 bp, Homo sapiens
tattttcagaatc

SEQ ID NO: 3298978 - DNA, 14 bp, Homo sapiens
tattttcagaatct

SEQ ID NO: 3298979 - DNA, 21 bp, Homo sapiens
tattttcagaatctgaatgta

SEQ ID NO: 3298980 - DNA, 22 bp, Homo sapiens
tattttcagaatctgaatgtaa

SEQ ID NO: 3298981 - DNA, 16 bp, Homo sapiens
tattttcagctcaatt

SEQ ID NO: 3298982 - DNA, 23 bp, Homo sapiens
tattttcagctcaattgttaatg

SEQ ID NO: 3298983 - DNA, 12 bp, Homo sapiens
tattttcagtac

SEQ ID NO: 3298984 - DNA, 19 bp, Homo sapiens
tattttcagtatactgtgt

SEQ ID NO: 3298985 - DNA, 14 bp, Homo sapiens
tattttcatgaaaa

SEQ ID NO: 3298986 - DNA, 20 bp, Homo sapiens
tattttcatgaaaataccat

SEQ ID NO: 3298987 - DNA, 17 bp, Homo sapiens
tattttcattacaatgg

SEQ ID NO: 3298988 - DNA, 21 bp, Homo sapiens
tattttcattacaatggaaac

SEQ ID NO: 3298989 - DNA, 15 bp, Homo sapiens
tattttcctggattt

SEQ ID NO: 3298990 - DNA, 14 bp, Homo sapiens
tattttcctttaga

SEQ ID NO: 3298991 - DNA, 17 bp, Homo sapiens
tattttcgtatgaaaat

SEQ ID NO: 3298992 - DNA, 14 bp, Homo sapiens
tattttctatttta

SEQ ID NO: 3298993 - DNA, 19 bp, Homo sapiens
tattttctattttaagact

SEQ ID NO: 3298994 - DNA, 20 bp, Homo sapiens
tattttctccaaataaaaat

SEQ ID NO: 3298995 - DNA, 20 bp, Homo sapiens
tattttctctgtacttttca

SEQ ID NO: 3298996 - DNA, 13 bp, Homo sapiens
tattttctgaatt

SEQ ID NO: 3298997 - DNA, 23 bp, Homo sapiens
tattttctgcagaaatttgcaac

SEQ ID NO: 3298998 - DNA, 22 bp, Homo sapiens
tattttctggtagatagaaata

SEQ ID NO: 3298999 - DNA, 13 bp, Homo sapiens
tattttctgtcag

SEQ ID NO: 3299000 - DNA, 14 bp, Homo sapiens
tattttctgtcaga

SEQ ID NO: 3299001 - DNA, 20 bp, Homo sapiens
tattttctgtcagatgagaa

SEQ ID NO: 3299002 - DNA, 21 bp, Homo sapiens
tattttctgtcagatgagaac

SEQ ID NO: 3299003 - DNA, 12 bp, Homo sapiens
tattttcttaaa

SEQ ID NO: 3299004 - DNA, 15 bp, Homo sapiens
tattttcttaaacca

SEQ ID NO: 3299005 - DNA, 16 bp, Homo sapiens
tattttgaaaagcttc

SEQ ID NO: 3299006 - DNA, 17 bp, Homo sapiens
tattttgaaaagcttct

SEQ ID NO: 3299007 - DNA, 20 bp, Homo sapiens
tattttgaaaagcttcttaa

SEQ ID NO: 3299008 - DNA, 11 bp, Homo sapiens
tattttgaatg

SEQ ID NO: 3299009 - DNA, 13 bp, Homo sapiens
tattttgaatgtc

SEQ ID NO: 3299010 - DNA, 14 bp, Homo sapiens
tattttgataataa

SEQ ID NO: 3299011 - DNA, 20 bp, Homo sapiens
tattttgatgagatattaaa

SEQ ID NO: 3299012 - DNA, 16 bp, Homo sapiens
tattttgattattgta

SEQ ID NO: 3299013 - DNA, 17 bp, Homo sapiens
tattttgattattgtat

SEQ ID NO: 3299014 - DNA, 18 bp, Homo sapiens
tattttgcatatatgttc

SEQ ID NO: 3299015 - DNA, 19 bp, Homo sapiens
tattttgctgagttgttct

SEQ ID NO: 3299016 - DNA, 21 bp, Homo sapiens
tattttgctgagttgttctaa

SEQ ID NO: 3299017 - DNA, 16 bp, Homo sapiens
tattttgctttggtta

SEQ ID NO: 3299018 - DNA, 23 bp, Homo sapiens
tattttggaaactgctaaattct

SEQ ID NO: 3299019 - DNA, 22 bp, Homo sapiens
tattttggagtgtaggtgactt

SEQ ID NO: 3299020 - DNA, 21 bp, Homo sapiens
tattttggatatattattgta

SEQ ID NO: 3299021 - DNA, 17 bp, Homo sapiens
tattttggcttcatttc

SEQ ID NO: 3299022 - DNA, 14 bp, Homo sapiens
tattttggtacttt

SEQ ID NO: 3299023 - DNA, 17 bp, Homo sapiens
tattttgtcttattctt

SEQ ID NO: 3299024 - DNA, 19 bp, Homo sapiens
tattttgtcttattcttaa

SEQ ID NO: 3299025 - DNA, 19 bp, Homo sapiens
tattttgtgatgatgctgt

SEQ ID NO: 3299026 - DNA, 15 bp, Homo sapiens
tattttgtgtacaag

SEQ ID NO: 3299027 - DNA, 17 bp, Homo sapiens
tattttgtgtgaaattg

SEQ ID NO: 3299028 - DNA, 17 bp, Homo sapiens
tattttgtgtgaccaac

SEQ ID NO: 3299029 - DNA, 23 bp, Homo sapiens
tattttgtgtgaccaactgtgtt

SEQ ID NO: 3299030 - DNA, 17 bp, Homo sapiens
tattttgttacactaaa

SEQ ID NO: 3299031 - DNA, 21 bp, Homo sapiens
tattttgttttgtgcagagat

SEQ ID NO: 3299032 - DNA, 24 bp, Homo sapiens
tattttgttttttttgactaaagc

SEQ ID NO: 3299033 - DNA, 19 bp, Homo sapiens
tatttttaaaaagaaatct

SEQ ID NO: 3299034 - DNA, 15 bp, Homo sapiens
tatttttaaagatag

SEQ ID NO: 3299035 - DNA, 12 bp, Homo sapiens
tatttttaatgg

SEQ ID NO: 3299036 - DNA, 13 bp, Homo sapiens
tatttttagatgg

SEQ ID NO: 3299037 - DNA, 22 bp, Homo sapiens
tatttttataaatataagcctt

SEQ ID NO: 3299038 - DNA, 23 bp, Homo sapiens
tatttttatatagcttgaaacat

SEQ ID NO: 3299039 - DNA, 21 bp, Homo sapiens
tatttttatatttagttatag

SEQ ID NO: 3299040 - DNA, 18 bp, Homo sapiens
tatttttatcatgaattc

SEQ ID NO: 3299041 - DNA, 12 bp, Homo sapiens
tatttttatctt

SEQ ID NO: 3299042 - DNA, 20 bp, Homo sapiens
tatttttcaataaagcattt

SEQ ID NO: 3299043 - DNA, 12 bp, Homo sapiens
tatttttcaatc

SEQ ID NO: 3299044 - DNA, 15 bp, Homo sapiens
tatttttcacagttt

SEQ ID NO: 3299045 - DNA, 14 bp, Homo sapiens
tatttttcatattg

SEQ ID NO: 3299046 - DNA, 19 bp, Homo sapiens
tatttttcatattgtgcca

SEQ ID NO: 3299047 - DNA, 22 bp, Homo sapiens
tatttttgaaaggcatgttcct

SEQ ID NO: 3299048 - DNA, 20 bp, Homo sapiens
tatttttgaacccctgtgtc

SEQ ID NO: 3299049 - DNA, 13 bp, Homo sapiens
tatttttgccctg

SEQ ID NO: 3299050 - DNA, 19 bp, Homo sapiens
tatttttggcagtctgaat

SEQ ID NO: 3299051 - DNA, 14 bp, Homo sapiens
tatttttggggcat

SEQ ID NO: 3299052 - DNA, 12 bp, Homo sapiens
tatttttgtaaa

SEQ ID NO: 3299053 - DNA, 22 bp, Homo sapiens
tatttttgtgaagtattcacaa

SEQ ID NO: 3299054 - DNA, 13 bp, Homo sapiens
tatttttgttgtt

SEQ ID NO: 3299055 - DNA, 22 bp, Homo sapiens
tatttttgttgttgttgtttgt

SEQ ID NO: 3299056 - DNA, 15 bp, Homo sapiens
tatttttttaaaatt

SEQ ID NO: 3299057 - DNA, 19 bp, Homo sapiens
tatttttttagattgagaa

SEQ ID NO: 3299058 - DNA, 13 bp, Homo sapiens
tattttttttggc

SEQ ID NO: 3299059 - DNA, 21 bp, Homo sapiens
tattttttttttcttcttggg

SEQ ID NO: 3299060 - DNA, 20 bp, Homo sapiens
tcaaaaaaaaaaaaatgcac

SEQ ID NO: 3299061 - DNA, 16 bp, Homo sapiens
tcaaaaaaaagaaaaa

SEQ ID NO: 3299062 - DNA, 17 bp, Homo sapiens
tcacctgtgacaaagga

SEQ ID NO: 3299063 - DNA, 19 bp, Homo sapiens
tcacctgtttttaagctgt

SEQ ID NO: 3299064 - DNA, 20 bp, Homo sapiens
tcacctgtttttaagctgtt

SEQ ID NO: 3299065 - DNA, 21 bp, Homo sapiens
tcaccttgtaaccagtgcaga

SEQ ID NO: 3299066 - DNA, 17 bp, Homo sapiens
tcacctttgtgtatttt

SEQ ID NO: 3299067 - DNA, 17 bp, Homo sapiens
tcaccttttcaggaaaa

SEQ ID NO: 3299068 - DNA, 13 bp, Homo sapiens
tcacgccactgca

SEQ ID NO: 3299069 - DNA, 22 bp, Homo sapiens
tcacgcctgtaatcccagcact

SEQ ID NO: 3299070 - DNA, 23 bp, Homo sapiens
tcacgcctgtaatcccagcactt

SEQ ID NO: 3299071 - DNA, 20 bp, Homo sapiens
tcacgctcccccgcagtccc

SEQ ID NO: 3299072 - DNA, 20 bp, Homo sapiens
tcacgctggggctctctgag

SEQ ID NO: 3299073 - DNA, 15 bp, Homo sapiens
tcacgctttcctgaa

SEQ ID NO: 3299074 - DNA, 16 bp, Homo sapiens
tcacgctttcctgaat

SEQ ID NO: 3299075 - DNA, 13 bp, Homo sapiens
tcacggctcactg

SEQ ID NO: 3299076 - DNA, 15 bp, Homo sapiens
tcacggctcactgca

SEQ ID NO: 3299077 - DNA, 20 bp, Homo sapiens
tcacggctcactgcagcctc

SEQ ID NO: 3299078 - DNA, 20 bp, Homo sapiens
tcacgggcatgggcactccc

SEQ ID NO: 3299079 - DNA, 17 bp, Homo sapiens
tcacggtgccaggtttt

SEQ ID NO: 3299080 - DNA, 17 bp, Homo sapiens
tcacgtaagatacaagt

SEQ ID NO: 3299081 - DNA, 13 bp, Homo sapiens
tcacgtaccccac

SEQ ID NO: 3299082 - DNA, 17 bp, Homo sapiens
tcactaaactttatttg

SEQ ID NO: 3299083 - DNA, 14 bp, Homo sapiens
tcactaacattata

SEQ ID NO: 3299084 - DNA, 15 bp, Homo sapiens
tcactaatttttgta

SEQ ID NO: 3299085 - DNA, 19 bp, Homo sapiens
tcactacaagtcagctcca

SEQ ID NO: 3299086 - DNA, 22 bp, Homo sapiens
tcactactcacagtctctttaa

SEQ ID NO: 3299087 - DNA, 16 bp, Homo sapiens
tcactagaagaaaagc

SEQ ID NO: 3299088 - DNA, 21 bp, Homo sapiens
tcactagagacaaatctttaa

SEQ ID NO: 3299089 - DNA, 24 bp, Homo sapiens
tcactagcatagaatagcgacagg

SEQ ID NO: 3299090 - DNA, 15 bp, Homo sapiens
tcactagctttgcct

SEQ ID NO: 3299091 - DNA, 21 bp, Homo sapiens
tcactaggcccccacttgcct

SEQ ID NO: 3299092 - DNA, 22 bp, Homo sapiens
tcactaggcccccacttgcctc

SEQ ID NO: 3299093 - DNA, 14 bp, Homo sapiens
tcactaggtaactt

SEQ ID NO: 3299094 - DNA, 13 bp, Homo sapiens
tcactataaatgg

SEQ ID NO: 3299095 - DNA, 16 bp, Homo sapiens
tcactatcttcttcaa

SEQ ID NO: 3299096 - DNA, 22 bp, Homo sapiens
tcactatcttcttcaaatacaa

SEQ ID NO: 3299097 - DNA, 17 bp, Homo sapiens
tcactatgggtgagcat

SEQ ID NO: 3299098 - DNA, 17 bp, Homo sapiens
tcactatggtatgctgg

SEQ ID NO: 3299099 - DNA, 20 bp, Homo sapiens
tcactatggtatgctggcca

SEQ ID NO: 3299100 - DNA, 21 bp, Homo sapiens
tcactatggtatgctggccag

SEQ ID NO: 3299101 - DNA, 19 bp, Homo sapiens
tcactccaccatccccacc

SEQ ID NO: 3299102 - DNA, 19 bp, Homo sapiens
tcactcccacctgcatctg

SEQ ID NO: 3299103 - DNA, 13 bp, Homo sapiens
tcactcccagcac

SEQ ID NO: 3299104 - DNA, 18 bp, Homo sapiens
tcactcccagcactcccc

SEQ ID NO: 3299105 - DNA, 22 bp, Homo sapiens
tcactcccagcactccccttgc

SEQ ID NO: 3299106 - DNA, 21 bp, Homo sapiens
tcactccccatgccacgttcc

SEQ ID NO: 3299107 - DNA, 17 bp, Homo sapiens
tcactccctctgccttc

SEQ ID NO: 3299108 - DNA, 14 bp, Homo sapiens
tcactccggtgtgc

SEQ ID NO: 3299109 - DNA, 17 bp, Homo sapiens
tcactccggtgtgcctg

SEQ ID NO: 3299110 - DNA, 15 bp, Homo sapiens
tcactcctacctggt

SEQ ID NO: 3299111 - DNA, 16 bp, Homo sapiens
tcactcctgcctccgc

SEQ ID NO: 3299112 - DNA, 23 bp, Homo sapiens
tcactcctgcctccgctggcttt

SEQ ID NO: 3299113 - DNA, 12 bp, Homo sapiens
tcactcctgggg

SEQ ID NO: 3299114 - DNA, 10 bp, Homo sapiens
tcactcctgt

SEQ ID NO: 3299115 - DNA, 20 bp, Homo sapiens
tcactcctgttacttaccta

SEQ ID NO: 3299116 - DNA, 13 bp, Homo sapiens
tcactctcagtgc

SEQ ID NO: 3299117 - DNA, 14 bp, Homo sapiens
tcactctccagggt

SEQ ID NO: 3299118 - DNA, 15 bp, Homo sapiens
tcactctccagggta

SEQ ID NO: 3299119 - DNA, 14 bp, Homo sapiens
tcactctctattgt

SEQ ID NO: 3299120 - DNA, 11 bp, Homo sapiens
tcactctgcca

SEQ ID NO: 3299121 - DNA, 13 bp, Homo sapiens
tcactctgccagg

SEQ ID NO: 3299122 - DNA, 21 bp, Homo sapiens
tcactctgccagggcagtgct

SEQ ID NO: 3299123 - DNA, 13 bp, Homo sapiens
tcactctggcctc

SEQ ID NO: 3299124 - DNA, 14 bp, Homo sapiens
tcactctggcctca

SEQ ID NO: 3299125 - DNA, 22 bp, Homo sapiens
tcactctgggcacactctgcca

SEQ ID NO: 3299126 - DNA, 13 bp, Homo sapiens
tcactctgggctg

SEQ ID NO: 3299127 - DNA, 15 bp, Homo sapiens
tcactctgtcagcca

SEQ ID NO: 3299128 - DNA, 16 bp, Homo sapiens
tcactctgtcatcttt

SEQ ID NO: 3299129 - DNA, 23 bp, Homo sapiens
tcactctgtccctgtccttccct

SEQ ID NO: 3299130 - DNA, 19 bp, Homo sapiens
tcactctgtcgcccagtct

SEQ ID NO: 3299131 - DNA, 22 bp, Homo sapiens
tcactctgtcgcccagtctgga

SEQ ID NO: 3299132 - DNA, 12 bp, Homo sapiens
tcactcttaggc

SEQ ID NO: 3299133 - DNA, 20 bp, Homo sapiens
tcactcttattgcccacgct

SEQ ID NO: 3299134 - DNA, 21 bp, Homo sapiens
tcactcttattgcccacgctg

SEQ ID NO: 3299135 - DNA, 16 bp, Homo sapiens
tcactgaaacctctgc

SEQ ID NO: 3299136 - DNA, 17 bp, Homo sapiens
tcactgaaacctctgcc

SEQ ID NO: 3299137 - DNA, 20 bp, Homo sapiens
tcactgaaacctctgccttc

SEQ ID NO: 3299138 - DNA, 17 bp, Homo sapiens
tcactgaaatgtttgga

SEQ ID NO: 3299139 - DNA, 11 bp, Homo sapiens
tcactgaagcc

SEQ ID NO: 3299140 - DNA, 14 bp, Homo sapiens
tcactgacacaaag

SEQ ID NO: 3299141 - DNA, 17 bp, Homo sapiens
tcactgacacaaaggaa

SEQ ID NO: 3299142 - DNA, 14 bp, Homo sapiens
tcactgatgtacaa

SEQ ID NO: 3299143 - DNA, 18 bp, Homo sapiens
tcactgcaacctccgcct

SEQ ID NO: 3299144 - DNA, 22 bp, Homo sapiens
tcactgcacagtgcatctcagc

SEQ ID NO: 3299145 - DNA, 18 bp, Homo sapiens
tcactgcactgcatgcaa

SEQ ID NO: 3299146 - DNA, 12 bp, Homo sapiens
tcactgcagcct

SEQ ID NO: 3299147 - DNA, 19 bp, Homo sapiens
tcactgccacactctccat

SEQ ID NO: 3299148 - DNA, 16 bp, Homo sapiens
tcactgccatgatagc

SEQ ID NO: 3299149 - DNA, 20 bp, Homo sapiens
tcactgcccgcacaccctca

SEQ ID NO: 3299150 - DNA, 14 bp, Homo sapiens
tcactgcctgtaga

SEQ ID NO: 3299151 - DNA, 23 bp, Homo sapiens
tcactgctccctgaagccagcct

SEQ ID NO: 3299152 - DNA, 22 bp, Homo sapiens
tcactgctggctgccttagaac

SEQ ID NO: 3299153 - DNA, 13 bp, Homo sapiens
tcactgctgtcat

SEQ ID NO: 3299154 - DNA, 18 bp, Homo sapiens
tcactggaccactgggca

SEQ ID NO: 3299155 - DNA, 11 bp, Homo sapiens
tcactggagcc

SEQ ID NO: 3299156 - DNA, 17 bp, Homo sapiens
tcactggagcccaggag

SEQ ID NO: 3299157 - DNA, 11 bp, Homo sapiens
tcactggctct

SEQ ID NO: 3299158 - DNA, 14 bp, Homo sapiens
tcactggctctcca

SEQ ID NO: 3299159 - DNA, 16 bp, Homo sapiens
tcactggctctccaag

SEQ ID NO: 3299160 - DNA, 19 bp, Homo sapiens
tcactggctctccaagtgc

SEQ ID NO: 3299161 - DNA, 20 bp, Homo sapiens
tcactggctctccaagtgcc

SEQ ID NO: 3299162 - DNA, 14 bp, Homo sapiens
tcactggctggctc

SEQ ID NO: 3299163 - DNA, 18 bp, Homo sapiens
tcactggcttccatcagt

SEQ ID NO: 3299164 - DNA, 17 bp, Homo sapiens
tcactggggcctacagc

SEQ ID NO: 3299165 - DNA, 18 bp, Homo sapiens
tcactgggggctttgggc

SEQ ID NO: 3299166 - DNA, 11 bp, Homo sapiens
tcactgggtgg

SEQ ID NO: 3299167 - DNA, 22 bp, Homo sapiens
tcactgggtgttgatcttacaa

SEQ ID NO: 3299168 - DNA, 18 bp, Homo sapiens
tcactggtagaccaaaat

SEQ ID NO: 3299169 - DNA, 19 bp, Homo sapiens
tcactggtagaccaaaata

SEQ ID NO: 3299170 - DNA, 19 bp, Homo sapiens
tcactggttttacttacaa

SEQ ID NO: 3299171 - DNA, 17 bp, Homo sapiens
tcactgtataaatagga

SEQ ID NO: 3299172 - DNA, 19 bp, Homo sapiens
tcactgtataaataggaga

SEQ ID NO: 3299173 - DNA, 21 bp, Homo sapiens
tcactgtgatcaatattttta

SEQ ID NO: 3299174 - DNA, 19 bp, Homo sapiens
tcactgtgcttcgagccaa

SEQ ID NO: 3299175 - DNA, 17 bp, Homo sapiens
tcactgtggccacagcc

SEQ ID NO: 3299176 - DNA, 17 bp, Homo sapiens
tcactgtgtcacccagg

SEQ ID NO: 3299177 - DNA, 23 bp, Homo sapiens
tcactgtttcatctaagtgcctc

SEQ ID NO: 3299178 - DNA, 17 bp, Homo sapiens
tcactgtttctctgctg

SEQ ID NO: 3299179 - DNA, 18 bp, Homo sapiens
tcactgtttctctgctgt

SEQ ID NO: 3299180 - DNA, 20 bp, Homo sapiens
tcactgtttctctgctgttg

SEQ ID NO: 3299181 - DNA, 16 bp, Homo sapiens
tcactgtttgttttta

SEQ ID NO: 3299182 - DNA, 14 bp, Homo sapiens
tcactgtttttaga

SEQ ID NO: 3299183 - DNA, 17 bp, Homo sapiens
tcactgtttttagacac

SEQ ID NO: 3299184 - DNA, 21 bp, Homo sapiens
tcactgtttttagacaccttc

SEQ ID NO: 3299185 - DNA, 22 bp, Homo sapiens
tcactgtttttttcccaggtgt

SEQ ID NO: 3299186 - DNA, 14 bp, Homo sapiens
tcacttcaatgtgt

SEQ ID NO: 3299187 - DNA, 17 bp, Homo sapiens
tcacttcctacaagagc

SEQ ID NO: 3299188 - DNA, 17 bp, Homo sapiens
tcagtagaattaccatt

SEQ ID NO: 3299189 - DNA, 16 bp, Homo sapiens
tcagtaggtccaaggg

SEQ ID NO: 3299190 - DNA, 19 bp, Homo sapiens
tcagtaggtccaagggcca

SEQ ID NO: 3299191 - DNA, 20 bp, Homo sapiens
tcagtaggtccaagggccat

SEQ ID NO: 3299192 - DNA, 17 bp, Homo sapiens
tcagtataaacaaagtt

SEQ ID NO: 3299193 - DNA, 14 bp, Homo sapiens
tcagtatatttggt

SEQ ID NO: 3299194 - DNA, 13 bp, Homo sapiens
tcagtatccaggc

SEQ ID NO: 3299195 - DNA, 20 bp, Homo sapiens
tcagtatctgtatctctctc

SEQ ID NO: 3299196 - DNA, 21 bp, Homo sapiens
tcagtatgatttatcctcaca

SEQ ID NO: 3299197 - DNA, 16 bp, Homo sapiens
tcagtatgtattcttt

SEQ ID NO: 3299198 - DNA, 17 bp, Homo sapiens
tcagtatttaatgaaac

SEQ ID NO: 3299199 - DNA, 17 bp, Homo sapiens
tcagtatttcaactgct

SEQ ID NO: 3299200 - DNA, 16 bp, Homo sapiens
tcagtattttttttta

SEQ ID NO: 3299201 - DNA, 15 bp, Homo sapiens
tcagtcaaaacttta

SEQ ID NO: 3299202 - DNA, 16 bp, Homo sapiens
tcagtcaatattttta

SEQ ID NO: 3299203 - DNA, 16 bp, Homo sapiens
tcagtcacacacacat

SEQ ID NO: 3299204 - DNA, 23 bp, Homo sapiens
tcagtcagttcccggagcacagc

SEQ ID NO: 3299205 - DNA, 20 bp, Homo sapiens
tcagtcatgcataaatatgc

SEQ ID NO: 3299206 - DNA, 12 bp, Homo sapiens
tcagtccaggat

SEQ ID NO: 3299207 - DNA, 20 bp, Homo sapiens
tcagtcccctcccatctggg

SEQ ID NO: 3299208 - DNA, 18 bp, Homo sapiens
tcagtccctatgtatttg

SEQ ID NO: 3299209 - DNA, 22 bp, Homo sapiens
tcagtcctcccctcacagcctc

SEQ ID NO: 3299210 - DNA, 14 bp, Homo sapiens
tcagtctccctttc

SEQ ID NO: 3299211 - DNA, 12 bp, Homo sapiens
tcagtctcttcc

SEQ ID NO: 3299212 - DNA, 13 bp, Homo sapiens
tcagtctcttcca

SEQ ID NO: 3299213 - DNA, 19 bp, Homo sapiens
tcagtctgattcccaagct

SEQ ID NO: 3299214 - DNA, 23 bp, Homo sapiens
tcagtctgattcccaagctctgc

SEQ ID NO: 3299215 - DNA, 18 bp, Homo sapiens
tcagtcttaatactttat

SEQ ID NO: 3299216 - DNA, 22 bp, Homo sapiens
tcagtctttcttagtgcctgtg

SEQ ID NO: 3299217 - DNA, 11 bp, Homo sapiens
tcagtgacaga

SEQ ID NO: 3299218 - DNA, 15 bp, Homo sapiens
tcagtgacagagttc

SEQ ID NO: 3299219 - DNA, 19 bp, Homo sapiens
tcagtgacagagttcacta

SEQ ID NO: 3299220 - DNA, 14 bp, Homo sapiens
tcagtgactcctgc

SEQ ID NO: 3299221 - DNA, 16 bp, Homo sapiens
tcagtgactcctgctg

SEQ ID NO: 3299222 - DNA, 22 bp, Homo sapiens
tcagtgactcctgctggtacct

SEQ ID NO: 3299223 - DNA, 19 bp, Homo sapiens
tcagtgatgtaccatgaaa

SEQ ID NO: 3299224 - DNA, 22 bp, Homo sapiens
tcagtgattttgtatatgaaaa

SEQ ID NO: 3299225 - DNA, 17 bp, Homo sapiens
tcagtgcaaattgtatc

SEQ ID NO: 3299226 - DNA, 13 bp, Homo sapiens
tcagtgcttgggc

SEQ ID NO: 3299227 - DNA, 12 bp, Homo sapiens
tcagtggcagct

SEQ ID NO: 3299228 - DNA, 17 bp, Homo sapiens
tcagtggcgagaaataa

SEQ ID NO: 3299229 - DNA, 12 bp, Homo sapiens
tcagtggcttcc

SEQ ID NO: 3299230 - DNA, 18 bp, Homo sapiens
tcagtgtacacgtctgga

SEQ ID NO: 3299231 - DNA, 18 bp, Homo sapiens
tcagtgtaccatttgcct

SEQ ID NO: 3299232 - DNA, 19 bp, Homo sapiens
tcagtgtaccatttgcctc

SEQ ID NO: 3299233 - DNA, 17 bp, Homo sapiens
tcagtgtagttaattta

SEQ ID NO: 3299234 - DNA, 18 bp, Homo sapiens
tcagtgtagttaatttat

SEQ ID NO: 3299235 - DNA, 22 bp, Homo sapiens
tcagtgtatggaaataaatgta

SEQ ID NO: 3299236 - DNA, 20 bp, Homo sapiens
tcagtgtcatttatgaaaag

SEQ ID NO: 3299237 - DNA, 13 bp, Homo sapiens
tcagtgtctcaca

SEQ ID NO: 3299238 - DNA, 15 bp, Homo sapiens
tcagtgtctggcttt

SEQ ID NO: 3299239 - DNA, 19 bp, Homo sapiens
tcagtgtgtctaaatttga

SEQ ID NO: 3299240 - DNA, 18 bp, Homo sapiens
tcagtgttgttgctctag

SEQ ID NO: 3299241 - DNA, 23 bp, Homo sapiens
tcagtgttttggactccatctct

SEQ ID NO: 3299242 - DNA, 22 bp, Homo sapiens
tcagtgtttttgaaacccacag

SEQ ID NO: 3299243 - DNA, 21 bp, Homo sapiens
tcagttacaaagtaatttctt

SEQ ID NO: 3299244 - DNA, 21 bp, Homo sapiens
tcagttatacagttataaaat

SEQ ID NO: 3299245 - DNA, 17 bp, Homo sapiens
tcagttatcctttgtga

SEQ ID NO: 3299246 - DNA, 21 bp, Homo sapiens
tcagttcatatttcatttcca

SEQ ID NO: 3299247 - DNA, 19 bp, Homo sapiens
tcagttcattgtggtcctt

SEQ ID NO: 3299248 - DNA, 12 bp, Homo sapiens
tcagttccaaga

SEQ ID NO: 3299249 - DNA, 13 bp, Homo sapiens
tcagttcccagct

SEQ ID NO: 3299250 - DNA, 20 bp, Homo sapiens
tcagttcccccagtacctcc

SEQ ID NO: 3299251 - DNA, 14 bp, Homo sapiens
tcagttcccggagc

SEQ ID NO: 3299252 - DNA, 21 bp, Homo sapiens
tcagttcccggagcacagccc

SEQ ID NO: 3299253 - DNA, 15 bp, Homo sapiens
tcagttcccttggcc

SEQ ID NO: 3299254 - DNA, 16 bp, Homo sapiens
tcagttcccttggcct

SEQ ID NO: 3299255 - DNA, 22 bp, Homo sapiens
tcagttcccttggcctcagaat

SEQ ID NO: 3299256 - DNA, 19 bp, Homo sapiens
tcagttctctcccttcctc

SEQ ID NO: 3299257 - DNA, 17 bp, Homo sapiens
tcagttctgtgtacatt

SEQ ID NO: 3299258 - DNA, 19 bp, Homo sapiens
tcagttctgtgtacatttt

SEQ ID NO: 3299259 - DNA, 23 bp, Homo sapiens
tcagtttatccaaggtgtaactc

SEQ ID NO: 3299260 - DNA, 17 bp, Homo sapiens
tcagtttcatgaaatga

SEQ ID NO: 3299261 - DNA, 18 bp, Homo sapiens
tcagtttctccatcagct

SEQ ID NO: 3299262 - DNA, 22 bp, Homo sapiens
tcagtttcttctgcgcctcagg

SEQ ID NO: 3299263 - DNA, 19 bp, Homo sapiens
tcagtttgctagcagaaat

SEQ ID NO: 3299264 - DNA, 16 bp, Homo sapiens
tcagtttgtgtgtctt

SEQ ID NO: 3299265 - DNA, 13 bp, Homo sapiens
tcagttttaacta

SEQ ID NO: 3299266 - DNA, 13 bp, Homo sapiens
tcagttttgtata

SEQ ID NO: 3299267 - DNA, 15 bp, Homo sapiens
tcagttttgtataac

SEQ ID NO: 3299268 - DNA, 16 bp, Homo sapiens
tcagtttttcatttgt

SEQ ID NO: 3299269 - DNA, 16 bp, Homo sapiens
tcagtttttgtatctt

SEQ ID NO: 3299270 - DNA, 17 bp, Homo sapiens
tcagtttttgtatcttg

SEQ ID NO: 3299271 - DNA, 20 bp, Homo sapiens
tcagttttttgttttacaat

SEQ ID NO: 3299272 - DNA, 15 bp, Homo sapiens
tcataaaaactgctt

SEQ ID NO: 3299273 - DNA, 12 bp, Homo sapiens
tcataaaataaa

SEQ ID NO: 3299274 - DNA, 19 bp, Homo sapiens
tcataaacagatgaataaa

SEQ ID NO: 3299275 - DNA, 12 bp, Homo sapiens
tcataaatgaag

SEQ ID NO: 3299276 - DNA, 12 bp, Homo sapiens
tcataacaatgt

SEQ ID NO: 3299277 - DNA, 13 bp, Homo sapiens
tcataacaatgta

SEQ ID NO: 3299278 - DNA, 17 bp, Homo sapiens
tcataacaatgtatgtg

SEQ ID NO: 3299279 - DNA, 22 bp, Homo sapiens
tcataacagtgccattgtcttt

SEQ ID NO: 3299280 - DNA, 17 bp, Homo sapiens
tcataacttcctgtact

SEQ ID NO: 3299281 - DNA, 15 bp, Homo sapiens
tcataaggcttcaaa

SEQ ID NO: 3299282 - DNA, 16 bp, Homo sapiens
tcataatgctttgtta

SEQ ID NO: 3299283 - DNA, 17 bp, Homo sapiens
tcataattacattccta

SEQ ID NO: 3299284 - DNA, 23 bp, Homo sapiens
tcatacagatcaggcagtgttta

SEQ ID NO: 3299285 - DNA, 17 bp, Homo sapiens
tcatacctaagtactgt

SEQ ID NO: 3299286 - DNA, 21 bp, Homo sapiens
tcatacctaagtactgtaata

SEQ ID NO: 3299287 - DNA, 14 bp, Homo sapiens
tcatacctcagaat

SEQ ID NO: 3299288 - DNA, 16 bp, Homo sapiens
tcatactgaaattatt

SEQ ID NO: 3299289 - DNA, 14 bp, Homo sapiens
tcatactgattttt

SEQ ID NO: 3299290 - DNA, 21 bp, Homo sapiens
tcatactgatttttaagtcaa

SEQ ID NO: 3299291 - DNA, 13 bp, Homo sapiens
tcatactgtctgg

SEQ ID NO: 3299292 - DNA, 19 bp, Homo sapiens
tcatagcattaactaatct

SEQ ID NO: 3299293 - DNA, 14 bp, Homo sapiens
tcatagcccagtag

SEQ ID NO: 3299294 - DNA, 17 bp, Homo sapiens
tcatagctgagattcct

SEQ ID NO: 3299295 - DNA, 20 bp, Homo sapiens
tcataggaaaagtacattta

SEQ ID NO: 3299296 - DNA, 20 bp, Homo sapiens
tcataggaagggaccaaggc

SEQ ID NO: 3299297 - DNA, 13 bp, Homo sapiens
tcataggagactg

SEQ ID NO: 3299298 - DNA, 15 bp, Homo sapiens
tcataggagactgcg

SEQ ID NO: 3299299 - DNA, 22 bp, Homo sapiens
tcatagggaaaggttttgtatt

SEQ ID NO: 3299300 - DNA, 16 bp, Homo sapiens
tcataggtatttcaaa

SEQ ID NO: 3299301 - DNA, 23 bp, Homo sapiens
tcataggtcactggctctccaag

SEQ ID NO: 3299302 - DNA, 14 bp, Homo sapiens
tcataggttaaaaa

SEQ ID NO: 3299303 - DNA, 23 bp, Homo sapiens
tcataggttaaaaaaaaaagtca

SEQ ID NO: 3299304 - DNA, 18 bp, Homo sapiens
tcatagtaacttcttatg

SEQ ID NO: 3299305 - DNA, 20 bp, Homo sapiens
tcatagtactctttgtagca

SEQ ID NO: 3299306 - DNA, 13 bp, Homo sapiens
tcatagttcagaa

SEQ ID NO: 3299307 - DNA, 14 bp, Homo sapiens
tcatagttcagaat

SEQ ID NO: 3299308 - DNA, 18 bp, Homo sapiens
tcatagttcagaatttag

SEQ ID NO: 3299309 - DNA, 13 bp, Homo sapiens
tcatataaacatt

SEQ ID NO: 3299310 - DNA, 21 bp, Homo sapiens
tcatataaacattttatttat

SEQ ID NO: 3299311 - DNA, 18 bp, Homo sapiens
tcatataagattcatatt

SEQ ID NO: 3299312 - DNA, 17 bp, Homo sapiens
tcatataccagcaatat

SEQ ID NO: 3299313 - DNA, 13 bp, Homo sapiens
tcatatatacata

SEQ ID NO: 3299314 - DNA, 17 bp, Homo sapiens
tccagaagaatattcag

SEQ ID NO: 3299315 - DNA, 15 bp, Homo sapiens
tccagaatctgctgt

SEQ ID NO: 3299316 - DNA, 19 bp, Homo sapiens
tccagaatctgctgttgcc

SEQ ID NO: 3299317 - DNA, 13 bp, Homo sapiens
tccagaatgctgt

SEQ ID NO: 3299318 - DNA, 16 bp, Homo sapiens
tccagaatgctgtaca

SEQ ID NO: 3299319 - DNA, 18 bp, Homo sapiens
tccagaatgctgtacatc

SEQ ID NO: 3299320 - DNA, 21 bp, Homo sapiens
tccagaatgctgtacatctat

SEQ ID NO: 3299321 - DNA, 13 bp, Homo sapiens
tccagaatgtaag

SEQ ID NO: 3299322 - DNA, 22 bp, Homo sapiens
tccagaatgtaagaaaacaaaa

SEQ ID NO: 3299323 - DNA, 22 bp, Homo sapiens
tccagaatttggaaatcctagt

SEQ ID NO: 3299324 - DNA, 13 bp, Homo sapiens
tccagacatcatg

SEQ ID NO: 3299325 - DNA, 14 bp, Homo sapiens
tccagacccggctg

SEQ ID NO: 3299326 - DNA, 15 bp, Homo sapiens
tccagacccggctgc

SEQ ID NO: 3299327 - DNA, 22 bp, Homo sapiens
tccagactgcttccaattttct

SEQ ID NO: 3299328 - DNA, 13 bp, Homo sapiens
tccagactgtaag

SEQ ID NO: 3299329 - DNA, 15 bp, Homo sapiens
tccagacttcaaaag

SEQ ID NO: 3299330 - DNA, 14 bp, Homo sapiens
tccagagacaacag

SEQ ID NO: 3299331 - DNA, 15 bp, Homo sapiens
tccagagacaacagg

SEQ ID NO: 3299332 - DNA, 22 bp, Homo sapiens
tccagagagtggctcctcccgg

SEQ ID NO: 3299333 - DNA, 23 bp, Homo sapiens
tccagagcagagtttacgggtct

SEQ ID NO: 3299334 - DNA, 16 bp, Homo sapiens
tccagagccagcctgg

SEQ ID NO: 3299335 - DNA, 18 bp, Homo sapiens
tccagagccagcctggga

SEQ ID NO: 3299336 - DNA, 20 bp, Homo sapiens
tccagagcggaggctgtgtg

SEQ ID NO: 3299337 - DNA, 20 bp, Homo sapiens
tccagaggctattattttca

SEQ ID NO: 3299338 - DNA, 22 bp, Homo sapiens
tccagagtctgagcccccggct

SEQ ID NO: 3299339 - DNA, 14 bp, Homo sapiens
tccagatagagaaa

SEQ ID NO: 3299340 - DNA, 15 bp, Homo sapiens
tccagatagtgtagc

SEQ ID NO: 3299341 - DNA, 17 bp, Homo sapiens
tccagattgacgacaag

SEQ ID NO: 3299342 - DNA, 19 bp, Homo sapiens
tccagatttttcggaggcc

SEQ ID NO: 3299343 - DNA, 18 bp, Homo sapiens
tccagcaccttctttctg

SEQ ID NO: 3299344 - DNA, 13 bp, Homo sapiens
tccagcagctgcg

SEQ ID NO: 3299345 - DNA, 19 bp, Homo sapiens
tccagcatccagcctgtgt

SEQ ID NO: 3299346 - DNA, 15 bp, Homo sapiens
tccagccaccaccca

SEQ ID NO: 3299347 - DNA, 10 bp, Homo sapiens
tccagccact

SEQ ID NO: 3299348 - DNA, 21 bp, Homo sapiens
tccagccacttccccctcttc

SEQ ID NO: 3299349 - DNA, 23 bp, Homo sapiens
tccagccagcaatgatgtccaga

SEQ ID NO: 3299350 - DNA, 15 bp, Homo sapiens
tccagcccacattgg

SEQ ID NO: 3299351 - DNA, 18 bp, Homo sapiens
tccagcccatctcggagc

SEQ ID NO: 3299352 - DNA, 15 bp, Homo sapiens
tccagcccctctggt

SEQ ID NO: 3299353 - DNA, 23 bp, Homo sapiens
tccagcccctctggtcgctcctg

SEQ ID NO: 3299354 - DNA, 12 bp, Homo sapiens
tccagcccctgt

SEQ ID NO: 3299355 - DNA, 14 bp, Homo sapiens
tccagcccgggagc

SEQ ID NO: 3299356 - DNA, 19 bp, Homo sapiens
tccagccgaagctgcaggg

SEQ ID NO: 3299357 - DNA, 21 bp, Homo sapiens
tccagccgccattgccaccag

SEQ ID NO: 3299358 - DNA, 20 bp, Homo sapiens
tccagcctgcccaagcccag

SEQ ID NO: 3299359 - DNA, 12 bp, Homo sapiens
tccagcctgggt

SEQ ID NO: 3299360 - DNA, 18 bp, Homo sapiens
tccagcctgggtgacaga

SEQ ID NO: 3299361 - DNA, 14 bp, Homo sapiens
tccagcctgtgtgt

SEQ ID NO: 3299362 - DNA, 15 bp, Homo sapiens
tccagctcaccagcc

SEQ ID NO: 3299363 - DNA, 18 bp, Homo sapiens
tccagctcaccagcccca

SEQ ID NO: 3299364 - DNA, 18 bp, Homo sapiens
tccagctcagaacccagg

SEQ ID NO: 3299365 - DNA, 21 bp, Homo sapiens
tccagctcagaacccagggct

SEQ ID NO: 3299366 - DNA, 18 bp, Homo sapiens
tccagctctaataaaaca

SEQ ID NO: 3299367 - DNA, 13 bp, Homo sapiens
tccagctctgaca

SEQ ID NO: 3299368 - DNA, 17 bp, Homo sapiens
tccagctctgacatccc

SEQ ID NO: 3299369 - DNA, 13 bp, Homo sapiens
tccagctctggag

SEQ ID NO: 3299370 - DNA, 15 bp, Homo sapiens
tccagctctggaggg

SEQ ID NO: 3299371 - DNA, 20 bp, Homo sapiens
tccagctctggaggggaggg

SEQ ID NO: 3299372 - DNA, 21 bp, Homo sapiens
tccagctgactaaactttttt

SEQ ID NO: 3299373 - DNA, 14 bp, Homo sapiens
tccagctgcaccag

SEQ ID NO: 3299374 - DNA, 11 bp, Homo sapiens
tccagctggcc

SEQ ID NO: 3299375 - DNA, 19 bp, Homo sapiens
tccagctgggaagcccttt

SEQ ID NO: 3299376 - DNA, 19 bp, Homo sapiens
tccagcttctggtactctc

SEQ ID NO: 3299377 - DNA, 21 bp, Homo sapiens
tccagcttctggtactctcct

SEQ ID NO: 3299378 - DNA, 19 bp, Homo sapiens
tccagctttctccccgcta

SEQ ID NO: 3299379 - DNA, 21 bp, Homo sapiens
tccaggaaactccacatctgc

SEQ ID NO: 3299380 - DNA, 18 bp, Homo sapiens
tccaggaagaagcagggg

SEQ ID NO: 3299381 - DNA, 13 bp, Homo sapiens
tccaggaaggcag

SEQ ID NO: 3299382 - DNA, 16 bp, Homo sapiens
tccaggaaggcagctg

SEQ ID NO: 3299383 - DNA, 22 bp, Homo sapiens
tccaggaatgcctcctccctgg

SEQ ID NO: 3299384 - DNA, 20 bp, Homo sapiens
tccaggactccactggacag

SEQ ID NO: 3299385 - DNA, 15 bp, Homo sapiens
tccaggatcctgcag

SEQ ID NO: 3299386 - DNA, 19 bp, Homo sapiens
tccaggatcctgcaggaac

SEQ ID NO: 3299387 - DNA, 19 bp, Homo sapiens
tccaggatctttgactgaa

SEQ ID NO: 3299388 - DNA, 21 bp, Homo sapiens
tccaggcaccaggactagggc

SEQ ID NO: 3299389 - DNA, 15 bp, Homo sapiens
tccaggcaccatctc

SEQ ID NO: 3299390 - DNA, 15 bp, Homo sapiens
tccaggcacccttct

SEQ ID NO: 3299391 - DNA, 16 bp, Homo sapiens
tccaggcacccttctt

SEQ ID NO: 3299392 - DNA, 23 bp, Homo sapiens
tccaggcacccttctttcctctt

SEQ ID NO: 3299393 - DNA, 22 bp, Homo sapiens
tccaggcagtcgggggctggcc

SEQ ID NO: 3299394 - DNA, 14 bp, Homo sapiens
tccaggccactgtg

SEQ ID NO: 3299395 - DNA, 17 bp, Homo sapiens
tccaggccactgtggcc

SEQ ID NO: 3299396 - DNA, 18 bp, Homo sapiens
tccaggccactgtggcca

SEQ ID NO: 3299397 - DNA, 23 bp, Homo sapiens
tccaggccactgtggccagagct

SEQ ID NO: 3299398 - DNA, 17 bp, Homo sapiens
tccaggcccaactgtga

SEQ ID NO: 3299399 - DNA, 15 bp, Homo sapiens
tccaggcccaaggct

SEQ ID NO: 3299400 - DNA, 21 bp, Homo sapiens
tccaggcccctgaggactgga

SEQ ID NO: 3299401 - DNA, 20 bp, Homo sapiens
tccaggcctgcagcaggagt

SEQ ID NO: 3299402 - DNA, 19 bp, Homo sapiens
tccaggctagtccggaccc

SEQ ID NO: 3299403 - DNA, 10 bp, Homo sapiens
tccaggctcc

SEQ ID NO: 3299404 - DNA, 14 bp, Homo sapiens
tccaggctcttcct

SEQ ID NO: 3299405 - DNA, 15 bp, Homo sapiens
tccaggctcttcctg

SEQ ID NO: 3299406 - DNA, 14 bp, Homo sapiens
tccaggctgtatcc

SEQ ID NO: 3299407 - DNA, 12 bp, Homo sapiens
tccagggaagct

SEQ ID NO: 3299408 - DNA, 18 bp, Homo sapiens
tccagggaagctggccga

SEQ ID NO: 3299409 - DNA, 19 bp, Homo sapiens
tccagggaatccaagcctc

SEQ ID NO: 3299410 - DNA, 14 bp, Homo sapiens
tccagggctagtga

SEQ ID NO: 3299411 - DNA, 14 bp, Homo sapiens
tccaggggaacctg

SEQ ID NO: 3299412 - DNA, 23 bp, Homo sapiens
tccaggggcccttgggacagcca

SEQ ID NO: 3299413 - DNA, 18 bp, Homo sapiens
tccagggtacatgcttta

SEQ ID NO: 3299414 - DNA, 17 bp, Homo sapiens
tccagggtccctctgtg

SEQ ID NO: 3299415 - DNA, 15 bp, Homo sapiens
tccagggtcttgggc

SEQ ID NO: 3299416 - DNA, 21 bp, Homo sapiens
tccagggtcttgggctactgg

SEQ ID NO: 3299417 - DNA, 12 bp, Homo sapiens
tccaggtcagga

SEQ ID NO: 3299418 - DNA, 21 bp, Homo sapiens
tccaggtcatgcagttcctgg

SEQ ID NO: 3299419 - DNA, 16 bp, Homo sapiens
tccaggtctcacgggc

SEQ ID NO: 3299420 - DNA, 15 bp, Homo sapiens
tccaggttcagcttg

SEQ ID NO: 3299421 - DNA, 20 bp, Homo sapiens
tccaggttccctcccagagg

SEQ ID NO: 3299422 - DNA, 14 bp, Homo sapiens
tccagtaacttttt

SEQ ID NO: 3299423 - DNA, 23 bp, Homo sapiens
tccagtaacttttttgtgtatgt

SEQ ID NO: 3299424 - DNA, 15 bp, Homo sapiens
tccagtaatctaata

SEQ ID NO: 3299425 - DNA, 17 bp, Homo sapiens
tccagtacctttgtcac

SEQ ID NO: 3299426 - DNA, 16 bp, Homo sapiens
tccagtaggatccagt

SEQ ID NO: 3299427 - DNA, 14 bp, Homo sapiens
tccagtatcttgtt

SEQ ID NO: 3299428 - DNA, 13 bp, Homo sapiens
tccagtattcttg

SEQ ID NO: 3299429 - DNA, 21 bp, Homo sapiens
tccagtattgaaaacttcaaa

SEQ ID NO: 3299430 - DNA, 15 bp, Homo sapiens
tccagtattgctgat

SEQ ID NO: 3299431 - DNA, 22 bp, Homo sapiens
tccagtccccctatccttggca

SEQ ID NO: 3299432 - DNA, 22 bp, Homo sapiens
tccagtctcttgtacagcgttt

SEQ ID NO: 3299433 - DNA, 15 bp, Homo sapiens
tccagtcttcctgac

SEQ ID NO: 3299434 - DNA, 21 bp, Homo sapiens
tccagtcttcctgacacttta

SEQ ID NO: 3299435 - DNA, 23 bp, Homo sapiens
tccagtcttcctgacactttaat

SEQ ID NO: 3299436 - DNA, 20 bp, Homo sapiens
tccagtgagtgtaaataatt

SEQ ID NO: 3299437 - DNA, 21 bp, Homo sapiens
tccagtgagtgtaaataattt

SEQ ID NO: 3299438 - DNA, 22 bp, Homo sapiens
tccagtgggctgatgctgggac

SEQ ID NO: 3299439 - DNA, 23 bp, Homo sapiens
tccagtgtcacctctctcagagc

SEQ ID NO: 3299440 - DNA, 22 bp, Homo sapiens
tccctcctgcccgccacacaga

SEQ ID NO: 3299441 - DNA, 13 bp, Homo sapiens
tccctcctgccgc

SEQ ID NO: 3299442 - DNA, 12 bp, Homo sapiens
tccctccttggg

SEQ ID NO: 3299443 - DNA, 13 bp, Homo sapiens
tccctccttgggt

SEQ ID NO: 3299444 - DNA, 15 bp, Homo sapiens
tccctccttgggtca

SEQ ID NO: 3299445 - DNA, 22 bp, Homo sapiens
tccctcgacagcgcccctgctg

SEQ ID NO: 3299446 - DNA, 23 bp, Homo sapiens
tccctcgacagcgcccctgctgt

SEQ ID NO: 3299447 - DNA, 14 bp, Homo sapiens
tccctcggaagccg

SEQ ID NO: 3299448 - DNA, 24 bp, Homo sapiens
tccctcggaagccgtctgactcca

SEQ ID NO: 3299449 - DNA, 18 bp, Homo sapiens
tccctcgggaagcagcca

SEQ ID NO: 3299450 - DNA, 19 bp, Homo sapiens
tccctctaatgagactgac

SEQ ID NO: 3299451 - DNA, 13 bp, Homo sapiens
tccctctagtgcc

SEQ ID NO: 3299452 - DNA, 13 bp, Homo sapiens
tccctctatttat

SEQ ID NO: 3299453 - DNA, 15 bp, Homo sapiens
tccctctcactcccc

SEQ ID NO: 3299454 - DNA, 14 bp, Homo sapiens
tccctctcatctca

SEQ ID NO: 3299455 - DNA, 12 bp, Homo sapiens
tccctctcctgc

SEQ ID NO: 3299456 - DNA, 17 bp, Homo sapiens
tccctctcctgcccaga

SEQ ID NO: 3299457 - DNA, 11 bp, Homo sapiens
tccctctctct

SEQ ID NO: 3299458 - DNA, 16 bp, Homo sapiens
tccctctctcttctgc

SEQ ID NO: 3299459 - DNA, 18 bp, Homo sapiens
tccctctctcttctgctc

SEQ ID NO: 3299460 - DNA, 20 bp, Homo sapiens
tccctctctcttctgctcca

SEQ ID NO: 3299461 - DNA, 23 bp, Homo sapiens
tccctctctcttctgctccaccc

SEQ ID NO: 3299462 - DNA, 15 bp, Homo sapiens
tccctctctggtttc

SEQ ID NO: 3299463 - DNA, 11 bp, Homo sapiens
tccctctgccc

SEQ ID NO: 3299464 - DNA, 13 bp, Homo sapiens
tccctctgcccca

SEQ ID NO: 3299465 - DNA, 19 bp, Homo sapiens
tccctctgccccaagcagc

SEQ ID NO: 3299466 - DNA, 15 bp, Homo sapiens
tccctctgccttcag

SEQ ID NO: 3299467 - DNA, 15 bp, Homo sapiens
tccctctgctcagcc

SEQ ID NO: 3299468 - DNA, 20 bp, Homo sapiens
tccctctgctcctggagcct

SEQ ID NO: 3299469 - DNA, 20 bp, Homo sapiens
tccctcttcactgtggccac

SEQ ID NO: 3299470 - DNA, 14 bp, Homo sapiens
tccctcttcccaga

SEQ ID NO: 3299471 - DNA, 17 bp, Homo sapiens
tccctcttctcaagtgc

SEQ ID NO: 3299472 - DNA, 19 bp, Homo sapiens
tccctcttctcaagtgcct

SEQ ID NO: 3299473 - DNA, 13 bp, Homo sapiens
tccctcttgtaag

SEQ ID NO: 3299474 - DNA, 13 bp, Homo sapiens
tccctcttgtttt

SEQ ID NO: 3299475 - DNA, 21 bp, Homo sapiens
tccctcttgttttgtttgtct

SEQ ID NO: 3299476 - DNA, 17 bp, Homo sapiens
tccctgaaaatgttttt

SEQ ID NO: 3299477 - DNA, 13 bp, Homo sapiens
tccctgaaacacg

SEQ ID NO: 3299478 - DNA, 15 bp, Homo sapiens
tccctgaaccatccc

SEQ ID NO: 3299479 - DNA, 13 bp, Homo sapiens
tccctgaactttt

SEQ ID NO: 3299480 - DNA, 17 bp, Homo sapiens
tccctgaagccagcctt

SEQ ID NO: 3299481 - DNA, 18 bp, Homo sapiens
tccctgaagccagccttc

SEQ ID NO: 3299482 - DNA, 19 bp, Homo sapiens
tccctgaagccagccttct

SEQ ID NO: 3299483 - DNA, 16 bp, Homo sapiens
tccctgactctctgtg

SEQ ID NO: 3299484 - DNA, 20 bp, Homo sapiens
tccctgactctctgtgacct

SEQ ID NO: 3299485 - DNA, 14 bp, Homo sapiens
tccctgacttgctt

SEQ ID NO: 3299486 - DNA, 16 bp, Homo sapiens
tccctgacttgcttta

SEQ ID NO: 3299487 - DNA, 15 bp, Homo sapiens
tccctgagacaggga

SEQ ID NO: 3299488 - DNA, 18 bp, Homo sapiens
tccctgattgacctgctc

SEQ ID NO: 3299489 - DNA, 11 bp, Homo sapiens
tccctgcaccc

SEQ ID NO: 3299490 - DNA, 15 bp, Homo sapiens
tccctgcaccctgga

SEQ ID NO: 3299491 - DNA, 20 bp, Homo sapiens
tccctgcactaaagccagcc

SEQ ID NO: 3299492 - DNA, 21 bp, Homo sapiens
tccctgcactaaagccagcct

SEQ ID NO: 3299493 - DNA, 22 bp, Homo sapiens
tccctgcactaaagccagcctg

SEQ ID NO: 3299494 - DNA, 14 bp, Homo sapiens
tccctgcacttgca

SEQ ID NO: 3299495 - DNA, 22 bp, Homo sapiens
tccctgcagggcgcccctggga

SEQ ID NO: 3299496 - DNA, 16 bp, Homo sapiens
tccctgccacatacag

SEQ ID NO: 3299497 - DNA, 12 bp, Homo sapiens
tccctgccagag

SEQ ID NO: 3299498 - DNA, 18 bp, Homo sapiens
tccctgcccctcccttca

SEQ ID NO: 3299499 - DNA, 15 bp, Homo sapiens
tccctgcctggcccc

SEQ ID NO: 3299500 - DNA, 19 bp, Homo sapiens
tccctgcgagacgcacaca

SEQ ID NO: 3299501 - DNA, 17 bp, Homo sapiens
tccctgcgcctgtgatg

SEQ ID NO: 3299502 - DNA, 14 bp, Homo sapiens
tccctgctgaatgc

SEQ ID NO: 3299503 - DNA, 18 bp, Homo sapiens
tccctgcttccaggaaac

SEQ ID NO: 3299504 - DNA, 19 bp, Homo sapiens
tccctgctttggctgaggg

SEQ ID NO: 3299505 - DNA, 13 bp, Homo sapiens
tccctggacacag

SEQ ID NO: 3299506 - DNA, 14 bp, Homo sapiens
tccctggacacagc

SEQ ID NO: 3299507 - DNA, 15 bp, Homo sapiens
tccctggacacagct

SEQ ID NO: 3299508 - DNA, 18 bp, Homo sapiens
tccctggacacagctctt

SEQ ID NO: 3299509 - DNA, 20 bp, Homo sapiens
tccctggacacagctcttca

SEQ ID NO: 3299510 - DNA, 20 bp, Homo sapiens
tccctggagaaaaaaattgc

SEQ ID NO: 3299511 - DNA, 17 bp, Homo sapiens
tccctggagccctgttg

SEQ ID NO: 3299512 - DNA, 18 bp, Homo sapiens
tccctggatgacattaaa

SEQ ID NO: 3299513 - DNA, 21 bp, Homo sapiens
tccctggcaggatgctgagct

SEQ ID NO: 3299514 - DNA, 18 bp, Homo sapiens
tccctggccccctccctg

SEQ ID NO: 3299515 - DNA, 17 bp, Homo sapiens
tccctggctccctcctc

SEQ ID NO: 3299516 - DNA, 15 bp, Homo sapiens
tccctggctctcaga

SEQ ID NO: 3299517 - DNA, 23 bp, Homo sapiens
tccctggctgccctggccctgag

SEQ ID NO: 3299518 - DNA, 14 bp, Homo sapiens
tccctgggaggccc

SEQ ID NO: 3299519 - DNA, 12 bp, Homo sapiens
tccctgggcatt

SEQ ID NO: 3299520 - DNA, 18 bp, Homo sapiens
tccctgggccagggtctg

SEQ ID NO: 3299521 - DNA, 16 bp, Homo sapiens
tccctgggcccctcca

SEQ ID NO: 3299522 - DNA, 20 bp, Homo sapiens
tccctgggcccctccacgcc

SEQ ID NO: 3299523 - DNA, 17 bp, Homo sapiens
tccctgggggccttggg

SEQ ID NO: 3299524 - DNA, 22 bp, Homo sapiens
tccctgggggccttgggtgagt

SEQ ID NO: 3299525 - DNA, 22 bp, Homo sapiens
tccctggtccctcgtccacagg

SEQ ID NO: 3299526 - DNA, 13 bp, Homo sapiens
tccctggtccctt

SEQ ID NO: 3299527 - DNA, 14 bp, Homo sapiens
tccctgtagctctg

SEQ ID NO: 3299528 - DNA, 18 bp, Homo sapiens
tccctgtatgtctacctc

SEQ ID NO: 3299529 - DNA, 22 bp, Homo sapiens
tccctgtatgtctacctctgac

SEQ ID NO: 3299530 - DNA, 19 bp, Homo sapiens
tccctgtctctgcatctga

SEQ ID NO: 3299531 - DNA, 13 bp, Homo sapiens
tccctgtgccact

SEQ ID NO: 3299532 - DNA, 16 bp, Homo sapiens
tccctgtgtcatttca

SEQ ID NO: 3299533 - DNA, 17 bp, Homo sapiens
tccctgtgtcatttcaa

SEQ ID NO: 3299534 - DNA, 14 bp, Homo sapiens
tccctgttcctttg

SEQ ID NO: 3299535 - DNA, 16 bp, Homo sapiens
tccctgttctcccttt

SEQ ID NO: 3299536 - DNA, 15 bp, Homo sapiens
tccctgttcttcctc

SEQ ID NO: 3299537 - DNA, 21 bp, Homo sapiens
tccctgttcttcctccagctg

SEQ ID NO: 3299538 - DNA, 20 bp, Homo sapiens
tccctgttgacgaagtctct

SEQ ID NO: 3299539 - DNA, 11 bp, Homo sapiens
tccctgtttaa

SEQ ID NO: 3299540 - DNA, 21 bp, Homo sapiens
tccctgttttctgagcccggg

SEQ ID NO: 3299541 - DNA, 12 bp, Homo sapiens
tcccttaaaatt

SEQ ID NO: 3299542 - DNA, 22 bp, Homo sapiens
tcccttaaaattaccagacaaa

SEQ ID NO: 3299543 - DNA, 19 bp, Homo sapiens
tcccttaaatacagataat

SEQ ID NO: 3299544 - DNA, 14 bp, Homo sapiens
tcccttaagaagtt

SEQ ID NO: 3299545 - DNA, 20 bp, Homo sapiens
tcccttatgtccaccacttc

SEQ ID NO: 3299546 - DNA, 21 bp, Homo sapiens
tcccttattagttacaaagtt

SEQ ID NO: 3299547 - DNA, 21 bp, Homo sapiens
tcccttcaagacgaggggcag

SEQ ID NO: 3299548 - DNA, 17 bp, Homo sapiens
tcccttcacagtcccag

SEQ ID NO: 3299549 - DNA, 21 bp, Homo sapiens
tcccttcagcccccagcccct

SEQ ID NO: 3299550 - DNA, 19 bp, Homo sapiens
tcccttcagtaccctctca

SEQ ID NO: 3299551 - DNA, 21 bp, Homo sapiens
tcccttcagtaccctctcagc

SEQ ID NO: 3299552 - DNA, 14 bp, Homo sapiens
tcccttccactgcc

SEQ ID NO: 3299553 - DNA, 17 bp, Homo sapiens
tcccttcccttccactg

SEQ ID NO: 3299554 - DNA, 16 bp, Homo sapiens
tcccttccgaccctct

SEQ ID NO: 3299555 - DNA, 22 bp, Homo sapiens
tcccttccgaccctctgggaac

SEQ ID NO: 3299556 - DNA, 16 bp, Homo sapiens
tcccttcctctctcct

SEQ ID NO: 3299557 - DNA, 12 bp, Homo sapiens
tcccttcctgga

SEQ ID NO: 3299558 - DNA, 14 bp, Homo sapiens
tcccttcctggaaa

SEQ ID NO: 3299559 - DNA, 19 bp, Homo sapiens
tcccttcctggaaacagca

SEQ ID NO: 3299560 - DNA, 21 bp, Homo sapiens
tcccttcctggaaacagcatg

SEQ ID NO: 3299561 - DNA, 22 bp, Homo sapiens
tcccttcctggaaacagcatga

SEQ ID NO: 3299562 - DNA, 16 bp, Homo sapiens
tcccttcctggcctca

SEQ ID NO: 3299563 - DNA, 23 bp, Homo sapiens
tcccttcttgcatccttcctata

SEQ ID NO: 3299564 - DNA, 16 bp, Homo sapiens
tcccttgaaggaagag

SEQ ID NO: 3299565 - DNA, 15 bp, Homo sapiens
tcccttgcaggggtc

SEQ ID NO: 3299566 - DNA, 21 bp, Homo sapiens
tcccttgcaggggtcccccct

SEQ ID NO: 3299567 - DNA, 13 bp, Homo sapiens
tcctgccagcccc

SEQ ID NO: 3299568 - DNA, 15 bp, Homo sapiens
tcctgccagctgcct

SEQ ID NO: 3299569 - DNA, 20 bp, Homo sapiens
tcctgccagctgccttcctc

SEQ ID NO: 3299570 - DNA, 17 bp, Homo sapiens
tcctgccagtgtggaac

SEQ ID NO: 3299571 - DNA, 15 bp, Homo sapiens
tcctgccatgtttag

SEQ ID NO: 3299572 - DNA, 18 bp, Homo sapiens
tcctgccattcttctggt

SEQ ID NO: 3299573 - DNA, 12 bp, Homo sapiens
tcctgcccagat

SEQ ID NO: 3299574 - DNA, 14 bp, Homo sapiens
tcctgcccagtccc

SEQ ID NO: 3299575 - DNA, 15 bp, Homo sapiens
tcctgcccagtcccc

SEQ ID NO: 3299576 - DNA, 19 bp, Homo sapiens
tcctgcccatgtgtcccct

SEQ ID NO: 3299577 - DNA, 16 bp, Homo sapiens
tcctgccctggaggaa

SEQ ID NO: 3299578 - DNA, 15 bp, Homo sapiens
tcctgccctgtccct

SEQ ID NO: 3299579 - DNA, 20 bp, Homo sapiens
tcctgccgcagacgggcaca

SEQ ID NO: 3299580 - DNA, 22 bp, Homo sapiens
tcctgccgcagacgggcacaga

SEQ ID NO: 3299581 - DNA, 19 bp, Homo sapiens
tcctgcctattatctgtca

SEQ ID NO: 3299582 - DNA, 13 bp, Homo sapiens
tcctgcctcagcc

SEQ ID NO: 3299583 - DNA, 14 bp, Homo sapiens
tcctgcctcagcct

SEQ ID NO: 3299584 - DNA, 15 bp, Homo sapiens
tcctgcctcagcctc

SEQ ID NO: 3299585 - DNA, 12 bp, Homo sapiens
tcctgcctccgc

SEQ ID NO: 3299586 - DNA, 17 bp, Homo sapiens
tcctgcctccgctggct

SEQ ID NO: 3299587 - DNA, 20 bp, Homo sapiens
tcctgcctcgaactggctgc

SEQ ID NO: 3299588 - DNA, 11 bp, Homo sapiens
tcctgcctggg

SEQ ID NO: 3299589 - DNA, 12 bp, Homo sapiens
tcctgcctgggt

SEQ ID NO: 3299590 - DNA, 17 bp, Homo sapiens
tcctgcctgggtgggac

SEQ ID NO: 3299591 - DNA, 20 bp, Homo sapiens
tcctgcctgggtgggacagc

SEQ ID NO: 3299592 - DNA, 23 bp, Homo sapiens
tcctgccttctgtcctggtgtca

SEQ ID NO: 3299593 - DNA, 16 bp, Homo sapiens
tcctgccttcttcttt

SEQ ID NO: 3299594 - DNA, 22 bp, Homo sapiens
tcctgccttcttctttttgctg

SEQ ID NO: 3299595 - DNA, 19 bp, Homo sapiens
tcctgccttggcctcccaa

SEQ ID NO: 3299596 - DNA, 14 bp, Homo sapiens
tcctgcctttaagc

SEQ ID NO: 3299597 - DNA, 12 bp, Homo sapiens
tcctgcctttta

SEQ ID NO: 3299598 - DNA, 15 bp, Homo sapiens
tcctgcgccccgccc

SEQ ID NO: 3299599 - DNA, 20 bp, Homo sapiens
tcctgcgccccgcccacacc

SEQ ID NO: 3299600 - DNA, 21 bp, Homo sapiens
tcctgcggagtgaagaggggc

SEQ ID NO: 3299601 - DNA, 13 bp, Homo sapiens
tcctgcgggtggg

SEQ ID NO: 3299602 - DNA, 15 bp, Homo sapiens
tcctgcgtcctcctc

SEQ ID NO: 3299603 - DNA, 21 bp, Homo sapiens
tcctgcgtcctcctcacctca

SEQ ID NO: 3299604 - DNA, 13 bp, Homo sapiens
tcctgctccagaa

SEQ ID NO: 3299605 - DNA, 19 bp, Homo sapiens
tcctgctccatgactggct

SEQ ID NO: 3299606 - DNA, 23 bp, Homo sapiens
tcctgctccatgactggctgtct

SEQ ID NO: 3299607 - DNA, 15 bp, Homo sapiens
tcctgctcctccctg

SEQ ID NO: 3299608 - DNA, 15 bp, Homo sapiens
tcctgctccttttgt

SEQ ID NO: 3299609 - DNA, 22 bp, Homo sapiens
tcctgctgcggaggagctgcct

SEQ ID NO: 3299610 - DNA, 24 bp, Homo sapiens
tcctgctgctgtaactgctgagcc

SEQ ID NO: 3299611 - DNA, 13 bp, Homo sapiens
tcctgctggacag

SEQ ID NO: 3299612 - DNA, 22 bp, Homo sapiens
tcctgctggacagagactcagc

SEQ ID NO: 3299613 - DNA, 14 bp, Homo sapiens
tcctgctggcttcc

SEQ ID NO: 3299614 - DNA, 23 bp, Homo sapiens
tcctgctggcttccagcttcagg

SEQ ID NO: 3299615 - DNA, 13 bp, Homo sapiens
tcctgctggtacc

SEQ ID NO: 3299616 - DNA, 22 bp, Homo sapiens
tcctgctgtagtcctttctgcc

SEQ ID NO: 3299617 - DNA, 15 bp, Homo sapiens
tcctgctttggcagt

SEQ ID NO: 3299618 - DNA, 17 bp, Homo sapiens
tcctggaaacagcatga

SEQ ID NO: 3299619 - DNA, 14 bp, Homo sapiens
tcctggaaaccaca

SEQ ID NO: 3299620 - DNA, 16 bp, Homo sapiens
tcctggaaaggctcag

SEQ ID NO: 3299621 - DNA, 15 bp, Homo sapiens
tcctggaaatattaa

SEQ ID NO: 3299622 - DNA, 22 bp, Homo sapiens
tcctggaaattgacgaggggtg

SEQ ID NO: 3299623 - DNA, 18 bp, Homo sapiens
tcctggaaccttgctgtc

SEQ ID NO: 3299624 - DNA, 17 bp, Homo sapiens
tcctggaagcaggtgct

SEQ ID NO: 3299625 - DNA, 14 bp, Homo sapiens
tcctggaagccagc

SEQ ID NO: 3299626 - DNA, 18 bp, Homo sapiens
tcctggaagccagctttc

SEQ ID NO: 3299627 - DNA, 20 bp, Homo sapiens
tcctggaagccagctttccc

SEQ ID NO: 3299628 - DNA, 14 bp, Homo sapiens
tcctggacatcacc

SEQ ID NO: 3299629 - DNA, 15 bp, Homo sapiens
tcctggacctgagtc

SEQ ID NO: 3299630 - DNA, 16 bp, Homo sapiens
tcctggacttaaagaa

SEQ ID NO: 3299631 - DNA, 19 bp, Homo sapiens
tcctggagcagaccacccc

SEQ ID NO: 3299632 - DNA, 18 bp, Homo sapiens
tcctggagcctttgaata

SEQ ID NO: 3299633 - DNA, 19 bp, Homo sapiens
tcctggaggggctggggac

SEQ ID NO: 3299634 - DNA, 19 bp, Homo sapiens
tcctggaggggtgttgtat

SEQ ID NO: 3299635 - DNA, 13 bp, Homo sapiens
tcctggatttata

SEQ ID NO: 3299636 - DNA, 14 bp, Homo sapiens
tcctggatttatag

SEQ ID NO: 3299637 - DNA, 21 bp, Homo sapiens
tcctggcaatagtgtgttctg

SEQ ID NO: 3299638 - DNA, 20 bp, Homo sapiens
tcctggcacccggcccctgc

SEQ ID NO: 3299639 - DNA, 22 bp, Homo sapiens
tcctggcacccggcccctgctg

SEQ ID NO: 3299640 - DNA, 23 bp, Homo sapiens
tcctggcacccggcccctgctgg

SEQ ID NO: 3299641 - DNA, 14 bp, Homo sapiens
tcctggcagcccag

SEQ ID NO: 3299642 - DNA, 16 bp, Homo sapiens
tcctggcagcccagag

SEQ ID NO: 3299643 - DNA, 17 bp, Homo sapiens
tcctggcagcccagaga

SEQ ID NO: 3299644 - DNA, 20 bp, Homo sapiens
tcctggccagatggcccgga

SEQ ID NO: 3299645 - DNA, 18 bp, Homo sapiens
tcctggcccctcaacctc

SEQ ID NO: 3299646 - DNA, 19 bp, Homo sapiens
tcctggcctcactggctgg

SEQ ID NO: 3299647 - DNA, 23 bp, Homo sapiens
tcctggcctcactggctggggca

SEQ ID NO: 3299648 - DNA, 17 bp, Homo sapiens
tcctggctaagcctctg

SEQ ID NO: 3299649 - DNA, 24 bp, Homo sapiens
tcctggctacatcccagcctgtgg

SEQ ID NO: 3299650 - DNA, 22 bp, Homo sapiens
tcctggctgcggcgtctgtctg

SEQ ID NO: 3299651 - DNA, 14 bp, Homo sapiens
tcctggctgtaaat

SEQ ID NO: 3299652 - DNA, 18 bp, Homo sapiens
tcctgggaagatgaggtt

SEQ ID NO: 3299653 - DNA, 16 bp, Homo sapiens
tcctgggaggacaggc

SEQ ID NO: 3299654 - DNA, 17 bp, Homo sapiens
tcctgggagtgagctgg

SEQ ID NO: 3299655 - DNA, 22 bp, Homo sapiens
tcctgggcagcctttccagcct

SEQ ID NO: 3299656 - DNA, 10 bp, Homo sapiens
tcctgggcct

SEQ ID NO: 3299657 - DNA, 15 bp, Homo sapiens
tcctgggcctgcccc

SEQ ID NO: 3299658 - DNA, 18 bp, Homo sapiens
tcctgggcctttgcaaga

SEQ ID NO: 3299659 - DNA, 17 bp, Homo sapiens
tcctggggccccgctgg

SEQ ID NO: 3299660 - DNA, 19 bp, Homo sapiens
tcctggggccccgctggga

SEQ ID NO: 3299661 - DNA, 18 bp, Homo sapiens
tcctggggctctgtgcag

SEQ ID NO: 3299662 - DNA, 18 bp, Homo sapiens
tcctgggggtggcaggca

SEQ ID NO: 3299663 - DNA, 19 bp, Homo sapiens
tcctgggggtggcaggcac

SEQ ID NO: 3299664 - DNA, 18 bp, Homo sapiens
tcctgggtttcctgcagg

SEQ ID NO: 3299665 - DNA, 15 bp, Homo sapiens
tcctggtacccagcc

SEQ ID NO: 3299666 - DNA, 16 bp, Homo sapiens
tcctggtacccagcca

SEQ ID NO: 3299667 - DNA, 13 bp, Homo sapiens
tcctggtccctca

SEQ ID NO: 3299668 - DNA, 15 bp, Homo sapiens
tcctggtccctctga

SEQ ID NO: 3299669 - DNA, 16 bp, Homo sapiens
tcctggtccctctgag

SEQ ID NO: 3299670 - DNA, 17 bp, Homo sapiens
tcctggtccctctgagg

SEQ ID NO: 3299671 - DNA, 20 bp, Homo sapiens
tcctggtcttgagatgtctt

SEQ ID NO: 3299672 - DNA, 20 bp, Homo sapiens
tcctggtgccaatttcaagt

SEQ ID NO: 3299673 - DNA, 21 bp, Homo sapiens
tcctggtgcccctcgccagct

SEQ ID NO: 3299674 - DNA, 21 bp, Homo sapiens
tcctggtgtcacttactgttt

SEQ ID NO: 3299675 - DNA, 23 bp, Homo sapiens
tcctggttccttcctatgcccag

SEQ ID NO: 3299676 - DNA, 19 bp, Homo sapiens
tcctggttttgtacactgc

SEQ ID NO: 3299677 - DNA, 21 bp, Homo sapiens
tcctggttttgtacactgctg

SEQ ID NO: 3299678 - DNA, 21 bp, Homo sapiens
tcctgtaagccaaagaaatga

SEQ ID NO: 3299679 - DNA, 23 bp, Homo sapiens
tcctgtaagccaaagaaatgaac

SEQ ID NO: 3299680 - DNA, 14 bp, Homo sapiens
tcctgtacctcagt

SEQ ID NO: 3299681 - DNA, 16 bp, Homo sapiens
tcctgtacctcagtgg

SEQ ID NO: 3299682 - DNA, 23 bp, Homo sapiens
tcctgtagttgcgtggactctgc

SEQ ID NO: 3299683 - DNA, 23 bp, Homo sapiens
tcctgtatgttgtacaatcaaaa

SEQ ID NO: 3299684 - DNA, 12 bp, Homo sapiens
tcctgtccactc

SEQ ID NO: 3299685 - DNA, 14 bp, Homo sapiens
tcctgtcccagagg

SEQ ID NO: 3299686 - DNA, 15 bp, Homo sapiens
tcctgtcccagaggt

SEQ ID NO: 3299687 - DNA, 22 bp, Homo sapiens
tcctgtcccgccttcctcctcc

SEQ ID NO: 3299688 - DNA, 18 bp, Homo sapiens
tcctgtcccttctcttaa

SEQ ID NO: 3299689 - DNA, 11 bp, Homo sapiens
tcctgtcctcc

SEQ ID NO: 3299690 - DNA, 21 bp, Homo sapiens
tcctgtcctcccatcccctgg

SEQ ID NO: 3299691 - DNA, 23 bp, Homo sapiens
tcctgtgaaaaataacggtgctt

SEQ ID NO: 3299692 - DNA, 11 bp, Homo sapiens
tcctgtgaatg

SEQ ID NO: 3299693 - DNA, 21 bp, Homo sapiens
tctaagtgttcgtctttagtt

SEQ ID NO: 3299694 - DNA, 16 bp, Homo sapiens
tctaagttataagact

SEQ ID NO: 3299695 - DNA, 20 bp, Homo sapiens
tctaagttataagactctca

SEQ ID NO: 3299696 - DNA, 18 bp, Homo sapiens
tctaagttcatgtttgta

SEQ ID NO: 3299697 - DNA, 12 bp, Homo sapiens
tctaagtttcta

SEQ ID NO: 3299698 - DNA, 14 bp, Homo sapiens
tctaagtttctaag

SEQ ID NO: 3299699 - DNA, 15 bp, Homo sapiens
tctaagtttctaaga

SEQ ID NO: 3299700 - DNA, 20 bp, Homo sapiens
tctaagtttctaagattcta

SEQ ID NO: 3299701 - DNA, 23 bp, Homo sapiens
tctaagtttctaagattctaaag

SEQ ID NO: 3299702 - DNA, 16 bp, Homo sapiens
tctaataaacttggat

SEQ ID NO: 3299703 - DNA, 13 bp, Homo sapiens
tctaataaattat

SEQ ID NO: 3299704 - DNA, 17 bp, Homo sapiens
tctaataatttctaatg

SEQ ID NO: 3299705 - DNA, 17 bp, Homo sapiens
tctaatacctctgtgtg

SEQ ID NO: 3299706 - DNA, 22 bp, Homo sapiens
tctaatactttgtttattgtaa

SEQ ID NO: 3299707 - DNA, 19 bp, Homo sapiens
tctaatagaactcagtttt

SEQ ID NO: 3299708 - DNA, 12 bp, Homo sapiens
tctaatagtctt

SEQ ID NO: 3299709 - DNA, 15 bp, Homo sapiens
tctaatatattttta

SEQ ID NO: 3299710 - DNA, 14 bp, Homo sapiens
tctaatatcattca

SEQ ID NO: 3299711 - DNA, 17 bp, Homo sapiens
tctaatatcattcacta

SEQ ID NO: 3299712 - DNA, 20 bp, Homo sapiens
tctaatatccccaaattagg

SEQ ID NO: 3299713 - DNA, 16 bp, Homo sapiens
tctaatatgattatac

SEQ ID NO: 3299714 - DNA, 17 bp, Homo sapiens
tctaatatgattataca

SEQ ID NO: 3299715 - DNA, 18 bp, Homo sapiens
tctaatatgattatacaa

SEQ ID NO: 3299716 - DNA, 17 bp, Homo sapiens
tctaatattaaaaatat

SEQ ID NO: 3299717 - DNA, 13 bp, Homo sapiens
tctaatattgctt

SEQ ID NO: 3299718 - DNA, 15 bp, Homo sapiens
tctaatattgcttct

SEQ ID NO: 3299719 - DNA, 19 bp, Homo sapiens
tctaatctagatatcgact

SEQ ID NO: 3299720 - DNA, 20 bp, Homo sapiens
tctaatctagatatcgactt

SEQ ID NO: 3299721 - DNA, 17 bp, Homo sapiens
tctaatgcttgatttag

SEQ ID NO: 3299722 - DNA, 17 bp, Homo sapiens
tctaatgtaagaaaatt

SEQ ID NO: 3299723 - DNA, 20 bp, Homo sapiens
tctaatgtagctatttttct

SEQ ID NO: 3299724 - DNA, 15 bp, Homo sapiens
tctaatgtcttcatt

SEQ ID NO: 3299725 - DNA, 17 bp, Homo sapiens
tctaatgtgaaaatcat

SEQ ID NO: 3299726 - DNA, 16 bp, Homo sapiens
tctaattaaaattgtg

SEQ ID NO: 3299727 - DNA, 15 bp, Homo sapiens
tctaattaattgtaa

SEQ ID NO: 3299728 - DNA, 21 bp, Homo sapiens
tctaattcccattttgcaaaa

SEQ ID NO: 3299729 - DNA, 22 bp, Homo sapiens
tctaattcccattttgcaaaat

SEQ ID NO: 3299730 - DNA, 12 bp, Homo sapiens
tctaattctgat

SEQ ID NO: 3299731 - DNA, 17 bp, Homo sapiens
tctaattgtcagtgatt

SEQ ID NO: 3299732 - DNA, 15 bp, Homo sapiens
tctaatttttaagaa

SEQ ID NO: 3299733 - DNA, 13 bp, Homo sapiens
tctacaaagcact

SEQ ID NO: 3299734 - DNA, 14 bp, Homo sapiens
tctacaagtatatg

SEQ ID NO: 3299735 - DNA, 16 bp, Homo sapiens
tctacaagtatatgtg

SEQ ID NO: 3299736 - DNA, 17 bp, Homo sapiens
tctacaatgtgaacttt

SEQ ID NO: 3299737 - DNA, 19 bp, Homo sapiens
tctacaatgtgaactttat

SEQ ID NO: 3299738 - DNA, 18 bp, Homo sapiens
tctacagaataatccagt

SEQ ID NO: 3299739 - DNA, 16 bp, Homo sapiens
tctacagacttctcca

SEQ ID NO: 3299740 - DNA, 15 bp, Homo sapiens
tctacagaggccatg

SEQ ID NO: 3299741 - DNA, 20 bp, Homo sapiens
tctacagctaatcagcattc

SEQ ID NO: 3299742 - DNA, 15 bp, Homo sapiens
tctacaggacaaagg

SEQ ID NO: 3299743 - DNA, 13 bp, Homo sapiens
tctacagtggttt

SEQ ID NO: 3299744 - DNA, 23 bp, Homo sapiens
tctacagtggttttatactgaag

SEQ ID NO: 3299745 - DNA, 20 bp, Homo sapiens
tctacagttaattatgtgca

SEQ ID NO: 3299746 - DNA, 13 bp, Homo sapiens
tctacatgactgg

SEQ ID NO: 3299747 - DNA, 15 bp, Homo sapiens
tctacatgactgggc

SEQ ID NO: 3299748 - DNA, 17 bp, Homo sapiens
tctacattaacttgaaa

SEQ ID NO: 3299749 - DNA, 22 bp, Homo sapiens
tctacatttaaacaagtatttt

SEQ ID NO: 3299750 - DNA, 13 bp, Homo sapiens
tctacatttcaca

SEQ ID NO: 3299751 - DNA, 23 bp, Homo sapiens
tctacatttcacctactttgtaa

SEQ ID NO: 3299752 - DNA, 15 bp, Homo sapiens
tctaccatttcagag

SEQ ID NO: 3299753 - DNA, 20 bp, Homo sapiens
tctacccaagggcagaaagt

SEQ ID NO: 3299754 - DNA, 19 bp, Homo sapiens
tctacccagcgagccctgg

SEQ ID NO: 3299755 - DNA, 20 bp, Homo sapiens
tctacccagcgagccctggt

SEQ ID NO: 3299756 - DNA, 18 bp, Homo sapiens
tctacccatgagcctgcc

SEQ ID NO: 3299757 - DNA, 23 bp, Homo sapiens
tctacccatgagcctgcccgctg

SEQ ID NO: 3299758 - DNA, 23 bp, Homo sapiens
tctaccccagactagatgtagta

SEQ ID NO: 3299759 - DNA, 15 bp, Homo sapiens
tctaccctcccaccc

SEQ ID NO: 3299760 - DNA, 20 bp, Homo sapiens
tctacctaatgtctcactgt

SEQ ID NO: 3299761 - DNA, 21 bp, Homo sapiens
tctacctaatgtctcactgtt

SEQ ID NO: 3299762 - DNA, 19 bp, Homo sapiens
tctacctccttagctttcc

SEQ ID NO: 3299763 - DNA, 15 bp, Homo sapiens
tctacctctgacttc

SEQ ID NO: 3299764 - DNA, 12 bp, Homo sapiens
tctacctgccct

SEQ ID NO: 3299765 - DNA, 18 bp, Homo sapiens
tctacctgccctcaaggg

SEQ ID NO: 3299766 - DNA, 21 bp, Homo sapiens
tctacctgctggacagcctcc

SEQ ID NO: 3299767 - DNA, 18 bp, Homo sapiens
tctacggatcatcaacaa

SEQ ID NO: 3299768 - DNA, 15 bp, Homo sapiens
tctactaaaaatgca

SEQ ID NO: 3299769 - DNA, 21 bp, Homo sapiens
tctactaagttattttatgac

SEQ ID NO: 3299770 - DNA, 18 bp, Homo sapiens
tctactatatacatatat

SEQ ID NO: 3299771 - DNA, 14 bp, Homo sapiens
tctactcagaaatt

SEQ ID NO: 3299772 - DNA, 16 bp, Homo sapiens
tctactcttgtcattt

SEQ ID NO: 3299773 - DNA, 16 bp, Homo sapiens
tctactggtcttgtgg

SEQ ID NO: 3299774 - DNA, 13 bp, Homo sapiens
tctacttcctaca

SEQ ID NO: 3299775 - DNA, 14 bp, Homo sapiens
tctagaaacaaaca

SEQ ID NO: 3299776 - DNA, 21 bp, Homo sapiens
tctagaaagaaaagaccctga

SEQ ID NO: 3299777 - DNA, 22 bp, Homo sapiens
tctagaaagcctgttcccctca

SEQ ID NO: 3299778 - DNA, 20 bp, Homo sapiens
tctagaaagtaagaaaacaa

SEQ ID NO: 3299779 - DNA, 14 bp, Homo sapiens
tctagaacctgggc

SEQ ID NO: 3299780 - DNA, 19 bp, Homo sapiens
tctagaacctgggctgtgc

SEQ ID NO: 3299781 - DNA, 20 bp, Homo sapiens
tctagaagccaagggaaagg

SEQ ID NO: 3299782 - DNA, 23 bp, Homo sapiens
tctagaagccaagggaaaggggt

SEQ ID NO: 3299783 - DNA, 18 bp, Homo sapiens
tctagaagtttcccttcc

SEQ ID NO: 3299784 - DNA, 23 bp, Homo sapiens
tctagaatctgcaattcaaaagt

SEQ ID NO: 3299785 - DNA, 19 bp, Homo sapiens
tctagacatggaggttcta

SEQ ID NO: 3299786 - DNA, 22 bp, Homo sapiens
tctagacatggaggttctaagg

SEQ ID NO: 3299787 - DNA, 13 bp, Homo sapiens
tctagaggcctca

SEQ ID NO: 3299788 - DNA, 15 bp, Homo sapiens
tctagagtctcagaa

SEQ ID NO: 3299789 - DNA, 16 bp, Homo sapiens
tctagatcactgtgct

SEQ ID NO: 3299790 - DNA, 20 bp, Homo sapiens
tctagatcagatgctccaag

SEQ ID NO: 3299791 - DNA, 22 bp, Homo sapiens
tctagatgaagttttacattgt

SEQ ID NO: 3299792 - DNA, 21 bp, Homo sapiens
tctagatgtttattcttctag

SEQ ID NO: 3299793 - DNA, 22 bp, Homo sapiens
tctagatgtttattcttctaga

SEQ ID NO: 3299794 - DNA, 16 bp, Homo sapiens
tctagattaatactct

SEQ ID NO: 3299795 - DNA, 18 bp, Homo sapiens
tctagattcaaaggttct

SEQ ID NO: 3299796 - DNA, 19 bp, Homo sapiens
tctagattcaaaggttcta

SEQ ID NO: 3299797 - DNA, 14 bp, Homo sapiens
tctagattctctgg

SEQ ID NO: 3299798 - DNA, 15 bp, Homo sapiens
tctagcaattttctt

SEQ ID NO: 3299799 - DNA, 18 bp, Homo sapiens
tctagcaattttctttgt

SEQ ID NO: 3299800 - DNA, 20 bp, Homo sapiens
tctagccaggagtctgtgct

SEQ ID NO: 3299801 - DNA, 20 bp, Homo sapiens
tctagcctatttacctgcag

SEQ ID NO: 3299802 - DNA, 12 bp, Homo sapiens
tctagcctgggc

SEQ ID NO: 3299803 - DNA, 14 bp, Homo sapiens
tctagcctgggcca

SEQ ID NO: 3299804 - DNA, 20 bp, Homo sapiens
tctagcctgggccagagaag

SEQ ID NO: 3299805 - DNA, 18 bp, Homo sapiens
tctagccttaaggggggc

SEQ ID NO: 3299806 - DNA, 14 bp, Homo sapiens
tctagctctctagg

SEQ ID NO: 3299807 - DNA, 16 bp, Homo sapiens
tctagctctctaggcc

SEQ ID NO: 3299808 - DNA, 13 bp, Homo sapiens
tctagctggcagg

SEQ ID NO: 3299809 - DNA, 14 bp, Homo sapiens
tctagctggcagga

SEQ ID NO: 3299810 - DNA, 18 bp, Homo sapiens
tctagctgtatgatttgt

SEQ ID NO: 3299811 - DNA, 19 bp, Homo sapiens
tctagctgttgagctgttt

SEQ ID NO: 3299812 - DNA, 21 bp, Homo sapiens
tctagcttagtttcagagacc

SEQ ID NO: 3299813 - DNA, 23 bp, Homo sapiens
tctaggagaaacttagaggaaaa

SEQ ID NO: 3299814 - DNA, 20 bp, Homo sapiens
tctaggattgggcctcccat

SEQ ID NO: 3299815 - DNA, 16 bp, Homo sapiens
tctaggcaagcaggac

SEQ ID NO: 3299816 - DNA, 19 bp, Homo sapiens
tctaggcaagcaggacctg

SEQ ID NO: 3299817 - DNA, 24 bp, Homo sapiens
tctaggcactgtagttctaagact

SEQ ID NO: 3299818 - DNA, 14 bp, Homo sapiens
tctcttgctttata

SEQ ID NO: 3299819 - DNA, 12 bp, Homo sapiens
tctcttggaaaa

SEQ ID NO: 3299820 - DNA, 18 bp, Homo sapiens
tctcttggaaaataagac

SEQ ID NO: 3299821 - DNA, 19 bp, Homo sapiens
tctcttggaaaataagaca

SEQ ID NO: 3299822 - DNA, 17 bp, Homo sapiens
tctcttggctctactcc

SEQ ID NO: 3299823 - DNA, 16 bp, Homo sapiens
tctcttgggaactgaa

SEQ ID NO: 3299824 - DNA, 15 bp, Homo sapiens
tctcttgtaaaaaga

SEQ ID NO: 3299825 - DNA, 20 bp, Homo sapiens
tctctttaatcttcagtttt

SEQ ID NO: 3299826 - DNA, 23 bp, Homo sapiens
tctctttctccttagtcttctca

SEQ ID NO: 3299827 - DNA, 13 bp, Homo sapiens
tctctttctctct

SEQ ID NO: 3299828 - DNA, 14 bp, Homo sapiens
tctctttctctctt

SEQ ID NO: 3299829 - DNA, 14 bp, Homo sapiens
tctctttctgtaca

SEQ ID NO: 3299830 - DNA, 13 bp, Homo sapiens
tctctttcttcct

SEQ ID NO: 3299831 - DNA, 17 bp, Homo sapiens
tctctttcttcctttct

SEQ ID NO: 3299832 - DNA, 13 bp, Homo sapiens
tctctttgttctc

SEQ ID NO: 3299833 - DNA, 17 bp, Homo sapiens
tctctttgttctcagct

SEQ ID NO: 3299834 - DNA, 21 bp, Homo sapiens
tctctttgttctcagctcccc

SEQ ID NO: 3299835 - DNA, 13 bp, Homo sapiens
tctcttttctctt

SEQ ID NO: 3299836 - DNA, 17 bp, Homo sapiens
tctcttttctcttttta

SEQ ID NO: 3299837 - DNA, 17 bp, Homo sapiens
tctcttttctgtacttc

SEQ ID NO: 3299838 - DNA, 20 bp, Homo sapiens
tctcttttctttagagcatt

SEQ ID NO: 3299839 - DNA, 17 bp, Homo sapiens
tctctttttggaggtgc

SEQ ID NO: 3299840 - DNA, 20 bp, Homo sapiens
tctctttttggaggtgctta

SEQ ID NO: 3299841 - DNA, 22 bp, Homo sapiens
tctgaaaaccccatttgctttc

SEQ ID NO: 3299842 - DNA, 22 bp, Homo sapiens
tctgaaaagcaattgccctgta

SEQ ID NO: 3299843 - DNA, 17 bp, Homo sapiens
tctgaaaatatctcttg

SEQ ID NO: 3299844 - DNA, 14 bp, Homo sapiens
tctgaaaatgtatg

SEQ ID NO: 3299845 - DNA, 23 bp, Homo sapiens
tctgaaaattccagaaaggatat

SEQ ID NO: 3299846 - DNA, 18 bp, Homo sapiens
tctgaaacacactgaaag

SEQ ID NO: 3299847 - DNA, 21 bp, Homo sapiens
tctgaaacacactgaaagctc

SEQ ID NO: 3299848 - DNA, 23 bp, Homo sapiens
tctgaaacccacagatgtctctg

SEQ ID NO: 3299849 - DNA, 13 bp, Homo sapiens
tctgaaagcacag

SEQ ID NO: 3299850 - DNA, 23 bp, Homo sapiens
tctgaaagcacaggagacactgt

SEQ ID NO: 3299851 - DNA, 13 bp, Homo sapiens
tctgaaaggaaat

SEQ ID NO: 3299852 - DNA, 17 bp, Homo sapiens
tctgaaaggaaatacac

SEQ ID NO: 3299853 - DNA, 22 bp, Homo sapiens
tctgaaaggaaatacacttctt

SEQ ID NO: 3299854 - DNA, 19 bp, Homo sapiens
tctgaaagttacccactga

SEQ ID NO: 3299855 - DNA, 19 bp, Homo sapiens
tctgaaataaaatgccata

SEQ ID NO: 3299856 - DNA, 18 bp, Homo sapiens
tctgaaatcgccgtgtta

SEQ ID NO: 3299857 - DNA, 12 bp, Homo sapiens
tctgaaatctga

SEQ ID NO: 3299858 - DNA, 15 bp, Homo sapiens
tctgaacacaggcag

SEQ ID NO: 3299859 - DNA, 16 bp, Homo sapiens
tctgaacacaggcagc

SEQ ID NO: 3299860 - DNA, 14 bp, Homo sapiens
tctgaactcaaact

SEQ ID NO: 3299861 - DNA, 17 bp, Homo sapiens
tctgaactcaaactgag

SEQ ID NO: 3299862 - DNA, 13 bp, Homo sapiens
tctgaactgttac

SEQ ID NO: 3299863 - DNA, 15 bp, Homo sapiens
tctgaactgttacaa

SEQ ID NO: 3299864 - DNA, 12 bp, Homo sapiens
tctgaactttgg

SEQ ID NO: 3299865 - DNA, 19 bp, Homo sapiens
tctgaagagtatccttcct

SEQ ID NO: 3299866 - DNA, 12 bp, Homo sapiens
tctgaagcatgt

SEQ ID NO: 3299867 - DNA, 13 bp, Homo sapiens
tctgaagcatgtt

SEQ ID NO: 3299868 - DNA, 20 bp, Homo sapiens
tctgaagcatgtttcatgtt

SEQ ID NO: 3299869 - DNA, 23 bp, Homo sapiens
tctgaagccatagcctccacgga

SEQ ID NO: 3299870 - DNA, 17 bp, Homo sapiens
tctgaagccctcccagg

SEQ ID NO: 3299871 - DNA, 23 bp, Homo sapiens
tctgaaggaatagccagagagga

SEQ ID NO: 3299872 - DNA, 13 bp, Homo sapiens
tctgaaggactgg

SEQ ID NO: 3299873 - DNA, 18 bp, Homo sapiens
tctgaaggcaaatataag

SEQ ID NO: 3299874 - DNA, 18 bp, Homo sapiens
tctgaagtcactgcacag

SEQ ID NO: 3299875 - DNA, 15 bp, Homo sapiens
tctgaataatttctt

SEQ ID NO: 3299876 - DNA, 16 bp, Homo sapiens
tctgaataatttctta

SEQ ID NO: 3299877 - DNA, 17 bp, Homo sapiens
tctgaatgtatttatgt

SEQ ID NO: 3299878 - DNA, 13 bp, Homo sapiens
tctgaatgttctg

SEQ ID NO: 3299879 - DNA, 16 bp, Homo sapiens
tctgaatgttctgaca

SEQ ID NO: 3299880 - DNA, 21 bp, Homo sapiens
tctgaattcaaagcttgtgaa

SEQ ID NO: 3299881 - DNA, 12 bp, Homo sapiens
tctgaatttatt

SEQ ID NO: 3299882 - DNA, 14 bp, Homo sapiens
tctgacaaactgtg

SEQ ID NO: 3299883 - DNA, 12 bp, Homo sapiens
tctgacaagggc

SEQ ID NO: 3299884 - DNA, 16 bp, Homo sapiens
tctgacaagggctgac

SEQ ID NO: 3299885 - DNA, 14 bp, Homo sapiens
tctgacacaaaaaa

SEQ ID NO: 3299886 - DNA, 14 bp, Homo sapiens
tctgacacacagct

SEQ ID NO: 3299887 - DNA, 21 bp, Homo sapiens
tctgacaggcaatgctggctg

SEQ ID NO: 3299888 - DNA, 20 bp, Homo sapiens
tctgacagtttttctgtttt

SEQ ID NO: 3299889 - DNA, 21 bp, Homo sapiens
tctgacatattatgcctgaat

SEQ ID NO: 3299890 - DNA, 15 bp, Homo sapiens
tctgacatcccttcc

SEQ ID NO: 3299891 - DNA, 17 bp, Homo sapiens
tctgacatcccttcctg

SEQ ID NO: 3299892 - DNA, 20 bp, Homo sapiens
tctgacatcccttcctggaa

SEQ ID NO: 3299893 - DNA, 23 bp, Homo sapiens
tctgacatcccttcctggaaaca

SEQ ID NO: 3299894 - DNA, 16 bp, Homo sapiens
tctgacatgcattgtt

SEQ ID NO: 3299895 - DNA, 16 bp, Homo sapiens
tctgacattaacagtt

SEQ ID NO: 3299896 - DNA, 18 bp, Homo sapiens
tctgacattaacagtttt

SEQ ID NO: 3299897 - DNA, 22 bp, Homo sapiens
tctgacattatgtggttttaga

SEQ ID NO: 3299898 - DNA, 14 bp, Homo sapiens
tctgaccatttcag

SEQ ID NO: 3299899 - DNA, 17 bp, Homo sapiens
tctgacccactgatctc

SEQ ID NO: 3299900 - DNA, 14 bp, Homo sapiens
tctgacccactgct

SEQ ID NO: 3299901 - DNA, 15 bp, Homo sapiens
tctgacccactgctt

SEQ ID NO: 3299902 - DNA, 14 bp, Homo sapiens
tctgacccagtgag

SEQ ID NO: 3299903 - DNA, 22 bp, Homo sapiens
tctgaccccagtggaaaacaaa

SEQ ID NO: 3299904 - DNA, 13 bp, Homo sapiens
tctgacccctcct

SEQ ID NO: 3299905 - DNA, 18 bp, Homo sapiens
tctgacccctcctcactg

SEQ ID NO: 3299906 - DNA, 18 bp, Homo sapiens
tctgacctgcactgggga

SEQ ID NO: 3299907 - DNA, 16 bp, Homo sapiens
tctgacctgcaggcca

SEQ ID NO: 3299908 - DNA, 19 bp, Homo sapiens
tctgacctgcaggccaaga

SEQ ID NO: 3299909 - DNA, 23 bp, Homo sapiens
tctgacctggcatctaattctga

SEQ ID NO: 3299910 - DNA, 15 bp, Homo sapiens
tctgacgaaggtcct

SEQ ID NO: 3299911 - DNA, 13 bp, Homo sapiens
tctgacggccctg

SEQ ID NO: 3299912 - DNA, 16 bp, Homo sapiens
tctgacggccctgcaa

SEQ ID NO: 3299913 - DNA, 14 bp, Homo sapiens
tctgactactttgc

SEQ ID NO: 3299914 - DNA, 21 bp, Homo sapiens
tctgactagtagatttctatg

SEQ ID NO: 3299915 - DNA, 20 bp, Homo sapiens
tctgactcaggcgcctggca

SEQ ID NO: 3299916 - DNA, 12 bp, Homo sapiens
tctgactccaga

SEQ ID NO: 3299917 - DNA, 19 bp, Homo sapiens
tctgactcggtttctccaa

SEQ ID NO: 3299918 - DNA, 13 bp, Homo sapiens
tctgactgccaag

SEQ ID NO: 3299919 - DNA, 16 bp, Homo sapiens
tctgactgccaagcca

SEQ ID NO: 3299920 - DNA, 19 bp, Homo sapiens
tctgactgccaagccagat

SEQ ID NO: 3299921 - DNA, 23 bp, Homo sapiens
tctgacttaagcaaaagaaaaag

SEQ ID NO: 3299922 - DNA, 12 bp, Homo sapiens
tctgacttctgc

SEQ ID NO: 3299923 - DNA, 9 bp, Homo sapiens
tctgagaaa

SEQ ID NO: 3299924 - DNA, 18 bp, Homo sapiens
tctgagaagacacaaggt

SEQ ID NO: 3299925 - DNA, 19 bp, Homo sapiens
tctgagaagaggagccctc

SEQ ID NO: 3299926 - DNA, 23 bp, Homo sapiens
tctgagaagaggagccctcatct

SEQ ID NO: 3299927 - DNA, 18 bp, Homo sapiens
tctgagaatcacggtggt

SEQ ID NO: 3299928 - DNA, 14 bp, Homo sapiens
tctgagagtctaga

SEQ ID NO: 3299929 - DNA, 22 bp, Homo sapiens
tctgagagtctagattctctgg

SEQ ID NO: 3299930 - DNA, 23 bp, Homo sapiens
tctgagcattcgctgtacccttt

SEQ ID NO: 3299931 - DNA, 14 bp, Homo sapiens
tctgagccagatta

SEQ ID NO: 3299932 - DNA, 14 bp, Homo sapiens
tctgagcccagctg

SEQ ID NO: 3299933 - DNA, 16 bp, Homo sapiens
tctgagcccagctgcc

SEQ ID NO: 3299934 - DNA, 22 bp, Homo sapiens
tctgagcccagctgcctggaga

SEQ ID NO: 3299935 - DNA, 12 bp, Homo sapiens
tctgagcccatg

SEQ ID NO: 3299936 - DNA, 15 bp, Homo sapiens
tctgagccctggtgt

SEQ ID NO: 3299937 - DNA, 17 bp, Homo sapiens
tctgagccttgagagaa

SEQ ID NO: 3299938 - DNA, 17 bp, Homo sapiens
tctgagctatttcatct

SEQ ID NO: 3299939 - DNA, 21 bp, Homo sapiens
tctgagcttttcatggaagtg

SEQ ID NO: 3299940 - DNA, 22 bp, Homo sapiens
tctgagcttttcatggaagtgg

SEQ ID NO: 3299941 - DNA, 17 bp, Homo sapiens
tctgaggaatccagacc

SEQ ID NO: 3299942 - DNA, 21 bp, Homo sapiens
tctgaggaatccagacccggc

SEQ ID NO: 3299943 - DNA, 23 bp, Homo sapiens
tctgaggaatccagacccggctg

SEQ ID NO: 3299944 - DNA, 20 bp, Homo sapiens
tctgtgaagtagttctgttt

SEQ ID NO: 3299945 - DNA, 15 bp, Homo sapiens
tctgtgaatacaatt

SEQ ID NO: 3299946 - DNA, 21 bp, Homo sapiens
tctgtgaatacaattaaaggt

SEQ ID NO: 3299947 - DNA, 13 bp, Homo sapiens
tctgtgaattaaa

SEQ ID NO: 3299948 - DNA, 14 bp, Homo sapiens
tctgtgacctcagg

SEQ ID NO: 3299949 - DNA, 23 bp, Homo sapiens
tctgtgacctcaggcactagcct

SEQ ID NO: 3299950 - DNA, 17 bp, Homo sapiens
tctgtgacgcagacaga

SEQ ID NO: 3299951 - DNA, 17 bp, Homo sapiens
tctgtgagatgctagaa

SEQ ID NO: 3299952 - DNA, 17 bp, Homo sapiens
tctgtgaggaaagcaca

SEQ ID NO: 3299953 - DNA, 20 bp, Homo sapiens
tctgtgagtgcgtctgaggg

SEQ ID NO: 3299954 - DNA, 17 bp, Homo sapiens
tctgtgatgagctgatc

SEQ ID NO: 3299955 - DNA, 12 bp, Homo sapiens
tctgtgcaaaca

SEQ ID NO: 3299956 - DNA, 18 bp, Homo sapiens
tctgtgcaaacagtaacg

SEQ ID NO: 3299957 - DNA, 17 bp, Homo sapiens
tctgtgccccatgcctg

SEQ ID NO: 3299958 - DNA, 18 bp, Homo sapiens
tctgtgccctccaaagag

SEQ ID NO: 3299959 - DNA, 17 bp, Homo sapiens
tctgtgcctgaatattt

SEQ ID NO: 3299960 - DNA, 17 bp, Homo sapiens
tctgtgccttgtttttt

SEQ ID NO: 3299961 - DNA, 14 bp, Homo sapiens
tctgtgctgacatg

SEQ ID NO: 3299962 - DNA, 13 bp, Homo sapiens
tctgtgctgtgcc

SEQ ID NO: 3299963 - DNA, 14 bp, Homo sapiens
tctgtgctgtgcct

SEQ ID NO: 3299964 - DNA, 20 bp, Homo sapiens
tctgtgctgtgcctgctaga

SEQ ID NO: 3299965 - DNA, 22 bp, Homo sapiens
tctgtggaccactgcatgagct

SEQ ID NO: 3299966 - DNA, 18 bp, Homo sapiens
tctgtggagctgccacag

SEQ ID NO: 3299967 - DNA, 17 bp, Homo sapiens
tctgtggaggggccctc

SEQ ID NO: 3299968 - DNA, 13 bp, Homo sapiens
tctgtgggcccct

SEQ ID NO: 3299969 - DNA, 23 bp, Homo sapiens
tctgtgggctacatgctggggtc

SEQ ID NO: 3299970 - DNA, 21 bp, Homo sapiens
tctgtggggaggggttgtttt

SEQ ID NO: 3299971 - DNA, 21 bp, Homo sapiens
tctgtggtgcctctcttggct

SEQ ID NO: 3299972 - DNA, 16 bp, Homo sapiens
tctgtggttcctctgc

SEQ ID NO: 3299973 - DNA, 17 bp, Homo sapiens
tctgtggttcctctgct

SEQ ID NO: 3299974 - DNA, 19 bp, Homo sapiens
tctgtgtatatctcttgga

SEQ ID NO: 3299975 - DNA, 18 bp, Homo sapiens
tctgtgtatattatttgg

SEQ ID NO: 3299976 - DNA, 20 bp, Homo sapiens
tctgtgtatttaattgtaaa

SEQ ID NO: 3299977 - DNA, 18 bp, Homo sapiens
tctgtgtattttcagtca

SEQ ID NO: 3299978 - DNA, 22 bp, Homo sapiens
tctgtgtcaggtggggcagctt

SEQ ID NO: 3299979 - DNA, 11 bp, Homo sapiens
tctgtgtcctt

SEQ ID NO: 3299980 - DNA, 16 bp, Homo sapiens
tctgtgtctaagattc

SEQ ID NO: 3299981 - DNA, 17 bp, Homo sapiens
tctgtgtctaagattct

SEQ ID NO: 3299982 - DNA, 20 bp, Homo sapiens
tctgtgtctaagattctaga

SEQ ID NO: 3299983 - DNA, 23 bp, Homo sapiens
tctgtgtctaagattctagatca

SEQ ID NO: 3299984 - DNA, 11 bp, Homo sapiens
tctgtgtctct

SEQ ID NO: 3299985 - DNA, 13 bp, Homo sapiens
tctgtgtctgctc

SEQ ID NO: 3299986 - DNA, 16 bp, Homo sapiens
tctgtgtgaaactttc

SEQ ID NO: 3299987 - DNA, 20 bp, Homo sapiens
tctgtgtgatgaactttctc

SEQ ID NO: 3299988 - DNA, 14 bp, Homo sapiens
tctgtgtgcacaaa

SEQ ID NO: 3299989 - DNA, 19 bp, Homo sapiens
tctgtgtgcaccttaccaa

SEQ ID NO: 3299990 - DNA, 17 bp, Homo sapiens
tctgtgtggcaaattaa

SEQ ID NO: 3299991 - DNA, 15 bp, Homo sapiens
tctgtgtgtgtatga

SEQ ID NO: 3299992 - DNA, 14 bp, Homo sapiens
tctgtgttcatttt

SEQ ID NO: 3299993 - DNA, 20 bp, Homo sapiens
tctgtgttcccagaggcagg

SEQ ID NO: 3299994 - DNA, 13 bp, Homo sapiens
tctgtgttgctgt

SEQ ID NO: 3299995 - DNA, 18 bp, Homo sapiens
tctgtgttgctgtttaga

SEQ ID NO: 3299996 - DNA, 18 bp, Homo sapiens
tctgtgtttaatttcttc

SEQ ID NO: 3299997 - DNA, 21 bp, Homo sapiens
tctgtgtttacagacagaaga

SEQ ID NO: 3299998 - DNA, 15 bp, Homo sapiens
tctgtgtttttgaaa

SEQ ID NO: 3299999 - DNA, 15 bp, Homo sapiens
tctgttaaaatctat

SEQ ID NO: 3300000 - DNA, 18 bp, Homo sapiens
tctgttaaggttgaactt

SEQ ID NO: 3300001 - DNA, 19 bp, Homo sapiens
tctgttaaggttgaacttt

SEQ ID NO: 3300002 - DNA, 23 bp, Homo sapiens
tctgttaaggttgaactttgcca

SEQ ID NO: 3300003 - DNA, 15 bp, Homo sapiens
tctgttatgggcttt

SEQ ID NO: 3300004 - DNA, 19 bp, Homo sapiens
tctgttcacaaactacctc

SEQ ID NO: 3300005 - DNA, 19 bp, Homo sapiens
tctgttcacttttcctccc

SEQ ID NO: 3300006 - DNA, 12 bp, Homo sapiens
tctgttccaaat

SEQ ID NO: 3300007 - DNA, 17 bp, Homo sapiens
tctgttccaaattcagt

SEQ ID NO: 3300008 - DNA, 22 bp, Homo sapiens
tctgttccaaattcagtttcat

SEQ ID NO: 3300009 - DNA, 22 bp, Homo sapiens
tctgttcccctgtcctgtgaat

SEQ ID NO: 3300010 - DNA, 20 bp, Homo sapiens
tctgttctacatagatgctt

SEQ ID NO: 3300011 - DNA, 13 bp, Homo sapiens
tctgttctagttt

SEQ ID NO: 3300012 - DNA, 15 bp, Homo sapiens
tctgttctagttttt

SEQ ID NO: 3300013 - DNA, 14 bp, Homo sapiens
tctgttctgctggg

SEQ ID NO: 3300014 - DNA, 14 bp, Homo sapiens
tctgttctggggga

SEQ ID NO: 3300015 - DNA, 17 bp, Homo sapiens
tctgttctgtttggcac

SEQ ID NO: 3300016 - DNA, 15 bp, Homo sapiens
tctgttgcaattagg

SEQ ID NO: 3300017 - DNA, 19 bp, Homo sapiens
tctgttgcaattaggattt

SEQ ID NO: 3300018 - DNA, 22 bp, Homo sapiens
tctgttggaagcttgttttcca

SEQ ID NO: 3300019 - DNA, 18 bp, Homo sapiens
tctgttggccagtgtgac

SEQ ID NO: 3300020 - DNA, 19 bp, Homo sapiens
tctgttggccagtgtgaca

SEQ ID NO: 3300021 - DNA, 11 bp, Homo sapiens
tctgttgtaac

SEQ ID NO: 3300022 - DNA, 12 bp, Homo sapiens
tctgttgtaact

SEQ ID NO: 3300023 - DNA, 14 bp, Homo sapiens
tctgttgtaactta

SEQ ID NO: 3300024 - DNA, 14 bp, Homo sapiens
tctgttgttccaaa

SEQ ID NO: 3300025 - DNA, 15 bp, Homo sapiens
tctgttgttccaaat

SEQ ID NO: 3300026 - DNA, 14 bp, Homo sapiens
tctgttgttccatt

SEQ ID NO: 3300027 - DNA, 18 bp, Homo sapiens
tctgtttacatccagagt

SEQ ID NO: 3300028 - DNA, 12 bp, Homo sapiens
tctgtttaggaa

SEQ ID NO: 3300029 - DNA, 12 bp, Homo sapiens
tctgtttctagt

SEQ ID NO: 3300030 - DNA, 20 bp, Homo sapiens
tctgtttcttaagggcacac

SEQ ID NO: 3300031 - DNA, 18 bp, Homo sapiens
tctgtttgctgtggaact

SEQ ID NO: 3300032 - DNA, 13 bp, Homo sapiens
tctgtttggcact

SEQ ID NO: 3300033 - DNA, 16 bp, Homo sapiens
tctgtttggcacttgt

SEQ ID NO: 3300034 - DNA, 17 bp, Homo sapiens
tctgtttggcacttgta

SEQ ID NO: 3300035 - DNA, 21 bp, Homo sapiens
tctgtttgttaaaactggcat

SEQ ID NO: 3300036 - DNA, 17 bp, Homo sapiens
tctgttttcctttctca

SEQ ID NO: 3300037 - DNA, 15 bp, Homo sapiens
tctgttttgtgagaa

SEQ ID NO: 3300038 - DNA, 16 bp, Homo sapiens
tctgttttgtgagaac

SEQ ID NO: 3300039 - DNA, 19 bp, Homo sapiens
tctgttttgtggtttggaa

SEQ ID NO: 3300040 - DNA, 19 bp, Homo sapiens
tctgtttttaatgctattt

SEQ ID NO: 3300041 - DNA, 23 bp, Homo sapiens
tctgtttttgtatctttatgctg

SEQ ID NO: 3300042 - DNA, 19 bp, Homo sapiens
tcttaaaatatatttcaga

SEQ ID NO: 3300043 - DNA, 13 bp, Homo sapiens
tcttaaacaatgt

SEQ ID NO: 3300044 - DNA, 19 bp, Homo sapiens
tcttaaacaatgtataaag

SEQ ID NO: 3300045 - DNA, 22 bp, Homo sapiens
tcttaaaccaacctttaaaatt

SEQ ID NO: 3300046 - DNA, 14 bp, Homo sapiens
tcttaaaggcctgg

SEQ ID NO: 3300047 - DNA, 16 bp, Homo sapiens
tcttaaatgagaagta

SEQ ID NO: 3300048 - DNA, 20 bp, Homo sapiens
tcttaaatgtttatactgta

SEQ ID NO: 3300049 - DNA, 21 bp, Homo sapiens
tcttaaatgtttatactgtat

SEQ ID NO: 3300050 - DNA, 14 bp, Homo sapiens
tcttaaatttttca

SEQ ID NO: 3300051 - DNA, 15 bp, Homo sapiens
tcttaaatttttcaa

SEQ ID NO: 3300052 - DNA, 20 bp, Homo sapiens
tcttaacaaaccaacatctt

SEQ ID NO: 3300053 - DNA, 15 bp, Homo sapiens
tcttaacactggcaa

SEQ ID NO: 3300054 - DNA, 23 bp, Homo sapiens
tcttaacctactaatagtttgtt

SEQ ID NO: 3300055 - DNA, 22 bp, Homo sapiens
tcttaactggcctaaatttctt

SEQ ID NO: 3300056 - DNA, 12 bp, Homo sapiens
tcttaacttctt

SEQ ID NO: 3300057 - DNA, 23 bp, Homo sapiens
tcttaacttcttgcttctttcta

SEQ ID NO: 3300058 - DNA, 15 bp, Homo sapiens
tcttaagagtgctaa

SEQ ID NO: 3300059 - DNA, 20 bp, Homo sapiens
tcttaagcctaaatgcctta

SEQ ID NO: 3300060 - DNA, 14 bp, Homo sapiens
tcttaatctgtgtg

SEQ ID NO: 3300061 - DNA, 14 bp, Homo sapiens
tcttaattattata

SEQ ID NO: 3300062 - DNA, 19 bp, Homo sapiens
tcttaattattataaaaat

SEQ ID NO: 3300063 - DNA, 18 bp, Homo sapiens
tcttaattctttgttctg

SEQ ID NO: 3300064 - DNA, 19 bp, Homo sapiens
tcttaattttttttaatgt

SEQ ID NO: 3300065 - DNA, 13 bp, Homo sapiens
tcttacaaaacat

SEQ ID NO: 3300066 - DNA, 17 bp, Homo sapiens
tcttacaaccaagaaca

SEQ ID NO: 3300067 - DNA, 17 bp, Homo sapiens
tcttacactgcctgtat

SEQ ID NO: 3300068 - DNA, 19 bp, Homo sapiens
tcttacagtgtttggacag

SEQ ID NO: 3300069 - DNA, 15 bp, Homo sapiens
tcttaccagatgcta

SEQ ID NO: 3300070 - DNA, 17 bp, Homo sapiens
tcttgtaaatgtttctt

SEQ ID NO: 3300071 - DNA, 14 bp, Homo sapiens
tcttgtaatttcca

SEQ ID NO: 3300072 - DNA, 17 bp, Homo sapiens
tcttgtacatgtgtagc

SEQ ID NO: 3300073 - DNA, 24 bp, Homo sapiens
tcttgtacatgtgtagcctgtgca

SEQ ID NO: 3300074 - DNA, 12 bp, Homo sapiens
tcttgtacttct

SEQ ID NO: 3300075 - DNA, 19 bp, Homo sapiens
tcttgtattaaactcttca

SEQ ID NO: 3300076 - DNA, 21 bp, Homo sapiens
tcttgtcagacataaagccat

SEQ ID NO: 3300077 - DNA, 18 bp, Homo sapiens
tcttgtcattaacacatt

SEQ ID NO: 3300078 - DNA, 12 bp, Homo sapiens
tcttgtcatttt

SEQ ID NO: 3300079 - DNA, 19 bp, Homo sapiens
tcttgtcatttttaatatt

SEQ ID NO: 3300080 - DNA, 23 bp, Homo sapiens
tcttgtccatgtggttcttcaaa

SEQ ID NO: 3300081 - DNA, 20 bp, Homo sapiens
tcttgtcccacgtgtcttcc

SEQ ID NO: 3300082 - DNA, 23 bp, Homo sapiens
tcttgtcccacgtgtcttccact

SEQ ID NO: 3300083 - DNA, 22 bp, Homo sapiens
tcttgtccctaagtaagtttct

SEQ ID NO: 3300084 - DNA, 12 bp, Homo sapiens
tcttgtctctgg

SEQ ID NO: 3300085 - DNA, 13 bp, Homo sapiens
tcttgtctctggg

SEQ ID NO: 3300086 - DNA, 15 bp, Homo sapiens
tcttgtctctgggct

SEQ ID NO: 3300087 - DNA, 14 bp, Homo sapiens
tcttgtgctagaat

SEQ ID NO: 3300088 - DNA, 17 bp, Homo sapiens
tcttgtgctagaatact

SEQ ID NO: 3300089 - DNA, 18 bp, Homo sapiens
tcttgtgctagaatactt

SEQ ID NO: 3300090 - DNA, 19 bp, Homo sapiens
tcttgtgctagaatacttt

SEQ ID NO: 3300091 - DNA, 23 bp, Homo sapiens
tcttgtgctagaatactttttaa

SEQ ID NO: 3300092 - DNA, 22 bp, Homo sapiens
tcttgtgctggatggagcccag

SEQ ID NO: 3300093 - DNA, 18 bp, Homo sapiens
tcttgtgcttttcctgat

SEQ ID NO: 3300094 - DNA, 13 bp, Homo sapiens
tcttgtggtgagg

SEQ ID NO: 3300095 - DNA, 15 bp, Homo sapiens
tcttgtggtgtaaag

SEQ ID NO: 3300096 - DNA, 19 bp, Homo sapiens
tcttgtgtgattaacttat

SEQ ID NO: 3300097 - DNA, 24 bp, Homo sapiens
tcttgttagagagcttttcactgt

SEQ ID NO: 3300098 - DNA, 14 bp, Homo sapiens
tcttgttcttcccc

SEQ ID NO: 3300099 - DNA, 15 bp, Homo sapiens
tcttgttgcatcttt

SEQ ID NO: 3300100 - DNA, 13 bp, Homo sapiens
tcttgtttattga

SEQ ID NO: 3300101 - DNA, 20 bp, Homo sapiens
tcttgtttctgaagtactta

SEQ ID NO: 3300102 - DNA, 14 bp, Homo sapiens
tcttgttttgtttg

SEQ ID NO: 3300103 - DNA, 17 bp, Homo sapiens
tcttgttttgtttgtct

SEQ ID NO: 3300104 - DNA, 17 bp, Homo sapiens
tctttaaaagaatgact

SEQ ID NO: 3300105 - DNA, 15 bp, Homo sapiens
tctttaaaagagaga

SEQ ID NO: 3300106 - DNA, 18 bp, Homo sapiens
tctttaaaggcccagccc

SEQ ID NO: 3300107 - DNA, 19 bp, Homo sapiens
tctttaacagcttacactg

SEQ ID NO: 3300108 - DNA, 15 bp, Homo sapiens
tctttaactcataaa

SEQ ID NO: 3300109 - DNA, 11 bp, Homo sapiens
tctttaactgc

SEQ ID NO: 3300110 - DNA, 22 bp, Homo sapiens
tctttaactgccgtaatttaac

SEQ ID NO: 3300111 - DNA, 17 bp, Homo sapiens
tctttaacttagtattt

SEQ ID NO: 3300112 - DNA, 14 bp, Homo sapiens
tctttaagaaagta

SEQ ID NO: 3300113 - DNA, 21 bp, Homo sapiens
tctttaagttttgattaatgt

SEQ ID NO: 3300114 - DNA, 16 bp, Homo sapiens
tctttaataaattgct

SEQ ID NO: 3300115 - DNA, 20 bp, Homo sapiens
tctttaatgtcacaggcagg

SEQ ID NO: 3300116 - DNA, 22 bp, Homo sapiens
tctttaatgtcacaggcaggtc

SEQ ID NO: 3300117 - DNA, 16 bp, Homo sapiens
tctttaccaaaggttt

SEQ ID NO: 3300118 - DNA, 16 bp, Homo sapiens
tctttactcccaagac

SEQ ID NO: 3300119 - DNA, 20 bp, Homo sapiens
tctttactcccttcctggcc

SEQ ID NO: 3300120 - DNA, 21 bp, Homo sapiens
tctttactcccttcctggcct

SEQ ID NO: 3300121 - DNA, 17 bp, Homo sapiens
tctttactctgacttcc

SEQ ID NO: 3300122 - DNA, 12 bp, Homo sapiens
tctttagtatag

SEQ ID NO: 3300123 - DNA, 22 bp, Homo sapiens
tctttagtttttggttgggaat

SEQ ID NO: 3300124 - DNA, 23 bp, Homo sapiens
tctttatagaaggaatttgtact

SEQ ID NO: 3300125 - DNA, 15 bp, Homo sapiens
tctttatagatgtac

SEQ ID NO: 3300126 - DNA, 16 bp, Homo sapiens
tctttatatgaacata

SEQ ID NO: 3300127 - DNA, 19 bp, Homo sapiens
tctttatgagctaaaaata

SEQ ID NO: 3300128 - DNA, 17 bp, Homo sapiens
tctttatgctgtatttt

SEQ ID NO: 3300129 - DNA, 15 bp, Homo sapiens
tctttattcttatta

SEQ ID NO: 3300130 - DNA, 18 bp, Homo sapiens
tctttatttatttatatt

SEQ ID NO: 3300131 - DNA, 15 bp, Homo sapiens
tctttcacaaggtat

SEQ ID NO: 3300132 - DNA, 19 bp, Homo sapiens
tctttcacaaggtataata

SEQ ID NO: 3300133 - DNA, 14 bp, Homo sapiens
tctttcacagctcc

SEQ ID NO: 3300134 - DNA, 15 bp, Homo sapiens
tctttcacagctcct

SEQ ID NO: 3300135 - DNA, 14 bp, Homo sapiens
tctttcacctttct

SEQ ID NO: 3300136 - DNA, 13 bp, Homo sapiens
tctttcacttgaa

SEQ ID NO: 3300137 - DNA, 16 bp, Homo sapiens
tctttcacttgaaaga

SEQ ID NO: 3300138 - DNA, 23 bp, Homo sapiens
tctttcagaaatataacacattt

SEQ ID NO: 3300139 - DNA, 21 bp, Homo sapiens
tctttcagtacttttttaaat

SEQ ID NO: 3300140 - DNA, 15 bp, Homo sapiens
tctttccaaaacatt

SEQ ID NO: 3300141 - DNA, 18 bp, Homo sapiens
tctttccaaattatttct

SEQ ID NO: 3300142 - DNA, 15 bp, Homo sapiens
tctttccactttcat

SEQ ID NO: 3300143 - DNA, 13 bp, Homo sapiens
tctttccaggctt

SEQ ID NO: 3300144 - DNA, 16 bp, Homo sapiens
tctttccataataaaa

SEQ ID NO: 3300145 - DNA, 19 bp, Homo sapiens
tctttccattatgattctt

SEQ ID NO: 3300146 - DNA, 22 bp, Homo sapiens
tctttcccaccctgttcccagt

SEQ ID NO: 3300147 - DNA, 16 bp, Homo sapiens
tctttcccccctccct

SEQ ID NO: 3300148 - DNA, 19 bp, Homo sapiens
tctttcccttttctgttta

SEQ ID NO: 3300149 - DNA, 23 bp, Homo sapiens
tctttcctacacactctgagtct

SEQ ID NO: 3300150 - DNA, 14 bp, Homo sapiens
tctttcctgccttc

SEQ ID NO: 3300151 - DNA, 11 bp, Homo sapiens
tctttcctgtc

SEQ ID NO: 3300152 - DNA, 16 bp, Homo sapiens
tctttccttaataaat

SEQ ID NO: 3300153 - DNA, 14 bp, Homo sapiens
tctttcgtcaccct

SEQ ID NO: 3300154 - DNA, 18 bp, Homo sapiens
tctttctaactttcttta

SEQ ID NO: 3300155 - DNA, 23 bp, Homo sapiens
tctttctacaaagcactagagaa

SEQ ID NO: 3300156 - DNA, 16 bp, Homo sapiens
tctttctagtggtctt

SEQ ID NO: 3300157 - DNA, 22 bp, Homo sapiens
tctttctagtggtctttgtaag

SEQ ID NO: 3300158 - DNA, 20 bp, Homo sapiens
tctttctctctctctcttcc

SEQ ID NO: 3300159 - DNA, 17 bp, Homo sapiens
tctttctctcttccctc

SEQ ID NO: 3300160 - DNA, 19 bp, Homo sapiens
tctttctgagcacacttta

SEQ ID NO: 3300161 - DNA, 13 bp, Homo sapiens
tctttctggactg

SEQ ID NO: 3300162 - DNA, 10 bp, Homo sapiens
tctttctgta

SEQ ID NO: 3300163 - DNA, 13 bp, Homo sapiens
tctttcttcaaat

SEQ ID NO: 3300164 - DNA, 14 bp, Homo sapiens
tctttcttcctctg

SEQ ID NO: 3300165 - DNA, 14 bp, Homo sapiens
tctttcttcctttc

SEQ ID NO: 3300166 - DNA, 16 bp, Homo sapiens
tctttcttcctttcta

SEQ ID NO: 3300167 - DNA, 21 bp, Homo sapiens
tctttcttgctggctctgaga

SEQ ID NO: 3300168 - DNA, 16 bp, Homo sapiens
tctttctttaaatgtt

SEQ ID NO: 3300169 - DNA, 17 bp, Homo sapiens
tctttctttacctgaga

SEQ ID NO: 3300170 - DNA, 21 bp, Homo sapiens
tctttctttacctgagaccag

SEQ ID NO: 3300171 - DNA, 19 bp, Homo sapiens
tctttctttggtgcctttc

SEQ ID NO: 3300172 - DNA, 21 bp, Homo sapiens
tctttgaaaacagatgaccat

SEQ ID NO: 3300173 - DNA, 19 bp, Homo sapiens
tctttgacaactaaaatta

SEQ ID NO: 3300174 - DNA, 17 bp, Homo sapiens
tctttgataatgttaaa

SEQ ID NO: 3300175 - DNA, 21 bp, Homo sapiens
tctttgatcgtatatttctca

SEQ ID NO: 3300176 - DNA, 20 bp, Homo sapiens
tctttgattctccttttatg

SEQ ID NO: 3300177 - DNA, 22 bp, Homo sapiens
tctttgattctccttttatgtg

SEQ ID NO: 3300178 - DNA, 15 bp, Homo sapiens
tctttgcaccaaaga

SEQ ID NO: 3300179 - DNA, 16 bp, Homo sapiens
tctttgcaccaaagac

SEQ ID NO: 3300180 - DNA, 14 bp, Homo sapiens
tctttgcagacagg

SEQ ID NO: 3300181 - DNA, 17 bp, Homo sapiens
tctttgcagacaggcaa

SEQ ID NO: 3300182 - DNA, 13 bp, Homo sapiens
tctttgcagggct

SEQ ID NO: 3300183 - DNA, 21 bp, Homo sapiens
tctttgccagtcattcagcag

SEQ ID NO: 3300184 - DNA, 15 bp, Homo sapiens
tctttgctgtactct

SEQ ID NO: 3300185 - DNA, 20 bp, Homo sapiens
tctttgctgtactcttgctg

SEQ ID NO: 3300186 - DNA, 16 bp, Homo sapiens
tctttggaaagtacac

SEQ ID NO: 3300187 - DNA, 14 bp, Homo sapiens
tctttggagttaaa

SEQ ID NO: 3300188 - DNA, 16 bp, Homo sapiens
tctttggtctattttc

SEQ ID NO: 3300189 - DNA, 20 bp, Homo sapiens
tctttggtgcctttcctgtt

SEQ ID NO: 3300190 - DNA, 21 bp, Homo sapiens
tctttgtaagagtgtagaagc

SEQ ID NO: 3300191 - DNA, 22 bp, Homo sapiens
tctttgtaagagtgtagaagca

SEQ ID NO: 3300192 - DNA, 23 bp, Homo sapiens
tctttgtaagagtgtagaagcat

SEQ ID NO: 3300193 - DNA, 18 bp, Homo sapiens
tctttgtaatttaatgaa

SEQ ID NO: 3300194 - DNA, 19 bp, Homo sapiens
tctttgtaccaaaatttta

SEQ ID NO: 3300195 - DNA, 23 bp, Homo sapiens
tctttgtaccaaaattttaaaaa

SEQ ID NO: 3300196 - DNA, 19 bp, Homo sapiens
tgaagctgttgtgtgaggt

SEQ ID NO: 3300197 - DNA, 22 bp, Homo sapiens
tgaagcttcactcactgtcaat

SEQ ID NO: 3300198 - DNA, 12 bp, Homo sapiens
tgaagctttata

SEQ ID NO: 3300199 - DNA, 21 bp, Homo sapiens
tgaaggaaaagcaagaaacag

SEQ ID NO: 3300200 - DNA, 22 bp, Homo sapiens
tgaaggaaaagcaagaaacagt

SEQ ID NO: 3300201 - DNA, 23 bp, Homo sapiens
tgaaggaaataaaaaagtctcta

SEQ ID NO: 3300202 - DNA, 17 bp, Homo sapiens
tgaaggaatagccagag

SEQ ID NO: 3300203 - DNA, 20 bp, Homo sapiens
tgaaggaatagccagagagg

SEQ ID NO: 3300204 - DNA, 22 bp, Homo sapiens
tgaaggacattgcggacagcca

SEQ ID NO: 3300205 - DNA, 20 bp, Homo sapiens
tgaaggactggattggccaa

SEQ ID NO: 3300206 - DNA, 16 bp, Homo sapiens
tgaaggagagcccttc

SEQ ID NO: 3300207 - DNA, 16 bp, Homo sapiens
tgaaggataagagaaa

SEQ ID NO: 3300208 - DNA, 16 bp, Homo sapiens
tgaaggcaaaattgca

SEQ ID NO: 3300209 - DNA, 14 bp, Homo sapiens
tgaaggcagtctga

SEQ ID NO: 3300210 - DNA, 19 bp, Homo sapiens
tgaaggcagtggcagggga

SEQ ID NO: 3300211 - DNA, 15 bp, Homo sapiens
tgaaggcctggctgg

SEQ ID NO: 3300212 - DNA, 19 bp, Homo sapiens
tgaaggccttattctacat

SEQ ID NO: 3300213 - DNA, 18 bp, Homo sapiens
tgaagggagaagacactg

SEQ ID NO: 3300214 - DNA, 21 bp, Homo sapiens
tgaagggagaagacactgcag

SEQ ID NO: 3300215 - DNA, 22 bp, Homo sapiens
tgaaggggcacaccactgccct

SEQ ID NO: 3300216 - DNA, 21 bp, Homo sapiens
tgaagggggtaccttaagaga

SEQ ID NO: 3300217 - DNA, 14 bp, Homo sapiens
tgaagggtcctgcc

SEQ ID NO: 3300218 - DNA, 18 bp, Homo sapiens
tgaaggtgataagggaaa

SEQ ID NO: 3300219 - DNA, 19 bp, Homo sapiens
tgaaggtgataagggaaaa

SEQ ID NO: 3300220 - DNA, 13 bp, Homo sapiens
tgaaggtgggaaa

SEQ ID NO: 3300221 - DNA, 16 bp, Homo sapiens
tgaagtaaactttttg

SEQ ID NO: 3300222 - DNA, 15 bp, Homo sapiens
tgaagtaaattatgt

SEQ ID NO: 3300223 - DNA, 16 bp, Homo sapiens
tgaagtaaattatgta

SEQ ID NO: 3300224 - DNA, 18 bp, Homo sapiens
tgaagtaaattatgtaac

SEQ ID NO: 3300225 - DNA, 19 bp, Homo sapiens
tgaagtaactgtggaggga

SEQ ID NO: 3300226 - DNA, 13 bp, Homo sapiens
tgaagtatattct

SEQ ID NO: 3300227 - DNA, 23 bp, Homo sapiens
tgaagtatattcttattggaaat

SEQ ID NO: 3300228 - DNA, 15 bp, Homo sapiens
tgaagtattcacaaa

SEQ ID NO: 3300229 - DNA, 17 bp, Homo sapiens
tgaagtatttctcactc

SEQ ID NO: 3300230 - DNA, 16 bp, Homo sapiens
tgaagtcactgcacag

SEQ ID NO: 3300231 - DNA, 21 bp, Homo sapiens
tgaagtcactgcacagtgcat

SEQ ID NO: 3300232 - DNA, 17 bp, Homo sapiens
tgaagtgactgttgtac

SEQ ID NO: 3300233 - DNA, 21 bp, Homo sapiens
tgaagtgcgtgaatgtatgta

SEQ ID NO: 3300234 - DNA, 15 bp, Homo sapiens
tgaagtgtgggataa

SEQ ID NO: 3300235 - DNA, 14 bp, Homo sapiens
tgaagttaacagag

SEQ ID NO: 3300236 - DNA, 18 bp, Homo sapiens
tgaagttcatggtgatca

SEQ ID NO: 3300237 - DNA, 20 bp, Homo sapiens
tgaagttcatggtgatcagt

SEQ ID NO: 3300238 - DNA, 16 bp, Homo sapiens
tgaagttgctgtttat

SEQ ID NO: 3300239 - DNA, 21 bp, Homo sapiens
tgaagttgctgtttatttttt

SEQ ID NO: 3300240 - DNA, 20 bp, Homo sapiens
tgaagttggcacatttcatg

SEQ ID NO: 3300241 - DNA, 22 bp, Homo sapiens
tgaagttggcacatttcatgag

SEQ ID NO: 3300242 - DNA, 17 bp, Homo sapiens
tgaagtttacaatcaaa

SEQ ID NO: 3300243 - DNA, 16 bp, Homo sapiens
tgaagtttacattgta

SEQ ID NO: 3300244 - DNA, 14 bp, Homo sapiens
tgaagtttcacatg

SEQ ID NO: 3300245 - DNA, 14 bp, Homo sapiens
tgaagtttgaacca

SEQ ID NO: 3300246 - DNA, 14 bp, Homo sapiens
tgaagttttacatt

SEQ ID NO: 3300247 - DNA, 16 bp, Homo sapiens
tgaagttttacattgt

SEQ ID NO: 3300248 - DNA, 17 bp, Homo sapiens
tgaagttttactgtcta

SEQ ID NO: 3300249 - DNA, 19 bp, Homo sapiens
tgaagtttttgaaatacct

SEQ ID NO: 3300250 - DNA, 17 bp, Homo sapiens
tgaataaaaaatagaca

SEQ ID NO: 3300251 - DNA, 13 bp, Homo sapiens
tgaataaaattat

SEQ ID NO: 3300252 - DNA, 20 bp, Homo sapiens
tgaataaaattattttggat

SEQ ID NO: 3300253 - DNA, 15 bp, Homo sapiens
tgaataaagacacct

SEQ ID NO: 3300254 - DNA, 16 bp, Homo sapiens
tgaataaagacaccta

SEQ ID NO: 3300255 - DNA, 15 bp, Homo sapiens
tgaataaatgtcttg

SEQ ID NO: 3300256 - DNA, 13 bp, Homo sapiens
tgaataacttgaa

SEQ ID NO: 3300257 - DNA, 16 bp, Homo sapiens
tgaataatggaaaatg

SEQ ID NO: 3300258 - DNA, 15 bp, Homo sapiens
tgaatacaattaaag

SEQ ID NO: 3300259 - DNA, 17 bp, Homo sapiens
tgaatacaattaaaggt

SEQ ID NO: 3300260 - DNA, 17 bp, Homo sapiens
tgaatacattaaaagaa

SEQ ID NO: 3300261 - DNA, 22 bp, Homo sapiens
tgaataccattaaaactgcttt

SEQ ID NO: 3300262 - DNA, 14 bp, Homo sapiens
tgaatactgctaca

SEQ ID NO: 3300263 - DNA, 20 bp, Homo sapiens
tgaatacttactataatttg

SEQ ID NO: 3300264 - DNA, 12 bp, Homo sapiens
tgaatagaaatg

SEQ ID NO: 3300265 - DNA, 18 bp, Homo sapiens
tgaatagatatgaaagct

SEQ ID NO: 3300266 - DNA, 18 bp, Homo sapiens
tgaataggtagtatcata

SEQ ID NO: 3300267 - DNA, 22 bp, Homo sapiens
tgaatagtcttttgcatgtcgc

SEQ ID NO: 3300268 - DNA, 12 bp, Homo sapiens
tgaatataaaaa

SEQ ID NO: 3300269 - DNA, 21 bp, Homo sapiens
tgaatatacagcaggtgctca

SEQ ID NO: 3300270 - DNA, 16 bp, Homo sapiens
tgaatatagcctgcct

SEQ ID NO: 3300271 - DNA, 15 bp, Homo sapiens
tgaatatcattaaat

SEQ ID NO: 3300272 - DNA, 16 bp, Homo sapiens
tgaatatctattaata

SEQ ID NO: 3300273 - DNA, 17 bp, Homo sapiens
tgaatatctattaatat

SEQ ID NO: 3300274 - DNA, 21 bp, Homo sapiens
tgaatatctattaatatatgt

SEQ ID NO: 3300275 - DNA, 15 bp, Homo sapiens
tgaatattactccta

SEQ ID NO: 3300276 - DNA, 11 bp, Homo sapiens
tgaatatttat

SEQ ID NO: 3300277 - DNA, 17 bp, Homo sapiens
tgaatatttataacagc

SEQ ID NO: 3300278 - DNA, 21 bp, Homo sapiens
tgaatatttgttatgtagata

SEQ ID NO: 3300279 - DNA, 24 bp, Homo sapiens
tgaatattttttatttctaagtat

SEQ ID NO: 3300280 - DNA, 16 bp, Homo sapiens
tgaatcactgttttta

SEQ ID NO: 3300281 - DNA, 20 bp, Homo sapiens
tgaatcagtataaacaaagt

SEQ ID NO: 3300282 - DNA, 16 bp, Homo sapiens
tgaatccaaactaatc

SEQ ID NO: 3300283 - DNA, 13 bp, Homo sapiens
tgaatccacctcg

SEQ ID NO: 3300284 - DNA, 20 bp, Homo sapiens
tgaatcccacccacatgtga

SEQ ID NO: 3300285 - DNA, 13 bp, Homo sapiens
tgaatcctctgtt

SEQ ID NO: 3300286 - DNA, 17 bp, Homo sapiens
tgaatcctcttctttat

SEQ ID NO: 3300287 - DNA, 15 bp, Homo sapiens
tgaatcctttgcctg

SEQ ID NO: 3300288 - DNA, 18 bp, Homo sapiens
tgaatctataaaagaatt

SEQ ID NO: 3300289 - DNA, 17 bp, Homo sapiens
tgaatctcgttcccaaa

SEQ ID NO: 3300290 - DNA, 15 bp, Homo sapiens
tgaatctgattttta

SEQ ID NO: 3300291 - DNA, 20 bp, Homo sapiens
tgaatctgtgcaaacagtaa

SEQ ID NO: 3300292 - DNA, 22 bp, Homo sapiens
tgaatgaaaaatttaagcattg

SEQ ID NO: 3300293 - DNA, 19 bp, Homo sapiens
tgaatgaaaataactgaac

SEQ ID NO: 3300294 - DNA, 16 bp, Homo sapiens
tgaatgaaagattaaa

SEQ ID NO: 3300295 - DNA, 19 bp, Homo sapiens
tgaatgaaagattaaacag

SEQ ID NO: 3300296 - DNA, 22 bp, Homo sapiens
tgaatgaaagattaaacagatg

SEQ ID NO: 3300297 - DNA, 12 bp, Homo sapiens
tgaatgaacact

SEQ ID NO: 3300298 - DNA, 15 bp, Homo sapiens
tgaatgaacactctt

SEQ ID NO: 3300299 - DNA, 22 bp, Homo sapiens
tgaatgagggccatatccctgt

SEQ ID NO: 3300300 - DNA, 22 bp, Homo sapiens
tgaatgaggtcagcatgtctat

SEQ ID NO: 3300301 - DNA, 15 bp, Homo sapiens
tgaatgatctctctg

SEQ ID NO: 3300302 - DNA, 17 bp, Homo sapiens
tgaatgattcatgttat

SEQ ID NO: 3300303 - DNA, 18 bp, Homo sapiens
tgaatgattcatgttata

SEQ ID NO: 3300304 - DNA, 19 bp, Homo sapiens
tgaatgcacactagcctct

SEQ ID NO: 3300305 - DNA, 15 bp, Homo sapiens
tgaatgcagaacggt

SEQ ID NO: 3300306 - DNA, 15 bp, Homo sapiens
tgaatgccactgcct

SEQ ID NO: 3300307 - DNA, 19 bp, Homo sapiens
tgaatgcctatggtggatc

SEQ ID NO: 3300308 - DNA, 19 bp, Homo sapiens
tgaatgcctcgctcccttc

SEQ ID NO: 3300309 - DNA, 17 bp, Homo sapiens
tgaatgcgctttattgc

SEQ ID NO: 3300310 - DNA, 11 bp, Homo sapiens
tgaatgctggg

SEQ ID NO: 3300311 - DNA, 12 bp, Homo sapiens
tgaatgcttttt

SEQ ID NO: 3300312 - DNA, 18 bp, Homo sapiens
tgaatgctttttgaatgt

SEQ ID NO: 3300313 - DNA, 15 bp, Homo sapiens
tgaatggattggatt

SEQ ID NO: 3300314 - DNA, 22 bp, Homo sapiens
tgaatggattggattatttaat

SEQ ID NO: 3300315 - DNA, 23 bp, Homo sapiens
tgaatggattggattatttaata

SEQ ID NO: 3300316 - DNA, 18 bp, Homo sapiens
tgaatggccctagaactg

SEQ ID NO: 3300317 - DNA, 17 bp, Homo sapiens
tgaatggcctgccttga

SEQ ID NO: 3300318 - DNA, 18 bp, Homo sapiens
tgaatgggacagagttga

SEQ ID NO: 3300319 - DNA, 17 bp, Homo sapiens
tgaatgggtccattttg

SEQ ID NO: 3300320 - DNA, 15 bp, Homo sapiens
tgaatggtgttgtat

SEQ ID NO: 3300321 - DNA, 18 bp, Homo sapiens
tgaatggtgttgtatgcc

SEQ ID NO: 3300322 - DNA, 14 bp, Homo sapiens
tgacagaggcagcc

SEQ ID NO: 3300323 - DNA, 15 bp, Homo sapiens
tgacagaggcagccc

SEQ ID NO: 3300324 - DNA, 17 bp, Homo sapiens
tgacagagtgagactct

SEQ ID NO: 3300325 - DNA, 19 bp, Homo sapiens
tgacagagtgagactctgt

SEQ ID NO: 3300326 - DNA, 22 bp, Homo sapiens
tgacagatatatttaagcctta

SEQ ID NO: 3300327 - DNA, 19 bp, Homo sapiens
tgacagatgttgaatgccc

SEQ ID NO: 3300328 - DNA, 13 bp, Homo sapiens
tgacagattctga

SEQ ID NO: 3300329 - DNA, 15 bp, Homo sapiens
tgacagattctgaca

SEQ ID NO: 3300330 - DNA, 22 bp, Homo sapiens
tgacagattctgacatttatat

SEQ ID NO: 3300331 - DNA, 14 bp, Homo sapiens
tgacagcaaaatgt

SEQ ID NO: 3300332 - DNA, 17 bp, Homo sapiens
tgacagcaaaatgttga

SEQ ID NO: 3300333 - DNA, 22 bp, Homo sapiens
tgacagcaaaatgttgaagaaa

SEQ ID NO: 3300334 - DNA, 17 bp, Homo sapiens
tgacagcctcccacccc

SEQ ID NO: 3300335 - DNA, 19 bp, Homo sapiens
tgacagcctcccaccccca

SEQ ID NO: 3300336 - DNA, 22 bp, Homo sapiens
tgacagcctcccacccccatct

SEQ ID NO: 3300337 - DNA, 16 bp, Homo sapiens
tgacaggaaagccctc

SEQ ID NO: 3300338 - DNA, 20 bp, Homo sapiens
tgacagggcacaccgggcac

SEQ ID NO: 3300339 - DNA, 21 bp, Homo sapiens
tgacagggcacaccgggcact

SEQ ID NO: 3300340 - DNA, 22 bp, Homo sapiens
tgacagggcacaccgggcactc

SEQ ID NO: 3300341 - DNA, 11 bp, Homo sapiens
tgacagggcca

SEQ ID NO: 3300342 - DNA, 12 bp, Homo sapiens
tgacagggccag

SEQ ID NO: 3300343 - DNA, 17 bp, Homo sapiens
tgacagggccagtgggg

SEQ ID NO: 3300344 - DNA, 21 bp, Homo sapiens
tgacagtcatcatcagggcct

SEQ ID NO: 3300345 - DNA, 22 bp, Homo sapiens
tgacagtcatcatcagggcctg

SEQ ID NO: 3300346 - DNA, 14 bp, Homo sapiens
tgacagtgcctggg

SEQ ID NO: 3300347 - DNA, 21 bp, Homo sapiens
tgacagtgcctgggaatgtat

SEQ ID NO: 3300348 - DNA, 16 bp, Homo sapiens
tgacagtgccttctct

SEQ ID NO: 3300349 - DNA, 22 bp, Homo sapiens
tgacataacaccaaacttcatt

SEQ ID NO: 3300350 - DNA, 20 bp, Homo sapiens
tgacatattatgcctgaatg

SEQ ID NO: 3300351 - DNA, 18 bp, Homo sapiens
tgacatcacagcagcctc

SEQ ID NO: 3300352 - DNA, 16 bp, Homo sapiens
tgacatcacttgtaca

SEQ ID NO: 3300353 - DNA, 12 bp, Homo sapiens
tgacatccaaat

SEQ ID NO: 3300354 - DNA, 11 bp, Homo sapiens
tgacatccctt

SEQ ID NO: 3300355 - DNA, 15 bp, Homo sapiens
tgacatcccttcctg

SEQ ID NO: 3300356 - DNA, 16 bp, Homo sapiens
tgacatcccttcctgg

SEQ ID NO: 3300357 - DNA, 17 bp, Homo sapiens
tgacatcccttcctgga

SEQ ID NO: 3300358 - DNA, 23 bp, Homo sapiens
tgacatcccttcctggaaacagc

SEQ ID NO: 3300359 - DNA, 14 bp, Homo sapiens
tgacatctcagggg

SEQ ID NO: 3300360 - DNA, 18 bp, Homo sapiens
tgacatctcaggggccag

SEQ ID NO: 3300361 - DNA, 21 bp, Homo sapiens
tgacatctcaggggccagagg

SEQ ID NO: 3300362 - DNA, 16 bp, Homo sapiens
tgacatctgtgtttca

SEQ ID NO: 3300363 - DNA, 12 bp, Homo sapiens
tgacatgaaaag

SEQ ID NO: 3300364 - DNA, 17 bp, Homo sapiens
tgacatgaaaagttatt

SEQ ID NO: 3300365 - DNA, 15 bp, Homo sapiens
tgacatgaagctgtt

SEQ ID NO: 3300366 - DNA, 17 bp, Homo sapiens
tgacatgcactgaccct

SEQ ID NO: 3300367 - DNA, 13 bp, Homo sapiens
tgacatgtaacag

SEQ ID NO: 3300368 - DNA, 16 bp, Homo sapiens
tgacatgtgaaacctt

SEQ ID NO: 3300369 - DNA, 19 bp, Homo sapiens
tgacatgtgaaaccttttt

SEQ ID NO: 3300370 - DNA, 22 bp, Homo sapiens
tgacatgtggaaagtgaatttg

SEQ ID NO: 3300371 - DNA, 19 bp, Homo sapiens
tgacatgttatatattttt

SEQ ID NO: 3300372 - DNA, 13 bp, Homo sapiens
tgacattaacagt

SEQ ID NO: 3300373 - DNA, 20 bp, Homo sapiens
tgacattatgtggttttaga

SEQ ID NO: 3300374 - DNA, 14 bp, Homo sapiens
tgacattgcacctg

SEQ ID NO: 3300375 - DNA, 18 bp, Homo sapiens
tgacattgtagagcttct

SEQ ID NO: 3300376 - DNA, 11 bp, Homo sapiens
tgacattgtct

SEQ ID NO: 3300377 - DNA, 12 bp, Homo sapiens
tgacatttaaat

SEQ ID NO: 3300378 - DNA, 18 bp, Homo sapiens
tgacatttaatttagtga

SEQ ID NO: 3300379 - DNA, 23 bp, Homo sapiens
tgacatttaatttagtgatctta

SEQ ID NO: 3300380 - DNA, 19 bp, Homo sapiens
tgacatttatatattgaat

SEQ ID NO: 3300381 - DNA, 20 bp, Homo sapiens
tgacatttatatattgaatt

SEQ ID NO: 3300382 - DNA, 22 bp, Homo sapiens
tgacatttcttctagtgatgat

SEQ ID NO: 3300383 - DNA, 22 bp, Homo sapiens
tgacatttgggagacatgtgac

SEQ ID NO: 3300384 - DNA, 12 bp, Homo sapiens
tgaccaaaatac

SEQ ID NO: 3300385 - DNA, 13 bp, Homo sapiens
tgaccaaaccagc

SEQ ID NO: 3300386 - DNA, 16 bp, Homo sapiens
tgaccaaaccagcctt

SEQ ID NO: 3300387 - DNA, 17 bp, Homo sapiens
tgaccaaaccagccttc

SEQ ID NO: 3300388 - DNA, 14 bp, Homo sapiens
tgaccaagaactgc

SEQ ID NO: 3300389 - DNA, 15 bp, Homo sapiens
tgaccaagaactgca

SEQ ID NO: 3300390 - DNA, 13 bp, Homo sapiens
tgaccaagttata

SEQ ID NO: 3300391 - DNA, 23 bp, Homo sapiens
tgaccaatattatactaagaaaa

SEQ ID NO: 3300392 - DNA, 13 bp, Homo sapiens
tgaccaccctccc

SEQ ID NO: 3300393 - DNA, 16 bp, Homo sapiens
tgaccaccctcccctc

SEQ ID NO: 3300394 - DNA, 18 bp, Homo sapiens
tgaccaccctcccctctc

SEQ ID NO: 3300395 - DNA, 22 bp, Homo sapiens
tgaccacgctttctagctgttg

SEQ ID NO: 3300396 - DNA, 22 bp, Homo sapiens
tgaccacggacgtttccatcag

SEQ ID NO: 3300397 - DNA, 18 bp, Homo sapiens
tgaccagcactgtctcag

SEQ ID NO: 3300398 - DNA, 22 bp, Homo sapiens
tgaccagcctccatgctgcctc

SEQ ID NO: 3300399 - DNA, 16 bp, Homo sapiens
tgaccaggcatcctcc

SEQ ID NO: 3300400 - DNA, 15 bp, Homo sapiens
tgaccataatttttt

SEQ ID NO: 3300401 - DNA, 20 bp, Homo sapiens
tgaccatacaatttcatcct

SEQ ID NO: 3300402 - DNA, 23 bp, Homo sapiens
tgaccatccactctaccctccca

SEQ ID NO: 3300403 - DNA, 14 bp, Homo sapiens
tgaccatctgcttt

SEQ ID NO: 3300404 - DNA, 18 bp, Homo sapiens
tgaccatcttcataattt

SEQ ID NO: 3300405 - DNA, 19 bp, Homo sapiens
tgaccatgctcatctgctg

SEQ ID NO: 3300406 - DNA, 12 bp, Homo sapiens
tgaccatgtact

SEQ ID NO: 3300407 - DNA, 13 bp, Homo sapiens
tgaccatgttcat

SEQ ID NO: 3300408 - DNA, 14 bp, Homo sapiens
tgaccatgttcatt

SEQ ID NO: 3300409 - DNA, 16 bp, Homo sapiens
tgaccatgttcattat

SEQ ID NO: 3300410 - DNA, 12 bp, Homo sapiens
tgacccaccagt

SEQ ID NO: 3300411 - DNA, 13 bp, Homo sapiens
tgacccaccagtg

SEQ ID NO: 3300412 - DNA, 11 bp, Homo sapiens
tgacccacccc

SEQ ID NO: 3300413 - DNA, 13 bp, Homo sapiens
tgacccacccctg

SEQ ID NO: 3300414 - DNA, 17 bp, Homo sapiens
tgacccacccctgtgct

SEQ ID NO: 3300415 - DNA, 20 bp, Homo sapiens
tgacccactgatctctacta

SEQ ID NO: 3300416 - DNA, 17 bp, Homo sapiens
tgacccactggttcctt

SEQ ID NO: 3300417 - DNA, 22 bp, Homo sapiens
tgacccagagtggagtctgagt

SEQ ID NO: 3300418 - DNA, 12 bp, Homo sapiens
tgacccagcatc

SEQ ID NO: 3300419 - DNA, 14 bp, Homo sapiens
tgacccaggccgca

SEQ ID NO: 3300420 - DNA, 15 bp, Homo sapiens
tgacccaggccgcag

SEQ ID NO: 3300421 - DNA, 16 bp, Homo sapiens
tgacccaggccgcagc

SEQ ID NO: 3300422 - DNA, 21 bp, Homo sapiens
tgacccaggccgcagctcttg

SEQ ID NO: 3300423 - DNA, 21 bp, Homo sapiens
tgacccagtccccgtgccccg

SEQ ID NO: 3300424 - DNA, 22 bp, Homo sapiens
tgaccccaaacaccttccagct

SEQ ID NO: 3300425 - DNA, 18 bp, Homo sapiens
tgaccccactgccaagtg

SEQ ID NO: 3300426 - DNA, 20 bp, Homo sapiens
tgaccccagtggaaaacaaa

SEQ ID NO: 3300427 - DNA, 15 bp, Homo sapiens
tgaccccctcccctg

SEQ ID NO: 3300428 - DNA, 21 bp, Homo sapiens
tgaccctatgggtctaggaca

SEQ ID NO: 3300429 - DNA, 15 bp, Homo sapiens
tgaccctgaagtgag

SEQ ID NO: 3300430 - DNA, 20 bp, Homo sapiens
tgaccctgcgaaggggccct

SEQ ID NO: 3300431 - DNA, 14 bp, Homo sapiens
tgacccttcagggc

SEQ ID NO: 3300432 - DNA, 17 bp, Homo sapiens
tgacccttcagggccag

SEQ ID NO: 3300433 - DNA, 21 bp, Homo sapiens
tgacccttcagggccagaagg

SEQ ID NO: 3300434 - DNA, 19 bp, Homo sapiens
tgacccttcccaatcagca

SEQ ID NO: 3300435 - DNA, 22 bp, Homo sapiens
tgacccttgggcctgggcctct

SEQ ID NO: 3300436 - DNA, 18 bp, Homo sapiens
tgaccgactaccccagtc

SEQ ID NO: 3300437 - DNA, 20 bp, Homo sapiens
tgaccgtactctcacatgtg

SEQ ID NO: 3300438 - DNA, 13 bp, Homo sapiens
tgacctactctca

SEQ ID NO: 3300439 - DNA, 20 bp, Homo sapiens
tgacctattcaccctccact

SEQ ID NO: 3300440 - DNA, 22 bp, Homo sapiens
tgacctattcaccctccacttc

SEQ ID NO: 3300441 - DNA, 14 bp, Homo sapiens
tgacctcactgtga

SEQ ID NO: 3300442 - DNA, 19 bp, Homo sapiens
tgacctcaggcactagcct

SEQ ID NO: 3300443 - DNA, 21 bp, Homo sapiens
tgacctcaggtgatccaccca

SEQ ID NO: 3300444 - DNA, 19 bp, Homo sapiens
tgacctcaggtgatccgcc

SEQ ID NO: 3300445 - DNA, 12 bp, Homo sapiens
tgacctcccagc

SEQ ID NO: 3300446 - DNA, 14 bp, Homo sapiens
tgacctcccagccc

SEQ ID NO: 3300447 - DNA, 15 bp, Homo sapiens
tgacctcccagccct

SEQ ID NO: 3300448 - DNA, 19 bp, Homo sapiens
tgaggagcatgttttgtat

SEQ ID NO: 3300449 - DNA, 20 bp, Homo sapiens
tgaggagcccatactcagcc

SEQ ID NO: 3300450 - DNA, 21 bp, Homo sapiens
tgaggagcccatactcagcct

SEQ ID NO: 3300451 - DNA, 14 bp, Homo sapiens
tgaggagccccagc

SEQ ID NO: 3300452 - DNA, 13 bp, Homo sapiens
tgaggagctgctg

SEQ ID NO: 3300453 - DNA, 15 bp, Homo sapiens
tgaggaggaaaagga

SEQ ID NO: 3300454 - DNA, 13 bp, Homo sapiens
tgaggaggaggct

SEQ ID NO: 3300455 - DNA, 17 bp, Homo sapiens
tgaggagggtggaggaa

SEQ ID NO: 3300456 - DNA, 19 bp, Homo sapiens
tgaggagtttcctaaaagt

SEQ ID NO: 3300457 - DNA, 13 bp, Homo sapiens
tgaggattgtgga

SEQ ID NO: 3300458 - DNA, 15 bp, Homo sapiens
tgaggattgtggaaa

SEQ ID NO: 3300459 - DNA, 17 bp, Homo sapiens
tgaggattgtggaaaac

SEQ ID NO: 3300460 - DNA, 20 bp, Homo sapiens
tgaggattgtggaaaaccag

SEQ ID NO: 3300461 - DNA, 20 bp, Homo sapiens
tgaggcaaattaactgtatg

SEQ ID NO: 3300462 - DNA, 20 bp, Homo sapiens
tgaggcaacctgattgtaaa

SEQ ID NO: 3300463 - DNA, 14 bp, Homo sapiens
tgaggcaagagaat

SEQ ID NO: 3300464 - DNA, 14 bp, Homo sapiens
tgaggcaggagaat

SEQ ID NO: 3300465 - DNA, 18 bp, Homo sapiens
tgaggcagggcaaatgac

SEQ ID NO: 3300466 - DNA, 16 bp, Homo sapiens
tgaggccatctcagga

SEQ ID NO: 3300467 - DNA, 16 bp, Homo sapiens
tgaggcctagactctg

SEQ ID NO: 3300468 - DNA, 14 bp, Homo sapiens
tgaggcctcatccc

SEQ ID NO: 3300469 - DNA, 14 bp, Homo sapiens
tgaggcctgaggcc

SEQ ID NO: 3300470 - DNA, 23 bp, Homo sapiens
tgaggcctggactttcctgcaac

SEQ ID NO: 3300471 - DNA, 22 bp, Homo sapiens
tgaggcctgtgcctgtcaggct

SEQ ID NO: 3300472 - DNA, 17 bp, Homo sapiens
tgaggcggtttcctgaa

SEQ ID NO: 3300473 - DNA, 20 bp, Homo sapiens
tgaggctccacttggtctgt

SEQ ID NO: 3300474 - DNA, 17 bp, Homo sapiens
tgaggctctttctgggc

SEQ ID NO: 3300475 - DNA, 12 bp, Homo sapiens
tgaggctgtcct

SEQ ID NO: 3300476 - DNA, 13 bp, Homo sapiens
tgaggctgtcctg

SEQ ID NO: 3300477 - DNA, 18 bp, Homo sapiens
tgaggctgtcctgtacat

SEQ ID NO: 3300478 - DNA, 21 bp, Homo sapiens
tgaggctgtggtcacagcgga

SEQ ID NO: 3300479 - DNA, 13 bp, Homo sapiens
tgaggcttagaga

SEQ ID NO: 3300480 - DNA, 17 bp, Homo sapiens
tgaggcttagagagagg

SEQ ID NO: 3300481 - DNA, 13 bp, Homo sapiens
tgaggcttccagg

SEQ ID NO: 3300482 - DNA, 16 bp, Homo sapiens
tgaggcttccaggctc

SEQ ID NO: 3300483 - DNA, 18 bp, Homo sapiens
tgaggcttccaggctctt

SEQ ID NO: 3300484 - DNA, 20 bp, Homo sapiens
tgaggcttccaggctcttcc

SEQ ID NO: 3300485 - DNA, 21 bp, Homo sapiens
tgaggcttccaggctcttcct

SEQ ID NO: 3300486 - DNA, 22 bp, Homo sapiens
tgaggcttccaggctcttcctg

SEQ ID NO: 3300487 - DNA, 13 bp, Homo sapiens
tgaggctttggat

SEQ ID NO: 3300488 - DNA, 23 bp, Homo sapiens
tgaggctttggatttgacattgc

SEQ ID NO: 3300489 - DNA, 18 bp, Homo sapiens
tgagggaggaggccacct

SEQ ID NO: 3300490 - DNA, 19 bp, Homo sapiens
tgagggaggaggccacctc

SEQ ID NO: 3300491 - DNA, 12 bp, Homo sapiens
tgagggcaaatc

SEQ ID NO: 3300492 - DNA, 18 bp, Homo sapiens
tgagggcagactggggca

SEQ ID NO: 3300493 - DNA, 14 bp, Homo sapiens
tgagggcccagagc

SEQ ID NO: 3300494 - DNA, 16 bp, Homo sapiens
tgagggcccagagcag

SEQ ID NO: 3300495 - DNA, 20 bp, Homo sapiens
tgagggcccagagcaggaag

SEQ ID NO: 3300496 - DNA, 21 bp, Homo sapiens
tgagggcccagccaggagcag

SEQ ID NO: 3300497 - DNA, 13 bp, Homo sapiens
tgaggggcagtcc

SEQ ID NO: 3300498 - DNA, 18 bp, Homo sapiens
tgaggggccctggccagg

SEQ ID NO: 3300499 - DNA, 14 bp, Homo sapiens
tgaggggcctggag

SEQ ID NO: 3300500 - DNA, 15 bp, Homo sapiens
tgaggggcctggaga

SEQ ID NO: 3300501 - DNA, 14 bp, Homo sapiens
tgaggggctggcct

SEQ ID NO: 3300502 - DNA, 17 bp, Homo sapiens
tgaggggcttcctgggt

SEQ ID NO: 3300503 - DNA, 14 bp, Homo sapiens
tgaggggggctggc

SEQ ID NO: 3300504 - DNA, 19 bp, Homo sapiens
tgagggtccccacctggga

SEQ ID NO: 3300505 - DNA, 12 bp, Homo sapiens
tgagggtcttct

SEQ ID NO: 3300506 - DNA, 14 bp, Homo sapiens
tgagggtggagact

SEQ ID NO: 3300507 - DNA, 18 bp, Homo sapiens
tgagggtgtttcctctaa

SEQ ID NO: 3300508 - DNA, 19 bp, Homo sapiens
tgagggtgtttcctctaaa

SEQ ID NO: 3300509 - DNA, 14 bp, Homo sapiens
tgaggtaaagatat

SEQ ID NO: 3300510 - DNA, 17 bp, Homo sapiens
tgaggtcaccaggggag

SEQ ID NO: 3300511 - DNA, 17 bp, Homo sapiens
tgaggtcagagcctgca

SEQ ID NO: 3300512 - DNA, 19 bp, Homo sapiens
tgaggtcagagcctgcagt

SEQ ID NO: 3300513 - DNA, 12 bp, Homo sapiens
tgaggtcaggga

SEQ ID NO: 3300514 - DNA, 23 bp, Homo sapiens
tgaggtccctgtgtgtaggctgg

SEQ ID NO: 3300515 - DNA, 17 bp, Homo sapiens
tgaggtctcttgaggga

SEQ ID NO: 3300516 - DNA, 14 bp, Homo sapiens
tgaggtctgttcct

SEQ ID NO: 3300517 - DNA, 17 bp, Homo sapiens
tgaggtcttttgacatg

SEQ ID NO: 3300518 - DNA, 18 bp, Homo sapiens
tgaggtgaaagggagcta

SEQ ID NO: 3300519 - DNA, 17 bp, Homo sapiens
tgaggtgaaatgggaga

SEQ ID NO: 3300520 - DNA, 18 bp, Homo sapiens
tgaggtgaaatgggagat

SEQ ID NO: 3300521 - DNA, 15 bp, Homo sapiens
tgaggtgcctgtccc

SEQ ID NO: 3300522 - DNA, 15 bp, Homo sapiens
tgaggtgctatgttc

SEQ ID NO: 3300523 - DNA, 18 bp, Homo sapiens
tgaggtggcactttttca

SEQ ID NO: 3300524 - DNA, 20 bp, Homo sapiens
tgaggtggcactttttcatt

SEQ ID NO: 3300525 - DNA, 13 bp, Homo sapiens
tgaggtgggaggt

SEQ ID NO: 3300526 - DNA, 18 bp, Homo sapiens
tgaggtgggaggtggaag

SEQ ID NO: 3300527 - DNA, 20 bp, Homo sapiens
tgaggtgggcccaggaccag

SEQ ID NO: 3300528 - DNA, 16 bp, Homo sapiens
tgaggtgggctggggc

SEQ ID NO: 3300529 - DNA, 12 bp, Homo sapiens
tgaggtggtagg

SEQ ID NO: 3300530 - DNA, 13 bp, Homo sapiens
tgaggtggtctga

SEQ ID NO: 3300531 - DNA, 17 bp, Homo sapiens
tgaggtggtctgaatgt

SEQ ID NO: 3300532 - DNA, 22 bp, Homo sapiens
tgaggtggtctgaatgttctga

SEQ ID NO: 3300533 - DNA, 23 bp, Homo sapiens
tgaggtgtgggggctgcagcatg

SEQ ID NO: 3300534 - DNA, 12 bp, Homo sapiens
tgaggttaggag

SEQ ID NO: 3300535 - DNA, 15 bp, Homo sapiens
tgaggttcctctgcc

SEQ ID NO: 3300536 - DNA, 19 bp, Homo sapiens
tgaggttctgagaccagtg

SEQ ID NO: 3300537 - DNA, 18 bp, Homo sapiens
tgagtaacatttgctgtt

SEQ ID NO: 3300538 - DNA, 15 bp, Homo sapiens
tgagtaatggtgtag

SEQ ID NO: 3300539 - DNA, 17 bp, Homo sapiens
tgagtaatggtgtagaa

SEQ ID NO: 3300540 - DNA, 19 bp, Homo sapiens
tgagtaatggtgtagaaca

SEQ ID NO: 3300541 - DNA, 15 bp, Homo sapiens
tgagtatacaatata

SEQ ID NO: 3300542 - DNA, 17 bp, Homo sapiens
tgagtatgtggaaggca

SEQ ID NO: 3300543 - DNA, 18 bp, Homo sapiens
tgagtcaatgtgcagtgt

SEQ ID NO: 3300544 - DNA, 14 bp, Homo sapiens
tgagtcaccaagcc

SEQ ID NO: 3300545 - DNA, 16 bp, Homo sapiens
tgagtcacccatgaag

SEQ ID NO: 3300546 - DNA, 21 bp, Homo sapiens
tgagtcacgctggggctctct

SEQ ID NO: 3300547 - DNA, 22 bp, Homo sapiens
tgagtcacgctggggctctctg

SEQ ID NO: 3300548 - DNA, 21 bp, Homo sapiens
tgagtcagatgggtctgatat

SEQ ID NO: 3300549 - DNA, 23 bp, Homo sapiens
tgagtcaggagcttattacagaa

SEQ ID NO: 3300550 - DNA, 15 bp, Homo sapiens
tgagtcagggcccag

SEQ ID NO: 3300551 - DNA, 23 bp, Homo sapiens
tgagtcattgacttcattttata

SEQ ID NO: 3300552 - DNA, 18 bp, Homo sapiens
tgagtcccccagagatgt

SEQ ID NO: 3300553 - DNA, 20 bp, Homo sapiens
tgagtcccccagagatgtca

SEQ ID NO: 3300554 - DNA, 15 bp, Homo sapiens
tgagtcccctactcc

SEQ ID NO: 3300555 - DNA, 16 bp, Homo sapiens
tgagtcctggtccctc

SEQ ID NO: 3300556 - DNA, 15 bp, Homo sapiens
tgagtcgaggacagg

SEQ ID NO: 3300557 - DNA, 16 bp, Homo sapiens
tgagtcgaggacaggg

SEQ ID NO: 3300558 - DNA, 19 bp, Homo sapiens
tgagtcgaggacagggagg

SEQ ID NO: 3300559 - DNA, 23 bp, Homo sapiens
tgagtctcccaaggctgcgtctg

SEQ ID NO: 3300560 - DNA, 21 bp, Homo sapiens
tgagtctctgaatgaagctga

SEQ ID NO: 3300561 - DNA, 18 bp, Homo sapiens
tgagtctgagtcctgtct

SEQ ID NO: 3300562 - DNA, 21 bp, Homo sapiens
tgagtctgagtcctgtctctg

SEQ ID NO: 3300563 - DNA, 21 bp, Homo sapiens
tgagtctgtactaaacagtaa

SEQ ID NO: 3300564 - DNA, 16 bp, Homo sapiens
tgagtcttggcggcag

SEQ ID NO: 3300565 - DNA, 17 bp, Homo sapiens
tgagtcttggcggcagc

SEQ ID NO: 3300566 - DNA, 21 bp, Homo sapiens
tgagtcttggcggcagcagcc

SEQ ID NO: 3300567 - DNA, 20 bp, Homo sapiens
tgagtgaaaatttttacatt

SEQ ID NO: 3300568 - DNA, 16 bp, Homo sapiens
tgagtgagcctggctc

SEQ ID NO: 3300569 - DNA, 17 bp, Homo sapiens
tgagtgagcctggctct

SEQ ID NO: 3300570 - DNA, 14 bp, Homo sapiens
tgagtggaatgcag

SEQ ID NO: 3300571 - DNA, 13 bp, Homo sapiens
tgagtggcagcca

SEQ ID NO: 3300572 - DNA, 14 bp, Homo sapiens
tgagtggcagccat

SEQ ID NO: 3300573 - DNA, 16 bp, Homo sapiens
tgagtggcagccatgc

SEQ ID NO: 3300574 - DNA, 21 bp, Homo sapiens
tgcaaagggtatcaggtgctg

SEQ ID NO: 3300575 - DNA, 15 bp, Homo sapiens
tgcaaataaagcctt

SEQ ID NO: 3300576 - DNA, 19 bp, Homo sapiens
tgcaaataaagccttttaa

SEQ ID NO: 3300577 - DNA, 23 bp, Homo sapiens
tgcaaatactgtatattcaggac

SEQ ID NO: 3300578 - DNA, 15 bp, Homo sapiens
tgcaaatataaacat

SEQ ID NO: 3300579 - DNA, 16 bp, Homo sapiens
tgcaaatataaacatc

SEQ ID NO: 3300580 - DNA, 14 bp, Homo sapiens
tgcaaatcttgaaa

SEQ ID NO: 3300581 - DNA, 21 bp, Homo sapiens
tgcaaatgagctctgaaatct

SEQ ID NO: 3300582 - DNA, 14 bp, Homo sapiens
tgcaaatgcctcca

SEQ ID NO: 3300583 - DNA, 21 bp, Homo sapiens
tgcaaattaaaacatatttca

SEQ ID NO: 3300584 - DNA, 22 bp, Homo sapiens
tgcaaattgattgtctttcccc

SEQ ID NO: 3300585 - DNA, 16 bp, Homo sapiens
tgcaaattgtatctta

SEQ ID NO: 3300586 - DNA, 13 bp, Homo sapiens
tgcaacaaaattc

SEQ ID NO: 3300587 - DNA, 15 bp, Homo sapiens
tgcaacaagcatgca

SEQ ID NO: 3300588 - DNA, 15 bp, Homo sapiens
tgcaacaggctgggc

SEQ ID NO: 3300589 - DNA, 11 bp, Homo sapiens
tgcaaccactg

SEQ ID NO: 3300590 - DNA, 13 bp, Homo sapiens
tgcaaccactgca

SEQ ID NO: 3300591 - DNA, 20 bp, Homo sapiens
tgcaaccagaattgtcctca

SEQ ID NO: 3300592 - DNA, 18 bp, Homo sapiens
tgcaaccatcagaattca

SEQ ID NO: 3300593 - DNA, 17 bp, Homo sapiens
tgcaacccttacccctt

SEQ ID NO: 3300594 - DNA, 16 bp, Homo sapiens
tgcaaccgtctgttat

SEQ ID NO: 3300595 - DNA, 13 bp, Homo sapiens
tgcaacctccgcc

SEQ ID NO: 3300596 - DNA, 19 bp, Homo sapiens
tgcaaccttgtttattaaa

SEQ ID NO: 3300597 - DNA, 17 bp, Homo sapiens
tgcaactcaaggacttt

SEQ ID NO: 3300598 - DNA, 15 bp, Homo sapiens
tgcaacttctttctg

SEQ ID NO: 3300599 - DNA, 17 bp, Homo sapiens
tgcaagaaaaaaactta

SEQ ID NO: 3300600 - DNA, 13 bp, Homo sapiens
tgcaagagtggac

SEQ ID NO: 3300601 - DNA, 16 bp, Homo sapiens
tgcaagcacagccctt

SEQ ID NO: 3300602 - DNA, 15 bp, Homo sapiens
tgcaagccccagggc

SEQ ID NO: 3300603 - DNA, 17 bp, Homo sapiens
tgcaagccccagggcct

SEQ ID NO: 3300604 - DNA, 20 bp, Homo sapiens
tgcaagccccagggcctggg

SEQ ID NO: 3300605 - DNA, 19 bp, Homo sapiens
tgcaagcctgtctgagact

SEQ ID NO: 3300606 - DNA, 15 bp, Homo sapiens
tgcaaggaccaggac

SEQ ID NO: 3300607 - DNA, 17 bp, Homo sapiens
tgcaaggaccaggactc

SEQ ID NO: 3300608 - DNA, 22 bp, Homo sapiens
tgcaaggattacagaaactgat

SEQ ID NO: 3300609 - DNA, 14 bp, Homo sapiens
tgcaaggcccacag

SEQ ID NO: 3300610 - DNA, 16 bp, Homo sapiens
tgcaaggcccacagga

SEQ ID NO: 3300611 - DNA, 16 bp, Homo sapiens
tgcaaggtactctggt

SEQ ID NO: 3300612 - DNA, 17 bp, Homo sapiens
tgcaagtatactaggga

SEQ ID NO: 3300613 - DNA, 15 bp, Homo sapiens
tgcaagtgtctggag

SEQ ID NO: 3300614 - DNA, 16 bp, Homo sapiens
tgcaagtgtctggagc

SEQ ID NO: 3300615 - DNA, 17 bp, Homo sapiens
tgcaagttagggtctat

SEQ ID NO: 3300616 - DNA, 23 bp, Homo sapiens
tgcaagttatattagtgaagatg

SEQ ID NO: 3300617 - DNA, 14 bp, Homo sapiens
tgcaataaaattta

SEQ ID NO: 3300618 - DNA, 15 bp, Homo sapiens
tgcaataaaatttaa

SEQ ID NO: 3300619 - DNA, 17 bp, Homo sapiens
tgcaataacttctatat

SEQ ID NO: 3300620 - DNA, 19 bp, Homo sapiens
tgcaataacttctgacctt

SEQ ID NO: 3300621 - DNA, 21 bp, Homo sapiens
tgcaataagaatttagggaga

SEQ ID NO: 3300622 - DNA, 16 bp, Homo sapiens
tgcaatagaaggtgat

SEQ ID NO: 3300623 - DNA, 16 bp, Homo sapiens
tgcaatagagactgta

SEQ ID NO: 3300624 - DNA, 14 bp, Homo sapiens
tgcaatatttgaat

SEQ ID NO: 3300625 - DNA, 23 bp, Homo sapiens
tgcaatcaaaaatatgtgttttt

SEQ ID NO: 3300626 - DNA, 13 bp, Homo sapiens
tgcaatcccagca

SEQ ID NO: 3300627 - DNA, 13 bp, Homo sapiens
tgcaatgaagaag

SEQ ID NO: 3300628 - DNA, 15 bp, Homo sapiens
tgcaatgcctagact

SEQ ID NO: 3300629 - DNA, 14 bp, Homo sapiens
tgcaatgcttctgt

SEQ ID NO: 3300630 - DNA, 16 bp, Homo sapiens
tgcaatgcttctgtag

SEQ ID NO: 3300631 - DNA, 17 bp, Homo sapiens
tgcaatgcttctgtagc

SEQ ID NO: 3300632 - DNA, 14 bp, Homo sapiens
tgcaatggcagcct

SEQ ID NO: 3300633 - DNA, 15 bp, Homo sapiens
tgcaatggcagcctt

SEQ ID NO: 3300634 - DNA, 16 bp, Homo sapiens
tgcaatggcagccttg

SEQ ID NO: 3300635 - DNA, 19 bp, Homo sapiens
tgcaatgtcacaacctctc

SEQ ID NO: 3300636 - DNA, 16 bp, Homo sapiens
tgcaattagcattctg

SEQ ID NO: 3300637 - DNA, 17 bp, Homo sapiens
tgcaattaggattttga

SEQ ID NO: 3300638 - DNA, 20 bp, Homo sapiens
tgcaattaggtttttcctta

SEQ ID NO: 3300639 - DNA, 18 bp, Homo sapiens
tgcaattcccctctgctg

SEQ ID NO: 3300640 - DNA, 16 bp, Homo sapiens
tgcaattgatttcttt

SEQ ID NO: 3300641 - DNA, 22 bp, Homo sapiens
tgcaatttattaaaatgattgt

SEQ ID NO: 3300642 - DNA, 12 bp, Homo sapiens
tgcaatttcaag

SEQ ID NO: 3300643 - DNA, 23 bp, Homo sapiens
tgcaatttgattgactgcccatt

SEQ ID NO: 3300644 - DNA, 18 bp, Homo sapiens
tgcacaaattgaaaacac

SEQ ID NO: 3300645 - DNA, 15 bp, Homo sapiens
tgcacaagaatggat

SEQ ID NO: 3300646 - DNA, 23 bp, Homo sapiens
tgcacaagaatggatcacaagat

SEQ ID NO: 3300647 - DNA, 17 bp, Homo sapiens
tgcacaagttccctgga

SEQ ID NO: 3300648 - DNA, 20 bp, Homo sapiens
tgcacaagttccctggagaa

SEQ ID NO: 3300649 - DNA, 22 bp, Homo sapiens
tgcacaagttccctggagaaaa

SEQ ID NO: 3300650 - DNA, 20 bp, Homo sapiens
tgcacaataaaaatgtttaa

SEQ ID NO: 3300651 - DNA, 14 bp, Homo sapiens
tgcacacaaatatt

SEQ ID NO: 3300652 - DNA, 18 bp, Homo sapiens
tgcacacacacacacatg

SEQ ID NO: 3300653 - DNA, 22 bp, Homo sapiens
tgcacacacacacacatgcaca

SEQ ID NO: 3300654 - DNA, 12 bp, Homo sapiens
tgcacacacagc

SEQ ID NO: 3300655 - DNA, 14 bp, Homo sapiens
tgcacacacagctc

SEQ ID NO: 3300656 - DNA, 17 bp, Homo sapiens
tgcacacacagctcctc

SEQ ID NO: 3300657 - DNA, 13 bp, Homo sapiens
tgcacacacctcc

SEQ ID NO: 3300658 - DNA, 17 bp, Homo sapiens
tgcacacagaaatatat

SEQ ID NO: 3300659 - DNA, 22 bp, Homo sapiens
tgcacaccaccctcccgctgca

SEQ ID NO: 3300660 - DNA, 20 bp, Homo sapiens
tgcacaccctccagagacaa

SEQ ID NO: 3300661 - DNA, 18 bp, Homo sapiens
tgcacacgggaaagcctt

SEQ ID NO: 3300662 - DNA, 19 bp, Homo sapiens
tgcacactagcctctccag

SEQ ID NO: 3300663 - DNA, 18 bp, Homo sapiens
tgcacagaagggctcttt

SEQ ID NO: 3300664 - DNA, 13 bp, Homo sapiens
tgcacagacaagc

SEQ ID NO: 3300665 - DNA, 17 bp, Homo sapiens
tgcacagacaagcagcc

SEQ ID NO: 3300666 - DNA, 12 bp, Homo sapiens
tgcacagagctc

SEQ ID NO: 3300667 - DNA, 13 bp, Homo sapiens
tgcacagagctct

SEQ ID NO: 3300668 - DNA, 20 bp, Homo sapiens
tgcacagagctctccagctc

SEQ ID NO: 3300669 - DNA, 21 bp, Homo sapiens
tgcacagagctctccagctcc

SEQ ID NO: 3300670 - DNA, 21 bp, Homo sapiens
tgcacagcagcaattgtttta

SEQ ID NO: 3300671 - DNA, 19 bp, Homo sapiens
tgcacagctgtagtacccc

SEQ ID NO: 3300672 - DNA, 14 bp, Homo sapiens
tgcacagctgtcca

SEQ ID NO: 3300673 - DNA, 18 bp, Homo sapiens
tgcacaggaaagagtcac

SEQ ID NO: 3300674 - DNA, 18 bp, Homo sapiens
tgcacaggcacacagggc

SEQ ID NO: 3300675 - DNA, 12 bp, Homo sapiens
tgcacagggtcc

SEQ ID NO: 3300676 - DNA, 19 bp, Homo sapiens
tgcacagtgatttttttct

SEQ ID NO: 3300677 - DNA, 21 bp, Homo sapiens
tgcacataagcttccatttta

SEQ ID NO: 3300678 - DNA, 22 bp, Homo sapiens
tgcacataagcttccattttaa

SEQ ID NO: 3300679 - DNA, 15 bp, Homo sapiens
tgcacatatggactc

SEQ ID NO: 3300680 - DNA, 16 bp, Homo sapiens
tgcacatccattccca

SEQ ID NO: 3300681 - DNA, 23 bp, Homo sapiens
tgcacatgaatcccacccacatg

SEQ ID NO: 3300682 - DNA, 15 bp, Homo sapiens
tgcacatgtcttgta

SEQ ID NO: 3300683 - DNA, 13 bp, Homo sapiens
tgcacatgtttcc

SEQ ID NO: 3300684 - DNA, 14 bp, Homo sapiens
tgcacatgtttcct

SEQ ID NO: 3300685 - DNA, 13 bp, Homo sapiens
tgcacatttattt

SEQ ID NO: 3300686 - DNA, 12 bp, Homo sapiens
tgcacatttctg

SEQ ID NO: 3300687 - DNA, 13 bp, Homo sapiens
tgcacatttctgg

SEQ ID NO: 3300688 - DNA, 14 bp, Homo sapiens
tgcacatttctgga

SEQ ID NO: 3300689 - DNA, 15 bp, Homo sapiens
tgcacatttctggat

SEQ ID NO: 3300690 - DNA, 17 bp, Homo sapiens
tgcacatttctggattg

SEQ ID NO: 3300691 - DNA, 14 bp, Homo sapiens
tgcacattttgatt

SEQ ID NO: 3300692 - DNA, 13 bp, Homo sapiens
tgcaccaaagaca

SEQ ID NO: 3300693 - DNA, 14 bp, Homo sapiens
tgcaccaccaagcc

SEQ ID NO: 3300694 - DNA, 15 bp, Homo sapiens
tgcaccaccaagcca

SEQ ID NO: 3300695 - DNA, 19 bp, Homo sapiens
tgcaccactgcactccagc

SEQ ID NO: 3300696 - DNA, 12 bp, Homo sapiens
tgcaccagagca

SEQ ID NO: 3300697 - DNA, 21 bp, Homo sapiens
tgcaccagagcaacctctcac

SEQ ID NO: 3300698 - DNA, 14 bp, Homo sapiens
tgcaccatctgctt

SEQ ID NO: 3300699 - DNA, 15 bp, Homo sapiens
tgcacccaactactg

SEQ ID NO: 3300700 - DNA, 17 bp, Homo sapiens
tgcacccacccaggagt

SEQ ID NO: 3300701 - DNA, 14 bp, Homo sapiens
tgccacttaatgta

SEQ ID NO: 3300702 - DNA, 17 bp, Homo sapiens
tgccacttaatgtatgt

SEQ ID NO: 3300703 - DNA, 23 bp, Homo sapiens
tgccacttaatgtatgttaccaa

SEQ ID NO: 3300704 - DNA, 20 bp, Homo sapiens
tgccactttacccacctaga

SEQ ID NO: 3300705 - DNA, 22 bp, Homo sapiens
tgccactttgactcagaggctg

SEQ ID NO: 3300706 - DNA, 12 bp, Homo sapiens
tgccactttgca

SEQ ID NO: 3300707 - DNA, 13 bp, Homo sapiens
tgccactttgcac

SEQ ID NO: 3300708 - DNA, 21 bp, Homo sapiens
tgccactttgcacattttgat

SEQ ID NO: 3300709 - DNA, 18 bp, Homo sapiens
tgccagaaacagtgggag

SEQ ID NO: 3300710 - DNA, 19 bp, Homo sapiens
tgccagaaacagtgggagc

SEQ ID NO: 3300711 - DNA, 22 bp, Homo sapiens
tgccagaaacagtgggagccct

SEQ ID NO: 3300712 - DNA, 20 bp, Homo sapiens
tgccagagctttgttttata

SEQ ID NO: 3300713 - DNA, 20 bp, Homo sapiens
tgccagaggaatcctggcag

SEQ ID NO: 3300714 - DNA, 15 bp, Homo sapiens
tgccagaggtgggca

SEQ ID NO: 3300715 - DNA, 17 bp, Homo sapiens
tgccagaggtgggcagg

SEQ ID NO: 3300716 - DNA, 21 bp, Homo sapiens
tgccagaggtgggcaggtggt

SEQ ID NO: 3300717 - DNA, 21 bp, Homo sapiens
tgccagatgcctttatggctg

SEQ ID NO: 3300718 - DNA, 16 bp, Homo sapiens
tgccagcaaccttgta

SEQ ID NO: 3300719 - DNA, 23 bp, Homo sapiens
tgccagcaatgacatctcagggg

SEQ ID NO: 3300720 - DNA, 13 bp, Homo sapiens
tgccagcacagag

SEQ ID NO: 3300721 - DNA, 21 bp, Homo sapiens
tgccagcacaggggccccaga

SEQ ID NO: 3300722 - DNA, 16 bp, Homo sapiens
tgccagcacgcctggc

SEQ ID NO: 3300723 - DNA, 10 bp, Homo sapiens
tgccagcagc

SEQ ID NO: 3300724 - DNA, 15 bp, Homo sapiens
tgccagcagcagcag

SEQ ID NO: 3300725 - DNA, 22 bp, Homo sapiens
tgccagcaggggggctgtgcca

SEQ ID NO: 3300726 - DNA, 17 bp, Homo sapiens
tgccagcattccagact

SEQ ID NO: 3300727 - DNA, 13 bp, Homo sapiens
tgccagcccagaa

SEQ ID NO: 3300728 - DNA, 15 bp, Homo sapiens
tgccagcccagaaca

SEQ ID NO: 3300729 - DNA, 18 bp, Homo sapiens
tgccagcccctgcctggg

SEQ ID NO: 3300730 - DNA, 15 bp, Homo sapiens
tgccagcccttcagg

SEQ ID NO: 3300731 - DNA, 21 bp, Homo sapiens
tgccagcccttcaggaagcag

SEQ ID NO: 3300732 - DNA, 12 bp, Homo sapiens
tgccagcctggc

SEQ ID NO: 3300733 - DNA, 21 bp, Homo sapiens
tgccagcctggcttctggagc

SEQ ID NO: 3300734 - DNA, 19 bp, Homo sapiens
tgccagctacttcctcctc

SEQ ID NO: 3300735 - DNA, 14 bp, Homo sapiens
tgccaggaacctgt

SEQ ID NO: 3300736 - DNA, 20 bp, Homo sapiens
tgccaggacatgcaataaaa

SEQ ID NO: 3300737 - DNA, 23 bp, Homo sapiens
tgccaggacatgcaataaaattt

SEQ ID NO: 3300738 - DNA, 18 bp, Homo sapiens
tgccaggcacctggcctg

SEQ ID NO: 3300739 - DNA, 12 bp, Homo sapiens
tgccaggcaggg

SEQ ID NO: 3300740 - DNA, 18 bp, Homo sapiens
tgccaggcaggggtgggg

SEQ ID NO: 3300741 - DNA, 14 bp, Homo sapiens
tgccaggccagcct

SEQ ID NO: 3300742 - DNA, 16 bp, Homo sapiens
tgccaggccagcctcc

SEQ ID NO: 3300743 - DNA, 12 bp, Homo sapiens
tgccaggcccat

SEQ ID NO: 3300744 - DNA, 22 bp, Homo sapiens
tgccaggcgttggtgccacttc

SEQ ID NO: 3300745 - DNA, 23 bp, Homo sapiens
tgccaggctccctttctcttctt

SEQ ID NO: 3300746 - DNA, 12 bp, Homo sapiens
tgccagggagct

SEQ ID NO: 3300747 - DNA, 22 bp, Homo sapiens
tgccagggcaatgatgaatgag

SEQ ID NO: 3300748 - DNA, 18 bp, Homo sapiens
tgccaggggcatccaagg

SEQ ID NO: 3300749 - DNA, 14 bp, Homo sapiens
tgccaggttttctg

SEQ ID NO: 3300750 - DNA, 21 bp, Homo sapiens
tgccagtaacgcgtcttcctg

SEQ ID NO: 3300751 - DNA, 23 bp, Homo sapiens
tgccagtaacgcgtcttcctgag

SEQ ID NO: 3300752 - DNA, 17 bp, Homo sapiens
tgccagtgacagacagg

SEQ ID NO: 3300753 - DNA, 14 bp, Homo sapiens
tgccagtgctggtc

SEQ ID NO: 3300754 - DNA, 13 bp, Homo sapiens
tgccagtgtcttt

SEQ ID NO: 3300755 - DNA, 15 bp, Homo sapiens
tgccagtgtctttct

SEQ ID NO: 3300756 - DNA, 22 bp, Homo sapiens
tgccatactttgtctgaaaaat

SEQ ID NO: 3300757 - DNA, 18 bp, Homo sapiens
tgccatagagtttaacac

SEQ ID NO: 3300758 - DNA, 20 bp, Homo sapiens
tgccatagagtttaacacaa

SEQ ID NO: 3300759 - DNA, 18 bp, Homo sapiens
tgccatagtcacatggcc

SEQ ID NO: 3300760 - DNA, 15 bp, Homo sapiens
tgccatattctgttg

SEQ ID NO: 3300761 - DNA, 16 bp, Homo sapiens
tgccatattctgttgg

SEQ ID NO: 3300762 - DNA, 16 bp, Homo sapiens
tgccatcaccgctggg

SEQ ID NO: 3300763 - DNA, 15 bp, Homo sapiens
tgccatcatgcctga

SEQ ID NO: 3300764 - DNA, 16 bp, Homo sapiens
tgccatcatgcctgac

SEQ ID NO: 3300765 - DNA, 21 bp, Homo sapiens
tgccatccaggttcagcttgt

SEQ ID NO: 3300766 - DNA, 18 bp, Homo sapiens
tgccatctagccagcccc

SEQ ID NO: 3300767 - DNA, 23 bp, Homo sapiens
tgccatctgtacatattactgtt

SEQ ID NO: 3300768 - DNA, 16 bp, Homo sapiens
tgccatctgtgtcctg

SEQ ID NO: 3300769 - DNA, 14 bp, Homo sapiens
tgccatgatctgta

SEQ ID NO: 3300770 - DNA, 14 bp, Homo sapiens
tgccatgctgggcc

SEQ ID NO: 3300771 - DNA, 22 bp, Homo sapiens
tgccatgctgggccactgggga

SEQ ID NO: 3300772 - DNA, 17 bp, Homo sapiens
tgccatggcgtgtccct

SEQ ID NO: 3300773 - DNA, 13 bp, Homo sapiens
tgccatgggccag

SEQ ID NO: 3300774 - DNA, 15 bp, Homo sapiens
tgccatgggccagcc

SEQ ID NO: 3300775 - DNA, 20 bp, Homo sapiens
tgccatgggcttcactgtat

SEQ ID NO: 3300776 - DNA, 16 bp, Homo sapiens
tgccatgtgaagaggg

SEQ ID NO: 3300777 - DNA, 15 bp, Homo sapiens
tgccatgttggccag

SEQ ID NO: 3300778 - DNA, 18 bp, Homo sapiens
tgccatgttggccaggct

SEQ ID NO: 3300779 - DNA, 21 bp, Homo sapiens
tgccatgttttgccaccccct

SEQ ID NO: 3300780 - DNA, 18 bp, Homo sapiens
tgccattcatagagagcc

SEQ ID NO: 3300781 - DNA, 15 bp, Homo sapiens
tgccattccactcca

SEQ ID NO: 3300782 - DNA, 21 bp, Homo sapiens
tgccattccactccactcagg

SEQ ID NO: 3300783 - DNA, 18 bp, Homo sapiens
tgccattccctgcctggg

SEQ ID NO: 3300784 - DNA, 13 bp, Homo sapiens
tgccattcttctg

SEQ ID NO: 3300785 - DNA, 21 bp, Homo sapiens
tgccattcttctggtgctact

SEQ ID NO: 3300786 - DNA, 13 bp, Homo sapiens
tgccattgggacc

SEQ ID NO: 3300787 - DNA, 17 bp, Homo sapiens
tgccattgggaccctcc

SEQ ID NO: 3300788 - DNA, 18 bp, Homo sapiens
tgccattgtctttatatg

SEQ ID NO: 3300789 - DNA, 16 bp, Homo sapiens
tgccatttagcaataa

SEQ ID NO: 3300790 - DNA, 19 bp, Homo sapiens
tgccatttagcaataaata

SEQ ID NO: 3300791 - DNA, 14 bp, Homo sapiens
tgccatttcccttc

SEQ ID NO: 3300792 - DNA, 21 bp, Homo sapiens
tgccatttgcaccctccgcct

SEQ ID NO: 3300793 - DNA, 23 bp, Homo sapiens
tgccatttgcttgtactgggaca

SEQ ID NO: 3300794 - DNA, 22 bp, Homo sapiens
tgccatttggtgtggattttct

SEQ ID NO: 3300795 - DNA, 22 bp, Homo sapiens
tgccattttattaaacattttc

SEQ ID NO: 3300796 - DNA, 23 bp, Homo sapiens
tgccattttattaaacattttca

SEQ ID NO: 3300797 - DNA, 13 bp, Homo sapiens
tgccatttttcta

SEQ ID NO: 3300798 - DNA, 20 bp, Homo sapiens
tgccatttttctataaatca

SEQ ID NO: 3300799 - DNA, 19 bp, Homo sapiens
tgcccaaacccttaactga

SEQ ID NO: 3300800 - DNA, 19 bp, Homo sapiens
tgcccaaagagcacaaaca

SEQ ID NO: 3300801 - DNA, 23 bp, Homo sapiens
tgcccaaagagcacaaacatttt

SEQ ID NO: 3300802 - DNA, 15 bp, Homo sapiens
tgcccaaagtgggga

SEQ ID NO: 3300803 - DNA, 22 bp, Homo sapiens
tgcccaaagtggggagggacaa

SEQ ID NO: 3300804 - DNA, 18 bp, Homo sapiens
tgcccaacaccagcccct

SEQ ID NO: 3300805 - DNA, 22 bp, Homo sapiens
tgcccaagaatagatgctgact

SEQ ID NO: 3300806 - DNA, 15 bp, Homo sapiens
tgcccaagccagagg

SEQ ID NO: 3300807 - DNA, 16 bp, Homo sapiens
tgcccaagccagaggc

SEQ ID NO: 3300808 - DNA, 23 bp, Homo sapiens
tgcccaagccagaggctgggttc

SEQ ID NO: 3300809 - DNA, 20 bp, Homo sapiens
tgcccaatgctttgggaggc

SEQ ID NO: 3300810 - DNA, 23 bp, Homo sapiens
tgcccacaccgcagggacaagcc

SEQ ID NO: 3300811 - DNA, 20 bp, Homo sapiens
tgcccacaggatcagtctga

SEQ ID NO: 3300812 - DNA, 13 bp, Homo sapiens
tgcccaccccctc

SEQ ID NO: 3300813 - DNA, 24 bp, Homo sapiens
tgcccaccccctcaagccaatccc

SEQ ID NO: 3300814 - DNA, 16 bp, Homo sapiens
tgcccaccccctgccc

SEQ ID NO: 3300815 - DNA, 18 bp, Homo sapiens
tgcccaccccctgccctg

SEQ ID NO: 3300816 - DNA, 16 bp, Homo sapiens
tgcccacgatcccctc

SEQ ID NO: 3300817 - DNA, 16 bp, Homo sapiens
tgcccacgcagaggac

SEQ ID NO: 3300818 - DNA, 22 bp, Homo sapiens
tgcccacttagccgtccatggc

SEQ ID NO: 3300819 - DNA, 17 bp, Homo sapiens
tgcccagacacagactg

SEQ ID NO: 3300820 - DNA, 20 bp, Homo sapiens
tgcccagacacagactggca

SEQ ID NO: 3300821 - DNA, 21 bp, Homo sapiens
tgcccagacacagactggcaa

SEQ ID NO: 3300822 - DNA, 16 bp, Homo sapiens
tgcccagagcacttta

SEQ ID NO: 3300823 - DNA, 18 bp, Homo sapiens
tgcccagagcactttagc

SEQ ID NO: 3300824 - DNA, 21 bp, Homo sapiens
tgcccagagggcccaggcagg

SEQ ID NO: 3300825 - DNA, 19 bp, Homo sapiens
tgcccaggagacagaccac

SEQ ID NO: 3300826 - DNA, 19 bp, Homo sapiens
tgcggttataaaaaatggt

SEQ ID NO: 3300827 - DNA, 20 bp, Homo sapiens
tgcggttataaaaaatggtt

SEQ ID NO: 3300828 - DNA, 22 bp, Homo sapiens
tgcggttataaaaaatggttca

SEQ ID NO: 3300829 - DNA, 21 bp, Homo sapiens
tgcggtttgttggatcttcaa

SEQ ID NO: 3300830 - DNA, 14 bp, Homo sapiens
tgcgtatgtctgtt

SEQ ID NO: 3300831 - DNA, 13 bp, Homo sapiens
tgcgtcccagctg

SEQ ID NO: 3300832 - DNA, 13 bp, Homo sapiens
tgcgtccccactc

SEQ ID NO: 3300833 - DNA, 13 bp, Homo sapiens
tgcgtcctgcaga

SEQ ID NO: 3300834 - DNA, 21 bp, Homo sapiens
tgcgtctggaggggcccctgc

SEQ ID NO: 3300835 - DNA, 23 bp, Homo sapiens
tgcgtctggaggggcccctgctt

SEQ ID NO: 3300836 - DNA, 22 bp, Homo sapiens
tgcgtgaaacacaccaggctgt

SEQ ID NO: 3300837 - DNA, 17 bp, Homo sapiens
tgcgtgcgagcacacac

SEQ ID NO: 3300838 - DNA, 18 bp, Homo sapiens
tgcgtggactctgcacat

SEQ ID NO: 3300839 - DNA, 13 bp, Homo sapiens
tgcgtggcctgag

SEQ ID NO: 3300840 - DNA, 16 bp, Homo sapiens
tgcgtggcctgagtcc

SEQ ID NO: 3300841 - DNA, 14 bp, Homo sapiens
tgcgtggctgtggc

SEQ ID NO: 3300842 - DNA, 13 bp, Homo sapiens
tgcgtgtcgtggg

SEQ ID NO: 3300843 - DNA, 18 bp, Homo sapiens
tgcgtgtgtgtgtgtttg

SEQ ID NO: 3300844 - DNA, 19 bp, Homo sapiens
tgcgttggagccactcctg

SEQ ID NO: 3300845 - DNA, 14 bp, Homo sapiens
tgcgtttttacagt

SEQ ID NO: 3300846 - DNA, 20 bp, Homo sapiens
tgctaaaaaaagtgcatgat

SEQ ID NO: 3300847 - DNA, 15 bp, Homo sapiens
tgctaaagcactttg

SEQ ID NO: 3300848 - DNA, 12 bp, Homo sapiens
tgctaaatagtt

SEQ ID NO: 3300849 - DNA, 13 bp, Homo sapiens
tgctaacaaagac

SEQ ID NO: 3300850 - DNA, 22 bp, Homo sapiens
tgctaacaaagacaaaagtctg

SEQ ID NO: 3300851 - DNA, 13 bp, Homo sapiens
tgctaacatctaa

SEQ ID NO: 3300852 - DNA, 15 bp, Homo sapiens
tgctaacctggaaag

SEQ ID NO: 3300853 - DNA, 17 bp, Homo sapiens
tgctaaccttgtagcat

SEQ ID NO: 3300854 - DNA, 14 bp, Homo sapiens
tgctaaccttttca

SEQ ID NO: 3300855 - DNA, 15 bp, Homo sapiens
tgctaaggttctaag

SEQ ID NO: 3300856 - DNA, 17 bp, Homo sapiens
tgctaaggttctaaggc

SEQ ID NO: 3300857 - DNA, 12 bp, Homo sapiens
tgctaataaaac

SEQ ID NO: 3300858 - DNA, 17 bp, Homo sapiens
tgctaataaacactggc

SEQ ID NO: 3300859 - DNA, 23 bp, Homo sapiens
tgctaataaacactggctctggg

SEQ ID NO: 3300860 - DNA, 16 bp, Homo sapiens
tgctaatcaaagccag

SEQ ID NO: 3300861 - DNA, 19 bp, Homo sapiens
tgctaatctctcttttgtt

SEQ ID NO: 3300862 - DNA, 22 bp, Homo sapiens
tgctaatcttcttatgcaattt

SEQ ID NO: 3300863 - DNA, 15 bp, Homo sapiens
tgctaattttctcaa

SEQ ID NO: 3300864 - DNA, 17 bp, Homo sapiens
tgctaattttctcaaaa

SEQ ID NO: 3300865 - DNA, 14 bp, Homo sapiens
tgctacaaatttat

SEQ ID NO: 3300866 - DNA, 19 bp, Homo sapiens
tgctacaacttcagcagta

SEQ ID NO: 3300867 - DNA, 13 bp, Homo sapiens
tgctacaggaggg

SEQ ID NO: 3300868 - DNA, 13 bp, Homo sapiens
tgctaccaaagca

SEQ ID NO: 3300869 - DNA, 22 bp, Homo sapiens
tgctaccagcgccaaatgttca

SEQ ID NO: 3300870 - DNA, 18 bp, Homo sapiens
tgctaccagtatttagaa

SEQ ID NO: 3300871 - DNA, 18 bp, Homo sapiens
tgctaccgttgacttcca

SEQ ID NO: 3300872 - DNA, 14 bp, Homo sapiens
tgctacctctgaga

SEQ ID NO: 3300873 - DNA, 18 bp, Homo sapiens
tgctacctctgagaagac

SEQ ID NO: 3300874 - DNA, 18 bp, Homo sapiens
tgctactaagttcacatt

SEQ ID NO: 3300875 - DNA, 15 bp, Homo sapiens
tgctactgcactcca

SEQ ID NO: 3300876 - DNA, 21 bp, Homo sapiens
tgctactgcactccagcctgg

SEQ ID NO: 3300877 - DNA, 21 bp, Homo sapiens
tgctactggacttgaatggtt

SEQ ID NO: 3300878 - DNA, 21 bp, Homo sapiens
tgctactgtcctacccaccct

SEQ ID NO: 3300879 - DNA, 22 bp, Homo sapiens
tgctactgtcctacccaccctc

SEQ ID NO: 3300880 - DNA, 18 bp, Homo sapiens
tgctactgtctttggaaa

SEQ ID NO: 3300881 - DNA, 19 bp, Homo sapiens
tgctacttaattcctttct

SEQ ID NO: 3300882 - DNA, 23 bp, Homo sapiens
tgctacttcactgtcatcttcaa

SEQ ID NO: 3300883 - DNA, 23 bp, Homo sapiens
tgctacttttttttagttcaata

SEQ ID NO: 3300884 - DNA, 14 bp, Homo sapiens
tgctagaaaatcga

SEQ ID NO: 3300885 - DNA, 14 bp, Homo sapiens
tgctagaactccct

SEQ ID NO: 3300886 - DNA, 18 bp, Homo sapiens
tgctagaactccctttca

SEQ ID NO: 3300887 - DNA, 20 bp, Homo sapiens
tgctagaactccctttcaac

SEQ ID NO: 3300888 - DNA, 19 bp, Homo sapiens
tgctagaacttttttaaat

SEQ ID NO: 3300889 - DNA, 22 bp, Homo sapiens
tgctagagcaacccctgtaccc

SEQ ID NO: 3300890 - DNA, 20 bp, Homo sapiens
tgctagattttaatttattt

SEQ ID NO: 3300891 - DNA, 14 bp, Homo sapiens
tgctagccccagag

SEQ ID NO: 3300892 - DNA, 17 bp, Homo sapiens
tgctaggagctgacaat

SEQ ID NO: 3300893 - DNA, 19 bp, Homo sapiens
tgctaggcgctggggagac

SEQ ID NO: 3300894 - DNA, 19 bp, Homo sapiens
tgctaggggatgaggggct

SEQ ID NO: 3300895 - DNA, 16 bp, Homo sapiens
tgctaggttaattcca

SEQ ID NO: 3300896 - DNA, 22 bp, Homo sapiens
tgctagtattcgctgtgttcat

SEQ ID NO: 3300897 - DNA, 13 bp, Homo sapiens
tgctagtgagctg

SEQ ID NO: 3300898 - DNA, 18 bp, Homo sapiens
tgctagtgagctgggcat

SEQ ID NO: 3300899 - DNA, 15 bp, Homo sapiens
tgctagtgttctgtc

SEQ ID NO: 3300900 - DNA, 18 bp, Homo sapiens
tgctagtttattggaagt

SEQ ID NO: 3300901 - DNA, 13 bp, Homo sapiens
tgctagttttaca

SEQ ID NO: 3300902 - DNA, 16 bp, Homo sapiens
tgctataatcattagt

SEQ ID NO: 3300903 - DNA, 22 bp, Homo sapiens
tgctataatcattagttttaga

SEQ ID NO: 3300904 - DNA, 15 bp, Homo sapiens
tgctatacacacaca

SEQ ID NO: 3300905 - DNA, 12 bp, Homo sapiens
tgctatgaaaat

SEQ ID NO: 3300906 - DNA, 16 bp, Homo sapiens
tgctatgaaaatgagc

SEQ ID NO: 3300907 - DNA, 13 bp, Homo sapiens
tgctatgtaaggg

SEQ ID NO: 3300908 - DNA, 17 bp, Homo sapiens
tgctatgtaagggtctt

SEQ ID NO: 3300909 - DNA, 19 bp, Homo sapiens
tgctatgttactattttct

SEQ ID NO: 3300910 - DNA, 23 bp, Homo sapiens
tgctattaaccttgccttagaaa

SEQ ID NO: 3300911 - DNA, 16 bp, Homo sapiens
tgctattgacaagtca

SEQ ID NO: 3300912 - DNA, 20 bp, Homo sapiens
tgctattggaggatcagttt

SEQ ID NO: 3300913 - DNA, 18 bp, Homo sapiens
tgctattgttgtgggctt

SEQ ID NO: 3300914 - DNA, 18 bp, Homo sapiens
tgctatttattttcctaa

SEQ ID NO: 3300915 - DNA, 19 bp, Homo sapiens
tgctatttattttcctaaa

SEQ ID NO: 3300916 - DNA, 11 bp, Homo sapiens
tgctatttgaa

SEQ ID NO: 3300917 - DNA, 14 bp, Homo sapiens
tgctatttgaagaa

SEQ ID NO: 3300918 - DNA, 16 bp, Homo sapiens
tgctatttgaagaaaa

SEQ ID NO: 3300919 - DNA, 15 bp, Homo sapiens
tgctcaaaaaatgag

SEQ ID NO: 3300920 - DNA, 18 bp, Homo sapiens
tgctcaaatctattcaga

SEQ ID NO: 3300921 - DNA, 21 bp, Homo sapiens
tgctcaaatctattcagacaa

SEQ ID NO: 3300922 - DNA, 23 bp, Homo sapiens
tgctcaactctacccctgctccc

SEQ ID NO: 3300923 - DNA, 14 bp, Homo sapiens
tgctcaagaagaca

SEQ ID NO: 3300924 - DNA, 21 bp, Homo sapiens
tgctcaataaatgattcttag

SEQ ID NO: 3300925 - DNA, 15 bp, Homo sapiens
tgctcacatatctgt

SEQ ID NO: 3300926 - DNA, 16 bp, Homo sapiens
tgctcacatatctgtc

SEQ ID NO: 3300927 - DNA, 17 bp, Homo sapiens
tgctcacatatctgtca

SEQ ID NO: 3300928 - DNA, 19 bp, Homo sapiens
tgctcaccgcccatcaggg

SEQ ID NO: 3300929 - DNA, 12 bp, Homo sapiens
tgctcacctctg

SEQ ID NO: 3300930 - DNA, 16 bp, Homo sapiens
tgctcacgctcccccg

SEQ ID NO: 3300931 - DNA, 20 bp, Homo sapiens
tgctcagagacctgaagtgt

SEQ ID NO: 3300932 - DNA, 18 bp, Homo sapiens
tgctcagtgcttgggctc

SEQ ID NO: 3300933 - DNA, 21 bp, Homo sapiens
tgctcatattgtgattctgcc

SEQ ID NO: 3300934 - DNA, 16 bp, Homo sapiens
tgctcatgttggccaa

SEQ ID NO: 3300935 - DNA, 18 bp, Homo sapiens
tgctcatttaagtttcaa

SEQ ID NO: 3300936 - DNA, 15 bp, Homo sapiens
tgctccaagattcta

SEQ ID NO: 3300937 - DNA, 15 bp, Homo sapiens
tgctccaatctctgg

SEQ ID NO: 3300938 - DNA, 15 bp, Homo sapiens
tgctccaccacatcc

SEQ ID NO: 3300939 - DNA, 15 bp, Homo sapiens
tgctccaccagcagc

SEQ ID NO: 3300940 - DNA, 18 bp, Homo sapiens
tgctccacccttggcctg

SEQ ID NO: 3300941 - DNA, 21 bp, Homo sapiens
tgctccagaatttggaaatcc

SEQ ID NO: 3300942 - DNA, 22 bp, Homo sapiens
tgctccagaatttggaaatcct

SEQ ID NO: 3300943 - DNA, 16 bp, Homo sapiens
tgctccagggagattt

SEQ ID NO: 3300944 - DNA, 22 bp, Homo sapiens
tgctccatttataaccccagcc

SEQ ID NO: 3300945 - DNA, 14 bp, Homo sapiens
tgctcccagcagcc

SEQ ID NO: 3300946 - DNA, 21 bp, Homo sapiens
tgctcccagcagccctaagga

SEQ ID NO: 3300947 - DNA, 12 bp, Homo sapiens
tgctcccagcct

SEQ ID NO: 3300948 - DNA, 14 bp, Homo sapiens
tgctcccagcctgc

SEQ ID NO: 3300949 - DNA, 16 bp, Homo sapiens
tgctcccagcctgctg

SEQ ID NO: 3300950 - DNA, 18 bp, Homo sapiens
tgctcccattcctccctc

SEQ ID NO: 3300951 - DNA, 18 bp, Homo sapiens
tgctccccagccctggct

SEQ ID NO: 3300952 - DNA, 14 bp, Homo sapiens
tggaaaaatggttg

SEQ ID NO: 3300953 - DNA, 21 bp, Homo sapiens
tggaaaaatggttgatggaaa

SEQ ID NO: 3300954 - DNA, 15 bp, Homo sapiens
tggaaaaatgtttgt

SEQ ID NO: 3300955 - DNA, 18 bp, Homo sapiens
tggaaaaggaagactaga

SEQ ID NO: 3300956 - DNA, 24 bp, Homo sapiens
tggaaaatacctaattgtggatga

SEQ ID NO: 3300957 - DNA, 15 bp, Homo sapiens
tggaaaattcatttt

SEQ ID NO: 3300958 - DNA, 16 bp, Homo sapiens
tggaaacactgatttt

SEQ ID NO: 3300959 - DNA, 15 bp, Homo sapiens
tggaaacagcatgaa

SEQ ID NO: 3300960 - DNA, 16 bp, Homo sapiens
tggaaacattacagtt

SEQ ID NO: 3300961 - DNA, 19 bp, Homo sapiens
tggaaactctttaacttct

SEQ ID NO: 3300962 - DNA, 16 bp, Homo sapiens
tggaaagaatctaata

SEQ ID NO: 3300963 - DNA, 19 bp, Homo sapiens
tggaaagatgttaagcatt

SEQ ID NO: 3300964 - DNA, 22 bp, Homo sapiens
tggaaagatgttaagcatttat

SEQ ID NO: 3300965 - DNA, 16 bp, Homo sapiens
tggaaagcaggatgta

SEQ ID NO: 3300966 - DNA, 17 bp, Homo sapiens
tggaaaggctcagtctc

SEQ ID NO: 3300967 - DNA, 21 bp, Homo sapiens
tggaaaggctcagtctcagga

SEQ ID NO: 3300968 - DNA, 23 bp, Homo sapiens
tggaaaggctcagtctcaggagc

SEQ ID NO: 3300969 - DNA, 21 bp, Homo sapiens
tggaaaggggagagcctgctg

SEQ ID NO: 3300970 - DNA, 17 bp, Homo sapiens
tggaaaggggagttgag

SEQ ID NO: 3300971 - DNA, 12 bp, Homo sapiens
tggaaagtcaga

SEQ ID NO: 3300972 - DNA, 16 bp, Homo sapiens
tggaaagtgaatttga

SEQ ID NO: 3300973 - DNA, 20 bp, Homo sapiens
tggaaagtgaatttgaatga

SEQ ID NO: 3300974 - DNA, 23 bp, Homo sapiens
tggaaagtgaatttgaatgaaaa

SEQ ID NO: 3300975 - DNA, 14 bp, Homo sapiens
tggaaataaagtca

SEQ ID NO: 3300976 - DNA, 16 bp, Homo sapiens
tggaaataaagtcaga

SEQ ID NO: 3300977 - DNA, 13 bp, Homo sapiens
tggaaataaatgt

SEQ ID NO: 3300978 - DNA, 20 bp, Homo sapiens
tggaaatattaagaaagact

SEQ ID NO: 3300979 - DNA, 23 bp, Homo sapiens
tggaaatattcatgcttcttcct

SEQ ID NO: 3300980 - DNA, 19 bp, Homo sapiens
tggaaatcctagtttcctc

SEQ ID NO: 3300981 - DNA, 20 bp, Homo sapiens
tggaaatcctgccctggagg

SEQ ID NO: 3300982 - DNA, 17 bp, Homo sapiens
tggaaatcgcttatatg

SEQ ID NO: 3300983 - DNA, 14 bp, Homo sapiens
tggaaatgtacttt

SEQ ID NO: 3300984 - DNA, 16 bp, Homo sapiens
tggaaatgtacttttg

SEQ ID NO: 3300985 - DNA, 21 bp, Homo sapiens
tggaaattcaggtgaaaatgt

SEQ ID NO: 3300986 - DNA, 13 bp, Homo sapiens
tggaaattcctgt

SEQ ID NO: 3300987 - DNA, 16 bp, Homo sapiens
tggaacaaagtgaagg

SEQ ID NO: 3300988 - DNA, 16 bp, Homo sapiens
tggaacagcgggagac

SEQ ID NO: 3300989 - DNA, 19 bp, Homo sapiens
tggaacagcgggagacctg

SEQ ID NO: 3300990 - DNA, 14 bp, Homo sapiens
tggaacatccttgg

SEQ ID NO: 3300991 - DNA, 13 bp, Homo sapiens
tggaacatttctt

SEQ ID NO: 3300992 - DNA, 16 bp, Homo sapiens
tggaacatttgatatt

SEQ ID NO: 3300993 - DNA, 21 bp, Homo sapiens
tggaaccacggagatctcctt

SEQ ID NO: 3300994 - DNA, 21 bp, Homo sapiens
tggaaccagggaggagaggaa

SEQ ID NO: 3300995 - DNA, 13 bp, Homo sapiens
tggaaccttccct

SEQ ID NO: 3300996 - DNA, 17 bp, Homo sapiens
tggaaccttccctccaa

SEQ ID NO: 3300997 - DNA, 14 bp, Homo sapiens
tggaaccttgctgt

SEQ ID NO: 3300998 - DNA, 22 bp, Homo sapiens
tggaaccttgctgtcctgatct

SEQ ID NO: 3300999 - DNA, 14 bp, Homo sapiens
tggaactaataaat

SEQ ID NO: 3301000 - DNA, 14 bp, Homo sapiens
tggaactactgtac

SEQ ID NO: 3301001 - DNA, 18 bp, Homo sapiens
tggaactactgtactttg

SEQ ID NO: 3301002 - DNA, 21 bp, Homo sapiens
tggaactgaccccctcccctg

SEQ ID NO: 3301003 - DNA, 22 bp, Homo sapiens
tggaactgaccccctcccctga

SEQ ID NO: 3301004 - DNA, 15 bp, Homo sapiens
tggaacttctaatat

SEQ ID NO: 3301005 - DNA, 21 bp, Homo sapiens
tggaacttctaatatattttt

SEQ ID NO: 3301006 - DNA, 22 bp, Homo sapiens
tggaagaaaaaaatcttctcca

SEQ ID NO: 3301007 - DNA, 15 bp, Homo sapiens
tggaagaaaatggtt

SEQ ID NO: 3301008 - DNA, 18 bp, Homo sapiens
tggaagaaggaaacggaa

SEQ ID NO: 3301009 - DNA, 21 bp, Homo sapiens
tggaagaagggagaagaaagg

SEQ ID NO: 3301010 - DNA, 16 bp, Homo sapiens
tggaagacacttcaga

SEQ ID NO: 3301011 - DNA, 17 bp, Homo sapiens
tggaagacacttcagat

SEQ ID NO: 3301012 - DNA, 14 bp, Homo sapiens
tggaagagaaatct

SEQ ID NO: 3301013 - DNA, 16 bp, Homo sapiens
tggaagagaaatctca

SEQ ID NO: 3301014 - DNA, 14 bp, Homo sapiens
tggaagagaatcac

SEQ ID NO: 3301015 - DNA, 22 bp, Homo sapiens
tggaagagagagccatgaagca

SEQ ID NO: 3301016 - DNA, 12 bp, Homo sapiens
tggaagagcagc

SEQ ID NO: 3301017 - DNA, 13 bp, Homo sapiens
tggaagagcagcc

SEQ ID NO: 3301018 - DNA, 21 bp, Homo sapiens
tggaagatcccctctcctgcc

SEQ ID NO: 3301019 - DNA, 14 bp, Homo sapiens
tggaagattcagct

SEQ ID NO: 3301020 - DNA, 14 bp, Homo sapiens
tggaagattttaaa

SEQ ID NO: 3301021 - DNA, 17 bp, Homo sapiens
tggaagctgccctgccc

SEQ ID NO: 3301022 - DNA, 22 bp, Homo sapiens
tggaaggaccacattttatatt

SEQ ID NO: 3301023 - DNA, 19 bp, Homo sapiens
tggaaggactgtggctgca

SEQ ID NO: 3301024 - DNA, 23 bp, Homo sapiens
tggaaggcagacagcaggcagcg

SEQ ID NO: 3301025 - DNA, 16 bp, Homo sapiens
tggaaggcagagaaat

SEQ ID NO: 3301026 - DNA, 20 bp, Homo sapiens
tggaaggcagagaaatctaa

SEQ ID NO: 3301027 - DNA, 16 bp, Homo sapiens
tggaaggcagggcaga

SEQ ID NO: 3301028 - DNA, 14 bp, Homo sapiens
tggaaggctggctg

SEQ ID NO: 3301029 - DNA, 12 bp, Homo sapiens
tggaagggctgg

SEQ ID NO: 3301030 - DNA, 14 bp, Homo sapiens
tggaagggctgggt

SEQ ID NO: 3301031 - DNA, 16 bp, Homo sapiens
tggaagggctgggtgt

SEQ ID NO: 3301032 - DNA, 16 bp, Homo sapiens
tggaaggggccttgct

SEQ ID NO: 3301033 - DNA, 14 bp, Homo sapiens
tggaagtctacctg

SEQ ID NO: 3301034 - DNA, 16 bp, Homo sapiens
tggaagtggttctatg

SEQ ID NO: 3301035 - DNA, 21 bp, Homo sapiens
tggaagtgtttcaaaaaatta

SEQ ID NO: 3301036 - DNA, 18 bp, Homo sapiens
tggaagttattaacttta

SEQ ID NO: 3301037 - DNA, 12 bp, Homo sapiens
tggaagttattt

SEQ ID NO: 3301038 - DNA, 13 bp, Homo sapiens
tggaagttattta

SEQ ID NO: 3301039 - DNA, 18 bp, Homo sapiens
tggaagttcatacctaag

SEQ ID NO: 3301040 - DNA, 16 bp, Homo sapiens
tggaagttgagactta

SEQ ID NO: 3301041 - DNA, 19 bp, Homo sapiens
tggaagtttgtgttctgtt

SEQ ID NO: 3301042 - DNA, 17 bp, Homo sapiens
tggaataaacattaatt

SEQ ID NO: 3301043 - DNA, 14 bp, Homo sapiens
tggaataacatgta

SEQ ID NO: 3301044 - DNA, 19 bp, Homo sapiens
tggaataacatgtaattaa

SEQ ID NO: 3301045 - DNA, 15 bp, Homo sapiens
tggaataagttcaaa

SEQ ID NO: 3301046 - DNA, 14 bp, Homo sapiens
tggaataatgtaaa

SEQ ID NO: 3301047 - DNA, 14 bp, Homo sapiens
tggaatacagtgtt

SEQ ID NO: 3301048 - DNA, 14 bp, Homo sapiens
tggaataggaataa

SEQ ID NO: 3301049 - DNA, 18 bp, Homo sapiens
tggaatataaggaaagca

SEQ ID NO: 3301050 - DNA, 22 bp, Homo sapiens
tggaatatcatctgtcattata

SEQ ID NO: 3301051 - DNA, 23 bp, Homo sapiens
tggaatattcccctatctctaga

SEQ ID NO: 3301052 - DNA, 13 bp, Homo sapiens
tggaatattgttt

SEQ ID NO: 3301053 - DNA, 14 bp, Homo sapiens
tggaatattgtttc

SEQ ID NO: 3301054 - DNA, 15 bp, Homo sapiens
tggaatcgtttcttt

SEQ ID NO: 3301055 - DNA, 19 bp, Homo sapiens
tggaatgactataaacatt

SEQ ID NO: 3301056 - DNA, 17 bp, Homo sapiens
tggaatgagtgtgcatg

SEQ ID NO: 3301057 - DNA, 18 bp, Homo sapiens
tggaatgcagggaagagg

SEQ ID NO: 3301058 - DNA, 15 bp, Homo sapiens
tggaatggacatcct

SEQ ID NO: 3301059 - DNA, 15 bp, Homo sapiens
tggaatggatttttc

SEQ ID NO: 3301060 - DNA, 18 bp, Homo sapiens
tggaatgtgcccctggcc

SEQ ID NO: 3301061 - DNA, 20 bp, Homo sapiens
tggaatgtgcccctggccca

SEQ ID NO: 3301062 - DNA, 23 bp, Homo sapiens
tggaatgtggcccctgaacaaga

SEQ ID NO: 3301063 - DNA, 21 bp, Homo sapiens
tggaattaaaaggatagtatt

SEQ ID NO: 3301064 - DNA, 18 bp, Homo sapiens
tggaattaacctggtgct

SEQ ID NO: 3301065 - DNA, 20 bp, Homo sapiens
tggaattaacctggtgctgg

SEQ ID NO: 3301066 - DNA, 18 bp, Homo sapiens
tggaattacaagccctgg

SEQ ID NO: 3301067 - DNA, 23 bp, Homo sapiens
tggaattattgtaccattttcta

SEQ ID NO: 3301068 - DNA, 22 bp, Homo sapiens
tggaattattttgaatgtcaca

SEQ ID NO: 3301069 - DNA, 13 bp, Homo sapiens
tggaattcagcac

SEQ ID NO: 3301070 - DNA, 18 bp, Homo sapiens
tggaattgatttgcattg

SEQ ID NO: 3301071 - DNA, 22 bp, Homo sapiens
tggaattgatttgcattgaaca

SEQ ID NO: 3301072 - DNA, 17 bp, Homo sapiens
tggaatttgtaacctca

SEQ ID NO: 3301073 - DNA, 19 bp, Homo sapiens
tggaatttgtaacctcagc

SEQ ID NO: 3301074 - DNA, 13 bp, Homo sapiens
tggaatttgttca

SEQ ID NO: 3301075 - DNA, 22 bp, Homo sapiens
tggacaacttatttaaaaatat

SEQ ID NO: 3301076 - DNA, 23 bp, Homo sapiens
tggacaacttatttaaaaatatt

SEQ ID NO: 3301077 - DNA, 16 bp, Homo sapiens
tggacaatcatgaaat

SEQ ID NO: 3301078 - DNA, 18 bp, Homo sapiens
tggcagtgttttggttca

SEQ ID NO: 3301079 - DNA, 23 bp, Homo sapiens
tggcagttgaacagagggagaga

SEQ ID NO: 3301080 - DNA, 15 bp, Homo sapiens
tggcatagctctggg

SEQ ID NO: 3301081 - DNA, 16 bp, Homo sapiens
tggcatagctctgggg

SEQ ID NO: 3301082 - DNA, 19 bp, Homo sapiens
tggcatcaaccaccatgga

SEQ ID NO: 3301083 - DNA, 15 bp, Homo sapiens
tggcatcatggtgga

SEQ ID NO: 3301084 - DNA, 17 bp, Homo sapiens
tggcatctcctgtcctg

SEQ ID NO: 3301085 - DNA, 20 bp, Homo sapiens
tggcatctgaatgaaaataa

SEQ ID NO: 3301086 - DNA, 23 bp, Homo sapiens
tggcatcttcgtcttcactctta

SEQ ID NO: 3301087 - DNA, 16 bp, Homo sapiens
tggcatctttgccttg

SEQ ID NO: 3301088 - DNA, 23 bp, Homo sapiens
tggcatctttgccttgggctgct

SEQ ID NO: 3301089 - DNA, 21 bp, Homo sapiens
tggcatgggcgcaggcccagt

SEQ ID NO: 3301090 - DNA, 15 bp, Homo sapiens
tggcatgtggcctgt

SEQ ID NO: 3301091 - DNA, 18 bp, Homo sapiens
tggcatgtggcctgtggc

SEQ ID NO: 3301092 - DNA, 22 bp, Homo sapiens
tggcatgttttctttgtttcct

SEQ ID NO: 3301093 - DNA, 13 bp, Homo sapiens
tggcatgttttga

SEQ ID NO: 3301094 - DNA, 20 bp, Homo sapiens
tggcatgttttgtgcatttg

SEQ ID NO: 3301095 - DNA, 22 bp, Homo sapiens
tggcatgttttgtgcatttgta

SEQ ID NO: 3301096 - DNA, 19 bp, Homo sapiens
tggcattacagctggagaa

SEQ ID NO: 3301097 - DNA, 20 bp, Homo sapiens
tggcattgtccctgtgccta

SEQ ID NO: 3301098 - DNA, 16 bp, Homo sapiens
tggcatttctatactt

SEQ ID NO: 3301099 - DNA, 21 bp, Homo sapiens
tggccaaacatcagacctgtc

SEQ ID NO: 3301100 - DNA, 23 bp, Homo sapiens
tggccaaacatcagacctgtctt

SEQ ID NO: 3301101 - DNA, 16 bp, Homo sapiens
tggccaaattatttgt

SEQ ID NO: 3301102 - DNA, 21 bp, Homo sapiens
tggccaactgcaaaaaaagcc

SEQ ID NO: 3301103 - DNA, 22 bp, Homo sapiens
tggccaactgcaaaaaaagcct

SEQ ID NO: 3301104 - DNA, 14 bp, Homo sapiens
tggccaagagcatc

SEQ ID NO: 3301105 - DNA, 21 bp, Homo sapiens
tggccacaacctgaaagacaa

SEQ ID NO: 3301106 - DNA, 22 bp, Homo sapiens
tggccacatttaatatcttcag

SEQ ID NO: 3301107 - DNA, 13 bp, Homo sapiens
tggccaccaggct

SEQ ID NO: 3301108 - DNA, 14 bp, Homo sapiens
tggccaccaggctg

SEQ ID NO: 3301109 - DNA, 16 bp, Homo sapiens
tggccaccaggctggc

SEQ ID NO: 3301110 - DNA, 18 bp, Homo sapiens
tggccaccaggctggcgc

SEQ ID NO: 3301111 - DNA, 20 bp, Homo sapiens
tggccaccaggctggcgcag

SEQ ID NO: 3301112 - DNA, 11 bp, Homo sapiens
tggccaccagt

SEQ ID NO: 3301113 - DNA, 21 bp, Homo sapiens
tggccacctgtagccatctgc

SEQ ID NO: 3301114 - DNA, 23 bp, Homo sapiens
tggccacctgtagccatctgcac

SEQ ID NO: 3301115 - DNA, 14 bp, Homo sapiens
tggccactccgaga

SEQ ID NO: 3301116 - DNA, 17 bp, Homo sapiens
tggccactgcacagagc

SEQ ID NO: 3301117 - DNA, 22 bp, Homo sapiens
tggccactttaagagagaaatc

SEQ ID NO: 3301118 - DNA, 21 bp, Homo sapiens
tggccagacacaggtgcctca

SEQ ID NO: 3301119 - DNA, 19 bp, Homo sapiens
tggccagacgctgccgctg

SEQ ID NO: 3301120 - DNA, 23 bp, Homo sapiens
tggccagagagcctggtgctgct

SEQ ID NO: 3301121 - DNA, 17 bp, Homo sapiens
tggccagagagggccca

SEQ ID NO: 3301122 - DNA, 18 bp, Homo sapiens
tggccagagagggcccag

SEQ ID NO: 3301123 - DNA, 21 bp, Homo sapiens
tggccagagagggcccagctg

SEQ ID NO: 3301124 - DNA, 23 bp, Homo sapiens
tggccagagctgggaggcatggc

SEQ ID NO: 3301125 - DNA, 24 bp, Homo sapiens
tggccagagctgggaggcatggcc

SEQ ID NO: 3301126 - DNA, 15 bp, Homo sapiens
tggccagatgcacca

SEQ ID NO: 3301127 - DNA, 18 bp, Homo sapiens
tggccagatgcaccagcc

SEQ ID NO: 3301128 - DNA, 21 bp, Homo sapiens
tggccagatgcaccagccctt

SEQ ID NO: 3301129 - DNA, 15 bp, Homo sapiens
tggccagcaccctct

SEQ ID NO: 3301130 - DNA, 21 bp, Homo sapiens
tggccagcaccctctcctggg

SEQ ID NO: 3301131 - DNA, 11 bp, Homo sapiens
tggccagcccg

SEQ ID NO: 3301132 - DNA, 14 bp, Homo sapiens
tggccagcccggct

SEQ ID NO: 3301133 - DNA, 16 bp, Homo sapiens
tggccagcccggctgg

SEQ ID NO: 3301134 - DNA, 20 bp, Homo sapiens
tggccagcccggctggtttt

SEQ ID NO: 3301135 - DNA, 19 bp, Homo sapiens
tggccagcctggggcctgg

SEQ ID NO: 3301136 - DNA, 20 bp, Homo sapiens
tggccagcctggggcctggc

SEQ ID NO: 3301137 - DNA, 22 bp, Homo sapiens
tggccagcctggggcctggcag

SEQ ID NO: 3301138 - DNA, 15 bp, Homo sapiens
tggccagctcataaa

SEQ ID NO: 3301139 - DNA, 18 bp, Homo sapiens
tggccagctcataaaatg

SEQ ID NO: 3301140 - DNA, 14 bp, Homo sapiens
tggccaggagctct

SEQ ID NO: 3301141 - DNA, 22 bp, Homo sapiens
tggccaggagctcttcaggcct

SEQ ID NO: 3301142 - DNA, 23 bp, Homo sapiens
tggccaggagctcttcaggcctc

SEQ ID NO: 3301143 - DNA, 21 bp, Homo sapiens
tggccaggaggttggtgactg

SEQ ID NO: 3301144 - DNA, 14 bp, Homo sapiens
tggccaggatggag

SEQ ID NO: 3301145 - DNA, 21 bp, Homo sapiens
tggccaggcactgccttctcc

SEQ ID NO: 3301146 - DNA, 12 bp, Homo sapiens
tggccaggcaga

SEQ ID NO: 3301147 - DNA, 16 bp, Homo sapiens
tggccaggcagatctg

SEQ ID NO: 3301148 - DNA, 23 bp, Homo sapiens
tggccaggcagatctgtgcccca

SEQ ID NO: 3301149 - DNA, 20 bp, Homo sapiens
tggccaggctggtcttgaac

SEQ ID NO: 3301150 - DNA, 11 bp, Homo sapiens
tggccagggca

SEQ ID NO: 3301151 - DNA, 12 bp, Homo sapiens
tggccagggcag

SEQ ID NO: 3301152 - DNA, 18 bp, Homo sapiens
tggccagggcagggccac

SEQ ID NO: 3301153 - DNA, 20 bp, Homo sapiens
tggccagggcagggccaccc

SEQ ID NO: 3301154 - DNA, 16 bp, Homo sapiens
tggccaggtggccact

SEQ ID NO: 3301155 - DNA, 19 bp, Homo sapiens
tggccaggtggccactcca

SEQ ID NO: 3301156 - DNA, 14 bp, Homo sapiens
tggccagtccaggc

SEQ ID NO: 3301157 - DNA, 15 bp, Homo sapiens
tggccagttgcccag

SEQ ID NO: 3301158 - DNA, 20 bp, Homo sapiens
tggccagttgcccagagcac

SEQ ID NO: 3301159 - DNA, 20 bp, Homo sapiens
tggccatccctgggcccctc

SEQ ID NO: 3301160 - DNA, 17 bp, Homo sapiens
tggccatctccctcccc

SEQ ID NO: 3301161 - DNA, 16 bp, Homo sapiens
tggccatggtaccccc

SEQ ID NO: 3301162 - DNA, 23 bp, Homo sapiens
tggccattctttttttcttggcc

SEQ ID NO: 3301163 - DNA, 14 bp, Homo sapiens
tggccatttgcttt

SEQ ID NO: 3301164 - DNA, 12 bp, Homo sapiens
tggcccacgccc

SEQ ID NO: 3301165 - DNA, 22 bp, Homo sapiens
tggcccacgccctccctctccc

SEQ ID NO: 3301166 - DNA, 11 bp, Homo sapiens
tggcccagccg

SEQ ID NO: 3301167 - DNA, 16 bp, Homo sapiens
tggcccaggaattaga

SEQ ID NO: 3301168 - DNA, 24 bp, Homo sapiens
tggcccatagaaacatgacactga

SEQ ID NO: 3301169 - DNA, 15 bp, Homo sapiens
tggcccatcaactgt

SEQ ID NO: 3301170 - DNA, 13 bp, Homo sapiens
tggccccaccctg

SEQ ID NO: 3301171 - DNA, 15 bp, Homo sapiens
tggccccaccctggg

SEQ ID NO: 3301172 - DNA, 12 bp, Homo sapiens
tggccccagcac

SEQ ID NO: 3301173 - DNA, 13 bp, Homo sapiens
tggccccagcaca

SEQ ID NO: 3301174 - DNA, 17 bp, Homo sapiens
tggccccagcacagctt

SEQ ID NO: 3301175 - DNA, 18 bp, Homo sapiens
tggccccagcacagcttg

SEQ ID NO: 3301176 - DNA, 18 bp, Homo sapiens
tggccccagccctgctgg

SEQ ID NO: 3301177 - DNA, 18 bp, Homo sapiens
tggccccatccaaccact

SEQ ID NO: 3301178 - DNA, 21 bp, Homo sapiens
tggcccccaataaaggcagct

SEQ ID NO: 3301179 - DNA, 12 bp, Homo sapiens
tggcccccaggg

SEQ ID NO: 3301180 - DNA, 16 bp, Homo sapiens
tggcccccaggggcag

SEQ ID NO: 3301181 - DNA, 15 bp, Homo sapiens
tggccccgccctcag

SEQ ID NO: 3301182 - DNA, 16 bp, Homo sapiens
tggccccgccctcagg

SEQ ID NO: 3301183 - DNA, 17 bp, Homo sapiens
tggccccgccctcaggc

SEQ ID NO: 3301184 - DNA, 15 bp, Homo sapiens
tggcccctactttgt

SEQ ID NO: 3301185 - DNA, 23 bp, Homo sapiens
tggcccctactttgtggcaatct

SEQ ID NO: 3301186 - DNA, 21 bp, Homo sapiens
tggcccctcaaatcgtccagc

SEQ ID NO: 3301187 - DNA, 13 bp, Homo sapiens
tggcccctcgcct

SEQ ID NO: 3301188 - DNA, 18 bp, Homo sapiens
tggcccctctgacctgca

SEQ ID NO: 3301189 - DNA, 14 bp, Homo sapiens
tggcccctgaacaa

SEQ ID NO: 3301190 - DNA, 17 bp, Homo sapiens
tggccccttttactttt

SEQ ID NO: 3301191 - DNA, 17 bp, Homo sapiens
tggcccgacagcctggc

SEQ ID NO: 3301192 - DNA, 19 bp, Homo sapiens
tggcccgacagcctggcac

SEQ ID NO: 3301193 - DNA, 21 bp, Homo sapiens
tggcccggccggcctggcacc

SEQ ID NO: 3301194 - DNA, 16 bp, Homo sapiens
tggccctgaggtgtgg

SEQ ID NO: 3301195 - DNA, 15 bp, Homo sapiens
tggccctgccctgag

SEQ ID NO: 3301196 - DNA, 13 bp, Homo sapiens
tggccctgcctca

SEQ ID NO: 3301197 - DNA, 17 bp, Homo sapiens
tggccctgcctcctggg

SEQ ID NO: 3301198 - DNA, 13 bp, Homo sapiens
tggccctgtccct

SEQ ID NO: 3301199 - DNA, 17 bp, Homo sapiens
tggccctgtccctccca

SEQ ID NO: 3301200 - DNA, 23 bp, Homo sapiens
tggccctgtccctcccacctctg

SEQ ID NO: 3301201 - DNA, 21 bp, Homo sapiens
tggcccttacttgcttctcta

SEQ ID NO: 3301202 - DNA, 14 bp, Homo sapiens
tggccgactctgca

SEQ ID NO: 3301203 - DNA, 13 bp, Homo sapiens
tgggcccagatct

SEQ ID NO: 3301204 - DNA, 14 bp, Homo sapiens
tgggcccaggacca

SEQ ID NO: 3301205 - DNA, 22 bp, Homo sapiens
tgggcccaggaccagctggggc

SEQ ID NO: 3301206 - DNA, 15 bp, Homo sapiens
tgggcccaggggctg

SEQ ID NO: 3301207 - DNA, 22 bp, Homo sapiens
tgggcccataatagttagccct

SEQ ID NO: 3301208 - DNA, 14 bp, Homo sapiens
tgggccccacctac

SEQ ID NO: 3301209 - DNA, 22 bp, Homo sapiens
tgggccccagaccccagggcag

SEQ ID NO: 3301210 - DNA, 13 bp, Homo sapiens
tgggccccatgct

SEQ ID NO: 3301211 - DNA, 16 bp, Homo sapiens
tgggccccatgctctg

SEQ ID NO: 3301212 - DNA, 17 bp, Homo sapiens
tgggccccatgctctgc

SEQ ID NO: 3301213 - DNA, 18 bp, Homo sapiens
tgggccccatgctctgcc

SEQ ID NO: 3301214 - DNA, 18 bp, Homo sapiens
tgggccccccagctcagg

SEQ ID NO: 3301215 - DNA, 17 bp, Homo sapiens
tgggccccgggctggag

SEQ ID NO: 3301216 - DNA, 22 bp, Homo sapiens
tgggcccctcaacagccaagtg

SEQ ID NO: 3301217 - DNA, 15 bp, Homo sapiens
tgggcccctcagagc

SEQ ID NO: 3301218 - DNA, 13 bp, Homo sapiens
tgggcccctccac

SEQ ID NO: 3301219 - DNA, 23 bp, Homo sapiens
tgggcccctccacgcctcctggc

SEQ ID NO: 3301220 - DNA, 13 bp, Homo sapiens
tgggccctctctc

SEQ ID NO: 3301221 - DNA, 18 bp, Homo sapiens
tgggccctctctctgggc

SEQ ID NO: 3301222 - DNA, 12 bp, Homo sapiens
tgggccctggag

SEQ ID NO: 3301223 - DNA, 18 bp, Homo sapiens
tgggccgaatcccccagg

SEQ ID NO: 3301224 - DNA, 21 bp, Homo sapiens
tgggccggcttcatgccagct

SEQ ID NO: 3301225 - DNA, 17 bp, Homo sapiens
tgggcctcaggctctgc

SEQ ID NO: 3301226 - DNA, 16 bp, Homo sapiens
tgggcctcccttgggc

SEQ ID NO: 3301227 - DNA, 19 bp, Homo sapiens
tgggcctgcttttccagga

SEQ ID NO: 3301228 - DNA, 21 bp, Homo sapiens
tgggcctgcttttccaggatc

SEQ ID NO: 3301229 - DNA, 13 bp, Homo sapiens
tgggcctgggcct

SEQ ID NO: 3301230 - DNA, 16 bp, Homo sapiens
tgggcctgggcctctg

SEQ ID NO: 3301231 - DNA, 15 bp, Homo sapiens
tgggcctgggcctgc

SEQ ID NO: 3301232 - DNA, 16 bp, Homo sapiens
tgggcctgggctaggg

SEQ ID NO: 3301233 - DNA, 22 bp, Homo sapiens
tgggcctgtcgtgccagtcctg

SEQ ID NO: 3301234 - DNA, 13 bp, Homo sapiens
tgggcctgtgcag

SEQ ID NO: 3301235 - DNA, 21 bp, Homo sapiens
tgggcctgtgcagcagcccag

SEQ ID NO: 3301236 - DNA, 23 bp, Homo sapiens
tgggcctgtgcagcagcccagct

SEQ ID NO: 3301237 - DNA, 19 bp, Homo sapiens
tgggccttagtgggccagg

SEQ ID NO: 3301238 - DNA, 23 bp, Homo sapiens
tgggccttagtgggccagggctg

SEQ ID NO: 3301239 - DNA, 13 bp, Homo sapiens
tgggccttgctac

SEQ ID NO: 3301240 - DNA, 15 bp, Homo sapiens
tgggccttgctgctg

SEQ ID NO: 3301241 - DNA, 16 bp, Homo sapiens
tgggccttgctgctgc

SEQ ID NO: 3301242 - DNA, 20 bp, Homo sapiens
tgggccttgctgctgctgca

SEQ ID NO: 3301243 - DNA, 21 bp, Homo sapiens
tgggcctttaagaaccttaat

SEQ ID NO: 3301244 - DNA, 15 bp, Homo sapiens
tgggcgcaggcccag

SEQ ID NO: 3301245 - DNA, 14 bp, Homo sapiens
tgggcgctgcttcc

SEQ ID NO: 3301246 - DNA, 16 bp, Homo sapiens
tgggcgctgcttccag

SEQ ID NO: 3301247 - DNA, 14 bp, Homo sapiens
tgggcgggccatga

SEQ ID NO: 3301248 - DNA, 19 bp, Homo sapiens
tgggcgtggtcactgctgt

SEQ ID NO: 3301249 - DNA, 16 bp, Homo sapiens
tgggcgttgggagcct

SEQ ID NO: 3301250 - DNA, 19 bp, Homo sapiens
tgggcgttgggagcctagc

SEQ ID NO: 3301251 - DNA, 20 bp, Homo sapiens
tgggctaccctaaagggaga

SEQ ID NO: 3301252 - DNA, 16 bp, Homo sapiens
tgggctactggcagct

SEQ ID NO: 3301253 - DNA, 17 bp, Homo sapiens
tgggctactggcagctc

SEQ ID NO: 3301254 - DNA, 19 bp, Homo sapiens
tgggctactggcagctcct

SEQ ID NO: 3301255 - DNA, 21 bp, Homo sapiens
tgggctagtgtgagtggcagc

SEQ ID NO: 3301256 - DNA, 22 bp, Homo sapiens
tgggctagtgtgagtggcagcc

SEQ ID NO: 3301257 - DNA, 18 bp, Homo sapiens
tgggctcacaggcctctc

SEQ ID NO: 3301258 - DNA, 18 bp, Homo sapiens
tgggctccacgggcaggg

SEQ ID NO: 3301259 - DNA, 15 bp, Homo sapiens
tgggctccctgatga

SEQ ID NO: 3301260 - DNA, 18 bp, Homo sapiens
tgggctcctggctgccag

SEQ ID NO: 3301261 - DNA, 19 bp, Homo sapiens
tgggctcctggctgccagg

SEQ ID NO: 3301262 - DNA, 12 bp, Homo sapiens
tgggctctgccc

SEQ ID NO: 3301263 - DNA, 15 bp, Homo sapiens
tgggctctgccccag

SEQ ID NO: 3301264 - DNA, 18 bp, Homo sapiens
tgggctctgtgcagtcac

SEQ ID NO: 3301265 - DNA, 13 bp, Homo sapiens
tgggctcttccaa

SEQ ID NO: 3301266 - DNA, 13 bp, Homo sapiens
tgggctgacacct

SEQ ID NO: 3301267 - DNA, 20 bp, Homo sapiens
tgggctgacccagcatctcc

SEQ ID NO: 3301268 - DNA, 16 bp, Homo sapiens
tgggctgagccctggc

SEQ ID NO: 3301269 - DNA, 15 bp, Homo sapiens
tgggctgatttacat

SEQ ID NO: 3301270 - DNA, 16 bp, Homo sapiens
tgggctgatttacatg

SEQ ID NO: 3301271 - DNA, 13 bp, Homo sapiens
tgggctgccctgg

SEQ ID NO: 3301272 - DNA, 14 bp, Homo sapiens
tgggctgccctggt

SEQ ID NO: 3301273 - DNA, 16 bp, Homo sapiens
tgggctgccctggtgc

SEQ ID NO: 3301274 - DNA, 17 bp, Homo sapiens
tgggctgccctggtgct

SEQ ID NO: 3301275 - DNA, 19 bp, Homo sapiens
tgggctgccctggtgctgc

SEQ ID NO: 3301276 - DNA, 21 bp, Homo sapiens
tgggctgccctggtgctgcca

SEQ ID NO: 3301277 - DNA, 19 bp, Homo sapiens
tgggctgcgggaggccctg

SEQ ID NO: 3301278 - DNA, 19 bp, Homo sapiens
tgggctgctgcaggccgtg

SEQ ID NO: 3301279 - DNA, 14 bp, Homo sapiens
tgggctggactgga

SEQ ID NO: 3301280 - DNA, 12 bp, Homo sapiens
tgggctggactt

SEQ ID NO: 3301281 - DNA, 21 bp, Homo sapiens
tgggctgggccctctcttctc

SEQ ID NO: 3301282 - DNA, 18 bp, Homo sapiens
tgggctggggctgctccc

SEQ ID NO: 3301283 - DNA, 18 bp, Homo sapiens
tgggctggtatctcagaa

SEQ ID NO: 3301284 - DNA, 12 bp, Homo sapiens
tgggctgtctgt

SEQ ID NO: 3301285 - DNA, 15 bp, Homo sapiens
tgggctgtctgtcac

SEQ ID NO: 3301286 - DNA, 16 bp, Homo sapiens
tgggctgtctgtcacc

SEQ ID NO: 3301287 - DNA, 18 bp, Homo sapiens
tgggctgtctgtcaccag

SEQ ID NO: 3301288 - DNA, 16 bp, Homo sapiens
tgggcttcactgtata

SEQ ID NO: 3301289 - DNA, 22 bp, Homo sapiens
tgggcttcagtggcagctgctt

SEQ ID NO: 3301290 - DNA, 15 bp, Homo sapiens
tgggcttccatgcct

SEQ ID NO: 3301291 - DNA, 11 bp, Homo sapiens
tgggcttgagc

SEQ ID NO: 3301292 - DNA, 17 bp, Homo sapiens
tgggcttggacttcctg

SEQ ID NO: 3301293 - DNA, 15 bp, Homo sapiens
tgggcttggcctgct

SEQ ID NO: 3301294 - DNA, 16 bp, Homo sapiens
tgggcttggcctgctg

SEQ ID NO: 3301295 - DNA, 16 bp, Homo sapiens
tgggctttgatttcca

SEQ ID NO: 3301296 - DNA, 14 bp, Homo sapiens
tgggctttgcaggc

SEQ ID NO: 3301297 - DNA, 15 bp, Homo sapiens
tgggctttgcaggct

SEQ ID NO: 3301298 - DNA, 19 bp, Homo sapiens
tgggctttgcaggctctgg

SEQ ID NO: 3301299 - DNA, 22 bp, Homo sapiens
tgggctttgcaggctctgggct

SEQ ID NO: 3301300 - DNA, 21 bp, Homo sapiens
tgggcttttggggagccagaa

SEQ ID NO: 3301301 - DNA, 16 bp, Homo sapiens
tggggaaaaaagcaca

SEQ ID NO: 3301302 - DNA, 23 bp, Homo sapiens
tggggaaaaaagcacatacatta

SEQ ID NO: 3301303 - DNA, 14 bp, Homo sapiens
tggggaaacctaga

SEQ ID NO: 3301304 - DNA, 23 bp, Homo sapiens
tggggaaaggggtcggctgacca

SEQ ID NO: 3301305 - DNA, 21 bp, Homo sapiens
tggggaagaggggctggggca

SEQ ID NO: 3301306 - DNA, 11 bp, Homo sapiens
tggggaaggag

SEQ ID NO: 3301307 - DNA, 17 bp, Homo sapiens
tggggacagttggcaga

SEQ ID NO: 3301308 - DNA, 18 bp, Homo sapiens
tggggacagttggcagag

SEQ ID NO: 3301309 - DNA, 19 bp, Homo sapiens
tggggacagttggcagaga

SEQ ID NO: 3301310 - DNA, 21 bp, Homo sapiens
tggggacagttggcagagaag

SEQ ID NO: 3301311 - DNA, 17 bp, Homo sapiens
tggggaccccaacctca

SEQ ID NO: 3301312 - DNA, 22 bp, Homo sapiens
tggggacccccacgattggcca

SEQ ID NO: 3301313 - DNA, 18 bp, Homo sapiens
tggggacctggtaccctc

SEQ ID NO: 3301314 - DNA, 21 bp, Homo sapiens
tggggactttatttatttcta

SEQ ID NO: 3301315 - DNA, 15 bp, Homo sapiens
tggggagaggaaaga

SEQ ID NO: 3301316 - DNA, 22 bp, Homo sapiens
tggggagaggaactccttggcc

SEQ ID NO: 3301317 - DNA, 20 bp, Homo sapiens
tggggagcacttgcgtcctg

SEQ ID NO: 3301318 - DNA, 23 bp, Homo sapiens
tggggagcacttgcgtcctgcag

SEQ ID NO: 3301319 - DNA, 15 bp, Homo sapiens
tggggagcagagaca

SEQ ID NO: 3301320 - DNA, 20 bp, Homo sapiens
tggggagcaggaggccaata

SEQ ID NO: 3301321 - DNA, 21 bp, Homo sapiens
tggggagcaggaggccaataa

SEQ ID NO: 3301322 - DNA, 22 bp, Homo sapiens
tggggagcaggaggccaataaa

SEQ ID NO: 3301323 - DNA, 22 bp, Homo sapiens
tggggagccaacagaagcttcc

SEQ ID NO: 3301324 - DNA, 19 bp, Homo sapiens
tggggagcccgtctcagtg

SEQ ID NO: 3301325 - DNA, 16 bp, Homo sapiens
tggggagctcctggcc

SEQ ID NO: 3301326 - DNA, 18 bp, Homo sapiens
tggggagctcctggccag

SEQ ID NO: 3301327 - DNA, 17 bp, Homo sapiens
tggggaggcccaaatga

SEQ ID NO: 3301328 - DNA, 23 bp, Homo sapiens
tggggagggacaagggattctgg

SEQ ID NO: 3301329 - DNA, 15 bp, Homo sapiens
tggttcttcatttat

SEQ ID NO: 3301330 - DNA, 23 bp, Homo sapiens
tggttgaactctggtggcacagg

SEQ ID NO: 3301331 - DNA, 22 bp, Homo sapiens
tggttgaccaaggtgcttttct

SEQ ID NO: 3301332 - DNA, 17 bp, Homo sapiens
tggttgagaaatgaata

SEQ ID NO: 3301333 - DNA, 16 bp, Homo sapiens
tggttgatggaaaata

SEQ ID NO: 3301334 - DNA, 17 bp, Homo sapiens
tggttgatggaaaataa

SEQ ID NO: 3301335 - DNA, 21 bp, Homo sapiens
tggttgatggaaaataaacat

SEQ ID NO: 3301336 - DNA, 13 bp, Homo sapiens
tggttgcctgggg

SEQ ID NO: 3301337 - DNA, 16 bp, Homo sapiens
tggttgggaatgagga

SEQ ID NO: 3301338 - DNA, 23 bp, Homo sapiens
tggttgggaatgaggaaaattct

SEQ ID NO: 3301339 - DNA, 22 bp, Homo sapiens
tggttggtaacacaaattttca

SEQ ID NO: 3301340 - DNA, 15 bp, Homo sapiens
tggttgtagaaggag

SEQ ID NO: 3301341 - DNA, 15 bp, Homo sapiens
tggttgtatttctat

SEQ ID NO: 3301342 - DNA, 23 bp, Homo sapiens
tggttgtcatttttgcagtagag

SEQ ID NO: 3301343 - DNA, 16 bp, Homo sapiens
tggttgtctagtcatt

SEQ ID NO: 3301344 - DNA, 20 bp, Homo sapiens
tggttgtctagtcattgtca

SEQ ID NO: 3301345 - DNA, 20 bp, Homo sapiens
tggttgtgcacatgcttcag

SEQ ID NO: 3301346 - DNA, 19 bp, Homo sapiens
tggttgtggtgtagactgt

SEQ ID NO: 3301347 - DNA, 15 bp, Homo sapiens
tggttgtgtctgctt

SEQ ID NO: 3301348 - DNA, 22 bp, Homo sapiens
tggttgttagttatagatgtct

SEQ ID NO: 3301349 - DNA, 22 bp, Homo sapiens
tggttgttgcaccatctgcttg

SEQ ID NO: 3301350 - DNA, 17 bp, Homo sapiens
tggttgtttctgttcca

SEQ ID NO: 3301351 - DNA, 15 bp, Homo sapiens
tggtttaaagaaagt

SEQ ID NO: 3301352 - DNA, 17 bp, Homo sapiens
tggtttaaagaaagtgt

SEQ ID NO: 3301353 - DNA, 21 bp, Homo sapiens
tggtttaaagaaagtgtattt

SEQ ID NO: 3301354 - DNA, 22 bp, Homo sapiens
tggtttaaccattggaatggac

SEQ ID NO: 3301355 - DNA, 19 bp, Homo sapiens
tggtttacaggccctgctc

SEQ ID NO: 3301356 - DNA, 15 bp, Homo sapiens
tggtttactttcaaa

SEQ ID NO: 3301357 - DNA, 16 bp, Homo sapiens
tggtttactttcaaat

SEQ ID NO: 3301358 - DNA, 21 bp, Homo sapiens
tggtttatagagggccaagac

SEQ ID NO: 3301359 - DNA, 20 bp, Homo sapiens
tggtttatattcttatgtta

SEQ ID NO: 3301360 - DNA, 16 bp, Homo sapiens
tggtttcaattcagat

SEQ ID NO: 3301361 - DNA, 12 bp, Homo sapiens
tggtttcagttc

SEQ ID NO: 3301362 - DNA, 20 bp, Homo sapiens
tggtttcagttctgtgtaca

SEQ ID NO: 3301363 - DNA, 21 bp, Homo sapiens
tggtttcagttctgtgtacat

SEQ ID NO: 3301364 - DNA, 12 bp, Homo sapiens
tggtttcatgtt

SEQ ID NO: 3301365 - DNA, 20 bp, Homo sapiens
tggtttccacgatgaaaaac

SEQ ID NO: 3301366 - DNA, 17 bp, Homo sapiens
tggtttcccccttctac

SEQ ID NO: 3301367 - DNA, 19 bp, Homo sapiens
tggtttcctcattcctgaa

SEQ ID NO: 3301368 - DNA, 18 bp, Homo sapiens
tggtttctagatcactgt

SEQ ID NO: 3301369 - DNA, 12 bp, Homo sapiens
tggtttgcacaa

SEQ ID NO: 3301370 - DNA, 13 bp, Homo sapiens
tggtttgcgcagt

SEQ ID NO: 3301371 - DNA, 21 bp, Homo sapiens
tggtttggtcagttacaaagt

SEQ ID NO: 3301372 - DNA, 22 bp, Homo sapiens
tggtttggtgctttttataaaa

SEQ ID NO: 3301373 - DNA, 20 bp, Homo sapiens
tggtttgtatgagatggtta

SEQ ID NO: 3301374 - DNA, 15 bp, Homo sapiens
tggtttgttccctgt

SEQ ID NO: 3301375 - DNA, 15 bp, Homo sapiens
tggttttaaaagcac

SEQ ID NO: 3301376 - DNA, 12 bp, Homo sapiens
tggttttaacaa

SEQ ID NO: 3301377 - DNA, 14 bp, Homo sapiens
tggttttagatttt

SEQ ID NO: 3301378 - DNA, 23 bp, Homo sapiens
tggttttatactgaaggaaaaac

SEQ ID NO: 3301379 - DNA, 13 bp, Homo sapiens
tggttttcctgtg

SEQ ID NO: 3301380 - DNA, 19 bp, Homo sapiens
tggttttgtacactgctgt

SEQ ID NO: 3301381 - DNA, 19 bp, Homo sapiens
tggtttttggctctttcag

SEQ ID NO: 3301382 - DNA, 23 bp, Homo sapiens
tgtaaaaaaagcaaaaatgacaa

SEQ ID NO: 3301383 - DNA, 15 bp, Homo sapiens
tgtaaaaaatggaaa

SEQ ID NO: 3301384 - DNA, 16 bp, Homo sapiens
tgtaaaaaatggaaaa

SEQ ID NO: 3301385 - DNA, 18 bp, Homo sapiens
tgtaaaaaatggaaaaaa

SEQ ID NO: 3301386 - DNA, 22 bp, Homo sapiens
tgtaaaaacagcattgctttct

SEQ ID NO: 3301387 - DNA, 23 bp, Homo sapiens
tgtaaaaacagcattgctttctg

SEQ ID NO: 3301388 - DNA, 16 bp, Homo sapiens
tgtaaaaatcttttga

SEQ ID NO: 3301389 - DNA, 23 bp, Homo sapiens
tgtaaaacaaaaatgtaatgatc

SEQ ID NO: 3301390 - DNA, 14 bp, Homo sapiens
tgtaaaacaaaatt

SEQ ID NO: 3301391 - DNA, 13 bp, Homo sapiens
tgtaaaacaggta

SEQ ID NO: 3301392 - DNA, 14 bp, Homo sapiens
tgtaaaacaggtag

SEQ ID NO: 3301393 - DNA, 22 bp, Homo sapiens
tgtaaaacaggtagaattatct

SEQ ID NO: 3301394 - DNA, 18 bp, Homo sapiens
tgtaaaacctgtcaatga

SEQ ID NO: 3301395 - DNA, 13 bp, Homo sapiens
tgtaaaagacatt

SEQ ID NO: 3301396 - DNA, 21 bp, Homo sapiens
tgtaaaatcttggcacagaaa

SEQ ID NO: 3301397 - DNA, 22 bp, Homo sapiens
tgtaaaatcttggcacagaaac

SEQ ID NO: 3301398 - DNA, 14 bp, Homo sapiens
tgtaaacaaactct

SEQ ID NO: 3301399 - DNA, 16 bp, Homo sapiens
tgtaaactcaaaactt

SEQ ID NO: 3301400 - DNA, 21 bp, Homo sapiens
tgtaaactcaaaacttaacat

SEQ ID NO: 3301401 - DNA, 12 bp, Homo sapiens
tgtaaactgcca

SEQ ID NO: 3301402 - DNA, 14 bp, Homo sapiens
tgtaaactgccata

SEQ ID NO: 3301403 - DNA, 22 bp, Homo sapiens
tgtaaactgccatatataacag

SEQ ID NO: 3301404 - DNA, 18 bp, Homo sapiens
tgtaaactgtactagtct

SEQ ID NO: 3301405 - DNA, 18 bp, Homo sapiens
tgtaaactgtgtattcca

SEQ ID NO: 3301406 - DNA, 12 bp, Homo sapiens
tgtaaacttctg

SEQ ID NO: 3301407 - DNA, 12 bp, Homo sapiens
tgtaaactttgt

SEQ ID NO: 3301408 - DNA, 22 bp, Homo sapiens
tgtaaagagacctacctcaggt

SEQ ID NO: 3301409 - DNA, 23 bp, Homo sapiens
tgtaaagagacctacctcaggtt

SEQ ID NO: 3301410 - DNA, 18 bp, Homo sapiens
tgtaaagccaacaccctg

SEQ ID NO: 3301411 - DNA, 13 bp, Homo sapiens
tgtaaaggaggga

SEQ ID NO: 3301412 - DNA, 22 bp, Homo sapiens
tgtaaaggagggagatctttcc

SEQ ID NO: 3301413 - DNA, 23 bp, Homo sapiens
tgtaaaggagggagatctttccc

SEQ ID NO: 3301414 - DNA, 21 bp, Homo sapiens
tgtaaaggagtcaaaactaca

SEQ ID NO: 3301415 - DNA, 17 bp, Homo sapiens
tgtaaaggtttcatgtt

SEQ ID NO: 3301416 - DNA, 19 bp, Homo sapiens
tgtaaagtaggaaaaataa

SEQ ID NO: 3301417 - DNA, 20 bp, Homo sapiens
tgtaaagtgtgtgattgaag

SEQ ID NO: 3301418 - DNA, 19 bp, Homo sapiens
tgtaaagttgcctttattt

SEQ ID NO: 3301419 - DNA, 21 bp, Homo sapiens
tgtaaataaaatgtgtacagt

SEQ ID NO: 3301420 - DNA, 19 bp, Homo sapiens
tgtaaataaccccattctt

SEQ ID NO: 3301421 - DNA, 23 bp, Homo sapiens
tgtaaataaccccattctttgct

SEQ ID NO: 3301422 - DNA, 21 bp, Homo sapiens
tgtaaatacacatagcatgta

SEQ ID NO: 3301423 - DNA, 12 bp, Homo sapiens
tgtaaatacata

SEQ ID NO: 3301424 - DNA, 19 bp, Homo sapiens
tgtaaataccattgacaca

SEQ ID NO: 3301425 - DNA, 13 bp, Homo sapiens
tgtaaatatatgt

SEQ ID NO: 3301426 - DNA, 14 bp, Homo sapiens
tgtaaatattctat

SEQ ID NO: 3301427 - DNA, 16 bp, Homo sapiens
tgtaaatattctatat

SEQ ID NO: 3301428 - DNA, 18 bp, Homo sapiens
tgtaaatcctagacttga

SEQ ID NO: 3301429 - DNA, 19 bp, Homo sapiens
tgtaaatcctttttcttta

SEQ ID NO: 3301430 - DNA, 23 bp, Homo sapiens
tgtaaatggttttgttttgcacg

SEQ ID NO: 3301431 - DNA, 12 bp, Homo sapiens
tgtaaattgaac

SEQ ID NO: 3301432 - DNA, 17 bp, Homo sapiens
tgtaaattgaatcagta

SEQ ID NO: 3301433 - DNA, 22 bp, Homo sapiens
tgtaaattgaatcagtataaac

SEQ ID NO: 3301434 - DNA, 22 bp, Homo sapiens
tgtaaattgatgggagaaatga

SEQ ID NO: 3301435 - DNA, 15 bp, Homo sapiens
tgtaacaagaaaaca

SEQ ID NO: 3301436 - DNA, 14 bp, Homo sapiens
tgtaacaagccacc

SEQ ID NO: 3301437 - DNA, 17 bp, Homo sapiens
tgtaacaagccacccca

SEQ ID NO: 3301438 - DNA, 15 bp, Homo sapiens
tgtaacaattgtgta

SEQ ID NO: 3301439 - DNA, 16 bp, Homo sapiens
tgtaacaattgtgtag

SEQ ID NO: 3301440 - DNA, 21 bp, Homo sapiens
tgtaacaattgtgtagccttt

SEQ ID NO: 3301441 - DNA, 22 bp, Homo sapiens
tgtaacaattgtgtagcctttt

SEQ ID NO: 3301442 - DNA, 23 bp, Homo sapiens
tgtaacacagctgagagactttt

SEQ ID NO: 3301443 - DNA, 11 bp, Homo sapiens
tgtaacagctg

SEQ ID NO: 3301444 - DNA, 14 bp, Homo sapiens
tgtaacagctgagg

SEQ ID NO: 3301445 - DNA, 15 bp, Homo sapiens
tgtaacagctgaggt

SEQ ID NO: 3301446 - DNA, 15 bp, Homo sapiens
tgtaacctcagctct

SEQ ID NO: 3301447 - DNA, 19 bp, Homo sapiens
tgtaacctcagctctggga

SEQ ID NO: 3301448 - DNA, 18 bp, Homo sapiens
tgtaacggttaactgtaa

SEQ ID NO: 3301449 - DNA, 21 bp, Homo sapiens
tgtaactacaaagctttgcta

SEQ ID NO: 3301450 - DNA, 23 bp, Homo sapiens
tgtaactatagactggaaaaaat

SEQ ID NO: 3301451 - DNA, 21 bp, Homo sapiens
tgtaactcaccgtgctgtctt

SEQ ID NO: 3301452 - DNA, 21 bp, Homo sapiens
tgtaactccagatagagaaat

SEQ ID NO: 3301453 - DNA, 17 bp, Homo sapiens
tgtaacttatgtagata

SEQ ID NO: 3301454 - DNA, 20 bp, Homo sapiens
tgtattctagctaatgtaat

SEQ ID NO: 3301455 - DNA, 22 bp, Homo sapiens
tgtattctagctaatgtaataa

SEQ ID NO: 3301456 - DNA, 22 bp, Homo sapiens
tgtattcttctgtatttctagg

SEQ ID NO: 3301457 - DNA, 20 bp, Homo sapiens
tgtattgagatttcttaaat

SEQ ID NO: 3301458 - DNA, 13 bp, Homo sapiens
tgtattgcttatt

SEQ ID NO: 3301459 - DNA, 15 bp, Homo sapiens
tgtattgcttatttt

SEQ ID NO: 3301460 - DNA, 18 bp, Homo sapiens
tgtattgggccttttgga

SEQ ID NO: 3301461 - DNA, 22 bp, Homo sapiens
tgtattgggccttttggatatg

SEQ ID NO: 3301462 - DNA, 15 bp, Homo sapiens
tgtattgtaaacatg

SEQ ID NO: 3301463 - DNA, 13 bp, Homo sapiens
tgtattgtggtat

SEQ ID NO: 3301464 - DNA, 14 bp, Homo sapiens
tgtattgtggtatt

SEQ ID NO: 3301465 - DNA, 19 bp, Homo sapiens
tgtattgttcccagtgaca

SEQ ID NO: 3301466 - DNA, 22 bp, Homo sapiens
tgtatttaattgtaaactgtac

SEQ ID NO: 3301467 - DNA, 20 bp, Homo sapiens
tgtatttacgctttgattca

SEQ ID NO: 3301468 - DNA, 22 bp, Homo sapiens
tgtatttatacccccaggaaac

SEQ ID NO: 3301469 - DNA, 22 bp, Homo sapiens
tgtatttatgtaatgaagtaaa

SEQ ID NO: 3301470 - DNA, 20 bp, Homo sapiens
tgtatttatgtgtatatttg

SEQ ID NO: 3301471 - DNA, 22 bp, Homo sapiens
tgtatttattaatttgaaacca

SEQ ID NO: 3301472 - DNA, 22 bp, Homo sapiens
tgtatttccaaacctggttcat

SEQ ID NO: 3301473 - DNA, 13 bp, Homo sapiens
tgtatttcttata

SEQ ID NO: 3301474 - DNA, 13 bp, Homo sapiens
tgtatttggaaat

SEQ ID NO: 3301475 - DNA, 15 bp, Homo sapiens
tgtatttgtattaat

SEQ ID NO: 3301476 - DNA, 16 bp, Homo sapiens
tgtatttgtattaata

SEQ ID NO: 3301477 - DNA, 21 bp, Homo sapiens
tgtatttgtattaataaagca

SEQ ID NO: 3301478 - DNA, 15 bp, Homo sapiens
tgtattttaacactt

SEQ ID NO: 3301479 - DNA, 18 bp, Homo sapiens
tgtattttaacactttgt

SEQ ID NO: 3301480 - DNA, 19 bp, Homo sapiens
tgtattttaacactttgta

SEQ ID NO: 3301481 - DNA, 14 bp, Homo sapiens
tgtattttaactca

SEQ ID NO: 3301482 - DNA, 15 bp, Homo sapiens
tgtattttaactcat

SEQ ID NO: 3301483 - DNA, 19 bp, Homo sapiens
tgtattttatttagacaag

SEQ ID NO: 3301484 - DNA, 14 bp, Homo sapiens
tgtattttgattat

SEQ ID NO: 3301485 - DNA, 18 bp, Homo sapiens
tgtatttttcaataataa

SEQ ID NO: 3301486 - DNA, 22 bp, Homo sapiens
tgtatttttctacattattgct

SEQ ID NO: 3301487 - DNA, 17 bp, Homo sapiens
tgtatttttgattgtta

SEQ ID NO: 3301488 - DNA, 21 bp, Homo sapiens
tgtatttttgtgaagtattca

SEQ ID NO: 3301489 - DNA, 16 bp, Homo sapiens
tgtattttttaaaaca

SEQ ID NO: 3301490 - DNA, 18 bp, Homo sapiens
tgtattttttaaaacact

SEQ ID NO: 3301491 - DNA, 19 bp, Homo sapiens
tgtattttttaaaacacta

SEQ ID NO: 3301492 - DNA, 22 bp, Homo sapiens
tgtattttttaaaacactaaaa

SEQ ID NO: 3301493 - DNA, 14 bp, Homo sapiens
tgtcaaaaaaaaaa

SEQ ID NO: 3301494 - DNA, 17 bp, Homo sapiens
tgtcaaaacactgtgga

SEQ ID NO: 3301495 - DNA, 16 bp, Homo sapiens
tgtcaaactgtagaaa

SEQ ID NO: 3301496 - DNA, 13 bp, Homo sapiens
tgtcaaagctttg

SEQ ID NO: 3301497 - DNA, 14 bp, Homo sapiens
tgtcaagaaagagc

SEQ ID NO: 3301498 - DNA, 15 bp, Homo sapiens
tgtcaagacatttct

SEQ ID NO: 3301499 - DNA, 19 bp, Homo sapiens
tgtcaaggctgcttagaat

SEQ ID NO: 3301500 - DNA, 15 bp, Homo sapiens
tgtcaagtacaagca

SEQ ID NO: 3301501 - DNA, 20 bp, Homo sapiens
tgtcaagttaacaaggaatg

SEQ ID NO: 3301502 - DNA, 23 bp, Homo sapiens
tgtcaataaacagcttcatgcct

SEQ ID NO: 3301503 - DNA, 13 bp, Homo sapiens
tgtcaatattaaa

SEQ ID NO: 3301504 - DNA, 14 bp, Homo sapiens
tgtcaatattaaat

SEQ ID NO: 3301505 - DNA, 18 bp, Homo sapiens
tgtcaatattaaatacag

SEQ ID NO: 3301506 - DNA, 15 bp, Homo sapiens
tgtcaatctgtccgt

SEQ ID NO: 3301507 - DNA, 19 bp, Homo sapiens
tgtcaatttccctcaggtt

SEQ ID NO: 3301508 - DNA, 15 bp, Homo sapiens
tgtcaatttctgtgt

SEQ ID NO: 3301509 - DNA, 14 bp, Homo sapiens
tgtcacaatcctaa

SEQ ID NO: 3301510 - DNA, 21 bp, Homo sapiens
tgtcacaatcctaacacatta

SEQ ID NO: 3301511 - DNA, 18 bp, Homo sapiens
tgtcacagaaatcagagg

SEQ ID NO: 3301512 - DNA, 13 bp, Homo sapiens
tgtcacaggcagg

SEQ ID NO: 3301513 - DNA, 21 bp, Homo sapiens
tgtcacaggcaggtccagggt

SEQ ID NO: 3301514 - DNA, 13 bp, Homo sapiens
tgtcacagggcca

SEQ ID NO: 3301515 - DNA, 14 bp, Homo sapiens
tgtcacagggccaa

SEQ ID NO: 3301516 - DNA, 17 bp, Homo sapiens
tgtcacattatttatta

SEQ ID NO: 3301517 - DNA, 15 bp, Homo sapiens
tgtcaccaaggaaac

SEQ ID NO: 3301518 - DNA, 14 bp, Homo sapiens
tgtcaccagctatc

SEQ ID NO: 3301519 - DNA, 15 bp, Homo sapiens
tgtcaccagctatct

SEQ ID NO: 3301520 - DNA, 19 bp, Homo sapiens
tgtcaccagctatctgtca

SEQ ID NO: 3301521 - DNA, 16 bp, Homo sapiens
tgtcacccagactgga

SEQ ID NO: 3301522 - DNA, 18 bp, Homo sapiens
tgtcaccctccacctctt

SEQ ID NO: 3301523 - DNA, 18 bp, Homo sapiens
tgtcaccggtcagtgcct

SEQ ID NO: 3301524 - DNA, 16 bp, Homo sapiens
tgtcacctctctcaga

SEQ ID NO: 3301525 - DNA, 17 bp, Homo sapiens
tgtcacctctctcagag

SEQ ID NO: 3301526 - DNA, 19 bp, Homo sapiens
tgtcacctctctcagagca

SEQ ID NO: 3301527 - DNA, 18 bp, Homo sapiens
tgtcacgtactgtctgat

SEQ ID NO: 3301528 - DNA, 19 bp, Homo sapiens
tgtcacgtactgtctgatt

SEQ ID NO: 3301529 - DNA, 16 bp, Homo sapiens
tgtcactactcacagt

SEQ ID NO: 3301530 - DNA, 22 bp, Homo sapiens
tgtcactcattgctgagcctct

SEQ ID NO: 3301531 - DNA, 18 bp, Homo sapiens
tgtcactgacacaaagga

SEQ ID NO: 3301532 - DNA, 17 bp, Homo sapiens
tgtcactgacctttgtt

SEQ ID NO: 3301533 - DNA, 14 bp, Homo sapiens
tgtcactggctggc

SEQ ID NO: 3301534 - DNA, 12 bp, Homo sapiens
tgtcactgtggt

SEQ ID NO: 3301535 - DNA, 15 bp, Homo sapiens
tgtcactgtggtcct

SEQ ID NO: 3301536 - DNA, 13 bp, Homo sapiens
tgtcactgtttct

SEQ ID NO: 3301537 - DNA, 14 bp, Homo sapiens
tgtcacttgtgctt

SEQ ID NO: 3301538 - DNA, 17 bp, Homo sapiens
tgtcacttgtgctttgc

SEQ ID NO: 3301539 - DNA, 14 bp, Homo sapiens
tgtcagaaacatga

SEQ ID NO: 3301540 - DNA, 16 bp, Homo sapiens
tgtcagaaaccagtta

SEQ ID NO: 3301541 - DNA, 20 bp, Homo sapiens
tgtcagaaaccctggtctcc

SEQ ID NO: 3301542 - DNA, 23 bp, Homo sapiens
tgtcagacagaacttgaatgtgt

SEQ ID NO: 3301543 - DNA, 16 bp, Homo sapiens
tgtcagacataaagcc

SEQ ID NO: 3301544 - DNA, 17 bp, Homo sapiens
tgtcagacataaagcca

SEQ ID NO: 3301545 - DNA, 23 bp, Homo sapiens
tgtcagacatccatgtttgtaaa

SEQ ID NO: 3301546 - DNA, 12 bp, Homo sapiens
tgtcagacttta

SEQ ID NO: 3301547 - DNA, 20 bp, Homo sapiens
tgtcagaggcacaaaagggt

SEQ ID NO: 3301548 - DNA, 15 bp, Homo sapiens
tgtcagagtgttgtt

SEQ ID NO: 3301549 - DNA, 15 bp, Homo sapiens
tgtcagatatgatat

SEQ ID NO: 3301550 - DNA, 23 bp, Homo sapiens
tgtcagatattttttcagaaata

SEQ ID NO: 3301551 - DNA, 16 bp, Homo sapiens
tgtcagatgagaacaa

SEQ ID NO: 3301552 - DNA, 19 bp, Homo sapiens
tgtcagatgagaacaaagc

SEQ ID NO: 3301553 - DNA, 21 bp, Homo sapiens
tgtcagatgagaacaaagctg

SEQ ID NO: 3301554 - DNA, 11 bp, Homo sapiens
tgtcagattcc

SEQ ID NO: 3301555 - DNA, 16 bp, Homo sapiens
tgtcagccagccgccc

SEQ ID NO: 3301556 - DNA, 20 bp, Homo sapiens
tgtcagccagccgccctggg

SEQ ID NO: 3301557 - DNA, 22 bp, Homo sapiens
tgtcagccagccgccctgggct

SEQ ID NO: 3301558 - DNA, 19 bp, Homo sapiens
tgtcagccatcgtcctggg

SEQ ID NO: 3301559 - DNA, 20 bp, Homo sapiens
tgtcagccgagccgggcctg

SEQ ID NO: 3301560 - DNA, 21 bp, Homo sapiens
tgtcagccgagccgggcctgg

SEQ ID NO: 3301561 - DNA, 15 bp, Homo sapiens
tgtcagcctgtgctg

SEQ ID NO: 3301562 - DNA, 23 bp, Homo sapiens
tgtcagcgcaggtttagtttact

SEQ ID NO: 3301563 - DNA, 23 bp, Homo sapiens
tgtcagcgttctaccaggcaaat

SEQ ID NO: 3301564 - DNA, 19 bp, Homo sapiens
tgtcagctactaatgatgt

SEQ ID NO: 3301565 - DNA, 16 bp, Homo sapiens
tgtcagcttcccagcc

SEQ ID NO: 3301566 - DNA, 20 bp, Homo sapiens
tgtcaggcatggctcagagc

SEQ ID NO: 3301567 - DNA, 16 bp, Homo sapiens
tgtcaggtggggcagc

SEQ ID NO: 3301568 - DNA, 17 bp, Homo sapiens
tgtcagtactattcagg

SEQ ID NO: 3301569 - DNA, 18 bp, Homo sapiens
tgtcagtatttcaactgc

SEQ ID NO: 3301570 - DNA, 16 bp, Homo sapiens
tgtcagtatttttgcc

SEQ ID NO: 3301571 - DNA, 20 bp, Homo sapiens
tgtcagtgttaaagattttg

SEQ ID NO: 3301572 - DNA, 22 bp, Homo sapiens
tgtcagtgttaaagattttgtt

SEQ ID NO: 3301573 - DNA, 12 bp, Homo sapiens
tgtcagtgtttt

SEQ ID NO: 3301574 - DNA, 23 bp, Homo sapiens
tgtcagttcttggtgctctgtgt

SEQ ID NO: 3301575 - DNA, 18 bp, Homo sapiens
tgtcataaacagatgaat

SEQ ID NO: 3301576 - DNA, 14 bp, Homo sapiens
tgtcataagaatga

SEQ ID NO: 3301577 - DNA, 15 bp, Homo sapiens
tgtcataagaatgaa

SEQ ID NO: 3301578 - DNA, 16 bp, Homo sapiens
tgtcatagaaattaca

SEQ ID NO: 3301579 - DNA, 15 bp, Homo sapiens
tgtcatatgactgat

SEQ ID NO: 3301580 - DNA, 15 bp, Homo sapiens
tgtgagtgtgacagg

SEQ ID NO: 3301581 - DNA, 19 bp, Homo sapiens
tgtgagtgtgtgtttgtgc

SEQ ID NO: 3301582 - DNA, 16 bp, Homo sapiens
tgtgagttctccctgt

SEQ ID NO: 3301583 - DNA, 21 bp, Homo sapiens
tgtgagtttaccttgtatact

SEQ ID NO: 3301584 - DNA, 22 bp, Homo sapiens
tgtgagtttaccttgtatactg

SEQ ID NO: 3301585 - DNA, 17 bp, Homo sapiens
tgtgataactctgcaaa

SEQ ID NO: 3301586 - DNA, 18 bp, Homo sapiens
tgtgataaggatcagaac

SEQ ID NO: 3301587 - DNA, 22 bp, Homo sapiens
tgtgatacattttttaagcttc

SEQ ID NO: 3301588 - DNA, 14 bp, Homo sapiens
tgtgatagcacttt

SEQ ID NO: 3301589 - DNA, 15 bp, Homo sapiens
tgtgatagcactttc

SEQ ID NO: 3301590 - DNA, 17 bp, Homo sapiens
tgtgatagcactttcta

SEQ ID NO: 3301591 - DNA, 14 bp, Homo sapiens
tgtgatattaacag

SEQ ID NO: 3301592 - DNA, 12 bp, Homo sapiens
tgtgatcaactg

SEQ ID NO: 3301593 - DNA, 17 bp, Homo sapiens
tgtgatcacgcctggct

SEQ ID NO: 3301594 - DNA, 15 bp, Homo sapiens
tgtgatcagaccata

SEQ ID NO: 3301595 - DNA, 14 bp, Homo sapiens
tgtgatgaatcaat

SEQ ID NO: 3301596 - DNA, 20 bp, Homo sapiens
tgtgatgaatcaatgaaaaa

SEQ ID NO: 3301597 - DNA, 13 bp, Homo sapiens
tgtgatgagctga

SEQ ID NO: 3301598 - DNA, 14 bp, Homo sapiens
tgtgatgagctgat

SEQ ID NO: 3301599 - DNA, 16 bp, Homo sapiens
tgtgatgaggggaggg

SEQ ID NO: 3301600 - DNA, 18 bp, Homo sapiens
tgtgatgatgctgtgaca

SEQ ID NO: 3301601 - DNA, 17 bp, Homo sapiens
tgtgatggatggcacaa

SEQ ID NO: 3301602 - DNA, 19 bp, Homo sapiens
tgtgatggatggcacaatg

SEQ ID NO: 3301603 - DNA, 20 bp, Homo sapiens
tgtgatggatggcacaatga

SEQ ID NO: 3301604 - DNA, 13 bp, Homo sapiens
tgtgatgttctaa

SEQ ID NO: 3301605 - DNA, 18 bp, Homo sapiens
tgtgatgttctaaggctc

SEQ ID NO: 3301606 - DNA, 14 bp, Homo sapiens
tgtgattcaatctg

SEQ ID NO: 3301607 - DNA, 16 bp, Homo sapiens
tgtgattcaatctgta

SEQ ID NO: 3301608 - DNA, 20 bp, Homo sapiens
tgtgattcaatctgtaaact

SEQ ID NO: 3301609 - DNA, 22 bp, Homo sapiens
tgtgattcaatctgtaaactgt

SEQ ID NO: 3301610 - DNA, 22 bp, Homo sapiens
tgtgattccactacacctggct

SEQ ID NO: 3301611 - DNA, 13 bp, Homo sapiens
tgtgattgaatct

SEQ ID NO: 3301612 - DNA, 16 bp, Homo sapiens
tgtgattgcacagaat

SEQ ID NO: 3301613 - DNA, 17 bp, Homo sapiens
tgtgattgtggaatgga

SEQ ID NO: 3301614 - DNA, 12 bp, Homo sapiens
tgtgatttccat

SEQ ID NO: 3301615 - DNA, 17 bp, Homo sapiens
tgtgatttcctaaacat

SEQ ID NO: 3301616 - DNA, 20 bp, Homo sapiens
tgtgatttcctaaacataat

SEQ ID NO: 3301617 - DNA, 14 bp, Homo sapiens
tgtgatttctttaa

SEQ ID NO: 3301618 - DNA, 19 bp, Homo sapiens
tgtgatttctttaaaagaa

SEQ ID NO: 3301619 - DNA, 21 bp, Homo sapiens
tgtgatttctttaaaagaatg

SEQ ID NO: 3301620 - DNA, 17 bp, Homo sapiens
tgtgatttgtgaaataa

SEQ ID NO: 3301621 - DNA, 11 bp, Homo sapiens
tgtgatttttt

SEQ ID NO: 3301622 - DNA, 15 bp, Homo sapiens
tgtgcaaattaacag

SEQ ID NO: 3301623 - DNA, 13 bp, Homo sapiens
tgtgcaatagaag

SEQ ID NO: 3301624 - DNA, 16 bp, Homo sapiens
tgtgcacatgcacgtg

SEQ ID NO: 3301625 - DNA, 21 bp, Homo sapiens
tgtgcaccttaccaactttct

SEQ ID NO: 3301626 - DNA, 21 bp, Homo sapiens
tgtgcacgagtgggaaggact

SEQ ID NO: 3301627 - DNA, 14 bp, Homo sapiens
tgtgcacgtacaca

SEQ ID NO: 3301628 - DNA, 19 bp, Homo sapiens
tgtgcacgtggcatgtggc

SEQ ID NO: 3301629 - DNA, 17 bp, Homo sapiens
tgtgcacttatttatga

SEQ ID NO: 3301630 - DNA, 15 bp, Homo sapiens
tgtgcagcagcccag

SEQ ID NO: 3301631 - DNA, 20 bp, Homo sapiens
tgtgcagcagcccagcttcc

SEQ ID NO: 3301632 - DNA, 22 bp, Homo sapiens
tgtgcagcagcccagcttcctg

SEQ ID NO: 3301633 - DNA, 15 bp, Homo sapiens
tgtgcagggagggca

SEQ ID NO: 3301634 - DNA, 20 bp, Homo sapiens
tgtgcagtgaaggttgctga

SEQ ID NO: 3301635 - DNA, 19 bp, Homo sapiens
tgtgcataatgctttggaa

SEQ ID NO: 3301636 - DNA, 20 bp, Homo sapiens
tgtgcataatgctttggaaa

SEQ ID NO: 3301637 - DNA, 22 bp, Homo sapiens
tgtgcataatgctttggaaaaa

SEQ ID NO: 3301638 - DNA, 13 bp, Homo sapiens
tgtgcatcctgtg

SEQ ID NO: 3301639 - DNA, 14 bp, Homo sapiens
tgtgcatcctgtga

SEQ ID NO: 3301640 - DNA, 16 bp, Homo sapiens
tgtgcatcctgtgaaa

SEQ ID NO: 3301641 - DNA, 13 bp, Homo sapiens
tgtgcatgggtta

SEQ ID NO: 3301642 - DNA, 20 bp, Homo sapiens
tgtgcatgtatgtcttggac

SEQ ID NO: 3301643 - DNA, 14 bp, Homo sapiens
tgtgcatgtgtgta

SEQ ID NO: 3301644 - DNA, 15 bp, Homo sapiens
tgtgcatgtgtgtat

SEQ ID NO: 3301645 - DNA, 20 bp, Homo sapiens
tgtgcatttcacctgtgaca

SEQ ID NO: 3301646 - DNA, 14 bp, Homo sapiens
tgtgccaacctgtt

SEQ ID NO: 3301647 - DNA, 17 bp, Homo sapiens
tgtgccaacctgttctt

SEQ ID NO: 3301648 - DNA, 16 bp, Homo sapiens
tgtgccaatatgtatt

SEQ ID NO: 3301649 - DNA, 17 bp, Homo sapiens
tgtgccaatatgtattg

SEQ ID NO: 3301650 - DNA, 17 bp, Homo sapiens
tgtgccaccatgcctca

SEQ ID NO: 3301651 - DNA, 21 bp, Homo sapiens
tgtgccagaggaatcctggca

SEQ ID NO: 3301652 - DNA, 18 bp, Homo sapiens
tgtgccagggcaatgatg

SEQ ID NO: 3301653 - DNA, 21 bp, Homo sapiens
tgtgccatagagtttaacaca

SEQ ID NO: 3301654 - DNA, 12 bp, Homo sapiens
tgtgccatgtgc

SEQ ID NO: 3301655 - DNA, 16 bp, Homo sapiens
tgtgccatgtgccagg

SEQ ID NO: 3301656 - DNA, 20 bp, Homo sapiens
tgtgcccacatcccaggctt

SEQ ID NO: 3301657 - DNA, 14 bp, Homo sapiens
tgtgccccatgcct

SEQ ID NO: 3301658 - DNA, 15 bp, Homo sapiens
tgtgccccatgcctg

SEQ ID NO: 3301659 - DNA, 19 bp, Homo sapiens
tgtgccccatgcctgtcca

SEQ ID NO: 3301660 - DNA, 18 bp, Homo sapiens
tgtgccctcaccaccaca

SEQ ID NO: 3301661 - DNA, 11 bp, Homo sapiens
tgtgccctggt

SEQ ID NO: 3301662 - DNA, 20 bp, Homo sapiens
tgtgcctatagtcccagcta

SEQ ID NO: 3301663 - DNA, 12 bp, Homo sapiens
tgtgcctctgcg

SEQ ID NO: 3301664 - DNA, 23 bp, Homo sapiens
tgtgcctctgcggggcagggcct

SEQ ID NO: 3301665 - DNA, 13 bp, Homo sapiens
tgtgcctctggga

SEQ ID NO: 3301666 - DNA, 16 bp, Homo sapiens
tgtgcctctgggactg

SEQ ID NO: 3301667 - DNA, 15 bp, Homo sapiens
tgtgcctgaccctac

SEQ ID NO: 3301668 - DNA, 14 bp, Homo sapiens
tgtgcctgcaccag

SEQ ID NO: 3301669 - DNA, 18 bp, Homo sapiens
tgtgcctgcaccaggaga

SEQ ID NO: 3301670 - DNA, 12 bp, Homo sapiens
tgtgcctgcagc

SEQ ID NO: 3301671 - DNA, 13 bp, Homo sapiens
tgtgcctgcagcc

SEQ ID NO: 3301672 - DNA, 21 bp, Homo sapiens
tgtgcctgccatgggccagcc

SEQ ID NO: 3301673 - DNA, 23 bp, Homo sapiens
tgtgcctgccatgggccagccta

SEQ ID NO: 3301674 - DNA, 19 bp, Homo sapiens
tgtgcctgctagagcaacc

SEQ ID NO: 3301675 - DNA, 22 bp, Homo sapiens
tgtgcctgggggagttttcctc

SEQ ID NO: 3301676 - DNA, 15 bp, Homo sapiens
tgtgcctggtagaaa

SEQ ID NO: 3301677 - DNA, 18 bp, Homo sapiens
tgtgcctgtcaggctctg

SEQ ID NO: 3301678 - DNA, 23 bp, Homo sapiens
tgtgcctgtcaggctctggccct

SEQ ID NO: 3301679 - DNA, 15 bp, Homo sapiens
tgtgccttatgttga

SEQ ID NO: 3301680 - DNA, 19 bp, Homo sapiens
tgtgccttctctatggcct

SEQ ID NO: 3301681 - DNA, 16 bp, Homo sapiens
tgtgccttcttttgat

SEQ ID NO: 3301682 - DNA, 13 bp, Homo sapiens
tgtgccttgtttt

SEQ ID NO: 3301683 - DNA, 15 bp, Homo sapiens
tgtgccttgtttttt

SEQ ID NO: 3301684 - DNA, 16 bp, Homo sapiens
tgtgcctttgcaaatc

SEQ ID NO: 3301685 - DNA, 15 bp, Homo sapiens
tgtgccttttatagc

SEQ ID NO: 3301686 - DNA, 16 bp, Homo sapiens
tgtgccttttatagct

SEQ ID NO: 3301687 - DNA, 15 bp, Homo sapiens
tgtgcggtgcataca

SEQ ID NO: 3301688 - DNA, 15 bp, Homo sapiens
tgtgcgtcccagctg

SEQ ID NO: 3301689 - DNA, 15 bp, Homo sapiens
tgtgcgtgaaacaca

SEQ ID NO: 3301690 - DNA, 14 bp, Homo sapiens
tgtgcgttaaataa

SEQ ID NO: 3301691 - DNA, 18 bp, Homo sapiens
tgtgcgttaaataagcaa

SEQ ID NO: 3301692 - DNA, 14 bp, Homo sapiens
tgtgctacagatga

SEQ ID NO: 3301693 - DNA, 18 bp, Homo sapiens
tgtgctagaatacttttt

SEQ ID NO: 3301694 - DNA, 19 bp, Homo sapiens
tgtgctagctaaaagacaa

SEQ ID NO: 3301695 - DNA, 15 bp, Homo sapiens
tgtgctataaatcct

SEQ ID NO: 3301696 - DNA, 18 bp, Homo sapiens
tgtgctatacacacacac

SEQ ID NO: 3301697 - DNA, 22 bp, Homo sapiens
tgtgctatataaatatgtcaga

SEQ ID NO: 3301698 - DNA, 14 bp, Homo sapiens
tgtgctatgaattt

SEQ ID NO: 3301699 - DNA, 14 bp, Homo sapiens
tgtgctatttaatt

SEQ ID NO: 3301700 - DNA, 17 bp, Homo sapiens
tgtgctcacgctccccc

SEQ ID NO: 3301701 - DNA, 18 bp, Homo sapiens
tgtgctcagaagaggaaa

SEQ ID NO: 3301702 - DNA, 12 bp, Homo sapiens
tgtgctcagaga

SEQ ID NO: 3301703 - DNA, 23 bp, Homo sapiens
tgtgctccgtgcctccaccacca

SEQ ID NO: 3301704 - DNA, 22 bp, Homo sapiens
tgtgctctgatcatccactgtg

SEQ ID NO: 3301705 - DNA, 23 bp, Homo sapiens
tgtgctctgatcatccactgtgc

SEQ ID NO: 3301706 - DNA, 16 bp, Homo sapiens
tgtgctctttgaagag

SEQ ID NO: 3301707 - DNA, 15 bp, Homo sapiens
tgttctgtttgttaa

SEQ ID NO: 3301708 - DNA, 16 bp, Homo sapiens
tgttctgtttgttaaa

SEQ ID NO: 3301709 - DNA, 13 bp, Homo sapiens
tgttcttacacat

SEQ ID NO: 3301710 - DNA, 14 bp, Homo sapiens
tgttcttacacata

SEQ ID NO: 3301711 - DNA, 22 bp, Homo sapiens
tgttcttacacatacagtttta

SEQ ID NO: 3301712 - DNA, 21 bp, Homo sapiens
tgttcttactgtaactacttc

SEQ ID NO: 3301713 - DNA, 20 bp, Homo sapiens
tgttcttagagtgtagctgt

SEQ ID NO: 3301714 - DNA, 22 bp, Homo sapiens
tgttcttcaagccagctctagg

SEQ ID NO: 3301715 - DNA, 16 bp, Homo sapiens
tgttcttcataagctg

SEQ ID NO: 3301716 - DNA, 19 bp, Homo sapiens
tgttcttgctgctagaact

SEQ ID NO: 3301717 - DNA, 23 bp, Homo sapiens
tgttcttgctgctagaacttttt

SEQ ID NO: 3301718 - DNA, 15 bp, Homo sapiens
tgttctttccggcca

SEQ ID NO: 3301719 - DNA, 20 bp, Homo sapiens
tgttctttggaaatacacag

SEQ ID NO: 3301720 - DNA, 13 bp, Homo sapiens
tgttctttgggga

SEQ ID NO: 3301721 - DNA, 12 bp, Homo sapiens
tgttcttttgca

SEQ ID NO: 3301722 - DNA, 13 bp, Homo sapiens
tgttctttttaga

SEQ ID NO: 3301723 - DNA, 21 bp, Homo sapiens
tgttgaaaaaatttaaaagta

SEQ ID NO: 3301724 - DNA, 18 bp, Homo sapiens
tgttgaaaatatttctct

SEQ ID NO: 3301725 - DNA, 21 bp, Homo sapiens
tgttgaaaatatttctctagt

SEQ ID NO: 3301726 - DNA, 14 bp, Homo sapiens
tgttgaaaatgttc

SEQ ID NO: 3301727 - DNA, 17 bp, Homo sapiens
tgttgaaaatgttcaga

SEQ ID NO: 3301728 - DNA, 22 bp, Homo sapiens
tgttgaaaattattttaaacaa

SEQ ID NO: 3301729 - DNA, 11 bp, Homo sapiens
tgttgaaagat

SEQ ID NO: 3301730 - DNA, 14 bp, Homo sapiens
tgttgaaattatgt

SEQ ID NO: 3301731 - DNA, 21 bp, Homo sapiens
tgttgaaattatgtatgttta

SEQ ID NO: 3301732 - DNA, 18 bp, Homo sapiens
tgttgaaattttgcaaat

SEQ ID NO: 3301733 - DNA, 23 bp, Homo sapiens
tgttgaaattttgcaaatataaa

SEQ ID NO: 3301734 - DNA, 23 bp, Homo sapiens
tgttgaaccaaacctccctgcta

SEQ ID NO: 3301735 - DNA, 14 bp, Homo sapiens
tgttgaagtttgaa

SEQ ID NO: 3301736 - DNA, 18 bp, Homo sapiens
tgttgacgaagtctcttt

SEQ ID NO: 3301737 - DNA, 23 bp, Homo sapiens
tgttgagaatcccaaatttgatt

SEQ ID NO: 3301738 - DNA, 18 bp, Homo sapiens
tgttgagatggtaacaga

SEQ ID NO: 3301739 - DNA, 16 bp, Homo sapiens
tgttgagccttttccc

SEQ ID NO: 3301740 - DNA, 18 bp, Homo sapiens
tgttgaggcatcaaaaaa

SEQ ID NO: 3301741 - DNA, 18 bp, Homo sapiens
tgttgagggccacttttt

SEQ ID NO: 3301742 - DNA, 21 bp, Homo sapiens
tgttgaggtggtctgaatgtt

SEQ ID NO: 3301743 - DNA, 15 bp, Homo sapiens
tgttgatcaaccatt

SEQ ID NO: 3301744 - DNA, 23 bp, Homo sapiens
tgttgatcatgtactttttagta

SEQ ID NO: 3301745 - DNA, 12 bp, Homo sapiens
tgttgatcccaa

SEQ ID NO: 3301746 - DNA, 16 bp, Homo sapiens
tgttgatcccaagaca

SEQ ID NO: 3301747 - DNA, 13 bp, Homo sapiens
tgttgatcccagt

SEQ ID NO: 3301748 - DNA, 14 bp, Homo sapiens
tgttgatcttacaa

SEQ ID NO: 3301749 - DNA, 22 bp, Homo sapiens
tgttgatgtatctgagttgcca

SEQ ID NO: 3301750 - DNA, 20 bp, Homo sapiens
tgttgattgcaggaataagg

SEQ ID NO: 3301751 - DNA, 15 bp, Homo sapiens
tgttgattttctgtt

SEQ ID NO: 3301752 - DNA, 15 bp, Homo sapiens
tgttgcaattaggat

SEQ ID NO: 3301753 - DNA, 17 bp, Homo sapiens
tgttgcaccatctgctt

SEQ ID NO: 3301754 - DNA, 19 bp, Homo sapiens
tgttgcaccatctgcttgg

SEQ ID NO: 3301755 - DNA, 18 bp, Homo sapiens
tgttgcattattcattta

SEQ ID NO: 3301756 - DNA, 20 bp, Homo sapiens
tgttgccaaatatgtcctgg

SEQ ID NO: 3301757 - DNA, 23 bp, Homo sapiens
tgttgccaaatatgtcctggggt

SEQ ID NO: 3301758 - DNA, 14 bp, Homo sapiens
tgttgccatagccc

SEQ ID NO: 3301759 - DNA, 12 bp, Homo sapiens
tgttgcccaggc

SEQ ID NO: 3301760 - DNA, 15 bp, Homo sapiens
tgttgcccaggcagg

SEQ ID NO: 3301761 - DNA, 17 bp, Homo sapiens
tgttgcccaggcaggtc

SEQ ID NO: 3301762 - DNA, 19 bp, Homo sapiens
tgttgcccaggcaggtctt

SEQ ID NO: 3301763 - DNA, 20 bp, Homo sapiens
tgttgcccaggctggcgtgc

SEQ ID NO: 3301764 - DNA, 17 bp, Homo sapiens
tgttgctatgtgcctta

SEQ ID NO: 3301765 - DNA, 19 bp, Homo sapiens
tgttgctcaaaaaatgagc

SEQ ID NO: 3301766 - DNA, 14 bp, Homo sapiens
tgttgctcagaagt

SEQ ID NO: 3301767 - DNA, 14 bp, Homo sapiens
tgttgctccctgtg

SEQ ID NO: 3301768 - DNA, 20 bp, Homo sapiens
tgttgctctaggaagacatt

SEQ ID NO: 3301769 - DNA, 22 bp, Homo sapiens
tgttgctgctactgtcttacta

SEQ ID NO: 3301770 - DNA, 15 bp, Homo sapiens
tgttggaaaaaattt

SEQ ID NO: 3301771 - DNA, 16 bp, Homo sapiens
tgttggagtgtttcta

SEQ ID NO: 3301772 - DNA, 15 bp, Homo sapiens
tgttggccaaagcca

SEQ ID NO: 3301773 - DNA, 23 bp, Homo sapiens
tgttggccaggctggtctaaaac

SEQ ID NO: 3301774 - DNA, 17 bp, Homo sapiens
tgttggctgggggcctc

SEQ ID NO: 3301775 - DNA, 18 bp, Homo sapiens
tgttgggatactgcaggg

SEQ ID NO: 3301776 - DNA, 18 bp, Homo sapiens
tgttgggattcctgaccc

SEQ ID NO: 3301777 - DNA, 16 bp, Homo sapiens
tgttggtaactaatgt

SEQ ID NO: 3301778 - DNA, 21 bp, Homo sapiens
tgttggtaattattttggtac

SEQ ID NO: 3301779 - DNA, 14 bp, Homo sapiens
tgttggtcatttta

SEQ ID NO: 3301780 - DNA, 22 bp, Homo sapiens
tgttggtcgcagctacataaga

SEQ ID NO: 3301781 - DNA, 20 bp, Homo sapiens
tgttggttgttttttccttt

SEQ ID NO: 3301782 - DNA, 13 bp, Homo sapiens
tgttggtttactt

SEQ ID NO: 3301783 - DNA, 17 bp, Homo sapiens
tgttgtaaaaagaaaaa

SEQ ID NO: 3301784 - DNA, 14 bp, Homo sapiens
tgttgtaacctgct

SEQ ID NO: 3301785 - DNA, 15 bp, Homo sapiens
tgttgtaagaattct

SEQ ID NO: 3301786 - DNA, 15 bp, Homo sapiens
tgttgtaatgctgca

SEQ ID NO: 3301787 - DNA, 16 bp, Homo sapiens
tgttgtaatgctgcac

SEQ ID NO: 3301788 - DNA, 16 bp, Homo sapiens
tgttgtacatttatga

SEQ ID NO: 3301789 - DNA, 16 bp, Homo sapiens
tgttgtacttaaatgg

SEQ ID NO: 3301790 - DNA, 15 bp, Homo sapiens
tgttgtatgccttta

SEQ ID NO: 3301791 - DNA, 18 bp, Homo sapiens
tgttgtcagcctgtgctg

SEQ ID NO: 3301792 - DNA, 22 bp, Homo sapiens
tgttgtccaacaataaacagga

SEQ ID NO: 3301793 - DNA, 17 bp, Homo sapiens
tgttgtccttttgtctt

SEQ ID NO: 3301794 - DNA, 15 bp, Homo sapiens
tgttgtcttcagcag

SEQ ID NO: 3301795 - DNA, 16 bp, Homo sapiens
tgttgtcttgaaagat

SEQ ID NO: 3301796 - DNA, 14 bp, Homo sapiens
tgttgtgatgtatt

SEQ ID NO: 3301797 - DNA, 19 bp, Homo sapiens
tgttgtggctcttatttct

SEQ ID NO: 3301798 - DNA, 22 bp, Homo sapiens
tgttgtgtctgtgccctccaaa

SEQ ID NO: 3301799 - DNA, 15 bp, Homo sapiens
tgttgtgtgtgcagg

SEQ ID NO: 3301800 - DNA, 22 bp, Homo sapiens
tgttgttccaaatgtgtataat

SEQ ID NO: 3301801 - DNA, 14 bp, Homo sapiens
tgttgtttctttct

SEQ ID NO: 3301802 - DNA, 12 bp, Homo sapiens
tgttgtttgcca

SEQ ID NO: 3301803 - DNA, 13 bp, Homo sapiens
tgttgtttgtaaa

SEQ ID NO: 3301804 - DNA, 15 bp, Homo sapiens
tgttgtttgtaaata

SEQ ID NO: 3301805 - DNA, 21 bp, Homo sapiens
tgttgtttgtaaataagagat

SEQ ID NO: 3301806 - DNA, 18 bp, Homo sapiens
tgtttaaaaaaacaaata

SEQ ID NO: 3301807 - DNA, 18 bp, Homo sapiens
tgtttaaaaaaacattat

SEQ ID NO: 3301808 - DNA, 21 bp, Homo sapiens
tgtttaaaactcagaatataa

SEQ ID NO: 3301809 - DNA, 13 bp, Homo sapiens
tgtttaaaatgta

SEQ ID NO: 3301810 - DNA, 17 bp, Homo sapiens
tgtttaaaattcagttt

SEQ ID NO: 3301811 - DNA, 12 bp, Homo sapiens
tgtttaaagaga

SEQ ID NO: 3301812 - DNA, 13 bp, Homo sapiens
tgtttaaatcatg

SEQ ID NO: 3301813 - DNA, 19 bp, Homo sapiens
tgtttaaatcatgtatgtt

SEQ ID NO: 3301814 - DNA, 21 bp, Homo sapiens
tgtttaagtgttgtaaatatt

SEQ ID NO: 3301815 - DNA, 14 bp, Homo sapiens
tgtttaatatttaa

SEQ ID NO: 3301816 - DNA, 17 bp, Homo sapiens
tgtttaatgtgaacttg

SEQ ID NO: 3301817 - DNA, 18 bp, Homo sapiens
tgtttaatgtgaacttgt

SEQ ID NO: 3301818 - DNA, 15 bp, Homo sapiens
tgtttaatttcttca

SEQ ID NO: 3301819 - DNA, 17 bp, Homo sapiens
tgtttaatttcttcaaa

SEQ ID NO: 3301820 - DNA, 20 bp, Homo sapiens
tgtttaatttcttcaaaatg

SEQ ID NO: 3301821 - DNA, 23 bp, Homo sapiens
tgtttaatttcttcaaaatgtat

SEQ ID NO: 3301822 - DNA, 18 bp, Homo sapiens
tgtttaatttttatttct

SEQ ID NO: 3301823 - DNA, 21 bp, Homo sapiens
tgtttaatttttatttcttcc

SEQ ID NO: 3301824 - DNA, 19 bp, Homo sapiens
tgtttacactctttgtaag

SEQ ID NO: 3301825 - DNA, 21 bp, Homo sapiens
tgtttacagcactactctgtg

SEQ ID NO: 3301826 - DNA, 22 bp, Homo sapiens
tgtttacagcactactctgtgc

SEQ ID NO: 3301827 - DNA, 20 bp, Homo sapiens
tgtttacagggagcctcctg

SEQ ID NO: 3301828 - DNA, 21 bp, Homo sapiens
tgtttacagggagcctcctgc

SEQ ID NO: 3301829 - DNA, 22 bp, Homo sapiens
tgtttacagggagcctcctgcc

SEQ ID NO: 3301830 - DNA, 12 bp, Homo sapiens
tgtttacatatc

SEQ ID NO: 3301831 - DNA, 15 bp, Homo sapiens
tgtttacatgtgtag

SEQ ID NO: 3301832 - DNA, 22 bp, Homo sapiens
tgtttacatgtgtagcctatgt

SEQ ID NO: 3301833 - DNA, 18 bp, Homo sapiens
ttaactttttttcttcta

SEQ ID NO: 3301834 - DNA, 18 bp, Homo sapiens
ttaagaaaaaagtgttga

SEQ ID NO: 3301835 - DNA, 17 bp, Homo sapiens
ttaagaaaagcactttt

SEQ ID NO: 3301836 - DNA, 18 bp, Homo sapiens
ttaagaaaagcacttttg

SEQ ID NO: 3301837 - DNA, 16 bp, Homo sapiens
ttaagaacacaaagcg

SEQ ID NO: 3301838 - DNA, 13 bp, Homo sapiens
ttaagaactgctt

SEQ ID NO: 3301839 - DNA, 21 bp, Homo sapiens
ttaagaagccctgcagagcac

SEQ ID NO: 3301840 - DNA, 13 bp, Homo sapiens
ttaagaagctgtt

SEQ ID NO: 3301841 - DNA, 20 bp, Homo sapiens
ttaagaatagaaaactgggt

SEQ ID NO: 3301842 - DNA, 19 bp, Homo sapiens
ttaagaatatgtttccttg

SEQ ID NO: 3301843 - DNA, 23 bp, Homo sapiens
ttaagaatgcagattcctgggcc

SEQ ID NO: 3301844 - DNA, 21 bp, Homo sapiens
ttaagaattgaccatctgctt

SEQ ID NO: 3301845 - DNA, 19 bp, Homo sapiens
ttaagaattgagtaatggt

SEQ ID NO: 3301846 - DNA, 16 bp, Homo sapiens
ttaagaatttcacaag

SEQ ID NO: 3301847 - DNA, 20 bp, Homo sapiens
ttaagacactgaaaaatcta

SEQ ID NO: 3301848 - DNA, 15 bp, Homo sapiens
ttaagacagtgtaca

SEQ ID NO: 3301849 - DNA, 16 bp, Homo sapiens
ttaagacatgatttcc

SEQ ID NO: 3301850 - DNA, 18 bp, Homo sapiens
ttaagactgattttaata

SEQ ID NO: 3301851 - DNA, 15 bp, Homo sapiens
ttaagagaaatggca

SEQ ID NO: 3301852 - DNA, 14 bp, Homo sapiens
ttaagagagaaatc

SEQ ID NO: 3301853 - DNA, 22 bp, Homo sapiens
ttaagagatcccttaagaagtt

SEQ ID NO: 3301854 - DNA, 23 bp, Homo sapiens
ttaagagccatataagtttgaag

SEQ ID NO: 3301855 - DNA, 16 bp, Homo sapiens
ttaagaggcagggtct

SEQ ID NO: 3301856 - DNA, 19 bp, Homo sapiens
ttaagagtgaaataattaa

SEQ ID NO: 3301857 - DNA, 19 bp, Homo sapiens
ttaagagtgctaaattttt

SEQ ID NO: 3301858 - DNA, 22 bp, Homo sapiens
ttaagatacagtgtaggcattt

SEQ ID NO: 3301859 - DNA, 14 bp, Homo sapiens
ttaagatggattct

SEQ ID NO: 3301860 - DNA, 18 bp, Homo sapiens
ttaagattgtaaaaataa

SEQ ID NO: 3301861 - DNA, 16 bp, Homo sapiens
ttaagatttttctcaa

SEQ ID NO: 3301862 - DNA, 22 bp, Homo sapiens
ttaagatttttctcaaagtttt

SEQ ID NO: 3301863 - DNA, 19 bp, Homo sapiens
ttaagcaaatgttaaaagt

SEQ ID NO: 3301864 - DNA, 14 bp, Homo sapiens
ttaagcactacata

SEQ ID NO: 3301865 - DNA, 15 bp, Homo sapiens
ttaagcactcttaaa

SEQ ID NO: 3301866 - DNA, 16 bp, Homo sapiens
ttaagcagaagcatta

SEQ ID NO: 3301867 - DNA, 13 bp, Homo sapiens
ttaagcagctctt

SEQ ID NO: 3301868 - DNA, 18 bp, Homo sapiens
ttaagcagctcttgctaa

SEQ ID NO: 3301869 - DNA, 12 bp, Homo sapiens
ttaagcattgtt

SEQ ID NO: 3301870 - DNA, 23 bp, Homo sapiens
ttaagcattgtttgcttattgtt

SEQ ID NO: 3301871 - DNA, 21 bp, Homo sapiens
ttaagcctcatatttaaagac

SEQ ID NO: 3301872 - DNA, 19 bp, Homo sapiens
ttaagctgcagagatttct

SEQ ID NO: 3301873 - DNA, 21 bp, Homo sapiens
ttaagctgttcctgttcagta

SEQ ID NO: 3301874 - DNA, 14 bp, Homo sapiens
ttaagctgtttcca

SEQ ID NO: 3301875 - DNA, 19 bp, Homo sapiens
ttaaggacaaaaatgaact

SEQ ID NO: 3301876 - DNA, 16 bp, Homo sapiens
ttaaggagatggcctc

SEQ ID NO: 3301877 - DNA, 20 bp, Homo sapiens
ttaaggattgtgatattttt

SEQ ID NO: 3301878 - DNA, 23 bp, Homo sapiens
ttaaggcagtatgatatcatgct

SEQ ID NO: 3301879 - DNA, 14 bp, Homo sapiens
ttaaggctgtgtga

SEQ ID NO: 3301880 - DNA, 21 bp, Homo sapiens
ttaagggatggaaaaggaaga

SEQ ID NO: 3301881 - DNA, 13 bp, Homo sapiens
ttaagggcagagt

SEQ ID NO: 3301882 - DNA, 18 bp, Homo sapiens
ttaaggggaagaatgaaa

SEQ ID NO: 3301883 - DNA, 23 bp, Homo sapiens
ttaaggggtgggtcagaacatgt

SEQ ID NO: 3301884 - DNA, 20 bp, Homo sapiens
ttaaggtgagcataaatcaa

SEQ ID NO: 3301885 - DNA, 15 bp, Homo sapiens
ttaaggttgaacttt

SEQ ID NO: 3301886 - DNA, 15 bp, Homo sapiens
ttaagtaaaccaaaa

SEQ ID NO: 3301887 - DNA, 21 bp, Homo sapiens
ttaagtaatgtggaagaaaat

SEQ ID NO: 3301888 - DNA, 20 bp, Homo sapiens
ttaagtagaaaagttgcaga

SEQ ID NO: 3301889 - DNA, 16 bp, Homo sapiens
ttaagtagaacaaaaa

SEQ ID NO: 3301890 - DNA, 19 bp, Homo sapiens
ttaagtagaacaaaaaacc

SEQ ID NO: 3301891 - DNA, 22 bp, Homo sapiens
ttaagtatctgggattattctt

SEQ ID NO: 3301892 - DNA, 19 bp, Homo sapiens
ttaagtatttatatattta

SEQ ID NO: 3301893 - DNA, 21 bp, Homo sapiens
ttaagtcattttcatgtgtgt

SEQ ID NO: 3301894 - DNA, 11 bp, Homo sapiens
ttaagtcccag

SEQ ID NO: 3301895 - DNA, 19 bp, Homo sapiens
ttaagtcccagtatacctc

SEQ ID NO: 3301896 - DNA, 21 bp, Homo sapiens
ttaagtcccagtatacctcat

SEQ ID NO: 3301897 - DNA, 15 bp, Homo sapiens
ttaagtgcctgagac

SEQ ID NO: 3301898 - DNA, 19 bp, Homo sapiens
ttaagtgcgtgtgtagagt

SEQ ID NO: 3301899 - DNA, 16 bp, Homo sapiens
ttaagtggtttgatca

SEQ ID NO: 3301900 - DNA, 17 bp, Homo sapiens
ttaagtgtgcagccata

SEQ ID NO: 3301901 - DNA, 22 bp, Homo sapiens
ttaagtgtgcagccatagtttg

SEQ ID NO: 3301902 - DNA, 22 bp, Homo sapiens
ttaagttatagtgaatactgct

SEQ ID NO: 3301903 - DNA, 18 bp, Homo sapiens
ttaagttggcttctgttt

SEQ ID NO: 3301904 - DNA, 21 bp, Homo sapiens
ttaagttggcttctgtttcta

SEQ ID NO: 3301905 - DNA, 23 bp, Homo sapiens
ttaagttggcttctgtttctagt

SEQ ID NO: 3301906 - DNA, 16 bp, Homo sapiens
ttaagtttcaaactta

SEQ ID NO: 3301907 - DNA, 21 bp, Homo sapiens
ttaataaaaagctttttcctc

SEQ ID NO: 3301908 - DNA, 12 bp, Homo sapiens
ttaataaaacaa

SEQ ID NO: 3301909 - DNA, 20 bp, Homo sapiens
ttaataaaactgcacagtgc

SEQ ID NO: 3301910 - DNA, 22 bp, Homo sapiens
ttaataaaactgcacagtgctg

SEQ ID NO: 3301911 - DNA, 21 bp, Homo sapiens
ttaataaagaattaacagaga

SEQ ID NO: 3301912 - DNA, 16 bp, Homo sapiens
ttaataaagatgagtt

SEQ ID NO: 3301913 - DNA, 16 bp, Homo sapiens
ttaataaagcattctt

SEQ ID NO: 3301914 - DNA, 20 bp, Homo sapiens
ttaataacattaccttactg

SEQ ID NO: 3301915 - DNA, 22 bp, Homo sapiens
ttaatacagtttatttttaaag

SEQ ID NO: 3301916 - DNA, 17 bp, Homo sapiens
ttaatactaccttgaaa

SEQ ID NO: 3301917 - DNA, 19 bp, Homo sapiens
ttaatagaatataattatc

SEQ ID NO: 3301918 - DNA, 15 bp, Homo sapiens
ttaatagcagccttt

SEQ ID NO: 3301919 - DNA, 18 bp, Homo sapiens
ttaatagcttttattgta

SEQ ID NO: 3301920 - DNA, 22 bp, Homo sapiens
ttaatagcttttattgtataaa

SEQ ID NO: 3301921 - DNA, 18 bp, Homo sapiens
ttaatagtttgtctattt

SEQ ID NO: 3301922 - DNA, 22 bp, Homo sapiens
ttaatataaagtagtcctgtga

SEQ ID NO: 3301923 - DNA, 19 bp, Homo sapiens
ttaatatatcccagaaatt

SEQ ID NO: 3301924 - DNA, 19 bp, Homo sapiens
ttaatatatgtattattta

SEQ ID NO: 3301925 - DNA, 15 bp, Homo sapiens
ttaatatattttttg

SEQ ID NO: 3301926 - DNA, 20 bp, Homo sapiens
ttaatatccctacatgtatt

SEQ ID NO: 3301927 - DNA, 18 bp, Homo sapiens
ttaatatctggcactgtt

SEQ ID NO: 3301928 - DNA, 19 bp, Homo sapiens
ttaatatctggcactgtta

SEQ ID NO: 3301929 - DNA, 14 bp, Homo sapiens
ttaatatgaaaact

SEQ ID NO: 3301930 - DNA, 20 bp, Homo sapiens
ttaatatgcttaaaataagc

SEQ ID NO: 3301931 - DNA, 15 bp, Homo sapiens
ttaatattctattaa

SEQ ID NO: 3301932 - DNA, 18 bp, Homo sapiens
ttaatattgatatgctta

SEQ ID NO: 3301933 - DNA, 17 bp, Homo sapiens
ttaatattgatgtcagt

SEQ ID NO: 3301934 - DNA, 21 bp, Homo sapiens
ttaatatttaaacagcagtgt

SEQ ID NO: 3301935 - DNA, 22 bp, Homo sapiens
ttaatatttaaacagcagtgtt

SEQ ID NO: 3301936 - DNA, 16 bp, Homo sapiens
ttaatatttaacatta

SEQ ID NO: 3301937 - DNA, 16 bp, Homo sapiens
ttaatattttgttctt

SEQ ID NO: 3301938 - DNA, 19 bp, Homo sapiens
ttaatattttgttcttatt

SEQ ID NO: 3301939 - DNA, 14 bp, Homo sapiens
ttaatcaagttgaa

SEQ ID NO: 3301940 - DNA, 17 bp, Homo sapiens
ttaatcaccttctttgt

SEQ ID NO: 3301941 - DNA, 17 bp, Homo sapiens
ttaatcatatttgaaaa

SEQ ID NO: 3301942 - DNA, 13 bp, Homo sapiens
ttaatcattttca

SEQ ID NO: 3301943 - DNA, 18 bp, Homo sapiens
ttaatccagttataagaa

SEQ ID NO: 3301944 - DNA, 20 bp, Homo sapiens
ttaatccagttataagaaga

SEQ ID NO: 3301945 - DNA, 21 bp, Homo sapiens
ttaatccagttataagaagaa

SEQ ID NO: 3301946 - DNA, 17 bp, Homo sapiens
ttaatcctgtaccaaat

SEQ ID NO: 3301947 - DNA, 22 bp, Homo sapiens
ttaatcctgtaccaaatctgac

SEQ ID NO: 3301948 - DNA, 15 bp, Homo sapiens
ttaatctctgttatg

SEQ ID NO: 3301949 - DNA, 19 bp, Homo sapiens
ttaatctctgttatgtact

SEQ ID NO: 3301950 - DNA, 23 bp, Homo sapiens
ttaatctctgttatgtactgtac

SEQ ID NO: 3301951 - DNA, 16 bp, Homo sapiens
ttaatcttagtgtatg

SEQ ID NO: 3301952 - DNA, 18 bp, Homo sapiens
ttaatcttcaaagccttc

SEQ ID NO: 3301953 - DNA, 14 bp, Homo sapiens
ttaatctttaataa

SEQ ID NO: 3301954 - DNA, 23 bp, Homo sapiens
ttaatctttctttacctgagacc

SEQ ID NO: 3301955 - DNA, 24 bp, Homo sapiens
ttaatctttctttacctgagacca

SEQ ID NO: 3301956 - DNA, 18 bp, Homo sapiens
ttaatctttgtgacagga

SEQ ID NO: 3301957 - DNA, 20 bp, Homo sapiens
ttcccggtcccgagtacagt

SEQ ID NO: 3301958 - DNA, 14 bp, Homo sapiens
ttcccgtttctcca

SEQ ID NO: 3301959 - DNA, 15 bp, Homo sapiens
ttcccgtttctccac

SEQ ID NO: 3301960 - DNA, 17 bp, Homo sapiens
ttcccgtttctccacct

SEQ ID NO: 3301961 - DNA, 15 bp, Homo sapiens
ttccctaaagtgatg

SEQ ID NO: 3301962 - DNA, 13 bp, Homo sapiens
ttccctacctcag

SEQ ID NO: 3301963 - DNA, 14 bp, Homo sapiens
ttccctacctcagg

SEQ ID NO: 3301964 - DNA, 21 bp, Homo sapiens
ttccctatgaaagattccaca

SEQ ID NO: 3301965 - DNA, 16 bp, Homo sapiens
ttccctctcctgccca

SEQ ID NO: 3301966 - DNA, 11 bp, Homo sapiens
ttccctctcta

SEQ ID NO: 3301967 - DNA, 19 bp, Homo sapiens
ttccctctgctcctggagc

SEQ ID NO: 3301968 - DNA, 14 bp, Homo sapiens
ttccctctggcttc

SEQ ID NO: 3301969 - DNA, 15 bp, Homo sapiens
ttccctcttcccaga

SEQ ID NO: 3301970 - DNA, 19 bp, Homo sapiens
ttccctcttcggtgttctt

SEQ ID NO: 3301971 - DNA, 20 bp, Homo sapiens
ttccctcttcggtgttcttc

SEQ ID NO: 3301972 - DNA, 20 bp, Homo sapiens
ttccctctttcttataatac

SEQ ID NO: 3301973 - DNA, 17 bp, Homo sapiens
ttccctgacttgcttta

SEQ ID NO: 3301974 - DNA, 11 bp, Homo sapiens
ttccctgcacc

SEQ ID NO: 3301975 - DNA, 22 bp, Homo sapiens
ttccctgcactaaagccagcct

SEQ ID NO: 3301976 - DNA, 19 bp, Homo sapiens
ttccctgcgcctgtgatgc

SEQ ID NO: 3301977 - DNA, 13 bp, Homo sapiens
ttccctgctgaat

SEQ ID NO: 3301978 - DNA, 16 bp, Homo sapiens
ttccctgtcagaggct

SEQ ID NO: 3301979 - DNA, 20 bp, Homo sapiens
ttccctgtctcttgaaaaat

SEQ ID NO: 3301980 - DNA, 16 bp, Homo sapiens
ttccctgttctccctt

SEQ ID NO: 3301981 - DNA, 15 bp, Homo sapiens
ttccctgttcttcct

SEQ ID NO: 3301982 - DNA, 16 bp, Homo sapiens
ttccctgttcttcctc

SEQ ID NO: 3301983 - DNA, 22 bp, Homo sapiens
ttcccttcagtaccctctcagc

SEQ ID NO: 3301984 - DNA, 23 bp, Homo sapiens
ttcccttcagtaccctctcagct

SEQ ID NO: 3301985 - DNA, 13 bp, Homo sapiens
ttcccttccactg

SEQ ID NO: 3301986 - DNA, 13 bp, Homo sapiens
ttcccttctctca

SEQ ID NO: 3301987 - DNA, 18 bp, Homo sapiens
ttcccttgccctttccat

SEQ ID NO: 3301988 - DNA, 15 bp, Homo sapiens
ttcccttggcctcag

SEQ ID NO: 3301989 - DNA, 12 bp, Homo sapiens
ttcccttgtatt

SEQ ID NO: 3301990 - DNA, 13 bp, Homo sapiens
ttcccttgtattt

SEQ ID NO: 3301991 - DNA, 17 bp, Homo sapiens
ttcccttgtgtcaagac

SEQ ID NO: 3301992 - DNA, 15 bp, Homo sapiens
ttccctttccccagc

SEQ ID NO: 3301993 - DNA, 15 bp, Homo sapiens
ttccctttgacttca

SEQ ID NO: 3301994 - DNA, 21 bp, Homo sapiens
ttccctttgacttcagctgcc

SEQ ID NO: 3301995 - DNA, 12 bp, Homo sapiens
ttccctttgcca

SEQ ID NO: 3301996 - DNA, 15 bp, Homo sapiens
ttccctttgtgcaca

SEQ ID NO: 3301997 - DNA, 16 bp, Homo sapiens
ttcccttttctgttta

SEQ ID NO: 3301998 - DNA, 23 bp, Homo sapiens
ttccgaagagggaatggatgggg

SEQ ID NO: 3301999 - DNA, 22 bp, Homo sapiens
ttccgacatcccagaccagcca

SEQ ID NO: 3302000 - DNA, 18 bp, Homo sapiens
ttccgaccctctgggaac

SEQ ID NO: 3302001 - DNA, 17 bp, Homo sapiens
ttccgagcattccagta

SEQ ID NO: 3302002 - DNA, 21 bp, Homo sapiens
ttccgcacttcagaattccat

SEQ ID NO: 3302003 - DNA, 19 bp, Homo sapiens
ttccgctttgaaagaagca

SEQ ID NO: 3302004 - DNA, 22 bp, Homo sapiens
ttccgctttgaaagaagcaaga

SEQ ID NO: 3302005 - DNA, 22 bp, Homo sapiens
ttccggatcctaagcatctaag

SEQ ID NO: 3302006 - DNA, 22 bp, Homo sapiens
ttccgggcagaaacaataaaac

SEQ ID NO: 3302007 - DNA, 17 bp, Homo sapiens
ttccggtagggaggcag

SEQ ID NO: 3302008 - DNA, 17 bp, Homo sapiens
ttccgtgaaaacggagc

SEQ ID NO: 3302009 - DNA, 18 bp, Homo sapiens
ttccgtgacgtcactgga

SEQ ID NO: 3302010 - DNA, 20 bp, Homo sapiens
ttccgtggtcagagtgccac

SEQ ID NO: 3302011 - DNA, 23 bp, Homo sapiens
ttccgttaacctttttgtaaata

SEQ ID NO: 3302012 - DNA, 15 bp, Homo sapiens
ttccgtttgcttttg

SEQ ID NO: 3302013 - DNA, 14 bp, Homo sapiens
ttcctaacacagca

SEQ ID NO: 3302014 - DNA, 18 bp, Homo sapiens
ttcctaagaagcttctaa

SEQ ID NO: 3302015 - DNA, 16 bp, Homo sapiens
ttcctacaaagatgtt

SEQ ID NO: 3302016 - DNA, 13 bp, Homo sapiens
ttcctacaactta

SEQ ID NO: 3302017 - DNA, 12 bp, Homo sapiens
ttcctacagccc

SEQ ID NO: 3302018 - DNA, 14 bp, Homo sapiens
ttcctacagcccct

SEQ ID NO: 3302019 - DNA, 17 bp, Homo sapiens
ttcctacccaaccactc

SEQ ID NO: 3302020 - DNA, 18 bp, Homo sapiens
ttcctactgtcctcagag

SEQ ID NO: 3302021 - DNA, 14 bp, Homo sapiens
ttcctagccctctc

SEQ ID NO: 3302022 - DNA, 18 bp, Homo sapiens
ttcctagccctctcacat

SEQ ID NO: 3302023 - DNA, 13 bp, Homo sapiens
ttcctagcctgtt

SEQ ID NO: 3302024 - DNA, 17 bp, Homo sapiens
ttcctaggcccaggcct

SEQ ID NO: 3302025 - DNA, 18 bp, Homo sapiens
ttcctagtgaaccacagg

SEQ ID NO: 3302026 - DNA, 22 bp, Homo sapiens
ttcctagtgaaccacaggtttt

SEQ ID NO: 3302027 - DNA, 24 bp, Homo sapiens
ttcctagtgaaccacaggttttag

SEQ ID NO: 3302028 - DNA, 20 bp, Homo sapiens
ttcctagtggatgactgttg

SEQ ID NO: 3302029 - DNA, 21 bp, Homo sapiens
ttcctagtggatgactgttga

SEQ ID NO: 3302030 - DNA, 15 bp, Homo sapiens
ttcctagttttctcc

SEQ ID NO: 3302031 - DNA, 18 bp, Homo sapiens
ttcctagttttctcctcc

SEQ ID NO: 3302032 - DNA, 20 bp, Homo sapiens
ttcctataacttcttcctgc

SEQ ID NO: 3302033 - DNA, 17 bp, Homo sapiens
ttcctataacttgatgc

SEQ ID NO: 3302034 - DNA, 20 bp, Homo sapiens
ttcctataacttgatgcatg

SEQ ID NO: 3302035 - DNA, 20 bp, Homo sapiens
ttcctatatacctaataccc

SEQ ID NO: 3302036 - DNA, 13 bp, Homo sapiens
ttcctatgatgga

SEQ ID NO: 3302037 - DNA, 23 bp, Homo sapiens
ttcctatgcccaggtaccaccct

SEQ ID NO: 3302038 - DNA, 22 bp, Homo sapiens
ttcctatttgccatgggcttca

SEQ ID NO: 3302039 - DNA, 21 bp, Homo sapiens
ttcctcacagccttggctcct

SEQ ID NO: 3302040 - DNA, 16 bp, Homo sapiens
ttcctcagcttatctc

SEQ ID NO: 3302041 - DNA, 16 bp, Homo sapiens
ttcctcatctttaaaa

SEQ ID NO: 3302042 - DNA, 15 bp, Homo sapiens
ttcctcattttgaat

SEQ ID NO: 3302043 - DNA, 23 bp, Homo sapiens
ttcctccccattagagtcagcct

SEQ ID NO: 3302044 - DNA, 17 bp, Homo sapiens
ttcctccccctgcaact

SEQ ID NO: 3302045 - DNA, 21 bp, Homo sapiens
ttcctccctgtctctgcatct

SEQ ID NO: 3302046 - DNA, 20 bp, Homo sapiens
ttcctccgtccacccaggct

SEQ ID NO: 3302047 - DNA, 22 bp, Homo sapiens
ttcctcctaccttttgtctctt

SEQ ID NO: 3302048 - DNA, 19 bp, Homo sapiens
ttcctcctccacagtgctg

SEQ ID NO: 3302049 - DNA, 14 bp, Homo sapiens
ttcctcctccccac

SEQ ID NO: 3302050 - DNA, 16 bp, Homo sapiens
ttcctcctccccactt

SEQ ID NO: 3302051 - DNA, 12 bp, Homo sapiens
ttcctcctgctg

SEQ ID NO: 3302052 - DNA, 14 bp, Homo sapiens
ttcctcctgctgta

SEQ ID NO: 3302053 - DNA, 14 bp, Homo sapiens
ttcctcctggaaat

SEQ ID NO: 3302054 - DNA, 17 bp, Homo sapiens
ttcctctagaagccaag

SEQ ID NO: 3302055 - DNA, 15 bp, Homo sapiens
ttcctctaggcaagc

SEQ ID NO: 3302056 - DNA, 23 bp, Homo sapiens
ttcctctaggcaagcaggacctg

SEQ ID NO: 3302057 - DNA, 23 bp, Homo sapiens
ttcctctagtgccctccacagcc

SEQ ID NO: 3302058 - DNA, 21 bp, Homo sapiens
ttcctctattgatgtacagtc

SEQ ID NO: 3302059 - DNA, 23 bp, Homo sapiens
ttcctctattgatgtacagtctg

SEQ ID NO: 3302060 - DNA, 17 bp, Homo sapiens
ttcctctcactaaactt

SEQ ID NO: 3302061 - DNA, 16 bp, Homo sapiens
ttcctctcactcctgc

SEQ ID NO: 3302062 - DNA, 17 bp, Homo sapiens
ttcctctcactcctgcc

SEQ ID NO: 3302063 - DNA, 19 bp, Homo sapiens
ttcctctcactcctgcctc

SEQ ID NO: 3302064 - DNA, 13 bp, Homo sapiens
ttcctctccactg

SEQ ID NO: 3302065 - DNA, 14 bp, Homo sapiens
ttcctctccactgc

SEQ ID NO: 3302066 - DNA, 15 bp, Homo sapiens
ttcctctccactgcc

SEQ ID NO: 3302067 - DNA, 16 bp, Homo sapiens
ttcctctccactgcct

SEQ ID NO: 3302068 - DNA, 14 bp, Homo sapiens
ttcctctctccaga

SEQ ID NO: 3302069 - DNA, 11 bp, Homo sapiens
ttcctctctgg

SEQ ID NO: 3302070 - DNA, 21 bp, Homo sapiens
ttcctctgagcccagctgcct

SEQ ID NO: 3302071 - DNA, 11 bp, Homo sapiens
ttcctctgccc

SEQ ID NO: 3302072 - DNA, 13 bp, Homo sapiens
ttcctctgcctgc

SEQ ID NO: 3302073 - DNA, 14 bp, Homo sapiens
ttcctctgcctgcc

SEQ ID NO: 3302074 - DNA, 21 bp, Homo sapiens
ttcctctgtattgtgctgatt

SEQ ID NO: 3302075 - DNA, 13 bp, Homo sapiens
ttcctcttcccca

SEQ ID NO: 3302076 - DNA, 18 bp, Homo sapiens
ttcctcttccccttgccc

SEQ ID NO: 3302077 - DNA, 19 bp, Homo sapiens
ttcctcttccgggcagaaa

SEQ ID NO: 3302078 - DNA, 21 bp, Homo sapiens
ttcctcttttgtgctgcttct

SEQ ID NO: 3302079 - DNA, 17 bp, Homo sapiens
ttcctgaaagaaacagt

SEQ ID NO: 3302080 - DNA, 18 bp, Homo sapiens
ttcctgaaataaacactg

SEQ ID NO: 3302081 - DNA, 14 bp, Homo sapiens
ttcctgaatgaaat

SEQ ID NO: 3302082 - DNA, 16 bp, Homo sapiens
ttcctgaatgaaatat

SEQ ID NO: 3302083 - DNA, 21 bp, Homo sapiens
ttctgagcccgggctgcctgg

SEQ ID NO: 3302084 - DNA, 16 bp, Homo sapiens
ttctgagctatttcat

SEQ ID NO: 3302085 - DNA, 23 bp, Homo sapiens
ttctgagctatttcatctatttt

SEQ ID NO: 3302086 - DNA, 13 bp, Homo sapiens
ttctgagtattct

SEQ ID NO: 3302087 - DNA, 14 bp, Homo sapiens
ttctgagtattctc

SEQ ID NO: 3302088 - DNA, 14 bp, Homo sapiens
ttctgagtgttttt

SEQ ID NO: 3302089 - DNA, 21 bp, Homo sapiens
ttctgagtttatattctgaaa

SEQ ID NO: 3302090 - DNA, 23 bp, Homo sapiens
ttctgagtttcattctcctgcct

SEQ ID NO: 3302091 - DNA, 19 bp, Homo sapiens
ttctgataaaagatggcca

SEQ ID NO: 3302092 - DNA, 13 bp, Homo sapiens
ttctgatcagagg

SEQ ID NO: 3302093 - DNA, 23 bp, Homo sapiens
ttctgatcagaggtgtacactaa

SEQ ID NO: 3302094 - DNA, 13 bp, Homo sapiens
ttctgatgagcaa

SEQ ID NO: 3302095 - DNA, 14 bp, Homo sapiens
ttctgatgagcaac

SEQ ID NO: 3302096 - DNA, 16 bp, Homo sapiens
ttctgatgtctctaaa

SEQ ID NO: 3302097 - DNA, 22 bp, Homo sapiens
ttctgatgtgtgttgtcagcct

SEQ ID NO: 3302098 - DNA, 14 bp, Homo sapiens
ttctgatttcagtt

SEQ ID NO: 3302099 - DNA, 20 bp, Homo sapiens
ttctgatttcagtttttcat

SEQ ID NO: 3302100 - DNA, 19 bp, Homo sapiens
ttctgcaactagccaaggc

SEQ ID NO: 3302101 - DNA, 20 bp, Homo sapiens
ttctgcaactagccaaggct

SEQ ID NO: 3302102 - DNA, 15 bp, Homo sapiens
ttctgcaactgaaat

SEQ ID NO: 3302103 - DNA, 12 bp, Homo sapiens
ttctgcactgaa

SEQ ID NO: 3302104 - DNA, 15 bp, Homo sapiens
ttctgcactgaaaag

SEQ ID NO: 3302105 - DNA, 20 bp, Homo sapiens
ttctgcagaactcctccaaa

SEQ ID NO: 3302106 - DNA, 20 bp, Homo sapiens
ttctgcagacacgccttccc

SEQ ID NO: 3302107 - DNA, 23 bp, Homo sapiens
ttctgcagcatgacctgtgacca

SEQ ID NO: 3302108 - DNA, 23 bp, Homo sapiens
ttctgcatatgttgaatactttt

SEQ ID NO: 3302109 - DNA, 18 bp, Homo sapiens
ttctgcatggattcagca

SEQ ID NO: 3302110 - DNA, 20 bp, Homo sapiens
ttctgcatggattcagcatg

SEQ ID NO: 3302111 - DNA, 23 bp, Homo sapiens
ttctgccaggcaacttttaaagc

SEQ ID NO: 3302112 - DNA, 19 bp, Homo sapiens
ttctgccatctagccagcc

SEQ ID NO: 3302113 - DNA, 19 bp, Homo sapiens
ttctgcccaaaaatatggt

SEQ ID NO: 3302114 - DNA, 19 bp, Homo sapiens
ttctgccctggctgctgcc

SEQ ID NO: 3302115 - DNA, 21 bp, Homo sapiens
ttctgccgccccctcctgaac

SEQ ID NO: 3302116 - DNA, 20 bp, Homo sapiens
ttctgcctagagtgtagcct

SEQ ID NO: 3302117 - DNA, 18 bp, Homo sapiens
ttctgcctgcccaggccc

SEQ ID NO: 3302118 - DNA, 13 bp, Homo sapiens
ttctgcctgttat

SEQ ID NO: 3302119 - DNA, 20 bp, Homo sapiens
ttctgcctgttataactctg

SEQ ID NO: 3302120 - DNA, 21 bp, Homo sapiens
ttctgcctgttataactctgc

SEQ ID NO: 3302121 - DNA, 24 bp, Homo sapiens
ttctgcctgttataactctgcact

SEQ ID NO: 3302122 - DNA, 15 bp, Homo sapiens
ttctgctccaccctt

SEQ ID NO: 3302123 - DNA, 17 bp, Homo sapiens
ttctgctccacccttgg

SEQ ID NO: 3302124 - DNA, 18 bp, Homo sapiens
ttctgctccacccttggc

SEQ ID NO: 3302125 - DNA, 11 bp, Homo sapiens
ttctgctcctc

SEQ ID NO: 3302126 - DNA, 15 bp, Homo sapiens
ttctgctcctctcca

SEQ ID NO: 3302127 - DNA, 18 bp, Homo sapiens
ttctgctcctctccaggc

SEQ ID NO: 3302128 - DNA, 14 bp, Homo sapiens
ttctgctctggaat

SEQ ID NO: 3302129 - DNA, 23 bp, Homo sapiens
ttctgctctggaataaagttgca

SEQ ID NO: 3302130 - DNA, 17 bp, Homo sapiens
ttctgctctggttgttt

SEQ ID NO: 3302131 - DNA, 16 bp, Homo sapiens
ttctgctgcccaggcc

SEQ ID NO: 3302132 - DNA, 20 bp, Homo sapiens
ttctgctgcccaggccacag

SEQ ID NO: 3302133 - DNA, 13 bp, Homo sapiens
ttctgctggataa

SEQ ID NO: 3302134 - DNA, 12 bp, Homo sapiens
ttctgctggcct

SEQ ID NO: 3302135 - DNA, 13 bp, Homo sapiens
ttctgctggcctg

SEQ ID NO: 3302136 - DNA, 13 bp, Homo sapiens
ttctgcttttctg

SEQ ID NO: 3302137 - DNA, 22 bp, Homo sapiens
ttctggaagggcagcatataaa

SEQ ID NO: 3302138 - DNA, 17 bp, Homo sapiens
ttctggaatttgttcaa

SEQ ID NO: 3302139 - DNA, 10 bp, Homo sapiens
ttctggagcc

SEQ ID NO: 3302140 - DNA, 13 bp, Homo sapiens
ttctggagccctt

SEQ ID NO: 3302141 - DNA, 14 bp, Homo sapiens
ttctggcctgcctt

SEQ ID NO: 3302142 - DNA, 20 bp, Homo sapiens
ttctggcctgccttcgttaa

SEQ ID NO: 3302143 - DNA, 17 bp, Homo sapiens
ttctggcctttcctctc

SEQ ID NO: 3302144 - DNA, 17 bp, Homo sapiens
ttctggctcctcaaaca

SEQ ID NO: 3302145 - DNA, 19 bp, Homo sapiens
ttctggctgaacactggca

SEQ ID NO: 3302146 - DNA, 22 bp, Homo sapiens
ttctgggagcagaaacagccat

SEQ ID NO: 3302147 - DNA, 22 bp, Homo sapiens
ttctgggctgcgggaggccctg

SEQ ID NO: 3302148 - DNA, 23 bp, Homo sapiens
ttctgggctgcgggaggccctgg

SEQ ID NO: 3302149 - DNA, 20 bp, Homo sapiens
ttctggggcaggctgggcca

SEQ ID NO: 3302150 - DNA, 21 bp, Homo sapiens
ttctggggcaggctgggccat

SEQ ID NO: 3302151 - DNA, 15 bp, Homo sapiens
ttctggggcccagga

SEQ ID NO: 3302152 - DNA, 18 bp, Homo sapiens
ttctgggtggcctcggga

SEQ ID NO: 3302153 - DNA, 13 bp, Homo sapiens
ttctgggtgtcca

SEQ ID NO: 3302154 - DNA, 19 bp, Homo sapiens
ttctggtagatagaaataa

SEQ ID NO: 3302155 - DNA, 15 bp, Homo sapiens
ttctggtatcttgtt

SEQ ID NO: 3302156 - DNA, 14 bp, Homo sapiens
ttctggtccttttt

SEQ ID NO: 3302157 - DNA, 16 bp, Homo sapiens
ttctggtcctttttgg

SEQ ID NO: 3302158 - DNA, 20 bp, Homo sapiens
ttctggtgctactccatgca

SEQ ID NO: 3302159 - DNA, 22 bp, Homo sapiens
ttctggtgctactccatgcagg

SEQ ID NO: 3302160 - DNA, 19 bp, Homo sapiens
ttctggtggggtgtgttcc

SEQ ID NO: 3302161 - DNA, 14 bp, Homo sapiens
ttctggttctaaca

SEQ ID NO: 3302162 - DNA, 13 bp, Homo sapiens
ttctggttgtatt

SEQ ID NO: 3302163 - DNA, 23 bp, Homo sapiens
ttctgtaaactcaaaacttaaca

SEQ ID NO: 3302164 - DNA, 13 bp, Homo sapiens
ttctgtagattct

SEQ ID NO: 3302165 - DNA, 21 bp, Homo sapiens
ttctgtagtactccttaagaa

SEQ ID NO: 3302166 - DNA, 13 bp, Homo sapiens
ttctgtatacaac

SEQ ID NO: 3302167 - DNA, 16 bp, Homo sapiens
ttctgtatatactttt

SEQ ID NO: 3302168 - DNA, 17 bp, Homo sapiens
ttctgtatatacttttt

SEQ ID NO: 3302169 - DNA, 14 bp, Homo sapiens
ttctgtcaagaaga

SEQ ID NO: 3302170 - DNA, 16 bp, Homo sapiens
ttctgtcagatgagaa

SEQ ID NO: 3302171 - DNA, 18 bp, Homo sapiens
ttctgtcagatgagaaca

SEQ ID NO: 3302172 - DNA, 19 bp, Homo sapiens
ttctgtcagatgagaacaa

SEQ ID NO: 3302173 - DNA, 22 bp, Homo sapiens
ttctgtccccagccctgtcctg

SEQ ID NO: 3302174 - DNA, 20 bp, Homo sapiens
ttctgtcctcttctctgcat

SEQ ID NO: 3302175 - DNA, 20 bp, Homo sapiens
ttctgtgaaatataattgta

SEQ ID NO: 3302176 - DNA, 13 bp, Homo sapiens
ttctgtgaagagg

SEQ ID NO: 3302177 - DNA, 15 bp, Homo sapiens
ttctgtgacccatct

SEQ ID NO: 3302178 - DNA, 13 bp, Homo sapiens
ttctgtgcctgaa

SEQ ID NO: 3302179 - DNA, 12 bp, Homo sapiens
ttctgtggctca

SEQ ID NO: 3302180 - DNA, 16 bp, Homo sapiens
ttctgtggctcacaga

SEQ ID NO: 3302181 - DNA, 20 bp, Homo sapiens
ttctgtggtccctctgtgtc

SEQ ID NO: 3302182 - DNA, 16 bp, Homo sapiens
ttctgtggttcctctg

SEQ ID NO: 3302183 - DNA, 22 bp, Homo sapiens
ttctgtggtttcatgttagtta

SEQ ID NO: 3302184 - DNA, 15 bp, Homo sapiens
ttctgtgtacatttt

SEQ ID NO: 3302185 - DNA, 15 bp, Homo sapiens
ttctgtgtacttttt

SEQ ID NO: 3302186 - DNA, 17 bp, Homo sapiens
ttctgtgtatttaattg

SEQ ID NO: 3302187 - DNA, 15 bp, Homo sapiens
ttctgtgttcatttt

SEQ ID NO: 3302188 - DNA, 13 bp, Homo sapiens
ttctgttccaaat

SEQ ID NO: 3302189 - DNA, 17 bp, Homo sapiens
ttctgttccaaattcag

SEQ ID NO: 3302190 - DNA, 13 bp, Homo sapiens
ttctgttctagtt

SEQ ID NO: 3302191 - DNA, 13 bp, Homo sapiens
ttctgttctcatt

SEQ ID NO: 3302192 - DNA, 16 bp, Homo sapiens
ttctgttctggaggaa

SEQ ID NO: 3302193 - DNA, 11 bp, Homo sapiens
ttctgttgtaa

SEQ ID NO: 3302194 - DNA, 14 bp, Homo sapiens
ttctgttgtaactt

SEQ ID NO: 3302195 - DNA, 23 bp, Homo sapiens
ttctgtttcaaggcactctagat

SEQ ID NO: 3302196 - DNA, 15 bp, Homo sapiens
ttctgtttctagttg

SEQ ID NO: 3302197 - DNA, 13 bp, Homo sapiens
ttctgtttggcac

SEQ ID NO: 3302198 - DNA, 14 bp, Homo sapiens
ttctgtttggcact

SEQ ID NO: 3302199 - DNA, 18 bp, Homo sapiens
ttctgtttggcacttgta

SEQ ID NO: 3302200 - DNA, 19 bp, Homo sapiens
ttctgtttggcacttgtat

SEQ ID NO: 3302201 - DNA, 21 bp, Homo sapiens
ttctgtttggcacttgtattt

SEQ ID NO: 3302202 - DNA, 14 bp, Homo sapiens
ttcttaaaaaggaa

SEQ ID NO: 3302203 - DNA, 14 bp, Homo sapiens
ttcttaaaagtact

SEQ ID NO: 3302204 - DNA, 15 bp, Homo sapiens
ttcttaaaagtactt

SEQ ID NO: 3302205 - DNA, 18 bp, Homo sapiens
ttcttaaaagtactttaa

SEQ ID NO: 3302206 - DNA, 19 bp, Homo sapiens
ttcttaaaagtactttaaa

SEQ ID NO: 3302207 - DNA, 15 bp, Homo sapiens
ttcttaaaatatatt

SEQ ID NO: 3302208 - DNA, 21 bp, Homo sapiens
ttcttaaaatatatttcagat

SEQ ID NO: 3302209 - DNA, 23 bp, Homo sapiens
ttgatgaagcaaggaagatatac

SEQ ID NO: 3302210 - DNA, 20 bp, Homo sapiens
ttgatgaccaaagtcctttt

SEQ ID NO: 3302211 - DNA, 17 bp, Homo sapiens
ttgatgacccccaacca

SEQ ID NO: 3302212 - DNA, 20 bp, Homo sapiens
ttgatgagatattaaattct

SEQ ID NO: 3302213 - DNA, 20 bp, Homo sapiens
ttgatgagttaactgtgaaa

SEQ ID NO: 3302214 - DNA, 18 bp, Homo sapiens
ttgatgataacacttaaa

SEQ ID NO: 3302215 - DNA, 16 bp, Homo sapiens
ttgatgatctttgcag

SEQ ID NO: 3302216 - DNA, 18 bp, Homo sapiens
ttgatgcaggcacttatt

SEQ ID NO: 3302217 - DNA, 16 bp, Homo sapiens
ttgatgcatgctattc

SEQ ID NO: 3302218 - DNA, 17 bp, Homo sapiens
ttgatgctatttatgca

SEQ ID NO: 3302219 - DNA, 15 bp, Homo sapiens
ttgatgctggagagg

SEQ ID NO: 3302220 - DNA, 15 bp, Homo sapiens
ttgatggaaaataaa

SEQ ID NO: 3302221 - DNA, 13 bp, Homo sapiens
ttgatgggttcta

SEQ ID NO: 3302222 - DNA, 16 bp, Homo sapiens
ttgatgtacagatttt

SEQ ID NO: 3302223 - DNA, 15 bp, Homo sapiens
ttgatgtatctgagt

SEQ ID NO: 3302224 - DNA, 23 bp, Homo sapiens
ttgatgtgaagataatttgcata

SEQ ID NO: 3302225 - DNA, 23 bp, Homo sapiens
ttgatgttaacaagaggggaaaa

SEQ ID NO: 3302226 - DNA, 13 bp, Homo sapiens
ttgatgtttgtgg

SEQ ID NO: 3302227 - DNA, 15 bp, Homo sapiens
ttgatgtttgtggcc

SEQ ID NO: 3302228 - DNA, 18 bp, Homo sapiens
ttgatgtttgtggcctca

SEQ ID NO: 3302229 - DNA, 19 bp, Homo sapiens
ttgatgtttgtggcctcag

SEQ ID NO: 3302230 - DNA, 16 bp, Homo sapiens
ttgattaacaaatatg

SEQ ID NO: 3302231 - DNA, 16 bp, Homo sapiens
ttgattaagattttac

SEQ ID NO: 3302232 - DNA, 17 bp, Homo sapiens
ttgattaagcttttgtc

SEQ ID NO: 3302233 - DNA, 12 bp, Homo sapiens
ttgattattctg

SEQ ID NO: 3302234 - DNA, 23 bp, Homo sapiens
ttgattattttttttttcttctt

SEQ ID NO: 3302235 - DNA, 14 bp, Homo sapiens
ttgattcagcctgt

SEQ ID NO: 3302236 - DNA, 19 bp, Homo sapiens
ttgattcatagtaacttct

SEQ ID NO: 3302237 - DNA, 12 bp, Homo sapiens
ttgattcttcct

SEQ ID NO: 3302238 - DNA, 15 bp, Homo sapiens
ttgattgtcagctac

SEQ ID NO: 3302239 - DNA, 17 bp, Homo sapiens
ttgattgtcagctacta

SEQ ID NO: 3302240 - DNA, 21 bp, Homo sapiens
ttgattgtcagctactaatga

SEQ ID NO: 3302241 - DNA, 11 bp, Homo sapiens
ttgatttacag

SEQ ID NO: 3302242 - DNA, 19 bp, Homo sapiens
ttgatttatgcatggaaac

SEQ ID NO: 3302243 - DNA, 14 bp, Homo sapiens
ttgatttcaaagtt

SEQ ID NO: 3302244 - DNA, 12 bp, Homo sapiens
ttgatttcaaca

SEQ ID NO: 3302245 - DNA, 19 bp, Homo sapiens
ttgatttccatcttaatgt

SEQ ID NO: 3302246 - DNA, 18 bp, Homo sapiens
ttgatttgaagaacatgt

SEQ ID NO: 3302247 - DNA, 18 bp, Homo sapiens
ttgatttgatgtgacttt

SEQ ID NO: 3302248 - DNA, 12 bp, Homo sapiens
ttgatttgcatg

SEQ ID NO: 3302249 - DNA, 13 bp, Homo sapiens
ttgatttgcattg

SEQ ID NO: 3302250 - DNA, 15 bp, Homo sapiens
ttgatttgcattgaa

SEQ ID NO: 3302251 - DNA, 16 bp, Homo sapiens
ttgattttctgttgta

SEQ ID NO: 3302252 - DNA, 14 bp, Homo sapiens
ttgatttttctctt

SEQ ID NO: 3302253 - DNA, 16 bp, Homo sapiens
ttgcaaaatttccagt

SEQ ID NO: 3302254 - DNA, 17 bp, Homo sapiens
ttgcaaatataaacatc

SEQ ID NO: 3302255 - DNA, 16 bp, Homo sapiens
ttgcaaatcagtgttt

SEQ ID NO: 3302256 - DNA, 16 bp, Homo sapiens
ttgcaaatcttgaaat

SEQ ID NO: 3302257 - DNA, 14 bp, Homo sapiens
ttgcaacaggctgg

SEQ ID NO: 3302258 - DNA, 17 bp, Homo sapiens
ttgcaacaggctgggct

SEQ ID NO: 3302259 - DNA, 14 bp, Homo sapiens
ttgcaaccgtctgt

SEQ ID NO: 3302260 - DNA, 23 bp, Homo sapiens
ttgcaacttcagttttatttttg

SEQ ID NO: 3302261 - DNA, 12 bp, Homo sapiens
ttgcaacttcat

SEQ ID NO: 3302262 - DNA, 20 bp, Homo sapiens
ttgcaatagcagttataaca

SEQ ID NO: 3302263 - DNA, 17 bp, Homo sapiens
ttgcaatggcagccttg

SEQ ID NO: 3302264 - DNA, 19 bp, Homo sapiens
ttgcaatggcagccttggc

SEQ ID NO: 3302265 - DNA, 19 bp, Homo sapiens
ttgcaatggctatatggca

SEQ ID NO: 3302266 - DNA, 15 bp, Homo sapiens
ttgcacatcttggct

SEQ ID NO: 3302267 - DNA, 13 bp, Homo sapiens
ttgcacccctcac

SEQ ID NO: 3302268 - DNA, 24 bp, Homo sapiens
ttgcacccctcactctggcctcag

SEQ ID NO: 3302269 - DNA, 14 bp, Homo sapiens
ttgcacccctccca

SEQ ID NO: 3302270 - DNA, 17 bp, Homo sapiens
ttgcacctacctcacag

SEQ ID NO: 3302271 - DNA, 18 bp, Homo sapiens
ttgcactcagcttttttc

SEQ ID NO: 3302272 - DNA, 17 bp, Homo sapiens
ttgcactccttccctaa

SEQ ID NO: 3302273 - DNA, 15 bp, Homo sapiens
ttgcactgaagtttt

SEQ ID NO: 3302274 - DNA, 18 bp, Homo sapiens
ttgcactgaagtttttga

SEQ ID NO: 3302275 - DNA, 15 bp, Homo sapiens
ttgcacttaatggct

SEQ ID NO: 3302276 - DNA, 22 bp, Homo sapiens
ttgcacttatatagcacctttc

SEQ ID NO: 3302277 - DNA, 20 bp, Homo sapiens
ttgcacttgtgattatttat

SEQ ID NO: 3302278 - DNA, 16 bp, Homo sapiens
ttgcagaaaattctgt

SEQ ID NO: 3302279 - DNA, 22 bp, Homo sapiens
ttgcagaaacattttgtggtca

SEQ ID NO: 3302280 - DNA, 11 bp, Homo sapiens
ttgcagaactg

SEQ ID NO: 3302281 - DNA, 16 bp, Homo sapiens
ttgcagaactgccatt

SEQ ID NO: 3302282 - DNA, 16 bp, Homo sapiens
ttgcagaactgtagct

SEQ ID NO: 3302283 - DNA, 16 bp, Homo sapiens
ttgcagacaggcaagc

SEQ ID NO: 3302284 - DNA, 22 bp, Homo sapiens
ttgcagacgggcaagaagctgc

SEQ ID NO: 3302285 - DNA, 15 bp, Homo sapiens
ttgcagatgtattga

SEQ ID NO: 3302286 - DNA, 14 bp, Homo sapiens
ttgcagcagtgagt

SEQ ID NO: 3302287 - DNA, 18 bp, Homo sapiens
ttgcaggagacattttca

SEQ ID NO: 3302288 - DNA, 22 bp, Homo sapiens
ttgcaggagcgtgaaggactta

SEQ ID NO: 3302289 - DNA, 18 bp, Homo sapiens
ttgcaggctctgggctca

SEQ ID NO: 3302290 - DNA, 13 bp, Homo sapiens
ttgcagggcagcc

SEQ ID NO: 3302291 - DNA, 17 bp, Homo sapiens
ttgcaggggtccctgct

SEQ ID NO: 3302292 - DNA, 13 bp, Homo sapiens
ttgcagtaactgt

SEQ ID NO: 3302293 - DNA, 20 bp, Homo sapiens
ttgcagtagagtcatctcca

SEQ ID NO: 3302294 - DNA, 21 bp, Homo sapiens
ttgcagttggactctcaggga

SEQ ID NO: 3302295 - DNA, 22 bp, Homo sapiens
ttgcataagattaaaggaagga

SEQ ID NO: 3302296 - DNA, 23 bp, Homo sapiens
ttgcataagattaaaggaaggaa

SEQ ID NO: 3302297 - DNA, 14 bp, Homo sapiens
ttgcataatgcaat

SEQ ID NO: 3302298 - DNA, 15 bp, Homo sapiens
ttgcataatgcaatc

SEQ ID NO: 3302299 - DNA, 16 bp, Homo sapiens
ttgcatactgagccaa

SEQ ID NO: 3302300 - DNA, 21 bp, Homo sapiens
ttgcatactttgtattttgat

SEQ ID NO: 3302301 - DNA, 15 bp, Homo sapiens
ttgcatagctctcct

SEQ ID NO: 3302302 - DNA, 19 bp, Homo sapiens
ttgcataggctcttaagca

SEQ ID NO: 3302303 - DNA, 20 bp, Homo sapiens
ttgcatcacctctgtaattt

SEQ ID NO: 3302304 - DNA, 15 bp, Homo sapiens
ttgcatcagtattaa

SEQ ID NO: 3302305 - DNA, 23 bp, Homo sapiens
ttgcatcagtattaatactaaaa

SEQ ID NO: 3302306 - DNA, 18 bp, Homo sapiens
ttgcatccaactccagga

SEQ ID NO: 3302307 - DNA, 18 bp, Homo sapiens
ttgcatccttcctataac

SEQ ID NO: 3302308 - DNA, 20 bp, Homo sapiens
ttgcatctaggtaattttta

SEQ ID NO: 3302309 - DNA, 17 bp, Homo sapiens
ttgcatgatatcttcaa

SEQ ID NO: 3302310 - DNA, 11 bp, Homo sapiens
ttgcatgcatg

SEQ ID NO: 3302311 - DNA, 15 bp, Homo sapiens
ttgcatgcatgcaaa

SEQ ID NO: 3302312 - DNA, 17 bp, Homo sapiens
ttgcatggattttggat

SEQ ID NO: 3302313 - DNA, 19 bp, Homo sapiens
ttgcatggctccagaaatg

SEQ ID NO: 3302314 - DNA, 21 bp, Homo sapiens
ttgcattaaattcacaaactt

SEQ ID NO: 3302315 - DNA, 14 bp, Homo sapiens
ttgcattgaatata

SEQ ID NO: 3302316 - DNA, 17 bp, Homo sapiens
ttgcattgaatatatta

SEQ ID NO: 3302317 - DNA, 22 bp, Homo sapiens
ttgcattgaggaaatattaatt

SEQ ID NO: 3302318 - DNA, 15 bp, Homo sapiens
ttgcattgtatgaaa

SEQ ID NO: 3302319 - DNA, 15 bp, Homo sapiens
ttgcatttaaaacag

SEQ ID NO: 3302320 - DNA, 20 bp, Homo sapiens
ttgcatttaaaacagacact

SEQ ID NO: 3302321 - DNA, 22 bp, Homo sapiens
ttgcatttaaaacagacactgg

SEQ ID NO: 3302322 - DNA, 15 bp, Homo sapiens
ttgcatttggtcaag

SEQ ID NO: 3302323 - DNA, 17 bp, Homo sapiens
ttgccaaaaaaaaaaga

SEQ ID NO: 3302324 - DNA, 18 bp, Homo sapiens
ttgccaaaaaaaaaagaa

SEQ ID NO: 3302325 - DNA, 23 bp, Homo sapiens
ttgccaaaataccagagccttca

SEQ ID NO: 3302326 - DNA, 13 bp, Homo sapiens
ttgccaaaatcct

SEQ ID NO: 3302327 - DNA, 13 bp, Homo sapiens
ttgccaaaattca

SEQ ID NO: 3302328 - DNA, 19 bp, Homo sapiens
ttgccaaaattcatttcta

SEQ ID NO: 3302329 - DNA, 16 bp, Homo sapiens
ttgccaaagtacagaa

SEQ ID NO: 3302330 - DNA, 21 bp, Homo sapiens
ttgccaaagtacagaatttga

SEQ ID NO: 3302331 - DNA, 22 bp, Homo sapiens
ttgccaaagttttgctgtctct

SEQ ID NO: 3302332 - DNA, 16 bp, Homo sapiens
ttgccaaatatgtcct

SEQ ID NO: 3302333 - DNA, 17 bp, Homo sapiens
ttgccaaatatgtcctg

SEQ ID NO: 3302334 - DNA, 15 bp, Homo sapiens
ttgccaaatctggct

SEQ ID NO: 3302335 - DNA, 19 bp, Homo sapiens
ttggtttgggggcgccctc

SEQ ID NO: 3302336 - DNA, 12 bp, Homo sapiens
ttggtttgtatg

SEQ ID NO: 3302337 - DNA, 20 bp, Homo sapiens
ttggtttgttaattcttatt

SEQ ID NO: 3302338 - DNA, 14 bp, Homo sapiens
ttggttttaaaagc

SEQ ID NO: 3302339 - DNA, 17 bp, Homo sapiens
ttggttttcctgtggca

SEQ ID NO: 3302340 - DNA, 21 bp, Homo sapiens
ttgtaaaaacagcattgcttt

SEQ ID NO: 3302341 - DNA, 23 bp, Homo sapiens
ttgtaaaaacagcattgctttct

SEQ ID NO: 3302342 - DNA, 22 bp, Homo sapiens
ttgtaaaaatcttttgaagcat

SEQ ID NO: 3302343 - DNA, 14 bp, Homo sapiens
ttgtaaaactacac

SEQ ID NO: 3302344 - DNA, 20 bp, Homo sapiens
ttgtaaaccattgtaactat

SEQ ID NO: 3302345 - DNA, 16 bp, Homo sapiens
ttgtaaacgtttcagt

SEQ ID NO: 3302346 - DNA, 22 bp, Homo sapiens
ttgtaaactcaaaatatttgta

SEQ ID NO: 3302347 - DNA, 15 bp, Homo sapiens
ttgtaaactgtacta

SEQ ID NO: 3302348 - DNA, 14 bp, Homo sapiens
ttgtaaacttctga

SEQ ID NO: 3302349 - DNA, 18 bp, Homo sapiens
ttgtaaagaaatttacta

SEQ ID NO: 3302350 - DNA, 20 bp, Homo sapiens
ttgtaaagaaatttactata

SEQ ID NO: 3302351 - DNA, 12 bp, Homo sapiens
ttgtaaatattt

SEQ ID NO: 3302352 - DNA, 16 bp, Homo sapiens
ttgtaaatatttatgt

SEQ ID NO: 3302353 - DNA, 21 bp, Homo sapiens
ttgtaaattaaacataaaaca

SEQ ID NO: 3302354 - DNA, 23 bp, Homo sapiens
ttgtaaattaatacttcatttgg

SEQ ID NO: 3302355 - DNA, 17 bp, Homo sapiens
ttgtaaccagtgcagaa

SEQ ID NO: 3302356 - DNA, 19 bp, Homo sapiens
ttgtaacctcagctctggg

SEQ ID NO: 3302357 - DNA, 17 bp, Homo sapiens
ttgtaacctgcattttt

SEQ ID NO: 3302358 - DNA, 22 bp, Homo sapiens
ttgtaactacaaagctttgcta

SEQ ID NO: 3302359 - DNA, 23 bp, Homo sapiens
ttgtaactacaaagctttgctac

SEQ ID NO: 3302360 - DNA, 20 bp, Homo sapiens
ttgtaactattaaccttttt

SEQ ID NO: 3302361 - DNA, 13 bp, Homo sapiens
ttgtaacttatgt

SEQ ID NO: 3302362 - DNA, 18 bp, Homo sapiens
ttgtaacttatgtagata

SEQ ID NO: 3302363 - DNA, 18 bp, Homo sapiens
ttgtaagacaaaggtttt

SEQ ID NO: 3302364 - DNA, 15 bp, Homo sapiens
ttgtaagagtgtaga

SEQ ID NO: 3302365 - DNA, 19 bp, Homo sapiens
ttgtaagagtgtagaagca

SEQ ID NO: 3302366 - DNA, 13 bp, Homo sapiens
ttgtaagatgctg

SEQ ID NO: 3302367 - DNA, 22 bp, Homo sapiens
ttgtaaggatataaaaagtaca

SEQ ID NO: 3302368 - DNA, 12 bp, Homo sapiens
ttgtaagtcatc

SEQ ID NO: 3302369 - DNA, 21 bp, Homo sapiens
ttgtaagttgtacaaatgtat

SEQ ID NO: 3302370 - DNA, 19 bp, Homo sapiens
ttgtaagtttcaggtgaca

SEQ ID NO: 3302371 - DNA, 14 bp, Homo sapiens
ttgtaatcactccc

SEQ ID NO: 3302372 - DNA, 22 bp, Homo sapiens
ttgtaatgcactgtttttaatc

SEQ ID NO: 3302373 - DNA, 14 bp, Homo sapiens
ttgtaatgctgcac

SEQ ID NO: 3302374 - DNA, 14 bp, Homo sapiens
ttgtaatgtgaaaa

SEQ ID NO: 3302375 - DNA, 15 bp, Homo sapiens
ttgtaatgttactga

SEQ ID NO: 3302376 - DNA, 17 bp, Homo sapiens
ttgtaattgcttacatt

SEQ ID NO: 3302377 - DNA, 22 bp, Homo sapiens
ttgtaatttaaacaggcccagc

SEQ ID NO: 3302378 - DNA, 23 bp, Homo sapiens
ttgtacaaaataaacaaataaca

SEQ ID NO: 3302379 - DNA, 20 bp, Homo sapiens
ttgtacaaaattaagcaaat

SEQ ID NO: 3302380 - DNA, 20 bp, Homo sapiens
ttgtacaaagattagtttca

SEQ ID NO: 3302381 - DNA, 17 bp, Homo sapiens
ttgtacaaagttttcct

SEQ ID NO: 3302382 - DNA, 19 bp, Homo sapiens
ttgtacaaagttttccttt

SEQ ID NO: 3302383 - DNA, 11 bp, Homo sapiens
ttgtacaaatg

SEQ ID NO: 3302384 - DNA, 13 bp, Homo sapiens
ttgtacaaatgta

SEQ ID NO: 3302385 - DNA, 20 bp, Homo sapiens
ttgtacaaatgtaagcaaag

SEQ ID NO: 3302386 - DNA, 16 bp, Homo sapiens
ttgtacaaatgtattt

SEQ ID NO: 3302387 - DNA, 19 bp, Homo sapiens
ttgtacaaatgtattttga

SEQ ID NO: 3302388 - DNA, 19 bp, Homo sapiens
ttgtacaattaagttacaa

SEQ ID NO: 3302389 - DNA, 19 bp, Homo sapiens
ttgtacaattactaaattg

SEQ ID NO: 3302390 - DNA, 22 bp, Homo sapiens
ttgtacagaatatttctattga

SEQ ID NO: 3302391 - DNA, 16 bp, Homo sapiens
ttgtacagctgtttaa

SEQ ID NO: 3302392 - DNA, 15 bp, Homo sapiens
ttgtacagtttgctg

SEQ ID NO: 3302393 - DNA, 16 bp, Homo sapiens
ttgtacagtttgctgt

SEQ ID NO: 3302394 - DNA, 20 bp, Homo sapiens
ttgtacagtttgctgtacta

SEQ ID NO: 3302395 - DNA, 15 bp, Homo sapiens
ttgtacatattgtta

SEQ ID NO: 3302396 - DNA, 15 bp, Homo sapiens
ttgtaccattttcta

SEQ ID NO: 3302397 - DNA, 15 bp, Homo sapiens
ttgtaccccccaacc

SEQ ID NO: 3302398 - DNA, 15 bp, Homo sapiens
ttgtacttaaatggt

SEQ ID NO: 3302399 - DNA, 17 bp, Homo sapiens
ttgtacttctgtgttca

SEQ ID NO: 3302400 - DNA, 19 bp, Homo sapiens
ttgtacttctgtgttcatt

SEQ ID NO: 3302401 - DNA, 15 bp, Homo sapiens
ttgtactttatcatg

SEQ ID NO: 3302402 - DNA, 22 bp, Homo sapiens
ttgtagaaacacagttttgaaa

SEQ ID NO: 3302403 - DNA, 18 bp, Homo sapiens
ttgtagactgatgtttta

SEQ ID NO: 3302404 - DNA, 20 bp, Homo sapiens
ttgtagactgatgttttagc

SEQ ID NO: 3302405 - DNA, 16 bp, Homo sapiens
ttgtagcactgagggt

SEQ ID NO: 3302406 - DNA, 22 bp, Homo sapiens
ttgtagcataactgtagctcaa

SEQ ID NO: 3302407 - DNA, 20 bp, Homo sapiens
ttgtaggagctgaggtttca

SEQ ID NO: 3302408 - DNA, 17 bp, Homo sapiens
ttgtaggataagtgaaa

SEQ ID NO: 3302409 - DNA, 23 bp, Homo sapiens
ttgtagttaatttattaagtctg

SEQ ID NO: 3302410 - DNA, 13 bp, Homo sapiens
ttgtagtttacct

SEQ ID NO: 3302411 - DNA, 12 bp, Homo sapiens
ttgtataaaata

SEQ ID NO: 3302412 - DNA, 19 bp, Homo sapiens
ttgtataaatgtatataca

SEQ ID NO: 3302413 - DNA, 16 bp, Homo sapiens
ttgtataagtcaagca

SEQ ID NO: 3302414 - DNA, 15 bp, Homo sapiens
ttgtataatattgaa

SEQ ID NO: 3302415 - DNA, 22 bp, Homo sapiens
ttgtataatttcgagatttgta

SEQ ID NO: 3302416 - DNA, 16 bp, Homo sapiens
ttgtatacaaatatat

SEQ ID NO: 3302417 - DNA, 19 bp, Homo sapiens
ttgtatacatcctgggtaa

SEQ ID NO: 3302418 - DNA, 13 bp, Homo sapiens
ttgtatatacagt

SEQ ID NO: 3302419 - DNA, 16 bp, Homo sapiens
ttgtatatacagttat

SEQ ID NO: 3302420 - DNA, 18 bp, Homo sapiens
ttgtatattatggaagat

SEQ ID NO: 3302421 - DNA, 20 bp, Homo sapiens
ttgtatattatggaagattt

SEQ ID NO: 3302422 - DNA, 16 bp, Homo sapiens
ttgtatattgtcagat

SEQ ID NO: 3302423 - DNA, 19 bp, Homo sapiens
ttgtatattgtcagatatt

SEQ ID NO: 3302424 - DNA, 20 bp, Homo sapiens
ttgtatattgtggatgtgtt

SEQ ID NO: 3302425 - DNA, 21 bp, Homo sapiens
ttgtatattgtggatgtgttc

SEQ ID NO: 3302426 - DNA, 16 bp, Homo sapiens
ttgtatatttgtacaa

SEQ ID NO: 3302427 - DNA, 18 bp, Homo sapiens
ttgtatatttgtacaaaa

SEQ ID NO: 3302428 - DNA, 13 bp, Homo sapiens
ttgtatctagtgc

SEQ ID NO: 3302429 - DNA, 17 bp, Homo sapiens
ttgtatctagtgcagct

SEQ ID NO: 3302430 - DNA, 21 bp, Homo sapiens
ttgtatctagtgcagctgatt

SEQ ID NO: 3302431 - DNA, 21 bp, Homo sapiens
ttgtatctctgaagcatgttt

SEQ ID NO: 3302432 - DNA, 13 bp, Homo sapiens
ttgtatcttcctt

SEQ ID NO: 3302433 - DNA, 22 bp, Homo sapiens
ttgtatcttggggcaagactgc

SEQ ID NO: 3302434 - DNA, 15 bp, Homo sapiens
ttgtatctttatgct

SEQ ID NO: 3302435 - DNA, 18 bp, Homo sapiens
ttgtatgatgtgttgtga

SEQ ID NO: 3302436 - DNA, 20 bp, Homo sapiens
ttgtatgcctttaaatctgt

SEQ ID NO: 3302437 - DNA, 21 bp, Homo sapiens
ttgtatgcctttaaatctgtg

SEQ ID NO: 3302438 - DNA, 15 bp, Homo sapiens
ttgtatgttatgaac

SEQ ID NO: 3302439 - DNA, 13 bp, Homo sapiens
ttgtattaaactc

SEQ ID NO: 3302440 - DNA, 16 bp, Homo sapiens
ttgtattaaactcttc

SEQ ID NO: 3302441 - DNA, 12 bp, Homo sapiens
ttgtattaataa

SEQ ID NO: 3302442 - DNA, 14 bp, Homo sapiens
ttgtattaataaag

SEQ ID NO: 3302443 - DNA, 16 bp, Homo sapiens
ttgtattaataaagca

SEQ ID NO: 3302444 - DNA, 18 bp, Homo sapiens
ttgtattaataaagcatt

SEQ ID NO: 3302445 - DNA, 19 bp, Homo sapiens
ttgtattaataaagcattc

SEQ ID NO: 3302446 - DNA, 19 bp, Homo sapiens
ttgtattactttctctgta

SEQ ID NO: 3302447 - DNA, 13 bp, Homo sapiens
ttgtattatttgg

SEQ ID NO: 3302448 - DNA, 18 bp, Homo sapiens
ttgtattatttggagtta

SEQ ID NO: 3302449 - DNA, 12 bp, Homo sapiens
ttgtattcagat

SEQ ID NO: 3302450 - DNA, 12 bp, Homo sapiens
ttgtattcttct

SEQ ID NO: 3302451 - DNA, 16 bp, Homo sapiens
ttgtattgactttatg

SEQ ID NO: 3302452 - DNA, 13 bp, Homo sapiens
ttgtattgttttc

SEQ ID NO: 3302453 - DNA, 15 bp, Homo sapiens
ttgtatttaattctt

SEQ ID NO: 3302454 - DNA, 16 bp, Homo sapiens
ttgtatttatgtgtat

SEQ ID NO: 3302455 - DNA, 18 bp, Homo sapiens
ttgtatttattaatttga

SEQ ID NO: 3302456 - DNA, 14 bp, Homo sapiens
ttgtattttaactc

SEQ ID NO: 3302457 - DNA, 18 bp, Homo sapiens
ttgtattttgattatttt

SEQ ID NO: 3302458 - DNA, 14 bp, Homo sapiens
ttgtattttgttaa

SEQ ID NO: 3302459 - DNA, 19 bp, Homo sapiens
ttgtattttgttaaagctg

SEQ ID NO: 3302460 - DNA, 15 bp, Homo sapiens
ttgtatttttaatgg

SEQ ID NO: 3302461 - DNA, 16 bp, Homo sapiens
ttgtgttgacattaag

SEQ ID NO: 3302462 - DNA, 23 bp, Homo sapiens
ttgtgttgttttttgttcaatgt

SEQ ID NO: 3302463 - DNA, 22 bp, Homo sapiens
ttgtgtttaactgtgaacaaat

SEQ ID NO: 3302464 - DNA, 17 bp, Homo sapiens
ttgtgtttgcttaaaca

SEQ ID NO: 3302465 - DNA, 20 bp, Homo sapiens
ttgtgtttgcttaaacaaag

SEQ ID NO: 3302466 - DNA, 18 bp, Homo sapiens
ttgtgtttttaatttatt

SEQ ID NO: 3302467 - DNA, 13 bp, Homo sapiens
ttgttaaaaataa

SEQ ID NO: 3302468 - DNA, 21 bp, Homo sapiens
ttgttaaaaataaatcccatg

SEQ ID NO: 3302469 - DNA, 17 bp, Homo sapiens
ttgttaaaaatattttc

SEQ ID NO: 3302470 - DNA, 18 bp, Homo sapiens
ttgttaaaaatattttct

SEQ ID NO: 3302471 - DNA, 15 bp, Homo sapiens
ttgttaaaagatggt

SEQ ID NO: 3302472 - DNA, 16 bp, Homo sapiens
ttgttaaaattatgaa

SEQ ID NO: 3302473 - DNA, 18 bp, Homo sapiens
ttgttaaatttagcagcc

SEQ ID NO: 3302474 - DNA, 19 bp, Homo sapiens
ttgttaatgaaaatgtcag

SEQ ID NO: 3302475 - DNA, 21 bp, Homo sapiens
ttgttaatgctctatgtttgt

SEQ ID NO: 3302476 - DNA, 17 bp, Homo sapiens
ttgttaatggtgcaaat

SEQ ID NO: 3302477 - DNA, 17 bp, Homo sapiens
ttgttaattcctatgaa

SEQ ID NO: 3302478 - DNA, 15 bp, Homo sapiens
ttgttaattcttatt

SEQ ID NO: 3302479 - DNA, 21 bp, Homo sapiens
ttgttacaggcaccgagaatg

SEQ ID NO: 3302480 - DNA, 22 bp, Homo sapiens
ttgttaccaaatacacatttca

SEQ ID NO: 3302481 - DNA, 23 bp, Homo sapiens
ttgttacctccaacagaactaaa

SEQ ID NO: 3302482 - DNA, 16 bp, Homo sapiens
ttgttacgtagcctaa

SEQ ID NO: 3302483 - DNA, 12 bp, Homo sapiens
ttgttactgttc

SEQ ID NO: 3302484 - DNA, 18 bp, Homo sapiens
ttgttactgttcttgctg

SEQ ID NO: 3302485 - DNA, 22 bp, Homo sapiens
ttgttactgttcttgctgctag

SEQ ID NO: 3302486 - DNA, 23 bp, Homo sapiens
ttgttactgttcttgctgctaga

SEQ ID NO: 3302487 - DNA, 17 bp, Homo sapiens
ttgttaggctgtaaaga

SEQ ID NO: 3302488 - DNA, 19 bp, Homo sapiens
ttgttagggtcagccattt

SEQ ID NO: 3302489 - DNA, 22 bp, Homo sapiens
ttgttagtttagtgtgtgtgca

SEQ ID NO: 3302490 - DNA, 13 bp, Homo sapiens
ttgttatacttca

SEQ ID NO: 3302491 - DNA, 22 bp, Homo sapiens
ttgttatcagtcaatattttta

SEQ ID NO: 3302492 - DNA, 13 bp, Homo sapiens
ttgttatgacagt

SEQ ID NO: 3302493 - DNA, 16 bp, Homo sapiens
ttgttatgtctagaaa

SEQ ID NO: 3302494 - DNA, 14 bp, Homo sapiens
ttgttattccatca

SEQ ID NO: 3302495 - DNA, 23 bp, Homo sapiens
ttgttattgggcaagtgattgaa

SEQ ID NO: 3302496 - DNA, 17 bp, Homo sapiens
ttgttattgtggaagat

SEQ ID NO: 3302497 - DNA, 14 bp, Homo sapiens
ttgttcaaacaata

SEQ ID NO: 3302498 - DNA, 15 bp, Homo sapiens
ttgttcaaatgcatt

SEQ ID NO: 3302499 - DNA, 20 bp, Homo sapiens
ttgttcaataataaatattt

SEQ ID NO: 3302500 - DNA, 14 bp, Homo sapiens
ttgttcatgtttgg

SEQ ID NO: 3302501 - DNA, 12 bp, Homo sapiens
ttgttcatttag

SEQ ID NO: 3302502 - DNA, 11 bp, Homo sapiens
ttgttcccagt

SEQ ID NO: 3302503 - DNA, 17 bp, Homo sapiens
ttgttccctatgaaaga

SEQ ID NO: 3302504 - DNA, 19 bp, Homo sapiens
ttgttctatttttcaatca

SEQ ID NO: 3302505 - DNA, 12 bp, Homo sapiens
ttgttctgggct

SEQ ID NO: 3302506 - DNA, 13 bp, Homo sapiens
ttgttctgggctc

SEQ ID NO: 3302507 - DNA, 21 bp, Homo sapiens
ttgttctgtcccttccacttc

SEQ ID NO: 3302508 - DNA, 14 bp, Homo sapiens
ttgttcttacacat

SEQ ID NO: 3302509 - DNA, 12 bp, Homo sapiens
ttgttcttacag

SEQ ID NO: 3302510 - DNA, 18 bp, Homo sapiens
ttgttgaaattttgcaaa

SEQ ID NO: 3302511 - DNA, 19 bp, Homo sapiens
ttgttgaacatacttcaaa

SEQ ID NO: 3302512 - DNA, 15 bp, Homo sapiens
ttgttgacagcaaaa

SEQ ID NO: 3302513 - DNA, 23 bp, Homo sapiens
ttgttgacagcaaaatgttgaag

SEQ ID NO: 3302514 - DNA, 14 bp, Homo sapiens
ttgttgaggtggtc

SEQ ID NO: 3302515 - DNA, 21 bp, Homo sapiens
ttgttgaggtggtctgaatgt

SEQ ID NO: 3302516 - DNA, 20 bp, Homo sapiens
ttgttgataaattccactgg

SEQ ID NO: 3302517 - DNA, 15 bp, Homo sapiens
ttgttgataggaact

SEQ ID NO: 3302518 - DNA, 20 bp, Homo sapiens
ttgttggatcttcaatggct

SEQ ID NO: 3302519 - DNA, 16 bp, Homo sapiens
ttgttggcacagaaca

SEQ ID NO: 3302520 - DNA, 16 bp, Homo sapiens
ttgttggggctttaca

SEQ ID NO: 3302521 - DNA, 17 bp, Homo sapiens
ttgttgtaaaaagaaaa

SEQ ID NO: 3302522 - DNA, 21 bp, Homo sapiens
ttgttgtaaaacaaaatttga

SEQ ID NO: 3302523 - DNA, 17 bp, Homo sapiens
ttgttgtataatttcga

SEQ ID NO: 3302524 - DNA, 19 bp, Homo sapiens
ttgttgtgactttgacgct

SEQ ID NO: 3302525 - DNA, 16 bp, Homo sapiens
ttgttgtgatgtcttt

SEQ ID NO: 3302526 - DNA, 14 bp, Homo sapiens
ttgttgtttgccat

SEQ ID NO: 3302527 - DNA, 13 bp, Homo sapiens
ttgttgtttgtaa

SEQ ID NO: 3302528 - DNA, 23 bp, Homo sapiens
ttgtttaaaactcagaatataac

SEQ ID NO: 3302529 - DNA, 18 bp, Homo sapiens
ttgtttaaaattcagttt

SEQ ID NO: 3302530 - DNA, 22 bp, Homo sapiens
ttgtttacagcactactctgtg

SEQ ID NO: 3302531 - DNA, 13 bp, Homo sapiens
ttgtttattgagt

SEQ ID NO: 3302532 - DNA, 15 bp, Homo sapiens
ttgtttattgtaaaa

SEQ ID NO: 3302533 - DNA, 17 bp, Homo sapiens
ttgtttatttttatata

SEQ ID NO: 3302534 - DNA, 21 bp, Homo sapiens
ttgtttcaatctctgactaaa

SEQ ID NO: 3302535 - DNA, 21 bp, Homo sapiens
ttgtttcaatgaggtgtccaa

SEQ ID NO: 3302536 - DNA, 23 bp, Homo sapiens
ttgtttcctcccctatctgtatt

SEQ ID NO: 3302537 - DNA, 16 bp, Homo sapiens
ttgtttcctcttccaa

SEQ ID NO: 3302538 - DNA, 19 bp, Homo sapiens
ttgtttcctcttccaaagt

SEQ ID NO: 3302539 - DNA, 21 bp, Homo sapiens
ttgtttcctcttccaaagtaa

SEQ ID NO: 3302540 - DNA, 22 bp, Homo sapiens
ttgtttctagactataaatgtt

SEQ ID NO: 3302541 - DNA, 16 bp, Homo sapiens
ttgtttctccccctgg

SEQ ID NO: 3302542 - DNA, 21 bp, Homo sapiens
ttgtttctgaaaattccagaa

SEQ ID NO: 3302543 - DNA, 14 bp, Homo sapiens
ttgtttctgaccca

SEQ ID NO: 3302544 - DNA, 17 bp, Homo sapiens
ttgtttctgttccaaat

SEQ ID NO: 3302545 - DNA, 13 bp, Homo sapiens
ttgtttcttgttt

SEQ ID NO: 3302546 - DNA, 18 bp, Homo sapiens
ttgtttcttgtttattga

SEQ ID NO: 3302547 - DNA, 17 bp, Homo sapiens
ttgtttgattcagcaaa

SEQ ID NO: 3302548 - DNA, 16 bp, Homo sapiens
ttgtttgccatacttt

SEQ ID NO: 3302549 - DNA, 23 bp, Homo sapiens
ttgtttgctcttttaagcagtct

SEQ ID NO: 3302550 - DNA, 21 bp, Homo sapiens
ttgtttggagacgtttataaa

SEQ ID NO: 3302551 - DNA, 16 bp, Homo sapiens
ttgtttggatgtaatt

SEQ ID NO: 3302552 - DNA, 16 bp, Homo sapiens
ttgtttggcaaggaaa

SEQ ID NO: 3302553 - DNA, 17 bp, Homo sapiens
ttgtttggcaaggaaag

SEQ ID NO: 3302554 - DNA, 18 bp, Homo sapiens
ttgtttggcaaggaaagg

SEQ ID NO: 3302555 - DNA, 14 bp, Homo sapiens
ttgtttggcttcct

SEQ ID NO: 3302556 - DNA, 16 bp, Homo sapiens
ttgtttgggtatcctg

SEQ ID NO: 3302557 - DNA, 13 bp, Homo sapiens
ttgtttgtaaata

SEQ ID NO: 3302558 - DNA, 16 bp, Homo sapiens
ttgtttgtaaatgcct

SEQ ID NO: 3302559 - DNA, 22 bp, Homo sapiens
ttgtttgtaaatgcctcttaaa

SEQ ID NO: 3302560 - DNA, 11 bp, Homo sapiens
ttgtttgtatt

SEQ ID NO: 3302561 - DNA, 21 bp, Homo sapiens
ttgtttgtttctccccctggg

SEQ ID NO: 3302562 - DNA, 14 bp, Homo sapiens
ttgttttcacttgt

SEQ ID NO: 3302563 - DNA, 18 bp, Homo sapiens
ttgttttcacttgtattg

SEQ ID NO: 3302564 - DNA, 16 bp, Homo sapiens
ttgttttctgactaat

SEQ ID NO: 3302565 - DNA, 18 bp, Homo sapiens
ttgttttcttctgtatgt

SEQ ID NO: 3302566 - DNA, 14 bp, Homo sapiens
ttgttttgcttttg

SEQ ID NO: 3302567 - DNA, 15 bp, Homo sapiens
ttgttttgggtgaat

SEQ ID NO: 3302568 - DNA, 13 bp, Homo sapiens
ttgttttgtattg

SEQ ID NO: 3302569 - DNA, 16 bp, Homo sapiens
ttgttttgtgcagaga

SEQ ID NO: 3302570 - DNA, 12 bp, Homo sapiens
ttgtttttcatt

SEQ ID NO: 3302571 - DNA, 13 bp, Homo sapiens
ttgtttttcattc

SEQ ID NO: 3302572 - DNA, 15 bp, Homo sapiens
ttgtttttctttcta

SEQ ID NO: 3302573 - DNA, 17 bp, Homo sapiens
ttgtttttgtaatgcac

SEQ ID NO: 3302574 - DNA, 16 bp, Homo sapiens
ttgttttttgtaacta

SEQ ID NO: 3302575 - DNA, 15 bp, Homo sapiens
ttgtttttttcctca

SEQ ID NO: 3302576 - DNA, 19 bp, Homo sapiens
ttgttttttttttccactt

SEQ ID NO: 3302577 - DNA, 18 bp, Homo sapiens
tttaaaaaaacaaataaa

SEQ ID NO: 3302578 - DNA, 18 bp, Homo sapiens
tttaaaaaaatttaagtg

SEQ ID NO: 3302579 - DNA, 16 bp, Homo sapiens
tttaaaaaatattttc

SEQ ID NO: 3302580 - DNA, 16 bp, Homo sapiens
tttaaaaaattatgga

SEQ ID NO: 3302581 - DNA, 17 bp, Homo sapiens
tttaaaaaattatggaa

SEQ ID NO: 3302582 - DNA, 21 bp, Homo sapiens
tttaaaaacactacttttgct

SEQ ID NO: 3302583 - DNA, 14 bp, Homo sapiens
tttaaaaactcttc

SEQ ID NO: 3302584 - DNA, 13 bp, Homo sapiens
tttaaaaagcaaa

SEQ ID NO: 3302585 - DNA, 18 bp, Homo sapiens
tttaaaaagctcactgct

SEQ ID NO: 3302586 - DNA, 21 bp, Homo sapiens
tttaaaaagctcactgctgat

SEQ ID NO: 3302587 - DNA, 15 bp, Homo sapiens
tttattaaatacaaa

SEQ ID NO: 3302588 - DNA, 15 bp, Homo sapiens
tttattaagatggat

SEQ ID NO: 3302589 - DNA, 12 bp, Homo sapiens
tttattaatgtt

SEQ ID NO: 3302590 - DNA, 18 bp, Homo sapiens
tttattaatgttttcaaa

SEQ ID NO: 3302591 - DNA, 16 bp, Homo sapiens
tttattaatttatatg

SEQ ID NO: 3302592 - DNA, 17 bp, Homo sapiens
tttattacaatttgtat

SEQ ID NO: 3302593 - DNA, 14 bp, Homo sapiens
tttattacctctga

SEQ ID NO: 3302594 - DNA, 22 bp, Homo sapiens
tttattagccagtgaaacactt

SEQ ID NO: 3302595 - DNA, 15 bp, Homo sapiens
tttattatgagctac

SEQ ID NO: 3302596 - DNA, 20 bp, Homo sapiens
tttattatgcattcttataa

SEQ ID NO: 3302597 - DNA, 13 bp, Homo sapiens
tttattatttgaa

SEQ ID NO: 3302598 - DNA, 16 bp, Homo sapiens
tttattcaccttttct

SEQ ID NO: 3302599 - DNA, 19 bp, Homo sapiens
tttattcagcttcatttgt

SEQ ID NO: 3302600 - DNA, 18 bp, Homo sapiens
tttattcataatgaatta

SEQ ID NO: 3302601 - DNA, 21 bp, Homo sapiens
tttattccctgcccaaaccct

SEQ ID NO: 3302602 - DNA, 16 bp, Homo sapiens
tttattcctgtatgtt

SEQ ID NO: 3302603 - DNA, 17 bp, Homo sapiens
tttattcttattactat

SEQ ID NO: 3302604 - DNA, 14 bp, Homo sapiens
tttattcttctaga

SEQ ID NO: 3302605 - DNA, 18 bp, Homo sapiens
tttattcttctagagttc

SEQ ID NO: 3302606 - DNA, 17 bp, Homo sapiens
tttattctttactatta

SEQ ID NO: 3302607 - DNA, 13 bp, Homo sapiens
tttattgaatatt

SEQ ID NO: 3302608 - DNA, 12 bp, Homo sapiens
tttattgacaca

SEQ ID NO: 3302609 - DNA, 14 bp, Homo sapiens
tttattgacacaga

SEQ ID NO: 3302610 - DNA, 14 bp, Homo sapiens
tttattgagaattt

SEQ ID NO: 3302611 - DNA, 18 bp, Homo sapiens
tttattgtacagactgtt

SEQ ID NO: 3302612 - DNA, 13 bp, Homo sapiens
tttattgtataaa

SEQ ID NO: 3302613 - DNA, 18 bp, Homo sapiens
tttattgtattttgatga

SEQ ID NO: 3302614 - DNA, 19 bp, Homo sapiens
tttattgtattttgatgag

SEQ ID NO: 3302615 - DNA, 19 bp, Homo sapiens
tttattgtctgtctacatt

SEQ ID NO: 3302616 - DNA, 19 bp, Homo sapiens
tttatttaaattacaattt

SEQ ID NO: 3302617 - DNA, 17 bp, Homo sapiens
tttatttaatgttatgt

SEQ ID NO: 3302618 - DNA, 18 bp, Homo sapiens
tttatttaattaaatgta

SEQ ID NO: 3302619 - DNA, 15 bp, Homo sapiens
tttatttacatttta

SEQ ID NO: 3302620 - DNA, 11 bp, Homo sapiens
tttatttacta

SEQ ID NO: 3302621 - DNA, 14 bp, Homo sapiens
tttatttatcagtg

SEQ ID NO: 3302622 - DNA, 15 bp, Homo sapiens
tttatttatcagtga

SEQ ID NO: 3302623 - DNA, 14 bp, Homo sapiens
tttatttattaaga

SEQ ID NO: 3302624 - DNA, 13 bp, Homo sapiens
tttatttatttct

SEQ ID NO: 3302625 - DNA, 20 bp, Homo sapiens
tttatttccactaaaaatat

SEQ ID NO: 3302626 - DNA, 20 bp, Homo sapiens
tttatttcctgtatgttgta

SEQ ID NO: 3302627 - DNA, 15 bp, Homo sapiens
tttatttctaaatga

SEQ ID NO: 3302628 - DNA, 17 bp, Homo sapiens
tttattttaatgtaaag

SEQ ID NO: 3302629 - DNA, 18 bp, Homo sapiens
tttattttattctatgta

SEQ ID NO: 3302630 - DNA, 12 bp, Homo sapiens
tttattttccta

SEQ ID NO: 3302631 - DNA, 22 bp, Homo sapiens
tttattttgtgctcatttaagt

SEQ ID NO: 3302632 - DNA, 17 bp, Homo sapiens
tttatttttcatattgt

SEQ ID NO: 3302633 - DNA, 20 bp, Homo sapiens
tttatttttcatattgtgcc

SEQ ID NO: 3302634 - DNA, 13 bp, Homo sapiens
tttatttttgaac

SEQ ID NO: 3302635 - DNA, 23 bp, Homo sapiens
tttatttttgaacccctgtgtcc

SEQ ID NO: 3302636 - DNA, 13 bp, Homo sapiens
tttatttttgtaa

SEQ ID NO: 3302637 - DNA, 14 bp, Homo sapiens
tttattttttaagt

SEQ ID NO: 3302638 - DNA, 17 bp, Homo sapiens
tttattttttcttttgt

SEQ ID NO: 3302639 - DNA, 15 bp, Homo sapiens
tttatttttttaagt

SEQ ID NO: 3302640 - DNA, 12 bp, Homo sapiens
tttcaaaaatgc

SEQ ID NO: 3302641 - DNA, 20 bp, Homo sapiens
tttcaaaacccaaatggcta

SEQ ID NO: 3302642 - DNA, 19 bp, Homo sapiens
tttcaaaatcagtttttca

SEQ ID NO: 3302643 - DNA, 12 bp, Homo sapiens
tttcaaaatgct

SEQ ID NO: 3302644 - DNA, 22 bp, Homo sapiens
tttcaaacttactattttgaca

SEQ ID NO: 3302645 - DNA, 14 bp, Homo sapiens
tttcaaagaaggaa

SEQ ID NO: 3302646 - DNA, 19 bp, Homo sapiens
tttcaaagatgctgtgagt

SEQ ID NO: 3302647 - DNA, 19 bp, Homo sapiens
tttcaaagtaaaggcctcc

SEQ ID NO: 3302648 - DNA, 19 bp, Homo sapiens
tttcaaatagggtctaact

SEQ ID NO: 3302649 - DNA, 14 bp, Homo sapiens
tttcaaattgtatc

SEQ ID NO: 3302650 - DNA, 23 bp, Homo sapiens
tttcaacaagaatattgtatgtt

SEQ ID NO: 3302651 - DNA, 16 bp, Homo sapiens
tttcaacatatcattt

SEQ ID NO: 3302652 - DNA, 18 bp, Homo sapiens
tttcaacatgagtgtatt

SEQ ID NO: 3302653 - DNA, 20 bp, Homo sapiens
tttcaacgcagccctgcttt

SEQ ID NO: 3302654 - DNA, 15 bp, Homo sapiens
tttcaacggaaagtg

SEQ ID NO: 3302655 - DNA, 19 bp, Homo sapiens
tttcaacttcagtactcaa

SEQ ID NO: 3302656 - DNA, 18 bp, Homo sapiens
tttcaagaaaaaataaat

SEQ ID NO: 3302657 - DNA, 22 bp, Homo sapiens
tttcaagaaaaaataaatggaa

SEQ ID NO: 3302658 - DNA, 17 bp, Homo sapiens
tttcaagaaactgagga

SEQ ID NO: 3302659 - DNA, 22 bp, Homo sapiens
tttcaagagtctaatagtcttt

SEQ ID NO: 3302660 - DNA, 22 bp, Homo sapiens
tttcaagcctgcctaggaattc

SEQ ID NO: 3302661 - DNA, 17 bp, Homo sapiens
tttcaaggcactctaga

SEQ ID NO: 3302662 - DNA, 16 bp, Homo sapiens
tttcaaggttctaacc

SEQ ID NO: 3302663 - DNA, 18 bp, Homo sapiens
tttcaagtcaaattaata

SEQ ID NO: 3302664 - DNA, 19 bp, Homo sapiens
tttcaagtgcctagactgt

SEQ ID NO: 3302665 - DNA, 20 bp, Homo sapiens
tttcaagtttacacttcata

SEQ ID NO: 3302666 - DNA, 20 bp, Homo sapiens
tttcaataaagcatttataa

SEQ ID NO: 3302667 - DNA, 14 bp, Homo sapiens
tttcaatcactgtc

SEQ ID NO: 3302668 - DNA, 15 bp, Homo sapiens
tttcaatcattgaag

SEQ ID NO: 3302669 - DNA, 13 bp, Homo sapiens
tttcaatgtgatt

SEQ ID NO: 3302670 - DNA, 14 bp, Homo sapiens
tttcaatgtgattc

SEQ ID NO: 3302671 - DNA, 20 bp, Homo sapiens
tttcaatgtgattctaatgt

SEQ ID NO: 3302672 - DNA, 15 bp, Homo sapiens
tttcaatgtttgaaa

SEQ ID NO: 3302673 - DNA, 14 bp, Homo sapiens
tttcaattcagatt

SEQ ID NO: 3302674 - DNA, 22 bp, Homo sapiens
tttcaattcagattgtcttgca

SEQ ID NO: 3302675 - DNA, 23 bp, Homo sapiens
tttcaattcagattgtcttgcaa

SEQ ID NO: 3302676 - DNA, 22 bp, Homo sapiens
tttcaattccacctgcaatcaa

SEQ ID NO: 3302677 - DNA, 14 bp, Homo sapiens
tttcaattctcaaa

SEQ ID NO: 3302678 - DNA, 13 bp, Homo sapiens
tttcacaacagat

SEQ ID NO: 3302679 - DNA, 17 bp, Homo sapiens
tttcacaattattaaat

SEQ ID NO: 3302680 - DNA, 23 bp, Homo sapiens
tttcacaggctgtaaattgaact

SEQ ID NO: 3302681 - DNA, 13 bp, Homo sapiens
tttcacagttttt

SEQ ID NO: 3302682 - DNA, 16 bp, Homo sapiens
tttcacatagctgtct

SEQ ID NO: 3302683 - DNA, 13 bp, Homo sapiens
tttcacattttcc

SEQ ID NO: 3302684 - DNA, 17 bp, Homo sapiens
tttcaccagatttgcta

SEQ ID NO: 3302685 - DNA, 22 bp, Homo sapiens
tttcaccccacccttcccctcc

SEQ ID NO: 3302686 - DNA, 21 bp, Homo sapiens
tttcacccttaacccaaggag

SEQ ID NO: 3302687 - DNA, 14 bp, Homo sapiens
tttcacctgtaaac

SEQ ID NO: 3302688 - DNA, 16 bp, Homo sapiens
tttcaccttttcagga

SEQ ID NO: 3302689 - DNA, 21 bp, Homo sapiens
tttcaccttttcaggaaaata

SEQ ID NO: 3302690 - DNA, 15 bp, Homo sapiens
tttcacgggagattt

SEQ ID NO: 3302691 - DNA, 22 bp, Homo sapiens
tttcacggtgccaggttttctg

SEQ ID NO: 3302692 - DNA, 23 bp, Homo sapiens
tttcacgtcttggtgccttttgt

SEQ ID NO: 3302693 - DNA, 15 bp, Homo sapiens
tttcactagaaaagc

SEQ ID NO: 3302694 - DNA, 16 bp, Homo sapiens
tttcactagagacaaa

SEQ ID NO: 3302695 - DNA, 19 bp, Homo sapiens
tttcactggagttacatta

SEQ ID NO: 3302696 - DNA, 22 bp, Homo sapiens
tttcacttcaagggagaatata

SEQ ID NO: 3302697 - DNA, 15 bp, Homo sapiens
tttcacttgaaagat

SEQ ID NO: 3302698 - DNA, 12 bp, Homo sapiens
tttcacttgtat

SEQ ID NO: 3302699 - DNA, 17 bp, Homo sapiens
tttcacttttgttctgc

SEQ ID NO: 3302700 - DNA, 16 bp, Homo sapiens
tttcagaaatatgtgg

SEQ ID NO: 3302701 - DNA, 20 bp, Homo sapiens
tttcagaaatatgtggtttc

SEQ ID NO: 3302702 - DNA, 13 bp, Homo sapiens
tttcagaagaaat

SEQ ID NO: 3302703 - DNA, 14 bp, Homo sapiens
tttcagaatctgaa

SEQ ID NO: 3302704 - DNA, 15 bp, Homo sapiens
tttcagactgcagag

SEQ ID NO: 3302705 - DNA, 19 bp, Homo sapiens
tttcagagaccttaattta

SEQ ID NO: 3302706 - DNA, 12 bp, Homo sapiens
tttcagatgctt

SEQ ID NO: 3302707 - DNA, 14 bp, Homo sapiens
tttcagatgcttct

SEQ ID NO: 3302708 - DNA, 19 bp, Homo sapiens
tttcagatgtcttctgcct

SEQ ID NO: 3302709 - DNA, 20 bp, Homo sapiens
tttcagattttttatttgaa

SEQ ID NO: 3302710 - DNA, 20 bp, Homo sapiens
tttcagcacccccacccacc

SEQ ID NO: 3302711 - DNA, 21 bp, Homo sapiens
tttcagcacccccacccacct

SEQ ID NO: 3302712 - DNA, 22 bp, Homo sapiens
tttcagcacccccacccacctc

SEQ ID NO: 3302713 - DNA, 13 bp, Homo sapiens
tttgagtcattga

SEQ ID NO: 3302714 - DNA, 19 bp, Homo sapiens
tttgagtcattgacttcat

SEQ ID NO: 3302715 - DNA, 22 bp, Homo sapiens
tttgagtcattgacttcatttt

SEQ ID NO: 3302716 - DNA, 14 bp, Homo sapiens
tttgagtgttttaa

SEQ ID NO: 3302717 - DNA, 12 bp, Homo sapiens
tttgagttctac

SEQ ID NO: 3302718 - DNA, 15 bp, Homo sapiens
tttgataatgttaaa

SEQ ID NO: 3302719 - DNA, 19 bp, Homo sapiens
tttgataatgttaaatttg

SEQ ID NO: 3302720 - DNA, 15 bp, Homo sapiens
tttgatacccctggg

SEQ ID NO: 3302721 - DNA, 14 bp, Homo sapiens
tttgatacttatat

SEQ ID NO: 3302722 - DNA, 15 bp, Homo sapiens
tttgatacttatatt

SEQ ID NO: 3302723 - DNA, 18 bp, Homo sapiens
tttgatacttatattttc

SEQ ID NO: 3302724 - DNA, 22 bp, Homo sapiens
tttgatagaaaggaacacgttt

SEQ ID NO: 3302725 - DNA, 15 bp, Homo sapiens
tttgatatgagtata

SEQ ID NO: 3302726 - DNA, 19 bp, Homo sapiens
tttgatatgagtatacaat

SEQ ID NO: 3302727 - DNA, 13 bp, Homo sapiens
tttgatcaaatct

SEQ ID NO: 3302728 - DNA, 15 bp, Homo sapiens
tttgatccaagctgg

SEQ ID NO: 3302729 - DNA, 12 bp, Homo sapiens
tttgatgataaa

SEQ ID NO: 3302730 - DNA, 20 bp, Homo sapiens
tttgatgctatttatgcaag

SEQ ID NO: 3302731 - DNA, 16 bp, Homo sapiens
tttgatgctggagagg

SEQ ID NO: 3302732 - DNA, 18 bp, Homo sapiens
tttgatgctggagaggtt

SEQ ID NO: 3302733 - DNA, 19 bp, Homo sapiens
tttgatgctggagaggtta

SEQ ID NO: 3302734 - DNA, 10 bp, Homo sapiens
tttgatgtat

SEQ ID NO: 3302735 - DNA, 16 bp, Homo sapiens
tttgatgtatgtgtga

SEQ ID NO: 3302736 - DNA, 19 bp, Homo sapiens
tttgatgtatgtgtgaaac

SEQ ID NO: 3302737 - DNA, 19 bp, Homo sapiens
tttgatgtccccaaagtac

SEQ ID NO: 3302738 - DNA, 14 bp, Homo sapiens
tttgatgtgacttt

SEQ ID NO: 3302739 - DNA, 13 bp, Homo sapiens
tttgattaatgtt

SEQ ID NO: 3302740 - DNA, 17 bp, Homo sapiens
tttgattaatgtttctt

SEQ ID NO: 3302741 - DNA, 14 bp, Homo sapiens
tttgattattatgt

SEQ ID NO: 3302742 - DNA, 14 bp, Homo sapiens
tttgattattgtat

SEQ ID NO: 3302743 - DNA, 16 bp, Homo sapiens
tttgattattgtattt

SEQ ID NO: 3302744 - DNA, 20 bp, Homo sapiens
tttgattcatagtaacttct

SEQ ID NO: 3302745 - DNA, 22 bp, Homo sapiens
tttgattccaatccaattatca

SEQ ID NO: 3302746 - DNA, 14 bp, Homo sapiens
tttgattctgaagt

SEQ ID NO: 3302747 - DNA, 21 bp, Homo sapiens
tttgattgttatgtaaaactc

SEQ ID NO: 3302748 - DNA, 18 bp, Homo sapiens
tttgatttacagcaagta

SEQ ID NO: 3302749 - DNA, 12 bp, Homo sapiens
tttgatttatgc

SEQ ID NO: 3302750 - DNA, 13 bp, Homo sapiens
tttgatttctatt

SEQ ID NO: 3302751 - DNA, 13 bp, Homo sapiens
tttgattttgctg

SEQ ID NO: 3302752 - DNA, 23 bp, Homo sapiens
tttgattttggaaagatgttaag

SEQ ID NO: 3302753 - DNA, 17 bp, Homo sapiens
tttgcaaatctaaagtt

SEQ ID NO: 3302754 - DNA, 20 bp, Homo sapiens
tttgcaacaggggaggaaaa

SEQ ID NO: 3302755 - DNA, 13 bp, Homo sapiens
tttgcaacattta

SEQ ID NO: 3302756 - DNA, 24 bp, Homo sapiens
tttgcaaggtgcatttttactatt

SEQ ID NO: 3302757 - DNA, 18 bp, Homo sapiens
tttgcacattttgatttt

SEQ ID NO: 3302758 - DNA, 14 bp, Homo sapiens
tttgcaccaaagac

SEQ ID NO: 3302759 - DNA, 15 bp, Homo sapiens
tttgcaccaaagaca

SEQ ID NO: 3302760 - DNA, 13 bp, Homo sapiens
tttgcacctctgt

SEQ ID NO: 3302761 - DNA, 13 bp, Homo sapiens
tttgcacctgtcc

SEQ ID NO: 3302762 - DNA, 17 bp, Homo sapiens
tttgcacgtttggtttg

SEQ ID NO: 3302763 - DNA, 21 bp, Homo sapiens
tttgcacgtttggtttgcgca

SEQ ID NO: 3302764 - DNA, 14 bp, Homo sapiens
tttgcactaaatca

SEQ ID NO: 3302765 - DNA, 19 bp, Homo sapiens
tttgcactaaatcagagac

SEQ ID NO: 3302766 - DNA, 20 bp, Homo sapiens
tttgcactaaatcagagaca

SEQ ID NO: 3302767 - DNA, 12 bp, Homo sapiens
tttgcactgagg

SEQ ID NO: 3302768 - DNA, 18 bp, Homo sapiens
tttgcactgatatatcat

SEQ ID NO: 3302769 - DNA, 20 bp, Homo sapiens
tttgcactggagttctatgc

SEQ ID NO: 3302770 - DNA, 13 bp, Homo sapiens
tttgcactgtttt

SEQ ID NO: 3302771 - DNA, 15 bp, Homo sapiens
tttgcacttaaaaat

SEQ ID NO: 3302772 - DNA, 12 bp, Homo sapiens
tttgcacttatg

SEQ ID NO: 3302773 - DNA, 14 bp, Homo sapiens
tttgcagacaggca

SEQ ID NO: 3302774 - DNA, 16 bp, Homo sapiens
tttgcaggctctgggc

SEQ ID NO: 3302775 - DNA, 21 bp, Homo sapiens
tttgcaggctctgggctcagg

SEQ ID NO: 3302776 - DNA, 14 bp, Homo sapiens
tttgcagggcagcc

SEQ ID NO: 3302777 - DNA, 10 bp, Homo sapiens
tttgcagtaa

SEQ ID NO: 3302778 - DNA, 12 bp, Homo sapiens
tttgcagtaact

SEQ ID NO: 3302779 - DNA, 21 bp, Homo sapiens
tttgcataatgcaatcaaaaa

SEQ ID NO: 3302780 - DNA, 14 bp, Homo sapiens
tttgcatagctctc

SEQ ID NO: 3302781 - DNA, 14 bp, Homo sapiens
tttgcatatatgtt

SEQ ID NO: 3302782 - DNA, 22 bp, Homo sapiens
tttgcatggctccagaaatgtc

SEQ ID NO: 3302783 - DNA, 18 bp, Homo sapiens
tttgcatgtcgcacaatg

SEQ ID NO: 3302784 - DNA, 18 bp, Homo sapiens
tttgcattgtgtcagaaa

SEQ ID NO: 3302785 - DNA, 17 bp, Homo sapiens
tttgccaaaaaaaaaag

SEQ ID NO: 3302786 - DNA, 23 bp, Homo sapiens
tttgccagagccaaattttatct

SEQ ID NO: 3302787 - DNA, 18 bp, Homo sapiens
tttgccatgttggccagg

SEQ ID NO: 3302788 - DNA, 16 bp, Homo sapiens
tttgccatttgatacc

SEQ ID NO: 3302789 - DNA, 16 bp, Homo sapiens
tttgcccaacaccagc

SEQ ID NO: 3302790 - DNA, 23 bp, Homo sapiens
tttgcccaacaccagcccctgcc

SEQ ID NO: 3302791 - DNA, 17 bp, Homo sapiens
tttgccccaagtcctca

SEQ ID NO: 3302792 - DNA, 15 bp, Homo sapiens
tttgcccttaaggac

SEQ ID NO: 3302793 - DNA, 16 bp, Homo sapiens
tttgccgctgagatat

SEQ ID NO: 3302794 - DNA, 18 bp, Homo sapiens
tttgccggatacaaactg

SEQ ID NO: 3302795 - DNA, 17 bp, Homo sapiens
tttgcctaccatttcac

SEQ ID NO: 3302796 - DNA, 13 bp, Homo sapiens
tttgcctctgcct

SEQ ID NO: 3302797 - DNA, 19 bp, Homo sapiens
tttgcctgcctggtgtgcc

SEQ ID NO: 3302798 - DNA, 12 bp, Homo sapiens
tttgcctggctg

SEQ ID NO: 3302799 - DNA, 22 bp, Homo sapiens
tttgcctggctgtggaggcctg

SEQ ID NO: 3302800 - DNA, 11 bp, Homo sapiens
tttgcctgtgc

SEQ ID NO: 3302801 - DNA, 17 bp, Homo sapiens
tttgccttcctttctcc

SEQ ID NO: 3302802 - DNA, 22 bp, Homo sapiens
tttgccttcctttctccaggac

SEQ ID NO: 3302803 - DNA, 16 bp, Homo sapiens
tttgccttgcagaact

SEQ ID NO: 3302804 - DNA, 20 bp, Homo sapiens
tttgccttgcagccacatgg

SEQ ID NO: 3302805 - DNA, 11 bp, Homo sapiens
tttgcctttct

SEQ ID NO: 3302806 - DNA, 16 bp, Homo sapiens
tttgcgaaaagataaa

SEQ ID NO: 3302807 - DNA, 16 bp, Homo sapiens
tttgctacaaatttat

SEQ ID NO: 3302808 - DNA, 19 bp, Homo sapiens
tttgctacaaatttatgca

SEQ ID NO: 3302809 - DNA, 22 bp, Homo sapiens
tttgctacaaatttatgcattt

SEQ ID NO: 3302810 - DNA, 14 bp, Homo sapiens
tttgctactaagtt

SEQ ID NO: 3302811 - DNA, 24 bp, Homo sapiens
tttgctactgtacataaacaatga

SEQ ID NO: 3302812 - DNA, 16 bp, Homo sapiens
tttgctatctgggctg

SEQ ID NO: 3302813 - DNA, 23 bp, Homo sapiens
tttgctattgacaagtcatttta

SEQ ID NO: 3302814 - DNA, 14 bp, Homo sapiens
tttgctccgaagct

SEQ ID NO: 3302815 - DNA, 23 bp, Homo sapiens
tttgctgacaaccattaaagtca

SEQ ID NO: 3302816 - DNA, 14 bp, Homo sapiens
tttgctgagttgtt

SEQ ID NO: 3302817 - DNA, 16 bp, Homo sapiens
tttgctgctatgaaaa

SEQ ID NO: 3302818 - DNA, 23 bp, Homo sapiens
tttgctgctatgaaaatgagcat

SEQ ID NO: 3302819 - DNA, 22 bp, Homo sapiens
tttgctgctgcccatgtttcaa

SEQ ID NO: 3302820 - DNA, 14 bp, Homo sapiens
tttgctgtactctt

SEQ ID NO: 3302821 - DNA, 17 bp, Homo sapiens
tttgctgtgaggctgtc

SEQ ID NO: 3302822 - DNA, 21 bp, Homo sapiens
tttgctgtgaggctgtcctgt

SEQ ID NO: 3302823 - DNA, 14 bp, Homo sapiens
tttgcttaaacaaa

SEQ ID NO: 3302824 - DNA, 12 bp, Homo sapiens
tttgcttagaaa

SEQ ID NO: 3302825 - DNA, 16 bp, Homo sapiens
tttgcttattgttcca

SEQ ID NO: 3302826 - DNA, 19 bp, Homo sapiens
tttgcttattgttccaaga

SEQ ID NO: 3302827 - DNA, 20 bp, Homo sapiens
tttgcttcattgtactacct

SEQ ID NO: 3302828 - DNA, 19 bp, Homo sapiens
tttgcttgaacacagtatt

SEQ ID NO: 3302829 - DNA, 12 bp, Homo sapiens
tttgctttctgt

SEQ ID NO: 3302830 - DNA, 19 bp, Homo sapiens
tttgctttggttaaaaatg

SEQ ID NO: 3302831 - DNA, 15 bp, Homo sapiens
tttggaaaaatgttt

SEQ ID NO: 3302832 - DNA, 17 bp, Homo sapiens
tttggaaactgctaaat

SEQ ID NO: 3302833 - DNA, 15 bp, Homo sapiens
tttggaaagagacca

SEQ ID NO: 3302834 - DNA, 13 bp, Homo sapiens
tttggaaagtaca

SEQ ID NO: 3302835 - DNA, 20 bp, Homo sapiens
tttggaaagtacactctgct

SEQ ID NO: 3302836 - DNA, 21 bp, Homo sapiens
tttggaaagtacactctgctg

SEQ ID NO: 3302837 - DNA, 22 bp, Homo sapiens
tttggaaagtacactctgctgt

SEQ ID NO: 3302838 - DNA, 11 bp, Homo sapiens
tttggaaatcc

SEQ ID NO: 3302839 - DNA, 14 bp, Homo sapiens
tttggaagttttca

SEQ ID NO: 3302840 - DNA, 14 bp, Homo sapiens
tttggaatatttga

SEQ ID NO: 3302841 - DNA, 16 bp, Homo sapiens
tttggaatatttgaat

SEQ ID NO: 3302842 - DNA, 18 bp, Homo sapiens
tttggaatatttgaataa

SEQ ID NO: 3302843 - DNA, 13 bp, Homo sapiens
tttggacagttta

SEQ ID NO: 3302844 - DNA, 17 bp, Homo sapiens
tttggaccccagctggg

SEQ ID NO: 3302845 - DNA, 19 bp, Homo sapiens
tttggacctaaatggcctc

SEQ ID NO: 3302846 - DNA, 16 bp, Homo sapiens
tttggacctaatccaa

SEQ ID NO: 3302847 - DNA, 19 bp, Homo sapiens
tttggactgagatttctta

SEQ ID NO: 3302848 - DNA, 19 bp, Homo sapiens
tttggagaacgccagtctc

SEQ ID NO: 3302849 - DNA, 19 bp, Homo sapiens
tttggagactctgtggggc

SEQ ID NO: 3302850 - DNA, 18 bp, Homo sapiens
tttggagactggggtggc

SEQ ID NO: 3302851 - DNA, 20 bp, Homo sapiens
tttggagtcccctcacctcc

SEQ ID NO: 3302852 - DNA, 19 bp, Homo sapiens
tttggatgggagtgagaca

SEQ ID NO: 3302853 - DNA, 13 bp, Homo sapiens
tttggatgtaatt

SEQ ID NO: 3302854 - DNA, 15 bp, Homo sapiens
tttggatgtaattta

SEQ ID NO: 3302855 - DNA, 18 bp, Homo sapiens
tttggattcttatgtagc

SEQ ID NO: 3302856 - DNA, 20 bp, Homo sapiens
tttggattcttatgtagcag

SEQ ID NO: 3302857 - DNA, 14 bp, Homo sapiens
tttggattgtatat

SEQ ID NO: 3302858 - DNA, 14 bp, Homo sapiens
tttggatttgacat

SEQ ID NO: 3302859 - DNA, 20 bp, Homo sapiens
tttggcaatttcctggccct

SEQ ID NO: 3302860 - DNA, 14 bp, Homo sapiens
tttggcacttgtat

SEQ ID NO: 3302861 - DNA, 19 bp, Homo sapiens
tttggcacttgtatttaat

SEQ ID NO: 3302862 - DNA, 22 bp, Homo sapiens
tttggcctgtttgatgtatgtg

SEQ ID NO: 3302863 - DNA, 16 bp, Homo sapiens
tttggctagtccttgt

SEQ ID NO: 3302864 - DNA, 18 bp, Homo sapiens
tttggctcctctagtaag

SEQ ID NO: 3302865 - DNA, 14 bp, Homo sapiens
tttggctctttcag

SEQ ID NO: 3302866 - DNA, 14 bp, Homo sapiens
tttggcttcatttc

SEQ ID NO: 3302867 - DNA, 16 bp, Homo sapiens
tttggcttcatttcaa

SEQ ID NO: 3302868 - DNA, 19 bp, Homo sapiens
tttgggaaagatggataaa

SEQ ID NO: 3302869 - DNA, 14 bp, Homo sapiens
tttgggacttctac

SEQ ID NO: 3302870 - DNA, 18 bp, Homo sapiens
tttgggagacatgtgaca

SEQ ID NO: 3302871 - DNA, 21 bp, Homo sapiens
tttgggagacatgtgacattt

SEQ ID NO: 3302872 - DNA, 14 bp, Homo sapiens
tttgggaggccaag

SEQ ID NO: 3302873 - DNA, 12 bp, Homo sapiens
tttgggcagagc

SEQ ID NO: 3302874 - DNA, 14 bp, Homo sapiens
tttggggaaaaaag

SEQ ID NO: 3302875 - DNA, 23 bp, Homo sapiens
tttggggaaaaaagcacatacat

SEQ ID NO: 3302876 - DNA, 17 bp, Homo sapiens
tttggggaaacctagag

SEQ ID NO: 3302877 - DNA, 19 bp, Homo sapiens
tttggggagggggaagaga

SEQ ID NO: 3302878 - DNA, 22 bp, Homo sapiens
tttgggggaaaatttagaaata

SEQ ID NO: 3302879 - DNA, 22 bp, Homo sapiens
tttgggtatgtttaatctgtta

SEQ ID NO: 3302880 - DNA, 22 bp, Homo sapiens
tttgggtctacaagtatatgtg

SEQ ID NO: 3302881 - DNA, 23 bp, Homo sapiens
tttgggtggggggcattgagtat

SEQ ID NO: 3302882 - DNA, 14 bp, Homo sapiens
tttggtaaaaatgc

SEQ ID NO: 3302883 - DNA, 18 bp, Homo sapiens
tttggtaattttttttgt

SEQ ID NO: 3302884 - DNA, 21 bp, Homo sapiens
tttggtagctgggaaagcata

SEQ ID NO: 3302885 - DNA, 21 bp, Homo sapiens
tttggtccttcaaaggcttgt

SEQ ID NO: 3302886 - DNA, 14 bp, Homo sapiens
tttggtctgggact

SEQ ID NO: 3302887 - DNA, 12 bp, Homo sapiens
tttggtgctttt

SEQ ID NO: 3302888 - DNA, 22 bp, Homo sapiens
tttggttaagttggcttctgtt

SEQ ID NO: 3302889 - DNA, 15 bp, Homo sapiens
tttggtttactttca

SEQ ID NO: 3302890 - DNA, 19 bp, Homo sapiens
tttggtttgacttgtttgt

SEQ ID NO: 3302891 - DNA, 22 bp, Homo sapiens
tttgtaaaaacagcattgcttt

SEQ ID NO: 3302892 - DNA, 22 bp, Homo sapiens
tttgtaaaaatcttttgaagca

SEQ ID NO: 3302893 - DNA, 21 bp, Homo sapiens
tttgtaaaagaacagtaaaca

SEQ ID NO: 3302894 - DNA, 22 bp, Homo sapiens
tttgtaaactcaaaatatttgt

SEQ ID NO: 3302895 - DNA, 23 bp, Homo sapiens
tttgtaaagaaatttactatata

SEQ ID NO: 3302896 - DNA, 19 bp, Homo sapiens
tttgtaaagttgcctttat

SEQ ID NO: 3302897 - DNA, 17 bp, Homo sapiens
tttgtaaataagagatt

SEQ ID NO: 3302898 - DNA, 14 bp, Homo sapiens
tttgtaaataggat

SEQ ID NO: 3302899 - DNA, 17 bp, Homo sapiens
tttgtaaattaatactt

SEQ ID NO: 3302900 - DNA, 16 bp, Homo sapiens
tttgtaacctcagctc

SEQ ID NO: 3302901 - DNA, 21 bp, Homo sapiens
tttgtaactacaaagctttgc

SEQ ID NO: 3302902 - DNA, 22 bp, Homo sapiens
tttgtaactacaaagctttgct

SEQ ID NO: 3302903 - DNA, 16 bp, Homo sapiens
tttgtaagacatttgt

SEQ ID NO: 3302904 - DNA, 17 bp, Homo sapiens
tttgtaagagtgtagaa

SEQ ID NO: 3302905 - DNA, 19 bp, Homo sapiens
tttgtaagagtgtagaagc

SEQ ID NO: 3302906 - DNA, 23 bp, Homo sapiens
tttgtaagagtgtagaagcattc

SEQ ID NO: 3302907 - DNA, 21 bp, Homo sapiens
tttgtaatcactcccattttt

SEQ ID NO: 3302908 - DNA, 13 bp, Homo sapiens
tttgtaatgtgaa

SEQ ID NO: 3302909 - DNA, 18 bp, Homo sapiens
tttgtaatgtgaaaagta

SEQ ID NO: 3302910 - DNA, 15 bp, Homo sapiens
tttgtaatgtgtgaa

SEQ ID NO: 3302911 - DNA, 20 bp, Homo sapiens
tttgtaattgcttacatttt

SEQ ID NO: 3302912 - DNA, 16 bp, Homo sapiens
tttgtaattgtgtaaa

SEQ ID NO: 3302913 - DNA, 20 bp, Homo sapiens
tttgtaatttttggggaaaa

SEQ ID NO: 3302914 - DNA, 23 bp, Homo sapiens
tttgtacaaaaaaaaagttttat

SEQ ID NO: 3302915 - DNA, 13 bp, Homo sapiens
tttgtacaaagtt

SEQ ID NO: 3302916 - DNA, 18 bp, Homo sapiens
tttgtacaaagttttcct

SEQ ID NO: 3302917 - DNA, 19 bp, Homo sapiens
tttgtacaaagttttcctt

SEQ ID NO: 3302918 - DNA, 19 bp, Homo sapiens
tttgtacaaggtaattgtt

SEQ ID NO: 3302919 - DNA, 20 bp, Homo sapiens
tttgtacaaggtaattgttt

SEQ ID NO: 3302920 - DNA, 14 bp, Homo sapiens
tttgtacactgctg

SEQ ID NO: 3302921 - DNA, 17 bp, Homo sapiens
tttgtacagtttgctgt

SEQ ID NO: 3302922 - DNA, 12 bp, Homo sapiens
tttgtacatctg

SEQ ID NO: 3302923 - DNA, 19 bp, Homo sapiens
tttgtacatctggcttatt

SEQ ID NO: 3302924 - DNA, 11 bp, Homo sapiens
tttgtacatgt

SEQ ID NO: 3302925 - DNA, 18 bp, Homo sapiens
tttgtaccccccaacccc

SEQ ID NO: 3302926 - DNA, 20 bp, Homo sapiens
tttgtaccccccaacccctg

SEQ ID NO: 3302927 - DNA, 14 bp, Homo sapiens
tttgtactgaaaaa

SEQ ID NO: 3302928 - DNA, 15 bp, Homo sapiens
tttgtactgaaaaat

SEQ ID NO: 3302929 - DNA, 16 bp, Homo sapiens
tttgtactgtaaagag

SEQ ID NO: 3302930 - DNA, 15 bp, Homo sapiens
tttgtacttcttatt

SEQ ID NO: 3302931 - DNA, 20 bp, Homo sapiens
tttgtacttggaagtgtttc

SEQ ID NO: 3302932 - DNA, 19 bp, Homo sapiens
tttgtagattaggattaaa

SEQ ID NO: 3302933 - DNA, 10 bp, Homo sapiens
tttgtagcat

SEQ ID NO: 3302934 - DNA, 16 bp, Homo sapiens
tttgtagcataactgt

SEQ ID NO: 3302935 - DNA, 23 bp, Homo sapiens
tttgtagcataactgtagctcaa

SEQ ID NO: 3302936 - DNA, 21 bp, Homo sapiens
tttgtaggaaggtctcattct

SEQ ID NO: 3302937 - DNA, 23 bp, Homo sapiens
tttgtaggaaggtctcattcttc

SEQ ID NO: 3302938 - DNA, 20 bp, Homo sapiens
tttgtaggggtcaaagaaat

SEQ ID NO: 3302939 - DNA, 21 bp, Homo sapiens
tttgtaggggtcaaagaaatg

SEQ ID NO: 3302940 - DNA, 23 bp, Homo sapiens
tttgtaggggtcaaagaaatgct

SEQ ID NO: 3302941 - DNA, 14 bp, Homo sapiens
tttgtaggtaaaat

SEQ ID NO: 3302942 - DNA, 14 bp, Homo sapiens
tttgtataaataat

SEQ ID NO: 3302943 - DNA, 19 bp, Homo sapiens
tttgtatacaaatatattg

SEQ ID NO: 3302944 - DNA, 18 bp, Homo sapiens
tttgtatatacagttatt

SEQ ID NO: 3302945 - DNA, 21 bp, Homo sapiens
tttgtatatacagttattttg

SEQ ID NO: 3302946 - DNA, 13 bp, Homo sapiens
tttgtatatccta

SEQ ID NO: 3302947 - DNA, 14 bp, Homo sapiens
tttgtatattacac

SEQ ID NO: 3302948 - DNA, 22 bp, Homo sapiens
tttgtatcttccatatttggaa

SEQ ID NO: 3302949 - DNA, 13 bp, Homo sapiens
tttgtatctttat

SEQ ID NO: 3302950 - DNA, 18 bp, Homo sapiens
tttgtatctttatgctgt

SEQ ID NO: 3302951 - DNA, 22 bp, Homo sapiens
tttgtatgccaagtgagaagat

SEQ ID NO: 3302952 - DNA, 13 bp, Homo sapiens
tttgtattaataa

SEQ ID NO: 3302953 - DNA, 17 bp, Homo sapiens
tttgtattaataaagca

SEQ ID NO: 3302954 - DNA, 17 bp, Homo sapiens
tttgtattactttctct

SEQ ID NO: 3302955 - DNA, 19 bp, Homo sapiens
tttgtattactttctctgt

SEQ ID NO: 3302956 - DNA, 19 bp, Homo sapiens
tttgtattgttaatatctt

SEQ ID NO: 3302957 - DNA, 14 bp, Homo sapiens
tttgtattttcatg

SEQ ID NO: 3302958 - DNA, 19 bp, Homo sapiens
tttgtattttttatttaca

SEQ ID NO: 3302959 - DNA, 14 bp, Homo sapiens
tttgtcaaactgta

SEQ ID NO: 3302960 - DNA, 16 bp, Homo sapiens
tttgtcaaactgtaga

SEQ ID NO: 3302961 - DNA, 16 bp, Homo sapiens
tttgtcacattattta

SEQ ID NO: 3302962 - DNA, 14 bp, Homo sapiens
tttgtcactttttc

SEQ ID NO: 3302963 - DNA, 15 bp, Homo sapiens
tttgtcactttttct

SEQ ID NO: 3302964 - DNA, 14 bp, Homo sapiens
tttgtcagacttta

SEQ ID NO: 3302965 - DNA, 23 bp, Homo sapiens
ttttgcacagttagttgtgaaag

SEQ ID NO: 3302966 - DNA, 16 bp, Homo sapiens
ttttgcacccctccca

SEQ ID NO: 3302967 - DNA, 13 bp, Homo sapiens
ttttgcagaagag

SEQ ID NO: 3302968 - DNA, 17 bp, Homo sapiens
ttttgcatactgaaaat

SEQ ID NO: 3302969 - DNA, 12 bp, Homo sapiens
ttttgcatgaaa

SEQ ID NO: 3302970 - DNA, 13 bp, Homo sapiens
ttttgcatttatg

SEQ ID NO: 3302971 - DNA, 16 bp, Homo sapiens
ttttgccacagctttt

SEQ ID NO: 3302972 - DNA, 23 bp, Homo sapiens
ttttgccatgttggccaggctgg

SEQ ID NO: 3302973 - DNA, 18 bp, Homo sapiens
ttttgcccttcacagtgt

SEQ ID NO: 3302974 - DNA, 13 bp, Homo sapiens
ttttgcctggctg

SEQ ID NO: 3302975 - DNA, 23 bp, Homo sapiens
ttttgcctgtgactgtaaagagt

SEQ ID NO: 3302976 - DNA, 16 bp, Homo sapiens
ttttgctataatcatt

SEQ ID NO: 3302977 - DNA, 15 bp, Homo sapiens
ttttgctcagttcca

SEQ ID NO: 3302978 - DNA, 21 bp, Homo sapiens
ttttgctgttgtttctaaaca

SEQ ID NO: 3302979 - DNA, 19 bp, Homo sapiens
ttttgcttttaattaaata

SEQ ID NO: 3302980 - DNA, 11 bp, Homo sapiens
ttttggaaact

SEQ ID NO: 3302981 - DNA, 13 bp, Homo sapiens
ttttggaatttgc

SEQ ID NO: 3302982 - DNA, 21 bp, Homo sapiens
ttttggactcagcccacctgc

SEQ ID NO: 3302983 - DNA, 20 bp, Homo sapiens
ttttggagaaggttatcaaa

SEQ ID NO: 3302984 - DNA, 16 bp, Homo sapiens
ttttggccaaagtgtt

SEQ ID NO: 3302985 - DNA, 17 bp, Homo sapiens
ttttggccaaagtgtta

SEQ ID NO: 3302986 - DNA, 18 bp, Homo sapiens
ttttggcctgtttgatgt

SEQ ID NO: 3302987 - DNA, 20 bp, Homo sapiens
ttttggctagagtttccact

SEQ ID NO: 3302988 - DNA, 16 bp, Homo sapiens
ttttggggagccagaa

SEQ ID NO: 3302989 - DNA, 18 bp, Homo sapiens
ttttggggggtaatcagc

SEQ ID NO: 3302990 - DNA, 18 bp, Homo sapiens
ttttgggggtgtgagtgt

SEQ ID NO: 3302991 - DNA, 16 bp, Homo sapiens
ttttggtagattaaat

SEQ ID NO: 3302992 - DNA, 21 bp, Homo sapiens
ttttggtccaagttgtgctta

SEQ ID NO: 3302993 - DNA, 12 bp, Homo sapiens
ttttggtgtatt

SEQ ID NO: 3302994 - DNA, 13 bp, Homo sapiens
ttttggtgtgttg

SEQ ID NO: 3302995 - DNA, 16 bp, Homo sapiens
ttttggttcttagttc

SEQ ID NO: 3302996 - DNA, 20 bp, Homo sapiens
ttttggttttaaaagcacaa

SEQ ID NO: 3302997 - DNA, 21 bp, Homo sapiens
ttttgtaaactggaattaaaa

SEQ ID NO: 3302998 - DNA, 19 bp, Homo sapiens
ttttgtaaatactgcttga

SEQ ID NO: 3302999 - DNA, 12 bp, Homo sapiens
ttttgtaacttg

SEQ ID NO: 3303000 - DNA, 13 bp, Homo sapiens
ttttgtaagataa

SEQ ID NO: 3303001 - DNA, 15 bp, Homo sapiens
ttttgtaagatgctg

SEQ ID NO: 3303002 - DNA, 16 bp, Homo sapiens
ttttgtaattgtgtaa

SEQ ID NO: 3303003 - DNA, 16 bp, Homo sapiens
ttttgtacatattgtt

SEQ ID NO: 3303004 - DNA, 19 bp, Homo sapiens
ttttgtagagccagggtct

SEQ ID NO: 3303005 - DNA, 23 bp, Homo sapiens
ttttgtaggggtcaaagaaatgc

SEQ ID NO: 3303006 - DNA, 14 bp, Homo sapiens
ttttgtataactta

SEQ ID NO: 3303007 - DNA, 11 bp, Homo sapiens
ttttgtataca

SEQ ID NO: 3303008 - DNA, 13 bp, Homo sapiens
ttttgtatacatc

SEQ ID NO: 3303009 - DNA, 15 bp, Homo sapiens
ttttgtatatacagt

SEQ ID NO: 3303010 - DNA, 13 bp, Homo sapiens
ttttgtatatatc

SEQ ID NO: 3303011 - DNA, 14 bp, Homo sapiens
ttttgtatcttcct

SEQ ID NO: 3303012 - DNA, 18 bp, Homo sapiens
ttttgtatcttcctttct

SEQ ID NO: 3303013 - DNA, 21 bp, Homo sapiens
ttttgtattacatctaatgct

SEQ ID NO: 3303014 - DNA, 15 bp, Homo sapiens
ttttgtatttttaat

SEQ ID NO: 3303015 - DNA, 15 bp, Homo sapiens
ttttgtatttttgat

SEQ ID NO: 3303016 - DNA, 16 bp, Homo sapiens
ttttgtcacattattt

SEQ ID NO: 3303017 - DNA, 23 bp, Homo sapiens
ttttgtcacattatttattaaaa

SEQ ID NO: 3303018 - DNA, 12 bp, Homo sapiens
ttttgtcttgaa

SEQ ID NO: 3303019 - DNA, 14 bp, Homo sapiens
ttttgtgaagtatt

SEQ ID NO: 3303020 - DNA, 23 bp, Homo sapiens
ttttgtgaatggattggattatt

SEQ ID NO: 3303021 - DNA, 23 bp, Homo sapiens
ttttgtgactatatagagatgtt

SEQ ID NO: 3303022 - DNA, 12 bp, Homo sapiens
ttttgtgcattc

SEQ ID NO: 3303023 - DNA, 13 bp, Homo sapiens
ttttgtgcattct

SEQ ID NO: 3303024 - DNA, 19 bp, Homo sapiens
ttttgtgcattctttggta

SEQ ID NO: 3303025 - DNA, 12 bp, Homo sapiens
ttttgtggggct

SEQ ID NO: 3303026 - DNA, 13 bp, Homo sapiens
ttttgtgtacagt

SEQ ID NO: 3303027 - DNA, 20 bp, Homo sapiens
ttttgtgtgaccaactgtgt

SEQ ID NO: 3303028 - DNA, 22 bp, Homo sapiens
ttttgttaaagctggaacattt

SEQ ID NO: 3303029 - DNA, 12 bp, Homo sapiens
ttttgttactgt

SEQ ID NO: 3303030 - DNA, 18 bp, Homo sapiens
ttttgttactgttcttgc

SEQ ID NO: 3303031 - DNA, 14 bp, Homo sapiens
ttttgttatagaat

SEQ ID NO: 3303032 - DNA, 15 bp, Homo sapiens
ttttgttccacaagt

SEQ ID NO: 3303033 - DNA, 23 bp, Homo sapiens
ttttgttcgcatggtcacacact

SEQ ID NO: 3303034 - DNA, 19 bp, Homo sapiens
ttttgttcttaattgcact

SEQ ID NO: 3303035 - DNA, 22 bp, Homo sapiens
ttttgttcttacacatacagtt

SEQ ID NO: 3303036 - DNA, 11 bp, Homo sapiens
ttttgttgaaa

SEQ ID NO: 3303037 - DNA, 13 bp, Homo sapiens
ttttgttggcata

SEQ ID NO: 3303038 - DNA, 21 bp, Homo sapiens
ttttgttggcatagctctggg

SEQ ID NO: 3303039 - DNA, 15 bp, Homo sapiens
ttttgttgtaaaaag

SEQ ID NO: 3303040 - DNA, 19 bp, Homo sapiens
ttttgttgtacttaaatgg

SEQ ID NO: 3303041 - DNA, 17 bp, Homo sapiens
ttttgttgtatgggatt

SEQ ID NO: 3303042 - DNA, 17 bp, Homo sapiens
ttttgtttaaaactcag

SEQ ID NO: 3303043 - DNA, 14 bp, Homo sapiens
ttttgtttgatgca

SEQ ID NO: 3303044 - DNA, 18 bp, Homo sapiens
ttttgtttggagacgttt

SEQ ID NO: 3303045 - DNA, 12 bp, Homo sapiens
ttttgtttgtct

SEQ ID NO: 3303046 - DNA, 17 bp, Homo sapiens
ttttgtttgtctctcct

SEQ ID NO: 3303047 - DNA, 16 bp, Homo sapiens
ttttgttttacaatgt

SEQ ID NO: 3303048 - DNA, 15 bp, Homo sapiens
ttttgttttggctga

SEQ ID NO: 3303049 - DNA, 14 bp, Homo sapiens
ttttgtttttgtta

SEQ ID NO: 3303050 - DNA, 22 bp, Homo sapiens
tttttaaaaatgtgtcaaaata

SEQ ID NO: 3303051 - DNA, 13 bp, Homo sapiens
tttttaaaacact

SEQ ID NO: 3303052 - DNA, 23 bp, Homo sapiens
tttttaaaagttgttaccaaata

SEQ ID NO: 3303053 - DNA, 19 bp, Homo sapiens
tttttaaaagtttcaatgt

SEQ ID NO: 3303054 - DNA, 18 bp, Homo sapiens
tttttaaagaagagtgac

SEQ ID NO: 3303055 - DNA, 12 bp, Homo sapiens
tttttaaagaca

SEQ ID NO: 3303056 - DNA, 14 bp, Homo sapiens
tttttaaagtactt

SEQ ID NO: 3303057 - DNA, 18 bp, Homo sapiens
tttttaaagttactttgt

SEQ ID NO: 3303058 - DNA, 12 bp, Homo sapiens
tttttaaagttt

SEQ ID NO: 3303059 - DNA, 11 bp, Homo sapiens
tttttaaataa

SEQ ID NO: 3303060 - DNA, 15 bp, Homo sapiens
tttttaaataaactt

SEQ ID NO: 3303061 - DNA, 13 bp, Homo sapiens
tttttaaatagag

SEQ ID NO: 3303062 - DNA, 13 bp, Homo sapiens
tttttaaatcata

SEQ ID NO: 3303063 - DNA, 20 bp, Homo sapiens
tttttaaatgtaaagatatt

SEQ ID NO: 3303064 - DNA, 12 bp, Homo sapiens
tttttaaattat

SEQ ID NO: 3303065 - DNA, 20 bp, Homo sapiens
tttttaaattttcttcagtt

SEQ ID NO: 3303066 - DNA, 13 bp, Homo sapiens
tttttaacacata

SEQ ID NO: 3303067 - DNA, 14 bp, Homo sapiens
tttttaacagcatg

SEQ ID NO: 3303068 - DNA, 23 bp, Homo sapiens
tttttaaccaagtcgctcctagg

SEQ ID NO: 3303069 - DNA, 14 bp, Homo sapiens
tttttaacctgttt

SEQ ID NO: 3303070 - DNA, 12 bp, Homo sapiens
tttttaagaaaa

SEQ ID NO: 3303071 - DNA, 16 bp, Homo sapiens
tttttaagaatatctg

SEQ ID NO: 3303072 - DNA, 18 bp, Homo sapiens
tttttaagctatcagcaa

SEQ ID NO: 3303073 - DNA, 18 bp, Homo sapiens
tttttaagtaagactttt

SEQ ID NO: 3303074 - DNA, 16 bp, Homo sapiens
tttttaagtatttata

SEQ ID NO: 3303075 - DNA, 17 bp, Homo sapiens
tttttaatcatgaatat

SEQ ID NO: 3303076 - DNA, 16 bp, Homo sapiens
tttttaatctagacaa

SEQ ID NO: 3303077 - DNA, 15 bp, Homo sapiens
tttttaatgaccaat

SEQ ID NO: 3303078 - DNA, 20 bp, Homo sapiens
tttttaatgaccaattgagt

SEQ ID NO: 3303079 - DNA, 18 bp, Homo sapiens
tttttaattgttgtttct

SEQ ID NO: 3303080 - DNA, 17 bp, Homo sapiens
tttttaatttgatgaaa

SEQ ID NO: 3303081 - DNA, 16 bp, Homo sapiens
tttttaattttaacat

SEQ ID NO: 3303082 - DNA, 19 bp, Homo sapiens
tttttaattttgatataca

SEQ ID NO: 3303083 - DNA, 13 bp, Homo sapiens
tttttacaagaag

SEQ ID NO: 3303084 - DNA, 18 bp, Homo sapiens
tttttacaagttttaaat

SEQ ID NO: 3303085 - DNA, 13 bp, Homo sapiens
tttttacagctgt

SEQ ID NO: 3303086 - DNA, 23 bp, Homo sapiens
tttttactcattgaaatgtcacg

SEQ ID NO: 3303087 - DNA, 20 bp, Homo sapiens
tttttagattgagaaatgtg

SEQ ID NO: 3303088 - DNA, 13 bp, Homo sapiens
tttttataattgt

SEQ ID NO: 3303089 - DNA, 17 bp, Homo sapiens
tttttataccattcaga

SEQ ID NO: 3303090 - DNA, 12 bp, Homo sapiens
tttttatactgc

SEQ ID NO: 3303091 - DNA, 23 bp, Homo sapiens
tttttatactgcacagtggcaca

SEQ ID NO: 3303092 - DNA, 18 bp, Homo sapiens
tttttatagcaacaacaa

SEQ ID NO: 3303093 - DNA, 16 bp, Homo sapiens
aaaaagggagtttttg

SEQ ID NO: 3303094 - DNA, 18 bp, Homo sapiens
aaaaaggtggtatgtaat

SEQ ID NO: 3303095 - DNA, 14 bp, Homo sapiens
aaaaagtatttttt

SEQ ID NO: 3303096 - DNA, 20 bp, Homo sapiens
aaaaagtatttttttaagtt

SEQ ID NO: 3303097 - DNA, 20 bp, Homo sapiens
aaaaagtcagactgctggga

SEQ ID NO: 3303098 - DNA, 13 bp, Homo sapiens
aaaaagtgacaca

SEQ ID NO: 3303099 - DNA, 14 bp, Homo sapiens
aaaaagtgacacag

SEQ ID NO: 3303100 - DNA, 12 bp, Homo sapiens
aaaaagtgtcaa

SEQ ID NO: 3303101 - DNA, 13 bp, Homo sapiens
aaaaagttgttca

SEQ ID NO: 3303102 - DNA, 14 bp, Homo sapiens
aaaaagttgttcaa

SEQ ID NO: 3303103 - DNA, 14 bp, Homo sapiens
aaaaagtttccata

SEQ ID NO: 3303104 - DNA, 17 bp, Homo sapiens
aaaaagttttatttttc

SEQ ID NO: 3303105 - DNA, 13 bp, Homo sapiens
aaaaagttttgat

SEQ ID NO: 3303106 - DNA, 14 bp, Homo sapiens
aaaaataaaactgt

SEQ ID NO: 3303107 - DNA, 13 bp, Homo sapiens
aaaaataaaagaa

SEQ ID NO: 3303108 - DNA, 21 bp, Homo sapiens
aaaaataaatttggttctaat

SEQ ID NO: 3303109 - DNA, 14 bp, Homo sapiens
aaaaatagacatgt

SEQ ID NO: 3303110 - DNA, 22 bp, Homo sapiens
aaaaatataaaattatgagatt

SEQ ID NO: 3303111 - DNA, 14 bp, Homo sapiens
aaaaatataactta

SEQ ID NO: 3303112 - DNA, 13 bp, Homo sapiens
aaaaatatactga

SEQ ID NO: 3303113 - DNA, 19 bp, Homo sapiens
aaaaatatatttaatgata

SEQ ID NO: 3303114 - DNA, 16 bp, Homo sapiens
aaaaatatcaggagct

SEQ ID NO: 3303115 - DNA, 14 bp, Homo sapiens
aaaaatatgaacct

SEQ ID NO: 3303116 - DNA, 10 bp, Homo sapiens
aaaaatatta

SEQ ID NO: 3303117 - DNA, 18 bp, Homo sapiens
aaaaatattcctccaaat

SEQ ID NO: 3303118 - DNA, 20 bp, Homo sapiens
aaaaatattcctccaaatct

SEQ ID NO: 3303119 - DNA, 22 bp, Homo sapiens
aaaaatattcctccaaatctct

SEQ ID NO: 3303120 - DNA, 11 bp, Homo sapiens
aaaaatattgt

SEQ ID NO: 3303121 - DNA, 21 bp, Homo sapiens
aaaaatcatgccagtattttt

SEQ ID NO: 3303122 - DNA, 23 bp, Homo sapiens
aaaaatccattttacacagcacc

SEQ ID NO: 3303123 - DNA, 14 bp, Homo sapiens
aaaaatctagtttt

SEQ ID NO: 3303124 - DNA, 16 bp, Homo sapiens
aaaaatctagtttttt

SEQ ID NO: 3303125 - DNA, 13 bp, Homo sapiens
aaaaatgacaaca

SEQ ID NO: 3303126 - DNA, 15 bp, Homo sapiens
aaaaatgcctttgag

SEQ ID NO: 3303127 - DNA, 18 bp, Homo sapiens
aaaaatgcctttgagaca

SEQ ID NO: 3303128 - DNA, 19 bp, Homo sapiens
aaaaatgcctttgagacag

SEQ ID NO: 3303129 - DNA, 22 bp, Homo sapiens
aaaaatgcctttgagacagttt

SEQ ID NO: 3303130 - DNA, 12 bp, Homo sapiens
aaaaatgctgct

SEQ ID NO: 3303131 - DNA, 15 bp, Homo sapiens
aaaaatgctgcttct

SEQ ID NO: 3303132 - DNA, 15 bp, Homo sapiens
aaaaatggaactgtg

SEQ ID NO: 3303133 - DNA, 23 bp, Homo sapiens
aaaaatggatattattagaaatt

SEQ ID NO: 3303134 - DNA, 22 bp, Homo sapiens
aaaaatgggagacagcctctta

SEQ ID NO: 3303135 - DNA, 19 bp, Homo sapiens
aaaaatggttgatggaaaa

SEQ ID NO: 3303136 - DNA, 20 bp, Homo sapiens
aaaaatggttgatggaaaat

SEQ ID NO: 3303137 - DNA, 21 bp, Homo sapiens
aaaaatgtaacatcataatta

SEQ ID NO: 3303138 - DNA, 19 bp, Homo sapiens
aaaaatgtgaaaaaaatta

SEQ ID NO: 3303139 - DNA, 12 bp, Homo sapiens
aaaaatgtttgt

SEQ ID NO: 3303140 - DNA, 12 bp, Homo sapiens
aaaaattacaaa

SEQ ID NO: 3303141 - DNA, 16 bp, Homo sapiens
aaaaattgctctgtgt

SEQ ID NO: 3303142 - DNA, 11 bp, Homo sapiens
aaaaattgttt

SEQ ID NO: 3303143 - DNA, 13 bp, Homo sapiens
aaaaattgtttct

SEQ ID NO: 3303144 - DNA, 16 bp, Homo sapiens
aaaaattgtttcttga

SEQ ID NO: 3303145 - DNA, 11 bp, Homo sapiens
aaaaatttaaa

SEQ ID NO: 3303146 - DNA, 15 bp, Homo sapiens
aaaaatttaaaagta

SEQ ID NO: 3303147 - DNA, 21 bp, Homo sapiens
aaaaatttaaaattacgtttg

SEQ ID NO: 3303148 - DNA, 21 bp, Homo sapiens
aaaaatttaaagggtgtactt

SEQ ID NO: 3303149 - DNA, 20 bp, Homo sapiens
aaaaatttaagcattgtttg

SEQ ID NO: 3303150 - DNA, 10 bp, Homo sapiens
aaaacaaaaa

SEQ ID NO: 3303151 - DNA, 15 bp, Homo sapiens
aaaacaaaaagatgt

SEQ ID NO: 3303152 - DNA, 15 bp, Homo sapiens
aaaacaaactaaatg

SEQ ID NO: 3303153 - DNA, 14 bp, Homo sapiens
aaaacaaccaagcg

SEQ ID NO: 3303154 - DNA, 13 bp, Homo sapiens
aaaacaatctgta

SEQ ID NO: 3303155 - DNA, 13 bp, Homo sapiens
aaaacaatcttat

SEQ ID NO: 3303156 - DNA, 15 bp, Homo sapiens
aaaacacaagcaaaa

SEQ ID NO: 3303157 - DNA, 12 bp, Homo sapiens
aaaacacattgc

SEQ ID NO: 3303158 - DNA, 22 bp, Homo sapiens
aaaacaccgcttctgccttttc

SEQ ID NO: 3303159 - DNA, 21 bp, Homo sapiens
aaaacagaacatcattagaac

SEQ ID NO: 3303160 - DNA, 16 bp, Homo sapiens
aaaacagattctatat

SEQ ID NO: 3303161 - DNA, 16 bp, Homo sapiens
aaaacagcattgcttt

SEQ ID NO: 3303162 - DNA, 21 bp, Homo sapiens
aaaacagccaccgtttcttcc

SEQ ID NO: 3303163 - DNA, 18 bp, Homo sapiens
aaaacagctctgcaggct

SEQ ID NO: 3303164 - DNA, 19 bp, Homo sapiens
aaaacaggtatatactttg

SEQ ID NO: 3303165 - DNA, 16 bp, Homo sapiens
aaaacatagcatctca

SEQ ID NO: 3303166 - DNA, 15 bp, Homo sapiens
aaaacatatttcatt

SEQ ID NO: 3303167 - DNA, 21 bp, Homo sapiens
aaaacatatttcattttaaca

SEQ ID NO: 3303168 - DNA, 16 bp, Homo sapiens
aaaacattgcttttga

SEQ ID NO: 3303169 - DNA, 11 bp, Homo sapiens
aaaacatttct

SEQ ID NO: 3303170 - DNA, 15 bp, Homo sapiens
aaaacattttgaagt

SEQ ID NO: 3303171 - DNA, 13 bp, Homo sapiens
aaaacatttttaa

SEQ ID NO: 3303172 - DNA, 12 bp, Homo sapiens
aaaaccaaatta

SEQ ID NO: 3303173 - DNA, 14 bp, Homo sapiens
aaaaccaatgattc

SEQ ID NO: 3303174 - DNA, 14 bp, Homo sapiens
aaaaccacaaaggc

SEQ ID NO: 3303175 - DNA, 12 bp, Homo sapiens
aaaaccacacaa

SEQ ID NO: 3303176 - DNA, 18 bp, Homo sapiens
aaaaccactgaacatttg

SEQ ID NO: 3303177 - DNA, 12 bp, Homo sapiens
aaaaccatattt

SEQ ID NO: 3303178 - DNA, 18 bp, Homo sapiens
aaaaccatctggcctggc

SEQ ID NO: 3303179 - DNA, 13 bp, Homo sapiens
aaaaccatttgaa

SEQ ID NO: 3303180 - DNA, 15 bp, Homo sapiens
aaaaccattttagtt

SEQ ID NO: 3303181 - DNA, 20 bp, Homo sapiens
aaaaccgttcaaattctctt

SEQ ID NO: 3303182 - DNA, 20 bp, Homo sapiens
aaaacctaagtcctttatgt

SEQ ID NO: 3303183 - DNA, 21 bp, Homo sapiens
aaaacctaagtcctttatgtg

SEQ ID NO: 3303184 - DNA, 12 bp, Homo sapiens
aaaacctaccag

SEQ ID NO: 3303185 - DNA, 18 bp, Homo sapiens
aaaacctgaactttcatt

SEQ ID NO: 3303186 - DNA, 15 bp, Homo sapiens
aaaacctgcagttaa

SEQ ID NO: 3303187 - DNA, 23 bp, Homo sapiens
aaaaccttagctccctcccgcac

SEQ ID NO: 3303188 - DNA, 23 bp, Homo sapiens
aaaaccttgtaaaaaaagcaaaa

SEQ ID NO: 3303189 - DNA, 13 bp, Homo sapiens
aaaacctttcaaa

SEQ ID NO: 3303190 - DNA, 14 bp, Homo sapiens
aaaacgaaaataaa

SEQ ID NO: 3303191 - DNA, 13 bp, Homo sapiens
aaaacgcctcttt

SEQ ID NO: 3303192 - DNA, 20 bp, Homo sapiens
aaaactaaggatttttcaag

SEQ ID NO: 3303193 - DNA, 22 bp, Homo sapiens
aaaactaggtaatgttttgtat

SEQ ID NO: 3303194 - DNA, 13 bp, Homo sapiens
aaaactatgtatt

SEQ ID NO: 3303195 - DNA, 15 bp, Homo sapiens
aaaactatgtattaa

SEQ ID NO: 3303196 - DNA, 14 bp, Homo sapiens
aaaactatttttgt

SEQ ID NO: 3303197 - DNA, 18 bp, Homo sapiens
aaaactcaacattactgt

SEQ ID NO: 3303198 - DNA, 16 bp, Homo sapiens
aaaactcccatttacg

SEQ ID NO: 3303199 - DNA, 16 bp, Homo sapiens
aaaactccgcccccag

SEQ ID NO: 3303200 - DNA, 12 bp, Homo sapiens
aaaactctactt

SEQ ID NO: 3303201 - DNA, 18 bp, Homo sapiens
aaaactgaaaatctaata

SEQ ID NO: 3303202 - DNA, 21 bp, Homo sapiens
aaaactgatgttactagcctc

SEQ ID NO: 3303203 - DNA, 16 bp, Homo sapiens
aaaactgcacagtgct

SEQ ID NO: 3303204 - DNA, 12 bp, Homo sapiens
aaaactgctttt

SEQ ID NO: 3303205 - DNA, 20 bp, Homo sapiens
aaaactgggataactgattt

SEQ ID NO: 3303206 - DNA, 22 bp, Homo sapiens
aaaactgggataactgatttct

SEQ ID NO: 3303207 - DNA, 20 bp, Homo sapiens
aaaactgttcttttgcattt

SEQ ID NO: 3303208 - DNA, 16 bp, Homo sapiens
aaaacttaaaagtatt

SEQ ID NO: 3303209 - DNA, 17 bp, Homo sapiens
aaaacttaacatattta

SEQ ID NO: 3303210 - DNA, 11 bp, Homo sapiens
aaaacttcaaa

SEQ ID NO: 3303211 - DNA, 22 bp, Homo sapiens
aaaacttcaaagctgaatattt

SEQ ID NO: 3303212 - DNA, 17 bp, Homo sapiens
aaaacttcatgtaattt

SEQ ID NO: 3303213 - DNA, 21 bp, Homo sapiens
aaaacttgactccatttcatc

SEQ ID NO: 3303214 - DNA, 15 bp, Homo sapiens
aaaacttggcacttt

SEQ ID NO: 3303215 - DNA, 17 bp, Homo sapiens
aaaacttgtaaatgctg

SEQ ID NO: 3303216 - DNA, 15 bp, Homo sapiens
aaaactttaaacctg

SEQ ID NO: 3303217 - DNA, 17 bp, Homo sapiens
aaaactttatgtactgc

SEQ ID NO: 3303218 - DNA, 12 bp, Homo sapiens
aaaactttcatt

SEQ ID NO: 3303219 - DNA, 15 bp, Homo sapiens
aaaacttttctgctg

SEQ ID NO: 3303220 - DNA, 17 bp, Homo sapiens
aaaagaaaaaaaaaaga

SEQ ID NO: 3303221 - DNA, 13 bp, Homo sapiens
aaaattgtgatca

SEQ ID NO: 3303222 - DNA, 13 bp, Homo sapiens
aaaattgttttca

SEQ ID NO: 3303223 - DNA, 20 bp, Homo sapiens
aaaattgttttcacttgtat

SEQ ID NO: 3303224 - DNA, 17 bp, Homo sapiens
aaaatttaaaagtaaaa

SEQ ID NO: 3303225 - DNA, 19 bp, Homo sapiens
aaaatttaaaagtaaaatg

SEQ ID NO: 3303226 - DNA, 16 bp, Homo sapiens
aaaatttaagcattgt

SEQ ID NO: 3303227 - DNA, 19 bp, Homo sapiens
aaaatttaagtatcttttt

SEQ ID NO: 3303228 - DNA, 18 bp, Homo sapiens
aaaatttaagtgcgtgtg

SEQ ID NO: 3303229 - DNA, 19 bp, Homo sapiens
aaaatttagaaatataatt

SEQ ID NO: 3303230 - DNA, 15 bp, Homo sapiens
aaaatttagtttttg

SEQ ID NO: 3303231 - DNA, 19 bp, Homo sapiens
aaaatttgactaattttac

SEQ ID NO: 3303232 - DNA, 12 bp, Homo sapiens
aaaattttactt

SEQ ID NO: 3303233 - DNA, 23 bp, Homo sapiens
aaaattttacttttgttctgtat

SEQ ID NO: 3303234 - DNA, 21 bp, Homo sapiens
aaaattttaggcactcttaaa

SEQ ID NO: 3303235 - DNA, 15 bp, Homo sapiens
aaaattttataagca

SEQ ID NO: 3303236 - DNA, 14 bp, Homo sapiens
aaaattttatagct

SEQ ID NO: 3303237 - DNA, 19 bp, Homo sapiens
aaaattttctcattttctt

SEQ ID NO: 3303238 - DNA, 21 bp, Homo sapiens
aaaattttgtatgttaaagag

SEQ ID NO: 3303239 - DNA, 10 bp, Homo sapiens
aaaattttta

SEQ ID NO: 3303240 - DNA, 21 bp, Homo sapiens
aaacaaaaattaggtattttg

SEQ ID NO: 3303241 - DNA, 19 bp, Homo sapiens
aaacaaacatgcagtactt

SEQ ID NO: 3303242 - DNA, 20 bp, Homo sapiens
aaacaaacatgcagtacttt

SEQ ID NO: 3303243 - DNA, 16 bp, Homo sapiens
aaacaaagtgactgtt

SEQ ID NO: 3303244 - DNA, 15 bp, Homo sapiens
aaacaaagtttcaga

SEQ ID NO: 3303245 - DNA, 23 bp, Homo sapiens
aaacaaagtttcagagtatattg

SEQ ID NO: 3303246 - DNA, 14 bp, Homo sapiens
aaacaaataaataa

SEQ ID NO: 3303247 - DNA, 17 bp, Homo sapiens
aaacaaataatcacatt

SEQ ID NO: 3303248 - DNA, 12 bp, Homo sapiens
aaacaaatatgc

SEQ ID NO: 3303249 - DNA, 14 bp, Homo sapiens
aaacaaatatgcaa

SEQ ID NO: 3303250 - DNA, 21 bp, Homo sapiens
aaacaaattcatattctgtct

SEQ ID NO: 3303251 - DNA, 17 bp, Homo sapiens
aaacaacatttatatgt

SEQ ID NO: 3303252 - DNA, 19 bp, Homo sapiens
aaacaagtggatgttttta

SEQ ID NO: 3303253 - DNA, 18 bp, Homo sapiens
aaacaagtttagaaagct

SEQ ID NO: 3303254 - DNA, 23 bp, Homo sapiens
aaacaatatgaggagacattctg

SEQ ID NO: 3303255 - DNA, 18 bp, Homo sapiens
aaacaatgttgtccaaca

SEQ ID NO: 3303256 - DNA, 22 bp, Homo sapiens
aaacaatgttgtccaacaataa

SEQ ID NO: 3303257 - DNA, 22 bp, Homo sapiens
aaacacaaaccacaactgacac

SEQ ID NO: 3303258 - DNA, 17 bp, Homo sapiens
aaacacaatacctacaa

SEQ ID NO: 3303259 - DNA, 20 bp, Homo sapiens
aaacacaatggagtgtgtaa

SEQ ID NO: 3303260 - DNA, 13 bp, Homo sapiens
aaacacagctgtt

SEQ ID NO: 3303261 - DNA, 17 bp, Homo sapiens
aaacacagggttttgta

SEQ ID NO: 3303262 - DNA, 19 bp, Homo sapiens
aaacacagtcaaaataatt

SEQ ID NO: 3303263 - DNA, 20 bp, Homo sapiens
aaacacagtcaaaataattc

SEQ ID NO: 3303264 - DNA, 14 bp, Homo sapiens
aaacacatcttccc

SEQ ID NO: 3303265 - DNA, 19 bp, Homo sapiens
aaacaccaacatgttggga

SEQ ID NO: 3303266 - DNA, 15 bp, Homo sapiens
aaacacctagcttta

SEQ ID NO: 3303267 - DNA, 14 bp, Homo sapiens
aaacacgaaacttg

SEQ ID NO: 3303268 - DNA, 17 bp, Homo sapiens
aaacacgaaacttgtta

SEQ ID NO: 3303269 - DNA, 13 bp, Homo sapiens
aaacactgaaaaa

SEQ ID NO: 3303270 - DNA, 13 bp, Homo sapiens
aaacactgtggaa

SEQ ID NO: 3303271 - DNA, 23 bp, Homo sapiens
aaacactgtggaactaataaata

SEQ ID NO: 3303272 - DNA, 14 bp, Homo sapiens
aaacagaaatggaa

SEQ ID NO: 3303273 - DNA, 15 bp, Homo sapiens
aaacagaactccctt

SEQ ID NO: 3303274 - DNA, 22 bp, Homo sapiens
aaacagacaatatgtgagtgcc

SEQ ID NO: 3303275 - DNA, 12 bp, Homo sapiens
aaacagacactg

SEQ ID NO: 3303276 - DNA, 16 bp, Homo sapiens
aaacagagacaggccc

SEQ ID NO: 3303277 - DNA, 16 bp, Homo sapiens
aaacagagcctgccta

SEQ ID NO: 3303278 - DNA, 21 bp, Homo sapiens
aaacagagtggcctccctgct

SEQ ID NO: 3303279 - DNA, 22 bp, Homo sapiens
aaacagagtggcctccctgctg

SEQ ID NO: 3303280 - DNA, 12 bp, Homo sapiens
aaacagatataa

SEQ ID NO: 3303281 - DNA, 17 bp, Homo sapiens
aaacagatgaccataat

SEQ ID NO: 3303282 - DNA, 18 bp, Homo sapiens
aaacagatgaccataatt

SEQ ID NO: 3303283 - DNA, 18 bp, Homo sapiens
aaacagatgtgaatattc

SEQ ID NO: 3303284 - DNA, 14 bp, Homo sapiens
aaacagatttttac

SEQ ID NO: 3303285 - DNA, 15 bp, Homo sapiens
aaacagatttttaca

SEQ ID NO: 3303286 - DNA, 12 bp, Homo sapiens
aaacagcatgaa

SEQ ID NO: 3303287 - DNA, 20 bp, Homo sapiens
aaacagccaccgtttcttcc

SEQ ID NO: 3303288 - DNA, 14 bp, Homo sapiens
aaacagccagcaag

SEQ ID NO: 3303289 - DNA, 14 bp, Homo sapiens
aaacagccatgtcc

SEQ ID NO: 3303290 - DNA, 13 bp, Homo sapiens
aaacagccattgc

SEQ ID NO: 3303291 - DNA, 19 bp, Homo sapiens
aaacagccccagtcttcct

SEQ ID NO: 3303292 - DNA, 22 bp, Homo sapiens
aaacagccgtcagccaaatgta

SEQ ID NO: 3303293 - DNA, 12 bp, Homo sapiens
aaacagctattt

SEQ ID NO: 3303294 - DNA, 16 bp, Homo sapiens
aaacagctatttaagg

SEQ ID NO: 3303295 - DNA, 17 bp, Homo sapiens
aaacagctcagccagtg

SEQ ID NO: 3303296 - DNA, 16 bp, Homo sapiens
aaacagctgtctctaa

SEQ ID NO: 3303297 - DNA, 19 bp, Homo sapiens
aaacagctttcaagtgcct

SEQ ID NO: 3303298 - DNA, 19 bp, Homo sapiens
aaacaggaattttattttg

SEQ ID NO: 3303299 - DNA, 18 bp, Homo sapiens
aaacaggagacaggaagg

SEQ ID NO: 3303300 - DNA, 13 bp, Homo sapiens
aaacaggcccagc

SEQ ID NO: 3303301 - DNA, 15 bp, Homo sapiens
aaacaggcccagcat

SEQ ID NO: 3303302 - DNA, 17 bp, Homo sapiens
aaacagggccacataga

SEQ ID NO: 3303303 - DNA, 22 bp, Homo sapiens
aaacagggctgccttctggcct

SEQ ID NO: 3303304 - DNA, 23 bp, Homo sapiens
aaacaggtatatactttgaaagg

SEQ ID NO: 3303305 - DNA, 18 bp, Homo sapiens
aaacagtatttcattgcc

SEQ ID NO: 3303306 - DNA, 23 bp, Homo sapiens
aaacagtccaaactgttctgaga

SEQ ID NO: 3303307 - DNA, 18 bp, Homo sapiens
aaacagtgggagccctga

SEQ ID NO: 3303308 - DNA, 18 bp, Homo sapiens
aaacagttggtaactttt

SEQ ID NO: 3303309 - DNA, 15 bp, Homo sapiens
aaacataaaaaccaa

SEQ ID NO: 3303310 - DNA, 15 bp, Homo sapiens
aaacataaaaagcag

SEQ ID NO: 3303311 - DNA, 16 bp, Homo sapiens
aaacataagagagcct

SEQ ID NO: 3303312 - DNA, 10 bp, Homo sapiens
aaacataatt

SEQ ID NO: 3303313 - DNA, 12 bp, Homo sapiens
aaacataattgt

SEQ ID NO: 3303314 - DNA, 20 bp, Homo sapiens
aaacataattgtggattata

SEQ ID NO: 3303315 - DNA, 18 bp, Homo sapiens
aaacatagagggagagag

SEQ ID NO: 3303316 - DNA, 15 bp, Homo sapiens
aaacatatgatttca

SEQ ID NO: 3303317 - DNA, 13 bp, Homo sapiens
aaacatatttgtg

SEQ ID NO: 3303318 - DNA, 23 bp, Homo sapiens
aaacatatttgtgaaaagagtat

SEQ ID NO: 3303319 - DNA, 19 bp, Homo sapiens
aaacatcaaataaatttct

SEQ ID NO: 3303320 - DNA, 22 bp, Homo sapiens
aaacatcacacacacagacaga

SEQ ID NO: 3303321 - DNA, 16 bp, Homo sapiens
aaacatcagacctgtc

SEQ ID NO: 3303322 - DNA, 19 bp, Homo sapiens
aaacatccaatattttctt

SEQ ID NO: 3303323 - DNA, 15 bp, Homo sapiens
aaacatgacactgac

SEQ ID NO: 3303324 - DNA, 21 bp, Homo sapiens
aaacatgcttgaataactgag

SEQ ID NO: 3303325 - DNA, 18 bp, Homo sapiens
aaacatggatacttcctg

SEQ ID NO: 3303326 - DNA, 18 bp, Homo sapiens
aaacatgtacaaaatcga

SEQ ID NO: 3303327 - DNA, 13 bp, Homo sapiens
aaacatgtattta

SEQ ID NO: 3303328 - DNA, 15 bp, Homo sapiens
aaacatgtatttatg

SEQ ID NO: 3303329 - DNA, 14 bp, Homo sapiens
aaacatgtgtttta

SEQ ID NO: 3303330 - DNA, 20 bp, Homo sapiens
aaacatgtttatttttcttg

SEQ ID NO: 3303331 - DNA, 21 bp, Homo sapiens
aaacatgtttatttttcttgt

SEQ ID NO: 3303332 - DNA, 18 bp, Homo sapiens
aaacattaattttgtgca

SEQ ID NO: 3303333 - DNA, 21 bp, Homo sapiens
aaacattaattttgtgcattc

SEQ ID NO: 3303334 - DNA, 20 bp, Homo sapiens
aaacattgaagtaatgaatt

SEQ ID NO: 3303335 - DNA, 17 bp, Homo sapiens
aaacattgtaaatattt

SEQ ID NO: 3303336 - DNA, 17 bp, Homo sapiens
aaacattgtgttgacat

SEQ ID NO: 3303337 - DNA, 16 bp, Homo sapiens
aaacatttactgacca

SEQ ID NO: 3303338 - DNA, 15 bp, Homo sapiens
aaacatttcatttcc

SEQ ID NO: 3303339 - DNA, 21 bp, Homo sapiens
aaacatttctggacagtacct

SEQ ID NO: 3303340 - DNA, 20 bp, Homo sapiens
aaacattttatttttaaaat

SEQ ID NO: 3303341 - DNA, 18 bp, Homo sapiens
aaacattttcatgcacag

SEQ ID NO: 3303342 - DNA, 17 bp, Homo sapiens
aaacattttgaagtgtg

SEQ ID NO: 3303343 - DNA, 19 bp, Homo sapiens
aaacattttgtcatataag

SEQ ID NO: 3303344 - DNA, 22 bp, Homo sapiens
aaaccaaaaaggctagtttatt

SEQ ID NO: 3303345 - DNA, 12 bp, Homo sapiens
aaaccaaaacat

SEQ ID NO: 3303346 - DNA, 20 bp, Homo sapiens
aaaccaaacttgttcattta

SEQ ID NO: 3303347 - DNA, 15 bp, Homo sapiens
aaaggcatctccctt

SEQ ID NO: 3303348 - DNA, 18 bp, Homo sapiens
aaaggccaaactgctgga

SEQ ID NO: 3303349 - DNA, 18 bp, Homo sapiens
aaaggccaaagataaaag

SEQ ID NO: 3303350 - DNA, 18 bp, Homo sapiens
aaaggccagtggaagaaa

SEQ ID NO: 3303351 - DNA, 17 bp, Homo sapiens
aaaggcccagcccctag

SEQ ID NO: 3303352 - DNA, 17 bp, Homo sapiens
aaaggccgccgtgacct

SEQ ID NO: 3303353 - DNA, 18 bp, Homo sapiens
aaaggccgccgtgaccta

SEQ ID NO: 3303354 - DNA, 15 bp, Homo sapiens
aaaggcctcctcccc

SEQ ID NO: 3303355 - DNA, 14 bp, Homo sapiens
aaaggcctctgtcc

SEQ ID NO: 3303356 - DNA, 13 bp, Homo sapiens
aaaggcctcttgt

SEQ ID NO: 3303357 - DNA, 20 bp, Homo sapiens
aaaggcctggaaccagggag

SEQ ID NO: 3303358 - DNA, 21 bp, Homo sapiens
aaaggcgcagtgcttctctac

SEQ ID NO: 3303359 - DNA, 19 bp, Homo sapiens
aaaggctaggtacacagct

SEQ ID NO: 3303360 - DNA, 19 bp, Homo sapiens
aaaggctcagtctcaggag

SEQ ID NO: 3303361 - DNA, 20 bp, Homo sapiens
aaaggctctgaaagccagct

SEQ ID NO: 3303362 - DNA, 13 bp, Homo sapiens
aaaggctgagaag

SEQ ID NO: 3303363 - DNA, 14 bp, Homo sapiens
aaaggctgagaagg

SEQ ID NO: 3303364 - DNA, 13 bp, Homo sapiens
aaaggctgccgag

SEQ ID NO: 3303365 - DNA, 18 bp, Homo sapiens
aaagggaagttgtgcctt

SEQ ID NO: 3303366 - DNA, 16 bp, Homo sapiens
aaagggacagcatgcc

SEQ ID NO: 3303367 - DNA, 18 bp, Homo sapiens
aaagggagctatcaggaa

SEQ ID NO: 3303368 - DNA, 14 bp, Homo sapiens
aaagggagtttttg

SEQ ID NO: 3303369 - DNA, 15 bp, Homo sapiens
aaagggagtttttga

SEQ ID NO: 3303370 - DNA, 13 bp, Homo sapiens
aaagggatatttt

SEQ ID NO: 3303371 - DNA, 20 bp, Homo sapiens
aaagggcacttaatttgtaa

SEQ ID NO: 3303372 - DNA, 15 bp, Homo sapiens
aaagggcagggccca

SEQ ID NO: 3303373 - DNA, 20 bp, Homo sapiens
aaagggcccagagagggtgg

SEQ ID NO: 3303374 - DNA, 22 bp, Homo sapiens
aaaggggagaaactgaaagtgt

SEQ ID NO: 3303375 - DNA, 16 bp, Homo sapiens
aaaggggagagcctgc

SEQ ID NO: 3303376 - DNA, 19 bp, Homo sapiens
aaaggggagagcctgctgg

SEQ ID NO: 3303377 - DNA, 19 bp, Homo sapiens
aaaggggagttgagtcaca

SEQ ID NO: 3303378 - DNA, 18 bp, Homo sapiens
aaaggggcagaaaaactc

SEQ ID NO: 3303379 - DNA, 14 bp, Homo sapiens
aaagggggcctggg

SEQ ID NO: 3303380 - DNA, 14 bp, Homo sapiens
aaaggggggagggg

SEQ ID NO: 3303381 - DNA, 16 bp, Homo sapiens
aaagggggtcccagtg

SEQ ID NO: 3303382 - DNA, 21 bp, Homo sapiens
aaagggtaatttcctttgctt

SEQ ID NO: 3303383 - DNA, 14 bp, Homo sapiens
aaagggtgaagcta

SEQ ID NO: 3303384 - DNA, 18 bp, Homo sapiens
aaagggtgtaggggccac

SEQ ID NO: 3303385 - DNA, 16 bp, Homo sapiens
aaaggtaatgtgtgga

SEQ ID NO: 3303386 - DNA, 14 bp, Homo sapiens
aaaggtagagtctt

SEQ ID NO: 3303387 - DNA, 13 bp, Homo sapiens
aaaggtataaata

SEQ ID NO: 3303388 - DNA, 18 bp, Homo sapiens
aaaggtctttttaaacca

SEQ ID NO: 3303389 - DNA, 20 bp, Homo sapiens
aaaggtgagtttgagctgcc

SEQ ID NO: 3303390 - DNA, 14 bp, Homo sapiens
aaaggtgtatttaa

SEQ ID NO: 3303391 - DNA, 19 bp, Homo sapiens
aaaggttatgttcattttt

SEQ ID NO: 3303392 - DNA, 17 bp, Homo sapiens
aaaggttcactaaagca

SEQ ID NO: 3303393 - DNA, 22 bp, Homo sapiens
aaaggttcttcatccctttcca

SEQ ID NO: 3303394 - DNA, 19 bp, Homo sapiens
aaaggttgctgtttcacaa

SEQ ID NO: 3303395 - DNA, 20 bp, Homo sapiens
aaaggtttaagaaatagaat

SEQ ID NO: 3303396 - DNA, 12 bp, Homo sapiens
aaaggttttgta

SEQ ID NO: 3303397 - DNA, 13 bp, Homo sapiens
aaaggttttgtat

SEQ ID NO: 3303398 - DNA, 23 bp, Homo sapiens
aaaggtttttaaagtaaatctct

SEQ ID NO: 3303399 - DNA, 14 bp, Homo sapiens
aaagtaaaatgtct

SEQ ID NO: 3303400 - DNA, 15 bp, Homo sapiens
aaagtaaaggcctcc

SEQ ID NO: 3303401 - DNA, 17 bp, Homo sapiens
aaagtaaatacaagact

SEQ ID NO: 3303402 - DNA, 14 bp, Homo sapiens
aaagtaactcattt

SEQ ID NO: 3303403 - DNA, 18 bp, Homo sapiens
aaagtaagttaataatgt

SEQ ID NO: 3303404 - DNA, 14 bp, Homo sapiens
aaagtaattttgtc

SEQ ID NO: 3303405 - DNA, 18 bp, Homo sapiens
aaagtaattttgtcacat

SEQ ID NO: 3303406 - DNA, 17 bp, Homo sapiens
aaagtacaatgtgtttt

SEQ ID NO: 3303407 - DNA, 17 bp, Homo sapiens
aaagtacactctgctgt

SEQ ID NO: 3303408 - DNA, 21 bp, Homo sapiens
aaagtacagaatttgaattat

SEQ ID NO: 3303409 - DNA, 12 bp, Homo sapiens
aaagtacattta

SEQ ID NO: 3303410 - DNA, 14 bp, Homo sapiens
aaagtacatttaat

SEQ ID NO: 3303411 - DNA, 20 bp, Homo sapiens
aaagtaccagcatgttaact

SEQ ID NO: 3303412 - DNA, 21 bp, Homo sapiens
aaagtacttctccaccctgct

SEQ ID NO: 3303413 - DNA, 14 bp, Homo sapiens
aaagtactttaaaa

SEQ ID NO: 3303414 - DNA, 19 bp, Homo sapiens
aaagtactttcttataaat

SEQ ID NO: 3303415 - DNA, 20 bp, Homo sapiens
aaagtagaagtcttagatgt

SEQ ID NO: 3303416 - DNA, 20 bp, Homo sapiens
aaagtagacaatcattgttt

SEQ ID NO: 3303417 - DNA, 18 bp, Homo sapiens
aaagtagggatgcggatc

SEQ ID NO: 3303418 - DNA, 16 bp, Homo sapiens
aaagtagtcctgtgaa

SEQ ID NO: 3303419 - DNA, 11 bp, Homo sapiens
aaagtataatc

SEQ ID NO: 3303420 - DNA, 14 bp, Homo sapiens
aaagtataatgttt

SEQ ID NO: 3303421 - DNA, 13 bp, Homo sapiens
aaagtatagagag

SEQ ID NO: 3303422 - DNA, 17 bp, Homo sapiens
aaagtatagagagaagt

SEQ ID NO: 3303423 - DNA, 23 bp, Homo sapiens
aaagtatatatttatttaagctt

SEQ ID NO: 3303424 - DNA, 16 bp, Homo sapiens
aaagtatcaggaatat

SEQ ID NO: 3303425 - DNA, 18 bp, Homo sapiens
aaagtatgcattattaaa

SEQ ID NO: 3303426 - DNA, 19 bp, Homo sapiens
aaagtatgcattattaaat

SEQ ID NO: 3303427 - DNA, 17 bp, Homo sapiens
aaagtattcaacaattt

SEQ ID NO: 3303428 - DNA, 21 bp, Homo sapiens
aaagtattcaacaatttcaat

SEQ ID NO: 3303429 - DNA, 14 bp, Homo sapiens
aaagtcagaatcag

SEQ ID NO: 3303430 - DNA, 20 bp, Homo sapiens
aaagtcagctttcagagcca

SEQ ID NO: 3303431 - DNA, 15 bp, Homo sapiens
aaagtcataaatgca

SEQ ID NO: 3303432 - DNA, 22 bp, Homo sapiens
aaagtcctttttttccatcttt

SEQ ID NO: 3303433 - DNA, 15 bp, Homo sapiens
aaagtcgttttccaa

SEQ ID NO: 3303434 - DNA, 13 bp, Homo sapiens
aaagtctattttt

SEQ ID NO: 3303435 - DNA, 15 bp, Homo sapiens
aaagtctctaattct

SEQ ID NO: 3303436 - DNA, 12 bp, Homo sapiens
aaagtctctatt

SEQ ID NO: 3303437 - DNA, 14 bp, Homo sapiens
aaagtctctattta

SEQ ID NO: 3303438 - DNA, 21 bp, Homo sapiens
aaagtctctatttaaattctt

SEQ ID NO: 3303439 - DNA, 11 bp, Homo sapiens
aaagtctgcaa

SEQ ID NO: 3303440 - DNA, 22 bp, Homo sapiens
aaagtctgtgtgatgaactttc

SEQ ID NO: 3303441 - DNA, 13 bp, Homo sapiens
aaagtgaagcaaa

SEQ ID NO: 3303442 - DNA, 22 bp, Homo sapiens
aaagtgaatgaaagattaaaca

SEQ ID NO: 3303443 - DNA, 12 bp, Homo sapiens
aaagtgaatttg

SEQ ID NO: 3303444 - DNA, 15 bp, Homo sapiens
aaagtgaatttgaat

SEQ ID NO: 3303445 - DNA, 19 bp, Homo sapiens
aaagtgaatttgaatgaaa

SEQ ID NO: 3303446 - DNA, 13 bp, Homo sapiens
aaagtgacacagc

SEQ ID NO: 3303447 - DNA, 23 bp, Homo sapiens
aaagtgatcaataaaatgtgatt

SEQ ID NO: 3303448 - DNA, 15 bp, Homo sapiens
aaagtgattaaacgt

SEQ ID NO: 3303449 - DNA, 12 bp, Homo sapiens
aaagtgatttct

SEQ ID NO: 3303450 - DNA, 23 bp, Homo sapiens
aaagtgcagctccgtttggcagt

SEQ ID NO: 3303451 - DNA, 11 bp, Homo sapiens
aaagtgccagc

SEQ ID NO: 3303452 - DNA, 12 bp, Homo sapiens
aaagtgcccagc

SEQ ID NO: 3303453 - DNA, 16 bp, Homo sapiens
aaagtgctaaggttct

SEQ ID NO: 3303454 - DNA, 17 bp, Homo sapiens
aaagtgctaaggttcta

SEQ ID NO: 3303455 - DNA, 23 bp, Homo sapiens
aaagtgctaaggttctaaggcct

SEQ ID NO: 3303456 - DNA, 17 bp, Homo sapiens
aaagtgctggattgtcc

SEQ ID NO: 3303457 - DNA, 13 bp, Homo sapiens
aaagtggaacgaa

SEQ ID NO: 3303458 - DNA, 21 bp, Homo sapiens
aaagtggcgtgggagccagcc

SEQ ID NO: 3303459 - DNA, 22 bp, Homo sapiens
aaagtggcgtgggagccagcct

SEQ ID NO: 3303460 - DNA, 21 bp, Homo sapiens
aaagtgggaggtcaggaaact

SEQ ID NO: 3303461 - DNA, 17 bp, Homo sapiens
aaagtgggcttgattct

SEQ ID NO: 3303462 - DNA, 14 bp, Homo sapiens
aaagtggttgttag

SEQ ID NO: 3303463 - DNA, 20 bp, Homo sapiens
aaagtgtaaatcctttttct

SEQ ID NO: 3303464 - DNA, 15 bp, Homo sapiens
aaagtgtaacagata

SEQ ID NO: 3303465 - DNA, 15 bp, Homo sapiens
aaagtgtaataatat

SEQ ID NO: 3303466 - DNA, 17 bp, Homo sapiens
aaagtgtatatttattc

SEQ ID NO: 3303467 - DNA, 10 bp, Homo sapiens
aaagtgtatt

SEQ ID NO: 3303468 - DNA, 22 bp, Homo sapiens
aaagtgtattagatgtggtttt

SEQ ID NO: 3303469 - DNA, 15 bp, Homo sapiens
aaagtgtatttggaa

SEQ ID NO: 3303470 - DNA, 23 bp, Homo sapiens
aaagtgtatttggaaataaagtc

SEQ ID NO: 3303471 - DNA, 20 bp, Homo sapiens
aaagtgtgttgttgctttag

SEQ ID NO: 3303472 - DNA, 9 bp, Homo sapiens
aaagtgttg

SEQ ID NO: 3303473 - DNA, 19 bp, Homo sapiens
aaagtgttggctaatgaag

SEQ ID NO: 3303474 - DNA, 23 bp, Homo sapiens
aaatggactggagctcatctgca

SEQ ID NO: 3303475 - DNA, 19 bp, Homo sapiens
aaatggactggtttgagat

SEQ ID NO: 3303476 - DNA, 19 bp, Homo sapiens
aaatggccatttgcttttt

SEQ ID NO: 3303477 - DNA, 22 bp, Homo sapiens
aaatggccatttgctttttcac

SEQ ID NO: 3303478 - DNA, 11 bp, Homo sapiens
aaatggcctca

SEQ ID NO: 3303479 - DNA, 15 bp, Homo sapiens
aaatggcctcatgtg

SEQ ID NO: 3303480 - DNA, 21 bp, Homo sapiens
aaatggcctcatgtggctgga

SEQ ID NO: 3303481 - DNA, 21 bp, Homo sapiens
aaatggcgtctggaagtccaa

SEQ ID NO: 3303482 - DNA, 17 bp, Homo sapiens
aaatggctaataaactg

SEQ ID NO: 3303483 - DNA, 18 bp, Homo sapiens
aaatggctaataaactgt

SEQ ID NO: 3303484 - DNA, 20 bp, Homo sapiens
aaatggctaataaactgtat

SEQ ID NO: 3303485 - DNA, 23 bp, Homo sapiens
aaatggctaataaactgtattaa

SEQ ID NO: 3303486 - DNA, 13 bp, Homo sapiens
aaatgggtctttt

SEQ ID NO: 3303487 - DNA, 14 bp, Homo sapiens
aaatgggtctttta

SEQ ID NO: 3303488 - DNA, 17 bp, Homo sapiens
aaatggtatcaaaatta

SEQ ID NO: 3303489 - DNA, 22 bp, Homo sapiens
aaatggtccaattagtttcctt

SEQ ID NO: 3303490 - DNA, 23 bp, Homo sapiens
aaatggtgaaaataaaataaagc

SEQ ID NO: 3303491 - DNA, 16 bp, Homo sapiens
aaatggtgtacataat

SEQ ID NO: 3303492 - DNA, 14 bp, Homo sapiens
aaatggtgtttttt

SEQ ID NO: 3303493 - DNA, 14 bp, Homo sapiens
aaatggttcagaat

SEQ ID NO: 3303494 - DNA, 14 bp, Homo sapiens
aaatggttgatgga

SEQ ID NO: 3303495 - DNA, 19 bp, Homo sapiens
aaatggttgatggaaaata

SEQ ID NO: 3303496 - DNA, 23 bp, Homo sapiens
aaatggtttattttgtattgtgg

SEQ ID NO: 3303497 - DNA, 20 bp, Homo sapiens
aaatggttttgttttgcacg

SEQ ID NO: 3303498 - DNA, 19 bp, Homo sapiens
aaatggtttttgcaagatt

SEQ ID NO: 3303499 - DNA, 22 bp, Homo sapiens
aaatgtaaagatatttttatct

SEQ ID NO: 3303500 - DNA, 15 bp, Homo sapiens
aaatgtaaatattct

SEQ ID NO: 3303501 - DNA, 18 bp, Homo sapiens
aaatgtaacttttgtaag

SEQ ID NO: 3303502 - DNA, 21 bp, Homo sapiens
aaatgtaagattatagattct

SEQ ID NO: 3303503 - DNA, 14 bp, Homo sapiens
aaatgtaagcaaag

SEQ ID NO: 3303504 - DNA, 19 bp, Homo sapiens
aaatgtaatttaaatgaaa

SEQ ID NO: 3303505 - DNA, 15 bp, Homo sapiens
aaatgtaatttagaa

SEQ ID NO: 3303506 - DNA, 16 bp, Homo sapiens
aaatgtacatttattc

SEQ ID NO: 3303507 - DNA, 17 bp, Homo sapiens
aaatgtaccttctttca

SEQ ID NO: 3303508 - DNA, 15 bp, Homo sapiens
aaatgtataaatata

SEQ ID NO: 3303509 - DNA, 17 bp, Homo sapiens
aaatgtataaatataca

SEQ ID NO: 3303510 - DNA, 21 bp, Homo sapiens
aaatgtataaatatacagtat

SEQ ID NO: 3303511 - DNA, 17 bp, Homo sapiens
aaatgtatatacacata

SEQ ID NO: 3303512 - DNA, 22 bp, Homo sapiens
aaatgtatatacacatatacct

SEQ ID NO: 3303513 - DNA, 14 bp, Homo sapiens
aaatgtatatattt

SEQ ID NO: 3303514 - DNA, 16 bp, Homo sapiens
aaatgtatatatttag

SEQ ID NO: 3303515 - DNA, 15 bp, Homo sapiens
aaatgtattcaagca

SEQ ID NO: 3303516 - DNA, 19 bp, Homo sapiens
aaatgtattcctgaaaagc

SEQ ID NO: 3303517 - DNA, 10 bp, Homo sapiens
aaatgtattt

SEQ ID NO: 3303518 - DNA, 14 bp, Homo sapiens
aaatgtattttgaa

SEQ ID NO: 3303519 - DNA, 17 bp, Homo sapiens
aaatgtattttgaagaa

SEQ ID NO: 3303520 - DNA, 21 bp, Homo sapiens
aaatgtattttgaagaatatt

SEQ ID NO: 3303521 - DNA, 21 bp, Homo sapiens
aaatgtcagtgtttgggaaat

SEQ ID NO: 3303522 - DNA, 16 bp, Homo sapiens
aaatgtcatcaaatat

SEQ ID NO: 3303523 - DNA, 18 bp, Homo sapiens
aaatgtctatagagaaaa

SEQ ID NO: 3303524 - DNA, 21 bp, Homo sapiens
aaatgtctctttaatgtcaca

SEQ ID NO: 3303525 - DNA, 21 bp, Homo sapiens
aaatgtctttccaaattattt

SEQ ID NO: 3303526 - DNA, 14 bp, Homo sapiens
aaatgtgaaaaaaa

SEQ ID NO: 3303527 - DNA, 14 bp, Homo sapiens
aaatgtgaaatctc

SEQ ID NO: 3303528 - DNA, 18 bp, Homo sapiens
aaatgtgaaatctcagaa

SEQ ID NO: 3303529 - DNA, 12 bp, Homo sapiens
aaatgtgaattt

SEQ ID NO: 3303530 - DNA, 15 bp, Homo sapiens
aaatgtgatgttcta

SEQ ID NO: 3303531 - DNA, 15 bp, Homo sapiens
aaatgtgatttttct

SEQ ID NO: 3303532 - DNA, 16 bp, Homo sapiens
aaatgtgatttttctg

SEQ ID NO: 3303533 - DNA, 17 bp, Homo sapiens
aaatgtgtacagtgaat

SEQ ID NO: 3303534 - DNA, 16 bp, Homo sapiens
aaatgtgtataatttt

SEQ ID NO: 3303535 - DNA, 13 bp, Homo sapiens
aaatgtgtatgtg

SEQ ID NO: 3303536 - DNA, 18 bp, Homo sapiens
aaatgttaaaagttttat

SEQ ID NO: 3303537 - DNA, 23 bp, Homo sapiens
aaatgttaaaagttttatatgct

SEQ ID NO: 3303538 - DNA, 23 bp, Homo sapiens
aaatgttatcttctcaagttcta

SEQ ID NO: 3303539 - DNA, 20 bp, Homo sapiens
aaatgttattttttaattat

SEQ ID NO: 3303540 - DNA, 19 bp, Homo sapiens
aaatgttctaagtttctaa

SEQ ID NO: 3303541 - DNA, 21 bp, Homo sapiens
aaatgttctaagtttctaaga

SEQ ID NO: 3303542 - DNA, 18 bp, Homo sapiens
aaatgttctatggttatg

SEQ ID NO: 3303543 - DNA, 11 bp, Homo sapiens
aaatgttcttt

SEQ ID NO: 3303544 - DNA, 22 bp, Homo sapiens
aaatgttgaaccaaacctccct

SEQ ID NO: 3303545 - DNA, 16 bp, Homo sapiens
aaatgttgagaagcgt

SEQ ID NO: 3303546 - DNA, 19 bp, Homo sapiens
aaatgttgagaatcccaaa

SEQ ID NO: 3303547 - DNA, 18 bp, Homo sapiens
aaatgtttatactgtatt

SEQ ID NO: 3303548 - DNA, 12 bp, Homo sapiens
aaatgtttggat

SEQ ID NO: 3303549 - DNA, 12 bp, Homo sapiens
aaattaaaaaaa

SEQ ID NO: 3303550 - DNA, 18 bp, Homo sapiens
aaattaaaacatatttca

SEQ ID NO: 3303551 - DNA, 18 bp, Homo sapiens
aaattaaacataaaacaa

SEQ ID NO: 3303552 - DNA, 21 bp, Homo sapiens
aaattaaagcctttagtatca

SEQ ID NO: 3303553 - DNA, 23 bp, Homo sapiens
aaattaaagcctttagtatcagt

SEQ ID NO: 3303554 - DNA, 23 bp, Homo sapiens
aaattaaatctgtccctgagagt

SEQ ID NO: 3303555 - DNA, 19 bp, Homo sapiens
aaattaaatgccttgtata

SEQ ID NO: 3303556 - DNA, 20 bp, Homo sapiens
aaattaaatgccttgtataa

SEQ ID NO: 3303557 - DNA, 15 bp, Homo sapiens
aaattaactgtatgt

SEQ ID NO: 3303558 - DNA, 17 bp, Homo sapiens
aaattaacttgagtttt

SEQ ID NO: 3303559 - DNA, 14 bp, Homo sapiens
aaattaagaaggca

SEQ ID NO: 3303560 - DNA, 12 bp, Homo sapiens
aaattaagacat

SEQ ID NO: 3303561 - DNA, 15 bp, Homo sapiens
aaattaagtagaaca

SEQ ID NO: 3303562 - DNA, 12 bp, Homo sapiens
aaattaatatct

SEQ ID NO: 3303563 - DNA, 13 bp, Homo sapiens
aaattacaatttt

SEQ ID NO: 3303564 - DNA, 14 bp, Homo sapiens
aaattacaatttta

SEQ ID NO: 3303565 - DNA, 16 bp, Homo sapiens
aaattacacccaaaga

SEQ ID NO: 3303566 - DNA, 22 bp, Homo sapiens
aaattacacccaaagaggtatt

SEQ ID NO: 3303567 - DNA, 17 bp, Homo sapiens
aaattacagatgtgaaa

SEQ ID NO: 3303568 - DNA, 13 bp, Homo sapiens
aaattagaaaata

SEQ ID NO: 3303569 - DNA, 15 bp, Homo sapiens
aaattagaaaatatt

SEQ ID NO: 3303570 - DNA, 17 bp, Homo sapiens
aaattagaaaatattct

SEQ ID NO: 3303571 - DNA, 19 bp, Homo sapiens
aaattagaaaatattctct

SEQ ID NO: 3303572 - DNA, 20 bp, Homo sapiens
aaattagaaagcaacttatc

SEQ ID NO: 3303573 - DNA, 16 bp, Homo sapiens
aaattaggactgtata

SEQ ID NO: 3303574 - DNA, 17 bp, Homo sapiens
aaattagtaatgtacta

SEQ ID NO: 3303575 - DNA, 22 bp, Homo sapiens
aaattatatatttattttattc

SEQ ID NO: 3303576 - DNA, 11 bp, Homo sapiens
aaattatcagt

SEQ ID NO: 3303577 - DNA, 17 bp, Homo sapiens
aaattatgataatatat

SEQ ID NO: 3303578 - DNA, 23 bp, Homo sapiens
aaattatggaatatcatctgtca

SEQ ID NO: 3303579 - DNA, 17 bp, Homo sapiens
aaattatgtatgtttac

SEQ ID NO: 3303580 - DNA, 21 bp, Homo sapiens
aaattatgttttaaacacatg

SEQ ID NO: 3303581 - DNA, 15 bp, Homo sapiens
aaattatttaataaa

SEQ ID NO: 3303582 - DNA, 13 bp, Homo sapiens
aaattatttgtgt

SEQ ID NO: 3303583 - DNA, 14 bp, Homo sapiens
aaattcaaaaagtg

SEQ ID NO: 3303584 - DNA, 21 bp, Homo sapiens
aaattcaaaaagtgtttattt

SEQ ID NO: 3303585 - DNA, 17 bp, Homo sapiens
aaattcaaaacctgcag

SEQ ID NO: 3303586 - DNA, 14 bp, Homo sapiens
aaattcaaagcatg

SEQ ID NO: 3303587 - DNA, 19 bp, Homo sapiens
aaattcaattgtaaattga

SEQ ID NO: 3303588 - DNA, 15 bp, Homo sapiens
aaattcacaaacttt

SEQ ID NO: 3303589 - DNA, 22 bp, Homo sapiens
aaattcagatcaaaatgccttt

SEQ ID NO: 3303590 - DNA, 21 bp, Homo sapiens
aaattcagcaaaccattttta

SEQ ID NO: 3303591 - DNA, 22 bp, Homo sapiens
aaattcaggtgaaaatgttcat

SEQ ID NO: 3303592 - DNA, 19 bp, Homo sapiens
aaattcagtttttgtatct

SEQ ID NO: 3303593 - DNA, 19 bp, Homo sapiens
aaattcatttcacattaat

SEQ ID NO: 3303594 - DNA, 12 bp, Homo sapiens
aaattcatttct

SEQ ID NO: 3303595 - DNA, 17 bp, Homo sapiens
aaattccaaagtctcta

SEQ ID NO: 3303596 - DNA, 21 bp, Homo sapiens
aaattccagaaaggatattta

SEQ ID NO: 3303597 - DNA, 21 bp, Homo sapiens
aaattcccttttcaccttttc

SEQ ID NO: 3303598 - DNA, 19 bp, Homo sapiens
aaattcctcaacagtgttt

SEQ ID NO: 3303599 - DNA, 13 bp, Homo sapiens
aaattccttgccc

SEQ ID NO: 3303600 - DNA, 20 bp, Homo sapiens
aacatctttgacactctgca

SEQ ID NO: 3303601 - DNA, 20 bp, Homo sapiens
aacatgaacacccttagaaa

SEQ ID NO: 3303602 - DNA, 16 bp, Homo sapiens
aacatgagttattcat

SEQ ID NO: 3303603 - DNA, 14 bp, Homo sapiens
aacatgcactgatg

SEQ ID NO: 3303604 - DNA, 16 bp, Homo sapiens
aacatgcagtactttt

SEQ ID NO: 3303605 - DNA, 18 bp, Homo sapiens
aacatgcagttcattatt

SEQ ID NO: 3303606 - DNA, 14 bp, Homo sapiens
aacatgccccctgc

SEQ ID NO: 3303607 - DNA, 23 bp, Homo sapiens
aacatgcttatgacaatgactgt

SEQ ID NO: 3303608 - DNA, 14 bp, Homo sapiens
aacatggacttgta

SEQ ID NO: 3303609 - DNA, 19 bp, Homo sapiens
aacatggacttgtatattt

SEQ ID NO: 3303610 - DNA, 23 bp, Homo sapiens
aacatggacttgtatatttgtac

SEQ ID NO: 3303611 - DNA, 13 bp, Homo sapiens
aacatggctttga

SEQ ID NO: 3303612 - DNA, 21 bp, Homo sapiens
aacatgggctcttcactagtg

SEQ ID NO: 3303613 - DNA, 20 bp, Homo sapiens
aacatggttttgaaatgctt

SEQ ID NO: 3303614 - DNA, 13 bp, Homo sapiens
aacatgtaaaatc

SEQ ID NO: 3303615 - DNA, 21 bp, Homo sapiens
aacatgtaattaagtactatg

SEQ ID NO: 3303616 - DNA, 12 bp, Homo sapiens
aacatgtattta

SEQ ID NO: 3303617 - DNA, 15 bp, Homo sapiens
aacatgtatttatgt

SEQ ID NO: 3303618 - DNA, 16 bp, Homo sapiens
aacatgtatttatgta

SEQ ID NO: 3303619 - DNA, 19 bp, Homo sapiens
aacatgtcctgcctattat

SEQ ID NO: 3303620 - DNA, 18 bp, Homo sapiens
aacatgtgccttttctga

SEQ ID NO: 3303621 - DNA, 12 bp, Homo sapiens
aacatgttaaga

SEQ ID NO: 3303622 - DNA, 21 bp, Homo sapiens
aacatgttattcaatgtgaca

SEQ ID NO: 3303623 - DNA, 18 bp, Homo sapiens
aacatgtttctgttttgt

SEQ ID NO: 3303624 - DNA, 14 bp, Homo sapiens
aacattaaaagaag

SEQ ID NO: 3303625 - DNA, 12 bp, Homo sapiens
aacattaaatgt

SEQ ID NO: 3303626 - DNA, 18 bp, Homo sapiens
aacattaaatgtcttata

SEQ ID NO: 3303627 - DNA, 20 bp, Homo sapiens
aacattaatagcagcctttc

SEQ ID NO: 3303628 - DNA, 18 bp, Homo sapiens
aacattaatgcctgcttt

SEQ ID NO: 3303629 - DNA, 19 bp, Homo sapiens
aacattaattttgtgcatt

SEQ ID NO: 3303630 - DNA, 20 bp, Homo sapiens
aacattaattttgtgcattc

SEQ ID NO: 3303631 - DNA, 22 bp, Homo sapiens
aacattaattttgtgcattctt

SEQ ID NO: 3303632 - DNA, 13 bp, Homo sapiens
aacattagtgaaa

SEQ ID NO: 3303633 - DNA, 12 bp, Homo sapiens
aacattatttat

SEQ ID NO: 3303634 - DNA, 14 bp, Homo sapiens
aacattcagctctg

SEQ ID NO: 3303635 - DNA, 15 bp, Homo sapiens
aacattcagctctgg

SEQ ID NO: 3303636 - DNA, 17 bp, Homo sapiens
aacattcagctctggag

SEQ ID NO: 3303637 - DNA, 19 bp, Homo sapiens
aacattcagctctggagaa

SEQ ID NO: 3303638 - DNA, 21 bp, Homo sapiens
aacattcccctccccactcct

SEQ ID NO: 3303639 - DNA, 14 bp, Homo sapiens
aacattctgccctc

SEQ ID NO: 3303640 - DNA, 20 bp, Homo sapiens
aacattgaccaagaactgca

SEQ ID NO: 3303641 - DNA, 23 bp, Homo sapiens
aacattgtgttcccatttcagct

SEQ ID NO: 3303642 - DNA, 19 bp, Homo sapiens
aacattgttgctccctgtg

SEQ ID NO: 3303643 - DNA, 15 bp, Homo sapiens
aacattgttttgtgt

SEQ ID NO: 3303644 - DNA, 17 bp, Homo sapiens
aacatttccgaataaag

SEQ ID NO: 3303645 - DNA, 20 bp, Homo sapiens
aacatttccgaataaagtat

SEQ ID NO: 3303646 - DNA, 15 bp, Homo sapiens
aacatttctgtaaat

SEQ ID NO: 3303647 - DNA, 13 bp, Homo sapiens
aacatttctgttc

SEQ ID NO: 3303648 - DNA, 16 bp, Homo sapiens
aacatttgatattttt

SEQ ID NO: 3303649 - DNA, 21 bp, Homo sapiens
aacatttgatatttttccatt

SEQ ID NO: 3303650 - DNA, 22 bp, Homo sapiens
aacatttgatatttttccattt

SEQ ID NO: 3303651 - DNA, 14 bp, Homo sapiens
aacatttgccttgc

SEQ ID NO: 3303652 - DNA, 17 bp, Homo sapiens
aacatttgccttgcaga

SEQ ID NO: 3303653 - DNA, 22 bp, Homo sapiens
aacatttgccttgcagaactgc

SEQ ID NO: 3303654 - DNA, 16 bp, Homo sapiens
aacatttgctgtttta

SEQ ID NO: 3303655 - DNA, 15 bp, Homo sapiens
aacattttaaataaa

SEQ ID NO: 3303656 - DNA, 14 bp, Homo sapiens
aacattttaattca

SEQ ID NO: 3303657 - DNA, 13 bp, Homo sapiens
aacattttcaata

SEQ ID NO: 3303658 - DNA, 16 bp, Homo sapiens
aacattttgtcatata

SEQ ID NO: 3303659 - DNA, 15 bp, Homo sapiens
aacattttgttctta

SEQ ID NO: 3303660 - DNA, 21 bp, Homo sapiens
aacattttgttcttacacata

SEQ ID NO: 3303661 - DNA, 23 bp, Homo sapiens
aacattttgttcttacacataca

SEQ ID NO: 3303662 - DNA, 20 bp, Homo sapiens
aacatttttaatttaacaaa

SEQ ID NO: 3303663 - DNA, 19 bp, Homo sapiens
aacatttttgataaagcct

SEQ ID NO: 3303664 - DNA, 13 bp, Homo sapiens
aaccaaaacttcc

SEQ ID NO: 3303665 - DNA, 19 bp, Homo sapiens
aaccaaacttgttcattta

SEQ ID NO: 3303666 - DNA, 16 bp, Homo sapiens
aaccaaaggacattat

SEQ ID NO: 3303667 - DNA, 18 bp, Homo sapiens
aaccaaaggacattatgt

SEQ ID NO: 3303668 - DNA, 22 bp, Homo sapiens
aaccaaatggttcttacttttc

SEQ ID NO: 3303669 - DNA, 19 bp, Homo sapiens
aaccaactctaatattgct

SEQ ID NO: 3303670 - DNA, 21 bp, Homo sapiens
aaccaagatctataaagcgat

SEQ ID NO: 3303671 - DNA, 13 bp, Homo sapiens
aaccaaggcagcc

SEQ ID NO: 3303672 - DNA, 16 bp, Homo sapiens
aaccaagtcatgtgca

SEQ ID NO: 3303673 - DNA, 23 bp, Homo sapiens
aaccaagtgtgctctttttttaa

SEQ ID NO: 3303674 - DNA, 18 bp, Homo sapiens
aaccaatgattcataaca

SEQ ID NO: 3303675 - DNA, 22 bp, Homo sapiens
aaccaattataacttattagca

SEQ ID NO: 3303676 - DNA, 15 bp, Homo sapiens
aaccacaaaggccaa

SEQ ID NO: 3303677 - DNA, 21 bp, Homo sapiens
aaccacaaaggccaaactgct

SEQ ID NO: 3303678 - DNA, 14 bp, Homo sapiens
aaccacaactgaca

SEQ ID NO: 3303679 - DNA, 17 bp, Homo sapiens
aaccacaactgacacag

SEQ ID NO: 3303680 - DNA, 17 bp, Homo sapiens
aaccacaactttgtcgt

SEQ ID NO: 3303681 - DNA, 23 bp, Homo sapiens
aaccacaaggtccactccctgct

SEQ ID NO: 3303682 - DNA, 17 bp, Homo sapiens
aaccacagggccagagg

SEQ ID NO: 3303683 - DNA, 21 bp, Homo sapiens
aaccaccaacagagaaaagca

SEQ ID NO: 3303684 - DNA, 13 bp, Homo sapiens
aaccaccatggat

SEQ ID NO: 3303685 - DNA, 16 bp, Homo sapiens
aaccacccaaaacacg

SEQ ID NO: 3303686 - DNA, 19 bp, Homo sapiens
aaccacctcagaaaggatt

SEQ ID NO: 3303687 - DNA, 13 bp, Homo sapiens
aaccactaaagta

SEQ ID NO: 3303688 - DNA, 18 bp, Homo sapiens
aaccactcccagtcccca

SEQ ID NO: 3303689 - DNA, 15 bp, Homo sapiens
aaccactgtaaaatg

SEQ ID NO: 3303690 - DNA, 16 bp, Homo sapiens
aaccactgtaaaatga

SEQ ID NO: 3303691 - DNA, 20 bp, Homo sapiens
aaccacttcctgctacagga

SEQ ID NO: 3303692 - DNA, 22 bp, Homo sapiens
aaccagaaaagcaatactgttt

SEQ ID NO: 3303693 - DNA, 21 bp, Homo sapiens
aaccagaattgtcctcaaggc

SEQ ID NO: 3303694 - DNA, 11 bp, Homo sapiens
aaccagcaggt

SEQ ID NO: 3303695 - DNA, 19 bp, Homo sapiens
aaccagcccgacagtgcca

SEQ ID NO: 3303696 - DNA, 21 bp, Homo sapiens
aaccagcccgacagtgccatc

SEQ ID NO: 3303697 - DNA, 20 bp, Homo sapiens
aaccagccgtattttacatg

SEQ ID NO: 3303698 - DNA, 21 bp, Homo sapiens
aaccagctaagaaaagatttt

SEQ ID NO: 3303699 - DNA, 14 bp, Homo sapiens
aaccagctcatctc

SEQ ID NO: 3303700 - DNA, 12 bp, Homo sapiens
aaccaggcccag

SEQ ID NO: 3303701 - DNA, 13 bp, Homo sapiens
aaccaggcccagc

SEQ ID NO: 3303702 - DNA, 18 bp, Homo sapiens
aaccagggaagctgtccc

SEQ ID NO: 3303703 - DNA, 21 bp, Homo sapiens
aaccagggagcccctttgatg

SEQ ID NO: 3303704 - DNA, 23 bp, Homo sapiens
aaccagtctgtgtttacagacag

SEQ ID NO: 3303705 - DNA, 13 bp, Homo sapiens
aaccagtgcagaa

SEQ ID NO: 3303706 - DNA, 17 bp, Homo sapiens
aaccagtttagatttca

SEQ ID NO: 3303707 - DNA, 18 bp, Homo sapiens
aaccagtttcaggtgttt

SEQ ID NO: 3303708 - DNA, 14 bp, Homo sapiens
aaccataaattcaa

SEQ ID NO: 3303709 - DNA, 14 bp, Homo sapiens
aaccatatgatact

SEQ ID NO: 3303710 - DNA, 16 bp, Homo sapiens
aaccatcattataaac

SEQ ID NO: 3303711 - DNA, 20 bp, Homo sapiens
aaccatccagtgacaaacca

SEQ ID NO: 3303712 - DNA, 22 bp, Homo sapiens
aaccatccctgatgtctgtctg

SEQ ID NO: 3303713 - DNA, 13 bp, Homo sapiens
aaccatctggcct

SEQ ID NO: 3303714 - DNA, 12 bp, Homo sapiens
aaccatcttctg

SEQ ID NO: 3303715 - DNA, 16 bp, Homo sapiens
aaccatgcaggaagga

SEQ ID NO: 3303716 - DNA, 23 bp, Homo sapiens
aaccatgctggtatatggcttca

SEQ ID NO: 3303717 - DNA, 13 bp, Homo sapiens
aaccatgttttgg

SEQ ID NO: 3303718 - DNA, 22 bp, Homo sapiens
aaccattaagtcatgtgtgaac

SEQ ID NO: 3303719 - DNA, 14 bp, Homo sapiens
aaccattatacctt

SEQ ID NO: 3303720 - DNA, 14 bp, Homo sapiens
aaccattatacttt

SEQ ID NO: 3303721 - DNA, 18 bp, Homo sapiens
aaccattatactttatat

SEQ ID NO: 3303722 - DNA, 18 bp, Homo sapiens
aaccattgtaactattaa

SEQ ID NO: 3303723 - DNA, 14 bp, Homo sapiens
aaccattgtcttgt

SEQ ID NO: 3303724 - DNA, 21 bp, Homo sapiens
aaccattttagttcctttatt

SEQ ID NO: 3303725 - DNA, 22 bp, Homo sapiens
aaccatttttgttactctcttc

SEQ ID NO: 3303726 - DNA, 14 bp, Homo sapiens
aacttatgtagata

SEQ ID NO: 3303727 - DNA, 17 bp, Homo sapiens
aacttatgtagatattt

SEQ ID NO: 3303728 - DNA, 14 bp, Homo sapiens
aacttattagaaac

SEQ ID NO: 3303729 - DNA, 18 bp, Homo sapiens
aacttatttaaaaatatt

SEQ ID NO: 3303730 - DNA, 21 bp, Homo sapiens
aacttatttaaaaatatttca

SEQ ID NO: 3303731 - DNA, 17 bp, Homo sapiens
aacttcacatttatgtg

SEQ ID NO: 3303732 - DNA, 14 bp, Homo sapiens
aacttcagaaagac

SEQ ID NO: 3303733 - DNA, 15 bp, Homo sapiens
aacttcagacacaaa

SEQ ID NO: 3303734 - DNA, 11 bp, Homo sapiens
aacttcagcag

SEQ ID NO: 3303735 - DNA, 18 bp, Homo sapiens
aacttcagtactcaaatt

SEQ ID NO: 3303736 - DNA, 13 bp, Homo sapiens
aacttcagtcctg

SEQ ID NO: 3303737 - DNA, 21 bp, Homo sapiens
aacttcagttttatttttgcc

SEQ ID NO: 3303738 - DNA, 23 bp, Homo sapiens
aacttcagttttatttttgccaa

SEQ ID NO: 3303739 - DNA, 14 bp, Homo sapiens
aacttcatgtaact

SEQ ID NO: 3303740 - DNA, 14 bp, Homo sapiens
aacttccaaagaaa

SEQ ID NO: 3303741 - DNA, 18 bp, Homo sapiens
aacttcccagtgaattct

SEQ ID NO: 3303742 - DNA, 17 bp, Homo sapiens
aacttccccatcttcta

SEQ ID NO: 3303743 - DNA, 18 bp, Homo sapiens
aacttccccatcttctaa

SEQ ID NO: 3303744 - DNA, 11 bp, Homo sapiens
aacttccctga

SEQ ID NO: 3303745 - DNA, 15 bp, Homo sapiens
aacttccgctgaggg

SEQ ID NO: 3303746 - DNA, 15 bp, Homo sapiens
aacttctctggaaag

SEQ ID NO: 3303747 - DNA, 22 bp, Homo sapiens
aacttctgcaacaagcatgcag

SEQ ID NO: 3303748 - DNA, 21 bp, Homo sapiens
aacttcttctccatccctcta

SEQ ID NO: 3303749 - DNA, 21 bp, Homo sapiens
aacttgactgggtgagaccca

SEQ ID NO: 3303750 - DNA, 19 bp, Homo sapiens
aacttgagggcccagagca

SEQ ID NO: 3303751 - DNA, 22 bp, Homo sapiens
aacttgagggcccagagcagga

SEQ ID NO: 3303752 - DNA, 12 bp, Homo sapiens
aacttgatgcat

SEQ ID NO: 3303753 - DNA, 15 bp, Homo sapiens
aacttgatttgcatg

SEQ ID NO: 3303754 - DNA, 23 bp, Homo sapiens
aacttgatttgcatggattttgg

SEQ ID NO: 3303755 - DNA, 23 bp, Homo sapiens
aacttggaatttgtaacctcagc

SEQ ID NO: 3303756 - DNA, 17 bp, Homo sapiens
aacttggatacttggat

SEQ ID NO: 3303757 - DNA, 13 bp, Homo sapiens
aacttggattctc

SEQ ID NO: 3303758 - DNA, 11 bp, Homo sapiens
aacttggcact

SEQ ID NO: 3303759 - DNA, 22 bp, Homo sapiens
aacttggctcgaatctctgtgc

SEQ ID NO: 3303760 - DNA, 22 bp, Homo sapiens
aacttgggttcttctcagcggg

SEQ ID NO: 3303761 - DNA, 17 bp, Homo sapiens
aacttggtatttttcag

SEQ ID NO: 3303762 - DNA, 14 bp, Homo sapiens
aacttggtcagagc

SEQ ID NO: 3303763 - DNA, 14 bp, Homo sapiens
aacttgtagctgta

SEQ ID NO: 3303764 - DNA, 16 bp, Homo sapiens
aacttgtagctgtaaa

SEQ ID NO: 3303765 - DNA, 23 bp, Homo sapiens
aacttgtagctgtaaaacgctgt

SEQ ID NO: 3303766 - DNA, 17 bp, Homo sapiens
aacttgtattaaagaca

SEQ ID NO: 3303767 - DNA, 14 bp, Homo sapiens
aacttgtatttcca

SEQ ID NO: 3303768 - DNA, 20 bp, Homo sapiens
aacttgtctttttctggact

SEQ ID NO: 3303769 - DNA, 12 bp, Homo sapiens
aacttgtgaatg

SEQ ID NO: 3303770 - DNA, 13 bp, Homo sapiens
aacttgtgaatgc

SEQ ID NO: 3303771 - DNA, 17 bp, Homo sapiens
aacttgttattgtgaat

SEQ ID NO: 3303772 - DNA, 18 bp, Homo sapiens
aacttgtttacaacattt

SEQ ID NO: 3303773 - DNA, 17 bp, Homo sapiens
aactttaaaaaatattt

SEQ ID NO: 3303774 - DNA, 16 bp, Homo sapiens
aactttaagcagctct

SEQ ID NO: 3303775 - DNA, 21 bp, Homo sapiens
aactttaagtttcaggataca

SEQ ID NO: 3303776 - DNA, 15 bp, Homo sapiens
aactttactctgtgt

SEQ ID NO: 3303777 - DNA, 18 bp, Homo sapiens
aactttactctgtgttta

SEQ ID NO: 3303778 - DNA, 22 bp, Homo sapiens
aactttagaagtgcatttctga

SEQ ID NO: 3303779 - DNA, 21 bp, Homo sapiens
aactttatcacattatttgca

SEQ ID NO: 3303780 - DNA, 23 bp, Homo sapiens
aactttatcatggaatttaatgc

SEQ ID NO: 3303781 - DNA, 19 bp, Homo sapiens
aactttattaaatacaaaa

SEQ ID NO: 3303782 - DNA, 21 bp, Homo sapiens
aactttattgggtttttattg

SEQ ID NO: 3303783 - DNA, 14 bp, Homo sapiens
aactttatttgtaa

SEQ ID NO: 3303784 - DNA, 14 bp, Homo sapiens
aactttcagaggca

SEQ ID NO: 3303785 - DNA, 13 bp, Homo sapiens
aactttcattttt

SEQ ID NO: 3303786 - DNA, 23 bp, Homo sapiens
aactttccccagatcaaattcta

SEQ ID NO: 3303787 - DNA, 14 bp, Homo sapiens
aactttcctcgcct

SEQ ID NO: 3303788 - DNA, 11 bp, Homo sapiens
aactttctgta

SEQ ID NO: 3303789 - DNA, 18 bp, Homo sapiens
aactttggagtcccctca

SEQ ID NO: 3303790 - DNA, 16 bp, Homo sapiens
aactttgggaaaacat

SEQ ID NO: 3303791 - DNA, 18 bp, Homo sapiens
aactttgtaaaaatcttt

SEQ ID NO: 3303792 - DNA, 18 bp, Homo sapiens
aactttgtcgtggttctt

SEQ ID NO: 3303793 - DNA, 20 bp, Homo sapiens
aactttgtggatgtcttcct

SEQ ID NO: 3303794 - DNA, 15 bp, Homo sapiens
aacttttaaagaaaa

SEQ ID NO: 3303795 - DNA, 15 bp, Homo sapiens
aacttttaaagctca

SEQ ID NO: 3303796 - DNA, 18 bp, Homo sapiens
aacttttcccctgtcctg

SEQ ID NO: 3303797 - DNA, 13 bp, Homo sapiens
aacttttctaaga

SEQ ID NO: 3303798 - DNA, 19 bp, Homo sapiens
aacttttctaagaaaagca

SEQ ID NO: 3303799 - DNA, 11 bp, Homo sapiens
aacttttgtaa

SEQ ID NO: 3303800 - DNA, 20 bp, Homo sapiens
aactttttatgtaatacttt

SEQ ID NO: 3303801 - DNA, 15 bp, Homo sapiens
aactttttatttcta

SEQ ID NO: 3303802 - DNA, 16 bp, Homo sapiens
aactttttatttctaa

SEQ ID NO: 3303803 - DNA, 14 bp, Homo sapiens
aacttttttaaata

SEQ ID NO: 3303804 - DNA, 20 bp, Homo sapiens
aacttttttaaataaacttt

SEQ ID NO: 3303805 - DNA, 21 bp, Homo sapiens
aacttttttaaataaactttt

SEQ ID NO: 3303806 - DNA, 16 bp, Homo sapiens
aacttttttgtgtatg

SEQ ID NO: 3303807 - DNA, 17 bp, Homo sapiens
aactttttttcaatgtg

SEQ ID NO: 3303808 - DNA, 21 bp, Homo sapiens
aactttttttctgtaccagtt

SEQ ID NO: 3303809 - DNA, 17 bp, Homo sapiens
aagaaaaaaaagaaagc

SEQ ID NO: 3303810 - DNA, 14 bp, Homo sapiens
aagaaaaaaatgta

SEQ ID NO: 3303811 - DNA, 16 bp, Homo sapiens
aagaaaaaagcttata

SEQ ID NO: 3303812 - DNA, 14 bp, Homo sapiens
aagaaaaaatcaga

SEQ ID NO: 3303813 - DNA, 23 bp, Homo sapiens
aagaaaaataccatgtctctaag

SEQ ID NO: 3303814 - DNA, 16 bp, Homo sapiens
aagaaaacaaactaaa

SEQ ID NO: 3303815 - DNA, 12 bp, Homo sapiens
aagaaaagcact

SEQ ID NO: 3303816 - DNA, 13 bp, Homo sapiens
aagaaaagcactt

SEQ ID NO: 3303817 - DNA, 14 bp, Homo sapiens
aagaaaagcacttt

SEQ ID NO: 3303818 - DNA, 19 bp, Homo sapiens
aagaaaagcacttttgtta

SEQ ID NO: 3303819 - DNA, 14 bp, Homo sapiens
aagaaaagccgaaa

SEQ ID NO: 3303820 - DNA, 15 bp, Homo sapiens
aagaaaaggacaaat

SEQ ID NO: 3303821 - DNA, 15 bp, Homo sapiens
aagaaaagtgcatat

SEQ ID NO: 3303822 - DNA, 22 bp, Homo sapiens
aagaaaagtgcatatttatcca

SEQ ID NO: 3303823 - DNA, 20 bp, Homo sapiens
aagaaaatatacatttgttg

SEQ ID NO: 3303824 - DNA, 13 bp, Homo sapiens
aagaaaatcactt

SEQ ID NO: 3303825 - DNA, 13 bp, Homo sapiens
aagaaaatctttg

SEQ ID NO: 3303826 - DNA, 16 bp, Homo sapiens
aagaaaatggctaata

SEQ ID NO: 3303827 - DNA, 12 bp, Homo sapiens
aagaaaattttt

SEQ ID NO: 3303828 - DNA, 13 bp, Homo sapiens
aagaaacaagctg

SEQ ID NO: 3303829 - DNA, 21 bp, Homo sapiens
aagaaacacatcaaataaact

SEQ ID NO: 3303830 - DNA, 16 bp, Homo sapiens
aagaaacagataccat

SEQ ID NO: 3303831 - DNA, 17 bp, Homo sapiens
aagaaactatacatcat

SEQ ID NO: 3303832 - DNA, 20 bp, Homo sapiens
aagaaactatgaagatctga

SEQ ID NO: 3303833 - DNA, 21 bp, Homo sapiens
aagaaactgaggaattttctt

SEQ ID NO: 3303834 - DNA, 13 bp, Homo sapiens
aagaaacttttgt

SEQ ID NO: 3303835 - DNA, 15 bp, Homo sapiens
aagaaacttttgtaa

SEQ ID NO: 3303836 - DNA, 19 bp, Homo sapiens
aagaaacttttgtaaagaa

SEQ ID NO: 3303837 - DNA, 13 bp, Homo sapiens
aagaaagactcta

SEQ ID NO: 3303838 - DNA, 16 bp, Homo sapiens
aagaaagactctattc

SEQ ID NO: 3303839 - DNA, 16 bp, Homo sapiens
aagaaagcatagacat

SEQ ID NO: 3303840 - DNA, 16 bp, Homo sapiens
aagaaaggaaaagaaa

SEQ ID NO: 3303841 - DNA, 17 bp, Homo sapiens
aagaaagtgggaggtca

SEQ ID NO: 3303842 - DNA, 23 bp, Homo sapiens
aagaaagtgggaggtcaggaaac

SEQ ID NO: 3303843 - DNA, 16 bp, Homo sapiens
aagaaagttctacagt

SEQ ID NO: 3303844 - DNA, 19 bp, Homo sapiens
aagaaataatgctacaatt

SEQ ID NO: 3303845 - DNA, 20 bp, Homo sapiens
aagaaatattccaaatgtct

SEQ ID NO: 3303846 - DNA, 13 bp, Homo sapiens
aagaaatccctgt

SEQ ID NO: 3303847 - DNA, 14 bp, Homo sapiens
aagaaatccctgtt

SEQ ID NO: 3303848 - DNA, 15 bp, Homo sapiens
aagaaatcttgtctt

SEQ ID NO: 3303849 - DNA, 12 bp, Homo sapiens
aagaaatgaaca

SEQ ID NO: 3303850 - DNA, 11 bp, Homo sapiens
aagaaatgatt

SEQ ID NO: 3303851 - DNA, 13 bp, Homo sapiens
aagaaatggtgaa

SEQ ID NO: 3303852 - DNA, 12 bp, Homo sapiens
aagaaatgtacc

SEQ ID NO: 3303853 - DNA, 22 bp, Homo sapiens
aagcctgagccttagctcccag

SEQ ID NO: 3303854 - DNA, 23 bp, Homo sapiens
aagcctgcctaggaattcccagc

SEQ ID NO: 3303855 - DNA, 15 bp, Homo sapiens
aagcctgctggctgc

SEQ ID NO: 3303856 - DNA, 22 bp, Homo sapiens
aagcctggatgccaaggagccc

SEQ ID NO: 3303857 - DNA, 12 bp, Homo sapiens
aagcctggccta

SEQ ID NO: 3303858 - DNA, 17 bp, Homo sapiens
aagcctgggattgacag

SEQ ID NO: 3303859 - DNA, 21 bp, Homo sapiens
aagccttaagccataggccca

SEQ ID NO: 3303860 - DNA, 18 bp, Homo sapiens
aagccttaatttgcacag

SEQ ID NO: 3303861 - DNA, 19 bp, Homo sapiens
aagccttataaaccaatct

SEQ ID NO: 3303862 - DNA, 22 bp, Homo sapiens
aagccttcaaaactatagcttg

SEQ ID NO: 3303863 - DNA, 16 bp, Homo sapiens
aagccttcagctccag

SEQ ID NO: 3303864 - DNA, 21 bp, Homo sapiens
aagccttctgcagcaggaact

SEQ ID NO: 3303865 - DNA, 23 bp, Homo sapiens
aagccttgggttccaaccaggca

SEQ ID NO: 3303866 - DNA, 15 bp, Homo sapiens
aagccttgttttctc

SEQ ID NO: 3303867 - DNA, 19 bp, Homo sapiens
aagcctttagtatcagtgt

SEQ ID NO: 3303868 - DNA, 14 bp, Homo sapiens
aagcctttccataa

SEQ ID NO: 3303869 - DNA, 15 bp, Homo sapiens
aagcctttccataag

SEQ ID NO: 3303870 - DNA, 23 bp, Homo sapiens
aagcgagtcatttcgttccctga

SEQ ID NO: 3303871 - DNA, 15 bp, Homo sapiens
aagcgattcactgta

SEQ ID NO: 3303872 - DNA, 14 bp, Homo sapiens
aagcgattctcctg

SEQ ID NO: 3303873 - DNA, 15 bp, Homo sapiens
aagcgctcccagcct

SEQ ID NO: 3303874 - DNA, 16 bp, Homo sapiens
aagcgctcccagcctg

SEQ ID NO: 3303875 - DNA, 12 bp, Homo sapiens
aagcgtctttaa

SEQ ID NO: 3303876 - DNA, 18 bp, Homo sapiens
aagcgtctttaagagact

SEQ ID NO: 3303877 - DNA, 16 bp, Homo sapiens
aagcgtgagccactgc

SEQ ID NO: 3303878 - DNA, 15 bp, Homo sapiens
aagcgttaagggcag

SEQ ID NO: 3303879 - DNA, 16 bp, Homo sapiens
aagcgttaagggcaga

SEQ ID NO: 3303880 - DNA, 22 bp, Homo sapiens
aagctaaaatatataatatact

SEQ ID NO: 3303881 - DNA, 23 bp, Homo sapiens
aagctaaaatatataatatacta

SEQ ID NO: 3303882 - DNA, 19 bp, Homo sapiens
aagctaatgtaggactgta

SEQ ID NO: 3303883 - DNA, 22 bp, Homo sapiens
aagctactgtgtgtgtgaatga

SEQ ID NO: 3303884 - DNA, 20 bp, Homo sapiens
aagctaggccccagaggccc

SEQ ID NO: 3303885 - DNA, 22 bp, Homo sapiens
aagctaggccccagaggccctg

SEQ ID NO: 3303886 - DNA, 23 bp, Homo sapiens
aagctaggccccagaggccctgg

SEQ ID NO: 3303887 - DNA, 22 bp, Homo sapiens
aagctaggcctggccagatgca

SEQ ID NO: 3303888 - DNA, 13 bp, Homo sapiens
aagctatcagcaa

SEQ ID NO: 3303889 - DNA, 16 bp, Homo sapiens
aagctattagccagga

SEQ ID NO: 3303890 - DNA, 21 bp, Homo sapiens
aagctattagccaggatcatg

SEQ ID NO: 3303891 - DNA, 23 bp, Homo sapiens
aagctatttaatatctggcactg

SEQ ID NO: 3303892 - DNA, 17 bp, Homo sapiens
aagctcaaatgaaatgt

SEQ ID NO: 3303893 - DNA, 16 bp, Homo sapiens
aagctcacaccaaatt

SEQ ID NO: 3303894 - DNA, 13 bp, Homo sapiens
aagctcactgctg

SEQ ID NO: 3303895 - DNA, 14 bp, Homo sapiens
aagctcacttctgg

SEQ ID NO: 3303896 - DNA, 14 bp, Homo sapiens
aagctcagaataga

SEQ ID NO: 3303897 - DNA, 15 bp, Homo sapiens
aagctcagattattt

SEQ ID NO: 3303898 - DNA, 12 bp, Homo sapiens
aagctcatattt

SEQ ID NO: 3303899 - DNA, 23 bp, Homo sapiens
aagctcatattttgtatatatct

SEQ ID NO: 3303900 - DNA, 19 bp, Homo sapiens
aagctccacggtgcgtggc

SEQ ID NO: 3303901 - DNA, 15 bp, Homo sapiens
aagctccctgcccca

SEQ ID NO: 3303902 - DNA, 16 bp, Homo sapiens
aagctccctgccccaa

SEQ ID NO: 3303903 - DNA, 17 bp, Homo sapiens
aagctccctgccccaaa

SEQ ID NO: 3303904 - DNA, 15 bp, Homo sapiens
aagctccctggagcc

SEQ ID NO: 3303905 - DNA, 14 bp, Homo sapiens
aagctcgccccacc

SEQ ID NO: 3303906 - DNA, 20 bp, Homo sapiens
aagctctagttcttaacaac

SEQ ID NO: 3303907 - DNA, 15 bp, Homo sapiens
aagctctattaagat

SEQ ID NO: 3303908 - DNA, 22 bp, Homo sapiens
aagctctcttgccgaggagcca

SEQ ID NO: 3303909 - DNA, 21 bp, Homo sapiens
aagctctggctgaaccctgtg

SEQ ID NO: 3303910 - DNA, 22 bp, Homo sapiens
aagctctggctgaaccctgtgc

SEQ ID NO: 3303911 - DNA, 19 bp, Homo sapiens
aagctcttggagctgtgag

SEQ ID NO: 3303912 - DNA, 12 bp, Homo sapiens
aagctgaaaata

SEQ ID NO: 3303913 - DNA, 11 bp, Homo sapiens
aagctgaaatt

SEQ ID NO: 3303914 - DNA, 22 bp, Homo sapiens
aagctgaaattttagaaatatt

SEQ ID NO: 3303915 - DNA, 16 bp, Homo sapiens
aagctgacttggcact

SEQ ID NO: 3303916 - DNA, 17 bp, Homo sapiens
aagctgagaactcctga

SEQ ID NO: 3303917 - DNA, 19 bp, Homo sapiens
aagctgagaactcctgact

SEQ ID NO: 3303918 - DNA, 18 bp, Homo sapiens
aagctgcagatctttgct

SEQ ID NO: 3303919 - DNA, 17 bp, Homo sapiens
aagctgccagcccagaa

SEQ ID NO: 3303920 - DNA, 20 bp, Homo sapiens
aagctgccagcccagaacac

SEQ ID NO: 3303921 - DNA, 21 bp, Homo sapiens
aagctgccatttcccttctgg

SEQ ID NO: 3303922 - DNA, 15 bp, Homo sapiens
aagctgccctgccca

SEQ ID NO: 3303923 - DNA, 14 bp, Homo sapiens
aagctgcctctggg

SEQ ID NO: 3303924 - DNA, 22 bp, Homo sapiens
aagctgcctgtagttaggaaat

SEQ ID NO: 3303925 - DNA, 15 bp, Homo sapiens
aagctgctaaatctc

SEQ ID NO: 3303926 - DNA, 22 bp, Homo sapiens
aagctgctaaatctcctatttt

SEQ ID NO: 3303927 - DNA, 17 bp, Homo sapiens
aagctgctccaggcctg

SEQ ID NO: 3303928 - DNA, 14 bp, Homo sapiens
aagctgctgacagt

SEQ ID NO: 3303929 - DNA, 16 bp, Homo sapiens
aagctgctgacagtgt

SEQ ID NO: 3303930 - DNA, 21 bp, Homo sapiens
aagctggaggctccaggactc

SEQ ID NO: 3303931 - DNA, 22 bp, Homo sapiens
aagctggaggctccaggactcc

SEQ ID NO: 3303932 - DNA, 11 bp, Homo sapiens
aagctggccct

SEQ ID NO: 3303933 - DNA, 14 bp, Homo sapiens
aagctggccctgcc

SEQ ID NO: 3303934 - DNA, 17 bp, Homo sapiens
aagctggccctgcctcc

SEQ ID NO: 3303935 - DNA, 22 bp, Homo sapiens
aagctggccctgcctcctggga

SEQ ID NO: 3303936 - DNA, 22 bp, Homo sapiens
aagctggccgagggtcctggct

SEQ ID NO: 3303937 - DNA, 14 bp, Homo sapiens
aagctgtaaattac

SEQ ID NO: 3303938 - DNA, 23 bp, Homo sapiens
aagctgtaaattactatggctga

SEQ ID NO: 3303939 - DNA, 20 bp, Homo sapiens
aagctgtactcagagcagag

SEQ ID NO: 3303940 - DNA, 22 bp, Homo sapiens
aagctgtagtagccctttctgt

SEQ ID NO: 3303941 - DNA, 13 bp, Homo sapiens
aagctgtccctgc

SEQ ID NO: 3303942 - DNA, 16 bp, Homo sapiens
aagctgtccctgcagg

SEQ ID NO: 3303943 - DNA, 11 bp, Homo sapiens
aagctgtgtgc

SEQ ID NO: 3303944 - DNA, 12 bp, Homo sapiens
aagctgtgtgca

SEQ ID NO: 3303945 - DNA, 15 bp, Homo sapiens
aagctgtgttgaaac

SEQ ID NO: 3303946 - DNA, 17 bp, Homo sapiens
aagctgttaaactgtta

SEQ ID NO: 3303947 - DNA, 20 bp, Homo sapiens
aagctgttaaactgttagca

SEQ ID NO: 3303948 - DNA, 20 bp, Homo sapiens
aagctgttgtacatttatga

SEQ ID NO: 3303949 - DNA, 15 bp, Homo sapiens
aagctgtttccatag

SEQ ID NO: 3303950 - DNA, 17 bp, Homo sapiens
aagctgtttggaaaaga

SEQ ID NO: 3303951 - DNA, 18 bp, Homo sapiens
aagcttaatagccctccc

SEQ ID NO: 3303952 - DNA, 15 bp, Homo sapiens
aagcttcagttgctt

SEQ ID NO: 3303953 - DNA, 16 bp, Homo sapiens
aagcttccatgattct

SEQ ID NO: 3303954 - DNA, 21 bp, Homo sapiens
aagcttccatgattctattta

SEQ ID NO: 3303955 - DNA, 18 bp, Homo sapiens
aagcttctaataaattat

SEQ ID NO: 3303956 - DNA, 12 bp, Homo sapiens
aagcttcttaat

SEQ ID NO: 3303957 - DNA, 14 bp, Homo sapiens
aagcttgagcctcc

SEQ ID NO: 3303958 - DNA, 23 bp, Homo sapiens
aagcttgtggccccttttacttt

SEQ ID NO: 3303959 - DNA, 22 bp, Homo sapiens
aagctttatacgtgtagctata

SEQ ID NO: 3303960 - DNA, 16 bp, Homo sapiens
aagctttatttctagc

SEQ ID NO: 3303961 - DNA, 21 bp, Homo sapiens
aagctttcctgccccaggcct

SEQ ID NO: 3303962 - DNA, 21 bp, Homo sapiens
aagctttcctgtttccagggt

SEQ ID NO: 3303963 - DNA, 22 bp, Homo sapiens
aagctttcctgtttccagggtc

SEQ ID NO: 3303964 - DNA, 17 bp, Homo sapiens
aagctttgctacaaatt

SEQ ID NO: 3303965 - DNA, 21 bp, Homo sapiens
aagctttggacccaaggaaaa

SEQ ID NO: 3303966 - DNA, 14 bp, Homo sapiens
aagcttttagaaat

SEQ ID NO: 3303967 - DNA, 18 bp, Homo sapiens
aagcttttagaaatactg

SEQ ID NO: 3303968 - DNA, 16 bp, Homo sapiens
aagctttttcctcctg

SEQ ID NO: 3303969 - DNA, 18 bp, Homo sapiens
aagctttttggaatcttt

SEQ ID NO: 3303970 - DNA, 15 bp, Homo sapiens
aaggaaaaataatca

SEQ ID NO: 3303971 - DNA, 17 bp, Homo sapiens
aaggaaaaataatcaag

SEQ ID NO: 3303972 - DNA, 14 bp, Homo sapiens
aaggaaaactgcat

SEQ ID NO: 3303973 - DNA, 19 bp, Homo sapiens
aaggaaaagaggcccaagt

SEQ ID NO: 3303974 - DNA, 14 bp, Homo sapiens
aaggaaaagcaaga

SEQ ID NO: 3303975 - DNA, 17 bp, Homo sapiens
aaggaaaatagtaatgt

SEQ ID NO: 3303976 - DNA, 22 bp, Homo sapiens
aaggaaaccaagtggtcaggag

SEQ ID NO: 3303977 - DNA, 13 bp, Homo sapiens
aaggaaactagac

SEQ ID NO: 3303978 - DNA, 16 bp, Homo sapiens
aagtgaagactggaag

SEQ ID NO: 3303979 - DNA, 14 bp, Homo sapiens
aagtgaattgaagt

SEQ ID NO: 3303980 - DNA, 16 bp, Homo sapiens
aagtgaattgaagttt

SEQ ID NO: 3303981 - DNA, 21 bp, Homo sapiens
aagtgaattgaagtttcaagt

SEQ ID NO: 3303982 - DNA, 23 bp, Homo sapiens
aagtgaatttgaatgaaaaattt

SEQ ID NO: 3303983 - DNA, 14 bp, Homo sapiens
aagtgactgttgta

SEQ ID NO: 3303984 - DNA, 15 bp, Homo sapiens
aagtgactgttgtac

SEQ ID NO: 3303985 - DNA, 12 bp, Homo sapiens
aagtgactgttt

SEQ ID NO: 3303986 - DNA, 23 bp, Homo sapiens
aagtgactgtttggcttataaac

SEQ ID NO: 3303987 - DNA, 13 bp, Homo sapiens
aagtgactttaaa

SEQ ID NO: 3303988 - DNA, 15 bp, Homo sapiens
aagtgagaagatggt

SEQ ID NO: 3303989 - DNA, 16 bp, Homo sapiens
aagtgagttttacacg

SEQ ID NO: 3303990 - DNA, 23 bp, Homo sapiens
aagtgatcaataaaatgtgattt

SEQ ID NO: 3303991 - DNA, 20 bp, Homo sapiens
aagtgatcctcccacctcag

SEQ ID NO: 3303992 - DNA, 23 bp, Homo sapiens
aagtgatcctcccacctcagcct

SEQ ID NO: 3303993 - DNA, 18 bp, Homo sapiens
aagtgatgggctttctct

SEQ ID NO: 3303994 - DNA, 13 bp, Homo sapiens
aagtgatgtcaga

SEQ ID NO: 3303995 - DNA, 15 bp, Homo sapiens
aagtgattcactgtg

SEQ ID NO: 3303996 - DNA, 15 bp, Homo sapiens
aagtgattctcctgc

SEQ ID NO: 3303997 - DNA, 14 bp, Homo sapiens
aagtgattgaaaat

SEQ ID NO: 3303998 - DNA, 18 bp, Homo sapiens
aagtgcacacagaaatat

SEQ ID NO: 3303999 - DNA, 20 bp, Homo sapiens
aagtgcacacagaaatatat

SEQ ID NO: 3304000 - DNA, 22 bp, Homo sapiens
aagtgcacacagaaatatatat

SEQ ID NO: 3304001 - DNA, 16 bp, Homo sapiens
aagtgcactttctaat

SEQ ID NO: 3304002 - DNA, 18 bp, Homo sapiens
aagtgcacttttttatga

SEQ ID NO: 3304003 - DNA, 20 bp, Homo sapiens
aagtgcatgatggtgagagc

SEQ ID NO: 3304004 - DNA, 14 bp, Homo sapiens
aagtgcatttctga

SEQ ID NO: 3304005 - DNA, 14 bp, Homo sapiens
aagtgccaaacaga

SEQ ID NO: 3304006 - DNA, 18 bp, Homo sapiens
aagtgccagaggtgggca

SEQ ID NO: 3304007 - DNA, 20 bp, Homo sapiens
aagtgccagaggtgggcagg

SEQ ID NO: 3304008 - DNA, 21 bp, Homo sapiens
aagtgccagtcttgtgtctgc

SEQ ID NO: 3304009 - DNA, 13 bp, Homo sapiens
aagtgcccaaagt

SEQ ID NO: 3304010 - DNA, 12 bp, Homo sapiens
aagtgccttctc

SEQ ID NO: 3304011 - DNA, 18 bp, Homo sapiens
aagtgcctttctgcagtt

SEQ ID NO: 3304012 - DNA, 19 bp, Homo sapiens
aagtgccttttgctgcgca

SEQ ID NO: 3304013 - DNA, 16 bp, Homo sapiens
aagtgcgtgtgtagag

SEQ ID NO: 3304014 - DNA, 16 bp, Homo sapiens
aagtgctaaggttcta

SEQ ID NO: 3304015 - DNA, 14 bp, Homo sapiens
aagtgctgagatta

SEQ ID NO: 3304016 - DNA, 13 bp, Homo sapiens
aagtgctggattg

SEQ ID NO: 3304017 - DNA, 13 bp, Homo sapiens
aagtgctgggatt

SEQ ID NO: 3304018 - DNA, 16 bp, Homo sapiens
aagtgctgtttattaa

SEQ ID NO: 3304019 - DNA, 20 bp, Homo sapiens
aagtgctgtttattaatctt

SEQ ID NO: 3304020 - DNA, 21 bp, Homo sapiens
aagtgctgtttattaatctta

SEQ ID NO: 3304021 - DNA, 19 bp, Homo sapiens
aagtgcttattacatttta

SEQ ID NO: 3304022 - DNA, 10 bp, Homo sapiens
aagtggaaaa

SEQ ID NO: 3304023 - DNA, 14 bp, Homo sapiens
aagtggaaaaaaga

SEQ ID NO: 3304024 - DNA, 19 bp, Homo sapiens
aagtggaaaaaagagaaaa

SEQ ID NO: 3304025 - DNA, 13 bp, Homo sapiens
aagtggatgggaa

SEQ ID NO: 3304026 - DNA, 14 bp, Homo sapiens
aagtggatgggaat

SEQ ID NO: 3304027 - DNA, 19 bp, Homo sapiens
aagtggatgggaatttgtc

SEQ ID NO: 3304028 - DNA, 16 bp, Homo sapiens
aagtggcatgttttgt

SEQ ID NO: 3304029 - DNA, 22 bp, Homo sapiens
aagtggcatgttttgtgcattt

SEQ ID NO: 3304030 - DNA, 20 bp, Homo sapiens
aagtggcgtgggagccagcc

SEQ ID NO: 3304031 - DNA, 12 bp, Homo sapiens
aagtgggcttga

SEQ ID NO: 3304032 - DNA, 22 bp, Homo sapiens
aagtgggcttgattctgcagta

SEQ ID NO: 3304033 - DNA, 17 bp, Homo sapiens
aagtggggatggggcct

SEQ ID NO: 3304034 - DNA, 13 bp, Homo sapiens
aagtggggctcgc

SEQ ID NO: 3304035 - DNA, 20 bp, Homo sapiens
aagtggggttgcaaccactg

SEQ ID NO: 3304036 - DNA, 14 bp, Homo sapiens
aagtgtaacagctg

SEQ ID NO: 3304037 - DNA, 21 bp, Homo sapiens
aagtgtaacagctgaggtctc

SEQ ID NO: 3304038 - DNA, 15 bp, Homo sapiens
aagtgtatatttatt

SEQ ID NO: 3304039 - DNA, 18 bp, Homo sapiens
aagtgtatatttattcat

SEQ ID NO: 3304040 - DNA, 19 bp, Homo sapiens
aagtgtatatttattcata

SEQ ID NO: 3304041 - DNA, 21 bp, Homo sapiens
aagtgtatatttattcataat

SEQ ID NO: 3304042 - DNA, 15 bp, Homo sapiens
aagtgtattagatgt

SEQ ID NO: 3304043 - DNA, 18 bp, Homo sapiens
aagtgtattagatgtggt

SEQ ID NO: 3304044 - DNA, 15 bp, Homo sapiens
aagtgtatttggaaa

SEQ ID NO: 3304045 - DNA, 24 bp, Homo sapiens
aagtgtctagagtcatgtgagcct

SEQ ID NO: 3304046 - DNA, 16 bp, Homo sapiens
aagtgtctctgccttg

SEQ ID NO: 3304047 - DNA, 17 bp, Homo sapiens
aagtgtgaccccactgc

SEQ ID NO: 3304048 - DNA, 13 bp, Homo sapiens
aagtgtgagcaaa

SEQ ID NO: 3304049 - DNA, 18 bp, Homo sapiens
aagtgtgagcgccttggt

SEQ ID NO: 3304050 - DNA, 19 bp, Homo sapiens
aagtgtgagcgccttggta

SEQ ID NO: 3304051 - DNA, 21 bp, Homo sapiens
aagtgtggaaaaatagctctg

SEQ ID NO: 3304052 - DNA, 16 bp, Homo sapiens
aagtgtgtatatattt

SEQ ID NO: 3304053 - DNA, 17 bp, Homo sapiens
aagtgtgtatatatttt

SEQ ID NO: 3304054 - DNA, 19 bp, Homo sapiens
aagtgtgtatatattttgt

SEQ ID NO: 3304055 - DNA, 19 bp, Homo sapiens
aagtgtgtttcttcccctt

SEQ ID NO: 3304056 - DNA, 21 bp, Homo sapiens
aagtgttatttttcaaggaag

SEQ ID NO: 3304057 - DNA, 17 bp, Homo sapiens
aagtgttcaagaaataa

SEQ ID NO: 3304058 - DNA, 21 bp, Homo sapiens
aagtgttcaagaaataaaaat

SEQ ID NO: 3304059 - DNA, 18 bp, Homo sapiens
aagtgttgctcttggaaa

SEQ ID NO: 3304060 - DNA, 22 bp, Homo sapiens
aagtgttggtctttctaatgta

SEQ ID NO: 3304061 - DNA, 17 bp, Homo sapiens
aagtgttgtaaatattt

SEQ ID NO: 3304062 - DNA, 22 bp, Homo sapiens
aagtgttgtatcaaagtgtgat

SEQ ID NO: 3304063 - DNA, 19 bp, Homo sapiens
aagtgtttatttttcatat

SEQ ID NO: 3304064 - DNA, 19 bp, Homo sapiens
aagtgttttactctttttc

SEQ ID NO: 3304065 - DNA, 20 bp, Homo sapiens
aagtgttttactctttttct

SEQ ID NO: 3304066 - DNA, 22 bp, Homo sapiens
aagtgttttctcagaacagctg

SEQ ID NO: 3304067 - DNA, 14 bp, Homo sapiens
aagttaaataaatc

SEQ ID NO: 3304068 - DNA, 15 bp, Homo sapiens
aagttaacaaggaat

SEQ ID NO: 3304069 - DNA, 13 bp, Homo sapiens
aagttaataatgt

SEQ ID NO: 3304070 - DNA, 18 bp, Homo sapiens
aagttaataatgtattgt

SEQ ID NO: 3304071 - DNA, 13 bp, Homo sapiens
aagttaattcacc

SEQ ID NO: 3304072 - DNA, 14 bp, Homo sapiens
aagttacactttta

SEQ ID NO: 3304073 - DNA, 13 bp, Homo sapiens
aagttacagaaat

SEQ ID NO: 3304074 - DNA, 20 bp, Homo sapiens
aagttactaggtaacttcat

SEQ ID NO: 3304075 - DNA, 14 bp, Homo sapiens
aagttactttgtaa

SEQ ID NO: 3304076 - DNA, 17 bp, Homo sapiens
aagttactttgtaattt

SEQ ID NO: 3304077 - DNA, 19 bp, Homo sapiens
aagttactttgtaattttt

SEQ ID NO: 3304078 - DNA, 18 bp, Homo sapiens
aagttagagaatatattt

SEQ ID NO: 3304079 - DNA, 16 bp, Homo sapiens
aagttagtggaaatct

SEQ ID NO: 3304080 - DNA, 13 bp, Homo sapiens
aagttatcaactt

SEQ ID NO: 3304081 - DNA, 11 bp, Homo sapiens
aagttattgta

SEQ ID NO: 3304082 - DNA, 12 bp, Homo sapiens
aagttattgtac

SEQ ID NO: 3304083 - DNA, 15 bp, Homo sapiens
aagttatttactttt

SEQ ID NO: 3304084 - DNA, 23 bp, Homo sapiens
aagttatttacttttaccactat

SEQ ID NO: 3304085 - DNA, 13 bp, Homo sapiens
aagttatttcttg

SEQ ID NO: 3304086 - DNA, 19 bp, Homo sapiens
aagttatttcttgtttgtt

SEQ ID NO: 3304087 - DNA, 20 bp, Homo sapiens
aagttatttgttcattattt

SEQ ID NO: 3304088 - DNA, 21 bp, Homo sapiens
aagttattttctacagtggtt

SEQ ID NO: 3304089 - DNA, 17 bp, Homo sapiens
aagttatttttgtacat

SEQ ID NO: 3304090 - DNA, 21 bp, Homo sapiens
aagttcatacctaagtactgt

SEQ ID NO: 3304091 - DNA, 23 bp, Homo sapiens
aagttcatacctaagtactgtaa

SEQ ID NO: 3304092 - DNA, 13 bp, Homo sapiens
aagttcatgtcta

SEQ ID NO: 3304093 - DNA, 17 bp, Homo sapiens
aagttcatgtttgtaaa

SEQ ID NO: 3304094 - DNA, 20 bp, Homo sapiens
aagttcatgtttgtaaatta

SEQ ID NO: 3304095 - DNA, 20 bp, Homo sapiens
aagttcattgcaattaaact

SEQ ID NO: 3304096 - DNA, 21 bp, Homo sapiens
aagttccaagagtctaaagat

SEQ ID NO: 3304097 - DNA, 17 bp, Homo sapiens
aagttccctacttcctg

SEQ ID NO: 3304098 - DNA, 20 bp, Homo sapiens
aagttccctacttcctgtga

SEQ ID NO: 3304099 - DNA, 11 bp, Homo sapiens
aagttccttcc

SEQ ID NO: 3304100 - DNA, 12 bp, Homo sapiens
aagttcgtctgt

SEQ ID NO: 3304101 - DNA, 19 bp, Homo sapiens
aagttctaagattctaatg

SEQ ID NO: 3304102 - DNA, 20 bp, Homo sapiens
aagttctaagattctaatga

SEQ ID NO: 3304103 - DNA, 21 bp, Homo sapiens
aagttctaagattctaatgat

SEQ ID NO: 3304104 - DNA, 21 bp, Homo sapiens
aatatctgggattctacttta

SEQ ID NO: 3304105 - DNA, 18 bp, Homo sapiens
aatatcttaattctttgt

SEQ ID NO: 3304106 - DNA, 18 bp, Homo sapiens
aatatcttcagctctttt

SEQ ID NO: 3304107 - DNA, 21 bp, Homo sapiens
aatatcttgctggattaatgt

SEQ ID NO: 3304108 - DNA, 12 bp, Homo sapiens
aatatctttctg

SEQ ID NO: 3304109 - DNA, 20 bp, Homo sapiens
aatatgaatctgctcacttt

SEQ ID NO: 3304110 - DNA, 19 bp, Homo sapiens
aatatgacggaagaacata

SEQ ID NO: 3304111 - DNA, 19 bp, Homo sapiens
aatatgactttttataaaa

SEQ ID NO: 3304112 - DNA, 16 bp, Homo sapiens
aatatgatgacaatca

SEQ ID NO: 3304113 - DNA, 14 bp, Homo sapiens
aatatgatgagatt

SEQ ID NO: 3304114 - DNA, 15 bp, Homo sapiens
aatatgattatacaa

SEQ ID NO: 3304115 - DNA, 12 bp, Homo sapiens
aatatgatttta

SEQ ID NO: 3304116 - DNA, 14 bp, Homo sapiens
aatatgcaagcagc

SEQ ID NO: 3304117 - DNA, 21 bp, Homo sapiens
aatatgcaagcagctttttat

SEQ ID NO: 3304118 - DNA, 14 bp, Homo sapiens
aatatgccccttct

SEQ ID NO: 3304119 - DNA, 14 bp, Homo sapiens
aatatgctaatttg

SEQ ID NO: 3304120 - DNA, 10 bp, Homo sapiens
aatatgctta

SEQ ID NO: 3304121 - DNA, 18 bp, Homo sapiens
aatatggaaccttccctc

SEQ ID NO: 3304122 - DNA, 15 bp, Homo sapiens
aatatggaacttaca

SEQ ID NO: 3304123 - DNA, 24 bp, Homo sapiens
aatatggaacttacattgttcaat

SEQ ID NO: 3304124 - DNA, 14 bp, Homo sapiens
aatatggaacttct

SEQ ID NO: 3304125 - DNA, 17 bp, Homo sapiens
aatatggacacttaata

SEQ ID NO: 3304126 - DNA, 14 bp, Homo sapiens
aatatggatttctt

SEQ ID NO: 3304127 - DNA, 18 bp, Homo sapiens
aatatggctataaatata

SEQ ID NO: 3304128 - DNA, 21 bp, Homo sapiens
aatatgggggccttttgggaa

SEQ ID NO: 3304129 - DNA, 17 bp, Homo sapiens
aatatgtatatgacatt

SEQ ID NO: 3304130 - DNA, 22 bp, Homo sapiens
aatatgtctcgctagtgatgtt

SEQ ID NO: 3304131 - DNA, 21 bp, Homo sapiens
aatatgtgagtgccttttgca

SEQ ID NO: 3304132 - DNA, 14 bp, Homo sapiens
aatatgttaaagtt

SEQ ID NO: 3304133 - DNA, 15 bp, Homo sapiens
aatatgttaaagttt

SEQ ID NO: 3304134 - DNA, 16 bp, Homo sapiens
aatatgttaaagttta

SEQ ID NO: 3304135 - DNA, 21 bp, Homo sapiens
aatatgttaacctcagtgtca

SEQ ID NO: 3304136 - DNA, 22 bp, Homo sapiens
aatatgttgagtgttcatttta

SEQ ID NO: 3304137 - DNA, 15 bp, Homo sapiens
aatattaaaagagac

SEQ ID NO: 3304138 - DNA, 19 bp, Homo sapiens
aatattaaagattctcttt

SEQ ID NO: 3304139 - DNA, 19 bp, Homo sapiens
aatattaaatacagacact

SEQ ID NO: 3304140 - DNA, 13 bp, Homo sapiens
aatattaaatctg

SEQ ID NO: 3304141 - DNA, 22 bp, Homo sapiens
aatattaccaaaaaagtatttt

SEQ ID NO: 3304142 - DNA, 15 bp, Homo sapiens
aatattatactaaga

SEQ ID NO: 3304143 - DNA, 22 bp, Homo sapiens
aatattatactaagaaaagata

SEQ ID NO: 3304144 - DNA, 14 bp, Homo sapiens
aatattatgtgttt

SEQ ID NO: 3304145 - DNA, 22 bp, Homo sapiens
aatattccagatctttcagaaa

SEQ ID NO: 3304146 - DNA, 15 bp, Homo sapiens
aatattgaaaattga

SEQ ID NO: 3304147 - DNA, 16 bp, Homo sapiens
aatattgaaaattgaa

SEQ ID NO: 3304148 - DNA, 19 bp, Homo sapiens
aatattgaaacactgtaca

SEQ ID NO: 3304149 - DNA, 23 bp, Homo sapiens
aatattgattgggaaaacatttg

SEQ ID NO: 3304150 - DNA, 22 bp, Homo sapiens
aatattgcttcttgtgttttac

SEQ ID NO: 3304151 - DNA, 14 bp, Homo sapiens
aatattgtatattt

SEQ ID NO: 3304152 - DNA, 21 bp, Homo sapiens
aatattgtcatgtttattcta

SEQ ID NO: 3304153 - DNA, 16 bp, Homo sapiens
aatattgtgttccttt

SEQ ID NO: 3304154 - DNA, 17 bp, Homo sapiens
aatattgtgttgtgaat

SEQ ID NO: 3304155 - DNA, 18 bp, Homo sapiens
aatattgtgttgtgaatg

SEQ ID NO: 3304156 - DNA, 23 bp, Homo sapiens
aatattgttgtataatttcgaga

SEQ ID NO: 3304157 - DNA, 15 bp, Homo sapiens
aatattgtttctgca

SEQ ID NO: 3304158 - DNA, 16 bp, Homo sapiens
aatatttaaacagcag

SEQ ID NO: 3304159 - DNA, 19 bp, Homo sapiens
aatatttaaacagcagtgt

SEQ ID NO: 3304160 - DNA, 15 bp, Homo sapiens
aatatttaaaccttt

SEQ ID NO: 3304161 - DNA, 17 bp, Homo sapiens
aatatttactctttgca

SEQ ID NO: 3304162 - DNA, 18 bp, Homo sapiens
aatatttactctttgcaa

SEQ ID NO: 3304163 - DNA, 16 bp, Homo sapiens
aatatttataaaactt

SEQ ID NO: 3304164 - DNA, 22 bp, Homo sapiens
aatatttataaagaatgtttct

SEQ ID NO: 3304165 - DNA, 17 bp, Homo sapiens
aatatttatatatttat

SEQ ID NO: 3304166 - DNA, 18 bp, Homo sapiens
aatatttatatttcacta

SEQ ID NO: 3304167 - DNA, 19 bp, Homo sapiens
aatatttatggatgcaaca

SEQ ID NO: 3304168 - DNA, 19 bp, Homo sapiens
aatatttatgtctatttaa

SEQ ID NO: 3304169 - DNA, 21 bp, Homo sapiens
aatatttattaaataaaatca

SEQ ID NO: 3304170 - DNA, 13 bp, Homo sapiens
aatatttattacc

SEQ ID NO: 3304171 - DNA, 15 bp, Homo sapiens
aatatttattacctc

SEQ ID NO: 3304172 - DNA, 16 bp, Homo sapiens
aatatttattacctct

SEQ ID NO: 3304173 - DNA, 18 bp, Homo sapiens
aatatttattacctctga

SEQ ID NO: 3304174 - DNA, 19 bp, Homo sapiens
aatatttattattttcacc

SEQ ID NO: 3304175 - DNA, 20 bp, Homo sapiens
aatatttattattttcacct

SEQ ID NO: 3304176 - DNA, 11 bp, Homo sapiens
aatatttattt

SEQ ID NO: 3304177 - DNA, 16 bp, Homo sapiens
aatatttcaagtgcct

SEQ ID NO: 3304178 - DNA, 18 bp, Homo sapiens
aatatttcaagtgcctag

SEQ ID NO: 3304179 - DNA, 16 bp, Homo sapiens
aatatttccatatgga

SEQ ID NO: 3304180 - DNA, 22 bp, Homo sapiens
aatatttcctgacttgagtgtt

SEQ ID NO: 3304181 - DNA, 21 bp, Homo sapiens
aatatttccttaaactgtgtg

SEQ ID NO: 3304182 - DNA, 13 bp, Homo sapiens
aatatttctattg

SEQ ID NO: 3304183 - DNA, 20 bp, Homo sapiens
aatatttgaataatgacaga

SEQ ID NO: 3304184 - DNA, 15 bp, Homo sapiens
aatatttgaatgaaa

SEQ ID NO: 3304185 - DNA, 18 bp, Homo sapiens
aatatttgactattctgt

SEQ ID NO: 3304186 - DNA, 16 bp, Homo sapiens
aatatttgacttgcat

SEQ ID NO: 3304187 - DNA, 15 bp, Homo sapiens
aatattttctgggtt

SEQ ID NO: 3304188 - DNA, 21 bp, Homo sapiens
aatattttctttaatgctttt

SEQ ID NO: 3304189 - DNA, 14 bp, Homo sapiens
aatattttgataat

SEQ ID NO: 3304190 - DNA, 15 bp, Homo sapiens
aatattttgataata

SEQ ID NO: 3304191 - DNA, 10 bp, Homo sapiens
aatattttgg

SEQ ID NO: 3304192 - DNA, 12 bp, Homo sapiens
aatattttggaa

SEQ ID NO: 3304193 - DNA, 16 bp, Homo sapiens
aatattttgttcttat

SEQ ID NO: 3304194 - DNA, 23 bp, Homo sapiens
aatatttttgaaaggcatgttcc

SEQ ID NO: 3304195 - DNA, 17 bp, Homo sapiens
aatattttttatttcta

SEQ ID NO: 3304196 - DNA, 13 bp, Homo sapiens
aatattttttgca

SEQ ID NO: 3304197 - DNA, 14 bp, Homo sapiens
aatattttttgcaa

SEQ ID NO: 3304198 - DNA, 15 bp, Homo sapiens
aatattttttgcaag

SEQ ID NO: 3304199 - DNA, 16 bp, Homo sapiens
aatattttttgcaagt

SEQ ID NO: 3304200 - DNA, 17 bp, Homo sapiens
aatattttttgcaagtt

SEQ ID NO: 3304201 - DNA, 14 bp, Homo sapiens
aatcaaagaattac

SEQ ID NO: 3304202 - DNA, 16 bp, Homo sapiens
aatcaaagaattacag

SEQ ID NO: 3304203 - DNA, 17 bp, Homo sapiens
aatcaaagaattacagt

SEQ ID NO: 3304204 - DNA, 18 bp, Homo sapiens
aatcaaataagtatttat

SEQ ID NO: 3304205 - DNA, 18 bp, Homo sapiens
aatcaaatctcctgctga

SEQ ID NO: 3304206 - DNA, 12 bp, Homo sapiens
aatcaaatgatt

SEQ ID NO: 3304207 - DNA, 13 bp, Homo sapiens
aatcaaatgattt

SEQ ID NO: 3304208 - DNA, 18 bp, Homo sapiens
aatcaaatgatttcatat

SEQ ID NO: 3304209 - DNA, 12 bp, Homo sapiens
aatcaacagaag

SEQ ID NO: 3304210 - DNA, 14 bp, Homo sapiens
aatcaagtaatgaa

SEQ ID NO: 3304211 - DNA, 14 bp, Homo sapiens
aatcacaaaaattt

SEQ ID NO: 3304212 - DNA, 19 bp, Homo sapiens
aatcacactgtcttctgat

SEQ ID NO: 3304213 - DNA, 17 bp, Homo sapiens
aatcaccttctttgtaa

SEQ ID NO: 3304214 - DNA, 18 bp, Homo sapiens
aatcactgcagcccagga

SEQ ID NO: 3304215 - DNA, 16 bp, Homo sapiens
aatcactgtttttaga

SEQ ID NO: 3304216 - DNA, 14 bp, Homo sapiens
aatcagaaaagtaa

SEQ ID NO: 3304217 - DNA, 24 bp, Homo sapiens
aatcagaagtcatcttgctaccag

SEQ ID NO: 3304218 - DNA, 18 bp, Homo sapiens
aatcagagagcaaggcat

SEQ ID NO: 3304219 - DNA, 17 bp, Homo sapiens
aatcagagtagaaataa

SEQ ID NO: 3304220 - DNA, 16 bp, Homo sapiens
aatcagcactgaaaat

SEQ ID NO: 3304221 - DNA, 18 bp, Homo sapiens
aatcagctctcctggctc

SEQ ID NO: 3304222 - DNA, 17 bp, Homo sapiens
aatcagggaccagcttt

SEQ ID NO: 3304223 - DNA, 19 bp, Homo sapiens
aatcagggaggtcattttg

SEQ ID NO: 3304224 - DNA, 22 bp, Homo sapiens
aatcagtcatgtgtaatatgca

SEQ ID NO: 3304225 - DNA, 17 bp, Homo sapiens
aatcagtctatccacag

SEQ ID NO: 3304226 - DNA, 20 bp, Homo sapiens
aatcagtgatctatgtttgt

SEQ ID NO: 3304227 - DNA, 18 bp, Homo sapiens
aatcagtgggcaggataa

SEQ ID NO: 3304228 - DNA, 14 bp, Homo sapiens
aatcagtttttcat

SEQ ID NO: 3304229 - DNA, 13 bp, Homo sapiens
aatcataaagtca

SEQ ID NO: 3304230 - DNA, 17 bp, Homo sapiens
aatgtaaaatgttgaat

SEQ ID NO: 3304231 - DNA, 14 bp, Homo sapiens
aatgtaaagaactt

SEQ ID NO: 3304232 - DNA, 21 bp, Homo sapiens
aatgtaaagaacttaaattat

SEQ ID NO: 3304233 - DNA, 22 bp, Homo sapiens
aatgtaaagaacttaaattatg

SEQ ID NO: 3304234 - DNA, 14 bp, Homo sapiens
aatgtaaatttata

SEQ ID NO: 3304235 - DNA, 22 bp, Homo sapiens
aatgtaacatcataattacatt

SEQ ID NO: 3304236 - DNA, 23 bp, Homo sapiens
aatgtaactccagatagagaaat

SEQ ID NO: 3304237 - DNA, 12 bp, Homo sapiens
aatgtaagaaaa

SEQ ID NO: 3304238 - DNA, 21 bp, Homo sapiens
aatgtaagaaaacaaaatcta

SEQ ID NO: 3304239 - DNA, 19 bp, Homo sapiens
aatgtaagattatagattc

SEQ ID NO: 3304240 - DNA, 20 bp, Homo sapiens
aatgtaagattatagattct

SEQ ID NO: 3304241 - DNA, 22 bp, Homo sapiens
aatgtaagcaaaggctctgaaa

SEQ ID NO: 3304242 - DNA, 19 bp, Homo sapiens
aatgtaatcaatgtttctt

SEQ ID NO: 3304243 - DNA, 13 bp, Homo sapiens
aatgtaatttaaa

SEQ ID NO: 3304244 - DNA, 17 bp, Homo sapiens
aatgtaatttaaatgaa

SEQ ID NO: 3304245 - DNA, 18 bp, Homo sapiens
aatgtaatttgtgtaata

SEQ ID NO: 3304246 - DNA, 17 bp, Homo sapiens
aatgtacaagttttgta

SEQ ID NO: 3304247 - DNA, 18 bp, Homo sapiens
aatgtacaagttttgtat

SEQ ID NO: 3304248 - DNA, 21 bp, Homo sapiens
aatgtaccttctttcactctg

SEQ ID NO: 3304249 - DNA, 17 bp, Homo sapiens
aatgtactgatttcagt

SEQ ID NO: 3304250 - DNA, 19 bp, Homo sapiens
aatgtaggcttagtttgtg

SEQ ID NO: 3304251 - DNA, 20 bp, Homo sapiens
aatgtaggtatgaataagtt

SEQ ID NO: 3304252 - DNA, 14 bp, Homo sapiens
aatgtataaagatt

SEQ ID NO: 3304253 - DNA, 13 bp, Homo sapiens
aatgtataaatat

SEQ ID NO: 3304254 - DNA, 16 bp, Homo sapiens
aatgtataaatataca

SEQ ID NO: 3304255 - DNA, 12 bp, Homo sapiens
aatgtatataaa

SEQ ID NO: 3304256 - DNA, 14 bp, Homo sapiens
aatgtatatacaca

SEQ ID NO: 3304257 - DNA, 16 bp, Homo sapiens
aatgtatcatagaaat

SEQ ID NO: 3304258 - DNA, 19 bp, Homo sapiens
aatgtatcatagaaatgta

SEQ ID NO: 3304259 - DNA, 22 bp, Homo sapiens
aatgtatcccttctcacagcac

SEQ ID NO: 3304260 - DNA, 13 bp, Homo sapiens
aatgtatctaaga

SEQ ID NO: 3304261 - DNA, 16 bp, Homo sapiens
aatgtatcttattcac

SEQ ID NO: 3304262 - DNA, 20 bp, Homo sapiens
aatgtatgcattcacattta

SEQ ID NO: 3304263 - DNA, 12 bp, Homo sapiens
aatgtatgtgaa

SEQ ID NO: 3304264 - DNA, 18 bp, Homo sapiens
aatgtatgtgaaagtgta

SEQ ID NO: 3304265 - DNA, 18 bp, Homo sapiens
aatgtatgtgcactgtca

SEQ ID NO: 3304266 - DNA, 12 bp, Homo sapiens
aatgtatgtgta

SEQ ID NO: 3304267 - DNA, 14 bp, Homo sapiens
aatgtattattctg

SEQ ID NO: 3304268 - DNA, 17 bp, Homo sapiens
aatgtattattctgcag

SEQ ID NO: 3304269 - DNA, 18 bp, Homo sapiens
aatgtattattctgcagc

SEQ ID NO: 3304270 - DNA, 13 bp, Homo sapiens
aatgtattcaagc

SEQ ID NO: 3304271 - DNA, 14 bp, Homo sapiens
aatgtattcaagca

SEQ ID NO: 3304272 - DNA, 19 bp, Homo sapiens
aatgtattcaagcaaacat

SEQ ID NO: 3304273 - DNA, 19 bp, Homo sapiens
aatgtattcctgaaaagct

SEQ ID NO: 3304274 - DNA, 13 bp, Homo sapiens
aatgtatttatgt

SEQ ID NO: 3304275 - DNA, 17 bp, Homo sapiens
aatgtatttatgtgtat

SEQ ID NO: 3304276 - DNA, 21 bp, Homo sapiens
aatgtatttatgtgtatattt

SEQ ID NO: 3304277 - DNA, 17 bp, Homo sapiens
aatgtatttgttcatgt

SEQ ID NO: 3304278 - DNA, 21 bp, Homo sapiens
aatgtatttgttcatgtttgg

SEQ ID NO: 3304279 - DNA, 20 bp, Homo sapiens
aatgtattttcagctcaatt

SEQ ID NO: 3304280 - DNA, 21 bp, Homo sapiens
aatgtcaactgtgtctctgaa

SEQ ID NO: 3304281 - DNA, 12 bp, Homo sapiens
aatgtcaaggca

SEQ ID NO: 3304282 - DNA, 15 bp, Homo sapiens
aatgtcacaggcagg

SEQ ID NO: 3304283 - DNA, 16 bp, Homo sapiens
aatgtcacaggcaggt

SEQ ID NO: 3304284 - DNA, 19 bp, Homo sapiens
aatgtcacaggcaggtcca

SEQ ID NO: 3304285 - DNA, 20 bp, Homo sapiens
aatgtcacgtactgtctgat

SEQ ID NO: 3304286 - DNA, 22 bp, Homo sapiens
aatgtcacgtactgtctgattg

SEQ ID NO: 3304287 - DNA, 19 bp, Homo sapiens
aatgtcagatgcgtgccca

SEQ ID NO: 3304288 - DNA, 13 bp, Homo sapiens
aatgtcagtattt

SEQ ID NO: 3304289 - DNA, 12 bp, Homo sapiens
aatgtcagtgtt

SEQ ID NO: 3304290 - DNA, 15 bp, Homo sapiens
aatgtcatatactgc

SEQ ID NO: 3304291 - DNA, 18 bp, Homo sapiens
aatgtcatatactgccat

SEQ ID NO: 3304292 - DNA, 19 bp, Homo sapiens
aatgtcccccatcatgtgg

SEQ ID NO: 3304293 - DNA, 23 bp, Homo sapiens
aatgtcctccagaagcctctggc

SEQ ID NO: 3304294 - DNA, 15 bp, Homo sapiens
aatgtctaaaattgt

SEQ ID NO: 3304295 - DNA, 17 bp, Homo sapiens
aatgtctaaatgctgaa

SEQ ID NO: 3304296 - DNA, 14 bp, Homo sapiens
aatgtctattaagg

SEQ ID NO: 3304297 - DNA, 16 bp, Homo sapiens
aatgtctcactgttct

SEQ ID NO: 3304298 - DNA, 13 bp, Homo sapiens
aatgtctcctccc

SEQ ID NO: 3304299 - DNA, 20 bp, Homo sapiens
aatgtctctttaatgtcaca

SEQ ID NO: 3304300 - DNA, 17 bp, Homo sapiens
aatgtctgagtgaacct

SEQ ID NO: 3304301 - DNA, 19 bp, Homo sapiens
aatgtctggagtggtaaca

SEQ ID NO: 3304302 - DNA, 17 bp, Homo sapiens
aatgtcttcatttcatt

SEQ ID NO: 3304303 - DNA, 22 bp, Homo sapiens
aatgtctttgttggaaaagaat

SEQ ID NO: 3304304 - DNA, 15 bp, Homo sapiens
aatgtcttttgaata

SEQ ID NO: 3304305 - DNA, 15 bp, Homo sapiens
aatgtgaaaaaaatt

SEQ ID NO: 3304306 - DNA, 15 bp, Homo sapiens
aatgtgaaaagtatc

SEQ ID NO: 3304307 - DNA, 17 bp, Homo sapiens
aatgtgaacttgtagct

SEQ ID NO: 3304308 - DNA, 15 bp, Homo sapiens
aatgtgaactttatt

SEQ ID NO: 3304309 - DNA, 20 bp, Homo sapiens
aatgtgatcaactgttcagg

SEQ ID NO: 3304310 - DNA, 18 bp, Homo sapiens
aatgtgatgatgtaattg

SEQ ID NO: 3304311 - DNA, 20 bp, Homo sapiens
aatgtgatgatgtaattgac

SEQ ID NO: 3304312 - DNA, 22 bp, Homo sapiens
aatgtgatggatggcacaatga

SEQ ID NO: 3304313 - DNA, 23 bp, Homo sapiens
aatgtgatggatggcacaatgaa

SEQ ID NO: 3304314 - DNA, 13 bp, Homo sapiens
aatgtgatgttct

SEQ ID NO: 3304315 - DNA, 17 bp, Homo sapiens
aatgtgatgttctaagg

SEQ ID NO: 3304316 - DNA, 19 bp, Homo sapiens
aatgtgattctaatgtctt

SEQ ID NO: 3304317 - DNA, 16 bp, Homo sapiens
aatgtgatttttctga

SEQ ID NO: 3304318 - DNA, 16 bp, Homo sapiens
aatgtgatttttgtaa

SEQ ID NO: 3304319 - DNA, 15 bp, Homo sapiens
aatgtgcccctggcc

SEQ ID NO: 3304320 - DNA, 18 bp, Homo sapiens
aatgtgcccctggcccat

SEQ ID NO: 3304321 - DNA, 20 bp, Homo sapiens
aatgtgcctaatggagaaga

SEQ ID NO: 3304322 - DNA, 19 bp, Homo sapiens
aatgtgctactgattgttt

SEQ ID NO: 3304323 - DNA, 15 bp, Homo sapiens
aatgtggaagaaaat

SEQ ID NO: 3304324 - DNA, 22 bp, Homo sapiens
aatgtggcaaggaaaaacaggt

SEQ ID NO: 3304325 - DNA, 20 bp, Homo sapiens
aatgtggccacttatttcac

SEQ ID NO: 3304326 - DNA, 14 bp, Homo sapiens
aatgtggctcctgg

SEQ ID NO: 3304327 - DNA, 13 bp, Homo sapiens
aatgtgggcactg

SEQ ID NO: 3304328 - DNA, 16 bp, Homo sapiens
aatgtgtacagtgaat

SEQ ID NO: 3304329 - DNA, 18 bp, Homo sapiens
aatgtgtacagtgaattg

SEQ ID NO: 3304330 - DNA, 23 bp, Homo sapiens
aatgtgtacagtgaattgtcttt

SEQ ID NO: 3304331 - DNA, 18 bp, Homo sapiens
aatgtgtataaattgtct

SEQ ID NO: 3304332 - DNA, 21 bp, Homo sapiens
aatgtgtatttactgtactaa

SEQ ID NO: 3304333 - DNA, 14 bp, Homo sapiens
aatgtgtcctatct

SEQ ID NO: 3304334 - DNA, 19 bp, Homo sapiens
aatgtgtcctatctatctt

SEQ ID NO: 3304335 - DNA, 13 bp, Homo sapiens
aatgtgtgaaaaa

SEQ ID NO: 3304336 - DNA, 19 bp, Homo sapiens
aatgtgtgccatagagttt

SEQ ID NO: 3304337 - DNA, 23 bp, Homo sapiens
aatgtgtggattgcctctgaaaa

SEQ ID NO: 3304338 - DNA, 18 bp, Homo sapiens
aatgtgtgtatgtgtatt

SEQ ID NO: 3304339 - DNA, 21 bp, Homo sapiens
aatgtgtgtatgtgtatttat

SEQ ID NO: 3304340 - DNA, 19 bp, Homo sapiens
aatgtgtgtgtgtggcagg

SEQ ID NO: 3304341 - DNA, 13 bp, Homo sapiens
aatgttaaatttg

SEQ ID NO: 3304342 - DNA, 17 bp, Homo sapiens
aatgttaaatttgtaag

SEQ ID NO: 3304343 - DNA, 14 bp, Homo sapiens
aatgttaagaattg

SEQ ID NO: 3304344 - DNA, 22 bp, Homo sapiens
aatgttaaggaaactcttatct

SEQ ID NO: 3304345 - DNA, 22 bp, Homo sapiens
aatgttaaggacttctgcagct

SEQ ID NO: 3304346 - DNA, 22 bp, Homo sapiens
aatgttaataaagcccgcgtct

SEQ ID NO: 3304347 - DNA, 15 bp, Homo sapiens
aatgttacattgttt

SEQ ID NO: 3304348 - DNA, 23 bp, Homo sapiens
aatgttactcagatataagagaa

SEQ ID NO: 3304349 - DNA, 13 bp, Homo sapiens
aatgttactgatc

SEQ ID NO: 3304350 - DNA, 19 bp, Homo sapiens
aatgttactgatcatgcat

SEQ ID NO: 3304351 - DNA, 22 bp, Homo sapiens
aatgttagaggttttaaagtga

SEQ ID NO: 3304352 - DNA, 13 bp, Homo sapiens
aatgttagatatt

SEQ ID NO: 3304353 - DNA, 13 bp, Homo sapiens
aatgttagtattt

SEQ ID NO: 3304354 - DNA, 18 bp, Homo sapiens
aatgttagtattttaatc

SEQ ID NO: 3304355 - DNA, 17 bp, Homo sapiens
aatgttatatcatatgt

SEQ ID NO: 3304356 - DNA, 16 bp, Homo sapiens
aatttgactaatttta

SEQ ID NO: 3304357 - DNA, 15 bp, Homo sapiens
aatttgatacttata

SEQ ID NO: 3304358 - DNA, 18 bp, Homo sapiens
aatttgatcgttccagtt

SEQ ID NO: 3304359 - DNA, 15 bp, Homo sapiens
aatttgattaacaaa

SEQ ID NO: 3304360 - DNA, 17 bp, Homo sapiens
aatttgattaacaaata

SEQ ID NO: 3304361 - DNA, 20 bp, Homo sapiens
aatttgattgactgcccatt

SEQ ID NO: 3304362 - DNA, 18 bp, Homo sapiens
aatttgcacagtgtgtga

SEQ ID NO: 3304363 - DNA, 16 bp, Homo sapiens
aatttgcatattctat

SEQ ID NO: 3304364 - DNA, 21 bp, Homo sapiens
aatttgcattaaattcacaaa

SEQ ID NO: 3304365 - DNA, 23 bp, Homo sapiens
aatttgcattaaattcacaaact

SEQ ID NO: 3304366 - DNA, 13 bp, Homo sapiens
aatttgcctgctg

SEQ ID NO: 3304367 - DNA, 13 bp, Homo sapiens
aatttgctttaat

SEQ ID NO: 3304368 - DNA, 16 bp, Homo sapiens
aatttgctttaattaa

SEQ ID NO: 3304369 - DNA, 22 bp, Homo sapiens
aatttggaggctggagtaatca

SEQ ID NO: 3304370 - DNA, 16 bp, Homo sapiens
aatttggattgctaat

SEQ ID NO: 3304371 - DNA, 22 bp, Homo sapiens
aatttggttctaatagaactca

SEQ ID NO: 3304372 - DNA, 16 bp, Homo sapiens
aatttggtttgttaat

SEQ ID NO: 3304373 - DNA, 24 bp, Homo sapiens
aatttgtaaaaacagcattgcttt

SEQ ID NO: 3304374 - DNA, 15 bp, Homo sapiens
aatttgtaacctcag

SEQ ID NO: 3304375 - DNA, 19 bp, Homo sapiens
aatttgtaattgcttacat

SEQ ID NO: 3304376 - DNA, 22 bp, Homo sapiens
aatttgtacaggactgtaaaga

SEQ ID NO: 3304377 - DNA, 21 bp, Homo sapiens
aatttgtattactttctctgt

SEQ ID NO: 3304378 - DNA, 19 bp, Homo sapiens
aatttgtgtaataaagtgt

SEQ ID NO: 3304379 - DNA, 21 bp, Homo sapiens
aatttgttggggctttacata

SEQ ID NO: 3304380 - DNA, 22 bp, Homo sapiens
aatttgtttacttgtaaattga

SEQ ID NO: 3304381 - DNA, 16 bp, Homo sapiens
aatttgtttcttctgt

SEQ ID NO: 3304382 - DNA, 21 bp, Homo sapiens
aatttgtttcttctgtcttta

SEQ ID NO: 3304383 - DNA, 16 bp, Homo sapiens
aattttaaagtatgca

SEQ ID NO: 3304384 - DNA, 17 bp, Homo sapiens
aattttaaagtgcaaaa

SEQ ID NO: 3304385 - DNA, 18 bp, Homo sapiens
aattttaaataaaagtga

SEQ ID NO: 3304386 - DNA, 22 bp, Homo sapiens
aattttaaataacctctggccc

SEQ ID NO: 3304387 - DNA, 17 bp, Homo sapiens
aattttaaataatttct

SEQ ID NO: 3304388 - DNA, 19 bp, Homo sapiens
aattttaagtgctttgtaa

SEQ ID NO: 3304389 - DNA, 20 bp, Homo sapiens
aattttacatgtttataaat

SEQ ID NO: 3304390 - DNA, 23 bp, Homo sapiens
aattttactccataaacagactg

SEQ ID NO: 3304391 - DNA, 13 bp, Homo sapiens
aattttagaaata

SEQ ID NO: 3304392 - DNA, 20 bp, Homo sapiens
aattttatagctcagtttat

SEQ ID NO: 3304393 - DNA, 14 bp, Homo sapiens
aattttatccctca

SEQ ID NO: 3304394 - DNA, 20 bp, Homo sapiens
aattttatccctcacctgta

SEQ ID NO: 3304395 - DNA, 19 bp, Homo sapiens
aattttattttaaaatttc

SEQ ID NO: 3304396 - DNA, 23 bp, Homo sapiens
aattttattttgtgctcatttaa

SEQ ID NO: 3304397 - DNA, 12 bp, Homo sapiens
aattttcagcat

SEQ ID NO: 3304398 - DNA, 18 bp, Homo sapiens
aattttcattaaacttga

SEQ ID NO: 3304399 - DNA, 21 bp, Homo sapiens
aattttcattaaacttgaagc

SEQ ID NO: 3304400 - DNA, 16 bp, Homo sapiens
aattttctaaaagctt

SEQ ID NO: 3304401 - DNA, 21 bp, Homo sapiens
aattttctaaaagctttcatg

SEQ ID NO: 3304402 - DNA, 15 bp, Homo sapiens
aattttctagacttt

SEQ ID NO: 3304403 - DNA, 20 bp, Homo sapiens
aattttctagactttctgtt

SEQ ID NO: 3304404 - DNA, 22 bp, Homo sapiens
aattttctccctttatgtatct

SEQ ID NO: 3304405 - DNA, 14 bp, Homo sapiens
aattttcttcagtt

SEQ ID NO: 3304406 - DNA, 13 bp, Homo sapiens
aattttcttcatg

SEQ ID NO: 3304407 - DNA, 19 bp, Homo sapiens
aattttcttcatgcaatga

SEQ ID NO: 3304408 - DNA, 17 bp, Homo sapiens
aattttctttgtttctt

SEQ ID NO: 3304409 - DNA, 21 bp, Homo sapiens
aattttgaataaataaatgta

SEQ ID NO: 3304410 - DNA, 20 bp, Homo sapiens
aattttgagttctacataag

SEQ ID NO: 3304411 - DNA, 19 bp, Homo sapiens
aattttgcaaatataaaca

SEQ ID NO: 3304412 - DNA, 21 bp, Homo sapiens
aattttgcaaatataaacatc

SEQ ID NO: 3304413 - DNA, 17 bp, Homo sapiens
aattttgcctttaacag

SEQ ID NO: 3304414 - DNA, 12 bp, Homo sapiens
aattttggattt

SEQ ID NO: 3304415 - DNA, 12 bp, Homo sapiens
aattttgtgatg

SEQ ID NO: 3304416 - DNA, 13 bp, Homo sapiens
aattttgtgatga

SEQ ID NO: 3304417 - DNA, 14 bp, Homo sapiens
aattttgtgcattc

SEQ ID NO: 3304418 - DNA, 16 bp, Homo sapiens
aattttgtgcattctt

SEQ ID NO: 3304419 - DNA, 13 bp, Homo sapiens
aattttgtgttgc

SEQ ID NO: 3304420 - DNA, 22 bp, Homo sapiens
aattttgttgaaaatggtttca

SEQ ID NO: 3304421 - DNA, 14 bp, Homo sapiens
aattttgtttttat

SEQ ID NO: 3304422 - DNA, 21 bp, Homo sapiens
aattttgtttttattttcaag

SEQ ID NO: 3304423 - DNA, 22 bp, Homo sapiens
aattttgtttttattttcaaga

SEQ ID NO: 3304424 - DNA, 20 bp, Homo sapiens
aatttttaaagtatatattt

SEQ ID NO: 3304425 - DNA, 13 bp, Homo sapiens
aatttttaagcaa

SEQ ID NO: 3304426 - DNA, 14 bp, Homo sapiens
aatttttaatgatg

SEQ ID NO: 3304427 - DNA, 14 bp, Homo sapiens
aatttttacattca

SEQ ID NO: 3304428 - DNA, 20 bp, Homo sapiens
aatttttacattcatcaata

SEQ ID NO: 3304429 - DNA, 18 bp, Homo sapiens
aatttttattaaattatg

SEQ ID NO: 3304430 - DNA, 16 bp, Homo sapiens
aatttttatttttcta

SEQ ID NO: 3304431 - DNA, 19 bp, Homo sapiens
aatttttgcttttagaaaa

SEQ ID NO: 3304432 - DNA, 12 bp, Homo sapiens
aatttttgtatt

SEQ ID NO: 3304433 - DNA, 17 bp, Homo sapiens
aatttttgtattatttt

SEQ ID NO: 3304434 - DNA, 15 bp, Homo sapiens
aatttttgtctcaga

SEQ ID NO: 3304435 - DNA, 22 bp, Homo sapiens
aattttttgaaacacaatacct

SEQ ID NO: 3304436 - DNA, 18 bp, Homo sapiens
aatttttttatgttttgt

SEQ ID NO: 3304437 - DNA, 19 bp, Homo sapiens
aatttttttcaatatttat

SEQ ID NO: 3304438 - DNA, 15 bp, Homo sapiens
aattttttttaaaga

SEQ ID NO: 3304439 - DNA, 19 bp, Homo sapiens
aattttttttaatgtacaa

SEQ ID NO: 3304440 - DNA, 21 bp, Homo sapiens
aattttttttttcctcttcag

SEQ ID NO: 3304441 - DNA, 19 bp, Homo sapiens
acaaaaaaaaagttttatt

SEQ ID NO: 3304442 - DNA, 22 bp, Homo sapiens
acaaaaaaaaagttttattttt

SEQ ID NO: 3304443 - DNA, 17 bp, Homo sapiens
acaaaaaaatttaaaat

SEQ ID NO: 3304444 - DNA, 11 bp, Homo sapiens
acaaaaaataa

SEQ ID NO: 3304445 - DNA, 22 bp, Homo sapiens
acaaaaacaggtatatactttg

SEQ ID NO: 3304446 - DNA, 15 bp, Homo sapiens
acaaaaaccagcagg

SEQ ID NO: 3304447 - DNA, 19 bp, Homo sapiens
acaaaaagaaatcttgtct

SEQ ID NO: 3304448 - DNA, 18 bp, Homo sapiens
acaaaaagtttccatatg

SEQ ID NO: 3304449 - DNA, 11 bp, Homo sapiens
acaaaaatggg

SEQ ID NO: 3304450 - DNA, 21 bp, Homo sapiens
acaaaaatgtaatgatcataa

SEQ ID NO: 3304451 - DNA, 14 bp, Homo sapiens
acaaaaattgtctt

SEQ ID NO: 3304452 - DNA, 23 bp, Homo sapiens
acaaaacactcggcatttcaaat

SEQ ID NO: 3304453 - DNA, 23 bp, Homo sapiens
acaaaacttaaaagtattcatac

SEQ ID NO: 3304454 - DNA, 11 bp, Homo sapiens
acaaaacttct

SEQ ID NO: 3304455 - DNA, 15 bp, Homo sapiens
acaaaagaaatacct

SEQ ID NO: 3304456 - DNA, 11 bp, Homo sapiens
acaaaagatgt

SEQ ID NO: 3304457 - DNA, 20 bp, Homo sapiens
acaaaagctgtaaattacta

SEQ ID NO: 3304458 - DNA, 20 bp, Homo sapiens
acaaaagttctgcgtaatga

SEQ ID NO: 3304459 - DNA, 14 bp, Homo sapiens
acaaaataaacaaa

SEQ ID NO: 3304460 - DNA, 19 bp, Homo sapiens
acaaaatacaatcctgttt

SEQ ID NO: 3304461 - DNA, 15 bp, Homo sapiens
acaaaatagaagctg

SEQ ID NO: 3304462 - DNA, 18 bp, Homo sapiens
acaaaatctaaaacaaaa

SEQ ID NO: 3304463 - DNA, 22 bp, Homo sapiens
acaaaatctaaaacaaaatctg

SEQ ID NO: 3304464 - DNA, 14 bp, Homo sapiens
acaaaatctgttta

SEQ ID NO: 3304465 - DNA, 22 bp, Homo sapiens
acaaaatgtagggttataataa

SEQ ID NO: 3304466 - DNA, 15 bp, Homo sapiens
acaaaatttagtttt

SEQ ID NO: 3304467 - DNA, 14 bp, Homo sapiens
acaaacaaaactta

SEQ ID NO: 3304468 - DNA, 15 bp, Homo sapiens
acaaacaaaacttaa

SEQ ID NO: 3304469 - DNA, 22 bp, Homo sapiens
acaaacactgcagaacagcatc

SEQ ID NO: 3304470 - DNA, 13 bp, Homo sapiens
acaaacattgtgt

SEQ ID NO: 3304471 - DNA, 20 bp, Homo sapiens
acaaacattgtgttgacatt

SEQ ID NO: 3304472 - DNA, 11 bp, Homo sapiens
acaaacatttt

SEQ ID NO: 3304473 - DNA, 16 bp, Homo sapiens
acaaacatttttcaac

SEQ ID NO: 3304474 - DNA, 13 bp, Homo sapiens
acaaaccaacatc

SEQ ID NO: 3304475 - DNA, 16 bp, Homo sapiens
acaaaccaacatcttt

SEQ ID NO: 3304476 - DNA, 16 bp, Homo sapiens
acaaaccacaactgac

SEQ ID NO: 3304477 - DNA, 21 bp, Homo sapiens
acaaaccacaactgacacagg

SEQ ID NO: 3304478 - DNA, 21 bp, Homo sapiens
acaaaccgagtgcaatgaatg

SEQ ID NO: 3304479 - DNA, 18 bp, Homo sapiens
acaaacctagaattttct

SEQ ID NO: 3304480 - DNA, 16 bp, Homo sapiens
acaaactacatgtaat

SEQ ID NO: 3304481 - DNA, 22 bp, Homo sapiens
acacctccctactcccctgggc

SEQ ID NO: 3304482 - DNA, 13 bp, Homo sapiens
acacctccctgaa

SEQ ID NO: 3304483 - DNA, 19 bp, Homo sapiens
acacctgatcttacagaaa

SEQ ID NO: 3304484 - DNA, 13 bp, Homo sapiens
acacctggactga

SEQ ID NO: 3304485 - DNA, 17 bp, Homo sapiens
acacctgggcttaagaa

SEQ ID NO: 3304486 - DNA, 22 bp, Homo sapiens
acacctgttcacagaaaaagca

SEQ ID NO: 3304487 - DNA, 15 bp, Homo sapiens
acaccttcattttga

SEQ ID NO: 3304488 - DNA, 20 bp, Homo sapiens
acaccttccagctcctgtaa

SEQ ID NO: 3304489 - DNA, 14 bp, Homo sapiens
acaccttcctcctg

SEQ ID NO: 3304490 - DNA, 19 bp, Homo sapiens
acaccttggggtccctcca

SEQ ID NO: 3304491 - DNA, 22 bp, Homo sapiens
acaccttgtgaccttctctata

SEQ ID NO: 3304492 - DNA, 16 bp, Homo sapiens
acacctttaggttctt

SEQ ID NO: 3304493 - DNA, 21 bp, Homo sapiens
acaccttttattgacacagaa

SEQ ID NO: 3304494 - DNA, 23 bp, Homo sapiens
acaccttttccccaaccacagag

SEQ ID NO: 3304495 - DNA, 13 bp, Homo sapiens
acacgaaacttgt

SEQ ID NO: 3304496 - DNA, 13 bp, Homo sapiens
acacgatgcattt

SEQ ID NO: 3304497 - DNA, 14 bp, Homo sapiens
acacgatgcattta

SEQ ID NO: 3304498 - DNA, 19 bp, Homo sapiens
acacgatgcatttaataaa

SEQ ID NO: 3304499 - DNA, 23 bp, Homo sapiens
acacgcaagggcatcaggcactg

SEQ ID NO: 3304500 - DNA, 14 bp, Homo sapiens
acacgcacgcacac

SEQ ID NO: 3304501 - DNA, 15 bp, Homo sapiens
acacgcacgcacaca

SEQ ID NO: 3304502 - DNA, 18 bp, Homo sapiens
acacgcacgcacacacac

SEQ ID NO: 3304503 - DNA, 20 bp, Homo sapiens
acacgcatggtcaaccctca

SEQ ID NO: 3304504 - DNA, 21 bp, Homo sapiens
acacggactcccgggccacgc

SEQ ID NO: 3304505 - DNA, 14 bp, Homo sapiens
acacggaggcatct

SEQ ID NO: 3304506 - DNA, 17 bp, Homo sapiens
acacggaggcatctgca

SEQ ID NO: 3304507 - DNA, 22 bp, Homo sapiens
acacggctgcctgacactgagc

SEQ ID NO: 3304508 - DNA, 21 bp, Homo sapiens
acacgtatttatatttggaaa

SEQ ID NO: 3304509 - DNA, 14 bp, Homo sapiens
acacgtggcctgca

SEQ ID NO: 3304510 - DNA, 23 bp, Homo sapiens
acactaaaagcagcgtcactcta

SEQ ID NO: 3304511 - DNA, 12 bp, Homo sapiens
acactaaaattt

SEQ ID NO: 3304512 - DNA, 14 bp, Homo sapiens
acactaaaatttaa

SEQ ID NO: 3304513 - DNA, 17 bp, Homo sapiens
acactaaagatccaaga

SEQ ID NO: 3304514 - DNA, 18 bp, Homo sapiens
acactaaaggtggaaata

SEQ ID NO: 3304515 - DNA, 14 bp, Homo sapiens
acactaacatttcc

SEQ ID NO: 3304516 - DNA, 22 bp, Homo sapiens
acactaaccaagctgagtttcc

SEQ ID NO: 3304517 - DNA, 23 bp, Homo sapiens
acactaaccaagctgagtttcct

SEQ ID NO: 3304518 - DNA, 14 bp, Homo sapiens
acactaaccacgct

SEQ ID NO: 3304519 - DNA, 23 bp, Homo sapiens
acactaagttatagtatatctgg

SEQ ID NO: 3304520 - DNA, 19 bp, Homo sapiens
acactaatgagtatttggt

SEQ ID NO: 3304521 - DNA, 20 bp, Homo sapiens
acactaatgagtatttggta

SEQ ID NO: 3304522 - DNA, 12 bp, Homo sapiens
acactaattcat

SEQ ID NO: 3304523 - DNA, 12 bp, Homo sapiens
acactaattcct

SEQ ID NO: 3304524 - DNA, 19 bp, Homo sapiens
acactactgctaaatcctc

SEQ ID NO: 3304525 - DNA, 18 bp, Homo sapiens
acactacttttgcttttt

SEQ ID NO: 3304526 - DNA, 13 bp, Homo sapiens
acactagcctctc

SEQ ID NO: 3304527 - DNA, 23 bp, Homo sapiens
acactagccttggcctctttcct

SEQ ID NO: 3304528 - DNA, 15 bp, Homo sapiens
acactatatatttta

SEQ ID NO: 3304529 - DNA, 15 bp, Homo sapiens
acactatgcacagag

SEQ ID NO: 3304530 - DNA, 18 bp, Homo sapiens
acactatggtatttgagt

SEQ ID NO: 3304531 - DNA, 14 bp, Homo sapiens
acactattttcaga

SEQ ID NO: 3304532 - DNA, 15 bp, Homo sapiens
acactattttcagaa

SEQ ID NO: 3304533 - DNA, 16 bp, Homo sapiens
acactcagaaagaggt

SEQ ID NO: 3304534 - DNA, 18 bp, Homo sapiens
acactccaccctccacct

SEQ ID NO: 3304535 - DNA, 11 bp, Homo sapiens
acactccaggc

SEQ ID NO: 3304536 - DNA, 18 bp, Homo sapiens
acactccaggccctgccc

SEQ ID NO: 3304537 - DNA, 14 bp, Homo sapiens
acactccagtgcca

SEQ ID NO: 3304538 - DNA, 23 bp, Homo sapiens
acactctctggaagccctggaga

SEQ ID NO: 3304539 - DNA, 18 bp, Homo sapiens
acactctgagtctctgaa

SEQ ID NO: 3304540 - DNA, 12 bp, Homo sapiens
acactctgctgt

SEQ ID NO: 3304541 - DNA, 16 bp, Homo sapiens
acactctgctgtttga

SEQ ID NO: 3304542 - DNA, 19 bp, Homo sapiens
acactcttcagtgactcct

SEQ ID NO: 3304543 - DNA, 12 bp, Homo sapiens
acactgaaaatg

SEQ ID NO: 3304544 - DNA, 21 bp, Homo sapiens
acactgaaagctctgttgcaa

SEQ ID NO: 3304545 - DNA, 22 bp, Homo sapiens
acactgaccttggagagacaca

SEQ ID NO: 3304546 - DNA, 11 bp, Homo sapiens
acactgagccc

SEQ ID NO: 3304547 - DNA, 19 bp, Homo sapiens
acactgagttctatcagtt

SEQ ID NO: 3304548 - DNA, 14 bp, Homo sapiens
acactgatgcaagg

SEQ ID NO: 3304549 - DNA, 22 bp, Homo sapiens
acactgatgcttagatgttcca

SEQ ID NO: 3304550 - DNA, 17 bp, Homo sapiens
acactgccaaataaaca

SEQ ID NO: 3304551 - DNA, 14 bp, Homo sapiens
acactgccaccttg

SEQ ID NO: 3304552 - DNA, 22 bp, Homo sapiens
acactgccatcttagtttggat

SEQ ID NO: 3304553 - DNA, 19 bp, Homo sapiens
acactgcctgtatacttta

SEQ ID NO: 3304554 - DNA, 20 bp, Homo sapiens
acactgcctgtatactttag

SEQ ID NO: 3304555 - DNA, 22 bp, Homo sapiens
acactgcctgtatactttagta

SEQ ID NO: 3304556 - DNA, 13 bp, Homo sapiens
acactgctcacag

SEQ ID NO: 3304557 - DNA, 20 bp, Homo sapiens
acactgctctaacagccctc

SEQ ID NO: 3304558 - DNA, 14 bp, Homo sapiens
acactgctgtaccc

SEQ ID NO: 3304559 - DNA, 15 bp, Homo sapiens
acactgctgtaccca

SEQ ID NO: 3304560 - DNA, 14 bp, Homo sapiens
acactggctctggg

SEQ ID NO: 3304561 - DNA, 18 bp, Homo sapiens
acactgggtggtggcctg

SEQ ID NO: 3304562 - DNA, 19 bp, Homo sapiens
acactgggtggtggcctgg

SEQ ID NO: 3304563 - DNA, 20 bp, Homo sapiens
acactgggtggtggcctggt

SEQ ID NO: 3304564 - DNA, 23 bp, Homo sapiens
acactgggtggtggcctggtccc

SEQ ID NO: 3304565 - DNA, 20 bp, Homo sapiens
acactggtgggcagctgagg

SEQ ID NO: 3304566 - DNA, 17 bp, Homo sapiens
acactgtcatgcttcat

SEQ ID NO: 3304567 - DNA, 15 bp, Homo sapiens
acactgtgccctggt

SEQ ID NO: 3304568 - DNA, 20 bp, Homo sapiens
acactgtggaactaataaat

SEQ ID NO: 3304569 - DNA, 18 bp, Homo sapiens
acactgtgtacacctcaa

SEQ ID NO: 3304570 - DNA, 16 bp, Homo sapiens
acactgttagaacact

SEQ ID NO: 3304571 - DNA, 20 bp, Homo sapiens
acactgttagaacactattt

SEQ ID NO: 3304572 - DNA, 21 bp, Homo sapiens
acactgttagaacactatttt

SEQ ID NO: 3304573 - DNA, 22 bp, Homo sapiens
acactgttagaacactattttc

SEQ ID NO: 3304574 - DNA, 20 bp, Homo sapiens
acacttaagggttttagaaa

SEQ ID NO: 3304575 - DNA, 21 bp, Homo sapiens
acacttacactttatgcacaa

SEQ ID NO: 3304576 - DNA, 19 bp, Homo sapiens
acacttagtgatcatttaa

SEQ ID NO: 3304577 - DNA, 22 bp, Homo sapiens
acacttagtgatcatttaaaaa

SEQ ID NO: 3304578 - DNA, 14 bp, Homo sapiens
acacttataagtga

SEQ ID NO: 3304579 - DNA, 16 bp, Homo sapiens
acacttatcttctgga

SEQ ID NO: 3304580 - DNA, 13 bp, Homo sapiens
acacttcagagag

SEQ ID NO: 3304581 - DNA, 16 bp, Homo sapiens
acacttcagagagctg

SEQ ID NO: 3304582 - DNA, 12 bp, Homo sapiens
acacttcagatc

SEQ ID NO: 3304583 - DNA, 13 bp, Homo sapiens
acacttcttttga

SEQ ID NO: 3304584 - DNA, 14 bp, Homo sapiens
acacttgaaacctt

SEQ ID NO: 3304585 - DNA, 21 bp, Homo sapiens
acacttgagaggatgaatgta

SEQ ID NO: 3304586 - DNA, 21 bp, Homo sapiens
acacttgcaggggtccctgct

SEQ ID NO: 3304587 - DNA, 18 bp, Homo sapiens
acacttgccttcttcacc

SEQ ID NO: 3304588 - DNA, 14 bp, Homo sapiens
acacttgctcccaa

SEQ ID NO: 3304589 - DNA, 13 bp, Homo sapiens
acacttggagccc

SEQ ID NO: 3304590 - DNA, 17 bp, Homo sapiens
acacttggagcccgtgc

SEQ ID NO: 3304591 - DNA, 18 bp, Homo sapiens
acacttggagcccgtgca

SEQ ID NO: 3304592 - DNA, 15 bp, Homo sapiens
acacttgtagagcag

SEQ ID NO: 3304593 - DNA, 17 bp, Homo sapiens
acacttgtataaatgta

SEQ ID NO: 3304594 - DNA, 18 bp, Homo sapiens
acacttgtcagcctcaga

SEQ ID NO: 3304595 - DNA, 16 bp, Homo sapiens
acacttgtgtgtgggc

SEQ ID NO: 3304596 - DNA, 22 bp, Homo sapiens
acacttgtgtgtgggctgtgag

SEQ ID NO: 3304597 - DNA, 23 bp, Homo sapiens
acacttgtgtgtgggctgtgagt

SEQ ID NO: 3304598 - DNA, 19 bp, Homo sapiens
acacttgttccagctcttt

SEQ ID NO: 3304599 - DNA, 22 bp, Homo sapiens
acactttaattaccaacctgtt

SEQ ID NO: 3304600 - DNA, 19 bp, Homo sapiens
acactttgcctcctgtgta

SEQ ID NO: 3304601 - DNA, 16 bp, Homo sapiens
acagaaaaacaatctt

SEQ ID NO: 3304602 - DNA, 22 bp, Homo sapiens
acagaaaaagcatgatgggaaa

SEQ ID NO: 3304603 - DNA, 14 bp, Homo sapiens
acagaaaaataagt

SEQ ID NO: 3304604 - DNA, 23 bp, Homo sapiens
acagaaaaataagtcaaaaggaa

SEQ ID NO: 3304605 - DNA, 13 bp, Homo sapiens
acagaaaagcata

SEQ ID NO: 3304606 - DNA, 23 bp, Homo sapiens
acagtgagtcgaggacagggagg

SEQ ID NO: 3304607 - DNA, 18 bp, Homo sapiens
acagtgatattggaactt

SEQ ID NO: 3304608 - DNA, 14 bp, Homo sapiens
acagtgatctccat

SEQ ID NO: 3304609 - DNA, 18 bp, Homo sapiens
acagtgatctccatatgt

SEQ ID NO: 3304610 - DNA, 13 bp, Homo sapiens
acagtgatttttt

SEQ ID NO: 3304611 - DNA, 13 bp, Homo sapiens
acagtgcagacag

SEQ ID NO: 3304612 - DNA, 14 bp, Homo sapiens
acagtgcagaggct

SEQ ID NO: 3304613 - DNA, 20 bp, Homo sapiens
acagtgcatattcctttcta

SEQ ID NO: 3304614 - DNA, 15 bp, Homo sapiens
acagtgcatctcagc

SEQ ID NO: 3304615 - DNA, 17 bp, Homo sapiens
acagtgcatctcagccc

SEQ ID NO: 3304616 - DNA, 14 bp, Homo sapiens
acagtgccatcccc

SEQ ID NO: 3304617 - DNA, 19 bp, Homo sapiens
acagtgccatccccacctt

SEQ ID NO: 3304618 - DNA, 21 bp, Homo sapiens
acagtgccatccccaccttca

SEQ ID NO: 3304619 - DNA, 16 bp, Homo sapiens
acagtgccattgtctt

SEQ ID NO: 3304620 - DNA, 20 bp, Homo sapiens
acagtgcctgggaatgtatt

SEQ ID NO: 3304621 - DNA, 13 bp, Homo sapiens
acagtgccttgct

SEQ ID NO: 3304622 - DNA, 21 bp, Homo sapiens
acagtgctcttttctcctcac

SEQ ID NO: 3304623 - DNA, 17 bp, Homo sapiens
acagtgctttgtaaatt

SEQ ID NO: 3304624 - DNA, 18 bp, Homo sapiens
acagtggaatataaggaa

SEQ ID NO: 3304625 - DNA, 15 bp, Homo sapiens
acagtggatcacaaa

SEQ ID NO: 3304626 - DNA, 17 bp, Homo sapiens
acagtggatcacaaagt

SEQ ID NO: 3304627 - DNA, 19 bp, Homo sapiens
acagtggattgtttatact

SEQ ID NO: 3304628 - DNA, 18 bp, Homo sapiens
acagtggctcataaaaat

SEQ ID NO: 3304629 - DNA, 19 bp, Homo sapiens
acagtggctgggtgggccc

SEQ ID NO: 3304630 - DNA, 22 bp, Homo sapiens
acagtggctgggtgggcccaga

SEQ ID NO: 3304631 - DNA, 16 bp, Homo sapiens
acagtgggaactctga

SEQ ID NO: 3304632 - DNA, 19 bp, Homo sapiens
acagtgggagccctgacct

SEQ ID NO: 3304633 - DNA, 20 bp, Homo sapiens
acagtgggagctgagctgga

SEQ ID NO: 3304634 - DNA, 14 bp, Homo sapiens
acagtgggtggcac

SEQ ID NO: 3304635 - DNA, 17 bp, Homo sapiens
acagtgggtggcacctc

SEQ ID NO: 3304636 - DNA, 16 bp, Homo sapiens
acagtggttgcctggg

SEQ ID NO: 3304637 - DNA, 20 bp, Homo sapiens
acagtggttttatactgaag

SEQ ID NO: 3304638 - DNA, 22 bp, Homo sapiens
acagtggttttatactgaagga

SEQ ID NO: 3304639 - DNA, 23 bp, Homo sapiens
acagtgtctgtatcggagacagt

SEQ ID NO: 3304640 - DNA, 23 bp, Homo sapiens
acagtgtctgtgccatggatttc

SEQ ID NO: 3304641 - DNA, 22 bp, Homo sapiens
acagtgtggtttgggaaagatg

SEQ ID NO: 3304642 - DNA, 22 bp, Homo sapiens
acagtgtgtgaactgctttcaa

SEQ ID NO: 3304643 - DNA, 20 bp, Homo sapiens
acagtgttattttctttgaa

SEQ ID NO: 3304644 - DNA, 22 bp, Homo sapiens
acagtgttattttctttgaaat

SEQ ID NO: 3304645 - DNA, 9 bp, Homo sapiens
acagtgttt

SEQ ID NO: 3304646 - DNA, 19 bp, Homo sapiens
acagtgtttcgacagctga

SEQ ID NO: 3304647 - DNA, 15 bp, Homo sapiens
acagtgtttggacag

SEQ ID NO: 3304648 - DNA, 21 bp, Homo sapiens
acagttaagaagccctgcaga

SEQ ID NO: 3304649 - DNA, 12 bp, Homo sapiens
acagttatctta

SEQ ID NO: 3304650 - DNA, 18 bp, Homo sapiens
acagttattaaaatgtta

SEQ ID NO: 3304651 - DNA, 23 bp, Homo sapiens
acagttatttatagtcatttatt

SEQ ID NO: 3304652 - DNA, 12 bp, Homo sapiens
acagttcaagaa

SEQ ID NO: 3304653 - DNA, 20 bp, Homo sapiens
acagttcaagaaagcttcaa

SEQ ID NO: 3304654 - DNA, 21 bp, Homo sapiens
acagttcaataaacttaactt

SEQ ID NO: 3304655 - DNA, 23 bp, Homo sapiens
acagttcaataaacttaacttta

SEQ ID NO: 3304656 - DNA, 23 bp, Homo sapiens
acagttcagtggcagggctcagg

SEQ ID NO: 3304657 - DNA, 13 bp, Homo sapiens
acagttcctggga

SEQ ID NO: 3304658 - DNA, 14 bp, Homo sapiens
acagttgcaggagc

SEQ ID NO: 3304659 - DNA, 16 bp, Homo sapiens
acagttgcaggagcgt

SEQ ID NO: 3304660 - DNA, 22 bp, Homo sapiens
acagttgccaccacctctgtgg

SEQ ID NO: 3304661 - DNA, 23 bp, Homo sapiens
acagttgccaccacctctgtggc

SEQ ID NO: 3304662 - DNA, 22 bp, Homo sapiens
acagttgctgtcataagaatga

SEQ ID NO: 3304663 - DNA, 21 bp, Homo sapiens
acagttggcagagaaggcctc

SEQ ID NO: 3304664 - DNA, 13 bp, Homo sapiens
acagttgtgttca

SEQ ID NO: 3304665 - DNA, 22 bp, Homo sapiens
acagtttaccagttgcctttta

SEQ ID NO: 3304666 - DNA, 15 bp, Homo sapiens
acagtttcattattc

SEQ ID NO: 3304667 - DNA, 12 bp, Homo sapiens
acagtttcttag

SEQ ID NO: 3304668 - DNA, 22 bp, Homo sapiens
acagtttcttagctttttaatt

SEQ ID NO: 3304669 - DNA, 19 bp, Homo sapiens
acagtttcttttttcttac

SEQ ID NO: 3304670 - DNA, 14 bp, Homo sapiens
acagtttgctctag

SEQ ID NO: 3304671 - DNA, 13 bp, Homo sapiens
acagtttgctgta

SEQ ID NO: 3304672 - DNA, 19 bp, Homo sapiens
acagttttaactgtggata

SEQ ID NO: 3304673 - DNA, 20 bp, Homo sapiens
acagttttagaataaggagg

SEQ ID NO: 3304674 - DNA, 21 bp, Homo sapiens
acagttttagaataaggagga

SEQ ID NO: 3304675 - DNA, 23 bp, Homo sapiens
acagttttagaataaggaggagg

SEQ ID NO: 3304676 - DNA, 12 bp, Homo sapiens
acagttttatgc

SEQ ID NO: 3304677 - DNA, 14 bp, Homo sapiens
acagttttccatga

SEQ ID NO: 3304678 - DNA, 20 bp, Homo sapiens
acagttttctagcaattttc

SEQ ID NO: 3304679 - DNA, 23 bp, Homo sapiens
acagttttgtcagtctttcttag

SEQ ID NO: 3304680 - DNA, 13 bp, Homo sapiens
acataaaaaccaa

SEQ ID NO: 3304681 - DNA, 20 bp, Homo sapiens
acataaaaagcagaatttta

SEQ ID NO: 3304682 - DNA, 23 bp, Homo sapiens
acataaaaagcagaattttaatg

SEQ ID NO: 3304683 - DNA, 14 bp, Homo sapiens
acataaaatctgtg

SEQ ID NO: 3304684 - DNA, 17 bp, Homo sapiens
acataaaatctgtgaat

SEQ ID NO: 3304685 - DNA, 13 bp, Homo sapiens
acataaacaatga

SEQ ID NO: 3304686 - DNA, 21 bp, Homo sapiens
acataaaccatttttgttact

SEQ ID NO: 3304687 - DNA, 13 bp, Homo sapiens
acataaactgact

SEQ ID NO: 3304688 - DNA, 15 bp, Homo sapiens
acataaactgacttt

SEQ ID NO: 3304689 - DNA, 23 bp, Homo sapiens
acataaatagtagaaaaatcaga

SEQ ID NO: 3304690 - DNA, 15 bp, Homo sapiens
acataacaagaaaat

SEQ ID NO: 3304691 - DNA, 18 bp, Homo sapiens
acataacctcagagtatc

SEQ ID NO: 3304692 - DNA, 14 bp, Homo sapiens
acataacgtttttc

SEQ ID NO: 3304693 - DNA, 18 bp, Homo sapiens
acataacgtttttccttt

SEQ ID NO: 3304694 - DNA, 22 bp, Homo sapiens
acataacgtttttcctttaaaa

SEQ ID NO: 3304695 - DNA, 13 bp, Homo sapiens
acataactaaatt

SEQ ID NO: 3304696 - DNA, 20 bp, Homo sapiens
acataactgaaaatgtgcta

SEQ ID NO: 3304697 - DNA, 13 bp, Homo sapiens
acataagaaatgt

SEQ ID NO: 3304698 - DNA, 15 bp, Homo sapiens
acataagataaatgt

SEQ ID NO: 3304699 - DNA, 16 bp, Homo sapiens
acataagataaatgtg

SEQ ID NO: 3304700 - DNA, 15 bp, Homo sapiens
acataagtaattcaa

SEQ ID NO: 3304701 - DNA, 21 bp, Homo sapiens
acataagtaattcaagaaaac

SEQ ID NO: 3304702 - DNA, 16 bp, Homo sapiens
acataagttagaacaa

SEQ ID NO: 3304703 - DNA, 17 bp, Homo sapiens
acataataagtttcata

SEQ ID NO: 3304704 - DNA, 21 bp, Homo sapiens
acataatgtttttcctttctt

SEQ ID NO: 3304705 - DNA, 19 bp, Homo sapiens
acataatttagttgtttct

SEQ ID NO: 3304706 - DNA, 22 bp, Homo sapiens
acatacacccaaacacttacac

SEQ ID NO: 3304707 - DNA, 20 bp, Homo sapiens
acatacacttgtataaatgt

SEQ ID NO: 3304708 - DNA, 13 bp, Homo sapiens
acatacagagtgg

SEQ ID NO: 3304709 - DNA, 20 bp, Homo sapiens
acatacataatgtttttcct

SEQ ID NO: 3304710 - DNA, 17 bp, Homo sapiens
acatacatgctactttt

SEQ ID NO: 3304711 - DNA, 14 bp, Homo sapiens
acatacgaaacaca

SEQ ID NO: 3304712 - DNA, 17 bp, Homo sapiens
acatacgaaacacaaac

SEQ ID NO: 3304713 - DNA, 24 bp, Homo sapiens
acatactccttccatcaaatagaa

SEQ ID NO: 3304714 - DNA, 19 bp, Homo sapiens
acatactgcatgtaagcca

SEQ ID NO: 3304715 - DNA, 15 bp, Homo sapiens
acatacttttgcaaa

SEQ ID NO: 3304716 - DNA, 16 bp, Homo sapiens
acatacttttgcaaaa

SEQ ID NO: 3304717 - DNA, 12 bp, Homo sapiens
acatagaaatgg

SEQ ID NO: 3304718 - DNA, 17 bp, Homo sapiens
acatagactagagaaac

SEQ ID NO: 3304719 - DNA, 22 bp, Homo sapiens
acatagagtgactccaagaaca

SEQ ID NO: 3304720 - DNA, 16 bp, Homo sapiens
acatagatattttcac

SEQ ID NO: 3304721 - DNA, 20 bp, Homo sapiens
acatagattaatggcactga

SEQ ID NO: 3304722 - DNA, 17 bp, Homo sapiens
acatagcctatatttac

SEQ ID NO: 3304723 - DNA, 19 bp, Homo sapiens
acatagcgccgtgctgtaa

SEQ ID NO: 3304724 - DNA, 21 bp, Homo sapiens
acatagtgatggttcccctgt

SEQ ID NO: 3304725 - DNA, 12 bp, Homo sapiens
acatagtgtaat

SEQ ID NO: 3304726 - DNA, 21 bp, Homo sapiens
acatagttttaaactcatttt

SEQ ID NO: 3304727 - DNA, 15 bp, Homo sapiens
acatagtttttcctg

SEQ ID NO: 3304728 - DNA, 20 bp, Homo sapiens
acatataaacatcacacaca

SEQ ID NO: 3304729 - DNA, 20 bp, Homo sapiens
acatatacctataatgtgtg

SEQ ID NO: 3304730 - DNA, 20 bp, Homo sapiens
acatatatatattttttaat

SEQ ID NO: 3304731 - DNA, 22 bp, Homo sapiens
acatggggcctggcccacgccc

SEQ ID NO: 3304732 - DNA, 20 bp, Homo sapiens
acatggtactcttgttgagt

SEQ ID NO: 3304733 - DNA, 23 bp, Homo sapiens
acatggtgcaccgagtgatttcc

SEQ ID NO: 3304734 - DNA, 13 bp, Homo sapiens
acatggtgcctga

SEQ ID NO: 3304735 - DNA, 18 bp, Homo sapiens
acatggttgtgacctgag

SEQ ID NO: 3304736 - DNA, 17 bp, Homo sapiens
acatggtttgactcccg

SEQ ID NO: 3304737 - DNA, 19 bp, Homo sapiens
acatgtaataaaaagtata

SEQ ID NO: 3304738 - DNA, 13 bp, Homo sapiens
acatgtaatttga

SEQ ID NO: 3304739 - DNA, 21 bp, Homo sapiens
acatgtacataaactgtcact

SEQ ID NO: 3304740 - DNA, 16 bp, Homo sapiens
acatgtagaaaaatac

SEQ ID NO: 3304741 - DNA, 20 bp, Homo sapiens
acatgtagtagtacttgaaa

SEQ ID NO: 3304742 - DNA, 18 bp, Homo sapiens
acatgtatggttactaaa

SEQ ID NO: 3304743 - DNA, 19 bp, Homo sapiens
acatgtattgcacattgta

SEQ ID NO: 3304744 - DNA, 15 bp, Homo sapiens
acatgtcaatctgtc

SEQ ID NO: 3304745 - DNA, 23 bp, Homo sapiens
acatgtcctgcctattatctgtc

SEQ ID NO: 3304746 - DNA, 16 bp, Homo sapiens
acatgtccttgtgtgt

SEQ ID NO: 3304747 - DNA, 21 bp, Homo sapiens
acatgtccttgtgtgttttga

SEQ ID NO: 3304748 - DNA, 14 bp, Homo sapiens
acatgtcttgtaca

SEQ ID NO: 3304749 - DNA, 13 bp, Homo sapiens
acatgtgaaacct

SEQ ID NO: 3304750 - DNA, 23 bp, Homo sapiens
acatgtgaaaccttttttaagat

SEQ ID NO: 3304751 - DNA, 12 bp, Homo sapiens
acatgtgacaca

SEQ ID NO: 3304752 - DNA, 15 bp, Homo sapiens
acatgtgacacatat

SEQ ID NO: 3304753 - DNA, 21 bp, Homo sapiens
acatgtgacatttatatattg

SEQ ID NO: 3304754 - DNA, 23 bp, Homo sapiens
acatgtgatacattttttaagct

SEQ ID NO: 3304755 - DNA, 17 bp, Homo sapiens
acatgtgccgaatgtgc

SEQ ID NO: 3304756 - DNA, 19 bp, Homo sapiens
acatgtggaaagtgaattt

SEQ ID NO: 3304757 - DNA, 21 bp, Homo sapiens
acatgtggcaaaatatggttt

SEQ ID NO: 3304758 - DNA, 20 bp, Homo sapiens
acatgtgtagcctatgttgt

SEQ ID NO: 3304759 - DNA, 15 bp, Homo sapiens
acatgtgtgtatata

SEQ ID NO: 3304760 - DNA, 21 bp, Homo sapiens
acatgtgttttaattccaata

SEQ ID NO: 3304761 - DNA, 20 bp, Homo sapiens
acatgttaatgacaatattc

SEQ ID NO: 3304762 - DNA, 11 bp, Homo sapiens
acatgttactg

SEQ ID NO: 3304763 - DNA, 19 bp, Homo sapiens
acatgttactgaccagcaa

SEQ ID NO: 3304764 - DNA, 21 bp, Homo sapiens
acatgttatcaaatctgggta

SEQ ID NO: 3304765 - DNA, 16 bp, Homo sapiens
acatgttattcaatgt

SEQ ID NO: 3304766 - DNA, 13 bp, Homo sapiens
acatgtttataaa

SEQ ID NO: 3304767 - DNA, 21 bp, Homo sapiens
acatgtttccatcatttctgt

SEQ ID NO: 3304768 - DNA, 17 bp, Homo sapiens
acatgtttctgttttgt

SEQ ID NO: 3304769 - DNA, 16 bp, Homo sapiens
acatgttttaaagaaa

SEQ ID NO: 3304770 - DNA, 15 bp, Homo sapiens
acatgtttttatatg

SEQ ID NO: 3304771 - DNA, 23 bp, Homo sapiens
acatgtttttgttttctttgaat

SEQ ID NO: 3304772 - DNA, 13 bp, Homo sapiens
acattaaaataaa

SEQ ID NO: 3304773 - DNA, 15 bp, Homo sapiens
acattaaaataaacc

SEQ ID NO: 3304774 - DNA, 17 bp, Homo sapiens
acattaaaataaaccaa

SEQ ID NO: 3304775 - DNA, 18 bp, Homo sapiens
acattaaaataaaccaaa

SEQ ID NO: 3304776 - DNA, 12 bp, Homo sapiens
acattaaacaca

SEQ ID NO: 3304777 - DNA, 22 bp, Homo sapiens
acattaaagaagggttgagctg

SEQ ID NO: 3304778 - DNA, 13 bp, Homo sapiens
acattaaatgtct

SEQ ID NO: 3304779 - DNA, 17 bp, Homo sapiens
acattaacagttttcca

SEQ ID NO: 3304780 - DNA, 18 bp, Homo sapiens
acattaacagttttccat

SEQ ID NO: 3304781 - DNA, 15 bp, Homo sapiens
acattaacatctatt

SEQ ID NO: 3304782 - DNA, 13 bp, Homo sapiens
acattaacttgaa

SEQ ID NO: 3304783 - DNA, 19 bp, Homo sapiens
acattaagaatgttggttt

SEQ ID NO: 3304784 - DNA, 17 bp, Homo sapiens
acattaatggtctaaaa

SEQ ID NO: 3304785 - DNA, 20 bp, Homo sapiens
acattaatggtctaaaaata

SEQ ID NO: 3304786 - DNA, 21 bp, Homo sapiens
acattaatgttaattcagcac

SEQ ID NO: 3304787 - DNA, 14 bp, Homo sapiens
acattaattaatta

SEQ ID NO: 3304788 - DNA, 16 bp, Homo sapiens
acattaattaattaaa

SEQ ID NO: 3304789 - DNA, 20 bp, Homo sapiens
acattaattaattaaagccc

SEQ ID NO: 3304790 - DNA, 13 bp, Homo sapiens
acattaattttgt

SEQ ID NO: 3304791 - DNA, 17 bp, Homo sapiens
acattaattttgtgcat

SEQ ID NO: 3304792 - DNA, 20 bp, Homo sapiens
acattaattttgtgcattct

SEQ ID NO: 3304793 - DNA, 22 bp, Homo sapiens
acattaattttgtgcattcttt

SEQ ID NO: 3304794 - DNA, 23 bp, Homo sapiens
acattaattttgtgcattctttg

SEQ ID NO: 3304795 - DNA, 17 bp, Homo sapiens
acattacagttcataat

SEQ ID NO: 3304796 - DNA, 19 bp, Homo sapiens
acattaccttactgtggag

SEQ ID NO: 3304797 - DNA, 20 bp, Homo sapiens
acattagaataaaaggtagt

SEQ ID NO: 3304798 - DNA, 22 bp, Homo sapiens
acattataaaccttcagaagct

SEQ ID NO: 3304799 - DNA, 14 bp, Homo sapiens
acattatattctct

SEQ ID NO: 3304800 - DNA, 18 bp, Homo sapiens
acattatattgcaatgaa

SEQ ID NO: 3304801 - DNA, 13 bp, Homo sapiens
acattatcttagt

SEQ ID NO: 3304802 - DNA, 17 bp, Homo sapiens
acattatgctccagaaa

SEQ ID NO: 3304803 - DNA, 19 bp, Homo sapiens
acattatgtggttttagat

SEQ ID NO: 3304804 - DNA, 19 bp, Homo sapiens
acattatgtgtgcatgtgt

SEQ ID NO: 3304805 - DNA, 18 bp, Homo sapiens
acattattatcaacaata

SEQ ID NO: 3304806 - DNA, 12 bp, Homo sapiens
acattattctgg

SEQ ID NO: 3304807 - DNA, 14 bp, Homo sapiens
acattatttatatg

SEQ ID NO: 3304808 - DNA, 18 bp, Homo sapiens
acattatttatatgggga

SEQ ID NO: 3304809 - DNA, 13 bp, Homo sapiens
acattatttctag

SEQ ID NO: 3304810 - DNA, 13 bp, Homo sapiens
acattcaaggcat

SEQ ID NO: 3304811 - DNA, 21 bp, Homo sapiens
acattcagctctggagaacag

SEQ ID NO: 3304812 - DNA, 22 bp, Homo sapiens
acattccaaaagggggcctggg

SEQ ID NO: 3304813 - DNA, 13 bp, Homo sapiens
acattcccctccc

SEQ ID NO: 3304814 - DNA, 21 bp, Homo sapiens
acattcccctcccacctctcc

SEQ ID NO: 3304815 - DNA, 23 bp, Homo sapiens
acattcccctccccactcctctc

SEQ ID NO: 3304816 - DNA, 13 bp, Homo sapiens
acattccctctcc

SEQ ID NO: 3304817 - DNA, 18 bp, Homo sapiens
acattccctctcctgccc

SEQ ID NO: 3304818 - DNA, 17 bp, Homo sapiens
acattcctaactagaat

SEQ ID NO: 3304819 - DNA, 21 bp, Homo sapiens
acattcctaactagaattagt

SEQ ID NO: 3304820 - DNA, 19 bp, Homo sapiens
acattcgatctcattcagt

SEQ ID NO: 3304821 - DNA, 23 bp, Homo sapiens
acattcgatctcattcagtatta

SEQ ID NO: 3304822 - DNA, 16 bp, Homo sapiens
acattcgtgagctggg

SEQ ID NO: 3304823 - DNA, 23 bp, Homo sapiens
acattctacttgcttattacatt

SEQ ID NO: 3304824 - DNA, 15 bp, Homo sapiens
acattctgatgagca

SEQ ID NO: 3304825 - DNA, 16 bp, Homo sapiens
acattctgatgagcaa

SEQ ID NO: 3304826 - DNA, 16 bp, Homo sapiens
acattctgatttggaa

SEQ ID NO: 3304827 - DNA, 23 bp, Homo sapiens
acattctgcctagagtgtagcct

SEQ ID NO: 3304828 - DNA, 17 bp, Homo sapiens
acattcttattaattct

SEQ ID NO: 3304829 - DNA, 18 bp, Homo sapiens
acattcttattaattctt

SEQ ID NO: 3304830 - DNA, 19 bp, Homo sapiens
acattcttattaattcttc

SEQ ID NO: 3304831 - DNA, 22 bp, Homo sapiens
acattcttggcttaatcatttt

SEQ ID NO: 3304832 - DNA, 23 bp, Homo sapiens
acattcttggcttaatcattttc

SEQ ID NO: 3304833 - DNA, 12 bp, Homo sapiens
acattgcttttc

SEQ ID NO: 3304834 - DNA, 13 bp, Homo sapiens
acattgcttttga

SEQ ID NO: 3304835 - DNA, 15 bp, Homo sapiens
acattggaatgttct

SEQ ID NO: 3304836 - DNA, 14 bp, Homo sapiens
acattgtcaataaa

SEQ ID NO: 3304837 - DNA, 16 bp, Homo sapiens
acattgtgttgacatt

SEQ ID NO: 3304838 - DNA, 20 bp, Homo sapiens
acattgttcaattagaatag

SEQ ID NO: 3304839 - DNA, 12 bp, Homo sapiens
acatttaaaatt

SEQ ID NO: 3304840 - DNA, 17 bp, Homo sapiens
acatttaaaattgctat

SEQ ID NO: 3304841 - DNA, 14 bp, Homo sapiens
acatttaaaccttt

SEQ ID NO: 3304842 - DNA, 16 bp, Homo sapiens
acatttaaacctttta

SEQ ID NO: 3304843 - DNA, 15 bp, Homo sapiens
acatttaaatccttg

SEQ ID NO: 3304844 - DNA, 20 bp, Homo sapiens
acatttaataatgtatgtac

SEQ ID NO: 3304845 - DNA, 23 bp, Homo sapiens
acatttaataatgtatgtacagc

SEQ ID NO: 3304846 - DNA, 15 bp, Homo sapiens
acatttatgatttaa

SEQ ID NO: 3304847 - DNA, 17 bp, Homo sapiens
acatttatgatttaata

SEQ ID NO: 3304848 - DNA, 19 bp, Homo sapiens
acatttatgatttaataaa

SEQ ID NO: 3304849 - DNA, 22 bp, Homo sapiens
acatttatgatttaataaaata

SEQ ID NO: 3304850 - DNA, 15 bp, Homo sapiens
acatttcagggagaa

SEQ ID NO: 3304851 - DNA, 23 bp, Homo sapiens
acatttcataatttgtttccagc

SEQ ID NO: 3304852 - DNA, 18 bp, Homo sapiens
acatttcatacaacagaa

SEQ ID NO: 3304853 - DNA, 20 bp, Homo sapiens
acatttcccccgagctcttg

SEQ ID NO: 3304854 - DNA, 13 bp, Homo sapiens
acatttctaaaat

SEQ ID NO: 3304855 - DNA, 16 bp, Homo sapiens
acatttctcactgaaa

SEQ ID NO: 3304856 - DNA, 17 bp, Homo sapiens
acccagcgagccctggt

SEQ ID NO: 3304857 - DNA, 24 bp, Homo sapiens
acccagcgagccctggtggcagtg

SEQ ID NO: 3304858 - DNA, 18 bp, Homo sapiens
acccagctactctgtcca

SEQ ID NO: 3304859 - DNA, 22 bp, Homo sapiens
acccagctactctgtccaggcc

SEQ ID NO: 3304860 - DNA, 14 bp, Homo sapiens
acccagctccaggg

SEQ ID NO: 3304861 - DNA, 17 bp, Homo sapiens
acccagctccaggggcc

SEQ ID NO: 3304862 - DNA, 11 bp, Homo sapiens
acccagctcct

SEQ ID NO: 3304863 - DNA, 18 bp, Homo sapiens
acccaggacatctcctgg

SEQ ID NO: 3304864 - DNA, 14 bp, Homo sapiens
acccaggaccaagc

SEQ ID NO: 3304865 - DNA, 23 bp, Homo sapiens
acccaggagccccgaggccttct

SEQ ID NO: 3304866 - DNA, 19 bp, Homo sapiens
acccaggagggagggggct

SEQ ID NO: 3304867 - DNA, 19 bp, Homo sapiens
acccaggctccgcccttag

SEQ ID NO: 3304868 - DNA, 21 bp, Homo sapiens
acccaggctccgcccttagtc

SEQ ID NO: 3304869 - DNA, 11 bp, Homo sapiens
acccaggctgc

SEQ ID NO: 3304870 - DNA, 18 bp, Homo sapiens
acccaggctgcactgcag

SEQ ID NO: 3304871 - DNA, 18 bp, Homo sapiens
acccaggctggagtgcag

SEQ ID NO: 3304872 - DNA, 16 bp, Homo sapiens
acccagggctctgccc

SEQ ID NO: 3304873 - DNA, 19 bp, Homo sapiens
acccagggctctgccccag

SEQ ID NO: 3304874 - DNA, 21 bp, Homo sapiens
acccagggctctgccccagtc

SEQ ID NO: 3304875 - DNA, 17 bp, Homo sapiens
acccaggtcttccagac

SEQ ID NO: 3304876 - DNA, 15 bp, Homo sapiens
acccaggtggagggc

SEQ ID NO: 3304877 - DNA, 18 bp, Homo sapiens
acccaggtggagggcaca

SEQ ID NO: 3304878 - DNA, 21 bp, Homo sapiens
acccagtccccgtgccccgcc

SEQ ID NO: 3304879 - DNA, 13 bp, Homo sapiens
acccagtgctgcc

SEQ ID NO: 3304880 - DNA, 15 bp, Homo sapiens
acccagtgctgccat

SEQ ID NO: 3304881 - DNA, 16 bp, Homo sapiens
acccagtgctgccatg

SEQ ID NO: 3304882 - DNA, 23 bp, Homo sapiens
acccagtgctgccatgccactgc

SEQ ID NO: 3304883 - DNA, 15 bp, Homo sapiens
acccagtgggacaga

SEQ ID NO: 3304884 - DNA, 21 bp, Homo sapiens
acccagttacttttttacact

SEQ ID NO: 3304885 - DNA, 16 bp, Homo sapiens
acccataatcctttct

SEQ ID NO: 3304886 - DNA, 17 bp, Homo sapiens
acccataatcctttctg

SEQ ID NO: 3304887 - DNA, 17 bp, Homo sapiens
acccatagatcttctga

SEQ ID NO: 3304888 - DNA, 16 bp, Homo sapiens
acccatcttcctgctg

SEQ ID NO: 3304889 - DNA, 18 bp, Homo sapiens
acccatcttcctgctgct

SEQ ID NO: 3304890 - DNA, 19 bp, Homo sapiens
acccatgaagacaggacag

SEQ ID NO: 3304891 - DNA, 12 bp, Homo sapiens
acccatgtcacc

SEQ ID NO: 3304892 - DNA, 20 bp, Homo sapiens
acccattcccccatgtggct

SEQ ID NO: 3304893 - DNA, 22 bp, Homo sapiens
acccattcgtggtgatcaatta

SEQ ID NO: 3304894 - DNA, 19 bp, Homo sapiens
acccattctacacagagca

SEQ ID NO: 3304895 - DNA, 16 bp, Homo sapiens
accccaaacaccttcc

SEQ ID NO: 3304896 - DNA, 18 bp, Homo sapiens
accccaaacaccttccag

SEQ ID NO: 3304897 - DNA, 15 bp, Homo sapiens
accccaaagcccctt

SEQ ID NO: 3304898 - DNA, 18 bp, Homo sapiens
accccaaagccccttgct

SEQ ID NO: 3304899 - DNA, 15 bp, Homo sapiens
accccaacaaaccat

SEQ ID NO: 3304900 - DNA, 19 bp, Homo sapiens
accccaacccaataaaact

SEQ ID NO: 3304901 - DNA, 14 bp, Homo sapiens
accccaacctcaga

SEQ ID NO: 3304902 - DNA, 16 bp, Homo sapiens
accccaacgcacagga

SEQ ID NO: 3304903 - DNA, 20 bp, Homo sapiens
accccaagtagtctgctcac

SEQ ID NO: 3304904 - DNA, 21 bp, Homo sapiens
accccaatttcggattttttc

SEQ ID NO: 3304905 - DNA, 15 bp, Homo sapiens
accccacaccccagc

SEQ ID NO: 3304906 - DNA, 17 bp, Homo sapiens
accccacaccccagccc

SEQ ID NO: 3304907 - DNA, 19 bp, Homo sapiens
accccacaccccagcccac

SEQ ID NO: 3304908 - DNA, 20 bp, Homo sapiens
accccacaccccagcccacc

SEQ ID NO: 3304909 - DNA, 20 bp, Homo sapiens
accccacagaaccttcaacc

SEQ ID NO: 3304910 - DNA, 19 bp, Homo sapiens
accccaccatatgaattgt

SEQ ID NO: 3304911 - DNA, 12 bp, Homo sapiens
accccaccctca

SEQ ID NO: 3304912 - DNA, 21 bp, Homo sapiens
accccaccctcagcacccctt

SEQ ID NO: 3304913 - DNA, 19 bp, Homo sapiens
accccagactagatgtagt

SEQ ID NO: 3304914 - DNA, 15 bp, Homo sapiens
accccagcctgacct

SEQ ID NO: 3304915 - DNA, 10 bp, Homo sapiens
accccagctg

SEQ ID NO: 3304916 - DNA, 11 bp, Homo sapiens
accccagctgg

SEQ ID NO: 3304917 - DNA, 14 bp, Homo sapiens
accccagctgggag

SEQ ID NO: 3304918 - DNA, 15 bp, Homo sapiens
accccagctgggagg

SEQ ID NO: 3304919 - DNA, 20 bp, Homo sapiens
accccagctgggaggcaaga

SEQ ID NO: 3304920 - DNA, 15 bp, Homo sapiens
accccaggcccttca

SEQ ID NO: 3304921 - DNA, 16 bp, Homo sapiens
accccaggcccttcag

SEQ ID NO: 3304922 - DNA, 19 bp, Homo sapiens
accccagttctaggggaga

SEQ ID NO: 3304923 - DNA, 17 bp, Homo sapiens
accccagttctgctcct

SEQ ID NO: 3304924 - DNA, 19 bp, Homo sapiens
accccatggagctgggcta

SEQ ID NO: 3304925 - DNA, 15 bp, Homo sapiens
accccatgtgccttt

SEQ ID NO: 3304926 - DNA, 16 bp, Homo sapiens
accccatgtgccttta

SEQ ID NO: 3304927 - DNA, 18 bp, Homo sapiens
acccccaagcctgggctt

SEQ ID NO: 3304928 - DNA, 18 bp, Homo sapiens
acccccacaagctgtccc

SEQ ID NO: 3304929 - DNA, 20 bp, Homo sapiens
acccccacaagctgtccctg

SEQ ID NO: 3304930 - DNA, 12 bp, Homo sapiens
acccccacccac

SEQ ID NO: 3304931 - DNA, 13 bp, Homo sapiens
acccccacccacc

SEQ ID NO: 3304932 - DNA, 21 bp, Homo sapiens
acccccacccacctccaccca

SEQ ID NO: 3304933 - DNA, 22 bp, Homo sapiens
acccccacccacctccacccag

SEQ ID NO: 3304934 - DNA, 23 bp, Homo sapiens
acccccacccacctccacccagc

SEQ ID NO: 3304935 - DNA, 14 bp, Homo sapiens
acccccaccccaca

SEQ ID NO: 3304936 - DNA, 19 bp, Homo sapiens
acccccacccccagctcaa

SEQ ID NO: 3304937 - DNA, 23 bp, Homo sapiens
acccccacgattggccacctgta

SEQ ID NO: 3304938 - DNA, 16 bp, Homo sapiens
acccccagccaggcta

SEQ ID NO: 3304939 - DNA, 12 bp, Homo sapiens
acccccagcctg

SEQ ID NO: 3304940 - DNA, 13 bp, Homo sapiens
acccccagctcaa

SEQ ID NO: 3304941 - DNA, 14 bp, Homo sapiens
acccccagctttgc

SEQ ID NO: 3304942 - DNA, 16 bp, Homo sapiens
acccccagctttgcta

SEQ ID NO: 3304943 - DNA, 17 bp, Homo sapiens
acccccaggcctgtcca

SEQ ID NO: 3304944 - DNA, 17 bp, Homo sapiens
acccccatctctccctc

SEQ ID NO: 3304945 - DNA, 16 bp, Homo sapiens
acccccattaaattca

SEQ ID NO: 3304946 - DNA, 17 bp, Homo sapiens
acccccatttctattta

SEQ ID NO: 3304947 - DNA, 19 bp, Homo sapiens
accccccaacccctgagga

SEQ ID NO: 3304948 - DNA, 12 bp, Homo sapiens
accccccacctg

SEQ ID NO: 3304949 - DNA, 11 bp, Homo sapiens
acccccctcct

SEQ ID NO: 3304950 - DNA, 15 bp, Homo sapiens
acccccctcctgctc

SEQ ID NO: 3304951 - DNA, 20 bp, Homo sapiens
acccccctcctgctcctccc

SEQ ID NO: 3304952 - DNA, 21 bp, Homo sapiens
acccccctcctgctcctccct

SEQ ID NO: 3304953 - DNA, 15 bp, Homo sapiens
acccccctgttctaa

SEQ ID NO: 3304954 - DNA, 19 bp, Homo sapiens
acccccctgttctaagggg

SEQ ID NO: 3304955 - DNA, 14 bp, Homo sapiens
acccccgcaccctt

SEQ ID NO: 3304956 - DNA, 19 bp, Homo sapiens
acccccgccacctcagggc

SEQ ID NO: 3304957 - DNA, 14 bp, Homo sapiens
accccctcaagccc

SEQ ID NO: 3304958 - DNA, 21 bp, Homo sapiens
accccctcaagccccagcagc

SEQ ID NO: 3304959 - DNA, 17 bp, Homo sapiens
accccctcacccctcca

SEQ ID NO: 3304960 - DNA, 13 bp, Homo sapiens
accccctcctggc

SEQ ID NO: 3304961 - DNA, 11 bp, Homo sapiens
accccctcctt

SEQ ID NO: 3304962 - DNA, 12 bp, Homo sapiens
accccctccttc

SEQ ID NO: 3304963 - DNA, 14 bp, Homo sapiens
accccctctagaaa

SEQ ID NO: 3304964 - DNA, 22 bp, Homo sapiens
accccctgctccaccagcagca

SEQ ID NO: 3304965 - DNA, 15 bp, Homo sapiens
accccctggccctgc

SEQ ID NO: 3304966 - DNA, 16 bp, Homo sapiens
accccctggccctgcc

SEQ ID NO: 3304967 - DNA, 21 bp, Homo sapiens
acccccttccccgctcttgcc

SEQ ID NO: 3304968 - DNA, 17 bp, Homo sapiens
acccccttctctgctcc

SEQ ID NO: 3304969 - DNA, 18 bp, Homo sapiens
acccccttctctgctcca

SEQ ID NO: 3304970 - DNA, 13 bp, Homo sapiens
acccccttctggg

SEQ ID NO: 3304971 - DNA, 17 bp, Homo sapiens
acccccttctgggcatc

SEQ ID NO: 3304972 - DNA, 18 bp, Homo sapiens
accccctttgtgctgtgg

SEQ ID NO: 3304973 - DNA, 15 bp, Homo sapiens
accccgcagacacct

SEQ ID NO: 3304974 - DNA, 14 bp, Homo sapiens
accccgcctgccct

SEQ ID NO: 3304975 - DNA, 19 bp, Homo sapiens
accccgcctgccctcatgg

SEQ ID NO: 3304976 - DNA, 17 bp, Homo sapiens
accccggcaggccctgc

SEQ ID NO: 3304977 - DNA, 14 bp, Homo sapiens
accccggcctcagg

SEQ ID NO: 3304978 - DNA, 15 bp, Homo sapiens
accccggcctcaggg

SEQ ID NO: 3304979 - DNA, 15 bp, Homo sapiens
accccggggaccctg

SEQ ID NO: 3304980 - DNA, 17 bp, Homo sapiens
accccggggaccctgtg

SEQ ID NO: 3304981 - DNA, 15 bp, Homo sapiens
accccgttacagctc

SEQ ID NO: 3304982 - DNA, 14 bp, Homo sapiens
acccctaagagact

SEQ ID NO: 3304983 - DNA, 20 bp, Homo sapiens
acctaggctcatggacgaga

SEQ ID NO: 3304984 - DNA, 21 bp, Homo sapiens
acctagtactctctgctctag

SEQ ID NO: 3304985 - DNA, 14 bp, Homo sapiens
acctagttttccat

SEQ ID NO: 3304986 - DNA, 16 bp, Homo sapiens
acctataaagtaaagc

SEQ ID NO: 3304987 - DNA, 18 bp, Homo sapiens
acctatctcgtgggagag

SEQ ID NO: 3304988 - DNA, 19 bp, Homo sapiens
acctatgatattttctgtg

SEQ ID NO: 3304989 - DNA, 19 bp, Homo sapiens
acctatgtcctaaggacac

SEQ ID NO: 3304990 - DNA, 22 bp, Homo sapiens
acctatgtcctaaggacacact

SEQ ID NO: 3304991 - DNA, 23 bp, Homo sapiens
acctatgtcctaaggacacacta

SEQ ID NO: 3304992 - DNA, 23 bp, Homo sapiens
acctatgttattttgtgtacaag

SEQ ID NO: 3304993 - DNA, 23 bp, Homo sapiens
acctcaaacttccagtcaggtag

SEQ ID NO: 3304994 - DNA, 17 bp, Homo sapiens
acctcaaccatcctggc

SEQ ID NO: 3304995 - DNA, 19 bp, Homo sapiens
acctcaacccccatttcta

SEQ ID NO: 3304996 - DNA, 21 bp, Homo sapiens
acctcaacccccatttctatt

SEQ ID NO: 3304997 - DNA, 22 bp, Homo sapiens
acctcaactgcctactccaaaa

SEQ ID NO: 3304998 - DNA, 19 bp, Homo sapiens
acctcaagccccatttcct

SEQ ID NO: 3304999 - DNA, 20 bp, Homo sapiens
acctcaagggggactgtctt

SEQ ID NO: 3305000 - DNA, 19 bp, Homo sapiens
acctcaagtgatctgccca

SEQ ID NO: 3305001 - DNA, 15 bp, Homo sapiens
acctcacagtgaccc

SEQ ID NO: 3305002 - DNA, 19 bp, Homo sapiens
acctcacagtgacccttcc

SEQ ID NO: 3305003 - DNA, 21 bp, Homo sapiens
acctcacagtgacccttccca

SEQ ID NO: 3305004 - DNA, 15 bp, Homo sapiens
acctcacctagaaat

SEQ ID NO: 3305005 - DNA, 23 bp, Homo sapiens
acctcactatggtatgctggcca

SEQ ID NO: 3305006 - DNA, 21 bp, Homo sapiens
acctcactgagaggcctggag

SEQ ID NO: 3305007 - DNA, 20 bp, Homo sapiens
acctcactttacataagaaa

SEQ ID NO: 3305008 - DNA, 13 bp, Homo sapiens
acctcacttttga

SEQ ID NO: 3305009 - DNA, 23 bp, Homo sapiens
acctcacttttgaatctataaaa

SEQ ID NO: 3305010 - DNA, 22 bp, Homo sapiens
acctcagacttaccaggaagca

SEQ ID NO: 3305011 - DNA, 23 bp, Homo sapiens
acctcagctctgggagaggattt

SEQ ID NO: 3305012 - DNA, 23 bp, Homo sapiens
acctcaggcactagcctttggct

SEQ ID NO: 3305013 - DNA, 12 bp, Homo sapiens
acctcaggcagc

SEQ ID NO: 3305014 - DNA, 13 bp, Homo sapiens
acctcaggccagg

SEQ ID NO: 3305015 - DNA, 19 bp, Homo sapiens
acctcaggcttccttggca

SEQ ID NO: 3305016 - DNA, 13 bp, Homo sapiens
acctcagggctcc

SEQ ID NO: 3305017 - DNA, 15 bp, Homo sapiens
acctcagggctccca

SEQ ID NO: 3305018 - DNA, 20 bp, Homo sapiens
acctcaggtgatccacccac

SEQ ID NO: 3305019 - DNA, 21 bp, Homo sapiens
acctcaggtgatccacccacc

SEQ ID NO: 3305020 - DNA, 17 bp, Homo sapiens
acctcaggttgctggtt

SEQ ID NO: 3305021 - DNA, 16 bp, Homo sapiens
acctcagtgtcattta

SEQ ID NO: 3305022 - DNA, 22 bp, Homo sapiens
acctcagttattacatgtaatt

SEQ ID NO: 3305023 - DNA, 17 bp, Homo sapiens
acctcagttcccttggc

SEQ ID NO: 3305024 - DNA, 18 bp, Homo sapiens
acctcagttcccttggcc

SEQ ID NO: 3305025 - DNA, 19 bp, Homo sapiens
acctcagttcccttggcct

SEQ ID NO: 3305026 - DNA, 20 bp, Homo sapiens
acctcagttcccttggcctc

SEQ ID NO: 3305027 - DNA, 21 bp, Homo sapiens
acctcagttcccttggcctca

SEQ ID NO: 3305028 - DNA, 22 bp, Homo sapiens
acctcagttcccttggcctcag

SEQ ID NO: 3305029 - DNA, 17 bp, Homo sapiens
acctcagttttatcatt

SEQ ID NO: 3305030 - DNA, 18 bp, Homo sapiens
acctcatctgtggagctg

SEQ ID NO: 3305031 - DNA, 13 bp, Homo sapiens
acctcatgcccac

SEQ ID NO: 3305032 - DNA, 22 bp, Homo sapiens
acctcatgcccaccccctgccc

SEQ ID NO: 3305033 - DNA, 18 bp, Homo sapiens
acctcatttttcatactg

SEQ ID NO: 3305034 - DNA, 19 bp, Homo sapiens
acctccaacagaactaaat

SEQ ID NO: 3305035 - DNA, 22 bp, Homo sapiens
acctccaaccaaataagacttc

SEQ ID NO: 3305036 - DNA, 19 bp, Homo sapiens
acctccacagttcagtggc

SEQ ID NO: 3305037 - DNA, 15 bp, Homo sapiens
acctccagacttcaa

SEQ ID NO: 3305038 - DNA, 22 bp, Homo sapiens
acctccagcccgggagcctagg

SEQ ID NO: 3305039 - DNA, 14 bp, Homo sapiens
acctccaggcctgt

SEQ ID NO: 3305040 - DNA, 16 bp, Homo sapiens
acctccattaaagtct

SEQ ID NO: 3305041 - DNA, 13 bp, Homo sapiens
acctcccagaggt

SEQ ID NO: 3305042 - DNA, 22 bp, Homo sapiens
acctcccagaggtccagcccat

SEQ ID NO: 3305043 - DNA, 13 bp, Homo sapiens
acctcccagccct

SEQ ID NO: 3305044 - DNA, 15 bp, Homo sapiens
acctcccagccctat

SEQ ID NO: 3305045 - DNA, 14 bp, Homo sapiens
acctccccacgccc

SEQ ID NO: 3305046 - DNA, 15 bp, Homo sapiens
acctccccagcattc

SEQ ID NO: 3305047 - DNA, 21 bp, Homo sapiens
acctccccagcattccagccc

SEQ ID NO: 3305048 - DNA, 12 bp, Homo sapiens
acctccccagcc

SEQ ID NO: 3305049 - DNA, 10 bp, Homo sapiens
acctccctcc

SEQ ID NO: 3305050 - DNA, 18 bp, Homo sapiens
acctccctcttgttttgt

SEQ ID NO: 3305051 - DNA, 23 bp, Homo sapiens
acctccctcttgttttgtttgtc

SEQ ID NO: 3305052 - DNA, 14 bp, Homo sapiens
acctccctgaacca

SEQ ID NO: 3305053 - DNA, 15 bp, Homo sapiens
acctccctgaaccat

SEQ ID NO: 3305054 - DNA, 20 bp, Homo sapiens
acctccctgaaccatccctg

SEQ ID NO: 3305055 - DNA, 12 bp, Homo sapiens
acctccctgccc

SEQ ID NO: 3305056 - DNA, 13 bp, Homo sapiens
acctccctgccca

SEQ ID NO: 3305057 - DNA, 14 bp, Homo sapiens
acctccctgctcag

SEQ ID NO: 3305058 - DNA, 22 bp, Homo sapiens
acctcccttccgaccctctggg

SEQ ID NO: 3305059 - DNA, 17 bp, Homo sapiens
acctccgagacagtcca

SEQ ID NO: 3305060 - DNA, 23 bp, Homo sapiens
acctccgcccctgcccccgctcc

SEQ ID NO: 3305061 - DNA, 20 bp, Homo sapiens
acctccgcctcttgggttca

SEQ ID NO: 3305062 - DNA, 15 bp, Homo sapiens
acctcctcatggcag

SEQ ID NO: 3305063 - DNA, 10 bp, Homo sapiens
acctcctccc

SEQ ID NO: 3305064 - DNA, 14 bp, Homo sapiens
acctcctccccctg

SEQ ID NO: 3305065 - DNA, 17 bp, Homo sapiens
acctcctccccctgttc

SEQ ID NO: 3305066 - DNA, 16 bp, Homo sapiens
acctcctcttctgacg

SEQ ID NO: 3305067 - DNA, 13 bp, Homo sapiens
acctcctgcctcg

SEQ ID NO: 3305068 - DNA, 21 bp, Homo sapiens
acctcctgtggaacccagcag

SEQ ID NO: 3305069 - DNA, 17 bp, Homo sapiens
acctccttagccctgtc

SEQ ID NO: 3305070 - DNA, 22 bp, Homo sapiens
acctcctttcatcacactgggt

SEQ ID NO: 3305071 - DNA, 23 bp, Homo sapiens
acctcgagatgggtgctggtcct

SEQ ID NO: 3305072 - DNA, 23 bp, Homo sapiens
acctcggagcatggtgttttcat

SEQ ID NO: 3305073 - DNA, 15 bp, Homo sapiens
acctcggcctcccaa

SEQ ID NO: 3305074 - DNA, 19 bp, Homo sapiens
acctcggcttgtgggctgg

SEQ ID NO: 3305075 - DNA, 20 bp, Homo sapiens
acctcggggacaccagagct

SEQ ID NO: 3305076 - DNA, 22 bp, Homo sapiens
acctcgtgatccgcctgcctct

SEQ ID NO: 3305077 - DNA, 19 bp, Homo sapiens
acctctacccaaaccctag

SEQ ID NO: 3305078 - DNA, 14 bp, Homo sapiens
acctctactttcca

SEQ ID NO: 3305079 - DNA, 15 bp, Homo sapiens
acctctatccaaaga

SEQ ID NO: 3305080 - DNA, 13 bp, Homo sapiens
acctctcactccc

SEQ ID NO: 3305081 - DNA, 18 bp, Homo sapiens
acctctcagcagaaacac

SEQ ID NO: 3305082 - DNA, 12 bp, Homo sapiens
acctctcagggc

SEQ ID NO: 3305083 - DNA, 18 bp, Homo sapiens
acctctcatcagtgtcct

SEQ ID NO: 3305084 - DNA, 11 bp, Homo sapiens
acctctccaag

SEQ ID NO: 3305085 - DNA, 22 bp, Homo sapiens
acctctccaagtctctctgtga

SEQ ID NO: 3305086 - DNA, 12 bp, Homo sapiens
acctctccctcg

SEQ ID NO: 3305087 - DNA, 14 bp, Homo sapiens
acctctctcagagc

SEQ ID NO: 3305088 - DNA, 19 bp, Homo sapiens
acctctctgtcccttgctg

SEQ ID NO: 3305089 - DNA, 13 bp, Homo sapiens
acctctgatacct

SEQ ID NO: 3305090 - DNA, 12 bp, Homo sapiens
acctctgcctga

SEQ ID NO: 3305091 - DNA, 14 bp, Homo sapiens
acctctgcggaccc

SEQ ID NO: 3305092 - DNA, 18 bp, Homo sapiens
acctctgcggaccccagc

SEQ ID NO: 3305093 - DNA, 19 bp, Homo sapiens
acctctgcggaccccagct

SEQ ID NO: 3305094 - DNA, 19 bp, Homo sapiens
acctctggactggctagag

SEQ ID NO: 3305095 - DNA, 23 bp, Homo sapiens
acctctggactggctagagtcct

SEQ ID NO: 3305096 - DNA, 17 bp, Homo sapiens
acctctggcccttggaa

SEQ ID NO: 3305097 - DNA, 20 bp, Homo sapiens
acctctggcccttggaataa

SEQ ID NO: 3305098 - DNA, 15 bp, Homo sapiens
acctctgtctcatcc

SEQ ID NO: 3305099 - DNA, 14 bp, Homo sapiens
acctctgtgacctc

SEQ ID NO: 3305100 - DNA, 21 bp, Homo sapiens
acctctgtgaggaaagcacac

SEQ ID NO: 3305101 - DNA, 20 bp, Homo sapiens
acctcttaacaatttctgtc

SEQ ID NO: 3305102 - DNA, 13 bp, Homo sapiens
acctcttccccag

SEQ ID NO: 3305103 - DNA, 23 bp, Homo sapiens
acctcttccccagaaaggagact

SEQ ID NO: 3305104 - DNA, 14 bp, Homo sapiens
acctcttctggctc

SEQ ID NO: 3305105 - DNA, 15 bp, Homo sapiens
acctcttgctgtctc

SEQ ID NO: 3305106 - DNA, 24 bp, Homo sapiens
acctcttgctgtctctgctcgccc

SEQ ID NO: 3305107 - DNA, 19 bp, Homo sapiens
acctgaaaaaaagtttaca

SEQ ID NO: 3305108 - DNA, 13 bp, Homo sapiens
acgtggcactggt

SEQ ID NO: 3305109 - DNA, 21 bp, Homo sapiens
acgtggcctcgtgaggggcaa

SEQ ID NO: 3305110 - DNA, 16 bp, Homo sapiens
acgtggcctcttgagc

SEQ ID NO: 3305111 - DNA, 16 bp, Homo sapiens
acgtgggcaaacaggc

SEQ ID NO: 3305112 - DNA, 11 bp, Homo sapiens
acgtggggctc

SEQ ID NO: 3305113 - DNA, 23 bp, Homo sapiens
acgtggtcactgtgcactgccct

SEQ ID NO: 3305114 - DNA, 14 bp, Homo sapiens
acgtgtagctatat

SEQ ID NO: 3305115 - DNA, 16 bp, Homo sapiens
acgtgtatagtatctg

SEQ ID NO: 3305116 - DNA, 19 bp, Homo sapiens
acgtgtcttccactttgca

SEQ ID NO: 3305117 - DNA, 18 bp, Homo sapiens
acgtgtgtaaatatgtac

SEQ ID NO: 3305118 - DNA, 15 bp, Homo sapiens
acgttactcagggct

SEQ ID NO: 3305119 - DNA, 12 bp, Homo sapiens
acgttggacttt

SEQ ID NO: 3305120 - DNA, 21 bp, Homo sapiens
acgttggacttttcgttaaca

SEQ ID NO: 3305121 - DNA, 13 bp, Homo sapiens
acgtttaactgca

SEQ ID NO: 3305122 - DNA, 16 bp, Homo sapiens
acgtttacttatctta

SEQ ID NO: 3305123 - DNA, 16 bp, Homo sapiens
acgtttataaacagaa

SEQ ID NO: 3305124 - DNA, 21 bp, Homo sapiens
acgtttataaacagaaatgga

SEQ ID NO: 3305125 - DNA, 10 bp, Homo sapiens
acgtttctca

SEQ ID NO: 3305126 - DNA, 12 bp, Homo sapiens
acgtttctcatt

SEQ ID NO: 3305127 - DNA, 14 bp, Homo sapiens
acgttttattgtgt

SEQ ID NO: 3305128 - DNA, 16 bp, Homo sapiens
acgttttattgtgttt

SEQ ID NO: 3305129 - DNA, 13 bp, Homo sapiens
acgtttttccttt

SEQ ID NO: 3305130 - DNA, 19 bp, Homo sapiens
acgtttttgtgctgtgggc

SEQ ID NO: 3305131 - DNA, 17 bp, Homo sapiens
actaaaaaaaaaaaggc

SEQ ID NO: 3305132 - DNA, 16 bp, Homo sapiens
actaaaaaaaagatga

SEQ ID NO: 3305133 - DNA, 17 bp, Homo sapiens
actaaaaaaaagatgaa

SEQ ID NO: 3305134 - DNA, 17 bp, Homo sapiens
actaaaagacatttgtt

SEQ ID NO: 3305135 - DNA, 21 bp, Homo sapiens
actaaaagcagcgtcactcta

SEQ ID NO: 3305136 - DNA, 20 bp, Homo sapiens
actaaaagttcttctccaat

SEQ ID NO: 3305137 - DNA, 16 bp, Homo sapiens
actaaaatgtatctaa

SEQ ID NO: 3305138 - DNA, 23 bp, Homo sapiens
actaaaattaggactgtataagt

SEQ ID NO: 3305139 - DNA, 19 bp, Homo sapiens
actaaacatatgatttcac

SEQ ID NO: 3305140 - DNA, 17 bp, Homo sapiens
actaaaccaactctaat

SEQ ID NO: 3305141 - DNA, 18 bp, Homo sapiens
actaaaccaactctaata

SEQ ID NO: 3305142 - DNA, 13 bp, Homo sapiens
actaaactttacc

SEQ ID NO: 3305143 - DNA, 13 bp, Homo sapiens
actaaactttatt

SEQ ID NO: 3305144 - DNA, 21 bp, Homo sapiens
actaaagatatcagagctctt

SEQ ID NO: 3305145 - DNA, 17 bp, Homo sapiens
actaaagcagtagaaat

SEQ ID NO: 3305146 - DNA, 16 bp, Homo sapiens
actaaagccagcctga

SEQ ID NO: 3305147 - DNA, 21 bp, Homo sapiens
actaaagctatgttacatgga

SEQ ID NO: 3305148 - DNA, 21 bp, Homo sapiens
actaaagtatagagaaaagtg

SEQ ID NO: 3305149 - DNA, 14 bp, Homo sapiens
actaaatctgtaag

SEQ ID NO: 3305150 - DNA, 22 bp, Homo sapiens
actaaatgagattatatgtgga

SEQ ID NO: 3305151 - DNA, 15 bp, Homo sapiens
actaaatgcctagtt

SEQ ID NO: 3305152 - DNA, 17 bp, Homo sapiens
actaaatgcctagtttt

SEQ ID NO: 3305153 - DNA, 19 bp, Homo sapiens
actaaatgcctagttttta

SEQ ID NO: 3305154 - DNA, 20 bp, Homo sapiens
actaaatgcctagtttttag

SEQ ID NO: 3305155 - DNA, 13 bp, Homo sapiens
actaaatgttcta

SEQ ID NO: 3305156 - DNA, 20 bp, Homo sapiens
actaaattacgtatgcaagt

SEQ ID NO: 3305157 - DNA, 20 bp, Homo sapiens
actaaattgtatacattttg

SEQ ID NO: 3305158 - DNA, 22 bp, Homo sapiens
actaaatttaaatttaaagata

SEQ ID NO: 3305159 - DNA, 15 bp, Homo sapiens
actaaatttgatact

SEQ ID NO: 3305160 - DNA, 17 bp, Homo sapiens
actaaatttgatactta

SEQ ID NO: 3305161 - DNA, 18 bp, Homo sapiens
actaaatttgatacttat

SEQ ID NO: 3305162 - DNA, 13 bp, Homo sapiens
actaacaagaatg

SEQ ID NO: 3305163 - DNA, 12 bp, Homo sapiens
actaacattata

SEQ ID NO: 3305164 - DNA, 22 bp, Homo sapiens
actaaccaagctgagtttccta

SEQ ID NO: 3305165 - DNA, 23 bp, Homo sapiens
actaaccagggaagctgtccctc

SEQ ID NO: 3305166 - DNA, 18 bp, Homo sapiens
actaactcaaatacacat

SEQ ID NO: 3305167 - DNA, 17 bp, Homo sapiens
actaacttgacttttaa

SEQ ID NO: 3305168 - DNA, 14 bp, Homo sapiens
actaagaaaagata

SEQ ID NO: 3305169 - DNA, 12 bp, Homo sapiens
actaagaaactt

SEQ ID NO: 3305170 - DNA, 14 bp, Homo sapiens
actaagaaactttt

SEQ ID NO: 3305171 - DNA, 15 bp, Homo sapiens
actaagaaacttttg

SEQ ID NO: 3305172 - DNA, 19 bp, Homo sapiens
actaagaaacttttgtaaa

SEQ ID NO: 3305173 - DNA, 17 bp, Homo sapiens
actaagaggtgggagga

SEQ ID NO: 3305174 - DNA, 17 bp, Homo sapiens
actaagattcttttaaa

SEQ ID NO: 3305175 - DNA, 21 bp, Homo sapiens
actaagattcttttaaattag

SEQ ID NO: 3305176 - DNA, 15 bp, Homo sapiens
actaagcaatttccc

SEQ ID NO: 3305177 - DNA, 15 bp, Homo sapiens
actaagccacaagaa

SEQ ID NO: 3305178 - DNA, 16 bp, Homo sapiens
actaagccctgtcgag

SEQ ID NO: 3305179 - DNA, 19 bp, Homo sapiens
actaaggcaggtgggcaga

SEQ ID NO: 3305180 - DNA, 22 bp, Homo sapiens
actaagggaacaatccatgtga

SEQ ID NO: 3305181 - DNA, 18 bp, Homo sapiens
actaagttatagtatatc

SEQ ID NO: 3305182 - DNA, 16 bp, Homo sapiens
actaagttattttatg

SEQ ID NO: 3305183 - DNA, 17 bp, Homo sapiens
actaagttattttatga

SEQ ID NO: 3305184 - DNA, 12 bp, Homo sapiens
actaataaagtg

SEQ ID NO: 3305185 - DNA, 14 bp, Homo sapiens
actaataaagtgcc

SEQ ID NO: 3305186 - DNA, 15 bp, Homo sapiens
actaataaatacata

SEQ ID NO: 3305187 - DNA, 19 bp, Homo sapiens
actaatattttatgtgaga

SEQ ID NO: 3305188 - DNA, 22 bp, Homo sapiens
actaatctattgggttcattat

SEQ ID NO: 3305189 - DNA, 17 bp, Homo sapiens
actaatgttatttttta

SEQ ID NO: 3305190 - DNA, 21 bp, Homo sapiens
actaattatactactttgtta

SEQ ID NO: 3305191 - DNA, 18 bp, Homo sapiens
actaattcataatcactc

SEQ ID NO: 3305192 - DNA, 23 bp, Homo sapiens
actaattccacaccttttattga

SEQ ID NO: 3305193 - DNA, 17 bp, Homo sapiens
actaattgacttgcaaa

SEQ ID NO: 3305194 - DNA, 23 bp, Homo sapiens
actaattttacacattagatttt

SEQ ID NO: 3305195 - DNA, 18 bp, Homo sapiens
actaattttgttgaaaat

SEQ ID NO: 3305196 - DNA, 13 bp, Homo sapiens
actaatttttgta

SEQ ID NO: 3305197 - DNA, 19 bp, Homo sapiens
actaatttttgtattattt

SEQ ID NO: 3305198 - DNA, 14 bp, Homo sapiens
actaattttttaag

SEQ ID NO: 3305199 - DNA, 15 bp, Homo sapiens
actaattttttaaga

SEQ ID NO: 3305200 - DNA, 14 bp, Homo sapiens
actacaaaatttga

SEQ ID NO: 3305201 - DNA, 20 bp, Homo sapiens
actacacatccctaatgtgt

SEQ ID NO: 3305202 - DNA, 13 bp, Homo sapiens
actacacctggct

SEQ ID NO: 3305203 - DNA, 21 bp, Homo sapiens
actacaccttgccttgctgtt

SEQ ID NO: 3305204 - DNA, 18 bp, Homo sapiens
actacactccagcctgag

SEQ ID NO: 3305205 - DNA, 20 bp, Homo sapiens
actacactccagcctgagca

SEQ ID NO: 3305206 - DNA, 14 bp, Homo sapiens
actacactgaggag

SEQ ID NO: 3305207 - DNA, 15 bp, Homo sapiens
actacagaagtggaa

SEQ ID NO: 3305208 - DNA, 23 bp, Homo sapiens
actacagacctgctttttgaaat

SEQ ID NO: 3305209 - DNA, 19 bp, Homo sapiens
actacagctcttaaatgta

SEQ ID NO: 3305210 - DNA, 21 bp, Homo sapiens
actacaggtgtttgactttca

SEQ ID NO: 3305211 - DNA, 20 bp, Homo sapiens
actacagtcaagatagaaag

SEQ ID NO: 3305212 - DNA, 15 bp, Homo sapiens
actacatattgtctg

SEQ ID NO: 3305213 - DNA, 20 bp, Homo sapiens
actacatgagaacaaacaga

SEQ ID NO: 3305214 - DNA, 20 bp, Homo sapiens
actacatgcagcccatgccc

SEQ ID NO: 3305215 - DNA, 18 bp, Homo sapiens
actacatgtggtttatag

SEQ ID NO: 3305216 - DNA, 13 bp, Homo sapiens
actacatttatga

SEQ ID NO: 3305217 - DNA, 14 bp, Homo sapiens
actaccacaaggaa

SEQ ID NO: 3305218 - DNA, 15 bp, Homo sapiens
actaccacaaggaaa

SEQ ID NO: 3305219 - DNA, 21 bp, Homo sapiens
actacccacgttctcacaccc

SEQ ID NO: 3305220 - DNA, 12 bp, Homo sapiens
actacctctgga

SEQ ID NO: 3305221 - DNA, 23 bp, Homo sapiens
actacctctggacagttgtgttg

SEQ ID NO: 3305222 - DNA, 19 bp, Homo sapiens
actacctcttaagtcccag

SEQ ID NO: 3305223 - DNA, 13 bp, Homo sapiens
actacctgtcaag

SEQ ID NO: 3305224 - DNA, 12 bp, Homo sapiens
actacctgtgta

SEQ ID NO: 3305225 - DNA, 14 bp, Homo sapiens
actactaaggaaaa

SEQ ID NO: 3305226 - DNA, 19 bp, Homo sapiens
actactaatagaataaagg

SEQ ID NO: 3305227 - DNA, 18 bp, Homo sapiens
actactacatctgtgatg

SEQ ID NO: 3305228 - DNA, 14 bp, Homo sapiens
actactagattgac

SEQ ID NO: 3305229 - DNA, 21 bp, Homo sapiens
actactagtttttacttttat

SEQ ID NO: 3305230 - DNA, 19 bp, Homo sapiens
actactcaatactacctct

SEQ ID NO: 3305231 - DNA, 14 bp, Homo sapiens
actactcctctgca

SEQ ID NO: 3305232 - DNA, 18 bp, Homo sapiens
actactgacatgtggggc

SEQ ID NO: 3305233 - DNA, 23 bp, Homo sapiens
actactgacatgtggggccaggt

SEQ ID NO: 3305234 - DNA, 19 bp, Homo sapiens
actccgccctcctcgggcc

SEQ ID NO: 3305235 - DNA, 23 bp, Homo sapiens
actccgccctcctcgggccgagg

SEQ ID NO: 3305236 - DNA, 17 bp, Homo sapiens
actccggcctgtaatca

SEQ ID NO: 3305237 - DNA, 23 bp, Homo sapiens
actccgtccatccgactgcccct

SEQ ID NO: 3305238 - DNA, 18 bp, Homo sapiens
actccgttggccactccg

SEQ ID NO: 3305239 - DNA, 21 bp, Homo sapiens
actccgttggccactccgaga

SEQ ID NO: 3305240 - DNA, 22 bp, Homo sapiens
actcctaattttaaataatttc

SEQ ID NO: 3305241 - DNA, 20 bp, Homo sapiens
actcctacaagatttagaaa

SEQ ID NO: 3305242 - DNA, 17 bp, Homo sapiens
actcctacctcagccta

SEQ ID NO: 3305243 - DNA, 17 bp, Homo sapiens
actcctacctgccctgg

SEQ ID NO: 3305244 - DNA, 18 bp, Homo sapiens
actcctacctgccctgga

SEQ ID NO: 3305245 - DNA, 21 bp, Homo sapiens
actcctaggagagccaacctc

SEQ ID NO: 3305246 - DNA, 17 bp, Homo sapiens
actcctataaggagagt

SEQ ID NO: 3305247 - DNA, 21 bp, Homo sapiens
actcctcaaaagcaaatgaga

SEQ ID NO: 3305248 - DNA, 21 bp, Homo sapiens
actcctccctttccttcctaa

SEQ ID NO: 3305249 - DNA, 13 bp, Homo sapiens
actcctctgggcc

SEQ ID NO: 3305250 - DNA, 19 bp, Homo sapiens
actcctctgggcctggggt

SEQ ID NO: 3305251 - DNA, 21 bp, Homo sapiens
actcctctgggcctggggtgc

SEQ ID NO: 3305252 - DNA, 13 bp, Homo sapiens
actcctctgtcca

SEQ ID NO: 3305253 - DNA, 23 bp, Homo sapiens
actcctgaagtgagttttacacg

SEQ ID NO: 3305254 - DNA, 21 bp, Homo sapiens
actcctgacagtcttgtgctt

SEQ ID NO: 3305255 - DNA, 15 bp, Homo sapiens
actcctgattttgta

SEQ ID NO: 3305256 - DNA, 13 bp, Homo sapiens
actcctgcaaaat

SEQ ID NO: 3305257 - DNA, 18 bp, Homo sapiens
actcctgcaaaattttat

SEQ ID NO: 3305258 - DNA, 18 bp, Homo sapiens
actcctgccagttgaaaa

SEQ ID NO: 3305259 - DNA, 23 bp, Homo sapiens
actcctgccagttgaaaatggat

SEQ ID NO: 3305260 - DNA, 22 bp, Homo sapiens
actcctgccctgttgtgtatag

SEQ ID NO: 3305261 - DNA, 19 bp, Homo sapiens
actcctgcctccgctggct

SEQ ID NO: 3305262 - DNA, 13 bp, Homo sapiens
actcctgctggta

SEQ ID NO: 3305263 - DNA, 18 bp, Homo sapiens
actcctgctggtacctgc

SEQ ID NO: 3305264 - DNA, 22 bp, Homo sapiens
actcctgctggtacctgccctc

SEQ ID NO: 3305265 - DNA, 11 bp, Homo sapiens
actcctggcct

SEQ ID NO: 3305266 - DNA, 13 bp, Homo sapiens
actcctggcctca

SEQ ID NO: 3305267 - DNA, 11 bp, Homo sapiens
actcctggtgc

SEQ ID NO: 3305268 - DNA, 13 bp, Homo sapiens
actcctggtgccc

SEQ ID NO: 3305269 - DNA, 18 bp, Homo sapiens
actcctgtacactgaata

SEQ ID NO: 3305270 - DNA, 17 bp, Homo sapiens
actcctgttacttacct

SEQ ID NO: 3305271 - DNA, 11 bp, Homo sapiens
actccttggcc

SEQ ID NO: 3305272 - DNA, 16 bp, Homo sapiens
actccttggcctagcc

SEQ ID NO: 3305273 - DNA, 15 bp, Homo sapiens
actcgaatctgtgtg

SEQ ID NO: 3305274 - DNA, 13 bp, Homo sapiens
actcgacccagaa

SEQ ID NO: 3305275 - DNA, 13 bp, Homo sapiens
actcgaggcctgc

SEQ ID NO: 3305276 - DNA, 12 bp, Homo sapiens
actcgcttcccc

SEQ ID NO: 3305277 - DNA, 15 bp, Homo sapiens
actcgcttcccccat

SEQ ID NO: 3305278 - DNA, 20 bp, Homo sapiens
actcgcttcccccatagcca

SEQ ID NO: 3305279 - DNA, 15 bp, Homo sapiens
actcgcttgtaaata

SEQ ID NO: 3305280 - DNA, 18 bp, Homo sapiens
actcgcttgtaaatacca

SEQ ID NO: 3305281 - DNA, 16 bp, Homo sapiens
actcggatggggcacg

SEQ ID NO: 3305282 - DNA, 18 bp, Homo sapiens
actcggatggggcacgga

SEQ ID NO: 3305283 - DNA, 19 bp, Homo sapiens
actcggatttgagtgatca

SEQ ID NO: 3305284 - DNA, 21 bp, Homo sapiens
actcgggaggctgaggcagga

SEQ ID NO: 3305285 - DNA, 23 bp, Homo sapiens
actcgggggtggagtgagactga

SEQ ID NO: 3305286 - DNA, 16 bp, Homo sapiens
actctaaaaaacattt

SEQ ID NO: 3305287 - DNA, 17 bp, Homo sapiens
actctaaaaaacatttt

SEQ ID NO: 3305288 - DNA, 15 bp, Homo sapiens
actctaaagaccaaa

SEQ ID NO: 3305289 - DNA, 16 bp, Homo sapiens
actctaaagaccaaac

SEQ ID NO: 3305290 - DNA, 18 bp, Homo sapiens
actctaaagaccaaactt

SEQ ID NO: 3305291 - DNA, 17 bp, Homo sapiens
actctaaattctttatt

SEQ ID NO: 3305292 - DNA, 22 bp, Homo sapiens
actctaaattctttatttctgt

SEQ ID NO: 3305293 - DNA, 14 bp, Homo sapiens
actctaacaggcac

SEQ ID NO: 3305294 - DNA, 21 bp, Homo sapiens
actctaacaggcactttgaga

SEQ ID NO: 3305295 - DNA, 12 bp, Homo sapiens
actctaagatct

SEQ ID NO: 3305296 - DNA, 13 bp, Homo sapiens
actctaagctgtg

SEQ ID NO: 3305297 - DNA, 16 bp, Homo sapiens
actctaagctgtgtgc

SEQ ID NO: 3305298 - DNA, 18 bp, Homo sapiens
actctaagctgtgtgcag

SEQ ID NO: 3305299 - DNA, 21 bp, Homo sapiens
actctaatatgattatacaaa

SEQ ID NO: 3305300 - DNA, 14 bp, Homo sapiens
actctaatattgct

SEQ ID NO: 3305301 - DNA, 15 bp, Homo sapiens
actctaatattgctt

SEQ ID NO: 3305302 - DNA, 15 bp, Homo sapiens
actctacagaggcca

SEQ ID NO: 3305303 - DNA, 13 bp, Homo sapiens
actctacatttaa

SEQ ID NO: 3305304 - DNA, 16 bp, Homo sapiens
actctacatttaaaca

SEQ ID NO: 3305305 - DNA, 18 bp, Homo sapiens
actctaccaaataatttc

SEQ ID NO: 3305306 - DNA, 13 bp, Homo sapiens
actctaccctccc

SEQ ID NO: 3305307 - DNA, 13 bp, Homo sapiens
actctacctcata

SEQ ID NO: 3305308 - DNA, 22 bp, Homo sapiens
actctacctcatatcagtttgc

SEQ ID NO: 3305309 - DNA, 14 bp, Homo sapiens
actctagattccat

SEQ ID NO: 3305310 - DNA, 13 bp, Homo sapiens
actctagcctggg

SEQ ID NO: 3305311 - DNA, 17 bp, Homo sapiens
actctagcctgggccag

SEQ ID NO: 3305312 - DNA, 20 bp, Homo sapiens
actctagcctgggccagaga

SEQ ID NO: 3305313 - DNA, 18 bp, Homo sapiens
actctaggatgtatattt

SEQ ID NO: 3305314 - DNA, 15 bp, Homo sapiens
actctaggttataca

SEQ ID NO: 3305315 - DNA, 18 bp, Homo sapiens
actctatagactctagga

SEQ ID NO: 3305316 - DNA, 18 bp, Homo sapiens
actctatctgggcctggg

SEQ ID NO: 3305317 - DNA, 14 bp, Homo sapiens
actctattctcaaa

SEQ ID NO: 3305318 - DNA, 16 bp, Homo sapiens
actctatttttacatt

SEQ ID NO: 3305319 - DNA, 19 bp, Homo sapiens
actctcaaaagtctatttt

SEQ ID NO: 3305320 - DNA, 15 bp, Homo sapiens
actctcagcccagaa

SEQ ID NO: 3305321 - DNA, 11 bp, Homo sapiens
actctcaggga

SEQ ID NO: 3305322 - DNA, 15 bp, Homo sapiens
actctcagtgcttct

SEQ ID NO: 3305323 - DNA, 17 bp, Homo sapiens
actctccaccctggctg

SEQ ID NO: 3305324 - DNA, 15 bp, Homo sapiens
actctccccacacta

SEQ ID NO: 3305325 - DNA, 19 bp, Homo sapiens
actctccccacgagggctg

SEQ ID NO: 3305326 - DNA, 20 bp, Homo sapiens
actctccccacgagggctgg

SEQ ID NO: 3305327 - DNA, 21 bp, Homo sapiens
actctcctagagacagaagca

SEQ ID NO: 3305328 - DNA, 23 bp, Homo sapiens
actctcctagagacagaagcagg

SEQ ID NO: 3305329 - DNA, 22 bp, Homo sapiens
actctcctcggccccctccatc

SEQ ID NO: 3305330 - DNA, 23 bp, Homo sapiens
actctccttcgtgtctctcccac

SEQ ID NO: 3305331 - DNA, 22 bp, Homo sapiens
actctctcccttggcagagaag

SEQ ID NO: 3305332 - DNA, 16 bp, Homo sapiens
actctctgcctggtgg

SEQ ID NO: 3305333 - DNA, 13 bp, Homo sapiens
actctctgctcta

SEQ ID NO: 3305334 - DNA, 24 bp, Homo sapiens
actctctgctctagccaggagtct

SEQ ID NO: 3305335 - DNA, 13 bp, Homo sapiens
actctgaaaaaca

SEQ ID NO: 3305336 - DNA, 15 bp, Homo sapiens
actctgaaaaacatt

SEQ ID NO: 3305337 - DNA, 23 bp, Homo sapiens
actctgaaaagcaattgccctgt

SEQ ID NO: 3305338 - DNA, 20 bp, Homo sapiens
actctgaaacacactgaaag

SEQ ID NO: 3305339 - DNA, 9 bp, Homo sapiens
actctgaac

SEQ ID NO: 3305340 - DNA, 16 bp, Homo sapiens
actctgaactttggag

SEQ ID NO: 3305341 - DNA, 12 bp, Homo sapiens
actctgagccca

SEQ ID NO: 3305342 - DNA, 18 bp, Homo sapiens
actctgagcccaggccgt

SEQ ID NO: 3305343 - DNA, 14 bp, Homo sapiens
actctgagcccatg

SEQ ID NO: 3305344 - DNA, 16 bp, Homo sapiens
actctgagtttaccat

SEQ ID NO: 3305345 - DNA, 23 bp, Homo sapiens
actctgatggttcttcacctcct

SEQ ID NO: 3305346 - DNA, 17 bp, Homo sapiens
actctgcaaaggcctgg

SEQ ID NO: 3305347 - DNA, 17 bp, Homo sapiens
actctgcacatgtcttg

SEQ ID NO: 3305348 - DNA, 19 bp, Homo sapiens
actctgcacatgtcttgta

SEQ ID NO: 3305349 - DNA, 15 bp, Homo sapiens
actctgcactactcc

SEQ ID NO: 3305350 - DNA, 21 bp, Homo sapiens
actctgcactctccaccctgg

SEQ ID NO: 3305351 - DNA, 24 bp, Homo sapiens
actctgcagactgctagtgttctg

SEQ ID NO: 3305352 - DNA, 18 bp, Homo sapiens
actctgcatcccagcacc

SEQ ID NO: 3305353 - DNA, 20 bp, Homo sapiens
actctgcatgtagaggcttg

SEQ ID NO: 3305354 - DNA, 16 bp, Homo sapiens
actctgcattctagta

SEQ ID NO: 3305355 - DNA, 16 bp, Homo sapiens
actctgccagccacat

SEQ ID NO: 3305356 - DNA, 18 bp, Homo sapiens
actctgccagggcagtgc

SEQ ID NO: 3305357 - DNA, 20 bp, Homo sapiens
actctgccccacgctgtggc

SEQ ID NO: 3305358 - DNA, 21 bp, Homo sapiens
actctgcccccatttccccga

SEQ ID NO: 3305359 - DNA, 17 bp, Homo sapiens
actctgctaatcatgtg

SEQ ID NO: 3305360 - DNA, 24 bp, Homo sapiens
actgtcactcattgctgagcctct

SEQ ID NO: 3305361 - DNA, 15 bp, Homo sapiens
actgtcactgttcct

SEQ ID NO: 3305362 - DNA, 13 bp, Homo sapiens
actgtcagattaa

SEQ ID NO: 3305363 - DNA, 21 bp, Homo sapiens
actgtcagattaaattacagc

SEQ ID NO: 3305364 - DNA, 13 bp, Homo sapiens
actgtcaggcctc

SEQ ID NO: 3305365 - DNA, 16 bp, Homo sapiens
actgtcccttgcctca

SEQ ID NO: 3305366 - DNA, 18 bp, Homo sapiens
actgtcctacccaccctc

SEQ ID NO: 3305367 - DNA, 20 bp, Homo sapiens
actgtcctctcccctccagc

SEQ ID NO: 3305368 - DNA, 14 bp, Homo sapiens
actgtcggagaggc

SEQ ID NO: 3305369 - DNA, 16 bp, Homo sapiens
actgtcggagaggctg

SEQ ID NO: 3305370 - DNA, 21 bp, Homo sapiens
actgtcggagaggctgtctgg

SEQ ID NO: 3305371 - DNA, 16 bp, Homo sapiens
actgtctaactttaga

SEQ ID NO: 3305372 - DNA, 21 bp, Homo sapiens
actgtctcaagagggcactgg

SEQ ID NO: 3305373 - DNA, 12 bp, Homo sapiens
actgtctcactg

SEQ ID NO: 3305374 - DNA, 17 bp, Homo sapiens
actgtctttaaaagaga

SEQ ID NO: 3305375 - DNA, 19 bp, Homo sapiens
actgtctttaaaagagaga

SEQ ID NO: 3305376 - DNA, 21 bp, Homo sapiens
actgtgaacttgactgggtga

SEQ ID NO: 3305377 - DNA, 21 bp, Homo sapiens
actgtgaccaccttctgtccc

SEQ ID NO: 3305378 - DNA, 14 bp, Homo sapiens
actgtgacctttgt

SEQ ID NO: 3305379 - DNA, 22 bp, Homo sapiens
actgtgaggaagtgtggaaaaa

SEQ ID NO: 3305380 - DNA, 22 bp, Homo sapiens
actgtgattcagaaaatgttct

SEQ ID NO: 3305381 - DNA, 12 bp, Homo sapiens
actgtgcactgc

SEQ ID NO: 3305382 - DNA, 16 bp, Homo sapiens
actgtgcactgccctg

SEQ ID NO: 3305383 - DNA, 17 bp, Homo sapiens
actgtgcactgccctgt

SEQ ID NO: 3305384 - DNA, 21 bp, Homo sapiens
actgtgcagaataatggaaac

SEQ ID NO: 3305385 - DNA, 19 bp, Homo sapiens
actgtgcatagtgctggga

SEQ ID NO: 3305386 - DNA, 16 bp, Homo sapiens
actgtgccatgtgcca

SEQ ID NO: 3305387 - DNA, 17 bp, Homo sapiens
actgtgccctggtggag

SEQ ID NO: 3305388 - DNA, 16 bp, Homo sapiens
actgtgcctagttcct

SEQ ID NO: 3305389 - DNA, 21 bp, Homo sapiens
actgtgctaataacagtgcat

SEQ ID NO: 3305390 - DNA, 15 bp, Homo sapiens
actgtgctactgtct

SEQ ID NO: 3305391 - DNA, 15 bp, Homo sapiens
actgtggaggaagga

SEQ ID NO: 3305392 - DNA, 23 bp, Homo sapiens
actgtggaggaaggattgtaaaa

SEQ ID NO: 3305393 - DNA, 18 bp, Homo sapiens
actgtggccacagccccc

SEQ ID NO: 3305394 - DNA, 22 bp, Homo sapiens
actgtggccagagctggaaggc

SEQ ID NO: 3305395 - DNA, 17 bp, Homo sapiens
actgtggccgttatctg

SEQ ID NO: 3305396 - DNA, 20 bp, Homo sapiens
actgtggccgttatctggaa

SEQ ID NO: 3305397 - DNA, 12 bp, Homo sapiens
actgtggctgca

SEQ ID NO: 3305398 - DNA, 18 bp, Homo sapiens
actgtggtctggtgttcc

SEQ ID NO: 3305399 - DNA, 16 bp, Homo sapiens
actgtgtacataactg

SEQ ID NO: 3305400 - DNA, 14 bp, Homo sapiens
actgtgtacataat

SEQ ID NO: 3305401 - DNA, 18 bp, Homo sapiens
actgtgtatgtacatata

SEQ ID NO: 3305402 - DNA, 20 bp, Homo sapiens
actgtgtctctgaattcctg

SEQ ID NO: 3305403 - DNA, 13 bp, Homo sapiens
actgtgtggaact

SEQ ID NO: 3305404 - DNA, 17 bp, Homo sapiens
actgtgtggactgtgat

SEQ ID NO: 3305405 - DNA, 19 bp, Homo sapiens
actgtgtggactgtgatgc

SEQ ID NO: 3305406 - DNA, 16 bp, Homo sapiens
actgtgtgtgtgaatg

SEQ ID NO: 3305407 - DNA, 12 bp, Homo sapiens
actgtgttcctg

SEQ ID NO: 3305408 - DNA, 15 bp, Homo sapiens
actgtgttcctggca

SEQ ID NO: 3305409 - DNA, 15 bp, Homo sapiens
actgtgttgtattaa

SEQ ID NO: 3305410 - DNA, 20 bp, Homo sapiens
actgtgttgtattaacaaaa

SEQ ID NO: 3305411 - DNA, 21 bp, Homo sapiens
actgtgttgtattaacaaaag

SEQ ID NO: 3305412 - DNA, 17 bp, Homo sapiens
actgttaatagttcagg

SEQ ID NO: 3305413 - DNA, 15 bp, Homo sapiens
actgttactttggca

SEQ ID NO: 3305414 - DNA, 17 bp, Homo sapiens
actgttactttggcaat

SEQ ID NO: 3305415 - DNA, 15 bp, Homo sapiens
actgttagaacacta

SEQ ID NO: 3305416 - DNA, 15 bp, Homo sapiens
actgttagcactgtt

SEQ ID NO: 3305417 - DNA, 18 bp, Homo sapiens
actgttagcactgttgat

SEQ ID NO: 3305418 - DNA, 21 bp, Homo sapiens
actgttagctttttaaaacat

SEQ ID NO: 3305419 - DNA, 19 bp, Homo sapiens
actgttatgaaataaagaa

SEQ ID NO: 3305420 - DNA, 14 bp, Homo sapiens
actgttcacggcag

SEQ ID NO: 3305421 - DNA, 22 bp, Homo sapiens
actgttcagctgtcctccctcc

SEQ ID NO: 3305422 - DNA, 17 bp, Homo sapiens
actgttccagattccta

SEQ ID NO: 3305423 - DNA, 19 bp, Homo sapiens
actgttccaggccctccag

SEQ ID NO: 3305424 - DNA, 15 bp, Homo sapiens
actgttccctctgct

SEQ ID NO: 3305425 - DNA, 16 bp, Homo sapiens
actgttccctctggct

SEQ ID NO: 3305426 - DNA, 16 bp, Homo sapiens
actgttctaaagctct

SEQ ID NO: 3305427 - DNA, 18 bp, Homo sapiens
actgttctaaagctctga

SEQ ID NO: 3305428 - DNA, 23 bp, Homo sapiens
actgttctctttaaaatatttgt

SEQ ID NO: 3305429 - DNA, 12 bp, Homo sapiens
actgttctgcaa

SEQ ID NO: 3305430 - DNA, 13 bp, Homo sapiens
actgttctgcaaa

SEQ ID NO: 3305431 - DNA, 13 bp, Homo sapiens
actgttctgtgtc

SEQ ID NO: 3305432 - DNA, 15 bp, Homo sapiens
actgttctgtgtctt

SEQ ID NO: 3305433 - DNA, 17 bp, Homo sapiens
actgttcttgctgctag

SEQ ID NO: 3305434 - DNA, 15 bp, Homo sapiens
actgttcttggtaac

SEQ ID NO: 3305435 - DNA, 16 bp, Homo sapiens
actgttgatgaagtat

SEQ ID NO: 3305436 - DNA, 21 bp, Homo sapiens
actgttgatgaagtatacttt

SEQ ID NO: 3305437 - DNA, 12 bp, Homo sapiens
actgttgcccag

SEQ ID NO: 3305438 - DNA, 13 bp, Homo sapiens
actgttgcccagg

SEQ ID NO: 3305439 - DNA, 17 bp, Homo sapiens
actgttgcccaggctgg

SEQ ID NO: 3305440 - DNA, 17 bp, Homo sapiens
actgttgcctaattgga

SEQ ID NO: 3305441 - DNA, 12 bp, Homo sapiens
actgttgctcaa

SEQ ID NO: 3305442 - DNA, 14 bp, Homo sapiens
actgttgtaagaat

SEQ ID NO: 3305443 - DNA, 21 bp, Homo sapiens
actgttgtaagaattctgatt

SEQ ID NO: 3305444 - DNA, 18 bp, Homo sapiens
actgttgtgatcttgcat

SEQ ID NO: 3305445 - DNA, 19 bp, Homo sapiens
actgttgtgatcttgcatt

SEQ ID NO: 3305446 - DNA, 21 bp, Homo sapiens
actgttgtgatcttgcattca

SEQ ID NO: 3305447 - DNA, 15 bp, Homo sapiens
actgttgtgggcgct

SEQ ID NO: 3305448 - DNA, 13 bp, Homo sapiens
actgtttatataa

SEQ ID NO: 3305449 - DNA, 15 bp, Homo sapiens
actgtttcactgaaa

SEQ ID NO: 3305450 - DNA, 20 bp, Homo sapiens
actgtttcactgaaatgttt

SEQ ID NO: 3305451 - DNA, 14 bp, Homo sapiens
actgtttccctgct

SEQ ID NO: 3305452 - DNA, 16 bp, Homo sapiens
actgtttccctgctga

SEQ ID NO: 3305453 - DNA, 14 bp, Homo sapiens
actgtttctctgct

SEQ ID NO: 3305454 - DNA, 16 bp, Homo sapiens
actgtttctcttgagc

SEQ ID NO: 3305455 - DNA, 21 bp, Homo sapiens
actgtttctcttgagctggcc

SEQ ID NO: 3305456 - DNA, 23 bp, Homo sapiens
actgtttctcttgagctggcctc

SEQ ID NO: 3305457 - DNA, 23 bp, Homo sapiens
actgtttgatataccaaattaaa

SEQ ID NO: 3305458 - DNA, 14 bp, Homo sapiens
actgtttggcttat

SEQ ID NO: 3305459 - DNA, 21 bp, Homo sapiens
actgtttggcttataaacaca

SEQ ID NO: 3305460 - DNA, 21 bp, Homo sapiens
actgtttgtttttatttaaat

SEQ ID NO: 3305461 - DNA, 16 bp, Homo sapiens
actgttttaattgtag

SEQ ID NO: 3305462 - DNA, 17 bp, Homo sapiens
actgttttccagttcat

SEQ ID NO: 3305463 - DNA, 14 bp, Homo sapiens
actgtttttaagta

SEQ ID NO: 3305464 - DNA, 18 bp, Homo sapiens
actgtttttaagtaactt

SEQ ID NO: 3305465 - DNA, 19 bp, Homo sapiens
actgtttttgaaaaattac

SEQ ID NO: 3305466 - DNA, 13 bp, Homo sapiens
actgttttttaag

SEQ ID NO: 3305467 - DNA, 14 bp, Homo sapiens
acttaaaaaaatga

SEQ ID NO: 3305468 - DNA, 17 bp, Homo sapiens
acttaaaaaaatgacag

SEQ ID NO: 3305469 - DNA, 16 bp, Homo sapiens
acttaaaaaatgtcca

SEQ ID NO: 3305470 - DNA, 14 bp, Homo sapiens
acttaaaaatgtaa

SEQ ID NO: 3305471 - DNA, 18 bp, Homo sapiens
acttaaaaatgtaaatat

SEQ ID NO: 3305472 - DNA, 23 bp, Homo sapiens
acttaaaaattagcatgctgctt

SEQ ID NO: 3305473 - DNA, 12 bp, Homo sapiens
acttaaaagtat

SEQ ID NO: 3305474 - DNA, 14 bp, Homo sapiens
acttaaaagtattc

SEQ ID NO: 3305475 - DNA, 20 bp, Homo sapiens
acttaaaatattcctgcatt

SEQ ID NO: 3305476 - DNA, 22 bp, Homo sapiens
acttaaagcccgcctgacagaa

SEQ ID NO: 3305477 - DNA, 17 bp, Homo sapiens
acttaaaggctgtggta

SEQ ID NO: 3305478 - DNA, 23 bp, Homo sapiens
acttaaatttggtttgttaattc

SEQ ID NO: 3305479 - DNA, 19 bp, Homo sapiens
acttaacccagattttatt

SEQ ID NO: 3305480 - DNA, 14 bp, Homo sapiens
acttaagagaaatg

SEQ ID NO: 3305481 - DNA, 15 bp, Homo sapiens
acttaagagtggcat

SEQ ID NO: 3305482 - DNA, 20 bp, Homo sapiens
acttaagcatctggctctaa

SEQ ID NO: 3305483 - DNA, 21 bp, Homo sapiens
acttaagcatctggctctaat

SEQ ID NO: 3305484 - DNA, 17 bp, Homo sapiens
acttaagtgcacttttt

SEQ ID NO: 3305485 - DNA, 19 bp, Homo sapiens
acttaataaatctgccatt

SEQ ID NO: 3305486 - DNA, 17 bp, Homo sapiens
actttttagtaatttct

SEQ ID NO: 3305487 - DNA, 13 bp, Homo sapiens
actttttcatttg

SEQ ID NO: 3305488 - DNA, 17 bp, Homo sapiens
actttttctgagctttt

SEQ ID NO: 3305489 - DNA, 14 bp, Homo sapiens
actttttcttgtat

SEQ ID NO: 3305490 - DNA, 20 bp, Homo sapiens
actttttgaactaagaaact

SEQ ID NO: 3305491 - DNA, 21 bp, Homo sapiens
actttttgaactaagaaactt

SEQ ID NO: 3305492 - DNA, 18 bp, Homo sapiens
actttttgttctggtcct

SEQ ID NO: 3305493 - DNA, 23 bp, Homo sapiens
actttttgttctggtcctttttg

SEQ ID NO: 3305494 - DNA, 16 bp, Homo sapiens
acttttttaaatattt

SEQ ID NO: 3305495 - DNA, 19 bp, Homo sapiens
acttttttagaaatgcaaa

SEQ ID NO: 3305496 - DNA, 13 bp, Homo sapiens
acttttttatagc

SEQ ID NO: 3305497 - DNA, 13 bp, Homo sapiens
acttttttccaaa

SEQ ID NO: 3305498 - DNA, 13 bp, Homo sapiens
acttttttgtgta

SEQ ID NO: 3305499 - DNA, 15 bp, Homo sapiens
acttttttgtgtatg

SEQ ID NO: 3305500 - DNA, 13 bp, Homo sapiens
actttttttcaat

SEQ ID NO: 3305501 - DNA, 14 bp, Homo sapiens
actttttttcaatg

SEQ ID NO: 3305502 - DNA, 15 bp, Homo sapiens
actttttttcaatgt

SEQ ID NO: 3305503 - DNA, 20 bp, Homo sapiens
actttttttctgtaccagtt

SEQ ID NO: 3305504 - DNA, 19 bp, Homo sapiens
actttttttggaagttatt

SEQ ID NO: 3305505 - DNA, 18 bp, Homo sapiens
acttttttttagttcaat

SEQ ID NO: 3305506 - DNA, 16 bp, Homo sapiens
actttttttttatact

SEQ ID NO: 3305507 - DNA, 20 bp, Homo sapiens
actttttttttatactgcac

SEQ ID NO: 3305508 - DNA, 17 bp, Homo sapiens
agaaaaaaaaccttgta

SEQ ID NO: 3305509 - DNA, 19 bp, Homo sapiens
agaaaaaaagaggtttaag

SEQ ID NO: 3305510 - DNA, 21 bp, Homo sapiens
agaaaaaaatcttctccagat

SEQ ID NO: 3305511 - DNA, 12 bp, Homo sapiens
agaaaaaagaag

SEQ ID NO: 3305512 - DNA, 15 bp, Homo sapiens
agaaaaaagtgttga

SEQ ID NO: 3305513 - DNA, 13 bp, Homo sapiens
agaaaaaataaat

SEQ ID NO: 3305514 - DNA, 22 bp, Homo sapiens
agaaaaaattccctcatttaaa

SEQ ID NO: 3305515 - DNA, 18 bp, Homo sapiens
agaaaaaccaatgattca

SEQ ID NO: 3305516 - DNA, 19 bp, Homo sapiens
agaaaaaccaatgattcat

SEQ ID NO: 3305517 - DNA, 20 bp, Homo sapiens
agaaaaaccaatgattcata

SEQ ID NO: 3305518 - DNA, 16 bp, Homo sapiens
agaaaaagtacaatga

SEQ ID NO: 3305519 - DNA, 17 bp, Homo sapiens
agaaaaataagtcaaaa

SEQ ID NO: 3305520 - DNA, 23 bp, Homo sapiens
agaaaaatcttgtgctagaatac

SEQ ID NO: 3305521 - DNA, 18 bp, Homo sapiens
agaaaacaacttggcatt

SEQ ID NO: 3305522 - DNA, 12 bp, Homo sapiens
agaaaacagaga

SEQ ID NO: 3305523 - DNA, 23 bp, Homo sapiens
agaaaacataatcttctgccttc

SEQ ID NO: 3305524 - DNA, 16 bp, Homo sapiens
agaaaacccttttcta

SEQ ID NO: 3305525 - DNA, 19 bp, Homo sapiens
agaaaactttaaaaaatat

SEQ ID NO: 3305526 - DNA, 22 bp, Homo sapiens
agaaaactttaaaaaatattta

SEQ ID NO: 3305527 - DNA, 17 bp, Homo sapiens
agaaaagaaaatatagt

SEQ ID NO: 3305528 - DNA, 17 bp, Homo sapiens
agaaaagataaagatga

SEQ ID NO: 3305529 - DNA, 12 bp, Homo sapiens
agaaaagcactt

SEQ ID NO: 3305530 - DNA, 19 bp, Homo sapiens
agaaaagcacttttgttat

SEQ ID NO: 3305531 - DNA, 20 bp, Homo sapiens
agaaaagcacttttgttatt

SEQ ID NO: 3305532 - DNA, 21 bp, Homo sapiens
agaaaagcacttttgttattc

SEQ ID NO: 3305533 - DNA, 12 bp, Homo sapiens
agaaaagcattt

SEQ ID NO: 3305534 - DNA, 16 bp, Homo sapiens
agaaaagccgaaaggg

SEQ ID NO: 3305535 - DNA, 19 bp, Homo sapiens
agaaaagctgccatttccc

SEQ ID NO: 3305536 - DNA, 15 bp, Homo sapiens
agaaaagtaattttg

SEQ ID NO: 3305537 - DNA, 20 bp, Homo sapiens
agaaaagtaattttgtcaca

SEQ ID NO: 3305538 - DNA, 15 bp, Homo sapiens
agaaaagtagacaat

SEQ ID NO: 3305539 - DNA, 12 bp, Homo sapiens
agaaaagtgaat

SEQ ID NO: 3305540 - DNA, 15 bp, Homo sapiens
agaaaagttgcagat

SEQ ID NO: 3305541 - DNA, 23 bp, Homo sapiens
agaaaatattatgtgtttccata

SEQ ID NO: 3305542 - DNA, 19 bp, Homo sapiens
agaaaatgacttatttctg

SEQ ID NO: 3305543 - DNA, 20 bp, Homo sapiens
agaaaatgacttatttctgc

SEQ ID NO: 3305544 - DNA, 23 bp, Homo sapiens
agaaaatgacttatttctgctct

SEQ ID NO: 3305545 - DNA, 18 bp, Homo sapiens
agaaaatgatgagttttt

SEQ ID NO: 3305546 - DNA, 20 bp, Homo sapiens
agaaaatgatgagtttttat

SEQ ID NO: 3305547 - DNA, 21 bp, Homo sapiens
agaaaatgatgagtttttatg

SEQ ID NO: 3305548 - DNA, 22 bp, Homo sapiens
agaaaatgcctcaattcacata

SEQ ID NO: 3305549 - DNA, 21 bp, Homo sapiens
agaaaatggctaataaactgt

SEQ ID NO: 3305550 - DNA, 20 bp, Homo sapiens
agaaaatggtttattttgta

SEQ ID NO: 3305551 - DNA, 21 bp, Homo sapiens
agaaaatggtttattttgtat

SEQ ID NO: 3305552 - DNA, 16 bp, Homo sapiens
agaaaatgttatttaa

SEQ ID NO: 3305553 - DNA, 14 bp, Homo sapiens
agaaaatgttctgt

SEQ ID NO: 3305554 - DNA, 14 bp, Homo sapiens
agaaaattctcctg

SEQ ID NO: 3305555 - DNA, 15 bp, Homo sapiens
agaaaattgcactaa

SEQ ID NO: 3305556 - DNA, 16 bp, Homo sapiens
agaaaattgcactaaa

SEQ ID NO: 3305557 - DNA, 17 bp, Homo sapiens
agaaaattgcctttaaa

SEQ ID NO: 3305558 - DNA, 13 bp, Homo sapiens
agaaacaagctgt

SEQ ID NO: 3305559 - DNA, 17 bp, Homo sapiens
agaaacaagctgtgcag

SEQ ID NO: 3305560 - DNA, 15 bp, Homo sapiens
agaaacaataaagag

SEQ ID NO: 3305561 - DNA, 17 bp, Homo sapiens
agaaacaataaagagat

SEQ ID NO: 3305562 - DNA, 10 bp, Homo sapiens
agaaacacaa

SEQ ID NO: 3305563 - DNA, 17 bp, Homo sapiens
agaaacacataaattat

SEQ ID NO: 3305564 - DNA, 13 bp, Homo sapiens
agaaacacattct

SEQ ID NO: 3305565 - DNA, 15 bp, Homo sapiens
agaaacactgaaaag

SEQ ID NO: 3305566 - DNA, 13 bp, Homo sapiens
agaaacagctcag

SEQ ID NO: 3305567 - DNA, 15 bp, Homo sapiens
agaaacagctttcaa

SEQ ID NO: 3305568 - DNA, 16 bp, Homo sapiens
agaaacagctttcaag

SEQ ID NO: 3305569 - DNA, 19 bp, Homo sapiens
agaaacagtgggagccctg

SEQ ID NO: 3305570 - DNA, 19 bp, Homo sapiens
agaaacagttggtaacttt

SEQ ID NO: 3305571 - DNA, 11 bp, Homo sapiens
agaaacatgaa

SEQ ID NO: 3305572 - DNA, 13 bp, Homo sapiens
agaaacattgtaa

SEQ ID NO: 3305573 - DNA, 16 bp, Homo sapiens
agaaacattgtaaata

SEQ ID NO: 3305574 - DNA, 17 bp, Homo sapiens
agaaacatttagattta

SEQ ID NO: 3305575 - DNA, 16 bp, Homo sapiens
agaaaccgtcctcttt

SEQ ID NO: 3305576 - DNA, 18 bp, Homo sapiens
agaaacctcattggccag

SEQ ID NO: 3305577 - DNA, 23 bp, Homo sapiens
agaaacctgaggatgcaacaaat

SEQ ID NO: 3305578 - DNA, 19 bp, Homo sapiens
agaaacctggggtgaatac

SEQ ID NO: 3305579 - DNA, 23 bp, Homo sapiens
agaaacctggggtgaatacttat

SEQ ID NO: 3305580 - DNA, 16 bp, Homo sapiens
agaaaccttattgtac

SEQ ID NO: 3305581 - DNA, 18 bp, Homo sapiens
agaaaccttattgtacct

SEQ ID NO: 3305582 - DNA, 18 bp, Homo sapiens
agaaactactaatttttt

SEQ ID NO: 3305583 - DNA, 19 bp, Homo sapiens
agaaactatgaagatctga

SEQ ID NO: 3305584 - DNA, 13 bp, Homo sapiens
agaaactccaaag

SEQ ID NO: 3305585 - DNA, 14 bp, Homo sapiens
agaaactgaaagtg

SEQ ID NO: 3305586 - DNA, 17 bp, Homo sapiens
agaaactgaaagtgttt

SEQ ID NO: 3305587 - DNA, 13 bp, Homo sapiens
agaaactgaggaa

SEQ ID NO: 3305588 - DNA, 14 bp, Homo sapiens
agaaactgatgcca

SEQ ID NO: 3305589 - DNA, 19 bp, Homo sapiens
agaaactggattaaaacaa

SEQ ID NO: 3305590 - DNA, 12 bp, Homo sapiens
agaaacttagag

SEQ ID NO: 3305591 - DNA, 23 bp, Homo sapiens
agaaacttgtgaagtggaaatgt

SEQ ID NO: 3305592 - DNA, 17 bp, Homo sapiens
agaaagaaaagaccctg

SEQ ID NO: 3305593 - DNA, 16 bp, Homo sapiens
agaaagaaaatgaaga

SEQ ID NO: 3305594 - DNA, 12 bp, Homo sapiens
agaaagaaagtt

SEQ ID NO: 3305595 - DNA, 12 bp, Homo sapiens
agaaagaagccc

SEQ ID NO: 3305596 - DNA, 14 bp, Homo sapiens
agaaagagctgcct

SEQ ID NO: 3305597 - DNA, 16 bp, Homo sapiens
agaaagagctgcctgg

SEQ ID NO: 3305598 - DNA, 15 bp, Homo sapiens
agaaagaggtctccc

SEQ ID NO: 3305599 - DNA, 17 bp, Homo sapiens
agaaagatcattgaaat

SEQ ID NO: 3305600 - DNA, 19 bp, Homo sapiens
agaaagatggatgtgcttt

SEQ ID NO: 3305601 - DNA, 14 bp, Homo sapiens
agaaagcaggggct

SEQ ID NO: 3305602 - DNA, 20 bp, Homo sapiens
agaaagcaggggctacaaga

SEQ ID NO: 3305603 - DNA, 22 bp, Homo sapiens
agaaagcctgttcccctcactg

SEQ ID NO: 3305604 - DNA, 19 bp, Homo sapiens
agaaagctggcaacatgaa

SEQ ID NO: 3305605 - DNA, 19 bp, Homo sapiens
agaaagctggtaaactatt

SEQ ID NO: 3305606 - DNA, 22 bp, Homo sapiens
agaaagctgtgaacaggctggg

SEQ ID NO: 3305607 - DNA, 16 bp, Homo sapiens
agaaaggaacctggga

SEQ ID NO: 3305608 - DNA, 13 bp, Homo sapiens
agaaaggagagac

SEQ ID NO: 3305609 - DNA, 20 bp, Homo sapiens
agaaaggaggggatagagag

SEQ ID NO: 3305610 - DNA, 21 bp, Homo sapiens
agaaaggatatttaagaaaat

SEQ ID NO: 3305611 - DNA, 15 bp, Homo sapiens
agaaaggcctgcaca

SEQ ID NO: 3305612 - DNA, 17 bp, Homo sapiens
agaccctgggagagaag

SEQ ID NO: 3305613 - DNA, 17 bp, Homo sapiens
agaccctgggtgggctc

SEQ ID NO: 3305614 - DNA, 20 bp, Homo sapiens
agaccctgggtgggctctgt

SEQ ID NO: 3305615 - DNA, 18 bp, Homo sapiens
agacccttgacacctgct

SEQ ID NO: 3305616 - DNA, 17 bp, Homo sapiens
agaccgctctcttttct

SEQ ID NO: 3305617 - DNA, 22 bp, Homo sapiens
agaccgctctcttttctgtact

SEQ ID NO: 3305618 - DNA, 17 bp, Homo sapiens
agaccgcttcacccctg

SEQ ID NO: 3305619 - DNA, 13 bp, Homo sapiens
agaccgtcctcac

SEQ ID NO: 3305620 - DNA, 18 bp, Homo sapiens
agaccgtcgggggctgag

SEQ ID NO: 3305621 - DNA, 23 bp, Homo sapiens
agaccgtcgggggctgaggggca

SEQ ID NO: 3305622 - DNA, 18 bp, Homo sapiens
agaccgtttacctagaag

SEQ ID NO: 3305623 - DNA, 21 bp, Homo sapiens
agaccgtttacctagaagaag

SEQ ID NO: 3305624 - DNA, 15 bp, Homo sapiens
agacctacattccct

SEQ ID NO: 3305625 - DNA, 18 bp, Homo sapiens
agacctacattccctctc

SEQ ID NO: 3305626 - DNA, 14 bp, Homo sapiens
agacctacctcagg

SEQ ID NO: 3305627 - DNA, 15 bp, Homo sapiens
agacctacctcaggt

SEQ ID NO: 3305628 - DNA, 16 bp, Homo sapiens
agacctactgttctaa

SEQ ID NO: 3305629 - DNA, 20 bp, Homo sapiens
agacctactgttctaaagct

SEQ ID NO: 3305630 - DNA, 20 bp, Homo sapiens
agacctcagtgccttcctgt

SEQ ID NO: 3305631 - DNA, 20 bp, Homo sapiens
agacctcatctgtggagctg

SEQ ID NO: 3305632 - DNA, 16 bp, Homo sapiens
agacctccaataaagt

SEQ ID NO: 3305633 - DNA, 15 bp, Homo sapiens
agacctccccagccc

SEQ ID NO: 3305634 - DNA, 23 bp, Homo sapiens
agacctccccagcccctagccca

SEQ ID NO: 3305635 - DNA, 16 bp, Homo sapiens
agacctcgagcagatg

SEQ ID NO: 3305636 - DNA, 23 bp, Homo sapiens
agacctctgtgaggaaagcacac

SEQ ID NO: 3305637 - DNA, 18 bp, Homo sapiens
agacctctgtgcacttat

SEQ ID NO: 3305638 - DNA, 19 bp, Homo sapiens
agacctcttctaagaggat

SEQ ID NO: 3305639 - DNA, 22 bp, Homo sapiens
agacctgcttcctgaaataaac

SEQ ID NO: 3305640 - DNA, 23 bp, Homo sapiens
agacctgcttcctgaaataaaca

SEQ ID NO: 3305641 - DNA, 19 bp, Homo sapiens
agacctgctttttgaaatg

SEQ ID NO: 3305642 - DNA, 13 bp, Homo sapiens
agacctggagccc

SEQ ID NO: 3305643 - DNA, 18 bp, Homo sapiens
agacctgtcttccaagga

SEQ ID NO: 3305644 - DNA, 12 bp, Homo sapiens
agacctgtgcta

SEQ ID NO: 3305645 - DNA, 15 bp, Homo sapiens
agaccttaatttata

SEQ ID NO: 3305646 - DNA, 13 bp, Homo sapiens
agaccttccataa

SEQ ID NO: 3305647 - DNA, 22 bp, Homo sapiens
agaccttccataatgctactgt

SEQ ID NO: 3305648 - DNA, 13 bp, Homo sapiens
agacgcagagcaa

SEQ ID NO: 3305649 - DNA, 22 bp, Homo sapiens
agacgcatagactgaggtataa

SEQ ID NO: 3305650 - DNA, 14 bp, Homo sapiens
agacgcatttcggt

SEQ ID NO: 3305651 - DNA, 15 bp, Homo sapiens
agacgccaccattcc

SEQ ID NO: 3305652 - DNA, 17 bp, Homo sapiens
agacgccaccattcctg

SEQ ID NO: 3305653 - DNA, 22 bp, Homo sapiens
agacggcagaaaacagagcctg

SEQ ID NO: 3305654 - DNA, 14 bp, Homo sapiens
agacggcggccagg

SEQ ID NO: 3305655 - DNA, 20 bp, Homo sapiens
agacggcggccaggcacagg

SEQ ID NO: 3305656 - DNA, 21 bp, Homo sapiens
agacggcggccaggcacaggg

SEQ ID NO: 3305657 - DNA, 16 bp, Homo sapiens
agacgggcaagaagct

SEQ ID NO: 3305658 - DNA, 16 bp, Homo sapiens
agacggtgttttgcca

SEQ ID NO: 3305659 - DNA, 14 bp, Homo sapiens
agacgtccatagct

SEQ ID NO: 3305660 - DNA, 18 bp, Homo sapiens
agacgtggaacctctgtc

SEQ ID NO: 3305661 - DNA, 20 bp, Homo sapiens
agacgtggaacctctgtctc

SEQ ID NO: 3305662 - DNA, 15 bp, Homo sapiens
agacgtttaactgca

SEQ ID NO: 3305663 - DNA, 21 bp, Homo sapiens
agacgtttttgtgctgtgggc

SEQ ID NO: 3305664 - DNA, 17 bp, Homo sapiens
agactaagaaatattcc

SEQ ID NO: 3305665 - DNA, 14 bp, Homo sapiens
agactaagccctgt

SEQ ID NO: 3305666 - DNA, 23 bp, Homo sapiens
agactaagccctgtcgagacact

SEQ ID NO: 3305667 - DNA, 14 bp, Homo sapiens
agactaatttaaaa

SEQ ID NO: 3305668 - DNA, 15 bp, Homo sapiens
agactaatttaaaaa

SEQ ID NO: 3305669 - DNA, 13 bp, Homo sapiens
agactactcaata

SEQ ID NO: 3305670 - DNA, 12 bp, Homo sapiens
agactagagaaa

SEQ ID NO: 3305671 - DNA, 13 bp, Homo sapiens
agactagatgtag

SEQ ID NO: 3305672 - DNA, 14 bp, Homo sapiens
agactagatgtagt

SEQ ID NO: 3305673 - DNA, 21 bp, Homo sapiens
agactagtgccgtagggagta

SEQ ID NO: 3305674 - DNA, 14 bp, Homo sapiens
agactatatacatg

SEQ ID NO: 3305675 - DNA, 15 bp, Homo sapiens
agactatatacatgt

SEQ ID NO: 3305676 - DNA, 13 bp, Homo sapiens
agactatggcctc

SEQ ID NO: 3305677 - DNA, 18 bp, Homo sapiens
agactatggcctcgcctc

SEQ ID NO: 3305678 - DNA, 19 bp, Homo sapiens
agactatttaaacttataa

SEQ ID NO: 3305679 - DNA, 22 bp, Homo sapiens
agactatttaaacttataaatc

SEQ ID NO: 3305680 - DNA, 14 bp, Homo sapiens
agactcacaggaag

SEQ ID NO: 3305681 - DNA, 22 bp, Homo sapiens
agactcacaggaaggaggagcc

SEQ ID NO: 3305682 - DNA, 20 bp, Homo sapiens
agactcagatgaggacagag

SEQ ID NO: 3305683 - DNA, 11 bp, Homo sapiens
agactcagcca

SEQ ID NO: 3305684 - DNA, 20 bp, Homo sapiens
agactcaggccaagaaacgt

SEQ ID NO: 3305685 - DNA, 23 bp, Homo sapiens
agactcaggccaagaaacgtctt

SEQ ID NO: 3305686 - DNA, 13 bp, Homo sapiens
agactcagtgttc

SEQ ID NO: 3305687 - DNA, 12 bp, Homo sapiens
agactcagtttg

SEQ ID NO: 3305688 - DNA, 15 bp, Homo sapiens
agactcagtttgtca

SEQ ID NO: 3305689 - DNA, 16 bp, Homo sapiens
agactcagtttgtcag

SEQ ID NO: 3305690 - DNA, 21 bp, Homo sapiens
agactcagtttgtcagacttt

SEQ ID NO: 3305691 - DNA, 19 bp, Homo sapiens
agactccagaatctgctgt

SEQ ID NO: 3305692 - DNA, 14 bp, Homo sapiens
agactccgccctcc

SEQ ID NO: 3305693 - DNA, 14 bp, Homo sapiens
agactcctctgggc

SEQ ID NO: 3305694 - DNA, 19 bp, Homo sapiens
agactcctctgggcctggg

SEQ ID NO: 3305695 - DNA, 16 bp, Homo sapiens
agactcctgccctgtt

SEQ ID NO: 3305696 - DNA, 17 bp, Homo sapiens
agactcctggtctgtga

SEQ ID NO: 3305697 - DNA, 19 bp, Homo sapiens
agactctagagtccaaggt

SEQ ID NO: 3305698 - DNA, 20 bp, Homo sapiens
agactctagagtccaaggtt

SEQ ID NO: 3305699 - DNA, 21 bp, Homo sapiens
agactctaggacataaattag

SEQ ID NO: 3305700 - DNA, 16 bp, Homo sapiens
agactctgtggggcct

SEQ ID NO: 3305701 - DNA, 20 bp, Homo sapiens
agactctttaataaattgct

SEQ ID NO: 3305702 - DNA, 18 bp, Homo sapiens
agactctttagagcagct

SEQ ID NO: 3305703 - DNA, 23 bp, Homo sapiens
agactgaaaatatataagctcag

SEQ ID NO: 3305704 - DNA, 17 bp, Homo sapiens
agactgaaagcagcagc

SEQ ID NO: 3305705 - DNA, 18 bp, Homo sapiens
agactgaaagcagcagct

SEQ ID NO: 3305706 - DNA, 19 bp, Homo sapiens
agactgacaacctcatcca

SEQ ID NO: 3305707 - DNA, 13 bp, Homo sapiens
agactgagcagcc

SEQ ID NO: 3305708 - DNA, 15 bp, Homo sapiens
agactgagcagccgc

SEQ ID NO: 3305709 - DNA, 17 bp, Homo sapiens
agactgagcagccgcca

SEQ ID NO: 3305710 - DNA, 13 bp, Homo sapiens
agactgatccaaa

SEQ ID NO: 3305711 - DNA, 21 bp, Homo sapiens
agactgcagaggggaaagact

SEQ ID NO: 3305712 - DNA, 18 bp, Homo sapiens
agactgcaggttggaccc

SEQ ID NO: 3305713 - DNA, 22 bp, Homo sapiens
agactgcgggatggtcctgggg

SEQ ID NO: 3305714 - DNA, 19 bp, Homo sapiens
agactgctgggactggcca

SEQ ID NO: 3305715 - DNA, 21 bp, Homo sapiens
agactgcttcccatcctaccc

SEQ ID NO: 3305716 - DNA, 19 bp, Homo sapiens
agactggaagcacagcttc

SEQ ID NO: 3305717 - DNA, 20 bp, Homo sapiens
agactggaagctaatttgca

SEQ ID NO: 3305718 - DNA, 14 bp, Homo sapiens
agactggagtgagg

SEQ ID NO: 3305719 - DNA, 16 bp, Homo sapiens
agactggagtgaggct

SEQ ID NO: 3305720 - DNA, 19 bp, Homo sapiens
agactggagtgaggcttcc

SEQ ID NO: 3305721 - DNA, 11 bp, Homo sapiens
agactggcagg

SEQ ID NO: 3305722 - DNA, 16 bp, Homo sapiens
agactggccgggcagg

SEQ ID NO: 3305723 - DNA, 17 bp, Homo sapiens
agactggccgggcaggc

SEQ ID NO: 3305724 - DNA, 21 bp, Homo sapiens
agactgggaagataggctctg

SEQ ID NO: 3305725 - DNA, 22 bp, Homo sapiens
agactgggaagataggctctgc

SEQ ID NO: 3305726 - DNA, 17 bp, Homo sapiens
agactgggagccacttc

SEQ ID NO: 3305727 - DNA, 18 bp, Homo sapiens
agactggggtggcctcaa

SEQ ID NO: 3305728 - DNA, 19 bp, Homo sapiens
agactggggtggcctcaag

SEQ ID NO: 3305729 - DNA, 15 bp, Homo sapiens
agactggtcctgtgt

SEQ ID NO: 3305730 - DNA, 17 bp, Homo sapiens
agactggtcctgtgtgc

SEQ ID NO: 3305731 - DNA, 15 bp, Homo sapiens
agactgtaagatgtt

SEQ ID NO: 3305732 - DNA, 17 bp, Homo sapiens
agactgtaattaagtaa

SEQ ID NO: 3305733 - DNA, 21 bp, Homo sapiens
agactgtactggccagtgtca

SEQ ID NO: 3305734 - DNA, 20 bp, Homo sapiens
agactgtaggaagagtagca

SEQ ID NO: 3305735 - DNA, 18 bp, Homo sapiens
agactgtaggattcaagt

SEQ ID NO: 3305736 - DNA, 21 bp, Homo sapiens
agactgtcagcttccaaacat

SEQ ID NO: 3305737 - DNA, 14 bp, Homo sapiens
agactgtctcaaga

SEQ ID NO: 3305738 - DNA, 18 bp, Homo sapiens
agaggacagtctggagaa

SEQ ID NO: 3305739 - DNA, 19 bp, Homo sapiens
agaggacagtggattgttt

SEQ ID NO: 3305740 - DNA, 14 bp, Homo sapiens
agaggaccacagtg

SEQ ID NO: 3305741 - DNA, 17 bp, Homo sapiens
agaggacgcacgctcgc

SEQ ID NO: 3305742 - DNA, 21 bp, Homo sapiens
agaggacgcacgctcgctgcc

SEQ ID NO: 3305743 - DNA, 22 bp, Homo sapiens
agaggacgcacgctcgctgcca

SEQ ID NO: 3305744 - DNA, 17 bp, Homo sapiens
agaggactcgcttgtaa

SEQ ID NO: 3305745 - DNA, 23 bp, Homo sapiens
agaggactcgcttgtaaatacca

SEQ ID NO: 3305746 - DNA, 14 bp, Homo sapiens
agaggagaaacaca

SEQ ID NO: 3305747 - DNA, 11 bp, Homo sapiens
agaggagaaga

SEQ ID NO: 3305748 - DNA, 15 bp, Homo sapiens
agaggagaagagaca

SEQ ID NO: 3305749 - DNA, 13 bp, Homo sapiens
agaggagaccctg

SEQ ID NO: 3305750 - DNA, 14 bp, Homo sapiens
agaggagaccctgg

SEQ ID NO: 3305751 - DNA, 17 bp, Homo sapiens
agaggagagaggcagag

SEQ ID NO: 3305752 - DNA, 12 bp, Homo sapiens
agaggagaggag

SEQ ID NO: 3305753 - DNA, 13 bp, Homo sapiens
agaggagcacctg

SEQ ID NO: 3305754 - DNA, 20 bp, Homo sapiens
agaggagctctaccctgctc

SEQ ID NO: 3305755 - DNA, 19 bp, Homo sapiens
agaggagtgattgaaccag

SEQ ID NO: 3305756 - DNA, 22 bp, Homo sapiens
agaggagtgattgaaccagctc

SEQ ID NO: 3305757 - DNA, 22 bp, Homo sapiens
agaggatgaaggctgtgaaaaa

SEQ ID NO: 3305758 - DNA, 13 bp, Homo sapiens
agaggatgagagc

SEQ ID NO: 3305759 - DNA, 14 bp, Homo sapiens
agaggatgagagcc

SEQ ID NO: 3305760 - DNA, 22 bp, Homo sapiens
agaggatgagagcccagaggta

SEQ ID NO: 3305761 - DNA, 15 bp, Homo sapiens
agaggatggccagtg

SEQ ID NO: 3305762 - DNA, 19 bp, Homo sapiens
agaggatgtctcaaacttc

SEQ ID NO: 3305763 - DNA, 18 bp, Homo sapiens
agaggatttttttctgag

SEQ ID NO: 3305764 - DNA, 17 bp, Homo sapiens
agaggcagcatgcttgg

SEQ ID NO: 3305765 - DNA, 19 bp, Homo sapiens
agaggcagcatgcttgggc

SEQ ID NO: 3305766 - DNA, 22 bp, Homo sapiens
agaggcagcttcaagtgccttt

SEQ ID NO: 3305767 - DNA, 13 bp, Homo sapiens
agaggcagggtct

SEQ ID NO: 3305768 - DNA, 16 bp, Homo sapiens
agaggcatcctgcctg

SEQ ID NO: 3305769 - DNA, 21 bp, Homo sapiens
agaggccagccccacccagga

SEQ ID NO: 3305770 - DNA, 23 bp, Homo sapiens
agaggccagccccacccaggagg

SEQ ID NO: 3305771 - DNA, 13 bp, Homo sapiens
agaggccctggag

SEQ ID NO: 3305772 - DNA, 20 bp, Homo sapiens
agaggcctcatgcctgctga

SEQ ID NO: 3305773 - DNA, 14 bp, Homo sapiens
agaggcctggagcc

SEQ ID NO: 3305774 - DNA, 15 bp, Homo sapiens
agaggcctggagccc

SEQ ID NO: 3305775 - DNA, 14 bp, Homo sapiens
agaggccttttgtt

SEQ ID NO: 3305776 - DNA, 15 bp, Homo sapiens
agaggcgagaggtga

SEQ ID NO: 3305777 - DNA, 15 bp, Homo sapiens
agaggcgggccagcc

SEQ ID NO: 3305778 - DNA, 16 bp, Homo sapiens
agaggcgggccagcca

SEQ ID NO: 3305779 - DNA, 16 bp, Homo sapiens
agaggctaagatgaga

SEQ ID NO: 3305780 - DNA, 19 bp, Homo sapiens
agaggctagcttctgcttt

SEQ ID NO: 3305781 - DNA, 19 bp, Homo sapiens
agaggctgaggcctggact

SEQ ID NO: 3305782 - DNA, 18 bp, Homo sapiens
agaggctgcccctctcac

SEQ ID NO: 3305783 - DNA, 19 bp, Homo sapiens
agaggctgcccctctcacc

SEQ ID NO: 3305784 - DNA, 17 bp, Homo sapiens
agaggctgggagcatag

SEQ ID NO: 3305785 - DNA, 19 bp, Homo sapiens
agaggcttctccgccagcc

SEQ ID NO: 3305786 - DNA, 23 bp, Homo sapiens
agaggcttctccgccagcctcct

SEQ ID NO: 3305787 - DNA, 14 bp, Homo sapiens
agaggcttctcctg

SEQ ID NO: 3305788 - DNA, 14 bp, Homo sapiens
agaggcttgtttac

SEQ ID NO: 3305789 - DNA, 19 bp, Homo sapiens
agaggcttgtttacctttc

SEQ ID NO: 3305790 - DNA, 15 bp, Homo sapiens
agagggacaggcact

SEQ ID NO: 3305791 - DNA, 17 bp, Homo sapiens
agagggacaggcactcc

SEQ ID NO: 3305792 - DNA, 14 bp, Homo sapiens
agagggaccatgtg

SEQ ID NO: 3305793 - DNA, 16 bp, Homo sapiens
agagggagctggaacc

SEQ ID NO: 3305794 - DNA, 14 bp, Homo sapiens
agagggaggtgttt

SEQ ID NO: 3305795 - DNA, 20 bp, Homo sapiens
agagggcagtacctgggaaa

SEQ ID NO: 3305796 - DNA, 14 bp, Homo sapiens
agagggcccagccc

SEQ ID NO: 3305797 - DNA, 16 bp, Homo sapiens
agagggcccagctgta

SEQ ID NO: 3305798 - DNA, 20 bp, Homo sapiens
agagggcccagctgtagcca

SEQ ID NO: 3305799 - DNA, 16 bp, Homo sapiens
agagggcccaggcagg

SEQ ID NO: 3305800 - DNA, 17 bp, Homo sapiens
agagggcccaggcaggc

SEQ ID NO: 3305801 - DNA, 21 bp, Homo sapiens
agagggcccaggcaggccacc

SEQ ID NO: 3305802 - DNA, 12 bp, Homo sapiens
agagggctggag

SEQ ID NO: 3305803 - DNA, 12 bp, Homo sapiens
agagggcttcct

SEQ ID NO: 3305804 - DNA, 22 bp, Homo sapiens
agagggcttcctctagaagcca

SEQ ID NO: 3305805 - DNA, 19 bp, Homo sapiens
agaggggaataatagaaga

SEQ ID NO: 3305806 - DNA, 15 bp, Homo sapiens
agaggggcagccctt

SEQ ID NO: 3305807 - DNA, 16 bp, Homo sapiens
agaggggcagcccttg

SEQ ID NO: 3305808 - DNA, 15 bp, Homo sapiens
agaggggcagccgct

SEQ ID NO: 3305809 - DNA, 23 bp, Homo sapiens
agaggggcagccgctaggagaga

SEQ ID NO: 3305810 - DNA, 16 bp, Homo sapiens
agaggggccaggccca

SEQ ID NO: 3305811 - DNA, 20 bp, Homo sapiens
agaggggccaggcccaggca

SEQ ID NO: 3305812 - DNA, 21 bp, Homo sapiens
agaggggccaggcccaggcag

SEQ ID NO: 3305813 - DNA, 23 bp, Homo sapiens
agaggggccaggcccaggcagag

SEQ ID NO: 3305814 - DNA, 12 bp, Homo sapiens
agaggggctggg

SEQ ID NO: 3305815 - DNA, 14 bp, Homo sapiens
agagggggctctcc

SEQ ID NO: 3305816 - DNA, 15 bp, Homo sapiens
agagggggctctcca

SEQ ID NO: 3305817 - DNA, 12 bp, Homo sapiens
agagggggtgga

SEQ ID NO: 3305818 - DNA, 19 bp, Homo sapiens
agagggggtggaggggtgt

SEQ ID NO: 3305819 - DNA, 15 bp, Homo sapiens
agaggggtgcaccca

SEQ ID NO: 3305820 - DNA, 16 bp, Homo sapiens
agagggtatttttgta

SEQ ID NO: 3305821 - DNA, 20 bp, Homo sapiens
agagggtctgaggaatccag

SEQ ID NO: 3305822 - DNA, 22 bp, Homo sapiens
agagggtggtgacctctgcctg

SEQ ID NO: 3305823 - DNA, 23 bp, Homo sapiens
agagggtggtgacctctgcctga

SEQ ID NO: 3305824 - DNA, 14 bp, Homo sapiens
agaggtcagactaa

SEQ ID NO: 3305825 - DNA, 12 bp, Homo sapiens
agaggtccagcc

SEQ ID NO: 3305826 - DNA, 14 bp, Homo sapiens
agaggtccagccca

SEQ ID NO: 3305827 - DNA, 17 bp, Homo sapiens
agaggtcctctggagcc

SEQ ID NO: 3305828 - DNA, 18 bp, Homo sapiens
agaggtcctctggagccc

SEQ ID NO: 3305829 - DNA, 22 bp, Homo sapiens
agaggtctctgccggctctttc

SEQ ID NO: 3305830 - DNA, 16 bp, Homo sapiens
agaggtctgagccctg

SEQ ID NO: 3305831 - DNA, 21 bp, Homo sapiens
agaggtctgagccctggtgtg

SEQ ID NO: 3305832 - DNA, 18 bp, Homo sapiens
agaggtgaaaatgaagaa

SEQ ID NO: 3305833 - DNA, 15 bp, Homo sapiens
agaggtggaaaaaca

SEQ ID NO: 3305834 - DNA, 20 bp, Homo sapiens
agaggtgggatcctccctca

SEQ ID NO: 3305835 - DNA, 15 bp, Homo sapiens
agaggtgggcagctg

SEQ ID NO: 3305836 - DNA, 21 bp, Homo sapiens
agaggtgtacactaacatttc

SEQ ID NO: 3305837 - DNA, 16 bp, Homo sapiens
agaggtgttatttgga

SEQ ID NO: 3305838 - DNA, 20 bp, Homo sapiens
agaggttaaggtgggtccag

SEQ ID NO: 3305839 - DNA, 18 bp, Homo sapiens
agaggttatctgcctggc

SEQ ID NO: 3305840 - DNA, 19 bp, Homo sapiens
agaggttatctgcctggcc

SEQ ID NO: 3305841 - DNA, 22 bp, Homo sapiens
agaggttatctgcctggcctgg

SEQ ID NO: 3305842 - DNA, 18 bp, Homo sapiens
agaggttttaaagtgatt

SEQ ID NO: 3305843 - DNA, 12 bp, Homo sapiens
agaggttttgtt

SEQ ID NO: 3305844 - DNA, 20 bp, Homo sapiens
agagtaactttactctgtgt

SEQ ID NO: 3305845 - DNA, 13 bp, Homo sapiens
agagtagaaataa

SEQ ID NO: 3305846 - DNA, 16 bp, Homo sapiens
agagtagaattgcatt

SEQ ID NO: 3305847 - DNA, 18 bp, Homo sapiens
agagtagaattgcattga

SEQ ID NO: 3305848 - DNA, 21 bp, Homo sapiens
agagtagatggtgaaatttat

SEQ ID NO: 3305849 - DNA, 22 bp, Homo sapiens
agagtagatggtgaaatttatt

SEQ ID NO: 3305850 - DNA, 18 bp, Homo sapiens
agagtagcatttcattct

SEQ ID NO: 3305851 - DNA, 18 bp, Homo sapiens
agagtatattatgtattt

SEQ ID NO: 3305852 - DNA, 17 bp, Homo sapiens
agagtatccttccttca

SEQ ID NO: 3305853 - DNA, 16 bp, Homo sapiens
agagtcagaggagaag

SEQ ID NO: 3305854 - DNA, 18 bp, Homo sapiens
agagtcatctccatcagc

SEQ ID NO: 3305855 - DNA, 16 bp, Homo sapiens
agagtcatgtgagcct

SEQ ID NO: 3305856 - DNA, 23 bp, Homo sapiens
agagtcatgtgagcctcgtgtca

SEQ ID NO: 3305857 - DNA, 19 bp, Homo sapiens
agagtccaaggtttaaaga

SEQ ID NO: 3305858 - DNA, 21 bp, Homo sapiens
agagtcccactgcctcaggtt

SEQ ID NO: 3305859 - DNA, 13 bp, Homo sapiens
agagtcctcactc

SEQ ID NO: 3305860 - DNA, 14 bp, Homo sapiens
agagtcctcactcc

SEQ ID NO: 3305861 - DNA, 17 bp, Homo sapiens
agagtcctcattataaa

SEQ ID NO: 3305862 - DNA, 11 bp, Homo sapiens
agagtctagat

SEQ ID NO: 3305863 - DNA, 13 bp, Homo sapiens
agagtctagattc

SEQ ID NO: 3305864 - DNA, 21 bp, Homo sapiens
agatgtgcttctgaaccgcaa

SEQ ID NO: 3305865 - DNA, 23 bp, Homo sapiens
agatgtggcaaagtgctgtaccc

SEQ ID NO: 3305866 - DNA, 15 bp, Homo sapiens
agatgttaaaataaa

SEQ ID NO: 3305867 - DNA, 17 bp, Homo sapiens
agatgttaaaataaatg

SEQ ID NO: 3305868 - DNA, 21 bp, Homo sapiens
agatgttgaagaatacagtta

SEQ ID NO: 3305869 - DNA, 16 bp, Homo sapiens
agatgttgtcttggct

SEQ ID NO: 3305870 - DNA, 13 bp, Homo sapiens
agatgttgtttta

SEQ ID NO: 3305871 - DNA, 19 bp, Homo sapiens
agatgttgttttaggggct

SEQ ID NO: 3305872 - DNA, 18 bp, Homo sapiens
agatgtttaacaaatcta

SEQ ID NO: 3305873 - DNA, 19 bp, Homo sapiens
agatgtttactcattgccc

SEQ ID NO: 3305874 - DNA, 22 bp, Homo sapiens
agatgtttattcttctagagtt

SEQ ID NO: 3305875 - DNA, 15 bp, Homo sapiens
agatgtttgtcagat

SEQ ID NO: 3305876 - DNA, 24 bp, Homo sapiens
agatgtttgtcagatatgatatgt

SEQ ID NO: 3305877 - DNA, 16 bp, Homo sapiens
agatgtttttaaaagt

SEQ ID NO: 3305878 - DNA, 17 bp, Homo sapiens
agattaaatatagatta

SEQ ID NO: 3305879 - DNA, 18 bp, Homo sapiens
agattaaattacagcttt

SEQ ID NO: 3305880 - DNA, 20 bp, Homo sapiens
agattaaattacagctttta

SEQ ID NO: 3305881 - DNA, 21 bp, Homo sapiens
agattaaattacagcttttat

SEQ ID NO: 3305882 - DNA, 17 bp, Homo sapiens
agattaatggcactgat

SEQ ID NO: 3305883 - DNA, 17 bp, Homo sapiens
agattacaggaatgaag

SEQ ID NO: 3305884 - DNA, 19 bp, Homo sapiens
agattacaggaatgaagaa

SEQ ID NO: 3305885 - DNA, 21 bp, Homo sapiens
agattacaggaatgaagaact

SEQ ID NO: 3305886 - DNA, 18 bp, Homo sapiens
agattactttgctgcctt

SEQ ID NO: 3305887 - DNA, 15 bp, Homo sapiens
agattagaacattta

SEQ ID NO: 3305888 - DNA, 18 bp, Homo sapiens
agattagagggaggtgtt

SEQ ID NO: 3305889 - DNA, 21 bp, Homo sapiens
agattagcaaggtcatttctt

SEQ ID NO: 3305890 - DNA, 15 bp, Homo sapiens
agattaggagaaaca

SEQ ID NO: 3305891 - DNA, 17 bp, Homo sapiens
agattaggagaaacaca

SEQ ID NO: 3305892 - DNA, 15 bp, Homo sapiens
agattatagattcta

SEQ ID NO: 3305893 - DNA, 17 bp, Homo sapiens
agattatagattctaaa

SEQ ID NO: 3305894 - DNA, 18 bp, Homo sapiens
agattatagattctaaag

SEQ ID NO: 3305895 - DNA, 19 bp, Homo sapiens
agattatagattctaaaga

SEQ ID NO: 3305896 - DNA, 20 bp, Homo sapiens
agattatgatgcatacagtt

SEQ ID NO: 3305897 - DNA, 14 bp, Homo sapiens
agattcaagttgtg

SEQ ID NO: 3305898 - DNA, 21 bp, Homo sapiens
agattcaagttgtgtctgaaa

SEQ ID NO: 3305899 - DNA, 22 bp, Homo sapiens
agattcacacctgactctgaaa

SEQ ID NO: 3305900 - DNA, 15 bp, Homo sapiens
agattcaggccagcc

SEQ ID NO: 3305901 - DNA, 17 bp, Homo sapiens
agattcaggccagccca

SEQ ID NO: 3305902 - DNA, 18 bp, Homo sapiens
agattcaggccagcccag

SEQ ID NO: 3305903 - DNA, 20 bp, Homo sapiens
agattcaggccagcccagcc

SEQ ID NO: 3305904 - DNA, 21 bp, Homo sapiens
agattcaggccagcccagcca

SEQ ID NO: 3305905 - DNA, 23 bp, Homo sapiens
agattcaggccagcccagccagg

SEQ ID NO: 3305906 - DNA, 19 bp, Homo sapiens
agattcatatttacttctt

SEQ ID NO: 3305907 - DNA, 22 bp, Homo sapiens
agattcatatttacttcttata

SEQ ID NO: 3305908 - DNA, 21 bp, Homo sapiens
agattccagagagtggctcct

SEQ ID NO: 3305909 - DNA, 22 bp, Homo sapiens
agattccagagagtggctcctc

SEQ ID NO: 3305910 - DNA, 23 bp, Homo sapiens
agattccattggtccaagattcc

SEQ ID NO: 3305911 - DNA, 18 bp, Homo sapiens
agattccggatcctaagc

SEQ ID NO: 3305912 - DNA, 23 bp, Homo sapiens
agattcctcttgcctctctcagg

SEQ ID NO: 3305913 - DNA, 17 bp, Homo sapiens
agattcctgggcctgtc

SEQ ID NO: 3305914 - DNA, 16 bp, Homo sapiens
agattcgctttccatg

SEQ ID NO: 3305915 - DNA, 15 bp, Homo sapiens
agattctaaagattc

SEQ ID NO: 3305916 - DNA, 16 bp, Homo sapiens
agattctaaagattct

SEQ ID NO: 3305917 - DNA, 18 bp, Homo sapiens
agattctaaagattctat

SEQ ID NO: 3305918 - DNA, 21 bp, Homo sapiens
agattctaaagattctatagt

SEQ ID NO: 3305919 - DNA, 13 bp, Homo sapiens
agattctaatgat

SEQ ID NO: 3305920 - DNA, 14 bp, Homo sapiens
agattctactcttg

SEQ ID NO: 3305921 - DNA, 22 bp, Homo sapiens
agattctatattattatatata

SEQ ID NO: 3305922 - DNA, 23 bp, Homo sapiens
agattctctggctgtaaggctct

SEQ ID NO: 3305923 - DNA, 18 bp, Homo sapiens
agattctctttaaaaaag

SEQ ID NO: 3305924 - DNA, 11 bp, Homo sapiens
agattctttta

SEQ ID NO: 3305925 - DNA, 20 bp, Homo sapiens
agattcttttaaattagaaa

SEQ ID NO: 3305926 - DNA, 19 bp, Homo sapiens
agattgactaactcaaata

SEQ ID NO: 3305927 - DNA, 13 bp, Homo sapiens
agattgagaaatg

SEQ ID NO: 3305928 - DNA, 13 bp, Homo sapiens
agattgagaagcc

SEQ ID NO: 3305929 - DNA, 17 bp, Homo sapiens
agattgagaaggagaga

SEQ ID NO: 3305930 - DNA, 22 bp, Homo sapiens
agattgagtaagatttacccag

SEQ ID NO: 3305931 - DNA, 16 bp, Homo sapiens
agattgcaacaggctg

SEQ ID NO: 3305932 - DNA, 20 bp, Homo sapiens
agattgcagaaaattctgtg

SEQ ID NO: 3305933 - DNA, 21 bp, Homo sapiens
agattgcagaaaattctgtgc

SEQ ID NO: 3305934 - DNA, 22 bp, Homo sapiens
agattgctgaaattttatatgc

SEQ ID NO: 3305935 - DNA, 15 bp, Homo sapiens
agattgcttctgtag

SEQ ID NO: 3305936 - DNA, 15 bp, Homo sapiens
agattggttttcctg

SEQ ID NO: 3305937 - DNA, 18 bp, Homo sapiens
agattgtgaatatttcca

SEQ ID NO: 3305938 - DNA, 21 bp, Homo sapiens
agattgtgtaacaattttaat

SEQ ID NO: 3305939 - DNA, 22 bp, Homo sapiens
agattgttgataggaactgtct

SEQ ID NO: 3305940 - DNA, 22 bp, Homo sapiens
agattgttttatcatgacatgt

SEQ ID NO: 3305941 - DNA, 13 bp, Homo sapiens
agatttaaatgca

SEQ ID NO: 3305942 - DNA, 19 bp, Homo sapiens
agatttaagcacaaacttt

SEQ ID NO: 3305943 - DNA, 21 bp, Homo sapiens
agatttacccagaatgtcaga

SEQ ID NO: 3305944 - DNA, 20 bp, Homo sapiens
agatttaggagcagaaatgc

SEQ ID NO: 3305945 - DNA, 17 bp, Homo sapiens
agatttatctttataca

SEQ ID NO: 3305946 - DNA, 18 bp, Homo sapiens
agatttatttttcagttc

SEQ ID NO: 3305947 - DNA, 20 bp, Homo sapiens
agatttatttttcagttcca

SEQ ID NO: 3305948 - DNA, 19 bp, Homo sapiens
agatttcatagttcagaat

SEQ ID NO: 3305949 - DNA, 22 bp, Homo sapiens
agatttctagttttttttctag

SEQ ID NO: 3305950 - DNA, 16 bp, Homo sapiens
agatttctcattgact

SEQ ID NO: 3305951 - DNA, 17 bp, Homo sapiens
agatttcttaaatcttt

SEQ ID NO: 3305952 - DNA, 20 bp, Homo sapiens
agatttcttaaatctttctt

SEQ ID NO: 3305953 - DNA, 22 bp, Homo sapiens
agatttcttaaatctttcttca

SEQ ID NO: 3305954 - DNA, 20 bp, Homo sapiens
agatttcttctctttagtat

SEQ ID NO: 3305955 - DNA, 17 bp, Homo sapiens
agatttgcccatttaca

SEQ ID NO: 3305956 - DNA, 17 bp, Homo sapiens
agatttggcatctcctg

SEQ ID NO: 3305957 - DNA, 17 bp, Homo sapiens
agatttgtaattacagg

SEQ ID NO: 3305958 - DNA, 21 bp, Homo sapiens
agatttgtccttttatttctc

SEQ ID NO: 3305959 - DNA, 17 bp, Homo sapiens
agattttaaaaagtctt

SEQ ID NO: 3305960 - DNA, 15 bp, Homo sapiens
agattttaatttatt

SEQ ID NO: 3305961 - DNA, 17 bp, Homo sapiens
agattttaattttgaat

SEQ ID NO: 3305962 - DNA, 21 bp, Homo sapiens
agattttaattttgaataaat

SEQ ID NO: 3305963 - DNA, 20 bp, Homo sapiens
agattttacaaaagatgtat

SEQ ID NO: 3305964 - DNA, 13 bp, Homo sapiens
agattttatttgt

SEQ ID NO: 3305965 - DNA, 21 bp, Homo sapiens
agattttatttgtaattttaa

SEQ ID NO: 3305966 - DNA, 19 bp, Homo sapiens
agattttcagcaaactctt

SEQ ID NO: 3305967 - DNA, 14 bp, Homo sapiens
agattttcagtcta

SEQ ID NO: 3305968 - DNA, 20 bp, Homo sapiens
agattttctattatggaaat

SEQ ID NO: 3305969 - DNA, 19 bp, Homo sapiens
agattttctggttctaaca

SEQ ID NO: 3305970 - DNA, 16 bp, Homo sapiens
agatttttaacgaatg

SEQ ID NO: 3305971 - DNA, 22 bp, Homo sapiens
agatttttctcaaagttttgaa

SEQ ID NO: 3305972 - DNA, 18 bp, Homo sapiens
agatttttttgtgtatgt

SEQ ID NO: 3305973 - DNA, 19 bp, Homo sapiens
agatttttttgtgtatgtt

SEQ ID NO: 3305974 - DNA, 23 bp, Homo sapiens
agcaaaaaaaaaaaaaagcatct

SEQ ID NO: 3305975 - DNA, 14 bp, Homo sapiens
agcaaaaacatgta

SEQ ID NO: 3305976 - DNA, 16 bp, Homo sapiens
agcaaaaatataaaat

SEQ ID NO: 3305977 - DNA, 13 bp, Homo sapiens
agcaaaaatctcc

SEQ ID NO: 3305978 - DNA, 16 bp, Homo sapiens
agcaaaaggcagctca

SEQ ID NO: 3305979 - DNA, 20 bp, Homo sapiens
agcaaaataaggaagagggc

SEQ ID NO: 3305980 - DNA, 13 bp, Homo sapiens
agcaaacagagga

SEQ ID NO: 3305981 - DNA, 11 bp, Homo sapiens
agcaaaccaat

SEQ ID NO: 3305982 - DNA, 20 bp, Homo sapiens
agcaaaccaatggtgatcct

SEQ ID NO: 3305983 - DNA, 17 bp, Homo sapiens
agcaaaccatttttaaa

SEQ ID NO: 3305984 - DNA, 18 bp, Homo sapiens
agcaaagaggactcgctt

SEQ ID NO: 3305985 - DNA, 23 bp, Homo sapiens
agcaaagattaaatgtgtcattg

SEQ ID NO: 3305986 - DNA, 23 bp, Homo sapiens
agcaaagctgatgacaacttccc

SEQ ID NO: 3305987 - DNA, 16 bp, Homo sapiens
agcaaatcagaaactt

SEQ ID NO: 3305988 - DNA, 14 bp, Homo sapiens
agcattaggctttt

SEQ ID NO: 3305989 - DNA, 16 bp, Homo sapiens
agcattatgcaattag

SEQ ID NO: 3305990 - DNA, 17 bp, Homo sapiens
agcattattcttcagaa

SEQ ID NO: 3305991 - DNA, 15 bp, Homo sapiens
agcattcagagagca

SEQ ID NO: 3305992 - DNA, 13 bp, Homo sapiens
agcattccagact

SEQ ID NO: 3305993 - DNA, 17 bp, Homo sapiens
agcattccagacttcaa

SEQ ID NO: 3305994 - DNA, 19 bp, Homo sapiens
agcattccagcccctctgg

SEQ ID NO: 3305995 - DNA, 15 bp, Homo sapiens
agcattccagtaact

SEQ ID NO: 3305996 - DNA, 14 bp, Homo sapiens
agcattccctccca

SEQ ID NO: 3305997 - DNA, 13 bp, Homo sapiens
agcattctcccca

SEQ ID NO: 3305998 - DNA, 19 bp, Homo sapiens
agcattctttggagttaaa

SEQ ID NO: 3305999 - DNA, 15 bp, Homo sapiens
agcattgaaattata

SEQ ID NO: 3306000 - DNA, 16 bp, Homo sapiens
agcattgataatcttc

SEQ ID NO: 3306001 - DNA, 17 bp, Homo sapiens
agcattgataatcttca

SEQ ID NO: 3306002 - DNA, 19 bp, Homo sapiens
agcattgataatcttcagg

SEQ ID NO: 3306003 - DNA, 20 bp, Homo sapiens
agcattgataatcttcaggt

SEQ ID NO: 3306004 - DNA, 14 bp, Homo sapiens
agcattgccattcc

SEQ ID NO: 3306005 - DNA, 22 bp, Homo sapiens
agcattgccattccctgcctgg

SEQ ID NO: 3306006 - DNA, 13 bp, Homo sapiens
agcattgcctggc

SEQ ID NO: 3306007 - DNA, 17 bp, Homo sapiens
agcattgcctggccttc

SEQ ID NO: 3306008 - DNA, 12 bp, Homo sapiens
agcattgctttc

SEQ ID NO: 3306009 - DNA, 15 bp, Homo sapiens
agcattgctttctga

SEQ ID NO: 3306010 - DNA, 17 bp, Homo sapiens
agcattgctttctgaaa

SEQ ID NO: 3306011 - DNA, 14 bp, Homo sapiens
agcattgtcttgtt

SEQ ID NO: 3306012 - DNA, 22 bp, Homo sapiens
agcattgtcttgttctgtccct

SEQ ID NO: 3306013 - DNA, 23 bp, Homo sapiens
agcattgtctttgctgtactctt

SEQ ID NO: 3306014 - DNA, 15 bp, Homo sapiens
agcattgtttgctta

SEQ ID NO: 3306015 - DNA, 21 bp, Homo sapiens
agcattgtttgcttattgttc

SEQ ID NO: 3306016 - DNA, 17 bp, Homo sapiens
agcatttaaagttgtat

SEQ ID NO: 3306017 - DNA, 12 bp, Homo sapiens
agcatttatcat

SEQ ID NO: 3306018 - DNA, 15 bp, Homo sapiens
agcatttatcattct

SEQ ID NO: 3306019 - DNA, 13 bp, Homo sapiens
agcatttatgttt

SEQ ID NO: 3306020 - DNA, 13 bp, Homo sapiens
agcatttcattct

SEQ ID NO: 3306021 - DNA, 14 bp, Homo sapiens
agcatttccaacac

SEQ ID NO: 3306022 - DNA, 23 bp, Homo sapiens
agcatttccaacaccacagacac

SEQ ID NO: 3306023 - DNA, 17 bp, Homo sapiens
agcattttaattctctc

SEQ ID NO: 3306024 - DNA, 11 bp, Homo sapiens
agcattttata

SEQ ID NO: 3306025 - DNA, 23 bp, Homo sapiens
agcatttttaagggagtggcctc

SEQ ID NO: 3306026 - DNA, 13 bp, Homo sapiens
agccaaacaaaac

SEQ ID NO: 3306027 - DNA, 14 bp, Homo sapiens
agccaaacaaaact

SEQ ID NO: 3306028 - DNA, 15 bp, Homo sapiens
agccaaacaagcctt

SEQ ID NO: 3306029 - DNA, 16 bp, Homo sapiens
agccaaaccctgtctg

SEQ ID NO: 3306030 - DNA, 13 bp, Homo sapiens
agccaaacccttg

SEQ ID NO: 3306031 - DNA, 19 bp, Homo sapiens
agccaaacccttgtcagtg

SEQ ID NO: 3306032 - DNA, 16 bp, Homo sapiens
agccaaagaaacaagc

SEQ ID NO: 3306033 - DNA, 17 bp, Homo sapiens
agccaaagaaacaagct

SEQ ID NO: 3306034 - DNA, 16 bp, Homo sapiens
agccaaagaaatgaac

SEQ ID NO: 3306035 - DNA, 17 bp, Homo sapiens
agccaaagaaatgaaca

SEQ ID NO: 3306036 - DNA, 19 bp, Homo sapiens
agccaaagctaggcctggc

SEQ ID NO: 3306037 - DNA, 14 bp, Homo sapiens
agccaaatgaaact

SEQ ID NO: 3306038 - DNA, 22 bp, Homo sapiens
agccaaatgcagggaggggagg

SEQ ID NO: 3306039 - DNA, 13 bp, Homo sapiens
agccaaatttaaa

SEQ ID NO: 3306040 - DNA, 14 bp, Homo sapiens
agccaaattttatc

SEQ ID NO: 3306041 - DNA, 23 bp, Homo sapiens
agccaacaccctgtctaaaaaac

SEQ ID NO: 3306042 - DNA, 20 bp, Homo sapiens
agccaacctcggcttgtggg

SEQ ID NO: 3306043 - DNA, 16 bp, Homo sapiens
agccaaccttcaaaga

SEQ ID NO: 3306044 - DNA, 14 bp, Homo sapiens
agccaactgctgct

SEQ ID NO: 3306045 - DNA, 18 bp, Homo sapiens
agccaactgtttccctgc

SEQ ID NO: 3306046 - DNA, 20 bp, Homo sapiens
agccaactgtttccctgctg

SEQ ID NO: 3306047 - DNA, 22 bp, Homo sapiens
agccaactgtttccctgctgaa

SEQ ID NO: 3306048 - DNA, 23 bp, Homo sapiens
agccaactgtttccctgctgaat

SEQ ID NO: 3306049 - DNA, 18 bp, Homo sapiens
agccaacttgtaaataca

SEQ ID NO: 3306050 - DNA, 19 bp, Homo sapiens
agccaagacaaggaggtag

SEQ ID NO: 3306051 - DNA, 20 bp, Homo sapiens
agccaagcaaaccaatggtg

SEQ ID NO: 3306052 - DNA, 23 bp, Homo sapiens
agccaagctccctggagccctgt

SEQ ID NO: 3306053 - DNA, 16 bp, Homo sapiens
agccaagctttaaatt

SEQ ID NO: 3306054 - DNA, 20 bp, Homo sapiens
agccaagctttaaattatgt

SEQ ID NO: 3306055 - DNA, 12 bp, Homo sapiens
agccaaggaggc

SEQ ID NO: 3306056 - DNA, 16 bp, Homo sapiens
agccaaggaggcctgg

SEQ ID NO: 3306057 - DNA, 20 bp, Homo sapiens
agccaagggaaaggggtgct

SEQ ID NO: 3306058 - DNA, 23 bp, Homo sapiens
agccaagggaaaggggtgctttt

SEQ ID NO: 3306059 - DNA, 21 bp, Homo sapiens
agccaagggaacctgtgtccg

SEQ ID NO: 3306060 - DNA, 16 bp, Homo sapiens
agccaagtcctccctc

SEQ ID NO: 3306061 - DNA, 16 bp, Homo sapiens
agccaagtggggtgct

SEQ ID NO: 3306062 - DNA, 13 bp, Homo sapiens
agccaatcccctc

SEQ ID NO: 3306063 - DNA, 14 bp, Homo sapiens
agccaatcccctcc

SEQ ID NO: 3306064 - DNA, 18 bp, Homo sapiens
agccaatcccctccttgg

SEQ ID NO: 3306065 - DNA, 23 bp, Homo sapiens
agccaatccctcaccttctgagt

SEQ ID NO: 3306066 - DNA, 19 bp, Homo sapiens
agccaatctacaatctctt

SEQ ID NO: 3306067 - DNA, 14 bp, Homo sapiens
agccaatgttttcc

SEQ ID NO: 3306068 - DNA, 19 bp, Homo sapiens
agccacaaaataaatgttg

SEQ ID NO: 3306069 - DNA, 17 bp, Homo sapiens
agccacaaatgccttga

SEQ ID NO: 3306070 - DNA, 15 bp, Homo sapiens
agccacaagtcttcc

SEQ ID NO: 3306071 - DNA, 17 bp, Homo sapiens
agccacacaaacgttta

SEQ ID NO: 3306072 - DNA, 15 bp, Homo sapiens
agccacacccaggca

SEQ ID NO: 3306073 - DNA, 19 bp, Homo sapiens
agccacagacccctgggag

SEQ ID NO: 3306074 - DNA, 15 bp, Homo sapiens
agccacatttggaat

SEQ ID NO: 3306075 - DNA, 21 bp, Homo sapiens
agccacatttggaatactttt

SEQ ID NO: 3306076 - DNA, 23 bp, Homo sapiens
agccacatttggaatactttttg

SEQ ID NO: 3306077 - DNA, 12 bp, Homo sapiens
agccaccaccca

SEQ ID NO: 3306078 - DNA, 14 bp, Homo sapiens
agccaccagttctc

SEQ ID NO: 3306079 - DNA, 14 bp, Homo sapiens
agccacccaagcct

SEQ ID NO: 3306080 - DNA, 17 bp, Homo sapiens
agccacccaagcctgct

SEQ ID NO: 3306081 - DNA, 19 bp, Homo sapiens
agccaccccgggctctctg

SEQ ID NO: 3306082 - DNA, 19 bp, Homo sapiens
agccacccgtggggtgctg

SEQ ID NO: 3306083 - DNA, 20 bp, Homo sapiens
agccaccgaagccgcctgtg

SEQ ID NO: 3306084 - DNA, 16 bp, Homo sapiens
agccaccgctgccagc

SEQ ID NO: 3306085 - DNA, 21 bp, Homo sapiens
agccacctaaacggttcagtt

SEQ ID NO: 3306086 - DNA, 12 bp, Homo sapiens
agccacctctcc

SEQ ID NO: 3306087 - DNA, 16 bp, Homo sapiens
agccacctctgtcatt

SEQ ID NO: 3306088 - DNA, 17 bp, Homo sapiens
agccacgaccagcccct

SEQ ID NO: 3306089 - DNA, 20 bp, Homo sapiens
agccacgaccagccccttcc

SEQ ID NO: 3306090 - DNA, 18 bp, Homo sapiens
agccacgctgtcctctcg

SEQ ID NO: 3306091 - DNA, 17 bp, Homo sapiens
agccacggccaggccag

SEQ ID NO: 3306092 - DNA, 14 bp, Homo sapiens
agccacgtgaatgg

SEQ ID NO: 3306093 - DNA, 20 bp, Homo sapiens
agccactcagtctcttccac

SEQ ID NO: 3306094 - DNA, 19 bp, Homo sapiens
agccactctcttccctttc

SEQ ID NO: 3306095 - DNA, 20 bp, Homo sapiens
agccactctcttccctttcc

SEQ ID NO: 3306096 - DNA, 15 bp, Homo sapiens
agccactgagcctgg

SEQ ID NO: 3306097 - DNA, 16 bp, Homo sapiens
agccactgagcctggc

SEQ ID NO: 3306098 - DNA, 19 bp, Homo sapiens
agccactgcaccgggccac

SEQ ID NO: 3306099 - DNA, 14 bp, Homo sapiens
agccacttccccct

SEQ ID NO: 3306100 - DNA, 16 bp, Homo sapiens
agccacttccccctct

SEQ ID NO: 3306101 - DNA, 17 bp, Homo sapiens
agccacttccccctctt

SEQ ID NO: 3306102 - DNA, 18 bp, Homo sapiens
agccacttctccccagaa

SEQ ID NO: 3306103 - DNA, 12 bp, Homo sapiens
agccagacagac

SEQ ID NO: 3306104 - DNA, 16 bp, Homo sapiens
agccagagatgcaata

SEQ ID NO: 3306105 - DNA, 12 bp, Homo sapiens
agccagagctgg

SEQ ID NO: 3306106 - DNA, 18 bp, Homo sapiens
agccagaggctgggttca

SEQ ID NO: 3306107 - DNA, 14 bp, Homo sapiens
agccagattctctt

SEQ ID NO: 3306108 - DNA, 16 bp, Homo sapiens
agccagattctcttga

SEQ ID NO: 3306109 - DNA, 17 bp, Homo sapiens
agccagattctcttgaa

SEQ ID NO: 3306110 - DNA, 18 bp, Homo sapiens
agccagatttgtcttttt

SEQ ID NO: 3306111 - DNA, 23 bp, Homo sapiens
agccagcaatgatgtccagaaga

SEQ ID NO: 3306112 - DNA, 15 bp, Homo sapiens
agccagcacctggca

SEQ ID NO: 3306113 - DNA, 22 bp, Homo sapiens
agccagcagagggggagtagcc

SEQ ID NO: 3306114 - DNA, 9 bp, Homo sapiens
agccagcca

SEQ ID NO: 3306115 - DNA, 15 bp, Homo sapiens
aggatgagagcccag

SEQ ID NO: 3306116 - DNA, 16 bp, Homo sapiens
aggatgagagcccaga

SEQ ID NO: 3306117 - DNA, 19 bp, Homo sapiens
aggatgagagcccagaggt

SEQ ID NO: 3306118 - DNA, 20 bp, Homo sapiens
aggatgagagcccagaggta

SEQ ID NO: 3306119 - DNA, 18 bp, Homo sapiens
aggatgataagttccttt

SEQ ID NO: 3306120 - DNA, 16 bp, Homo sapiens
aggatgcaacaaatat

SEQ ID NO: 3306121 - DNA, 19 bp, Homo sapiens
aggatgcacatttctggat

SEQ ID NO: 3306122 - DNA, 15 bp, Homo sapiens
aggatgccagcccct

SEQ ID NO: 3306123 - DNA, 18 bp, Homo sapiens
aggatgccagcccctgcc

SEQ ID NO: 3306124 - DNA, 23 bp, Homo sapiens
aggatgctaacatctaaaaatag

SEQ ID NO: 3306125 - DNA, 18 bp, Homo sapiens
aggatgctctttcccttt

SEQ ID NO: 3306126 - DNA, 17 bp, Homo sapiens
aggatggagagagggga

SEQ ID NO: 3306127 - DNA, 17 bp, Homo sapiens
aggatggagccagctct

SEQ ID NO: 3306128 - DNA, 12 bp, Homo sapiens
aggatggcctgg

SEQ ID NO: 3306129 - DNA, 14 bp, Homo sapiens
aggatggcctggaa

SEQ ID NO: 3306130 - DNA, 20 bp, Homo sapiens
aggatggtctcgatctcctg

SEQ ID NO: 3306131 - DNA, 23 bp, Homo sapiens
aggatgtaggggttaacttggtc

SEQ ID NO: 3306132 - DNA, 18 bp, Homo sapiens
aggatgtcacagggccaa

SEQ ID NO: 3306133 - DNA, 22 bp, Homo sapiens
aggatgtccctgggccagggtc

SEQ ID NO: 3306134 - DNA, 23 bp, Homo sapiens
aggatgtccctgggccagggtct

SEQ ID NO: 3306135 - DNA, 21 bp, Homo sapiens
aggatgtgatatataagtgta

SEQ ID NO: 3306136 - DNA, 15 bp, Homo sapiens
aggatgtgtgcatgt

SEQ ID NO: 3306137 - DNA, 16 bp, Homo sapiens
aggatgtgtgcatgtg

SEQ ID NO: 3306138 - DNA, 16 bp, Homo sapiens
aggatgttctgggaca

SEQ ID NO: 3306139 - DNA, 15 bp, Homo sapiens
aggattaaaatggat

SEQ ID NO: 3306140 - DNA, 14 bp, Homo sapiens
aggattacagaaac

SEQ ID NO: 3306141 - DNA, 16 bp, Homo sapiens
aggattacatgcatgt

SEQ ID NO: 3306142 - DNA, 12 bp, Homo sapiens
aggattatggaa

SEQ ID NO: 3306143 - DNA, 18 bp, Homo sapiens
aggattattgatagtact

SEQ ID NO: 3306144 - DNA, 16 bp, Homo sapiens
aggattcagccggagg

SEQ ID NO: 3306145 - DNA, 15 bp, Homo sapiens
aggattcaggggctg

SEQ ID NO: 3306146 - DNA, 15 bp, Homo sapiens
aggattcccccagcc

SEQ ID NO: 3306147 - DNA, 12 bp, Homo sapiens
aggattctaaaa

SEQ ID NO: 3306148 - DNA, 15 bp, Homo sapiens
aggattgctactgtc

SEQ ID NO: 3306149 - DNA, 20 bp, Homo sapiens
aggatttaacagtcatttaa

SEQ ID NO: 3306150 - DNA, 18 bp, Homo sapiens
aggatttcttaaattttt

SEQ ID NO: 3306151 - DNA, 19 bp, Homo sapiens
aggattttgatccaagctg

SEQ ID NO: 3306152 - DNA, 16 bp, Homo sapiens
aggcaaaaaactctta

SEQ ID NO: 3306153 - DNA, 17 bp, Homo sapiens
aggcaaaattgcaaatc

SEQ ID NO: 3306154 - DNA, 17 bp, Homo sapiens
aggcaaatgtgtacatg

SEQ ID NO: 3306155 - DNA, 23 bp, Homo sapiens
aggcaaattaactgtatgtgtgt

SEQ ID NO: 3306156 - DNA, 13 bp, Homo sapiens
aggcaacaggatt

SEQ ID NO: 3306157 - DNA, 16 bp, Homo sapiens
aggcaacatccaaaat

SEQ ID NO: 3306158 - DNA, 17 bp, Homo sapiens
aggcaacttcagtcctg

SEQ ID NO: 3306159 - DNA, 14 bp, Homo sapiens
aggcaacttttaaa

SEQ ID NO: 3306160 - DNA, 15 bp, Homo sapiens
aggcaacttttaaag

SEQ ID NO: 3306161 - DNA, 15 bp, Homo sapiens
aggcaagaaaaggac

SEQ ID NO: 3306162 - DNA, 17 bp, Homo sapiens
aggcaagagggggtgga

SEQ ID NO: 3306163 - DNA, 21 bp, Homo sapiens
aggcaagagggggtggagggg

SEQ ID NO: 3306164 - DNA, 12 bp, Homo sapiens
aggcaagcagga

SEQ ID NO: 3306165 - DNA, 15 bp, Homo sapiens
aggcaagcaggacct

SEQ ID NO: 3306166 - DNA, 16 bp, Homo sapiens
aggcaagcccctcagc

SEQ ID NO: 3306167 - DNA, 17 bp, Homo sapiens
aggcaagcccctcagcc

SEQ ID NO: 3306168 - DNA, 20 bp, Homo sapiens
aggcaagcccctcagccctt

SEQ ID NO: 3306169 - DNA, 13 bp, Homo sapiens
aggcaagcccttc

SEQ ID NO: 3306170 - DNA, 21 bp, Homo sapiens
aggcaagcccttcggtcacct

SEQ ID NO: 3306171 - DNA, 15 bp, Homo sapiens
aggcaagctgaaatt

SEQ ID NO: 3306172 - DNA, 14 bp, Homo sapiens
aggcaaggcaggtg

SEQ ID NO: 3306173 - DNA, 18 bp, Homo sapiens
aggcaaggctatgtgatt

SEQ ID NO: 3306174 - DNA, 15 bp, Homo sapiens
aggcaagtttctagc

SEQ ID NO: 3306175 - DNA, 21 bp, Homo sapiens
aggcaattagacactttggaa

SEQ ID NO: 3306176 - DNA, 11 bp, Homo sapiens
aggcacacagc

SEQ ID NO: 3306177 - DNA, 15 bp, Homo sapiens
aggcacacagcagcc

SEQ ID NO: 3306178 - DNA, 20 bp, Homo sapiens
aggcacacagcagcccccca

SEQ ID NO: 3306179 - DNA, 21 bp, Homo sapiens
aggcacacagcagccccccag

SEQ ID NO: 3306180 - DNA, 13 bp, Homo sapiens
aggcacacagcta

SEQ ID NO: 3306181 - DNA, 15 bp, Homo sapiens
aggcacacagggccc

SEQ ID NO: 3306182 - DNA, 17 bp, Homo sapiens
aggcacagggcccgcag

SEQ ID NO: 3306183 - DNA, 14 bp, Homo sapiens
aggcacagtgggag

SEQ ID NO: 3306184 - DNA, 15 bp, Homo sapiens
aggcacagtgggagc

SEQ ID NO: 3306185 - DNA, 18 bp, Homo sapiens
aggcacagtgggagctga

SEQ ID NO: 3306186 - DNA, 20 bp, Homo sapiens
aggcacagtgggagctgagc

SEQ ID NO: 3306187 - DNA, 21 bp, Homo sapiens
aggcacagtgggagctgagct

SEQ ID NO: 3306188 - DNA, 23 bp, Homo sapiens
aggcacagtgggagctgagctgg

SEQ ID NO: 3306189 - DNA, 16 bp, Homo sapiens
aggcaccagcatccac

SEQ ID NO: 3306190 - DNA, 14 bp, Homo sapiens
aggcaccagctctg

SEQ ID NO: 3306191 - DNA, 15 bp, Homo sapiens
aggcaccagctctgt

SEQ ID NO: 3306192 - DNA, 16 bp, Homo sapiens
aggcaccagctctgtg

SEQ ID NO: 3306193 - DNA, 22 bp, Homo sapiens
aggcacccaccatcatgtctgg

SEQ ID NO: 3306194 - DNA, 23 bp, Homo sapiens
aggcacccggggccagagacata

SEQ ID NO: 3306195 - DNA, 15 bp, Homo sapiens
aggcaccgagaatgt

SEQ ID NO: 3306196 - DNA, 21 bp, Homo sapiens
aggcaccgccacgtcccagca

SEQ ID NO: 3306197 - DNA, 22 bp, Homo sapiens
aggcaccgccacgtcccagcat

SEQ ID NO: 3306198 - DNA, 20 bp, Homo sapiens
aggcacctcacaggccccag

SEQ ID NO: 3306199 - DNA, 13 bp, Homo sapiens
aggcacctcttcc

SEQ ID NO: 3306200 - DNA, 14 bp, Homo sapiens
aggcacctggcctg

SEQ ID NO: 3306201 - DNA, 16 bp, Homo sapiens
aggcacctggcctgct

SEQ ID NO: 3306202 - DNA, 17 bp, Homo sapiens
aggcacgggtggtcccc

SEQ ID NO: 3306203 - DNA, 15 bp, Homo sapiens
aggcactagcctttg

SEQ ID NO: 3306204 - DNA, 16 bp, Homo sapiens
aggcactccaaacctg

SEQ ID NO: 3306205 - DNA, 17 bp, Homo sapiens
aggcactctagattcca

SEQ ID NO: 3306206 - DNA, 16 bp, Homo sapiens
aggcactctgttattt

SEQ ID NO: 3306207 - DNA, 15 bp, Homo sapiens
aggcactgccttctc

SEQ ID NO: 3306208 - DNA, 15 bp, Homo sapiens
aggcactggtggcat

SEQ ID NO: 3306209 - DNA, 16 bp, Homo sapiens
aggcactgtactaggc

SEQ ID NO: 3306210 - DNA, 17 bp, Homo sapiens
aggcactgtagttctaa

SEQ ID NO: 3306211 - DNA, 16 bp, Homo sapiens
aggcacttaagcacaa

SEQ ID NO: 3306212 - DNA, 15 bp, Homo sapiens
aggcagacagcaggc

SEQ ID NO: 3306213 - DNA, 14 bp, Homo sapiens
aggcagagaaatct

SEQ ID NO: 3306214 - DNA, 11 bp, Homo sapiens
aggcagagagc

SEQ ID NO: 3306215 - DNA, 22 bp, Homo sapiens
aggcagagctgacgggaggccc

SEQ ID NO: 3306216 - DNA, 23 bp, Homo sapiens
aggcagatctgtgccccatgcct

SEQ ID NO: 3306217 - DNA, 17 bp, Homo sapiens
aggcagattgaaaagga

SEQ ID NO: 3306218 - DNA, 20 bp, Homo sapiens
aggcagcatgcttgggctga

SEQ ID NO: 3306219 - DNA, 11 bp, Homo sapiens
aggcagcatgg

SEQ ID NO: 3306220 - DNA, 12 bp, Homo sapiens
aggcagccccct

SEQ ID NO: 3306221 - DNA, 16 bp, Homo sapiens
aggcagccccctccac

SEQ ID NO: 3306222 - DNA, 17 bp, Homo sapiens
aggcagccccctccaca

SEQ ID NO: 3306223 - DNA, 13 bp, Homo sapiens
aggcagccgccct

SEQ ID NO: 3306224 - DNA, 12 bp, Homo sapiens
aggcagcctcca

SEQ ID NO: 3306225 - DNA, 18 bp, Homo sapiens
aggcagcctccagagcca

SEQ ID NO: 3306226 - DNA, 20 bp, Homo sapiens
aggcagcctccagagccagc

SEQ ID NO: 3306227 - DNA, 21 bp, Homo sapiens
aggcagcctccagagccagcc

SEQ ID NO: 3306228 - DNA, 22 bp, Homo sapiens
aggcagcctccagagccagcct

SEQ ID NO: 3306229 - DNA, 16 bp, Homo sapiens
aggcagcctccagcct

SEQ ID NO: 3306230 - DNA, 21 bp, Homo sapiens
aggcagcctccagcctgccca

SEQ ID NO: 3306231 - DNA, 14 bp, Homo sapiens
aggcagcgccaagc

SEQ ID NO: 3306232 - DNA, 12 bp, Homo sapiens
aggcagctcacc

SEQ ID NO: 3306233 - DNA, 20 bp, Homo sapiens
aggcagctcacccctgggca

SEQ ID NO: 3306234 - DNA, 12 bp, Homo sapiens
aggcagctgcct

SEQ ID NO: 3306235 - DNA, 14 bp, Homo sapiens
aggcagctgcctct

SEQ ID NO: 3306236 - DNA, 18 bp, Homo sapiens
aggcagctgcctctgctc

SEQ ID NO: 3306237 - DNA, 17 bp, Homo sapiens
aggcagctgcctgctct

SEQ ID NO: 3306238 - DNA, 18 bp, Homo sapiens
aggcagcttcaagtgcct

SEQ ID NO: 3306239 - DNA, 20 bp, Homo sapiens
aggcagcttcaagtgccttt

SEQ ID NO: 3306240 - DNA, 19 bp, Homo sapiens
aggcaggaacaaacagggc

SEQ ID NO: 3306241 - DNA, 23 bp, Homo sapiens
aggcaggaccttcgggctgtgcc

SEQ ID NO: 3306242 - DNA, 15 bp, Homo sapiens
agggagccatttgag

SEQ ID NO: 3306243 - DNA, 11 bp, Homo sapiens
agggagcctcc

SEQ ID NO: 3306244 - DNA, 13 bp, Homo sapiens
agggagcctcctg

SEQ ID NO: 3306245 - DNA, 14 bp, Homo sapiens
agggagcctcctgc

SEQ ID NO: 3306246 - DNA, 17 bp, Homo sapiens
agggagcctcctgccca

SEQ ID NO: 3306247 - DNA, 16 bp, Homo sapiens
agggagctggaacccg

SEQ ID NO: 3306248 - DNA, 13 bp, Homo sapiens
agggagctgggac

SEQ ID NO: 3306249 - DNA, 15 bp, Homo sapiens
agggaggaacacctg

SEQ ID NO: 3306250 - DNA, 14 bp, Homo sapiens
agggaggaagatat

SEQ ID NO: 3306251 - DNA, 23 bp, Homo sapiens
agggaggacgctctctggccttc

SEQ ID NO: 3306252 - DNA, 16 bp, Homo sapiens
agggaggaggccacct

SEQ ID NO: 3306253 - DNA, 17 bp, Homo sapiens
agggaggaggccacctc

SEQ ID NO: 3306254 - DNA, 20 bp, Homo sapiens
agggaggaggccacctctcc

SEQ ID NO: 3306255 - DNA, 12 bp, Homo sapiens
agggaggcagcc

SEQ ID NO: 3306256 - DNA, 15 bp, Homo sapiens
agggaggcagcctcc

SEQ ID NO: 3306257 - DNA, 16 bp, Homo sapiens
agggaggcagcctcca

SEQ ID NO: 3306258 - DNA, 13 bp, Homo sapiens
agggaggccgggc

SEQ ID NO: 3306259 - DNA, 13 bp, Homo sapiens
agggagggaattt

SEQ ID NO: 3306260 - DNA, 17 bp, Homo sapiens
agggagggcagttttct

SEQ ID NO: 3306261 - DNA, 13 bp, Homo sapiens
agggaggggaggc

SEQ ID NO: 3306262 - DNA, 16 bp, Homo sapiens
agggagggggaagtcg

SEQ ID NO: 3306263 - DNA, 23 bp, Homo sapiens
agggagggggaagtcgaaggatg

SEQ ID NO: 3306264 - DNA, 15 bp, Homo sapiens
agggaggtagtttca

SEQ ID NO: 3306265 - DNA, 21 bp, Homo sapiens
agggaggtcactggaaagggg

SEQ ID NO: 3306266 - DNA, 13 bp, Homo sapiens
agggaggtttgtg

SEQ ID NO: 3306267 - DNA, 17 bp, Homo sapiens
agggaggtttgtgagag

SEQ ID NO: 3306268 - DNA, 20 bp, Homo sapiens
agggagtccgaaagggactt

SEQ ID NO: 3306269 - DNA, 17 bp, Homo sapiens
agggagtgacagaggca

SEQ ID NO: 3306270 - DNA, 18 bp, Homo sapiens
agggagtgacagaggcag

SEQ ID NO: 3306271 - DNA, 15 bp, Homo sapiens
agggagtgctggctc

SEQ ID NO: 3306272 - DNA, 17 bp, Homo sapiens
agggagtgctggctcac

SEQ ID NO: 3306273 - DNA, 20 bp, Homo sapiens
agggagtgctggctcacagt

SEQ ID NO: 3306274 - DNA, 23 bp, Homo sapiens
agggagtgtttgtgtctgactca

SEQ ID NO: 3306275 - DNA, 21 bp, Homo sapiens
agggagttatctaaaagaaat

SEQ ID NO: 3306276 - DNA, 14 bp, Homo sapiens
agggatcacagggc

SEQ ID NO: 3306277 - DNA, 13 bp, Homo sapiens
agggatctgctta

SEQ ID NO: 3306278 - DNA, 18 bp, Homo sapiens
agggatgaagggcgagtg

SEQ ID NO: 3306279 - DNA, 18 bp, Homo sapiens
agggatgcggatcctgct

SEQ ID NO: 3306280 - DNA, 16 bp, Homo sapiens
agggatgctgcctgag

SEQ ID NO: 3306281 - DNA, 18 bp, Homo sapiens
agggatgctgcctgagtc

SEQ ID NO: 3306282 - DNA, 13 bp, Homo sapiens
agggatgctgggc

SEQ ID NO: 3306283 - DNA, 16 bp, Homo sapiens
agggatgggggatggg

SEQ ID NO: 3306284 - DNA, 18 bp, Homo sapiens
agggatggtaagttgaga

SEQ ID NO: 3306285 - DNA, 18 bp, Homo sapiens
agggattaacctctgcac

SEQ ID NO: 3306286 - DNA, 18 bp, Homo sapiens
agggattcacatctgcat

SEQ ID NO: 3306287 - DNA, 15 bp, Homo sapiens
agggattcaggctgc

SEQ ID NO: 3306288 - DNA, 20 bp, Homo sapiens
agggattctgggcttggggt

SEQ ID NO: 3306289 - DNA, 20 bp, Homo sapiens
agggattctggttccagggt

SEQ ID NO: 3306290 - DNA, 19 bp, Homo sapiens
agggattgaggggccctgg

SEQ ID NO: 3306291 - DNA, 20 bp, Homo sapiens
agggattggaccgagctgga

SEQ ID NO: 3306292 - DNA, 22 bp, Homo sapiens
agggcaaatgacatgcactgac

SEQ ID NO: 3306293 - DNA, 15 bp, Homo sapiens
agggcaatctttgcc

SEQ ID NO: 3306294 - DNA, 14 bp, Homo sapiens
agggcaattggaac

SEQ ID NO: 3306295 - DNA, 20 bp, Homo sapiens
agggcacaagtcctggatgt

SEQ ID NO: 3306296 - DNA, 14 bp, Homo sapiens
agggcacagccctc

SEQ ID NO: 3306297 - DNA, 19 bp, Homo sapiens
agggcaccaggggtttctc

SEQ ID NO: 3306298 - DNA, 16 bp, Homo sapiens
agggcacgcaggacca

SEQ ID NO: 3306299 - DNA, 21 bp, Homo sapiens
agggcacttaatttgtaaact

SEQ ID NO: 3306300 - DNA, 15 bp, Homo sapiens
agggcagactggggc

SEQ ID NO: 3306301 - DNA, 19 bp, Homo sapiens
agggcagagaatggctggg

SEQ ID NO: 3306302 - DNA, 18 bp, Homo sapiens
agggcagagccatgggcc

SEQ ID NO: 3306303 - DNA, 20 bp, Homo sapiens
agggcagagccatgggcctg

SEQ ID NO: 3306304 - DNA, 12 bp, Homo sapiens
agggcagctgct

SEQ ID NO: 3306305 - DNA, 23 bp, Homo sapiens
agggcagcttgccccggccccgg

SEQ ID NO: 3306306 - DNA, 19 bp, Homo sapiens
agggcaggaaggagagcct

SEQ ID NO: 3306307 - DNA, 21 bp, Homo sapiens
agggcaggaaggagagcctgc

SEQ ID NO: 3306308 - DNA, 17 bp, Homo sapiens
agggcagggcccacgtg

SEQ ID NO: 3306309 - DNA, 19 bp, Homo sapiens
agggcagggcccacgtgta

SEQ ID NO: 3306310 - DNA, 21 bp, Homo sapiens
agggcagggtgggcagcctat

SEQ ID NO: 3306311 - DNA, 18 bp, Homo sapiens
agggcagtacctgggaaa

SEQ ID NO: 3306312 - DNA, 15 bp, Homo sapiens
agggcagtgcccatg

SEQ ID NO: 3306313 - DNA, 22 bp, Homo sapiens
agggcagtgcccatgtgtacat

SEQ ID NO: 3306314 - DNA, 14 bp, Homo sapiens
agggcatcaggcac

SEQ ID NO: 3306315 - DNA, 18 bp, Homo sapiens
agggcatgcattttgcag

SEQ ID NO: 3306316 - DNA, 15 bp, Homo sapiens
agggcatgccccggc

SEQ ID NO: 3306317 - DNA, 17 bp, Homo sapiens
agggcatggccaggtgg

SEQ ID NO: 3306318 - DNA, 18 bp, Homo sapiens
agggcattcgggccacag

SEQ ID NO: 3306319 - DNA, 24 bp, Homo sapiens
agggccacactattaccatgagaa

SEQ ID NO: 3306320 - DNA, 15 bp, Homo sapiens
agggccacgctccag

SEQ ID NO: 3306321 - DNA, 23 bp, Homo sapiens
agggccactttttttttatactg

SEQ ID NO: 3306322 - DNA, 16 bp, Homo sapiens
agggccagaaggaggg

SEQ ID NO: 3306323 - DNA, 21 bp, Homo sapiens
agggccagaaggagggcagag

SEQ ID NO: 3306324 - DNA, 22 bp, Homo sapiens
agggccagaaggagggcagagc

SEQ ID NO: 3306325 - DNA, 18 bp, Homo sapiens
agggccagactggaagac

SEQ ID NO: 3306326 - DNA, 14 bp, Homo sapiens
agggccagagggag

SEQ ID NO: 3306327 - DNA, 22 bp, Homo sapiens
agggccaggaaggacagactgg

SEQ ID NO: 3306328 - DNA, 13 bp, Homo sapiens
agggccaggcagg

SEQ ID NO: 3306329 - DNA, 21 bp, Homo sapiens
agggccaggcaggtgcctgga

SEQ ID NO: 3306330 - DNA, 12 bp, Homo sapiens
agggccagggcc

SEQ ID NO: 3306331 - DNA, 19 bp, Homo sapiens
agggccagggccctgcaga

SEQ ID NO: 3306332 - DNA, 22 bp, Homo sapiens
agggccagggccctgcagaggg

SEQ ID NO: 3306333 - DNA, 23 bp, Homo sapiens
agggccagtcctgcctggccagg

SEQ ID NO: 3306334 - DNA, 21 bp, Homo sapiens
agggccagtggggcctgtgga

SEQ ID NO: 3306335 - DNA, 23 bp, Homo sapiens
agggccatacttttgagaggggt

SEQ ID NO: 3306336 - DNA, 19 bp, Homo sapiens
agggccatgctgaggcctg

SEQ ID NO: 3306337 - DNA, 22 bp, Homo sapiens
agggcccaagtccctgttttct

SEQ ID NO: 3306338 - DNA, 23 bp, Homo sapiens
agggcccagagagggtggtgacc

SEQ ID NO: 3306339 - DNA, 17 bp, Homo sapiens
agggcccagagcaggaa

SEQ ID NO: 3306340 - DNA, 18 bp, Homo sapiens
agggcccagagcaggaag

SEQ ID NO: 3306341 - DNA, 14 bp, Homo sapiens
agggcccagccagg

SEQ ID NO: 3306342 - DNA, 12 bp, Homo sapiens
agggcccagccc

SEQ ID NO: 3306343 - DNA, 13 bp, Homo sapiens
agggcccagccca

SEQ ID NO: 3306344 - DNA, 15 bp, Homo sapiens
agggcccagctgtag

SEQ ID NO: 3306345 - DNA, 19 bp, Homo sapiens
agggcccagctgtagccat

SEQ ID NO: 3306346 - DNA, 22 bp, Homo sapiens
agggcccagctgtagccatggc

SEQ ID NO: 3306347 - DNA, 12 bp, Homo sapiens
agggcccaggag

SEQ ID NO: 3306348 - DNA, 11 bp, Homo sapiens
agggcccctcc

SEQ ID NO: 3306349 - DNA, 18 bp, Homo sapiens
agggcccctccctctgcc

SEQ ID NO: 3306350 - DNA, 20 bp, Homo sapiens
agggcccctccctctgcccc

SEQ ID NO: 3306351 - DNA, 17 bp, Homo sapiens
agggcccggccacaccc

SEQ ID NO: 3306352 - DNA, 20 bp, Homo sapiens
agggccgtaccccaccctca

SEQ ID NO: 3306353 - DNA, 15 bp, Homo sapiens
agggcctggggcctg

SEQ ID NO: 3306354 - DNA, 14 bp, Homo sapiens
agggcctgggggca

SEQ ID NO: 3306355 - DNA, 13 bp, Homo sapiens
agggcgagactcc

SEQ ID NO: 3306356 - DNA, 19 bp, Homo sapiens
agggcgagactctgtctca

SEQ ID NO: 3306357 - DNA, 13 bp, Homo sapiens
agggcgagtgaat

SEQ ID NO: 3306358 - DNA, 12 bp, Homo sapiens
agggcgctcaga

SEQ ID NO: 3306359 - DNA, 13 bp, Homo sapiens
agggcgctcagac

SEQ ID NO: 3306360 - DNA, 14 bp, Homo sapiens
agggcgctcagacg

SEQ ID NO: 3306361 - DNA, 22 bp, Homo sapiens
agggcgctcagacggcggccag

SEQ ID NO: 3306362 - DNA, 23 bp, Homo sapiens
agggcgctcagacggcggccagg

SEQ ID NO: 3306363 - DNA, 16 bp, Homo sapiens
agggcggcaggggcct

SEQ ID NO: 3306364 - DNA, 18 bp, Homo sapiens
agggcgggcagagggctg

SEQ ID NO: 3306365 - DNA, 15 bp, Homo sapiens
agggcggtgctagct

SEQ ID NO: 3306366 - DNA, 21 bp, Homo sapiens
agggctactgcagctttacat

SEQ ID NO: 3306367 - DNA, 22 bp, Homo sapiens
agggctagtgacttgtgtccca

SEQ ID NO: 3306368 - DNA, 15 bp, Homo sapiens
aggtccacaggtcta

SEQ ID NO: 3306369 - DNA, 12 bp, Homo sapiens
aggtccagccca

SEQ ID NO: 3306370 - DNA, 15 bp, Homo sapiens
aggtccagcccatct

SEQ ID NO: 3306371 - DNA, 18 bp, Homo sapiens
aggtccagctctggaggg

SEQ ID NO: 3306372 - DNA, 18 bp, Homo sapiens
aggtcccacctccagccc

SEQ ID NO: 3306373 - DNA, 22 bp, Homo sapiens
aggtcccctccacatcccagca

SEQ ID NO: 3306374 - DNA, 22 bp, Homo sapiens
aggtccctgtgtgtaggctggg

SEQ ID NO: 3306375 - DNA, 14 bp, Homo sapiens
aggtcccttgtttc

SEQ ID NO: 3306376 - DNA, 16 bp, Homo sapiens
aggtcctacagggcca

SEQ ID NO: 3306377 - DNA, 20 bp, Homo sapiens
aggtcctctggagccctaac

SEQ ID NO: 3306378 - DNA, 23 bp, Homo sapiens
aggtcctgcccatgtgtcccctc

SEQ ID NO: 3306379 - DNA, 21 bp, Homo sapiens
aggtcctttggacagctgact

SEQ ID NO: 3306380 - DNA, 21 bp, Homo sapiens
aggtctccagttggctttact

SEQ ID NO: 3306381 - DNA, 17 bp, Homo sapiens
aggtctccccatcccca

SEQ ID NO: 3306382 - DNA, 19 bp, Homo sapiens
aggtctcctcagggtgggg

SEQ ID NO: 3306383 - DNA, 15 bp, Homo sapiens
aggtctccttactct

SEQ ID NO: 3306384 - DNA, 22 bp, Homo sapiens
aggtctccttactctgagccca

SEQ ID NO: 3306385 - DNA, 17 bp, Homo sapiens
aggtctcttctcccaga

SEQ ID NO: 3306386 - DNA, 19 bp, Homo sapiens
aggtctcttctcccagaat

SEQ ID NO: 3306387 - DNA, 23 bp, Homo sapiens
aggtcttcatatttttgatcatc

SEQ ID NO: 3306388 - DNA, 20 bp, Homo sapiens
aggtcttcatcgaatctact

SEQ ID NO: 3306389 - DNA, 21 bp, Homo sapiens
aggtcttcatcgaatctacta

SEQ ID NO: 3306390 - DNA, 12 bp, Homo sapiens
aggtcttccaga

SEQ ID NO: 3306391 - DNA, 13 bp, Homo sapiens
aggtcttccagac

SEQ ID NO: 3306392 - DNA, 17 bp, Homo sapiens
aggtcttgaactcctgg

SEQ ID NO: 3306393 - DNA, 20 bp, Homo sapiens
aggtcttgaactcctggcct

SEQ ID NO: 3306394 - DNA, 18 bp, Homo sapiens
aggtcttgcagtggcttt

SEQ ID NO: 3306395 - DNA, 11 bp, Homo sapiens
aggtcttgcta

SEQ ID NO: 3306396 - DNA, 14 bp, Homo sapiens
aggtctttctctca

SEQ ID NO: 3306397 - DNA, 16 bp, Homo sapiens
aggtcttttgacatgt

SEQ ID NO: 3306398 - DNA, 16 bp, Homo sapiens
aggtgaaaatgaagaa

SEQ ID NO: 3306399 - DNA, 18 bp, Homo sapiens
aggtgaagatgaagaagc

SEQ ID NO: 3306400 - DNA, 19 bp, Homo sapiens
aggtgacagaaggaccagc

SEQ ID NO: 3306401 - DNA, 13 bp, Homo sapiens
aggtgacagagtg

SEQ ID NO: 3306402 - DNA, 16 bp, Homo sapiens
aggtgacatgtgaaac

SEQ ID NO: 3306403 - DNA, 18 bp, Homo sapiens
aggtgaccctgatgaaaa

SEQ ID NO: 3306404 - DNA, 13 bp, Homo sapiens
aggtgagaaaaaa

SEQ ID NO: 3306405 - DNA, 14 bp, Homo sapiens
aggtgagaaaaaaa

SEQ ID NO: 3306406 - DNA, 15 bp, Homo sapiens
aggtgagaaaaaaac

SEQ ID NO: 3306407 - DNA, 14 bp, Homo sapiens
aggtgagagtggga

SEQ ID NO: 3306408 - DNA, 19 bp, Homo sapiens
aggtgagatcacagcctcc

SEQ ID NO: 3306409 - DNA, 13 bp, Homo sapiens
aggtgagctactt

SEQ ID NO: 3306410 - DNA, 14 bp, Homo sapiens
aggtgagctacttt

SEQ ID NO: 3306411 - DNA, 22 bp, Homo sapiens
aggtgaggcccaagagccctgt

SEQ ID NO: 3306412 - DNA, 23 bp, Homo sapiens
aggtgaggtccaccggcccctgg

SEQ ID NO: 3306413 - DNA, 14 bp, Homo sapiens
aggtgatccaccca

SEQ ID NO: 3306414 - DNA, 19 bp, Homo sapiens
aggtgatggaggtatttga

SEQ ID NO: 3306415 - DNA, 19 bp, Homo sapiens
aggtgattctaatcatctg

SEQ ID NO: 3306416 - DNA, 21 bp, Homo sapiens
aggtgattctaatcatctgca

SEQ ID NO: 3306417 - DNA, 15 bp, Homo sapiens
aggtgcaatttcaag

SEQ ID NO: 3306418 - DNA, 13 bp, Homo sapiens
aggtgcagctcct

SEQ ID NO: 3306419 - DNA, 11 bp, Homo sapiens
aggtgcagtgg

SEQ ID NO: 3306420 - DNA, 16 bp, Homo sapiens
aggtgcagtggctcac

SEQ ID NO: 3306421 - DNA, 16 bp, Homo sapiens
aggtgcagttccccca

SEQ ID NO: 3306422 - DNA, 23 bp, Homo sapiens
aggtgcatctggggaactagagg

SEQ ID NO: 3306423 - DNA, 14 bp, Homo sapiens
aggtgccaccaccc

SEQ ID NO: 3306424 - DNA, 18 bp, Homo sapiens
aggtgccaccaccctgcc

SEQ ID NO: 3306425 - DNA, 19 bp, Homo sapiens
aggtgccaccaccctgccc

SEQ ID NO: 3306426 - DNA, 20 bp, Homo sapiens
aggtgccaccaccctgcccc

SEQ ID NO: 3306427 - DNA, 22 bp, Homo sapiens
aggtgccaccaccctgcccccc

SEQ ID NO: 3306428 - DNA, 15 bp, Homo sapiens
aggtgccactccctg

SEQ ID NO: 3306429 - DNA, 20 bp, Homo sapiens
aggtgccactccctgagctt

SEQ ID NO: 3306430 - DNA, 21 bp, Homo sapiens
aggtgccagcctgaggcagcc

SEQ ID NO: 3306431 - DNA, 20 bp, Homo sapiens
aggtgcctcagactccgccc

SEQ ID NO: 3306432 - DNA, 15 bp, Homo sapiens
aggtgcctccaggtg

SEQ ID NO: 3306433 - DNA, 21 bp, Homo sapiens
aggtgcgaatgacagtagcat

SEQ ID NO: 3306434 - DNA, 17 bp, Homo sapiens
aggtgctaatttgtttt

SEQ ID NO: 3306435 - DNA, 22 bp, Homo sapiens
aggtgctacaacatgtgaggca

SEQ ID NO: 3306436 - DNA, 21 bp, Homo sapiens
aggtgctctcctggcacccag

SEQ ID NO: 3306437 - DNA, 19 bp, Homo sapiens
aggtgcttaagcagaagca

SEQ ID NO: 3306438 - DNA, 14 bp, Homo sapiens
aggtgcttgttatg

SEQ ID NO: 3306439 - DNA, 23 bp, Homo sapiens
aggtgctttgctagatgctgtga

SEQ ID NO: 3306440 - DNA, 21 bp, Homo sapiens
aggtggaaaatggactggctt

SEQ ID NO: 3306441 - DNA, 15 bp, Homo sapiens
aggtggaagaaggga

SEQ ID NO: 3306442 - DNA, 16 bp, Homo sapiens
aggtggaagaagggag

SEQ ID NO: 3306443 - DNA, 17 bp, Homo sapiens
aggtggaataaacatta

SEQ ID NO: 3306444 - DNA, 15 bp, Homo sapiens
aggtggagggcacag

SEQ ID NO: 3306445 - DNA, 15 bp, Homo sapiens
aggtggatggcccca

SEQ ID NO: 3306446 - DNA, 17 bp, Homo sapiens
aggtggcaatgcttaaa

SEQ ID NO: 3306447 - DNA, 21 bp, Homo sapiens
aggtggcaatgcttaaactaa

SEQ ID NO: 3306448 - DNA, 22 bp, Homo sapiens
aggtggcaatgcttaaactaaa

SEQ ID NO: 3306449 - DNA, 14 bp, Homo sapiens
aggtggcagagtga

SEQ ID NO: 3306450 - DNA, 15 bp, Homo sapiens
aggtggcagagtgaa

SEQ ID NO: 3306451 - DNA, 13 bp, Homo sapiens
aggtggcagccct

SEQ ID NO: 3306452 - DNA, 15 bp, Homo sapiens
aggtggcagccctgt

SEQ ID NO: 3306453 - DNA, 21 bp, Homo sapiens
aggtggccactttaagagaga

SEQ ID NO: 3306454 - DNA, 17 bp, Homo sapiens
aggtggctatggccacc

SEQ ID NO: 3306455 - DNA, 21 bp, Homo sapiens
aggtgggactttgttgtttgg

SEQ ID NO: 3306456 - DNA, 13 bp, Homo sapiens
aggtgggagcagg

SEQ ID NO: 3306457 - DNA, 20 bp, Homo sapiens
aggtgggagcaggagattga

SEQ ID NO: 3306458 - DNA, 13 bp, Homo sapiens
aggtgggcagctg

SEQ ID NO: 3306459 - DNA, 18 bp, Homo sapiens
aggtgggcagctgggccc

SEQ ID NO: 3306460 - DNA, 22 bp, Homo sapiens
aggtgggcaggtggtggcactg

SEQ ID NO: 3306461 - DNA, 17 bp, Homo sapiens
aggtgggcatgccaccc

SEQ ID NO: 3306462 - DNA, 22 bp, Homo sapiens
aggtgggcatgccaccctcaca

SEQ ID NO: 3306463 - DNA, 16 bp, Homo sapiens
aggtgggcccaggacc

SEQ ID NO: 3306464 - DNA, 18 bp, Homo sapiens
aggtgggcccaggaccag

SEQ ID NO: 3306465 - DNA, 23 bp, Homo sapiens
aggtgggcccaggaccagctggg

SEQ ID NO: 3306466 - DNA, 21 bp, Homo sapiens
aggtgggccttgctacctcaa

SEQ ID NO: 3306467 - DNA, 19 bp, Homo sapiens
aggtgggctgagccctggc

SEQ ID NO: 3306468 - DNA, 15 bp, Homo sapiens
aggtgggctggactt

SEQ ID NO: 3306469 - DNA, 14 bp, Homo sapiens
aggtggggcagctt

SEQ ID NO: 3306470 - DNA, 15 bp, Homo sapiens
aggtggggccctgcc

SEQ ID NO: 3306471 - DNA, 19 bp, Homo sapiens
aggtggggccctgccccta

SEQ ID NO: 3306472 - DNA, 22 bp, Homo sapiens
aggtggggccctgcccctagga

SEQ ID NO: 3306473 - DNA, 17 bp, Homo sapiens
aggtggggcgaggcagg

SEQ ID NO: 3306474 - DNA, 14 bp, Homo sapiens
aggtgggtccagga

SEQ ID NO: 3306475 - DNA, 23 bp, Homo sapiens
aggtgggtccaggaaggcagctg

SEQ ID NO: 3306476 - DNA, 21 bp, Homo sapiens
aggtgggtgtgggtggaaggg

SEQ ID NO: 3306477 - DNA, 18 bp, Homo sapiens
aggtggtctgaatgttct

SEQ ID NO: 3306478 - DNA, 21 bp, Homo sapiens
aggtggtctgaatgttctgac

SEQ ID NO: 3306479 - DNA, 22 bp, Homo sapiens
aggtggtctgaatgttctgaca

SEQ ID NO: 3306480 - DNA, 23 bp, Homo sapiens
aggtggtctgaatgttctgacat

SEQ ID NO: 3306481 - DNA, 19 bp, Homo sapiens
aggtggttctaatattttt

SEQ ID NO: 3306482 - DNA, 15 bp, Homo sapiens
aggtggttttaaagg

SEQ ID NO: 3306483 - DNA, 13 bp, Homo sapiens
aggtgtacactaa

SEQ ID NO: 3306484 - DNA, 19 bp, Homo sapiens
aggtgtacactaacatttc

SEQ ID NO: 3306485 - DNA, 23 bp, Homo sapiens
aggtgtatgccacacctggcctt

SEQ ID NO: 3306486 - DNA, 15 bp, Homo sapiens
aggtgtcatttccat

SEQ ID NO: 3306487 - DNA, 17 bp, Homo sapiens
aggtgtcatttccatta

SEQ ID NO: 3306488 - DNA, 20 bp, Homo sapiens
aggtgtcctttcccctctct

SEQ ID NO: 3306489 - DNA, 17 bp, Homo sapiens
aggtgtgaaccaccaca

SEQ ID NO: 3306490 - DNA, 12 bp, Homo sapiens
aggtgtgaatgc

SEQ ID NO: 3306491 - DNA, 14 bp, Homo sapiens
aggtgtgagtcacc

SEQ ID NO: 3306492 - DNA, 14 bp, Homo sapiens
aggtgtggctgtca

SEQ ID NO: 3306493 - DNA, 19 bp, Homo sapiens
agtcatgcataaatatgca

SEQ ID NO: 3306494 - DNA, 22 bp, Homo sapiens
agtcatggagaatctgctgcat

SEQ ID NO: 3306495 - DNA, 13 bp, Homo sapiens
agtcatgtgagcc

SEQ ID NO: 3306496 - DNA, 20 bp, Homo sapiens
agtcattccttctttttaaa

SEQ ID NO: 3306497 - DNA, 16 bp, Homo sapiens
agtcattgacttcatt

SEQ ID NO: 3306498 - DNA, 17 bp, Homo sapiens
agtcattgacttcattt

SEQ ID NO: 3306499 - DNA, 18 bp, Homo sapiens
agtcattgtatgttatta

SEQ ID NO: 3306500 - DNA, 20 bp, Homo sapiens
agtcatttattttaaaaaat

SEQ ID NO: 3306501 - DNA, 19 bp, Homo sapiens
agtcatttgctgagcatgt

SEQ ID NO: 3306502 - DNA, 21 bp, Homo sapiens
agtcattttaactttatcaca

SEQ ID NO: 3306503 - DNA, 23 bp, Homo sapiens
agtccaaatgtcctccagaagcc

SEQ ID NO: 3306504 - DNA, 14 bp, Homo sapiens
agtccaagaatcca

SEQ ID NO: 3306505 - DNA, 19 bp, Homo sapiens
agtccacacaaagattttc

SEQ ID NO: 3306506 - DNA, 11 bp, Homo sapiens
agtccagacac

SEQ ID NO: 3306507 - DNA, 22 bp, Homo sapiens
agtccagtgtcacctctctcag

SEQ ID NO: 3306508 - DNA, 15 bp, Homo sapiens
agtccataccttata

SEQ ID NO: 3306509 - DNA, 15 bp, Homo sapiens
agtccattctcccag

SEQ ID NO: 3306510 - DNA, 16 bp, Homo sapiens
agtccattctcccagg

SEQ ID NO: 3306511 - DNA, 18 bp, Homo sapiens
agtccatttcccacatct

SEQ ID NO: 3306512 - DNA, 21 bp, Homo sapiens
agtccatttcccacatctttc

SEQ ID NO: 3306513 - DNA, 19 bp, Homo sapiens
agtcccaaaacccttacag

SEQ ID NO: 3306514 - DNA, 16 bp, Homo sapiens
agtcccaccttggctg

SEQ ID NO: 3306515 - DNA, 20 bp, Homo sapiens
agtcccactgcctcaggttc

SEQ ID NO: 3306516 - DNA, 20 bp, Homo sapiens
agtcccagctacttgggagg

SEQ ID NO: 3306517 - DNA, 18 bp, Homo sapiens
agtcccagtatacctcat

SEQ ID NO: 3306518 - DNA, 17 bp, Homo sapiens
agtcccagtattctcag

SEQ ID NO: 3306519 - DNA, 13 bp, Homo sapiens
agtcccattcata

SEQ ID NO: 3306520 - DNA, 11 bp, Homo sapiens
agtccccaccc

SEQ ID NO: 3306521 - DNA, 13 bp, Homo sapiens
agtccccacccct

SEQ ID NO: 3306522 - DNA, 15 bp, Homo sapiens
agtcccccaacccca

SEQ ID NO: 3306523 - DNA, 18 bp, Homo sapiens
agtcccccaaccccagcc

SEQ ID NO: 3306524 - DNA, 19 bp, Homo sapiens
agtcccccaactctgagcc

SEQ ID NO: 3306525 - DNA, 22 bp, Homo sapiens
agtcccccaactctgagcccat

SEQ ID NO: 3306526 - DNA, 12 bp, Homo sapiens
agtcccccaggg

SEQ ID NO: 3306527 - DNA, 22 bp, Homo sapiens
agtccccctatccttggcacca

SEQ ID NO: 3306528 - DNA, 19 bp, Homo sapiens
agtccccgaggagctgggc

SEQ ID NO: 3306529 - DNA, 18 bp, Homo sapiens
agtccccgggcatctttg

SEQ ID NO: 3306530 - DNA, 22 bp, Homo sapiens
agtccccgggcatctttgggga

SEQ ID NO: 3306531 - DNA, 23 bp, Homo sapiens
agtccccgtgccccgcctccccg

SEQ ID NO: 3306532 - DNA, 16 bp, Homo sapiens
agtccccgtggccatc

SEQ ID NO: 3306533 - DNA, 22 bp, Homo sapiens
agtccccgtggccatccctgtg

SEQ ID NO: 3306534 - DNA, 13 bp, Homo sapiens
agtcccctcccat

SEQ ID NO: 3306535 - DNA, 21 bp, Homo sapiens
agtcccctcccatctgggagt

SEQ ID NO: 3306536 - DNA, 13 bp, Homo sapiens
agtccctgttttc

SEQ ID NO: 3306537 - DNA, 20 bp, Homo sapiens
agtccctgttttctgagccc

SEQ ID NO: 3306538 - DNA, 22 bp, Homo sapiens
agtccctgttttctgagcccgg

SEQ ID NO: 3306539 - DNA, 13 bp, Homo sapiens
agtcccttcccct

SEQ ID NO: 3306540 - DNA, 20 bp, Homo sapiens
agtcccttcccctccctggc

SEQ ID NO: 3306541 - DNA, 21 bp, Homo sapiens
agtcccttcccctccctggct

SEQ ID NO: 3306542 - DNA, 14 bp, Homo sapiens
agtcccttgttttg

SEQ ID NO: 3306543 - DNA, 15 bp, Homo sapiens
agtccgcagaagccc

SEQ ID NO: 3306544 - DNA, 17 bp, Homo sapiens
agtccgcagtctggcct

SEQ ID NO: 3306545 - DNA, 17 bp, Homo sapiens
agtcctcactcccagtc

SEQ ID NO: 3306546 - DNA, 12 bp, Homo sapiens
agtcctcccctc

SEQ ID NO: 3306547 - DNA, 16 bp, Homo sapiens
agtcctcccctcacag

SEQ ID NO: 3306548 - DNA, 22 bp, Homo sapiens
agtcctcccctcacagcctctg

SEQ ID NO: 3306549 - DNA, 13 bp, Homo sapiens
agtcctcctggga

SEQ ID NO: 3306550 - DNA, 15 bp, Homo sapiens
agtcctcgtagccat

SEQ ID NO: 3306551 - DNA, 17 bp, Homo sapiens
agtcctcgtagccatct

SEQ ID NO: 3306552 - DNA, 15 bp, Homo sapiens
agtcctgctccagaa

SEQ ID NO: 3306553 - DNA, 14 bp, Homo sapiens
agtcctggaagcca

SEQ ID NO: 3306554 - DNA, 20 bp, Homo sapiens
agtcctggaagccagctttc

SEQ ID NO: 3306555 - DNA, 18 bp, Homo sapiens
agtcctggctacatccca

SEQ ID NO: 3306556 - DNA, 21 bp, Homo sapiens
agtcctgggagaacctcaggc

SEQ ID NO: 3306557 - DNA, 15 bp, Homo sapiens
agtcctggtccctct

SEQ ID NO: 3306558 - DNA, 19 bp, Homo sapiens
agtcctggtccctctgagg

SEQ ID NO: 3306559 - DNA, 13 bp, Homo sapiens
agtcctgtgaatg

SEQ ID NO: 3306560 - DNA, 18 bp, Homo sapiens
agtcctgtgaatgccact

SEQ ID NO: 3306561 - DNA, 19 bp, Homo sapiens
agtcctgtgaatgccactg

SEQ ID NO: 3306562 - DNA, 13 bp, Homo sapiens
agtcctgtgaatt

SEQ ID NO: 3306563 - DNA, 22 bp, Homo sapiens
agtcctttcccaccattcctgc

SEQ ID NO: 3306564 - DNA, 15 bp, Homo sapiens
agtcctttctgcctt

SEQ ID NO: 3306565 - DNA, 16 bp, Homo sapiens
agtcctttctgccttg

SEQ ID NO: 3306566 - DNA, 16 bp, Homo sapiens
agtcctttttttccat

SEQ ID NO: 3306567 - DNA, 21 bp, Homo sapiens
agtcctttttttccatcttta

SEQ ID NO: 3306568 - DNA, 18 bp, Homo sapiens
agtcgaaggatgctcttt

SEQ ID NO: 3306569 - DNA, 23 bp, Homo sapiens
agtcgaccgcacttatggtaatc

SEQ ID NO: 3306570 - DNA, 23 bp, Homo sapiens
agtcgattatttccagtgttcta

SEQ ID NO: 3306571 - DNA, 20 bp, Homo sapiens
agtcgcgagcacatgttcat

SEQ ID NO: 3306572 - DNA, 16 bp, Homo sapiens
agtcgggggctggcct

SEQ ID NO: 3306573 - DNA, 20 bp, Homo sapiens
agtcgggggctggcctagga

SEQ ID NO: 3306574 - DNA, 16 bp, Homo sapiens
agtcgtcgcacagtct

SEQ ID NO: 3306575 - DNA, 18 bp, Homo sapiens
agtcgtggggtgtgctgg

SEQ ID NO: 3306576 - DNA, 17 bp, Homo sapiens
agtcgttggagactgaa

SEQ ID NO: 3306577 - DNA, 22 bp, Homo sapiens
agtctaaagatggagtttctaa

SEQ ID NO: 3306578 - DNA, 13 bp, Homo sapiens
agtctacctgctg

SEQ ID NO: 3306579 - DNA, 14 bp, Homo sapiens
agtctagattctct

SEQ ID NO: 3306580 - DNA, 16 bp, Homo sapiens
agtctagattctctgg

SEQ ID NO: 3306581 - DNA, 19 bp, Homo sapiens
agtctagtacttattacat

SEQ ID NO: 3306582 - DNA, 18 bp, Homo sapiens
agtctatatgaaaaacaa

SEQ ID NO: 3306583 - DNA, 14 bp, Homo sapiens
agtctatccacaga

SEQ ID NO: 3306584 - DNA, 15 bp, Homo sapiens
agtctatccacagag

SEQ ID NO: 3306585 - DNA, 14 bp, Homo sapiens
agtctattttatta

SEQ ID NO: 3306586 - DNA, 17 bp, Homo sapiens
agtctattttattatga

SEQ ID NO: 3306587 - DNA, 23 bp, Homo sapiens
agtctatttttttaactgaaaat

SEQ ID NO: 3306588 - DNA, 21 bp, Homo sapiens
agtctcaaaaatacaaaataa

SEQ ID NO: 3306589 - DNA, 16 bp, Homo sapiens
agtctcactgttgccc

SEQ ID NO: 3306590 - DNA, 17 bp, Homo sapiens
agtctcactgttgccca

SEQ ID NO: 3306591 - DNA, 19 bp, Homo sapiens
agtctcactgttgcccagg

SEQ ID NO: 3306592 - DNA, 20 bp, Homo sapiens
agtctcactgttgcccaggc

SEQ ID NO: 3306593 - DNA, 23 bp, Homo sapiens
agtctcactgttgcccaggctgg

SEQ ID NO: 3306594 - DNA, 19 bp, Homo sapiens
agtctcagaaactcccctg

SEQ ID NO: 3306595 - DNA, 13 bp, Homo sapiens
agtctcaggagca

SEQ ID NO: 3306596 - DNA, 10 bp, Homo sapiens
agtctcagtt

SEQ ID NO: 3306597 - DNA, 13 bp, Homo sapiens
agtctcccaaggc

SEQ ID NO: 3306598 - DNA, 13 bp, Homo sapiens
agtctcccaggcc

SEQ ID NO: 3306599 - DNA, 16 bp, Homo sapiens
agtctccttcagcacg

SEQ ID NO: 3306600 - DNA, 19 bp, Homo sapiens
agtctcctttgcactgagg

SEQ ID NO: 3306601 - DNA, 22 bp, Homo sapiens
agtctcctttgcactgagggcc

SEQ ID NO: 3306602 - DNA, 12 bp, Homo sapiens
agtctctattta

SEQ ID NO: 3306603 - DNA, 13 bp, Homo sapiens
agtctctcctgta

SEQ ID NO: 3306604 - DNA, 22 bp, Homo sapiens
agtctctcctgtaagccaaaga

SEQ ID NO: 3306605 - DNA, 21 bp, Homo sapiens
agtctctcttctctccagctg

SEQ ID NO: 3306606 - DNA, 15 bp, Homo sapiens
agtctctgccaccca

SEQ ID NO: 3306607 - DNA, 21 bp, Homo sapiens
agtctctgccacccactcagg

SEQ ID NO: 3306608 - DNA, 22 bp, Homo sapiens
agtctctgccacccactcagga

SEQ ID NO: 3306609 - DNA, 11 bp, Homo sapiens
agtctcttcca

SEQ ID NO: 3306610 - DNA, 13 bp, Homo sapiens
agtctcttctcca

SEQ ID NO: 3306611 - DNA, 14 bp, Homo sapiens
agtctcttctccac

SEQ ID NO: 3306612 - DNA, 16 bp, Homo sapiens
agtctcttctccactg

SEQ ID NO: 3306613 - DNA, 17 bp, Homo sapiens
agtctcttctccactgg

SEQ ID NO: 3306614 - DNA, 19 bp, Homo sapiens
agtctcttctccactggat

SEQ ID NO: 3306615 - DNA, 21 bp, Homo sapiens
agtctcttctccactggatgg

SEQ ID NO: 3306616 - DNA, 22 bp, Homo sapiens
agtctctttaatcttcagtttt

SEQ ID NO: 3306617 - DNA, 13 bp, Homo sapiens
agtctctttctgt

SEQ ID NO: 3306618 - DNA, 17 bp, Homo sapiens
agtctctttcttccttt

SEQ ID NO: 3306619 - DNA, 15 bp, Homo sapiens
agtgcttcagagttt

SEQ ID NO: 3306620 - DNA, 15 bp, Homo sapiens
agtgcttcagcctga

SEQ ID NO: 3306621 - DNA, 19 bp, Homo sapiens
agtgcttcagcctgaggct

SEQ ID NO: 3306622 - DNA, 16 bp, Homo sapiens
agtgcttccaaggatg

SEQ ID NO: 3306623 - DNA, 21 bp, Homo sapiens
agtgcttcttactattaagca

SEQ ID NO: 3306624 - DNA, 19 bp, Homo sapiens
agtgcttgatatgtaagta

SEQ ID NO: 3306625 - DNA, 14 bp, Homo sapiens
agtgcttgggctcc

SEQ ID NO: 3306626 - DNA, 18 bp, Homo sapiens
agtgcttgttagagagaa

SEQ ID NO: 3306627 - DNA, 23 bp, Homo sapiens
agtgctttgacttcttgcttcag

SEQ ID NO: 3306628 - DNA, 14 bp, Homo sapiens
agtggaaaaaagag

SEQ ID NO: 3306629 - DNA, 23 bp, Homo sapiens
agtggaaaataggctttttaatc

SEQ ID NO: 3306630 - DNA, 22 bp, Homo sapiens
agtggaaatcgcttatatgtcc

SEQ ID NO: 3306631 - DNA, 14 bp, Homo sapiens
agtggaaattcagg

SEQ ID NO: 3306632 - DNA, 16 bp, Homo sapiens
agtggaacgaaaatga

SEQ ID NO: 3306633 - DNA, 13 bp, Homo sapiens
agtggaagagcag

SEQ ID NO: 3306634 - DNA, 16 bp, Homo sapiens
agtggaagagcagcct

SEQ ID NO: 3306635 - DNA, 24 bp, Homo sapiens
agtggaagagcagcctgatggcca

SEQ ID NO: 3306636 - DNA, 18 bp, Homo sapiens
agtggaccttgagaccac

SEQ ID NO: 3306637 - DNA, 19 bp, Homo sapiens
agtggaccttgagaccaca

SEQ ID NO: 3306638 - DNA, 18 bp, Homo sapiens
agtggactgaatgtgcct

SEQ ID NO: 3306639 - DNA, 12 bp, Homo sapiens
agtggagaggga

SEQ ID NO: 3306640 - DNA, 16 bp, Homo sapiens
agtggatcacaaagtg

SEQ ID NO: 3306641 - DNA, 18 bp, Homo sapiens
agtggatcttcagaactg

SEQ ID NO: 3306642 - DNA, 23 bp, Homo sapiens
agtggatcttcagaactgccctt

SEQ ID NO: 3306643 - DNA, 14 bp, Homo sapiens
agtggatgactgtt

SEQ ID NO: 3306644 - DNA, 16 bp, Homo sapiens
agtggatgggaatttg

SEQ ID NO: 3306645 - DNA, 16 bp, Homo sapiens
agtggatgtttttaat

SEQ ID NO: 3306646 - DNA, 14 bp, Homo sapiens
agtggattgcattt

SEQ ID NO: 3306647 - DNA, 18 bp, Homo sapiens
agtggattggctttgtgc

SEQ ID NO: 3306648 - DNA, 14 bp, Homo sapiens
agtggcagccatgc

SEQ ID NO: 3306649 - DNA, 20 bp, Homo sapiens
agtggcagctgcttttgtct

SEQ ID NO: 3306650 - DNA, 17 bp, Homo sapiens
agtggcagggctcagga

SEQ ID NO: 3306651 - DNA, 16 bp, Homo sapiens
agtggcatgtgctgtg

SEQ ID NO: 3306652 - DNA, 14 bp, Homo sapiens
agtggccagccagt

SEQ ID NO: 3306653 - DNA, 12 bp, Homo sapiens
agtggcctccct

SEQ ID NO: 3306654 - DNA, 17 bp, Homo sapiens
agtggcctccctgctgt

SEQ ID NO: 3306655 - DNA, 14 bp, Homo sapiens
agtggcctggccag

SEQ ID NO: 3306656 - DNA, 18 bp, Homo sapiens
agtggcctggccaggagc

SEQ ID NO: 3306657 - DNA, 13 bp, Homo sapiens
agtggctcctccc

SEQ ID NO: 3306658 - DNA, 23 bp, Homo sapiens
agtggcttaaaacaacactcaca

SEQ ID NO: 3306659 - DNA, 15 bp, Homo sapiens
agtggcttcaaaata

SEQ ID NO: 3306660 - DNA, 15 bp, Homo sapiens
agtggcttcccagct

SEQ ID NO: 3306661 - DNA, 15 bp, Homo sapiens
agtgggacccataga

SEQ ID NO: 3306662 - DNA, 14 bp, Homo sapiens
agtgggagaaggca

SEQ ID NO: 3306663 - DNA, 15 bp, Homo sapiens
agtgggagctgagct

SEQ ID NO: 3306664 - DNA, 17 bp, Homo sapiens
agtgggagctgagctgg

SEQ ID NO: 3306665 - DNA, 15 bp, Homo sapiens
agtgggagctgcctg

SEQ ID NO: 3306666 - DNA, 22 bp, Homo sapiens
agtgggataaaggcccagactc

SEQ ID NO: 3306667 - DNA, 20 bp, Homo sapiens
agtgggcatcagcagcaggg

SEQ ID NO: 3306668 - DNA, 14 bp, Homo sapiens
agtgggccagggct

SEQ ID NO: 3306669 - DNA, 22 bp, Homo sapiens
agtgggccagggctgccctgag

SEQ ID NO: 3306670 - DNA, 18 bp, Homo sapiens
agtgggccctctctctgg

SEQ ID NO: 3306671 - DNA, 15 bp, Homo sapiens
agtgggcgttgggag

SEQ ID NO: 3306672 - DNA, 16 bp, Homo sapiens
agtgggcttgattctg

SEQ ID NO: 3306673 - DNA, 21 bp, Homo sapiens
agtggggatggggcctccctc

SEQ ID NO: 3306674 - DNA, 12 bp, Homo sapiens
agtggggcctgg

SEQ ID NO: 3306675 - DNA, 14 bp, Homo sapiens
agtggggcctggga

SEQ ID NO: 3306676 - DNA, 14 bp, Homo sapiens
agtggggcctgtgg

SEQ ID NO: 3306677 - DNA, 15 bp, Homo sapiens
agtggggcctgtgga

SEQ ID NO: 3306678 - DNA, 19 bp, Homo sapiens
agtgggggagagcaggctg

SEQ ID NO: 3306679 - DNA, 18 bp, Homo sapiens
agtggggggtcgtgggcc

SEQ ID NO: 3306680 - DNA, 18 bp, Homo sapiens
agtggggtgctgggagga

SEQ ID NO: 3306681 - DNA, 14 bp, Homo sapiens
agtgggtctgggat

SEQ ID NO: 3306682 - DNA, 16 bp, Homo sapiens
agtgggtgacaagagc

SEQ ID NO: 3306683 - DNA, 21 bp, Homo sapiens
agtgggtgacaagagcctgat

SEQ ID NO: 3306684 - DNA, 18 bp, Homo sapiens
agtgggtgagatgctgga

SEQ ID NO: 3306685 - DNA, 22 bp, Homo sapiens
agtgggtgagatgctggagaag

SEQ ID NO: 3306686 - DNA, 20 bp, Homo sapiens
agtggtaatcatatgtgtct

SEQ ID NO: 3306687 - DNA, 14 bp, Homo sapiens
agtggtatgtctct

SEQ ID NO: 3306688 - DNA, 23 bp, Homo sapiens
agtggtcaggagttgtttctgac

SEQ ID NO: 3306689 - DNA, 13 bp, Homo sapiens
agtggtctttgta

SEQ ID NO: 3306690 - DNA, 14 bp, Homo sapiens
agtggtctttgtaa

SEQ ID NO: 3306691 - DNA, 15 bp, Homo sapiens
agtggtctttgtaag

SEQ ID NO: 3306692 - DNA, 17 bp, Homo sapiens
agtggtctttgtaagag

SEQ ID NO: 3306693 - DNA, 19 bp, Homo sapiens
agtggtctttgtaagagtg

SEQ ID NO: 3306694 - DNA, 20 bp, Homo sapiens
agtggtctttgtaagagtgt

SEQ ID NO: 3306695 - DNA, 21 bp, Homo sapiens
agtggtctttgtaagagtgta

SEQ ID NO: 3306696 - DNA, 14 bp, Homo sapiens
agtggtgcagacag

SEQ ID NO: 3306697 - DNA, 17 bp, Homo sapiens
agtggtggttcctttgc

SEQ ID NO: 3306698 - DNA, 14 bp, Homo sapiens
agtggttgttgcca

SEQ ID NO: 3306699 - DNA, 23 bp, Homo sapiens
agtggtttaggctatttgtaaat

SEQ ID NO: 3306700 - DNA, 18 bp, Homo sapiens
agtggttttatactgaag

SEQ ID NO: 3306701 - DNA, 11 bp, Homo sapiens
agtgtaaaata

SEQ ID NO: 3306702 - DNA, 16 bp, Homo sapiens
agtgtaacagctgagg

SEQ ID NO: 3306703 - DNA, 16 bp, Homo sapiens
agtgtacatagtgtaa

SEQ ID NO: 3306704 - DNA, 17 bp, Homo sapiens
agtgtacatcatgttat

SEQ ID NO: 3306705 - DNA, 14 bp, Homo sapiens
agtgtacctcctct

SEQ ID NO: 3306706 - DNA, 21 bp, Homo sapiens
agtgtacctcctctcagtgtt

SEQ ID NO: 3306707 - DNA, 17 bp, Homo sapiens
agtgtacttaactattc

SEQ ID NO: 3306708 - DNA, 14 bp, Homo sapiens
agtgtagaagcatt

SEQ ID NO: 3306709 - DNA, 15 bp, Homo sapiens
agtgtagaagcattc

SEQ ID NO: 3306710 - DNA, 16 bp, Homo sapiens
agtgtagaagcattcc

SEQ ID NO: 3306711 - DNA, 18 bp, Homo sapiens
agtgtagaagcattcctt

SEQ ID NO: 3306712 - DNA, 20 bp, Homo sapiens
agtgtagaagcattccttct

SEQ ID NO: 3306713 - DNA, 21 bp, Homo sapiens
agtgtagcccacacttgagag

SEQ ID NO: 3306714 - DNA, 18 bp, Homo sapiens
agtgtagcctaaagggca

SEQ ID NO: 3306715 - DNA, 14 bp, Homo sapiens
agtgtagctgtaag

SEQ ID NO: 3306716 - DNA, 20 bp, Homo sapiens
agtgtagctgtaagggcagt

SEQ ID NO: 3306717 - DNA, 21 bp, Homo sapiens
agtgtagctgtaagggcagtg

SEQ ID NO: 3306718 - DNA, 16 bp, Homo sapiens
agtgtatatttattca

SEQ ID NO: 3306719 - DNA, 20 bp, Homo sapiens
agtgtatcaggtcagggact

SEQ ID NO: 3306720 - DNA, 14 bp, Homo sapiens
agtgtatctccttt

SEQ ID NO: 3306721 - DNA, 15 bp, Homo sapiens
agtgtatgattactg

SEQ ID NO: 3306722 - DNA, 21 bp, Homo sapiens
agtgtatggaaataaatgtat

SEQ ID NO: 3306723 - DNA, 16 bp, Homo sapiens
agtgtatgtcttgtat

SEQ ID NO: 3306724 - DNA, 15 bp, Homo sapiens
agtgtcaagttgtgc

SEQ ID NO: 3306725 - DNA, 21 bp, Homo sapiens
agtgtcacttacctagattta

SEQ ID NO: 3306726 - DNA, 15 bp, Homo sapiens
agtgtcccagggccc

SEQ ID NO: 3306727 - DNA, 19 bp, Homo sapiens
agtgtcccagggccctgga

SEQ ID NO: 3306728 - DNA, 19 bp, Homo sapiens
agtgtcccctccactgtca

SEQ ID NO: 3306729 - DNA, 12 bp, Homo sapiens
agtgtcctgccc

SEQ ID NO: 3306730 - DNA, 15 bp, Homo sapiens
agtgtcctgcccatg

SEQ ID NO: 3306731 - DNA, 18 bp, Homo sapiens
agtgtcctgcccatgccc

SEQ ID NO: 3306732 - DNA, 14 bp, Homo sapiens
agtgtccttagaac

SEQ ID NO: 3306733 - DNA, 16 bp, Homo sapiens
agtgtccttagtgtat

SEQ ID NO: 3306734 - DNA, 17 bp, Homo sapiens
agtgtccttcttgctcc

SEQ ID NO: 3306735 - DNA, 17 bp, Homo sapiens
agtgtctccccgtgtcc

SEQ ID NO: 3306736 - DNA, 12 bp, Homo sapiens
agtgtctggctt

SEQ ID NO: 3306737 - DNA, 16 bp, Homo sapiens
agtgtctggctttttc

SEQ ID NO: 3306738 - DNA, 22 bp, Homo sapiens
agtgtctgtatcggagacagtg

SEQ ID NO: 3306739 - DNA, 15 bp, Homo sapiens
agtgtctttctttgg

SEQ ID NO: 3306740 - DNA, 21 bp, Homo sapiens
agtgtctttctttggtgcctt

SEQ ID NO: 3306741 - DNA, 23 bp, Homo sapiens
agtgtctttctttggtgcctttc

SEQ ID NO: 3306742 - DNA, 13 bp, Homo sapiens
agtgtgaacaaaa

SEQ ID NO: 3306743 - DNA, 11 bp, Homo sapiens
agtgtgacagg

SEQ ID NO: 3306744 - DNA, 14 bp, Homo sapiens
agtgtgacagggcc

SEQ ID NO: 3306745 - DNA, 18 bp, Homo sapiens
agtgtgagcgccttggta

SEQ ID NO: 3306746 - DNA, 15 bp, Homo sapiens
agttttgctgtctct

SEQ ID NO: 3306747 - DNA, 23 bp, Homo sapiens
agttttgtacaaagttttccttt

SEQ ID NO: 3306748 - DNA, 11 bp, Homo sapiens
agttttgtata

SEQ ID NO: 3306749 - DNA, 13 bp, Homo sapiens
agttttgtataaa

SEQ ID NO: 3306750 - DNA, 15 bp, Homo sapiens
agttttgtataaata

SEQ ID NO: 3306751 - DNA, 20 bp, Homo sapiens
agttttgtataaataataaa

SEQ ID NO: 3306752 - DNA, 17 bp, Homo sapiens
agttttgtataacttaa

SEQ ID NO: 3306753 - DNA, 12 bp, Homo sapiens
agttttgtcttg

SEQ ID NO: 3306754 - DNA, 13 bp, Homo sapiens
agttttgtcttga

SEQ ID NO: 3306755 - DNA, 14 bp, Homo sapiens
agttttgtcttgaa

SEQ ID NO: 3306756 - DNA, 12 bp, Homo sapiens
agttttgttctt

SEQ ID NO: 3306757 - DNA, 19 bp, Homo sapiens
agttttgttcttttataga

SEQ ID NO: 3306758 - DNA, 13 bp, Homo sapiens
agttttgttgtac

SEQ ID NO: 3306759 - DNA, 23 bp, Homo sapiens
agttttgttgtacttaaatggta

SEQ ID NO: 3306760 - DNA, 20 bp, Homo sapiens
agttttgtttggtttacttt

SEQ ID NO: 3306761 - DNA, 21 bp, Homo sapiens
agtttttaacaatctaacaat

SEQ ID NO: 3306762 - DNA, 15 bp, Homo sapiens
agtttttaattttaa

SEQ ID NO: 3306763 - DNA, 21 bp, Homo sapiens
agtttttacctaccacagtgt

SEQ ID NO: 3306764 - DNA, 15 bp, Homo sapiens
agtttttactgaaca

SEQ ID NO: 3306765 - DNA, 20 bp, Homo sapiens
agtttttatgcctttctctc

SEQ ID NO: 3306766 - DNA, 23 bp, Homo sapiens
agtttttatggttccaatgaaat

SEQ ID NO: 3306767 - DNA, 23 bp, Homo sapiens
agtttttcaggagcgcaagatag

SEQ ID NO: 3306768 - DNA, 21 bp, Homo sapiens
agtttttcatttgttttgctt

SEQ ID NO: 3306769 - DNA, 13 bp, Homo sapiens
agtttttctgtca

SEQ ID NO: 3306770 - DNA, 17 bp, Homo sapiens
agtttttggttgggaat

SEQ ID NO: 3306771 - DNA, 19 bp, Homo sapiens
agtttttgtactgtaaaga

SEQ ID NO: 3306772 - DNA, 13 bp, Homo sapiens
agtttttgtatct

SEQ ID NO: 3306773 - DNA, 22 bp, Homo sapiens
agtttttgtttttgcatgaaat

SEQ ID NO: 3306774 - DNA, 16 bp, Homo sapiens
agttttttttgtaaac

SEQ ID NO: 3306775 - DNA, 15 bp, Homo sapiens
agttttttttgtttg

SEQ ID NO: 3306776 - DNA, 21 bp, Homo sapiens
agttttttttgtttgcctctt

SEQ ID NO: 3306777 - DNA, 20 bp, Homo sapiens
ataaaaaaaaaaggatgaaa

SEQ ID NO: 3306778 - DNA, 14 bp, Homo sapiens
ataaaaaaataaaa

SEQ ID NO: 3306779 - DNA, 14 bp, Homo sapiens
ataaaaaagaaatc

SEQ ID NO: 3306780 - DNA, 18 bp, Homo sapiens
ataaaaaagaagcacttt

SEQ ID NO: 3306781 - DNA, 14 bp, Homo sapiens
ataaaaaagtctct

SEQ ID NO: 3306782 - DNA, 16 bp, Homo sapiens
ataaaaaagtctctat

SEQ ID NO: 3306783 - DNA, 11 bp, Homo sapiens
ataaaaaataa

SEQ ID NO: 3306784 - DNA, 14 bp, Homo sapiens
ataaaaaatctgaa

SEQ ID NO: 3306785 - DNA, 13 bp, Homo sapiens
ataaaaaatggtt

SEQ ID NO: 3306786 - DNA, 18 bp, Homo sapiens
ataaaaactaatttcata

SEQ ID NO: 3306787 - DNA, 20 bp, Homo sapiens
ataaaaacttgaaaatatat

SEQ ID NO: 3306788 - DNA, 20 bp, Homo sapiens
ataaaaagacattcttccaa

SEQ ID NO: 3306789 - DNA, 20 bp, Homo sapiens
ataaaaagcagaattttaat

SEQ ID NO: 3306790 - DNA, 22 bp, Homo sapiens
ataaaaagcctgcaatttcata

SEQ ID NO: 3306791 - DNA, 12 bp, Homo sapiens
ataaaaaggtgt

SEQ ID NO: 3306792 - DNA, 21 bp, Homo sapiens
ataaaaagtttcacaggtcaa

SEQ ID NO: 3306793 - DNA, 23 bp, Homo sapiens
ataaaaagtttcacaggtcaata

SEQ ID NO: 3306794 - DNA, 16 bp, Homo sapiens
ataaaaatatgtacaa

SEQ ID NO: 3306795 - DNA, 14 bp, Homo sapiens
ataaaaatattgtg

SEQ ID NO: 3306796 - DNA, 13 bp, Homo sapiens
ataaaaatgacag

SEQ ID NO: 3306797 - DNA, 12 bp, Homo sapiens
ataaaaatggat

SEQ ID NO: 3306798 - DNA, 14 bp, Homo sapiens
ataaaaattctgaa

SEQ ID NO: 3306799 - DNA, 21 bp, Homo sapiens
ataaaacctttcaaatttcac

SEQ ID NO: 3306800 - DNA, 22 bp, Homo sapiens
ataaaacctttcaaatttcaca

SEQ ID NO: 3306801 - DNA, 12 bp, Homo sapiens
ataaaactgcac

SEQ ID NO: 3306802 - DNA, 13 bp, Homo sapiens
ataaaactgcaca

SEQ ID NO: 3306803 - DNA, 17 bp, Homo sapiens
ataaaactttgctgcca

SEQ ID NO: 3306804 - DNA, 12 bp, Homo sapiens
ataaaagacaca

SEQ ID NO: 3306805 - DNA, 15 bp, Homo sapiens
ataaaagattcacct

SEQ ID NO: 3306806 - DNA, 20 bp, Homo sapiens
ataaaagcagcatctgctaa

SEQ ID NO: 3306807 - DNA, 15 bp, Homo sapiens
ataaaagcataaatg

SEQ ID NO: 3306808 - DNA, 18 bp, Homo sapiens
ataaaagcataaatgcaa

SEQ ID NO: 3306809 - DNA, 20 bp, Homo sapiens
ataaaagcataaatgcaaac

SEQ ID NO: 3306810 - DNA, 15 bp, Homo sapiens
ataaaagcattgtct

SEQ ID NO: 3306811 - DNA, 12 bp, Homo sapiens
ataaaagccttg

SEQ ID NO: 3306812 - DNA, 14 bp, Homo sapiens
ataaaagctataaa

SEQ ID NO: 3306813 - DNA, 19 bp, Homo sapiens
ataaaaggcaaatgtgtac

SEQ ID NO: 3306814 - DNA, 20 bp, Homo sapiens
ataaaaggcaaatgtgtaca

SEQ ID NO: 3306815 - DNA, 17 bp, Homo sapiens
ataaaagggcaaatctg

SEQ ID NO: 3306816 - DNA, 16 bp, Homo sapiens
ataaaaggtttctttt

SEQ ID NO: 3306817 - DNA, 21 bp, Homo sapiens
ataaaagtgaatgaaagatta

SEQ ID NO: 3306818 - DNA, 13 bp, Homo sapiens
ataaaagtgatca

SEQ ID NO: 3306819 - DNA, 18 bp, Homo sapiens
ataaaagtgatcaataaa

SEQ ID NO: 3306820 - DNA, 23 bp, Homo sapiens
ataaaagttaataacagctcctt

SEQ ID NO: 3306821 - DNA, 14 bp, Homo sapiens
ataaaataaaataa

SEQ ID NO: 3306822 - DNA, 19 bp, Homo sapiens
ataaaataactaaaatgta

SEQ ID NO: 3306823 - DNA, 23 bp, Homo sapiens
ataaaataatgggattttctttt

SEQ ID NO: 3306824 - DNA, 17 bp, Homo sapiens
ataaaataattctaaag

SEQ ID NO: 3306825 - DNA, 18 bp, Homo sapiens
ataaaatagttgtccata

SEQ ID NO: 3306826 - DNA, 16 bp, Homo sapiens
ataaaatatctatatt

SEQ ID NO: 3306827 - DNA, 19 bp, Homo sapiens
ataaaatatctatattcta

SEQ ID NO: 3306828 - DNA, 18 bp, Homo sapiens
ataaaatgaaaattgtat

SEQ ID NO: 3306829 - DNA, 17 bp, Homo sapiens
ataaaatggacacaaat

SEQ ID NO: 3306830 - DNA, 16 bp, Homo sapiens
ataaaatggctgtaat

SEQ ID NO: 3306831 - DNA, 16 bp, Homo sapiens
ataaaatgtattcaag

SEQ ID NO: 3306832 - DNA, 13 bp, Homo sapiens
ataaaatgtgtac

SEQ ID NO: 3306833 - DNA, 15 bp, Homo sapiens
ataaaattaaatgcc

SEQ ID NO: 3306834 - DNA, 18 bp, Homo sapiens
ataaaattattttggatt

SEQ ID NO: 3306835 - DNA, 22 bp, Homo sapiens
ataaaattctattacagtatgt

SEQ ID NO: 3306836 - DNA, 12 bp, Homo sapiens
ataaaatttaaa

SEQ ID NO: 3306837 - DNA, 14 bp, Homo sapiens
ataaaattttgctt

SEQ ID NO: 3306838 - DNA, 15 bp, Homo sapiens
ataaacaaagttact

SEQ ID NO: 3306839 - DNA, 16 bp, Homo sapiens
ataaacactggctctg

SEQ ID NO: 3306840 - DNA, 18 bp, Homo sapiens
ataaacactggctctggg

SEQ ID NO: 3306841 - DNA, 19 bp, Homo sapiens
ataaacactggctctggga

SEQ ID NO: 3306842 - DNA, 12 bp, Homo sapiens
ataaacactggt

SEQ ID NO: 3306843 - DNA, 20 bp, Homo sapiens
ataaacagactgttaattat

SEQ ID NO: 3306844 - DNA, 13 bp, Homo sapiens
ataaacagctatt

SEQ ID NO: 3306845 - DNA, 22 bp, Homo sapiens
ataaacagcttcatgcctttgt

SEQ ID NO: 3306846 - DNA, 18 bp, Homo sapiens
ataaacaggaattttatt

SEQ ID NO: 3306847 - DNA, 21 bp, Homo sapiens
ataaacagtatattctttggt

SEQ ID NO: 3306848 - DNA, 22 bp, Homo sapiens
ataaacagtggaatataaggaa

SEQ ID NO: 3306849 - DNA, 15 bp, Homo sapiens
ataaacattaaatgt

SEQ ID NO: 3306850 - DNA, 21 bp, Homo sapiens
ataaacattaattttgtgcat

SEQ ID NO: 3306851 - DNA, 15 bp, Homo sapiens
ataaacattttattt

SEQ ID NO: 3306852 - DNA, 19 bp, Homo sapiens
ataaaccaaatatgttaaa

SEQ ID NO: 3306853 - DNA, 20 bp, Homo sapiens
ataaaccatttttgttactc

SEQ ID NO: 3306854 - DNA, 16 bp, Homo sapiens
ataaacccacattctt

SEQ ID NO: 3306855 - DNA, 20 bp, Homo sapiens
ataaaccgtttttaacacat

SEQ ID NO: 3306856 - DNA, 16 bp, Homo sapiens
ataaacctcaaaatgt

SEQ ID NO: 3306857 - DNA, 15 bp, Homo sapiens
ataaacgcaagctga

SEQ ID NO: 3306858 - DNA, 19 bp, Homo sapiens
ataaactgaatattttgga

SEQ ID NO: 3306859 - DNA, 23 bp, Homo sapiens
ataaactgaatattttggaaact

SEQ ID NO: 3306860 - DNA, 12 bp, Homo sapiens
ataaactgactt

SEQ ID NO: 3306861 - DNA, 15 bp, Homo sapiens
ataaactgactttat

SEQ ID NO: 3306862 - DNA, 21 bp, Homo sapiens
ataaactggtatgaataattg

SEQ ID NO: 3306863 - DNA, 22 bp, Homo sapiens
ataaactgtattaaatcttaaa

SEQ ID NO: 3306864 - DNA, 14 bp, Homo sapiens
ataaactgtttata

SEQ ID NO: 3306865 - DNA, 17 bp, Homo sapiens
ataaacttagaggaaaa

SEQ ID NO: 3306866 - DNA, 23 bp, Homo sapiens
ataaacttagtgcggacaagttt

SEQ ID NO: 3306867 - DNA, 20 bp, Homo sapiens
ataaactttaatataaagta

SEQ ID NO: 3306868 - DNA, 16 bp, Homo sapiens
ataaactttttttcaa

SEQ ID NO: 3306869 - DNA, 17 bp, Homo sapiens
ataaagaaattgcaata

SEQ ID NO: 3306870 - DNA, 21 bp, Homo sapiens
ataaagaactccttattttgt

SEQ ID NO: 3306871 - DNA, 15 bp, Homo sapiens
ataaagaatatatat

SEQ ID NO: 3306872 - DNA, 12 bp, Homo sapiens
atacataaatag

SEQ ID NO: 3306873 - DNA, 14 bp, Homo sapiens
atacatacacttgt

SEQ ID NO: 3306874 - DNA, 14 bp, Homo sapiens
atacatatctttat

SEQ ID NO: 3306875 - DNA, 21 bp, Homo sapiens
atacatatctttattaatcac

SEQ ID NO: 3306876 - DNA, 22 bp, Homo sapiens
atacatatgagtgtggaagccg

SEQ ID NO: 3306877 - DNA, 21 bp, Homo sapiens
atacatatgtagactatatac

SEQ ID NO: 3306878 - DNA, 23 bp, Homo sapiens
atacatatgtagactatatacat

SEQ ID NO: 3306879 - DNA, 17 bp, Homo sapiens
atacatcaatttaaaaa

SEQ ID NO: 3306880 - DNA, 18 bp, Homo sapiens
atacatcactgcttgatg

SEQ ID NO: 3306881 - DNA, 15 bp, Homo sapiens
atacatctctcccca

SEQ ID NO: 3306882 - DNA, 16 bp, Homo sapiens
atacatctctccccaa

SEQ ID NO: 3306883 - DNA, 13 bp, Homo sapiens
atacatgagaaag

SEQ ID NO: 3306884 - DNA, 15 bp, Homo sapiens
atacatgagaaagat

SEQ ID NO: 3306885 - DNA, 23 bp, Homo sapiens
atacatgcgtgtacctcacttta

SEQ ID NO: 3306886 - DNA, 16 bp, Homo sapiens
atacatgtgatacatt

SEQ ID NO: 3306887 - DNA, 18 bp, Homo sapiens
atacatgtgatacatttt

SEQ ID NO: 3306888 - DNA, 21 bp, Homo sapiens
atacatgtgccgaatgtgcag

SEQ ID NO: 3306889 - DNA, 22 bp, Homo sapiens
atacattaaaactaggtaatgt

SEQ ID NO: 3306890 - DNA, 14 bp, Homo sapiens
atacattaaaagaa

SEQ ID NO: 3306891 - DNA, 14 bp, Homo sapiens
atacattgtgtgaa

SEQ ID NO: 3306892 - DNA, 20 bp, Homo sapiens
atacattgtgtgaaaaaaga

SEQ ID NO: 3306893 - DNA, 15 bp, Homo sapiens
atacatttataatgt

SEQ ID NO: 3306894 - DNA, 18 bp, Homo sapiens
atacattttgttatagaa

SEQ ID NO: 3306895 - DNA, 14 bp, Homo sapiens
ataccaagtattta

SEQ ID NO: 3306896 - DNA, 13 bp, Homo sapiens
ataccacatcaaa

SEQ ID NO: 3306897 - DNA, 15 bp, Homo sapiens
ataccacatcaaata

SEQ ID NO: 3306898 - DNA, 17 bp, Homo sapiens
ataccacctttactgtg

SEQ ID NO: 3306899 - DNA, 16 bp, Homo sapiens
ataccacttacctcaa

SEQ ID NO: 3306900 - DNA, 21 bp, Homo sapiens
ataccactttgacacgcttca

SEQ ID NO: 3306901 - DNA, 15 bp, Homo sapiens
ataccagagccttca

SEQ ID NO: 3306902 - DNA, 22 bp, Homo sapiens
ataccagagccttcaagtgcca

SEQ ID NO: 3306903 - DNA, 16 bp, Homo sapiens
ataccaggattttttt

SEQ ID NO: 3306904 - DNA, 17 bp, Homo sapiens
ataccatactcatttct

SEQ ID NO: 3306905 - DNA, 20 bp, Homo sapiens
ataccattttttaaggaaac

SEQ ID NO: 3306906 - DNA, 22 bp, Homo sapiens
ataccattttttaaggaaacaa

SEQ ID NO: 3306907 - DNA, 18 bp, Homo sapiens
atacccatagcttccatg

SEQ ID NO: 3306908 - DNA, 12 bp, Homo sapiens
ataccctccccc

SEQ ID NO: 3306909 - DNA, 18 bp, Homo sapiens
ataccctctaaaaaagaa

SEQ ID NO: 3306910 - DNA, 15 bp, Homo sapiens
atacccttcttttat

SEQ ID NO: 3306911 - DNA, 19 bp, Homo sapiens
atacccttcttttatgagc

SEQ ID NO: 3306912 - DNA, 15 bp, Homo sapiens
atacctaagtactgt

SEQ ID NO: 3306913 - DNA, 22 bp, Homo sapiens
atacctaagtactgtaataata

SEQ ID NO: 3306914 - DNA, 15 bp, Homo sapiens
atacctataatgtgt

SEQ ID NO: 3306915 - DNA, 16 bp, Homo sapiens
atacctataatgtgtg

SEQ ID NO: 3306916 - DNA, 18 bp, Homo sapiens
atacctataatgtgtgta

SEQ ID NO: 3306917 - DNA, 13 bp, Homo sapiens
atacctcatgttt

SEQ ID NO: 3306918 - DNA, 21 bp, Homo sapiens
atacctcatgtttatgaaaat

SEQ ID NO: 3306919 - DNA, 22 bp, Homo sapiens
atacctcatgtttatgaaaata

SEQ ID NO: 3306920 - DNA, 16 bp, Homo sapiens
atacctcatttttcat

SEQ ID NO: 3306921 - DNA, 19 bp, Homo sapiens
atacctcatttttcatact

SEQ ID NO: 3306922 - DNA, 18 bp, Homo sapiens
atacctccattaaatggt

SEQ ID NO: 3306923 - DNA, 12 bp, Homo sapiens
atacctctgtgt

SEQ ID NO: 3306924 - DNA, 20 bp, Homo sapiens
atacctggcttttactttat

SEQ ID NO: 3306925 - DNA, 14 bp, Homo sapiens
atacctgtcaatac

SEQ ID NO: 3306926 - DNA, 17 bp, Homo sapiens
atacctgtctcagctgt

SEQ ID NO: 3306927 - DNA, 18 bp, Homo sapiens
ataccttatatatgcact

SEQ ID NO: 3306928 - DNA, 13 bp, Homo sapiens
ataccttcttatt

SEQ ID NO: 3306929 - DNA, 13 bp, Homo sapiens
atacctttgtagt

SEQ ID NO: 3306930 - DNA, 16 bp, Homo sapiens
atacgagagcagaggt

SEQ ID NO: 3306931 - DNA, 17 bp, Homo sapiens
atacgagagcagaggtc

SEQ ID NO: 3306932 - DNA, 19 bp, Homo sapiens
atacgagagcagaggtctc

SEQ ID NO: 3306933 - DNA, 20 bp, Homo sapiens
atacgagagcagaggtctcc

SEQ ID NO: 3306934 - DNA, 23 bp, Homo sapiens
atacgcaacataattaaattttg

SEQ ID NO: 3306935 - DNA, 20 bp, Homo sapiens
atacgctactataaagagaa

SEQ ID NO: 3306936 - DNA, 13 bp, Homo sapiens
atacgtgcacagg

SEQ ID NO: 3306937 - DNA, 13 bp, Homo sapiens
atacgtgtagcta

SEQ ID NO: 3306938 - DNA, 18 bp, Homo sapiens
atacgtgttttgaattgc

SEQ ID NO: 3306939 - DNA, 21 bp, Homo sapiens
atacgtgttttgaattgcaaa

SEQ ID NO: 3306940 - DNA, 22 bp, Homo sapiens
atactaaaagcaaatctacaga

SEQ ID NO: 3306941 - DNA, 12 bp, Homo sapiens
atactaaaatat

SEQ ID NO: 3306942 - DNA, 14 bp, Homo sapiens
atactaaaatatgt

SEQ ID NO: 3306943 - DNA, 20 bp, Homo sapiens
atactaaaccaactctaata

SEQ ID NO: 3306944 - DNA, 14 bp, Homo sapiens
atactaagaaaaga

SEQ ID NO: 3306945 - DNA, 21 bp, Homo sapiens
atactaagaccctaattcttt

SEQ ID NO: 3306946 - DNA, 11 bp, Homo sapiens
atactacctct

SEQ ID NO: 3306947 - DNA, 18 bp, Homo sapiens
atactactgaaacagatt

SEQ ID NO: 3306948 - DNA, 19 bp, Homo sapiens
atactactgaaacagattt

SEQ ID NO: 3306949 - DNA, 14 bp, Homo sapiens
atactactttctct

SEQ ID NO: 3306950 - DNA, 15 bp, Homo sapiens
atactactttctctt

SEQ ID NO: 3306951 - DNA, 19 bp, Homo sapiens
atactactttctctttttc

SEQ ID NO: 3306952 - DNA, 19 bp, Homo sapiens
atactcaaatgagtaacat

SEQ ID NO: 3306953 - DNA, 12 bp, Homo sapiens
atactcagcctg

SEQ ID NO: 3306954 - DNA, 13 bp, Homo sapiens
atactcagcctgc

SEQ ID NO: 3306955 - DNA, 17 bp, Homo sapiens
atactcagcctgctgcc

SEQ ID NO: 3306956 - DNA, 15 bp, Homo sapiens
atactcatcagagca

SEQ ID NO: 3306957 - DNA, 14 bp, Homo sapiens
atactcatttctaa

SEQ ID NO: 3306958 - DNA, 16 bp, Homo sapiens
atactcatttctaaaa

SEQ ID NO: 3306959 - DNA, 20 bp, Homo sapiens
atactcatttctaaaagaat

SEQ ID NO: 3306960 - DNA, 21 bp, Homo sapiens
atactcatttctaaaagaata

SEQ ID NO: 3306961 - DNA, 17 bp, Homo sapiens
atactccagtgtacata

SEQ ID NO: 3306962 - DNA, 21 bp, Homo sapiens
atactccagtgtacatagtgt

SEQ ID NO: 3306963 - DNA, 23 bp, Homo sapiens
atactccagtgtacatagtgtaa

SEQ ID NO: 3306964 - DNA, 13 bp, Homo sapiens
atactctctgcct

SEQ ID NO: 3306965 - DNA, 15 bp, Homo sapiens
atactctgtcagatg

SEQ ID NO: 3306966 - DNA, 22 bp, Homo sapiens
atactcttaggaagagaaacca

SEQ ID NO: 3306967 - DNA, 22 bp, Homo sapiens
atactcttcctatttttgtagt

SEQ ID NO: 3306968 - DNA, 17 bp, Homo sapiens
atactctttctgtatat

SEQ ID NO: 3306969 - DNA, 20 bp, Homo sapiens
atactgaaattattttctcc

SEQ ID NO: 3306970 - DNA, 22 bp, Homo sapiens
atactgaaattattttctccaa

SEQ ID NO: 3306971 - DNA, 17 bp, Homo sapiens
atactgaatgcataaat

SEQ ID NO: 3306972 - DNA, 22 bp, Homo sapiens
atactgagggaccaactgggcc

SEQ ID NO: 3306973 - DNA, 15 bp, Homo sapiens
atactgattatgaaa

SEQ ID NO: 3306974 - DNA, 17 bp, Homo sapiens
atactgattatgtcttt

SEQ ID NO: 3306975 - DNA, 14 bp, Homo sapiens
atactgatttttaa

SEQ ID NO: 3306976 - DNA, 15 bp, Homo sapiens
atactgcagggccag

SEQ ID NO: 3306977 - DNA, 19 bp, Homo sapiens
atactgcagggccaggact

SEQ ID NO: 3306978 - DNA, 23 bp, Homo sapiens
atactgcatgtaagccaagtcat

SEQ ID NO: 3306979 - DNA, 19 bp, Homo sapiens
atactgctacagcaatttc

SEQ ID NO: 3306980 - DNA, 19 bp, Homo sapiens
atactgctactgtaatttt

SEQ ID NO: 3306981 - DNA, 22 bp, Homo sapiens
atactgctactgtaattttata

SEQ ID NO: 3306982 - DNA, 23 bp, Homo sapiens
atactgcttgaccgtactctcac

SEQ ID NO: 3306983 - DNA, 23 bp, Homo sapiens
atactgcttgcttacaatcttta

SEQ ID NO: 3306984 - DNA, 19 bp, Homo sapiens
atactggaagttttgcatt

SEQ ID NO: 3306985 - DNA, 15 bp, Homo sapiens
atactggcctggact

SEQ ID NO: 3306986 - DNA, 14 bp, Homo sapiens
atactgggtttcaa

SEQ ID NO: 3306987 - DNA, 19 bp, Homo sapiens
atactgtatgccttctgta

SEQ ID NO: 3306988 - DNA, 16 bp, Homo sapiens
atactgtatttctaag

SEQ ID NO: 3306989 - DNA, 15 bp, Homo sapiens
atactgtctgggatt

SEQ ID NO: 3306990 - DNA, 14 bp, Homo sapiens
atactgtgcagaat

SEQ ID NO: 3306991 - DNA, 19 bp, Homo sapiens
atactgtgcagaataatgg

SEQ ID NO: 3306992 - DNA, 16 bp, Homo sapiens
atacttaaatttggtt

SEQ ID NO: 3306993 - DNA, 16 bp, Homo sapiens
atacttactataattt

SEQ ID NO: 3306994 - DNA, 23 bp, Homo sapiens
atacttagaaacaaaaagagctt

SEQ ID NO: 3306995 - DNA, 14 bp, Homo sapiens
atacttatattttc

SEQ ID NO: 3306996 - DNA, 18 bp, Homo sapiens
atacttatttgtatatgg

SEQ ID NO: 3306997 - DNA, 16 bp, Homo sapiens
atacttcactacttta

SEQ ID NO: 3306998 - DNA, 14 bp, Homo sapiens
atatagagatgttt

SEQ ID NO: 3306999 - DNA, 14 bp, Homo sapiens
atatagattagaaa

SEQ ID NO: 3307000 - DNA, 17 bp, Homo sapiens
atatagattagaaaaat

SEQ ID NO: 3307001 - DNA, 17 bp, Homo sapiens
atatagcagcaaaaata

SEQ ID NO: 3307002 - DNA, 19 bp, Homo sapiens
atatagcagcaaaaatata

SEQ ID NO: 3307003 - DNA, 19 bp, Homo sapiens
atatagcattgataatctt

SEQ ID NO: 3307004 - DNA, 23 bp, Homo sapiens
atatagcattgataatcttcagg

SEQ ID NO: 3307005 - DNA, 13 bp, Homo sapiens
atatagcctgcct

SEQ ID NO: 3307006 - DNA, 16 bp, Homo sapiens
atatagcctgcctcag

SEQ ID NO: 3307007 - DNA, 20 bp, Homo sapiens
atataggaaactaagcattg

SEQ ID NO: 3307008 - DNA, 18 bp, Homo sapiens
atataggtgatgtttgct

SEQ ID NO: 3307009 - DNA, 14 bp, Homo sapiens
atatagtaaacact

SEQ ID NO: 3307010 - DNA, 12 bp, Homo sapiens
atatagttttac

SEQ ID NO: 3307011 - DNA, 16 bp, Homo sapiens
atatagttttactttt

SEQ ID NO: 3307012 - DNA, 19 bp, Homo sapiens
atatataaaaagaaaagat

SEQ ID NO: 3307013 - DNA, 21 bp, Homo sapiens
atatataaaaagaaaagataa

SEQ ID NO: 3307014 - DNA, 15 bp, Homo sapiens
atatataaagtatag

SEQ ID NO: 3307015 - DNA, 12 bp, Homo sapiens
atatataaatgt

SEQ ID NO: 3307016 - DNA, 13 bp, Homo sapiens
atatataaatgta

SEQ ID NO: 3307017 - DNA, 17 bp, Homo sapiens
atatataacagatacat

SEQ ID NO: 3307018 - DNA, 23 bp, Homo sapiens
atatataagctcagattatttaa

SEQ ID NO: 3307019 - DNA, 15 bp, Homo sapiens
atatataagtgtaca

SEQ ID NO: 3307020 - DNA, 17 bp, Homo sapiens
atatataatgttgccag

SEQ ID NO: 3307021 - DNA, 18 bp, Homo sapiens
atatatacagtaacttta

SEQ ID NO: 3307022 - DNA, 20 bp, Homo sapiens
atatatacagtaactttatg

SEQ ID NO: 3307023 - DNA, 12 bp, Homo sapiens
atatatacttgt

SEQ ID NO: 3307024 - DNA, 15 bp, Homo sapiens
atatatacttgtggt

SEQ ID NO: 3307025 - DNA, 11 bp, Homo sapiens
atatatataaa

SEQ ID NO: 3307026 - DNA, 13 bp, Homo sapiens
atatatataaaga

SEQ ID NO: 3307027 - DNA, 13 bp, Homo sapiens
atatatataaagt

SEQ ID NO: 3307028 - DNA, 16 bp, Homo sapiens
atatatataaatgtat

SEQ ID NO: 3307029 - DNA, 14 bp, Homo sapiens
atatatatacatat

SEQ ID NO: 3307030 - DNA, 13 bp, Homo sapiens
atatatatatata

SEQ ID NO: 3307031 - DNA, 14 bp, Homo sapiens
atatatatatataa

SEQ ID NO: 3307032 - DNA, 15 bp, Homo sapiens
atatatatatataaa

SEQ ID NO: 3307033 - DNA, 14 bp, Homo sapiens
atatatatatatat

SEQ ID NO: 3307034 - DNA, 16 bp, Homo sapiens
atatatatatatataa

SEQ ID NO: 3307035 - DNA, 15 bp, Homo sapiens
atatatatatatgca

SEQ ID NO: 3307036 - DNA, 17 bp, Homo sapiens
atatatattataaatat

SEQ ID NO: 3307037 - DNA, 16 bp, Homo sapiens
atatatcaaagtgaga

SEQ ID NO: 3307038 - DNA, 15 bp, Homo sapiens
atatatcatgagtga

SEQ ID NO: 3307039 - DNA, 19 bp, Homo sapiens
atatatccccactactcaa

SEQ ID NO: 3307040 - DNA, 20 bp, Homo sapiens
atatatcttatgttaaagga

SEQ ID NO: 3307041 - DNA, 13 bp, Homo sapiens
atatatgaggact

SEQ ID NO: 3307042 - DNA, 15 bp, Homo sapiens
atatatgatttatat

SEQ ID NO: 3307043 - DNA, 15 bp, Homo sapiens
atatatgcactatgt

SEQ ID NO: 3307044 - DNA, 19 bp, Homo sapiens
atatatgcactatgtatat

SEQ ID NO: 3307045 - DNA, 14 bp, Homo sapiens
atatatgccttttt

SEQ ID NO: 3307046 - DNA, 20 bp, Homo sapiens
atatatgtattatttataat

SEQ ID NO: 3307047 - DNA, 13 bp, Homo sapiens
atatatgtgtatg

SEQ ID NO: 3307048 - DNA, 16 bp, Homo sapiens
atatatgtgtgtgtat

SEQ ID NO: 3307049 - DNA, 19 bp, Homo sapiens
atatatgtgtgtgtatgtt

SEQ ID NO: 3307050 - DNA, 22 bp, Homo sapiens
atatatgttttaagaggcaggg

SEQ ID NO: 3307051 - DNA, 20 bp, Homo sapiens
atatattaaaattccaaatt

SEQ ID NO: 3307052 - DNA, 17 bp, Homo sapiens
atatattataaatatat

SEQ ID NO: 3307053 - DNA, 13 bp, Homo sapiens
atatattattgta

SEQ ID NO: 3307054 - DNA, 14 bp, Homo sapiens
atatattattgtaa

SEQ ID NO: 3307055 - DNA, 15 bp, Homo sapiens
atatattcccaatag

SEQ ID NO: 3307056 - DNA, 14 bp, Homo sapiens
atatattgtacaaa

SEQ ID NO: 3307057 - DNA, 18 bp, Homo sapiens
atatattgttgttacttt

SEQ ID NO: 3307058 - DNA, 13 bp, Homo sapiens
atatatttataac

SEQ ID NO: 3307059 - DNA, 14 bp, Homo sapiens
atatatttataact

SEQ ID NO: 3307060 - DNA, 15 bp, Homo sapiens
atatatttataactc

SEQ ID NO: 3307061 - DNA, 15 bp, Homo sapiens
atatatttcactttt

SEQ ID NO: 3307062 - DNA, 14 bp, Homo sapiens
atatatttcagata

SEQ ID NO: 3307063 - DNA, 18 bp, Homo sapiens
atatatttgaatatcatt

SEQ ID NO: 3307064 - DNA, 13 bp, Homo sapiens
atatatttgcaga

SEQ ID NO: 3307065 - DNA, 18 bp, Homo sapiens
atatatttgcagataatt

SEQ ID NO: 3307066 - DNA, 23 bp, Homo sapiens
atatatttgcagataattctgga

SEQ ID NO: 3307067 - DNA, 15 bp, Homo sapiens
atatattttcagtac

SEQ ID NO: 3307068 - DNA, 20 bp, Homo sapiens
atatattttgtgtgaaattg

SEQ ID NO: 3307069 - DNA, 16 bp, Homo sapiens
atatattttgtttaca

SEQ ID NO: 3307070 - DNA, 19 bp, Homo sapiens
atatattttttaatttgat

SEQ ID NO: 3307071 - DNA, 20 bp, Homo sapiens
atatattttttgaactttgt

SEQ ID NO: 3307072 - DNA, 22 bp, Homo sapiens
atatcaaaataggatttcttaa

SEQ ID NO: 3307073 - DNA, 16 bp, Homo sapiens
atatcaagatgattct

SEQ ID NO: 3307074 - DNA, 19 bp, Homo sapiens
atatcagaatatgattcac

SEQ ID NO: 3307075 - DNA, 18 bp, Homo sapiens
atatcagagctcttaatg

SEQ ID NO: 3307076 - DNA, 13 bp, Homo sapiens
atatcatacaaat

SEQ ID NO: 3307077 - DNA, 17 bp, Homo sapiens
atatcatataaacattt

SEQ ID NO: 3307078 - DNA, 13 bp, Homo sapiens
atatcatatgtat

SEQ ID NO: 3307079 - DNA, 23 bp, Homo sapiens
atatcatttattttttacattat

SEQ ID NO: 3307080 - DNA, 11 bp, Homo sapiens
atatcatttta

SEQ ID NO: 3307081 - DNA, 13 bp, Homo sapiens
atatcattttaaa

SEQ ID NO: 3307082 - DNA, 19 bp, Homo sapiens
atatccaaaagctttttat

SEQ ID NO: 3307083 - DNA, 15 bp, Homo sapiens
atatccaaagactgt

SEQ ID NO: 3307084 - DNA, 17 bp, Homo sapiens
atatccaaagactgtac

SEQ ID NO: 3307085 - DNA, 18 bp, Homo sapiens
atatccaaagactgtact

SEQ ID NO: 3307086 - DNA, 21 bp, Homo sapiens
atatccaagtaccaatgctgt

SEQ ID NO: 3307087 - DNA, 20 bp, Homo sapiens
atatccacatctttaagtat

SEQ ID NO: 3307088 - DNA, 16 bp, Homo sapiens
atatccatctttttct

SEQ ID NO: 3307089 - DNA, 21 bp, Homo sapiens
atatccatgacctagttttcc

SEQ ID NO: 3307090 - DNA, 11 bp, Homo sapiens
atatcccttcc

SEQ ID NO: 3307091 - DNA, 14 bp, Homo sapiens
atatcctgagccat

SEQ ID NO: 3307092 - DNA, 13 bp, Homo sapiens
atatcctgtgact

SEQ ID NO: 3307093 - DNA, 14 bp, Homo sapiens
atatcctgtgactg

SEQ ID NO: 3307094 - DNA, 17 bp, Homo sapiens
atatccttatcagagct

SEQ ID NO: 3307095 - DNA, 22 bp, Homo sapiens
atatctaaagctttggacaagt

SEQ ID NO: 3307096 - DNA, 13 bp, Homo sapiens
atatctaatatat

SEQ ID NO: 3307097 - DNA, 21 bp, Homo sapiens
atatctaccccagactagatg

SEQ ID NO: 3307098 - DNA, 14 bp, Homo sapiens
atatctatatataa

SEQ ID NO: 3307099 - DNA, 17 bp, Homo sapiens
atatctatatataattc

SEQ ID NO: 3307100 - DNA, 20 bp, Homo sapiens
atatctatatataattctgt

SEQ ID NO: 3307101 - DNA, 23 bp, Homo sapiens
atatctatatataattctgtaca

SEQ ID NO: 3307102 - DNA, 13 bp, Homo sapiens
atatctattaata

SEQ ID NO: 3307103 - DNA, 15 bp, Homo sapiens
atatctattaatata

SEQ ID NO: 3307104 - DNA, 23 bp, Homo sapiens
atatctcaatgaaccataaattc

SEQ ID NO: 3307105 - DNA, 16 bp, Homo sapiens
atatctctatttgaga

SEQ ID NO: 3307106 - DNA, 11 bp, Homo sapiens
atatctcttgg

SEQ ID NO: 3307107 - DNA, 16 bp, Homo sapiens
atatctcttggaaaat

SEQ ID NO: 3307108 - DNA, 20 bp, Homo sapiens
atatctcttggaaaataaga

SEQ ID NO: 3307109 - DNA, 15 bp, Homo sapiens
atatctcttgtgctt

SEQ ID NO: 3307110 - DNA, 16 bp, Homo sapiens
atatctgaaaatgtat

SEQ ID NO: 3307111 - DNA, 16 bp, Homo sapiens
atatctgcttcagtgg

SEQ ID NO: 3307112 - DNA, 13 bp, Homo sapiens
atatctggcactg

SEQ ID NO: 3307113 - DNA, 21 bp, Homo sapiens
atatctggcctaaaatcttgg

SEQ ID NO: 3307114 - DNA, 13 bp, Homo sapiens
atatctgtaatga

SEQ ID NO: 3307115 - DNA, 14 bp, Homo sapiens
atatcttaaagaaa

SEQ ID NO: 3307116 - DNA, 20 bp, Homo sapiens
atatcttcaagcctgggcgt

SEQ ID NO: 3307117 - DNA, 17 bp, Homo sapiens
atatcttcacattgtgt

SEQ ID NO: 3307118 - DNA, 19 bp, Homo sapiens
atatcttctgatttgtccc

SEQ ID NO: 3307119 - DNA, 22 bp, Homo sapiens
atatcttgctggattaatgttt

SEQ ID NO: 3307120 - DNA, 14 bp, Homo sapiens
atatctttattcac

SEQ ID NO: 3307121 - DNA, 24 bp, Homo sapiens
atatctttattcaccttttcttca

SEQ ID NO: 3307122 - DNA, 13 bp, Homo sapiens
atatcttttggtt

SEQ ID NO: 3307123 - DNA, 14 bp, Homo sapiens
atatcttttggtta

SEQ ID NO: 3307124 - DNA, 18 bp, Homo sapiens
atatgaaactctacattt

SEQ ID NO: 3307125 - DNA, 12 bp, Homo sapiens
atatgaacatag

SEQ ID NO: 3307126 - DNA, 20 bp, Homo sapiens
atcaaaaggttaataaagta

SEQ ID NO: 3307127 - DNA, 14 bp, Homo sapiens
atcaaaataaaaag

SEQ ID NO: 3307128 - DNA, 20 bp, Homo sapiens
atcaaaataggatttcttaa

SEQ ID NO: 3307129 - DNA, 21 bp, Homo sapiens
atcaaaataggatttcttaaa

SEQ ID NO: 3307130 - DNA, 22 bp, Homo sapiens
atcaaacagccccagtcttcct

SEQ ID NO: 3307131 - DNA, 20 bp, Homo sapiens
atcaaaccctagccttgctt

SEQ ID NO: 3307132 - DNA, 21 bp, Homo sapiens
atcaaaccctagccttgcttg

SEQ ID NO: 3307133 - DNA, 15 bp, Homo sapiens
atcaaagaattacag

SEQ ID NO: 3307134 - DNA, 20 bp, Homo sapiens
atcaaagtcaaaaatagcaa

SEQ ID NO: 3307135 - DNA, 15 bp, Homo sapiens
atcaaataaatttct

SEQ ID NO: 3307136 - DNA, 18 bp, Homo sapiens
atcaaataagtatttata

SEQ ID NO: 3307137 - DNA, 19 bp, Homo sapiens
atcaaataagtatttataa

SEQ ID NO: 3307138 - DNA, 20 bp, Homo sapiens
atcaaatagaaccactatga

SEQ ID NO: 3307139 - DNA, 15 bp, Homo sapiens
atcaaatatagaaag

SEQ ID NO: 3307140 - DNA, 16 bp, Homo sapiens
atcaaatatagaaagt

SEQ ID NO: 3307141 - DNA, 14 bp, Homo sapiens
atcaaatctcctgc

SEQ ID NO: 3307142 - DNA, 17 bp, Homo sapiens
atcaaatctcctgctga

SEQ ID NO: 3307143 - DNA, 21 bp, Homo sapiens
atcaaatctgtatatgttgta

SEQ ID NO: 3307144 - DNA, 22 bp, Homo sapiens
atcaaatctgtatatgttgtaa

SEQ ID NO: 3307145 - DNA, 15 bp, Homo sapiens
atcaaatgatttcat

SEQ ID NO: 3307146 - DNA, 17 bp, Homo sapiens
atcaaatgatttcatat

SEQ ID NO: 3307147 - DNA, 15 bp, Homo sapiens
atcaacaagatttcc

SEQ ID NO: 3307148 - DNA, 23 bp, Homo sapiens
atcaaccacctatttttgacatg

SEQ ID NO: 3307149 - DNA, 18 bp, Homo sapiens
atcaagaaatactttcga

SEQ ID NO: 3307150 - DNA, 23 bp, Homo sapiens
atcaagaatggggatcacagaga

SEQ ID NO: 3307151 - DNA, 18 bp, Homo sapiens
atcaagagttttggagat

SEQ ID NO: 3307152 - DNA, 14 bp, Homo sapiens
atcaagattttagg

SEQ ID NO: 3307153 - DNA, 17 bp, Homo sapiens
atcaagcaggaattatg

SEQ ID NO: 3307154 - DNA, 18 bp, Homo sapiens
atcaagcaggaattatgt

SEQ ID NO: 3307155 - DNA, 19 bp, Homo sapiens
atcaagcaggaattatgtc

SEQ ID NO: 3307156 - DNA, 13 bp, Homo sapiens
atcaagcttttct

SEQ ID NO: 3307157 - DNA, 15 bp, Homo sapiens
atcaagcttttctgt

SEQ ID NO: 3307158 - DNA, 19 bp, Homo sapiens
atcaagcttttctgtagat

SEQ ID NO: 3307159 - DNA, 22 bp, Homo sapiens
atcaaggaagaaatggttcaga

SEQ ID NO: 3307160 - DNA, 19 bp, Homo sapiens
atcaagtcaatcatttctc

SEQ ID NO: 3307161 - DNA, 17 bp, Homo sapiens
atcaagtcccaaattca

SEQ ID NO: 3307162 - DNA, 17 bp, Homo sapiens
atcaataaaatgtgatt

SEQ ID NO: 3307163 - DNA, 10 bp, Homo sapiens
atcaataaat

SEQ ID NO: 3307164 - DNA, 19 bp, Homo sapiens
atcaatacactagttgttt

SEQ ID NO: 3307165 - DNA, 15 bp, Homo sapiens
atcaatcaaataagt

SEQ ID NO: 3307166 - DNA, 19 bp, Homo sapiens
atcaatcatctgtgtgaaa

SEQ ID NO: 3307167 - DNA, 22 bp, Homo sapiens
atcaatccttcttatgtttgct

SEQ ID NO: 3307168 - DNA, 14 bp, Homo sapiens
atcaatgagtaaca

SEQ ID NO: 3307169 - DNA, 17 bp, Homo sapiens
atcaatgtgtctttcta

SEQ ID NO: 3307170 - DNA, 18 bp, Homo sapiens
atcaatgttcattgtaat

SEQ ID NO: 3307171 - DNA, 21 bp, Homo sapiens
atcaattaacatcgtgggtca

SEQ ID NO: 3307172 - DNA, 16 bp, Homo sapiens
atcaattatagtttct

SEQ ID NO: 3307173 - DNA, 19 bp, Homo sapiens
atcaattggcagtgacttt

SEQ ID NO: 3307174 - DNA, 21 bp, Homo sapiens
atcaattggcagtgactttgt

SEQ ID NO: 3307175 - DNA, 18 bp, Homo sapiens
atcaatttaaaaagcaaa

SEQ ID NO: 3307176 - DNA, 19 bp, Homo sapiens
atcaatttaaaaagcaaaa

SEQ ID NO: 3307177 - DNA, 17 bp, Homo sapiens
atcaatttaagtgttgg

SEQ ID NO: 3307178 - DNA, 20 bp, Homo sapiens
atcaattttcattaaacttg

SEQ ID NO: 3307179 - DNA, 22 bp, Homo sapiens
atcaattttcattaaacttgaa

SEQ ID NO: 3307180 - DNA, 22 bp, Homo sapiens
atcaattttgacttaatgtgat

SEQ ID NO: 3307181 - DNA, 13 bp, Homo sapiens
atcacaaaaattt

SEQ ID NO: 3307182 - DNA, 13 bp, Homo sapiens
atcacaatacaga

SEQ ID NO: 3307183 - DNA, 16 bp, Homo sapiens
atcacaccactgtact

SEQ ID NO: 3307184 - DNA, 22 bp, Homo sapiens
atcacagagacattcctccgag

SEQ ID NO: 3307185 - DNA, 14 bp, Homo sapiens
atcacagcctccag

SEQ ID NO: 3307186 - DNA, 16 bp, Homo sapiens
atcacagcctccaggg

SEQ ID NO: 3307187 - DNA, 17 bp, Homo sapiens
atcacaggatgccagcc

SEQ ID NO: 3307188 - DNA, 19 bp, Homo sapiens
atcacaggatgccagcccc

SEQ ID NO: 3307189 - DNA, 12 bp, Homo sapiens
atcacagggcag

SEQ ID NO: 3307190 - DNA, 19 bp, Homo sapiens
atcacagggcagagccggg

SEQ ID NO: 3307191 - DNA, 22 bp, Homo sapiens
atcacagggccccagaaggcag

SEQ ID NO: 3307192 - DNA, 20 bp, Homo sapiens
atcacaggggcggggcagga

SEQ ID NO: 3307193 - DNA, 20 bp, Homo sapiens
atcacagggttgggcccaga

SEQ ID NO: 3307194 - DNA, 23 bp, Homo sapiens
atcacagggttgggcccagatct

SEQ ID NO: 3307195 - DNA, 15 bp, Homo sapiens
atcacattatttgca

SEQ ID NO: 3307196 - DNA, 14 bp, Homo sapiens
atcacatttctatg

SEQ ID NO: 3307197 - DNA, 15 bp, Homo sapiens
atcaccagcccggcc

SEQ ID NO: 3307198 - DNA, 16 bp, Homo sapiens
atcaccataacctctg

SEQ ID NO: 3307199 - DNA, 17 bp, Homo sapiens
atcaccataacctctgg

SEQ ID NO: 3307200 - DNA, 14 bp, Homo sapiens
atcaccattatatt

SEQ ID NO: 3307201 - DNA, 16 bp, Homo sapiens
atcaccctttccggca

SEQ ID NO: 3307202 - DNA, 22 bp, Homo sapiens
atcaccgacgcgtctcctgttt

SEQ ID NO: 3307203 - DNA, 22 bp, Homo sapiens
atcacctatttccattcaacaa

SEQ ID NO: 3307204 - DNA, 12 bp, Homo sapiens
atcacctcaggc

SEQ ID NO: 3307205 - DNA, 13 bp, Homo sapiens
atcacctctctgt

SEQ ID NO: 3307206 - DNA, 15 bp, Homo sapiens
atcacgccactgcac

SEQ ID NO: 3307207 - DNA, 13 bp, Homo sapiens
atcacgctccccg

SEQ ID NO: 3307208 - DNA, 23 bp, Homo sapiens
atcacgctccccgcctgttcccc

SEQ ID NO: 3307209 - DNA, 22 bp, Homo sapiens
atcacggctcactgcagcctca

SEQ ID NO: 3307210 - DNA, 16 bp, Homo sapiens
atcacggtggtaaaga

SEQ ID NO: 3307211 - DNA, 17 bp, Homo sapiens
atcacgtaccccactgg

SEQ ID NO: 3307212 - DNA, 21 bp, Homo sapiens
atcacgtctgacaaatgtgta

SEQ ID NO: 3307213 - DNA, 13 bp, Homo sapiens
atcactaaacttt

SEQ ID NO: 3307214 - DNA, 14 bp, Homo sapiens
atcactaacattat

SEQ ID NO: 3307215 - DNA, 20 bp, Homo sapiens
atcactaatactaattcatt

SEQ ID NO: 3307216 - DNA, 12 bp, Homo sapiens
atcactcccatt

SEQ ID NO: 3307217 - DNA, 22 bp, Homo sapiens
atcactctaaaaaacattttta

SEQ ID NO: 3307218 - DNA, 13 bp, Homo sapiens
atcactctgtcct

SEQ ID NO: 3307219 - DNA, 23 bp, Homo sapiens
atcactcttgtactgcctgccac

SEQ ID NO: 3307220 - DNA, 13 bp, Homo sapiens
atcactgaaacaa

SEQ ID NO: 3307221 - DNA, 20 bp, Homo sapiens
atcactgaacaaactaaagg

SEQ ID NO: 3307222 - DNA, 20 bp, Homo sapiens
atcactgaatttataaagta

SEQ ID NO: 3307223 - DNA, 11 bp, Homo sapiens
atcactgcagc

SEQ ID NO: 3307224 - DNA, 12 bp, Homo sapiens
atcactgccaca

SEQ ID NO: 3307225 - DNA, 19 bp, Homo sapiens
atcactgccacactctcca

SEQ ID NO: 3307226 - DNA, 22 bp, Homo sapiens
atcactgccacactctccatca

SEQ ID NO: 3307227 - DNA, 19 bp, Homo sapiens
atcactgcttgatgaagca

SEQ ID NO: 3307228 - DNA, 21 bp, Homo sapiens
atcactgcttgatgaagcaag

SEQ ID NO: 3307229 - DNA, 10 bp, Homo sapiens
atcactggag

SEQ ID NO: 3307230 - DNA, 15 bp, Homo sapiens
atcactggagcccag

SEQ ID NO: 3307231 - DNA, 16 bp, Homo sapiens
atcactggagcccagg

SEQ ID NO: 3307232 - DNA, 18 bp, Homo sapiens
atcactggcaatgaaaaa

SEQ ID NO: 3307233 - DNA, 22 bp, Homo sapiens
atcactggcaatgaaaaattct

SEQ ID NO: 3307234 - DNA, 14 bp, Homo sapiens
atcactgtttttag

SEQ ID NO: 3307235 - DNA, 16 bp, Homo sapiens
atcacttcatgttttg

SEQ ID NO: 3307236 - DNA, 17 bp, Homo sapiens
atcacttcatgttttgt

SEQ ID NO: 3307237 - DNA, 14 bp, Homo sapiens
atcacttccatgac

SEQ ID NO: 3307238 - DNA, 20 bp, Homo sapiens
atcactttctcagttttcat

SEQ ID NO: 3307239 - DNA, 16 bp, Homo sapiens
atcactttgtctaact

SEQ ID NO: 3307240 - DNA, 19 bp, Homo sapiens
atcactttgttaaaaatat

SEQ ID NO: 3307241 - DNA, 13 bp, Homo sapiens
atcacttttcagt

SEQ ID NO: 3307242 - DNA, 13 bp, Homo sapiens
atcagaaaaggga

SEQ ID NO: 3307243 - DNA, 21 bp, Homo sapiens
atcagaaatgtcatcaaatat

SEQ ID NO: 3307244 - DNA, 14 bp, Homo sapiens
atcagaacagcaga

SEQ ID NO: 3307245 - DNA, 13 bp, Homo sapiens
atcagaacatgaa

SEQ ID NO: 3307246 - DNA, 19 bp, Homo sapiens
atcagaacattcagctctg

SEQ ID NO: 3307247 - DNA, 23 bp, Homo sapiens
atcagaacattcagctctggaga

SEQ ID NO: 3307248 - DNA, 17 bp, Homo sapiens
atcagaatatcagaata

SEQ ID NO: 3307249 - DNA, 12 bp, Homo sapiens
atcagaattctc

SEQ ID NO: 3307250 - DNA, 12 bp, Homo sapiens
atcagacaagca

SEQ ID NO: 3307251 - DNA, 16 bp, Homo sapiens
atcagaccataatgtt

SEQ ID NO: 3307252 - DNA, 22 bp, Homo sapiens
atccctcgggaagcagccagct

SEQ ID NO: 3307253 - DNA, 15 bp, Homo sapiens
atccctgaggactga

SEQ ID NO: 3307254 - DNA, 14 bp, Homo sapiens
atccctgcctggtc

SEQ ID NO: 3307255 - DNA, 15 bp, Homo sapiens
atccctgcctggtca

SEQ ID NO: 3307256 - DNA, 16 bp, Homo sapiens
atccctgcggcctcca

SEQ ID NO: 3307257 - DNA, 17 bp, Homo sapiens
atccctggagcaggagc

SEQ ID NO: 3307258 - DNA, 11 bp, Homo sapiens
atccctggccc

SEQ ID NO: 3307259 - DNA, 16 bp, Homo sapiens
atccctggccccctcc

SEQ ID NO: 3307260 - DNA, 17 bp, Homo sapiens
atccctgggcattgctt

SEQ ID NO: 3307261 - DNA, 21 bp, Homo sapiens
atccctgtttaatatttaaac

SEQ ID NO: 3307262 - DNA, 22 bp, Homo sapiens
atccctgtttaatatttaaaca

SEQ ID NO: 3307263 - DNA, 15 bp, Homo sapiens
atcccttaagaagtt

SEQ ID NO: 3307264 - DNA, 16 bp, Homo sapiens
atcccttcctggaaac

SEQ ID NO: 3307265 - DNA, 17 bp, Homo sapiens
atcccttcctggaaaca

SEQ ID NO: 3307266 - DNA, 21 bp, Homo sapiens
atcccttcctggaaacagcat

SEQ ID NO: 3307267 - DNA, 22 bp, Homo sapiens
atcccttcctggaaacagcatg

SEQ ID NO: 3307268 - DNA, 20 bp, Homo sapiens
atccctttacaatgtgaata

SEQ ID NO: 3307269 - DNA, 12 bp, Homo sapiens
atcccttttcct

SEQ ID NO: 3307270 - DNA, 16 bp, Homo sapiens
atcccttttcctgtca

SEQ ID NO: 3307271 - DNA, 20 bp, Homo sapiens
atcccttttcctgtcagtgt

SEQ ID NO: 3307272 - DNA, 21 bp, Homo sapiens
atccgactctaagctgtgtgc

SEQ ID NO: 3307273 - DNA, 13 bp, Homo sapiens
atccggaaagaag

SEQ ID NO: 3307274 - DNA, 18 bp, Homo sapiens
atccgtcattgctgctgc

SEQ ID NO: 3307275 - DNA, 22 bp, Homo sapiens
atccgtgtatttggctgggcta

SEQ ID NO: 3307276 - DNA, 21 bp, Homo sapiens
atcctaagatgtgttcttatt

SEQ ID NO: 3307277 - DNA, 21 bp, Homo sapiens
atcctaagctattcagtaata

SEQ ID NO: 3307278 - DNA, 21 bp, Homo sapiens
atcctaagggtcgaaagctct

SEQ ID NO: 3307279 - DNA, 23 bp, Homo sapiens
atcctaagggtcgaaagctctag

SEQ ID NO: 3307280 - DNA, 15 bp, Homo sapiens
atcctaatttctcct

SEQ ID NO: 3307281 - DNA, 20 bp, Homo sapiens
atcctaatttctcctccctt

SEQ ID NO: 3307282 - DNA, 15 bp, Homo sapiens
atcctacaatatttt

SEQ ID NO: 3307283 - DNA, 11 bp, Homo sapiens
atcctacagta

SEQ ID NO: 3307284 - DNA, 15 bp, Homo sapiens
atcctacagtacaat

SEQ ID NO: 3307285 - DNA, 17 bp, Homo sapiens
atcctacagtacaatca

SEQ ID NO: 3307286 - DNA, 13 bp, Homo sapiens
atcctagacttga

SEQ ID NO: 3307287 - DNA, 20 bp, Homo sapiens
atcctagacttgaaagtttt

SEQ ID NO: 3307288 - DNA, 16 bp, Homo sapiens
atcctagatcctaagg

SEQ ID NO: 3307289 - DNA, 17 bp, Homo sapiens
atcctagattatatcaa

SEQ ID NO: 3307290 - DNA, 23 bp, Homo sapiens
atcctagattatatcaaagtatt

SEQ ID NO: 3307291 - DNA, 20 bp, Homo sapiens
atcctagtcattcttcccta

SEQ ID NO: 3307292 - DNA, 19 bp, Homo sapiens
atcctataagcttaaatag

SEQ ID NO: 3307293 - DNA, 19 bp, Homo sapiens
atcctatcaacaacaaggt

SEQ ID NO: 3307294 - DNA, 19 bp, Homo sapiens
atcctatctggggagctcc

SEQ ID NO: 3307295 - DNA, 19 bp, Homo sapiens
atcctcaaagaaagtgtat

SEQ ID NO: 3307296 - DNA, 20 bp, Homo sapiens
atcctcaaagaaagtgtatt

SEQ ID NO: 3307297 - DNA, 17 bp, Homo sapiens
atcctcagttggaatca

SEQ ID NO: 3307298 - DNA, 21 bp, Homo sapiens
atcctcattgcctcctgttct

SEQ ID NO: 3307299 - DNA, 18 bp, Homo sapiens
atcctccacatcctgtgt

SEQ ID NO: 3307300 - DNA, 20 bp, Homo sapiens
atcctccacatcctgtgtca

SEQ ID NO: 3307301 - DNA, 11 bp, Homo sapiens
atcctccagct

SEQ ID NO: 3307302 - DNA, 21 bp, Homo sapiens
atcctccagtaccttgcttct

SEQ ID NO: 3307303 - DNA, 19 bp, Homo sapiens
atcctcccacctcagcctc

SEQ ID NO: 3307304 - DNA, 17 bp, Homo sapiens
atcctcctcagccccca

SEQ ID NO: 3307305 - DNA, 15 bp, Homo sapiens
atcctcctccagggt

SEQ ID NO: 3307306 - DNA, 11 bp, Homo sapiens
atcctcctccc

SEQ ID NO: 3307307 - DNA, 14 bp, Homo sapiens
atcctcctggaacc

SEQ ID NO: 3307308 - DNA, 22 bp, Homo sapiens
atcctcctggaaccttgctgtc

SEQ ID NO: 3307309 - DNA, 14 bp, Homo sapiens
atcctctattttgt

SEQ ID NO: 3307310 - DNA, 15 bp, Homo sapiens
atcctctccactcca

SEQ ID NO: 3307311 - DNA, 16 bp, Homo sapiens
atcctctcctttgaaa

SEQ ID NO: 3307312 - DNA, 18 bp, Homo sapiens
atcctctgagtgtgacca

SEQ ID NO: 3307313 - DNA, 14 bp, Homo sapiens
atcctctgctggtt

SEQ ID NO: 3307314 - DNA, 19 bp, Homo sapiens
atcctctgctggttcctga

SEQ ID NO: 3307315 - DNA, 22 bp, Homo sapiens
atcctcttctgcttaggagaga

SEQ ID NO: 3307316 - DNA, 13 bp, Homo sapiens
atcctctttgtaa

SEQ ID NO: 3307317 - DNA, 17 bp, Homo sapiens
atcctgaactttctccc

SEQ ID NO: 3307318 - DNA, 19 bp, Homo sapiens
atcctgaactttctccctc

SEQ ID NO: 3307319 - DNA, 16 bp, Homo sapiens
atcctgaatctgtgca

SEQ ID NO: 3307320 - DNA, 16 bp, Homo sapiens
atcctgaggctccact

SEQ ID NO: 3307321 - DNA, 20 bp, Homo sapiens
atcctgcagcctcctcctga

SEQ ID NO: 3307322 - DNA, 20 bp, Homo sapiens
atcctgcaggaacgagcact

SEQ ID NO: 3307323 - DNA, 18 bp, Homo sapiens
atcctgccaccctgtagc

SEQ ID NO: 3307324 - DNA, 21 bp, Homo sapiens
atcctgccagccccacacagc

SEQ ID NO: 3307325 - DNA, 13 bp, Homo sapiens
atcctgccattta

SEQ ID NO: 3307326 - DNA, 14 bp, Homo sapiens
atcctgcccagtgt

SEQ ID NO: 3307327 - DNA, 21 bp, Homo sapiens
atcctgcccagtgttgtttgt

SEQ ID NO: 3307328 - DNA, 18 bp, Homo sapiens
atcctgccctggaggaag

SEQ ID NO: 3307329 - DNA, 11 bp, Homo sapiens
atcctgcctgg

SEQ ID NO: 3307330 - DNA, 16 bp, Homo sapiens
atcctgcgggtggggc

SEQ ID NO: 3307331 - DNA, 11 bp, Homo sapiens
atcctgctggg

SEQ ID NO: 3307332 - DNA, 20 bp, Homo sapiens
atcctggaggggtgttgtat

SEQ ID NO: 3307333 - DNA, 16 bp, Homo sapiens
atcctggattcactca

SEQ ID NO: 3307334 - DNA, 20 bp, Homo sapiens
atcctggattcactcactca

SEQ ID NO: 3307335 - DNA, 17 bp, Homo sapiens
atcctggcacccggccc

SEQ ID NO: 3307336 - DNA, 19 bp, Homo sapiens
atcctggcacccggcccct

SEQ ID NO: 3307337 - DNA, 21 bp, Homo sapiens
atcctggcacccggcccctgc

SEQ ID NO: 3307338 - DNA, 21 bp, Homo sapiens
atcctggcacgccctactcca

SEQ ID NO: 3307339 - DNA, 11 bp, Homo sapiens
atcctggcagc

SEQ ID NO: 3307340 - DNA, 16 bp, Homo sapiens
atcctggcagcccaga

SEQ ID NO: 3307341 - DNA, 20 bp, Homo sapiens
atcctggcagcccagagact

SEQ ID NO: 3307342 - DNA, 18 bp, Homo sapiens
atcctggctctgtggctt

SEQ ID NO: 3307343 - DNA, 19 bp, Homo sapiens
atcctggggcagcactccc

SEQ ID NO: 3307344 - DNA, 19 bp, Homo sapiens
atcctggtaaccaaatatt

SEQ ID NO: 3307345 - DNA, 17 bp, Homo sapiens
atcctgtaccaaatctg

SEQ ID NO: 3307346 - DNA, 21 bp, Homo sapiens
atcctgtaccaaatctgacat

SEQ ID NO: 3307347 - DNA, 17 bp, Homo sapiens
atcctgtataagcactg

SEQ ID NO: 3307348 - DNA, 21 bp, Homo sapiens
atcctgtattcttcaaccagt

SEQ ID NO: 3307349 - DNA, 23 bp, Homo sapiens
atcctgtctttctgagcacactt

SEQ ID NO: 3307350 - DNA, 16 bp, Homo sapiens
atcctgtgacatgtaa

SEQ ID NO: 3307351 - DNA, 19 bp, Homo sapiens
atccttagaggtcctctgg

SEQ ID NO: 3307352 - DNA, 21 bp, Homo sapiens
atccttagaggtcctctggag

SEQ ID NO: 3307353 - DNA, 20 bp, Homo sapiens
atccttcacaggcagtgcat

SEQ ID NO: 3307354 - DNA, 21 bp, Homo sapiens
atccttcacaggcagtgcatg

SEQ ID NO: 3307355 - DNA, 18 bp, Homo sapiens
atccttccaaaaattatt

SEQ ID NO: 3307356 - DNA, 20 bp, Homo sapiens
atccttccaaaaattattat

SEQ ID NO: 3307357 - DNA, 20 bp, Homo sapiens
atccttccaaagaattctta

SEQ ID NO: 3307358 - DNA, 17 bp, Homo sapiens
atccttccagtggctcg

SEQ ID NO: 3307359 - DNA, 22 bp, Homo sapiens
atccttccagtggctcgctccc

SEQ ID NO: 3307360 - DNA, 21 bp, Homo sapiens
atccttccccaacttccctag

SEQ ID NO: 3307361 - DNA, 15 bp, Homo sapiens
atccttcctataact

SEQ ID NO: 3307362 - DNA, 22 bp, Homo sapiens
atccttcggggcgatgctccct

SEQ ID NO: 3307363 - DNA, 19 bp, Homo sapiens
atccttcgtgaacatcccc

SEQ ID NO: 3307364 - DNA, 22 bp, Homo sapiens
atccttgatgcaagtgcaacct

SEQ ID NO: 3307365 - DNA, 15 bp, Homo sapiens
atccttggtctttgt

SEQ ID NO: 3307366 - DNA, 19 bp, Homo sapiens
atccttggtctttgtatct

SEQ ID NO: 3307367 - DNA, 21 bp, Homo sapiens
atccttgtctgaatgtattta

SEQ ID NO: 3307368 - DNA, 17 bp, Homo sapiens
atcctttacgtgtttaa

SEQ ID NO: 3307369 - DNA, 15 bp, Homo sapiens
atcctttgcagggca

SEQ ID NO: 3307370 - DNA, 17 bp, Homo sapiens
atcctttttccatcatt

SEQ ID NO: 3307371 - DNA, 18 bp, Homo sapiens
atcctttttctttataaa

SEQ ID NO: 3307372 - DNA, 15 bp, Homo sapiens
atccttttttgtcat

SEQ ID NO: 3307373 - DNA, 17 bp, Homo sapiens
atccttttttgtcattt

SEQ ID NO: 3307374 - DNA, 17 bp, Homo sapiens
atcgaaaattcatttca

SEQ ID NO: 3307375 - DNA, 20 bp, Homo sapiens
atcgaaataacaatgttaag

SEQ ID NO: 3307376 - DNA, 15 bp, Homo sapiens
atcgaaccgttttga

SEQ ID NO: 3307377 - DNA, 20 bp, Homo sapiens
atctcctataatctgtcaaa

SEQ ID NO: 3307378 - DNA, 20 bp, Homo sapiens
atctcctatttttttaaaat

SEQ ID NO: 3307379 - DNA, 12 bp, Homo sapiens
atctcctgctct

SEQ ID NO: 3307380 - DNA, 18 bp, Homo sapiens
atctcctgtgatcctttg

SEQ ID NO: 3307381 - DNA, 18 bp, Homo sapiens
atctcctgtgcatgggtg

SEQ ID NO: 3307382 - DNA, 15 bp, Homo sapiens
atctccttgactgcc

SEQ ID NO: 3307383 - DNA, 15 bp, Homo sapiens
atctcctttcaggga

SEQ ID NO: 3307384 - DNA, 12 bp, Homo sapiens
atctcggctcac

SEQ ID NO: 3307385 - DNA, 22 bp, Homo sapiens
atctcggttctgcgccacttcc

SEQ ID NO: 3307386 - DNA, 13 bp, Homo sapiens
atctcgttcccaa

SEQ ID NO: 3307387 - DNA, 14 bp, Homo sapiens
atctcgttcccaaa

SEQ ID NO: 3307388 - DNA, 15 bp, Homo sapiens
atctctaatatggca

SEQ ID NO: 3307389 - DNA, 14 bp, Homo sapiens
atctctaccccttt

SEQ ID NO: 3307390 - DNA, 16 bp, Homo sapiens
atctctacccctttct

SEQ ID NO: 3307391 - DNA, 14 bp, Homo sapiens
atctctcaaaactt

SEQ ID NO: 3307392 - DNA, 16 bp, Homo sapiens
atctctcaggagcaca

SEQ ID NO: 3307393 - DNA, 22 bp, Homo sapiens
atctctcaggagcacaggcagc

SEQ ID NO: 3307394 - DNA, 12 bp, Homo sapiens
atctctcatcct

SEQ ID NO: 3307395 - DNA, 17 bp, Homo sapiens
atctctcatcctccagt

SEQ ID NO: 3307396 - DNA, 21 bp, Homo sapiens
atctctcatcctccagtacct

SEQ ID NO: 3307397 - DNA, 14 bp, Homo sapiens
atctctccctcccc

SEQ ID NO: 3307398 - DNA, 15 bp, Homo sapiens
atctctccctcccct

SEQ ID NO: 3307399 - DNA, 23 bp, Homo sapiens
atctctccctcccctgccatttt

SEQ ID NO: 3307400 - DNA, 12 bp, Homo sapiens
atctctcctggc

SEQ ID NO: 3307401 - DNA, 14 bp, Homo sapiens
atctctcctggcct

SEQ ID NO: 3307402 - DNA, 22 bp, Homo sapiens
atctctcctggcctatccgctg

SEQ ID NO: 3307403 - DNA, 22 bp, Homo sapiens
atctctctactcctacctcagc

SEQ ID NO: 3307404 - DNA, 23 bp, Homo sapiens
atctctctactcctacctcagcc

SEQ ID NO: 3307405 - DNA, 14 bp, Homo sapiens
atctctctctgtgt

SEQ ID NO: 3307406 - DNA, 22 bp, Homo sapiens
atctctctgaatcctaagggct

SEQ ID NO: 3307407 - DNA, 16 bp, Homo sapiens
atctctctggggccct

SEQ ID NO: 3307408 - DNA, 20 bp, Homo sapiens
atctctctggggccctgggc

SEQ ID NO: 3307409 - DNA, 12 bp, Homo sapiens
atctctcttcca

SEQ ID NO: 3307410 - DNA, 13 bp, Homo sapiens
atctctgaaagca

SEQ ID NO: 3307411 - DNA, 19 bp, Homo sapiens
atctctgaagcatgtttca

SEQ ID NO: 3307412 - DNA, 20 bp, Homo sapiens
atctctgcctagaatcttta

SEQ ID NO: 3307413 - DNA, 21 bp, Homo sapiens
atctctgcctagaatctttat

SEQ ID NO: 3307414 - DNA, 17 bp, Homo sapiens
atctctgctctctatgt

SEQ ID NO: 3307415 - DNA, 18 bp, Homo sapiens
atctctgtactttgcttg

SEQ ID NO: 3307416 - DNA, 15 bp, Homo sapiens
atctctgtgccttcg

SEQ ID NO: 3307417 - DNA, 16 bp, Homo sapiens
atctcttattttacaa

SEQ ID NO: 3307418 - DNA, 19 bp, Homo sapiens
atctcttattttacaataa

SEQ ID NO: 3307419 - DNA, 20 bp, Homo sapiens
atctcttcattcaaactgca

SEQ ID NO: 3307420 - DNA, 17 bp, Homo sapiens
atctcttgcttgtcatt

SEQ ID NO: 3307421 - DNA, 18 bp, Homo sapiens
atctcttggaaaataaga

SEQ ID NO: 3307422 - DNA, 20 bp, Homo sapiens
atctcttggaaaataagaca

SEQ ID NO: 3307423 - DNA, 17 bp, Homo sapiens
atctctttcacattgtt

SEQ ID NO: 3307424 - DNA, 10 bp, Homo sapiens
atctcttttc

SEQ ID NO: 3307425 - DNA, 15 bp, Homo sapiens
atctctttttgtttg

SEQ ID NO: 3307426 - DNA, 16 bp, Homo sapiens
atctctttttgtttgc

SEQ ID NO: 3307427 - DNA, 22 bp, Homo sapiens
atctgaaaatgtatgtgtaagt

SEQ ID NO: 3307428 - DNA, 23 bp, Homo sapiens
atctgaaaatgtatgtgtaagta

SEQ ID NO: 3307429 - DNA, 21 bp, Homo sapiens
atctgaaacccacagatgtct

SEQ ID NO: 3307430 - DNA, 14 bp, Homo sapiens
atctgaactctcaa

SEQ ID NO: 3307431 - DNA, 22 bp, Homo sapiens
atctgaagaggcttctcctgtt

SEQ ID NO: 3307432 - DNA, 17 bp, Homo sapiens
atctgaagatatatttc

SEQ ID NO: 3307433 - DNA, 15 bp, Homo sapiens
atctgaagccctccc

SEQ ID NO: 3307434 - DNA, 22 bp, Homo sapiens
atctgaatgaaaataactgaac

SEQ ID NO: 3307435 - DNA, 17 bp, Homo sapiens
atctgaattaaataaat

SEQ ID NO: 3307436 - DNA, 13 bp, Homo sapiens
atctgacatatta

SEQ ID NO: 3307437 - DNA, 17 bp, Homo sapiens
atctgacatattatgcc

SEQ ID NO: 3307438 - DNA, 12 bp, Homo sapiens
atctgactgcca

SEQ ID NO: 3307439 - DNA, 14 bp, Homo sapiens
atctgagggaggag

SEQ ID NO: 3307440 - DNA, 14 bp, Homo sapiens
atctgagttgccaa

SEQ ID NO: 3307441 - DNA, 23 bp, Homo sapiens
atctgagttgccaagacaaatca

SEQ ID NO: 3307442 - DNA, 17 bp, Homo sapiens
atctgatcacttcatgt

SEQ ID NO: 3307443 - DNA, 18 bp, Homo sapiens
atctgattggacattttc

SEQ ID NO: 3307444 - DNA, 11 bp, Homo sapiens
atctgcaaaag

SEQ ID NO: 3307445 - DNA, 21 bp, Homo sapiens
atctgcaaaaggcctcttgta

SEQ ID NO: 3307446 - DNA, 22 bp, Homo sapiens
atctgcaaaaggcctcttgtaa

SEQ ID NO: 3307447 - DNA, 15 bp, Homo sapiens
atctgcaatatgaat

SEQ ID NO: 3307448 - DNA, 20 bp, Homo sapiens
atctgcacacacctccgaga

SEQ ID NO: 3307449 - DNA, 21 bp, Homo sapiens
atctgcaccccttctctcctc

SEQ ID NO: 3307450 - DNA, 21 bp, Homo sapiens
atctgcaccctcgatgaagcc

SEQ ID NO: 3307451 - DNA, 22 bp, Homo sapiens
atctgcagaacatcgatatgta

SEQ ID NO: 3307452 - DNA, 19 bp, Homo sapiens
atctgcagtacagtcttat

SEQ ID NO: 3307453 - DNA, 20 bp, Homo sapiens
atctgcagttctttttgtac

SEQ ID NO: 3307454 - DNA, 11 bp, Homo sapiens
atctgcattta

SEQ ID NO: 3307455 - DNA, 16 bp, Homo sapiens
atctgcatttagcaca

SEQ ID NO: 3307456 - DNA, 16 bp, Homo sapiens
atctgcccaggggtgc

SEQ ID NO: 3307457 - DNA, 22 bp, Homo sapiens
atctgcccaggggtgccccctc

SEQ ID NO: 3307458 - DNA, 11 bp, Homo sapiens
atctgcccctc

SEQ ID NO: 3307459 - DNA, 13 bp, Homo sapiens
atctgcctggcct

SEQ ID NO: 3307460 - DNA, 19 bp, Homo sapiens
atctgcctggcctggctcc

SEQ ID NO: 3307461 - DNA, 11 bp, Homo sapiens
atctgcctggg

SEQ ID NO: 3307462 - DNA, 21 bp, Homo sapiens
atctgcctgggcctgtgcagc

SEQ ID NO: 3307463 - DNA, 22 bp, Homo sapiens
atctgcggatctcagctttgag

SEQ ID NO: 3307464 - DNA, 23 bp, Homo sapiens
atctgcggatctcagctttgaga

SEQ ID NO: 3307465 - DNA, 14 bp, Homo sapiens
atctgctaataaaa

SEQ ID NO: 3307466 - DNA, 18 bp, Homo sapiens
atctgctaccaaaacagt

SEQ ID NO: 3307467 - DNA, 14 bp, Homo sapiens
atctgctcacttta

SEQ ID NO: 3307468 - DNA, 18 bp, Homo sapiens
atctgctggagtttcatg

SEQ ID NO: 3307469 - DNA, 15 bp, Homo sapiens
atctgctgtatatgg

SEQ ID NO: 3307470 - DNA, 17 bp, Homo sapiens
atctgctgttgccatag

SEQ ID NO: 3307471 - DNA, 14 bp, Homo sapiens
atctgcttcagtgg

SEQ ID NO: 3307472 - DNA, 17 bp, Homo sapiens
atctgcttggttggctg

SEQ ID NO: 3307473 - DNA, 14 bp, Homo sapiens
atctgcttttatta

SEQ ID NO: 3307474 - DNA, 21 bp, Homo sapiens
atctggaatctggagaccagg

SEQ ID NO: 3307475 - DNA, 17 bp, Homo sapiens
atctggacagaacattt

SEQ ID NO: 3307476 - DNA, 15 bp, Homo sapiens
atctggactcctctg

SEQ ID NO: 3307477 - DNA, 17 bp, Homo sapiens
atctggactcctctgtc

SEQ ID NO: 3307478 - DNA, 18 bp, Homo sapiens
atctggactcctctgtcc

SEQ ID NO: 3307479 - DNA, 22 bp, Homo sapiens
atctggactcctctgtccaggc

SEQ ID NO: 3307480 - DNA, 20 bp, Homo sapiens
atctggagctggcactgtgg

SEQ ID NO: 3307481 - DNA, 14 bp, Homo sapiens
atctggcactgtta

SEQ ID NO: 3307482 - DNA, 20 bp, Homo sapiens
atctggcctaaaatcttgga

SEQ ID NO: 3307483 - DNA, 21 bp, Homo sapiens
atctggcctaaaatcttggaa

SEQ ID NO: 3307484 - DNA, 12 bp, Homo sapiens
atctggcctggc

SEQ ID NO: 3307485 - DNA, 15 bp, Homo sapiens
atctggcctggcctg

SEQ ID NO: 3307486 - DNA, 16 bp, Homo sapiens
atctggcctggcctgg

SEQ ID NO: 3307487 - DNA, 18 bp, Homo sapiens
atctggcctggcctggcc

SEQ ID NO: 3307488 - DNA, 23 bp, Homo sapiens
atctggcctggcctggccctgcc

SEQ ID NO: 3307489 - DNA, 19 bp, Homo sapiens
atctggctcctttacaaaa

SEQ ID NO: 3307490 - DNA, 21 bp, Homo sapiens
atctggctcctttacaaaaga

SEQ ID NO: 3307491 - DNA, 22 bp, Homo sapiens
atctggctgcagttttgctatc

SEQ ID NO: 3307492 - DNA, 16 bp, Homo sapiens
atctggcttagtgcca

SEQ ID NO: 3307493 - DNA, 17 bp, Homo sapiens
atctggcttattttaat

SEQ ID NO: 3307494 - DNA, 21 bp, Homo sapiens
atctggcttattttaatgtga

SEQ ID NO: 3307495 - DNA, 18 bp, Homo sapiens
atctgggagtcccctttt

SEQ ID NO: 3307496 - DNA, 21 bp, Homo sapiens
atctgggattattctttgaaa

SEQ ID NO: 3307497 - DNA, 12 bp, Homo sapiens
atctgggcctgg

SEQ ID NO: 3307498 - DNA, 17 bp, Homo sapiens
atctgggctgtgggcaa

SEQ ID NO: 3307499 - DNA, 15 bp, Homo sapiens
atctggggagctcct

SEQ ID NO: 3307500 - DNA, 16 bp, Homo sapiens
atctggggagctcctg

SEQ ID NO: 3307501 - DNA, 17 bp, Homo sapiens
atctggggagctcctgg

SEQ ID NO: 3307502 - DNA, 18 bp, Homo sapiens
atctggggagctcctggc

SEQ ID NO: 3307503 - DNA, 13 bp, Homo sapiens
atgaatcactgtt

SEQ ID NO: 3307504 - DNA, 19 bp, Homo sapiens
atgaatcactgtttttaga

SEQ ID NO: 3307505 - DNA, 21 bp, Homo sapiens
atgaatcccacccacatgtga

SEQ ID NO: 3307506 - DNA, 20 bp, Homo sapiens
atgaatctcccactccagcg

SEQ ID NO: 3307507 - DNA, 16 bp, Homo sapiens
atgaatctgctcactt

SEQ ID NO: 3307508 - DNA, 18 bp, Homo sapiens
atgaatctgctcacttta

SEQ ID NO: 3307509 - DNA, 16 bp, Homo sapiens
atgaatgagaatctac

SEQ ID NO: 3307510 - DNA, 18 bp, Homo sapiens
atgaatgcaaaattgttt

SEQ ID NO: 3307511 - DNA, 16 bp, Homo sapiens
atgaatgcttttagtg

SEQ ID NO: 3307512 - DNA, 16 bp, Homo sapiens
atgaatgtatattttg

SEQ ID NO: 3307513 - DNA, 13 bp, Homo sapiens
atgaatgtatcag

SEQ ID NO: 3307514 - DNA, 17 bp, Homo sapiens
atgaatgtatgtgcact

SEQ ID NO: 3307515 - DNA, 15 bp, Homo sapiens
atgaatgtatttatt

SEQ ID NO: 3307516 - DNA, 17 bp, Homo sapiens
atgaatgtatttatttg

SEQ ID NO: 3307517 - DNA, 11 bp, Homo sapiens
atgaatgttta

SEQ ID NO: 3307518 - DNA, 14 bp, Homo sapiens
atgaattaaagtgg

SEQ ID NO: 3307519 - DNA, 14 bp, Homo sapiens
atgaattaaataaa

SEQ ID NO: 3307520 - DNA, 17 bp, Homo sapiens
atgaattaaatattgaa

SEQ ID NO: 3307521 - DNA, 19 bp, Homo sapiens
atgaattcaagaaaggaaa

SEQ ID NO: 3307522 - DNA, 22 bp, Homo sapiens
atgaattcccttttaatcaact

SEQ ID NO: 3307523 - DNA, 12 bp, Homo sapiens
atgaattcttta

SEQ ID NO: 3307524 - DNA, 13 bp, Homo sapiens
atgaattgcattt

SEQ ID NO: 3307525 - DNA, 14 bp, Homo sapiens
atgaattgtacaga

SEQ ID NO: 3307526 - DNA, 22 bp, Homo sapiens
atgaattgtacagaatatttct

SEQ ID NO: 3307527 - DNA, 16 bp, Homo sapiens
atgaatttaaatataa

SEQ ID NO: 3307528 - DNA, 15 bp, Homo sapiens
atgaatttggagact

SEQ ID NO: 3307529 - DNA, 21 bp, Homo sapiens
atgaatttggagactctgtgg

SEQ ID NO: 3307530 - DNA, 15 bp, Homo sapiens
atgaattttaaagta

SEQ ID NO: 3307531 - DNA, 16 bp, Homo sapiens
atgaattttaaagtat

SEQ ID NO: 3307532 - DNA, 17 bp, Homo sapiens
atgacaaaaaatgtttt

SEQ ID NO: 3307533 - DNA, 18 bp, Homo sapiens
atgacaaatgtattaatg

SEQ ID NO: 3307534 - DNA, 14 bp, Homo sapiens
atgacaaattatat

SEQ ID NO: 3307535 - DNA, 17 bp, Homo sapiens
atgacaaattggggctg

SEQ ID NO: 3307536 - DNA, 21 bp, Homo sapiens
atgacaacagaaaaacaatct

SEQ ID NO: 3307537 - DNA, 15 bp, Homo sapiens
atgacaccatctttt

SEQ ID NO: 3307538 - DNA, 16 bp, Homo sapiens
atgacaccatctttta

SEQ ID NO: 3307539 - DNA, 22 bp, Homo sapiens
atgacaccatcttttattcttt

SEQ ID NO: 3307540 - DNA, 20 bp, Homo sapiens
atgacacccaccctgtgcca

SEQ ID NO: 3307541 - DNA, 22 bp, Homo sapiens
atgacacccgtgagcgcctgtg

SEQ ID NO: 3307542 - DNA, 14 bp, Homo sapiens
atgacaccctggcc

SEQ ID NO: 3307543 - DNA, 15 bp, Homo sapiens
atgacaccctggcct

SEQ ID NO: 3307544 - DNA, 17 bp, Homo sapiens
atgacacctccatttct

SEQ ID NO: 3307545 - DNA, 20 bp, Homo sapiens
atgacagatatatttaagcc

SEQ ID NO: 3307546 - DNA, 19 bp, Homo sapiens
atgacagatggtgaagtaa

SEQ ID NO: 3307547 - DNA, 19 bp, Homo sapiens
atgacagccatttgtaatg

SEQ ID NO: 3307548 - DNA, 17 bp, Homo sapiens
atgacaggcctgaagat

SEQ ID NO: 3307549 - DNA, 19 bp, Homo sapiens
atgacaggcctgaagatat

SEQ ID NO: 3307550 - DNA, 22 bp, Homo sapiens
atgacaggcctgaagatattac

SEQ ID NO: 3307551 - DNA, 16 bp, Homo sapiens
atgacaggtaaattaa

SEQ ID NO: 3307552 - DNA, 18 bp, Homo sapiens
atgacatcacttgtacaa

SEQ ID NO: 3307553 - DNA, 20 bp, Homo sapiens
atgacatcacttgtacaaaa

SEQ ID NO: 3307554 - DNA, 18 bp, Homo sapiens
atgacatgaacaatgtgt

SEQ ID NO: 3307555 - DNA, 14 bp, Homo sapiens
atgacatgcactga

SEQ ID NO: 3307556 - DNA, 16 bp, Homo sapiens
atgacatgcactgacc

SEQ ID NO: 3307557 - DNA, 15 bp, Homo sapiens
atgacatgttatata

SEQ ID NO: 3307558 - DNA, 22 bp, Homo sapiens
atgacatttaaatgtaacttat

SEQ ID NO: 3307559 - DNA, 21 bp, Homo sapiens
atgacattttttttaactact

SEQ ID NO: 3307560 - DNA, 15 bp, Homo sapiens
atgaccaaagtcctt

SEQ ID NO: 3307561 - DNA, 21 bp, Homo sapiens
atgaccagggatgctgggctg

SEQ ID NO: 3307562 - DNA, 12 bp, Homo sapiens
atgacccacccc

SEQ ID NO: 3307563 - DNA, 13 bp, Homo sapiens
atgacccacccct

SEQ ID NO: 3307564 - DNA, 14 bp, Homo sapiens
atgacccacccctg

SEQ ID NO: 3307565 - DNA, 17 bp, Homo sapiens
atgacccacccctgtgc

SEQ ID NO: 3307566 - DNA, 12 bp, Homo sapiens
atgacccagacc

SEQ ID NO: 3307567 - DNA, 23 bp, Homo sapiens
atgaccctgcgaaggggccctgg

SEQ ID NO: 3307568 - DNA, 19 bp, Homo sapiens
atgacctcaagtagcactg

SEQ ID NO: 3307569 - DNA, 18 bp, Homo sapiens
atgacctcttcctttagg

SEQ ID NO: 3307570 - DNA, 17 bp, Homo sapiens
atgaccttcctcctcct

SEQ ID NO: 3307571 - DNA, 17 bp, Homo sapiens
atgaccttggggtacaa

SEQ ID NO: 3307572 - DNA, 13 bp, Homo sapiens
atgaccttttgga

SEQ ID NO: 3307573 - DNA, 21 bp, Homo sapiens
atgacgccagataaaatgttc

SEQ ID NO: 3307574 - DNA, 18 bp, Homo sapiens
atgacgcggctcaaaagg

SEQ ID NO: 3307575 - DNA, 17 bp, Homo sapiens
atgacgctgatacataa

SEQ ID NO: 3307576 - DNA, 19 bp, Homo sapiens
atgacggaagaacatagaa

SEQ ID NO: 3307577 - DNA, 17 bp, Homo sapiens
atgactaaagagagaat

SEQ ID NO: 3307578 - DNA, 21 bp, Homo sapiens
atgactaaagagagaatgtag

SEQ ID NO: 3307579 - DNA, 23 bp, Homo sapiens
atgactaattagggtacatttat

SEQ ID NO: 3307580 - DNA, 15 bp, Homo sapiens
atgactataaacatt

SEQ ID NO: 3307581 - DNA, 16 bp, Homo sapiens
atgactataaacatta

SEQ ID NO: 3307582 - DNA, 23 bp, Homo sapiens
atgactataaacattaaaagaag

SEQ ID NO: 3307583 - DNA, 16 bp, Homo sapiens
atgactcgggggtggg

SEQ ID NO: 3307584 - DNA, 16 bp, Homo sapiens
atgactctttctgaag

SEQ ID NO: 3307585 - DNA, 13 bp, Homo sapiens
atgactgaatggg

SEQ ID NO: 3307586 - DNA, 13 bp, Homo sapiens
atgactgattact

SEQ ID NO: 3307587 - DNA, 15 bp, Homo sapiens
atgactggctgtctg

SEQ ID NO: 3307588 - DNA, 20 bp, Homo sapiens
atgactggctgtctgcctgt

SEQ ID NO: 3307589 - DNA, 21 bp, Homo sapiens
atgactggctgtctgcctgta

SEQ ID NO: 3307590 - DNA, 10 bp, Homo sapiens
atgactgggc

SEQ ID NO: 3307591 - DNA, 12 bp, Homo sapiens
atgactgggcct

SEQ ID NO: 3307592 - DNA, 11 bp, Homo sapiens
atgactgttga

SEQ ID NO: 3307593 - DNA, 18 bp, Homo sapiens
atgactgtttttgtagtg

SEQ ID NO: 3307594 - DNA, 18 bp, Homo sapiens
atgacttatttctgctct

SEQ ID NO: 3307595 - DNA, 21 bp, Homo sapiens
atgacttatttctgctctgga

SEQ ID NO: 3307596 - DNA, 16 bp, Homo sapiens
atgacttccctgctcc

SEQ ID NO: 3307597 - DNA, 16 bp, Homo sapiens
atgacttgctactttt

SEQ ID NO: 3307598 - DNA, 17 bp, Homo sapiens
atgagaaacagctcagc

SEQ ID NO: 3307599 - DNA, 13 bp, Homo sapiens
atgagaacaaaca

SEQ ID NO: 3307600 - DNA, 16 bp, Homo sapiens
atgagaacaaagctgt

SEQ ID NO: 3307601 - DNA, 17 bp, Homo sapiens
atgagaacaaagctgtt

SEQ ID NO: 3307602 - DNA, 20 bp, Homo sapiens
atgagaacaaagctgttaaa

SEQ ID NO: 3307603 - DNA, 17 bp, Homo sapiens
atgagaacaagtcacag

SEQ ID NO: 3307604 - DNA, 21 bp, Homo sapiens
atgagaacaagtcacagctgc

SEQ ID NO: 3307605 - DNA, 15 bp, Homo sapiens
atgagactctagggt

SEQ ID NO: 3307606 - DNA, 17 bp, Homo sapiens
atgagactctagggtcc

SEQ ID NO: 3307607 - DNA, 19 bp, Homo sapiens
atgagagagagactgtgtg

SEQ ID NO: 3307608 - DNA, 14 bp, Homo sapiens
atgagagcccagag

SEQ ID NO: 3307609 - DNA, 18 bp, Homo sapiens
atgagagcccagaggtaa

SEQ ID NO: 3307610 - DNA, 17 bp, Homo sapiens
atgagatattaaattct

SEQ ID NO: 3307611 - DNA, 22 bp, Homo sapiens
atgagatggttaaaaaggccaa

SEQ ID NO: 3307612 - DNA, 18 bp, Homo sapiens
atgagattgttttatcat

SEQ ID NO: 3307613 - DNA, 16 bp, Homo sapiens
atgagatttgccagca

SEQ ID NO: 3307614 - DNA, 16 bp, Homo sapiens
atgagatttttaaaaa

SEQ ID NO: 3307615 - DNA, 16 bp, Homo sapiens
atgagattttttttaa

SEQ ID NO: 3307616 - DNA, 14 bp, Homo sapiens
atgagcacctccat

SEQ ID NO: 3307617 - DNA, 16 bp, Homo sapiens
atgagcatcagagagt

SEQ ID NO: 3307618 - DNA, 22 bp, Homo sapiens
atgagcatcagagagtgtacat

SEQ ID NO: 3307619 - DNA, 16 bp, Homo sapiens
atgagcatcctgagcc

SEQ ID NO: 3307620 - DNA, 18 bp, Homo sapiens
atgagcatcctgagcccc

SEQ ID NO: 3307621 - DNA, 18 bp, Homo sapiens
atgagcatgcattttctt

SEQ ID NO: 3307622 - DNA, 22 bp, Homo sapiens
atgagcatttgtttgaccccag

SEQ ID NO: 3307623 - DNA, 23 bp, Homo sapiens
atgagcatttgtttgaccccagt

SEQ ID NO: 3307624 - DNA, 11 bp, Homo sapiens
atgagccagac

SEQ ID NO: 3307625 - DNA, 16 bp, Homo sapiens
atgagcccagagaaca

SEQ ID NO: 3307626 - DNA, 17 bp, Homo sapiens
atgagcccagagaacag

SEQ ID NO: 3307627 - DNA, 20 bp, Homo sapiens
atgagccgctgtgagcccct

SEQ ID NO: 3307628 - DNA, 23 bp, Homo sapiens
atgagccgctgtgagcccctggt

SEQ ID NO: 3307629 - DNA, 23 bp, Homo sapiens
atgcaacgggattgaagggtcct

SEQ ID NO: 3307630 - DNA, 20 bp, Homo sapiens
atgcaagaaaaaaacttact

SEQ ID NO: 3307631 - DNA, 22 bp, Homo sapiens
atgcaaggaccaggactccctc

SEQ ID NO: 3307632 - DNA, 12 bp, Homo sapiens
atgcaaggatta

SEQ ID NO: 3307633 - DNA, 20 bp, Homo sapiens
atgcaaggattacagaaact

SEQ ID NO: 3307634 - DNA, 14 bp, Homo sapiens
atgcaagtctgtga

SEQ ID NO: 3307635 - DNA, 16 bp, Homo sapiens
atgcaagtctgtgagt

SEQ ID NO: 3307636 - DNA, 24 bp, Homo sapiens
atgcaatgtaagcatactttgtaa

SEQ ID NO: 3307637 - DNA, 17 bp, Homo sapiens
atgcaatgtgctactga

SEQ ID NO: 3307638 - DNA, 21 bp, Homo sapiens
atgcaattaggtttttcctta

SEQ ID NO: 3307639 - DNA, 17 bp, Homo sapiens
atgcaatttcctttttt

SEQ ID NO: 3307640 - DNA, 17 bp, Homo sapiens
atgcaatttgattgact

SEQ ID NO: 3307641 - DNA, 10 bp, Homo sapiens
atgcacacac

SEQ ID NO: 3307642 - DNA, 21 bp, Homo sapiens
atgcacacacacacgctttct

SEQ ID NO: 3307643 - DNA, 21 bp, Homo sapiens
atgcacacgggaaagccttaa

SEQ ID NO: 3307644 - DNA, 22 bp, Homo sapiens
atgcacactagcctctccagga

SEQ ID NO: 3307645 - DNA, 19 bp, Homo sapiens
atgcacagtatcttttctt

SEQ ID NO: 3307646 - DNA, 17 bp, Homo sapiens
atgcacatttctggatt

SEQ ID NO: 3307647 - DNA, 21 bp, Homo sapiens
atgcaccaccaagccaaggga

SEQ ID NO: 3307648 - DNA, 20 bp, Homo sapiens
atgcaccctcatacacagaa

SEQ ID NO: 3307649 - DNA, 20 bp, Homo sapiens
atgcacctagctgtgcaaga

SEQ ID NO: 3307650 - DNA, 16 bp, Homo sapiens
atgcaccttgtgtctg

SEQ ID NO: 3307651 - DNA, 20 bp, Homo sapiens
atgcactatatgtttacaca

SEQ ID NO: 3307652 - DNA, 13 bp, Homo sapiens
atgcactatgagg

SEQ ID NO: 3307653 - DNA, 16 bp, Homo sapiens
atgcactatgaggaat

SEQ ID NO: 3307654 - DNA, 23 bp, Homo sapiens
atgcactgaaaacttagccagag

SEQ ID NO: 3307655 - DNA, 23 bp, Homo sapiens
atgcactgacccttccagacata

SEQ ID NO: 3307656 - DNA, 12 bp, Homo sapiens
atgcactgtttt

SEQ ID NO: 3307657 - DNA, 17 bp, Homo sapiens
atgcagaaccacaaaca

SEQ ID NO: 3307658 - DNA, 18 bp, Homo sapiens
atgcagaaccacaaacaa

SEQ ID NO: 3307659 - DNA, 19 bp, Homo sapiens
atgcagaaccacaaacaat

SEQ ID NO: 3307660 - DNA, 18 bp, Homo sapiens
atgcagaagcatattttg

SEQ ID NO: 3307661 - DNA, 23 bp, Homo sapiens
atgcagaagcatattttgctggt

SEQ ID NO: 3307662 - DNA, 19 bp, Homo sapiens
atgcagacaacaccttcct

SEQ ID NO: 3307663 - DNA, 21 bp, Homo sapiens
atgcagacaacaccttcctcc

SEQ ID NO: 3307664 - DNA, 18 bp, Homo sapiens
atgcagactcctcagatc

SEQ ID NO: 3307665 - DNA, 13 bp, Homo sapiens
atgcagagagcca

SEQ ID NO: 3307666 - DNA, 14 bp, Homo sapiens
atgcagagagccat

SEQ ID NO: 3307667 - DNA, 21 bp, Homo sapiens
atgcagagagccattttgtga

SEQ ID NO: 3307668 - DNA, 22 bp, Homo sapiens
atgcagagagccattttgtgaa

SEQ ID NO: 3307669 - DNA, 21 bp, Homo sapiens
atgcagagcgccgtgagttct

SEQ ID NO: 3307670 - DNA, 15 bp, Homo sapiens
atgcagaggaggtga

SEQ ID NO: 3307671 - DNA, 17 bp, Homo sapiens
atgcagatagaatcaat

SEQ ID NO: 3307672 - DNA, 17 bp, Homo sapiens
atgcagattcctgggcc

SEQ ID NO: 3307673 - DNA, 21 bp, Homo sapiens
atgcagattcctgggcctgtc

SEQ ID NO: 3307674 - DNA, 19 bp, Homo sapiens
atgcagccgccttccttga

SEQ ID NO: 3307675 - DNA, 12 bp, Homo sapiens
atgcagcctgct

SEQ ID NO: 3307676 - DNA, 13 bp, Homo sapiens
atgcagcctgctc

SEQ ID NO: 3307677 - DNA, 14 bp, Homo sapiens
atgcaggaaggaaa

SEQ ID NO: 3307678 - DNA, 16 bp, Homo sapiens
atgcaggacaggaggc

SEQ ID NO: 3307679 - DNA, 22 bp, Homo sapiens
atgcaggagcttctgggagatt

SEQ ID NO: 3307680 - DNA, 14 bp, Homo sapiens
atgcaggcatgctt

SEQ ID NO: 3307681 - DNA, 22 bp, Homo sapiens
atgcaggccctttgaagcctca

SEQ ID NO: 3307682 - DNA, 18 bp, Homo sapiens
atgcagggaagagggcag

SEQ ID NO: 3307683 - DNA, 17 bp, Homo sapiens
atgcagggaggggaggc

SEQ ID NO: 3307684 - DNA, 18 bp, Homo sapiens
atgcaggggtcagtgcag

SEQ ID NO: 3307685 - DNA, 21 bp, Homo sapiens
atgcaggttggaaggggcctt

SEQ ID NO: 3307686 - DNA, 15 bp, Homo sapiens
atgcagtaacattct

SEQ ID NO: 3307687 - DNA, 11 bp, Homo sapiens
atgcagtcctg

SEQ ID NO: 3307688 - DNA, 14 bp, Homo sapiens
atgcagttcctggc

SEQ ID NO: 3307689 - DNA, 15 bp, Homo sapiens
atgcagttcctggcc

SEQ ID NO: 3307690 - DNA, 15 bp, Homo sapiens
atgcataaaatatat

SEQ ID NO: 3307691 - DNA, 14 bp, Homo sapiens
atgcataaatgcat

SEQ ID NO: 3307692 - DNA, 17 bp, Homo sapiens
atgcatagagccctggc

SEQ ID NO: 3307693 - DNA, 18 bp, Homo sapiens
atgcatagagccctggcc

SEQ ID NO: 3307694 - DNA, 17 bp, Homo sapiens
atgcatattgattctga

SEQ ID NO: 3307695 - DNA, 17 bp, Homo sapiens
atgcatcgggaaagaag

SEQ ID NO: 3307696 - DNA, 18 bp, Homo sapiens
atgcatcgggaaagaaga

SEQ ID NO: 3307697 - DNA, 13 bp, Homo sapiens
atgcatgaacaag

SEQ ID NO: 3307698 - DNA, 19 bp, Homo sapiens
atgcatgcttctttataaa

SEQ ID NO: 3307699 - DNA, 12 bp, Homo sapiens
atgcattaaacc

SEQ ID NO: 3307700 - DNA, 20 bp, Homo sapiens
atgcattaaacctgtctcca

SEQ ID NO: 3307701 - DNA, 23 bp, Homo sapiens
atgcattcacatttagaaaagtg

SEQ ID NO: 3307702 - DNA, 16 bp, Homo sapiens
atgcattgaaagaatt

SEQ ID NO: 3307703 - DNA, 19 bp, Homo sapiens
atgcattgttggctatttg

SEQ ID NO: 3307704 - DNA, 21 bp, Homo sapiens
atgcattgttggctatttgaa

SEQ ID NO: 3307705 - DNA, 14 bp, Homo sapiens
atgcatttaataaa

SEQ ID NO: 3307706 - DNA, 16 bp, Homo sapiens
atgcatttaataaaga

SEQ ID NO: 3307707 - DNA, 12 bp, Homo sapiens
atgcatttcaaa

SEQ ID NO: 3307708 - DNA, 15 bp, Homo sapiens
atgcatttcaaatgt

SEQ ID NO: 3307709 - DNA, 13 bp, Homo sapiens
atgcatttcattc

SEQ ID NO: 3307710 - DNA, 23 bp, Homo sapiens
atgcatttgaggtcaagtaagaa

SEQ ID NO: 3307711 - DNA, 16 bp, Homo sapiens
atgccaatactagtca

SEQ ID NO: 3307712 - DNA, 23 bp, Homo sapiens
atgccaatactagtcaccccaag

SEQ ID NO: 3307713 - DNA, 17 bp, Homo sapiens
atgccaatattaaatct

SEQ ID NO: 3307714 - DNA, 16 bp, Homo sapiens
atgccaattattgtta

SEQ ID NO: 3307715 - DNA, 16 bp, Homo sapiens
atgccacacagagtgg

SEQ ID NO: 3307716 - DNA, 18 bp, Homo sapiens
atgccacacagagtggtc

SEQ ID NO: 3307717 - DNA, 15 bp, Homo sapiens
atgccacacctggcc

SEQ ID NO: 3307718 - DNA, 15 bp, Homo sapiens
atgccaccctcacac

SEQ ID NO: 3307719 - DNA, 17 bp, Homo sapiens
atgccaccctcacacac

SEQ ID NO: 3307720 - DNA, 19 bp, Homo sapiens
atgccaccctgttttcagc

SEQ ID NO: 3307721 - DNA, 21 bp, Homo sapiens
atgccacgttccacagttgcc

SEQ ID NO: 3307722 - DNA, 16 bp, Homo sapiens
atgccactcctccctc

SEQ ID NO: 3307723 - DNA, 18 bp, Homo sapiens
atgccactcctccctccg

SEQ ID NO: 3307724 - DNA, 13 bp, Homo sapiens
atgccactgccag

SEQ ID NO: 3307725 - DNA, 17 bp, Homo sapiens
atgccactgccaggcac

SEQ ID NO: 3307726 - DNA, 19 bp, Homo sapiens
atgccactgccaggcacct

SEQ ID NO: 3307727 - DNA, 17 bp, Homo sapiens
atgccactgccttcgct

SEQ ID NO: 3307728 - DNA, 18 bp, Homo sapiens
atgccactgccttcgctt

SEQ ID NO: 3307729 - DNA, 12 bp, Homo sapiens
atgccagcccct

SEQ ID NO: 3307730 - DNA, 17 bp, Homo sapiens
atgccagcccctgcctg

SEQ ID NO: 3307731 - DNA, 20 bp, Homo sapiens
atgccagcccctgcctgggt

SEQ ID NO: 3307732 - DNA, 12 bp, Homo sapiens
atgccagccctt

SEQ ID NO: 3307733 - DNA, 16 bp, Homo sapiens
atgccagctacttcct

SEQ ID NO: 3307734 - DNA, 20 bp, Homo sapiens
atgccatttcagtggcttcc

SEQ ID NO: 3307735 - DNA, 12 bp, Homo sapiens
atgccatttgtt

SEQ ID NO: 3307736 - DNA, 14 bp, Homo sapiens
atgccatttgttta

SEQ ID NO: 3307737 - DNA, 16 bp, Homo sapiens
atgccatttgtttatt

SEQ ID NO: 3307738 - DNA, 19 bp, Homo sapiens
atgcccaccccctgccctg

SEQ ID NO: 3307739 - DNA, 17 bp, Homo sapiens
atgcccacgttctttcc

SEQ ID NO: 3307740 - DNA, 11 bp, Homo sapiens
atgcccagaag

SEQ ID NO: 3307741 - DNA, 12 bp, Homo sapiens
atgcccagaaga

SEQ ID NO: 3307742 - DNA, 23 bp, Homo sapiens
atgcccagagggcccaggcaggc

SEQ ID NO: 3307743 - DNA, 14 bp, Homo sapiens
atgcccagcagggg

SEQ ID NO: 3307744 - DNA, 22 bp, Homo sapiens
atgcccagcaggggaggtgagg

SEQ ID NO: 3307745 - DNA, 13 bp, Homo sapiens
atgcccaggtacc

SEQ ID NO: 3307746 - DNA, 15 bp, Homo sapiens
atgcccagtgagact

SEQ ID NO: 3307747 - DNA, 15 bp, Homo sapiens
atgccccagagctgt

SEQ ID NO: 3307748 - DNA, 13 bp, Homo sapiens
atgcccccctcaa

SEQ ID NO: 3307749 - DNA, 21 bp, Homo sapiens
atgcccccctcaaacctcctc

SEQ ID NO: 3307750 - DNA, 24 bp, Homo sapiens
atgccccctccaggagagagccag

SEQ ID NO: 3307751 - DNA, 13 bp, Homo sapiens
atgccccctttca

SEQ ID NO: 3307752 - DNA, 21 bp, Homo sapiens
atgccccctttcagatgtctt

SEQ ID NO: 3307753 - DNA, 20 bp, Homo sapiens
atgcccctgtactccagcct

SEQ ID NO: 3307754 - DNA, 22 bp, Homo sapiens
atgccccttcttgggccccaga

SEQ ID NO: 3307755 - DNA, 20 bp, Homo sapiens
atgcttaaactaaataatga

SEQ ID NO: 3307756 - DNA, 15 bp, Homo sapiens
atgcttaatttctaa

SEQ ID NO: 3307757 - DNA, 13 bp, Homo sapiens
atgcttactgata

SEQ ID NO: 3307758 - DNA, 22 bp, Homo sapiens
atgcttactgatatattttaca

SEQ ID NO: 3307759 - DNA, 17 bp, Homo sapiens
atgcttagcttatcttt

SEQ ID NO: 3307760 - DNA, 18 bp, Homo sapiens
atgcttagcttatctttc

SEQ ID NO: 3307761 - DNA, 23 bp, Homo sapiens
atgcttagcttatctttctttcc

SEQ ID NO: 3307762 - DNA, 19 bp, Homo sapiens
atgcttatcatctaaagat

SEQ ID NO: 3307763 - DNA, 19 bp, Homo sapiens
atgcttcccagagggagca

SEQ ID NO: 3307764 - DNA, 16 bp, Homo sapiens
atgcttcctgacaatc

SEQ ID NO: 3307765 - DNA, 20 bp, Homo sapiens
atgcttcctgacaatcaact

SEQ ID NO: 3307766 - DNA, 19 bp, Homo sapiens
atgcttctataattttgcc

SEQ ID NO: 3307767 - DNA, 22 bp, Homo sapiens
atgcttctcatcttgtgaaatg

SEQ ID NO: 3307768 - DNA, 14 bp, Homo sapiens
atgcttctgtagct

SEQ ID NO: 3307769 - DNA, 18 bp, Homo sapiens
atgcttctgtagcttcta

SEQ ID NO: 3307770 - DNA, 21 bp, Homo sapiens
atgcttgacaaatattttcat

SEQ ID NO: 3307771 - DNA, 13 bp, Homo sapiens
atgcttgggctga

SEQ ID NO: 3307772 - DNA, 22 bp, Homo sapiens
atgcttgggctgacccagcatc

SEQ ID NO: 3307773 - DNA, 17 bp, Homo sapiens
atgcttgtaacaagaaa

SEQ ID NO: 3307774 - DNA, 21 bp, Homo sapiens
atgcttgtaacaagaaaacat

SEQ ID NO: 3307775 - DNA, 18 bp, Homo sapiens
atgctttattaatgtttt

SEQ ID NO: 3307776 - DNA, 12 bp, Homo sapiens
atgctttggaaa

SEQ ID NO: 3307777 - DNA, 22 bp, Homo sapiens
atgctttgtcttcagcctctcc

SEQ ID NO: 3307778 - DNA, 22 bp, Homo sapiens
atgcttttatatttttttaaaa

SEQ ID NO: 3307779 - DNA, 18 bp, Homo sapiens
atgcttttgcttgcaatg

SEQ ID NO: 3307780 - DNA, 19 bp, Homo sapiens
atggaaaaaaacataaaaa

SEQ ID NO: 3307781 - DNA, 21 bp, Homo sapiens
atggaaaaatggttgatggaa

SEQ ID NO: 3307782 - DNA, 14 bp, Homo sapiens
atggaaaaggaaga

SEQ ID NO: 3307783 - DNA, 18 bp, Homo sapiens
atggaaaagtgtccttct

SEQ ID NO: 3307784 - DNA, 15 bp, Homo sapiens
atggaaaataaacat

SEQ ID NO: 3307785 - DNA, 16 bp, Homo sapiens
atggaaaataaacatc

SEQ ID NO: 3307786 - DNA, 20 bp, Homo sapiens
atggaaaatacctaattgtg

SEQ ID NO: 3307787 - DNA, 16 bp, Homo sapiens
atggaaacattacagt

SEQ ID NO: 3307788 - DNA, 16 bp, Homo sapiens
atggaaattttgctat

SEQ ID NO: 3307789 - DNA, 16 bp, Homo sapiens
atggaactactgtact

SEQ ID NO: 3307790 - DNA, 14 bp, Homo sapiens
atggaactgacccc

SEQ ID NO: 3307791 - DNA, 18 bp, Homo sapiens
atggaacttctaatatat

SEQ ID NO: 3307792 - DNA, 12 bp, Homo sapiens
atggaagaaagt

SEQ ID NO: 3307793 - DNA, 13 bp, Homo sapiens
atggaagaaagta

SEQ ID NO: 3307794 - DNA, 14 bp, Homo sapiens
atggaagaaagtaa

SEQ ID NO: 3307795 - DNA, 17 bp, Homo sapiens
atggaagattttaaatt

SEQ ID NO: 3307796 - DNA, 15 bp, Homo sapiens
atggaaggaagaaaa

SEQ ID NO: 3307797 - DNA, 16 bp, Homo sapiens
atggaagggtttgtgg

SEQ ID NO: 3307798 - DNA, 17 bp, Homo sapiens
atggaaggtttgtatat

SEQ ID NO: 3307799 - DNA, 17 bp, Homo sapiens
atggaagtggcagtgaa

SEQ ID NO: 3307800 - DNA, 18 bp, Homo sapiens
atggaagtggcagtgaaa

SEQ ID NO: 3307801 - DNA, 15 bp, Homo sapiens
atggaagttttccta

SEQ ID NO: 3307802 - DNA, 16 bp, Homo sapiens
atggaataactctgtg

SEQ ID NO: 3307803 - DNA, 18 bp, Homo sapiens
atggaatggacatcctgt

SEQ ID NO: 3307804 - DNA, 19 bp, Homo sapiens
atggaatgtgcccctggcc

SEQ ID NO: 3307805 - DNA, 15 bp, Homo sapiens
atggaattgatttgc

SEQ ID NO: 3307806 - DNA, 18 bp, Homo sapiens
atggaattgatttgcatt

SEQ ID NO: 3307807 - DNA, 19 bp, Homo sapiens
atggaattgatttgcattg

SEQ ID NO: 3307808 - DNA, 22 bp, Homo sapiens
atggacaacttatttaaaaata

SEQ ID NO: 3307809 - DNA, 23 bp, Homo sapiens
atggacaacttatttaaaaatat

SEQ ID NO: 3307810 - DNA, 20 bp, Homo sapiens
atggacacaaattttcaagt

SEQ ID NO: 3307811 - DNA, 19 bp, Homo sapiens
atggacactccagtgccag

SEQ ID NO: 3307812 - DNA, 22 bp, Homo sapiens
atggacagttcacaccctgcaa

SEQ ID NO: 3307813 - DNA, 23 bp, Homo sapiens
atggacagttcacaccctgcaag

SEQ ID NO: 3307814 - DNA, 23 bp, Homo sapiens
atggacatcctgtataagcactg

SEQ ID NO: 3307815 - DNA, 14 bp, Homo sapiens
atggacatgatctt

SEQ ID NO: 3307816 - DNA, 17 bp, Homo sapiens
atggacatttagaagaa

SEQ ID NO: 3307817 - DNA, 18 bp, Homo sapiens
atggacatttagaagaaa

SEQ ID NO: 3307818 - DNA, 22 bp, Homo sapiens
atggaccacgaatattctttct

SEQ ID NO: 3307819 - DNA, 21 bp, Homo sapiens
atggaccgggtgggcctggcc

SEQ ID NO: 3307820 - DNA, 12 bp, Homo sapiens
atggacctaaca

SEQ ID NO: 3307821 - DNA, 13 bp, Homo sapiens
atggacctaacat

SEQ ID NO: 3307822 - DNA, 15 bp, Homo sapiens
atggaccttctagaa

SEQ ID NO: 3307823 - DNA, 13 bp, Homo sapiens
atggactatctgt

SEQ ID NO: 3307824 - DNA, 18 bp, Homo sapiens
atggactctgaaaaacat

SEQ ID NO: 3307825 - DNA, 16 bp, Homo sapiens
atggactcttctcggc

SEQ ID NO: 3307826 - DNA, 15 bp, Homo sapiens
atggactggtttgag

SEQ ID NO: 3307827 - DNA, 18 bp, Homo sapiens
atggacttatttcttcaa

SEQ ID NO: 3307828 - DNA, 20 bp, Homo sapiens
atggacttatttcttcaaat

SEQ ID NO: 3307829 - DNA, 15 bp, Homo sapiens
atggagaaagaagtg

SEQ ID NO: 3307830 - DNA, 21 bp, Homo sapiens
atggagaaagaagtggagaca

SEQ ID NO: 3307831 - DNA, 17 bp, Homo sapiens
atggagagaggggaata

SEQ ID NO: 3307832 - DNA, 20 bp, Homo sapiens
atggagaggcggcctcgtgc

SEQ ID NO: 3307833 - DNA, 20 bp, Homo sapiens
atggagattcagttttcatt

SEQ ID NO: 3307834 - DNA, 15 bp, Homo sapiens
atggagccagctccc

SEQ ID NO: 3307835 - DNA, 13 bp, Homo sapiens
atggagcccaggc

SEQ ID NO: 3307836 - DNA, 23 bp, Homo sapiens
atggagcccaggcgggagcggtg

SEQ ID NO: 3307837 - DNA, 23 bp, Homo sapiens
atggagcccccagatagagctgg

SEQ ID NO: 3307838 - DNA, 22 bp, Homo sapiens
atggaggaaaaccaagccgtgg

SEQ ID NO: 3307839 - DNA, 13 bp, Homo sapiens
atggaggaatatg

SEQ ID NO: 3307840 - DNA, 17 bp, Homo sapiens
atggaggatattctact

SEQ ID NO: 3307841 - DNA, 16 bp, Homo sapiens
atggaggatggagaga

SEQ ID NO: 3307842 - DNA, 20 bp, Homo sapiens
atggaggcagagacctccaa

SEQ ID NO: 3307843 - DNA, 14 bp, Homo sapiens
atggaggcttttca

SEQ ID NO: 3307844 - DNA, 14 bp, Homo sapiens
atggaggggaattc

SEQ ID NO: 3307845 - DNA, 18 bp, Homo sapiens
atggaggggtggtcctga

SEQ ID NO: 3307846 - DNA, 12 bp, Homo sapiens
atggaggttcta

SEQ ID NO: 3307847 - DNA, 17 bp, Homo sapiens
atggaggttctcagagc

SEQ ID NO: 3307848 - DNA, 18 bp, Homo sapiens
atggagtattttaagtct

SEQ ID NO: 3307849 - DNA, 15 bp, Homo sapiens
atggagtttctaagg

SEQ ID NO: 3307850 - DNA, 16 bp, Homo sapiens
atggagtttctaaggt

SEQ ID NO: 3307851 - DNA, 19 bp, Homo sapiens
atggataacctatatgatt

SEQ ID NO: 3307852 - DNA, 19 bp, Homo sapiens
atggatacgtgttttgaat

SEQ ID NO: 3307853 - DNA, 16 bp, Homo sapiens
atggatacttcctggg

SEQ ID NO: 3307854 - DNA, 16 bp, Homo sapiens
atggatcacaagatgg

SEQ ID NO: 3307855 - DNA, 16 bp, Homo sapiens
atggatcctggaggat

SEQ ID NO: 3307856 - DNA, 21 bp, Homo sapiens
atggatgaatctcccactcca

SEQ ID NO: 3307857 - DNA, 13 bp, Homo sapiens
atggatgattcag

SEQ ID NO: 3307858 - DNA, 13 bp, Homo sapiens
atggatgcaaagt

SEQ ID NO: 3307859 - DNA, 13 bp, Homo sapiens
atggatgccaata

SEQ ID NO: 3307860 - DNA, 19 bp, Homo sapiens
atggatgcccagaggactc

SEQ ID NO: 3307861 - DNA, 14 bp, Homo sapiens
atggatggcacaat

SEQ ID NO: 3307862 - DNA, 13 bp, Homo sapiens
atggatggggaga

SEQ ID NO: 3307863 - DNA, 22 bp, Homo sapiens
atggatggtggaccctactatt

SEQ ID NO: 3307864 - DNA, 20 bp, Homo sapiens
atggattcaattacggactc

SEQ ID NO: 3307865 - DNA, 14 bp, Homo sapiens
atggattctcagat

SEQ ID NO: 3307866 - DNA, 16 bp, Homo sapiens
atggattctcagatat

SEQ ID NO: 3307867 - DNA, 18 bp, Homo sapiens
atggattctcagatattt

SEQ ID NO: 3307868 - DNA, 15 bp, Homo sapiens
atggattggattatt

SEQ ID NO: 3307869 - DNA, 19 bp, Homo sapiens
atggatttcgtttttcttg

SEQ ID NO: 3307870 - DNA, 23 bp, Homo sapiens
atggatttcgtttttcttggggt

SEQ ID NO: 3307871 - DNA, 19 bp, Homo sapiens
atggatttgatgctgtttg

SEQ ID NO: 3307872 - DNA, 22 bp, Homo sapiens
atggatttggcactagccaaag

SEQ ID NO: 3307873 - DNA, 20 bp, Homo sapiens
atggattttctattgttact

SEQ ID NO: 3307874 - DNA, 21 bp, Homo sapiens
atggattttggataaatcatt

SEQ ID NO: 3307875 - DNA, 22 bp, Homo sapiens
atggatttttaaattatactgt

SEQ ID NO: 3307876 - DNA, 16 bp, Homo sapiens
atggatttttacaaga

SEQ ID NO: 3307877 - DNA, 16 bp, Homo sapiens
atggatttttctttaa

SEQ ID NO: 3307878 - DNA, 19 bp, Homo sapiens
atggatttttctttaactg

SEQ ID NO: 3307879 - DNA, 20 bp, Homo sapiens
atggatttttctttaactgc

SEQ ID NO: 3307880 - DNA, 14 bp, Homo sapiens
atgtacttgatact

SEQ ID NO: 3307881 - DNA, 22 bp, Homo sapiens
atgtacttgatactgaatgcat

SEQ ID NO: 3307882 - DNA, 19 bp, Homo sapiens
atgtacttgtttctctgtt

SEQ ID NO: 3307883 - DNA, 15 bp, Homo sapiens
atgtagaaacattta

SEQ ID NO: 3307884 - DNA, 14 bp, Homo sapiens
atgtagaaattctt

SEQ ID NO: 3307885 - DNA, 14 bp, Homo sapiens
atgtagaactcagc

SEQ ID NO: 3307886 - DNA, 15 bp, Homo sapiens
atgtagaactcagca

SEQ ID NO: 3307887 - DNA, 18 bp, Homo sapiens
atgtagaactcagcagtt

SEQ ID NO: 3307888 - DNA, 20 bp, Homo sapiens
atgtagaactcagcagttga

SEQ ID NO: 3307889 - DNA, 13 bp, Homo sapiens
atgtagaattgct

SEQ ID NO: 3307890 - DNA, 16 bp, Homo sapiens
atgtagactatataca

SEQ ID NO: 3307891 - DNA, 21 bp, Homo sapiens
atgtagactatatacatgtgt

SEQ ID NO: 3307892 - DNA, 22 bp, Homo sapiens
atgtagattaaggtgatgtgat

SEQ ID NO: 3307893 - DNA, 14 bp, Homo sapiens
atgtagccagctgt

SEQ ID NO: 3307894 - DNA, 13 bp, Homo sapiens
atgtagcccatcc

SEQ ID NO: 3307895 - DNA, 21 bp, Homo sapiens
atgtagccccctggcctctgt

SEQ ID NO: 3307896 - DNA, 22 bp, Homo sapiens
atgtagcctttactgtttgata

SEQ ID NO: 3307897 - DNA, 13 bp, Homo sapiens
atgtagcgtgttt

SEQ ID NO: 3307898 - DNA, 14 bp, Homo sapiens
atgtagctgaaaat

SEQ ID NO: 3307899 - DNA, 15 bp, Homo sapiens
atgtagctgaaaata

SEQ ID NO: 3307900 - DNA, 14 bp, Homo sapiens
atgtagctgaaaca

SEQ ID NO: 3307901 - DNA, 13 bp, Homo sapiens
atgtagtaattga

SEQ ID NO: 3307902 - DNA, 21 bp, Homo sapiens
atgtagtattttttgtataat

SEQ ID NO: 3307903 - DNA, 23 bp, Homo sapiens
atgtagtattttttgtataattg

SEQ ID NO: 3307904 - DNA, 18 bp, Homo sapiens
atgtagttctgccaggca

SEQ ID NO: 3307905 - DNA, 23 bp, Homo sapiens
atgtagttgtcacactaaaattt

SEQ ID NO: 3307906 - DNA, 17 bp, Homo sapiens
atgtataaagaacaagg

SEQ ID NO: 3307907 - DNA, 21 bp, Homo sapiens
atgtataaagcaactgttatg

SEQ ID NO: 3307908 - DNA, 12 bp, Homo sapiens
atgtataaatat

SEQ ID NO: 3307909 - DNA, 17 bp, Homo sapiens
atgtataaccaagtgtg

SEQ ID NO: 3307910 - DNA, 19 bp, Homo sapiens
atgtataaccaagtgtgct

SEQ ID NO: 3307911 - DNA, 12 bp, Homo sapiens
atgtatatacac

SEQ ID NO: 3307912 - DNA, 18 bp, Homo sapiens
atgtatatacacatatac

SEQ ID NO: 3307913 - DNA, 17 bp, Homo sapiens
atgtatatatttagtgc

SEQ ID NO: 3307914 - DNA, 19 bp, Homo sapiens
atgtatatcattctacaga

SEQ ID NO: 3307915 - DNA, 18 bp, Homo sapiens
atgtatattttatataaa

SEQ ID NO: 3307916 - DNA, 15 bp, Homo sapiens
atgtatctgagcagg

SEQ ID NO: 3307917 - DNA, 14 bp, Homo sapiens
atgtatctgagttg

SEQ ID NO: 3307918 - DNA, 21 bp, Homo sapiens
atgtatgaaggaatcattcca

SEQ ID NO: 3307919 - DNA, 20 bp, Homo sapiens
atgtatggaatacagtgtta

SEQ ID NO: 3307920 - DNA, 19 bp, Homo sapiens
atgtatgggtagggtaaat

SEQ ID NO: 3307921 - DNA, 21 bp, Homo sapiens
atgtatgggtagggtaaatca

SEQ ID NO: 3307922 - DNA, 16 bp, Homo sapiens
atgtatgtgcactgtc

SEQ ID NO: 3307923 - DNA, 20 bp, Homo sapiens
atgtatgtgcactgtcactt

SEQ ID NO: 3307924 - DNA, 12 bp, Homo sapiens
atgtatgtgtaa

SEQ ID NO: 3307925 - DNA, 16 bp, Homo sapiens
atgtatgtgtaagtat

SEQ ID NO: 3307926 - DNA, 17 bp, Homo sapiens
atgtatgtgtgaaacaa

SEQ ID NO: 3307927 - DNA, 12 bp, Homo sapiens
atgtatgttacc

SEQ ID NO: 3307928 - DNA, 14 bp, Homo sapiens
atgtatgttaccaa

SEQ ID NO: 3307929 - DNA, 14 bp, Homo sapiens
atgtattataactt

SEQ ID NO: 3307930 - DNA, 17 bp, Homo sapiens
atgtattattctgcagc

SEQ ID NO: 3307931 - DNA, 16 bp, Homo sapiens
atgtattatttataat

SEQ ID NO: 3307932 - DNA, 17 bp, Homo sapiens
atgtattatttataatt

SEQ ID NO: 3307933 - DNA, 13 bp, Homo sapiens
atgtattcaagca

SEQ ID NO: 3307934 - DNA, 15 bp, Homo sapiens
atgtattcccttgta

SEQ ID NO: 3307935 - DNA, 17 bp, Homo sapiens
atgtattcccttgtatt

SEQ ID NO: 3307936 - DNA, 21 bp, Homo sapiens
atgtattcccttgtattttgt

SEQ ID NO: 3307937 - DNA, 17 bp, Homo sapiens
atgtattcttttctcag

SEQ ID NO: 3307938 - DNA, 22 bp, Homo sapiens
atgtattgaagaggatattctt

SEQ ID NO: 3307939 - DNA, 17 bp, Homo sapiens
atgtattgcacattgta

SEQ ID NO: 3307940 - DNA, 19 bp, Homo sapiens
atgtattgtaatctttcat

SEQ ID NO: 3307941 - DNA, 13 bp, Homo sapiens
atgtatttatgta

SEQ ID NO: 3307942 - DNA, 15 bp, Homo sapiens
atgtatttatgtgta

SEQ ID NO: 3307943 - DNA, 18 bp, Homo sapiens
atgtatttgttcatgttt

SEQ ID NO: 3307944 - DNA, 13 bp, Homo sapiens
atgtattttacac

SEQ ID NO: 3307945 - DNA, 23 bp, Homo sapiens
atgtattttacacaaatgtgatt

SEQ ID NO: 3307946 - DNA, 17 bp, Homo sapiens
atgtcaaataaagcaaa

SEQ ID NO: 3307947 - DNA, 22 bp, Homo sapiens
atgtcaaggcagttgcttgtgt

SEQ ID NO: 3307948 - DNA, 16 bp, Homo sapiens
atgtcaatatgagata

SEQ ID NO: 3307949 - DNA, 14 bp, Homo sapiens
atgtcacaaattga

SEQ ID NO: 3307950 - DNA, 15 bp, Homo sapiens
atgtcacaggcaggt

SEQ ID NO: 3307951 - DNA, 14 bp, Homo sapiens
atgtcacagggcca

SEQ ID NO: 3307952 - DNA, 22 bp, Homo sapiens
atgtcaccggtcagtgcctttt

SEQ ID NO: 3307953 - DNA, 21 bp, Homo sapiens
atgtcacgtactgtctgattg

SEQ ID NO: 3307954 - DNA, 14 bp, Homo sapiens
atgtcactgtggtc

SEQ ID NO: 3307955 - DNA, 14 bp, Homo sapiens
atgtcagattcctt

SEQ ID NO: 3307956 - DNA, 16 bp, Homo sapiens
atgtcagattcctttc

SEQ ID NO: 3307957 - DNA, 18 bp, Homo sapiens
atgtcagattcctttccc

SEQ ID NO: 3307958 - DNA, 16 bp, Homo sapiens
atgtcagcttcccagc

SEQ ID NO: 3307959 - DNA, 18 bp, Homo sapiens
atgtcagtatttcaactg

SEQ ID NO: 3307960 - DNA, 23 bp, Homo sapiens
atgtcagtatttcaactgctgta

SEQ ID NO: 3307961 - DNA, 24 bp, Homo sapiens
atgtcagtatttcagtgtagttaa

SEQ ID NO: 3307962 - DNA, 17 bp, Homo sapiens
atgtcagtgtttgggaa

SEQ ID NO: 3307963 - DNA, 21 bp, Homo sapiens
atgtcatggccttgaaacagt

SEQ ID NO: 3307964 - DNA, 16 bp, Homo sapiens
atgtcattaaacatga

SEQ ID NO: 3307965 - DNA, 16 bp, Homo sapiens
atgtccaaagaggctg

SEQ ID NO: 3307966 - DNA, 21 bp, Homo sapiens
atgtccaaagaggctgcccct

SEQ ID NO: 3307967 - DNA, 22 bp, Homo sapiens
atgtccaaagaggctgcccctc

SEQ ID NO: 3307968 - DNA, 14 bp, Homo sapiens
atgtccaagttctt

SEQ ID NO: 3307969 - DNA, 20 bp, Homo sapiens
atgtccaagttcttcacctc

SEQ ID NO: 3307970 - DNA, 22 bp, Homo sapiens
atgtccaagttcttcacctcta

SEQ ID NO: 3307971 - DNA, 21 bp, Homo sapiens
atgtccagaagaatattcagg

SEQ ID NO: 3307972 - DNA, 20 bp, Homo sapiens
atgtcccaacttgtaaaaat

SEQ ID NO: 3307973 - DNA, 12 bp, Homo sapiens
atgtcccaccca

SEQ ID NO: 3307974 - DNA, 20 bp, Homo sapiens
atgtccctgggccagggtct

SEQ ID NO: 3307975 - DNA, 20 bp, Homo sapiens
atgtccctttcttggccagt

SEQ ID NO: 3307976 - DNA, 17 bp, Homo sapiens
atgtcctaaggacacac

SEQ ID NO: 3307977 - DNA, 19 bp, Homo sapiens
atgtcctaaggacacacta

SEQ ID NO: 3307978 - DNA, 20 bp, Homo sapiens
atgtcctactatcactgaac

SEQ ID NO: 3307979 - DNA, 13 bp, Homo sapiens
atgtcctatgtgt

SEQ ID NO: 3307980 - DNA, 18 bp, Homo sapiens
atgtcctccagaagcctc

SEQ ID NO: 3307981 - DNA, 20 bp, Homo sapiens
atgtcctgcctattatctgt

SEQ ID NO: 3307982 - DNA, 13 bp, Homo sapiens
atgtcctgccttt

SEQ ID NO: 3307983 - DNA, 14 bp, Homo sapiens
atgtcgcctctgca

SEQ ID NO: 3307984 - DNA, 16 bp, Homo sapiens
atgtcgtaggtaaact

SEQ ID NO: 3307985 - DNA, 20 bp, Homo sapiens
atgtcgtgaccaactagaca

SEQ ID NO: 3307986 - DNA, 14 bp, Homo sapiens
atgtctaaaattgt

SEQ ID NO: 3307987 - DNA, 17 bp, Homo sapiens
atgtctaaatgctgaaa

SEQ ID NO: 3307988 - DNA, 22 bp, Homo sapiens
atgtctataatcccagcacttt

SEQ ID NO: 3307989 - DNA, 16 bp, Homo sapiens
atgtctattcagcttc

SEQ ID NO: 3307990 - DNA, 23 bp, Homo sapiens
atgtctatttaagcctcatattt

SEQ ID NO: 3307991 - DNA, 13 bp, Homo sapiens
atgtctcactgtt

SEQ ID NO: 3307992 - DNA, 16 bp, Homo sapiens
atgtctcactgttctg

SEQ ID NO: 3307993 - DNA, 17 bp, Homo sapiens
atgtctcaggtccctgc

SEQ ID NO: 3307994 - DNA, 13 bp, Homo sapiens
atgtctccagatt

SEQ ID NO: 3307995 - DNA, 22 bp, Homo sapiens
atgtctccagattggcacccct

SEQ ID NO: 3307996 - DNA, 18 bp, Homo sapiens
atgtctcctttgctcttg

SEQ ID NO: 3307997 - DNA, 15 bp, Homo sapiens
atgtctcgctagtga

SEQ ID NO: 3307998 - DNA, 14 bp, Homo sapiens
atgtctctaaagca

SEQ ID NO: 3307999 - DNA, 12 bp, Homo sapiens
atgtctgataat

SEQ ID NO: 3308000 - DNA, 14 bp, Homo sapiens
atgtctgataatga

SEQ ID NO: 3308001 - DNA, 15 bp, Homo sapiens
atgtctgataatgat

SEQ ID NO: 3308002 - DNA, 22 bp, Homo sapiens
atgtctgataatgatttgctct

SEQ ID NO: 3308003 - DNA, 20 bp, Homo sapiens
atgtctggagtggtaacagc

SEQ ID NO: 3308004 - DNA, 23 bp, Homo sapiens
atgtctgttaccatgtcactgtg

SEQ ID NO: 3308005 - DNA, 16 bp, Homo sapiens
atgtctgttgatgact

SEQ ID NO: 3308006 - DNA, 17 bp, Homo sapiens
atgtgtgcctgtggcag

SEQ ID NO: 3308007 - DNA, 14 bp, Homo sapiens
atgtgtggcctgca

SEQ ID NO: 3308008 - DNA, 23 bp, Homo sapiens
atgtgtgggtgaatgtgtgttca

SEQ ID NO: 3308009 - DNA, 17 bp, Homo sapiens
atgtgtggtttcagttc

SEQ ID NO: 3308010 - DNA, 21 bp, Homo sapiens
atgtgtggtttcagttctgtg

SEQ ID NO: 3308011 - DNA, 14 bp, Homo sapiens
atgtgtgtaggtta

SEQ ID NO: 3308012 - DNA, 18 bp, Homo sapiens
atgtgtgtgtgtggcagg

SEQ ID NO: 3308013 - DNA, 13 bp, Homo sapiens
atgtgtgttcatg

SEQ ID NO: 3308014 - DNA, 22 bp, Homo sapiens
atgtgtgttgtcagcctgtgct

SEQ ID NO: 3308015 - DNA, 21 bp, Homo sapiens
atgtgttcattcaagctattt

SEQ ID NO: 3308016 - DNA, 15 bp, Homo sapiens
atgtgttcctcctgc

SEQ ID NO: 3308017 - DNA, 16 bp, Homo sapiens
atgtgtttgctgcctt

SEQ ID NO: 3308018 - DNA, 16 bp, Homo sapiens
atgtgtttttctccag

SEQ ID NO: 3308019 - DNA, 16 bp, Homo sapiens
atgttaaagagaatga

SEQ ID NO: 3308020 - DNA, 13 bp, Homo sapiens
atgttaaagttta

SEQ ID NO: 3308021 - DNA, 15 bp, Homo sapiens
atgttaaatactgtg

SEQ ID NO: 3308022 - DNA, 21 bp, Homo sapiens
atgttaaatactgtgcagaat

SEQ ID NO: 3308023 - DNA, 23 bp, Homo sapiens
atgttaaatactgtgcagaataa

SEQ ID NO: 3308024 - DNA, 15 bp, Homo sapiens
atgttaaatttgtaa

SEQ ID NO: 3308025 - DNA, 16 bp, Homo sapiens
atgttaaatttgtaag

SEQ ID NO: 3308026 - DNA, 22 bp, Homo sapiens
atgttaaatttgtaagtttcag

SEQ ID NO: 3308027 - DNA, 20 bp, Homo sapiens
atgttaagataacttactgt

SEQ ID NO: 3308028 - DNA, 19 bp, Homo sapiens
atgttaaggaaactcttat

SEQ ID NO: 3308029 - DNA, 14 bp, Homo sapiens
atgttaagttatat

SEQ ID NO: 3308030 - DNA, 16 bp, Homo sapiens
atgttaatttatttag

SEQ ID NO: 3308031 - DNA, 17 bp, Homo sapiens
atgttaatttatttagt

SEQ ID NO: 3308032 - DNA, 14 bp, Homo sapiens
atgttacattatta

SEQ ID NO: 3308033 - DNA, 14 bp, Homo sapiens
atgttacccattca

SEQ ID NO: 3308034 - DNA, 21 bp, Homo sapiens
atgttacctcctataaactta

SEQ ID NO: 3308035 - DNA, 22 bp, Homo sapiens
atgttactcagtgttagagaaa

SEQ ID NO: 3308036 - DNA, 14 bp, Homo sapiens
atgttactgaccag

SEQ ID NO: 3308037 - DNA, 13 bp, Homo sapiens
atgttactgatca

SEQ ID NO: 3308038 - DNA, 21 bp, Homo sapiens
atgttactgatcatgcattgt

SEQ ID NO: 3308039 - DNA, 22 bp, Homo sapiens
atgttactgatcatgcattgtt

SEQ ID NO: 3308040 - DNA, 16 bp, Homo sapiens
atgttagaggttttaa

SEQ ID NO: 3308041 - DNA, 22 bp, Homo sapiens
atgttagaggttttaaagtgat

SEQ ID NO: 3308042 - DNA, 17 bp, Homo sapiens
atgttagtaatggcaga

SEQ ID NO: 3308043 - DNA, 20 bp, Homo sapiens
atgttagttaccttatagtt

SEQ ID NO: 3308044 - DNA, 22 bp, Homo sapiens
atgttagttaccttatagttac

SEQ ID NO: 3308045 - DNA, 20 bp, Homo sapiens
atgttatcttctcaagttct

SEQ ID NO: 3308046 - DNA, 22 bp, Homo sapiens
atgttatcttctcaagttctaa

SEQ ID NO: 3308047 - DNA, 22 bp, Homo sapiens
atgttatgatattgtttaaaat

SEQ ID NO: 3308048 - DNA, 17 bp, Homo sapiens
atgttatgggatgtaaa

SEQ ID NO: 3308049 - DNA, 19 bp, Homo sapiens
atgttatgggatgtaaaca

SEQ ID NO: 3308050 - DNA, 13 bp, Homo sapiens
atgttatttaaca

SEQ ID NO: 3308051 - DNA, 22 bp, Homo sapiens
atgttatttgttattttcagta

SEQ ID NO: 3308052 - DNA, 19 bp, Homo sapiens
atgttattttttaattatt

SEQ ID NO: 3308053 - DNA, 17 bp, Homo sapiens
atgttcaaagccacatt

SEQ ID NO: 3308054 - DNA, 18 bp, Homo sapiens
atgttcatgtaagaagcc

SEQ ID NO: 3308055 - DNA, 12 bp, Homo sapiens
atgttcattata

SEQ ID NO: 3308056 - DNA, 13 bp, Homo sapiens
atgttcattataa

SEQ ID NO: 3308057 - DNA, 23 bp, Homo sapiens
atgttcattgtaatgttactgat

SEQ ID NO: 3308058 - DNA, 19 bp, Homo sapiens
atgttccctcttgtccctt

SEQ ID NO: 3308059 - DNA, 13 bp, Homo sapiens
atgttccctgcac

SEQ ID NO: 3308060 - DNA, 20 bp, Homo sapiens
atgttcctaaggtcatttct

SEQ ID NO: 3308061 - DNA, 21 bp, Homo sapiens
atgttcctaaggtcatttctt

SEQ ID NO: 3308062 - DNA, 22 bp, Homo sapiens
atgttctaacagatcagaacat

SEQ ID NO: 3308063 - DNA, 12 bp, Homo sapiens
atgttctaaggc

SEQ ID NO: 3308064 - DNA, 20 bp, Homo sapiens
atgttctaaggctctgagag

SEQ ID NO: 3308065 - DNA, 22 bp, Homo sapiens
atgttctaaggctctgagagtc

SEQ ID NO: 3308066 - DNA, 12 bp, Homo sapiens
atgttctaagtt

SEQ ID NO: 3308067 - DNA, 20 bp, Homo sapiens
atgttctaagtttctaagat

SEQ ID NO: 3308068 - DNA, 21 bp, Homo sapiens
atgttctaagtttctaagatt

SEQ ID NO: 3308069 - DNA, 19 bp, Homo sapiens
atgttctaatactttgttt

SEQ ID NO: 3308070 - DNA, 22 bp, Homo sapiens
atgttctaggatagttgatgca

SEQ ID NO: 3308071 - DNA, 19 bp, Homo sapiens
atgttctatggttatgaaa

SEQ ID NO: 3308072 - DNA, 21 bp, Homo sapiens
atgttctatggttatgaaaga

SEQ ID NO: 3308073 - DNA, 11 bp, Homo sapiens
atgttctatta

SEQ ID NO: 3308074 - DNA, 20 bp, Homo sapiens
atgttctattttttgttttg

SEQ ID NO: 3308075 - DNA, 17 bp, Homo sapiens
atgttctctgaggacac

SEQ ID NO: 3308076 - DNA, 15 bp, Homo sapiens
atgttctgacattaa

SEQ ID NO: 3308077 - DNA, 16 bp, Homo sapiens
atgttctgacattaac

SEQ ID NO: 3308078 - DNA, 18 bp, Homo sapiens
atgttctgacattaacag

SEQ ID NO: 3308079 - DNA, 22 bp, Homo sapiens
atgttctgaccctgcttcaaat

SEQ ID NO: 3308080 - DNA, 20 bp, Homo sapiens
atgttctgcccccagcccaa

SEQ ID NO: 3308081 - DNA, 11 bp, Homo sapiens
atgttctggga

SEQ ID NO: 3308082 - DNA, 12 bp, Homo sapiens
atgttctgggac

SEQ ID NO: 3308083 - DNA, 15 bp, Homo sapiens
atgttctgggacaca

SEQ ID NO: 3308084 - DNA, 13 bp, Homo sapiens
atgttctgtttgc

SEQ ID NO: 3308085 - DNA, 21 bp, Homo sapiens
atgttcttgggtggttcctaa

SEQ ID NO: 3308086 - DNA, 19 bp, Homo sapiens
atgttctttggaaagtaca

SEQ ID NO: 3308087 - DNA, 21 bp, Homo sapiens
atgttgaaaaaatttaaaagt

SEQ ID NO: 3308088 - DNA, 12 bp, Homo sapiens
atgttgaaagat

SEQ ID NO: 3308089 - DNA, 18 bp, Homo sapiens
atgttgaagaatacagtt

SEQ ID NO: 3308090 - DNA, 15 bp, Homo sapiens
atgttgaatactttt

SEQ ID NO: 3308091 - DNA, 16 bp, Homo sapiens
atgttgagaatcccaa

SEQ ID NO: 3308092 - DNA, 22 bp, Homo sapiens
atgttgagaatcccaaatttga

SEQ ID NO: 3308093 - DNA, 18 bp, Homo sapiens
atgttgagccaggcctgg

SEQ ID NO: 3308094 - DNA, 21 bp, Homo sapiens
atgttgagtgttcattttagt

SEQ ID NO: 3308095 - DNA, 19 bp, Homo sapiens
atgttgcaatgtgaaaaat

SEQ ID NO: 3308096 - DNA, 14 bp, Homo sapiens
atgttgcccaggca

SEQ ID NO: 3308097 - DNA, 15 bp, Homo sapiens
atgttgcccaggcag

SEQ ID NO: 3308098 - DNA, 17 bp, Homo sapiens
atgttgctataataaag

SEQ ID NO: 3308099 - DNA, 22 bp, Homo sapiens
atgttgctatgtgccttatgtt

SEQ ID NO: 3308100 - DNA, 20 bp, Homo sapiens
atgttgctgaggagtgagga

SEQ ID NO: 3308101 - DNA, 19 bp, Homo sapiens
atgttgctggactgtcata

SEQ ID NO: 3308102 - DNA, 14 bp, Homo sapiens
atgttggccaggct

SEQ ID NO: 3308103 - DNA, 19 bp, Homo sapiens
atgttggccaggctggtct

SEQ ID NO: 3308104 - DNA, 18 bp, Homo sapiens
atgttggtcattttatgt

SEQ ID NO: 3308105 - DNA, 14 bp, Homo sapiens
atgttggtgttcca

SEQ ID NO: 3308106 - DNA, 14 bp, Homo sapiens
atgttggtttactt

SEQ ID NO: 3308107 - DNA, 18 bp, Homo sapiens
atgttggtttactttcaa

SEQ ID NO: 3308108 - DNA, 23 bp, Homo sapiens
atgttgtaataaaacttatgcta

SEQ ID NO: 3308109 - DNA, 19 bp, Homo sapiens
atgttgtaatatttcttca

SEQ ID NO: 3308110 - DNA, 14 bp, Homo sapiens
atgttgtaatgctg

SEQ ID NO: 3308111 - DNA, 18 bp, Homo sapiens
atgttgtacaatcaaaac

SEQ ID NO: 3308112 - DNA, 16 bp, Homo sapiens
atgttgtccaacaata

SEQ ID NO: 3308113 - DNA, 14 bp, Homo sapiens
atgttgttatttaa

SEQ ID NO: 3308114 - DNA, 17 bp, Homo sapiens
atgttgttatttaaaga

SEQ ID NO: 3308115 - DNA, 19 bp, Homo sapiens
atgttgttcaaatgcattt

SEQ ID NO: 3308116 - DNA, 20 bp, Homo sapiens
atgttgttcaaatgcatttt

SEQ ID NO: 3308117 - DNA, 19 bp, Homo sapiens
atgtttacactctttgtaa

SEQ ID NO: 3308118 - DNA, 21 bp, Homo sapiens
atgtttacactctttgtaaga

SEQ ID NO: 3308119 - DNA, 20 bp, Homo sapiens
atgtttacatatcacctcat

SEQ ID NO: 3308120 - DNA, 13 bp, Homo sapiens
atgtttatactgt

SEQ ID NO: 3308121 - DNA, 22 bp, Homo sapiens
atgtttatactgtatttctaag

SEQ ID NO: 3308122 - DNA, 23 bp, Homo sapiens
atgtttatactgtatttctaaga

SEQ ID NO: 3308123 - DNA, 18 bp, Homo sapiens
atgtttatgaaaataaat

SEQ ID NO: 3308124 - DNA, 15 bp, Homo sapiens
atgtttatgagccag

SEQ ID NO: 3308125 - DNA, 16 bp, Homo sapiens
atgtttatgagccaga

SEQ ID NO: 3308126 - DNA, 18 bp, Homo sapiens
atgtttattcctgataat

SEQ ID NO: 3308127 - DNA, 15 bp, Homo sapiens
atgtttattctaata

SEQ ID NO: 3308128 - DNA, 13 bp, Homo sapiens
atgtttccagcag

SEQ ID NO: 3308129 - DNA, 19 bp, Homo sapiens
atgtttccagcagaagaca

SEQ ID NO: 3308130 - DNA, 24 bp, Homo sapiens
atgtttccagcagaagacaaaaag

SEQ ID NO: 3308131 - DNA, 18 bp, Homo sapiens
attacttttgcaaactgt

SEQ ID NO: 3308132 - DNA, 15 bp, Homo sapiens
attagaaaatattct

SEQ ID NO: 3308133 - DNA, 21 bp, Homo sapiens
attagaaaatattctctattt

SEQ ID NO: 3308134 - DNA, 13 bp, Homo sapiens
attagaaaatgtt

SEQ ID NO: 3308135 - DNA, 22 bp, Homo sapiens
attagaaaatgttatttaacag

SEQ ID NO: 3308136 - DNA, 16 bp, Homo sapiens
attagaaatagacagt

SEQ ID NO: 3308137 - DNA, 14 bp, Homo sapiens
attagaacatttaa

SEQ ID NO: 3308138 - DNA, 15 bp, Homo sapiens
attagaagacaacag

SEQ ID NO: 3308139 - DNA, 15 bp, Homo sapiens
attagaagtctttca

SEQ ID NO: 3308140 - DNA, 16 bp, Homo sapiens
attagaagtctttcag

SEQ ID NO: 3308141 - DNA, 22 bp, Homo sapiens
attagaatagtgttctgcaaaa

SEQ ID NO: 3308142 - DNA, 12 bp, Homo sapiens
attagaatgccg

SEQ ID NO: 3308143 - DNA, 21 bp, Homo sapiens
attagaattagtgccagaatt

SEQ ID NO: 3308144 - DNA, 18 bp, Homo sapiens
attagactgtgattcaga

SEQ ID NO: 3308145 - DNA, 20 bp, Homo sapiens
attagactttagaaataaat

SEQ ID NO: 3308146 - DNA, 13 bp, Homo sapiens
attagagaagctg

SEQ ID NO: 3308147 - DNA, 14 bp, Homo sapiens
attagagcattgaa

SEQ ID NO: 3308148 - DNA, 19 bp, Homo sapiens
attagagggaggagaatga

SEQ ID NO: 3308149 - DNA, 13 bp, Homo sapiens
attagagggaggt

SEQ ID NO: 3308150 - DNA, 19 bp, Homo sapiens
attagatcaaatagttgca

SEQ ID NO: 3308151 - DNA, 22 bp, Homo sapiens
attagatggcttattttttaaa

SEQ ID NO: 3308152 - DNA, 18 bp, Homo sapiens
attagattttattttact

SEQ ID NO: 3308153 - DNA, 20 bp, Homo sapiens
attagattttattttactat

SEQ ID NO: 3308154 - DNA, 14 bp, Homo sapiens
attagcacagattt

SEQ ID NO: 3308155 - DNA, 18 bp, Homo sapiens
attagcacagattttaat

SEQ ID NO: 3308156 - DNA, 19 bp, Homo sapiens
attagcaggtgcaccttct

SEQ ID NO: 3308157 - DNA, 13 bp, Homo sapiens
attagccaggatc

SEQ ID NO: 3308158 - DNA, 18 bp, Homo sapiens
attagctctggggggcag

SEQ ID NO: 3308159 - DNA, 16 bp, Homo sapiens
attagctgtgtgaaat

SEQ ID NO: 3308160 - DNA, 19 bp, Homo sapiens
attagctttattatggctt

SEQ ID NO: 3308161 - DNA, 22 bp, Homo sapiens
attagctttattatggcttgtg

SEQ ID NO: 3308162 - DNA, 23 bp, Homo sapiens
attagctttattatggcttgtga

SEQ ID NO: 3308163 - DNA, 20 bp, Homo sapiens
attaggaagtgtaacagctg

SEQ ID NO: 3308164 - DNA, 16 bp, Homo sapiens
attaggatttcatgat

SEQ ID NO: 3308165 - DNA, 20 bp, Homo sapiens
attaggcaaggctatgtgat

SEQ ID NO: 3308166 - DNA, 23 bp, Homo sapiens
attagggagaaaattcaattgta

SEQ ID NO: 3308167 - DNA, 15 bp, Homo sapiens
attagggatgcctcc

SEQ ID NO: 3308168 - DNA, 23 bp, Homo sapiens
attagggcaattggaacaaagtg

SEQ ID NO: 3308169 - DNA, 19 bp, Homo sapiens
attagtatggttcaagatt

SEQ ID NO: 3308170 - DNA, 13 bp, Homo sapiens
attagtatgtctg

SEQ ID NO: 3308171 - DNA, 16 bp, Homo sapiens
attagtccaaatgtga

SEQ ID NO: 3308172 - DNA, 15 bp, Homo sapiens
attagtgattctgat

SEQ ID NO: 3308173 - DNA, 21 bp, Homo sapiens
attagtgccacttaatgtatg

SEQ ID NO: 3308174 - DNA, 22 bp, Homo sapiens
attagtgccacttaatgtatgt

SEQ ID NO: 3308175 - DNA, 18 bp, Homo sapiens
attagtgccagaatttta

SEQ ID NO: 3308176 - DNA, 22 bp, Homo sapiens
attagtgccagaattttaggaa

SEQ ID NO: 3308177 - DNA, 17 bp, Homo sapiens
attagtttcctttttaa

SEQ ID NO: 3308178 - DNA, 20 bp, Homo sapiens
attagtttcctttttaatat

SEQ ID NO: 3308179 - DNA, 14 bp, Homo sapiens
attataaaaatatt

SEQ ID NO: 3308180 - DNA, 22 bp, Homo sapiens
attataaaaatattaagacaat

SEQ ID NO: 3308181 - DNA, 13 bp, Homo sapiens
attataaaaccat

SEQ ID NO: 3308182 - DNA, 14 bp, Homo sapiens
attataaaaccatg

SEQ ID NO: 3308183 - DNA, 17 bp, Homo sapiens
attataaatatatataa

SEQ ID NO: 3308184 - DNA, 20 bp, Homo sapiens
attataaatatatataaaga

SEQ ID NO: 3308185 - DNA, 12 bp, Homo sapiens
attataactgta

SEQ ID NO: 3308186 - DNA, 15 bp, Homo sapiens
attataacttaaaat

SEQ ID NO: 3308187 - DNA, 13 bp, Homo sapiens
attataacttatt

SEQ ID NO: 3308188 - DNA, 18 bp, Homo sapiens
attataacttattagcag

SEQ ID NO: 3308189 - DNA, 18 bp, Homo sapiens
attataagcattgaaatt

SEQ ID NO: 3308190 - DNA, 23 bp, Homo sapiens
attataagggagagctgagccag

SEQ ID NO: 3308191 - DNA, 19 bp, Homo sapiens
attataagtcttacataaa

SEQ ID NO: 3308192 - DNA, 18 bp, Homo sapiens
attataatctcaaaggag

SEQ ID NO: 3308193 - DNA, 13 bp, Homo sapiens
attataattgtat

SEQ ID NO: 3308194 - DNA, 15 bp, Homo sapiens
attataattgtatca

SEQ ID NO: 3308195 - DNA, 23 bp, Homo sapiens
attataatttttttcaatattta

SEQ ID NO: 3308196 - DNA, 18 bp, Homo sapiens
attatacaaaagagcatg

SEQ ID NO: 3308197 - DNA, 22 bp, Homo sapiens
attatacaaaagagcatggatg

SEQ ID NO: 3308198 - DNA, 23 bp, Homo sapiens
attatacaaaagagcatggatgc

SEQ ID NO: 3308199 - DNA, 19 bp, Homo sapiens
attatacaaattaaaaaga

SEQ ID NO: 3308200 - DNA, 20 bp, Homo sapiens
attatacatgtgatacattt

SEQ ID NO: 3308201 - DNA, 22 bp, Homo sapiens
attatacatgtgatacattttt

SEQ ID NO: 3308202 - DNA, 14 bp, Homo sapiens
attatacgctggca

SEQ ID NO: 3308203 - DNA, 17 bp, Homo sapiens
attatactaacttattt

SEQ ID NO: 3308204 - DNA, 20 bp, Homo sapiens
attatactgtagctgatgaa

SEQ ID NO: 3308205 - DNA, 13 bp, Homo sapiens
attatactttata

SEQ ID NO: 3308206 - DNA, 14 bp, Homo sapiens
attatactttatat

SEQ ID NO: 3308207 - DNA, 17 bp, Homo sapiens
attatactttatatctg

SEQ ID NO: 3308208 - DNA, 16 bp, Homo sapiens
attatagattctaaag

SEQ ID NO: 3308209 - DNA, 19 bp, Homo sapiens
attatagattctaaagatt

SEQ ID NO: 3308210 - DNA, 15 bp, Homo sapiens
attatagcaacttta

SEQ ID NO: 3308211 - DNA, 15 bp, Homo sapiens
attatagcttttaag

SEQ ID NO: 3308212 - DNA, 19 bp, Homo sapiens
attataggtaatcaatgaa

SEQ ID NO: 3308213 - DNA, 15 bp, Homo sapiens
attatagtttcaagc

SEQ ID NO: 3308214 - DNA, 13 bp, Homo sapiens
attatattctaat

SEQ ID NO: 3308215 - DNA, 23 bp, Homo sapiens
attatattggtgcgtttttacag

SEQ ID NO: 3308216 - DNA, 17 bp, Homo sapiens
attatcaatatctaata

SEQ ID NO: 3308217 - DNA, 13 bp, Homo sapiens
attatcagcaaag

SEQ ID NO: 3308218 - DNA, 15 bp, Homo sapiens
attatcagcaaagaa

SEQ ID NO: 3308219 - DNA, 17 bp, Homo sapiens
attatccatattgagtc

SEQ ID NO: 3308220 - DNA, 21 bp, Homo sapiens
attatcctgaactcttctgca

SEQ ID NO: 3308221 - DNA, 19 bp, Homo sapiens
attatcggaagcagtgcct

SEQ ID NO: 3308222 - DNA, 16 bp, Homo sapiens
attatcgggaacagtg

SEQ ID NO: 3308223 - DNA, 18 bp, Homo sapiens
attatcgggaacagtgtt

SEQ ID NO: 3308224 - DNA, 19 bp, Homo sapiens
attatcgggaacagtgttt

SEQ ID NO: 3308225 - DNA, 20 bp, Homo sapiens
attatctatacatatcttta

SEQ ID NO: 3308226 - DNA, 22 bp, Homo sapiens
attatctatacatatctttatt

SEQ ID NO: 3308227 - DNA, 13 bp, Homo sapiens
attatctgagttg

SEQ ID NO: 3308228 - DNA, 12 bp, Homo sapiens
attatgacagtt

SEQ ID NO: 3308229 - DNA, 14 bp, Homo sapiens
attatgacagttat

SEQ ID NO: 3308230 - DNA, 17 bp, Homo sapiens
attatgacagttatact

SEQ ID NO: 3308231 - DNA, 20 bp, Homo sapiens
attatgagaggcaatgattg

SEQ ID NO: 3308232 - DNA, 23 bp, Homo sapiens
attatgagattggttttcctgtg

SEQ ID NO: 3308233 - DNA, 15 bp, Homo sapiens
attatgagctacaac

SEQ ID NO: 3308234 - DNA, 21 bp, Homo sapiens
attatgatgcatacagttttc

SEQ ID NO: 3308235 - DNA, 16 bp, Homo sapiens
attatgcactaaatat

SEQ ID NO: 3308236 - DNA, 16 bp, Homo sapiens
attatgcattatatca

SEQ ID NO: 3308237 - DNA, 14 bp, Homo sapiens
attatgcattctta

SEQ ID NO: 3308238 - DNA, 16 bp, Homo sapiens
attatgcattcttata

SEQ ID NO: 3308239 - DNA, 14 bp, Homo sapiens
attatgccactgct

SEQ ID NO: 3308240 - DNA, 15 bp, Homo sapiens
attatggaaaaataa

SEQ ID NO: 3308241 - DNA, 14 bp, Homo sapiens
attatggaaaactg

SEQ ID NO: 3308242 - DNA, 15 bp, Homo sapiens
attatggaaaactgt

SEQ ID NO: 3308243 - DNA, 14 bp, Homo sapiens
attatggaatatca

SEQ ID NO: 3308244 - DNA, 19 bp, Homo sapiens
attatggaatatcatctgt

SEQ ID NO: 3308245 - DNA, 16 bp, Homo sapiens
attatggcctttttaa

SEQ ID NO: 3308246 - DNA, 19 bp, Homo sapiens
attatggcctttttaagta

SEQ ID NO: 3308247 - DNA, 17 bp, Homo sapiens
attatgtatgtttacat

SEQ ID NO: 3308248 - DNA, 15 bp, Homo sapiens
attatgtcaaccagg

SEQ ID NO: 3308249 - DNA, 17 bp, Homo sapiens
attatgtccactgtgta

SEQ ID NO: 3308250 - DNA, 16 bp, Homo sapiens
attatgtctcaaaata

SEQ ID NO: 3308251 - DNA, 14 bp, Homo sapiens
attatgtcttcttt

SEQ ID NO: 3308252 - DNA, 23 bp, Homo sapiens
attatgtcttttatatttgtatc

SEQ ID NO: 3308253 - DNA, 13 bp, Homo sapiens
attatgtgaagaa

SEQ ID NO: 3308254 - DNA, 17 bp, Homo sapiens
attatgtggttttagat

SEQ ID NO: 3308255 - DNA, 19 bp, Homo sapiens
attatgtgtgcatgtgtgt

SEQ ID NO: 3308256 - DNA, 12 bp, Homo sapiens
attatgttcatg

SEQ ID NO: 3308257 - DNA, 20 bp, Homo sapiens
attcagtgctgtggcctggg

SEQ ID NO: 3308258 - DNA, 21 bp, Homo sapiens
attcagtgctgtggcctgggc

SEQ ID NO: 3308259 - DNA, 14 bp, Homo sapiens
attcagtgcttctt

SEQ ID NO: 3308260 - DNA, 14 bp, Homo sapiens
attcagtttcataa

SEQ ID NO: 3308261 - DNA, 14 bp, Homo sapiens
attcagttttcatt

SEQ ID NO: 3308262 - DNA, 18 bp, Homo sapiens
attcagtttttgtatctt

SEQ ID NO: 3308263 - DNA, 20 bp, Homo sapiens
attcataaagagaaaatgat

SEQ ID NO: 3308264 - DNA, 17 bp, Homo sapiens
attcatcccaactgtct

SEQ ID NO: 3308265 - DNA, 17 bp, Homo sapiens
attcatcccttaattta

SEQ ID NO: 3308266 - DNA, 18 bp, Homo sapiens
attcatctgggaggcaga

SEQ ID NO: 3308267 - DNA, 20 bp, Homo sapiens
attcatctgtttttcttttt

SEQ ID NO: 3308268 - DNA, 15 bp, Homo sapiens
attcatgtattttgt

SEQ ID NO: 3308269 - DNA, 13 bp, Homo sapiens
attcatgttttga

SEQ ID NO: 3308270 - DNA, 15 bp, Homo sapiens
attcattaaatgttt

SEQ ID NO: 3308271 - DNA, 16 bp, Homo sapiens
attcattaaatgtttg

SEQ ID NO: 3308272 - DNA, 19 bp, Homo sapiens
attcattatttttccactt

SEQ ID NO: 3308273 - DNA, 20 bp, Homo sapiens
attcattatttttccacttt

SEQ ID NO: 3308274 - DNA, 18 bp, Homo sapiens
attcattctgtgatcatt

SEQ ID NO: 3308275 - DNA, 14 bp, Homo sapiens
attcattggctcct

SEQ ID NO: 3308276 - DNA, 13 bp, Homo sapiens
attcattgtctct

SEQ ID NO: 3308277 - DNA, 16 bp, Homo sapiens
attcatttaaaatgat

SEQ ID NO: 3308278 - DNA, 12 bp, Homo sapiens
attcatttcaca

SEQ ID NO: 3308279 - DNA, 12 bp, Homo sapiens
attcatttctaa

SEQ ID NO: 3308280 - DNA, 14 bp, Homo sapiens
attcatttgtattg

SEQ ID NO: 3308281 - DNA, 20 bp, Homo sapiens
attcatttgtattgcttatt

SEQ ID NO: 3308282 - DNA, 10 bp, Homo sapiens
attcattttc

SEQ ID NO: 3308283 - DNA, 21 bp, Homo sapiens
attcattttctgacatgcatt

SEQ ID NO: 3308284 - DNA, 22 bp, Homo sapiens
attcattttctgacatgcattg

SEQ ID NO: 3308285 - DNA, 17 bp, Homo sapiens
attccaaaagggggcct

SEQ ID NO: 3308286 - DNA, 12 bp, Homo sapiens
attccaaaatat

SEQ ID NO: 3308287 - DNA, 18 bp, Homo sapiens
attccaaaccaaatttta

SEQ ID NO: 3308288 - DNA, 20 bp, Homo sapiens
attccaaagagtagaattgc

SEQ ID NO: 3308289 - DNA, 16 bp, Homo sapiens
attccaaagtctctaa

SEQ ID NO: 3308290 - DNA, 19 bp, Homo sapiens
attccaaagtctctaattc

SEQ ID NO: 3308291 - DNA, 20 bp, Homo sapiens
attccaaatgtcttttagaa

SEQ ID NO: 3308292 - DNA, 20 bp, Homo sapiens
attccaacagctcaagtctt

SEQ ID NO: 3308293 - DNA, 15 bp, Homo sapiens
attccaacagtgagt

SEQ ID NO: 3308294 - DNA, 20 bp, Homo sapiens
attccaacatttctcactga

SEQ ID NO: 3308295 - DNA, 22 bp, Homo sapiens
attccaagacatgtctgttcta

SEQ ID NO: 3308296 - DNA, 16 bp, Homo sapiens
attccaagactctaga

SEQ ID NO: 3308297 - DNA, 18 bp, Homo sapiens
attccaagactctagagt

SEQ ID NO: 3308298 - DNA, 17 bp, Homo sapiens
attccaatatgatgact

SEQ ID NO: 3308299 - DNA, 18 bp, Homo sapiens
attccaatatgatgactc

SEQ ID NO: 3308300 - DNA, 14 bp, Homo sapiens
attccaatctctgt

SEQ ID NO: 3308301 - DNA, 14 bp, Homo sapiens
attccaattaaatt

SEQ ID NO: 3308302 - DNA, 18 bp, Homo sapiens
attccaattaaatttatt

SEQ ID NO: 3308303 - DNA, 17 bp, Homo sapiens
attccacagatatcttt

SEQ ID NO: 3308304 - DNA, 19 bp, Homo sapiens
attccacagatatcttttt

SEQ ID NO: 3308305 - DNA, 22 bp, Homo sapiens
attccacagatatctttttcat

SEQ ID NO: 3308306 - DNA, 23 bp, Homo sapiens
attccagaatgctgtacatctat

SEQ ID NO: 3308307 - DNA, 14 bp, Homo sapiens
attccagacttcaa

SEQ ID NO: 3308308 - DNA, 20 bp, Homo sapiens
attccagatctttcagaaat

SEQ ID NO: 3308309 - DNA, 14 bp, Homo sapiens
attccagtaacttt

SEQ ID NO: 3308310 - DNA, 19 bp, Homo sapiens
attccagtaacttttttgt

SEQ ID NO: 3308311 - DNA, 22 bp, Homo sapiens
attccatatcttgcgaatccaa

SEQ ID NO: 3308312 - DNA, 23 bp, Homo sapiens
attccatatcttgcgaatccaag

SEQ ID NO: 3308313 - DNA, 17 bp, Homo sapiens
attccatatctttggat

SEQ ID NO: 3308314 - DNA, 13 bp, Homo sapiens
attccatatttat

SEQ ID NO: 3308315 - DNA, 18 bp, Homo sapiens
attccatccatatacttt

SEQ ID NO: 3308316 - DNA, 15 bp, Homo sapiens
attccatgaatgtat

SEQ ID NO: 3308317 - DNA, 14 bp, Homo sapiens
attcccaagaaatg

SEQ ID NO: 3308318 - DNA, 16 bp, Homo sapiens
attcccaagaaatgct

SEQ ID NO: 3308319 - DNA, 16 bp, Homo sapiens
attcccaagctctgct

SEQ ID NO: 3308320 - DNA, 18 bp, Homo sapiens
attcccaagctctgctcc

SEQ ID NO: 3308321 - DNA, 18 bp, Homo sapiens
attcccacacctccacag

SEQ ID NO: 3308322 - DNA, 19 bp, Homo sapiens
attcccagagcaaaataat

SEQ ID NO: 3308323 - DNA, 15 bp, Homo sapiens
attcccagagtcaga

SEQ ID NO: 3308324 - DNA, 15 bp, Homo sapiens
attccccatttcctg

SEQ ID NO: 3308325 - DNA, 17 bp, Homo sapiens
attccccatttcctgta

SEQ ID NO: 3308326 - DNA, 21 bp, Homo sapiens
attcccccatgtggctgaaga

SEQ ID NO: 3308327 - DNA, 17 bp, Homo sapiens
attcccccccctttcct

SEQ ID NO: 3308328 - DNA, 22 bp, Homo sapiens
attcccctctgctgctgtccct

SEQ ID NO: 3308329 - DNA, 18 bp, Homo sapiens
attcccgttttgtcactt

SEQ ID NO: 3308330 - DNA, 21 bp, Homo sapiens
attcccgttttgtcacttttt

SEQ ID NO: 3308331 - DNA, 23 bp, Homo sapiens
attcccgttttgtcactttttct

SEQ ID NO: 3308332 - DNA, 12 bp, Homo sapiens
attccctgccca

SEQ ID NO: 3308333 - DNA, 13 bp, Homo sapiens
attccctgcccaa

SEQ ID NO: 3308334 - DNA, 13 bp, Homo sapiens
attccctgcctgg

SEQ ID NO: 3308335 - DNA, 12 bp, Homo sapiens
attcccttgtat

SEQ ID NO: 3308336 - DNA, 23 bp, Homo sapiens
attcccttttcaccttttcagga

SEQ ID NO: 3308337 - DNA, 18 bp, Homo sapiens
attccgagcattccagta

SEQ ID NO: 3308338 - DNA, 22 bp, Homo sapiens
attccgagcattccagtaactt

SEQ ID NO: 3308339 - DNA, 18 bp, Homo sapiens
attccgttgtctgtggat

SEQ ID NO: 3308340 - DNA, 20 bp, Homo sapiens
attcctaacacagcatgtgt

SEQ ID NO: 3308341 - DNA, 20 bp, Homo sapiens
attcctaactagaattagta

SEQ ID NO: 3308342 - DNA, 14 bp, Homo sapiens
attcctaagaatca

SEQ ID NO: 3308343 - DNA, 15 bp, Homo sapiens
attcctaagccactt

SEQ ID NO: 3308344 - DNA, 21 bp, Homo sapiens
attcctacaacttaatggaaa

SEQ ID NO: 3308345 - DNA, 13 bp, Homo sapiens
attcctactccct

SEQ ID NO: 3308346 - DNA, 14 bp, Homo sapiens
attcctactccctc

SEQ ID NO: 3308347 - DNA, 24 bp, Homo sapiens
attcctatgatggatggcagactc

SEQ ID NO: 3308348 - DNA, 17 bp, Homo sapiens
attcctcacagccttgg

SEQ ID NO: 3308349 - DNA, 21 bp, Homo sapiens
attcctccaaatctcttgctt

SEQ ID NO: 3308350 - DNA, 12 bp, Homo sapiens
attcctctggga

SEQ ID NO: 3308351 - DNA, 14 bp, Homo sapiens
attcctcttattgg

SEQ ID NO: 3308352 - DNA, 14 bp, Homo sapiens
attcctgaaaagct

SEQ ID NO: 3308353 - DNA, 13 bp, Homo sapiens
attcctgaaagaa

SEQ ID NO: 3308354 - DNA, 14 bp, Homo sapiens
attcctgacccagg

SEQ ID NO: 3308355 - DNA, 16 bp, Homo sapiens
attcctgacccaggcc

SEQ ID NO: 3308356 - DNA, 21 bp, Homo sapiens
attcctgacccaggccgcagc

SEQ ID NO: 3308357 - DNA, 20 bp, Homo sapiens
attcctgagatttcctcctg

SEQ ID NO: 3308358 - DNA, 18 bp, Homo sapiens
attcctgcatttgtgaaa

SEQ ID NO: 3308359 - DNA, 14 bp, Homo sapiens
attcctggacatca

SEQ ID NO: 3308360 - DNA, 10 bp, Homo sapiens
attcctgggc

SEQ ID NO: 3308361 - DNA, 20 bp, Homo sapiens
attcctggtacccagccatc

SEQ ID NO: 3308362 - DNA, 15 bp, Homo sapiens
attccttcagatttg

SEQ ID NO: 3308363 - DNA, 22 bp, Homo sapiens
attccttctctgaacacaggca

SEQ ID NO: 3308364 - DNA, 20 bp, Homo sapiens
attccttctttgataatgtt

SEQ ID NO: 3308365 - DNA, 21 bp, Homo sapiens
attccttctttgataatgtta

SEQ ID NO: 3308366 - DNA, 18 bp, Homo sapiens
attccttgccccacagtt

SEQ ID NO: 3308367 - DNA, 12 bp, Homo sapiens
attccttgtgaa

SEQ ID NO: 3308368 - DNA, 11 bp, Homo sapiens
attcctttccc

SEQ ID NO: 3308369 - DNA, 14 bp, Homo sapiens
attcctttcccttt

SEQ ID NO: 3308370 - DNA, 17 bp, Homo sapiens
attcctttccctttagc

SEQ ID NO: 3308371 - DNA, 15 bp, Homo sapiens
attcctttctcatcc

SEQ ID NO: 3308372 - DNA, 18 bp, Homo sapiens
attccttttgtgtacagt

SEQ ID NO: 3308373 - DNA, 19 bp, Homo sapiens
attcgcccgagctgtttat

SEQ ID NO: 3308374 - DNA, 22 bp, Homo sapiens
attcgcctttgtcttgtacttc

SEQ ID NO: 3308375 - DNA, 20 bp, Homo sapiens
attcgctgaattgcccgttt

SEQ ID NO: 3308376 - DNA, 16 bp, Homo sapiens
attcgctgtacccttt

SEQ ID NO: 3308377 - DNA, 22 bp, Homo sapiens
attcgctgtaccctttaagata

SEQ ID NO: 3308378 - DNA, 20 bp, Homo sapiens
attcggaactgtcctttcct

SEQ ID NO: 3308379 - DNA, 21 bp, Homo sapiens
attcggaactgtcctttcctt

SEQ ID NO: 3308380 - DNA, 14 bp, Homo sapiens
attcgggccacagg

SEQ ID NO: 3308381 - DNA, 22 bp, Homo sapiens
attcgtgagctggggactcagg

SEQ ID NO: 3308382 - DNA, 21 bp, Homo sapiens
attcgtgattttcaagcagca

SEQ ID NO: 3308383 - DNA, 19 bp, Homo sapiens
attcttttctcagtgttgg

SEQ ID NO: 3308384 - DNA, 16 bp, Homo sapiens
attctttttctttttt

SEQ ID NO: 3308385 - DNA, 19 bp, Homo sapiens
attgaaaaaaaaaatgttg

SEQ ID NO: 3308386 - DNA, 17 bp, Homo sapiens
attgaaaacttcaaagc

SEQ ID NO: 3308387 - DNA, 16 bp, Homo sapiens
attgaaaagtttttgt

SEQ ID NO: 3308388 - DNA, 16 bp, Homo sapiens
attgaaaattgaaaag

SEQ ID NO: 3308389 - DNA, 18 bp, Homo sapiens
attgaaaattgaaaagta

SEQ ID NO: 3308390 - DNA, 15 bp, Homo sapiens
attgaaagagaacca

SEQ ID NO: 3308391 - DNA, 17 bp, Homo sapiens
attgaaattgtacatat

SEQ ID NO: 3308392 - DNA, 19 bp, Homo sapiens
attgaaattgtgaactcat

SEQ ID NO: 3308393 - DNA, 14 bp, Homo sapiens
attgaacacaaact

SEQ ID NO: 3308394 - DNA, 17 bp, Homo sapiens
attgaacacaaactgta

SEQ ID NO: 3308395 - DNA, 15 bp, Homo sapiens
attgaaccagctcat

SEQ ID NO: 3308396 - DNA, 20 bp, Homo sapiens
attgaagagatttcaacata

SEQ ID NO: 3308397 - DNA, 12 bp, Homo sapiens
attgaaggaatt

SEQ ID NO: 3308398 - DNA, 22 bp, Homo sapiens
attgaagtaaactttttgttct

SEQ ID NO: 3308399 - DNA, 13 bp, Homo sapiens
attgaagtttcaa

SEQ ID NO: 3308400 - DNA, 15 bp, Homo sapiens
attgaagtttcaagt

SEQ ID NO: 3308401 - DNA, 22 bp, Homo sapiens
attgaataaaaaatagacatgt

SEQ ID NO: 3308402 - DNA, 13 bp, Homo sapiens
attgaatattgtg

SEQ ID NO: 3308403 - DNA, 15 bp, Homo sapiens
attgaatattgtgtt

SEQ ID NO: 3308404 - DNA, 20 bp, Homo sapiens
attgaatggtgcattgtata

SEQ ID NO: 3308405 - DNA, 16 bp, Homo sapiens
attgacaaatctgtgt

SEQ ID NO: 3308406 - DNA, 14 bp, Homo sapiens
attgaccaagaact

SEQ ID NO: 3308407 - DNA, 18 bp, Homo sapiens
attgaccaagaactgcat

SEQ ID NO: 3308408 - DNA, 15 bp, Homo sapiens
attgacggtttttta

SEQ ID NO: 3308409 - DNA, 21 bp, Homo sapiens
attgacggttttttattattg

SEQ ID NO: 3308410 - DNA, 22 bp, Homo sapiens
attgactcaaatctccagtatt

SEQ ID NO: 3308411 - DNA, 14 bp, Homo sapiens
attgacttcatttt

SEQ ID NO: 3308412 - DNA, 17 bp, Homo sapiens
attgacttcattttata

SEQ ID NO: 3308413 - DNA, 18 bp, Homo sapiens
attgacttcattttatat

SEQ ID NO: 3308414 - DNA, 20 bp, Homo sapiens
attgacttcattttatattt

SEQ ID NO: 3308415 - DNA, 22 bp, Homo sapiens
attgacttcattttatatttaa

SEQ ID NO: 3308416 - DNA, 17 bp, Homo sapiens
attgactttatgttgta

SEQ ID NO: 3308417 - DNA, 17 bp, Homo sapiens
attgagaattttaaatt

SEQ ID NO: 3308418 - DNA, 16 bp, Homo sapiens
attgagagttttgtct

SEQ ID NO: 3308419 - DNA, 20 bp, Homo sapiens
attgagctagcgatttcaga

SEQ ID NO: 3308420 - DNA, 19 bp, Homo sapiens
attgagctgatataaattc

SEQ ID NO: 3308421 - DNA, 20 bp, Homo sapiens
attgagctgatataaattct

SEQ ID NO: 3308422 - DNA, 18 bp, Homo sapiens
attgaggagctgcactga

SEQ ID NO: 3308423 - DNA, 16 bp, Homo sapiens
attgagggtcattctt

SEQ ID NO: 3308424 - DNA, 18 bp, Homo sapiens
attgaggtttggaagagt

SEQ ID NO: 3308425 - DNA, 22 bp, Homo sapiens
attgagtaatggtgtagaacac

SEQ ID NO: 3308426 - DNA, 17 bp, Homo sapiens
attgagttccagttgaa

SEQ ID NO: 3308427 - DNA, 21 bp, Homo sapiens
attgagtttgtaggtaaaatg

SEQ ID NO: 3308428 - DNA, 13 bp, Homo sapiens
attgataatcttc

SEQ ID NO: 3308429 - DNA, 18 bp, Homo sapiens
attgatagagtgttatca

SEQ ID NO: 3308430 - DNA, 20 bp, Homo sapiens
attgatatctccatgatgat

SEQ ID NO: 3308431 - DNA, 23 bp, Homo sapiens
attgatcactttgttaaaaatat

SEQ ID NO: 3308432 - DNA, 20 bp, Homo sapiens
attgatcattttccccccac

SEQ ID NO: 3308433 - DNA, 21 bp, Homo sapiens
attgatcattttccccccact

SEQ ID NO: 3308434 - DNA, 20 bp, Homo sapiens
attgatgcatgctattcaca

SEQ ID NO: 3308435 - DNA, 21 bp, Homo sapiens
attgatgtacagtctgtcatg

SEQ ID NO: 3308436 - DNA, 19 bp, Homo sapiens
attgatgtgtttatttata

SEQ ID NO: 3308437 - DNA, 16 bp, Homo sapiens
attgatgttaacaaga

SEQ ID NO: 3308438 - DNA, 13 bp, Homo sapiens
attgatttgcatt

SEQ ID NO: 3308439 - DNA, 20 bp, Homo sapiens
attgatttgcattgaacaca

SEQ ID NO: 3308440 - DNA, 19 bp, Homo sapiens
attgcaaaatagcatttgt

SEQ ID NO: 3308441 - DNA, 17 bp, Homo sapiens
attgcaaatcttgaaat

SEQ ID NO: 3308442 - DNA, 19 bp, Homo sapiens
attgcaacaggctgggctt

SEQ ID NO: 3308443 - DNA, 23 bp, Homo sapiens
attgcaagaagctttatttctag

SEQ ID NO: 3308444 - DNA, 14 bp, Homo sapiens
attgcaatatctga

SEQ ID NO: 3308445 - DNA, 17 bp, Homo sapiens
attgcaatatctgaagc

SEQ ID NO: 3308446 - DNA, 13 bp, Homo sapiens
attgcacagaatt

SEQ ID NO: 3308447 - DNA, 16 bp, Homo sapiens
attgcacgtggcctct

SEQ ID NO: 3308448 - DNA, 19 bp, Homo sapiens
attgcacgtggcctcttga

SEQ ID NO: 3308449 - DNA, 23 bp, Homo sapiens
attgcacgtggcctcttgagcag

SEQ ID NO: 3308450 - DNA, 10 bp, Homo sapiens
attgcactaa

SEQ ID NO: 3308451 - DNA, 12 bp, Homo sapiens
attgcactaaat

SEQ ID NO: 3308452 - DNA, 23 bp, Homo sapiens
attgcactctaaaaggttcaggg

SEQ ID NO: 3308453 - DNA, 18 bp, Homo sapiens
attgcactgaagtttttg

SEQ ID NO: 3308454 - DNA, 20 bp, Homo sapiens
attgcactgaagtttttgaa

SEQ ID NO: 3308455 - DNA, 22 bp, Homo sapiens
attgcactgaagtttttgaaat

SEQ ID NO: 3308456 - DNA, 17 bp, Homo sapiens
attgcactgctgttcct

SEQ ID NO: 3308457 - DNA, 22 bp, Homo sapiens
attgcacttgattaagcttttg

SEQ ID NO: 3308458 - DNA, 16 bp, Homo sapiens
attgcagaaaggagag

SEQ ID NO: 3308459 - DNA, 17 bp, Homo sapiens
attgcagactgttctta

SEQ ID NO: 3308460 - DNA, 18 bp, Homo sapiens
attgcaggagacattttc

SEQ ID NO: 3308461 - DNA, 14 bp, Homo sapiens
attgcaggatggtg

SEQ ID NO: 3308462 - DNA, 18 bp, Homo sapiens
attgcatcacctctgtaa

SEQ ID NO: 3308463 - DNA, 22 bp, Homo sapiens
attgcatcacctctgtaatttt

SEQ ID NO: 3308464 - DNA, 15 bp, Homo sapiens
attgccaaattgaca

SEQ ID NO: 3308465 - DNA, 20 bp, Homo sapiens
attgccaagccccccgagtg

SEQ ID NO: 3308466 - DNA, 21 bp, Homo sapiens
attgccaccaggagaaccact

SEQ ID NO: 3308467 - DNA, 16 bp, Homo sapiens
attgccagtgtctttc

SEQ ID NO: 3308468 - DNA, 18 bp, Homo sapiens
attgccagtgtctttctt

SEQ ID NO: 3308469 - DNA, 18 bp, Homo sapiens
attgccattttattaaac

SEQ ID NO: 3308470 - DNA, 21 bp, Homo sapiens
attgcccatgggatatgtggt

SEQ ID NO: 3308471 - DNA, 18 bp, Homo sapiens
attgcccccacctctggt

SEQ ID NO: 3308472 - DNA, 12 bp, Homo sapiens
attgcctcctgt

SEQ ID NO: 3308473 - DNA, 20 bp, Homo sapiens
attgcctcctgttctgccca

SEQ ID NO: 3308474 - DNA, 21 bp, Homo sapiens
attgcctcttttcacattttt

SEQ ID NO: 3308475 - DNA, 13 bp, Homo sapiens
attgcgctgctac

SEQ ID NO: 3308476 - DNA, 16 bp, Homo sapiens
attgcggacagccacg

SEQ ID NO: 3308477 - DNA, 18 bp, Homo sapiens
attgcggacagccacggc

SEQ ID NO: 3308478 - DNA, 18 bp, Homo sapiens
attgcggccccaggaggg

SEQ ID NO: 3308479 - DNA, 18 bp, Homo sapiens
attgctactataatcaaa

SEQ ID NO: 3308480 - DNA, 22 bp, Homo sapiens
attgctagccagcattccatat

SEQ ID NO: 3308481 - DNA, 18 bp, Homo sapiens
attgctatgttactattt

SEQ ID NO: 3308482 - DNA, 20 bp, Homo sapiens
attgctatgttactattttc

SEQ ID NO: 3308483 - DNA, 23 bp, Homo sapiens
attgctcaagttcattgatgacc

SEQ ID NO: 3308484 - DNA, 16 bp, Homo sapiens
attgctgattttaaag

SEQ ID NO: 3308485 - DNA, 22 bp, Homo sapiens
attgctgtaccacatctgctct

SEQ ID NO: 3308486 - DNA, 14 bp, Homo sapiens
attgcttacatttt

SEQ ID NO: 3308487 - DNA, 16 bp, Homo sapiens
attgcttacattttta

SEQ ID NO: 3308488 - DNA, 21 bp, Homo sapiens
attgcttacatttttacaata

SEQ ID NO: 3308489 - DNA, 13 bp, Homo sapiens
attgcttagtaaa

SEQ ID NO: 3308490 - DNA, 22 bp, Homo sapiens
attgcttagtaaaatttatttc

SEQ ID NO: 3308491 - DNA, 19 bp, Homo sapiens
attgcttattttattatga

SEQ ID NO: 3308492 - DNA, 22 bp, Homo sapiens
attgcttctgtagtactcctta

SEQ ID NO: 3308493 - DNA, 15 bp, Homo sapiens
attgctttctgaaat

SEQ ID NO: 3308494 - DNA, 17 bp, Homo sapiens
attgctttctgaaatta

SEQ ID NO: 3308495 - DNA, 23 bp, Homo sapiens
attgctttgaagcagttgtgtca

SEQ ID NO: 3308496 - DNA, 14 bp, Homo sapiens
attgctttgccaaa

SEQ ID NO: 3308497 - DNA, 20 bp, Homo sapiens
attgctttgccaaaatacca

SEQ ID NO: 3308498 - DNA, 18 bp, Homo sapiens
attgctttggtcatatga

SEQ ID NO: 3308499 - DNA, 18 bp, Homo sapiens
attgcttttattttgaaa

SEQ ID NO: 3308500 - DNA, 19 bp, Homo sapiens
attgcttttgttgtgactt

SEQ ID NO: 3308501 - DNA, 20 bp, Homo sapiens
attgcttttgttgtgacttt

SEQ ID NO: 3308502 - DNA, 21 bp, Homo sapiens
attggaagtgttcaagaaata

SEQ ID NO: 3308503 - DNA, 22 bp, Homo sapiens
attggaatggaactactgtact

SEQ ID NO: 3308504 - DNA, 14 bp, Homo sapiens
attggaattaacct

SEQ ID NO: 3308505 - DNA, 15 bp, Homo sapiens
attggaattaacctg

SEQ ID NO: 3308506 - DNA, 16 bp, Homo sapiens
attggacatagatatt

SEQ ID NO: 3308507 - DNA, 17 bp, Homo sapiens
attggacattttcttca

SEQ ID NO: 3308508 - DNA, 16 bp, Homo sapiens
atttataaaaaggtgt

SEQ ID NO: 3308509 - DNA, 15 bp, Homo sapiens
atttataaaattaga

SEQ ID NO: 3308510 - DNA, 17 bp, Homo sapiens
atttataaacagacaat

SEQ ID NO: 3308511 - DNA, 21 bp, Homo sapiens
atttataaacagacaatatgt

SEQ ID NO: 3308512 - DNA, 18 bp, Homo sapiens
atttataaactaggtaaa

SEQ ID NO: 3308513 - DNA, 17 bp, Homo sapiens
atttataaatgagcaaa

SEQ ID NO: 3308514 - DNA, 13 bp, Homo sapiens
atttataactcat

SEQ ID NO: 3308515 - DNA, 18 bp, Homo sapiens
atttataactcatcataa

SEQ ID NO: 3308516 - DNA, 17 bp, Homo sapiens
atttataagcagattta

SEQ ID NO: 3308517 - DNA, 17 bp, Homo sapiens
atttataatacagaatc

SEQ ID NO: 3308518 - DNA, 16 bp, Homo sapiens
atttataatgttagta

SEQ ID NO: 3308519 - DNA, 19 bp, Homo sapiens
atttatacagtgccttgct

SEQ ID NO: 3308520 - DNA, 23 bp, Homo sapiens
atttataggccagggcatgtgta

SEQ ID NO: 3308521 - DNA, 17 bp, Homo sapiens
atttatagtatgtgact

SEQ ID NO: 3308522 - DNA, 18 bp, Homo sapiens
atttatagtatgtgactt

SEQ ID NO: 3308523 - DNA, 14 bp, Homo sapiens
atttatatatgtat

SEQ ID NO: 3308524 - DNA, 14 bp, Homo sapiens
atttatatatttat

SEQ ID NO: 3308525 - DNA, 16 bp, Homo sapiens
atttatatatttataa

SEQ ID NO: 3308526 - DNA, 17 bp, Homo sapiens
atttatatatttataac

SEQ ID NO: 3308527 - DNA, 21 bp, Homo sapiens
atttatatcagtttcatgaaa

SEQ ID NO: 3308528 - DNA, 19 bp, Homo sapiens
atttatattgtcactcatt

SEQ ID NO: 3308529 - DNA, 15 bp, Homo sapiens
atttatatttggaaa

SEQ ID NO: 3308530 - DNA, 19 bp, Homo sapiens
atttatatttttaaaatat

SEQ ID NO: 3308531 - DNA, 18 bp, Homo sapiens
atttatatttttatttta

SEQ ID NO: 3308532 - DNA, 13 bp, Homo sapiens
atttatatttttg

SEQ ID NO: 3308533 - DNA, 15 bp, Homo sapiens
atttatcagtgacag

SEQ ID NO: 3308534 - DNA, 18 bp, Homo sapiens
atttatccaaaatgtgta

SEQ ID NO: 3308535 - DNA, 20 bp, Homo sapiens
atttatccacaggaaagtgt

SEQ ID NO: 3308536 - DNA, 21 bp, Homo sapiens
atttatccacaggaaagtgtt

SEQ ID NO: 3308537 - DNA, 16 bp, Homo sapiens
atttatccctttacaa

SEQ ID NO: 3308538 - DNA, 22 bp, Homo sapiens
atttatccctttacaatgtgaa

SEQ ID NO: 3308539 - DNA, 20 bp, Homo sapiens
atttatcctgaaatttcaga

SEQ ID NO: 3308540 - DNA, 21 bp, Homo sapiens
atttatcctgaaatttcagat

SEQ ID NO: 3308541 - DNA, 11 bp, Homo sapiens
atttatctata

SEQ ID NO: 3308542 - DNA, 14 bp, Homo sapiens
atttatctccctta

SEQ ID NO: 3308543 - DNA, 19 bp, Homo sapiens
atttatcttgtctctgggc

SEQ ID NO: 3308544 - DNA, 22 bp, Homo sapiens
atttatctttacttttaaacag

SEQ ID NO: 3308545 - DNA, 12 bp, Homo sapiens
atttatctttat

SEQ ID NO: 3308546 - DNA, 18 bp, Homo sapiens
atttatgaaaaaatatga

SEQ ID NO: 3308547 - DNA, 22 bp, Homo sapiens
atttatgaaaaaatatgaacct

SEQ ID NO: 3308548 - DNA, 14 bp, Homo sapiens
atttatgaagcaga

SEQ ID NO: 3308549 - DNA, 15 bp, Homo sapiens
atttatgaagcagat

SEQ ID NO: 3308550 - DNA, 19 bp, Homo sapiens
atttatgaagcagatttat

SEQ ID NO: 3308551 - DNA, 23 bp, Homo sapiens
atttatgaattgaattatcttgg

SEQ ID NO: 3308552 - DNA, 20 bp, Homo sapiens
atttatgagtaactattatt

SEQ ID NO: 3308553 - DNA, 16 bp, Homo sapiens
atttatgatttaataa

SEQ ID NO: 3308554 - DNA, 17 bp, Homo sapiens
atttatgcaagttaggg

SEQ ID NO: 3308555 - DNA, 17 bp, Homo sapiens
atttatggaccactttt

SEQ ID NO: 3308556 - DNA, 16 bp, Homo sapiens
atttatgggtggattt

SEQ ID NO: 3308557 - DNA, 15 bp, Homo sapiens
atttatggttgttaa

SEQ ID NO: 3308558 - DNA, 23 bp, Homo sapiens
atttatggttgttaaaaatgtca

SEQ ID NO: 3308559 - DNA, 13 bp, Homo sapiens
atttatgtgtgag

SEQ ID NO: 3308560 - DNA, 18 bp, Homo sapiens
atttatgtgtgaggagct

SEQ ID NO: 3308561 - DNA, 16 bp, Homo sapiens
atttatgttaaaagat

SEQ ID NO: 3308562 - DNA, 16 bp, Homo sapiens
atttattaaaaatgtt

SEQ ID NO: 3308563 - DNA, 17 bp, Homo sapiens
atttattaaaaatgttc

SEQ ID NO: 3308564 - DNA, 19 bp, Homo sapiens
atttattaaaatgattgta

SEQ ID NO: 3308565 - DNA, 21 bp, Homo sapiens
atttattaaaatgattgtaaa

SEQ ID NO: 3308566 - DNA, 23 bp, Homo sapiens
atttattaaaatgattgtaaaat

SEQ ID NO: 3308567 - DNA, 14 bp, Homo sapiens
atttattaaataaa

SEQ ID NO: 3308568 - DNA, 16 bp, Homo sapiens
atttattaagatggat

SEQ ID NO: 3308569 - DNA, 21 bp, Homo sapiens
atttattaagatggattctca

SEQ ID NO: 3308570 - DNA, 16 bp, Homo sapiens
atttattaagtctggg

SEQ ID NO: 3308571 - DNA, 15 bp, Homo sapiens
atttattaatattta

SEQ ID NO: 3308572 - DNA, 14 bp, Homo sapiens
atttattaatttga

SEQ ID NO: 3308573 - DNA, 16 bp, Homo sapiens
atttattagccaactg

SEQ ID NO: 3308574 - DNA, 11 bp, Homo sapiens
atttattattt

SEQ ID NO: 3308575 - DNA, 13 bp, Homo sapiens
atttattatttat

SEQ ID NO: 3308576 - DNA, 19 bp, Homo sapiens
atttattcaattcctctgg

SEQ ID NO: 3308577 - DNA, 13 bp, Homo sapiens
atttattcataga

SEQ ID NO: 3308578 - DNA, 19 bp, Homo sapiens
atttattccatattcatgt

SEQ ID NO: 3308579 - DNA, 20 bp, Homo sapiens
atttattccatattcatgta

SEQ ID NO: 3308580 - DNA, 21 bp, Homo sapiens
atttattctctatttattggg

SEQ ID NO: 3308581 - DNA, 13 bp, Homo sapiens
atttattctgctc

SEQ ID NO: 3308582 - DNA, 18 bp, Homo sapiens
atttattgaagaaacaga

SEQ ID NO: 3308583 - DNA, 14 bp, Homo sapiens
atttattgaatatt

SEQ ID NO: 3308584 - DNA, 21 bp, Homo sapiens
atttattgcaggatggtgtct

SEQ ID NO: 3308585 - DNA, 16 bp, Homo sapiens
atttattgtctgtcta

SEQ ID NO: 3308586 - DNA, 17 bp, Homo sapiens
atttattgtctgtctac

SEQ ID NO: 3308587 - DNA, 23 bp, Homo sapiens
atttattgtctgtctacatttct

SEQ ID NO: 3308588 - DNA, 14 bp, Homo sapiens
atttattgttagaa

SEQ ID NO: 3308589 - DNA, 17 bp, Homo sapiens
atttattgtttatgtaa

SEQ ID NO: 3308590 - DNA, 21 bp, Homo sapiens
atttattgtttatgtaaatgt

SEQ ID NO: 3308591 - DNA, 20 bp, Homo sapiens
atttatttaataacaattgt

SEQ ID NO: 3308592 - DNA, 15 bp, Homo sapiens
atttatttaatgtta

SEQ ID NO: 3308593 - DNA, 19 bp, Homo sapiens
atttatttatgaaaaaata

SEQ ID NO: 3308594 - DNA, 17 bp, Homo sapiens
atttatttattaagatg

SEQ ID NO: 3308595 - DNA, 13 bp, Homo sapiens
atttatttattat

SEQ ID NO: 3308596 - DNA, 14 bp, Homo sapiens
atttatttattatt

SEQ ID NO: 3308597 - DNA, 12 bp, Homo sapiens
atttatttcctc

SEQ ID NO: 3308598 - DNA, 15 bp, Homo sapiens
atttatttcctccct

SEQ ID NO: 3308599 - DNA, 14 bp, Homo sapiens
atttatttgtttcc

SEQ ID NO: 3308600 - DNA, 22 bp, Homo sapiens
atttattttaaaaaatgaaaat

SEQ ID NO: 3308601 - DNA, 15 bp, Homo sapiens
atttattttattcta

SEQ ID NO: 3308602 - DNA, 16 bp, Homo sapiens
atttattttattctat

SEQ ID NO: 3308603 - DNA, 16 bp, Homo sapiens
atttattttcctaaag

SEQ ID NO: 3308604 - DNA, 17 bp, Homo sapiens
atttattttcctaaaga

SEQ ID NO: 3308605 - DNA, 18 bp, Homo sapiens
atttatttttcagttcca

SEQ ID NO: 3308606 - DNA, 22 bp, Homo sapiens
atttatttttcagttccaagaa

SEQ ID NO: 3308607 - DNA, 19 bp, Homo sapiens
atttattttttacattatt

SEQ ID NO: 3308608 - DNA, 17 bp, Homo sapiens
atttcaaaaatataact

SEQ ID NO: 3308609 - DNA, 13 bp, Homo sapiens
atttcaaaagaca

SEQ ID NO: 3308610 - DNA, 17 bp, Homo sapiens
atttcaaaagacatgtt

SEQ ID NO: 3308611 - DNA, 19 bp, Homo sapiens
atttcaacatatcattttt

SEQ ID NO: 3308612 - DNA, 12 bp, Homo sapiens
atttcaactgct

SEQ ID NO: 3308613 - DNA, 14 bp, Homo sapiens
atttcaactgctgt

SEQ ID NO: 3308614 - DNA, 19 bp, Homo sapiens
atttcaagaaaaaataaat

SEQ ID NO: 3308615 - DNA, 15 bp, Homo sapiens
atttcaagaccttct

SEQ ID NO: 3308616 - DNA, 21 bp, Homo sapiens
atttcaagcagctgaagaaaa

SEQ ID NO: 3308617 - DNA, 15 bp, Homo sapiens
atttcaaggttctaa

SEQ ID NO: 3308618 - DNA, 13 bp, Homo sapiens
atttcaagtgcct

SEQ ID NO: 3308619 - DNA, 11 bp, Homo sapiens
atttcaagttc

SEQ ID NO: 3308620 - DNA, 16 bp, Homo sapiens
atttcaagttccaagt

SEQ ID NO: 3308621 - DNA, 23 bp, Homo sapiens
atttcaagttccaagttgctaat

SEQ ID NO: 3308622 - DNA, 16 bp, Homo sapiens
atttcaatcattgaag

SEQ ID NO: 3308623 - DNA, 22 bp, Homo sapiens
atttcaatgtgtataaattgtc

SEQ ID NO: 3308624 - DNA, 17 bp, Homo sapiens
atttcacattattctgg

SEQ ID NO: 3308625 - DNA, 14 bp, Homo sapiens
atttcacctgtaaa

SEQ ID NO: 3308626 - DNA, 15 bp, Homo sapiens
atttcacctgtaaac

SEQ ID NO: 3308627 - DNA, 16 bp, Homo sapiens
atttcactagaaaagc

SEQ ID NO: 3308628 - DNA, 16 bp, Homo sapiens
atttcactagagacaa

SEQ ID NO: 3308629 - DNA, 19 bp, Homo sapiens
atttcactatcttcttcaa

SEQ ID NO: 3308630 - DNA, 20 bp, Homo sapiens
atttcactatcttcttcaaa

SEQ ID NO: 3308631 - DNA, 16 bp, Homo sapiens
atttcagacctagcag

SEQ ID NO: 3308632 - DNA, 20 bp, Homo sapiens
atttcagacctagcagggaa

SEQ ID NO: 3308633 - DNA, 16 bp, Homo sapiens
atttcagagaggcctt

SEQ ID NO: 3308634 - DNA, 18 bp, Homo sapiens
atttgtccttttatttct

SEQ ID NO: 3308635 - DNA, 19 bp, Homo sapiens
atttgtccttttatttctc

SEQ ID NO: 3308636 - DNA, 23 bp, Homo sapiens
atttgtccttttatttctccatc

SEQ ID NO: 3308637 - DNA, 15 bp, Homo sapiens
atttgtctttcagga

SEQ ID NO: 3308638 - DNA, 22 bp, Homo sapiens
atttgtctttttgttgtaaaac

SEQ ID NO: 3308639 - DNA, 15 bp, Homo sapiens
atttgtgaactggaa

SEQ ID NO: 3308640 - DNA, 14 bp, Homo sapiens
atttgtgagactgt

SEQ ID NO: 3308641 - DNA, 12 bp, Homo sapiens
atttgtggaata

SEQ ID NO: 3308642 - DNA, 20 bp, Homo sapiens
atttgtgtaataaagtgttt

SEQ ID NO: 3308643 - DNA, 20 bp, Homo sapiens
atttgtgttttaatttaaac

SEQ ID NO: 3308644 - DNA, 21 bp, Homo sapiens
atttgtgttttaatttaaaca

SEQ ID NO: 3308645 - DNA, 22 bp, Homo sapiens
atttgttagttcctgtatgaaa

SEQ ID NO: 3308646 - DNA, 17 bp, Homo sapiens
atttgttattttcagta

SEQ ID NO: 3308647 - DNA, 12 bp, Homo sapiens
atttgttcaagt

SEQ ID NO: 3308648 - DNA, 16 bp, Homo sapiens
atttgttgaaattatg

SEQ ID NO: 3308649 - DNA, 17 bp, Homo sapiens
atttgttgacagcaaaa

SEQ ID NO: 3308650 - DNA, 18 bp, Homo sapiens
atttgtttcttctgtctt

SEQ ID NO: 3308651 - DNA, 12 bp, Homo sapiens
atttgtttgtat

SEQ ID NO: 3308652 - DNA, 13 bp, Homo sapiens
atttgtttgtatt

SEQ ID NO: 3308653 - DNA, 15 bp, Homo sapiens
atttgttttgaattt

SEQ ID NO: 3308654 - DNA, 17 bp, Homo sapiens
atttgttttgaattttg

SEQ ID NO: 3308655 - DNA, 13 bp, Homo sapiens
atttgttttgctt

SEQ ID NO: 3308656 - DNA, 18 bp, Homo sapiens
atttgttttgcttttgtt

SEQ ID NO: 3308657 - DNA, 16 bp, Homo sapiens
atttgttttggatata

SEQ ID NO: 3308658 - DNA, 15 bp, Homo sapiens
atttgtttttctcac

SEQ ID NO: 3308659 - DNA, 13 bp, Homo sapiens
attttaaaaaagg

SEQ ID NO: 3308660 - DNA, 14 bp, Homo sapiens
attttaaaaacttt

SEQ ID NO: 3308661 - DNA, 14 bp, Homo sapiens
attttaaaaagtct

SEQ ID NO: 3308662 - DNA, 22 bp, Homo sapiens
attttaaaaatacagatagata

SEQ ID NO: 3308663 - DNA, 15 bp, Homo sapiens
attttaaaagtctat

SEQ ID NO: 3308664 - DNA, 22 bp, Homo sapiens
attttaaaagtctattttatta

SEQ ID NO: 3308665 - DNA, 19 bp, Homo sapiens
attttaaaagttttgttct

SEQ ID NO: 3308666 - DNA, 13 bp, Homo sapiens
attttaaaatttc

SEQ ID NO: 3308667 - DNA, 13 bp, Homo sapiens
attttaaacgctt

SEQ ID NO: 3308668 - DNA, 21 bp, Homo sapiens
attttaaacgcttcttatgta

SEQ ID NO: 3308669 - DNA, 18 bp, Homo sapiens
attttaaagccattctga

SEQ ID NO: 3308670 - DNA, 19 bp, Homo sapiens
attttaaagtaatttctaa

SEQ ID NO: 3308671 - DNA, 15 bp, Homo sapiens
attttaaataaaaga

SEQ ID NO: 3308672 - DNA, 22 bp, Homo sapiens
attttaaattataacttaaaat

SEQ ID NO: 3308673 - DNA, 13 bp, Homo sapiens
attttaacaaaag

SEQ ID NO: 3308674 - DNA, 11 bp, Homo sapiens
attttaacaag

SEQ ID NO: 3308675 - DNA, 16 bp, Homo sapiens
attttaacactttgta

SEQ ID NO: 3308676 - DNA, 19 bp, Homo sapiens
attttaacatgatttcaaa

SEQ ID NO: 3308677 - DNA, 20 bp, Homo sapiens
attttaacctagatgtttaa

SEQ ID NO: 3308678 - DNA, 17 bp, Homo sapiens
attttaactttatcaca

SEQ ID NO: 3308679 - DNA, 14 bp, Homo sapiens
attttaagcactct

SEQ ID NO: 3308680 - DNA, 16 bp, Homo sapiens
attttaagggggaaaa

SEQ ID NO: 3308681 - DNA, 16 bp, Homo sapiens
attttaagtctacaaa

SEQ ID NO: 3308682 - DNA, 20 bp, Homo sapiens
attttaagtgctttgtaatg

SEQ ID NO: 3308683 - DNA, 15 bp, Homo sapiens
attttaatattgatg

SEQ ID NO: 3308684 - DNA, 18 bp, Homo sapiens
attttaatcaagttgaat

SEQ ID NO: 3308685 - DNA, 20 bp, Homo sapiens
attttaatgggtttcccttg

SEQ ID NO: 3308686 - DNA, 16 bp, Homo sapiens
attttaatgtgatgat

SEQ ID NO: 3308687 - DNA, 13 bp, Homo sapiens
attttaattatta

SEQ ID NO: 3308688 - DNA, 23 bp, Homo sapiens
attttaattattattcttcataa

SEQ ID NO: 3308689 - DNA, 14 bp, Homo sapiens
attttaattctctc

SEQ ID NO: 3308690 - DNA, 15 bp, Homo sapiens
attttacaaaagatg

SEQ ID NO: 3308691 - DNA, 14 bp, Homo sapiens
attttacacaaatg

SEQ ID NO: 3308692 - DNA, 13 bp, Homo sapiens
attttacacatta

SEQ ID NO: 3308693 - DNA, 12 bp, Homo sapiens
attttacagtga

SEQ ID NO: 3308694 - DNA, 13 bp, Homo sapiens
attttaccaaagc

SEQ ID NO: 3308695 - DNA, 17 bp, Homo sapiens
attttaccaaagcatca

SEQ ID NO: 3308696 - DNA, 18 bp, Homo sapiens
attttaccaaagcatcaa

SEQ ID NO: 3308697 - DNA, 22 bp, Homo sapiens
attttaccaaagcatcaataca

SEQ ID NO: 3308698 - DNA, 15 bp, Homo sapiens
attttacctcttatt

SEQ ID NO: 3308699 - DNA, 18 bp, Homo sapiens
attttacctcttattgca

SEQ ID NO: 3308700 - DNA, 13 bp, Homo sapiens
attttacttgaat

SEQ ID NO: 3308701 - DNA, 13 bp, Homo sapiens
attttactttgta

SEQ ID NO: 3308702 - DNA, 18 bp, Homo sapiens
attttagactcaaagaat

SEQ ID NO: 3308703 - DNA, 15 bp, Homo sapiens
attttaggaacttca

SEQ ID NO: 3308704 - DNA, 18 bp, Homo sapiens
attttaggaacttcagag

SEQ ID NO: 3308705 - DNA, 19 bp, Homo sapiens
attttaggaacttcagaga

SEQ ID NO: 3308706 - DNA, 15 bp, Homo sapiens
attttaggtgttgat

SEQ ID NO: 3308707 - DNA, 15 bp, Homo sapiens
attttagtacatttt

SEQ ID NO: 3308708 - DNA, 14 bp, Homo sapiens
attttagtgactgt

SEQ ID NO: 3308709 - DNA, 13 bp, Homo sapiens
attttagtttata

SEQ ID NO: 3308710 - DNA, 19 bp, Homo sapiens
attttatagctcagtttat

SEQ ID NO: 3308711 - DNA, 22 bp, Homo sapiens
attttatagctcagtttatcca

SEQ ID NO: 3308712 - DNA, 18 bp, Homo sapiens
attttatatgcttactga

SEQ ID NO: 3308713 - DNA, 23 bp, Homo sapiens
attttatatgcttactgatatat

SEQ ID NO: 3308714 - DNA, 14 bp, Homo sapiens
attttatctgtgaa

SEQ ID NO: 3308715 - DNA, 17 bp, Homo sapiens
attttatgaatatcatt

SEQ ID NO: 3308716 - DNA, 23 bp, Homo sapiens
attttatgacatgaaaagttatt

SEQ ID NO: 3308717 - DNA, 15 bp, Homo sapiens
attttatgtctgtaa

SEQ ID NO: 3308718 - DNA, 22 bp, Homo sapiens
attttattaagctttttggaat

SEQ ID NO: 3308719 - DNA, 15 bp, Homo sapiens
attttattgtatttt

SEQ ID NO: 3308720 - DNA, 20 bp, Homo sapiens
attttattgtattttgatga

SEQ ID NO: 3308721 - DNA, 13 bp, Homo sapiens
attttatttccat

SEQ ID NO: 3308722 - DNA, 14 bp, Homo sapiens
attttattttgctg

SEQ ID NO: 3308723 - DNA, 23 bp, Homo sapiens
attttattttgtgctcatttaag

SEQ ID NO: 3308724 - DNA, 13 bp, Homo sapiens
attttcaaagaga

SEQ ID NO: 3308725 - DNA, 16 bp, Homo sapiens
attttcaaagagatgg

SEQ ID NO: 3308726 - DNA, 22 bp, Homo sapiens
attttcaaagctttttccagag

SEQ ID NO: 3308727 - DNA, 18 bp, Homo sapiens
attttcaacgcagccctg

SEQ ID NO: 3308728 - DNA, 20 bp, Homo sapiens
attttcaagcagcatcttct

SEQ ID NO: 3308729 - DNA, 16 bp, Homo sapiens
attttcaagtaattgt

SEQ ID NO: 3308730 - DNA, 13 bp, Homo sapiens
attttcaagttta

SEQ ID NO: 3308731 - DNA, 15 bp, Homo sapiens
attttcacaatgtca

SEQ ID NO: 3308732 - DNA, 17 bp, Homo sapiens
attttcacaattattaa

SEQ ID NO: 3308733 - DNA, 15 bp, Homo sapiens
attttcaccccaccc

SEQ ID NO: 3308734 - DNA, 16 bp, Homo sapiens
attttcaccccaccct

SEQ ID NO: 3308735 - DNA, 23 bp, Homo sapiens
attttcacctgttaaggtggaaa

SEQ ID NO: 3308736 - DNA, 13 bp, Homo sapiens
attttcactgtag

SEQ ID NO: 3308737 - DNA, 14 bp, Homo sapiens
attttcactttgtg

SEQ ID NO: 3308738 - DNA, 17 bp, Homo sapiens
attttcagaaaatatta

SEQ ID NO: 3308739 - DNA, 12 bp, Homo sapiens
attttcagaatc

SEQ ID NO: 3308740 - DNA, 14 bp, Homo sapiens
attttcagaatctg

SEQ ID NO: 3308741 - DNA, 22 bp, Homo sapiens
attttcagaatctgaatgtaat

SEQ ID NO: 3308742 - DNA, 21 bp, Homo sapiens
attttcagctcaattgttaat

SEQ ID NO: 3308743 - DNA, 20 bp, Homo sapiens
attttcaggaaatctacttc

SEQ ID NO: 3308744 - DNA, 19 bp, Homo sapiens
attttcagtataatttaac

SEQ ID NO: 3308745 - DNA, 18 bp, Homo sapiens
attttcagtatactgtgt

SEQ ID NO: 3308746 - DNA, 14 bp, Homo sapiens
attttcagtatttt

SEQ ID NO: 3308747 - DNA, 19 bp, Homo sapiens
attttcagtcttgtagtgt

SEQ ID NO: 3308748 - DNA, 20 bp, Homo sapiens
attttcatgcacagtagatt

SEQ ID NO: 3308749 - DNA, 15 bp, Homo sapiens
attttcatgcttcca

SEQ ID NO: 3308750 - DNA, 12 bp, Homo sapiens
attttcattaaa

SEQ ID NO: 3308751 - DNA, 15 bp, Homo sapiens
attttcattacaatg

SEQ ID NO: 3308752 - DNA, 16 bp, Homo sapiens
attttcatttgtacaa

SEQ ID NO: 3308753 - DNA, 17 bp, Homo sapiens
attttccaaatgtaata

SEQ ID NO: 3308754 - DNA, 15 bp, Homo sapiens
attttcccatcatcc

SEQ ID NO: 3308755 - DNA, 22 bp, Homo sapiens
attttccccccactctccccac

SEQ ID NO: 3308756 - DNA, 14 bp, Homo sapiens
attttccccttcct

SEQ ID NO: 3308757 - DNA, 14 bp, Homo sapiens
attttcctcttgtg

SEQ ID NO: 3308758 - DNA, 15 bp, Homo sapiens
attttcctcttgtga

SEQ ID NO: 3308759 - DNA, 22 bp, Homo sapiens
attttcctggatttatagtatg

SEQ ID NO: 3308760 - DNA, 17 bp, Homo sapiens
attttcgggattctttg

SEQ ID NO: 3308761 - DNA, 18 bp, Homo sapiens
attttcgtatgaaaatga

SEQ ID NO: 3308762 - DNA, 19 bp, Homo sapiens
attttctaaaagctttcat

SEQ ID NO: 3308763 - DNA, 22 bp, Homo sapiens
attttctaagcaatttcttgct

SEQ ID NO: 3308764 - DNA, 16 bp, Homo sapiens
attttctactgtaaga

SEQ ID NO: 3308765 - DNA, 18 bp, Homo sapiens
attttctagactttctgt

SEQ ID NO: 3308766 - DNA, 16 bp, Homo sapiens
attttctattttaaga

SEQ ID NO: 3308767 - DNA, 23 bp, Homo sapiens
attttctattttaagactgattt

SEQ ID NO: 3308768 - DNA, 17 bp, Homo sapiens
attttctcaaaagcatt

SEQ ID NO: 3308769 - DNA, 14 bp, Homo sapiens
attttctccagctc

SEQ ID NO: 3308770 - DNA, 21 bp, Homo sapiens
attttctccctttatgtatct

SEQ ID NO: 3308771 - DNA, 22 bp, Homo sapiens
attttctgaaagttacccactg

SEQ ID NO: 3308772 - DNA, 15 bp, Homo sapiens
attttctgacatgca

SEQ ID NO: 3308773 - DNA, 18 bp, Homo sapiens
attttctgacatgcattg

SEQ ID NO: 3308774 - DNA, 22 bp, Homo sapiens
attttctggaatacatgaaata

SEQ ID NO: 3308775 - DNA, 21 bp, Homo sapiens
attttctggtagatagaaata

SEQ ID NO: 3308776 - DNA, 14 bp, Homo sapiens
attttctggttcta

SEQ ID NO: 3308777 - DNA, 15 bp, Homo sapiens
attttctggttctaa

SEQ ID NO: 3308778 - DNA, 14 bp, Homo sapiens
attttctgtcagat

SEQ ID NO: 3308779 - DNA, 18 bp, Homo sapiens
attttctgtcagatgaga

SEQ ID NO: 3308780 - DNA, 21 bp, Homo sapiens
attttctgtgcctgaatattt

SEQ ID NO: 3308781 - DNA, 11 bp, Homo sapiens
attttctgttg

SEQ ID NO: 3308782 - DNA, 20 bp, Homo sapiens
attttcttacccaatttccc

SEQ ID NO: 3308783 - DNA, 14 bp, Homo sapiens
attttcttcagttg

SEQ ID NO: 3308784 - DNA, 15 bp, Homo sapiens
attttctttgaaatt

SEQ ID NO: 3308785 - DNA, 16 bp, Homo sapiens
attttctttgtttctt

SEQ ID NO: 3308786 - DNA, 22 bp, Homo sapiens
attttcttttttatcttgcact

SEQ ID NO: 3308787 - DNA, 14 bp, Homo sapiens
attttgaaaagctt

SEQ ID NO: 3308788 - DNA, 11 bp, Homo sapiens
attttgaatac

SEQ ID NO: 3308789 - DNA, 22 bp, Homo sapiens
attttgaataccattaaaactg

SEQ ID NO: 3308790 - DNA, 15 bp, Homo sapiens
attttgaatgtcaca

SEQ ID NO: 3308791 - DNA, 24 bp, Homo sapiens
attttgacagttattttgataaca

SEQ ID NO: 3308792 - DNA, 18 bp, Homo sapiens
attttgaggtaaagatat

SEQ ID NO: 3308793 - DNA, 14 bp, Homo sapiens
attttgagttgcca

SEQ ID NO: 3308794 - DNA, 18 bp, Homo sapiens
attttgataataaattga

SEQ ID NO: 3308795 - DNA, 16 bp, Homo sapiens
attttgataataatat

SEQ ID NO: 3308796 - DNA, 19 bp, Homo sapiens
attttgatatacattgtgt

SEQ ID NO: 3308797 - DNA, 20 bp, Homo sapiens
attttgatatacattgtgtg

SEQ ID NO: 3308798 - DNA, 21 bp, Homo sapiens
attttgatgtgacaataatat

SEQ ID NO: 3308799 - DNA, 22 bp, Homo sapiens
attttgattattgtatttattc

SEQ ID NO: 3308800 - DNA, 14 bp, Homo sapiens
attttgcaaaatga

SEQ ID NO: 3308801 - DNA, 15 bp, Homo sapiens
attttgcaaaatttc

SEQ ID NO: 3308802 - DNA, 13 bp, Homo sapiens
attttgcaaatat

SEQ ID NO: 3308803 - DNA, 16 bp, Homo sapiens
attttgcagcagtgag

SEQ ID NO: 3308804 - DNA, 19 bp, Homo sapiens
attttgctgagttgttcta

SEQ ID NO: 3308805 - DNA, 20 bp, Homo sapiens
attttgctgagttgttctaa

SEQ ID NO: 3308806 - DNA, 14 bp, Homo sapiens
attttgctggaata

SEQ ID NO: 3308807 - DNA, 14 bp, Homo sapiens
attttgcttaaaat

SEQ ID NO: 3308808 - DNA, 14 bp, Homo sapiens
attttggaaaataa

SEQ ID NO: 3308809 - DNA, 20 bp, Homo sapiens
attttggaaaataaattatt

SEQ ID NO: 3308810 - DNA, 12 bp, Homo sapiens
attttggaaact

SEQ ID NO: 3308811 - DNA, 16 bp, Homo sapiens
attttggaaactgcta

SEQ ID NO: 3308812 - DNA, 23 bp, Homo sapiens
attttggaaactgctaaattcta

SEQ ID NO: 3308813 - DNA, 20 bp, Homo sapiens
attttggaagattttcagtc

SEQ ID NO: 3308814 - DNA, 18 bp, Homo sapiens
attttggactgagatttc

SEQ ID NO: 3308815 - DNA, 19 bp, Homo sapiens
attttggactgagatttct

SEQ ID NO: 3308816 - DNA, 18 bp, Homo sapiens
attttggatatattattg

SEQ ID NO: 3308817 - DNA, 19 bp, Homo sapiens
attttggatatattattgt

SEQ ID NO: 3308818 - DNA, 21 bp, Homo sapiens
attttggcgaatctcaaaatt

SEQ ID NO: 3308819 - DNA, 19 bp, Homo sapiens
attttggcgctattacaaa

SEQ ID NO: 3308820 - DNA, 21 bp, Homo sapiens
attttggcgctattacaaata

SEQ ID NO: 3308821 - DNA, 20 bp, Homo sapiens
attttggcttcatttcaatc

SEQ ID NO: 3308822 - DNA, 21 bp, Homo sapiens
attttggcttcatttcaatca

SEQ ID NO: 3308823 - DNA, 21 bp, Homo sapiens
attttgggacaattgttttaa

SEQ ID NO: 3308824 - DNA, 16 bp, Homo sapiens
attttgggacttctac

SEQ ID NO: 3308825 - DNA, 16 bp, Homo sapiens
attttggggtctcttt

SEQ ID NO: 3308826 - DNA, 20 bp, Homo sapiens
attttggggttgtgttgtca

SEQ ID NO: 3308827 - DNA, 21 bp, Homo sapiens
attttggtattacactgtatt

SEQ ID NO: 3308828 - DNA, 18 bp, Homo sapiens
attttggtccaagttgtg

SEQ ID NO: 3308829 - DNA, 21 bp, Homo sapiens
attttggtgaatgtgggtagt

SEQ ID NO: 3308830 - DNA, 16 bp, Homo sapiens
attttggtgagaaatg

SEQ ID NO: 3308831 - DNA, 12 bp, Homo sapiens
attttggtttct

SEQ ID NO: 3308832 - DNA, 10 bp, Homo sapiens
attttgtaaa

SEQ ID NO: 3308833 - DNA, 20 bp, Homo sapiens
attttgtaaactcaaaatat

SEQ ID NO: 3308834 - DNA, 20 bp, Homo sapiens
attttgtacaaatttgttat

SEQ ID NO: 3308835 - DNA, 15 bp, Homo sapiens
attttgtatgttaaa

SEQ ID NO: 3308836 - DNA, 14 bp, Homo sapiens
attttgtattgtgg

SEQ ID NO: 3308837 - DNA, 18 bp, Homo sapiens
attttgtcccattttccc

SEQ ID NO: 3308838 - DNA, 16 bp, Homo sapiens
attttgtcttattctt

SEQ ID NO: 3308839 - DNA, 13 bp, Homo sapiens
attttgtgaatgg

SEQ ID NO: 3308840 - DNA, 20 bp, Homo sapiens
attttgtgatgatgctgtga

SEQ ID NO: 3308841 - DNA, 22 bp, Homo sapiens
attttgtgatgatgctgtgaca

SEQ ID NO: 3308842 - DNA, 13 bp, Homo sapiens
attttgtgcattc

SEQ ID NO: 3308843 - DNA, 16 bp, Homo sapiens
attttgtgcattcttt

SEQ ID NO: 3308844 - DNA, 19 bp, Homo sapiens
attttgtgcattctttggt

SEQ ID NO: 3308845 - DNA, 18 bp, Homo sapiens
attttgtggttctatttt

SEQ ID NO: 3308846 - DNA, 23 bp, Homo sapiens
attttgtgtacaagttgttattg

SEQ ID NO: 3308847 - DNA, 23 bp, Homo sapiens
attttgtgtgaccaactgtgttg

SEQ ID NO: 3308848 - DNA, 13 bp, Homo sapiens
attttgtgttgct

SEQ ID NO: 3308849 - DNA, 15 bp, Homo sapiens
attttgtgttgctaa

SEQ ID NO: 3308850 - DNA, 17 bp, Homo sapiens
attttgtgttgctaaaa

SEQ ID NO: 3308851 - DNA, 14 bp, Homo sapiens
attttgtgttgtac

SEQ ID NO: 3308852 - DNA, 14 bp, Homo sapiens
attttgttaaagct

SEQ ID NO: 3308853 - DNA, 15 bp, Homo sapiens
attttgttaaagctg

SEQ ID NO: 3308854 - DNA, 22 bp, Homo sapiens
attttgttatagaatacttttt

SEQ ID NO: 3308855 - DNA, 17 bp, Homo sapiens
attttgttcttacacat

SEQ ID NO: 3308856 - DNA, 23 bp, Homo sapiens
attttgttgctgttttgatttgt

SEQ ID NO: 3308857 - DNA, 19 bp, Homo sapiens
attttgttgcttttgtgaa

SEQ ID NO: 3308858 - DNA, 21 bp, Homo sapiens
attttgttggcatagctctgg

SEQ ID NO: 3308859 - DNA, 19 bp, Homo sapiens
attttgttgtaaaaagaaa

SEQ ID NO: 3308860 - DNA, 20 bp, Homo sapiens
attttgtttttattttcaag

SEQ ID NO: 3308861 - DNA, 19 bp, Homo sapiens
attttgttttttaagtaag

SEQ ID NO: 3308862 - DNA, 12 bp, Homo sapiens
atttttaaagat

SEQ ID NO: 3308863 - DNA, 15 bp, Homo sapiens
atttttaaagataga

SEQ ID NO: 3308864 - DNA, 14 bp, Homo sapiens
atttttaaagtaga

SEQ ID NO: 3308865 - DNA, 19 bp, Homo sapiens
atttttacaagaagtttat

SEQ ID NO: 3308866 - DNA, 16 bp, Homo sapiens
atttttacaagatcca

SEQ ID NO: 3308867 - DNA, 23 bp, Homo sapiens
atttttacaagatccatttgcct

SEQ ID NO: 3308868 - DNA, 21 bp, Homo sapiens
atttttaccctaatgtcttca

SEQ ID NO: 3308869 - DNA, 22 bp, Homo sapiens
atttttaccctaatgtcttcat

SEQ ID NO: 3308870 - DNA, 20 bp, Homo sapiens
atttttagccataattttgc

SEQ ID NO: 3308871 - DNA, 22 bp, Homo sapiens
atttttaggaagttttctgtag

SEQ ID NO: 3308872 - DNA, 14 bp, Homo sapiens
atttttagtagaga

SEQ ID NO: 3308873 - DNA, 21 bp, Homo sapiens
atttttataattgtacaaaat

SEQ ID NO: 3308874 - DNA, 21 bp, Homo sapiens
atttttatagcaacaacaatt

SEQ ID NO: 3308875 - DNA, 20 bp, Homo sapiens
atttttatatcagcctgagt

SEQ ID NO: 3308876 - DNA, 22 bp, Homo sapiens
atttttatattgtttttgtatt

SEQ ID NO: 3308877 - DNA, 17 bp, Homo sapiens
atttttatgatgatgaa

SEQ ID NO: 3308878 - DNA, 14 bp, Homo sapiens
atttttatttcttt

SEQ ID NO: 3308879 - DNA, 18 bp, Homo sapiens
atttttatttctttttaa

SEQ ID NO: 3308880 - DNA, 21 bp, Homo sapiens
atttttatttctttttaatta

SEQ ID NO: 3308881 - DNA, 14 bp, Homo sapiens
atttttatttttga

SEQ ID NO: 3308882 - DNA, 20 bp, Homo sapiens
atttttcaacaaatatcttg

SEQ ID NO: 3308883 - DNA, 12 bp, Homo sapiens
atttttcaatca

SEQ ID NO: 3308884 - DNA, 18 bp, Homo sapiens
atttttcagatgcttctg

SEQ ID NO: 3308885 - DNA, 18 bp, Homo sapiens
atttttcagctctctgta

SEQ ID NO: 3308886 - DNA, 17 bp, Homo sapiens
caaacttaagaaacact

SEQ ID NO: 3308887 - DNA, 20 bp, Homo sapiens
caaacttcagaaacccggct

SEQ ID NO: 3308888 - DNA, 18 bp, Homo sapiens
caaacttggatacttgga

SEQ ID NO: 3308889 - DNA, 17 bp, Homo sapiens
caaacttggatttttga

SEQ ID NO: 3308890 - DNA, 13 bp, Homo sapiens
caaacttgttcat

SEQ ID NO: 3308891 - DNA, 17 bp, Homo sapiens
caaacttgttcatttag

SEQ ID NO: 3308892 - DNA, 19 bp, Homo sapiens
caaacttttcccctgtcct

SEQ ID NO: 3308893 - DNA, 13 bp, Homo sapiens
caaacttttttat

SEQ ID NO: 3308894 - DNA, 15 bp, Homo sapiens
caaacttttttatat

SEQ ID NO: 3308895 - DNA, 17 bp, Homo sapiens
caaacttttttatatct

SEQ ID NO: 3308896 - DNA, 19 bp, Homo sapiens
caaacttttttatatcttt

SEQ ID NO: 3308897 - DNA, 23 bp, Homo sapiens
caaagaaacaagctgtgcaggca

SEQ ID NO: 3308898 - DNA, 14 bp, Homo sapiens
caaagaaagtgtat

SEQ ID NO: 3308899 - DNA, 15 bp, Homo sapiens
caaagaaatgaacat

SEQ ID NO: 3308900 - DNA, 18 bp, Homo sapiens
caaagaaatgaacattcc

SEQ ID NO: 3308901 - DNA, 16 bp, Homo sapiens
caaagaacaagaaatt

SEQ ID NO: 3308902 - DNA, 17 bp, Homo sapiens
caaagaaccatgcagga

SEQ ID NO: 3308903 - DNA, 17 bp, Homo sapiens
caaagaaggaattctag

SEQ ID NO: 3308904 - DNA, 22 bp, Homo sapiens
caaagaaggcatttgcagggtc

SEQ ID NO: 3308905 - DNA, 15 bp, Homo sapiens
caaagaatgtttata

SEQ ID NO: 3308906 - DNA, 19 bp, Homo sapiens
caaagacaaaagtctgtct

SEQ ID NO: 3308907 - DNA, 14 bp, Homo sapiens
caaagacagtattt

SEQ ID NO: 3308908 - DNA, 16 bp, Homo sapiens
caaagacagtatttat

SEQ ID NO: 3308909 - DNA, 19 bp, Homo sapiens
caaagacagtatttattgg

SEQ ID NO: 3308910 - DNA, 15 bp, Homo sapiens
caaagacctacctcc

SEQ ID NO: 3308911 - DNA, 17 bp, Homo sapiens
caaagacctacctccag

SEQ ID NO: 3308912 - DNA, 16 bp, Homo sapiens
caaagacgtaataaaa

SEQ ID NO: 3308913 - DNA, 16 bp, Homo sapiens
caaagactcctctggg

SEQ ID NO: 3308914 - DNA, 17 bp, Homo sapiens
caaagactcctctgggc

SEQ ID NO: 3308915 - DNA, 16 bp, Homo sapiens
caaagagagtggaaat

SEQ ID NO: 3308916 - DNA, 16 bp, Homo sapiens
caaagagggcttcctc

SEQ ID NO: 3308917 - DNA, 16 bp, Homo sapiens
caaagaggtatttatc

SEQ ID NO: 3308918 - DNA, 22 bp, Homo sapiens
caaagataaggactagatacta

SEQ ID NO: 3308919 - DNA, 17 bp, Homo sapiens
caaagatcaaaataaaa

SEQ ID NO: 3308920 - DNA, 17 bp, Homo sapiens
caaagatcaccagccat

SEQ ID NO: 3308921 - DNA, 12 bp, Homo sapiens
caaagatgaaaa

SEQ ID NO: 3308922 - DNA, 15 bp, Homo sapiens
caaagatgcagccgc

SEQ ID NO: 3308923 - DNA, 16 bp, Homo sapiens
caaagatgctgtgagt

SEQ ID NO: 3308924 - DNA, 20 bp, Homo sapiens
caaagatgtgggttcttttt

SEQ ID NO: 3308925 - DNA, 15 bp, Homo sapiens
caaagattaaatgtg

SEQ ID NO: 3308926 - DNA, 13 bp, Homo sapiens
caaagattgagaa

SEQ ID NO: 3308927 - DNA, 14 bp, Homo sapiens
caaagattgatttg

SEQ ID NO: 3308928 - DNA, 20 bp, Homo sapiens
caaagattttctaaggaatg

SEQ ID NO: 3308929 - DNA, 19 bp, Homo sapiens
caaagcaagggctccagca

SEQ ID NO: 3308930 - DNA, 14 bp, Homo sapiens
caaagcacagtgtt

SEQ ID NO: 3308931 - DNA, 22 bp, Homo sapiens
caaagcacagtgttaaatgaaa

SEQ ID NO: 3308932 - DNA, 17 bp, Homo sapiens
caaagcacagtttgaac

SEQ ID NO: 3308933 - DNA, 22 bp, Homo sapiens
caaagcacgaaatgttattttt

SEQ ID NO: 3308934 - DNA, 15 bp, Homo sapiens
caaagcagcagccac

SEQ ID NO: 3308935 - DNA, 19 bp, Homo sapiens
caaagcatagatgttttgg

SEQ ID NO: 3308936 - DNA, 14 bp, Homo sapiens
caaagcatggacta

SEQ ID NO: 3308937 - DNA, 21 bp, Homo sapiens
caaagcatgtgctagtggcaa

SEQ ID NO: 3308938 - DNA, 22 bp, Homo sapiens
caaagccaaactctgccagcca

SEQ ID NO: 3308939 - DNA, 17 bp, Homo sapiens
caaagccacaaggctgg

SEQ ID NO: 3308940 - DNA, 20 bp, Homo sapiens
caaagccacctctgtcattt

SEQ ID NO: 3308941 - DNA, 23 bp, Homo sapiens
caaagccacctctgtcatttgtt

SEQ ID NO: 3308942 - DNA, 12 bp, Homo sapiens
caaagccagtga

SEQ ID NO: 3308943 - DNA, 14 bp, Homo sapiens
caaagccagtgaaa

SEQ ID NO: 3308944 - DNA, 16 bp, Homo sapiens
caaagccagtgaaatg

SEQ ID NO: 3308945 - DNA, 17 bp, Homo sapiens
caaagccagtgaaatgt

SEQ ID NO: 3308946 - DNA, 23 bp, Homo sapiens
caaagccccttgctctcccctgc

SEQ ID NO: 3308947 - DNA, 18 bp, Homo sapiens
caaagcctcttcaaaaag

SEQ ID NO: 3308948 - DNA, 14 bp, Homo sapiens
caaagcctggccta

SEQ ID NO: 3308949 - DNA, 19 bp, Homo sapiens
caaagcgagatcccatctc

SEQ ID NO: 3308950 - DNA, 13 bp, Homo sapiens
caaagcgggggga

SEQ ID NO: 3308951 - DNA, 16 bp, Homo sapiens
caaagcggggggaggg

SEQ ID NO: 3308952 - DNA, 17 bp, Homo sapiens
caaagcggtccctgtcc

SEQ ID NO: 3308953 - DNA, 15 bp, Homo sapiens
caaagcgtttcttta

SEQ ID NO: 3308954 - DNA, 20 bp, Homo sapiens
caaagcgtttctttacttct

SEQ ID NO: 3308955 - DNA, 14 bp, Homo sapiens
caaagctaaaatat

SEQ ID NO: 3308956 - DNA, 13 bp, Homo sapiens
caaagctaggatg

SEQ ID NO: 3308957 - DNA, 13 bp, Homo sapiens
caaagctaggcct

SEQ ID NO: 3308958 - DNA, 15 bp, Homo sapiens
caaagctaggcctgg

SEQ ID NO: 3308959 - DNA, 17 bp, Homo sapiens
caaagctaggcctggcc

SEQ ID NO: 3308960 - DNA, 20 bp, Homo sapiens
caaagctcaaataaaaataa

SEQ ID NO: 3308961 - DNA, 11 bp, Homo sapiens
caaagctcata

SEQ ID NO: 3308962 - DNA, 23 bp, Homo sapiens
caaagctctattaagatttccaa

SEQ ID NO: 3308963 - DNA, 16 bp, Homo sapiens
caaagctgttaaactg

SEQ ID NO: 3308964 - DNA, 18 bp, Homo sapiens
caaagcttctatcccagg

SEQ ID NO: 3308965 - DNA, 14 bp, Homo sapiens
caaagcttgaagat

SEQ ID NO: 3308966 - DNA, 19 bp, Homo sapiens
caaagcttgaagatcgtta

SEQ ID NO: 3308967 - DNA, 14 bp, Homo sapiens
caaagctttcctgc

SEQ ID NO: 3308968 - DNA, 22 bp, Homo sapiens
caaagctttcctgccccaggcc

SEQ ID NO: 3308969 - DNA, 18 bp, Homo sapiens
caaagctttcctgtttcc

SEQ ID NO: 3308970 - DNA, 23 bp, Homo sapiens
caaagctttcctgtttccagggt

SEQ ID NO: 3308971 - DNA, 13 bp, Homo sapiens
caaagctttgcta

SEQ ID NO: 3308972 - DNA, 14 bp, Homo sapiens
caaagctttgctac

SEQ ID NO: 3308973 - DNA, 18 bp, Homo sapiens
caaagctttgctacaaat

SEQ ID NO: 3308974 - DNA, 19 bp, Homo sapiens
caaagctttgctacaaatt

SEQ ID NO: 3308975 - DNA, 20 bp, Homo sapiens
caaagcttttagaaatactg

SEQ ID NO: 3308976 - DNA, 18 bp, Homo sapiens
caaaggaaaaagcacaag

SEQ ID NO: 3308977 - DNA, 22 bp, Homo sapiens
caaaggaaaatagtaatgtttt

SEQ ID NO: 3308978 - DNA, 19 bp, Homo sapiens
caaaggaatctccagtttt

SEQ ID NO: 3308979 - DNA, 16 bp, Homo sapiens
caaaggaccagcgtcc

SEQ ID NO: 3308980 - DNA, 11 bp, Homo sapiens
caaaggagaaa

SEQ ID NO: 3308981 - DNA, 18 bp, Homo sapiens
caaaggagaaaaaaaacc

SEQ ID NO: 3308982 - DNA, 22 bp, Homo sapiens
caaaggatagtgcgatgtttca

SEQ ID NO: 3308983 - DNA, 21 bp, Homo sapiens
caaaggatgaagaacacagca

SEQ ID NO: 3308984 - DNA, 13 bp, Homo sapiens
caaaggccaaact

SEQ ID NO: 3308985 - DNA, 13 bp, Homo sapiens
caaaggccagtgg

SEQ ID NO: 3308986 - DNA, 20 bp, Homo sapiens
caaaggccagtggaagaaac

SEQ ID NO: 3308987 - DNA, 12 bp, Homo sapiens
caaagggaggga

SEQ ID NO: 3308988 - DNA, 19 bp, Homo sapiens
caaagggagggagcaagcc

SEQ ID NO: 3308989 - DNA, 20 bp, Homo sapiens
caaagggagggagcaagccc

SEQ ID NO: 3308990 - DNA, 17 bp, Homo sapiens
caaagggccatcgttca

SEQ ID NO: 3308991 - DNA, 20 bp, Homo sapiens
caaagggccatcgttcatcc

SEQ ID NO: 3308992 - DNA, 15 bp, Homo sapiens
caaaggggacaggcc

SEQ ID NO: 3308993 - DNA, 20 bp, Homo sapiens
caaagggtgaagctatttat

SEQ ID NO: 3308994 - DNA, 21 bp, Homo sapiens
caaagggtgaagctatttatc

SEQ ID NO: 3308995 - DNA, 13 bp, Homo sapiens
caaaggtggaata

SEQ ID NO: 3308996 - DNA, 20 bp, Homo sapiens
caaaggtggaataaacatta

SEQ ID NO: 3308997 - DNA, 22 bp, Homo sapiens
caaaggttctaggtttcaaaga

SEQ ID NO: 3308998 - DNA, 17 bp, Homo sapiens
caaagtaaaggcctcct

SEQ ID NO: 3308999 - DNA, 19 bp, Homo sapiens
caaagtaaaggcctcctcc

SEQ ID NO: 3309000 - DNA, 20 bp, Homo sapiens
caaagtaaaggcctcctccc

SEQ ID NO: 3309001 - DNA, 15 bp, Homo sapiens
caaagtacagaattt

SEQ ID NO: 3309002 - DNA, 16 bp, Homo sapiens
caaagtacagaatttg

SEQ ID NO: 3309003 - DNA, 18 bp, Homo sapiens
caaagtaccacactgagt

SEQ ID NO: 3309004 - DNA, 20 bp, Homo sapiens
caaagtaccacactgagttc

SEQ ID NO: 3309005 - DNA, 21 bp, Homo sapiens
caaagtagaagtcttagatgt

SEQ ID NO: 3309006 - DNA, 15 bp, Homo sapiens
caaagtataatcttt

SEQ ID NO: 3309007 - DNA, 17 bp, Homo sapiens
caaagtccacacaaaga

SEQ ID NO: 3309008 - DNA, 14 bp, Homo sapiens
caaagtctctaatt

SEQ ID NO: 3309009 - DNA, 15 bp, Homo sapiens
caaagtctctaattc

SEQ ID NO: 3309010 - DNA, 16 bp, Homo sapiens
caaagtgccactcatt

SEQ ID NO: 3309011 - DNA, 16 bp, Homo sapiens
caaagtgctgagatta

SEQ ID NO: 3309012 - DNA, 12 bp, Homo sapiens
caacctcctgtg

SEQ ID NO: 3309013 - DNA, 16 bp, Homo sapiens
caacctcgctgagggc

SEQ ID NO: 3309014 - DNA, 21 bp, Homo sapiens
caacctcggcttgtgggctgg

SEQ ID NO: 3309015 - DNA, 22 bp, Homo sapiens
caacctcggcttgtgggctggt

SEQ ID NO: 3309016 - DNA, 20 bp, Homo sapiens
caacctctacctcctgggtt

SEQ ID NO: 3309017 - DNA, 21 bp, Homo sapiens
caacctctctgatcttgtgct

SEQ ID NO: 3309018 - DNA, 20 bp, Homo sapiens
caacctctgcctcccaggtt

SEQ ID NO: 3309019 - DNA, 15 bp, Homo sapiens
caacctgaaagacaa

SEQ ID NO: 3309020 - DNA, 16 bp, Homo sapiens
caacctgattgtaaac

SEQ ID NO: 3309021 - DNA, 18 bp, Homo sapiens
caacctgctctcctcttg

SEQ ID NO: 3309022 - DNA, 21 bp, Homo sapiens
caacctgctctcctcttgcca

SEQ ID NO: 3309023 - DNA, 19 bp, Homo sapiens
caacctgggtccaaataaa

SEQ ID NO: 3309024 - DNA, 20 bp, Homo sapiens
caacctgggtccaaataaaa

SEQ ID NO: 3309025 - DNA, 18 bp, Homo sapiens
caacctggtggcaccaga

SEQ ID NO: 3309026 - DNA, 22 bp, Homo sapiens
caacctggtggcaccagatgca

SEQ ID NO: 3309027 - DNA, 18 bp, Homo sapiens
caacctgtgtgagagaat

SEQ ID NO: 3309028 - DNA, 22 bp, Homo sapiens
caacctgttacctactttgact

SEQ ID NO: 3309029 - DNA, 23 bp, Homo sapiens
caacctgttacctactttgactt

SEQ ID NO: 3309030 - DNA, 15 bp, Homo sapiens
caacctgttcttaga

SEQ ID NO: 3309031 - DNA, 21 bp, Homo sapiens
caacctgttcttagagtgtag

SEQ ID NO: 3309032 - DNA, 22 bp, Homo sapiens
caacctgttcttagagtgtagc

SEQ ID NO: 3309033 - DNA, 17 bp, Homo sapiens
caaccttcaaagaaact

SEQ ID NO: 3309034 - DNA, 16 bp, Homo sapiens
caaccttccaagtgta

SEQ ID NO: 3309035 - DNA, 17 bp, Homo sapiens
caaccttctgtggctca

SEQ ID NO: 3309036 - DNA, 12 bp, Homo sapiens
caacctttaaaa

SEQ ID NO: 3309037 - DNA, 17 bp, Homo sapiens
caacctttcacctttgt

SEQ ID NO: 3309038 - DNA, 14 bp, Homo sapiens
caacgaagaaaaaa

SEQ ID NO: 3309039 - DNA, 13 bp, Homo sapiens
caacgacaaagcc

SEQ ID NO: 3309040 - DNA, 15 bp, Homo sapiens
caacgcagccctgct

SEQ ID NO: 3309041 - DNA, 18 bp, Homo sapiens
caacgcagccctgctttg

SEQ ID NO: 3309042 - DNA, 15 bp, Homo sapiens
caacgcccctgtggc

SEQ ID NO: 3309043 - DNA, 19 bp, Homo sapiens
caacgcccctgtggccaac

SEQ ID NO: 3309044 - DNA, 23 bp, Homo sapiens
caacgcttgtagaactcactctg

SEQ ID NO: 3309045 - DNA, 17 bp, Homo sapiens
caacgtaaaaataaaag

SEQ ID NO: 3309046 - DNA, 21 bp, Homo sapiens
caacgtgagagaaagagagaa

SEQ ID NO: 3309047 - DNA, 23 bp, Homo sapiens
caacgtggctttttttttttccc

SEQ ID NO: 3309048 - DNA, 16 bp, Homo sapiens
caacgttactcagggc

SEQ ID NO: 3309049 - DNA, 20 bp, Homo sapiens
caactactcagaaggccgag

SEQ ID NO: 3309050 - DNA, 18 bp, Homo sapiens
caactagatttgtccttt

SEQ ID NO: 3309051 - DNA, 15 bp, Homo sapiens
caactagccaaggct

SEQ ID NO: 3309052 - DNA, 13 bp, Homo sapiens
caactatttttgt

SEQ ID NO: 3309053 - DNA, 23 bp, Homo sapiens
caactcagagaaaaatgctcccc

SEQ ID NO: 3309054 - DNA, 14 bp, Homo sapiens
caactcctaatttt

SEQ ID NO: 3309055 - DNA, 15 bp, Homo sapiens
caactctacccctgc

SEQ ID NO: 3309056 - DNA, 12 bp, Homo sapiens
caactcttgatt

SEQ ID NO: 3309057 - DNA, 22 bp, Homo sapiens
caactgaaaagactcagtgttc

SEQ ID NO: 3309058 - DNA, 13 bp, Homo sapiens
caactgaacgaca

SEQ ID NO: 3309059 - DNA, 18 bp, Homo sapiens
caactgaatgaggtcagc

SEQ ID NO: 3309060 - DNA, 14 bp, Homo sapiens
caactgacacagga

SEQ ID NO: 3309061 - DNA, 15 bp, Homo sapiens
caactgaccagcctc

SEQ ID NO: 3309062 - DNA, 17 bp, Homo sapiens
caactgaccagcctcca

SEQ ID NO: 3309063 - DNA, 22 bp, Homo sapiens
caactgcaaaaaaagcctccaa

SEQ ID NO: 3309064 - DNA, 19 bp, Homo sapiens
caactgcaataacttctga

SEQ ID NO: 3309065 - DNA, 23 bp, Homo sapiens
caactgcaataacttctgacctt

SEQ ID NO: 3309066 - DNA, 20 bp, Homo sapiens
caactgctaatgcaaattaa

SEQ ID NO: 3309067 - DNA, 13 bp, Homo sapiens
caactgctgtaaa

SEQ ID NO: 3309068 - DNA, 11 bp, Homo sapiens
caactgctttg

SEQ ID NO: 3309069 - DNA, 13 bp, Homo sapiens
caactggacaaga

SEQ ID NO: 3309070 - DNA, 18 bp, Homo sapiens
caactggacaagatttcc

SEQ ID NO: 3309071 - DNA, 22 bp, Homo sapiens
caactggccggtctgcaagtca

SEQ ID NO: 3309072 - DNA, 21 bp, Homo sapiens
caactggttgtatatttttat

SEQ ID NO: 3309073 - DNA, 15 bp, Homo sapiens
caactgtatatattc

SEQ ID NO: 3309074 - DNA, 18 bp, Homo sapiens
caactgtcttatttaatg

SEQ ID NO: 3309075 - DNA, 12 bp, Homo sapiens
caactgtgtgat

SEQ ID NO: 3309076 - DNA, 16 bp, Homo sapiens
caactgtgttgtatta

SEQ ID NO: 3309077 - DNA, 19 bp, Homo sapiens
caactgtgttgtattaaca

SEQ ID NO: 3309078 - DNA, 17 bp, Homo sapiens
caactgtttccctgctg

SEQ ID NO: 3309079 - DNA, 14 bp, Homo sapiens
caacttaacatggg

SEQ ID NO: 3309080 - DNA, 16 bp, Homo sapiens
caacttaacatgggct

SEQ ID NO: 3309081 - DNA, 21 bp, Homo sapiens
caacttaatgttctgaataat

SEQ ID NO: 3309082 - DNA, 14 bp, Homo sapiens
caacttatttaaaa

SEQ ID NO: 3309083 - DNA, 20 bp, Homo sapiens
caacttatttaaaaatattt

SEQ ID NO: 3309084 - DNA, 21 bp, Homo sapiens
caacttatttaaaaatatttc

SEQ ID NO: 3309085 - DNA, 14 bp, Homo sapiens
caacttcagtcctg

SEQ ID NO: 3309086 - DNA, 17 bp, Homo sapiens
caacttcagtcctggga

SEQ ID NO: 3309087 - DNA, 22 bp, Homo sapiens
caacttgcatccaactccagga

SEQ ID NO: 3309088 - DNA, 16 bp, Homo sapiens
caacttgtaaatacac

SEQ ID NO: 3309089 - DNA, 16 bp, Homo sapiens
caacttgtatttccaa

SEQ ID NO: 3309090 - DNA, 22 bp, Homo sapiens
caacttgtctttttctggactg

SEQ ID NO: 3309091 - DNA, 17 bp, Homo sapiens
caacttgttgtggctct

SEQ ID NO: 3309092 - DNA, 18 bp, Homo sapiens
caactttcagaagtgcca

SEQ ID NO: 3309093 - DNA, 16 bp, Homo sapiens
caactttctgtaaact

SEQ ID NO: 3309094 - DNA, 21 bp, Homo sapiens
caactttgtggatgtcttcct

SEQ ID NO: 3309095 - DNA, 22 bp, Homo sapiens
caactttgtggatgtcttcctt

SEQ ID NO: 3309096 - DNA, 21 bp, Homo sapiens
caacttttaaccaaacaatta

SEQ ID NO: 3309097 - DNA, 15 bp, Homo sapiens
caagaaaacaacttc

SEQ ID NO: 3309098 - DNA, 16 bp, Homo sapiens
caagaaaatctttgtt

SEQ ID NO: 3309099 - DNA, 16 bp, Homo sapiens
caagaaacagccagca

SEQ ID NO: 3309100 - DNA, 18 bp, Homo sapiens
caagaaacagccagcaag

SEQ ID NO: 3309101 - DNA, 18 bp, Homo sapiens
caagaaactgaggaattt

SEQ ID NO: 3309102 - DNA, 19 bp, Homo sapiens
caagaaactgaggaatttt

SEQ ID NO: 3309103 - DNA, 20 bp, Homo sapiens
caagaaagctcactgtagct

SEQ ID NO: 3309104 - DNA, 16 bp, Homo sapiens
caagaaagctggtaaa

SEQ ID NO: 3309105 - DNA, 12 bp, Homo sapiens
caagaaagtcca

SEQ ID NO: 3309106 - DNA, 16 bp, Homo sapiens
caagaaatttgatttc

SEQ ID NO: 3309107 - DNA, 17 bp, Homo sapiens
caagaacattatcttag

SEQ ID NO: 3309108 - DNA, 12 bp, Homo sapiens
caagaacttgtt

SEQ ID NO: 3309109 - DNA, 13 bp, Homo sapiens
caagaacttgttt

SEQ ID NO: 3309110 - DNA, 14 bp, Homo sapiens
caagaagaatgaac

SEQ ID NO: 3309111 - DNA, 12 bp, Homo sapiens
caagaagacatg

SEQ ID NO: 3309112 - DNA, 21 bp, Homo sapiens
caagaagctgcttctgcccac

SEQ ID NO: 3309113 - DNA, 22 bp, Homo sapiens
caagaagctttaatatttaaat

SEQ ID NO: 3309114 - DNA, 23 bp, Homo sapiens
caagaagggttttccaccctgga

SEQ ID NO: 3309115 - DNA, 20 bp, Homo sapiens
caagaagtagcagtgtctgt

SEQ ID NO: 3309116 - DNA, 14 bp, Homo sapiens
caagaatacttgaa

SEQ ID NO: 3309117 - DNA, 23 bp, Homo sapiens
caagaatattgtatgttaaagca

SEQ ID NO: 3309118 - DNA, 23 bp, Homo sapiens
caagaatcagtctatccacagag

SEQ ID NO: 3309119 - DNA, 13 bp, Homo sapiens
caagaatggatca

SEQ ID NO: 3309120 - DNA, 14 bp, Homo sapiens
caagacaaaccaag

SEQ ID NO: 3309121 - DNA, 12 bp, Homo sapiens
caagacaaatca

SEQ ID NO: 3309122 - DNA, 14 bp, Homo sapiens
caagacaaatcaac

SEQ ID NO: 3309123 - DNA, 12 bp, Homo sapiens
caagacagagac

SEQ ID NO: 3309124 - DNA, 18 bp, Homo sapiens
caagacagagacgcagga

SEQ ID NO: 3309125 - DNA, 13 bp, Homo sapiens
caagacagatgcc

SEQ ID NO: 3309126 - DNA, 21 bp, Homo sapiens
caagacagatgccccagagct

SEQ ID NO: 3309127 - DNA, 14 bp, Homo sapiens
caagacatgtctgt

SEQ ID NO: 3309128 - DNA, 15 bp, Homo sapiens
caagacatgtctgtt

SEQ ID NO: 3309129 - DNA, 17 bp, Homo sapiens
caagacatgtctgttct

SEQ ID NO: 3309130 - DNA, 16 bp, Homo sapiens
caagacccccagcact

SEQ ID NO: 3309131 - DNA, 22 bp, Homo sapiens
caagacctcatctgtggagctg

SEQ ID NO: 3309132 - DNA, 23 bp, Homo sapiens
caagacctcatctgtggagctgc

SEQ ID NO: 3309133 - DNA, 20 bp, Homo sapiens
caagacgaggggcagggaag

SEQ ID NO: 3309134 - DNA, 22 bp, Homo sapiens
caagactagactactcaatatt

SEQ ID NO: 3309135 - DNA, 23 bp, Homo sapiens
caagactgcaaacttttttatat

SEQ ID NO: 3309136 - DNA, 16 bp, Homo sapiens
caagactgttgctcaa

SEQ ID NO: 3309137 - DNA, 22 bp, Homo sapiens
caagtcacagctgcagctgggc

SEQ ID NO: 3309138 - DNA, 20 bp, Homo sapiens
caagtcactcttttttagtt

SEQ ID NO: 3309139 - DNA, 13 bp, Homo sapiens
caagtcagacaga

SEQ ID NO: 3309140 - DNA, 19 bp, Homo sapiens
caagtcagaggatggccag

SEQ ID NO: 3309141 - DNA, 23 bp, Homo sapiens
caagtcagaggatggccagtgtc

SEQ ID NO: 3309142 - DNA, 20 bp, Homo sapiens
caagtcagattgctgggagg

SEQ ID NO: 3309143 - DNA, 15 bp, Homo sapiens
caagtcagctccagc

SEQ ID NO: 3309144 - DNA, 16 bp, Homo sapiens
caagtcatgtgcattt

SEQ ID NO: 3309145 - DNA, 12 bp, Homo sapiens
caagtcattgtt

SEQ ID NO: 3309146 - DNA, 13 bp, Homo sapiens
caagtcattgttt

SEQ ID NO: 3309147 - DNA, 14 bp, Homo sapiens
caagtccagctggg

SEQ ID NO: 3309148 - DNA, 23 bp, Homo sapiens
caagtccctgactctctgtgacc

SEQ ID NO: 3309149 - DNA, 21 bp, Homo sapiens
caagtccctgttttctgagcc

SEQ ID NO: 3309150 - DNA, 22 bp, Homo sapiens
caagtccctgttttctgagccc

SEQ ID NO: 3309151 - DNA, 17 bp, Homo sapiens
caagtcccttgttttgt

SEQ ID NO: 3309152 - DNA, 13 bp, Homo sapiens
caagtcctggcta

SEQ ID NO: 3309153 - DNA, 23 bp, Homo sapiens
caagtccttacctcttccggaga

SEQ ID NO: 3309154 - DNA, 20 bp, Homo sapiens
caagtccttgacctctataa

SEQ ID NO: 3309155 - DNA, 21 bp, Homo sapiens
caagtccttgacctctataaa

SEQ ID NO: 3309156 - DNA, 14 bp, Homo sapiens
caagtctagagtct

SEQ ID NO: 3309157 - DNA, 18 bp, Homo sapiens
caagtctctctgtgaata

SEQ ID NO: 3309158 - DNA, 23 bp, Homo sapiens
caagtcttaacaaaccaacatct

SEQ ID NO: 3309159 - DNA, 22 bp, Homo sapiens
caagtctttgagatgcttctgg

SEQ ID NO: 3309160 - DNA, 21 bp, Homo sapiens
caagtgaacactgttctacca

SEQ ID NO: 3309161 - DNA, 22 bp, Homo sapiens
caagtgaagaacactactgcta

SEQ ID NO: 3309162 - DNA, 14 bp, Homo sapiens
caagtgagagctgg

SEQ ID NO: 3309163 - DNA, 17 bp, Homo sapiens
caagtgattctcctgcc

SEQ ID NO: 3309164 - DNA, 20 bp, Homo sapiens
caagtgattctcctgcctca

SEQ ID NO: 3309165 - DNA, 18 bp, Homo sapiens
caagtgccaaacagagta

SEQ ID NO: 3309166 - DNA, 23 bp, Homo sapiens
caagtgccactgcccgagctggt

SEQ ID NO: 3309167 - DNA, 13 bp, Homo sapiens
caagtgccagagg

SEQ ID NO: 3309168 - DNA, 20 bp, Homo sapiens
caagtgccagtcttgtgtct

SEQ ID NO: 3309169 - DNA, 16 bp, Homo sapiens
caagtgcctgctttta

SEQ ID NO: 3309170 - DNA, 18 bp, Homo sapiens
caagtgccttttgctgcg

SEQ ID NO: 3309171 - DNA, 16 bp, Homo sapiens
caagtgctgaacagtg

SEQ ID NO: 3309172 - DNA, 18 bp, Homo sapiens
caagtgctgaacagtgga

SEQ ID NO: 3309173 - DNA, 22 bp, Homo sapiens
caagtggaccttaggccttcct

SEQ ID NO: 3309174 - DNA, 23 bp, Homo sapiens
caagtggaccttaggccttcctc

SEQ ID NO: 3309175 - DNA, 19 bp, Homo sapiens
caagtggaccttgagacca

SEQ ID NO: 3309176 - DNA, 19 bp, Homo sapiens
caagtggatgggaatttgt

SEQ ID NO: 3309177 - DNA, 22 bp, Homo sapiens
caagtggatgggaatttgtcag

SEQ ID NO: 3309178 - DNA, 14 bp, Homo sapiens
caagtggatgtttt

SEQ ID NO: 3309179 - DNA, 17 bp, Homo sapiens
caagtggcatgtgctgt

SEQ ID NO: 3309180 - DNA, 17 bp, Homo sapiens
caagtggggctcgccat

SEQ ID NO: 3309181 - DNA, 18 bp, Homo sapiens
caagtggggtgctgggag

SEQ ID NO: 3309182 - DNA, 14 bp, Homo sapiens
caagtggtcaggag

SEQ ID NO: 3309183 - DNA, 14 bp, Homo sapiens
caagtgtatatcag

SEQ ID NO: 3309184 - DNA, 16 bp, Homo sapiens
caagtgtatatcagaa

SEQ ID NO: 3309185 - DNA, 15 bp, Homo sapiens
caagtgtctggagcg

SEQ ID NO: 3309186 - DNA, 15 bp, Homo sapiens
caagtgtcttccatc

SEQ ID NO: 3309187 - DNA, 19 bp, Homo sapiens
caagtgtgaacaaaagatg

SEQ ID NO: 3309188 - DNA, 19 bp, Homo sapiens
caagtgtgctaaaaatgag

SEQ ID NO: 3309189 - DNA, 19 bp, Homo sapiens
caagtgtgctttagcttga

SEQ ID NO: 3309190 - DNA, 21 bp, Homo sapiens
caagtgtgggccactgtggtg

SEQ ID NO: 3309191 - DNA, 22 bp, Homo sapiens
caagtgtgtgccaccatgcctc

SEQ ID NO: 3309192 - DNA, 18 bp, Homo sapiens
caagttaaagtgaataac

SEQ ID NO: 3309193 - DNA, 15 bp, Homo sapiens
caagttaacaaggaa

SEQ ID NO: 3309194 - DNA, 16 bp, Homo sapiens
caagttagaaaacata

SEQ ID NO: 3309195 - DNA, 16 bp, Homo sapiens
caagttagctcaggag

SEQ ID NO: 3309196 - DNA, 17 bp, Homo sapiens
caagttagctcaggagg

SEQ ID NO: 3309197 - DNA, 16 bp, Homo sapiens
caagttatctttccct

SEQ ID NO: 3309198 - DNA, 15 bp, Homo sapiens
caagttcgtctgttg

SEQ ID NO: 3309199 - DNA, 16 bp, Homo sapiens
caagttcgtctgttgt

SEQ ID NO: 3309200 - DNA, 15 bp, Homo sapiens
caagttctaagattc

SEQ ID NO: 3309201 - DNA, 21 bp, Homo sapiens
caagttctaagattctaatga

SEQ ID NO: 3309202 - DNA, 15 bp, Homo sapiens
caagttcttcacctc

SEQ ID NO: 3309203 - DNA, 17 bp, Homo sapiens
caagttcttcacctcta

SEQ ID NO: 3309204 - DNA, 23 bp, Homo sapiens
caagttgcgacggagagaaaaaa

SEQ ID NO: 3309205 - DNA, 20 bp, Homo sapiens
caagttgctgtcactgtttt

SEQ ID NO: 3309206 - DNA, 18 bp, Homo sapiens
caagttgtgcttgagcca

SEQ ID NO: 3309207 - DNA, 16 bp, Homo sapiens
caagttgttattgttg

SEQ ID NO: 3309208 - DNA, 17 bp, Homo sapiens
caagttgttattgttga

SEQ ID NO: 3309209 - DNA, 16 bp, Homo sapiens
caagtttatttctctc

SEQ ID NO: 3309210 - DNA, 16 bp, Homo sapiens
caagtttcagacaggg

SEQ ID NO: 3309211 - DNA, 17 bp, Homo sapiens
caagtttccatagcaac

SEQ ID NO: 3309212 - DNA, 23 bp, Homo sapiens
caagtttctagctagaaatatga

SEQ ID NO: 3309213 - DNA, 12 bp, Homo sapiens
caagttttgtat

SEQ ID NO: 3309214 - DNA, 18 bp, Homo sapiens
caataaaaacattttgaa

SEQ ID NO: 3309215 - DNA, 19 bp, Homo sapiens
caataaaaacattttgaag

SEQ ID NO: 3309216 - DNA, 22 bp, Homo sapiens
caataaaaacattttgaagtgt

SEQ ID NO: 3309217 - DNA, 14 bp, Homo sapiens
caataaaaatcata

SEQ ID NO: 3309218 - DNA, 13 bp, Homo sapiens
caataaaactgat

SEQ ID NO: 3309219 - DNA, 20 bp, Homo sapiens
caataaaatcttgaaaatgc

SEQ ID NO: 3309220 - DNA, 15 bp, Homo sapiens
caataaaatgtgatt

SEQ ID NO: 3309221 - DNA, 21 bp, Homo sapiens
caataaaatgtgatttttctg

SEQ ID NO: 3309222 - DNA, 17 bp, Homo sapiens
caataaaatttctaaga

SEQ ID NO: 3309223 - DNA, 18 bp, Homo sapiens
caataaaatttttttaaa

SEQ ID NO: 3309224 - DNA, 23 bp, Homo sapiens
caataaacctccgccaatgcacg

SEQ ID NO: 3309225 - DNA, 17 bp, Homo sapiens
caataaacctcttttct

SEQ ID NO: 3309226 - DNA, 18 bp, Homo sapiens
caataaacgcattatcag

SEQ ID NO: 3309227 - DNA, 12 bp, Homo sapiens
caataaactcct

SEQ ID NO: 3309228 - DNA, 14 bp, Homo sapiens
caataaactggtat

SEQ ID NO: 3309229 - DNA, 22 bp, Homo sapiens
caataaactggtatgaataatt

SEQ ID NO: 3309230 - DNA, 22 bp, Homo sapiens
caataaacttagaggaaaatga

SEQ ID NO: 3309231 - DNA, 23 bp, Homo sapiens
caataaagcagcctcattctgag

SEQ ID NO: 3309232 - DNA, 14 bp, Homo sapiens
caataaagcattta

SEQ ID NO: 3309233 - DNA, 19 bp, Homo sapiens
caataaagcatttataaat

SEQ ID NO: 3309234 - DNA, 13 bp, Homo sapiens
caataaagctttt

SEQ ID NO: 3309235 - DNA, 11 bp, Homo sapiens
caataaaggca

SEQ ID NO: 3309236 - DNA, 13 bp, Homo sapiens
caataaaggcagc

SEQ ID NO: 3309237 - DNA, 20 bp, Homo sapiens
caataaaggcagctgcctct

SEQ ID NO: 3309238 - DNA, 22 bp, Homo sapiens
caataaaggcagctgcctctgc

SEQ ID NO: 3309239 - DNA, 24 bp, Homo sapiens
caataaaggcagctgcctctgctc

SEQ ID NO: 3309240 - DNA, 20 bp, Homo sapiens
caataaagtgacaaaagctc

SEQ ID NO: 3309241 - DNA, 19 bp, Homo sapiens
caataaagtgccttctggg

SEQ ID NO: 3309242 - DNA, 22 bp, Homo sapiens
caataaagtgccttctgggctt

SEQ ID NO: 3309243 - DNA, 14 bp, Homo sapiens
caataaatatttga

SEQ ID NO: 3309244 - DNA, 12 bp, Homo sapiens
caataaatgaat

SEQ ID NO: 3309245 - DNA, 18 bp, Homo sapiens
caataaatgtattcaaat

SEQ ID NO: 3309246 - DNA, 14 bp, Homo sapiens
caataacactaaaa

SEQ ID NO: 3309247 - DNA, 17 bp, Homo sapiens
caataacactaaaattt

SEQ ID NO: 3309248 - DNA, 15 bp, Homo sapiens
caataacccagttac

SEQ ID NO: 3309249 - DNA, 14 bp, Homo sapiens
caataactactgtg

SEQ ID NO: 3309250 - DNA, 16 bp, Homo sapiens
caataactactgtgtt

SEQ ID NO: 3309251 - DNA, 21 bp, Homo sapiens
caataactactgtgttcctgg

SEQ ID NO: 3309252 - DNA, 12 bp, Homo sapiens
caataacttcta

SEQ ID NO: 3309253 - DNA, 17 bp, Homo sapiens
caataacttctatattt

SEQ ID NO: 3309254 - DNA, 21 bp, Homo sapiens
caataacttctatattttaat

SEQ ID NO: 3309255 - DNA, 22 bp, Homo sapiens
caataacttctatattttaata

SEQ ID NO: 3309256 - DNA, 23 bp, Homo sapiens
caataacttctatattttaatag

SEQ ID NO: 3309257 - DNA, 13 bp, Homo sapiens
caataacttctga

SEQ ID NO: 3309258 - DNA, 17 bp, Homo sapiens
caataagttccatgtta

SEQ ID NO: 3309259 - DNA, 19 bp, Homo sapiens
caataataaatatttttgc

SEQ ID NO: 3309260 - DNA, 22 bp, Homo sapiens
caataatattgttgtataattt

SEQ ID NO: 3309261 - DNA, 17 bp, Homo sapiens
caataatatttcaagtg

SEQ ID NO: 3309262 - DNA, 18 bp, Homo sapiens
caataatatttcaagtgc

SEQ ID NO: 3309263 - DNA, 21 bp, Homo sapiens
caataatatttcaagtgccta

SEQ ID NO: 3309264 - DNA, 17 bp, Homo sapiens
caataatggtcccatcc

SEQ ID NO: 3309265 - DNA, 18 bp, Homo sapiens
caataatggtcccatcca

SEQ ID NO: 3309266 - DNA, 19 bp, Homo sapiens
caataatggtcccatccag

SEQ ID NO: 3309267 - DNA, 23 bp, Homo sapiens
caataatggtcccatccaggcag

SEQ ID NO: 3309268 - DNA, 15 bp, Homo sapiens
caataattgtttcca

SEQ ID NO: 3309269 - DNA, 13 bp, Homo sapiens
caatacaaatgga

SEQ ID NO: 3309270 - DNA, 15 bp, Homo sapiens
caatacaaatggatt

SEQ ID NO: 3309271 - DNA, 19 bp, Homo sapiens
caatacaccttccccaccc

SEQ ID NO: 3309272 - DNA, 17 bp, Homo sapiens
caatacactagttgttt

SEQ ID NO: 3309273 - DNA, 19 bp, Homo sapiens
caatacactagttgtttct

SEQ ID NO: 3309274 - DNA, 21 bp, Homo sapiens
caatacctacaataaactggt

SEQ ID NO: 3309275 - DNA, 23 bp, Homo sapiens
caatagaaactcaccatgtaaaa

SEQ ID NO: 3309276 - DNA, 17 bp, Homo sapiens
caatagcactttcattg

SEQ ID NO: 3309277 - DNA, 20 bp, Homo sapiens
caatagcagttataacagat

SEQ ID NO: 3309278 - DNA, 21 bp, Homo sapiens
caatagcagttataacagatg

SEQ ID NO: 3309279 - DNA, 22 bp, Homo sapiens
caataggagtggtgatttgaaa

SEQ ID NO: 3309280 - DNA, 21 bp, Homo sapiens
caatagggtagaatgattaat

SEQ ID NO: 3309281 - DNA, 17 bp, Homo sapiens
caatagtatttctcctt

SEQ ID NO: 3309282 - DNA, 19 bp, Homo sapiens
caatagtatttctcctttg

SEQ ID NO: 3309283 - DNA, 22 bp, Homo sapiens
caatagtatttctcctttgcaa

SEQ ID NO: 3309284 - DNA, 15 bp, Homo sapiens
caatagtgtgttctg

SEQ ID NO: 3309285 - DNA, 17 bp, Homo sapiens
caatagtgtgttctgat

SEQ ID NO: 3309286 - DNA, 23 bp, Homo sapiens
caatataaaaggcaaatgtgtac

SEQ ID NO: 3309287 - DNA, 12 bp, Homo sapiens
caatataaagtt

SEQ ID NO: 3309288 - DNA, 20 bp, Homo sapiens
caatatagaaaaataaaaat

SEQ ID NO: 3309289 - DNA, 16 bp, Homo sapiens
caatatataaaaatat

SEQ ID NO: 3309290 - DNA, 17 bp, Homo sapiens
caatatataaaaatata

SEQ ID NO: 3309291 - DNA, 19 bp, Homo sapiens
caatatccctcttgtaagt

SEQ ID NO: 3309292 - DNA, 17 bp, Homo sapiens
caatatctaatatatat

SEQ ID NO: 3309293 - DNA, 13 bp, Homo sapiens
caatatgcaagca

SEQ ID NO: 3309294 - DNA, 17 bp, Homo sapiens
caatatgcaagcagctt

SEQ ID NO: 3309295 - DNA, 18 bp, Homo sapiens
caatatgcaagcagcttt

SEQ ID NO: 3309296 - DNA, 18 bp, Homo sapiens
caatatgggggccttttg

SEQ ID NO: 3309297 - DNA, 15 bp, Homo sapiens
caatatgtaaatagt

SEQ ID NO: 3309298 - DNA, 21 bp, Homo sapiens
caatatgtaaatagtgcagaa

SEQ ID NO: 3309299 - DNA, 14 bp, Homo sapiens
caatatgtattgta

SEQ ID NO: 3309300 - DNA, 16 bp, Homo sapiens
caatatgtattgtaaa

SEQ ID NO: 3309301 - DNA, 21 bp, Homo sapiens
caatatgtattgtaaacatgt

SEQ ID NO: 3309302 - DNA, 22 bp, Homo sapiens
caatatgtgagtgccttttgca

SEQ ID NO: 3309303 - DNA, 17 bp, Homo sapiens
caatattaaaagagacc

SEQ ID NO: 3309304 - DNA, 12 bp, Homo sapiens
caatattaaata

SEQ ID NO: 3309305 - DNA, 14 bp, Homo sapiens
caatattaaataca

SEQ ID NO: 3309306 - DNA, 15 bp, Homo sapiens
caatattaaatacag

SEQ ID NO: 3309307 - DNA, 19 bp, Homo sapiens
caatattaccttaagattt

SEQ ID NO: 3309308 - DNA, 20 bp, Homo sapiens
caatattaccttaagatttt

SEQ ID NO: 3309309 - DNA, 14 bp, Homo sapiens
caatattataattt

SEQ ID NO: 3309310 - DNA, 17 bp, Homo sapiens
caatattgattgggaaa

SEQ ID NO: 3309311 - DNA, 21 bp, Homo sapiens
caatattgattgggaaaacat

SEQ ID NO: 3309312 - DNA, 23 bp, Homo sapiens
caatattgattgggaaaacattt

SEQ ID NO: 3309313 - DNA, 19 bp, Homo sapiens
caatattgtatatttttat

SEQ ID NO: 3309314 - DNA, 24 bp, Homo sapiens
caatatttaacaatttattctgat

SEQ ID NO: 3309315 - DNA, 14 bp, Homo sapiens
caatatttatggat

SEQ ID NO: 3309316 - DNA, 21 bp, Homo sapiens
caatatttctgctttctttga

SEQ ID NO: 3309317 - DNA, 17 bp, Homo sapiens
caatattttattctagg

SEQ ID NO: 3309318 - DNA, 19 bp, Homo sapiens
caatattttctttaatgct

SEQ ID NO: 3309319 - DNA, 16 bp, Homo sapiens
caatatttttatatca

SEQ ID NO: 3309320 - DNA, 17 bp, Homo sapiens
caatcaaagcacttgga

SEQ ID NO: 3309321 - DNA, 18 bp, Homo sapiens
caatcaaaggaaaatagt

SEQ ID NO: 3309322 - DNA, 22 bp, Homo sapiens
caatcaaataagtatttataat

SEQ ID NO: 3309323 - DNA, 14 bp, Homo sapiens
caatcaaatctgct

SEQ ID NO: 3309324 - DNA, 17 bp, Homo sapiens
caatcacactacacatc

SEQ ID NO: 3309325 - DNA, 18 bp, Homo sapiens
caatcacactacacatca

SEQ ID NO: 3309326 - DNA, 19 bp, Homo sapiens
caatcacactacacatcac

SEQ ID NO: 3309327 - DNA, 21 bp, Homo sapiens
caatcagagtgtacaaattgt

SEQ ID NO: 3309328 - DNA, 13 bp, Homo sapiens
caatcagcactga

SEQ ID NO: 3309329 - DNA, 19 bp, Homo sapiens
caatcagtatgtattcttt

SEQ ID NO: 3309330 - DNA, 15 bp, Homo sapiens
caatcagtcccctcc

SEQ ID NO: 3309331 - DNA, 20 bp, Homo sapiens
caatcagtcccctcccatct

SEQ ID NO: 3309332 - DNA, 20 bp, Homo sapiens
caatcatctgtgtgaaaatg

SEQ ID NO: 3309333 - DNA, 15 bp, Homo sapiens
caatcatgagtcaga

SEQ ID NO: 3309334 - DNA, 13 bp, Homo sapiens
caatcatttctca

SEQ ID NO: 3309335 - DNA, 15 bp, Homo sapiens
caatccaaataaaga

SEQ ID NO: 3309336 - DNA, 17 bp, Homo sapiens
caatccataactttagt

SEQ ID NO: 3309337 - DNA, 23 bp, Homo sapiens
caatccatgttagtttttacttt

SEQ ID NO: 3309338 - DNA, 14 bp, Homo sapiens
caatcccaattctg

SEQ ID NO: 3309339 - DNA, 16 bp, Homo sapiens
caatcccaccaaccct

SEQ ID NO: 3309340 - DNA, 17 bp, Homo sapiens
caatcccaccaaccctc

SEQ ID NO: 3309341 - DNA, 22 bp, Homo sapiens
caatcccaccaaccctcagagc

SEQ ID NO: 3309342 - DNA, 15 bp, Homo sapiens
caatcccacctagcc

SEQ ID NO: 3309343 - DNA, 14 bp, Homo sapiens
caatcccctccttg

SEQ ID NO: 3309344 - DNA, 20 bp, Homo sapiens
caatcccctccttgggcact

SEQ ID NO: 3309345 - DNA, 20 bp, Homo sapiens
caatccctttattaccccct

SEQ ID NO: 3309346 - DNA, 22 bp, Homo sapiens
caatcctaacacattatcggga

SEQ ID NO: 3309347 - DNA, 20 bp, Homo sapiens
caatcctaatttctcctccc

SEQ ID NO: 3309348 - DNA, 21 bp, Homo sapiens
caatcctaatttctcctccct

SEQ ID NO: 3309349 - DNA, 17 bp, Homo sapiens
caatcctgtctttctga

SEQ ID NO: 3309350 - DNA, 15 bp, Homo sapiens
caatcctgtttataa

SEQ ID NO: 3309351 - DNA, 16 bp, Homo sapiens
caatcctttctgccca

SEQ ID NO: 3309352 - DNA, 14 bp, Homo sapiens
caatctaacaataa

SEQ ID NO: 3309353 - DNA, 17 bp, Homo sapiens
caatctaacaataatat

SEQ ID NO: 3309354 - DNA, 18 bp, Homo sapiens
caatctcaaggaatcttt

SEQ ID NO: 3309355 - DNA, 18 bp, Homo sapiens
caatctcggctcactgca

SEQ ID NO: 3309356 - DNA, 11 bp, Homo sapiens
caatctctctc

SEQ ID NO: 3309357 - DNA, 18 bp, Homo sapiens
caatctcttggtggggag

SEQ ID NO: 3309358 - DNA, 17 bp, Homo sapiens
caatctggaagaaaaaa

SEQ ID NO: 3309359 - DNA, 20 bp, Homo sapiens
caatctggcttagtgccacc

SEQ ID NO: 3309360 - DNA, 16 bp, Homo sapiens
caatctgtaaactgtg

SEQ ID NO: 3309361 - DNA, 18 bp, Homo sapiens
caatctgtaaactgtgta

SEQ ID NO: 3309362 - DNA, 23 bp, Homo sapiens
caatctgtgatgacattccctgc

SEQ ID NO: 3309363 - DNA, 12 bp, Homo sapiens
caatctgtgggc

SEQ ID NO: 3309364 - DNA, 20 bp, Homo sapiens
caatcttaaacataataaat

SEQ ID NO: 3309365 - DNA, 17 bp, Homo sapiens
caatcttaccagatgct

SEQ ID NO: 3309366 - DNA, 18 bp, Homo sapiens
caatcttaccagatgcta

SEQ ID NO: 3309367 - DNA, 21 bp, Homo sapiens
caatcttaccagatgctactg

SEQ ID NO: 3309368 - DNA, 23 bp, Homo sapiens
caatctttaacaacctctgagcc

SEQ ID NO: 3309369 - DNA, 14 bp, Homo sapiens
caatctttgccttt

SEQ ID NO: 3309370 - DNA, 20 bp, Homo sapiens
caatgaaaactctttgctgc

SEQ ID NO: 3309371 - DNA, 12 bp, Homo sapiens
caatgaaaagtc

SEQ ID NO: 3309372 - DNA, 17 bp, Homo sapiens
caatgaaagtttgcact

SEQ ID NO: 3309373 - DNA, 21 bp, Homo sapiens
caatgaaatgaattaaagtgg

SEQ ID NO: 3309374 - DNA, 18 bp, Homo sapiens
caatgaacacttataagt

SEQ ID NO: 3309375 - DNA, 17 bp, Homo sapiens
caatgaacatccctttt

SEQ ID NO: 3309376 - DNA, 17 bp, Homo sapiens
caatgaaccataaattc

SEQ ID NO: 3309377 - DNA, 19 bp, Homo sapiens
caatgaaccataaattcaa

SEQ ID NO: 3309378 - DNA, 17 bp, Homo sapiens
caatgaactgcttttcc

SEQ ID NO: 3309379 - DNA, 12 bp, Homo sapiens
caatgaatgtat

SEQ ID NO: 3309380 - DNA, 20 bp, Homo sapiens
caatgaatgtatattttgtg

SEQ ID NO: 3309381 - DNA, 21 bp, Homo sapiens
caatgaatgtatattttgtgt

SEQ ID NO: 3309382 - DNA, 19 bp, Homo sapiens
caatgacatctcaggggcc

SEQ ID NO: 3309383 - DNA, 11 bp, Homo sapiens
caatgactact

SEQ ID NO: 3309384 - DNA, 20 bp, Homo sapiens
caatgactagtcacctgggg

SEQ ID NO: 3309385 - DNA, 20 bp, Homo sapiens
caatgactgtgctactgtct

SEQ ID NO: 3309386 - DNA, 18 bp, Homo sapiens
caatgatagtaagaaaag

SEQ ID NO: 3309387 - DNA, 19 bp, Homo sapiens
cacacggactcccgggcca

SEQ ID NO: 3309388 - DNA, 20 bp, Homo sapiens
cacacggactcccgggccac

SEQ ID NO: 3309389 - DNA, 21 bp, Homo sapiens
cacacggactcccgggccacg

SEQ ID NO: 3309390 - DNA, 17 bp, Homo sapiens
cacacgtacttaaatga

SEQ ID NO: 3309391 - DNA, 13 bp, Homo sapiens
cacactaaaattt

SEQ ID NO: 3309392 - DNA, 14 bp, Homo sapiens
cacactaaaattta

SEQ ID NO: 3309393 - DNA, 18 bp, Homo sapiens
cacactaatctgaaagga

SEQ ID NO: 3309394 - DNA, 15 bp, Homo sapiens
cacactactacctct

SEQ ID NO: 3309395 - DNA, 17 bp, Homo sapiens
cacactattaccatgag

SEQ ID NO: 3309396 - DNA, 14 bp, Homo sapiens
cacactcagaaaga

SEQ ID NO: 3309397 - DNA, 11 bp, Homo sapiens
cacactgccaa

SEQ ID NO: 3309398 - DNA, 12 bp, Homo sapiens
cacactgccaaa

SEQ ID NO: 3309399 - DNA, 18 bp, Homo sapiens
cacactgccaaataaaca

SEQ ID NO: 3309400 - DNA, 21 bp, Homo sapiens
cacactgccaaataaacagct

SEQ ID NO: 3309401 - DNA, 22 bp, Homo sapiens
cacactgtcatgcttcatcatt

SEQ ID NO: 3309402 - DNA, 14 bp, Homo sapiens
cacacttcaggctc

SEQ ID NO: 3309403 - DNA, 17 bp, Homo sapiens
cacacttcaggctcttc

SEQ ID NO: 3309404 - DNA, 19 bp, Homo sapiens
cacacttgagaggatgaat

SEQ ID NO: 3309405 - DNA, 21 bp, Homo sapiens
cacacttgagaggatgaatgt

SEQ ID NO: 3309406 - DNA, 17 bp, Homo sapiens
cacacttgttccagctc

SEQ ID NO: 3309407 - DNA, 17 bp, Homo sapiens
cacactttttaagaaat

SEQ ID NO: 3309408 - DNA, 14 bp, Homo sapiens
cacagaaaaagcat

SEQ ID NO: 3309409 - DNA, 15 bp, Homo sapiens
cacagaaaaagcatg

SEQ ID NO: 3309410 - DNA, 18 bp, Homo sapiens
cacagaaatatatataca

SEQ ID NO: 3309411 - DNA, 23 bp, Homo sapiens
cacagaaatatatatacatatgt

SEQ ID NO: 3309412 - DNA, 19 bp, Homo sapiens
cacagaaatcagaggagag

SEQ ID NO: 3309413 - DNA, 11 bp, Homo sapiens
cacagaacagg

SEQ ID NO: 3309414 - DNA, 19 bp, Homo sapiens
cacagacaagcagcccttg

SEQ ID NO: 3309415 - DNA, 19 bp, Homo sapiens
cacagacacaatatgtatg

SEQ ID NO: 3309416 - DNA, 20 bp, Homo sapiens
cacagacacaatatgtatgc

SEQ ID NO: 3309417 - DNA, 14 bp, Homo sapiens
cacagacacacaca

SEQ ID NO: 3309418 - DNA, 18 bp, Homo sapiens
cacagacacacacacgca

SEQ ID NO: 3309419 - DNA, 13 bp, Homo sapiens
cacagacccctcc

SEQ ID NO: 3309420 - DNA, 14 bp, Homo sapiens
cacagacccctccc

SEQ ID NO: 3309421 - DNA, 15 bp, Homo sapiens
cacagacccctggga

SEQ ID NO: 3309422 - DNA, 17 bp, Homo sapiens
cacagacccctgggagc

SEQ ID NO: 3309423 - DNA, 11 bp, Homo sapiens
cacagactccg

SEQ ID NO: 3309424 - DNA, 15 bp, Homo sapiens
cacagactccggcct

SEQ ID NO: 3309425 - DNA, 16 bp, Homo sapiens
cacagactccggcctg

SEQ ID NO: 3309426 - DNA, 22 bp, Homo sapiens
cacagactccggcctgtaatca

SEQ ID NO: 3309427 - DNA, 19 bp, Homo sapiens
cacagactggcaataaact

SEQ ID NO: 3309428 - DNA, 19 bp, Homo sapiens
cacagactggttttgcaac

SEQ ID NO: 3309429 - DNA, 17 bp, Homo sapiens
cacagacttctggaagg

SEQ ID NO: 3309430 - DNA, 20 bp, Homo sapiens
cacagacttctggaaggctg

SEQ ID NO: 3309431 - DNA, 14 bp, Homo sapiens
cacagactttctgt

SEQ ID NO: 3309432 - DNA, 16 bp, Homo sapiens
cacagactttctgtga

SEQ ID NO: 3309433 - DNA, 19 bp, Homo sapiens
cacagagaaagtacttctc

SEQ ID NO: 3309434 - DNA, 21 bp, Homo sapiens
cacagagaaagtacttctcca

SEQ ID NO: 3309435 - DNA, 15 bp, Homo sapiens
cacagagaagggaag

SEQ ID NO: 3309436 - DNA, 23 bp, Homo sapiens
cacagagaagtttgtagccaggt

SEQ ID NO: 3309437 - DNA, 21 bp, Homo sapiens
cacagagacattcctccgagc

SEQ ID NO: 3309438 - DNA, 22 bp, Homo sapiens
cacagagagacagacttgagaa

SEQ ID NO: 3309439 - DNA, 22 bp, Homo sapiens
cacagagagggagagcagagaa

SEQ ID NO: 3309440 - DNA, 12 bp, Homo sapiens
cacagagagtcc

SEQ ID NO: 3309441 - DNA, 23 bp, Homo sapiens
cacagagcaagagataagtcttt

SEQ ID NO: 3309442 - DNA, 19 bp, Homo sapiens
cacagagcgtccttccccc

SEQ ID NO: 3309443 - DNA, 21 bp, Homo sapiens
cacagagctctccagctccaa

SEQ ID NO: 3309444 - DNA, 15 bp, Homo sapiens
cacagaggaagagca

SEQ ID NO: 3309445 - DNA, 19 bp, Homo sapiens
cacagaggtcaggaagcag

SEQ ID NO: 3309446 - DNA, 16 bp, Homo sapiens
cacagagtgctggact

SEQ ID NO: 3309447 - DNA, 18 bp, Homo sapiens
cacagagtgctggactgt

SEQ ID NO: 3309448 - DNA, 21 bp, Homo sapiens
cacagagtttttcaggagaga

SEQ ID NO: 3309449 - DNA, 19 bp, Homo sapiens
cacagataccttgaaagga

SEQ ID NO: 3309450 - DNA, 19 bp, Homo sapiens
cacagatatactttgtgga

SEQ ID NO: 3309451 - DNA, 19 bp, Homo sapiens
cacagatcccactggaaga

SEQ ID NO: 3309452 - DNA, 20 bp, Homo sapiens
cacagatcccactggaagat

SEQ ID NO: 3309453 - DNA, 17 bp, Homo sapiens
cacagatgacaaattat

SEQ ID NO: 3309454 - DNA, 17 bp, Homo sapiens
cacagatggatttgcct

SEQ ID NO: 3309455 - DNA, 23 bp, Homo sapiens
cacagatggatttgcctgtgcca

SEQ ID NO: 3309456 - DNA, 15 bp, Homo sapiens
cacagatgtaattat

SEQ ID NO: 3309457 - DNA, 17 bp, Homo sapiens
cacagatgtctctgggg

SEQ ID NO: 3309458 - DNA, 22 bp, Homo sapiens
cacagatgtgggctttgatttc

SEQ ID NO: 3309459 - DNA, 14 bp, Homo sapiens
cacagattgtttct

SEQ ID NO: 3309460 - DNA, 15 bp, Homo sapiens
cacagattgtttcta

SEQ ID NO: 3309461 - DNA, 18 bp, Homo sapiens
cacagattttaattgtca

SEQ ID NO: 3309462 - DNA, 16 bp, Homo sapiens
cacagcacaccagccg

SEQ ID NO: 3309463 - DNA, 13 bp, Homo sapiens
cacagcacatgct

SEQ ID NO: 3309464 - DNA, 19 bp, Homo sapiens
cacagcacatgctggccag

SEQ ID NO: 3309465 - DNA, 23 bp, Homo sapiens
cacagcacatgctggccagcctg

SEQ ID NO: 3309466 - DNA, 23 bp, Homo sapiens
cacagcagcagaacaagtgcctc

SEQ ID NO: 3309467 - DNA, 18 bp, Homo sapiens
cacagcagcatcttcaaa

SEQ ID NO: 3309468 - DNA, 11 bp, Homo sapiens
cacagcagccc

SEQ ID NO: 3309469 - DNA, 15 bp, Homo sapiens
cacagcagcccccca

SEQ ID NO: 3309470 - DNA, 18 bp, Homo sapiens
cacagcagccccccagca

SEQ ID NO: 3309471 - DNA, 21 bp, Homo sapiens
cacagcagcctccaacacaag

SEQ ID NO: 3309472 - DNA, 12 bp, Homo sapiens
cacagcagcctg

SEQ ID NO: 3309473 - DNA, 19 bp, Homo sapiens
cacagcagcttcaccagag

SEQ ID NO: 3309474 - DNA, 22 bp, Homo sapiens
cacagcagcttcaccagagcat

SEQ ID NO: 3309475 - DNA, 14 bp, Homo sapiens
cacagcatcgggag

SEQ ID NO: 3309476 - DNA, 15 bp, Homo sapiens
cacagcatcgggagc

SEQ ID NO: 3309477 - DNA, 17 bp, Homo sapiens
cacagcatgtgccaaga

SEQ ID NO: 3309478 - DNA, 22 bp, Homo sapiens
cacagccacccgtggggtgctg

SEQ ID NO: 3309479 - DNA, 16 bp, Homo sapiens
cacagccagcacctgg

SEQ ID NO: 3309480 - DNA, 20 bp, Homo sapiens
cacagccagcacctggcatc

SEQ ID NO: 3309481 - DNA, 13 bp, Homo sapiens
cacagcccaagag

SEQ ID NO: 3309482 - DNA, 17 bp, Homo sapiens
cacagcccagggcctgc

SEQ ID NO: 3309483 - DNA, 14 bp, Homo sapiens
cacagcccccttgc

SEQ ID NO: 3309484 - DNA, 19 bp, Homo sapiens
cacagcccccttgccctcc

SEQ ID NO: 3309485 - DNA, 15 bp, Homo sapiens
cacagccctcagcgt

SEQ ID NO: 3309486 - DNA, 22 bp, Homo sapiens
cacagccctccgaccctcatgg

SEQ ID NO: 3309487 - DNA, 17 bp, Homo sapiens
cacagccctgggagggg

SEQ ID NO: 3309488 - DNA, 21 bp, Homo sapiens
cacagccgcagcctccctctg

SEQ ID NO: 3309489 - DNA, 16 bp, Homo sapiens
cacagcctccagggcc

SEQ ID NO: 3309490 - DNA, 23 bp, Homo sapiens
cacagcctctgacccctcctcac

SEQ ID NO: 3309491 - DNA, 17 bp, Homo sapiens
cacagcctctggctcca

SEQ ID NO: 3309492 - DNA, 18 bp, Homo sapiens
cacagcctctggctccac

SEQ ID NO: 3309493 - DNA, 13 bp, Homo sapiens
cacagccttggct

SEQ ID NO: 3309494 - DNA, 21 bp, Homo sapiens
cacagccttggctcctgagaa

SEQ ID NO: 3309495 - DNA, 14 bp, Homo sapiens
cacagcgagggcag

SEQ ID NO: 3309496 - DNA, 15 bp, Homo sapiens
cacagcgagggcagc

SEQ ID NO: 3309497 - DNA, 19 bp, Homo sapiens
cacagcgagggcagctgct

SEQ ID NO: 3309498 - DNA, 21 bp, Homo sapiens
cacagcggagtctgtcctgtg

SEQ ID NO: 3309499 - DNA, 14 bp, Homo sapiens
cacagcggcccctg

SEQ ID NO: 3309500 - DNA, 15 bp, Homo sapiens
cacagcgtccctggc

SEQ ID NO: 3309501 - DNA, 19 bp, Homo sapiens
cacagcgtccctggcgcag

SEQ ID NO: 3309502 - DNA, 16 bp, Homo sapiens
cacagctcaggaacta

SEQ ID NO: 3309503 - DNA, 16 bp, Homo sapiens
cacagctccctgccaa

SEQ ID NO: 3309504 - DNA, 15 bp, Homo sapiens
cacagctcctcccac

SEQ ID NO: 3309505 - DNA, 16 bp, Homo sapiens
cacagctctgtcctgg

SEQ ID NO: 3309506 - DNA, 11 bp, Homo sapiens
cacagctcttc

SEQ ID NO: 3309507 - DNA, 13 bp, Homo sapiens
cacagctcttcat

SEQ ID NO: 3309508 - DNA, 14 bp, Homo sapiens
cacagctcttctcc

SEQ ID NO: 3309509 - DNA, 15 bp, Homo sapiens
cacagctcttctcca

SEQ ID NO: 3309510 - DNA, 20 bp, Homo sapiens
cacagctcttctccaggctg

SEQ ID NO: 3309511 - DNA, 13 bp, Homo sapiens
cacagctcttctt

SEQ ID NO: 3309512 - DNA, 19 bp, Homo sapiens
cacagctgagagactttta

SEQ ID NO: 3309513 - DNA, 12 bp, Homo sapiens
cacagctgcagc

SEQ ID NO: 3309514 - DNA, 14 bp, Homo sapiens
cacagctgcagctg

SEQ ID NO: 3309515 - DNA, 15 bp, Homo sapiens
cacagctgcagctgg

SEQ ID NO: 3309516 - DNA, 12 bp, Homo sapiens
cacagctgggca

SEQ ID NO: 3309517 - DNA, 13 bp, Homo sapiens
cacagctgggcaa

SEQ ID NO: 3309518 - DNA, 14 bp, Homo sapiens
cacagctgggcaaa

SEQ ID NO: 3309519 - DNA, 17 bp, Homo sapiens
cacagctgttcttctgt

SEQ ID NO: 3309520 - DNA, 16 bp, Homo sapiens
cacagcttagatttca

SEQ ID NO: 3309521 - DNA, 17 bp, Homo sapiens
cacagcttagatttcat

SEQ ID NO: 3309522 - DNA, 19 bp, Homo sapiens
cacagcttagatttcatag

SEQ ID NO: 3309523 - DNA, 22 bp, Homo sapiens
cacagcttcatttcctgtgtct

SEQ ID NO: 3309524 - DNA, 13 bp, Homo sapiens
cacagcttttgca

SEQ ID NO: 3309525 - DNA, 23 bp, Homo sapiens
cacaggaaaccaacacccaaagc

SEQ ID NO: 3309526 - DNA, 16 bp, Homo sapiens
cacaggactctgcctc

SEQ ID NO: 3309527 - DNA, 21 bp, Homo sapiens
cacaggagacactgtgctata

SEQ ID NO: 3309528 - DNA, 17 bp, Homo sapiens
cacaggaggccagtggg

SEQ ID NO: 3309529 - DNA, 22 bp, Homo sapiens
cacaggagtgtcctcttccctc

SEQ ID NO: 3309530 - DNA, 23 bp, Homo sapiens
cacaggatgaggtggtggagtgg

SEQ ID NO: 3309531 - DNA, 17 bp, Homo sapiens
cacaggatgccagcccc

SEQ ID NO: 3309532 - DNA, 19 bp, Homo sapiens
cacaggatgccagcccctg

SEQ ID NO: 3309533 - DNA, 21 bp, Homo sapiens
cacaggatgccagcccctgcc

SEQ ID NO: 3309534 - DNA, 20 bp, Homo sapiens
cacaggcaaaatccttgctt

SEQ ID NO: 3309535 - DNA, 17 bp, Homo sapiens
cacaggcacgggtccct

SEQ ID NO: 3309536 - DNA, 11 bp, Homo sapiens
cacaggcagct

SEQ ID NO: 3309537 - DNA, 16 bp, Homo sapiens
cacaggcagctttcta

SEQ ID NO: 3309538 - DNA, 14 bp, Homo sapiens
cacaggcaggtcca

SEQ ID NO: 3309539 - DNA, 18 bp, Homo sapiens
cacaggcagtgcatgtga

SEQ ID NO: 3309540 - DNA, 22 bp, Homo sapiens
cacaggcccccttgagtggggt

SEQ ID NO: 3309541 - DNA, 18 bp, Homo sapiens
cacaggcccggctccagg

SEQ ID NO: 3309542 - DNA, 22 bp, Homo sapiens
cacaggcccttcctctccactg

SEQ ID NO: 3309543 - DNA, 12 bp, Homo sapiens
cacaggcctccc

SEQ ID NO: 3309544 - DNA, 13 bp, Homo sapiens
cacaggcctccct

SEQ ID NO: 3309545 - DNA, 15 bp, Homo sapiens
cacaggcctccctgt

SEQ ID NO: 3309546 - DNA, 23 bp, Homo sapiens
cacaggcctctcttttccccgcc

SEQ ID NO: 3309547 - DNA, 15 bp, Homo sapiens
cacaggctagatccc

SEQ ID NO: 3309548 - DNA, 16 bp, Homo sapiens
cacagggcaccagagg

SEQ ID NO: 3309549 - DNA, 17 bp, Homo sapiens
cacagggcaccagaggc

SEQ ID NO: 3309550 - DNA, 13 bp, Homo sapiens
cacagggcagagc

SEQ ID NO: 3309551 - DNA, 20 bp, Homo sapiens
cacagggcatgccccggcca

SEQ ID NO: 3309552 - DNA, 23 bp, Homo sapiens
cacagggcatgccccggccacct

SEQ ID NO: 3309553 - DNA, 18 bp, Homo sapiens
cacagggccagagggagc

SEQ ID NO: 3309554 - DNA, 23 bp, Homo sapiens
cacagggcggtaccttgtgccca

SEQ ID NO: 3309555 - DNA, 23 bp, Homo sapiens
cacagggctctttgatggaccca

SEQ ID NO: 3309556 - DNA, 16 bp, Homo sapiens
cacaggggcaggcctg

SEQ ID NO: 3309557 - DNA, 15 bp, Homo sapiens
cacaggggccccaga

SEQ ID NO: 3309558 - DNA, 16 bp, Homo sapiens
cacaggggcggggcag

SEQ ID NO: 3309559 - DNA, 19 bp, Homo sapiens
cacaggggcggggcaggaa

SEQ ID NO: 3309560 - DNA, 21 bp, Homo sapiens
cacaggggtggagtttctgac

SEQ ID NO: 3309561 - DNA, 22 bp, Homo sapiens
cacagggtccccgagtgcctag

SEQ ID NO: 3309562 - DNA, 17 bp, Homo sapiens
cacagggtctgctcttt

SEQ ID NO: 3309563 - DNA, 23 bp, Homo sapiens
cacagggtctgctctttctctgc

SEQ ID NO: 3309564 - DNA, 18 bp, Homo sapiens
cacaggtcaataaactta

SEQ ID NO: 3309565 - DNA, 22 bp, Homo sapiens
cacaggtcccacctccagcccg

SEQ ID NO: 3309566 - DNA, 14 bp, Homo sapiens
cacaggtctagact

SEQ ID NO: 3309567 - DNA, 19 bp, Homo sapiens
cacaggtgcaacagacttg

SEQ ID NO: 3309568 - DNA, 19 bp, Homo sapiens
cacaggtgtggtgtaattt

SEQ ID NO: 3309569 - DNA, 18 bp, Homo sapiens
cacaggttggaagagaat

SEQ ID NO: 3309570 - DNA, 20 bp, Homo sapiens
cacaggttggaagagaatca

SEQ ID NO: 3309571 - DNA, 18 bp, Homo sapiens
cacaggttttagcattgt

SEQ ID NO: 3309572 - DNA, 19 bp, Homo sapiens
cacaggttttagcattgtc

SEQ ID NO: 3309573 - DNA, 16 bp, Homo sapiens
cacagtaaaaataaaa

SEQ ID NO: 3309574 - DNA, 17 bp, Homo sapiens
cacagtacagcatgtgc

SEQ ID NO: 3309575 - DNA, 13 bp, Homo sapiens
cacagtactttat

SEQ ID NO: 3309576 - DNA, 20 bp, Homo sapiens
cacagtagaactgtctgtga

SEQ ID NO: 3309577 - DNA, 14 bp, Homo sapiens
cacagtagagccag

SEQ ID NO: 3309578 - DNA, 17 bp, Homo sapiens
cacagtagagccagctt

SEQ ID NO: 3309579 - DNA, 20 bp, Homo sapiens
cacagtagctccaacacttt

SEQ ID NO: 3309580 - DNA, 14 bp, Homo sapiens
cacagtcaaaataa

SEQ ID NO: 3309581 - DNA, 19 bp, Homo sapiens
cacagtcaaggtcacttaa

SEQ ID NO: 3309582 - DNA, 18 bp, Homo sapiens
cacagtcagcatgcttcc

SEQ ID NO: 3309583 - DNA, 21 bp, Homo sapiens
cacagtcagcatgcttcccag

SEQ ID NO: 3309584 - DNA, 11 bp, Homo sapiens
cacagtcccag

SEQ ID NO: 3309585 - DNA, 23 bp, Homo sapiens
cacagtcccaggtttagtgaaaa

SEQ ID NO: 3309586 - DNA, 15 bp, Homo sapiens
cacagtccccagact

SEQ ID NO: 3309587 - DNA, 16 bp, Homo sapiens
cacagtccccagactc

SEQ ID NO: 3309588 - DNA, 19 bp, Homo sapiens
cacagtgagtcgaggacag

SEQ ID NO: 3309589 - DNA, 11 bp, Homo sapiens
cacagtgctgc

SEQ ID NO: 3309590 - DNA, 12 bp, Homo sapiens
cacagtgctgct

SEQ ID NO: 3309591 - DNA, 15 bp, Homo sapiens
cacagtgctgcttct

SEQ ID NO: 3309592 - DNA, 13 bp, Homo sapiens
cacagtgctgttg

SEQ ID NO: 3309593 - DNA, 18 bp, Homo sapiens
cacagtggactcagcagt

SEQ ID NO: 3309594 - DNA, 19 bp, Homo sapiens
cacagtggactcagcagtg

SEQ ID NO: 3309595 - DNA, 13 bp, Homo sapiens
cacagtgggaact

SEQ ID NO: 3309596 - DNA, 14 bp, Homo sapiens
cacagtgggaactc

SEQ ID NO: 3309597 - DNA, 14 bp, Homo sapiens
cacagtgggagctg

SEQ ID NO: 3309598 - DNA, 13 bp, Homo sapiens
cacagtgggtggc

SEQ ID NO: 3309599 - DNA, 18 bp, Homo sapiens
cacagtgggtggcacctc

SEQ ID NO: 3309600 - DNA, 14 bp, Homo sapiens
cacagtgttgccca

SEQ ID NO: 3309601 - DNA, 10 bp, Homo sapiens
cacagtgttt

SEQ ID NO: 3309602 - DNA, 21 bp, Homo sapiens
cacagttagttgtgaaagaaa

SEQ ID NO: 3309603 - DNA, 17 bp, Homo sapiens
cacagttatcttagctg

SEQ ID NO: 3309604 - DNA, 20 bp, Homo sapiens
cacagttcagtggcagggct

SEQ ID NO: 3309605 - DNA, 21 bp, Homo sapiens
cacagttcagtggcagggctc

SEQ ID NO: 3309606 - DNA, 22 bp, Homo sapiens
cacagttcagtggcagggctca

SEQ ID NO: 3309607 - DNA, 22 bp, Homo sapiens
cacagttccctttatttcacat

SEQ ID NO: 3309608 - DNA, 14 bp, Homo sapiens
cacagttgccacca

SEQ ID NO: 3309609 - DNA, 20 bp, Homo sapiens
cacagttgccaccacctctg

SEQ ID NO: 3309610 - DNA, 23 bp, Homo sapiens
cacagttggccttcagaaccatc

SEQ ID NO: 3309611 - DNA, 18 bp, Homo sapiens
cacagttgggacccaaaa

SEQ ID NO: 3309612 - DNA, 22 bp, Homo sapiens
cacagttgtctattctgagcct

SEQ ID NO: 3309613 - DNA, 23 bp, Homo sapiens
cacagttgtctattctgagcctt

SEQ ID NO: 3309614 - DNA, 24 bp, Homo sapiens
cacagttgtctattctgagccttg

SEQ ID NO: 3309615 - DNA, 14 bp, Homo sapiens
cacagttgtgttca

SEQ ID NO: 3309616 - DNA, 12 bp, Homo sapiens
cacagtttgaac

SEQ ID NO: 3309617 - DNA, 20 bp, Homo sapiens
cacagtttgatgtcattaat

SEQ ID NO: 3309618 - DNA, 17 bp, Homo sapiens
cacagttttgaaagaaa

SEQ ID NO: 3309619 - DNA, 12 bp, Homo sapiens
cacataaaactt

SEQ ID NO: 3309620 - DNA, 17 bp, Homo sapiens
cacatacacacacacgc

SEQ ID NO: 3309621 - DNA, 15 bp, Homo sapiens
cacatacaggtgctc

SEQ ID NO: 3309622 - DNA, 18 bp, Homo sapiens
cacatacaggtgctcaat

SEQ ID NO: 3309623 - DNA, 13 bp, Homo sapiens
cacatacagtttt

SEQ ID NO: 3309624 - DNA, 16 bp, Homo sapiens
cacatacagttttatg

SEQ ID NO: 3309625 - DNA, 16 bp, Homo sapiens
cacatacattaaaact

SEQ ID NO: 3309626 - DNA, 17 bp, Homo sapiens
cacatacattaaaacta

SEQ ID NO: 3309627 - DNA, 13 bp, Homo sapiens
cacataccctccc

SEQ ID NO: 3309628 - DNA, 21 bp, Homo sapiens
cacatagcaggggcaccttcc

SEQ ID NO: 3309629 - DNA, 23 bp, Homo sapiens
cacatagcgccgtgctgtaaata

SEQ ID NO: 3309630 - DNA, 13 bp, Homo sapiens
cacatagctgtct

SEQ ID NO: 3309631 - DNA, 16 bp, Homo sapiens
cacatagctgtctaga

SEQ ID NO: 3309632 - DNA, 20 bp, Homo sapiens
cacatagttctccagttgta

SEQ ID NO: 3309633 - DNA, 22 bp, Homo sapiens
cacatatacctataatgtgtgt

SEQ ID NO: 3309634 - DNA, 14 bp, Homo sapiens
cacatatctgtcat

SEQ ID NO: 3309635 - DNA, 18 bp, Homo sapiens
cacatatgcaccttgtgt

SEQ ID NO: 3309636 - DNA, 21 bp, Homo sapiens
cacatatgcaccttgtgtctg

SEQ ID NO: 3309637 - DNA, 22 bp, Homo sapiens
cacatatgcaccttgtgtctgt

SEQ ID NO: 3309638 - DNA, 15 bp, Homo sapiens
cacatatttgatagt

SEQ ID NO: 3309639 - DNA, 14 bp, Homo sapiens
caccccggcctcca

SEQ ID NO: 3309640 - DNA, 15 bp, Homo sapiens
caccccgggctctct

SEQ ID NO: 3309641 - DNA, 17 bp, Homo sapiens
cacccctaagtgcccaa

SEQ ID NO: 3309642 - DNA, 16 bp, Homo sapiens
cacccctaatgagggt

SEQ ID NO: 3309643 - DNA, 22 bp, Homo sapiens
cacccctaatgagggtgtgaga

SEQ ID NO: 3309644 - DNA, 13 bp, Homo sapiens
cacccctccagga

SEQ ID NO: 3309645 - DNA, 17 bp, Homo sapiens
cacccctcccattagga

SEQ ID NO: 3309646 - DNA, 12 bp, Homo sapiens
cacccctgcact

SEQ ID NO: 3309647 - DNA, 13 bp, Homo sapiens
cacccctgcactt

SEQ ID NO: 3309648 - DNA, 11 bp, Homo sapiens
cacccctgccc

SEQ ID NO: 3309649 - DNA, 14 bp, Homo sapiens
cacccctgccccca

SEQ ID NO: 3309650 - DNA, 19 bp, Homo sapiens
cacccctgcccccagcccc

SEQ ID NO: 3309651 - DNA, 24 bp, Homo sapiens
cacccctgctctacccatgagcct

SEQ ID NO: 3309652 - DNA, 13 bp, Homo sapiens
cacccctgggcag

SEQ ID NO: 3309653 - DNA, 21 bp, Homo sapiens
cacccctgtgctccgtgcctc

SEQ ID NO: 3309654 - DNA, 23 bp, Homo sapiens
cacccctgtgctccgtgcctcca

SEQ ID NO: 3309655 - DNA, 21 bp, Homo sapiens
caccccttaggccccgtggtg

SEQ ID NO: 3309656 - DNA, 21 bp, Homo sapiens
cacccgaagcgcttctgcacc

SEQ ID NO: 3309657 - DNA, 14 bp, Homo sapiens
cacccgactcctca

SEQ ID NO: 3309658 - DNA, 15 bp, Homo sapiens
cacccgactcctcaa

SEQ ID NO: 3309659 - DNA, 22 bp, Homo sapiens
cacccgaggggggccccgggac

SEQ ID NO: 3309660 - DNA, 19 bp, Homo sapiens
cacccgatgctgctttccc

SEQ ID NO: 3309661 - DNA, 23 bp, Homo sapiens
cacccgatgctgctttcccctgt

SEQ ID NO: 3309662 - DNA, 13 bp, Homo sapiens
cacccgcctctcc

SEQ ID NO: 3309663 - DNA, 15 bp, Homo sapiens
cacccgcttcctgtt

SEQ ID NO: 3309664 - DNA, 16 bp, Homo sapiens
cacccggcccctgctg

SEQ ID NO: 3309665 - DNA, 20 bp, Homo sapiens
cacccggctcgtgtatttat

SEQ ID NO: 3309666 - DNA, 15 bp, Homo sapiens
cacccggctgcagag

SEQ ID NO: 3309667 - DNA, 21 bp, Homo sapiens
cacccggctgcagaggccaga

SEQ ID NO: 3309668 - DNA, 20 bp, Homo sapiens
cacccgggggagcccagtga

SEQ ID NO: 3309669 - DNA, 23 bp, Homo sapiens
cacccgtgagcgcctgtgcacac

SEQ ID NO: 3309670 - DNA, 19 bp, Homo sapiens
cacccgtggggtgctgccc

SEQ ID NO: 3309671 - DNA, 17 bp, Homo sapiens
caccctagtcccttccc

SEQ ID NO: 3309672 - DNA, 20 bp, Homo sapiens
caccctagtcccttcccctc

SEQ ID NO: 3309673 - DNA, 18 bp, Homo sapiens
caccctcacacacacagc

SEQ ID NO: 3309674 - DNA, 15 bp, Homo sapiens
caccctcactctgcc

SEQ ID NO: 3309675 - DNA, 18 bp, Homo sapiens
caccctcactctgccagg

SEQ ID NO: 3309676 - DNA, 21 bp, Homo sapiens
caccctcactctgccagggca

SEQ ID NO: 3309677 - DNA, 19 bp, Homo sapiens
caccctcagcaccccttcc

SEQ ID NO: 3309678 - DNA, 21 bp, Homo sapiens
caccctcagcaccccttccat

SEQ ID NO: 3309679 - DNA, 22 bp, Homo sapiens
caccctcagcaccccttccatg

SEQ ID NO: 3309680 - DNA, 13 bp, Homo sapiens
caccctcatgaaa

SEQ ID NO: 3309681 - DNA, 13 bp, Homo sapiens
caccctccaccct

SEQ ID NO: 3309682 - DNA, 14 bp, Homo sapiens
caccctccatgctc

SEQ ID NO: 3309683 - DNA, 20 bp, Homo sapiens
caccctcccaagtagctggg

SEQ ID NO: 3309684 - DNA, 18 bp, Homo sapiens
caccctccttgagactgg

SEQ ID NO: 3309685 - DNA, 12 bp, Homo sapiens
caccctcctttc

SEQ ID NO: 3309686 - DNA, 16 bp, Homo sapiens
caccctcgaagcgcgc

SEQ ID NO: 3309687 - DNA, 22 bp, Homo sapiens
caccctcggggggtcacaggcc

SEQ ID NO: 3309688 - DNA, 15 bp, Homo sapiens
caccctctcctgggg

SEQ ID NO: 3309689 - DNA, 21 bp, Homo sapiens
caccctgaacaaatcttgggt

SEQ ID NO: 3309690 - DNA, 17 bp, Homo sapiens
caccctgaggtcaggga

SEQ ID NO: 3309691 - DNA, 17 bp, Homo sapiens
caccctgatttcttgct

SEQ ID NO: 3309692 - DNA, 17 bp, Homo sapiens
caccctgcaaggcccac

SEQ ID NO: 3309693 - DNA, 15 bp, Homo sapiens
caccctgcccctgca

SEQ ID NO: 3309694 - DNA, 16 bp, Homo sapiens
caccctgcccctgcaa

SEQ ID NO: 3309695 - DNA, 15 bp, Homo sapiens
caccctgcccgctcc

SEQ ID NO: 3309696 - DNA, 16 bp, Homo sapiens
caccctgctcctcctg

SEQ ID NO: 3309697 - DNA, 12 bp, Homo sapiens
caccctgctctc

SEQ ID NO: 3309698 - DNA, 17 bp, Homo sapiens
caccctggaaaggggag

SEQ ID NO: 3309699 - DNA, 11 bp, Homo sapiens
caccctggaat

SEQ ID NO: 3309700 - DNA, 21 bp, Homo sapiens
caccctggcctgaactgagga

SEQ ID NO: 3309701 - DNA, 16 bp, Homo sapiens
caccctgggagacaga

SEQ ID NO: 3309702 - DNA, 17 bp, Homo sapiens
caccctgggagacagac

SEQ ID NO: 3309703 - DNA, 12 bp, Homo sapiens
caccctgggagc

SEQ ID NO: 3309704 - DNA, 16 bp, Homo sapiens
caccctgggagccagt

SEQ ID NO: 3309705 - DNA, 12 bp, Homo sapiens
caccctgggccc

SEQ ID NO: 3309706 - DNA, 22 bp, Homo sapiens
caccctgggccctgggctggaa

SEQ ID NO: 3309707 - DNA, 15 bp, Homo sapiens
caccctggggagaaa

SEQ ID NO: 3309708 - DNA, 18 bp, Homo sapiens
caccctgggtgccattcc

SEQ ID NO: 3309709 - DNA, 16 bp, Homo sapiens
caccctgtacctcatc

SEQ ID NO: 3309710 - DNA, 16 bp, Homo sapiens
caccctgtactgttct

SEQ ID NO: 3309711 - DNA, 16 bp, Homo sapiens
caccctgtagatgttc

SEQ ID NO: 3309712 - DNA, 13 bp, Homo sapiens
caccctgtcaagt

SEQ ID NO: 3309713 - DNA, 22 bp, Homo sapiens
caccctgtcaagttaacaagga

SEQ ID NO: 3309714 - DNA, 16 bp, Homo sapiens
caccctgtcccccagc

SEQ ID NO: 3309715 - DNA, 20 bp, Homo sapiens
caccctgtggccctggctct

SEQ ID NO: 3309716 - DNA, 20 bp, Homo sapiens
cacccttcacataccctccc

SEQ ID NO: 3309717 - DNA, 23 bp, Homo sapiens
cacccttcccctccttctccctt

SEQ ID NO: 3309718 - DNA, 13 bp, Homo sapiens
cacccttctttcc

SEQ ID NO: 3309719 - DNA, 14 bp, Homo sapiens
cacccttgcaccgt

SEQ ID NO: 3309720 - DNA, 21 bp, Homo sapiens
cacccttggcctgtctcatcc

SEQ ID NO: 3309721 - DNA, 17 bp, Homo sapiens
caccgacgcgtctcctg

SEQ ID NO: 3309722 - DNA, 15 bp, Homo sapiens
caccgactagccagg

SEQ ID NO: 3309723 - DNA, 21 bp, Homo sapiens
caccgagtgatttccatctct

SEQ ID NO: 3309724 - DNA, 12 bp, Homo sapiens
caccgagtgggg

SEQ ID NO: 3309725 - DNA, 14 bp, Homo sapiens
caccgatggagccc

SEQ ID NO: 3309726 - DNA, 19 bp, Homo sapiens
caccgcagtcgtcgcacag

SEQ ID NO: 3309727 - DNA, 15 bp, Homo sapiens
caccgcccccacccc

SEQ ID NO: 3309728 - DNA, 21 bp, Homo sapiens
caccgcctctggccgccaccc

SEQ ID NO: 3309729 - DNA, 21 bp, Homo sapiens
caccgcggcgcttcccagcac

SEQ ID NO: 3309730 - DNA, 13 bp, Homo sapiens
caccgctgccagc

SEQ ID NO: 3309731 - DNA, 19 bp, Homo sapiens
caccgctgctccacgcgct

SEQ ID NO: 3309732 - DNA, 18 bp, Homo sapiens
caccgcttctgccttttc

SEQ ID NO: 3309733 - DNA, 19 bp, Homo sapiens
caccggaggtcactccacc

SEQ ID NO: 3309734 - DNA, 12 bp, Homo sapiens
caccggcgcgct

SEQ ID NO: 3309735 - DNA, 16 bp, Homo sapiens
caccggcgctgcaggt

SEQ ID NO: 3309736 - DNA, 21 bp, Homo sapiens
caccgggagcctccccctcag

SEQ ID NO: 3309737 - DNA, 13 bp, Homo sapiens
caccgggcctgga

SEQ ID NO: 3309738 - DNA, 14 bp, Homo sapiens
caccggtcagtgcc

SEQ ID NO: 3309739 - DNA, 16 bp, Homo sapiens
caccggtccagctggc

SEQ ID NO: 3309740 - DNA, 18 bp, Homo sapiens
caccggtccagctggcct

SEQ ID NO: 3309741 - DNA, 19 bp, Homo sapiens
caccgtcatggcttaatgt

SEQ ID NO: 3309742 - DNA, 15 bp, Homo sapiens
caccgtccgccctgc

SEQ ID NO: 3309743 - DNA, 14 bp, Homo sapiens
caccgtcctcagca

SEQ ID NO: 3309744 - DNA, 18 bp, Homo sapiens
caccgtgatggagaggac

SEQ ID NO: 3309745 - DNA, 13 bp, Homo sapiens
caccgtgctgtct

SEQ ID NO: 3309746 - DNA, 19 bp, Homo sapiens
caccgtgctgtcttctggt

SEQ ID NO: 3309747 - DNA, 21 bp, Homo sapiens
caccgtgctgtcttctggtct

SEQ ID NO: 3309748 - DNA, 17 bp, Homo sapiens
caccgtggaggaggaag

SEQ ID NO: 3309749 - DNA, 20 bp, Homo sapiens
caccgtgggcagtgccaccc

SEQ ID NO: 3309750 - DNA, 17 bp, Homo sapiens
caccgttcaagcgccag

SEQ ID NO: 3309751 - DNA, 14 bp, Homo sapiens
caccgttcattcag

SEQ ID NO: 3309752 - DNA, 13 bp, Homo sapiens
cacctaccatgct

SEQ ID NO: 3309753 - DNA, 14 bp, Homo sapiens
cacctaccatgctg

SEQ ID NO: 3309754 - DNA, 15 bp, Homo sapiens
cacctaccatgctgc

SEQ ID NO: 3309755 - DNA, 18 bp, Homo sapiens
cacctaccgagttcaagt

SEQ ID NO: 3309756 - DNA, 20 bp, Homo sapiens
cacctactatgtgctgggtg

SEQ ID NO: 3309757 - DNA, 21 bp, Homo sapiens
cacctactatgtgctgggtgc

SEQ ID NO: 3309758 - DNA, 12 bp, Homo sapiens
cacctactgagt

SEQ ID NO: 3309759 - DNA, 14 bp, Homo sapiens
cacctagcccagga

SEQ ID NO: 3309760 - DNA, 15 bp, Homo sapiens
cacctagctgtgcaa

SEQ ID NO: 3309761 - DNA, 13 bp, Homo sapiens
cacctatgttatt

SEQ ID NO: 3309762 - DNA, 16 bp, Homo sapiens
cacctatgttattttg

SEQ ID NO: 3309763 - DNA, 22 bp, Homo sapiens
cacctatgttattttgtgtaca

SEQ ID NO: 3309764 - DNA, 18 bp, Homo sapiens
cacctcaccccgttacag

SEQ ID NO: 3309765 - DNA, 20 bp, Homo sapiens
cacctcagaaagtcaccagg

SEQ ID NO: 3309766 - DNA, 18 bp, Homo sapiens
cactagaagaaaagccca

SEQ ID NO: 3309767 - DNA, 20 bp, Homo sapiens
cactagaagaaaagcccatt

SEQ ID NO: 3309768 - DNA, 16 bp, Homo sapiens
cactagagaatgcaca

SEQ ID NO: 3309769 - DNA, 18 bp, Homo sapiens
cactagagacaaatcttt

SEQ ID NO: 3309770 - DNA, 20 bp, Homo sapiens
cactagagacaaatctttaa

SEQ ID NO: 3309771 - DNA, 23 bp, Homo sapiens
cactagcatagaatagcgacagg

SEQ ID NO: 3309772 - DNA, 23 bp, Homo sapiens
cactagcccaatgaaatgaatta

SEQ ID NO: 3309773 - DNA, 17 bp, Homo sapiens
cactagcctctccagga

SEQ ID NO: 3309774 - DNA, 20 bp, Homo sapiens
cactaggaatcccagaggtg

SEQ ID NO: 3309775 - DNA, 17 bp, Homo sapiens
cactaggcccccacttg

SEQ ID NO: 3309776 - DNA, 23 bp, Homo sapiens
cactaggcccccacttgcctctt

SEQ ID NO: 3309777 - DNA, 14 bp, Homo sapiens
cactaggtaactta

SEQ ID NO: 3309778 - DNA, 17 bp, Homo sapiens
cactaggttcaattccc

SEQ ID NO: 3309779 - DNA, 14 bp, Homo sapiens
cactatagcctagg

SEQ ID NO: 3309780 - DNA, 15 bp, Homo sapiens
cactatatcatgggc

SEQ ID NO: 3309781 - DNA, 16 bp, Homo sapiens
cactatccatgcacca

SEQ ID NO: 3309782 - DNA, 18 bp, Homo sapiens
cactatccatgcaccaaa

SEQ ID NO: 3309783 - DNA, 19 bp, Homo sapiens
cactatccatgcaccaaac

SEQ ID NO: 3309784 - DNA, 19 bp, Homo sapiens
cactatcccaatcaaagaa

SEQ ID NO: 3309785 - DNA, 18 bp, Homo sapiens
cactatctcacactaatc

SEQ ID NO: 3309786 - DNA, 14 bp, Homo sapiens
cactatcttcttca

SEQ ID NO: 3309787 - DNA, 17 bp, Homo sapiens
cactatgaagctacctc

SEQ ID NO: 3309788 - DNA, 13 bp, Homo sapiens
cactatgcacaga

SEQ ID NO: 3309789 - DNA, 16 bp, Homo sapiens
cactatgcacagagcc

SEQ ID NO: 3309790 - DNA, 20 bp, Homo sapiens
cactatggtatgctggccag

SEQ ID NO: 3309791 - DNA, 22 bp, Homo sapiens
cactatggtatgctggccagca

SEQ ID NO: 3309792 - DNA, 15 bp, Homo sapiens
cactatgttgcccag

SEQ ID NO: 3309793 - DNA, 17 bp, Homo sapiens
cactatgttgcccaggc

SEQ ID NO: 3309794 - DNA, 20 bp, Homo sapiens
cactattttcagaatctgaa

SEQ ID NO: 3309795 - DNA, 13 bp, Homo sapiens
cactcaaacaatc

SEQ ID NO: 3309796 - DNA, 19 bp, Homo sapiens
cactcaaattaatctttct

SEQ ID NO: 3309797 - DNA, 14 bp, Homo sapiens
cactcaactctgag

SEQ ID NO: 3309798 - DNA, 16 bp, Homo sapiens
cactcaactctgagcc

SEQ ID NO: 3309799 - DNA, 17 bp, Homo sapiens
cactcaactctgagccc

SEQ ID NO: 3309800 - DNA, 19 bp, Homo sapiens
cactcaactctgagcccat

SEQ ID NO: 3309801 - DNA, 16 bp, Homo sapiens
cactcacagacctgga

SEQ ID NO: 3309802 - DNA, 13 bp, Homo sapiens
cactcacatgaca

SEQ ID NO: 3309803 - DNA, 16 bp, Homo sapiens
cactcaccccctttgc

SEQ ID NO: 3309804 - DNA, 16 bp, Homo sapiens
cactcactaggccccc

SEQ ID NO: 3309805 - DNA, 15 bp, Homo sapiens
cactcactcactcat

SEQ ID NO: 3309806 - DNA, 19 bp, Homo sapiens
cactcagaaagaggtctcc

SEQ ID NO: 3309807 - DNA, 23 bp, Homo sapiens
cactcagaaagaggtctccccat

SEQ ID NO: 3309808 - DNA, 12 bp, Homo sapiens
cactcagaagac

SEQ ID NO: 3309809 - DNA, 17 bp, Homo sapiens
cactcagaagacactga

SEQ ID NO: 3309810 - DNA, 18 bp, Homo sapiens
cactcagaagacactgat

SEQ ID NO: 3309811 - DNA, 12 bp, Homo sapiens
cactcagacctg

SEQ ID NO: 3309812 - DNA, 21 bp, Homo sapiens
cactcagccatttccccctcc

SEQ ID NO: 3309813 - DNA, 22 bp, Homo sapiens
cactcagctgtcctgcagcaaa

SEQ ID NO: 3309814 - DNA, 18 bp, Homo sapiens
cactcagtctctcttctc

SEQ ID NO: 3309815 - DNA, 21 bp, Homo sapiens
cactcattgctgagcctctgc

SEQ ID NO: 3309816 - DNA, 15 bp, Homo sapiens
cactccacagagtga

SEQ ID NO: 3309817 - DNA, 12 bp, Homo sapiens
cactccaccctc

SEQ ID NO: 3309818 - DNA, 16 bp, Homo sapiens
cactccagacccctgg

SEQ ID NO: 3309819 - DNA, 21 bp, Homo sapiens
cactccagcctgagcaacaga

SEQ ID NO: 3309820 - DNA, 14 bp, Homo sapiens
cactccagcctggg

SEQ ID NO: 3309821 - DNA, 13 bp, Homo sapiens
cactccaggccct

SEQ ID NO: 3309822 - DNA, 14 bp, Homo sapiens
cactccaggccctg

SEQ ID NO: 3309823 - DNA, 15 bp, Homo sapiens
cactccaggccctgc

SEQ ID NO: 3309824 - DNA, 12 bp, Homo sapiens
cactccattccc

SEQ ID NO: 3309825 - DNA, 23 bp, Homo sapiens
cactcccacctgacacaccaggc

SEQ ID NO: 3309826 - DNA, 14 bp, Homo sapiens
cactcccagcactc

SEQ ID NO: 3309827 - DNA, 19 bp, Homo sapiens
cactcccatttttacttaa

SEQ ID NO: 3309828 - DNA, 14 bp, Homo sapiens
cactccccaaggaa

SEQ ID NO: 3309829 - DNA, 19 bp, Homo sapiens
cactccccagagctgtgcc

SEQ ID NO: 3309830 - DNA, 20 bp, Homo sapiens
cactccccagagctgtgcca

SEQ ID NO: 3309831 - DNA, 23 bp, Homo sapiens
cactccccagagctgtgccagca

SEQ ID NO: 3309832 - DNA, 18 bp, Homo sapiens
cactccccatgccacgtt

SEQ ID NO: 3309833 - DNA, 19 bp, Homo sapiens
cactccccatgccacgttc

SEQ ID NO: 3309834 - DNA, 18 bp, Homo sapiens
cactccccgaagtctttt

SEQ ID NO: 3309835 - DNA, 19 bp, Homo sapiens
cactccccgaagtcttttg

SEQ ID NO: 3309836 - DNA, 14 bp, Homo sapiens
cactccccttgcct

SEQ ID NO: 3309837 - DNA, 18 bp, Homo sapiens
cactccccttgccttccc

SEQ ID NO: 3309838 - DNA, 14 bp, Homo sapiens
cactccctccatca

SEQ ID NO: 3309839 - DNA, 18 bp, Homo sapiens
cactcccttgctggcccc

SEQ ID NO: 3309840 - DNA, 22 bp, Homo sapiens
cactccggtgtgcctgcagccc

SEQ ID NO: 3309841 - DNA, 14 bp, Homo sapiens
cactcctccctccg

SEQ ID NO: 3309842 - DNA, 19 bp, Homo sapiens
cactcctcctcactaaaaa

SEQ ID NO: 3309843 - DNA, 10 bp, Homo sapiens
cactcctggg

SEQ ID NO: 3309844 - DNA, 13 bp, Homo sapiens
cactcctgtacac

SEQ ID NO: 3309845 - DNA, 16 bp, Homo sapiens
cactcctgtcccgcct

SEQ ID NO: 3309846 - DNA, 18 bp, Homo sapiens
cactcctgttacttacct

SEQ ID NO: 3309847 - DNA, 14 bp, Homo sapiens
cactccttgtcccc

SEQ ID NO: 3309848 - DNA, 17 bp, Homo sapiens
cactcgaggcctgcaaa

SEQ ID NO: 3309849 - DNA, 13 bp, Homo sapiens
cactcgcttcccc

SEQ ID NO: 3309850 - DNA, 13 bp, Homo sapiens
cactctaaaaaac

SEQ ID NO: 3309851 - DNA, 18 bp, Homo sapiens
cactctaaaaggttcagg

SEQ ID NO: 3309852 - DNA, 20 bp, Homo sapiens
cactctaaaaggttcaggga

SEQ ID NO: 3309853 - DNA, 16 bp, Homo sapiens
cactctaccctcccac

SEQ ID NO: 3309854 - DNA, 17 bp, Homo sapiens
cactctaccctcccacc

SEQ ID NO: 3309855 - DNA, 11 bp, Homo sapiens
cactctacctc

SEQ ID NO: 3309856 - DNA, 14 bp, Homo sapiens
cactctacctcctt

SEQ ID NO: 3309857 - DNA, 18 bp, Homo sapiens
cactctacctccttagct

SEQ ID NO: 3309858 - DNA, 19 bp, Homo sapiens
cactctacctccttagctt

SEQ ID NO: 3309859 - DNA, 18 bp, Homo sapiens
cactctatgagttggact

SEQ ID NO: 3309860 - DNA, 13 bp, Homo sapiens
cactctccatcac

SEQ ID NO: 3309861 - DNA, 14 bp, Homo sapiens
cactctccccacac

SEQ ID NO: 3309862 - DNA, 15 bp, Homo sapiens
cactctccccacact

SEQ ID NO: 3309863 - DNA, 21 bp, Homo sapiens
cactctccccacactaacctg

SEQ ID NO: 3309864 - DNA, 15 bp, Homo sapiens
cactctcggggccct

SEQ ID NO: 3309865 - DNA, 19 bp, Homo sapiens
cactctgagtctctgaatg

SEQ ID NO: 3309866 - DNA, 16 bp, Homo sapiens
cactctgccagcaaag

SEQ ID NO: 3309867 - DNA, 17 bp, Homo sapiens
cactctgccagcaaaga

SEQ ID NO: 3309868 - DNA, 12 bp, Homo sapiens
cactctgctgct

SEQ ID NO: 3309869 - DNA, 13 bp, Homo sapiens
cactctgcttctc

SEQ ID NO: 3309870 - DNA, 18 bp, Homo sapiens
cactctgcttctctgact

SEQ ID NO: 3309871 - DNA, 24 bp, Homo sapiens
cactctgtaatagttcagtagaat

SEQ ID NO: 3309872 - DNA, 12 bp, Homo sapiens
cactctgtccct

SEQ ID NO: 3309873 - DNA, 20 bp, Homo sapiens
cactctgtccctgtccttcc

SEQ ID NO: 3309874 - DNA, 22 bp, Homo sapiens
cactctgtccctgtccttccct

SEQ ID NO: 3309875 - DNA, 13 bp, Homo sapiens
cactctgttattt

SEQ ID NO: 3309876 - DNA, 14 bp, Homo sapiens
cactcttaaagcaa

SEQ ID NO: 3309877 - DNA, 23 bp, Homo sapiens
cactcttcagtgactcctgctgg

SEQ ID NO: 3309878 - DNA, 13 bp, Homo sapiens
cactcttgaagag

SEQ ID NO: 3309879 - DNA, 12 bp, Homo sapiens
cactctttgtaa

SEQ ID NO: 3309880 - DNA, 15 bp, Homo sapiens
cactcttttgcttta

SEQ ID NO: 3309881 - DNA, 19 bp, Homo sapiens
cactgaaaacttagccaga

SEQ ID NO: 3309882 - DNA, 22 bp, Homo sapiens
cactgaaaataccatcaggcct

SEQ ID NO: 3309883 - DNA, 16 bp, Homo sapiens
cactgaaacctctgcc

SEQ ID NO: 3309884 - DNA, 16 bp, Homo sapiens
cactgaacatttgctt

SEQ ID NO: 3309885 - DNA, 13 bp, Homo sapiens
cactgaagctggg

SEQ ID NO: 3309886 - DNA, 18 bp, Homo sapiens
cactgaagtttttgaaat

SEQ ID NO: 3309887 - DNA, 19 bp, Homo sapiens
cactgaagtttttgaaata

SEQ ID NO: 3309888 - DNA, 20 bp, Homo sapiens
cactgaagtttttgaaatac

SEQ ID NO: 3309889 - DNA, 21 bp, Homo sapiens
cactgaagtttttgaaatacc

SEQ ID NO: 3309890 - DNA, 13 bp, Homo sapiens
cactgaatttata

SEQ ID NO: 3309891 - DNA, 13 bp, Homo sapiens
cactgacagcctc

SEQ ID NO: 3309892 - DNA, 17 bp, Homo sapiens
cactgaccatccactct

SEQ ID NO: 3309893 - DNA, 20 bp, Homo sapiens
cactgggatgagccgctgtg

SEQ ID NO: 3309894 - DNA, 22 bp, Homo sapiens
cactgggatgagccgctgtgag

SEQ ID NO: 3309895 - DNA, 23 bp, Homo sapiens
cactgggccagccctgcagccca

SEQ ID NO: 3309896 - DNA, 19 bp, Homo sapiens
cactggtaggttgggacac

SEQ ID NO: 3309897 - DNA, 21 bp, Homo sapiens
cactggtaggttgggacacca

SEQ ID NO: 3309898 - DNA, 20 bp, Homo sapiens
cactggtctctaagtgtaaa

SEQ ID NO: 3309899 - DNA, 14 bp, Homo sapiens
cactggtctgctgt

SEQ ID NO: 3309900 - DNA, 20 bp, Homo sapiens
cactggtctgtttgcatttg

SEQ ID NO: 3309901 - DNA, 15 bp, Homo sapiens
cactggtgaactgag

SEQ ID NO: 3309902 - DNA, 17 bp, Homo sapiens
cactggtgaactgagct

SEQ ID NO: 3309903 - DNA, 13 bp, Homo sapiens
cactggtgccaac

SEQ ID NO: 3309904 - DNA, 15 bp, Homo sapiens
cactggtgccaacca

SEQ ID NO: 3309905 - DNA, 22 bp, Homo sapiens
cactggtggcccgacagcctgg

SEQ ID NO: 3309906 - DNA, 19 bp, Homo sapiens
cactggtgggcagctgagg

SEQ ID NO: 3309907 - DNA, 19 bp, Homo sapiens
cactggtggtttttgctct

SEQ ID NO: 3309908 - DNA, 14 bp, Homo sapiens
cactgtagcaggtt

SEQ ID NO: 3309909 - DNA, 14 bp, Homo sapiens
cactgtagttctaa

SEQ ID NO: 3309910 - DNA, 20 bp, Homo sapiens
cactgtagttctaagactca

SEQ ID NO: 3309911 - DNA, 13 bp, Homo sapiens
cactgtataaata

SEQ ID NO: 3309912 - DNA, 16 bp, Homo sapiens
cactgtataaatagga

SEQ ID NO: 3309913 - DNA, 17 bp, Homo sapiens
cactgtataaataggag

SEQ ID NO: 3309914 - DNA, 18 bp, Homo sapiens
cactgtataaataggaga

SEQ ID NO: 3309915 - DNA, 16 bp, Homo sapiens
cactgtcaccctccac

SEQ ID NO: 3309916 - DNA, 14 bp, Homo sapiens
cactgtcaggcctc

SEQ ID NO: 3309917 - DNA, 12 bp, Homo sapiens
cactgtctcagt

SEQ ID NO: 3309918 - DNA, 14 bp, Homo sapiens
cactgtctgttctg

SEQ ID NO: 3309919 - DNA, 19 bp, Homo sapiens
cactgtctttaattctgta

SEQ ID NO: 3309920 - DNA, 14 bp, Homo sapiens
cactgtgccctggt

SEQ ID NO: 3309921 - DNA, 15 bp, Homo sapiens
cactgtgccctggtg

SEQ ID NO: 3309922 - DNA, 17 bp, Homo sapiens
cactgtgccctggtgga

SEQ ID NO: 3309923 - DNA, 18 bp, Homo sapiens
cactgtgccctggtggag

SEQ ID NO: 3309924 - DNA, 21 bp, Homo sapiens
cactgtgcctttgcaaatcag

SEQ ID NO: 3309925 - DNA, 22 bp, Homo sapiens
cactgtgcctttgcaaatcagt

SEQ ID NO: 3309926 - DNA, 17 bp, Homo sapiens
cactgtgcttcgagcca

SEQ ID NO: 3309927 - DNA, 19 bp, Homo sapiens
cactgtggaactaataaat

SEQ ID NO: 3309928 - DNA, 20 bp, Homo sapiens
cactgtggaactaataaata

SEQ ID NO: 3309929 - DNA, 16 bp, Homo sapiens
cactgtggccagagct

SEQ ID NO: 3309930 - DNA, 18 bp, Homo sapiens
cactgtggccagagctgg

SEQ ID NO: 3309931 - DNA, 20 bp, Homo sapiens
cactgtggccagagctggaa

SEQ ID NO: 3309932 - DNA, 17 bp, Homo sapiens
cactgtgggaaggccag

SEQ ID NO: 3309933 - DNA, 21 bp, Homo sapiens
cactgtgggaaggccagctgc

SEQ ID NO: 3309934 - DNA, 21 bp, Homo sapiens
cactgttaatacacagtactt

SEQ ID NO: 3309935 - DNA, 17 bp, Homo sapiens
cactgttagaacactat

SEQ ID NO: 3309936 - DNA, 20 bp, Homo sapiens
cactgttagaacactatttt

SEQ ID NO: 3309937 - DNA, 21 bp, Homo sapiens
cactgttagaacactattttc

SEQ ID NO: 3309938 - DNA, 22 bp, Homo sapiens
cactgttagctttttaaaacat

SEQ ID NO: 3309939 - DNA, 15 bp, Homo sapiens
cactgttatcaaaac

SEQ ID NO: 3309940 - DNA, 14 bp, Homo sapiens
cactgttcaatact

SEQ ID NO: 3309941 - DNA, 20 bp, Homo sapiens
cactgttccctctgctcctg

SEQ ID NO: 3309942 - DNA, 19 bp, Homo sapiens
cactgttctgaaagtgact

SEQ ID NO: 3309943 - DNA, 11 bp, Homo sapiens
cactgttctgc

SEQ ID NO: 3309944 - DNA, 14 bp, Homo sapiens
cactgttctgcaaa

SEQ ID NO: 3309945 - DNA, 16 bp, Homo sapiens
cactgttgaaaattat

SEQ ID NO: 3309946 - DNA, 17 bp, Homo sapiens
cactgttgatgtatctg

SEQ ID NO: 3309947 - DNA, 19 bp, Homo sapiens
cactgttgcccaggctggc

SEQ ID NO: 3309948 - DNA, 23 bp, Homo sapiens
cactgttgcccaggctggcgtgc

SEQ ID NO: 3309949 - DNA, 21 bp, Homo sapiens
cactgtttaagtactgtttac

SEQ ID NO: 3309950 - DNA, 12 bp, Homo sapiens
cactgtttctct

SEQ ID NO: 3309951 - DNA, 18 bp, Homo sapiens
cactgtttctctgctgtt

SEQ ID NO: 3309952 - DNA, 19 bp, Homo sapiens
cactgtttctcttgagctg

SEQ ID NO: 3309953 - DNA, 20 bp, Homo sapiens
cactgtttctcttgagctgg

SEQ ID NO: 3309954 - DNA, 14 bp, Homo sapiens
cactgtttttaatc

SEQ ID NO: 3309955 - DNA, 20 bp, Homo sapiens
cactgtttttagacaccttc

SEQ ID NO: 3309956 - DNA, 21 bp, Homo sapiens
cactgtttttagacaccttca

SEQ ID NO: 3309957 - DNA, 16 bp, Homo sapiens
cacttaaaaattagca

SEQ ID NO: 3309958 - DNA, 13 bp, Homo sapiens
cacttaagactgt

SEQ ID NO: 3309959 - DNA, 17 bp, Homo sapiens
cacttaaggcactctgt

SEQ ID NO: 3309960 - DNA, 16 bp, Homo sapiens
cacttaagtgcacttt

SEQ ID NO: 3309961 - DNA, 21 bp, Homo sapiens
cacttaagttagcctccacca

SEQ ID NO: 3309962 - DNA, 16 bp, Homo sapiens
cacttaatagcaacag

SEQ ID NO: 3309963 - DNA, 21 bp, Homo sapiens
cacttaatagcaacagagcac

SEQ ID NO: 3309964 - DNA, 12 bp, Homo sapiens
cacttacctcaa

SEQ ID NO: 3309965 - DNA, 22 bp, Homo sapiens
cacttagccgcaccctgcacct

SEQ ID NO: 3309966 - DNA, 19 bp, Homo sapiens
cacttagccgtccatggca

SEQ ID NO: 3309967 - DNA, 18 bp, Homo sapiens
cacttatatagcaccttt

SEQ ID NO: 3309968 - DNA, 17 bp, Homo sapiens
cacttatcttctggatt

SEQ ID NO: 3309969 - DNA, 12 bp, Homo sapiens
cacttatggtaa

SEQ ID NO: 3309970 - DNA, 12 bp, Homo sapiens
cacttatgtact

SEQ ID NO: 3309971 - DNA, 16 bp, Homo sapiens
cacttattgtaaattt

SEQ ID NO: 3309972 - DNA, 20 bp, Homo sapiens
cacttattgtccaggtgagg

SEQ ID NO: 3309973 - DNA, 15 bp, Homo sapiens
cacttattgtcccct

SEQ ID NO: 3309974 - DNA, 21 bp, Homo sapiens
cacttcaagtgaccaccagga

SEQ ID NO: 3309975 - DNA, 22 bp, Homo sapiens
cacttcaatgtgtcatttccgg

SEQ ID NO: 3309976 - DNA, 19 bp, Homo sapiens
cacttcagatctgaggttg

SEQ ID NO: 3309977 - DNA, 15 bp, Homo sapiens
cacttcataatccag

SEQ ID NO: 3309978 - DNA, 16 bp, Homo sapiens
cacttcattgagagtt

SEQ ID NO: 3309979 - DNA, 19 bp, Homo sapiens
cacttccaaaattcttatt

SEQ ID NO: 3309980 - DNA, 14 bp, Homo sapiens
cacttccaggggaa

SEQ ID NO: 3309981 - DNA, 17 bp, Homo sapiens
cacttcccgtctcagaa

SEQ ID NO: 3309982 - DNA, 17 bp, Homo sapiens
cacttcctacaagagca

SEQ ID NO: 3309983 - DNA, 23 bp, Homo sapiens
cacttcctacaagagcagcctgt

SEQ ID NO: 3309984 - DNA, 17 bp, Homo sapiens
cacttcctgctacagga

SEQ ID NO: 3309985 - DNA, 16 bp, Homo sapiens
cacttctgcattcctg

SEQ ID NO: 3309986 - DNA, 21 bp, Homo sapiens
cacttctgtgagacccccaca

SEQ ID NO: 3309987 - DNA, 14 bp, Homo sapiens
cacttcttacccca

SEQ ID NO: 3309988 - DNA, 12 bp, Homo sapiens
cacttcttcctt

SEQ ID NO: 3309989 - DNA, 16 bp, Homo sapiens
cacttcttcctttctc

SEQ ID NO: 3309990 - DNA, 18 bp, Homo sapiens
cacttcttgttccccact

SEQ ID NO: 3309991 - DNA, 14 bp, Homo sapiens
cacttgaaaccttt

SEQ ID NO: 3309992 - DNA, 23 bp, Homo sapiens
cacttgatgatacaatgaacact

SEQ ID NO: 3309993 - DNA, 13 bp, Homo sapiens
cacttgcagactc

SEQ ID NO: 3309994 - DNA, 14 bp, Homo sapiens
cacttgcagactct

SEQ ID NO: 3309995 - DNA, 17 bp, Homo sapiens
cacttgcaggggtccct

SEQ ID NO: 3309996 - DNA, 21 bp, Homo sapiens
cacttgcaggggtccctgcta

SEQ ID NO: 3309997 - DNA, 22 bp, Homo sapiens
cacttgccctgttctcttcaca

SEQ ID NO: 3309998 - DNA, 18 bp, Homo sapiens
cacttgcgtcctgcagag

SEQ ID NO: 3309999 - DNA, 19 bp, Homo sapiens
cacttgcgtcctgcagagg

SEQ ID NO: 3310000 - DNA, 17 bp, Homo sapiens
cacttgctcccaaccca

SEQ ID NO: 3310001 - DNA, 15 bp, Homo sapiens
cacttgctggggctc

SEQ ID NO: 3310002 - DNA, 14 bp, Homo sapiens
cacttggagcccgt

SEQ ID NO: 3310003 - DNA, 14 bp, Homo sapiens
cacttggcctcagc

SEQ ID NO: 3310004 - DNA, 16 bp, Homo sapiens
cacttggcctcagctg

SEQ ID NO: 3310005 - DNA, 20 bp, Homo sapiens
cacttggcctcagctggctg

SEQ ID NO: 3310006 - DNA, 16 bp, Homo sapiens
cacttgggtcttccct

SEQ ID NO: 3310007 - DNA, 14 bp, Homo sapiens
cacttggtgtactg

SEQ ID NO: 3310008 - DNA, 12 bp, Homo sapiens
cacttgtacaaa

SEQ ID NO: 3310009 - DNA, 17 bp, Homo sapiens
cacttgtacaaaataaa

SEQ ID NO: 3310010 - DNA, 19 bp, Homo sapiens
cacttgtataaatgtatat

SEQ ID NO: 3310011 - DNA, 15 bp, Homo sapiens
cacttgtattgactt

SEQ ID NO: 3310012 - DNA, 14 bp, Homo sapiens
cacttgtatttaat

SEQ ID NO: 3310013 - DNA, 15 bp, Homo sapiens
cacttgtatttaatt

SEQ ID NO: 3310014 - DNA, 22 bp, Homo sapiens
cacttgtcactgacacaaagga

SEQ ID NO: 3310015 - DNA, 15 bp, Homo sapiens
cacttgtgctttgct

SEQ ID NO: 3310016 - DNA, 18 bp, Homo sapiens
cacttgtgctttgctctt

SEQ ID NO: 3310017 - DNA, 19 bp, Homo sapiens
cacttgtgtcaaccactaa

SEQ ID NO: 3310018 - DNA, 22 bp, Homo sapiens
cacttgtgtcaaccactaaagt

SEQ ID NO: 3310019 - DNA, 17 bp, Homo sapiens
cagacgctgccgctgcc

SEQ ID NO: 3310020 - DNA, 15 bp, Homo sapiens
cagacggcggccagg

SEQ ID NO: 3310021 - DNA, 18 bp, Homo sapiens
cagacgggcaagaagctg

SEQ ID NO: 3310022 - DNA, 16 bp, Homo sapiens
cagacgggcacagaca

SEQ ID NO: 3310023 - DNA, 18 bp, Homo sapiens
cagacgggcacagacacg

SEQ ID NO: 3310024 - DNA, 18 bp, Homo sapiens
cagacgtccatagctcct

SEQ ID NO: 3310025 - DNA, 19 bp, Homo sapiens
cagacgtccatagctcctc

SEQ ID NO: 3310026 - DNA, 20 bp, Homo sapiens
cagacgtccatagctcctct

SEQ ID NO: 3310027 - DNA, 24 bp, Homo sapiens
cagacgtggtggctcacacctgca

SEQ ID NO: 3310028 - DNA, 20 bp, Homo sapiens
cagactagatgtagtatttt

SEQ ID NO: 3310029 - DNA, 21 bp, Homo sapiens
cagactagatgtagtattttt

SEQ ID NO: 3310030 - DNA, 18 bp, Homo sapiens
cagactcagtttgtcaga

SEQ ID NO: 3310031 - DNA, 14 bp, Homo sapiens
cagactctaggtta

SEQ ID NO: 3310032 - DNA, 17 bp, Homo sapiens
cagactctcagcccaga

SEQ ID NO: 3310033 - DNA, 14 bp, Homo sapiens
cagactctgagctg

SEQ ID NO: 3310034 - DNA, 22 bp, Homo sapiens
cagactctttcgatacccagga

SEQ ID NO: 3310035 - DNA, 23 bp, Homo sapiens
cagactgcagaggggaaagactt

SEQ ID NO: 3310036 - DNA, 13 bp, Homo sapiens
cagactgctagtg

SEQ ID NO: 3310037 - DNA, 22 bp, Homo sapiens
cagactgctagtgttctgtcta

SEQ ID NO: 3310038 - DNA, 13 bp, Homo sapiens
cagactgctggga

SEQ ID NO: 3310039 - DNA, 15 bp, Homo sapiens
cagactgctgggact

SEQ ID NO: 3310040 - DNA, 23 bp, Homo sapiens
cagactgctgggactggccaggt

SEQ ID NO: 3310041 - DNA, 14 bp, Homo sapiens
cagactgcttccaa

SEQ ID NO: 3310042 - DNA, 16 bp, Homo sapiens
cagactggaagcacag

SEQ ID NO: 3310043 - DNA, 21 bp, Homo sapiens
cagactggaagcacagcttca

SEQ ID NO: 3310044 - DNA, 12 bp, Homo sapiens
cagactgtttta

SEQ ID NO: 3310045 - DNA, 23 bp, Homo sapiens
cagactgttttactgttttaatt

SEQ ID NO: 3310046 - DNA, 24 bp, Homo sapiens
cagacttccttgagacacggagcc

SEQ ID NO: 3310047 - DNA, 14 bp, Homo sapiens
cagacttctccaga

SEQ ID NO: 3310048 - DNA, 15 bp, Homo sapiens
cagacttctccagac

SEQ ID NO: 3310049 - DNA, 14 bp, Homo sapiens
cagacttctggaag

SEQ ID NO: 3310050 - DNA, 21 bp, Homo sapiens
cagacttctggaaggctggct

SEQ ID NO: 3310051 - DNA, 15 bp, Homo sapiens
cagactttaaagaat

SEQ ID NO: 3310052 - DNA, 21 bp, Homo sapiens
cagactttagtgccctgcccc

SEQ ID NO: 3310053 - DNA, 16 bp, Homo sapiens
cagacttttgtacatc

SEQ ID NO: 3310054 - DNA, 23 bp, Homo sapiens
cagagaaaaatgctccccacagc

SEQ ID NO: 3310055 - DNA, 16 bp, Homo sapiens
cagagaaaatgaattt

SEQ ID NO: 3310056 - DNA, 23 bp, Homo sapiens
cagagaaagtacttctccaccct

SEQ ID NO: 3310057 - DNA, 11 bp, Homo sapiens
cagagaacagc

SEQ ID NO: 3310058 - DNA, 21 bp, Homo sapiens
cagagaagattcttgtattta

SEQ ID NO: 3310059 - DNA, 19 bp, Homo sapiens
cagagaagcggatttccag

SEQ ID NO: 3310060 - DNA, 13 bp, Homo sapiens
cagagaaggcctc

SEQ ID NO: 3310061 - DNA, 19 bp, Homo sapiens
cagagaaggcctcttgtgc

SEQ ID NO: 3310062 - DNA, 22 bp, Homo sapiens
cagagaaggcctcttgtgctca

SEQ ID NO: 3310063 - DNA, 22 bp, Homo sapiens
cagagaagggcataaaacagct

SEQ ID NO: 3310064 - DNA, 20 bp, Homo sapiens
cagagaagttctcaaagtta

SEQ ID NO: 3310065 - DNA, 23 bp, Homo sapiens
cagagaagttctcaaagttaatt

SEQ ID NO: 3310066 - DNA, 20 bp, Homo sapiens
cagagaagtttgtagccagg

SEQ ID NO: 3310067 - DNA, 14 bp, Homo sapiens
cagagaatggctgg

SEQ ID NO: 3310068 - DNA, 21 bp, Homo sapiens
cagagaatggctgggtcaggg

SEQ ID NO: 3310069 - DNA, 13 bp, Homo sapiens
cagagaatttcta

SEQ ID NO: 3310070 - DNA, 16 bp, Homo sapiens
cagagaatttctacca

SEQ ID NO: 3310071 - DNA, 23 bp, Homo sapiens
cagagaatttctaccatttcaga

SEQ ID NO: 3310072 - DNA, 12 bp, Homo sapiens
cagagacaaaat

SEQ ID NO: 3310073 - DNA, 10 bp, Homo sapiens
cagagacata

SEQ ID NO: 3310074 - DNA, 18 bp, Homo sapiens
cagagaccaggctgtgtc

SEQ ID NO: 3310075 - DNA, 20 bp, Homo sapiens
cagagaccctctgccaccag

SEQ ID NO: 3310076 - DNA, 18 bp, Homo sapiens
cagagaccgtcctcaccc

SEQ ID NO: 3310077 - DNA, 15 bp, Homo sapiens
cagagaccttaattt

SEQ ID NO: 3310078 - DNA, 18 bp, Homo sapiens
cagagaccttaatttata

SEQ ID NO: 3310079 - DNA, 18 bp, Homo sapiens
cagagacgcaggaatgga

SEQ ID NO: 3310080 - DNA, 13 bp, Homo sapiens
cagagacggcaga

SEQ ID NO: 3310081 - DNA, 16 bp, Homo sapiens
cagagagaaaaagatt

SEQ ID NO: 3310082 - DNA, 16 bp, Homo sapiens
cagagagacccttgtg

SEQ ID NO: 3310083 - DNA, 13 bp, Homo sapiens
cagagagagagaa

SEQ ID NO: 3310084 - DNA, 15 bp, Homo sapiens
cagagagagagaaag

SEQ ID NO: 3310085 - DNA, 17 bp, Homo sapiens
cagagagagagaaagag

SEQ ID NO: 3310086 - DNA, 15 bp, Homo sapiens
cagagagccattttg

SEQ ID NO: 3310087 - DNA, 18 bp, Homo sapiens
cagagagccattttgtga

SEQ ID NO: 3310088 - DNA, 19 bp, Homo sapiens
cagagagctggtagttagt

SEQ ID NO: 3310089 - DNA, 20 bp, Homo sapiens
cagagagcttagcctggagc

SEQ ID NO: 3310090 - DNA, 18 bp, Homo sapiens
cagagaggactgtaggga

SEQ ID NO: 3310091 - DNA, 20 bp, Homo sapiens
cagagaggactgtagggagg

SEQ ID NO: 3310092 - DNA, 21 bp, Homo sapiens
cagagaggagaaacacatctt

SEQ ID NO: 3310093 - DNA, 16 bp, Homo sapiens
cagagaggagcacctg

SEQ ID NO: 3310094 - DNA, 20 bp, Homo sapiens
cagagaggagcacctgaacc

SEQ ID NO: 3310095 - DNA, 21 bp, Homo sapiens
cagagagggatgggttcctgc

SEQ ID NO: 3310096 - DNA, 22 bp, Homo sapiens
cagagagggcccagctgtagcc

SEQ ID NO: 3310097 - DNA, 17 bp, Homo sapiens
cagagaggtctcaggtt

SEQ ID NO: 3310098 - DNA, 14 bp, Homo sapiens
cagagagtcccact

SEQ ID NO: 3310099 - DNA, 18 bp, Homo sapiens
cagagagtcccactgcct

SEQ ID NO: 3310100 - DNA, 13 bp, Homo sapiens
cagagagtggctc

SEQ ID NO: 3310101 - DNA, 16 bp, Homo sapiens
cagagataaagacctt

SEQ ID NO: 3310102 - DNA, 20 bp, Homo sapiens
cagagatgcaccaccaagcc

SEQ ID NO: 3310103 - DNA, 19 bp, Homo sapiens
cagagatgccagcccttca

SEQ ID NO: 3310104 - DNA, 22 bp, Homo sapiens
cagagatggtaatctacagctc

SEQ ID NO: 3310105 - DNA, 18 bp, Homo sapiens
cagagatgtcatcagagc

SEQ ID NO: 3310106 - DNA, 16 bp, Homo sapiens
cagagattcccaagcc

SEQ ID NO: 3310107 - DNA, 22 bp, Homo sapiens
cagagcaacgaccagggccgag

SEQ ID NO: 3310108 - DNA, 19 bp, Homo sapiens
cagagcacaaacttcagaa

SEQ ID NO: 3310109 - DNA, 15 bp, Homo sapiens
cagagcaccccctgc

SEQ ID NO: 3310110 - DNA, 20 bp, Homo sapiens
cagagcaccccctgctccac

SEQ ID NO: 3310111 - DNA, 20 bp, Homo sapiens
cagagcacctttgcacagga

SEQ ID NO: 3310112 - DNA, 14 bp, Homo sapiens
cagagcactcccta

SEQ ID NO: 3310113 - DNA, 20 bp, Homo sapiens
cagagcactgggttgcaggg

SEQ ID NO: 3310114 - DNA, 14 bp, Homo sapiens
cagagcactttagc

SEQ ID NO: 3310115 - DNA, 13 bp, Homo sapiens
cagagcagatgca

SEQ ID NO: 3310116 - DNA, 16 bp, Homo sapiens
cagagcagatgcagag

SEQ ID NO: 3310117 - DNA, 20 bp, Homo sapiens
cagagcagatgcagagagcc

SEQ ID NO: 3310118 - DNA, 13 bp, Homo sapiens
cagagcagctagc

SEQ ID NO: 3310119 - DNA, 13 bp, Homo sapiens
cagagcaggacct

SEQ ID NO: 3310120 - DNA, 15 bp, Homo sapiens
cagagcaggacctcc

SEQ ID NO: 3310121 - DNA, 19 bp, Homo sapiens
cagagcaggacctcccttc

SEQ ID NO: 3310122 - DNA, 12 bp, Homo sapiens
cagagcaggagc

SEQ ID NO: 3310123 - DNA, 23 bp, Homo sapiens
cagagcaggagcatcctctgctg

SEQ ID NO: 3310124 - DNA, 17 bp, Homo sapiens
cagagcaggggctccag

SEQ ID NO: 3310125 - DNA, 14 bp, Homo sapiens
cagagcatctggct

SEQ ID NO: 3310126 - DNA, 23 bp, Homo sapiens
cagagcatctggctgtttagcag

SEQ ID NO: 3310127 - DNA, 15 bp, Homo sapiens
cagagcatgtgtcag

SEQ ID NO: 3310128 - DNA, 15 bp, Homo sapiens
cagagcatttaagga

SEQ ID NO: 3310129 - DNA, 21 bp, Homo sapiens
cagagcatttccaacaccaca

SEQ ID NO: 3310130 - DNA, 11 bp, Homo sapiens
cagagccaagt

SEQ ID NO: 3310131 - DNA, 13 bp, Homo sapiens
cagagccaagtcc

SEQ ID NO: 3310132 - DNA, 17 bp, Homo sapiens
cagagccactctatgag

SEQ ID NO: 3310133 - DNA, 19 bp, Homo sapiens
cagagccagatgcaggaca

SEQ ID NO: 3310134 - DNA, 20 bp, Homo sapiens
cagagccagatgcaggacag

SEQ ID NO: 3310135 - DNA, 23 bp, Homo sapiens
cagagccagatgcaggacaggag

SEQ ID NO: 3310136 - DNA, 14 bp, Homo sapiens
cagagccagcctgg

SEQ ID NO: 3310137 - DNA, 17 bp, Homo sapiens
cagagccagcctgggac

SEQ ID NO: 3310138 - DNA, 14 bp, Homo sapiens
cagagccagtgaag

SEQ ID NO: 3310139 - DNA, 17 bp, Homo sapiens
cagagccagtgaaggag

SEQ ID NO: 3310140 - DNA, 11 bp, Homo sapiens
cagagccatgg

SEQ ID NO: 3310141 - DNA, 14 bp, Homo sapiens
cagagccatgggcc

SEQ ID NO: 3310142 - DNA, 16 bp, Homo sapiens
cagagccatgggcctg

SEQ ID NO: 3310143 - DNA, 18 bp, Homo sapiens
cagagccatgggcctggg

SEQ ID NO: 3310144 - DNA, 19 bp, Homo sapiens
cagagccatgggcctgggc

SEQ ID NO: 3310145 - DNA, 17 bp, Homo sapiens
cagagtggcctccctgc

SEQ ID NO: 3310146 - DNA, 12 bp, Homo sapiens
cagagtggcctg

SEQ ID NO: 3310147 - DNA, 13 bp, Homo sapiens
cagagtggcctgg

SEQ ID NO: 3310148 - DNA, 17 bp, Homo sapiens
cagagtggcctggccag

SEQ ID NO: 3310149 - DNA, 22 bp, Homo sapiens
cagagtggcctggccaggagct

SEQ ID NO: 3310150 - DNA, 23 bp, Homo sapiens
cagagtggcctggccaggagctc

SEQ ID NO: 3310151 - DNA, 12 bp, Homo sapiens
cagagtggctgc

SEQ ID NO: 3310152 - DNA, 15 bp, Homo sapiens
cagagtgggccccgg

SEQ ID NO: 3310153 - DNA, 23 bp, Homo sapiens
cagagtgggccccgggctggaga

SEQ ID NO: 3310154 - DNA, 22 bp, Homo sapiens
cagagtggtctttctggagagg

SEQ ID NO: 3310155 - DNA, 16 bp, Homo sapiens
cagagtggtttccaat

SEQ ID NO: 3310156 - DNA, 15 bp, Homo sapiens
cagagtgtacaaatt

SEQ ID NO: 3310157 - DNA, 18 bp, Homo sapiens
cagagtgtggactctggt

SEQ ID NO: 3310158 - DNA, 12 bp, Homo sapiens
cagagttacagt

SEQ ID NO: 3310159 - DNA, 22 bp, Homo sapiens
cagagttattgaatcttaattt

SEQ ID NO: 3310160 - DNA, 16 bp, Homo sapiens
cagagttcacaggagg

SEQ ID NO: 3310161 - DNA, 20 bp, Homo sapiens
cagagttcactataaatggt

SEQ ID NO: 3310162 - DNA, 17 bp, Homo sapiens
cagagtttacattctaa

SEQ ID NO: 3310163 - DNA, 20 bp, Homo sapiens
cagagtttgccttcctttct

SEQ ID NO: 3310164 - DNA, 13 bp, Homo sapiens
cagagtttgtgtg

SEQ ID NO: 3310165 - DNA, 22 bp, Homo sapiens
cagagtttgtgtgttgtcttga

SEQ ID NO: 3310166 - DNA, 17 bp, Homo sapiens
cagagttttcattaaat

SEQ ID NO: 3310167 - DNA, 14 bp, Homo sapiens
cagataaaatgttc

SEQ ID NO: 3310168 - DNA, 23 bp, Homo sapiens
cagataacttttttgagtcattg

SEQ ID NO: 3310169 - DNA, 20 bp, Homo sapiens
cagataagcaagagagatgt

SEQ ID NO: 3310170 - DNA, 22 bp, Homo sapiens
cagataagcaagagagatgttt

SEQ ID NO: 3310171 - DNA, 17 bp, Homo sapiens
cagataatcagcctctt

SEQ ID NO: 3310172 - DNA, 18 bp, Homo sapiens
cagataattcatttgtat

SEQ ID NO: 3310173 - DNA, 20 bp, Homo sapiens
cagataattcatttgtattg

SEQ ID NO: 3310174 - DNA, 17 bp, Homo sapiens
cagataattctggacca

SEQ ID NO: 3310175 - DNA, 14 bp, Homo sapiens
cagatacacacaca

SEQ ID NO: 3310176 - DNA, 22 bp, Homo sapiens
cagatacaggaaaagctgctga

SEQ ID NO: 3310177 - DNA, 17 bp, Homo sapiens
cagatacatatgagtgt

SEQ ID NO: 3310178 - DNA, 16 bp, Homo sapiens
cagatacatcactgct

SEQ ID NO: 3310179 - DNA, 14 bp, Homo sapiens
cagataccagcccc

SEQ ID NO: 3310180 - DNA, 16 bp, Homo sapiens
cagataccagcccctg

SEQ ID NO: 3310181 - DNA, 18 bp, Homo sapiens
cagatactggaagttttg

SEQ ID NO: 3310182 - DNA, 13 bp, Homo sapiens
cagatagagaaat

SEQ ID NO: 3310183 - DNA, 15 bp, Homo sapiens
cagatatactttgtg

SEQ ID NO: 3310184 - DNA, 18 bp, Homo sapiens
cagatatactttgtggac

SEQ ID NO: 3310185 - DNA, 17 bp, Homo sapiens
cagatatatttaagcct

SEQ ID NO: 3310186 - DNA, 23 bp, Homo sapiens
cagatatatttaagccttataaa

SEQ ID NO: 3310187 - DNA, 15 bp, Homo sapiens
cagatatatttttca

SEQ ID NO: 3310188 - DNA, 18 bp, Homo sapiens
cagatatatttttcacag

SEQ ID NO: 3310189 - DNA, 14 bp, Homo sapiens
cagatatcaaaatt

SEQ ID NO: 3310190 - DNA, 23 bp, Homo sapiens
cagatatcaaaattctagctgta

SEQ ID NO: 3310191 - DNA, 20 bp, Homo sapiens
cagatatcatactgattttt

SEQ ID NO: 3310192 - DNA, 13 bp, Homo sapiens
cagatatcttttt

SEQ ID NO: 3310193 - DNA, 22 bp, Homo sapiens
cagatatctttttcattattgt

SEQ ID NO: 3310194 - DNA, 15 bp, Homo sapiens
cagatatgatatgta

SEQ ID NO: 3310195 - DNA, 14 bp, Homo sapiens
cagatatttatatt

SEQ ID NO: 3310196 - DNA, 16 bp, Homo sapiens
cagatatttatatttt

SEQ ID NO: 3310197 - DNA, 21 bp, Homo sapiens
cagatatttatatttttattt

SEQ ID NO: 3310198 - DNA, 22 bp, Homo sapiens
cagatatttatatttttatttt

SEQ ID NO: 3310199 - DNA, 17 bp, Homo sapiens
cagatcaaaatgccttt

SEQ ID NO: 3310200 - DNA, 21 bp, Homo sapiens
cagatcaccagcccggcctgc

SEQ ID NO: 3310201 - DNA, 20 bp, Homo sapiens
cagatcaggcagtgtttaaa

SEQ ID NO: 3310202 - DNA, 15 bp, Homo sapiens
cagatcatccagaag

SEQ ID NO: 3310203 - DNA, 23 bp, Homo sapiens
cagatcctgggtactgaaagcct

SEQ ID NO: 3310204 - DNA, 13 bp, Homo sapiens
cagatcctttttc

SEQ ID NO: 3310205 - DNA, 15 bp, Homo sapiens
cagatctcccactgc

SEQ ID NO: 3310206 - DNA, 14 bp, Homo sapiens
cagatctgcctggg

SEQ ID NO: 3310207 - DNA, 17 bp, Homo sapiens
cagatctgcctgggcct

SEQ ID NO: 3310208 - DNA, 18 bp, Homo sapiens
cagatctgcctgggcctg

SEQ ID NO: 3310209 - DNA, 18 bp, Homo sapiens
cagatctggtcccttgca

SEQ ID NO: 3310210 - DNA, 12 bp, Homo sapiens
cagatctgtgcc

SEQ ID NO: 3310211 - DNA, 13 bp, Homo sapiens
cagatctgtgccc

SEQ ID NO: 3310212 - DNA, 14 bp, Homo sapiens
cagatctgtgcccc

SEQ ID NO: 3310213 - DNA, 20 bp, Homo sapiens
cagatctgtgccccatgcct

SEQ ID NO: 3310214 - DNA, 23 bp, Homo sapiens
cagatctgtgccccatgcctgtc

SEQ ID NO: 3310215 - DNA, 16 bp, Homo sapiens
cagatgaactgactga

SEQ ID NO: 3310216 - DNA, 19 bp, Homo sapiens
cagatgaactgactgaagg

SEQ ID NO: 3310217 - DNA, 20 bp, Homo sapiens
cagatgaactgactgaagga

SEQ ID NO: 3310218 - DNA, 15 bp, Homo sapiens
cagatgaatgtattt

SEQ ID NO: 3310219 - DNA, 21 bp, Homo sapiens
cagatgacacgcgctctccac

SEQ ID NO: 3310220 - DNA, 17 bp, Homo sapiens
cagatgaccataatttt

SEQ ID NO: 3310221 - DNA, 18 bp, Homo sapiens
cagatgagaacaaagctg

SEQ ID NO: 3310222 - DNA, 15 bp, Homo sapiens
cagatgaggacagag

SEQ ID NO: 3310223 - DNA, 18 bp, Homo sapiens
cagatgatcaactcttcg

SEQ ID NO: 3310224 - DNA, 14 bp, Homo sapiens
cagatgatccatga

SEQ ID NO: 3310225 - DNA, 16 bp, Homo sapiens
cagatgcagagagcca

SEQ ID NO: 3310226 - DNA, 15 bp, Homo sapiens
cagatgcaggacagg

SEQ ID NO: 3310227 - DNA, 17 bp, Homo sapiens
cagatgcaggacaggag

SEQ ID NO: 3310228 - DNA, 20 bp, Homo sapiens
cagatgcaggacaggaggcg

SEQ ID NO: 3310229 - DNA, 16 bp, Homo sapiens
cagatgccacacctgc

SEQ ID NO: 3310230 - DNA, 20 bp, Homo sapiens
cagatgcccagagggcccag

SEQ ID NO: 3310231 - DNA, 22 bp, Homo sapiens
cagatgccctttggaaagccat

SEQ ID NO: 3310232 - DNA, 16 bp, Homo sapiens
cagatgctactggact

SEQ ID NO: 3310233 - DNA, 23 bp, Homo sapiens
cagatgctccaagattctagatg

SEQ ID NO: 3310234 - DNA, 12 bp, Homo sapiens
cagatgcttctg

SEQ ID NO: 3310235 - DNA, 13 bp, Homo sapiens
cagatgcttctgg

SEQ ID NO: 3310236 - DNA, 23 bp, Homo sapiens
cagatgcttgcggcaaaaggaaa

SEQ ID NO: 3310237 - DNA, 19 bp, Homo sapiens
cagatggaaaattcatttt

SEQ ID NO: 3310238 - DNA, 20 bp, Homo sapiens
cagatggaaagaggtgaaaa

SEQ ID NO: 3310239 - DNA, 21 bp, Homo sapiens
cagatggaatgctgtgttaaa

SEQ ID NO: 3310240 - DNA, 19 bp, Homo sapiens
cagatggactccagcctgc

SEQ ID NO: 3310241 - DNA, 23 bp, Homo sapiens
cagatggaggttctcagagccaa

SEQ ID NO: 3310242 - DNA, 17 bp, Homo sapiens
cagatggcccctccact

SEQ ID NO: 3310243 - DNA, 22 bp, Homo sapiens
cagatggcccctccactgggga

SEQ ID NO: 3310244 - DNA, 16 bp, Homo sapiens
cagatggtgaagcatt

SEQ ID NO: 3310245 - DNA, 17 bp, Homo sapiens
cagatgtattgactgta

SEQ ID NO: 3310246 - DNA, 19 bp, Homo sapiens
cagatgtcagcttcccagc

SEQ ID NO: 3310247 - DNA, 15 bp, Homo sapiens
cagatgtctctgggg

SEQ ID NO: 3310248 - DNA, 22 bp, Homo sapiens
cagatgtcttctgcctgttata

SEQ ID NO: 3310249 - DNA, 16 bp, Homo sapiens
cagatgtgactgtata

SEQ ID NO: 3310250 - DNA, 18 bp, Homo sapiens
cagatgtgctataatctg

SEQ ID NO: 3310251 - DNA, 20 bp, Homo sapiens
cagatgtgggctttgatttc

SEQ ID NO: 3310252 - DNA, 17 bp, Homo sapiens
cagatgttaaaataaat

SEQ ID NO: 3310253 - DNA, 20 bp, Homo sapiens
cagatgttaaaataaatggt

SEQ ID NO: 3310254 - DNA, 18 bp, Homo sapiens
cagatgtttccagacttc

SEQ ID NO: 3310255 - DNA, 16 bp, Homo sapiens
cagattaaattacagc

SEQ ID NO: 3310256 - DNA, 22 bp, Homo sapiens
cagattaaattacagcttttat

SEQ ID NO: 3310257 - DNA, 19 bp, Homo sapiens
cagattacaggaatgaaga

SEQ ID NO: 3310258 - DNA, 21 bp, Homo sapiens
cagattactgctttaatcaga

SEQ ID NO: 3310259 - DNA, 20 bp, Homo sapiens
cagattcaggccagcccagc

SEQ ID NO: 3310260 - DNA, 14 bp, Homo sapiens
cagattcccagagc

SEQ ID NO: 3310261 - DNA, 21 bp, Homo sapiens
cagattcccagagcaaaataa

SEQ ID NO: 3310262 - DNA, 17 bp, Homo sapiens
cagattcctgggcctgt

SEQ ID NO: 3310263 - DNA, 21 bp, Homo sapiens
cagattcctgggcctgtcccc

SEQ ID NO: 3310264 - DNA, 14 bp, Homo sapiens
cagattcctttccc

SEQ ID NO: 3310265 - DNA, 13 bp, Homo sapiens
cagattctcttga

SEQ ID NO: 3310266 - DNA, 19 bp, Homo sapiens
cagattctgacatttatat

SEQ ID NO: 3310267 - DNA, 13 bp, Homo sapiens
cagattgcctcct

SEQ ID NO: 3310268 - DNA, 15 bp, Homo sapiens
cagattgctgggagg

SEQ ID NO: 3310269 - DNA, 16 bp, Homo sapiens
cagattgggataaggc

SEQ ID NO: 3310270 - DNA, 13 bp, Homo sapiens
cagcatcagggtt

SEQ ID NO: 3310271 - DNA, 23 bp, Homo sapiens
cagcatcagggttaagaagactt

SEQ ID NO: 3310272 - DNA, 22 bp, Homo sapiens
cagcatccaccttggctctgcc

SEQ ID NO: 3310273 - DNA, 13 bp, Homo sapiens
cagcatccagcct

SEQ ID NO: 3310274 - DNA, 17 bp, Homo sapiens
cagcatccagcctgtgt

SEQ ID NO: 3310275 - DNA, 19 bp, Homo sapiens
cagcatcccagccagggtt

SEQ ID NO: 3310276 - DNA, 14 bp, Homo sapiens
cagcatccctggag

SEQ ID NO: 3310277 - DNA, 19 bp, Homo sapiens
cagcatccctggagcagga

SEQ ID NO: 3310278 - DNA, 22 bp, Homo sapiens
cagcatccctggagcaggagcc

SEQ ID NO: 3310279 - DNA, 17 bp, Homo sapiens
cagcatccgcaggtgct

SEQ ID NO: 3310280 - DNA, 20 bp, Homo sapiens
cagcatccgcaggtgctggt

SEQ ID NO: 3310281 - DNA, 14 bp, Homo sapiens
cagcatcctggcac

SEQ ID NO: 3310282 - DNA, 23 bp, Homo sapiens
cagcatccttttctgcagagggg

SEQ ID NO: 3310283 - DNA, 15 bp, Homo sapiens
cagcatcgggagcac

SEQ ID NO: 3310284 - DNA, 20 bp, Homo sapiens
cagcatcgggagcacccaga

SEQ ID NO: 3310285 - DNA, 21 bp, Homo sapiens
cagcatctaaagcagcaggtc

SEQ ID NO: 3310286 - DNA, 15 bp, Homo sapiens
cagcatctcccagca

SEQ ID NO: 3310287 - DNA, 13 bp, Homo sapiens
cagcatgaataaa

SEQ ID NO: 3310288 - DNA, 23 bp, Homo sapiens
cagcatgacctgtgaccagcact

SEQ ID NO: 3310289 - DNA, 20 bp, Homo sapiens
cagcatgccccttggctgga

SEQ ID NO: 3310290 - DNA, 14 bp, Homo sapiens
cagcatgcttccca

SEQ ID NO: 3310291 - DNA, 22 bp, Homo sapiens
cagcatgcttcccagagggagc

SEQ ID NO: 3310292 - DNA, 23 bp, Homo sapiens
cagcatgcttcccagagggagca

SEQ ID NO: 3310293 - DNA, 14 bp, Homo sapiens
cagcatggagagag

SEQ ID NO: 3310294 - DNA, 15 bp, Homo sapiens
cagcatggcatagcc

SEQ ID NO: 3310295 - DNA, 19 bp, Homo sapiens
cagcatggcatagccccgg

SEQ ID NO: 3310296 - DNA, 18 bp, Homo sapiens
cagcatggtccctgcctt

SEQ ID NO: 3310297 - DNA, 22 bp, Homo sapiens
cagcatgtccaacatggtaatt

SEQ ID NO: 3310298 - DNA, 13 bp, Homo sapiens
cagcatgtgccaa

SEQ ID NO: 3310299 - DNA, 17 bp, Homo sapiens
cagcatgttaactttat

SEQ ID NO: 3310300 - DNA, 17 bp, Homo sapiens
cagcatgttgctgagga

SEQ ID NO: 3310301 - DNA, 18 bp, Homo sapiens
cagcatgttgctgaggag

SEQ ID NO: 3310302 - DNA, 18 bp, Homo sapiens
cagcattactaaggcagg

SEQ ID NO: 3310303 - DNA, 24 bp, Homo sapiens
cagcattcatttgttttttcaatg

SEQ ID NO: 3310304 - DNA, 18 bp, Homo sapiens
cagcattccagacttcaa

SEQ ID NO: 3310305 - DNA, 21 bp, Homo sapiens
cagcattccagcccctctggt

SEQ ID NO: 3310306 - DNA, 18 bp, Homo sapiens
cagcattcttagcctgtg

SEQ ID NO: 3310307 - DNA, 15 bp, Homo sapiens
cagcattgctggttc

SEQ ID NO: 3310308 - DNA, 13 bp, Homo sapiens
cagcattgctttc

SEQ ID NO: 3310309 - DNA, 10 bp, Homo sapiens
cagcattgtc

SEQ ID NO: 3310310 - DNA, 12 bp, Homo sapiens
cagcattgtctt

SEQ ID NO: 3310311 - DNA, 22 bp, Homo sapiens
cagcattgtctttgctgtactc

SEQ ID NO: 3310312 - DNA, 21 bp, Homo sapiens
cagcatttccacaccaagcag

SEQ ID NO: 3310313 - DNA, 15 bp, Homo sapiens
cagccaaaccctgtc

SEQ ID NO: 3310314 - DNA, 20 bp, Homo sapiens
cagccaagattttcctcttg

SEQ ID NO: 3310315 - DNA, 22 bp, Homo sapiens
cagccaagattttcctcttgtg

SEQ ID NO: 3310316 - DNA, 15 bp, Homo sapiens
cagccaagcacctcc

SEQ ID NO: 3310317 - DNA, 21 bp, Homo sapiens
cagccaaggccgaagctctgg

SEQ ID NO: 3310318 - DNA, 22 bp, Homo sapiens
cagccaaggccgaagctctggc

SEQ ID NO: 3310319 - DNA, 15 bp, Homo sapiens
cagccacacccaggc

SEQ ID NO: 3310320 - DNA, 17 bp, Homo sapiens
cagccacagacccctgg

SEQ ID NO: 3310321 - DNA, 15 bp, Homo sapiens
cagccacccaagcct

SEQ ID NO: 3310322 - DNA, 19 bp, Homo sapiens
cagccacccaagcctgctg

SEQ ID NO: 3310323 - DNA, 20 bp, Homo sapiens
cagccacccaagcctgctgg

SEQ ID NO: 3310324 - DNA, 22 bp, Homo sapiens
cagccaccccgggctctctgct

SEQ ID NO: 3310325 - DNA, 21 bp, Homo sapiens
cagccaccgaagccgcctgtg

SEQ ID NO: 3310326 - DNA, 22 bp, Homo sapiens
cagccaccgtttcttcctgcca

SEQ ID NO: 3310327 - DNA, 16 bp, Homo sapiens
cagccacctaaacggt

SEQ ID NO: 3310328 - DNA, 20 bp, Homo sapiens
cagccacgaccagccccttc

SEQ ID NO: 3310329 - DNA, 14 bp, Homo sapiens
cagccacggccagg

SEQ ID NO: 3310330 - DNA, 19 bp, Homo sapiens
cagccacggccaggccaga

SEQ ID NO: 3310331 - DNA, 18 bp, Homo sapiens
cagccacttccccctctt

SEQ ID NO: 3310332 - DNA, 22 bp, Homo sapiens
cagccacttcggccaggtcaca

SEQ ID NO: 3310333 - DNA, 16 bp, Homo sapiens
cagccagaccagcagg

SEQ ID NO: 3310334 - DNA, 15 bp, Homo sapiens
cagccagagttcctg

SEQ ID NO: 3310335 - DNA, 23 bp, Homo sapiens
cagccagcccatggcccccaata

SEQ ID NO: 3310336 - DNA, 13 bp, Homo sapiens
cagccaggagcag

SEQ ID NO: 3310337 - DNA, 23 bp, Homo sapiens
cagccaggccaacagcacctccc

SEQ ID NO: 3310338 - DNA, 13 bp, Homo sapiens
cagccaggcgggc

SEQ ID NO: 3310339 - DNA, 16 bp, Homo sapiens
cagccaggcgggctca

SEQ ID NO: 3310340 - DNA, 19 bp, Homo sapiens
cagccaggcgggctcaagg

SEQ ID NO: 3310341 - DNA, 11 bp, Homo sapiens
cagccaggcta

SEQ ID NO: 3310342 - DNA, 19 bp, Homo sapiens
cagccaggctcaggccatg

SEQ ID NO: 3310343 - DNA, 13 bp, Homo sapiens
cagccaggctgcc

SEQ ID NO: 3310344 - DNA, 22 bp, Homo sapiens
cagccagtcccgtttcatttag

SEQ ID NO: 3310345 - DNA, 21 bp, Homo sapiens
cagccagtcttgcctaggcca

SEQ ID NO: 3310346 - DNA, 24 bp, Homo sapiens
cagccagtgccattccactccact

SEQ ID NO: 3310347 - DNA, 16 bp, Homo sapiens
cagccagttggtgggg

SEQ ID NO: 3310348 - DNA, 21 bp, Homo sapiens
cagccagttggtggggccagg

SEQ ID NO: 3310349 - DNA, 15 bp, Homo sapiens
cagccataaaagcat

SEQ ID NO: 3310350 - DNA, 20 bp, Homo sapiens
cagccataaaagcattgtct

SEQ ID NO: 3310351 - DNA, 13 bp, Homo sapiens
cagccataataat

SEQ ID NO: 3310352 - DNA, 16 bp, Homo sapiens
cagccatcgtcctggg

SEQ ID NO: 3310353 - DNA, 16 bp, Homo sapiens
cagccatctgcccagg

SEQ ID NO: 3310354 - DNA, 17 bp, Homo sapiens
cagccatgcccaggacg

SEQ ID NO: 3310355 - DNA, 12 bp, Homo sapiens
cagccatgcctc

SEQ ID NO: 3310356 - DNA, 17 bp, Homo sapiens
cagccatgcctcatgcc

SEQ ID NO: 3310357 - DNA, 18 bp, Homo sapiens
cagccatgcctcatgcca

SEQ ID NO: 3310358 - DNA, 22 bp, Homo sapiens
cagccattgcggccccaggagg

SEQ ID NO: 3310359 - DNA, 23 bp, Homo sapiens
cagccattgcggccccaggaggg

SEQ ID NO: 3310360 - DNA, 17 bp, Homo sapiens
cagccatttccccctcc

SEQ ID NO: 3310361 - DNA, 20 bp, Homo sapiens
cagccatttccccctcctca

SEQ ID NO: 3310362 - DNA, 14 bp, Homo sapiens
cagccatttttaat

SEQ ID NO: 3310363 - DNA, 21 bp, Homo sapiens
cagcccaagaggactgagact

SEQ ID NO: 3310364 - DNA, 10 bp, Homo sapiens
cagcccaagt

SEQ ID NO: 3310365 - DNA, 19 bp, Homo sapiens
cagcccacatagtgatggt

SEQ ID NO: 3310366 - DNA, 15 bp, Homo sapiens
cagcccacctgcacc

SEQ ID NO: 3310367 - DNA, 17 bp, Homo sapiens
cagcccacctgcaccca

SEQ ID NO: 3310368 - DNA, 14 bp, Homo sapiens
cagcccactgagaa

SEQ ID NO: 3310369 - DNA, 13 bp, Homo sapiens
cagcccagagact

SEQ ID NO: 3310370 - DNA, 11 bp, Homo sapiens
cagcccagagc

SEQ ID NO: 3310371 - DNA, 15 bp, Homo sapiens
cagcccagagcctgg

SEQ ID NO: 3310372 - DNA, 15 bp, Homo sapiens
cagcccagccaggcc

SEQ ID NO: 3310373 - DNA, 11 bp, Homo sapiens
cagcccagctt

SEQ ID NO: 3310374 - DNA, 16 bp, Homo sapiens
cagcccagcttcctgg

SEQ ID NO: 3310375 - DNA, 22 bp, Homo sapiens
cagcccaggatactggcacaga

SEQ ID NO: 3310376 - DNA, 16 bp, Homo sapiens
cagcccagggctcctg

SEQ ID NO: 3310377 - DNA, 23 bp, Homo sapiens
cagcccatccatagtaactgaca

SEQ ID NO: 3310378 - DNA, 18 bp, Homo sapiens
cagcccatccattaggcc

SEQ ID NO: 3310379 - DNA, 17 bp, Homo sapiens
cagcccatgcccacctg

SEQ ID NO: 3310380 - DNA, 19 bp, Homo sapiens
cagcccatgcccacctgcc

SEQ ID NO: 3310381 - DNA, 17 bp, Homo sapiens
cagcccatggccctgtg

SEQ ID NO: 3310382 - DNA, 14 bp, Homo sapiens
cagccccacccagg

SEQ ID NO: 3310383 - DNA, 17 bp, Homo sapiens
cagccccacccccagcc

SEQ ID NO: 3310384 - DNA, 22 bp, Homo sapiens
cagccccacccctaagtgccca

SEQ ID NO: 3310385 - DNA, 23 bp, Homo sapiens
cagccccacccctaagtgcccaa

SEQ ID NO: 3310386 - DNA, 14 bp, Homo sapiens
cagccccactgcca

SEQ ID NO: 3310387 - DNA, 15 bp, Homo sapiens
cagccccactgccag

SEQ ID NO: 3310388 - DNA, 18 bp, Homo sapiens
cagccccactgccagcag

SEQ ID NO: 3310389 - DNA, 19 bp, Homo sapiens
cagccccactgccagcagc

SEQ ID NO: 3310390 - DNA, 21 bp, Homo sapiens
cagccccactgccagcagcag

SEQ ID NO: 3310391 - DNA, 15 bp, Homo sapiens
cagccccagaagaaa

SEQ ID NO: 3310392 - DNA, 21 bp, Homo sapiens
cagccccagacaacagcccag

SEQ ID NO: 3310393 - DNA, 12 bp, Homo sapiens
cagccccagaga

SEQ ID NO: 3310394 - DNA, 17 bp, Homo sapiens
cagccccagagagagga

SEQ ID NO: 3310395 - DNA, 14 bp, Homo sapiens
cagctccagctcac

SEQ ID NO: 3310396 - DNA, 17 bp, Homo sapiens
cagctccagctcaccag

SEQ ID NO: 3310397 - DNA, 20 bp, Homo sapiens
cagctccagctcaccagccc

SEQ ID NO: 3310398 - DNA, 22 bp, Homo sapiens
cagctccagggaatccaagcct

SEQ ID NO: 3310399 - DNA, 14 bp, Homo sapiens
cagctccaggggcc

SEQ ID NO: 3310400 - DNA, 20 bp, Homo sapiens
cagctccaggggcccttggg

SEQ ID NO: 3310401 - DNA, 21 bp, Homo sapiens
cagctccaggtggctctgagg

SEQ ID NO: 3310402 - DNA, 21 bp, Homo sapiens
cagctcccaaggctctgagca

SEQ ID NO: 3310403 - DNA, 13 bp, Homo sapiens
cagctccccccgc

SEQ ID NO: 3310404 - DNA, 15 bp, Homo sapiens
cagctccccctgtcc

SEQ ID NO: 3310405 - DNA, 16 bp, Homo sapiens
cagctccctagactgc

SEQ ID NO: 3310406 - DNA, 20 bp, Homo sapiens
cagctccctagactgcatcc

SEQ ID NO: 3310407 - DNA, 13 bp, Homo sapiens
cagctccctgcca

SEQ ID NO: 3310408 - DNA, 14 bp, Homo sapiens
cagctcccttctct

SEQ ID NO: 3310409 - DNA, 15 bp, Homo sapiens
cagctcccttctctg

SEQ ID NO: 3310410 - DNA, 12 bp, Homo sapiens
cagctcctcagc

SEQ ID NO: 3310411 - DNA, 23 bp, Homo sapiens
cagctcctctccttgggctcctg

SEQ ID NO: 3310412 - DNA, 21 bp, Homo sapiens
cagctccttctgtcctactct

SEQ ID NO: 3310413 - DNA, 13 bp, Homo sapiens
cagctccttttcc

SEQ ID NO: 3310414 - DNA, 17 bp, Homo sapiens
cagctccttttccgttc

SEQ ID NO: 3310415 - DNA, 23 bp, Homo sapiens
cagctccttttccgttctgttct

SEQ ID NO: 3310416 - DNA, 20 bp, Homo sapiens
cagctccttttgtccccagg

SEQ ID NO: 3310417 - DNA, 20 bp, Homo sapiens
cagctcgatccaaattgtgc

SEQ ID NO: 3310418 - DNA, 19 bp, Homo sapiens
cagctcgcacccccctgtt

SEQ ID NO: 3310419 - DNA, 22 bp, Homo sapiens
cagctcgcacccccctgttcta

SEQ ID NO: 3310420 - DNA, 11 bp, Homo sapiens
cagctctccag

SEQ ID NO: 3310421 - DNA, 14 bp, Homo sapiens
cagctctccagtca

SEQ ID NO: 3310422 - DNA, 13 bp, Homo sapiens
cagctctcctggc

SEQ ID NO: 3310423 - DNA, 13 bp, Homo sapiens
cagctctctgtat

SEQ ID NO: 3310424 - DNA, 18 bp, Homo sapiens
cagctctctgtataaaca

SEQ ID NO: 3310425 - DNA, 15 bp, Homo sapiens
cagctctgagccaga

SEQ ID NO: 3310426 - DNA, 19 bp, Homo sapiens
cagctctgagccagattac

SEQ ID NO: 3310427 - DNA, 18 bp, Homo sapiens
cagctctgaggggagggg

SEQ ID NO: 3310428 - DNA, 18 bp, Homo sapiens
cagctctgctatgagtgt

SEQ ID NO: 3310429 - DNA, 13 bp, Homo sapiens
cagctctggagaa

SEQ ID NO: 3310430 - DNA, 12 bp, Homo sapiens
cagctctgtcct

SEQ ID NO: 3310431 - DNA, 16 bp, Homo sapiens
cagctctgtcctggga

SEQ ID NO: 3310432 - DNA, 23 bp, Homo sapiens
cagctctgtcctgggagtgagct

SEQ ID NO: 3310433 - DNA, 17 bp, Homo sapiens
cagctctgtggcctgtg

SEQ ID NO: 3310434 - DNA, 19 bp, Homo sapiens
cagctctgtggcctgtgtc

SEQ ID NO: 3310435 - DNA, 24 bp, Homo sapiens
cagctctgtggcctgtgtccagca

SEQ ID NO: 3310436 - DNA, 21 bp, Homo sapiens
cagctctgtgttgccatgtgt

SEQ ID NO: 3310437 - DNA, 15 bp, Homo sapiens
cagctcttaaatgta

SEQ ID NO: 3310438 - DNA, 21 bp, Homo sapiens
cagctcttcattccattgact

SEQ ID NO: 3310439 - DNA, 11 bp, Homo sapiens
cagctcttcca

SEQ ID NO: 3310440 - DNA, 18 bp, Homo sapiens
cagctcttctccaggctg

SEQ ID NO: 3310441 - DNA, 12 bp, Homo sapiens
cagctcttcttg

SEQ ID NO: 3310442 - DNA, 15 bp, Homo sapiens
cagctcttgcccttc

SEQ ID NO: 3310443 - DNA, 17 bp, Homo sapiens
cagctcttgcccttccc

SEQ ID NO: 3310444 - DNA, 24 bp, Homo sapiens
cagctcttgctaatcagtgtctca

SEQ ID NO: 3310445 - DNA, 22 bp, Homo sapiens
cagctctttgaaatagtctgtg

SEQ ID NO: 3310446 - DNA, 22 bp, Homo sapiens
cagctgaaacattccgaagagg

SEQ ID NO: 3310447 - DNA, 17 bp, Homo sapiens
cagctgactgaatgcag

SEQ ID NO: 3310448 - DNA, 17 bp, Homo sapiens
cagctgagccctgggga

SEQ ID NO: 3310449 - DNA, 14 bp, Homo sapiens
cagctgatgagtta

SEQ ID NO: 3310450 - DNA, 18 bp, Homo sapiens
cagctgatgttggaagag

SEQ ID NO: 3310451 - DNA, 12 bp, Homo sapiens
cagctgatttta

SEQ ID NO: 3310452 - DNA, 15 bp, Homo sapiens
cagctgattttaaca

SEQ ID NO: 3310453 - DNA, 18 bp, Homo sapiens
cagctgattttaacaata

SEQ ID NO: 3310454 - DNA, 19 bp, Homo sapiens
cagctgcaaggtactctgg

SEQ ID NO: 3310455 - DNA, 22 bp, Homo sapiens
cagctgcaaggtactctggtga

SEQ ID NO: 3310456 - DNA, 16 bp, Homo sapiens
cagctgcaccagagca

SEQ ID NO: 3310457 - DNA, 20 bp, Homo sapiens
cagctgcacctgccagcctg

SEQ ID NO: 3310458 - DNA, 14 bp, Homo sapiens
cagctgcagctggg

SEQ ID NO: 3310459 - DNA, 17 bp, Homo sapiens
cagctgccccggcccct

SEQ ID NO: 3310460 - DNA, 22 bp, Homo sapiens
cagctgccccggcccctccccc

SEQ ID NO: 3310461 - DNA, 17 bp, Homo sapiens
cagctgccgaccagagc

SEQ ID NO: 3310462 - DNA, 14 bp, Homo sapiens
cagctgcctcactt

SEQ ID NO: 3310463 - DNA, 17 bp, Homo sapiens
cagctgcctcacttcct

SEQ ID NO: 3310464 - DNA, 13 bp, Homo sapiens
cagctgcctctgc

SEQ ID NO: 3310465 - DNA, 14 bp, Homo sapiens
cagctgcctctgct

SEQ ID NO: 3310466 - DNA, 18 bp, Homo sapiens
cagctgcctctgctccct

SEQ ID NO: 3310467 - DNA, 20 bp, Homo sapiens
cagctgcctgaaacagccat

SEQ ID NO: 3310468 - DNA, 12 bp, Homo sapiens
cagctgcctgca

SEQ ID NO: 3310469 - DNA, 17 bp, Homo sapiens
cagctgcctggagaggg

SEQ ID NO: 3310470 - DNA, 19 bp, Homo sapiens
cagctgcctgtgcctgcca

SEQ ID NO: 3310471 - DNA, 23 bp, Homo sapiens
cagctgcctgtgcctgccatggg

SEQ ID NO: 3310472 - DNA, 19 bp, Homo sapiens
cagctgcgggtctgaagga

SEQ ID NO: 3310473 - DNA, 24 bp, Homo sapiens
cagctgcggtccacccaggagccc

SEQ ID NO: 3310474 - DNA, 15 bp, Homo sapiens
cagctgctcagaatt

SEQ ID NO: 3310475 - DNA, 17 bp, Homo sapiens
cagctgctcagaattca

SEQ ID NO: 3310476 - DNA, 19 bp, Homo sapiens
cagctgctcagaattcatc

SEQ ID NO: 3310477 - DNA, 20 bp, Homo sapiens
cagctgctctgccccttggg

SEQ ID NO: 3310478 - DNA, 22 bp, Homo sapiens
cagctgcttttgtctatgggac

SEQ ID NO: 3310479 - DNA, 23 bp, Homo sapiens
cagctgcttttgtctatgggact

SEQ ID NO: 3310480 - DNA, 14 bp, Homo sapiens
cagctggaagtcta

SEQ ID NO: 3310481 - DNA, 24 bp, Homo sapiens
cagctggaagtctacctgctggac

SEQ ID NO: 3310482 - DNA, 18 bp, Homo sapiens
cagctggactctgcatcc

SEQ ID NO: 3310483 - DNA, 16 bp, Homo sapiens
cagctggagaagaccc

SEQ ID NO: 3310484 - DNA, 17 bp, Homo sapiens
cagctggcctggacagt

SEQ ID NO: 3310485 - DNA, 20 bp, Homo sapiens
cagctgggaagcccttttta

SEQ ID NO: 3310486 - DNA, 15 bp, Homo sapiens
cagctgggcaaagcc

SEQ ID NO: 3310487 - DNA, 16 bp, Homo sapiens
cagctgggcaaagcca

SEQ ID NO: 3310488 - DNA, 17 bp, Homo sapiens
cagctgggcaaagccac

SEQ ID NO: 3310489 - DNA, 13 bp, Homo sapiens
cagctgggcccca

SEQ ID NO: 3310490 - DNA, 19 bp, Homo sapiens
cagctgggccccacctact

SEQ ID NO: 3310491 - DNA, 18 bp, Homo sapiens
cagctgggccccatgctc

SEQ ID NO: 3310492 - DNA, 20 bp, Homo sapiens
cagctggttactcagggttc

SEQ ID NO: 3310493 - DNA, 13 bp, Homo sapiens
cagctggttgctc

SEQ ID NO: 3310494 - DNA, 20 bp, Homo sapiens
cagctgtaagaagagactgg

SEQ ID NO: 3310495 - DNA, 16 bp, Homo sapiens
cagctgtaatctatga

SEQ ID NO: 3310496 - DNA, 14 bp, Homo sapiens
cagctgtagccatg

SEQ ID NO: 3310497 - DNA, 19 bp, Homo sapiens
cagctgtagccatggctca

SEQ ID NO: 3310498 - DNA, 20 bp, Homo sapiens
cagctgtagccatggctcag

SEQ ID NO: 3310499 - DNA, 16 bp, Homo sapiens
cagctgtcctgcagca

SEQ ID NO: 3310500 - DNA, 22 bp, Homo sapiens
cagctgtcctgcagcaaacact

SEQ ID NO: 3310501 - DNA, 12 bp, Homo sapiens
cagctgtctcta

SEQ ID NO: 3310502 - DNA, 13 bp, Homo sapiens
cagctgtgagcct

SEQ ID NO: 3310503 - DNA, 16 bp, Homo sapiens
cagctgtgagccttgg

SEQ ID NO: 3310504 - DNA, 13 bp, Homo sapiens
cagctgtgcactt

SEQ ID NO: 3310505 - DNA, 18 bp, Homo sapiens
cagctgtgctctggacag

SEQ ID NO: 3310506 - DNA, 19 bp, Homo sapiens
cagctgtgctctggacagg

SEQ ID NO: 3310507 - DNA, 16 bp, Homo sapiens
cagctgtgctgtggag

SEQ ID NO: 3310508 - DNA, 23 bp, Homo sapiens
cagctgtggcagagttacagttc

SEQ ID NO: 3310509 - DNA, 18 bp, Homo sapiens
cagcttaagcgttcatat

SEQ ID NO: 3310510 - DNA, 14 bp, Homo sapiens
cagcttagatttca

SEQ ID NO: 3310511 - DNA, 17 bp, Homo sapiens
cagcttagatttcatag

SEQ ID NO: 3310512 - DNA, 15 bp, Homo sapiens
cagcttatctctttt

SEQ ID NO: 3310513 - DNA, 19 bp, Homo sapiens
cagcttatctcttttatat

SEQ ID NO: 3310514 - DNA, 22 bp, Homo sapiens
cagcttatctcttttatatttg

SEQ ID NO: 3310515 - DNA, 16 bp, Homo sapiens
cagcttcaagtgcctt

SEQ ID NO: 3310516 - DNA, 17 bp, Homo sapiens
cagcttcaagtgccttt

SEQ ID NO: 3310517 - DNA, 21 bp, Homo sapiens
cagcttcaggcaccagcatcc

SEQ ID NO: 3310518 - DNA, 19 bp, Homo sapiens
cagcttcatgcctttgtaa

SEQ ID NO: 3310519 - DNA, 15 bp, Homo sapiens
cagcttcatttcctg

SEQ ID NO: 3310520 - DNA, 20 bp, Homo sapiens
cagcttcatttcctgtgtct

SEQ ID NO: 3310521 - DNA, 17 bp, Homo sapiens
caggactccctcctcac

SEQ ID NO: 3310522 - DNA, 21 bp, Homo sapiens
caggactccctcctcacctct

SEQ ID NO: 3310523 - DNA, 17 bp, Homo sapiens
caggactgagccccgca

SEQ ID NO: 3310524 - DNA, 13 bp, Homo sapiens
caggactgcacag

SEQ ID NO: 3310525 - DNA, 20 bp, Homo sapiens
caggactgtaaagatttgtt

SEQ ID NO: 3310526 - DNA, 21 bp, Homo sapiens
caggacttaacggctccagga

SEQ ID NO: 3310527 - DNA, 20 bp, Homo sapiens
caggacttggtctgatttca

SEQ ID NO: 3310528 - DNA, 23 bp, Homo sapiens
caggacttggtctgatttcagga

SEQ ID NO: 3310529 - DNA, 19 bp, Homo sapiens
caggactttgaggcaagtg

SEQ ID NO: 3310530 - DNA, 11 bp, Homo sapiens
caggagaacca

SEQ ID NO: 3310531 - DNA, 16 bp, Homo sapiens
caggagaatcactgca

SEQ ID NO: 3310532 - DNA, 20 bp, Homo sapiens
caggagaatcactgcagccc

SEQ ID NO: 3310533 - DNA, 22 bp, Homo sapiens
caggagaatcactgcagcccag

SEQ ID NO: 3310534 - DNA, 23 bp, Homo sapiens
caggagaatcactgcagcccagg

SEQ ID NO: 3310535 - DNA, 14 bp, Homo sapiens
caggagacaggaag

SEQ ID NO: 3310536 - DNA, 13 bp, Homo sapiens
caggagacatttt

SEQ ID NO: 3310537 - DNA, 18 bp, Homo sapiens
caggagacattttcatat

SEQ ID NO: 3310538 - DNA, 18 bp, Homo sapiens
caggagagactgagcagc

SEQ ID NO: 3310539 - DNA, 19 bp, Homo sapiens
caggagagactgagcagcc

SEQ ID NO: 3310540 - DNA, 12 bp, Homo sapiens
caggagagagaa

SEQ ID NO: 3310541 - DNA, 14 bp, Homo sapiens
caggagagagaaag

SEQ ID NO: 3310542 - DNA, 23 bp, Homo sapiens
caggagagagaaagccaggcagg

SEQ ID NO: 3310543 - DNA, 14 bp, Homo sapiens
caggagagagccag

SEQ ID NO: 3310544 - DNA, 16 bp, Homo sapiens
caggagagagccagga

SEQ ID NO: 3310545 - DNA, 14 bp, Homo sapiens
caggagaggcagca

SEQ ID NO: 3310546 - DNA, 23 bp, Homo sapiens
caggagaggcagcatgcttgggc

SEQ ID NO: 3310547 - DNA, 16 bp, Homo sapiens
caggagaggctgggct

SEQ ID NO: 3310548 - DNA, 19 bp, Homo sapiens
caggagagggatacaagag

SEQ ID NO: 3310549 - DNA, 12 bp, Homo sapiens
caggagagtaga

SEQ ID NO: 3310550 - DNA, 22 bp, Homo sapiens
caggagatcgagaccatcctgg

SEQ ID NO: 3310551 - DNA, 16 bp, Homo sapiens
caggagatggagggct

SEQ ID NO: 3310552 - DNA, 23 bp, Homo sapiens
caggagattgagaaggagagaaa

SEQ ID NO: 3310553 - DNA, 23 bp, Homo sapiens
caggagcacaggcagctggatga

SEQ ID NO: 3310554 - DNA, 15 bp, Homo sapiens
caggagcaggaccta

SEQ ID NO: 3310555 - DNA, 15 bp, Homo sapiens
caggagcaggcacgg

SEQ ID NO: 3310556 - DNA, 17 bp, Homo sapiens
caggagcaggcacgggt

SEQ ID NO: 3310557 - DNA, 20 bp, Homo sapiens
caggagccccgaggccttct

SEQ ID NO: 3310558 - DNA, 14 bp, Homo sapiens
caggagccccgcca

SEQ ID NO: 3310559 - DNA, 15 bp, Homo sapiens
caggagccccgccac

SEQ ID NO: 3310560 - DNA, 13 bp, Homo sapiens
caggagcctagcg

SEQ ID NO: 3310561 - DNA, 23 bp, Homo sapiens
caggagcctagcggagcccagcc

SEQ ID NO: 3310562 - DNA, 16 bp, Homo sapiens
caggagcctgtgcctc

SEQ ID NO: 3310563 - DNA, 13 bp, Homo sapiens
caggagcgcaaga

SEQ ID NO: 3310564 - DNA, 16 bp, Homo sapiens
caggagcgcaagatag

SEQ ID NO: 3310565 - DNA, 15 bp, Homo sapiens
caggagctcaggaag

SEQ ID NO: 3310566 - DNA, 18 bp, Homo sapiens
caggagctcttcaggcct

SEQ ID NO: 3310567 - DNA, 22 bp, Homo sapiens
caggagctcttcaggcctccct

SEQ ID NO: 3310568 - DNA, 21 bp, Homo sapiens
caggagctgtcaccaaggaaa

SEQ ID NO: 3310569 - DNA, 22 bp, Homo sapiens
caggagctgtcaccaaggaaac

SEQ ID NO: 3310570 - DNA, 13 bp, Homo sapiens
caggaggccagtg

SEQ ID NO: 3310571 - DNA, 16 bp, Homo sapiens
caggaggccagtgggc

SEQ ID NO: 3310572 - DNA, 20 bp, Homo sapiens
caggaggccagtgggcgggc

SEQ ID NO: 3310573 - DNA, 20 bp, Homo sapiens
caggaggcggcccggccagc

SEQ ID NO: 3310574 - DNA, 11 bp, Homo sapiens
caggagggagg

SEQ ID NO: 3310575 - DNA, 17 bp, Homo sapiens
caggaggggaactgagt

SEQ ID NO: 3310576 - DNA, 24 bp, Homo sapiens
caggaggggtgagtcccctactcc

SEQ ID NO: 3310577 - DNA, 22 bp, Homo sapiens
caggagggtatggtgctgctct

SEQ ID NO: 3310578 - DNA, 15 bp, Homo sapiens
caggagggtctatgg

SEQ ID NO: 3310579 - DNA, 18 bp, Homo sapiens
caggaggtggctatggcc

SEQ ID NO: 3310580 - DNA, 17 bp, Homo sapiens
caggaggtgtgaatgca

SEQ ID NO: 3310581 - DNA, 20 bp, Homo sapiens
caggagtcagtgtctggctt

SEQ ID NO: 3310582 - DNA, 14 bp, Homo sapiens
caggagtccacttt

SEQ ID NO: 3310583 - DNA, 20 bp, Homo sapiens
caggagtctctgccacccac

SEQ ID NO: 3310584 - DNA, 22 bp, Homo sapiens
caggagtctctgccacccactc

SEQ ID NO: 3310585 - DNA, 23 bp, Homo sapiens
caggagtctctgccacccactca

SEQ ID NO: 3310586 - DNA, 17 bp, Homo sapiens
caggagtggtgcagaca

SEQ ID NO: 3310587 - DNA, 24 bp, Homo sapiens
caggagtggtgcagacagaagtct

SEQ ID NO: 3310588 - DNA, 17 bp, Homo sapiens
caggagtgtcctgccca

SEQ ID NO: 3310589 - DNA, 19 bp, Homo sapiens
caggagtgtcctgcccatg

SEQ ID NO: 3310590 - DNA, 22 bp, Homo sapiens
caggagtgtcctgcccatgccc

SEQ ID NO: 3310591 - DNA, 19 bp, Homo sapiens
caggagttaaaaagggcag

SEQ ID NO: 3310592 - DNA, 21 bp, Homo sapiens
caggagttcgagaccagcctc

SEQ ID NO: 3310593 - DNA, 17 bp, Homo sapiens
caggagttggagaccag

SEQ ID NO: 3310594 - DNA, 20 bp, Homo sapiens
caggagtttgagacaagccc

SEQ ID NO: 3310595 - DNA, 22 bp, Homo sapiens
caggagtttgagacaagccctg

SEQ ID NO: 3310596 - DNA, 16 bp, Homo sapiens
caggataaggagactg

SEQ ID NO: 3310597 - DNA, 19 bp, Homo sapiens
caggataatatatttgcag

SEQ ID NO: 3310598 - DNA, 19 bp, Homo sapiens
caggatactggcacagagg

SEQ ID NO: 3310599 - DNA, 21 bp, Homo sapiens
caggatatccttatcagagct

SEQ ID NO: 3310600 - DNA, 20 bp, Homo sapiens
caggatattagttaatgagc

SEQ ID NO: 3310601 - DNA, 21 bp, Homo sapiens
caggatcatggtgtaataaga

SEQ ID NO: 3310602 - DNA, 14 bp, Homo sapiens
caggatcctgcagg

SEQ ID NO: 3310603 - DNA, 17 bp, Homo sapiens
caggatcctgcaggaac

SEQ ID NO: 3310604 - DNA, 23 bp, Homo sapiens
caggatgaaagttcccccatcag

SEQ ID NO: 3310605 - DNA, 16 bp, Homo sapiens
caggatgaacccagga

SEQ ID NO: 3310606 - DNA, 17 bp, Homo sapiens
caggatgcacatttctg

SEQ ID NO: 3310607 - DNA, 17 bp, Homo sapiens
caggatgccagcccctg

SEQ ID NO: 3310608 - DNA, 18 bp, Homo sapiens
caggatgccagcccctgc

SEQ ID NO: 3310609 - DNA, 21 bp, Homo sapiens
caggatgccagcccctgcctg

SEQ ID NO: 3310610 - DNA, 13 bp, Homo sapiens
caggatgctgggt

SEQ ID NO: 3310611 - DNA, 15 bp, Homo sapiens
caggatgctgggtgg

SEQ ID NO: 3310612 - DNA, 20 bp, Homo sapiens
caggatggactcttctcggc

SEQ ID NO: 3310613 - DNA, 21 bp, Homo sapiens
caggatggactcttctcggct

SEQ ID NO: 3310614 - DNA, 22 bp, Homo sapiens
caggatggactcttctcggctc

SEQ ID NO: 3310615 - DNA, 15 bp, Homo sapiens
caggatggaggggtg

SEQ ID NO: 3310616 - DNA, 21 bp, Homo sapiens
caggatggaggggtggtcctg

SEQ ID NO: 3310617 - DNA, 21 bp, Homo sapiens
caggatgggggctggcctctg

SEQ ID NO: 3310618 - DNA, 19 bp, Homo sapiens
caggatggtctcgatctcc

SEQ ID NO: 3310619 - DNA, 21 bp, Homo sapiens
caggatggtctcgatctcctg

SEQ ID NO: 3310620 - DNA, 21 bp, Homo sapiens
caggatgtagttctgccaggc

SEQ ID NO: 3310621 - DNA, 22 bp, Homo sapiens
caggatgtagttctgccaggca

SEQ ID NO: 3310622 - DNA, 23 bp, Homo sapiens
caggatgtagttctgccaggcaa

SEQ ID NO: 3310623 - DNA, 15 bp, Homo sapiens
caggattcagccgga

SEQ ID NO: 3310624 - DNA, 14 bp, Homo sapiens
caggattcccccag

SEQ ID NO: 3310625 - DNA, 15 bp, Homo sapiens
caggattcccccagc

SEQ ID NO: 3310626 - DNA, 21 bp, Homo sapiens
caggatttcgtgggtctgttt

SEQ ID NO: 3310627 - DNA, 12 bp, Homo sapiens
caggatttctaa

SEQ ID NO: 3310628 - DNA, 14 bp, Homo sapiens
caggcaaaatcctt

SEQ ID NO: 3310629 - DNA, 18 bp, Homo sapiens
caggcaaaatccttgctt

SEQ ID NO: 3310630 - DNA, 12 bp, Homo sapiens
caggcaaattca

SEQ ID NO: 3310631 - DNA, 21 bp, Homo sapiens
caggcaagcacctcctgcctc

SEQ ID NO: 3310632 - DNA, 16 bp, Homo sapiens
caggcaagcccctcag

SEQ ID NO: 3310633 - DNA, 21 bp, Homo sapiens
caggcaagcccctcagccctt

SEQ ID NO: 3310634 - DNA, 24 bp, Homo sapiens
caggcaagcccctcagcccttgcc

SEQ ID NO: 3310635 - DNA, 15 bp, Homo sapiens
caggcaatgctggct

SEQ ID NO: 3310636 - DNA, 19 bp, Homo sapiens
caggcaatgctggctgttg

SEQ ID NO: 3310637 - DNA, 17 bp, Homo sapiens
caggcacacagcagccc

SEQ ID NO: 3310638 - DNA, 14 bp, Homo sapiens
caggcacacagcta

SEQ ID NO: 3310639 - DNA, 15 bp, Homo sapiens
caggcacacagggcc

SEQ ID NO: 3310640 - DNA, 18 bp, Homo sapiens
caggcacccaccatcatg

SEQ ID NO: 3310641 - DNA, 22 bp, Homo sapiens
caggcacccaccatcatgtctg

SEQ ID NO: 3310642 - DNA, 22 bp, Homo sapiens
caggcacccggggccagagaca

SEQ ID NO: 3310643 - DNA, 23 bp, Homo sapiens
caggcacccttctttcctcttcc

SEQ ID NO: 3310644 - DNA, 17 bp, Homo sapiens
caggcaccgagaatgtt

SEQ ID NO: 3310645 - DNA, 22 bp, Homo sapiens
cagggccagaaggagggcagag

SEQ ID NO: 3310646 - DNA, 15 bp, Homo sapiens
cagggccagactgga

SEQ ID NO: 3310647 - DNA, 17 bp, Homo sapiens
cagggccagactggaag

SEQ ID NO: 3310648 - DNA, 14 bp, Homo sapiens
cagggccagaggga

SEQ ID NO: 3310649 - DNA, 17 bp, Homo sapiens
cagggccagagggagct

SEQ ID NO: 3310650 - DNA, 11 bp, Homo sapiens
cagggccagga

SEQ ID NO: 3310651 - DNA, 12 bp, Homo sapiens
cagggccaggac

SEQ ID NO: 3310652 - DNA, 18 bp, Homo sapiens
cagggccaggactgagcc

SEQ ID NO: 3310653 - DNA, 16 bp, Homo sapiens
cagggccaggctggtc

SEQ ID NO: 3310654 - DNA, 12 bp, Homo sapiens
cagggccagggc

SEQ ID NO: 3310655 - DNA, 20 bp, Homo sapiens
cagggccagtggggcctgtg

SEQ ID NO: 3310656 - DNA, 18 bp, Homo sapiens
cagggccatctgactgcc

SEQ ID NO: 3310657 - DNA, 18 bp, Homo sapiens
cagggcccaagtccctgt

SEQ ID NO: 3310658 - DNA, 14 bp, Homo sapiens
cagggcccacgtgt

SEQ ID NO: 3310659 - DNA, 17 bp, Homo sapiens
cagggcccagaggctga

SEQ ID NO: 3310660 - DNA, 11 bp, Homo sapiens
cagggcccctc

SEQ ID NO: 3310661 - DNA, 21 bp, Homo sapiens
cagggcccgcagtgctgggac

SEQ ID NO: 3310662 - DNA, 19 bp, Homo sapiens
cagggcccttggggctggg

SEQ ID NO: 3310663 - DNA, 21 bp, Homo sapiens
cagggcccttggggctggggg

SEQ ID NO: 3310664 - DNA, 14 bp, Homo sapiens
cagggccgaggagg

SEQ ID NO: 3310665 - DNA, 21 bp, Homo sapiens
cagggcctactgccacccgct

SEQ ID NO: 3310666 - DNA, 18 bp, Homo sapiens
cagggcctgcttcccctt

SEQ ID NO: 3310667 - DNA, 21 bp, Homo sapiens
cagggcctgcttccccttcct

SEQ ID NO: 3310668 - DNA, 15 bp, Homo sapiens
cagggcctggagccc

SEQ ID NO: 3310669 - DNA, 17 bp, Homo sapiens
cagggcctggagcccca

SEQ ID NO: 3310670 - DNA, 17 bp, Homo sapiens
cagggcctggcaggcca

SEQ ID NO: 3310671 - DNA, 18 bp, Homo sapiens
cagggcctggcaggccag

SEQ ID NO: 3310672 - DNA, 20 bp, Homo sapiens
cagggcctggcaggccagtg

SEQ ID NO: 3310673 - DNA, 13 bp, Homo sapiens
cagggcctggggg

SEQ ID NO: 3310674 - DNA, 13 bp, Homo sapiens
cagggcgagactc

SEQ ID NO: 3310675 - DNA, 14 bp, Homo sapiens
cagggcgctcagac

SEQ ID NO: 3310676 - DNA, 22 bp, Homo sapiens
cagggcgggcagagggctggag

SEQ ID NO: 3310677 - DNA, 22 bp, Homo sapiens
cagggcggtaccttgtgcccag

SEQ ID NO: 3310678 - DNA, 17 bp, Homo sapiens
cagggctaaggccccca

SEQ ID NO: 3310679 - DNA, 15 bp, Homo sapiens
cagggctaccctccc

SEQ ID NO: 3310680 - DNA, 12 bp, Homo sapiens
cagggctcagcg

SEQ ID NO: 3310681 - DNA, 21 bp, Homo sapiens
cagggctcagcggggacagct

SEQ ID NO: 3310682 - DNA, 13 bp, Homo sapiens
cagggctcaggat

SEQ ID NO: 3310683 - DNA, 12 bp, Homo sapiens
cagggctcccat

SEQ ID NO: 3310684 - DNA, 14 bp, Homo sapiens
cagggctcctccca

SEQ ID NO: 3310685 - DNA, 17 bp, Homo sapiens
cagggctcctcccagct

SEQ ID NO: 3310686 - DNA, 13 bp, Homo sapiens
cagggctcctgcc

SEQ ID NO: 3310687 - DNA, 23 bp, Homo sapiens
cagggctcctgccttctgtcctg

SEQ ID NO: 3310688 - DNA, 15 bp, Homo sapiens
cagggctctgcccca

SEQ ID NO: 3310689 - DNA, 16 bp, Homo sapiens
cagggctctgccccag

SEQ ID NO: 3310690 - DNA, 20 bp, Homo sapiens
cagggctggccccagggcac

SEQ ID NO: 3310691 - DNA, 23 bp, Homo sapiens
cagggctggccccagggcaccct

SEQ ID NO: 3310692 - DNA, 13 bp, Homo sapiens
cagggctggctct

SEQ ID NO: 3310693 - DNA, 15 bp, Homo sapiens
cagggctggctctgc

SEQ ID NO: 3310694 - DNA, 14 bp, Homo sapiens
caggggaaaatgaa

SEQ ID NO: 3310695 - DNA, 14 bp, Homo sapiens
caggggaagccttg

SEQ ID NO: 3310696 - DNA, 15 bp, Homo sapiens
caggggaagccttgc

SEQ ID NO: 3310697 - DNA, 15 bp, Homo sapiens
caggggaccacacct

SEQ ID NO: 3310698 - DNA, 15 bp, Homo sapiens
caggggactcagccc

SEQ ID NO: 3310699 - DNA, 14 bp, Homo sapiens
caggggaggaaaaa

SEQ ID NO: 3310700 - DNA, 15 bp, Homo sapiens
caggggaggagcctg

SEQ ID NO: 3310701 - DNA, 20 bp, Homo sapiens
caggggaggccaagttgtca

SEQ ID NO: 3310702 - DNA, 16 bp, Homo sapiens
caggggatgcccagaa

SEQ ID NO: 3310703 - DNA, 20 bp, Homo sapiens
caggggatgcccagaagagt

SEQ ID NO: 3310704 - DNA, 13 bp, Homo sapiens
caggggcaccttc

SEQ ID NO: 3310705 - DNA, 12 bp, Homo sapiens
caggggcaggcc

SEQ ID NO: 3310706 - DNA, 15 bp, Homo sapiens
caggggcaggcctgg

SEQ ID NO: 3310707 - DNA, 17 bp, Homo sapiens
caggggcaggcctggga

SEQ ID NO: 3310708 - DNA, 15 bp, Homo sapiens
caggggccagaggaa

SEQ ID NO: 3310709 - DNA, 14 bp, Homo sapiens
caggggccccagat

SEQ ID NO: 3310710 - DNA, 19 bp, Homo sapiens
caggggccccagatctgcc

SEQ ID NO: 3310711 - DNA, 17 bp, Homo sapiens
caggggcccgggaactc

SEQ ID NO: 3310712 - DNA, 22 bp, Homo sapiens
caggggcccgggaactcctgcc

SEQ ID NO: 3310713 - DNA, 23 bp, Homo sapiens
caggggcccgggaactcctgcca

SEQ ID NO: 3310714 - DNA, 17 bp, Homo sapiens
caggggcccttgggaca

SEQ ID NO: 3310715 - DNA, 22 bp, Homo sapiens
caggggcccttgggacagccag

SEQ ID NO: 3310716 - DNA, 12 bp, Homo sapiens
caggggcctgga

SEQ ID NO: 3310717 - DNA, 13 bp, Homo sapiens
caggggcctggag

SEQ ID NO: 3310718 - DNA, 15 bp, Homo sapiens
caggggcggggcagg

SEQ ID NO: 3310719 - DNA, 18 bp, Homo sapiens
caggggcggggcaggaat

SEQ ID NO: 3310720 - DNA, 17 bp, Homo sapiens
caggggctacaagaggg

SEQ ID NO: 3310721 - DNA, 18 bp, Homo sapiens
caggggctacaagaggga

SEQ ID NO: 3310722 - DNA, 19 bp, Homo sapiens
caggggctctggagagaaa

SEQ ID NO: 3310723 - DNA, 21 bp, Homo sapiens
caggggctgactctccaggga

SEQ ID NO: 3310724 - DNA, 16 bp, Homo sapiens
caggggctgcttcctc

SEQ ID NO: 3310725 - DNA, 20 bp, Homo sapiens
caggggctgcttcctcctgg

SEQ ID NO: 3310726 - DNA, 22 bp, Homo sapiens
caggggctgcttcctcctggaa

SEQ ID NO: 3310727 - DNA, 17 bp, Homo sapiens
caggggctgggctccct

SEQ ID NO: 3310728 - DNA, 20 bp, Homo sapiens
caggggctgggctccctgat

SEQ ID NO: 3310729 - DNA, 12 bp, Homo sapiens
caggggctgttt

SEQ ID NO: 3310730 - DNA, 15 bp, Homo sapiens
caggggctgtttgag

SEQ ID NO: 3310731 - DNA, 19 bp, Homo sapiens
cagggggaaggtggggtcc

SEQ ID NO: 3310732 - DNA, 19 bp, Homo sapiens
cagggggccccgccagggc

SEQ ID NO: 3310733 - DNA, 22 bp, Homo sapiens
cagggggccccgccagggctgg

SEQ ID NO: 3310734 - DNA, 23 bp, Homo sapiens
cagggggccccgccagggctggg

SEQ ID NO: 3310735 - DNA, 21 bp, Homo sapiens
caggggtcagtgcagcagagg

SEQ ID NO: 3310736 - DNA, 18 bp, Homo sapiens
caggggtcccagccaccc

SEQ ID NO: 3310737 - DNA, 16 bp, Homo sapiens
caggggtccctgctag

SEQ ID NO: 3310738 - DNA, 17 bp, Homo sapiens
caggggtccctgctagt

SEQ ID NO: 3310739 - DNA, 18 bp, Homo sapiens
caggggtcgtcaccacct

SEQ ID NO: 3310740 - DNA, 14 bp, Homo sapiens
caggggtctccctg

SEQ ID NO: 3310741 - DNA, 15 bp, Homo sapiens
caggggtctccctgg

SEQ ID NO: 3310742 - DNA, 16 bp, Homo sapiens
caggggtctccctggc

SEQ ID NO: 3310743 - DNA, 22 bp, Homo sapiens
caggggtctccctggctccctc

SEQ ID NO: 3310744 - DNA, 13 bp, Homo sapiens
caggggtgccccc

SEQ ID NO: 3310745 - DNA, 15 bp, Homo sapiens
caggggtgccccctc

SEQ ID NO: 3310746 - DNA, 18 bp, Homo sapiens
caggggtggagtttctga

SEQ ID NO: 3310747 - DNA, 12 bp, Homo sapiens
caggggtggggg

SEQ ID NO: 3310748 - DNA, 13 bp, Homo sapiens
caggggttcgaga

SEQ ID NO: 3310749 - DNA, 13 bp, Homo sapiens
caggggttgcagt

SEQ ID NO: 3310750 - DNA, 13 bp, Homo sapiens
caggggtttctcg

SEQ ID NO: 3310751 - DNA, 21 bp, Homo sapiens
cagggtaactgtgctgaatgc

SEQ ID NO: 3310752 - DNA, 23 bp, Homo sapiens
cagggtacccgcctgagctcctg

SEQ ID NO: 3310753 - DNA, 19 bp, Homo sapiens
cagggtaccctttggggag

SEQ ID NO: 3310754 - DNA, 22 bp, Homo sapiens
cagggtaccctttggggagcag

SEQ ID NO: 3310755 - DNA, 17 bp, Homo sapiens
cagggtcagtggaagcc

SEQ ID NO: 3310756 - DNA, 15 bp, Homo sapiens
cagggtccctctgtg

SEQ ID NO: 3310757 - DNA, 16 bp, Homo sapiens
cagggtccctctgtgt

SEQ ID NO: 3310758 - DNA, 21 bp, Homo sapiens
cagggtccgcaccagctgctc

SEQ ID NO: 3310759 - DNA, 20 bp, Homo sapiens
cagggtcctcttctgggcct

SEQ ID NO: 3310760 - DNA, 21 bp, Homo sapiens
cagggtccttttgacactgct

SEQ ID NO: 3310761 - DNA, 21 bp, Homo sapiens
cagggtctcactatgttgccc

SEQ ID NO: 3310762 - DNA, 15 bp, Homo sapiens
cagggtctcactctg

SEQ ID NO: 3310763 - DNA, 16 bp, Homo sapiens
cagggtctcactctgt

SEQ ID NO: 3310764 - DNA, 16 bp, Homo sapiens
cagggtctctccctca

SEQ ID NO: 3310765 - DNA, 16 bp, Homo sapiens
cagggtctcttccttc

SEQ ID NO: 3310766 - DNA, 22 bp, Homo sapiens
cagggtctcttccttcggtctt

SEQ ID NO: 3310767 - DNA, 20 bp, Homo sapiens
cagggtctgctctttctctg

SEQ ID NO: 3310768 - DNA, 22 bp, Homo sapiens
cagggtctgctctttctctgcc

SEQ ID NO: 3310769 - DNA, 15 bp, Homo sapiens
cagggtctgtgtgaa

SEQ ID NO: 3310770 - DNA, 21 bp, Homo sapiens
cagggtcttccctacctcagg

SEQ ID NO: 3310771 - DNA, 13 bp, Homo sapiens
cagtcttcctgac

SEQ ID NO: 3310772 - DNA, 12 bp, Homo sapiens
cagtcttccttg

SEQ ID NO: 3310773 - DNA, 16 bp, Homo sapiens
cagtcttgcctaggcc

SEQ ID NO: 3310774 - DNA, 18 bp, Homo sapiens
cagtcttgcctaggccaa

SEQ ID NO: 3310775 - DNA, 13 bp, Homo sapiens
cagtcttgtgctt

SEQ ID NO: 3310776 - DNA, 21 bp, Homo sapiens
cagtctttttctgttgtaact

SEQ ID NO: 3310777 - DNA, 18 bp, Homo sapiens
cagtgaaacacttgcttg

SEQ ID NO: 3310778 - DNA, 16 bp, Homo sapiens
cagtgaaatgtgaagg

SEQ ID NO: 3310779 - DNA, 23 bp, Homo sapiens
cagtgaacttacacttggagccc

SEQ ID NO: 3310780 - DNA, 17 bp, Homo sapiens
cagtgaagatgtttact

SEQ ID NO: 3310781 - DNA, 12 bp, Homo sapiens
cagtgaattctt

SEQ ID NO: 3310782 - DNA, 14 bp, Homo sapiens
cagtgaattgtctt

SEQ ID NO: 3310783 - DNA, 21 bp, Homo sapiens
cagtgacacaatctcggctca

SEQ ID NO: 3310784 - DNA, 16 bp, Homo sapiens
cagtgacacttcagag

SEQ ID NO: 3310785 - DNA, 23 bp, Homo sapiens
cagtgacacttcagagagctggt

SEQ ID NO: 3310786 - DNA, 16 bp, Homo sapiens
cagtgacagacaggct

SEQ ID NO: 3310787 - DNA, 16 bp, Homo sapiens
cagtgacagagttcac

SEQ ID NO: 3310788 - DNA, 20 bp, Homo sapiens
cagtgacatcaaagcctggc

SEQ ID NO: 3310789 - DNA, 21 bp, Homo sapiens
cagtgacatcaaagcctggcc

SEQ ID NO: 3310790 - DNA, 22 bp, Homo sapiens
cagtgacatcaaagcctggcct

SEQ ID NO: 3310791 - DNA, 13 bp, Homo sapiens
cagtgaccccaga

SEQ ID NO: 3310792 - DNA, 14 bp, Homo sapiens
cagtgaccccagaa

SEQ ID NO: 3310793 - DNA, 24 bp, Homo sapiens
cagtgacccttcccaatcagcact

SEQ ID NO: 3310794 - DNA, 19 bp, Homo sapiens
cagtgacctgctgggtaaa

SEQ ID NO: 3310795 - DNA, 13 bp, Homo sapiens
cagtgaccttttc

SEQ ID NO: 3310796 - DNA, 18 bp, Homo sapiens
cagtgacgtgcacctgta

SEQ ID NO: 3310797 - DNA, 14 bp, Homo sapiens
cagtgactcctgct

SEQ ID NO: 3310798 - DNA, 16 bp, Homo sapiens
cagtgactcctgctgg

SEQ ID NO: 3310799 - DNA, 22 bp, Homo sapiens
cagtgactcctgctggtacctg

SEQ ID NO: 3310800 - DNA, 18 bp, Homo sapiens
cagtgactgaaaccattt

SEQ ID NO: 3310801 - DNA, 12 bp, Homo sapiens
cagtgactggca

SEQ ID NO: 3310802 - DNA, 13 bp, Homo sapiens
cagtgactggcag

SEQ ID NO: 3310803 - DNA, 14 bp, Homo sapiens
cagtgactggcagg

SEQ ID NO: 3310804 - DNA, 22 bp, Homo sapiens
cagtgacttggccccagacgca

SEQ ID NO: 3310805 - DNA, 14 bp, Homo sapiens
cagtgactttgtat

SEQ ID NO: 3310806 - DNA, 15 bp, Homo sapiens
cagtgactttgtata

SEQ ID NO: 3310807 - DNA, 19 bp, Homo sapiens
cagtgactttttctgagct

SEQ ID NO: 3310808 - DNA, 14 bp, Homo sapiens
cagtgagaaaaagc

SEQ ID NO: 3310809 - DNA, 16 bp, Homo sapiens
cagtgagacagtctgg

SEQ ID NO: 3310810 - DNA, 12 bp, Homo sapiens
cagtgagccgag

SEQ ID NO: 3310811 - DNA, 15 bp, Homo sapiens
cagtgaggagggtgg

SEQ ID NO: 3310812 - DNA, 19 bp, Homo sapiens
cagtgagtcgaggacaggg

SEQ ID NO: 3310813 - DNA, 20 bp, Homo sapiens
cagtgagtcgaggacaggga

SEQ ID NO: 3310814 - DNA, 23 bp, Homo sapiens
cagtgagtcgaggacagggaggt

SEQ ID NO: 3310815 - DNA, 18 bp, Homo sapiens
cagtgagtctctggggca

SEQ ID NO: 3310816 - DNA, 15 bp, Homo sapiens
cagtgagtctcttca

SEQ ID NO: 3310817 - DNA, 18 bp, Homo sapiens
cagtgagtctcttcagaa

SEQ ID NO: 3310818 - DNA, 20 bp, Homo sapiens
cagtgagtgtaaataatttt

SEQ ID NO: 3310819 - DNA, 21 bp, Homo sapiens
cagtgatatggcagaagacac

SEQ ID NO: 3310820 - DNA, 22 bp, Homo sapiens
cagtgatctatgtttgtgtgat

SEQ ID NO: 3310821 - DNA, 22 bp, Homo sapiens
cagtgatttttttcttgtaatt

SEQ ID NO: 3310822 - DNA, 17 bp, Homo sapiens
cagtgcaaattgtatct

SEQ ID NO: 3310823 - DNA, 17 bp, Homo sapiens
cagtgcaacagcactgg

SEQ ID NO: 3310824 - DNA, 22 bp, Homo sapiens
cagtgcaatggtataaatttca

SEQ ID NO: 3310825 - DNA, 14 bp, Homo sapiens
cagtgcagaaatga

SEQ ID NO: 3310826 - DNA, 13 bp, Homo sapiens
cagtgcagcaata

SEQ ID NO: 3310827 - DNA, 21 bp, Homo sapiens
cagtgcatagttgtagacaaa

SEQ ID NO: 3310828 - DNA, 14 bp, Homo sapiens
cagtgcatcattac

SEQ ID NO: 3310829 - DNA, 21 bp, Homo sapiens
cagtgcatcattactgttcca

SEQ ID NO: 3310830 - DNA, 15 bp, Homo sapiens
cagtgcatctcagcc

SEQ ID NO: 3310831 - DNA, 18 bp, Homo sapiens
cagtgcatgtgaagcatg

SEQ ID NO: 3310832 - DNA, 20 bp, Homo sapiens
cagtgcatgtgaagcatgct

SEQ ID NO: 3310833 - DNA, 17 bp, Homo sapiens
cagtgccaactcctcac

SEQ ID NO: 3310834 - DNA, 13 bp, Homo sapiens
cagtgccaaggac

SEQ ID NO: 3310835 - DNA, 19 bp, Homo sapiens
cagtgccacatactgcgga

SEQ ID NO: 3310836 - DNA, 21 bp, Homo sapiens
cagtgccagcaatgacatctc

SEQ ID NO: 3310837 - DNA, 20 bp, Homo sapiens
cagtgccatgtaaatcccca

SEQ ID NO: 3310838 - DNA, 17 bp, Homo sapiens
cagtgccattgtcttta

SEQ ID NO: 3310839 - DNA, 17 bp, Homo sapiens
cagtgcccatgtgtaca

SEQ ID NO: 3310840 - DNA, 17 bp, Homo sapiens
cagtgccctcattttat

SEQ ID NO: 3310841 - DNA, 17 bp, Homo sapiens
cagtgcctcgaggcacc

SEQ ID NO: 3310842 - DNA, 21 bp, Homo sapiens
cagtgcctggatcccctctgt

SEQ ID NO: 3310843 - DNA, 13 bp, Homo sapiens
cagtgccttcaac

SEQ ID NO: 3310844 - DNA, 22 bp, Homo sapiens
cagtgccttcaacaacgtgaga

SEQ ID NO: 3310845 - DNA, 13 bp, Homo sapiens
cagtgccttctct

SEQ ID NO: 3310846 - DNA, 21 bp, Homo sapiens
cagtgctagtgagctgggcat

SEQ ID NO: 3310847 - DNA, 14 bp, Homo sapiens
cagtgctcttttct

SEQ ID NO: 3310848 - DNA, 13 bp, Homo sapiens
cagtgctgccatg

SEQ ID NO: 3310849 - DNA, 15 bp, Homo sapiens
cagtgctgccatgcc

SEQ ID NO: 3310850 - DNA, 17 bp, Homo sapiens
cagtgctgccatgccac

SEQ ID NO: 3310851 - DNA, 18 bp, Homo sapiens
cagtgctgccatgccact

SEQ ID NO: 3310852 - DNA, 21 bp, Homo sapiens
cagtgctgccatgccactgcc

SEQ ID NO: 3310853 - DNA, 16 bp, Homo sapiens
cagtgctgctgtaaat

SEQ ID NO: 3310854 - DNA, 19 bp, Homo sapiens
cagtgctgtccatgcttct

SEQ ID NO: 3310855 - DNA, 22 bp, Homo sapiens
cagtgctgtccatgcttctcat

SEQ ID NO: 3310856 - DNA, 15 bp, Homo sapiens
cagtgctgtggcctg

SEQ ID NO: 3310857 - DNA, 12 bp, Homo sapiens
cagtgctgtgtg

SEQ ID NO: 3310858 - DNA, 14 bp, Homo sapiens
cagtgctgttggtg

SEQ ID NO: 3310859 - DNA, 17 bp, Homo sapiens
cagtgcttcagcctgag

SEQ ID NO: 3310860 - DNA, 18 bp, Homo sapiens
cagtgcttcagcctgagg

SEQ ID NO: 3310861 - DNA, 13 bp, Homo sapiens
cagtggaagaaac

SEQ ID NO: 3310862 - DNA, 23 bp, Homo sapiens
cagtggaatataaggaaagcaat

SEQ ID NO: 3310863 - DNA, 15 bp, Homo sapiens
cagtggaattgtaca

SEQ ID NO: 3310864 - DNA, 20 bp, Homo sapiens
cagtggactcagcagtgacc

SEQ ID NO: 3310865 - DNA, 15 bp, Homo sapiens
cagtggaggaagagg

SEQ ID NO: 3310866 - DNA, 13 bp, Homo sapiens
cagtggatcttca

SEQ ID NO: 3310867 - DNA, 17 bp, Homo sapiens
cagtggattgtttatac

SEQ ID NO: 3310868 - DNA, 12 bp, Homo sapiens
cagtggcagaga

SEQ ID NO: 3310869 - DNA, 14 bp, Homo sapiens
cagtggcagagaat

SEQ ID NO: 3310870 - DNA, 15 bp, Homo sapiens
cagtggcagctgctt

SEQ ID NO: 3310871 - DNA, 18 bp, Homo sapiens
cagtggcagggctcagga

SEQ ID NO: 3310872 - DNA, 15 bp, Homo sapiens
cagtggcaggggagc

SEQ ID NO: 3310873 - DNA, 14 bp, Homo sapiens
cagtggctcataaa

SEQ ID NO: 3310874 - DNA, 16 bp, Homo sapiens
cagtggctcataaaaa

SEQ ID NO: 3310875 - DNA, 17 bp, Homo sapiens
cagtggctgggtgggcc

SEQ ID NO: 3310876 - DNA, 22 bp, Homo sapiens
cagtggctgggtgggcccagaa

SEQ ID NO: 3310877 - DNA, 20 bp, Homo sapiens
cagtggctggtccagggcta

SEQ ID NO: 3310878 - DNA, 21 bp, Homo sapiens
cagtggcttcccagctctgac

SEQ ID NO: 3310879 - DNA, 16 bp, Homo sapiens
cagtgggacagggcat

SEQ ID NO: 3310880 - DNA, 19 bp, Homo sapiens
cagtgggacagggcatggc

SEQ ID NO: 3310881 - DNA, 13 bp, Homo sapiens
cagtgggagccct

SEQ ID NO: 3310882 - DNA, 15 bp, Homo sapiens
cagtgggagctgcct

SEQ ID NO: 3310883 - DNA, 17 bp, Homo sapiens
cagtgggagctgcctgt

SEQ ID NO: 3310884 - DNA, 18 bp, Homo sapiens
cagtgggagctgcctgtt

SEQ ID NO: 3310885 - DNA, 11 bp, Homo sapiens
cagtgggaggg

SEQ ID NO: 3310886 - DNA, 19 bp, Homo sapiens
cagtgggaggggcaggctg

SEQ ID NO: 3310887 - DNA, 21 bp, Homo sapiens
cagtgggaggggcaggctgac

SEQ ID NO: 3310888 - DNA, 18 bp, Homo sapiens
cagtgggcatcagcagca

SEQ ID NO: 3310889 - DNA, 15 bp, Homo sapiens
cagtgggtggcacct

SEQ ID NO: 3310890 - DNA, 16 bp, Homo sapiens
cagtgggtggcacctc

SEQ ID NO: 3310891 - DNA, 19 bp, Homo sapiens
cagtgggtggcacctcctg

SEQ ID NO: 3310892 - DNA, 15 bp, Homo sapiens
cagtggttgcctggg

SEQ ID NO: 3310893 - DNA, 19 bp, Homo sapiens
cagtgtaatccaggggtgt

SEQ ID NO: 3310894 - DNA, 17 bp, Homo sapiens
cagtgtacaaaactgta

SEQ ID NO: 3310895 - DNA, 17 bp, Homo sapiens
cagtgtacacgtctgga

SEQ ID NO: 3310896 - DNA, 20 bp, Homo sapiens
cagtgtacatagtgtaatgt

SEQ ID NO: 3310897 - DNA, 23 bp, Homo sapiens
catagacatggatgcgaggacca

SEQ ID NO: 3310898 - DNA, 20 bp, Homo sapiens
catagactgaggtataaaga

SEQ ID NO: 3310899 - DNA, 13 bp, Homo sapiens
catagagccctgg

SEQ ID NO: 3310900 - DNA, 15 bp, Homo sapiens
catagagccctggcc

SEQ ID NO: 3310901 - DNA, 22 bp, Homo sapiens
catagagccctggccagccctt

SEQ ID NO: 3310902 - DNA, 21 bp, Homo sapiens
catagaggcttctccgccagc

SEQ ID NO: 3310903 - DNA, 22 bp, Homo sapiens
catagataatattgtttggtaa

SEQ ID NO: 3310904 - DNA, 23 bp, Homo sapiens
catagataatattgtttggtaaa

SEQ ID NO: 3310905 - DNA, 20 bp, Homo sapiens
catagatatctatattttta

SEQ ID NO: 3310906 - DNA, 14 bp, Homo sapiens
catagatattttca

SEQ ID NO: 3310907 - DNA, 23 bp, Homo sapiens
catagatcagcaaaccggggcct

SEQ ID NO: 3310908 - DNA, 16 bp, Homo sapiens
catagatgttttggta

SEQ ID NO: 3310909 - DNA, 18 bp, Homo sapiens
catagatgttttggtaga

SEQ ID NO: 3310910 - DNA, 16 bp, Homo sapiens
catagattaatggcac

SEQ ID NO: 3310911 - DNA, 19 bp, Homo sapiens
catagattaatggcactga

SEQ ID NO: 3310912 - DNA, 16 bp, Homo sapiens
catagatttatttttc

SEQ ID NO: 3310913 - DNA, 22 bp, Homo sapiens
catagatttatttttcagttcc

SEQ ID NO: 3310914 - DNA, 21 bp, Homo sapiens
catagatttcttctctttagt

SEQ ID NO: 3310915 - DNA, 22 bp, Homo sapiens
catagcagagaatgaaagggcc

SEQ ID NO: 3310916 - DNA, 23 bp, Homo sapiens
catagcagaggggccaggcccag

SEQ ID NO: 3310917 - DNA, 16 bp, Homo sapiens
catagcagattttaat

SEQ ID NO: 3310918 - DNA, 19 bp, Homo sapiens
catagcaggggcaccttcc

SEQ ID NO: 3310919 - DNA, 15 bp, Homo sapiens
catagcattaactaa

SEQ ID NO: 3310920 - DNA, 15 bp, Homo sapiens
catagcccagtagac

SEQ ID NO: 3310921 - DNA, 19 bp, Homo sapiens
catagccccggccccccgc

SEQ ID NO: 3310922 - DNA, 18 bp, Homo sapiens
catagcctaatccctggg

SEQ ID NO: 3310923 - DNA, 19 bp, Homo sapiens
catagcctaatccctgggc

SEQ ID NO: 3310924 - DNA, 19 bp, Homo sapiens
catagcctccacggagagc

SEQ ID NO: 3310925 - DNA, 23 bp, Homo sapiens
catagcggactcctcctttctcc

SEQ ID NO: 3310926 - DNA, 16 bp, Homo sapiens
catagctgtacttctt

SEQ ID NO: 3310927 - DNA, 18 bp, Homo sapiens
catagcttattattgaag

SEQ ID NO: 3310928 - DNA, 24 bp, Homo sapiens
cataggaagggaccaaggcaaggc

SEQ ID NO: 3310929 - DNA, 20 bp, Homo sapiens
cataggacatactgcatgta

SEQ ID NO: 3310930 - DNA, 21 bp, Homo sapiens
cataggtcactggctctccaa

SEQ ID NO: 3310931 - DNA, 22 bp, Homo sapiens
cataggttaaaaaaaaaagtca

SEQ ID NO: 3310932 - DNA, 22 bp, Homo sapiens
catagtaacttcttatggaatt

SEQ ID NO: 3310933 - DNA, 24 bp, Homo sapiens
catagtaacttcttatggaattga

SEQ ID NO: 3310934 - DNA, 20 bp, Homo sapiens
catagtaagaccccatctct

SEQ ID NO: 3310935 - DNA, 16 bp, Homo sapiens
catagtaccaatcatt

SEQ ID NO: 3310936 - DNA, 22 bp, Homo sapiens
catagtaccaatcattttaatt

SEQ ID NO: 3310937 - DNA, 22 bp, Homo sapiens
catagtaccatttatacaaatt

SEQ ID NO: 3310938 - DNA, 20 bp, Homo sapiens
catagtagtatgatgataca

SEQ ID NO: 3310939 - DNA, 13 bp, Homo sapiens
catagtagttttt

SEQ ID NO: 3310940 - DNA, 20 bp, Homo sapiens
catagtatggtggctgggtt

SEQ ID NO: 3310941 - DNA, 13 bp, Homo sapiens
catagtcacatgg

SEQ ID NO: 3310942 - DNA, 21 bp, Homo sapiens
catagtcagcagcagctctga

SEQ ID NO: 3310943 - DNA, 22 bp, Homo sapiens
catagtgatggttcccctgttc

SEQ ID NO: 3310944 - DNA, 18 bp, Homo sapiens
catagtggggcctgggag

SEQ ID NO: 3310945 - DNA, 20 bp, Homo sapiens
catagttggtaatgcttgga

SEQ ID NO: 3310946 - DNA, 20 bp, Homo sapiens
catagtttacaatattatgt

SEQ ID NO: 3310947 - DNA, 21 bp, Homo sapiens
catagtttgggtatttttggt

SEQ ID NO: 3310948 - DNA, 13 bp, Homo sapiens
catagtttttcct

SEQ ID NO: 3310949 - DNA, 19 bp, Homo sapiens
catataaacatcacacaca

SEQ ID NO: 3310950 - DNA, 14 bp, Homo sapiens
catataaccaaaat

SEQ ID NO: 3310951 - DNA, 23 bp, Homo sapiens
catataagattcatatttacttc

SEQ ID NO: 3310952 - DNA, 21 bp, Homo sapiens
catataagtttgaaggaaaca

SEQ ID NO: 3310953 - DNA, 24 bp, Homo sapiens
catataagtttgaaggaaacagtt

SEQ ID NO: 3310954 - DNA, 17 bp, Homo sapiens
catataatgttgttatt

SEQ ID NO: 3310955 - DNA, 18 bp, Homo sapiens
catatacctataatgtgt

SEQ ID NO: 3310956 - DNA, 16 bp, Homo sapiens
catatagacacataca

SEQ ID NO: 3310957 - DNA, 22 bp, Homo sapiens
catatagcattgataatcttca

SEQ ID NO: 3310958 - DNA, 15 bp, Homo sapiens
catatagtcaatgta

SEQ ID NO: 3310959 - DNA, 21 bp, Homo sapiens
catatcaattggcagtgactt

SEQ ID NO: 3310960 - DNA, 13 bp, Homo sapiens
catatcagttgag

SEQ ID NO: 3310961 - DNA, 23 bp, Homo sapiens
catatcatcaatgtgacatttac

SEQ ID NO: 3310962 - DNA, 14 bp, Homo sapiens
catatcctgagcca

SEQ ID NO: 3310963 - DNA, 23 bp, Homo sapiens
catatcctgagccatcggtgaaa

SEQ ID NO: 3310964 - DNA, 18 bp, Homo sapiens
catatcgctgacttcatg

SEQ ID NO: 3310965 - DNA, 13 bp, Homo sapiens
catatctctaatt

SEQ ID NO: 3310966 - DNA, 18 bp, Homo sapiens
catatcttaaagaaacag

SEQ ID NO: 3310967 - DNA, 15 bp, Homo sapiens
catatcttgccttca

SEQ ID NO: 3310968 - DNA, 20 bp, Homo sapiens
catatcttgcgaatccaagc

SEQ ID NO: 3310969 - DNA, 22 bp, Homo sapiens
catatcttgcgaatccaagctc

SEQ ID NO: 3310970 - DNA, 15 bp, Homo sapiens
catatctttattaat

SEQ ID NO: 3310971 - DNA, 16 bp, Homo sapiens
catatgaattgtacag

SEQ ID NO: 3310972 - DNA, 22 bp, Homo sapiens
catatgaccattgagtccctgc

SEQ ID NO: 3310973 - DNA, 22 bp, Homo sapiens
catatgagccgtgaactgtgca

SEQ ID NO: 3310974 - DNA, 20 bp, Homo sapiens
catatgcaccttgtgtctgt

SEQ ID NO: 3310975 - DNA, 23 bp, Homo sapiens
catatgcaccttgtgtctgtaca

SEQ ID NO: 3310976 - DNA, 20 bp, Homo sapiens
catatgcagaaatagacaaa

SEQ ID NO: 3310977 - DNA, 22 bp, Homo sapiens
catatgccttggggaggacaaa

SEQ ID NO: 3310978 - DNA, 16 bp, Homo sapiens
catatgctgacagctc

SEQ ID NO: 3310979 - DNA, 15 bp, Homo sapiens
catatggaggcctga

SEQ ID NO: 3310980 - DNA, 15 bp, Homo sapiens
catatggcccagtgt

SEQ ID NO: 3310981 - DNA, 16 bp, Homo sapiens
catatggcccagtgtc

SEQ ID NO: 3310982 - DNA, 20 bp, Homo sapiens
catatgggatattcccaagc

SEQ ID NO: 3310983 - DNA, 21 bp, Homo sapiens
catatgtaccatgtacatgaa

SEQ ID NO: 3310984 - DNA, 18 bp, Homo sapiens
catatgtagaaacattta

SEQ ID NO: 3310985 - DNA, 19 bp, Homo sapiens
catatgtagaaacatttag

SEQ ID NO: 3310986 - DNA, 17 bp, Homo sapiens
catatgtagactatata

SEQ ID NO: 3310987 - DNA, 18 bp, Homo sapiens
catatgttgaatactttt

SEQ ID NO: 3310988 - DNA, 19 bp, Homo sapiens
catatgttgaatacttttt

SEQ ID NO: 3310989 - DNA, 20 bp, Homo sapiens
catattaaaattacagatgt

SEQ ID NO: 3310990 - DNA, 23 bp, Homo sapiens
catattaaaattacagatgtgaa

SEQ ID NO: 3310991 - DNA, 15 bp, Homo sapiens
catattaagacagtg

SEQ ID NO: 3310992 - DNA, 22 bp, Homo sapiens
catattaagacagtgtacaaaa

SEQ ID NO: 3310993 - DNA, 23 bp, Homo sapiens
catattaagacagtgtacaaaac

SEQ ID NO: 3310994 - DNA, 23 bp, Homo sapiens
catattcatgtaaacaaaattta

SEQ ID NO: 3310995 - DNA, 17 bp, Homo sapiens
catattccatatttatt

SEQ ID NO: 3310996 - DNA, 17 bp, Homo sapiens
catattctaaaaccatt

SEQ ID NO: 3310997 - DNA, 13 bp, Homo sapiens
catattctattgt

SEQ ID NO: 3310998 - DNA, 18 bp, Homo sapiens
catattctgttggccagt

SEQ ID NO: 3310999 - DNA, 15 bp, Homo sapiens
catattcttgtgctt

SEQ ID NO: 3311000 - DNA, 13 bp, Homo sapiens
catattgatgaaa

SEQ ID NO: 3311001 - DNA, 20 bp, Homo sapiens
catattgcaggagacatttt

SEQ ID NO: 3311002 - DNA, 22 bp, Homo sapiens
catattgcaggagacattttca

SEQ ID NO: 3311003 - DNA, 16 bp, Homo sapiens
catattgctgagagaa

SEQ ID NO: 3311004 - DNA, 21 bp, Homo sapiens
catattgctgagagaaatatg

SEQ ID NO: 3311005 - DNA, 13 bp, Homo sapiens
catattgtaaaac

SEQ ID NO: 3311006 - DNA, 20 bp, Homo sapiens
catattgtgccaatatgtat

SEQ ID NO: 3311007 - DNA, 22 bp, Homo sapiens
catattgtgccaatatgtattg

SEQ ID NO: 3311008 - DNA, 23 bp, Homo sapiens
catattgtgcttcacagtagagc

SEQ ID NO: 3311009 - DNA, 19 bp, Homo sapiens
catattgttagggtcagcc

SEQ ID NO: 3311010 - DNA, 21 bp, Homo sapiens
catattgttagggtcagccat

SEQ ID NO: 3311011 - DNA, 23 bp, Homo sapiens
catattgttagggtcagccattt

SEQ ID NO: 3311012 - DNA, 19 bp, Homo sapiens
catattgttgcattgcttt

SEQ ID NO: 3311013 - DNA, 15 bp, Homo sapiens
catattgtttgatct

SEQ ID NO: 3311014 - DNA, 13 bp, Homo sapiens
catatttactctt

SEQ ID NO: 3311015 - DNA, 12 bp, Homo sapiens
catatttatcca

SEQ ID NO: 3311016 - DNA, 21 bp, Homo sapiens
catatttatccaaaatgtgta

SEQ ID NO: 3311017 - DNA, 22 bp, Homo sapiens
catatttatccaaaatgtgtat

SEQ ID NO: 3311018 - DNA, 20 bp, Homo sapiens
catatttattgcattgctgg

SEQ ID NO: 3311019 - DNA, 12 bp, Homo sapiens
catatttgaaaa

SEQ ID NO: 3311020 - DNA, 13 bp, Homo sapiens
catccctgtgagg

SEQ ID NO: 3311021 - DNA, 13 bp, Homo sapiens
catccctttccag

SEQ ID NO: 3311022 - DNA, 17 bp, Homo sapiens
catccctttcccttggt

SEQ ID NO: 3311023 - DNA, 16 bp, Homo sapiens
catccctttctcccag

SEQ ID NO: 3311024 - DNA, 14 bp, Homo sapiens
catcccttttcctg

SEQ ID NO: 3311025 - DNA, 16 bp, Homo sapiens
catcccttttcctgtc

SEQ ID NO: 3311026 - DNA, 16 bp, Homo sapiens
catccctttttttaca

SEQ ID NO: 3311027 - DNA, 14 bp, Homo sapiens
catccgactgcccc

SEQ ID NO: 3311028 - DNA, 16 bp, Homo sapiens
catccgactgcccctg

SEQ ID NO: 3311029 - DNA, 20 bp, Homo sapiens
catccgactgcccctgctgt

SEQ ID NO: 3311030 - DNA, 14 bp, Homo sapiens
catccgcaggtgct

SEQ ID NO: 3311031 - DNA, 18 bp, Homo sapiens
catccgtcattgctgctg

SEQ ID NO: 3311032 - DNA, 13 bp, Homo sapiens
catcctaccctcg

SEQ ID NO: 3311033 - DNA, 15 bp, Homo sapiens
catcctaccctcggg

SEQ ID NO: 3311034 - DNA, 19 bp, Homo sapiens
catcctaccctcgggccca

SEQ ID NO: 3311035 - DNA, 23 bp, Homo sapiens
catcctaccctcgggcccacctg

SEQ ID NO: 3311036 - DNA, 11 bp, Homo sapiens
catcctataag

SEQ ID NO: 3311037 - DNA, 14 bp, Homo sapiens
catcctcaaagaaa

SEQ ID NO: 3311038 - DNA, 16 bp, Homo sapiens
catcctcatccctgac

SEQ ID NO: 3311039 - DNA, 17 bp, Homo sapiens
catcctcattgcctcct

SEQ ID NO: 3311040 - DNA, 20 bp, Homo sapiens
catcctcattgcctcctgtt

SEQ ID NO: 3311041 - DNA, 21 bp, Homo sapiens
catcctcattgcctcctgttc

SEQ ID NO: 3311042 - DNA, 12 bp, Homo sapiens
catcctccacat

SEQ ID NO: 3311043 - DNA, 18 bp, Homo sapiens
catcctccacatcctgtg

SEQ ID NO: 3311044 - DNA, 21 bp, Homo sapiens
catcctccacatcctgtgtca

SEQ ID NO: 3311045 - DNA, 14 bp, Homo sapiens
catcctccagcttc

SEQ ID NO: 3311046 - DNA, 13 bp, Homo sapiens
catcctcccaagg

SEQ ID NO: 3311047 - DNA, 19 bp, Homo sapiens
catcctccgtccagccgcc

SEQ ID NO: 3311048 - DNA, 20 bp, Homo sapiens
catcctccgtccagccgcca

SEQ ID NO: 3311049 - DNA, 16 bp, Homo sapiens
catcctcctcagcccc

SEQ ID NO: 3311050 - DNA, 17 bp, Homo sapiens
catcctcctcagccccc

SEQ ID NO: 3311051 - DNA, 18 bp, Homo sapiens
catcctcctcagccccca

SEQ ID NO: 3311052 - DNA, 21 bp, Homo sapiens
catcctcctcagcccccaggc

SEQ ID NO: 3311053 - DNA, 16 bp, Homo sapiens
catcctcctcccaccc

SEQ ID NO: 3311054 - DNA, 20 bp, Homo sapiens
catcctcctcccacccggct

SEQ ID NO: 3311055 - DNA, 16 bp, Homo sapiens
catcctcctggaacct

SEQ ID NO: 3311056 - DNA, 12 bp, Homo sapiens
catcctgcagcc

SEQ ID NO: 3311057 - DNA, 20 bp, Homo sapiens
catcctgcagcctcctcctg

SEQ ID NO: 3311058 - DNA, 17 bp, Homo sapiens
catcctgccagccccac

SEQ ID NO: 3311059 - DNA, 15 bp, Homo sapiens
catcctgcctgggtg

SEQ ID NO: 3311060 - DNA, 10 bp, Homo sapiens
catcctggat

SEQ ID NO: 3311061 - DNA, 23 bp, Homo sapiens
catcctggcacccggcccctgct

SEQ ID NO: 3311062 - DNA, 15 bp, Homo sapiens
catcctggcacgccc

SEQ ID NO: 3311063 - DNA, 17 bp, Homo sapiens
catcctggcacgcccta

SEQ ID NO: 3311064 - DNA, 12 bp, Homo sapiens
catcctggctgc

SEQ ID NO: 3311065 - DNA, 15 bp, Homo sapiens
catcctggggcagca

SEQ ID NO: 3311066 - DNA, 17 bp, Homo sapiens
catcctggggcagcact

SEQ ID NO: 3311067 - DNA, 19 bp, Homo sapiens
catcctgtataagcactga

SEQ ID NO: 3311068 - DNA, 23 bp, Homo sapiens
catcctgtgccactaaactacat

SEQ ID NO: 3311069 - DNA, 23 bp, Homo sapiens
catcctgtgtcagaaaccctggt

SEQ ID NO: 3311070 - DNA, 14 bp, Homo sapiens
catcctgttttctc

SEQ ID NO: 3311071 - DNA, 15 bp, Homo sapiens
catccttccccaact

SEQ ID NO: 3311072 - DNA, 19 bp, Homo sapiens
catccttggtctttgtatc

SEQ ID NO: 3311073 - DNA, 21 bp, Homo sapiens
catccttggtctttgtatctt

SEQ ID NO: 3311074 - DNA, 15 bp, Homo sapiens
catcctttacgtgtt

SEQ ID NO: 3311075 - DNA, 19 bp, Homo sapiens
catcctttacgtgtttaaa

SEQ ID NO: 3311076 - DNA, 19 bp, Homo sapiens
catccttttctgcagaggg

SEQ ID NO: 3311077 - DNA, 21 bp, Homo sapiens
catcgaatctactaattccac

SEQ ID NO: 3311078 - DNA, 16 bp, Homo sapiens
catcgcaccattctga

SEQ ID NO: 3311079 - DNA, 16 bp, Homo sapiens
catcgccaaggactga

SEQ ID NO: 3311080 - DNA, 19 bp, Homo sapiens
catcggacaagacccccag

SEQ ID NO: 3311081 - DNA, 21 bp, Homo sapiens
catcggacaagacccccagca

SEQ ID NO: 3311082 - DNA, 20 bp, Homo sapiens
catcggaggctgggcccctg

SEQ ID NO: 3311083 - DNA, 22 bp, Homo sapiens
catcggaggctgggcccctggg

SEQ ID NO: 3311084 - DNA, 23 bp, Homo sapiens
catcggaggctgggcccctggga

SEQ ID NO: 3311085 - DNA, 23 bp, Homo sapiens
catcgtcctgggactcggagact

SEQ ID NO: 3311086 - DNA, 16 bp, Homo sapiens
catcgtgacccttcag

SEQ ID NO: 3311087 - DNA, 21 bp, Homo sapiens
catcgtgacccttcagggcca

SEQ ID NO: 3311088 - DNA, 20 bp, Homo sapiens
catctaagttataagactct

SEQ ID NO: 3311089 - DNA, 18 bp, Homo sapiens
catctaatgcttgtttat

SEQ ID NO: 3311090 - DNA, 19 bp, Homo sapiens
catctaatgcttgtttatg

SEQ ID NO: 3311091 - DNA, 14 bp, Homo sapiens
catctaattctgat

SEQ ID NO: 3311092 - DNA, 13 bp, Homo sapiens
catctagccagcc

SEQ ID NO: 3311093 - DNA, 21 bp, Homo sapiens
catctagccagcccctcttcc

SEQ ID NO: 3311094 - DNA, 22 bp, Homo sapiens
catctagccagcccctcttccc

SEQ ID NO: 3311095 - DNA, 19 bp, Homo sapiens
catctatcgagtttgcaat

SEQ ID NO: 3311096 - DNA, 15 bp, Homo sapiens
catctatctcaatcc

SEQ ID NO: 3311097 - DNA, 19 bp, Homo sapiens
catctattataaaaccatg

SEQ ID NO: 3311098 - DNA, 20 bp, Homo sapiens
catctattataaaaccatgt

SEQ ID NO: 3311099 - DNA, 14 bp, Homo sapiens
catctattttggat

SEQ ID NO: 3311100 - DNA, 16 bp, Homo sapiens
catctattttggattg

SEQ ID NO: 3311101 - DNA, 19 bp, Homo sapiens
catctcaaaacagagggct

SEQ ID NO: 3311102 - DNA, 20 bp, Homo sapiens
catctcaaaacagagggctg

SEQ ID NO: 3311103 - DNA, 22 bp, Homo sapiens
catctcaaaacagagggctgca

SEQ ID NO: 3311104 - DNA, 18 bp, Homo sapiens
catctcagaccctttagc

SEQ ID NO: 3311105 - DNA, 14 bp, Homo sapiens
catctcagcctcct

SEQ ID NO: 3311106 - DNA, 16 bp, Homo sapiens
catctcagcctcctga

SEQ ID NO: 3311107 - DNA, 18 bp, Homo sapiens
catctcagcctcctgagc

SEQ ID NO: 3311108 - DNA, 21 bp, Homo sapiens
catctcagcctcctgagcctg

SEQ ID NO: 3311109 - DNA, 23 bp, Homo sapiens
catctcagcctcctgagcctgtg

SEQ ID NO: 3311110 - DNA, 23 bp, Homo sapiens
catctcaggagatggagggcttg

SEQ ID NO: 3311111 - DNA, 16 bp, Homo sapiens
catctcaggggccaga

SEQ ID NO: 3311112 - DNA, 15 bp, Homo sapiens
catctcaggtgccac

SEQ ID NO: 3311113 - DNA, 16 bp, Homo sapiens
catctcaggtgccact

SEQ ID NO: 3311114 - DNA, 20 bp, Homo sapiens
catctcagttcactgcaact

SEQ ID NO: 3311115 - DNA, 18 bp, Homo sapiens
catctccaagataagcct

SEQ ID NO: 3311116 - DNA, 22 bp, Homo sapiens
catctccagggagcaagacaga

SEQ ID NO: 3311117 - DNA, 14 bp, Homo sapiens
catctccatcagct

SEQ ID NO: 3311118 - DNA, 16 bp, Homo sapiens
catctccatcagctgt

SEQ ID NO: 3311119 - DNA, 19 bp, Homo sapiens
catctccccaggcctccag

SEQ ID NO: 3311120 - DNA, 21 bp, Homo sapiens
catctccccaggcctccagcc

SEQ ID NO: 3311121 - DNA, 17 bp, Homo sapiens
catctccctgcctggcc

SEQ ID NO: 3311122 - DNA, 13 bp, Homo sapiens
catctcccttcct

SEQ ID NO: 3311123 - DNA, 22 bp, Homo sapiens
catctcccttcctgtgggagca

SEQ ID NO: 3311124 - DNA, 23 bp, Homo sapiens
catctcctggctaagcctctgct

SEQ ID NO: 3311125 - DNA, 11 bp, Homo sapiens
catctcctgtc

SEQ ID NO: 3311126 - DNA, 13 bp, Homo sapiens
catctcctgtgca

SEQ ID NO: 3311127 - DNA, 22 bp, Homo sapiens
catctcggttctgcgccacttc

SEQ ID NO: 3311128 - DNA, 16 bp, Homo sapiens
catctctcatcctcca

SEQ ID NO: 3311129 - DNA, 12 bp, Homo sapiens
catctctcccca

SEQ ID NO: 3311130 - DNA, 12 bp, Homo sapiens
catctctccctc

SEQ ID NO: 3311131 - DNA, 20 bp, Homo sapiens
catctctctggggccctggg

SEQ ID NO: 3311132 - DNA, 21 bp, Homo sapiens
catctctctggggccctgggc

SEQ ID NO: 3311133 - DNA, 14 bp, Homo sapiens
catctcttcaggtt

SEQ ID NO: 3311134 - DNA, 21 bp, Homo sapiens
catctcttcattcaaactgca

SEQ ID NO: 3311135 - DNA, 21 bp, Homo sapiens
catctcttcctccgaggccag

SEQ ID NO: 3311136 - DNA, 19 bp, Homo sapiens
catctgaaacccacagatg

SEQ ID NO: 3311137 - DNA, 22 bp, Homo sapiens
catctgaaacccacagatgtct

SEQ ID NO: 3311138 - DNA, 15 bp, Homo sapiens
catctgaagagcaga

SEQ ID NO: 3311139 - DNA, 19 bp, Homo sapiens
catctgaatgaaaataact

SEQ ID NO: 3311140 - DNA, 22 bp, Homo sapiens
catctgaatgaaaataactgaa

SEQ ID NO: 3311141 - DNA, 23 bp, Homo sapiens
catctgaatgaaaataactgaac

SEQ ID NO: 3311142 - DNA, 16 bp, Homo sapiens
catctgacacaaaaaa

SEQ ID NO: 3311143 - DNA, 19 bp, Homo sapiens
catctgactgccaagccag

SEQ ID NO: 3311144 - DNA, 20 bp, Homo sapiens
catctgactgccaagccaga

SEQ ID NO: 3311145 - DNA, 20 bp, Homo sapiens
catggcaccagccccctgga

SEQ ID NO: 3311146 - DNA, 22 bp, Homo sapiens
catggcaccttcagactttgct

SEQ ID NO: 3311147 - DNA, 18 bp, Homo sapiens
catggcagagtttgtgtg

SEQ ID NO: 3311148 - DNA, 13 bp, Homo sapiens
catggcagctggt

SEQ ID NO: 3311149 - DNA, 13 bp, Homo sapiens
catggccaggtgg

SEQ ID NO: 3311150 - DNA, 14 bp, Homo sapiens
catggccaggtggc

SEQ ID NO: 3311151 - DNA, 15 bp, Homo sapiens
catggccaggtggcc

SEQ ID NO: 3311152 - DNA, 15 bp, Homo sapiens
catggccccaggccc

SEQ ID NO: 3311153 - DNA, 17 bp, Homo sapiens
catggcccccaataaag

SEQ ID NO: 3311154 - DNA, 18 bp, Homo sapiens
catggcccccaataaagg

SEQ ID NO: 3311155 - DNA, 22 bp, Homo sapiens
catggcccccaataaaggcagc

SEQ ID NO: 3311156 - DNA, 23 bp, Homo sapiens
catggcccccaataaaggcagct

SEQ ID NO: 3311157 - DNA, 24 bp, Homo sapiens
catggcccccaataaaggcagctg

SEQ ID NO: 3311158 - DNA, 12 bp, Homo sapiens
catggcccctct

SEQ ID NO: 3311159 - DNA, 17 bp, Homo sapiens
catggcccctctgacct

SEQ ID NO: 3311160 - DNA, 18 bp, Homo sapiens
catggcccctctgacctg

SEQ ID NO: 3311161 - DNA, 12 bp, Homo sapiens
catggccctggg

SEQ ID NO: 3311162 - DNA, 19 bp, Homo sapiens
catggcctatgcacatatg

SEQ ID NO: 3311163 - DNA, 17 bp, Homo sapiens
catggcgtaatgggcct

SEQ ID NO: 3311164 - DNA, 19 bp, Homo sapiens
catggcgtaatgggcctgc

SEQ ID NO: 3311165 - DNA, 21 bp, Homo sapiens
catggcgtaatgggcctgccc

SEQ ID NO: 3311166 - DNA, 14 bp, Homo sapiens
catggcgtgtccct

SEQ ID NO: 3311167 - DNA, 19 bp, Homo sapiens
catggcgtgtccctctcgg

SEQ ID NO: 3311168 - DNA, 16 bp, Homo sapiens
catggctaactggcga

SEQ ID NO: 3311169 - DNA, 20 bp, Homo sapiens
catggctcaggcaagcccct

SEQ ID NO: 3311170 - DNA, 21 bp, Homo sapiens
catggctctggactctaaaga

SEQ ID NO: 3311171 - DNA, 20 bp, Homo sapiens
catggctgcttgattttgta

SEQ ID NO: 3311172 - DNA, 20 bp, Homo sapiens
catggcttaatgtttattcc

SEQ ID NO: 3311173 - DNA, 21 bp, Homo sapiens
catgggaaaggaggcatgcct

SEQ ID NO: 3311174 - DNA, 22 bp, Homo sapiens
catgggaaaggaggcatgcctc

SEQ ID NO: 3311175 - DNA, 19 bp, Homo sapiens
catgggaatgatagcccag

SEQ ID NO: 3311176 - DNA, 13 bp, Homo sapiens
catgggagccagc

SEQ ID NO: 3311177 - DNA, 17 bp, Homo sapiens
catgggagccagctgct

SEQ ID NO: 3311178 - DNA, 21 bp, Homo sapiens
catgggagctggttagaaatg

SEQ ID NO: 3311179 - DNA, 22 bp, Homo sapiens
catgggagggggcttgaagcca

SEQ ID NO: 3311180 - DNA, 21 bp, Homo sapiens
catgggatacaacctccctct

SEQ ID NO: 3311181 - DNA, 16 bp, Homo sapiens
catgggccagagcctc

SEQ ID NO: 3311182 - DNA, 14 bp, Homo sapiens
catgggccagccta

SEQ ID NO: 3311183 - DNA, 16 bp, Homo sapiens
catgggccagcctagc

SEQ ID NO: 3311184 - DNA, 18 bp, Homo sapiens
catgggccagcctagccc

SEQ ID NO: 3311185 - DNA, 16 bp, Homo sapiens
catgggcctgggcctg

SEQ ID NO: 3311186 - DNA, 22 bp, Homo sapiens
catgggcctttaagaaccttaa

SEQ ID NO: 3311187 - DNA, 16 bp, Homo sapiens
catgggcgcaggccca

SEQ ID NO: 3311188 - DNA, 22 bp, Homo sapiens
catgggctagtgtgagtggcag

SEQ ID NO: 3311189 - DNA, 14 bp, Homo sapiens
catgggctgagtgg

SEQ ID NO: 3311190 - DNA, 12 bp, Homo sapiens
catgggcttcac

SEQ ID NO: 3311191 - DNA, 16 bp, Homo sapiens
catgggcttcactgta

SEQ ID NO: 3311192 - DNA, 20 bp, Homo sapiens
catgggcttcactgtataaa

SEQ ID NO: 3311193 - DNA, 23 bp, Homo sapiens
catgggcttggacttcctggggc

SEQ ID NO: 3311194 - DNA, 22 bp, Homo sapiens
catgggggcaccgggctccatg

SEQ ID NO: 3311195 - DNA, 17 bp, Homo sapiens
catgggtccaagagaca

SEQ ID NO: 3311196 - DNA, 18 bp, Homo sapiens
catgggtccaagagacat

SEQ ID NO: 3311197 - DNA, 19 bp, Homo sapiens
catgggtcccttgaaggaa

SEQ ID NO: 3311198 - DNA, 15 bp, Homo sapiens
catgggttatgtgta

SEQ ID NO: 3311199 - DNA, 15 bp, Homo sapiens
catggtccctgcctt

SEQ ID NO: 3311200 - DNA, 14 bp, Homo sapiens
catggtcctttctg

SEQ ID NO: 3311201 - DNA, 19 bp, Homo sapiens
catggtcctttctggaagt

SEQ ID NO: 3311202 - DNA, 11 bp, Homo sapiens
catggtgaaaa

SEQ ID NO: 3311203 - DNA, 19 bp, Homo sapiens
catggtgaaaatgtactga

SEQ ID NO: 3311204 - DNA, 16 bp, Homo sapiens
catggtgatcagtgca

SEQ ID NO: 3311205 - DNA, 13 bp, Homo sapiens
catggtgcctgag

SEQ ID NO: 3311206 - DNA, 16 bp, Homo sapiens
catggtgcctgagagg

SEQ ID NO: 3311207 - DNA, 19 bp, Homo sapiens
catggtgcctgagaggcag

SEQ ID NO: 3311208 - DNA, 22 bp, Homo sapiens
catggtgcctgagaggcaggca

SEQ ID NO: 3311209 - DNA, 14 bp, Homo sapiens
catggtgctagtgg

SEQ ID NO: 3311210 - DNA, 22 bp, Homo sapiens
catggtggacccagcgggcagg

SEQ ID NO: 3311211 - DNA, 14 bp, Homo sapiens
catggtgtaataag

SEQ ID NO: 3311212 - DNA, 19 bp, Homo sapiens
catggtgtaataagacata

SEQ ID NO: 3311213 - DNA, 16 bp, Homo sapiens
catggtgttttcattc

SEQ ID NO: 3311214 - DNA, 13 bp, Homo sapiens
catggttaagagt

SEQ ID NO: 3311215 - DNA, 16 bp, Homo sapiens
catggttaagagtcca

SEQ ID NO: 3311216 - DNA, 19 bp, Homo sapiens
catggttaaggtaaagtaa

SEQ ID NO: 3311217 - DNA, 16 bp, Homo sapiens
catggttccttccctg

SEQ ID NO: 3311218 - DNA, 14 bp, Homo sapiens
catggttgagaaat

SEQ ID NO: 3311219 - DNA, 22 bp, Homo sapiens
catggtttaaaagaaaaaatga

SEQ ID NO: 3311220 - DNA, 16 bp, Homo sapiens
catgtaaaagagtcat

SEQ ID NO: 3311221 - DNA, 21 bp, Homo sapiens
catgtaaacaaaatttagttt

SEQ ID NO: 3311222 - DNA, 21 bp, Homo sapiens
catgtaaataccagactgcag

SEQ ID NO: 3311223 - DNA, 23 bp, Homo sapiens
catgtaaataccagactgcaggt

SEQ ID NO: 3311224 - DNA, 16 bp, Homo sapiens
catgtaacattggtga

SEQ ID NO: 3311225 - DNA, 18 bp, Homo sapiens
catgtaaccggcatgttt

SEQ ID NO: 3311226 - DNA, 17 bp, Homo sapiens
catgtaataaattcaaa

SEQ ID NO: 3311227 - DNA, 22 bp, Homo sapiens
catgtaataaattcaaaacctg

SEQ ID NO: 3311228 - DNA, 16 bp, Homo sapiens
catgtaatccttttgt

SEQ ID NO: 3311229 - DNA, 21 bp, Homo sapiens
catgtaatggtatcttaaagt

SEQ ID NO: 3311230 - DNA, 21 bp, Homo sapiens
catgtaattaagtactatgta

SEQ ID NO: 3311231 - DNA, 23 bp, Homo sapiens
catgtacaaaatcgattggcttt

SEQ ID NO: 3311232 - DNA, 19 bp, Homo sapiens
catgtacataaactgtcac

SEQ ID NO: 3311233 - DNA, 15 bp, Homo sapiens
catgtacatgaagaa

SEQ ID NO: 3311234 - DNA, 20 bp, Homo sapiens
catgtacatgaagaagctaa

SEQ ID NO: 3311235 - DNA, 17 bp, Homo sapiens
catgtactcaagtacca

SEQ ID NO: 3311236 - DNA, 21 bp, Homo sapiens
catgtacttgtttgcaagcag

SEQ ID NO: 3311237 - DNA, 23 bp, Homo sapiens
catgtactttggcatcttttgga

SEQ ID NO: 3311238 - DNA, 19 bp, Homo sapiens
catgtagccagcagaactg

SEQ ID NO: 3311239 - DNA, 18 bp, Homo sapiens
catgtagccccctggcct

SEQ ID NO: 3311240 - DNA, 14 bp, Homo sapiens
catgtatgttatga

SEQ ID NO: 3311241 - DNA, 17 bp, Homo sapiens
catgtatgttatgatat

SEQ ID NO: 3311242 - DNA, 18 bp, Homo sapiens
catgtatgttatgatatt

SEQ ID NO: 3311243 - DNA, 22 bp, Homo sapiens
catgtatgttatgatattgttt

SEQ ID NO: 3311244 - DNA, 21 bp, Homo sapiens
catgtattgcacattgtaaaa

SEQ ID NO: 3311245 - DNA, 16 bp, Homo sapiens
catgtattttacacaa

SEQ ID NO: 3311246 - DNA, 20 bp, Homo sapiens
catgtcaccggtcagtgcct

SEQ ID NO: 3311247 - DNA, 21 bp, Homo sapiens
catgtcaccggtcagtgcctt

SEQ ID NO: 3311248 - DNA, 23 bp, Homo sapiens
catgtcatttgactgtctcactt

SEQ ID NO: 3311249 - DNA, 19 bp, Homo sapiens
catgtccaaacgtcctctt

SEQ ID NO: 3311250 - DNA, 14 bp, Homo sapiens
catgtccaaagagg

SEQ ID NO: 3311251 - DNA, 21 bp, Homo sapiens
catgtccaaagaggctgcccc

SEQ ID NO: 3311252 - DNA, 22 bp, Homo sapiens
catgtccaagttcttcacctct

SEQ ID NO: 3311253 - DNA, 20 bp, Homo sapiens
catgtccatcccttttcctg

SEQ ID NO: 3311254 - DNA, 22 bp, Homo sapiens
catgtccatcccttttcctgtc

SEQ ID NO: 3311255 - DNA, 14 bp, Homo sapiens
catgtcccacccac

SEQ ID NO: 3311256 - DNA, 17 bp, Homo sapiens
catgtcccacccacccg

SEQ ID NO: 3311257 - DNA, 18 bp, Homo sapiens
catgtcccacccacccgc

SEQ ID NO: 3311258 - DNA, 15 bp, Homo sapiens
catgtcctatgtgtg

SEQ ID NO: 3311259 - DNA, 16 bp, Homo sapiens
catgtcctatgtgtga

SEQ ID NO: 3311260 - DNA, 13 bp, Homo sapiens
catgtcctgccta

SEQ ID NO: 3311261 - DNA, 19 bp, Homo sapiens
catgtcctgctggcttcca

SEQ ID NO: 3311262 - DNA, 22 bp, Homo sapiens
catgtccttgtgtgttttgaga

SEQ ID NO: 3311263 - DNA, 21 bp, Homo sapiens
catgtcctttgcgcctgtgac

SEQ ID NO: 3311264 - DNA, 15 bp, Homo sapiens
catgtcgcacaatgt

SEQ ID NO: 3311265 - DNA, 15 bp, Homo sapiens
catgtcgcctctgca

SEQ ID NO: 3311266 - DNA, 19 bp, Homo sapiens
catgtcgcgctcagcatgc

SEQ ID NO: 3311267 - DNA, 13 bp, Homo sapiens
catgtcgcttttg

SEQ ID NO: 3311268 - DNA, 22 bp, Homo sapiens
catgtctataatcccagcactt

SEQ ID NO: 3311269 - DNA, 16 bp, Homo sapiens
catgtctattcagctt

SEQ ID NO: 3311270 - DNA, 16 bp, Homo sapiens
cattcttggcccagga

SEQ ID NO: 3311271 - DNA, 19 bp, Homo sapiens
cattcttggcttaatcatt

SEQ ID NO: 3311272 - DNA, 18 bp, Homo sapiens
cattcttgtcacaataaa

SEQ ID NO: 3311273 - DNA, 13 bp, Homo sapiens
cattctttcccag

SEQ ID NO: 3311274 - DNA, 15 bp, Homo sapiens
cattctttgcttgaa

SEQ ID NO: 3311275 - DNA, 14 bp, Homo sapiens
cattctttggtaat

SEQ ID NO: 3311276 - DNA, 17 bp, Homo sapiens
cattctttggtaatttt

SEQ ID NO: 3311277 - DNA, 16 bp, Homo sapiens
cattctttttttcttg

SEQ ID NO: 3311278 - DNA, 17 bp, Homo sapiens
cattctttttttcttgg

SEQ ID NO: 3311279 - DNA, 19 bp, Homo sapiens
cattctttttttcttggcc

SEQ ID NO: 3311280 - DNA, 12 bp, Homo sapiens
cattgaaagaag

SEQ ID NO: 3311281 - DNA, 22 bp, Homo sapiens
cattgaaagagaaccagtttca

SEQ ID NO: 3311282 - DNA, 19 bp, Homo sapiens
cattgaaatgagcacctcc

SEQ ID NO: 3311283 - DNA, 14 bp, Homo sapiens
cattgaaatgtcac

SEQ ID NO: 3311284 - DNA, 14 bp, Homo sapiens
cattgaacacaaac

SEQ ID NO: 3311285 - DNA, 17 bp, Homo sapiens
cattgaacacaaactgt

SEQ ID NO: 3311286 - DNA, 16 bp, Homo sapiens
cattgaagccgactct

SEQ ID NO: 3311287 - DNA, 20 bp, Homo sapiens
cattgaagccgactctggcc

SEQ ID NO: 3311288 - DNA, 14 bp, Homo sapiens
cattgaaggcttaa

SEQ ID NO: 3311289 - DNA, 13 bp, Homo sapiens
cattgacaaatct

SEQ ID NO: 3311290 - DNA, 21 bp, Homo sapiens
cattgacaaatctgtgtatat

SEQ ID NO: 3311291 - DNA, 17 bp, Homo sapiens
cattgaccaagaactgc

SEQ ID NO: 3311292 - DNA, 18 bp, Homo sapiens
cattgacctctcagggcc

SEQ ID NO: 3311293 - DNA, 22 bp, Homo sapiens
cattgacctctcagggcctggc

SEQ ID NO: 3311294 - DNA, 19 bp, Homo sapiens
cattgacgattccttctct

SEQ ID NO: 3311295 - DNA, 23 bp, Homo sapiens
cattgacgattccttctctgaac

SEQ ID NO: 3311296 - DNA, 15 bp, Homo sapiens
cattgactcttgcgt

SEQ ID NO: 3311297 - DNA, 17 bp, Homo sapiens
cattgacttcattttat

SEQ ID NO: 3311298 - DNA, 18 bp, Homo sapiens
cattgagagttttgtctt

SEQ ID NO: 3311299 - DNA, 19 bp, Homo sapiens
cattgagcttgcatgcttg

SEQ ID NO: 3311300 - DNA, 9 bp, Homo sapiens
cattgagta

SEQ ID NO: 3311301 - DNA, 16 bp, Homo sapiens
cattgataatcttcag

SEQ ID NO: 3311302 - DNA, 17 bp, Homo sapiens
cattgatggatgtcttc

SEQ ID NO: 3311303 - DNA, 16 bp, Homo sapiens
cattgattgtcagcta

SEQ ID NO: 3311304 - DNA, 21 bp, Homo sapiens
cattgcacataagcttccatt

SEQ ID NO: 3311305 - DNA, 20 bp, Homo sapiens
cattgcactctagcctgggc

SEQ ID NO: 3311306 - DNA, 16 bp, Homo sapiens
cattgcagaataatgt

SEQ ID NO: 3311307 - DNA, 20 bp, Homo sapiens
cattgcagcagataactttt

SEQ ID NO: 3311308 - DNA, 20 bp, Homo sapiens
cattgcagtttaagagcaga

SEQ ID NO: 3311309 - DNA, 17 bp, Homo sapiens
cattgccaccaggagaa

SEQ ID NO: 3311310 - DNA, 15 bp, Homo sapiens
cattgccagtgtctt

SEQ ID NO: 3311311 - DNA, 15 bp, Homo sapiens
cattgccattccctg

SEQ ID NO: 3311312 - DNA, 18 bp, Homo sapiens
cattgccattccctgcct

SEQ ID NO: 3311313 - DNA, 14 bp, Homo sapiens
cattgcccccacct

SEQ ID NO: 3311314 - DNA, 18 bp, Homo sapiens
cattgcctcctgttctgc

SEQ ID NO: 3311315 - DNA, 22 bp, Homo sapiens
cattgcctcctgttctgcccac

SEQ ID NO: 3311316 - DNA, 19 bp, Homo sapiens
cattgcctcttttcacatt

SEQ ID NO: 3311317 - DNA, 15 bp, Homo sapiens
cattgcggacagcca

SEQ ID NO: 3311318 - DNA, 21 bp, Homo sapiens
cattgcggacagccacggcca

SEQ ID NO: 3311319 - DNA, 14 bp, Homo sapiens
cattgcggccccag

SEQ ID NO: 3311320 - DNA, 17 bp, Homo sapiens
cattgcggccccaggag

SEQ ID NO: 3311321 - DNA, 13 bp, Homo sapiens
cattgctctctgg

SEQ ID NO: 3311322 - DNA, 14 bp, Homo sapiens
cattgctctctggg

SEQ ID NO: 3311323 - DNA, 15 bp, Homo sapiens
cattgctctctgggc

SEQ ID NO: 3311324 - DNA, 17 bp, Homo sapiens
cattgctgagcctctgc

SEQ ID NO: 3311325 - DNA, 21 bp, Homo sapiens
cattgctgagcctctgctccc

SEQ ID NO: 3311326 - DNA, 22 bp, Homo sapiens
cattgcttgtgccacaccctcc

SEQ ID NO: 3311327 - DNA, 14 bp, Homo sapiens
cattgctttctgaa

SEQ ID NO: 3311328 - DNA, 11 bp, Homo sapiens
cattgcttttg

SEQ ID NO: 3311329 - DNA, 17 bp, Homo sapiens
cattggaataaggcatg

SEQ ID NO: 3311330 - DNA, 19 bp, Homo sapiens
cattggaatgttctcagat

SEQ ID NO: 3311331 - DNA, 10 bp, Homo sapiens
cattggagct

SEQ ID NO: 3311332 - DNA, 16 bp, Homo sapiens
cattggagctgactgt

SEQ ID NO: 3311333 - DNA, 18 bp, Homo sapiens
cattggatattttttact

SEQ ID NO: 3311334 - DNA, 22 bp, Homo sapiens
cattggatttttgttaattttc

SEQ ID NO: 3311335 - DNA, 21 bp, Homo sapiens
cattggcaagatgaaataatt

SEQ ID NO: 3311336 - DNA, 23 bp, Homo sapiens
cattggcaagatgaaataatttt

SEQ ID NO: 3311337 - DNA, 19 bp, Homo sapiens
cattggctcagcccgctga

SEQ ID NO: 3311338 - DNA, 14 bp, Homo sapiens
cattggtggactac

SEQ ID NO: 3311339 - DNA, 19 bp, Homo sapiens
cattgtaaatagtatttga

SEQ ID NO: 3311340 - DNA, 13 bp, Homo sapiens
cattgtaactatt

SEQ ID NO: 3311341 - DNA, 21 bp, Homo sapiens
cattgtagaaacacagttttg

SEQ ID NO: 3311342 - DNA, 15 bp, Homo sapiens
cattgtatgatgtgt

SEQ ID NO: 3311343 - DNA, 18 bp, Homo sapiens
cattgtccctcttcactc

SEQ ID NO: 3311344 - DNA, 22 bp, Homo sapiens
cattgtcgtataggcatgtaaa

SEQ ID NO: 3311345 - DNA, 21 bp, Homo sapiens
cattgtctcctatatatttct

SEQ ID NO: 3311346 - DNA, 20 bp, Homo sapiens
cattgtctcgtgtacagctc

SEQ ID NO: 3311347 - DNA, 15 bp, Homo sapiens
cattgtcttgttctg

SEQ ID NO: 3311348 - DNA, 20 bp, Homo sapiens
cattgtcttgttctgtccct

SEQ ID NO: 3311349 - DNA, 17 bp, Homo sapiens
cattgtctttatatgaa

SEQ ID NO: 3311350 - DNA, 13 bp, Homo sapiens
cattgtctttgct

SEQ ID NO: 3311351 - DNA, 16 bp, Homo sapiens
cattgtctttgctgta

SEQ ID NO: 3311352 - DNA, 18 bp, Homo sapiens
cattgtgattggcctgta

SEQ ID NO: 3311353 - DNA, 16 bp, Homo sapiens
cattgtggctcctatc

SEQ ID NO: 3311354 - DNA, 22 bp, Homo sapiens
cattgtgggatgttcagcactg

SEQ ID NO: 3311355 - DNA, 21 bp, Homo sapiens
cattgtggtgtgagcttcaga

SEQ ID NO: 3311356 - DNA, 17 bp, Homo sapiens
cattgtgtcagaaacat

SEQ ID NO: 3311357 - DNA, 19 bp, Homo sapiens
cattgtgttgacattaaga

SEQ ID NO: 3311358 - DNA, 16 bp, Homo sapiens
cattgttcaattagaa

SEQ ID NO: 3311359 - DNA, 18 bp, Homo sapiens
cattgttcaattagaata

SEQ ID NO: 3311360 - DNA, 17 bp, Homo sapiens
cattgttgctccctgtg

SEQ ID NO: 3311361 - DNA, 18 bp, Homo sapiens
cattgttggctatttgaa

SEQ ID NO: 3311362 - DNA, 17 bp, Homo sapiens
cattgtttattaacaaa

SEQ ID NO: 3311363 - DNA, 17 bp, Homo sapiens
cattgtttcgtaacaca

SEQ ID NO: 3311364 - DNA, 19 bp, Homo sapiens
cattgtttgcttattgttc

SEQ ID NO: 3311365 - DNA, 20 bp, Homo sapiens
cattgtttgcttattgttcc

SEQ ID NO: 3311366 - DNA, 21 bp, Homo sapiens
cattgtttgcttattgttcca

SEQ ID NO: 3311367 - DNA, 18 bp, Homo sapiens
cattgtttgtctgtcttc

SEQ ID NO: 3311368 - DNA, 14 bp, Homo sapiens
cattgttttctttt

SEQ ID NO: 3311369 - DNA, 18 bp, Homo sapiens
cattgttttcttttacag

SEQ ID NO: 3311370 - DNA, 23 bp, Homo sapiens
cattgttttcttttacagactag

SEQ ID NO: 3311371 - DNA, 14 bp, Homo sapiens
cattgttttgaaac

SEQ ID NO: 3311372 - DNA, 16 bp, Homo sapiens
cattgttttgaatatt

SEQ ID NO: 3311373 - DNA, 12 bp, Homo sapiens
catttaaaaaaa

SEQ ID NO: 3311374 - DNA, 21 bp, Homo sapiens
catttaaaaaaaaaatttgtt

SEQ ID NO: 3311375 - DNA, 20 bp, Homo sapiens
catttaaaaagctcactgct

SEQ ID NO: 3311376 - DNA, 13 bp, Homo sapiens
catttaaaacaga

SEQ ID NO: 3311377 - DNA, 22 bp, Homo sapiens
catttaaaagcataaggccgga

SEQ ID NO: 3311378 - DNA, 16 bp, Homo sapiens
catttaaaatgattag

SEQ ID NO: 3311379 - DNA, 18 bp, Homo sapiens
catttaaaatgattagaa

SEQ ID NO: 3311380 - DNA, 20 bp, Homo sapiens
catttaaaattgctatgtta

SEQ ID NO: 3311381 - DNA, 22 bp, Homo sapiens
catttaaaattgctatgttact

SEQ ID NO: 3311382 - DNA, 19 bp, Homo sapiens
catttaaacaagtatttta

SEQ ID NO: 3311383 - DNA, 23 bp, Homo sapiens
catttaaacccaatcagatgcct

SEQ ID NO: 3311384 - DNA, 15 bp, Homo sapiens
catttaaagttgtat

SEQ ID NO: 3311385 - DNA, 11 bp, Homo sapiens
catttaaatcc

SEQ ID NO: 3311386 - DNA, 22 bp, Homo sapiens
catttaaatgtaacttattatt

SEQ ID NO: 3311387 - DNA, 18 bp, Homo sapiens
catttaaatttttttcct

SEQ ID NO: 3311388 - DNA, 12 bp, Homo sapiens
catttaataaag

SEQ ID NO: 3311389 - DNA, 19 bp, Homo sapiens
catttaataaagatgagtt

SEQ ID NO: 3311390 - DNA, 18 bp, Homo sapiens
catttaataatgtatgta

SEQ ID NO: 3311391 - DNA, 21 bp, Homo sapiens
catttaatggcagctagtgcc

SEQ ID NO: 3311392 - DNA, 17 bp, Homo sapiens
catttacaccacacttt

SEQ ID NO: 3311393 - DNA, 12 bp, Homo sapiens
catttacacttt

SEQ ID NO: 3311394 - DNA, 20 bp, Homo sapiens
catttacagtccttcaaaat

SEQ ID NO: 3311395 - DNA, 17 bp, Homo sapiens
catttacagtctctttc

SEQ ID NO: 3311396 - DNA, 15 bp, Homo sapiens
catttgtgtcaatgg

SEQ ID NO: 3311397 - DNA, 22 bp, Homo sapiens
catttgtgttttgaaagcccaa

SEQ ID NO: 3311398 - DNA, 19 bp, Homo sapiens
catttgttggtaactaatg

SEQ ID NO: 3311399 - DNA, 21 bp, Homo sapiens
cattttaaaaacatagaaaaa

SEQ ID NO: 3311400 - DNA, 15 bp, Homo sapiens
cattttaaaaacttt

SEQ ID NO: 3311401 - DNA, 19 bp, Homo sapiens
cattttaaaaactttattg

SEQ ID NO: 3311402 - DNA, 20 bp, Homo sapiens
cattttaaaaactttattgg

SEQ ID NO: 3311403 - DNA, 14 bp, Homo sapiens
cattttaaaggata

SEQ ID NO: 3311404 - DNA, 13 bp, Homo sapiens
cattttaaataaa

SEQ ID NO: 3311405 - DNA, 15 bp, Homo sapiens
cattttaaataaaag

SEQ ID NO: 3311406 - DNA, 17 bp, Homo sapiens
cattttaaataaaagaa

SEQ ID NO: 3311407 - DNA, 18 bp, Homo sapiens
cattttaacatgatttca

SEQ ID NO: 3311408 - DNA, 16 bp, Homo sapiens
cattttaacgctgcct

SEQ ID NO: 3311409 - DNA, 14 bp, Homo sapiens
cattttaattcatc

SEQ ID NO: 3311410 - DNA, 14 bp, Homo sapiens
cattttaattttaa

SEQ ID NO: 3311411 - DNA, 18 bp, Homo sapiens
cattttaattttaaagtg

SEQ ID NO: 3311412 - DNA, 20 bp, Homo sapiens
cattttacagtgaccttttc

SEQ ID NO: 3311413 - DNA, 16 bp, Homo sapiens
cattttagtgactgta

SEQ ID NO: 3311414 - DNA, 12 bp, Homo sapiens
cattttatattt

SEQ ID NO: 3311415 - DNA, 16 bp, Homo sapiens
cattttatatttttgt

SEQ ID NO: 3311416 - DNA, 18 bp, Homo sapiens
cattttattaaacatttt

SEQ ID NO: 3311417 - DNA, 21 bp, Homo sapiens
cattttattaagctttttgga

SEQ ID NO: 3311418 - DNA, 17 bp, Homo sapiens
cattttcaactgctttg

SEQ ID NO: 3311419 - DNA, 15 bp, Homo sapiens
cattttcaatactgt

SEQ ID NO: 3311420 - DNA, 12 bp, Homo sapiens
cattttcatgtg

SEQ ID NO: 3311421 - DNA, 12 bp, Homo sapiens
cattttcccaga

SEQ ID NO: 3311422 - DNA, 19 bp, Homo sapiens
cattttcccatcatccttt

SEQ ID NO: 3311423 - DNA, 20 bp, Homo sapiens
cattttcccatcatcctttg

SEQ ID NO: 3311424 - DNA, 17 bp, Homo sapiens
cattttccccccactct

SEQ ID NO: 3311425 - DNA, 16 bp, Homo sapiens
cattttccccttcctc

SEQ ID NO: 3311426 - DNA, 12 bp, Homo sapiens
cattttctcagt

SEQ ID NO: 3311427 - DNA, 15 bp, Homo sapiens
cattttctcagtgtg

SEQ ID NO: 3311428 - DNA, 22 bp, Homo sapiens
cattttcttcagagagctaaat

SEQ ID NO: 3311429 - DNA, 18 bp, Homo sapiens
cattttcttttcacttcg

SEQ ID NO: 3311430 - DNA, 14 bp, Homo sapiens
cattttgcaaaatt

SEQ ID NO: 3311431 - DNA, 15 bp, Homo sapiens
cattttgcaaaattt

SEQ ID NO: 3311432 - DNA, 17 bp, Homo sapiens
cattttgcaaaatttcc

SEQ ID NO: 3311433 - DNA, 16 bp, Homo sapiens
cattttgcagcagtga

SEQ ID NO: 3311434 - DNA, 22 bp, Homo sapiens
cattttgcagcagtgagtctct

SEQ ID NO: 3311435 - DNA, 18 bp, Homo sapiens
cattttggaagttttcag

SEQ ID NO: 3311436 - DNA, 22 bp, Homo sapiens
cattttggcgctattacaaata

SEQ ID NO: 3311437 - DNA, 22 bp, Homo sapiens
cattttgggacaattgttttaa

SEQ ID NO: 3311438 - DNA, 20 bp, Homo sapiens
cattttggggtacccactgc

SEQ ID NO: 3311439 - DNA, 22 bp, Homo sapiens
cattttggtaagagacagaatg

SEQ ID NO: 3311440 - DNA, 12 bp, Homo sapiens
cattttgtgaat

SEQ ID NO: 3311441 - DNA, 14 bp, Homo sapiens
cattttgtgaatgg

SEQ ID NO: 3311442 - DNA, 16 bp, Homo sapiens
cattttgtgaatggat

SEQ ID NO: 3311443 - DNA, 22 bp, Homo sapiens
cattttgtggtcattaagcatt

SEQ ID NO: 3311444 - DNA, 13 bp, Homo sapiens
cattttgttctta

SEQ ID NO: 3311445 - DNA, 18 bp, Homo sapiens
cattttgttcttacacat

SEQ ID NO: 3311446 - DNA, 16 bp, Homo sapiens
cattttgttgtaaaaa

SEQ ID NO: 3311447 - DNA, 19 bp, Homo sapiens
cattttgttgtaaaaagaa

SEQ ID NO: 3311448 - DNA, 23 bp, Homo sapiens
catttttaaagtagaagagggtt

SEQ ID NO: 3311449 - DNA, 18 bp, Homo sapiens
catttttaatattactgt

SEQ ID NO: 3311450 - DNA, 21 bp, Homo sapiens
catttttaatattactgtctt

SEQ ID NO: 3311451 - DNA, 23 bp, Homo sapiens
catttttaatattactgtcttta

SEQ ID NO: 3311452 - DNA, 20 bp, Homo sapiens
catttttagtagagacaggg

SEQ ID NO: 3311453 - DNA, 17 bp, Homo sapiens
catttttcaaaaaggga

SEQ ID NO: 3311454 - DNA, 16 bp, Homo sapiens
catttttcatactgaa

SEQ ID NO: 3311455 - DNA, 19 bp, Homo sapiens
catttttccgtttgctttt

SEQ ID NO: 3311456 - DNA, 14 bp, Homo sapiens
catttttcctctgt

SEQ ID NO: 3311457 - DNA, 13 bp, Homo sapiens
catttttgtacag

SEQ ID NO: 3311458 - DNA, 13 bp, Homo sapiens
cattttttaagct

SEQ ID NO: 3311459 - DNA, 17 bp, Homo sapiens
cattttttaaggaaaca

SEQ ID NO: 3311460 - DNA, 16 bp, Homo sapiens
cattttttaatttact

SEQ ID NO: 3311461 - DNA, 21 bp, Homo sapiens
cattttttaatttacttgttt

SEQ ID NO: 3311462 - DNA, 14 bp, Homo sapiens
catttttttgcatg

SEQ ID NO: 3311463 - DNA, 15 bp, Homo sapiens
catttttttttcaat

SEQ ID NO: 3311464 - DNA, 23 bp, Homo sapiens
ccaaaaaaaggaaaaataatcaa

SEQ ID NO: 3311465 - DNA, 22 bp, Homo sapiens
ccaaaaaattctacaacacaca

SEQ ID NO: 3311466 - DNA, 19 bp, Homo sapiens
ccaaaaatgtgtaagaaca

SEQ ID NO: 3311467 - DNA, 18 bp, Homo sapiens
ccaaaacacgcacaccct

SEQ ID NO: 3311468 - DNA, 17 bp, Homo sapiens
ccaaaacataaaaacca

SEQ ID NO: 3311469 - DNA, 18 bp, Homo sapiens
ccaaaacataaaaaccaa

SEQ ID NO: 3311470 - DNA, 15 bp, Homo sapiens
ccaaaacccatgtgg

SEQ ID NO: 3311471 - DNA, 19 bp, Homo sapiens
ccaaaagattgctgaaatt

SEQ ID NO: 3311472 - DNA, 21 bp, Homo sapiens
ccaaaatcctgaactttctcc

SEQ ID NO: 3311473 - DNA, 12 bp, Homo sapiens
ccaaacaagcct

SEQ ID NO: 3311474 - DNA, 20 bp, Homo sapiens
ccaaacaccttccagctcct

SEQ ID NO: 3311475 - DNA, 22 bp, Homo sapiens
ccaaacaccttccagctcctgt

SEQ ID NO: 3311476 - DNA, 17 bp, Homo sapiens
ccaaacatgtatttatg

SEQ ID NO: 3311477 - DNA, 15 bp, Homo sapiens
ccaaaccatgagaat

SEQ ID NO: 3311478 - DNA, 12 bp, Homo sapiens
ccaaaccctagg

SEQ ID NO: 3311479 - DNA, 14 bp, Homo sapiens
ccaaaccctgtctg

SEQ ID NO: 3311480 - DNA, 15 bp, Homo sapiens
ccaaacccttaactg

SEQ ID NO: 3311481 - DNA, 13 bp, Homo sapiens
ccaaacgcctccc

SEQ ID NO: 3311482 - DNA, 13 bp, Homo sapiens
ccaaactacagaa

SEQ ID NO: 3311483 - DNA, 16 bp, Homo sapiens
ccaaactactgaatga

SEQ ID NO: 3311484 - DNA, 19 bp, Homo sapiens
ccaaactgcacacacagct

SEQ ID NO: 3311485 - DNA, 20 bp, Homo sapiens
ccaaactgtctttgtcacca

SEQ ID NO: 3311486 - DNA, 14 bp, Homo sapiens
ccaaactgttctga

SEQ ID NO: 3311487 - DNA, 15 bp, Homo sapiens
ccaaacttgttcatt

SEQ ID NO: 3311488 - DNA, 17 bp, Homo sapiens
ccaaacttgttcattta

SEQ ID NO: 3311489 - DNA, 12 bp, Homo sapiens
ccaaagaaacaa

SEQ ID NO: 3311490 - DNA, 14 bp, Homo sapiens
ccaaagaaacaagc

SEQ ID NO: 3311491 - DNA, 15 bp, Homo sapiens
ccaaagaaacaagct

SEQ ID NO: 3311492 - DNA, 20 bp, Homo sapiens
ccaaagaaacaagctgtgca

SEQ ID NO: 3311493 - DNA, 14 bp, Homo sapiens
ccaaagaattctta

SEQ ID NO: 3311494 - DNA, 17 bp, Homo sapiens
ccaaagactgtactggc

SEQ ID NO: 3311495 - DNA, 21 bp, Homo sapiens
ccaaagaggctgcccctctca

SEQ ID NO: 3311496 - DNA, 10 bp, Homo sapiens
ccaaagataa

SEQ ID NO: 3311497 - DNA, 20 bp, Homo sapiens
ccaaagcaatgtgagtccca

SEQ ID NO: 3311498 - DNA, 19 bp, Homo sapiens
ccaaagccaaagctaggcc

SEQ ID NO: 3311499 - DNA, 19 bp, Homo sapiens
ccaaagccagtgaaatgtg

SEQ ID NO: 3311500 - DNA, 21 bp, Homo sapiens
ccaaagctaggcctggccaga

SEQ ID NO: 3311501 - DNA, 15 bp, Homo sapiens
ccaaagctttcctgc

SEQ ID NO: 3311502 - DNA, 16 bp, Homo sapiens
ccaaagctttcctgcc

SEQ ID NO: 3311503 - DNA, 17 bp, Homo sapiens
ccaaagctttcctgccc

SEQ ID NO: 3311504 - DNA, 17 bp, Homo sapiens
ccaaaggaaaaagcaca

SEQ ID NO: 3311505 - DNA, 23 bp, Homo sapiens
ccaaaggaaaaagcacaagaagc

SEQ ID NO: 3311506 - DNA, 15 bp, Homo sapiens
ccaaaggaaggaacg

SEQ ID NO: 3311507 - DNA, 20 bp, Homo sapiens
ccaaaggacattatgtgtgc

SEQ ID NO: 3311508 - DNA, 16 bp, Homo sapiens
ccaaaggctctctcct

SEQ ID NO: 3311509 - DNA, 15 bp, Homo sapiens
ccaaaggctggtggc

SEQ ID NO: 3311510 - DNA, 16 bp, Homo sapiens
ccaaaggggctgctgg

SEQ ID NO: 3311511 - DNA, 17 bp, Homo sapiens
ccaaaggggctgctggg

SEQ ID NO: 3311512 - DNA, 20 bp, Homo sapiens
ccaaaggtaagtctgagacc

SEQ ID NO: 3311513 - DNA, 23 bp, Homo sapiens
ccaaaggtttttaaagtaaatct

SEQ ID NO: 3311514 - DNA, 22 bp, Homo sapiens
ccaaagtacagaatttgaatta

SEQ ID NO: 3311515 - DNA, 15 bp, Homo sapiens
ccaaagtaccacact

SEQ ID NO: 3311516 - DNA, 16 bp, Homo sapiens
ccaaagtctcccttct

SEQ ID NO: 3311517 - DNA, 23 bp, Homo sapiens
ccaaagtgccactcattcctgta

SEQ ID NO: 3311518 - DNA, 23 bp, Homo sapiens
ccaaagtggggagggacaaggga

SEQ ID NO: 3311519 - DNA, 14 bp, Homo sapiens
ccaaagttctaata

SEQ ID NO: 3311520 - DNA, 19 bp, Homo sapiens
ccaaagttctaataatttc

SEQ ID NO: 3311521 - DNA, 20 bp, Homo sapiens
ccaaagttctaataatttct

SEQ ID NO: 3311522 - DNA, 17 bp, Homo sapiens
ccaatgtaccgtttcct

SEQ ID NO: 3311523 - DNA, 12 bp, Homo sapiens
ccaatgttttcc

SEQ ID NO: 3311524 - DNA, 16 bp, Homo sapiens
ccaattagtttccttt

SEQ ID NO: 3311525 - DNA, 20 bp, Homo sapiens
ccaattagtttcctttttaa

SEQ ID NO: 3311526 - DNA, 11 bp, Homo sapiens
ccaatttaagg

SEQ ID NO: 3311527 - DNA, 23 bp, Homo sapiens
ccaatttcggattttttccaaaa

SEQ ID NO: 3311528 - DNA, 12 bp, Homo sapiens
ccaatttcttcc

SEQ ID NO: 3311529 - DNA, 14 bp, Homo sapiens
ccaatttcttcctt

SEQ ID NO: 3311530 - DNA, 15 bp, Homo sapiens
ccaatttcttccttc

SEQ ID NO: 3311531 - DNA, 20 bp, Homo sapiens
ccaatttggtaaaaatgctg

SEQ ID NO: 3311532 - DNA, 23 bp, Homo sapiens
ccaatttggtaaaaatgctgctc

SEQ ID NO: 3311533 - DNA, 15 bp, Homo sapiens
ccacaaaaaatactt

SEQ ID NO: 3311534 - DNA, 14 bp, Homo sapiens
ccacaaaaataaaa

SEQ ID NO: 3311535 - DNA, 14 bp, Homo sapiens
ccacaaaagaagtg

SEQ ID NO: 3311536 - DNA, 12 bp, Homo sapiens
ccacaaaatata

SEQ ID NO: 3311537 - DNA, 11 bp, Homo sapiens
ccacaaacaat

SEQ ID NO: 3311538 - DNA, 20 bp, Homo sapiens
ccacaaagcacagtttgaac

SEQ ID NO: 3311539 - DNA, 14 bp, Homo sapiens
ccacaaagccttat

SEQ ID NO: 3311540 - DNA, 22 bp, Homo sapiens
ccacaaagccttatcaagtgtc

SEQ ID NO: 3311541 - DNA, 23 bp, Homo sapiens
ccacaaagccttatcaagtgtct

SEQ ID NO: 3311542 - DNA, 22 bp, Homo sapiens
ccacaaagctaggatggttctg

SEQ ID NO: 3311543 - DNA, 20 bp, Homo sapiens
ccacaaatcaaagcaagggc

SEQ ID NO: 3311544 - DNA, 18 bp, Homo sapiens
ccacaacagaataaagca

SEQ ID NO: 3311545 - DNA, 20 bp, Homo sapiens
ccacaacagaataaagcagc

SEQ ID NO: 3311546 - DNA, 14 bp, Homo sapiens
ccacaactgacaca

SEQ ID NO: 3311547 - DNA, 17 bp, Homo sapiens
ccacaactgacacagga

SEQ ID NO: 3311548 - DNA, 16 bp, Homo sapiens
ccacaagaaatttgat

SEQ ID NO: 3311549 - DNA, 15 bp, Homo sapiens
ccacaagctgtccct

SEQ ID NO: 3311550 - DNA, 16 bp, Homo sapiens
ccacaagctgtccctg

SEQ ID NO: 3311551 - DNA, 17 bp, Homo sapiens
ccacaaggctggccagc

SEQ ID NO: 3311552 - DNA, 18 bp, Homo sapiens
ccacaaggtccactccct

SEQ ID NO: 3311553 - DNA, 16 bp, Homo sapiens
ccacaagtgccctcca

SEQ ID NO: 3311554 - DNA, 20 bp, Homo sapiens
ccacaatctggcttagtgcc

SEQ ID NO: 3311555 - DNA, 13 bp, Homo sapiens
ccacaattccatt

SEQ ID NO: 3311556 - DNA, 12 bp, Homo sapiens
ccacacacagag

SEQ ID NO: 3311557 - DNA, 22 bp, Homo sapiens
ccacacacagaggaagagcagg

SEQ ID NO: 3311558 - DNA, 14 bp, Homo sapiens
ccacacaggctggc

SEQ ID NO: 3311559 - DNA, 17 bp, Homo sapiens
ccacacagtccccagac

SEQ ID NO: 3311560 - DNA, 14 bp, Homo sapiens
ccacaccaacactg

SEQ ID NO: 3311561 - DNA, 14 bp, Homo sapiens
ccacaccaagcagc

SEQ ID NO: 3311562 - DNA, 15 bp, Homo sapiens
ccacaccagtggcct

SEQ ID NO: 3311563 - DNA, 20 bp, Homo sapiens
ccacacccaatgctgctcca

SEQ ID NO: 3311564 - DNA, 16 bp, Homo sapiens
ccacacccagcctcag

SEQ ID NO: 3311565 - DNA, 15 bp, Homo sapiens
ccacacccagcggcc

SEQ ID NO: 3311566 - DNA, 13 bp, Homo sapiens
ccacaccccagcc

SEQ ID NO: 3311567 - DNA, 17 bp, Homo sapiens
ccacaccccagcccacc

SEQ ID NO: 3311568 - DNA, 20 bp, Homo sapiens
ccacaccccagcccaccctg

SEQ ID NO: 3311569 - DNA, 13 bp, Homo sapiens
ccacaccctcggg

SEQ ID NO: 3311570 - DNA, 17 bp, Homo sapiens
ccacaccctcggggggt

SEQ ID NO: 3311571 - DNA, 19 bp, Homo sapiens
ccacaccctgtactgttct

SEQ ID NO: 3311572 - DNA, 14 bp, Homo sapiens
ccacaccgcagaag

SEQ ID NO: 3311573 - DNA, 15 bp, Homo sapiens
ccacaccgcagaagc

SEQ ID NO: 3311574 - DNA, 18 bp, Homo sapiens
ccacacctcagttccctt

SEQ ID NO: 3311575 - DNA, 15 bp, Homo sapiens
ccacacctccacagt

SEQ ID NO: 3311576 - DNA, 16 bp, Homo sapiens
ccacacctccctgaac

SEQ ID NO: 3311577 - DNA, 13 bp, Homo sapiens
ccacacctggcct

SEQ ID NO: 3311578 - DNA, 16 bp, Homo sapiens
ccacacctggccttaa

SEQ ID NO: 3311579 - DNA, 22 bp, Homo sapiens
ccacacctggccttaaagaggg

SEQ ID NO: 3311580 - DNA, 15 bp, Homo sapiens
ccacaccttccaggg

SEQ ID NO: 3311581 - DNA, 16 bp, Homo sapiens
ccacacgattagcttt

SEQ ID NO: 3311582 - DNA, 16 bp, Homo sapiens
ccacacggactcccgg

SEQ ID NO: 3311583 - DNA, 19 bp, Homo sapiens
ccacacggactcccgggcc

SEQ ID NO: 3311584 - DNA, 16 bp, Homo sapiens
ccacactaacctgggt

SEQ ID NO: 3311585 - DNA, 22 bp, Homo sapiens
ccacactaacctgggttccctt

SEQ ID NO: 3311586 - DNA, 14 bp, Homo sapiens
ccacactacacagc

SEQ ID NO: 3311587 - DNA, 15 bp, Homo sapiens
ccacactatgcacag

SEQ ID NO: 3311588 - DNA, 18 bp, Homo sapiens
ccacactattaccatgag

SEQ ID NO: 3311589 - DNA, 13 bp, Homo sapiens
ccacactctccat

SEQ ID NO: 3311590 - DNA, 16 bp, Homo sapiens
ccacactctccatcac

SEQ ID NO: 3311591 - DNA, 20 bp, Homo sapiens
ccacactgagttctatcagt

SEQ ID NO: 3311592 - DNA, 21 bp, Homo sapiens
ccacacttcaggctcttctcc

SEQ ID NO: 3311593 - DNA, 17 bp, Homo sapiens
ccacacttgaaaccttt

SEQ ID NO: 3311594 - DNA, 19 bp, Homo sapiens
ccacacttgagaggatgaa

SEQ ID NO: 3311595 - DNA, 16 bp, Homo sapiens
ccacacttgctggggc

SEQ ID NO: 3311596 - DNA, 23 bp, Homo sapiens
ccacagaaccttcaacccagtgg

SEQ ID NO: 3311597 - DNA, 11 bp, Homo sapiens
ccacagacaca

SEQ ID NO: 3311598 - DNA, 13 bp, Homo sapiens
ccacagacacaca

SEQ ID NO: 3311599 - DNA, 20 bp, Homo sapiens
ccacagacacacacacgcac

SEQ ID NO: 3311600 - DNA, 21 bp, Homo sapiens
ccacagacacacacacgcacg

SEQ ID NO: 3311601 - DNA, 17 bp, Homo sapiens
ccacagacccctgggag

SEQ ID NO: 3311602 - DNA, 18 bp, Homo sapiens
ccacagacccctgggagc

SEQ ID NO: 3311603 - DNA, 21 bp, Homo sapiens
ccacagagaagtttgtagcca

SEQ ID NO: 3311604 - DNA, 17 bp, Homo sapiens
ccacagagtgagccagt

SEQ ID NO: 3311605 - DNA, 16 bp, Homo sapiens
ccacagagtgctggac

SEQ ID NO: 3311606 - DNA, 18 bp, Homo sapiens
ccacagagtttttcagga

SEQ ID NO: 3311607 - DNA, 19 bp, Homo sapiens
ccacagattgtttctatac

SEQ ID NO: 3311608 - DNA, 22 bp, Homo sapiens
ccacagcacagctccctgccaa

SEQ ID NO: 3311609 - DNA, 22 bp, Homo sapiens
ccacagcatcgggagcacccag

SEQ ID NO: 3311610 - DNA, 19 bp, Homo sapiens
ccacagccagcacctggca

SEQ ID NO: 3311611 - DNA, 22 bp, Homo sapiens
ccacagcccccttgccctccgc

SEQ ID NO: 3311612 - DNA, 12 bp, Homo sapiens
ccacagccgcag

SEQ ID NO: 3311613 - DNA, 18 bp, Homo sapiens
ccacagccgcagcctccc

SEQ ID NO: 3311614 - DNA, 22 bp, Homo sapiens
ccacagccgcctttgggttcca

SEQ ID NO: 3311615 - DNA, 21 bp, Homo sapiens
ccacagcgagggcagctgcta

SEQ ID NO: 3311616 - DNA, 15 bp, Homo sapiens
ccacagcgtccctgg

SEQ ID NO: 3311617 - DNA, 17 bp, Homo sapiens
ccacagcgtccctggcg

SEQ ID NO: 3311618 - DNA, 17 bp, Homo sapiens
ccacagcgtgggaactc

SEQ ID NO: 3311619 - DNA, 18 bp, Homo sapiens
ccacagctacctgagacg

SEQ ID NO: 3311620 - DNA, 19 bp, Homo sapiens
ccacaggaagcctgcagtc

SEQ ID NO: 3311621 - DNA, 19 bp, Homo sapiens
ccacaggaggcaagcaagc

SEQ ID NO: 3311622 - DNA, 16 bp, Homo sapiens
ccacaggatcagtctg

SEQ ID NO: 3311623 - DNA, 15 bp, Homo sapiens
ccacaggcataagct

SEQ ID NO: 3311624 - DNA, 16 bp, Homo sapiens
ccacaggcccttcctc

SEQ ID NO: 3311625 - DNA, 17 bp, Homo sapiens
ccacaggcccttcctct

SEQ ID NO: 3311626 - DNA, 18 bp, Homo sapiens
ccacaggcccttcctctc

SEQ ID NO: 3311627 - DNA, 13 bp, Homo sapiens
ccacaggcctccc

SEQ ID NO: 3311628 - DNA, 24 bp, Homo sapiens
ccacagggccagagggagctggaa

SEQ ID NO: 3311629 - DNA, 14 bp, Homo sapiens
ccacaggggcaggc

SEQ ID NO: 3311630 - DNA, 15 bp, Homo sapiens
ccacaggggcaggcc

SEQ ID NO: 3311631 - DNA, 20 bp, Homo sapiens
ccacagtagaactgtctgtg

SEQ ID NO: 3311632 - DNA, 15 bp, Homo sapiens
ccacagtagtcttga

SEQ ID NO: 3311633 - DNA, 13 bp, Homo sapiens
ccacagtgctgct

SEQ ID NO: 3311634 - DNA, 15 bp, Homo sapiens
ccacagtgctgcttc

SEQ ID NO: 3311635 - DNA, 23 bp, Homo sapiens
ccacagtgggtggcacctcctga

SEQ ID NO: 3311636 - DNA, 18 bp, Homo sapiens
ccacagttatcttagctg

SEQ ID NO: 3311637 - DNA, 22 bp, Homo sapiens
ccacagttgccaccacctctgt

SEQ ID NO: 3311638 - DNA, 18 bp, Homo sapiens
ccacagttttagttggtg

SEQ ID NO: 3311639 - DNA, 22 bp, Homo sapiens
ccacataaggggtttgccattt

SEQ ID NO: 3311640 - DNA, 19 bp, Homo sapiens
ccacatacaggtgctcaat

SEQ ID NO: 3311641 - DNA, 19 bp, Homo sapiens
ccacatagtgatggttccc

SEQ ID NO: 3311642 - DNA, 21 bp, Homo sapiens
ccacatagtgatggttcccct

SEQ ID NO: 3311643 - DNA, 22 bp, Homo sapiens
ccacatagtgatggttcccctg

SEQ ID NO: 3311644 - DNA, 23 bp, Homo sapiens
ccacatagtgatggttcccctgt

SEQ ID NO: 3311645 - DNA, 16 bp, Homo sapiens
ccacatcaaataagaa

SEQ ID NO: 3311646 - DNA, 17 bp, Homo sapiens
ccacatcccagcagccc

SEQ ID NO: 3311647 - DNA, 13 bp, Homo sapiens
ccacatcccaggc

SEQ ID NO: 3311648 - DNA, 20 bp, Homo sapiens
ccactgcactccagcctggc

SEQ ID NO: 3311649 - DNA, 21 bp, Homo sapiens
ccactgcactccagcctgggc

SEQ ID NO: 3311650 - DNA, 20 bp, Homo sapiens
ccactgcagtccgcagtctg

SEQ ID NO: 3311651 - DNA, 14 bp, Homo sapiens
ccactgccagcagc

SEQ ID NO: 3311652 - DNA, 15 bp, Homo sapiens
ccactgccagcagca

SEQ ID NO: 3311653 - DNA, 13 bp, Homo sapiens
ccactgccaggca

SEQ ID NO: 3311654 - DNA, 18 bp, Homo sapiens
ccactgccaggcacctgg

SEQ ID NO: 3311655 - DNA, 19 bp, Homo sapiens
ccactgccaggcacctggc

SEQ ID NO: 3311656 - DNA, 23 bp, Homo sapiens
ccactgccaggcacctggcctgc

SEQ ID NO: 3311657 - DNA, 19 bp, Homo sapiens
ccactgcccaccccctcaa

SEQ ID NO: 3311658 - DNA, 21 bp, Homo sapiens
ccactgccccccgaggctgct

SEQ ID NO: 3311659 - DNA, 15 bp, Homo sapiens
ccactgcccgagctg

SEQ ID NO: 3311660 - DNA, 22 bp, Homo sapiens
ccactgcccgagctggtgcatt

SEQ ID NO: 3311661 - DNA, 17 bp, Homo sapiens
ccactgccctgcctgcc

SEQ ID NO: 3311662 - DNA, 18 bp, Homo sapiens
ccactgccctgcctgccc

SEQ ID NO: 3311663 - DNA, 21 bp, Homo sapiens
ccactgccctgcctgcccact

SEQ ID NO: 3311664 - DNA, 13 bp, Homo sapiens
ccactgccctggc

SEQ ID NO: 3311665 - DNA, 15 bp, Homo sapiens
ccactgcctctgcct

SEQ ID NO: 3311666 - DNA, 20 bp, Homo sapiens
ccactgcttttggtctgtgt

SEQ ID NO: 3311667 - DNA, 22 bp, Homo sapiens
ccactgcttttggtctgtgtga

SEQ ID NO: 3311668 - DNA, 15 bp, Homo sapiens
ccactggacagaccc

SEQ ID NO: 3311669 - DNA, 19 bp, Homo sapiens
ccactggacagacccaggt

SEQ ID NO: 3311670 - DNA, 22 bp, Homo sapiens
ccactggacagacccaggtctt

SEQ ID NO: 3311671 - DNA, 23 bp, Homo sapiens
ccactggacagacccaggtcttc

SEQ ID NO: 3311672 - DNA, 20 bp, Homo sapiens
ccactggacttgagcttggc

SEQ ID NO: 3311673 - DNA, 14 bp, Homo sapiens
ccactggccaccag

SEQ ID NO: 3311674 - DNA, 16 bp, Homo sapiens
ccactggccaccaggc

SEQ ID NO: 3311675 - DNA, 17 bp, Homo sapiens
ccactggccaccaggct

SEQ ID NO: 3311676 - DNA, 18 bp, Homo sapiens
ccactggccaccaggctg

SEQ ID NO: 3311677 - DNA, 20 bp, Homo sapiens
ccactggccaccaggctggc

SEQ ID NO: 3311678 - DNA, 17 bp, Homo sapiens
ccactgggaccaaccct

SEQ ID NO: 3311679 - DNA, 17 bp, Homo sapiens
ccactgggccagccctg

SEQ ID NO: 3311680 - DNA, 18 bp, Homo sapiens
ccactggggaatgctccc

SEQ ID NO: 3311681 - DNA, 22 bp, Homo sapiens
ccactggggaatgctcccagct

SEQ ID NO: 3311682 - DNA, 17 bp, Homo sapiens
ccactggggactttatt

SEQ ID NO: 3311683 - DNA, 17 bp, Homo sapiens
ccactgggtgagagagg

SEQ ID NO: 3311684 - DNA, 18 bp, Homo sapiens
ccactgtaaaatgaaatt

SEQ ID NO: 3311685 - DNA, 22 bp, Homo sapiens
ccactgtcactgtttctctgct

SEQ ID NO: 3311686 - DNA, 18 bp, Homo sapiens
ccactgtccccctaccca

SEQ ID NO: 3311687 - DNA, 22 bp, Homo sapiens
ccactgtcctaccagttgccct

SEQ ID NO: 3311688 - DNA, 12 bp, Homo sapiens
ccactgtctttt

SEQ ID NO: 3311689 - DNA, 15 bp, Homo sapiens
ccactgtgccatgtg

SEQ ID NO: 3311690 - DNA, 20 bp, Homo sapiens
ccactgtgcctttgcaaatc

SEQ ID NO: 3311691 - DNA, 18 bp, Homo sapiens
ccactgtggcaaatggag

SEQ ID NO: 3311692 - DNA, 16 bp, Homo sapiens
ccactgtggcactggc

SEQ ID NO: 3311693 - DNA, 14 bp, Homo sapiens
ccactgtggccaga

SEQ ID NO: 3311694 - DNA, 16 bp, Homo sapiens
ccactgtggccagagc

SEQ ID NO: 3311695 - DNA, 13 bp, Homo sapiens
ccactgtggtggc

SEQ ID NO: 3311696 - DNA, 16 bp, Homo sapiens
ccacttaaaaaatgtc

SEQ ID NO: 3311697 - DNA, 17 bp, Homo sapiens
ccacttaaaaaatgtcc

SEQ ID NO: 3311698 - DNA, 20 bp, Homo sapiens
ccacttaatgtatgttacca

SEQ ID NO: 3311699 - DNA, 13 bp, Homo sapiens
ccacttacctcaa

SEQ ID NO: 3311700 - DNA, 19 bp, Homo sapiens
ccacttagaaattgcattt

SEQ ID NO: 3311701 - DNA, 15 bp, Homo sapiens
ccacttagccgtcca

SEQ ID NO: 3311702 - DNA, 22 bp, Homo sapiens
ccacttagccgtccatggcacc

SEQ ID NO: 3311703 - DNA, 22 bp, Homo sapiens
ccacttattccccattcttcct

SEQ ID NO: 3311704 - DNA, 21 bp, Homo sapiens
ccacttccaggggaacctgcc

SEQ ID NO: 3311705 - DNA, 17 bp, Homo sapiens
ccacttcctgctacagg

SEQ ID NO: 3311706 - DNA, 11 bp, Homo sapiens
ccacttccttt

SEQ ID NO: 3311707 - DNA, 20 bp, Homo sapiens
ccacttcggccaggtcacac

SEQ ID NO: 3311708 - DNA, 20 bp, Homo sapiens
ccacttcttaaaggcctgga

SEQ ID NO: 3311709 - DNA, 13 bp, Homo sapiens
ccacttcttcctt

SEQ ID NO: 3311710 - DNA, 18 bp, Homo sapiens
ccacttcttcctttctct

SEQ ID NO: 3311711 - DNA, 22 bp, Homo sapiens
ccacttcttcctttctctttct

SEQ ID NO: 3311712 - DNA, 23 bp, Homo sapiens
ccacttcttcctttctctttctc

SEQ ID NO: 3311713 - DNA, 18 bp, Homo sapiens
ccacttgagtgtcaagct

SEQ ID NO: 3311714 - DNA, 16 bp, Homo sapiens
ccacttgcctcttcct

SEQ ID NO: 3311715 - DNA, 22 bp, Homo sapiens
ccacttgcctcttccttgaaga

SEQ ID NO: 3311716 - DNA, 21 bp, Homo sapiens
ccacttggaggcctttcatcc

SEQ ID NO: 3311717 - DNA, 12 bp, Homo sapiens
ccacttggtctg

SEQ ID NO: 3311718 - DNA, 20 bp, Homo sapiens
ccacttggtctgtgagatgc

SEQ ID NO: 3311719 - DNA, 23 bp, Homo sapiens
ccactttcagagcccccagccct

SEQ ID NO: 3311720 - DNA, 21 bp, Homo sapiens
ccactttcatctggggtgggg

SEQ ID NO: 3311721 - DNA, 14 bp, Homo sapiens
ccactttgcacatt

SEQ ID NO: 3311722 - DNA, 19 bp, Homo sapiens
ccactttgcacattttgat

SEQ ID NO: 3311723 - DNA, 13 bp, Homo sapiens
ccactttgtccat

SEQ ID NO: 3311724 - DNA, 22 bp, Homo sapiens
ccactttgtttcgtggggaggt

SEQ ID NO: 3311725 - DNA, 14 bp, Homo sapiens
ccagaacaaaaaga

SEQ ID NO: 3311726 - DNA, 19 bp, Homo sapiens
ccagaactgcccccactgt

SEQ ID NO: 3311727 - DNA, 19 bp, Homo sapiens
ccagaagaatattcaggac

SEQ ID NO: 3311728 - DNA, 20 bp, Homo sapiens
ccagaagaatattcaggact

SEQ ID NO: 3311729 - DNA, 16 bp, Homo sapiens
ccagaagccaaagact

SEQ ID NO: 3311730 - DNA, 19 bp, Homo sapiens
ccagaagcctctggctaga

SEQ ID NO: 3311731 - DNA, 20 bp, Homo sapiens
ccagaagcctctggctagag

SEQ ID NO: 3311732 - DNA, 16 bp, Homo sapiens
ccagaaggagggcaga

SEQ ID NO: 3311733 - DNA, 18 bp, Homo sapiens
ccagaaggagggcagagc

SEQ ID NO: 3311734 - DNA, 12 bp, Homo sapiens
ccagaaggcagg

SEQ ID NO: 3311735 - DNA, 18 bp, Homo sapiens
ccagaatccataaatgtg

SEQ ID NO: 3311736 - DNA, 13 bp, Homo sapiens
ccagaatcccagc

SEQ ID NO: 3311737 - DNA, 15 bp, Homo sapiens
ccagaatcccagccg

SEQ ID NO: 3311738 - DNA, 14 bp, Homo sapiens
ccagaatctgctgt

SEQ ID NO: 3311739 - DNA, 16 bp, Homo sapiens
ccagaatgctgtacat

SEQ ID NO: 3311740 - DNA, 23 bp, Homo sapiens
ccagaatggtctttctaatgtgt

SEQ ID NO: 3311741 - DNA, 12 bp, Homo sapiens
ccagaatgtaag

SEQ ID NO: 3311742 - DNA, 18 bp, Homo sapiens
ccagaattgtcctcaagg

SEQ ID NO: 3311743 - DNA, 13 bp, Homo sapiens
ccagaatttggaa

SEQ ID NO: 3311744 - DNA, 16 bp, Homo sapiens
ccagaatttggaaatc

SEQ ID NO: 3311745 - DNA, 13 bp, Homo sapiens
ccagacaaccaaa

SEQ ID NO: 3311746 - DNA, 14 bp, Homo sapiens
ccagacaaccaaaa

SEQ ID NO: 3311747 - DNA, 16 bp, Homo sapiens
ccagacaaccaaaaca

SEQ ID NO: 3311748 - DNA, 15 bp, Homo sapiens
ccagacacagactgg

SEQ ID NO: 3311749 - DNA, 19 bp, Homo sapiens
ccagacatcatgaatttta

SEQ ID NO: 3311750 - DNA, 18 bp, Homo sapiens
ccagaccaccagccgccc

SEQ ID NO: 3311751 - DNA, 14 bp, Homo sapiens
ccagaccccagggc

SEQ ID NO: 3311752 - DNA, 16 bp, Homo sapiens
ccagaccccagggcag

SEQ ID NO: 3311753 - DNA, 19 bp, Homo sapiens
ccagacccctctggccagg

SEQ ID NO: 3311754 - DNA, 20 bp, Homo sapiens
ccagacccctctggccagga

SEQ ID NO: 3311755 - DNA, 22 bp, Homo sapiens
ccagacccctctggccaggatg

SEQ ID NO: 3311756 - DNA, 19 bp, Homo sapiens
ccagaccgtcgcacccaca

SEQ ID NO: 3311757 - DNA, 18 bp, Homo sapiens
ccagacgctgccgctgcc

SEQ ID NO: 3311758 - DNA, 17 bp, Homo sapiens
ccagacgtaggggaggg

SEQ ID NO: 3311759 - DNA, 18 bp, Homo sapiens
ccagactagatgtagtat

SEQ ID NO: 3311760 - DNA, 22 bp, Homo sapiens
ccagactagatgtagtattttt

SEQ ID NO: 3311761 - DNA, 21 bp, Homo sapiens
ccagactctaggttatacaat

SEQ ID NO: 3311762 - DNA, 13 bp, Homo sapiens
ccagacttccttg

SEQ ID NO: 3311763 - DNA, 22 bp, Homo sapiens
ccagactttagtgccctgcccc

SEQ ID NO: 3311764 - DNA, 23 bp, Homo sapiens
ccagactttagtgccctgccccc

SEQ ID NO: 3311765 - DNA, 18 bp, Homo sapiens
ccagagaccgtcctcacc

SEQ ID NO: 3311766 - DNA, 16 bp, Homo sapiens
ccagagactttgtaga

SEQ ID NO: 3311767 - DNA, 14 bp, Homo sapiens
ccagagagaggatg

SEQ ID NO: 3311768 - DNA, 15 bp, Homo sapiens
ccagagagaggatgt

SEQ ID NO: 3311769 - DNA, 22 bp, Homo sapiens
ccagagagcctggtgctgctgc

SEQ ID NO: 3311770 - DNA, 16 bp, Homo sapiens
ccagagaggagcacct

SEQ ID NO: 3311771 - DNA, 20 bp, Homo sapiens
ccagagaggagcacctgaac

SEQ ID NO: 3311772 - DNA, 17 bp, Homo sapiens
ccagagagggcccagct

SEQ ID NO: 3311773 - DNA, 23 bp, Homo sapiens
ccagcgtttagtttctagaggcc

SEQ ID NO: 3311774 - DNA, 17 bp, Homo sapiens
ccagctaatctgtaggg

SEQ ID NO: 3311775 - DNA, 23 bp, Homo sapiens
ccagctaatctgtagggctggac

SEQ ID NO: 3311776 - DNA, 14 bp, Homo sapiens
ccagctaccccttc

SEQ ID NO: 3311777 - DNA, 18 bp, Homo sapiens
ccagctaccccttctttg

SEQ ID NO: 3311778 - DNA, 14 bp, Homo sapiens
ccagctactcagaa

SEQ ID NO: 3311779 - DNA, 21 bp, Homo sapiens
ccagctactcagaagcctgag

SEQ ID NO: 3311780 - DNA, 23 bp, Homo sapiens
ccagctactcagaagcctgaggc

SEQ ID NO: 3311781 - DNA, 17 bp, Homo sapiens
ccagctactctgtccag

SEQ ID NO: 3311782 - DNA, 21 bp, Homo sapiens
ccagctactctgtccaggcca

SEQ ID NO: 3311783 - DNA, 15 bp, Homo sapiens
ccagctacttgggag

SEQ ID NO: 3311784 - DNA, 16 bp, Homo sapiens
ccagctacttgggagg

SEQ ID NO: 3311785 - DNA, 22 bp, Homo sapiens
ccagctcaccagccccagtgcc

SEQ ID NO: 3311786 - DNA, 15 bp, Homo sapiens
ccagctcagaaccca

SEQ ID NO: 3311787 - DNA, 16 bp, Homo sapiens
ccagctcagaacccag

SEQ ID NO: 3311788 - DNA, 17 bp, Homo sapiens
ccagctcagaacccagg

SEQ ID NO: 3311789 - DNA, 20 bp, Homo sapiens
ccagctcagaacccagggct

SEQ ID NO: 3311790 - DNA, 18 bp, Homo sapiens
ccagctcaggggcagctc

SEQ ID NO: 3311791 - DNA, 22 bp, Homo sapiens
ccagctcatatgctgacagctc

SEQ ID NO: 3311792 - DNA, 12 bp, Homo sapiens
ccagctcatctc

SEQ ID NO: 3311793 - DNA, 21 bp, Homo sapiens
ccagctccaagacctgttggt

SEQ ID NO: 3311794 - DNA, 12 bp, Homo sapiens
ccagctccaggg

SEQ ID NO: 3311795 - DNA, 21 bp, Homo sapiens
ccagctccaggggcccttggg

SEQ ID NO: 3311796 - DNA, 21 bp, Homo sapiens
ccagctccccccgcccaccca

SEQ ID NO: 3311797 - DNA, 13 bp, Homo sapiens
ccagctccctaga

SEQ ID NO: 3311798 - DNA, 21 bp, Homo sapiens
ccagctccctagactgcatcc

SEQ ID NO: 3311799 - DNA, 16 bp, Homo sapiens
ccagctccctctattt

SEQ ID NO: 3311800 - DNA, 22 bp, Homo sapiens
ccagctcctttctcctgtgaat

SEQ ID NO: 3311801 - DNA, 14 bp, Homo sapiens
ccagctctgacatc

SEQ ID NO: 3311802 - DNA, 15 bp, Homo sapiens
ccagctctgacatcc

SEQ ID NO: 3311803 - DNA, 16 bp, Homo sapiens
ccagctctgacatccc

SEQ ID NO: 3311804 - DNA, 20 bp, Homo sapiens
ccagctctgacatcccttcc

SEQ ID NO: 3311805 - DNA, 22 bp, Homo sapiens
ccagctctgacatcccttcctg

SEQ ID NO: 3311806 - DNA, 19 bp, Homo sapiens
ccagctctggaggggaggg

SEQ ID NO: 3311807 - DNA, 11 bp, Homo sapiens
ccagctctgtg

SEQ ID NO: 3311808 - DNA, 12 bp, Homo sapiens
ccagctctgtgg

SEQ ID NO: 3311809 - DNA, 15 bp, Homo sapiens
ccagctgaaggcagt

SEQ ID NO: 3311810 - DNA, 18 bp, Homo sapiens
ccagctgaaggcagtggc

SEQ ID NO: 3311811 - DNA, 19 bp, Homo sapiens
ccagctgaaggcagtggca

SEQ ID NO: 3311812 - DNA, 22 bp, Homo sapiens
ccagctgaaggcagtggcaggg

SEQ ID NO: 3311813 - DNA, 16 bp, Homo sapiens
ccagctgactgtggcc

SEQ ID NO: 3311814 - DNA, 13 bp, Homo sapiens
ccagctgcaccag

SEQ ID NO: 3311815 - DNA, 17 bp, Homo sapiens
ccagctgcacctgccag

SEQ ID NO: 3311816 - DNA, 18 bp, Homo sapiens
ccagctgcacctgccagc

SEQ ID NO: 3311817 - DNA, 19 bp, Homo sapiens
ccagctgcacctgccagcc

SEQ ID NO: 3311818 - DNA, 23 bp, Homo sapiens
ccagctgcacctgccagcctggc

SEQ ID NO: 3311819 - DNA, 18 bp, Homo sapiens
ccagctgccccagccaga

SEQ ID NO: 3311820 - DNA, 13 bp, Homo sapiens
ccagctgcctgga

SEQ ID NO: 3311821 - DNA, 23 bp, Homo sapiens
ccagctgcctgtgcctgccatgg

SEQ ID NO: 3311822 - DNA, 16 bp, Homo sapiens
ccagctgcgcttgctt

SEQ ID NO: 3311823 - DNA, 18 bp, Homo sapiens
ccagctgcgcttgctttt

SEQ ID NO: 3311824 - DNA, 20 bp, Homo sapiens
ccagctgcgcttgcttttct

SEQ ID NO: 3311825 - DNA, 21 bp, Homo sapiens
ccagctgcgcttgcttttctg

SEQ ID NO: 3311826 - DNA, 16 bp, Homo sapiens
ccagctgctctgcccc

SEQ ID NO: 3311827 - DNA, 21 bp, Homo sapiens
ccagctgctctgccccttggg

SEQ ID NO: 3311828 - DNA, 15 bp, Homo sapiens
ccagctgctgctctc

SEQ ID NO: 3311829 - DNA, 19 bp, Homo sapiens
ccagctgcttcagggaggt

SEQ ID NO: 3311830 - DNA, 12 bp, Homo sapiens
ccagctgctttt

SEQ ID NO: 3311831 - DNA, 13 bp, Homo sapiens
ccagctggcctgg

SEQ ID NO: 3311832 - DNA, 12 bp, Homo sapiens
ccagctgggagg

SEQ ID NO: 3311833 - DNA, 14 bp, Homo sapiens
ccagctgggaggca

SEQ ID NO: 3311834 - DNA, 19 bp, Homo sapiens
ccagctgggctctgcaatt

SEQ ID NO: 3311835 - DNA, 17 bp, Homo sapiens
ccagctgtagccatggc

SEQ ID NO: 3311836 - DNA, 21 bp, Homo sapiens
ccagctgtagccatggctcag

SEQ ID NO: 3311837 - DNA, 14 bp, Homo sapiens
ccagctgtgagcct

SEQ ID NO: 3311838 - DNA, 20 bp, Homo sapiens
ccagcttaagcgttcatatg

SEQ ID NO: 3311839 - DNA, 20 bp, Homo sapiens
ccagcttcaggcaccagcat

SEQ ID NO: 3311840 - DNA, 21 bp, Homo sapiens
ccagcttcggagggcccctgc

SEQ ID NO: 3311841 - DNA, 22 bp, Homo sapiens
ccagcttctcctgcgccccgcc

SEQ ID NO: 3311842 - DNA, 17 bp, Homo sapiens
ccagcttgcgaataaca

SEQ ID NO: 3311843 - DNA, 14 bp, Homo sapiens
ccagcttggggcca

SEQ ID NO: 3311844 - DNA, 19 bp, Homo sapiens
ccagcttggggccaccaaa

SEQ ID NO: 3311845 - DNA, 21 bp, Homo sapiens
ccagcttggggccaccaaagc

SEQ ID NO: 3311846 - DNA, 19 bp, Homo sapiens
ccagcttgttctgggctca

SEQ ID NO: 3311847 - DNA, 18 bp, Homo sapiens
ccagctttgcccaacacc

SEQ ID NO: 3311848 - DNA, 20 bp, Homo sapiens
ccagctttgctaccaaagca

SEQ ID NO: 3311849 - DNA, 16 bp, Homo sapiens
ccagcttttcctccct

SEQ ID NO: 3311850 - DNA, 20 bp, Homo sapiens
ccaggaaactccacatctgc

SEQ ID NO: 3311851 - DNA, 22 bp, Homo sapiens
ccaggaaactccacatctgcct

SEQ ID NO: 3311852 - DNA, 23 bp, Homo sapiens
ccaggaaactccacatctgcctt

SEQ ID NO: 3311853 - DNA, 22 bp, Homo sapiens
ccaggaacacccgactcctcaa

SEQ ID NO: 3311854 - DNA, 12 bp, Homo sapiens
ccaggaagccca

SEQ ID NO: 3311855 - DNA, 12 bp, Homo sapiens
ccaggaaggcag

SEQ ID NO: 3311856 - DNA, 13 bp, Homo sapiens
ccaggaaggcagc

SEQ ID NO: 3311857 - DNA, 15 bp, Homo sapiens
ccaggaaggcagctg

SEQ ID NO: 3311858 - DNA, 17 bp, Homo sapiens
ccaggaaggcagctgct

SEQ ID NO: 3311859 - DNA, 16 bp, Homo sapiens
ccaggaaggcctaggc

SEQ ID NO: 3311860 - DNA, 21 bp, Homo sapiens
ccaggaaggcctaggctagga

SEQ ID NO: 3311861 - DNA, 20 bp, Homo sapiens
ccaggacaccacacccagcc

SEQ ID NO: 3311862 - DNA, 23 bp, Homo sapiens
ccaggacaccacacccagcctca

SEQ ID NO: 3311863 - DNA, 19 bp, Homo sapiens
ccaggacatctcctggcta

SEQ ID NO: 3311864 - DNA, 17 bp, Homo sapiens
ccaggacatctctgccc

SEQ ID NO: 3311865 - DNA, 17 bp, Homo sapiens
ccaggaccacacagtcc

SEQ ID NO: 3311866 - DNA, 20 bp, Homo sapiens
ccaggaccacacagtcccca

SEQ ID NO: 3311867 - DNA, 23 bp, Homo sapiens
ccaggaccacacagtccccagac

SEQ ID NO: 3311868 - DNA, 18 bp, Homo sapiens
ccaggaccagctggggcg

SEQ ID NO: 3311869 - DNA, 16 bp, Homo sapiens
ccaggacgcttctgaa

SEQ ID NO: 3311870 - DNA, 18 bp, Homo sapiens
ccaggacgcttctgaatg

SEQ ID NO: 3311871 - DNA, 23 bp, Homo sapiens
ccaggacgcttctgaatgctgct

SEQ ID NO: 3311872 - DNA, 18 bp, Homo sapiens
ccaggacgtcctatctcc

SEQ ID NO: 3311873 - DNA, 21 bp, Homo sapiens
ccaggacgtcctatctccccc

SEQ ID NO: 3311874 - DNA, 19 bp, Homo sapiens
ccaggacgtctggggtgtg

SEQ ID NO: 3311875 - DNA, 15 bp, Homo sapiens
ccaggactccactgg

SEQ ID NO: 3311876 - DNA, 18 bp, Homo sapiens
ccaggactccactggaca

SEQ ID NO: 3311877 - DNA, 19 bp, Homo sapiens
ccaggactccactggacag

SEQ ID NO: 3311878 - DNA, 21 bp, Homo sapiens
ccaggactccactggacagac

SEQ ID NO: 3311879 - DNA, 23 bp, Homo sapiens
ccaggactccactggacagaccc

SEQ ID NO: 3311880 - DNA, 17 bp, Homo sapiens
ccaggactccctcctca

SEQ ID NO: 3311881 - DNA, 16 bp, Homo sapiens
ccaggactgagccccg

SEQ ID NO: 3311882 - DNA, 19 bp, Homo sapiens
ccaggactgagccccgcag

SEQ ID NO: 3311883 - DNA, 19 bp, Homo sapiens
ccaggacttggggtcagga

SEQ ID NO: 3311884 - DNA, 20 bp, Homo sapiens
ccaggacttggggtcaggaa

SEQ ID NO: 3311885 - DNA, 23 bp, Homo sapiens
ccaggagaaccactacatgcagc

SEQ ID NO: 3311886 - DNA, 12 bp, Homo sapiens
ccaggagagaga

SEQ ID NO: 3311887 - DNA, 21 bp, Homo sapiens
ccaggagagagaaagccaggc

SEQ ID NO: 3311888 - DNA, 16 bp, Homo sapiens
ccaggagagagccagg

SEQ ID NO: 3311889 - DNA, 23 bp, Homo sapiens
ccaggagagagccaggatgccca

SEQ ID NO: 3311890 - DNA, 20 bp, Homo sapiens
ccaggagccccgaggccttc

SEQ ID NO: 3311891 - DNA, 13 bp, Homo sapiens
ccaggagctcttc

SEQ ID NO: 3311892 - DNA, 15 bp, Homo sapiens
ccaggagctgtcacc

SEQ ID NO: 3311893 - DNA, 16 bp, Homo sapiens
ccaggaggctgaggtg

SEQ ID NO: 3311894 - DNA, 18 bp, Homo sapiens
ccaggaggtcgaccccaa

SEQ ID NO: 3311895 - DNA, 22 bp, Homo sapiens
ccaggaggtggctatggccacc

SEQ ID NO: 3311896 - DNA, 15 bp, Homo sapiens
ccaggagtctgtgct

SEQ ID NO: 3311897 - DNA, 23 bp, Homo sapiens
ccaggagtttaagaccagcctgg

SEQ ID NO: 3311898 - DNA, 19 bp, Homo sapiens
ccagtgtcaagttgtgctt

SEQ ID NO: 3311899 - DNA, 16 bp, Homo sapiens
ccagtgtccttagaac

SEQ ID NO: 3311900 - DNA, 14 bp, Homo sapiens
ccagtgtctgggtt

SEQ ID NO: 3311901 - DNA, 16 bp, Homo sapiens
ccagtgtctttctttg

SEQ ID NO: 3311902 - DNA, 14 bp, Homo sapiens
ccagtgtgacaagg

SEQ ID NO: 3311903 - DNA, 23 bp, Homo sapiens
ccagtgtgacaaggattgctact

SEQ ID NO: 3311904 - DNA, 22 bp, Homo sapiens
ccagtgtggggttctgctggga

SEQ ID NO: 3311905 - DNA, 18 bp, Homo sapiens
ccagtgttctatgaacaa

SEQ ID NO: 3311906 - DNA, 19 bp, Homo sapiens
ccagtgttctgcatggatt

SEQ ID NO: 3311907 - DNA, 20 bp, Homo sapiens
ccagtgttgtttgtaaataa

SEQ ID NO: 3311908 - DNA, 22 bp, Homo sapiens
ccagttagaaggaggttctaat

SEQ ID NO: 3311909 - DNA, 21 bp, Homo sapiens
ccagttagactagtccccggt

SEQ ID NO: 3311910 - DNA, 17 bp, Homo sapiens
ccagttatgtgaatgat

SEQ ID NO: 3311911 - DNA, 12 bp, Homo sapiens
ccagttcaaagt

SEQ ID NO: 3311912 - DNA, 15 bp, Homo sapiens
ccagttcctcttttg

SEQ ID NO: 3311913 - DNA, 22 bp, Homo sapiens
ccagttctaggggagaagagcc

SEQ ID NO: 3311914 - DNA, 14 bp, Homo sapiens
ccagttctgctcct

SEQ ID NO: 3311915 - DNA, 14 bp, Homo sapiens
ccagttgcccagag

SEQ ID NO: 3311916 - DNA, 19 bp, Homo sapiens
ccagttgccctagcccaga

SEQ ID NO: 3311917 - DNA, 21 bp, Homo sapiens
ccagttggggaagccaggtga

SEQ ID NO: 3311918 - DNA, 23 bp, Homo sapiens
ccagttggggaagccaggtgagc

SEQ ID NO: 3311919 - DNA, 17 bp, Homo sapiens
ccagttgggtggatgcc

SEQ ID NO: 3311920 - DNA, 19 bp, Homo sapiens
ccagttgggtggatgcctg

SEQ ID NO: 3311921 - DNA, 20 bp, Homo sapiens
ccagttgggtggatgcctgg

SEQ ID NO: 3311922 - DNA, 17 bp, Homo sapiens
ccagttggtggggccag

SEQ ID NO: 3311923 - DNA, 18 bp, Homo sapiens
ccagttggtggggccagg

SEQ ID NO: 3311924 - DNA, 19 bp, Homo sapiens
ccagttggtggggccaggc

SEQ ID NO: 3311925 - DNA, 23 bp, Homo sapiens
ccagtttaagacaccaaatataa

SEQ ID NO: 3311926 - DNA, 13 bp, Homo sapiens
ccagttttcattt

SEQ ID NO: 3311927 - DNA, 23 bp, Homo sapiens
ccagtttttgtttttgcatgaaa

SEQ ID NO: 3311928 - DNA, 14 bp, Homo sapiens
ccataaaagcattg

SEQ ID NO: 3311929 - DNA, 22 bp, Homo sapiens
ccataaacggttcctggtgact

SEQ ID NO: 3311930 - DNA, 17 bp, Homo sapiens
ccataaatccagttcta

SEQ ID NO: 3311931 - DNA, 19 bp, Homo sapiens
ccataataaaaggctttga

SEQ ID NO: 3311932 - DNA, 21 bp, Homo sapiens
ccataataataatttgcactt

SEQ ID NO: 3311933 - DNA, 21 bp, Homo sapiens
ccataatctggactcctctgt

SEQ ID NO: 3311934 - DNA, 19 bp, Homo sapiens
ccataatgtataaagaaca

SEQ ID NO: 3311935 - DNA, 20 bp, Homo sapiens
ccataattatgacagttata

SEQ ID NO: 3311936 - DNA, 16 bp, Homo sapiens
ccataattttttttaa

SEQ ID NO: 3311937 - DNA, 20 bp, Homo sapiens
ccataattttttttttcctt

SEQ ID NO: 3311938 - DNA, 15 bp, Homo sapiens
ccatacaatttcatc

SEQ ID NO: 3311939 - DNA, 19 bp, Homo sapiens
ccatacaatttcatcctcc

SEQ ID NO: 3311940 - DNA, 20 bp, Homo sapiens
ccatacagggtctcttcctt

SEQ ID NO: 3311941 - DNA, 21 bp, Homo sapiens
ccatacagggtctcttccttc

SEQ ID NO: 3311942 - DNA, 14 bp, Homo sapiens
ccataccagctcgc

SEQ ID NO: 3311943 - DNA, 14 bp, Homo sapiens
ccatactcatttct

SEQ ID NO: 3311944 - DNA, 22 bp, Homo sapiens
ccatacttttggctcctctagt

SEQ ID NO: 3311945 - DNA, 17 bp, Homo sapiens
ccatagaaacatgacac

SEQ ID NO: 3311946 - DNA, 17 bp, Homo sapiens
ccatagatcttctgaaa

SEQ ID NO: 3311947 - DNA, 21 bp, Homo sapiens
ccatagctcctctccctcaca

SEQ ID NO: 3311948 - DNA, 12 bp, Homo sapiens
ccataggagagg

SEQ ID NO: 3311949 - DNA, 16 bp, Homo sapiens
ccatagtaactgacat

SEQ ID NO: 3311950 - DNA, 14 bp, Homo sapiens
ccatagtagtatga

SEQ ID NO: 3311951 - DNA, 13 bp, Homo sapiens
ccatagtggggcc

SEQ ID NO: 3311952 - DNA, 19 bp, Homo sapiens
ccatagtggggcctgggag

SEQ ID NO: 3311953 - DNA, 21 bp, Homo sapiens
ccatagtttgggtatttttgg

SEQ ID NO: 3311954 - DNA, 15 bp, Homo sapiens
ccatataagtttgaa

SEQ ID NO: 3311955 - DNA, 16 bp, Homo sapiens
ccatataagtttgaag

SEQ ID NO: 3311956 - DNA, 22 bp, Homo sapiens
ccatataagtttgaaggaaaca

SEQ ID NO: 3311957 - DNA, 23 bp, Homo sapiens
ccatataagtttgaaggaaacag

SEQ ID NO: 3311958 - DNA, 21 bp, Homo sapiens
ccatatataacagatacattt

SEQ ID NO: 3311959 - DNA, 19 bp, Homo sapiens
ccatatctccttcccctac

SEQ ID NO: 3311960 - DNA, 21 bp, Homo sapiens
ccatatcttaaagaaacagct

SEQ ID NO: 3311961 - DNA, 21 bp, Homo sapiens
ccatatcttgcgaatccaagc

SEQ ID NO: 3311962 - DNA, 12 bp, Homo sapiens
ccatatgaattg

SEQ ID NO: 3311963 - DNA, 16 bp, Homo sapiens
ccatatgcagaaatag

SEQ ID NO: 3311964 - DNA, 22 bp, Homo sapiens
ccatatgccttggggaggacaa

SEQ ID NO: 3311965 - DNA, 22 bp, Homo sapiens
ccatatggattttctattgtta

SEQ ID NO: 3311966 - DNA, 14 bp, Homo sapiens
ccatatgttacact

SEQ ID NO: 3311967 - DNA, 15 bp, Homo sapiens
ccatattctgttggc

SEQ ID NO: 3311968 - DNA, 23 bp, Homo sapiens
ccatattctgttggccagtgtga

SEQ ID NO: 3311969 - DNA, 21 bp, Homo sapiens
ccatattgtgcttcacagtag

SEQ ID NO: 3311970 - DNA, 12 bp, Homo sapiens
ccatatttattc

SEQ ID NO: 3311971 - DNA, 19 bp, Homo sapiens
ccatattttattgtatttt

SEQ ID NO: 3311972 - DNA, 17 bp, Homo sapiens
ccatcacaatacagata

SEQ ID NO: 3311973 - DNA, 19 bp, Homo sapiens
ccatcacaggatgccagcc

SEQ ID NO: 3311974 - DNA, 22 bp, Homo sapiens
ccatcacaggatgccagcccct

SEQ ID NO: 3311975 - DNA, 13 bp, Homo sapiens
ccatcacagggtt

SEQ ID NO: 3311976 - DNA, 20 bp, Homo sapiens
ccatcacagggttgggccca

SEQ ID NO: 3311977 - DNA, 15 bp, Homo sapiens
ccatcaccaccgcct

SEQ ID NO: 3311978 - DNA, 18 bp, Homo sapiens
ccatcaccctcttcctgt

SEQ ID NO: 3311979 - DNA, 20 bp, Homo sapiens
ccatcaccctcttcctgtga

SEQ ID NO: 3311980 - DNA, 15 bp, Homo sapiens
ccatcaccctttccg

SEQ ID NO: 3311981 - DNA, 14 bp, Homo sapiens
ccatcaccgctggg

SEQ ID NO: 3311982 - DNA, 24 bp, Homo sapiens
ccatcagctgtaagaagagactgg

SEQ ID NO: 3311983 - DNA, 17 bp, Homo sapiens
ccatcaggttccatccc

SEQ ID NO: 3311984 - DNA, 15 bp, Homo sapiens
ccatcagtgaaagaa

SEQ ID NO: 3311985 - DNA, 20 bp, Homo sapiens
ccatcagttcccccagtacc

SEQ ID NO: 3311986 - DNA, 21 bp, Homo sapiens
ccatcagttcccccagtacct

SEQ ID NO: 3311987 - DNA, 15 bp, Homo sapiens
ccatcatcccagctg

SEQ ID NO: 3311988 - DNA, 17 bp, Homo sapiens
ccatcatcctttgttct

SEQ ID NO: 3311989 - DNA, 15 bp, Homo sapiens
ccatcatgccttgat

SEQ ID NO: 3311990 - DNA, 20 bp, Homo sapiens
ccatcatgccttgataaata

SEQ ID NO: 3311991 - DNA, 14 bp, Homo sapiens
ccatcatgtctggc

SEQ ID NO: 3311992 - DNA, 12 bp, Homo sapiens
ccatcatttctg

SEQ ID NO: 3311993 - DNA, 11 bp, Homo sapiens
ccatcatttta

SEQ ID NO: 3311994 - DNA, 14 bp, Homo sapiens
ccatcattttacag

SEQ ID NO: 3311995 - DNA, 20 bp, Homo sapiens
ccatccaaataagaaaccta

SEQ ID NO: 3311996 - DNA, 16 bp, Homo sapiens
ccatccactctaccct

SEQ ID NO: 3311997 - DNA, 18 bp, Homo sapiens
ccatccaggttcagcttg

SEQ ID NO: 3311998 - DNA, 18 bp, Homo sapiens
ccatccagtgacaaacca

SEQ ID NO: 3311999 - DNA, 14 bp, Homo sapiens
ccatccatctccag

SEQ ID NO: 3312000 - DNA, 16 bp, Homo sapiens
ccatccatctccaggg

SEQ ID NO: 3312001 - DNA, 21 bp, Homo sapiens
ccatcccaggacaccacaccc

SEQ ID NO: 3312002 - DNA, 23 bp, Homo sapiens
ccatcccaggacaccacacccag

SEQ ID NO: 3312003 - DNA, 16 bp, Homo sapiens
ccatccccaccagctc

SEQ ID NO: 3312004 - DNA, 18 bp, Homo sapiens
ccatccccaccagctcgt

SEQ ID NO: 3312005 - DNA, 17 bp, Homo sapiens
ccatcccctatggacca

SEQ ID NO: 3312006 - DNA, 13 bp, Homo sapiens
ccatcccctggac

SEQ ID NO: 3312007 - DNA, 18 bp, Homo sapiens
ccatccctcggacccacc

SEQ ID NO: 3312008 - DNA, 13 bp, Homo sapiens
ccatccctgcctg

SEQ ID NO: 3312009 - DNA, 14 bp, Homo sapiens
ccatccctgcctgg

SEQ ID NO: 3312010 - DNA, 14 bp, Homo sapiens
ccatccctgggccc

SEQ ID NO: 3312011 - DNA, 14 bp, Homo sapiens
ccatccctgggggc

SEQ ID NO: 3312012 - DNA, 18 bp, Homo sapiens
ccatccgactgcccctgc

SEQ ID NO: 3312013 - DNA, 21 bp, Homo sapiens
ccatccgactgcccctgctgt

SEQ ID NO: 3312014 - DNA, 23 bp, Homo sapiens
ccatccggtttgccatgttgcca

SEQ ID NO: 3312015 - DNA, 23 bp, Homo sapiens
ccatcctaccctcgggcccacct

SEQ ID NO: 3312016 - DNA, 16 bp, Homo sapiens
ccatcctccagcttct

SEQ ID NO: 3312017 - DNA, 13 bp, Homo sapiens
ccatcctgactga

SEQ ID NO: 3312018 - DNA, 15 bp, Homo sapiens
ccatcctgcagcctc

SEQ ID NO: 3312019 - DNA, 22 bp, Homo sapiens
ccatcctgcagcctcctcctga

SEQ ID NO: 3312020 - DNA, 13 bp, Homo sapiens
ccatcctggctgc

SEQ ID NO: 3312021 - DNA, 15 bp, Homo sapiens
ccatccttccctttg

SEQ ID NO: 3312022 - DNA, 16 bp, Homo sapiens
ccatcgtcctgggact

SEQ ID NO: 3312023 - DNA, 19 bp, Homo sapiens
cccaacccacctctggccc

SEQ ID NO: 3312024 - DNA, 22 bp, Homo sapiens
cccaaccccagccgctcggagg

SEQ ID NO: 3312025 - DNA, 13 bp, Homo sapiens
cccaacccccctc

SEQ ID NO: 3312026 - DNA, 19 bp, Homo sapiens
cccaacccccctcctgctc

SEQ ID NO: 3312027 - DNA, 20 bp, Homo sapiens
cccaaccccgcggtgctctg

SEQ ID NO: 3312028 - DNA, 22 bp, Homo sapiens
cccaaccccgcggtgctctggc

SEQ ID NO: 3312029 - DNA, 15 bp, Homo sapiens
cccaacccctgagga

SEQ ID NO: 3312030 - DNA, 13 bp, Homo sapiens
cccaacctgctct

SEQ ID NO: 3312031 - DNA, 23 bp, Homo sapiens
cccaacctgctctcctcttgcca

SEQ ID NO: 3312032 - DNA, 16 bp, Homo sapiens
cccaacggccctgcag

SEQ ID NO: 3312033 - DNA, 22 bp, Homo sapiens
cccaacggccctgcagccagct

SEQ ID NO: 3312034 - DNA, 19 bp, Homo sapiens
cccaacgggaaaggaaacg

SEQ ID NO: 3312035 - DNA, 17 bp, Homo sapiens
cccaactctgagcccat

SEQ ID NO: 3312036 - DNA, 19 bp, Homo sapiens
cccaactctgagcccatgt

SEQ ID NO: 3312037 - DNA, 18 bp, Homo sapiens
cccaagacagatgcccca

SEQ ID NO: 3312038 - DNA, 24 bp, Homo sapiens
cccaagagaactcgcgctcagtaa

SEQ ID NO: 3312039 - DNA, 15 bp, Homo sapiens
cccaagagatgaaga

SEQ ID NO: 3312040 - DNA, 16 bp, Homo sapiens
cccaagagcagagtct

SEQ ID NO: 3312041 - DNA, 17 bp, Homo sapiens
cccaagagcagagtctg

SEQ ID NO: 3312042 - DNA, 14 bp, Homo sapiens
cccaagaggactga

SEQ ID NO: 3312043 - DNA, 17 bp, Homo sapiens
cccaagaggtctgagcc

SEQ ID NO: 3312044 - DNA, 22 bp, Homo sapiens
cccaagaggtctgagccctggt

SEQ ID NO: 3312045 - DNA, 20 bp, Homo sapiens
cccaagattcacacctgact

SEQ ID NO: 3312046 - DNA, 12 bp, Homo sapiens
cccaagccccat

SEQ ID NO: 3312047 - DNA, 13 bp, Homo sapiens
cccaagccccatc

SEQ ID NO: 3312048 - DNA, 14 bp, Homo sapiens
cccaagccccatct

SEQ ID NO: 3312049 - DNA, 17 bp, Homo sapiens
cccaagccctgaggcct

SEQ ID NO: 3312050 - DNA, 21 bp, Homo sapiens
cccaagccctgaggcctgagg

SEQ ID NO: 3312051 - DNA, 13 bp, Homo sapiens
cccaagctcctcc

SEQ ID NO: 3312052 - DNA, 13 bp, Homo sapiens
cccaagctctgct

SEQ ID NO: 3312053 - DNA, 14 bp, Homo sapiens
cccaagctctgctc

SEQ ID NO: 3312054 - DNA, 21 bp, Homo sapiens
cccaaggacggcaccatccag

SEQ ID NO: 3312055 - DNA, 19 bp, Homo sapiens
cccaaggctcccggaattc

SEQ ID NO: 3312056 - DNA, 17 bp, Homo sapiens
cccaaggctctgagcaa

SEQ ID NO: 3312057 - DNA, 14 bp, Homo sapiens
cccaagggccctgg

SEQ ID NO: 3312058 - DNA, 16 bp, Homo sapiens
cccaagggcctcccac

SEQ ID NO: 3312059 - DNA, 17 bp, Homo sapiens
cccaaggtcccctccac

SEQ ID NO: 3312060 - DNA, 23 bp, Homo sapiens
cccaagtagctgggattacaggt

SEQ ID NO: 3312061 - DNA, 19 bp, Homo sapiens
cccaagtagtctgctcaca

SEQ ID NO: 3312062 - DNA, 22 bp, Homo sapiens
cccaagtcagacagatgtcagc

SEQ ID NO: 3312063 - DNA, 21 bp, Homo sapiens
cccaagtcccagagcacctca

SEQ ID NO: 3312064 - DNA, 19 bp, Homo sapiens
cccaagtgcactttctaat

SEQ ID NO: 3312065 - DNA, 18 bp, Homo sapiens
cccaagtgccagtcttgt

SEQ ID NO: 3312066 - DNA, 20 bp, Homo sapiens
cccaagtggtttccacatgc

SEQ ID NO: 3312067 - DNA, 15 bp, Homo sapiens
cccaagtgtgaacaa

SEQ ID NO: 3312068 - DNA, 16 bp, Homo sapiens
cccaataaaggcagct

SEQ ID NO: 3312069 - DNA, 18 bp, Homo sapiens
cccaataaaggcagctgc

SEQ ID NO: 3312070 - DNA, 21 bp, Homo sapiens
cccaataaaggcagctgcctc

SEQ ID NO: 3312071 - DNA, 23 bp, Homo sapiens
cccaataaaggcagctgcctctg

SEQ ID NO: 3312072 - DNA, 15 bp, Homo sapiens
cccaatattataatt

SEQ ID NO: 3312073 - DNA, 16 bp, Homo sapiens
cccaatcagcactgaa

SEQ ID NO: 3312074 - DNA, 17 bp, Homo sapiens
cccaatccctttattac

SEQ ID NO: 3312075 - DNA, 21 bp, Homo sapiens
cccaatccctttattaccccc

SEQ ID NO: 3312076 - DNA, 20 bp, Homo sapiens
cccaatgcacatccattccc

SEQ ID NO: 3312077 - DNA, 16 bp, Homo sapiens
cccaatgctgctccac

SEQ ID NO: 3312078 - DNA, 16 bp, Homo sapiens
cccaatgtaggagctg

SEQ ID NO: 3312079 - DNA, 19 bp, Homo sapiens
cccaattacagggtgactc

SEQ ID NO: 3312080 - DNA, 14 bp, Homo sapiens
cccaattaggaagt

SEQ ID NO: 3312081 - DNA, 15 bp, Homo sapiens
cccaattaggaagtg

SEQ ID NO: 3312082 - DNA, 11 bp, Homo sapiens
cccaatttccc

SEQ ID NO: 3312083 - DNA, 19 bp, Homo sapiens
cccacaacccaaaaggttt

SEQ ID NO: 3312084 - DNA, 21 bp, Homo sapiens
cccacaaccttcggctccggg

SEQ ID NO: 3312085 - DNA, 21 bp, Homo sapiens
cccacaagctgtccctgcagg

SEQ ID NO: 3312086 - DNA, 23 bp, Homo sapiens
cccacaatctggcttagtgccac

SEQ ID NO: 3312087 - DNA, 22 bp, Homo sapiens
cccacaattaaaccgcatgtga

SEQ ID NO: 3312088 - DNA, 16 bp, Homo sapiens
cccacaccccagccca

SEQ ID NO: 3312089 - DNA, 17 bp, Homo sapiens
cccacaccccagcccac

SEQ ID NO: 3312090 - DNA, 23 bp, Homo sapiens
cccacaccctcggggggtcacag

SEQ ID NO: 3312091 - DNA, 18 bp, Homo sapiens
cccacaccgtcttccttc

SEQ ID NO: 3312092 - DNA, 19 bp, Homo sapiens
cccacaccgtcttccttca

SEQ ID NO: 3312093 - DNA, 20 bp, Homo sapiens
cccacaccgtcttccttcag

SEQ ID NO: 3312094 - DNA, 15 bp, Homo sapiens
cccacacctccacag

SEQ ID NO: 3312095 - DNA, 21 bp, Homo sapiens
cccacactatgcacagagccc

SEQ ID NO: 3312096 - DNA, 19 bp, Homo sapiens
cccacacttgttccagctc

SEQ ID NO: 3312097 - DNA, 20 bp, Homo sapiens
cccacagactccggcctgta

SEQ ID NO: 3312098 - DNA, 20 bp, Homo sapiens
cccacagagtgctggactgt

SEQ ID NO: 3312099 - DNA, 20 bp, Homo sapiens
cccacagatgtctctggggc

SEQ ID NO: 3312100 - DNA, 17 bp, Homo sapiens
cccacagcgtccctggc

SEQ ID NO: 3312101 - DNA, 14 bp, Homo sapiens
cccacagctacctg

SEQ ID NO: 3312102 - DNA, 16 bp, Homo sapiens
cccacaggaggcaagc

SEQ ID NO: 3312103 - DNA, 16 bp, Homo sapiens
cccacagttgtgttca

SEQ ID NO: 3312104 - DNA, 22 bp, Homo sapiens
cccacagttgtgttcatgctga

SEQ ID NO: 3312105 - DNA, 16 bp, Homo sapiens
cccacatcccaggctt

SEQ ID NO: 3312106 - DNA, 14 bp, Homo sapiens
cccacattggaccc

SEQ ID NO: 3312107 - DNA, 23 bp, Homo sapiens
cccaccactaggactctgaggct

SEQ ID NO: 3312108 - DNA, 11 bp, Homo sapiens
cccaccagtgc

SEQ ID NO: 3312109 - DNA, 13 bp, Homo sapiens
cccaccagtgcct

SEQ ID NO: 3312110 - DNA, 17 bp, Homo sapiens
cccaccattctacctga

SEQ ID NO: 3312111 - DNA, 14 bp, Homo sapiens
cccacccacatgtg

SEQ ID NO: 3312112 - DNA, 15 bp, Homo sapiens
cccacccacatgtga

SEQ ID NO: 3312113 - DNA, 11 bp, Homo sapiens
cccacccacct

SEQ ID NO: 3312114 - DNA, 13 bp, Homo sapiens
cccacccacctcc

SEQ ID NO: 3312115 - DNA, 13 bp, Homo sapiens
cccacccatcttc

SEQ ID NO: 3312116 - DNA, 16 bp, Homo sapiens
cccacccatcttcctg

SEQ ID NO: 3312117 - DNA, 17 bp, Homo sapiens
cccacccatcttcctgc

SEQ ID NO: 3312118 - DNA, 20 bp, Homo sapiens
cccacccatcttcctgctgc

SEQ ID NO: 3312119 - DNA, 12 bp, Homo sapiens
cccaccccacac

SEQ ID NO: 3312120 - DNA, 14 bp, Homo sapiens
cccaccccacactt

SEQ ID NO: 3312121 - DNA, 16 bp, Homo sapiens
cccaccccacctgcag

SEQ ID NO: 3312122 - DNA, 12 bp, Homo sapiens
cccaccccacgc

SEQ ID NO: 3312123 - DNA, 14 bp, Homo sapiens
cccacccccagcca

SEQ ID NO: 3312124 - DNA, 13 bp, Homo sapiens
cccacccccagct

SEQ ID NO: 3312125 - DNA, 12 bp, Homo sapiens
cccacccccatc

SEQ ID NO: 3312126 - DNA, 14 bp, Homo sapiens
cccaccccctgccc

SEQ ID NO: 3312127 - DNA, 16 bp, Homo sapiens
cccacccccttctctg

SEQ ID NO: 3312128 - DNA, 22 bp, Homo sapiens
cccacccccttctctgctccac

SEQ ID NO: 3312129 - DNA, 13 bp, Homo sapiens
cccaccccgggga

SEQ ID NO: 3312130 - DNA, 17 bp, Homo sapiens
cccaccccggggaccct

SEQ ID NO: 3312131 - DNA, 20 bp, Homo sapiens
cccaccccggggaccctgtg

SEQ ID NO: 3312132 - DNA, 16 bp, Homo sapiens
cccacccctgccccca

SEQ ID NO: 3312133 - DNA, 12 bp, Homo sapiens
cccacccctgtg

SEQ ID NO: 3312134 - DNA, 15 bp, Homo sapiens
cccacccctgtgctc

SEQ ID NO: 3312135 - DNA, 21 bp, Homo sapiens
cccaccccttaggccccgtgg

SEQ ID NO: 3312136 - DNA, 22 bp, Homo sapiens
cccaccctgctcctcctgccct

SEQ ID NO: 3312137 - DNA, 14 bp, Homo sapiens
cccaccctgctgcc

SEQ ID NO: 3312138 - DNA, 16 bp, Homo sapiens
cccaccctgctgcctt

SEQ ID NO: 3312139 - DNA, 12 bp, Homo sapiens
cccaccctggga

SEQ ID NO: 3312140 - DNA, 13 bp, Homo sapiens
cccaccctgtgcc

SEQ ID NO: 3312141 - DNA, 17 bp, Homo sapiens
cccaccctgtgccatca

SEQ ID NO: 3312142 - DNA, 13 bp, Homo sapiens
cccaccgccccca

SEQ ID NO: 3312143 - DNA, 16 bp, Homo sapiens
cccaccgggagcctcc

SEQ ID NO: 3312144 - DNA, 23 bp, Homo sapiens
cccaccgggagcctccccctcag

SEQ ID NO: 3312145 - DNA, 17 bp, Homo sapiens
cccaccggtccagctgg

SEQ ID NO: 3312146 - DNA, 23 bp, Homo sapiens
cccaccgtccgccctgctcctcc

SEQ ID NO: 3312147 - DNA, 20 bp, Homo sapiens
cccaccgtggaggaggaagg

SEQ ID NO: 3312148 - DNA, 20 bp, Homo sapiens
cccaccgtgggcagtgccac

SEQ ID NO: 3312149 - DNA, 13 bp, Homo sapiens
cccatgacaatca

SEQ ID NO: 3312150 - DNA, 19 bp, Homo sapiens
cccatgacccacccctgtg

SEQ ID NO: 3312151 - DNA, 22 bp, Homo sapiens
cccatgacccacccctgtgctc

SEQ ID NO: 3312152 - DNA, 17 bp, Homo sapiens
cccatgactgcacccag

SEQ ID NO: 3312153 - DNA, 22 bp, Homo sapiens
cccatgactgcacccagctcca

SEQ ID NO: 3312154 - DNA, 15 bp, Homo sapiens
cccatgagcctcagc

SEQ ID NO: 3312155 - DNA, 13 bp, Homo sapiens
cccatgagcctgc

SEQ ID NO: 3312156 - DNA, 14 bp, Homo sapiens
cccatgagcctgcc

SEQ ID NO: 3312157 - DNA, 20 bp, Homo sapiens
cccatgagttgtcagctttg

SEQ ID NO: 3312158 - DNA, 15 bp, Homo sapiens
cccatgatccctgtg

SEQ ID NO: 3312159 - DNA, 19 bp, Homo sapiens
cccatgcaggccctttgaa

SEQ ID NO: 3312160 - DNA, 14 bp, Homo sapiens
cccatgccccagtc

SEQ ID NO: 3312161 - DNA, 14 bp, Homo sapiens
cccatgcctgtcca

SEQ ID NO: 3312162 - DNA, 16 bp, Homo sapiens
cccatgcctgtccagc

SEQ ID NO: 3312163 - DNA, 20 bp, Homo sapiens
cccatgcgtgccgcctgctc

SEQ ID NO: 3312164 - DNA, 22 bp, Homo sapiens
cccatgcgtgccgcctgctcct

SEQ ID NO: 3312165 - DNA, 12 bp, Homo sapiens
cccatgctctgc

SEQ ID NO: 3312166 - DNA, 16 bp, Homo sapiens
cccatgctctgcccca

SEQ ID NO: 3312167 - DNA, 17 bp, Homo sapiens
cccatggaatatttcca

SEQ ID NO: 3312168 - DNA, 15 bp, Homo sapiens
cccatggacactcca

SEQ ID NO: 3312169 - DNA, 21 bp, Homo sapiens
cccatggacactccagtgcca

SEQ ID NO: 3312170 - DNA, 13 bp, Homo sapiens
cccatggagccag

SEQ ID NO: 3312171 - DNA, 19 bp, Homo sapiens
cccatggagccagctccct

SEQ ID NO: 3312172 - DNA, 13 bp, Homo sapiens
cccatggccccca

SEQ ID NO: 3312173 - DNA, 14 bp, Homo sapiens
cccatggcccccaa

SEQ ID NO: 3312174 - DNA, 16 bp, Homo sapiens
cccatggcccccaata

SEQ ID NO: 3312175 - DNA, 18 bp, Homo sapiens
cccatggcccccaataaa

SEQ ID NO: 3312176 - DNA, 19 bp, Homo sapiens
cccatggcccccaataaag

SEQ ID NO: 3312177 - DNA, 21 bp, Homo sapiens
cccatggcccccaataaaggc

SEQ ID NO: 3312178 - DNA, 14 bp, Homo sapiens
cccatggccctgtg

SEQ ID NO: 3312179 - DNA, 22 bp, Homo sapiens
cccatggccctgtgctaatccc

SEQ ID NO: 3312180 - DNA, 23 bp, Homo sapiens
cccatgggctgagtggggagcag

SEQ ID NO: 3312181 - DNA, 16 bp, Homo sapiens
cccatgggcttggact

SEQ ID NO: 3312182 - DNA, 22 bp, Homo sapiens
cccatgggttgtgtgtttattt

SEQ ID NO: 3312183 - DNA, 23 bp, Homo sapiens
cccatgggttgtgtgtttatttc

SEQ ID NO: 3312184 - DNA, 23 bp, Homo sapiens
cccatgtatttatctctatttaa

SEQ ID NO: 3312185 - DNA, 18 bp, Homo sapiens
cccatgtcgcgctcagca

SEQ ID NO: 3312186 - DNA, 17 bp, Homo sapiens
cccatgtgtacattctg

SEQ ID NO: 3312187 - DNA, 23 bp, Homo sapiens
cccatgtgtcccctcactctgtc

SEQ ID NO: 3312188 - DNA, 21 bp, Homo sapiens
cccatgtgtcctggttcccgt

SEQ ID NO: 3312189 - DNA, 21 bp, Homo sapiens
cccatgttctgcccccagccc

SEQ ID NO: 3312190 - DNA, 13 bp, Homo sapiens
cccatgtttcaaa

SEQ ID NO: 3312191 - DNA, 21 bp, Homo sapiens
cccattaggacaatcagtccc

SEQ ID NO: 3312192 - DNA, 13 bp, Homo sapiens
cccattcctccct

SEQ ID NO: 3312193 - DNA, 19 bp, Homo sapiens
cccattctacacagagcag

SEQ ID NO: 3312194 - DNA, 15 bp, Homo sapiens
cccattctgcctgcc

SEQ ID NO: 3312195 - DNA, 19 bp, Homo sapiens
cccattctgcctgcccagg

SEQ ID NO: 3312196 - DNA, 12 bp, Homo sapiens
cccattcttcct

SEQ ID NO: 3312197 - DNA, 21 bp, Homo sapiens
cccattcttcctagttttctc

SEQ ID NO: 3312198 - DNA, 21 bp, Homo sapiens
cccattctttgcttgaacaca

SEQ ID NO: 3312199 - DNA, 15 bp, Homo sapiens
cccattgtggctcct

SEQ ID NO: 3312200 - DNA, 20 bp, Homo sapiens
cccatttaaatttttttcct

SEQ ID NO: 3312201 - DNA, 14 bp, Homo sapiens
cccatttcaatgtg

SEQ ID NO: 3312202 - DNA, 16 bp, Homo sapiens
cccatttcccatctgc

SEQ ID NO: 3312203 - DNA, 17 bp, Homo sapiens
cccatttcccatctgca

SEQ ID NO: 3312204 - DNA, 15 bp, Homo sapiens
cccatttctatttat

SEQ ID NO: 3312205 - DNA, 17 bp, Homo sapiens
cccatttctatttattt

SEQ ID NO: 3312206 - DNA, 20 bp, Homo sapiens
cccatttctatttatttact

SEQ ID NO: 3312207 - DNA, 15 bp, Homo sapiens
cccatttctcactga

SEQ ID NO: 3312208 - DNA, 12 bp, Homo sapiens
cccattttgcaa

SEQ ID NO: 3312209 - DNA, 22 bp, Homo sapiens
cccattttggaagttttcagga

SEQ ID NO: 3312210 - DNA, 22 bp, Homo sapiens
ccccaaacaccttccagctcct

SEQ ID NO: 3312211 - DNA, 15 bp, Homo sapiens
ccccaacactccagg

SEQ ID NO: 3312212 - DNA, 19 bp, Homo sapiens
ccccaacactgtgccctgg

SEQ ID NO: 3312213 - DNA, 21 bp, Homo sapiens
ccccaacactgtgccctggtg

SEQ ID NO: 3312214 - DNA, 22 bp, Homo sapiens
ccccaacagcgacatagcccat

SEQ ID NO: 3312215 - DNA, 14 bp, Homo sapiens
ccccaaccccagcc

SEQ ID NO: 3312216 - DNA, 21 bp, Homo sapiens
ccccaaccccgcggtgctctg

SEQ ID NO: 3312217 - DNA, 14 bp, Homo sapiens
ccccaacccctgag

SEQ ID NO: 3312218 - DNA, 20 bp, Homo sapiens
ccccaacctcagggctccca

SEQ ID NO: 3312219 - DNA, 15 bp, Homo sapiens
ccccaacctgcactc

SEQ ID NO: 3312220 - DNA, 20 bp, Homo sapiens
ccccaacttccctagtcccc

SEQ ID NO: 3312221 - DNA, 18 bp, Homo sapiens
ccccaagcagccagccag

SEQ ID NO: 3312222 - DNA, 16 bp, Homo sapiens
ccccaagctgttttct

SEQ ID NO: 3312223 - DNA, 17 bp, Homo sapiens
ccccaagctgttttctt

SEQ ID NO: 3312224 - DNA, 13 bp, Homo sapiens
ccccaaggctgcg

SEQ ID NO: 3312225 - DNA, 16 bp, Homo sapiens
ccccaagggccctggc

SEQ ID NO: 3312226 - DNA, 18 bp, Homo sapiens
ccccaagggccctggcac

SEQ ID NO: 3312227 - DNA, 18 bp, Homo sapiens
ccccaaggttctggttcc

SEQ ID NO: 3312228 - DNA, 13 bp, Homo sapiens
ccccaagtcctca

SEQ ID NO: 3312229 - DNA, 15 bp, Homo sapiens
ccccaataaaggcag

SEQ ID NO: 3312230 - DNA, 23 bp, Homo sapiens
ccccaataaaggcagctgcctct

SEQ ID NO: 3312231 - DNA, 21 bp, Homo sapiens
ccccaattacagggtgactca

SEQ ID NO: 3312232 - DNA, 18 bp, Homo sapiens
ccccacaagctgtccctg

SEQ ID NO: 3312233 - DNA, 19 bp, Homo sapiens
ccccacaagctgtccctgc

SEQ ID NO: 3312234 - DNA, 13 bp, Homo sapiens
ccccacaatctgg

SEQ ID NO: 3312235 - DNA, 17 bp, Homo sapiens
ccccacacagctacagc

SEQ ID NO: 3312236 - DNA, 19 bp, Homo sapiens
ccccacaccttccagggcc

SEQ ID NO: 3312237 - DNA, 20 bp, Homo sapiens
ccccacacggactcccgggc

SEQ ID NO: 3312238 - DNA, 23 bp, Homo sapiens
ccccacacttgttccagctcttt

SEQ ID NO: 3312239 - DNA, 13 bp, Homo sapiens
ccccacagaacct

SEQ ID NO: 3312240 - DNA, 22 bp, Homo sapiens
ccccacagaaccttcaacccag

SEQ ID NO: 3312241 - DNA, 12 bp, Homo sapiens
ccccacagcctc

SEQ ID NO: 3312242 - DNA, 17 bp, Homo sapiens
ccccacagcgtccctgg

SEQ ID NO: 3312243 - DNA, 16 bp, Homo sapiens
ccccacagttgtgttc

SEQ ID NO: 3312244 - DNA, 23 bp, Homo sapiens
ccccacagttgtgttcatgctga

SEQ ID NO: 3312245 - DNA, 13 bp, Homo sapiens
ccccaccagctcg

SEQ ID NO: 3312246 - DNA, 20 bp, Homo sapiens
ccccacccacctccacccag

SEQ ID NO: 3312247 - DNA, 17 bp, Homo sapiens
ccccaccccaccccacc

SEQ ID NO: 3312248 - DNA, 13 bp, Homo sapiens
ccccacccccagc

SEQ ID NO: 3312249 - DNA, 15 bp, Homo sapiens
ccccacccccagcca

SEQ ID NO: 3312250 - DNA, 23 bp, Homo sapiens
ccccaccccggggaccctgtgac

SEQ ID NO: 3312251 - DNA, 13 bp, Homo sapiens
ccccaccctcagc

SEQ ID NO: 3312252 - DNA, 13 bp, Homo sapiens
ccccaccctccat

SEQ ID NO: 3312253 - DNA, 15 bp, Homo sapiens
ccccaccctcctctt

SEQ ID NO: 3312254 - DNA, 16 bp, Homo sapiens
ccccaccgccgtggag

SEQ ID NO: 3312255 - DNA, 18 bp, Homo sapiens
ccccaccggtccagctgg

SEQ ID NO: 3312256 - DNA, 13 bp, Homo sapiens
ccccacctcctgc

SEQ ID NO: 3312257 - DNA, 13 bp, Homo sapiens
ccccacctctggt

SEQ ID NO: 3312258 - DNA, 23 bp, Homo sapiens
ccccacctgacaatggcagctag

SEQ ID NO: 3312259 - DNA, 12 bp, Homo sapiens
ccccacctgcca

SEQ ID NO: 3312260 - DNA, 17 bp, Homo sapiens
ccccacgagggtcagga

SEQ ID NO: 3312261 - DNA, 21 bp, Homo sapiens
ccccacgagtcacctgcaagc

SEQ ID NO: 3312262 - DNA, 23 bp, Homo sapiens
ccccacgagtcacctgcaagccc

SEQ ID NO: 3312263 - DNA, 20 bp, Homo sapiens
ccccacgctgtggccctgga

SEQ ID NO: 3312264 - DNA, 22 bp, Homo sapiens
ccccacggccgctccaggggtg

SEQ ID NO: 3312265 - DNA, 18 bp, Homo sapiens
ccccactactcaatacta

SEQ ID NO: 3312266 - DNA, 13 bp, Homo sapiens
ccccactcacccc

SEQ ID NO: 3312267 - DNA, 21 bp, Homo sapiens
ccccactcccttgctggcccc

SEQ ID NO: 3312268 - DNA, 15 bp, Homo sapiens
ccccactctccccac

SEQ ID NO: 3312269 - DNA, 13 bp, Homo sapiens
ccccactgatgct

SEQ ID NO: 3312270 - DNA, 15 bp, Homo sapiens
ccccactgatgctgt

SEQ ID NO: 3312271 - DNA, 17 bp, Homo sapiens
ccccactgccaagtggg

SEQ ID NO: 3312272 - DNA, 15 bp, Homo sapiens
ccccactgccagcag

SEQ ID NO: 3312273 - DNA, 13 bp, Homo sapiens
ccccactgggcca

SEQ ID NO: 3312274 - DNA, 17 bp, Homo sapiens
ccccagagatgccagcc

SEQ ID NO: 3312275 - DNA, 19 bp, Homo sapiens
ccccttttgcctggctgtg

SEQ ID NO: 3312276 - DNA, 20 bp, Homo sapiens
cccgaactcgcggcaaaatt

SEQ ID NO: 3312277 - DNA, 16 bp, Homo sapiens
cccgaatagctgggac

SEQ ID NO: 3312278 - DNA, 18 bp, Homo sapiens
cccgaatagctgggacta

SEQ ID NO: 3312279 - DNA, 14 bp, Homo sapiens
cccgacactgctgc

SEQ ID NO: 3312280 - DNA, 15 bp, Homo sapiens
cccgacagcctggca

SEQ ID NO: 3312281 - DNA, 13 bp, Homo sapiens
cccgacagtgcca

SEQ ID NO: 3312282 - DNA, 23 bp, Homo sapiens
cccgacagtgccatccccacctt

SEQ ID NO: 3312283 - DNA, 12 bp, Homo sapiens
cccgactcctca

SEQ ID NO: 3312284 - DNA, 20 bp, Homo sapiens
cccgagatgtgacccaccag

SEQ ID NO: 3312285 - DNA, 12 bp, Homo sapiens
cccgagctggtg

SEQ ID NO: 3312286 - DNA, 16 bp, Homo sapiens
cccgaggagctgggcc

SEQ ID NO: 3312287 - DNA, 21 bp, Homo sapiens
cccgaggagctgggcccctgc

SEQ ID NO: 3312288 - DNA, 13 bp, Homo sapiens
cccgagtagctgg

SEQ ID NO: 3312289 - DNA, 16 bp, Homo sapiens
cccgagtagctgggac

SEQ ID NO: 3312290 - DNA, 22 bp, Homo sapiens
cccgagtagctgggactacagg

SEQ ID NO: 3312291 - DNA, 14 bp, Homo sapiens
cccgagtctgggac

SEQ ID NO: 3312292 - DNA, 21 bp, Homo sapiens
cccgagtgaggacgcaccgcc

SEQ ID NO: 3312293 - DNA, 21 bp, Homo sapiens
cccgagtgcggcgtggagact

SEQ ID NO: 3312294 - DNA, 15 bp, Homo sapiens
cccgatgctgctttc

SEQ ID NO: 3312295 - DNA, 20 bp, Homo sapiens
cccgatgctgctttcccctg

SEQ ID NO: 3312296 - DNA, 19 bp, Homo sapiens
cccgatgtcccctgcgggc

SEQ ID NO: 3312297 - DNA, 11 bp, Homo sapiens
cccgcacagca

SEQ ID NO: 3312298 - DNA, 14 bp, Homo sapiens
cccgcacagcagcc

SEQ ID NO: 3312299 - DNA, 18 bp, Homo sapiens
cccgcacagccacccgtg

SEQ ID NO: 3312300 - DNA, 17 bp, Homo sapiens
cccgcactctgccccca

SEQ ID NO: 3312301 - DNA, 16 bp, Homo sapiens
cccgcagacaccttgg

SEQ ID NO: 3312302 - DNA, 20 bp, Homo sapiens
cccgcagacctccccagccc

SEQ ID NO: 3312303 - DNA, 22 bp, Homo sapiens
cccgcagcccgtgaagcagtgc

SEQ ID NO: 3312304 - DNA, 21 bp, Homo sapiens
cccgcaggaactgggctgggc

SEQ ID NO: 3312305 - DNA, 18 bp, Homo sapiens
cccgcagtccccagccct

SEQ ID NO: 3312306 - DNA, 15 bp, Homo sapiens
cccgcagtgctggga

SEQ ID NO: 3312307 - DNA, 23 bp, Homo sapiens
cccgccacctatctcgtgggaga

SEQ ID NO: 3312308 - DNA, 16 bp, Homo sapiens
cccgccagggctgggg

SEQ ID NO: 3312309 - DNA, 14 bp, Homo sapiens
cccgcccctgcagc

SEQ ID NO: 3312310 - DNA, 20 bp, Homo sapiens
cccgccgcttttctcctctt

SEQ ID NO: 3312311 - DNA, 15 bp, Homo sapiens
cccgcctccctctca

SEQ ID NO: 3312312 - DNA, 12 bp, Homo sapiens
cccgcctctccc

SEQ ID NO: 3312313 - DNA, 16 bp, Homo sapiens
cccgcctgagctcctg

SEQ ID NO: 3312314 - DNA, 13 bp, Homo sapiens
cccgcctgcagtc

SEQ ID NO: 3312315 - DNA, 20 bp, Homo sapiens
cccgcctgcagtcttctggg

SEQ ID NO: 3312316 - DNA, 13 bp, Homo sapiens
cccgcctgccacc

SEQ ID NO: 3312317 - DNA, 12 bp, Homo sapiens
cccgcctggcca

SEQ ID NO: 3312318 - DNA, 14 bp, Homo sapiens
cccgcctggccagg

SEQ ID NO: 3312319 - DNA, 17 bp, Homo sapiens
cccgcctggccaggagc

SEQ ID NO: 3312320 - DNA, 21 bp, Homo sapiens
cccgcctggccaggagcaggc

SEQ ID NO: 3312321 - DNA, 16 bp, Homo sapiens
cccgcctggccagggc

SEQ ID NO: 3312322 - DNA, 17 bp, Homo sapiens
cccgcctggccagggca

SEQ ID NO: 3312323 - DNA, 14 bp, Homo sapiens
cccgccttcctggg

SEQ ID NO: 3312324 - DNA, 13 bp, Homo sapiens
cccgcgatgccct

SEQ ID NO: 3312325 - DNA, 16 bp, Homo sapiens
cccgcgctcgcccagc

SEQ ID NO: 3312326 - DNA, 17 bp, Homo sapiens
cccgcgctcgcccagca

SEQ ID NO: 3312327 - DNA, 15 bp, Homo sapiens
cccgcggtgctctgg

SEQ ID NO: 3312328 - DNA, 20 bp, Homo sapiens
cccgcggtgctctggcggct

SEQ ID NO: 3312329 - DNA, 21 bp, Homo sapiens
cccgctcacaacttgggttct

SEQ ID NO: 3312330 - DNA, 20 bp, Homo sapiens
cccgctcctcccctcttgag

SEQ ID NO: 3312331 - DNA, 20 bp, Homo sapiens
cccgctgcaatgcctagact

SEQ ID NO: 3312332 - DNA, 14 bp, Homo sapiens
cccggagcacagcc

SEQ ID NO: 3312333 - DNA, 16 bp, Homo sapiens
cccggagcacagccct

SEQ ID NO: 3312334 - DNA, 15 bp, Homo sapiens
cccggatcagagcag

SEQ ID NO: 3312335 - DNA, 17 bp, Homo sapiens
cccggatcagagcagga

SEQ ID NO: 3312336 - DNA, 16 bp, Homo sapiens
cccggcaccctctggc

SEQ ID NO: 3312337 - DNA, 12 bp, Homo sapiens
cccggcagggcg

SEQ ID NO: 3312338 - DNA, 21 bp, Homo sapiens
cccggcagggcgggcagaggg

SEQ ID NO: 3312339 - DNA, 16 bp, Homo sapiens
cccggccacacccagc

SEQ ID NO: 3312340 - DNA, 18 bp, Homo sapiens
cccggccacacccagcgg

SEQ ID NO: 3312341 - DNA, 20 bp, Homo sapiens
cccggccacctctgcggacc

SEQ ID NO: 3312342 - DNA, 14 bp, Homo sapiens
cccggccagcgggc

SEQ ID NO: 3312343 - DNA, 18 bp, Homo sapiens
cccggccagcgggcacag

SEQ ID NO: 3312344 - DNA, 22 bp, Homo sapiens
cccggccagcgggcacagggca

SEQ ID NO: 3312345 - DNA, 16 bp, Homo sapiens
cccggccggcctggca

SEQ ID NO: 3312346 - DNA, 14 bp, Homo sapiens
cccggcctcagggc

SEQ ID NO: 3312347 - DNA, 23 bp, Homo sapiens
cccggcctcctcggagagcagca

SEQ ID NO: 3312348 - DNA, 17 bp, Homo sapiens
cccggcctgctcccagc

SEQ ID NO: 3312349 - DNA, 18 bp, Homo sapiens
cccggcctgctcccagca

SEQ ID NO: 3312350 - DNA, 15 bp, Homo sapiens
cccggcgccgggcac

SEQ ID NO: 3312351 - DNA, 17 bp, Homo sapiens
cccggctaatttttgta

SEQ ID NO: 3312352 - DNA, 15 bp, Homo sapiens
cccggctccaggctc

SEQ ID NO: 3312353 - DNA, 16 bp, Homo sapiens
cccggctccaggctcc

SEQ ID NO: 3312354 - DNA, 13 bp, Homo sapiens
cccggctgcctgc

SEQ ID NO: 3312355 - DNA, 23 bp, Homo sapiens
cccggctgcttggcagttgcagt

SEQ ID NO: 3312356 - DNA, 23 bp, Homo sapiens
cccggctggttttgtaagatgct

SEQ ID NO: 3312357 - DNA, 19 bp, Homo sapiens
cccgggacccacggagccc

SEQ ID NO: 3312358 - DNA, 13 bp, Homo sapiens
cccgggagcctag

SEQ ID NO: 3312359 - DNA, 18 bp, Homo sapiens
cccgggagcctaggacca

SEQ ID NO: 3312360 - DNA, 14 bp, Homo sapiens
cccgggccacgccc

SEQ ID NO: 3312361 - DNA, 17 bp, Homo sapiens
cccgggctgcctgggct

SEQ ID NO: 3312362 - DNA, 23 bp, Homo sapiens
cccgggctgcctgggctgttggc

SEQ ID NO: 3312363 - DNA, 13 bp, Homo sapiens
cccgggctggaga

SEQ ID NO: 3312364 - DNA, 21 bp, Homo sapiens
cccgggctggagaaagagctg

SEQ ID NO: 3312365 - DNA, 16 bp, Homo sapiens
cccggggccagagaca

SEQ ID NO: 3312366 - DNA, 12 bp, Homo sapiens
cccggggctggc

SEQ ID NO: 3312367 - DNA, 23 bp, Homo sapiens
cccggggctggcaagcagggaaa

SEQ ID NO: 3312368 - DNA, 17 bp, Homo sapiens
cccggggtcctgtggca

SEQ ID NO: 3312369 - DNA, 15 bp, Homo sapiens
cccgggtctcaggcc

SEQ ID NO: 3312370 - DNA, 17 bp, Homo sapiens
cccgggtctcaggcctc

SEQ ID NO: 3312371 - DNA, 18 bp, Homo sapiens
cccggtgcccaagaatag

SEQ ID NO: 3312372 - DNA, 18 bp, Homo sapiens
cccggttcagacccctgc

SEQ ID NO: 3312373 - DNA, 14 bp, Homo sapiens
cccgtaatgcttag

SEQ ID NO: 3312374 - DNA, 15 bp, Homo sapiens
cccgtagtctcctgg

SEQ ID NO: 3312375 - DNA, 11 bp, Homo sapiens
cccgtccctgc

SEQ ID NO: 3312376 - DNA, 12 bp, Homo sapiens
cccgtccctgcc

SEQ ID NO: 3312377 - DNA, 12 bp, Homo sapiens
cccgtctcagtg

SEQ ID NO: 3312378 - DNA, 13 bp, Homo sapiens
cccgtctcagtgt

SEQ ID NO: 3312379 - DNA, 11 bp, Homo sapiens
cccgtgcagta

SEQ ID NO: 3312380 - DNA, 18 bp, Homo sapiens
cccgtggccatccctgtg

SEQ ID NO: 3312381 - DNA, 21 bp, Homo sapiens
cccgtggtggcggtggctgcc

SEQ ID NO: 3312382 - DNA, 14 bp, Homo sapiens
cccgtgtcctctcc

SEQ ID NO: 3312383 - DNA, 20 bp, Homo sapiens
cccgtgtgcacaccaccctc

SEQ ID NO: 3312384 - DNA, 16 bp, Homo sapiens
cccgttacagctcccc

SEQ ID NO: 3312385 - DNA, 12 bp, Homo sapiens
cccgtttctcca

SEQ ID NO: 3312386 - DNA, 14 bp, Homo sapiens
cccgtttctggtgg

SEQ ID NO: 3312387 - DNA, 20 bp, Homo sapiens
ccctaaaagcactcctgctt

SEQ ID NO: 3312388 - DNA, 19 bp, Homo sapiens
ccctaaggatctctcagga

SEQ ID NO: 3312389 - DNA, 20 bp, Homo sapiens
ccctaagtaagtttcttcct

SEQ ID NO: 3312390 - DNA, 13 bp, Homo sapiens
ccctaagtgccca

SEQ ID NO: 3312391 - DNA, 17 bp, Homo sapiens
ccctaagtgcccaaagt

SEQ ID NO: 3312392 - DNA, 23 bp, Homo sapiens
ccctaagtggattggctttgtgc

SEQ ID NO: 3312393 - DNA, 19 bp, Homo sapiens
ccctaatttaacccagctc

SEQ ID NO: 3312394 - DNA, 15 bp, Homo sapiens
ccctacacctccctc

SEQ ID NO: 3312395 - DNA, 16 bp, Homo sapiens
ccctacattagtaaaa

SEQ ID NO: 3312396 - DNA, 13 bp, Homo sapiens
ccctacctcaggc

SEQ ID NO: 3312397 - DNA, 23 bp, Homo sapiens
ccctacctgattggtgcaaccct

SEQ ID NO: 3312398 - DNA, 14 bp, Homo sapiens
ccctacctgtgcct

SEQ ID NO: 3312399 - DNA, 23 bp, Homo sapiens
ccctactattcagtggcgagaaa

SEQ ID NO: 3312400 - DNA, 22 bp, Homo sapiens
ccctactcattggggttccgca

SEQ ID NO: 3312401 - DNA, 15 bp, Homo sapiens
ccctactccctgcag

SEQ ID NO: 3312402 - DNA, 20 bp, Homo sapiens
ccctgcctgggttgggggca

SEQ ID NO: 3312403 - DNA, 24 bp, Homo sapiens
ccctgccttgggccttgctgctgc

SEQ ID NO: 3312404 - DNA, 19 bp, Homo sapiens
ccctgcgaaggggccctgg

SEQ ID NO: 3312405 - DNA, 20 bp, Homo sapiens
ccctgcgaaggggccctggt

SEQ ID NO: 3312406 - DNA, 24 bp, Homo sapiens
ccctgcgggcgcgggcagccaccc

SEQ ID NO: 3312407 - DNA, 23 bp, Homo sapiens
ccctgcggtcaggctgggcagcc

SEQ ID NO: 3312408 - DNA, 21 bp, Homo sapiens
ccctgcgtcctgacgccctgc

SEQ ID NO: 3312409 - DNA, 22 bp, Homo sapiens
ccctgcgtcctgacgccctgcg

SEQ ID NO: 3312410 - DNA, 16 bp, Homo sapiens
ccctgcgttggagcca

SEQ ID NO: 3312411 - DNA, 16 bp, Homo sapiens
ccctgctacctgttct

SEQ ID NO: 3312412 - DNA, 17 bp, Homo sapiens
ccctgctactcctgtgc

SEQ ID NO: 3312413 - DNA, 18 bp, Homo sapiens
ccctgctactcctgtgct

SEQ ID NO: 3312414 - DNA, 21 bp, Homo sapiens
ccctgctactcctgtgctctg

SEQ ID NO: 3312415 - DNA, 16 bp, Homo sapiens
ccctgctcagtaaagc

SEQ ID NO: 3312416 - DNA, 22 bp, Homo sapiens
ccctgctcagtgcttgggctcc

SEQ ID NO: 3312417 - DNA, 16 bp, Homo sapiens
ccctgctccaccagca

SEQ ID NO: 3312418 - DNA, 18 bp, Homo sapiens
ccctgctcccagcctgct

SEQ ID NO: 3312419 - DNA, 21 bp, Homo sapiens
ccctgctcccattcctccctc

SEQ ID NO: 3312420 - DNA, 18 bp, Homo sapiens
ccctgctcctccctggct

SEQ ID NO: 3312421 - DNA, 22 bp, Homo sapiens
ccctgctcctccctggctgccc

SEQ ID NO: 3312422 - DNA, 18 bp, Homo sapiens
ccctgctcctcctgccct

SEQ ID NO: 3312423 - DNA, 13 bp, Homo sapiens
ccctgctcctgca

SEQ ID NO: 3312424 - DNA, 15 bp, Homo sapiens
ccctgctctacccat

SEQ ID NO: 3312425 - DNA, 13 bp, Homo sapiens
ccctgctgcaggg

SEQ ID NO: 3312426 - DNA, 11 bp, Homo sapiens
ccctgctgccc

SEQ ID NO: 3312427 - DNA, 21 bp, Homo sapiens
ccctgctgcccaatctccatc

SEQ ID NO: 3312428 - DNA, 13 bp, Homo sapiens
ccctgctgccttc

SEQ ID NO: 3312429 - DNA, 21 bp, Homo sapiens
ccctgctgtcttccccaccgc

SEQ ID NO: 3312430 - DNA, 23 bp, Homo sapiens
ccctgctgtcttccccaccgcag

SEQ ID NO: 3312431 - DNA, 13 bp, Homo sapiens
ccctgctgtgcca

SEQ ID NO: 3312432 - DNA, 14 bp, Homo sapiens
ccctgctgtgctgc

SEQ ID NO: 3312433 - DNA, 13 bp, Homo sapiens
ccctgctgtggga

SEQ ID NO: 3312434 - DNA, 11 bp, Homo sapiens
ccctgcttctc

SEQ ID NO: 3312435 - DNA, 15 bp, Homo sapiens
ccctgcttctccagc

SEQ ID NO: 3312436 - DNA, 21 bp, Homo sapiens
ccctgcttctccagcctggac

SEQ ID NO: 3312437 - DNA, 22 bp, Homo sapiens
ccctgctttggctgaggggctt

SEQ ID NO: 3312438 - DNA, 20 bp, Homo sapiens
ccctgctttgggctgccctg

SEQ ID NO: 3312439 - DNA, 22 bp, Homo sapiens
ccctgctttgggctgccctggt

SEQ ID NO: 3312440 - DNA, 23 bp, Homo sapiens
ccctgctttgggctgccctggtg

SEQ ID NO: 3312441 - DNA, 13 bp, Homo sapiens
ccctgcttttgca

SEQ ID NO: 3312442 - DNA, 18 bp, Homo sapiens
ccctgctttttttcttaa

SEQ ID NO: 3312443 - DNA, 20 bp, Homo sapiens
ccctggaactctatctgggc

SEQ ID NO: 3312444 - DNA, 23 bp, Homo sapiens
ccctggaactctatctgggcctg

SEQ ID NO: 3312445 - DNA, 21 bp, Homo sapiens
ccctggaaggacatccatgtt

SEQ ID NO: 3312446 - DNA, 20 bp, Homo sapiens
ccctggaattcagcaccctg

SEQ ID NO: 3312447 - DNA, 22 bp, Homo sapiens
ccctggaattcagcaccctggg

SEQ ID NO: 3312448 - DNA, 14 bp, Homo sapiens
ccctggacacagct

SEQ ID NO: 3312449 - DNA, 19 bp, Homo sapiens
ccctggagaaaaaaattgc

SEQ ID NO: 3312450 - DNA, 22 bp, Homo sapiens
ccctggagaaaaaaattgctct

SEQ ID NO: 3312451 - DNA, 13 bp, Homo sapiens
ccctggagcagga

SEQ ID NO: 3312452 - DNA, 16 bp, Homo sapiens
ccctggagccaactgc

SEQ ID NO: 3312453 - DNA, 22 bp, Homo sapiens
ccctggagccaactgctgcttt

SEQ ID NO: 3312454 - DNA, 13 bp, Homo sapiens
ccctggagccaga

SEQ ID NO: 3312455 - DNA, 12 bp, Homo sapiens
ccctggagccca

SEQ ID NO: 3312456 - DNA, 18 bp, Homo sapiens
ccctggaggtctccaggg

SEQ ID NO: 3312457 - DNA, 19 bp, Homo sapiens
ccctggaggtctccagggg

SEQ ID NO: 3312458 - DNA, 21 bp, Homo sapiens
ccctggaggtctccaggggcc

SEQ ID NO: 3312459 - DNA, 15 bp, Homo sapiens
ccctggatgggcatt

SEQ ID NO: 3312460 - DNA, 21 bp, Homo sapiens
ccctggatgggcattgggctg

SEQ ID NO: 3312461 - DNA, 21 bp, Homo sapiens
ccctggatgtgtggggcatgg

SEQ ID NO: 3312462 - DNA, 21 bp, Homo sapiens
ccctggcagcacagcccaggg

SEQ ID NO: 3312463 - DNA, 22 bp, Homo sapiens
ccctggcagcacagcccagggc

SEQ ID NO: 3312464 - DNA, 12 bp, Homo sapiens
ccctggccagcc

SEQ ID NO: 3312465 - DNA, 14 bp, Homo sapiens
ccctggccagccct

SEQ ID NO: 3312466 - DNA, 17 bp, Homo sapiens
ccctggccagcccttcc

SEQ ID NO: 3312467 - DNA, 9 bp, Homo sapiens
ccctggccc

SEQ ID NO: 3312468 - DNA, 14 bp, Homo sapiens
ccctggccctgagg

SEQ ID NO: 3312469 - DNA, 17 bp, Homo sapiens
ccctggccctgaggtgt

SEQ ID NO: 3312470 - DNA, 13 bp, Homo sapiens
ccctggccctgcc

SEQ ID NO: 3312471 - DNA, 20 bp, Homo sapiens
ccctggccctttccccttcc

SEQ ID NO: 3312472 - DNA, 13 bp, Homo sapiens
ccctggcctcccc

SEQ ID NO: 3312473 - DNA, 19 bp, Homo sapiens
ccctggcctcccctgccac

SEQ ID NO: 3312474 - DNA, 22 bp, Homo sapiens
ccctggccttaaaaggggccca

SEQ ID NO: 3312475 - DNA, 17 bp, Homo sapiens
ccctggctcccacaggc

SEQ ID NO: 3312476 - DNA, 16 bp, Homo sapiens
ccctggctccctcctc

SEQ ID NO: 3312477 - DNA, 18 bp, Homo sapiens
ccctggctccctcctcca

SEQ ID NO: 3312478 - DNA, 20 bp, Homo sapiens
ccctggctccctcctccagg

SEQ ID NO: 3312479 - DNA, 23 bp, Homo sapiens
ccctggctccctcctccaggcct

SEQ ID NO: 3312480 - DNA, 19 bp, Homo sapiens
ccctggctctcagaaggta

SEQ ID NO: 3312481 - DNA, 13 bp, Homo sapiens
ccctggctctgca

SEQ ID NO: 3312482 - DNA, 13 bp, Homo sapiens
ccctggctctgct

SEQ ID NO: 3312483 - DNA, 15 bp, Homo sapiens
ccctggctgactggc

SEQ ID NO: 3312484 - DNA, 18 bp, Homo sapiens
ccctggctgactggccag

SEQ ID NO: 3312485 - DNA, 21 bp, Homo sapiens
ccctggctgactggccagttg

SEQ ID NO: 3312486 - DNA, 17 bp, Homo sapiens
ccctggctgccctggcc

SEQ ID NO: 3312487 - DNA, 18 bp, Homo sapiens
ccctggctgctgccccca

SEQ ID NO: 3312488 - DNA, 16 bp, Homo sapiens
ccctggcttgcttgcc

SEQ ID NO: 3312489 - DNA, 17 bp, Homo sapiens
ccctggcttttcactgc

SEQ ID NO: 3312490 - DNA, 20 bp, Homo sapiens
ccctgggagacaactggaca

SEQ ID NO: 3312491 - DNA, 13 bp, Homo sapiens
ccctgggcaggcg

SEQ ID NO: 3312492 - DNA, 15 bp, Homo sapiens
ccctgggcaggcggt

SEQ ID NO: 3312493 - DNA, 22 bp, Homo sapiens
ccctgggcaggcggtccccatc

SEQ ID NO: 3312494 - DNA, 12 bp, Homo sapiens
ccctgggccagg

SEQ ID NO: 3312495 - DNA, 16 bp, Homo sapiens
ccctgggccagggtct

SEQ ID NO: 3312496 - DNA, 17 bp, Homo sapiens
ccctgggccagggtctg

SEQ ID NO: 3312497 - DNA, 14 bp, Homo sapiens
ccctgggcccctcc

SEQ ID NO: 3312498 - DNA, 15 bp, Homo sapiens
ccctgggcccctcca

SEQ ID NO: 3312499 - DNA, 19 bp, Homo sapiens
ccctgggcccctccacgcc

SEQ ID NO: 3312500 - DNA, 22 bp, Homo sapiens
ccctgggcccctccacgcctcc

SEQ ID NO: 3312501 - DNA, 18 bp, Homo sapiens
ccctgggccctgggctgg

SEQ ID NO: 3312502 - DNA, 18 bp, Homo sapiens
ccctgggcctcatcacag

SEQ ID NO: 3312503 - DNA, 15 bp, Homo sapiens
ccctgggctctgccc

SEQ ID NO: 3312504 - DNA, 14 bp, Homo sapiens
ccctgggctggaat

SEQ ID NO: 3312505 - DNA, 20 bp, Homo sapiens
ccctgggcttggcctgctgt

SEQ ID NO: 3312506 - DNA, 21 bp, Homo sapiens
ccctgggcttggcctgctgtg

SEQ ID NO: 3312507 - DNA, 18 bp, Homo sapiens
ccctggggaaggagccag

SEQ ID NO: 3312508 - DNA, 17 bp, Homo sapiens
ccctggggacccccacg

SEQ ID NO: 3312509 - DNA, 14 bp, Homo sapiens
ccctggggctgggc

SEQ ID NO: 3312510 - DNA, 15 bp, Homo sapiens
ccctggggcttctcc

SEQ ID NO: 3312511 - DNA, 19 bp, Homo sapiens
ccctggggcttctcctgac

SEQ ID NO: 3312512 - DNA, 13 bp, Homo sapiens
ccctgggtgccat

SEQ ID NO: 3312513 - DNA, 21 bp, Homo sapiens
ccctgggtgggtggtggggag

SEQ ID NO: 3312514 - DNA, 22 bp, Homo sapiens
ccctgggtgggtggtggggagg

SEQ ID NO: 3312515 - DNA, 23 bp, Homo sapiens
ccctgggtgggtggtggggaggg

SEQ ID NO: 3312516 - DNA, 12 bp, Homo sapiens
ccctggtctccg

SEQ ID NO: 3312517 - DNA, 15 bp, Homo sapiens
ccctggtgcctggct

SEQ ID NO: 3312518 - DNA, 15 bp, Homo sapiens
ccctggtgctgccac

SEQ ID NO: 3312519 - DNA, 16 bp, Homo sapiens
ccctggtgctgccaca

SEQ ID NO: 3312520 - DNA, 21 bp, Homo sapiens
ccctggtgctgccacacttca

SEQ ID NO: 3312521 - DNA, 20 bp, Homo sapiens
ccctggtggacagtcctggg

SEQ ID NO: 3312522 - DNA, 21 bp, Homo sapiens
ccctggtggacagtcctggga

SEQ ID NO: 3312523 - DNA, 13 bp, Homo sapiens
ccctggtggcagt

SEQ ID NO: 3312524 - DNA, 15 bp, Homo sapiens
ccctggtggcagtgg

SEQ ID NO: 3312525 - DNA, 22 bp, Homo sapiens
ccctggtggcagtgggagctgc

SEQ ID NO: 3312526 - DNA, 14 bp, Homo sapiens
ccctggtgtgtttc

SEQ ID NO: 3312527 - DNA, 14 bp, Homo sapiens
ccggccacctctgc

SEQ ID NO: 3312528 - DNA, 13 bp, Homo sapiens
ccggccagcgggc

SEQ ID NO: 3312529 - DNA, 18 bp, Homo sapiens
ccggccagcgggcacagg

SEQ ID NO: 3312530 - DNA, 19 bp, Homo sapiens
ccggccagcgggcacaggg

SEQ ID NO: 3312531 - DNA, 22 bp, Homo sapiens
ccggccagcgggcacagggcac

SEQ ID NO: 3312532 - DNA, 18 bp, Homo sapiens
ccggcccagtgccactgc

SEQ ID NO: 3312533 - DNA, 15 bp, Homo sapiens
ccggccccagccaga

SEQ ID NO: 3312534 - DNA, 21 bp, Homo sapiens
ccggccccccgcgctcgccca

SEQ ID NO: 3312535 - DNA, 15 bp, Homo sapiens
ccggcccctggcagc

SEQ ID NO: 3312536 - DNA, 13 bp, Homo sapiens
ccggcctcagggc

SEQ ID NO: 3312537 - DNA, 15 bp, Homo sapiens
ccggcctctctggcc

SEQ ID NO: 3312538 - DNA, 18 bp, Homo sapiens
ccggcctcttccacccat

SEQ ID NO: 3312539 - DNA, 12 bp, Homo sapiens
ccggcctggcac

SEQ ID NO: 3312540 - DNA, 19 bp, Homo sapiens
ccggcgctgattcctcgtg

SEQ ID NO: 3312541 - DNA, 19 bp, Homo sapiens
ccggcgggatgttgaactg

SEQ ID NO: 3312542 - DNA, 23 bp, Homo sapiens
ccggctatgggggcactgaggac

SEQ ID NO: 3312543 - DNA, 13 bp, Homo sapiens
ccggctccaggct

SEQ ID NO: 3312544 - DNA, 18 bp, Homo sapiens
ccggctcgtgtatttatt

SEQ ID NO: 3312545 - DNA, 12 bp, Homo sapiens
ccggctgcctgc

SEQ ID NO: 3312546 - DNA, 13 bp, Homo sapiens
ccggctgcctgcc

SEQ ID NO: 3312547 - DNA, 23 bp, Homo sapiens
ccggctgggtcggccctgcccaa

SEQ ID NO: 3312548 - DNA, 17 bp, Homo sapiens
ccggctgtgctcagaga

SEQ ID NO: 3312549 - DNA, 13 bp, Homo sapiens
ccggctgtggagc

SEQ ID NO: 3312550 - DNA, 15 bp, Homo sapiens
ccgggacccacggag

SEQ ID NO: 3312551 - DNA, 23 bp, Homo sapiens
ccgggagaaggcatgagaaagaa

SEQ ID NO: 3312552 - DNA, 19 bp, Homo sapiens
ccgggagcctaggaccact

SEQ ID NO: 3312553 - DNA, 20 bp, Homo sapiens
ccgggagcctccccctcaga

SEQ ID NO: 3312554 - DNA, 12 bp, Homo sapiens
ccgggcaaaggg

SEQ ID NO: 3312555 - DNA, 15 bp, Homo sapiens
ccgggcaggtcctgc

SEQ ID NO: 3312556 - DNA, 17 bp, Homo sapiens
ccgggccacgccccagc

SEQ ID NO: 3312557 - DNA, 19 bp, Homo sapiens
ccgggctccatgcctctgg

SEQ ID NO: 3312558 - DNA, 14 bp, Homo sapiens
ccgggctctctgct

SEQ ID NO: 3312559 - DNA, 16 bp, Homo sapiens
ccgggctctctgctgt

SEQ ID NO: 3312560 - DNA, 17 bp, Homo sapiens
ccgggctggagaaagag

SEQ ID NO: 3312561 - DNA, 16 bp, Homo sapiens
ccggggaagctgccag

SEQ ID NO: 3312562 - DNA, 20 bp, Homo sapiens
ccggggaagctgccagccca

SEQ ID NO: 3312563 - DNA, 16 bp, Homo sapiens
ccggggccagcaccac

SEQ ID NO: 3312564 - DNA, 15 bp, Homo sapiens
ccggggccagcactt

SEQ ID NO: 3312565 - DNA, 22 bp, Homo sapiens
ccggggccctctctgcaccgga

SEQ ID NO: 3312566 - DNA, 20 bp, Homo sapiens
ccggggcgcctagagcgcgg

SEQ ID NO: 3312567 - DNA, 16 bp, Homo sapiens
ccggggctggcaagca

SEQ ID NO: 3312568 - DNA, 20 bp, Homo sapiens
ccggggctggcaagcaggga

SEQ ID NO: 3312569 - DNA, 14 bp, Homo sapiens
ccgggggagcccag

SEQ ID NO: 3312570 - DNA, 15 bp, Homo sapiens
ccgggggaggaaggg

SEQ ID NO: 3312571 - DNA, 13 bp, Homo sapiens
ccggggtctgtgc

SEQ ID NO: 3312572 - DNA, 17 bp, Homo sapiens
ccggggtctgtgctgtg

SEQ ID NO: 3312573 - DNA, 18 bp, Homo sapiens
ccgggtctcaggcctcca

SEQ ID NO: 3312574 - DNA, 18 bp, Homo sapiens
ccgggtgggcctggcctg

SEQ ID NO: 3312575 - DNA, 19 bp, Homo sapiens
ccgggtgggcctggcctga

SEQ ID NO: 3312576 - DNA, 13 bp, Homo sapiens
ccgggtgtggcct

SEQ ID NO: 3312577 - DNA, 23 bp, Homo sapiens
ccgggttcgcaccattctcctgc

SEQ ID NO: 3312578 - DNA, 20 bp, Homo sapiens
ccgggttctagtctcctttg

SEQ ID NO: 3312579 - DNA, 18 bp, Homo sapiens
ccggtagggaggcagcct

SEQ ID NO: 3312580 - DNA, 15 bp, Homo sapiens
ccggtccagctggcc

SEQ ID NO: 3312581 - DNA, 20 bp, Homo sapiens
ccggtcccacccctccctct

SEQ ID NO: 3312582 - DNA, 12 bp, Homo sapiens
ccggtcccctgc

SEQ ID NO: 3312583 - DNA, 19 bp, Homo sapiens
ccggtcccctgcctggaac

SEQ ID NO: 3312584 - DNA, 17 bp, Homo sapiens
ccggtcgggcagccagc

SEQ ID NO: 3312585 - DNA, 20 bp, Homo sapiens
ccggtctgcaagtcagagga

SEQ ID NO: 3312586 - DNA, 21 bp, Homo sapiens
ccggtggcggcagggccaggc

SEQ ID NO: 3312587 - DNA, 13 bp, Homo sapiens
ccggtggtgcccg

SEQ ID NO: 3312588 - DNA, 17 bp, Homo sapiens
ccggtggtttgccatgt

SEQ ID NO: 3312589 - DNA, 16 bp, Homo sapiens
ccggtgtgcctgcagc

SEQ ID NO: 3312590 - DNA, 19 bp, Homo sapiens
ccgtaataacacccttcct

SEQ ID NO: 3312591 - DNA, 14 bp, Homo sapiens
ccgtaccccaccct

SEQ ID NO: 3312592 - DNA, 15 bp, Homo sapiens
ccgtaccccaccctc

SEQ ID NO: 3312593 - DNA, 12 bp, Homo sapiens
ccgtactctcac

SEQ ID NO: 3312594 - DNA, 15 bp, Homo sapiens
ccgtagtctcctggg

SEQ ID NO: 3312595 - DNA, 19 bp, Homo sapiens
ccgtagtctcctgggtgtg

SEQ ID NO: 3312596 - DNA, 15 bp, Homo sapiens
ccgtatatgtctaca

SEQ ID NO: 3312597 - DNA, 17 bp, Homo sapiens
ccgtcacccctgtttct

SEQ ID NO: 3312598 - DNA, 15 bp, Homo sapiens
ccgtcatgttcctca

SEQ ID NO: 3312599 - DNA, 14 bp, Homo sapiens
ccgtcattgctgct

SEQ ID NO: 3312600 - DNA, 19 bp, Homo sapiens
ccgtcattgctgctgctac

SEQ ID NO: 3312601 - DNA, 15 bp, Homo sapiens
ccgtccacccaggct

SEQ ID NO: 3312602 - DNA, 23 bp, Homo sapiens
ccgtccacccaggctgcactgca

SEQ ID NO: 3312603 - DNA, 23 bp, Homo sapiens
ccgtccatggcaccagccccctg

SEQ ID NO: 3312604 - DNA, 16 bp, Homo sapiens
ccgtcctcacccctgt

SEQ ID NO: 3312605 - DNA, 23 bp, Homo sapiens
ccgtcctcacccctgtcctcact

SEQ ID NO: 3312606 - DNA, 24 bp, Homo sapiens
ccgtcctcacccctgtcctcactg

SEQ ID NO: 3312607 - DNA, 16 bp, Homo sapiens
ccgtcctgcctgtggc

SEQ ID NO: 3312608 - DNA, 21 bp, Homo sapiens
ccgtcgaggggctctcagctc

SEQ ID NO: 3312609 - DNA, 11 bp, Homo sapiens
ccgtctacatt

SEQ ID NO: 3312610 - DNA, 13 bp, Homo sapiens
ccgtctcctccct

SEQ ID NO: 3312611 - DNA, 17 bp, Homo sapiens
ccgtctgactccagagt

SEQ ID NO: 3312612 - DNA, 17 bp, Homo sapiens
ccgtgaagcagtgcctc

SEQ ID NO: 3312613 - DNA, 22 bp, Homo sapiens
ccgtgagcaggaaggcctgggt

SEQ ID NO: 3312614 - DNA, 17 bp, Homo sapiens
ccgtgagttctcagggc

SEQ ID NO: 3312615 - DNA, 20 bp, Homo sapiens
ccgtgagttctcagggctcc

SEQ ID NO: 3312616 - DNA, 17 bp, Homo sapiens
ccgtgatgctcaggctt

SEQ ID NO: 3312617 - DNA, 24 bp, Homo sapiens
ccgtgatggagaggacagagcagg

SEQ ID NO: 3312618 - DNA, 16 bp, Homo sapiens
ccgtgcagtacaggca

SEQ ID NO: 3312619 - DNA, 20 bp, Homo sapiens
ccgtgccaaagtctcccttc

SEQ ID NO: 3312620 - DNA, 17 bp, Homo sapiens
ccgtgcccgcaggaact

SEQ ID NO: 3312621 - DNA, 23 bp, Homo sapiens
ccgtgcccgcaggaactgggctg

SEQ ID NO: 3312622 - DNA, 14 bp, Homo sapiens
ccgtgcctccacca

SEQ ID NO: 3312623 - DNA, 22 bp, Homo sapiens
ccgtgcctccaccaccactggc

SEQ ID NO: 3312624 - DNA, 14 bp, Homo sapiens
ccgtgccttcagct

SEQ ID NO: 3312625 - DNA, 16 bp, Homo sapiens
ccgtgccttcagctct

SEQ ID NO: 3312626 - DNA, 20 bp, Homo sapiens
ccgtgctgtcttctggtctg

SEQ ID NO: 3312627 - DNA, 14 bp, Homo sapiens
ccgtggacaggccc

SEQ ID NO: 3312628 - DNA, 15 bp, Homo sapiens
ccgtggacaggccca

SEQ ID NO: 3312629 - DNA, 16 bp, Homo sapiens
ccgtggacaggcccag

SEQ ID NO: 3312630 - DNA, 21 bp, Homo sapiens
ccgtggacaggcccagcgcgg

SEQ ID NO: 3312631 - DNA, 20 bp, Homo sapiens
ccgtggaggaggaaggcaag

SEQ ID NO: 3312632 - DNA, 23 bp, Homo sapiens
ccgtggaggaggaaggcaagagg

SEQ ID NO: 3312633 - DNA, 17 bp, Homo sapiens
ccgtggccatccctgtg

SEQ ID NO: 3312634 - DNA, 16 bp, Homo sapiens
ccgtggccctgccctc

SEQ ID NO: 3312635 - DNA, 14 bp, Homo sapiens
ccgtggcttcccgc

SEQ ID NO: 3312636 - DNA, 17 bp, Homo sapiens
ccgtgggtcattacaaa

SEQ ID NO: 3312637 - DNA, 18 bp, Homo sapiens
ccgtggtagaggcctggg

SEQ ID NO: 3312638 - DNA, 20 bp, Homo sapiens
ccgtggtagaggcctggggc

SEQ ID NO: 3312639 - DNA, 19 bp, Homo sapiens
ccgtggtcagagtgccact

SEQ ID NO: 3312640 - DNA, 20 bp, Homo sapiens
ccgtggtgacatttcccaag

SEQ ID NO: 3312641 - DNA, 21 bp, Homo sapiens
ccgtggtggcaccgagaccaa

SEQ ID NO: 3312642 - DNA, 16 bp, Homo sapiens
ccgtgtcccaaggagc

SEQ ID NO: 3312643 - DNA, 18 bp, Homo sapiens
ccgtgtcccaaggagctg

SEQ ID NO: 3312644 - DNA, 14 bp, Homo sapiens
ccgtgtcctctccc

SEQ ID NO: 3312645 - DNA, 19 bp, Homo sapiens
ccgtgtcctctccctgcca

SEQ ID NO: 3312646 - DNA, 17 bp, Homo sapiens
ccgtgtctgtctggcac

SEQ ID NO: 3312647 - DNA, 22 bp, Homo sapiens
ccgtgtgagaagtgaatgctgg

SEQ ID NO: 3312648 - DNA, 23 bp, Homo sapiens
ccgtgtgagaagtgaatgctggg

SEQ ID NO: 3312649 - DNA, 18 bp, Homo sapiens
ccgtgtgagtgtgacagg

SEQ ID NO: 3312650 - DNA, 20 bp, Homo sapiens
ccgtgtgagtgtgacagggc

SEQ ID NO: 3312651 - DNA, 13 bp, Homo sapiens
ccgtgtggacaca

SEQ ID NO: 3312652 - DNA, 15 bp, Homo sapiens
ccgtgttagccagga

SEQ ID NO: 3312653 - DNA, 17 bp, Homo sapiens
cctcacacaccctgagg

SEQ ID NO: 3312654 - DNA, 23 bp, Homo sapiens
cctcacacaccctgaggtcaggg

SEQ ID NO: 3312655 - DNA, 13 bp, Homo sapiens
cctcacagcctct

SEQ ID NO: 3312656 - DNA, 14 bp, Homo sapiens
cctcacagcctctg

SEQ ID NO: 3312657 - DNA, 19 bp, Homo sapiens
cctcacagcctctgacccc

SEQ ID NO: 3312658 - DNA, 21 bp, Homo sapiens
cctcacagcctctgacccctc

SEQ ID NO: 3312659 - DNA, 19 bp, Homo sapiens
cctcacagccttggctcct

SEQ ID NO: 3312660 - DNA, 16 bp, Homo sapiens
cctcaccattgtgaag

SEQ ID NO: 3312661 - DNA, 19 bp, Homo sapiens
cctcacccccagctttgct

SEQ ID NO: 3312662 - DNA, 19 bp, Homo sapiens
cctcaccccctcctggcaa

SEQ ID NO: 3312663 - DNA, 20 bp, Homo sapiens
cctcacccctgtcctcactg

SEQ ID NO: 3312664 - DNA, 14 bp, Homo sapiens
cctcaccctgcctt

SEQ ID NO: 3312665 - DNA, 17 bp, Homo sapiens
cctcaccgcttccctcc

SEQ ID NO: 3312666 - DNA, 22 bp, Homo sapiens
cctcacctaataggctgggaga

SEQ ID NO: 3312667 - DNA, 15 bp, Homo sapiens
cctcacctcatgccc

SEQ ID NO: 3312668 - DNA, 17 bp, Homo sapiens
cctcacctcatgcccac

SEQ ID NO: 3312669 - DNA, 22 bp, Homo sapiens
cctcacctcatgcccaccccct

SEQ ID NO: 3312670 - DNA, 14 bp, Homo sapiens
cctcacctcctcta

SEQ ID NO: 3312671 - DNA, 12 bp, Homo sapiens
cctcacctctgg

SEQ ID NO: 3312672 - DNA, 13 bp, Homo sapiens
cctcacctctgga

SEQ ID NO: 3312673 - DNA, 20 bp, Homo sapiens
cctcacctctggactggcta

SEQ ID NO: 3312674 - DNA, 22 bp, Homo sapiens
cctcacctctggactggctaga

SEQ ID NO: 3312675 - DNA, 14 bp, Homo sapiens
cctcacctgtctag

SEQ ID NO: 3312676 - DNA, 21 bp, Homo sapiens
cctcaccttgtaaccagtgca

SEQ ID NO: 3312677 - DNA, 20 bp, Homo sapiens
cctcactatggtatgctggc

SEQ ID NO: 3312678 - DNA, 12 bp, Homo sapiens
cctcactctgcc

SEQ ID NO: 3312679 - DNA, 19 bp, Homo sapiens
cctcactctgccagggcag

SEQ ID NO: 3312680 - DNA, 22 bp, Homo sapiens
cctcactctgccagggcagtgc

SEQ ID NO: 3312681 - DNA, 17 bp, Homo sapiens
cctcactctgtcagcca

SEQ ID NO: 3312682 - DNA, 18 bp, Homo sapiens
cctcactctgtcagccag

SEQ ID NO: 3312683 - DNA, 20 bp, Homo sapiens
cctcactctgtcagccagcc

SEQ ID NO: 3312684 - DNA, 21 bp, Homo sapiens
cctcactgagaggcctggagc

SEQ ID NO: 3312685 - DNA, 14 bp, Homo sapiens
cctcactgcccgca

SEQ ID NO: 3312686 - DNA, 18 bp, Homo sapiens
cctcactgcccgcacacc

SEQ ID NO: 3312687 - DNA, 20 bp, Homo sapiens
cctcactgcccgcacaccct

SEQ ID NO: 3312688 - DNA, 21 bp, Homo sapiens
cctcactgcccgcacaccctc

SEQ ID NO: 3312689 - DNA, 21 bp, Homo sapiens
cctcactggaggagcagcttc

SEQ ID NO: 3312690 - DNA, 14 bp, Homo sapiens
cctcactggatgaa

SEQ ID NO: 3312691 - DNA, 17 bp, Homo sapiens
cctcactggccatccct

SEQ ID NO: 3312692 - DNA, 18 bp, Homo sapiens
cctcactggccatccctc

SEQ ID NO: 3312693 - DNA, 13 bp, Homo sapiens
cctcactggctgg

SEQ ID NO: 3312694 - DNA, 14 bp, Homo sapiens
cctcactgggtggg

SEQ ID NO: 3312695 - DNA, 16 bp, Homo sapiens
cctcactgttgaattt

SEQ ID NO: 3312696 - DNA, 15 bp, Homo sapiens
cctcagaaagtcacc

SEQ ID NO: 3312697 - DNA, 21 bp, Homo sapiens
cctcagagcatttaaggaaac

SEQ ID NO: 3312698 - DNA, 19 bp, Homo sapiens
cctcagagccctgccctgc

SEQ ID NO: 3312699 - DNA, 17 bp, Homo sapiens
cctcagatctgaacaca

SEQ ID NO: 3312700 - DNA, 13 bp, Homo sapiens
cctcagcacccct

SEQ ID NO: 3312701 - DNA, 22 bp, Homo sapiens
cctcagcaccccttccatgtgg

SEQ ID NO: 3312702 - DNA, 12 bp, Homo sapiens
cctcagccccca

SEQ ID NO: 3312703 - DNA, 18 bp, Homo sapiens
cctcagcccccaggccag

SEQ ID NO: 3312704 - DNA, 11 bp, Homo sapiens
cctcagccctc

SEQ ID NO: 3312705 - DNA, 11 bp, Homo sapiens
cctcagccctt

SEQ ID NO: 3312706 - DNA, 22 bp, Homo sapiens
cctcagcccttgcccccatccc

SEQ ID NO: 3312707 - DNA, 16 bp, Homo sapiens
cctcagcctagaccct

SEQ ID NO: 3312708 - DNA, 20 bp, Homo sapiens
cctcagcctagaccctcctc

SEQ ID NO: 3312709 - DNA, 15 bp, Homo sapiens
cctcagcctcagagg

SEQ ID NO: 3312710 - DNA, 17 bp, Homo sapiens
cctcagcctcagaggag

SEQ ID NO: 3312711 - DNA, 21 bp, Homo sapiens
cctcagcctcccaaagtgctg

SEQ ID NO: 3312712 - DNA, 22 bp, Homo sapiens
cctcagcctcccaaagtgctgg

SEQ ID NO: 3312713 - DNA, 22 bp, Homo sapiens
cctcagcctcccaagtagctgg

SEQ ID NO: 3312714 - DNA, 12 bp, Homo sapiens
cctcagcctccg

SEQ ID NO: 3312715 - DNA, 12 bp, Homo sapiens
cctcagccttaa

SEQ ID NO: 3312716 - DNA, 18 bp, Homo sapiens
cctcagctctgggagagg

SEQ ID NO: 3312717 - DNA, 14 bp, Homo sapiens
cctcagctgaatgc

SEQ ID NO: 3312718 - DNA, 14 bp, Homo sapiens
cctcagctgcctca

SEQ ID NO: 3312719 - DNA, 14 bp, Homo sapiens
cctcagctggctgt

SEQ ID NO: 3312720 - DNA, 20 bp, Homo sapiens
cctcagctggttactcaggg

SEQ ID NO: 3312721 - DNA, 21 bp, Homo sapiens
cctcagctggttactcagggt

SEQ ID NO: 3312722 - DNA, 23 bp, Homo sapiens
cctcagctggttactcagggttc

SEQ ID NO: 3312723 - DNA, 10 bp, Homo sapiens
cctcaggaat

SEQ ID NO: 3312724 - DNA, 19 bp, Homo sapiens
cctcaggaggcaggacctt

SEQ ID NO: 3312725 - DNA, 15 bp, Homo sapiens
cctcaggcacacagc

SEQ ID NO: 3312726 - DNA, 17 bp, Homo sapiens
cctcaggcacacagcta

SEQ ID NO: 3312727 - DNA, 15 bp, Homo sapiens
cctcaggcactagcc

SEQ ID NO: 3312728 - DNA, 16 bp, Homo sapiens
cctcaggcactagcct

SEQ ID NO: 3312729 - DNA, 17 bp, Homo sapiens
cctcaggcactagcctt

SEQ ID NO: 3312730 - DNA, 18 bp, Homo sapiens
cctcaggcactagccttt

SEQ ID NO: 3312731 - DNA, 13 bp, Homo sapiens
cctcaggctctgc

SEQ ID NO: 3312732 - DNA, 19 bp, Homo sapiens
cctcagggagcagggaagg

SEQ ID NO: 3312733 - DNA, 11 bp, Homo sapiens
cctcagggcac

SEQ ID NO: 3312734 - DNA, 22 bp, Homo sapiens
cctcagggcacgcaggaccagt

SEQ ID NO: 3312735 - DNA, 18 bp, Homo sapiens
cctcagggccaggaagga

SEQ ID NO: 3312736 - DNA, 17 bp, Homo sapiens
cctcagggctcccaggg

SEQ ID NO: 3312737 - DNA, 21 bp, Homo sapiens
cctcaggtggccagcctggat

SEQ ID NO: 3312738 - DNA, 24 bp, Homo sapiens
cctcaggtgttttttatgaagtgc

SEQ ID NO: 3312739 - DNA, 23 bp, Homo sapiens
cctcaggttcctatggctggcca

SEQ ID NO: 3312740 - DNA, 18 bp, Homo sapiens
cctcaggttctattttct

SEQ ID NO: 3312741 - DNA, 22 bp, Homo sapiens
cctcaggttctattttcttaaa

SEQ ID NO: 3312742 - DNA, 16 bp, Homo sapiens
cctcaggttgctggtt

SEQ ID NO: 3312743 - DNA, 21 bp, Homo sapiens
cctcaggttgctggttgctgt

SEQ ID NO: 3312744 - DNA, 22 bp, Homo sapiens
cctcagtaacatttctgttctc

SEQ ID NO: 3312745 - DNA, 16 bp, Homo sapiens
cctcagtatatttaaa

SEQ ID NO: 3312746 - DNA, 22 bp, Homo sapiens
cctcagtcagttcccggagcac

SEQ ID NO: 3312747 - DNA, 17 bp, Homo sapiens
cctcagtcctcccctca

SEQ ID NO: 3312748 - DNA, 18 bp, Homo sapiens
cctcagtcctcccctcac

SEQ ID NO: 3312749 - DNA, 19 bp, Homo sapiens
cctcagtcctcccctcaca

SEQ ID NO: 3312750 - DNA, 13 bp, Homo sapiens
cctcagtgaccca

SEQ ID NO: 3312751 - DNA, 16 bp, Homo sapiens
cctcagtgagataaat

SEQ ID NO: 3312752 - DNA, 16 bp, Homo sapiens
cctcagtggatcttca

SEQ ID NO: 3312753 - DNA, 12 bp, Homo sapiens
cctcagtggcag

SEQ ID NO: 3312754 - DNA, 13 bp, Homo sapiens
cctcagtggcagc

SEQ ID NO: 3312755 - DNA, 17 bp, Homo sapiens
cctcagttcccagctcc

SEQ ID NO: 3312756 - DNA, 16 bp, Homo sapiens
cctcagttcccttggc

SEQ ID NO: 3312757 - DNA, 19 bp, Homo sapiens
cctcagttcccttggcctc

SEQ ID NO: 3312758 - DNA, 15 bp, Homo sapiens
cctcagttggaatca

SEQ ID NO: 3312759 - DNA, 16 bp, Homo sapiens
cctcagttggaatcat

SEQ ID NO: 3312760 - DNA, 19 bp, Homo sapiens
cctcagtttctccatcagc

SEQ ID NO: 3312761 - DNA, 19 bp, Homo sapiens
cctcagttttatcattttc

SEQ ID NO: 3312762 - DNA, 20 bp, Homo sapiens
cctcatagtatggtggctgg

SEQ ID NO: 3312763 - DNA, 21 bp, Homo sapiens
cctcatcacagcaatatttaa

SEQ ID NO: 3312764 - DNA, 13 bp, Homo sapiens
cctcatcaggatg

SEQ ID NO: 3312765 - DNA, 14 bp, Homo sapiens
cctcatcaggatga

SEQ ID NO: 3312766 - DNA, 21 bp, Homo sapiens
cctcatcaggatgaacccagg

SEQ ID NO: 3312767 - DNA, 13 bp, Homo sapiens
cctcatcccatga

SEQ ID NO: 3312768 - DNA, 18 bp, Homo sapiens
cctcatcccctcgtcctg

SEQ ID NO: 3312769 - DNA, 23 bp, Homo sapiens
cctcatcccctcgtcctgtccca

SEQ ID NO: 3312770 - DNA, 11 bp, Homo sapiens
cctcatccctc

SEQ ID NO: 3312771 - DNA, 21 bp, Homo sapiens
cctcatcgcgtcctcctaccg

SEQ ID NO: 3312772 - DNA, 15 bp, Homo sapiens
cctcatctgtggagc

SEQ ID NO: 3312773 - DNA, 15 bp, Homo sapiens
cctcatctttctcct

SEQ ID NO: 3312774 - DNA, 17 bp, Homo sapiens
cctcatgccacaccttc

SEQ ID NO: 3312775 - DNA, 20 bp, Homo sapiens
cctcatgccacaccttcttc

SEQ ID NO: 3312776 - DNA, 21 bp, Homo sapiens
cctcatgcccaccccctgccc

SEQ ID NO: 3312777 - DNA, 14 bp, Homo sapiens
cctcatgcctgctg

SEQ ID NO: 3312778 - DNA, 15 bp, Homo sapiens
cctcatgcctgctga

SEQ ID NO: 3312779 - DNA, 15 bp, Homo sapiens
cctctagtgccctcc

SEQ ID NO: 3312780 - DNA, 15 bp, Homo sapiens
cctctatacatctct

SEQ ID NO: 3312781 - DNA, 19 bp, Homo sapiens
cctctatacatctctcccc

SEQ ID NO: 3312782 - DNA, 21 bp, Homo sapiens
cctctatttatgtttgcactt

SEQ ID NO: 3312783 - DNA, 14 bp, Homo sapiens
cctctcacctcagc

SEQ ID NO: 3312784 - DNA, 13 bp, Homo sapiens
cctctcactcctg

SEQ ID NO: 3312785 - DNA, 17 bp, Homo sapiens
cctctcagaggcctgct

SEQ ID NO: 3312786 - DNA, 13 bp, Homo sapiens
cctctcagctcca

SEQ ID NO: 3312787 - DNA, 15 bp, Homo sapiens
cctctcaggatccaa

SEQ ID NO: 3312788 - DNA, 17 bp, Homo sapiens
cctctcagttctctccc

SEQ ID NO: 3312789 - DNA, 23 bp, Homo sapiens
cctctcatcagtgtcctcttgct

SEQ ID NO: 3312790 - DNA, 19 bp, Homo sapiens
cctctccaagggcttctgc

SEQ ID NO: 3312791 - DNA, 21 bp, Homo sapiens
cctctccaagggcttctgcac

SEQ ID NO: 3312792 - DNA, 21 bp, Homo sapiens
cctctccaagtctctctgtga

SEQ ID NO: 3312793 - DNA, 22 bp, Homo sapiens
cctctccaagtctctctgtgaa

SEQ ID NO: 3312794 - DNA, 16 bp, Homo sapiens
cctctccactccatgt

SEQ ID NO: 3312795 - DNA, 13 bp, Homo sapiens
cctctccactgcc

SEQ ID NO: 3312796 - DNA, 19 bp, Homo sapiens
cctctccactgccttcgat

SEQ ID NO: 3312797 - DNA, 14 bp, Homo sapiens
cctctccaggcacc

SEQ ID NO: 3312798 - DNA, 17 bp, Homo sapiens
cctctccaggcaccctt

SEQ ID NO: 3312799 - DNA, 14 bp, Homo sapiens
cctctcccaggccc

SEQ ID NO: 3312800 - DNA, 22 bp, Homo sapiens
cctctcccatccccctgccctc

SEQ ID NO: 3312801 - DNA, 23 bp, Homo sapiens
cctctccccaggtccagctctgg

SEQ ID NO: 3312802 - DNA, 13 bp, Homo sapiens
cctctcccctcca

SEQ ID NO: 3312803 - DNA, 23 bp, Homo sapiens
cctctcccggctgcctgccgccc

SEQ ID NO: 3312804 - DNA, 17 bp, Homo sapiens
cctctcccgtcagggcc

SEQ ID NO: 3312805 - DNA, 19 bp, Homo sapiens
cctctcccgtcagggccca

SEQ ID NO: 3312806 - DNA, 15 bp, Homo sapiens
cctctcctactcact

SEQ ID NO: 3312807 - DNA, 22 bp, Homo sapiens
cctctcctgggggtggcaggca

SEQ ID NO: 3312808 - DNA, 14 bp, Homo sapiens
cctctcctgtctgc

SEQ ID NO: 3312809 - DNA, 13 bp, Homo sapiens
cctctccttccta

SEQ ID NO: 3312810 - DNA, 17 bp, Homo sapiens
cctctccttccttaccc

SEQ ID NO: 3312811 - DNA, 20 bp, Homo sapiens
cctctccttgggctcctggc

SEQ ID NO: 3312812 - DNA, 14 bp, Homo sapiens
cctctcctttgaaa

SEQ ID NO: 3312813 - DNA, 17 bp, Homo sapiens
cctctccttttgaggct

SEQ ID NO: 3312814 - DNA, 17 bp, Homo sapiens
cctctcggaaggctggc

SEQ ID NO: 3312815 - DNA, 15 bp, Homo sapiens
cctctcggccaggca

SEQ ID NO: 3312816 - DNA, 19 bp, Homo sapiens
cctctctactggagtggaa

SEQ ID NO: 3312817 - DNA, 13 bp, Homo sapiens
cctctctcagagc

SEQ ID NO: 3312818 - DNA, 24 bp, Homo sapiens
cctctctcagagcatctggctgtt

SEQ ID NO: 3312819 - DNA, 16 bp, Homo sapiens
cctctctcccatttca

SEQ ID NO: 3312820 - DNA, 12 bp, Homo sapiens
cctctctccctc

SEQ ID NO: 3312821 - DNA, 10 bp, Homo sapiens
cctctctctt

SEQ ID NO: 3312822 - DNA, 19 bp, Homo sapiens
cctctctcttctgctccac

SEQ ID NO: 3312823 - DNA, 21 bp, Homo sapiens
cctctctcttctgctccaccc

SEQ ID NO: 3312824 - DNA, 15 bp, Homo sapiens
cctctctggcctccc

SEQ ID NO: 3312825 - DNA, 17 bp, Homo sapiens
cctctctggcctcccac

SEQ ID NO: 3312826 - DNA, 18 bp, Homo sapiens
cctctctggcctcccacc

SEQ ID NO: 3312827 - DNA, 22 bp, Homo sapiens
cctctctggcctcccacccgat

SEQ ID NO: 3312828 - DNA, 23 bp, Homo sapiens
cctctctgtagtttatggcagaa

SEQ ID NO: 3312829 - DNA, 15 bp, Homo sapiens
cctctctttgttctc

SEQ ID NO: 3312830 - DNA, 21 bp, Homo sapiens
cctctctttgttctcagctcc

SEQ ID NO: 3312831 - DNA, 22 bp, Homo sapiens
cctctctttgttctcagctccc

SEQ ID NO: 3312832 - DNA, 17 bp, Homo sapiens
cctctcttttccccgcc

SEQ ID NO: 3312833 - DNA, 18 bp, Homo sapiens
cctctcttttccccgcct

SEQ ID NO: 3312834 - DNA, 21 bp, Homo sapiens
cctctcttttccccgcctgca

SEQ ID NO: 3312835 - DNA, 17 bp, Homo sapiens
cctctgacacacagctc

SEQ ID NO: 3312836 - DNA, 21 bp, Homo sapiens
cctctgacacacagctctgtc

SEQ ID NO: 3312837 - DNA, 13 bp, Homo sapiens
cctctgaccaaca

SEQ ID NO: 3312838 - DNA, 17 bp, Homo sapiens
cctctgaccaacaggct

SEQ ID NO: 3312839 - DNA, 13 bp, Homo sapiens
cctctgacccctc

SEQ ID NO: 3312840 - DNA, 16 bp, Homo sapiens
cctctgacctgcaggc

SEQ ID NO: 3312841 - DNA, 20 bp, Homo sapiens
cctctgacctgcaggccaag

SEQ ID NO: 3312842 - DNA, 20 bp, Homo sapiens
cctctgactagtagatttct

SEQ ID NO: 3312843 - DNA, 18 bp, Homo sapiens
cctctgactctgagtcca

SEQ ID NO: 3312844 - DNA, 24 bp, Homo sapiens
cctctgactctgagtccactgctc

SEQ ID NO: 3312845 - DNA, 12 bp, Homo sapiens
cctctgagccca

SEQ ID NO: 3312846 - DNA, 15 bp, Homo sapiens
cctctgagcccaagc

SEQ ID NO: 3312847 - DNA, 14 bp, Homo sapiens
cctctgagcccagc

SEQ ID NO: 3312848 - DNA, 15 bp, Homo sapiens
cctctgagcccagct

SEQ ID NO: 3312849 - DNA, 20 bp, Homo sapiens
cctctgagcccagctgcctg

SEQ ID NO: 3312850 - DNA, 15 bp, Homo sapiens
cctctgatacctcaa

SEQ ID NO: 3312851 - DNA, 19 bp, Homo sapiens
cctctgcacaccctccaga

SEQ ID NO: 3312852 - DNA, 20 bp, Homo sapiens
cctctgcacaccctccagag

SEQ ID NO: 3312853 - DNA, 17 bp, Homo sapiens
cctctgcagtgccttgg

SEQ ID NO: 3312854 - DNA, 19 bp, Homo sapiens
cctctgccaaaggatgtga

SEQ ID NO: 3312855 - DNA, 20 bp, Homo sapiens
cctctgccaaaggatgtgat

SEQ ID NO: 3312856 - DNA, 11 bp, Homo sapiens
cctctgccacc

SEQ ID NO: 3312857 - DNA, 17 bp, Homo sapiens
cctctgccaccagagac

SEQ ID NO: 3312858 - DNA, 17 bp, Homo sapiens
cctctgccccaagcagc

SEQ ID NO: 3312859 - DNA, 18 bp, Homo sapiens
cctctgccccaagcagcc

SEQ ID NO: 3312860 - DNA, 19 bp, Homo sapiens
cctctgccggtcgggcagc

SEQ ID NO: 3312861 - DNA, 21 bp, Homo sapiens
cctctgcctctgacacacagc

SEQ ID NO: 3312862 - DNA, 23 bp, Homo sapiens
cctctgcctctgacacacagctc

SEQ ID NO: 3312863 - DNA, 20 bp, Homo sapiens
cctctgcctgaagtcacaca

SEQ ID NO: 3312864 - DNA, 12 bp, Homo sapiens
cctctgcctgcc

SEQ ID NO: 3312865 - DNA, 13 bp, Homo sapiens
cctctgcctgccc

SEQ ID NO: 3312866 - DNA, 21 bp, Homo sapiens
cctctgcctgccccgccccca

SEQ ID NO: 3312867 - DNA, 19 bp, Homo sapiens
cctctgcctgtctccccca

SEQ ID NO: 3312868 - DNA, 13 bp, Homo sapiens
cctctgcggaccc

SEQ ID NO: 3312869 - DNA, 18 bp, Homo sapiens
cctctgcggaccccagct

SEQ ID NO: 3312870 - DNA, 17 bp, Homo sapiens
cctctgcggggcagggc

SEQ ID NO: 3312871 - DNA, 24 bp, Homo sapiens
cctctgcggggcagggccttcctg

SEQ ID NO: 3312872 - DNA, 15 bp, Homo sapiens
cctctgctcagccaa

SEQ ID NO: 3312873 - DNA, 13 bp, Homo sapiens
cctctgctcccca

SEQ ID NO: 3312874 - DNA, 12 bp, Homo sapiens
cctctgcttccg

SEQ ID NO: 3312875 - DNA, 22 bp, Homo sapiens
cctctgcttccgtactatggct

SEQ ID NO: 3312876 - DNA, 16 bp, Homo sapiens
cctctggaattgctca

SEQ ID NO: 3312877 - DNA, 16 bp, Homo sapiens
cctctggacggcaggc

SEQ ID NO: 3312878 - DNA, 21 bp, Homo sapiens
cctctggacggcaggctcact

SEQ ID NO: 3312879 - DNA, 23 bp, Homo sapiens
cctctggacggcaggctcactgc

SEQ ID NO: 3312880 - DNA, 16 bp, Homo sapiens
cctctggactggctag

SEQ ID NO: 3312881 - DNA, 17 bp, Homo sapiens
cctctggactggctaga

SEQ ID NO: 3312882 - DNA, 17 bp, Homo sapiens
cctctggagccctaacc

SEQ ID NO: 3312883 - DNA, 20 bp, Homo sapiens
cctctggaggggtgtggctc

SEQ ID NO: 3312884 - DNA, 12 bp, Homo sapiens
cctctggccctc

SEQ ID NO: 3312885 - DNA, 16 bp, Homo sapiens
cctctggcccttggaa

SEQ ID NO: 3312886 - DNA, 19 bp, Homo sapiens
cctctggccgccaccccca

SEQ ID NO: 3312887 - DNA, 22 bp, Homo sapiens
cctctggctagaggccagcccc

SEQ ID NO: 3312888 - DNA, 20 bp, Homo sapiens
cctctggctccacacctcca

SEQ ID NO: 3312889 - DNA, 12 bp, Homo sapiens
cctctggcttcc

SEQ ID NO: 3312890 - DNA, 14 bp, Homo sapiens
cctctgggaacctc

SEQ ID NO: 3312891 - DNA, 20 bp, Homo sapiens
cctctgggaacctcccagag

SEQ ID NO: 3312892 - DNA, 22 bp, Homo sapiens
cctctgggaacctcccagaggt

SEQ ID NO: 3312893 - DNA, 20 bp, Homo sapiens
cctctggggaccccaacctc

SEQ ID NO: 3312894 - DNA, 21 bp, Homo sapiens
cctctggggaccccaacctca

SEQ ID NO: 3312895 - DNA, 16 bp, Homo sapiens
cctctggtccacacta

SEQ ID NO: 3312896 - DNA, 19 bp, Homo sapiens
cctctggttcttcatttat

SEQ ID NO: 3312897 - DNA, 16 bp, Homo sapiens
cctctgtatagaaatc

SEQ ID NO: 3312898 - DNA, 18 bp, Homo sapiens
cctctgtatagaaatcta

SEQ ID NO: 3312899 - DNA, 20 bp, Homo sapiens
cctctgtcatcactccctgg

SEQ ID NO: 3312900 - DNA, 22 bp, Homo sapiens
cctctgtcatcactccctggat

SEQ ID NO: 3312901 - DNA, 17 bp, Homo sapiens
cctctgtcctgcttctg

SEQ ID NO: 3312902 - DNA, 22 bp, Homo sapiens
cctctgtctcatcctcctggaa

SEQ ID NO: 3312903 - DNA, 22 bp, Homo sapiens
cctctgtcttgtgaaggcaggg

SEQ ID NO: 3312904 - DNA, 17 bp, Homo sapiens
cctgctccctgctttgg

SEQ ID NO: 3312905 - DNA, 14 bp, Homo sapiens
cctgctccgctgct

SEQ ID NO: 3312906 - DNA, 22 bp, Homo sapiens
cctgctccgctgctccttggct

SEQ ID NO: 3312907 - DNA, 13 bp, Homo sapiens
cctgctcctccct

SEQ ID NO: 3312908 - DNA, 16 bp, Homo sapiens
cctgctcctccctgcc

SEQ ID NO: 3312909 - DNA, 18 bp, Homo sapiens
cctgctcctccctggctg

SEQ ID NO: 3312910 - DNA, 19 bp, Homo sapiens
cctgctcctccctggctgc

SEQ ID NO: 3312911 - DNA, 21 bp, Homo sapiens
cctgctcctcctgccctgtcc

SEQ ID NO: 3312912 - DNA, 16 bp, Homo sapiens
cctgctcctgcagcat

SEQ ID NO: 3312913 - DNA, 23 bp, Homo sapiens
cctgctctacccatgagcctgcc

SEQ ID NO: 3312914 - DNA, 17 bp, Homo sapiens
cctgctctagtgggaca

SEQ ID NO: 3312915 - DNA, 18 bp, Homo sapiens
cctgctctagtgggacag

SEQ ID NO: 3312916 - DNA, 22 bp, Homo sapiens
cctgctctagtgggacagccca

SEQ ID NO: 3312917 - DNA, 21 bp, Homo sapiens
cctgctctccgaccagacacc

SEQ ID NO: 3312918 - DNA, 18 bp, Homo sapiens
cctgctctcctcttgcca

SEQ ID NO: 3312919 - DNA, 12 bp, Homo sapiens
cctgctgaatgc

SEQ ID NO: 3312920 - DNA, 13 bp, Homo sapiens
cctgctgaatgcc

SEQ ID NO: 3312921 - DNA, 23 bp, Homo sapiens
cctgctgaatgcctcgctccctt

SEQ ID NO: 3312922 - DNA, 17 bp, Homo sapiens
cctgctgagagccccca

SEQ ID NO: 3312923 - DNA, 12 bp, Homo sapiens
cctgctgcaggg

SEQ ID NO: 3312924 - DNA, 14 bp, Homo sapiens
cctgctgcaggggc

SEQ ID NO: 3312925 - DNA, 20 bp, Homo sapiens
cctgctgcaggggctctgga

SEQ ID NO: 3312926 - DNA, 14 bp, Homo sapiens
cctgctgccagtgc

SEQ ID NO: 3312927 - DNA, 15 bp, Homo sapiens
cctgctgccagtgca

SEQ ID NO: 3312928 - DNA, 15 bp, Homo sapiens
cctgctgccgcctcc

SEQ ID NO: 3312929 - DNA, 21 bp, Homo sapiens
cctgctgccgcctcccagcct

SEQ ID NO: 3312930 - DNA, 18 bp, Homo sapiens
cctgctgcggaggagctg

SEQ ID NO: 3312931 - DNA, 20 bp, Homo sapiens
cctgctgcggaggagctgcc

SEQ ID NO: 3312932 - DNA, 22 bp, Homo sapiens
cctgctgctgtaactgctgagc

SEQ ID NO: 3312933 - DNA, 20 bp, Homo sapiens
cctgctggacagagactcag

SEQ ID NO: 3312934 - DNA, 13 bp, Homo sapiens
cctgctggacagc

SEQ ID NO: 3312935 - DNA, 19 bp, Homo sapiens
cctgctggcacccaccgtg

SEQ ID NO: 3312936 - DNA, 17 bp, Homo sapiens
cctgctggctgcggccc

SEQ ID NO: 3312937 - DNA, 19 bp, Homo sapiens
cctgctgggaaccccgcag

SEQ ID NO: 3312938 - DNA, 21 bp, Homo sapiens
cctgctgggaaccccgcagcc

SEQ ID NO: 3312939 - DNA, 23 bp, Homo sapiens
cctgctgggaaccccgcagcccg

SEQ ID NO: 3312940 - DNA, 13 bp, Homo sapiens
cctgctggggatc

SEQ ID NO: 3312941 - DNA, 22 bp, Homo sapiens
cctgctggtacctgccctctat

SEQ ID NO: 3312942 - DNA, 19 bp, Homo sapiens
cctgctgtagtcctttctg

SEQ ID NO: 3312943 - DNA, 23 bp, Homo sapiens
cctgctgtgattccactacacct

SEQ ID NO: 3312944 - DNA, 21 bp, Homo sapiens
cctgctgtgccatgctgggcc

SEQ ID NO: 3312945 - DNA, 21 bp, Homo sapiens
cctgcttagctgccttgagct

SEQ ID NO: 3312946 - DNA, 22 bp, Homo sapiens
cctgcttccaggaaactccaca

SEQ ID NO: 3312947 - DNA, 21 bp, Homo sapiens
cctgcttcccacctccctgcc

SEQ ID NO: 3312948 - DNA, 14 bp, Homo sapiens
cctgcttccccttc

SEQ ID NO: 3312949 - DNA, 17 bp, Homo sapiens
cctgcttccccttccta

SEQ ID NO: 3312950 - DNA, 17 bp, Homo sapiens
cctgcttcctgaaataa

SEQ ID NO: 3312951 - DNA, 18 bp, Homo sapiens
cctgcttcctgaaataaa

SEQ ID NO: 3312952 - DNA, 19 bp, Homo sapiens
cctgcttcctgaaataaac

SEQ ID NO: 3312953 - DNA, 20 bp, Homo sapiens
cctgcttcctgaaataaaca

SEQ ID NO: 3312954 - DNA, 23 bp, Homo sapiens
cctgcttcctgaaataaacactg

SEQ ID NO: 3312955 - DNA, 17 bp, Homo sapiens
cctgcttctccagcctg

SEQ ID NO: 3312956 - DNA, 20 bp, Homo sapiens
cctgcttctccagcctggac

SEQ ID NO: 3312957 - DNA, 14 bp, Homo sapiens
cctgcttggcccgg

SEQ ID NO: 3312958 - DNA, 22 bp, Homo sapiens
cctgctttcaagacccctgtct

SEQ ID NO: 3312959 - DNA, 17 bp, Homo sapiens
cctgctttgggctgccc

SEQ ID NO: 3312960 - DNA, 20 bp, Homo sapiens
cctgctttgggctgccctgg

SEQ ID NO: 3312961 - DNA, 20 bp, Homo sapiens
cctgcttttaggagaattca

SEQ ID NO: 3312962 - DNA, 14 bp, Homo sapiens
cctgcttttccagg

SEQ ID NO: 3312963 - DNA, 15 bp, Homo sapiens
cctgcttttccagga

SEQ ID NO: 3312964 - DNA, 22 bp, Homo sapiens
cctgcttttccaggatcctgca

SEQ ID NO: 3312965 - DNA, 17 bp, Homo sapiens
cctgctttttgaaatga

SEQ ID NO: 3312966 - DNA, 15 bp, Homo sapiens
cctgctttttggaaa

SEQ ID NO: 3312967 - DNA, 20 bp, Homo sapiens
cctgctttttggaaagtcag

SEQ ID NO: 3312968 - DNA, 14 bp, Homo sapiens
cctgctttttttct

SEQ ID NO: 3312969 - DNA, 15 bp, Homo sapiens
cctggaaacagcatg

SEQ ID NO: 3312970 - DNA, 16 bp, Homo sapiens
cctggaaacagcatga

SEQ ID NO: 3312971 - DNA, 15 bp, Homo sapiens
cctggaaaccacagt

SEQ ID NO: 3312972 - DNA, 17 bp, Homo sapiens
cctggaaaccacagtcc

SEQ ID NO: 3312973 - DNA, 20 bp, Homo sapiens
cctggaaaggctcagtctca

SEQ ID NO: 3312974 - DNA, 21 bp, Homo sapiens
cctggaaaggctcagtctcag

SEQ ID NO: 3312975 - DNA, 22 bp, Homo sapiens
cctggaaaggctcagtctcagg

SEQ ID NO: 3312976 - DNA, 19 bp, Homo sapiens
cctggaaaggggagttgag

SEQ ID NO: 3312977 - DNA, 24 bp, Homo sapiens
cctggaacatcctttgcagggcag

SEQ ID NO: 3312978 - DNA, 14 bp, Homo sapiens
cctggaaccaggga

SEQ ID NO: 3312979 - DNA, 20 bp, Homo sapiens
cctggaactctatctgggcc

SEQ ID NO: 3312980 - DNA, 21 bp, Homo sapiens
cctggaagagccgagcacctg

SEQ ID NO: 3312981 - DNA, 22 bp, Homo sapiens
cctggaagagccgagcacctgt

SEQ ID NO: 3312982 - DNA, 20 bp, Homo sapiens
cctggaaggacatccatgtt

SEQ ID NO: 3312983 - DNA, 12 bp, Homo sapiens
cctggacacagc

SEQ ID NO: 3312984 - DNA, 13 bp, Homo sapiens
cctggacacagct

SEQ ID NO: 3312985 - DNA, 15 bp, Homo sapiens
cctggacacagctct

SEQ ID NO: 3312986 - DNA, 16 bp, Homo sapiens
cctggacacccctgct

SEQ ID NO: 3312987 - DNA, 20 bp, Homo sapiens
cctggacatcctcttctgct

SEQ ID NO: 3312988 - DNA, 13 bp, Homo sapiens
cctggacctgagt

SEQ ID NO: 3312989 - DNA, 20 bp, Homo sapiens
cctggacctgagtcggcccc

SEQ ID NO: 3312990 - DNA, 23 bp, Homo sapiens
cctggacctgccctgggccacac

SEQ ID NO: 3312991 - DNA, 23 bp, Homo sapiens
cctggactctgccccacgctgtg

SEQ ID NO: 3312992 - DNA, 19 bp, Homo sapiens
cctggactgagccaaggag

SEQ ID NO: 3312993 - DNA, 22 bp, Homo sapiens
cctggactggtggcccctgcct

SEQ ID NO: 3312994 - DNA, 14 bp, Homo sapiens
cctggactgttttc

SEQ ID NO: 3312995 - DNA, 17 bp, Homo sapiens
cctggactttcctgcaa

SEQ ID NO: 3312996 - DNA, 19 bp, Homo sapiens
cctggactttcctgcaact

SEQ ID NO: 3312997 - DNA, 22 bp, Homo sapiens
cctggagaaggaagctgcctgg

SEQ ID NO: 3312998 - DNA, 16 bp, Homo sapiens
cctggagacccacccc

SEQ ID NO: 3312999 - DNA, 13 bp, Homo sapiens
cctggagagcgag

SEQ ID NO: 3313000 - DNA, 16 bp, Homo sapiens
cctggagagcgaggag

SEQ ID NO: 3313001 - DNA, 20 bp, Homo sapiens
cctggagagcgaggaggcgc

SEQ ID NO: 3313002 - DNA, 15 bp, Homo sapiens
cctggagagggtctc

SEQ ID NO: 3313003 - DNA, 20 bp, Homo sapiens
cctggagagggtctcgctgt

SEQ ID NO: 3313004 - DNA, 23 bp, Homo sapiens
cctggagatattataagggagag

SEQ ID NO: 3313005 - DNA, 13 bp, Homo sapiens
cctggagatcctc

SEQ ID NO: 3313006 - DNA, 16 bp, Homo sapiens
cctggagatcctcctg

SEQ ID NO: 3313007 - DNA, 19 bp, Homo sapiens
cctggagatcctcctgcag

SEQ ID NO: 3313008 - DNA, 18 bp, Homo sapiens
cctggagccaactgctgc

SEQ ID NO: 3313009 - DNA, 12 bp, Homo sapiens
cctggagccaga

SEQ ID NO: 3313010 - DNA, 21 bp, Homo sapiens
cctggagcccacaaccttcgg

SEQ ID NO: 3313011 - DNA, 12 bp, Homo sapiens
cctggagcccct

SEQ ID NO: 3313012 - DNA, 14 bp, Homo sapiens
cctggagcccctgg

SEQ ID NO: 3313013 - DNA, 16 bp, Homo sapiens
cctggagcccctgggt

SEQ ID NO: 3313014 - DNA, 14 bp, Homo sapiens
cctggagccctgtt

SEQ ID NO: 3313015 - DNA, 16 bp, Homo sapiens
cctggagccctgttgg

SEQ ID NO: 3313016 - DNA, 18 bp, Homo sapiens
cctggaggaattcagctc

SEQ ID NO: 3313017 - DNA, 19 bp, Homo sapiens
cctggaggaattcagctca

SEQ ID NO: 3313018 - DNA, 21 bp, Homo sapiens
cctggaggtctccaggggcct

SEQ ID NO: 3313019 - DNA, 22 bp, Homo sapiens
cctggagtgtatgactgcacat

SEQ ID NO: 3313020 - DNA, 20 bp, Homo sapiens
cctggagtttaatacagtga

SEQ ID NO: 3313021 - DNA, 22 bp, Homo sapiens
cctggatattattcttgtagtt

SEQ ID NO: 3313022 - DNA, 23 bp, Homo sapiens
cctggatcacgacgctgcagagc

SEQ ID NO: 3313023 - DNA, 17 bp, Homo sapiens
cctggatccagcactgg

SEQ ID NO: 3313024 - DNA, 18 bp, Homo sapiens
cctggatccagcactggt

SEQ ID NO: 3313025 - DNA, 18 bp, Homo sapiens
cctggatcccctctgtct

SEQ ID NO: 3313026 - DNA, 17 bp, Homo sapiens
cctggatctatccctgc

SEQ ID NO: 3313027 - DNA, 20 bp, Homo sapiens
cctggatgagaaacagctca

SEQ ID NO: 3313028 - DNA, 13 bp, Homo sapiens
cctgggacccagc

SEQ ID NO: 3313029 - DNA, 16 bp, Homo sapiens
cctgggacccagctac

SEQ ID NO: 3313030 - DNA, 18 bp, Homo sapiens
cctgggacccagctactc

SEQ ID NO: 3313031 - DNA, 13 bp, Homo sapiens
cctgggactcgga

SEQ ID NO: 3313032 - DNA, 18 bp, Homo sapiens
cctgggagaacctcaggc

SEQ ID NO: 3313033 - DNA, 15 bp, Homo sapiens
cctgggagacaactg

SEQ ID NO: 3313034 - DNA, 21 bp, Homo sapiens
cctgggagccagtcctccact

SEQ ID NO: 3313035 - DNA, 16 bp, Homo sapiens
cctgggagcccagagg

SEQ ID NO: 3313036 - DNA, 21 bp, Homo sapiens
cctgggagcccccaccacaaa

SEQ ID NO: 3313037 - DNA, 22 bp, Homo sapiens
cctgggagcccccaccacaaac

SEQ ID NO: 3313038 - DNA, 15 bp, Homo sapiens
cctgggaggacaggc

SEQ ID NO: 3313039 - DNA, 17 bp, Homo sapiens
cctgggaggacaggcag

SEQ ID NO: 3313040 - DNA, 18 bp, Homo sapiens
cctgggagtgagctggtt

SEQ ID NO: 3313041 - DNA, 14 bp, Homo sapiens
cctgggatgctagc

SEQ ID NO: 3313042 - DNA, 19 bp, Homo sapiens
cctgggatgctagccccag

SEQ ID NO: 3313043 - DNA, 18 bp, Homo sapiens
cctgggatgggaccaggg

SEQ ID NO: 3313044 - DNA, 13 bp, Homo sapiens
cctgggcagaaag

SEQ ID NO: 3313045 - DNA, 19 bp, Homo sapiens
cctgggcagcatactgaga

SEQ ID NO: 3313046 - DNA, 10 bp, Homo sapiens
cctgggcagg

SEQ ID NO: 3313047 - DNA, 22 bp, Homo sapiens
cctgggcaggcggtccccatcc

SEQ ID NO: 3313048 - DNA, 16 bp, Homo sapiens
cctgggcattgctttc

SEQ ID NO: 3313049 - DNA, 17 bp, Homo sapiens
cctgggcattgctttcc

SEQ ID NO: 3313050 - DNA, 19 bp, Homo sapiens
cctgggcatttggtgagag

SEQ ID NO: 3313051 - DNA, 22 bp, Homo sapiens
cctgggcccctccacgcctcct

SEQ ID NO: 3313052 - DNA, 23 bp, Homo sapiens
cctgggcccctccacgcctcctg

SEQ ID NO: 3313053 - DNA, 16 bp, Homo sapiens
cctgggccctgggctg

SEQ ID NO: 3313054 - DNA, 16 bp, Homo sapiens
cctgggccgctgccac

SEQ ID NO: 3313055 - DNA, 20 bp, Homo sapiens
cctgggcctcatcacagcaa

SEQ ID NO: 3313056 - DNA, 14 bp, Homo sapiens
cctgggcctgcccc

SEQ ID NO: 3313057 - DNA, 20 bp, Homo sapiens
cctgggcctgcttttccagg

SEQ ID NO: 3313058 - DNA, 21 bp, Homo sapiens
cctgggcctgcttttccagga

SEQ ID NO: 3313059 - DNA, 20 bp, Homo sapiens
cctgggcctgtcccccaagg

SEQ ID NO: 3313060 - DNA, 17 bp, Homo sapiens
cctgggcctgtgcagca

SEQ ID NO: 3313061 - DNA, 18 bp, Homo sapiens
cctgggcctgtgcagcag

SEQ ID NO: 3313062 - DNA, 21 bp, Homo sapiens
cctgggcctgtgcagcagccc

SEQ ID NO: 3313063 - DNA, 23 bp, Homo sapiens
cctgggcctttgcaagatgcttg

SEQ ID NO: 3313064 - DNA, 16 bp, Homo sapiens
cctgggctcagcctga

SEQ ID NO: 3313065 - DNA, 20 bp, Homo sapiens
cctgggctctgccccagctc

SEQ ID NO: 3313066 - DNA, 22 bp, Homo sapiens
cctgggctctgccccagctctg

SEQ ID NO: 3313067 - DNA, 24 bp, Homo sapiens
cctgggctctgccccagctctggc

SEQ ID NO: 3313068 - DNA, 16 bp, Homo sapiens
cctgggctggactgga

SEQ ID NO: 3313069 - DNA, 18 bp, Homo sapiens
cctgggctggactggagg

SEQ ID NO: 3313070 - DNA, 13 bp, Homo sapiens
cctgggctgtgct

SEQ ID NO: 3313071 - DNA, 18 bp, Homo sapiens
cctgggctgttggcactc

SEQ ID NO: 3313072 - DNA, 20 bp, Homo sapiens
cctgggctgttggcactcac

SEQ ID NO: 3313073 - DNA, 18 bp, Homo sapiens
cctgggcttggcctgctg

SEQ ID NO: 3313074 - DNA, 21 bp, Homo sapiens
cctgggcttggcctgctgtga

SEQ ID NO: 3313075 - DNA, 17 bp, Homo sapiens
cctggggaaggagccag

SEQ ID NO: 3313076 - DNA, 18 bp, Homo sapiens
cctggggaaggagccagt

SEQ ID NO: 3313077 - DNA, 21 bp, Homo sapiens
cctggggaccccactccctgc

SEQ ID NO: 3313078 - DNA, 18 bp, Homo sapiens
cctggggactgttccaaa

SEQ ID NO: 3313079 - DNA, 23 bp, Homo sapiens
cctggggactgttccaaagccag

SEQ ID NO: 3313080 - DNA, 17 bp, Homo sapiens
cctggggcagcactccc

SEQ ID NO: 3313081 - DNA, 12 bp, Homo sapiens
cctggggccccg

SEQ ID NO: 3313082 - DNA, 14 bp, Homo sapiens
cctggggctccctc

SEQ ID NO: 3313083 - DNA, 20 bp, Homo sapiens
cctggggctccctctctggt

SEQ ID NO: 3313084 - DNA, 22 bp, Homo sapiens
cctggggctcctttctccagcc

SEQ ID NO: 3313085 - DNA, 14 bp, Homo sapiens
cctggggctgggcc

SEQ ID NO: 3313086 - DNA, 21 bp, Homo sapiens
cctggggcttctcctgaccca

SEQ ID NO: 3313087 - DNA, 18 bp, Homo sapiens
cctgggggagttttcctc

SEQ ID NO: 3313088 - DNA, 14 bp, Homo sapiens
cctgggggcagtga

SEQ ID NO: 3313089 - DNA, 20 bp, Homo sapiens
cctgggggcagtgactggca

SEQ ID NO: 3313090 - DNA, 15 bp, Homo sapiens
cctgggggccgtgct

SEQ ID NO: 3313091 - DNA, 19 bp, Homo sapiens
cctgggggcttttgccact

SEQ ID NO: 3313092 - DNA, 21 bp, Homo sapiens
cctggggtttgaagctgactt

SEQ ID NO: 3313093 - DNA, 18 bp, Homo sapiens
cctgggtatgttcctaag

SEQ ID NO: 3313094 - DNA, 14 bp, Homo sapiens
cctgggtctgtgtc

SEQ ID NO: 3313095 - DNA, 15 bp, Homo sapiens
cctgggtctgtgtct

SEQ ID NO: 3313096 - DNA, 13 bp, Homo sapiens
cctgggtgacatt

SEQ ID NO: 3313097 - DNA, 18 bp, Homo sapiens
cctgggtgccattcccag

SEQ ID NO: 3313098 - DNA, 23 bp, Homo sapiens
cctgggtgctggctgcccagacc

SEQ ID NO: 3313099 - DNA, 16 bp, Homo sapiens
cctgggtgggacagcc

SEQ ID NO: 3313100 - DNA, 13 bp, Homo sapiens
cctgggtgggtgg

SEQ ID NO: 3313101 - DNA, 17 bp, Homo sapiens
cctgggtgggtggtggg

SEQ ID NO: 3313102 - DNA, 20 bp, Homo sapiens
cctgggttccaatcctggct

SEQ ID NO: 3313103 - DNA, 15 bp, Homo sapiens
cctggtacccagcca

SEQ ID NO: 3313104 - DNA, 17 bp, Homo sapiens
cctggtacccagccatc

SEQ ID NO: 3313105 - DNA, 20 bp, Homo sapiens
cctggtacccagccatctgc

SEQ ID NO: 3313106 - DNA, 22 bp, Homo sapiens
cctggtacccagccatctgccc

SEQ ID NO: 3313107 - DNA, 17 bp, Homo sapiens
cctggtaccctcctggc

SEQ ID NO: 3313108 - DNA, 22 bp, Homo sapiens
cctggtcacaggactctgcctc

SEQ ID NO: 3313109 - DNA, 22 bp, Homo sapiens
cctggtccagggaagctggccg

SEQ ID NO: 3313110 - DNA, 15 bp, Homo sapiens
cctggtccctcaccc

SEQ ID NO: 3313111 - DNA, 14 bp, Homo sapiens
cctggtccctctga

SEQ ID NO: 3313112 - DNA, 15 bp, Homo sapiens
cctggtccctctgag

SEQ ID NO: 3313113 - DNA, 17 bp, Homo sapiens
cctggtccctctgaggc

SEQ ID NO: 3313114 - DNA, 18 bp, Homo sapiens
cctggtccctctgaggca

SEQ ID NO: 3313115 - DNA, 14 bp, Homo sapiens
cctggtctccgtgg

SEQ ID NO: 3313116 - DNA, 16 bp, Homo sapiens
cctggtcttgagatgt

SEQ ID NO: 3313117 - DNA, 20 bp, Homo sapiens
cctggtgaatggccttcctt

SEQ ID NO: 3313118 - DNA, 14 bp, Homo sapiens
cctggtgactcctg

SEQ ID NO: 3313119 - DNA, 13 bp, Homo sapiens
cctggtgcccctc

SEQ ID NO: 3313120 - DNA, 20 bp, Homo sapiens
cctggtgcccctcgccagct

SEQ ID NO: 3313121 - DNA, 21 bp, Homo sapiens
cctggtgcccctcgccagctt

SEQ ID NO: 3313122 - DNA, 19 bp, Homo sapiens
cctggtgccctgagacaga

SEQ ID NO: 3313123 - DNA, 18 bp, Homo sapiens
cctggtgctgccacactt

SEQ ID NO: 3313124 - DNA, 13 bp, Homo sapiens
cctggtgctggat

SEQ ID NO: 3313125 - DNA, 14 bp, Homo sapiens
cctggtggacagtc

SEQ ID NO: 3313126 - DNA, 18 bp, Homo sapiens
cctggtggacagtcctgg

SEQ ID NO: 3313127 - DNA, 12 bp, Homo sapiens
cctggtggcagc

SEQ ID NO: 3313128 - DNA, 13 bp, Homo sapiens
cctggtggcagct

SEQ ID NO: 3313129 - DNA, 19 bp, Homo sapiens
cctggtggcagtgggagct

SEQ ID NO: 3313130 - DNA, 20 bp, Homo sapiens
cctggtggcagtgggagctg

SEQ ID NO: 3313131 - DNA, 21 bp, Homo sapiens
cctggtggcagtgggagctgc

SEQ ID NO: 3313132 - DNA, 18 bp, Homo sapiens
cctggtggccttctgctg

SEQ ID NO: 3313133 - DNA, 20 bp, Homo sapiens
cctggtggccttctgctgcc

SEQ ID NO: 3313134 - DNA, 24 bp, Homo sapiens
cctggtggccttctgctgcccagg

SEQ ID NO: 3313135 - DNA, 18 bp, Homo sapiens
cctggtggtcagatgcag

SEQ ID NO: 3313136 - DNA, 14 bp, Homo sapiens
cctggttcatattt

SEQ ID NO: 3313137 - DNA, 22 bp, Homo sapiens
cctggttcatatttatactttg

SEQ ID NO: 3313138 - DNA, 20 bp, Homo sapiens
cctggttccttcctatgccc

SEQ ID NO: 3313139 - DNA, 15 bp, Homo sapiens
cctggttttgtacac

SEQ ID NO: 3313140 - DNA, 20 bp, Homo sapiens
cctggttttgtacactgctg

SEQ ID NO: 3313141 - DNA, 22 bp, Homo sapiens
cctggttttgtacactgctgta

SEQ ID NO: 3313142 - DNA, 12 bp, Homo sapiens
cctgtaaacctg

SEQ ID NO: 3313143 - DNA, 18 bp, Homo sapiens
cctgtaacttgagagtag

SEQ ID NO: 3313144 - DNA, 17 bp, Homo sapiens
cctgtaagccaaagaaa

SEQ ID NO: 3313145 - DNA, 21 bp, Homo sapiens
cctgtaatcagctctcctggc

SEQ ID NO: 3313146 - DNA, 16 bp, Homo sapiens
cctgtaatcccagcac

SEQ ID NO: 3313147 - DNA, 18 bp, Homo sapiens
cctgtaatcccagcactt

SEQ ID NO: 3313148 - DNA, 23 bp, Homo sapiens
cctgtacaatcatgaacagctct

SEQ ID NO: 3313149 - DNA, 12 bp, Homo sapiens
cctgtacactga

SEQ ID NO: 3313150 - DNA, 21 bp, Homo sapiens
cctgtacactgaatatttata

SEQ ID NO: 3313151 - DNA, 22 bp, Homo sapiens
cctgtacagtagattttccaaa

SEQ ID NO: 3313152 - DNA, 14 bp, Homo sapiens
cctgtacagtgtta

SEQ ID NO: 3313153 - DNA, 14 bp, Homo sapiens
ccttgcacatagta

SEQ ID NO: 3313154 - DNA, 13 bp, Homo sapiens
ccttgcacccctc

SEQ ID NO: 3313155 - DNA, 17 bp, Homo sapiens
ccttgcacccctcactc

SEQ ID NO: 3313156 - DNA, 18 bp, Homo sapiens
ccttgcagaactgccatt

SEQ ID NO: 3313157 - DNA, 17 bp, Homo sapiens
ccttgcagttcagcacc

SEQ ID NO: 3313158 - DNA, 13 bp, Homo sapiens
ccttgccccacag

SEQ ID NO: 3313159 - DNA, 22 bp, Homo sapiens
ccttgccccacagttgtgttca

SEQ ID NO: 3313160 - DNA, 20 bp, Homo sapiens
ccttgcccccatccctcgga

SEQ ID NO: 3313161 - DNA, 17 bp, Homo sapiens
ccttgccctccgcctgg

SEQ ID NO: 3313162 - DNA, 16 bp, Homo sapiens
ccttgccctgacctcc

SEQ ID NO: 3313163 - DNA, 15 bp, Homo sapiens
ccttgccctttccat

SEQ ID NO: 3313164 - DNA, 12 bp, Homo sapiens
ccttgcctcccc

SEQ ID NO: 3313165 - DNA, 17 bp, Homo sapiens
ccttgcctccccatttc

SEQ ID NO: 3313166 - DNA, 23 bp, Homo sapiens
ccttgcctccccatttcccatct

SEQ ID NO: 3313167 - DNA, 12 bp, Homo sapiens
ccttgcctttgt

SEQ ID NO: 3313168 - DNA, 20 bp, Homo sapiens
ccttgcctttgtggccttcc

SEQ ID NO: 3313169 - DNA, 23 bp, Homo sapiens
ccttgctcaaccatggctgaagg

SEQ ID NO: 3313170 - DNA, 18 bp, Homo sapiens
ccttgctcgctgtaaaat

SEQ ID NO: 3313171 - DNA, 21 bp, Homo sapiens
ccttgctgagtggcgcaaggc

SEQ ID NO: 3313172 - DNA, 22 bp, Homo sapiens
ccttgctgcaagcacagccctt

SEQ ID NO: 3313173 - DNA, 13 bp, Homo sapiens
ccttgctgcccgc

SEQ ID NO: 3313174 - DNA, 18 bp, Homo sapiens
ccttgctgctgctgcacc

SEQ ID NO: 3313175 - DNA, 16 bp, Homo sapiens
ccttgctgtcctgatc

SEQ ID NO: 3313176 - DNA, 21 bp, Homo sapiens
ccttgcttgttgggattcctg

SEQ ID NO: 3313177 - DNA, 13 bp, Homo sapiens
ccttgctttcctg

SEQ ID NO: 3313178 - DNA, 15 bp, Homo sapiens
ccttgctttcctggg

SEQ ID NO: 3313179 - DNA, 16 bp, Homo sapiens
ccttgctttcctgggc

SEQ ID NO: 3313180 - DNA, 17 bp, Homo sapiens
ccttgctttcctgggcc

SEQ ID NO: 3313181 - DNA, 18 bp, Homo sapiens
ccttgctttcctgggcct

SEQ ID NO: 3313182 - DNA, 20 bp, Homo sapiens
ccttgctttcggagctcctg

SEQ ID NO: 3313183 - DNA, 15 bp, Homo sapiens
ccttggaataaagtt

SEQ ID NO: 3313184 - DNA, 16 bp, Homo sapiens
ccttggagagacacag

SEQ ID NO: 3313185 - DNA, 13 bp, Homo sapiens
ccttggagcaggc

SEQ ID NO: 3313186 - DNA, 14 bp, Homo sapiens
ccttggagcaggca

SEQ ID NO: 3313187 - DNA, 16 bp, Homo sapiens
ccttggcaccaaagat

SEQ ID NO: 3313188 - DNA, 20 bp, Homo sapiens
ccttggcaccaaagatgcag

SEQ ID NO: 3313189 - DNA, 22 bp, Homo sapiens
ccttggcagtgtcccagggccc

SEQ ID NO: 3313190 - DNA, 17 bp, Homo sapiens
ccttggcatgggcgcag

SEQ ID NO: 3313191 - DNA, 19 bp, Homo sapiens
ccttggccggctgtgctca

SEQ ID NO: 3313192 - DNA, 21 bp, Homo sapiens
ccttggccggctgtgctcaga

SEQ ID NO: 3313193 - DNA, 19 bp, Homo sapiens
ccttggccgtgaggacacg

SEQ ID NO: 3313194 - DNA, 15 bp, Homo sapiens
ccttggcctagccca

SEQ ID NO: 3313195 - DNA, 16 bp, Homo sapiens
ccttggcctctttcct

SEQ ID NO: 3313196 - DNA, 22 bp, Homo sapiens
ccttggctcaagtcctcttttc

SEQ ID NO: 3313197 - DNA, 23 bp, Homo sapiens
ccttggctctgccagtggatccc

SEQ ID NO: 3313198 - DNA, 18 bp, Homo sapiens
ccttggctgactggggct

SEQ ID NO: 3313199 - DNA, 15 bp, Homo sapiens
ccttgggacagccag

SEQ ID NO: 3313200 - DNA, 20 bp, Homo sapiens
ccttgggacagccagagctg

SEQ ID NO: 3313201 - DNA, 11 bp, Homo sapiens
ccttgggcagt

SEQ ID NO: 3313202 - DNA, 16 bp, Homo sapiens
ccttgggcatccaccc

SEQ ID NO: 3313203 - DNA, 23 bp, Homo sapiens
ccttgggcatccacccagtgctg

SEQ ID NO: 3313204 - DNA, 19 bp, Homo sapiens
ccttgggcctgggcctctg

SEQ ID NO: 3313205 - DNA, 22 bp, Homo sapiens
ccttgggcctgggcctctgccc

SEQ ID NO: 3313206 - DNA, 17 bp, Homo sapiens
ccttgggccttgctgct

SEQ ID NO: 3313207 - DNA, 18 bp, Homo sapiens
ccttgggccttgctgctg

SEQ ID NO: 3313208 - DNA, 13 bp, Homo sapiens
ccttgggctcctg

SEQ ID NO: 3313209 - DNA, 15 bp, Homo sapiens
ccttgggctcctggc

SEQ ID NO: 3313210 - DNA, 16 bp, Homo sapiens
ccttgggctcctggct

SEQ ID NO: 3313211 - DNA, 17 bp, Homo sapiens
ccttgggctcctggctg

SEQ ID NO: 3313212 - DNA, 22 bp, Homo sapiens
ccttgggctcctggctgccagg

SEQ ID NO: 3313213 - DNA, 17 bp, Homo sapiens
ccttggggaatttcctc

SEQ ID NO: 3313214 - DNA, 19 bp, Homo sapiens
ccttggggtccctccaccc

SEQ ID NO: 3313215 - DNA, 21 bp, Homo sapiens
ccttggggtccctccacccca

SEQ ID NO: 3313216 - DNA, 19 bp, Homo sapiens
ccttgggtagtgagcagtg

SEQ ID NO: 3313217 - DNA, 13 bp, Homo sapiens
ccttgggtcattg

SEQ ID NO: 3313218 - DNA, 18 bp, Homo sapiens
ccttgggttgctggttgg

SEQ ID NO: 3313219 - DNA, 11 bp, Homo sapiens
ccttggtctga

SEQ ID NO: 3313220 - DNA, 17 bp, Homo sapiens
ccttggtctttgtatct

SEQ ID NO: 3313221 - DNA, 15 bp, Homo sapiens
ccttggtggcaagag

SEQ ID NO: 3313222 - DNA, 17 bp, Homo sapiens
ccttggttcatcagtgt

SEQ ID NO: 3313223 - DNA, 15 bp, Homo sapiens
ccttgtaaaaaaagc

SEQ ID NO: 3313224 - DNA, 17 bp, Homo sapiens
ccttgtaaaaaaagcaa

SEQ ID NO: 3313225 - DNA, 19 bp, Homo sapiens
ccttgtaaccagtgcagaa

SEQ ID NO: 3313226 - DNA, 12 bp, Homo sapiens
ccttgtactctt

SEQ ID NO: 3313227 - DNA, 18 bp, Homo sapiens
ccttgtactcttaggata

SEQ ID NO: 3313228 - DNA, 18 bp, Homo sapiens
ccttgtataatattgaaa

SEQ ID NO: 3313229 - DNA, 21 bp, Homo sapiens
ccttgtattttgttaaagctg

SEQ ID NO: 3313230 - DNA, 13 bp, Homo sapiens
ccttgtcctgcca

SEQ ID NO: 3313231 - DNA, 15 bp, Homo sapiens
ccttgtcctgccagc

SEQ ID NO: 3313232 - DNA, 19 bp, Homo sapiens
ccttgtcctgccagctgcc

SEQ ID NO: 3313233 - DNA, 13 bp, Homo sapiens
ccttgtctgagat

SEQ ID NO: 3313234 - DNA, 23 bp, Homo sapiens
ccttgtctgggtctaccaggaac

SEQ ID NO: 3313235 - DNA, 17 bp, Homo sapiens
ccttgtgaccttctcta

SEQ ID NO: 3313236 - DNA, 17 bp, Homo sapiens
ccttgtgccctgccccc

SEQ ID NO: 3313237 - DNA, 16 bp, Homo sapiens
ccttgtgtatatttgt

SEQ ID NO: 3313238 - DNA, 17 bp, Homo sapiens
ccttgttggtcagagga

SEQ ID NO: 3313239 - DNA, 14 bp, Homo sapiens
ccttgttggtggag

SEQ ID NO: 3313240 - DNA, 19 bp, Homo sapiens
ccttgttttattcaaagac

SEQ ID NO: 3313241 - DNA, 23 bp, Homo sapiens
cctttaagatatccatctttttc

SEQ ID NO: 3313242 - DNA, 22 bp, Homo sapiens
cctttaagccaaagaaacaagc

SEQ ID NO: 3313243 - DNA, 19 bp, Homo sapiens
cctttaattaagactgaaa

SEQ ID NO: 3313244 - DNA, 22 bp, Homo sapiens
cctttacaaaagaaataccttg

SEQ ID NO: 3313245 - DNA, 12 bp, Homo sapiens
cctttacaatgt

SEQ ID NO: 3313246 - DNA, 17 bp, Homo sapiens
cctttacaatgtgaata

SEQ ID NO: 3313247 - DNA, 17 bp, Homo sapiens
cctttacattcaacttt

SEQ ID NO: 3313248 - DNA, 15 bp, Homo sapiens
cctttacgtgtttaa

SEQ ID NO: 3313249 - DNA, 21 bp, Homo sapiens
cctttactatcattctcagtg

SEQ ID NO: 3313250 - DNA, 18 bp, Homo sapiens
cctttagcacgtttaaag

SEQ ID NO: 3313251 - DNA, 19 bp, Homo sapiens
cctttagccaaacccttgt

SEQ ID NO: 3313252 - DNA, 14 bp, Homo sapiens
cctttagggcagct

SEQ ID NO: 3313253 - DNA, 13 bp, Homo sapiens
cctttattttaga

SEQ ID NO: 3313254 - DNA, 21 bp, Homo sapiens
cctttatttttggcgtggctg

SEQ ID NO: 3313255 - DNA, 15 bp, Homo sapiens
cctttcacaaccttc

SEQ ID NO: 3313256 - DNA, 17 bp, Homo sapiens
cctttcagatgaccttt

SEQ ID NO: 3313257 - DNA, 14 bp, Homo sapiens
cctttcagatgtct

SEQ ID NO: 3313258 - DNA, 20 bp, Homo sapiens
cctttcagatgtcttctgcc

SEQ ID NO: 3313259 - DNA, 21 bp, Homo sapiens
cctttcagatgtcttctgcct

SEQ ID NO: 3313260 - DNA, 19 bp, Homo sapiens
cctttccaccacagccagc

SEQ ID NO: 3313261 - DNA, 18 bp, Homo sapiens
cctttcccaccattcctg

SEQ ID NO: 3313262 - DNA, 18 bp, Homo sapiens
cctttccccagcccaggg

SEQ ID NO: 3313263 - DNA, 18 bp, Homo sapiens
cctttcccccttctctta

SEQ ID NO: 3313264 - DNA, 12 bp, Homo sapiens
cctttccccttc

SEQ ID NO: 3313265 - DNA, 21 bp, Homo sapiens
cctttccccttcccctcccct

SEQ ID NO: 3313266 - DNA, 14 bp, Homo sapiens
cctttccgctgtcg

SEQ ID NO: 3313267 - DNA, 11 bp, Homo sapiens
cctttcctaaa

SEQ ID NO: 3313268 - DNA, 22 bp, Homo sapiens
cctttcctggacactcagacct

SEQ ID NO: 3313269 - DNA, 20 bp, Homo sapiens
cctttcctgttcagcattct

SEQ ID NO: 3313270 - DNA, 13 bp, Homo sapiens
cctttccttccta

SEQ ID NO: 3313271 - DNA, 15 bp, Homo sapiens
cctttccttcctaat

SEQ ID NO: 3313272 - DNA, 13 bp, Homo sapiens
cctttctaataaa

SEQ ID NO: 3313273 - DNA, 16 bp, Homo sapiens
cctttctccagccagc

SEQ ID NO: 3313274 - DNA, 17 bp, Homo sapiens
cctttctccagccagca

SEQ ID NO: 3313275 - DNA, 15 bp, Homo sapiens
cctttctcctgtgaa

SEQ ID NO: 3313276 - DNA, 17 bp, Homo sapiens
cctttctcctgtgaatg

SEQ ID NO: 3313277 - DNA, 17 bp, Homo sapiens
cctttctcgattttatc

SEQ ID NO: 3313278 - DNA, 19 bp, Homo sapiens
cctttctctctcctctctg

SEQ ID NO: 3313279 - DNA, 12 bp, Homo sapiens
cgcagcccgtga

SEQ ID NO: 3313280 - DNA, 20 bp, Homo sapiens
cgcagcccgtgaagcagtgc

SEQ ID NO: 3313281 - DNA, 13 bp, Homo sapiens
cgcagctggactc

SEQ ID NO: 3313282 - DNA, 17 bp, Homo sapiens
cgcagctggactctgca

SEQ ID NO: 3313283 - DNA, 19 bp, Homo sapiens
cgcaggagtctctgccacc

SEQ ID NO: 3313284 - DNA, 23 bp, Homo sapiens
cgcaggagtctctgccacccact

SEQ ID NO: 3313285 - DNA, 18 bp, Homo sapiens
cgcaggatccgctgccac

SEQ ID NO: 3313286 - DNA, 20 bp, Homo sapiens
cgcaggatccgctgccacca

SEQ ID NO: 3313287 - DNA, 17 bp, Homo sapiens
cgcaggattcagccgga

SEQ ID NO: 3313288 - DNA, 14 bp, Homo sapiens
cgcaggcccagtga

SEQ ID NO: 3313289 - DNA, 19 bp, Homo sapiens
cgcaggcgaccgggcctcc

SEQ ID NO: 3313290 - DNA, 16 bp, Homo sapiens
cgcaggggttgcagtg

SEQ ID NO: 3313291 - DNA, 14 bp, Homo sapiens
cgcaggtgggctgg

SEQ ID NO: 3313292 - DNA, 20 bp, Homo sapiens
cgcaggtgggtgctgccctg

SEQ ID NO: 3313293 - DNA, 12 bp, Homo sapiens
cgcagtccccag

SEQ ID NO: 3313294 - DNA, 17 bp, Homo sapiens
cgcagtccccagccctt

SEQ ID NO: 3313295 - DNA, 14 bp, Homo sapiens
cgcagtctggcctg

SEQ ID NO: 3313296 - DNA, 19 bp, Homo sapiens
cgcagtgctgggaccagag

SEQ ID NO: 3313297 - DNA, 23 bp, Homo sapiens
cgcatacacacatgccctcctgg

SEQ ID NO: 3313298 - DNA, 15 bp, Homo sapiens
cgcataggacctttc

SEQ ID NO: 3313299 - DNA, 14 bp, Homo sapiens
cgcatccagcaaga

SEQ ID NO: 3313300 - DNA, 20 bp, Homo sapiens
cgcatctcaaaacagagggc

SEQ ID NO: 3313301 - DNA, 16 bp, Homo sapiens
cgcattggtgactcac

SEQ ID NO: 3313302 - DNA, 12 bp, Homo sapiens
cgcattgtacac

SEQ ID NO: 3313303 - DNA, 22 bp, Homo sapiens
cgccaaatgttcatcctcattg

SEQ ID NO: 3313304 - DNA, 19 bp, Homo sapiens
cgccaagcaacctgggtcc

SEQ ID NO: 3313305 - DNA, 13 bp, Homo sapiens
cgccaccatcctg

SEQ ID NO: 3313306 - DNA, 11 bp, Homo sapiens
cgccaccattc

SEQ ID NO: 3313307 - DNA, 16 bp, Homo sapiens
cgccaccattcctgga

SEQ ID NO: 3313308 - DNA, 19 bp, Homo sapiens
cgccacccccatcttccac

SEQ ID NO: 3313309 - DNA, 23 bp, Homo sapiens
cgccacctcagggcacgcaggac

SEQ ID NO: 3313310 - DNA, 14 bp, Homo sapiens
cgccacggcctggc

SEQ ID NO: 3313311 - DNA, 15 bp, Homo sapiens
cgccacgtcccagca

SEQ ID NO: 3313312 - DNA, 19 bp, Homo sapiens
cgccactcagccatttccc

SEQ ID NO: 3313313 - DNA, 13 bp, Homo sapiens
cgccactgcactc

SEQ ID NO: 3313314 - DNA, 13 bp, Homo sapiens
cgccacttccttt

SEQ ID NO: 3313315 - DNA, 14 bp, Homo sapiens
cgccagagggcttg

SEQ ID NO: 3313316 - DNA, 17 bp, Homo sapiens
cgccagaggtgcttcac

SEQ ID NO: 3313317 - DNA, 13 bp, Homo sapiens
cgccagcctcctc

SEQ ID NO: 3313318 - DNA, 16 bp, Homo sapiens
cgccagcctcctctgg

SEQ ID NO: 3313319 - DNA, 18 bp, Homo sapiens
cgccagcctcctctggac

SEQ ID NO: 3313320 - DNA, 12 bp, Homo sapiens
cgccagcttctc

SEQ ID NO: 3313321 - DNA, 21 bp, Homo sapiens
cgcccacaggaagcctgcagt

SEQ ID NO: 3313322 - DNA, 22 bp, Homo sapiens
cgcccacaggaagcctgcagtc

SEQ ID NO: 3313323 - DNA, 15 bp, Homo sapiens
cgcccagctgcacct

SEQ ID NO: 3313324 - DNA, 13 bp, Homo sapiens
cgcccaggctgga

SEQ ID NO: 3313325 - DNA, 16 bp, Homo sapiens
cgcccagggaggagtc

SEQ ID NO: 3313326 - DNA, 21 bp, Homo sapiens
cgcccagtctggaatgcagtg

SEQ ID NO: 3313327 - DNA, 22 bp, Homo sapiens
cgcccagttgggtggatgcctg

SEQ ID NO: 3313328 - DNA, 21 bp, Homo sapiens
cgccccagatcaccagcccgg

SEQ ID NO: 3313329 - DNA, 18 bp, Homo sapiens
cgcccccagtccccaccc

SEQ ID NO: 3313330 - DNA, 22 bp, Homo sapiens
cgcccccagtccccacccctgc

SEQ ID NO: 3313331 - DNA, 13 bp, Homo sapiens
cgcccccagtgtg

SEQ ID NO: 3313332 - DNA, 19 bp, Homo sapiens
cgccccctccgccctgcca

SEQ ID NO: 3313333 - DNA, 14 bp, Homo sapiens
cgccccctcctcta

SEQ ID NO: 3313334 - DNA, 19 bp, Homo sapiens
cgcccctgcagcacggaca

SEQ ID NO: 3313335 - DNA, 12 bp, Homo sapiens
cgcccctgctgt

SEQ ID NO: 3313336 - DNA, 18 bp, Homo sapiens
cgcccctgctgtcttccc

SEQ ID NO: 3313337 - DNA, 14 bp, Homo sapiens
cgcccctgtggcca

SEQ ID NO: 3313338 - DNA, 15 bp, Homo sapiens
cgcccgcccctgcag

SEQ ID NO: 3313339 - DNA, 13 bp, Homo sapiens
cgcccgctcctgc

SEQ ID NO: 3313340 - DNA, 18 bp, Homo sapiens
cgcccgctcctgccgcag

SEQ ID NO: 3313341 - DNA, 12 bp, Homo sapiens
cgcccgtcctgc

SEQ ID NO: 3313342 - DNA, 15 bp, Homo sapiens
cgcccgtcctgcctg

SEQ ID NO: 3313343 - DNA, 18 bp, Homo sapiens
cgccctactccactgccc

SEQ ID NO: 3313344 - DNA, 19 bp, Homo sapiens
cgccctactccactgccct

SEQ ID NO: 3313345 - DNA, 21 bp, Homo sapiens
cgccctactccactgccctgg

SEQ ID NO: 3313346 - DNA, 21 bp, Homo sapiens
cgccctccctctcccaggccc

SEQ ID NO: 3313347 - DNA, 19 bp, Homo sapiens
cgccctcctcgggccgagg

SEQ ID NO: 3313348 - DNA, 17 bp, Homo sapiens
cgccctctctgctcctt

SEQ ID NO: 3313349 - DNA, 15 bp, Homo sapiens
cgccctcttcctgac

SEQ ID NO: 3313350 - DNA, 12 bp, Homo sapiens
cgccctgccact

SEQ ID NO: 3313351 - DNA, 21 bp, Homo sapiens
cgccctgcgttggagccactc

SEQ ID NO: 3313352 - DNA, 15 bp, Homo sapiens
cgccctgctcctccc

SEQ ID NO: 3313353 - DNA, 17 bp, Homo sapiens
cgccctgctcctccctg

SEQ ID NO: 3313354 - DNA, 14 bp, Homo sapiens
cgccctggacttgg

SEQ ID NO: 3313355 - DNA, 15 bp, Homo sapiens
cgccctgggctggac

SEQ ID NO: 3313356 - DNA, 18 bp, Homo sapiens
cgccctgggctgtctgtc

SEQ ID NO: 3313357 - DNA, 14 bp, Homo sapiens
cgccctttcctcct

SEQ ID NO: 3313358 - DNA, 18 bp, Homo sapiens
cgccgactttgtaccccc

SEQ ID NO: 3313359 - DNA, 15 bp, Homo sapiens
cgccgccaccagccc

SEQ ID NO: 3313360 - DNA, 12 bp, Homo sapiens
cgccgcgggtgt

SEQ ID NO: 3313361 - DNA, 12 bp, Homo sapiens
cgccgtgaccta

SEQ ID NO: 3313362 - DNA, 17 bp, Homo sapiens
cgccgtgagttctcagg

SEQ ID NO: 3313363 - DNA, 21 bp, Homo sapiens
cgccgtgagttctcagggctc

SEQ ID NO: 3313364 - DNA, 22 bp, Homo sapiens
cgccgtgttactgttgcactga

SEQ ID NO: 3313365 - DNA, 18 bp, Homo sapiens
cgcctaaggtcacagcta

SEQ ID NO: 3313366 - DNA, 19 bp, Homo sapiens
cgcctaccaatctctgctc

SEQ ID NO: 3313367 - DNA, 16 bp, Homo sapiens
cgcctactcttcaggg

SEQ ID NO: 3313368 - DNA, 15 bp, Homo sapiens
cgcctcactttccac

SEQ ID NO: 3313369 - DNA, 14 bp, Homo sapiens
cgcctcccacggca

SEQ ID NO: 3313370 - DNA, 15 bp, Homo sapiens
cgcctcccacggcac

SEQ ID NO: 3313371 - DNA, 15 bp, Homo sapiens
cgcctcccagcctgg

SEQ ID NO: 3313372 - DNA, 12 bp, Homo sapiens
cgcctccccacc

SEQ ID NO: 3313373 - DNA, 22 bp, Homo sapiens
cgcctcctggccagacgctgcc

SEQ ID NO: 3313374 - DNA, 13 bp, Homo sapiens
cgcctctcccgtc

SEQ ID NO: 3313375 - DNA, 21 bp, Homo sapiens
cgcctctcccgtcagggccca

SEQ ID NO: 3313376 - DNA, 21 bp, Homo sapiens
cgcctgacaaccactggtctg

SEQ ID NO: 3313377 - DNA, 23 bp, Homo sapiens
cgcctgacaaccactggtctgta

SEQ ID NO: 3313378 - DNA, 14 bp, Homo sapiens
cgcctgagctcctg

SEQ ID NO: 3313379 - DNA, 14 bp, Homo sapiens
cgcctgcagtcttc

SEQ ID NO: 3313380 - DNA, 15 bp, Homo sapiens
cgcctgcctctgcct

SEQ ID NO: 3313381 - DNA, 15 bp, Homo sapiens
cgcctgctccctgca

SEQ ID NO: 3313382 - DNA, 23 bp, Homo sapiens
cgcctgctcctcactggaggagc

SEQ ID NO: 3313383 - DNA, 20 bp, Homo sapiens
cgcctggatttctggttctg

SEQ ID NO: 3313384 - DNA, 16 bp, Homo sapiens
cgcctggcacatttca

SEQ ID NO: 3313385 - DNA, 13 bp, Homo sapiens
cgcctggccagga

SEQ ID NO: 3313386 - DNA, 14 bp, Homo sapiens
cgcctggccaggag

SEQ ID NO: 3313387 - DNA, 15 bp, Homo sapiens
cgcctggccaggagc

SEQ ID NO: 3313388 - DNA, 16 bp, Homo sapiens
cgcctggccagggcag

SEQ ID NO: 3313389 - DNA, 18 bp, Homo sapiens
cgcctggccagggcaggg

SEQ ID NO: 3313390 - DNA, 10 bp, Homo sapiens
cgcctgggat

SEQ ID NO: 3313391 - DNA, 19 bp, Homo sapiens
cgcctgttcccccgccgct

SEQ ID NO: 3313392 - DNA, 21 bp, Homo sapiens
cgcctgttcccccgccgcttt

SEQ ID NO: 3313393 - DNA, 13 bp, Homo sapiens
cgccttcctcctc

SEQ ID NO: 3313394 - DNA, 12 bp, Homo sapiens
cgccttcctggg

SEQ ID NO: 3313395 - DNA, 13 bp, Homo sapiens
cgccttccttgac

SEQ ID NO: 3313396 - DNA, 19 bp, Homo sapiens
cgccttgtctcctactcct

SEQ ID NO: 3313397 - DNA, 17 bp, Homo sapiens
cgcctttccgcggagcc

SEQ ID NO: 3313398 - DNA, 14 bp, Homo sapiens
cgccttttgtatac

SEQ ID NO: 3313399 - DNA, 15 bp, Homo sapiens
cgccttttgtataca

SEQ ID NO: 3313400 - DNA, 15 bp, Homo sapiens
cgcgactaatttcaa

SEQ ID NO: 3313401 - DNA, 14 bp, Homo sapiens
cgcgatcccacaca

SEQ ID NO: 3313402 - DNA, 15 bp, Homo sapiens
cgcgccactcgcttc

SEQ ID NO: 3313403 - DNA, 22 bp, Homo sapiens
cgcgccactcgcttcccccata

SEQ ID NO: 3313404 - DNA, 16 bp, Homo sapiens
cgcgctcgcccagcag

SEQ ID NO: 3313405 - DNA, 21 bp, Homo sapiens
cgcggaggaggagggaggcca

SEQ ID NO: 3313406 - DNA, 15 bp, Homo sapiens
cggcttgtgggctgg

SEQ ID NO: 3313407 - DNA, 16 bp, Homo sapiens
cggcttgtgggctggt

SEQ ID NO: 3313408 - DNA, 13 bp, Homo sapiens
cgggaacagtgtt

SEQ ID NO: 3313409 - DNA, 22 bp, Homo sapiens
cgggaacagtgtttcccataat

SEQ ID NO: 3313410 - DNA, 16 bp, Homo sapiens
cgggaacatgccccct

SEQ ID NO: 3313411 - DNA, 13 bp, Homo sapiens
cgggaagcagcca

SEQ ID NO: 3313412 - DNA, 14 bp, Homo sapiens
cgggaagcagccag

SEQ ID NO: 3313413 - DNA, 15 bp, Homo sapiens
cgggaagcagccagc

SEQ ID NO: 3313414 - DNA, 16 bp, Homo sapiens
cgggaagcagccagct

SEQ ID NO: 3313415 - DNA, 12 bp, Homo sapiens
cgggaagcggag

SEQ ID NO: 3313416 - DNA, 15 bp, Homo sapiens
cgggacacctgccct

SEQ ID NO: 3313417 - DNA, 15 bp, Homo sapiens
cgggacccacggagc

SEQ ID NO: 3313418 - DNA, 18 bp, Homo sapiens
cgggagacagcttctctg

SEQ ID NO: 3313419 - DNA, 14 bp, Homo sapiens
cgggagcacccaga

SEQ ID NO: 3313420 - DNA, 15 bp, Homo sapiens
cgggagcagtgtctt

SEQ ID NO: 3313421 - DNA, 17 bp, Homo sapiens
cgggagcggtggccctg

SEQ ID NO: 3313422 - DNA, 13 bp, Homo sapiens
cgggaggaggtgt

SEQ ID NO: 3313423 - DNA, 16 bp, Homo sapiens
cgggaggcaccagctc

SEQ ID NO: 3313424 - DNA, 18 bp, Homo sapiens
cgggaggcaccagctctg

SEQ ID NO: 3313425 - DNA, 21 bp, Homo sapiens
cgggaggcaccagctctgtgg

SEQ ID NO: 3313426 - DNA, 13 bp, Homo sapiens
cgggaggccctgg

SEQ ID NO: 3313427 - DNA, 16 bp, Homo sapiens
cgggaggccctggccc

SEQ ID NO: 3313428 - DNA, 21 bp, Homo sapiens
cgggaggccctggccctttcc

SEQ ID NO: 3313429 - DNA, 14 bp, Homo sapiens
cgggaggctgggca

SEQ ID NO: 3313430 - DNA, 16 bp, Homo sapiens
cgggcaagaagctgct

SEQ ID NO: 3313431 - DNA, 15 bp, Homo sapiens
cgggcaatcatgagc

SEQ ID NO: 3313432 - DNA, 14 bp, Homo sapiens
cgggcacaataaat

SEQ ID NO: 3313433 - DNA, 15 bp, Homo sapiens
cgggcacaataaatc

SEQ ID NO: 3313434 - DNA, 12 bp, Homo sapiens
cgggcacagggc

SEQ ID NO: 3313435 - DNA, 14 bp, Homo sapiens
cgggcacagggcac

SEQ ID NO: 3313436 - DNA, 17 bp, Homo sapiens
cgggcacagggcaccag

SEQ ID NO: 3313437 - DNA, 20 bp, Homo sapiens
cgggcacagggcaccagagg

SEQ ID NO: 3313438 - DNA, 16 bp, Homo sapiens
cgggcaccagccagcg

SEQ ID NO: 3313439 - DNA, 14 bp, Homo sapiens
cgggcacctgtagt

SEQ ID NO: 3313440 - DNA, 10 bp, Homo sapiens
cgggcagaaa

SEQ ID NO: 3313441 - DNA, 14 bp, Homo sapiens
cgggcagagggctg

SEQ ID NO: 3313442 - DNA, 22 bp, Homo sapiens
cgggcagagggctggaggccca

SEQ ID NO: 3313443 - DNA, 20 bp, Homo sapiens
cgggcagatgggcggacggc

SEQ ID NO: 3313444 - DNA, 22 bp, Homo sapiens
cgggcagccacccaagcctgct

SEQ ID NO: 3313445 - DNA, 23 bp, Homo sapiens
cgggcagccacccaagcctgctg

SEQ ID NO: 3313446 - DNA, 15 bp, Homo sapiens
cgggcagccagcaga

SEQ ID NO: 3313447 - DNA, 16 bp, Homo sapiens
cgggcagcgggccagg

SEQ ID NO: 3313448 - DNA, 20 bp, Homo sapiens
cgggcaggggtcagagcact

SEQ ID NO: 3313449 - DNA, 12 bp, Homo sapiens
cgggccacagag

SEQ ID NO: 3313450 - DNA, 13 bp, Homo sapiens
cgggccacagggc

SEQ ID NO: 3313451 - DNA, 23 bp, Homo sapiens
cgggccacgccccagcccgacaa

SEQ ID NO: 3313452 - DNA, 15 bp, Homo sapiens
cgggccagccaggcg

SEQ ID NO: 3313453 - DNA, 18 bp, Homo sapiens
cgggccagccaggcgggc

SEQ ID NO: 3313454 - DNA, 20 bp, Homo sapiens
cgggccagccaggcgggctc

SEQ ID NO: 3313455 - DNA, 21 bp, Homo sapiens
cgggccagccaggcgggctca

SEQ ID NO: 3313456 - DNA, 14 bp, Homo sapiens
cgggccaggcccgc

SEQ ID NO: 3313457 - DNA, 15 bp, Homo sapiens
cgggccaggcccgca

SEQ ID NO: 3313458 - DNA, 14 bp, Homo sapiens
cgggccatgaggga

SEQ ID NO: 3313459 - DNA, 22 bp, Homo sapiens
cgggccccatcctcatccctga

SEQ ID NO: 3313460 - DNA, 16 bp, Homo sapiens
cgggccgaggcccagc

SEQ ID NO: 3313461 - DNA, 18 bp, Homo sapiens
cgggccgaggcccagcgg

SEQ ID NO: 3313462 - DNA, 23 bp, Homo sapiens
cgggccgaggcccagcgggcaga

SEQ ID NO: 3313463 - DNA, 14 bp, Homo sapiens
cgggcgcgggcagc

SEQ ID NO: 3313464 - DNA, 21 bp, Homo sapiens
cgggcggaggggatccagcca

SEQ ID NO: 3313465 - DNA, 22 bp, Homo sapiens
cgggcggaggggatccagccac

SEQ ID NO: 3313466 - DNA, 17 bp, Homo sapiens
cgggctccctggcagga

SEQ ID NO: 3313467 - DNA, 20 bp, Homo sapiens
cgggctccctggcaggatgc

SEQ ID NO: 3313468 - DNA, 14 bp, Homo sapiens
cgggctctctgctg

SEQ ID NO: 3313469 - DNA, 15 bp, Homo sapiens
cgggctgcctgggct

SEQ ID NO: 3313470 - DNA, 16 bp, Homo sapiens
cgggctgcctgggctg

SEQ ID NO: 3313471 - DNA, 14 bp, Homo sapiens
cgggctggagaaag

SEQ ID NO: 3313472 - DNA, 15 bp, Homo sapiens
cgggctggagaaaga

SEQ ID NO: 3313473 - DNA, 16 bp, Homo sapiens
cgggctggcctgtgcc

SEQ ID NO: 3313474 - DNA, 16 bp, Homo sapiens
cgggctgggagctctg

SEQ ID NO: 3313475 - DNA, 24 bp, Homo sapiens
cgggcttttctggggcccaggaag

SEQ ID NO: 3313476 - DNA, 23 bp, Homo sapiens
cggggacagctccttctgtccta

SEQ ID NO: 3313477 - DNA, 12 bp, Homo sapiens
cggggaccctgt

SEQ ID NO: 3313478 - DNA, 18 bp, Homo sapiens
cggggagtttctttcctg

SEQ ID NO: 3313479 - DNA, 15 bp, Homo sapiens
cggggcagtcagatt

SEQ ID NO: 3313480 - DNA, 20 bp, Homo sapiens
cggggcagtcagatttttaa

SEQ ID NO: 3313481 - DNA, 22 bp, Homo sapiens
cggggcagttcgggaaccccct

SEQ ID NO: 3313482 - DNA, 16 bp, Homo sapiens
cggggcatgctggggc

SEQ ID NO: 3313483 - DNA, 17 bp, Homo sapiens
cggggcatgctggggca

SEQ ID NO: 3313484 - DNA, 14 bp, Homo sapiens
cggggccccagggc

SEQ ID NO: 3313485 - DNA, 15 bp, Homo sapiens
cggggccccagggct

SEQ ID NO: 3313486 - DNA, 19 bp, Homo sapiens
cggggccctctctgcaccg

SEQ ID NO: 3313487 - DNA, 19 bp, Homo sapiens
cggggcccttggggcctgg

SEQ ID NO: 3313488 - DNA, 22 bp, Homo sapiens
cggggcccttggggcctggctt

SEQ ID NO: 3313489 - DNA, 17 bp, Homo sapiens
cggggcctccaacccat

SEQ ID NO: 3313490 - DNA, 17 bp, Homo sapiens
cggggcgatgctccctc

SEQ ID NO: 3313491 - DNA, 20 bp, Homo sapiens
cggggcgatgctccctcagc

SEQ ID NO: 3313492 - DNA, 18 bp, Homo sapiens
cggggcgcctagagcgcg

SEQ ID NO: 3313493 - DNA, 14 bp, Homo sapiens
cggggctccaggct

SEQ ID NO: 3313494 - DNA, 19 bp, Homo sapiens
cggggctcgaggctggtgc

SEQ ID NO: 3313495 - DNA, 11 bp, Homo sapiens
cggggctggca

SEQ ID NO: 3313496 - DNA, 12 bp, Homo sapiens
cggggctggcaa

SEQ ID NO: 3313497 - DNA, 15 bp, Homo sapiens
cggggctgggaggaa

SEQ ID NO: 3313498 - DNA, 15 bp, Homo sapiens
cgggggagcccagtg

SEQ ID NO: 3313499 - DNA, 18 bp, Homo sapiens
cgggggaggggcgcggga

SEQ ID NO: 3313500 - DNA, 16 bp, Homo sapiens
cgggggctgaggggca

SEQ ID NO: 3313501 - DNA, 13 bp, Homo sapiens
cgggggctggcct

SEQ ID NO: 3313502 - DNA, 17 bp, Homo sapiens
cggggggggcgcctgga

SEQ ID NO: 3313503 - DNA, 21 bp, Homo sapiens
cggggtatcctgggggaccca

SEQ ID NO: 3313504 - DNA, 17 bp, Homo sapiens
cggggtcctgtggcagg

SEQ ID NO: 3313505 - DNA, 17 bp, Homo sapiens
cggggtctgtgctgtgc

SEQ ID NO: 3313506 - DNA, 19 bp, Homo sapiens
cggggtggtgggaaccatg

SEQ ID NO: 3313507 - DNA, 14 bp, Homo sapiens
cgggtctcaggcct

SEQ ID NO: 3313508 - DNA, 16 bp, Homo sapiens
cgggtggggcttgggg

SEQ ID NO: 3313509 - DNA, 20 bp, Homo sapiens
cgggtggggcttggggctca

SEQ ID NO: 3313510 - DNA, 14 bp, Homo sapiens
cgggtggtccccgt

SEQ ID NO: 3313511 - DNA, 16 bp, Homo sapiens
cgggtgtggcctcagc

SEQ ID NO: 3313512 - DNA, 17 bp, Homo sapiens
cgggtgtggcctcagcc

SEQ ID NO: 3313513 - DNA, 19 bp, Homo sapiens
cgggtgtggcctcagccct

SEQ ID NO: 3313514 - DNA, 20 bp, Homo sapiens
cgggtgtggcctcagccctc

SEQ ID NO: 3313515 - DNA, 16 bp, Homo sapiens
cgggttccgcaggcag

SEQ ID NO: 3313516 - DNA, 22 bp, Homo sapiens
cgggttgttttgggtgaatctt

SEQ ID NO: 3313517 - DNA, 16 bp, Homo sapiens
cggtagggaggcagcc

SEQ ID NO: 3313518 - DNA, 18 bp, Homo sapiens
cggtatccccccatcttg

SEQ ID NO: 3313519 - DNA, 18 bp, Homo sapiens
cggtcaggtttaacattt

SEQ ID NO: 3313520 - DNA, 21 bp, Homo sapiens
cggtcaggtttaacatttgcc

SEQ ID NO: 3313521 - DNA, 16 bp, Homo sapiens
cggtccacccaggagc

SEQ ID NO: 3313522 - DNA, 13 bp, Homo sapiens
cggtcccacccct

SEQ ID NO: 3313523 - DNA, 17 bp, Homo sapiens
cggtccccatccccacc

SEQ ID NO: 3313524 - DNA, 16 bp, Homo sapiens
cggtctgcaagtcaga

SEQ ID NO: 3313525 - DNA, 21 bp, Homo sapiens
cggtctgttctgtttcaaggc

SEQ ID NO: 3313526 - DNA, 23 bp, Homo sapiens
cggtgcatacacccccacctcct

SEQ ID NO: 3313527 - DNA, 17 bp, Homo sapiens
cggtgccaggttttctg

SEQ ID NO: 3313528 - DNA, 19 bp, Homo sapiens
cggtgccatgtctgcagtg

SEQ ID NO: 3313529 - DNA, 18 bp, Homo sapiens
cggtgcgtggctgtggca

SEQ ID NO: 3313530 - DNA, 19 bp, Homo sapiens
cggtgcgtggctgtggcac

SEQ ID NO: 3313531 - DNA, 12 bp, Homo sapiens
cggtgctctggc

SEQ ID NO: 3313532 - DNA, 16 bp, Homo sapiens
cggtgcttctggaaac

SEQ ID NO: 3313533 - DNA, 24 bp, Homo sapiens
ctaaacataattgtggattataaa

SEQ ID NO: 3313534 - DNA, 12 bp, Homo sapiens
ctaaacccaatg

SEQ ID NO: 3313535 - DNA, 14 bp, Homo sapiens
ctaaacccaatgac

SEQ ID NO: 3313536 - DNA, 15 bp, Homo sapiens
ctaaacccctgtccc

SEQ ID NO: 3313537 - DNA, 16 bp, Homo sapiens
ctaaacccctgtccca

SEQ ID NO: 3313538 - DNA, 16 bp, Homo sapiens
ctaaacggattccaaa

SEQ ID NO: 3313539 - DNA, 17 bp, Homo sapiens
ctaaacggattccaaag

SEQ ID NO: 3313540 - DNA, 15 bp, Homo sapiens
ctaaactatctgtat

SEQ ID NO: 3313541 - DNA, 19 bp, Homo sapiens
ctaaactatctgtatttat

SEQ ID NO: 3313542 - DNA, 17 bp, Homo sapiens
ctaaactttatttgtaa

SEQ ID NO: 3313543 - DNA, 23 bp, Homo sapiens
ctaaactttatttgtaaaccatt

SEQ ID NO: 3313544 - DNA, 15 bp, Homo sapiens
ctaaactttttttct

SEQ ID NO: 3313545 - DNA, 17 bp, Homo sapiens
ctaaactttttttctgt

SEQ ID NO: 3313546 - DNA, 21 bp, Homo sapiens
ctaaactttttttctgtacca

SEQ ID NO: 3313547 - DNA, 23 bp, Homo sapiens
ctaaagaaaaatatcttggccta

SEQ ID NO: 3313548 - DNA, 18 bp, Homo sapiens
ctaaagagagaatgtaga

SEQ ID NO: 3313549 - DNA, 18 bp, Homo sapiens
ctaaagagcccttgcctc

SEQ ID NO: 3313550 - DNA, 19 bp, Homo sapiens
ctaaagatggagtttctaa

SEQ ID NO: 3313551 - DNA, 20 bp, Homo sapiens
ctaaagatggagtttctaag

SEQ ID NO: 3313552 - DNA, 18 bp, Homo sapiens
ctaaagattctatagttc

SEQ ID NO: 3313553 - DNA, 20 bp, Homo sapiens
ctaaagattctatagttcta

SEQ ID NO: 3313554 - DNA, 15 bp, Homo sapiens
ctaaagccagcctga

SEQ ID NO: 3313555 - DNA, 14 bp, Homo sapiens
ctaaagctttggac

SEQ ID NO: 3313556 - DNA, 16 bp, Homo sapiens
ctaaaggatgctgctg

SEQ ID NO: 3313557 - DNA, 19 bp, Homo sapiens
ctaaaggggactagacagt

SEQ ID NO: 3313558 - DNA, 17 bp, Homo sapiens
ctaaaggggagaaactg

SEQ ID NO: 3313559 - DNA, 16 bp, Homo sapiens
ctaaaggtgtatttaa

SEQ ID NO: 3313560 - DNA, 20 bp, Homo sapiens
ctaaagtatgtaaagtatgt

SEQ ID NO: 3313561 - DNA, 14 bp, Homo sapiens
ctaaagttctaaga

SEQ ID NO: 3313562 - DNA, 15 bp, Homo sapiens
ctaaagttctaagat

SEQ ID NO: 3313563 - DNA, 12 bp, Homo sapiens
ctaaataatgaa

SEQ ID NO: 3313564 - DNA, 22 bp, Homo sapiens
ctaaataatgaataaactgaat

SEQ ID NO: 3313565 - DNA, 17 bp, Homo sapiens
ctaaatatccaaagact

SEQ ID NO: 3313566 - DNA, 21 bp, Homo sapiens
ctaaatatccaaagactgtac

SEQ ID NO: 3313567 - DNA, 23 bp, Homo sapiens
ctaaatatccaaagactgtactg

SEQ ID NO: 3313568 - DNA, 21 bp, Homo sapiens
ctaaatatgaaccctttgttt

SEQ ID NO: 3313569 - DNA, 14 bp, Homo sapiens
ctaaatatttcctt

SEQ ID NO: 3313570 - DNA, 14 bp, Homo sapiens
ctaaatcagagaca

SEQ ID NO: 3313571 - DNA, 19 bp, Homo sapiens
ctaaatcagagacaaaata

SEQ ID NO: 3313572 - DNA, 17 bp, Homo sapiens
ctaaatcctttactgtt

SEQ ID NO: 3313573 - DNA, 14 bp, Homo sapiens
ctaaatctatttat

SEQ ID NO: 3313574 - DNA, 16 bp, Homo sapiens
ctaaatctatttatta

SEQ ID NO: 3313575 - DNA, 19 bp, Homo sapiens
ctaaatctatttattaata

SEQ ID NO: 3313576 - DNA, 21 bp, Homo sapiens
ctaaatctatttattaatatt

SEQ ID NO: 3313577 - DNA, 18 bp, Homo sapiens
ctaaatctgtaagctctt

SEQ ID NO: 3313578 - DNA, 22 bp, Homo sapiens
ctaaatctgtaagctctttgaa

SEQ ID NO: 3313579 - DNA, 22 bp, Homo sapiens
ctaaatgaaaatcgtgacaaca

SEQ ID NO: 3313580 - DNA, 15 bp, Homo sapiens
ctaaatgaatgttta

SEQ ID NO: 3313581 - DNA, 21 bp, Homo sapiens
ctaaatgcatatcctgagcca

SEQ ID NO: 3313582 - DNA, 12 bp, Homo sapiens
ctaaatggcctc

SEQ ID NO: 3313583 - DNA, 13 bp, Homo sapiens
ctaaatggcctca

SEQ ID NO: 3313584 - DNA, 15 bp, Homo sapiens
ctaaatggtgctgca

SEQ ID NO: 3313585 - DNA, 18 bp, Homo sapiens
ctaaatgtgcaatagaag

SEQ ID NO: 3313586 - DNA, 22 bp, Homo sapiens
ctaaatgttctatggttatgaa

SEQ ID NO: 3313587 - DNA, 23 bp, Homo sapiens
ctaaattatttactgcaaaaaga

SEQ ID NO: 3313588 - DNA, 14 bp, Homo sapiens
ctaaattccacact

SEQ ID NO: 3313589 - DNA, 14 bp, Homo sapiens
ctaaattctatgtt

SEQ ID NO: 3313590 - DNA, 22 bp, Homo sapiens
ctaaattctatgttaaatactg

SEQ ID NO: 3313591 - DNA, 15 bp, Homo sapiens
ctaaattctttattt

SEQ ID NO: 3313592 - DNA, 14 bp, Homo sapiens
ctaaattgtaaact

SEQ ID NO: 3313593 - DNA, 14 bp, Homo sapiens
ctaaatttaaattt

SEQ ID NO: 3313594 - DNA, 16 bp, Homo sapiens
ctaaatttaatgctgc

SEQ ID NO: 3313595 - DNA, 18 bp, Homo sapiens
ctaaatttaatgctgcct

SEQ ID NO: 3313596 - DNA, 13 bp, Homo sapiens
ctaaatttcacta

SEQ ID NO: 3313597 - DNA, 23 bp, Homo sapiens
ctaaatttgaatgttaagcagat

SEQ ID NO: 3313598 - DNA, 14 bp, Homo sapiens
ctaaatttgatact

SEQ ID NO: 3313599 - DNA, 15 bp, Homo sapiens
ctaaatttgatactt

SEQ ID NO: 3313600 - DNA, 19 bp, Homo sapiens
ctaaatttgatacttatat

SEQ ID NO: 3313601 - DNA, 21 bp, Homo sapiens
ctaaatttgatacttatattt

SEQ ID NO: 3313602 - DNA, 16 bp, Homo sapiens
ctaacaagatttgtaa

SEQ ID NO: 3313603 - DNA, 14 bp, Homo sapiens
ctaacacagcatgt

SEQ ID NO: 3313604 - DNA, 16 bp, Homo sapiens
ctaacacagcatgtgt

SEQ ID NO: 3313605 - DNA, 17 bp, Homo sapiens
ctaacacagcatgtgta

SEQ ID NO: 3313606 - DNA, 17 bp, Homo sapiens
ctaacacattatcggga

SEQ ID NO: 3313607 - DNA, 18 bp, Homo sapiens
ctaacagaaattaattta

SEQ ID NO: 3313608 - DNA, 12 bp, Homo sapiens
ctaacagccctc

SEQ ID NO: 3313609 - DNA, 12 bp, Homo sapiens
ctaacaggcact

SEQ ID NO: 3313610 - DNA, 20 bp, Homo sapiens
ctaacagtgaagttttactg

SEQ ID NO: 3313611 - DNA, 23 bp, Homo sapiens
ctaacataaaatctgtgaattaa

SEQ ID NO: 3313612 - DNA, 15 bp, Homo sapiens
ctaacatgttatcaa

SEQ ID NO: 3313613 - DNA, 12 bp, Homo sapiens
ctaacattatat

SEQ ID NO: 3313614 - DNA, 15 bp, Homo sapiens
ctaacattatttatt

SEQ ID NO: 3313615 - DNA, 11 bp, Homo sapiens
ctaacatttcc

SEQ ID NO: 3313616 - DNA, 18 bp, Homo sapiens
ctaacattttaaataaaa

SEQ ID NO: 3313617 - DNA, 21 bp, Homo sapiens
ctaaccaagctgagtttccta

SEQ ID NO: 3313618 - DNA, 17 bp, Homo sapiens
ctaaccaggcccagcca

SEQ ID NO: 3313619 - DNA, 19 bp, Homo sapiens
ctaaccccaacgcacagga

SEQ ID NO: 3313620 - DNA, 13 bp, Homo sapiens
ctaaccccttcca

SEQ ID NO: 3313621 - DNA, 17 bp, Homo sapiens
ctaacctcgggcctgct

SEQ ID NO: 3313622 - DNA, 20 bp, Homo sapiens
ctaacgacttcagggcaggg

SEQ ID NO: 3313623 - DNA, 19 bp, Homo sapiens
ctaacgggaggctgggcac

SEQ ID NO: 3313624 - DNA, 22 bp, Homo sapiens
ctaacgttgagcccctggaggc

SEQ ID NO: 3313625 - DNA, 22 bp, Homo sapiens
ctaactagaattagtatgtctg

SEQ ID NO: 3313626 - DNA, 21 bp, Homo sapiens
ctaactagacaccaaagttct

SEQ ID NO: 3313627 - DNA, 22 bp, Homo sapiens
ctaactagacaccaaagttcta

SEQ ID NO: 3313628 - DNA, 14 bp, Homo sapiens
ctaactcaaataca

SEQ ID NO: 3313629 - DNA, 17 bp, Homo sapiens
ctaactcagaattattt

SEQ ID NO: 3313630 - DNA, 17 bp, Homo sapiens
ctaactccactggctcc

SEQ ID NO: 3313631 - DNA, 14 bp, Homo sapiens
ctaactcctgagaa

SEQ ID NO: 3313632 - DNA, 23 bp, Homo sapiens
ctaactcctgccattcttctggt

SEQ ID NO: 3313633 - DNA, 13 bp, Homo sapiens
ctaactgtaaatc

SEQ ID NO: 3313634 - DNA, 13 bp, Homo sapiens
ctaactttattct

SEQ ID NO: 3313635 - DNA, 22 bp, Homo sapiens
ctaagaaaagatacgactttat

SEQ ID NO: 3313636 - DNA, 23 bp, Homo sapiens
ctaagaaaagatacgactttatt

SEQ ID NO: 3313637 - DNA, 14 bp, Homo sapiens
ctaagaaaagattt

SEQ ID NO: 3313638 - DNA, 21 bp, Homo sapiens
ctaagaaaagattttaatcaa

SEQ ID NO: 3313639 - DNA, 17 bp, Homo sapiens
ctaagaaaccctctgtc

SEQ ID NO: 3313640 - DNA, 14 bp, Homo sapiens
ctaagaaacttttg

SEQ ID NO: 3313641 - DNA, 20 bp, Homo sapiens
ctaagaaacttttgtaaaga

SEQ ID NO: 3313642 - DNA, 21 bp, Homo sapiens
ctaagaagcttctaataaatt

SEQ ID NO: 3313643 - DNA, 15 bp, Homo sapiens
ctaagaataataaaa

SEQ ID NO: 3313644 - DNA, 18 bp, Homo sapiens
ctaagaatgcattattga

SEQ ID NO: 3313645 - DNA, 15 bp, Homo sapiens
ctaagacacaaatgc

SEQ ID NO: 3313646 - DNA, 23 bp, Homo sapiens
ctaagacacaaatgcatgaacaa

SEQ ID NO: 3313647 - DNA, 21 bp, Homo sapiens
ctaagacacctgaaccctcca

SEQ ID NO: 3313648 - DNA, 13 bp, Homo sapiens
ctaagacatgtga

SEQ ID NO: 3313649 - DNA, 13 bp, Homo sapiens
ctaagactcaaat

SEQ ID NO: 3313650 - DNA, 22 bp, Homo sapiens
ctaagactcaaatgttctaagt

SEQ ID NO: 3313651 - DNA, 22 bp, Homo sapiens
ctaagactgtgacaactgtcta

SEQ ID NO: 3313652 - DNA, 18 bp, Homo sapiens
ctaagagaaaattgcact

SEQ ID NO: 3313653 - DNA, 20 bp, Homo sapiens
ctaagagccatttaggggcc

SEQ ID NO: 3313654 - DNA, 14 bp, Homo sapiens
ctaagatcttagat

SEQ ID NO: 3313655 - DNA, 17 bp, Homo sapiens
ctaagatcttagattct

SEQ ID NO: 3313656 - DNA, 20 bp, Homo sapiens
ctaagatcttagattctctg

SEQ ID NO: 3313657 - DNA, 21 bp, Homo sapiens
ctaagatgagatttgccagca

SEQ ID NO: 3313658 - DNA, 24 bp, Homo sapiens
ctaagatgagatttgccagcacag

SEQ ID NO: 3313659 - DNA, 22 bp, Homo sapiens
ctactataatcaaatgatttca

SEQ ID NO: 3313660 - DNA, 23 bp, Homo sapiens
ctactataatcaaatgatttcat

SEQ ID NO: 3313661 - DNA, 18 bp, Homo sapiens
ctactatggctgagttct

SEQ ID NO: 3313662 - DNA, 13 bp, Homo sapiens
ctactatgtgctg

SEQ ID NO: 3313663 - DNA, 16 bp, Homo sapiens
ctactatgtgctgggt

SEQ ID NO: 3313664 - DNA, 15 bp, Homo sapiens
ctactattcatgttt

SEQ ID NO: 3313665 - DNA, 17 bp, Homo sapiens
ctactcagaagcctgag

SEQ ID NO: 3313666 - DNA, 18 bp, Homo sapiens
ctactccactgccctggc

SEQ ID NO: 3313667 - DNA, 13 bp, Homo sapiens
ctactcccctggg

SEQ ID NO: 3313668 - DNA, 14 bp, Homo sapiens
ctactcccctgggc

SEQ ID NO: 3313669 - DNA, 18 bp, Homo sapiens
ctactccctcttcactgt

SEQ ID NO: 3313670 - DNA, 22 bp, Homo sapiens
ctactccctgcagatgccaccc

SEQ ID NO: 3313671 - DNA, 17 bp, Homo sapiens
ctactcctacctcagcc

SEQ ID NO: 3313672 - DNA, 21 bp, Homo sapiens
ctactcctacctcagcctaga

SEQ ID NO: 3313673 - DNA, 14 bp, Homo sapiens
ctactcctctgcag

SEQ ID NO: 3313674 - DNA, 20 bp, Homo sapiens
ctactcctctgcagtgcctt

SEQ ID NO: 3313675 - DNA, 21 bp, Homo sapiens
ctactcctctgcagtgccttg

SEQ ID NO: 3313676 - DNA, 13 bp, Homo sapiens
ctactcctgactc

SEQ ID NO: 3313677 - DNA, 13 bp, Homo sapiens
ctactcctgtgct

SEQ ID NO: 3313678 - DNA, 14 bp, Homo sapiens
ctactcctgtgctc

SEQ ID NO: 3313679 - DNA, 22 bp, Homo sapiens
ctactcgggaggctgaggcagg

SEQ ID NO: 3313680 - DNA, 17 bp, Homo sapiens
ctactctccccacgagg

SEQ ID NO: 3313681 - DNA, 20 bp, Homo sapiens
ctactctccccacgagggct

SEQ ID NO: 3313682 - DNA, 22 bp, Homo sapiens
ctactctccccacgagggctgg

SEQ ID NO: 3313683 - DNA, 18 bp, Homo sapiens
ctactctgtccaggccac

SEQ ID NO: 3313684 - DNA, 14 bp, Homo sapiens
ctactctgtgccag

SEQ ID NO: 3313685 - DNA, 21 bp, Homo sapiens
ctactctgtgtcaggtggggc

SEQ ID NO: 3313686 - DNA, 18 bp, Homo sapiens
ctactgaaacagatttca

SEQ ID NO: 3313687 - DNA, 20 bp, Homo sapiens
ctactgacatgtggggccag

SEQ ID NO: 3313688 - DNA, 21 bp, Homo sapiens
ctactgagcatttgcacctct

SEQ ID NO: 3313689 - DNA, 13 bp, Homo sapiens
ctactgagtaggc

SEQ ID NO: 3313690 - DNA, 16 bp, Homo sapiens
ctactgatttcctttg

SEQ ID NO: 3313691 - DNA, 19 bp, Homo sapiens
ctactgcactccagcctgg

SEQ ID NO: 3313692 - DNA, 17 bp, Homo sapiens
ctactggacttgaatgg

SEQ ID NO: 3313693 - DNA, 15 bp, Homo sapiens
ctactggattcttat

SEQ ID NO: 3313694 - DNA, 15 bp, Homo sapiens
ctactggcagctcct

SEQ ID NO: 3313695 - DNA, 23 bp, Homo sapiens
ctactggcctccctttgtgtgca

SEQ ID NO: 3313696 - DNA, 15 bp, Homo sapiens
ctactgtcctcagag

SEQ ID NO: 3313697 - DNA, 20 bp, Homo sapiens
ctactgtctcactgaaacat

SEQ ID NO: 3313698 - DNA, 15 bp, Homo sapiens
ctactgtgtgtgtga

SEQ ID NO: 3313699 - DNA, 12 bp, Homo sapiens
ctactgtgttcc

SEQ ID NO: 3313700 - DNA, 20 bp, Homo sapiens
ctactgtgttcctggcaata

SEQ ID NO: 3313701 - DNA, 18 bp, Homo sapiens
ctactgttcctttcagat

SEQ ID NO: 3313702 - DNA, 13 bp, Homo sapiens
ctacttaagagaa

SEQ ID NO: 3313703 - DNA, 22 bp, Homo sapiens
ctacttaattcctttctcatcc

SEQ ID NO: 3313704 - DNA, 17 bp, Homo sapiens
ctacttagcatgtccct

SEQ ID NO: 3313705 - DNA, 19 bp, Homo sapiens
ctacttcatagctccttgg

SEQ ID NO: 3313706 - DNA, 20 bp, Homo sapiens
ctacttctgactttacttgt

SEQ ID NO: 3313707 - DNA, 23 bp, Homo sapiens
ctacttgataatattagtgattc

SEQ ID NO: 3313708 - DNA, 18 bp, Homo sapiens
ctacttgcagtacatcaa

SEQ ID NO: 3313709 - DNA, 23 bp, Homo sapiens
ctacttggtggtttgcttgctct

SEQ ID NO: 3313710 - DNA, 13 bp, Homo sapiens
ctacttggtttgt

SEQ ID NO: 3313711 - DNA, 17 bp, Homo sapiens
ctacttggtttgtgttc

SEQ ID NO: 3313712 - DNA, 14 bp, Homo sapiens
ctactttataacta

SEQ ID NO: 3313713 - DNA, 14 bp, Homo sapiens
ctactttccaggct

SEQ ID NO: 3313714 - DNA, 21 bp, Homo sapiens
ctagaaaatttagccctttaa

SEQ ID NO: 3313715 - DNA, 21 bp, Homo sapiens
ctagaaacccaagctcctcct

SEQ ID NO: 3313716 - DNA, 19 bp, Homo sapiens
ctagaaatgtgaatgagga

SEQ ID NO: 3313717 - DNA, 15 bp, Homo sapiens
ctagaaattcttaag

SEQ ID NO: 3313718 - DNA, 23 bp, Homo sapiens
ctagaaatttttcagatgcttct

SEQ ID NO: 3313719 - DNA, 14 bp, Homo sapiens
ctagaacacaggca

SEQ ID NO: 3313720 - DNA, 16 bp, Homo sapiens
ctagaacactaactca

SEQ ID NO: 3313721 - DNA, 19 bp, Homo sapiens
ctagaacactaactcacca

SEQ ID NO: 3313722 - DNA, 16 bp, Homo sapiens
ctagaaccacttcctg

SEQ ID NO: 3313723 - DNA, 14 bp, Homo sapiens
ctagaacctgggct

SEQ ID NO: 3313724 - DNA, 16 bp, Homo sapiens
ctagaacctgggctgt

SEQ ID NO: 3313725 - DNA, 18 bp, Homo sapiens
ctagaactccctttcaac

SEQ ID NO: 3313726 - DNA, 11 bp, Homo sapiens
ctagaactttt

SEQ ID NO: 3313727 - DNA, 13 bp, Homo sapiens
ctagaactttttt

SEQ ID NO: 3313728 - DNA, 15 bp, Homo sapiens
ctagaacttttttaa

SEQ ID NO: 3313729 - DNA, 21 bp, Homo sapiens
ctagaacttttttaaataaac

SEQ ID NO: 3313730 - DNA, 22 bp, Homo sapiens
ctagaacttttttaaataaact

SEQ ID NO: 3313731 - DNA, 23 bp, Homo sapiens
ctagaacttttttaaataaactt

SEQ ID NO: 3313732 - DNA, 16 bp, Homo sapiens
ctagaagcacatgtgt

SEQ ID NO: 3313733 - DNA, 12 bp, Homo sapiens
ctagaagccaag

SEQ ID NO: 3313734 - DNA, 13 bp, Homo sapiens
ctagaagccaagg

SEQ ID NO: 3313735 - DNA, 16 bp, Homo sapiens
ctagaagccaagggaa

SEQ ID NO: 3313736 - DNA, 20 bp, Homo sapiens
ctagaagccaagggaaaggg

SEQ ID NO: 3313737 - DNA, 21 bp, Homo sapiens
ctagaagccaagggaaagggg

SEQ ID NO: 3313738 - DNA, 19 bp, Homo sapiens
ctagaagcctaagaactgt

SEQ ID NO: 3313739 - DNA, 22 bp, Homo sapiens
ctagaagtttcccttcctccat

SEQ ID NO: 3313740 - DNA, 12 bp, Homo sapiens
ctagaatacttt

SEQ ID NO: 3313741 - DNA, 14 bp, Homo sapiens
ctagaatctttatt

SEQ ID NO: 3313742 - DNA, 20 bp, Homo sapiens
ctagaattataagtcacaaa

SEQ ID NO: 3313743 - DNA, 22 bp, Homo sapiens
ctagaatttattcaattcctct

SEQ ID NO: 3313744 - DNA, 17 bp, Homo sapiens
ctagaatttgtattttg

SEQ ID NO: 3313745 - DNA, 18 bp, Homo sapiens
ctagaatttgtattttgc

SEQ ID NO: 3313746 - DNA, 19 bp, Homo sapiens
ctagaatttgtattttgct

SEQ ID NO: 3313747 - DNA, 18 bp, Homo sapiens
ctagacaccaaagttcta

SEQ ID NO: 3313748 - DNA, 13 bp, Homo sapiens
ctagacactgcca

SEQ ID NO: 3313749 - DNA, 14 bp, Homo sapiens
ctagacattctgtc

SEQ ID NO: 3313750 - DNA, 16 bp, Homo sapiens
ctagacattctgtcgc

SEQ ID NO: 3313751 - DNA, 14 bp, Homo sapiens
ctagacccaggtgg

SEQ ID NO: 3313752 - DNA, 23 bp, Homo sapiens
ctagactggagtgaggcttccag

SEQ ID NO: 3313753 - DNA, 15 bp, Homo sapiens
ctagactgttacttt

SEQ ID NO: 3313754 - DNA, 18 bp, Homo sapiens
ctagactgttactttggc

SEQ ID NO: 3313755 - DNA, 19 bp, Homo sapiens
ctagacttcccaacagcct

SEQ ID NO: 3313756 - DNA, 22 bp, Homo sapiens
ctagacttgaaagttttccagt

SEQ ID NO: 3313757 - DNA, 12 bp, Homo sapiens
ctagactttctg

SEQ ID NO: 3313758 - DNA, 13 bp, Homo sapiens
ctagactttctgt

SEQ ID NO: 3313759 - DNA, 14 bp, Homo sapiens
ctagactttctgtt

SEQ ID NO: 3313760 - DNA, 23 bp, Homo sapiens
ctagactttgggatcaaataact

SEQ ID NO: 3313761 - DNA, 14 bp, Homo sapiens
ctagagaagataat

SEQ ID NO: 3313762 - DNA, 15 bp, Homo sapiens
ctagagaagataatt

SEQ ID NO: 3313763 - DNA, 20 bp, Homo sapiens
ctagagaagataattgttga

SEQ ID NO: 3313764 - DNA, 21 bp, Homo sapiens
ctagagaatgcacagatatac

SEQ ID NO: 3313765 - DNA, 16 bp, Homo sapiens
ctagagacaaatcttt

SEQ ID NO: 3313766 - DNA, 23 bp, Homo sapiens
ctagagacagaagcaggctggag

SEQ ID NO: 3313767 - DNA, 22 bp, Homo sapiens
ctagagatctggttttgctatt

SEQ ID NO: 3313768 - DNA, 16 bp, Homo sapiens
ctagagcaacccctgt

SEQ ID NO: 3313769 - DNA, 21 bp, Homo sapiens
ctagagcaacccctgtaccca

SEQ ID NO: 3313770 - DNA, 15 bp, Homo sapiens
ctagagccagaccaa

SEQ ID NO: 3313771 - DNA, 17 bp, Homo sapiens
ctagagccgggcacagc

SEQ ID NO: 3313772 - DNA, 16 bp, Homo sapiens
ctagagcgcggctggc

SEQ ID NO: 3313773 - DNA, 17 bp, Homo sapiens
ctagagcgcggctggct

SEQ ID NO: 3313774 - DNA, 18 bp, Homo sapiens
ctagagcgcggctggctc

SEQ ID NO: 3313775 - DNA, 22 bp, Homo sapiens
ctagaggatgaaggctgtgaaa

SEQ ID NO: 3313776 - DNA, 18 bp, Homo sapiens
ctagaggcagggagggga

SEQ ID NO: 3313777 - DNA, 17 bp, Homo sapiens
ctagaggccagccccac

SEQ ID NO: 3313778 - DNA, 19 bp, Homo sapiens
ctagaggccagccccaccc

SEQ ID NO: 3313779 - DNA, 11 bp, Homo sapiens
ctagaggcctc

SEQ ID NO: 3313780 - DNA, 22 bp, Homo sapiens
ctagagggatacactgaagtta

SEQ ID NO: 3313781 - DNA, 16 bp, Homo sapiens
ctagagggttcctgta

SEQ ID NO: 3313782 - DNA, 21 bp, Homo sapiens
ctagaggtgggcagctgggcc

SEQ ID NO: 3313783 - DNA, 15 bp, Homo sapiens
ctagagtgtagccta

SEQ ID NO: 3313784 - DNA, 16 bp, Homo sapiens
ctagagtgtagcctaa

SEQ ID NO: 3313785 - DNA, 18 bp, Homo sapiens
ctatatataattctgtac

SEQ ID NO: 3313786 - DNA, 16 bp, Homo sapiens
ctatatatataaatat

SEQ ID NO: 3313787 - DNA, 16 bp, Homo sapiens
ctatatatataaatgt

SEQ ID NO: 3313788 - DNA, 18 bp, Homo sapiens
ctatatatatatgccttt

SEQ ID NO: 3313789 - DNA, 17 bp, Homo sapiens
ctatatatgtgtatgta

SEQ ID NO: 3313790 - DNA, 12 bp, Homo sapiens
ctatatatttct

SEQ ID NO: 3313791 - DNA, 14 bp, Homo sapiens
ctatatatttctat

SEQ ID NO: 3313792 - DNA, 16 bp, Homo sapiens
ctatatccatgtactg

SEQ ID NO: 3313793 - DNA, 17 bp, Homo sapiens
ctatatcctgtgactgt

SEQ ID NO: 3313794 - DNA, 16 bp, Homo sapiens
ctatatgaatttaaat

SEQ ID NO: 3313795 - DNA, 17 bp, Homo sapiens
ctatatgatttatagtt

SEQ ID NO: 3313796 - DNA, 16 bp, Homo sapiens
ctatatggaattgctt

SEQ ID NO: 3313797 - DNA, 13 bp, Homo sapiens
ctatatggcaaga

SEQ ID NO: 3313798 - DNA, 17 bp, Homo sapiens
ctatattattatatata

SEQ ID NO: 3313799 - DNA, 23 bp, Homo sapiens
ctatattctatacacaccctgcc

SEQ ID NO: 3313800 - DNA, 18 bp, Homo sapiens
ctatattgattgtccttt

SEQ ID NO: 3313801 - DNA, 22 bp, Homo sapiens
ctatattgttttcagtgtacat

SEQ ID NO: 3313802 - DNA, 16 bp, Homo sapiens
ctatatttcaatactg

SEQ ID NO: 3313803 - DNA, 19 bp, Homo sapiens
ctatatttgtgctatttaa

SEQ ID NO: 3313804 - DNA, 14 bp, Homo sapiens
ctatattttaatag

SEQ ID NO: 3313805 - DNA, 17 bp, Homo sapiens
ctatatttttgtactga

SEQ ID NO: 3313806 - DNA, 14 bp, Homo sapiens
ctatcaaaagaaat

SEQ ID NO: 3313807 - DNA, 15 bp, Homo sapiens
ctatcaagcccaggt

SEQ ID NO: 3313808 - DNA, 19 bp, Homo sapiens
ctatcacctagcagcctca

SEQ ID NO: 3313809 - DNA, 17 bp, Homo sapiens
ctatcacctatttccat

SEQ ID NO: 3313810 - DNA, 13 bp, Homo sapiens
ctatcagaagacc

SEQ ID NO: 3313811 - DNA, 19 bp, Homo sapiens
ctatcagagttgctgcaaa

SEQ ID NO: 3313812 - DNA, 14 bp, Homo sapiens
ctatcagcaatact

SEQ ID NO: 3313813 - DNA, 13 bp, Homo sapiens
ctatcatggcata

SEQ ID NO: 3313814 - DNA, 13 bp, Homo sapiens
ctatcattctcag

SEQ ID NO: 3313815 - DNA, 18 bp, Homo sapiens
ctatcattgcttcctcct

SEQ ID NO: 3313816 - DNA, 20 bp, Homo sapiens
ctatcattgcttcctcctcc

SEQ ID NO: 3313817 - DNA, 16 bp, Homo sapiens
ctatcatttttgtaca

SEQ ID NO: 3313818 - DNA, 16 bp, Homo sapiens
ctatccatgcaccaaa

SEQ ID NO: 3313819 - DNA, 17 bp, Homo sapiens
ctatccatgcaccaaac

SEQ ID NO: 3313820 - DNA, 17 bp, Homo sapiens
ctatccccatctccctg

SEQ ID NO: 3313821 - DNA, 21 bp, Homo sapiens
ctatccccatctccctgcctg

SEQ ID NO: 3313822 - DNA, 14 bp, Homo sapiens
ctatccgctgccag

SEQ ID NO: 3313823 - DNA, 22 bp, Homo sapiens
ctatccgctgccagccttgagc

SEQ ID NO: 3313824 - DNA, 19 bp, Homo sapiens
ctatcctgaaaattctgta

SEQ ID NO: 3313825 - DNA, 13 bp, Homo sapiens
ctatccttcgtga

SEQ ID NO: 3313826 - DNA, 11 bp, Homo sapiens
ctatccttggc

SEQ ID NO: 3313827 - DNA, 18 bp, Homo sapiens
ctatccttggcaccaaag

SEQ ID NO: 3313828 - DNA, 14 bp, Homo sapiens
ctatcgagtttgca

SEQ ID NO: 3313829 - DNA, 18 bp, Homo sapiens
ctatcgagtttgcaatgt

SEQ ID NO: 3313830 - DNA, 16 bp, Homo sapiens
ctatctaaccctccca

SEQ ID NO: 3313831 - DNA, 17 bp, Homo sapiens
ctatctaaccctcccat

SEQ ID NO: 3313832 - DNA, 18 bp, Homo sapiens
ctatctagttctaacagt

SEQ ID NO: 3313833 - DNA, 12 bp, Homo sapiens
ctatctcatcta

SEQ ID NO: 3313834 - DNA, 21 bp, Homo sapiens
ctatctcatctatctcaatcc

SEQ ID NO: 3313835 - DNA, 12 bp, Homo sapiens
ctatctcctgac

SEQ ID NO: 3313836 - DNA, 15 bp, Homo sapiens
ctatctcctgacaga

SEQ ID NO: 3313837 - DNA, 14 bp, Homo sapiens
ctatctgagtgaat

SEQ ID NO: 3313838 - DNA, 16 bp, Homo sapiens
ctatctgagtgaatta

SEQ ID NO: 3313839 - DNA, 13 bp, Homo sapiens
ctatctgggcctg

SEQ ID NO: 3313840 - DNA, 16 bp, Homo sapiens
ctatctgggcctgggc

SEQ ID NO: 3313841 - DNA, 17 bp, Homo sapiens
ctatctgggcctgggct

SEQ ID NO: 3313842 - DNA, 21 bp, Homo sapiens
ctatctggggagctcctggcc

SEQ ID NO: 3313843 - DNA, 22 bp, Homo sapiens
ctatctgtcatctctctggggc

SEQ ID NO: 3313844 - DNA, 11 bp, Homo sapiens
ctatctgtctg

SEQ ID NO: 3313845 - DNA, 18 bp, Homo sapiens
ctatctgtctggtggccc

SEQ ID NO: 3313846 - DNA, 13 bp, Homo sapiens
ctatcttccaaat

SEQ ID NO: 3313847 - DNA, 12 bp, Homo sapiens
ctatgaacaact

SEQ ID NO: 3313848 - DNA, 20 bp, Homo sapiens
ctatgaagttgctgtttatt

SEQ ID NO: 3313849 - DNA, 17 bp, Homo sapiens
ctatgaattctaagtga

SEQ ID NO: 3313850 - DNA, 17 bp, Homo sapiens
ctatgagaacaagtcac

SEQ ID NO: 3313851 - DNA, 13 bp, Homo sapiens
ctatgaggaaagg

SEQ ID NO: 3313852 - DNA, 13 bp, Homo sapiens
ctatgagtctaga

SEQ ID NO: 3313853 - DNA, 21 bp, Homo sapiens
ctatgataaattatgataata

SEQ ID NO: 3313854 - DNA, 23 bp, Homo sapiens
ctatgatattccccatttcctgt

SEQ ID NO: 3313855 - DNA, 21 bp, Homo sapiens
ctatgatcccagcactttggg

SEQ ID NO: 3313856 - DNA, 19 bp, Homo sapiens
ctatgatgtgaaacacttt

SEQ ID NO: 3313857 - DNA, 17 bp, Homo sapiens
ctatgattgtactttga

SEQ ID NO: 3313858 - DNA, 13 bp, Homo sapiens
ctatgcacagagc

SEQ ID NO: 3313859 - DNA, 14 bp, Homo sapiens
ctatgcacagagcc

SEQ ID NO: 3313860 - DNA, 15 bp, Homo sapiens
ctatgcacagagccc

SEQ ID NO: 3313861 - DNA, 12 bp, Homo sapiens
ctatgcacatat

SEQ ID NO: 3313862 - DNA, 13 bp, Homo sapiens
ctatgcacatatg

SEQ ID NO: 3313863 - DNA, 12 bp, Homo sapiens
ctatgcagcctg

SEQ ID NO: 3313864 - DNA, 15 bp, Homo sapiens
ctatgcagcctgctc

SEQ ID NO: 3313865 - DNA, 22 bp, Homo sapiens
ctatgcccaggtaccacccttc

SEQ ID NO: 3313866 - DNA, 17 bp, Homo sapiens
ctatgccccaaatatag

SEQ ID NO: 3313867 - DNA, 21 bp, Homo sapiens
ctatgctggtaggctcctgcc

SEQ ID NO: 3313868 - DNA, 22 bp, Homo sapiens
ctatgctgttcactggacactt

SEQ ID NO: 3313869 - DNA, 19 bp, Homo sapiens
ctatggagagaattaaaac

SEQ ID NO: 3313870 - DNA, 19 bp, Homo sapiens
ctatggagcctggcacagg

SEQ ID NO: 3313871 - DNA, 19 bp, Homo sapiens
ctatggagggtcctcctcc

SEQ ID NO: 3313872 - DNA, 14 bp, Homo sapiens
ctatggatggcttc

SEQ ID NO: 3313873 - DNA, 13 bp, Homo sapiens
ctatggctttcaa

SEQ ID NO: 3313874 - DNA, 23 bp, Homo sapiens
ctatgggactcaatgcactgaca

SEQ ID NO: 3313875 - DNA, 13 bp, Homo sapiens
ctatgggagcccc

SEQ ID NO: 3313876 - DNA, 17 bp, Homo sapiens
ctatgggagccccaggg

SEQ ID NO: 3313877 - DNA, 22 bp, Homo sapiens
ctatggtatgctggccagcacc

SEQ ID NO: 3313878 - DNA, 15 bp, Homo sapiens
ctatggttatgaaag

SEQ ID NO: 3313879 - DNA, 22 bp, Homo sapiens
ctatgtatggaatacagtgtta

SEQ ID NO: 3313880 - DNA, 11 bp, Homo sapiens
ctatgtatgtt

SEQ ID NO: 3313881 - DNA, 14 bp, Homo sapiens
ctatgtatgttaat

SEQ ID NO: 3313882 - DNA, 20 bp, Homo sapiens
ctatgtatgttaatttattt

SEQ ID NO: 3313883 - DNA, 14 bp, Homo sapiens
ctatgtattaattt

SEQ ID NO: 3313884 - DNA, 17 bp, Homo sapiens
ctatgtattaatttaga

SEQ ID NO: 3313885 - DNA, 22 bp, Homo sapiens
ctatgtatttgcagttcacctg

SEQ ID NO: 3313886 - DNA, 22 bp, Homo sapiens
ctatgtcctaaggacacactaa

SEQ ID NO: 3313887 - DNA, 12 bp, Homo sapiens
ctatgtgacaat

SEQ ID NO: 3313888 - DNA, 17 bp, Homo sapiens
ctatgtgccttatgttg

SEQ ID NO: 3313889 - DNA, 22 bp, Homo sapiens
ctatgtgccttatgttgaaaaa

SEQ ID NO: 3313890 - DNA, 14 bp, Homo sapiens
ctatgtgtttttct

SEQ ID NO: 3313891 - DNA, 18 bp, Homo sapiens
ctatgttactattttcta

SEQ ID NO: 3313892 - DNA, 22 bp, Homo sapiens
ctatgttactattttctacaat

SEQ ID NO: 3313893 - DNA, 14 bp, Homo sapiens
ctatgttccccagg

SEQ ID NO: 3313894 - DNA, 16 bp, Homo sapiens
ctatgttgcccaggca

SEQ ID NO: 3313895 - DNA, 18 bp, Homo sapiens
ctatgttgcccaggcagg

SEQ ID NO: 3313896 - DNA, 21 bp, Homo sapiens
ctatgttgcccaggcaggtct

SEQ ID NO: 3313897 - DNA, 22 bp, Homo sapiens
ctatgttgcccaggcaggtctt

SEQ ID NO: 3313898 - DNA, 12 bp, Homo sapiens
ctatgtttgtat

SEQ ID NO: 3313899 - DNA, 21 bp, Homo sapiens
ctatgtttgtgtgatttccta

SEQ ID NO: 3313900 - DNA, 19 bp, Homo sapiens
ctattaaagtgctaaggtt

SEQ ID NO: 3313901 - DNA, 23 bp, Homo sapiens
ctattaaagtgctaaggttctaa

SEQ ID NO: 3313902 - DNA, 16 bp, Homo sapiens
ctattaagcagtaaaa

SEQ ID NO: 3313903 - DNA, 20 bp, Homo sapiens
ctattaagcagtaaaaactg

SEQ ID NO: 3313904 - DNA, 15 bp, Homo sapiens
ctattaatatatgta

SEQ ID NO: 3313905 - DNA, 14 bp, Homo sapiens
ctattagactgtag

SEQ ID NO: 3313906 - DNA, 12 bp, Homo sapiens
ctattagacttt

SEQ ID NO: 3313907 - DNA, 18 bp, Homo sapiens
ctattagactttagaaat

SEQ ID NO: 3313908 - DNA, 20 bp, Homo sapiens
ctattagactttagaaataa

SEQ ID NO: 3313909 - DNA, 15 bp, Homo sapiens
ctattatggaaaact

SEQ ID NO: 3313910 - DNA, 17 bp, Homo sapiens
ctattatggaaaactgt

SEQ ID NO: 3313911 - DNA, 18 bp, Homo sapiens
ctattatggaaaactgtg

SEQ ID NO: 3313912 - DNA, 22 bp, Homo sapiens
ctattattttcactgtagaatg

SEQ ID NO: 3313913 - DNA, 16 bp, Homo sapiens
ctattatttttataat

SEQ ID NO: 3313914 - DNA, 15 bp, Homo sapiens
ctattcagacaagca

SEQ ID NO: 3313915 - DNA, 19 bp, Homo sapiens
ctattcagtggcgagaaat

SEQ ID NO: 3313916 - DNA, 17 bp, Homo sapiens
ctattcattaaatgttt

SEQ ID NO: 3313917 - DNA, 19 bp, Homo sapiens
ctattcccacacctccaca

SEQ ID NO: 3313918 - DNA, 16 bp, Homo sapiens
ctattccctttgactt

SEQ ID NO: 3313919 - DNA, 17 bp, Homo sapiens
ctattccctttgacttc

SEQ ID NO: 3313920 - DNA, 21 bp, Homo sapiens
ctattccctttgacttcagct

SEQ ID NO: 3313921 - DNA, 23 bp, Homo sapiens
ctattccctttgacttcagctgc

SEQ ID NO: 3313922 - DNA, 17 bp, Homo sapiens
ctattccgagcccttag

SEQ ID NO: 3313923 - DNA, 16 bp, Homo sapiens
ctattccttctggcct

SEQ ID NO: 3313924 - DNA, 23 bp, Homo sapiens
ctattccttctggcctttcctct

SEQ ID NO: 3313925 - DNA, 22 bp, Homo sapiens
ctattctataaaactctgcatg

SEQ ID NO: 3313926 - DNA, 14 bp, Homo sapiens
ctattctattgcag

SEQ ID NO: 3313927 - DNA, 23 bp, Homo sapiens
ctattctcaaagttaaaagtaaa

SEQ ID NO: 3313928 - DNA, 21 bp, Homo sapiens
ctattctcaaagtttcctaat

SEQ ID NO: 3313929 - DNA, 16 bp, Homo sapiens
ctattctcatgcctca

SEQ ID NO: 3313930 - DNA, 13 bp, Homo sapiens
ctattctgagcct

SEQ ID NO: 3313931 - DNA, 12 bp, Homo sapiens
ctattctgtcag

SEQ ID NO: 3313932 - DNA, 22 bp, Homo sapiens
ctattctgtcagtgttaaagat

SEQ ID NO: 3313933 - DNA, 17 bp, Homo sapiens
ctattgacaagtcattt

SEQ ID NO: 3313934 - DNA, 21 bp, Homo sapiens
ctattgatgtacagtctgtca

SEQ ID NO: 3313935 - DNA, 22 bp, Homo sapiens
ctattgcaaaggttccaactgt

SEQ ID NO: 3313936 - DNA, 14 bp, Homo sapiens
ctattgctcatcag

SEQ ID NO: 3313937 - DNA, 15 bp, Homo sapiens
ctattgttgtgggct

SEQ ID NO: 3313938 - DNA, 14 bp, Homo sapiens
ctattgtttattct

SEQ ID NO: 3313939 - DNA, 22 bp, Homo sapiens
ctattgtttattctttttaaag

SEQ ID NO: 3313940 - DNA, 15 bp, Homo sapiens
ctatttaaagcctcc

SEQ ID NO: 3313941 - DNA, 15 bp, Homo sapiens
ctatttaaattcttt

SEQ ID NO: 3313942 - DNA, 23 bp, Homo sapiens
ctatttacctgcaggctgagcca

SEQ ID NO: 3313943 - DNA, 21 bp, Homo sapiens
ctatttataatacagaatctt

SEQ ID NO: 3313944 - DNA, 17 bp, Homo sapiens
ctatttatatgtacatg

SEQ ID NO: 3313945 - DNA, 21 bp, Homo sapiens
ctatttatctgtagtaaacta

SEQ ID NO: 3313946 - DNA, 19 bp, Homo sapiens
ctatttatctgtgtttttg

SEQ ID NO: 3313947 - DNA, 17 bp, Homo sapiens
ctatttattaatattta

SEQ ID NO: 3313948 - DNA, 15 bp, Homo sapiens
ctatttattgacttt

SEQ ID NO: 3313949 - DNA, 16 bp, Homo sapiens
ctatttattgactttg

SEQ ID NO: 3313950 - DNA, 18 bp, Homo sapiens
ctatttatttactgagct

SEQ ID NO: 3313951 - DNA, 16 bp, Homo sapiens
ctatttattttcctaa

SEQ ID NO: 3313952 - DNA, 21 bp, Homo sapiens
ctatttattttcctaaagaga

SEQ ID NO: 3313953 - DNA, 17 bp, Homo sapiens
ctatttcatgtttttga

SEQ ID NO: 3313954 - DNA, 13 bp, Homo sapiens
ctatttcattttt

SEQ ID NO: 3313955 - DNA, 17 bp, Homo sapiens
ctatttccattccagaa

SEQ ID NO: 3313956 - DNA, 23 bp, Homo sapiens
ctatttccccaggggaaaatgaa

SEQ ID NO: 3313957 - DNA, 22 bp, Homo sapiens
ctatttctacacagtgggaact

SEQ ID NO: 3313958 - DNA, 22 bp, Homo sapiens
ctatttctgggtcttttgctac

SEQ ID NO: 3313959 - DNA, 13 bp, Homo sapiens
ctatttgaaatac

SEQ ID NO: 3313960 - DNA, 14 bp, Homo sapiens
ctatttgaagaaaa

SEQ ID NO: 3313961 - DNA, 20 bp, Homo sapiens
ctatttgaagaaaaaaatgt

SEQ ID NO: 3313962 - DNA, 23 bp, Homo sapiens
ctatttgaagaaaaaaatgtaca

SEQ ID NO: 3313963 - DNA, 22 bp, Homo sapiens
ctatttgccatgggcttcactg

SEQ ID NO: 3313964 - DNA, 21 bp, Homo sapiens
ctatttgtagattaggattaa

SEQ ID NO: 3313965 - DNA, 16 bp, Homo sapiens
ctatttgtgtgtatgc

SEQ ID NO: 3313966 - DNA, 20 bp, Homo sapiens
ctatttgttcagagaggcct

SEQ ID NO: 3313967 - DNA, 23 bp, Homo sapiens
ctattttaagactgattttaata

SEQ ID NO: 3313968 - DNA, 14 bp, Homo sapiens
ctattttcacaatt

SEQ ID NO: 3313969 - DNA, 23 bp, Homo sapiens
ctattttcagaatctgaatgtaa

SEQ ID NO: 3313970 - DNA, 19 bp, Homo sapiens
ctattttgacagttatttt

SEQ ID NO: 3313971 - DNA, 17 bp, Homo sapiens
ctattttggattgtata

SEQ ID NO: 3313972 - DNA, 17 bp, Homo sapiens
ctattttgggtattaat

SEQ ID NO: 3313973 - DNA, 22 bp, Homo sapiens
ctatttttgacatggaaatgaa

SEQ ID NO: 3313974 - DNA, 15 bp, Homo sapiens
ctatttttgtaaact

SEQ ID NO: 3313975 - DNA, 12 bp, Homo sapiens
ctatttttgtgt

SEQ ID NO: 3313976 - DNA, 13 bp, Homo sapiens
ctatttttgttgt

SEQ ID NO: 3313977 - DNA, 20 bp, Homo sapiens
ctatttttttaactgaaaat

SEQ ID NO: 3313978 - DNA, 17 bp, Homo sapiens
ctatttttttagattga

SEQ ID NO: 3313979 - DNA, 22 bp, Homo sapiens
ctatttttttagattgagaaat

SEQ ID NO: 3313980 - DNA, 15 bp, Homo sapiens
ctcaaaaccatctct

SEQ ID NO: 3313981 - DNA, 17 bp, Homo sapiens
ctcaaaaccatctctct

SEQ ID NO: 3313982 - DNA, 20 bp, Homo sapiens
ctcaaaactggacagtcact

SEQ ID NO: 3313983 - DNA, 20 bp, Homo sapiens
ctcaaaacttaacatattta

SEQ ID NO: 3313984 - DNA, 20 bp, Homo sapiens
ctcaaaagcacccttgacgt

SEQ ID NO: 3313985 - DNA, 22 bp, Homo sapiens
ctcaaaagcatttatcattctt

SEQ ID NO: 3313986 - DNA, 21 bp, Homo sapiens
ctcaaaataaaaagcctcagt

SEQ ID NO: 3313987 - DNA, 13 bp, Homo sapiens
ctcaaaatatttg

SEQ ID NO: 3313988 - DNA, 22 bp, Homo sapiens
ctcaaactaaaagacatttgtt

SEQ ID NO: 3313989 - DNA, 23 bp, Homo sapiens
ctcaaactcattgcagcagataa

SEQ ID NO: 3313990 - DNA, 22 bp, Homo sapiens
ctcaaactgaggaatttcacct

SEQ ID NO: 3313991 - DNA, 22 bp, Homo sapiens
ctcaaagcggtttaaccacatt

SEQ ID NO: 3313992 - DNA, 17 bp, Homo sapiens
ctcaaaggagaaaaaaa

SEQ ID NO: 3313993 - DNA, 23 bp, Homo sapiens
ctcaaaggagaaaaaaaaccttg

SEQ ID NO: 3313994 - DNA, 13 bp, Homo sapiens
ctcaaagtctgca

SEQ ID NO: 3313995 - DNA, 14 bp, Homo sapiens
ctcaaagtctgcaa

SEQ ID NO: 3313996 - DNA, 17 bp, Homo sapiens
ctcaaagttttgaaaag

SEQ ID NO: 3313997 - DNA, 18 bp, Homo sapiens
ctcaaagttttgaaaagc

SEQ ID NO: 3313998 - DNA, 23 bp, Homo sapiens
ctcaaagttttgaaaagctatta

SEQ ID NO: 3313999 - DNA, 12 bp, Homo sapiens
ctcaaataacta

SEQ ID NO: 3314000 - DNA, 18 bp, Homo sapiens
ctcaaatacacatttgct

SEQ ID NO: 3314001 - DNA, 21 bp, Homo sapiens
ctcaaatgagtaacatttgct

SEQ ID NO: 3314002 - DNA, 22 bp, Homo sapiens
ctcaaatgttctaagtttctaa

SEQ ID NO: 3314003 - DNA, 23 bp, Homo sapiens
ctcaaatgttctaagtttctaag

SEQ ID NO: 3314004 - DNA, 24 bp, Homo sapiens
ctcaaatgttctaagtttctaaga

SEQ ID NO: 3314005 - DNA, 23 bp, Homo sapiens
ctcaaattaatctttctttacct

SEQ ID NO: 3314006 - DNA, 12 bp, Homo sapiens
ctcaaatttatt

SEQ ID NO: 3314007 - DNA, 19 bp, Homo sapiens
ctcaacaagggagagacct

SEQ ID NO: 3314008 - DNA, 14 bp, Homo sapiens
ctcaacaggcccag

SEQ ID NO: 3314009 - DNA, 16 bp, Homo sapiens
ctcaacattgcatggt

SEQ ID NO: 3314010 - DNA, 22 bp, Homo sapiens
ctcaaccccaccatatgaattg

SEQ ID NO: 3314011 - DNA, 21 bp, Homo sapiens
ctcaacccctcccctccatcc

SEQ ID NO: 3314012 - DNA, 17 bp, Homo sapiens
ctcaacctcctgggcta

SEQ ID NO: 3314013 - DNA, 14 bp, Homo sapiens
ctcaacctcctgtg

SEQ ID NO: 3314014 - DNA, 18 bp, Homo sapiens
ctcaacctcttctggctc

SEQ ID NO: 3314015 - DNA, 15 bp, Homo sapiens
ctcaacgtattgttt

SEQ ID NO: 3314016 - DNA, 20 bp, Homo sapiens
ctcaactattctgttccaca

SEQ ID NO: 3314017 - DNA, 17 bp, Homo sapiens
ctcaactctacccctgc

SEQ ID NO: 3314018 - DNA, 13 bp, Homo sapiens
ctcaactctgagc

SEQ ID NO: 3314019 - DNA, 16 bp, Homo sapiens
ctcaagaaattttcaa

SEQ ID NO: 3314020 - DNA, 20 bp, Homo sapiens
ctcaagaagacatggagact

SEQ ID NO: 3314021 - DNA, 11 bp, Homo sapiens
ctcaagacaat

SEQ ID NO: 3314022 - DNA, 20 bp, Homo sapiens
ctcaagagcacacagagaag

SEQ ID NO: 3314023 - DNA, 17 bp, Homo sapiens
ctcaagaggcagagttc

SEQ ID NO: 3314024 - DNA, 19 bp, Homo sapiens
ctcaagagggcactggtgg

SEQ ID NO: 3314025 - DNA, 21 bp, Homo sapiens
ctcaagatactgctactgtaa

SEQ ID NO: 3314026 - DNA, 16 bp, Homo sapiens
ctcaagatgaaggcaa

SEQ ID NO: 3314027 - DNA, 22 bp, Homo sapiens
ctcaagcagcgaccgccccctc

SEQ ID NO: 3314028 - DNA, 23 bp, Homo sapiens
ctcaagcagcgaccgccccctcc

SEQ ID NO: 3314029 - DNA, 18 bp, Homo sapiens
ctcaagccccagcagccc

SEQ ID NO: 3314030 - DNA, 21 bp, Homo sapiens
ctcaagccccagcagccctca

SEQ ID NO: 3314031 - DNA, 19 bp, Homo sapiens
ctcaagcccttggggaggg

SEQ ID NO: 3314032 - DNA, 17 bp, Homo sapiens
ctcaagcgattctcctg

SEQ ID NO: 3314033 - DNA, 13 bp, Homo sapiens
ctcaaggaatctt

SEQ ID NO: 3314034 - DNA, 15 bp, Homo sapiens
ctcaaggacttgaaa

SEQ ID NO: 3314035 - DNA, 19 bp, Homo sapiens
ctcaaggtgggccttgcta

SEQ ID NO: 3314036 - DNA, 20 bp, Homo sapiens
ctcaggaggcgcccttggct

SEQ ID NO: 3314037 - DNA, 20 bp, Homo sapiens
ctcaggatccaagctaagca

SEQ ID NO: 3314038 - DNA, 14 bp, Homo sapiens
ctcaggcaagcccc

SEQ ID NO: 3314039 - DNA, 15 bp, Homo sapiens
ctcaggcaagcccct

SEQ ID NO: 3314040 - DNA, 22 bp, Homo sapiens
ctcaggcaagcccctcagccct

SEQ ID NO: 3314041 - DNA, 15 bp, Homo sapiens
ctcaggcacacagct

SEQ ID NO: 3314042 - DNA, 18 bp, Homo sapiens
ctcaggcacacagctact

SEQ ID NO: 3314043 - DNA, 18 bp, Homo sapiens
ctcaggcactagcctttg

SEQ ID NO: 3314044 - DNA, 23 bp, Homo sapiens
ctcaggcactagcctttggctct

SEQ ID NO: 3314045 - DNA, 22 bp, Homo sapiens
ctcaggcagcgtgtgggtcccg

SEQ ID NO: 3314046 - DNA, 16 bp, Homo sapiens
ctcaggcataggcctg

SEQ ID NO: 3314047 - DNA, 21 bp, Homo sapiens
ctcaggcataggcctgggtgc

SEQ ID NO: 3314048 - DNA, 22 bp, Homo sapiens
ctcaggcataggcctgggtgct

SEQ ID NO: 3314049 - DNA, 22 bp, Homo sapiens
ctcaggcctccagcggcggagg

SEQ ID NO: 3314050 - DNA, 14 bp, Homo sapiens
ctcaggcgcctggc

SEQ ID NO: 3314051 - DNA, 15 bp, Homo sapiens
ctcaggcgcctggca

SEQ ID NO: 3314052 - DNA, 18 bp, Homo sapiens
ctcaggcgcctggcacat

SEQ ID NO: 3314053 - DNA, 11 bp, Homo sapiens
ctcaggctccg

SEQ ID NO: 3314054 - DNA, 19 bp, Homo sapiens
ctcaggctctgcacagaca

SEQ ID NO: 3314055 - DNA, 14 bp, Homo sapiens
ctcaggctctgctg

SEQ ID NO: 3314056 - DNA, 20 bp, Homo sapiens
ctcaggctctgctggtggaa

SEQ ID NO: 3314057 - DNA, 15 bp, Homo sapiens
ctcaggcttgaaatg

SEQ ID NO: 3314058 - DNA, 16 bp, Homo sapiens
ctcagggacagagcca

SEQ ID NO: 3314059 - DNA, 19 bp, Homo sapiens
ctcagggagcagggaaggc

SEQ ID NO: 3314060 - DNA, 16 bp, Homo sapiens
ctcagggcacgcagga

SEQ ID NO: 3314061 - DNA, 13 bp, Homo sapiens
ctcagggccatgc

SEQ ID NO: 3314062 - DNA, 18 bp, Homo sapiens
ctcagggccatgctgagg

SEQ ID NO: 3314063 - DNA, 19 bp, Homo sapiens
ctcagggccatgctgaggc

SEQ ID NO: 3314064 - DNA, 13 bp, Homo sapiens
ctcagggcgctca

SEQ ID NO: 3314065 - DNA, 16 bp, Homo sapiens
ctcagggcgctcagac

SEQ ID NO: 3314066 - DNA, 18 bp, Homo sapiens
ctcagggcgctcagacgg

SEQ ID NO: 3314067 - DNA, 15 bp, Homo sapiens
ctcagggctcccagg

SEQ ID NO: 3314068 - DNA, 21 bp, Homo sapiens
ctcagggctcctcccagcttg

SEQ ID NO: 3314069 - DNA, 16 bp, Homo sapiens
ctcagggctggagtgc

SEQ ID NO: 3314070 - DNA, 19 bp, Homo sapiens
ctcaggggaaaactgttac

SEQ ID NO: 3314071 - DNA, 14 bp, Homo sapiens
ctcaggggcagctc

SEQ ID NO: 3314072 - DNA, 17 bp, Homo sapiens
ctcaggggccagaggaa

SEQ ID NO: 3314073 - DNA, 14 bp, Homo sapiens
ctcaggggctgttt

SEQ ID NO: 3314074 - DNA, 15 bp, Homo sapiens
ctcaggggctgtttg

SEQ ID NO: 3314075 - DNA, 19 bp, Homo sapiens
ctcaggggctgtttgagga

SEQ ID NO: 3314076 - DNA, 15 bp, Homo sapiens
ctcagggtgcagagg

SEQ ID NO: 3314077 - DNA, 19 bp, Homo sapiens
ctcaggtgatccacccacc

SEQ ID NO: 3314078 - DNA, 20 bp, Homo sapiens
ctcaggtgatctacctgcct

SEQ ID NO: 3314079 - DNA, 16 bp, Homo sapiens
ctcaggtgccactccc

SEQ ID NO: 3314080 - DNA, 18 bp, Homo sapiens
ctcaggtgccactccctg

SEQ ID NO: 3314081 - DNA, 21 bp, Homo sapiens
ctcaggtgccactccctgagc

SEQ ID NO: 3314082 - DNA, 20 bp, Homo sapiens
ctcaggtggccagcctggat

SEQ ID NO: 3314083 - DNA, 23 bp, Homo sapiens
ctcaggtgtccctgcacttgcag

SEQ ID NO: 3314084 - DNA, 14 bp, Homo sapiens
ctcaggtgttgcca

SEQ ID NO: 3314085 - DNA, 22 bp, Homo sapiens
ctcaggtgttttttatgaagtg

SEQ ID NO: 3314086 - DNA, 14 bp, Homo sapiens
ctcaggttgtctga

SEQ ID NO: 3314087 - DNA, 15 bp, Homo sapiens
ctcaggtttgttttg

SEQ ID NO: 3314088 - DNA, 20 bp, Homo sapiens
ctcagtaaacgggaacatgc

SEQ ID NO: 3314089 - DNA, 16 bp, Homo sapiens
ctcagtaacatttctg

SEQ ID NO: 3314090 - DNA, 18 bp, Homo sapiens
ctcagtaacatttctgtt

SEQ ID NO: 3314091 - DNA, 22 bp, Homo sapiens
ctcagtaacatttctgttctca

SEQ ID NO: 3314092 - DNA, 18 bp, Homo sapiens
ctcagtatatttaaactc

SEQ ID NO: 3314093 - DNA, 18 bp, Homo sapiens
ctcagtatgctgcccctg

SEQ ID NO: 3314094 - DNA, 20 bp, Homo sapiens
ctcagtcagttcccggagca

SEQ ID NO: 3314095 - DNA, 22 bp, Homo sapiens
ctcagtcagttcccggagcaca

SEQ ID NO: 3314096 - DNA, 15 bp, Homo sapiens
ctcagtccatagcag

SEQ ID NO: 3314097 - DNA, 17 bp, Homo sapiens
ctcagtccatagcagag

SEQ ID NO: 3314098 - DNA, 20 bp, Homo sapiens
ctcagtcctcccctcacagc

SEQ ID NO: 3314099 - DNA, 23 bp, Homo sapiens
ctcagtcctcccctcacagcctc

SEQ ID NO: 3314100 - DNA, 15 bp, Homo sapiens
ctcagtctaaggtct

SEQ ID NO: 3314101 - DNA, 16 bp, Homo sapiens
ctcagtctcaggagca

SEQ ID NO: 3314102 - DNA, 14 bp, Homo sapiens
ctcagtctcttcca

SEQ ID NO: 3314103 - DNA, 24 bp, Homo sapiens
ctcagtctggtgctccagttccag

SEQ ID NO: 3314104 - DNA, 17 bp, Homo sapiens
ctcagtgcatttgtgct

SEQ ID NO: 3314105 - DNA, 13 bp, Homo sapiens
ctcagtgccacta

SEQ ID NO: 3314106 - DNA, 16 bp, Homo sapiens
ctcagtggatcttcag

SEQ ID NO: 3314107 - DNA, 17 bp, Homo sapiens
ctcagtggatcttcaga

SEQ ID NO: 3314108 - DNA, 13 bp, Homo sapiens
ctcagtggcagca

SEQ ID NO: 3314109 - DNA, 14 bp, Homo sapiens
ctcagtgtcattta

SEQ ID NO: 3314110 - DNA, 17 bp, Homo sapiens
ctcagtgtcatttatga

SEQ ID NO: 3314111 - DNA, 14 bp, Homo sapiens
ctcagtgttagaga

SEQ ID NO: 3314112 - DNA, 22 bp, Homo sapiens
ctcagtgttggtatattttata

SEQ ID NO: 3314113 - DNA, 23 bp, Homo sapiens
ctcagttattacatgtaatttga

SEQ ID NO: 3314114 - DNA, 22 bp, Homo sapiens
ctcagttcaacctggtggcacc

SEQ ID NO: 3314115 - DNA, 22 bp, Homo sapiens
ctcagttccatggcaattttgt

SEQ ID NO: 3314116 - DNA, 20 bp, Homo sapiens
ctcagttcccagctcccccc

SEQ ID NO: 3314117 - DNA, 19 bp, Homo sapiens
ctcagttcccttggcctca

SEQ ID NO: 3314118 - DNA, 16 bp, Homo sapiens
ctcagttctctccctt

SEQ ID NO: 3314119 - DNA, 13 bp, Homo sapiens
ctcagttggaaat

SEQ ID NO: 3314120 - DNA, 20 bp, Homo sapiens
ctcagttgtgactaactaga

SEQ ID NO: 3314121 - DNA, 22 bp, Homo sapiens
ctcagtttgtgtgtcttaatta

SEQ ID NO: 3314122 - DNA, 17 bp, Homo sapiens
ctcagttttatcatttt

SEQ ID NO: 3314123 - DNA, 13 bp, Homo sapiens
ctcagttttcata

SEQ ID NO: 3314124 - DNA, 17 bp, Homo sapiens
ctcataaaaagcaaaac

SEQ ID NO: 3314125 - DNA, 22 bp, Homo sapiens
ctcataatggaaaaaaagactg

SEQ ID NO: 3314126 - DNA, 16 bp, Homo sapiens
ctcataatgtgaaata

SEQ ID NO: 3314127 - DNA, 20 bp, Homo sapiens
ctcataatgtgaaatatgat

SEQ ID NO: 3314128 - DNA, 14 bp, Homo sapiens
ctcatagacactga

SEQ ID NO: 3314129 - DNA, 18 bp, Homo sapiens
ctcatagcattaactaat

SEQ ID NO: 3314130 - DNA, 20 bp, Homo sapiens
ctcatagccccggtgtgcgg

SEQ ID NO: 3314131 - DNA, 23 bp, Homo sapiens
ctcatagtatggtggctgggttg

SEQ ID NO: 3314132 - DNA, 16 bp, Homo sapiens
ctcatatatattttaa

SEQ ID NO: 3314133 - DNA, 14 bp, Homo sapiens
ctcatatgccaccc

SEQ ID NO: 3314134 - DNA, 19 bp, Homo sapiens
ctcatatggcccagtgtca

SEQ ID NO: 3314135 - DNA, 20 bp, Homo sapiens
ctcatatggtctaccagttt

SEQ ID NO: 3314136 - DNA, 13 bp, Homo sapiens
ctcatattgtgat

SEQ ID NO: 3314137 - DNA, 12 bp, Homo sapiens
ctcatattttgt

SEQ ID NO: 3314138 - DNA, 16 bp, Homo sapiens
ctcatcaactgaatga

SEQ ID NO: 3314139 - DNA, 13 bp, Homo sapiens
ctcatcagagcag

SEQ ID NO: 3314140 - DNA, 22 bp, Homo sapiens
ctcatcagagcagctagctctt

SEQ ID NO: 3314141 - DNA, 16 bp, Homo sapiens
ctcatcaggatgaacc

SEQ ID NO: 3314142 - DNA, 19 bp, Homo sapiens
ctcatccaccccatccctc

SEQ ID NO: 3314143 - DNA, 24 bp, Homo sapiens
ctcatccaccccatccctccccag

SEQ ID NO: 3314144 - DNA, 15 bp, Homo sapiens
ctcatccattcctct

SEQ ID NO: 3314145 - DNA, 21 bp, Homo sapiens
ctcatcccatgagaccctggt

SEQ ID NO: 3314146 - DNA, 22 bp, Homo sapiens
ctcatccccaggggtcccagcc

SEQ ID NO: 3314147 - DNA, 23 bp, Homo sapiens
ctcatccccaggggtcccagcca

SEQ ID NO: 3314148 - DNA, 16 bp, Homo sapiens
ctcatccccagtccca

SEQ ID NO: 3314149 - DNA, 19 bp, Homo sapiens
ctcatccccagtcccaatg

SEQ ID NO: 3314150 - DNA, 19 bp, Homo sapiens
ctcatcccgtgttctcctt

SEQ ID NO: 3314151 - DNA, 15 bp, Homo sapiens
ctcatccctcggaag

SEQ ID NO: 3314152 - DNA, 13 bp, Homo sapiens
ctcatcctcctgg

SEQ ID NO: 3314153 - DNA, 22 bp, Homo sapiens
ctcatcctggcacgccctactc

SEQ ID NO: 3314154 - DNA, 12 bp, Homo sapiens
ctcatccttaat

SEQ ID NO: 3314155 - DNA, 14 bp, Homo sapiens
ctcatctatctcaa

SEQ ID NO: 3314156 - DNA, 18 bp, Homo sapiens
ctcatctatctcaatcct

SEQ ID NO: 3314157 - DNA, 14 bp, Homo sapiens
ctcatctccaagga

SEQ ID NO: 3314158 - DNA, 20 bp, Homo sapiens
ctcatctccaaggatcctct

SEQ ID NO: 3314159 - DNA, 21 bp, Homo sapiens
ctcatctccaaggatcctctc

SEQ ID NO: 3314160 - DNA, 22 bp, Homo sapiens
ctcatctccaaggatcctctcc

SEQ ID NO: 3314161 - DNA, 15 bp, Homo sapiens
ctccccatcccatgt

SEQ ID NO: 3314162 - DNA, 16 bp, Homo sapiens
ctccccatccccattc

SEQ ID NO: 3314163 - DNA, 20 bp, Homo sapiens
ctccccatgtgtcctggttc

SEQ ID NO: 3314164 - DNA, 21 bp, Homo sapiens
ctccccatgtgtcctggttcc

SEQ ID NO: 3314165 - DNA, 18 bp, Homo sapiens
ctccccatttcccatctg

SEQ ID NO: 3314166 - DNA, 19 bp, Homo sapiens
ctccccatttcccatctgc

SEQ ID NO: 3314167 - DNA, 21 bp, Homo sapiens
ctccccatttcccatctgcac

SEQ ID NO: 3314168 - DNA, 22 bp, Homo sapiens
ctccccatttcccatctgcacc

SEQ ID NO: 3314169 - DNA, 12 bp, Homo sapiens
ctcccccaaagc

SEQ ID NO: 3314170 - DNA, 12 bp, Homo sapiens
ctcccccaaccc

SEQ ID NO: 3314171 - DNA, 16 bp, Homo sapiens
ctcccccaacccacct

SEQ ID NO: 3314172 - DNA, 20 bp, Homo sapiens
ctcccccaacccacctctgg

SEQ ID NO: 3314173 - DNA, 21 bp, Homo sapiens
ctcccccaacccacctctggc

SEQ ID NO: 3314174 - DNA, 13 bp, Homo sapiens
ctcccccacctga

SEQ ID NO: 3314175 - DNA, 16 bp, Homo sapiens
ctcccccacctgacaa

SEQ ID NO: 3314176 - DNA, 16 bp, Homo sapiens
ctcccccatctcccac

SEQ ID NO: 3314177 - DNA, 15 bp, Homo sapiens
ctccccccgcccacc

SEQ ID NO: 3314178 - DNA, 15 bp, Homo sapiens
ctcccccgacactgc

SEQ ID NO: 3314179 - DNA, 22 bp, Homo sapiens
ctcccccgacactgctgcacca

SEQ ID NO: 3314180 - DNA, 21 bp, Homo sapiens
ctcccccgcagtccccagccc

SEQ ID NO: 3314181 - DNA, 22 bp, Homo sapiens
ctcccccgcagtccccagccct

SEQ ID NO: 3314182 - DNA, 12 bp, Homo sapiens
ctccccctcaga

SEQ ID NO: 3314183 - DNA, 13 bp, Homo sapiens
ctccccctgcaac

SEQ ID NO: 3314184 - DNA, 11 bp, Homo sapiens
ctccccctgcc

SEQ ID NO: 3314185 - DNA, 12 bp, Homo sapiens
ctccccctgggc

SEQ ID NO: 3314186 - DNA, 12 bp, Homo sapiens
ctccccctgtcc

SEQ ID NO: 3314187 - DNA, 15 bp, Homo sapiens
ctccccgccttccgc

SEQ ID NO: 3314188 - DNA, 16 bp, Homo sapiens
ctccccggacatactc

SEQ ID NO: 3314189 - DNA, 15 bp, Homo sapiens
ctccccggcaccctc

SEQ ID NO: 3314190 - DNA, 18 bp, Homo sapiens
ctcccctaaccctacttt

SEQ ID NO: 3314191 - DNA, 21 bp, Homo sapiens
ctcccctcaagaaattttcaa

SEQ ID NO: 3314192 - DNA, 12 bp, Homo sapiens
aaaacaggtaga

SEQ ID NO: 3314193 - DNA, 22 bp, Homo sapiens
aaaacaggtagaattatctaat

SEQ ID NO: 3314194 - DNA, 18 bp, Homo sapiens
aaaacaggtatatacttt

SEQ ID NO: 3314195 - DNA, 18 bp, Homo sapiens
aaaacataatcttctgcc

SEQ ID NO: 3314196 - DNA, 24 bp, Homo sapiens
aaaacataatcttctgccttctca

SEQ ID NO: 3314197 - DNA, 23 bp, Homo sapiens
aaaacatagaaatggaaattttg

SEQ ID NO: 3314198 - DNA, 23 bp, Homo sapiens
aaaacatattcaaagcagcagcc

SEQ ID NO: 3314199 - DNA, 19 bp, Homo sapiens
aaaacatattcttgtgctt

SEQ ID NO: 3314200 - DNA, 16 bp, Homo sapiens
aaaacatatttcattt

SEQ ID NO: 3314201 - DNA, 21 bp, Homo sapiens
aaaacatgcttgaataactga

SEQ ID NO: 3314202 - DNA, 15 bp, Homo sapiens
aaaacatgtttattt

SEQ ID NO: 3314203 - DNA, 19 bp, Homo sapiens
aaaacatgtttatttttct

SEQ ID NO: 3314204 - DNA, 11 bp, Homo sapiens
aaaacattcca

SEQ ID NO: 3314205 - DNA, 17 bp, Homo sapiens
aaaacattgcttttgaa

SEQ ID NO: 3314206 - DNA, 15 bp, Homo sapiens
aaaacatttcaaagc

SEQ ID NO: 3314207 - DNA, 13 bp, Homo sapiens
aaaacatttgctg

SEQ ID NO: 3314208 - DNA, 21 bp, Homo sapiens
aaaacattttttaatagaata

SEQ ID NO: 3314209 - DNA, 15 bp, Homo sapiens
aaaaccaaacttgtt

SEQ ID NO: 3314210 - DNA, 22 bp, Homo sapiens
aaaaccaaagagggcttcctct

SEQ ID NO: 3314211 - DNA, 19 bp, Homo sapiens
aaaaccaagccgtggcttc

SEQ ID NO: 3314212 - DNA, 23 bp, Homo sapiens
aaaaccaatgattcataacaatg

SEQ ID NO: 3314213 - DNA, 15 bp, Homo sapiens
aaaaccatattttat

SEQ ID NO: 3314214 - DNA, 21 bp, Homo sapiens
aaaacccacaaaaatgttgaa

SEQ ID NO: 3314215 - DNA, 13 bp, Homo sapiens
aaaacctgacaaa

SEQ ID NO: 3314216 - DNA, 19 bp, Homo sapiens
aaaacctgtgccaggctga

SEQ ID NO: 3314217 - DNA, 13 bp, Homo sapiens
aaaaccttgtaaa

SEQ ID NO: 3314218 - DNA, 19 bp, Homo sapiens
aaaacgatgaagttatgct

SEQ ID NO: 3314219 - DNA, 13 bp, Homo sapiens
aaaacgcatggag

SEQ ID NO: 3314220 - DNA, 17 bp, Homo sapiens
aaaacgcatggagtgtg

SEQ ID NO: 3314221 - DNA, 23 bp, Homo sapiens
aaaacgcctcttttccctctcta

SEQ ID NO: 3314222 - DNA, 15 bp, Homo sapiens
aaaacgttttattgt

SEQ ID NO: 3314223 - DNA, 17 bp, Homo sapiens
aaaacgttttattgtgt

SEQ ID NO: 3314224 - DNA, 19 bp, Homo sapiens
aaaacgttttattgtgttt

SEQ ID NO: 3314225 - DNA, 13 bp, Homo sapiens
aaaactaatttca

SEQ ID NO: 3314226 - DNA, 17 bp, Homo sapiens
aaaactaatttcatact

SEQ ID NO: 3314227 - DNA, 21 bp, Homo sapiens
aaaactacaaatcaagtattt

SEQ ID NO: 3314228 - DNA, 20 bp, Homo sapiens
aaaactaggtaatgttttgt

SEQ ID NO: 3314229 - DNA, 15 bp, Homo sapiens
aaaactcactgtgat

SEQ ID NO: 3314230 - DNA, 15 bp, Homo sapiens
aggcctctgtgtcct

SEQ ID NO: 3314231 - DNA, 20 bp, Homo sapiens
aggcctctgtgtccttccct

SEQ ID NO: 3314232 - DNA, 22 bp, Homo sapiens
aggcctctgtgtccttccctgc

SEQ ID NO: 3314233 - DNA, 14 bp, Homo sapiens
aggcctcttgtgct

SEQ ID NO: 3314234 - DNA, 17 bp, Homo sapiens
aggcctgaaagaggctg

SEQ ID NO: 3314235 - DNA, 23 bp, Homo sapiens
aggcctgaaagaggctgaggcct

SEQ ID NO: 3314236 - DNA, 17 bp, Homo sapiens
aggcctgacttctgctg

SEQ ID NO: 3314237 - DNA, 19 bp, Homo sapiens
aggcctgaggcctgtgcct

SEQ ID NO: 3314238 - DNA, 20 bp, Homo sapiens
aggcctgaggcctgtgcctg

SEQ ID NO: 3314239 - DNA, 16 bp, Homo sapiens
aggcctgatgctgccc

SEQ ID NO: 3314240 - DNA, 22 bp, Homo sapiens
aggcctgcaaaccttcctggga

SEQ ID NO: 3314241 - DNA, 24 bp, Homo sapiens
aggcctgcacacaagcccacagca

SEQ ID NO: 3314242 - DNA, 18 bp, Homo sapiens
aggcctgcctcccacttc

SEQ ID NO: 3314243 - DNA, 22 bp, Homo sapiens
aggcctgcctcccacttcactg

SEQ ID NO: 3314244 - DNA, 17 bp, Homo sapiens
aggcctgctgccagtgc

SEQ ID NO: 3314245 - DNA, 17 bp, Homo sapiens
aggcctggactttcctg

SEQ ID NO: 3314246 - DNA, 18 bp, Homo sapiens
aggcctggactttcctgc

SEQ ID NO: 3314247 - DNA, 12 bp, Homo sapiens
aggcctggccag

SEQ ID NO: 3314248 - DNA, 15 bp, Homo sapiens
aggcctggccagatg

SEQ ID NO: 3314249 - DNA, 16 bp, Homo sapiens
aggcctggccagatgc

SEQ ID NO: 3314250 - DNA, 14 bp, Homo sapiens
aggcctggctggaa

SEQ ID NO: 3314251 - DNA, 17 bp, Homo sapiens
aggcctggctggaagag

SEQ ID NO: 3314252 - DNA, 19 bp, Homo sapiens
aggcctgggacccagctac

SEQ ID NO: 3314253 - DNA, 19 bp, Homo sapiens
aggcctgggccgctgccac

SEQ ID NO: 3314254 - DNA, 20 bp, Homo sapiens
aggcctgggccgctgccacg

SEQ ID NO: 3314255 - DNA, 21 bp, Homo sapiens
aggcctgggccgctgccacgt

SEQ ID NO: 3314256 - DNA, 18 bp, Homo sapiens
ggtccaccggcccctggc

SEQ ID NO: 3314257 - DNA, 15 bp, Homo sapiens
ggtccactccctgct

SEQ ID NO: 3314258 - DNA, 11 bp, Homo sapiens
ggtccagctct

SEQ ID NO: 3314259 - DNA, 15 bp, Homo sapiens
ggtccagctctgaca

SEQ ID NO: 3314260 - DNA, 18 bp, Homo sapiens
ggtccagctctgacatcc

SEQ ID NO: 3314261 - DNA, 21 bp, Homo sapiens
ggtccagctctgacatccctt

SEQ ID NO: 3314262 - DNA, 15 bp, Homo sapiens
ggtccagctctggag

SEQ ID NO: 3314263 - DNA, 22 bp, Homo sapiens
ggtccagctctggaggggaggg

SEQ ID NO: 3314264 - DNA, 18 bp, Homo sapiens
ggtccagctggcctggac

SEQ ID NO: 3314265 - DNA, 20 bp, Homo sapiens
ggtccagctggcctggacag

SEQ ID NO: 3314266 - DNA, 16 bp, Homo sapiens
ggtccaggaaggcagc

SEQ ID NO: 3314267 - DNA, 17 bp, Homo sapiens
ggtccaggaaggcagct

SEQ ID NO: 3314268 - DNA, 22 bp, Homo sapiens
ggtccaggaaggcagctgctct

SEQ ID NO: 3314269 - DNA, 14 bp, Homo sapiens
ggtcccaagacagt

SEQ ID NO: 3314270 - DNA, 23 bp, Homo sapiens
ggtcccaagacagtgagacagtc

SEQ ID NO: 3314271 - DNA, 17 bp, Homo sapiens
ggtcccacctccagccc

SEQ ID NO: 3314272 - DNA, 14 bp, Homo sapiens
ggtcccactcagtc

SEQ ID NO: 3314273 - DNA, 22 bp, Homo sapiens
ggtcccactcagtccatagcag

SEQ ID NO: 3314274 - DNA, 15 bp, Homo sapiens
ggtcccagtgggagg

SEQ ID NO: 3314275 - DNA, 19 bp, Homo sapiens
ggtcccagtgggaggggca

SEQ ID NO: 3314276 - DNA, 21 bp, Homo sapiens
ggtcccagtgggaggggcagg

SEQ ID NO: 3314277 - DNA, 22 bp, Homo sapiens
ggtcccagtgggaggggcaggc

SEQ ID NO: 3314278 - DNA, 11 bp, Homo sapiens
ggtcccatcca

SEQ ID NO: 3314279 - DNA, 12 bp, Homo sapiens
ggtcccatccag

SEQ ID NO: 3314280 - DNA, 17 bp, Homo sapiens
ggtcccatttctcactg

SEQ ID NO: 3314281 - DNA, 21 bp, Homo sapiens
ggtccccatcatcccagctgc

SEQ ID NO: 3314282 - DNA, 14 bp, Homo sapiens
ggtccccatcccca

SEQ ID NO: 3314283 - DNA, 17 bp, Homo sapiens
ggtccccgagtgcctag

SEQ ID NO: 3314284 - DNA, 22 bp, Homo sapiens
ggtccccgttccaccccaagag

SEQ ID NO: 3314285 - DNA, 15 bp, Homo sapiens
ggtcccctgcctgga

SEQ ID NO: 3314286 - DNA, 19 bp, Homo sapiens
ggtccctccgcggctggag

SEQ ID NO: 3314287 - DNA, 22 bp, Homo sapiens
ggtcccttaaggcacagtggga

SEQ ID NO: 3314288 - DNA, 20 bp, Homo sapiens
ggtcccttgaaggaagaggg

SEQ ID NO: 3314289 - DNA, 23 bp, Homo sapiens
ggtccgcaccagctgctctgccc

SEQ ID NO: 3314290 - DNA, 20 bp, Homo sapiens
ggtccgccttaatctggaag

SEQ ID NO: 3314291 - DNA, 17 bp, Homo sapiens
ggtccggtgttctaaga

SEQ ID NO: 3314292 - DNA, 21 bp, Homo sapiens
ggtccggtgttctaagatgtg

SEQ ID NO: 3314293 - DNA, 21 bp, Homo sapiens
ggtcctctcagttctctccct

SEQ ID NO: 3314294 - DNA, 17 bp, Homo sapiens
ggtcctgagggtcccca

SEQ ID NO: 3314295 - DNA, 22 bp, Homo sapiens
ggtcctgcccatgtgtcccctc

SEQ ID NO: 3314296 - DNA, 12 bp, Homo sapiens
ggtcctggctcc

SEQ ID NO: 3314297 - DNA, 14 bp, Homo sapiens
ggtcctggctcctg

SEQ ID NO: 3314298 - DNA, 12 bp, Homo sapiens
ggtcctggggct

SEQ ID NO: 3314299 - DNA, 22 bp, Homo sapiens
ggtcctggggctctgtgcaggg

SEQ ID NO: 3314300 - DNA, 17 bp, Homo sapiens
ggtcctgtggcaggcag

SEQ ID NO: 3314301 - DNA, 23 bp, Homo sapiens
ggtccttaggagacgctgcactt

SEQ ID NO: 3314302 - DNA, 21 bp, Homo sapiens
ggtccttcaagttagctcagg

SEQ ID NO: 3314303 - DNA, 22 bp, Homo sapiens
ggtccttcctttaggtctggtt

SEQ ID NO: 3314304 - DNA, 12 bp, Homo sapiens
ggtcctttctcc

SEQ ID NO: 3314305 - DNA, 13 bp, Homo sapiens
ggtcgctcctgcc

SEQ ID NO: 3314306 - DNA, 13 bp, Homo sapiens
ggtcggccctgcc

SEQ ID NO: 3314307 - DNA, 14 bp, Homo sapiens
ggtctagaagaaca

SEQ ID NO: 3314308 - DNA, 21 bp, Homo sapiens
ggtctcacagtgttgcccagg

SEQ ID NO: 3314309 - DNA, 21 bp, Homo sapiens
ggtctcactatgttgcccagg

SEQ ID NO: 3314310 - DNA, 12 bp, Homo sapiens
ggtctcactctg

SEQ ID NO: 3314311 - DNA, 21 bp, Homo sapiens
ggtctcaggatatccttatca

SEQ ID NO: 3314312 - DNA, 17 bp, Homo sapiens
ggtctcatgtcctgctg

SEQ ID NO: 3314313 - DNA, 18 bp, Homo sapiens
ggtctccaggggcctgca

SEQ ID NO: 3314314 - DNA, 15 bp, Homo sapiens
ggtctccccatcccc

SEQ ID NO: 3314315 - DNA, 11 bp, Homo sapiens
ggtctccctgg

SEQ ID NO: 3314316 - DNA, 14 bp, Homo sapiens
ggtctccctggctc

SEQ ID NO: 3314317 - DNA, 16 bp, Homo sapiens
ggtctccctggctccc

SEQ ID NO: 3314318 - DNA, 24 bp, Homo sapiens
ggtctccctggctccctcctccag

SEQ ID NO: 3314319 - DNA, 18 bp, Homo sapiens
ggtctccttactctgagc

SEQ ID NO: 3314320 - DNA, 23 bp, Homo sapiens
ggtctcgctgtcactggctggct

SEQ ID NO: 3314321 - DNA, 19 bp, Homo sapiens
ggtctcgctttgttgccca

SEQ ID NO: 3314322 - DNA, 12 bp, Homo sapiens
ggtctcttcctt

SEQ ID NO: 3314323 - DNA, 13 bp, Homo sapiens
ggtctcttccttc

SEQ ID NO: 3314324 - DNA, 15 bp, Homo sapiens
ggtctcttgagggag

SEQ ID NO: 3314325 - DNA, 20 bp, Homo sapiens
ggtctcttttgtaaattaaa

SEQ ID NO: 3314326 - DNA, 22 bp, Homo sapiens
ggtctgaaggaatagccagaga

SEQ ID NO: 3314327 - DNA, 23 bp, Homo sapiens
ggtctgaaggaatagccagagag

SEQ ID NO: 3314328 - DNA, 14 bp, Homo sapiens
ggtctgaatgttct

SEQ ID NO: 3314329 - DNA, 14 bp, Homo sapiens
ggtctgagccctgg

SEQ ID NO: 3314330 - DNA, 15 bp, Homo sapiens
ggtctgatattaatc

SEQ ID NO: 3314331 - DNA, 16 bp, Homo sapiens
ggtctgatattaatca

SEQ ID NO: 3314332 - DNA, 15 bp, Homo sapiens
ggtctgcaagtcaga

SEQ ID NO: 3314333 - DNA, 16 bp, Homo sapiens
ggtctgcaagtcagag

SEQ ID NO: 3314334 - DNA, 20 bp, Homo sapiens
ggtctgctctttctctgcca

SEQ ID NO: 3314335 - DNA, 20 bp, Homo sapiens
ggtctggcagggatgggttt

SEQ ID NO: 3314336 - DNA, 17 bp, Homo sapiens
ggtctgggacttccttg

SEQ ID NO: 3314337 - DNA, 14 bp, Homo sapiens
ggtctgtcccacca

SEQ ID NO: 3314338 - DNA, 16 bp, Homo sapiens
ggtctgtgctgtgcct

SEQ ID NO: 3314339 - DNA, 18 bp, Homo sapiens
ggtctgtgtctcttttct

SEQ ID NO: 3314340 - DNA, 16 bp, Homo sapiens
ggtctgtgtgaatgtg

SEQ ID NO: 3314341 - DNA, 19 bp, Homo sapiens
ggtctgttggcaggctggc

SEQ ID NO: 3314342 - DNA, 16 bp, Homo sapiens
ggtcttccagacctgc

SEQ ID NO: 3314343 - DNA, 22 bp, Homo sapiens
ggtcttcttacatgcatttgag

SEQ ID NO: 3314344 - DNA, 21 bp, Homo sapiens
ggtcttgaactcctggcctca

SEQ ID NO: 3314345 - DNA, 13 bp, Homo sapiens
ggtcttgatctcc

SEQ ID NO: 3314346 - DNA, 14 bp, Homo sapiens
ggtctttccacttt

SEQ ID NO: 3314347 - DNA, 15 bp, Homo sapiens
ggtctttgtaagagt

SEQ ID NO: 3314348 - DNA, 19 bp, Homo sapiens
ggtcttttataggaaaaaa

SEQ ID NO: 3314349 - DNA, 14 bp, Homo sapiens
ggtcttttgtattt

SEQ ID NO: 3314350 - DNA, 15 bp, Homo sapiens
ggtctttttaaacca

SEQ ID NO: 3314351 - DNA, 24 bp, Homo sapiens
ggtcttttttcatttcttcctcag

SEQ ID NO: 3314352 - DNA, 13 bp, Homo sapiens
ggtgaaagaacaa

SEQ ID NO: 3314353 - DNA, 23 bp, Homo sapiens
ggtgaaatttattagttaatata

SEQ ID NO: 3314354 - DNA, 21 bp, Homo sapiens
ggtgaaggaggtcaggcccca

SEQ ID NO: 3314355 - DNA, 19 bp, Homo sapiens
ggtgaaggatccaggaata

SEQ ID NO: 3314356 - DNA, 17 bp, Homo sapiens
ggtgaaggcctggctgg

SEQ ID NO: 3314357 - DNA, 23 bp, Homo sapiens
ggtgaaggcctggctggaagagg

SEQ ID NO: 3314358 - DNA, 16 bp, Homo sapiens
ggtgaaggctctcacc

SEQ ID NO: 3314359 - DNA, 18 bp, Homo sapiens
ggtgaagggagagccagc

SEQ ID NO: 3314360 - DNA, 18 bp, Homo sapiens
ggtgaatacttattttca

SEQ ID NO: 3314361 - DNA, 16 bp, Homo sapiens
ggtgaatcttgtctaa

SEQ ID NO: 3314362 - DNA, 12 bp, Homo sapiens
ggtgacagtcat

SEQ ID NO: 3314363 - DNA, 18 bp, Homo sapiens
ggtgacagtcatcatcag

SEQ ID NO: 3314364 - DNA, 19 bp, Homo sapiens
ggtgacagtcatcatcagg

SEQ ID NO: 3314365 - DNA, 21 bp, Homo sapiens
ggtgacagtcatcatcagggc

SEQ ID NO: 3314366 - DNA, 14 bp, Homo sapiens
ggtgacatgtgaaa

SEQ ID NO: 3314367 - DNA, 18 bp, Homo sapiens
ggtgacatgtgaaacctt

SEQ ID NO: 3314368 - DNA, 14 bp, Homo sapiens
ggtgacatttccca

SEQ ID NO: 3314369 - DNA, 17 bp, Homo sapiens
ggtgaccgactacccca

SEQ ID NO: 3314370 - DNA, 16 bp, Homo sapiens
ggtgacctctgcctga

SEQ ID NO: 3314371 - DNA, 19 bp, Homo sapiens
ggtgactcacttcaatgtg

SEQ ID NO: 3314372 - DNA, 20 bp, Homo sapiens
ggtgactcacttcaatgtgt

SEQ ID NO: 3314373 - DNA, 22 bp, Homo sapiens
ggtgactcacttcaatgtgtca

SEQ ID NO: 3314374 - DNA, 19 bp, Homo sapiens
ggtgagagagacaggcagc

SEQ ID NO: 3314375 - DNA, 16 bp, Homo sapiens
ggtgagagtgggaggg

SEQ ID NO: 3314376 - DNA, 17 bp, Homo sapiens
ggtgagcatggcagctg

SEQ ID NO: 3314377 - DNA, 13 bp, Homo sapiens
ggtgagccagtgg

SEQ ID NO: 3314378 - DNA, 11 bp, Homo sapiens
ggtgagctggg

SEQ ID NO: 3314379 - DNA, 15 bp, Homo sapiens
ggtgaggaccactcc

SEQ ID NO: 3314380 - DNA, 18 bp, Homo sapiens
ggtgaggaccactcctgt

SEQ ID NO: 3314381 - DNA, 15 bp, Homo sapiens
ggtgaggagggcagt

SEQ ID NO: 3314382 - DNA, 21 bp, Homo sapiens
ggtgaggcccaagagccctgt

SEQ ID NO: 3314383 - DNA, 17 bp, Homo sapiens
ggtgaggggctggcact

SEQ ID NO: 3314384 - DNA, 22 bp, Homo sapiens
ggtgaggtccaccggcccctgg

SEQ ID NO: 3314385 - DNA, 13 bp, Homo sapiens
caaatttatcaaa

SEQ ID NO: 3314386 - DNA, 15 bp, Homo sapiens
caaatttatgcattt

SEQ ID NO: 3314387 - DNA, 18 bp, Homo sapiens
caaatttatgcatttcat

SEQ ID NO: 3314388 - DNA, 21 bp, Homo sapiens
caaatttatgcatttcattca

SEQ ID NO: 3314389 - DNA, 23 bp, Homo sapiens
caaatttatgcatttcattcaaa

SEQ ID NO: 3314390 - DNA, 16 bp, Homo sapiens
caaatttcaaaagaca

SEQ ID NO: 3314391 - DNA, 17 bp, Homo sapiens
caaatttcaaaagacat

SEQ ID NO: 3314392 - DNA, 15 bp, Homo sapiens
caaattttatctgga

SEQ ID NO: 3314393 - DNA, 21 bp, Homo sapiens
caaattttcaagtttacactt

SEQ ID NO: 3314394 - DNA, 20 bp, Homo sapiens
caaattttgagcaaagaaac

SEQ ID NO: 3314395 - DNA, 21 bp, Homo sapiens
caaattttgatgccaagaaag

SEQ ID NO: 3314396 - DNA, 20 bp, Homo sapiens
caacaaaaggacttcaggaa

SEQ ID NO: 3314397 - DNA, 20 bp, Homo sapiens
caacaaagaaacaaagatgt

SEQ ID NO: 3314398 - DNA, 19 bp, Homo sapiens
caacaaagattgagaagcc

SEQ ID NO: 3314399 - DNA, 21 bp, Homo sapiens
caacaaagattgagaagccat

SEQ ID NO: 3314400 - DNA, 23 bp, Homo sapiens
caacaaagcgagatcccatctct

SEQ ID NO: 3314401 - DNA, 16 bp, Homo sapiens
caacaacgtgagagaa

SEQ ID NO: 3314402 - DNA, 22 bp, Homo sapiens
caacaagcccgttagccccagg

SEQ ID NO: 3314403 - DNA, 18 bp, Homo sapiens
caacaagccctgcttttg

SEQ ID NO: 3314404 - DNA, 18 bp, Homo sapiens
caacaagggagagacctc

SEQ ID NO: 3314405 - DNA, 14 bp, Homo sapiens
caacaataaaacat

SEQ ID NO: 3314406 - DNA, 13 bp, Homo sapiens
caacaataacact

SEQ ID NO: 3314407 - DNA, 22 bp, Homo sapiens
caacaatacatgctgctaattc

SEQ ID NO: 3314408 - DNA, 16 bp, Homo sapiens
caacacaataacacta

SEQ ID NO: 3314409 - DNA, 22 bp, Homo sapiens
caacacacacaacgtaaaaata

SEQ ID NO: 3314410 - DNA, 16 bp, Homo sapiens
caacacacctggtgaa

SEQ ID NO: 3314411 - DNA, 12 bp, Homo sapiens
caacaccacaga

SEQ ID NO: 3314412 - DNA, 13 bp, Homo sapiens
caacaccacagac

SEQ ID NO: 3314413 - DNA, 14 bp, Homo sapiens
caacaccagcccct

SEQ ID NO: 3314414 - DNA, 22 bp, Homo sapiens
caacaccttcagaggctgaggt

SEQ ID NO: 3314415 - DNA, 16 bp, Homo sapiens
caacaccttcctcctg

SEQ ID NO: 3314416 - DNA, 20 bp, Homo sapiens
caacaccttcctcctgcaga

SEQ ID NO: 3314417 - DNA, 15 bp, Homo sapiens
caacactatatattt

SEQ ID NO: 3314418 - DNA, 13 bp, Homo sapiens
caacactccaggc

SEQ ID NO: 3314419 - DNA, 21 bp, Homo sapiens
caacactccaggccctgcccc

SEQ ID NO: 3314420 - DNA, 14 bp, Homo sapiens
caacactgtgccct

SEQ ID NO: 3314421 - DNA, 18 bp, Homo sapiens
caacgtgagagaaagaga

SEQ ID NO: 3314422 - DNA, 20 bp, Homo sapiens
caacgtgagagaaagagaga

SEQ ID NO: 3314423 - DNA, 22 bp, Homo sapiens
caacgtgagagaaagagagaag

SEQ ID NO: 3314424 - DNA, 17 bp, Homo sapiens
caacgttactcagggct

SEQ ID NO: 3314425 - DNA, 22 bp, Homo sapiens
caacgttcgatttctacctcag

SEQ ID NO: 3314426 - DNA, 23 bp, Homo sapiens
caacgttcgatttctacctcagc

SEQ ID NO: 3314427 - DNA, 13 bp, Homo sapiens
caactaaaattag

SEQ ID NO: 3314428 - DNA, 13 bp, Homo sapiens
caactaagccctc

SEQ ID NO: 3314429 - DNA, 11 bp, Homo sapiens
caactacctga

SEQ ID NO: 3314430 - DNA, 13 bp, Homo sapiens
caactactaatag

SEQ ID NO: 3314431 - DNA, 23 bp, Homo sapiens
caactactcagaaggccgaggca

SEQ ID NO: 3314432 - DNA, 16 bp, Homo sapiens
caactagacattctgt

SEQ ID NO: 3314433 - DNA, 13 bp, Homo sapiens
caactagatttgt

SEQ ID NO: 3314434 - DNA, 14 bp, Homo sapiens
caactagatttgtc

SEQ ID NO: 3314435 - DNA, 22 bp, Homo sapiens
caactagatttgtccttttatt

SEQ ID NO: 3314436 - DNA, 18 bp, Homo sapiens
caactagcccctggggtg

SEQ ID NO: 3314437 - DNA, 13 bp, Homo sapiens
caactatcaaaat

SEQ ID NO: 3314438 - DNA, 19 bp, Homo sapiens
caactatcctgacttctaa

SEQ ID NO: 3314439 - DNA, 17 bp, Homo sapiens
caactatggatcagaat

SEQ ID NO: 3314440 - DNA, 21 bp, Homo sapiens
caactattttattatcctaga

SEQ ID NO: 3314441 - DNA, 20 bp, Homo sapiens
caactatttttccaaaataa

SEQ ID NO: 3314442 - DNA, 22 bp, Homo sapiens
caactcccttaaggtctccaaa

SEQ ID NO: 3314443 - DNA, 15 bp, Homo sapiens
caactcctaatttta

SEQ ID NO: 3314444 - DNA, 19 bp, Homo sapiens
caactcgctttaggtcagc

SEQ ID NO: 3314445 - DNA, 17 bp, Homo sapiens
caactctaatattgctt

SEQ ID NO: 3314446 - DNA, 16 bp, Homo sapiens
caactcttgattatcc

SEQ ID NO: 3314447 - DNA, 13 bp, Homo sapiens
caactctttgtta

SEQ ID NO: 3314448 - DNA, 14 bp, Homo sapiens
caactctttgttat

SEQ ID NO: 3314449 - DNA, 18 bp, Homo sapiens
caactctttgttatttga

SEQ ID NO: 3314450 - DNA, 13 bp, Homo sapiens
caactgaaaagac

SEQ ID NO: 3314451 - DNA, 13 bp, Homo sapiens
caactgacacagg

SEQ ID NO: 3314452 - DNA, 16 bp, Homo sapiens
caactgacacaggaaa

SEQ ID NO: 3314453 - DNA, 19 bp, Homo sapiens
caactgaccagcctccatg

SEQ ID NO: 3314454 - DNA, 21 bp, Homo sapiens
caactgcaaaaaaagcctcca

SEQ ID NO: 3314455 - DNA, 22 bp, Homo sapiens
caactgcctactccaaaatgtt

SEQ ID NO: 3314456 - DNA, 23 bp, Homo sapiens
caactgcctcgaaacacagaaac

SEQ ID NO: 3314457 - DNA, 12 bp, Homo sapiens
caactgctgctt

SEQ ID NO: 3314458 - DNA, 11 bp, Homo sapiens
caactggatgt

SEQ ID NO: 3314459 - DNA, 16 bp, Homo sapiens
caactgggccaggagg

SEQ ID NO: 3314460 - DNA, 17 bp, Homo sapiens
caactgggccaggaggt

SEQ ID NO: 3314461 - DNA, 12 bp, Homo sapiens
caactgtgactg

SEQ ID NO: 3314462 - DNA, 18 bp, Homo sapiens
caactgtgtctctgaatt

SEQ ID NO: 3314463 - DNA, 17 bp, Homo sapiens
caactgtgttgtattaa

SEQ ID NO: 3314464 - DNA, 19 bp, Homo sapiens
caactgttgattgcaggaa

SEQ ID NO: 3314465 - DNA, 18 bp, Homo sapiens
caactgtttccctgctga

SEQ ID NO: 3314466 - DNA, 19 bp, Homo sapiens
caactgtttccctgctgaa

SEQ ID NO: 3314467 - DNA, 15 bp, Homo sapiens
caacttaacatgggc

SEQ ID NO: 3314468 - DNA, 14 bp, Homo sapiens
caacttaatggaaa

SEQ ID NO: 3314469 - DNA, 15 bp, Homo sapiens
caacttaatgttctg

SEQ ID NO: 3314470 - DNA, 18 bp, Homo sapiens
caacttcagcagtaccta

SEQ ID NO: 3314471 - DNA, 14 bp, Homo sapiens
caacttcagtccaa

SEQ ID NO: 3314472 - DNA, 15 bp, Homo sapiens
caacttcagttttat

SEQ ID NO: 3314473 - DNA, 16 bp, Homo sapiens
caacttccaagacaag

SEQ ID NO: 3314474 - DNA, 15 bp, Homo sapiens
caacttccgctgagg

SEQ ID NO: 3314475 - DNA, 21 bp, Homo sapiens
caacttgagggcccagagcag

SEQ ID NO: 3314476 - DNA, 23 bp, Homo sapiens
caacttgtattaaagacagaggc

SEQ ID NO: 3314477 - DNA, 17 bp, Homo sapiens
caacttgtctttttctg

SEQ ID NO: 3314478 - DNA, 12 bp, Homo sapiens
caacttgtgtac

SEQ ID NO: 3314479 - DNA, 22 bp, Homo sapiens
caactttaagcagctcttgcta

SEQ ID NO: 3314480 - DNA, 13 bp, Homo sapiens
caactttactgta

SEQ ID NO: 3314481 - DNA, 23 bp, Homo sapiens
caactttctgtaaactcaaaact

SEQ ID NO: 3314482 - DNA, 23 bp, Homo sapiens
caactttgtcgtggttcttaaat

SEQ ID NO: 3314483 - DNA, 13 bp, Homo sapiens
caacttttaaagc

SEQ ID NO: 3314484 - DNA, 20 bp, Homo sapiens
caacttttgtgtaatgaaaa

SEQ ID NO: 3314485 - DNA, 15 bp, Homo sapiens
caagaaaaaataaat

SEQ ID NO: 3314486 - DNA, 12 bp, Homo sapiens
caagaaaacata

SEQ ID NO: 3314487 - DNA, 10 bp, Homo sapiens
caagaaaagg

SEQ ID NO: 3314488 - DNA, 13 bp, Homo sapiens
caagaaacagcca

SEQ ID NO: 3314489 - DNA, 15 bp, Homo sapiens
caagaaataaatcag

SEQ ID NO: 3314490 - DNA, 13 bp, Homo sapiens
caagaaatttgat

SEQ ID NO: 3314491 - DNA, 14 bp, Homo sapiens
caagaaccatttgc

SEQ ID NO: 3314492 - DNA, 16 bp, Homo sapiens
caagaaccatttgcaa

SEQ ID NO: 3314493 - DNA, 13 bp, Homo sapiens
caagaactgcatg

SEQ ID NO: 3314494 - DNA, 23 bp, Homo sapiens
caagaactgcatggacctaacat

SEQ ID NO: 3314495 - DNA, 10 bp, Homo sapiens
caagaacttg

SEQ ID NO: 3314496 - DNA, 19 bp, Homo sapiens
caagaagaagggcacccta

SEQ ID NO: 3314497 - DNA, 18 bp, Homo sapiens
caagaagacatggagact

SEQ ID NO: 3314498 - DNA, 21 bp, Homo sapiens
caagaagatcacgctccccgc

SEQ ID NO: 3314499 - DNA, 21 bp, Homo sapiens
caagaagcgtgagacgccacc

SEQ ID NO: 3314500 - DNA, 13 bp, Homo sapiens
caagaagctgctt

SEQ ID NO: 3314501 - DNA, 20 bp, Homo sapiens
caagaaggaaagatttgtga

SEQ ID NO: 3314502 - DNA, 21 bp, Homo sapiens
caagaaggaaagatttgtgaa

SEQ ID NO: 3314503 - DNA, 16 bp, Homo sapiens
caagaagtagcagtgt

SEQ ID NO: 3314504 - DNA, 20 bp, Homo sapiens
caagaataatcacgctttcc

SEQ ID NO: 3314505 - DNA, 21 bp, Homo sapiens
caagaataatcacgctttcct

SEQ ID NO: 3314506 - DNA, 23 bp, Homo sapiens
caagaataatcacgctttcctga

SEQ ID NO: 3314507 - DNA, 13 bp, Homo sapiens
caagaatacttga

SEQ ID NO: 3314508 - DNA, 18 bp, Homo sapiens
caagaatagatgctgact

SEQ ID NO: 3314509 - DNA, 16 bp, Homo sapiens
caagaatattgtccct

SEQ ID NO: 3314510 - DNA, 18 bp, Homo sapiens
caagaatccacatttcta

SEQ ID NO: 3314511 - DNA, 21 bp, Homo sapiens
caagaatccacatttctaaaa

SEQ ID NO: 3314512 - DNA, 14 bp, Homo sapiens
caagaatggatcac

SEQ ID NO: 3314513 - DNA, 21 bp, Homo sapiens
caagaatggatcacaagatgg

SEQ ID NO: 3314514 - DNA, 21 bp, Homo sapiens
caagaatggggatcacagaga

SEQ ID NO: 3314515 - DNA, 18 bp, Homo sapiens
caagaattagaagtcttt

SEQ ID NO: 3314516 - DNA, 20 bp, Homo sapiens
caagaatttgacttggaaaa

SEQ ID NO: 3314517 - DNA, 18 bp, Homo sapiens
caagacaaatcaacagaa

SEQ ID NO: 3314518 - DNA, 16 bp, Homo sapiens
caagacacgtggcctc

SEQ ID NO: 3314519 - DNA, 17 bp, Homo sapiens
caagacacgtggcctcg

SEQ ID NO: 3314520 - DNA, 19 bp, Homo sapiens
caagacacgtggcctcgtg

SEQ ID NO: 3314521 - DNA, 15 bp, Homo sapiens
caagctgagtttcct

SEQ ID NO: 3314522 - DNA, 24 bp, Homo sapiens
caagctgcgggctccctggcagga

SEQ ID NO: 3314523 - DNA, 12 bp, Homo sapiens
caagctggcctc

SEQ ID NO: 3314524 - DNA, 21 bp, Homo sapiens
caagctggtcccactcagtcc

SEQ ID NO: 3314525 - DNA, 17 bp, Homo sapiens
caagctgtccagagaaa

SEQ ID NO: 3314526 - DNA, 18 bp, Homo sapiens
caagctgtccagagaaaa

SEQ ID NO: 3314527 - DNA, 12 bp, Homo sapiens
caagctgtcccc

SEQ ID NO: 3314528 - DNA, 16 bp, Homo sapiens
caagctgtcccctctg

SEQ ID NO: 3314529 - DNA, 15 bp, Homo sapiens
caagctgtccctgca

SEQ ID NO: 3314530 - DNA, 12 bp, Homo sapiens
caagctgtgcag

SEQ ID NO: 3314531 - DNA, 14 bp, Homo sapiens
caagctgttttctt

SEQ ID NO: 3314532 - DNA, 16 bp, Homo sapiens
caagctgttttcttct

SEQ ID NO: 3314533 - DNA, 16 bp, Homo sapiens
caaggaaaactgcatg

SEQ ID NO: 3314534 - DNA, 19 bp, Homo sapiens
caaggaaaggggagaaggg

SEQ ID NO: 3314535 - DNA, 23 bp, Homo sapiens
caaggaaagggggtcccagtggg

SEQ ID NO: 3314536 - DNA, 16 bp, Homo sapiens
caaggaacaaaaaaac

SEQ ID NO: 3314537 - DNA, 21 bp, Homo sapiens
caaggaactttccccagatca

SEQ ID NO: 3314538 - DNA, 23 bp, Homo sapiens
caaggaaggttcatgtagagaaa

SEQ ID NO: 3314539 - DNA, 20 bp, Homo sapiens
caaggaataaatgagaggga

SEQ ID NO: 3314540 - DNA, 19 bp, Homo sapiens
caaggaatgcctgtgccaa

SEQ ID NO: 3314541 - DNA, 21 bp, Homo sapiens
caaggaatgcctgtgccaata

SEQ ID NO: 3314542 - DNA, 18 bp, Homo sapiens
caaggaatttcttaactt

SEQ ID NO: 3314543 - DNA, 21 bp, Homo sapiens
caaggaatttcttaacttctt

SEQ ID NO: 3314544 - DNA, 15 bp, Homo sapiens
caaggaccaggactc

SEQ ID NO: 3314545 - DNA, 18 bp, Homo sapiens
caaggacttccacatttt

SEQ ID NO: 3314546 - DNA, 21 bp, Homo sapiens
caaggacttccacatttttgc

SEQ ID NO: 3314547 - DNA, 16 bp, Homo sapiens
caaggactttgcagcc

SEQ ID NO: 3314548 - DNA, 21 bp, Homo sapiens
caaggagaatatgataaaaca

SEQ ID NO: 3314549 - DNA, 18 bp, Homo sapiens
caaggagcaaacactgaa

SEQ ID NO: 3314550 - DNA, 15 bp, Homo sapiens
caaggagctcaccct

SEQ ID NO: 3314551 - DNA, 19 bp, Homo sapiens
caaggagctgatttccagg

SEQ ID NO: 3314552 - DNA, 21 bp, Homo sapiens
caaggagctgatttccaggcc

SEQ ID NO: 3314553 - DNA, 22 bp, Homo sapiens
caaggagctgatttccaggccc

SEQ ID NO: 3314554 - DNA, 16 bp, Homo sapiens
caaggatatactgcag

SEQ ID NO: 3314555 - DNA, 18 bp, Homo sapiens
caaggatatactgcagct

SEQ ID NO: 3314556 - DNA, 17 bp, Homo sapiens
caaggatcctctccact

SEQ ID NO: 3314557 - DNA, 15 bp, Homo sapiens
caaggatgaaagaaa

SEQ ID NO: 3314558 - DNA, 13 bp, Homo sapiens
caaggattacaga

SEQ ID NO: 3314559 - DNA, 21 bp, Homo sapiens
caaggattacagaaactgatg

SEQ ID NO: 3314560 - DNA, 14 bp, Homo sapiens
caaggcaagcattt

SEQ ID NO: 3314561 - DNA, 14 bp, Homo sapiens
caaggcaaggcagg

SEQ ID NO: 3314562 - DNA, 15 bp, Homo sapiens
caaggcagcctccag

SEQ ID NO: 3314563 - DNA, 16 bp, Homo sapiens
caaggcagcctccaga

SEQ ID NO: 3314564 - DNA, 16 bp, Homo sapiens
caaggcagggaaagga

SEQ ID NO: 3314565 - DNA, 15 bp, Homo sapiens
caaggcaggtgcctc

SEQ ID NO: 3314566 - DNA, 19 bp, Homo sapiens
caaggccagagtggcctgg

SEQ ID NO: 3314567 - DNA, 20 bp, Homo sapiens
caaggccagagtggcctggc

SEQ ID NO: 3314568 - DNA, 15 bp, Homo sapiens
caaggcccacaggag

SEQ ID NO: 3314569 - DNA, 16 bp, Homo sapiens
caaggccctgctgccc

SEQ ID NO: 3314570 - DNA, 17 bp, Homo sapiens
caaggccctgctgccca

SEQ ID NO: 3314571 - DNA, 16 bp, Homo sapiens
caaggccgaagctctg

SEQ ID NO: 3314572 - DNA, 23 bp, Homo sapiens
caaggccgaagctctggctgaac

SEQ ID NO: 3314573 - DNA, 21 bp, Homo sapiens
caaggcgagtttccccactaa

SEQ ID NO: 3314574 - DNA, 14 bp, Homo sapiens
caaggctatgtgat

SEQ ID NO: 3314575 - DNA, 18 bp, Homo sapiens
caaggctgaccaagagag

SEQ ID NO: 3314576 - DNA, 18 bp, Homo sapiens
caaggctgcggtttgttg

SEQ ID NO: 3314577 - DNA, 18 bp, Homo sapiens
caaggctgcgtctggagg

SEQ ID NO: 3314578 - DNA, 16 bp, Homo sapiens
caaggctgcttagaat

SEQ ID NO: 3314579 - DNA, 14 bp, Homo sapiens
caaggctggccagc

SEQ ID NO: 3314580 - DNA, 22 bp, Homo sapiens
caaggctgggtaatgtgaaggc

SEQ ID NO: 3314581 - DNA, 12 bp, Homo sapiens
caagggaaaggg

SEQ ID NO: 3314582 - DNA, 16 bp, Homo sapiens
caagggaacctgtgtc

SEQ ID NO: 3314583 - DNA, 20 bp, Homo sapiens
caagggaagaaacactctta

SEQ ID NO: 3314584 - DNA, 13 bp, Homo sapiens
caagggaccttca

SEQ ID NO: 3314585 - DNA, 13 bp, Homo sapiens
caagggagaaaag

SEQ ID NO: 3314586 - DNA, 15 bp, Homo sapiens
caagggagaaaagag

SEQ ID NO: 3314587 - DNA, 16 bp, Homo sapiens
caagggcatcaggcac

SEQ ID NO: 3314588 - DNA, 18 bp, Homo sapiens
caagggcatcaggcactg

SEQ ID NO: 3314589 - DNA, 12 bp, Homo sapiens
caagggctccag

SEQ ID NO: 3314590 - DNA, 13 bp, Homo sapiens
caagggctccagc

SEQ ID NO: 3314591 - DNA, 19 bp, Homo sapiens
caagggctccagcatccag

SEQ ID NO: 3314592 - DNA, 20 bp, Homo sapiens
caagggctccagcatccagc

SEQ ID NO: 3314593 - DNA, 17 bp, Homo sapiens
caagggctgtcattgca

SEQ ID NO: 3314594 - DNA, 23 bp, Homo sapiens
caagggcttctgcaccctccacc

SEQ ID NO: 3314595 - DNA, 17 bp, Homo sapiens
caaggggcccaaattct

SEQ ID NO: 3314596 - DNA, 21 bp, Homo sapiens
caagggggtgtcatctgagga

SEQ ID NO: 3314597 - DNA, 23 bp, Homo sapiens
caaggtaattgttttttaaagca

SEQ ID NO: 3314598 - DNA, 14 bp, Homo sapiens
caaggtactctggt

SEQ ID NO: 3314599 - DNA, 16 bp, Homo sapiens
caaggtactctggtga

SEQ ID NO: 3314600 - DNA, 20 bp, Homo sapiens
caaggtcacttaaagggtct

SEQ ID NO: 3314601 - DNA, 19 bp, Homo sapiens
caaggtccactccctgctc

SEQ ID NO: 3314602 - DNA, 21 bp, Homo sapiens
caaggtccactccctgctcca

SEQ ID NO: 3314603 - DNA, 15 bp, Homo sapiens
caaggtcctgctcaa

SEQ ID NO: 3314604 - DNA, 23 bp, Homo sapiens
caaggtctccttactctgagccc

SEQ ID NO: 3314605 - DNA, 14 bp, Homo sapiens
caaggtctttggtt

SEQ ID NO: 3314606 - DNA, 20 bp, Homo sapiens
caaggtgacagaaggaccag

SEQ ID NO: 3314607 - DNA, 18 bp, Homo sapiens
caaggtgatttcagactg

SEQ ID NO: 3314608 - DNA, 21 bp, Homo sapiens
caaggtgatttcagactgcag

SEQ ID NO: 3314609 - DNA, 21 bp, Homo sapiens
caaggtgccaccaccctgccc

SEQ ID NO: 3314610 - DNA, 13 bp, Homo sapiens
caaggtgctcaca

SEQ ID NO: 3314611 - DNA, 15 bp, Homo sapiens
caaggtgctgatgtc

SEQ ID NO: 3314612 - DNA, 22 bp, Homo sapiens
caaggtgggccttgctacctca

SEQ ID NO: 3314613 - DNA, 19 bp, Homo sapiens
caaggtgggctgagccctg

SEQ ID NO: 3314614 - DNA, 24 bp, Homo sapiens
caaggtgggctgagccctggcagg

SEQ ID NO: 3314615 - DNA, 16 bp, Homo sapiens
caaggttggcacccca

SEQ ID NO: 3314616 - DNA, 19 bp, Homo sapiens
caaggttggcaccccagct

SEQ ID NO: 3314617 - DNA, 17 bp, Homo sapiens
caaggtttaaagagtct

SEQ ID NO: 3314618 - DNA, 20 bp, Homo sapiens
caaggtttaaagagtctaga

SEQ ID NO: 3314619 - DNA, 22 bp, Homo sapiens
caaggtttaaagagtctagatt

SEQ ID NO: 3314620 - DNA, 18 bp, Homo sapiens
caaggttttaggttctaa

SEQ ID NO: 3314621 - DNA, 17 bp, Homo sapiens
caaggttttggagtcag

SEQ ID NO: 3314622 - DNA, 14 bp, Homo sapiens
caagtaaaagaaaa

SEQ ID NO: 3314623 - DNA, 14 bp, Homo sapiens
caagtaagaagaca

SEQ ID NO: 3314624 - DNA, 23 bp, Homo sapiens
caagtaatataatggaagagaaa

SEQ ID NO: 3314625 - DNA, 11 bp, Homo sapiens
caagtaattgt

SEQ ID NO: 3314626 - DNA, 20 bp, Homo sapiens
caagtaccaccaagggatct

SEQ ID NO: 3314627 - DNA, 14 bp, Homo sapiens
caagtactatctgt

SEQ ID NO: 3314628 - DNA, 19 bp, Homo sapiens
caagtagctgggactacag

SEQ ID NO: 3314629 - DNA, 12 bp, Homo sapiens
caagtatatact

SEQ ID NO: 3314630 - DNA, 18 bp, Homo sapiens
caagtatatacttttaaa

SEQ ID NO: 3314631 - DNA, 20 bp, Homo sapiens
caagtatatacttttaaatt

SEQ ID NO: 3314632 - DNA, 22 bp, Homo sapiens
caagtatttgggaagtgaagac

SEQ ID NO: 3314633 - DNA, 16 bp, Homo sapiens
ctggagaaagagctgc

SEQ ID NO: 3314634 - DNA, 17 bp, Homo sapiens
ctggagaaagagctgcc

SEQ ID NO: 3314635 - DNA, 18 bp, Homo sapiens
ctggagaaagagctgcct

SEQ ID NO: 3314636 - DNA, 23 bp, Homo sapiens
ctggagaaagagctgcctggatg

SEQ ID NO: 3314637 - DNA, 15 bp, Homo sapiens
ctggagaactagaga

SEQ ID NO: 3314638 - DNA, 18 bp, Homo sapiens
ctggagaagagaggagag

SEQ ID NO: 3314639 - DNA, 20 bp, Homo sapiens
ctggagaagagaggagagga

SEQ ID NO: 3314640 - DNA, 20 bp, Homo sapiens
ctggagacagccccagagca

SEQ ID NO: 3314641 - DNA, 22 bp, Homo sapiens
ctggagacagccccagagcagg

SEQ ID NO: 3314642 - DNA, 19 bp, Homo sapiens
ctggagaccagggagcctt

SEQ ID NO: 3314643 - DNA, 18 bp, Homo sapiens
ctggagaccatgcagagc

SEQ ID NO: 3314644 - DNA, 21 bp, Homo sapiens
ctggagaccatgcagagcgcc

SEQ ID NO: 3314645 - DNA, 21 bp, Homo sapiens
ctggagacccaccccacctgc

SEQ ID NO: 3314646 - DNA, 21 bp, Homo sapiens
ctggagaccgcttcacccctg

SEQ ID NO: 3314647 - DNA, 22 bp, Homo sapiens
ctggagaccgcttcacccctgc

SEQ ID NO: 3314648 - DNA, 23 bp, Homo sapiens
ctggagaccgcttcacccctgca

SEQ ID NO: 3314649 - DNA, 18 bp, Homo sapiens
ctggagacgggtgggcgg

SEQ ID NO: 3314650 - DNA, 20 bp, Homo sapiens
ctggagacgtggaacctctg

SEQ ID NO: 3314651 - DNA, 21 bp, Homo sapiens
ctggagacgtggaacctctgt

SEQ ID NO: 3314652 - DNA, 21 bp, Homo sapiens
ctggagacttagggcaccagg

SEQ ID NO: 3314653 - DNA, 14 bp, Homo sapiens
ctggagagaaacaa

SEQ ID NO: 3314654 - DNA, 17 bp, Homo sapiens
ctggagagcgaggaggc

SEQ ID NO: 3314655 - DNA, 19 bp, Homo sapiens
ctggagagcgaggaggcgc

SEQ ID NO: 3314656 - DNA, 23 bp, Homo sapiens
ctggagagggtctcgctgtcact

SEQ ID NO: 3314657 - DNA, 14 bp, Homo sapiens
ctggagatcctcct

SEQ ID NO: 3314658 - DNA, 15 bp, Homo sapiens
ctggagatcctcctg

SEQ ID NO: 3314659 - DNA, 22 bp, Homo sapiens
ctggagcagaccaccccgcctg

SEQ ID NO: 3314660 - DNA, 13 bp, Homo sapiens
ctggagcaggagc

SEQ ID NO: 3314661 - DNA, 21 bp, Homo sapiens
ctggagcatgcagaggaggtg

SEQ ID NO: 3314662 - DNA, 20 bp, Homo sapiens
ctggagccaactgctgcttt

SEQ ID NO: 3314663 - DNA, 13 bp, Homo sapiens
ctggagccccatc

SEQ ID NO: 3314664 - DNA, 16 bp, Homo sapiens
ctggagcccctgggtg

SEQ ID NO: 3314665 - DNA, 18 bp, Homo sapiens
ctggagcccctgggtggg

SEQ ID NO: 3314666 - DNA, 14 bp, Homo sapiens
ctggagccctaacc

SEQ ID NO: 3314667 - DNA, 12 bp, Homo sapiens
ctggagccctgt

SEQ ID NO: 3314668 - DNA, 15 bp, Homo sapiens
ctggagccctgttgg

SEQ ID NO: 3314669 - DNA, 15 bp, Homo sapiens
ctggagcccttgggt

SEQ ID NO: 3314670 - DNA, 23 bp, Homo sapiens
ctggagcctccactgcctctgga

SEQ ID NO: 3314671 - DNA, 22 bp, Homo sapiens
ctggagcctgagtcagggccca

SEQ ID NO: 3314672 - DNA, 21 bp, Homo sapiens
ctggagctcatctgcaaaagg

SEQ ID NO: 3314673 - DNA, 16 bp, Homo sapiens
ctggagctggcactgt

SEQ ID NO: 3314674 - DNA, 18 bp, Homo sapiens
ctggaggaacacttgatg

SEQ ID NO: 3314675 - DNA, 21 bp, Homo sapiens
ctggaggaattcagctcagct

SEQ ID NO: 3314676 - DNA, 17 bp, Homo sapiens
ctggaggattttccagt

SEQ ID NO: 3314677 - DNA, 14 bp, Homo sapiens
ctggaggcccaggc

SEQ ID NO: 3314678 - DNA, 17 bp, Homo sapiens
ctggaggcccaggctgg

SEQ ID NO: 3314679 - DNA, 20 bp, Homo sapiens
ctggaggcccctggagccag

SEQ ID NO: 3314680 - DNA, 15 bp, Homo sapiens
ctggaggcctctggc

SEQ ID NO: 3314681 - DNA, 14 bp, Homo sapiens
ctggaggctccagg

SEQ ID NO: 3314682 - DNA, 17 bp, Homo sapiens
ctggaggctccaggact

SEQ ID NO: 3314683 - DNA, 18 bp, Homo sapiens
ctggaggctccaggactc

SEQ ID NO: 3314684 - DNA, 19 bp, Homo sapiens
ctggaggctccaggactcc

SEQ ID NO: 3314685 - DNA, 16 bp, Homo sapiens
ctggaggtctccaggg

SEQ ID NO: 3314686 - DNA, 19 bp, Homo sapiens
ctggaggtgggagcaggag

SEQ ID NO: 3314687 - DNA, 20 bp, Homo sapiens
ctggaggtgggagcaggaga

SEQ ID NO: 3314688 - DNA, 22 bp, Homo sapiens
ctggaggtgggcatgccaccct

SEQ ID NO: 3314689 - DNA, 16 bp, Homo sapiens
ctggaggtggggcgag

SEQ ID NO: 3314690 - DNA, 23 bp, Homo sapiens
ctggaggtggggcgaggcaggcc

SEQ ID NO: 3314691 - DNA, 14 bp, Homo sapiens
ctggagtccctgtg

SEQ ID NO: 3314692 - DNA, 12 bp, Homo sapiens
ctggagtctgga

SEQ ID NO: 3314693 - DNA, 17 bp, Homo sapiens
ctggagtctggctttac

SEQ ID NO: 3314694 - DNA, 18 bp, Homo sapiens
ctggagtctggctttacc

SEQ ID NO: 3314695 - DNA, 16 bp, Homo sapiens
ctggagtgaggcttcc

SEQ ID NO: 3314696 - DNA, 23 bp, Homo sapiens
ctggagtgaggcttccaggctct

SEQ ID NO: 3314697 - DNA, 16 bp, Homo sapiens
ctggagtgcagggagg

SEQ ID NO: 3314698 - DNA, 16 bp, Homo sapiens
ctggagtgcagtgagc

SEQ ID NO: 3314699 - DNA, 17 bp, Homo sapiens
ctggagtgcagtgagcc

SEQ ID NO: 3314700 - DNA, 17 bp, Homo sapiens
ctggagtgcgctcttgg

SEQ ID NO: 3314701 - DNA, 19 bp, Homo sapiens
ctggagtgcgctcttggtc

SEQ ID NO: 3314702 - DNA, 23 bp, Homo sapiens
ctggagtgcgctcttggtccctg

SEQ ID NO: 3314703 - DNA, 16 bp, Homo sapiens
ctggagttacattaat

SEQ ID NO: 3314704 - DNA, 22 bp, Homo sapiens
ctggagttacattaatgttaat

SEQ ID NO: 3314705 - DNA, 14 bp, Homo sapiens
ctggagttgggggc

SEQ ID NO: 3314706 - DNA, 13 bp, Homo sapiens
ctggagtttcatg

SEQ ID NO: 3314707 - DNA, 22 bp, Homo sapiens
ctggagtttcatgtacaagatg

SEQ ID NO: 3314708 - DNA, 21 bp, Homo sapiens
ctggatatttgcacttatgta

SEQ ID NO: 3314709 - DNA, 16 bp, Homo sapiens
ctggatattttcaaat

SEQ ID NO: 3314710 - DNA, 20 bp, Homo sapiens
ctggatcacgacgctgcaga

SEQ ID NO: 3314711 - DNA, 17 bp, Homo sapiens
ctggatcagtcctttga

SEQ ID NO: 3314712 - DNA, 16 bp, Homo sapiens
ctggatccagcactgg

SEQ ID NO: 3314713 - DNA, 17 bp, Homo sapiens
ctggatccatcaggcca

SEQ ID NO: 3314714 - DNA, 23 bp, Homo sapiens
ctggatcccctctgtctacaaat

SEQ ID NO: 3314715 - DNA, 23 bp, Homo sapiens
ctggatctatccctgcggcctcc

SEQ ID NO: 3314716 - DNA, 13 bp, Homo sapiens
ctggatgaagatt

SEQ ID NO: 3314717 - DNA, 23 bp, Homo sapiens
ctggatgaagattctcctgtgct

SEQ ID NO: 3314718 - DNA, 15 bp, Homo sapiens
ctggatgagaaacag

SEQ ID NO: 3314719 - DNA, 19 bp, Homo sapiens
ctggatgagaaacagctca

SEQ ID NO: 3314720 - DNA, 11 bp, Homo sapiens
ctggatggagc

SEQ ID NO: 3314721 - DNA, 16 bp, Homo sapiens
ctggatggagcccagg

SEQ ID NO: 3314722 - DNA, 18 bp, Homo sapiens
ctggatggagcccaggcg

SEQ ID NO: 3314723 - DNA, 17 bp, Homo sapiens
ctggatgggcattgggc

SEQ ID NO: 3314724 - DNA, 16 bp, Homo sapiens
ctggattcattgtctc

SEQ ID NO: 3314725 - DNA, 17 bp, Homo sapiens
ctggattcattgtctct

SEQ ID NO: 3314726 - DNA, 21 bp, Homo sapiens
ctggattgtccttggaggaaa

SEQ ID NO: 3314727 - DNA, 21 bp, Homo sapiens
ctggatttatagtatgtgact

SEQ ID NO: 3314728 - DNA, 17 bp, Homo sapiens
ctggcaaaataaaacat

SEQ ID NO: 3314729 - DNA, 20 bp, Homo sapiens
ctggcaaagcttttagaaat

SEQ ID NO: 3314730 - DNA, 13 bp, Homo sapiens
ctggcaaaggacc

SEQ ID NO: 3314731 - DNA, 14 bp, Homo sapiens
ctggcaagaggcct

SEQ ID NO: 3314732 - DNA, 15 bp, Homo sapiens
ctggcaagaggcctc

SEQ ID NO: 3314733 - DNA, 17 bp, Homo sapiens
ctggcaagaggcctcat

SEQ ID NO: 3314734 - DNA, 15 bp, Homo sapiens
ctggcaatagtgtgt

SEQ ID NO: 3314735 - DNA, 20 bp, Homo sapiens
ctggcaatagtgtgttctga

SEQ ID NO: 3314736 - DNA, 18 bp, Homo sapiens
ctggcaattgtctattta

SEQ ID NO: 3314737 - DNA, 12 bp, Homo sapiens
ctggcacagagg

SEQ ID NO: 3314738 - DNA, 13 bp, Homo sapiens
ctggcacagaggt

SEQ ID NO: 3314739 - DNA, 18 bp, Homo sapiens
ctggcacaggactgattc

SEQ ID NO: 3314740 - DNA, 15 bp, Homo sapiens
ctggcacagggcagt

SEQ ID NO: 3314741 - DNA, 21 bp, Homo sapiens
ctggcacccggcccctgctgg

SEQ ID NO: 3314742 - DNA, 20 bp, Homo sapiens
tgctgccacaaccagccagg

SEQ ID NO: 3314743 - DNA, 15 bp, Homo sapiens
tgctgccacacttca

SEQ ID NO: 3314744 - DNA, 22 bp, Homo sapiens
tgctgccacacttcaggctctt

SEQ ID NO: 3314745 - DNA, 14 bp, Homo sapiens
tgctgccagggctt

SEQ ID NO: 3314746 - DNA, 17 bp, Homo sapiens
tgctgccagtgcagcca

SEQ ID NO: 3314747 - DNA, 13 bp, Homo sapiens
tgctgccatccag

SEQ ID NO: 3314748 - DNA, 15 bp, Homo sapiens
tgctgccatccaggt

SEQ ID NO: 3314749 - DNA, 12 bp, Homo sapiens
tgctgccatgcc

SEQ ID NO: 3314750 - DNA, 18 bp, Homo sapiens
tgctgccatgccactgcc

SEQ ID NO: 3314751 - DNA, 14 bp, Homo sapiens
tgctgcccagcctc

SEQ ID NO: 3314752 - DNA, 17 bp, Homo sapiens
tgctgcccaggccacag

SEQ ID NO: 3314753 - DNA, 20 bp, Homo sapiens
tgctgcccaggccacagccg

SEQ ID NO: 3314754 - DNA, 14 bp, Homo sapiens
tgctgcccccaccc

SEQ ID NO: 3314755 - DNA, 20 bp, Homo sapiens
tgctgcccccaccccgggga

SEQ ID NO: 3314756 - DNA, 19 bp, Homo sapiens
tgctgccccgttccctgtc

SEQ ID NO: 3314757 - DNA, 21 bp, Homo sapiens
tgctgccccgttccctgtcag

SEQ ID NO: 3314758 - DNA, 20 bp, Homo sapiens
tgctgcccgcgggagacagc

SEQ ID NO: 3314759 - DNA, 11 bp, Homo sapiens
tgctgccctgt

SEQ ID NO: 3314760 - DNA, 19 bp, Homo sapiens
tgctgccgcctcccagcct

SEQ ID NO: 3314761 - DNA, 21 bp, Homo sapiens
tgctgccgcctcccagcctgg

SEQ ID NO: 3314762 - DNA, 14 bp, Homo sapiens
tgctgcctccagaa

SEQ ID NO: 3314763 - DNA, 20 bp, Homo sapiens
tgctgccttctgacggccct

SEQ ID NO: 3314764 - DNA, 21 bp, Homo sapiens
tgctgccttctgacggccctg

SEQ ID NO: 3314765 - DNA, 22 bp, Homo sapiens
tgctgccttctgacggccctgc

SEQ ID NO: 3314766 - DNA, 23 bp, Homo sapiens
tgctgccttctgacggccctgca

SEQ ID NO: 3314767 - DNA, 23 bp, Homo sapiens
tgctgcgcaccaatgcccagcag

SEQ ID NO: 3314768 - DNA, 18 bp, Homo sapiens
tgctgcggaggagctgcc

SEQ ID NO: 3314769 - DNA, 19 bp, Homo sapiens
tgctgcggaggagctgcct

SEQ ID NO: 3314770 - DNA, 21 bp, Homo sapiens
tgctgcgtccccactcccttg

SEQ ID NO: 3314771 - DNA, 16 bp, Homo sapiens
tgctgctaccagcgcc

SEQ ID NO: 3314772 - DNA, 13 bp, Homo sapiens
tgctgctagaact

SEQ ID NO: 3314773 - DNA, 17 bp, Homo sapiens
tgctgctagaacttttt

SEQ ID NO: 3314774 - DNA, 20 bp, Homo sapiens
tgctgctagaacttttttaa

SEQ ID NO: 3314775 - DNA, 19 bp, Homo sapiens
tgctgctatcctgccaaaa

SEQ ID NO: 3314776 - DNA, 13 bp, Homo sapiens
tgctgctatgaaa

SEQ ID NO: 3314777 - DNA, 15 bp, Homo sapiens
tgctgctccaccctc

SEQ ID NO: 3314778 - DNA, 17 bp, Homo sapiens
tgctgctccgcccgctc

SEQ ID NO: 3314779 - DNA, 12 bp, Homo sapiens
tgctgctctcag

SEQ ID NO: 3314780 - DNA, 17 bp, Homo sapiens
tgctgctgcctctttcc

SEQ ID NO: 3314781 - DNA, 13 bp, Homo sapiens
tgctgctgctgca

SEQ ID NO: 3314782 - DNA, 20 bp, Homo sapiens
tgctgctgtaactgctgagc

SEQ ID NO: 3314783 - DNA, 23 bp, Homo sapiens
tgctgctgtaactgctgagccac

SEQ ID NO: 3314784 - DNA, 18 bp, Homo sapiens
tgctgctgtgcagcatgg

SEQ ID NO: 3314785 - DNA, 20 bp, Homo sapiens
tgctgcttagacataacaaa

SEQ ID NO: 3314786 - DNA, 20 bp, Homo sapiens
tgctgcttccggtagggagg

SEQ ID NO: 3314787 - DNA, 14 bp, Homo sapiens
tgctgcttctcttg

SEQ ID NO: 3314788 - DNA, 14 bp, Homo sapiens
tgctgcttggattt

SEQ ID NO: 3314789 - DNA, 16 bp, Homo sapiens
tgctgctttcccctgt

SEQ ID NO: 3314790 - DNA, 17 bp, Homo sapiens
tgctgctttcccctgtg

SEQ ID NO: 3314791 - DNA, 23 bp, Homo sapiens
tgctgctttcccctgtggggatc

SEQ ID NO: 3314792 - DNA, 17 bp, Homo sapiens
tgctgcttttgagcctc

SEQ ID NO: 3314793 - DNA, 18 bp, Homo sapiens
tgctgcttttgagcctca

SEQ ID NO: 3314794 - DNA, 20 bp, Homo sapiens
tgctgctttttgaggtggca

SEQ ID NO: 3314795 - DNA, 17 bp, Homo sapiens
tgctgctttttggcaca

SEQ ID NO: 3314796 - DNA, 20 bp, Homo sapiens
cagcctgggagcccagaggg

SEQ ID NO: 3314797 - DNA, 16 bp, Homo sapiens
cagcctggggcctggc

SEQ ID NO: 3314798 - DNA, 17 bp, Homo sapiens
cagcctggggcctggca

SEQ ID NO: 3314799 - DNA, 16 bp, Homo sapiens
cagcctggggctccct

SEQ ID NO: 3314800 - DNA, 23 bp, Homo sapiens
cagcctggggctccctctctggt

SEQ ID NO: 3314801 - DNA, 24 bp, Homo sapiens
cagcctggggctccctctctggtt

SEQ ID NO: 3314802 - DNA, 20 bp, Homo sapiens
cagcctggtcaacatggtga

SEQ ID NO: 3314803 - DNA, 21 bp, Homo sapiens
cagcctggttcagaataaatt

SEQ ID NO: 3314804 - DNA, 16 bp, Homo sapiens
cagcctggttttcaca

SEQ ID NO: 3314805 - DNA, 19 bp, Homo sapiens
cagcctgtcccatggacac

SEQ ID NO: 3314806 - DNA, 21 bp, Homo sapiens
cagcctgtcccatggacactc

SEQ ID NO: 3314807 - DNA, 23 bp, Homo sapiens
cagcctgtgctgtggcatagaca

SEQ ID NO: 3314808 - DNA, 16 bp, Homo sapiens
cagcctgtggcagggc

SEQ ID NO: 3314809 - DNA, 19 bp, Homo sapiens
cagcctgtggttacagtgc

SEQ ID NO: 3314810 - DNA, 14 bp, Homo sapiens
cagccttccccctc

SEQ ID NO: 3314811 - DNA, 22 bp, Homo sapiens
cagccttcggagcgttctctgt

SEQ ID NO: 3314812 - DNA, 21 bp, Homo sapiens
cagccttcttccatcccagga

SEQ ID NO: 3314813 - DNA, 15 bp, Homo sapiens
cagccttgagccctg

SEQ ID NO: 3314814 - DNA, 19 bp, Homo sapiens
cagccttgagccctggctg

SEQ ID NO: 3314815 - DNA, 14 bp, Homo sapiens
cagccttggctcct

SEQ ID NO: 3314816 - DNA, 23 bp, Homo sapiens
cagccttggctcctgagaaaggt

SEQ ID NO: 3314817 - DNA, 15 bp, Homo sapiens
cagcctttccagcct

SEQ ID NO: 3314818 - DNA, 17 bp, Homo sapiens
cagcctttgcctccccg

SEQ ID NO: 3314819 - DNA, 18 bp, Homo sapiens
cagcctttggccttggct

SEQ ID NO: 3314820 - DNA, 20 bp, Homo sapiens
cagcgacatagcccatccct

SEQ ID NO: 3314821 - DNA, 22 bp, Homo sapiens
cagcgactccgttggccactcc

SEQ ID NO: 3314822 - DNA, 16 bp, Homo sapiens
cagcgagccctggtgg

SEQ ID NO: 3314823 - DNA, 20 bp, Homo sapiens
cagcgagccctggtggcagt

SEQ ID NO: 3314824 - DNA, 21 bp, Homo sapiens
cagcgagccctggtggcagtg

SEQ ID NO: 3314825 - DNA, 14 bp, Homo sapiens
cagcgagggcagct

SEQ ID NO: 3314826 - DNA, 17 bp, Homo sapiens
cagcgagggcagctgct

SEQ ID NO: 3314827 - DNA, 21 bp, Homo sapiens
cagcgcagactggcggagaag

SEQ ID NO: 3314828 - DNA, 19 bp, Homo sapiens
cagcgccaaatgttcatcc

SEQ ID NO: 3314829 - DNA, 19 bp, Homo sapiens
cagcgccaagcaacctggg

SEQ ID NO: 3314830 - DNA, 22 bp, Homo sapiens
cagcgccaagcaacctgggtcc

SEQ ID NO: 3314831 - DNA, 24 bp, Homo sapiens
cagcgccaagtgcgtgccgtgtga

SEQ ID NO: 3314832 - DNA, 20 bp, Homo sapiens
cagcgcccagggaggagtca

SEQ ID NO: 3314833 - DNA, 15 bp, Homo sapiens
cagcgcggaggagga

SEQ ID NO: 3314834 - DNA, 17 bp, Homo sapiens
cagcgctcctcctgtgt

SEQ ID NO: 3314835 - DNA, 19 bp, Homo sapiens
cagcgctcctcctgtgtga

SEQ ID NO: 3314836 - DNA, 22 bp, Homo sapiens
cagcgctcctcctgtgtgactg

SEQ ID NO: 3314837 - DNA, 13 bp, Homo sapiens
cagcgctctgcct

SEQ ID NO: 3314838 - DNA, 17 bp, Homo sapiens
cagcggagtctgtcctg

SEQ ID NO: 3314839 - DNA, 12 bp, Homo sapiens
cagcggcccccc

SEQ ID NO: 3314840 - DNA, 14 bp, Homo sapiens
cagcggcccctgca

SEQ ID NO: 3314841 - DNA, 15 bp, Homo sapiens
cagcggcccctgcat

SEQ ID NO: 3314842 - DNA, 16 bp, Homo sapiens
cagcggcccctgcatc

SEQ ID NO: 3314843 - DNA, 13 bp, Homo sapiens
cagcgggagacct

SEQ ID NO: 3314844 - DNA, 14 bp, Homo sapiens
cagcgggcacaggg

SEQ ID NO: 3314845 - DNA, 17 bp, Homo sapiens
cagcgggcacagggcac

SEQ ID NO: 3314846 - DNA, 16 bp, Homo sapiens
cagcgggcagatgggc

SEQ ID NO: 3314847 - DNA, 14 bp, Homo sapiens
cagcggggacagct

SEQ ID NO: 3314848 - DNA, 19 bp, Homo sapiens
cagcggggacagctccttc

SEQ ID NO: 3314849 - DNA, 19 bp, Homo sapiens
cagcggggcgaagcccagg

SEQ ID NO: 3314850 - DNA, 19 bp, Homo sapiens
cagcgtcactctacctaat

SEQ ID NO: 3314851 - DNA, 15 bp, Homo sapiens
cagcgtccctggcgc

SEQ ID NO: 3314852 - DNA, 22 bp, Homo sapiens
cagcgtcctcgttcaaaacatt

SEQ ID NO: 3314853 - DNA, 22 bp, Homo sapiens
cagcgtgggaactcactttccc

SEQ ID NO: 3314854 - DNA, 15 bp, Homo sapiens
cagcgtgtgtatccg

SEQ ID NO: 3314855 - DNA, 19 bp, Homo sapiens
cagcgtgtgtatccgactc

SEQ ID NO: 3314856 - DNA, 14 bp, Homo sapiens
cagcgttgcatgtc

SEQ ID NO: 3314857 - DNA, 17 bp, Homo sapiens
cagcgttgcatgtcgtg

SEQ ID NO: 3314858 - DNA, 22 bp, Homo sapiens
cagcgtttagtttctagaggcc

SEQ ID NO: 3314859 - DNA, 20 bp, Homo sapiens
cagcgtttgaggggctggcc

SEQ ID NO: 3314860 - DNA, 18 bp, Homo sapiens
cagctaaagcccaacctc

SEQ ID NO: 3314861 - DNA, 22 bp, Homo sapiens
cagctaaagcccaacctcctga

SEQ ID NO: 3314862 - DNA, 23 bp, Homo sapiens
cagctaagaaaagattttaatca

SEQ ID NO: 3314863 - DNA, 19 bp, Homo sapiens
cagctaaggacatttccca

SEQ ID NO: 3314864 - DNA, 12 bp, Homo sapiens
cagctaatctgt

SEQ ID NO: 3314865 - DNA, 17 bp, Homo sapiens
cagctaatctgtagggc

SEQ ID NO: 3314866 - DNA, 15 bp, Homo sapiens
cagctacagctttct

SEQ ID NO: 3314867 - DNA, 24 bp, Homo sapiens
cagctacccaggaggctgaggtgg

SEQ ID NO: 3314868 - DNA, 24 bp, Homo sapiens
cagctaccctttttctccagctgg

SEQ ID NO: 3314869 - DNA, 20 bp, Homo sapiens
cagctacctgagacgggcat

SEQ ID NO: 3314870 - DNA, 15 bp, Homo sapiens
cagctactcagaagc

SEQ ID NO: 3314871 - DNA, 16 bp, Homo sapiens
cagctactcagaagcc

SEQ ID NO: 3314872 - DNA, 19 bp, Homo sapiens
cagctactcagaagcctga

SEQ ID NO: 3314873 - DNA, 20 bp, Homo sapiens
cagctactcagaagcctgag

SEQ ID NO: 3314874 - DNA, 21 bp, Homo sapiens
cagctactcagaagcctgagg

SEQ ID NO: 3314875 - DNA, 22 bp, Homo sapiens
cagctactcagaagcctgaggc

SEQ ID NO: 3314876 - DNA, 18 bp, Homo sapiens
cagctacttgggaggctg

SEQ ID NO: 3314877 - DNA, 17 bp, Homo sapiens
cagctacttggtttgtg

SEQ ID NO: 3314878 - DNA, 15 bp, Homo sapiens
cagctactttccatt

SEQ ID NO: 3314879 - DNA, 21 bp, Homo sapiens
cagctaggaagagcaggactc

SEQ ID NO: 3314880 - DNA, 20 bp, Homo sapiens
cagctaggactgaggagtgg

SEQ ID NO: 3314881 - DNA, 21 bp, Homo sapiens
cagctagggggcgttatttat

SEQ ID NO: 3314882 - DNA, 19 bp, Homo sapiens
cagctatcgaacttcacaa

SEQ ID NO: 3314883 - DNA, 15 bp, Homo sapiens
cagctatgggagccc

SEQ ID NO: 3314884 - DNA, 23 bp, Homo sapiens
cagctatgggagccccagggtct

SEQ ID NO: 3314885 - DNA, 15 bp, Homo sapiens
cagctatttaagggg

SEQ ID NO: 3314886 - DNA, 13 bp, Homo sapiens
cagctcacagtgc

SEQ ID NO: 3314887 - DNA, 20 bp, Homo sapiens
cagctcacagtgctgtgtgc

SEQ ID NO: 3314888 - DNA, 15 bp, Homo sapiens
cagctcaccagcccc

SEQ ID NO: 3314889 - DNA, 14 bp, Homo sapiens
cagctcacccctgg

SEQ ID NO: 3314890 - DNA, 15 bp, Homo sapiens
cagctcacccctggg

SEQ ID NO: 3314891 - DNA, 18 bp, Homo sapiens
cagctcacccctgggcag

SEQ ID NO: 3314892 - DNA, 16 bp, Homo sapiens
cagctcagaacccagg

SEQ ID NO: 3314893 - DNA, 14 bp, Homo sapiens
cagctcagccagtg

SEQ ID NO: 3314894 - DNA, 15 bp, Homo sapiens
cagctcagccagtgg

SEQ ID NO: 3314895 - DNA, 11 bp, Homo sapiens
cagctcagcgc

SEQ ID NO: 3314896 - DNA, 17 bp, Homo sapiens
cagctcagcgccagcct

SEQ ID NO: 3314897 - DNA, 14 bp, Homo sapiens
cagctcaggcagct

SEQ ID NO: 3314898 - DNA, 16 bp, Homo sapiens
cagctcaggcagctcg

SEQ ID NO: 3314899 - DNA, 17 bp, Homo sapiens
cagctcaggggcagctc

SEQ ID NO: 3314900 - DNA, 23 bp, Homo sapiens
cagctcatatgctgacagctctt

SEQ ID NO: 3314901 - DNA, 13 bp, Homo sapiens
cagctcatctcca

SEQ ID NO: 3314902 - DNA, 17 bp, Homo sapiens
cagctcatgcccccttt

SEQ ID NO: 3314903 - DNA, 13 bp, Homo sapiens
cagctccagctca

SEQ ID NO: 3314904 - DNA, 16 bp, Homo sapiens
cagctccagctcacca

SEQ ID NO: 3314905 - DNA, 22 bp, Homo sapiens
cagctccagctcaccagcccca

SEQ ID NO: 3314906 - DNA, 20 bp, Homo sapiens
cagctccagggaatccaagc

SEQ ID NO: 3314907 - DNA, 17 bp, Homo sapiens
cagctccaggtggctct

SEQ ID NO: 3314908 - DNA, 16 bp, Homo sapiens
cagctccccctgtccc

SEQ ID NO: 3314909 - DNA, 17 bp, Homo sapiens
cagctccccctgtcccc

SEQ ID NO: 3314910 - DNA, 18 bp, Homo sapiens
cagctccccctgtcccct

SEQ ID NO: 3314911 - DNA, 21 bp, Homo sapiens
taacatctattataaaaccat

SEQ ID NO: 3314912 - DNA, 18 bp, Homo sapiens
taacatgaggggacattt

SEQ ID NO: 3314913 - DNA, 18 bp, Homo sapiens
taacatgcatactttatt

SEQ ID NO: 3314914 - DNA, 11 bp, Homo sapiens
taacatgggct

SEQ ID NO: 3314915 - DNA, 15 bp, Homo sapiens
taacattaacatcta

SEQ ID NO: 3314916 - DNA, 13 bp, Homo sapiens
taacattacctta

SEQ ID NO: 3314917 - DNA, 17 bp, Homo sapiens
taacattaccttactgt

SEQ ID NO: 3314918 - DNA, 16 bp, Homo sapiens
taacattatattgcaa

SEQ ID NO: 3314919 - DNA, 22 bp, Homo sapiens
taacattctgtaaaatgtctgt

SEQ ID NO: 3314920 - DNA, 23 bp, Homo sapiens
taacattgaccaagaactgcatg

SEQ ID NO: 3314921 - DNA, 16 bp, Homo sapiens
taacatttctgttctc

SEQ ID NO: 3314922 - DNA, 12 bp, Homo sapiens
taacatttgcct

SEQ ID NO: 3314923 - DNA, 14 bp, Homo sapiens
taacatttgctgtt

SEQ ID NO: 3314924 - DNA, 12 bp, Homo sapiens
taacattttgtt

SEQ ID NO: 3314925 - DNA, 21 bp, Homo sapiens
taacattttgttcttacacat

SEQ ID NO: 3314926 - DNA, 22 bp, Homo sapiens
taacattttgttcttacacata

SEQ ID NO: 3314927 - DNA, 16 bp, Homo sapiens
taaccaaacaattatt

SEQ ID NO: 3314928 - DNA, 21 bp, Homo sapiens
taaccaaatattaaagattct

SEQ ID NO: 3314929 - DNA, 20 bp, Homo sapiens
taaccacgtctgtcttcaca

SEQ ID NO: 3314930 - DNA, 19 bp, Homo sapiens
taaccaggccatttttggt

SEQ ID NO: 3314931 - DNA, 14 bp, Homo sapiens
taaccaggcccagc

SEQ ID NO: 3314932 - DNA, 15 bp, Homo sapiens
taaccaggcccagcc

SEQ ID NO: 3314933 - DNA, 18 bp, Homo sapiens
taaccaggcccagccagt

SEQ ID NO: 3314934 - DNA, 19 bp, Homo sapiens
taaccagtacctctgtata

SEQ ID NO: 3314935 - DNA, 20 bp, Homo sapiens
taaccagtgcagaaatgaaa

SEQ ID NO: 3314936 - DNA, 22 bp, Homo sapiens
taaccagttaccacacatctat

SEQ ID NO: 3314937 - DNA, 15 bp, Homo sapiens
taaccattggaatgg

SEQ ID NO: 3314938 - DNA, 19 bp, Homo sapiens
taaccattgtcttgttctg

SEQ ID NO: 3314939 - DNA, 14 bp, Homo sapiens
taacccacttgtca

SEQ ID NO: 3314940 - DNA, 14 bp, Homo sapiens
taacccagatttta

SEQ ID NO: 3314941 - DNA, 14 bp, Homo sapiens
taacccagttactt

SEQ ID NO: 3314942 - DNA, 15 bp, Homo sapiens
taaccccattctttg

SEQ ID NO: 3314943 - DNA, 17 bp, Homo sapiens
taaccccattctttgct

SEQ ID NO: 3314944 - DNA, 19 bp, Homo sapiens
taacccccttaaatttaat

SEQ ID NO: 3314945 - DNA, 21 bp, Homo sapiens
taacctaattaatatattaaa

SEQ ID NO: 3314946 - DNA, 13 bp, Homo sapiens
taacctagttaaa

SEQ ID NO: 3314947 - DNA, 22 bp, Homo sapiens
taacctagttaaagaaaggaaa

SEQ ID NO: 3314948 - DNA, 20 bp, Homo sapiens
taacctatatgatttatagt

SEQ ID NO: 3314949 - DNA, 16 bp, Homo sapiens
taacctcagctctggg

SEQ ID NO: 3314950 - DNA, 17 bp, Homo sapiens
taacctcagctctggga

SEQ ID NO: 3314951 - DNA, 16 bp, Homo sapiens
taacctcgggcctgct

SEQ ID NO: 3314952 - DNA, 15 bp, Homo sapiens
taacctctgctttta

SEQ ID NO: 3314953 - DNA, 20 bp, Homo sapiens
taacctctgcttttatctca

SEQ ID NO: 3314954 - DNA, 11 bp, Homo sapiens
taacctctggc

SEQ ID NO: 3314955 - DNA, 14 bp, Homo sapiens
taacctctggccct

SEQ ID NO: 3314956 - DNA, 17 bp, Homo sapiens
taacctctggcccttgg

SEQ ID NO: 3314957 - DNA, 22 bp, Homo sapiens
taacctgactggttaacagcag

SEQ ID NO: 3314958 - DNA, 16 bp, Homo sapiens
taacctggacctggaa

SEQ ID NO: 3314959 - DNA, 12 bp, Homo sapiens
taacctggtgct

SEQ ID NO: 3314960 - DNA, 22 bp, Homo sapiens
taacctggtgctggatattttc

SEQ ID NO: 3314961 - DNA, 18 bp, Homo sapiens
taacctgtctcacctgga

SEQ ID NO: 3314962 - DNA, 17 bp, Homo sapiens
taacctgttttgttaat

SEQ ID NO: 3314963 - DNA, 12 bp, Homo sapiens
taacctttctgg

SEQ ID NO: 3314964 - DNA, 13 bp, Homo sapiens
taacctttgctat

SEQ ID NO: 3314965 - DNA, 17 bp, Homo sapiens
taacctttttgtaaata

SEQ ID NO: 3314966 - DNA, 15 bp, Homo sapiens
taaccttttttgtct

SEQ ID NO: 3314967 - DNA, 23 bp, Homo sapiens
taacgacttcagggcagggctct

SEQ ID NO: 3314968 - DNA, 14 bp, Homo sapiens
taacgcaaccaagt

SEQ ID NO: 3314969 - DNA, 15 bp, Homo sapiens
taacggctccaggat

SEQ ID NO: 3314970 - DNA, 19 bp, Homo sapiens
taacgtttttcctttaaaa

SEQ ID NO: 3314971 - DNA, 20 bp, Homo sapiens
taacgtttttcctttaaaaa

SEQ ID NO: 3314972 - DNA, 14 bp, Homo sapiens
taactaaaaggtat

SEQ ID NO: 3314973 - DNA, 23 bp, Homo sapiens
taactaaaatgtatctaagaata

SEQ ID NO: 3314974 - DNA, 21 bp, Homo sapiens
tgccttccataattatgacag

SEQ ID NO: 3314975 - DNA, 13 bp, Homo sapiens
tgccttcctcctt

SEQ ID NO: 3314976 - DNA, 14 bp, Homo sapiens
tgccttcctcctta

SEQ ID NO: 3314977 - DNA, 20 bp, Homo sapiens
tgccttcctttctccaggac

SEQ ID NO: 3314978 - DNA, 16 bp, Homo sapiens
tgccttcgcttcttgc

SEQ ID NO: 3314979 - DNA, 16 bp, Homo sapiens
tgccttctacttttaa

SEQ ID NO: 3314980 - DNA, 20 bp, Homo sapiens
tgccttctccttccccagga

SEQ ID NO: 3314981 - DNA, 21 bp, Homo sapiens
tgccttctccttccccaggat

SEQ ID NO: 3314982 - DNA, 22 bp, Homo sapiens
tgccttctccttccccaggatg

SEQ ID NO: 3314983 - DNA, 23 bp, Homo sapiens
tgccttctccttccccaggatgg

SEQ ID NO: 3314984 - DNA, 14 bp, Homo sapiens
tgccttctgggctt

SEQ ID NO: 3314985 - DNA, 20 bp, Homo sapiens
tgccttctgtcctggtgtca

SEQ ID NO: 3314986 - DNA, 16 bp, Homo sapiens
tgccttctgtctgctc

SEQ ID NO: 3314987 - DNA, 14 bp, Homo sapiens
tgccttgaactgtt

SEQ ID NO: 3314988 - DNA, 15 bp, Homo sapiens
tgccttgaagccact

SEQ ID NO: 3314989 - DNA, 17 bp, Homo sapiens
tgccttgataaatatat

SEQ ID NO: 3314990 - DNA, 20 bp, Homo sapiens
tgccttgataaatatatatg

SEQ ID NO: 3314991 - DNA, 14 bp, Homo sapiens
tgccttgcagaact

SEQ ID NO: 3314992 - DNA, 20 bp, Homo sapiens
tgccttgcagaactgccatt

SEQ ID NO: 3314993 - DNA, 18 bp, Homo sapiens
tgccttgctcctagcaga

SEQ ID NO: 3314994 - DNA, 21 bp, Homo sapiens
tgccttgctcggcgcccacca

SEQ ID NO: 3314995 - DNA, 22 bp, Homo sapiens
tgccttggcctcggcgggcttt

SEQ ID NO: 3314996 - DNA, 19 bp, Homo sapiens
tgccttggctcagacatgt

SEQ ID NO: 3314997 - DNA, 19 bp, Homo sapiens
tgccttgggccttgctgct

SEQ ID NO: 3314998 - DNA, 18 bp, Homo sapiens
tgccttggggaatttcct

SEQ ID NO: 3314999 - DNA, 19 bp, Homo sapiens
tgccttggggaatttcctc

SEQ ID NO: 3315000 - DNA, 16 bp, Homo sapiens
tgccttgtataatatt

SEQ ID NO: 3315001 - DNA, 18 bp, Homo sapiens
tgccttgtccctctcact

SEQ ID NO: 3315002 - DNA, 18 bp, Homo sapiens
tgcctttaaatctgtgat

SEQ ID NO: 3315003 - DNA, 22 bp, Homo sapiens
tgcctttaagccaaagaaacaa

SEQ ID NO: 3315004 - DNA, 22 bp, Homo sapiens
tgcctttagtccacggaccccc

SEQ ID NO: 3315005 - DNA, 23 bp, Homo sapiens
tgcctttatatttcacaggctgt

SEQ ID NO: 3315006 - DNA, 19 bp, Homo sapiens
tgcctttatctctgaggct

SEQ ID NO: 3315007 - DNA, 12 bp, Homo sapiens
tgcctttcctgt

SEQ ID NO: 3315008 - DNA, 14 bp, Homo sapiens
tgcctttcctgttc

SEQ ID NO: 3315009 - DNA, 20 bp, Homo sapiens
tgcctttctcgattttatct

SEQ ID NO: 3315010 - DNA, 15 bp, Homo sapiens
tgcctttgtggcctt

SEQ ID NO: 3315011 - DNA, 15 bp, Homo sapiens
tgcctttgttttgat

SEQ ID NO: 3315012 - DNA, 16 bp, Homo sapiens
tgccttttaattttta

SEQ ID NO: 3315013 - DNA, 17 bp, Homo sapiens
tgccttttatagctatt

SEQ ID NO: 3315014 - DNA, 19 bp, Homo sapiens
tgccttttgcacccctccc

SEQ ID NO: 3315015 - DNA, 20 bp, Homo sapiens
tgccttttgcacccctccca

SEQ ID NO: 3315016 - DNA, 21 bp, Homo sapiens
tgccttttgcacccctcccat

SEQ ID NO: 3315017 - DNA, 15 bp, Homo sapiens
tgccttttgcagaag

SEQ ID NO: 3315018 - DNA, 19 bp, Homo sapiens
tgccttttgcagaagaggg

SEQ ID NO: 3315019 - DNA, 22 bp, Homo sapiens
tgccttttgcagaagagggtgt

SEQ ID NO: 3315020 - DNA, 18 bp, Homo sapiens
tgccttttgctgcgcacc

SEQ ID NO: 3315021 - DNA, 20 bp, Homo sapiens
tgccttttgctgcgcaccaa

SEQ ID NO: 3315022 - DNA, 14 bp, Homo sapiens
tgccttttgtgtga

SEQ ID NO: 3315023 - DNA, 16 bp, Homo sapiens
tgcgaaggggccctgg

SEQ ID NO: 3315024 - DNA, 15 bp, Homo sapiens
tgcgacggagagaaa

SEQ ID NO: 3315025 - DNA, 21 bp, Homo sapiens
tgcgagacgcacacagctgag

SEQ ID NO: 3315026 - DNA, 21 bp, Homo sapiens
tgcgagcgctatcttcacata

SEQ ID NO: 3315027 - DNA, 12 bp, Homo sapiens
tgcgaggaccac

SEQ ID NO: 3315028 - DNA, 14 bp, Homo sapiens
tgcgatagagtctc

SEQ ID NO: 3315029 - DNA, 16 bp, Homo sapiens
tgcgatagagtctcac

SEQ ID NO: 3315030 - DNA, 19 bp, Homo sapiens
tgcgattttgcctgtgtct

SEQ ID NO: 3315031 - DNA, 17 bp, Homo sapiens
tgcgcaaaactgcctga

SEQ ID NO: 3315032 - DNA, 13 bp, Homo sapiens
tgcgcaatgtggc

SEQ ID NO: 3315033 - DNA, 22 bp, Homo sapiens
tgcgcacaaggctgaccaagag

SEQ ID NO: 3315034 - DNA, 21 bp, Homo sapiens
tgcgccccctccgccctgcca

SEQ ID NO: 3315035 - DNA, 15 bp, Homo sapiens
tgcgccccgcccaca

SEQ ID NO: 3315036 - DNA, 16 bp, Homo sapiens
tgcgccctgcactccc

SEQ ID NO: 3315037 - DNA, 13 bp, Homo sapiens
tgcgcctacagga

SEQ ID NO: 3315038 - DNA, 14 bp, Homo sapiens
tgcgcctacaggag

SEQ ID NO: 3315039 - DNA, 19 bp, Homo sapiens
tgcgcctgtgatgctgggc

SEQ ID NO: 3315040 - DNA, 13 bp, Homo sapiens
tgcgctcagggcc

SEQ ID NO: 3315041 - DNA, 15 bp, Homo sapiens
tgcgctcagggccat

SEQ ID NO: 3315042 - DNA, 17 bp, Homo sapiens
tgcgctcggcaggaagg

SEQ ID NO: 3315043 - DNA, 17 bp, Homo sapiens
tgcgctcttggtccctg

SEQ ID NO: 3315044 - DNA, 17 bp, Homo sapiens
tgcgctgctttttcaaa

SEQ ID NO: 3315045 - DNA, 14 bp, Homo sapiens
tgcgcttgcttttc

SEQ ID NO: 3315046 - DNA, 15 bp, Homo sapiens
tgcggacaagtttta

SEQ ID NO: 3315047 - DNA, 17 bp, Homo sapiens
tgcggacagccacggcc

SEQ ID NO: 3315048 - DNA, 14 bp, Homo sapiens
tgcggacgggctgt

SEQ ID NO: 3315049 - DNA, 20 bp, Homo sapiens
tgcggagtgaagaggggcag

SEQ ID NO: 3315050 - DNA, 16 bp, Homo sapiens
tgcggatcctgctggg

SEQ ID NO: 3315051 - DNA, 15 bp, Homo sapiens
tgcggatctcagctt

SEQ ID NO: 3315052 - DNA, 18 bp, Homo sapiens
tgcgggaggccctggccc

SEQ ID NO: 3315053 - DNA, 19 bp, Homo sapiens
tgcgggaggccctggccct

SEQ ID NO: 3315054 - DNA, 16 bp, Homo sapiens
tgctcccagctgtgct

SEQ ID NO: 3315055 - DNA, 20 bp, Homo sapiens
tgctcccagctgtgctgtgg

SEQ ID NO: 3315056 - DNA, 20 bp, Homo sapiens
tgctccccacagcgtccctg

SEQ ID NO: 3315057 - DNA, 22 bp, Homo sapiens
tgctccccacagcgtccctggc

SEQ ID NO: 3315058 - DNA, 23 bp, Homo sapiens
tgctccccagccctggctctgca

SEQ ID NO: 3315059 - DNA, 18 bp, Homo sapiens
tgctccctcagcctcaga

SEQ ID NO: 3315060 - DNA, 19 bp, Homo sapiens
tgctccctcagcctcagag

SEQ ID NO: 3315061 - DNA, 20 bp, Homo sapiens
tgctccctcccctgccctgg

SEQ ID NO: 3315062 - DNA, 21 bp, Homo sapiens
tgctccctgaagccagccttc

SEQ ID NO: 3315063 - DNA, 12 bp, Homo sapiens
tgctccctgtgt

SEQ ID NO: 3315064 - DNA, 13 bp, Homo sapiens
tgctccgcccgct

SEQ ID NO: 3315065 - DNA, 23 bp, Homo sapiens
tgctccgctcccaccgcccccac

SEQ ID NO: 3315066 - DNA, 21 bp, Homo sapiens
tgctccgctgctccttggctt

SEQ ID NO: 3315067 - DNA, 23 bp, Homo sapiens
tgctccgctgctccttggcttac

SEQ ID NO: 3315068 - DNA, 14 bp, Homo sapiens
tgctccgtgcctcc

SEQ ID NO: 3315069 - DNA, 20 bp, Homo sapiens
tgctccgtgcctccaccacc

SEQ ID NO: 3315070 - DNA, 17 bp, Homo sapiens
tgctcctagcagacaga

SEQ ID NO: 3315071 - DNA, 15 bp, Homo sapiens
tgctcctcacctgtc

SEQ ID NO: 3315072 - DNA, 16 bp, Homo sapiens
tgctcctcacctgtct

SEQ ID NO: 3315073 - DNA, 17 bp, Homo sapiens
tgctcctcactggagga

SEQ ID NO: 3315074 - DNA, 23 bp, Homo sapiens
tgctcctcactggaggagcagct

SEQ ID NO: 3315075 - DNA, 10 bp, Homo sapiens
tgctcctccc

SEQ ID NO: 3315076 - DNA, 17 bp, Homo sapiens
tgctcctccctgccccc

SEQ ID NO: 3315077 - DNA, 21 bp, Homo sapiens
tgctcctccctgccccccaag

SEQ ID NO: 3315078 - DNA, 13 bp, Homo sapiens
tgctcctccctgg

SEQ ID NO: 3315079 - DNA, 20 bp, Homo sapiens
tgctcctccctggctgccct

SEQ ID NO: 3315080 - DNA, 19 bp, Homo sapiens
tgctcctccttggtgcctg

SEQ ID NO: 3315081 - DNA, 11 bp, Homo sapiens
tgctcctctcc

SEQ ID NO: 3315082 - DNA, 12 bp, Homo sapiens
tgctcctctcca

SEQ ID NO: 3315083 - DNA, 14 bp, Homo sapiens
tgctcctctccagg

SEQ ID NO: 3315084 - DNA, 18 bp, Homo sapiens
tgctcctctccccagcaa

SEQ ID NO: 3315085 - DNA, 19 bp, Homo sapiens
tgctcctctccccagcaag

SEQ ID NO: 3315086 - DNA, 23 bp, Homo sapiens
tgctccttcactgttccctctgg

SEQ ID NO: 3315087 - DNA, 21 bp, Homo sapiens
tgctctaacacctgcctaggt

SEQ ID NO: 3315088 - DNA, 16 bp, Homo sapiens
tgctctaacagccctc

SEQ ID NO: 3315089 - DNA, 15 bp, Homo sapiens
tgctctagccaggag

SEQ ID NO: 3315090 - DNA, 22 bp, Homo sapiens
tgctctagccaggagtctgtgc

SEQ ID NO: 3315091 - DNA, 16 bp, Homo sapiens
tgctctagctggcagg

SEQ ID NO: 3315092 - DNA, 15 bp, Homo sapiens
tgctctagggaatct

SEQ ID NO: 3315093 - DNA, 21 bp, Homo sapiens
tgctctagggaatctggatta

SEQ ID NO: 3315094 - DNA, 16 bp, Homo sapiens
tgctctagtgggacag

SEQ ID NO: 3315095 - DNA, 22 bp, Homo sapiens
tgctctatgtttgtatttggaa

SEQ ID NO: 3315096 - DNA, 21 bp, Homo sapiens
tgctctattgtagcatttctt

SEQ ID NO: 3315097 - DNA, 22 bp, Homo sapiens
tgctctcaccagctgctgctct

SEQ ID NO: 3315098 - DNA, 16 bp, Homo sapiens
tgctctcagcctccca

SEQ ID NO: 3315099 - DNA, 17 bp, Homo sapiens
tgctctcagcctcccac

SEQ ID NO: 3315100 - DNA, 21 bp, Homo sapiens
tgctctcatatatattttaaa

SEQ ID NO: 3315101 - DNA, 12 bp, Homo sapiens
tgctctcccctg

SEQ ID NO: 3315102 - DNA, 17 bp, Homo sapiens
tgctctcccctgccctg

SEQ ID NO: 3315103 - DNA, 23 bp, Homo sapiens
tgctctccgaccagacaccttga

SEQ ID NO: 3315104 - DNA, 16 bp, Homo sapiens
tgctctcctcttgcca

SEQ ID NO: 3315105 - DNA, 16 bp, Homo sapiens
gcagcctctccccagg

SEQ ID NO: 3315106 - DNA, 13 bp, Homo sapiens
gcagcctgatggc

SEQ ID NO: 3315107 - DNA, 14 bp, Homo sapiens
gcagcctgatggcc

SEQ ID NO: 3315108 - DNA, 17 bp, Homo sapiens
gcagcctgatggccaag

SEQ ID NO: 3315109 - DNA, 19 bp, Homo sapiens
gcagcctgcgctcggcagg

SEQ ID NO: 3315110 - DNA, 21 bp, Homo sapiens
gcagcctgcgctcggcaggaa

SEQ ID NO: 3315111 - DNA, 22 bp, Homo sapiens
gcagcctgcgctcggcaggaag

SEQ ID NO: 3315112 - DNA, 23 bp, Homo sapiens
gcagcctgcgctcggcaggaagg

SEQ ID NO: 3315113 - DNA, 21 bp, Homo sapiens
gcagcctgctctagtgggaca

SEQ ID NO: 3315114 - DNA, 22 bp, Homo sapiens
gcagcctgcttcccacctccct

SEQ ID NO: 3315115 - DNA, 14 bp, Homo sapiens
gcagccttggggca

SEQ ID NO: 3315116 - DNA, 15 bp, Homo sapiens
gcagccttggggcat

SEQ ID NO: 3315117 - DNA, 18 bp, Homo sapiens
gcagcgaccgccccctcc

SEQ ID NO: 3315118 - DNA, 20 bp, Homo sapiens
gcagcgccaagcaacctggg

SEQ ID NO: 3315119 - DNA, 18 bp, Homo sapiens
gcagcgggccaggcccgc

SEQ ID NO: 3315120 - DNA, 16 bp, Homo sapiens
gcagcgtgtgggtccc

SEQ ID NO: 3315121 - DNA, 20 bp, Homo sapiens
gcagcgtgtgggtcccgcac

SEQ ID NO: 3315122 - DNA, 11 bp, Homo sapiens
gcagctaccac

SEQ ID NO: 3315123 - DNA, 14 bp, Homo sapiens
gcagctagactgga

SEQ ID NO: 3315124 - DNA, 21 bp, Homo sapiens
gcagctagactggagtgaggc

SEQ ID NO: 3315125 - DNA, 20 bp, Homo sapiens
gcagctaggactgaggagtg

SEQ ID NO: 3315126 - DNA, 14 bp, Homo sapiens
gcagctagtgcctt

SEQ ID NO: 3315127 - DNA, 19 bp, Homo sapiens
gcagctatgcgcaatgtgg

SEQ ID NO: 3315128 - DNA, 15 bp, Homo sapiens
gcagctcacccctgg

SEQ ID NO: 3315129 - DNA, 18 bp, Homo sapiens
gcagctcacccctgggca

SEQ ID NO: 3315130 - DNA, 19 bp, Homo sapiens
gcagctcacccctgggcag

SEQ ID NO: 3315131 - DNA, 20 bp, Homo sapiens
gcagctcacccctgggcagg

SEQ ID NO: 3315132 - DNA, 21 bp, Homo sapiens
gcagctcacccctgggcaggc

SEQ ID NO: 3315133 - DNA, 22 bp, Homo sapiens
gcagctcacccctgggcaggcg

SEQ ID NO: 3315134 - DNA, 14 bp, Homo sapiens
gcagctcccgcagg

SEQ ID NO: 3315135 - DNA, 14 bp, Homo sapiens
gcagctctccagtc

SEQ ID NO: 3315136 - DNA, 15 bp, Homo sapiens
gcagctctgagccag

SEQ ID NO: 3315137 - DNA, 21 bp, Homo sapiens
gcagctctgagccagattaca

SEQ ID NO: 3315138 - DNA, 23 bp, Homo sapiens
gcagctcttgcccttccctgtcc

SEQ ID NO: 3315139 - DNA, 16 bp, Homo sapiens
gcagctgagagccctg

SEQ ID NO: 3315140 - DNA, 21 bp, Homo sapiens
gcagctgatgttggaagagaa

SEQ ID NO: 3315141 - DNA, 15 bp, Homo sapiens
gcagctgcctctgct

SEQ ID NO: 3315142 - DNA, 21 bp, Homo sapiens
gcagctgcctctgctccctct

SEQ ID NO: 3315143 - DNA, 17 bp, Homo sapiens
gcagctgcgggtctgaa

SEQ ID NO: 3315144 - DNA, 19 bp, Homo sapiens
gcagctgcgggtctgaagg

SEQ ID NO: 3315145 - DNA, 22 bp, Homo sapiens
gcagctgcggtccacccaggag

SEQ ID NO: 3315146 - DNA, 16 bp, Homo sapiens
gcagctgggccccatg

SEQ ID NO: 3315147 - DNA, 18 bp, Homo sapiens
gcagctgggccccatgct

SEQ ID NO: 3315148 - DNA, 20 bp, Homo sapiens
gcagctgggccccatgctct

SEQ ID NO: 3315149 - DNA, 21 bp, Homo sapiens
gcagctgggccccatgctctg

SEQ ID NO: 3315150 - DNA, 16 bp, Homo sapiens
gcagcttcaagtgcct

SEQ ID NO: 3315151 - DNA, 17 bp, Homo sapiens
gcagcttcaagtgcctt

SEQ ID NO: 3315152 - DNA, 21 bp, Homo sapiens
gcagcttccttctgggactgg

SEQ ID NO: 3315153 - DNA, 21 bp, Homo sapiens
gcagcttgagggttgggctgg

SEQ ID NO: 3315154 - DNA, 21 bp, Homo sapiens
gcagcttgggagagcccctgg

SEQ ID NO: 3315155 - DNA, 22 bp, Homo sapiens
gcagcttgggagagcccctggg

SEQ ID NO: 3315156 - DNA, 17 bp, Homo sapiens
gcagctttaaactcagg

SEQ ID NO: 3315157 - DNA, 19 bp, Homo sapiens
gcagctttaaactcaggga

SEQ ID NO: 3315158 - DNA, 22 bp, Homo sapiens
gcagctttgggatcccaccctg

SEQ ID NO: 3315159 - DNA, 23 bp, Homo sapiens
gcagctttgggatcccaccctgg

SEQ ID NO: 3315160 - DNA, 18 bp, Homo sapiens
gcaggaacaaacagggct

SEQ ID NO: 3315161 - DNA, 20 bp, Homo sapiens
gcaggaacgagcactggcca

SEQ ID NO: 3315162 - DNA, 21 bp, Homo sapiens
gcaggaacgagcactggccag

SEQ ID NO: 3315163 - DNA, 22 bp, Homo sapiens
gcaggaacgagcactggccaga

SEQ ID NO: 3315164 - DNA, 21 bp, Homo sapiens
gcaggaagcattcagagagca

SEQ ID NO: 3315165 - DNA, 23 bp, Homo sapiens
gcaggaaggagagcctgctgcat

SEQ ID NO: 3315166 - DNA, 14 bp, Homo sapiens
gcaggaaggagcgg

SEQ ID NO: 3315167 - DNA, 14 bp, Homo sapiens
gcaggaaggcctgg

SEQ ID NO: 3315168 - DNA, 23 bp, Homo sapiens
gcaggacacatcccggcctcttc

SEQ ID NO: 3315169 - DNA, 13 bp, Homo sapiens
gcaggacaggagg

SEQ ID NO: 3315170 - DNA, 22 bp, Homo sapiens
gcaggacaggaggcggcccggc

SEQ ID NO: 3315171 - DNA, 18 bp, Homo sapiens
gcaggacctcccttccga

SEQ ID NO: 3315172 - DNA, 17 bp, Homo sapiens
gcaggactccaggccca

SEQ ID NO: 3315173 - DNA, 16 bp, Homo sapiens
gcaggagaatcactgc

SEQ ID NO: 3315174 - DNA, 22 bp, Homo sapiens
gcaggagagactgagcagccgc

SEQ ID NO: 3315175 - DNA, 13 bp, Homo sapiens
gcaggagaggctg

SEQ ID NO: 3315176 - DNA, 15 bp, Homo sapiens
gcaggagaggctggg

SEQ ID NO: 3315177 - DNA, 18 bp, Homo sapiens
gcaggagaggctgggctg

SEQ ID NO: 3315178 - DNA, 21 bp, Homo sapiens
gcaggagattgagaaggagag

SEQ ID NO: 3315179 - DNA, 23 bp, Homo sapiens
gcaggagattgagaaggagagaa

SEQ ID NO: 3315180 - DNA, 14 bp, Homo sapiens
gcaggagccccgcc

SEQ ID NO: 3315181 - DNA, 20 bp, Homo sapiens
gcaggagcgtgaaggactta

SEQ ID NO: 3315182 - DNA, 22 bp, Homo sapiens
gcaggagcgtgaaggacttagc

SEQ ID NO: 3315183 - DNA, 11 bp, Homo sapiens
gcaggagggag

SEQ ID NO: 3315184 - DNA, 18 bp, Homo sapiens
gcaggagggtgaggaggt

SEQ ID NO: 3315185 - DNA, 15 bp, Homo sapiens
gcaggagtgtcctgc

SEQ ID NO: 3315186 - DNA, 19 bp, Homo sapiens
gcaggcaaaaaagggacag

SEQ ID NO: 3315187 - DNA, 22 bp, Homo sapiens
gcaggcaccgccacgtcccagc

SEQ ID NO: 3315188 - DNA, 23 bp, Homo sapiens
gcaggcaccgccacgtcccagca

SEQ ID NO: 3315189 - DNA, 20 bp, Homo sapiens
gcaggcacctagcaattcca

SEQ ID NO: 3315190 - DNA, 18 bp, Homo sapiens
gcaggcacgggtggtccc

SEQ ID NO: 3315191 - DNA, 20 bp, Homo sapiens
gcaggcacgggtggtccccg

SEQ ID NO: 3315192 - DNA, 20 bp, Homo sapiens
gcaggcagactacacaggat

SEQ ID NO: 3315193 - DNA, 13 bp, Homo sapiens
gcaggcagcgcca

SEQ ID NO: 3315194 - DNA, 21 bp, Homo sapiens
gcaggcagcgccaagcaacct

SEQ ID NO: 3315195 - DNA, 22 bp, Homo sapiens
gcaggcagcgccaagcaacctg

SEQ ID NO: 3315196 - DNA, 18 bp, Homo sapiens
gcaggcaggaacaaacag

SEQ ID NO: 3315197 - DNA, 20 bp, Homo sapiens
gcaggcatgcttctcaccgt

SEQ ID NO: 3315198 - DNA, 16 bp, Homo sapiens
gcaggcatgtcctgga

SEQ ID NO: 3315199 - DNA, 15 bp, Homo sapiens
gcaggcattgaggaa

SEQ ID NO: 3315200 - DNA, 17 bp, Homo sapiens
gcaggccagatggcccc

SEQ ID NO: 3315201 - DNA, 13 bp, Homo sapiens
gcaggccagtgtc

SEQ ID NO: 3315202 - DNA, 11 bp, Homo sapiens
gcaggccctgc

SEQ ID NO: 3315203 - DNA, 14 bp, Homo sapiens
gcaggccggaacca

SEQ ID NO: 3315204 - DNA, 19 bp, Homo sapiens
gcaggccggaaccacaggg

SEQ ID NO: 3315205 - DNA, 21 bp, Homo sapiens
gcaggccggaaccacagggcc

SEQ ID NO: 3315206 - DNA, 23 bp, Homo sapiens
gcaggcctccaacgcccctgtgg

SEQ ID NO: 3315207 - DNA, 12 bp, Homo sapiens
gcaggcctggga

SEQ ID NO: 3315208 - DNA, 17 bp, Homo sapiens
gcaggcgaccgggcctc

SEQ ID NO: 3315209 - DNA, 19 bp, Homo sapiens
gcaggcgaccgggcctccc

SEQ ID NO: 3315210 - DNA, 14 bp, Homo sapiens
gcaggcggtcccca

SEQ ID NO: 3315211 - DNA, 20 bp, Homo sapiens
gcaggcggtccccatcccca

SEQ ID NO: 3315212 - DNA, 22 bp, Homo sapiens
gcaggcggtccccatccccacc

SEQ ID NO: 3315213 - DNA, 16 bp, Homo sapiens
gcaggcggtggggaga

SEQ ID NO: 3315214 - DNA, 20 bp, Homo sapiens
gcaggcgtgactcagcagcc

SEQ ID NO: 3315215 - DNA, 17 bp, Homo sapiens
gcaggctcactgccagg

SEQ ID NO: 3315216 - DNA, 18 bp, Homo sapiens
gcaggctcactgccaggc

SEQ ID NO: 3315217 - DNA, 13 bp, Homo sapiens
gcaggctctgggc

SEQ ID NO: 3315218 - DNA, 22 bp, Homo sapiens
gcaggctctgggctcagggctg

SEQ ID NO: 3315219 - DNA, 23 bp, Homo sapiens
gcaggctctgggctcagggctgg

SEQ ID NO: 3315220 - DNA, 11 bp, Homo sapiens
gcaggctgaca

SEQ ID NO: 3315221 - DNA, 15 bp, Homo sapiens
gcaggctgacatctg

SEQ ID NO: 3315222 - DNA, 12 bp, Homo sapiens
gcaggctggcca

SEQ ID NO: 3315223 - DNA, 17 bp, Homo sapiens
gcaggctggcctatgtg

SEQ ID NO: 3315224 - DNA, 10 bp, Homo sapiens
gcaggctggg

SEQ ID NO: 3315225 - DNA, 13 bp, Homo sapiens
gcaggctgggcca

SEQ ID NO: 3315226 - DNA, 17 bp, Homo sapiens
gcaggctgtctggccag

SEQ ID NO: 3315227 - DNA, 16 bp, Homo sapiens
gcagggaaagctccac

SEQ ID NO: 3315228 - DNA, 17 bp, Homo sapiens
gcagggaaagctccacg

SEQ ID NO: 3315229 - DNA, 13 bp, Homo sapiens
gcagggaaaggaa

SEQ ID NO: 3315230 - DNA, 20 bp, Homo sapiens
gcatacgagagcagaggtct

SEQ ID NO: 3315231 - DNA, 13 bp, Homo sapiens
gcatactgaaaat

SEQ ID NO: 3315232 - DNA, 16 bp, Homo sapiens
gcatactgaaaatcca

SEQ ID NO: 3315233 - DNA, 16 bp, Homo sapiens
gcatactttctctcta

SEQ ID NO: 3315234 - DNA, 15 bp, Homo sapiens
gcatactttgtaaat

SEQ ID NO: 3315235 - DNA, 16 bp, Homo sapiens
gcatagaggcttctcc

SEQ ID NO: 3315236 - DNA, 22 bp, Homo sapiens
gcatagaggcttctccgccagc

SEQ ID NO: 3315237 - DNA, 23 bp, Homo sapiens
gcatagataatattgtttggtaa

SEQ ID NO: 3315238 - DNA, 17 bp, Homo sapiens
gcatataaatatattta

SEQ ID NO: 3315239 - DNA, 22 bp, Homo sapiens
gcatatgcctgtaatcccaact

SEQ ID NO: 3315240 - DNA, 17 bp, Homo sapiens
gcatatgttgaatactt

SEQ ID NO: 3315241 - DNA, 18 bp, Homo sapiens
gcatatgttgaatacttt

SEQ ID NO: 3315242 - DNA, 20 bp, Homo sapiens
gcatatgttgaatacttttt

SEQ ID NO: 3315243 - DNA, 15 bp, Homo sapiens
gcatattagttaatc

SEQ ID NO: 3315244 - DNA, 15 bp, Homo sapiens
gcatattcctttcta

SEQ ID NO: 3315245 - DNA, 16 bp, Homo sapiens
gcatattcctttctat

SEQ ID NO: 3315246 - DNA, 21 bp, Homo sapiens
gcatatttatccaaaatgtgt

SEQ ID NO: 3315247 - DNA, 22 bp, Homo sapiens
gcatatttgccaataaagcttt

SEQ ID NO: 3315248 - DNA, 13 bp, Homo sapiens
gcatattttgctg

SEQ ID NO: 3315249 - DNA, 13 bp, Homo sapiens
gcatcaaccacca

SEQ ID NO: 3315250 - DNA, 13 bp, Homo sapiens
gcatcaagaatta

SEQ ID NO: 3315251 - DNA, 22 bp, Homo sapiens
gcatcacagggcagagccggga

SEQ ID NO: 3315252 - DNA, 14 bp, Homo sapiens
gcatcacctcaggc

SEQ ID NO: 3315253 - DNA, 15 bp, Homo sapiens
gcatcacctctgtaa

SEQ ID NO: 3315254 - DNA, 21 bp, Homo sapiens
gcatcactccccaaggaagag

SEQ ID NO: 3315255 - DNA, 22 bp, Homo sapiens
gcatcactgggtgttgatctta

SEQ ID NO: 3315256 - DNA, 17 bp, Homo sapiens
gcatcaggcactggtgg

SEQ ID NO: 3315257 - DNA, 18 bp, Homo sapiens
gcatcaggcactggtggc

SEQ ID NO: 3315258 - DNA, 17 bp, Homo sapiens
gcatccaaggcaaacaa

SEQ ID NO: 3315259 - DNA, 15 bp, Homo sapiens
gcatccacccagtgc

SEQ ID NO: 3315260 - DNA, 22 bp, Homo sapiens
gcatccacccagtgctgccatg

SEQ ID NO: 3315261 - DNA, 23 bp, Homo sapiens
gcatccacccagtgctgccatgc

SEQ ID NO: 3315262 - DNA, 21 bp, Homo sapiens
gcatccaccttggctctgcca

SEQ ID NO: 3315263 - DNA, 12 bp, Homo sapiens
gcatccatacca

SEQ ID NO: 3315264 - DNA, 20 bp, Homo sapiens
gcatcccagcacctgcctcc

SEQ ID NO: 3315265 - DNA, 22 bp, Homo sapiens
gcatcccagcacctgcctcctc

SEQ ID NO: 3315266 - DNA, 13 bp, Homo sapiens
gcatcccagggga

SEQ ID NO: 3315267 - DNA, 14 bp, Homo sapiens
gcatcccaggggac

SEQ ID NO: 3315268 - DNA, 19 bp, Homo sapiens
gcatcccaggggaccacac

SEQ ID NO: 3315269 - DNA, 19 bp, Homo sapiens
gcatccccttggctgtgag

SEQ ID NO: 3315270 - DNA, 12 bp, Homo sapiens
gcatccctgaga

SEQ ID NO: 3315271 - DNA, 16 bp, Homo sapiens
gcatccctggagcagg

SEQ ID NO: 3315272 - DNA, 23 bp, Homo sapiens
gcatccgtgtatttggctgggct

SEQ ID NO: 3315273 - DNA, 16 bp, Homo sapiens
gcatcctccacatcct

SEQ ID NO: 3315274 - DNA, 21 bp, Homo sapiens
gcatcctcctcagcccccagg

SEQ ID NO: 3315275 - DNA, 15 bp, Homo sapiens
gcatcctctgctggt

SEQ ID NO: 3315276 - DNA, 12 bp, Homo sapiens
gcatcctgcctg

SEQ ID NO: 3315277 - DNA, 21 bp, Homo sapiens
gcatcctgcctgggtgggaca

SEQ ID NO: 3315278 - DNA, 22 bp, Homo sapiens
gcatcctgcctgggtgggacag

SEQ ID NO: 3315279 - DNA, 13 bp, Homo sapiens
gcatcctggcacc

SEQ ID NO: 3315280 - DNA, 14 bp, Homo sapiens
gcatcctggcaccc

SEQ ID NO: 3315281 - DNA, 11 bp, Homo sapiens
gcatcctgtga

SEQ ID NO: 3315282 - DNA, 13 bp, Homo sapiens
gcatccttcctat

SEQ ID NO: 3315283 - DNA, 14 bp, Homo sapiens
gcatccttcctata

SEQ ID NO: 3315284 - DNA, 20 bp, Homo sapiens
gcatccttttctgcagaggg

SEQ ID NO: 3315285 - DNA, 23 bp, Homo sapiens
gcatcggactaaactatctgtat

SEQ ID NO: 3315286 - DNA, 20 bp, Homo sapiens
gcatcgggaaagaagaaact

SEQ ID NO: 3315287 - DNA, 15 bp, Homo sapiens
gcatcgtagaagaga

SEQ ID NO: 3315288 - DNA, 21 bp, Homo sapiens
gcatcgtgacccttcagggcc

SEQ ID NO: 3315289 - DNA, 16 bp, Homo sapiens
gcatctaggtaatttt

SEQ ID NO: 3315290 - DNA, 22 bp, Homo sapiens
gcatctcaaaacagagggctgc

SEQ ID NO: 3315291 - DNA, 17 bp, Homo sapiens
gcatctcagcgccagct

SEQ ID NO: 3315292 - DNA, 15 bp, Homo sapiens
gcatctcctgtgcat

SEQ ID NO: 3315293 - DNA, 16 bp, Homo sapiens
gcatctcctgtgcatg

SEQ ID NO: 3315294 - DNA, 14 bp, Homo sapiens
gcatctctgtactt

SEQ ID NO: 3315295 - DNA, 21 bp, Homo sapiens
gcatctgaatgaaaataactg

SEQ ID NO: 3315296 - DNA, 23 bp, Homo sapiens
gcatctgaatgaaaataactgaa

SEQ ID NO: 3315297 - DNA, 16 bp, Homo sapiens
gcatctgacacaaaaa

SEQ ID NO: 3315298 - DNA, 13 bp, Homo sapiens
gcatctgatagaa

SEQ ID NO: 3315299 - DNA, 14 bp, Homo sapiens
gcatctgcccctcc

SEQ ID NO: 3315300 - DNA, 18 bp, Homo sapiens
gcatctgctaataaaacc

SEQ ID NO: 3315301 - DNA, 14 bp, Homo sapiens
gcatctgtgatggg

SEQ ID NO: 3315302 - DNA, 22 bp, Homo sapiens
gcatcttatagcactttgaaat

SEQ ID NO: 3315303 - DNA, 22 bp, Homo sapiens
gcatcttgggggggtggccgct

SEQ ID NO: 3315304 - DNA, 13 bp, Homo sapiens
gcatctttgcctt

SEQ ID NO: 3315305 - DNA, 16 bp, Homo sapiens
gcatgaaattgtatct

SEQ ID NO: 3315306 - DNA, 15 bp, Homo sapiens
gcatgaataaaacac

SEQ ID NO: 3315307 - DNA, 22 bp, Homo sapiens
gcatgaataaaacactcatccc

SEQ ID NO: 3315308 - DNA, 17 bp, Homo sapiens
gcatgacctgtgaccag

SEQ ID NO: 3315309 - DNA, 22 bp, Homo sapiens
gcatgacctgtgaccagcactg

SEQ ID NO: 3315310 - DNA, 19 bp, Homo sapiens
gcatgactatgtatttttc

SEQ ID NO: 3315311 - DNA, 12 bp, Homo sapiens
gcatgaggaggt

SEQ ID NO: 3315312 - DNA, 19 bp, Homo sapiens
gcatgagggatcacagggc

SEQ ID NO: 3315313 - DNA, 20 bp, Homo sapiens
gcatgagggatcacagggcc

SEQ ID NO: 3315314 - DNA, 13 bp, Homo sapiens
gcatgatgggaaa

SEQ ID NO: 3315315 - DNA, 18 bp, Homo sapiens
gcatgatgggaaaatatt

SEQ ID NO: 3315316 - DNA, 21 bp, Homo sapiens
gcatgatgggaaaatatttcc

SEQ ID NO: 3315317 - DNA, 13 bp, Homo sapiens
gcatgatggtgag

SEQ ID NO: 3315318 - DNA, 20 bp, Homo sapiens
gcatgatgttaaccagaata

SEQ ID NO: 3315319 - DNA, 14 bp, Homo sapiens
gcatgattctttaa

SEQ ID NO: 3315320 - DNA, 14 bp, Homo sapiens
gcatgcattttgca

SEQ ID NO: 3315321 - DNA, 13 bp, Homo sapiens
gcatgccaccctc

SEQ ID NO: 3315322 - DNA, 19 bp, Homo sapiens
gcatgccccggccacctct

SEQ ID NO: 3315323 - DNA, 20 bp, Homo sapiens
gcatgccccggccacctctg

SEQ ID NO: 3315324 - DNA, 21 bp, Homo sapiens
gcatgccccggccacctctgc

SEQ ID NO: 3315325 - DNA, 23 bp, Homo sapiens
gcatgccccggccacctctgcgg

SEQ ID NO: 3315326 - DNA, 15 bp, Homo sapiens
gcatgccccttggct

SEQ ID NO: 3315327 - DNA, 11 bp, Homo sapiens
gcatgcctctg

SEQ ID NO: 3315328 - DNA, 19 bp, Homo sapiens
gcatgcctctgatatggga

SEQ ID NO: 3315329 - DNA, 13 bp, Homo sapiens
gcatgctggggca

SEQ ID NO: 3315330 - DNA, 15 bp, Homo sapiens
gcatgctggggcaag

SEQ ID NO: 3315331 - DNA, 18 bp, Homo sapiens
gcatgcttaaattttaac

SEQ ID NO: 3315332 - DNA, 14 bp, Homo sapiens
gcatgcttcccaga

SEQ ID NO: 3315333 - DNA, 15 bp, Homo sapiens
gcatgcttcccagag

SEQ ID NO: 3315334 - DNA, 15 bp, Homo sapiens
gcatgcttgggctga

SEQ ID NO: 3315335 - DNA, 14 bp, Homo sapiens
gcatgctttgctgc

SEQ ID NO: 3315336 - DNA, 16 bp, Homo sapiens
gcatggaaaaatggtt

SEQ ID NO: 3315337 - DNA, 15 bp, Homo sapiens
gcatggagaataaac

SEQ ID NO: 3315338 - DNA, 19 bp, Homo sapiens
gcatggagagcctcttagt

SEQ ID NO: 3315339 - DNA, 21 bp, Homo sapiens
gcatggagagcctcttagtga

SEQ ID NO: 3315340 - DNA, 15 bp, Homo sapiens
gcatggaggaggagg

SEQ ID NO: 3315341 - DNA, 18 bp, Homo sapiens
gcatggagtgtgtattgt

SEQ ID NO: 3315342 - DNA, 20 bp, Homo sapiens
gcatggagtgtgtattgttc

SEQ ID NO: 3315343 - DNA, 14 bp, Homo sapiens
gcatggatgcattt

SEQ ID NO: 3315344 - DNA, 15 bp, Homo sapiens
gcatggatttctgtc

SEQ ID NO: 3315345 - DNA, 13 bp, Homo sapiens
gcatggcaggctg

SEQ ID NO: 3315346 - DNA, 17 bp, Homo sapiens
gcatggccaggtggcca

SEQ ID NO: 3315347 - DNA, 22 bp, Homo sapiens
gcatggctcagatcggccacag

SEQ ID NO: 3315348 - DNA, 19 bp, Homo sapiens
gcatgggaaagccacctct

SEQ ID NO: 3315349 - DNA, 15 bp, Homo sapiens
gcatgggcgcaggcc

SEQ ID NO: 3315350 - DNA, 22 bp, Homo sapiens
gcatggggataaaggagaaggc

SEQ ID NO: 3315351 - DNA, 23 bp, Homo sapiens
gcatggggataaaggagaaggca

SEQ ID NO: 3315352 - DNA, 23 bp, Homo sapiens
gcatgggggcaccgggctccatg

SEQ ID NO: 3315353 - DNA, 20 bp, Homo sapiens
gcatgggtccaagagacatg

SEQ ID NO: 3315354 - DNA, 20 bp, Homo sapiens
gcatggtaccagccctgggg

SEQ ID NO: 3315355 - DNA, 18 bp, Homo sapiens
gcatggtcacacactgat

SEQ ID NO: 3315356 - DNA, 22 bp, Homo sapiens
gccaaccagcccgacagtgcca

SEQ ID NO: 3315357 - DNA, 22 bp, Homo sapiens
gccaacctcggcttgtgggctg

SEQ ID NO: 3315358 - DNA, 19 bp, Homo sapiens
gccaactgcaaaaaaagcc

SEQ ID NO: 3315359 - DNA, 21 bp, Homo sapiens
gccaactgcaaaaaaagcctc

SEQ ID NO: 3315360 - DNA, 22 bp, Homo sapiens
gccaactgcaaaaaaagcctcc

SEQ ID NO: 3315361 - DNA, 18 bp, Homo sapiens
gccaactgtttccctgct

SEQ ID NO: 3315362 - DNA, 21 bp, Homo sapiens
gccaacttgagggcccagagc

SEQ ID NO: 3315363 - DNA, 13 bp, Homo sapiens
gccaacttgtaaa

SEQ ID NO: 3315364 - DNA, 15 bp, Homo sapiens
gccaacttgtaaata

SEQ ID NO: 3315365 - DNA, 18 bp, Homo sapiens
gccaacttgtaaatacac

SEQ ID NO: 3315366 - DNA, 20 bp, Homo sapiens
gccaagaaaagggctgacat

SEQ ID NO: 3315367 - DNA, 13 bp, Homo sapiens
gccaagaatactt

SEQ ID NO: 3315368 - DNA, 16 bp, Homo sapiens
gccaagaatacttgaa

SEQ ID NO: 3315369 - DNA, 13 bp, Homo sapiens
gccaagacaaatc

SEQ ID NO: 3315370 - DNA, 22 bp, Homo sapiens
gccaagacaaatcaacagaagc

SEQ ID NO: 3315371 - DNA, 12 bp, Homo sapiens
gccaagacttgg

SEQ ID NO: 3315372 - DNA, 22 bp, Homo sapiens
gccaagacttggcaacagaagc

SEQ ID NO: 3315373 - DNA, 23 bp, Homo sapiens
gccaagacttggcaacagaagca

SEQ ID NO: 3315374 - DNA, 23 bp, Homo sapiens
gccaagagaaaggcctgcacaca

SEQ ID NO: 3315375 - DNA, 18 bp, Homo sapiens
gccaagatctacaggaca

SEQ ID NO: 3315376 - DNA, 19 bp, Homo sapiens
gccaagatctacaggacaa

SEQ ID NO: 3315377 - DNA, 19 bp, Homo sapiens
gccaagcaacctgggtcca

SEQ ID NO: 3315378 - DNA, 22 bp, Homo sapiens
gccaagcacctagcctcgctct

SEQ ID NO: 3315379 - DNA, 12 bp, Homo sapiens
gccaagccagat

SEQ ID NO: 3315380 - DNA, 16 bp, Homo sapiens
gccaagctccaagccc

SEQ ID NO: 3315381 - DNA, 15 bp, Homo sapiens
gccaagctccctgga

SEQ ID NO: 3315382 - DNA, 22 bp, Homo sapiens
gccaagcttgttatcagctttc

SEQ ID NO: 3315383 - DNA, 16 bp, Homo sapiens
gccaaggactgactga

SEQ ID NO: 3315384 - DNA, 17 bp, Homo sapiens
gccaaggactgactgag

SEQ ID NO: 3315385 - DNA, 18 bp, Homo sapiens
gccaaggaggcctgggga

SEQ ID NO: 3315386 - DNA, 18 bp, Homo sapiens
gccaaggccgaagctctg

SEQ ID NO: 3315387 - DNA, 19 bp, Homo sapiens
gccaaggccgaagctctgg

SEQ ID NO: 3315388 - DNA, 20 bp, Homo sapiens
gccaaggccgaagctctggc

SEQ ID NO: 3315389 - DNA, 12 bp, Homo sapiens
gccaagggaaag

SEQ ID NO: 3315390 - DNA, 19 bp, Homo sapiens
gccaagggaacctgtgtcc

SEQ ID NO: 3315391 - DNA, 14 bp, Homo sapiens
gccaaggtgccacc

SEQ ID NO: 3315392 - DNA, 18 bp, Homo sapiens
gccaaggtgggctgagcc

SEQ ID NO: 3315393 - DNA, 23 bp, Homo sapiens
gccaaggtgggctgagccctggc

SEQ ID NO: 3315394 - DNA, 23 bp, Homo sapiens
gccaaggtgggtggatcacctgt

SEQ ID NO: 3315395 - DNA, 22 bp, Homo sapiens
gccaagtataattttttgtaat

SEQ ID NO: 3315396 - DNA, 14 bp, Homo sapiens
gccaagtctcagaa

SEQ ID NO: 3315397 - DNA, 16 bp, Homo sapiens
gccaagtctcagaaga

SEQ ID NO: 3315398 - DNA, 20 bp, Homo sapiens
gccaagtggggatggggcct

SEQ ID NO: 3315399 - DNA, 13 bp, Homo sapiens
gccaagtggggtg

SEQ ID NO: 3315400 - DNA, 23 bp, Homo sapiens
gccaagtggggtgctgggaggag

SEQ ID NO: 3315401 - DNA, 19 bp, Homo sapiens
gccaagtgtgaccccactg

SEQ ID NO: 3315402 - DNA, 15 bp, Homo sapiens
gccaagttcctctag

SEQ ID NO: 3315403 - DNA, 15 bp, Homo sapiens
gccaataaaaagttc

SEQ ID NO: 3315404 - DNA, 13 bp, Homo sapiens
gccaatatgtatt

SEQ ID NO: 3315405 - DNA, 18 bp, Homo sapiens
gccaatcccctccttggg

SEQ ID NO: 3315406 - DNA, 21 bp, Homo sapiens
gccaatcccctccttgggcac

SEQ ID NO: 3315407 - DNA, 21 bp, Homo sapiens
gccaatccctcaccttctgag

SEQ ID NO: 3315408 - DNA, 16 bp, Homo sapiens
gccaatgcacggcctc

SEQ ID NO: 3315409 - DNA, 19 bp, Homo sapiens
gccaatggagactgtctca

SEQ ID NO: 3315410 - DNA, 22 bp, Homo sapiens
gccaatggaggggggtgctggc

SEQ ID NO: 3315411 - DNA, 19 bp, Homo sapiens
gccaatgttttccacccat

SEQ ID NO: 3315412 - DNA, 15 bp, Homo sapiens
gccacaaaaacaggt

SEQ ID NO: 3315413 - DNA, 20 bp, Homo sapiens
gccacaaatcaaagcaaggg

SEQ ID NO: 3315414 - DNA, 22 bp, Homo sapiens
gccacaaatcaaagcaagggct

SEQ ID NO: 3315415 - DNA, 19 bp, Homo sapiens
gccacaacagaataaagca

SEQ ID NO: 3315416 - DNA, 20 bp, Homo sapiens
gccacaacagaataaagcag

SEQ ID NO: 3315417 - DNA, 19 bp, Homo sapiens
gccacaacctgaaagacaa

SEQ ID NO: 3315418 - DNA, 23 bp, Homo sapiens
gccacaagaaatttgatttctat

SEQ ID NO: 3315419 - DNA, 14 bp, Homo sapiens
gccacacagaccac

SEQ ID NO: 3315420 - DNA, 19 bp, Homo sapiens
gccacaccatctcctttca

SEQ ID NO: 3315421 - DNA, 12 bp, Homo sapiens
gccacacccagg

SEQ ID NO: 3315422 - DNA, 21 bp, Homo sapiens
gccacactattaccatgagaa

SEQ ID NO: 3315423 - DNA, 17 bp, Homo sapiens
gccacactctccatcac

SEQ ID NO: 3315424 - DNA, 20 bp, Homo sapiens
gccacacttcaggctcttct

SEQ ID NO: 3315425 - DNA, 23 bp, Homo sapiens
gccacacttcaggctcttctcct

SEQ ID NO: 3315426 - DNA, 13 bp, Homo sapiens
gccacagacccct

SEQ ID NO: 3315427 - DNA, 20 bp, Homo sapiens
gccacagacccctgggagct

SEQ ID NO: 3315428 - DNA, 14 bp, Homo sapiens
gccacagagaaagt

SEQ ID NO: 3315429 - DNA, 20 bp, Homo sapiens
gccacagagaaagtacttct

SEQ ID NO: 3315430 - DNA, 21 bp, Homo sapiens
gccacagagaagtttgtagcc

SEQ ID NO: 3315431 - DNA, 16 bp, Homo sapiens
gccacagcttttgcaa

SEQ ID NO: 3315432 - DNA, 13 bp, Homo sapiens
gccacaggcctcc

SEQ ID NO: 3315433 - DNA, 22 bp, Homo sapiens
gccacaggcctccctgtttgaa

SEQ ID NO: 3315434 - DNA, 15 bp, Homo sapiens
gccacagtagaactg

SEQ ID NO: 3315435 - DNA, 15 bp, Homo sapiens
gccacatggagcccc

SEQ ID NO: 3315436 - DNA, 20 bp, Homo sapiens
gccacatggccccatcccag

SEQ ID NO: 3315437 - DNA, 12 bp, Homo sapiens
gccacatttaat

SEQ ID NO: 3315438 - DNA, 16 bp, Homo sapiens
gccacatttagtcctg

SEQ ID NO: 3315439 - DNA, 12 bp, Homo sapiens
gccacatttctg

SEQ ID NO: 3315440 - DNA, 18 bp, Homo sapiens
gccacatttctgatcaga

SEQ ID NO: 3315441 - DNA, 22 bp, Homo sapiens
gccacatttctgatcagaggtg

SEQ ID NO: 3315442 - DNA, 14 bp, Homo sapiens
gccacatttggaat

SEQ ID NO: 3315443 - DNA, 19 bp, Homo sapiens
gccacatttggaatacttt

SEQ ID NO: 3315444 - DNA, 16 bp, Homo sapiens
gccaccaacactgctc

SEQ ID NO: 3315445 - DNA, 12 bp, Homo sapiens
gccaccacacac

SEQ ID NO: 3315446 - DNA, 13 bp, Homo sapiens
gccaccaccctgc

SEQ ID NO: 3315447 - DNA, 14 bp, Homo sapiens
gccaccacctctgt

SEQ ID NO: 3315448 - DNA, 14 bp, Homo sapiens
gccaccacgtccag

SEQ ID NO: 3315449 - DNA, 15 bp, Homo sapiens
gccaccacgtccagc

SEQ ID NO: 3315450 - DNA, 15 bp, Homo sapiens
gccaccacgtctgcc

SEQ ID NO: 3315451 - DNA, 18 bp, Homo sapiens
gccaccacgtctgccagg

SEQ ID NO: 3315452 - DNA, 14 bp, Homo sapiens
gccaccagatgctg

SEQ ID NO: 3315453 - DNA, 23 bp, Homo sapiens
gccaccagatgctgaatccccta

SEQ ID NO: 3315454 - DNA, 14 bp, Homo sapiens
gccaccaggctggc

SEQ ID NO: 3315455 - DNA, 12 bp, Homo sapiens
gccaccatcctg

SEQ ID NO: 3315456 - DNA, 16 bp, Homo sapiens
gccaccatggccagcc

SEQ ID NO: 3315457 - DNA, 16 bp, Homo sapiens
gccaccattcctggaa

SEQ ID NO: 3315458 - DNA, 19 bp, Homo sapiens
gccacccaagcctgctggc

SEQ ID NO: 3315459 - DNA, 20 bp, Homo sapiens
gccacccaagcctgctggct

SEQ ID NO: 3315460 - DNA, 13 bp, Homo sapiens
gccaccccaaccc

SEQ ID NO: 3315461 - DNA, 19 bp, Homo sapiens
gccaccccatgtgccttta

SEQ ID NO: 3315462 - DNA, 21 bp, Homo sapiens
gccaccccgggctctctgctg

SEQ ID NO: 3315463 - DNA, 13 bp, Homo sapiens
gccacccctcccc

SEQ ID NO: 3315464 - DNA, 18 bp, Homo sapiens
gccacccgttctgctggc

SEQ ID NO: 3315465 - DNA, 22 bp, Homo sapiens
gccacccgttctgctggcctgg

SEQ ID NO: 3315466 - DNA, 23 bp, Homo sapiens
gccacccgttctgctggcctgga

SEQ ID NO: 3315467 - DNA, 19 bp, Homo sapiens
gccaccctcacacacacag

SEQ ID NO: 3315468 - DNA, 21 bp, Homo sapiens
gccaccctcacacacacagct

SEQ ID NO: 3315469 - DNA, 16 bp, Homo sapiens
gccaccgctgccagca

SEQ ID NO: 3315470 - DNA, 20 bp, Homo sapiens
gccaccggaggtcactccac

SEQ ID NO: 3315471 - DNA, 19 bp, Homo sapiens
gccacctatctcgtgggag

SEQ ID NO: 3315472 - DNA, 20 bp, Homo sapiens
gccacctatctcgtgggaga

SEQ ID NO: 3315473 - DNA, 21 bp, Homo sapiens
gccacctatctcgtgggagag

SEQ ID NO: 3315474 - DNA, 15 bp, Homo sapiens
gccacctcagggcac

SEQ ID NO: 3315475 - DNA, 15 bp, Homo sapiens
gccacctcctccccc

SEQ ID NO: 3315476 - DNA, 16 bp, Homo sapiens
gccacctcctccccct

SEQ ID NO: 3315477 - DNA, 15 bp, Homo sapiens
gccacctctccaagg

SEQ ID NO: 3315478 - DNA, 22 bp, Homo sapiens
gccacctctccaagggcttctg

SEQ ID NO: 3315479 - DNA, 11 bp, Homo sapiens
gccacctctgc

SEQ ID NO: 3315480 - DNA, 14 bp, Homo sapiens
gccacctctgcgga

SEQ ID NO: 3315481 - DNA, 10 bp, Homo sapiens
gccagccaca

SEQ ID NO: 3315482 - DNA, 20 bp, Homo sapiens
gccagccacagacccctggg

SEQ ID NO: 3315483 - DNA, 21 bp, Homo sapiens
gccagccacagacccctggga

SEQ ID NO: 3315484 - DNA, 23 bp, Homo sapiens
gccagccacagacccctgggagc

SEQ ID NO: 3315485 - DNA, 13 bp, Homo sapiens
gccagccaggcgg

SEQ ID NO: 3315486 - DNA, 18 bp, Homo sapiens
gccagccaggcgggctca

SEQ ID NO: 3315487 - DNA, 21 bp, Homo sapiens
gccagccaggcgggctcaagg

SEQ ID NO: 3315488 - DNA, 19 bp, Homo sapiens
gccagccagtcttgcctag

SEQ ID NO: 3315489 - DNA, 12 bp, Homo sapiens
gccagcccagcc

SEQ ID NO: 3315490 - DNA, 18 bp, Homo sapiens
gccagcccatggccccca

SEQ ID NO: 3315491 - DNA, 18 bp, Homo sapiens
gccagccccacacagcta

SEQ ID NO: 3315492 - DNA, 14 bp, Homo sapiens
gccagccccaccca

SEQ ID NO: 3315493 - DNA, 19 bp, Homo sapiens
gccagccccacccaggagg

SEQ ID NO: 3315494 - DNA, 20 bp, Homo sapiens
gccagccccacccccagcca

SEQ ID NO: 3315495 - DNA, 21 bp, Homo sapiens
gccagccccacccccagccag

SEQ ID NO: 3315496 - DNA, 16 bp, Homo sapiens
gccagcccctgcctgg

SEQ ID NO: 3315497 - DNA, 15 bp, Homo sapiens
gccagccctgcagcc

SEQ ID NO: 3315498 - DNA, 12 bp, Homo sapiens
gccagcccttca

SEQ ID NO: 3315499 - DNA, 17 bp, Homo sapiens
gccagcccttcctctca

SEQ ID NO: 3315500 - DNA, 21 bp, Homo sapiens
gccagcccttcctctcactcc

SEQ ID NO: 3315501 - DNA, 17 bp, Homo sapiens
gccagccgccctgggct

SEQ ID NO: 3315502 - DNA, 19 bp, Homo sapiens
gccagccgccctgggctgt

SEQ ID NO: 3315503 - DNA, 20 bp, Homo sapiens
gccagccgccctgggctgtc

SEQ ID NO: 3315504 - DNA, 20 bp, Homo sapiens
gccagcctccgagagggaga

SEQ ID NO: 3315505 - DNA, 11 bp, Homo sapiens
gccagcctggc

SEQ ID NO: 3315506 - DNA, 12 bp, Homo sapiens
gccagcctggct

SEQ ID NO: 3315507 - DNA, 17 bp, Homo sapiens
gccagcctggcttctgg

SEQ ID NO: 3315508 - DNA, 20 bp, Homo sapiens
gccagccttgagccctggct

SEQ ID NO: 3315509 - DNA, 22 bp, Homo sapiens
gccagccttgagccctggctgt

SEQ ID NO: 3315510 - DNA, 14 bp, Homo sapiens
gccagcgtcccagg

SEQ ID NO: 3315511 - DNA, 16 bp, Homo sapiens
gccagcgtcccagggt

SEQ ID NO: 3315512 - DNA, 19 bp, Homo sapiens
gccagcgtcccagggtacc

SEQ ID NO: 3315513 - DNA, 23 bp, Homo sapiens
gccagctacttcctcctccccac

SEQ ID NO: 3315514 - DNA, 13 bp, Homo sapiens
gccagctccccac

SEQ ID NO: 3315515 - DNA, 15 bp, Homo sapiens
gccagctctaccagt

SEQ ID NO: 3315516 - DNA, 13 bp, Homo sapiens
gccagctctaggc

SEQ ID NO: 3315517 - DNA, 16 bp, Homo sapiens
gccagctctagttttc

SEQ ID NO: 3315518 - DNA, 23 bp, Homo sapiens
gccagctgcctgtgcctgccatg

SEQ ID NO: 3315519 - DNA, 17 bp, Homo sapiens
gccagctgggagcactg

SEQ ID NO: 3315520 - DNA, 18 bp, Homo sapiens
gccagcttggggccacca

SEQ ID NO: 3315521 - DNA, 22 bp, Homo sapiens
gccaggaacctgtcctaaggaa

SEQ ID NO: 3315522 - DNA, 17 bp, Homo sapiens
gccaggaagtacttcca

SEQ ID NO: 3315523 - DNA, 18 bp, Homo sapiens
gccaggaccacacagtcc

SEQ ID NO: 3315524 - DNA, 23 bp, Homo sapiens
gccaggaccacacagtccccaga

SEQ ID NO: 3315525 - DNA, 15 bp, Homo sapiens
gccaggactgagccc

SEQ ID NO: 3315526 - DNA, 16 bp, Homo sapiens
gccaggactgagcccc

SEQ ID NO: 3315527 - DNA, 17 bp, Homo sapiens
gccaggactgagccccg

SEQ ID NO: 3315528 - DNA, 13 bp, Homo sapiens
gccaggagcagat

SEQ ID NO: 3315529 - DNA, 14 bp, Homo sapiens
gccaggagtctgtg

SEQ ID NO: 3315530 - DNA, 18 bp, Homo sapiens
gccaggcacagggcccgc

SEQ ID NO: 3315531 - DNA, 14 bp, Homo sapiens
gccaggcacctggc

SEQ ID NO: 3315532 - DNA, 19 bp, Homo sapiens
gccaggcacctggcctgct

SEQ ID NO: 3315533 - DNA, 20 bp, Homo sapiens
gccaggcacctggcctgctg

SEQ ID NO: 3315534 - DNA, 21 bp, Homo sapiens
gccaggcacctggcctgctgg

SEQ ID NO: 3315535 - DNA, 19 bp, Homo sapiens
gccaggcactgccttctcc

SEQ ID NO: 3315536 - DNA, 21 bp, Homo sapiens
gccaggcagatctgtgcccca

SEQ ID NO: 3315537 - DNA, 19 bp, Homo sapiens
gccaggcaggtagccaggg

SEQ ID NO: 3315538 - DNA, 12 bp, Homo sapiens
gccaggccagag

SEQ ID NO: 3315539 - DNA, 13 bp, Homo sapiens
gccaggccagcct

SEQ ID NO: 3315540 - DNA, 19 bp, Homo sapiens
gccaggccagcctccgaga

SEQ ID NO: 3315541 - DNA, 17 bp, Homo sapiens
gccaggccaggaccaca

SEQ ID NO: 3315542 - DNA, 20 bp, Homo sapiens
gccaggccaggaccacacag

SEQ ID NO: 3315543 - DNA, 23 bp, Homo sapiens
gccaggccaggaccacacagtcc

SEQ ID NO: 3315544 - DNA, 11 bp, Homo sapiens
gccaggcccag

SEQ ID NO: 3315545 - DNA, 13 bp, Homo sapiens
gccaggcccaggc

SEQ ID NO: 3315546 - DNA, 15 bp, Homo sapiens
gccaggcccaggcag

SEQ ID NO: 3315547 - DNA, 17 bp, Homo sapiens
gccaggcccaggcagag

SEQ ID NO: 3315548 - DNA, 21 bp, Homo sapiens
gccaggcctcttggcagtcac

SEQ ID NO: 3315549 - DNA, 21 bp, Homo sapiens
gccaggcctgggtctgtgtct

SEQ ID NO: 3315550 - DNA, 21 bp, Homo sapiens
gccaggcgttggtgccacttc

SEQ ID NO: 3315551 - DNA, 13 bp, Homo sapiens
gccaggctggtct

SEQ ID NO: 3315552 - DNA, 23 bp, Homo sapiens
gccagggcagggccaccccactc

SEQ ID NO: 3315553 - DNA, 18 bp, Homo sapiens
gccagggcagtgctagtg

SEQ ID NO: 3315554 - DNA, 14 bp, Homo sapiens
gccagggcatgtgt

SEQ ID NO: 3315555 - DNA, 20 bp, Homo sapiens
gccagggccacgctccagct

SEQ ID NO: 3315556 - DNA, 22 bp, Homo sapiens
gccagggccacgctccagctgc

SEQ ID NO: 3315557 - DNA, 10 bp, Homo sapiens
gccagggctt

SEQ ID NO: 3315558 - DNA, 12 bp, Homo sapiens
gccagggcttcc

SEQ ID NO: 3315559 - DNA, 19 bp, Homo sapiens
gccagggggactagcccct

SEQ ID NO: 3315560 - DNA, 20 bp, Homo sapiens
gccagggtctctccctcagg

SEQ ID NO: 3315561 - DNA, 19 bp, Homo sapiens
gccagggtctgtgtgaatg

SEQ ID NO: 3315562 - DNA, 21 bp, Homo sapiens
gccagggtctgtgtgaatgtg

SEQ ID NO: 3315563 - DNA, 20 bp, Homo sapiens
gccaggtacaggagaggcag

SEQ ID NO: 3315564 - DNA, 21 bp, Homo sapiens
gccaggtacaggagaggcagc

SEQ ID NO: 3315565 - DNA, 22 bp, Homo sapiens
gccaggtacaggagaggcagca

SEQ ID NO: 3315566 - DNA, 16 bp, Homo sapiens
gccaggtgaggtccac

SEQ ID NO: 3315567 - DNA, 22 bp, Homo sapiens
gccaggttcacactcagaaaga

SEQ ID NO: 3315568 - DNA, 22 bp, Homo sapiens
gccaggtttctgcccacattgg

SEQ ID NO: 3315569 - DNA, 19 bp, Homo sapiens
gccaggttttctgggtgtc

SEQ ID NO: 3315570 - DNA, 19 bp, Homo sapiens
gccagtaacgcgtcttcct

SEQ ID NO: 3315571 - DNA, 15 bp, Homo sapiens
gccagtaatctttat

SEQ ID NO: 3315572 - DNA, 23 bp, Homo sapiens
gccagtatctatatatgtgtatg

SEQ ID NO: 3315573 - DNA, 17 bp, Homo sapiens
gccagtatttttaaagg

SEQ ID NO: 3315574 - DNA, 17 bp, Homo sapiens
gccagtcaagaagaaaa

SEQ ID NO: 3315575 - DNA, 21 bp, Homo sapiens
gccagtccaggctgccgtggg

SEQ ID NO: 3315576 - DNA, 18 bp, Homo sapiens
gccagtcctcctgggagc

SEQ ID NO: 3315577 - DNA, 19 bp, Homo sapiens
gccagtcctcctgggagcc

SEQ ID NO: 3315578 - DNA, 16 bp, Homo sapiens
gccagtcctgcaggag

SEQ ID NO: 3315579 - DNA, 20 bp, Homo sapiens
gccagtcctgcctggccagg

SEQ ID NO: 3315580 - DNA, 14 bp, Homo sapiens
gccagtctcccagg

SEQ ID NO: 3315581 - DNA, 15 bp, Homo sapiens
gccagtctcccaggc

SEQ ID NO: 3315582 - DNA, 15 bp, Homo sapiens
gccagtctgggctgc

SEQ ID NO: 3315583 - DNA, 20 bp, Homo sapiens
gccagtctgtggatcagaga

SEQ ID NO: 3315584 - DNA, 13 bp, Homo sapiens
gccagtgacagac

SEQ ID NO: 3315585 - DNA, 14 bp, Homo sapiens
gccagtgacagaca

SEQ ID NO: 3315586 - DNA, 14 bp, Homo sapiens
gccagtggaagaaa

SEQ ID NO: 3315587 - DNA, 16 bp, Homo sapiens
gccagtggaagaaaca

SEQ ID NO: 3315588 - DNA, 12 bp, Homo sapiens
gccagtggatcc

SEQ ID NO: 3315589 - DNA, 17 bp, Homo sapiens
gccagtggatcccctgc

SEQ ID NO: 3315590 - DNA, 21 bp, Homo sapiens
gccagtggggatgaggtcacc

SEQ ID NO: 3315591 - DNA, 15 bp, Homo sapiens
gccagtggggcctgt

SEQ ID NO: 3315592 - DNA, 16 bp, Homo sapiens
gccagtggggcctgtg

SEQ ID NO: 3315593 - DNA, 17 bp, Homo sapiens
gccagtgtaatccccca

SEQ ID NO: 3315594 - DNA, 22 bp, Homo sapiens
gccagtgtctgtcccggggtcc

SEQ ID NO: 3315595 - DNA, 18 bp, Homo sapiens
gccagtgtctttctttgg

SEQ ID NO: 3315596 - DNA, 15 bp, Homo sapiens
gccagttgcccagag

SEQ ID NO: 3315597 - DNA, 14 bp, Homo sapiens
gccagttggaacca

SEQ ID NO: 3315598 - DNA, 18 bp, Homo sapiens
gccagttggtggggccag

SEQ ID NO: 3315599 - DNA, 20 bp, Homo sapiens
gccagttggtggggccaggc

SEQ ID NO: 3315600 - DNA, 20 bp, Homo sapiens
gccataaaagcattgtctct

SEQ ID NO: 3315601 - DNA, 20 bp, Homo sapiens
gccataaacggttcctggtg

SEQ ID NO: 3315602 - DNA, 21 bp, Homo sapiens
gccataaacggttcctggtga

SEQ ID NO: 3315603 - DNA, 20 bp, Homo sapiens
gccataataataatttgcac

SEQ ID NO: 3315604 - DNA, 18 bp, Homo sapiens
gccatataagtttgaagg

SEQ ID NO: 3315605 - DNA, 22 bp, Homo sapiens
gccatataagtttgaaggaaac

SEQ ID NO: 3315606 - DNA, 20 bp, Homo sapiens
aaaccttttttaagattttt

SEQ ID NO: 3315607 - DNA, 22 bp, Homo sapiens
aaaccttttttaagatttttct

SEQ ID NO: 3315608 - DNA, 23 bp, Homo sapiens
aaaccttttttaagatttttctc

SEQ ID NO: 3315609 - DNA, 14 bp, Homo sapiens
aaacgcaattttac

SEQ ID NO: 3315610 - DNA, 21 bp, Homo sapiens
aaacgctacctctctgtccct

SEQ ID NO: 3315611 - DNA, 19 bp, Homo sapiens
aaacggttcagtttcttct

SEQ ID NO: 3315612 - DNA, 15 bp, Homo sapiens
aaacggttcctggtg

SEQ ID NO: 3315613 - DNA, 17 bp, Homo sapiens
aaacggttcctggtgac

SEQ ID NO: 3315614 - DNA, 19 bp, Homo sapiens
aaactaaaaaaaaaaaggc

SEQ ID NO: 3315615 - DNA, 14 bp, Homo sapiens
aaactaaataatga

SEQ ID NO: 3315616 - DNA, 17 bp, Homo sapiens
aaactaaatctctaata

SEQ ID NO: 3315617 - DNA, 20 bp, Homo sapiens
aaactaaattgtaaactcct

SEQ ID NO: 3315618 - DNA, 15 bp, Homo sapiens
aaactaacagataag

SEQ ID NO: 3315619 - DNA, 20 bp, Homo sapiens
aaactaacagataagcaaga

SEQ ID NO: 3315620 - DNA, 16 bp, Homo sapiens
aaactaagattctttt

SEQ ID NO: 3315621 - DNA, 22 bp, Homo sapiens
aaactacacatccctaatgtgt

SEQ ID NO: 3315622 - DNA, 13 bp, Homo sapiens
aaactactaattt

SEQ ID NO: 3315623 - DNA, 15 bp, Homo sapiens
aaactaggtaaaatt

SEQ ID NO: 3315624 - DNA, 14 bp, Homo sapiens
aaactaggtaatgt

SEQ ID NO: 3315625 - DNA, 23 bp, Homo sapiens
aaactatctgtatttattatttg

SEQ ID NO: 3315626 - DNA, 16 bp, Homo sapiens
aaactatgtgtttttc

SEQ ID NO: 3315627 - DNA, 17 bp, Homo sapiens
aaactatgtgtttttct

SEQ ID NO: 3315628 - DNA, 11 bp, Homo sapiens
aaactatttat

SEQ ID NO: 3315629 - DNA, 13 bp, Homo sapiens
aaactatttatct

SEQ ID NO: 3315630 - DNA, 22 bp, Homo sapiens
aaactatttatctgtgtttttg

SEQ ID NO: 3315631 - DNA, 18 bp, Homo sapiens
aaactcaaaaccatctct

SEQ ID NO: 3315632 - DNA, 19 bp, Homo sapiens
aaactcaaaacttaacata

SEQ ID NO: 3315633 - DNA, 15 bp, Homo sapiens
aaactcacaaatgat

SEQ ID NO: 3315634 - DNA, 16 bp, Homo sapiens
aaactcaccatgtaaa

SEQ ID NO: 3315635 - DNA, 15 bp, Homo sapiens
aaactcactgctcaa

SEQ ID NO: 3315636 - DNA, 20 bp, Homo sapiens
aaactcactgctcaagaaga

SEQ ID NO: 3315637 - DNA, 13 bp, Homo sapiens
aaactcagggaca

SEQ ID NO: 3315638 - DNA, 17 bp, Homo sapiens
aaactcattgcagcaga

SEQ ID NO: 3315639 - DNA, 19 bp, Homo sapiens
aaactcattgcagcagata

SEQ ID NO: 3315640 - DNA, 12 bp, Homo sapiens
aaactccaaagt

SEQ ID NO: 3315641 - DNA, 15 bp, Homo sapiens
aaactccaaagtcca

SEQ ID NO: 3315642 - DNA, 14 bp, Homo sapiens
aaactccgaagaaa

SEQ ID NO: 3315643 - DNA, 20 bp, Homo sapiens
aaactctaaacattaatcaa

SEQ ID NO: 3315644 - DNA, 14 bp, Homo sapiens
aaactctgccagcc

SEQ ID NO: 3315645 - DNA, 17 bp, Homo sapiens
aaactcttaatctgtgt

SEQ ID NO: 3315646 - DNA, 15 bp, Homo sapiens
aaactcttatctcag

SEQ ID NO: 3315647 - DNA, 16 bp, Homo sapiens
aaactcttatctcagt

SEQ ID NO: 3315648 - DNA, 12 bp, Homo sapiens
aaactcttcagt

SEQ ID NO: 3315649 - DNA, 13 bp, Homo sapiens
aaactcttcagtg

SEQ ID NO: 3315650 - DNA, 14 bp, Homo sapiens
aaactgaaaatcta

SEQ ID NO: 3315651 - DNA, 19 bp, Homo sapiens
aaactgaaaatctaatatt

SEQ ID NO: 3315652 - DNA, 13 bp, Homo sapiens
aaactgaaccaca

SEQ ID NO: 3315653 - DNA, 14 bp, Homo sapiens
aaactgaatggaag

SEQ ID NO: 3315654 - DNA, 18 bp, Homo sapiens
aaactgagcctcacttgc

SEQ ID NO: 3315655 - DNA, 13 bp, Homo sapiens
aaactgatttctt

SEQ ID NO: 3315656 - DNA, 17 bp, Homo sapiens
aaactgcaatagagact

SEQ ID NO: 3315657 - DNA, 21 bp, Homo sapiens
aaactgcaatagagactgtag

SEQ ID NO: 3315658 - DNA, 17 bp, Homo sapiens
aaactgcacagtgctgt

SEQ ID NO: 3315659 - DNA, 15 bp, Homo sapiens
aaactgcacttttag

SEQ ID NO: 3315660 - DNA, 16 bp, Homo sapiens
aaactgcatgaaaaat

SEQ ID NO: 3315661 - DNA, 17 bp, Homo sapiens
aaactgcctgaaagcaa

SEQ ID NO: 3315662 - DNA, 15 bp, Homo sapiens
aaactgctaaattct

SEQ ID NO: 3315663 - DNA, 21 bp, Homo sapiens
aaactgctggacgtctttctt

SEQ ID NO: 3315664 - DNA, 22 bp, Homo sapiens
aaactgcttcccttactttgct

SEQ ID NO: 3315665 - DNA, 15 bp, Homo sapiens
aaactggagtctgga

SEQ ID NO: 3315666 - DNA, 21 bp, Homo sapiens
aaactggattaaaacaatttt

SEQ ID NO: 3315667 - DNA, 22 bp, Homo sapiens
aaactggattaaaacaattttt

SEQ ID NO: 3315668 - DNA, 20 bp, Homo sapiens
aaactggcatctgacacaaa

SEQ ID NO: 3315669 - DNA, 21 bp, Homo sapiens
aaactggctggcccagagttt

SEQ ID NO: 3315670 - DNA, 19 bp, Homo sapiens
aaactgggataactgattt

SEQ ID NO: 3315671 - DNA, 21 bp, Homo sapiens
aaactgggataactgatttct

SEQ ID NO: 3315672 - DNA, 21 bp, Homo sapiens
aaactggttttaagtgctttc

SEQ ID NO: 3315673 - DNA, 20 bp, Homo sapiens
aaactgtaaataaaatgtgt

SEQ ID NO: 3315674 - DNA, 21 bp, Homo sapiens
aaactgtaaataaaatgtgta

SEQ ID NO: 3315675 - DNA, 23 bp, Homo sapiens
aaactgtaaataaaatgtgtaca

SEQ ID NO: 3315676 - DNA, 16 bp, Homo sapiens
aaactgtacatttaaa

SEQ ID NO: 3315677 - DNA, 17 bp, Homo sapiens
aaactgtacatttaaaa

SEQ ID NO: 3315678 - DNA, 19 bp, Homo sapiens
aaactgtattaaatcttaa

SEQ ID NO: 3315679 - DNA, 14 bp, Homo sapiens
aaactgtcactgtt

SEQ ID NO: 3315680 - DNA, 20 bp, Homo sapiens
aaactgtctttaaaagagag

SEQ ID NO: 3315681 - DNA, 14 bp, Homo sapiens
aaactgtgcaatcc

SEQ ID NO: 3315682 - DNA, 19 bp, Homo sapiens
aaactgtgtattccaagac

SEQ ID NO: 3315683 - DNA, 14 bp, Homo sapiens
aaactgtgttgcca

SEQ ID NO: 3315684 - DNA, 17 bp, Homo sapiens
aaactgtgttgccacag

SEQ ID NO: 3315685 - DNA, 21 bp, Homo sapiens
aaactgttacctaaagtattt

SEQ ID NO: 3315686 - DNA, 14 bp, Homo sapiens
aaactgttctctat

SEQ ID NO: 3315687 - DNA, 23 bp, Homo sapiens
aaactgttctctattagacttta

SEQ ID NO: 3315688 - DNA, 12 bp, Homo sapiens
aaactgttcttt

SEQ ID NO: 3315689 - DNA, 14 bp, Homo sapiens
aaactgtttatata

SEQ ID NO: 3315690 - DNA, 23 bp, Homo sapiens
aaactgtttcagattttttattt

SEQ ID NO: 3315691 - DNA, 20 bp, Homo sapiens
aaactgttttagacctataa

SEQ ID NO: 3315692 - DNA, 21 bp, Homo sapiens
aaacttaaaagtattcataca

SEQ ID NO: 3315693 - DNA, 15 bp, Homo sapiens
aaacttaagatattt

SEQ ID NO: 3315694 - DNA, 13 bp, Homo sapiens
aaacttaagatga

SEQ ID NO: 3315695 - DNA, 14 bp, Homo sapiens
aaacttaagatgaa

SEQ ID NO: 3315696 - DNA, 20 bp, Homo sapiens
aaacttataaatcatattga

SEQ ID NO: 3315697 - DNA, 13 bp, Homo sapiens
aaacttatgctag

SEQ ID NO: 3315698 - DNA, 18 bp, Homo sapiens
aaacttatgctagtttat

SEQ ID NO: 3315699 - DNA, 12 bp, Homo sapiens
aaacttcaaagc

SEQ ID NO: 3315700 - DNA, 15 bp, Homo sapiens
aaacttcaaagctga

SEQ ID NO: 3315701 - DNA, 17 bp, Homo sapiens
aaacttcaaagctgaat

SEQ ID NO: 3315702 - DNA, 18 bp, Homo sapiens
aaacttcaaagctgaata

SEQ ID NO: 3315703 - DNA, 15 bp, Homo sapiens
aaacttcatgtaact

SEQ ID NO: 3315704 - DNA, 17 bp, Homo sapiens
aaacttccaaagaaagt

SEQ ID NO: 3315705 - DNA, 20 bp, Homo sapiens
aaacttccacaagagtgaat

SEQ ID NO: 3315706 - DNA, 23 bp, Homo sapiens
aaacttcttgtcagacataaagc

SEQ ID NO: 3315707 - DNA, 14 bp, Homo sapiens
aaacttgaaaatat

SEQ ID NO: 3315708 - DNA, 15 bp, Homo sapiens
aaacttgaagcagtc

SEQ ID NO: 3315709 - DNA, 22 bp, Homo sapiens
aaacttgatgtgttatctctta

SEQ ID NO: 3315710 - DNA, 18 bp, Homo sapiens
aaacttgctttatgcctt

SEQ ID NO: 3315711 - DNA, 17 bp, Homo sapiens
aaacttggatacttgga

SEQ ID NO: 3315712 - DNA, 20 bp, Homo sapiens
aaacttggatacttggattt

SEQ ID NO: 3315713 - DNA, 12 bp, Homo sapiens
aaacttgtaaat

SEQ ID NO: 3315714 - DNA, 13 bp, Homo sapiens
aaacttgtgaatg

SEQ ID NO: 3315715 - DNA, 22 bp, Homo sapiens
aaacttgttattgtgaatgatt

SEQ ID NO: 3315716 - DNA, 14 bp, Homo sapiens
aaacttgttcattt

SEQ ID NO: 3315717 - DNA, 20 bp, Homo sapiens
aaacttgtttgctgtgaaca

SEQ ID NO: 3315718 - DNA, 21 bp, Homo sapiens
aaactttaaaaaatatttatt

SEQ ID NO: 3315719 - DNA, 14 bp, Homo sapiens
aaactttaaacctg

SEQ ID NO: 3315720 - DNA, 18 bp, Homo sapiens
aaactttagggtaaaaat

SEQ ID NO: 3315721 - DNA, 24 bp, Homo sapiens
aaactttaggtttttttaatgata

SEQ ID NO: 3315722 - DNA, 11 bp, Homo sapiens
aaactttattg

SEQ ID NO: 3315723 - DNA, 19 bp, Homo sapiens
aaactttattgggttttta

SEQ ID NO: 3315724 - DNA, 20 bp, Homo sapiens
aaactttatttgtaaaccat

SEQ ID NO: 3315725 - DNA, 17 bp, Homo sapiens
aaactttgggaaaacat

SEQ ID NO: 3315726 - DNA, 13 bp, Homo sapiens
aaacttttaactg

SEQ ID NO: 3315727 - DNA, 16 bp, Homo sapiens
aaacttttaattcatt

SEQ ID NO: 3315728 - DNA, 16 bp, Homo sapiens
aaacttttttatatct

SEQ ID NO: 3315729 - DNA, 17 bp, Homo sapiens
aaacttttttatatctt

SEQ ID NO: 3315730 - DNA, 17 bp, Homo sapiens
aaactttttttcaatgt

SEQ ID NO: 3315731 - DNA, 18 bp, Homo sapiens
aaactttttttcaatgtg

SEQ ID NO: 3315732 - DNA, 22 bp, Homo sapiens
aaagcacttggactcttgctct

SEQ ID NO: 3315733 - DNA, 18 bp, Homo sapiens
aaagcacttttgttattc

SEQ ID NO: 3315734 - DNA, 14 bp, Homo sapiens
aaagcactttttgg

SEQ ID NO: 3315735 - DNA, 20 bp, Homo sapiens
aaagcagcagctaggactga

SEQ ID NO: 3315736 - DNA, 21 bp, Homo sapiens
aaagcagcagctaggactgag

SEQ ID NO: 3315737 - DNA, 13 bp, Homo sapiens
aaagcagcatctg

SEQ ID NO: 3315738 - DNA, 22 bp, Homo sapiens
aaagcaggcttgcccagtacat

SEQ ID NO: 3315739 - DNA, 24 bp, Homo sapiens
aaagcaggcttgcccagtacattt

SEQ ID NO: 3315740 - DNA, 18 bp, Homo sapiens
aaagcagggaatttctat

SEQ ID NO: 3315741 - DNA, 19 bp, Homo sapiens
aaagcagggcagcagggaa

SEQ ID NO: 3315742 - DNA, 18 bp, Homo sapiens
aaagcataaaaacatttt

SEQ ID NO: 3315743 - DNA, 15 bp, Homo sapiens
aaagcataaatgcaa

SEQ ID NO: 3315744 - DNA, 17 bp, Homo sapiens
aaagcatacatgcaaaa

SEQ ID NO: 3315745 - DNA, 13 bp, Homo sapiens
aaagcatccatgt

SEQ ID NO: 3315746 - DNA, 20 bp, Homo sapiens
aaagcatgatgggaaaatat

SEQ ID NO: 3315747 - DNA, 23 bp, Homo sapiens
aaagcatgatgggaaaatatttc

SEQ ID NO: 3315748 - DNA, 18 bp, Homo sapiens
aaagcatggacatttaga

SEQ ID NO: 3315749 - DNA, 15 bp, Homo sapiens
aaagcattctttaac

SEQ ID NO: 3315750 - DNA, 14 bp, Homo sapiens
aaagcattgtctct

SEQ ID NO: 3315751 - DNA, 12 bp, Homo sapiens
aaagcatttata

SEQ ID NO: 3315752 - DNA, 12 bp, Homo sapiens
aaagcattttca

SEQ ID NO: 3315753 - DNA, 15 bp, Homo sapiens
aaagccaaacaaaac

SEQ ID NO: 3315754 - DNA, 16 bp, Homo sapiens
aaagccaaacaaaact

SEQ ID NO: 3315755 - DNA, 23 bp, Homo sapiens
aaagccaacagtcaaaacagaga

SEQ ID NO: 3315756 - DNA, 20 bp, Homo sapiens
aaagccaaccttcaaagaaa

SEQ ID NO: 3315757 - DNA, 19 bp, Homo sapiens
aaagccacaaggctggcca

SEQ ID NO: 3315758 - DNA, 18 bp, Homo sapiens
aaagccacattatttcta

SEQ ID NO: 3315759 - DNA, 18 bp, Homo sapiens
aaagccacctctgtcatt

SEQ ID NO: 3315760 - DNA, 16 bp, Homo sapiens
aaagccactagactct

SEQ ID NO: 3315761 - DNA, 19 bp, Homo sapiens
aaagccagctgccgaccag

SEQ ID NO: 3315762 - DNA, 13 bp, Homo sapiens
aaagccagggtct

SEQ ID NO: 3315763 - DNA, 19 bp, Homo sapiens
aaagccatcatgccttgat

SEQ ID NO: 3315764 - DNA, 23 bp, Homo sapiens
aaagcccttccatgtcgcctctg

SEQ ID NO: 3315765 - DNA, 13 bp, Homo sapiens
aaagcctcaacca

SEQ ID NO: 3315766 - DNA, 16 bp, Homo sapiens
aaagcctctgctgcca

SEQ ID NO: 3315767 - DNA, 13 bp, Homo sapiens
aaagcctgctcaa

SEQ ID NO: 3315768 - DNA, 17 bp, Homo sapiens
aaagcctgtaagcctgc

SEQ ID NO: 3315769 - DNA, 22 bp, Homo sapiens
aaagcctgtaagcctgcaagcc

SEQ ID NO: 3315770 - DNA, 19 bp, Homo sapiens
aaagccttgtgtatatttg

SEQ ID NO: 3315771 - DNA, 22 bp, Homo sapiens
aaagccttgtgtatatttgtat

SEQ ID NO: 3315772 - DNA, 23 bp, Homo sapiens
aaagccttgtgtatatttgtata

SEQ ID NO: 3315773 - DNA, 17 bp, Homo sapiens
aaagccttgttttctct

SEQ ID NO: 3315774 - DNA, 17 bp, Homo sapiens
aaagcgatatacagatg

SEQ ID NO: 3315775 - DNA, 15 bp, Homo sapiens
aaagcggtccctgtc

SEQ ID NO: 3315776 - DNA, 14 bp, Homo sapiens
aaagcgtctttaag

SEQ ID NO: 3315777 - DNA, 19 bp, Homo sapiens
aaagcgtctttaagagact

SEQ ID NO: 3315778 - DNA, 17 bp, Homo sapiens
aaagctaaaatgatttt

SEQ ID NO: 3315779 - DNA, 16 bp, Homo sapiens
aaagctaggcctggcc

SEQ ID NO: 3315780 - DNA, 18 bp, Homo sapiens
aaagctaggcctggccag

SEQ ID NO: 3315781 - DNA, 14 bp, Homo sapiens
aaagctatgttaca

SEQ ID NO: 3315782 - DNA, 22 bp, Homo sapiens
aaagctattagccaggatcatg

SEQ ID NO: 3315783 - DNA, 24 bp, Homo sapiens
aaagctcactgctgatcgtagaaa

SEQ ID NO: 3315784 - DNA, 20 bp, Homo sapiens
aaagctcatgcatttcaagc

SEQ ID NO: 3315785 - DNA, 19 bp, Homo sapiens
aaagctgattactgtcaat

SEQ ID NO: 3315786 - DNA, 15 bp, Homo sapiens
aaagctgcctgtagt

SEQ ID NO: 3315787 - DNA, 16 bp, Homo sapiens
aaagctgctaaatctc

SEQ ID NO: 3315788 - DNA, 23 bp, Homo sapiens
aaagctggaacatttgatatttt

SEQ ID NO: 3315789 - DNA, 14 bp, Homo sapiens
aaagctggccctgc

SEQ ID NO: 3315790 - DNA, 14 bp, Homo sapiens
aaagctgttaaact

SEQ ID NO: 3315791 - DNA, 23 bp, Homo sapiens
aaagctgttaaactgttagcact

SEQ ID NO: 3315792 - DNA, 14 bp, Homo sapiens
aaagctgttccttg

SEQ ID NO: 3315793 - DNA, 16 bp, Homo sapiens
aaagcttcacagtacc

SEQ ID NO: 3315794 - DNA, 21 bp, Homo sapiens
aaagcttctatcccaggaggt

SEQ ID NO: 3315795 - DNA, 15 bp, Homo sapiens
aaagcttgaaaagat

SEQ ID NO: 3315796 - DNA, 20 bp, Homo sapiens
aaagcttgaagatcgttagt

SEQ ID NO: 3315797 - DNA, 23 bp, Homo sapiens
aaagcttgtggccccttttactt

SEQ ID NO: 3315798 - DNA, 15 bp, Homo sapiens
aaagcttgttaagat

SEQ ID NO: 3315799 - DNA, 12 bp, Homo sapiens
aaagctttcctg

SEQ ID NO: 3315800 - DNA, 14 bp, Homo sapiens
aaagctttcctgcc

SEQ ID NO: 3315801 - DNA, 23 bp, Homo sapiens
aaagctttcctgtttccagggtc

SEQ ID NO: 3315802 - DNA, 13 bp, Homo sapiens
aaagctttgctac

SEQ ID NO: 3315803 - DNA, 16 bp, Homo sapiens
aaagctttggacaagt

SEQ ID NO: 3315804 - DNA, 14 bp, Homo sapiens
aaaggaaaaataat

SEQ ID NO: 3315805 - DNA, 15 bp, Homo sapiens
aaaggaaaaataatc

SEQ ID NO: 3315806 - DNA, 13 bp, Homo sapiens
aaaggaaaagaaa

SEQ ID NO: 3315807 - DNA, 18 bp, Homo sapiens
aaaggaaaatagtaatgt

SEQ ID NO: 3315808 - DNA, 12 bp, Homo sapiens
aaaggaaatttg

SEQ ID NO: 3315809 - DNA, 16 bp, Homo sapiens
aaaggaacatttaggg

SEQ ID NO: 3315810 - DNA, 19 bp, Homo sapiens
aaaggaagagctaataaat

SEQ ID NO: 3315811 - DNA, 18 bp, Homo sapiens
aaaggaagtgccccctcc

SEQ ID NO: 3315812 - DNA, 24 bp, Homo sapiens
aaaggacaggaggaggagatggcc

SEQ ID NO: 3315813 - DNA, 12 bp, Homo sapiens
aaaggagaaaaa

SEQ ID NO: 3315814 - DNA, 18 bp, Homo sapiens
aaaggagaaaaaaaacct

SEQ ID NO: 3315815 - DNA, 20 bp, Homo sapiens
aaaggagacaagttccatgg

SEQ ID NO: 3315816 - DNA, 16 bp, Homo sapiens
aaaggaggcatgcctc

SEQ ID NO: 3315817 - DNA, 13 bp, Homo sapiens
aaaggaggctggc

SEQ ID NO: 3315818 - DNA, 14 bp, Homo sapiens
aaaggataactctg

SEQ ID NO: 3315819 - DNA, 19 bp, Homo sapiens
aaaggatatttaagaaaat

SEQ ID NO: 3315820 - DNA, 21 bp, Homo sapiens
aaaggatatttaagaaaatac

SEQ ID NO: 3315821 - DNA, 12 bp, Homo sapiens
aaaggatatttt

SEQ ID NO: 3315822 - DNA, 15 bp, Homo sapiens
aaaggatgaagaaca

SEQ ID NO: 3315823 - DNA, 19 bp, Homo sapiens
aaaggatgaagaacacagc

SEQ ID NO: 3315824 - DNA, 12 bp, Homo sapiens
aaaggatgtgat

SEQ ID NO: 3315825 - DNA, 17 bp, Homo sapiens
aaaggatgtgatatata

SEQ ID NO: 3315826 - DNA, 13 bp, Homo sapiens
aaaggatgtgatt

SEQ ID NO: 3315827 - DNA, 16 bp, Homo sapiens
aaaggattttaccaaa

SEQ ID NO: 3315828 - DNA, 20 bp, Homo sapiens
aaaggattttaccaaagcat

SEQ ID NO: 3315829 - DNA, 16 bp, Homo sapiens
aaaggcaaatgtgtac

SEQ ID NO: 3315830 - DNA, 23 bp, Homo sapiens
aaaggcagctcacccctgggcag

SEQ ID NO: 3315831 - DNA, 16 bp, Homo sapiens
aaaggcagctgcctct

SEQ ID NO: 3315832 - DNA, 22 bp, Homo sapiens
aaaggcagctgcctctgctccc

SEQ ID NO: 3315833 - DNA, 14 bp, Homo sapiens
aaaggcagttttct

SEQ ID NO: 3315834 - DNA, 15 bp, Homo sapiens
aaaggccaaagataa

SEQ ID NO: 3315835 - DNA, 19 bp, Homo sapiens
aaaggccagtggaagaaac

SEQ ID NO: 3315836 - DNA, 16 bp, Homo sapiens
aaaggcccagccccta

SEQ ID NO: 3315837 - DNA, 21 bp, Homo sapiens
aaaggcctcctcccccacccc

SEQ ID NO: 3315838 - DNA, 21 bp, Homo sapiens
aaaggcctcttgtaaagactg

SEQ ID NO: 3315839 - DNA, 15 bp, Homo sapiens
aaaggcctgcacaca

SEQ ID NO: 3315840 - DNA, 11 bp, Homo sapiens
aaaggcctgga

SEQ ID NO: 3315841 - DNA, 19 bp, Homo sapiens
aaaggctagtttattttgt

SEQ ID NO: 3315842 - DNA, 21 bp, Homo sapiens
aaaggctcagtctcaggagca

SEQ ID NO: 3315843 - DNA, 16 bp, Homo sapiens
aaaggcttgaagctgt

SEQ ID NO: 3315844 - DNA, 16 bp, Homo sapiens
aaagggaaaagggaga

SEQ ID NO: 3315845 - DNA, 22 bp, Homo sapiens
aaagggacttggaagctccgct

SEQ ID NO: 3315846 - DNA, 15 bp, Homo sapiens
aaagggagaaggaag

SEQ ID NO: 3315847 - DNA, 12 bp, Homo sapiens
aaagggcactta

SEQ ID NO: 3315848 - DNA, 17 bp, Homo sapiens
aaagggcacttaatttg

SEQ ID NO: 3315849 - DNA, 17 bp, Homo sapiens
aaagggctatggcaagg

SEQ ID NO: 3315850 - DNA, 16 bp, Homo sapiens
aaaggggacaggcctc

SEQ ID NO: 3315851 - DNA, 14 bp, Homo sapiens
aaaggggagagcct

SEQ ID NO: 3315852 - DNA, 21 bp, Homo sapiens
aaaggggcccaagccccatct

SEQ ID NO: 3315853 - DNA, 13 bp, Homo sapiens
aaaggggctgctg

SEQ ID NO: 3315854 - DNA, 14 bp, Homo sapiens
aaaggggctgctgg

SEQ ID NO: 3315855 - DNA, 15 bp, Homo sapiens
aaaggggctgctggg

SEQ ID NO: 3315856 - DNA, 19 bp, Homo sapiens
aaaggggctgctggggcat

SEQ ID NO: 3315857 - DNA, 15 bp, Homo sapiens
aaaggggtgctttta

SEQ ID NO: 3315858 - DNA, 22 bp, Homo sapiens
aaaggggttggggtgacagtca

SEQ ID NO: 3315859 - DNA, 20 bp, Homo sapiens
aaagggttgaaaatgtgttt

SEQ ID NO: 3315860 - DNA, 23 bp, Homo sapiens
aaagggttgaaaatgtgtttgct

SEQ ID NO: 3315861 - DNA, 15 bp, Homo sapiens
aaaggtataattaaa

SEQ ID NO: 3315862 - DNA, 14 bp, Homo sapiens
aaaggtataatttt

SEQ ID NO: 3315863 - DNA, 18 bp, Homo sapiens
aaaggtattttgaatacc

SEQ ID NO: 3315864 - DNA, 14 bp, Homo sapiens
aaaggtcaataagg

SEQ ID NO: 3315865 - DNA, 20 bp, Homo sapiens
aaaggtccacaggtctagac

SEQ ID NO: 3315866 - DNA, 15 bp, Homo sapiens
aaaggtcctgccctc

SEQ ID NO: 3315867 - DNA, 21 bp, Homo sapiens
aaaggtgagtttgagctgcct

SEQ ID NO: 3315868 - DNA, 22 bp, Homo sapiens
aaaggtgagtttgagctgcctt

SEQ ID NO: 3315869 - DNA, 16 bp, Homo sapiens
aaaggtggaataaaca

SEQ ID NO: 3315870 - DNA, 23 bp, Homo sapiens
aaaggtggtatgtaatttatgca

SEQ ID NO: 3315871 - DNA, 18 bp, Homo sapiens
aaaggtggtgaggcaata

SEQ ID NO: 3315872 - DNA, 13 bp, Homo sapiens
aaaggtgtattta

SEQ ID NO: 3315873 - DNA, 13 bp, Homo sapiens
aaaggttctaggt

SEQ ID NO: 3315874 - DNA, 21 bp, Homo sapiens
aaaggttctaggtttcaaaga

SEQ ID NO: 3315875 - DNA, 14 bp, Homo sapiens
aaaggttcttcatc

SEQ ID NO: 3315876 - DNA, 15 bp, Homo sapiens
aaaggttcttcatcc

SEQ ID NO: 3315877 - DNA, 16 bp, Homo sapiens
aaaggttgaataatat

SEQ ID NO: 3315878 - DNA, 19 bp, Homo sapiens
aaaggtttgcattctcaca

SEQ ID NO: 3315879 - DNA, 14 bp, Homo sapiens
aaaggttttgtatt

SEQ ID NO: 3315880 - DNA, 17 bp, Homo sapiens
aaaggttttgtattttt

SEQ ID NO: 3315881 - DNA, 18 bp, Homo sapiens
aaaggttttttttcagtt

SEQ ID NO: 3315882 - DNA, 12 bp, Homo sapiens
aaagtaaagcta

SEQ ID NO: 3315883 - DNA, 13 bp, Homo sapiens
aaagtaaagctaa

SEQ ID NO: 3315884 - DNA, 23 bp, Homo sapiens
aaagtaaagctaaaatgatttta

SEQ ID NO: 3315885 - DNA, 22 bp, Homo sapiens
aaagtaaaggcctcctccccca

SEQ ID NO: 3315886 - DNA, 12 bp, Homo sapiens
aaagtaaataca

SEQ ID NO: 3315887 - DNA, 15 bp, Homo sapiens
aaagtaaatacaaga

SEQ ID NO: 3315888 - DNA, 19 bp, Homo sapiens
aaagtaaatacaagactgt

SEQ ID NO: 3315889 - DNA, 22 bp, Homo sapiens
aaagtaaatacaagactgttgt

SEQ ID NO: 3315890 - DNA, 12 bp, Homo sapiens
aaagtaaatctc

SEQ ID NO: 3315891 - DNA, 21 bp, Homo sapiens
aaagtaaggtgcttggagttt

SEQ ID NO: 3315892 - DNA, 19 bp, Homo sapiens
aaagtaagtaccactcagg

SEQ ID NO: 3315893 - DNA, 15 bp, Homo sapiens
aaagtaagttaataa

SEQ ID NO: 3315894 - DNA, 17 bp, Homo sapiens
aaagtaagttaataatg

SEQ ID NO: 3315895 - DNA, 13 bp, Homo sapiens
aaagtaattttgt

SEQ ID NO: 3315896 - DNA, 17 bp, Homo sapiens
aaagtaccacactgagt

SEQ ID NO: 3315897 - DNA, 20 bp, Homo sapiens
aaagtacttctccaccctgc

SEQ ID NO: 3315898 - DNA, 22 bp, Homo sapiens
aaagtagaagtcttagatgtat

SEQ ID NO: 3315899 - DNA, 12 bp, Homo sapiens
aaagtagggggc

SEQ ID NO: 3315900 - DNA, 20 bp, Homo sapiens
aaagtataatgtttattaaa

SEQ ID NO: 3315901 - DNA, 22 bp, Homo sapiens
aaagtataatgtttattaaatg

SEQ ID NO: 3315902 - DNA, 17 bp, Homo sapiens
aaagtatatatagaatc

SEQ ID NO: 3315903 - DNA, 17 bp, Homo sapiens
aaagtatcactctaaaa

SEQ ID NO: 3315904 - DNA, 20 bp, Homo sapiens
aaagtatcactctaaaaaac

SEQ ID NO: 3315905 - DNA, 21 bp, Homo sapiens
aaagtatcactctaaaaaaca

SEQ ID NO: 3315906 - DNA, 23 bp, Homo sapiens
aaagtatcactctaaaaaacatt

SEQ ID NO: 3315907 - DNA, 14 bp, Homo sapiens
aaagtatgcattat

SEQ ID NO: 3315908 - DNA, 20 bp, Homo sapiens
aaagtatgtaaagtatgtaa

SEQ ID NO: 3315909 - DNA, 13 bp, Homo sapiens
aaagtattgtcta

SEQ ID NO: 3315910 - DNA, 15 bp, Homo sapiens
aaagtcagaagtttt

SEQ ID NO: 3315911 - DNA, 23 bp, Homo sapiens
aaagtcagttgctcaaaaagaaa

SEQ ID NO: 3315912 - DNA, 21 bp, Homo sapiens
aaagtccataccttatatatg

SEQ ID NO: 3315913 - DNA, 16 bp, Homo sapiens
aaagtcctttttttcc

SEQ ID NO: 3315914 - DNA, 16 bp, Homo sapiens
aaagtcgttttccaaa

SEQ ID NO: 3315915 - DNA, 19 bp, Homo sapiens
aaagtctatttttttaact

SEQ ID NO: 3315916 - DNA, 22 bp, Homo sapiens
aaagtctatttttttaactgaa

SEQ ID NO: 3315917 - DNA, 23 bp, Homo sapiens
aaagtctatttttttaactgaaa

SEQ ID NO: 3315918 - DNA, 13 bp, Homo sapiens
aaagtctctattt

SEQ ID NO: 3315919 - DNA, 15 bp, Homo sapiens
aaagtctctatttaa

SEQ ID NO: 3315920 - DNA, 17 bp, Homo sapiens
aaagtctctatttaaat

SEQ ID NO: 3315921 - DNA, 23 bp, Homo sapiens
aaagtctgtgtgatgaactttct

SEQ ID NO: 3315922 - DNA, 21 bp, Homo sapiens
aaagtgaatttgaatgaaaaa

SEQ ID NO: 3315923 - DNA, 21 bp, Homo sapiens
aaagtgatgggctttctcttt

SEQ ID NO: 3315924 - DNA, 18 bp, Homo sapiens
aaagtgcatatttatcca

SEQ ID NO: 3315925 - DNA, 20 bp, Homo sapiens
aaagtgcctgacacactaac

SEQ ID NO: 3315926 - DNA, 18 bp, Homo sapiens
aaagtgctaaggttctaa

SEQ ID NO: 3315927 - DNA, 20 bp, Homo sapiens
aaagtgctaaggttctaagg

SEQ ID NO: 3315928 - DNA, 21 bp, Homo sapiens
aaagtgctaaggttctaaggc

SEQ ID NO: 3315929 - DNA, 20 bp, Homo sapiens
aaagtgctggattgtccttg

SEQ ID NO: 3315930 - DNA, 11 bp, Homo sapiens
aaagtgctggg

SEQ ID NO: 3315931 - DNA, 20 bp, Homo sapiens
aaagtgtatatttattcata

SEQ ID NO: 3315932 - DNA, 23 bp, Homo sapiens
aaagtgtattagatgtggttttt

SEQ ID NO: 3315933 - DNA, 22 bp, Homo sapiens
aaagtgtatttggaaataaagt

SEQ ID NO: 3315934 - DNA, 18 bp, Homo sapiens
aaagtgtgtatatatttt

SEQ ID NO: 3315935 - DNA, 19 bp, Homo sapiens
aaagtgtgtatatattttg

SEQ ID NO: 3315936 - DNA, 21 bp, Homo sapiens
aaagtgtgtatatattttgtg

SEQ ID NO: 3315937 - DNA, 17 bp, Homo sapiens
aaagtgtgttgttgctt

SEQ ID NO: 3315938 - DNA, 12 bp, Homo sapiens
aaagtgttggtc

SEQ ID NO: 3315939 - DNA, 18 bp, Homo sapiens
aaagtgttggtctttcta

SEQ ID NO: 3315940 - DNA, 11 bp, Homo sapiens
aaagtgttttc

SEQ ID NO: 3315941 - DNA, 16 bp, Homo sapiens
aaagtgttttcagagc

SEQ ID NO: 3315942 - DNA, 12 bp, Homo sapiens
aaagttaacatt

SEQ ID NO: 3315943 - DNA, 15 bp, Homo sapiens
aaagttaacattaat

SEQ ID NO: 3315944 - DNA, 17 bp, Homo sapiens
aaagttacagaaatact

SEQ ID NO: 3315945 - DNA, 17 bp, Homo sapiens
aaagttacccactgaag

SEQ ID NO: 3315946 - DNA, 15 bp, Homo sapiens
aaagttatttatgct

SEQ ID NO: 3315947 - DNA, 19 bp, Homo sapiens
aaagttcataacagtgcca

SEQ ID NO: 3315948 - DNA, 22 bp, Homo sapiens
aaagttccaagagtctaaagat

SEQ ID NO: 3315949 - DNA, 16 bp, Homo sapiens
aaagttctaagattct

SEQ ID NO: 3315950 - DNA, 20 bp, Homo sapiens
aaagttctaataatttctaa

SEQ ID NO: 3315951 - DNA, 19 bp, Homo sapiens
aaagttctgtgtaaacaga

SEQ ID NO: 3315952 - DNA, 18 bp, Homo sapiens
aaagttctgtgtatttaa

SEQ ID NO: 3315953 - DNA, 22 bp, Homo sapiens
aaagttgcagatgtattgactg

SEQ ID NO: 3315954 - DNA, 14 bp, Homo sapiens
aaagttgtcttaaa

SEQ ID NO: 3315955 - DNA, 19 bp, Homo sapiens
aaagtttacaagtgtatat

SEQ ID NO: 3315956 - DNA, 23 bp, Homo sapiens
aaagtttcacaggtcaataaact

SEQ ID NO: 3315957 - DNA, 20 bp, Homo sapiens
aaagtttcctaatcagaaat

SEQ ID NO: 3315958 - DNA, 23 bp, Homo sapiens
aaagtttctcttttcaaaacatt

SEQ ID NO: 3315959 - DNA, 17 bp, Homo sapiens
aaagttttatatgcttt

SEQ ID NO: 3315960 - DNA, 18 bp, Homo sapiens
aaagttttattataaatt

SEQ ID NO: 3315961 - DNA, 19 bp, Homo sapiens
aaagttttattataaattc

SEQ ID NO: 3315962 - DNA, 14 bp, Homo sapiens
aaagttttccagta

SEQ ID NO: 3315963 - DNA, 16 bp, Homo sapiens
aaagttttccagtatt

SEQ ID NO: 3315964 - DNA, 15 bp, Homo sapiens
aaagttttcctgaga

SEQ ID NO: 3315965 - DNA, 14 bp, Homo sapiens
aaagttttgaaaag

SEQ ID NO: 3315966 - DNA, 19 bp, Homo sapiens
aaagttttgaaaagctatt

SEQ ID NO: 3315967 - DNA, 21 bp, Homo sapiens
aaagttttgagtagatattac

SEQ ID NO: 3315968 - DNA, 22 bp, Homo sapiens
aaagttttgagtagatattact

SEQ ID NO: 3315969 - DNA, 22 bp, Homo sapiens
aaagttttttattatgcattat

SEQ ID NO: 3315970 - DNA, 13 bp, Homo sapiens
aaataaaaaagtc

SEQ ID NO: 3315971 - DNA, 18 bp, Homo sapiens
aaataaaaacaaacgttt

SEQ ID NO: 3315972 - DNA, 17 bp, Homo sapiens
aaataaaaaccaaatta

SEQ ID NO: 3315973 - DNA, 15 bp, Homo sapiens
aaataaaaactaatt

SEQ ID NO: 3315974 - DNA, 19 bp, Homo sapiens
aaataaaaagtgacacagc

SEQ ID NO: 3315975 - DNA, 21 bp, Homo sapiens
aaataaaaagtgacacagcag

SEQ ID NO: 3315976 - DNA, 22 bp, Homo sapiens
aaataaaaatcaacttgtgtac

SEQ ID NO: 3315977 - DNA, 16 bp, Homo sapiens
aaataaaaattctgaa

SEQ ID NO: 3315978 - DNA, 14 bp, Homo sapiens
aaataaaactgaat

SEQ ID NO: 3315979 - DNA, 13 bp, Homo sapiens
aaataaaagcaca

SEQ ID NO: 3315980 - DNA, 16 bp, Homo sapiens
aaataaaagcacaagt

SEQ ID NO: 3315981 - DNA, 22 bp, Homo sapiens
aaataaaagtgaatgaaagatt

SEQ ID NO: 3315982 - DNA, 14 bp, Homo sapiens
aaataaaataaaat

SEQ ID NO: 3315983 - DNA, 19 bp, Homo sapiens
aaataaaatgaaaattgta

SEQ ID NO: 3315984 - DNA, 23 bp, Homo sapiens
aaataaaatgccatagtttgtga

SEQ ID NO: 3315985 - DNA, 16 bp, Homo sapiens
aaataaacatcagttt

SEQ ID NO: 3315986 - DNA, 22 bp, Homo sapiens
aaataaaccaaaggacattatg

SEQ ID NO: 3315987 - DNA, 14 bp, Homo sapiens
aaataaactctaaa

SEQ ID NO: 3315988 - DNA, 14 bp, Homo sapiens
aaataaactgttgc

SEQ ID NO: 3315989 - DNA, 13 bp, Homo sapiens
aaataaacttttt

SEQ ID NO: 3315990 - DNA, 17 bp, Homo sapiens
aaataaagataaccctt

SEQ ID NO: 3315991 - DNA, 13 bp, Homo sapiens
aaataaagcagaa

SEQ ID NO: 3315992 - DNA, 11 bp, Homo sapiens
aaataaagcct

SEQ ID NO: 3315993 - DNA, 16 bp, Homo sapiens
aaataaagccttttaa

SEQ ID NO: 3315994 - DNA, 16 bp, Homo sapiens
aaataaagtatatata

SEQ ID NO: 3315995 - DNA, 20 bp, Homo sapiens
aaataaagtttgcttagaaa

SEQ ID NO: 3315996 - DNA, 21 bp, Homo sapiens
aaataaatggtttctgaaaat

SEQ ID NO: 3315997 - DNA, 19 bp, Homo sapiens
aaataaattggtgataagt

SEQ ID NO: 3315998 - DNA, 21 bp, Homo sapiens
aaataaatttaactttaacca

SEQ ID NO: 3315999 - DNA, 16 bp, Homo sapiens
aaataaatttctggga

SEQ ID NO: 3316000 - DNA, 19 bp, Homo sapiens
aaataaatttggttctaat

SEQ ID NO: 3316001 - DNA, 15 bp, Homo sapiens
aaataacaatgttaa

SEQ ID NO: 3316002 - DNA, 18 bp, Homo sapiens
aaataacaatgttaagga

SEQ ID NO: 3316003 - DNA, 19 bp, Homo sapiens
aaataacaatgttaaggaa

SEQ ID NO: 3316004 - DNA, 21 bp, Homo sapiens
aaataacacacatataaacat

SEQ ID NO: 3316005 - DNA, 23 bp, Homo sapiens
aaataacacagagagacagactt

SEQ ID NO: 3316006 - DNA, 18 bp, Homo sapiens
aaataaccccattctttg

SEQ ID NO: 3316007 - DNA, 17 bp, Homo sapiens
aaataacctctggccct

SEQ ID NO: 3316008 - DNA, 18 bp, Homo sapiens
aaataacctctggccctt

SEQ ID NO: 3316009 - DNA, 14 bp, Homo sapiens
aaataactaaaatg

SEQ ID NO: 3316010 - DNA, 15 bp, Homo sapiens
aaataactaaaatgt

SEQ ID NO: 3316011 - DNA, 23 bp, Homo sapiens
aaataactgaaccaaattgcact

SEQ ID NO: 3316012 - DNA, 20 bp, Homo sapiens
aaataactggaacaaattat

SEQ ID NO: 3316013 - DNA, 15 bp, Homo sapiens
aaataacttcaagca

SEQ ID NO: 3316014 - DNA, 15 bp, Homo sapiens
aaataacttcagtcc

SEQ ID NO: 3316015 - DNA, 16 bp, Homo sapiens
aaataacttcagtcct

SEQ ID NO: 3316016 - DNA, 21 bp, Homo sapiens
aaataagacaatagtatttct

SEQ ID NO: 3316017 - DNA, 14 bp, Homo sapiens
aaataagagatttg

SEQ ID NO: 3316018 - DNA, 13 bp, Homo sapiens
aaataagattcta

SEQ ID NO: 3316019 - DNA, 15 bp, Homo sapiens
aaataagattctaac

SEQ ID NO: 3316020 - DNA, 16 bp, Homo sapiens
aaataagattctaacg

SEQ ID NO: 3316021 - DNA, 20 bp, Homo sapiens
aaataagcaaataaacagtg

SEQ ID NO: 3316022 - DNA, 15 bp, Homo sapiens
aaataagcaggtgga

SEQ ID NO: 3316023 - DNA, 21 bp, Homo sapiens
aaataagcccagtgctgctgt

SEQ ID NO: 3316024 - DNA, 22 bp, Homo sapiens
aaataagcccagtgctgctgta

SEQ ID NO: 3316025 - DNA, 22 bp, Homo sapiens
aaataaggaagagggctgagct

SEQ ID NO: 3316026 - DNA, 16 bp, Homo sapiens
aaataagtcaaaagga

SEQ ID NO: 3316027 - DNA, 17 bp, Homo sapiens
aaataagtcaaaaggaa

SEQ ID NO: 3316028 - DNA, 12 bp, Homo sapiens
aaataatatgca

SEQ ID NO: 3316029 - DNA, 13 bp, Homo sapiens
aaataattaaata

SEQ ID NO: 3316030 - DNA, 17 bp, Homo sapiens
aaataattgatttcaag

SEQ ID NO: 3316031 - DNA, 21 bp, Homo sapiens
aaatacaaaaaattagccaag

SEQ ID NO: 3316032 - DNA, 16 bp, Homo sapiens
aaatacaaagtaaata

SEQ ID NO: 3316033 - DNA, 18 bp, Homo sapiens
aaatacaaagtaaataca

SEQ ID NO: 3316034 - DNA, 14 bp, Homo sapiens
aaatacaagactgt

SEQ ID NO: 3316035 - DNA, 15 bp, Homo sapiens
aaatacaagactgtt

SEQ ID NO: 3316036 - DNA, 22 bp, Homo sapiens
aaatacaataaactattggaaa

SEQ ID NO: 3316037 - DNA, 23 bp, Homo sapiens
aaatacacagatgattaaacaga

SEQ ID NO: 3316038 - DNA, 12 bp, Homo sapiens
aaatacacattt

SEQ ID NO: 3316039 - DNA, 13 bp, Homo sapiens
aaatacacatttc

SEQ ID NO: 3316040 - DNA, 14 bp, Homo sapiens
aaatacacatttca

SEQ ID NO: 3316041 - DNA, 22 bp, Homo sapiens
aaatacaccacctcactcctgt

SEQ ID NO: 3316042 - DNA, 18 bp, Homo sapiens
aaatacacttcttttgaa

SEQ ID NO: 3316043 - DNA, 13 bp, Homo sapiens
aaatacaggaaga

SEQ ID NO: 3316044 - DNA, 21 bp, Homo sapiens
aaatacatatcgctgacttca

SEQ ID NO: 3316045 - DNA, 19 bp, Homo sapiens
aaataccacaagcctgaga

SEQ ID NO: 3316046 - DNA, 14 bp, Homo sapiens
aaataccagagcct

SEQ ID NO: 3316047 - DNA, 22 bp, Homo sapiens
aaataccagagccttcaagtgc

SEQ ID NO: 3316048 - DNA, 16 bp, Homo sapiens
aaataccaggattttt

SEQ ID NO: 3316049 - DNA, 19 bp, Homo sapiens
aaataccatgtctctaagc

SEQ ID NO: 3316050 - DNA, 14 bp, Homo sapiens
aaatacctcatgtt

SEQ ID NO: 3316051 - DNA, 22 bp, Homo sapiens
aaatacctcatgtttatgaaaa

SEQ ID NO: 3316052 - DNA, 20 bp, Homo sapiens
aaatacctccattaaatggt

SEQ ID NO: 3316053 - DNA, 14 bp, Homo sapiens
aaatacctttgtag

SEQ ID NO: 3316054 - DNA, 15 bp, Homo sapiens
aaatacctttgtagt

SEQ ID NO: 3316055 - DNA, 17 bp, Homo sapiens
aaatactaaaagcaaat

SEQ ID NO: 3316056 - DNA, 22 bp, Homo sapiens
aaatactaaaagcaaatctaca

SEQ ID NO: 3316057 - DNA, 20 bp, Homo sapiens
aaatactatttaaagcctcc

SEQ ID NO: 3316058 - DNA, 21 bp, Homo sapiens
aaatactgtgcagaataatgg

SEQ ID NO: 3316059 - DNA, 14 bp, Homo sapiens
aaatacttgtttca

SEQ ID NO: 3316060 - DNA, 17 bp, Homo sapiens
aaatacttttactctgc

SEQ ID NO: 3316061 - DNA, 19 bp, Homo sapiens
aaatactttttaacaaaaa

SEQ ID NO: 3316062 - DNA, 16 bp, Homo sapiens
aaatagaaccactatg

SEQ ID NO: 3316063 - DNA, 21 bp, Homo sapiens
aaatagaatgttactttggaa

SEQ ID NO: 3316064 - DNA, 18 bp, Homo sapiens
aaatagacaaaaagtata

SEQ ID NO: 3316065 - DNA, 19 bp, Homo sapiens
aaatagacatattaacatg

SEQ ID NO: 3316066 - DNA, 20 bp, Homo sapiens
aaatagagcttttaaaaatg

SEQ ID NO: 3316067 - DNA, 22 bp, Homo sapiens
aaatagcttagcggcaagaagc

SEQ ID NO: 3316068 - DNA, 20 bp, Homo sapiens
aaataggaatcattcagaaa

SEQ ID NO: 3316069 - DNA, 16 bp, Homo sapiens
aaataggagaggatga

SEQ ID NO: 3316070 - DNA, 24 bp, Homo sapiens
aaataggagaggatgagagcccag

SEQ ID NO: 3316071 - DNA, 14 bp, Homo sapiens
aaataggattttta

SEQ ID NO: 3316072 - DNA, 20 bp, Homo sapiens
aaataggggatggtccagga

SEQ ID NO: 3316073 - DNA, 22 bp, Homo sapiens
aaatagttaagacatgatttcc

SEQ ID NO: 3316074 - DNA, 16 bp, Homo sapiens
aaatagttgtccatat

SEQ ID NO: 3316075 - DNA, 19 bp, Homo sapiens
aaatagtttatttttcaca

SEQ ID NO: 3316076 - DNA, 12 bp, Homo sapiens
aaatagtttgtt

SEQ ID NO: 3316077 - DNA, 13 bp, Homo sapiens
aaatataaacatc

SEQ ID NO: 3316078 - DNA, 16 bp, Homo sapiens
aaatataacacatttt

SEQ ID NO: 3316079 - DNA, 23 bp, Homo sapiens
aaatataacaggtgcttctttgt

SEQ ID NO: 3316080 - DNA, 14 bp, Homo sapiens
aaatataagatttt

SEQ ID NO: 3316081 - DNA, 19 bp, Homo sapiens
aaatataattctgtaaatg

SEQ ID NO: 3316082 - DNA, 13 bp, Homo sapiens
aaatataattgta

SEQ ID NO: 3316083 - DNA, 15 bp, Homo sapiens
aaatatactatgaaa

SEQ ID NO: 3316084 - DNA, 22 bp, Homo sapiens
aaatatactgattttgaaaagt

SEQ ID NO: 3316085 - DNA, 22 bp, Homo sapiens
aaatatagaaagttgatattca

SEQ ID NO: 3316086 - DNA, 13 bp, Homo sapiens
aaatatagattag

SEQ ID NO: 3316087 - DNA, 18 bp, Homo sapiens
aaatatagattagaaaaa

SEQ ID NO: 3316088 - DNA, 12 bp, Homo sapiens
aaatatataata

SEQ ID NO: 3316089 - DNA, 16 bp, Homo sapiens
aaatatataatatact

SEQ ID NO: 3316090 - DNA, 13 bp, Homo sapiens
aaatatatataaa

SEQ ID NO: 3316091 - DNA, 15 bp, Homo sapiens
aaatatatttaatga

SEQ ID NO: 3316092 - DNA, 17 bp, Homo sapiens
aaatatattttcagtac

SEQ ID NO: 3316093 - DNA, 19 bp, Homo sapiens
aaatatcagacaagcacta

SEQ ID NO: 3316094 - DNA, 16 bp, Homo sapiens
aaatatcatataaaca

SEQ ID NO: 3316095 - DNA, 19 bp, Homo sapiens
aaatatccaaagactgtac

SEQ ID NO: 3316096 - DNA, 18 bp, Homo sapiens
aaatatccttgatgtaca

SEQ ID NO: 3316097 - DNA, 19 bp, Homo sapiens
aaatatccttgatgtacag

SEQ ID NO: 3316098 - DNA, 13 bp, Homo sapiens
aaatatctatatt

SEQ ID NO: 3316099 - DNA, 18 bp, Homo sapiens
aaatatctgaaaatgtat

SEQ ID NO: 3316100 - DNA, 21 bp, Homo sapiens
aaatatctgaaaatgtatgtg

SEQ ID NO: 3316101 - DNA, 22 bp, Homo sapiens
aaatatctgaaaatgtatgtgt

SEQ ID NO: 3316102 - DNA, 23 bp, Homo sapiens
aaatatctgaaaatgtatgtgta

SEQ ID NO: 3316103 - DNA, 14 bp, Homo sapiens
aaatatcttggcct

SEQ ID NO: 3316104 - DNA, 21 bp, Homo sapiens
aaatatcttgtgttgtccttt

SEQ ID NO: 3316105 - DNA, 18 bp, Homo sapiens
aaatatgaaccctttgtt

SEQ ID NO: 3316106 - DNA, 19 bp, Homo sapiens
aaatatgaacctattttca

SEQ ID NO: 3316107 - DNA, 23 bp, Homo sapiens
aaatatgaacctattttcatttg

SEQ ID NO: 3316108 - DNA, 17 bp, Homo sapiens
aaatatgcagaatctct

SEQ ID NO: 3316109 - DNA, 14 bp, Homo sapiens
aaatatgcagtgat

SEQ ID NO: 3316110 - DNA, 22 bp, Homo sapiens
aaatatgcagtgatatggcaga

SEQ ID NO: 3316111 - DNA, 21 bp, Homo sapiens
aaatatggaacttacattgtt

SEQ ID NO: 3316112 - DNA, 17 bp, Homo sapiens
aaatatggaacttctaa

SEQ ID NO: 3316113 - DNA, 18 bp, Homo sapiens
aaatatggaacttctaat

SEQ ID NO: 3316114 - DNA, 16 bp, Homo sapiens
aaatatggacacttaa

SEQ ID NO: 3316115 - DNA, 19 bp, Homo sapiens
aaatatggctagttttcaa

SEQ ID NO: 3316116 - DNA, 19 bp, Homo sapiens
aaatatggtttggtttttc

SEQ ID NO: 3316117 - DNA, 15 bp, Homo sapiens
aaatatgtcagatgt

SEQ ID NO: 3316118 - DNA, 16 bp, Homo sapiens
aaatatgtcctggggt

SEQ ID NO: 3316119 - DNA, 18 bp, Homo sapiens
aaatatgtctcgctagtg

SEQ ID NO: 3316120 - DNA, 20 bp, Homo sapiens
aaatattataacttaaaaaa

SEQ ID NO: 3316121 - DNA, 14 bp, Homo sapiens
aaatattatgtgtt

SEQ ID NO: 3316122 - DNA, 16 bp, Homo sapiens
aaatattcacatcttc

SEQ ID NO: 3316123 - DNA, 17 bp, Homo sapiens
aaatattcactggcccc

SEQ ID NO: 3316124 - DNA, 23 bp, Homo sapiens
aaatattccatccatatactttg

SEQ ID NO: 3316125 - DNA, 13 bp, Homo sapiens
aaatattctatat

SEQ ID NO: 3316126 - DNA, 15 bp, Homo sapiens
aaatattctctattt

SEQ ID NO: 3316127 - DNA, 15 bp, Homo sapiens
aaatattgatgaaaa

SEQ ID NO: 3316128 - DNA, 16 bp, Homo sapiens
aaatatttactctttg

SEQ ID NO: 3316129 - DNA, 19 bp, Homo sapiens
aaatatttataaaacttct

SEQ ID NO: 3316130 - DNA, 12 bp, Homo sapiens
aaatatttatct

SEQ ID NO: 3316131 - DNA, 15 bp, Homo sapiens
aaatatttatgtaaa

SEQ ID NO: 3316132 - DNA, 14 bp, Homo sapiens
aaatatttccttaa

SEQ ID NO: 3316133 - DNA, 17 bp, Homo sapiens
aaatatttgaatgaaaa

SEQ ID NO: 3316134 - DNA, 18 bp, Homo sapiens
aaatatttgacttgcatg

SEQ ID NO: 3316135 - DNA, 12 bp, Homo sapiens
aaatatttggag

SEQ ID NO: 3316136 - DNA, 14 bp, Homo sapiens
aaatatttgtacat

SEQ ID NO: 3316137 - DNA, 15 bp, Homo sapiens
aaatatttgtacata

SEQ ID NO: 3316138 - DNA, 12 bp, Homo sapiens
aaatattttctc

SEQ ID NO: 3316139 - DNA, 15 bp, Homo sapiens
aaatattttctctgt

SEQ ID NO: 3316140 - DNA, 12 bp, Homo sapiens
aaatcaaagtag

SEQ ID NO: 3316141 - DNA, 15 bp, Homo sapiens
aaatcaaattgctta

SEQ ID NO: 3316142 - DNA, 16 bp, Homo sapiens
aaatcaacagaagcat

SEQ ID NO: 3316143 - DNA, 19 bp, Homo sapiens
aaatcaacagaagcatttg

SEQ ID NO: 3316144 - DNA, 17 bp, Homo sapiens
aaatcaaccctctcctg

SEQ ID NO: 3316145 - DNA, 16 bp, Homo sapiens
aaatcaacttaacatg

SEQ ID NO: 3316146 - DNA, 18 bp, Homo sapiens
aaatcaagtatttgggaa

SEQ ID NO: 3316147 - DNA, 23 bp, Homo sapiens
aaatcaagtatttgggaagtgaa

SEQ ID NO: 3316148 - DNA, 17 bp, Homo sapiens
aaatcaatagttgaatt

SEQ ID NO: 3316149 - DNA, 17 bp, Homo sapiens
aaatcaatttttaggaa

SEQ ID NO: 3316150 - DNA, 22 bp, Homo sapiens
aaatcacaaaaatttgaacact

SEQ ID NO: 3316151 - DNA, 12 bp, Homo sapiens
aaatcagaagtc

SEQ ID NO: 3316152 - DNA, 16 bp, Homo sapiens
aaatcagccgcaagga

SEQ ID NO: 3316153 - DNA, 16 bp, Homo sapiens
aaatcagctgctacta

SEQ ID NO: 3316154 - DNA, 14 bp, Homo sapiens
aaatcagctttgta

SEQ ID NO: 3316155 - DNA, 15 bp, Homo sapiens
aaatcagtaagaggt

SEQ ID NO: 3316156 - DNA, 12 bp, Homo sapiens
aaatcagtattt

SEQ ID NO: 3316157 - DNA, 21 bp, Homo sapiens
aaatcagtgatctatgtttgt

SEQ ID NO: 3316158 - DNA, 16 bp, Homo sapiens
aaatcagtttttcata

SEQ ID NO: 3316159 - DNA, 17 bp, Homo sapiens
aaatcagtttttcatac

SEQ ID NO: 3316160 - DNA, 22 bp, Homo sapiens
aaatcatattaaaattacagat

SEQ ID NO: 3316161 - DNA, 15 bp, Homo sapiens
aaatcatcctgtttt

SEQ ID NO: 3316162 - DNA, 22 bp, Homo sapiens
aaatcatcctgttttctctgtg

SEQ ID NO: 3316163 - DNA, 18 bp, Homo sapiens
aaatcatgtatgttatga

SEQ ID NO: 3316164 - DNA, 12 bp, Homo sapiens
aaatcatttcag

SEQ ID NO: 3316165 - DNA, 14 bp, Homo sapiens
aaatcatttcagta

SEQ ID NO: 3316166 - DNA, 14 bp, Homo sapiens
aaatccagaaagaa

SEQ ID NO: 3316167 - DNA, 18 bp, Homo sapiens
aaatccattgtttaaaga

SEQ ID NO: 3316168 - DNA, 21 bp, Homo sapiens
aaatcctagtttcctctcctt

SEQ ID NO: 3316169 - DNA, 19 bp, Homo sapiens
aaatcctttttctttataa

SEQ ID NO: 3316170 - DNA, 22 bp, Homo sapiens
aaatcggatctggggctctggg

SEQ ID NO: 3316171 - DNA, 15 bp, Homo sapiens
aaatcgttggaaaat

SEQ ID NO: 3316172 - DNA, 12 bp, Homo sapiens
aaatctaaagtt

SEQ ID NO: 3316173 - DNA, 20 bp, Homo sapiens
aaatctaaatctatttatta

SEQ ID NO: 3316174 - DNA, 15 bp, Homo sapiens
aaatctaaatttctt

SEQ ID NO: 3316175 - DNA, 17 bp, Homo sapiens
aaatctagccagagccc

SEQ ID NO: 3316176 - DNA, 21 bp, Homo sapiens
aaatctagttttttttgtaaa

SEQ ID NO: 3316177 - DNA, 13 bp, Homo sapiens
aaatctattcaga

SEQ ID NO: 3316178 - DNA, 12 bp, Homo sapiens
aaatctatttat

SEQ ID NO: 3316179 - DNA, 16 bp, Homo sapiens
aaatctcaaatttatt

SEQ ID NO: 3316180 - DNA, 11 bp, Homo sapiens
aaatctcatac

SEQ ID NO: 3316181 - DNA, 23 bp, Homo sapiens
aaatctcatactcccccacagtt

SEQ ID NO: 3316182 - DNA, 12 bp, Homo sapiens
aaatctcattcc

SEQ ID NO: 3316183 - DNA, 20 bp, Homo sapiens
aaatctcccattttggaatt

SEQ ID NO: 3316184 - DNA, 15 bp, Homo sapiens
aaatctctaatatgg

SEQ ID NO: 3316185 - DNA, 17 bp, Homo sapiens
aaatctcttctttgctg

SEQ ID NO: 3316186 - DNA, 16 bp, Homo sapiens
aaatctgaacattctc

SEQ ID NO: 3316187 - DNA, 20 bp, Homo sapiens
aaatctgaactctcaaaagt

SEQ ID NO: 3316188 - DNA, 14 bp, Homo sapiens
aaatctgacatatt

SEQ ID NO: 3316189 - DNA, 15 bp, Homo sapiens
aaatctgacatatta

SEQ ID NO: 3316190 - DNA, 13 bp, Homo sapiens
aaatctgcagagg

SEQ ID NO: 3316191 - DNA, 11 bp, Homo sapiens
aaatctgccac

SEQ ID NO: 3316192 - DNA, 22 bp, Homo sapiens
aaatctggtcttgttagaaaac

SEQ ID NO: 3316193 - DNA, 16 bp, Homo sapiens
aaatctgtatatgttg

SEQ ID NO: 3316194 - DNA, 21 bp, Homo sapiens
aaatctgtccaaaggaggctg

SEQ ID NO: 3316195 - DNA, 22 bp, Homo sapiens
aaatctgtccaaaggaggctgg

SEQ ID NO: 3316196 - DNA, 20 bp, Homo sapiens
aaatctgtgaattaaaaaag

SEQ ID NO: 3316197 - DNA, 15 bp, Homo sapiens
aaatctgttgttcca

SEQ ID NO: 3316198 - DNA, 23 bp, Homo sapiens
aaatctgttgttccaaatgtgta

SEQ ID NO: 3316199 - DNA, 18 bp, Homo sapiens
aaatctgtttgatccctg

SEQ ID NO: 3316200 - DNA, 14 bp, Homo sapiens
aaatcttaaaaagt

SEQ ID NO: 3316201 - DNA, 13 bp, Homo sapiens
aaatcttaaacaa

SEQ ID NO: 3316202 - DNA, 15 bp, Homo sapiens
aaatcttaaacaatg

SEQ ID NO: 3316203 - DNA, 16 bp, Homo sapiens
aaatcttatagttcta

SEQ ID NO: 3316204 - DNA, 19 bp, Homo sapiens
aaatcttatagttctaggc

SEQ ID NO: 3316205 - DNA, 15 bp, Homo sapiens
aaatcttgaatttct

SEQ ID NO: 3316206 - DNA, 19 bp, Homo sapiens
aaatcttggaagtacatga

SEQ ID NO: 3316207 - DNA, 20 bp, Homo sapiens
aaatcttggaagtacatgaa

SEQ ID NO: 3316208 - DNA, 17 bp, Homo sapiens
aaatcttggcacagaaa

SEQ ID NO: 3316209 - DNA, 14 bp, Homo sapiens
aaatctttaagaat

SEQ ID NO: 3316210 - DNA, 15 bp, Homo sapiens
aaatctttcttcaaa

SEQ ID NO: 3316211 - DNA, 15 bp, Homo sapiens
aaatcttttgaagca

SEQ ID NO: 3316212 - DNA, 14 bp, Homo sapiens
aaatctttttgata

SEQ ID NO: 3316213 - DNA, 22 bp, Homo sapiens
aaatctttttgataagcacatt

SEQ ID NO: 3316214 - DNA, 14 bp, Homo sapiens
aaatgaaagaaaat

SEQ ID NO: 3316215 - DNA, 23 bp, Homo sapiens
aaatgaaagtgactttaaaagaa

SEQ ID NO: 3316216 - DNA, 17 bp, Homo sapiens
aaatgaaatttaaacat

SEQ ID NO: 3316217 - DNA, 14 bp, Homo sapiens
aaatgaagaaggaa

SEQ ID NO: 3316218 - DNA, 22 bp, Homo sapiens
aaatgaaggttaggatttaaca

SEQ ID NO: 3316219 - DNA, 18 bp, Homo sapiens
aaatgaatatctattaat

SEQ ID NO: 3316220 - DNA, 18 bp, Homo sapiens
aaatgaatattttgataa

SEQ ID NO: 3316221 - DNA, 19 bp, Homo sapiens
aaatgaatctcgttcccaa

SEQ ID NO: 3316222 - DNA, 23 bp, Homo sapiens
aaatgaatctcgttcccaaagaa

SEQ ID NO: 3316223 - DNA, 11 bp, Homo sapiens
aaatgaatgag

SEQ ID NO: 3316224 - DNA, 13 bp, Homo sapiens
aaatgaattcttt

SEQ ID NO: 3316225 - DNA, 19 bp, Homo sapiens
aaatgacaacagaaaaaca

SEQ ID NO: 3316226 - DNA, 20 bp, Homo sapiens
aaatgacaacagaaaaacaa

SEQ ID NO: 3316227 - DNA, 15 bp, Homo sapiens
aaatgacaatgatga

SEQ ID NO: 3316228 - DNA, 22 bp, Homo sapiens
aaatgacaccatcttttattct

SEQ ID NO: 3316229 - DNA, 15 bp, Homo sapiens
aaatgacagactgaa

SEQ ID NO: 3316230 - DNA, 14 bp, Homo sapiens
aaatgacatgcact

SEQ ID NO: 3316231 - DNA, 16 bp, Homo sapiens
aaatgacttatttctg

SEQ ID NO: 3316232 - DNA, 20 bp, Homo sapiens
aaatgacttatttctgctct

SEQ ID NO: 3316233 - DNA, 21 bp, Homo sapiens
aaatgagaattttatattcta

SEQ ID NO: 3316234 - DNA, 15 bp, Homo sapiens
aaatgagctctgaaa

SEQ ID NO: 3316235 - DNA, 13 bp, Homo sapiens
aaatgagtaacat

SEQ ID NO: 3316236 - DNA, 15 bp, Homo sapiens
aaatgagtaacattt

SEQ ID NO: 3316237 - DNA, 23 bp, Homo sapiens
aaatgagttgtgaaagttttgag

SEQ ID NO: 3316238 - DNA, 20 bp, Homo sapiens
aaatgagttgtgatgaatca

SEQ ID NO: 3316239 - DNA, 22 bp, Homo sapiens
aaatgatccccaagtgtgaaca

SEQ ID NO: 3316240 - DNA, 18 bp, Homo sapiens
aaatgatgtgtacccaaa

SEQ ID NO: 3316241 - DNA, 21 bp, Homo sapiens
aaatgattcaaattgctgctt

SEQ ID NO: 3316242 - DNA, 23 bp, Homo sapiens
aaatgattggaatattacaatac

SEQ ID NO: 3316243 - DNA, 13 bp, Homo sapiens
aaatgatttcata

SEQ ID NO: 3316244 - DNA, 16 bp, Homo sapiens
aaatgatttcatattg

SEQ ID NO: 3316245 - DNA, 21 bp, Homo sapiens
aaatgattttatctgtgaatt

SEQ ID NO: 3316246 - DNA, 19 bp, Homo sapiens
aaatgcaaagttctgtgtt

SEQ ID NO: 3316247 - DNA, 21 bp, Homo sapiens
aaatgcagggaggggaggcag

SEQ ID NO: 3316248 - DNA, 22 bp, Homo sapiens
aaatgcagggaggggaggcaga

SEQ ID NO: 3316249 - DNA, 12 bp, Homo sapiens
aaatgcagtgaa

SEQ ID NO: 3316250 - DNA, 15 bp, Homo sapiens
aaatgcataaatgca

SEQ ID NO: 3316251 - DNA, 19 bp, Homo sapiens
aaatgccatagtttgtgaa

SEQ ID NO: 3316252 - DNA, 23 bp, Homo sapiens
aaatgccctcctaaatgtcagct

SEQ ID NO: 3316253 - DNA, 13 bp, Homo sapiens
aaatgccctcttc

SEQ ID NO: 3316254 - DNA, 16 bp, Homo sapiens
aaatgcctagttttta

SEQ ID NO: 3316255 - DNA, 13 bp, Homo sapiens
aaatgcctcttaa

SEQ ID NO: 3316256 - DNA, 14 bp, Homo sapiens
aaatgccttgtata

SEQ ID NO: 3316257 - DNA, 14 bp, Homo sapiens
aaatgcctttgaga

SEQ ID NO: 3316258 - DNA, 17 bp, Homo sapiens
aaatgcctttgagacag

SEQ ID NO: 3316259 - DNA, 15 bp, Homo sapiens
aaatgcgtccctgta

SEQ ID NO: 3316260 - DNA, 13 bp, Homo sapiens
aaatgctctctca

SEQ ID NO: 3316261 - DNA, 14 bp, Homo sapiens
aaatgctgcttctc

SEQ ID NO: 3316262 - DNA, 23 bp, Homo sapiens
aaatgcttcatttgtatgtcaaa

SEQ ID NO: 3316263 - DNA, 20 bp, Homo sapiens
aaatggaaagtaactcattt

SEQ ID NO: 3316264 - DNA, 14 bp, Homo sapiens
aaatggaaattttg

SEQ ID NO: 3316265 - DNA, 22 bp, Homo sapiens
aaatggaatgtgcccctggccc

SEQ ID NO: 3316266 - DNA, 18 bp, Homo sapiens
aaatggaggcttttcact

SEQ ID NO: 3316267 - DNA, 13 bp, Homo sapiens
aaatggatactgg

SEQ ID NO: 3316268 - DNA, 19 bp, Homo sapiens
aaatggatattattagaaa

SEQ ID NO: 3316269 - DNA, 13 bp, Homo sapiens
aaatggccatttg

SEQ ID NO: 3316270 - DNA, 22 bp, Homo sapiens
aaatggcctcatgtggctggaa

SEQ ID NO: 3316271 - DNA, 21 bp, Homo sapiens
aaatggctgtaatcatttgtt

SEQ ID NO: 3316272 - DNA, 21 bp, Homo sapiens
aaatggcttcggacaaaatat

SEQ ID NO: 3316273 - DNA, 17 bp, Homo sapiens
aaatgggtcttttatag

SEQ ID NO: 3316274 - DNA, 21 bp, Homo sapiens
aaatggtatcaaaattacata

SEQ ID NO: 3316275 - DNA, 19 bp, Homo sapiens
aaatggtgctcaccatgct

SEQ ID NO: 3316276 - DNA, 20 bp, Homo sapiens
aaatggtgtacataatgtat

SEQ ID NO: 3316277 - DNA, 15 bp, Homo sapiens
aaatggttcagaatt

SEQ ID NO: 3316278 - DNA, 23 bp, Homo sapiens
aaatggttcagaattaaactttt

SEQ ID NO: 3316279 - DNA, 15 bp, Homo sapiens
aaatggttgatggaa

SEQ ID NO: 3316280 - DNA, 17 bp, Homo sapiens
aaatggttgatggaaaa

SEQ ID NO: 3316281 - DNA, 17 bp, Homo sapiens
aaatggtttattttgta

SEQ ID NO: 3316282 - DNA, 18 bp, Homo sapiens
aaatggtttcaagttatt

SEQ ID NO: 3316283 - DNA, 16 bp, Homo sapiens
aaatggttttgttttg

SEQ ID NO: 3316284 - DNA, 24 bp, Homo sapiens
aaatggttttgttttgcacgtttg

SEQ ID NO: 3316285 - DNA, 17 bp, Homo sapiens
aaatgtaaatttataaa

SEQ ID NO: 3316286 - DNA, 19 bp, Homo sapiens
aaatgtaacatcataatta

SEQ ID NO: 3316287 - DNA, 17 bp, Homo sapiens
aaatgtaacttttgtaa

SEQ ID NO: 3316288 - DNA, 12 bp, Homo sapiens
aaatgtaattga

SEQ ID NO: 3316289 - DNA, 14 bp, Homo sapiens
aaatgtaatttaaa

SEQ ID NO: 3316290 - DNA, 17 bp, Homo sapiens
aaatgtaatttaaatga

SEQ ID NO: 3316291 - DNA, 18 bp, Homo sapiens
aaatgtacatttattcat

SEQ ID NO: 3316292 - DNA, 16 bp, Homo sapiens
aaatgtacctgatgta

SEQ ID NO: 3316293 - DNA, 15 bp, Homo sapiens
aaatgtacttttgga

SEQ ID NO: 3316294 - DNA, 18 bp, Homo sapiens
aaatgtagaaattcttca

SEQ ID NO: 3316295 - DNA, 16 bp, Homo sapiens
aaatgtaggtatgaat

SEQ ID NO: 3316296 - DNA, 13 bp, Homo sapiens
aaatgtataaata

SEQ ID NO: 3316297 - DNA, 14 bp, Homo sapiens
aaatgtatatacac

SEQ ID NO: 3316298 - DNA, 15 bp, Homo sapiens
aaatgtatatacaca

SEQ ID NO: 3316299 - DNA, 16 bp, Homo sapiens
aaatgtatatacacat

SEQ ID NO: 3316300 - DNA, 18 bp, Homo sapiens
aaatgtatatacacatat

SEQ ID NO: 3316301 - DNA, 23 bp, Homo sapiens
aaatgtatatacacatataccta

SEQ ID NO: 3316302 - DNA, 17 bp, Homo sapiens
aaatgtatatatttagt

SEQ ID NO: 3316303 - DNA, 17 bp, Homo sapiens
aaatgtatcatagaaat

SEQ ID NO: 3316304 - DNA, 20 bp, Homo sapiens
aaatgtatcatagaaatgta

SEQ ID NO: 3316305 - DNA, 20 bp, Homo sapiens
aaatgtatctaagaataata

SEQ ID NO: 3316306 - DNA, 13 bp, Homo sapiens
aaatgtatgcatt

SEQ ID NO: 3316307 - DNA, 15 bp, Homo sapiens
aaatgtattcaaata

SEQ ID NO: 3316308 - DNA, 13 bp, Homo sapiens
aaatgtattcaag

SEQ ID NO: 3316309 - DNA, 23 bp, Homo sapiens
aaatgtatttaattaaatctcaa

SEQ ID NO: 3316310 - DNA, 17 bp, Homo sapiens
aaatgtcatcaaatatt

SEQ ID NO: 3316311 - DNA, 21 bp, Homo sapiens
aaatgtctatagagaaaaact

SEQ ID NO: 3316312 - DNA, 19 bp, Homo sapiens
aaatgtgaaaaaaattatt

SEQ ID NO: 3316313 - DNA, 17 bp, Homo sapiens
aaatgtgaatttttatt

SEQ ID NO: 3316314 - DNA, 22 bp, Homo sapiens
aaatgtgatgttctaaggctct

SEQ ID NO: 3316315 - DNA, 13 bp, Homo sapiens
aaatgtgattttt

SEQ ID NO: 3316316 - DNA, 15 bp, Homo sapiens
aaatgtggctcctgg

SEQ ID NO: 3316317 - DNA, 22 bp, Homo sapiens
aaatgtgtacagtgaattgtct

SEQ ID NO: 3316318 - DNA, 12 bp, Homo sapiens
aaatgtgtacat

SEQ ID NO: 3316319 - DNA, 15 bp, Homo sapiens
aaatgtgtcaatgta

SEQ ID NO: 3316320 - DNA, 20 bp, Homo sapiens
aaatgtgtcctatctatctt

SEQ ID NO: 3316321 - DNA, 21 bp, Homo sapiens
aaatgtgtcctatctatcttc

SEQ ID NO: 3316322 - DNA, 13 bp, Homo sapiens
aaatgtgtttgct

SEQ ID NO: 3316323 - DNA, 14 bp, Homo sapiens
aaatgttaaaagtt

SEQ ID NO: 3316324 - DNA, 18 bp, Homo sapiens
aaatgttaactacatatt

SEQ ID NO: 3316325 - DNA, 17 bp, Homo sapiens
aaatgttagatattgct

SEQ ID NO: 3316326 - DNA, 17 bp, Homo sapiens
aaatgttatcttctcaa

SEQ ID NO: 3316327 - DNA, 18 bp, Homo sapiens
aaatgttcatcaattccc

SEQ ID NO: 3316328 - DNA, 17 bp, Homo sapiens
aaatgttctaagtttct

SEQ ID NO: 3316329 - DNA, 13 bp, Homo sapiens
aaatgttctcaaa

SEQ ID NO: 3316330 - DNA, 12 bp, Homo sapiens
aaatgttgaata

SEQ ID NO: 3316331 - DNA, 15 bp, Homo sapiens
aaatgttgaataaaa

SEQ ID NO: 3316332 - DNA, 12 bp, Homo sapiens
aaatgttgagaa

SEQ ID NO: 3316333 - DNA, 17 bp, Homo sapiens
aaatgttggaatgttat

SEQ ID NO: 3316334 - DNA, 11 bp, Homo sapiens
aaatgtttctt

SEQ ID NO: 3316335 - DNA, 18 bp, Homo sapiens
aaatgtttcttttccctt

SEQ ID NO: 3316336 - DNA, 14 bp, Homo sapiens
aaatgtttgacaca

SEQ ID NO: 3316337 - DNA, 20 bp, Homo sapiens
aaatgtttgttaaaaataaa

SEQ ID NO: 3316338 - DNA, 21 bp, Homo sapiens
aaatgtttttctgccagggag

SEQ ID NO: 3316339 - DNA, 23 bp, Homo sapiens
aaatgtttttctgccagggagct

SEQ ID NO: 3316340 - DNA, 22 bp, Homo sapiens
aaattaaaaaaaaattgtatct

SEQ ID NO: 3316341 - DNA, 18 bp, Homo sapiens
aaattaaaaagattcttt

SEQ ID NO: 3316342 - DNA, 23 bp, Homo sapiens
aaattaaaaagattctttttctg

SEQ ID NO: 3316343 - DNA, 12 bp, Homo sapiens
aaattaaatgcc

SEQ ID NO: 3316344 - DNA, 11 bp, Homo sapiens
aaattaacaca

SEQ ID NO: 3316345 - DNA, 14 bp, Homo sapiens
aaattaactgtatg

SEQ ID NO: 3316346 - DNA, 13 bp, Homo sapiens
aaattaagacttt

SEQ ID NO: 3316347 - DNA, 13 bp, Homo sapiens
aaattaagcaaat

SEQ ID NO: 3316348 - DNA, 14 bp, Homo sapiens
aaattaatatcttt

SEQ ID NO: 3316349 - DNA, 17 bp, Homo sapiens
aaattaatatctttctg

SEQ ID NO: 3316350 - DNA, 16 bp, Homo sapiens
aaattaatatgattat

SEQ ID NO: 3316351 - DNA, 14 bp, Homo sapiens
aaattaattttact

SEQ ID NO: 3316352 - DNA, 11 bp, Homo sapiens
aaattacagat

SEQ ID NO: 3316353 - DNA, 14 bp, Homo sapiens
aaattacagcttca

SEQ ID NO: 3316354 - DNA, 14 bp, Homo sapiens
aaattacagctttt

SEQ ID NO: 3316355 - DNA, 22 bp, Homo sapiens
aaattacagcttttatggatga

SEQ ID NO: 3316356 - DNA, 14 bp, Homo sapiens
aaattacatatact

SEQ ID NO: 3316357 - DNA, 15 bp, Homo sapiens
aaattacctgtggat

SEQ ID NO: 3316358 - DNA, 22 bp, Homo sapiens
aaattactaattttacacatta

SEQ ID NO: 3316359 - DNA, 15 bp, Homo sapiens
aaattactacaaaat

SEQ ID NO: 3316360 - DNA, 14 bp, Homo sapiens
aaattacttttctg

SEQ ID NO: 3316361 - DNA, 12 bp, Homo sapiens
aaattagaaaat

SEQ ID NO: 3316362 - DNA, 20 bp, Homo sapiens
aaattagaaaatgttattta

SEQ ID NO: 3316363 - DNA, 23 bp, Homo sapiens
aaattagaaaccttaatatgtgg

SEQ ID NO: 3316364 - DNA, 14 bp, Homo sapiens
aaattagatgaact

SEQ ID NO: 3316365 - DNA, 14 bp, Homo sapiens
aaattaggaataaa

SEQ ID NO: 3316366 - DNA, 15 bp, Homo sapiens
aaattaggaataaat

SEQ ID NO: 3316367 - DNA, 23 bp, Homo sapiens
aaattaggaggctcaacaataaa

SEQ ID NO: 3316368 - DNA, 18 bp, Homo sapiens
aaattaggatttcatgat

SEQ ID NO: 3316369 - DNA, 19 bp, Homo sapiens
aaattaggatttcatgatt

SEQ ID NO: 3316370 - DNA, 13 bp, Homo sapiens
aaattataaactt

SEQ ID NO: 3316371 - DNA, 16 bp, Homo sapiens
aaattatactgtagct

SEQ ID NO: 3316372 - DNA, 15 bp, Homo sapiens
aaattatatatttat

SEQ ID NO: 3316373 - DNA, 17 bp, Homo sapiens
aaattatcctctttgta

SEQ ID NO: 3316374 - DNA, 17 bp, Homo sapiens
aaattatgagatttttt

SEQ ID NO: 3316375 - DNA, 19 bp, Homo sapiens
aaattattataagcattga

SEQ ID NO: 3316376 - DNA, 22 bp, Homo sapiens
aaattattataagcattgaaat

SEQ ID NO: 3316377 - DNA, 15 bp, Homo sapiens
aaattatttcttaat

SEQ ID NO: 3316378 - DNA, 16 bp, Homo sapiens
aaattatttgtaagat

SEQ ID NO: 3316379 - DNA, 17 bp, Homo sapiens
aaattattttaaacaaa

SEQ ID NO: 3316380 - DNA, 19 bp, Homo sapiens
aaattcaaaacctgcagtt

SEQ ID NO: 3316381 - DNA, 16 bp, Homo sapiens
aaattcaactttgtaa

SEQ ID NO: 3316382 - DNA, 13 bp, Homo sapiens
aaattcaatgatt

SEQ ID NO: 3316383 - DNA, 16 bp, Homo sapiens
aaattcacaatagaaa

SEQ ID NO: 3316384 - DNA, 22 bp, Homo sapiens
aaattcaccccctttcctggac

SEQ ID NO: 3316385 - DNA, 20 bp, Homo sapiens
aaattcagatatatttttca

SEQ ID NO: 3316386 - DNA, 14 bp, Homo sapiens
aaattcagtttcat

SEQ ID NO: 3316387 - DNA, 18 bp, Homo sapiens
aaattcagtttttgtatc

SEQ ID NO: 3316388 - DNA, 23 bp, Homo sapiens
aaattcagtttttgtatcttggg

SEQ ID NO: 3316389 - DNA, 16 bp, Homo sapiens
aaattcatattctgtc

SEQ ID NO: 3316390 - DNA, 18 bp, Homo sapiens
aaattccaaagtctctaa

SEQ ID NO: 3316391 - DNA, 21 bp, Homo sapiens
aaattccaaagtctctaattc

SEQ ID NO: 3316392 - DNA, 22 bp, Homo sapiens
aaattcctactccctcttccaa

SEQ ID NO: 3316393 - DNA, 19 bp, Homo sapiens
aaattccttgccccacagt

SEQ ID NO: 3316394 - DNA, 22 bp, Homo sapiens
aaattccttgccccacagttgt

SEQ ID NO: 3316395 - DNA, 17 bp, Homo sapiens
aaattctactaagttat

SEQ ID NO: 3316396 - DNA, 19 bp, Homo sapiens
aaattctactaagttattt

SEQ ID NO: 3316397 - DNA, 23 bp, Homo sapiens
aaattctactaagttattttatg

SEQ ID NO: 3316398 - DNA, 23 bp, Homo sapiens
aaattctataggaacatatgaaa

SEQ ID NO: 3316399 - DNA, 20 bp, Homo sapiens
aaattctcagtcagtaattg

SEQ ID NO: 3316400 - DNA, 12 bp, Homo sapiens
aaattctcttct

SEQ ID NO: 3316401 - DNA, 9 bp, Homo sapiens
aaattctgt

SEQ ID NO: 3316402 - DNA, 17 bp, Homo sapiens
aaattcttgaagttcat

SEQ ID NO: 3316403 - DNA, 18 bp, Homo sapiens
aaattcttgaagttcatg

SEQ ID NO: 3316404 - DNA, 21 bp, Homo sapiens
aaattcttttttaaattttct

SEQ ID NO: 3316405 - DNA, 14 bp, Homo sapiens
aaattgaagccaga

SEQ ID NO: 3316406 - DNA, 21 bp, Homo sapiens
aaattgaataggtagtatcat

SEQ ID NO: 3316407 - DNA, 23 bp, Homo sapiens
aaattgaatcagtataaacaaag

SEQ ID NO: 3316408 - DNA, 22 bp, Homo sapiens
aaattgaggtttggaagagtga

SEQ ID NO: 3316409 - DNA, 11 bp, Homo sapiens
aaattgatttt

SEQ ID NO: 3316410 - DNA, 20 bp, Homo sapiens
aaattgcacacactcagtgc

SEQ ID NO: 3316411 - DNA, 14 bp, Homo sapiens
aaattgcactgaag

SEQ ID NO: 3316412 - DNA, 17 bp, Homo sapiens
aaattgcataaagcata

SEQ ID NO: 3316413 - DNA, 14 bp, Homo sapiens
aaattgcatacttt

SEQ ID NO: 3316414 - DNA, 21 bp, Homo sapiens
aaattgccattggacagttgt

SEQ ID NO: 3316415 - DNA, 13 bp, Homo sapiens
aaattgccatttt

SEQ ID NO: 3316416 - DNA, 17 bp, Homo sapiens
aaattgctatgttacta

SEQ ID NO: 3316417 - DNA, 21 bp, Homo sapiens
aaattgctatgttactatttt

SEQ ID NO: 3316418 - DNA, 22 bp, Homo sapiens
aaattgctcctaactccaccgc

SEQ ID NO: 3316419 - DNA, 19 bp, Homo sapiens
aaattgcttttgttgtgac

SEQ ID NO: 3316420 - DNA, 12 bp, Homo sapiens
aaattgcttttt

SEQ ID NO: 3316421 - DNA, 15 bp, Homo sapiens
aaattggtgataagt

SEQ ID NO: 3316422 - DNA, 18 bp, Homo sapiens
aaattggtgataagtgga

SEQ ID NO: 3316423 - DNA, 18 bp, Homo sapiens
aaattgtcacctctgtta

SEQ ID NO: 3316424 - DNA, 18 bp, Homo sapiens
aaattgtcgtttttattc

SEQ ID NO: 3316425 - DNA, 23 bp, Homo sapiens
aaattgtgtacactttcattact

SEQ ID NO: 3316426 - DNA, 19 bp, Homo sapiens
aaattgtgttgtcttcagc

SEQ ID NO: 3316427 - DNA, 19 bp, Homo sapiens
aaattgtttagtggaaaat

SEQ ID NO: 3316428 - DNA, 14 bp, Homo sapiens
aaattgttttcact

SEQ ID NO: 3316429 - DNA, 15 bp, Homo sapiens
aaattgttttcactt

SEQ ID NO: 3316430 - DNA, 19 bp, Homo sapiens
aaattgttttcacttgtat

SEQ ID NO: 3316431 - DNA, 20 bp, Homo sapiens
aaattgttttcacttgtatt

SEQ ID NO: 3316432 - DNA, 22 bp, Homo sapiens
aaattgttttcacttgtattga

SEQ ID NO: 3316433 - DNA, 13 bp, Homo sapiens
aaatttaaacatt

SEQ ID NO: 3316434 - DNA, 19 bp, Homo sapiens
aaatttaactctggtttct

SEQ ID NO: 3316435 - DNA, 16 bp, Homo sapiens
aaatttaagcattgtt

SEQ ID NO: 3316436 - DNA, 17 bp, Homo sapiens
aaatttaatgctgcctt

SEQ ID NO: 3316437 - DNA, 12 bp, Homo sapiens
aaatttactata

SEQ ID NO: 3316438 - DNA, 13 bp, Homo sapiens
aaatttatatact

SEQ ID NO: 3316439 - DNA, 23 bp, Homo sapiens
aaatttatcaaagcatagatgtt

SEQ ID NO: 3316440 - DNA, 13 bp, Homo sapiens
aaatttatgcatt

SEQ ID NO: 3316441 - DNA, 14 bp, Homo sapiens
aaatttatgcattt

SEQ ID NO: 3316442 - DNA, 15 bp, Homo sapiens
aaatttatgcatttc

SEQ ID NO: 3316443 - DNA, 18 bp, Homo sapiens
aaatttatgcatttcatt

SEQ ID NO: 3316444 - DNA, 20 bp, Homo sapiens
aaatttatgcatttcattca

SEQ ID NO: 3316445 - DNA, 14 bp, Homo sapiens
aaatttattttaat

SEQ ID NO: 3316446 - DNA, 13 bp, Homo sapiens
aaatttcattttc

SEQ ID NO: 3316447 - DNA, 22 bp, Homo sapiens
aaatttccagtacctttgtcac

SEQ ID NO: 3316448 - DNA, 18 bp, Homo sapiens
aaatttctgtaaaacagg

SEQ ID NO: 3316449 - DNA, 17 bp, Homo sapiens
aaatttgactaatttta

SEQ ID NO: 3316450 - DNA, 18 bp, Homo sapiens
aaatttgactaattttac

SEQ ID NO: 3316451 - DNA, 15 bp, Homo sapiens
aaatttgattgattt

SEQ ID NO: 3316452 - DNA, 15 bp, Homo sapiens
aaatttgatttccat

SEQ ID NO: 3316453 - DNA, 14 bp, Homo sapiens
aaatttgatttcta

SEQ ID NO: 3316454 - DNA, 13 bp, Homo sapiens
aaatttgtaagtt

SEQ ID NO: 3316455 - DNA, 16 bp, Homo sapiens
aaatttgtaagtttca

SEQ ID NO: 3316456 - DNA, 19 bp, Homo sapiens
aaatttgtaagtttcaggt

SEQ ID NO: 3316457 - DNA, 18 bp, Homo sapiens
aaatttgtttgaaatctt

SEQ ID NO: 3316458 - DNA, 18 bp, Homo sapiens
aaatttgtttgtattttt

SEQ ID NO: 3316459 - DNA, 15 bp, Homo sapiens
aaattttaactaaat

SEQ ID NO: 3316460 - DNA, 15 bp, Homo sapiens
aaattttagaaatat

SEQ ID NO: 3316461 - DNA, 15 bp, Homo sapiens
aaattttagtacatt

SEQ ID NO: 3316462 - DNA, 15 bp, Homo sapiens
aaattttagtccaaa

SEQ ID NO: 3316463 - DNA, 18 bp, Homo sapiens
aaattttatttcctggac

SEQ ID NO: 3316464 - DNA, 19 bp, Homo sapiens
aaattttctagactttctg

SEQ ID NO: 3316465 - DNA, 14 bp, Homo sapiens
aaattttgcaaata

SEQ ID NO: 3316466 - DNA, 15 bp, Homo sapiens
aaattttgcaaatat

SEQ ID NO: 3316467 - DNA, 21 bp, Homo sapiens
aaattttgctatcaacaataa

SEQ ID NO: 3316468 - DNA, 15 bp, Homo sapiens
aaatttttatttttc

SEQ ID NO: 3316469 - DNA, 20 bp, Homo sapiens
aaatttttcagatgcttctg

SEQ ID NO: 3316470 - DNA, 21 bp, Homo sapiens
aaatttttctcagtttgtata

SEQ ID NO: 3316471 - DNA, 15 bp, Homo sapiens
aaattttttgaaaca

SEQ ID NO: 3316472 - DNA, 22 bp, Homo sapiens
aaattttttttcaaaaatgctg

SEQ ID NO: 3316473 - DNA, 17 bp, Homo sapiens
aaattttttttttaata

SEQ ID NO: 3316474 - DNA, 17 bp, Homo sapiens
aacaaaaaacagattct

SEQ ID NO: 3316475 - DNA, 19 bp, Homo sapiens
aacaaaaacactaaaaata

SEQ ID NO: 3316476 - DNA, 16 bp, Homo sapiens
aacaaaaagaaatctt

SEQ ID NO: 3316477 - DNA, 11 bp, Homo sapiens
aacaaaaataa

SEQ ID NO: 3316478 - DNA, 15 bp, Homo sapiens
aacaaaagcaagact

SEQ ID NO: 3316479 - DNA, 21 bp, Homo sapiens
aacaaaagcgacccattcaga

SEQ ID NO: 3316480 - DNA, 17 bp, Homo sapiens
aacaaaatctaaaacaa

SEQ ID NO: 3316481 - DNA, 19 bp, Homo sapiens
aacaaaatttgtttgaaat

SEQ ID NO: 3316482 - DNA, 10 bp, Homo sapiens
aacaaaccat

SEQ ID NO: 3316483 - DNA, 17 bp, Homo sapiens
aacaaagcacagtgtta

SEQ ID NO: 3316484 - DNA, 21 bp, Homo sapiens
aacaaagccaaacaaaactga

SEQ ID NO: 3316485 - DNA, 22 bp, Homo sapiens
aacaaagctgttaaactgttag

SEQ ID NO: 3316486 - DNA, 13 bp, Homo sapiens
aacaaagttacta

SEQ ID NO: 3316487 - DNA, 13 bp, Homo sapiens
aacaaataaataa

SEQ ID NO: 3316488 - DNA, 16 bp, Homo sapiens
aacaaataatcacatt

SEQ ID NO: 3316489 - DNA, 18 bp, Homo sapiens
aacaaatatgctaatttg

SEQ ID NO: 3316490 - DNA, 23 bp, Homo sapiens
aacaaatattgccaactcttcta

SEQ ID NO: 3316491 - DNA, 20 bp, Homo sapiens
aacaaatgctctgtcttcaa

SEQ ID NO: 3316492 - DNA, 20 bp, Homo sapiens
aacaaattatgttacatctg

SEQ ID NO: 3316493 - DNA, 21 bp, Homo sapiens
aacaacccacaccgtcttcct

SEQ ID NO: 3316494 - DNA, 14 bp, Homo sapiens
aacaacctcaactg

SEQ ID NO: 3316495 - DNA, 22 bp, Homo sapiens
aacaacgcttgtgaatgtattt

SEQ ID NO: 3316496 - DNA, 23 bp, Homo sapiens
aacaacgtgagagaaagagagaa

SEQ ID NO: 3316497 - DNA, 16 bp, Homo sapiens
aacaactaggcttcag

SEQ ID NO: 3316498 - DNA, 17 bp, Homo sapiens
aacaacttggcatttct

SEQ ID NO: 3316499 - DNA, 13 bp, Homo sapiens
aacaagaaaacat

SEQ ID NO: 3316500 - DNA, 14 bp, Homo sapiens
aacaagaaaacata

SEQ ID NO: 3316501 - DNA, 17 bp, Homo sapiens
aacaagaggggaaaaca

SEQ ID NO: 3316502 - DNA, 19 bp, Homo sapiens
aacaagatctttcaggaaa

SEQ ID NO: 3316503 - DNA, 19 bp, Homo sapiens
aacaagatttgtaattaca

SEQ ID NO: 3316504 - DNA, 13 bp, Homo sapiens
aacaagcatgcag

SEQ ID NO: 3316505 - DNA, 16 bp, Homo sapiens
aacaagcccaaattta

SEQ ID NO: 3316506 - DNA, 20 bp, Homo sapiens
aacaagccctgcttttgcat

SEQ ID NO: 3316507 - DNA, 14 bp, Homo sapiens
aacaagctgtgcag

SEQ ID NO: 3316508 - DNA, 19 bp, Homo sapiens
aacaaggaatgcctgtgcc

SEQ ID NO: 3316509 - DNA, 16 bp, Homo sapiens
aacaaggtagttttta

SEQ ID NO: 3316510 - DNA, 16 bp, Homo sapiens
aacaaggttcttctaa

SEQ ID NO: 3316511 - DNA, 22 bp, Homo sapiens
aacaaggttcttctaaaattga

SEQ ID NO: 3316512 - DNA, 17 bp, Homo sapiens
aacaagtaagaaaaata

SEQ ID NO: 3316513 - DNA, 15 bp, Homo sapiens
aacaataaaacatta

SEQ ID NO: 3316514 - DNA, 16 bp, Homo sapiens
aacaataaaacattat

SEQ ID NO: 3316515 - DNA, 14 bp, Homo sapiens
aacaataaagagat

SEQ ID NO: 3316516 - DNA, 16 bp, Homo sapiens
aacaataaagtgacaa

SEQ ID NO: 3316517 - DNA, 20 bp, Homo sapiens
acatggtgcctgagaggcag

SEQ ID NO: 3316518 - DNA, 14 bp, Homo sapiens
acatggtttaaaag

SEQ ID NO: 3316519 - DNA, 20 bp, Homo sapiens
acatgtaataaaaagtatat

SEQ ID NO: 3316520 - DNA, 14 bp, Homo sapiens
acatgtaataaatt

SEQ ID NO: 3316521 - DNA, 18 bp, Homo sapiens
acatgtaataaattcaaa

SEQ ID NO: 3316522 - DNA, 15 bp, Homo sapiens
acatgtaattaagta

SEQ ID NO: 3316523 - DNA, 21 bp, Homo sapiens
acatgtcatttgactgtctca

SEQ ID NO: 3316524 - DNA, 19 bp, Homo sapiens
acatgtcctaattcttctg

SEQ ID NO: 3316525 - DNA, 13 bp, Homo sapiens
acatgtcttccat

SEQ ID NO: 3316526 - DNA, 20 bp, Homo sapiens
acatgtcttccatgtatctt

SEQ ID NO: 3316527 - DNA, 13 bp, Homo sapiens
acatgtcttgtac

SEQ ID NO: 3316528 - DNA, 16 bp, Homo sapiens
acatgtcttgtacatg

SEQ ID NO: 3316529 - DNA, 19 bp, Homo sapiens
acatgtcttgtacatgtgt

SEQ ID NO: 3316530 - DNA, 15 bp, Homo sapiens
acatgtgaaaccttt

SEQ ID NO: 3316531 - DNA, 14 bp, Homo sapiens
acatgtgacacata

SEQ ID NO: 3316532 - DNA, 21 bp, Homo sapiens
acatgtgacacatatgcacct

SEQ ID NO: 3316533 - DNA, 14 bp, Homo sapiens
acatgtgacattta

SEQ ID NO: 3316534 - DNA, 18 bp, Homo sapiens
acatgtgaggaggaaaag

SEQ ID NO: 3316535 - DNA, 19 bp, Homo sapiens
acatgtgaggaggaaaagg

SEQ ID NO: 3316536 - DNA, 20 bp, Homo sapiens
acatgtgaggaggaaaagga

SEQ ID NO: 3316537 - DNA, 16 bp, Homo sapiens
acatgtgcacatgcac

SEQ ID NO: 3316538 - DNA, 18 bp, Homo sapiens
acatgtgccttttctgaa

SEQ ID NO: 3316539 - DNA, 13 bp, Homo sapiens
acatgtggtttat

SEQ ID NO: 3316540 - DNA, 14 bp, Homo sapiens
acatgtgtaaaggt

SEQ ID NO: 3316541 - DNA, 17 bp, Homo sapiens
acatgtgtagcctgtgc

SEQ ID NO: 3316542 - DNA, 16 bp, Homo sapiens
acatgtgtatttatac

SEQ ID NO: 3316543 - DNA, 23 bp, Homo sapiens
acatgtgtcaacacccctgtgtg

SEQ ID NO: 3316544 - DNA, 12 bp, Homo sapiens
acatgtgtgtat

SEQ ID NO: 3316545 - DNA, 13 bp, Homo sapiens
acatgtgtgtata

SEQ ID NO: 3316546 - DNA, 17 bp, Homo sapiens
acatgtgtgtatatatg

SEQ ID NO: 3316547 - DNA, 22 bp, Homo sapiens
acatgtgtgtatatatgtgtat

SEQ ID NO: 3316548 - DNA, 23 bp, Homo sapiens
acatgtgtgtatatatgtgtata

SEQ ID NO: 3316549 - DNA, 12 bp, Homo sapiens
acatgtgtttta

SEQ ID NO: 3316550 - DNA, 22 bp, Homo sapiens
acatgttaagataacttactgt

SEQ ID NO: 3316551 - DNA, 16 bp, Homo sapiens
acatgttactgaccag

SEQ ID NO: 3316552 - DNA, 15 bp, Homo sapiens
acatgttattcaatg

SEQ ID NO: 3316553 - DNA, 11 bp, Homo sapiens
acatgttcata

SEQ ID NO: 3316554 - DNA, 16 bp, Homo sapiens
acattaaaaatggaac

SEQ ID NO: 3316555 - DNA, 18 bp, Homo sapiens
acattaaaagaagactgg

SEQ ID NO: 3316556 - DNA, 20 bp, Homo sapiens
acattaaaagaagactggaa

SEQ ID NO: 3316557 - DNA, 17 bp, Homo sapiens
acattaaatgtcttata

SEQ ID NO: 3316558 - DNA, 20 bp, Homo sapiens
acattaacagttttccatga

SEQ ID NO: 3316559 - DNA, 14 bp, Homo sapiens
acattaacttgaaa

SEQ ID NO: 3316560 - DNA, 14 bp, Homo sapiens
acattaagaatgtt

SEQ ID NO: 3316561 - DNA, 22 bp, Homo sapiens
acattaatgttaattcagcact

SEQ ID NO: 3316562 - DNA, 17 bp, Homo sapiens
acattaattaattaaag

SEQ ID NO: 3316563 - DNA, 12 bp, Homo sapiens
acattacagttc

SEQ ID NO: 3316564 - DNA, 16 bp, Homo sapiens
acattaccttactgtg

SEQ ID NO: 3316565 - DNA, 18 bp, Homo sapiens
acattagaacactgcatt

SEQ ID NO: 3316566 - DNA, 22 bp, Homo sapiens
acattagcagtttgctttgtat

SEQ ID NO: 3316567 - DNA, 14 bp, Homo sapiens
acattatattgcaa

SEQ ID NO: 3316568 - DNA, 15 bp, Homo sapiens
acattatattgcaat

SEQ ID NO: 3316569 - DNA, 18 bp, Homo sapiens
acattatcgggagcagtg

SEQ ID NO: 3316570 - DNA, 19 bp, Homo sapiens
acattatcgggagcagtgt

SEQ ID NO: 3316571 - DNA, 21 bp, Homo sapiens
acattatcgggagcagtgtct

SEQ ID NO: 3316572 - DNA, 22 bp, Homo sapiens
acattatcgggagcagtgtctt

SEQ ID NO: 3316573 - DNA, 21 bp, Homo sapiens
acattatgtggttttagattt

SEQ ID NO: 3316574 - DNA, 20 bp, Homo sapiens
acattatgtgtgcatgtgtg

SEQ ID NO: 3316575 - DNA, 21 bp, Homo sapiens
acattatgtgtgcatgtgtgt

SEQ ID NO: 3316576 - DNA, 23 bp, Homo sapiens
acattattgtcccacaatattac

SEQ ID NO: 3316577 - DNA, 16 bp, Homo sapiens
acattatttctagtcc

SEQ ID NO: 3316578 - DNA, 13 bp, Homo sapiens
acattatttgcat

SEQ ID NO: 3316579 - DNA, 20 bp, Homo sapiens
acattcacacagggctcttt

SEQ ID NO: 3316580 - DNA, 16 bp, Homo sapiens
acattcagctctggag

SEQ ID NO: 3316581 - DNA, 17 bp, Homo sapiens
acattcagctctggaga

SEQ ID NO: 3316582 - DNA, 19 bp, Homo sapiens
acattcaggaattcttgga

SEQ ID NO: 3316583 - DNA, 20 bp, Homo sapiens
acattcatcaatatccctct

SEQ ID NO: 3316584 - DNA, 14 bp, Homo sapiens
acattccctctcct

SEQ ID NO: 3316585 - DNA, 17 bp, Homo sapiens
acattccctctcctgcc

SEQ ID NO: 3316586 - DNA, 18 bp, Homo sapiens
acattcctaactagaatt

SEQ ID NO: 3316587 - DNA, 14 bp, Homo sapiens
acattcgatctcat

SEQ ID NO: 3316588 - DNA, 16 bp, Homo sapiens
acattcgatctcattc

SEQ ID NO: 3316589 - DNA, 22 bp, Homo sapiens
acattctattttgggtattaat

SEQ ID NO: 3316590 - DNA, 19 bp, Homo sapiens
acattctgatttggaaaaa

SEQ ID NO: 3316591 - DNA, 18 bp, Homo sapiens
acattctgcctagagtgt

SEQ ID NO: 3316592 - DNA, 19 bp, Homo sapiens
acattctgcctagagtgta

SEQ ID NO: 3316593 - DNA, 20 bp, Homo sapiens
acattctggggaaacaacat

SEQ ID NO: 3316594 - DNA, 22 bp, Homo sapiens
acattctgtcgccttagcatgt

SEQ ID NO: 3316595 - DNA, 16 bp, Homo sapiens
acattgaatgcgcttt

SEQ ID NO: 3316596 - DNA, 24 bp, Homo sapiens
acattgacacacagaaatgtgtca

SEQ ID NO: 3316597 - DNA, 17 bp, Homo sapiens
acattgaccaagaactg

SEQ ID NO: 3316598 - DNA, 19 bp, Homo sapiens
acattgacgattccttctc

SEQ ID NO: 3316599 - DNA, 22 bp, Homo sapiens
acattgacgattccttctctga

SEQ ID NO: 3316600 - DNA, 23 bp, Homo sapiens
acattgagctgatataaattctg

SEQ ID NO: 3316601 - DNA, 22 bp, Homo sapiens
acattgcggacagccacggcca

SEQ ID NO: 3316602 - DNA, 15 bp, Homo sapiens
acattgcgtttgacc

SEQ ID NO: 3316603 - DNA, 15 bp, Homo sapiens
acattgcttttgaaa

SEQ ID NO: 3316604 - DNA, 21 bp, Homo sapiens
acattggtgaaggatccagga

SEQ ID NO: 3316605 - DNA, 23 bp, Homo sapiens
acattggtgaaggatccaggaat

SEQ ID NO: 3316606 - DNA, 19 bp, Homo sapiens
acattgtctcctatatatt

SEQ ID NO: 3316607 - DNA, 22 bp, Homo sapiens
acattgtctcctatatatttct

SEQ ID NO: 3316608 - DNA, 23 bp, Homo sapiens
acattgtgtgaaaaaagaaaatg

SEQ ID NO: 3316609 - DNA, 16 bp, Homo sapiens
acattgttatttctgt

SEQ ID NO: 3316610 - DNA, 17 bp, Homo sapiens
acattgttcttattctg

SEQ ID NO: 3316611 - DNA, 17 bp, Homo sapiens
acattgtttgctgctat

SEQ ID NO: 3316612 - DNA, 18 bp, Homo sapiens
acattgtttgctgctatt

SEQ ID NO: 3316613 - DNA, 14 bp, Homo sapiens
acatttaaatcctt

SEQ ID NO: 3316614 - DNA, 12 bp, Homo sapiens
acatttaaatgt

SEQ ID NO: 3316615 - DNA, 16 bp, Homo sapiens
acatttaacttttcta

SEQ ID NO: 3316616 - DNA, 17 bp, Homo sapiens
acatttaatacagcagt

SEQ ID NO: 3316617 - DNA, 16 bp, Homo sapiens
acatttaatatcttca

SEQ ID NO: 3316618 - DNA, 18 bp, Homo sapiens
acatttacaccacacttt

SEQ ID NO: 3316619 - DNA, 17 bp, Homo sapiens
acatttagaaaagtgaa

SEQ ID NO: 3316620 - DNA, 14 bp, Homo sapiens
acatttagatttag

SEQ ID NO: 3316621 - DNA, 15 bp, Homo sapiens
acatttagtcctgta

SEQ ID NO: 3316622 - DNA, 16 bp, Homo sapiens
acatttatatttgtgt

SEQ ID NO: 3316623 - DNA, 15 bp, Homo sapiens
acatttattctgctc

SEQ ID NO: 3316624 - DNA, 15 bp, Homo sapiens
acatttatttcctcc

SEQ ID NO: 3316625 - DNA, 16 bp, Homo sapiens
acatttcaaagctgag

SEQ ID NO: 3316626 - DNA, 14 bp, Homo sapiens
acatttcaaagttt

SEQ ID NO: 3316627 - DNA, 14 bp, Homo sapiens
acatttcacctcct

SEQ ID NO: 3316628 - DNA, 14 bp, Homo sapiens
acatttcagggaga

SEQ ID NO: 3316629 - DNA, 16 bp, Homo sapiens
acatttccgaataaag

SEQ ID NO: 3316630 - DNA, 14 bp, Homo sapiens
acatttctctaact

SEQ ID NO: 3316631 - DNA, 20 bp, Homo sapiens
acatttctctaactcctgcc

SEQ ID NO: 3316632 - DNA, 18 bp, Homo sapiens
acatttctgatcagaggt

SEQ ID NO: 3316633 - DNA, 21 bp, Homo sapiens
acatttctgatcagaggtgta

SEQ ID NO: 3316634 - DNA, 12 bp, Homo sapiens
acatttctggat

SEQ ID NO: 3316635 - DNA, 15 bp, Homo sapiens
acatttctgtaaata

SEQ ID NO: 3316636 - DNA, 18 bp, Homo sapiens
acatttctgtaaatacca

SEQ ID NO: 3316637 - DNA, 13 bp, Homo sapiens
acatttctttctt

SEQ ID NO: 3316638 - DNA, 22 bp, Homo sapiens
acatttctttcttgctggctct

SEQ ID NO: 3316639 - DNA, 11 bp, Homo sapiens
acatttgatat

SEQ ID NO: 3316640 - DNA, 12 bp, Homo sapiens
acatttgatatt

SEQ ID NO: 3316641 - DNA, 17 bp, Homo sapiens
acatttgatatttttcc

SEQ ID NO: 3316642 - DNA, 13 bp, Homo sapiens
acatttgccttgc

SEQ ID NO: 3316643 - DNA, 16 bp, Homo sapiens
acatttgccttgcaga

SEQ ID NO: 3316644 - DNA, 14 bp, Homo sapiens
acatttgccttgct

SEQ ID NO: 3316645 - DNA, 23 bp, Homo sapiens
acatttgccttttgttaaaagat

SEQ ID NO: 3316646 - DNA, 16 bp, Homo sapiens
acagcagtctccttca

SEQ ID NO: 3316647 - DNA, 16 bp, Homo sapiens
acagcagtgtcatcag

SEQ ID NO: 3316648 - DNA, 13 bp, Homo sapiens
acagcatcagggt

SEQ ID NO: 3316649 - DNA, 22 bp, Homo sapiens
acagcatcgggagcacccagag

SEQ ID NO: 3316650 - DNA, 23 bp, Homo sapiens
acagcatgaataaaacactcatc

SEQ ID NO: 3316651 - DNA, 15 bp, Homo sapiens
acagcatgccccttg

SEQ ID NO: 3316652 - DNA, 17 bp, Homo sapiens
acagcatgccccttggc

SEQ ID NO: 3316653 - DNA, 21 bp, Homo sapiens
acagcatgtacggattttcag

SEQ ID NO: 3316654 - DNA, 13 bp, Homo sapiens
acagcatgtgtat

SEQ ID NO: 3316655 - DNA, 13 bp, Homo sapiens
acagcattgcttt

SEQ ID NO: 3316656 - DNA, 18 bp, Homo sapiens
acagcattgtctttgctg

SEQ ID NO: 3316657 - DNA, 15 bp, Homo sapiens
acagccaagtgtgac

SEQ ID NO: 3316658 - DNA, 16 bp, Homo sapiens
acagccatgcccgcat

SEQ ID NO: 3316659 - DNA, 20 bp, Homo sapiens
acagccattgcggccccagg

SEQ ID NO: 3316660 - DNA, 21 bp, Homo sapiens
acagccattgcggccccagga

SEQ ID NO: 3316661 - DNA, 20 bp, Homo sapiens
acagccatttgtaatgaatt

SEQ ID NO: 3316662 - DNA, 19 bp, Homo sapiens
acagcccaagaggactgag

SEQ ID NO: 3316663 - DNA, 10 bp, Homo sapiens
acagcccaga

SEQ ID NO: 3316664 - DNA, 15 bp, Homo sapiens
acagcccaggatact

SEQ ID NO: 3316665 - DNA, 19 bp, Homo sapiens
acagcccaggcatctcctt

SEQ ID NO: 3316666 - DNA, 20 bp, Homo sapiens
acagcccaggcatctccttg

SEQ ID NO: 3316667 - DNA, 17 bp, Homo sapiens
acagccccagagcaggg

SEQ ID NO: 3316668 - DNA, 17 bp, Homo sapiens
acagcccccttgccctc

SEQ ID NO: 3316669 - DNA, 12 bp, Homo sapiens
acagccctggga

SEQ ID NO: 3316670 - DNA, 13 bp, Homo sapiens
acagccctgggag

SEQ ID NO: 3316671 - DNA, 15 bp, Homo sapiens
acagcccttttgtga

SEQ ID NO: 3316672 - DNA, 22 bp, Homo sapiens
acagccgcagcctccctctgac

SEQ ID NO: 3316673 - DNA, 12 bp, Homo sapiens
acagcctagggt

SEQ ID NO: 3316674 - DNA, 18 bp, Homo sapiens
acagcctcacttgaatgt

SEQ ID NO: 3316675 - DNA, 21 bp, Homo sapiens
acagcctctgacccctcctca

SEQ ID NO: 3316676 - DNA, 15 bp, Homo sapiens
acagcctctggctcc

SEQ ID NO: 3316677 - DNA, 15 bp, Homo sapiens
acagcctcttcagcc

SEQ ID NO: 3316678 - DNA, 16 bp, Homo sapiens
acagcctcttcagccc

SEQ ID NO: 3316679 - DNA, 15 bp, Homo sapiens
acagcctgcaagtca

SEQ ID NO: 3316680 - DNA, 16 bp, Homo sapiens
acagcctggttttcac

SEQ ID NO: 3316681 - DNA, 16 bp, Homo sapiens
acagccttagctgcca

SEQ ID NO: 3316682 - DNA, 21 bp, Homo sapiens
acagccttggctcctgagaaa

SEQ ID NO: 3316683 - DNA, 16 bp, Homo sapiens
acagccttgtccccct

SEQ ID NO: 3316684 - DNA, 14 bp, Homo sapiens
acagcctttctgag

SEQ ID NO: 3316685 - DNA, 14 bp, Homo sapiens
acagcgacatagcc

SEQ ID NO: 3316686 - DNA, 20 bp, Homo sapiens
acagcgacatagcccatccc

SEQ ID NO: 3316687 - DNA, 14 bp, Homo sapiens
acagcgagggcagc

SEQ ID NO: 3316688 - DNA, 18 bp, Homo sapiens
acagcgagggcagctgct

SEQ ID NO: 3316689 - DNA, 19 bp, Homo sapiens
acagcgagggcagctgcta

SEQ ID NO: 3316690 - DNA, 14 bp, Homo sapiens
acagcgcccctgct

SEQ ID NO: 3316691 - DNA, 15 bp, Homo sapiens
acagcgcggaggagg

SEQ ID NO: 3316692 - DNA, 15 bp, Homo sapiens
acagcggaggtgtgg

SEQ ID NO: 3316693 - DNA, 15 bp, Homo sapiens
acagcggcccctgca

SEQ ID NO: 3316694 - DNA, 16 bp, Homo sapiens
acagcggcccctgcat

SEQ ID NO: 3316695 - DNA, 23 bp, Homo sapiens
acagcgtccctagcagtgaacta

SEQ ID NO: 3316696 - DNA, 17 bp, Homo sapiens
acagctaatgggacact

SEQ ID NO: 3316697 - DNA, 19 bp, Homo sapiens
acagctaatgggacactaa

SEQ ID NO: 3316698 - DNA, 21 bp, Homo sapiens
acagctatgggagccccaggg

SEQ ID NO: 3316699 - DNA, 14 bp, Homo sapiens
acagctatttaagg

SEQ ID NO: 3316700 - DNA, 20 bp, Homo sapiens
acagctcaagtcttccctga

SEQ ID NO: 3316701 - DNA, 17 bp, Homo sapiens
acagctcacctctgaag

SEQ ID NO: 3316702 - DNA, 13 bp, Homo sapiens
acagctcagccag

SEQ ID NO: 3316703 - DNA, 17 bp, Homo sapiens
acagctcagccagtggg

SEQ ID NO: 3316704 - DNA, 20 bp, Homo sapiens
acagctcagccagtggggat

SEQ ID NO: 3316705 - DNA, 14 bp, Homo sapiens
acagctcaggaggc

SEQ ID NO: 3316706 - DNA, 19 bp, Homo sapiens
acagctcaggaggcgccct

SEQ ID NO: 3316707 - DNA, 12 bp, Homo sapiens
acagctcctccc

SEQ ID NO: 3316708 - DNA, 14 bp, Homo sapiens
acagctcctcccac

SEQ ID NO: 3316709 - DNA, 23 bp, Homo sapiens
acagctcctcttaccgtagcctc

SEQ ID NO: 3316710 - DNA, 16 bp, Homo sapiens
acagctccttctgtcc

SEQ ID NO: 3316711 - DNA, 14 bp, Homo sapiens
acagctctgtcctg

SEQ ID NO: 3316712 - DNA, 17 bp, Homo sapiens
acagctctgtgttgcca

SEQ ID NO: 3316713 - DNA, 15 bp, Homo sapiens
acagctcttcattcc

SEQ ID NO: 3316714 - DNA, 16 bp, Homo sapiens
acagctcttcattcca

SEQ ID NO: 3316715 - DNA, 19 bp, Homo sapiens
acagctcttctccaggctg

SEQ ID NO: 3316716 - DNA, 20 bp, Homo sapiens
acagctcttctccaggctgt

SEQ ID NO: 3316717 - DNA, 18 bp, Homo sapiens
acagctgactgaatgcag

SEQ ID NO: 3316718 - DNA, 22 bp, Homo sapiens
acagctgagagacttttaatca

SEQ ID NO: 3316719 - DNA, 14 bp, Homo sapiens
acagctgagcactt

SEQ ID NO: 3316720 - DNA, 22 bp, Homo sapiens
acagctgaggtctcttgaggga

SEQ ID NO: 3316721 - DNA, 13 bp, Homo sapiens
acagctgcagctg

SEQ ID NO: 3316722 - DNA, 12 bp, Homo sapiens
acagctgcctgc

SEQ ID NO: 3316723 - DNA, 20 bp, Homo sapiens
acagctgtattgtctgaact

SEQ ID NO: 3316724 - DNA, 22 bp, Homo sapiens
acagctgtgttattctttgcgt

SEQ ID NO: 3316725 - DNA, 21 bp, Homo sapiens
acagctgttcttctgttctgc

SEQ ID NO: 3316726 - DNA, 14 bp, Homo sapiens
acagctgtttaaga

SEQ ID NO: 3316727 - DNA, 19 bp, Homo sapiens
acagctgtttaagatgggc

SEQ ID NO: 3316728 - DNA, 17 bp, Homo sapiens
acagcttaacaatgcaa

SEQ ID NO: 3316729 - DNA, 14 bp, Homo sapiens
acagcttagatttc

SEQ ID NO: 3316730 - DNA, 18 bp, Homo sapiens
acagcttagatttcatag

SEQ ID NO: 3316731 - DNA, 21 bp, Homo sapiens
acagcttcaccctgtcaagtt

SEQ ID NO: 3316732 - DNA, 22 bp, Homo sapiens
acagcttcaggttatcgaaata

SEQ ID NO: 3316733 - DNA, 17 bp, Homo sapiens
acagcttcatgcctttg

SEQ ID NO: 3316734 - DNA, 19 bp, Homo sapiens
acagcttcatgcctttgta

SEQ ID NO: 3316735 - DNA, 23 bp, Homo sapiens
acagcttcattatctgagttgca

SEQ ID NO: 3316736 - DNA, 15 bp, Homo sapiens
acagcttctctgcag

SEQ ID NO: 3316737 - DNA, 16 bp, Homo sapiens
acagcttgagccgggc

SEQ ID NO: 3316738 - DNA, 21 bp, Homo sapiens
acagcttgagccgggcccctg

SEQ ID NO: 3316739 - DNA, 22 bp, Homo sapiens
acagcttgagccgggcccctgg

SEQ ID NO: 3316740 - DNA, 21 bp, Homo sapiens
acagctttcttgctcccttca

SEQ ID NO: 3316741 - DNA, 22 bp, Homo sapiens
acagctttcttgctcccttcag

SEQ ID NO: 3316742 - DNA, 16 bp, Homo sapiens
acagctttgctccgct

SEQ ID NO: 3316743 - DNA, 20 bp, Homo sapiens
acagctttgctccgctccca

SEQ ID NO: 3316744 - DNA, 14 bp, Homo sapiens
acagcttttatgga

SEQ ID NO: 3316745 - DNA, 17 bp, Homo sapiens
acagcttttatggatga

SEQ ID NO: 3316746 - DNA, 21 bp, Homo sapiens
acagcttttgcaacttaatac

SEQ ID NO: 3316747 - DNA, 22 bp, Homo sapiens
acagcttttgcaacttaatact

SEQ ID NO: 3316748 - DNA, 20 bp, Homo sapiens
acaggaaaaaaaattctgtt

SEQ ID NO: 3316749 - DNA, 17 bp, Homo sapiens
acaggaaaagctgctga

SEQ ID NO: 3316750 - DNA, 18 bp, Homo sapiens
acaggaaaagctgctgac

SEQ ID NO: 3316751 - DNA, 20 bp, Homo sapiens
aatatctttgtgataattta

SEQ ID NO: 3316752 - DNA, 13 bp, Homo sapiens
aatatgaaaactt

SEQ ID NO: 3316753 - DNA, 21 bp, Homo sapiens
aatatgaaccctttgtttctt

SEQ ID NO: 3316754 - DNA, 16 bp, Homo sapiens
aatatgaacctatttt

SEQ ID NO: 3316755 - DNA, 19 bp, Homo sapiens
aatatgaacctattttcat

SEQ ID NO: 3316756 - DNA, 18 bp, Homo sapiens
aatatgaatacagggcat

SEQ ID NO: 3316757 - DNA, 13 bp, Homo sapiens
aatatgaccattt

SEQ ID NO: 3316758 - DNA, 17 bp, Homo sapiens
aatatgacggaagaaca

SEQ ID NO: 3316759 - DNA, 14 bp, Homo sapiens
aatatgatgacaat

SEQ ID NO: 3316760 - DNA, 20 bp, Homo sapiens
aatatgatgagattcactta

SEQ ID NO: 3316761 - DNA, 14 bp, Homo sapiens
aatatgattattaa

SEQ ID NO: 3316762 - DNA, 19 bp, Homo sapiens
aatatgattcactatttaa

SEQ ID NO: 3316763 - DNA, 20 bp, Homo sapiens
aatatgattttttaaaagaa

SEQ ID NO: 3316764 - DNA, 22 bp, Homo sapiens
aatatgattttttaaaagaaat

SEQ ID NO: 3316765 - DNA, 17 bp, Homo sapiens
aatatgcagaatctctg

SEQ ID NO: 3316766 - DNA, 22 bp, Homo sapiens
aatatgcagtgatatggcagaa

SEQ ID NO: 3316767 - DNA, 14 bp, Homo sapiens
aatatgctgccaaa

SEQ ID NO: 3316768 - DNA, 19 bp, Homo sapiens
aatatgctgccaaattttg

SEQ ID NO: 3316769 - DNA, 22 bp, Homo sapiens
aatatgctgccaaattttggcc

SEQ ID NO: 3316770 - DNA, 23 bp, Homo sapiens
aatatgcttaaaataagcaggtg

SEQ ID NO: 3316771 - DNA, 21 bp, Homo sapiens
aatatggaaccttccctccaa

SEQ ID NO: 3316772 - DNA, 14 bp, Homo sapiens
aatatggaacttac

SEQ ID NO: 3316773 - DNA, 20 bp, Homo sapiens
aatatggaacttacattgtt

SEQ ID NO: 3316774 - DNA, 20 bp, Homo sapiens
aatatggctagttttcaact

SEQ ID NO: 3316775 - DNA, 15 bp, Homo sapiens
aatatggctataaat

SEQ ID NO: 3316776 - DNA, 19 bp, Homo sapiens
aatatgggcattgtagtta

SEQ ID NO: 3316777 - DNA, 19 bp, Homo sapiens
aatatgtatatgacattta

SEQ ID NO: 3316778 - DNA, 12 bp, Homo sapiens
aatatgtcctgg

SEQ ID NO: 3316779 - DNA, 17 bp, Homo sapiens
aatatgttaaagtttaa

SEQ ID NO: 3316780 - DNA, 22 bp, Homo sapiens
aatatgttaacctcagtgtcat

SEQ ID NO: 3316781 - DNA, 18 bp, Homo sapiens
aatatgttgagtgttcat

SEQ ID NO: 3316782 - DNA, 15 bp, Homo sapiens
aatatgtttaaaata

SEQ ID NO: 3316783 - DNA, 19 bp, Homo sapiens
aatatgtttccttgtttat

SEQ ID NO: 3316784 - DNA, 17 bp, Homo sapiens
aatattaaaccctggat

SEQ ID NO: 3316785 - DNA, 14 bp, Homo sapiens
aatattaaatacag

SEQ ID NO: 3316786 - DNA, 22 bp, Homo sapiens
aatattaaatacagacactaag

SEQ ID NO: 3316787 - DNA, 14 bp, Homo sapiens
aatattaagacaat

SEQ ID NO: 3316788 - DNA, 17 bp, Homo sapiens
aatattaccttaagatt

SEQ ID NO: 3316789 - DNA, 14 bp, Homo sapiens
aatattagtgattc

SEQ ID NO: 3316790 - DNA, 15 bp, Homo sapiens
aatattagtgattct

SEQ ID NO: 3316791 - DNA, 17 bp, Homo sapiens
aatattagtgattctga

SEQ ID NO: 3316792 - DNA, 16 bp, Homo sapiens
aatattatactaagaa

SEQ ID NO: 3316793 - DNA, 13 bp, Homo sapiens
aatattattatga

SEQ ID NO: 3316794 - DNA, 20 bp, Homo sapiens
aatattatttgtgtttccta

SEQ ID NO: 3316795 - DNA, 16 bp, Homo sapiens
aatattcacatgttct

SEQ ID NO: 3316796 - DNA, 20 bp, Homo sapiens
aatattcagggtaaatagga

SEQ ID NO: 3316797 - DNA, 16 bp, Homo sapiens
aatattcattggttaa

SEQ ID NO: 3316798 - DNA, 16 bp, Homo sapiens
aatattccagatcttt

SEQ ID NO: 3316799 - DNA, 23 bp, Homo sapiens
aatattccagatctttcagaaat

SEQ ID NO: 3316800 - DNA, 12 bp, Homo sapiens
aatattcctgaa

SEQ ID NO: 3316801 - DNA, 14 bp, Homo sapiens
aatattctctattt

SEQ ID NO: 3316802 - DNA, 16 bp, Homo sapiens
aatattgagaaagaaa

SEQ ID NO: 3316803 - DNA, 21 bp, Homo sapiens
aatattgattgggaaaacatt

SEQ ID NO: 3316804 - DNA, 22 bp, Homo sapiens
aatattgattgggaaaacattt

SEQ ID NO: 3316805 - DNA, 16 bp, Homo sapiens
aatattgttgacaact

SEQ ID NO: 3316806 - DNA, 18 bp, Homo sapiens
aatattgttgtataattt

SEQ ID NO: 3316807 - DNA, 19 bp, Homo sapiens
aatattgttgtataatttc

SEQ ID NO: 3316808 - DNA, 22 bp, Homo sapiens
aatattgtttggtaaatgtttc

SEQ ID NO: 3316809 - DNA, 14 bp, Homo sapiens
aatattgtttttct

SEQ ID NO: 3316810 - DNA, 12 bp, Homo sapiens
aatatttaaaca

SEQ ID NO: 3316811 - DNA, 17 bp, Homo sapiens
aatatttaaacagcagt

SEQ ID NO: 3316812 - DNA, 21 bp, Homo sapiens
aatatttaacattatttatat

SEQ ID NO: 3316813 - DNA, 17 bp, Homo sapiens
aatatttaagaaaagca

SEQ ID NO: 3316814 - DNA, 18 bp, Homo sapiens
aatatttaagaaaagcac

SEQ ID NO: 3316815 - DNA, 22 bp, Homo sapiens
aatatttaagaaaagcactttt

SEQ ID NO: 3316816 - DNA, 17 bp, Homo sapiens
aatatttataaaacttc

SEQ ID NO: 3316817 - DNA, 17 bp, Homo sapiens
aatatttataacagcat

SEQ ID NO: 3316818 - DNA, 14 bp, Homo sapiens
aatatttatatatt

SEQ ID NO: 3316819 - DNA, 17 bp, Homo sapiens
aatatttatatttcact

SEQ ID NO: 3316820 - DNA, 18 bp, Homo sapiens
aatatttattaaataaaa

SEQ ID NO: 3316821 - DNA, 22 bp, Homo sapiens
aatatttattaaataaaatcaa

SEQ ID NO: 3316822 - DNA, 12 bp, Homo sapiens
aattaaatctgt

SEQ ID NO: 3316823 - DNA, 11 bp, Homo sapiens
aattaaatgta

SEQ ID NO: 3316824 - DNA, 14 bp, Homo sapiens
aattaaatgtattt

SEQ ID NO: 3316825 - DNA, 14 bp, Homo sapiens
aattaaattttgag

SEQ ID NO: 3316826 - DNA, 12 bp, Homo sapiens
aattaacctggt

SEQ ID NO: 3316827 - DNA, 18 bp, Homo sapiens
aattaacctggtgctgga

SEQ ID NO: 3316828 - DNA, 11 bp, Homo sapiens
aattaactgta

SEQ ID NO: 3316829 - DNA, 13 bp, Homo sapiens
aattaagaaggca

SEQ ID NO: 3316830 - DNA, 16 bp, Homo sapiens
aattaagaaggcaaaa

SEQ ID NO: 3316831 - DNA, 15 bp, Homo sapiens
aattaagactgaaaa

SEQ ID NO: 3316832 - DNA, 22 bp, Homo sapiens
aattaagatacaaattaatttt

SEQ ID NO: 3316833 - DNA, 18 bp, Homo sapiens
aattaagcaaatgttaaa

SEQ ID NO: 3316834 - DNA, 16 bp, Homo sapiens
aattaagtactatgta

SEQ ID NO: 3316835 - DNA, 17 bp, Homo sapiens
aattaagtactatgtat

SEQ ID NO: 3316836 - DNA, 14 bp, Homo sapiens
aattaagttatctt

SEQ ID NO: 3316837 - DNA, 14 bp, Homo sapiens
aattaatagctttt

SEQ ID NO: 3316838 - DNA, 17 bp, Homo sapiens
aattaatatattaaaat

SEQ ID NO: 3316839 - DNA, 21 bp, Homo sapiens
aattaatatccctacatgtat

SEQ ID NO: 3316840 - DNA, 16 bp, Homo sapiens
aattaatatgattatt

SEQ ID NO: 3316841 - DNA, 14 bp, Homo sapiens
aattaatttgatta

SEQ ID NO: 3316842 - DNA, 14 bp, Homo sapiens
aattacaaagaacc

SEQ ID NO: 3316843 - DNA, 14 bp, Homo sapiens
aattacacccaaag

SEQ ID NO: 3316844 - DNA, 17 bp, Homo sapiens
aattacactgtgccttt

SEQ ID NO: 3316845 - DNA, 19 bp, Homo sapiens
aattacactgtgccttttc

SEQ ID NO: 3316846 - DNA, 15 bp, Homo sapiens
aattacagatgtgaa

SEQ ID NO: 3316847 - DNA, 16 bp, Homo sapiens
aattacagatgtgaaa

SEQ ID NO: 3316848 - DNA, 14 bp, Homo sapiens
aattacagctttta

SEQ ID NO: 3316849 - DNA, 14 bp, Homo sapiens
aattacataatttt

SEQ ID NO: 3316850 - DNA, 15 bp, Homo sapiens
aattacatacagatt

SEQ ID NO: 3316851 - DNA, 23 bp, Homo sapiens
aattacattcctaactagaatta

SEQ ID NO: 3316852 - DNA, 13 bp, Homo sapiens
aattaccattaat

SEQ ID NO: 3316853 - DNA, 17 bp, Homo sapiens
aattaccattaattaca

SEQ ID NO: 3316854 - DNA, 18 bp, Homo sapiens
aattaccattaattacat

SEQ ID NO: 3316855 - DNA, 14 bp, Homo sapiens
aattacctgtggat

SEQ ID NO: 3316856 - DNA, 14 bp, Homo sapiens
aattaccttctatt

SEQ ID NO: 3316857 - DNA, 21 bp, Homo sapiens
aattaccttgagccagtaatt

SEQ ID NO: 3316858 - DNA, 22 bp, Homo sapiens
aattacggactctggatatttg

SEQ ID NO: 3316859 - DNA, 19 bp, Homo sapiens
aattacgtttgttattcct

SEQ ID NO: 3316860 - DNA, 22 bp, Homo sapiens
aattacgtttgttattcctagt

SEQ ID NO: 3316861 - DNA, 15 bp, Homo sapiens
aattactaattttac

SEQ ID NO: 3316862 - DNA, 16 bp, Homo sapiens
aattactacaaaattt

SEQ ID NO: 3316863 - DNA, 19 bp, Homo sapiens
aattactcagcagaatggt

SEQ ID NO: 3316864 - DNA, 14 bp, Homo sapiens
aattactcaggttt

SEQ ID NO: 3316865 - DNA, 14 bp, Homo sapiens
aattactggtccaa

SEQ ID NO: 3316866 - DNA, 23 bp, Homo sapiens
aattactttggggctaatttaac

SEQ ID NO: 3316867 - DNA, 20 bp, Homo sapiens
aattagaaaaaaattactaa

SEQ ID NO: 3316868 - DNA, 22 bp, Homo sapiens
aattagaaaatgttatttaaca

SEQ ID NO: 3316869 - DNA, 15 bp, Homo sapiens
aattagaatagtgtt

SEQ ID NO: 3316870 - DNA, 15 bp, Homo sapiens
aattagactgtgatt

SEQ ID NO: 3316871 - DNA, 21 bp, Homo sapiens
aattagactgtgattcagaaa

SEQ ID NO: 3316872 - DNA, 17 bp, Homo sapiens
aattagagaagctgaaa

SEQ ID NO: 3316873 - DNA, 19 bp, Homo sapiens
aattagatgattatatatt

SEQ ID NO: 3316874 - DNA, 14 bp, Homo sapiens
aattagcattctgt

SEQ ID NO: 3316875 - DNA, 13 bp, Homo sapiens
aattagctctggg

SEQ ID NO: 3316876 - DNA, 15 bp, Homo sapiens
aattagctctggggg

SEQ ID NO: 3316877 - DNA, 22 bp, Homo sapiens
aattaggaagtgtaacagctga

SEQ ID NO: 3316878 - DNA, 22 bp, Homo sapiens
aattaggctgtaactactttat

SEQ ID NO: 3316879 - DNA, 17 bp, Homo sapiens
aattagggtacatttat

SEQ ID NO: 3316880 - DNA, 15 bp, Homo sapiens
aattaggttaacatt

SEQ ID NO: 3316881 - DNA, 16 bp, Homo sapiens
aattaggttaacattg

SEQ ID NO: 3316882 - DNA, 21 bp, Homo sapiens
aattaggtttttccttatttg

SEQ ID NO: 3316883 - DNA, 17 bp, Homo sapiens
aattagtatttatttaa

SEQ ID NO: 3316884 - DNA, 17 bp, Homo sapiens
aattagtgccacttaat

SEQ ID NO: 3316885 - DNA, 13 bp, Homo sapiens
aattagtttcctt

SEQ ID NO: 3316886 - DNA, 14 bp, Homo sapiens
aattagtttccttt

SEQ ID NO: 3316887 - DNA, 18 bp, Homo sapiens
aattataacagttatatt

SEQ ID NO: 3316888 - DNA, 14 bp, Homo sapiens
aattataagtcaca

SEQ ID NO: 3316889 - DNA, 17 bp, Homo sapiens
aattataattttagttt

SEQ ID NO: 3316890 - DNA, 14 bp, Homo sapiens
aattatactacttt

SEQ ID NO: 3316891 - DNA, 13 bp, Homo sapiens
aattatagctttt

SEQ ID NO: 3316892 - DNA, 13 bp, Homo sapiens
aattatagtttca

SEQ ID NO: 3316893 - DNA, 14 bp, Homo sapiens
aattatagtttctg

SEQ ID NO: 3316894 - DNA, 17 bp, Homo sapiens
aattatagtttctgagg

SEQ ID NO: 3316895 - DNA, 20 bp, Homo sapiens
aattatataggttgtgcaaa

SEQ ID NO: 3316896 - DNA, 21 bp, Homo sapiens
aattatataggttgtgcaaat

SEQ ID NO: 3316897 - DNA, 13 bp, Homo sapiens
aattatcagcaaa

SEQ ID NO: 3316898 - DNA, 19 bp, Homo sapiens
aattatcagcaaagaaaaa

SEQ ID NO: 3316899 - DNA, 21 bp, Homo sapiens
aattatcagttatattttgct

SEQ ID NO: 3316900 - DNA, 17 bp, Homo sapiens
aattatcctctttgtaa

SEQ ID NO: 3316901 - DNA, 17 bp, Homo sapiens
aattatcggaagcagtg

SEQ ID NO: 3316902 - DNA, 15 bp, Homo sapiens
aattatctcctaatt

SEQ ID NO: 3316903 - DNA, 21 bp, Homo sapiens
aattatgaatctgatttttat

SEQ ID NO: 3316904 - DNA, 15 bp, Homo sapiens
aattatgacagttat

SEQ ID NO: 3316905 - DNA, 13 bp, Homo sapiens
aattatggaatat

SEQ ID NO: 3316906 - DNA, 23 bp, Homo sapiens
aattatggatacgtgttttgaat

SEQ ID NO: 3316907 - DNA, 16 bp, Homo sapiens
aattatgtaatatatt

SEQ ID NO: 3316908 - DNA, 20 bp, Homo sapiens
aattatgttttcaactcagg

SEQ ID NO: 3316909 - DNA, 19 bp, Homo sapiens
aattattaactacatttat

SEQ ID NO: 3316910 - DNA, 15 bp, Homo sapiens
aattattataaaaat

SEQ ID NO: 3316911 - DNA, 17 bp, Homo sapiens
aattattataaaaatat

SEQ ID NO: 3316912 - DNA, 22 bp, Homo sapiens
aattattataaaaatattaaga

SEQ ID NO: 3316913 - DNA, 18 bp, Homo sapiens
aattattataagcattga

SEQ ID NO: 3316914 - DNA, 20 bp, Homo sapiens
aattattatgtctcaaaata

SEQ ID NO: 3316915 - DNA, 15 bp, Homo sapiens
aattattatttgtgt

SEQ ID NO: 3316916 - DNA, 17 bp, Homo sapiens
aattattccaaaccaaa

SEQ ID NO: 3316917 - DNA, 17 bp, Homo sapiens
aattattctgattcttt

SEQ ID NO: 3316918 - DNA, 20 bp, Homo sapiens
aattattgatatatattata

SEQ ID NO: 3316919 - DNA, 19 bp, Homo sapiens
aattatttatttaataaca

SEQ ID NO: 3316920 - DNA, 22 bp, Homo sapiens
aattatttcatgattagaaatt

SEQ ID NO: 3316921 - DNA, 22 bp, Homo sapiens
aattatttctgtcacagtaaaa

SEQ ID NO: 3316922 - DNA, 14 bp, Homo sapiens
aattatttgtgtaa

SEQ ID NO: 3316923 - DNA, 15 bp, Homo sapiens
aattatttgtgtaat

SEQ ID NO: 3316924 - DNA, 21 bp, Homo sapiens
aattatttgtgtaatagaaaa

SEQ ID NO: 3316925 - DNA, 12 bp, Homo sapiens
aattattttaaa

SEQ ID NO: 3316926 - DNA, 14 bp, Homo sapiens
aattattttaaaca

SEQ ID NO: 3316927 - DNA, 23 bp, Homo sapiens
aattattttctccaaataaaaat

SEQ ID NO: 3316928 - DNA, 19 bp, Homo sapiens
aattattttggtactttta

SEQ ID NO: 3316929 - DNA, 15 bp, Homo sapiens
aattcaaaaagtgtt

SEQ ID NO: 3316930 - DNA, 22 bp, Homo sapiens
aattcaaaagttccaagagtct

SEQ ID NO: 3316931 - DNA, 14 bp, Homo sapiens
aattcaaagcttgt

SEQ ID NO: 3316932 - DNA, 17 bp, Homo sapiens
aattcaaagcttgtgaa

SEQ ID NO: 3316933 - DNA, 14 bp, Homo sapiens
aattcaactttgta

SEQ ID NO: 3316934 - DNA, 16 bp, Homo sapiens
aattcaactttgtaaa

SEQ ID NO: 3316935 - DNA, 12 bp, Homo sapiens
aattcaagaaaa

SEQ ID NO: 3316936 - DNA, 20 bp, Homo sapiens
aattcacagtgctcttttct

SEQ ID NO: 3316937 - DNA, 21 bp, Homo sapiens
aattcaccccctttcctggac

SEQ ID NO: 3316938 - DNA, 21 bp, Homo sapiens
aattcacctatgttattttgt

SEQ ID NO: 3316939 - DNA, 23 bp, Homo sapiens
aattcacctatgttattttgtgt

SEQ ID NO: 3316940 - DNA, 20 bp, Homo sapiens
aattcactcaagcactgata

SEQ ID NO: 3316941 - DNA, 14 bp, Homo sapiens
aattcacttcagtt

SEQ ID NO: 3316942 - DNA, 15 bp, Homo sapiens
aattcagaaactaca

SEQ ID NO: 3316943 - DNA, 16 bp, Homo sapiens
aattcagattgtcttg

SEQ ID NO: 3316944 - DNA, 16 bp, Homo sapiens
aattcagcaaaccatt

SEQ ID NO: 3316945 - DNA, 17 bp, Homo sapiens
aattcagcaccctgggt

SEQ ID NO: 3316946 - DNA, 20 bp, Homo sapiens
aattcagctcagcttcttcc

SEQ ID NO: 3316947 - DNA, 22 bp, Homo sapiens
aattcagggtggtaaagtatgt

SEQ ID NO: 3316948 - DNA, 14 bp, Homo sapiens
aattcagtttcata

SEQ ID NO: 3316949 - DNA, 16 bp, Homo sapiens
aattcagtttcataaa

SEQ ID NO: 3316950 - DNA, 12 bp, Homo sapiens
aattcagttttt

SEQ ID NO: 3316951 - DNA, 20 bp, Homo sapiens
aattcagtttttgtatcttg

SEQ ID NO: 3316952 - DNA, 14 bp, Homo sapiens
aattcagttttttt

SEQ ID NO: 3316953 - DNA, 18 bp, Homo sapiens
aattcatcccaactgtct

SEQ ID NO: 3316954 - DNA, 22 bp, Homo sapiens
aattcatggcatgcttaaattt

SEQ ID NO: 3316955 - DNA, 15 bp, Homo sapiens
aattcatttcacatt

SEQ ID NO: 3316956 - DNA, 17 bp, Homo sapiens
aattccaattaaattta

SEQ ID NO: 3316957 - DNA, 20 bp, Homo sapiens
aattccaattaaatttattt

SEQ ID NO: 3316958 - DNA, 13 bp, Homo sapiens
aattccactggac

SEQ ID NO: 3316959 - DNA, 14 bp, Homo sapiens
aattccactggact

SEQ ID NO: 3316960 - DNA, 19 bp, Homo sapiens
aattcccattttgcaaaat

SEQ ID NO: 3316961 - DNA, 10 bp, Homo sapiens
aattccctat

SEQ ID NO: 3316962 - DNA, 13 bp, Homo sapiens
aattcctaacttt

SEQ ID NO: 3316963 - DNA, 22 bp, Homo sapiens
aattcctacaacttaatggaaa

SEQ ID NO: 3316964 - DNA, 13 bp, Homo sapiens
aattcctctggga

SEQ ID NO: 3316965 - DNA, 23 bp, Homo sapiens
aattcctcttcattgtctacata

SEQ ID NO: 3316966 - DNA, 14 bp, Homo sapiens
aattcctgtcttcc

SEQ ID NO: 3316967 - DNA, 20 bp, Homo sapiens
aattcctgtcttccaaattg

SEQ ID NO: 3316968 - DNA, 19 bp, Homo sapiens
aattccttttctaactctc

SEQ ID NO: 3316969 - DNA, 23 bp, Homo sapiens
aattcgtacataataagtttcat

SEQ ID NO: 3316970 - DNA, 13 bp, Homo sapiens
aattcgtgtgttt

SEQ ID NO: 3316971 - DNA, 16 bp, Homo sapiens
aattctaagttattta

SEQ ID NO: 3316972 - DNA, 14 bp, Homo sapiens
aattctactaagtt

SEQ ID NO: 3316973 - DNA, 16 bp, Homo sapiens
aattctactaagttat

SEQ ID NO: 3316974 - DNA, 17 bp, Homo sapiens
aattctactaagttatt

SEQ ID NO: 3316975 - DNA, 14 bp, Homo sapiens
aattctagctgtat

SEQ ID NO: 3316976 - DNA, 16 bp, Homo sapiens
aattctataaggccat

SEQ ID NO: 3316977 - DNA, 22 bp, Homo sapiens
aattctataaggccataaaaca

SEQ ID NO: 3316978 - DNA, 13 bp, Homo sapiens
aattctatgttaa

SEQ ID NO: 3316979 - DNA, 15 bp, Homo sapiens
aattctattaaagtg

SEQ ID NO: 3316980 - DNA, 14 bp, Homo sapiens
aattctatttgctg

SEQ ID NO: 3316981 - DNA, 16 bp, Homo sapiens
aattctcaaagtttta

SEQ ID NO: 3316982 - DNA, 21 bp, Homo sapiens
aattctcatttgtcacacact

SEQ ID NO: 3316983 - DNA, 12 bp, Homo sapiens
aattctcctgga

SEQ ID NO: 3316984 - DNA, 14 bp, Homo sapiens
aattctctttcaaa

SEQ ID NO: 3316985 - DNA, 12 bp, Homo sapiens
aattctgtaaat

SEQ ID NO: 3316986 - DNA, 17 bp, Homo sapiens
aattctgtacatagcct

SEQ ID NO: 3316987 - DNA, 21 bp, Homo sapiens
aattctgtacatagcctatat

SEQ ID NO: 3316988 - DNA, 22 bp, Homo sapiens
aattctgttgttccattttatg

SEQ ID NO: 3316989 - DNA, 19 bp, Homo sapiens
aattctgtttttaatgcta

SEQ ID NO: 3316990 - DNA, 19 bp, Homo sapiens
aattcttaagtcttttgtc

SEQ ID NO: 3316991 - DNA, 15 bp, Homo sapiens
aattcttatgcttat

SEQ ID NO: 3316992 - DNA, 15 bp, Homo sapiens
aattcttgaaggaaa

SEQ ID NO: 3316993 - DNA, 16 bp, Homo sapiens
aattcttgaaggaaaa

SEQ ID NO: 3316994 - DNA, 15 bp, Homo sapiens
aattcttgtatatta

SEQ ID NO: 3316995 - DNA, 16 bp, Homo sapiens
aattcttgtatattat

SEQ ID NO: 3316996 - DNA, 19 bp, Homo sapiens
aattctttctattttcaca

SEQ ID NO: 3316997 - DNA, 20 bp, Homo sapiens
aattctttctattttcacaa

SEQ ID NO: 3316998 - DNA, 22 bp, Homo sapiens
aattctttctattttcacaatt

SEQ ID NO: 3316999 - DNA, 14 bp, Homo sapiens
aattgaaaacacac

SEQ ID NO: 3317000 - DNA, 14 bp, Homo sapiens
aattgaagaaaatc

SEQ ID NO: 3317001 - DNA, 20 bp, Homo sapiens
aattgaagagatttcaacat

SEQ ID NO: 3317002 - DNA, 21 bp, Homo sapiens
aattgaagagatttcaacata

SEQ ID NO: 3317003 - DNA, 14 bp, Homo sapiens
aattgacaaatgat

SEQ ID NO: 3317004 - DNA, 18 bp, Homo sapiens
aattgaccatctgctttt

SEQ ID NO: 3317005 - DNA, 15 bp, Homo sapiens
aattgactcaaatct

SEQ ID NO: 3317006 - DNA, 15 bp, Homo sapiens
aattgagattagagg

SEQ ID NO: 3317007 - DNA, 17 bp, Homo sapiens
aattgaggggattaata

SEQ ID NO: 3317008 - DNA, 21 bp, Homo sapiens
aattgaggtttggaagagtga

SEQ ID NO: 3317009 - DNA, 21 bp, Homo sapiens
aattgatcataggtatttcaa

SEQ ID NO: 3317010 - DNA, 22 bp, Homo sapiens
aattgatcattttccccccact

SEQ ID NO: 3317011 - DNA, 15 bp, Homo sapiens
aattgatcctttgat

SEQ ID NO: 3317012 - DNA, 14 bp, Homo sapiens
aattgatgtgttta

SEQ ID NO: 3317013 - DNA, 22 bp, Homo sapiens
aattgattattctgattccact

SEQ ID NO: 3317014 - DNA, 23 bp, Homo sapiens
aattgattattctgattccactt

SEQ ID NO: 3317015 - DNA, 21 bp, Homo sapiens
aattgatttcttttcttcctg

SEQ ID NO: 3317016 - DNA, 14 bp, Homo sapiens
aattgcactctaaa

SEQ ID NO: 3317017 - DNA, 17 bp, Homo sapiens
aattgcactgaagtttt

SEQ ID NO: 3317018 - DNA, 22 bp, Homo sapiens
aattgcactgaagtttttgaaa

SEQ ID NO: 3317019 - DNA, 14 bp, Homo sapiens
aattgcacttttaa

SEQ ID NO: 3317020 - DNA, 16 bp, Homo sapiens
aattgcataaagcata

SEQ ID NO: 3317021 - DNA, 22 bp, Homo sapiens
aattgcatactttgtattttga

SEQ ID NO: 3317022 - DNA, 15 bp, Homo sapiens
aattgcctgatttgt

SEQ ID NO: 3317023 - DNA, 14 bp, Homo sapiens
aattgctatgttac

SEQ ID NO: 3317024 - DNA, 19 bp, Homo sapiens
aattgctatgttactattt

SEQ ID NO: 3317025 - DNA, 11 bp, Homo sapiens
aattgctccta

SEQ ID NO: 3317026 - DNA, 22 bp, Homo sapiens
aattgctctgtgtatatctctt

SEQ ID NO: 3317027 - DNA, 15 bp, Homo sapiens
aattgcttacatttt

SEQ ID NO: 3317028 - DNA, 21 bp, Homo sapiens
aattgcttacatttttacaat

SEQ ID NO: 3317029 - DNA, 19 bp, Homo sapiens
aattgcttaccaaaggata

SEQ ID NO: 3317030 - DNA, 14 bp, Homo sapiens
aattgctttgccaa

SEQ ID NO: 3317031 - DNA, 21 bp, Homo sapiens
aattgctttgccaaaatacca

SEQ ID NO: 3317032 - DNA, 17 bp, Homo sapiens
aattggaacaaagtgaa

SEQ ID NO: 3317033 - DNA, 20 bp, Homo sapiens
aattggaagctgccctgccc

SEQ ID NO: 3317034 - DNA, 16 bp, Homo sapiens
aattggatattgatga

SEQ ID NO: 3317035 - DNA, 16 bp, Homo sapiens
aattgggacaacagtg

SEQ ID NO: 3317036 - DNA, 21 bp, Homo sapiens
aattgggagcttgggaatgga

SEQ ID NO: 3317037 - DNA, 16 bp, Homo sapiens
aattggggaggagggg

SEQ ID NO: 3317038 - DNA, 23 bp, Homo sapiens
aattgggtttagtcaatcactgc

SEQ ID NO: 3317039 - DNA, 20 bp, Homo sapiens
aattggtaaaactcactgtg

SEQ ID NO: 3317040 - DNA, 18 bp, Homo sapiens
aattggtgataagtggaa

SEQ ID NO: 3317041 - DNA, 19 bp, Homo sapiens
aattggtgataagtggaaa

SEQ ID NO: 3317042 - DNA, 15 bp, Homo sapiens
aattgtacatatttg

SEQ ID NO: 3317043 - DNA, 21 bp, Homo sapiens
aattgtacatatttgtggaat

SEQ ID NO: 3317044 - DNA, 17 bp, Homo sapiens
aattgtagttctgtgta

SEQ ID NO: 3317045 - DNA, 12 bp, Homo sapiens
aattgtataagt

SEQ ID NO: 3317046 - DNA, 20 bp, Homo sapiens
aattgtatacattttgttat

SEQ ID NO: 3317047 - DNA, 21 bp, Homo sapiens
aattgtatacattttgttata

SEQ ID NO: 3317048 - DNA, 24 bp, Homo sapiens
aattgtatcatttgaacaactagg

SEQ ID NO: 3317049 - DNA, 22 bp, Homo sapiens
aattgtatgttagaataatttt

SEQ ID NO: 3317050 - DNA, 15 bp, Homo sapiens
aattgtcgtttttat

SEQ ID NO: 3317051 - DNA, 19 bp, Homo sapiens
aattgtcgtttttattcct

SEQ ID NO: 3317052 - DNA, 13 bp, Homo sapiens
aattgtctattta

SEQ ID NO: 3317053 - DNA, 19 bp, Homo sapiens
aattgtcttttagacaact

SEQ ID NO: 3317054 - DNA, 14 bp, Homo sapiens
aattgtgagggaca

SEQ ID NO: 3317055 - DNA, 20 bp, Homo sapiens
aattgtgccgagaaaagcat

SEQ ID NO: 3317056 - DNA, 20 bp, Homo sapiens
aattgtggattataaaaaat

SEQ ID NO: 3317057 - DNA, 23 bp, Homo sapiens
aattgtggattataaaaaatgta

SEQ ID NO: 3317058 - DNA, 15 bp, Homo sapiens
aattgtgtaaaaaat

SEQ ID NO: 3317059 - DNA, 16 bp, Homo sapiens
aattgtgtagcctttt

SEQ ID NO: 3317060 - DNA, 13 bp, Homo sapiens
aattgttgacagt

SEQ ID NO: 3317061 - DNA, 12 bp, Homo sapiens
aattgttgtttc

SEQ ID NO: 3317062 - DNA, 18 bp, Homo sapiens
aattgttgtttctttcta

SEQ ID NO: 3317063 - DNA, 19 bp, Homo sapiens
aattgtttggcttcctcct

SEQ ID NO: 3317064 - DNA, 20 bp, Homo sapiens
aattgtttggcttcctcctg

SEQ ID NO: 3317065 - DNA, 18 bp, Homo sapiens
aattgttttaatctgaaa

SEQ ID NO: 3317066 - DNA, 17 bp, Homo sapiens
aattgttttgcactttt

SEQ ID NO: 3317067 - DNA, 20 bp, Homo sapiens
aattgttttgcactttttta

SEQ ID NO: 3317068 - DNA, 14 bp, Homo sapiens
aatttaaaaaaata

SEQ ID NO: 3317069 - DNA, 14 bp, Homo sapiens
aatttaaaaaataa

SEQ ID NO: 3317070 - DNA, 15 bp, Homo sapiens
aatttaaaaagcaaa

SEQ ID NO: 3317071 - DNA, 21 bp, Homo sapiens
aatttaaaagtaaaatgtctt

SEQ ID NO: 3317072 - DNA, 13 bp, Homo sapiens
aatttaaaattaa

SEQ ID NO: 3317073 - DNA, 14 bp, Homo sapiens
aatttaaacattaa

SEQ ID NO: 3317074 - DNA, 12 bp, Homo sapiens
aatttaaagata

SEQ ID NO: 3317075 - DNA, 13 bp, Homo sapiens
aatttaaagatat

SEQ ID NO: 3317076 - DNA, 18 bp, Homo sapiens
aatttaaagggtgtactt

SEQ ID NO: 3317077 - DNA, 19 bp, Homo sapiens
aatttaaagggtgtactta

SEQ ID NO: 3317078 - DNA, 14 bp, Homo sapiens
aatttaaatataat

SEQ ID NO: 3317079 - DNA, 16 bp, Homo sapiens
aatttaaatgaaagaa

SEQ ID NO: 3317080 - DNA, 14 bp, Homo sapiens
aatttaagcattgt

SEQ ID NO: 3317081 - DNA, 21 bp, Homo sapiens
aatttaagtcattttcatgtg

SEQ ID NO: 3317082 - DNA, 18 bp, Homo sapiens
aatttaagtgttggaaaa

SEQ ID NO: 3317083 - DNA, 14 bp, Homo sapiens
aatttaatgaaaag

SEQ ID NO: 3317084 - DNA, 15 bp, Homo sapiens
aatttaatgctgcct

SEQ ID NO: 3317085 - DNA, 19 bp, Homo sapiens
aatttaatggatatttctc

SEQ ID NO: 3317086 - DNA, 15 bp, Homo sapiens
aatttacactgccat

SEQ ID NO: 3317087 - DNA, 15 bp, Homo sapiens
aatttacatactctg

SEQ ID NO: 3317088 - DNA, 19 bp, Homo sapiens
aatttacatactctgctta

SEQ ID NO: 3317089 - DNA, 16 bp, Homo sapiens
aatttacctaagatta

SEQ ID NO: 3317090 - DNA, 18 bp, Homo sapiens
aatttacctaagattaca

SEQ ID NO: 3317091 - DNA, 12 bp, Homo sapiens
aatttactatat

SEQ ID NO: 3317092 - DNA, 15 bp, Homo sapiens
aatttactatatata

SEQ ID NO: 3317093 - DNA, 17 bp, Homo sapiens
aatttagatcttatatt

SEQ ID NO: 3317094 - DNA, 21 bp, Homo sapiens
aatttagtgatcttagcatag

SEQ ID NO: 3317095 - DNA, 23 bp, Homo sapiens
aatttagtgatcttagcatagct

SEQ ID NO: 3317096 - DNA, 15 bp, Homo sapiens
aatttagttattgat

SEQ ID NO: 3317097 - DNA, 17 bp, Homo sapiens
aatttagtttttgttct

SEQ ID NO: 3317098 - DNA, 16 bp, Homo sapiens
aatttataaaaaggtg

SEQ ID NO: 3317099 - DNA, 21 bp, Homo sapiens
aatttataaaattagaaagca

SEQ ID NO: 3317100 - DNA, 15 bp, Homo sapiens
aatttataaagtacc

SEQ ID NO: 3317101 - DNA, 14 bp, Homo sapiens
aatttataacaaat

SEQ ID NO: 3317102 - DNA, 17 bp, Homo sapiens
aatttatacaatatcat

SEQ ID NO: 3317103 - DNA, 21 bp, Homo sapiens
aatttatacctacctgtgtgg

SEQ ID NO: 3317104 - DNA, 14 bp, Homo sapiens
aatttatcaaagca

SEQ ID NO: 3317105 - DNA, 15 bp, Homo sapiens
aatttatcaaagcat

SEQ ID NO: 3317106 - DNA, 17 bp, Homo sapiens
aatttatccctttacaa

SEQ ID NO: 3317107 - DNA, 15 bp, Homo sapiens
aatttatgaagcaga

SEQ ID NO: 3317108 - DNA, 13 bp, Homo sapiens
aatttatgcattt

SEQ ID NO: 3317109 - DNA, 16 bp, Homo sapiens
aatttatgcatttcat

SEQ ID NO: 3317110 - DNA, 16 bp, Homo sapiens
aatttattaagtctgg

SEQ ID NO: 3317111 - DNA, 18 bp, Homo sapiens
aatttattagttaatata

SEQ ID NO: 3317112 - DNA, 19 bp, Homo sapiens
aatttattagttaatatat

SEQ ID NO: 3317113 - DNA, 16 bp, Homo sapiens
aatttattattgaaat

SEQ ID NO: 3317114 - DNA, 17 bp, Homo sapiens
aatttattattgaaatt

SEQ ID NO: 3317115 - DNA, 12 bp, Homo sapiens
aatttattcaat

SEQ ID NO: 3317116 - DNA, 17 bp, Homo sapiens
aatttatttattaagat

SEQ ID NO: 3317117 - DNA, 17 bp, Homo sapiens
aatttatttcatccagt

SEQ ID NO: 3317118 - DNA, 14 bp, Homo sapiens
aatttatttccact

SEQ ID NO: 3317119 - DNA, 12 bp, Homo sapiens
aatttatttgtt

SEQ ID NO: 3317120 - DNA, 15 bp, Homo sapiens
aatttcaaaaatata

SEQ ID NO: 3317121 - DNA, 19 bp, Homo sapiens
aatttcaaaaatataactt

SEQ ID NO: 3317122 - DNA, 17 bp, Homo sapiens
aatttcaaaagacatgt

SEQ ID NO: 3317123 - DNA, 12 bp, Homo sapiens
aatttcaaaatg

SEQ ID NO: 3317124 - DNA, 14 bp, Homo sapiens
aatttcaaggttct

SEQ ID NO: 3317125 - DNA, 17 bp, Homo sapiens
aatttcacaatataaag

SEQ ID NO: 3317126 - DNA, 21 bp, Homo sapiens
aatttcaccaccaaatgccaa

SEQ ID NO: 3317127 - DNA, 20 bp, Homo sapiens
aatttcacctgtaaacctga

SEQ ID NO: 3317128 - DNA, 13 bp, Homo sapiens
aatttcagtgtaa

SEQ ID NO: 3317129 - DNA, 20 bp, Homo sapiens
aatttcatagctgtacttct

SEQ ID NO: 3317130 - DNA, 15 bp, Homo sapiens
aatttcatatctaca

SEQ ID NO: 3317131 - DNA, 18 bp, Homo sapiens
aatttcatatgctgtata

SEQ ID NO: 3317132 - DNA, 18 bp, Homo sapiens
aatttcattttccttcag

SEQ ID NO: 3317133 - DNA, 13 bp, Homo sapiens
aatttcccacccc

SEQ ID NO: 3317134 - DNA, 18 bp, Homo sapiens
aatttcccacccccaccc

SEQ ID NO: 3317135 - DNA, 12 bp, Homo sapiens
aatttccctcag

SEQ ID NO: 3317136 - DNA, 11 bp, Homo sapiens
aatttcctggc

SEQ ID NO: 3317137 - DNA, 21 bp, Homo sapiens
aatttcggattttttccaaaa

SEQ ID NO: 3317138 - DNA, 18 bp, Homo sapiens
aatttctaccatttcaga

SEQ ID NO: 3317139 - DNA, 12 bp, Homo sapiens
aatttctcctcc

SEQ ID NO: 3317140 - DNA, 20 bp, Homo sapiens
aatttctcctcccttccttt

SEQ ID NO: 3317141 - DNA, 15 bp, Homo sapiens
aatttcttaacttct

SEQ ID NO: 3317142 - DNA, 16 bp, Homo sapiens
aatttcttaacttctt

SEQ ID NO: 3317143 - DNA, 19 bp, Homo sapiens
aatttcttcaaaatgtata

SEQ ID NO: 3317144 - DNA, 14 bp, Homo sapiens
aatttcttccttcc

SEQ ID NO: 3317145 - DNA, 21 bp, Homo sapiens
aatttcttctggtagtgtcag

SEQ ID NO: 3317146 - DNA, 24 bp, Homo sapiens
aatttcttgctctatctctcaaaa

SEQ ID NO: 3317147 - DNA, 20 bp, Homo sapiens
aatttcttttccttcattca

SEQ ID NO: 3317148 - DNA, 13 bp, Homo sapiens
aatttcttttgct

SEQ ID NO: 3317149 - DNA, 23 bp, Homo sapiens
aatttgaaaacataatctgcaaa

SEQ ID NO: 3317150 - DNA, 19 bp, Homo sapiens
aatttgaaaataattgttc

SEQ ID NO: 3317151 - DNA, 18 bp, Homo sapiens
aatttgaaaccaggacat

SEQ ID NO: 3317152 - DNA, 15 bp, Homo sapiens
aatttgaatgaaaaa

SEQ ID NO: 3317153 - DNA, 13 bp, Homo sapiens
aatttgaggacaa

SEQ ID NO: 3317154 - DNA, 14 bp, Homo sapiens
aatttgaggacaac

SEQ ID NO: 3317155 - DNA, 13 bp, Homo sapiens
aatttgatactta

SEQ ID NO: 3317156 - DNA, 18 bp, Homo sapiens
aatttgatacttatattt

SEQ ID NO: 3317157 - DNA, 13 bp, Homo sapiens
aatttgattaaca

SEQ ID NO: 3317158 - DNA, 18 bp, Homo sapiens
aatttgattaacaaatat

SEQ ID NO: 3317159 - DNA, 15 bp, Homo sapiens
aatttgattgatttg

SEQ ID NO: 3317160 - DNA, 16 bp, Homo sapiens
aatttgattgatttga

SEQ ID NO: 3317161 - DNA, 18 bp, Homo sapiens
aatttgcaaccatcagaa

SEQ ID NO: 3317162 - DNA, 20 bp, Homo sapiens
aatttgcactaaatcagaga

SEQ ID NO: 3317163 - DNA, 23 bp, Homo sapiens
aatttgcatattctattgtatta

SEQ ID NO: 3317164 - DNA, 15 bp, Homo sapiens
aatttgcattaaatt

SEQ ID NO: 3317165 - DNA, 20 bp, Homo sapiens
aatttgcattgtgtcagaaa

SEQ ID NO: 3317166 - DNA, 15 bp, Homo sapiens
aatttgcctgctggg

SEQ ID NO: 3317167 - DNA, 20 bp, Homo sapiens
aatttgctggagaagtgtgt

SEQ ID NO: 3317168 - DNA, 19 bp, Homo sapiens
aatttggagcacaaaattc

SEQ ID NO: 3317169 - DNA, 20 bp, Homo sapiens
aatttggagcacaaaattca

SEQ ID NO: 3317170 - DNA, 21 bp, Homo sapiens
aatttggagcacaaaattcaa

SEQ ID NO: 3317171 - DNA, 19 bp, Homo sapiens
aatttggatcatgttatga

SEQ ID NO: 3317172 - DNA, 22 bp, Homo sapiens
aatttggatcatgttatgattt

SEQ ID NO: 3317173 - DNA, 22 bp, Homo sapiens
aatttgggaaggtttgtgtttt

SEQ ID NO: 3317174 - DNA, 18 bp, Homo sapiens
aatttggtaaaaatgctg

SEQ ID NO: 3317175 - DNA, 16 bp, Homo sapiens
aatttggttctaatag

SEQ ID NO: 3317176 - DNA, 17 bp, Homo sapiens
aatttggtttgttaatt

SEQ ID NO: 3317177 - DNA, 23 bp, Homo sapiens
aatttgtaaaaacagcattgctt

SEQ ID NO: 3317178 - DNA, 16 bp, Homo sapiens
aatttgtaaacttctg

SEQ ID NO: 3317179 - DNA, 16 bp, Homo sapiens
aatttgtaacctcagc

SEQ ID NO: 3317180 - DNA, 13 bp, Homo sapiens
aatttgtaagttt

SEQ ID NO: 3317181 - DNA, 14 bp, Homo sapiens
aatttgtaagtttc

SEQ ID NO: 3317182 - DNA, 18 bp, Homo sapiens
aatttgtaagtttcaggt

SEQ ID NO: 3317183 - DNA, 19 bp, Homo sapiens
aatttgtaagtttcaggtg

SEQ ID NO: 3317184 - DNA, 23 bp, Homo sapiens
aatttgtaagtttcaggtgacat

SEQ ID NO: 3317185 - DNA, 19 bp, Homo sapiens
aatttgtacaggactgtaa

SEQ ID NO: 3317186 - DNA, 13 bp, Homo sapiens
aatttgtacttct

SEQ ID NO: 3317187 - DNA, 18 bp, Homo sapiens
aatttgtacttcttattg

SEQ ID NO: 3317188 - DNA, 10 bp, Homo sapiens
aatttgtcag

SEQ ID NO: 3317189 - DNA, 22 bp, Homo sapiens
aatttgtctgaaacatttcata

SEQ ID NO: 3317190 - DNA, 18 bp, Homo sapiens
aatttgtggttgtagaag

SEQ ID NO: 3317191 - DNA, 13 bp, Homo sapiens
aatttgtgtaata

SEQ ID NO: 3317192 - DNA, 16 bp, Homo sapiens
aatttgtgtaataaag

SEQ ID NO: 3317193 - DNA, 17 bp, Homo sapiens
aatttgtgtaataaagt

SEQ ID NO: 3317194 - DNA, 20 bp, Homo sapiens
aatttgtgtaataaagtgtt

SEQ ID NO: 3317195 - DNA, 22 bp, Homo sapiens
aatttgtgtaataaagtgtttt

SEQ ID NO: 3317196 - DNA, 21 bp, Homo sapiens
aatttgtgtgtttttagctgt

SEQ ID NO: 3317197 - DNA, 14 bp, Homo sapiens
aatttgttaattcc

SEQ ID NO: 3317198 - DNA, 21 bp, Homo sapiens
aatttgttaattcctatgaag

SEQ ID NO: 3317199 - DNA, 16 bp, Homo sapiens
aatttgttataatgaa

SEQ ID NO: 3317200 - DNA, 18 bp, Homo sapiens
aatttgtttcttctgtct

SEQ ID NO: 3317201 - DNA, 13 bp, Homo sapiens
aatttgtttgtat

SEQ ID NO: 3317202 - DNA, 12 bp, Homo sapiens
aattttaaaaaa

SEQ ID NO: 3317203 - DNA, 23 bp, Homo sapiens
aattttaaaaaagggagtttttg

SEQ ID NO: 3317204 - DNA, 12 bp, Homo sapiens
aattttaaagta

SEQ ID NO: 3317205 - DNA, 18 bp, Homo sapiens
aattttaaagtatgcatt

SEQ ID NO: 3317206 - DNA, 16 bp, Homo sapiens
aattttaaagtgcaaa

SEQ ID NO: 3317207 - DNA, 19 bp, Homo sapiens
aattttaacctatgatatt

SEQ ID NO: 3317208 - DNA, 14 bp, Homo sapiens
aattttaatgtgaa

SEQ ID NO: 3317209 - DNA, 19 bp, Homo sapiens
aattttacaattatggaaa

SEQ ID NO: 3317210 - DNA, 18 bp, Homo sapiens
aattttaccctttagact

SEQ ID NO: 3317211 - DNA, 15 bp, Homo sapiens
aattttagaaatatt

SEQ ID NO: 3317212 - DNA, 17 bp, Homo sapiens
aattttagaaatattca

SEQ ID NO: 3317213 - DNA, 21 bp, Homo sapiens
aattttaggaacttcagagat

SEQ ID NO: 3317214 - DNA, 22 bp, Homo sapiens
aattttagtttatattaatttc

SEQ ID NO: 3317215 - DNA, 19 bp, Homo sapiens
aattttatagctcagttta

SEQ ID NO: 3317216 - DNA, 13 bp, Homo sapiens
aattttatattct

SEQ ID NO: 3317217 - DNA, 15 bp, Homo sapiens
aattttattaaatgc

SEQ ID NO: 3317218 - DNA, 17 bp, Homo sapiens
aattttatttataaact

SEQ ID NO: 3317219 - DNA, 13 bp, Homo sapiens
aattttattttgt

SEQ ID NO: 3317220 - DNA, 15 bp, Homo sapiens
aattttcaagtaatt

SEQ ID NO: 3317221 - DNA, 19 bp, Homo sapiens
aattttcaagtaattgtga

SEQ ID NO: 3317222 - DNA, 14 bp, Homo sapiens
aattttcacttctg

SEQ ID NO: 3317223 - DNA, 16 bp, Homo sapiens
acaataaatgtattca

SEQ ID NO: 3317224 - DNA, 19 bp, Homo sapiens
acaataaatgtattcaaat

SEQ ID NO: 3317225 - DNA, 14 bp, Homo sapiens
acaataaatgtgca

SEQ ID NO: 3317226 - DNA, 19 bp, Homo sapiens
acaataacccagttacttt

SEQ ID NO: 3317227 - DNA, 20 bp, Homo sapiens
acaataacccagttactttt

SEQ ID NO: 3317228 - DNA, 18 bp, Homo sapiens
acaataactactgtgttc

SEQ ID NO: 3317229 - DNA, 20 bp, Homo sapiens
acaataactactgtgttcct

SEQ ID NO: 3317230 - DNA, 21 bp, Homo sapiens
acaataagcgttaagggcaga

SEQ ID NO: 3317231 - DNA, 23 bp, Homo sapiens
acaataagcgttaagggcagagt

SEQ ID NO: 3317232 - DNA, 21 bp, Homo sapiens
acaataatattgttgtataat

SEQ ID NO: 3317233 - DNA, 15 bp, Homo sapiens
acaataatatttcaa

SEQ ID NO: 3317234 - DNA, 22 bp, Homo sapiens
acaataatatttcaagtgccta

SEQ ID NO: 3317235 - DNA, 12 bp, Homo sapiens
acaatacaaatg

SEQ ID NO: 3317236 - DNA, 14 bp, Homo sapiens
acaatacaaatgga

SEQ ID NO: 3317237 - DNA, 16 bp, Homo sapiens
acaatacatgagaaag

SEQ ID NO: 3317238 - DNA, 22 bp, Homo sapiens
acaataggagtggtgatttgaa

SEQ ID NO: 3317239 - DNA, 13 bp, Homo sapiens
acaataggtcttt

SEQ ID NO: 3317240 - DNA, 19 bp, Homo sapiens
acaataggtctttctctca

SEQ ID NO: 3317241 - DNA, 20 bp, Homo sapiens
acaatagtatttctcctttg

SEQ ID NO: 3317242 - DNA, 15 bp, Homo sapiens
acaatagtcagaaaa

SEQ ID NO: 3317243 - DNA, 15 bp, Homo sapiens
acaatatatagaatt

SEQ ID NO: 3317244 - DNA, 12 bp, Homo sapiens
acaatatcatat

SEQ ID NO: 3317245 - DNA, 13 bp, Homo sapiens
acaatatgtatgc

SEQ ID NO: 3317246 - DNA, 18 bp, Homo sapiens
acaatattgattgggaaa

SEQ ID NO: 3317247 - DNA, 15 bp, Homo sapiens
acaatatttataaag

SEQ ID NO: 3317248 - DNA, 17 bp, Homo sapiens
acaatattttgtggctt

SEQ ID NO: 3317249 - DNA, 14 bp, Homo sapiens
acaatcaaaggaaa

SEQ ID NO: 3317250 - DNA, 19 bp, Homo sapiens
acaatcaaaggaaaatagt

SEQ ID NO: 3317251 - DNA, 13 bp, Homo sapiens
acaatcaaatctc

SEQ ID NO: 3317252 - DNA, 16 bp, Homo sapiens
acaatcactaaacttt

SEQ ID NO: 3317253 - DNA, 20 bp, Homo sapiens
acaatcactaaactttattt

SEQ ID NO: 3317254 - DNA, 15 bp, Homo sapiens
acaatcactgaaaca

SEQ ID NO: 3317255 - DNA, 19 bp, Homo sapiens
acaatcatgaacagctctg

SEQ ID NO: 3317256 - DNA, 21 bp, Homo sapiens
acaatcatgaacagctctgag

SEQ ID NO: 3317257 - DNA, 21 bp, Homo sapiens
acaatcattgttttgaatatt

SEQ ID NO: 3317258 - DNA, 18 bp, Homo sapiens
acaatccatgtgattaat

SEQ ID NO: 3317259 - DNA, 18 bp, Homo sapiens
acaatcccacctagccca

SEQ ID NO: 3317260 - DNA, 18 bp, Homo sapiens
acaatctaacaataatat

SEQ ID NO: 3317261 - DNA, 21 bp, Homo sapiens
acaatctaacaataatatttc

SEQ ID NO: 3317262 - DNA, 14 bp, Homo sapiens
acaatctattttgt

SEQ ID NO: 3317263 - DNA, 19 bp, Homo sapiens
acaatctctttttgtttgc

SEQ ID NO: 3317264 - DNA, 20 bp, Homo sapiens
acaatctggcttagtgccac

SEQ ID NO: 3317265 - DNA, 21 bp, Homo sapiens
acaatgaaaactctttgctgc

SEQ ID NO: 3317266 - DNA, 16 bp, Homo sapiens
acaatgaacacttata

SEQ ID NO: 3317267 - DNA, 24 bp, Homo sapiens
acaatgaacatccctttttcaatg

SEQ ID NO: 3317268 - DNA, 18 bp, Homo sapiens
acaatgaagataaaaaga

SEQ ID NO: 3317269 - DNA, 13 bp, Homo sapiens
acaatgaatgtat

SEQ ID NO: 3317270 - DNA, 19 bp, Homo sapiens
acaatgactagtcacctgg

SEQ ID NO: 3317271 - DNA, 20 bp, Homo sapiens
acaatgatgccctgctccag

SEQ ID NO: 3317272 - DNA, 17 bp, Homo sapiens
acaatgctgatttggtg

SEQ ID NO: 3317273 - DNA, 17 bp, Homo sapiens
acaatggggtgggccca

SEQ ID NO: 3317274 - DNA, 12 bp, Homo sapiens
acaatgtataaa

SEQ ID NO: 3317275 - DNA, 15 bp, Homo sapiens
acaatgtataaagat

SEQ ID NO: 3317276 - DNA, 22 bp, Homo sapiens
acaatgtcagtatttcagtgta

SEQ ID NO: 3317277 - DNA, 18 bp, Homo sapiens
acaatgtgtttttctcca

SEQ ID NO: 3317278 - DNA, 19 bp, Homo sapiens
acaatgtgtttttctccag

SEQ ID NO: 3317279 - DNA, 19 bp, Homo sapiens
acaatgttaaggaaactct

SEQ ID NO: 3317280 - DNA, 20 bp, Homo sapiens
acaatgttaaggaaactctt

SEQ ID NO: 3317281 - DNA, 21 bp, Homo sapiens
acaatgttaaggaaactctta

SEQ ID NO: 3317282 - DNA, 17 bp, Homo sapiens
acaatgtttgatgtccc

SEQ ID NO: 3317283 - DNA, 22 bp, Homo sapiens
acaattaagttacaattacatc

SEQ ID NO: 3317284 - DNA, 17 bp, Homo sapiens
acaattaatagtttgtc

SEQ ID NO: 3317285 - DNA, 15 bp, Homo sapiens
acaattaattcatcc

SEQ ID NO: 3317286 - DNA, 21 bp, Homo sapiens
acaattacatctctaattttg

SEQ ID NO: 3317287 - DNA, 18 bp, Homo sapiens
acaattactaaattgtat

SEQ ID NO: 3317288 - DNA, 12 bp, Homo sapiens
acaattattaaa

SEQ ID NO: 3317289 - DNA, 21 bp, Homo sapiens
acaattatttatttcatgtct

SEQ ID NO: 3317290 - DNA, 16 bp, Homo sapiens
acaattcattggctcc

SEQ ID NO: 3317291 - DNA, 17 bp, Homo sapiens
acaattcattggctcct

SEQ ID NO: 3317292 - DNA, 14 bp, Homo sapiens
acaattccaaagga

SEQ ID NO: 3317293 - DNA, 21 bp, Homo sapiens
acaattctgtttttaatgcta

SEQ ID NO: 3317294 - DNA, 16 bp, Homo sapiens
acaattgaagtaaact

SEQ ID NO: 3317295 - DNA, 21 bp, Homo sapiens
acaattgtcgaaaagagtctt

SEQ ID NO: 3317296 - DNA, 14 bp, Homo sapiens
acaattgtgtagcc

SEQ ID NO: 3317297 - DNA, 21 bp, Homo sapiens
acaattgtttggggttgaaaa

SEQ ID NO: 3317298 - DNA, 20 bp, Homo sapiens
acaattgttttaatctgaaa

SEQ ID NO: 3317299 - DNA, 14 bp, Homo sapiens
acaatttaatgtat

SEQ ID NO: 3317300 - DNA, 15 bp, Homo sapiens
acaatttcatcctcc

SEQ ID NO: 3317301 - DNA, 16 bp, Homo sapiens
acaatttcatcctcct

SEQ ID NO: 3317302 - DNA, 11 bp, Homo sapiens
acaatttctgt

SEQ ID NO: 3317303 - DNA, 16 bp, Homo sapiens
acaatttgttaattcc

SEQ ID NO: 3317304 - DNA, 15 bp, Homo sapiens
acaattttgtacaaa

SEQ ID NO: 3317305 - DNA, 17 bp, Homo sapiens
acaatttttaataaatt

SEQ ID NO: 3317306 - DNA, 21 bp, Homo sapiens
acacaaaactccgcccccagc

SEQ ID NO: 3317307 - DNA, 15 bp, Homo sapiens
acacaaactgtaaat

SEQ ID NO: 3317308 - DNA, 15 bp, Homo sapiens
acacaaagattttct

SEQ ID NO: 3317309 - DNA, 20 bp, Homo sapiens
acacaaagattttctaagga

SEQ ID NO: 3317310 - DNA, 13 bp, Homo sapiens
acacaaagcctgt

SEQ ID NO: 3317311 - DNA, 20 bp, Homo sapiens
acacaaaggaagtgccccct

SEQ ID NO: 3317312 - DNA, 21 bp, Homo sapiens
acacaaaggaagtgccccctc

SEQ ID NO: 3317313 - DNA, 13 bp, Homo sapiens
acacaaatgcatg

SEQ ID NO: 3317314 - DNA, 20 bp, Homo sapiens
acacaaatgtgatttttgta

SEQ ID NO: 3317315 - DNA, 18 bp, Homo sapiens
acacaaattttcaagttt

SEQ ID NO: 3317316 - DNA, 17 bp, Homo sapiens
acacaactatcaaaatt

SEQ ID NO: 3317317 - DNA, 18 bp, Homo sapiens
acacaactatttttccaa

SEQ ID NO: 3317318 - DNA, 13 bp, Homo sapiens
acacaagaaaaag

SEQ ID NO: 3317319 - DNA, 14 bp, Homo sapiens
acacaagaaaaaga

SEQ ID NO: 3317320 - DNA, 22 bp, Homo sapiens
acacaagaagaagggcacccta

SEQ ID NO: 3317321 - DNA, 15 bp, Homo sapiens
acacaagcaatgcaa

SEQ ID NO: 3317322 - DNA, 17 bp, Homo sapiens
acacaagcccacagcac

SEQ ID NO: 3317323 - DNA, 18 bp, Homo sapiens
acacaagcccacagcaca

SEQ ID NO: 3317324 - DNA, 16 bp, Homo sapiens
acacaagtcctgtgaa

SEQ ID NO: 3317325 - DNA, 16 bp, Homo sapiens
acacaatatgtatgct

SEQ ID NO: 3317326 - DNA, 18 bp, Homo sapiens
acacaatggagtgtgtaa

SEQ ID NO: 3317327 - DNA, 20 bp, Homo sapiens
acacaattcattggctcctg

SEQ ID NO: 3317328 - DNA, 21 bp, Homo sapiens
acacaattggaattgtcttta

SEQ ID NO: 3317329 - DNA, 10 bp, Homo sapiens
acacacacac

SEQ ID NO: 3317330 - DNA, 15 bp, Homo sapiens
acacacacacaaacc

SEQ ID NO: 3317331 - DNA, 17 bp, Homo sapiens
acacacacacacacgat

SEQ ID NO: 3317332 - DNA, 13 bp, Homo sapiens
acacacacacacg

SEQ ID NO: 3317333 - DNA, 16 bp, Homo sapiens
acacacacacacgatg

SEQ ID NO: 3317334 - DNA, 14 bp, Homo sapiens
acacacacacgcac

SEQ ID NO: 3317335 - DNA, 14 bp, Homo sapiens
acacacacatccac

SEQ ID NO: 3317336 - DNA, 22 bp, Homo sapiens
acacacacgatgcatttaataa

SEQ ID NO: 3317337 - DNA, 19 bp, Homo sapiens
acacacacgcacgcacaca

SEQ ID NO: 3317338 - DNA, 20 bp, Homo sapiens
acacacagaaatgtgtcaat

SEQ ID NO: 3317339 - DNA, 13 bp, Homo sapiens
acacacagctctg

SEQ ID NO: 3317340 - DNA, 19 bp, Homo sapiens
acacacagctctgtcctgg

SEQ ID NO: 3317341 - DNA, 15 bp, Homo sapiens
acacacagctgggca

SEQ ID NO: 3317342 - DNA, 19 bp, Homo sapiens
acacacatacgtgcacagg

SEQ ID NO: 3317343 - DNA, 21 bp, Homo sapiens
acacacatataaacatcacac

SEQ ID NO: 3317344 - DNA, 14 bp, Homo sapiens
acacacatgcacac

SEQ ID NO: 3317345 - DNA, 18 bp, Homo sapiens
acacacatgccctcctgg

SEQ ID NO: 3317346 - DNA, 15 bp, Homo sapiens
acacaccagagccca

SEQ ID NO: 3317347 - DNA, 12 bp, Homo sapiens
acacaccctgcc

SEQ ID NO: 3317348 - DNA, 14 bp, Homo sapiens
acacacctccgaga

SEQ ID NO: 3317349 - DNA, 21 bp, Homo sapiens
acacacgatgcatttaataaa

SEQ ID NO: 3317350 - DNA, 13 bp, Homo sapiens
acacacgcacgca

SEQ ID NO: 3317351 - DNA, 17 bp, Homo sapiens
acacacgtatttatatt

SEQ ID NO: 3317352 - DNA, 14 bp, Homo sapiens
acacactactacct

SEQ ID NO: 3317353 - DNA, 13 bp, Homo sapiens
acacactgatgct

SEQ ID NO: 3317354 - DNA, 19 bp, Homo sapiens
acacactgtcatgcttcat

SEQ ID NO: 3317355 - DNA, 22 bp, Homo sapiens
acacactgtcatgcttcatcat

SEQ ID NO: 3317356 - DNA, 17 bp, Homo sapiens
acacactttttattaga

SEQ ID NO: 3317357 - DNA, 20 bp, Homo sapiens
acacagaaaatgttgagaat

SEQ ID NO: 3317358 - DNA, 14 bp, Homo sapiens
acacagaaaccaat

SEQ ID NO: 3317359 - DNA, 13 bp, Homo sapiens
acacagaaacctt

SEQ ID NO: 3317360 - DNA, 21 bp, Homo sapiens
acacagaaacctttttaaaaa

SEQ ID NO: 3317361 - DNA, 12 bp, Homo sapiens
acacagaaatat

SEQ ID NO: 3317362 - DNA, 14 bp, Homo sapiens
acacagaaatatat

SEQ ID NO: 3317363 - DNA, 16 bp, Homo sapiens
acacagactggcaata

SEQ ID NO: 3317364 - DNA, 18 bp, Homo sapiens
acacagactggcaataaa

SEQ ID NO: 3317365 - DNA, 23 bp, Homo sapiens
acacagactttctgtgacgcaga

SEQ ID NO: 3317366 - DNA, 22 bp, Homo sapiens
acacagagaagcggatttccag

SEQ ID NO: 3317367 - DNA, 12 bp, Homo sapiens
acacagaggaag

SEQ ID NO: 3317368 - DNA, 19 bp, Homo sapiens
acacagaggctgcctctcc

SEQ ID NO: 3317369 - DNA, 19 bp, Homo sapiens
acacagagtggtctttctg

SEQ ID NO: 3317370 - DNA, 21 bp, Homo sapiens
acacagagtggtctttctgga

SEQ ID NO: 3317371 - DNA, 15 bp, Homo sapiens
acacagcatgtgtat

SEQ ID NO: 3317372 - DNA, 17 bp, Homo sapiens
acacagcgtccctagca

SEQ ID NO: 3317373 - DNA, 18 bp, Homo sapiens
acacagcgtccctagcag

SEQ ID NO: 3317374 - DNA, 11 bp, Homo sapiens
acacagctctg

SEQ ID NO: 3317375 - DNA, 20 bp, Homo sapiens
acacagctctgtcctgggag

SEQ ID NO: 3317376 - DNA, 13 bp, Homo sapiens
acacagctcttca

SEQ ID NO: 3317377 - DNA, 13 bp, Homo sapiens
acacagctcttct

SEQ ID NO: 3317378 - DNA, 16 bp, Homo sapiens
acacagctcttctcca

SEQ ID NO: 3317379 - DNA, 18 bp, Homo sapiens
acacagctcttctccagg

SEQ ID NO: 3317380 - DNA, 22 bp, Homo sapiens
acacagctgagagacttttaat

SEQ ID NO: 3317381 - DNA, 14 bp, Homo sapiens
acacagctgagcac

SEQ ID NO: 3317382 - DNA, 12 bp, Homo sapiens
acacagctgggc

SEQ ID NO: 3317383 - DNA, 18 bp, Homo sapiens
acacagcttaacaatgca

SEQ ID NO: 3317384 - DNA, 23 bp, Homo sapiens
acacaggcccggctccaggctcc

SEQ ID NO: 3317385 - DNA, 24 bp, Homo sapiens
acacaggcccggctccaggctcct

SEQ ID NO: 3317386 - DNA, 12 bp, Homo sapiens
acacaggctggc

SEQ ID NO: 3317387 - DNA, 14 bp, Homo sapiens
acacagggctcttt

SEQ ID NO: 3317388 - DNA, 19 bp, Homo sapiens
acacaggggtggagtttct

SEQ ID NO: 3317389 - DNA, 14 bp, Homo sapiens
acacagtactttat

SEQ ID NO: 3317390 - DNA, 21 bp, Homo sapiens
acacagtagctccaacacttt

SEQ ID NO: 3317391 - DNA, 15 bp, Homo sapiens
acacagtcaaaataa

SEQ ID NO: 3317392 - DNA, 23 bp, Homo sapiens
acacagtcaaaataattctaaat

SEQ ID NO: 3317393 - DNA, 21 bp, Homo sapiens
acacagtcaaatttacattta

SEQ ID NO: 3317394 - DNA, 13 bp, Homo sapiens
acacagtccccag

SEQ ID NO: 3317395 - DNA, 17 bp, Homo sapiens
acacagtccccagactc

SEQ ID NO: 3317396 - DNA, 13 bp, Homo sapiens
acacagtgaaacg

SEQ ID NO: 3317397 - DNA, 22 bp, Homo sapiens
acacagtgctgaccagacagcc

SEQ ID NO: 3317398 - DNA, 20 bp, Homo sapiens
acacagtggagcccacgagc

SEQ ID NO: 3317399 - DNA, 19 bp, Homo sapiens
acacagtgggaactctgac

SEQ ID NO: 3317400 - DNA, 22 bp, Homo sapiens
acacagtgggaactctgacaag

SEQ ID NO: 3317401 - DNA, 16 bp, Homo sapiens
acacagttcctgggaa

SEQ ID NO: 3317402 - DNA, 15 bp, Homo sapiens
acacagttgctgtca

SEQ ID NO: 3317403 - DNA, 14 bp, Homo sapiens
acacagttttgaaa

SEQ ID NO: 3317404 - DNA, 14 bp, Homo sapiens
acacataaattatg

SEQ ID NO: 3317405 - DNA, 22 bp, Homo sapiens
acacatacagttttatgctctt

SEQ ID NO: 3317406 - DNA, 20 bp, Homo sapiens
acacatagattaatggcact

SEQ ID NO: 3317407 - DNA, 22 bp, Homo sapiens
acacatataaacatcacacaca

SEQ ID NO: 3317408 - DNA, 14 bp, Homo sapiens
acacatcaagcttt

SEQ ID NO: 3317409 - DNA, 18 bp, Homo sapiens
acacatcaagcttttctg

SEQ ID NO: 3317410 - DNA, 17 bp, Homo sapiens
acacatccagacatcat

SEQ ID NO: 3317411 - DNA, 20 bp, Homo sapiens
acacatccagacatcatgaa

SEQ ID NO: 3317412 - DNA, 19 bp, Homo sapiens
acacatccctaatgtgtgc

SEQ ID NO: 3317413 - DNA, 20 bp, Homo sapiens
acacatccctaatgtgtgcc

SEQ ID NO: 3317414 - DNA, 19 bp, Homo sapiens
acacatccgccttttgtat

SEQ ID NO: 3317415 - DNA, 22 bp, Homo sapiens
acacatccgccttttgtataca

SEQ ID NO: 3317416 - DNA, 12 bp, Homo sapiens
acacatctcctc

SEQ ID NO: 3317417 - DNA, 13 bp, Homo sapiens
acacatcttccct

SEQ ID NO: 3317418 - DNA, 21 bp, Homo sapiens
acacatgacgccagataaaat

SEQ ID NO: 3317419 - DNA, 12 bp, Homo sapiens
acacatgcacac

SEQ ID NO: 3317420 - DNA, 13 bp, Homo sapiens
acacatgcacaca

SEQ ID NO: 3317421 - DNA, 16 bp, Homo sapiens
acacatgccctcctgg

SEQ ID NO: 3317422 - DNA, 16 bp, Homo sapiens
acacatgctaggatgc

SEQ ID NO: 3317423 - DNA, 16 bp, Homo sapiens
acacattacaaagcca

SEQ ID NO: 3317424 - DNA, 20 bp, Homo sapiens
acacattatcgggagcagtg

SEQ ID NO: 3317425 - DNA, 23 bp, Homo sapiens
acacattatcgggagcagtgtct

SEQ ID NO: 3317426 - DNA, 14 bp, Homo sapiens
acacatttaattca

SEQ ID NO: 3317427 - DNA, 13 bp, Homo sapiens
acacatttcacat

SEQ ID NO: 3317428 - DNA, 17 bp, Homo sapiens
acacatttgctactgtt

SEQ ID NO: 3317429 - DNA, 23 bp, Homo sapiens
acacatttgggatgttccttttt

SEQ ID NO: 3317430 - DNA, 11 bp, Homo sapiens
acacatttgta

SEQ ID NO: 3317431 - DNA, 18 bp, Homo sapiens
acacatttgtacagaatt

SEQ ID NO: 3317432 - DNA, 18 bp, Homo sapiens
acaccaaacttcattttt

SEQ ID NO: 3317433 - DNA, 14 bp, Homo sapiens
acaccaaatataac

SEQ ID NO: 3317434 - DNA, 20 bp, Homo sapiens
acaccaaatataacaagtat

SEQ ID NO: 3317435 - DNA, 16 bp, Homo sapiens
acaccaagcagcaaca

SEQ ID NO: 3317436 - DNA, 14 bp, Homo sapiens
acaccaaggaagct

SEQ ID NO: 3317437 - DNA, 18 bp, Homo sapiens
acaccaatcccagggctg

SEQ ID NO: 3317438 - DNA, 21 bp, Homo sapiens
acaccaatcccagggctggct

SEQ ID NO: 3317439 - DNA, 22 bp, Homo sapiens
acaccaatcccagggctggctc

SEQ ID NO: 3317440 - DNA, 23 bp, Homo sapiens
acaccaatttggtaaaaatgctg

SEQ ID NO: 3317441 - DNA, 14 bp, Homo sapiens
acaccacacccagc

SEQ ID NO: 3317442 - DNA, 15 bp, Homo sapiens
acaccacacccagcc

SEQ ID NO: 3317443 - DNA, 16 bp, Homo sapiens
acaccacactttcaaa

SEQ ID NO: 3317444 - DNA, 21 bp, Homo sapiens
acaccacagacacacacacgc

SEQ ID NO: 3317445 - DNA, 12 bp, Homo sapiens
acaccaccctcc

SEQ ID NO: 3317446 - DNA, 22 bp, Homo sapiens
acaccacgtccttattggaata

SEQ ID NO: 3317447 - DNA, 13 bp, Homo sapiens
acaccactgccct

SEQ ID NO: 3317448 - DNA, 17 bp, Homo sapiens
acaccactgttgccttt

SEQ ID NO: 3317449 - DNA, 17 bp, Homo sapiens
acaccagagcagatgca

SEQ ID NO: 3317450 - DNA, 12 bp, Homo sapiens
acaccagagccc

SEQ ID NO: 3317451 - DNA, 18 bp, Homo sapiens
acaccagagcccaccttg

SEQ ID NO: 3317452 - DNA, 17 bp, Homo sapiens
acaccagagctgccgac

SEQ ID NO: 3317453 - DNA, 20 bp, Homo sapiens
acaccagcccccaggaagac

SEQ ID NO: 3317454 - DNA, 17 bp, Homo sapiens
acaccagcccctgcccc

SEQ ID NO: 3317455 - DNA, 21 bp, Homo sapiens
acaccagcccctgccccagcc

SEQ ID NO: 3317456 - DNA, 22 bp, Homo sapiens
acaccagcccctgccccagccc

SEQ ID NO: 3317457 - DNA, 14 bp, Homo sapiens
acaccaggctgtgg

SEQ ID NO: 3317458 - DNA, 17 bp, Homo sapiens
acaccagtcacatgacc

SEQ ID NO: 3317459 - DNA, 20 bp, Homo sapiens
acaccatcgatcatgatgta

SEQ ID NO: 3317460 - DNA, 18 bp, Homo sapiens
acaccatcttttattctt

SEQ ID NO: 3317461 - DNA, 15 bp, Homo sapiens
acacccaccctgtgc

SEQ ID NO: 3317462 - DNA, 12 bp, Homo sapiens
acacccagccca

SEQ ID NO: 3317463 - DNA, 16 bp, Homo sapiens
acacccagcctcagtc

SEQ ID NO: 3317464 - DNA, 23 bp, Homo sapiens
acacccagcctcagtcctcccct

SEQ ID NO: 3317465 - DNA, 17 bp, Homo sapiens
acacccagttctgaata

SEQ ID NO: 3317466 - DNA, 14 bp, Homo sapiens
acaccccagcccac

SEQ ID NO: 3317467 - DNA, 13 bp, Homo sapiens
acacccctgctct

SEQ ID NO: 3317468 - DNA, 17 bp, Homo sapiens
acacccgactcctcaaa

SEQ ID NO: 3317469 - DNA, 18 bp, Homo sapiens
acacccgtgagcgcctgt

SEQ ID NO: 3317470 - DNA, 14 bp, Homo sapiens
acaccgtcttcctt

SEQ ID NO: 3317471 - DNA, 15 bp, Homo sapiens
acaccgtcttccttc

SEQ ID NO: 3317472 - DNA, 22 bp, Homo sapiens
acacctaaaggtgtatttaaac

SEQ ID NO: 3317473 - DNA, 23 bp, Homo sapiens
acacctaactcttttctattttg

SEQ ID NO: 3317474 - DNA, 18 bp, Homo sapiens
acacctaccaaaaaataa

SEQ ID NO: 3317475 - DNA, 21 bp, Homo sapiens
acacctactctatcagagaaa

SEQ ID NO: 3317476 - DNA, 13 bp, Homo sapiens
acacctccaccgt

SEQ ID NO: 3317477 - DNA, 16 bp, Homo sapiens
acacctccctgaacca

SEQ ID NO: 3317478 - DNA, 22 bp, Homo sapiens
acacctccctgaaccatccctg

SEQ ID NO: 3317479 - DNA, 14 bp, Homo sapiens
acacctgactctga

SEQ ID NO: 3317480 - DNA, 16 bp, Homo sapiens
acacctgactctgaaa

SEQ ID NO: 3317481 - DNA, 18 bp, Homo sapiens
acacctgactctgaaatc

SEQ ID NO: 3317482 - DNA, 19 bp, Homo sapiens
acacctgcaatcccagcac

SEQ ID NO: 3317483 - DNA, 13 bp, Homo sapiens
acacctgccctgc

SEQ ID NO: 3317484 - DNA, 15 bp, Homo sapiens
acacctggactgagc

SEQ ID NO: 3317485 - DNA, 23 bp, Homo sapiens
acacctggctgaggttcctctgc

SEQ ID NO: 3317486 - DNA, 23 bp, Homo sapiens
acacctgttcacagaaaaagcat

SEQ ID NO: 3317487 - DNA, 14 bp, Homo sapiens
acaccttcattttg

SEQ ID NO: 3317488 - DNA, 14 bp, Homo sapiens
acaccttccagggc

SEQ ID NO: 3317489 - DNA, 15 bp, Homo sapiens
acaccttcctcctgc

SEQ ID NO: 3317490 - DNA, 14 bp, Homo sapiens
acaccttgacaggg

SEQ ID NO: 3317491 - DNA, 15 bp, Homo sapiens
acaccttgacagggc

SEQ ID NO: 3317492 - DNA, 20 bp, Homo sapiens
acaccttggacatcctcctc

SEQ ID NO: 3317493 - DNA, 22 bp, Homo sapiens
acaccttggacatcctcctccc

SEQ ID NO: 3317494 - DNA, 23 bp, Homo sapiens
acaccttggggtccctccacccc

SEQ ID NO: 3317495 - DNA, 23 bp, Homo sapiens
acaccttgtgaccttctctatat

SEQ ID NO: 3317496 - DNA, 15 bp, Homo sapiens
acaccttttaactca

SEQ ID NO: 3317497 - DNA, 23 bp, Homo sapiens
acaccttttattgacacagaaaa

SEQ ID NO: 3317498 - DNA, 17 bp, Homo sapiens
acacgaaacttgttatt

SEQ ID NO: 3317499 - DNA, 14 bp, Homo sapiens
acacgaaagaaatg

SEQ ID NO: 3317500 - DNA, 15 bp, Homo sapiens
acacgaaagaaatgt

SEQ ID NO: 3317501 - DNA, 15 bp, Homo sapiens
acacgaactgaaatg

SEQ ID NO: 3317502 - DNA, 24 bp, Homo sapiens
acacgatgcatttaataaagatga

SEQ ID NO: 3317503 - DNA, 14 bp, Homo sapiens
acacgatgccgaga

SEQ ID NO: 3317504 - DNA, 16 bp, Homo sapiens
acacgcaagggcatca

SEQ ID NO: 3317505 - DNA, 23 bp, Homo sapiens
acacgcgggcgcgatcccacaca

SEQ ID NO: 3317506 - DNA, 17 bp, Homo sapiens
acacgcgtgcacacacc

SEQ ID NO: 3317507 - DNA, 22 bp, Homo sapiens
acacggagcccagccctcccca

SEQ ID NO: 3317508 - DNA, 20 bp, Homo sapiens
acacgggaaagccttaaaaa

SEQ ID NO: 3317509 - DNA, 19 bp, Homo sapiens
acacgtacctctcatcagt

SEQ ID NO: 3317510 - DNA, 19 bp, Homo sapiens
acacgtatttatatttgga

SEQ ID NO: 3317511 - DNA, 23 bp, Homo sapiens
acacgtggcctcgtgaggggcaa

SEQ ID NO: 3317512 - DNA, 14 bp, Homo sapiens
acacgtttttacat

SEQ ID NO: 3317513 - DNA, 14 bp, Homo sapiens
acactaaaaataaa

SEQ ID NO: 3317514 - DNA, 14 bp, Homo sapiens
acactaaaatttta

SEQ ID NO: 3317515 - DNA, 18 bp, Homo sapiens
acactaaaattttaggca

SEQ ID NO: 3317516 - DNA, 16 bp, Homo sapiens
acactaaccaagctga

SEQ ID NO: 3317517 - DNA, 19 bp, Homo sapiens
acactaaccacgctggacc

SEQ ID NO: 3317518 - DNA, 23 bp, Homo sapiens
acactaattcctttctatcctac

SEQ ID NO: 3317519 - DNA, 20 bp, Homo sapiens
acactagcccaatgaaatga

SEQ ID NO: 3317520 - DNA, 19 bp, Homo sapiens
acactagttttgtgccagc

SEQ ID NO: 3317521 - DNA, 23 bp, Homo sapiens
acactagttttgtgccagccgtg

SEQ ID NO: 3317522 - DNA, 17 bp, Homo sapiens
acactatatattttatg

SEQ ID NO: 3317523 - DNA, 14 bp, Homo sapiens
acactatgcacaga

SEQ ID NO: 3317524 - DNA, 16 bp, Homo sapiens
acactatgcacagagc

SEQ ID NO: 3317525 - DNA, 18 bp, Homo sapiens
acactattaccatgagaa

SEQ ID NO: 3317526 - DNA, 16 bp, Homo sapiens
acactattcactaaaa

SEQ ID NO: 3317527 - DNA, 16 bp, Homo sapiens
acactattttcagaat

SEQ ID NO: 3317528 - DNA, 16 bp, Homo sapiens
acactcaaaagacaaa

SEQ ID NO: 3317529 - DNA, 14 bp, Homo sapiens
acactcaataaatt

SEQ ID NO: 3317530 - DNA, 22 bp, Homo sapiens
acactcacatttattctgctca

SEQ ID NO: 3317531 - DNA, 14 bp, Homo sapiens
acactcagacctga

SEQ ID NO: 3317532 - DNA, 16 bp, Homo sapiens
acactcagttgttcaa

SEQ ID NO: 3317533 - DNA, 14 bp, Homo sapiens
acactccagcctga

SEQ ID NO: 3317534 - DNA, 16 bp, Homo sapiens
acactccagcctgagc

SEQ ID NO: 3317535 - DNA, 14 bp, Homo sapiens
acactccaggccct

SEQ ID NO: 3317536 - DNA, 15 bp, Homo sapiens
acactccaggccctg

SEQ ID NO: 3317537 - DNA, 19 bp, Homo sapiens
acactccagtgccagcaat

SEQ ID NO: 3317538 - DNA, 21 bp, Homo sapiens
acactccagtgccagcaatga

SEQ ID NO: 3317539 - DNA, 15 bp, Homo sapiens
acactccccgaagtc

SEQ ID NO: 3317540 - DNA, 14 bp, Homo sapiens
acactctctggaag

SEQ ID NO: 3317541 - DNA, 13 bp, Homo sapiens
acactcttcagtg

SEQ ID NO: 3317542 - DNA, 22 bp, Homo sapiens
acactcttcagtgactcctgct

SEQ ID NO: 3317543 - DNA, 16 bp, Homo sapiens
acactctttgtaagag

SEQ ID NO: 3317544 - DNA, 13 bp, Homo sapiens
acactgaaaaatt

SEQ ID NO: 3317545 - DNA, 18 bp, Homo sapiens
acactgaatatttatatt

SEQ ID NO: 3317546 - DNA, 21 bp, Homo sapiens
acactgagccccacctctcca

SEQ ID NO: 3317547 - DNA, 20 bp, Homo sapiens
acactgagttctatcagtta

SEQ ID NO: 3317548 - DNA, 13 bp, Homo sapiens
acactgattttgt

SEQ ID NO: 3317549 - DNA, 11 bp, Homo sapiens
acactgccaaa

SEQ ID NO: 3317550 - DNA, 18 bp, Homo sapiens
acactgccaaataaacag

SEQ ID NO: 3317551 - DNA, 19 bp, Homo sapiens
acactgccgacatcagcat

SEQ ID NO: 3317552 - DNA, 14 bp, Homo sapiens
acactgcctgtata

SEQ ID NO: 3317553 - DNA, 14 bp, Homo sapiens
acactgctctaaca

SEQ ID NO: 3317554 - DNA, 17 bp, Homo sapiens
acactgctctaacagcc

SEQ ID NO: 3317555 - DNA, 19 bp, Homo sapiens
acactgctctaacagccct

SEQ ID NO: 3317556 - DNA, 15 bp, Homo sapiens
acactgctcttaaga

SEQ ID NO: 3317557 - DNA, 18 bp, Homo sapiens
acactgctcttaagaaac

SEQ ID NO: 3317558 - DNA, 19 bp, Homo sapiens
acactgctcttaagaaact

SEQ ID NO: 3317559 - DNA, 14 bp, Homo sapiens
acactggcccctca

SEQ ID NO: 3317560 - DNA, 22 bp, Homo sapiens
acactggctaaagataattgct

SEQ ID NO: 3317561 - DNA, 15 bp, Homo sapiens
acactggctctggga

SEQ ID NO: 3317562 - DNA, 16 bp, Homo sapiens
acactggctctgggac

SEQ ID NO: 3317563 - DNA, 17 bp, Homo sapiens
acactggctctgggact

SEQ ID NO: 3317564 - DNA, 15 bp, Homo sapiens
acactggtctgctgt

SEQ ID NO: 3317565 - DNA, 21 bp, Homo sapiens
acactggtgggcagctgagga

SEQ ID NO: 3317566 - DNA, 22 bp, Homo sapiens
acactggtttggtcagttacaa

SEQ ID NO: 3317567 - DNA, 21 bp, Homo sapiens
acactgtatttgtatctctga

SEQ ID NO: 3317568 - DNA, 18 bp, Homo sapiens
acactgtgccctggtgga

SEQ ID NO: 3317569 - DNA, 13 bp, Homo sapiens
acactgtgctata

SEQ ID NO: 3317570 - DNA, 15 bp, Homo sapiens
acactgtgctataaa

SEQ ID NO: 3317571 - DNA, 17 bp, Homo sapiens
acactgtgtacacctca

SEQ ID NO: 3317572 - DNA, 22 bp, Homo sapiens
acactgtgtcccccccagtgca

SEQ ID NO: 3317573 - DNA, 18 bp, Homo sapiens
acactgttagaacactat

SEQ ID NO: 3317574 - DNA, 14 bp, Homo sapiens
acactgttctgaaa

SEQ ID NO: 3317575 - DNA, 16 bp, Homo sapiens
acacttaaaattgtaa

SEQ ID NO: 3317576 - DNA, 14 bp, Homo sapiens
acacttaacagatg

SEQ ID NO: 3317577 - DNA, 16 bp, Homo sapiens
acacttaacagatgca

SEQ ID NO: 3317578 - DNA, 13 bp, Homo sapiens
acacttaatagca

SEQ ID NO: 3317579 - DNA, 18 bp, Homo sapiens
acacttcaaggtgacaga

SEQ ID NO: 3317580 - DNA, 19 bp, Homo sapiens
acacttcagagagctggta

SEQ ID NO: 3317581 - DNA, 20 bp, Homo sapiens
acacttcagagagctggtag

SEQ ID NO: 3317582 - DNA, 15 bp, Homo sapiens
acacttcaggctctt

SEQ ID NO: 3317583 - DNA, 19 bp, Homo sapiens
acacttcaggctcttctcc

SEQ ID NO: 3317584 - DNA, 22 bp, Homo sapiens
acacttcaggctcttctccttt

SEQ ID NO: 3317585 - DNA, 16 bp, Homo sapiens
acagaaaccagaaaag

SEQ ID NO: 3317586 - DNA, 17 bp, Homo sapiens
acagaaacctatcctca

SEQ ID NO: 3317587 - DNA, 12 bp, Homo sapiens
acagaaactgat

SEQ ID NO: 3317588 - DNA, 13 bp, Homo sapiens
acagaaactgatg

SEQ ID NO: 3317589 - DNA, 19 bp, Homo sapiens
acagaaactggattaaaac

SEQ ID NO: 3317590 - DNA, 23 bp, Homo sapiens
acagaaactggattaaaacaatt

SEQ ID NO: 3317591 - DNA, 16 bp, Homo sapiens
acagaaagtttgtaaa

SEQ ID NO: 3317592 - DNA, 17 bp, Homo sapiens
acagaaagtttgtaaaa

SEQ ID NO: 3317593 - DNA, 13 bp, Homo sapiens
acagaaatactat

SEQ ID NO: 3317594 - DNA, 17 bp, Homo sapiens
acagaaatataataaaa

SEQ ID NO: 3317595 - DNA, 17 bp, Homo sapiens
acagaaatatatataca

SEQ ID NO: 3317596 - DNA, 19 bp, Homo sapiens
acagaaatatatatacata

SEQ ID NO: 3317597 - DNA, 20 bp, Homo sapiens
acagaaatcagaggagagac

SEQ ID NO: 3317598 - DNA, 19 bp, Homo sapiens
acagaaatgtgtcaatgta

SEQ ID NO: 3317599 - DNA, 17 bp, Homo sapiens
acagaaattagccgggc

SEQ ID NO: 3317600 - DNA, 13 bp, Homo sapiens
acagaacagggtc

SEQ ID NO: 3317601 - DNA, 17 bp, Homo sapiens
acagaacccctacatga

SEQ ID NO: 3317602 - DNA, 15 bp, Homo sapiens
acagaactaaatgtt

SEQ ID NO: 3317603 - DNA, 16 bp, Homo sapiens
acagaactaaatgttc

SEQ ID NO: 3317604 - DNA, 18 bp, Homo sapiens
acagaactaaatgttcta

SEQ ID NO: 3317605 - DNA, 16 bp, Homo sapiens
acagaagcagcttctt

SEQ ID NO: 3317606 - DNA, 18 bp, Homo sapiens
acagaagcaggctggagg

SEQ ID NO: 3317607 - DNA, 20 bp, Homo sapiens
acagaagcatttgtattttg

SEQ ID NO: 3317608 - DNA, 21 bp, Homo sapiens
acagaagcatttgtattttgt

SEQ ID NO: 3317609 - DNA, 17 bp, Homo sapiens
acagaagccaagctccc

SEQ ID NO: 3317610 - DNA, 20 bp, Homo sapiens
acagaagccaagctccctgg

SEQ ID NO: 3317611 - DNA, 21 bp, Homo sapiens
acagaagccaagctccctgga

SEQ ID NO: 3317612 - DNA, 13 bp, Homo sapiens
acagaagcttcag

SEQ ID NO: 3317613 - DNA, 14 bp, Homo sapiens
acagaataaagcag

SEQ ID NO: 3317614 - DNA, 23 bp, Homo sapiens
acagaataatccagtattgctga

SEQ ID NO: 3317615 - DNA, 21 bp, Homo sapiens
acagaatatttctattgaatt

SEQ ID NO: 3317616 - DNA, 10 bp, Homo sapiens
acagaatttt

SEQ ID NO: 3317617 - DNA, 13 bp, Homo sapiens
acagaatttttcc

SEQ ID NO: 3317618 - DNA, 15 bp, Homo sapiens
acagacaagcagccc

SEQ ID NO: 3317619 - DNA, 16 bp, Homo sapiens
acagacacacacacgc

SEQ ID NO: 3317620 - DNA, 17 bp, Homo sapiens
acagacacacacacgca

SEQ ID NO: 3317621 - DNA, 22 bp, Homo sapiens
acagacacacacacgcacgcac

SEQ ID NO: 3317622 - DNA, 17 bp, Homo sapiens
acagacacaggcccggc

SEQ ID NO: 3317623 - DNA, 20 bp, Homo sapiens
acagacacgagccacctcac

SEQ ID NO: 3317624 - DNA, 15 bp, Homo sapiens
acagacaggctctta

SEQ ID NO: 3317625 - DNA, 20 bp, Homo sapiens
acagaccacatctttatctg

SEQ ID NO: 3317626 - DNA, 19 bp, Homo sapiens
acagaccagtgaccccaga

SEQ ID NO: 3317627 - DNA, 20 bp, Homo sapiens
acagacccaggtcttccaga

SEQ ID NO: 3317628 - DNA, 22 bp, Homo sapiens
acagacccctcccctcgtgtca

SEQ ID NO: 3317629 - DNA, 23 bp, Homo sapiens
acagactagcaggctactgggac

SEQ ID NO: 3317630 - DNA, 17 bp, Homo sapiens
acagactggaagcacag

SEQ ID NO: 3317631 - DNA, 12 bp, Homo sapiens
acagactgtttt

SEQ ID NO: 3317632 - DNA, 18 bp, Homo sapiens
acagactgttttactgtt

SEQ ID NO: 3317633 - DNA, 21 bp, Homo sapiens
acagactgttttactgtttta

SEQ ID NO: 3317634 - DNA, 16 bp, Homo sapiens
acagacttctccagac

SEQ ID NO: 3317635 - DNA, 18 bp, Homo sapiens
acagacttctggaaggct

SEQ ID NO: 3317636 - DNA, 20 bp, Homo sapiens
acagacttctggaaggctgg

SEQ ID NO: 3317637 - DNA, 15 bp, Homo sapiens
acagacttgagaact

SEQ ID NO: 3317638 - DNA, 18 bp, Homo sapiens
acagacttgagaacttga

SEQ ID NO: 3317639 - DNA, 14 bp, Homo sapiens
acagactttagctt

SEQ ID NO: 3317640 - DNA, 20 bp, Homo sapiens
acagagaagcggatttccag

SEQ ID NO: 3317641 - DNA, 19 bp, Homo sapiens
acagagaaggcgcttccca

SEQ ID NO: 3317642 - DNA, 13 bp, Homo sapiens
acagagaataact

SEQ ID NO: 3317643 - DNA, 21 bp, Homo sapiens
acagagacaggcccaagagat

SEQ ID NO: 3317644 - DNA, 11 bp, Homo sapiens
acagagaccta

SEQ ID NO: 3317645 - DNA, 23 bp, Homo sapiens
acagagactcagatgaggacaga

SEQ ID NO: 3317646 - DNA, 14 bp, Homo sapiens
acagagagaaaaag

SEQ ID NO: 3317647 - DNA, 17 bp, Homo sapiens
acagagattgaactcca

SEQ ID NO: 3317648 - DNA, 15 bp, Homo sapiens
acagagcaagactct

SEQ ID NO: 3317649 - DNA, 20 bp, Homo sapiens
acagagcactaggttcaatt

SEQ ID NO: 3317650 - DNA, 12 bp, Homo sapiens
acagagcctgcc

SEQ ID NO: 3317651 - DNA, 18 bp, Homo sapiens
acagagcctgcctaacca

SEQ ID NO: 3317652 - DNA, 22 bp, Homo sapiens
acagagcctgcctaaccaggcc

SEQ ID NO: 3317653 - DNA, 15 bp, Homo sapiens
acagagcgcccctcc

SEQ ID NO: 3317654 - DNA, 20 bp, Homo sapiens
acagaggaagaatttgttat

SEQ ID NO: 3317655 - DNA, 14 bp, Homo sapiens
acagaggaagagca

SEQ ID NO: 3317656 - DNA, 23 bp, Homo sapiens
acagagtatgaacacctgggctt

SEQ ID NO: 3317657 - DNA, 14 bp, Homo sapiens
acagagtctcactg

SEQ ID NO: 3317658 - DNA, 19 bp, Homo sapiens
acagagtctcactgttgcc

SEQ ID NO: 3317659 - DNA, 19 bp, Homo sapiens
acagagtgagactctgtct

SEQ ID NO: 3317660 - DNA, 19 bp, Homo sapiens
acagagtgagccagtgagg

SEQ ID NO: 3317661 - DNA, 17 bp, Homo sapiens
acagagtgctggactgt

SEQ ID NO: 3317662 - DNA, 15 bp, Homo sapiens
acagagttcacagga

SEQ ID NO: 3317663 - DNA, 13 bp, Homo sapiens
acagagttgattt

SEQ ID NO: 3317664 - DNA, 14 bp, Homo sapiens
acagataatcagtg

SEQ ID NO: 3317665 - DNA, 12 bp, Homo sapiens
acagataccata

SEQ ID NO: 3317666 - DNA, 22 bp, Homo sapiens
acagatactggaagttttgcat

SEQ ID NO: 3317667 - DNA, 17 bp, Homo sapiens
acagatataaatggctg

SEQ ID NO: 3317668 - DNA, 15 bp, Homo sapiens
acagatatactttgt

SEQ ID NO: 3317669 - DNA, 16 bp, Homo sapiens
acagatgaaaatttga

SEQ ID NO: 3317670 - DNA, 19 bp, Homo sapiens
acagatgaactctttctgg

SEQ ID NO: 3317671 - DNA, 18 bp, Homo sapiens
acagatgaccataatttt

SEQ ID NO: 3317672 - DNA, 12 bp, Homo sapiens
acagatgatact

SEQ ID NO: 3317673 - DNA, 18 bp, Homo sapiens
acagatgatacttccaag

SEQ ID NO: 3317674 - DNA, 19 bp, Homo sapiens
acagatgccccagagctgt

SEQ ID NO: 3317675 - DNA, 19 bp, Homo sapiens
acagatggaaaaactgagg

SEQ ID NO: 3317676 - DNA, 21 bp, Homo sapiens
acagatggaaaaactgaggct

SEQ ID NO: 3317677 - DNA, 20 bp, Homo sapiens
acagatgtcagccgagccgg

SEQ ID NO: 3317678 - DNA, 16 bp, Homo sapiens
acagatgtctctgggg

SEQ ID NO: 3317679 - DNA, 12 bp, Homo sapiens
acagatgtgaaa

SEQ ID NO: 3317680 - DNA, 14 bp, Homo sapiens
acagatgtgaaaat

SEQ ID NO: 3317681 - DNA, 20 bp, Homo sapiens
acagatgtgggccaccatgt

SEQ ID NO: 3317682 - DNA, 18 bp, Homo sapiens
acagattcaggccagccc

SEQ ID NO: 3317683 - DNA, 15 bp, Homo sapiens
acagattctgacatt

SEQ ID NO: 3317684 - DNA, 20 bp, Homo sapiens
acagattctgacatttatat

SEQ ID NO: 3317685 - DNA, 19 bp, Homo sapiens
acagattctttcagttctt

SEQ ID NO: 3317686 - DNA, 20 bp, Homo sapiens
acagattctttcagttcttt

SEQ ID NO: 3317687 - DNA, 13 bp, Homo sapiens
acagattgcctcc

SEQ ID NO: 3317688 - DNA, 24 bp, Homo sapiens
acagattggagagggctctgtgct

SEQ ID NO: 3317689 - DNA, 15 bp, Homo sapiens
acagattgtttctat

SEQ ID NO: 3317690 - DNA, 16 bp, Homo sapiens
acagattgtttctata

SEQ ID NO: 3317691 - DNA, 14 bp, Homo sapiens
acagattttaattg

SEQ ID NO: 3317692 - DNA, 18 bp, Homo sapiens
acagattttaattgtcat

SEQ ID NO: 3317693 - DNA, 19 bp, Homo sapiens
acagattttaattgtcatg

SEQ ID NO: 3317694 - DNA, 21 bp, Homo sapiens
acagattttatttgtaatttt

SEQ ID NO: 3317695 - DNA, 15 bp, Homo sapiens
acagattttctagaa

SEQ ID NO: 3317696 - DNA, 15 bp, Homo sapiens
acagatttttacaaa

SEQ ID NO: 3317697 - DNA, 20 bp, Homo sapiens
acagcaacaatttatgaatt

SEQ ID NO: 3317698 - DNA, 16 bp, Homo sapiens
acagcaatatttaaca

SEQ ID NO: 3317699 - DNA, 20 bp, Homo sapiens
acagcaatatttaacaattt

SEQ ID NO: 3317700 - DNA, 14 bp, Homo sapiens
acagcaatttctaa

SEQ ID NO: 3317701 - DNA, 14 bp, Homo sapiens
acagcacaccagcc

SEQ ID NO: 3317702 - DNA, 17 bp, Homo sapiens
acagcacaccagccgct

SEQ ID NO: 3317703 - DNA, 20 bp, Homo sapiens
acagcacaccagccgctgca

SEQ ID NO: 3317704 - DNA, 20 bp, Homo sapiens
acagcacagctccctgccaa

SEQ ID NO: 3317705 - DNA, 20 bp, Homo sapiens
acagcactactctgtgccag

SEQ ID NO: 3317706 - DNA, 20 bp, Homo sapiens
acagcactggctctctccag

SEQ ID NO: 3317707 - DNA, 14 bp, Homo sapiens
acagcactggggag

SEQ ID NO: 3317708 - DNA, 20 bp, Homo sapiens
acagcagccccccagcacta

SEQ ID NO: 3317709 - DNA, 18 bp, Homo sapiens
acagcagcccctgcacaa

SEQ ID NO: 3317710 - DNA, 13 bp, Homo sapiens
acagcagcctgct

SEQ ID NO: 3317711 - DNA, 16 bp, Homo sapiens
acagcaggcagcgcca

SEQ ID NO: 3317712 - DNA, 22 bp, Homo sapiens
acagcagtcccagtattctcag

SEQ ID NO: 3317713 - DNA, 14 bp, Homo sapiens
acagcagtctcctt

SEQ ID NO: 3317714 - DNA, 15 bp, Homo sapiens
aacaataaatgtgca

SEQ ID NO: 3317715 - DNA, 17 bp, Homo sapiens
aacaataactactgtgt

SEQ ID NO: 3317716 - DNA, 15 bp, Homo sapiens
aacaataatatttca

SEQ ID NO: 3317717 - DNA, 13 bp, Homo sapiens
aacaatatcatat

SEQ ID NO: 3317718 - DNA, 18 bp, Homo sapiens
aacaatatcatatcatca

SEQ ID NO: 3317719 - DNA, 19 bp, Homo sapiens
aacaatatgaggagacatt

SEQ ID NO: 3317720 - DNA, 22 bp, Homo sapiens
aacaatccatgtgattaatgtt

SEQ ID NO: 3317721 - DNA, 23 bp, Homo sapiens
aacaatccatgtgattaatgttt

SEQ ID NO: 3317722 - DNA, 15 bp, Homo sapiens
aacaatccattcaca

SEQ ID NO: 3317723 - DNA, 16 bp, Homo sapiens
aacaatccattcacaa

SEQ ID NO: 3317724 - DNA, 14 bp, Homo sapiens
aacaatcctttctg

SEQ ID NO: 3317725 - DNA, 15 bp, Homo sapiens
aacaatctaacaata

SEQ ID NO: 3317726 - DNA, 17 bp, Homo sapiens
aacaatctggaagaaaa

SEQ ID NO: 3317727 - DNA, 23 bp, Homo sapiens
aacaatcttattccgagcattcc

SEQ ID NO: 3317728 - DNA, 18 bp, Homo sapiens
aacaatgaaaactctttg

SEQ ID NO: 3317729 - DNA, 14 bp, Homo sapiens
aacaatgaagataa

SEQ ID NO: 3317730 - DNA, 18 bp, Homo sapiens
aacaatgaagataaaaag

SEQ ID NO: 3317731 - DNA, 15 bp, Homo sapiens
aacaatgatgccctg

SEQ ID NO: 3317732 - DNA, 13 bp, Homo sapiens
aacaatgtataaa

SEQ ID NO: 3317733 - DNA, 13 bp, Homo sapiens
aacaatgttaagg

SEQ ID NO: 3317734 - DNA, 18 bp, Homo sapiens
aacaatgttaaggaaact

SEQ ID NO: 3317735 - DNA, 17 bp, Homo sapiens
aacaatgttgtccaaca

SEQ ID NO: 3317736 - DNA, 21 bp, Homo sapiens
aacaatgttgtccaacaataa

SEQ ID NO: 3317737 - DNA, 23 bp, Homo sapiens
aacaattgaagtaaactttttgt

SEQ ID NO: 3317738 - DNA, 20 bp, Homo sapiens
aacaattgtgtagccttttt

SEQ ID NO: 3317739 - DNA, 23 bp, Homo sapiens
aacaattgtgtagcctttttgta

SEQ ID NO: 3317740 - DNA, 13 bp, Homo sapiens
aacaattttaatg

SEQ ID NO: 3317741 - DNA, 17 bp, Homo sapiens
aacaattttttttttcc

SEQ ID NO: 3317742 - DNA, 19 bp, Homo sapiens
aacacaaactgtaaataaa

SEQ ID NO: 3317743 - DNA, 22 bp, Homo sapiens
aacacaagaaaaagataagaaa

SEQ ID NO: 3317744 - DNA, 12 bp, Homo sapiens
aacacaagcaaa

SEQ ID NO: 3317745 - DNA, 13 bp, Homo sapiens
aacacaataccta

SEQ ID NO: 3317746 - DNA, 19 bp, Homo sapiens
aacacaatggagtgtgtaa

SEQ ID NO: 3317747 - DNA, 13 bp, Homo sapiens
aacacaatgttat

SEQ ID NO: 3317748 - DNA, 16 bp, Homo sapiens
aacacacagatctgca

SEQ ID NO: 3317749 - DNA, 16 bp, Homo sapiens
aacacaccaggctgtg

SEQ ID NO: 3317750 - DNA, 21 bp, Homo sapiens
aacacactactacctcttaag

SEQ ID NO: 3317751 - DNA, 22 bp, Homo sapiens
aacacagagaagcggatttcca

SEQ ID NO: 3317752 - DNA, 23 bp, Homo sapiens
aacacagagaagcggatttccag

SEQ ID NO: 3317753 - DNA, 18 bp, Homo sapiens
aacacagcaattcctcag

SEQ ID NO: 3317754 - DNA, 14 bp, Homo sapiens
aacacagcatgtgc

SEQ ID NO: 3317755 - DNA, 16 bp, Homo sapiens
aacacagcatgtgcca

SEQ ID NO: 3317756 - DNA, 18 bp, Homo sapiens
aacacagcatgtgtattt

SEQ ID NO: 3317757 - DNA, 17 bp, Homo sapiens
aacacagctgttcttct

SEQ ID NO: 3317758 - DNA, 18 bp, Homo sapiens
aacacagctgttcttctg

SEQ ID NO: 3317759 - DNA, 22 bp, Homo sapiens
aacacaggcaaaatccttgctt

SEQ ID NO: 3317760 - DNA, 17 bp, Homo sapiens
aacacagggttttgtat

SEQ ID NO: 3317761 - DNA, 12 bp, Homo sapiens
aacacagtattt

SEQ ID NO: 3317762 - DNA, 16 bp, Homo sapiens
aacacagtcaaaataa

SEQ ID NO: 3317763 - DNA, 19 bp, Homo sapiens
aacacagtcaaaataattc

SEQ ID NO: 3317764 - DNA, 13 bp, Homo sapiens
aacacagtttagt

SEQ ID NO: 3317765 - DNA, 14 bp, Homo sapiens
aacacagttttgaa

SEQ ID NO: 3317766 - DNA, 20 bp, Homo sapiens
aacacagttttgaaagaaaa

SEQ ID NO: 3317767 - DNA, 15 bp, Homo sapiens
aacacataaattatg

SEQ ID NO: 3317768 - DNA, 17 bp, Homo sapiens
aacacataactagaaac

SEQ ID NO: 3317769 - DNA, 20 bp, Homo sapiens
aacacatagcgccgtgctgt

SEQ ID NO: 3317770 - DNA, 17 bp, Homo sapiens
aacacatcaaataaact

SEQ ID NO: 3317771 - DNA, 19 bp, Homo sapiens
aacacattgaatgcgcttt

SEQ ID NO: 3317772 - DNA, 14 bp, Homo sapiens
aacaccacagaaat

SEQ ID NO: 3317773 - DNA, 16 bp, Homo sapiens
aacaccacagacacac

SEQ ID NO: 3317774 - DNA, 18 bp, Homo sapiens
aacaccacagacacacac

SEQ ID NO: 3317775 - DNA, 15 bp, Homo sapiens
aacaccattgaaggc

SEQ ID NO: 3317776 - DNA, 17 bp, Homo sapiens
aacaccattgaaggctt

SEQ ID NO: 3317777 - DNA, 19 bp, Homo sapiens
aacaccattgaaggcttaa

SEQ ID NO: 3317778 - DNA, 14 bp, Homo sapiens
aacacccttagaaa

SEQ ID NO: 3317779 - DNA, 20 bp, Homo sapiens
aacaccgcttctgccttttc

SEQ ID NO: 3317780 - DNA, 19 bp, Homo sapiens
aacacctagctttattctt

SEQ ID NO: 3317781 - DNA, 22 bp, Homo sapiens
aacaccttcagaggctgaggtg

SEQ ID NO: 3317782 - DNA, 16 bp, Homo sapiens
aacaccttcctcctgc

SEQ ID NO: 3317783 - DNA, 12 bp, Homo sapiens
aacacgaaactt

SEQ ID NO: 3317784 - DNA, 14 bp, Homo sapiens
aacacgaaacttgt

SEQ ID NO: 3317785 - DNA, 16 bp, Homo sapiens
aacacgaaacttgtta

SEQ ID NO: 3317786 - DNA, 19 bp, Homo sapiens
aacacgaaacttgttattg

SEQ ID NO: 3317787 - DNA, 19 bp, Homo sapiens
aacacgcatggtcaaccct

SEQ ID NO: 3317788 - DNA, 14 bp, Homo sapiens
aacacgcattgtac

SEQ ID NO: 3317789 - DNA, 15 bp, Homo sapiens
aacacgtttttacat

SEQ ID NO: 3317790 - DNA, 15 bp, Homo sapiens
aacactaaaaataaa

SEQ ID NO: 3317791 - DNA, 23 bp, Homo sapiens
aacactagggccttggaaattcc

SEQ ID NO: 3317792 - DNA, 14 bp, Homo sapiens
aacactccaggccc

SEQ ID NO: 3317793 - DNA, 15 bp, Homo sapiens
aacactccaggccct

SEQ ID NO: 3317794 - DNA, 16 bp, Homo sapiens
aacactccaggccctg

SEQ ID NO: 3317795 - DNA, 21 bp, Homo sapiens
aacactccaggccctgccccc

SEQ ID NO: 3317796 - DNA, 21 bp, Homo sapiens
aacactccccattaacagatg

SEQ ID NO: 3317797 - DNA, 20 bp, Homo sapiens
aacactggcacactgctctt

SEQ ID NO: 3317798 - DNA, 14 bp, Homo sapiens
aacactggtgccaa

SEQ ID NO: 3317799 - DNA, 23 bp, Homo sapiens
aacactggtggaggatggaaagg

SEQ ID NO: 3317800 - DNA, 18 bp, Homo sapiens
aacactgtgccctggtgg

SEQ ID NO: 3317801 - DNA, 22 bp, Homo sapiens
aacactgtgtacacctcaaata

SEQ ID NO: 3317802 - DNA, 18 bp, Homo sapiens
aacacttatcttctggat

SEQ ID NO: 3317803 - DNA, 11 bp, Homo sapiens
aacacttccat

SEQ ID NO: 3317804 - DNA, 23 bp, Homo sapiens
aacactttgagcatttttaaggg

SEQ ID NO: 3317805 - DNA, 13 bp, Homo sapiens
aacactttgtatt

SEQ ID NO: 3317806 - DNA, 16 bp, Homo sapiens
aacagaaaaacaatct

SEQ ID NO: 3317807 - DNA, 16 bp, Homo sapiens
aacagaaaaataagtc

SEQ ID NO: 3317808 - DNA, 19 bp, Homo sapiens
aacagaaagtcattccttc

SEQ ID NO: 3317809 - DNA, 15 bp, Homo sapiens
aacagaacagcttca

SEQ ID NO: 3317810 - DNA, 13 bp, Homo sapiens
aacagaacagggt

SEQ ID NO: 3317811 - DNA, 16 bp, Homo sapiens
aacagaactaaatgtt

SEQ ID NO: 3317812 - DNA, 15 bp, Homo sapiens
aacagaactcccttc

SEQ ID NO: 3317813 - DNA, 14 bp, Homo sapiens
aacagaagcttcca

SEQ ID NO: 3317814 - DNA, 21 bp, Homo sapiens
aacagacaatatgtgagtgcc

SEQ ID NO: 3317815 - DNA, 19 bp, Homo sapiens
aacagacaccatcttttgt

SEQ ID NO: 3317816 - DNA, 18 bp, Homo sapiens
aacagaccccctctagaa

SEQ ID NO: 3317817 - DNA, 14 bp, Homo sapiens
aacagagaaagggt

SEQ ID NO: 3317818 - DNA, 19 bp, Homo sapiens
aacagagacaggcccaaga

SEQ ID NO: 3317819 - DNA, 14 bp, Homo sapiens
aacagagcctgcct

SEQ ID NO: 3317820 - DNA, 20 bp, Homo sapiens
aacagaggaagaatttgtta

SEQ ID NO: 3317821 - DNA, 19 bp, Homo sapiens
aacagagggctgcattcga

SEQ ID NO: 3317822 - DNA, 15 bp, Homo sapiens
aacagagtggcctcc

SEQ ID NO: 3317823 - DNA, 20 bp, Homo sapiens
aacagatagttgtgttttta

SEQ ID NO: 3317824 - DNA, 20 bp, Homo sapiens
aacagatataaatggctggt

SEQ ID NO: 3317825 - DNA, 15 bp, Homo sapiens
aacagatgtgaaaat

SEQ ID NO: 3317826 - DNA, 17 bp, Homo sapiens
aacagattcaggccagc

SEQ ID NO: 3317827 - DNA, 18 bp, Homo sapiens
aacagattcaggccagcc

SEQ ID NO: 3317828 - DNA, 14 bp, Homo sapiens
aacagatttttaca

SEQ ID NO: 3317829 - DNA, 13 bp, Homo sapiens
aacagcaactaca

SEQ ID NO: 3317830 - DNA, 13 bp, Homo sapiens
aacagcaagaaat

SEQ ID NO: 3317831 - DNA, 18 bp, Homo sapiens
aacagcactggctctctc

SEQ ID NO: 3317832 - DNA, 21 bp, Homo sapiens
aacagcagggtagtctggttt

SEQ ID NO: 3317833 - DNA, 11 bp, Homo sapiens
aacagcagtgt

SEQ ID NO: 3317834 - DNA, 13 bp, Homo sapiens
aacagcagtgttc

SEQ ID NO: 3317835 - DNA, 15 bp, Homo sapiens
aacagcagtgttccc

SEQ ID NO: 3317836 - DNA, 14 bp, Homo sapiens
aacagcattgcttt

SEQ ID NO: 3317837 - DNA, 16 bp, Homo sapiens
aacagcattgctttct

SEQ ID NO: 3317838 - DNA, 20 bp, Homo sapiens
aacagcattgctttctgaaa

SEQ ID NO: 3317839 - DNA, 16 bp, Homo sapiens
aacagccaagtgtgac

SEQ ID NO: 3317840 - DNA, 12 bp, Homo sapiens
aacagccagcaa

SEQ ID NO: 3317841 - DNA, 11 bp, Homo sapiens
aacagccatgc

SEQ ID NO: 3317842 - DNA, 16 bp, Homo sapiens
aacagccatgcccgca

SEQ ID NO: 3317843 - DNA, 22 bp, Homo sapiens
aacagccatgtccaagttcttc

SEQ ID NO: 3317844 - DNA, 21 bp, Homo sapiens
aagaatttattgaatatttat

SEQ ID NO: 3317845 - DNA, 14 bp, Homo sapiens
aagaatttcacaag

SEQ ID NO: 3317846 - DNA, 18 bp, Homo sapiens
aagacaaagtcccagaat

SEQ ID NO: 3317847 - DNA, 21 bp, Homo sapiens
aagacaaagtcccagaattgt

SEQ ID NO: 3317848 - DNA, 18 bp, Homo sapiens
aagacaagtatgaatatt

SEQ ID NO: 3317849 - DNA, 22 bp, Homo sapiens
aagacaatagcacttaaattcc

SEQ ID NO: 3317850 - DNA, 16 bp, Homo sapiens
aagacaatcactgaaa

SEQ ID NO: 3317851 - DNA, 16 bp, Homo sapiens
aagacaccagagcaga

SEQ ID NO: 3317852 - DNA, 18 bp, Homo sapiens
aagacaccgttcattcag

SEQ ID NO: 3317853 - DNA, 22 bp, Homo sapiens
aagacacgtggcctcgtgaggg

SEQ ID NO: 3317854 - DNA, 13 bp, Homo sapiens
aagacacttcaga

SEQ ID NO: 3317855 - DNA, 21 bp, Homo sapiens
aagacagagacgcaggaatgg

SEQ ID NO: 3317856 - DNA, 18 bp, Homo sapiens
aagacagtatttattggt

SEQ ID NO: 3317857 - DNA, 13 bp, Homo sapiens
aagacagtgtaca

SEQ ID NO: 3317858 - DNA, 23 bp, Homo sapiens
aagacatactccttccatcaaat

SEQ ID NO: 3317859 - DNA, 13 bp, Homo sapiens
aagacatgtctgt

SEQ ID NO: 3317860 - DNA, 17 bp, Homo sapiens
aagacatgtctgttcta

SEQ ID NO: 3317861 - DNA, 21 bp, Homo sapiens
aagacatgtgaggaggaaaag

SEQ ID NO: 3317862 - DNA, 13 bp, Homo sapiens
aagacattgtcaa

SEQ ID NO: 3317863 - DNA, 17 bp, Homo sapiens
aagacattgtcaataaa

SEQ ID NO: 3317864 - DNA, 17 bp, Homo sapiens
aagacatttgatagaaa

SEQ ID NO: 3317865 - DNA, 18 bp, Homo sapiens
aagacatttgatagaaag

SEQ ID NO: 3317866 - DNA, 11 bp, Homo sapiens
aagacatttgt

SEQ ID NO: 3317867 - DNA, 16 bp, Homo sapiens
aagacatttgtatatt

SEQ ID NO: 3317868 - DNA, 17 bp, Homo sapiens
aagacatttgtatattg

SEQ ID NO: 3317869 - DNA, 13 bp, Homo sapiens
aagacatttttat

SEQ ID NO: 3317870 - DNA, 15 bp, Homo sapiens
aagacattttttgct

SEQ ID NO: 3317871 - DNA, 17 bp, Homo sapiens
aagacattttttgctat

SEQ ID NO: 3317872 - DNA, 13 bp, Homo sapiens
aagaccaaacttc

SEQ ID NO: 3317873 - DNA, 15 bp, Homo sapiens
aagaccaaaggaagg

SEQ ID NO: 3317874 - DNA, 14 bp, Homo sapiens
aagaccaatttatg

SEQ ID NO: 3317875 - DNA, 19 bp, Homo sapiens
aagaccaatttatgggaga

SEQ ID NO: 3317876 - DNA, 17 bp, Homo sapiens
aagaccacaaaaattga

SEQ ID NO: 3317877 - DNA, 14 bp, Homo sapiens
aagaccagaaattc

SEQ ID NO: 3317878 - DNA, 15 bp, Homo sapiens
aagaccagcctggcc

SEQ ID NO: 3317879 - DNA, 14 bp, Homo sapiens
aagaccattctgtg

SEQ ID NO: 3317880 - DNA, 13 bp, Homo sapiens
aagacccccagca

SEQ ID NO: 3317881 - DNA, 14 bp, Homo sapiens
aagaccctgagact

SEQ ID NO: 3317882 - DNA, 15 bp, Homo sapiens
aagaccctgagactc

SEQ ID NO: 3317883 - DNA, 19 bp, Homo sapiens
aagacctcatctgtggagc

SEQ ID NO: 3317884 - DNA, 20 bp, Homo sapiens
aagacctcatctgtggagct

SEQ ID NO: 3317885 - DNA, 17 bp, Homo sapiens
aagacctgttggttcca

SEQ ID NO: 3317886 - DNA, 20 bp, Homo sapiens
aagaccttctccccattctg

SEQ ID NO: 3317887 - DNA, 13 bp, Homo sapiens
aagacgaggggca

SEQ ID NO: 3317888 - DNA, 20 bp, Homo sapiens
aagacgaggggcagggaagg

SEQ ID NO: 3317889 - DNA, 14 bp, Homo sapiens
aagacgcctgagct

SEQ ID NO: 3317890 - DNA, 22 bp, Homo sapiens
aagacgccttcatctgggacaa

SEQ ID NO: 3317891 - DNA, 23 bp, Homo sapiens
aagacgccttcatctgggacaaa

SEQ ID NO: 3317892 - DNA, 12 bp, Homo sapiens
aagacgtttttg

SEQ ID NO: 3317893 - DNA, 16 bp, Homo sapiens
aagactaatttaaaaa

SEQ ID NO: 3317894 - DNA, 23 bp, Homo sapiens
aagactagactactcaatattaa

SEQ ID NO: 3317895 - DNA, 20 bp, Homo sapiens
aagactagaggcttgcataa

SEQ ID NO: 3317896 - DNA, 17 bp, Homo sapiens
aagactcaaatgttcta

SEQ ID NO: 3317897 - DNA, 18 bp, Homo sapiens
aagactcaaatgttctaa

SEQ ID NO: 3317898 - DNA, 11 bp, Homo sapiens
aagactcagcc

SEQ ID NO: 3317899 - DNA, 17 bp, Homo sapiens
aagactcctctgggcct

SEQ ID NO: 3317900 - DNA, 12 bp, Homo sapiens
aagactctagag

SEQ ID NO: 3317901 - DNA, 19 bp, Homo sapiens
aagactctagagtccaagg

SEQ ID NO: 3317902 - DNA, 21 bp, Homo sapiens
aagactctagagtccaaggtt

SEQ ID NO: 3317903 - DNA, 15 bp, Homo sapiens
aagactgaacatgtt

SEQ ID NO: 3317904 - DNA, 20 bp, Homo sapiens
aagactgatgaagaaattta

SEQ ID NO: 3317905 - DNA, 22 bp, Homo sapiens
aagactggaagctaatttgcat

SEQ ID NO: 3317906 - DNA, 24 bp, Homo sapiens
aagactggacatttaacttttcta

SEQ ID NO: 3317907 - DNA, 16 bp, Homo sapiens
aagactgtacaaagta

SEQ ID NO: 3317908 - DNA, 13 bp, Homo sapiens
aagactgtactgg

SEQ ID NO: 3317909 - DNA, 16 bp, Homo sapiens
aagactgttgctcaaa

SEQ ID NO: 3317910 - DNA, 24 bp, Homo sapiens
aagacttaaagggcccaatgaatt

SEQ ID NO: 3317911 - DNA, 20 bp, Homo sapiens
aagacttcggggaagataca

SEQ ID NO: 3317912 - DNA, 16 bp, Homo sapiens
aagacttggcaacaga

SEQ ID NO: 3317913 - DNA, 19 bp, Homo sapiens
aagacttggcaacagaagc

SEQ ID NO: 3317914 - DNA, 14 bp, Homo sapiens
aagactttaattat

SEQ ID NO: 3317915 - DNA, 17 bp, Homo sapiens
aagagaaaaaccaatga

SEQ ID NO: 3317916 - DNA, 20 bp, Homo sapiens
aagagaaactttgtgctaca

SEQ ID NO: 3317917 - DNA, 11 bp, Homo sapiens
aagagaaatct

SEQ ID NO: 3317918 - DNA, 16 bp, Homo sapiens
aagagaagacgaaata

SEQ ID NO: 3317919 - DNA, 14 bp, Homo sapiens
aagagaagcaattt

SEQ ID NO: 3317920 - DNA, 18 bp, Homo sapiens
aagagaagtctcattcgc

SEQ ID NO: 3317921 - DNA, 21 bp, Homo sapiens
aagagaagttattttctacag

SEQ ID NO: 3317922 - DNA, 11 bp, Homo sapiens
aagagaatgag

SEQ ID NO: 3317923 - DNA, 13 bp, Homo sapiens
aagagacactcca

SEQ ID NO: 3317924 - DNA, 15 bp, Homo sapiens
aagagacagcccagg

SEQ ID NO: 3317925 - DNA, 17 bp, Homo sapiens
aagagacagttatttat

SEQ ID NO: 3317926 - DNA, 16 bp, Homo sapiens
aagagacatggaagag

SEQ ID NO: 3317927 - DNA, 18 bp, Homo sapiens
aagagacatggaagagag

SEQ ID NO: 3317928 - DNA, 16 bp, Homo sapiens
aagagacctacctcag

SEQ ID NO: 3317929 - DNA, 18 bp, Homo sapiens
aagagacctacctcaggt

SEQ ID NO: 3317930 - DNA, 20 bp, Homo sapiens
aagagacttaaaggacagga

SEQ ID NO: 3317931 - DNA, 11 bp, Homo sapiens
aagagagaaat

SEQ ID NO: 3317932 - DNA, 13 bp, Homo sapiens
aagagagaagcca

SEQ ID NO: 3317933 - DNA, 15 bp, Homo sapiens
aagagagatgttttg

SEQ ID NO: 3317934 - DNA, 19 bp, Homo sapiens
aagagaggagaggagagag

SEQ ID NO: 3317935 - DNA, 13 bp, Homo sapiens
aagagagggacag

SEQ ID NO: 3317936 - DNA, 18 bp, Homo sapiens
aagagagggacaggcact

SEQ ID NO: 3317937 - DNA, 14 bp, Homo sapiens
aagagatctttctt

SEQ ID NO: 3317938 - DNA, 13 bp, Homo sapiens
aagagatgaagag

SEQ ID NO: 3317939 - DNA, 12 bp, Homo sapiens
aagagatgcact

SEQ ID NO: 3317940 - DNA, 17 bp, Homo sapiens
aagagatgggcttgttt

SEQ ID NO: 3317941 - DNA, 21 bp, Homo sapiens
aagagatgtggcaaagtgctg

SEQ ID NO: 3317942 - DNA, 20 bp, Homo sapiens
aagagattagaacatttaat

SEQ ID NO: 3317943 - DNA, 14 bp, Homo sapiens
aagagcagaacaga

SEQ ID NO: 3317944 - DNA, 13 bp, Homo sapiens
aagagcagagtct

SEQ ID NO: 3317945 - DNA, 15 bp, Homo sapiens
aagagcagagtctgg

SEQ ID NO: 3317946 - DNA, 22 bp, Homo sapiens
aagagcagagtctgggcctctg

SEQ ID NO: 3317947 - DNA, 11 bp, Homo sapiens
aagagcagcct

SEQ ID NO: 3317948 - DNA, 12 bp, Homo sapiens
aagagcagcctg

SEQ ID NO: 3317949 - DNA, 13 bp, Homo sapiens
aagagcagcctgg

SEQ ID NO: 3317950 - DNA, 19 bp, Homo sapiens
aagagcagcctgtggcatc

SEQ ID NO: 3317951 - DNA, 9 bp, Homo sapiens
aagagccat

SEQ ID NO: 3317952 - DNA, 19 bp, Homo sapiens
aagagccatataagtttga

SEQ ID NO: 3317953 - DNA, 20 bp, Homo sapiens
aagagccctggacacccctg

SEQ ID NO: 3317954 - DNA, 22 bp, Homo sapiens
aagagccctggacacccctgct

SEQ ID NO: 3317955 - DNA, 16 bp, Homo sapiens
aagagcccttgcctcc

SEQ ID NO: 3317956 - DNA, 15 bp, Homo sapiens
aagagccggtggtgc

SEQ ID NO: 3317957 - DNA, 17 bp, Homo sapiens
aagagccggtggtgccc

SEQ ID NO: 3317958 - DNA, 13 bp, Homo sapiens
aagagctattgcc

SEQ ID NO: 3317959 - DNA, 17 bp, Homo sapiens
aagagctgcctggatga

SEQ ID NO: 3317960 - DNA, 18 bp, Homo sapiens
aagagctgcctggatgag

SEQ ID NO: 3317961 - DNA, 23 bp, Homo sapiens
aagagctgtctatgcagcctgct

SEQ ID NO: 3317962 - DNA, 16 bp, Homo sapiens
aagagcttgctttgat

SEQ ID NO: 3317963 - DNA, 13 bp, Homo sapiens
aagaggaacagtg

SEQ ID NO: 3317964 - DNA, 15 bp, Homo sapiens
aagaggaactgggcc

SEQ ID NO: 3317965 - DNA, 18 bp, Homo sapiens
aagaggaatttcttttcc

SEQ ID NO: 3317966 - DNA, 15 bp, Homo sapiens
aagaggactgagact

SEQ ID NO: 3317967 - DNA, 19 bp, Homo sapiens
aagaggatctcctgtccat

SEQ ID NO: 3317968 - DNA, 19 bp, Homo sapiens
aagaggcaagctgaaattt

SEQ ID NO: 3317969 - DNA, 14 bp, Homo sapiens
aagaggcagggtct

SEQ ID NO: 3317970 - DNA, 17 bp, Homo sapiens
aagaggcatcctgcctg

SEQ ID NO: 3317971 - DNA, 18 bp, Homo sapiens
aagaggcatcctgcctgg

SEQ ID NO: 3317972 - DNA, 19 bp, Homo sapiens
aagaggcctcatgcctgct

SEQ ID NO: 3317973 - DNA, 20 bp, Homo sapiens
aagaggcctcatgcctgctg

SEQ ID NO: 3317974 - DNA, 22 bp, Homo sapiens
aagaggcctcatgcctgctgag

SEQ ID NO: 3317975 - DNA, 17 bp, Homo sapiens
aagaggcgggccagcca

SEQ ID NO: 3317976 - DNA, 20 bp, Homo sapiens
aagaggctgaggcctggact

SEQ ID NO: 3317977 - DNA, 17 bp, Homo sapiens
aagaggctgcccctctc

SEQ ID NO: 3317978 - DNA, 11 bp, Homo sapiens
aagaggcttct

SEQ ID NO: 3317979 - DNA, 9 bp, Homo sapiens
aagccaagc

SEQ ID NO: 3317980 - DNA, 20 bp, Homo sapiens
aagccaagcaaaccaatggt

SEQ ID NO: 3317981 - DNA, 23 bp, Homo sapiens
aagccaagctccctggagccctg

SEQ ID NO: 3317982 - DNA, 19 bp, Homo sapiens
aagccaagtggggtgctgg

SEQ ID NO: 3317983 - DNA, 14 bp, Homo sapiens
aagccaatcccctc

SEQ ID NO: 3317984 - DNA, 16 bp, Homo sapiens
aagccaatcccctcct

SEQ ID NO: 3317985 - DNA, 20 bp, Homo sapiens
aagccaatcccctccttggg

SEQ ID NO: 3317986 - DNA, 19 bp, Homo sapiens
aagccaatctacaatctct

SEQ ID NO: 3317987 - DNA, 16 bp, Homo sapiens
aagccacaagaaattt

SEQ ID NO: 3317988 - DNA, 13 bp, Homo sapiens
aagccacatagag

SEQ ID NO: 3317989 - DNA, 19 bp, Homo sapiens
aagccacattatttctagt

SEQ ID NO: 3317990 - DNA, 16 bp, Homo sapiens
aagctgattactgtca

SEQ ID NO: 3317991 - DNA, 19 bp, Homo sapiens
aagctgattactgtcaata

SEQ ID NO: 3317992 - DNA, 23 bp, Homo sapiens
aagctgattactgtcaataaaca

SEQ ID NO: 3317993 - DNA, 12 bp, Homo sapiens
aagctgcacatg

SEQ ID NO: 3317994 - DNA, 17 bp, Homo sapiens
aagctgcagagatttct

SEQ ID NO: 3317995 - DNA, 23 bp, Homo sapiens
aagctgcagagatttctcattga

SEQ ID NO: 3317996 - DNA, 15 bp, Homo sapiens
aagctgccagcccag

SEQ ID NO: 3317997 - DNA, 16 bp, Homo sapiens
aagctgccagcccaga

SEQ ID NO: 3317998 - DNA, 21 bp, Homo sapiens
aagctgccgaaccaaaagaat

SEQ ID NO: 3317999 - DNA, 15 bp, Homo sapiens
aagctgcctggtata

SEQ ID NO: 3318000 - DNA, 21 bp, Homo sapiens
aagctgcctgtagttaggaaa

SEQ ID NO: 3318001 - DNA, 17 bp, Homo sapiens
aagctgcttctgcccac

SEQ ID NO: 3318002 - DNA, 21 bp, Homo sapiens
aagctgctttaaaaaaataca

SEQ ID NO: 3318003 - DNA, 16 bp, Homo sapiens
aagctggacttctgtg

SEQ ID NO: 3318004 - DNA, 19 bp, Homo sapiens
aagctggaggctccaggac

SEQ ID NO: 3318005 - DNA, 20 bp, Homo sapiens
aagctggaggctccaggact

SEQ ID NO: 3318006 - DNA, 13 bp, Homo sapiens
aagctggccctgc

SEQ ID NO: 3318007 - DNA, 18 bp, Homo sapiens
aagctggccctgcctcct

SEQ ID NO: 3318008 - DNA, 21 bp, Homo sapiens
aagctggccctgcctcctggg

SEQ ID NO: 3318009 - DNA, 23 bp, Homo sapiens
aagctggccctgcctcctgggaa

SEQ ID NO: 3318010 - DNA, 21 bp, Homo sapiens
aagctggccgagggtcctggc

SEQ ID NO: 3318011 - DNA, 12 bp, Homo sapiens
aagctggctctg

SEQ ID NO: 3318012 - DNA, 16 bp, Homo sapiens
aagctggctctgtttg

SEQ ID NO: 3318013 - DNA, 17 bp, Homo sapiens
aagctggctctgtttga

SEQ ID NO: 3318014 - DNA, 22 bp, Homo sapiens
aagctgggaaaaaagttttgat

SEQ ID NO: 3318015 - DNA, 17 bp, Homo sapiens
aagctggtaaactattt

SEQ ID NO: 3318016 - DNA, 18 bp, Homo sapiens
aagctggtcccactcagt

SEQ ID NO: 3318017 - DNA, 17 bp, Homo sapiens
aagctggtggccttggc

SEQ ID NO: 3318018 - DNA, 16 bp, Homo sapiens
aagctgtaaattacat

SEQ ID NO: 3318019 - DNA, 19 bp, Homo sapiens
aagctgtacgcgtttgtct

SEQ ID NO: 3318020 - DNA, 18 bp, Homo sapiens
aagctgtactcagagcag

SEQ ID NO: 3318021 - DNA, 23 bp, Homo sapiens
aagctgtagtagccctttctgtg

SEQ ID NO: 3318022 - DNA, 22 bp, Homo sapiens
aagctgtataattaattgtcat

SEQ ID NO: 3318023 - DNA, 12 bp, Homo sapiens
aagctgtcccct

SEQ ID NO: 3318024 - DNA, 14 bp, Homo sapiens
aagctgtccctgca

SEQ ID NO: 3318025 - DNA, 21 bp, Homo sapiens
aagctgtccctgcagggccat

SEQ ID NO: 3318026 - DNA, 23 bp, Homo sapiens
aagctgtgttgaaacagaaaaat

SEQ ID NO: 3318027 - DNA, 17 bp, Homo sapiens
aagctgttgtacattta

SEQ ID NO: 3318028 - DNA, 21 bp, Homo sapiens
aagctgttgtacatttatgat

SEQ ID NO: 3318029 - DNA, 23 bp, Homo sapiens
aagctgtttccatagggtgacac

SEQ ID NO: 3318030 - DNA, 10 bp, Homo sapiens
aagcttagaa

SEQ ID NO: 3318031 - DNA, 18 bp, Homo sapiens
aagcttcaaattaaaaca

SEQ ID NO: 3318032 - DNA, 15 bp, Homo sapiens
aagcttccatgattc

SEQ ID NO: 3318033 - DNA, 19 bp, Homo sapiens
aagcttctaataaattata

SEQ ID NO: 3318034 - DNA, 21 bp, Homo sapiens
aagcttcttaattaatttgat

SEQ ID NO: 3318035 - DNA, 12 bp, Homo sapiens
aagcttgactcc

SEQ ID NO: 3318036 - DNA, 15 bp, Homo sapiens
aagcttgactcccaa

SEQ ID NO: 3318037 - DNA, 13 bp, Homo sapiens
aagcttgagcctc

SEQ ID NO: 3318038 - DNA, 18 bp, Homo sapiens
aagcttgagcctccccca

SEQ ID NO: 3318039 - DNA, 14 bp, Homo sapiens
aagctttaaattat

SEQ ID NO: 3318040 - DNA, 18 bp, Homo sapiens
aagctttattgttcacac

SEQ ID NO: 3318041 - DNA, 13 bp, Homo sapiens
aagctttatttct

SEQ ID NO: 3318042 - DNA, 20 bp, Homo sapiens
aagctttatttctagctttt

SEQ ID NO: 3318043 - DNA, 18 bp, Homo sapiens
aagctttcctgccccagg

SEQ ID NO: 3318044 - DNA, 16 bp, Homo sapiens
aagctttcctgtttcc

SEQ ID NO: 3318045 - DNA, 16 bp, Homo sapiens
aagctttctctcagaa

SEQ ID NO: 3318046 - DNA, 21 bp, Homo sapiens
aagctttgctacaaatttatg

SEQ ID NO: 3318047 - DNA, 23 bp, Homo sapiens
aagctttttattcctcctgctca

SEQ ID NO: 3318048 - DNA, 17 bp, Homo sapiens
aagctttttttcttgct

SEQ ID NO: 3318049 - DNA, 19 bp, Homo sapiens
aaggaaaaacacaagcaaa

SEQ ID NO: 3318050 - DNA, 14 bp, Homo sapiens
aaggaaaaataatc

SEQ ID NO: 3318051 - DNA, 21 bp, Homo sapiens
aaggaaaactatgtattaatt

SEQ ID NO: 3318052 - DNA, 16 bp, Homo sapiens
aaggaaaactgcatgg

SEQ ID NO: 3318053 - DNA, 16 bp, Homo sapiens
aaggaaaagcaagaaa

SEQ ID NO: 3318054 - DNA, 12 bp, Homo sapiens
aaggaaaatgat

SEQ ID NO: 3318055 - DNA, 14 bp, Homo sapiens
aaggaaaatgatac

SEQ ID NO: 3318056 - DNA, 16 bp, Homo sapiens
aaggaaacgctacctc

SEQ ID NO: 3318057 - DNA, 13 bp, Homo sapiens
aaggaaactctta

SEQ ID NO: 3318058 - DNA, 13 bp, Homo sapiens
aaggaaagaaggg

SEQ ID NO: 3318059 - DNA, 15 bp, Homo sapiens
aaggaaagatttgtg

SEQ ID NO: 3318060 - DNA, 17 bp, Homo sapiens
aaggaaagatttgtgaa

SEQ ID NO: 3318061 - DNA, 21 bp, Homo sapiens
aaggaaagtcaagaagaatga

SEQ ID NO: 3318062 - DNA, 20 bp, Homo sapiens
aaggaaataaaaaagtctct

SEQ ID NO: 3318063 - DNA, 22 bp, Homo sapiens
aaggaaataaaaaagtctctat

SEQ ID NO: 3318064 - DNA, 21 bp, Homo sapiens
aaggaaatacacttcttttga

SEQ ID NO: 3318065 - DNA, 13 bp, Homo sapiens
aaggaacaaaaat

SEQ ID NO: 3318066 - DNA, 13 bp, Homo sapiens
aaggaaccttcct

SEQ ID NO: 3318067 - DNA, 23 bp, Homo sapiens
aaggaactaggtcaaaaatctgt

SEQ ID NO: 3318068 - DNA, 14 bp, Homo sapiens
aaggaagagggctg

SEQ ID NO: 3318069 - DNA, 15 bp, Homo sapiens
aaggaagagggctga

SEQ ID NO: 3318070 - DNA, 18 bp, Homo sapiens
aaggaagccaaatttatc

SEQ ID NO: 3318071 - DNA, 19 bp, Homo sapiens
aaggaagccaaatttatca

SEQ ID NO: 3318072 - DNA, 18 bp, Homo sapiens
aaggaagctgtgttgaaa

SEQ ID NO: 3318073 - DNA, 12 bp, Homo sapiens
aaggaaggtgga

SEQ ID NO: 3318074 - DNA, 17 bp, Homo sapiens
aaggaagtttgattttt

SEQ ID NO: 3318075 - DNA, 16 bp, Homo sapiens
aaggaatcattccagt

SEQ ID NO: 3318076 - DNA, 18 bp, Homo sapiens
aaggaatcattccagtgc

SEQ ID NO: 3318077 - DNA, 20 bp, Homo sapiens
aaggaatcattccagtgcta

SEQ ID NO: 3318078 - DNA, 17 bp, Homo sapiens
aaggaatctccagtttt

SEQ ID NO: 3318079 - DNA, 21 bp, Homo sapiens
aaggaatctttaagcagagaa

SEQ ID NO: 3318080 - DNA, 17 bp, Homo sapiens
aaggaatgcctgtgcca

SEQ ID NO: 3318081 - DNA, 21 bp, Homo sapiens
aaggaatgtagctggtttcct

SEQ ID NO: 3318082 - DNA, 16 bp, Homo sapiens
aaggaattatcaatta

SEQ ID NO: 3318083 - DNA, 20 bp, Homo sapiens
aaggaattctaggcatccca

SEQ ID NO: 3318084 - DNA, 14 bp, Homo sapiens
aaggaatttgtact

SEQ ID NO: 3318085 - DNA, 23 bp, Homo sapiens
aaggacaaaaatgaactgaagtt

SEQ ID NO: 3318086 - DNA, 14 bp, Homo sapiens
aaggacacactaat

SEQ ID NO: 3318087 - DNA, 13 bp, Homo sapiens
aaggacactagaa

SEQ ID NO: 3318088 - DNA, 22 bp, Homo sapiens
aaggacagactggccgggcagg

SEQ ID NO: 3318089 - DNA, 13 bp, Homo sapiens
aaggacaggaccc

SEQ ID NO: 3318090 - DNA, 18 bp, Homo sapiens
aaggacaggaccctcagg

SEQ ID NO: 3318091 - DNA, 20 bp, Homo sapiens
aaggacaggaggaggagatg

SEQ ID NO: 3318092 - DNA, 16 bp, Homo sapiens
aaggacattatgtgtg

SEQ ID NO: 3318093 - DNA, 19 bp, Homo sapiens
aaggaccacattttatatt

SEQ ID NO: 3318094 - DNA, 14 bp, Homo sapiens
aaggaccagccctt

SEQ ID NO: 3318095 - DNA, 18 bp, Homo sapiens
aaggacccggaggggcct

SEQ ID NO: 3318096 - DNA, 21 bp, Homo sapiens
aaggacccggaggggcctggc

SEQ ID NO: 3318097 - DNA, 16 bp, Homo sapiens
aaggacgtgtgtaaat

SEQ ID NO: 3318098 - DNA, 18 bp, Homo sapiens
aaggactaacataaaatc

SEQ ID NO: 3318099 - DNA, 17 bp, Homo sapiens
aaggactggattggcca

SEQ ID NO: 3318100 - DNA, 16 bp, Homo sapiens
aaggactgtggctgca

SEQ ID NO: 3318101 - DNA, 18 bp, Homo sapiens
aaggacttccacattttt

SEQ ID NO: 3318102 - DNA, 13 bp, Homo sapiens
aaggacttctgca

SEQ ID NO: 3318103 - DNA, 12 bp, Homo sapiens
aaggagaaaaaa

SEQ ID NO: 3318104 - DNA, 15 bp, Homo sapiens
aaggagaaaaaaaac

SEQ ID NO: 3318105 - DNA, 15 bp, Homo sapiens
aaggagaaccagcac

SEQ ID NO: 3318106 - DNA, 14 bp, Homo sapiens
aaggagaattgaat

SEQ ID NO: 3318107 - DNA, 14 bp, Homo sapiens
aaggagacaagttc

SEQ ID NO: 3318108 - DNA, 11 bp, Homo sapiens
aaggagagaaa

SEQ ID NO: 3318109 - DNA, 16 bp, Homo sapiens
aaggagagaaagtggg

SEQ ID NO: 3318110 - DNA, 14 bp, Homo sapiens
aaggagagcaagaa

SEQ ID NO: 3318111 - DNA, 16 bp, Homo sapiens
aaggagattccacaca

SEQ ID NO: 3318112 - DNA, 19 bp, Homo sapiens
aaggagcggcgccctggac

SEQ ID NO: 3318113 - DNA, 20 bp, Homo sapiens
aaggagcggcgccctggact

SEQ ID NO: 3318114 - DNA, 13 bp, Homo sapiens
aaggagctcaccc

SEQ ID NO: 3318115 - DNA, 24 bp, Homo sapiens
aaggagctgatttccaggcccctg

SEQ ID NO: 3318116 - DNA, 17 bp, Homo sapiens
aaggaggaggagggaga

SEQ ID NO: 3318117 - DNA, 20 bp, Homo sapiens
aaggaggcatgcctctgata

SEQ ID NO: 3318118 - DNA, 18 bp, Homo sapiens
aaggaggccaaccagccc

SEQ ID NO: 3318119 - DNA, 23 bp, Homo sapiens
aaggaggccaaccagcccgacag

SEQ ID NO: 3318120 - DNA, 13 bp, Homo sapiens
aaggagggcagag

SEQ ID NO: 3318121 - DNA, 20 bp, Homo sapiens
aaggaggggatagagagaga

SEQ ID NO: 3318122 - DNA, 15 bp, Homo sapiens
aaggataaatcataa

SEQ ID NO: 3318123 - DNA, 22 bp, Homo sapiens
aaggataaatcataaagtcagt

SEQ ID NO: 3318124 - DNA, 17 bp, Homo sapiens
aaggataccttcttatt

SEQ ID NO: 3318125 - DNA, 20 bp, Homo sapiens
aaggatagtgcgatgtttca

SEQ ID NO: 3318126 - DNA, 16 bp, Homo sapiens
aaggatatactgcagc

SEQ ID NO: 3318127 - DNA, 23 bp, Homo sapiens
aaggatatgaaactctacattta

SEQ ID NO: 3318128 - DNA, 23 bp, Homo sapiens
aaggatatttaagaaaatacaat

SEQ ID NO: 3318129 - DNA, 22 bp, Homo sapiens
aaggatcagaacagcagaggtt

SEQ ID NO: 3318130 - DNA, 17 bp, Homo sapiens
aaggatccaggaatatg

SEQ ID NO: 3318131 - DNA, 20 bp, Homo sapiens
aaggatccaggaatatgaca

SEQ ID NO: 3318132 - DNA, 16 bp, Homo sapiens
aaggatccggaaagaa

SEQ ID NO: 3318133 - DNA, 16 bp, Homo sapiens
aaggatcctctccact

SEQ ID NO: 3318134 - DNA, 18 bp, Homo sapiens
aaggatcctctccactcc

SEQ ID NO: 3318135 - DNA, 20 bp, Homo sapiens
aaggatcctctccactccat

SEQ ID NO: 3318136 - DNA, 20 bp, Homo sapiens
aaggatggtggttattttaa

SEQ ID NO: 3318137 - DNA, 21 bp, Homo sapiens
aaggatggtggttattttaaa

SEQ ID NO: 3318138 - DNA, 15 bp, Homo sapiens
aaggatgttggtgtt

SEQ ID NO: 3318139 - DNA, 14 bp, Homo sapiens
aaggattttaccaa

SEQ ID NO: 3318140 - DNA, 18 bp, Homo sapiens
aaggattttaccaaagca

SEQ ID NO: 3318141 - DNA, 15 bp, Homo sapiens
aaggattttttaaag

SEQ ID NO: 3318142 - DNA, 14 bp, Homo sapiens
aaggcaaaaatatc

SEQ ID NO: 3318143 - DNA, 19 bp, Homo sapiens
aaggcaaaattgcaaatct

SEQ ID NO: 3318144 - DNA, 13 bp, Homo sapiens
aaggcaagagggg

SEQ ID NO: 3318145 - DNA, 14 bp, Homo sapiens
aaggcacagtggga

SEQ ID NO: 3318146 - DNA, 16 bp, Homo sapiens
aaggcacagtgggagc

SEQ ID NO: 3318147 - DNA, 22 bp, Homo sapiens
aaggcacagtgggagctgagct

SEQ ID NO: 3318148 - DNA, 19 bp, Homo sapiens
aaggcactctagattccat

SEQ ID NO: 3318149 - DNA, 21 bp, Homo sapiens
aaggcactctgttatttagac

SEQ ID NO: 3318150 - DNA, 14 bp, Homo sapiens
aaggcagacagcag

SEQ ID NO: 3318151 - DNA, 20 bp, Homo sapiens
aaggcagagaagttctcaaa

SEQ ID NO: 3318152 - DNA, 13 bp, Homo sapiens
aaggcagcaggcg

SEQ ID NO: 3318153 - DNA, 11 bp, Homo sapiens
aaggcagcctc

SEQ ID NO: 3318154 - DNA, 17 bp, Homo sapiens
aaggcagcctccagagc

SEQ ID NO: 3318155 - DNA, 20 bp, Homo sapiens
aaggcagcctccagagccag

SEQ ID NO: 3318156 - DNA, 23 bp, Homo sapiens
aaggcagctcacccctgggcagg

SEQ ID NO: 3318157 - DNA, 16 bp, Homo sapiens
aaggcagctgcctctg

SEQ ID NO: 3318158 - DNA, 21 bp, Homo sapiens
aaggcagctgcctctgctccc

SEQ ID NO: 3318159 - DNA, 23 bp, Homo sapiens
aaggcagctgcctctgctccctc

SEQ ID NO: 3318160 - DNA, 18 bp, Homo sapiens
aaggcagggaaaggaaaa

SEQ ID NO: 3318161 - DNA, 12 bp, Homo sapiens
aaggcagggcag

SEQ ID NO: 3318162 - DNA, 14 bp, Homo sapiens
aaggcaggtgcctc

SEQ ID NO: 3318163 - DNA, 19 bp, Homo sapiens
aaggcaggtgggcagacag

SEQ ID NO: 3318164 - DNA, 22 bp, Homo sapiens
aaggcaggttggatgggagtgg

SEQ ID NO: 3318165 - DNA, 16 bp, Homo sapiens
aaggcagtggcagggg

SEQ ID NO: 3318166 - DNA, 14 bp, Homo sapiens
aaggccaaagataa

SEQ ID NO: 3318167 - DNA, 21 bp, Homo sapiens
aaggccaataaagagttagaa

SEQ ID NO: 3318168 - DNA, 18 bp, Homo sapiens
aaggccagtggaaattca

SEQ ID NO: 3318169 - DNA, 17 bp, Homo sapiens
aaggccataaaacaggt

SEQ ID NO: 3318170 - DNA, 18 bp, Homo sapiens
aaggccataaaacaggta

SEQ ID NO: 3318171 - DNA, 22 bp, Homo sapiens
aaggcccaagagcagagtctgg

SEQ ID NO: 3318172 - DNA, 15 bp, Homo sapiens
aaggcccagccccta

SEQ ID NO: 3318173 - DNA, 16 bp, Homo sapiens
aaggcctaggattcta

SEQ ID NO: 3318174 - DNA, 19 bp, Homo sapiens
aaggcctccctagccagca

SEQ ID NO: 3318175 - DNA, 12 bp, Homo sapiens
aaggcctcctcc

SEQ ID NO: 3318176 - DNA, 13 bp, Homo sapiens
aaggcctcctccc

SEQ ID NO: 3318177 - DNA, 21 bp, Homo sapiens
aaggcctcttgtaaagactgg

SEQ ID NO: 3318178 - DNA, 23 bp, Homo sapiens
aaggcctcttgtgctcacgctcc

SEQ ID NO: 3318179 - DNA, 14 bp, Homo sapiens
aaggcctggctgga

SEQ ID NO: 3318180 - DNA, 13 bp, Homo sapiens
aaggctaaaaagt

SEQ ID NO: 3318181 - DNA, 16 bp, Homo sapiens
aaggctctatgagtct

SEQ ID NO: 3318182 - DNA, 14 bp, Homo sapiens
aaggctctcacccc

SEQ ID NO: 3318183 - DNA, 18 bp, Homo sapiens
aaggctctgaaagccagc

SEQ ID NO: 3318184 - DNA, 14 bp, Homo sapiens
aaggctctgagagt

SEQ ID NO: 3318185 - DNA, 22 bp, Homo sapiens
aaggctctgagagtctagattc

SEQ ID NO: 3318186 - DNA, 18 bp, Homo sapiens
aaggctgaactcttcaga

SEQ ID NO: 3318187 - DNA, 23 bp, Homo sapiens
aaggctgagacagtgaatttggg

SEQ ID NO: 3318188 - DNA, 16 bp, Homo sapiens
aaggctgatgtcaatt

SEQ ID NO: 3318189 - DNA, 15 bp, Homo sapiens
aaggctgcttagaat

SEQ ID NO: 3318190 - DNA, 23 bp, Homo sapiens
aaggctggccagcaaggcaggtt

SEQ ID NO: 3318191 - DNA, 16 bp, Homo sapiens
aaggctggctgagtgg

SEQ ID NO: 3318192 - DNA, 20 bp, Homo sapiens
aaggctgtgtgaatttttct

SEQ ID NO: 3318193 - DNA, 14 bp, Homo sapiens
aaggcttgaagctg

SEQ ID NO: 3318194 - DNA, 15 bp, Homo sapiens
aaggctttatctcag

SEQ ID NO: 3318195 - DNA, 22 bp, Homo sapiens
aagggaaagcttcattctcctt

SEQ ID NO: 3318196 - DNA, 15 bp, Homo sapiens
aagggaaatatcatt

SEQ ID NO: 3318197 - DNA, 12 bp, Homo sapiens
aagggaatcctc

SEQ ID NO: 3318198 - DNA, 15 bp, Homo sapiens
aagggacagcatgcc

SEQ ID NO: 3318199 - DNA, 18 bp, Homo sapiens
aagggacttaacttgttt

SEQ ID NO: 3318200 - DNA, 13 bp, Homo sapiens
aagggagaaaaga

SEQ ID NO: 3318201 - DNA, 18 bp, Homo sapiens
aagggagaaaagagaaac

SEQ ID NO: 3318202 - DNA, 16 bp, Homo sapiens
aagggagaagacactg

SEQ ID NO: 3318203 - DNA, 22 bp, Homo sapiens
aagggagaagacactgcagtga

SEQ ID NO: 3318204 - DNA, 14 bp, Homo sapiens
aagggagagctgag

SEQ ID NO: 3318205 - DNA, 18 bp, Homo sapiens
aagggagctatcaggaac

SEQ ID NO: 3318206 - DNA, 18 bp, Homo sapiens
aagggaggacgggagctg

SEQ ID NO: 3318207 - DNA, 20 bp, Homo sapiens
aagggatggaaaaggaagac

SEQ ID NO: 3318208 - DNA, 11 bp, Homo sapiens
aagggattctg

SEQ ID NO: 3318209 - DNA, 16 bp, Homo sapiens
aagggatttcttaggg

SEQ ID NO: 3318210 - DNA, 14 bp, Homo sapiens
aagggcaaatctgc

SEQ ID NO: 3318211 - DNA, 14 bp, Homo sapiens
aagggcacttaatt

SEQ ID NO: 3318212 - DNA, 11 bp, Homo sapiens
aagggcagaga

SEQ ID NO: 3318213 - DNA, 16 bp, Homo sapiens
aagggcagggcccacg

SEQ ID NO: 3318214 - DNA, 13 bp, Homo sapiens
aagggcagtgccc

SEQ ID NO: 3318215 - DNA, 17 bp, Homo sapiens
aagggcatgccttgtgc

SEQ ID NO: 3318216 - DNA, 9 bp, Homo sapiens
aagggccag

SEQ ID NO: 3318217 - DNA, 14 bp, Homo sapiens
aagggccagtcctg

SEQ ID NO: 3318218 - DNA, 22 bp, Homo sapiens
aagggccagtcctgcctggcca

SEQ ID NO: 3318219 - DNA, 18 bp, Homo sapiens
aagggccagtctgggctg

SEQ ID NO: 3318220 - DNA, 13 bp, Homo sapiens
aagggcccagaga

SEQ ID NO: 3318221 - DNA, 19 bp, Homo sapiens
aagggcctgcctggcccct

SEQ ID NO: 3318222 - DNA, 23 bp, Homo sapiens
aagggcgcctactcttcagggtc

SEQ ID NO: 3318223 - DNA, 14 bp, Homo sapiens
aagggcttactatt

SEQ ID NO: 3318224 - DNA, 22 bp, Homo sapiens
aaggggaatgtttgcctctgcc

SEQ ID NO: 3318225 - DNA, 15 bp, Homo sapiens
aaggggacaggcctc

SEQ ID NO: 3318226 - DNA, 14 bp, Homo sapiens
aaggggcacaccac

SEQ ID NO: 3318227 - DNA, 16 bp, Homo sapiens
aaggggcccaagcccc

SEQ ID NO: 3318228 - DNA, 13 bp, Homo sapiens
aaggggccctggt

SEQ ID NO: 3318229 - DNA, 23 bp, Homo sapiens
aaggggcctcaccgagtgggggc

SEQ ID NO: 3318230 - DNA, 12 bp, Homo sapiens
aaggggctgctg

SEQ ID NO: 3318231 - DNA, 14 bp, Homo sapiens
aaggggctgctggg

SEQ ID NO: 3318232 - DNA, 21 bp, Homo sapiens
aaggggggttgcagtggagag

SEQ ID NO: 3318233 - DNA, 18 bp, Homo sapiens
aagggggtcaaaggaaga

SEQ ID NO: 3318234 - DNA, 13 bp, Homo sapiens
aaggggtaaaagg

SEQ ID NO: 3318235 - DNA, 23 bp, Homo sapiens
aaggggtgggtcagaacatgtta

SEQ ID NO: 3318236 - DNA, 16 bp, Homo sapiens
aaggggttggattgca

SEQ ID NO: 3318237 - DNA, 15 bp, Homo sapiens
aaggggttggggtga

SEQ ID NO: 3318238 - DNA, 16 bp, Homo sapiens
aaggggtttgccattt

SEQ ID NO: 3318239 - DNA, 20 bp, Homo sapiens
aaggggtttgccatttgata

SEQ ID NO: 3318240 - DNA, 16 bp, Homo sapiens
aagggtcatagaaagg

SEQ ID NO: 3318241 - DNA, 21 bp, Homo sapiens
aagggtcgaaagctctagaat

SEQ ID NO: 3318242 - DNA, 22 bp, Homo sapiens
aagggtcgaaagctctagaatc

SEQ ID NO: 3318243 - DNA, 12 bp, Homo sapiens
aagggtggaaat

SEQ ID NO: 3318244 - DNA, 22 bp, Homo sapiens
aagggtggaaatcaaccctctc

SEQ ID NO: 3318245 - DNA, 17 bp, Homo sapiens
aagggtgggtgctcaga

SEQ ID NO: 3318246 - DNA, 19 bp, Homo sapiens
aagggtgggtgctcagaat

SEQ ID NO: 3318247 - DNA, 20 bp, Homo sapiens
aagggtgtaggggccacctc

SEQ ID NO: 3318248 - DNA, 23 bp, Homo sapiens
aagggtgtaggggccacctcctc

SEQ ID NO: 3318249 - DNA, 21 bp, Homo sapiens
aagggtgttgggagggtggtt

SEQ ID NO: 3318250 - DNA, 17 bp, Homo sapiens
aagggttgaaggcagtc

SEQ ID NO: 3318251 - DNA, 14 bp, Homo sapiens
aagggttgagctgg

SEQ ID NO: 3318252 - DNA, 18 bp, Homo sapiens
aagggtttcgactggtcc

SEQ ID NO: 3318253 - DNA, 19 bp, Homo sapiens
aagggtttcgactggtcca

SEQ ID NO: 3318254 - DNA, 14 bp, Homo sapiens
aaggtaattgtttt

SEQ ID NO: 3318255 - DNA, 20 bp, Homo sapiens
aaggtagatcctgagatgat

SEQ ID NO: 3318256 - DNA, 18 bp, Homo sapiens
aaggtagcattctttgga

SEQ ID NO: 3318257 - DNA, 20 bp, Homo sapiens
aaggtagcattctttggagt

SEQ ID NO: 3318258 - DNA, 18 bp, Homo sapiens
aaggtagcttacctgaca

SEQ ID NO: 3318259 - DNA, 20 bp, Homo sapiens
aaggtagcttacctgacaca

SEQ ID NO: 3318260 - DNA, 22 bp, Homo sapiens
aaggtagtttttacctaccaca

SEQ ID NO: 3318261 - DNA, 17 bp, Homo sapiens
aaggtataattaaactt

SEQ ID NO: 3318262 - DNA, 21 bp, Homo sapiens
aaggtataattaaacttcttt

SEQ ID NO: 3318263 - DNA, 23 bp, Homo sapiens
aaggtatggtggggatattttta

SEQ ID NO: 3318264 - DNA, 23 bp, Homo sapiens
aaggtatttctccagttgggact

SEQ ID NO: 3318265 - DNA, 19 bp, Homo sapiens
aaggtccacaggtctagac

SEQ ID NO: 3318266 - DNA, 20 bp, Homo sapiens
aaggtccactccctgctcca

SEQ ID NO: 3318267 - DNA, 23 bp, Homo sapiens
aaggtcctctcagttctctccct

SEQ ID NO: 3318268 - DNA, 23 bp, Homo sapiens
aaggtctcatgctgttgctgcta

SEQ ID NO: 3318269 - DNA, 22 bp, Homo sapiens
aaggtctccttactctgagccc

SEQ ID NO: 3318270 - DNA, 21 bp, Homo sapiens
aaggtcttgcagtggcttttc

SEQ ID NO: 3318271 - DNA, 13 bp, Homo sapiens
aaggtctttggtt

SEQ ID NO: 3318272 - DNA, 13 bp, Homo sapiens
aaggtctttgtta

SEQ ID NO: 3318273 - DNA, 21 bp, Homo sapiens
aaggtgacacattacaaagcc

SEQ ID NO: 3318274 - DNA, 13 bp, Homo sapiens
aaggtgcctcaga

SEQ ID NO: 3318275 - DNA, 15 bp, Homo sapiens
aaggtgcctcagact

SEQ ID NO: 3318276 - DNA, 13 bp, Homo sapiens
aaggtgctgagct

SEQ ID NO: 3318277 - DNA, 14 bp, Homo sapiens
aaggtgctgagctt

SEQ ID NO: 3318278 - DNA, 20 bp, Homo sapiens
aaggtgctggaggtgggagc

SEQ ID NO: 3318279 - DNA, 16 bp, Homo sapiens
aaggtgcttggagttt

SEQ ID NO: 3318280 - DNA, 15 bp, Homo sapiens
aaggtgcttgttatg

SEQ ID NO: 3318281 - DNA, 12 bp, Homo sapiens
aaggtggaataa

SEQ ID NO: 3318282 - DNA, 18 bp, Homo sapiens
aaggtggcaatgcttaaa

SEQ ID NO: 3318283 - DNA, 18 bp, Homo sapiens
aaggtggggccctgcccc

SEQ ID NO: 3318284 - DNA, 19 bp, Homo sapiens
aaggtggggccctgcccct

SEQ ID NO: 3318285 - DNA, 21 bp, Homo sapiens
aaggtgggtccaggaaggcag

SEQ ID NO: 3318286 - DNA, 22 bp, Homo sapiens
aaggtgggtccaggaaggcagc

SEQ ID NO: 3318287 - DNA, 24 bp, Homo sapiens
aaggtgggtccaggaaggcagctg

SEQ ID NO: 3318288 - DNA, 12 bp, Homo sapiens
aaggtgtattta

SEQ ID NO: 3318289 - DNA, 15 bp, Homo sapiens
aaggtgtgaaatcat

SEQ ID NO: 3318290 - DNA, 16 bp, Homo sapiens
aaggttaataaagtaa

SEQ ID NO: 3318291 - DNA, 21 bp, Homo sapiens
aaggttatgttcatttttcaa

SEQ ID NO: 3318292 - DNA, 17 bp, Homo sapiens
aaggttcactaaagcag

SEQ ID NO: 3318293 - DNA, 19 bp, Homo sapiens
aaggttccaactgtatata

SEQ ID NO: 3318294 - DNA, 11 bp, Homo sapiens
aaggttctaag

SEQ ID NO: 3318295 - DNA, 12 bp, Homo sapiens
aaggttctaggt

SEQ ID NO: 3318296 - DNA, 19 bp, Homo sapiens
aaggttcttcatccctttc

SEQ ID NO: 3318297 - DNA, 23 bp, Homo sapiens
aaggttgaactttgccaaaaaaa

SEQ ID NO: 3318298 - DNA, 16 bp, Homo sapiens
aaggttttaggttcta

SEQ ID NO: 3318299 - DNA, 17 bp, Homo sapiens
aaggttttaggttctaa

SEQ ID NO: 3318300 - DNA, 20 bp, Homo sapiens
aaggttttcctcttctattt

SEQ ID NO: 3318301 - DNA, 12 bp, Homo sapiens
aagtaaaatgtc

SEQ ID NO: 3318302 - DNA, 22 bp, Homo sapiens
aagtaaaattatcctctttgta

SEQ ID NO: 3318303 - DNA, 16 bp, Homo sapiens
aagtaaaattgtttca

SEQ ID NO: 3318304 - DNA, 18 bp, Homo sapiens
aagtaaaggcctcctccc

SEQ ID NO: 3318305 - DNA, 12 bp, Homo sapiens
aagtaaatacaa

SEQ ID NO: 3318306 - DNA, 16 bp, Homo sapiens
aagtaaatacaagact

SEQ ID NO: 3318307 - DNA, 22 bp, Homo sapiens
aagtaaatacaagactgttgtg

SEQ ID NO: 3318308 - DNA, 22 bp, Homo sapiens
aagtaacatgcatactttattg

SEQ ID NO: 3318309 - DNA, 12 bp, Homo sapiens
aagtaactcatt

SEQ ID NO: 3318310 - DNA, 16 bp, Homo sapiens
aagtaactcatttgtt

SEQ ID NO: 3318311 - DNA, 21 bp, Homo sapiens
aagtaactcatttgttaaaat

SEQ ID NO: 3318312 - DNA, 14 bp, Homo sapiens
aagtaactgtgaga

SEQ ID NO: 3318313 - DNA, 13 bp, Homo sapiens
aagtaagaagaca

SEQ ID NO: 3318314 - DNA, 15 bp, Homo sapiens
aagtaagaagacatg

SEQ ID NO: 3318315 - DNA, 22 bp, Homo sapiens
aagtaagagctaagttctaagt

SEQ ID NO: 3318316 - DNA, 23 bp, Homo sapiens
aagtaagagtactgggagaatca

SEQ ID NO: 3318317 - DNA, 18 bp, Homo sapiens
aagtaagcaaacaaatat

SEQ ID NO: 3318318 - DNA, 18 bp, Homo sapiens
aagtaagtaccactcagg

SEQ ID NO: 3318319 - DNA, 20 bp, Homo sapiens
aagtaagttaataatgtatt

SEQ ID NO: 3318320 - DNA, 17 bp, Homo sapiens
aagtaagtttatccaaa

SEQ ID NO: 3318321 - DNA, 21 bp, Homo sapiens
aagtaatataatggaagagaa

SEQ ID NO: 3318322 - DNA, 23 bp, Homo sapiens
aagtaatataatggaagagaaat

SEQ ID NO: 3318323 - DNA, 16 bp, Homo sapiens
aagtaatctttaaact

SEQ ID NO: 3318324 - DNA, 13 bp, Homo sapiens
aagtaatgtggaa

SEQ ID NO: 3318325 - DNA, 14 bp, Homo sapiens
aagtaatgtggaag

SEQ ID NO: 3318326 - DNA, 11 bp, Homo sapiens
aagtaattatc

SEQ ID NO: 3318327 - DNA, 13 bp, Homo sapiens
aagtaattatcgg

SEQ ID NO: 3318328 - DNA, 23 bp, Homo sapiens
aagtaattatcgggaacagtgtt

SEQ ID NO: 3318329 - DNA, 16 bp, Homo sapiens
aagtaattatgcacta

SEQ ID NO: 3318330 - DNA, 19 bp, Homo sapiens
aagtaattatgcactaaat

SEQ ID NO: 3318331 - DNA, 16 bp, Homo sapiens
aagtaattgtgaaaaa

SEQ ID NO: 3318332 - DNA, 22 bp, Homo sapiens
aagtaattttgtcacattattt

SEQ ID NO: 3318333 - DNA, 18 bp, Homo sapiens
aagtacaatgaactgctt

SEQ ID NO: 3318334 - DNA, 19 bp, Homo sapiens
aagtacaatgtgtttttct

SEQ ID NO: 3318335 - DNA, 14 bp, Homo sapiens
aagtacagaatttg

SEQ ID NO: 3318336 - DNA, 16 bp, Homo sapiens
aagtacagaatttgaa

SEQ ID NO: 3318337 - DNA, 19 bp, Homo sapiens
aagtacagaatttgaatta

SEQ ID NO: 3318338 - DNA, 13 bp, Homo sapiens
aagtacatttaat

SEQ ID NO: 3318339 - DNA, 19 bp, Homo sapiens
aagtactagatgcatcact

SEQ ID NO: 3318340 - DNA, 16 bp, Homo sapiens
aagtactatgtatcaa

SEQ ID NO: 3318341 - DNA, 11 bp, Homo sapiens
aagtactgtaa

SEQ ID NO: 3318342 - DNA, 14 bp, Homo sapiens
aagtactgtaataa

SEQ ID NO: 3318343 - DNA, 14 bp, Homo sapiens
aagtactgtttacc

SEQ ID NO: 3318344 - DNA, 22 bp, Homo sapiens
aagtacttctccaccctgctct

SEQ ID NO: 3318345 - DNA, 22 bp, Homo sapiens
aagtacttgagtgtaatgtttg

SEQ ID NO: 3318346 - DNA, 17 bp, Homo sapiens
aagtactttcttataaa

SEQ ID NO: 3318347 - DNA, 17 bp, Homo sapiens
aagtagacaatcattgt

SEQ ID NO: 3318348 - DNA, 21 bp, Homo sapiens
aagtaggatgaatcatattca

SEQ ID NO: 3318349 - DNA, 16 bp, Homo sapiens
aagtaggcatatatca

SEQ ID NO: 3318350 - DNA, 17 bp, Homo sapiens
aagtagggatgcggatc

SEQ ID NO: 3318351 - DNA, 14 bp, Homo sapiens
aagtagtaaatttt

SEQ ID NO: 3318352 - DNA, 19 bp, Homo sapiens
aagtataatctttctatag

SEQ ID NO: 3318353 - DNA, 20 bp, Homo sapiens
aagtataatgtttattaaat

SEQ ID NO: 3318354 - DNA, 15 bp, Homo sapiens
aagtatacataagtt

SEQ ID NO: 3318355 - DNA, 14 bp, Homo sapiens
aagtatagagagaa

SEQ ID NO: 3318356 - DNA, 17 bp, Homo sapiens
aagtatagagagaagtt

SEQ ID NO: 3318357 - DNA, 11 bp, Homo sapiens
aagtatatact

SEQ ID NO: 3318358 - DNA, 11 bp, Homo sapiens
aagtatatata

SEQ ID NO: 3318359 - DNA, 22 bp, Homo sapiens
aagtatatgtgaaaaaaatgag

SEQ ID NO: 3318360 - DNA, 15 bp, Homo sapiens
aagtatattcttatt

SEQ ID NO: 3318361 - DNA, 22 bp, Homo sapiens
aagtatcactctaaaaaacatt

SEQ ID NO: 3318362 - DNA, 23 bp, Homo sapiens
aagtatcactctaaaaaacattt

SEQ ID NO: 3318363 - DNA, 19 bp, Homo sapiens
aagtatctgggattattct

SEQ ID NO: 3318364 - DNA, 20 bp, Homo sapiens
aagtatctgggattattctt

SEQ ID NO: 3318365 - DNA, 23 bp, Homo sapiens
aagtatcttctatttttatcatg

SEQ ID NO: 3318366 - DNA, 20 bp, Homo sapiens
aagtatgcattattaaattg

SEQ ID NO: 3318367 - DNA, 12 bp, Homo sapiens
aagtatgtaaag

SEQ ID NO: 3318368 - DNA, 19 bp, Homo sapiens
aagtatgtgtaaaatgtga

SEQ ID NO: 3318369 - DNA, 13 bp, Homo sapiens
aagtattattcaa

SEQ ID NO: 3318370 - DNA, 11 bp, Homo sapiens
aagtattcaca

SEQ ID NO: 3318371 - DNA, 21 bp, Homo sapiens
aagtattcatacaccttgcta

SEQ ID NO: 3318372 - DNA, 13 bp, Homo sapiens
aagtattgaaagt

SEQ ID NO: 3318373 - DNA, 13 bp, Homo sapiens
aagtatttaaatg

SEQ ID NO: 3318374 - DNA, 12 bp, Homo sapiens
aagtatttataa

SEQ ID NO: 3318375 - DNA, 13 bp, Homo sapiens
aagtatttataat

SEQ ID NO: 3318376 - DNA, 22 bp, Homo sapiens
aagtatttatatatttataact

SEQ ID NO: 3318377 - DNA, 23 bp, Homo sapiens
aagtatttatatatttataactc

SEQ ID NO: 3318378 - DNA, 21 bp, Homo sapiens
aagtatttttataaatataag

SEQ ID NO: 3318379 - DNA, 23 bp, Homo sapiens
aagtatttttttaagttagagaa

SEQ ID NO: 3318380 - DNA, 15 bp, Homo sapiens
aagtcaaaaggaaca

SEQ ID NO: 3318381 - DNA, 17 bp, Homo sapiens
aagtcaaaaggaacaaa

SEQ ID NO: 3318382 - DNA, 19 bp, Homo sapiens
aagtcaaaaggaacaaaaa

SEQ ID NO: 3318383 - DNA, 12 bp, Homo sapiens
aagtcaagcaca

SEQ ID NO: 3318384 - DNA, 13 bp, Homo sapiens
aagtcaagcacat

SEQ ID NO: 3318385 - DNA, 17 bp, Homo sapiens
aagtcaagcacatgtaa

SEQ ID NO: 3318386 - DNA, 22 bp, Homo sapiens
aagtcaagcacatgtaataaat

SEQ ID NO: 3318387 - DNA, 13 bp, Homo sapiens
aagtcacacagtg

SEQ ID NO: 3318388 - DNA, 17 bp, Homo sapiens
aagtcacagctgcagct

SEQ ID NO: 3318389 - DNA, 15 bp, Homo sapiens
aagtcacatgcgtaa

SEQ ID NO: 3318390 - DNA, 16 bp, Homo sapiens
aagtcaccaaatagtg

SEQ ID NO: 3318391 - DNA, 20 bp, Homo sapiens
aagtcaccactccattccca

SEQ ID NO: 3318392 - DNA, 19 bp, Homo sapiens
aagtcaccttgtgtgttcc

SEQ ID NO: 3318393 - DNA, 16 bp, Homo sapiens
aagtcactcaattgtt

SEQ ID NO: 3318394 - DNA, 12 bp, Homo sapiens
aagtcagaagtt

SEQ ID NO: 3318395 - DNA, 23 bp, Homo sapiens
aagtcagaatcagaagatagtct

SEQ ID NO: 3318396 - DNA, 17 bp, Homo sapiens
aagtcagactgctggga

SEQ ID NO: 3318397 - DNA, 12 bp, Homo sapiens
aagtcagaggat

SEQ ID NO: 3318398 - DNA, 15 bp, Homo sapiens
aagtcagaggatggc

SEQ ID NO: 3318399 - DNA, 15 bp, Homo sapiens
aagtcagattgctgg

SEQ ID NO: 3318400 - DNA, 14 bp, Homo sapiens
aagtcatctactta

SEQ ID NO: 3318401 - DNA, 17 bp, Homo sapiens
aagtcatgtgtgaacac

SEQ ID NO: 3318402 - DNA, 19 bp, Homo sapiens
aagtcattgtttttctcgc

SEQ ID NO: 3318403 - DNA, 18 bp, Homo sapiens
aagtcattttaactttat

SEQ ID NO: 3318404 - DNA, 22 bp, Homo sapiens
aagtcattttaactttatcaca

SEQ ID NO: 3318405 - DNA, 12 bp, Homo sapiens
aagtccaatgtg

SEQ ID NO: 3318406 - DNA, 17 bp, Homo sapiens
aagtcctacaagctaaa

SEQ ID NO: 3318407 - DNA, 19 bp, Homo sapiens
aagtcctccctctctactg

SEQ ID NO: 3318408 - DNA, 18 bp, Homo sapiens
aagtcctcttttctgaga

SEQ ID NO: 3318409 - DNA, 13 bp, Homo sapiens
aagtcctgaagag

SEQ ID NO: 3318410 - DNA, 15 bp, Homo sapiens
aagtcctggctacat

SEQ ID NO: 3318411 - DNA, 18 bp, Homo sapiens
aagtccttacctcttccg

SEQ ID NO: 3318412 - DNA, 21 bp, Homo sapiens
aagtcctttttttccatcttt

SEQ ID NO: 3318413 - DNA, 22 bp, Homo sapiens
aagtctacctgctggacagcct

SEQ ID NO: 3318414 - DNA, 14 bp, Homo sapiens
aagtctattcaaaa

SEQ ID NO: 3318415 - DNA, 12 bp, Homo sapiens
aagtctatttta

SEQ ID NO: 3318416 - DNA, 14 bp, Homo sapiens
aagtctattttatt

SEQ ID NO: 3318417 - DNA, 21 bp, Homo sapiens
aagtctcactggctgtcagta

SEQ ID NO: 3318418 - DNA, 13 bp, Homo sapiens
aagtctcagaaga

SEQ ID NO: 3318419 - DNA, 14 bp, Homo sapiens
aagtctccttcccc

SEQ ID NO: 3318420 - DNA, 15 bp, Homo sapiens
aagtctctctgtgaa

SEQ ID NO: 3318421 - DNA, 16 bp, Homo sapiens
aagtctctctgtgaat

SEQ ID NO: 3318422 - DNA, 17 bp, Homo sapiens
aagtctctctgtgaata

SEQ ID NO: 3318423 - DNA, 16 bp, Homo sapiens
aagtctctgctggccc

SEQ ID NO: 3318424 - DNA, 21 bp, Homo sapiens
aagtctctgctggcccagcca

SEQ ID NO: 3318425 - DNA, 12 bp, Homo sapiens
aagtctgaatca

SEQ ID NO: 3318426 - DNA, 20 bp, Homo sapiens
aagtctgactctccactcct

SEQ ID NO: 3318427 - DNA, 18 bp, Homo sapiens
aagtctgggatgtagaac

SEQ ID NO: 3318428 - DNA, 20 bp, Homo sapiens
aagtctgggatgtagaactt

SEQ ID NO: 3318429 - DNA, 14 bp, Homo sapiens
aagtctgtacctca

SEQ ID NO: 3318430 - DNA, 15 bp, Homo sapiens
aagtctgtacctcaa

SEQ ID NO: 3318431 - DNA, 22 bp, Homo sapiens
aagtctgtctttcctgaaccat

SEQ ID NO: 3318432 - DNA, 18 bp, Homo sapiens
aagtctgtgagtgcgtct

SEQ ID NO: 3318433 - DNA, 20 bp, Homo sapiens
aagtcttcactctctgaaga

SEQ ID NO: 3318434 - DNA, 12 bp, Homo sapiens
aagtcttcaggg

SEQ ID NO: 3318435 - DNA, 18 bp, Homo sapiens
aagtctttcagtggaatt

SEQ ID NO: 3318436 - DNA, 15 bp, Homo sapiens
aagtctttcatggct

SEQ ID NO: 3318437 - DNA, 12 bp, Homo sapiens
aagtcttttgtc

SEQ ID NO: 3318438 - DNA, 15 bp, Homo sapiens
aagtcttttttttcc

SEQ ID NO: 3318439 - DNA, 17 bp, Homo sapiens
aagtgaaatggatacta

SEQ ID NO: 3318440 - DNA, 13 bp, Homo sapiens
aagtgaagactgg

SEQ ID NO: 3318441 - DNA, 14 bp, Homo sapiens
aagtgaagtgatac

SEQ ID NO: 3318442 - DNA, 14 bp, Homo sapiens
aagtgaatccttaa

SEQ ID NO: 3318443 - DNA, 15 bp, Homo sapiens
aagtgaattgaagtt

SEQ ID NO: 3318444 - DNA, 13 bp, Homo sapiens
aagtgaatttata

SEQ ID NO: 3318445 - DNA, 19 bp, Homo sapiens
aagtgaatttgaatgaaaa

SEQ ID NO: 3318446 - DNA, 20 bp, Homo sapiens
aagtgaatttgaatgaaaaa

SEQ ID NO: 3318447 - DNA, 19 bp, Homo sapiens
aagtgactttaaaagaaaa

SEQ ID NO: 3318448 - DNA, 15 bp, Homo sapiens
aagtgagagctgggt

SEQ ID NO: 3318449 - DNA, 14 bp, Homo sapiens
aagtgagttttaca

SEQ ID NO: 3318450 - DNA, 14 bp, Homo sapiens
aagtgatgttggaa

SEQ ID NO: 3318451 - DNA, 17 bp, Homo sapiens
aagtgattctcctgcct

SEQ ID NO: 3318452 - DNA, 14 bp, Homo sapiens
aagtgattcttttt

SEQ ID NO: 3318453 - DNA, 23 bp, Homo sapiens
aagtgcacacagaaatatatata

SEQ ID NO: 3318454 - DNA, 15 bp, Homo sapiens
aagtgcactttctaa

SEQ ID NO: 3318455 - DNA, 14 bp, Homo sapiens
aagtgcatgatggt

SEQ ID NO: 3318456 - DNA, 23 bp, Homo sapiens
aagtgcatgatggtgagagccca

SEQ ID NO: 3318457 - DNA, 22 bp, Homo sapiens
aagtgcatttctgaatagaaat

SEQ ID NO: 3318458 - DNA, 20 bp, Homo sapiens
aagtgccactcattcctgta

SEQ ID NO: 3318459 - DNA, 22 bp, Homo sapiens
aagtgccactgcccgagctggt

SEQ ID NO: 3318460 - DNA, 14 bp, Homo sapiens
aagtgccagaggtg

SEQ ID NO: 3318461 - DNA, 15 bp, Homo sapiens
aagtgccagaggtgg

SEQ ID NO: 3318462 - DNA, 16 bp, Homo sapiens
aagtgccagcattcca

SEQ ID NO: 3318463 - DNA, 11 bp, Homo sapiens
aagtgcccaaa

SEQ ID NO: 3318464 - DNA, 12 bp, Homo sapiens
aagtgcccaaag

SEQ ID NO: 3318465 - DNA, 16 bp, Homo sapiens
aagtgcccaaagtggg

SEQ ID NO: 3318466 - DNA, 19 bp, Homo sapiens
aagtgcctagactgttact

SEQ ID NO: 3318467 - DNA, 18 bp, Homo sapiens
aagtgcctcacatttttt

SEQ ID NO: 3318468 - DNA, 23 bp, Homo sapiens
aagtgcctcacatttttttctac

SEQ ID NO: 3318469 - DNA, 12 bp, Homo sapiens
aagtgccttaat

SEQ ID NO: 3318470 - DNA, 13 bp, Homo sapiens
aagtgccttctcc

SEQ ID NO: 3318471 - DNA, 23 bp, Homo sapiens
aagtgccttctccttccccagga

SEQ ID NO: 3318472 - DNA, 14 bp, Homo sapiens
aagtgccttctggg

SEQ ID NO: 3318473 - DNA, 17 bp, Homo sapiens
aagtgccttctgggctt

SEQ ID NO: 3318474 - DNA, 23 bp, Homo sapiens
aagtgcctttctgcagtttttca

SEQ ID NO: 3318475 - DNA, 20 bp, Homo sapiens
aagtgccttttgctgcgcac

SEQ ID NO: 3318476 - DNA, 15 bp, Homo sapiens
aagtgcgtgaatgta

SEQ ID NO: 3318477 - DNA, 16 bp, Homo sapiens
aagtgcgtgccgtgtg

SEQ ID NO: 3318478 - DNA, 18 bp, Homo sapiens
aagtgcgtgtgtagagtt

SEQ ID NO: 3318479 - DNA, 21 bp, Homo sapiens
aagtgcgtgtgtagagttaag

SEQ ID NO: 3318480 - DNA, 22 bp, Homo sapiens
aagtgcgtgtgtagagttaaga

SEQ ID NO: 3318481 - DNA, 23 bp, Homo sapiens
aagtgcgtgtgtagagttaagaa

SEQ ID NO: 3318482 - DNA, 15 bp, Homo sapiens
aagtgctaaggttct

SEQ ID NO: 3318483 - DNA, 19 bp, Homo sapiens
aagtgctaaggttctaagg

SEQ ID NO: 3318484 - DNA, 21 bp, Homo sapiens
aagtgctaaggttctaaggcc

SEQ ID NO: 3318485 - DNA, 23 bp, Homo sapiens
aagtgctgtcttgatgactgctg

SEQ ID NO: 3318486 - DNA, 18 bp, Homo sapiens
aagtgctgtttattaatc

SEQ ID NO: 3318487 - DNA, 11 bp, Homo sapiens
aagtggaaaaa

SEQ ID NO: 3318488 - DNA, 13 bp, Homo sapiens
aagtggaaaaaag

SEQ ID NO: 3318489 - DNA, 13 bp, Homo sapiens
aagtggaaatgtt

SEQ ID NO: 3318490 - DNA, 18 bp, Homo sapiens
aagtggacaaattttgag

SEQ ID NO: 3318491 - DNA, 20 bp, Homo sapiens
aagtggaccttgagaccaca

SEQ ID NO: 3318492 - DNA, 16 bp, Homo sapiens
aagtggaggcacttta

SEQ ID NO: 3318493 - DNA, 16 bp, Homo sapiens
aagtggattggctttg

SEQ ID NO: 3318494 - DNA, 17 bp, Homo sapiens
aagtggcatgtgctgtg

SEQ ID NO: 3318495 - DNA, 13 bp, Homo sapiens
aagtggctgtccc

SEQ ID NO: 3318496 - DNA, 20 bp, Homo sapiens
aagtggggagggacaaggga

SEQ ID NO: 3318497 - DNA, 15 bp, Homo sapiens
aagtggggctcgcca

SEQ ID NO: 3318498 - DNA, 18 bp, Homo sapiens
aagtggggtgctgggagg

SEQ ID NO: 3318499 - DNA, 23 bp, Homo sapiens
aagtggtactagtgtggtgtgtt

SEQ ID NO: 3318500 - DNA, 17 bp, Homo sapiens
aagtgtaaacaccatag

SEQ ID NO: 3318501 - DNA, 15 bp, Homo sapiens
aagtgtaacagctga

SEQ ID NO: 3318502 - DNA, 17 bp, Homo sapiens
aagtgtaacagctgagg

SEQ ID NO: 3318503 - DNA, 14 bp, Homo sapiens
aagtgtaagtttgt

SEQ ID NO: 3318504 - DNA, 21 bp, Homo sapiens
aagtgtaccaacataagtgtt

SEQ ID NO: 3318505 - DNA, 14 bp, Homo sapiens
aagtgtatctcctt

SEQ ID NO: 3318506 - DNA, 17 bp, Homo sapiens
aagtgtatgtgtgaatt

SEQ ID NO: 3318507 - DNA, 19 bp, Homo sapiens
aagctcgccccacctccac

SEQ ID NO: 3318508 - DNA, 22 bp, Homo sapiens
aagctcgccccacctccacctg

SEQ ID NO: 3318509 - DNA, 21 bp, Homo sapiens
aagctctactgaggtgctatg

SEQ ID NO: 3318510 - DNA, 16 bp, Homo sapiens
aagctctagtgggaag

SEQ ID NO: 3318511 - DNA, 15 bp, Homo sapiens
aagctctgaagaact

SEQ ID NO: 3318512 - DNA, 17 bp, Homo sapiens
aagctctgctcctctcc

SEQ ID NO: 3318513 - DNA, 15 bp, Homo sapiens
aagctctggctgaac

SEQ ID NO: 3318514 - DNA, 23 bp, Homo sapiens
aagctctggctgaaccctgtgct

SEQ ID NO: 3318515 - DNA, 22 bp, Homo sapiens
aagctcttacactacattagaa

SEQ ID NO: 3318516 - DNA, 18 bp, Homo sapiens
aagctgaaattttagaaa

SEQ ID NO: 3318517 - DNA, 18 bp, Homo sapiens
aagctgaatattttttat

SEQ ID NO: 3318518 - DNA, 23 bp, Homo sapiens
aagctgaatattttttatttcta

SEQ ID NO: 3318519 - DNA, 17 bp, Homo sapiens
aagctgacttggcactt

SEQ ID NO: 3318520 - DNA, 22 bp, Homo sapiens
aagctgactttatagctgcaag

SEQ ID NO: 3318521 - DNA, 17 bp, Homo sapiens
aagctgaggcgggagaa

SEQ ID NO: 3318522 - DNA, 23 bp, Homo sapiens
aagctgagttacttgtctgaggc

SEQ ID NO: 3318523 - DNA, 13 bp, Homo sapiens
aagctgagtttcc

SEQ ID NO: 3318524 - DNA, 14 bp, Homo sapiens
aagctgagtttcct

SEQ ID NO: 3318525 - DNA, 22 bp, Homo sapiens
aataatatttcaagtgcctaga

SEQ ID NO: 3318526 - DNA, 14 bp, Homo sapiens
aataatccagtatt

SEQ ID NO: 3318527 - DNA, 16 bp, Homo sapiens
aataatccagtattgc

SEQ ID NO: 3318528 - DNA, 20 bp, Homo sapiens
aataatccagtattgctgat

SEQ ID NO: 3318529 - DNA, 19 bp, Homo sapiens
aataatcttattagggaga

SEQ ID NO: 3318530 - DNA, 16 bp, Homo sapiens
aataatgaataaactg

SEQ ID NO: 3318531 - DNA, 19 bp, Homo sapiens
aataatgacagatggtgaa

SEQ ID NO: 3318532 - DNA, 21 bp, Homo sapiens
aataatgctacaattttaaga

SEQ ID NO: 3318533 - DNA, 14 bp, Homo sapiens
aataatgcttcaga

SEQ ID NO: 3318534 - DNA, 13 bp, Homo sapiens
aataatggaaaca

SEQ ID NO: 3318535 - DNA, 15 bp, Homo sapiens
aataatggaaacatt

SEQ ID NO: 3318536 - DNA, 20 bp, Homo sapiens
aataatggaaacattacagt

SEQ ID NO: 3318537 - DNA, 20 bp, Homo sapiens
aataatggtcccatccaggc

SEQ ID NO: 3318538 - DNA, 19 bp, Homo sapiens
aataatgtattgtaatctt

SEQ ID NO: 3318539 - DNA, 18 bp, Homo sapiens
aataattatttatttaat

SEQ ID NO: 3318540 - DNA, 14 bp, Homo sapiens
aataattctaaatc

SEQ ID NO: 3318541 - DNA, 16 bp, Homo sapiens
aataatttctaatgtt

SEQ ID NO: 3318542 - DNA, 12 bp, Homo sapiens
aataattttaaa

SEQ ID NO: 3318543 - DNA, 16 bp, Homo sapiens
aataattttaaacaaa

SEQ ID NO: 3318544 - DNA, 17 bp, Homo sapiens
aataatttttatattta

SEQ ID NO: 3318545 - DNA, 15 bp, Homo sapiens
aatacaaagtaaata

SEQ ID NO: 3318546 - DNA, 22 bp, Homo sapiens
aatacaacatgtagctgagttt

SEQ ID NO: 3318547 - DNA, 13 bp, Homo sapiens
aatacaagactgt

SEQ ID NO: 3318548 - DNA, 12 bp, Homo sapiens
aatacaataaac

SEQ ID NO: 3318549 - DNA, 14 bp, Homo sapiens
aatacaattaaagg

SEQ ID NO: 3318550 - DNA, 15 bp, Homo sapiens
aatacaattaaaggt

SEQ ID NO: 3318551 - DNA, 19 bp, Homo sapiens
aatacacagtactttattg

SEQ ID NO: 3318552 - DNA, 12 bp, Homo sapiens
aatacacatttc

SEQ ID NO: 3318553 - DNA, 20 bp, Homo sapiens
aatacaccacctcactcctg

SEQ ID NO: 3318554 - DNA, 22 bp, Homo sapiens
aatacaccacctcactcctgtt

SEQ ID NO: 3318555 - DNA, 16 bp, Homo sapiens
aatacaccttccccac

SEQ ID NO: 3318556 - DNA, 17 bp, Homo sapiens
aatacacttcttttgaa

SEQ ID NO: 3318557 - DNA, 19 bp, Homo sapiens
aatacagaaattagccggg

SEQ ID NO: 3318558 - DNA, 15 bp, Homo sapiens
aatacagaatcttgt

SEQ ID NO: 3318559 - DNA, 12 bp, Homo sapiens
aatacagataac

SEQ ID NO: 3318560 - DNA, 21 bp, Homo sapiens
aatacagataattcatttgta

SEQ ID NO: 3318561 - DNA, 18 bp, Homo sapiens
aatacagcaacaatttat

SEQ ID NO: 3318562 - DNA, 16 bp, Homo sapiens
aatacagggcatgcat

SEQ ID NO: 3318563 - DNA, 17 bp, Homo sapiens
aatacagttctgctctg

SEQ ID NO: 3318564 - DNA, 21 bp, Homo sapiens
aatacataaatagtagaaaaa

SEQ ID NO: 3318565 - DNA, 23 bp, Homo sapiens
aatacatacggtcaggtttaaca

SEQ ID NO: 3318566 - DNA, 16 bp, Homo sapiens
aataccaagtatttat

SEQ ID NO: 3318567 - DNA, 16 bp, Homo sapiens
aataccacaagcctga

SEQ ID NO: 3318568 - DNA, 23 bp, Homo sapiens
aataccagagccttcaagtgcca

SEQ ID NO: 3318569 - DNA, 15 bp, Homo sapiens
aataccatttagtaa

SEQ ID NO: 3318570 - DNA, 17 bp, Homo sapiens
aatacctaattgtggat

SEQ ID NO: 3318571 - DNA, 18 bp, Homo sapiens
aatacctacaataaactg

SEQ ID NO: 3318572 - DNA, 20 bp, Homo sapiens
aatacctacaataaactggt

SEQ ID NO: 3318573 - DNA, 22 bp, Homo sapiens
aatacctcatgtttatgaaaat

SEQ ID NO: 3318574 - DNA, 19 bp, Homo sapiens
aatacctccattaaatggt

SEQ ID NO: 3318575 - DNA, 15 bp, Homo sapiens
aatacctctgtgtgc

SEQ ID NO: 3318576 - DNA, 19 bp, Homo sapiens
aatacctttgtagttactc

SEQ ID NO: 3318577 - DNA, 18 bp, Homo sapiens
aatacgcactacatgtgg

SEQ ID NO: 3318578 - DNA, 15 bp, Homo sapiens
aatactaaaagcaaa

SEQ ID NO: 3318579 - DNA, 19 bp, Homo sapiens
aatactaaaagcaaatcta

SEQ ID NO: 3318580 - DNA, 14 bp, Homo sapiens
aatactaccttgaa

SEQ ID NO: 3318581 - DNA, 16 bp, Homo sapiens
aatactagtcacccca

SEQ ID NO: 3318582 - DNA, 13 bp, Homo sapiens
aatactcaaatga

SEQ ID NO: 3318583 - DNA, 18 bp, Homo sapiens
aatactctatttttacat

SEQ ID NO: 3318584 - DNA, 14 bp, Homo sapiens
aatactctgttgta

SEQ ID NO: 3318585 - DNA, 22 bp, Homo sapiens
aatactctgttgtactatggaa

SEQ ID NO: 3318586 - DNA, 22 bp, Homo sapiens
aatactgtgcagaataatggaa

SEQ ID NO: 3318587 - DNA, 18 bp, Homo sapiens
aatacttaaaaatagtct

SEQ ID NO: 3318588 - DNA, 13 bp, Homo sapiens
aatacttaataaa

SEQ ID NO: 3318589 - DNA, 22 bp, Homo sapiens
aatacttatatttttaataaaa

SEQ ID NO: 3318590 - DNA, 20 bp, Homo sapiens
aatactttcgaaatttcatt

SEQ ID NO: 3318591 - DNA, 16 bp, Homo sapiens
aatactttcttagatt

SEQ ID NO: 3318592 - DNA, 23 bp, Homo sapiens
aatactttgtcctaagagattta

SEQ ID NO: 3318593 - DNA, 20 bp, Homo sapiens
aatactttgtttattgtaaa

SEQ ID NO: 3318594 - DNA, 17 bp, Homo sapiens
aatagaaaactgaaaat

SEQ ID NO: 3318595 - DNA, 19 bp, Homo sapiens
aatagaaaactgaaaatct

SEQ ID NO: 3318596 - DNA, 20 bp, Homo sapiens
aatagaaaactgaaaatcta

SEQ ID NO: 3318597 - DNA, 12 bp, Homo sapiens
aatagaaaagta

SEQ ID NO: 3318598 - DNA, 18 bp, Homo sapiens
aatagaaaagtagacaat

SEQ ID NO: 3318599 - DNA, 21 bp, Homo sapiens
aatagaaactcaccatgtaaa

SEQ ID NO: 3318600 - DNA, 13 bp, Homo sapiens
aatagaacacagt

SEQ ID NO: 3318601 - DNA, 13 bp, Homo sapiens
aatagaaggtgat

SEQ ID NO: 3318602 - DNA, 15 bp, Homo sapiens
aatagaataaaggca

SEQ ID NO: 3318603 - DNA, 20 bp, Homo sapiens
aatagaatataattatcgga

SEQ ID NO: 3318604 - DNA, 18 bp, Homo sapiens
aatagacaaaaagtatat

SEQ ID NO: 3318605 - DNA, 22 bp, Homo sapiens
aatagacactccccgaagtctt

SEQ ID NO: 3318606 - DNA, 20 bp, Homo sapiens
aatagacagtatatttatag

SEQ ID NO: 3318607 - DNA, 13 bp, Homo sapiens
aatagacatgtag

SEQ ID NO: 3318608 - DNA, 14 bp, Homo sapiens
aatagagactgtag

SEQ ID NO: 3318609 - DNA, 14 bp, Homo sapiens
aatagagataagtc

SEQ ID NO: 3318610 - DNA, 22 bp, Homo sapiens
aatagagcaaaattgatgtgtt

SEQ ID NO: 3318611 - DNA, 16 bp, Homo sapiens
aatagatgtgatcact

SEQ ID NO: 3318612 - DNA, 11 bp, Homo sapiens
aatagattctc

SEQ ID NO: 3318613 - DNA, 18 bp, Homo sapiens
aatagatttaggagcaga

SEQ ID NO: 3318614 - DNA, 17 bp, Homo sapiens
aatagcaacttttgtgt

SEQ ID NO: 3318615 - DNA, 21 bp, Homo sapiens
aatagcaaggctgtgcatcta

SEQ ID NO: 3318616 - DNA, 16 bp, Homo sapiens
aatagcacttaaattc

SEQ ID NO: 3318617 - DNA, 14 bp, Homo sapiens
aatagcagcctttc

SEQ ID NO: 3318618 - DNA, 22 bp, Homo sapiens
aatagccacatttggaatactt

SEQ ID NO: 3318619 - DNA, 22 bp, Homo sapiens
aatagccagagaggagcacctg

SEQ ID NO: 3318620 - DNA, 22 bp, Homo sapiens
aatagcgctgtttttgttgtgt

SEQ ID NO: 3318621 - DNA, 16 bp, Homo sapiens
aatagctacagtgcat

SEQ ID NO: 3318622 - DNA, 20 bp, Homo sapiens
aatagctatcctaaatttga

SEQ ID NO: 3318623 - DNA, 18 bp, Homo sapiens
aatagcttccaataaagc

SEQ ID NO: 3318624 - DNA, 20 bp, Homo sapiens
aataggaacaatctttgctg

SEQ ID NO: 3318625 - DNA, 20 bp, Homo sapiens
aataggaatcattcagaaat

SEQ ID NO: 3318626 - DNA, 11 bp, Homo sapiens
aataggagtct

SEQ ID NO: 3318627 - DNA, 21 bp, Homo sapiens
aataggagtggtgatttgaaa

SEQ ID NO: 3318628 - DNA, 16 bp, Homo sapiens
aataggcaaattaatc

SEQ ID NO: 3318629 - DNA, 17 bp, Homo sapiens
aatagggtagaatgatt

SEQ ID NO: 3318630 - DNA, 14 bp, Homo sapiens
aataggtagtttgg

SEQ ID NO: 3318631 - DNA, 17 bp, Homo sapiens
aataggtagtttggata

SEQ ID NO: 3318632 - DNA, 19 bp, Homo sapiens
aataggtctttctctcagt

SEQ ID NO: 3318633 - DNA, 22 bp, Homo sapiens
aatagtaaaagataacaagatc

SEQ ID NO: 3318634 - DNA, 18 bp, Homo sapiens
aatagtatttatgaaatg

SEQ ID NO: 3318635 - DNA, 14 bp, Homo sapiens
aatagtctgtgtga

SEQ ID NO: 3318636 - DNA, 13 bp, Homo sapiens
aatagtgcttttt

SEQ ID NO: 3318637 - DNA, 21 bp, Homo sapiens
aatagtgtgttctgattagaa

SEQ ID NO: 3318638 - DNA, 23 bp, Homo sapiens
aatagtgtgttctgattagaaat

SEQ ID NO: 3318639 - DNA, 21 bp, Homo sapiens
aatagttaagacatgatttcc

SEQ ID NO: 3318640 - DNA, 21 bp, Homo sapiens
aatagttcaggtaacaggcag

SEQ ID NO: 3318641 - DNA, 14 bp, Homo sapiens
aatagttgagcccc

SEQ ID NO: 3318642 - DNA, 18 bp, Homo sapiens
aatagttgtccatatttt

SEQ ID NO: 3318643 - DNA, 21 bp, Homo sapiens
aatagttgtccatattttcac

SEQ ID NO: 3318644 - DNA, 19 bp, Homo sapiens
aatagtttgaattcagtaa

SEQ ID NO: 3318645 - DNA, 19 bp, Homo sapiens
aatagtttgtctattttaa

SEQ ID NO: 3318646 - DNA, 14 bp, Homo sapiens
aatagttttttact

SEQ ID NO: 3318647 - DNA, 14 bp, Homo sapiens
aatataaaaggcaa

SEQ ID NO: 3318648 - DNA, 23 bp, Homo sapiens
aatataaaaggcaaatgtgtaca

SEQ ID NO: 3318649 - DNA, 12 bp, Homo sapiens
aatataaaatta

SEQ ID NO: 3318650 - DNA, 15 bp, Homo sapiens
aatataaaattatga

SEQ ID NO: 3318651 - DNA, 12 bp, Homo sapiens
aatataaacatc

SEQ ID NO: 3318652 - DNA, 16 bp, Homo sapiens
aatataaagtattcaa

SEQ ID NO: 3318653 - DNA, 17 bp, Homo sapiens
aatataaatagctaatg

SEQ ID NO: 3318654 - DNA, 21 bp, Homo sapiens
tggaggatgaatagatgtgat

SEQ ID NO: 3318655 - DNA, 15 bp, Homo sapiens
tggaggcagagacct

SEQ ID NO: 3318656 - DNA, 16 bp, Homo sapiens
tggaggcagagacctc

SEQ ID NO: 3318657 - DNA, 18 bp, Homo sapiens
tggaggcccaggctggga

SEQ ID NO: 3318658 - DNA, 13 bp, Homo sapiens
tggaggcccctgg

SEQ ID NO: 3318659 - DNA, 21 bp, Homo sapiens
tggaggccctcctgtgctggg

SEQ ID NO: 3318660 - DNA, 13 bp, Homo sapiens
tggaggcctctgg

SEQ ID NO: 3318661 - DNA, 16 bp, Homo sapiens
tggaggcctctggccc

SEQ ID NO: 3318662 - DNA, 14 bp, Homo sapiens
tggaggcctgatgc

SEQ ID NO: 3318663 - DNA, 19 bp, Homo sapiens
tggaggcctgatgctgccc

SEQ ID NO: 3318664 - DNA, 20 bp, Homo sapiens
tggaggcctgatgctgcccc

SEQ ID NO: 3318665 - DNA, 19 bp, Homo sapiens
tggaggctgacgtgtgagg

SEQ ID NO: 3318666 - DNA, 15 bp, Homo sapiens
tggaggcttcctgcg

SEQ ID NO: 3318667 - DNA, 16 bp, Homo sapiens
tggaggcttcctgcgt

SEQ ID NO: 3318668 - DNA, 17 bp, Homo sapiens
tggaggcttcctgcgtc

SEQ ID NO: 3318669 - DNA, 16 bp, Homo sapiens
tggaggcttttcactg

SEQ ID NO: 3318670 - DNA, 17 bp, Homo sapiens
tggaggcttttcactgc

SEQ ID NO: 3318671 - DNA, 15 bp, Homo sapiens
tggagggcacagccc

SEQ ID NO: 3318672 - DNA, 13 bp, Homo sapiens
tggagggcttggc

SEQ ID NO: 3318673 - DNA, 14 bp, Homo sapiens
tggaggggcccctg

SEQ ID NO: 3318674 - DNA, 13 bp, Homo sapiens
tggaggggccctc

SEQ ID NO: 3318675 - DNA, 14 bp, Homo sapiens
tggaggggccctcc

SEQ ID NO: 3318676 - DNA, 19 bp, Homo sapiens
tggaggggtggtcctgact

SEQ ID NO: 3318677 - DNA, 11 bp, Homo sapiens
tggaggggtgt

SEQ ID NO: 3318678 - DNA, 18 bp, Homo sapiens
tggaggggtgtggcagtg

SEQ ID NO: 3318679 - DNA, 23 bp, Homo sapiens
tggaggtgagatcacagcctcca

SEQ ID NO: 3318680 - DNA, 12 bp, Homo sapiens
tggaggtgggag

SEQ ID NO: 3318681 - DNA, 13 bp, Homo sapiens
tggaggtgggcat

SEQ ID NO: 3318682 - DNA, 13 bp, Homo sapiens
tggaggttctaag

SEQ ID NO: 3318683 - DNA, 19 bp, Homo sapiens
tggaggttctcagagccaa

SEQ ID NO: 3318684 - DNA, 15 bp, Homo sapiens
tggaggttgaagcca

SEQ ID NO: 3318685 - DNA, 22 bp, Homo sapiens
tggaggttgaagccaagtgggg

SEQ ID NO: 3318686 - DNA, 18 bp, Homo sapiens
tggagtactatatttaca

SEQ ID NO: 3318687 - DNA, 15 bp, Homo sapiens
tggagtacttagcta

SEQ ID NO: 3318688 - DNA, 16 bp, Homo sapiens
tggagtataatattca

SEQ ID NO: 3318689 - DNA, 14 bp, Homo sapiens
tggagtatgtctga

SEQ ID NO: 3318690 - DNA, 13 bp, Homo sapiens
tggagtctgagtc

SEQ ID NO: 3318691 - DNA, 16 bp, Homo sapiens
tggagtctggagtggg

SEQ ID NO: 3318692 - DNA, 17 bp, Homo sapiens
tggagtctggagtgggc

SEQ ID NO: 3318693 - DNA, 19 bp, Homo sapiens
tggagtctggagtgggcag

SEQ ID NO: 3318694 - DNA, 17 bp, Homo sapiens
tggagtgaggcttccag

SEQ ID NO: 3318695 - DNA, 17 bp, Homo sapiens
tggagtgcagggaggag

SEQ ID NO: 3318696 - DNA, 19 bp, Homo sapiens
tggagtgcagggaggagag

SEQ ID NO: 3318697 - DNA, 14 bp, Homo sapiens
tggagtgcagtgag

SEQ ID NO: 3318698 - DNA, 22 bp, Homo sapiens
tggagtgcgctcttggtccctg

SEQ ID NO: 3318699 - DNA, 23 bp, Homo sapiens
tggagtgcgctcttggtccctgg

SEQ ID NO: 3318700 - DNA, 17 bp, Homo sapiens
tggagtggtaacagctc

SEQ ID NO: 3318701 - DNA, 14 bp, Homo sapiens
tggagtgtatgact

SEQ ID NO: 3318702 - DNA, 12 bp, Homo sapiens
tggagtgtgtaa

SEQ ID NO: 3318703 - DNA, 20 bp, Homo sapiens
tggagtgtgtattgttccca

SEQ ID NO: 3318704 - DNA, 15 bp, Homo sapiens
tggagttaaaatgca

SEQ ID NO: 3318705 - DNA, 14 bp, Homo sapiens
tggagttcttgtgc

SEQ ID NO: 3318706 - DNA, 15 bp, Homo sapiens
tggagttcttgtgcc

SEQ ID NO: 3318707 - DNA, 23 bp, Homo sapiens
tggagtttaatacagtgagctct

SEQ ID NO: 3318708 - DNA, 21 bp, Homo sapiens
tggagtttcatgtacaagatg

SEQ ID NO: 3318709 - DNA, 13 bp, Homo sapiens
tggagtttctgac

SEQ ID NO: 3318710 - DNA, 15 bp, Homo sapiens
tggataaactgagcc

SEQ ID NO: 3318711 - DNA, 16 bp, Homo sapiens
tggataaactgagcct

SEQ ID NO: 3318712 - DNA, 23 bp, Homo sapiens
tggataataaacctgggctcagc

SEQ ID NO: 3318713 - DNA, 14 bp, Homo sapiens
tggatacttcctgg

SEQ ID NO: 3318714 - DNA, 17 bp, Homo sapiens
tggatataatgtatttt

SEQ ID NO: 3318715 - DNA, 17 bp, Homo sapiens
tggatatagttttactt

SEQ ID NO: 3318716 - DNA, 14 bp, Homo sapiens
tggatattgttacg

SEQ ID NO: 3318717 - DNA, 15 bp, Homo sapiens
tggatatttgcactt

SEQ ID NO: 3318718 - DNA, 18 bp, Homo sapiens
tggatatttgcacttatg

SEQ ID NO: 3318719 - DNA, 20 bp, Homo sapiens
tggatatttgcacttatgta

SEQ ID NO: 3318720 - DNA, 11 bp, Homo sapiens
tggatatttgt

SEQ ID NO: 3318721 - DNA, 13 bp, Homo sapiens
tggatatttgtat

SEQ ID NO: 3318722 - DNA, 22 bp, Homo sapiens
tggatatttttgtacttgattt

SEQ ID NO: 3318723 - DNA, 23 bp, Homo sapiens
tggatcccctctgtctacaaata

SEQ ID NO: 3318724 - DNA, 20 bp, Homo sapiens
tggatcccctgcggtcaggc

SEQ ID NO: 3318725 - DNA, 21 bp, Homo sapiens
tggatcccctgcggtcaggct

SEQ ID NO: 3318726 - DNA, 19 bp, Homo sapiens
tggatctccccactctagg

SEQ ID NO: 3318727 - DNA, 20 bp, Homo sapiens
tggatcttcagaactgccct

SEQ ID NO: 3318728 - DNA, 19 bp, Homo sapiens
tggatcttgaatgtggtct

SEQ ID NO: 3318729 - DNA, 16 bp, Homo sapiens
tggatcttttcattct

SEQ ID NO: 3318730 - DNA, 22 bp, Homo sapiens
tggatgaagattctcctgtgct

SEQ ID NO: 3318731 - DNA, 17 bp, Homo sapiens
tggatgaggcacttctg

SEQ ID NO: 3318732 - DNA, 15 bp, Homo sapiens
tggatgatttcatct

SEQ ID NO: 3318733 - DNA, 13 bp, Homo sapiens
tggatgcaaagta

SEQ ID NO: 3318734 - DNA, 20 bp, Homo sapiens
tggatgcaaagtacaatgtg

SEQ ID NO: 3318735 - DNA, 16 bp, Homo sapiens
tggatgcatttcaaat

SEQ ID NO: 3318736 - DNA, 18 bp, Homo sapiens
tggatgccaaggagcccc

SEQ ID NO: 3318737 - DNA, 21 bp, Homo sapiens
tggatgccaatattaaatctg

SEQ ID NO: 3318738 - DNA, 20 bp, Homo sapiens
tggatgcctcattatgtcaa

SEQ ID NO: 3318739 - DNA, 20 bp, Homo sapiens
tggatgcctggtggcagctg

SEQ ID NO: 3318740 - DNA, 23 bp, Homo sapiens
tggatgcctggtggcagctgcgg

SEQ ID NO: 3318741 - DNA, 13 bp, Homo sapiens
tggatggcacaat

SEQ ID NO: 3318742 - DNA, 15 bp, Homo sapiens
tggatggcacaatga

SEQ ID NO: 3318743 - DNA, 13 bp, Homo sapiens
tggatggcttcta

SEQ ID NO: 3318744 - DNA, 17 bp, Homo sapiens
tggatgggagtgagaca

SEQ ID NO: 3318745 - DNA, 18 bp, Homo sapiens
tggatgggcaaagcttgt

SEQ ID NO: 3318746 - DNA, 22 bp, Homo sapiens
tggatgggcattgggctgacac

SEQ ID NO: 3318747 - DNA, 23 bp, Homo sapiens
tggatgggcattgggctgacacc

SEQ ID NO: 3318748 - DNA, 18 bp, Homo sapiens
tggatggtcattgcagtt

SEQ ID NO: 3318749 - DNA, 20 bp, Homo sapiens
tggatgtaattagctctggg

SEQ ID NO: 3318750 - DNA, 21 bp, Homo sapiens
tggatgtaattagctctgggg

SEQ ID NO: 3318751 - DNA, 23 bp, Homo sapiens
tggatgtggggtccccatcatcc

SEQ ID NO: 3318752 - DNA, 19 bp, Homo sapiens
tggattaatctttaataac

SEQ ID NO: 3318753 - DNA, 19 bp, Homo sapiens
tggattaatgttttgtaca

SEQ ID NO: 3318754 - DNA, 14 bp, Homo sapiens
tggattagaaattt

SEQ ID NO: 3318755 - DNA, 19 bp, Homo sapiens
tggattataaaaaatgtaa

SEQ ID NO: 3318756 - DNA, 17 bp, Homo sapiens
tggattattcatttaaa

SEQ ID NO: 3318757 - DNA, 18 bp, Homo sapiens
tggattattcatttaaaa

SEQ ID NO: 3318758 - DNA, 21 bp, Homo sapiens
aaaaataaaaactaatttcat

SEQ ID NO: 3318759 - DNA, 12 bp, Homo sapiens
aaaaataatcaa

SEQ ID NO: 3318760 - DNA, 17 bp, Homo sapiens
aaaaatacaatttttat

SEQ ID NO: 3318761 - DNA, 14 bp, Homo sapiens
aaaaatacatgcat

SEQ ID NO: 3318762 - DNA, 18 bp, Homo sapiens
aaaaatagacatgtagtt

SEQ ID NO: 3318763 - DNA, 21 bp, Homo sapiens
aaaaatatccttgatgtacag

SEQ ID NO: 3318764 - DNA, 12 bp, Homo sapiens
aaaaatatgaac

SEQ ID NO: 3318765 - DNA, 22 bp, Homo sapiens
aaaaatatgaacctattttcat

SEQ ID NO: 3318766 - DNA, 23 bp, Homo sapiens
aaaaatatgaacctattttcatt

SEQ ID NO: 3318767 - DNA, 16 bp, Homo sapiens
aaaaatattataactt

SEQ ID NO: 3318768 - DNA, 13 bp, Homo sapiens
aaaaatattccat

SEQ ID NO: 3318769 - DNA, 12 bp, Homo sapiens
aaaaatattgtt

SEQ ID NO: 3318770 - DNA, 22 bp, Homo sapiens
aaaaatattttctctgtacttt

SEQ ID NO: 3318771 - DNA, 17 bp, Homo sapiens
aaaaatcacaaaaattt

SEQ ID NO: 3318772 - DNA, 20 bp, Homo sapiens
aaaaatcatgccagtatttt

SEQ ID NO: 3318773 - DNA, 19 bp, Homo sapiens
aaaaatcatgggccagagc

SEQ ID NO: 3318774 - DNA, 16 bp, Homo sapiens
aaaaatccagaaagaa

SEQ ID NO: 3318775 - DNA, 20 bp, Homo sapiens
aaaaatcttgtgctagaata

SEQ ID NO: 3318776 - DNA, 21 bp, Homo sapiens
aaaaatgaaagtgactttaaa

SEQ ID NO: 3318777 - DNA, 15 bp, Homo sapiens
aaaaatgaatgtcta

SEQ ID NO: 3318778 - DNA, 19 bp, Homo sapiens
aaaaatgacaacagaaaaa

SEQ ID NO: 3318779 - DNA, 22 bp, Homo sapiens
aaaaatgagcttgattaaatca

SEQ ID NO: 3318780 - DNA, 12 bp, Homo sapiens
aaaaatgccttt

SEQ ID NO: 3318781 - DNA, 13 bp, Homo sapiens
aaaaatgcctttg

SEQ ID NO: 3318782 - DNA, 20 bp, Homo sapiens
aaaaatgcctttgagacagt

SEQ ID NO: 3318783 - DNA, 24 bp, Homo sapiens
aaaaatgcctttgagacagtttct

SEQ ID NO: 3318784 - DNA, 20 bp, Homo sapiens
aaaaatgggagacagcctct

SEQ ID NO: 3318785 - DNA, 13 bp, Homo sapiens
aaaaatggtaatt

SEQ ID NO: 3318786 - DNA, 13 bp, Homo sapiens
aaaaatgtaacat

SEQ ID NO: 3318787 - DNA, 14 bp, Homo sapiens
aaaaatgtaacatc

SEQ ID NO: 3318788 - DNA, 16 bp, Homo sapiens
aaaaatgtaatttaga

SEQ ID NO: 3318789 - DNA, 13 bp, Homo sapiens
aaaaatgtacatt

SEQ ID NO: 3318790 - DNA, 21 bp, Homo sapiens
aaaaatgtagaaattcttcat

SEQ ID NO: 3318791 - DNA, 22 bp, Homo sapiens
aaaaatgtagaaattcttcatg

SEQ ID NO: 3318792 - DNA, 18 bp, Homo sapiens
aaaaatgtcctgcctttt

SEQ ID NO: 3318793 - DNA, 13 bp, Homo sapiens
aaaaatgttctca

SEQ ID NO: 3318794 - DNA, 20 bp, Homo sapiens
aaaaattctgttgttccatt

SEQ ID NO: 3318795 - DNA, 20 bp, Homo sapiens
aaaaattgctctgtgtatat

SEQ ID NO: 3318796 - DNA, 15 bp, Homo sapiens
aaaaattgtctttat

SEQ ID NO: 3318797 - DNA, 18 bp, Homo sapiens
aaaaattgtttcttgaca

SEQ ID NO: 3318798 - DNA, 14 bp, Homo sapiens
aaaaatttaagcat

SEQ ID NO: 3318799 - DNA, 18 bp, Homo sapiens
aaaaatttaagcattgtt

SEQ ID NO: 3318800 - DNA, 21 bp, Homo sapiens
aaaaatttaagcattgtttgc

SEQ ID NO: 3318801 - DNA, 17 bp, Homo sapiens
aaaaatttgaacactgg

SEQ ID NO: 3318802 - DNA, 23 bp, Homo sapiens
aaaaatttgtctgaaacatttca

SEQ ID NO: 3318803 - DNA, 11 bp, Homo sapiens
aaaacaaaaag

SEQ ID NO: 3318804 - DNA, 15 bp, Homo sapiens
aaaacaaaatctaaa

SEQ ID NO: 3318805 - DNA, 22 bp, Homo sapiens
aaaacaaaatttgactaatttt

SEQ ID NO: 3318806 - DNA, 15 bp, Homo sapiens
aaaacaaaattttat

SEQ ID NO: 3318807 - DNA, 12 bp, Homo sapiens
aaaacaaacatg

SEQ ID NO: 3318808 - DNA, 19 bp, Homo sapiens
aaaacaatcatttgctttt

SEQ ID NO: 3318809 - DNA, 19 bp, Homo sapiens
aaaacaatctggaagaaaa

SEQ ID NO: 3318810 - DNA, 16 bp, Homo sapiens
aaaacaatttcttttt

SEQ ID NO: 3318811 - DNA, 19 bp, Homo sapiens
aaaacacactactacctct

SEQ ID NO: 3318812 - DNA, 21 bp, Homo sapiens
aaaacaccgcttctgcctttt

SEQ ID NO: 3318813 - DNA, 20 bp, Homo sapiens
aaaacacgcacaccctgccc

SEQ ID NO: 3318814 - DNA, 21 bp, Homo sapiens
aaaacactaaaaataaaaatg

SEQ ID NO: 3318815 - DNA, 18 bp, Homo sapiens
aaaacactacttttgctt

SEQ ID NO: 3318816 - DNA, 14 bp, Homo sapiens
aaaacactagtttt

SEQ ID NO: 3318817 - DNA, 19 bp, Homo sapiens
aaaacactcaacaaactta

SEQ ID NO: 3318818 - DNA, 20 bp, Homo sapiens
aaaacactgaaaaattatac

SEQ ID NO: 3318819 - DNA, 15 bp, Homo sapiens
aaaacactgccctct

SEQ ID NO: 3318820 - DNA, 23 bp, Homo sapiens
aaaacactgtggaactaataaat

SEQ ID NO: 3318821 - DNA, 20 bp, Homo sapiens
aaaacagcattgctttctga

SEQ ID NO: 3318822 - DNA, 23 bp, Homo sapiens
aaaacagctgtctctaacttatt

SEQ ID NO: 3318823 - DNA, 19 bp, Homo sapiens
aaaacagtggatcacaaag

SEQ ID NO: 3318824 - DNA, 17 bp, Homo sapiens
aaaacataatcttctgc

SEQ ID NO: 3318825 - DNA, 20 bp, Homo sapiens
aaaacataatcttctgcctt

SEQ ID NO: 3318826 - DNA, 18 bp, Homo sapiens
aaaacatagctggttaac

SEQ ID NO: 3318827 - DNA, 18 bp, Homo sapiens
aaaacatattcaaagcag

SEQ ID NO: 3318828 - DNA, 13 bp, Homo sapiens
aaaacatatttca

SEQ ID NO: 3318829 - DNA, 14 bp, Homo sapiens
aaaacatatttcat

SEQ ID NO: 3318830 - DNA, 15 bp, Homo sapiens
aaaacatgagttatt

SEQ ID NO: 3318831 - DNA, 14 bp, Homo sapiens
aaaacatggtagaa

SEQ ID NO: 3318832 - DNA, 16 bp, Homo sapiens
aaaacatggtagaatt

SEQ ID NO: 3318833 - DNA, 13 bp, Homo sapiens
aaaacatgtatgt

SEQ ID NO: 3318834 - DNA, 13 bp, Homo sapiens
aaaacatgttgaa

SEQ ID NO: 3318835 - DNA, 14 bp, Homo sapiens
aaaacattccaaga

SEQ ID NO: 3318836 - DNA, 12 bp, Homo sapiens
aaaacatttgct

SEQ ID NO: 3318837 - DNA, 23 bp, Homo sapiens
aaaacatttttaatttaacaaac

SEQ ID NO: 3318838 - DNA, 13 bp, Homo sapiens
aaaaccaaagagg

SEQ ID NO: 3318839 - DNA, 21 bp, Homo sapiens
aaaaccacaaaggccaaactg

SEQ ID NO: 3318840 - DNA, 15 bp, Homo sapiens
aaaaccacacaaaga

SEQ ID NO: 3318841 - DNA, 15 bp, Homo sapiens
aaaaccatctctctt

SEQ ID NO: 3318842 - DNA, 22 bp, Homo sapiens
aaaacccaaatggctagaacgt

SEQ ID NO: 3318843 - DNA, 18 bp, Homo sapiens
aaaaccctgctttttgac

SEQ ID NO: 3318844 - DNA, 18 bp, Homo sapiens
aaaaccgttcaaattctc

SEQ ID NO: 3318845 - DNA, 22 bp, Homo sapiens
aaaacctgggtatgttcctaag

SEQ ID NO: 3318846 - DNA, 14 bp, Homo sapiens
aaaacctgtcaatg

SEQ ID NO: 3318847 - DNA, 16 bp, Homo sapiens
aaaaccttgttctatt

SEQ ID NO: 3318848 - DNA, 20 bp, Homo sapiens
aaaacctttcaaatttcaca

SEQ ID NO: 3318849 - DNA, 20 bp, Homo sapiens
aaaacgaaaataaagtagct

SEQ ID NO: 3318850 - DNA, 18 bp, Homo sapiens
aaaactaaatctctaata

SEQ ID NO: 3318851 - DNA, 14 bp, Homo sapiens
aaaactaaatttca

SEQ ID NO: 3318852 - DNA, 15 bp, Homo sapiens
aaaactaagcacaaa

SEQ ID NO: 3318853 - DNA, 14 bp, Homo sapiens
aaaactaatttcat

SEQ ID NO: 3318854 - DNA, 17 bp, Homo sapiens
aaaactccaccttccca

SEQ ID NO: 3318855 - DNA, 20 bp, Homo sapiens
aaaactccgcccccagccta

SEQ ID NO: 3318856 - DNA, 13 bp, Homo sapiens
aaaactcgctttt

SEQ ID NO: 3318857 - DNA, 14 bp, Homo sapiens
aaaactcgctttta

SEQ ID NO: 3318858 - DNA, 19 bp, Homo sapiens
aaaactctacttaatccaa

SEQ ID NO: 3318859 - DNA, 13 bp, Homo sapiens
aaaactcttcagt

SEQ ID NO: 3318860 - DNA, 19 bp, Homo sapiens
aaaactgaaaatctaatat

SEQ ID NO: 3318861 - DNA, 18 bp, Homo sapiens
aaaactgcacagtgctgt

SEQ ID NO: 3318862 - DNA, 17 bp, Homo sapiens
aaaactgtacatttaaa

SEQ ID NO: 3318863 - DNA, 17 bp, Homo sapiens
aaaactgtgttgccaca

SEQ ID NO: 3318864 - DNA, 18 bp, Homo sapiens
aaaacttagacccatgct

SEQ ID NO: 3318865 - DNA, 17 bp, Homo sapiens
aaaacttcaaaaactaa

SEQ ID NO: 3318866 - DNA, 14 bp, Homo sapiens
aaaacttcaaagct

SEQ ID NO: 3318867 - DNA, 10 bp, Homo sapiens
aaaacttctt

SEQ ID NO: 3318868 - DNA, 12 bp, Homo sapiens
aaaacttctttt

SEQ ID NO: 3318869 - DNA, 13 bp, Homo sapiens
aaaacttggcact

SEQ ID NO: 3318870 - DNA, 24 bp, Homo sapiens
aaaactttgacgagtcaccttcca

SEQ ID NO: 3318871 - DNA, 11 bp, Homo sapiens
aaaactttgga

SEQ ID NO: 3318872 - DNA, 13 bp, Homo sapiens
aaaagaaaaacca

SEQ ID NO: 3318873 - DNA, 21 bp, Homo sapiens
aaaagaaaaaccactcccagt

SEQ ID NO: 3318874 - DNA, 11 bp, Homo sapiens
aaaagaaaatg

SEQ ID NO: 3318875 - DNA, 17 bp, Homo sapiens
aaaagaacactagagtc

SEQ ID NO: 3318876 - DNA, 13 bp, Homo sapiens
aaaagaagactgg

SEQ ID NO: 3318877 - DNA, 14 bp, Homo sapiens
aaaagaaggaaaga

SEQ ID NO: 3318878 - DNA, 20 bp, Homo sapiens
aaaagaagttactttgtaat

SEQ ID NO: 3318879 - DNA, 21 bp, Homo sapiens
aaaagaatctgcatttagcac

SEQ ID NO: 3318880 - DNA, 11 bp, Homo sapiens
aaaagagaaac

SEQ ID NO: 3318881 - DNA, 16 bp, Homo sapiens
aaaagagcatggatgc

SEQ ID NO: 3318882 - DNA, 20 bp, Homo sapiens
aaaagaggtttaagtttgtt

SEQ ID NO: 3318883 - DNA, 22 bp, Homo sapiens
aaaagataaagaccagaaattc

SEQ ID NO: 3318884 - DNA, 13 bp, Homo sapiens
aaaagataaagat

SEQ ID NO: 3318885 - DNA, 20 bp, Homo sapiens
aaaagatacgactttatttt

SEQ ID NO: 3318886 - DNA, 23 bp, Homo sapiens
aaaagatctgttttgaaggcaaa

SEQ ID NO: 3318887 - DNA, 18 bp, Homo sapiens
aaaagatggcctttgctt

SEQ ID NO: 3318888 - DNA, 13 bp, Homo sapiens
aaaagattagcaa

SEQ ID NO: 3318889 - DNA, 13 bp, Homo sapiens
aaaagattctgaa

SEQ ID NO: 3318890 - DNA, 23 bp, Homo sapiens
aaaagattctgaaaccacagttt

SEQ ID NO: 3318891 - DNA, 18 bp, Homo sapiens
aaaagattctttttctga

SEQ ID NO: 3318892 - DNA, 21 bp, Homo sapiens
aaaagattgaagtattttgct

SEQ ID NO: 3318893 - DNA, 18 bp, Homo sapiens
aaaagattgctgaaattt

SEQ ID NO: 3318894 - DNA, 21 bp, Homo sapiens
aaaagattgctgaaattttat

SEQ ID NO: 3318895 - DNA, 13 bp, Homo sapiens
aaaagatttaagc

SEQ ID NO: 3318896 - DNA, 15 bp, Homo sapiens
aaaagattttaatca

SEQ ID NO: 3318897 - DNA, 21 bp, Homo sapiens
aaaagattttcagaaaatatt

SEQ ID NO: 3318898 - DNA, 14 bp, Homo sapiens
aaaagcaaatgaga

SEQ ID NO: 3318899 - DNA, 12 bp, Homo sapiens
aaaagcaagact

SEQ ID NO: 3318900 - DNA, 19 bp, Homo sapiens
aaaagcacaagtacttttg

SEQ ID NO: 3318901 - DNA, 16 bp, Homo sapiens
aaaagcacatacatta

SEQ ID NO: 3318902 - DNA, 22 bp, Homo sapiens
aaaagcacatacattaaaacta

SEQ ID NO: 3318903 - DNA, 11 bp, Homo sapiens
aaaagcacctc

SEQ ID NO: 3318904 - DNA, 18 bp, Homo sapiens
aaaagcacttactttttt

SEQ ID NO: 3318905 - DNA, 13 bp, Homo sapiens
aaaagcacttttg

SEQ ID NO: 3318906 - DNA, 14 bp, Homo sapiens
aaaagcacttttgt

SEQ ID NO: 3318907 - DNA, 19 bp, Homo sapiens
aaaagcacttttgttattc

SEQ ID NO: 3318908 - DNA, 21 bp, Homo sapiens
aaaagcacttttgttattcca

SEQ ID NO: 3318909 - DNA, 18 bp, Homo sapiens
aaaagcagagtggactgc

SEQ ID NO: 3318910 - DNA, 19 bp, Homo sapiens
aaaagcaggcctttgcaga

SEQ ID NO: 3318911 - DNA, 19 bp, Homo sapiens
aaaagcatgatgggaaaat

SEQ ID NO: 3318912 - DNA, 22 bp, Homo sapiens
aaaagccagccaagctttaaat

SEQ ID NO: 3318913 - DNA, 17 bp, Homo sapiens
aaaagccataacttgaa

SEQ ID NO: 3318914 - DNA, 14 bp, Homo sapiens
aaaagccatgtata

SEQ ID NO: 3318915 - DNA, 22 bp, Homo sapiens
aaaagccgaaagggttaatcat

SEQ ID NO: 3318916 - DNA, 14 bp, Homo sapiens
aaaagccttgtgta

SEQ ID NO: 3318917 - DNA, 17 bp, Homo sapiens
aaaagccttgtgtatat

SEQ ID NO: 3318918 - DNA, 18 bp, Homo sapiens
aaaagccttgtgtatatt

SEQ ID NO: 3318919 - DNA, 22 bp, Homo sapiens
aaaagcggaaagttagtgcttg

SEQ ID NO: 3318920 - DNA, 21 bp, Homo sapiens
aaaagcgtctttaagagactc

SEQ ID NO: 3318921 - DNA, 15 bp, Homo sapiens
aaaagctataaagta

SEQ ID NO: 3318922 - DNA, 13 bp, Homo sapiens
aaaagctcactgc

SEQ ID NO: 3318923 - DNA, 13 bp, Homo sapiens
aaaagctcctgtc

SEQ ID NO: 3318924 - DNA, 21 bp, Homo sapiens
aaaagctgtaaattactatgg

SEQ ID NO: 3318925 - DNA, 20 bp, Homo sapiens
aaaagcttcttaattaattt

SEQ ID NO: 3318926 - DNA, 21 bp, Homo sapiens
aaaagcttcttaattaatttg

SEQ ID NO: 3318927 - DNA, 13 bp, Homo sapiens
aaaagctttcatg

SEQ ID NO: 3318928 - DNA, 11 bp, Homo sapiens
aaaaggaaaaa

SEQ ID NO: 3318929 - DNA, 13 bp, Homo sapiens
aaaaggaaaaaaa

SEQ ID NO: 3318930 - DNA, 21 bp, Homo sapiens
aaaaggaaacttcagttgatc

SEQ ID NO: 3318931 - DNA, 12 bp, Homo sapiens
aaaaggaaattt

SEQ ID NO: 3318932 - DNA, 19 bp, Homo sapiens
aaaaggaacaaaaattaca

SEQ ID NO: 3318933 - DNA, 16 bp, Homo sapiens
aaaaggaacaaataaa

SEQ ID NO: 3318934 - DNA, 16 bp, Homo sapiens
aaaaggatagtatttt

SEQ ID NO: 3318935 - DNA, 17 bp, Homo sapiens
aaaaggatagtattttt

SEQ ID NO: 3318936 - DNA, 22 bp, Homo sapiens
aaaaggatagtatttttatcca

SEQ ID NO: 3318937 - DNA, 17 bp, Homo sapiens
aaaaggccaaagataaa

SEQ ID NO: 3318938 - DNA, 18 bp, Homo sapiens
aaaaggccagtggaaatt

SEQ ID NO: 3318939 - DNA, 17 bp, Homo sapiens
aaaaggctgagaaggaa

SEQ ID NO: 3318940 - DNA, 14 bp, Homo sapiens
aaaagggagttttt

SEQ ID NO: 3318941 - DNA, 15 bp, Homo sapiens
aaaaggtattaaatt

SEQ ID NO: 3318942 - DNA, 16 bp, Homo sapiens
aaaaggttaataaagt

SEQ ID NO: 3318943 - DNA, 13 bp, Homo sapiens
aaaaggttgaata

SEQ ID NO: 3318944 - DNA, 22 bp, Homo sapiens
aaaaggtttctttttttttcct

SEQ ID NO: 3318945 - DNA, 23 bp, Homo sapiens
aaaaggtttctttttttttcctt

SEQ ID NO: 3318946 - DNA, 13 bp, Homo sapiens
aaaagtaaaatgt

SEQ ID NO: 3318947 - DNA, 17 bp, Homo sapiens
aaaagtaatctttaaac

SEQ ID NO: 3318948 - DNA, 15 bp, Homo sapiens
aaaagtaattttgtc

SEQ ID NO: 3318949 - DNA, 21 bp, Homo sapiens
aaaagtaattttgtcacatta

SEQ ID NO: 3318950 - DNA, 23 bp, Homo sapiens
aaaagtaattttgtcacattatt

SEQ ID NO: 3318951 - DNA, 17 bp, Homo sapiens
aaaagtacatttaatac

SEQ ID NO: 3318952 - DNA, 14 bp, Homo sapiens
aaaagtactttaaa

SEQ ID NO: 3318953 - DNA, 14 bp, Homo sapiens
aaaagtcataaatg

SEQ ID NO: 3318954 - DNA, 15 bp, Homo sapiens
aaaagtcgttttcca

SEQ ID NO: 3318955 - DNA, 13 bp, Homo sapiens
aaaagtctctatt

SEQ ID NO: 3318956 - DNA, 23 bp, Homo sapiens
aaaagtctctatttaaattcttt

SEQ ID NO: 3318957 - DNA, 13 bp, Homo sapiens
aaaagtgcatgat

SEQ ID NO: 3318958 - DNA, 16 bp, Homo sapiens
aaaagtgtatagaata

SEQ ID NO: 3318959 - DNA, 13 bp, Homo sapiens
aaaagtgtccttc

SEQ ID NO: 3318960 - DNA, 20 bp, Homo sapiens
aaaagtgtgtatatattttg

SEQ ID NO: 3318961 - DNA, 19 bp, Homo sapiens
aaaagttaataacagctcc

SEQ ID NO: 3318962 - DNA, 13 bp, Homo sapiens
aaaagttatttat

SEQ ID NO: 3318963 - DNA, 22 bp, Homo sapiens
aaaagttcataacagtgccatt

SEQ ID NO: 3318964 - DNA, 16 bp, Homo sapiens
aaaagttccatagaaa

SEQ ID NO: 3318965 - DNA, 23 bp, Homo sapiens
aaaagttggactaaatgcctagt

SEQ ID NO: 3318966 - DNA, 12 bp, Homo sapiens
aaaagttgttca

SEQ ID NO: 3318967 - DNA, 13 bp, Homo sapiens
aaaagttgttcaa

SEQ ID NO: 3318968 - DNA, 23 bp, Homo sapiens
aaaagtttacaacataatctagt

SEQ ID NO: 3318969 - DNA, 16 bp, Homo sapiens
aaaagtttacaagtgt

SEQ ID NO: 3318970 - DNA, 13 bp, Homo sapiens
aaaagtttcaatg

SEQ ID NO: 3318971 - DNA, 19 bp, Homo sapiens
aaaagttttgatatttatt

SEQ ID NO: 3318972 - DNA, 19 bp, Homo sapiens
aaaataaaaaatctgaaga

SEQ ID NO: 3318973 - DNA, 20 bp, Homo sapiens
aaaataaaaagatcactttc

SEQ ID NO: 3318974 - DNA, 17 bp, Homo sapiens
aaaataaaaagtgacac

SEQ ID NO: 3318975 - DNA, 22 bp, Homo sapiens
aaaataaaaagtgacacagcag

SEQ ID NO: 3318976 - DNA, 14 bp, Homo sapiens
aaaataaaacatgt

SEQ ID NO: 3318977 - DNA, 12 bp, Homo sapiens
aaaataaaactg

SEQ ID NO: 3318978 - DNA, 20 bp, Homo sapiens
aaaataaaacttcacattta

SEQ ID NO: 3318979 - DNA, 14 bp, Homo sapiens
aaaataaacaaata

SEQ ID NO: 3318980 - DNA, 14 bp, Homo sapiens
aaaataaaccaaat

SEQ ID NO: 3318981 - DNA, 18 bp, Homo sapiens
aaaataaaggataactct

SEQ ID NO: 3318982 - DNA, 20 bp, Homo sapiens
aaaataaataaaaactaatt

SEQ ID NO: 3318983 - DNA, 13 bp, Homo sapiens
aaaataacagtat

SEQ ID NO: 3318984 - DNA, 15 bp, Homo sapiens
aaaataactgaattt

SEQ ID NO: 3318985 - DNA, 16 bp, Homo sapiens
aaaataacttcaagca

SEQ ID NO: 3318986 - DNA, 13 bp, Homo sapiens
aaaataagtcaaa

SEQ ID NO: 3318987 - DNA, 13 bp, Homo sapiens
aaaataataataa

SEQ ID NO: 3318988 - DNA, 12 bp, Homo sapiens
aaaataataatt

SEQ ID NO: 3318989 - DNA, 22 bp, Homo sapiens
aaaataataatttttatattta

SEQ ID NO: 3318990 - DNA, 23 bp, Homo sapiens
aaaataatattaatttatttaat

SEQ ID NO: 3318991 - DNA, 16 bp, Homo sapiens
aaaataatcaagattt

SEQ ID NO: 3318992 - DNA, 16 bp, Homo sapiens
aaaataattaaataaa

SEQ ID NO: 3318993 - DNA, 20 bp, Homo sapiens
aaaataattaaataaatgaa

SEQ ID NO: 3318994 - DNA, 14 bp, Homo sapiens
aaaataattattta

SEQ ID NO: 3318995 - DNA, 22 bp, Homo sapiens
aaaataattgatttcaagacct

SEQ ID NO: 3318996 - DNA, 19 bp, Homo sapiens
aaaataattttaaacaaag

SEQ ID NO: 3318997 - DNA, 17 bp, Homo sapiens
aaaatacaatcctgttt

SEQ ID NO: 3318998 - DNA, 16 bp, Homo sapiens
aaaatacaatttttat

SEQ ID NO: 3318999 - DNA, 15 bp, Homo sapiens
aaaatacagtattct

SEQ ID NO: 3319000 - DNA, 12 bp, Homo sapiens
aaaatacattta

SEQ ID NO: 3319001 - DNA, 15 bp, Homo sapiens
aaaataccagagcct

SEQ ID NO: 3319002 - DNA, 19 bp, Homo sapiens
aaaatacctaattgtggat

SEQ ID NO: 3319003 - DNA, 14 bp, Homo sapiens
aaaatactctgcta

SEQ ID NO: 3319004 - DNA, 13 bp, Homo sapiens
aagcaacatggct

SEQ ID NO: 3319005 - DNA, 15 bp, Homo sapiens
aagcaacatggcttt

SEQ ID NO: 3319006 - DNA, 14 bp, Homo sapiens
aagcaactgttatg

SEQ ID NO: 3319007 - DNA, 13 bp, Homo sapiens
aagcaagaaacag

SEQ ID NO: 3319008 - DNA, 15 bp, Homo sapiens
aagcaagacacgtgg

SEQ ID NO: 3319009 - DNA, 16 bp, Homo sapiens
aagcaagggctccagc

SEQ ID NO: 3319010 - DNA, 19 bp, Homo sapiens
aagcaagttcgtctgttgt

SEQ ID NO: 3319011 - DNA, 14 bp, Homo sapiens
aagcaataaatgaa

SEQ ID NO: 3319012 - DNA, 17 bp, Homo sapiens
aagcaataattgtttcc

SEQ ID NO: 3319013 - DNA, 14 bp, Homo sapiens
aagcaatactgttt

SEQ ID NO: 3319014 - DNA, 17 bp, Homo sapiens
aagcaatactgtttcca

SEQ ID NO: 3319015 - DNA, 14 bp, Homo sapiens
aagcaatattgtat

SEQ ID NO: 3319016 - DNA, 17 bp, Homo sapiens
aagcaatattgtatatt

SEQ ID NO: 3319017 - DNA, 13 bp, Homo sapiens
aagcaatgtgttt

SEQ ID NO: 3319018 - DNA, 17 bp, Homo sapiens
aagcaattgctcatgtt

SEQ ID NO: 3319019 - DNA, 14 bp, Homo sapiens
aagcacaactccct

SEQ ID NO: 3319020 - DNA, 13 bp, Homo sapiens
aagcacaagaagc

SEQ ID NO: 3319021 - DNA, 20 bp, Homo sapiens
aagcacaatcactaaacttt

SEQ ID NO: 3319022 - DNA, 23 bp, Homo sapiens
aagcacaatcactaaactttatt

SEQ ID NO: 3319023 - DNA, 14 bp, Homo sapiens
aagcacaggagaca

SEQ ID NO: 3319024 - DNA, 16 bp, Homo sapiens
aagcacatacattaaa

SEQ ID NO: 3319025 - DNA, 19 bp, Homo sapiens
aagcacatacattaaaact

SEQ ID NO: 3319026 - DNA, 20 bp, Homo sapiens
aagcacatacattaaaacta

SEQ ID NO: 3319027 - DNA, 21 bp, Homo sapiens
aagcacatacattaaaactag

SEQ ID NO: 3319028 - DNA, 13 bp, Homo sapiens
aagcacatgtaat

SEQ ID NO: 3319029 - DNA, 19 bp, Homo sapiens
aagcaccgcctccaaatgc

SEQ ID NO: 3319030 - DNA, 15 bp, Homo sapiens
aagcacctcctgcct

SEQ ID NO: 3319031 - DNA, 16 bp, Homo sapiens
aagcacctcctgcctc

SEQ ID NO: 3319032 - DNA, 17 bp, Homo sapiens
aagcacctcctgcctcg

SEQ ID NO: 3319033 - DNA, 21 bp, Homo sapiens
aagcactaaaaagttgaacca

SEQ ID NO: 3319034 - DNA, 14 bp, Homo sapiens
aagcactaagaggt

SEQ ID NO: 3319035 - DNA, 19 bp, Homo sapiens
aagcactacaccttgcctt

SEQ ID NO: 3319036 - DNA, 19 bp, Homo sapiens
aagcactattttatattta

SEQ ID NO: 3319037 - DNA, 21 bp, Homo sapiens
aagcactattttatatttaaa

SEQ ID NO: 3319038 - DNA, 23 bp, Homo sapiens
aagcactcctgcttaatcttcaa

SEQ ID NO: 3319039 - DNA, 14 bp, Homo sapiens
aagcactttgcact

SEQ ID NO: 3319040 - DNA, 19 bp, Homo sapiens
aagcacttttgttattcca

SEQ ID NO: 3319041 - DNA, 22 bp, Homo sapiens
aagcacttttgttattccatca

SEQ ID NO: 3319042 - DNA, 18 bp, Homo sapiens
aagcactttttggctgac

SEQ ID NO: 3319043 - DNA, 20 bp, Homo sapiens
aagcagaaaataaaggaagc

SEQ ID NO: 3319044 - DNA, 16 bp, Homo sapiens
aagcagaattttaatg

SEQ ID NO: 3319045 - DNA, 21 bp, Homo sapiens
aagcagaattttaatgtgaag

SEQ ID NO: 3319046 - DNA, 19 bp, Homo sapiens
aagcagagagtccaattta

SEQ ID NO: 3319047 - DNA, 17 bp, Homo sapiens
aagcagagtgcacagct

SEQ ID NO: 3319048 - DNA, 15 bp, Homo sapiens
aagcagagtggactg

SEQ ID NO: 3319049 - DNA, 21 bp, Homo sapiens
aagcagagtggactgcattta

SEQ ID NO: 3319050 - DNA, 14 bp, Homo sapiens
aagcagagttttca

SEQ ID NO: 3319051 - DNA, 15 bp, Homo sapiens
aagcagcatggaaaa

SEQ ID NO: 3319052 - DNA, 19 bp, Homo sapiens
aagcagcatggaaaaatgg

SEQ ID NO: 3319053 - DNA, 12 bp, Homo sapiens
aagcagccagcc

SEQ ID NO: 3319054 - DNA, 13 bp, Homo sapiens
aagcagccagcca

SEQ ID NO: 3319055 - DNA, 17 bp, Homo sapiens
aagcagccagccagtct

SEQ ID NO: 3319056 - DNA, 15 bp, Homo sapiens
aagcagcccttgctt

SEQ ID NO: 3319057 - DNA, 11 bp, Homo sapiens
aagcagcctga

SEQ ID NO: 3319058 - DNA, 17 bp, Homo sapiens
aagcagccttaagctta

SEQ ID NO: 3319059 - DNA, 20 bp, Homo sapiens
aagcagcgggctaacgggag

SEQ ID NO: 3319060 - DNA, 19 bp, Homo sapiens
aagcagctgaagaaaaaat

SEQ ID NO: 3319061 - DNA, 15 bp, Homo sapiens
aagcagcttcttttg

SEQ ID NO: 3319062 - DNA, 16 bp, Homo sapiens
aagcagctttaaacaa

SEQ ID NO: 3319063 - DNA, 22 bp, Homo sapiens
aagcagctttttattccctgcc

SEQ ID NO: 3319064 - DNA, 22 bp, Homo sapiens
aagcaggacctagagccgggca

SEQ ID NO: 3319065 - DNA, 21 bp, Homo sapiens
aagcaggcttgcccagtacat

SEQ ID NO: 3319066 - DNA, 22 bp, Homo sapiens
aagcagggcagcagggaacaaa

SEQ ID NO: 3319067 - DNA, 22 bp, Homo sapiens
aagcaggggctacaagagggaa

SEQ ID NO: 3319068 - DNA, 18 bp, Homo sapiens
aagcagggtaccctttgg

SEQ ID NO: 3319069 - DNA, 17 bp, Homo sapiens
aagcaggtgctacaaca

SEQ ID NO: 3319070 - DNA, 14 bp, Homo sapiens
aagcaggtggatct

SEQ ID NO: 3319071 - DNA, 19 bp, Homo sapiens
aagcaggtggatctatttc

SEQ ID NO: 3319072 - DNA, 20 bp, Homo sapiens
aagcaggtgtcctttcccct

SEQ ID NO: 3319073 - DNA, 23 bp, Homo sapiens
aagcaggtgtcctttcccctctc

SEQ ID NO: 3319074 - DNA, 16 bp, Homo sapiens
aagcaggtttttctcc

SEQ ID NO: 3319075 - DNA, 20 bp, Homo sapiens
aagcagtagaaataatatgc

SEQ ID NO: 3319076 - DNA, 22 bp, Homo sapiens
aagcagtagaaataatatgcat

SEQ ID NO: 3319077 - DNA, 17 bp, Homo sapiens
aagcagtgcctcgaggc

SEQ ID NO: 3319078 - DNA, 15 bp, Homo sapiens
aagcagtgccttcca

SEQ ID NO: 3319079 - DNA, 18 bp, Homo sapiens
aagcagtgccttccataa

SEQ ID NO: 3319080 - DNA, 20 bp, Homo sapiens
aagcagtgccttccataatt

SEQ ID NO: 3319081 - DNA, 15 bp, Homo sapiens
aagcagttgtgtcag

SEQ ID NO: 3319082 - DNA, 17 bp, Homo sapiens
aagcataaaaacatttt

SEQ ID NO: 3319083 - DNA, 19 bp, Homo sapiens
aagcatcacctcaggccag

SEQ ID NO: 3319084 - DNA, 14 bp, Homo sapiens
aagcatccatgtgt

SEQ ID NO: 3319085 - DNA, 16 bp, Homo sapiens
aagcatcctccacatc

SEQ ID NO: 3319086 - DNA, 18 bp, Homo sapiens
aagcatctaagttataag

SEQ ID NO: 3319087 - DNA, 22 bp, Homo sapiens
aagcatgatgggaaaatatttc

SEQ ID NO: 3319088 - DNA, 13 bp, Homo sapiens
aagcatgtggcat

SEQ ID NO: 3319089 - DNA, 12 bp, Homo sapiens
aagcatgtttca

SEQ ID NO: 3319090 - DNA, 14 bp, Homo sapiens
aagcatgtttcatg

SEQ ID NO: 3319091 - DNA, 16 bp, Homo sapiens
aagcatgtttcatgtt

SEQ ID NO: 3319092 - DNA, 20 bp, Homo sapiens
aagcatgtttcatgttttgt

SEQ ID NO: 3319093 - DNA, 15 bp, Homo sapiens
aagcattcagagagc

SEQ ID NO: 3319094 - DNA, 13 bp, Homo sapiens
aagcattccttct

SEQ ID NO: 3319095 - DNA, 14 bp, Homo sapiens
aagcattccttctt

SEQ ID NO: 3319096 - DNA, 20 bp, Homo sapiens
aagcattccttctttgataa

SEQ ID NO: 3319097 - DNA, 21 bp, Homo sapiens
aagcattccttctttgataat

SEQ ID NO: 3319098 - DNA, 23 bp, Homo sapiens
aagcattccttctttgataatgt

SEQ ID NO: 3319099 - DNA, 13 bp, Homo sapiens
aagcattctttaa

SEQ ID NO: 3319100 - DNA, 13 bp, Homo sapiens
aagcattgtctct

SEQ ID NO: 3319101 - DNA, 20 bp, Homo sapiens
aagcattgtttgcttattgt

SEQ ID NO: 3319102 - DNA, 22 bp, Homo sapiens
aagcattgtttgcttattgttc

SEQ ID NO: 3319103 - DNA, 21 bp, Homo sapiens
aagcatttgtattttgtgtga

SEQ ID NO: 3319104 - DNA, 22 bp, Homo sapiens
aagccaaaaaccttagctccct

SEQ ID NO: 3319105 - DNA, 20 bp, Homo sapiens
aagccaaactctgccagcca

SEQ ID NO: 3319106 - DNA, 11 bp, Homo sapiens
aagccaaagaa

SEQ ID NO: 3319107 - DNA, 14 bp, Homo sapiens
aagccaaagaaaca

SEQ ID NO: 3319108 - DNA, 15 bp, Homo sapiens
aagccaaagaaacaa

SEQ ID NO: 3319109 - DNA, 23 bp, Homo sapiens
aagccaaagaaacaagctgtgca

SEQ ID NO: 3319110 - DNA, 13 bp, Homo sapiens
aagccaaatgaaa

SEQ ID NO: 3319111 - DNA, 16 bp, Homo sapiens
aagccaaatttatcaa

SEQ ID NO: 3319112 - DNA, 20 bp, Homo sapiens
aagccaaccttcaaagaaac

SEQ ID NO: 3319113 - DNA, 22 bp, Homo sapiens
aagccaaccttcaaagaaactt

SEQ ID NO: 3319114 - DNA, 17 bp, Homo sapiens
aagccaacttgtaaata

SEQ ID NO: 3319115 - DNA, 19 bp, Homo sapiens
aagccaagctccctggagc

SEQ ID NO: 3319116 - DNA, 13 bp, Homo sapiens
aagccaagtgggg

SEQ ID NO: 3319117 - DNA, 19 bp, Homo sapiens
aagccaatcccctccttgg

SEQ ID NO: 3319118 - DNA, 15 bp, Homo sapiens
aagccacaagaaatt

SEQ ID NO: 3319119 - DNA, 19 bp, Homo sapiens
aagccaccctaccatgaat

SEQ ID NO: 3319120 - DNA, 20 bp, Homo sapiens
aagccacctctccctcaaca

SEQ ID NO: 3319121 - DNA, 17 bp, Homo sapiens
aagccactagactcttc

SEQ ID NO: 3319122 - DNA, 13 bp, Homo sapiens
aagccactgaagc

SEQ ID NO: 3319123 - DNA, 14 bp, Homo sapiens
aagccactgaagct

SEQ ID NO: 3319124 - DNA, 18 bp, Homo sapiens
aagccacttgaaatgtta

SEQ ID NO: 3319125 - DNA, 14 bp, Homo sapiens
aagccagagcctgg

SEQ ID NO: 3319126 - DNA, 22 bp, Homo sapiens
aagccagccaagctttaaatta

SEQ ID NO: 3319127 - DNA, 13 bp, Homo sapiens
aagccagccacag

SEQ ID NO: 3319128 - DNA, 14 bp, Homo sapiens
aagccagctctagg

SEQ ID NO: 3319129 - DNA, 21 bp, Homo sapiens
aagccagctgcagctgggctg

SEQ ID NO: 3319130 - DNA, 14 bp, Homo sapiens
aagccagctttccc

SEQ ID NO: 3319131 - DNA, 21 bp, Homo sapiens
aagccaggcaggtagccaggg

SEQ ID NO: 3319132 - DNA, 19 bp, Homo sapiens
aagccaggtgagctctgac

SEQ ID NO: 3319133 - DNA, 23 bp, Homo sapiens
aagccaggtgtggtggtatgtgc

SEQ ID NO: 3319134 - DNA, 23 bp, Homo sapiens
aagccagttggatctctggttgt

SEQ ID NO: 3319135 - DNA, 17 bp, Homo sapiens
aagccataggcccagga

SEQ ID NO: 3319136 - DNA, 18 bp, Homo sapiens
aagccataggcccaggat

SEQ ID NO: 3319137 - DNA, 20 bp, Homo sapiens
aagccatcatatcccctgtg

SEQ ID NO: 3319138 - DNA, 22 bp, Homo sapiens
aagccattgtttccattacaaa

SEQ ID NO: 3319139 - DNA, 22 bp, Homo sapiens
aagcccaaatttaatttgcaac

SEQ ID NO: 3319140 - DNA, 17 bp, Homo sapiens
aagcccaacctcctgac

SEQ ID NO: 3319141 - DNA, 22 bp, Homo sapiens
aagcccaacctcctgacctgtc

SEQ ID NO: 3319142 - DNA, 11 bp, Homo sapiens
aagcccacact

SEQ ID NO: 3319143 - DNA, 23 bp, Homo sapiens
aagcccacagcacagctccctgc

SEQ ID NO: 3319144 - DNA, 14 bp, Homo sapiens
aagcccaggcccct

SEQ ID NO: 3319145 - DNA, 22 bp, Homo sapiens
aagcccatgagtccttgaaaat

SEQ ID NO: 3319146 - DNA, 16 bp, Homo sapiens
aagccccagcagccct

SEQ ID NO: 3319147 - DNA, 16 bp, Homo sapiens
aagccccatttcctca

SEQ ID NO: 3319148 - DNA, 12 bp, Homo sapiens
aagcccctcagc

SEQ ID NO: 3319149 - DNA, 13 bp, Homo sapiens
aagcccctcagcc

SEQ ID NO: 3319150 - DNA, 19 bp, Homo sapiens
aagcccctcagcccttgcc

SEQ ID NO: 3319151 - DNA, 20 bp, Homo sapiens
aagcccctcagcccttgccc

SEQ ID NO: 3319152 - DNA, 19 bp, Homo sapiens
aagcccgttagccccaggg

SEQ ID NO: 3319153 - DNA, 21 bp, Homo sapiens
aagccctcgaaccaaggcagc

SEQ ID NO: 3319154 - DNA, 18 bp, Homo sapiens
aagccctgaggcctgagg

SEQ ID NO: 3319155 - DNA, 23 bp, Homo sapiens
aagccctgattgtgtatattcat

SEQ ID NO: 3319156 - DNA, 16 bp, Homo sapiens
aagccctgcttttgca

SEQ ID NO: 3319157 - DNA, 13 bp, Homo sapiens
aagccctggagac

SEQ ID NO: 3319158 - DNA, 19 bp, Homo sapiens
aagccctggagccaactgc

SEQ ID NO: 3319159 - DNA, 18 bp, Homo sapiens
aagccctgtcgagacact

SEQ ID NO: 3319160 - DNA, 20 bp, Homo sapiens
aagcccttccatgtcgcctc

SEQ ID NO: 3319161 - DNA, 14 bp, Homo sapiens
aagccctttgccat

SEQ ID NO: 3319162 - DNA, 15 bp, Homo sapiens
aagccgaccttccct

SEQ ID NO: 3319163 - DNA, 16 bp, Homo sapiens
aagccgactctggccc

SEQ ID NO: 3319164 - DNA, 18 bp, Homo sapiens
aagccgactctggccctg

SEQ ID NO: 3319165 - DNA, 17 bp, Homo sapiens
aagccgagagccttttg

SEQ ID NO: 3319166 - DNA, 16 bp, Homo sapiens
aagccgtctgactcca

SEQ ID NO: 3319167 - DNA, 18 bp, Homo sapiens
aagccgtctgactccaga

SEQ ID NO: 3319168 - DNA, 14 bp, Homo sapiens
aagccgtggcttcc

SEQ ID NO: 3319169 - DNA, 21 bp, Homo sapiens
aagcctcaaggttttaggttc

SEQ ID NO: 3319170 - DNA, 19 bp, Homo sapiens
aagcctccaagggtttcga

SEQ ID NO: 3319171 - DNA, 15 bp, Homo sapiens
aagcctccacagcga

SEQ ID NO: 3319172 - DNA, 12 bp, Homo sapiens
aagcctctggct

SEQ ID NO: 3319173 - DNA, 12 bp, Homo sapiens
aagcctgagcct

SEQ ID NO: 3319174 - DNA, 22 bp, Homo sapiens
aagcctgcacaataaaaatgtt

SEQ ID NO: 3319175 - DNA, 14 bp, Homo sapiens
aagcctgcaggagt

SEQ ID NO: 3319176 - DNA, 10 bp, Homo sapiens
aagcctgccc

SEQ ID NO: 3319177 - DNA, 15 bp, Homo sapiens
aagcctgcccttgtc

SEQ ID NO: 3319178 - DNA, 17 bp, Homo sapiens
aagcctgcccttgtctg

SEQ ID NO: 3319179 - DNA, 15 bp, Homo sapiens
aagcctgcctcccaa

SEQ ID NO: 3319180 - DNA, 17 bp, Homo sapiens
aagcctgcctggaagag

SEQ ID NO: 3319181 - DNA, 21 bp, Homo sapiens
aagcctgctggctgcggcccc

SEQ ID NO: 3319182 - DNA, 14 bp, Homo sapiens
aagcctggactctg

SEQ ID NO: 3319183 - DNA, 18 bp, Homo sapiens
aagcctggactctgcccc

SEQ ID NO: 3319184 - DNA, 16 bp, Homo sapiens
aagcctgttcccctca

SEQ ID NO: 3319185 - DNA, 20 bp, Homo sapiens
aagcctgttcccctcactgg

SEQ ID NO: 3319186 - DNA, 13 bp, Homo sapiens
aagccttaaaaat

SEQ ID NO: 3319187 - DNA, 14 bp, Homo sapiens
aagccttaagccat

SEQ ID NO: 3319188 - DNA, 16 bp, Homo sapiens
aagccttatcaagtgt

SEQ ID NO: 3319189 - DNA, 22 bp, Homo sapiens
aagccttatcaagtgtcttcca

SEQ ID NO: 3319190 - DNA, 17 bp, Homo sapiens
aagccttcagctccagg

SEQ ID NO: 3319191 - DNA, 13 bp, Homo sapiens
aagccttctgcag

SEQ ID NO: 3319192 - DNA, 14 bp, Homo sapiens
aagccttctgcagc

SEQ ID NO: 3319193 - DNA, 19 bp, Homo sapiens
aagccttgtgtatatttgt

SEQ ID NO: 3319194 - DNA, 22 bp, Homo sapiens
aagccttgtgtatatttgtata

SEQ ID NO: 3319195 - DNA, 16 bp, Homo sapiens
aagccttgttttctct

SEQ ID NO: 3319196 - DNA, 22 bp, Homo sapiens
aagcgaagtctttgccttctct

SEQ ID NO: 3319197 - DNA, 21 bp, Homo sapiens
aagcgatatacagatgaaaat

SEQ ID NO: 3319198 - DNA, 21 bp, Homo sapiens
aagcgatgaatttggagactc

SEQ ID NO: 3319199 - DNA, 16 bp, Homo sapiens
aagcgattcttctgct

SEQ ID NO: 3319200 - DNA, 21 bp, Homo sapiens
aagcggaggttgcagggagcc

SEQ ID NO: 3319201 - DNA, 16 bp, Homo sapiens
aagcgtctttaagaga

SEQ ID NO: 3319202 - DNA, 21 bp, Homo sapiens
aagcgtctttaagagactcac

SEQ ID NO: 3319203 - DNA, 17 bp, Homo sapiens
aagcgtgagacgccacc

SEQ ID NO: 3319204 - DNA, 21 bp, Homo sapiens
aagcgtgcacaaggattgaaa

SEQ ID NO: 3319205 - DNA, 18 bp, Homo sapiens
aagcgttaagggcagagt

SEQ ID NO: 3319206 - DNA, 21 bp, Homo sapiens
aagctaaaatatataatatac

SEQ ID NO: 3319207 - DNA, 14 bp, Homo sapiens
aagctaatttgcat

SEQ ID NO: 3319208 - DNA, 15 bp, Homo sapiens
aagctaatttgcatt

SEQ ID NO: 3319209 - DNA, 19 bp, Homo sapiens
aagctactgtgtgtgtgaa

SEQ ID NO: 3319210 - DNA, 21 bp, Homo sapiens
aagctagacagatccccgttc

SEQ ID NO: 3319211 - DNA, 14 bp, Homo sapiens
aagctaggaatgaa

SEQ ID NO: 3319212 - DNA, 14 bp, Homo sapiens
aagctaggccccag

SEQ ID NO: 3319213 - DNA, 19 bp, Homo sapiens
aagctaggccccagaggcc

SEQ ID NO: 3319214 - DNA, 16 bp, Homo sapiens
aagctaggcctggcca

SEQ ID NO: 3319215 - DNA, 22 bp, Homo sapiens
aagctagggtggcccttgcagt

SEQ ID NO: 3319216 - DNA, 19 bp, Homo sapiens
aagctattagccaggatca

SEQ ID NO: 3319217 - DNA, 17 bp, Homo sapiens
aagctatttatctgtag

SEQ ID NO: 3319218 - DNA, 15 bp, Homo sapiens
aagctcactgctgat

SEQ ID NO: 3319219 - DNA, 23 bp, Homo sapiens
aagctcacttctgggcttcatct

SEQ ID NO: 3319220 - DNA, 20 bp, Homo sapiens
aagctcatattttgtatata

SEQ ID NO: 3319221 - DNA, 22 bp, Homo sapiens
aagctcatattttgtatatatc

SEQ ID NO: 3319222 - DNA, 22 bp, Homo sapiens
aagctcatgcatttcaagcagc

SEQ ID NO: 3319223 - DNA, 20 bp, Homo sapiens
aagctccatctccactccag

SEQ ID NO: 3319224 - DNA, 13 bp, Homo sapiens
aagctccctggag

SEQ ID NO: 3319225 - DNA, 18 bp, Homo sapiens
aagctccctggagccctg

SEQ ID NO: 3319226 - DNA, 19 bp, Homo sapiens
aagctccctggagccctgt

SEQ ID NO: 3319227 - DNA, 14 bp, Homo sapiens
aagctcctcctcgg

SEQ ID NO: 3319228 - DNA, 13 bp, Homo sapiens
aagctcctgtcct

SEQ ID NO: 3319229 - DNA, 15 bp, Homo sapiens
aagctcctgtcctcc

SEQ ID NO: 3319230 - DNA, 20 bp, Homo sapiens
aagctcctgtcctcccatcc

SEQ ID NO: 3319231 - DNA, 22 bp, Homo sapiens
aagctccttgagtaaaaaggtg

SEQ ID NO: 3319232 - DNA, 15 bp, Homo sapiens
aagctcgccccacct

SEQ ID NO: 3319233 - DNA, 15 bp, Homo sapiens
aagctctagaatctg

SEQ ID NO: 3319234 - DNA, 23 bp, Homo sapiens
aagctctcttgccgaggagccag

SEQ ID NO: 3319235 - DNA, 13 bp, Homo sapiens
aagctctgctcct

SEQ ID NO: 3319236 - DNA, 24 bp, Homo sapiens
aagctctggctgaaccctgtgctg

SEQ ID NO: 3319237 - DNA, 16 bp, Homo sapiens
aagctctttgaaacaa

SEQ ID NO: 3319238 - DNA, 12 bp, Homo sapiens
aagctgaaattt

SEQ ID NO: 3319239 - DNA, 13 bp, Homo sapiens
aagctgaaatttt

SEQ ID NO: 3319240 - DNA, 13 bp, Homo sapiens
aagctgaatattt

SEQ ID NO: 3319241 - DNA, 15 bp, Homo sapiens
aagctgagaagaatg

SEQ ID NO: 3319242 - DNA, 20 bp, Homo sapiens
aagctgagaagaatgaaaat

SEQ ID NO: 3319243 - DNA, 15 bp, Homo sapiens
aagctgagtttccta

SEQ ID NO: 3319244 - DNA, 22 bp, Homo sapiens
aagctgatcataagtgaattta

SEQ ID NO: 3319245 - DNA, 18 bp, Homo sapiens
aagctgattttttttaat

SEQ ID NO: 3319246 - DNA, 15 bp, Homo sapiens
aagctgcagagattt

SEQ ID NO: 3319247 - DNA, 13 bp, Homo sapiens
aagctgcagcttg

SEQ ID NO: 3319248 - DNA, 17 bp, Homo sapiens
aagctgcatttaaatca

SEQ ID NO: 3319249 - DNA, 11 bp, Homo sapiens
aagctgccagc

SEQ ID NO: 3319250 - DNA, 18 bp, Homo sapiens
aagctgccagcccagaac

SEQ ID NO: 3319251 - DNA, 18 bp, Homo sapiens
aagctgcccactgtttct

SEQ ID NO: 3319252 - DNA, 15 bp, Homo sapiens
aagctgcctctgggc

SEQ ID NO: 3319253 - DNA, 20 bp, Homo sapiens
aagctgcctggtatatccaa

SEQ ID NO: 3319254 - DNA, 14 bp, Homo sapiens
aagctgcctgtagt

SEQ ID NO: 3319255 - DNA, 15 bp, Homo sapiens
aagctgcctgtagtt

SEQ ID NO: 3319256 - DNA, 16 bp, Homo sapiens
aagctgcctgtagtta

SEQ ID NO: 3319257 - DNA, 19 bp, Homo sapiens
aagctgcttgtcctgggcc

SEQ ID NO: 3319258 - DNA, 15 bp, Homo sapiens
aagctggaacatttg

SEQ ID NO: 3319259 - DNA, 19 bp, Homo sapiens
aagctggacttctgtgggc

SEQ ID NO: 3319260 - DNA, 18 bp, Homo sapiens
aagctggaggctccagga

SEQ ID NO: 3319261 - DNA, 16 bp, Homo sapiens
aagctggcaacatgaa

SEQ ID NO: 3319262 - DNA, 12 bp, Homo sapiens
aagctggccctg

SEQ ID NO: 3319263 - DNA, 20 bp, Homo sapiens
aagctggccctgcctcctgg

SEQ ID NO: 3319264 - DNA, 22 bp, Homo sapiens
aagctggcctctaccacaaggg

SEQ ID NO: 3319265 - DNA, 13 bp, Homo sapiens
aagctggcctgag

SEQ ID NO: 3319266 - DNA, 16 bp, Homo sapiens
aagctgtaaattacta

SEQ ID NO: 3319267 - DNA, 17 bp, Homo sapiens
aagctgtccctgcaggg

SEQ ID NO: 3319268 - DNA, 20 bp, Homo sapiens
aagctgtccctgcagggcca

SEQ ID NO: 3319269 - DNA, 10 bp, Homo sapiens
aagctgtgca

SEQ ID NO: 3319270 - DNA, 13 bp, Homo sapiens
aagctgtggccag

SEQ ID NO: 3319271 - DNA, 21 bp, Homo sapiens
aagctgtgtctgcccaatgaa

SEQ ID NO: 3319272 - DNA, 16 bp, Homo sapiens
aagctgtgttgaaaca

SEQ ID NO: 3319273 - DNA, 21 bp, Homo sapiens
aagctgtgttgaaacagaaaa

SEQ ID NO: 3319274 - DNA, 14 bp, Homo sapiens
aagctgttaaactg

SEQ ID NO: 3319275 - DNA, 18 bp, Homo sapiens
aagctgttaaactgttag

SEQ ID NO: 3319276 - DNA, 12 bp, Homo sapiens
aagctgttgtac

SEQ ID NO: 3319277 - DNA, 13 bp, Homo sapiens
aagctgttgtaca

SEQ ID NO: 3319278 - DNA, 14 bp, Homo sapiens
aagctgttgtacat

SEQ ID NO: 3319279 - DNA, 22 bp, Homo sapiens
aagcttaaattgcttttgttgt

SEQ ID NO: 3319280 - DNA, 17 bp, Homo sapiens
aagcttaatagccctcc

SEQ ID NO: 3319281 - DNA, 11 bp, Homo sapiens
aagcttagaac

SEQ ID NO: 3319282 - DNA, 18 bp, Homo sapiens
aagcttcaaactgcatga

SEQ ID NO: 3319283 - DNA, 18 bp, Homo sapiens
aagcttcagttgcttgtc

SEQ ID NO: 3319284 - DNA, 17 bp, Homo sapiens
aagcttcgttagaatgt

SEQ ID NO: 3319285 - DNA, 14 bp, Homo sapiens
aagcttctaataaa

SEQ ID NO: 3319286 - DNA, 16 bp, Homo sapiens
aagcttctaataaatt

SEQ ID NO: 3319287 - DNA, 15 bp, Homo sapiens
aagcttgaaaagatt

SEQ ID NO: 3319288 - DNA, 17 bp, Homo sapiens
aagcttgactcccaagt

SEQ ID NO: 3319289 - DNA, 17 bp, Homo sapiens
aagcttgtcaaagatgc

SEQ ID NO: 3319290 - DNA, 19 bp, Homo sapiens
aagcttgtggccaatggaa

SEQ ID NO: 3319291 - DNA, 20 bp, Homo sapiens
aagcttgtggccaatggaac

SEQ ID NO: 3319292 - DNA, 15 bp, Homo sapiens
aagcttgttttccag

SEQ ID NO: 3319293 - DNA, 13 bp, Homo sapiens
aagctttaaatta

SEQ ID NO: 3319294 - DNA, 20 bp, Homo sapiens
aagctttatacgtgtagcta

SEQ ID NO: 3319295 - DNA, 12 bp, Homo sapiens
aagctttcctgc

SEQ ID NO: 3319296 - DNA, 16 bp, Homo sapiens
aagctttcctgcccca

SEQ ID NO: 3319297 - DNA, 22 bp, Homo sapiens
aagctttcctgccccaggcctg

SEQ ID NO: 3319298 - DNA, 17 bp, Homo sapiens
aagctttcctgtttcca

SEQ ID NO: 3319299 - DNA, 16 bp, Homo sapiens
aagctttgatttagat

SEQ ID NO: 3319300 - DNA, 22 bp, Homo sapiens
aagctttgatttagattgagta

SEQ ID NO: 3319301 - DNA, 13 bp, Homo sapiens
aagcttttagaaa

SEQ ID NO: 3319302 - DNA, 17 bp, Homo sapiens
aagcttttgtctgtagg

SEQ ID NO: 3319303 - DNA, 12 bp, Homo sapiens
aagctttttgga

SEQ ID NO: 3319304 - DNA, 14 bp, Homo sapiens
aagctttttggaat

SEQ ID NO: 3319305 - DNA, 21 bp, Homo sapiens
aagctttttttcttgctagta

SEQ ID NO: 3319306 - DNA, 16 bp, Homo sapiens
aaggaaaaacacaagc

SEQ ID NO: 3319307 - DNA, 20 bp, Homo sapiens
aaggaaaaacacaagcaaaa

SEQ ID NO: 3319308 - DNA, 16 bp, Homo sapiens
aaggaaaaagcacaag

SEQ ID NO: 3319309 - DNA, 19 bp, Homo sapiens
aaggaaaaagcacaagaag

SEQ ID NO: 3319310 - DNA, 16 bp, Homo sapiens
aaggaaaaataatcaa

SEQ ID NO: 3319311 - DNA, 20 bp, Homo sapiens
aaggaaaacgtgaacaaact

SEQ ID NO: 3319312 - DNA, 22 bp, Homo sapiens
aaggaaaactatgtattaattt

SEQ ID NO: 3319313 - DNA, 20 bp, Homo sapiens
aaggaaaagaaaacaaaaaa

SEQ ID NO: 3319314 - DNA, 19 bp, Homo sapiens
aaggaaaagcaagaaacag

SEQ ID NO: 3319315 - DNA, 21 bp, Homo sapiens
aaggaaactagacaagtaaaa

SEQ ID NO: 3319316 - DNA, 12 bp, Homo sapiens
aaggaaactctt

SEQ ID NO: 3319317 - DNA, 19 bp, Homo sapiens
aaggaaactcttatctcag

SEQ ID NO: 3319318 - DNA, 20 bp, Homo sapiens
aaggaaacttcagttgatct

SEQ ID NO: 3319319 - DNA, 20 bp, Homo sapiens
aaggaaagcaataaatgaat

SEQ ID NO: 3319320 - DNA, 19 bp, Homo sapiens
aaggaaagtcaagaagaat

SEQ ID NO: 3319321 - DNA, 23 bp, Homo sapiens
aaggaacaaaaaaaccacaaagg

SEQ ID NO: 3319322 - DNA, 18 bp, Homo sapiens
aaggaacaaaaattacaa

SEQ ID NO: 3319323 - DNA, 18 bp, Homo sapiens
aaggaacacgtttttaca

SEQ ID NO: 3319324 - DNA, 17 bp, Homo sapiens
aaggaacagcaatggtg

SEQ ID NO: 3319325 - DNA, 23 bp, Homo sapiens
aaggaaccttccttcctgcttga

SEQ ID NO: 3319326 - DNA, 16 bp, Homo sapiens
aaggaagctccactgt

SEQ ID NO: 3319327 - DNA, 18 bp, Homo sapiens
aaggaagctccactgtca

SEQ ID NO: 3319328 - DNA, 15 bp, Homo sapiens
aaggaagctccagat

SEQ ID NO: 3319329 - DNA, 12 bp, Homo sapiens
aaggaaggaaaa

SEQ ID NO: 3319330 - DNA, 23 bp, Homo sapiens
aaggaagggcagagaatggctgg

SEQ ID NO: 3319331 - DNA, 13 bp, Homo sapiens
aaggaataaatga

SEQ ID NO: 3319332 - DNA, 18 bp, Homo sapiens
aaggaatagccagagagg

SEQ ID NO: 3319333 - DNA, 17 bp, Homo sapiens
aaggaatttcttaactt

SEQ ID NO: 3319334 - DNA, 23 bp, Homo sapiens
aaggaatttcttaacttcttgct

SEQ ID NO: 3319335 - DNA, 18 bp, Homo sapiens
aaggacattgcggacagc

SEQ ID NO: 3319336 - DNA, 16 bp, Homo sapiens
aaggaccacattttat

SEQ ID NO: 3319337 - DNA, 20 bp, Homo sapiens
aaggaccagcccttgaggga

SEQ ID NO: 3319338 - DNA, 12 bp, Homo sapiens
aaggaccaggac

SEQ ID NO: 3319339 - DNA, 19 bp, Homo sapiens
aaggacctgaaattccaaa

SEQ ID NO: 3319340 - DNA, 21 bp, Homo sapiens
aaggacggccttcaactgaaa

SEQ ID NO: 3319341 - DNA, 17 bp, Homo sapiens
aaggactaacataaaat

SEQ ID NO: 3319342 - DNA, 22 bp, Homo sapiens
aaggactagatactactttctc

SEQ ID NO: 3319343 - DNA, 18 bp, Homo sapiens
aaggactggattggccaa

SEQ ID NO: 3319344 - DNA, 13 bp, Homo sapiens
aaggactgtggct

SEQ ID NO: 3319345 - DNA, 15 bp, Homo sapiens
aaggactgtggctgc

SEQ ID NO: 3319346 - DNA, 17 bp, Homo sapiens
aaggactgtggctgcag

SEQ ID NO: 3319347 - DNA, 14 bp, Homo sapiens
aaggacttccacat

SEQ ID NO: 3319348 - DNA, 16 bp, Homo sapiens
aaggacttctgcagct

SEQ ID NO: 3319349 - DNA, 12 bp, Homo sapiens
aaggacttgaaa

SEQ ID NO: 3319350 - DNA, 19 bp, Homo sapiens
aaggacttgaaagcatcca

SEQ ID NO: 3319351 - DNA, 17 bp, Homo sapiens
aaggagaaaaaaaacct

SEQ ID NO: 3319352 - DNA, 19 bp, Homo sapiens
aaggagaaacagagacagg

SEQ ID NO: 3319353 - DNA, 12 bp, Homo sapiens
aaggagagaaag

SEQ ID NO: 3319354 - DNA, 13 bp, Homo sapiens
aaggagagcctgc

SEQ ID NO: 3319355 - DNA, 18 bp, Homo sapiens
aaggagatgtcttggaac

SEQ ID NO: 3319356 - DNA, 13 bp, Homo sapiens
aaggagcacaagc

SEQ ID NO: 3319357 - DNA, 12 bp, Homo sapiens
aaggagcacagg

SEQ ID NO: 3319358 - DNA, 19 bp, Homo sapiens
aaggagccttgttggtgga

SEQ ID NO: 3319359 - DNA, 21 bp, Homo sapiens
aaggagcggcgccctggactt

SEQ ID NO: 3319360 - DNA, 23 bp, Homo sapiens
aaggagcggcgccctggacttgg

SEQ ID NO: 3319361 - DNA, 20 bp, Homo sapiens
aaggagctgatttccaggcc

SEQ ID NO: 3319362 - DNA, 15 bp, Homo sapiens
aaggaggaggaggga

SEQ ID NO: 3319363 - DNA, 19 bp, Homo sapiens
aaggaggaggagggagaag

SEQ ID NO: 3319364 - DNA, 21 bp, Homo sapiens
aaggaggaggagggagaagag

SEQ ID NO: 3319365 - DNA, 16 bp, Homo sapiens
aaggaggccaaccagc

SEQ ID NO: 3319366 - DNA, 20 bp, Homo sapiens
aaggaggccaaccagcccga

SEQ ID NO: 3319367 - DNA, 11 bp, Homo sapiens
aaggagggaga

SEQ ID NO: 3319368 - DNA, 15 bp, Homo sapiens
aaggagggcagagcc

SEQ ID NO: 3319369 - DNA, 17 bp, Homo sapiens
aaggaggggctgtaaaa

SEQ ID NO: 3319370 - DNA, 15 bp, Homo sapiens
aaggaggtagagagg

SEQ ID NO: 3319371 - DNA, 17 bp, Homo sapiens
aaggagtcaaaactaca

SEQ ID NO: 3319372 - DNA, 16 bp, Homo sapiens
aaggagttggaagtga

SEQ ID NO: 3319373 - DNA, 20 bp, Homo sapiens
aaggataaatcataaagtca

SEQ ID NO: 3319374 - DNA, 13 bp, Homo sapiens
aaggataactctg

SEQ ID NO: 3319375 - DNA, 19 bp, Homo sapiens
aaggataccttcttattta

SEQ ID NO: 3319376 - DNA, 15 bp, Homo sapiens
aaggatagtaagcat

SEQ ID NO: 3319377 - DNA, 20 bp, Homo sapiens
aaggatagtaagcatagaaa

SEQ ID NO: 3319378 - DNA, 17 bp, Homo sapiens
aaggatagtatttttat

SEQ ID NO: 3319379 - DNA, 14 bp, Homo sapiens
aaggatatactgca

SEQ ID NO: 3319380 - DNA, 19 bp, Homo sapiens
aaggatatttaagaaaata

SEQ ID NO: 3319381 - DNA, 20 bp, Homo sapiens
aaggatctctataacagatc

SEQ ID NO: 3319382 - DNA, 16 bp, Homo sapiens
aaggatctctcaggag

SEQ ID NO: 3319383 - DNA, 18 bp, Homo sapiens
aaggatgctctttccctt

SEQ ID NO: 3319384 - DNA, 14 bp, Homo sapiens
aaggatgtcacagg

SEQ ID NO: 3319385 - DNA, 15 bp, Homo sapiens
aaggatgtcacaggg

SEQ ID NO: 3319386 - DNA, 12 bp, Homo sapiens
aaggattacaga

SEQ ID NO: 3319387 - DNA, 17 bp, Homo sapiens
aaggattacagaaactg

SEQ ID NO: 3319388 - DNA, 16 bp, Homo sapiens
aaggattatggaaaaa

SEQ ID NO: 3319389 - DNA, 14 bp, Homo sapiens
aaggattctgggaa

SEQ ID NO: 3319390 - DNA, 20 bp, Homo sapiens
aaggattctgggaatcatgt

SEQ ID NO: 3319391 - DNA, 14 bp, Homo sapiens
aaggattgaaaatt

SEQ ID NO: 3319392 - DNA, 15 bp, Homo sapiens
aaggattgctactgt

SEQ ID NO: 3319393 - DNA, 12 bp, Homo sapiens
aaggattgtaaa

SEQ ID NO: 3319394 - DNA, 13 bp, Homo sapiens
aaggattgtaaaa

SEQ ID NO: 3319395 - DNA, 20 bp, Homo sapiens
aaggattttaccaaagcatc

SEQ ID NO: 3319396 - DNA, 18 bp, Homo sapiens
aaggatttttcaagagat

SEQ ID NO: 3319397 - DNA, 15 bp, Homo sapiens
aaggcaaaaatgtaa

SEQ ID NO: 3319398 - DNA, 12 bp, Homo sapiens
aaggcaaaattg

SEQ ID NO: 3319399 - DNA, 18 bp, Homo sapiens
aaggcaaatgtgtacatg

SEQ ID NO: 3319400 - DNA, 19 bp, Homo sapiens
aaggcaagagggggtggag

SEQ ID NO: 3319401 - DNA, 21 bp, Homo sapiens
aaggcaagagggggtggaggg

SEQ ID NO: 3319402 - DNA, 20 bp, Homo sapiens
aaggcaagtttctagctaga

SEQ ID NO: 3319403 - DNA, 17 bp, Homo sapiens
aaggcacagtgggagct

SEQ ID NO: 3319404 - DNA, 19 bp, Homo sapiens
aaggcacccacaaataaat

SEQ ID NO: 3319405 - DNA, 20 bp, Homo sapiens
aaggcacccacaaataaatg

SEQ ID NO: 3319406 - DNA, 15 bp, Homo sapiens
aaggcactctagatt

SEQ ID NO: 3319407 - DNA, 16 bp, Homo sapiens
aaggcactctagattc

SEQ ID NO: 3319408 - DNA, 15 bp, Homo sapiens
aaggcagagaaatct

SEQ ID NO: 3319409 - DNA, 13 bp, Homo sapiens
aaggcagcctcca

SEQ ID NO: 3319410 - DNA, 16 bp, Homo sapiens
aaggcagcctccagag

SEQ ID NO: 3319411 - DNA, 21 bp, Homo sapiens
aaggcagctcacccctgggca

SEQ ID NO: 3319412 - DNA, 14 bp, Homo sapiens
aaggcagctgcctc

SEQ ID NO: 3319413 - DNA, 18 bp, Homo sapiens
aaggcagctgcctctgct

SEQ ID NO: 3319414 - DNA, 20 bp, Homo sapiens
aaggcagctgcctctgctcc

SEQ ID NO: 3319415 - DNA, 16 bp, Homo sapiens
aaggcaggcatatcaa

SEQ ID NO: 3319416 - DNA, 23 bp, Homo sapiens
aaggcaggtagatcgcttgagcc

SEQ ID NO: 3319417 - DNA, 17 bp, Homo sapiens
aaggcaggtgcctccag

SEQ ID NO: 3319418 - DNA, 22 bp, Homo sapiens
aaggcagtctctatattatgtc

SEQ ID NO: 3319419 - DNA, 21 bp, Homo sapiens
aaggcagtggcaggggagcag

SEQ ID NO: 3319420 - DNA, 15 bp, Homo sapiens
aaggcagttttctaa

SEQ ID NO: 3319421 - DNA, 12 bp, Homo sapiens
aaggcatgagaa

SEQ ID NO: 3319422 - DNA, 15 bp, Homo sapiens
aaggcatgagaaaga

SEQ ID NO: 3319423 - DNA, 17 bp, Homo sapiens
aaggccaaagataaaag

SEQ ID NO: 3319424 - DNA, 22 bp, Homo sapiens
aaggccacatacctctctgaga

SEQ ID NO: 3319425 - DNA, 17 bp, Homo sapiens
aaggccagagtggcctg

SEQ ID NO: 3319426 - DNA, 21 bp, Homo sapiens
aaggccagagtggcctggcca

SEQ ID NO: 3319427 - DNA, 24 bp, Homo sapiens
aaggccataaaacaggtaatataa

SEQ ID NO: 3319428 - DNA, 14 bp, Homo sapiens
aaggcccagcccct

SEQ ID NO: 3319429 - DNA, 16 bp, Homo sapiens
aaggcccagcccctag

SEQ ID NO: 3319430 - DNA, 20 bp, Homo sapiens
aaggcccccaaacatagccc

SEQ ID NO: 3319431 - DNA, 22 bp, Homo sapiens
aaggccctgctttttttcttaa

SEQ ID NO: 3319432 - DNA, 16 bp, Homo sapiens
aaggccgaagctctgg

SEQ ID NO: 3319433 - DNA, 18 bp, Homo sapiens
aaggccgaagctctggct

SEQ ID NO: 3319434 - DNA, 17 bp, Homo sapiens
aaggccgtgtctctgag

SEQ ID NO: 3319435 - DNA, 17 bp, Homo sapiens
aaggcctaggctaggac

SEQ ID NO: 3319436 - DNA, 15 bp, Homo sapiens
aaggcctcctccccc

SEQ ID NO: 3319437 - DNA, 21 bp, Homo sapiens
aaggcctcctcccccacccct

SEQ ID NO: 3319438 - DNA, 13 bp, Homo sapiens
aaggcctctgtcc

SEQ ID NO: 3319439 - DNA, 13 bp, Homo sapiens
aaggcctcttgta

SEQ ID NO: 3319440 - DNA, 15 bp, Homo sapiens
aaggcctcttgtgct

SEQ ID NO: 3319441 - DNA, 12 bp, Homo sapiens
aaggcctggctg

SEQ ID NO: 3319442 - DNA, 11 bp, Homo sapiens
aaggccttaag

SEQ ID NO: 3319443 - DNA, 15 bp, Homo sapiens
aaggccttaatatgt

SEQ ID NO: 3319444 - DNA, 21 bp, Homo sapiens
aaggccttattctacatttca

SEQ ID NO: 3319445 - DNA, 17 bp, Homo sapiens
aaggctcagtctcagga

SEQ ID NO: 3319446 - DNA, 13 bp, Homo sapiens
aaggctctagatc

SEQ ID NO: 3319447 - DNA, 17 bp, Homo sapiens
aaggctctgaaagccag

SEQ ID NO: 3319448 - DNA, 12 bp, Homo sapiens
aaggctctgaga

SEQ ID NO: 3319449 - DNA, 17 bp, Homo sapiens
aaggctctgagagtcta

SEQ ID NO: 3319450 - DNA, 23 bp, Homo sapiens
aaggctctgagcaaatgtggctc

SEQ ID NO: 3319451 - DNA, 19 bp, Homo sapiens
aaggctgaactcttcagaa

SEQ ID NO: 3319452 - DNA, 16 bp, Homo sapiens
aaggctgaccaagaga

SEQ ID NO: 3319453 - DNA, 17 bp, Homo sapiens
aaggctgaccaagagag

SEQ ID NO: 3319454 - DNA, 19 bp, Homo sapiens
aaggctgaccaagagagaa

SEQ ID NO: 3319455 - DNA, 12 bp, Homo sapiens
aaggctgagaag

SEQ ID NO: 3319456 - DNA, 13 bp, Homo sapiens
aaggctgccgagg

SEQ ID NO: 3319457 - DNA, 14 bp, Homo sapiens
aaggctgcgtctgg

SEQ ID NO: 3319458 - DNA, 16 bp, Homo sapiens
aaggctggctgggcat

SEQ ID NO: 3319459 - DNA, 21 bp, Homo sapiens
aaggctgggtaatgtgaaggc

SEQ ID NO: 3319460 - DNA, 15 bp, Homo sapiens
aaggcttaaacccat

SEQ ID NO: 3319461 - DNA, 16 bp, Homo sapiens
aaggcttgaagctgtg

SEQ ID NO: 3319462 - DNA, 15 bp, Homo sapiens
aagggaaaagggaga

SEQ ID NO: 3319463 - DNA, 17 bp, Homo sapiens
aagggaagaaggggcca

SEQ ID NO: 3319464 - DNA, 23 bp, Homo sapiens
aagggaagcacatgatcatggga

SEQ ID NO: 3319465 - DNA, 14 bp, Homo sapiens
aagggaaggacaga

SEQ ID NO: 3319466 - DNA, 14 bp, Homo sapiens
aagggaatgcatta

SEQ ID NO: 3319467 - DNA, 13 bp, Homo sapiens
aagggaccaaggc

SEQ ID NO: 3319468 - DNA, 20 bp, Homo sapiens
aagggacttggaagctccgc

SEQ ID NO: 3319469 - DNA, 13 bp, Homo sapiens
aagggagaaaaag

SEQ ID NO: 3319470 - DNA, 22 bp, Homo sapiens
aagggaggacgggagctgggga

SEQ ID NO: 3319471 - DNA, 14 bp, Homo sapiens
aagggagggagcaa

SEQ ID NO: 3319472 - DNA, 18 bp, Homo sapiens
aagggagggagcaagccc

SEQ ID NO: 3319473 - DNA, 19 bp, Homo sapiens
aagggagggagcaagccct

SEQ ID NO: 3319474 - DNA, 13 bp, Homo sapiens
aagggatcctgcc

SEQ ID NO: 3319475 - DNA, 13 bp, Homo sapiens
aagggcacacaca

SEQ ID NO: 3319476 - DNA, 18 bp, Homo sapiens
aagggcacttaatttgta

SEQ ID NO: 3319477 - DNA, 21 bp, Homo sapiens
aagggcaggaaggagagcctg

SEQ ID NO: 3319478 - DNA, 22 bp, Homo sapiens
aagggcaggaaggagagcctgc

SEQ ID NO: 3319479 - DNA, 22 bp, Homo sapiens
aagggcagggcatctcctgtgc

SEQ ID NO: 3319480 - DNA, 15 bp, Homo sapiens
aagggcaggtcttca

SEQ ID NO: 3319481 - DNA, 11 bp, Homo sapiens
aagggcagtgc

SEQ ID NO: 3319482 - DNA, 17 bp, Homo sapiens
aagggcataaaacagct

SEQ ID NO: 3319483 - DNA, 16 bp, Homo sapiens
aagggcatcaggcact

SEQ ID NO: 3319484 - DNA, 18 bp, Homo sapiens
aagggcatcaggcactgg

SEQ ID NO: 3319485 - DNA, 14 bp, Homo sapiens
aagggcatgccttg

SEQ ID NO: 3319486 - DNA, 14 bp, Homo sapiens
aagggccagtctgg

SEQ ID NO: 3319487 - DNA, 17 bp, Homo sapiens
aagggccctggcacccc

SEQ ID NO: 3319488 - DNA, 15 bp, Homo sapiens
aagggctccagcatc

SEQ ID NO: 3319489 - DNA, 22 bp, Homo sapiens
aagggctccagcatccagcctg

SEQ ID NO: 3319490 - DNA, 24 bp, Homo sapiens
aagggctccagcatccagcctgtg

SEQ ID NO: 3319491 - DNA, 18 bp, Homo sapiens
aagggcttctgcaccctc

SEQ ID NO: 3319492 - DNA, 19 bp, Homo sapiens
aagggcttctgcaccctcc

SEQ ID NO: 3319493 - DNA, 12 bp, Homo sapiens
aaggggacaggc

SEQ ID NO: 3319494 - DNA, 16 bp, Homo sapiens
aaggggacaggcctca

SEQ ID NO: 3319495 - DNA, 22 bp, Homo sapiens
aaggggagaaactgaaagtgtt

SEQ ID NO: 3319496 - DNA, 15 bp, Homo sapiens
aaggggagagcctgc

SEQ ID NO: 3319497 - DNA, 17 bp, Homo sapiens
aaggggcacaccactgc

SEQ ID NO: 3319498 - DNA, 23 bp, Homo sapiens
aaggggcacaccactgccctgcc

SEQ ID NO: 3319499 - DNA, 21 bp, Homo sapiens
aaggggcccaagccccatctc

SEQ ID NO: 3319500 - DNA, 16 bp, Homo sapiens
aaggggccccggggct

SEQ ID NO: 3319501 - DNA, 20 bp, Homo sapiens
aaggggccccggggctggca

SEQ ID NO: 3319502 - DNA, 16 bp, Homo sapiens
aaggggctgaaagaac

SEQ ID NO: 3319503 - DNA, 21 bp, Homo sapiens
aaggggctgctggggcatgtg

SEQ ID NO: 3319504 - DNA, 15 bp, Homo sapiens
aagggggaggggaag

SEQ ID NO: 3319505 - DNA, 18 bp, Homo sapiens
aagggggaggggaagtcc

SEQ ID NO: 3319506 - DNA, 15 bp, Homo sapiens
aaggggggagctggg

SEQ ID NO: 3319507 - DNA, 18 bp, Homo sapiens
aaggggggcagggagtga

SEQ ID NO: 3319508 - DNA, 22 bp, Homo sapiens
aaggggggggcaatctctctct

SEQ ID NO: 3319509 - DNA, 17 bp, Homo sapiens
aagggggtcaaaggaag

SEQ ID NO: 3319510 - DNA, 12 bp, Homo sapiens
aagggggtccca

SEQ ID NO: 3319511 - DNA, 19 bp, Homo sapiens
aaggggttggggtgacagt

SEQ ID NO: 3319512 - DNA, 17 bp, Homo sapiens
aagggtcatagaaaggg

SEQ ID NO: 3319513 - DNA, 18 bp, Homo sapiens
aagggtcgaaagctctag

SEQ ID NO: 3319514 - DNA, 18 bp, Homo sapiens
aagggtgggtgctcagaa

SEQ ID NO: 3319515 - DNA, 19 bp, Homo sapiens
aagggtgtaggggccacct

SEQ ID NO: 3319516 - DNA, 22 bp, Homo sapiens
aagggtgtaggggccacctcct

SEQ ID NO: 3319517 - DNA, 14 bp, Homo sapiens
aagggtttcgactg

SEQ ID NO: 3319518 - DNA, 13 bp, Homo sapiens
aaggtaatgtgtg

SEQ ID NO: 3319519 - DNA, 12 bp, Homo sapiens
aaggtaattgtt

SEQ ID NO: 3319520 - DNA, 19 bp, Homo sapiens
aaggtaattgttttttaaa

SEQ ID NO: 3319521 - DNA, 14 bp, Homo sapiens
aaggtacaacagaa

SEQ ID NO: 3319522 - DNA, 20 bp, Homo sapiens
aaggtagaaatatctgaaaa

SEQ ID NO: 3319523 - DNA, 19 bp, Homo sapiens
aaggtaggaaggtcaaggt

SEQ ID NO: 3319524 - DNA, 12 bp, Homo sapiens
aaggtagttttt

SEQ ID NO: 3319525 - DNA, 12 bp, Homo sapiens
aaggtataaata

SEQ ID NO: 3319526 - DNA, 12 bp, Homo sapiens
aaggtataataa

SEQ ID NO: 3319527 - DNA, 11 bp, Homo sapiens
aaggtataatt

SEQ ID NO: 3319528 - DNA, 21 bp, Homo sapiens
aaggtatacacccagttctga

SEQ ID NO: 3319529 - DNA, 15 bp, Homo sapiens
aaggtattagcaaag

SEQ ID NO: 3319530 - DNA, 16 bp, Homo sapiens
aaggtattatacatgt

SEQ ID NO: 3319531 - DNA, 15 bp, Homo sapiens
aaggtattttgaata

SEQ ID NO: 3319532 - DNA, 24 bp, Homo sapiens
aaggtcctgctcaactctacccct

SEQ ID NO: 3319533 - DNA, 12 bp, Homo sapiens
aaggtctattgg

SEQ ID NO: 3319534 - DNA, 15 bp, Homo sapiens
aaggtctcattcttc

SEQ ID NO: 3319535 - DNA, 18 bp, Homo sapiens
aaggtctttcagtacttt

SEQ ID NO: 3319536 - DNA, 22 bp, Homo sapiens
aaggtgaggagggcagtccaag

SEQ ID NO: 3319537 - DNA, 21 bp, Homo sapiens
aaggtgagtttgagctgcctt

SEQ ID NO: 3319538 - DNA, 19 bp, Homo sapiens
aaggtgataagggaaaaga

SEQ ID NO: 3319539 - DNA, 19 bp, Homo sapiens
aaggtgatttcagactgca

SEQ ID NO: 3319540 - DNA, 22 bp, Homo sapiens
aaggtggaaaatggactggctt

SEQ ID NO: 3319541 - DNA, 17 bp, Homo sapiens
aaggtggggagaagctg

SEQ ID NO: 3319542 - DNA, 16 bp, Homo sapiens
aaggtggggccctgcc

SEQ ID NO: 3319543 - DNA, 21 bp, Homo sapiens
aaggtgtatttaaactatctt

SEQ ID NO: 3319544 - DNA, 15 bp, Homo sapiens
aaggtgtgagactgg

SEQ ID NO: 3319545 - DNA, 15 bp, Homo sapiens
aaggttaataaagta

SEQ ID NO: 3319546 - DNA, 20 bp, Homo sapiens
aaggttaatgttcatcatcc

SEQ ID NO: 3319547 - DNA, 17 bp, Homo sapiens
aaggttaggatttaaca

SEQ ID NO: 3319548 - DNA, 17 bp, Homo sapiens
aaggttatgttcatttt

SEQ ID NO: 3319549 - DNA, 14 bp, Homo sapiens
aaggttctaaggcc

SEQ ID NO: 3319550 - DNA, 13 bp, Homo sapiens
aaggttctaggtt

SEQ ID NO: 3319551 - DNA, 17 bp, Homo sapiens
aaggttcttcatccctt

SEQ ID NO: 3319552 - DNA, 16 bp, Homo sapiens
aaggttgaactttgcc

SEQ ID NO: 3319553 - DNA, 17 bp, Homo sapiens
aaggttgaataatatat

SEQ ID NO: 3319554 - DNA, 13 bp, Homo sapiens
aaggttgcagtgc

SEQ ID NO: 3319555 - DNA, 21 bp, Homo sapiens
aaggtttaaagagtctagatt

SEQ ID NO: 3319556 - DNA, 21 bp, Homo sapiens
aaggtttcgtttctgtataca

SEQ ID NO: 3319557 - DNA, 17 bp, Homo sapiens
aaggtttgtatattgtc

SEQ ID NO: 3319558 - DNA, 12 bp, Homo sapiens
aaggttttaagt

SEQ ID NO: 3319559 - DNA, 19 bp, Homo sapiens
aaggttttaggttctaaag

SEQ ID NO: 3319560 - DNA, 22 bp, Homo sapiens
aaggttttggatcttgaatgtg

SEQ ID NO: 3319561 - DNA, 14 bp, Homo sapiens
aagtaaaatgtctt

SEQ ID NO: 3319562 - DNA, 23 bp, Homo sapiens
aagtaaaattatcctctttgtaa

SEQ ID NO: 3319563 - DNA, 14 bp, Homo sapiens
aagtaaaattgttt

SEQ ID NO: 3319564 - DNA, 20 bp, Homo sapiens
aagtaaacctagtaaaacct

SEQ ID NO: 3319565 - DNA, 21 bp, Homo sapiens
aagtaaagccattaaatgaat

SEQ ID NO: 3319566 - DNA, 21 bp, Homo sapiens
aagtaaaggcctcctccccca

SEQ ID NO: 3319567 - DNA, 23 bp, Homo sapiens
aagtaaaggcctcctcccccacc

SEQ ID NO: 3319568 - DNA, 14 bp, Homo sapiens
aagtaaatctcttt

SEQ ID NO: 3319569 - DNA, 15 bp, Homo sapiens
aagtaacataactag

SEQ ID NO: 3319570 - DNA, 18 bp, Homo sapiens
aagtaacatgcatacttt

SEQ ID NO: 3319571 - DNA, 20 bp, Homo sapiens
aagtaagaaagtgaagcaaa

SEQ ID NO: 3319572 - DNA, 21 bp, Homo sapiens
aagtaagtaccactcaggcca

SEQ ID NO: 3319573 - DNA, 19 bp, Homo sapiens
aagtaagttaataatgtat

SEQ ID NO: 3319574 - DNA, 21 bp, Homo sapiens
aagtaagtttatccaaatctt

SEQ ID NO: 3319575 - DNA, 17 bp, Homo sapiens
aagtaatacgttttgac

SEQ ID NO: 3319576 - DNA, 18 bp, Homo sapiens
aagtaatacgttttgaca

SEQ ID NO: 3319577 - DNA, 13 bp, Homo sapiens
aagtaatataatg

SEQ ID NO: 3319578 - DNA, 18 bp, Homo sapiens
aagtaatcccgccaccta

SEQ ID NO: 3319579 - DNA, 23 bp, Homo sapiens
aagtaatgtattagtatggttca

SEQ ID NO: 3319580 - DNA, 13 bp, Homo sapiens
aagtaattatgca

SEQ ID NO: 3319581 - DNA, 14 bp, Homo sapiens
aagtaattcctctc

SEQ ID NO: 3319582 - DNA, 13 bp, Homo sapiens
aagtaatttcagt

SEQ ID NO: 3319583 - DNA, 14 bp, Homo sapiens
aagtaatttcagtg

SEQ ID NO: 3319584 - DNA, 23 bp, Homo sapiens
aagtaatttcagtgtaaagtgtg

SEQ ID NO: 3319585 - DNA, 17 bp, Homo sapiens
aagtaattttgtcacat

SEQ ID NO: 3319586 - DNA, 21 bp, Homo sapiens
aagtaattttgtcacattatt

SEQ ID NO: 3319587 - DNA, 23 bp, Homo sapiens
aagtacaatgaactgcttttcct

SEQ ID NO: 3319588 - DNA, 18 bp, Homo sapiens
aagtacaatgtgtttttc

SEQ ID NO: 3319589 - DNA, 16 bp, Homo sapiens
aagtacactctgctgt

SEQ ID NO: 3319590 - DNA, 19 bp, Homo sapiens
aagtacactctgctgtttg

SEQ ID NO: 3319591 - DNA, 13 bp, Homo sapiens
aagtacagaattt

SEQ ID NO: 3319592 - DNA, 18 bp, Homo sapiens
aagtaccacactgagttc

SEQ ID NO: 3319593 - DNA, 17 bp, Homo sapiens
aagtaccactcaggcca

SEQ ID NO: 3319594 - DNA, 18 bp, Homo sapiens
aagtaccctgatgccttt

SEQ ID NO: 3319595 - DNA, 15 bp, Homo sapiens
aagtacgttattgtt

SEQ ID NO: 3319596 - DNA, 15 bp, Homo sapiens
aagtactatgtatca

SEQ ID NO: 3319597 - DNA, 19 bp, Homo sapiens
aagtactgtaataatacct

SEQ ID NO: 3319598 - DNA, 21 bp, Homo sapiens
aagtactgtaataatacctca

SEQ ID NO: 3319599 - DNA, 19 bp, Homo sapiens
aagtactgtttaccatttt

SEQ ID NO: 3319600 - DNA, 20 bp, Homo sapiens
aagtactgtttaccattttt

SEQ ID NO: 3319601 - DNA, 18 bp, Homo sapiens
aagtacttctccaccctg

SEQ ID NO: 3319602 - DNA, 19 bp, Homo sapiens
aagtacttctccaccctgc

SEQ ID NO: 3319603 - DNA, 20 bp, Homo sapiens
aagtactttaaaaaggaaat

SEQ ID NO: 3319604 - DNA, 16 bp, Homo sapiens
aagtagaacaaaaaac

SEQ ID NO: 3319605 - DNA, 20 bp, Homo sapiens
aagtagaagtcttagatgta

SEQ ID NO: 3319606 - DNA, 15 bp, Homo sapiens
aagtagaataaaaac

SEQ ID NO: 3319607 - DNA, 19 bp, Homo sapiens
aagtagacaatcattgttt

SEQ ID NO: 3319608 - DNA, 21 bp, Homo sapiens
aagtagacaatcattgttttg

SEQ ID NO: 3319609 - DNA, 22 bp, Homo sapiens
aagtaggactttcctaaatgtt

SEQ ID NO: 3319610 - DNA, 23 bp, Homo sapiens
aagtaggactttcctaaatgttt

SEQ ID NO: 3319611 - DNA, 15 bp, Homo sapiens
aagtagtaaattttg

SEQ ID NO: 3319612 - DNA, 16 bp, Homo sapiens
aagtagtaaattttgt

SEQ ID NO: 3319613 - DNA, 14 bp, Homo sapiens
aagtagtcctgtga

SEQ ID NO: 3319614 - DNA, 16 bp, Homo sapiens
aagtagttggtttgta

SEQ ID NO: 3319615 - DNA, 17 bp, Homo sapiens
aagtagttggtttgtat

SEQ ID NO: 3319616 - DNA, 20 bp, Homo sapiens
aagtagtttgtataacttct

SEQ ID NO: 3319617 - DNA, 13 bp, Homo sapiens
aagtataatgttt

SEQ ID NO: 3319618 - DNA, 15 bp, Homo sapiens
aagtatacttatatt

SEQ ID NO: 3319619 - DNA, 17 bp, Homo sapiens
aagtatagagaaaagtg

SEQ ID NO: 3319620 - DNA, 13 bp, Homo sapiens
aagtatatattta

SEQ ID NO: 3319621 - DNA, 21 bp, Homo sapiens
aagtatatgtgaaaaaaatga

SEQ ID NO: 3319622 - DNA, 12 bp, Homo sapiens
aagtatattaaa

SEQ ID NO: 3319623 - DNA, 21 bp, Homo sapiens
aagtatattcttattggaaat

SEQ ID NO: 3319624 - DNA, 13 bp, Homo sapiens
aagtatcactcta

SEQ ID NO: 3319625 - DNA, 19 bp, Homo sapiens
aagtatcactctaaaaaac

SEQ ID NO: 3319626 - DNA, 20 bp, Homo sapiens
aagtatcactctaaaaaaca

SEQ ID NO: 3319627 - DNA, 20 bp, Homo sapiens
aagtatcaggaatataaata

SEQ ID NO: 3319628 - DNA, 18 bp, Homo sapiens
aagtatcttttttcaaaa

SEQ ID NO: 3319629 - DNA, 21 bp, Homo sapiens
aagtatgaatattactctcaa

SEQ ID NO: 3319630 - DNA, 18 bp, Homo sapiens
aagtatgcattattaaat

SEQ ID NO: 3319631 - DNA, 22 bp, Homo sapiens
aagtatgcattattaaattgta

SEQ ID NO: 3319632 - DNA, 21 bp, Homo sapiens
aagtatgtaaacaggagacag

SEQ ID NO: 3319633 - DNA, 14 bp, Homo sapiens
aagtattctttttc

SEQ ID NO: 3319634 - DNA, 21 bp, Homo sapiens
aagtattgagaacctggcctg

SEQ ID NO: 3319635 - DNA, 14 bp, Homo sapiens
aagtatttaaatgt

SEQ ID NO: 3319636 - DNA, 15 bp, Homo sapiens
aagtatttaaatgtt

SEQ ID NO: 3319637 - DNA, 10 bp, Homo sapiens
aagtatttag

SEQ ID NO: 3319638 - DNA, 16 bp, Homo sapiens
aagtatttaggttttt

SEQ ID NO: 3319639 - DNA, 12 bp, Homo sapiens
aagtatttatat

SEQ ID NO: 3319640 - DNA, 17 bp, Homo sapiens
aagtatttatatattta

SEQ ID NO: 3319641 - DNA, 15 bp, Homo sapiens
aagtatttttttatc

SEQ ID NO: 3319642 - DNA, 16 bp, Homo sapiens
aagtcaaaaggaacaa

SEQ ID NO: 3319643 - DNA, 15 bp, Homo sapiens
aagtcaaacttggat

SEQ ID NO: 3319644 - DNA, 19 bp, Homo sapiens
aagtcaaattaataatctt

SEQ ID NO: 3319645 - DNA, 14 bp, Homo sapiens
aagtcaagcacatg

SEQ ID NO: 3319646 - DNA, 21 bp, Homo sapiens
aagtcaagcacatgtaataaa

SEQ ID NO: 3319647 - DNA, 16 bp, Homo sapiens
aagtcaatcatttctc

SEQ ID NO: 3319648 - DNA, 17 bp, Homo sapiens
aagtcaatcatttctca

SEQ ID NO: 3319649 - DNA, 19 bp, Homo sapiens
aagtcacagctgcagctgg

SEQ ID NO: 3319650 - DNA, 14 bp, Homo sapiens
aagtcaccggagct

SEQ ID NO: 3319651 - DNA, 19 bp, Homo sapiens
aagttaatgtatataaaaa

SEQ ID NO: 3319652 - DNA, 21 bp, Homo sapiens
aagttacacttttatttcctg

SEQ ID NO: 3319653 - DNA, 18 bp, Homo sapiens
aagttactaggtaacttc

SEQ ID NO: 3319654 - DNA, 19 bp, Homo sapiens
aagttactaggtaacttca

SEQ ID NO: 3319655 - DNA, 24 bp, Homo sapiens
aagttagaaggcttaagaactgct

SEQ ID NO: 3319656 - DNA, 13 bp, Homo sapiens
aagttagctcagg

SEQ ID NO: 3319657 - DNA, 15 bp, Homo sapiens
aagttagctcaggag

SEQ ID NO: 3319658 - DNA, 22 bp, Homo sapiens
aagttagtggaaatctgaacat

SEQ ID NO: 3319659 - DNA, 16 bp, Homo sapiens
aagttatagtatatct

SEQ ID NO: 3319660 - DNA, 17 bp, Homo sapiens
aagttatagtatatctg

SEQ ID NO: 3319661 - DNA, 17 bp, Homo sapiens
aagttatagtgaatact

SEQ ID NO: 3319662 - DNA, 15 bp, Homo sapiens
aagttattaacttta

SEQ ID NO: 3319663 - DNA, 17 bp, Homo sapiens
aagttattaactttaat

SEQ ID NO: 3319664 - DNA, 14 bp, Homo sapiens
aagttatttacttt

SEQ ID NO: 3319665 - DNA, 12 bp, Homo sapiens
aagttatttatg

SEQ ID NO: 3319666 - DNA, 18 bp, Homo sapiens
aagttatttatgctataa

SEQ ID NO: 3319667 - DNA, 13 bp, Homo sapiens
aagttattttatg

SEQ ID NO: 3319668 - DNA, 21 bp, Homo sapiens
aagttattttcagacatattt

SEQ ID NO: 3319669 - DNA, 14 bp, Homo sapiens
aagttattttctac

SEQ ID NO: 3319670 - DNA, 18 bp, Homo sapiens
aagttattttctacagtg

SEQ ID NO: 3319671 - DNA, 15 bp, Homo sapiens
aagttatttttgtac

SEQ ID NO: 3319672 - DNA, 17 bp, Homo sapiens
aagttcacaaaatggtg

SEQ ID NO: 3319673 - DNA, 20 bp, Homo sapiens
aagttcataacagtgccatt

SEQ ID NO: 3319674 - DNA, 22 bp, Homo sapiens
aagttcatacctaagtactgta

SEQ ID NO: 3319675 - DNA, 15 bp, Homo sapiens
aagttcatattccat

SEQ ID NO: 3319676 - DNA, 23 bp, Homo sapiens
aagttcatattccatatttattc

SEQ ID NO: 3319677 - DNA, 21 bp, Homo sapiens
aagttcatgtccaaacgtcct

SEQ ID NO: 3319678 - DNA, 17 bp, Homo sapiens
aagttccaagagtctaa

SEQ ID NO: 3319679 - DNA, 20 bp, Homo sapiens
aagttccaagagtctaaaga

SEQ ID NO: 3319680 - DNA, 19 bp, Homo sapiens
aagttccaagttgctaata

SEQ ID NO: 3319681 - DNA, 12 bp, Homo sapiens
aacctgattgta

SEQ ID NO: 3319682 - DNA, 15 bp, Homo sapiens
aacctgattgtaaac

SEQ ID NO: 3319683 - DNA, 16 bp, Homo sapiens
aacctgattgtaaact

SEQ ID NO: 3319684 - DNA, 18 bp, Homo sapiens
aacctgattgtaaacttc

SEQ ID NO: 3319685 - DNA, 22 bp, Homo sapiens
aacctgcccaaagattgatttg

SEQ ID NO: 3319686 - DNA, 22 bp, Homo sapiens
aacctgctttcaagacccctgt

SEQ ID NO: 3319687 - DNA, 15 bp, Homo sapiens
aacctggacctggaa

SEQ ID NO: 3319688 - DNA, 17 bp, Homo sapiens
aacctggacctggaact

SEQ ID NO: 3319689 - DNA, 19 bp, Homo sapiens
aacctggccgcgtttagac

SEQ ID NO: 3319690 - DNA, 20 bp, Homo sapiens
aacctgggattcaggaatgt

SEQ ID NO: 3319691 - DNA, 21 bp, Homo sapiens
aacctgggattcaggaatgtg

SEQ ID NO: 3319692 - DNA, 20 bp, Homo sapiens
aacctgggtatgttcctaag

SEQ ID NO: 3319693 - DNA, 17 bp, Homo sapiens
aacctgtcattgtattc

SEQ ID NO: 3319694 - DNA, 15 bp, Homo sapiens
aacctgtcctaagga

SEQ ID NO: 3319695 - DNA, 18 bp, Homo sapiens
aacctgtctccactgtgc

SEQ ID NO: 3319696 - DNA, 21 bp, Homo sapiens
aacctgttacctactttgact

SEQ ID NO: 3319697 - DNA, 16 bp, Homo sapiens
aacctgttcaggcagg

SEQ ID NO: 3319698 - DNA, 18 bp, Homo sapiens
aacctgttcttagagtgt

SEQ ID NO: 3319699 - DNA, 22 bp, Homo sapiens
aacctgttcttagagtgtagct

SEQ ID NO: 3319700 - DNA, 16 bp, Homo sapiens
aacctgttttgttaat

SEQ ID NO: 3319701 - DNA, 17 bp, Homo sapiens
aaccttaaaacagctgt

SEQ ID NO: 3319702 - DNA, 13 bp, Homo sapiens
aaccttaagacct

SEQ ID NO: 3319703 - DNA, 18 bp, Homo sapiens
aaccttaatgacaacact

SEQ ID NO: 3319704 - DNA, 15 bp, Homo sapiens
aaccttcagaagcta

SEQ ID NO: 3319705 - DNA, 14 bp, Homo sapiens
aaccttcctgggag

SEQ ID NO: 3319706 - DNA, 21 bp, Homo sapiens
aaccttgaagtgactgttgta

SEQ ID NO: 3319707 - DNA, 17 bp, Homo sapiens
aaccttgagtcagaaaa

SEQ ID NO: 3319708 - DNA, 23 bp, Homo sapiens
aaccttgagtcagaaaacagaga

SEQ ID NO: 3319709 - DNA, 20 bp, Homo sapiens
aaccttgccttagaaacaca

SEQ ID NO: 3319710 - DNA, 11 bp, Homo sapiens
aaccttgctgt

SEQ ID NO: 3319711 - DNA, 20 bp, Homo sapiens
aaccttgttctatttttcaa

SEQ ID NO: 3319712 - DNA, 20 bp, Homo sapiens
aaccttgtttattaaattgc

SEQ ID NO: 3319713 - DNA, 15 bp, Homo sapiens
aaccttgttttggac

SEQ ID NO: 3319714 - DNA, 23 bp, Homo sapiens
aaccttgttttggacagtttacc

SEQ ID NO: 3319715 - DNA, 16 bp, Homo sapiens
aacctttaaaattgtc

SEQ ID NO: 3319716 - DNA, 15 bp, Homo sapiens
aacctttagggcagc

SEQ ID NO: 3319717 - DNA, 11 bp, Homo sapiens
aacctttttct

SEQ ID NO: 3319718 - DNA, 16 bp, Homo sapiens
aacctttttgtaaata

SEQ ID NO: 3319719 - DNA, 21 bp, Homo sapiens
aaccttttttaagatttttct

SEQ ID NO: 3319720 - DNA, 18 bp, Homo sapiens
aaccttttttgtcttatt

SEQ ID NO: 3319721 - DNA, 17 bp, Homo sapiens
aacctttttttttgaaa

SEQ ID NO: 3319722 - DNA, 12 bp, Homo sapiens
aacgaagaaaaa

SEQ ID NO: 3319723 - DNA, 23 bp, Homo sapiens
aacgaagagttcccttgaaactt

SEQ ID NO: 3319724 - DNA, 14 bp, Homo sapiens
aacgagcactggcc

SEQ ID NO: 3319725 - DNA, 19 bp, Homo sapiens
aacgagcactggccagaga

SEQ ID NO: 3319726 - DNA, 23 bp, Homo sapiens
aacgagggctgatggaggaaaaa

SEQ ID NO: 3319727 - DNA, 13 bp, Homo sapiens
aacgatgtgtctg

SEQ ID NO: 3319728 - DNA, 13 bp, Homo sapiens
aacgcaattttac

SEQ ID NO: 3319729 - DNA, 12 bp, Homo sapiens
aacgcacaggaa

SEQ ID NO: 3319730 - DNA, 14 bp, Homo sapiens
aacgcagaagaaag

SEQ ID NO: 3319731 - DNA, 18 bp, Homo sapiens
aacgcagatgatccatga

SEQ ID NO: 3319732 - DNA, 18 bp, Homo sapiens
aacgcatggagtgtgtat

SEQ ID NO: 3319733 - DNA, 13 bp, Homo sapiens
aacgccagtctcc

SEQ ID NO: 3319734 - DNA, 15 bp, Homo sapiens
aacgccagtctccca

SEQ ID NO: 3319735 - DNA, 16 bp, Homo sapiens
aacgcccctgtggcca

SEQ ID NO: 3319736 - DNA, 18 bp, Homo sapiens
aacgcccctgtggccaac

SEQ ID NO: 3319737 - DNA, 18 bp, Homo sapiens
aacgcctcccctgcccca

SEQ ID NO: 3319738 - DNA, 22 bp, Homo sapiens
aacgcctcttttccctctctag

SEQ ID NO: 3319739 - DNA, 15 bp, Homo sapiens
aacgctacctctctg

SEQ ID NO: 3319740 - DNA, 20 bp, Homo sapiens
aacgctcttagctttctcag

SEQ ID NO: 3319741 - DNA, 11 bp, Homo sapiens
aacggaagctg

SEQ ID NO: 3319742 - DNA, 23 bp, Homo sapiens
aacggctaacctggacctggaac

SEQ ID NO: 3319743 - DNA, 14 bp, Homo sapiens
aacggctccaggat

SEQ ID NO: 3319744 - DNA, 16 bp, Homo sapiens
aacgggaacatgcccc

SEQ ID NO: 3319745 - DNA, 21 bp, Homo sapiens
aacgggaccccctggccctgc

SEQ ID NO: 3319746 - DNA, 13 bp, Homo sapiens
aacgggaggctgg

SEQ ID NO: 3319747 - DNA, 17 bp, Homo sapiens
aacgggctgccctgcca

SEQ ID NO: 3319748 - DNA, 14 bp, Homo sapiens
aacggtgcttgtgt

SEQ ID NO: 3319749 - DNA, 13 bp, Homo sapiens
aacgtattttaaa

SEQ ID NO: 3319750 - DNA, 15 bp, Homo sapiens
aacgtgatgatcagc

SEQ ID NO: 3319751 - DNA, 20 bp, Homo sapiens
aacgttactcagggctcctc

SEQ ID NO: 3319752 - DNA, 16 bp, Homo sapiens
aacgttcgatttctac

SEQ ID NO: 3319753 - DNA, 21 bp, Homo sapiens
aacgttcgatttctacctcag

SEQ ID NO: 3319754 - DNA, 14 bp, Homo sapiens
aacgttgctcccca

SEQ ID NO: 3319755 - DNA, 15 bp, Homo sapiens
aacgttttattgtgt

SEQ ID NO: 3319756 - DNA, 19 bp, Homo sapiens
aactaaaaaaaaaaaggcc

SEQ ID NO: 3319757 - DNA, 14 bp, Homo sapiens
aactaaaagacatt

SEQ ID NO: 3319758 - DNA, 23 bp, Homo sapiens
aactaaataatgaataaactgaa

SEQ ID NO: 3319759 - DNA, 14 bp, Homo sapiens
aactaaatgttcta

SEQ ID NO: 3319760 - DNA, 16 bp, Homo sapiens
aactaaattgtaaact

SEQ ID NO: 3319761 - DNA, 22 bp, Homo sapiens
aactaaatttcactactagatt

SEQ ID NO: 3319762 - DNA, 16 bp, Homo sapiens
aactaaattttaaagc

SEQ ID NO: 3319763 - DNA, 14 bp, Homo sapiens
aactaacatgtcct

SEQ ID NO: 3319764 - DNA, 18 bp, Homo sapiens
aactaacctggtatttta

SEQ ID NO: 3319765 - DNA, 19 bp, Homo sapiens
aactaagaaacttttgtaa

SEQ ID NO: 3319766 - DNA, 21 bp, Homo sapiens
aagtcaccttagggtggcttt

SEQ ID NO: 3319767 - DNA, 12 bp, Homo sapiens
aagtcactgcac

SEQ ID NO: 3319768 - DNA, 16 bp, Homo sapiens
aagtcagaatcagaag

SEQ ID NO: 3319769 - DNA, 20 bp, Homo sapiens
aagtcagaggatggccagtg

SEQ ID NO: 3319770 - DNA, 22 bp, Homo sapiens
aagtcagaggatggccagtgtc

SEQ ID NO: 3319771 - DNA, 23 bp, Homo sapiens
aagtcagatggaaaattcatttt

SEQ ID NO: 3319772 - DNA, 16 bp, Homo sapiens
aagtcaggtccaattt

SEQ ID NO: 3319773 - DNA, 16 bp, Homo sapiens
aagtcagtatggtcta

SEQ ID NO: 3319774 - DNA, 20 bp, Homo sapiens
aagtcatctacttaataaat

SEQ ID NO: 3319775 - DNA, 14 bp, Homo sapiens
aagtcatcttgcta

SEQ ID NO: 3319776 - DNA, 17 bp, Homo sapiens
aagtcatggagaatctg

SEQ ID NO: 3319777 - DNA, 14 bp, Homo sapiens
aagtcatgtgcatt

SEQ ID NO: 3319778 - DNA, 15 bp, Homo sapiens
aagtcatgtgcattt

SEQ ID NO: 3319779 - DNA, 20 bp, Homo sapiens
aagtcattttaactttatca

SEQ ID NO: 3319780 - DNA, 21 bp, Homo sapiens
aagtccagctgggaagccctt

SEQ ID NO: 3319781 - DNA, 17 bp, Homo sapiens
aagtccatcaccctttc

SEQ ID NO: 3319782 - DNA, 20 bp, Homo sapiens
aagtcccagagcacctcacc

SEQ ID NO: 3319783 - DNA, 19 bp, Homo sapiens
aagtcccagtatacctcat

SEQ ID NO: 3319784 - DNA, 19 bp, Homo sapiens
aagtccctgactctctgtg

SEQ ID NO: 3319785 - DNA, 21 bp, Homo sapiens
aagtccctgttttctgagccc

SEQ ID NO: 3319786 - DNA, 22 bp, Homo sapiens
aagtccctgttttctgagcccg

SEQ ID NO: 3319787 - DNA, 19 bp, Homo sapiens
aagtccgcagaagccctga

SEQ ID NO: 3319788 - DNA, 22 bp, Homo sapiens
aagtcctcttttctgagaggac

SEQ ID NO: 3319789 - DNA, 17 bp, Homo sapiens
aagtcctgaagaggcgg

SEQ ID NO: 3319790 - DNA, 22 bp, Homo sapiens
aagtcctgaagaggcgggccag

SEQ ID NO: 3319791 - DNA, 23 bp, Homo sapiens
aagtcctggctacatcccagcct

SEQ ID NO: 3319792 - DNA, 15 bp, Homo sapiens
aagtcgaaggatgct

SEQ ID NO: 3319793 - DNA, 16 bp, Homo sapiens
aagtcggaacagcaga

SEQ ID NO: 3319794 - DNA, 15 bp, Homo sapiens
aagtcgttttccaaa

SEQ ID NO: 3319795 - DNA, 19 bp, Homo sapiens
aagtcgttttccaaactga

SEQ ID NO: 3319796 - DNA, 16 bp, Homo sapiens
aagtctacaaaaaggt

SEQ ID NO: 3319797 - DNA, 14 bp, Homo sapiens
aagtctacctgctg

SEQ ID NO: 3319798 - DNA, 17 bp, Homo sapiens
aagtctacctgctggac

SEQ ID NO: 3319799 - DNA, 11 bp, Homo sapiens
aagtctatttt

SEQ ID NO: 3319800 - DNA, 21 bp, Homo sapiens
aagtctatttttttaactgaa

SEQ ID NO: 3319801 - DNA, 21 bp, Homo sapiens
aatggacttatttcttcaaat

SEQ ID NO: 3319802 - DNA, 12 bp, Homo sapiens
aatggaggcttt

SEQ ID NO: 3319803 - DNA, 14 bp, Homo sapiens
aatggaggcttttc

SEQ ID NO: 3319804 - DNA, 19 bp, Homo sapiens
aatggagtcagtttgcagt

SEQ ID NO: 3319805 - DNA, 19 bp, Homo sapiens
aatggatactacatcttta

SEQ ID NO: 3319806 - DNA, 17 bp, Homo sapiens
aatggatattattagaa

SEQ ID NO: 3319807 - DNA, 19 bp, Homo sapiens
aatggatattattagaaat

SEQ ID NO: 3319808 - DNA, 18 bp, Homo sapiens
aatggattggattattta

SEQ ID NO: 3319809 - DNA, 23 bp, Homo sapiens
aatggattggattatttaataac

SEQ ID NO: 3319810 - DNA, 19 bp, Homo sapiens
aatggatttaatccatttt

SEQ ID NO: 3319811 - DNA, 13 bp, Homo sapiens
aatggatttttct

SEQ ID NO: 3319812 - DNA, 12 bp, Homo sapiens
aatggcactgat

SEQ ID NO: 3319813 - DNA, 19 bp, Homo sapiens
aatggcaggggaagccttg

SEQ ID NO: 3319814 - DNA, 22 bp, Homo sapiens
aatggccaaatggtttttgcaa

SEQ ID NO: 3319815 - DNA, 21 bp, Homo sapiens
aatggccctagaactgtgcct

SEQ ID NO: 3319816 - DNA, 14 bp, Homo sapiens
aatggcctgccttg

SEQ ID NO: 3319817 - DNA, 22 bp, Homo sapiens
aatggcctgccttgaagccact

SEQ ID NO: 3319818 - DNA, 14 bp, Homo sapiens
aatggccttccttc

SEQ ID NO: 3319819 - DNA, 23 bp, Homo sapiens
aatggctaataaactgtattaaa

SEQ ID NO: 3319820 - DNA, 19 bp, Homo sapiens
aatggctagtactgtattg

SEQ ID NO: 3319821 - DNA, 20 bp, Homo sapiens
aatggctcaagtagaaaagc

SEQ ID NO: 3319822 - DNA, 15 bp, Homo sapiens
aatggctgggtcagg

SEQ ID NO: 3319823 - DNA, 16 bp, Homo sapiens
aatggctgggtcaggg

SEQ ID NO: 3319824 - DNA, 13 bp, Homo sapiens
aatgggacactaa

SEQ ID NO: 3319825 - DNA, 23 bp, Homo sapiens
aatgggcactgggatgagccgct

SEQ ID NO: 3319826 - DNA, 15 bp, Homo sapiens
aatgggcctgcccaa

SEQ ID NO: 3319827 - DNA, 16 bp, Homo sapiens
aatgggctcaaccaga

SEQ ID NO: 3319828 - DNA, 18 bp, Homo sapiens
aatgggggtagcagctgg

SEQ ID NO: 3319829 - DNA, 21 bp, Homo sapiens
aatggggtttgggcccctcag

SEQ ID NO: 3319830 - DNA, 13 bp, Homo sapiens
aatgggtctttta

SEQ ID NO: 3319831 - DNA, 19 bp, Homo sapiens
aatggtatcctactgagca

SEQ ID NO: 3319832 - DNA, 14 bp, Homo sapiens
aatggtcagcgttg

SEQ ID NO: 3319833 - DNA, 20 bp, Homo sapiens
aatggtcagcgttgcatgtc

SEQ ID NO: 3319834 - DNA, 20 bp, Homo sapiens
aatggtccaattagtttcct

SEQ ID NO: 3319835 - DNA, 19 bp, Homo sapiens
aatggtcccatccaggcag

SEQ ID NO: 3319836 - DNA, 18 bp, Homo sapiens
aatggtctaaaaataaac

SEQ ID NO: 3319837 - DNA, 17 bp, Homo sapiens
aatggtgcttaagttcc

SEQ ID NO: 3319838 - DNA, 13 bp, Homo sapiens
aatggtgtacata

SEQ ID NO: 3319839 - DNA, 15 bp, Homo sapiens
aatggtgtagaacac

SEQ ID NO: 3319840 - DNA, 15 bp, Homo sapiens
aatggtgttccattg

SEQ ID NO: 3319841 - DNA, 19 bp, Homo sapiens
aatggtgttgtatgccttt

SEQ ID NO: 3319842 - DNA, 22 bp, Homo sapiens
aatggttcagaattaaactttt

SEQ ID NO: 3319843 - DNA, 20 bp, Homo sapiens
aatggttgatggaaaataaa

SEQ ID NO: 3319844 - DNA, 16 bp, Homo sapiens
aatggtttattttgta

SEQ ID NO: 3319845 - DNA, 22 bp, Homo sapiens
aatggtttattttgtattgtgg

SEQ ID NO: 3319846 - DNA, 21 bp, Homo sapiens
aatggtttggtgctttttata

SEQ ID NO: 3319847 - DNA, 15 bp, Homo sapiens
aatggttttgttttg

SEQ ID NO: 3319848 - DNA, 16 bp, Homo sapiens
aatgtaaaagaaaatt

SEQ ID NO: 3319849 - DNA, 16 bp, Homo sapiens
aatgtaaactgccata

SEQ ID NO: 3319850 - DNA, 22 bp, Homo sapiens
aatgtaaactttgtcatggttt

SEQ ID NO: 3319851 - DNA, 14 bp, Homo sapiens
aatgtaaaggaggg

SEQ ID NO: 3319852 - DNA, 16 bp, Homo sapiens
aatgtaaaggagggag

SEQ ID NO: 3319853 - DNA, 20 bp, Homo sapiens
aatgtaaaggagtcaaaact

SEQ ID NO: 3319854 - DNA, 21 bp, Homo sapiens
aatgtaaaggagtcaaaacta

SEQ ID NO: 3319855 - DNA, 23 bp, Homo sapiens
aatgtaaaggagtcaaaactaca

SEQ ID NO: 3319856 - DNA, 18 bp, Homo sapiens
aatgtaaatattctatat

SEQ ID NO: 3319857 - DNA, 17 bp, Homo sapiens
aatgtaacatcataatt

SEQ ID NO: 3319858 - DNA, 18 bp, Homo sapiens
aatgtaacatcataatta

SEQ ID NO: 3319859 - DNA, 15 bp, Homo sapiens
aatgtaacttttgta

SEQ ID NO: 3319860 - DNA, 19 bp, Homo sapiens
aatgtaagaaaacaaaatc

SEQ ID NO: 3319861 - DNA, 15 bp, Homo sapiens
aatgtaagaaaattt

SEQ ID NO: 3319862 - DNA, 22 bp, Homo sapiens
aatgtaagattatagattctaa

SEQ ID NO: 3319863 - DNA, 15 bp, Homo sapiens
aatgtaagctctact

SEQ ID NO: 3319864 - DNA, 16 bp, Homo sapiens
aatgtaatagggaaaa

SEQ ID NO: 3319865 - DNA, 14 bp, Homo sapiens
aatgtaattgaata

SEQ ID NO: 3319866 - DNA, 14 bp, Homo sapiens
aatgtaatttgtgt

SEQ ID NO: 3319867 - DNA, 23 bp, Homo sapiens
aatgtaatttgtgtaataaagtg

SEQ ID NO: 3319868 - DNA, 19 bp, Homo sapiens
aatgtacaagttttgtata

SEQ ID NO: 3319869 - DNA, 15 bp, Homo sapiens
aatgtactgagattt

SEQ ID NO: 3319870 - DNA, 14 bp, Homo sapiens
aatgtactgcatat

SEQ ID NO: 3319871 - DNA, 20 bp, Homo sapiens
aatgtacttttggataagta

SEQ ID NO: 3319872 - DNA, 23 bp, Homo sapiens
aatgtagcgactgtcaacagcgt

SEQ ID NO: 3319873 - DNA, 22 bp, Homo sapiens
aatgtagctatttttcttgttg

SEQ ID NO: 3319874 - DNA, 14 bp, Homo sapiens
aatgtagctggttt

SEQ ID NO: 3319875 - DNA, 17 bp, Homo sapiens
aatgtagctggtttcct

SEQ ID NO: 3319876 - DNA, 18 bp, Homo sapiens
aatgtataaagattgtac

SEQ ID NO: 3319877 - DNA, 15 bp, Homo sapiens
aatgtataaatatac

SEQ ID NO: 3319878 - DNA, 15 bp, Homo sapiens
aatgtatataaaaat

SEQ ID NO: 3319879 - DNA, 13 bp, Homo sapiens
aatgtatatacac

SEQ ID NO: 3319880 - DNA, 19 bp, Homo sapiens
aatgtatatacacatatac

SEQ ID NO: 3319881 - DNA, 21 bp, Homo sapiens
aatgtatatacacatatacct

SEQ ID NO: 3319882 - DNA, 14 bp, Homo sapiens
aatgtatattttgt

SEQ ID NO: 3319883 - DNA, 15 bp, Homo sapiens
aatgtatgtgaaagt

SEQ ID NO: 3319884 - DNA, 17 bp, Homo sapiens
aatgtatgtgaaagtgt

SEQ ID NO: 3319885 - DNA, 19 bp, Homo sapiens
aatgtatgtgaaagtgtaa

SEQ ID NO: 3319886 - DNA, 20 bp, Homo sapiens
aatgtatgtgaaagtgtaaa

SEQ ID NO: 3319887 - DNA, 21 bp, Homo sapiens
aatgtatgtgcactgtcactt

SEQ ID NO: 3319888 - DNA, 13 bp, Homo sapiens
aatgtatgttacc

SEQ ID NO: 3319889 - DNA, 17 bp, Homo sapiens
aatgtatgttaccaaaa

SEQ ID NO: 3319890 - DNA, 19 bp, Homo sapiens
aatgtattagtatggttca

SEQ ID NO: 3319891 - DNA, 17 bp, Homo sapiens
aatgtattcaagcaaac

SEQ ID NO: 3319892 - DNA, 21 bp, Homo sapiens
aatgtattcctgaaaagctgc

SEQ ID NO: 3319893 - DNA, 19 bp, Homo sapiens
aatgtattgttggtaatta

SEQ ID NO: 3319894 - DNA, 12 bp, Homo sapiens
aatgtatttatg

SEQ ID NO: 3319895 - DNA, 15 bp, Homo sapiens
aatgtatttgttcat

SEQ ID NO: 3319896 - DNA, 20 bp, Homo sapiens
aatgtatttgttcatgtttg

SEQ ID NO: 3319897 - DNA, 12 bp, Homo sapiens
aatgtattttga

SEQ ID NO: 3319898 - DNA, 13 bp, Homo sapiens
aatgtattttgaa

SEQ ID NO: 3319899 - DNA, 14 bp, Homo sapiens
aatgtatttttcta

SEQ ID NO: 3319900 - DNA, 19 bp, Homo sapiens
aatgtcacaaattgatcaa

SEQ ID NO: 3319901 - DNA, 17 bp, Homo sapiens
aatgtcacattctattt

SEQ ID NO: 3319902 - DNA, 17 bp, Homo sapiens
aatgtcacttaaaggct

SEQ ID NO: 3319903 - DNA, 18 bp, Homo sapiens
aatgtcagtgtttgggaa

SEQ ID NO: 3319904 - DNA, 19 bp, Homo sapiens
aatgtcatggccttgaaac

SEQ ID NO: 3319905 - DNA, 18 bp, Homo sapiens
aatgtcccctcaaactca

SEQ ID NO: 3319906 - DNA, 17 bp, Homo sapiens
aatgtcctccagaagcc

SEQ ID NO: 3319907 - DNA, 20 bp, Homo sapiens
aataaagaactccttatttt

SEQ ID NO: 3319908 - DNA, 16 bp, Homo sapiens
aataaagaatttaaag

SEQ ID NO: 3319909 - DNA, 15 bp, Homo sapiens
aataaagagttagaa

SEQ ID NO: 3319910 - DNA, 10 bp, Homo sapiens
aataaagcag

SEQ ID NO: 3319911 - DNA, 11 bp, Homo sapiens
aataaagcagc

SEQ ID NO: 3319912 - DNA, 13 bp, Homo sapiens
aataaagcattct

SEQ ID NO: 3319913 - DNA, 14 bp, Homo sapiens
aataaagcattctt

SEQ ID NO: 3319914 - DNA, 20 bp, Homo sapiens
aataaagcattctttaacag

SEQ ID NO: 3319915 - DNA, 12 bp, Homo sapiens
aataaagccttt

SEQ ID NO: 3319916 - DNA, 21 bp, Homo sapiens
aataaagccttttaaatcatc

SEQ ID NO: 3319917 - DNA, 18 bp, Homo sapiens
aataaagcttgtggcccc

SEQ ID NO: 3319918 - DNA, 11 bp, Homo sapiens
aataaaggcag

SEQ ID NO: 3319919 - DNA, 17 bp, Homo sapiens
aataaaggcagctgcct

SEQ ID NO: 3319920 - DNA, 19 bp, Homo sapiens
aataaaggcagctgcctct

SEQ ID NO: 3319921 - DNA, 20 bp, Homo sapiens
aataaaggcagctgcctctg

SEQ ID NO: 3319922 - DNA, 23 bp, Homo sapiens
aataaaggcagctgcctctgctc

SEQ ID NO: 3319923 - DNA, 19 bp, Homo sapiens
aataaaggcagttttctaa

SEQ ID NO: 3319924 - DNA, 15 bp, Homo sapiens
aataaagtatataat

SEQ ID NO: 3319925 - DNA, 16 bp, Homo sapiens
aataaagtgccttctg

SEQ ID NO: 3319926 - DNA, 15 bp, Homo sapiens
aataaagtgttttca

SEQ ID NO: 3319927 - DNA, 14 bp, Homo sapiens
aataaataacactt

SEQ ID NO: 3319928 - DNA, 23 bp, Homo sapiens
aataaatactgcagcttgagttt

SEQ ID NO: 3319929 - DNA, 13 bp, Homo sapiens
aataaatatactc

SEQ ID NO: 3319930 - DNA, 14 bp, Homo sapiens
aataaatatttatg

SEQ ID NO: 3319931 - DNA, 13 bp, Homo sapiens
aataaatcacaca

SEQ ID NO: 3319932 - DNA, 21 bp, Homo sapiens
aataaatcattaatactcttc

SEQ ID NO: 3319933 - DNA, 23 bp, Homo sapiens
aatgacaacagaaaaacaatctt

SEQ ID NO: 3319934 - DNA, 13 bp, Homo sapiens
aatgacagatggt

SEQ ID NO: 3319935 - DNA, 16 bp, Homo sapiens
aatgacagattctgac

SEQ ID NO: 3319936 - DNA, 17 bp, Homo sapiens
aatgacagattctgaca

SEQ ID NO: 3319937 - DNA, 12 bp, Homo sapiens
aatgacatgcac

SEQ ID NO: 3319938 - DNA, 15 bp, Homo sapiens
aatgacatgcactga

SEQ ID NO: 3319939 - DNA, 14 bp, Homo sapiens
aatgacgtttacat

SEQ ID NO: 3319940 - DNA, 16 bp, Homo sapiens
aatgactaattagggt

SEQ ID NO: 3319941 - DNA, 23 bp, Homo sapiens
aatgactatataatttatttcca

SEQ ID NO: 3319942 - DNA, 20 bp, Homo sapiens
aatgactcagaatattgctt

SEQ ID NO: 3319943 - DNA, 17 bp, Homo sapiens
aatgactccactgtttt

SEQ ID NO: 3319944 - DNA, 15 bp, Homo sapiens
aatgacttatttctg

SEQ ID NO: 3319945 - DNA, 20 bp, Homo sapiens
aatgacttatttctgctctg

SEQ ID NO: 3319946 - DNA, 15 bp, Homo sapiens
aatgagacgaaatgc

SEQ ID NO: 3319947 - DNA, 22 bp, Homo sapiens
aatgagacgaaatgctgatgta

SEQ ID NO: 3319948 - DNA, 18 bp, Homo sapiens
aatgagacttactgggtg

SEQ ID NO: 3319949 - DNA, 15 bp, Homo sapiens
aatgagattgaattt

SEQ ID NO: 3319950 - DNA, 22 bp, Homo sapiens
aatgagccatcactagaagaaa

SEQ ID NO: 3319951 - DNA, 19 bp, Homo sapiens
aatgagcccagagaacagc

SEQ ID NO: 3319952 - DNA, 17 bp, Homo sapiens
aatgagcttgattaaat

SEQ ID NO: 3319953 - DNA, 17 bp, Homo sapiens
aatgaggaaaattctta

SEQ ID NO: 3319954 - DNA, 16 bp, Homo sapiens
aatgaggtcagagcct

SEQ ID NO: 3319955 - DNA, 19 bp, Homo sapiens
aatgaggtcagcatgtcta

SEQ ID NO: 3319956 - DNA, 12 bp, Homo sapiens
aatgagtaacat

SEQ ID NO: 3319957 - DNA, 16 bp, Homo sapiens
aatgagtgaattgaat

SEQ ID NO: 3319958 - DNA, 13 bp, Homo sapiens
aatgagtgtgcat

SEQ ID NO: 3319959 - DNA, 13 bp, Homo sapiens
aatgagttgtgaa

SEQ ID NO: 3319960 - DNA, 21 bp, Homo sapiens
aatgataagtaaatgctaggt

SEQ ID NO: 3319961 - DNA, 15 bp, Homo sapiens
aatgatactgattat

SEQ ID NO: 3319962 - DNA, 17 bp, Homo sapiens
aatgatactgattatga

SEQ ID NO: 3319963 - DNA, 15 bp, Homo sapiens
aatgatagcccagaa

SEQ ID NO: 3319964 - DNA, 19 bp, Homo sapiens
aatgatcaaattttgagca

SEQ ID NO: 3319965 - DNA, 22 bp, Homo sapiens
aatgatcatatcaattggcagt

SEQ ID NO: 3319966 - DNA, 21 bp, Homo sapiens
aatgatcgaaaaaataattat

SEQ ID NO: 3319967 - DNA, 23 bp, Homo sapiens
aatgatgatgacgacgacaacga

SEQ ID NO: 3319968 - DNA, 18 bp, Homo sapiens
aatgatggcaattttgta

SEQ ID NO: 3319969 - DNA, 19 bp, Homo sapiens
aatgatggcaattttgtaa

SEQ ID NO: 3319970 - DNA, 15 bp, Homo sapiens
aatgatggcagagga

SEQ ID NO: 3319971 - DNA, 18 bp, Homo sapiens
aatgattaaagactgtga

SEQ ID NO: 3319972 - DNA, 16 bp, Homo sapiens
aatgattaatcaaagg

SEQ ID NO: 3319973 - DNA, 18 bp, Homo sapiens
aatgattattttcattac

SEQ ID NO: 3319974 - DNA, 19 bp, Homo sapiens
aatgattattttcattaca

SEQ ID NO: 3319975 - DNA, 16 bp, Homo sapiens
aatgattcataacaat

SEQ ID NO: 3319976 - DNA, 15 bp, Homo sapiens
aatgattcatgttat

SEQ ID NO: 3319977 - DNA, 16 bp, Homo sapiens
aatgattcatgttata

SEQ ID NO: 3319978 - DNA, 22 bp, Homo sapiens
aatgattcttccttttattaaa

SEQ ID NO: 3319979 - DNA, 13 bp, Homo sapiens
aatgattgtaaaa

SEQ ID NO: 3319980 - DNA, 20 bp, Homo sapiens
aatgattgtaaaatagcttg

SEQ ID NO: 3319981 - DNA, 14 bp, Homo sapiens
aatgatttcatatt

SEQ ID NO: 3319982 - DNA, 22 bp, Homo sapiens
aatgatttcatgctatctctgt

SEQ ID NO: 3319983 - DNA, 19 bp, Homo sapiens
aatgattttatctgtgaat

SEQ ID NO: 3319984 - DNA, 20 bp, Homo sapiens
aatgattttatctgtgaatt

SEQ ID NO: 3319985 - DNA, 14 bp, Homo sapiens
aatgatttttagat

SEQ ID NO: 3319986 - DNA, 14 bp, Homo sapiens
aatgcaaaattgtt

SEQ ID NO: 3319987 - DNA, 18 bp, Homo sapiens
aatgcaaaattgttttca

SEQ ID NO: 3319988 - DNA, 22 bp, Homo sapiens
aatgcaaaattgttttcacttg

SEQ ID NO: 3319989 - DNA, 14 bp, Homo sapiens
aatgcaaagctgaa

SEQ ID NO: 3319990 - DNA, 23 bp, Homo sapiens
aatgcaaagttctgtgtttaatt

SEQ ID NO: 3319991 - DNA, 13 bp, Homo sapiens
aatgcaaattaaa

SEQ ID NO: 3319992 - DNA, 18 bp, Homo sapiens
aatgcaaattaaaacata

SEQ ID NO: 3319993 - DNA, 21 bp, Homo sapiens
aatgcaaattaaaacatattt

SEQ ID NO: 3319994 - DNA, 24 bp, Homo sapiens
aatgcaatctccccttgatttaaa

SEQ ID NO: 3319995 - DNA, 16 bp, Homo sapiens
aatgcaatttgattga

SEQ ID NO: 3319996 - DNA, 17 bp, Homo sapiens
aatgcacaagaatggat

SEQ ID NO: 3319997 - DNA, 17 bp, Homo sapiens
aatgcacaagctcagaa

SEQ ID NO: 3319998 - DNA, 17 bp, Homo sapiens
aatgcacatccattccc

SEQ ID NO: 3319999 - DNA, 11 bp, Homo sapiens
aatgcacggcc

SEQ ID NO: 3320000 - DNA, 19 bp, Homo sapiens
aatgcacgtagctgaggcc

SEQ ID NO: 3320001 - DNA, 13 bp, Homo sapiens
aatgcactgtttt

SEQ ID NO: 3320002 - DNA, 16 bp, Homo sapiens
aatgcagattcctggg

SEQ ID NO: 3320003 - DNA, 17 bp, Homo sapiens
aatgcagattcctgggc

SEQ ID NO: 3320004 - DNA, 19 bp, Homo sapiens
aatgcagattcctgggcct

SEQ ID NO: 3320005 - DNA, 20 bp, Homo sapiens
aatgcagattcctgggcctg

SEQ ID NO: 3320006 - DNA, 21 bp, Homo sapiens
aatgcagattcctgggcctgt

SEQ ID NO: 3320007 - DNA, 23 bp, Homo sapiens
aatgcagcaaggccctgctgccc

SEQ ID NO: 3320008 - DNA, 13 bp, Homo sapiens
aatgcataaataa

SEQ ID NO: 3320009 - DNA, 18 bp, Homo sapiens
aatgcatagagccctggc

SEQ ID NO: 3320010 - DNA, 20 bp, Homo sapiens
aatgcatagagccctggcca

SEQ ID NO: 3320011 - DNA, 17 bp, Homo sapiens
aatgcattattttgaat

SEQ ID NO: 3320012 - DNA, 14 bp, Homo sapiens
aatgcattgaaaga

SEQ ID NO: 3320013 - DNA, 17 bp, Homo sapiens
aatgccatctatctagt

SEQ ID NO: 3320014 - DNA, 13 bp, Homo sapiens
aatgccatgaatt

SEQ ID NO: 3320015 - DNA, 21 bp, Homo sapiens
aatgccatttcagtggcttcc

SEQ ID NO: 3320016 - DNA, 17 bp, Homo sapiens
aatgccctcctaaatgt

SEQ ID NO: 3320017 - DNA, 18 bp, Homo sapiens
aatgccctcctaaatgtc

SEQ ID NO: 3320018 - DNA, 14 bp, Homo sapiens
aatgcctcctccct

SEQ ID NO: 3320019 - DNA, 19 bp, Homo sapiens
aatgcctcgctcccttcaa

SEQ ID NO: 3320020 - DNA, 14 bp, Homo sapiens
aatgccttgaactg

SEQ ID NO: 3320021 - DNA, 15 bp, Homo sapiens
aatgccttgtataaa

SEQ ID NO: 3320022 - DNA, 17 bp, Homo sapiens
aatgccttgtataaaat

SEQ ID NO: 3320023 - DNA, 18 bp, Homo sapiens
aatgcctttatatttcac

SEQ ID NO: 3320024 - DNA, 17 bp, Homo sapiens
aatgcctttgagacagt

SEQ ID NO: 3320025 - DNA, 20 bp, Homo sapiens
aatgctaaccttgtagcatg

SEQ ID NO: 3320026 - DNA, 18 bp, Homo sapiens
aatgctaggttaattcca

SEQ ID NO: 3320027 - DNA, 14 bp, Homo sapiens
aatgctctatgttt

SEQ ID NO: 3320028 - DNA, 18 bp, Homo sapiens
aatgctgaaaaaacacct

SEQ ID NO: 3320029 - DNA, 12 bp, Homo sapiens
aatgctgctcca

SEQ ID NO: 3320030 - DNA, 13 bp, Homo sapiens
aatgctgcttctc

SEQ ID NO: 3320031 - DNA, 22 bp, Homo sapiens
aatgctgcttctcctcccagcg

SEQ ID NO: 3320032 - DNA, 14 bp, Homo sapiens
aatgctggactgga

SEQ ID NO: 3320033 - DNA, 15 bp, Homo sapiens
aatgctggttttcct

SEQ ID NO: 3320034 - DNA, 18 bp, Homo sapiens
aatgctggttttcctaaa

SEQ ID NO: 3320035 - DNA, 15 bp, Homo sapiens
aatgctgtacatcta

SEQ ID NO: 3320036 - DNA, 15 bp, Homo sapiens
aatgcttaaactaaa

SEQ ID NO: 3320037 - DNA, 16 bp, Homo sapiens
aatgcttaatttctaa

SEQ ID NO: 3320038 - DNA, 17 bp, Homo sapiens
aatgcttaatttctaaa

SEQ ID NO: 3320039 - DNA, 21 bp, Homo sapiens
aatgcttcgttttctaaagga

SEQ ID NO: 3320040 - DNA, 18 bp, Homo sapiens
aatgcttctgtagcttct

SEQ ID NO: 3320041 - DNA, 14 bp, Homo sapiens
aatgctttggaaaa

SEQ ID NO: 3320042 - DNA, 17 bp, Homo sapiens
aatgctttgggaggcca

SEQ ID NO: 3320043 - DNA, 21 bp, Homo sapiens
aatgctttgggaggccaaggc

SEQ ID NO: 3320044 - DNA, 16 bp, Homo sapiens
aatatgattcactatt

SEQ ID NO: 3320045 - DNA, 23 bp, Homo sapiens
aatatgattttttaaaagaaatt

SEQ ID NO: 3320046 - DNA, 13 bp, Homo sapiens
aatatgcaagcag

SEQ ID NO: 3320047 - DNA, 18 bp, Homo sapiens
aatatgcaagcagctttt

SEQ ID NO: 3320048 - DNA, 23 bp, Homo sapiens
aatatgcctgcaatctgagccag

SEQ ID NO: 3320049 - DNA, 16 bp, Homo sapiens
aatatgcttaaaataa

SEQ ID NO: 3320050 - DNA, 19 bp, Homo sapiens
aatatgcttaaaataagca

SEQ ID NO: 3320051 - DNA, 11 bp, Homo sapiens
aatatgcttac

SEQ ID NO: 3320052 - DNA, 17 bp, Homo sapiens
aatatgcttataaccta

SEQ ID NO: 3320053 - DNA, 16 bp, Homo sapiens
aatatggaacttacat

SEQ ID NO: 3320054 - DNA, 17 bp, Homo sapiens
aatatggaacttacatt

SEQ ID NO: 3320055 - DNA, 17 bp, Homo sapiens
aatatggaacttctaat

SEQ ID NO: 3320056 - DNA, 18 bp, Homo sapiens
aatatggaacttctaata

SEQ ID NO: 3320057 - DNA, 15 bp, Homo sapiens
aatatgtatcctcta

SEQ ID NO: 3320058 - DNA, 11 bp, Homo sapiens
aatatgtatgc

SEQ ID NO: 3320059 - DNA, 14 bp, Homo sapiens
aatatgtattgtaa

SEQ ID NO: 3320060 - DNA, 15 bp, Homo sapiens
aatatgtattgtaaa

SEQ ID NO: 3320061 - DNA, 20 bp, Homo sapiens
aatatgtattgtaaacatgt

SEQ ID NO: 3320062 - DNA, 13 bp, Homo sapiens
aatatgtcctggg

SEQ ID NO: 3320063 - DNA, 13 bp, Homo sapiens
aatatgtttcctt

SEQ ID NO: 3320064 - DNA, 14 bp, Homo sapiens
aatatgtttccttg

SEQ ID NO: 3320065 - DNA, 13 bp, Homo sapiens
aatattaaagatt

SEQ ID NO: 3320066 - DNA, 13 bp, Homo sapiens
aatattaaataca

SEQ ID NO: 3320067 - DNA, 16 bp, Homo sapiens
aatattaaatacagac

SEQ ID NO: 3320068 - DNA, 13 bp, Homo sapiens
aatattaagaaag

SEQ ID NO: 3320069 - DNA, 14 bp, Homo sapiens
aatattaccaaaaa

SEQ ID NO: 3320070 - DNA, 17 bp, Homo sapiens
aatattactcctatttt

SEQ ID NO: 3320071 - DNA, 20 bp, Homo sapiens
aatattactcctatttttgt

SEQ ID NO: 3320072 - DNA, 16 bp, Homo sapiens
aatattactgtcttta

SEQ ID NO: 3320073 - DNA, 18 bp, Homo sapiens
aatattagtgattctgat

SEQ ID NO: 3320074 - DNA, 19 bp, Homo sapiens
aatattagtgattctgatt

SEQ ID NO: 3320075 - DNA, 20 bp, Homo sapiens
aatattagtgattctgattt

SEQ ID NO: 3320076 - DNA, 19 bp, Homo sapiens
aatattatttgtgtttcct

SEQ ID NO: 3320077 - DNA, 18 bp, Homo sapiens
aatattccagatctttca

SEQ ID NO: 3320078 - DNA, 13 bp, Homo sapiens
aatattcccaagc

SEQ ID NO: 3320079 - DNA, 20 bp, Homo sapiens
aatattcccctatctctaga

SEQ ID NO: 3320080 - DNA, 19 bp, Homo sapiens
aatattcctccaaatctct

SEQ ID NO: 3320081 - DNA, 16 bp, Homo sapiens
aatattctatatgaat

SEQ ID NO: 3320082 - DNA, 20 bp, Homo sapiens
aatattctatatgaatttaa

SEQ ID NO: 3320083 - DNA, 19 bp, Homo sapiens
aatattctccccacccacc

SEQ ID NO: 3320084 - DNA, 13 bp, Homo sapiens
aatattgaaaatt

SEQ ID NO: 3320085 - DNA, 20 bp, Homo sapiens
aatattgaaaattgaaaagt

SEQ ID NO: 3320086 - DNA, 14 bp, Homo sapiens
aatattgacttgta

SEQ ID NO: 3320087 - DNA, 20 bp, Homo sapiens
aatattgagaaagaaactaa

SEQ ID NO: 3320088 - DNA, 17 bp, Homo sapiens
aatattgatatgcttat

SEQ ID NO: 3320089 - DNA, 21 bp, Homo sapiens
aatattgatgttaacaagagg

SEQ ID NO: 3320090 - DNA, 23 bp, Homo sapiens
aatattgtgaagaaaaataaagt

SEQ ID NO: 3320091 - DNA, 10 bp, Homo sapiens
aatattgtgt

SEQ ID NO: 3320092 - DNA, 20 bp, Homo sapiens
aatattgttgacaactgtga

SEQ ID NO: 3320093 - DNA, 12 bp, Homo sapiens
aatattgtttct

SEQ ID NO: 3320094 - DNA, 14 bp, Homo sapiens
aatattgtttctgc

SEQ ID NO: 3320095 - DNA, 20 bp, Homo sapiens
aatattgtttggtaaatgtt

SEQ ID NO: 3320096 - DNA, 21 bp, Homo sapiens
aatattgtttggtaaatgttt

SEQ ID NO: 3320097 - DNA, 23 bp, Homo sapiens
aatattgtttggtaaatgtttct

SEQ ID NO: 3320098 - DNA, 18 bp, Homo sapiens
aatattgtttttctttct

SEQ ID NO: 3320099 - DNA, 14 bp, Homo sapiens
aatatttaagaaaa

SEQ ID NO: 3320100 - DNA, 13 bp, Homo sapiens
aatatttactctt

SEQ ID NO: 3320101 - DNA, 13 bp, Homo sapiens
aatatttataaaa

SEQ ID NO: 3320102 - DNA, 19 bp, Homo sapiens
aatatttataaatgagcaa

SEQ ID NO: 3320103 - DNA, 12 bp, Homo sapiens
aatatttatgga

SEQ ID NO: 3320104 - DNA, 13 bp, Homo sapiens
aatatttatggat

SEQ ID NO: 3320105 - DNA, 15 bp, Homo sapiens
aatatttatgtaaac

SEQ ID NO: 3320106 - DNA, 21 bp, Homo sapiens
aatatttatgtctatttaagc

SEQ ID NO: 3320107 - DNA, 11 bp, Homo sapiens
aatatttatta

SEQ ID NO: 3320108 - DNA, 12 bp, Homo sapiens
aatatttattaa

SEQ ID NO: 3320109 - DNA, 17 bp, Homo sapiens
aatatttattaaataaa

SEQ ID NO: 3320110 - DNA, 12 bp, Homo sapiens
aatatttattat

SEQ ID NO: 3320111 - DNA, 13 bp, Homo sapiens
aatatttcaagtg

SEQ ID NO: 3320112 - DNA, 13 bp, Homo sapiens
aatatttccatat

SEQ ID NO: 3320113 - DNA, 12 bp, Homo sapiens
aatatttcctga

SEQ ID NO: 3320114 - DNA, 19 bp, Homo sapiens
aatatttccttaaactgtg

SEQ ID NO: 3320115 - DNA, 12 bp, Homo sapiens
aatatttctatt

SEQ ID NO: 3320116 - DNA, 22 bp, Homo sapiens
aatatttgacttgcatgaagag

SEQ ID NO: 3320117 - DNA, 12 bp, Homo sapiens
aatatttgtaca

SEQ ID NO: 3320118 - DNA, 15 bp, Homo sapiens
aatattttagaagct

SEQ ID NO: 3320119 - DNA, 14 bp, Homo sapiens
aatattttattcta

SEQ ID NO: 3320120 - DNA, 13 bp, Homo sapiens
aatattttctatt

SEQ ID NO: 3320121 - DNA, 23 bp, Homo sapiens
aatattttctctgtacttttcat

SEQ ID NO: 3320122 - DNA, 16 bp, Homo sapiens
aatattttgataataa

SEQ ID NO: 3320123 - DNA, 14 bp, Homo sapiens
aatattttggaaac

SEQ ID NO: 3320124 - DNA, 13 bp, Homo sapiens
aatattttggatg

SEQ ID NO: 3320125 - DNA, 20 bp, Homo sapiens
aatatttttagctctgttct

SEQ ID NO: 3320126 - DNA, 15 bp, Homo sapiens
aatatttttatatca

SEQ ID NO: 3320127 - DNA, 23 bp, Homo sapiens
aatatttttatatcatgcaaaat

SEQ ID NO: 3320128 - DNA, 19 bp, Homo sapiens
aatattttttatatataca

SEQ ID NO: 3320129 - DNA, 23 bp, Homo sapiens
aatattttttatttctaagtatt

SEQ ID NO: 3320130 - DNA, 13 bp, Homo sapiens
aatcaaaacacac

SEQ ID NO: 3320131 - DNA, 14 bp, Homo sapiens
aatcaaaacacact

SEQ ID NO: 3320132 - DNA, 18 bp, Homo sapiens
aatcaaaactctcctaca

SEQ ID NO: 3320133 - DNA, 13 bp, Homo sapiens
aatcaaaattgtc

SEQ ID NO: 3320134 - DNA, 14 bp, Homo sapiens
aatcaaaattgtct

SEQ ID NO: 3320135 - DNA, 15 bp, Homo sapiens
aatcaaagaattaca

SEQ ID NO: 3320136 - DNA, 18 bp, Homo sapiens
aatcaaagaattacagta

SEQ ID NO: 3320137 - DNA, 23 bp, Homo sapiens
aatcaaagtagaaactactaatt

SEQ ID NO: 3320138 - DNA, 14 bp, Homo sapiens
aatcaaataagtat

SEQ ID NO: 3320139 - DNA, 14 bp, Homo sapiens
aatcaaatgatttc

SEQ ID NO: 3320140 - DNA, 16 bp, Homo sapiens
aatcaaatgatttcat

SEQ ID NO: 3320141 - DNA, 20 bp, Homo sapiens
aatcaaatgatttcatattg

SEQ ID NO: 3320142 - DNA, 13 bp, Homo sapiens
aatcaacagaagc

SEQ ID NO: 3320143 - DNA, 14 bp, Homo sapiens
aatcaacagaagca

SEQ ID NO: 3320144 - DNA, 16 bp, Homo sapiens
aatcaacagaagcatt

SEQ ID NO: 3320145 - DNA, 20 bp, Homo sapiens
aatcaaccctctcctgtctg

SEQ ID NO: 3320146 - DNA, 11 bp, Homo sapiens
aatcaacttta

SEQ ID NO: 3320147 - DNA, 15 bp, Homo sapiens
aatcaactttactgt

SEQ ID NO: 3320148 - DNA, 18 bp, Homo sapiens
aatcaagattttagggct

SEQ ID NO: 3320149 - DNA, 15 bp, Homo sapiens
aatcaataaagaaaa

SEQ ID NO: 3320150 - DNA, 19 bp, Homo sapiens
aatcaatacactagttgtt

SEQ ID NO: 3320151 - DNA, 20 bp, Homo sapiens
aatcaatacactagttgttt

SEQ ID NO: 3320152 - DNA, 14 bp, Homo sapiens
aatcaatacagctt

SEQ ID NO: 3320153 - DNA, 21 bp, Homo sapiens
aatcaatctttaacaacctct

SEQ ID NO: 3320154 - DNA, 19 bp, Homo sapiens
aatcaatgaaaaatgtaat

SEQ ID NO: 3320155 - DNA, 13 bp, Homo sapiens
aatcaatgaatat

SEQ ID NO: 3320156 - DNA, 19 bp, Homo sapiens
aatcaatgaatattgaagt

SEQ ID NO: 3320157 - DNA, 16 bp, Homo sapiens
aatcaccctaccaact

SEQ ID NO: 3320158 - DNA, 15 bp, Homo sapiens
aatcaccttctttgt

SEQ ID NO: 3320159 - DNA, 16 bp, Homo sapiens
aatcaccttctttgta

SEQ ID NO: 3320160 - DNA, 20 bp, Homo sapiens
aatcacggtggtaaagaaag

SEQ ID NO: 3320161 - DNA, 16 bp, Homo sapiens
aatcactaaactttat

SEQ ID NO: 3320162 - DNA, 18 bp, Homo sapiens
aatcactctaattaattg

SEQ ID NO: 3320163 - DNA, 17 bp, Homo sapiens
aatcactgcactgcatg

SEQ ID NO: 3320164 - DNA, 22 bp, Homo sapiens
aatcactgcactgcatgcaaac

SEQ ID NO: 3320165 - DNA, 17 bp, Homo sapiens
aatcactgcagcccagg

SEQ ID NO: 3320166 - DNA, 20 bp, Homo sapiens
aatcactgcagcccaggagg

SEQ ID NO: 3320167 - DNA, 14 bp, Homo sapiens
aatcactgttttta

SEQ ID NO: 3320168 - DNA, 19 bp, Homo sapiens
aatcagaaaagtaattttg

SEQ ID NO: 3320169 - DNA, 22 bp, Homo sapiens
aatcagaaaagtaattttgtca

SEQ ID NO: 3320170 - DNA, 13 bp, Homo sapiens
aatcagaaatttt

SEQ ID NO: 3320171 - DNA, 20 bp, Homo sapiens
aatcagaagtcatcttgcta

SEQ ID NO: 3320172 - DNA, 13 bp, Homo sapiens
aatctcaaataac

SEQ ID NO: 3320173 - DNA, 22 bp, Homo sapiens
aatctcaaataggctattaaaa

SEQ ID NO: 3320174 - DNA, 21 bp, Homo sapiens
aatctcagaatttatctccct

SEQ ID NO: 3320175 - DNA, 14 bp, Homo sapiens
aatctcagtgcttt

SEQ ID NO: 3320176 - DNA, 16 bp, Homo sapiens
aatctcatacctctga

SEQ ID NO: 3320177 - DNA, 23 bp, Homo sapiens
aatctcataggttgccaataata

SEQ ID NO: 3320178 - DNA, 12 bp, Homo sapiens
aatctcattccc

SEQ ID NO: 3320179 - DNA, 12 bp, Homo sapiens
accttgcttctt

SEQ ID NO: 3320180 - DNA, 19 bp, Homo sapiens
accttggcctctccttgga

SEQ ID NO: 3320181 - DNA, 12 bp, Homo sapiens
accttggctcaa

SEQ ID NO: 3320182 - DNA, 16 bp, Homo sapiens
accttggctctgccag

SEQ ID NO: 3320183 - DNA, 14 bp, Homo sapiens
accttggctgcagg

SEQ ID NO: 3320184 - DNA, 17 bp, Homo sapiens
accttggctgcagggag

SEQ ID NO: 3320185 - DNA, 19 bp, Homo sapiens
accttgtaaaaaaagcaaa

SEQ ID NO: 3320186 - DNA, 21 bp, Homo sapiens
accttgtaaccagtgcagaaa

SEQ ID NO: 3320187 - DNA, 18 bp, Homo sapiens
accttgtgcccagggttt

SEQ ID NO: 3320188 - DNA, 12 bp, Homo sapiens
accttgtgtctg

SEQ ID NO: 3320189 - DNA, 15 bp, Homo sapiens
accttgtgtctgtac

SEQ ID NO: 3320190 - DNA, 16 bp, Homo sapiens
accttgttcctgccct

SEQ ID NO: 3320191 - DNA, 20 bp, Homo sapiens
accttgttctatttttcaat

SEQ ID NO: 3320192 - DNA, 18 bp, Homo sapiens
acctttaaaattgtcacc

SEQ ID NO: 3320193 - DNA, 12 bp, Homo sapiens
acctttactgtg

SEQ ID NO: 3320194 - DNA, 15 bp, Homo sapiens
acctttagggcagct

SEQ ID NO: 3320195 - DNA, 17 bp, Homo sapiens
acctttattttagaatt

SEQ ID NO: 3320196 - DNA, 20 bp, Homo sapiens
acctttcaccctcatgaaaa

SEQ ID NO: 3320197 - DNA, 13 bp, Homo sapiens
acctttcccatct

SEQ ID NO: 3320198 - DNA, 18 bp, Homo sapiens
acctttcccatcttccaa

SEQ ID NO: 3320199 - DNA, 20 bp, Homo sapiens
acctttgagtagatccattt

SEQ ID NO: 3320200 - DNA, 14 bp, Homo sapiens
acctttgctatgta

SEQ ID NO: 3320201 - DNA, 15 bp, Homo sapiens
acctttgctatgtaa

SEQ ID NO: 3320202 - DNA, 18 bp, Homo sapiens
acctttggagcaaagctg

SEQ ID NO: 3320203 - DNA, 19 bp, Homo sapiens
acctttgtaagacatttgt

SEQ ID NO: 3320204 - DNA, 20 bp, Homo sapiens
acctttgtaagacatttgta

SEQ ID NO: 3320205 - DNA, 19 bp, Homo sapiens
acctttgtagttactcaag

SEQ ID NO: 3320206 - DNA, 24 bp, Homo sapiens
acctttgtagttactcaagcagtt

SEQ ID NO: 3320207 - DNA, 20 bp, Homo sapiens
acctttgtttccttattcag

SEQ ID NO: 3320208 - DNA, 14 bp, Homo sapiens
accttttattacat

SEQ ID NO: 3320209 - DNA, 13 bp, Homo sapiens
accttttattata

SEQ ID NO: 3320210 - DNA, 19 bp, Homo sapiens
accttttgaagtagtttgt

SEQ ID NO: 3320211 - DNA, 19 bp, Homo sapiens
accttttgggaatgtttta

SEQ ID NO: 3320212 - DNA, 22 bp, Homo sapiens
accttttgggaatgttttaaat

SEQ ID NO: 3320213 - DNA, 21 bp, Homo sapiens
acctttttccctcttcccaga

SEQ ID NO: 3320214 - DNA, 19 bp, Homo sapiens
acctttttcttgatcttaa

SEQ ID NO: 3320215 - DNA, 15 bp, Homo sapiens
acctttttgtatgtg

SEQ ID NO: 3320216 - DNA, 18 bp, Homo sapiens
acctttttgtatgtgaac

SEQ ID NO: 3320217 - DNA, 19 bp, Homo sapiens
acctttttgtatgtgaaca

SEQ ID NO: 3320218 - DNA, 15 bp, Homo sapiens
accttttttaagatt

SEQ ID NO: 3320219 - DNA, 16 bp, Homo sapiens
acctttttttttgaaa

SEQ ID NO: 3320220 - DNA, 17 bp, Homo sapiens
acctttttttttgaaac

SEQ ID NO: 3320221 - DNA, 19 bp, Homo sapiens
acctttttttttgaaacag

SEQ ID NO: 3320222 - DNA, 18 bp, Homo sapiens
acgaaacttgttattgtg

SEQ ID NO: 3320223 - DNA, 21 bp, Homo sapiens
acgaaacttgttattgtgaat

SEQ ID NO: 3320224 - DNA, 13 bp, Homo sapiens
acgaaatgttatt

SEQ ID NO: 3320225 - DNA, 16 bp, Homo sapiens
acgaacacaagaaaaa

SEQ ID NO: 3320226 - DNA, 22 bp, Homo sapiens
acgaaggggccccggggctggc

SEQ ID NO: 3320227 - DNA, 23 bp, Homo sapiens
acgaaggggccccggggctggca

SEQ ID NO: 3320228 - DNA, 22 bp, Homo sapiens
acgaccagccccttcctgggta

SEQ ID NO: 3320229 - DNA, 14 bp, Homo sapiens
acgacgctgcagag

SEQ ID NO: 3320230 - DNA, 22 bp, Homo sapiens
acgacttcagggcagggctctg

SEQ ID NO: 3320231 - DNA, 19 bp, Homo sapiens
acgagatcaagagatcaag

SEQ ID NO: 3320232 - DNA, 14 bp, Homo sapiens
acgagcactggcca

SEQ ID NO: 3320233 - DNA, 20 bp, Homo sapiens
acgagctggaacccacgagg

SEQ ID NO: 3320234 - DNA, 20 bp, Homo sapiens
acgagggaggaacacctgat

SEQ ID NO: 3320235 - DNA, 21 bp, Homo sapiens
acgagggctgatggaggaaaa

SEQ ID NO: 3320236 - DNA, 12 bp, Homo sapiens
acgagggctggc

SEQ ID NO: 3320237 - DNA, 19 bp, Homo sapiens
acgaggggcagggaaggac

SEQ ID NO: 3320238 - DNA, 20 bp, Homo sapiens
acgaggggtgtcttgggcag

SEQ ID NO: 3320239 - DNA, 21 bp, Homo sapiens
acgaggggtgtcttgggcaga

SEQ ID NO: 3320240 - DNA, 13 bp, Homo sapiens
acgagtcacctgc

SEQ ID NO: 3320241 - DNA, 20 bp, Homo sapiens
acgagtcacctgcaagcccc

SEQ ID NO: 3320242 - DNA, 19 bp, Homo sapiens
acgagttaatgatggcaga

SEQ ID NO: 3320243 - DNA, 23 bp, Homo sapiens
acgatacgctactataaagagaa

SEQ ID NO: 3320244 - DNA, 16 bp, Homo sapiens
acgatcccctccccca

SEQ ID NO: 3320245 - DNA, 19 bp, Homo sapiens
acgatcctgccaccctgta

SEQ ID NO: 3320246 - DNA, 20 bp, Homo sapiens
acgatcctgccaccctgtag

SEQ ID NO: 3320247 - DNA, 21 bp, Homo sapiens
acgatcctgccaccctgtagc

SEQ ID NO: 3320248 - DNA, 15 bp, Homo sapiens
acgatgaatttcttc

SEQ ID NO: 3320249 - DNA, 19 bp, Homo sapiens
acgatgaatttcttctaat

SEQ ID NO: 3320250 - DNA, 14 bp, Homo sapiens
acgatgacagtgtt

SEQ ID NO: 3320251 - DNA, 20 bp, Homo sapiens
acgatgcatttaataaagat

SEQ ID NO: 3320252 - DNA, 23 bp, Homo sapiens
acgatgcatttaataaagatgag

SEQ ID NO: 3320253 - DNA, 23 bp, Homo sapiens
acgatggggggctgatggctgcc

SEQ ID NO: 3320254 - DNA, 15 bp, Homo sapiens
acgatgtgtctgtat

SEQ ID NO: 3320255 - DNA, 23 bp, Homo sapiens
acgatgtgtctgtatttcatgtg

SEQ ID NO: 3320256 - DNA, 14 bp, Homo sapiens
acgattagctttat

SEQ ID NO: 3320257 - DNA, 11 bp, Homo sapiens
acgatttgtct

SEQ ID NO: 3320258 - DNA, 17 bp, Homo sapiens
acgcaaatacactccag

SEQ ID NO: 3320259 - DNA, 18 bp, Homo sapiens
acgcaagggcatcaggca

SEQ ID NO: 3320260 - DNA, 14 bp, Homo sapiens
acgcacacacacaa

SEQ ID NO: 3320261 - DNA, 13 bp, Homo sapiens
acgcacaccctgc

SEQ ID NO: 3320262 - DNA, 16 bp, Homo sapiens
acgcacgcacacacac

SEQ ID NO: 3320263 - DNA, 18 bp, Homo sapiens
acgcacgctcgctgccat

SEQ ID NO: 3320264 - DNA, 17 bp, Homo sapiens
acgcactccatgagcac

SEQ ID NO: 3320265 - DNA, 21 bp, Homo sapiens
acgcactccatgagcacccca

SEQ ID NO: 3320266 - DNA, 17 bp, Homo sapiens
acgcactgggccacgga

SEQ ID NO: 3320267 - DNA, 17 bp, Homo sapiens
acgcagatgatccatga

SEQ ID NO: 3320268 - DNA, 12 bp, Homo sapiens
acgcagccctgc

SEQ ID NO: 3320269 - DNA, 23 bp, Homo sapiens
acgcagccctgctttgggctgcc

SEQ ID NO: 3320270 - DNA, 23 bp, Homo sapiens
acgcaggagaatcactgcagccc

SEQ ID NO: 3320271 - DNA, 20 bp, Homo sapiens
acgccactgcactccagcct

SEQ ID NO: 3320272 - DNA, 14 bp, Homo sapiens
acgccagtctccca

SEQ ID NO: 3320273 - DNA, 15 bp, Homo sapiens
acgccagtctcccag

SEQ ID NO: 3320274 - DNA, 21 bp, Homo sapiens
acgccccagataccagcccct

SEQ ID NO: 3320275 - DNA, 17 bp, Homo sapiens
acgcccccaggaatgca

SEQ ID NO: 3320276 - DNA, 18 bp, Homo sapiens
acgccccgggcaaagggt

SEQ ID NO: 3320277 - DNA, 16 bp, Homo sapiens
acgcccctgtggccaa

SEQ ID NO: 3320278 - DNA, 20 bp, Homo sapiens
acgcccgtcctgcctgtggc

SEQ ID NO: 3320279 - DNA, 12 bp, Homo sapiens
acgccctcccct

SEQ ID NO: 3320280 - DNA, 13 bp, Homo sapiens
acgccctcccctc

SEQ ID NO: 3320281 - DNA, 22 bp, Homo sapiens
acgccctcccctcccctgctgc

SEQ ID NO: 3320282 - DNA, 22 bp, Homo sapiens
acgccctccctctcccaggccc

SEQ ID NO: 3320283 - DNA, 17 bp, Homo sapiens
acgcccttggccatggg

SEQ ID NO: 3320284 - DNA, 18 bp, Homo sapiens
acgccgtctccatggcat

SEQ ID NO: 3320285 - DNA, 12 bp, Homo sapiens
acgcctcctggc

SEQ ID NO: 3320286 - DNA, 19 bp, Homo sapiens
acgcctcttttccctctct

SEQ ID NO: 3320287 - DNA, 22 bp, Homo sapiens
acgcctgccctccccagagcac

SEQ ID NO: 3320288 - DNA, 11 bp, Homo sapiens
acgcctggcta

SEQ ID NO: 3320289 - DNA, 18 bp, Homo sapiens
acgcctgtaatcccagca

SEQ ID NO: 3320290 - DNA, 21 bp, Homo sapiens
acgcctgtaatcccagcactt

SEQ ID NO: 3320291 - DNA, 16 bp, Homo sapiens
acgccttccaggtcag

SEQ ID NO: 3320292 - DNA, 18 bp, Homo sapiens
acgccttccaggtcagga

SEQ ID NO: 3320293 - DNA, 20 bp, Homo sapiens
acgcgccttgtctcctactc

SEQ ID NO: 3320294 - DNA, 18 bp, Homo sapiens
acgcgcttcgacttttct

SEQ ID NO: 3320295 - DNA, 15 bp, Homo sapiens
acgcgtcttcctgag

SEQ ID NO: 3320296 - DNA, 17 bp, Homo sapiens
acgctaaagagcccttg

SEQ ID NO: 3320297 - DNA, 19 bp, Homo sapiens
acgctaacaatttctcata

SEQ ID NO: 3320298 - DNA, 19 bp, Homo sapiens
acgctccagctgccccggc

SEQ ID NO: 3320299 - DNA, 14 bp, Homo sapiens
acgctcccccgcag

SEQ ID NO: 3320300 - DNA, 14 bp, Homo sapiens
acgctccccgcctg

SEQ ID NO: 3320301 - DNA, 19 bp, Homo sapiens
acgctccccgcctgttccc

SEQ ID NO: 3320302 - DNA, 12 bp, Homo sapiens
acgctcgctgcc

SEQ ID NO: 3320303 - DNA, 14 bp, Homo sapiens
acgctcgctgccat

SEQ ID NO: 3320304 - DNA, 23 bp, Homo sapiens
acgctcgctgccatcaccgctgg

SEQ ID NO: 3320305 - DNA, 15 bp, Homo sapiens
acgctctctggcctt

SEQ ID NO: 3320306 - DNA, 16 bp, Homo sapiens
acgctctctggccttc

SEQ ID NO: 3320307 - DNA, 16 bp, Homo sapiens
acgctgatacataact

SEQ ID NO: 3320308 - DNA, 18 bp, Homo sapiens
acctgccctctatttatt

SEQ ID NO: 3320309 - DNA, 12 bp, Homo sapiens
acctgccctgcc

SEQ ID NO: 3320310 - DNA, 13 bp, Homo sapiens
acctgccctggaa

SEQ ID NO: 3320311 - DNA, 13 bp, Homo sapiens
acctgcctcctcg

SEQ ID NO: 3320312 - DNA, 21 bp, Homo sapiens
acctgcctcggcctcccaaag

SEQ ID NO: 3320313 - DNA, 19 bp, Homo sapiens
acctgcctctcacacacat

SEQ ID NO: 3320314 - DNA, 16 bp, Homo sapiens
acctgctccgctgctc

SEQ ID NO: 3320315 - DNA, 19 bp, Homo sapiens
acctgctctcctcttgcca

SEQ ID NO: 3320316 - DNA, 16 bp, Homo sapiens
acctgctgcgtcccca

SEQ ID NO: 3320317 - DNA, 20 bp, Homo sapiens
acctgctgcgtccccactcc

SEQ ID NO: 3320318 - DNA, 13 bp, Homo sapiens
acctgctggacag

SEQ ID NO: 3320319 - DNA, 19 bp, Homo sapiens
acctgctggacagcctccg

SEQ ID NO: 3320320 - DNA, 17 bp, Homo sapiens
acctgctgggtaaactg

SEQ ID NO: 3320321 - DNA, 21 bp, Homo sapiens
acctgctgtgatacgatgctt

SEQ ID NO: 3320322 - DNA, 16 bp, Homo sapiens
acctgcttcctgaaat

SEQ ID NO: 3320323 - DNA, 15 bp, Homo sapiens
acctgctttcaagac

SEQ ID NO: 3320324 - DNA, 13 bp, Homo sapiens
acctgctttttga

SEQ ID NO: 3320325 - DNA, 17 bp, Homo sapiens
acctgctttttgaaatg

SEQ ID NO: 3320326 - DNA, 23 bp, Homo sapiens
acctgctttttgaaatgaaattt

SEQ ID NO: 3320327 - DNA, 20 bp, Homo sapiens
acctggaactgtagggccag

SEQ ID NO: 3320328 - DNA, 15 bp, Homo sapiens
acctggacctggaac

SEQ ID NO: 3320329 - DNA, 22 bp, Homo sapiens
acctggactgagccaaggaggc

SEQ ID NO: 3320330 - DNA, 15 bp, Homo sapiens
acctggagtttaata

SEQ ID NO: 3320331 - DNA, 17 bp, Homo sapiens
acctggatccagcactg

SEQ ID NO: 3320332 - DNA, 21 bp, Homo sapiens
acctggcatcgcaccattctg

SEQ ID NO: 3320333 - DNA, 13 bp, Homo sapiens
acctggccacctg

SEQ ID NO: 3320334 - DNA, 21 bp, Homo sapiens
acctggccacctgaggtgggc

SEQ ID NO: 3320335 - DNA, 22 bp, Homo sapiens
acctggccgcgtttagaccaag

SEQ ID NO: 3320336 - DNA, 17 bp, Homo sapiens
acctggccgctaagttg

SEQ ID NO: 3320337 - DNA, 13 bp, Homo sapiens
acctggcctgctg

SEQ ID NO: 3320338 - DNA, 14 bp, Homo sapiens
acctggcctgctgg

SEQ ID NO: 3320339 - DNA, 16 bp, Homo sapiens
acctggcctgctggga

SEQ ID NO: 3320340 - DNA, 13 bp, Homo sapiens
acctggcctgtgg

SEQ ID NO: 3320341 - DNA, 17 bp, Homo sapiens
acctggccttaaagagg

SEQ ID NO: 3320342 - DNA, 13 bp, Homo sapiens
acctggctgaggt

SEQ ID NO: 3320343 - DNA, 19 bp, Homo sapiens
acctggcttttactttatt

SEQ ID NO: 3320344 - DNA, 15 bp, Homo sapiens
acctgggaaaggacc

SEQ ID NO: 3320345 - DNA, 23 bp, Homo sapiens
acctgggaaaggacccacccatc

SEQ ID NO: 3320346 - DNA, 20 bp, Homo sapiens
acctgggatgaggggtgctg

SEQ ID NO: 3320347 - DNA, 14 bp, Homo sapiens
acctgggccctgga

SEQ ID NO: 3320348 - DNA, 14 bp, Homo sapiens
acctgggtccaaat

SEQ ID NO: 3320349 - DNA, 17 bp, Homo sapiens
acctgggtccaaataaa

SEQ ID NO: 3320350 - DNA, 16 bp, Homo sapiens
acctggtaccctcctg

SEQ ID NO: 3320351 - DNA, 21 bp, Homo sapiens
acctggtcacaggactctgcc

SEQ ID NO: 3320352 - DNA, 22 bp, Homo sapiens
acctggtcacaggactctgcct

SEQ ID NO: 3320353 - DNA, 10 bp, Homo sapiens
acctggtgct

SEQ ID NO: 3320354 - DNA, 22 bp, Homo sapiens
acctggtgctggatattttcaa

SEQ ID NO: 3320355 - DNA, 12 bp, Homo sapiens
acctggtggcac

SEQ ID NO: 3320356 - DNA, 15 bp, Homo sapiens
acctgtaacttttgt

SEQ ID NO: 3320357 - DNA, 15 bp, Homo sapiens
acctgtaatcccagc

SEQ ID NO: 3320358 - DNA, 20 bp, Homo sapiens
acctgtaatcccagctactt

SEQ ID NO: 3320359 - DNA, 12 bp, Homo sapiens
acctgtactcag

SEQ ID NO: 3320360 - DNA, 16 bp, Homo sapiens
acctgtagtcccagct

SEQ ID NO: 3320361 - DNA, 19 bp, Homo sapiens
acctgtagtcccagctact

SEQ ID NO: 3320362 - DNA, 17 bp, Homo sapiens
acctgtatgtctccagt

SEQ ID NO: 3320363 - DNA, 14 bp, Homo sapiens
acctgtcaatacta

SEQ ID NO: 3320364 - DNA, 19 bp, Homo sapiens
acctgtcaccgtgagcagc

SEQ ID NO: 3320365 - DNA, 18 bp, Homo sapiens
acctgtcatgcccccctc

SEQ ID NO: 3320366 - DNA, 16 bp, Homo sapiens
acctgtctcagctgtt

SEQ ID NO: 3320367 - DNA, 16 bp, Homo sapiens
acctgtctccactgtg

SEQ ID NO: 3320368 - DNA, 17 bp, Homo sapiens
acctgtctccactgtgc

SEQ ID NO: 3320369 - DNA, 13 bp, Homo sapiens
acctgtgacaaag

SEQ ID NO: 3320370 - DNA, 23 bp, Homo sapiens
acctgtgaccagcactgtctcag

SEQ ID NO: 3320371 - DNA, 18 bp, Homo sapiens
acctgtgagtttaaagca

SEQ ID NO: 3320372 - DNA, 18 bp, Homo sapiens
acctgtgccctcaccacc

SEQ ID NO: 3320373 - DNA, 13 bp, Homo sapiens
acctgtggatatt

SEQ ID NO: 3320374 - DNA, 12 bp, Homo sapiens
acctgtgggtgt

SEQ ID NO: 3320375 - DNA, 16 bp, Homo sapiens
acctgtgtacataact

SEQ ID NO: 3320376 - DNA, 16 bp, Homo sapiens
acctgtgtgagagaat

SEQ ID NO: 3320377 - DNA, 20 bp, Homo sapiens
acctgtgtggtactctgaaa

SEQ ID NO: 3320378 - DNA, 17 bp, Homo sapiens
acctgttacctactttg

SEQ ID NO: 3320379 - DNA, 14 bp, Homo sapiens
acctgttatgtatg

SEQ ID NO: 3320380 - DNA, 15 bp, Homo sapiens
acctgttattttatg

SEQ ID NO: 3320381 - DNA, 17 bp, Homo sapiens
acctgttcacagaaaaa

SEQ ID NO: 3320382 - DNA, 22 bp, Homo sapiens
acctgttcacagaaaaagcatg

SEQ ID NO: 3320383 - DNA, 17 bp, Homo sapiens
acctgttcttagagtgt

SEQ ID NO: 3320384 - DNA, 20 bp, Homo sapiens
acctgttcttagagtgtagc

SEQ ID NO: 3320385 - DNA, 18 bp, Homo sapiens
acctgttttcgcacctac

SEQ ID NO: 3320386 - DNA, 16 bp, Homo sapiens
acctgtttttaagctg

SEQ ID NO: 3320387 - DNA, 18 bp, Homo sapiens
acctgtttttaagctgtt

SEQ ID NO: 3320388 - DNA, 14 bp, Homo sapiens
accttaatttatat

SEQ ID NO: 3320389 - DNA, 15 bp, Homo sapiens
accttaccaactttc

SEQ ID NO: 3320390 - DNA, 18 bp, Homo sapiens
accttaccaactttctgt

SEQ ID NO: 3320391 - DNA, 13 bp, Homo sapiens
accttactaatta

SEQ ID NO: 3320392 - DNA, 22 bp, Homo sapiens
accttagaaatcattgtagaaa

SEQ ID NO: 3320393 - DNA, 20 bp, Homo sapiens
accttagataatatttctga

SEQ ID NO: 3320394 - DNA, 20 bp, Homo sapiens
accttagctccctcccgcac

SEQ ID NO: 3320395 - DNA, 23 bp, Homo sapiens
accttagctccctcccgcacccc

SEQ ID NO: 3320396 - DNA, 15 bp, Homo sapiens
accttaggccttcct

SEQ ID NO: 3320397 - DNA, 18 bp, Homo sapiens
accttaggccttcctctc

SEQ ID NO: 3320398 - DNA, 14 bp, Homo sapiens
accttatagttact

SEQ ID NO: 3320399 - DNA, 18 bp, Homo sapiens
accttatagttactgtgt

SEQ ID NO: 3320400 - DNA, 13 bp, Homo sapiens
accttatctgtgc

SEQ ID NO: 3320401 - DNA, 22 bp, Homo sapiens
accttatctgtgcgtgaaacac

SEQ ID NO: 3320402 - DNA, 17 bp, Homo sapiens
accttattgtacctctc

SEQ ID NO: 3320403 - DNA, 18 bp, Homo sapiens
accttattgtacctctct

SEQ ID NO: 3320404 - DNA, 22 bp, Homo sapiens
accttatttgctaatcaaagcc

SEQ ID NO: 3320405 - DNA, 15 bp, Homo sapiens
accttcaaagaaact

SEQ ID NO: 3320406 - DNA, 16 bp, Homo sapiens
accttcaacccagtgg

SEQ ID NO: 3320407 - DNA, 22 bp, Homo sapiens
acctcactgagaggcctggagc

SEQ ID NO: 3320408 - DNA, 19 bp, Homo sapiens
acctcagaaagtcaccagg

SEQ ID NO: 3320409 - DNA, 23 bp, Homo sapiens
acctcagaaagtcaccaggactt

SEQ ID NO: 3320410 - DNA, 13 bp, Homo sapiens
acctcagcctaga

SEQ ID NO: 3320411 - DNA, 11 bp, Homo sapiens
acctcagcctc

SEQ ID NO: 3320412 - DNA, 14 bp, Homo sapiens
acctcagctctggg

SEQ ID NO: 3320413 - DNA, 15 bp, Homo sapiens
acctcagctctggga

SEQ ID NO: 3320414 - DNA, 18 bp, Homo sapiens
acctcagctctgggagag

SEQ ID NO: 3320415 - DNA, 22 bp, Homo sapiens
acctcagctctgggagaggatt

SEQ ID NO: 3320416 - DNA, 16 bp, Homo sapiens
acctcaggcagctcaa

SEQ ID NO: 3320417 - DNA, 15 bp, Homo sapiens
acctcaggcaggaag

SEQ ID NO: 3320418 - DNA, 18 bp, Homo sapiens
acctcaggcttccttggc

SEQ ID NO: 3320419 - DNA, 10 bp, Homo sapiens
acctcagggc

SEQ ID NO: 3320420 - DNA, 22 bp, Homo sapiens
acctcagggcacgcaggaccag

SEQ ID NO: 3320421 - DNA, 15 bp, Homo sapiens
acctcaggtgatcca

SEQ ID NO: 3320422 - DNA, 16 bp, Homo sapiens
acctcaggttgctggt

SEQ ID NO: 3320423 - DNA, 19 bp, Homo sapiens
acctcaggttgctggttgc

SEQ ID NO: 3320424 - DNA, 23 bp, Homo sapiens
acctcagtgccttcctgtttttc

SEQ ID NO: 3320425 - DNA, 19 bp, Homo sapiens
acctcagtggatcttcaga

SEQ ID NO: 3320426 - DNA, 13 bp, Homo sapiens
acccttccagaca

SEQ ID NO: 3320427 - DNA, 22 bp, Homo sapiens
acccttcccctccttctccctt

SEQ ID NO: 3320428 - DNA, 13 bp, Homo sapiens
acccttccctgca

SEQ ID NO: 3320429 - DNA, 22 bp, Homo sapiens
acccttcctgcatttctcttct

SEQ ID NO: 3320430 - DNA, 23 bp, Homo sapiens
acccttgaatgtagcagccccgg

SEQ ID NO: 3320431 - DNA, 11 bp, Homo sapiens
acccttgacac

SEQ ID NO: 3320432 - DNA, 20 bp, Homo sapiens
acccttgcatccattgttgt

SEQ ID NO: 3320433 - DNA, 15 bp, Homo sapiens
acccttgctttcctg

SEQ ID NO: 3320434 - DNA, 18 bp, Homo sapiens
acccttgctttcctgggc

SEQ ID NO: 3320435 - DNA, 20 bp, Homo sapiens
accctttaagatatccatct

SEQ ID NO: 3320436 - DNA, 20 bp, Homo sapiens
accctttagccaaacccttg

SEQ ID NO: 3320437 - DNA, 22 bp, Homo sapiens
accctttgcctttcttctgccc

SEQ ID NO: 3320438 - DNA, 16 bp, Homo sapiens
actgcccgctcctcgg

SEQ ID NO: 3320439 - DNA, 12 bp, Homo sapiens
actgccctgcct

SEQ ID NO: 3320440 - DNA, 16 bp, Homo sapiens
actgccctgcctgccc

SEQ ID NO: 3320441 - DNA, 18 bp, Homo sapiens
actgccctgcctgcccac

SEQ ID NO: 3320442 - DNA, 12 bp, Homo sapiens
actgccctggca

SEQ ID NO: 3320443 - DNA, 13 bp, Homo sapiens
actgccctggcag

SEQ ID NO: 3320444 - DNA, 17 bp, Homo sapiens
actgccctggcagcagc

SEQ ID NO: 3320445 - DNA, 13 bp, Homo sapiens
actgccctgttca

SEQ ID NO: 3320446 - DNA, 24 bp, Homo sapiens
actgccctgttcatgtgcctctgc

SEQ ID NO: 3320447 - DNA, 15 bp, Homo sapiens
actgcccttgctgcc

SEQ ID NO: 3320448 - DNA, 16 bp, Homo sapiens
actgcccttgctgccc

SEQ ID NO: 3320449 - DNA, 17 bp, Homo sapiens
actgcccttgctgcccg

SEQ ID NO: 3320450 - DNA, 17 bp, Homo sapiens
actgccgacatcagcat

SEQ ID NO: 3320451 - DNA, 15 bp, Homo sapiens
actgccgtaatttaa

SEQ ID NO: 3320452 - DNA, 20 bp, Homo sapiens
actgcctataatcttataca

SEQ ID NO: 3320453 - DNA, 15 bp, Homo sapiens
actgcctcaggttcc

SEQ ID NO: 3320454 - DNA, 19 bp, Homo sapiens
actgcctcgaaacacagaa

SEQ ID NO: 3320455 - DNA, 10 bp, Homo sapiens
actgcctctg

SEQ ID NO: 3320456 - DNA, 14 bp, Homo sapiens
actgcctctgccac

SEQ ID NO: 3320457 - DNA, 13 bp, Homo sapiens
actgcctctgcct

SEQ ID NO: 3320458 - DNA, 18 bp, Homo sapiens
actgcctctgccttagag

SEQ ID NO: 3320459 - DNA, 18 bp, Homo sapiens
actgcctgtagagacaat

SEQ ID NO: 3320460 - DNA, 15 bp, Homo sapiens
actgccttcgcttct

SEQ ID NO: 3320461 - DNA, 22 bp, Homo sapiens
actgccttcgcttcttgcctct

SEQ ID NO: 3320462 - DNA, 20 bp, Homo sapiens
actgccttctcctctctggg

SEQ ID NO: 3320463 - DNA, 15 bp, Homo sapiens
actgcgactttctgc

SEQ ID NO: 3320464 - DNA, 18 bp, Homo sapiens
actgcgactttctgcctg

SEQ ID NO: 3320465 - DNA, 21 bp, Homo sapiens
actgcgactttctgcctggag

SEQ ID NO: 3320466 - DNA, 19 bp, Homo sapiens
actgcggaccaagggactc

SEQ ID NO: 3320467 - DNA, 15 bp, Homo sapiens
actgcggctgtctcc

SEQ ID NO: 3320468 - DNA, 21 bp, Homo sapiens
actgcgggatggtcctggggc

SEQ ID NO: 3320469 - DNA, 22 bp, Homo sapiens
actgcgggatggtcctggggct

SEQ ID NO: 3320470 - DNA, 14 bp, Homo sapiens
actgcgttctgcaa

SEQ ID NO: 3320471 - DNA, 20 bp, Homo sapiens
actgcgttctgcaagcatca

SEQ ID NO: 3320472 - DNA, 15 bp, Homo sapiens
actgctaaatcctca

SEQ ID NO: 3320473 - DNA, 21 bp, Homo sapiens
actgctaaattctatgttaaa

SEQ ID NO: 3320474 - DNA, 16 bp, Homo sapiens
actgctacagcaattt

SEQ ID NO: 3320475 - DNA, 22 bp, Homo sapiens
actgctactgtaattttatatg

SEQ ID NO: 3320476 - DNA, 18 bp, Homo sapiens
actgctcaagaagacatg

SEQ ID NO: 3320477 - DNA, 23 bp, Homo sapiens
actgctccatttataaccccagc

SEQ ID NO: 3320478 - DNA, 18 bp, Homo sapiens
actgctccccagccctgg

SEQ ID NO: 3320479 - DNA, 21 bp, Homo sapiens
actgctccccagccctggctc

SEQ ID NO: 3320480 - DNA, 18 bp, Homo sapiens
actgctccctgaagccag

SEQ ID NO: 3320481 - DNA, 21 bp, Homo sapiens
actgctccctgaagccagcct

SEQ ID NO: 3320482 - DNA, 18 bp, Homo sapiens
actgctctaacagccctc

SEQ ID NO: 3320483 - DNA, 15 bp, Homo sapiens
actgctcttgtttct

SEQ ID NO: 3320484 - DNA, 14 bp, Homo sapiens
actgctgagccact

SEQ ID NO: 3320485 - DNA, 16 bp, Homo sapiens
actgctgagccactcg

SEQ ID NO: 3320486 - DNA, 19 bp, Homo sapiens
actgctgatcgtagaaaat

SEQ ID NO: 3320487 - DNA, 21 bp, Homo sapiens
actgctgatcgtagaaaattt

SEQ ID NO: 3320488 - DNA, 12 bp, Homo sapiens
actgctgcacca

SEQ ID NO: 3320489 - DNA, 22 bp, Homo sapiens
actgctggacgtctttcttttt

SEQ ID NO: 3320490 - DNA, 20 bp, Homo sapiens
actgctggagtctggcttta

SEQ ID NO: 3320491 - DNA, 21 bp, Homo sapiens
actgctggagtctggctttac

SEQ ID NO: 3320492 - DNA, 13 bp, Homo sapiens
actgctggctgcc

SEQ ID NO: 3320493 - DNA, 14 bp, Homo sapiens
actgctggctgcct

SEQ ID NO: 3320494 - DNA, 13 bp, Homo sapiens
actgctgggactg

SEQ ID NO: 3320495 - DNA, 18 bp, Homo sapiens
actgctgggactggccag

SEQ ID NO: 3320496 - DNA, 13 bp, Homo sapiens
actgctgtaccca

SEQ ID NO: 3320497 - DNA, 19 bp, Homo sapiens
actgctgtacccagatgcc

SEQ ID NO: 3320498 - DNA, 15 bp, Homo sapiens
actgctgtcttccaa

SEQ ID NO: 3320499 - DNA, 17 bp, Homo sapiens
actgcttacttatgcca

SEQ ID NO: 3320500 - DNA, 19 bp, Homo sapiens
actgcttcccatcctaccc

SEQ ID NO: 3320501 - DNA, 15 bp, Homo sapiens
actgcttggaagaag

SEQ ID NO: 3320502 - DNA, 20 bp, Homo sapiens
actgctttccagcctgggca

SEQ ID NO: 3320503 - DNA, 14 bp, Homo sapiens
actgctttctgttc

SEQ ID NO: 3320504 - DNA, 16 bp, Homo sapiens
actgctttctgttcca

SEQ ID NO: 3320505 - DNA, 17 bp, Homo sapiens
actgctttctgttccaa

SEQ ID NO: 3320506 - DNA, 18 bp, Homo sapiens
actgctttctgttccaaa

SEQ ID NO: 3320507 - DNA, 23 bp, Homo sapiens
actgctttgggatttaatttcca

SEQ ID NO: 3320508 - DNA, 23 bp, Homo sapiens
actgctttgtttggatgcctcag

SEQ ID NO: 3320509 - DNA, 19 bp, Homo sapiens
actgcttttttttttccag

SEQ ID NO: 3320510 - DNA, 14 bp, Homo sapiens
actggaagaaagca

SEQ ID NO: 3320511 - DNA, 14 bp, Homo sapiens
actggaagcacagc

SEQ ID NO: 3320512 - DNA, 19 bp, Homo sapiens
actggaagctaatttgcat

SEQ ID NO: 3320513 - DNA, 12 bp, Homo sapiens
actggaagttca

SEQ ID NO: 3320514 - DNA, 19 bp, Homo sapiens
actggacacaaacaggaat

SEQ ID NO: 3320515 - DNA, 20 bp, Homo sapiens
actggacacaataggtcttt

SEQ ID NO: 3320516 - DNA, 21 bp, Homo sapiens
actggacagctttgctccgct

SEQ ID NO: 3320517 - DNA, 18 bp, Homo sapiens
actggacagtcactgcca

SEQ ID NO: 3320518 - DNA, 21 bp, Homo sapiens
actggacatttaacttttcta

SEQ ID NO: 3320519 - DNA, 20 bp, Homo sapiens
actggaccactgggcaatga

SEQ ID NO: 3320520 - DNA, 21 bp, Homo sapiens
actggaccactgggcaatgat

SEQ ID NO: 3320521 - DNA, 15 bp, Homo sapiens
actggacctgaaatt

SEQ ID NO: 3320522 - DNA, 13 bp, Homo sapiens
actggagcactga

SEQ ID NO: 3320523 - DNA, 12 bp, Homo sapiens
actggagcccag

SEQ ID NO: 3320524 - DNA, 19 bp, Homo sapiens
actggaggagcagcttcct

SEQ ID NO: 3320525 - DNA, 21 bp, Homo sapiens
actggaggcccctggagccag

SEQ ID NO: 3320526 - DNA, 22 bp, Homo sapiens
actggaggcccctggagccaga

SEQ ID NO: 3320527 - DNA, 17 bp, Homo sapiens
actggaggttgaagcca

SEQ ID NO: 3320528 - DNA, 18 bp, Homo sapiens
actggaggttgaagccaa

SEQ ID NO: 3320529 - DNA, 20 bp, Homo sapiens
actggagtgaggcttccagg

SEQ ID NO: 3320530 - DNA, 21 bp, Homo sapiens
actggagtgaggcttccaggc

SEQ ID NO: 3320531 - DNA, 18 bp, Homo sapiens
actggagtgcagggagga

SEQ ID NO: 3320532 - DNA, 15 bp, Homo sapiens
actggagttacatta

SEQ ID NO: 3320533 - DNA, 22 bp, Homo sapiens
actggatgaaataactccttct

SEQ ID NO: 3320534 - DNA, 14 bp, Homo sapiens
actggattggccaa

SEQ ID NO: 3320535 - DNA, 17 bp, Homo sapiens
actggcaagaggcctca

SEQ ID NO: 3320536 - DNA, 12 bp, Homo sapiens
actggcaataaa

SEQ ID NO: 3320537 - DNA, 14 bp, Homo sapiens
actggcaataaact

SEQ ID NO: 3320538 - DNA, 15 bp, Homo sapiens
actggcaataaactc

SEQ ID NO: 3320539 - DNA, 19 bp, Homo sapiens
actggcaattgtctattta

SEQ ID NO: 3320540 - DNA, 21 bp, Homo sapiens
actggcacactgctcttaaga

SEQ ID NO: 3320541 - DNA, 19 bp, Homo sapiens
actggcagatcgctcactg

SEQ ID NO: 3320542 - DNA, 14 bp, Homo sapiens
actggcagcatctt

SEQ ID NO: 3320543 - DNA, 22 bp, Homo sapiens
actggcaggggagacaggagcc

SEQ ID NO: 3320544 - DNA, 13 bp, Homo sapiens
actggcaggtgca

SEQ ID NO: 3320545 - DNA, 23 bp, Homo sapiens
actggcaggtgcagatgggctgt

SEQ ID NO: 3320546 - DNA, 21 bp, Homo sapiens
actggcatctgacacaaaaaa

SEQ ID NO: 3320547 - DNA, 18 bp, Homo sapiens
actggccaccaggctggc

SEQ ID NO: 3320548 - DNA, 22 bp, Homo sapiens
actggccaccaggctggcgcag

SEQ ID NO: 3320549 - DNA, 18 bp, Homo sapiens
actggccacccctcccca

SEQ ID NO: 3320550 - DNA, 17 bp, Homo sapiens
actggccagagagggcc

SEQ ID NO: 3320551 - DNA, 22 bp, Homo sapiens
actggccagagagggcccagct

SEQ ID NO: 3320552 - DNA, 23 bp, Homo sapiens
actggccagagagggcccagctg

SEQ ID NO: 3320553 - DNA, 11 bp, Homo sapiens
actggccaggg

SEQ ID NO: 3320554 - DNA, 22 bp, Homo sapiens
actggccagggccacgctccag

SEQ ID NO: 3320555 - DNA, 19 bp, Homo sapiens
actggccagttgcccagag

SEQ ID NO: 3320556 - DNA, 19 bp, Homo sapiens
actggccccggatcagagc

SEQ ID NO: 3320557 - DNA, 20 bp, Homo sapiens
actggccccggatcagagca

SEQ ID NO: 3320558 - DNA, 21 bp, Homo sapiens
actggccccggatcagagcag

SEQ ID NO: 3320559 - DNA, 21 bp, Homo sapiens
actggcccctactttgtggca

SEQ ID NO: 3320560 - DNA, 17 bp, Homo sapiens
actggccgggcaggcgt

SEQ ID NO: 3320561 - DNA, 22 bp, Homo sapiens
actggccggtctgcaagtcaga

SEQ ID NO: 3320562 - DNA, 14 bp, Homo sapiens
actggcctaaattt

SEQ ID NO: 3320563 - DNA, 18 bp, Homo sapiens
actggcctgacttggggg

SEQ ID NO: 3320564 - DNA, 19 bp, Homo sapiens
actggcgttcacctccctg

SEQ ID NO: 3320565 - DNA, 21 bp, Homo sapiens
actggctagagtcctcactcc

SEQ ID NO: 3320566 - DNA, 15 bp, Homo sapiens
actcattgaaatgtc

SEQ ID NO: 3320567 - DNA, 15 bp, Homo sapiens
actcattgcagcaga

SEQ ID NO: 3320568 - DNA, 16 bp, Homo sapiens
actcattgcagcagat

SEQ ID NO: 3320569 - DNA, 16 bp, Homo sapiens
actcattgcccccacc

SEQ ID NO: 3320570 - DNA, 22 bp, Homo sapiens
actcattgcccccacctctggt

SEQ ID NO: 3320571 - DNA, 18 bp, Homo sapiens
actcattgctgagcctct

SEQ ID NO: 3320572 - DNA, 23 bp, Homo sapiens
actcattgctgagcctctgctcc

SEQ ID NO: 3320573 - DNA, 15 bp, Homo sapiens
actcattttctataa

SEQ ID NO: 3320574 - DNA, 22 bp, Homo sapiens
actccaaaatgttggtcatttt

SEQ ID NO: 3320575 - DNA, 21 bp, Homo sapiens
actccaccatccccaccccac

SEQ ID NO: 3320576 - DNA, 16 bp, Homo sapiens
actccaccctccacct

SEQ ID NO: 3320577 - DNA, 19 bp, Homo sapiens
actccacgatcctgccacc

SEQ ID NO: 3320578 - DNA, 22 bp, Homo sapiens
actccactctccttcgtgtctc

SEQ ID NO: 3320579 - DNA, 22 bp, Homo sapiens
actccactgccctggcagcagc

SEQ ID NO: 3320580 - DNA, 12 bp, Homo sapiens
actccactggac

SEQ ID NO: 3320581 - DNA, 14 bp, Homo sapiens
actccactggacag

SEQ ID NO: 3320582 - DNA, 20 bp, Homo sapiens
actccactggacagacccag

SEQ ID NO: 3320583 - DNA, 15 bp, Homo sapiens
actccagacccctgg

SEQ ID NO: 3320584 - DNA, 14 bp, Homo sapiens
actccagatagaga

SEQ ID NO: 3320585 - DNA, 20 bp, Homo sapiens
actccagcaacttcttctcc

SEQ ID NO: 3320586 - DNA, 13 bp, Homo sapiens
actccagcctgag

SEQ ID NO: 3320587 - DNA, 14 bp, Homo sapiens
actccagcctgagc

SEQ ID NO: 3320588 - DNA, 15 bp, Homo sapiens
actccagcctgagca

SEQ ID NO: 3320589 - DNA, 14 bp, Homo sapiens
actccagcctgggc

SEQ ID NO: 3320590 - DNA, 18 bp, Homo sapiens
actccagcctgggcaaca

SEQ ID NO: 3320591 - DNA, 11 bp, Homo sapiens
actccaggccc

SEQ ID NO: 3320592 - DNA, 21 bp, Homo sapiens
actccaggcccaaggctcccg

SEQ ID NO: 3320593 - DNA, 15 bp, Homo sapiens
actccaggccctcct

SEQ ID NO: 3320594 - DNA, 16 bp, Homo sapiens
actccaggccctgccc

SEQ ID NO: 3320595 - DNA, 14 bp, Homo sapiens
actccattcccaac

SEQ ID NO: 3320596 - DNA, 18 bp, Homo sapiens
actccattcccaactaga

SEQ ID NO: 3320597 - DNA, 12 bp, Homo sapiens
actccattgtcg

SEQ ID NO: 3320598 - DNA, 20 bp, Homo sapiens
actccatttggtcctttctc

SEQ ID NO: 3320599 - DNA, 16 bp, Homo sapiens
actcccaaccctggct

SEQ ID NO: 3320600 - DNA, 18 bp, Homo sapiens
actcccagcactcccctt

SEQ ID NO: 3320601 - DNA, 23 bp, Homo sapiens
actcccagcactccccttgcctt

SEQ ID NO: 3320602 - DNA, 16 bp, Homo sapiens
actcccatttttactt

SEQ ID NO: 3320603 - DNA, 20 bp, Homo sapiens
actccccagagctgtgccag

SEQ ID NO: 3320604 - DNA, 17 bp, Homo sapiens
actccccagccccaccc

SEQ ID NO: 3320605 - DNA, 13 bp, Homo sapiens
actcccccacctg

SEQ ID NO: 3320606 - DNA, 14 bp, Homo sapiens
actcccccacctga

SEQ ID NO: 3320607 - DNA, 21 bp, Homo sapiens
actccccctaaacccctgtcc

SEQ ID NO: 3320608 - DNA, 14 bp, Homo sapiens
actccccgaagtct

SEQ ID NO: 3320609 - DNA, 16 bp, Homo sapiens
actcccgggccacgcc

SEQ ID NO: 3320610 - DNA, 17 bp, Homo sapiens
actcccgggccacgccc

SEQ ID NO: 3320611 - DNA, 16 bp, Homo sapiens
actccctacactgatg

SEQ ID NO: 3320612 - DNA, 18 bp, Homo sapiens
actccctacactgatgca

SEQ ID NO: 3320613 - DNA, 19 bp, Homo sapiens
actccctacactgatgcaa

SEQ ID NO: 3320614 - DNA, 15 bp, Homo sapiens
actccctcctcacct

SEQ ID NO: 3320615 - DNA, 15 bp, Homo sapiens
actccctctgccttc

SEQ ID NO: 3320616 - DNA, 22 bp, Homo sapiens
actccctcttcactgtggccac

SEQ ID NO: 3320617 - DNA, 23 bp, Homo sapiens
actccctcttcactgtggccaca

SEQ ID NO: 3320618 - DNA, 17 bp, Homo sapiens
actccctggctctcaga

SEQ ID NO: 3320619 - DNA, 18 bp, Homo sapiens
actccctggctctcagaa

SEQ ID NO: 3320620 - DNA, 22 bp, Homo sapiens
actccctgtgggggtggccatc

SEQ ID NO: 3320621 - DNA, 23 bp, Homo sapiens
actcccttccctctctcccattt

SEQ ID NO: 3320622 - DNA, 20 bp, Homo sapiens
actcccttcctggcctcact

SEQ ID NO: 3320623 - DNA, 18 bp, Homo sapiens
actcccttgctggcccca

SEQ ID NO: 3320624 - DNA, 19 bp, Homo sapiens
actcccttgctggccccag

SEQ ID NO: 3320625 - DNA, 21 bp, Homo sapiens
actcccttggtggcaagagcc

SEQ ID NO: 3320626 - DNA, 22 bp, Homo sapiens
actccgagaggtgggccagtct

SEQ ID NO: 3320627 - DNA, 13 bp, Homo sapiens
actccgcccccag

SEQ ID NO: 3320628 - DNA, 15 bp, Homo sapiens
actccgcccccagcc

SEQ ID NO: 3320629 - DNA, 21 bp, Homo sapiens
actccgcccccagcctatgag

SEQ ID NO: 3320630 - DNA, 17 bp, Homo sapiens
actccgccctcctcggg

SEQ ID NO: 3320631 - DNA, 21 bp, Homo sapiens
actccgccctcctcgggccga

SEQ ID NO: 3320632 - DNA, 23 bp, Homo sapiens
actccgcggagtgatcatggaaa

SEQ ID NO: 3320633 - DNA, 23 bp, Homo sapiens
actccggattgcgttcctccccg

SEQ ID NO: 3320634 - DNA, 16 bp, Homo sapiens
actccggtgtgcctgc

SEQ ID NO: 3320635 - DNA, 19 bp, Homo sapiens
actccgtaacagattttgt

SEQ ID NO: 3320636 - DNA, 19 bp, Homo sapiens
actcctaaacctttgcccc

SEQ ID NO: 3320637 - DNA, 22 bp, Homo sapiens
actcctacaagatttagaaaaa

SEQ ID NO: 3320638 - DNA, 21 bp, Homo sapiens
actcttattgcccacgctgga

SEQ ID NO: 3320639 - DNA, 12 bp, Homo sapiens
actcttcactgt

SEQ ID NO: 3320640 - DNA, 22 bp, Homo sapiens
actcttcagtgactcctgctgg

SEQ ID NO: 3320641 - DNA, 20 bp, Homo sapiens
actcttcagtgcaaattgta

SEQ ID NO: 3320642 - DNA, 16 bp, Homo sapiens
actcttctcggctcag

SEQ ID NO: 3320643 - DNA, 16 bp, Homo sapiens
actcttcttgaaattt

SEQ ID NO: 3320644 - DNA, 12 bp, Homo sapiens
actcttgaagag

SEQ ID NO: 3320645 - DNA, 15 bp, Homo sapiens
actcttgaagaggag

SEQ ID NO: 3320646 - DNA, 15 bp, Homo sapiens
actcttgacctcagg

SEQ ID NO: 3320647 - DNA, 10 bp, Homo sapiens
actcttgctg

SEQ ID NO: 3320648 - DNA, 20 bp, Homo sapiens
actcttggtcagcttttgtt

SEQ ID NO: 3320649 - DNA, 14 bp, Homo sapiens
actcttgtcatttt

SEQ ID NO: 3320650 - DNA, 21 bp, Homo sapiens
actcttgtgaattattctgat

SEQ ID NO: 3320651 - DNA, 18 bp, Homo sapiens
actctttctgaaggaaga

SEQ ID NO: 3320652 - DNA, 22 bp, Homo sapiens
actctttctgtatatacttttt

SEQ ID NO: 3320653 - DNA, 23 bp, Homo sapiens
actctttgtggggaagaggggct

SEQ ID NO: 3320654 - DNA, 19 bp, Homo sapiens
actctttttagggccaggc

SEQ ID NO: 3320655 - DNA, 20 bp, Homo sapiens
actctttttctaaagtgttg

SEQ ID NO: 3320656 - DNA, 20 bp, Homo sapiens
actctttttggactcagccc

SEQ ID NO: 3320657 - DNA, 18 bp, Homo sapiens
actctttttgttttttgt

SEQ ID NO: 3320658 - DNA, 21 bp, Homo sapiens
actgaaaaaaaaaaagaagaa

SEQ ID NO: 3320659 - DNA, 24 bp, Homo sapiens
actgaaaaaaaaaaagaagaagaa

SEQ ID NO: 3320660 - DNA, 16 bp, Homo sapiens
actgaaaaattatact

SEQ ID NO: 3320661 - DNA, 22 bp, Homo sapiens
actgaaaacatttcaaagctga

SEQ ID NO: 3320662 - DNA, 16 bp, Homo sapiens
actgaaaacttagcca

SEQ ID NO: 3320663 - DNA, 18 bp, Homo sapiens
actgaaaacttagccaga

SEQ ID NO: 3320664 - DNA, 17 bp, Homo sapiens
actgaaaagaaggaaag

SEQ ID NO: 3320665 - DNA, 19 bp, Homo sapiens
actgaaaataccatcaggc

SEQ ID NO: 3320666 - DNA, 13 bp, Homo sapiens
actgaaaatgtaa

SEQ ID NO: 3320667 - DNA, 14 bp, Homo sapiens
actgaaaatgtaaa

SEQ ID NO: 3320668 - DNA, 19 bp, Homo sapiens
actgaaaatgtgctatact

SEQ ID NO: 3320669 - DNA, 18 bp, Homo sapiens
actgaaacaaaaattgtc

SEQ ID NO: 3320670 - DNA, 20 bp, Homo sapiens
actgaaacaaaaattgtctt

SEQ ID NO: 3320671 - DNA, 14 bp, Homo sapiens
actgaaacagattt

SEQ ID NO: 3320672 - DNA, 17 bp, Homo sapiens
actgaaacatggctgtg

SEQ ID NO: 3320673 - DNA, 18 bp, Homo sapiens
actgaaacctctgccttc

SEQ ID NO: 3320674 - DNA, 21 bp, Homo sapiens
actgaaagacaccatttatct

SEQ ID NO: 3320675 - DNA, 14 bp, Homo sapiens
actgaaagcagcag

SEQ ID NO: 3320676 - DNA, 23 bp, Homo sapiens
actgaaatgagcatgcattttct

SEQ ID NO: 3320677 - DNA, 17 bp, Homo sapiens
actgaaattacatattg

SEQ ID NO: 3320678 - DNA, 21 bp, Homo sapiens
actgaacaccattgaaggctt

SEQ ID NO: 3320679 - DNA, 15 bp, Homo sapiens
actgaacatgtttac

SEQ ID NO: 3320680 - DNA, 19 bp, Homo sapiens
actgaaccaaattgcactg

SEQ ID NO: 3320681 - DNA, 12 bp, Homo sapiens
actgaagagaca

SEQ ID NO: 3320682 - DNA, 18 bp, Homo sapiens
actgaagccaaatgaaac

SEQ ID NO: 3320683 - DNA, 19 bp, Homo sapiens
actgaagccaaatgaaact

SEQ ID NO: 3320684 - DNA, 19 bp, Homo sapiens
actgaaggaaaagcaagaa

SEQ ID NO: 3320685 - DNA, 20 bp, Homo sapiens
actgaaggaaaagcaagaaa

SEQ ID NO: 3320686 - DNA, 16 bp, Homo sapiens
actgaaggcatatgca

SEQ ID NO: 3320687 - DNA, 13 bp, Homo sapiens
actgaagtgctta

SEQ ID NO: 3320688 - DNA, 17 bp, Homo sapiens
actgaagttaacagaga

SEQ ID NO: 3320689 - DNA, 15 bp, Homo sapiens
actgaagtttcacat

SEQ ID NO: 3320690 - DNA, 18 bp, Homo sapiens
actgaagtttttgaaata

SEQ ID NO: 3320691 - DNA, 19 bp, Homo sapiens
actgaagtttttgaaatac

SEQ ID NO: 3320692 - DNA, 14 bp, Homo sapiens
actgaatattttgg

SEQ ID NO: 3320693 - DNA, 12 bp, Homo sapiens
actgaatgaggt

SEQ ID NO: 3320694 - DNA, 17 bp, Homo sapiens
actgaatgcataaataa

SEQ ID NO: 3320695 - DNA, 18 bp, Homo sapiens
actgaatgtttacatgtc

SEQ ID NO: 3320696 - DNA, 21 bp, Homo sapiens
actgaattaatcatctataaa

SEQ ID NO: 3320697 - DNA, 13 bp, Homo sapiens
actgaatttggag

SEQ ID NO: 3320698 - DNA, 15 bp, Homo sapiens
actgaattttgggac

SEQ ID NO: 3320699 - DNA, 18 bp, Homo sapiens
actgaattttgggacttc

SEQ ID NO: 3320700 - DNA, 13 bp, Homo sapiens
actgacacaaagg

SEQ ID NO: 3320701 - DNA, 23 bp, Homo sapiens
actgacatgattagcagaagaaa

SEQ ID NO: 3320702 - DNA, 17 bp, Homo sapiens
actgacattgttggcca

SEQ ID NO: 3320703 - DNA, 18 bp, Homo sapiens
actgacattgttggccaa

SEQ ID NO: 3320704 - DNA, 15 bp, Homo sapiens
actgacatttcttct

SEQ ID NO: 3320705 - DNA, 13 bp, Homo sapiens
actgaccagcctc

SEQ ID NO: 3320706 - DNA, 15 bp, Homo sapiens
actgaccagcctcca

SEQ ID NO: 3320707 - DNA, 23 bp, Homo sapiens
actgaccagcctccatgctgcct

SEQ ID NO: 3320708 - DNA, 16 bp, Homo sapiens
actgaccatccactct

SEQ ID NO: 3320709 - DNA, 22 bp, Homo sapiens
actgaccatccactctaccctc

SEQ ID NO: 3320710 - DNA, 13 bp, Homo sapiens
actgacccttcca

SEQ ID NO: 3320711 - DNA, 17 bp, Homo sapiens
actgacccttccagaca

SEQ ID NO: 3320712 - DNA, 19 bp, Homo sapiens
actgacccttccagacata

SEQ ID NO: 3320713 - DNA, 15 bp, Homo sapiens
actgacccttgaacc

SEQ ID NO: 3320714 - DNA, 20 bp, Homo sapiens
actgaccttggagagacaca

SEQ ID NO: 3320715 - DNA, 18 bp, Homo sapiens
actgactgagacacgatg

SEQ ID NO: 3320716 - DNA, 23 bp, Homo sapiens
actgactgagacacgatgccgag

SEQ ID NO: 3320717 - DNA, 24 bp, Homo sapiens
actgacttgtttgtcttccattcc

SEQ ID NO: 3320718 - DNA, 15 bp, Homo sapiens
actgactttctgatt

SEQ ID NO: 3320719 - DNA, 13 bp, Homo sapiens
actgactttgctt

SEQ ID NO: 3320720 - DNA, 17 bp, Homo sapiens
actgagattttggtatt

SEQ ID NO: 3320721 - DNA, 15 bp, Homo sapiens
actgagcatttgcac

SEQ ID NO: 3320722 - DNA, 19 bp, Homo sapiens
actgagccaaggaggcctg

SEQ ID NO: 3320723 - DNA, 14 bp, Homo sapiens
actgagccccacct

SEQ ID NO: 3320724 - DNA, 21 bp, Homo sapiens
actgagccccgcagacctccc

SEQ ID NO: 3320725 - DNA, 22 bp, Homo sapiens
actgagcggccgcagagactgg

SEQ ID NO: 3320726 - DNA, 12 bp, Homo sapiens
actgagctgaga

SEQ ID NO: 3320727 - DNA, 16 bp, Homo sapiens
actgagcttagagtat

SEQ ID NO: 3320728 - DNA, 17 bp, Homo sapiens
actgagcttctctgtga

SEQ ID NO: 3320729 - DNA, 18 bp, Homo sapiens
actgagcttctctgtgaa

SEQ ID NO: 3320730 - DNA, 17 bp, Homo sapiens
actgaggaatttcacct

SEQ ID NO: 3320731 - DNA, 18 bp, Homo sapiens
actgaggagatgaccagg

SEQ ID NO: 3320732 - DNA, 20 bp, Homo sapiens
actgaggagatgaccaggga

SEQ ID NO: 3320733 - DNA, 22 bp, Homo sapiens
actgaggagatgaccagggatg

SEQ ID NO: 3320734 - DNA, 17 bp, Homo sapiens
actgaggcttagagaga

SEQ ID NO: 3320735 - DNA, 12 bp, Homo sapiens
actgagggccac

SEQ ID NO: 3320736 - DNA, 22 bp, Homo sapiens
actgagggccacactattacca

SEQ ID NO: 3320737 - DNA, 11 bp, Homo sapiens
actgagtcacg

SEQ ID NO: 3320738 - DNA, 23 bp, Homo sapiens
actgagtcacgctggggctctct

SEQ ID NO: 3320739 - DNA, 19 bp, Homo sapiens
actgagtcttaacttttca

SEQ ID NO: 3320740 - DNA, 23 bp, Homo sapiens
actgagttgggcaaaacccagga

SEQ ID NO: 3320741 - DNA, 22 bp, Homo sapiens
actgatatatcatgagtgaata

SEQ ID NO: 3320742 - DNA, 15 bp, Homo sapiens
actgatcacccaatg

SEQ ID NO: 3320743 - DNA, 18 bp, Homo sapiens
actgatccaaaaattata

SEQ ID NO: 3320744 - DNA, 20 bp, Homo sapiens
actgatgaagaaatttatga

SEQ ID NO: 3320745 - DNA, 17 bp, Homo sapiens
actgatgcaaggattac

SEQ ID NO: 3320746 - DNA, 23 bp, Homo sapiens
actgatgcaaggattacagaaac

SEQ ID NO: 3320747 - DNA, 12 bp, Homo sapiens
actgatgccaag

SEQ ID NO: 3320748 - DNA, 16 bp, Homo sapiens
actgatgctgagattc

SEQ ID NO: 3320749 - DNA, 18 bp, Homo sapiens
actgatgctgagattctt

SEQ ID NO: 3320750 - DNA, 15 bp, Homo sapiens
actgatgctgttctc

SEQ ID NO: 3320751 - DNA, 20 bp, Homo sapiens
actgatggaccgggtgggcc

SEQ ID NO: 3320752 - DNA, 22 bp, Homo sapiens
actgatggaccgggtgggcctg

SEQ ID NO: 3320753 - DNA, 22 bp, Homo sapiens
actgatggctaatgtactgcat

SEQ ID NO: 3320754 - DNA, 23 bp, Homo sapiens
actgatgggcaacccccagcctg

SEQ ID NO: 3320755 - DNA, 13 bp, Homo sapiens
actgatgttgtgt

SEQ ID NO: 3320756 - DNA, 16 bp, Homo sapiens
actgattacctgccaa

SEQ ID NO: 3320757 - DNA, 20 bp, Homo sapiens
actgattctgggatgctcct

SEQ ID NO: 3320758 - DNA, 13 bp, Homo sapiens
actgatttcacaa

SEQ ID NO: 3320759 - DNA, 17 bp, Homo sapiens
actgatttctatggctt

SEQ ID NO: 3320760 - DNA, 14 bp, Homo sapiens
actgattttgtaaa

SEQ ID NO: 3320761 - DNA, 15 bp, Homo sapiens
actgatttttaagtc

SEQ ID NO: 3320762 - DNA, 17 bp, Homo sapiens
actgcaaaaaaagcctc

SEQ ID NO: 3320763 - DNA, 19 bp, Homo sapiens
actgcaaaaaaagcctcca

SEQ ID NO: 3320764 - DNA, 23 bp, Homo sapiens
actgcaaacttttttatatcttt

SEQ ID NO: 3320765 - DNA, 15 bp, Homo sapiens
actgcaaataaagcc

SEQ ID NO: 3320766 - DNA, 18 bp, Homo sapiens
actgcaacaacgcctggt

SEQ ID NO: 3320767 - DNA, 18 bp, Homo sapiens
actgcaacctctgcctcc

SEQ ID NO: 3320768 - DNA, 17 bp, Homo sapiens
actgcaataacttctga

SEQ ID NO: 3320769 - DNA, 15 bp, Homo sapiens
actgcaatagagact

SEQ ID NO: 3320770 - DNA, 16 bp, Homo sapiens
actgcaatagagactg

SEQ ID NO: 3320771 - DNA, 17 bp, Homo sapiens
actgcaatagagactgt

SEQ ID NO: 3320772 - DNA, 18 bp, Homo sapiens
actgcaatagagactgta

SEQ ID NO: 3320773 - DNA, 19 bp, Homo sapiens
actgcaatagagactgtag

SEQ ID NO: 3320774 - DNA, 21 bp, Homo sapiens
actgcaatcctgtctttctga

SEQ ID NO: 3320775 - DNA, 15 bp, Homo sapiens
actgcacacacagct

SEQ ID NO: 3320776 - DNA, 23 bp, Homo sapiens
actgcacagagctctccagctcc

SEQ ID NO: 3320777 - DNA, 22 bp, Homo sapiens
actgcacagcggcccctgcatc

SEQ ID NO: 3320778 - DNA, 16 bp, Homo sapiens
actgcacagcgtcctg

SEQ ID NO: 3320779 - DNA, 18 bp, Homo sapiens
actgcacagcgtcctgtc

SEQ ID NO: 3320780 - DNA, 23 bp, Homo sapiens
actgcacagtgcatctcagccca

SEQ ID NO: 3320781 - DNA, 13 bp, Homo sapiens
actgcacagtgct

SEQ ID NO: 3320782 - DNA, 20 bp, Homo sapiens
actgcacagtgctgttggtg

SEQ ID NO: 3320783 - DNA, 15 bp, Homo sapiens
actgcacagtggcac

SEQ ID NO: 3320784 - DNA, 16 bp, Homo sapiens
actgcaccgggccaca

SEQ ID NO: 3320785 - DNA, 13 bp, Homo sapiens
actgcactccagc

SEQ ID NO: 3320786 - DNA, 16 bp, Homo sapiens
actgcactccagcctg

SEQ ID NO: 3320787 - DNA, 19 bp, Homo sapiens
actgcactccagcctgggg

SEQ ID NO: 3320788 - DNA, 20 bp, Homo sapiens
actgcactccagcctggggg

SEQ ID NO: 3320789 - DNA, 17 bp, Homo sapiens
actgcactgcatgcaaa

SEQ ID NO: 3320790 - DNA, 15 bp, Homo sapiens
actgcagaggggaaa

SEQ ID NO: 3320791 - DNA, 15 bp, Homo sapiens
actgcagcacctcca

SEQ ID NO: 3320792 - DNA, 14 bp, Homo sapiens
actgcagcagaaag

SEQ ID NO: 3320793 - DNA, 12 bp, Homo sapiens
actgcagcccag

SEQ ID NO: 3320794 - DNA, 21 bp, Homo sapiens
actgcagcctcaacctcctgg

SEQ ID NO: 3320795 - DNA, 14 bp, Homo sapiens
actgcaggccctgg

SEQ ID NO: 3320796 - DNA, 17 bp, Homo sapiens
actgcaggccctggcct

SEQ ID NO: 3320797 - DNA, 17 bp, Homo sapiens
actgcagggactgccag

SEQ ID NO: 3320798 - DNA, 15 bp, Homo sapiens
actgcagggccagga

SEQ ID NO: 3320799 - DNA, 22 bp, Homo sapiens
actgcagggccaggactgagcc

SEQ ID NO: 3320800 - DNA, 12 bp, Homo sapiens
actgcagggcct

SEQ ID NO: 3320801 - DNA, 20 bp, Homo sapiens
actgcaggttggaccccaga

SEQ ID NO: 3320802 - DNA, 16 bp, Homo sapiens
actgcagtcttatttc

SEQ ID NO: 3320803 - DNA, 16 bp, Homo sapiens
actgcagttgactttc

SEQ ID NO: 3320804 - DNA, 21 bp, Homo sapiens
actgcatgcaaacaagaaacg

SEQ ID NO: 3320805 - DNA, 17 bp, Homo sapiens
actgcatggacctaaca

SEQ ID NO: 3320806 - DNA, 16 bp, Homo sapiens
actgcattagaaatta

SEQ ID NO: 3320807 - DNA, 17 bp, Homo sapiens
actgcattctctcccat

SEQ ID NO: 3320808 - DNA, 21 bp, Homo sapiens
actgcattctctcccatcctg

SEQ ID NO: 3320809 - DNA, 15 bp, Homo sapiens
actgccaaataaaca

SEQ ID NO: 3320810 - DNA, 18 bp, Homo sapiens
actgccaaataaacagct

SEQ ID NO: 3320811 - DNA, 19 bp, Homo sapiens
actgccaaataaacagcta

SEQ ID NO: 3320812 - DNA, 18 bp, Homo sapiens
actgccacactctccatc

SEQ ID NO: 3320813 - DNA, 16 bp, Homo sapiens
actgccaccttgtggc

SEQ ID NO: 3320814 - DNA, 13 bp, Homo sapiens
actgccagcagca

SEQ ID NO: 3320815 - DNA, 16 bp, Homo sapiens
actgccagcagcagca

SEQ ID NO: 3320816 - DNA, 15 bp, Homo sapiens
actgccaggcacctg

SEQ ID NO: 3320817 - DNA, 18 bp, Homo sapiens
actgccaggcacctggcc

SEQ ID NO: 3320818 - DNA, 19 bp, Homo sapiens
actgccagtccccctgccc

SEQ ID NO: 3320819 - DNA, 21 bp, Homo sapiens
actgccatgatagctggggct

SEQ ID NO: 3320820 - DNA, 20 bp, Homo sapiens
actgccattattttctgtca

SEQ ID NO: 3320821 - DNA, 23 bp, Homo sapiens
actgccattattttctgtcagat

SEQ ID NO: 3320822 - DNA, 13 bp, Homo sapiens
actgcccaccccc

SEQ ID NO: 3320823 - DNA, 14 bp, Homo sapiens
actgcccaccccct

SEQ ID NO: 3320824 - DNA, 19 bp, Homo sapiens
actgccccccgaggctgct

SEQ ID NO: 3320825 - DNA, 21 bp, Homo sapiens
actgccccccgaggctgctag

SEQ ID NO: 3320826 - DNA, 19 bp, Homo sapiens
actgcccgcacaccctcac

SEQ ID NO: 3320827 - DNA, 20 bp, Homo sapiens
acccctgggcctcatcacag

SEQ ID NO: 3320828 - DNA, 16 bp, Homo sapiens
acccctgtacccagct

SEQ ID NO: 3320829 - DNA, 11 bp, Homo sapiens
acccctgtccc

SEQ ID NO: 3320830 - DNA, 15 bp, Homo sapiens
acccctgtcctcact

SEQ ID NO: 3320831 - DNA, 19 bp, Homo sapiens
acccctgtcctcactgctc

SEQ ID NO: 3320832 - DNA, 21 bp, Homo sapiens
acccctgtcctcactgctccc

SEQ ID NO: 3320833 - DNA, 13 bp, Homo sapiens
accatatgaattg

SEQ ID NO: 3320834 - DNA, 14 bp, Homo sapiens
accatcaccaccgc

SEQ ID NO: 3320835 - DNA, 17 bp, Homo sapiens
accatcatgtctggcta

SEQ ID NO: 3320836 - DNA, 23 bp, Homo sapiens
accatccactctaccctcccacc

SEQ ID NO: 3320837 - DNA, 15 bp, Homo sapiens
accatccctgccaca

SEQ ID NO: 3320838 - DNA, 15 bp, Homo sapiens
acattattgcttatt

SEQ ID NO: 3320839 - DNA, 21 bp, Homo sapiens
acattatttattaaaaatgtt

SEQ ID NO: 3320840 - DNA, 18 bp, Homo sapiens
acattcaacagagactga

SEQ ID NO: 3320841 - DNA, 15 bp, Homo sapiens
acattccctctcctg

SEQ ID NO: 3320842 - DNA, 11 bp, Homo sapiens
acattccctgc

SEQ ID NO: 3320843 - DNA, 22 bp, Homo sapiens
acattcccttgatggtctcaag

SEQ ID NO: 3320844 - DNA, 15 bp, Homo sapiens
acattccgaagaggg

SEQ ID NO: 3320845 - DNA, 19 bp, Homo sapiens
acattcctaactagaatta

SEQ ID NO: 3320846 - DNA, 18 bp, Homo sapiens
acattcgtgagctgggga

SEQ ID NO: 3320847 - DNA, 22 bp, Homo sapiens
acattctctaggagaaacttag

SEQ ID NO: 3320848 - DNA, 22 bp, Homo sapiens
acattctgcctagagtgtagcc

SEQ ID NO: 3320849 - DNA, 14 bp, Homo sapiens
acattctgtaaaat

SEQ ID NO: 3320850 - DNA, 18 bp, Homo sapiens
acattgaagtaatgaatt

SEQ ID NO: 3320851 - DNA, 20 bp, Homo sapiens
acattgaagtaatgaatttt

SEQ ID NO: 3320852 - DNA, 16 bp, Homo sapiens
acattgaccaagaact

SEQ ID NO: 3320853 - DNA, 16 bp, Homo sapiens
acattgagctgatata

SEQ ID NO: 3320854 - DNA, 20 bp, Homo sapiens
acattgagctgatataaatt

SEQ ID NO: 3320855 - DNA, 21 bp, Homo sapiens
acattgcggacagccacggcc

SEQ ID NO: 3320856 - DNA, 14 bp, Homo sapiens
acattgctctctgg

SEQ ID NO: 3320857 - DNA, 20 bp, Homo sapiens
acattgcttgtgccacaccc

SEQ ID NO: 3320858 - DNA, 17 bp, Homo sapiens
acattggaatgttctca

SEQ ID NO: 3320859 - DNA, 22 bp, Homo sapiens
acattggtgaaggatccaggaa

SEQ ID NO: 3320860 - DNA, 17 bp, Homo sapiens
acattgtaaatagtatt

SEQ ID NO: 3320861 - DNA, 16 bp, Homo sapiens
acattgttcaattaga

SEQ ID NO: 3320862 - DNA, 20 bp, Homo sapiens
acattgttctttccggccaa

SEQ ID NO: 3320863 - DNA, 14 bp, Homo sapiens
acattgttgagcta

SEQ ID NO: 3320864 - DNA, 17 bp, Homo sapiens
acattgttgagctattg

SEQ ID NO: 3320865 - DNA, 15 bp, Homo sapiens
acattgttgctccct

SEQ ID NO: 3320866 - DNA, 21 bp, Homo sapiens
acattgttgctccctgtgaca

SEQ ID NO: 3320867 - DNA, 16 bp, Homo sapiens
acatttaaatccttgt

SEQ ID NO: 3320868 - DNA, 17 bp, Homo sapiens
acatttaaatgtaactt

SEQ ID NO: 3320869 - DNA, 16 bp, Homo sapiens
acatttaatacagcag

SEQ ID NO: 3320870 - DNA, 12 bp, Homo sapiens
acatttaattta

SEQ ID NO: 3320871 - DNA, 12 bp, Homo sapiens
acatttacagtc

SEQ ID NO: 3320872 - DNA, 21 bp, Homo sapiens
acatttacagtccttcaaaat

SEQ ID NO: 3320873 - DNA, 14 bp, Homo sapiens
acatttactgacca

SEQ ID NO: 3320874 - DNA, 13 bp, Homo sapiens
acatttagaaaag

SEQ ID NO: 3320875 - DNA, 16 bp, Homo sapiens
acatttagaaaagtga

SEQ ID NO: 3320876 - DNA, 20 bp, Homo sapiens
acatttagaaaagtgaattg

SEQ ID NO: 3320877 - DNA, 16 bp, Homo sapiens
acatttagaagaaaga

SEQ ID NO: 3320878 - DNA, 13 bp, Homo sapiens
acatttagatcct

SEQ ID NO: 3320879 - DNA, 23 bp, Homo sapiens
acatttagatcctggtttcataa

SEQ ID NO: 3320880 - DNA, 14 bp, Homo sapiens
acatttagtcctgt

SEQ ID NO: 3320881 - DNA, 20 bp, Homo sapiens
acatttataatgtttgctat

SEQ ID NO: 3320882 - DNA, 12 bp, Homo sapiens
acatttataatt

SEQ ID NO: 3320883 - DNA, 13 bp, Homo sapiens
acatttatatttg

SEQ ID NO: 3320884 - DNA, 18 bp, Homo sapiens
acatttatgagtaactat

SEQ ID NO: 3320885 - DNA, 14 bp, Homo sapiens
acatttatgattta

SEQ ID NO: 3320886 - DNA, 20 bp, Homo sapiens
acatttatgatttaataaaa

SEQ ID NO: 3320887 - DNA, 14 bp, Homo sapiens
acatttatttcctc

SEQ ID NO: 3320888 - DNA, 16 bp, Homo sapiens
acatttcacattattc

SEQ ID NO: 3320889 - DNA, 20 bp, Homo sapiens
acatttcacctactttgtaa

SEQ ID NO: 3320890 - DNA, 18 bp, Homo sapiens
acatttcagggagaaact

SEQ ID NO: 3320891 - DNA, 17 bp, Homo sapiens
acatttccgaataaagt

SEQ ID NO: 3320892 - DNA, 22 bp, Homo sapiens
acatttctctaactcctgccat

SEQ ID NO: 3320893 - DNA, 23 bp, Homo sapiens
acatttctctaactcctgccatt

SEQ ID NO: 3320894 - DNA, 14 bp, Homo sapiens
acatttctctgagc

SEQ ID NO: 3320895 - DNA, 15 bp, Homo sapiens
acatttctctgagca

SEQ ID NO: 3320896 - DNA, 14 bp, Homo sapiens
acatttctggacag

SEQ ID NO: 3320897 - DNA, 14 bp, Homo sapiens
acatttctggattg

SEQ ID NO: 3320898 - DNA, 19 bp, Homo sapiens
acatttctgtaaataccat

SEQ ID NO: 3320899 - DNA, 15 bp, Homo sapiens
acatttctgttctca

SEQ ID NO: 3320900 - DNA, 23 bp, Homo sapiens
acatttcttagactacatttaga

SEQ ID NO: 3320901 - DNA, 19 bp, Homo sapiens
acatttgatagaaaggaac

SEQ ID NO: 3320902 - DNA, 17 bp, Homo sapiens
acatttgatgcatgtct

SEQ ID NO: 3320903 - DNA, 20 bp, Homo sapiens
acatttgccttgcagaactg

SEQ ID NO: 3320904 - DNA, 23 bp, Homo sapiens
acatttgccttgcagaactgcca

SEQ ID NO: 3320905 - DNA, 15 bp, Homo sapiens
acatttgctgccatt

SEQ ID NO: 3320906 - DNA, 22 bp, Homo sapiens
acatttgctgttttaaacatta

SEQ ID NO: 3320907 - DNA, 16 bp, Homo sapiens
acatttggaatacttt

SEQ ID NO: 3320908 - DNA, 17 bp, Homo sapiens
acatttgggagacatgt

SEQ ID NO: 3320909 - DNA, 20 bp, Homo sapiens
acatttgggagacatgtgac

SEQ ID NO: 3320910 - DNA, 22 bp, Homo sapiens
acatttggtggtactttattct

SEQ ID NO: 3320911 - DNA, 23 bp, Homo sapiens
acatttggtggtactttattctt

SEQ ID NO: 3320912 - DNA, 15 bp, Homo sapiens
acatttgtacagaat

SEQ ID NO: 3320913 - DNA, 16 bp, Homo sapiens
acatttgtatattgtg

SEQ ID NO: 3320914 - DNA, 18 bp, Homo sapiens
acatttgtatattgtgga

SEQ ID NO: 3320915 - DNA, 15 bp, Homo sapiens
acatttgtcagtatt

SEQ ID NO: 3320916 - DNA, 16 bp, Homo sapiens
acatttgtcagtattt

SEQ ID NO: 3320917 - DNA, 12 bp, Homo sapiens
acatttgtgaga

SEQ ID NO: 3320918 - DNA, 15 bp, Homo sapiens
acattttaaataaaa

SEQ ID NO: 3320919 - DNA, 20 bp, Homo sapiens
acattttatatttttgtaca

SEQ ID NO: 3320920 - DNA, 12 bp, Homo sapiens
acattttctggt

SEQ ID NO: 3320921 - DNA, 21 bp, Homo sapiens
acattttgttatagaatactt

SEQ ID NO: 3320922 - DNA, 12 bp, Homo sapiens
acattttgttct

SEQ ID NO: 3320923 - DNA, 14 bp, Homo sapiens
acattttgttctta

SEQ ID NO: 3320924 - DNA, 20 bp, Homo sapiens
acattttgttcttacacata

SEQ ID NO: 3320925 - DNA, 19 bp, Homo sapiens
acattttgttgtaaaaaga

SEQ ID NO: 3320926 - DNA, 20 bp, Homo sapiens
acattttgttgtaaaaagaa

SEQ ID NO: 3320927 - DNA, 21 bp, Homo sapiens
acattttgttgtaaaaagaaa

SEQ ID NO: 3320928 - DNA, 17 bp, Homo sapiens
acatttttaatttaaca

SEQ ID NO: 3320929 - DNA, 15 bp, Homo sapiens
acatttttgaataca

SEQ ID NO: 3320930 - DNA, 17 bp, Homo sapiens
acattttttaactttct

SEQ ID NO: 3320931 - DNA, 17 bp, Homo sapiens
acattttttaagcttca

SEQ ID NO: 3320932 - DNA, 14 bp, Homo sapiens
acattttttgctat

SEQ ID NO: 3320933 - DNA, 20 bp, Homo sapiens
acattttttgctataatcat

SEQ ID NO: 3320934 - DNA, 21 bp, Homo sapiens
acattttttgctataatcatt

SEQ ID NO: 3320935 - DNA, 23 bp, Homo sapiens
acatttttttgcatgcatgcaaa

SEQ ID NO: 3320936 - DNA, 13 bp, Homo sapiens
accaaaacttcca

SEQ ID NO: 3320937 - DNA, 18 bp, Homo sapiens
accaaaattttaaaaaag

SEQ ID NO: 3320938 - DNA, 15 bp, Homo sapiens
accaaaccagccttc

SEQ ID NO: 3320939 - DNA, 22 bp, Homo sapiens
accaaactgcacacacagctcc

SEQ ID NO: 3320940 - DNA, 20 bp, Homo sapiens
accaaacttcattttttaaa

SEQ ID NO: 3320941 - DNA, 18 bp, Homo sapiens
accaaacttgttcattta

SEQ ID NO: 3320942 - DNA, 13 bp, Homo sapiens
accaaagacatca

SEQ ID NO: 3320943 - DNA, 15 bp, Homo sapiens
accaaagagggcttc

SEQ ID NO: 3320944 - DNA, 20 bp, Homo sapiens
acagctaatcagcattctca

SEQ ID NO: 3320945 - DNA, 15 bp, Homo sapiens
acagctaatgggaca

SEQ ID NO: 3320946 - DNA, 14 bp, Homo sapiens
acagctactctccc

SEQ ID NO: 3320947 - DNA, 21 bp, Homo sapiens
acagctacttggtttgtgttc

SEQ ID NO: 3320948 - DNA, 15 bp, Homo sapiens
acagctatttaaggg

SEQ ID NO: 3320949 - DNA, 15 bp, Homo sapiens
acagctcacctctga

SEQ ID NO: 3320950 - DNA, 20 bp, Homo sapiens
acagctcacctctgaaggca

SEQ ID NO: 3320951 - DNA, 14 bp, Homo sapiens
acagctcagccagt

SEQ ID NO: 3320952 - DNA, 19 bp, Homo sapiens
acagctcccaaacggaaga

SEQ ID NO: 3320953 - DNA, 14 bp, Homo sapiens
acagctccccaagt

SEQ ID NO: 3320954 - DNA, 14 bp, Homo sapiens
acagctccctgcca

SEQ ID NO: 3320955 - DNA, 15 bp, Homo sapiens
acagctcccttccct

SEQ ID NO: 3320956 - DNA, 19 bp, Homo sapiens
acagctcccttccctgcag

SEQ ID NO: 3320957 - DNA, 13 bp, Homo sapiens
acagctccttctg

SEQ ID NO: 3320958 - DNA, 14 bp, Homo sapiens
acagctccttctgt

SEQ ID NO: 3320959 - DNA, 23 bp, Homo sapiens
acagctccttctgtcctactctg

SEQ ID NO: 3320960 - DNA, 13 bp, Homo sapiens
acagctctagaca

SEQ ID NO: 3320961 - DNA, 13 bp, Homo sapiens
acagctctcccct

SEQ ID NO: 3320962 - DNA, 14 bp, Homo sapiens
acagctctgagatc

SEQ ID NO: 3320963 - DNA, 16 bp, Homo sapiens
acagctctgagatcct

SEQ ID NO: 3320964 - DNA, 15 bp, Homo sapiens
acagctctggccaca

SEQ ID NO: 3320965 - DNA, 13 bp, Homo sapiens
acagctctgtcct

SEQ ID NO: 3320966 - DNA, 19 bp, Homo sapiens
acagctctgtgttgccatg

SEQ ID NO: 3320967 - DNA, 14 bp, Homo sapiens
acagctcttcattc

SEQ ID NO: 3320968 - DNA, 22 bp, Homo sapiens
acagctgactgaatgcagaacg

SEQ ID NO: 3320969 - DNA, 19 bp, Homo sapiens
acagctgagagacttttaa

SEQ ID NO: 3320970 - DNA, 16 bp, Homo sapiens
acagctgatacttcat

SEQ ID NO: 3320971 - DNA, 16 bp, Homo sapiens
acagctgcattagaaa

SEQ ID NO: 3320972 - DNA, 16 bp, Homo sapiens
acagctgcctgcagta

SEQ ID NO: 3320973 - DNA, 16 bp, Homo sapiens
acagctggaccctgct

SEQ ID NO: 3320974 - DNA, 21 bp, Homo sapiens
acagctggaccctgcttcacc

SEQ ID NO: 3320975 - DNA, 23 bp, Homo sapiens
acagctggaccctgcttcaccct

SEQ ID NO: 3320976 - DNA, 11 bp, Homo sapiens
acagctgggca

SEQ ID NO: 3320977 - DNA, 15 bp, Homo sapiens
acagctgggcaaagc

SEQ ID NO: 3320978 - DNA, 16 bp, Homo sapiens
acagctgttcttctgt

SEQ ID NO: 3320979 - DNA, 17 bp, Homo sapiens
acagctgtttaagatgg

SEQ ID NO: 3320980 - DNA, 17 bp, Homo sapiens
acagcttcaccctgtca

SEQ ID NO: 3320981 - DNA, 13 bp, Homo sapiens
acagcttcaggtt

SEQ ID NO: 3320982 - DNA, 21 bp, Homo sapiens
acagcttcattatctgagttg

SEQ ID NO: 3320983 - DNA, 21 bp, Homo sapiens
acagcttcatttcctgtgtct

SEQ ID NO: 3320984 - DNA, 11 bp, Homo sapiens
acagcttctct

SEQ ID NO: 3320985 - DNA, 13 bp, Homo sapiens
acagcttctctgc

SEQ ID NO: 3320986 - DNA, 15 bp, Homo sapiens
acagcttgacctgag

SEQ ID NO: 3320987 - DNA, 17 bp, Homo sapiens
acagcttgacctgaggc

SEQ ID NO: 3320988 - DNA, 22 bp, Homo sapiens
acagcttgacctgaggctgtgg

SEQ ID NO: 3320989 - DNA, 23 bp, Homo sapiens
acagcttgacctgaggctgtggt

SEQ ID NO: 3320990 - DNA, 15 bp, Homo sapiens
acagctttacacaca

SEQ ID NO: 3320991 - DNA, 16 bp, Homo sapiens
acagctttacacacac

SEQ ID NO: 3320992 - DNA, 21 bp, Homo sapiens
acagctttgctccgctcccac

SEQ ID NO: 3320993 - DNA, 18 bp, Homo sapiens
acagcttttatggatgat

SEQ ID NO: 3320994 - DNA, 19 bp, Homo sapiens
acaggaaaaaaaattctgt

SEQ ID NO: 3320995 - DNA, 16 bp, Homo sapiens
acaggaaggcaggagg

SEQ ID NO: 3320996 - DNA, 22 bp, Homo sapiens
acaggaaggcaggaggggtgag

SEQ ID NO: 3320997 - DNA, 21 bp, Homo sapiens
acaggaatagatgtggtcctt

SEQ ID NO: 3320998 - DNA, 18 bp, Homo sapiens
acaggaattttattttgc

SEQ ID NO: 3320999 - DNA, 13 bp, Homo sapiens
acaggacagagtt

SEQ ID NO: 3321000 - DNA, 22 bp, Homo sapiens
acaggacagtgcttcagcctga

SEQ ID NO: 3321001 - DNA, 14 bp, Homo sapiens
acaggaccctcagg

SEQ ID NO: 3321002 - DNA, 15 bp, Homo sapiens
acaggactgtaaaga

SEQ ID NO: 3321003 - DNA, 20 bp, Homo sapiens
acaggactgtaaagatttgt

SEQ ID NO: 3321004 - DNA, 15 bp, Homo sapiens
acaggagaggcagca

SEQ ID NO: 3321005 - DNA, 14 bp, Homo sapiens
acaggagcctagcg

SEQ ID NO: 3321006 - DNA, 17 bp, Homo sapiens
acaggagcctagcggag

SEQ ID NO: 3321007 - DNA, 12 bp, Homo sapiens
acaggagctttt

SEQ ID NO: 3321008 - DNA, 14 bp, Homo sapiens
acaggaggaggaga

SEQ ID NO: 3321009 - DNA, 19 bp, Homo sapiens
acaggaggaggagatggcc

SEQ ID NO: 3321010 - DNA, 16 bp, Homo sapiens
acaggaggccagtggg

SEQ ID NO: 3321011 - DNA, 20 bp, Homo sapiens
acaggaggcggcccggccag

SEQ ID NO: 3321012 - DNA, 21 bp, Homo sapiens
acaggaggcggcccggccagc

SEQ ID NO: 3321013 - DNA, 18 bp, Homo sapiens
acaggaggtgtgaatgca

SEQ ID NO: 3321014 - DNA, 21 bp, Homo sapiens
acaggagtcagtctctttctg

SEQ ID NO: 3321015 - DNA, 19 bp, Homo sapiens
acaggagtcagtgtctggc

SEQ ID NO: 3321016 - DNA, 17 bp, Homo sapiens
acaggatgaaagttccc

SEQ ID NO: 3321017 - DNA, 14 bp, Homo sapiens
acaggatgccagcc

SEQ ID NO: 3321018 - DNA, 15 bp, Homo sapiens
acaggatgccagccc

SEQ ID NO: 3321019 - DNA, 16 bp, Homo sapiens
acaggatgccagcccc

SEQ ID NO: 3321020 - DNA, 17 bp, Homo sapiens
acaggatgccagcccct

SEQ ID NO: 3321021 - DNA, 18 bp, Homo sapiens
acaggatgccagcccctg

SEQ ID NO: 3321022 - DNA, 24 bp, Homo sapiens
acaggatgccagcccctgcctggg

SEQ ID NO: 3321023 - DNA, 14 bp, Homo sapiens
acaggattattgga

SEQ ID NO: 3321024 - DNA, 23 bp, Homo sapiens
acaggattgatcattcttttata

SEQ ID NO: 3321025 - DNA, 15 bp, Homo sapiens
acaggcaagcacctc

SEQ ID NO: 3321026 - DNA, 19 bp, Homo sapiens
acaggcaagcacctcctgc

SEQ ID NO: 3321027 - DNA, 23 bp, Homo sapiens
acaggcaagcacctcctgcctcg

SEQ ID NO: 3321028 - DNA, 18 bp, Homo sapiens
acaggcaatgctggctgt

SEQ ID NO: 3321029 - DNA, 21 bp, Homo sapiens
acagtgtaatccaggggtgta

SEQ ID NO: 3321030 - DNA, 24 bp, Homo sapiens
acagtgtctgtatcggagacagtg

SEQ ID NO: 3321031 - DNA, 13 bp, Homo sapiens
acagttaactttc

SEQ ID NO: 3321032 - DNA, 14 bp, Homo sapiens
acagttaactttca

SEQ ID NO: 3321033 - DNA, 16 bp, Homo sapiens
acagttaactttcaga

SEQ ID NO: 3321034 - DNA, 14 bp, Homo sapiens
acagttaattatgt

SEQ ID NO: 3321035 - DNA, 22 bp, Homo sapiens
acagttagggttgagttacttc

SEQ ID NO: 3321036 - DNA, 14 bp, Homo sapiens
acagttataaaatt

SEQ ID NO: 3321037 - DNA, 14 bp, Homo sapiens
acagttatattttt

SEQ ID NO: 3321038 - DNA, 14 bp, Homo sapiens
acagttatttatag

SEQ ID NO: 3321039 - DNA, 15 bp, Homo sapiens
acagttattttgata

SEQ ID NO: 3321040 - DNA, 13 bp, Homo sapiens
acagttattttgg

SEQ ID NO: 3321041 - DNA, 15 bp, Homo sapiens
acagttattttggat

SEQ ID NO: 3321042 - DNA, 14 bp, Homo sapiens
acagttcacaccct

SEQ ID NO: 3321043 - DNA, 17 bp, Homo sapiens
acagttcacaccctgca

SEQ ID NO: 3321044 - DNA, 15 bp, Homo sapiens
acagttcatatgtac

SEQ ID NO: 3321045 - DNA, 21 bp, Homo sapiens
acagttccctttatttcacat

SEQ ID NO: 3321046 - DNA, 13 bp, Homo sapiens
acagttctgaaga

SEQ ID NO: 3321047 - DNA, 15 bp, Homo sapiens
acagttctgaagaat

SEQ ID NO: 3321048 - DNA, 21 bp, Homo sapiens
acagttctgctctggttgttt

SEQ ID NO: 3321049 - DNA, 12 bp, Homo sapiens
acagttctgtgg

SEQ ID NO: 3321050 - DNA, 17 bp, Homo sapiens
acagttcttggtgactg

SEQ ID NO: 3321051 - DNA, 21 bp, Homo sapiens
acagttgccacatttagtcct

SEQ ID NO: 3321052 - DNA, 19 bp, Homo sapiens
acagttgccaccacctctg

SEQ ID NO: 3321053 - DNA, 20 bp, Homo sapiens
acagttgccaccacctctgt

SEQ ID NO: 3321054 - DNA, 14 bp, Homo sapiens
acagttggcagaga

SEQ ID NO: 3321055 - DNA, 16 bp, Homo sapiens
acagttggtaactttt

SEQ ID NO: 3321056 - DNA, 24 bp, Homo sapiens
acagttggtaacttttgtgaatta

SEQ ID NO: 3321057 - DNA, 23 bp, Homo sapiens
acagttgtctattctgagccttg

SEQ ID NO: 3321058 - DNA, 17 bp, Homo sapiens
acagtttcattattctc

SEQ ID NO: 3321059 - DNA, 16 bp, Homo sapiens
acagtttcttagcttt

SEQ ID NO: 3321060 - DNA, 18 bp, Homo sapiens
acagtttcttagcttttt

SEQ ID NO: 3321061 - DNA, 19 bp, Homo sapiens
acagtttcttgcttggaag

SEQ ID NO: 3321062 - DNA, 16 bp, Homo sapiens
acagtttgatgtcatt

SEQ ID NO: 3321063 - DNA, 17 bp, Homo sapiens
acatctgtgtttcaagt

SEQ ID NO: 3321064 - DNA, 20 bp, Homo sapiens
acatcttctgtgaaatataa

SEQ ID NO: 3321065 - DNA, 13 bp, Homo sapiens
acatcttgctctg

SEQ ID NO: 3321066 - DNA, 14 bp, Homo sapiens
acatcttgctctgc

SEQ ID NO: 3321067 - DNA, 18 bp, Homo sapiens
acatcttgctctgctgac

SEQ ID NO: 3321068 - DNA, 18 bp, Homo sapiens
acatctttattgaaattc

SEQ ID NO: 3321069 - DNA, 19 bp, Homo sapiens
acatctttattgaaattct

SEQ ID NO: 3321070 - DNA, 15 bp, Homo sapiens
acatgaaaattttaa

SEQ ID NO: 3321071 - DNA, 13 bp, Homo sapiens
acatgaaacagaa

SEQ ID NO: 3321072 - DNA, 15 bp, Homo sapiens
acatgaaacagaaac

SEQ ID NO: 3321073 - DNA, 20 bp, Homo sapiens
acatgaaacctacacactgt

SEQ ID NO: 3321074 - DNA, 22 bp, Homo sapiens
acatgaaatgccctcctaaatg

SEQ ID NO: 3321075 - DNA, 18 bp, Homo sapiens
acatgaaatgcttccaag

SEQ ID NO: 3321076 - DNA, 16 bp, Homo sapiens
acatgaacaatgtgtg

SEQ ID NO: 3321077 - DNA, 20 bp, Homo sapiens
acatgaagaatgcattcaaa

SEQ ID NO: 3321078 - DNA, 20 bp, Homo sapiens
acatgaatcccacccacatg

SEQ ID NO: 3321079 - DNA, 18 bp, Homo sapiens
acatgaattgcattttac

SEQ ID NO: 3321080 - DNA, 11 bp, Homo sapiens
acatgacactg

SEQ ID NO: 3321081 - DNA, 13 bp, Homo sapiens
acatgacactgac

SEQ ID NO: 3321082 - DNA, 16 bp, Homo sapiens
acatgactgggcctcc

SEQ ID NO: 3321083 - DNA, 12 bp, Homo sapiens
acatgagaaaga

SEQ ID NO: 3321084 - DNA, 13 bp, Homo sapiens
acatgagaaagat

SEQ ID NO: 3321085 - DNA, 23 bp, Homo sapiens
acatgagctatttccattccaga

SEQ ID NO: 3321086 - DNA, 19 bp, Homo sapiens
acatgagttattcataaag

SEQ ID NO: 3321087 - DNA, 13 bp, Homo sapiens
acatgatttcctt

SEQ ID NO: 3321088 - DNA, 17 bp, Homo sapiens
acatgatttccttgaat

SEQ ID NO: 3321089 - DNA, 21 bp, Homo sapiens
acatgatttccttgaatgtgg

SEQ ID NO: 3321090 - DNA, 23 bp, Homo sapiens
acatgcaaaaagaaatgactaat

SEQ ID NO: 3321091 - DNA, 13 bp, Homo sapiens
acatgcaataaaa

SEQ ID NO: 3321092 - DNA, 16 bp, Homo sapiens
acatgcaataaaattt

SEQ ID NO: 3321093 - DNA, 11 bp, Homo sapiens
acatgcacaca

SEQ ID NO: 3321094 - DNA, 13 bp, Homo sapiens
acatgcactgacc

SEQ ID NO: 3321095 - DNA, 18 bp, Homo sapiens
acatgcactgacccttcc

SEQ ID NO: 3321096 - DNA, 15 bp, Homo sapiens
acatgcagcccatgc

SEQ ID NO: 3321097 - DNA, 20 bp, Homo sapiens
acatgcagcccatgcccacc

SEQ ID NO: 3321098 - DNA, 16 bp, Homo sapiens
acatgcatactttatt

SEQ ID NO: 3321099 - DNA, 23 bp, Homo sapiens
acatgcattgttggctatttgaa

SEQ ID NO: 3321100 - DNA, 14 bp, Homo sapiens
acatgccagaagga

SEQ ID NO: 3321101 - DNA, 21 bp, Homo sapiens
acatgccagaaggaatcttct

SEQ ID NO: 3321102 - DNA, 13 bp, Homo sapiens
acatgccctcctg

SEQ ID NO: 3321103 - DNA, 15 bp, Homo sapiens
acatgctcacctcta

SEQ ID NO: 3321104 - DNA, 19 bp, Homo sapiens
acatgctcacctctagcct

SEQ ID NO: 3321105 - DNA, 14 bp, Homo sapiens
acatgctgagtctc

SEQ ID NO: 3321106 - DNA, 16 bp, Homo sapiens
acatgctggccagcct

SEQ ID NO: 3321107 - DNA, 19 bp, Homo sapiens
acatgctggccagcctggg

SEQ ID NO: 3321108 - DNA, 20 bp, Homo sapiens
acatgctgtgctctttgaag

SEQ ID NO: 3321109 - DNA, 16 bp, Homo sapiens
acatgcttgaataact

SEQ ID NO: 3321110 - DNA, 20 bp, Homo sapiens
acatgcttttctgccactcc

SEQ ID NO: 3321111 - DNA, 18 bp, Homo sapiens
acatggacttgtatattt

SEQ ID NO: 3321112 - DNA, 14 bp, Homo sapiens
acatggaggttcta

SEQ ID NO: 3321113 - DNA, 17 bp, Homo sapiens
acatggaggttctaagg

SEQ ID NO: 3321114 - DNA, 19 bp, Homo sapiens
acatggagtatatgtcaag

SEQ ID NO: 3321115 - DNA, 16 bp, Homo sapiens
acatggatacttcctg

SEQ ID NO: 3321116 - DNA, 15 bp, Homo sapiens
acatggccccatccc

SEQ ID NO: 3321117 - DNA, 23 bp, Homo sapiens
acatggctctggactctaaagac

SEQ ID NO: 3321118 - DNA, 23 bp, Homo sapiens
acatggtactcttgttgagttct

SEQ ID NO: 3321119 - DNA, 18 bp, Homo sapiens
acatggtgcctgagaggc

SEQ ID NO: 3321120 - DNA, 17 bp, Homo sapiens
acatgtaataaaaagta

SEQ ID NO: 3321121 - DNA, 23 bp, Homo sapiens
acatgtaataaaaagtatatgtt

SEQ ID NO: 3321122 - DNA, 19 bp, Homo sapiens
acatgtaataaattcaaaa

SEQ ID NO: 3321123 - DNA, 17 bp, Homo sapiens
acatgtaattaagtact

SEQ ID NO: 3321124 - DNA, 19 bp, Homo sapiens
acatgtaattaagtactat

SEQ ID NO: 3321125 - DNA, 21 bp, Homo sapiens
acatgtaattaagtactatgt

SEQ ID NO: 3321126 - DNA, 23 bp, Homo sapiens
acatgtaattaagtactatgtat

SEQ ID NO: 3321127 - DNA, 12 bp, Homo sapiens
acatgtacataa

SEQ ID NO: 3321128 - DNA, 15 bp, Homo sapiens
acatgtatggttact

SEQ ID NO: 3321129 - DNA, 18 bp, Homo sapiens
acatgtattgcacattgt

SEQ ID NO: 3321130 - DNA, 21 bp, Homo sapiens
acatgtattgcacattgtaaa

SEQ ID NO: 3321131 - DNA, 14 bp, Homo sapiens
acatgtatttatgt

SEQ ID NO: 3321132 - DNA, 17 bp, Homo sapiens
acatgtctgttctacat

SEQ ID NO: 3321133 - DNA, 22 bp, Homo sapiens
acatgtcttgtacatgtgtagc

SEQ ID NO: 3321134 - DNA, 12 bp, Homo sapiens
acatgtgaaacc

SEQ ID NO: 3321135 - DNA, 17 bp, Homo sapiens
acatgtgaaaccttttt

SEQ ID NO: 3321136 - DNA, 20 bp, Homo sapiens
acatgtgaaaccttttttaa

SEQ ID NO: 3321137 - DNA, 21 bp, Homo sapiens
acatgtgaaaccttttttaag

SEQ ID NO: 3321138 - DNA, 13 bp, Homo sapiens
acatgtgacattt

SEQ ID NO: 3321139 - DNA, 15 bp, Homo sapiens
acatgtgacatttat

SEQ ID NO: 3321140 - DNA, 17 bp, Homo sapiens
acatgtgaggaggaaaa

SEQ ID NO: 3321141 - DNA, 14 bp, Homo sapiens
acatgtgatacatt

SEQ ID NO: 3321142 - DNA, 21 bp, Homo sapiens
acatgtgcaattgtgagggac

SEQ ID NO: 3321143 - DNA, 18 bp, Homo sapiens
acatgtgcacatgcacgt

SEQ ID NO: 3321144 - DNA, 22 bp, Homo sapiens
acatgtgccagggcaatgatga

SEQ ID NO: 3321145 - DNA, 16 bp, Homo sapiens
acatgtggggccaggt

SEQ ID NO: 3321146 - DNA, 16 bp, Homo sapiens
acatgtggtttataga

SEQ ID NO: 3321147 - DNA, 21 bp, Homo sapiens
acatgtgtagcctatgttgtg

SEQ ID NO: 3321148 - DNA, 20 bp, Homo sapiens
acatgtgtagcctgtgcatg

SEQ ID NO: 3321149 - DNA, 14 bp, Homo sapiens
acatgtgtgtatat

SEQ ID NO: 3321150 - DNA, 18 bp, Homo sapiens
acatgtgtgtatatatgt

SEQ ID NO: 3321151 - DNA, 17 bp, Homo sapiens
acatgttactgaccagc

SEQ ID NO: 3321152 - DNA, 19 bp, Homo sapiens
acatgttactggataaatt

SEQ ID NO: 3321153 - DNA, 21 bp, Homo sapiens
acatgttactggataaattgt

SEQ ID NO: 3321154 - DNA, 22 bp, Homo sapiens
acatgttctaatactttgttta

SEQ ID NO: 3321155 - DNA, 14 bp, Homo sapiens
acatgttgtaaatt

SEQ ID NO: 3321156 - DNA, 15 bp, Homo sapiens
acatgtttacaggtt

SEQ ID NO: 3321157 - DNA, 13 bp, Homo sapiens
acatgtttccatc

SEQ ID NO: 3321158 - DNA, 11 bp, Homo sapiens
acatgtttcct

SEQ ID NO: 3321159 - DNA, 13 bp, Homo sapiens
acatgtttctgtt

SEQ ID NO: 3321160 - DNA, 22 bp, Homo sapiens
acatgtttctgttttgttgttt

SEQ ID NO: 3321161 - DNA, 15 bp, Homo sapiens
acattaaaaatggaa

SEQ ID NO: 3321162 - DNA, 21 bp, Homo sapiens
acattaaaagaagactggaag

SEQ ID NO: 3321163 - DNA, 16 bp, Homo sapiens
acattaaaataaacca

SEQ ID NO: 3321164 - DNA, 21 bp, Homo sapiens
acagacacgctcgcgggcagc

SEQ ID NO: 3321165 - DNA, 20 bp, Homo sapiens
acagacactacatatctaaa

SEQ ID NO: 3321166 - DNA, 18 bp, Homo sapiens
acagacagaagagaagga

SEQ ID NO: 3321167 - DNA, 21 bp, Homo sapiens
acagacagagaaggcagcagg

SEQ ID NO: 3321168 - DNA, 13 bp, Homo sapiens
acagacaggctct

SEQ ID NO: 3321169 - DNA, 21 bp, Homo sapiens
acagaccacatctttatctgt

SEQ ID NO: 3321170 - DNA, 22 bp, Homo sapiens
acagaccacatctttatctgtt

SEQ ID NO: 3321171 - DNA, 21 bp, Homo sapiens
acagaccagtgaccccagaaa

SEQ ID NO: 3321172 - DNA, 12 bp, Homo sapiens
acagacccaggt

SEQ ID NO: 3321173 - DNA, 14 bp, Homo sapiens
acagacccaggtct

SEQ ID NO: 3321174 - DNA, 21 bp, Homo sapiens
acagacccctcccctcgtgtc

SEQ ID NO: 3321175 - DNA, 16 bp, Homo sapiens
acagacccctgggagc

SEQ ID NO: 3321176 - DNA, 21 bp, Homo sapiens
acagacctgctttttgaaatg

SEQ ID NO: 3321177 - DNA, 17 bp, Homo sapiens
acagacctggagcccct

SEQ ID NO: 3321178 - DNA, 21 bp, Homo sapiens
acagacctggagcccctgggt

SEQ ID NO: 3321179 - DNA, 23 bp, Homo sapiens
acagactgcgatttgtcccaggt

SEQ ID NO: 3321180 - DNA, 14 bp, Homo sapiens
acagactggaagca

SEQ ID NO: 3321181 - DNA, 19 bp, Homo sapiens
acagactggaagcacagct

SEQ ID NO: 3321182 - DNA, 17 bp, Homo sapiens
acagactggcaataaac

SEQ ID NO: 3321183 - DNA, 20 bp, Homo sapiens
acagactggccgggcaggcg

SEQ ID NO: 3321184 - DNA, 15 bp, Homo sapiens
acagactgttaatta

SEQ ID NO: 3321185 - DNA, 19 bp, Homo sapiens
acagactgttttactgttt

SEQ ID NO: 3321186 - DNA, 17 bp, Homo sapiens
acagacttctccagacc

SEQ ID NO: 3321187 - DNA, 16 bp, Homo sapiens
acagacttctggaagg

SEQ ID NO: 3321188 - DNA, 19 bp, Homo sapiens
acagacttctggaaggctg

SEQ ID NO: 3321189 - DNA, 22 bp, Homo sapiens
acagacttctggaaggctggct

SEQ ID NO: 3321190 - DNA, 14 bp, Homo sapiens
acagacttgagaac

SEQ ID NO: 3321191 - DNA, 18 bp, Homo sapiens
acagagaaagtacttctc

SEQ ID NO: 3321192 - DNA, 21 bp, Homo sapiens
acagagaagtttgtagccagg

SEQ ID NO: 3321193 - DNA, 22 bp, Homo sapiens
acagagaagtttgtagccaggt

SEQ ID NO: 3321194 - DNA, 23 bp, Homo sapiens
acagagaagtttgtagccaggta

SEQ ID NO: 3321195 - DNA, 15 bp, Homo sapiens
acagagacaggccca

SEQ ID NO: 3321196 - DNA, 16 bp, Homo sapiens
acagagacattcctcc

SEQ ID NO: 3321197 - DNA, 20 bp, Homo sapiens
acagagactcagcgctcctc

SEQ ID NO: 3321198 - DNA, 20 bp, Homo sapiens
acagagactgaatagatatg

SEQ ID NO: 3321199 - DNA, 13 bp, Homo sapiens
acagagagaaaaa

SEQ ID NO: 3321200 - DNA, 14 bp, Homo sapiens
acagagaggagaaa

SEQ ID NO: 3321201 - DNA, 24 bp, Homo sapiens
acagagagggagagcagagaaaga

SEQ ID NO: 3321202 - DNA, 20 bp, Homo sapiens
acagagattgaactccaaga

SEQ ID NO: 3321203 - DNA, 22 bp, Homo sapiens
acagagcactaggttcaattcc

SEQ ID NO: 3321204 - DNA, 14 bp, Homo sapiens
acagagcaggactg

SEQ ID NO: 3321205 - DNA, 20 bp, Homo sapiens
acagagcaggggctccagca

SEQ ID NO: 3321206 - DNA, 22 bp, Homo sapiens
acagagcgtggctgtgctctca

SEQ ID NO: 3321207 - DNA, 22 bp, Homo sapiens
acagagctgtcacttttgctcc

SEQ ID NO: 3321208 - DNA, 23 bp, Homo sapiens
acagaggaaacaatatttataaa

SEQ ID NO: 3321209 - DNA, 16 bp, Homo sapiens
acagaggaagagcagg

SEQ ID NO: 3321210 - DNA, 17 bp, Homo sapiens
acagaggaagagcaggc

SEQ ID NO: 3321211 - DNA, 18 bp, Homo sapiens
acagaggaagagcaggca

SEQ ID NO: 3321212 - DNA, 14 bp, Homo sapiens
acagaggcagcccc

SEQ ID NO: 3321213 - DNA, 15 bp, Homo sapiens
acagaggcagcccca

SEQ ID NO: 3321214 - DNA, 19 bp, Homo sapiens
acagaggcagccccattct

SEQ ID NO: 3321215 - DNA, 21 bp, Homo sapiens
acagaggccatgggcctcctg

SEQ ID NO: 3321216 - DNA, 12 bp, Homo sapiens
acagagggctgc

SEQ ID NO: 3321217 - DNA, 16 bp, Homo sapiens
acagagtccgggagaa

SEQ ID NO: 3321218 - DNA, 17 bp, Homo sapiens
acagagtgagccagtga

SEQ ID NO: 3321219 - DNA, 15 bp, Homo sapiens
acagagtgctggact

SEQ ID NO: 3321220 - DNA, 16 bp, Homo sapiens
acagagtgcttttctg

SEQ ID NO: 3321221 - DNA, 14 bp, Homo sapiens
acagagtggccgtc

SEQ ID NO: 3321222 - DNA, 18 bp, Homo sapiens
acagagtggcctccctgc

SEQ ID NO: 3321223 - DNA, 20 bp, Homo sapiens
acagagtggcctccctgctg

SEQ ID NO: 3321224 - DNA, 15 bp, Homo sapiens
acagagtgggccccg

SEQ ID NO: 3321225 - DNA, 24 bp, Homo sapiens
acagagtggtctttctggagaggt

SEQ ID NO: 3321226 - DNA, 14 bp, Homo sapiens
acagagttcacagg

SEQ ID NO: 3321227 - DNA, 17 bp, Homo sapiens
acagagttcacaggagg

SEQ ID NO: 3321228 - DNA, 18 bp, Homo sapiens
acagagttcacaggaggc

SEQ ID NO: 3321229 - DNA, 21 bp, Homo sapiens
acagataagcaagagagatgt

SEQ ID NO: 3321230 - DNA, 13 bp, Homo sapiens
acagatacatttc

SEQ ID NO: 3321231 - DNA, 21 bp, Homo sapiens
acagatactggaagttttgca

SEQ ID NO: 3321232 - DNA, 13 bp, Homo sapiens
acagatagttgtg

SEQ ID NO: 3321233 - DNA, 16 bp, Homo sapiens
acagatatcagtgtct

SEQ ID NO: 3321234 - DNA, 15 bp, Homo sapiens
acagatatctttttc

SEQ ID NO: 3321235 - DNA, 17 bp, Homo sapiens
acagatcagaacatgaa

SEQ ID NO: 3321236 - DNA, 17 bp, Homo sapiens
acagatcctttttccat

SEQ ID NO: 3321237 - DNA, 19 bp, Homo sapiens
acagatcctttttccatca

SEQ ID NO: 3321238 - DNA, 20 bp, Homo sapiens
acagatcctttttccatcat

SEQ ID NO: 3321239 - DNA, 23 bp, Homo sapiens
acagatcgaaccgttttgaagct

SEQ ID NO: 3321240 - DNA, 16 bp, Homo sapiens
acagatctttactctt

SEQ ID NO: 3321241 - DNA, 12 bp, Homo sapiens
acagatgaaaat

SEQ ID NO: 3321242 - DNA, 14 bp, Homo sapiens
acagatgaataaac

SEQ ID NO: 3321243 - DNA, 17 bp, Homo sapiens
acagatgaatgtattta

SEQ ID NO: 3321244 - DNA, 19 bp, Homo sapiens
acagatgaccataattttt

SEQ ID NO: 3321245 - DNA, 19 bp, Homo sapiens
acagatgatgagaatttct

SEQ ID NO: 3321246 - DNA, 20 bp, Homo sapiens
acagatgatgagaatttcta

SEQ ID NO: 3321247 - DNA, 16 bp, Homo sapiens
acagatgcaatgtgct

SEQ ID NO: 3321248 - DNA, 13 bp, Homo sapiens
acagatgccccag

SEQ ID NO: 3321249 - DNA, 16 bp, Homo sapiens
acagatgccccagagc

SEQ ID NO: 3321250 - DNA, 19 bp, Homo sapiens
acagatgccttttttgtag

SEQ ID NO: 3321251 - DNA, 21 bp, Homo sapiens
acagatgtaattatgttttca

SEQ ID NO: 3321252 - DNA, 13 bp, Homo sapiens
acagatgtgaaaa

SEQ ID NO: 3321253 - DNA, 19 bp, Homo sapiens
acagatgtgaaaataaagc

SEQ ID NO: 3321254 - DNA, 12 bp, Homo sapiens
acagatgttgaa

SEQ ID NO: 3321255 - DNA, 21 bp, Homo sapiens
acagattctttcagttctttg

SEQ ID NO: 3321256 - DNA, 14 bp, Homo sapiens
acagattgtttcta

SEQ ID NO: 3321257 - DNA, 16 bp, Homo sapiens
acagatttcatacctc

SEQ ID NO: 3321258 - DNA, 20 bp, Homo sapiens
acagattttaattgtcatgg

SEQ ID NO: 3321259 - DNA, 12 bp, Homo sapiens
acagattttatt

SEQ ID NO: 3321260 - DNA, 14 bp, Homo sapiens
acagattttatttg

SEQ ID NO: 3321261 - DNA, 19 bp, Homo sapiens
acagattttatttgtaatt

SEQ ID NO: 3321262 - DNA, 20 bp, Homo sapiens
acagattttggggttgtgtt

SEQ ID NO: 3321263 - DNA, 16 bp, Homo sapiens
acagatttttacaaat

SEQ ID NO: 3321264 - DNA, 17 bp, Homo sapiens
acagatttttacaaatg

SEQ ID NO: 3321265 - DNA, 19 bp, Homo sapiens
acagcaaaatgttgaagaa

SEQ ID NO: 3321266 - DNA, 13 bp, Homo sapiens
acagcaaaccctg

SEQ ID NO: 3321267 - DNA, 17 bp, Homo sapiens
acagcaacaatttatga

SEQ ID NO: 3321268 - DNA, 18 bp, Homo sapiens
acagcacatgctggccag

SEQ ID NO: 3321269 - DNA, 12 bp, Homo sapiens
acagcactactc

SEQ ID NO: 3321270 - DNA, 13 bp, Homo sapiens
acagcactactct

SEQ ID NO: 3321271 - DNA, 15 bp, Homo sapiens
acagcactactctgt

SEQ ID NO: 3321272 - DNA, 17 bp, Homo sapiens
acagcactactctgtgc

SEQ ID NO: 3321273 - DNA, 19 bp, Homo sapiens
acagcactggctctctcca

SEQ ID NO: 3321274 - DNA, 12 bp, Homo sapiens
acagcacttgtt

SEQ ID NO: 3321275 - DNA, 22 bp, Homo sapiens
acagcagcagaacaagtgcctc

SEQ ID NO: 3321276 - DNA, 19 bp, Homo sapiens
acagcagccccccagcact

SEQ ID NO: 3321277 - DNA, 15 bp, Homo sapiens
acagcagcctccaac

SEQ ID NO: 3321278 - DNA, 11 bp, Homo sapiens
acagcagcctg

SEQ ID NO: 3321279 - DNA, 12 bp, Homo sapiens
acagcagcttca

SEQ ID NO: 3321280 - DNA, 17 bp, Homo sapiens
acagcagcttcaccaga

SEQ ID NO: 3321281 - DNA, 18 bp, Homo sapiens
acagcagcttcaccagag

SEQ ID NO: 3321282 - DNA, 22 bp, Homo sapiens
acagcagcttcaccagagcatt

SEQ ID NO: 3321283 - DNA, 22 bp, Homo sapiens
acagcagggtagtctggtttct

SEQ ID NO: 3321284 - DNA, 17 bp, Homo sapiens
acagcagtgtcatcaga

SEQ ID NO: 3321285 - DNA, 13 bp, Homo sapiens
acagcagtgttcc

SEQ ID NO: 3321286 - DNA, 19 bp, Homo sapiens
acagcagtgttccccatct

SEQ ID NO: 3321287 - DNA, 21 bp, Homo sapiens
acagcatcgggagcacccaga

SEQ ID NO: 3321288 - DNA, 13 bp, Homo sapiens
acagcatgaataa

SEQ ID NO: 3321289 - DNA, 15 bp, Homo sapiens
acagcatgaataaaa

SEQ ID NO: 3321290 - DNA, 24 bp, Homo sapiens
acagcatgaataaaacactcatcc

SEQ ID NO: 3321291 - DNA, 14 bp, Homo sapiens
acagcatgcccctt

SEQ ID NO: 3321292 - DNA, 19 bp, Homo sapiens
acagcatgccccttggctg

SEQ ID NO: 3321293 - DNA, 16 bp, Homo sapiens
aatgtggccacttatt

SEQ ID NO: 3321294 - DNA, 21 bp, Homo sapiens
aatgtggcttgagaaatatgg

SEQ ID NO: 3321295 - DNA, 16 bp, Homo sapiens
aatgtggtctcaggat

SEQ ID NO: 3321296 - DNA, 13 bp, Homo sapiens
aatgtgtaagaac

SEQ ID NO: 3321297 - DNA, 21 bp, Homo sapiens
aatgtgtaagaacaactacct

SEQ ID NO: 3321298 - DNA, 14 bp, Homo sapiens
aatgtgtcattgga

SEQ ID NO: 3321299 - DNA, 23 bp, Homo sapiens
aatgtgtcctatctatcttccaa

SEQ ID NO: 3321300 - DNA, 16 bp, Homo sapiens
aatgtgtggtggcctc

SEQ ID NO: 3321301 - DNA, 16 bp, Homo sapiens
aatgtgtttttctcca

SEQ ID NO: 3321302 - DNA, 22 bp, Homo sapiens
aatgtgtttttctccagtgctg

SEQ ID NO: 3321303 - DNA, 13 bp, Homo sapiens
aatgttaaaggga

SEQ ID NO: 3321304 - DNA, 18 bp, Homo sapiens
aatgttaaagggatattt

SEQ ID NO: 3321305 - DNA, 17 bp, Homo sapiens
aatgttaactacatatt

SEQ ID NO: 3321306 - DNA, 15 bp, Homo sapiens
aatgttaagaattga

SEQ ID NO: 3321307 - DNA, 15 bp, Homo sapiens
aatgttacattatta

SEQ ID NO: 3321308 - DNA, 16 bp, Homo sapiens
aatgttacattattat

SEQ ID NO: 3321309 - DNA, 21 bp, Homo sapiens
aatgttactcagatataagag

SEQ ID NO: 3321310 - DNA, 18 bp, Homo sapiens
aatgttagatattgctac

SEQ ID NO: 3321311 - DNA, 23 bp, Homo sapiens
aatgttatcttctcaagttctaa

SEQ ID NO: 3321312 - DNA, 24 bp, Homo sapiens
aatgttcattgtaatgttactgat

SEQ ID NO: 3321313 - DNA, 14 bp, Homo sapiens
aatgttccctgcac

SEQ ID NO: 3321314 - DNA, 20 bp, Homo sapiens
aatgttccctgcaccctgga

SEQ ID NO: 3321315 - DNA, 14 bp, Homo sapiens
aatgttctaagttt

SEQ ID NO: 3321316 - DNA, 20 bp, Homo sapiens
aatgttctaagtttctaaga

SEQ ID NO: 3321317 - DNA, 21 bp, Homo sapiens
aatgttctaagtttctaagat

SEQ ID NO: 3321318 - DNA, 23 bp, Homo sapiens
aatgttctaagtttctaagattc

SEQ ID NO: 3321319 - DNA, 20 bp, Homo sapiens
aatgttctatggttatgaaa

SEQ ID NO: 3321320 - DNA, 17 bp, Homo sapiens
aatgttctcagatttct

SEQ ID NO: 3321321 - DNA, 19 bp, Homo sapiens
aatgttgaaccaaacctcc

SEQ ID NO: 3321322 - DNA, 20 bp, Homo sapiens
aatgttgcttaggatgtgtg

SEQ ID NO: 3321323 - DNA, 14 bp, Homo sapiens
aatgttggaatgtt

SEQ ID NO: 3321324 - DNA, 22 bp, Homo sapiens
aatgttgtagttacctactgag

SEQ ID NO: 3321325 - DNA, 21 bp, Homo sapiens
aatgttgtccaacaataaaca

SEQ ID NO: 3321326 - DNA, 16 bp, Homo sapiens
aatgtttaaatataaa

SEQ ID NO: 3321327 - DNA, 12 bp, Homo sapiens
aatgtttaaatc

SEQ ID NO: 3321328 - DNA, 22 bp, Homo sapiens
aatgtttaaatcatgtatgtta

SEQ ID NO: 3321329 - DNA, 20 bp, Homo sapiens
aatgtttacactctttgtaa

SEQ ID NO: 3321330 - DNA, 14 bp, Homo sapiens
aatgtttatactgt

SEQ ID NO: 3321331 - DNA, 15 bp, Homo sapiens
aatgtttatgagcca

SEQ ID NO: 3321332 - DNA, 21 bp, Homo sapiens
aatgtttcttttgtttggtaa

SEQ ID NO: 3321333 - DNA, 23 bp, Homo sapiens
aatgtttgaggagcatgttttgt

SEQ ID NO: 3321334 - DNA, 13 bp, Homo sapiens
aatgtttgatgtc

SEQ ID NO: 3321335 - DNA, 18 bp, Homo sapiens
aatgtttgcctctgcctc

SEQ ID NO: 3321336 - DNA, 19 bp, Homo sapiens
aatgtttgcctctgcctct

SEQ ID NO: 3321337 - DNA, 20 bp, Homo sapiens
aatgtttgtctcagttggaa

SEQ ID NO: 3321338 - DNA, 18 bp, Homo sapiens
aatgtttgttaaaaataa

SEQ ID NO: 3321339 - DNA, 13 bp, Homo sapiens
aatgttttaaatt

SEQ ID NO: 3321340 - DNA, 20 bp, Homo sapiens
aatgttttcattatgttcat

SEQ ID NO: 3321341 - DNA, 14 bp, Homo sapiens
aatgttttgtacaa

SEQ ID NO: 3321342 - DNA, 18 bp, Homo sapiens
aatgttttgtatatacag

SEQ ID NO: 3321343 - DNA, 19 bp, Homo sapiens
aatgttttgtatatacagt

SEQ ID NO: 3321344 - DNA, 13 bp, Homo sapiens
aatgttttttgcc

SEQ ID NO: 3321345 - DNA, 17 bp, Homo sapiens
aattaaaaaaaaattgt

SEQ ID NO: 3321346 - DNA, 21 bp, Homo sapiens
aattaaaaaccactgaacatt

SEQ ID NO: 3321347 - DNA, 15 bp, Homo sapiens
aattaaaaagattct

SEQ ID NO: 3321348 - DNA, 19 bp, Homo sapiens
aattaaaaagattcttttt

SEQ ID NO: 3321349 - DNA, 23 bp, Homo sapiens
aattaaaaagattctttttctga

SEQ ID NO: 3321350 - DNA, 16 bp, Homo sapiens
aattaaaacagctgca

SEQ ID NO: 3321351 - DNA, 21 bp, Homo sapiens
aattaaaacatatttcatttt

SEQ ID NO: 3321352 - DNA, 14 bp, Homo sapiens
aattaaaacgaaaa

SEQ ID NO: 3321353 - DNA, 20 bp, Homo sapiens
aattaaaaggatagtatttt

SEQ ID NO: 3321354 - DNA, 16 bp, Homo sapiens
aattaaacttccaaag

SEQ ID NO: 3321355 - DNA, 21 bp, Homo sapiens
aattaaacttccaaagaaagt

SEQ ID NO: 3321356 - DNA, 18 bp, Homo sapiens
aattaaaggtcctgccct

SEQ ID NO: 3321357 - DNA, 14 bp, Homo sapiens
aattaaataaatga

SEQ ID NO: 3321358 - DNA, 17 bp, Homo sapiens
aattaaatccaataaaa

SEQ ID NO: 3321359 - DNA, 17 bp, Homo sapiens
aattaaatgccttgtat

SEQ ID NO: 3321360 - DNA, 12 bp, Homo sapiens
aattaaatgtag

SEQ ID NO: 3321361 - DNA, 17 bp, Homo sapiens
aattaaatgtatttaat

SEQ ID NO: 3321362 - DNA, 22 bp, Homo sapiens
aattaaattttgagttctacat

SEQ ID NO: 3321363 - DNA, 21 bp, Homo sapiens
aattaagaatatgtttccttg

SEQ ID NO: 3321364 - DNA, 13 bp, Homo sapiens
aattaagaatctc

SEQ ID NO: 3321365 - DNA, 22 bp, Homo sapiens
aattaagcaaatgttaaaagtt

SEQ ID NO: 3321366 - DNA, 12 bp, Homo sapiens
aattaagtagaa

SEQ ID NO: 3321367 - DNA, 20 bp, Homo sapiens
aattaatagtttgtctattt

SEQ ID NO: 3321368 - DNA, 16 bp, Homo sapiens
aattaatggaatcttc

SEQ ID NO: 3321369 - DNA, 13 bp, Homo sapiens
aattaattaagta

SEQ ID NO: 3321370 - DNA, 15 bp, Homo sapiens
aattaattgtcatta

SEQ ID NO: 3321371 - DNA, 15 bp, Homo sapiens
aattaatttgattaa

SEQ ID NO: 3321372 - DNA, 16 bp, Homo sapiens
aattaatttgattaac

SEQ ID NO: 3321373 - DNA, 21 bp, Homo sapiens
aattaatttgattaacaaata

SEQ ID NO: 3321374 - DNA, 13 bp, Homo sapiens
aattaatttggag

SEQ ID NO: 3321375 - DNA, 19 bp, Homo sapiens
aattacaattttatctgtt

SEQ ID NO: 3321376 - DNA, 15 bp, Homo sapiens
aattacagcttttat

SEQ ID NO: 3321377 - DNA, 17 bp, Homo sapiens
aattacagcttttatgg

SEQ ID NO: 3321378 - DNA, 16 bp, Homo sapiens
aattacagggtgactc

SEQ ID NO: 3321379 - DNA, 19 bp, Homo sapiens
aattacagggtgactcaca

SEQ ID NO: 3321380 - DNA, 21 bp, Homo sapiens
aattacagttaaagaagcaat

SEQ ID NO: 3321381 - DNA, 14 bp, Homo sapiens
aattacattcctaa

SEQ ID NO: 3321382 - DNA, 19 bp, Homo sapiens
aattacattcctaactaga

SEQ ID NO: 3321383 - DNA, 15 bp, Homo sapiens
aattaccaacctgtt

SEQ ID NO: 3321384 - DNA, 15 bp, Homo sapiens
aattaccattaatta

SEQ ID NO: 3321385 - DNA, 14 bp, Homo sapiens
aattacccactgtc

SEQ ID NO: 3321386 - DNA, 16 bp, Homo sapiens
aattacgtatgcaagt

SEQ ID NO: 3321387 - DNA, 24 bp, Homo sapiens
aattactaaattgtatacattttg

SEQ ID NO: 3321388 - DNA, 18 bp, Homo sapiens
aattactgtatataaact

SEQ ID NO: 3321389 - DNA, 15 bp, Homo sapiens
aattactgtgtaaat

SEQ ID NO: 3321390 - DNA, 18 bp, Homo sapiens
aattagaaaatattctct

SEQ ID NO: 3321391 - DNA, 23 bp, Homo sapiens
aattagactgtgattcagaaaat

SEQ ID NO: 3321392 - DNA, 13 bp, Homo sapiens
aattagatggctt

SEQ ID NO: 3321393 - DNA, 17 bp, Homo sapiens
aattagctctggggggc

SEQ ID NO: 3321394 - DNA, 16 bp, Homo sapiens
aattagctgtgtgaaa

SEQ ID NO: 3321395 - DNA, 14 bp, Homo sapiens
acacttcttttgaa

SEQ ID NO: 3321396 - DNA, 13 bp, Homo sapiens
acacttgaaacct

SEQ ID NO: 3321397 - DNA, 14 bp, Homo sapiens
acacttgagaggat

SEQ ID NO: 3321398 - DNA, 20 bp, Homo sapiens
acacttgccttcttcaccca

SEQ ID NO: 3321399 - DNA, 13 bp, Homo sapiens
acacttgctgggg

SEQ ID NO: 3321400 - DNA, 15 bp, Homo sapiens
acacttgtcagcctc

SEQ ID NO: 3321401 - DNA, 20 bp, Homo sapiens
acacttgttccagctctttg

SEQ ID NO: 3321402 - DNA, 13 bp, Homo sapiens
acactttatttac

SEQ ID NO: 3321403 - DNA, 17 bp, Homo sapiens
acactttcaaagacaat

SEQ ID NO: 3321404 - DNA, 20 bp, Homo sapiens
acactttcattacttttaaa

SEQ ID NO: 3321405 - DNA, 23 bp, Homo sapiens
acactttgagcatttttaaggga

SEQ ID NO: 3321406 - DNA, 17 bp, Homo sapiens
acactttgcactgatat

SEQ ID NO: 3321407 - DNA, 19 bp, Homo sapiens
acactttgcactgatatat

SEQ ID NO: 3321408 - DNA, 22 bp, Homo sapiens
acactttgcactgatatatcat

SEQ ID NO: 3321409 - DNA, 23 bp, Homo sapiens
acactttgcctcctgtgtactgt

SEQ ID NO: 3321410 - DNA, 22 bp, Homo sapiens
acactttggaagtttgtgttct

SEQ ID NO: 3321411 - DNA, 13 bp, Homo sapiens
acactttgtatta

SEQ ID NO: 3321412 - DNA, 18 bp, Homo sapiens
acacttttgagacttttt

SEQ ID NO: 3321413 - DNA, 16 bp, Homo sapiens
acagaaaaataagtca

SEQ ID NO: 3321414 - DNA, 15 bp, Homo sapiens
acagaaaaatcttgt

SEQ ID NO: 3321415 - DNA, 22 bp, Homo sapiens
acagaaaacattctgatttgga

SEQ ID NO: 3321416 - DNA, 17 bp, Homo sapiens
acagaaacatgccagaa

SEQ ID NO: 3321417 - DNA, 22 bp, Homo sapiens
acagaaacctatcctcactgcc

SEQ ID NO: 3321418 - DNA, 20 bp, Homo sapiens
acagaaacctttttaaaaat

SEQ ID NO: 3321419 - DNA, 21 bp, Homo sapiens
acagaaacgtgttaaaggttt

SEQ ID NO: 3321420 - DNA, 23 bp, Homo sapiens
acagaaactaaactcttaccata

SEQ ID NO: 3321421 - DNA, 16 bp, Homo sapiens
acagaaactgatgcca

SEQ ID NO: 3321422 - DNA, 20 bp, Homo sapiens
acagaaagagactccgtctc

SEQ ID NO: 3321423 - DNA, 19 bp, Homo sapiens
acagaaagtcattccttct

SEQ ID NO: 3321424 - DNA, 14 bp, Homo sapiens
acagaaatatatat

SEQ ID NO: 3321425 - DNA, 20 bp, Homo sapiens
acagaaatatatatacatat

SEQ ID NO: 3321426 - DNA, 22 bp, Homo sapiens
acagaaatatatatacatatgt

SEQ ID NO: 3321427 - DNA, 15 bp, Homo sapiens
acagaaatggactgg

SEQ ID NO: 3321428 - DNA, 14 bp, Homo sapiens
acagaacagcttca

SEQ ID NO: 3321429 - DNA, 17 bp, Homo sapiens
acagaacagcttcaggt

SEQ ID NO: 3321430 - DNA, 18 bp, Homo sapiens
acagaacagcttcaggtt

SEQ ID NO: 3321431 - DNA, 23 bp, Homo sapiens
acagaacaggaggtgtgaatgca

SEQ ID NO: 3321432 - DNA, 15 bp, Homo sapiens
acagaacagggtcat

SEQ ID NO: 3321433 - DNA, 22 bp, Homo sapiens
acagaacctactgttcctttca

SEQ ID NO: 3321434 - DNA, 18 bp, Homo sapiens
acagaaccttcaacccag

SEQ ID NO: 3321435 - DNA, 19 bp, Homo sapiens
acagaacttcagaaagact

SEQ ID NO: 3321436 - DNA, 17 bp, Homo sapiens
acagaacttgaatgtgt

SEQ ID NO: 3321437 - DNA, 17 bp, Homo sapiens
acagaagagaaggaagc

SEQ ID NO: 3321438 - DNA, 19 bp, Homo sapiens
acagaagcaggctggaggt

SEQ ID NO: 3321439 - DNA, 14 bp, Homo sapiens
acagaagcatttgt

SEQ ID NO: 3321440 - DNA, 15 bp, Homo sapiens
acagaagcatttgta

SEQ ID NO: 3321441 - DNA, 17 bp, Homo sapiens
acagaagcatttgtatt

SEQ ID NO: 3321442 - DNA, 22 bp, Homo sapiens
acagaagccaagctccctggag

SEQ ID NO: 3321443 - DNA, 23 bp, Homo sapiens
acagaagccaagctccctggagc

SEQ ID NO: 3321444 - DNA, 14 bp, Homo sapiens
acagaagcttcaga

SEQ ID NO: 3321445 - DNA, 18 bp, Homo sapiens
acagaagcttcagaagtt

SEQ ID NO: 3321446 - DNA, 19 bp, Homo sapiens
acagaagcttcagaagttt

SEQ ID NO: 3321447 - DNA, 14 bp, Homo sapiens
acagaagggctctt

SEQ ID NO: 3321448 - DNA, 16 bp, Homo sapiens
acagaataaagcagcc

SEQ ID NO: 3321449 - DNA, 21 bp, Homo sapiens
acagaataaagcagcctgatt

SEQ ID NO: 3321450 - DNA, 19 bp, Homo sapiens
acagaatatttctattgaa

SEQ ID NO: 3321451 - DNA, 18 bp, Homo sapiens
acagaatcttgttttgaa

SEQ ID NO: 3321452 - DNA, 13 bp, Homo sapiens
acagaatgtatct

SEQ ID NO: 3321453 - DNA, 15 bp, Homo sapiens
acagaatgtatctgt

SEQ ID NO: 3321454 - DNA, 17 bp, Homo sapiens
acagaatgtatctgtga

SEQ ID NO: 3321455 - DNA, 13 bp, Homo sapiens
acagaatttgaat

SEQ ID NO: 3321456 - DNA, 23 bp, Homo sapiens
acagaatttgaattatcagcaaa

SEQ ID NO: 3321457 - DNA, 17 bp, Homo sapiens
acagacaaagagagtgg

SEQ ID NO: 3321458 - DNA, 14 bp, Homo sapiens
acagacaagcagcc

SEQ ID NO: 3321459 - DNA, 18 bp, Homo sapiens
acagacaagcagcccttg

SEQ ID NO: 3321460 - DNA, 14 bp, Homo sapiens
acagacaaggagga

SEQ ID NO: 3321461 - DNA, 19 bp, Homo sapiens
acagacacaatatgtatgc

SEQ ID NO: 3321462 - DNA, 11 bp, Homo sapiens
acagacacagg

SEQ ID NO: 3321463 - DNA, 13 bp, Homo sapiens
acagacacaggcc

SEQ ID NO: 3321464 - DNA, 14 bp, Homo sapiens
acagacacaggccc

SEQ ID NO: 3321465 - DNA, 18 bp, Homo sapiens
acagacacaggcccggct

SEQ ID NO: 3321466 - DNA, 22 bp, Homo sapiens
acagacacaggcccggctccag

SEQ ID NO: 3321467 - DNA, 20 bp, Homo sapiens
acagacacgctcgcgggcag

SEQ ID NO: 3321468 - DNA, 17 bp, Homo sapiens
ccagaggtccagcccat

SEQ ID NO: 3321469 - DNA, 19 bp, Homo sapiens
ccagaggtccagcccatct

SEQ ID NO: 3321470 - DNA, 19 bp, Homo sapiens
ccagaggtctagattaata

SEQ ID NO: 3321471 - DNA, 20 bp, Homo sapiens
ccagaggtgggatcctccct

SEQ ID NO: 3321472 - DNA, 18 bp, Homo sapiens
ccagaggttatctgcctg

SEQ ID NO: 3321473 - DNA, 15 bp, Homo sapiens
ccagagtctgagccc

SEQ ID NO: 3321474 - DNA, 17 bp, Homo sapiens
ccagagtctgagccccc

SEQ ID NO: 3321475 - DNA, 22 bp, Homo sapiens
ccagagtgaaagggctatggca

SEQ ID NO: 3321476 - DNA, 15 bp, Homo sapiens
ccagagtggagtctg

SEQ ID NO: 3321477 - DNA, 17 bp, Homo sapiens
ccagagtggagtctgag

SEQ ID NO: 3321478 - DNA, 18 bp, Homo sapiens
ccagagtggagtctgagt

SEQ ID NO: 3321479 - DNA, 19 bp, Homo sapiens
ccagagtggagtctgagtc

SEQ ID NO: 3321480 - DNA, 13 bp, Homo sapiens
ccagagttcctgc

SEQ ID NO: 3321481 - DNA, 17 bp, Homo sapiens
ccagagttcctgcggag

SEQ ID NO: 3321482 - DNA, 18 bp, Homo sapiens
ccagatagagctgggtgg

SEQ ID NO: 3321483 - DNA, 22 bp, Homo sapiens
ccagatagagctgggtggcctg

SEQ ID NO: 3321484 - DNA, 17 bp, Homo sapiens
ccagatagtgtagctga

SEQ ID NO: 3321485 - DNA, 15 bp, Homo sapiens
ccagatctgcctggg

SEQ ID NO: 3321486 - DNA, 19 bp, Homo sapiens
ccagatctgcctgggcctg

SEQ ID NO: 3321487 - DNA, 24 bp, Homo sapiens
ccagatctgcctgggcctgtgcag

SEQ ID NO: 3321488 - DNA, 17 bp, Homo sapiens
ccagatctgtctccaag

SEQ ID NO: 3321489 - DNA, 16 bp, Homo sapiens
ccagatgaactgactg

SEQ ID NO: 3321490 - DNA, 13 bp, Homo sapiens
ccagatgcaccag

SEQ ID NO: 3321491 - DNA, 14 bp, Homo sapiens
ccagatgcaccagc

SEQ ID NO: 3321492 - DNA, 15 bp, Homo sapiens
ccagatgcaccagcc

SEQ ID NO: 3321493 - DNA, 23 bp, Homo sapiens
ccagatgcaccagcccttagcag

SEQ ID NO: 3321494 - DNA, 19 bp, Homo sapiens
ccagatgcaggacaggagg

SEQ ID NO: 3321495 - DNA, 22 bp, Homo sapiens
ccagatgcaggacaggaggcgg

SEQ ID NO: 3321496 - DNA, 13 bp, Homo sapiens
ccagatgctactg

SEQ ID NO: 3321497 - DNA, 18 bp, Homo sapiens
ccagatggaaaaataaca

SEQ ID NO: 3321498 - DNA, 17 bp, Homo sapiens
ccagatgtttccagact

SEQ ID NO: 3321499 - DNA, 21 bp, Homo sapiens
ccagattacaggaatgaagaa

SEQ ID NO: 3321500 - DNA, 16 bp, Homo sapiens
ccagattgcaacaggc

SEQ ID NO: 3321501 - DNA, 22 bp, Homo sapiens
ccagattgcaacaggctgggct

SEQ ID NO: 3321502 - DNA, 23 bp, Homo sapiens
ccagattgcaacaggctgggctt

SEQ ID NO: 3321503 - DNA, 17 bp, Homo sapiens
ccagatttattttaaac

SEQ ID NO: 3321504 - DNA, 15 bp, Homo sapiens
ccagatttgtctttt

SEQ ID NO: 3321505 - DNA, 15 bp, Homo sapiens
ccagattttgctgta

SEQ ID NO: 3321506 - DNA, 18 bp, Homo sapiens
ccagattttgctgtatat

SEQ ID NO: 3321507 - DNA, 24 bp, Homo sapiens
ccagattttttacagctgcctgca

SEQ ID NO: 3321508 - DNA, 22 bp, Homo sapiens
ccagcaaaagagctattgccaa

SEQ ID NO: 3321509 - DNA, 14 bp, Homo sapiens
ccagcaacttcttc

SEQ ID NO: 3321510 - DNA, 21 bp, Homo sapiens
ccagcaacttgtctttttctg

SEQ ID NO: 3321511 - DNA, 23 bp, Homo sapiens
ccagcaagacctcatctgtggag

SEQ ID NO: 3321512 - DNA, 23 bp, Homo sapiens
ccagcaatgacatctcaggggcc

SEQ ID NO: 3321513 - DNA, 17 bp, Homo sapiens
ccagcaatgatgtccag

SEQ ID NO: 3321514 - DNA, 21 bp, Homo sapiens
ccagcacagagcgtccttccc

SEQ ID NO: 3321515 - DNA, 17 bp, Homo sapiens
ccagcacaggggcccca

SEQ ID NO: 3321516 - DNA, 22 bp, Homo sapiens
ccagcacaggggccccagatct

SEQ ID NO: 3321517 - DNA, 12 bp, Homo sapiens
ccaataaaggca

SEQ ID NO: 3321518 - DNA, 13 bp, Homo sapiens
ccaataaaggcag

SEQ ID NO: 3321519 - DNA, 15 bp, Homo sapiens
ccaataaaggcagct

SEQ ID NO: 3321520 - DNA, 23 bp, Homo sapiens
ccaataaaggcagctgcctctgc

SEQ ID NO: 3321521 - DNA, 24 bp, Homo sapiens
ccaataaaggcagctgcctctgct

SEQ ID NO: 3321522 - DNA, 15 bp, Homo sapiens
ccaataaagtgcctt

SEQ ID NO: 3321523 - DNA, 18 bp, Homo sapiens
ccaataaagtgccttctg

SEQ ID NO: 3321524 - DNA, 20 bp, Homo sapiens
ccaataaagtgccttctggg

SEQ ID NO: 3321525 - DNA, 20 bp, Homo sapiens
ccaataatcagaaaagtaat

SEQ ID NO: 3321526 - DNA, 22 bp, Homo sapiens
ccaatagggctgagctctctgt

SEQ ID NO: 3321527 - DNA, 15 bp, Homo sapiens
ccaatatgtattgta

SEQ ID NO: 3321528 - DNA, 12 bp, Homo sapiens
ccaatatttctg

SEQ ID NO: 3321529 - DNA, 19 bp, Homo sapiens
ccaatatttctgctttctt

SEQ ID NO: 3321530 - DNA, 17 bp, Homo sapiens
ccaatcaaagaattaca

SEQ ID NO: 3321531 - DNA, 18 bp, Homo sapiens
ccaatcaaagaattacag

SEQ ID NO: 3321532 - DNA, 15 bp, Homo sapiens
ccaatcagcactgaa

SEQ ID NO: 3321533 - DNA, 13 bp, Homo sapiens
ccaatcagctcct

SEQ ID NO: 3321534 - DNA, 15 bp, Homo sapiens
ccaatcccagggctg

SEQ ID NO: 3321535 - DNA, 21 bp, Homo sapiens
ccaatcccagggctggctctg

SEQ ID NO: 3321536 - DNA, 17 bp, Homo sapiens
ccaatcctcactgggtg

SEQ ID NO: 3321537 - DNA, 21 bp, Homo sapiens
ccaatctattctcaaagttaa

SEQ ID NO: 3321538 - DNA, 11 bp, Homo sapiens
ccaatctctgg

SEQ ID NO: 3321539 - DNA, 19 bp, Homo sapiens
ccaatctctggtgcctaaa

SEQ ID NO: 3321540 - DNA, 23 bp, Homo sapiens
ccaatctctgttctgtttggcac

SEQ ID NO: 3321541 - DNA, 18 bp, Homo sapiens
ccaatgaattattatata

SEQ ID NO: 3321542 - DNA, 17 bp, Homo sapiens
ccaatgacttccctgct

SEQ ID NO: 3321543 - DNA, 19 bp, Homo sapiens
ccaatgcacatccattccc

SEQ ID NO: 3321544 - DNA, 20 bp, Homo sapiens
ccaatgcatagagccctggc

SEQ ID NO: 3321545 - DNA, 16 bp, Homo sapiens
ccaatgcccagcaggg

SEQ ID NO: 3321546 - DNA, 12 bp, Homo sapiens
ccaatggaaacc

SEQ ID NO: 3321547 - DNA, 21 bp, Homo sapiens
ccaatggtgatcctctatttt

SEQ ID NO: 3321548 - DNA, 15 bp, Homo sapiens
ccaatgtaggagctg

SEQ ID NO: 3321549 - DNA, 17 bp, Homo sapiens
ccaatgtaggagctgcc

SEQ ID NO: 3321550 - DNA, 18 bp, Homo sapiens
ccaatgttttccacccat

SEQ ID NO: 3321551 - DNA, 16 bp, Homo sapiens
ccaattaaatttattt

SEQ ID NO: 3321552 - DNA, 15 bp, Homo sapiens
ccaattaagcagctt

SEQ ID NO: 3321553 - DNA, 19 bp, Homo sapiens
ccaattacagggtgactca

SEQ ID NO: 3321554 - DNA, 22 bp, Homo sapiens
ccaattacagggtgactcacag

SEQ ID NO: 3321555 - DNA, 19 bp, Homo sapiens
ccaattactattccctttg

SEQ ID NO: 3321556 - DNA, 14 bp, Homo sapiens
ccaattagtttcct

SEQ ID NO: 3321557 - DNA, 22 bp, Homo sapiens
ccaattatatgagacgtttttg

SEQ ID NO: 3321558 - DNA, 15 bp, Homo sapiens
ccaattattgatata

SEQ ID NO: 3321559 - DNA, 20 bp, Homo sapiens
ccaattattgatatatatta

SEQ ID NO: 3321560 - DNA, 18 bp, Homo sapiens
ccaattattgttacacat

SEQ ID NO: 3321561 - DNA, 14 bp, Homo sapiens
ccaattctgtccca

SEQ ID NO: 3321562 - DNA, 21 bp, Homo sapiens
ccaattgttgacagttctgaa

SEQ ID NO: 3321563 - DNA, 22 bp, Homo sapiens
ccaattgttgacagttctgaag

SEQ ID NO: 3321564 - DNA, 20 bp, Homo sapiens
ccaatttcggattttttcca

SEQ ID NO: 3321565 - DNA, 22 bp, Homo sapiens
ccaatttcggattttttccaaa

SEQ ID NO: 3321566 - DNA, 16 bp, Homo sapiens
ccaatttcttccttcc

SEQ ID NO: 3321567 - DNA, 17 bp, Homo sapiens
ccaatttcttccttcca

SEQ ID NO: 3321568 - DNA, 22 bp, Homo sapiens
ccaatttggtaaaaatgctgct

SEQ ID NO: 3321569 - DNA, 19 bp, Homo sapiens
ccacaaaaaattgctccta

SEQ ID NO: 3321570 - DNA, 13 bp, Homo sapiens
ccacaaaaacagg

SEQ ID NO: 3321571 - DNA, 13 bp, Homo sapiens
ccacaaaaattga

SEQ ID NO: 3321572 - DNA, 15 bp, Homo sapiens
ccacaaaagaagtga

SEQ ID NO: 3321573 - DNA, 19 bp, Homo sapiens
ccacaaagcattttcattt

SEQ ID NO: 3321574 - DNA, 9 bp, Homo sapiens
ccacaaagg

SEQ ID NO: 3321575 - DNA, 19 bp, Homo sapiens
ccacaaatcaaagcaaggg

SEQ ID NO: 3321576 - DNA, 23 bp, Homo sapiens
ccacaaatcaaagcaagggctcc

SEQ ID NO: 3321577 - DNA, 19 bp, Homo sapiens
ccacaacagaataaagcag

SEQ ID NO: 3321578 - DNA, 17 bp, Homo sapiens
ccacaaccttcggctcc

SEQ ID NO: 3321579 - DNA, 16 bp, Homo sapiens
ccacaactcccttgca

SEQ ID NO: 3321580 - DNA, 17 bp, Homo sapiens
ccacaactcccttgcac

SEQ ID NO: 3321581 - DNA, 19 bp, Homo sapiens
ccacaactcccttgcacgt

SEQ ID NO: 3321582 - DNA, 21 bp, Homo sapiens
ccacaagaaatttgatttcta

SEQ ID NO: 3321583 - DNA, 18 bp, Homo sapiens
ccacaagctgtccctgca

SEQ ID NO: 3321584 - DNA, 20 bp, Homo sapiens
ccacaagctgtccctgcagg

SEQ ID NO: 3321585 - DNA, 21 bp, Homo sapiens
ccacaagctgtccctgcaggg

SEQ ID NO: 3321586 - DNA, 18 bp, Homo sapiens
ccacaaggctggccagca

SEQ ID NO: 3321587 - DNA, 22 bp, Homo sapiens
ccacaaggtccactccctgctc

SEQ ID NO: 3321588 - DNA, 23 bp, Homo sapiens
ccacaaggtccactccctgctcc

SEQ ID NO: 3321589 - DNA, 17 bp, Homo sapiens
ccacaagtccagctggg

SEQ ID NO: 3321590 - DNA, 15 bp, Homo sapiens
ccacaagtcttccag

SEQ ID NO: 3321591 - DNA, 15 bp, Homo sapiens
ccacaagttaaataa

SEQ ID NO: 3321592 - DNA, 20 bp, Homo sapiens
ccacaagttaaataaatcat

SEQ ID NO: 3321593 - DNA, 18 bp, Homo sapiens
ccacaattaaaccgcatg

SEQ ID NO: 3321594 - DNA, 16 bp, Homo sapiens
ccacacacagaggaag

SEQ ID NO: 3321595 - DNA, 18 bp, Homo sapiens
ccacacacagaggaagag

SEQ ID NO: 3321596 - DNA, 16 bp, Homo sapiens
ccacacagtccccaga

SEQ ID NO: 3321597 - DNA, 16 bp, Homo sapiens
ccacaccaacgaggtg

SEQ ID NO: 3321598 - DNA, 14 bp, Homo sapiens
ccacacccagccca

SEQ ID NO: 3321599 - DNA, 20 bp, Homo sapiens
ccacacccagcccacttctg

SEQ ID NO: 3321600 - DNA, 21 bp, Homo sapiens
ccacacccagcccacttctgc

SEQ ID NO: 3321601 - DNA, 22 bp, Homo sapiens
ccacacccagcccacttctgcc

SEQ ID NO: 3321602 - DNA, 13 bp, Homo sapiens
ccacacccagcct

SEQ ID NO: 3321603 - DNA, 15 bp, Homo sapiens
ccacacccagcctca

SEQ ID NO: 3321604 - DNA, 14 bp, Homo sapiens
ccacacccagcggc

SEQ ID NO: 3321605 - DNA, 12 bp, Homo sapiens
ccacaccccagc

SEQ ID NO: 3321606 - DNA, 15 bp, Homo sapiens
ccacaccccagccca

SEQ ID NO: 3321607 - DNA, 23 bp, Homo sapiens
ccacaccctgtactgttctgtgt

SEQ ID NO: 3321608 - DNA, 22 bp, Homo sapiens
ccacacctcagttcccttggcc

SEQ ID NO: 3321609 - DNA, 14 bp, Homo sapiens
ccacacctccacag

SEQ ID NO: 3321610 - DNA, 17 bp, Homo sapiens
ccacacggactcccggg

SEQ ID NO: 3321611 - DNA, 23 bp, Homo sapiens
ccacactaacctgggttcccttt

SEQ ID NO: 3321612 - DNA, 14 bp, Homo sapiens
ccacactagaaaga

SEQ ID NO: 3321613 - DNA, 18 bp, Homo sapiens
ccacactatgcacagagc

SEQ ID NO: 3321614 - DNA, 17 bp, Homo sapiens
ccacactgaaaccaaaa

SEQ ID NO: 3321615 - DNA, 13 bp, Homo sapiens
ccacactgagttc

SEQ ID NO: 3321616 - DNA, 13 bp, Homo sapiens
ccacactgccacc

SEQ ID NO: 3321617 - DNA, 17 bp, Homo sapiens
ccacacttgagaggatg

SEQ ID NO: 3321618 - DNA, 18 bp, Homo sapiens
ccacacttgctggggctc

SEQ ID NO: 3321619 - DNA, 20 bp, Homo sapiens
ccacacttgttccagctctt

SEQ ID NO: 3321620 - DNA, 12 bp, Homo sapiens
ccacagaacctt

SEQ ID NO: 3321621 - DNA, 21 bp, Homo sapiens
ccacagaagacttcccagctt

SEQ ID NO: 3321622 - DNA, 14 bp, Homo sapiens
ccacagacacacac

SEQ ID NO: 3321623 - DNA, 16 bp, Homo sapiens
ccacagacccctggga

SEQ ID NO: 3321624 - DNA, 20 bp, Homo sapiens
ccacagagaagtttgtagcc

SEQ ID NO: 3321625 - DNA, 22 bp, Homo sapiens
ccacagagaagtttgtagccag

SEQ ID NO: 3321626 - DNA, 14 bp, Homo sapiens
ccacccctgtgctc

SEQ ID NO: 3321627 - DNA, 16 bp, Homo sapiens
ccaccccttaggcccc

SEQ ID NO: 3321628 - DNA, 18 bp, Homo sapiens
ccaccccttccccaggcc

SEQ ID NO: 3321629 - DNA, 22 bp, Homo sapiens
ccaccccttggaggagagagac

SEQ ID NO: 3321630 - DNA, 15 bp, Homo sapiens
ccacccgaaatgcca

SEQ ID NO: 3321631 - DNA, 13 bp, Homo sapiens
ccacccgatgctg

SEQ ID NO: 3321632 - DNA, 15 bp, Homo sapiens
ccacccgccgcctcc

SEQ ID NO: 3321633 - DNA, 16 bp, Homo sapiens
ccacccgggggagccc

SEQ ID NO: 3321634 - DNA, 21 bp, Homo sapiens
ccacccgggggagcccagtga

SEQ ID NO: 3321635 - DNA, 21 bp, Homo sapiens
ccacccgttctgctggcctgg

SEQ ID NO: 3321636 - DNA, 17 bp, Homo sapiens
ccaccctccaccttcca

SEQ ID NO: 3321637 - DNA, 18 bp, Homo sapiens
ccaccctcctcttggaat

SEQ ID NO: 3321638 - DNA, 11 bp, Homo sapiens
ccaccctgctc

SEQ ID NO: 3321639 - DNA, 13 bp, Homo sapiens
ccaccctggctgg

SEQ ID NO: 3321640 - DNA, 15 bp, Homo sapiens
ccaccctgggagaca

SEQ ID NO: 3321641 - DNA, 14 bp, Homo sapiens
ccaccctgtccccc

SEQ ID NO: 3321642 - DNA, 18 bp, Homo sapiens
ccaccctgtcccccagct

SEQ ID NO: 3321643 - DNA, 22 bp, Homo sapiens
ccaccctgtcccccagctctgg

SEQ ID NO: 3321644 - DNA, 14 bp, Homo sapiens
ccacccttcagacc

SEQ ID NO: 3321645 - DNA, 14 bp, Homo sapiens
ccacccttcccctc

SEQ ID NO: 3321646 - DNA, 19 bp, Homo sapiens
ccacccttggcctgtctca

SEQ ID NO: 3321647 - DNA, 13 bp, Homo sapiens
ccaccgcctctgg

SEQ ID NO: 3321648 - DNA, 14 bp, Homo sapiens
ccaccgcctctggc

SEQ ID NO: 3321649 - DNA, 21 bp, Homo sapiens
ccaccgctgccagcacagagc

SEQ ID NO: 3321650 - DNA, 20 bp, Homo sapiens
ccaccggaggtcactccacc

SEQ ID NO: 3321651 - DNA, 13 bp, Homo sapiens
ccaccggcccctg

SEQ ID NO: 3321652 - DNA, 16 bp, Homo sapiens
ccaccgggagcctccc

SEQ ID NO: 3321653 - DNA, 17 bp, Homo sapiens
ccactctatgagttgga

SEQ ID NO: 3321654 - DNA, 13 bp, Homo sapiens
ccactctccccac

SEQ ID NO: 3321655 - DNA, 16 bp, Homo sapiens
ccactctccccacact

SEQ ID NO: 3321656 - DNA, 18 bp, Homo sapiens
ccactctcggggcccttg

SEQ ID NO: 3321657 - DNA, 13 bp, Homo sapiens
ccactctcttccc

SEQ ID NO: 3321658 - DNA, 14 bp, Homo sapiens
ccactctcttccct

SEQ ID NO: 3321659 - DNA, 19 bp, Homo sapiens
ccactctgcttctctgact

SEQ ID NO: 3321660 - DNA, 18 bp, Homo sapiens
ccactgaagcccatttct

SEQ ID NO: 3321661 - DNA, 15 bp, Homo sapiens
ccactgaagctggga

SEQ ID NO: 3321662 - DNA, 14 bp, Homo sapiens
ccactgagtaccag

SEQ ID NO: 3321663 - DNA, 17 bp, Homo sapiens
ccactgatgctgttctc

SEQ ID NO: 3321664 - DNA, 19 bp, Homo sapiens
ccactgcaaataaagcctt

SEQ ID NO: 3321665 - DNA, 19 bp, Homo sapiens
ccactgcactatagcctag

SEQ ID NO: 3321666 - DNA, 18 bp, Homo sapiens
ccactgcactccagcctg

SEQ ID NO: 3321667 - DNA, 19 bp, Homo sapiens
ccactgcactccagcctgg

SEQ ID NO: 3321668 - DNA, 13 bp, Homo sapiens
ccactgccagcag

SEQ ID NO: 3321669 - DNA, 17 bp, Homo sapiens
ccactgccagcagcagc

SEQ ID NO: 3321670 - DNA, 20 bp, Homo sapiens
ccactgccagcagcagcagg

SEQ ID NO: 3321671 - DNA, 12 bp, Homo sapiens
ccactgccaggc

SEQ ID NO: 3321672 - DNA, 14 bp, Homo sapiens
ccactgccaggcac

SEQ ID NO: 3321673 - DNA, 15 bp, Homo sapiens
ccactgccaggcacc

SEQ ID NO: 3321674 - DNA, 17 bp, Homo sapiens
ccactgccaggcacctg

SEQ ID NO: 3321675 - DNA, 15 bp, Homo sapiens
ccactgcccaccccc

SEQ ID NO: 3321676 - DNA, 19 bp, Homo sapiens
ccactgccccccgaggctg

SEQ ID NO: 3321677 - DNA, 15 bp, Homo sapiens
ccactgccctgcctg

SEQ ID NO: 3321678 - DNA, 14 bp, Homo sapiens
ccactgcctcaggt

SEQ ID NO: 3321679 - DNA, 19 bp, Homo sapiens
ccactgcctcaggttccta

SEQ ID NO: 3321680 - DNA, 18 bp, Homo sapiens
ccactgcctctgccttag

SEQ ID NO: 3321681 - DNA, 21 bp, Homo sapiens
ccactgcctctgccttagagg

SEQ ID NO: 3321682 - DNA, 20 bp, Homo sapiens
ccactgcctctggaattgct

SEQ ID NO: 3321683 - DNA, 21 bp, Homo sapiens
ccactgcgggagctctgtatg

SEQ ID NO: 3321684 - DNA, 14 bp, Homo sapiens
ccactgctccattt

SEQ ID NO: 3321685 - DNA, 18 bp, Homo sapiens
ccactgctttccagcctg

SEQ ID NO: 3321686 - DNA, 14 bp, Homo sapiens
ccactggaagatcc

SEQ ID NO: 3321687 - DNA, 13 bp, Homo sapiens
ccactggacagac

SEQ ID NO: 3321688 - DNA, 16 bp, Homo sapiens
ccactggacttgagct

SEQ ID NO: 3321689 - DNA, 21 bp, Homo sapiens
ccactggacttgagcttggca

SEQ ID NO: 3321690 - DNA, 11 bp, Homo sapiens
ccactggccac

SEQ ID NO: 3321691 - DNA, 18 bp, Homo sapiens
ccactgggaccaaccctg

SEQ ID NO: 3321692 - DNA, 24 bp, Homo sapiens
ccactgggccagccctgcagccca

SEQ ID NO: 3321693 - DNA, 19 bp, Homo sapiens
ccactgtcactgtttctct

SEQ ID NO: 3321694 - DNA, 23 bp, Homo sapiens
ccactgtcactgtttctctgctg

SEQ ID NO: 3321695 - DNA, 15 bp, Homo sapiens
ccactgtcaggcctc

SEQ ID NO: 3321696 - DNA, 20 bp, Homo sapiens
ccactgtccccctacccacc

SEQ ID NO: 3321697 - DNA, 22 bp, Homo sapiens
ccactgtccccctacccaccga

SEQ ID NO: 3321698 - DNA, 19 bp, Homo sapiens
ccactgtgccatgtgccag

SEQ ID NO: 3321699 - DNA, 21 bp, Homo sapiens
ccactgtgcctttgcaaatca

SEQ ID NO: 3321700 - DNA, 18 bp, Homo sapiens
ccactgtggccagagctg

SEQ ID NO: 3321701 - DNA, 19 bp, Homo sapiens
ccactgtggccagagctgg

SEQ ID NO: 3321702 - DNA, 14 bp, Homo sapiens
ccactgttatcaaa

SEQ ID NO: 3321703 - DNA, 21 bp, Homo sapiens
ccacttaaaaaatgtccatga

SEQ ID NO: 3321704 - DNA, 21 bp, Homo sapiens
ccacttagaaattgcatttcc

SEQ ID NO: 3321705 - DNA, 18 bp, Homo sapiens
ccacttagccgcaccctg

SEQ ID NO: 3321706 - DNA, 19 bp, Homo sapiens
ccacttagccgtccatggc

SEQ ID NO: 3321707 - DNA, 20 bp, Homo sapiens
ccacttagccgtccatggca

SEQ ID NO: 3321708 - DNA, 21 bp, Homo sapiens
ccacttagccgtccatggcac

SEQ ID NO: 3321709 - DNA, 17 bp, Homo sapiens
ccacttcaagtgaccac

SEQ ID NO: 3321710 - DNA, 13 bp, Homo sapiens
ccacttcactgcg

SEQ ID NO: 3321711 - DNA, 21 bp, Homo sapiens
ccacttcattcttgaaagctg

SEQ ID NO: 3321712 - DNA, 23 bp, Homo sapiens
ccacttcattcttgaaagctgtg

SEQ ID NO: 3321713 - DNA, 13 bp, Homo sapiens
ccacttccagggg

SEQ ID NO: 3321714 - DNA, 18 bp, Homo sapiens
ccacttccaggggaacct

SEQ ID NO: 3321715 - DNA, 12 bp, Homo sapiens
ccacttcccctc

SEQ ID NO: 3321716 - DNA, 13 bp, Homo sapiens
ccacttcctgcta

SEQ ID NO: 3321717 - DNA, 19 bp, Homo sapiens
ccacttcctgctacaggag

SEQ ID NO: 3321718 - DNA, 19 bp, Homo sapiens
ccacttcctttgtgtttat

SEQ ID NO: 3321719 - DNA, 20 bp, Homo sapiens
ccacttcctttgtgtttata

SEQ ID NO: 3321720 - DNA, 16 bp, Homo sapiens
ccacttctaactccac

SEQ ID NO: 3321721 - DNA, 19 bp, Homo sapiens
ccacttctaactccactgg

SEQ ID NO: 3321722 - DNA, 11 bp, Homo sapiens
ccacttctccc

SEQ ID NO: 3321723 - DNA, 18 bp, Homo sapiens
ccacttcttaaaggcctg

SEQ ID NO: 3321724 - DNA, 19 bp, Homo sapiens
ccacttcttaaaggcctgg

SEQ ID NO: 3321725 - DNA, 23 bp, Homo sapiens
ccacttgacactattcactaaaa

SEQ ID NO: 3321726 - DNA, 21 bp, Homo sapiens
ccacttgtccgctgggtggta

SEQ ID NO: 3321727 - DNA, 13 bp, Homo sapiens
ccactttcagagc

SEQ ID NO: 3321728 - DNA, 18 bp, Homo sapiens
ccactttgactcagaggc

SEQ ID NO: 3321729 - DNA, 20 bp, Homo sapiens
ccactttgcacagctctccg

SEQ ID NO: 3321730 - DNA, 15 bp, Homo sapiens
ccactttgcacattt

SEQ ID NO: 3321731 - DNA, 15 bp, Homo sapiens
ccactttggagactg

SEQ ID NO: 3321732 - DNA, 16 bp, Homo sapiens
ccacttttattcattt

SEQ ID NO: 3321733 - DNA, 13 bp, Homo sapiens
ccacttttattta

SEQ ID NO: 3321734 - DNA, 15 bp, Homo sapiens
ccagaaaaccccagc

SEQ ID NO: 3321735 - DNA, 15 bp, Homo sapiens
ccagaaacagtggga

SEQ ID NO: 3321736 - DNA, 22 bp, Homo sapiens
ccagaaacagtgggagccctga

SEQ ID NO: 3321737 - DNA, 12 bp, Homo sapiens
ccagaaagaaaa

SEQ ID NO: 3321738 - DNA, 15 bp, Homo sapiens
ccagaaaggatattt

SEQ ID NO: 3321739 - DNA, 17 bp, Homo sapiens
ccagaaaggatatttaa

SEQ ID NO: 3321740 - DNA, 23 bp, Homo sapiens
ccagaaaggatatttaagaaaat

SEQ ID NO: 3321741 - DNA, 10 bp, Homo sapiens
ccagaaattc

SEQ ID NO: 3321742 - DNA, 20 bp, Homo sapiens
ccagaacacggctcacgctt

SEQ ID NO: 3321743 - DNA, 18 bp, Homo sapiens
ccagaactgcccccactg

SEQ ID NO: 3321744 - DNA, 21 bp, Homo sapiens
ccagaactgcccccactgtcc

SEQ ID NO: 3321745 - DNA, 17 bp, Homo sapiens
ccagaacttagccttta

SEQ ID NO: 3321746 - DNA, 13 bp, Homo sapiens
ccagaacttccct

SEQ ID NO: 3321747 - DNA, 14 bp, Homo sapiens
ccagaacttccctg

SEQ ID NO: 3321748 - DNA, 15 bp, Homo sapiens
ccagaacttccctga

SEQ ID NO: 3321749 - DNA, 18 bp, Homo sapiens
ccagaagaaaattctcct

SEQ ID NO: 3321750 - DNA, 15 bp, Homo sapiens
ccagaagcctctggc

SEQ ID NO: 3321751 - DNA, 16 bp, Homo sapiens
ccagaagcctctggct

SEQ ID NO: 3321752 - DNA, 15 bp, Homo sapiens
ccagaagcttccata

SEQ ID NO: 3321753 - DNA, 17 bp, Homo sapiens
ccagaaggagggcagag

SEQ ID NO: 3321754 - DNA, 20 bp, Homo sapiens
ccagaaggagggcagagcca

SEQ ID NO: 3321755 - DNA, 14 bp, Homo sapiens
ccagaaggggtttg

SEQ ID NO: 3321756 - DNA, 12 bp, Homo sapiens
ccagaagggtag

SEQ ID NO: 3321757 - DNA, 20 bp, Homo sapiens
ccagaagggtagctgggcgg

SEQ ID NO: 3321758 - DNA, 13 bp, Homo sapiens
ccagaatctgctg

SEQ ID NO: 3321759 - DNA, 17 bp, Homo sapiens
ccagaatgctgtacatc

SEQ ID NO: 3321760 - DNA, 21 bp, Homo sapiens
ccagaatgctgtacatctatt

SEQ ID NO: 3321761 - DNA, 15 bp, Homo sapiens
ccagaatggagcctg

SEQ ID NO: 3321762 - DNA, 16 bp, Homo sapiens
ccagaatgtaagaaaa

SEQ ID NO: 3321763 - DNA, 21 bp, Homo sapiens
ccagaatttggaaatcctagt

SEQ ID NO: 3321764 - DNA, 23 bp, Homo sapiens
ccagaatttggaaatcctagttt

SEQ ID NO: 3321765 - DNA, 22 bp, Homo sapiens
ccagacaaggaaatacccttct

SEQ ID NO: 3321766 - DNA, 17 bp, Homo sapiens
ccagacaattccattca

SEQ ID NO: 3321767 - DNA, 20 bp, Homo sapiens
ccagacacagactggcaata

SEQ ID NO: 3321768 - DNA, 21 bp, Homo sapiens
ccagacacagactggcaataa

SEQ ID NO: 3321769 - DNA, 17 bp, Homo sapiens
ccagacaccttgacagg

SEQ ID NO: 3321770 - DNA, 23 bp, Homo sapiens
ccagacactgaccatccactcta

SEQ ID NO: 3321771 - DNA, 16 bp, Homo sapiens
ccagacagcacagggc

SEQ ID NO: 3321772 - DNA, 18 bp, Homo sapiens
ccagacagcacagggcag

SEQ ID NO: 3321773 - DNA, 19 bp, Homo sapiens
ccagacagcacagggcagg

SEQ ID NO: 3321774 - DNA, 21 bp, Homo sapiens
ccagaccaacgttactcaggg

SEQ ID NO: 3321775 - DNA, 17 bp, Homo sapiens
ccagacccctctggcca

SEQ ID NO: 3321776 - DNA, 21 bp, Homo sapiens
ccagacccctctggccaggat

SEQ ID NO: 3321777 - DNA, 16 bp, Homo sapiens
ccagacccctggcttt

SEQ ID NO: 3321778 - DNA, 24 bp, Homo sapiens
ccagacccctggcttttcactgct

SEQ ID NO: 3321779 - DNA, 14 bp, Homo sapiens
ccagacccggctgc

SEQ ID NO: 3321780 - DNA, 17 bp, Homo sapiens
ccagacccggctgcgtg

SEQ ID NO: 3321781 - DNA, 15 bp, Homo sapiens
ccagaccttaataaa

SEQ ID NO: 3321782 - DNA, 17 bp, Homo sapiens
ccaccgggagcctcccc

SEQ ID NO: 3321783 - DNA, 19 bp, Homo sapiens
ccaccgggctgggagctct

SEQ ID NO: 3321784 - DNA, 19 bp, Homo sapiens
ccaccgtccgccctgctcc

SEQ ID NO: 3321785 - DNA, 13 bp, Homo sapiens
ccaccgtggagga

SEQ ID NO: 3321786 - DNA, 16 bp, Homo sapiens
ccaccgtggaggagga

SEQ ID NO: 3321787 - DNA, 19 bp, Homo sapiens
ccaccgtgggcagtgccac

SEQ ID NO: 3321788 - DNA, 19 bp, Homo sapiens
ccaccgttcaagcgccaga

SEQ ID NO: 3321789 - DNA, 23 bp, Homo sapiens
ccacctacttttctttcctcaga

SEQ ID NO: 3321790 - DNA, 16 bp, Homo sapiens
ccacctagaacactaa

SEQ ID NO: 3321791 - DNA, 19 bp, Homo sapiens
ccacctagaacactaactc

SEQ ID NO: 3321792 - DNA, 18 bp, Homo sapiens
ccacctatctcgtgggag

SEQ ID NO: 3321793 - DNA, 12 bp, Homo sapiens
ccacctcagcct

SEQ ID NO: 3321794 - DNA, 13 bp, Homo sapiens
ccacctcagcctc

SEQ ID NO: 3321795 - DNA, 16 bp, Homo sapiens
ccacctcagggcacgc

SEQ ID NO: 3321796 - DNA, 14 bp, Homo sapiens
ccacctccacccag

SEQ ID NO: 3321797 - DNA, 16 bp, Homo sapiens
ccacctccacccagcc

SEQ ID NO: 3321798 - DNA, 12 bp, Homo sapiens
ccacctccacct

SEQ ID NO: 3321799 - DNA, 13 bp, Homo sapiens
ccacctccagccc

SEQ ID NO: 3321800 - DNA, 17 bp, Homo sapiens
ccacctccccacgccct

SEQ ID NO: 3321801 - DNA, 15 bp, Homo sapiens
ccacctccctcacca

SEQ ID NO: 3321802 - DNA, 18 bp, Homo sapiens
ccacctcctagaggtggg

SEQ ID NO: 3321803 - DNA, 23 bp, Homo sapiens
ccacctcctagaggtgggcagct

SEQ ID NO: 3321804 - DNA, 11 bp, Homo sapiens
ccacctcctcc

SEQ ID NO: 3321805 - DNA, 17 bp, Homo sapiens
ccacctcctccccctgt

SEQ ID NO: 3321806 - DNA, 19 bp, Homo sapiens
ccacctcctccccctgttc

SEQ ID NO: 3321807 - DNA, 21 bp, Homo sapiens
ccacctcggagcatggtgttt

SEQ ID NO: 3321808 - DNA, 19 bp, Homo sapiens
ccacctcggtcactccaac

SEQ ID NO: 3321809 - DNA, 23 bp, Homo sapiens
ccacctctccaagtctctctgtg

SEQ ID NO: 3321810 - DNA, 11 bp, Homo sapiens
ccacctctgcg

SEQ ID NO: 3321811 - DNA, 18 bp, Homo sapiens
ccacctctgtcatttgtt

SEQ ID NO: 3321812 - DNA, 17 bp, Homo sapiens
ccacctctgtgacctca

SEQ ID NO: 3321813 - DNA, 22 bp, Homo sapiens
ccacctctgtgacctcaggcac

SEQ ID NO: 3321814 - DNA, 23 bp, Homo sapiens
ccacctctgtgacctcaggcact

SEQ ID NO: 3321815 - DNA, 14 bp, Homo sapiens
ccacctctgtggca

SEQ ID NO: 3321816 - DNA, 21 bp, Homo sapiens
ccacctctgtggcattgaaat

SEQ ID NO: 3321817 - DNA, 17 bp, Homo sapiens
ccacctgacacaccagg

SEQ ID NO: 3321818 - DNA, 23 bp, Homo sapiens
ccacctgacacaccaggcgctaa

SEQ ID NO: 3321819 - DNA, 22 bp, Homo sapiens
ccacctgaggtgggctggggct

SEQ ID NO: 3321820 - DNA, 14 bp, Homo sapiens
ccacctgcacccag

SEQ ID NO: 3321821 - DNA, 15 bp, Homo sapiens
ccacctgcccatcac

SEQ ID NO: 3321822 - DNA, 20 bp, Homo sapiens
ccacctgcccatcacagggt

SEQ ID NO: 3321823 - DNA, 24 bp, Homo sapiens
ccacctggagaaggaagctgcctg

SEQ ID NO: 3321824 - DNA, 23 bp, Homo sapiens
ccacctggatctatccctgcggc

SEQ ID NO: 3321825 - DNA, 14 bp, Homo sapiens
ccacctggccacct

SEQ ID NO: 3321826 - DNA, 21 bp, Homo sapiens
ccacctggtactccctctcag

SEQ ID NO: 3321827 - DNA, 20 bp, Homo sapiens
ccacctgtagccatctgcac

SEQ ID NO: 3321828 - DNA, 12 bp, Homo sapiens
ccacctgtctca

SEQ ID NO: 3321829 - DNA, 20 bp, Homo sapiens
ccacctgtctcagcctccca

SEQ ID NO: 3321830 - DNA, 18 bp, Homo sapiens
ccacctgtgccctcacca

SEQ ID NO: 3321831 - DNA, 21 bp, Homo sapiens
ccacctgtgccctcaccacca

SEQ ID NO: 3321832 - DNA, 14 bp, Homo sapiens
ccaccttcccatgc

SEQ ID NO: 3321833 - DNA, 18 bp, Homo sapiens
ccaccttctgtccccagc

SEQ ID NO: 3321834 - DNA, 16 bp, Homo sapiens
ccaccttggctcaagt

SEQ ID NO: 3321835 - DNA, 14 bp, Homo sapiens
ccaccttggctctg

SEQ ID NO: 3321836 - DNA, 22 bp, Homo sapiens
ccaccttggctctgccagtgga

SEQ ID NO: 3321837 - DNA, 14 bp, Homo sapiens
ccaccttggctgca

SEQ ID NO: 3321838 - DNA, 13 bp, Homo sapiens
ccacctttactgt

SEQ ID NO: 3321839 - DNA, 14 bp, Homo sapiens
ccaccttttctgat

SEQ ID NO: 3321840 - DNA, 14 bp, Homo sapiens
ccacgaccagcccc

SEQ ID NO: 3321841 - DNA, 20 bp, Homo sapiens
ccacgagggctggctggcct

SEQ ID NO: 3321842 - DNA, 16 bp, Homo sapiens
ccacgagtcacctgca

SEQ ID NO: 3321843 - DNA, 15 bp, Homo sapiens
ccacgatcccctccc

SEQ ID NO: 3321844 - DNA, 13 bp, Homo sapiens
ccacgattggcca

SEQ ID NO: 3321845 - DNA, 17 bp, Homo sapiens
ccacgattttctccagc

SEQ ID NO: 3321846 - DNA, 21 bp, Homo sapiens
ccacgcactgggccacggagg

SEQ ID NO: 3321847 - DNA, 19 bp, Homo sapiens
ccacgcatacacacatgcc

SEQ ID NO: 3321848 - DNA, 13 bp, Homo sapiens
ccacgccccagcc

SEQ ID NO: 3321849 - DNA, 17 bp, Homo sapiens
ccacgcccgtcctgcct

SEQ ID NO: 3321850 - DNA, 22 bp, Homo sapiens
ccacgccctcccctcccctgct

SEQ ID NO: 3321851 - DNA, 18 bp, Homo sapiens
ccacgcgggggccttgag

SEQ ID NO: 3321852 - DNA, 14 bp, Homo sapiens
ccacgctagggcgg

SEQ ID NO: 3321853 - DNA, 13 bp, Homo sapiens
ccacgctggagtg

SEQ ID NO: 3321854 - DNA, 12 bp, Homo sapiens
ccacgctgtcct

SEQ ID NO: 3321855 - DNA, 17 bp, Homo sapiens
ccacgctgtggccctgg

SEQ ID NO: 3321856 - DNA, 18 bp, Homo sapiens
ccacggacgtttccatca

SEQ ID NO: 3321857 - DNA, 14 bp, Homo sapiens
ccacggccaggcca

SEQ ID NO: 3321858 - DNA, 15 bp, Homo sapiens
ccacggccaggccag

SEQ ID NO: 3321859 - DNA, 18 bp, Homo sapiens
ccacggctaagaggctgc

SEQ ID NO: 3321860 - DNA, 18 bp, Homo sapiens
ccacgggaagtttagaga

SEQ ID NO: 3321861 - DNA, 17 bp, Homo sapiens
ccacgggtctgccatgc

SEQ ID NO: 3321862 - DNA, 13 bp, Homo sapiens
ccacggtgcgtgg

SEQ ID NO: 3321863 - DNA, 17 bp, Homo sapiens
ccacggtgcgtggctgt

SEQ ID NO: 3321864 - DNA, 20 bp, Homo sapiens
ccacggtgcgtggctgtggc

SEQ ID NO: 3321865 - DNA, 12 bp, Homo sapiens
ccacgtcccagc

SEQ ID NO: 3321866 - DNA, 13 bp, Homo sapiens
ccacgtctgccag

SEQ ID NO: 3321867 - DNA, 17 bp, Homo sapiens
ccacgtctgtcttcaca

SEQ ID NO: 3321868 - DNA, 17 bp, Homo sapiens
ccacgtgacagtgcctg

SEQ ID NO: 3321869 - DNA, 13 bp, Homo sapiens
ccacgtggtcact

SEQ ID NO: 3321870 - DNA, 23 bp, Homo sapiens
ccacgtggtcactgtgcactgcc

SEQ ID NO: 3321871 - DNA, 20 bp, Homo sapiens
ccacgtgtatagtatctgta

SEQ ID NO: 3321872 - DNA, 23 bp, Homo sapiens
ccacgtgtatagtatctgtatat

SEQ ID NO: 3321873 - DNA, 12 bp, Homo sapiens
ccacgtgtcttc

SEQ ID NO: 3321874 - DNA, 16 bp, Homo sapiens
ccacgtgtcttccact

SEQ ID NO: 3321875 - DNA, 20 bp, Homo sapiens
ccacgttggagaagcccgtg

SEQ ID NO: 3321876 - DNA, 16 bp, Homo sapiens
ccactaaaaatattgt

SEQ ID NO: 3321877 - DNA, 22 bp, Homo sapiens
ccactaaaagatcgcagtttgc

SEQ ID NO: 3321878 - DNA, 18 bp, Homo sapiens
ccactaactcctgagaaa

SEQ ID NO: 3321879 - DNA, 15 bp, Homo sapiens
ccactaataaagtgc

SEQ ID NO: 3321880 - DNA, 15 bp, Homo sapiens
ccactacacctggct

SEQ ID NO: 3321881 - DNA, 18 bp, Homo sapiens
ccactacactccagcctg

SEQ ID NO: 3321882 - DNA, 19 bp, Homo sapiens
ccactacactccagcctga

SEQ ID NO: 3321883 - DNA, 20 bp, Homo sapiens
ccactacactccagcctgag

SEQ ID NO: 3321884 - DNA, 23 bp, Homo sapiens
ccactacggaatagttggctagg

SEQ ID NO: 3321885 - DNA, 21 bp, Homo sapiens
ccactactcaatactacctct

SEQ ID NO: 3321886 - DNA, 20 bp, Homo sapiens
ccactactgcagcacctcca

SEQ ID NO: 3321887 - DNA, 16 bp, Homo sapiens
ccactagactcttcac

SEQ ID NO: 3321888 - DNA, 19 bp, Homo sapiens
ccactaggaatcccagagg

SEQ ID NO: 3321889 - DNA, 16 bp, Homo sapiens
ccactaggactctgag

SEQ ID NO: 3321890 - DNA, 22 bp, Homo sapiens
ccactagtaagtaattatgcac

SEQ ID NO: 3321891 - DNA, 21 bp, Homo sapiens
ccactcacatgacacccgtga

SEQ ID NO: 3321892 - DNA, 13 bp, Homo sapiens
ccactcaccaggg

SEQ ID NO: 3321893 - DNA, 17 bp, Homo sapiens
ccactcaccagggtccg

SEQ ID NO: 3321894 - DNA, 16 bp, Homo sapiens
ccactcaccagtgtcc

SEQ ID NO: 3321895 - DNA, 22 bp, Homo sapiens
ccactcaccccctttgctgtga

SEQ ID NO: 3321896 - DNA, 22 bp, Homo sapiens
ccactcactaggcccccacttg

SEQ ID NO: 3321897 - DNA, 20 bp, Homo sapiens
ccactcagccatttccccct

SEQ ID NO: 3321898 - DNA, 15 bp, Homo sapiens
ccactcagctgtcct

SEQ ID NO: 3321899 - DNA, 13 bp, Homo sapiens
ccactcaggccaa

SEQ ID NO: 3321900 - DNA, 19 bp, Homo sapiens
ccactccagacccctggct

SEQ ID NO: 3321901 - DNA, 20 bp, Homo sapiens
ccactccagacccctggctt

SEQ ID NO: 3321902 - DNA, 22 bp, Homo sapiens
ccactccagacccctggctttt

SEQ ID NO: 3321903 - DNA, 15 bp, Homo sapiens
ccactcctccctccg

SEQ ID NO: 3321904 - DNA, 23 bp, Homo sapiens
ccactcgacccagaatggagcct

SEQ ID NO: 3321905 - DNA, 16 bp, Homo sapiens
ccactcgatgatgctt

SEQ ID NO: 3321906 - DNA, 17 bp, Homo sapiens
ccactcgcagtcgcagg

SEQ ID NO: 3321907 - DNA, 20 bp, Homo sapiens
ccactctaccctcccacccc

SEQ ID NO: 3321908 - DNA, 21 bp, Homo sapiens
ccactctaccctcccaccccc

SEQ ID NO: 3321909 - DNA, 12 bp, Homo sapiens
ccactctacctc

SEQ ID NO: 3321910 - DNA, 23 bp, Homo sapiens
ccactctaggggtcaggctccat

SEQ ID NO: 3321911 - DNA, 20 bp, Homo sapiens
ccaaacatcagacctgtctt

SEQ ID NO: 3321912 - DNA, 15 bp, Homo sapiens
ccaaacatgtattta

SEQ ID NO: 3321913 - DNA, 23 bp, Homo sapiens
ccaaaccctaggttcccggtccc

SEQ ID NO: 3321914 - DNA, 17 bp, Homo sapiens
ccaaacccttgctttcc

SEQ ID NO: 3321915 - DNA, 23 bp, Homo sapiens
ccaaacccttgctttcctgggcc

SEQ ID NO: 3321916 - DNA, 14 bp, Homo sapiens
ccaaacctgtcttg

SEQ ID NO: 3321917 - DNA, 21 bp, Homo sapiens
ccaaacgccctttcctcctca

SEQ ID NO: 3321918 - DNA, 21 bp, Homo sapiens
ccaaactgactcaacagtcat

SEQ ID NO: 3321919 - DNA, 17 bp, Homo sapiens
ccaaactgatccagtat

SEQ ID NO: 3321920 - DNA, 20 bp, Homo sapiens
ccaaactgcacacacagctc

SEQ ID NO: 3321921 - DNA, 24 bp, Homo sapiens
ccaaactgctggacgtctttcttt

SEQ ID NO: 3321922 - DNA, 16 bp, Homo sapiens
ccaaactgttcaagaa

SEQ ID NO: 3321923 - DNA, 15 bp, Homo sapiens
ccaaacttcactctg

SEQ ID NO: 3321924 - DNA, 19 bp, Homo sapiens
ccaaagaaacaagctgtgc

SEQ ID NO: 3321925 - DNA, 16 bp, Homo sapiens
ccaaagaaatgaacat

SEQ ID NO: 3321926 - DNA, 23 bp, Homo sapiens
ccaaagaaatgaacattccaagg

SEQ ID NO: 3321927 - DNA, 20 bp, Homo sapiens
ccaaagaacttgatttgcat

SEQ ID NO: 3321928 - DNA, 21 bp, Homo sapiens
ccaaagaacttgatttgcatg

SEQ ID NO: 3321929 - DNA, 14 bp, Homo sapiens
ccaaagactgtact

SEQ ID NO: 3321930 - DNA, 20 bp, Homo sapiens
ccaaagagcacaaacatttt

SEQ ID NO: 3321931 - DNA, 22 bp, Homo sapiens
ccaaagagcacaaacatttttc

SEQ ID NO: 3321932 - DNA, 15 bp, Homo sapiens
ccaaagagccttcag

SEQ ID NO: 3321933 - DNA, 22 bp, Homo sapiens
ccaaagaggctgcccctctcac

SEQ ID NO: 3321934 - DNA, 22 bp, Homo sapiens
ccaaagagtagaattgcattga

SEQ ID NO: 3321935 - DNA, 15 bp, Homo sapiens
ccaaagagtgatagt

SEQ ID NO: 3321936 - DNA, 13 bp, Homo sapiens
ccaaagatgcagc

SEQ ID NO: 3321937 - DNA, 22 bp, Homo sapiens
ccaaagatgcagccgccttcct

SEQ ID NO: 3321938 - DNA, 23 bp, Homo sapiens
ccaaagatgcagccgccttcctt

SEQ ID NO: 3321939 - DNA, 13 bp, Homo sapiens
ccaaagcatggac

SEQ ID NO: 3321940 - DNA, 14 bp, Homo sapiens
ccaaagccagtgaa

SEQ ID NO: 3321941 - DNA, 20 bp, Homo sapiens
ccaaagccagtgaaatgtga

SEQ ID NO: 3321942 - DNA, 22 bp, Homo sapiens
ccaaagccagtgaaatgtgaag

SEQ ID NO: 3321943 - DNA, 15 bp, Homo sapiens
ccaaagctaggcctg

SEQ ID NO: 3321944 - DNA, 17 bp, Homo sapiens
ccaaagctaggcctggc

SEQ ID NO: 3321945 - DNA, 18 bp, Homo sapiens
ccaaagctgcccactgtt

SEQ ID NO: 3321946 - DNA, 21 bp, Homo sapiens
ccaaagctgcccactgtttct

SEQ ID NO: 3321947 - DNA, 21 bp, Homo sapiens
ccaaagctgttggtctgtccc

SEQ ID NO: 3321948 - DNA, 14 bp, Homo sapiens
ccaaagctttcctg

SEQ ID NO: 3321949 - DNA, 22 bp, Homo sapiens
ccaaaggaaaaagcacaagaag

SEQ ID NO: 3321950 - DNA, 18 bp, Homo sapiens
ccaaaggagctatggaga

SEQ ID NO: 3321951 - DNA, 15 bp, Homo sapiens
ccaaaggaggctggc

SEQ ID NO: 3321952 - DNA, 16 bp, Homo sapiens
ccaaaggatgtgatat

SEQ ID NO: 3321953 - DNA, 13 bp, Homo sapiens
ccaaaggctggtg

SEQ ID NO: 3321954 - DNA, 17 bp, Homo sapiens
ccaaaggggacaggcct

SEQ ID NO: 3321955 - DNA, 18 bp, Homo sapiens
ccaaaggggacaggcctc

SEQ ID NO: 3321956 - DNA, 19 bp, Homo sapiens
ccaaaggggacaggcctca

SEQ ID NO: 3321957 - DNA, 19 bp, Homo sapiens
ccaaaggggctgctggggc

SEQ ID NO: 3321958 - DNA, 20 bp, Homo sapiens
ccaaaggggctgctggggca

SEQ ID NO: 3321959 - DNA, 23 bp, Homo sapiens
ccaaagggtgaagctatttatct

SEQ ID NO: 3321960 - DNA, 14 bp, Homo sapiens
ccaaagtctctaat

SEQ ID NO: 3321961 - DNA, 16 bp, Homo sapiens
ccaaagtctctaattc

SEQ ID NO: 3321962 - DNA, 18 bp, Homo sapiens
ccaaagtctctaattcta

SEQ ID NO: 3321963 - DNA, 14 bp, Homo sapiens
ccaaagtgctggga

SEQ ID NO: 3321964 - DNA, 16 bp, Homo sapiens
ccaaagtggggaggga

SEQ ID NO: 3321965 - DNA, 19 bp, Homo sapiens
ccaaagttgttgtaacctg

SEQ ID NO: 3321966 - DNA, 20 bp, Homo sapiens
ccaaataaaaactaaattgt

SEQ ID NO: 3321967 - DNA, 16 bp, Homo sapiens
ccaaatcatagtggct

SEQ ID NO: 3321968 - DNA, 16 bp, Homo sapiens
ccaaatcccagggaag

SEQ ID NO: 3321969 - DNA, 22 bp, Homo sapiens
ccaaatctcaatgaagccagct

SEQ ID NO: 3321970 - DNA, 22 bp, Homo sapiens
ccaaatctgacatattatgcct

SEQ ID NO: 3321971 - DNA, 15 bp, Homo sapiens
ccaaatgcaatttga

SEQ ID NO: 3321972 - DNA, 21 bp, Homo sapiens
ccaaatgcacaagctcagaat

SEQ ID NO: 3321973 - DNA, 23 bp, Homo sapiens
ccaaatgcagggaggggaggcag

SEQ ID NO: 3321974 - DNA, 18 bp, Homo sapiens
ccaaatgtaattgaataa

SEQ ID NO: 3321975 - DNA, 22 bp, Homo sapiens
ccaaatgtaattgaataaagtt

SEQ ID NO: 3321976 - DNA, 16 bp, Homo sapiens
ccaaatgttcatcctc

SEQ ID NO: 3321977 - DNA, 19 bp, Homo sapiens
ccaaattatttcttaatta

SEQ ID NO: 3321978 - DNA, 14 bp, Homo sapiens
ccaaattatttgtg

SEQ ID NO: 3321979 - DNA, 18 bp, Homo sapiens
ccaaattatttgtgtaat

SEQ ID NO: 3321980 - DNA, 19 bp, Homo sapiens
ccaaattcagtttcataaa

SEQ ID NO: 3321981 - DNA, 22 bp, Homo sapiens
ccaaattgctcctaagcttcaa

SEQ ID NO: 3321982 - DNA, 20 bp, Homo sapiens
ccaaattgctgggattacag

SEQ ID NO: 3321983 - DNA, 17 bp, Homo sapiens
ccaaattgtgcttctcc

SEQ ID NO: 3321984 - DNA, 20 bp, Homo sapiens
ccaaattgtgcttctcccca

SEQ ID NO: 3321985 - DNA, 21 bp, Homo sapiens
ccaaattgtgcttctccccag

SEQ ID NO: 3321986 - DNA, 12 bp, Homo sapiens
ccaacaaaccat

SEQ ID NO: 3321987 - DNA, 17 bp, Homo sapiens
ccaacaacatccatgtc

SEQ ID NO: 3321988 - DNA, 12 bp, Homo sapiens
ccaacacagttg

SEQ ID NO: 3321989 - DNA, 15 bp, Homo sapiens
ccaacaccacagaaa

SEQ ID NO: 3321990 - DNA, 23 bp, Homo sapiens
ccaacaccacagacacacacacg

SEQ ID NO: 3321991 - DNA, 16 bp, Homo sapiens
ccaacaccagcccctg

SEQ ID NO: 3321992 - DNA, 22 bp, Homo sapiens
ccaacacccaaagcatggacta

SEQ ID NO: 3321993 - DNA, 20 bp, Homo sapiens
ccaacaccctgtctaaaaaa

SEQ ID NO: 3321994 - DNA, 12 bp, Homo sapiens
ccaacactccag

SEQ ID NO: 3321995 - DNA, 13 bp, Homo sapiens
ccaacactccagg

SEQ ID NO: 3321996 - DNA, 16 bp, Homo sapiens
ccaacactccaggccc

SEQ ID NO: 3321997 - DNA, 17 bp, Homo sapiens
ccaacactccaggccct

SEQ ID NO: 3321998 - DNA, 16 bp, Homo sapiens
ccaacactgtgccctg

SEQ ID NO: 3321999 - DNA, 17 bp, Homo sapiens
ccaacactgtgccctgg

SEQ ID NO: 3322000 - DNA, 12 bp, Homo sapiens
ccaacagccatg

SEQ ID NO: 3322001 - DNA, 13 bp, Homo sapiens
ccaacatcaacat

SEQ ID NO: 3322002 - DNA, 13 bp, Homo sapiens
ccaacatccagat

SEQ ID NO: 3322003 - DNA, 20 bp, Homo sapiens
ccaacatccagatctatagc

SEQ ID NO: 3322004 - DNA, 17 bp, Homo sapiens
ccaacatcgtgaaaccc

SEQ ID NO: 3322005 - DNA, 21 bp, Homo sapiens
ccaacatgcactgatgttgtg

SEQ ID NO: 3322006 - DNA, 23 bp, Homo sapiens
ccaacatgcactgatgttgtgtt

SEQ ID NO: 3322007 - DNA, 23 bp, Homo sapiens
ccaaccaacttggttctgcttca

SEQ ID NO: 3322008 - DNA, 15 bp, Homo sapiens
ccaaccagaataaaa

SEQ ID NO: 3322009 - DNA, 13 bp, Homo sapiens
ccaaccagacagc

SEQ ID NO: 3322010 - DNA, 12 bp, Homo sapiens
ccaaccaggcag

SEQ ID NO: 3322011 - DNA, 16 bp, Homo sapiens
ccaaccatcttcactg

SEQ ID NO: 3322012 - DNA, 15 bp, Homo sapiens
ccaacccacctctgg

SEQ ID NO: 3322013 - DNA, 23 bp, Homo sapiens
ccaacccacctctggccctgtgt

SEQ ID NO: 3322014 - DNA, 13 bp, Homo sapiens
ccaaccccagccg

SEQ ID NO: 3322015 - DNA, 13 bp, Homo sapiens
ccaacccccaccc

SEQ ID NO: 3322016 - DNA, 19 bp, Homo sapiens
ccaacccccaccccacact

SEQ ID NO: 3322017 - DNA, 23 bp, Homo sapiens
ccaacccccctcctgctcctccc

SEQ ID NO: 3322018 - DNA, 17 bp, Homo sapiens
ccaaccccggaaaacat

SEQ ID NO: 3322019 - DNA, 22 bp, Homo sapiens
ccaaccctaggttccctgttct

SEQ ID NO: 3322020 - DNA, 15 bp, Homo sapiens
ccaaccctcagagcc

SEQ ID NO: 3322021 - DNA, 17 bp, Homo sapiens
ccaaccctggggaagga

SEQ ID NO: 3322022 - DNA, 20 bp, Homo sapiens
ccaaccctggggaaggagcc

SEQ ID NO: 3322023 - DNA, 16 bp, Homo sapiens
ccaaccgacaggccct

SEQ ID NO: 3322024 - DNA, 18 bp, Homo sapiens
ccaaccgacaggccctgg

SEQ ID NO: 3322025 - DNA, 15 bp, Homo sapiens
ccaacctcagaggca

SEQ ID NO: 3322026 - DNA, 20 bp, Homo sapiens
ccaacctcagggctcccagg

SEQ ID NO: 3322027 - DNA, 14 bp, Homo sapiens
ccaacctcctgacc

SEQ ID NO: 3322028 - DNA, 21 bp, Homo sapiens
ccaacctcggcttgtgggctg

SEQ ID NO: 3322029 - DNA, 13 bp, Homo sapiens
ccaacctctggag

SEQ ID NO: 3322030 - DNA, 21 bp, Homo sapiens
ccaacctgttcttagagtgta

SEQ ID NO: 3322031 - DNA, 14 bp, Homo sapiens
ccaaccttcaaaga

SEQ ID NO: 3322032 - DNA, 17 bp, Homo sapiens
cattattttctgtcaga

SEQ ID NO: 3322033 - DNA, 14 bp, Homo sapiens
cattattttgtggt

SEQ ID NO: 3322034 - DNA, 21 bp, Homo sapiens
cattattttgtggttctattt

SEQ ID NO: 3322035 - DNA, 20 bp, Homo sapiens
cattatttttccactttgtt

SEQ ID NO: 3322036 - DNA, 14 bp, Homo sapiens
cattcaaatcagtg

SEQ ID NO: 3322037 - DNA, 19 bp, Homo sapiens
cattcaaatcagtgatcta

SEQ ID NO: 3322038 - DNA, 23 bp, Homo sapiens
cattcaaatgggtgatatcctga

SEQ ID NO: 3322039 - DNA, 12 bp, Homo sapiens
cattcaacaaga

SEQ ID NO: 3322040 - DNA, 18 bp, Homo sapiens
cattcaacagagactgaa

SEQ ID NO: 3322041 - DNA, 23 bp, Homo sapiens
cattcaactttagtatttttact

SEQ ID NO: 3322042 - DNA, 15 bp, Homo sapiens
cattcaagctattta

SEQ ID NO: 3322043 - DNA, 17 bp, Homo sapiens
cattcaatctttggagg

SEQ ID NO: 3322044 - DNA, 16 bp, Homo sapiens
cattcacaagcctcct

SEQ ID NO: 3322045 - DNA, 15 bp, Homo sapiens
cattcacttcataat

SEQ ID NO: 3322046 - DNA, 20 bp, Homo sapiens
cattcacttctgcattcctg

SEQ ID NO: 3322047 - DNA, 15 bp, Homo sapiens
cattcacttgcattt

SEQ ID NO: 3322048 - DNA, 23 bp, Homo sapiens
cattcagaaatgttgagtctgta

SEQ ID NO: 3322049 - DNA, 17 bp, Homo sapiens
cattcagatcactgaat

SEQ ID NO: 3322050 - DNA, 19 bp, Homo sapiens
cattcagcagcaaattttc

SEQ ID NO: 3322051 - DNA, 14 bp, Homo sapiens
cattcagctctgga

SEQ ID NO: 3322052 - DNA, 15 bp, Homo sapiens
cattcagctctggag

SEQ ID NO: 3322053 - DNA, 17 bp, Homo sapiens
cattcagctctggagaa

SEQ ID NO: 3322054 - DNA, 20 bp, Homo sapiens
cattcagctctggagaacag

SEQ ID NO: 3322055 - DNA, 13 bp, Homo sapiens
cattcaggaattc

SEQ ID NO: 3322056 - DNA, 14 bp, Homo sapiens
cattcatattaaga

SEQ ID NO: 3322057 - DNA, 16 bp, Homo sapiens
cattcatattaagaca

SEQ ID NO: 3322058 - DNA, 13 bp, Homo sapiens
cattcatttttat

SEQ ID NO: 3322059 - DNA, 16 bp, Homo sapiens
cattcatttttatagc

SEQ ID NO: 3322060 - DNA, 20 bp, Homo sapiens
cattccaaaagggggcctgg

SEQ ID NO: 3322061 - DNA, 18 bp, Homo sapiens
cattccaacaatggggtg

SEQ ID NO: 3322062 - DNA, 16 bp, Homo sapiens
cattccaacagtgagt

SEQ ID NO: 3322063 - DNA, 17 bp, Homo sapiens
cattccaagactctaga

SEQ ID NO: 3322064 - DNA, 22 bp, Homo sapiens
cattccaaggagttggaagtga

SEQ ID NO: 3322065 - DNA, 15 bp, Homo sapiens
cattccagacttcaa

SEQ ID NO: 3322066 - DNA, 22 bp, Homo sapiens
cattccagcccctctggtcgct

SEQ ID NO: 3322067 - DNA, 17 bp, Homo sapiens
cattccagtaacttttt

SEQ ID NO: 3322068 - DNA, 20 bp, Homo sapiens
cattccagtaacttttttgt

SEQ ID NO: 3322069 - DNA, 21 bp, Homo sapiens
cattccagtgctagaaaattt

SEQ ID NO: 3322070 - DNA, 17 bp, Homo sapiens
cattccatattgggaat

SEQ ID NO: 3322071 - DNA, 12 bp, Homo sapiens
cattcccagcgt

SEQ ID NO: 3322072 - DNA, 20 bp, Homo sapiens
cattcccccttcctagtgaa

SEQ ID NO: 3322073 - DNA, 14 bp, Homo sapiens
cattccctctcctg

SEQ ID NO: 3322074 - DNA, 15 bp, Homo sapiens
cattccctctcctgc

SEQ ID NO: 3322075 - DNA, 14 bp, Homo sapiens
cattcctaactaga

SEQ ID NO: 3322076 - DNA, 15 bp, Homo sapiens
cattcctaactagaa

SEQ ID NO: 3322077 - DNA, 12 bp, Homo sapiens
cattcctccctc

SEQ ID NO: 3322078 - DNA, 21 bp, Homo sapiens
cattcctggaaaccacagtcc

SEQ ID NO: 3322079 - DNA, 17 bp, Homo sapiens
cattcctggtacccagc

SEQ ID NO: 3322080 - DNA, 23 bp, Homo sapiens
cattcgacctataagaagcctta

SEQ ID NO: 3322081 - DNA, 24 bp, Homo sapiens
cattcgcctttgtcttgtacttct

SEQ ID NO: 3322082 - DNA, 21 bp, Homo sapiens
cattcggggaagctgcacatg

SEQ ID NO: 3322083 - DNA, 16 bp, Homo sapiens
cattcggtgtggtgca

SEQ ID NO: 3322084 - DNA, 15 bp, Homo sapiens
cattcgtgagctggg

SEQ ID NO: 3322085 - DNA, 14 bp, Homo sapiens
cattctaatttgca

SEQ ID NO: 3322086 - DNA, 16 bp, Homo sapiens
cattctacacagagca

SEQ ID NO: 3322087 - DNA, 20 bp, Homo sapiens
cattctacagaataatccag

SEQ ID NO: 3322088 - DNA, 14 bp, Homo sapiens
cattctcactccta

SEQ ID NO: 3322089 - DNA, 17 bp, Homo sapiens
cattctcactcctacct

SEQ ID NO: 3322090 - DNA, 18 bp, Homo sapiens
cattctctcccatcctgg

SEQ ID NO: 3322091 - DNA, 13 bp, Homo sapiens
cattctcttttaa

SEQ ID NO: 3322092 - DNA, 21 bp, Homo sapiens
cattctgaattaattaatttg

SEQ ID NO: 3322093 - DNA, 16 bp, Homo sapiens
cattctgactcggttt

SEQ ID NO: 3322094 - DNA, 17 bp, Homo sapiens
cattctgcaagtatact

SEQ ID NO: 3322095 - DNA, 22 bp, Homo sapiens
cattctgccgccccctcctgaa

SEQ ID NO: 3322096 - DNA, 17 bp, Homo sapiens
cattctgcctagagtgt

SEQ ID NO: 3322097 - DNA, 12 bp, Homo sapiens
cattctgcctgc

SEQ ID NO: 3322098 - DNA, 16 bp, Homo sapiens
cattctgcctgcccag

SEQ ID NO: 3322099 - DNA, 22 bp, Homo sapiens
cattctgtcgccttagcatgtt

SEQ ID NO: 3322100 - DNA, 23 bp, Homo sapiens
cattctgtgaccaaaataccttg

SEQ ID NO: 3322101 - DNA, 17 bp, Homo sapiens
cattctgtgatcattta

SEQ ID NO: 3322102 - DNA, 24 bp, Homo sapiens
cattcttacaattgcactgctgtt

SEQ ID NO: 3322103 - DNA, 14 bp, Homo sapiens
cattcttataacat

SEQ ID NO: 3322104 - DNA, 21 bp, Homo sapiens
cattcttcctagttttctcct

SEQ ID NO: 3322105 - DNA, 19 bp, Homo sapiens
cattcttcgacatccgtca

SEQ ID NO: 3322106 - DNA, 20 bp, Homo sapiens
cattcttctctagctggtgg

SEQ ID NO: 3322107 - DNA, 18 bp, Homo sapiens
cattcttctctgttgtcg

SEQ ID NO: 3322108 - DNA, 13 bp, Homo sapiens
cattcttggccca

SEQ ID NO: 3322109 - DNA, 19 bp, Homo sapiens
cattcttgtcacaataaat

SEQ ID NO: 3322110 - DNA, 18 bp, Homo sapiens
cattctttatcttgacat

SEQ ID NO: 3322111 - DNA, 13 bp, Homo sapiens
cattctttgcttg

SEQ ID NO: 3322112 - DNA, 19 bp, Homo sapiens
cattctttgcttgaacaca

SEQ ID NO: 3322113 - DNA, 20 bp, Homo sapiens
cattctttgcttgaacacag

SEQ ID NO: 3322114 - DNA, 16 bp, Homo sapiens
cattgaaagagaacca

SEQ ID NO: 3322115 - DNA, 19 bp, Homo sapiens
cattgaaagagaaccagtt

SEQ ID NO: 3322116 - DNA, 20 bp, Homo sapiens
cattgaaatgagcacctcca

SEQ ID NO: 3322117 - DNA, 18 bp, Homo sapiens
cattgaaattctgagaaa

SEQ ID NO: 3322118 - DNA, 22 bp, Homo sapiens
cattgaacacaaactgtaaata

SEQ ID NO: 3322119 - DNA, 17 bp, Homo sapiens
cattgaagccgactctg

SEQ ID NO: 3322120 - DNA, 21 bp, Homo sapiens
cattgaagccgactctggccc

SEQ ID NO: 3322121 - DNA, 15 bp, Homo sapiens
cattgaccaagaact

SEQ ID NO: 3322122 - DNA, 19 bp, Homo sapiens
cattgaccaagaactgcat

SEQ ID NO: 3322123 - DNA, 17 bp, Homo sapiens
cattgacccatagcaca

SEQ ID NO: 3322124 - DNA, 15 bp, Homo sapiens
cattgacctctcagg

SEQ ID NO: 3322125 - DNA, 17 bp, Homo sapiens
cattgacctctcagggc

SEQ ID NO: 3322126 - DNA, 19 bp, Homo sapiens
cattgacctctcagggcct

SEQ ID NO: 3322127 - DNA, 21 bp, Homo sapiens
cattgacctctcagggcctgg

SEQ ID NO: 3322128 - DNA, 22 bp, Homo sapiens
cattgactggtttacaggccct

SEQ ID NO: 3322129 - DNA, 23 bp, Homo sapiens
cattgactggtttacaggccctg

SEQ ID NO: 3322130 - DNA, 12 bp, Homo sapiens
cattgacttcat

SEQ ID NO: 3322131 - DNA, 13 bp, Homo sapiens
cattgacttcatt

SEQ ID NO: 3322132 - DNA, 14 bp, Homo sapiens
cattgacttcattt

SEQ ID NO: 3322133 - DNA, 18 bp, Homo sapiens
cattgacttttataaagc

SEQ ID NO: 3322134 - DNA, 21 bp, Homo sapiens
cattgagctagcgatttcaga

SEQ ID NO: 3322135 - DNA, 18 bp, Homo sapiens
cattgagctgatataaat

SEQ ID NO: 3322136 - DNA, 21 bp, Homo sapiens
cattgaggaaatattaatttt

SEQ ID NO: 3322137 - DNA, 10 bp, Homo sapiens
cattgagtat

SEQ ID NO: 3322138 - DNA, 22 bp, Homo sapiens
cattgagtattgtttaaaatgt

SEQ ID NO: 3322139 - DNA, 15 bp, Homo sapiens
cattgataatcttca

SEQ ID NO: 3322140 - DNA, 22 bp, Homo sapiens
cattgcatcacctctgtaattt

SEQ ID NO: 3322141 - DNA, 13 bp, Homo sapiens
cattgccaccagg

SEQ ID NO: 3322142 - DNA, 14 bp, Homo sapiens
cattgccagtgtct

SEQ ID NO: 3322143 - DNA, 17 bp, Homo sapiens
cattgccagtgtctttc

SEQ ID NO: 3322144 - DNA, 20 bp, Homo sapiens
catgtccaagttcttcacct

SEQ ID NO: 3322145 - DNA, 23 bp, Homo sapiens
catgtccaagttcttcacctcta

SEQ ID NO: 3322146 - DNA, 14 bp, Homo sapiens
catgtccatccctt

SEQ ID NO: 3322147 - DNA, 23 bp, Homo sapiens
catgtccctaccgagtctcttct

SEQ ID NO: 3322148 - DNA, 18 bp, Homo sapiens
catgtcctaattcttctg

SEQ ID NO: 3322149 - DNA, 19 bp, Homo sapiens
catgtcctaattcttctgt

SEQ ID NO: 3322150 - DNA, 18 bp, Homo sapiens
catgtcctatgtgtgact

SEQ ID NO: 3322151 - DNA, 16 bp, Homo sapiens
catgtcctgctggctt

SEQ ID NO: 3322152 - DNA, 20 bp, Homo sapiens
catgtcctgctggcttccag

SEQ ID NO: 3322153 - DNA, 21 bp, Homo sapiens
catgtcctgctggcttccagc

SEQ ID NO: 3322154 - DNA, 19 bp, Homo sapiens
catgtccttgtgtgttttg

SEQ ID NO: 3322155 - DNA, 14 bp, Homo sapiens
catgtcgcacaatg

SEQ ID NO: 3322156 - DNA, 18 bp, Homo sapiens
catgtcgcctctgcattc

SEQ ID NO: 3322157 - DNA, 20 bp, Homo sapiens
catgtcgcctctgcattcag

SEQ ID NO: 3322158 - DNA, 22 bp, Homo sapiens
catgtcgctagccagtgctcca

SEQ ID NO: 3322159 - DNA, 15 bp, Homo sapiens
catgtcttgtacatg

SEQ ID NO: 3322160 - DNA, 17 bp, Homo sapiens
catgtcttgtacatgtg

SEQ ID NO: 3322161 - DNA, 13 bp, Homo sapiens
catgtctttactg

SEQ ID NO: 3322162 - DNA, 18 bp, Homo sapiens
catgtgaaacctttttta

SEQ ID NO: 3322163 - DNA, 22 bp, Homo sapiens
catgtgaaaccttttttaagat

SEQ ID NO: 3322164 - DNA, 13 bp, Homo sapiens
catgtgaagaggg

SEQ ID NO: 3322165 - DNA, 12 bp, Homo sapiens
catgtgacacat

SEQ ID NO: 3322166 - DNA, 15 bp, Homo sapiens
catgtgacacatatg

SEQ ID NO: 3322167 - DNA, 18 bp, Homo sapiens
catgtgagccaccgctgc

SEQ ID NO: 3322168 - DNA, 14 bp, Homo sapiens
catgtgagctcttc

SEQ ID NO: 3322169 - DNA, 21 bp, Homo sapiens
catgtgagtgacgatgatgta

SEQ ID NO: 3322170 - DNA, 16 bp, Homo sapiens
catgtgatacattttt

SEQ ID NO: 3322171 - DNA, 21 bp, Homo sapiens
catgtgcaattgtgagggaca

SEQ ID NO: 3322172 - DNA, 11 bp, Homo sapiens
catgtgccaag

SEQ ID NO: 3322173 - DNA, 15 bp, Homo sapiens
catgtgccacacagt

SEQ ID NO: 3322174 - DNA, 21 bp, Homo sapiens
catgtgccaggtttttggtct

SEQ ID NO: 3322175 - DNA, 18 bp, Homo sapiens
catgtgccatctgtacat

SEQ ID NO: 3322176 - DNA, 16 bp, Homo sapiens
catgtgcctgcaccag

SEQ ID NO: 3322177 - DNA, 15 bp, Homo sapiens
catgtggagaaagga

SEQ ID NO: 3322178 - DNA, 22 bp, Homo sapiens
catgtggctgtagatcccaaga

SEQ ID NO: 3322179 - DNA, 18 bp, Homo sapiens
catgtgggtgagccagtg

SEQ ID NO: 3322180 - DNA, 23 bp, Homo sapiens
catgtggtggcacaggccccctt

SEQ ID NO: 3322181 - DNA, 20 bp, Homo sapiens
catgtggtttatagagggcc

SEQ ID NO: 3322182 - DNA, 22 bp, Homo sapiens
catgtgtcacttgtgctttgct

SEQ ID NO: 3322183 - DNA, 17 bp, Homo sapiens
catgtgtcccctcactc

SEQ ID NO: 3322184 - DNA, 20 bp, Homo sapiens
catgtgtcccctcactctgt

SEQ ID NO: 3322185 - DNA, 12 bp, Homo sapiens
catgtgtgcctg

SEQ ID NO: 3322186 - DNA, 17 bp, Homo sapiens
catgtgtgcctgtggca

SEQ ID NO: 3322187 - DNA, 21 bp, Homo sapiens
catgtgtggtacatggtgttt

SEQ ID NO: 3322188 - DNA, 13 bp, Homo sapiens
catgtgtgtataa

SEQ ID NO: 3322189 - DNA, 14 bp, Homo sapiens
catgtgtgtatata

SEQ ID NO: 3322190 - DNA, 18 bp, Homo sapiens
catgtgtgtatatatgtg

SEQ ID NO: 3322191 - DNA, 19 bp, Homo sapiens
catgtgtgtgagtttgctg

SEQ ID NO: 3322192 - DNA, 17 bp, Homo sapiens
catgttactgaccagca

SEQ ID NO: 3322193 - DNA, 21 bp, Homo sapiens
catgttactggataaattgtt

SEQ ID NO: 3322194 - DNA, 13 bp, Homo sapiens
catgttatatatt

SEQ ID NO: 3322195 - DNA, 20 bp, Homo sapiens
catgttatatattttttgta

SEQ ID NO: 3322196 - DNA, 22 bp, Homo sapiens
catgttatatattttttgtagg

SEQ ID NO: 3322197 - DNA, 19 bp, Homo sapiens
catgttatgatttgtaaca

SEQ ID NO: 3322198 - DNA, 22 bp, Homo sapiens
catgttcaaagccacattattt

SEQ ID NO: 3322199 - DNA, 20 bp, Homo sapiens
catgttcacaccgctgcact

SEQ ID NO: 3322200 - DNA, 23 bp, Homo sapiens
catgttcatatagtcaatgtaaa

SEQ ID NO: 3322201 - DNA, 21 bp, Homo sapiens
catgttcctcaaaagcaccct

SEQ ID NO: 3322202 - DNA, 15 bp, Homo sapiens
catgttctctgagga

SEQ ID NO: 3322203 - DNA, 16 bp, Homo sapiens
catgttctgcccccag

SEQ ID NO: 3322204 - DNA, 18 bp, Homo sapiens
catgttctgcccccagcc

SEQ ID NO: 3322205 - DNA, 17 bp, Homo sapiens
catgttgatcatgtact

SEQ ID NO: 3322206 - DNA, 22 bp, Homo sapiens
catgttgcccccgtgagccaat

SEQ ID NO: 3322207 - DNA, 16 bp, Homo sapiens
catgttggccaggctg

SEQ ID NO: 3322208 - DNA, 21 bp, Homo sapiens
catgttggccaggctggtcta

SEQ ID NO: 3322209 - DNA, 15 bp, Homo sapiens
catgttgggaaactt

SEQ ID NO: 3322210 - DNA, 22 bp, Homo sapiens
catgttggtcaaaagctggatt

SEQ ID NO: 3322211 - DNA, 19 bp, Homo sapiens
catgtttacaggtttgaat

SEQ ID NO: 3322212 - DNA, 13 bp, Homo sapiens
catgtttattcta

SEQ ID NO: 3322213 - DNA, 13 bp, Homo sapiens
catgtttcatgtt

SEQ ID NO: 3322214 - DNA, 16 bp, Homo sapiens
catgtttcatgttttg

SEQ ID NO: 3322215 - DNA, 19 bp, Homo sapiens
catgtttccatcatttctg

SEQ ID NO: 3322216 - DNA, 20 bp, Homo sapiens
catgtttccatcatttctgt

SEQ ID NO: 3322217 - DNA, 21 bp, Homo sapiens
catgtttcctctagttctttg

SEQ ID NO: 3322218 - DNA, 17 bp, Homo sapiens
catgtttggtgcataga

SEQ ID NO: 3322219 - DNA, 15 bp, Homo sapiens
catgttttgtgacta

SEQ ID NO: 3322220 - DNA, 13 bp, Homo sapiens
cattaaaaaatga

SEQ ID NO: 3322221 - DNA, 21 bp, Homo sapiens
cattaaaaaatgaaatatttt

SEQ ID NO: 3322222 - DNA, 14 bp, Homo sapiens
cattaaaaatggaa

SEQ ID NO: 3322223 - DNA, 14 bp, Homo sapiens
cattaaaactgctt

SEQ ID NO: 3322224 - DNA, 14 bp, Homo sapiens
cattaaacctgtct

SEQ ID NO: 3322225 - DNA, 17 bp, Homo sapiens
cattaaagtctgaatca

SEQ ID NO: 3322226 - DNA, 13 bp, Homo sapiens
cattaaatgtttg

SEQ ID NO: 3322227 - DNA, 13 bp, Homo sapiens
cattaaattcaca

SEQ ID NO: 3322228 - DNA, 13 bp, Homo sapiens
cattaacacaaag

SEQ ID NO: 3322229 - DNA, 21 bp, Homo sapiens
cattaacagttttccatgaaa

SEQ ID NO: 3322230 - DNA, 23 bp, Homo sapiens
cattaacagttttccatgaaaac

SEQ ID NO: 3322231 - DNA, 18 bp, Homo sapiens
cattaaggggaagaatga

SEQ ID NO: 3322232 - DNA, 23 bp, Homo sapiens
cattaagtcatgtgtgaacacat

SEQ ID NO: 3322233 - DNA, 22 bp, Homo sapiens
cattaatcaatcatctgtgtga

SEQ ID NO: 3322234 - DNA, 17 bp, Homo sapiens
cattaatcatttcccca

SEQ ID NO: 3322235 - DNA, 22 bp, Homo sapiens
cattaatgcctgctttttggaa

SEQ ID NO: 3322236 - DNA, 13 bp, Homo sapiens
cattaatgtgttg

SEQ ID NO: 3322237 - DNA, 15 bp, Homo sapiens
cattaatgtttctat

SEQ ID NO: 3322238 - DNA, 12 bp, Homo sapiens
cattaattaatt

SEQ ID NO: 3322239 - DNA, 18 bp, Homo sapiens
cattaattaattaaagcc

SEQ ID NO: 3322240 - DNA, 12 bp, Homo sapiens
cattaattacat

SEQ ID NO: 3322241 - DNA, 13 bp, Homo sapiens
cattaattacata

SEQ ID NO: 3322242 - DNA, 16 bp, Homo sapiens
cattaattttgtgcat

SEQ ID NO: 3322243 - DNA, 21 bp, Homo sapiens
cattaattttgtgcattcttt

SEQ ID NO: 3322244 - DNA, 17 bp, Homo sapiens
cattacaaaatccaact

SEQ ID NO: 3322245 - DNA, 13 bp, Homo sapiens
cattacaatggaa

SEQ ID NO: 3322246 - DNA, 21 bp, Homo sapiens
cattacagagaggagaaacac

SEQ ID NO: 3322247 - DNA, 20 bp, Homo sapiens
cattaccaaaataataaaaa

SEQ ID NO: 3322248 - DNA, 13 bp, Homo sapiens
cattacccttccc

SEQ ID NO: 3322249 - DNA, 20 bp, Homo sapiens
cattaccttactgtggagga

SEQ ID NO: 3322250 - DNA, 16 bp, Homo sapiens
cattactgttaactgt

SEQ ID NO: 3322251 - DNA, 18 bp, Homo sapiens
cattacttgctttcaatt

SEQ ID NO: 3322252 - DNA, 20 bp, Homo sapiens
cattacttgctttcaattga

SEQ ID NO: 3322253 - DNA, 16 bp, Homo sapiens
cattacttttaaaaat

SEQ ID NO: 3322254 - DNA, 14 bp, Homo sapiens
cattagaattattt

SEQ ID NO: 3322255 - DNA, 17 bp, Homo sapiens
cattagagtcaactaca

SEQ ID NO: 3322256 - DNA, 22 bp, Homo sapiens
cattagatattaggggggaaag

SEQ ID NO: 3322257 - DNA, 20 bp, Homo sapiens
cattagcacagattttaatt

SEQ ID NO: 3322258 - DNA, 18 bp, Homo sapiens
cattagccagatttgtct

SEQ ID NO: 3322259 - DNA, 22 bp, Homo sapiens
cattaggacaatcagtcccctc

SEQ ID NO: 3322260 - DNA, 16 bp, Homo sapiens
cattagttttagaggc

SEQ ID NO: 3322261 - DNA, 17 bp, Homo sapiens
cattataaaccttcaga

SEQ ID NO: 3322262 - DNA, 22 bp, Homo sapiens
cattataaaccttcagaagcta

SEQ ID NO: 3322263 - DNA, 15 bp, Homo sapiens
cattataatctcaaa

SEQ ID NO: 3322264 - DNA, 15 bp, Homo sapiens
cattatactttatat

SEQ ID NO: 3322265 - DNA, 21 bp, Homo sapiens
cattatactttatatctgtaa

SEQ ID NO: 3322266 - DNA, 19 bp, Homo sapiens
cattatattctaattaaaa

SEQ ID NO: 3322267 - DNA, 15 bp, Homo sapiens
cattatattctctta

SEQ ID NO: 3322268 - DNA, 13 bp, Homo sapiens
cattatattgcaa

SEQ ID NO: 3322269 - DNA, 15 bp, Homo sapiens
cattatattgcaatg

SEQ ID NO: 3322270 - DNA, 20 bp, Homo sapiens
cattatattttgaaagaagc

SEQ ID NO: 3322271 - DNA, 16 bp, Homo sapiens
cattatcgggagcagt

SEQ ID NO: 3322272 - DNA, 16 bp, Homo sapiens
cattatctgagttgca

SEQ ID NO: 3322273 - DNA, 19 bp, Homo sapiens
catgacgccagataaaatg

SEQ ID NO: 3322274 - DNA, 22 bp, Homo sapiens
catgactatgtatttttctatg

SEQ ID NO: 3322275 - DNA, 17 bp, Homo sapiens
catgactcgggggtggg

SEQ ID NO: 3322276 - DNA, 23 bp, Homo sapiens
catgactcgtatatgtctcaggt

SEQ ID NO: 3322277 - DNA, 11 bp, Homo sapiens
catgactgcac

SEQ ID NO: 3322278 - DNA, 20 bp, Homo sapiens
catgactgcacccagctcca

SEQ ID NO: 3322279 - DNA, 16 bp, Homo sapiens
catgactggctgtctg

SEQ ID NO: 3322280 - DNA, 13 bp, Homo sapiens
catgactgtgacc

SEQ ID NO: 3322281 - DNA, 15 bp, Homo sapiens
catgagaagagggcc

SEQ ID NO: 3322282 - DNA, 19 bp, Homo sapiens
catgagaatctatatttaa

SEQ ID NO: 3322283 - DNA, 20 bp, Homo sapiens
catgagaatttgcaacaggg

SEQ ID NO: 3322284 - DNA, 14 bp, Homo sapiens
catgagacacatct

SEQ ID NO: 3322285 - DNA, 19 bp, Homo sapiens
catgagacacatctcctcc

SEQ ID NO: 3322286 - DNA, 23 bp, Homo sapiens
catgagaccctggtgcctggctc

SEQ ID NO: 3322287 - DNA, 22 bp, Homo sapiens
catgagactttccgactgcttt

SEQ ID NO: 3322288 - DNA, 22 bp, Homo sapiens
catgagcctcagcatcctggca

SEQ ID NO: 3322289 - DNA, 23 bp, Homo sapiens
catgagcctcagcatcctggcac

SEQ ID NO: 3322290 - DNA, 16 bp, Homo sapiens
catgagctatttccat

SEQ ID NO: 3322291 - DNA, 23 bp, Homo sapiens
catgagctatttccattccagaa

SEQ ID NO: 3322292 - DNA, 21 bp, Homo sapiens
catgaggacatgatggagcgc

SEQ ID NO: 3322293 - DNA, 17 bp, Homo sapiens
catgaggccatctcagg

SEQ ID NO: 3322294 - DNA, 18 bp, Homo sapiens
catgagggatcacagggc

SEQ ID NO: 3322295 - DNA, 23 bp, Homo sapiens
catgagtagtgggctatgcagga

SEQ ID NO: 3322296 - DNA, 14 bp, Homo sapiens
catgagtgaataaa

SEQ ID NO: 3322297 - DNA, 16 bp, Homo sapiens
catgagttatcatgaa

SEQ ID NO: 3322298 - DNA, 21 bp, Homo sapiens
catgataccacctttactgtg

SEQ ID NO: 3322299 - DNA, 22 bp, Homo sapiens
catgataccacctttactgtgc

SEQ ID NO: 3322300 - DNA, 22 bp, Homo sapiens
catgatccctgtgttgtctcta

SEQ ID NO: 3322301 - DNA, 16 bp, Homo sapiens
catgatgaaactgtca

SEQ ID NO: 3322302 - DNA, 21 bp, Homo sapiens
catgatgaaactgtcataatg

SEQ ID NO: 3322303 - DNA, 14 bp, Homo sapiens
catgatgatagttg

SEQ ID NO: 3322304 - DNA, 23 bp, Homo sapiens
catgatggattcccccccctttc

SEQ ID NO: 3322305 - DNA, 12 bp, Homo sapiens
catgatgggaaa

SEQ ID NO: 3322306 - DNA, 17 bp, Homo sapiens
catgatgggaaaatatt

SEQ ID NO: 3322307 - DNA, 20 bp, Homo sapiens
catgatgggaaaatatttcc

SEQ ID NO: 3322308 - DNA, 23 bp, Homo sapiens
catgatgggaaaatatttcctga

SEQ ID NO: 3322309 - DNA, 22 bp, Homo sapiens
catgatgggaatagggagacag

SEQ ID NO: 3322310 - DNA, 16 bp, Homo sapiens
catctccagggagcaa

SEQ ID NO: 3322311 - DNA, 20 bp, Homo sapiens
catctccagggagcaagaca

SEQ ID NO: 3322312 - DNA, 19 bp, Homo sapiens
catctccatcatatgcctg

SEQ ID NO: 3322313 - DNA, 20 bp, Homo sapiens
catctccatcatatgcctga

SEQ ID NO: 3322314 - DNA, 14 bp, Homo sapiens
catctccccaggcc

SEQ ID NO: 3322315 - DNA, 18 bp, Homo sapiens
catctccccaggcctcca

SEQ ID NO: 3322316 - DNA, 15 bp, Homo sapiens
catctccctccccag

SEQ ID NO: 3322317 - DNA, 16 bp, Homo sapiens
catctccctgcctggc

SEQ ID NO: 3322318 - DNA, 21 bp, Homo sapiens
catctcctataatctgtcaaa

SEQ ID NO: 3322319 - DNA, 20 bp, Homo sapiens
catctcctggctaagcctct

SEQ ID NO: 3322320 - DNA, 17 bp, Homo sapiens
catctcctgtcctgggc

SEQ ID NO: 3322321 - DNA, 19 bp, Homo sapiens
catctcctgtgcatgggtg

SEQ ID NO: 3322322 - DNA, 16 bp, Homo sapiens
catctccttgactgcc

SEQ ID NO: 3322323 - DNA, 21 bp, Homo sapiens
catctcggagcatcccggagg

SEQ ID NO: 3322324 - DNA, 14 bp, Homo sapiens
catctctaattttg

SEQ ID NO: 3322325 - DNA, 15 bp, Homo sapiens
catctctaattttgg

SEQ ID NO: 3322326 - DNA, 13 bp, Homo sapiens
catctctctgggg

SEQ ID NO: 3322327 - DNA, 13 bp, Homo sapiens
catctctgcttgg

SEQ ID NO: 3322328 - DNA, 18 bp, Homo sapiens
catctctgtactttgctt

SEQ ID NO: 3322329 - DNA, 10 bp, Homo sapiens
catctcttca

SEQ ID NO: 3322330 - DNA, 20 bp, Homo sapiens
catctgaatgaaaataactg

SEQ ID NO: 3322331 - DNA, 21 bp, Homo sapiens
catctgaatgaaaataactga

SEQ ID NO: 3322332 - DNA, 16 bp, Homo sapiens
catctgactctctttt

SEQ ID NO: 3322333 - DNA, 21 bp, Homo sapiens
catctgactgccaagccagat

SEQ ID NO: 3322334 - DNA, 13 bp, Homo sapiens
catctgattaaaa

SEQ ID NO: 3322335 - DNA, 12 bp, Homo sapiens
catctgcaaaag

SEQ ID NO: 3322336 - DNA, 23 bp, Homo sapiens
catctgcaaaaggcctcttgtaa

SEQ ID NO: 3322337 - DNA, 14 bp, Homo sapiens
catctgccacaggc

SEQ ID NO: 3322338 - DNA, 12 bp, Homo sapiens
catctgcccagg

SEQ ID NO: 3322339 - DNA, 13 bp, Homo sapiens
catctgcccaggg

SEQ ID NO: 3322340 - DNA, 15 bp, Homo sapiens
catctgcccaggggt

SEQ ID NO: 3322341 - DNA, 15 bp, Homo sapiens
catctgcccctcccc

SEQ ID NO: 3322342 - DNA, 14 bp, Homo sapiens
catctgctggtccg

SEQ ID NO: 3322343 - DNA, 20 bp, Homo sapiens
catctggcaacatctttatc

SEQ ID NO: 3322344 - DNA, 16 bp, Homo sapiens
catctggcctggcctg

SEQ ID NO: 3322345 - DNA, 17 bp, Homo sapiens
catctggcctggcctgg

SEQ ID NO: 3322346 - DNA, 14 bp, Homo sapiens
catctggctgttta

SEQ ID NO: 3322347 - DNA, 20 bp, Homo sapiens
catctggctgtttagcagaa

SEQ ID NO: 3322348 - DNA, 22 bp, Homo sapiens
catctggctgtttagcagaact

SEQ ID NO: 3322349 - DNA, 13 bp, Homo sapiens
catctgggacaaa

SEQ ID NO: 3322350 - DNA, 16 bp, Homo sapiens
catctggggttggcaa

SEQ ID NO: 3322351 - DNA, 12 bp, Homo sapiens
catctgtagata

SEQ ID NO: 3322352 - DNA, 20 bp, Homo sapiens
catctgtcattatattctaa

SEQ ID NO: 3322353 - DNA, 20 bp, Homo sapiens
catctgtggagctgccacag

SEQ ID NO: 3322354 - DNA, 14 bp, Homo sapiens
catctgtgtcctgg

SEQ ID NO: 3322355 - DNA, 19 bp, Homo sapiens
catctgtgtttcaagtggg

SEQ ID NO: 3322356 - DNA, 12 bp, Homo sapiens
catctgttgttt

SEQ ID NO: 3322357 - DNA, 20 bp, Homo sapiens
catctgttgttttgttttaa

SEQ ID NO: 3322358 - DNA, 15 bp, Homo sapiens
catcttatagcactt

SEQ ID NO: 3322359 - DNA, 18 bp, Homo sapiens
catcttatcaaggactct

SEQ ID NO: 3322360 - DNA, 14 bp, Homo sapiens
catcttcaaagctt

SEQ ID NO: 3322361 - DNA, 16 bp, Homo sapiens
catcttcactgcaatt

SEQ ID NO: 3322362 - DNA, 21 bp, Homo sapiens
catcttcacttctaaatgcat

SEQ ID NO: 3322363 - DNA, 15 bp, Homo sapiens
catcttcataatttg

SEQ ID NO: 3322364 - DNA, 11 bp, Homo sapiens
catcttccatt

SEQ ID NO: 3322365 - DNA, 14 bp, Homo sapiens
catcttcctgctgc

SEQ ID NO: 3322366 - DNA, 19 bp, Homo sapiens
catcttcgtcttcactctt

SEQ ID NO: 3322367 - DNA, 21 bp, Homo sapiens
catcttcgtcttcactcttag

SEQ ID NO: 3322368 - DNA, 21 bp, Homo sapiens
catcttctccccacagcctct

SEQ ID NO: 3322369 - DNA, 14 bp, Homo sapiens
catcttctggaata

SEQ ID NO: 3322370 - DNA, 16 bp, Homo sapiens
catcttctgtgaaata

SEQ ID NO: 3322371 - DNA, 13 bp, Homo sapiens
catcttgcttccc

SEQ ID NO: 3322372 - DNA, 15 bp, Homo sapiens
catcttgcttcccta

SEQ ID NO: 3322373 - DNA, 20 bp, Homo sapiens
catctttaacagcttacact

SEQ ID NO: 3322374 - DNA, 13 bp, Homo sapiens
catctttaagtat

SEQ ID NO: 3322375 - DNA, 22 bp, Homo sapiens
catctttatagaaggaatttgt

SEQ ID NO: 3322376 - DNA, 16 bp, Homo sapiens
catctttatctgttct

SEQ ID NO: 3322377 - DNA, 17 bp, Homo sapiens
catctttattgaaattc

SEQ ID NO: 3322378 - DNA, 21 bp, Homo sapiens
catctttattgaaattctatt

SEQ ID NO: 3322379 - DNA, 23 bp, Homo sapiens
catctttcctcaagtatcttcta

SEQ ID NO: 3322380 - DNA, 15 bp, Homo sapiens
catctttgccttggg

SEQ ID NO: 3322381 - DNA, 15 bp, Homo sapiens
catctttggggaggt

SEQ ID NO: 3322382 - DNA, 21 bp, Homo sapiens
catctttggggaggtgttcac

SEQ ID NO: 3322383 - DNA, 13 bp, Homo sapiens
catcttttatcta

SEQ ID NO: 3322384 - DNA, 15 bp, Homo sapiens
catcttttgatcttt

SEQ ID NO: 3322385 - DNA, 21 bp, Homo sapiens
catcttttgtgagatgtaatt

SEQ ID NO: 3322386 - DNA, 14 bp, Homo sapiens
catctttttctttt

SEQ ID NO: 3322387 - DNA, 12 bp, Homo sapiens
catgaaaaagca

SEQ ID NO: 3322388 - DNA, 19 bp, Homo sapiens
catgaaaaagcagctacca

SEQ ID NO: 3322389 - DNA, 22 bp, Homo sapiens
catgaaaaatcatgggccagag

SEQ ID NO: 3322390 - DNA, 13 bp, Homo sapiens
catgaaaacgttt

SEQ ID NO: 3322391 - DNA, 19 bp, Homo sapiens
catgaaaacgttttattgt

SEQ ID NO: 3322392 - DNA, 22 bp, Homo sapiens
catgaaaacgttttattgtgtt

SEQ ID NO: 3322393 - DNA, 24 bp, Homo sapiens
catgaaaataccatttagtaagaa

SEQ ID NO: 3322394 - DNA, 11 bp, Homo sapiens
catgaaaattt

SEQ ID NO: 3322395 - DNA, 19 bp, Homo sapiens
catgaaaattttaaaaata

SEQ ID NO: 3322396 - DNA, 13 bp, Homo sapiens
catgaaacaaagc

SEQ ID NO: 3322397 - DNA, 13 bp, Homo sapiens
catgaaacagaaa

SEQ ID NO: 3322398 - DNA, 16 bp, Homo sapiens
catgaaataaagaatt

SEQ ID NO: 3322399 - DNA, 20 bp, Homo sapiens
catgaaataaagaatttaaa

SEQ ID NO: 3322400 - DNA, 22 bp, Homo sapiens
catgaaatatagatcagttata

SEQ ID NO: 3322401 - DNA, 13 bp, Homo sapiens
catgaaatatgca

SEQ ID NO: 3322402 - DNA, 23 bp, Homo sapiens
catgaaatgccctcctaaatgtc

SEQ ID NO: 3322403 - DNA, 24 bp, Homo sapiens
catgaaattgtctagcagagcagg

SEQ ID NO: 3322404 - DNA, 22 bp, Homo sapiens
catgaacagaaaacattctgat

SEQ ID NO: 3322405 - DNA, 23 bp, Homo sapiens
catgaacagaaaacattctgatt

SEQ ID NO: 3322406 - DNA, 20 bp, Homo sapiens
catgaacagctctgagatcc

SEQ ID NO: 3322407 - DNA, 15 bp, Homo sapiens
catgaaccaaatggt

SEQ ID NO: 3322408 - DNA, 14 bp, Homo sapiens
catgaagaatgcat

SEQ ID NO: 3322409 - DNA, 18 bp, Homo sapiens
catgaagaatgcattcaa

SEQ ID NO: 3322410 - DNA, 20 bp, Homo sapiens
catgaagaatgcattcaaaa

SEQ ID NO: 3322411 - DNA, 15 bp, Homo sapiens
catgaagagaagcaa

SEQ ID NO: 3322412 - DNA, 16 bp, Homo sapiens
catgaagagaagcaat

SEQ ID NO: 3322413 - DNA, 18 bp, Homo sapiens
catgaagagaagcaattt

SEQ ID NO: 3322414 - DNA, 14 bp, Homo sapiens
catgaagagcaaaa

SEQ ID NO: 3322415 - DNA, 19 bp, Homo sapiens
catgaagagcaaaaatatc

SEQ ID NO: 3322416 - DNA, 17 bp, Homo sapiens
catgaagtaaattatgt

SEQ ID NO: 3322417 - DNA, 18 bp, Homo sapiens
catgaagtaaattatgta

SEQ ID NO: 3322418 - DNA, 14 bp, Homo sapiens
catgaataaaacac

SEQ ID NO: 3322419 - DNA, 16 bp, Homo sapiens
catgaatgatttgtgt

SEQ ID NO: 3322420 - DNA, 18 bp, Homo sapiens
catgaattcccttttaat

SEQ ID NO: 3322421 - DNA, 15 bp, Homo sapiens
catgaattttaaagt

SEQ ID NO: 3322422 - DNA, 16 bp, Homo sapiens
catgaattttaaagta

SEQ ID NO: 3322423 - DNA, 23 bp, Homo sapiens
catgacaacttttaaagaaaaat

SEQ ID NO: 3322424 - DNA, 12 bp, Homo sapiens
catgacactgac

SEQ ID NO: 3322425 - DNA, 13 bp, Homo sapiens
catgacactgacc

SEQ ID NO: 3322426 - DNA, 20 bp, Homo sapiens
catgacagcgctaaacgttg

SEQ ID NO: 3322427 - DNA, 15 bp, Homo sapiens
catgacatgttatat

SEQ ID NO: 3322428 - DNA, 16 bp, Homo sapiens
catgacatgttatata

SEQ ID NO: 3322429 - DNA, 18 bp, Homo sapiens
catgaccatactgaggga

SEQ ID NO: 3322430 - DNA, 12 bp, Homo sapiens
catgacccaccc

SEQ ID NO: 3322431 - DNA, 15 bp, Homo sapiens
catgacccacccctg

SEQ ID NO: 3322432 - DNA, 16 bp, Homo sapiens
catgacccacccctgt

SEQ ID NO: 3322433 - DNA, 17 bp, Homo sapiens
catgacccacccctgtg

SEQ ID NO: 3322434 - DNA, 19 bp, Homo sapiens
catgacctaccaggacaga

SEQ ID NO: 3322435 - DNA, 21 bp, Homo sapiens
catgacctaccaggacagaac

SEQ ID NO: 3322436 - DNA, 14 bp, Homo sapiens
catgacctccaggg

SEQ ID NO: 3322437 - DNA, 17 bp, Homo sapiens
catgacctgtgaccagc

SEQ ID NO: 3322438 - DNA, 19 bp, Homo sapiens
catgacgacaaagctgcta

SEQ ID NO: 3322439 - DNA, 23 bp, Homo sapiens
catgacgacaaagctgctaaatc

SEQ ID NO: 3322440 - DNA, 19 bp, Homo sapiens
catccactctaccctccca

SEQ ID NO: 3322441 - DNA, 14 bp, Homo sapiens
catccactgtgcca

SEQ ID NO: 3322442 - DNA, 16 bp, Homo sapiens
catccagacatcatga

SEQ ID NO: 3322443 - DNA, 13 bp, Homo sapiens
catccagcaagaa

SEQ ID NO: 3322444 - DNA, 15 bp, Homo sapiens
catccaggttcagct

SEQ ID NO: 3322445 - DNA, 17 bp, Homo sapiens
catccataccagctcgc

SEQ ID NO: 3322446 - DNA, 14 bp, Homo sapiens
catccatctccagg

SEQ ID NO: 3322447 - DNA, 18 bp, Homo sapiens
catccatgtcctatgtgt

SEQ ID NO: 3322448 - DNA, 19 bp, Homo sapiens
catccatgttccgagaaga

SEQ ID NO: 3322449 - DNA, 19 bp, Homo sapiens
catccatgtttgtaaaact

SEQ ID NO: 3322450 - DNA, 18 bp, Homo sapiens
catccattcccaagaaat

SEQ ID NO: 3322451 - DNA, 17 bp, Homo sapiens
catcccaaccagtgcca

SEQ ID NO: 3322452 - DNA, 22 bp, Homo sapiens
catcccaaccagtgccaaggac

SEQ ID NO: 3322453 - DNA, 14 bp, Homo sapiens
catcccacaccctg

SEQ ID NO: 3322454 - DNA, 19 bp, Homo sapiens
catcccacgcactccatga

SEQ ID NO: 3322455 - DNA, 18 bp, Homo sapiens
catcccacttagccgcac

SEQ ID NO: 3322456 - DNA, 19 bp, Homo sapiens
catcccacttagccgcacc

SEQ ID NO: 3322457 - DNA, 15 bp, Homo sapiens
catcccagcacctgc

SEQ ID NO: 3322458 - DNA, 18 bp, Homo sapiens
catcccagcagcccaagc

SEQ ID NO: 3322459 - DNA, 13 bp, Homo sapiens
catcccagcccca

SEQ ID NO: 3322460 - DNA, 17 bp, Homo sapiens
catcccagcctgtggtt

SEQ ID NO: 3322461 - DNA, 19 bp, Homo sapiens
catcccaggcttcaccctg

SEQ ID NO: 3322462 - DNA, 14 bp, Homo sapiens
catcccaggggacc

SEQ ID NO: 3322463 - DNA, 19 bp, Homo sapiens
catccccacaatctggctt

SEQ ID NO: 3322464 - DNA, 15 bp, Homo sapiens
catccccaccagctc

SEQ ID NO: 3322465 - DNA, 16 bp, Homo sapiens
catccccaccagctcg

SEQ ID NO: 3322466 - DNA, 21 bp, Homo sapiens
catccccaggggtcccagcca

SEQ ID NO: 3322467 - DNA, 15 bp, Homo sapiens
catccccatcctcca

SEQ ID NO: 3322468 - DNA, 16 bp, Homo sapiens
catccccatcctccag

SEQ ID NO: 3322469 - DNA, 21 bp, Homo sapiens
catccccatcctccagcttct

SEQ ID NO: 3322470 - DNA, 17 bp, Homo sapiens
catccccattcggggct

SEQ ID NO: 3322471 - DNA, 14 bp, Homo sapiens
catcccctggactg

SEQ ID NO: 3322472 - DNA, 15 bp, Homo sapiens
catcccggaggaaat

SEQ ID NO: 3322473 - DNA, 16 bp, Homo sapiens
catcccggaggaaatc

SEQ ID NO: 3322474 - DNA, 17 bp, Homo sapiens
catcccggaggaaatct

SEQ ID NO: 3322475 - DNA, 13 bp, Homo sapiens
catcccggcctct

SEQ ID NO: 3322476 - DNA, 14 bp, Homo sapiens
catcccgtgttctc

SEQ ID NO: 3322477 - DNA, 22 bp, Homo sapiens
catccctaccccctaagagcca

SEQ ID NO: 3322478 - DNA, 14 bp, Homo sapiens
catccctcctgctt

SEQ ID NO: 3322479 - DNA, 15 bp, Homo sapiens
catccctcctgcttt

SEQ ID NO: 3322480 - DNA, 19 bp, Homo sapiens
catccctcggaagccgtct

SEQ ID NO: 3322481 - DNA, 21 bp, Homo sapiens
catccctgactggccaaaccc

SEQ ID NO: 3322482 - DNA, 23 bp, Homo sapiens
catccctgagacagggagggaag

SEQ ID NO: 3322483 - DNA, 16 bp, Homo sapiens
catccctgcctggtca

SEQ ID NO: 3322484 - DNA, 13 bp, Homo sapiens
catccctggagca

SEQ ID NO: 3322485 - DNA, 23 bp, Homo sapiens
catccctggccccctccctggat

SEQ ID NO: 3322486 - DNA, 11 bp, Homo sapiens
catccctgggc

SEQ ID NO: 3322487 - DNA, 12 bp, Homo sapiens
catccctgtgag

SEQ ID NO: 3322488 - DNA, 11 bp, Homo sapiens
catcccttcct

SEQ ID NO: 3322489 - DNA, 19 bp, Homo sapiens
catcccttcctggaaacag

SEQ ID NO: 3322490 - DNA, 21 bp, Homo sapiens
catcccttcctggaaacagca

SEQ ID NO: 3322491 - DNA, 15 bp, Homo sapiens
catatggactctgca

SEQ ID NO: 3322492 - DNA, 23 bp, Homo sapiens
catatggattttctattgttact

SEQ ID NO: 3322493 - DNA, 21 bp, Homo sapiens
catatgggatattcccaagcc

SEQ ID NO: 3322494 - DNA, 15 bp, Homo sapiens
catatgtacataaat

SEQ ID NO: 3322495 - DNA, 15 bp, Homo sapiens
catatgtaccatgta

SEQ ID NO: 3322496 - DNA, 21 bp, Homo sapiens
catatgtagactatatacatg

SEQ ID NO: 3322497 - DNA, 17 bp, Homo sapiens
catatgtattcctgatc

SEQ ID NO: 3322498 - DNA, 18 bp, Homo sapiens
catatgtgttacttcaag

SEQ ID NO: 3322499 - DNA, 15 bp, Homo sapiens
catatgttgctcagt

SEQ ID NO: 3322500 - DNA, 16 bp, Homo sapiens
catattaagacagtgt

SEQ ID NO: 3322501 - DNA, 18 bp, Homo sapiens
catattaagacagtgtac

SEQ ID NO: 3322502 - DNA, 21 bp, Homo sapiens
catattaagacagtgtacaaa

SEQ ID NO: 3322503 - DNA, 19 bp, Homo sapiens
catattactgttgcattta

SEQ ID NO: 3322504 - DNA, 21 bp, Homo sapiens
catattactgttgcatttact

SEQ ID NO: 3322505 - DNA, 23 bp, Homo sapiens
catattactgttgcatttacttt

SEQ ID NO: 3322506 - DNA, 14 bp, Homo sapiens
catattaggaaaat

SEQ ID NO: 3322507 - DNA, 15 bp, Homo sapiens
catattatgcctgaa

SEQ ID NO: 3322508 - DNA, 20 bp, Homo sapiens
catattctattgtattattt

SEQ ID NO: 3322509 - DNA, 13 bp, Homo sapiens
catattctgtctg

SEQ ID NO: 3322510 - DNA, 19 bp, Homo sapiens
catattgatctttttatca

SEQ ID NO: 3322511 - DNA, 16 bp, Homo sapiens
catattgatgaaaaga

SEQ ID NO: 3322512 - DNA, 20 bp, Homo sapiens
catattgatgaaaagattta

SEQ ID NO: 3322513 - DNA, 21 bp, Homo sapiens
catattgcaggagacattttc

SEQ ID NO: 3322514 - DNA, 17 bp, Homo sapiens
catattggcatggattt

SEQ ID NO: 3322515 - DNA, 16 bp, Homo sapiens
catattgtaaaacagg

SEQ ID NO: 3322516 - DNA, 17 bp, Homo sapiens
catattgtaaaacaggt

SEQ ID NO: 3322517 - DNA, 20 bp, Homo sapiens
catattgtgattctgccttt

SEQ ID NO: 3322518 - DNA, 16 bp, Homo sapiens
catattgttggcacag

SEQ ID NO: 3322519 - DNA, 22 bp, Homo sapiens
catattgttggcacagaacagg

SEQ ID NO: 3322520 - DNA, 16 bp, Homo sapiens
catatttacttcttat

SEQ ID NO: 3322521 - DNA, 17 bp, Homo sapiens
catatttacttcttata

SEQ ID NO: 3322522 - DNA, 16 bp, Homo sapiens
catatttatactttgc

SEQ ID NO: 3322523 - DNA, 13 bp, Homo sapiens
catatttcatttt

SEQ ID NO: 3322524 - DNA, 14 bp, Homo sapiens
catatttcatttta

SEQ ID NO: 3322525 - DNA, 15 bp, Homo sapiens
catatttcattttaa

SEQ ID NO: 3322526 - DNA, 17 bp, Homo sapiens
catatttgccaataaag

SEQ ID NO: 3322527 - DNA, 18 bp, Homo sapiens
catatttgccaataaagc

SEQ ID NO: 3322528 - DNA, 19 bp, Homo sapiens
catatttgccaataaagct

SEQ ID NO: 3322529 - DNA, 20 bp, Homo sapiens
catatttgccaataaagctt

SEQ ID NO: 3322530 - DNA, 15 bp, Homo sapiens
catatttggaagaaa

SEQ ID NO: 3322531 - DNA, 17 bp, Homo sapiens
catattttattctttta

SEQ ID NO: 3322532 - DNA, 21 bp, Homo sapiens
catattttattgtattttgat

SEQ ID NO: 3322533 - DNA, 12 bp, Homo sapiens
catattttgctg

SEQ ID NO: 3322534 - DNA, 17 bp, Homo sapiens
catcaaacctttgagta

SEQ ID NO: 3322535 - DNA, 16 bp, Homo sapiens
catcaacaagatttcc

SEQ ID NO: 3322536 - DNA, 22 bp, Homo sapiens
catcaagaatggggatcacaga

SEQ ID NO: 3322537 - DNA, 15 bp, Homo sapiens
catcaagcttttctg

SEQ ID NO: 3322538 - DNA, 14 bp, Homo sapiens
catcaataaatgct

SEQ ID NO: 3322539 - DNA, 24 bp, Homo sapiens
catcaatatccctcttgtaagtca

SEQ ID NO: 3322540 - DNA, 17 bp, Homo sapiens
catcaatgtgacattta

SEQ ID NO: 3322541 - DNA, 11 bp, Homo sapiens
catcaatgttc

SEQ ID NO: 3322542 - DNA, 14 bp, Homo sapiens
catcaatgttcatt

SEQ ID NO: 3322543 - DNA, 16 bp, Homo sapiens
catcaattaacatcgt

SEQ ID NO: 3322544 - DNA, 11 bp, Homo sapiens
catcacacaca

SEQ ID NO: 3322545 - DNA, 15 bp, Homo sapiens
cagttttccatgaaa

SEQ ID NO: 3322546 - DNA, 13 bp, Homo sapiens
cagttttcccctg

SEQ ID NO: 3322547 - DNA, 12 bp, Homo sapiens
cagtttttcagg

SEQ ID NO: 3322548 - DNA, 13 bp, Homo sapiens
cagtttttcattt

SEQ ID NO: 3322549 - DNA, 14 bp, Homo sapiens
cagtttttcatttg

SEQ ID NO: 3322550 - DNA, 19 bp, Homo sapiens
cagtttttcatttgttttg

SEQ ID NO: 3322551 - DNA, 16 bp, Homo sapiens
cagttttttatgctaa

SEQ ID NO: 3322552 - DNA, 17 bp, Homo sapiens
cataaaaaagaagcact

SEQ ID NO: 3322553 - DNA, 20 bp, Homo sapiens
cataaaaaagaagcactttg

SEQ ID NO: 3322554 - DNA, 14 bp, Homo sapiens
cataaaaaccaaac

SEQ ID NO: 3322555 - DNA, 23 bp, Homo sapiens
cataaaaagcaaaacaaaaatta

SEQ ID NO: 3322556 - DNA, 14 bp, Homo sapiens
cataaaaagcagaa

SEQ ID NO: 3322557 - DNA, 22 bp, Homo sapiens
cataaaaagcagaattttaatg

SEQ ID NO: 3322558 - DNA, 23 bp, Homo sapiens
cataaaaagcctgcaatttcata

SEQ ID NO: 3322559 - DNA, 16 bp, Homo sapiens
cataaaagcattgtct

SEQ ID NO: 3322560 - DNA, 14 bp, Homo sapiens
cataaaatctgtga

SEQ ID NO: 3322561 - DNA, 14 bp, Homo sapiens
cataaaattttcta

SEQ ID NO: 3322562 - DNA, 18 bp, Homo sapiens
cataaacaatgatgccct

SEQ ID NO: 3322563 - DNA, 17 bp, Homo sapiens
cataaacggttcctggt

SEQ ID NO: 3322564 - DNA, 14 bp, Homo sapiens
cataaagagaaaat

SEQ ID NO: 3322565 - DNA, 12 bp, Homo sapiens
cataaagtactt

SEQ ID NO: 3322566 - DNA, 16 bp, Homo sapiens
cataaataaaactgaa

SEQ ID NO: 3322567 - DNA, 17 bp, Homo sapiens
cataaataaaactgaat

SEQ ID NO: 3322568 - DNA, 18 bp, Homo sapiens
cataaataaaactgaatc

SEQ ID NO: 3322569 - DNA, 15 bp, Homo sapiens
cataaatagtagaaa

SEQ ID NO: 3322570 - DNA, 15 bp, Homo sapiens
cataaatatgcagtg

SEQ ID NO: 3322571 - DNA, 20 bp, Homo sapiens
cataaatgttcagcttcaga

SEQ ID NO: 3322572 - DNA, 13 bp, Homo sapiens
cataacaatgtat

SEQ ID NO: 3322573 - DNA, 21 bp, Homo sapiens
cataacaccaatcccagggct

SEQ ID NO: 3322574 - DNA, 22 bp, Homo sapiens
cataacaccaatcccagggctg

SEQ ID NO: 3322575 - DNA, 17 bp, Homo sapiens
cataacagcctctgtga

SEQ ID NO: 3322576 - DNA, 14 bp, Homo sapiens
cataacagtgccat

SEQ ID NO: 3322577 - DNA, 12 bp, Homo sapiens
cataacctgtct

SEQ ID NO: 3322578 - DNA, 20 bp, Homo sapiens
cataaccttaaaaaggacta

SEQ ID NO: 3322579 - DNA, 15 bp, Homo sapiens
cataacgtttttcct

SEQ ID NO: 3322580 - DNA, 17 bp, Homo sapiens
cataacgtttttccttt

SEQ ID NO: 3322581 - DNA, 21 bp, Homo sapiens
cataacgtttttcctttaaaa

SEQ ID NO: 3322582 - DNA, 14 bp, Homo sapiens
cataactaaatttg

SEQ ID NO: 3322583 - DNA, 19 bp, Homo sapiens
cataactaaatttgatact

SEQ ID NO: 3322584 - DNA, 14 bp, Homo sapiens
cataactgaaaatg

SEQ ID NO: 3322585 - DNA, 14 bp, Homo sapiens
cataacttcctgta

SEQ ID NO: 3322586 - DNA, 12 bp, Homo sapiens
cataacttgaaa

SEQ ID NO: 3322587 - DNA, 21 bp, Homo sapiens
cataagattaaaggaaggaaa

SEQ ID NO: 3322588 - DNA, 22 bp, Homo sapiens
cataagattaaaggaaggaaaa

SEQ ID NO: 3322589 - DNA, 22 bp, Homo sapiens
cataagctatcacctagcagcc

SEQ ID NO: 3322590 - DNA, 22 bp, Homo sapiens
cataaggaatgtagctggtttc

SEQ ID NO: 3322591 - DNA, 19 bp, Homo sapiens
cataaggacgtgtgtaaat

SEQ ID NO: 3322592 - DNA, 21 bp, Homo sapiens
cataaggggtttgccatttga

SEQ ID NO: 3322593 - DNA, 22 bp, Homo sapiens
cataaggtttcgtttctgtata

SEQ ID NO: 3322594 - DNA, 16 bp, Homo sapiens
cataagtaattcaaga

SEQ ID NO: 3322595 - DNA, 18 bp, Homo sapiens
cataagtaattcaagaaa

SEQ ID NO: 3322596 - DNA, 19 bp, Homo sapiens
cataagtattatgtctctt

SEQ ID NO: 3322597 - DNA, 20 bp, Homo sapiens
cataataaatcacacattca

SEQ ID NO: 3322598 - DNA, 17 bp, Homo sapiens
cataataagctaaagag

SEQ ID NO: 3322599 - DNA, 18 bp, Homo sapiens
cataatagttagccctca

SEQ ID NO: 3322600 - DNA, 20 bp, Homo sapiens
cataatgctaatttaaagag

SEQ ID NO: 3322601 - DNA, 15 bp, Homo sapiens
cataatgctactgtc

SEQ ID NO: 3322602 - DNA, 19 bp, Homo sapiens
cataatgcttaatttctaa

SEQ ID NO: 3322603 - DNA, 15 bp, Homo sapiens
cataatgctttgtta

SEQ ID NO: 3322604 - DNA, 14 bp, Homo sapiens
cataatgtattgtt

SEQ ID NO: 3322605 - DNA, 18 bp, Homo sapiens
cataatgttacattatta

SEQ ID NO: 3322606 - DNA, 21 bp, Homo sapiens
cataatgtttctggatttcat

SEQ ID NO: 3322607 - DNA, 19 bp, Homo sapiens
cataatgtttttcctttct

SEQ ID NO: 3322608 - DNA, 13 bp, Homo sapiens
cacagaaaaagca

SEQ ID NO: 3322609 - DNA, 20 bp, Homo sapiens
cacagaaatcagaggagaga

SEQ ID NO: 3322610 - DNA, 22 bp, Homo sapiens
cacagaacctactgttcctttc

SEQ ID NO: 3322611 - DNA, 21 bp, Homo sapiens
cacagaaccttcaacccagtg

SEQ ID NO: 3322612 - DNA, 19 bp, Homo sapiens
cacagaagacttcccagct

SEQ ID NO: 3322613 - DNA, 20 bp, Homo sapiens
cacagaagacttcccagctt

SEQ ID NO: 3322614 - DNA, 23 bp, Homo sapiens
cacagaatttgtatgtattttca

SEQ ID NO: 3322615 - DNA, 12 bp, Homo sapiens
cacagacacaca

SEQ ID NO: 3322616 - DNA, 13 bp, Homo sapiens
cacagacacacac

SEQ ID NO: 3322617 - DNA, 17 bp, Homo sapiens
cacagacacacacacgc

SEQ ID NO: 3322618 - DNA, 15 bp, Homo sapiens
cacagacacgctcgc

SEQ ID NO: 3322619 - DNA, 22 bp, Homo sapiens
cacagacacgctcgcgggcagc

SEQ ID NO: 3322620 - DNA, 18 bp, Homo sapiens
cacagacctggagcccct

SEQ ID NO: 3322621 - DNA, 22 bp, Homo sapiens
cacagacctggagcccctgggt

SEQ ID NO: 3322622 - DNA, 19 bp, Homo sapiens
cacagacgccttactggca

SEQ ID NO: 3322623 - DNA, 18 bp, Homo sapiens
cacagactccggcctgta

SEQ ID NO: 3322624 - DNA, 13 bp, Homo sapiens
cacagactggcaa

SEQ ID NO: 3322625 - DNA, 22 bp, Homo sapiens
cacagacttctggaaggctggc

SEQ ID NO: 3322626 - DNA, 12 bp, Homo sapiens
cacagagaaagt

SEQ ID NO: 3322627 - DNA, 16 bp, Homo sapiens
cacagagacattcctc

SEQ ID NO: 3322628 - DNA, 10 bp, Homo sapiens
cacagagaga

SEQ ID NO: 3322629 - DNA, 18 bp, Homo sapiens
cacagagagggagagcag

SEQ ID NO: 3322630 - DNA, 19 bp, Homo sapiens
cacagagagggagagcaga

SEQ ID NO: 3322631 - DNA, 16 bp, Homo sapiens
cacagagagtcccact

SEQ ID NO: 3322632 - DNA, 13 bp, Homo sapiens
cacagagcccaat

SEQ ID NO: 3322633 - DNA, 16 bp, Homo sapiens
cacagagctctccagc

SEQ ID NO: 3322634 - DNA, 17 bp, Homo sapiens
cacagagctctccagct

SEQ ID NO: 3322635 - DNA, 18 bp, Homo sapiens
cacagagctctccagctc

SEQ ID NO: 3322636 - DNA, 23 bp, Homo sapiens
cacagaggtagtctcactgcttg

SEQ ID NO: 3322637 - DNA, 16 bp, Homo sapiens
cacagagtgagccagt

SEQ ID NO: 3322638 - DNA, 17 bp, Homo sapiens
cacagagtgagccagtg

SEQ ID NO: 3322639 - DNA, 23 bp, Homo sapiens
cacagatatactttgtggaccaa

SEQ ID NO: 3322640 - DNA, 11 bp, Homo sapiens
cacagatcatg

SEQ ID NO: 3322641 - DNA, 19 bp, Homo sapiens
cacagatggatttgcctgt

SEQ ID NO: 3322642 - DNA, 16 bp, Homo sapiens
cacagatgtctctggg

SEQ ID NO: 3322643 - DNA, 19 bp, Homo sapiens
cacagatgtctctggggca

SEQ ID NO: 3322644 - DNA, 20 bp, Homo sapiens
cacagattgtttctatacaa

SEQ ID NO: 3322645 - DNA, 21 bp, Homo sapiens
cacagattgtttctatacaaa

SEQ ID NO: 3322646 - DNA, 12 bp, Homo sapiens
cacagattttaa

SEQ ID NO: 3322647 - DNA, 15 bp, Homo sapiens
cacagattttaattg

SEQ ID NO: 3322648 - DNA, 16 bp, Homo sapiens
cacagcaatatttaac

SEQ ID NO: 3322649 - DNA, 18 bp, Homo sapiens
cacagcaattcctcaggc

SEQ ID NO: 3322650 - DNA, 19 bp, Homo sapiens
cacagcacaccagccgctg

SEQ ID NO: 3322651 - DNA, 13 bp, Homo sapiens
cacagcagcttca

SEQ ID NO: 3322652 - DNA, 21 bp, Homo sapiens
cacagcagcttcaccagagca

SEQ ID NO: 3322653 - DNA, 13 bp, Homo sapiens
cacagcaggtcct

SEQ ID NO: 3322654 - DNA, 17 bp, Homo sapiens
cacagcatggaggagga

SEQ ID NO: 3322655 - DNA, 15 bp, Homo sapiens
cacagcatgtgccaa

SEQ ID NO: 3322656 - DNA, 16 bp, Homo sapiens
cacagcatgtgccaag

SEQ ID NO: 3322657 - DNA, 18 bp, Homo sapiens
cacagcatgtgccaagat

SEQ ID NO: 3322658 - DNA, 16 bp, Homo sapiens
cacagcattgtatatg

SEQ ID NO: 3322659 - DNA, 15 bp, Homo sapiens
cacagccacccgtgg

SEQ ID NO: 3322660 - DNA, 17 bp, Homo sapiens
cacagccagcacctggc

SEQ ID NO: 3322661 - DNA, 22 bp, Homo sapiens
cacagccagggggatgccactc

SEQ ID NO: 3322662 - DNA, 15 bp, Homo sapiens
cacagccatgccctt

SEQ ID NO: 3322663 - DNA, 15 bp, Homo sapiens
cacagcccagcttgg

SEQ ID NO: 3322664 - DNA, 17 bp, Homo sapiens
cacagcccccttgccct

SEQ ID NO: 3322665 - DNA, 22 bp, Homo sapiens
cacagccgcagcctccctctga

SEQ ID NO: 3322666 - DNA, 21 bp, Homo sapiens
cacagccgcctgaaagccaca

SEQ ID NO: 3322667 - DNA, 11 bp, Homo sapiens
cacagcctctg

SEQ ID NO: 3322668 - DNA, 12 bp, Homo sapiens
cacagcctctga

SEQ ID NO: 3322669 - DNA, 13 bp, Homo sapiens
cacagcctctgac

SEQ ID NO: 3322670 - DNA, 15 bp, Homo sapiens
cacagcctctgaccc

SEQ ID NO: 3322671 - DNA, 22 bp, Homo sapiens
cacagcctctgacccctcctca

SEQ ID NO: 3322672 - DNA, 16 bp, Homo sapiens
cacagcctctggctcc

SEQ ID NO: 3322673 - DNA, 20 bp, Homo sapiens
cacagcctctggctccacac

SEQ ID NO: 3322674 - DNA, 23 bp, Homo sapiens
cacagccttcggacagacatatg

SEQ ID NO: 3322675 - DNA, 20 bp, Homo sapiens
cacagcggaggtgtggagcc

SEQ ID NO: 3322676 - DNA, 23 bp, Homo sapiens
cacagcggagtctgtcctgtgac

SEQ ID NO: 3322677 - DNA, 22 bp, Homo sapiens
cacagcgtccctagcagtgaac

SEQ ID NO: 3322678 - DNA, 14 bp, Homo sapiens
cacagcgtccctgg

SEQ ID NO: 3322679 - DNA, 16 bp, Homo sapiens
cacagcgtccctggcg

SEQ ID NO: 3322680 - DNA, 16 bp, Homo sapiens
cacagctactctcccc

SEQ ID NO: 3322681 - DNA, 15 bp, Homo sapiens
cacagctcaggaggc

SEQ ID NO: 3322682 - DNA, 11 bp, Homo sapiens
cacagctctgt

SEQ ID NO: 3322683 - DNA, 14 bp, Homo sapiens
cacagctctgtcct

SEQ ID NO: 3322684 - DNA, 20 bp, Homo sapiens
cacagctctgtcctgggagt

SEQ ID NO: 3322685 - DNA, 16 bp, Homo sapiens
cacagctcttcattcc

SEQ ID NO: 3322686 - DNA, 18 bp, Homo sapiens
cacagctcttcattccat

SEQ ID NO: 3322687 - DNA, 20 bp, Homo sapiens
cacagctcttcattccattg

SEQ ID NO: 3322688 - DNA, 17 bp, Homo sapiens
cacagctcttctccagg

SEQ ID NO: 3322689 - DNA, 18 bp, Homo sapiens
cacagctcttctccaggc

SEQ ID NO: 3322690 - DNA, 19 bp, Homo sapiens
cacagctcttctccaggct

SEQ ID NO: 3322691 - DNA, 21 bp, Homo sapiens
cacagctcttctccaggctgt

SEQ ID NO: 3322692 - DNA, 18 bp, Homo sapiens
cacagctgagagactttt

SEQ ID NO: 3322693 - DNA, 16 bp, Homo sapiens
cacagctgagcactta

SEQ ID NO: 3322694 - DNA, 21 bp, Homo sapiens
cacagctggagctctcaaact

SEQ ID NO: 3322695 - DNA, 22 bp, Homo sapiens
cacagctgttcttctgttctgc

SEQ ID NO: 3322696 - DNA, 18 bp, Homo sapiens
cacagcttaacaatgcaa

SEQ ID NO: 3322697 - DNA, 15 bp, Homo sapiens
cacagcttagatttc

SEQ ID NO: 3322698 - DNA, 18 bp, Homo sapiens
cacagcttgacctgaggc

SEQ ID NO: 3322699 - DNA, 21 bp, Homo sapiens
cacagcttgacctgaggctgt

SEQ ID NO: 3322700 - DNA, 22 bp, Homo sapiens
cacagcttgacctgaggctgtg

SEQ ID NO: 3322701 - DNA, 15 bp, Homo sapiens
cacaggaggcaagca

SEQ ID NO: 3322702 - DNA, 16 bp, Homo sapiens
cacaggagtgtcctct

SEQ ID NO: 3322703 - DNA, 20 bp, Homo sapiens
cacaggagtgtcctcttccc

SEQ ID NO: 3322704 - DNA, 12 bp, Homo sapiens
cacaggatcagt

SEQ ID NO: 3322705 - DNA, 15 bp, Homo sapiens
cacaggatcagtctg

SEQ ID NO: 3322706 - DNA, 16 bp, Homo sapiens
cacaggatcagtctga

SEQ ID NO: 3322707 - DNA, 13 bp, Homo sapiens
cacaggatgccag

SEQ ID NO: 3322708 - DNA, 16 bp, Homo sapiens
cacaggcaaaatcctt

SEQ ID NO: 3322709 - DNA, 13 bp, Homo sapiens
cacaggcacacag

SEQ ID NO: 3322710 - DNA, 16 bp, Homo sapiens
cacaggcagctggatg

SEQ ID NO: 3322711 - DNA, 21 bp, Homo sapiens
cacaggcagctggatgagact

SEQ ID NO: 3322712 - DNA, 23 bp, Homo sapiens
cacaggcagtgcatgtgaagcat

SEQ ID NO: 3322713 - DNA, 13 bp, Homo sapiens
cacaggcccagaa

SEQ ID NO: 3322714 - DNA, 21 bp, Homo sapiens
cacaggcccccttgagtgggg

SEQ ID NO: 3322715 - DNA, 16 bp, Homo sapiens
cacaggcccggctcca

SEQ ID NO: 3322716 - DNA, 23 bp, Homo sapiens
cacaggcccggctccaggctcct

SEQ ID NO: 3322717 - DNA, 15 bp, Homo sapiens
cacaggcccttcctc

SEQ ID NO: 3322718 - DNA, 21 bp, Homo sapiens
cacaggcccttcctctccact

SEQ ID NO: 3322719 - DNA, 23 bp, Homo sapiens
cacaggcccttcctctccactgc

SEQ ID NO: 3322720 - DNA, 16 bp, Homo sapiens
cacaggcctccctgtt

SEQ ID NO: 3322721 - DNA, 14 bp, Homo sapiens
cacaggcctctctt

SEQ ID NO: 3322722 - DNA, 22 bp, Homo sapiens
cacaggcctctcttttccccgc

SEQ ID NO: 3322723 - DNA, 14 bp, Homo sapiens
cacaggctagatcc

SEQ ID NO: 3322724 - DNA, 14 bp, Homo sapiens
cacaggctggcagt

SEQ ID NO: 3322725 - DNA, 19 bp, Homo sapiens
cacagggcaccagaggccg

SEQ ID NO: 3322726 - DNA, 20 bp, Homo sapiens
cacagggcaccagaggccga

SEQ ID NO: 3322727 - DNA, 14 bp, Homo sapiens
cacagggcagagcc

SEQ ID NO: 3322728 - DNA, 17 bp, Homo sapiens
cacagggcagagccggg

SEQ ID NO: 3322729 - DNA, 13 bp, Homo sapiens
cacagggcagggg

SEQ ID NO: 3322730 - DNA, 17 bp, Homo sapiens
cacagggcaggggtggt

SEQ ID NO: 3322731 - DNA, 19 bp, Homo sapiens
cacagggccccagaaggca

SEQ ID NO: 3322732 - DNA, 15 bp, Homo sapiens
cacagggcccggcca

SEQ ID NO: 3322733 - DNA, 21 bp, Homo sapiens
cacagggcggtaccttgtgcc

SEQ ID NO: 3322734 - DNA, 17 bp, Homo sapiens
cacaggggcaggcctgg

SEQ ID NO: 3322735 - DNA, 20 bp, Homo sapiens
cacaggggcaggcctgggac

SEQ ID NO: 3322736 - DNA, 19 bp, Homo sapiens
cacaggggccccagatctg

SEQ ID NO: 3322737 - DNA, 22 bp, Homo sapiens
cacaactcccttaaggtctcca

SEQ ID NO: 3322738 - DNA, 18 bp, Homo sapiens
cacaactgacacaggaaa

SEQ ID NO: 3322739 - DNA, 14 bp, Homo sapiens
cacaagaaatttga

SEQ ID NO: 3322740 - DNA, 20 bp, Homo sapiens
cacaagaaatttgatttcta

SEQ ID NO: 3322741 - DNA, 13 bp, Homo sapiens
cacaagaatggat

SEQ ID NO: 3322742 - DNA, 20 bp, Homo sapiens
cacaagagcccagcagggcc

SEQ ID NO: 3322743 - DNA, 22 bp, Homo sapiens
cacaagcaatgcaagaaaaaaa

SEQ ID NO: 3322744 - DNA, 23 bp, Homo sapiens
cacaagcaatgcaagaaaaaaac

SEQ ID NO: 3322745 - DNA, 22 bp, Homo sapiens
cacaagcagagtgcacagctgt

SEQ ID NO: 3322746 - DNA, 19 bp, Homo sapiens
cacaagcctgagaactgaa

SEQ ID NO: 3322747 - DNA, 15 bp, Homo sapiens
cacaagctgtccctg

SEQ ID NO: 3322748 - DNA, 16 bp, Homo sapiens
cacaagctgtccctgc

SEQ ID NO: 3322749 - DNA, 15 bp, Homo sapiens
cacaaggaataaatg

SEQ ID NO: 3322750 - DNA, 18 bp, Homo sapiens
cacaaggaataaatgaga

SEQ ID NO: 3322751 - DNA, 18 bp, Homo sapiens
cacaaggattgaaaattc

SEQ ID NO: 3322752 - DNA, 16 bp, Homo sapiens
cacaaggctggccagc

SEQ ID NO: 3322753 - DNA, 17 bp, Homo sapiens
cacaagggaaggacaga

SEQ ID NO: 3322754 - DNA, 16 bp, Homo sapiens
cacaaggtataataag

SEQ ID NO: 3322755 - DNA, 20 bp, Homo sapiens
cacaagtcctgtgaatttct

SEQ ID NO: 3322756 - DNA, 22 bp, Homo sapiens
cacaagtgccactgcccgagct

SEQ ID NO: 3322757 - DNA, 18 bp, Homo sapiens
cacaagttccctggagaa

SEQ ID NO: 3322758 - DNA, 19 bp, Homo sapiens
cacaataacactaaaattt

SEQ ID NO: 3322759 - DNA, 19 bp, Homo sapiens
cacaatacagataacatta

SEQ ID NO: 3322760 - DNA, 18 bp, Homo sapiens
cacaataggtctttctct

SEQ ID NO: 3322761 - DNA, 19 bp, Homo sapiens
cacaataggtctttctctc

SEQ ID NO: 3322762 - DNA, 21 bp, Homo sapiens
cacaatcactaaactttattt

SEQ ID NO: 3322763 - DNA, 17 bp, Homo sapiens
cacaatcccacctagcc

SEQ ID NO: 3322764 - DNA, 21 bp, Homo sapiens
cacaatcccacctagcccagg

SEQ ID NO: 3322765 - DNA, 22 bp, Homo sapiens
cacaatcccacctagcccagga

SEQ ID NO: 3322766 - DNA, 22 bp, Homo sapiens
cacaatcctaacacattatcgg

SEQ ID NO: 3322767 - DNA, 13 bp, Homo sapiens
cacaatgaatgta

SEQ ID NO: 3322768 - DNA, 16 bp, Homo sapiens
cacaatgtcagtattt

SEQ ID NO: 3322769 - DNA, 19 bp, Homo sapiens
cacaattaaaccgcatgtg

SEQ ID NO: 3322770 - DNA, 19 bp, Homo sapiens
cacaattcattggctcctg

SEQ ID NO: 3322771 - DNA, 13 bp, Homo sapiens
cacaatttgcact

SEQ ID NO: 3322772 - DNA, 13 bp, Homo sapiens
cacacaaaggtat

SEQ ID NO: 3322773 - DNA, 18 bp, Homo sapiens
cacacaaaggtataattt

SEQ ID NO: 3322774 - DNA, 19 bp, Homo sapiens
cacacaagggaaggacaga

SEQ ID NO: 3322775 - DNA, 15 bp, Homo sapiens
cacacacacaaacct

SEQ ID NO: 3322776 - DNA, 11 bp, Homo sapiens
cacacacacac

SEQ ID NO: 3322777 - DNA, 16 bp, Homo sapiens
cacacacacacacacg

SEQ ID NO: 3322778 - DNA, 15 bp, Homo sapiens
cacacacacacgatg

SEQ ID NO: 3322779 - DNA, 13 bp, Homo sapiens
cacacacacgcac

SEQ ID NO: 3322780 - DNA, 12 bp, Homo sapiens
cacacacagagg

SEQ ID NO: 3322781 - DNA, 14 bp, Homo sapiens
cacacacagaggaa

SEQ ID NO: 3322782 - DNA, 23 bp, Homo sapiens
cacacacagaggaagagcaggca

SEQ ID NO: 3322783 - DNA, 14 bp, Homo sapiens
cacacacagctcct

SEQ ID NO: 3322784 - DNA, 14 bp, Homo sapiens
cacacacatgcaca

SEQ ID NO: 3322785 - DNA, 14 bp, Homo sapiens
cacacaccagagcc

SEQ ID NO: 3322786 - DNA, 16 bp, Homo sapiens
cacacaccagagccca

SEQ ID NO: 3322787 - DNA, 14 bp, Homo sapiens
cacacacccctccg

SEQ ID NO: 3322788 - DNA, 15 bp, Homo sapiens
cacacaccctgaggt

SEQ ID NO: 3322789 - DNA, 14 bp, Homo sapiens
cacacacctccgag

SEQ ID NO: 3322790 - DNA, 23 bp, Homo sapiens
cacacacctccgagacagtccag

SEQ ID NO: 3322791 - DNA, 13 bp, Homo sapiens
cacacacctgtag

SEQ ID NO: 3322792 - DNA, 14 bp, Homo sapiens
cacacacgcacgca

SEQ ID NO: 3322793 - DNA, 18 bp, Homo sapiens
cacacacgcacgcacaca

SEQ ID NO: 3322794 - DNA, 23 bp, Homo sapiens
cacacacgcacgcacacacacaa

SEQ ID NO: 3322795 - DNA, 20 bp, Homo sapiens
cacacacgcgcgcgcacaca

SEQ ID NO: 3322796 - DNA, 22 bp, Homo sapiens
cacacagaggaagagcaggcac

SEQ ID NO: 3322797 - DNA, 14 bp, Homo sapiens
cacacagagtggtc

SEQ ID NO: 3322798 - DNA, 16 bp, Homo sapiens
cacacagatacacaca

SEQ ID NO: 3322799 - DNA, 14 bp, Homo sapiens
cacacagcagcccc

SEQ ID NO: 3322800 - DNA, 13 bp, Homo sapiens
cacacagctcctc

SEQ ID NO: 3322801 - DNA, 13 bp, Homo sapiens
cacacagctctgt

SEQ ID NO: 3322802 - DNA, 15 bp, Homo sapiens
cacacagctctgtcc

SEQ ID NO: 3322803 - DNA, 17 bp, Homo sapiens
cacacagctctgtcctg

SEQ ID NO: 3322804 - DNA, 13 bp, Homo sapiens
cacacagctgggc

SEQ ID NO: 3322805 - DNA, 15 bp, Homo sapiens
cacacagctgggcaa

SEQ ID NO: 3322806 - DNA, 20 bp, Homo sapiens
cacacaggggtggagtttct

SEQ ID NO: 3322807 - DNA, 22 bp, Homo sapiens
cacacagtccccagactcagct

SEQ ID NO: 3322808 - DNA, 23 bp, Homo sapiens
cacacagtgagtcgaggacaggg

SEQ ID NO: 3322809 - DNA, 13 bp, Homo sapiens
cacacatatatat

SEQ ID NO: 3322810 - DNA, 13 bp, Homo sapiens
cacacatcaggag

SEQ ID NO: 3322811 - DNA, 16 bp, Homo sapiens
cacacatccaccccag

SEQ ID NO: 3322812 - DNA, 16 bp, Homo sapiens
cacacatttaattcag

SEQ ID NO: 3322813 - DNA, 18 bp, Homo sapiens
cacaccaagcagcaacag

SEQ ID NO: 3322814 - DNA, 12 bp, Homo sapiens
cacaccaccctc

SEQ ID NO: 3322815 - DNA, 18 bp, Homo sapiens
cacaccactgccctgcct

SEQ ID NO: 3322816 - DNA, 19 bp, Homo sapiens
cacaccactgccctgcctg

SEQ ID NO: 3322817 - DNA, 18 bp, Homo sapiens
cacaccactgttgccttt

SEQ ID NO: 3322818 - DNA, 22 bp, Homo sapiens
cacaccagagcccaccttggct

SEQ ID NO: 3322819 - DNA, 14 bp, Homo sapiens
cacaccagccgctg

SEQ ID NO: 3322820 - DNA, 16 bp, Homo sapiens
cacaccagccgctgca

SEQ ID NO: 3322821 - DNA, 18 bp, Homo sapiens
cacaccagccgctgcagg

SEQ ID NO: 3322822 - DNA, 22 bp, Homo sapiens
cacaccaggctgtgggcctcaa

SEQ ID NO: 3322823 - DNA, 14 bp, Homo sapiens
cacacccaccgtcc

SEQ ID NO: 3322824 - DNA, 13 bp, Homo sapiens
cacacccagccca

SEQ ID NO: 3322825 - DNA, 16 bp, Homo sapiens
cacacccagcctcagt

SEQ ID NO: 3322826 - DNA, 13 bp, Homo sapiens
cacaccccacacc

SEQ ID NO: 3322827 - DNA, 21 bp, Homo sapiens
cacaccctcccccgccactcc

SEQ ID NO: 3322828 - DNA, 13 bp, Homo sapiens
cacaccctgaggt

SEQ ID NO: 3322829 - DNA, 12 bp, Homo sapiens
cacaccctgcaa

SEQ ID NO: 3322830 - DNA, 15 bp, Homo sapiens
cacaccctgcccctg

SEQ ID NO: 3322831 - DNA, 16 bp, Homo sapiens
cacaccctgcccctgc

SEQ ID NO: 3322832 - DNA, 17 bp, Homo sapiens
cacaccgggcactcaga

SEQ ID NO: 3322833 - DNA, 13 bp, Homo sapiens
cacacctcagttc

SEQ ID NO: 3322834 - DNA, 18 bp, Homo sapiens
cacacctcagttcccttg

SEQ ID NO: 3322835 - DNA, 12 bp, Homo sapiens
cacacctccaca

SEQ ID NO: 3322836 - DNA, 13 bp, Homo sapiens
cacacctccacag

SEQ ID NO: 3322837 - DNA, 16 bp, Homo sapiens
cacacctccctgaacc

SEQ ID NO: 3322838 - DNA, 17 bp, Homo sapiens
cacacctccctgaacca

SEQ ID NO: 3322839 - DNA, 17 bp, Homo sapiens
cacacctgaacttgcct

SEQ ID NO: 3322840 - DNA, 16 bp, Homo sapiens
cacacctgactctgaa

SEQ ID NO: 3322841 - DNA, 15 bp, Homo sapiens
cacacctggccttaa

SEQ ID NO: 3322842 - DNA, 21 bp, Homo sapiens
cacaccttccagggccctagg

SEQ ID NO: 3322843 - DNA, 10 bp, Homo sapiens
cacacgatgc

SEQ ID NO: 3322844 - DNA, 13 bp, Homo sapiens
cacacgatgcatt

SEQ ID NO: 3322845 - DNA, 22 bp, Homo sapiens
cacacgatgcatttaataaaga

SEQ ID NO: 3322846 - DNA, 17 bp, Homo sapiens
cacacgattagctttat

SEQ ID NO: 3322847 - DNA, 21 bp, Homo sapiens
cacacgcacgcacacacacaa

SEQ ID NO: 3322848 - DNA, 21 bp, Homo sapiens
cacacggaggcatctgcaccc

SEQ ID NO: 3322849 - DNA, 22 bp, Homo sapiens
cacacgtatttatatttggaaa

SEQ ID NO: 3322850 - DNA, 17 bp, Homo sapiens
cacactaaaatttaatt

SEQ ID NO: 3322851 - DNA, 18 bp, Homo sapiens
cacactacacagcacacc

SEQ ID NO: 3322852 - DNA, 13 bp, Homo sapiens
cacactagaaaga

SEQ ID NO: 3322853 - DNA, 17 bp, Homo sapiens
cacactagcctctccag

SEQ ID NO: 3322854 - DNA, 21 bp, Homo sapiens
cacactatgcacagagcccaa

SEQ ID NO: 3322855 - DNA, 20 bp, Homo sapiens
cacactattaccatgagaag

SEQ ID NO: 3322856 - DNA, 20 bp, Homo sapiens
cacactcaaaagacaaacat

SEQ ID NO: 3322857 - DNA, 22 bp, Homo sapiens
cacactctccatcaccctcttc

SEQ ID NO: 3322858 - DNA, 22 bp, Homo sapiens
cacactgccaaataaacagcta

SEQ ID NO: 3322859 - DNA, 13 bp, Homo sapiens
cacactgctctta

SEQ ID NO: 3322860 - DNA, 20 bp, Homo sapiens
cacactgtcatgcttcatca

SEQ ID NO: 3322861 - DNA, 20 bp, Homo sapiens
cacacttcaggctcttctcc

SEQ ID NO: 3322862 - DNA, 22 bp, Homo sapiens
cacacttcaggctcttctcctt

SEQ ID NO: 3322863 - DNA, 16 bp, Homo sapiens
cacacttgaaaccttt

SEQ ID NO: 3322864 - DNA, 22 bp, Homo sapiens
cacacttgtaggataagtgaaa

SEQ ID NO: 3322865 - DNA, 13 bp, Homo sapiens
cacacttgtgtgt

SEQ ID NO: 3322866 - DNA, 16 bp, Homo sapiens
cacactttttatttaa

SEQ ID NO: 3322867 - DNA, 16 bp, Homo sapiens
attctctatttattgg

SEQ ID NO: 3322868 - DNA, 21 bp, Homo sapiens
attctctctcactcacatttt

SEQ ID NO: 3322869 - DNA, 12 bp, Homo sapiens
attctctgagtg

SEQ ID NO: 3322870 - DNA, 20 bp, Homo sapiens
attctctgagtggtggttcc

SEQ ID NO: 3322871 - DNA, 22 bp, Homo sapiens
attctctggctgtaaggctcta

SEQ ID NO: 3322872 - DNA, 12 bp, Homo sapiens
attctcttatcc

SEQ ID NO: 3322873 - DNA, 14 bp, Homo sapiens
attctcttatccaa

SEQ ID NO: 3322874 - DNA, 21 bp, Homo sapiens
attctcttctttttctttttt

SEQ ID NO: 3322875 - DNA, 16 bp, Homo sapiens
attctcttgaataaag

SEQ ID NO: 3322876 - DNA, 15 bp, Homo sapiens
attctcttgtataag

SEQ ID NO: 3322877 - DNA, 18 bp, Homo sapiens
attctcttgtataagatc

SEQ ID NO: 3322878 - DNA, 20 bp, Homo sapiens
attctctttaaaaaagactg

SEQ ID NO: 3322879 - DNA, 12 bp, Homo sapiens
attctcttttaa

SEQ ID NO: 3322880 - DNA, 19 bp, Homo sapiens
attctgaaaccacagtttc

SEQ ID NO: 3322881 - DNA, 22 bp, Homo sapiens
attctgaaaccacagtttcatt

SEQ ID NO: 3322882 - DNA, 18 bp, Homo sapiens
attctgaaaggaaataca

SEQ ID NO: 3322883 - DNA, 10 bp, Homo sapiens
attctgaatg

SEQ ID NO: 3322884 - DNA, 15 bp, Homo sapiens
attctgacatttata

SEQ ID NO: 3322885 - DNA, 15 bp, Homo sapiens
attctgaggccctgc

SEQ ID NO: 3322886 - DNA, 23 bp, Homo sapiens
attctgattattgagttccagtt

SEQ ID NO: 3322887 - DNA, 21 bp, Homo sapiens
attctgattctggctttaagc

SEQ ID NO: 3322888 - DNA, 13 bp, Homo sapiens
attctgatttcag

SEQ ID NO: 3322889 - DNA, 19 bp, Homo sapiens
attctgatttggaaaaaga

SEQ ID NO: 3322890 - DNA, 16 bp, Homo sapiens
attctgcaactagcca

SEQ ID NO: 3322891 - DNA, 22 bp, Homo sapiens
attctgcaagcacatctgcatt

SEQ ID NO: 3322892 - DNA, 22 bp, Homo sapiens
attctgcagaactcctccaaag

SEQ ID NO: 3322893 - DNA, 16 bp, Homo sapiens
attctgcccaaaaata

SEQ ID NO: 3322894 - DNA, 18 bp, Homo sapiens
attctgcccaaaaatatg

SEQ ID NO: 3322895 - DNA, 19 bp, Homo sapiens
attctgcccaaaaatatgg

SEQ ID NO: 3322896 - DNA, 17 bp, Homo sapiens
attctgccctccttaat

SEQ ID NO: 3322897 - DNA, 19 bp, Homo sapiens
attctgccctccttaattt

SEQ ID NO: 3322898 - DNA, 20 bp, Homo sapiens
attctgccgccccctcctga

SEQ ID NO: 3322899 - DNA, 21 bp, Homo sapiens
attctgccgccccctcctgaa

SEQ ID NO: 3322900 - DNA, 14 bp, Homo sapiens
attctgcctgccca

SEQ ID NO: 3322901 - DNA, 20 bp, Homo sapiens
attctgcctgcccaggcccc

SEQ ID NO: 3322902 - DNA, 24 bp, Homo sapiens
attctgctacttcactgtcatctt

SEQ ID NO: 3322903 - DNA, 21 bp, Homo sapiens
attctgctcacatatctgtca

SEQ ID NO: 3322904 - DNA, 22 bp, Homo sapiens
attctgctcacatatctgtcat

SEQ ID NO: 3322905 - DNA, 19 bp, Homo sapiens
attctgggaatcatgtcca

SEQ ID NO: 3322906 - DNA, 19 bp, Homo sapiens
attctgggaggcaagaaaa

SEQ ID NO: 3322907 - DNA, 24 bp, Homo sapiens
attctgggcaccacaaaatataca

SEQ ID NO: 3322908 - DNA, 18 bp, Homo sapiens
attctgtacatagcctat

SEQ ID NO: 3322909 - DNA, 21 bp, Homo sapiens
attctgtcgccttagcatgtt

SEQ ID NO: 3322910 - DNA, 14 bp, Homo sapiens
attctgtctttcaa

SEQ ID NO: 3322911 - DNA, 20 bp, Homo sapiens
attctgtgccttgttttttg

SEQ ID NO: 3322912 - DNA, 12 bp, Homo sapiens
attctgttaaaa

SEQ ID NO: 3322913 - DNA, 15 bp, Homo sapiens
attctgttaaaatct

SEQ ID NO: 3322914 - DNA, 20 bp, Homo sapiens
attctgttaaaatctattct

SEQ ID NO: 3322915 - DNA, 14 bp, Homo sapiens
attctgttggccag

SEQ ID NO: 3322916 - DNA, 17 bp, Homo sapiens
attctgttgttccattt

SEQ ID NO: 3322917 - DNA, 20 bp, Homo sapiens
attctgttgttccattttat

SEQ ID NO: 3322918 - DNA, 15 bp, Homo sapiens
attcttacactgcct

SEQ ID NO: 3322919 - DNA, 23 bp, Homo sapiens
attcttacactgcctgtatactt

SEQ ID NO: 3322920 - DNA, 18 bp, Homo sapiens
attcttagcctgtggcag

SEQ ID NO: 3322921 - DNA, 15 bp, Homo sapiens
attcttatacacatt

SEQ ID NO: 3322922 - DNA, 14 bp, Homo sapiens
attcttatgcttat

SEQ ID NO: 3322923 - DNA, 14 bp, Homo sapiens
attcttattggaaa

SEQ ID NO: 3322924 - DNA, 19 bp, Homo sapiens
attcttattggaaatgtac

SEQ ID NO: 3322925 - DNA, 14 bp, Homo sapiens
attcttcaaccagt

SEQ ID NO: 3322926 - DNA, 13 bp, Homo sapiens
attcttctagagt

SEQ ID NO: 3322927 - DNA, 16 bp, Homo sapiens
attcttctctgttgtc

SEQ ID NO: 3322928 - DNA, 14 bp, Homo sapiens
attcttctgtattt

SEQ ID NO: 3322929 - DNA, 15 bp, Homo sapiens
attcttctgtatttc

SEQ ID NO: 3322930 - DNA, 17 bp, Homo sapiens
attcttctgtatttcta

SEQ ID NO: 3322931 - DNA, 13 bp, Homo sapiens
attcttctgtcct

SEQ ID NO: 3322932 - DNA, 16 bp, Homo sapiens
attcttgaaagctgtg

SEQ ID NO: 3322933 - DNA, 18 bp, Homo sapiens
attcttggcttaatcatt

SEQ ID NO: 3322934 - DNA, 14 bp, Homo sapiens
attcttgtcaaaaa

SEQ ID NO: 3322935 - DNA, 18 bp, Homo sapiens
attcttgttttctttctt

SEQ ID NO: 3322936 - DNA, 23 bp, Homo sapiens
attcttgttttctttctttaaat

SEQ ID NO: 3322937 - DNA, 17 bp, Homo sapiens
attctttatcttgacat

SEQ ID NO: 3322938 - DNA, 17 bp, Homo sapiens
attctttccattatgat

SEQ ID NO: 3322939 - DNA, 22 bp, Homo sapiens
attctttccattatgattcttt

SEQ ID NO: 3322940 - DNA, 15 bp, Homo sapiens
attctttcccagtga

SEQ ID NO: 3322941 - DNA, 22 bp, Homo sapiens
attctttgaaaacagatgacca

SEQ ID NO: 3322942 - DNA, 21 bp, Homo sapiens
attctttggagttaaaatgca

SEQ ID NO: 3322943 - DNA, 22 bp, Homo sapiens
attctttggagttgtcacatca

SEQ ID NO: 3322944 - DNA, 18 bp, Homo sapiens
attcttttaaattagaaa

SEQ ID NO: 3322945 - DNA, 14 bp, Homo sapiens
attctttttaaagt

SEQ ID NO: 3322946 - DNA, 22 bp, Homo sapiens
attctttttcttttttaaatta

SEQ ID NO: 3322947 - DNA, 17 bp, Homo sapiens
attcttttttaaatttt

SEQ ID NO: 3322948 - DNA, 19 bp, Homo sapiens
attcttttttaaattttct

SEQ ID NO: 3322949 - DNA, 15 bp, Homo sapiens
attgaaaaattatca

SEQ ID NO: 3322950 - DNA, 15 bp, Homo sapiens
attgaaaacttcaaa

SEQ ID NO: 3322951 - DNA, 20 bp, Homo sapiens
attgaaaagtttttgtttgg

SEQ ID NO: 3322952 - DNA, 21 bp, Homo sapiens
attgaaaatagtaaatgcttt

SEQ ID NO: 3322953 - DNA, 12 bp, Homo sapiens
attgaaatgtca

SEQ ID NO: 3322954 - DNA, 19 bp, Homo sapiens
attgaaattatagtttcaa

SEQ ID NO: 3322955 - DNA, 16 bp, Homo sapiens
attgaaattgtacata

SEQ ID NO: 3322956 - DNA, 21 bp, Homo sapiens
attgaaattgtacatatttgt

SEQ ID NO: 3322957 - DNA, 16 bp, Homo sapiens
attgaacacaaactgt

SEQ ID NO: 3322958 - DNA, 18 bp, Homo sapiens
attgaacacaaactgtaa

SEQ ID NO: 3322959 - DNA, 23 bp, Homo sapiens
attgaaccagctcatctccaagg

SEQ ID NO: 3322960 - DNA, 14 bp, Homo sapiens
attgaagaaacaga

SEQ ID NO: 3322961 - DNA, 15 bp, Homo sapiens
attgaagaaacagat

SEQ ID NO: 3322962 - DNA, 21 bp, Homo sapiens
attgaagagatttcaacatat

SEQ ID NO: 3322963 - DNA, 20 bp, Homo sapiens
attgaagaggatattcttct

SEQ ID NO: 3322964 - DNA, 17 bp, Homo sapiens
attgaaggaagccaaat

SEQ ID NO: 3322965 - DNA, 16 bp, Homo sapiens
attgaagtaaactttt

SEQ ID NO: 3322966 - DNA, 13 bp, Homo sapiens
attgaagtatatt

SEQ ID NO: 3322967 - DNA, 16 bp, Homo sapiens
attgaagtatattctt

SEQ ID NO: 3322968 - DNA, 16 bp, Homo sapiens
attgaagtttcaagtt

SEQ ID NO: 3322969 - DNA, 20 bp, Homo sapiens
attgaagtttcaagttttaa

SEQ ID NO: 3322970 - DNA, 23 bp, Homo sapiens
attgaatattgtgttccttttta

SEQ ID NO: 3322971 - DNA, 14 bp, Homo sapiens
attgaatctgattg

SEQ ID NO: 3322972 - DNA, 15 bp, Homo sapiens
attgaatgcgcttta

SEQ ID NO: 3322973 - DNA, 16 bp, Homo sapiens
attgaatgtttccaac

SEQ ID NO: 3322974 - DNA, 17 bp, Homo sapiens
attgacaaatctgtgta

SEQ ID NO: 3322975 - DNA, 21 bp, Homo sapiens
attgacaaatctgtgtatatt

SEQ ID NO: 3322976 - DNA, 22 bp, Homo sapiens
attgacaaatctgtgtatatta

SEQ ID NO: 3322977 - DNA, 15 bp, Homo sapiens
attgacaagtcattt

SEQ ID NO: 3322978 - DNA, 17 bp, Homo sapiens
attgacacagaaaatgt

SEQ ID NO: 3322979 - DNA, 13 bp, Homo sapiens
attgacagaagct

SEQ ID NO: 3322980 - DNA, 21 bp, Homo sapiens
attgaccctagccagagaata

SEQ ID NO: 3322981 - DNA, 23 bp, Homo sapiens
attgaccgcgactaatttcaaaa

SEQ ID NO: 3322982 - DNA, 15 bp, Homo sapiens
attattatatacata

SEQ ID NO: 3322983 - DNA, 14 bp, Homo sapiens
attattatcattga

SEQ ID NO: 3322984 - DNA, 21 bp, Homo sapiens
attccagatctttcagaaata

SEQ ID NO: 3322985 - DNA, 15 bp, Homo sapiens
cacaggggcggggca

SEQ ID NO: 3322986 - DNA, 21 bp, Homo sapiens
cacagggtccccgagtgccta

SEQ ID NO: 3322987 - DNA, 15 bp, Homo sapiens
cacagggtctgctct

SEQ ID NO: 3322988 - DNA, 14 bp, Homo sapiens
cacagggttgggcc

SEQ ID NO: 3322989 - DNA, 23 bp, Homo sapiens
cacagggttgggcccagatctgg

SEQ ID NO: 3322990 - DNA, 15 bp, Homo sapiens
cacagggttttgtat

SEQ ID NO: 3322991 - DNA, 16 bp, Homo sapiens
cacagggttttgtatt

SEQ ID NO: 3322992 - DNA, 12 bp, Homo sapiens
cacaggtcccac

SEQ ID NO: 3322993 - DNA, 15 bp, Homo sapiens
cacaggtcccacctc

SEQ ID NO: 3322994 - DNA, 19 bp, Homo sapiens
cacaggtcccacctccagc

SEQ ID NO: 3322995 - DNA, 13 bp, Homo sapiens
cacaggtctagac

SEQ ID NO: 3322996 - DNA, 15 bp, Homo sapiens
cacaggttttagcat

SEQ ID NO: 3322997 - DNA, 20 bp, Homo sapiens
cacaggttttttcaatttat

SEQ ID NO: 3322998 - DNA, 17 bp, Homo sapiens
cacagtaaaaataaaat

SEQ ID NO: 3322999 - DNA, 19 bp, Homo sapiens
cacagtacagcatgtgcct

SEQ ID NO: 3323000 - DNA, 19 bp, Homo sapiens
cacagtacgaacctacagt

SEQ ID NO: 3323001 - DNA, 18 bp, Homo sapiens
cacagtactttattgtac

SEQ ID NO: 3323002 - DNA, 21 bp, Homo sapiens
cacagtactttattgtacaga

SEQ ID NO: 3323003 - DNA, 17 bp, Homo sapiens
cacagtaggaattggaa

SEQ ID NO: 3323004 - DNA, 16 bp, Homo sapiens
cacagtagtcttgatg

SEQ ID NO: 3323005 - DNA, 22 bp, Homo sapiens
cacagtcaccttctcggcaact

SEQ ID NO: 3323006 - DNA, 16 bp, Homo sapiens
cacagtcactgatgta

SEQ ID NO: 3323007 - DNA, 22 bp, Homo sapiens
cacagtcagcatgcttcccaga

SEQ ID NO: 3323008 - DNA, 23 bp, Homo sapiens
cacagtcagcatgcttcccagag

SEQ ID NO: 3323009 - DNA, 14 bp, Homo sapiens
cacagtctctctct

SEQ ID NO: 3323010 - DNA, 22 bp, Homo sapiens
cacagtctctttaatcttcagt

SEQ ID NO: 3323011 - DNA, 21 bp, Homo sapiens
cacagtgaaacgcaattttac

SEQ ID NO: 3323012 - DNA, 11 bp, Homo sapiens
cacagtgaccc

SEQ ID NO: 3323013 - DNA, 16 bp, Homo sapiens
cacagtgacccttccc

SEQ ID NO: 3323014 - DNA, 20 bp, Homo sapiens
cacagtgagtcgaggacagg

SEQ ID NO: 3323015 - DNA, 22 bp, Homo sapiens
cacagtgagtcgaggacaggga

SEQ ID NO: 3323016 - DNA, 16 bp, Homo sapiens
cacagtgctcttttct

SEQ ID NO: 3323017 - DNA, 13 bp, Homo sapiens
cacagtgctgctt

SEQ ID NO: 3323018 - DNA, 23 bp, Homo sapiens
cacagtggactcagcagtgacca

SEQ ID NO: 3323019 - DNA, 20 bp, Homo sapiens
cacagtggcacaaaaaaata

SEQ ID NO: 3323020 - DNA, 19 bp, Homo sapiens
cacagtgggaactctgaca

SEQ ID NO: 3323021 - DNA, 17 bp, Homo sapiens
cacagtgggagctgagc

SEQ ID NO: 3323022 - DNA, 19 bp, Homo sapiens
cacagtgggagctgagctg

SEQ ID NO: 3323023 - DNA, 20 bp, Homo sapiens
cacagtgggtggcacctcct

SEQ ID NO: 3323024 - DNA, 23 bp, Homo sapiens
cacagtgggtggcacctcctgag

SEQ ID NO: 3323025 - DNA, 17 bp, Homo sapiens
cacagttcaattctcat

SEQ ID NO: 3323026 - DNA, 14 bp, Homo sapiens
cacagttcctggga

SEQ ID NO: 3323027 - DNA, 23 bp, Homo sapiens
cacagttgccaccacctctgtgg

SEQ ID NO: 3323028 - DNA, 15 bp, Homo sapiens
cacagttggccttca

SEQ ID NO: 3323029 - DNA, 22 bp, Homo sapiens
cacagttggctggatgaaattt

SEQ ID NO: 3323030 - DNA, 22 bp, Homo sapiens
cacagttgggacccaaaacaca

SEQ ID NO: 3323031 - DNA, 20 bp, Homo sapiens
cacagttgtctattctgagc

SEQ ID NO: 3323032 - DNA, 20 bp, Homo sapiens
cacagtttagtgctttacat

SEQ ID NO: 3323033 - DNA, 21 bp, Homo sapiens
cacagttttagttggtgctga

SEQ ID NO: 3323034 - DNA, 15 bp, Homo sapiens
cacagttttgaaaga

SEQ ID NO: 3323035 - DNA, 21 bp, Homo sapiens
cacagttttgaaagaaaaata

SEQ ID NO: 3323036 - DNA, 13 bp, Homo sapiens
cacataagaaaat

SEQ ID NO: 3323037 - DNA, 22 bp, Homo sapiens
cacataaggacgtgtgtaaata

SEQ ID NO: 3323038 - DNA, 20 bp, Homo sapiens
cacatacacccaaacactta

SEQ ID NO: 3323039 - DNA, 14 bp, Homo sapiens
cacatacaggtgct

SEQ ID NO: 3323040 - DNA, 16 bp, Homo sapiens
cacatacaggtgctca

SEQ ID NO: 3323041 - DNA, 17 bp, Homo sapiens
cacatacaggtgctcaa

SEQ ID NO: 3323042 - DNA, 11 bp, Homo sapiens
cacatacatta

SEQ ID NO: 3323043 - DNA, 12 bp, Homo sapiens
cacatacattaa

SEQ ID NO: 3323044 - DNA, 14 bp, Homo sapiens
cacatacattaaaa

SEQ ID NO: 3323045 - DNA, 18 bp, Homo sapiens
cacatacattaaaactag

SEQ ID NO: 3323046 - DNA, 14 bp, Homo sapiens
cacatacctctctg

SEQ ID NO: 3323047 - DNA, 18 bp, Homo sapiens
cacatacgtgcacagggt

SEQ ID NO: 3323048 - DNA, 22 bp, Homo sapiens
cacatactgcggaccaagggac

SEQ ID NO: 3323049 - DNA, 18 bp, Homo sapiens
cacatagcatgtaatggt

SEQ ID NO: 3323050 - DNA, 21 bp, Homo sapiens
cacatataaacatcacacaca

SEQ ID NO: 3323051 - DNA, 14 bp, Homo sapiens
cacatatcagcagg

SEQ ID NO: 3323052 - DNA, 18 bp, Homo sapiens
cacatatccaggcaccag

SEQ ID NO: 3323053 - DNA, 19 bp, Homo sapiens
cacatatccaggcaccagg

SEQ ID NO: 3323054 - DNA, 12 bp, Homo sapiens
cacatatctgtc

SEQ ID NO: 3323055 - DNA, 19 bp, Homo sapiens
cacatatgcaccttgtgtc

SEQ ID NO: 3323056 - DNA, 18 bp, Homo sapiens
cacatcacacaagatttg

SEQ ID NO: 3323057 - DNA, 10 bp, Homo sapiens
cacatcagat

SEQ ID NO: 3323058 - DNA, 16 bp, Homo sapiens
cacatcccagcagccc

SEQ ID NO: 3323059 - DNA, 21 bp, Homo sapiens
cacatccccagaatccataaa

SEQ ID NO: 3323060 - DNA, 14 bp, Homo sapiens
cacatcccggcctc

SEQ ID NO: 3323061 - DNA, 15 bp, Homo sapiens
cacatcccggcctct

SEQ ID NO: 3323062 - DNA, 17 bp, Homo sapiens
cacatcccggcctcttc

SEQ ID NO: 3323063 - DNA, 19 bp, Homo sapiens
cacatcccggcctcttcca

SEQ ID NO: 3323064 - DNA, 17 bp, Homo sapiens
cacatccgccttttgta

SEQ ID NO: 3323065 - DNA, 14 bp, Homo sapiens
cacatcctccgtcc

SEQ ID NO: 3323066 - DNA, 22 bp, Homo sapiens
cacatctcctccatactcagga

SEQ ID NO: 3323067 - DNA, 13 bp, Homo sapiens
cacatctctgaaa

SEQ ID NO: 3323068 - DNA, 14 bp, Homo sapiens
cacatcttgctctg

SEQ ID NO: 3323069 - DNA, 17 bp, Homo sapiens
cacatcttgctctgctg

SEQ ID NO: 3323070 - DNA, 23 bp, Homo sapiens
cacatcttgctctgctgacagac

SEQ ID NO: 3323071 - DNA, 20 bp, Homo sapiens
cacatctttaacttagtatt

SEQ ID NO: 3323072 - DNA, 21 bp, Homo sapiens
cacatctttcctcaagtatct

SEQ ID NO: 3323073 - DNA, 21 bp, Homo sapiens
cacatgacgccagataaaatg

SEQ ID NO: 3323074 - DNA, 16 bp, Homo sapiens
cacatgaggccatctc

SEQ ID NO: 3323075 - DNA, 13 bp, Homo sapiens
cacatgcacacac

SEQ ID NO: 3323076 - DNA, 16 bp, Homo sapiens
cacatgccctcctgga

SEQ ID NO: 3323077 - DNA, 9 bp, Homo sapiens
cacatgcta

SEQ ID NO: 3323078 - DNA, 16 bp, Homo sapiens
cacatgctaaagccag

SEQ ID NO: 3323079 - DNA, 21 bp, Homo sapiens
cacatgctgagtctcccaagg

SEQ ID NO: 3323080 - DNA, 16 bp, Homo sapiens
cacatgctggccagcc

SEQ ID NO: 3323081 - DNA, 19 bp, Homo sapiens
cacatgctggccagcctgg

SEQ ID NO: 3323082 - DNA, 22 bp, Homo sapiens
cacatggagccccctctgccgg

SEQ ID NO: 3323083 - DNA, 16 bp, Homo sapiens
cacatggggcctggcc

SEQ ID NO: 3323084 - DNA, 20 bp, Homo sapiens
cacatggggcctggcccacg

SEQ ID NO: 3323085 - DNA, 20 bp, Homo sapiens
cacatgtacataaactgtca

SEQ ID NO: 3323086 - DNA, 15 bp, Homo sapiens
cacatgtcttgtaca

SEQ ID NO: 3323087 - DNA, 17 bp, Homo sapiens
cacatgtgcacatgcac

SEQ ID NO: 3323088 - DNA, 13 bp, Homo sapiens
cacatgtgccaca

SEQ ID NO: 3323089 - DNA, 14 bp, Homo sapiens
cacctgcctcctcg

SEQ ID NO: 3323090 - DNA, 23 bp, Homo sapiens
cacctgctgagaaaacatgcctc

SEQ ID NO: 3323091 - DNA, 14 bp, Homo sapiens
cacctgctgcgtcc

SEQ ID NO: 3323092 - DNA, 20 bp, Homo sapiens
cacctgctgcgtccccactc

SEQ ID NO: 3323093 - DNA, 21 bp, Homo sapiens
cacctgctgcgtccccactcc

SEQ ID NO: 3323094 - DNA, 16 bp, Homo sapiens
cacctggactgagcca

SEQ ID NO: 3323095 - DNA, 11 bp, Homo sapiens
cacctggccac

SEQ ID NO: 3323096 - DNA, 19 bp, Homo sapiens
cacctggccacctgaggtg

SEQ ID NO: 3323097 - DNA, 13 bp, Homo sapiens
cacctggccttaa

SEQ ID NO: 3323098 - DNA, 20 bp, Homo sapiens
cacctggccttaaagaggga

SEQ ID NO: 3323099 - DNA, 23 bp, Homo sapiens
cacctggccttaaagagggacag

SEQ ID NO: 3323100 - DNA, 20 bp, Homo sapiens
cacctggctgaggttcctct

SEQ ID NO: 3323101 - DNA, 16 bp, Homo sapiens
cacctgggcttaagaa

SEQ ID NO: 3323102 - DNA, 19 bp, Homo sapiens
cacctgggcttaagaaatc

SEQ ID NO: 3323103 - DNA, 18 bp, Homo sapiens
cacctgggggggttgggc

SEQ ID NO: 3323104 - DNA, 20 bp, Homo sapiens
cacctggtactccctctcag

SEQ ID NO: 3323105 - DNA, 14 bp, Homo sapiens
cacctgtaaacctg

SEQ ID NO: 3323106 - DNA, 15 bp, Homo sapiens
cacctgtaaacctga

SEQ ID NO: 3323107 - DNA, 18 bp, Homo sapiens
cacctgtaaagtgcctta

SEQ ID NO: 3323108 - DNA, 15 bp, Homo sapiens
cacctgtactcagga

SEQ ID NO: 3323109 - DNA, 15 bp, Homo sapiens
cacctgtagccatct

SEQ ID NO: 3323110 - DNA, 22 bp, Homo sapiens
cacctgtagccatctgcacaca

SEQ ID NO: 3323111 - DNA, 20 bp, Homo sapiens
cacctgtccccaccctccac

SEQ ID NO: 3323112 - DNA, 12 bp, Homo sapiens
cacctgtgacaa

SEQ ID NO: 3323113 - DNA, 14 bp, Homo sapiens
cacctgtgacaaag

SEQ ID NO: 3323114 - DNA, 19 bp, Homo sapiens
cacctgtgagtttaaagca

SEQ ID NO: 3323115 - DNA, 20 bp, Homo sapiens
cacctgtgagtttaaagcaa

SEQ ID NO: 3323116 - DNA, 17 bp, Homo sapiens
cacctgtgccctcacca

SEQ ID NO: 3323117 - DNA, 16 bp, Homo sapiens
cacctgttatgtatga

SEQ ID NO: 3323118 - DNA, 20 bp, Homo sapiens
caccttaggaggccgaggca

SEQ ID NO: 3323119 - DNA, 21 bp, Homo sapiens
caccttagggtggctttaatt

SEQ ID NO: 3323120 - DNA, 23 bp, Homo sapiens
caccttagggtggctttaattgt

SEQ ID NO: 3323121 - DNA, 16 bp, Homo sapiens
caccttcacctcggag

SEQ ID NO: 3323122 - DNA, 19 bp, Homo sapiens
caccttcactctccagggt

SEQ ID NO: 3323123 - DNA, 16 bp, Homo sapiens
caccttccaaacaaaa

SEQ ID NO: 3323124 - DNA, 14 bp, Homo sapiens
caccttccagctcc

SEQ ID NO: 3323125 - DNA, 14 bp, Homo sapiens
caccttccagggcc

SEQ ID NO: 3323126 - DNA, 18 bp, Homo sapiens
caccttccattttccccc

SEQ ID NO: 3323127 - DNA, 18 bp, Homo sapiens
caccttcccactttccca

SEQ ID NO: 3323128 - DNA, 14 bp, Homo sapiens
caccttcctcctgc

SEQ ID NO: 3323129 - DNA, 17 bp, Homo sapiens
caccttcctcctgcaga

SEQ ID NO: 3323130 - DNA, 18 bp, Homo sapiens
caccttcctcctgcagac

SEQ ID NO: 3323131 - DNA, 16 bp, Homo sapiens
caccttcgagtagaga

SEQ ID NO: 3323132 - DNA, 21 bp, Homo sapiens
caccttctagtcttggccagc

SEQ ID NO: 3323133 - DNA, 12 bp, Homo sapiens
caccttctgagt

SEQ ID NO: 3323134 - DNA, 17 bp, Homo sapiens
caccttctgagtattct

SEQ ID NO: 3323135 - DNA, 19 bp, Homo sapiens
caccttctgtccccagccc

SEQ ID NO: 3323136 - DNA, 21 bp, Homo sapiens
caccttctgtccccagccctg

SEQ ID NO: 3323137 - DNA, 13 bp, Homo sapiens
caccttctttgta

SEQ ID NO: 3323138 - DNA, 18 bp, Homo sapiens
caccttgacagggcacac

SEQ ID NO: 3323139 - DNA, 23 bp, Homo sapiens
caccttgatcccaatccttatcc

SEQ ID NO: 3323140 - DNA, 17 bp, Homo sapiens
caccttggacatcctcc

SEQ ID NO: 3323141 - DNA, 13 bp, Homo sapiens
caccttggctcaa

SEQ ID NO: 3323142 - DNA, 21 bp, Homo sapiens
caccttggctctgccagtgga

SEQ ID NO: 3323143 - DNA, 15 bp, Homo sapiens
caccttggctgcagg

SEQ ID NO: 3323144 - DNA, 16 bp, Homo sapiens
caccttggctgcaggg

SEQ ID NO: 3323145 - DNA, 18 bp, Homo sapiens
caccttggctgcagggag

SEQ ID NO: 3323146 - DNA, 21 bp, Homo sapiens
caccttggggtccctccaccc

SEQ ID NO: 3323147 - DNA, 15 bp, Homo sapiens
caccttgtgtctgta

SEQ ID NO: 3323148 - DNA, 12 bp, Homo sapiens
cacctttactgt

SEQ ID NO: 3323149 - DNA, 14 bp, Homo sapiens
cacctttaggttct

SEQ ID NO: 3323150 - DNA, 16 bp, Homo sapiens
cacctttgtaagacat

SEQ ID NO: 3323151 - DNA, 19 bp, Homo sapiens
cacctttgtaagacatttg

SEQ ID NO: 3323152 - DNA, 23 bp, Homo sapiens
caccttttccccaaccacagaga

SEQ ID NO: 3323153 - DNA, 12 bp, Homo sapiens
cacctttttgca

SEQ ID NO: 3323154 - DNA, 14 bp, Homo sapiens
caccttttttccta

SEQ ID NO: 3323155 - DNA, 21 bp, Homo sapiens
cacgaaacttgttattgtgaa

SEQ ID NO: 3323156 - DNA, 17 bp, Homo sapiens
cacgaaatgttattttt

SEQ ID NO: 3323157 - DNA, 22 bp, Homo sapiens
cacgaatttgctggggaatctc

SEQ ID NO: 3323158 - DNA, 12 bp, Homo sapiens
cacgaccagccc

SEQ ID NO: 3323159 - DNA, 13 bp, Homo sapiens
cacgaccagcccc

SEQ ID NO: 3323160 - DNA, 17 bp, Homo sapiens
cacgactggccagggcc

SEQ ID NO: 3323161 - DNA, 12 bp, Homo sapiens
cacgagccacct

SEQ ID NO: 3323162 - DNA, 22 bp, Homo sapiens
cacgaggaatctgtgggtctgg

SEQ ID NO: 3323163 - DNA, 11 bp, Homo sapiens
cacgagggctg

SEQ ID NO: 3323164 - DNA, 13 bp, Homo sapiens
cacgagggctggc

SEQ ID NO: 3323165 - DNA, 14 bp, Homo sapiens
cacgaggtgcagta

SEQ ID NO: 3323166 - DNA, 14 bp, Homo sapiens
cacgagtcacctgc

SEQ ID NO: 3323167 - DNA, 18 bp, Homo sapiens
cacgagtcacctgcaagc

SEQ ID NO: 3323168 - DNA, 23 bp, Homo sapiens
cacgagtcacctgcaagccccag

SEQ ID NO: 3323169 - DNA, 19 bp, Homo sapiens
cacgatcctgccaccctgt

SEQ ID NO: 3323170 - DNA, 15 bp, Homo sapiens
cacgatgaaaaactt

SEQ ID NO: 3323171 - DNA, 15 bp, Homo sapiens
cacgatgcatttaat

SEQ ID NO: 3323172 - DNA, 21 bp, Homo sapiens
cacgatgccgagacctcaagc

SEQ ID NO: 3323173 - DNA, 21 bp, Homo sapiens
cacgattttctccagctcaga

SEQ ID NO: 3323174 - DNA, 18 bp, Homo sapiens
cacgcaaatacactccag

SEQ ID NO: 3323175 - DNA, 23 bp, Homo sapiens
cacgcaagggcatcaggcactgg

SEQ ID NO: 3323176 - DNA, 13 bp, Homo sapiens
cacgcacacacac

SEQ ID NO: 3323177 - DNA, 14 bp, Homo sapiens
cacgcacgcacaca

SEQ ID NO: 3323178 - DNA, 14 bp, Homo sapiens
cacgcactgggcca

SEQ ID NO: 3323179 - DNA, 14 bp, Homo sapiens
cacgccactgcact

SEQ ID NO: 3323180 - DNA, 14 bp, Homo sapiens
cacgccccagcccg

SEQ ID NO: 3323181 - DNA, 15 bp, Homo sapiens
cacgcccccaggaat

SEQ ID NO: 3323182 - DNA, 15 bp, Homo sapiens
cacgcccgcaccccc

SEQ ID NO: 3323183 - DNA, 15 bp, Homo sapiens
cacgcccgtcctgcc

SEQ ID NO: 3323184 - DNA, 19 bp, Homo sapiens
cacgcccgtcctgcctgtg

SEQ ID NO: 3323185 - DNA, 21 bp, Homo sapiens
cacgcccgtcctgcctgtggc

SEQ ID NO: 3323186 - DNA, 17 bp, Homo sapiens
cacgccctactccactg

SEQ ID NO: 3323187 - DNA, 19 bp, Homo sapiens
cacgccctactccactgcc

SEQ ID NO: 3323188 - DNA, 21 bp, Homo sapiens
cacgccctcccctcccctgct

SEQ ID NO: 3323189 - DNA, 19 bp, Homo sapiens
cacgcctatgatcccagca

SEQ ID NO: 3323190 - DNA, 22 bp, Homo sapiens
cacgcctatgatcccagcactt

SEQ ID NO: 3323191 - DNA, 13 bp, Homo sapiens
cacgcctcctggc

SEQ ID NO: 3323192 - DNA, 15 bp, Homo sapiens
cacgcctcctggcca

SEQ ID NO: 3323193 - DNA, 16 bp, Homo sapiens
cacgcctcctggccag

SEQ ID NO: 3323194 - DNA, 17 bp, Homo sapiens
cacgcctcctggccaga

SEQ ID NO: 3323195 - DNA, 16 bp, Homo sapiens
cacgcgctctccacca

SEQ ID NO: 3323196 - DNA, 15 bp, Homo sapiens
cacgcgggggccttg

SEQ ID NO: 3323197 - DNA, 21 bp, Homo sapiens
cacgcgtgcacacaccagagc

SEQ ID NO: 3323198 - DNA, 14 bp, Homo sapiens
cacgctccagctgc

SEQ ID NO: 3323199 - DNA, 19 bp, Homo sapiens
cacgctccagctgccccgg

SEQ ID NO: 3323200 - DNA, 17 bp, Homo sapiens
cacgctcccccgcagtc

SEQ ID NO: 3323201 - DNA, 22 bp, Homo sapiens
cacgctcgcgggcagcgggcca

SEQ ID NO: 3323202 - DNA, 18 bp, Homo sapiens
cacgctcgctgccatcac

SEQ ID NO: 3323203 - DNA, 17 bp, Homo sapiens
cacgctggaccttgaac

SEQ ID NO: 3323204 - DNA, 20 bp, Homo sapiens
cacgctggaccttgaactgg

SEQ ID NO: 3323205 - DNA, 16 bp, Homo sapiens
cacgctggagtgcagt

SEQ ID NO: 3323206 - DNA, 16 bp, Homo sapiens
cacgctggggctctct

SEQ ID NO: 3323207 - DNA, 20 bp, Homo sapiens
cacgctggggctctctgaga

SEQ ID NO: 3323208 - DNA, 18 bp, Homo sapiens
cacgctgggtcctaatta

SEQ ID NO: 3323209 - DNA, 13 bp, Homo sapiens
cacgctgtcctct

SEQ ID NO: 3323210 - DNA, 18 bp, Homo sapiens
cacgctttgatgagcatt

SEQ ID NO: 3323211 - DNA, 17 bp, Homo sapiens
cacggacaataaacctc

SEQ ID NO: 3323212 - DNA, 17 bp, Homo sapiens
cacggacgtttccatca

SEQ ID NO: 3323213 - DNA, 22 bp, Homo sapiens
cacggagccgcgggacagccaa

SEQ ID NO: 3323214 - DNA, 17 bp, Homo sapiens
cacggcagaccagaacg

SEQ ID NO: 3323215 - DNA, 19 bp, Homo sapiens
cactcccttgctggcccca

SEQ ID NO: 3323216 - DNA, 22 bp, Homo sapiens
cactcccttgctggccccagcc

SEQ ID NO: 3323217 - DNA, 21 bp, Homo sapiens
cactccggtgtgcctgcagcc

SEQ ID NO: 3323218 - DNA, 14 bp, Homo sapiens
cactcctacctggt

SEQ ID NO: 3323219 - DNA, 22 bp, Homo sapiens
cactcctaggagagccaacctc

SEQ ID NO: 3323220 - DNA, 12 bp, Homo sapiens
cactcctccctc

SEQ ID NO: 3323221 - DNA, 15 bp, Homo sapiens
cactcctctcccaca

SEQ ID NO: 3323222 - DNA, 21 bp, Homo sapiens
cactcctgcctccgctggctt

SEQ ID NO: 3323223 - DNA, 13 bp, Homo sapiens
cactcctgtcccg

SEQ ID NO: 3323224 - DNA, 15 bp, Homo sapiens
cactcgcagtcgcag

SEQ ID NO: 3323225 - DNA, 22 bp, Homo sapiens
cactcggcatttcaaatgtgct

SEQ ID NO: 3323226 - DNA, 12 bp, Homo sapiens
cactctacctcc

SEQ ID NO: 3323227 - DNA, 14 bp, Homo sapiens
cactctagattcca

SEQ ID NO: 3323228 - DNA, 13 bp, Homo sapiens
cactctatgagtt

SEQ ID NO: 3323229 - DNA, 12 bp, Homo sapiens
cactctccccac

SEQ ID NO: 3323230 - DNA, 13 bp, Homo sapiens
cactctctgaaga

SEQ ID NO: 3323231 - DNA, 18 bp, Homo sapiens
cactctgagtctctgaat

SEQ ID NO: 3323232 - DNA, 15 bp, Homo sapiens
cactctgcagactgc

SEQ ID NO: 3323233 - DNA, 15 bp, Homo sapiens
cactctgccagggca

SEQ ID NO: 3323234 - DNA, 19 bp, Homo sapiens
cactctgccagggcagtgc

SEQ ID NO: 3323235 - DNA, 11 bp, Homo sapiens
cactctgctgc

SEQ ID NO: 3323236 - DNA, 14 bp, Homo sapiens
cactctgcttctct

SEQ ID NO: 3323237 - DNA, 17 bp, Homo sapiens
cactctgcttctctgac

SEQ ID NO: 3323238 - DNA, 13 bp, Homo sapiens
cactctggcctca

SEQ ID NO: 3323239 - DNA, 16 bp, Homo sapiens
cactctgtcagccagc

SEQ ID NO: 3323240 - DNA, 17 bp, Homo sapiens
cactctgtcagccagcc

SEQ ID NO: 3323241 - DNA, 21 bp, Homo sapiens
cactctgtcagccagccgccc

SEQ ID NO: 3323242 - DNA, 18 bp, Homo sapiens
cactctgtccctgtcctt

SEQ ID NO: 3323243 - DNA, 15 bp, Homo sapiens
cactctgtcgcccag

SEQ ID NO: 3323244 - DNA, 20 bp, Homo sapiens
cactctgtcgcccagtctgg

SEQ ID NO: 3323245 - DNA, 17 bp, Homo sapiens
cactctgttatttagac

SEQ ID NO: 3323246 - DNA, 20 bp, Homo sapiens
cactctgttatttagactca

SEQ ID NO: 3323247 - DNA, 22 bp, Homo sapiens
cactcttaaagcaaaaaatgaa

SEQ ID NO: 3323248 - DNA, 21 bp, Homo sapiens
cactcttcagtgactcctgct

SEQ ID NO: 3323249 - DNA, 14 bp, Homo sapiens
cactcttgaagagg

SEQ ID NO: 3323250 - DNA, 15 bp, Homo sapiens
cactctttgtaagag

SEQ ID NO: 3323251 - DNA, 11 bp, Homo sapiens
cactgaaaaat

SEQ ID NO: 3323252 - DNA, 20 bp, Homo sapiens
cactgaaaaatctaagtgat

SEQ ID NO: 3323253 - DNA, 14 bp, Homo sapiens
cactgaaaaattat

SEQ ID NO: 3323254 - DNA, 21 bp, Homo sapiens
cactgaaaaggttcttcatcc

SEQ ID NO: 3323255 - DNA, 17 bp, Homo sapiens
cactgaaacctctgcct

SEQ ID NO: 3323256 - DNA, 20 bp, Homo sapiens
cactgaaagctctgttgcaa

SEQ ID NO: 3323257 - DNA, 17 bp, Homo sapiens
cactgaagcctgcgttg

SEQ ID NO: 3323258 - DNA, 17 bp, Homo sapiens
cactgaagctgggattc

SEQ ID NO: 3323259 - DNA, 22 bp, Homo sapiens
cagaatctgctgttgccatagc

SEQ ID NO: 3323260 - DNA, 19 bp, Homo sapiens
cagaatcttgttttgaaaa

SEQ ID NO: 3323261 - DNA, 18 bp, Homo sapiens
cagaatgaggaataataa

SEQ ID NO: 3323262 - DNA, 17 bp, Homo sapiens
cagaatgctgtacatct

SEQ ID NO: 3323263 - DNA, 18 bp, Homo sapiens
cagaatgctgtacatcta

SEQ ID NO: 3323264 - DNA, 22 bp, Homo sapiens
cagaatggaaaaatccttgaag

SEQ ID NO: 3323265 - DNA, 21 bp, Homo sapiens
cagaatggctatcaaaagaaa

SEQ ID NO: 3323266 - DNA, 22 bp, Homo sapiens
cagaatgtaagaaaacaaaatc

SEQ ID NO: 3323267 - DNA, 12 bp, Homo sapiens
cagaatgtatct

SEQ ID NO: 3323268 - DNA, 13 bp, Homo sapiens
cagaatgtatctg

SEQ ID NO: 3323269 - DNA, 14 bp, Homo sapiens
cagaatgtatctgt

SEQ ID NO: 3323270 - DNA, 13 bp, Homo sapiens
cagaatgtcagat

SEQ ID NO: 3323271 - DNA, 17 bp, Homo sapiens
cagaatgtttttaaaat

SEQ ID NO: 3323272 - DNA, 21 bp, Homo sapiens
cagaattagatggcttatttt

SEQ ID NO: 3323273 - DNA, 13 bp, Homo sapiens
cagaattgatcat

SEQ ID NO: 3323274 - DNA, 20 bp, Homo sapiens
cagaattgtatctcatactg

SEQ ID NO: 3323275 - DNA, 14 bp, Homo sapiens
cagaatttatctcc

SEQ ID NO: 3323276 - DNA, 13 bp, Homo sapiens
cagaatttgaatt

SEQ ID NO: 3323277 - DNA, 21 bp, Homo sapiens
cagaatttgtatgtattttca

SEQ ID NO: 3323278 - DNA, 18 bp, Homo sapiens
cagaattttaatgtgaag

SEQ ID NO: 3323279 - DNA, 21 bp, Homo sapiens
cagaattttaggaacttcaga

SEQ ID NO: 3323280 - DNA, 19 bp, Homo sapiens
cagacaaaaaaatttaaaa

SEQ ID NO: 3323281 - DNA, 22 bp, Homo sapiens
cagacaaatgtggttacacact

SEQ ID NO: 3323282 - DNA, 20 bp, Homo sapiens
cagacaacaccttcctcctg

SEQ ID NO: 3323283 - DNA, 16 bp, Homo sapiens
cagacaacagcccagg

SEQ ID NO: 3323284 - DNA, 15 bp, Homo sapiens
cagacaaccaaaaca

SEQ ID NO: 3323285 - DNA, 16 bp, Homo sapiens
cagacaaccaaaacat

SEQ ID NO: 3323286 - DNA, 17 bp, Homo sapiens
cagacaaccaaaacata

SEQ ID NO: 3323287 - DNA, 23 bp, Homo sapiens
cagacaagcaacaggttttataa

SEQ ID NO: 3323288 - DNA, 17 bp, Homo sapiens
cagacaagcactatttt

SEQ ID NO: 3323289 - DNA, 15 bp, Homo sapiens
cagacaagcagccct

SEQ ID NO: 3323290 - DNA, 16 bp, Homo sapiens
cagacaagcagccctt

SEQ ID NO: 3323291 - DNA, 17 bp, Homo sapiens
cagacaagcagcccttg

SEQ ID NO: 3323292 - DNA, 19 bp, Homo sapiens
cagacaagcagcccttgct

SEQ ID NO: 3323293 - DNA, 14 bp, Homo sapiens
cagacacacacaca

SEQ ID NO: 3323294 - DNA, 17 bp, Homo sapiens
cagacacacacacgcac

SEQ ID NO: 3323295 - DNA, 15 bp, Homo sapiens
cagacacagactggc

SEQ ID NO: 3323296 - DNA, 22 bp, Homo sapiens
cagacacagactggcaataaac

SEQ ID NO: 3323297 - DNA, 13 bp, Homo sapiens
cagacacagccca

SEQ ID NO: 3323298 - DNA, 14 bp, Homo sapiens
cagacaccctcaac

SEQ ID NO: 3323299 - DNA, 14 bp, Homo sapiens
cagacacctggact

SEQ ID NO: 3323300 - DNA, 17 bp, Homo sapiens
cagacacctggactgag

SEQ ID NO: 3323301 - DNA, 22 bp, Homo sapiens
cagacacctgttcacagaaaaa

SEQ ID NO: 3323302 - DNA, 18 bp, Homo sapiens
cagacaccttggacatcc

SEQ ID NO: 3323303 - DNA, 19 bp, Homo sapiens
cagacacgagccacctcac

SEQ ID NO: 3323304 - DNA, 19 bp, Homo sapiens
cagacacgctcgcgggcag

SEQ ID NO: 3323305 - DNA, 11 bp, Homo sapiens
cagacactaag

SEQ ID NO: 3323306 - DNA, 19 bp, Homo sapiens
cagacactacatatctaaa

SEQ ID NO: 3323307 - DNA, 21 bp, Homo sapiens
cagacactgaccatccactct

SEQ ID NO: 3323308 - DNA, 13 bp, Homo sapiens
cagacacttattt

SEQ ID NO: 3323309 - DNA, 15 bp, Homo sapiens
cagacactttggaag

SEQ ID NO: 3323310 - DNA, 11 bp, Homo sapiens
cagacagaaga

SEQ ID NO: 3323311 - DNA, 18 bp, Homo sapiens
cagacagaagtctcctca

SEQ ID NO: 3323312 - DNA, 19 bp, Homo sapiens
cagacagatgtcagcttcc

SEQ ID NO: 3323313 - DNA, 14 bp, Homo sapiens
cagacagcacaggg

SEQ ID NO: 3323314 - DNA, 17 bp, Homo sapiens
cagacagcacagggcag

SEQ ID NO: 3323315 - DNA, 14 bp, Homo sapiens
cagacagcaggcag

SEQ ID NO: 3323316 - DNA, 19 bp, Homo sapiens
cagacagcaggcagcgcca

SEQ ID NO: 3323317 - DNA, 20 bp, Homo sapiens
cagacaggcaagcacctcct

SEQ ID NO: 3323318 - DNA, 20 bp, Homo sapiens
cagacaggccatgtgagcca

SEQ ID NO: 3323319 - DNA, 21 bp, Homo sapiens
cagacaggccatgtgagccac

SEQ ID NO: 3323320 - DNA, 20 bp, Homo sapiens
cagacaggctcttagcagct

SEQ ID NO: 3323321 - DNA, 19 bp, Homo sapiens
cagacagtgttttctggga

SEQ ID NO: 3323322 - DNA, 14 bp, Homo sapiens
cagacataaagcca

SEQ ID NO: 3323323 - DNA, 17 bp, Homo sapiens
cagacatgaaataaaga

SEQ ID NO: 3323324 - DNA, 21 bp, Homo sapiens
cagacatgaaataaagaattt

SEQ ID NO: 3323325 - DNA, 17 bp, Homo sapiens
cagacattatgtaaaag

SEQ ID NO: 3323326 - DNA, 23 bp, Homo sapiens
cagaggtctctgccggctctttc

SEQ ID NO: 3323327 - DNA, 13 bp, Homo sapiens
cagaggtgggcag

SEQ ID NO: 3323328 - DNA, 14 bp, Homo sapiens
cagaggtgggcagg

SEQ ID NO: 3323329 - DNA, 17 bp, Homo sapiens
cagaggtgggcaggtgg

SEQ ID NO: 3323330 - DNA, 17 bp, Homo sapiens
cagaggtgtacactaac

SEQ ID NO: 3323331 - DNA, 19 bp, Homo sapiens
cagaggtgtacactaacat

SEQ ID NO: 3323332 - DNA, 22 bp, Homo sapiens
cagaggtgtacactaacatttc

SEQ ID NO: 3323333 - DNA, 23 bp, Homo sapiens
cagaggtgtacactaacatttcc

SEQ ID NO: 3323334 - DNA, 17 bp, Homo sapiens
cagaggttatctgcctg

SEQ ID NO: 3323335 - DNA, 18 bp, Homo sapiens
cagaggttatctgcctgg

SEQ ID NO: 3323336 - DNA, 20 bp, Homo sapiens
cagaggttatctgcctggcc

SEQ ID NO: 3323337 - DNA, 23 bp, Homo sapiens
cagaggttatctgcctggcctgg

SEQ ID NO: 3323338 - DNA, 21 bp, Homo sapiens
cagaggttctttgagggactg

SEQ ID NO: 3323339 - DNA, 13 bp, Homo sapiens
cagagtatcttta

SEQ ID NO: 3323340 - DNA, 21 bp, Homo sapiens
cagagtatgaacacctgggct

SEQ ID NO: 3323341 - DNA, 17 bp, Homo sapiens
cagagtcagaggagaag

SEQ ID NO: 3323342 - DNA, 16 bp, Homo sapiens
cagagtccaatttaag

SEQ ID NO: 3323343 - DNA, 22 bp, Homo sapiens
cagagtccatttcccacatctt

SEQ ID NO: 3323344 - DNA, 12 bp, Homo sapiens
cagagtccggga

SEQ ID NO: 3323345 - DNA, 17 bp, Homo sapiens
cagagtcctcattataa

SEQ ID NO: 3323346 - DNA, 15 bp, Homo sapiens
cagagtcctttccaa

SEQ ID NO: 3323347 - DNA, 21 bp, Homo sapiens
cagagtctcactgttgcccag

SEQ ID NO: 3323348 - DNA, 15 bp, Homo sapiens
cagagtctgagcccc

SEQ ID NO: 3323349 - DNA, 20 bp, Homo sapiens
cagagtctgggcctctgact

SEQ ID NO: 3323350 - DNA, 20 bp, Homo sapiens
cagagtctggtgaagctcac

SEQ ID NO: 3323351 - DNA, 23 bp, Homo sapiens
cagagtgaaagggctatggcaag

SEQ ID NO: 3323352 - DNA, 19 bp, Homo sapiens
cagagtgagaccctgtctc

SEQ ID NO: 3323353 - DNA, 16 bp, Homo sapiens
cagagtgagactctgt

SEQ ID NO: 3323354 - DNA, 18 bp, Homo sapiens
cagagtgagactctgtct

SEQ ID NO: 3323355 - DNA, 19 bp, Homo sapiens
cagagtgagactctgtctc

SEQ ID NO: 3323356 - DNA, 21 bp, Homo sapiens
cagagtgagcaagggggccca

SEQ ID NO: 3323357 - DNA, 11 bp, Homo sapiens
cagagtgagcc

SEQ ID NO: 3323358 - DNA, 15 bp, Homo sapiens
cagagtgcacagctg

SEQ ID NO: 3323359 - DNA, 17 bp, Homo sapiens
cagagtgcacagctgtc

SEQ ID NO: 3323360 - DNA, 11 bp, Homo sapiens
cagagtgccac

SEQ ID NO: 3323361 - DNA, 16 bp, Homo sapiens
cagagtgctggactgt

SEQ ID NO: 3323362 - DNA, 17 bp, Homo sapiens
cagagtggagtctgagt

SEQ ID NO: 3323363 - DNA, 19 bp, Homo sapiens
cagagtggcctccctgctg

SEQ ID NO: 3323364 - DNA, 15 bp, Homo sapiens
cagagtggcctggcc

SEQ ID NO: 3323365 - DNA, 16 bp, Homo sapiens
cagagtggcctggcca

SEQ ID NO: 3323366 - DNA, 18 bp, Homo sapiens
cagagtgggccccgggct

SEQ ID NO: 3323367 - DNA, 20 bp, Homo sapiens
cagagtggtttccaatgtgt

SEQ ID NO: 3323368 - DNA, 15 bp, Homo sapiens
cagagttacagttct

SEQ ID NO: 3323369 - DNA, 19 bp, Homo sapiens
cagagttacagttctgtgg

SEQ ID NO: 3323370 - DNA, 17 bp, Homo sapiens
cagagttcacaggaggc

SEQ ID NO: 3323371 - DNA, 19 bp, Homo sapiens
cagagttcacaggaggcca

SEQ ID NO: 3323372 - DNA, 23 bp, Homo sapiens
cagagttcacaggaggccagtgg

SEQ ID NO: 3323373 - DNA, 12 bp, Homo sapiens
cagagttcacta

SEQ ID NO: 3323374 - DNA, 17 bp, Homo sapiens
cagagttcctgcggagt

SEQ ID NO: 3323375 - DNA, 23 bp, Homo sapiens
cagagttcctgcggagtgaagag

SEQ ID NO: 3323376 - DNA, 20 bp, Homo sapiens
cagagttgctgcaaacctga

SEQ ID NO: 3323377 - DNA, 16 bp, Homo sapiens
cagagtttacattcta

SEQ ID NO: 3323378 - DNA, 23 bp, Homo sapiens
cagagtttagaggaaaaaaatga

SEQ ID NO: 3323379 - DNA, 19 bp, Homo sapiens
cagagtttgccttcctttc

SEQ ID NO: 3323380 - DNA, 12 bp, Homo sapiens
cagagtttgtgt

SEQ ID NO: 3323381 - DNA, 15 bp, Homo sapiens
cagagtttgtgtgta

SEQ ID NO: 3323382 - DNA, 16 bp, Homo sapiens
cagagtttgtgtgtat

SEQ ID NO: 3323383 - DNA, 21 bp, Homo sapiens
cagagtttgtgtgtatttgta

SEQ ID NO: 3323384 - DNA, 17 bp, Homo sapiens
cagagtttgtgtgttgt

SEQ ID NO: 3323385 - DNA, 19 bp, Homo sapiens
cagagtttgtgtgttgtct

SEQ ID NO: 3323386 - DNA, 23 bp, Homo sapiens
cagagttttcattaaatcctttt

SEQ ID NO: 3323387 - DNA, 20 bp, Homo sapiens
cagataacaatgcagcaagg

SEQ ID NO: 3323388 - DNA, 17 bp, Homo sapiens
cagataaccagctgtaa

SEQ ID NO: 3323389 - DNA, 20 bp, Homo sapiens
cagataacttttttgagtca

SEQ ID NO: 3323390 - DNA, 21 bp, Homo sapiens
cagataacttttttgagtcat

SEQ ID NO: 3323391 - DNA, 16 bp, Homo sapiens
cagataatcagcctct

SEQ ID NO: 3323392 - DNA, 19 bp, Homo sapiens
cagataatcagcctcttaa

SEQ ID NO: 3323393 - DNA, 14 bp, Homo sapiens
cagataatcagtgt

SEQ ID NO: 3323394 - DNA, 23 bp, Homo sapiens
cacttgaaagattttattgtata

SEQ ID NO: 3323395 - DNA, 18 bp, Homo sapiens
cacttgaggtcaggagtt

SEQ ID NO: 3323396 - DNA, 22 bp, Homo sapiens
cacttgaggtcaggagttccta

SEQ ID NO: 3323397 - DNA, 18 bp, Homo sapiens
cacttgagttcaggagtt

SEQ ID NO: 3323398 - DNA, 14 bp, Homo sapiens
cacttgattccttg

SEQ ID NO: 3323399 - DNA, 18 bp, Homo sapiens
cacttgcagactctacag

SEQ ID NO: 3323400 - DNA, 20 bp, Homo sapiens
cacttgcaggggtccctgct

SEQ ID NO: 3323401 - DNA, 16 bp, Homo sapiens
cacttgccaaaatcca

SEQ ID NO: 3323402 - DNA, 20 bp, Homo sapiens
cacttgccattccaaaatat

SEQ ID NO: 3323403 - DNA, 15 bp, Homo sapiens
cacttgcgtcctgca

SEQ ID NO: 3323404 - DNA, 16 bp, Homo sapiens
cacttgcgtcctgcag

SEQ ID NO: 3323405 - DNA, 20 bp, Homo sapiens
cacttgcgtcctgcagagga

SEQ ID NO: 3323406 - DNA, 23 bp, Homo sapiens
cacttgcgtcctgcagaggacca

SEQ ID NO: 3323407 - DNA, 13 bp, Homo sapiens
cacttgctggggc

SEQ ID NO: 3323408 - DNA, 20 bp, Homo sapiens
cacttgctggggctcacggg

SEQ ID NO: 3323409 - DNA, 21 bp, Homo sapiens
cacttggcctcagctggctgt

SEQ ID NO: 3323410 - DNA, 16 bp, Homo sapiens
cacttgtatatacgca

SEQ ID NO: 3323411 - DNA, 19 bp, Homo sapiens
cacttgtatcctctggttc

SEQ ID NO: 3323412 - DNA, 20 bp, Homo sapiens
cacttgtgctttgctcttgt

SEQ ID NO: 3323413 - DNA, 16 bp, Homo sapiens
cacttgttccagctct

SEQ ID NO: 3323414 - DNA, 22 bp, Homo sapiens
cactttaaagcaattgcataat

SEQ ID NO: 3323415 - DNA, 18 bp, Homo sapiens
cactttaagagagaaatc

SEQ ID NO: 3323416 - DNA, 20 bp, Homo sapiens
cactttaattaccaacctgt

SEQ ID NO: 3323417 - DNA, 17 bp, Homo sapiens
cactttacccacctaga

SEQ ID NO: 3323418 - DNA, 19 bp, Homo sapiens
cactttacccacctagaac

SEQ ID NO: 3323419 - DNA, 15 bp, Homo sapiens
cactttagggctgta

SEQ ID NO: 3323420 - DNA, 20 bp, Homo sapiens
cactttataagtcattgtat

SEQ ID NO: 3323421 - DNA, 22 bp, Homo sapiens
cactttataagtcattgtatgt

SEQ ID NO: 3323422 - DNA, 23 bp, Homo sapiens
cactttcagagcccccagccctg

SEQ ID NO: 3323423 - DNA, 19 bp, Homo sapiens
cactttcatctggggtggg

SEQ ID NO: 3323424 - DNA, 16 bp, Homo sapiens
cactttcattgccagt

SEQ ID NO: 3323425 - DNA, 17 bp, Homo sapiens
cactttcattgccagtg

SEQ ID NO: 3323426 - DNA, 23 bp, Homo sapiens
cactttcattgccagtgtctttc

SEQ ID NO: 3323427 - DNA, 22 bp, Homo sapiens
cactttccaccaagtgtctaga

SEQ ID NO: 3323428 - DNA, 13 bp, Homo sapiens
cactttccacttc

SEQ ID NO: 3323429 - DNA, 18 bp, Homo sapiens
cactttccacttcttcct

SEQ ID NO: 3323430 - DNA, 19 bp, Homo sapiens
cactttccacttcttcctt

SEQ ID NO: 3323431 - DNA, 22 bp, Homo sapiens
cactttccacttcttcctttct

SEQ ID NO: 3323432 - DNA, 18 bp, Homo sapiens
cactttcccttgtgtcaa

SEQ ID NO: 3323433 - DNA, 17 bp, Homo sapiens
cactttctaatgtttct

SEQ ID NO: 3323434 - DNA, 12 bp, Homo sapiens
cactttgaaata

SEQ ID NO: 3323435 - DNA, 21 bp, Homo sapiens
cactttgaaatacctcatgtt

SEQ ID NO: 3323436 - DNA, 22 bp, Homo sapiens
cactttgaaatacctcatgttt

SEQ ID NO: 3323437 - DNA, 21 bp, Homo sapiens
cactttgagcatttttaaggg

SEQ ID NO: 3323438 - DNA, 14 bp, Homo sapiens
cactttgcacagct

SEQ ID NO: 3323439 - DNA, 13 bp, Homo sapiens
cactttgcacatt

SEQ ID NO: 3323440 - DNA, 15 bp, Homo sapiens
cactttgcacatttt

SEQ ID NO: 3323441 - DNA, 18 bp, Homo sapiens
cactttgcacattttgat

SEQ ID NO: 3323442 - DNA, 13 bp, Homo sapiens
cactttggagact

SEQ ID NO: 3323443 - DNA, 12 bp, Homo sapiens
cactttgggagg

SEQ ID NO: 3323444 - DNA, 12 bp, Homo sapiens
cactttgttctt

SEQ ID NO: 3323445 - DNA, 13 bp, Homo sapiens
cacttttatttat

SEQ ID NO: 3323446 - DNA, 20 bp, Homo sapiens
cacttttcaatcccaattct

SEQ ID NO: 3323447 - DNA, 13 bp, Homo sapiens
cacttttcagtga

SEQ ID NO: 3323448 - DNA, 13 bp, Homo sapiens
cacttttcatcct

SEQ ID NO: 3323449 - DNA, 14 bp, Homo sapiens
cacttttcatcctt

SEQ ID NO: 3323450 - DNA, 19 bp, Homo sapiens
cacttttcatccttcccca

SEQ ID NO: 3323451 - DNA, 17 bp, Homo sapiens
cacttttgttattccat

SEQ ID NO: 3323452 - DNA, 22 bp, Homo sapiens
cacttttgttattccatcaata

SEQ ID NO: 3323453 - DNA, 14 bp, Homo sapiens
cacttttgttctgc

SEQ ID NO: 3323454 - DNA, 18 bp, Homo sapiens
cacttttgttctgcttta

SEQ ID NO: 3323455 - DNA, 19 bp, Homo sapiens
cactttttattagataacg

SEQ ID NO: 3323456 - DNA, 15 bp, Homo sapiens
cactttttcgtgtgg

SEQ ID NO: 3323457 - DNA, 13 bp, Homo sapiens
cactttttgaact

SEQ ID NO: 3323458 - DNA, 16 bp, Homo sapiens
cactttttgaactaag

SEQ ID NO: 3323459 - DNA, 19 bp, Homo sapiens
cactttttttttttttccc

SEQ ID NO: 3323460 - DNA, 20 bp, Homo sapiens
cactttttttttttttcccc

SEQ ID NO: 3323461 - DNA, 21 bp, Homo sapiens
cagaaaaagcatgatgggaaa

SEQ ID NO: 3323462 - DNA, 13 bp, Homo sapiens
cagaaaaataagt

SEQ ID NO: 3323463 - DNA, 17 bp, Homo sapiens
cagaaaaataagtcaaa

SEQ ID NO: 3323464 - DNA, 22 bp, Homo sapiens
cagaaaaataagtcaaaaggaa

SEQ ID NO: 3323465 - DNA, 13 bp, Homo sapiens
cagaaaacaactt

SEQ ID NO: 3323466 - DNA, 22 bp, Homo sapiens
cagaaaacaacttggcatttct

SEQ ID NO: 3323467 - DNA, 13 bp, Homo sapiens
cagaaaacagaga

SEQ ID NO: 3323468 - DNA, 20 bp, Homo sapiens
cagaaaacagagcctgccta

SEQ ID NO: 3323469 - DNA, 20 bp, Homo sapiens
cagaaaacctgttcaggcag

SEQ ID NO: 3323470 - DNA, 15 bp, Homo sapiens
cagaaaagaaaacca

SEQ ID NO: 3323471 - DNA, 16 bp, Homo sapiens
cagaaaagtaattttg

SEQ ID NO: 3323472 - DNA, 20 bp, Homo sapiens
cagaaaagtaattttgtcac

SEQ ID NO: 3323473 - DNA, 18 bp, Homo sapiens
cagaaaatgttgagaatc

SEQ ID NO: 3323474 - DNA, 22 bp, Homo sapiens
cagaaaattggcagtggcagag

SEQ ID NO: 3323475 - DNA, 18 bp, Homo sapiens
cagaaacaaaaacactaa

SEQ ID NO: 3323476 - DNA, 20 bp, Homo sapiens
cagaaacaaaaacactaaaa

SEQ ID NO: 3323477 - DNA, 14 bp, Homo sapiens
cagaaaccagttat

SEQ ID NO: 3323478 - DNA, 15 bp, Homo sapiens
cagaaaccagttatg

SEQ ID NO: 3323479 - DNA, 14 bp, Homo sapiens
cagaaactgatgcc

SEQ ID NO: 3323480 - DNA, 20 bp, Homo sapiens
cagaaacttgtgaagtggaa

SEQ ID NO: 3323481 - DNA, 18 bp, Homo sapiens
cagaaagcataaaattct

SEQ ID NO: 3323482 - DNA, 18 bp, Homo sapiens
cagaaaggaaaacctgaa

SEQ ID NO: 3323483 - DNA, 12 bp, Homo sapiens
cagaaaggagag

SEQ ID NO: 3323484 - DNA, 23 bp, Homo sapiens
cagaaagtgcctgacacactaac

SEQ ID NO: 3323485 - DNA, 22 bp, Homo sapiens
cagaaatactataacatatgta

SEQ ID NO: 3323486 - DNA, 19 bp, Homo sapiens
cagaaatatatatacatat

SEQ ID NO: 3323487 - DNA, 21 bp, Homo sapiens
cagaaatgtctaaatgctgaa

SEQ ID NO: 3323488 - DNA, 11 bp, Homo sapiens
cagaaattgga

SEQ ID NO: 3323489 - DNA, 20 bp, Homo sapiens
cagaaattggaacagaatgt

SEQ ID NO: 3323490 - DNA, 18 bp, Homo sapiens
cagaaatttttatttttc

SEQ ID NO: 3323491 - DNA, 19 bp, Homo sapiens
cagaaatttttatttttct

SEQ ID NO: 3323492 - DNA, 15 bp, Homo sapiens
cagaacaacaactat

SEQ ID NO: 3323493 - DNA, 12 bp, Homo sapiens
cagaacagcaga

SEQ ID NO: 3323494 - DNA, 13 bp, Homo sapiens
cagaacagctgaa

SEQ ID NO: 3323495 - DNA, 15 bp, Homo sapiens
cagaacagcttcagg

SEQ ID NO: 3323496 - DNA, 17 bp, Homo sapiens
cagaacagcttcaggtt

SEQ ID NO: 3323497 - DNA, 24 bp, Homo sapiens
cagaacagcttcaggttatcgaaa

SEQ ID NO: 3323498 - DNA, 21 bp, Homo sapiens
cagaacaggaggtgtgaatgc

SEQ ID NO: 3323499 - DNA, 23 bp, Homo sapiens
cagaacaggaggtgtgaatgcac

SEQ ID NO: 3323500 - DNA, 19 bp, Homo sapiens
cagaacatcgatatgtata

SEQ ID NO: 3323501 - DNA, 15 bp, Homo sapiens
cagaacatgttaaga

SEQ ID NO: 3323502 - DNA, 17 bp, Homo sapiens
cagaacatgttaagata

SEQ ID NO: 3323503 - DNA, 19 bp, Homo sapiens
cagaacattcagctctgga

SEQ ID NO: 3323504 - DNA, 22 bp, Homo sapiens
cagaacattcagctctggagaa

SEQ ID NO: 3323505 - DNA, 23 bp, Homo sapiens
cagaacattcagctctggagaac

SEQ ID NO: 3323506 - DNA, 15 bp, Homo sapiens
cagaaccacaaacaa

SEQ ID NO: 3323507 - DNA, 22 bp, Homo sapiens
cagaaccacacttgaaaccttt

SEQ ID NO: 3323508 - DNA, 15 bp, Homo sapiens
cagaaccatccatag

SEQ ID NO: 3323509 - DNA, 20 bp, Homo sapiens
cagaacccagggctctgccc

SEQ ID NO: 3323510 - DNA, 21 bp, Homo sapiens
cagaacccagggctctgcccc

SEQ ID NO: 3323511 - DNA, 21 bp, Homo sapiens
cagaacctaaaagtattattc

SEQ ID NO: 3323512 - DNA, 20 bp, Homo sapiens
cagaacctactgttcctttc

SEQ ID NO: 3323513 - DNA, 21 bp, Homo sapiens
cagaacctactgttcctttca

SEQ ID NO: 3323514 - DNA, 18 bp, Homo sapiens
cagaacctcttccccaga

SEQ ID NO: 3323515 - DNA, 12 bp, Homo sapiens
cagaactaaatg

SEQ ID NO: 3323516 - DNA, 14 bp, Homo sapiens
cagaactaaatgtt

SEQ ID NO: 3323517 - DNA, 13 bp, Homo sapiens
cagaactcccttc

SEQ ID NO: 3323518 - DNA, 14 bp, Homo sapiens
cagaactgccatta

SEQ ID NO: 3323519 - DNA, 12 bp, Homo sapiens
caggaacccttg

SEQ ID NO: 3323520 - DNA, 19 bp, Homo sapiens
caggaacccttgcatccat

SEQ ID NO: 3323521 - DNA, 20 bp, Homo sapiens
caggaacccttgcatccatt

SEQ ID NO: 3323522 - DNA, 21 bp, Homo sapiens
caggaacctgtcctaaggaac

SEQ ID NO: 3323523 - DNA, 13 bp, Homo sapiens
caggaacgagcac

SEQ ID NO: 3323524 - DNA, 20 bp, Homo sapiens
caggaacgagcactggccag

SEQ ID NO: 3323525 - DNA, 15 bp, Homo sapiens
caggaactctggacc

SEQ ID NO: 3323526 - DNA, 14 bp, Homo sapiens
caggaactgggctg

SEQ ID NO: 3323527 - DNA, 18 bp, Homo sapiens
caggaactgggctgggcc

SEQ ID NO: 3323528 - DNA, 15 bp, Homo sapiens
caggaagcaccccat

SEQ ID NO: 3323529 - DNA, 14 bp, Homo sapiens
caggaagcccacac

SEQ ID NO: 3323530 - DNA, 19 bp, Homo sapiens
caggaagcctgcagtcctg

SEQ ID NO: 3323531 - DNA, 14 bp, Homo sapiens
caggaaggaaaact

SEQ ID NO: 3323532 - DNA, 19 bp, Homo sapiens
caggaaggaaaactatgta

SEQ ID NO: 3323533 - DNA, 18 bp, Homo sapiens
caggaaggagagcctgct

SEQ ID NO: 3323534 - DNA, 16 bp, Homo sapiens
caggaaggagcggcgc

SEQ ID NO: 3323535 - DNA, 22 bp, Homo sapiens
caggaaggagcggcgccctgga

SEQ ID NO: 3323536 - DNA, 23 bp, Homo sapiens
caggaaggagcggcgccctggac

SEQ ID NO: 3323537 - DNA, 23 bp, Homo sapiens
caggaaggaggagccgaccggga

SEQ ID NO: 3323538 - DNA, 13 bp, Homo sapiens
caggaaggcagct

SEQ ID NO: 3323539 - DNA, 14 bp, Homo sapiens
caggaaggcctagg

SEQ ID NO: 3323540 - DNA, 14 bp, Homo sapiens
caggaaggcctggg

SEQ ID NO: 3323541 - DNA, 21 bp, Homo sapiens
caggaagggcaggaaggagag

SEQ ID NO: 3323542 - DNA, 16 bp, Homo sapiens
caggaagtcttcaggg

SEQ ID NO: 3323543 - DNA, 23 bp, Homo sapiens
caggaataaggccttaatatgtt

SEQ ID NO: 3323544 - DNA, 14 bp, Homo sapiens
caggaatatgacac

SEQ ID NO: 3323545 - DNA, 17 bp, Homo sapiens
caggaatattttccaaa

SEQ ID NO: 3323546 - DNA, 14 bp, Homo sapiens
caggaatgatctct

SEQ ID NO: 3323547 - DNA, 15 bp, Homo sapiens
caggaatgtctggag

SEQ ID NO: 3323548 - DNA, 16 bp, Homo sapiens
caggaatgtgtggcct

SEQ ID NO: 3323549 - DNA, 22 bp, Homo sapiens
caggaattagagaagctgaaag

SEQ ID NO: 3323550 - DNA, 19 bp, Homo sapiens
caggaattccaattaaatt

SEQ ID NO: 3323551 - DNA, 21 bp, Homo sapiens
caggaattcttggagaaaatg

SEQ ID NO: 3323552 - DNA, 14 bp, Homo sapiens
caggaattttattt

SEQ ID NO: 3323553 - DNA, 16 bp, Homo sapiens
caggaattttattttg

SEQ ID NO: 3323554 - DNA, 19 bp, Homo sapiens
caggacaaagggagggagc

SEQ ID NO: 3323555 - DNA, 22 bp, Homo sapiens
caggacaaagggagggagcaag

SEQ ID NO: 3323556 - DNA, 22 bp, Homo sapiens
caggacacatcccggcctcttc

SEQ ID NO: 3323557 - DNA, 17 bp, Homo sapiens
caggacaccacacccag

SEQ ID NO: 3323558 - DNA, 23 bp, Homo sapiens
caggacaccacacccagcctcag

SEQ ID NO: 3323559 - DNA, 18 bp, Homo sapiens
caggacagagttcacagg

SEQ ID NO: 3323560 - DNA, 19 bp, Homo sapiens
caggacagagttcacagga

SEQ ID NO: 3323561 - DNA, 13 bp, Homo sapiens
caggacaggaggc

SEQ ID NO: 3323562 - DNA, 21 bp, Homo sapiens
caggacaggaggcggcccggc

SEQ ID NO: 3323563 - DNA, 21 bp, Homo sapiens
caggacagtgcttcagcctga

SEQ ID NO: 3323564 - DNA, 19 bp, Homo sapiens
caggacatgcaataaaatt

SEQ ID NO: 3323565 - DNA, 13 bp, Homo sapiens
caggaccaagcca

SEQ ID NO: 3323566 - DNA, 13 bp, Homo sapiens
caggaccacacag

SEQ ID NO: 3323567 - DNA, 16 bp, Homo sapiens
caggaccacacagtcc

SEQ ID NO: 3323568 - DNA, 18 bp, Homo sapiens
caggaccacacagtcccc

SEQ ID NO: 3323569 - DNA, 19 bp, Homo sapiens
caggaccacacagtcccca

SEQ ID NO: 3323570 - DNA, 12 bp, Homo sapiens
caggaccagctg

SEQ ID NO: 3323571 - DNA, 13 bp, Homo sapiens
caggaccagctgg

SEQ ID NO: 3323572 - DNA, 23 bp, Homo sapiens
caggaccagctggggcgtgggga

SEQ ID NO: 3323573 - DNA, 13 bp, Homo sapiens
caggacccaggcc

SEQ ID NO: 3323574 - DNA, 16 bp, Homo sapiens
caggacccaggccctc

SEQ ID NO: 3323575 - DNA, 14 bp, Homo sapiens
caggaccctcagga

SEQ ID NO: 3323576 - DNA, 15 bp, Homo sapiens
caggaccctcaggaa

SEQ ID NO: 3323577 - DNA, 19 bp, Homo sapiens
caggacctcccttccgacc

SEQ ID NO: 3323578 - DNA, 23 bp, Homo sapiens
caggacctcccttccgaccctct

SEQ ID NO: 3323579 - DNA, 20 bp, Homo sapiens
caggaccttttgaagtagtt

SEQ ID NO: 3323580 - DNA, 15 bp, Homo sapiens
caggacgcttctgaa

SEQ ID NO: 3323581 - DNA, 21 bp, Homo sapiens
caggacgcttctgaatgctgc

SEQ ID NO: 3323582 - DNA, 16 bp, Homo sapiens
caggacgtcctatctc

SEQ ID NO: 3323583 - DNA, 22 bp, Homo sapiens
caggactcacaggttggaagag

SEQ ID NO: 3323584 - DNA, 14 bp, Homo sapiens
caggactccactgg

SEQ ID NO: 3323585 - DNA, 16 bp, Homo sapiens
caggactccactggac

SEQ ID NO: 3323586 - DNA, 13 bp, Homo sapiens
caggactccctcc

SEQ ID NO: 3323587 - DNA, 14 bp, Homo sapiens
caggactccctcct

SEQ ID NO: 3323588 - DNA, 16 bp, Homo sapiens
caggactctgcctcct

SEQ ID NO: 3323589 - DNA, 18 bp, Homo sapiens
caggactgagccccgcag

SEQ ID NO: 3323590 - DNA, 21 bp, Homo sapiens
caggactgagtcccctccagg

SEQ ID NO: 3323591 - DNA, 14 bp, Homo sapiens
caggactgtgactc

SEQ ID NO: 3323592 - DNA, 20 bp, Homo sapiens
caggacttgctaaagcactt

SEQ ID NO: 3323593 - DNA, 19 bp, Homo sapiens
caggacttggggtcaggaa

SEQ ID NO: 3323594 - DNA, 14 bp, Homo sapiens
caggagaatcactg

SEQ ID NO: 3323595 - DNA, 15 bp, Homo sapiens
caggagagagccagg

SEQ ID NO: 3323596 - DNA, 21 bp, Homo sapiens
caggagagagccaggatgccc

SEQ ID NO: 3323597 - DNA, 12 bp, Homo sapiens
caggagagcagc

SEQ ID NO: 3323598 - DNA, 21 bp, Homo sapiens
caggagaggcagcatgcttgg

SEQ ID NO: 3323599 - DNA, 14 bp, Homo sapiens
caggagaggctggg

SEQ ID NO: 3323600 - DNA, 17 bp, Homo sapiens
caggagaggctgggctg

SEQ ID NO: 3323601 - DNA, 17 bp, Homo sapiens
caggagatcgagaccat

SEQ ID NO: 3323602 - DNA, 14 bp, Homo sapiens
caggagatggaggg

SEQ ID NO: 3323603 - DNA, 17 bp, Homo sapiens
caggagatggagggctt

SEQ ID NO: 3323604 - DNA, 16 bp, Homo sapiens
caggagattgagaagg

SEQ ID NO: 3323605 - DNA, 19 bp, Homo sapiens
caggagattgagaaggaga

SEQ ID NO: 3323606 - DNA, 20 bp, Homo sapiens
caggagattgagaaggagag

SEQ ID NO: 3323607 - DNA, 22 bp, Homo sapiens
caggagattgagaaggagagaa

SEQ ID NO: 3323608 - DNA, 15 bp, Homo sapiens
caggagcacaggcag

SEQ ID NO: 3323609 - DNA, 19 bp, Homo sapiens
caggagcatcctctgctgg

SEQ ID NO: 3323610 - DNA, 18 bp, Homo sapiens
caggagccccgaggcctt

SEQ ID NO: 3323611 - DNA, 22 bp, Homo sapiens
caggagccccgaggccttctct

SEQ ID NO: 3323612 - DNA, 12 bp, Homo sapiens
caggagcctagc

SEQ ID NO: 3323613 - DNA, 16 bp, Homo sapiens
caggagcctagcggag

SEQ ID NO: 3323614 - DNA, 11 bp, Homo sapiens
caggagcctgg

SEQ ID NO: 3323615 - DNA, 15 bp, Homo sapiens
caggagcgcaagata

SEQ ID NO: 3323616 - DNA, 15 bp, Homo sapiens
caggagctcttcagg

SEQ ID NO: 3323617 - DNA, 16 bp, Homo sapiens
caggagcttttttaca

SEQ ID NO: 3323618 - DNA, 18 bp, Homo sapiens
caggaggcaagcaagctc

SEQ ID NO: 3323619 - DNA, 16 bp, Homo sapiens
caggaggccaataaaa

SEQ ID NO: 3323620 - DNA, 17 bp, Homo sapiens
caggaggcgcccttggc

SEQ ID NO: 3323621 - DNA, 22 bp, Homo sapiens
caggaggcgcccttggcttctg

SEQ ID NO: 3323622 - DNA, 19 bp, Homo sapiens
caggaggcggcccggccag

SEQ ID NO: 3323623 - DNA, 21 bp, Homo sapiens
caggaggcggcccggccagcg

SEQ ID NO: 3323624 - DNA, 22 bp, Homo sapiens
caggaggcggcccggccagcgg

SEQ ID NO: 3323625 - DNA, 14 bp, Homo sapiens
caggaggctgaggt

SEQ ID NO: 3323626 - DNA, 18 bp, Homo sapiens
caggaggctggaggaagg

SEQ ID NO: 3323627 - DNA, 22 bp, Homo sapiens
caggagggaacatttccgaata

SEQ ID NO: 3323628 - DNA, 16 bp, Homo sapiens
caggagggcatccata

SEQ ID NO: 3323629 - DNA, 24 bp, Homo sapiens
caggaggggaactgagtcacgctg

SEQ ID NO: 3323630 - DNA, 16 bp, Homo sapiens
caggaggggtctcatg

SEQ ID NO: 3323631 - DNA, 18 bp, Homo sapiens
caggaggggtctcatgtc

SEQ ID NO: 3323632 - DNA, 20 bp, Homo sapiens
caggagggtctatggggaga

SEQ ID NO: 3323633 - DNA, 17 bp, Homo sapiens
caggagggtgaggaggt

SEQ ID NO: 3323634 - DNA, 22 bp, Homo sapiens
caggaggtggctatggccaccc

SEQ ID NO: 3323635 - DNA, 20 bp, Homo sapiens
caggagtcagtctctttctg

SEQ ID NO: 3323636 - DNA, 18 bp, Homo sapiens
caggagtcagtgtctggc

SEQ ID NO: 3323637 - DNA, 19 bp, Homo sapiens
caggagtcagtgtctggct

SEQ ID NO: 3323638 - DNA, 18 bp, Homo sapiens
caggagtctctgccaccc

SEQ ID NO: 3323639 - DNA, 19 bp, Homo sapiens
caggagtctctgccaccca

SEQ ID NO: 3323640 - DNA, 21 bp, Homo sapiens
caggagtctctgccacccact

SEQ ID NO: 3323641 - DNA, 14 bp, Homo sapiens
caggagtctgtgct

SEQ ID NO: 3323642 - DNA, 16 bp, Homo sapiens
caggagtgtcctgccc

SEQ ID NO: 3323643 - DNA, 23 bp, Homo sapiens
caggagttcaataaatgtctgtt

SEQ ID NO: 3323644 - DNA, 18 bp, Homo sapiens
caggagttcgagaccagc

SEQ ID NO: 3323645 - DNA, 20 bp, Homo sapiens
caggagttcgagaccagcct

SEQ ID NO: 3323646 - DNA, 21 bp, Homo sapiens
caggagttggagaccaggcct

SEQ ID NO: 3323647 - DNA, 22 bp, Homo sapiens
caggagtttaagaccagcctgg

SEQ ID NO: 3323648 - DNA, 21 bp, Homo sapiens
caggagtttgagacaagccct

SEQ ID NO: 3323649 - DNA, 18 bp, Homo sapiens
caggagtttgaggctgca

SEQ ID NO: 3323650 - DNA, 21 bp, Homo sapiens
caggagtttgaggctgcagcg

SEQ ID NO: 3323651 - DNA, 22 bp, Homo sapiens
caggagtttgaggctgcagcga

SEQ ID NO: 3323652 - DNA, 19 bp, Homo sapiens
cagataattcatttgtatt

SEQ ID NO: 3323653 - DNA, 21 bp, Homo sapiens
cagataattctggaccagaga

SEQ ID NO: 3323654 - DNA, 13 bp, Homo sapiens
cagatacatcact

SEQ ID NO: 3323655 - DNA, 15 bp, Homo sapiens
cagatacatcactgc

SEQ ID NO: 3323656 - DNA, 15 bp, Homo sapiens
cagatacatttccct

SEQ ID NO: 3323657 - DNA, 22 bp, Homo sapiens
cagataccttatcttacaatat

SEQ ID NO: 3323658 - DNA, 20 bp, Homo sapiens
cagatacgtagttgtgcttt

SEQ ID NO: 3323659 - DNA, 22 bp, Homo sapiens
cagatactggaagttttgcatt

SEQ ID NO: 3323660 - DNA, 14 bp, Homo sapiens
cagatataagagaa

SEQ ID NO: 3323661 - DNA, 16 bp, Homo sapiens
cagatatatttttcac

SEQ ID NO: 3323662 - DNA, 19 bp, Homo sapiens
cagatatatttttcacagt

SEQ ID NO: 3323663 - DNA, 13 bp, Homo sapiens
cagatatcaaaat

SEQ ID NO: 3323664 - DNA, 15 bp, Homo sapiens
cagatatcagtgtct

SEQ ID NO: 3323665 - DNA, 18 bp, Homo sapiens
cagatatctttttcatta

SEQ ID NO: 3323666 - DNA, 15 bp, Homo sapiens
cagatattttttcag

SEQ ID NO: 3323667 - DNA, 14 bp, Homo sapiens
cagatcaagagttt

SEQ ID NO: 3323668 - DNA, 19 bp, Homo sapiens
cagatcaagagttttggag

SEQ ID NO: 3323669 - DNA, 19 bp, Homo sapiens
cagatcactgaatttataa

SEQ ID NO: 3323670 - DNA, 17 bp, Homo sapiens
cagatcagaacatgaaa

SEQ ID NO: 3323671 - DNA, 19 bp, Homo sapiens
cagatcaggcagtgtttaa

SEQ ID NO: 3323672 - DNA, 16 bp, Homo sapiens
cagatcagtgtaccat

SEQ ID NO: 3323673 - DNA, 15 bp, Homo sapiens
cagatccagactgta

SEQ ID NO: 3323674 - DNA, 12 bp, Homo sapiens
cagatcctttca

SEQ ID NO: 3323675 - DNA, 18 bp, Homo sapiens
cagatcctttttccatca

SEQ ID NO: 3323676 - DNA, 19 bp, Homo sapiens
cagatcctttttccatcat

SEQ ID NO: 3323677 - DNA, 20 bp, Homo sapiens
cagatcctttttccatcatt

SEQ ID NO: 3323678 - DNA, 23 bp, Homo sapiens
cagatcctttttccatcatttta

SEQ ID NO: 3323679 - DNA, 15 bp, Homo sapiens
cagatcgatcctgga

SEQ ID NO: 3323680 - DNA, 12 bp, Homo sapiens
cagatctgcctg

SEQ ID NO: 3323681 - DNA, 15 bp, Homo sapiens
cagatctgcctgggc

SEQ ID NO: 3323682 - DNA, 20 bp, Homo sapiens
cagatctgcctgggcctgtg

SEQ ID NO: 3323683 - DNA, 18 bp, Homo sapiens
cagatctgtgccccatgc

SEQ ID NO: 3323684 - DNA, 12 bp, Homo sapiens
cagatctgtttt

SEQ ID NO: 3323685 - DNA, 13 bp, Homo sapiens
cagatctgttttg

SEQ ID NO: 3323686 - DNA, 22 bp, Homo sapiens
cagatcttccgtggtcagagtg

SEQ ID NO: 3323687 - DNA, 15 bp, Homo sapiens
cagatctttcagaaa

SEQ ID NO: 3323688 - DNA, 17 bp, Homo sapiens
cagatgaaaatttgaga

SEQ ID NO: 3323689 - DNA, 22 bp, Homo sapiens
cagatgaactctttctggcctg

SEQ ID NO: 3323690 - DNA, 12 bp, Homo sapiens
cagatgaataaa

SEQ ID NO: 3323691 - DNA, 19 bp, Homo sapiens
cagatgaatgtatttattt

SEQ ID NO: 3323692 - DNA, 23 bp, Homo sapiens
cagatgaatgtatttatttggga

SEQ ID NO: 3323693 - DNA, 23 bp, Homo sapiens
cagatgacaaattatatttgaaa

SEQ ID NO: 3323694 - DNA, 19 bp, Homo sapiens
cagatgagaacaaagctgt

SEQ ID NO: 3323695 - DNA, 21 bp, Homo sapiens
cagatgagaacaaagctgtta

SEQ ID NO: 3323696 - DNA, 18 bp, Homo sapiens
cagatgatctctccacgg

SEQ ID NO: 3323697 - DNA, 22 bp, Homo sapiens
cagatgatgagaatttctaaaa

SEQ ID NO: 3323698 - DNA, 19 bp, Homo sapiens
cagatgcaacctcactatg

SEQ ID NO: 3323699 - DNA, 15 bp, Homo sapiens
cagatgcaatgtgct

SEQ ID NO: 3323700 - DNA, 13 bp, Homo sapiens
cagatgcaccagc

SEQ ID NO: 3323701 - DNA, 21 bp, Homo sapiens
cagctgatacttcatttaaaa

SEQ ID NO: 3323702 - DNA, 17 bp, Homo sapiens
cagctgattttaacaat

SEQ ID NO: 3323703 - DNA, 20 bp, Homo sapiens
cagctgattttaacaataac

SEQ ID NO: 3323704 - DNA, 21 bp, Homo sapiens
cagctgattttaacaataact

SEQ ID NO: 3323705 - DNA, 20 bp, Homo sapiens
cagctgcaaggtactctggt

SEQ ID NO: 3323706 - DNA, 19 bp, Homo sapiens
cagctgcaccagagcaacc

SEQ ID NO: 3323707 - DNA, 21 bp, Homo sapiens
cagctgcacctgccagcctgg

SEQ ID NO: 3323708 - DNA, 16 bp, Homo sapiens
cagctgcagctgggcc

SEQ ID NO: 3323709 - DNA, 17 bp, Homo sapiens
cagctgcagctgggccc

SEQ ID NO: 3323710 - DNA, 19 bp, Homo sapiens
cagctgcagctgggcccca

SEQ ID NO: 3323711 - DNA, 23 bp, Homo sapiens
cagctgcagctgggccccatgct

SEQ ID NO: 3323712 - DNA, 16 bp, Homo sapiens
cagctgcagctgggct

SEQ ID NO: 3323713 - DNA, 15 bp, Homo sapiens
cagctgcctctgctc

SEQ ID NO: 3323714 - DNA, 20 bp, Homo sapiens
cagctgcctctgctccctct

SEQ ID NO: 3323715 - DNA, 14 bp, Homo sapiens
cagctgcctggaga

SEQ ID NO: 3323716 - DNA, 18 bp, Homo sapiens
cagctgcctggagagggt

SEQ ID NO: 3323717 - DNA, 14 bp, Homo sapiens
cagctgcctgtgcc

SEQ ID NO: 3323718 - DNA, 18 bp, Homo sapiens
cagctgcctgtgcctgcc

SEQ ID NO: 3323719 - DNA, 22 bp, Homo sapiens
cagctgcctgtgcctgccatgg

SEQ ID NO: 3323720 - DNA, 13 bp, Homo sapiens
cagctgccttcct

SEQ ID NO: 3323721 - DNA, 22 bp, Homo sapiens
cagctgcggtccacccaggagc

SEQ ID NO: 3323722 - DNA, 16 bp, Homo sapiens
cagctgctatccccat

SEQ ID NO: 3323723 - DNA, 23 bp, Homo sapiens
cagctgctatccccatctccctg

SEQ ID NO: 3323724 - DNA, 20 bp, Homo sapiens
cagctgctatttattttcct

SEQ ID NO: 3323725 - DNA, 18 bp, Homo sapiens
cagctgctccctggcatt

SEQ ID NO: 3323726 - DNA, 16 bp, Homo sapiens
cagctgctctgcccct

SEQ ID NO: 3323727 - DNA, 20 bp, Homo sapiens
cagctgctcttagtgcccgc

SEQ ID NO: 3323728 - DNA, 22 bp, Homo sapiens
cagctgctcttagtgcccgcct

SEQ ID NO: 3323729 - DNA, 11 bp, Homo sapiens
cagctgctttt

SEQ ID NO: 3323730 - DNA, 19 bp, Homo sapiens
cagctggaagtctacctgc

SEQ ID NO: 3323731 - DNA, 22 bp, Homo sapiens
cagctggaagtctacctgctgg

SEQ ID NO: 3323732 - DNA, 15 bp, Homo sapiens
cagctggactctgca

SEQ ID NO: 3323733 - DNA, 13 bp, Homo sapiens
cagctggcctgga

SEQ ID NO: 3323734 - DNA, 19 bp, Homo sapiens
cagctgggccccatgctct

SEQ ID NO: 3323735 - DNA, 20 bp, Homo sapiens
cagctgggccccatgctctg

SEQ ID NO: 3323736 - DNA, 21 bp, Homo sapiens
cagctgggccccatgctctgc

SEQ ID NO: 3323737 - DNA, 16 bp, Homo sapiens
cagctgggctctgcaa

SEQ ID NO: 3323738 - DNA, 17 bp, Homo sapiens
cagctgggctctgcaat

SEQ ID NO: 3323739 - DNA, 18 bp, Homo sapiens
cagctggggcgtggggag

SEQ ID NO: 3323740 - DNA, 19 bp, Homo sapiens
cagctggggcgtggggagg

SEQ ID NO: 3323741 - DNA, 17 bp, Homo sapiens
cagctggttactcaggg

SEQ ID NO: 3323742 - DNA, 19 bp, Homo sapiens
cagctggttactcagggtt

SEQ ID NO: 3323743 - DNA, 21 bp, Homo sapiens
cagctggttactcagggttca

SEQ ID NO: 3323744 - DNA, 22 bp, Homo sapiens
cagctggttactcagggttcat

SEQ ID NO: 3323745 - DNA, 18 bp, Homo sapiens
cagctgtaacacagctga

SEQ ID NO: 3323746 - DNA, 20 bp, Homo sapiens
cagctgtaacacagctgaga

SEQ ID NO: 3323747 - DNA, 17 bp, Homo sapiens
cagctgtcctccctcca

SEQ ID NO: 3323748 - DNA, 18 bp, Homo sapiens
cagctgtcctccctccac

SEQ ID NO: 3323749 - DNA, 17 bp, Homo sapiens
cagctgtgagccttggc

SEQ ID NO: 3323750 - DNA, 24 bp, Homo sapiens
cagctgtgctctggacaggcatgt

SEQ ID NO: 3323751 - DNA, 12 bp, Homo sapiens
cagctgtggcag

SEQ ID NO: 3323752 - DNA, 17 bp, Homo sapiens
cagctgtggcagagtta

SEQ ID NO: 3323753 - DNA, 19 bp, Homo sapiens
cagctgtggcagagttaca

SEQ ID NO: 3323754 - DNA, 16 bp, Homo sapiens
cagctgttactttctt

SEQ ID NO: 3323755 - DNA, 14 bp, Homo sapiens
cagctgtttaagat

SEQ ID NO: 3323756 - DNA, 17 bp, Homo sapiens
cagcttaacaatgcaac

SEQ ID NO: 3323757 - DNA, 19 bp, Homo sapiens
cagcttagatttcatagtt

SEQ ID NO: 3323758 - DNA, 18 bp, Homo sapiens
cagcttatctcttttata

SEQ ID NO: 3323759 - DNA, 23 bp, Homo sapiens
cagcttatctcttttatatttgt

SEQ ID NO: 3323760 - DNA, 21 bp, Homo sapiens
cagcttatgggatccttgtct

SEQ ID NO: 3323761 - DNA, 14 bp, Homo sapiens
cagcttcaagtgcc

SEQ ID NO: 3323762 - DNA, 16 bp, Homo sapiens
cagcttcaccctgtca

SEQ ID NO: 3323763 - DNA, 14 bp, Homo sapiens
cagcttcaggcacc

SEQ ID NO: 3323764 - DNA, 18 bp, Homo sapiens
cagcttcaggcaccagca

SEQ ID NO: 3323765 - DNA, 18 bp, Homo sapiens
cagcttcatgcctttgta

SEQ ID NO: 3323766 - DNA, 20 bp, Homo sapiens
cagcttcatgcctttgtaag

SEQ ID NO: 3323767 - DNA, 20 bp, Homo sapiens
cagcttcattatctgagttg

SEQ ID NO: 3323768 - DNA, 17 bp, Homo sapiens
cagcttcatttgtgtca

SEQ ID NO: 3323769 - DNA, 14 bp, Homo sapiens
cagcttcccagcca

SEQ ID NO: 3323770 - DNA, 17 bp, Homo sapiens
cagcttccttctgggac

SEQ ID NO: 3323771 - DNA, 23 bp, Homo sapiens
cagcttcggagggcccctgcgtg

SEQ ID NO: 3323772 - DNA, 16 bp, Homo sapiens
cagcttctcctgcgcc

SEQ ID NO: 3323773 - DNA, 17 bp, Homo sapiens
cagcttctcctgcgccc

SEQ ID NO: 3323774 - DNA, 19 bp, Homo sapiens
cagcttctgccacataaaa

SEQ ID NO: 3323775 - DNA, 14 bp, Homo sapiens
cagcttctggtact

SEQ ID NO: 3323776 - DNA, 21 bp, Homo sapiens
cagcttctggtactctcctag

SEQ ID NO: 3323777 - DNA, 19 bp, Homo sapiens
cagcttcttcacaggcact

SEQ ID NO: 3323778 - DNA, 24 bp, Homo sapiens
cagcttcttgcactccttccctaa

SEQ ID NO: 3323779 - DNA, 17 bp, Homo sapiens
cagcttgacctgaggct

SEQ ID NO: 3323780 - DNA, 21 bp, Homo sapiens
cagcttgagggttgggctggt

SEQ ID NO: 3323781 - DNA, 12 bp, Homo sapiens
cagcttgagttt

SEQ ID NO: 3323782 - DNA, 17 bp, Homo sapiens
cagcttgttctgggctc

SEQ ID NO: 3323783 - DNA, 18 bp, Homo sapiens
cagctttaaactcaggga

SEQ ID NO: 3323784 - DNA, 18 bp, Homo sapiens
cagctttacacacacaga

SEQ ID NO: 3323785 - DNA, 19 bp, Homo sapiens
cagctttacatgcaattta

SEQ ID NO: 3323786 - DNA, 15 bp, Homo sapiens
cagctttcagagcca

SEQ ID NO: 3323787 - DNA, 14 bp, Homo sapiens
cagctttcagggcc

SEQ ID NO: 3323788 - DNA, 16 bp, Homo sapiens
cagctttcatgattag

SEQ ID NO: 3323789 - DNA, 17 bp, Homo sapiens
cagctttccctgcctct

SEQ ID NO: 3323790 - DNA, 23 bp, Homo sapiens
cagctttctccccgctaaggaag

SEQ ID NO: 3323791 - DNA, 19 bp, Homo sapiens
cagctttcttgctcccttc

SEQ ID NO: 3323792 - DNA, 22 bp, Homo sapiens
cagctttgactttatctcctgc

SEQ ID NO: 3323793 - DNA, 20 bp, Homo sapiens
cagctttgagaagccttcag

SEQ ID NO: 3323794 - DNA, 16 bp, Homo sapiens
cagctttgatccctga

SEQ ID NO: 3323795 - DNA, 22 bp, Homo sapiens
cagctttgctaccaaagcacct

SEQ ID NO: 3323796 - DNA, 11 bp, Homo sapiens
cagctttgtcc

SEQ ID NO: 3323797 - DNA, 14 bp, Homo sapiens
cagcttttactgtt

SEQ ID NO: 3323798 - DNA, 22 bp, Homo sapiens
cagcttttatggatgattaaat

SEQ ID NO: 3323799 - DNA, 17 bp, Homo sapiens
cagcttttctttttctg

SEQ ID NO: 3323800 - DNA, 18 bp, Homo sapiens
cagcttttgttgtttata

SEQ ID NO: 3323801 - DNA, 18 bp, Homo sapiens
cagctttttattccctgc

SEQ ID NO: 3323802 - DNA, 21 bp, Homo sapiens
caggaaaaaaaaaaaaaagac

SEQ ID NO: 3323803 - DNA, 16 bp, Homo sapiens
caggaaaagctgctga

SEQ ID NO: 3323804 - DNA, 22 bp, Homo sapiens
caggaaaaggtagcttacctga

SEQ ID NO: 3323805 - DNA, 18 bp, Homo sapiens
caggaaaccaacacccaa

SEQ ID NO: 3323806 - DNA, 15 bp, Homo sapiens
caggaaaccctggct

SEQ ID NO: 3323807 - DNA, 23 bp, Homo sapiens
caggaaactccacatctgcctta

SEQ ID NO: 3323808 - DNA, 14 bp, Homo sapiens
caggaaagccctcc

SEQ ID NO: 3323809 - DNA, 18 bp, Homo sapiens
caggaaaggcccagccac

SEQ ID NO: 3323810 - DNA, 13 bp, Homo sapiens
caggaaataaagt

SEQ ID NO: 3323811 - DNA, 22 bp, Homo sapiens
caggaacacccgactcctcaaa

SEQ ID NO: 3323812 - DNA, 20 bp, Homo sapiens
caggaacagctatgggagcc

SEQ ID NO: 3323813 - DNA, 22 bp, Homo sapiens
caggaacagctatgggagcccc

SEQ ID NO: 3323814 - DNA, 17 bp, Homo sapiens
caggcccgcaccccggc

SEQ ID NO: 3323815 - DNA, 21 bp, Homo sapiens
caggcccgcaccccggcctca

SEQ ID NO: 3323816 - DNA, 13 bp, Homo sapiens
caggcccggctcc

SEQ ID NO: 3323817 - DNA, 14 bp, Homo sapiens
caggcccggctcca

SEQ ID NO: 3323818 - DNA, 15 bp, Homo sapiens
caggcccggctccag

SEQ ID NO: 3323819 - DNA, 20 bp, Homo sapiens
caggcccggctccaggctcc

SEQ ID NO: 3323820 - DNA, 21 bp, Homo sapiens
caggcccggctccaggctcct

SEQ ID NO: 3323821 - DNA, 22 bp, Homo sapiens
caggcccggctccaggctcctt

SEQ ID NO: 3323822 - DNA, 17 bp, Homo sapiens
caggccctccatgggct

SEQ ID NO: 3323823 - DNA, 16 bp, Homo sapiens
caggccctccctgact

SEQ ID NO: 3323824 - DNA, 22 bp, Homo sapiens
caggccctgccccctcccactc

SEQ ID NO: 3323825 - DNA, 15 bp, Homo sapiens
caggccctgctcctg

SEQ ID NO: 3323826 - DNA, 17 bp, Homo sapiens
caggccctggcctcccc

SEQ ID NO: 3323827 - DNA, 18 bp, Homo sapiens
caggccctggcctcccct

SEQ ID NO: 3323828 - DNA, 16 bp, Homo sapiens
caggcccttcctctcc

SEQ ID NO: 3323829 - DNA, 19 bp, Homo sapiens
caggcccttcctctccact

SEQ ID NO: 3323830 - DNA, 21 bp, Homo sapiens
caggccctttgaagcctcagc

SEQ ID NO: 3323831 - DNA, 22 bp, Homo sapiens
caggccctttgaagcctcagct

SEQ ID NO: 3323832 - DNA, 13 bp, Homo sapiens
caggccgcagctc

SEQ ID NO: 3323833 - DNA, 16 bp, Homo sapiens
caggccggaaccacag

SEQ ID NO: 3323834 - DNA, 17 bp, Homo sapiens
caggccggaaccacagg

SEQ ID NO: 3323835 - DNA, 19 bp, Homo sapiens
caggccggaaccacagggc

SEQ ID NO: 3323836 - DNA, 21 bp, Homo sapiens
caggccggaaccacagggcca

SEQ ID NO: 3323837 - DNA, 13 bp, Homo sapiens
caggccggccagc

SEQ ID NO: 3323838 - DNA, 21 bp, Homo sapiens
caggccggccagcctcaccct

SEQ ID NO: 3323839 - DNA, 19 bp, Homo sapiens
caggcctaatctcatacct

SEQ ID NO: 3323840 - DNA, 15 bp, Homo sapiens
caggcctaggaggcc

SEQ ID NO: 3323841 - DNA, 13 bp, Homo sapiens
caggcctcacctc

SEQ ID NO: 3323842 - DNA, 23 bp, Homo sapiens
caggcctccaacgcccctgtggc

SEQ ID NO: 3323843 - DNA, 24 bp, Homo sapiens
caggcctccaacgcccctgtggcc

SEQ ID NO: 3323844 - DNA, 13 bp, Homo sapiens
caggcctccagcc

SEQ ID NO: 3323845 - DNA, 18 bp, Homo sapiens
caggcctccagcctctcc

SEQ ID NO: 3323846 - DNA, 17 bp, Homo sapiens
caggcctccagcggcgg

SEQ ID NO: 3323847 - DNA, 22 bp, Homo sapiens
caggcctccctctctcttctgc

SEQ ID NO: 3323848 - DNA, 23 bp, Homo sapiens
caggcctccctctctcttctgct

SEQ ID NO: 3323849 - DNA, 13 bp, Homo sapiens
caggcctccctgt

SEQ ID NO: 3323850 - DNA, 22 bp, Homo sapiens
caggcctctcttttccccgcct

SEQ ID NO: 3323851 - DNA, 23 bp, Homo sapiens
caggcctctcttttccccgcctg

SEQ ID NO: 3323852 - DNA, 17 bp, Homo sapiens
caggcctctgagcccaa

SEQ ID NO: 3323853 - DNA, 15 bp, Homo sapiens
caggcctctgtgtcc

SEQ ID NO: 3323854 - DNA, 22 bp, Homo sapiens
caggcctctgtgtccttccctg

SEQ ID NO: 3323855 - DNA, 12 bp, Homo sapiens
caggcctcttgg

SEQ ID NO: 3323856 - DNA, 20 bp, Homo sapiens
caggcctgaaagaggctgag

SEQ ID NO: 3323857 - DNA, 22 bp, Homo sapiens
caggcctgaaagaggctgaggc

SEQ ID NO: 3323858 - DNA, 12 bp, Homo sapiens
caggcctgcctc

SEQ ID NO: 3323859 - DNA, 17 bp, Homo sapiens
caggcctggcaagtggg

SEQ ID NO: 3323860 - DNA, 14 bp, Homo sapiens
caggcctgggtctg

SEQ ID NO: 3323861 - DNA, 12 bp, Homo sapiens
caggcctgggtt

SEQ ID NO: 3323862 - DNA, 18 bp, Homo sapiens
caggcctgtccaccctgc

SEQ ID NO: 3323863 - DNA, 12 bp, Homo sapiens
caggcctgtgtg

SEQ ID NO: 3323864 - DNA, 19 bp, Homo sapiens
caggcgatccacctgtctc

SEQ ID NO: 3323865 - DNA, 21 bp, Homo sapiens
caggcgcctggcacatttcag

SEQ ID NO: 3323866 - DNA, 15 bp, Homo sapiens
caggcgctgtgctat

SEQ ID NO: 3323867 - DNA, 21 bp, Homo sapiens
caggcgggagcggtggccctg

SEQ ID NO: 3323868 - DNA, 21 bp, Homo sapiens
caggcggggggggcgcctgga

SEQ ID NO: 3323869 - DNA, 22 bp, Homo sapiens
caggcggggggggcgcctggag

SEQ ID NO: 3323870 - DNA, 21 bp, Homo sapiens
caggcggtccccatccccacc

SEQ ID NO: 3323871 - DNA, 18 bp, Homo sapiens
caggcgtgactcagcagc

SEQ ID NO: 3323872 - DNA, 21 bp, Homo sapiens
caggcgtgactcagcagcctg

SEQ ID NO: 3323873 - DNA, 16 bp, Homo sapiens
caggcgttggtgccac

SEQ ID NO: 3323874 - DNA, 18 bp, Homo sapiens
caggctactctcctcggc

SEQ ID NO: 3323875 - DNA, 18 bp, Homo sapiens
caggctagtccggaccca

SEQ ID NO: 3323876 - DNA, 15 bp, Homo sapiens
caggctatttgttca

SEQ ID NO: 3323877 - DNA, 19 bp, Homo sapiens
caggctatttgttcagaga

SEQ ID NO: 3323878 - DNA, 16 bp, Homo sapiens
caggctcactgccagg

SEQ ID NO: 3323879 - DNA, 18 bp, Homo sapiens
caggctcactgccaggcc

SEQ ID NO: 3323880 - DNA, 17 bp, Homo sapiens
caggctccgcccttagt

SEQ ID NO: 3323881 - DNA, 14 bp, Homo sapiens
caggctccgggctt

SEQ ID NO: 3323882 - DNA, 16 bp, Homo sapiens
caggctccgggctttc

SEQ ID NO: 3323883 - DNA, 12 bp, Homo sapiens
caggctctgcac

SEQ ID NO: 3323884 - DNA, 13 bp, Homo sapiens
caggctctggccc

SEQ ID NO: 3323885 - DNA, 14 bp, Homo sapiens
caggctctggccct

SEQ ID NO: 3323886 - DNA, 18 bp, Homo sapiens
caggctctggcccttgcc

SEQ ID NO: 3323887 - DNA, 19 bp, Homo sapiens
caggctctgggctcagggc

SEQ ID NO: 3323888 - DNA, 22 bp, Homo sapiens
caggctctgggctcagggctgg

SEQ ID NO: 3323889 - DNA, 20 bp, Homo sapiens
caggctcttcctggacctga

SEQ ID NO: 3323890 - DNA, 14 bp, Homo sapiens
caggctcttctcct

SEQ ID NO: 3323891 - DNA, 12 bp, Homo sapiens
caggctgaagag

SEQ ID NO: 3323892 - DNA, 16 bp, Homo sapiens
caggctgaagagaggg

SEQ ID NO: 3323893 - DNA, 19 bp, Homo sapiens
caggctgaattacagtgaa

SEQ ID NO: 3323894 - DNA, 20 bp, Homo sapiens
caggctgagccactctcttc

SEQ ID NO: 3323895 - DNA, 14 bp, Homo sapiens
caggctgcactgca

SEQ ID NO: 3323896 - DNA, 15 bp, Homo sapiens
caggctgcactgcag

SEQ ID NO: 3323897 - DNA, 16 bp, Homo sapiens
caggctgcactgcagt

SEQ ID NO: 3323898 - DNA, 18 bp, Homo sapiens
caggctgcactgcagtga

SEQ ID NO: 3323899 - DNA, 18 bp, Homo sapiens
caggctgcccccaacact

SEQ ID NO: 3323900 - DNA, 19 bp, Homo sapiens
caggctgctaacctggaaa

SEQ ID NO: 3323901 - DNA, 15 bp, Homo sapiens
caggctgcttgggat

SEQ ID NO: 3323902 - DNA, 13 bp, Homo sapiens
caggctggcagct

SEQ ID NO: 3323903 - DNA, 13 bp, Homo sapiens
caggctggcgcag

SEQ ID NO: 3323904 - DNA, 15 bp, Homo sapiens
caggctggcgtgcag

SEQ ID NO: 3323905 - DNA, 17 bp, Homo sapiens
caggctggcgtgcagtg

SEQ ID NO: 3323906 - DNA, 17 bp, Homo sapiens
caggctgggcagcccca

SEQ ID NO: 3323907 - DNA, 19 bp, Homo sapiens
caggctgggcagccccaga

SEQ ID NO: 3323908 - DNA, 20 bp, Homo sapiens
caggctgggcagccccagag

SEQ ID NO: 3323909 - DNA, 22 bp, Homo sapiens
caggctgggcagccccagagag

SEQ ID NO: 3323910 - DNA, 11 bp, Homo sapiens
caggctgggcc

SEQ ID NO: 3323911 - DNA, 12 bp, Homo sapiens
caggctgggcca

SEQ ID NO: 3323912 - DNA, 17 bp, Homo sapiens
caggctgggccatgtcc

SEQ ID NO: 3323913 - DNA, 18 bp, Homo sapiens
caggctgggccatgtcca

SEQ ID NO: 3323914 - DNA, 23 bp, Homo sapiens
caggctgggccatgtccaaagag

SEQ ID NO: 3323915 - DNA, 14 bp, Homo sapiens
caggctgggcttca

SEQ ID NO: 3323916 - DNA, 20 bp, Homo sapiens
caggctgggcttcagtggca

SEQ ID NO: 3323917 - DNA, 23 bp, Homo sapiens
caggctgggcttcagtggcagct

SEQ ID NO: 3323918 - DNA, 17 bp, Homo sapiens
caggctggtctaaaact

SEQ ID NO: 3323919 - DNA, 13 bp, Homo sapiens
caggctggtctca

SEQ ID NO: 3323920 - DNA, 21 bp, Homo sapiens
caggctgtatcccatgagcct

SEQ ID NO: 3323921 - DNA, 16 bp, Homo sapiens
caggctgtctggccag

SEQ ID NO: 3323922 - DNA, 22 bp, Homo sapiens
caggcttcaccctgaatggttc

SEQ ID NO: 3323923 - DNA, 14 bp, Homo sapiens
caggcttccttggc

SEQ ID NO: 3323924 - DNA, 17 bp, Homo sapiens
caggcttggcaaagaag

SEQ ID NO: 3323925 - DNA, 19 bp, Homo sapiens
caggctttgtacagagtgc

SEQ ID NO: 3323926 - DNA, 15 bp, Homo sapiens
cagggaaagctccac

SEQ ID NO: 3323927 - DNA, 12 bp, Homo sapiens
cagggaaaggaa

SEQ ID NO: 3323928 - DNA, 14 bp, Homo sapiens
cagggaaaggaaaa

SEQ ID NO: 3323929 - DNA, 22 bp, Homo sapiens
cagggaaccgttattataattg

SEQ ID NO: 3323930 - DNA, 12 bp, Homo sapiens
cagggaagaggg

SEQ ID NO: 3323931 - DNA, 16 bp, Homo sapiens
cagggaagagggcagt

SEQ ID NO: 3323932 - DNA, 20 bp, Homo sapiens
cagggaagagggcagtacct

SEQ ID NO: 3323933 - DNA, 22 bp, Homo sapiens
cagggaagagggcagtacctgg

SEQ ID NO: 3323934 - DNA, 14 bp, Homo sapiens
cagggaagctggcc

SEQ ID NO: 3323935 - DNA, 17 bp, Homo sapiens
cagggaagctggccgag

SEQ ID NO: 3323936 - DNA, 12 bp, Homo sapiens
cagggaaggaaa

SEQ ID NO: 3323937 - DNA, 15 bp, Homo sapiens
cagggaaggacagga

SEQ ID NO: 3323938 - DNA, 18 bp, Homo sapiens
cagggaaggacaggaccc

SEQ ID NO: 3323939 - DNA, 19 bp, Homo sapiens
cagggaaggacttggagag

SEQ ID NO: 3323940 - DNA, 15 bp, Homo sapiens
cagggaaggcctgac

SEQ ID NO: 3323941 - DNA, 16 bp, Homo sapiens
cagggaaggcctgact

SEQ ID NO: 3323942 - DNA, 20 bp, Homo sapiens
cagggaaggtggggccctgc

SEQ ID NO: 3323943 - DNA, 16 bp, Homo sapiens
agataaagatgatcta

SEQ ID NO: 3323944 - DNA, 12 bp, Homo sapiens
agataacatttt

SEQ ID NO: 3323945 - DNA, 21 bp, Homo sapiens
agataaccagctgtaacacag

SEQ ID NO: 3323946 - DNA, 18 bp, Homo sapiens
agataacccttattccat

SEQ ID NO: 3323947 - DNA, 20 bp, Homo sapiens
agataacttactgtatatgt

SEQ ID NO: 3323948 - DNA, 21 bp, Homo sapiens
agataacttactgtatatgta

SEQ ID NO: 3323949 - DNA, 23 bp, Homo sapiens
agataacttactgtatatgtatt

SEQ ID NO: 3323950 - DNA, 20 bp, Homo sapiens
agataacttttttgagtcat

SEQ ID NO: 3323951 - DNA, 21 bp, Homo sapiens
agataacttttttgagtcatt

SEQ ID NO: 3323952 - DNA, 22 bp, Homo sapiens
agataagaatgctggttttcct

SEQ ID NO: 3323953 - DNA, 12 bp, Homo sapiens
agataagacata

SEQ ID NO: 3323954 - DNA, 16 bp, Homo sapiens
agataagcctgagcct

SEQ ID NO: 3323955 - DNA, 21 bp, Homo sapiens
agataaggactagatactact

SEQ ID NO: 3323956 - DNA, 13 bp, Homo sapiens
agataatagttta

SEQ ID NO: 3323957 - DNA, 17 bp, Homo sapiens
agataatcagcctctta

SEQ ID NO: 3323958 - DNA, 13 bp, Homo sapiens
agataatccctgt

SEQ ID NO: 3323959 - DNA, 23 bp, Homo sapiens
agataatctagaacacaggcaaa

SEQ ID NO: 3323960 - DNA, 16 bp, Homo sapiens
agataatctcagtgct

SEQ ID NO: 3323961 - DNA, 19 bp, Homo sapiens
agataatctcagtgctttc

SEQ ID NO: 3323962 - DNA, 13 bp, Homo sapiens
agataattcattt

SEQ ID NO: 3323963 - DNA, 14 bp, Homo sapiens
agataattcatttg

SEQ ID NO: 3323964 - DNA, 16 bp, Homo sapiens
agataattcatttgta

SEQ ID NO: 3323965 - DNA, 18 bp, Homo sapiens
agataattgttgaaattt

SEQ ID NO: 3323966 - DNA, 12 bp, Homo sapiens
agataatttgaa

SEQ ID NO: 3323967 - DNA, 14 bp, Homo sapiens
agatacaaattaat

SEQ ID NO: 3323968 - DNA, 18 bp, Homo sapiens
agatacaaattaatttta

SEQ ID NO: 3323969 - DNA, 19 bp, Homo sapiens
agatacaggaaaagctgct

SEQ ID NO: 3323970 - DNA, 18 bp, Homo sapiens
agataccaggttgaaaga

SEQ ID NO: 3323971 - DNA, 22 bp, Homo sapiens
agataccctacgctgtccagaa

SEQ ID NO: 3323972 - DNA, 23 bp, Homo sapiens
agataccctacgctgtccagaaa

SEQ ID NO: 3323973 - DNA, 16 bp, Homo sapiens
agatacgactttattt

SEQ ID NO: 3323974 - DNA, 19 bp, Homo sapiens
agatacgactttattttct

SEQ ID NO: 3323975 - DNA, 18 bp, Homo sapiens
agatactactttctcttt

SEQ ID NO: 3323976 - DNA, 19 bp, Homo sapiens
agatactgctactgtaatt

SEQ ID NO: 3323977 - DNA, 20 bp, Homo sapiens
agatactggaagttttgcat

SEQ ID NO: 3323978 - DNA, 20 bp, Homo sapiens
agatagaaagggtgctgcca

SEQ ID NO: 3323979 - DNA, 13 bp, Homo sapiens
agatagaatttcc

SEQ ID NO: 3323980 - DNA, 12 bp, Homo sapiens
agatagagaaat

SEQ ID NO: 3323981 - DNA, 14 bp, Homo sapiens
agatagatgacttt

SEQ ID NO: 3323982 - DNA, 14 bp, Homo sapiens
agatagctgcatgt

SEQ ID NO: 3323983 - DNA, 12 bp, Homo sapiens
agataggcctgt

SEQ ID NO: 3323984 - DNA, 13 bp, Homo sapiens
agataggctctgc

SEQ ID NO: 3323985 - DNA, 21 bp, Homo sapiens
agataggctctgcacagatgg

SEQ ID NO: 3323986 - DNA, 15 bp, Homo sapiens
agatataaatggctg

SEQ ID NO: 3323987 - DNA, 17 bp, Homo sapiens
agatataaatggctggt

SEQ ID NO: 3323988 - DNA, 16 bp, Homo sapiens
agatataatgaacaaa

SEQ ID NO: 3323989 - DNA, 13 bp, Homo sapiens
agatatatatcat

SEQ ID NO: 3323990 - DNA, 19 bp, Homo sapiens
agatatatgctctgcatgt

SEQ ID NO: 3323991 - DNA, 17 bp, Homo sapiens
agatatatttaagcctt

SEQ ID NO: 3323992 - DNA, 19 bp, Homo sapiens
agatatatttaagccttat

SEQ ID NO: 3323993 - DNA, 14 bp, Homo sapiens
agatatatttcact

SEQ ID NO: 3323994 - DNA, 16 bp, Homo sapiens
agatatatttttcaca

SEQ ID NO: 3323995 - DNA, 16 bp, Homo sapiens
agatatcagagctctt

SEQ ID NO: 3323996 - DNA, 18 bp, Homo sapiens
agatatcagagctcttaa

SEQ ID NO: 3323997 - DNA, 19 bp, Homo sapiens
agatatcatactgattttt

SEQ ID NO: 3323998 - DNA, 23 bp, Homo sapiens
agatatcatactgatttttaagt

SEQ ID NO: 3323999 - DNA, 13 bp, Homo sapiens
agatatccatctt

SEQ ID NO: 3324000 - DNA, 14 bp, Homo sapiens
agatatccatcttt

SEQ ID NO: 3324001 - DNA, 16 bp, Homo sapiens
agatatcgacttgttt

SEQ ID NO: 3324002 - DNA, 15 bp, Homo sapiens
agatatctcaatgaa

SEQ ID NO: 3324003 - DNA, 15 bp, Homo sapiens
agatatgaaagctga

SEQ ID NO: 3324004 - DNA, 17 bp, Homo sapiens
agatatgatatgtaaac

SEQ ID NO: 3324005 - DNA, 16 bp, Homo sapiens
agatatggcacttctc

SEQ ID NO: 3324006 - DNA, 13 bp, Homo sapiens
agatattaaattc

SEQ ID NO: 3324007 - DNA, 14 bp, Homo sapiens
agatattaaattct

SEQ ID NO: 3324008 - DNA, 21 bp, Homo sapiens
agatattaaattctcaaagtt

SEQ ID NO: 3324009 - DNA, 15 bp, Homo sapiens
agatattactttatc

SEQ ID NO: 3324010 - DNA, 19 bp, Homo sapiens
agatattaggggggaaagt

SEQ ID NO: 3324011 - DNA, 22 bp, Homo sapiens
agatattaggggggaaagtcat

SEQ ID NO: 3324012 - DNA, 14 bp, Homo sapiens
agatattattgctt

SEQ ID NO: 3324013 - DNA, 19 bp, Homo sapiens
agatattgatcaaatatag

SEQ ID NO: 3324014 - DNA, 13 bp, Homo sapiens
agatattgttcaa

SEQ ID NO: 3324015 - DNA, 23 bp, Homo sapiens
agatattgttcaaacaatatcat

SEQ ID NO: 3324016 - DNA, 23 bp, Homo sapiens
agatatttacatgaattgcattt

SEQ ID NO: 3324017 - DNA, 17 bp, Homo sapiens
agatatttatatatatt

SEQ ID NO: 3324018 - DNA, 19 bp, Homo sapiens
agatatttttatctttata

SEQ ID NO: 3324019 - DNA, 20 bp, Homo sapiens
agatatttttatctttatat

SEQ ID NO: 3324020 - DNA, 21 bp, Homo sapiens
agatattttttcagaaatatg

SEQ ID NO: 3324021 - DNA, 12 bp, Homo sapiens
agatcaaagatg

SEQ ID NO: 3324022 - DNA, 13 bp, Homo sapiens
agatcaaagatga

SEQ ID NO: 3324023 - DNA, 14 bp, Homo sapiens
agatcaaatagttg

SEQ ID NO: 3324024 - DNA, 14 bp, Homo sapiens
agatcaaccccttc

SEQ ID NO: 3324025 - DNA, 20 bp, Homo sapiens
agatcaagagttttggagat

SEQ ID NO: 3324026 - DNA, 12 bp, Homo sapiens
agatcacagcct

SEQ ID NO: 3324027 - DNA, 12 bp, Homo sapiens
agatggggcacc

SEQ ID NO: 3324028 - DNA, 13 bp, Homo sapiens
agatggggcacca

SEQ ID NO: 3324029 - DNA, 18 bp, Homo sapiens
agatgggggcaagaagat

SEQ ID NO: 3324030 - DNA, 12 bp, Homo sapiens
agatgggtgggg

SEQ ID NO: 3324031 - DNA, 13 bp, Homo sapiens
agatgggtggggg

SEQ ID NO: 3324032 - DNA, 21 bp, Homo sapiens
agatgggtgggggctcctggt

SEQ ID NO: 3324033 - DNA, 18 bp, Homo sapiens
agatggtaaaccagatct

SEQ ID NO: 3324034 - DNA, 12 bp, Homo sapiens
agatggtaacag

SEQ ID NO: 3324035 - DNA, 15 bp, Homo sapiens
agatggtgaaattta

SEQ ID NO: 3324036 - DNA, 22 bp, Homo sapiens
agatggtgaggctgtcagtgta

SEQ ID NO: 3324037 - DNA, 15 bp, Homo sapiens
agatggttaaacatt

SEQ ID NO: 3324038 - DNA, 17 bp, Homo sapiens
agatggttaaacatttt

SEQ ID NO: 3324039 - DNA, 18 bp, Homo sapiens
agatggttacactgttag

SEQ ID NO: 3324040 - DNA, 17 bp, Homo sapiens
agatggtttccacattt

SEQ ID NO: 3324041 - DNA, 18 bp, Homo sapiens
agatggtttgagcctgag

SEQ ID NO: 3324042 - DNA, 17 bp, Homo sapiens
agatgtaaaaggtatta

SEQ ID NO: 3324043 - DNA, 21 bp, Homo sapiens
agatgtagcaaaacgcatgga

SEQ ID NO: 3324044 - DNA, 17 bp, Homo sapiens
agatgtattgactgtac

SEQ ID NO: 3324045 - DNA, 19 bp, Homo sapiens
agatgtcagcttcccagcc

SEQ ID NO: 3324046 - DNA, 13 bp, Homo sapiens
agatgtcatcaga

SEQ ID NO: 3324047 - DNA, 12 bp, Homo sapiens
agatgtctattc

SEQ ID NO: 3324048 - DNA, 13 bp, Homo sapiens
agatgtgaaaata

SEQ ID NO: 3324049 - DNA, 22 bp, Homo sapiens
agatgtgaaaataaagcagaag

SEQ ID NO: 3324050 - DNA, 20 bp, Homo sapiens
agatgtgacccaccagtgcc

SEQ ID NO: 3324051 - DNA, 18 bp, Homo sapiens
agatgtgatattctaaga

SEQ ID NO: 3324052 - DNA, 19 bp, Homo sapiens
agatgtgatattctaagac

SEQ ID NO: 3324053 - DNA, 20 bp, Homo sapiens
agatgtgatattctaagact

SEQ ID NO: 3324054 - DNA, 16 bp, Homo sapiens
agatgtgcaaatgcaa

SEQ ID NO: 3324055 - DNA, 18 bp, Homo sapiens
agatgtgcaaatgcaagc

SEQ ID NO: 3324056 - DNA, 21 bp, Homo sapiens
agatgtggccttccatttata

SEQ ID NO: 3324057 - DNA, 15 bp, Homo sapiens
agatgtggtttttaa

SEQ ID NO: 3324058 - DNA, 17 bp, Homo sapiens
agatgtgttcctcctgc

SEQ ID NO: 3324059 - DNA, 18 bp, Homo sapiens
agatgtgttcctcctgct

SEQ ID NO: 3324060 - DNA, 14 bp, Homo sapiens
agatgttaaaataa

SEQ ID NO: 3324061 - DNA, 11 bp, Homo sapiens
agatgttctag

SEQ ID NO: 3324062 - DNA, 13 bp, Homo sapiens
agatgttgtcttg

SEQ ID NO: 3324063 - DNA, 17 bp, Homo sapiens
agatgtttaacaaatct

SEQ ID NO: 3324064 - DNA, 18 bp, Homo sapiens
agatgtttattcttctag

SEQ ID NO: 3324065 - DNA, 19 bp, Homo sapiens
agatgtttattcttctaga

SEQ ID NO: 3324066 - DNA, 21 bp, Homo sapiens
agatgtttattcttctagagt

SEQ ID NO: 3324067 - DNA, 14 bp, Homo sapiens
agatgtttcacacc

SEQ ID NO: 3324068 - DNA, 23 bp, Homo sapiens
agatgtttcacaccggaaggttt

SEQ ID NO: 3324069 - DNA, 21 bp, Homo sapiens
agatgtttccagacttccttg

SEQ ID NO: 3324070 - DNA, 22 bp, Homo sapiens
agatgttttaccgtaataatta

SEQ ID NO: 3324071 - DNA, 20 bp, Homo sapiens
agatgtttttaaaagtttca

SEQ ID NO: 3324072 - DNA, 22 bp, Homo sapiens
agatgtttttaaaagtttcaat

SEQ ID NO: 3324073 - DNA, 20 bp, Homo sapiens
agattaaaccaattataact

SEQ ID NO: 3324074 - DNA, 16 bp, Homo sapiens
agattaaaggaaggaa

SEQ ID NO: 3324075 - DNA, 18 bp, Homo sapiens
agattaaaggaaggaaaa

SEQ ID NO: 3324076 - DNA, 16 bp, Homo sapiens
agattaaatatagatt

SEQ ID NO: 3324077 - DNA, 16 bp, Homo sapiens
agattaagagccatat

SEQ ID NO: 3324078 - DNA, 14 bp, Homo sapiens
agattaatggcact

SEQ ID NO: 3324079 - DNA, 15 bp, Homo sapiens
agattaatggcactg

SEQ ID NO: 3324080 - DNA, 18 bp, Homo sapiens
agattacaggaatgaaga

SEQ ID NO: 3324081 - DNA, 22 bp, Homo sapiens
agattacaggaatgaagaactg

SEQ ID NO: 3324082 - DNA, 22 bp, Homo sapiens
agattacccaaaaactgtcttt

SEQ ID NO: 3324083 - DNA, 13 bp, Homo sapiens
agattagaaaaat

SEQ ID NO: 3324084 - DNA, 16 bp, Homo sapiens
agattagaacatttaa

SEQ ID NO: 3324085 - DNA, 16 bp, Homo sapiens
agattcaaaggttcta

SEQ ID NO: 3324086 - DNA, 17 bp, Homo sapiens
agattcaaaggttctag

SEQ ID NO: 3324087 - DNA, 18 bp, Homo sapiens
agattcaggtatgttgcc

SEQ ID NO: 3324088 - DNA, 9 bp, Homo sapiens
agattccac

SEQ ID NO: 3324089 - DNA, 19 bp, Homo sapiens
agattccagagagtggctc

SEQ ID NO: 3324090 - DNA, 21 bp, Homo sapiens
agattccattggtccaagatt

SEQ ID NO: 3324091 - DNA, 16 bp, Homo sapiens
agattccggatcctaa

SEQ ID NO: 3324092 - DNA, 20 bp, Homo sapiens
agattcctcttgcctctctc

SEQ ID NO: 3324093 - DNA, 21 bp, Homo sapiens
agattcctcttgcctctctca

SEQ ID NO: 3324094 - DNA, 14 bp, Homo sapiens
agattcctgggcct

SEQ ID NO: 3324095 - DNA, 15 bp, Homo sapiens
agattcctgggcctg

SEQ ID NO: 3324096 - DNA, 16 bp, Homo sapiens
agattcctgggcctgt

SEQ ID NO: 3324097 - DNA, 12 bp, Homo sapiens
agattctaaaga

SEQ ID NO: 3324098 - DNA, 13 bp, Homo sapiens
agattctaaagat

SEQ ID NO: 3324099 - DNA, 14 bp, Homo sapiens
agattctaatgatg

SEQ ID NO: 3324100 - DNA, 19 bp, Homo sapiens
agattctactcttgtcatt

SEQ ID NO: 3324101 - DNA, 12 bp, Homo sapiens
agattctagatc

SEQ ID NO: 3324102 - DNA, 14 bp, Homo sapiens
agattctagatcag

SEQ ID NO: 3324103 - DNA, 19 bp, Homo sapiens
agattctagccaaactatt

SEQ ID NO: 3324104 - DNA, 15 bp, Homo sapiens
agattctatagttct

SEQ ID NO: 3324105 - DNA, 16 bp, Homo sapiens
agattctatagttcta

SEQ ID NO: 3324106 - DNA, 18 bp, Homo sapiens
agattctatagttctaga

SEQ ID NO: 3324107 - DNA, 19 bp, Homo sapiens
agattctatagttctagac

SEQ ID NO: 3324108 - DNA, 21 bp, Homo sapiens
agattctctggctgtaaggct

SEQ ID NO: 3324109 - DNA, 16 bp, Homo sapiens
agattctctgtgtcta

SEQ ID NO: 3324110 - DNA, 19 bp, Homo sapiens
agattctctgtgtctaaga

SEQ ID NO: 3324111 - DNA, 22 bp, Homo sapiens
agattctctgtgtctaagattc

SEQ ID NO: 3324112 - DNA, 23 bp, Homo sapiens
agattctctgtgtctaagattct

SEQ ID NO: 3324113 - DNA, 13 bp, Homo sapiens
agattctctttaa

SEQ ID NO: 3324114 - DNA, 20 bp, Homo sapiens
agattctctttaaaaaagac

SEQ ID NO: 3324115 - DNA, 22 bp, Homo sapiens
agattctgacatttatatttgt

SEQ ID NO: 3324116 - DNA, 12 bp, Homo sapiens
agattcttttaa

SEQ ID NO: 3324117 - DNA, 21 bp, Homo sapiens
agattcttttaaattagaaaa

SEQ ID NO: 3324118 - DNA, 22 bp, Homo sapiens
agattcttttaaattagaaaat

SEQ ID NO: 3324119 - DNA, 18 bp, Homo sapiens
agattgaaaatcttgtgt

SEQ ID NO: 3324120 - DNA, 17 bp, Homo sapiens
agattgacgacaagtgc

SEQ ID NO: 3324121 - DNA, 17 bp, Homo sapiens
agattgactaactcaaa

SEQ ID NO: 3324122 - DNA, 16 bp, Homo sapiens
agattgagaaatgtgt

SEQ ID NO: 3324123 - DNA, 19 bp, Homo sapiens
agattgagaaggagagaaa

SEQ ID NO: 3324124 - DNA, 18 bp, Homo sapiens
agattgagtaagatttac

SEQ ID NO: 3324125 - DNA, 23 bp, Homo sapiens
agattgagtataaaaacttgaaa

SEQ ID NO: 3324126 - DNA, 17 bp, Homo sapiens
agattgcaacaggctgg

SEQ ID NO: 3324127 - DNA, 19 bp, Homo sapiens
agattgcaacaggctgggc

SEQ ID NO: 3324128 - DNA, 20 bp, Homo sapiens
agattgcaacaggctgggct

SEQ ID NO: 3324129 - DNA, 23 bp, Homo sapiens
agattgcaacaggctgggcttca

SEQ ID NO: 3324130 - DNA, 16 bp, Homo sapiens
agattgccccaggtct

SEQ ID NO: 3324131 - DNA, 14 bp, Homo sapiens
agattgctgaaatt

SEQ ID NO: 3324132 - DNA, 15 bp, Homo sapiens
agattgctgcaaaga

SEQ ID NO: 3324133 - DNA, 16 bp, Homo sapiens
agattgtacttagcca

SEQ ID NO: 3324134 - DNA, 22 bp, Homo sapiens
agattgtcttgcaacttcagtt

SEQ ID NO: 3324135 - DNA, 23 bp, Homo sapiens
agattgtcttgcaacttcagttt

SEQ ID NO: 3324136 - DNA, 23 bp, Homo sapiens
agattgttttatcatgacatgtt

SEQ ID NO: 3324137 - DNA, 16 bp, Homo sapiens
agatttactaaatcaa

SEQ ID NO: 3324138 - DNA, 13 bp, Homo sapiens
agatttatcttta

SEQ ID NO: 3324139 - DNA, 18 bp, Homo sapiens
agatttatctttatacag

SEQ ID NO: 3324140 - DNA, 21 bp, Homo sapiens
agatttatttttcagttccaa

SEQ ID NO: 3324141 - DNA, 13 bp, Homo sapiens
agatttcaacata

SEQ ID NO: 3324142 - DNA, 18 bp, Homo sapiens
agatttcaagaaaaaata

SEQ ID NO: 3324143 - DNA, 20 bp, Homo sapiens
agatttcatagttcagaatt

SEQ ID NO: 3324144 - DNA, 22 bp, Homo sapiens
agatttcttaaataatgcttca

SEQ ID NO: 3324145 - DNA, 15 bp, Homo sapiens
agatttcttaaatct

SEQ ID NO: 3324146 - DNA, 19 bp, Homo sapiens
agatttcttaaatctttct

SEQ ID NO: 3324147 - DNA, 16 bp, Homo sapiens
agatttgcccatttac

SEQ ID NO: 3324148 - DNA, 22 bp, Homo sapiens
agatttgcccatttacactttt

SEQ ID NO: 3324149 - DNA, 12 bp, Homo sapiens
agatttggaata

SEQ ID NO: 3324150 - DNA, 22 bp, Homo sapiens
agatttgtaattacaggaggga

SEQ ID NO: 3324151 - DNA, 13 bp, Homo sapiens
agatttgtccttt

SEQ ID NO: 3324152 - DNA, 23 bp, Homo sapiens
agatttgtccttttatttctcca

SEQ ID NO: 3324153 - DNA, 18 bp, Homo sapiens
agatttgtgaactggaag

SEQ ID NO: 3324154 - DNA, 13 bp, Homo sapiens
agatttgtgttat

SEQ ID NO: 3324155 - DNA, 22 bp, Homo sapiens
agatttgttgacagcaaaatgt

SEQ ID NO: 3324156 - DNA, 23 bp, Homo sapiens
agatttgttgacagcaaaatgtt

SEQ ID NO: 3324157 - DNA, 17 bp, Homo sapiens
agattttaattgtcatg

SEQ ID NO: 3324158 - DNA, 18 bp, Homo sapiens
agattttaatttatttgt

SEQ ID NO: 3324159 - DNA, 18 bp, Homo sapiens
agattttacaaaagatgt

SEQ ID NO: 3324160 - DNA, 14 bp, Homo sapiens
agattttaggtgtt

SEQ ID NO: 3324161 - DNA, 15 bp, Homo sapiens
agattttaggtgttg

SEQ ID NO: 3324162 - DNA, 13 bp, Homo sapiens
agattttattgta

SEQ ID NO: 3324163 - DNA, 14 bp, Homo sapiens
agattttatttgta

SEQ ID NO: 3324164 - DNA, 18 bp, Homo sapiens
agattttatttgtaattt

SEQ ID NO: 3324165 - DNA, 14 bp, Homo sapiens
agattttattttac

SEQ ID NO: 3324166 - DNA, 20 bp, Homo sapiens
agattttcctcttgtgattt

SEQ ID NO: 3324167 - DNA, 22 bp, Homo sapiens
agattttctgggcctaaaggat

SEQ ID NO: 3324168 - DNA, 16 bp, Homo sapiens
agattttctggttcta

SEQ ID NO: 3324169 - DNA, 18 bp, Homo sapiens
agattttctggttctaac

SEQ ID NO: 3324170 - DNA, 14 bp, Homo sapiens
agattttgaatgct

SEQ ID NO: 3324171 - DNA, 23 bp, Homo sapiens
agattttgttttgttggacattt

SEQ ID NO: 3324172 - DNA, 19 bp, Homo sapiens
agatttttaaaaaatattt

SEQ ID NO: 3324173 - DNA, 21 bp, Homo sapiens
agatttttaaaaaatattttc

SEQ ID NO: 3324174 - DNA, 13 bp, Homo sapiens
agattttttttaa

SEQ ID NO: 3324175 - DNA, 15 bp, Homo sapiens
agcaaaaaaggaaaa

SEQ ID NO: 3324176 - DNA, 13 bp, Homo sapiens
agcaaaaaatgaa

SEQ ID NO: 3324177 - DNA, 20 bp, Homo sapiens
agcaaaaaatgaatgtctaa

SEQ ID NO: 3324178 - DNA, 21 bp, Homo sapiens
agcaaaaatctcccagtgaca

SEQ ID NO: 3324179 - DNA, 20 bp, Homo sapiens
agcaaaaatgacaacagaaa

SEQ ID NO: 3324180 - DNA, 13 bp, Homo sapiens
agcaaaagaaaaa

SEQ ID NO: 3324181 - DNA, 18 bp, Homo sapiens
agcaaaaggctgagaagg

SEQ ID NO: 3324182 - DNA, 17 bp, Homo sapiens
agcaaaataaggaagag

SEQ ID NO: 3324183 - DNA, 19 bp, Homo sapiens
agcaaaattgatgtgttta

SEQ ID NO: 3324184 - DNA, 11 bp, Homo sapiens
agcaaaccatt

SEQ ID NO: 3324185 - DNA, 12 bp, Homo sapiens
agcaaaccatta

SEQ ID NO: 3324186 - DNA, 23 bp, Homo sapiens
agcaaaccatttttaaagtagaa

SEQ ID NO: 3324187 - DNA, 18 bp, Homo sapiens
agcaaaccgccctgcagc

SEQ ID NO: 3324188 - DNA, 19 bp, Homo sapiens
agcaaactaacttgacttt

SEQ ID NO: 3324189 - DNA, 17 bp, Homo sapiens
agcaaactcttttccca

SEQ ID NO: 3324190 - DNA, 22 bp, Homo sapiens
agcaaagaggactcgcttgtaa

SEQ ID NO: 3324191 - DNA, 23 bp, Homo sapiens
agcaaagaggactcgcttgtaaa

SEQ ID NO: 3324192 - DNA, 12 bp, Homo sapiens
agcaaagatcaa

SEQ ID NO: 3324193 - DNA, 22 bp, Homo sapiens
agcaaatcatctgcattcctga

SEQ ID NO: 3324194 - DNA, 13 bp, Homo sapiens
agcaacaaagagc

SEQ ID NO: 3324195 - DNA, 13 bp, Homo sapiens
agcaacatggctt

SEQ ID NO: 3324196 - DNA, 14 bp, Homo sapiens
agcaacatggcttt

SEQ ID NO: 3324197 - DNA, 22 bp, Homo sapiens
agcaacccctgtacccagctcc

SEQ ID NO: 3324198 - DNA, 18 bp, Homo sapiens
agcaacctgggtccaaat

SEQ ID NO: 3324199 - DNA, 20 bp, Homo sapiens
agcaacctgggtccaaataa

SEQ ID NO: 3324200 - DNA, 22 bp, Homo sapiens
agcaacctttcacctttgtgta

SEQ ID NO: 3324201 - DNA, 17 bp, Homo sapiens
agcaacgcttgtagaac

SEQ ID NO: 3324202 - DNA, 20 bp, Homo sapiens
agcaactcttgattatccat

SEQ ID NO: 3324203 - DNA, 18 bp, Homo sapiens
agcaactgttatgaaata

SEQ ID NO: 3324204 - DNA, 21 bp, Homo sapiens
agcaactgttatgaaataaag

SEQ ID NO: 3324205 - DNA, 16 bp, Homo sapiens
agcaacttcttctcca

SEQ ID NO: 3324206 - DNA, 20 bp, Homo sapiens
agcaacttgtctttttctgg

SEQ ID NO: 3324207 - DNA, 21 bp, Homo sapiens
agcaacttgtctttttctgga

SEQ ID NO: 3324208 - DNA, 11 bp, Homo sapiens
agcaagaaata

SEQ ID NO: 3324209 - DNA, 18 bp, Homo sapiens
agcaagaaataaatcaga

SEQ ID NO: 3324210 - DNA, 21 bp, Homo sapiens
agcaagaataaaaaagaaatc

SEQ ID NO: 3324211 - DNA, 22 bp, Homo sapiens
agcaagagagagagagaatgag

SEQ ID NO: 3324212 - DNA, 22 bp, Homo sapiens
agcaagaggcaagctgaaattt

SEQ ID NO: 3324213 - DNA, 16 bp, Homo sapiens
agcaagagggaacaaa

SEQ ID NO: 3324214 - DNA, 20 bp, Homo sapiens
agcaagcatttatgtttatt

SEQ ID NO: 3324215 - DNA, 13 bp, Homo sapiens
agcaagccctact

SEQ ID NO: 3324216 - DNA, 15 bp, Homo sapiens
agcaagcgggagccc

SEQ ID NO: 3324217 - DNA, 12 bp, Homo sapiens
agcaagctggcc

SEQ ID NO: 3324218 - DNA, 12 bp, Homo sapiens
agcaaggcaggt

SEQ ID NO: 3324219 - DNA, 16 bp, Homo sapiens
agcaaggcaggttgga

SEQ ID NO: 3324220 - DNA, 15 bp, Homo sapiens
agcaaggccctgctg

SEQ ID NO: 3324221 - DNA, 17 bp, Homo sapiens
agcaaggccctgctgcc

SEQ ID NO: 3324222 - DNA, 18 bp, Homo sapiens
agcaaggccctgctgccc

SEQ ID NO: 3324223 - DNA, 19 bp, Homo sapiens
agcaagggaccttcatgcc

SEQ ID NO: 3324224 - DNA, 16 bp, Homo sapiens
agcaagggagaaaaga

SEQ ID NO: 3324225 - DNA, 20 bp, Homo sapiens
agcaagggagaaaagagaaa

SEQ ID NO: 3324226 - DNA, 21 bp, Homo sapiens
agcaagggagaaaagagaaac

SEQ ID NO: 3324227 - DNA, 16 bp, Homo sapiens
agcaaggggctctgcc

SEQ ID NO: 3324228 - DNA, 14 bp, Homo sapiens
agcaagggggccca

SEQ ID NO: 3324229 - DNA, 20 bp, Homo sapiens
agcaaggtcatttcttcagt

SEQ ID NO: 3324230 - DNA, 20 bp, Homo sapiens
agcaagtagataaatatttg

SEQ ID NO: 3324231 - DNA, 20 bp, Homo sapiens
agcaagtcttaacaaaccaa

SEQ ID NO: 3324232 - DNA, 15 bp, Homo sapiens
agcaagttcgtctgt

SEQ ID NO: 3324233 - DNA, 13 bp, Homo sapiens
agcaataaataac

SEQ ID NO: 3324234 - DNA, 14 bp, Homo sapiens
agcaataaataaca

SEQ ID NO: 3324235 - DNA, 21 bp, Homo sapiens
agcaataaataacacttgtca

SEQ ID NO: 3324236 - DNA, 13 bp, Homo sapiens
agcaataaatgaa

SEQ ID NO: 3324237 - DNA, 19 bp, Homo sapiens
agcaataatggtcccatcc

SEQ ID NO: 3324238 - DNA, 23 bp, Homo sapiens
agcaataatggtcccatccaggc

SEQ ID NO: 3324239 - DNA, 14 bp, Homo sapiens
agcaataattgttt

SEQ ID NO: 3324240 - DNA, 17 bp, Homo sapiens
agcaataattgtttcca

SEQ ID NO: 3324241 - DNA, 21 bp, Homo sapiens
agcaatatttaacaatttatt

SEQ ID NO: 3324242 - DNA, 18 bp, Homo sapiens
agcaatctccttactgtg

SEQ ID NO: 3324243 - DNA, 16 bp, Homo sapiens
agcaatctgcatttta

SEQ ID NO: 3324244 - DNA, 19 bp, Homo sapiens
agcaatgacatctcagggg

SEQ ID NO: 3324245 - DNA, 20 bp, Homo sapiens
agcaatgacatctcaggggc

SEQ ID NO: 3324246 - DNA, 20 bp, Homo sapiens
agcaatgccatttcagtggc

SEQ ID NO: 3324247 - DNA, 23 bp, Homo sapiens
agcaatgccatttcagtggcttc

SEQ ID NO: 3324248 - DNA, 23 bp, Homo sapiens
agcaatggtgtcagtatccaggc

SEQ ID NO: 3324249 - DNA, 13 bp, Homo sapiens
agcaatgtgagtc

SEQ ID NO: 3324250 - DNA, 15 bp, Homo sapiens
agcaatgtgagtccc

SEQ ID NO: 3324251 - DNA, 21 bp, Homo sapiens
agcaatgtgagtcccagagcc

SEQ ID NO: 3324252 - DNA, 22 bp, Homo sapiens
agcaatgtgagtcccagagccc

SEQ ID NO: 3324253 - DNA, 20 bp, Homo sapiens
agcaattccatgctataaaa

SEQ ID NO: 3324254 - DNA, 22 bp, Homo sapiens
agcaattctcctgcctcagcct

SEQ ID NO: 3324255 - DNA, 23 bp, Homo sapiens
agcaattctcctgcctcagcctc

SEQ ID NO: 3324256 - DNA, 14 bp, Homo sapiens
agcaattgccctgt

SEQ ID NO: 3324257 - DNA, 13 bp, Homo sapiens
agcaatttctaat

SEQ ID NO: 3324258 - DNA, 14 bp, Homo sapiens
agcaattttctttg

SEQ ID NO: 3324259 - DNA, 11 bp, Homo sapiens
agcacaaaatt

SEQ ID NO: 3324260 - DNA, 15 bp, Homo sapiens
agcacaaaattcaaa

SEQ ID NO: 3324261 - DNA, 22 bp, Homo sapiens
agcacaaaattcaaagcatgga

SEQ ID NO: 3324262 - DNA, 18 bp, Homo sapiens
agcacaagaagcgtgaga

SEQ ID NO: 3324263 - DNA, 18 bp, Homo sapiens
agcacaagcgtgtttcta

SEQ ID NO: 3324264 - DNA, 15 bp, Homo sapiens
agcacaccagccgct

SEQ ID NO: 3324265 - DNA, 22 bp, Homo sapiens
agcacagattttaattgtcatg

SEQ ID NO: 3324266 - DNA, 12 bp, Homo sapiens
agcacagcccag

SEQ ID NO: 3324267 - DNA, 14 bp, Homo sapiens
agcacagcccaggg

SEQ ID NO: 3324268 - DNA, 12 bp, Homo sapiens
agcacagccctg

SEQ ID NO: 3324269 - DNA, 18 bp, Homo sapiens
agcacagcttagatttca

SEQ ID NO: 3324270 - DNA, 13 bp, Homo sapiens
agcacaggagaca

SEQ ID NO: 3324271 - DNA, 15 bp, Homo sapiens
agcacaggcagctgg

SEQ ID NO: 3324272 - DNA, 22 bp, Homo sapiens
agcacagggacacaaagaggaa

SEQ ID NO: 3324273 - DNA, 12 bp, Homo sapiens
agcacagggcag

SEQ ID NO: 3324274 - DNA, 16 bp, Homo sapiens
agcacagggcaggggt

SEQ ID NO: 3324275 - DNA, 15 bp, Homo sapiens
agcacaggggcccca

SEQ ID NO: 3324276 - DNA, 16 bp, Homo sapiens
agcacaggggccccag

SEQ ID NO: 3324277 - DNA, 20 bp, Homo sapiens
agcacaggggccccagatct

SEQ ID NO: 3324278 - DNA, 19 bp, Homo sapiens
agcacagtgttaaatgaaa

SEQ ID NO: 3324279 - DNA, 11 bp, Homo sapiens
agcacatacat

SEQ ID NO: 3324280 - DNA, 15 bp, Homo sapiens
agcacatacattaaa

SEQ ID NO: 3324281 - DNA, 15 bp, Homo sapiens
agcacatctgcattt

SEQ ID NO: 3324282 - DNA, 14 bp, Homo sapiens
agcacatgatcatg

SEQ ID NO: 3324283 - DNA, 15 bp, Homo sapiens
agcacatgctggcca

SEQ ID NO: 3324284 - DNA, 22 bp, Homo sapiens
agcacatgcttagcttatcttt

SEQ ID NO: 3324285 - DNA, 21 bp, Homo sapiens
agcacatgtaataaattcaaa

SEQ ID NO: 3324286 - DNA, 22 bp, Homo sapiens
agcaccaaaagcttaccaaggg

SEQ ID NO: 3324287 - DNA, 14 bp, Homo sapiens
agcacccagagcac

SEQ ID NO: 3324288 - DNA, 22 bp, Homo sapiens
agcacccagagcaccccctgct

SEQ ID NO: 3324289 - DNA, 21 bp, Homo sapiens
agcacccatttcaatgtgtat

SEQ ID NO: 3324290 - DNA, 18 bp, Homo sapiens
agcacccccacccacctc

SEQ ID NO: 3324291 - DNA, 13 bp, Homo sapiens
agcaccccctgct

SEQ ID NO: 3324292 - DNA, 12 bp, Homo sapiens
agcaccccttcc

SEQ ID NO: 3324293 - DNA, 14 bp, Homo sapiens
agcaccccttccat

SEQ ID NO: 3324294 - DNA, 13 bp, Homo sapiens
agcaccctccccc

SEQ ID NO: 3324295 - DNA, 12 bp, Homo sapiens
agcaccctctcc

SEQ ID NO: 3324296 - DNA, 14 bp, Homo sapiens
agcaccctctcctg

SEQ ID NO: 3324297 - DNA, 19 bp, Homo sapiens
agcaccctctcctgggggt

SEQ ID NO: 3324298 - DNA, 23 bp, Homo sapiens
agcacctactatgtgctgggtgc

SEQ ID NO: 3324299 - DNA, 18 bp, Homo sapiens
agcacctagtccagtgac

SEQ ID NO: 3324300 - DNA, 15 bp, Homo sapiens
agcacctccaggcct

SEQ ID NO: 3324301 - DNA, 17 bp, Homo sapiens
agcacctccaggcctgt

SEQ ID NO: 3324302 - DNA, 14 bp, Homo sapiens
agcacctcctgcct

SEQ ID NO: 3324303 - DNA, 19 bp, Homo sapiens
agcacctccttgtcacttt

SEQ ID NO: 3324304 - DNA, 15 bp, Homo sapiens
agcacctgaacccca

SEQ ID NO: 3324305 - DNA, 21 bp, Homo sapiens
agcacctgaaccccatgggct

SEQ ID NO: 3324306 - DNA, 21 bp, Homo sapiens
agcacctgcctcctcgttcct

SEQ ID NO: 3324307 - DNA, 15 bp, Homo sapiens
agcaccttcctcact

SEQ ID NO: 3324308 - DNA, 15 bp, Homo sapiens
agcaccttctttctg

SEQ ID NO: 3324309 - DNA, 19 bp, Homo sapiens
agcaccttctttctggact

SEQ ID NO: 3324310 - DNA, 22 bp, Homo sapiens
agcaccttctttctggactggc

SEQ ID NO: 3324311 - DNA, 22 bp, Homo sapiens
agcacctttcaaccaggcacct

SEQ ID NO: 3324312 - DNA, 18 bp, Homo sapiens
agcacgaaatgttatttt

SEQ ID NO: 3324313 - DNA, 17 bp, Homo sapiens
agcacggacaataaacc

SEQ ID NO: 3324314 - DNA, 21 bp, Homo sapiens
agcacgtaaatgcgtccctgt

SEQ ID NO: 3324315 - DNA, 20 bp, Homo sapiens
agcactaaaaagttgaacca

SEQ ID NO: 3324316 - DNA, 17 bp, Homo sapiens
agcactaaggccgtgtc

SEQ ID NO: 3324317 - DNA, 19 bp, Homo sapiens
agcactagacatgtcatgg

SEQ ID NO: 3324318 - DNA, 23 bp, Homo sapiens
agcactagacatgtcatggtcct

SEQ ID NO: 3324319 - DNA, 13 bp, Homo sapiens
agcactagagaat

SEQ ID NO: 3324320 - DNA, 16 bp, Homo sapiens
agcactagtttgatta

SEQ ID NO: 3324321 - DNA, 22 bp, Homo sapiens
agcactagtttgattattatgt

SEQ ID NO: 3324322 - DNA, 18 bp, Homo sapiens
agcactcacgccctaagc

SEQ ID NO: 3324323 - DNA, 20 bp, Homo sapiens
agcactccccagagctgtgc

SEQ ID NO: 3324324 - DNA, 20 bp, Homo sapiens
agcactccccttgccttccc

SEQ ID NO: 3324325 - DNA, 16 bp, Homo sapiens
agcactcctgcttaat

SEQ ID NO: 3324326 - DNA, 20 bp, Homo sapiens
agcactcctgcttaatcttc

SEQ ID NO: 3324327 - DNA, 22 bp, Homo sapiens
agcactgaaaataccatcaggc

SEQ ID NO: 3324328 - DNA, 12 bp, Homo sapiens
agcactgacctg

SEQ ID NO: 3324329 - DNA, 22 bp, Homo sapiens
agcactggagtgcagggaggag

SEQ ID NO: 3324330 - DNA, 23 bp, Homo sapiens
agcactggagtgcagggaggaga

SEQ ID NO: 3324331 - DNA, 16 bp, Homo sapiens
agcactggccagagag

SEQ ID NO: 3324332 - DNA, 17 bp, Homo sapiens
agcactggccagagagg

SEQ ID NO: 3324333 - DNA, 20 bp, Homo sapiens
agcactggctctctccagga

SEQ ID NO: 3324334 - DNA, 20 bp, Homo sapiens
agcactggtgtgaactcacc

SEQ ID NO: 3324335 - DNA, 12 bp, Homo sapiens
agcactgtccct

SEQ ID NO: 3324336 - DNA, 16 bp, Homo sapiens
agcactgtcccttgcc

SEQ ID NO: 3324337 - DNA, 19 bp, Homo sapiens
agagggctctgtgctgaca

SEQ ID NO: 3324338 - DNA, 11 bp, Homo sapiens
agagggctgga

SEQ ID NO: 3324339 - DNA, 12 bp, Homo sapiens
agaggggaagga

SEQ ID NO: 3324340 - DNA, 20 bp, Homo sapiens
agaggggaataatagaagaa

SEQ ID NO: 3324341 - DNA, 23 bp, Homo sapiens
agaggggatggggatagaggaaa

SEQ ID NO: 3324342 - DNA, 13 bp, Homo sapiens
agaggggcagccc

SEQ ID NO: 3324343 - DNA, 19 bp, Homo sapiens
agaggggcagcccttgctt

SEQ ID NO: 3324344 - DNA, 14 bp, Homo sapiens
agaggggcagccgc

SEQ ID NO: 3324345 - DNA, 20 bp, Homo sapiens
agaggggcagccgctaggag

SEQ ID NO: 3324346 - DNA, 14 bp, Homo sapiens
agaggggccaggcc

SEQ ID NO: 3324347 - DNA, 13 bp, Homo sapiens
agaggggccgctg

SEQ ID NO: 3324348 - DNA, 18 bp, Homo sapiens
agaggggctttctggaga

SEQ ID NO: 3324349 - DNA, 13 bp, Homo sapiens
agagggggctctc

SEQ ID NO: 3324350 - DNA, 23 bp, Homo sapiens
agaggggtgcacccactcaccag

SEQ ID NO: 3324351 - DNA, 19 bp, Homo sapiens
agaggggtggagactgctt

SEQ ID NO: 3324352 - DNA, 15 bp, Homo sapiens
agagggtagggcaca

SEQ ID NO: 3324353 - DNA, 23 bp, Homo sapiens
agagggtctcgctgtcactggct

SEQ ID NO: 3324354 - DNA, 20 bp, Homo sapiens
agagggtggtgacctctgcc

SEQ ID NO: 3324355 - DNA, 23 bp, Homo sapiens
agagggttttaggtagaaaaaca

SEQ ID NO: 3324356 - DNA, 16 bp, Homo sapiens
agaggtaacagaacag

SEQ ID NO: 3324357 - DNA, 22 bp, Homo sapiens
agaggtaacagaacagcttcag

SEQ ID NO: 3324358 - DNA, 16 bp, Homo sapiens
agaggtccagcccatc

SEQ ID NO: 3324359 - DNA, 18 bp, Homo sapiens
agaggtccagcccatctc

SEQ ID NO: 3324360 - DNA, 17 bp, Homo sapiens
agaggtctccccatccc

SEQ ID NO: 3324361 - DNA, 18 bp, Homo sapiens
agaggtctccccatcccc

SEQ ID NO: 3324362 - DNA, 13 bp, Homo sapiens
agaggtctgagcc

SEQ ID NO: 3324363 - DNA, 14 bp, Homo sapiens
agaggtctgagccc

SEQ ID NO: 3324364 - DNA, 16 bp, Homo sapiens
agaggtgaaaatgaag

SEQ ID NO: 3324365 - DNA, 21 bp, Homo sapiens
agaggtgaaaatgaagaagga

SEQ ID NO: 3324366 - DNA, 16 bp, Homo sapiens
agaggtgcttcaccct

SEQ ID NO: 3324367 - DNA, 13 bp, Homo sapiens
agaggtggccaga

SEQ ID NO: 3324368 - DNA, 14 bp, Homo sapiens
agaggtgggagggc

SEQ ID NO: 3324369 - DNA, 12 bp, Homo sapiens
agaggtgggcag

SEQ ID NO: 3324370 - DNA, 13 bp, Homo sapiens
agaggtgggcagc

SEQ ID NO: 3324371 - DNA, 20 bp, Homo sapiens
agaggtgggcagctgggccc

SEQ ID NO: 3324372 - DNA, 21 bp, Homo sapiens
agaggtgggccagtctgtgga

SEQ ID NO: 3324373 - DNA, 16 bp, Homo sapiens
agaggttaaggtgcaa

SEQ ID NO: 3324374 - DNA, 21 bp, Homo sapiens
agaggttatctgcctggcctg

SEQ ID NO: 3324375 - DNA, 20 bp, Homo sapiens
agaggttgggcttccatgcc

SEQ ID NO: 3324376 - DNA, 22 bp, Homo sapiens
agaggtttgactagatgatgga

SEQ ID NO: 3324377 - DNA, 16 bp, Homo sapiens
agaggttttgttgttt

SEQ ID NO: 3324378 - DNA, 15 bp, Homo sapiens
agagtaaataaactg

SEQ ID NO: 3324379 - DNA, 22 bp, Homo sapiens
agagtaaataaactgtttatat

SEQ ID NO: 3324380 - DNA, 14 bp, Homo sapiens
agagtactgggaga

SEQ ID NO: 3324381 - DNA, 14 bp, Homo sapiens
agagtagaaataaa

SEQ ID NO: 3324382 - DNA, 15 bp, Homo sapiens
agagtagaaataaaa

SEQ ID NO: 3324383 - DNA, 14 bp, Homo sapiens
agagtatgaacacc

SEQ ID NO: 3324384 - DNA, 21 bp, Homo sapiens
agagtcaactacacaaagcag

SEQ ID NO: 3324385 - DNA, 18 bp, Homo sapiens
agagtcagccttccccct

SEQ ID NO: 3324386 - DNA, 13 bp, Homo sapiens
agagtcatatttt

SEQ ID NO: 3324387 - DNA, 17 bp, Homo sapiens
agagtcatattttgatt

SEQ ID NO: 3324388 - DNA, 12 bp, Homo sapiens
agagtcatgtga

SEQ ID NO: 3324389 - DNA, 22 bp, Homo sapiens
agagtcatgtgagcctcgtgtc

SEQ ID NO: 3324390 - DNA, 15 bp, Homo sapiens
agagtcccactgcct

SEQ ID NO: 3324391 - DNA, 20 bp, Homo sapiens
agagtcccactgcctcaggt

SEQ ID NO: 3324392 - DNA, 22 bp, Homo sapiens
agagtcccccctcccacctcca

SEQ ID NO: 3324393 - DNA, 21 bp, Homo sapiens
agagtccttgcaaaattgtct

SEQ ID NO: 3324394 - DNA, 19 bp, Homo sapiens
agagtcgttggagactgaa

SEQ ID NO: 3324395 - DNA, 13 bp, Homo sapiens
agagtctaaagat

SEQ ID NO: 3324396 - DNA, 17 bp, Homo sapiens
agagtctaaagatggag

SEQ ID NO: 3324397 - DNA, 22 bp, Homo sapiens
agagtctaaagatggagtttct

SEQ ID NO: 3324398 - DNA, 22 bp, Homo sapiens
agagtctagattcaaaggttct

SEQ ID NO: 3324399 - DNA, 15 bp, Homo sapiens
agagtctagattctc

SEQ ID NO: 3324400 - DNA, 17 bp, Homo sapiens
agagtctagcactcatt

SEQ ID NO: 3324401 - DNA, 22 bp, Homo sapiens
agagtctcactgttgcccaggc

SEQ ID NO: 3324402 - DNA, 21 bp, Homo sapiens
agagtctcagaaactcccctg

SEQ ID NO: 3324403 - DNA, 13 bp, Homo sapiens
agagtctgggcct

SEQ ID NO: 3324404 - DNA, 16 bp, Homo sapiens
agagtctgggcctctg

SEQ ID NO: 3324405 - DNA, 22 bp, Homo sapiens
agagtcttacaatcaaatctcc

SEQ ID NO: 3324406 - DNA, 23 bp, Homo sapiens
agagtgaaaccatgactgtgacc

SEQ ID NO: 3324407 - DNA, 18 bp, Homo sapiens
agagtgactccaagaaca

SEQ ID NO: 3324408 - DNA, 17 bp, Homo sapiens
agagtgacttattttgt

SEQ ID NO: 3324409 - DNA, 22 bp, Homo sapiens
agagtgacttattttgtcttat

SEQ ID NO: 3324410 - DNA, 16 bp, Homo sapiens
agagtgagactctgtc

SEQ ID NO: 3324411 - DNA, 19 bp, Homo sapiens
agagtgagactctgtctca

SEQ ID NO: 3324412 - DNA, 14 bp, Homo sapiens
agagtgagagggca

SEQ ID NO: 3324413 - DNA, 22 bp, Homo sapiens
agagtgagctacagagccgagc

SEQ ID NO: 3324414 - DNA, 22 bp, Homo sapiens
agagtgatagtcttttgctttt

SEQ ID NO: 3324415 - DNA, 15 bp, Homo sapiens
agagtgcacagctgt

SEQ ID NO: 3324416 - DNA, 18 bp, Homo sapiens
agagtgccactgcgggag

SEQ ID NO: 3324417 - DNA, 14 bp, Homo sapiens
agagtgctggactg

SEQ ID NO: 3324418 - DNA, 13 bp, Homo sapiens
agagtggaaggac

SEQ ID NO: 3324419 - DNA, 15 bp, Homo sapiens
agagtggaaggactg

SEQ ID NO: 3324420 - DNA, 22 bp, Homo sapiens
agagtggaaggactgtggctgc

SEQ ID NO: 3324421 - DNA, 15 bp, Homo sapiens
agagtggactgcatt

SEQ ID NO: 3324422 - DNA, 12 bp, Homo sapiens
agagtggcctcc

SEQ ID NO: 3324423 - DNA, 16 bp, Homo sapiens
agagtggcctccctgc

SEQ ID NO: 3324424 - DNA, 11 bp, Homo sapiens
agagtggcctg

SEQ ID NO: 3324425 - DNA, 14 bp, Homo sapiens
agagtggcctggcc

SEQ ID NO: 3324426 - DNA, 22 bp, Homo sapiens
agagtggcctggccaggagctc

SEQ ID NO: 3324427 - DNA, 23 bp, Homo sapiens
actggctccatgattctctgagt

SEQ ID NO: 3324428 - DNA, 20 bp, Homo sapiens
actggctctccaagtgccag

SEQ ID NO: 3324429 - DNA, 14 bp, Homo sapiens
actggctctctcca

SEQ ID NO: 3324430 - DNA, 23 bp, Homo sapiens
actggctctctccaggatccaga

SEQ ID NO: 3324431 - DNA, 13 bp, Homo sapiens
actggctctggga

SEQ ID NO: 3324432 - DNA, 18 bp, Homo sapiens
actggctggcctgagcaa

SEQ ID NO: 3324433 - DNA, 16 bp, Homo sapiens
actggctggctgcagt

SEQ ID NO: 3324434 - DNA, 11 bp, Homo sapiens
actggctgggg

SEQ ID NO: 3324435 - DNA, 14 bp, Homo sapiens
actggctggggcag

SEQ ID NO: 3324436 - DNA, 15 bp, Homo sapiens
actggctggggcaga

SEQ ID NO: 3324437 - DNA, 17 bp, Homo sapiens
actggctggggcagagg

SEQ ID NO: 3324438 - DNA, 17 bp, Homo sapiens
actggctgtctgcctgt

SEQ ID NO: 3324439 - DNA, 23 bp, Homo sapiens
actgggaagataggctctgcaca

SEQ ID NO: 3324440 - DNA, 14 bp, Homo sapiens
actgggagtcagag

SEQ ID NO: 3324441 - DNA, 17 bp, Homo sapiens
actgggagtcagagccc

SEQ ID NO: 3324442 - DNA, 18 bp, Homo sapiens
actgggagtcagagccct

SEQ ID NO: 3324443 - DNA, 21 bp, Homo sapiens
actgggagtcagagccctggc

SEQ ID NO: 3324444 - DNA, 18 bp, Homo sapiens
actgggataactgatttc

SEQ ID NO: 3324445 - DNA, 14 bp, Homo sapiens
actgggccacggag

SEQ ID NO: 3324446 - DNA, 14 bp, Homo sapiens
actgggccagccct

SEQ ID NO: 3324447 - DNA, 23 bp, Homo sapiens
actgggctgggcctcgtgcgccc

SEQ ID NO: 3324448 - DNA, 16 bp, Homo sapiens
actggggactttattt

SEQ ID NO: 3324449 - DNA, 17 bp, Homo sapiens
actggggagcccgtctc

SEQ ID NO: 3324450 - DNA, 21 bp, Homo sapiens
actggggagcccgtctcagtg

SEQ ID NO: 3324451 - DNA, 21 bp, Homo sapiens
actggggcctacagctttgat

SEQ ID NO: 3324452 - DNA, 13 bp, Homo sapiens
actggggcctcca

SEQ ID NO: 3324453 - DNA, 22 bp, Homo sapiens
actggggctggggtgagagagg

SEQ ID NO: 3324454 - DNA, 20 bp, Homo sapiens
actggggctttgccttgcag

SEQ ID NO: 3324455 - DNA, 16 bp, Homo sapiens
actggggtggcctcaa

SEQ ID NO: 3324456 - DNA, 20 bp, Homo sapiens
actgggtaaaagcagggcag

SEQ ID NO: 3324457 - DNA, 18 bp, Homo sapiens
actgggtacttgtggaca

SEQ ID NO: 3324458 - DNA, 21 bp, Homo sapiens
actgggtgttgatcttacaag

SEQ ID NO: 3324459 - DNA, 17 bp, Homo sapiens
actgggttaatggctag

SEQ ID NO: 3324460 - DNA, 14 bp, Homo sapiens
actgggttcttgtt

SEQ ID NO: 3324461 - DNA, 18 bp, Homo sapiens
actgggtttcaagaaaat

SEQ ID NO: 3324462 - DNA, 20 bp, Homo sapiens
actgggtttggaccccagct

SEQ ID NO: 3324463 - DNA, 17 bp, Homo sapiens
actggtatgaataattg

SEQ ID NO: 3324464 - DNA, 18 bp, Homo sapiens
actggtatgtaaaagaaa

SEQ ID NO: 3324465 - DNA, 15 bp, Homo sapiens
actggtcctgtgtgc

SEQ ID NO: 3324466 - DNA, 20 bp, Homo sapiens
actggtcctgtgtgcagtga

SEQ ID NO: 3324467 - DNA, 20 bp, Homo sapiens
actggtggcccgacagcctg

SEQ ID NO: 3324468 - DNA, 17 bp, Homo sapiens
actggtgggcagctgag

SEQ ID NO: 3324469 - DNA, 17 bp, Homo sapiens
actggtggtttttgctc

SEQ ID NO: 3324470 - DNA, 16 bp, Homo sapiens
agccaggaggcctgct

SEQ ID NO: 3324471 - DNA, 19 bp, Homo sapiens
agccaggaggcctgctagg

SEQ ID NO: 3324472 - DNA, 16 bp, Homo sapiens
agccaggagtctgtgc

SEQ ID NO: 3324473 - DNA, 21 bp, Homo sapiens
agccaggagtctgtgctcttt

SEQ ID NO: 3324474 - DNA, 14 bp, Homo sapiens
agccaggatcatgg

SEQ ID NO: 3324475 - DNA, 14 bp, Homo sapiens
agccaggatgccca

SEQ ID NO: 3324476 - DNA, 22 bp, Homo sapiens
agccaggcctgggtctgtgtct

SEQ ID NO: 3324477 - DNA, 15 bp, Homo sapiens
agccaggcgggctca

SEQ ID NO: 3324478 - DNA, 11 bp, Homo sapiens
agccaggctat

SEQ ID NO: 3324479 - DNA, 16 bp, Homo sapiens
agccaggctatggttg

SEQ ID NO: 3324480 - DNA, 18 bp, Homo sapiens
agccaggctcaggccatg

SEQ ID NO: 3324481 - DNA, 18 bp, Homo sapiens
agccagggggactagccc

SEQ ID NO: 3324482 - DNA, 23 bp, Homo sapiens
agccagggggactagcccctgtg

SEQ ID NO: 3324483 - DNA, 20 bp, Homo sapiens
agccagggggatgccactcc

SEQ ID NO: 3324484 - DNA, 12 bp, Homo sapiens
agccagggtctc

SEQ ID NO: 3324485 - DNA, 16 bp, Homo sapiens
agccagggtctctccc

SEQ ID NO: 3324486 - DNA, 21 bp, Homo sapiens
agccagggtctctccctcagg

SEQ ID NO: 3324487 - DNA, 17 bp, Homo sapiens
agccaggtacaggagag

SEQ ID NO: 3324488 - DNA, 21 bp, Homo sapiens
agccaggtacaggagaggcag

SEQ ID NO: 3324489 - DNA, 22 bp, Homo sapiens
agccaggtacaggagaggcagc

SEQ ID NO: 3324490 - DNA, 17 bp, Homo sapiens
agccaggtatggctctg

SEQ ID NO: 3324491 - DNA, 19 bp, Homo sapiens
agccaggtatggctctgca

SEQ ID NO: 3324492 - DNA, 23 bp, Homo sapiens
agccaggtgagctctgacccttg

SEQ ID NO: 3324493 - DNA, 19 bp, Homo sapiens
agccagtcttgcctaggcc

SEQ ID NO: 3324494 - DNA, 16 bp, Homo sapiens
agccagtgaaatgtga

SEQ ID NO: 3324495 - DNA, 15 bp, Homo sapiens
agccagtgacttttt

SEQ ID NO: 3324496 - DNA, 20 bp, Homo sapiens
agccagttcaaagtgtatat

SEQ ID NO: 3324497 - DNA, 13 bp, Homo sapiens
agccagttggtgg

SEQ ID NO: 3324498 - DNA, 15 bp, Homo sapiens
agccagttggtgggg

SEQ ID NO: 3324499 - DNA, 21 bp, Homo sapiens
agccagttggtggggccaggc

SEQ ID NO: 3324500 - DNA, 22 bp, Homo sapiens
agccagtttgggtaaaatactt

SEQ ID NO: 3324501 - DNA, 23 bp, Homo sapiens
agccagtttgggtaaaatacttt

SEQ ID NO: 3324502 - DNA, 21 bp, Homo sapiens
agccataaaagcattgtctct

SEQ ID NO: 3324503 - DNA, 15 bp, Homo sapiens
agccataataataat

SEQ ID NO: 3324504 - DNA, 17 bp, Homo sapiens
agccataattttgcata

SEQ ID NO: 3324505 - DNA, 22 bp, Homo sapiens
agccataattttgcatactgaa

SEQ ID NO: 3324506 - DNA, 14 bp, Homo sapiens
agccataggcccag

SEQ ID NO: 3324507 - DNA, 17 bp, Homo sapiens
agccataggcccaggat

SEQ ID NO: 3324508 - DNA, 14 bp, Homo sapiens
agccatcaaaatgc

SEQ ID NO: 3324509 - DNA, 18 bp, Homo sapiens
agccatcaaaatgctttt

SEQ ID NO: 3324510 - DNA, 18 bp, Homo sapiens
agccatcactagaagaaa

SEQ ID NO: 3324511 - DNA, 22 bp, Homo sapiens
agccatctctctactcctacct

SEQ ID NO: 3324512 - DNA, 14 bp, Homo sapiens
agccatctgcccag

SEQ ID NO: 3324513 - DNA, 15 bp, Homo sapiens
agccatctgcccagg

SEQ ID NO: 3324514 - DNA, 16 bp, Homo sapiens
agccatctgcccaggg

SEQ ID NO: 3324515 - DNA, 23 bp, Homo sapiens
agccatgaagcattaaaatgcat

SEQ ID NO: 3324516 - DNA, 22 bp, Homo sapiens
agccatgatcgagccactgcac

SEQ ID NO: 3324517 - DNA, 17 bp, Homo sapiens
agccatgatttgtccca

SEQ ID NO: 3324518 - DNA, 22 bp, Homo sapiens
agccatgatttgtcccagcctg

SEQ ID NO: 3324519 - DNA, 14 bp, Homo sapiens
agccatgcctcatg

SEQ ID NO: 3324520 - DNA, 16 bp, Homo sapiens
agccatgcctcatgcc

SEQ ID NO: 3324521 - DNA, 14 bp, Homo sapiens
agccatggctcagg

SEQ ID NO: 3324522 - DNA, 14 bp, Homo sapiens
agcactgtctcagt

SEQ ID NO: 3324523 - DNA, 15 bp, Homo sapiens
agcactgttgatgta

SEQ ID NO: 3324524 - DNA, 17 bp, Homo sapiens
agcactgttgatgtatc

SEQ ID NO: 3324525 - DNA, 18 bp, Homo sapiens
agcactgttgatgtatct

SEQ ID NO: 3324526 - DNA, 20 bp, Homo sapiens
agcactgttgatgtatctga

SEQ ID NO: 3324527 - DNA, 18 bp, Homo sapiens
agcacttacaccagtttg

SEQ ID NO: 3324528 - DNA, 15 bp, Homo sapiens
agcacttatttaatg

SEQ ID NO: 3324529 - DNA, 20 bp, Homo sapiens
agcacttcacagctggaccc

SEQ ID NO: 3324530 - DNA, 12 bp, Homo sapiens
agcacttccaaa

SEQ ID NO: 3324531 - DNA, 18 bp, Homo sapiens
agcacttccaaaattctt

SEQ ID NO: 3324532 - DNA, 23 bp, Homo sapiens
agcacttgaccttttcgacgctt

SEQ ID NO: 3324533 - DNA, 14 bp, Homo sapiens
agcacttgcgtcct

SEQ ID NO: 3324534 - DNA, 17 bp, Homo sapiens
agcacttgcgtcctgca

SEQ ID NO: 3324535 - DNA, 20 bp, Homo sapiens
agcactttgaaatacctcat

SEQ ID NO: 3324536 - DNA, 21 bp, Homo sapiens
agcactttgaaatacctcatg

SEQ ID NO: 3324537 - DNA, 11 bp, Homo sapiens
agcactttgat

SEQ ID NO: 3324538 - DNA, 21 bp, Homo sapiens
agcactttgggaggccgaggc

SEQ ID NO: 3324539 - DNA, 21 bp, Homo sapiens
agcactttgggaggctgaggc

SEQ ID NO: 3324540 - DNA, 19 bp, Homo sapiens
agcacttttgttattccat

SEQ ID NO: 3324541 - DNA, 21 bp, Homo sapiens
agcacttttgttattccatca

SEQ ID NO: 3324542 - DNA, 22 bp, Homo sapiens
agcagaaaacctgttcaggcag

SEQ ID NO: 3324543 - DNA, 22 bp, Homo sapiens
agcagaaaactggccctgccct

SEQ ID NO: 3324544 - DNA, 13 bp, Homo sapiens
agcagaaacacac

SEQ ID NO: 3324545 - DNA, 17 bp, Homo sapiens
agcagaaacacacagtc

SEQ ID NO: 3324546 - DNA, 16 bp, Homo sapiens
agcagaaacagccatt

SEQ ID NO: 3324547 - DNA, 22 bp, Homo sapiens
agcagaacaagtgcctcctgga

SEQ ID NO: 3324548 - DNA, 21 bp, Homo sapiens
agcagaacggagccccaggcc

SEQ ID NO: 3324549 - DNA, 13 bp, Homo sapiens
agcagaagacaaa

SEQ ID NO: 3324550 - DNA, 18 bp, Homo sapiens
agcagaagcagggtaccc

SEQ ID NO: 3324551 - DNA, 15 bp, Homo sapiens
agcagacagaaactg

SEQ ID NO: 3324552 - DNA, 20 bp, Homo sapiens
agcagacgtccatagctcct

SEQ ID NO: 3324553 - DNA, 17 bp, Homo sapiens
agcagaggggccaggcc

SEQ ID NO: 3324554 - DNA, 19 bp, Homo sapiens
agcagaggggccaggccca

SEQ ID NO: 3324555 - DNA, 13 bp, Homo sapiens
agcagaggtctcc

SEQ ID NO: 3324556 - DNA, 15 bp, Homo sapiens
agcagagtctgggcc

SEQ ID NO: 3324557 - DNA, 16 bp, Homo sapiens
agcagagtctgggcct

SEQ ID NO: 3324558 - DNA, 21 bp, Homo sapiens
agcagagtctgggcctctgac

SEQ ID NO: 3324559 - DNA, 16 bp, Homo sapiens
agcagagtgcacagct

SEQ ID NO: 3324560 - DNA, 15 bp, Homo sapiens
agcagagtggactgc

SEQ ID NO: 3324561 - DNA, 19 bp, Homo sapiens
agcagagtggactgcattt

SEQ ID NO: 3324562 - DNA, 12 bp, Homo sapiens
agcagagttaaa

SEQ ID NO: 3324563 - DNA, 15 bp, Homo sapiens
agcagagttttcatt

SEQ ID NO: 3324564 - DNA, 19 bp, Homo sapiens
agcagagttttcattaaat

SEQ ID NO: 3324565 - DNA, 14 bp, Homo sapiens
agcagataactttt

SEQ ID NO: 3324566 - DNA, 14 bp, Homo sapiens
agcagatggacagc

SEQ ID NO: 3324567 - DNA, 17 bp, Homo sapiens
agcagcaaaaatataaa

SEQ ID NO: 3324568 - DNA, 12 bp, Homo sapiens
agcagcagcagg

SEQ ID NO: 3324569 - DNA, 13 bp, Homo sapiens
agcagcagcaggt

SEQ ID NO: 3324570 - DNA, 20 bp, Homo sapiens
agcagcagctctgagccaga

SEQ ID NO: 3324571 - DNA, 14 bp, Homo sapiens
agcagcagggtttt

SEQ ID NO: 3324572 - DNA, 12 bp, Homo sapiens
agcagcaggtga

SEQ ID NO: 3324573 - DNA, 22 bp, Homo sapiens
agcagcagttggatcttttgaa

SEQ ID NO: 3324574 - DNA, 21 bp, Homo sapiens
agcagcatggaaaaatggttg

SEQ ID NO: 3324575 - DNA, 22 bp, Homo sapiens
agcagcatggaaaaatggttga

SEQ ID NO: 3324576 - DNA, 10 bp, Homo sapiens
agcagccagc

SEQ ID NO: 3324577 - DNA, 13 bp, Homo sapiens
agcagccagccag

SEQ ID NO: 3324578 - DNA, 13 bp, Homo sapiens
agcagccagctcc

SEQ ID NO: 3324579 - DNA, 19 bp, Homo sapiens
agcagccatcataggaagg

SEQ ID NO: 3324580 - DNA, 12 bp, Homo sapiens
agcagcccaaat

SEQ ID NO: 3324581 - DNA, 13 bp, Homo sapiens
agcagcccaaatt

SEQ ID NO: 3324582 - DNA, 13 bp, Homo sapiens
agcagcccaagct

SEQ ID NO: 3324583 - DNA, 13 bp, Homo sapiens
agcagcccagctt

SEQ ID NO: 3324584 - DNA, 17 bp, Homo sapiens
agcagccccccagcact

SEQ ID NO: 3324585 - DNA, 18 bp, Homo sapiens
agcagccccccagcacta

SEQ ID NO: 3324586 - DNA, 18 bp, Homo sapiens
agcagccctaaggatctc

SEQ ID NO: 3324587 - DNA, 16 bp, Homo sapiens
agctcaattgttaatg

SEQ ID NO: 3324588 - DNA, 18 bp, Homo sapiens
agctcaattgttaatgtg

SEQ ID NO: 3324589 - DNA, 16 bp, Homo sapiens
agctcaccagccccag

SEQ ID NO: 3324590 - DNA, 19 bp, Homo sapiens
agctcaccagccccagtgc

SEQ ID NO: 3324591 - DNA, 21 bp, Homo sapiens
agctcaccagccccagtgccc

SEQ ID NO: 3324592 - DNA, 13 bp, Homo sapiens
agctcacccctgg

SEQ ID NO: 3324593 - DNA, 20 bp, Homo sapiens
agctcacccctgggcaggcg

SEQ ID NO: 3324594 - DNA, 14 bp, Homo sapiens
agctcaccctgccc

SEQ ID NO: 3324595 - DNA, 18 bp, Homo sapiens
agctcaccctgcccgctc

SEQ ID NO: 3324596 - DNA, 19 bp, Homo sapiens
agctcaccctgcccgctcc

SEQ ID NO: 3324597 - DNA, 13 bp, Homo sapiens
agctcactgctga

SEQ ID NO: 3324598 - DNA, 13 bp, Homo sapiens
agctcacttctgg

SEQ ID NO: 3324599 - DNA, 23 bp, Homo sapiens
agctcagacttgccaggctccct

SEQ ID NO: 3324600 - DNA, 21 bp, Homo sapiens
agctcagctactgatttttgt

SEQ ID NO: 3324601 - DNA, 16 bp, Homo sapiens
agctcaggaagaagag

SEQ ID NO: 3324602 - DNA, 17 bp, Homo sapiens
agctcaggaagaagaga

SEQ ID NO: 3324603 - DNA, 15 bp, Homo sapiens
agcctgcttcccacc

SEQ ID NO: 3324604 - DNA, 22 bp, Homo sapiens
agcctgcttcccacctccctgc

SEQ ID NO: 3324605 - DNA, 16 bp, Homo sapiens
agcctggacccccagc

SEQ ID NO: 3324606 - DNA, 18 bp, Homo sapiens
agcctggacccccagctt

SEQ ID NO: 3324607 - DNA, 16 bp, Homo sapiens
agcctggcacaggact

SEQ ID NO: 3324608 - DNA, 17 bp, Homo sapiens
agcctggcccatagaaa

SEQ ID NO: 3324609 - DNA, 19 bp, Homo sapiens
agcctggcccatagaaaca

SEQ ID NO: 3324610 - DNA, 16 bp, Homo sapiens
agcctggctaacatgg

SEQ ID NO: 3324611 - DNA, 11 bp, Homo sapiens
agcctggctct

SEQ ID NO: 3324612 - DNA, 17 bp, Homo sapiens
agcctggctgcccatca

SEQ ID NO: 3324613 - DNA, 21 bp, Homo sapiens
agcctggcttctggagccctt

SEQ ID NO: 3324614 - DNA, 23 bp, Homo sapiens
agcctggcttctggagcccttgg

SEQ ID NO: 3324615 - DNA, 16 bp, Homo sapiens
agcctgggactcccag

SEQ ID NO: 3324616 - DNA, 15 bp, Homo sapiens
agcctgggagcccag

SEQ ID NO: 3324617 - DNA, 17 bp, Homo sapiens
agcctgggcagccaggc

SEQ ID NO: 3324618 - DNA, 20 bp, Homo sapiens
agcctgggcagccaggctgc

SEQ ID NO: 3324619 - DNA, 16 bp, Homo sapiens
agcctgggccagagaa

SEQ ID NO: 3324620 - DNA, 13 bp, Homo sapiens
agcctggggcctg

SEQ ID NO: 3324621 - DNA, 19 bp, Homo sapiens
agcctggggcctggcaggg

SEQ ID NO: 3324622 - DNA, 16 bp, Homo sapiens
agcctggggctccctc

SEQ ID NO: 3324623 - DNA, 15 bp, Homo sapiens
agcctggtgctgctg

SEQ ID NO: 3324624 - DNA, 17 bp, Homo sapiens
agcctggttcagaataa

SEQ ID NO: 3324625 - DNA, 18 bp, Homo sapiens
agcctggttcagaataaa

SEQ ID NO: 3324626 - DNA, 16 bp, Homo sapiens
agcctgtaagcctgca

SEQ ID NO: 3324627 - DNA, 18 bp, Homo sapiens
agcctgtaagcctgcaag

SEQ ID NO: 3324628 - DNA, 19 bp, Homo sapiens
agcctgtcccatggacact

SEQ ID NO: 3324629 - DNA, 12 bp, Homo sapiens
agcctgtgcctc

SEQ ID NO: 3324630 - DNA, 17 bp, Homo sapiens
agcctgtgcctctggga

SEQ ID NO: 3324631 - DNA, 10 bp, Homo sapiens
agcctgtgcg

SEQ ID NO: 3324632 - DNA, 17 bp, Homo sapiens
agcctgtgcgtcccagc

SEQ ID NO: 3324633 - DNA, 18 bp, Homo sapiens
agcctgtgcgtcccagct

SEQ ID NO: 3324634 - DNA, 16 bp, Homo sapiens
agcctgtgctgtggca

SEQ ID NO: 3324635 - DNA, 24 bp, Homo sapiens
agcctgtggcagtaaagagaaact

SEQ ID NO: 3324636 - DNA, 14 bp, Homo sapiens
agcctgtggcatct

SEQ ID NO: 3324637 - DNA, 22 bp, Homo sapiens
agcctgtggcatctttgccttg

SEQ ID NO: 3324638 - DNA, 17 bp, Homo sapiens
agcctgttcccctcact

SEQ ID NO: 3324639 - DNA, 22 bp, Homo sapiens
agcctgttcccctcactggatg

SEQ ID NO: 3324640 - DNA, 11 bp, Homo sapiens
agcctgtttca

SEQ ID NO: 3324641 - DNA, 14 bp, Homo sapiens
agcctgtttcttcc

SEQ ID NO: 3324642 - DNA, 20 bp, Homo sapiens
agccttaatttttttttcat

SEQ ID NO: 3324643 - DNA, 14 bp, Homo sapiens
agccttacatttgt

SEQ ID NO: 3324644 - DNA, 15 bp, Homo sapiens
agccttagctcccag

SEQ ID NO: 3324645 - DNA, 13 bp, Homo sapiens
agccttagctgcc

SEQ ID NO: 3324646 - DNA, 22 bp, Homo sapiens
agccttagggaagctggcctga

SEQ ID NO: 3324647 - DNA, 18 bp, Homo sapiens
agccttataaaccaatct

SEQ ID NO: 3324648 - DNA, 15 bp, Homo sapiens
agccttatcaagtgt

SEQ ID NO: 3324649 - DNA, 14 bp, Homo sapiens
agccttatttctag

SEQ ID NO: 3324650 - DNA, 20 bp, Homo sapiens
agccttcaaaactatagctt

SEQ ID NO: 3324651 - DNA, 24 bp, Homo sapiens
agccttcaagtgccaaacagagta

SEQ ID NO: 3324652 - DNA, 15 bp, Homo sapiens
agccttcagaatgct

SEQ ID NO: 3324653 - DNA, 21 bp, Homo sapiens
agccttcggagcgttctctgt

SEQ ID NO: 3324654 - DNA, 20 bp, Homo sapiens
agccttctgcagcaggaact

SEQ ID NO: 3324655 - DNA, 16 bp, Homo sapiens
agccttgagccctggc

SEQ ID NO: 3324656 - DNA, 17 bp, Homo sapiens
agccttgagccctggct

SEQ ID NO: 3324657 - DNA, 19 bp, Homo sapiens
agccttgagccctggctgt

SEQ ID NO: 3324658 - DNA, 21 bp, Homo sapiens
agccttgcccggattctggga

SEQ ID NO: 3324659 - DNA, 23 bp, Homo sapiens
agccttgcctaaatttaatgctg

SEQ ID NO: 3324660 - DNA, 20 bp, Homo sapiens
agccttgctagacagccagg

SEQ ID NO: 3324661 - DNA, 19 bp, Homo sapiens
agccttggcctctttcctc

SEQ ID NO: 3324662 - DNA, 12 bp, Homo sapiens
agccttggctcc

SEQ ID NO: 3324663 - DNA, 22 bp, Homo sapiens
agccttgggttccaaccaggca

SEQ ID NO: 3324664 - DNA, 15 bp, Homo sapiens
agccttgtgccctgc

SEQ ID NO: 3324665 - DNA, 19 bp, Homo sapiens
agccttgtgccctgccccc

SEQ ID NO: 3324666 - DNA, 20 bp, Homo sapiens
agccttgtgccctgccccca

SEQ ID NO: 3324667 - DNA, 19 bp, Homo sapiens
agccttgtgtatatttgta

SEQ ID NO: 3324668 - DNA, 24 bp, Homo sapiens
agccttgtgtatatttgtatatta

SEQ ID NO: 3324669 - DNA, 13 bp, Homo sapiens
agcctttaatgca

SEQ ID NO: 3324670 - DNA, 15 bp, Homo sapiens
agcctttaatgcatc

SEQ ID NO: 3324671 - DNA, 16 bp, Homo sapiens
agcctttacctgtgaa

SEQ ID NO: 3324672 - DNA, 20 bp, Homo sapiens
agcctttagtatcagtgttt

SEQ ID NO: 3324673 - DNA, 15 bp, Homo sapiens
agcctttctctcttt

SEQ ID NO: 3324674 - DNA, 21 bp, Homo sapiens
agcctttgaataaaaatgcac

SEQ ID NO: 3324675 - DNA, 20 bp, Homo sapiens
agcctttgaatgctaagaat

SEQ ID NO: 3324676 - DNA, 21 bp, Homo sapiens
agcctttggctctggagacag

SEQ ID NO: 3324677 - DNA, 23 bp, Homo sapiens
agccttttccctctttggctccc

SEQ ID NO: 3324678 - DNA, 14 bp, Homo sapiens
agcgaaacacagag

SEQ ID NO: 3324679 - DNA, 13 bp, Homo sapiens
agcgaagtagctt

SEQ ID NO: 3324680 - DNA, 17 bp, Homo sapiens
agcgacccattcagaga

SEQ ID NO: 3324681 - DNA, 22 bp, Homo sapiens
agcgaccttcctcatccacccc

SEQ ID NO: 3324682 - DNA, 16 bp, Homo sapiens
agcgactccgttggcc

SEQ ID NO: 3324683 - DNA, 17 bp, Homo sapiens
agcgactccgttggcca

SEQ ID NO: 3324684 - DNA, 21 bp, Homo sapiens
agcgactccgttggccactcc

SEQ ID NO: 3324685 - DNA, 16 bp, Homo sapiens
agcgagagtctgtctc

SEQ ID NO: 3324686 - DNA, 19 bp, Homo sapiens
agcgaggaggcgcggcctc

SEQ ID NO: 3324687 - DNA, 21 bp, Homo sapiens
agcgaggaggcgcggcctccc

SEQ ID NO: 3324688 - DNA, 16 bp, Homo sapiens
agcgagggcagctgct

SEQ ID NO: 3324689 - DNA, 17 bp, Homo sapiens
agcgagggcagctgcta

SEQ ID NO: 3324690 - DNA, 22 bp, Homo sapiens
agcgagtcatttcgttccctga

SEQ ID NO: 3324691 - DNA, 18 bp, Homo sapiens
agcgatctctcctggcct

SEQ ID NO: 3324692 - DNA, 23 bp, Homo sapiens
agcgattattatctaaagtgtgt

SEQ ID NO: 3324693 - DNA, 17 bp, Homo sapiens
agcgattcttctgcttc

SEQ ID NO: 3324694 - DNA, 22 bp, Homo sapiens
agcgattcttctgcttcagcct

SEQ ID NO: 3324695 - DNA, 12 bp, Homo sapiens
agcgcacctgcc

SEQ ID NO: 3324696 - DNA, 14 bp, Homo sapiens
agcgcacctgcccc

SEQ ID NO: 3324697 - DNA, 19 bp, Homo sapiens
agcgcaggtttagtttact

SEQ ID NO: 3324698 - DNA, 17 bp, Homo sapiens
agcgccaaatgttcatc

SEQ ID NO: 3324699 - DNA, 20 bp, Homo sapiens
agcgccaagtgcgtgccgtg

SEQ ID NO: 3324700 - DNA, 22 bp, Homo sapiens
agcgccagtgtaatcccccagg

SEQ ID NO: 3324701 - DNA, 21 bp, Homo sapiens
agcgccgtgagttctcagggc

SEQ ID NO: 3324702 - DNA, 15 bp, Homo sapiens
aggatccttccctgt

SEQ ID NO: 3324703 - DNA, 19 bp, Homo sapiens
aggatctctcaggagcaca

SEQ ID NO: 3324704 - DNA, 22 bp, Homo sapiens
aggatctctcaggagcacaggc

SEQ ID NO: 3324705 - DNA, 14 bp, Homo sapiens
aggatgaaagaaag

SEQ ID NO: 3324706 - DNA, 18 bp, Homo sapiens
aggatgaatgtatgtgca

SEQ ID NO: 3324707 - DNA, 20 bp, Homo sapiens
aggatgaatgtatgtgcact

SEQ ID NO: 3324708 - DNA, 20 bp, Homo sapiens
aggatgacctggataactta

SEQ ID NO: 3324709 - DNA, 14 bp, Homo sapiens
aggatgagagccca

SEQ ID NO: 3324710 - DNA, 23 bp, Homo sapiens
aggatgagagcccagaggtaaca

SEQ ID NO: 3324711 - DNA, 14 bp, Homo sapiens
aggatgccagcccc

SEQ ID NO: 3324712 - DNA, 20 bp, Homo sapiens
aggatgccagcccctgcctg

SEQ ID NO: 3324713 - DNA, 22 bp, Homo sapiens
aggatgccagcccctgcctggg

SEQ ID NO: 3324714 - DNA, 16 bp, Homo sapiens
aggatgctaacatcta

SEQ ID NO: 3324715 - DNA, 16 bp, Homo sapiens
aggatgctgcagcaga

SEQ ID NO: 3324716 - DNA, 15 bp, Homo sapiens
aggatgctgctgttg

SEQ ID NO: 3324717 - DNA, 21 bp, Homo sapiens
aggatgctgctgttgaagctt

SEQ ID NO: 3324718 - DNA, 12 bp, Homo sapiens
aggatgctggcc

SEQ ID NO: 3324719 - DNA, 13 bp, Homo sapiens
aggatgctgggtg

SEQ ID NO: 3324720 - DNA, 14 bp, Homo sapiens
aggatgctgggtgg

SEQ ID NO: 3324721 - DNA, 15 bp, Homo sapiens
aggatggccagtgtc

SEQ ID NO: 3324722 - DNA, 18 bp, Homo sapiens
aggatggccagtgtctgt

SEQ ID NO: 3324723 - DNA, 19 bp, Homo sapiens
aggatggccagtgtctgtc

SEQ ID NO: 3324724 - DNA, 22 bp, Homo sapiens
aggatggggctcccagctcctt

SEQ ID NO: 3324725 - DNA, 19 bp, Homo sapiens
aggatgggggctggcctct

SEQ ID NO: 3324726 - DNA, 19 bp, Homo sapiens
aggatggtggttattttaa

SEQ ID NO: 3324727 - DNA, 21 bp, Homo sapiens
aggatggtggttattttaaat

SEQ ID NO: 3324728 - DNA, 16 bp, Homo sapiens
aggatggttctgtgac

SEQ ID NO: 3324729 - DNA, 16 bp, Homo sapiens
aggatgtatattttat

SEQ ID NO: 3324730 - DNA, 21 bp, Homo sapiens
aggatgtatattttatataaa

SEQ ID NO: 3324731 - DNA, 16 bp, Homo sapiens
aggatgtcacagggcc

SEQ ID NO: 3324732 - DNA, 17 bp, Homo sapiens
aggatgtcacagggcca

SEQ ID NO: 3324733 - DNA, 20 bp, Homo sapiens
aggatgtccctgggccaggg

SEQ ID NO: 3324734 - DNA, 14 bp, Homo sapiens
aggatgtgatatat

SEQ ID NO: 3324735 - DNA, 15 bp, Homo sapiens
aggatgttctgggac

SEQ ID NO: 3324736 - DNA, 16 bp, Homo sapiens
aggattacagaaactg

SEQ ID NO: 3324737 - DNA, 18 bp, Homo sapiens
aggattacagaaactgat

SEQ ID NO: 3324738 - DNA, 23 bp, Homo sapiens
aggattacagaaactgatgccaa

SEQ ID NO: 3324739 - DNA, 13 bp, Homo sapiens
aggattattgata

SEQ ID NO: 3324740 - DNA, 14 bp, Homo sapiens
aggattattggaaa

SEQ ID NO: 3324741 - DNA, 14 bp, Homo sapiens
aggattcagccgga

SEQ ID NO: 3324742 - DNA, 14 bp, Homo sapiens
aggattcaggggct

SEQ ID NO: 3324743 - DNA, 19 bp, Homo sapiens
aggattgtaaaaaaaaatg

SEQ ID NO: 3324744 - DNA, 12 bp, Homo sapiens
aggattgtggaa

SEQ ID NO: 3324745 - DNA, 16 bp, Homo sapiens
aggatttaacagtcat

SEQ ID NO: 3324746 - DNA, 21 bp, Homo sapiens
aggatttaacagtcatttaaa

SEQ ID NO: 3324747 - DNA, 16 bp, Homo sapiens
aggatttcaagcctgc

SEQ ID NO: 3324748 - DNA, 19 bp, Homo sapiens
aggatttcatgatttcatt

SEQ ID NO: 3324749 - DNA, 20 bp, Homo sapiens
aggatttcatgatttcattt

SEQ ID NO: 3324750 - DNA, 13 bp, Homo sapiens
aggatttcgtggg

SEQ ID NO: 3324751 - DNA, 19 bp, Homo sapiens
aggattttaacaaaagcaa

SEQ ID NO: 3324752 - DNA, 14 bp, Homo sapiens
aggattttaccaaa

SEQ ID NO: 3324753 - DNA, 17 bp, Homo sapiens
aggattttaccaaagca

SEQ ID NO: 3324754 - DNA, 19 bp, Homo sapiens
aggattttaccaaagcatc

SEQ ID NO: 3324755 - DNA, 12 bp, Homo sapiens
aggatttttaga

SEQ ID NO: 3324756 - DNA, 15 bp, Homo sapiens
aggcaaaaaactctt

SEQ ID NO: 3324757 - DNA, 13 bp, Homo sapiens
aggcaaaattgca

SEQ ID NO: 3324758 - DNA, 19 bp, Homo sapiens
aggcaaaattgcaaatctt

SEQ ID NO: 3324759 - DNA, 13 bp, Homo sapiens
aggcaaatgtgta

SEQ ID NO: 3324760 - DNA, 22 bp, Homo sapiens
aggcaacttcagtcctgggaga

SEQ ID NO: 3324761 - DNA, 13 bp, Homo sapiens
aggcaagaggggt

SEQ ID NO: 3324762 - DNA, 18 bp, Homo sapiens
aggcaagcaagctctctt

SEQ ID NO: 3324763 - DNA, 14 bp, Homo sapiens
aggcaagcacctcc

SEQ ID NO: 3324764 - DNA, 18 bp, Homo sapiens
aggcaagcacctcctgcc

SEQ ID NO: 3324765 - DNA, 19 bp, Homo sapiens
aggcaagcaggacctggca

SEQ ID NO: 3324766 - DNA, 13 bp, Homo sapiens
aggcaagcccctc

SEQ ID NO: 3324767 - DNA, 15 bp, Homo sapiens
aggcaagcccctcag

SEQ ID NO: 3324768 - DNA, 18 bp, Homo sapiens
aggcaagcccctcagccc

SEQ ID NO: 3324769 - DNA, 21 bp, Homo sapiens
aggcaagcccctcagcccttg

SEQ ID NO: 3324770 - DNA, 23 bp, Homo sapiens
aggcaagcccctcagcccttgcc

SEQ ID NO: 3324771 - DNA, 22 bp, Homo sapiens
aggcaagcccttcggtcacctg

SEQ ID NO: 3324772 - DNA, 21 bp, Homo sapiens
aggcaagctgaaattttagaa

SEQ ID NO: 3324773 - DNA, 20 bp, Homo sapiens
aggcaaggcaggtgcctcca

SEQ ID NO: 3324774 - DNA, 22 bp, Homo sapiens
aggcaaggcaggtgcctccagg

SEQ ID NO: 3324775 - DNA, 15 bp, Homo sapiens
aggcaagtttgttca

SEQ ID NO: 3324776 - DNA, 14 bp, Homo sapiens
aggcaataaaaatc

SEQ ID NO: 3324777 - DNA, 14 bp, Homo sapiens
aggcaatgctggct

SEQ ID NO: 3324778 - DNA, 15 bp, Homo sapiens
aggcaatgctggctg

SEQ ID NO: 3324779 - DNA, 12 bp, Homo sapiens
aggcaattagac

SEQ ID NO: 3324780 - DNA, 22 bp, Homo sapiens
aggcacaaggttggttgctaag

SEQ ID NO: 3324781 - DNA, 17 bp, Homo sapiens
aggcacacagcagcccc

SEQ ID NO: 3324782 - DNA, 20 bp, Homo sapiens
aggcacacagggcccggcca

SEQ ID NO: 3324783 - DNA, 22 bp, Homo sapiens
aggcacagggcccgcagtgctg

SEQ ID NO: 3324784 - DNA, 14 bp, Homo sapiens
aggcacatggagga

SEQ ID NO: 3324785 - DNA, 13 bp, Homo sapiens
aggcaccagaaga

SEQ ID NO: 3324786 - DNA, 20 bp, Homo sapiens
aggcaccagcatccaccttg

SEQ ID NO: 3324787 - DNA, 20 bp, Homo sapiens
aggcaccagctctgtggcct

SEQ ID NO: 3324788 - DNA, 21 bp, Homo sapiens
aggcaccagctctgtggcctg

SEQ ID NO: 3324789 - DNA, 20 bp, Homo sapiens
aggcaccgccacgtcccagc

SEQ ID NO: 3324790 - DNA, 13 bp, Homo sapiens
aggcaccggcgct

SEQ ID NO: 3324791 - DNA, 14 bp, Homo sapiens
aggcaccggcgctg

SEQ ID NO: 3324792 - DNA, 20 bp, Homo sapiens
aggcaccggcgctgcaggta

SEQ ID NO: 3324793 - DNA, 14 bp, Homo sapiens
aggcacctcttcct

SEQ ID NO: 3324794 - DNA, 13 bp, Homo sapiens
aggcacctggcct

SEQ ID NO: 3324795 - DNA, 18 bp, Homo sapiens
aggcacctggcctgctgg

SEQ ID NO: 3324796 - DNA, 20 bp, Homo sapiens
aggcacctggcctgctggga

SEQ ID NO: 3324797 - DNA, 21 bp, Homo sapiens
aggcacctggcctgctgggaa

SEQ ID NO: 3324798 - DNA, 22 bp, Homo sapiens
aggcacctggcctgctgggaac

SEQ ID NO: 3324799 - DNA, 14 bp, Homo sapiens
aggcacgggtccct

SEQ ID NO: 3324800 - DNA, 16 bp, Homo sapiens
aggcacgggtggtccc

SEQ ID NO: 3324801 - DNA, 19 bp, Homo sapiens
aggcactcatgggtaataa

SEQ ID NO: 3324802 - DNA, 14 bp, Homo sapiens
aggcactctagatt

SEQ ID NO: 3324803 - DNA, 20 bp, Homo sapiens
aggcactgccttctcctctc

SEQ ID NO: 3324804 - DNA, 16 bp, Homo sapiens
aggcactgctgcccag

SEQ ID NO: 3324805 - DNA, 22 bp, Homo sapiens
aggcactgctgcccagcctcca

SEQ ID NO: 3324806 - DNA, 19 bp, Homo sapiens
aggcactgtagttctaaga

SEQ ID NO: 3324807 - DNA, 21 bp, Homo sapiens
aggcacttaaagccttttcct

SEQ ID NO: 3324808 - DNA, 13 bp, Homo sapiens
aggcagacagcag

SEQ ID NO: 3324809 - DNA, 23 bp, Homo sapiens
aggcagacagcaggcagcgccaa

SEQ ID NO: 3324810 - DNA, 9 bp, Homo sapiens
aggcagaga

SEQ ID NO: 3324811 - DNA, 16 bp, Homo sapiens
aggcagagacctccaa

SEQ ID NO: 3324812 - DNA, 18 bp, Homo sapiens
aggcagagctgacgggag

SEQ ID NO: 3324813 - DNA, 20 bp, Homo sapiens
aggcagagctgacgggaggc

SEQ ID NO: 3324814 - DNA, 19 bp, Homo sapiens
aggcagagtttgccttcct

SEQ ID NO: 3324815 - DNA, 15 bp, Homo sapiens
aggcagattgaaaag

SEQ ID NO: 3324816 - DNA, 16 bp, Homo sapiens
aggcagattgaaaagg

SEQ ID NO: 3324817 - DNA, 16 bp, Homo sapiens
aggcagatttgaggtt

SEQ ID NO: 3324818 - DNA, 19 bp, Homo sapiens
aggcagcatgcttgggctg

SEQ ID NO: 3324819 - DNA, 24 bp, Homo sapiens
aggcagcatgcttgggctgaccca

SEQ ID NO: 3324820 - DNA, 22 bp, Homo sapiens
aggcagccccattctgcctgcc

SEQ ID NO: 3324821 - DNA, 14 bp, Homo sapiens
aggcagccccctcc

SEQ ID NO: 3324822 - DNA, 17 bp, Homo sapiens
aggcagcctccagagcc

SEQ ID NO: 3324823 - DNA, 19 bp, Homo sapiens
aggcagcctccagagccag

SEQ ID NO: 3324824 - DNA, 20 bp, Homo sapiens
aggcagcgccaagcaacctg

SEQ ID NO: 3324825 - DNA, 21 bp, Homo sapiens
aggcagcgccaagtgcgtgcc

SEQ ID NO: 3324826 - DNA, 13 bp, Homo sapiens
aggcagctcaccc

SEQ ID NO: 3324827 - DNA, 21 bp, Homo sapiens
aggcagctcacccctgggcag

SEQ ID NO: 3324828 - DNA, 22 bp, Homo sapiens
aggcagctcacccctgggcagg

SEQ ID NO: 3324829 - DNA, 11 bp, Homo sapiens
aggcagctgcc

SEQ ID NO: 3324830 - DNA, 13 bp, Homo sapiens
aggcagctgcctc

SEQ ID NO: 3324831 - DNA, 15 bp, Homo sapiens
aggagaattgaattc

SEQ ID NO: 3324832 - DNA, 13 bp, Homo sapiens
aggagaattgctt

SEQ ID NO: 3324833 - DNA, 20 bp, Homo sapiens
aggagaattgcttgaacctg

SEQ ID NO: 3324834 - DNA, 20 bp, Homo sapiens
aggagaccaagtcctggcta

SEQ ID NO: 3324835 - DNA, 14 bp, Homo sapiens
aggagaccctggaa

SEQ ID NO: 3324836 - DNA, 23 bp, Homo sapiens
aggagagacggtgttgggagccc

SEQ ID NO: 3324837 - DNA, 11 bp, Homo sapiens
aggagagagaa

SEQ ID NO: 3324838 - DNA, 12 bp, Homo sapiens
aggagagagaaa

SEQ ID NO: 3324839 - DNA, 18 bp, Homo sapiens
aggagagagaaagccagg

SEQ ID NO: 3324840 - DNA, 11 bp, Homo sapiens
aggagagagac

SEQ ID NO: 3324841 - DNA, 15 bp, Homo sapiens
aggagagagccagga

SEQ ID NO: 3324842 - DNA, 13 bp, Homo sapiens
aggagagaggcag

SEQ ID NO: 3324843 - DNA, 18 bp, Homo sapiens
aggagagcctgctgcatg

SEQ ID NO: 3324844 - DNA, 14 bp, Homo sapiens
aggagaggagagag

SEQ ID NO: 3324845 - DNA, 16 bp, Homo sapiens
aggagaggagagaggc

SEQ ID NO: 3324846 - DNA, 13 bp, Homo sapiens
aggagaggatgag

SEQ ID NO: 3324847 - DNA, 13 bp, Homo sapiens
aggagaggcagca

SEQ ID NO: 3324848 - DNA, 16 bp, Homo sapiens
aggagaggcagcatgc

SEQ ID NO: 3324849 - DNA, 15 bp, Homo sapiens
aggagaggctgggct

SEQ ID NO: 3324850 - DNA, 22 bp, Homo sapiens
aggagaggggaagggccagtct

SEQ ID NO: 3324851 - DNA, 17 bp, Homo sapiens
aggagagtagaacagat

SEQ ID NO: 3324852 - DNA, 22 bp, Homo sapiens
aggagagttcaagcctgtggga

SEQ ID NO: 3324853 - DNA, 18 bp, Homo sapiens
aggagatatctgagggag

SEQ ID NO: 3324854 - DNA, 23 bp, Homo sapiens
aggagatatctgagggaggaggc

SEQ ID NO: 3324855 - DNA, 22 bp, Homo sapiens
aggagatccagggcaaggccat

SEQ ID NO: 3324856 - DNA, 20 bp, Homo sapiens
aggagatcgagaccatcctg

SEQ ID NO: 3324857 - DNA, 18 bp, Homo sapiens
aggagatgaccagggatg

SEQ ID NO: 3324858 - DNA, 15 bp, Homo sapiens
aggagatggagggct

SEQ ID NO: 3324859 - DNA, 21 bp, Homo sapiens
aggagattgagaaggagagaa

SEQ ID NO: 3324860 - DNA, 22 bp, Homo sapiens
aggagattgagaaggagagaaa

SEQ ID NO: 3324861 - DNA, 15 bp, Homo sapiens
aggagcaaacactga

SEQ ID NO: 3324862 - DNA, 15 bp, Homo sapiens
aggagcacaggtccc

SEQ ID NO: 3324863 - DNA, 16 bp, Homo sapiens
aggagcaggcacgggt

SEQ ID NO: 3324864 - DNA, 15 bp, Homo sapiens
aggagccaccagttc

SEQ ID NO: 3324865 - DNA, 17 bp, Homo sapiens
aggagccaccagttctc

SEQ ID NO: 3324866 - DNA, 16 bp, Homo sapiens
aggagccagacagacc

SEQ ID NO: 3324867 - DNA, 20 bp, Homo sapiens
aggagcccatactcagcctg

SEQ ID NO: 3324868 - DNA, 14 bp, Homo sapiens
aggagccccagcta

SEQ ID NO: 3324869 - DNA, 13 bp, Homo sapiens
aggagcgcaagat

SEQ ID NO: 3324870 - DNA, 19 bp, Homo sapiens
aggagcggcgccctggact

SEQ ID NO: 3324871 - DNA, 12 bp, Homo sapiens
aggagctaaggc

SEQ ID NO: 3324872 - DNA, 16 bp, Homo sapiens
aggagctaaggctcta

SEQ ID NO: 3324873 - DNA, 20 bp, Homo sapiens
aggagctcaccctgcccgct

SEQ ID NO: 3324874 - DNA, 15 bp, Homo sapiens
aggagctgaggtttc

SEQ ID NO: 3324875 - DNA, 21 bp, Homo sapiens
aggagctgaggtttcaccctt

SEQ ID NO: 3324876 - DNA, 19 bp, Homo sapiens
aggagctgatttccaggcc

SEQ ID NO: 3324877 - DNA, 20 bp, Homo sapiens
aggagctgatttccaggccc

SEQ ID NO: 3324878 - DNA, 23 bp, Homo sapiens
aggagctgatttccaggcccctg

SEQ ID NO: 3324879 - DNA, 21 bp, Homo sapiens
aggagctgccttggctcagac

SEQ ID NO: 3324880 - DNA, 13 bp, Homo sapiens
aggagctgctggc

SEQ ID NO: 3324881 - DNA, 16 bp, Homo sapiens
aggagctgctggcttg

SEQ ID NO: 3324882 - DNA, 17 bp, Homo sapiens
aggagctgctggcttgc

SEQ ID NO: 3324883 - DNA, 14 bp, Homo sapiens
aggaggaaaaggaa

SEQ ID NO: 3324884 - DNA, 19 bp, Homo sapiens
aggaggaatgctggactgg

SEQ ID NO: 3324885 - DNA, 22 bp, Homo sapiens
aggaggaatgctggactggagg

SEQ ID NO: 3324886 - DNA, 17 bp, Homo sapiens
aggaggagatggccata

SEQ ID NO: 3324887 - DNA, 15 bp, Homo sapiens
aggaggagggagaag

SEQ ID NO: 3324888 - DNA, 15 bp, Homo sapiens
aggaggagggaggcc

SEQ ID NO: 3324889 - DNA, 21 bp, Homo sapiens
aggaggatgactaacaagatt

SEQ ID NO: 3324890 - DNA, 18 bp, Homo sapiens
aggaggcacctacactca

SEQ ID NO: 3324891 - DNA, 18 bp, Homo sapiens
aggaggccaaccagcccg

SEQ ID NO: 3324892 - DNA, 19 bp, Homo sapiens
aggaggccaaccagcccga

SEQ ID NO: 3324893 - DNA, 13 bp, Homo sapiens
aggaggccaataa

SEQ ID NO: 3324894 - DNA, 18 bp, Homo sapiens
aggaggccaataaaaagt

SEQ ID NO: 3324895 - DNA, 19 bp, Homo sapiens
aggaggccacctctccaag

SEQ ID NO: 3324896 - DNA, 14 bp, Homo sapiens
aggaggccagtggg

SEQ ID NO: 3324897 - DNA, 16 bp, Homo sapiens
aggaggcctgcacagg

SEQ ID NO: 3324898 - DNA, 13 bp, Homo sapiens
aggaggcgcggcc

SEQ ID NO: 3324899 - DNA, 19 bp, Homo sapiens
aggaggcggcccggccagc

SEQ ID NO: 3324900 - DNA, 13 bp, Homo sapiens
aggaggctgaggg

SEQ ID NO: 3324901 - DNA, 12 bp, Homo sapiens
aggaggctggag

SEQ ID NO: 3324902 - DNA, 21 bp, Homo sapiens
aggaggctggaggaagggggg

SEQ ID NO: 3324903 - DNA, 22 bp, Homo sapiens
aggaggctggtgacaggccaaa

SEQ ID NO: 3324904 - DNA, 14 bp, Homo sapiens
aggagggagaagag

SEQ ID NO: 3324905 - DNA, 16 bp, Homo sapiens
aggagggagaagagaa

SEQ ID NO: 3324906 - DNA, 16 bp, Homo sapiens
aggagggagacactgg

SEQ ID NO: 3324907 - DNA, 14 bp, Homo sapiens
aggagggagaggga

SEQ ID NO: 3324908 - DNA, 15 bp, Homo sapiens
aggagggagagggag

SEQ ID NO: 3324909 - DNA, 16 bp, Homo sapiens
aggagggagccttgtg

SEQ ID NO: 3324910 - DNA, 17 bp, Homo sapiens
aggagggagccttgtga

SEQ ID NO: 3324911 - DNA, 14 bp, Homo sapiens
aggagggatgctgc

SEQ ID NO: 3324912 - DNA, 17 bp, Homo sapiens
aggagggcagagccatg

SEQ ID NO: 3324913 - DNA, 19 bp, Homo sapiens
aggagggtacagctgggct

SEQ ID NO: 3324914 - DNA, 21 bp, Homo sapiens
aggagggtggaggaaggtgct

SEQ ID NO: 3324915 - DNA, 16 bp, Homo sapiens
aggagggtttgggcag

SEQ ID NO: 3324916 - DNA, 20 bp, Homo sapiens
aggaggtggaggttgcagtg

SEQ ID NO: 3324917 - DNA, 14 bp, Homo sapiens
aggaggtggcagcc

SEQ ID NO: 3324918 - DNA, 20 bp, Homo sapiens
aggaggtggcagccctgtag

SEQ ID NO: 3324919 - DNA, 21 bp, Homo sapiens
aggaggtggcagccctgtagg

SEQ ID NO: 3324920 - DNA, 13 bp, Homo sapiens
aggaggtgtgagg

SEQ ID NO: 3324921 - DNA, 20 bp, Homo sapiens
aggaggtgtgaggaggaggc

SEQ ID NO: 3324922 - DNA, 16 bp, Homo sapiens
aggaggttggtgactg

SEQ ID NO: 3324923 - DNA, 14 bp, Homo sapiens
aggaggtttgcagg

SEQ ID NO: 3324924 - DNA, 16 bp, Homo sapiens
aggagtaaaattcagt

SEQ ID NO: 3324925 - DNA, 11 bp, Homo sapiens
aggagtaacaa

SEQ ID NO: 3324926 - DNA, 19 bp, Homo sapiens
aggagtaacaatacaaatg

SEQ ID NO: 3324927 - DNA, 21 bp, Homo sapiens
aggagtcagtctctttctgta

SEQ ID NO: 3324928 - DNA, 19 bp, Homo sapiens
aggagtctctgccacccac

SEQ ID NO: 3324929 - DNA, 13 bp, Homo sapiens
aggagtctgtgct

SEQ ID NO: 3324930 - DNA, 17 bp, Homo sapiens
aggagtctgtgctcttt

SEQ ID NO: 3324931 - DNA, 22 bp, Homo sapiens
aggagtgattgaaccagctcat

SEQ ID NO: 3324932 - DNA, 23 bp, Homo sapiens
aggagtgggttttattgtccttc

SEQ ID NO: 3324933 - DNA, 16 bp, Homo sapiens
aggagtgtgagaatca

SEQ ID NO: 3324934 - DNA, 22 bp, Homo sapiens
aggagttaaagagcagcctggc

SEQ ID NO: 3324935 - DNA, 16 bp, Homo sapiens
aggagttcgagaccag

SEQ ID NO: 3324936 - DNA, 20 bp, Homo sapiens
aggagttgagtacagtgagg

SEQ ID NO: 3324937 - DNA, 16 bp, Homo sapiens
aggagttggaatgttg

SEQ ID NO: 3324938 - DNA, 20 bp, Homo sapiens
aggagtttcctaaaagttca

SEQ ID NO: 3324939 - DNA, 21 bp, Homo sapiens
aggagtttgagaccagcttag

SEQ ID NO: 3324940 - DNA, 20 bp, Homo sapiens
aggagtttgaggctgcagcg

SEQ ID NO: 3324941 - DNA, 16 bp, Homo sapiens
aggataaggagactga

SEQ ID NO: 3324942 - DNA, 22 bp, Homo sapiens
aggataattttcctcaatcaca

SEQ ID NO: 3324943 - DNA, 18 bp, Homo sapiens
agctgactgtggccccct

SEQ ID NO: 3324944 - DNA, 13 bp, Homo sapiens
agctgactgttct

SEQ ID NO: 3324945 - DNA, 16 bp, Homo sapiens
agctgacttggcactt

SEQ ID NO: 3324946 - DNA, 18 bp, Homo sapiens
agctgagaactcctgact

SEQ ID NO: 3324947 - DNA, 19 bp, Homo sapiens
agctgagaactcctgactg

SEQ ID NO: 3324948 - DNA, 10 bp, Homo sapiens
agctgagccc

SEQ ID NO: 3324949 - DNA, 11 bp, Homo sapiens
agctgagccct

SEQ ID NO: 3324950 - DNA, 17 bp, Homo sapiens
agctgagccctggggac

SEQ ID NO: 3324951 - DNA, 18 bp, Homo sapiens
agctgagctggaaggggc

SEQ ID NO: 3324952 - DNA, 20 bp, Homo sapiens
agctgaggacacaccccaca

SEQ ID NO: 3324953 - DNA, 16 bp, Homo sapiens
agctgaggactctgca

SEQ ID NO: 3324954 - DNA, 20 bp, Homo sapiens
aggcccgctctacatcttct

SEQ ID NO: 3324955 - DNA, 15 bp, Homo sapiens
aggcccggctccagg

SEQ ID NO: 3324956 - DNA, 16 bp, Homo sapiens
aggcccggctccaggc

SEQ ID NO: 3324957 - DNA, 17 bp, Homo sapiens
aggcccggctccaggct

SEQ ID NO: 3324958 - DNA, 18 bp, Homo sapiens
aggcccggctccaggctc

SEQ ID NO: 3324959 - DNA, 20 bp, Homo sapiens
aggcccggctccaggctcct

SEQ ID NO: 3324960 - DNA, 12 bp, Homo sapiens
aggccctgccca

SEQ ID NO: 3324961 - DNA, 12 bp, Homo sapiens
aggccctgctcc

SEQ ID NO: 3324962 - DNA, 16 bp, Homo sapiens
aggccctgctcctgca

SEQ ID NO: 3324963 - DNA, 18 bp, Homo sapiens
aggccctgctcctgcagc

SEQ ID NO: 3324964 - DNA, 14 bp, Homo sapiens
aggccctgctgccc

SEQ ID NO: 3324965 - DNA, 15 bp, Homo sapiens
aggccctgctgccca

SEQ ID NO: 3324966 - DNA, 22 bp, Homo sapiens
aggccctgctttttttcttaaa

SEQ ID NO: 3324967 - DNA, 20 bp, Homo sapiens
aggccctggaggtctccagg

SEQ ID NO: 3324968 - DNA, 13 bp, Homo sapiens
aggccctgtctgt

SEQ ID NO: 3324969 - DNA, 22 bp, Homo sapiens
aggcccttgtcctgccagctgc

SEQ ID NO: 3324970 - DNA, 23 bp, Homo sapiens
aggcccttgtcctgccagctgcc

SEQ ID NO: 3324971 - DNA, 19 bp, Homo sapiens
aggccgaagctctggctga

SEQ ID NO: 3324972 - DNA, 24 bp, Homo sapiens
aggccgaagctctggctgaaccct

SEQ ID NO: 3324973 - DNA, 18 bp, Homo sapiens
aggccgagcgttcccagc

SEQ ID NO: 3324974 - DNA, 23 bp, Homo sapiens
aggccgagcgttcccagcagggg

SEQ ID NO: 3324975 - DNA, 20 bp, Homo sapiens
aggccgcagctccattttct

SEQ ID NO: 3324976 - DNA, 21 bp, Homo sapiens
aggccgcagctcttgcccttc

SEQ ID NO: 3324977 - DNA, 13 bp, Homo sapiens
aggccggccagcc

SEQ ID NO: 3324978 - DNA, 15 bp, Homo sapiens
aggccggccagcctc

SEQ ID NO: 3324979 - DNA, 22 bp, Homo sapiens
aggccgttccccttggcttcct

SEQ ID NO: 3324980 - DNA, 19 bp, Homo sapiens
aggcctaatctcatacctc

SEQ ID NO: 3324981 - DNA, 16 bp, Homo sapiens
aggcctaccccgcaga

SEQ ID NO: 3324982 - DNA, 22 bp, Homo sapiens
aggcctaccccgcagacacctt

SEQ ID NO: 3324983 - DNA, 14 bp, Homo sapiens
aggcctagactctg

SEQ ID NO: 3324984 - DNA, 15 bp, Homo sapiens
aggcctaggattcta

SEQ ID NO: 3324985 - DNA, 20 bp, Homo sapiens
aggcctaggctaggacgttg

SEQ ID NO: 3324986 - DNA, 22 bp, Homo sapiens
aggcctaggtgcagctcctcag

SEQ ID NO: 3324987 - DNA, 15 bp, Homo sapiens
aggcctcatccctcg

SEQ ID NO: 3324988 - DNA, 20 bp, Homo sapiens
aggcctcatgcctgctgaga

SEQ ID NO: 3324989 - DNA, 19 bp, Homo sapiens
aggcctccaacgcccctgt

SEQ ID NO: 3324990 - DNA, 14 bp, Homo sapiens
aggcctccagcctc

SEQ ID NO: 3324991 - DNA, 16 bp, Homo sapiens
aggcctccagcctctc

SEQ ID NO: 3324992 - DNA, 17 bp, Homo sapiens
aggcctccagcctctcc

SEQ ID NO: 3324993 - DNA, 15 bp, Homo sapiens
aggcctccctctctc

SEQ ID NO: 3324994 - DNA, 12 bp, Homo sapiens
aggcctccctgt

SEQ ID NO: 3324995 - DNA, 12 bp, Homo sapiens
aggcctcctccc

SEQ ID NO: 3324996 - DNA, 13 bp, Homo sapiens
aggcctcctcccc

SEQ ID NO: 3324997 - DNA, 23 bp, Homo sapiens
aggcctctccagtttgcacctgt

SEQ ID NO: 3324998 - DNA, 11 bp, Homo sapiens
aggcctctctt

SEQ ID NO: 3324999 - DNA, 21 bp, Homo sapiens
aggcctctcttttccccgcct

SEQ ID NO: 3325000 - DNA, 14 bp, Homo sapiens
aggcctctggccct

SEQ ID NO: 3325001 - DNA, 23 bp, Homo sapiens
aggcctctgtgtccttccctgca

SEQ ID NO: 3325002 - DNA, 16 bp, Homo sapiens
aggcctgactactgcc

SEQ ID NO: 3325003 - DNA, 18 bp, Homo sapiens
aggcctgactactgccca

SEQ ID NO: 3325004 - DNA, 19 bp, Homo sapiens
aggcctgacttctgctggc

SEQ ID NO: 3325005 - DNA, 14 bp, Homo sapiens
aggcctgaggcctg

SEQ ID NO: 3325006 - DNA, 18 bp, Homo sapiens
aggcctgaggcctgtgcc

SEQ ID NO: 3325007 - DNA, 15 bp, Homo sapiens
aggcctgatgctgcc

SEQ ID NO: 3325008 - DNA, 17 bp, Homo sapiens
aggcctgatgctgcccc

SEQ ID NO: 3325009 - DNA, 12 bp, Homo sapiens
aggcctgcacac

SEQ ID NO: 3325010 - DNA, 13 bp, Homo sapiens
aggcctgcacaca

SEQ ID NO: 3325011 - DNA, 13 bp, Homo sapiens
aggcctgcctgtt

SEQ ID NO: 3325012 - DNA, 18 bp, Homo sapiens
aggcctgctgccagtgca

SEQ ID NO: 3325013 - DNA, 17 bp, Homo sapiens
aggcctggaaccaggga

SEQ ID NO: 3325014 - DNA, 18 bp, Homo sapiens
aggcctggaaccagggag

SEQ ID NO: 3325015 - DNA, 19 bp, Homo sapiens
aggcctggaaccagggagg

SEQ ID NO: 3325016 - DNA, 17 bp, Homo sapiens
aggcctggccagatgca

SEQ ID NO: 3325017 - DNA, 13 bp, Homo sapiens
aggcctggctgga

SEQ ID NO: 3325018 - DNA, 17 bp, Homo sapiens
aggcctgggacccagct

SEQ ID NO: 3325019 - DNA, 18 bp, Homo sapiens
aggcctgggacccagcta

SEQ ID NO: 3325020 - DNA, 23 bp, Homo sapiens
aggcctgggacccagctactctg

SEQ ID NO: 3325021 - DNA, 18 bp, Homo sapiens
aggcctggggaggcccta

SEQ ID NO: 3325022 - DNA, 21 bp, Homo sapiens
aggcctggggccggtagaggc

SEQ ID NO: 3325023 - DNA, 16 bp, Homo sapiens
aggcctgggtctgtgt

SEQ ID NO: 3325024 - DNA, 21 bp, Homo sapiens
aggcctgggtctgtgtctctt

SEQ ID NO: 3325025 - DNA, 15 bp, Homo sapiens
aggcctgtgcctgtc

SEQ ID NO: 3325026 - DNA, 15 bp, Homo sapiens
aggccttcctctctc

SEQ ID NO: 3325027 - DNA, 18 bp, Homo sapiens
aggccttcctctctccag

SEQ ID NO: 3325028 - DNA, 17 bp, Homo sapiens
aggccttctctgaagga

SEQ ID NO: 3325029 - DNA, 17 bp, Homo sapiens
aggccttttaacatttt

SEQ ID NO: 3325030 - DNA, 18 bp, Homo sapiens
aggccttttaacattttg

SEQ ID NO: 3325031 - DNA, 22 bp, Homo sapiens
aggcgaccgggcctcccctcca

SEQ ID NO: 3325032 - DNA, 19 bp, Homo sapiens
aggcgagagaggagccaga

SEQ ID NO: 3325033 - DNA, 23 bp, Homo sapiens
aggcgagagaggagccagacaga

SEQ ID NO: 3325034 - DNA, 15 bp, Homo sapiens
aggcgaggagagtgg

SEQ ID NO: 3325035 - DNA, 13 bp, Homo sapiens
aggcgagtccagg

SEQ ID NO: 3325036 - DNA, 23 bp, Homo sapiens
aggcgatccacctgtctcagcct

SEQ ID NO: 3325037 - DNA, 14 bp, Homo sapiens
aggcgccccttccc

SEQ ID NO: 3325038 - DNA, 15 bp, Homo sapiens
aggcggcccggccag

SEQ ID NO: 3325039 - DNA, 20 bp, Homo sapiens
aggcggcccggccagcgggc

SEQ ID NO: 3325040 - DNA, 21 bp, Homo sapiens
aggcggcccggccagcgggca

SEQ ID NO: 3325041 - DNA, 14 bp, Homo sapiens
aggcgggaggaggt

SEQ ID NO: 3325042 - DNA, 14 bp, Homo sapiens
aggcgggccagcca

SEQ ID NO: 3325043 - DNA, 15 bp, Homo sapiens
aggcgggccagccag

SEQ ID NO: 3325044 - DNA, 15 bp, Homo sapiens
aggcgggcggtcagg

SEQ ID NO: 3325045 - DNA, 22 bp, Homo sapiens
aggcggggggggcgcctggaga

SEQ ID NO: 3325046 - DNA, 18 bp, Homo sapiens
agggaagaaggggccatc

SEQ ID NO: 3325047 - DNA, 19 bp, Homo sapiens
agggaagaaggggccatca

SEQ ID NO: 3325048 - DNA, 14 bp, Homo sapiens
agggaagagacagc

SEQ ID NO: 3325049 - DNA, 19 bp, Homo sapiens
agggaagagacagcccagg

SEQ ID NO: 3325050 - DNA, 14 bp, Homo sapiens
agggaagagggcag

SEQ ID NO: 3325051 - DNA, 16 bp, Homo sapiens
agggaagagggcagta

SEQ ID NO: 3325052 - DNA, 13 bp, Homo sapiens
agggaagagtttt

SEQ ID NO: 3325053 - DNA, 19 bp, Homo sapiens
agggaagcactgcctccct

SEQ ID NO: 3325054 - DNA, 13 bp, Homo sapiens
agggaaggacaga

SEQ ID NO: 3325055 - DNA, 14 bp, Homo sapiens
agggaaggacagga

SEQ ID NO: 3325056 - DNA, 22 bp, Homo sapiens
agggaaggacaggaccctcagg

SEQ ID NO: 3325057 - DNA, 21 bp, Homo sapiens
agggaaggggaggcagccggc

SEQ ID NO: 3325058 - DNA, 22 bp, Homo sapiens
agggaaggtggggccctgcccc

SEQ ID NO: 3325059 - DNA, 22 bp, Homo sapiens
agggaagtgtgagcgccttggt

SEQ ID NO: 3325060 - DNA, 15 bp, Homo sapiens
agggaatccaagcct

SEQ ID NO: 3325061 - DNA, 16 bp, Homo sapiens
agggaatccccgaagg

SEQ ID NO: 3325062 - DNA, 20 bp, Homo sapiens
agggaatccccgaaggtgct

SEQ ID NO: 3325063 - DNA, 15 bp, Homo sapiens
agggaatcctcctcc

SEQ ID NO: 3325064 - DNA, 22 bp, Homo sapiens
agggaatctaatatccccaaat

SEQ ID NO: 3325065 - DNA, 16 bp, Homo sapiens
agggaatctggattat

SEQ ID NO: 3325066 - DNA, 23 bp, Homo sapiens
agggaatgttccctgcaccctgg

SEQ ID NO: 3325067 - DNA, 15 bp, Homo sapiens
agggaatttcaggaa

SEQ ID NO: 3325068 - DNA, 21 bp, Homo sapiens
agggacagcccactgagaagt

SEQ ID NO: 3325069 - DNA, 18 bp, Homo sapiens
agggacaggctgaagaga

SEQ ID NO: 3325070 - DNA, 16 bp, Homo sapiens
agggaccaactgggcc

SEQ ID NO: 3325071 - DNA, 17 bp, Homo sapiens
agggaccaactgggccc

SEQ ID NO: 3325072 - DNA, 21 bp, Homo sapiens
agggaccaaggcaaggcaggt

SEQ ID NO: 3325073 - DNA, 18 bp, Homo sapiens
agggaccactgggtgaga

SEQ ID NO: 3325074 - DNA, 13 bp, Homo sapiens
agggaccatgtgt

SEQ ID NO: 3325075 - DNA, 22 bp, Homo sapiens
agggactacccatagacatgaa

SEQ ID NO: 3325076 - DNA, 13 bp, Homo sapiens
agggacttaaaaa

SEQ ID NO: 3325077 - DNA, 17 bp, Homo sapiens
agggacttaaaaaactt

SEQ ID NO: 3325078 - DNA, 18 bp, Homo sapiens
agggacttggaagctccg

SEQ ID NO: 3325079 - DNA, 19 bp, Homo sapiens
agggacttggaagctccgc

SEQ ID NO: 3325080 - DNA, 17 bp, Homo sapiens
agggacttggacaggag

SEQ ID NO: 3325081 - DNA, 14 bp, Homo sapiens
agggagaaaagaga

SEQ ID NO: 3325082 - DNA, 17 bp, Homo sapiens
agggagaaactccaaag

SEQ ID NO: 3325083 - DNA, 15 bp, Homo sapiens
agggagaagacactg

SEQ ID NO: 3325084 - DNA, 14 bp, Homo sapiens
agggagaagagaaa

SEQ ID NO: 3325085 - DNA, 15 bp, Homo sapiens
agggagaagagaaaa

SEQ ID NO: 3325086 - DNA, 16 bp, Homo sapiens
agggagagacctcatc

SEQ ID NO: 3325087 - DNA, 23 bp, Homo sapiens
agggagagagagagagagaggac

SEQ ID NO: 3325088 - DNA, 15 bp, Homo sapiens
agggagagccagctc

SEQ ID NO: 3325089 - DNA, 16 bp, Homo sapiens
agggagagctgagcca

SEQ ID NO: 3325090 - DNA, 22 bp, Homo sapiens
agggagcaggccggaaccacag

SEQ ID NO: 3325091 - DNA, 17 bp, Homo sapiens
agggagccatttgagag

SEQ ID NO: 3325092 - DNA, 20 bp, Homo sapiens
agggagcctagaagctggtg

SEQ ID NO: 3325093 - DNA, 16 bp, Homo sapiens
agggagcctcctgccc

SEQ ID NO: 3325094 - DNA, 21 bp, Homo sapiens
agggaggacgctctctggcct

SEQ ID NO: 3325095 - DNA, 19 bp, Homo sapiens
agggaggacgggagctggg

SEQ ID NO: 3325096 - DNA, 19 bp, Homo sapiens
agggaggaggccacctctc

SEQ ID NO: 3325097 - DNA, 16 bp, Homo sapiens
agggaggccgggcggt

SEQ ID NO: 3325098 - DNA, 13 bp, Homo sapiens
agggagggagcaa

SEQ ID NO: 3325099 - DNA, 14 bp, Homo sapiens
agggagggagcaag

SEQ ID NO: 3325100 - DNA, 16 bp, Homo sapiens
agggagggagcaagcc

SEQ ID NO: 3325101 - DNA, 17 bp, Homo sapiens
agggagggagcaagccc

SEQ ID NO: 3325102 - DNA, 20 bp, Homo sapiens
agggagggcggtggacaata

SEQ ID NO: 3325103 - DNA, 15 bp, Homo sapiens
agggagggctgaccc

SEQ ID NO: 3325104 - DNA, 17 bp, Homo sapiens
agggagggctgacccag

SEQ ID NO: 3325105 - DNA, 16 bp, Homo sapiens
agggaggtcaggccct

SEQ ID NO: 3325106 - DNA, 17 bp, Homo sapiens
agggaggtcaggccctg

SEQ ID NO: 3325107 - DNA, 22 bp, Homo sapiens
agggaggtcaggccctggaact

SEQ ID NO: 3325108 - DNA, 23 bp, Homo sapiens
agggaggtgtttaaagagaggtt

SEQ ID NO: 3325109 - DNA, 18 bp, Homo sapiens
agggaggtttgtgagagc

SEQ ID NO: 3325110 - DNA, 18 bp, Homo sapiens
agggagtgctggctcaca

SEQ ID NO: 3325111 - DNA, 19 bp, Homo sapiens
agggagtgtttgtgtctga

SEQ ID NO: 3325112 - DNA, 13 bp, Homo sapiens
agggagtttttga

SEQ ID NO: 3325113 - DNA, 21 bp, Homo sapiens
agggatcaaccagctaagaaa

SEQ ID NO: 3325114 - DNA, 16 bp, Homo sapiens
agggatctctctacaa

SEQ ID NO: 3325115 - DNA, 21 bp, Homo sapiens
agggatctgtttgaacactta

SEQ ID NO: 3325116 - DNA, 17 bp, Homo sapiens
agggatgaagggcgagt

SEQ ID NO: 3325117 - DNA, 15 bp, Homo sapiens
agggatgactaaaat

SEQ ID NO: 3325118 - DNA, 17 bp, Homo sapiens
agggatgctgcctgagt

SEQ ID NO: 3325119 - DNA, 15 bp, Homo sapiens
agggatgctgctccg

SEQ ID NO: 3325120 - DNA, 14 bp, Homo sapiens
agggatgctgggct

SEQ ID NO: 3325121 - DNA, 22 bp, Homo sapiens
agggatggaaaaggaagactag

SEQ ID NO: 3325122 - DNA, 13 bp, Homo sapiens
agggatggagaaa

SEQ ID NO: 3325123 - DNA, 15 bp, Homo sapiens
agggatggagaaaga

SEQ ID NO: 3325124 - DNA, 21 bp, Homo sapiens
agggatggagaaagaagtgga

SEQ ID NO: 3325125 - DNA, 22 bp, Homo sapiens
agggattctgggcttggggtgt

SEQ ID NO: 3325126 - DNA, 15 bp, Homo sapiens
agggatttcttaggg

SEQ ID NO: 3325127 - DNA, 20 bp, Homo sapiens
agggcaaatgacatgcactg

SEQ ID NO: 3325128 - DNA, 23 bp, Homo sapiens
agggcaaatgacatgcactgacc

SEQ ID NO: 3325129 - DNA, 21 bp, Homo sapiens
agggcaagtggatgggaattt

SEQ ID NO: 3325130 - DNA, 21 bp, Homo sapiens
agggcacaccgggcactcaga

SEQ ID NO: 3325131 - DNA, 13 bp, Homo sapiens
agggcacagccct

SEQ ID NO: 3325132 - DNA, 14 bp, Homo sapiens
agggcaccagaggc

SEQ ID NO: 3325133 - DNA, 17 bp, Homo sapiens
agggcacgcaggaccag

SEQ ID NO: 3325134 - DNA, 13 bp, Homo sapiens
agggcactgggct

SEQ ID NO: 3325135 - DNA, 16 bp, Homo sapiens
agggcactgggctgtt

SEQ ID NO: 3325136 - DNA, 14 bp, Homo sapiens
agggcactggtggc

SEQ ID NO: 3325137 - DNA, 15 bp, Homo sapiens
agggcagaaagtaga

SEQ ID NO: 3325138 - DNA, 21 bp, Homo sapiens
agggcagagaatggctgggtc

SEQ ID NO: 3325139 - DNA, 15 bp, Homo sapiens
agggcagagccatgg

SEQ ID NO: 3325140 - DNA, 19 bp, Homo sapiens
agggcagagccatgggcct

SEQ ID NO: 3325141 - DNA, 21 bp, Homo sapiens
agggcagagccatgggcctgg

SEQ ID NO: 3325142 - DNA, 23 bp, Homo sapiens
agggcagagccatgggcctgggc

SEQ ID NO: 3325143 - DNA, 13 bp, Homo sapiens
agggcagagggaa

SEQ ID NO: 3325144 - DNA, 22 bp, Homo sapiens
agggcagagggaatgttccctg

SEQ ID NO: 3325145 - DNA, 23 bp, Homo sapiens
agggcagagggaatgttccctgc

SEQ ID NO: 3325146 - DNA, 12 bp, Homo sapiens
agggcagcccca

SEQ ID NO: 3325147 - DNA, 11 bp, Homo sapiens
agggcagcttg

SEQ ID NO: 3325148 - DNA, 18 bp, Homo sapiens
agggcagcttgccccggc

SEQ ID NO: 3325149 - DNA, 16 bp, Homo sapiens
agggcaggaaggagag

SEQ ID NO: 3325150 - DNA, 18 bp, Homo sapiens
agggcaggaaggagagcc

SEQ ID NO: 3325151 - DNA, 13 bp, Homo sapiens
agggcagggccac

SEQ ID NO: 3325152 - DNA, 15 bp, Homo sapiens
agggcagggccaccc

SEQ ID NO: 3325153 - DNA, 16 bp, Homo sapiens
agggcagggccacccc

SEQ ID NO: 3325154 - DNA, 14 bp, Homo sapiens
agggcagggcccac

SEQ ID NO: 3325155 - DNA, 18 bp, Homo sapiens
agggcagggcccacgtgt

SEQ ID NO: 3325156 - DNA, 15 bp, Homo sapiens
agggcagggctctga

SEQ ID NO: 3325157 - DNA, 23 bp, Homo sapiens
agggcaggggatgcccagaagag

SEQ ID NO: 3325158 - DNA, 14 bp, Homo sapiens
agggcaggggtggt

SEQ ID NO: 3325159 - DNA, 23 bp, Homo sapiens
agggcagggtgggcagcctatgg

SEQ ID NO: 3325160 - DNA, 15 bp, Homo sapiens
agggcagtacctggg

SEQ ID NO: 3325161 - DNA, 16 bp, Homo sapiens
agggcagtacctggga

SEQ ID NO: 3325162 - DNA, 17 bp, Homo sapiens
agggcagtacctgggaa

SEQ ID NO: 3325163 - DNA, 14 bp, Homo sapiens
agggcataaaacag

SEQ ID NO: 3325164 - DNA, 15 bp, Homo sapiens
agggcataaaacagc

SEQ ID NO: 3325165 - DNA, 15 bp, Homo sapiens
agggcatcaggcact

SEQ ID NO: 3325166 - DNA, 22 bp, Homo sapiens
agggcatgccacgtgggctcat

SEQ ID NO: 3325167 - DNA, 20 bp, Homo sapiens
agggcatgccccggccacct

SEQ ID NO: 3325168 - DNA, 22 bp, Homo sapiens
agggcatgccccggccacctct

SEQ ID NO: 3325169 - DNA, 13 bp, Homo sapiens
agggcatgccttg

SEQ ID NO: 3325170 - DNA, 17 bp, Homo sapiens
agggcatgcgcacaagg

SEQ ID NO: 3325171 - DNA, 21 bp, Homo sapiens
agggcattcgggccacagggc

SEQ ID NO: 3325172 - DNA, 23 bp, Homo sapiens
aggcagctgcctctgctccctct

SEQ ID NO: 3325173 - DNA, 14 bp, Homo sapiens
aggcagctgctctt

SEQ ID NO: 3325174 - DNA, 13 bp, Homo sapiens
aggcaggaagccc

SEQ ID NO: 3325175 - DNA, 21 bp, Homo sapiens
aggcaggaccttcgggctgtg

SEQ ID NO: 3325176 - DNA, 21 bp, Homo sapiens
aggcaggcacctagcaattcc

SEQ ID NO: 3325177 - DNA, 21 bp, Homo sapiens
aggcagggaaaggaaaagaag

SEQ ID NO: 3325178 - DNA, 19 bp, Homo sapiens
aggcagggcagagggaatg

SEQ ID NO: 3325179 - DNA, 21 bp, Homo sapiens
aggcagggcccttggggctgg

SEQ ID NO: 3325180 - DNA, 23 bp, Homo sapiens
aggcagggggaaggtggggtcct

SEQ ID NO: 3325181 - DNA, 18 bp, Homo sapiens
aggcagggtctcactctg

SEQ ID NO: 3325182 - DNA, 22 bp, Homo sapiens
aggcagggtctcactctgtcgc

SEQ ID NO: 3325183 - DNA, 18 bp, Homo sapiens
aggcaggtgcctccaggt

SEQ ID NO: 3325184 - DNA, 21 bp, Homo sapiens
aggcaggtgcctccaggtgtg

SEQ ID NO: 3325185 - DNA, 16 bp, Homo sapiens
aggcaggtgggcagac

SEQ ID NO: 3325186 - DNA, 19 bp, Homo sapiens
aggcagtaataaaaagatt

SEQ ID NO: 3325187 - DNA, 19 bp, Homo sapiens
aggcagtcgggggctggcc

SEQ ID NO: 3325188 - DNA, 20 bp, Homo sapiens
aggcagtcgggggctggcct

SEQ ID NO: 3325189 - DNA, 13 bp, Homo sapiens
aggcagtctctat

SEQ ID NO: 3325190 - DNA, 21 bp, Homo sapiens
aggcagtctctatattatgtc

SEQ ID NO: 3325191 - DNA, 14 bp, Homo sapiens
aggcagtctgaacc

SEQ ID NO: 3325192 - DNA, 14 bp, Homo sapiens
aggcagtgcatgtg

SEQ ID NO: 3325193 - DNA, 21 bp, Homo sapiens
aggcagttgacggggcagtca

SEQ ID NO: 3325194 - DNA, 14 bp, Homo sapiens
aggcagttttctaa

SEQ ID NO: 3325195 - DNA, 21 bp, Homo sapiens
aggcatacgagagcagaggtc

SEQ ID NO: 3325196 - DNA, 22 bp, Homo sapiens
aggcatatcttctatatctgaa

SEQ ID NO: 3325197 - DNA, 12 bp, Homo sapiens
aggcatatttta

SEQ ID NO: 3325198 - DNA, 17 bp, Homo sapiens
aggcatcccaggggacc

SEQ ID NO: 3325199 - DNA, 18 bp, Homo sapiens
aggcatcccaggggacca

SEQ ID NO: 3325200 - DNA, 15 bp, Homo sapiens
aggcatcctgcctgg

SEQ ID NO: 3325201 - DNA, 24 bp, Homo sapiens
aggcatcctgcctgggtgggacag

SEQ ID NO: 3325202 - DNA, 21 bp, Homo sapiens
aggcatctccttgggctggga

SEQ ID NO: 3325203 - DNA, 19 bp, Homo sapiens
aggcatctgtgggcatggt

SEQ ID NO: 3325204 - DNA, 22 bp, Homo sapiens
aggcatgagccactgagcctgg

SEQ ID NO: 3325205 - DNA, 15 bp, Homo sapiens
aggcatgagggatca

SEQ ID NO: 3325206 - DNA, 22 bp, Homo sapiens
aggcatgagggatcacagggcc

SEQ ID NO: 3325207 - DNA, 20 bp, Homo sapiens
aggcatgatgatctgcctct

SEQ ID NO: 3325208 - DNA, 15 bp, Homo sapiens
aggcatgcctctgat

SEQ ID NO: 3325209 - DNA, 21 bp, Homo sapiens
aggcatgcctctgatatggga

SEQ ID NO: 3325210 - DNA, 13 bp, Homo sapiens
aggcatggccctg

SEQ ID NO: 3325211 - DNA, 16 bp, Homo sapiens
aggcatggccctgggg

SEQ ID NO: 3325212 - DNA, 21 bp, Homo sapiens
aggcatggccctggggtccca

SEQ ID NO: 3325213 - DNA, 21 bp, Homo sapiens
aggcatggggggtggggggag

SEQ ID NO: 3325214 - DNA, 19 bp, Homo sapiens
aggcatgtaggaccctgca

SEQ ID NO: 3325215 - DNA, 12 bp, Homo sapiens
aggcatgtcctg

SEQ ID NO: 3325216 - DNA, 12 bp, Homo sapiens
aggcatgttctc

SEQ ID NO: 3325217 - DNA, 18 bp, Homo sapiens
aggcatgttctctgagga

SEQ ID NO: 3325218 - DNA, 20 bp, Homo sapiens
aggcatgttctctgaggaca

SEQ ID NO: 3325219 - DNA, 22 bp, Homo sapiens
aggcatgttctctgaggacact

SEQ ID NO: 3325220 - DNA, 19 bp, Homo sapiens
aggcattaacacaaaggag

SEQ ID NO: 3325221 - DNA, 16 bp, Homo sapiens
aggcattaatgtttct

SEQ ID NO: 3325222 - DNA, 13 bp, Homo sapiens
aggccaaactgct

SEQ ID NO: 3325223 - DNA, 14 bp, Homo sapiens
aggccaaactgctg

SEQ ID NO: 3325224 - DNA, 21 bp, Homo sapiens
aggccaaagagtctccagttt

SEQ ID NO: 3325225 - DNA, 15 bp, Homo sapiens
aggccaaagataaaa

SEQ ID NO: 3325226 - DNA, 14 bp, Homo sapiens
aggccaaatgcaca

SEQ ID NO: 3325227 - DNA, 14 bp, Homo sapiens
aggccaaccagccc

SEQ ID NO: 3325228 - DNA, 15 bp, Homo sapiens
aggccaaccagcccg

SEQ ID NO: 3325229 - DNA, 20 bp, Homo sapiens
aggccaagagcagaggcagc

SEQ ID NO: 3325230 - DNA, 22 bp, Homo sapiens
aggccaagtgtgataaataaac

SEQ ID NO: 3325231 - DNA, 12 bp, Homo sapiens
aggccaataaaa

SEQ ID NO: 3325232 - DNA, 16 bp, Homo sapiens
aggccaataaaaagtt

SEQ ID NO: 3325233 - DNA, 21 bp, Homo sapiens
aggccacaccatctcctttca

SEQ ID NO: 3325234 - DNA, 12 bp, Homo sapiens
aggccacagccg

SEQ ID NO: 3325235 - DNA, 13 bp, Homo sapiens
aggccacagccgc

SEQ ID NO: 3325236 - DNA, 20 bp, Homo sapiens
aggccaccccctatcctctg

SEQ ID NO: 3325237 - DNA, 15 bp, Homo sapiens
aggccacctccccag

SEQ ID NO: 3325238 - DNA, 11 bp, Homo sapiens
aggccacctct

SEQ ID NO: 3325239 - DNA, 12 bp, Homo sapiens
aggccacctctc

SEQ ID NO: 3325240 - DNA, 14 bp, Homo sapiens
aggccacctctcca

SEQ ID NO: 3325241 - DNA, 17 bp, Homo sapiens
aggccactgtggccaga

SEQ ID NO: 3325242 - DNA, 20 bp, Homo sapiens
aggccagagggagtgacaga

SEQ ID NO: 3325243 - DNA, 15 bp, Homo sapiens
aggccagagggcagt

SEQ ID NO: 3325244 - DNA, 18 bp, Homo sapiens
aggccagagggcagtggc

SEQ ID NO: 3325245 - DNA, 21 bp, Homo sapiens
aggccagagtggcctggccag

SEQ ID NO: 3325246 - DNA, 14 bp, Homo sapiens
aggccagcccagcc

SEQ ID NO: 3325247 - DNA, 16 bp, Homo sapiens
aggccagcccagccag

SEQ ID NO: 3325248 - DNA, 18 bp, Homo sapiens
aggccagccccacccagg

SEQ ID NO: 3325249 - DNA, 13 bp, Homo sapiens
aggccagcctccg

SEQ ID NO: 3325250 - DNA, 20 bp, Homo sapiens
aggccaggaccacacagtcc

SEQ ID NO: 3325251 - DNA, 23 bp, Homo sapiens
aggccaggaccacacagtcccca

SEQ ID NO: 3325252 - DNA, 24 bp, Homo sapiens
aggccaggaccacacagtccccag

SEQ ID NO: 3325253 - DNA, 15 bp, Homo sapiens
aggccagggcatgtg

SEQ ID NO: 3325254 - DNA, 14 bp, Homo sapiens
aggccaggtgcagt

SEQ ID NO: 3325255 - DNA, 15 bp, Homo sapiens
aggccagtgagctgt

SEQ ID NO: 3325256 - DNA, 22 bp, Homo sapiens
aggccagtgggcgggccatgag

SEQ ID NO: 3325257 - DNA, 13 bp, Homo sapiens
aggccagtgtctg

SEQ ID NO: 3325258 - DNA, 16 bp, Homo sapiens
aggccataaaacaggt

SEQ ID NO: 3325259 - DNA, 18 bp, Homo sapiens
aggccatctcagcttgct

SEQ ID NO: 3325260 - DNA, 16 bp, Homo sapiens
aggccatgtgagccac

SEQ ID NO: 3325261 - DNA, 14 bp, Homo sapiens
aggcccaactgtga

SEQ ID NO: 3325262 - DNA, 12 bp, Homo sapiens
aggcccaagaga

SEQ ID NO: 3325263 - DNA, 20 bp, Homo sapiens
aggcccaagagcagagtctg

SEQ ID NO: 3325264 - DNA, 15 bp, Homo sapiens
aggcccaaggctccc

SEQ ID NO: 3325265 - DNA, 18 bp, Homo sapiens
aggcccaaggtcccctcc

SEQ ID NO: 3325266 - DNA, 19 bp, Homo sapiens
aggcccaaggtcccctcca

SEQ ID NO: 3325267 - DNA, 12 bp, Homo sapiens
aggcccacagga

SEQ ID NO: 3325268 - DNA, 22 bp, Homo sapiens
aggcccagcattgctggttcta

SEQ ID NO: 3325269 - DNA, 12 bp, Homo sapiens
aggcccagccag

SEQ ID NO: 3325270 - DNA, 13 bp, Homo sapiens
aggcccagccagt

SEQ ID NO: 3325271 - DNA, 16 bp, Homo sapiens
aggcccagcccctaga

SEQ ID NO: 3325272 - DNA, 19 bp, Homo sapiens
aggcccagcgcggccagcg

SEQ ID NO: 3325273 - DNA, 18 bp, Homo sapiens
aggcccagcgggcagatg

SEQ ID NO: 3325274 - DNA, 14 bp, Homo sapiens
aggcccaggcagag

SEQ ID NO: 3325275 - DNA, 13 bp, Homo sapiens
aggcccaggctgg

SEQ ID NO: 3325276 - DNA, 16 bp, Homo sapiens
aggcccaggctgggaa

SEQ ID NO: 3325277 - DNA, 23 bp, Homo sapiens
aggcccagggagggaagtgtgag

SEQ ID NO: 3325278 - DNA, 23 bp, Homo sapiens
aggcccagtgacaaagactcctc

SEQ ID NO: 3325279 - DNA, 18 bp, Homo sapiens
aggcccatggttgagaaa

SEQ ID NO: 3325280 - DNA, 22 bp, Homo sapiens
aggccccaaaggaaaaagcaca

SEQ ID NO: 3325281 - DNA, 16 bp, Homo sapiens
aggccccactccttcc

SEQ ID NO: 3325282 - DNA, 19 bp, Homo sapiens
aggccccactgatgctgtt

SEQ ID NO: 3325283 - DNA, 16 bp, Homo sapiens
aggccccagaggccct

SEQ ID NO: 3325284 - DNA, 17 bp, Homo sapiens
aggccccagaggccctg

SEQ ID NO: 3325285 - DNA, 22 bp, Homo sapiens
aggccccagaggccctggaggt

SEQ ID NO: 3325286 - DNA, 21 bp, Homo sapiens
aggccccagctctgaggggag

SEQ ID NO: 3325287 - DNA, 19 bp, Homo sapiens
aggcccccaaacatagccc

SEQ ID NO: 3325288 - DNA, 22 bp, Homo sapiens
aggcccccaaacatagcccctg

SEQ ID NO: 3325289 - DNA, 17 bp, Homo sapiens
aggcccccacttgcctc

SEQ ID NO: 3325290 - DNA, 18 bp, Homo sapiens
aggcccccagcccagggc

SEQ ID NO: 3325291 - DNA, 19 bp, Homo sapiens
aggcccccagcccagggct

SEQ ID NO: 3325292 - DNA, 13 bp, Homo sapiens
aggccccctgcat

SEQ ID NO: 3325293 - DNA, 17 bp, Homo sapiens
aggccccgtggtgacat

SEQ ID NO: 3325294 - DNA, 12 bp, Homo sapiens
aggcccctgagg

SEQ ID NO: 3325295 - DNA, 16 bp, Homo sapiens
aggcccctgaggactg

SEQ ID NO: 3325296 - DNA, 20 bp, Homo sapiens
aggcccctgaggactggaga

SEQ ID NO: 3325297 - DNA, 12 bp, Homo sapiens
aggcccctgcca

SEQ ID NO: 3325298 - DNA, 16 bp, Homo sapiens
aggcccctggagccag

SEQ ID NO: 3325299 - DNA, 23 bp, Homo sapiens
aggcccgagatgtgacccaccag

SEQ ID NO: 3325300 - DNA, 16 bp, Homo sapiens
aggcccgcccgcccac

SEQ ID NO: 3325301 - DNA, 19 bp, Homo sapiens
aggtggtctgaatgttctg

SEQ ID NO: 3325302 - DNA, 20 bp, Homo sapiens
aggtggtggcactgagcccc

SEQ ID NO: 3325303 - DNA, 14 bp, Homo sapiens
aggtgtacactaac

SEQ ID NO: 3325304 - DNA, 16 bp, Homo sapiens
aggtgtacactaacat

SEQ ID NO: 3325305 - DNA, 22 bp, Homo sapiens
aggtgtatgccacacctggcct

SEQ ID NO: 3325306 - DNA, 13 bp, Homo sapiens
aggtgtatttaaa

SEQ ID NO: 3325307 - DNA, 14 bp, Homo sapiens
aggtgtgaaatcat

SEQ ID NO: 3325308 - DNA, 22 bp, Homo sapiens
aggtgtgaaccaccacacccag

SEQ ID NO: 3325309 - DNA, 13 bp, Homo sapiens
aggtgtgaatgca

SEQ ID NO: 3325310 - DNA, 20 bp, Homo sapiens
aggtgtgaatgcacgtttca

SEQ ID NO: 3325311 - DNA, 21 bp, Homo sapiens
aggtgtgagtcaccaagccca

SEQ ID NO: 3325312 - DNA, 22 bp, Homo sapiens
aggtgtgagtcaccaagcccag

SEQ ID NO: 3325313 - DNA, 15 bp, Homo sapiens
aggtgtgctctgatc

SEQ ID NO: 3325314 - DNA, 16 bp, Homo sapiens
aggtgtgggggctgca

SEQ ID NO: 3325315 - DNA, 16 bp, Homo sapiens
aggtgtggtggctcat

SEQ ID NO: 3325316 - DNA, 21 bp, Homo sapiens
aggtgtggtgtaatttataaa

SEQ ID NO: 3325317 - DNA, 16 bp, Homo sapiens
aggtgttactgtaatt

SEQ ID NO: 3325318 - DNA, 23 bp, Homo sapiens
aggtgttatttggaaccttgttt

SEQ ID NO: 3325319 - DNA, 19 bp, Homo sapiens
aggtgttcccaggctgccc

SEQ ID NO: 3325320 - DNA, 17 bp, Homo sapiens
aggtgttctacactcat

SEQ ID NO: 3325321 - DNA, 18 bp, Homo sapiens
aggtgttgattttctgtt

SEQ ID NO: 3325322 - DNA, 21 bp, Homo sapiens
aggtgttgattttctgttgta

SEQ ID NO: 3325323 - DNA, 23 bp, Homo sapiens
aggtgttgccaaatatgtcctgg

SEQ ID NO: 3325324 - DNA, 20 bp, Homo sapiens
aggtgtttaaagagaggtta

SEQ ID NO: 3325325 - DNA, 18 bp, Homo sapiens
aggttaaggtgggtccag

SEQ ID NO: 3325326 - DNA, 16 bp, Homo sapiens
aggttaatatttaaga

SEQ ID NO: 3325327 - DNA, 14 bp, Homo sapiens
aggttaatgttcat

SEQ ID NO: 3325328 - DNA, 21 bp, Homo sapiens
aggttacaagcctgcacaata

SEQ ID NO: 3325329 - DNA, 15 bp, Homo sapiens
aggttacgaagacaa

SEQ ID NO: 3325330 - DNA, 21 bp, Homo sapiens
aggttagcctttgccctgtca

SEQ ID NO: 3325331 - DNA, 21 bp, Homo sapiens
aggttaggagttcgagaccag

SEQ ID NO: 3325332 - DNA, 19 bp, Homo sapiens
aggttataggtcactcctg

SEQ ID NO: 3325333 - DNA, 14 bp, Homo sapiens
aggttatcgaaata

SEQ ID NO: 3325334 - DNA, 17 bp, Homo sapiens
aggttatcgaaataaca

SEQ ID NO: 3325335 - DNA, 20 bp, Homo sapiens
aggttatcgaaataacaatg

SEQ ID NO: 3325336 - DNA, 16 bp, Homo sapiens
aggttatctgcctggc

SEQ ID NO: 3325337 - DNA, 18 bp, Homo sapiens
aggttatctgcctggcct

SEQ ID NO: 3325338 - DNA, 23 bp, Homo sapiens
aggttatctttttaaaaactctt

SEQ ID NO: 3325339 - DNA, 13 bp, Homo sapiens
aggttatgttcat

SEQ ID NO: 3325340 - DNA, 19 bp, Homo sapiens
aggttatttaaaataaatt

SEQ ID NO: 3325341 - DNA, 24 bp, Homo sapiens
aggttcactgagctccccagatct

SEQ ID NO: 3325342 - DNA, 15 bp, Homo sapiens
aggttcagccaaggt

SEQ ID NO: 3325343 - DNA, 17 bp, Homo sapiens
aggttccaactgtatat

SEQ ID NO: 3325344 - DNA, 16 bp, Homo sapiens
aggttccatcctttac

SEQ ID NO: 3325345 - DNA, 19 bp, Homo sapiens
aggttccccaagggccctg

SEQ ID NO: 3325346 - DNA, 20 bp, Homo sapiens
aggttccccaagggccctgg

SEQ ID NO: 3325347 - DNA, 22 bp, Homo sapiens
aggttccccaagggccctggca

SEQ ID NO: 3325348 - DNA, 19 bp, Homo sapiens
aggttccctgttcttcctc

SEQ ID NO: 3325349 - DNA, 15 bp, Homo sapiens
aggttcctctgcctg

SEQ ID NO: 3325350 - DNA, 12 bp, Homo sapiens
aggttctaaagt

SEQ ID NO: 3325351 - DNA, 14 bp, Homo sapiens
aggttctaaagttc

SEQ ID NO: 3325352 - DNA, 18 bp, Homo sapiens
aggttctaaagttctaag

SEQ ID NO: 3325353 - DNA, 20 bp, Homo sapiens
aggttctaaagttctaagat

SEQ ID NO: 3325354 - DNA, 19 bp, Homo sapiens
aggttctaaggcctaggat

SEQ ID NO: 3325355 - DNA, 22 bp, Homo sapiens
aggttctaaggcctaggattct

SEQ ID NO: 3325356 - DNA, 17 bp, Homo sapiens
aggttctaggtttcaaa

SEQ ID NO: 3325357 - DNA, 18 bp, Homo sapiens
aggttctattttcttaaa

SEQ ID NO: 3325358 - DNA, 14 bp, Homo sapiens
aggttctgcctgct

SEQ ID NO: 3325359 - DNA, 17 bp, Homo sapiens
aggttctgcctgctttg

SEQ ID NO: 3325360 - DNA, 17 bp, Homo sapiens
aggttcttagtgtcact

SEQ ID NO: 3325361 - DNA, 19 bp, Homo sapiens
aggttcttttccattgtca

SEQ ID NO: 3325362 - DNA, 17 bp, Homo sapiens
aggttgaactttgccaa

SEQ ID NO: 3325363 - DNA, 19 bp, Homo sapiens
aggttgaactttgccaaaa

SEQ ID NO: 3325364 - DNA, 15 bp, Homo sapiens
aggttgaagccaagt

SEQ ID NO: 3325365 - DNA, 23 bp, Homo sapiens
aggttgaagccaagtggggtgct

SEQ ID NO: 3325366 - DNA, 17 bp, Homo sapiens
aggttgaggggctcctg

SEQ ID NO: 3325367 - DNA, 20 bp, Homo sapiens
aggttgaggggctcctggaa

SEQ ID NO: 3325368 - DNA, 16 bp, Homo sapiens
aggttgcagtgagctg

SEQ ID NO: 3325369 - DNA, 17 bp, Homo sapiens
agggcctgggggcagtg

SEQ ID NO: 3325370 - DNA, 17 bp, Homo sapiens
agggcctggtccctggg

SEQ ID NO: 3325371 - DNA, 21 bp, Homo sapiens
agggcctggtccctgggagga

SEQ ID NO: 3325372 - DNA, 22 bp, Homo sapiens
agggcgcccctgggagacaact

SEQ ID NO: 3325373 - DNA, 14 bp, Homo sapiens
agggcgcctactct

SEQ ID NO: 3325374 - DNA, 16 bp, Homo sapiens
agggcgctcagacggc

SEQ ID NO: 3325375 - DNA, 21 bp, Homo sapiens
agggcgctcagacggcggcca

SEQ ID NO: 3325376 - DNA, 13 bp, Homo sapiens
agggcggcagggg

SEQ ID NO: 3325377 - DNA, 23 bp, Homo sapiens
agggcggcaggggcctggagatc

SEQ ID NO: 3325378 - DNA, 19 bp, Homo sapiens
agggcgggcagagggctgg

SEQ ID NO: 3325379 - DNA, 24 bp, Homo sapiens
agggctagtgacttgtgtcccatg

SEQ ID NO: 3325380 - DNA, 22 bp, Homo sapiens
agggctccagcatccagcctgt

SEQ ID NO: 3325381 - DNA, 13 bp, Homo sapiens
agggctcccaggg

SEQ ID NO: 3325382 - DNA, 23 bp, Homo sapiens
agggctcccttatgtccaccact

SEQ ID NO: 3325383 - DNA, 14 bp, Homo sapiens
agggctcctcccag

SEQ ID NO: 3325384 - DNA, 18 bp, Homo sapiens
agggctcctcccagcttg

SEQ ID NO: 3325385 - DNA, 14 bp, Homo sapiens
agggctcctgcagg

SEQ ID NO: 3325386 - DNA, 22 bp, Homo sapiens
agggctcctgccttctgtcctg

SEQ ID NO: 3325387 - DNA, 15 bp, Homo sapiens
agggctctaaaaaaa

SEQ ID NO: 3325388 - DNA, 23 bp, Homo sapiens
agggctctaaaaaaagccccaaa

SEQ ID NO: 3325389 - DNA, 16 bp, Homo sapiens
agggctctcttaggca

SEQ ID NO: 3325390 - DNA, 15 bp, Homo sapiens
agggctctgatattc

SEQ ID NO: 3325391 - DNA, 21 bp, Homo sapiens
agggctctgatattccatgaa

SEQ ID NO: 3325392 - DNA, 22 bp, Homo sapiens
agggctctgatattccatgaat

SEQ ID NO: 3325393 - DNA, 15 bp, Homo sapiens
agggctctgccccag

SEQ ID NO: 3325394 - DNA, 18 bp, Homo sapiens
agggctctttctctctgc

SEQ ID NO: 3325395 - DNA, 15 bp, Homo sapiens
agggctgacctgcct

SEQ ID NO: 3325396 - DNA, 16 bp, Homo sapiens
agggctgagctgggga

SEQ ID NO: 3325397 - DNA, 12 bp, Homo sapiens
agggctggacct

SEQ ID NO: 3325398 - DNA, 17 bp, Homo sapiens
agggctggaggcccagg

SEQ ID NO: 3325399 - DNA, 14 bp, Homo sapiens
agggctggccccag

SEQ ID NO: 3325400 - DNA, 12 bp, Homo sapiens
agggctggctgg

SEQ ID NO: 3325401 - DNA, 13 bp, Homo sapiens
agggctggctggc

SEQ ID NO: 3325402 - DNA, 20 bp, Homo sapiens
agggcttcctctagaagcca

SEQ ID NO: 3325403 - DNA, 13 bp, Homo sapiens
agggcttctgcac

SEQ ID NO: 3325404 - DNA, 19 bp, Homo sapiens
agggcttctgcaccctcca

SEQ ID NO: 3325405 - DNA, 22 bp, Homo sapiens
agggcttctgcaccctccaccc

SEQ ID NO: 3325406 - DNA, 17 bp, Homo sapiens
agggcttggcccagcgc

SEQ ID NO: 3325407 - DNA, 22 bp, Homo sapiens
agggcttttattttttcttttg

SEQ ID NO: 3325408 - DNA, 21 bp, Homo sapiens
aggggaaagaaagggaaaagg

SEQ ID NO: 3325409 - DNA, 14 bp, Homo sapiens
aggggaacagactg

SEQ ID NO: 3325410 - DNA, 14 bp, Homo sapiens
aggggaagccttgc

SEQ ID NO: 3325411 - DNA, 13 bp, Homo sapiens
aggggaagctgca

SEQ ID NO: 3325412 - DNA, 15 bp, Homo sapiens
aggggaagctgcagc

SEQ ID NO: 3325413 - DNA, 17 bp, Homo sapiens
aggggaaggagaagtaa

SEQ ID NO: 3325414 - DNA, 14 bp, Homo sapiens
aggggaagggccag

SEQ ID NO: 3325415 - DNA, 20 bp, Homo sapiens
aggggaatgtttgcctctgc

SEQ ID NO: 3325416 - DNA, 21 bp, Homo sapiens
aggggaatgtttgcctctgcc

SEQ ID NO: 3325417 - DNA, 14 bp, Homo sapiens
aggggacaggcctc

SEQ ID NO: 3325418 - DNA, 15 bp, Homo sapiens
aggggacaggcctca

SEQ ID NO: 3325419 - DNA, 15 bp, Homo sapiens
aggggagacaggagc

SEQ ID NO: 3325420 - DNA, 15 bp, Homo sapiens
aggggagagcctgct

SEQ ID NO: 3325421 - DNA, 22 bp, Homo sapiens
aggggagagcctgctggcaccc

SEQ ID NO: 3325422 - DNA, 23 bp, Homo sapiens
aggggagcaaaatcgatgcagtg

SEQ ID NO: 3325423 - DNA, 17 bp, Homo sapiens
aggggagcacggagccg

SEQ ID NO: 3325424 - DNA, 19 bp, Homo sapiens
aggggagcacggagccgcg

SEQ ID NO: 3325425 - DNA, 13 bp, Homo sapiens
aggggaggaaaaa

SEQ ID NO: 3325426 - DNA, 17 bp, Homo sapiens
aggggaggaaaaaagaa

SEQ ID NO: 3325427 - DNA, 23 bp, Homo sapiens
aggggaggaaaaaagaaccaaaa

SEQ ID NO: 3325428 - DNA, 14 bp, Homo sapiens
aggggaggcagatg

SEQ ID NO: 3325429 - DNA, 16 bp, Homo sapiens
aggggatagagagaga

SEQ ID NO: 3325430 - DNA, 21 bp, Homo sapiens
aggggatagagagagaccact

SEQ ID NO: 3325431 - DNA, 18 bp, Homo sapiens
aggggatataggagagga

SEQ ID NO: 3325432 - DNA, 17 bp, Homo sapiens
aggggatgcccagaaga

SEQ ID NO: 3325433 - DNA, 19 bp, Homo sapiens
aggggcaagctaggcccca

SEQ ID NO: 3325434 - DNA, 11 bp, Homo sapiens
aggggcacacc

SEQ ID NO: 3325435 - DNA, 19 bp, Homo sapiens
aggggcacaccactgccct

SEQ ID NO: 3325436 - DNA, 22 bp, Homo sapiens
aggggcacaccactgccctgcc

SEQ ID NO: 3325437 - DNA, 23 bp, Homo sapiens
aggggcacaccactgccctgcct

SEQ ID NO: 3325438 - DNA, 17 bp, Homo sapiens
aggggcagaaaaactct

SEQ ID NO: 3325439 - DNA, 13 bp, Homo sapiens
aggggcagccctt

SEQ ID NO: 3325440 - DNA, 16 bp, Homo sapiens
aggggcagcccttgct

SEQ ID NO: 3325441 - DNA, 13 bp, Homo sapiens
aggggcagccgct

SEQ ID NO: 3325442 - DNA, 20 bp, Homo sapiens
aggggcaggactgagtcccc

SEQ ID NO: 3325443 - DNA, 16 bp, Homo sapiens
aggggcaggcctggga

SEQ ID NO: 3325444 - DNA, 22 bp, Homo sapiens
aggggcaggcctgggacccagc

SEQ ID NO: 3325445 - DNA, 23 bp, Homo sapiens
aggggcaggcctgggacccagct

SEQ ID NO: 3325446 - DNA, 13 bp, Homo sapiens
aggggcaggctga

SEQ ID NO: 3325447 - DNA, 16 bp, Homo sapiens
aggggcagggatgggg

SEQ ID NO: 3325448 - DNA, 13 bp, Homo sapiens
aggggcagtccca

SEQ ID NO: 3325449 - DNA, 21 bp, Homo sapiens
agtatctgtatataagttgct

SEQ ID NO: 3325450 - DNA, 18 bp, Homo sapiens
agtatcttgtttggcctc

SEQ ID NO: 3325451 - DNA, 16 bp, Homo sapiens
agtatgtaaagtatgt

SEQ ID NO: 3325452 - DNA, 19 bp, Homo sapiens
agtatgtctgtttttgtat

SEQ ID NO: 3325453 - DNA, 22 bp, Homo sapiens
agtatgtgctatacacacacac

SEQ ID NO: 3325454 - DNA, 14 bp, Homo sapiens
agtatgtgtaaaat

SEQ ID NO: 3325455 - DNA, 16 bp, Homo sapiens
agtatgttaagctctt

SEQ ID NO: 3325456 - DNA, 20 bp, Homo sapiens
agtattaaaggggggagggg

SEQ ID NO: 3325457 - DNA, 18 bp, Homo sapiens
agtattaatactaaaata

SEQ ID NO: 3325458 - DNA, 20 bp, Homo sapiens
agtattagactggaagttca

SEQ ID NO: 3325459 - DNA, 16 bp, Homo sapiens
agtattagacttctaa

SEQ ID NO: 3325460 - DNA, 19 bp, Homo sapiens
agtattcaacaatttcaat

SEQ ID NO: 3325461 - DNA, 23 bp, Homo sapiens
agtattctcagagcatgtgtcag

SEQ ID NO: 3325462 - DNA, 19 bp, Homo sapiens
agtattcttatttaatgaa

SEQ ID NO: 3325463 - DNA, 14 bp, Homo sapiens
agtattctttttct

SEQ ID NO: 3325464 - DNA, 22 bp, Homo sapiens
agtattgaaaaattatcagtta

SEQ ID NO: 3325465 - DNA, 15 bp, Homo sapiens
agtattgaaaacttc

SEQ ID NO: 3325466 - DNA, 19 bp, Homo sapiens
agtattgagaacctggcct

SEQ ID NO: 3325467 - DNA, 14 bp, Homo sapiens
agtattgtttaaaa

SEQ ID NO: 3325468 - DNA, 16 bp, Homo sapiens
agtattgtttaaaatg

SEQ ID NO: 3325469 - DNA, 15 bp, Homo sapiens
agtatttaatgaaac

SEQ ID NO: 3325470 - DNA, 14 bp, Homo sapiens
agtatttatatatt

SEQ ID NO: 3325471 - DNA, 20 bp, Homo sapiens
agtatttatatatttataac

SEQ ID NO: 3325472 - DNA, 16 bp, Homo sapiens
agtatttattggtggg

SEQ ID NO: 3325473 - DNA, 13 bp, Homo sapiens
agtatttcagtgt

SEQ ID NO: 3325474 - DNA, 14 bp, Homo sapiens
agtatttcagtgta

SEQ ID NO: 3325475 - DNA, 15 bp, Homo sapiens
agtatttcattgcct

SEQ ID NO: 3325476 - DNA, 13 bp, Homo sapiens
agtatttctcctt

SEQ ID NO: 3325477 - DNA, 20 bp, Homo sapiens
agtatttctcctttgcaata

SEQ ID NO: 3325478 - DNA, 23 bp, Homo sapiens
agtatttgaaactgaatgtttat

SEQ ID NO: 3325479 - DNA, 17 bp, Homo sapiens
agtatttgggaagtgaa

SEQ ID NO: 3325480 - DNA, 18 bp, Homo sapiens
agtatttggtccaaaaaa

SEQ ID NO: 3325481 - DNA, 19 bp, Homo sapiens
agtatttggtccaaaaaaa

SEQ ID NO: 3325482 - DNA, 19 bp, Homo sapiens
agtattttaagtctacaaa

SEQ ID NO: 3325483 - DNA, 16 bp, Homo sapiens
agtattttaatcctgt

SEQ ID NO: 3325484 - DNA, 22 bp, Homo sapiens
agtattttacctagcatttcaa

SEQ ID NO: 3325485 - DNA, 23 bp, Homo sapiens
agtattttggttcttagttctca

SEQ ID NO: 3325486 - DNA, 13 bp, Homo sapiens
agtattttttgta

SEQ ID NO: 3325487 - DNA, 14 bp, Homo sapiens
agtcaaaacagaga

SEQ ID NO: 3325488 - DNA, 19 bp, Homo sapiens
agtcaaaactatttttgta

SEQ ID NO: 3325489 - DNA, 19 bp, Homo sapiens
agtcaaaggcatctccctt

SEQ ID NO: 3325490 - DNA, 20 bp, Homo sapiens
agtcaaaggcatctcccttc

SEQ ID NO: 3325491 - DNA, 18 bp, Homo sapiens
agtcaaatttacatttat

SEQ ID NO: 3325492 - DNA, 13 bp, Homo sapiens
agtcaagaagaat

SEQ ID NO: 3325493 - DNA, 16 bp, Homo sapiens
agtcaagcacatgtaa

SEQ ID NO: 3325494 - DNA, 15 bp, Homo sapiens
agtcaatcatttctc

SEQ ID NO: 3325495 - DNA, 16 bp, Homo sapiens
agtcaatccaagacta

SEQ ID NO: 3325496 - DNA, 14 bp, Homo sapiens
agtcaatgtgcagt

SEQ ID NO: 3325497 - DNA, 22 bp, Homo sapiens
agtcacacagtattacttctgc

SEQ ID NO: 3325498 - DNA, 23 bp, Homo sapiens
agtcacacagtattacttctgct

SEQ ID NO: 3325499 - DNA, 23 bp, Homo sapiens
agtcacacagtgagtcgaggaca

SEQ ID NO: 3325500 - DNA, 15 bp, Homo sapiens
agtcacagctgcagc

SEQ ID NO: 3325501 - DNA, 15 bp, Homo sapiens
agtcaccaagcccag

SEQ ID NO: 3325502 - DNA, 20 bp, Homo sapiens
agtcaccctacctgtgcctg

SEQ ID NO: 3325503 - DNA, 14 bp, Homo sapiens
agtcacctgcaagc

SEQ ID NO: 3325504 - DNA, 15 bp, Homo sapiens
agtcacctgcaagcc

SEQ ID NO: 3325505 - DNA, 16 bp, Homo sapiens
agtcacctgcaagccc

SEQ ID NO: 3325506 - DNA, 17 bp, Homo sapiens
agtcacctgcaagcccc

SEQ ID NO: 3325507 - DNA, 19 bp, Homo sapiens
agtcacctgcaagccccag

SEQ ID NO: 3325508 - DNA, 17 bp, Homo sapiens
agtcgtggggtgtgctg

SEQ ID NO: 3325509 - DNA, 19 bp, Homo sapiens
agtcgtggggtgtgctggg

SEQ ID NO: 3325510 - DNA, 16 bp, Homo sapiens
agtcgttggagactga

SEQ ID NO: 3325511 - DNA, 13 bp, Homo sapiens
agtcgttttccaa

SEQ ID NO: 3325512 - DNA, 21 bp, Homo sapiens
agtctaaagatggagtttcta

SEQ ID NO: 3325513 - DNA, 23 bp, Homo sapiens
agtctaaagatggagtttctaag

SEQ ID NO: 3325514 - DNA, 23 bp, Homo sapiens
agtctaaatatttccttaaactg

SEQ ID NO: 3325515 - DNA, 14 bp, Homo sapiens
agtctacctgctgg

SEQ ID NO: 3325516 - DNA, 15 bp, Homo sapiens
agtctacctgctgga

SEQ ID NO: 3325517 - DNA, 23 bp, Homo sapiens
agtctagatgtttattcttctag

SEQ ID NO: 3325518 - DNA, 14 bp, Homo sapiens
agtctagattcaaa

SEQ ID NO: 3325519 - DNA, 20 bp, Homo sapiens
agtctagattcaaaggttct

SEQ ID NO: 3325520 - DNA, 13 bp, Homo sapiens
agtctagattctc

SEQ ID NO: 3325521 - DNA, 18 bp, Homo sapiens
agtctagggcacaaagac

SEQ ID NO: 3325522 - DNA, 10 bp, Homo sapiens
agtctatttt

SEQ ID NO: 3325523 - DNA, 11 bp, Homo sapiens
agtctatttta

SEQ ID NO: 3325524 - DNA, 21 bp, Homo sapiens
agtctatttttttaactgaaa

SEQ ID NO: 3325525 - DNA, 14 bp, Homo sapiens
agtctcactctgtt

SEQ ID NO: 3325526 - DNA, 19 bp, Homo sapiens
agtctcactttgtcgccca

SEQ ID NO: 3325527 - DNA, 22 bp, Homo sapiens
agtctcagatatcatactgatt

SEQ ID NO: 3325528 - DNA, 17 bp, Homo sapiens
agtctcaggagcatggg

SEQ ID NO: 3325529 - DNA, 20 bp, Homo sapiens
agtctcagtttgtgtgtctt

SEQ ID NO: 3325530 - DNA, 15 bp, Homo sapiens
agtctcatgggaagc

SEQ ID NO: 3325531 - DNA, 17 bp, Homo sapiens
agtctcattacttttga

SEQ ID NO: 3325532 - DNA, 21 bp, Homo sapiens
agtctcattcgcctttgtctt

SEQ ID NO: 3325533 - DNA, 14 bp, Homo sapiens
agtctcccaaggct

SEQ ID NO: 3325534 - DNA, 19 bp, Homo sapiens
agtctcccaggccccctgc

SEQ ID NO: 3325535 - DNA, 23 bp, Homo sapiens
agtctcccaggccccctgcatct

SEQ ID NO: 3325536 - DNA, 12 bp, Homo sapiens
agtctcccttct

SEQ ID NO: 3325537 - DNA, 17 bp, Homo sapiens
agtctccctttcccttc

SEQ ID NO: 3325538 - DNA, 11 bp, Homo sapiens
agtctcctcaa

SEQ ID NO: 3325539 - DNA, 23 bp, Homo sapiens
agtctcctcaatttttgtctcag

SEQ ID NO: 3325540 - DNA, 20 bp, Homo sapiens
agtctcctcactctgtccct

SEQ ID NO: 3325541 - DNA, 11 bp, Homo sapiens
agtctcctggg

SEQ ID NO: 3325542 - DNA, 15 bp, Homo sapiens
agtctccttcagcac

SEQ ID NO: 3325543 - DNA, 23 bp, Homo sapiens
agtctctatattatgtcttcttt

SEQ ID NO: 3325544 - DNA, 18 bp, Homo sapiens
agtctctatttaaattct

SEQ ID NO: 3325545 - DNA, 11 bp, Homo sapiens
agtctctcctg

SEQ ID NO: 3325546 - DNA, 19 bp, Homo sapiens
agtctctctctctctctcc

SEQ ID NO: 3325547 - DNA, 13 bp, Homo sapiens
agtctctctgtga

SEQ ID NO: 3325548 - DNA, 14 bp, Homo sapiens
agtctctctgtgaa

SEQ ID NO: 3325549 - DNA, 15 bp, Homo sapiens
agtctctctgtgaat

SEQ ID NO: 3325550 - DNA, 17 bp, Homo sapiens
agtctctctgtgaatac

SEQ ID NO: 3325551 - DNA, 20 bp, Homo sapiens
agtctctctgtgaatacaat

SEQ ID NO: 3325552 - DNA, 21 bp, Homo sapiens
agtctctctgtgaatacaatt

SEQ ID NO: 3325553 - DNA, 16 bp, Homo sapiens
agtctctcttctctcc

SEQ ID NO: 3325554 - DNA, 19 bp, Homo sapiens
agtctctgaatgaagctga

SEQ ID NO: 3325555 - DNA, 12 bp, Homo sapiens
agtctcttcaga

SEQ ID NO: 3325556 - DNA, 21 bp, Homo sapiens
agtctcttttctttagagcat

SEQ ID NO: 3325557 - DNA, 23 bp, Homo sapiens
agtctcttttctttagagcattg

SEQ ID NO: 3325558 - DNA, 16 bp, Homo sapiens
agtctgaatgctgcca

SEQ ID NO: 3325559 - DNA, 15 bp, Homo sapiens
agtctgagcccccgg

SEQ ID NO: 3325560 - DNA, 13 bp, Homo sapiens
agtctgagtcctg

SEQ ID NO: 3325561 - DNA, 14 bp, Homo sapiens
agtctgagtctgag

SEQ ID NO: 3325562 - DNA, 16 bp, Homo sapiens
agtctgattcccaagc

SEQ ID NO: 3325563 - DNA, 18 bp, Homo sapiens
agtctgattcccaagctc

SEQ ID NO: 3325564 - DNA, 22 bp, Homo sapiens
agtctgattcccaagctctgct

SEQ ID NO: 3325565 - DNA, 20 bp, Homo sapiens
agtctgcccacgcagaggac

SEQ ID NO: 3325566 - DNA, 19 bp, Homo sapiens
agtctggagtgggcagagc

SEQ ID NO: 3325567 - DNA, 22 bp, Homo sapiens
agtctggcagactttcttctct

SEQ ID NO: 3325568 - DNA, 15 bp, Homo sapiens
agtctggccaacatc

SEQ ID NO: 3325569 - DNA, 22 bp, Homo sapiens
agtctgggacacaaaactccgc

SEQ ID NO: 3325570 - DNA, 15 bp, Homo sapiens
agtctgggcctctga

SEQ ID NO: 3325571 - DNA, 20 bp, Homo sapiens
agtctggtttctagacttgt

SEQ ID NO: 3325572 - DNA, 19 bp, Homo sapiens
agtctgtacctcaaatgaa

SEQ ID NO: 3325573 - DNA, 17 bp, Homo sapiens
agtctgtactaaacagt

SEQ ID NO: 3325574 - DNA, 23 bp, Homo sapiens
agtctgtcatgaacatgttcctg

SEQ ID NO: 3325575 - DNA, 16 bp, Homo sapiens
agtctgtcctgtgacg

SEQ ID NO: 3325576 - DNA, 14 bp, Homo sapiens
agtctgtctactgt

SEQ ID NO: 3325577 - DNA, 21 bp, Homo sapiens
agtctgtctactgtggtgatc

SEQ ID NO: 3325578 - DNA, 21 bp, Homo sapiens
agtctgtgagtgcgtctgagg

SEQ ID NO: 3325579 - DNA, 11 bp, Homo sapiens
agtctgtgtga

SEQ ID NO: 3325580 - DNA, 19 bp, Homo sapiens
agtctgtgtgatgaacttt

SEQ ID NO: 3325581 - DNA, 20 bp, Homo sapiens
agtctgtgtggcaaattaaa

SEQ ID NO: 3325582 - DNA, 17 bp, Homo sapiens
agtctgtgtgggactgt

SEQ ID NO: 3325583 - DNA, 20 bp, Homo sapiens
agtctgtgtttacagacaga

SEQ ID NO: 3325584 - DNA, 22 bp, Homo sapiens
agtgccagcattccagacttca

SEQ ID NO: 3325585 - DNA, 18 bp, Homo sapiens
agtgcccaaagtggggag

SEQ ID NO: 3325586 - DNA, 14 bp, Homo sapiens
agtgcccacaggat

SEQ ID NO: 3325587 - DNA, 20 bp, Homo sapiens
agtgcccaccctgggagaca

SEQ ID NO: 3325588 - DNA, 20 bp, Homo sapiens
agtgcccgcctaggagttga

SEQ ID NO: 3325589 - DNA, 15 bp, Homo sapiens
agtgccctgccccct

SEQ ID NO: 3325590 - DNA, 18 bp, Homo sapiens
agtgccggctgtggagca

SEQ ID NO: 3325591 - DNA, 13 bp, Homo sapiens
agtgcctcgaggc

SEQ ID NO: 3325592 - DNA, 17 bp, Homo sapiens
agtgcctcgaggcaccg

SEQ ID NO: 3325593 - DNA, 17 bp, Homo sapiens
agtgcctgggaatgtat

SEQ ID NO: 3325594 - DNA, 18 bp, Homo sapiens
agtgcctgggaatgtatt

SEQ ID NO: 3325595 - DNA, 20 bp, Homo sapiens
agtgccttaatagtagggta

SEQ ID NO: 3325596 - DNA, 15 bp, Homo sapiens
agtgccttccataat

SEQ ID NO: 3325597 - DNA, 16 bp, Homo sapiens
agtgccttccataatt

SEQ ID NO: 3325598 - DNA, 13 bp, Homo sapiens
agtgccttctcct

SEQ ID NO: 3325599 - DNA, 22 bp, Homo sapiens
agtgccttctccttccccagga

SEQ ID NO: 3325600 - DNA, 14 bp, Homo sapiens
agtgccttctgggc

SEQ ID NO: 3325601 - DNA, 20 bp, Homo sapiens
agtgccttctttagaccctc

SEQ ID NO: 3325602 - DNA, 21 bp, Homo sapiens
agtgccttggggaatttcctc

SEQ ID NO: 3325603 - DNA, 14 bp, Homo sapiens
agtgccttttggaa

SEQ ID NO: 3325604 - DNA, 19 bp, Homo sapiens
agtgcggtttactcactgc

SEQ ID NO: 3325605 - DNA, 14 bp, Homo sapiens
agtgcgtgaatgta

SEQ ID NO: 3325606 - DNA, 13 bp, Homo sapiens
agtgcgtgtgtag

SEQ ID NO: 3325607 - DNA, 18 bp, Homo sapiens
agtgcgtgtgtagagtta

SEQ ID NO: 3325608 - DNA, 24 bp, Homo sapiens
agtgctagaaaatttagcccttta

SEQ ID NO: 3325609 - DNA, 23 bp, Homo sapiens
agtgctagtgagctgggcatggt

SEQ ID NO: 3325610 - DNA, 13 bp, Homo sapiens
agtgctatatata

SEQ ID NO: 3325611 - DNA, 15 bp, Homo sapiens
agtgctatatatata

SEQ ID NO: 3325612 - DNA, 22 bp, Homo sapiens
agtgctctgatgcaatagtgga

SEQ ID NO: 3325613 - DNA, 17 bp, Homo sapiens
agtgctcttttctcctc

SEQ ID NO: 3325614 - DNA, 14 bp, Homo sapiens
agtgctgaacagtg

SEQ ID NO: 3325615 - DNA, 21 bp, Homo sapiens
agtgctgagattacaggcatg

SEQ ID NO: 3325616 - DNA, 16 bp, Homo sapiens
agtgctgcatcttata

SEQ ID NO: 3325617 - DNA, 22 bp, Homo sapiens
agtgctgcatcttatagcactt

SEQ ID NO: 3325618 - DNA, 11 bp, Homo sapiens
agtgctgccat

SEQ ID NO: 3325619 - DNA, 21 bp, Homo sapiens
agtgctgccatgccactgcca

SEQ ID NO: 3325620 - DNA, 15 bp, Homo sapiens
agtgctgctgtaaat

SEQ ID NO: 3325621 - DNA, 13 bp, Homo sapiens
agtgctgcttctc

SEQ ID NO: 3325622 - DNA, 15 bp, Homo sapiens
agtgctgcttctctt

SEQ ID NO: 3325623 - DNA, 19 bp, Homo sapiens
agtgctgcttctcttggga

SEQ ID NO: 3325624 - DNA, 14 bp, Homo sapiens
agtgtacatcatgt

SEQ ID NO: 3325625 - DNA, 23 bp, Homo sapiens
agtgtacatggaataacatgtaa

SEQ ID NO: 3325626 - DNA, 12 bp, Homo sapiens
agtgtagaagca

SEQ ID NO: 3325627 - DNA, 20 bp, Homo sapiens
agtgtagcctaaagggcagg

SEQ ID NO: 3325628 - DNA, 23 bp, Homo sapiens
agtgtagcctaaagggcagggcc

SEQ ID NO: 3325629 - DNA, 17 bp, Homo sapiens
agtgtagccttgcccgg

SEQ ID NO: 3325630 - DNA, 18 bp, Homo sapiens
agtgtagccttgcccgga

SEQ ID NO: 3325631 - DNA, 19 bp, Homo sapiens
agtgtagctgtaagggcag

SEQ ID NO: 3325632 - DNA, 21 bp, Homo sapiens
agtgtatcaggtcagggactt

SEQ ID NO: 3325633 - DNA, 16 bp, Homo sapiens
agtgtatggaaataaa

SEQ ID NO: 3325634 - DNA, 20 bp, Homo sapiens
agtgtatggaaataaatgta

SEQ ID NO: 3325635 - DNA, 14 bp, Homo sapiens
agtgtatggggcag

SEQ ID NO: 3325636 - DNA, 13 bp, Homo sapiens
agtgtatgtcttg

SEQ ID NO: 3325637 - DNA, 18 bp, Homo sapiens
agtgtattagatgtggtt

SEQ ID NO: 3325638 - DNA, 14 bp, Homo sapiens
agtgtattatcact

SEQ ID NO: 3325639 - DNA, 15 bp, Homo sapiens
agtgtattatcactg

SEQ ID NO: 3325640 - DNA, 22 bp, Homo sapiens
agtgtattttttaaaattgatt

SEQ ID NO: 3325641 - DNA, 14 bp, Homo sapiens
agtgtcaagttgtg

SEQ ID NO: 3325642 - DNA, 15 bp, Homo sapiens
agtgtcacctctctc

SEQ ID NO: 3325643 - DNA, 19 bp, Homo sapiens
agtgtcacctctctcagag

SEQ ID NO: 3325644 - DNA, 21 bp, Homo sapiens
agtgtcacctctctcagagca

SEQ ID NO: 3325645 - DNA, 19 bp, Homo sapiens
agtgtcacttacctagatt

SEQ ID NO: 3325646 - DNA, 15 bp, Homo sapiens
agtgtcacttccaca

SEQ ID NO: 3325647 - DNA, 23 bp, Homo sapiens
agtgtcagttcaactttcagaag

SEQ ID NO: 3325648 - DNA, 15 bp, Homo sapiens
agtgtcccctccact

SEQ ID NO: 3325649 - DNA, 22 bp, Homo sapiens
agtgtcctcttccctctctgca

SEQ ID NO: 3325650 - DNA, 14 bp, Homo sapiens
agtgtccttagtgt

SEQ ID NO: 3325651 - DNA, 18 bp, Homo sapiens
agtgtccttagtgtataa

SEQ ID NO: 3325652 - DNA, 15 bp, Homo sapiens
agtgtctcacactgg

SEQ ID NO: 3325653 - DNA, 22 bp, Homo sapiens
agtgtctcggagggattcccct

SEQ ID NO: 3325654 - DNA, 13 bp, Homo sapiens
agtgtctggcttt

SEQ ID NO: 3325655 - DNA, 15 bp, Homo sapiens
agtgtctggcttttt

SEQ ID NO: 3325656 - DNA, 17 bp, Homo sapiens
agtgtctgggtttttct

SEQ ID NO: 3325657 - DNA, 14 bp, Homo sapiens
agtgtcttccataa

SEQ ID NO: 3325658 - DNA, 22 bp, Homo sapiens
agtgtctttctttggtgccttt

SEQ ID NO: 3325659 - DNA, 14 bp, Homo sapiens
agtgtgaaatatat

SEQ ID NO: 3325660 - DNA, 22 bp, Homo sapiens
agtgtgaacaaaagatgctctt

SEQ ID NO: 3325661 - DNA, 23 bp, Homo sapiens
agtgtgacaaggattgctactgt

SEQ ID NO: 3325662 - DNA, 22 bp, Homo sapiens
agtgtgacagggccagtggggc

SEQ ID NO: 3325663 - DNA, 14 bp, Homo sapiens
agtgtgagcgcctt

SEQ ID NO: 3325664 - DNA, 17 bp, Homo sapiens
agtgtgagtggcagcca

SEQ ID NO: 3325665 - DNA, 22 bp, Homo sapiens
agtgtgagtggcagccatgcct

SEQ ID NO: 3325666 - DNA, 19 bp, Homo sapiens
agtgtgcacgagtgggaag

SEQ ID NO: 3325667 - DNA, 20 bp, Homo sapiens
agtgtggaagccggagggtg

SEQ ID NO: 3325668 - DNA, 13 bp, Homo sapiens
agtgtggagaggg

SEQ ID NO: 3325669 - DNA, 23 bp, Homo sapiens
agtgtgggtttggttagaggaag

SEQ ID NO: 3325670 - DNA, 19 bp, Homo sapiens
agtgtgtaaggtatatgtt

SEQ ID NO: 3325671 - DNA, 19 bp, Homo sapiens
agtgtgtattgttcccagt

SEQ ID NO: 3325672 - DNA, 19 bp, Homo sapiens
agtgtgtgcataatagcta

SEQ ID NO: 3325673 - DNA, 16 bp, Homo sapiens
agtgtgtggctgggcg

SEQ ID NO: 3325674 - DNA, 17 bp, Homo sapiens
agtgtgttctgattaga

SEQ ID NO: 3325675 - DNA, 15 bp, Homo sapiens
agtgtgttgttgctt

SEQ ID NO: 3325676 - DNA, 22 bp, Homo sapiens
agtgtgttgttgctttaggctc

SEQ ID NO: 3325677 - DNA, 13 bp, Homo sapiens
agtgttagagaaa

SEQ ID NO: 3325678 - DNA, 22 bp, Homo sapiens
agtgttattttctttgaaattg

SEQ ID NO: 3325679 - DNA, 21 bp, Homo sapiens
agtgttatttttcaaggaagg

SEQ ID NO: 3325680 - DNA, 18 bp, Homo sapiens
agtgttccctttcctact

SEQ ID NO: 3325681 - DNA, 15 bp, Homo sapiens
agtgttcgcttggct

SEQ ID NO: 3325682 - DNA, 17 bp, Homo sapiens
agtgttctgcaaaaata

SEQ ID NO: 3325683 - DNA, 16 bp, Homo sapiens
agtgttgaaaatgttc

SEQ ID NO: 3325684 - DNA, 17 bp, Homo sapiens
agtgttgagccttttcc

SEQ ID NO: 3325685 - DNA, 17 bp, Homo sapiens
agtgttggtctttctaa

SEQ ID NO: 3325686 - DNA, 22 bp, Homo sapiens
agtgttggtctttctaatgtag

SEQ ID NO: 3325687 - DNA, 19 bp, Homo sapiens
agtgttgtttgtaaataag

SEQ ID NO: 3325688 - DNA, 19 bp, Homo sapiens
agtgtttatttttcatatt

SEQ ID NO: 3325689 - DNA, 21 bp, Homo sapiens
agtgtttatttttcatattgt

SEQ ID NO: 3325690 - DNA, 15 bp, Homo sapiens
agtgtttcccataat

SEQ ID NO: 3325691 - DNA, 14 bp, Homo sapiens
agtgtttctgttat

SEQ ID NO: 3325692 - DNA, 12 bp, Homo sapiens
agtgtttggggg

SEQ ID NO: 3325693 - DNA, 21 bp, Homo sapiens
agtgtttgtgtctgactcagg

SEQ ID NO: 3325694 - DNA, 14 bp, Homo sapiens
agtgttttactctt

SEQ ID NO: 3325695 - DNA, 12 bp, Homo sapiens
agtgttttcaga

SEQ ID NO: 3325696 - DNA, 17 bp, Homo sapiens
agtgttttcagaagaaa

SEQ ID NO: 3325697 - DNA, 14 bp, Homo sapiens
agtgttttcagagc

SEQ ID NO: 3325698 - DNA, 13 bp, Homo sapiens
agtgttttctggg

SEQ ID NO: 3325699 - DNA, 22 bp, Homo sapiens
agtgttttggactccatctctc

SEQ ID NO: 3325700 - DNA, 16 bp, Homo sapiens
agttaaaagcatttta

SEQ ID NO: 3325701 - DNA, 12 bp, Homo sapiens
agttaaaagtaa

SEQ ID NO: 3325702 - DNA, 15 bp, Homo sapiens
agttaaactaaaaaa

SEQ ID NO: 3325703 - DNA, 21 bp, Homo sapiens
agttaaatagagtatatgcac

SEQ ID NO: 3325704 - DNA, 14 bp, Homo sapiens
agttaaatctcaaa

SEQ ID NO: 3325705 - DNA, 13 bp, Homo sapiens
agttaacaggata

SEQ ID NO: 3325706 - DNA, 15 bp, Homo sapiens
agttaacaggatatt

SEQ ID NO: 3325707 - DNA, 16 bp, Homo sapiens
agttaacaggatatta

SEQ ID NO: 3325708 - DNA, 19 bp, Homo sapiens
agttaacaggatattagac

SEQ ID NO: 3325709 - DNA, 18 bp, Homo sapiens
agttaactgtgaaatacc

SEQ ID NO: 3325710 - DNA, 15 bp, Homo sapiens
agttaagaagctgtt

SEQ ID NO: 3325711 - DNA, 16 bp, Homo sapiens
agttaagaagctgttg

SEQ ID NO: 3325712 - DNA, 17 bp, Homo sapiens
agttaataacagctcct

SEQ ID NO: 3325713 - DNA, 20 bp, Homo sapiens
agttaatatatcccagaaat

SEQ ID NO: 3325714 - DNA, 18 bp, Homo sapiens
agttaatgatggcagagg

SEQ ID NO: 3325715 - DNA, 15 bp, Homo sapiens
agttaatgtatataa

SEQ ID NO: 3325716 - DNA, 23 bp, Homo sapiens
agttaatttttccaactactaat

SEQ ID NO: 3325717 - DNA, 15 bp, Homo sapiens
agttacaaagttata

SEQ ID NO: 3325718 - DNA, 17 bp, Homo sapiens
agttacaattacatctc

SEQ ID NO: 3325719 - DNA, 14 bp, Homo sapiens
atattttggaaact

SEQ ID NO: 3325720 - DNA, 21 bp, Homo sapiens
atattttgtatatatctgctt

SEQ ID NO: 3325721 - DNA, 22 bp, Homo sapiens
atattttgtattgttaatatct

SEQ ID NO: 3325722 - DNA, 14 bp, Homo sapiens
atattttgttctta

SEQ ID NO: 3325723 - DNA, 14 bp, Homo sapiens
atatttttaaagat

SEQ ID NO: 3325724 - DNA, 15 bp, Homo sapiens
atatttttagctctg

SEQ ID NO: 3325725 - DNA, 16 bp, Homo sapiens
atatttttatatttag

SEQ ID NO: 3325726 - DNA, 18 bp, Homo sapiens
atatttttatatttagtt

SEQ ID NO: 3325727 - DNA, 15 bp, Homo sapiens
atatttttatctata

SEQ ID NO: 3325728 - DNA, 16 bp, Homo sapiens
atatttttatctatat

SEQ ID NO: 3325729 - DNA, 16 bp, Homo sapiens
atatttttattttatt

SEQ ID NO: 3325730 - DNA, 22 bp, Homo sapiens
atatttttggggcatcctggat

SEQ ID NO: 3325731 - DNA, 21 bp, Homo sapiens
atatttttggttgtcaatatt

SEQ ID NO: 3325732 - DNA, 16 bp, Homo sapiens
atatttttgtacttga

SEQ ID NO: 3325733 - DNA, 21 bp, Homo sapiens
atatttttgtgttttcttgta

SEQ ID NO: 3325734 - DNA, 20 bp, Homo sapiens
atattttttaatttgatgaa

SEQ ID NO: 3325735 - DNA, 20 bp, Homo sapiens
atattttttatatatacagt

SEQ ID NO: 3325736 - DNA, 16 bp, Homo sapiens
atattttttatttcta

SEQ ID NO: 3325737 - DNA, 12 bp, Homo sapiens
atattttttgca

SEQ ID NO: 3325738 - DNA, 13 bp, Homo sapiens
atattttttgcaa

SEQ ID NO: 3325739 - DNA, 19 bp, Homo sapiens
atattttttgcaagttata

SEQ ID NO: 3325740 - DNA, 17 bp, Homo sapiens
atatttttttaatttaa

SEQ ID NO: 3325741 - DNA, 16 bp, Homo sapiens
atcaaaaaaacaagtt

SEQ ID NO: 3325742 - DNA, 16 bp, Homo sapiens
atcaaaaatattccat

SEQ ID NO: 3325743 - DNA, 21 bp, Homo sapiens
atcaaaacacactactacctc

SEQ ID NO: 3325744 - DNA, 12 bp, Homo sapiens
atcaaaacatgc

SEQ ID NO: 3325745 - DNA, 17 bp, Homo sapiens
atcaaaacctgtgccag

SEQ ID NO: 3325746 - DNA, 22 bp, Homo sapiens
atcaaaacctgtgccaggctga

SEQ ID NO: 3325747 - DNA, 21 bp, Homo sapiens
atcaaaacctttcaaatatca

SEQ ID NO: 3325748 - DNA, 13 bp, Homo sapiens
atcaaaagaaata

SEQ ID NO: 3325749 - DNA, 15 bp, Homo sapiens
atcaaaataaaaagt

SEQ ID NO: 3325750 - DNA, 18 bp, Homo sapiens
atcaaaataaaaagtgac

SEQ ID NO: 3325751 - DNA, 19 bp, Homo sapiens
atcaaaataggatttctta

SEQ ID NO: 3325752 - DNA, 11 bp, Homo sapiens
atcaaaatctt

SEQ ID NO: 3325753 - DNA, 17 bp, Homo sapiens
atcaaaccctagccttg

SEQ ID NO: 3325754 - DNA, 18 bp, Homo sapiens
atcaaaccctagccttgc

SEQ ID NO: 3325755 - DNA, 15 bp, Homo sapiens
atcaaacctttgagt

SEQ ID NO: 3325756 - DNA, 14 bp, Homo sapiens
atcaaagaattaca

SEQ ID NO: 3325757 - DNA, 18 bp, Homo sapiens
atcaaagaattacagtac

SEQ ID NO: 3325758 - DNA, 18 bp, Homo sapiens
atcaaagagagaaaataa

SEQ ID NO: 3325759 - DNA, 12 bp, Homo sapiens
atcaaagatgaa

SEQ ID NO: 3325760 - DNA, 14 bp, Homo sapiens
atcaaagctcataa

SEQ ID NO: 3325761 - DNA, 14 bp, Homo sapiens
atcaaataagaaat

SEQ ID NO: 3325762 - DNA, 11 bp, Homo sapiens
atcaaatatag

SEQ ID NO: 3325763 - DNA, 18 bp, Homo sapiens
atcaaatctcctgctgat

SEQ ID NO: 3325764 - DNA, 16 bp, Homo sapiens
atcaaatgatttcata

SEQ ID NO: 3325765 - DNA, 23 bp, Homo sapiens
atcaaattgcttaaaaaagagtt

SEQ ID NO: 3325766 - DNA, 17 bp, Homo sapiens
atcaacaataaaatttt

SEQ ID NO: 3325767 - DNA, 13 bp, Homo sapiens
atcaacagaagca

SEQ ID NO: 3325768 - DNA, 17 bp, Homo sapiens
atcaacagaagcatttg

SEQ ID NO: 3325769 - DNA, 18 bp, Homo sapiens
atcaacatgttattcaat

SEQ ID NO: 3325770 - DNA, 20 bp, Homo sapiens
atcaaccccttcgctcctgt

SEQ ID NO: 3325771 - DNA, 11 bp, Homo sapiens
atcaactgaat

SEQ ID NO: 3325772 - DNA, 14 bp, Homo sapiens
atcaactgaatgag

SEQ ID NO: 3325773 - DNA, 16 bp, Homo sapiens
atcaacttgtgtactg

SEQ ID NO: 3325774 - DNA, 15 bp, Homo sapiens
atcaactttactgta

SEQ ID NO: 3325775 - DNA, 12 bp, Homo sapiens
atcaagaaagtc

SEQ ID NO: 3325776 - DNA, 15 bp, Homo sapiens
atcaagaaagtgttg

SEQ ID NO: 3325777 - DNA, 22 bp, Homo sapiens
atcaagaattagaagtctttca

SEQ ID NO: 3325778 - DNA, 16 bp, Homo sapiens
atcaagtatttgggaa

SEQ ID NO: 3325779 - DNA, 16 bp, Homo sapiens
atcaagtgtgctttag

SEQ ID NO: 3325780 - DNA, 12 bp, Homo sapiens
atcaatacacta

SEQ ID NO: 3325781 - DNA, 17 bp, Homo sapiens
atcaatacagcttcatt

SEQ ID NO: 3325782 - DNA, 14 bp, Homo sapiens
atcaatagttgaat

SEQ ID NO: 3325783 - DNA, 17 bp, Homo sapiens
atcaatagttgaattag

SEQ ID NO: 3325784 - DNA, 13 bp, Homo sapiens
atcaatcaaataa

SEQ ID NO: 3325785 - DNA, 13 bp, Homo sapiens
atcaatcatgccc

SEQ ID NO: 3325786 - DNA, 13 bp, Homo sapiens
atcaatgttcatt

SEQ ID NO: 3325787 - DNA, 19 bp, Homo sapiens
atcaatgtttcttctaggt

SEQ ID NO: 3325788 - DNA, 15 bp, Homo sapiens
atcaattaaatgtag

SEQ ID NO: 3325789 - DNA, 23 bp, Homo sapiens
atcaattggcagtgactttgtat

SEQ ID NO: 3325790 - DNA, 15 bp, Homo sapiens
atcacaaagtggaac

SEQ ID NO: 3325791 - DNA, 16 bp, Homo sapiens
atcacaagatggaatt

SEQ ID NO: 3325792 - DNA, 11 bp, Homo sapiens
atcacacacac

SEQ ID NO: 3325793 - DNA, 14 bp, Homo sapiens
atcacacttctgtg

SEQ ID NO: 3325794 - DNA, 16 bp, Homo sapiens
atcacagagacattcc

SEQ ID NO: 3325795 - DNA, 12 bp, Homo sapiens
atcacagcagcc

SEQ ID NO: 3325796 - DNA, 15 bp, Homo sapiens
atcacagcctccagg

SEQ ID NO: 3325797 - DNA, 18 bp, Homo sapiens
atcacaggatgccagccc

SEQ ID NO: 3325798 - DNA, 22 bp, Homo sapiens
atcacaggatgccagcccctgc

SEQ ID NO: 3325799 - DNA, 15 bp, Homo sapiens
atcacagggcagagc

SEQ ID NO: 3325800 - DNA, 20 bp, Homo sapiens
atcacagggcagagccggga

SEQ ID NO: 3325801 - DNA, 16 bp, Homo sapiens
atcacagtcatcttta

SEQ ID NO: 3325802 - DNA, 18 bp, Homo sapiens
atcacataaccttaaaaa

SEQ ID NO: 3325803 - DNA, 24 bp, Homo sapiens
atcacattgagctgatataaattc

SEQ ID NO: 3325804 - DNA, 17 bp, Homo sapiens
atcaccaccgcctctgg

SEQ ID NO: 3325805 - DNA, 20 bp, Homo sapiens
atcaccaccgcctctggccg

SEQ ID NO: 3325806 - DNA, 22 bp, Homo sapiens
atcaccagtcctagctcttaca

SEQ ID NO: 3325807 - DNA, 23 bp, Homo sapiens
atcaccctttccggcacactgcc

SEQ ID NO: 3325808 - DNA, 16 bp, Homo sapiens
atcaccgctgggtggt

SEQ ID NO: 3325809 - DNA, 19 bp, Homo sapiens
atcaccgctgggtggtttt

SEQ ID NO: 3325810 - DNA, 15 bp, Homo sapiens
atcacctcaggccag

SEQ ID NO: 3325811 - DNA, 12 bp, Homo sapiens
atcacctgaggt

SEQ ID NO: 3325812 - DNA, 13 bp, Homo sapiens
atcaccttccaaa

SEQ ID NO: 3325813 - DNA, 14 bp, Homo sapiens
atcaccttctttgt

SEQ ID NO: 3325814 - DNA, 15 bp, Homo sapiens
atcaccttctttgta

SEQ ID NO: 3325815 - DNA, 14 bp, Homo sapiens
atcacgccactgca

SEQ ID NO: 3325816 - DNA, 17 bp, Homo sapiens
atcacgccactgcactc

SEQ ID NO: 3325817 - DNA, 20 bp, Homo sapiens
atcacgccactgcactccag

SEQ ID NO: 3325818 - DNA, 23 bp, Homo sapiens
atcacgccactgcactccagcct

SEQ ID NO: 3325819 - DNA, 14 bp, Homo sapiens
atcacgcctggcta

SEQ ID NO: 3325820 - DNA, 15 bp, Homo sapiens
atcacggctcactgc

SEQ ID NO: 3325821 - DNA, 20 bp, Homo sapiens
atcacgtctgacaaatgtgt

SEQ ID NO: 3325822 - DNA, 12 bp, Homo sapiens
atcactaaactt

SEQ ID NO: 3325823 - DNA, 15 bp, Homo sapiens
atcactaaactttat

SEQ ID NO: 3325824 - DNA, 18 bp, Homo sapiens
atcactaacattatattg

SEQ ID NO: 3325825 - DNA, 18 bp, Homo sapiens
atcactaggtaacttatt

SEQ ID NO: 3325826 - DNA, 21 bp, Homo sapiens
atcactatccatgcaccaaac

SEQ ID NO: 3325827 - DNA, 12 bp, Homo sapiens
atcactcccagc

SEQ ID NO: 3325828 - DNA, 21 bp, Homo sapiens
atcactcccagcactcccctt

SEQ ID NO: 3325829 - DNA, 23 bp, Homo sapiens
atcactcccagcactccccttgc

SEQ ID NO: 3325830 - DNA, 21 bp, Homo sapiens
atcactctgctgcttagacat

SEQ ID NO: 3325831 - DNA, 22 bp, Homo sapiens
atcactgaattaagccatcagg

SEQ ID NO: 3325832 - DNA, 20 bp, Homo sapiens
atcactgccacactctccat

SEQ ID NO: 3325833 - DNA, 21 bp, Homo sapiens
atcactgccacactctccatc

SEQ ID NO: 3325834 - DNA, 14 bp, Homo sapiens
atcactgcttgatg

SEQ ID NO: 3325835 - DNA, 17 bp, Homo sapiens
atcactggagcccagga

SEQ ID NO: 3325836 - DNA, 19 bp, Homo sapiens
atcactggctggcctgagc

SEQ ID NO: 3325837 - DNA, 20 bp, Homo sapiens
atcactggctggcctgagca

SEQ ID NO: 3325838 - DNA, 20 bp, Homo sapiens
atcacttaggaaatggcttt

SEQ ID NO: 3325839 - DNA, 14 bp, Homo sapiens
atcacttgtacaaa

SEQ ID NO: 3325840 - DNA, 16 bp, Homo sapiens
atcacttgtacaaaat

SEQ ID NO: 3325841 - DNA, 12 bp, Homo sapiens
atcactttcata

SEQ ID NO: 3325842 - DNA, 14 bp, Homo sapiens
atcacttttcagtg

SEQ ID NO: 3325843 - DNA, 16 bp, Homo sapiens
atcactttttgaacta

SEQ ID NO: 3325844 - DNA, 18 bp, Homo sapiens
atcactttttgaactaag

SEQ ID NO: 3325845 - DNA, 15 bp, Homo sapiens
atcagaaaagggaag

SEQ ID NO: 3325846 - DNA, 22 bp, Homo sapiens
atcatgtccatcccttttcctg

SEQ ID NO: 3325847 - DNA, 24 bp, Homo sapiens
atcatgtccatcccttttcctgtc

SEQ ID NO: 3325848 - DNA, 17 bp, Homo sapiens
atcatgtggccccaccc

SEQ ID NO: 3325849 - DNA, 16 bp, Homo sapiens
atcatgttgatcatgt

SEQ ID NO: 3325850 - DNA, 16 bp, Homo sapiens
atcattaaattggaat

SEQ ID NO: 3325851 - DNA, 20 bp, Homo sapiens
atcattacccttccctgcac

SEQ ID NO: 3325852 - DNA, 11 bp, Homo sapiens
atcattagaac

SEQ ID NO: 3325853 - DNA, 14 bp, Homo sapiens
atcattcagaaatg

SEQ ID NO: 3325854 - DNA, 19 bp, Homo sapiens
atcattcttttatagagca

SEQ ID NO: 3325855 - DNA, 18 bp, Homo sapiens
atcattgaaatacttttt

SEQ ID NO: 3325856 - DNA, 19 bp, Homo sapiens
atcattgaagtatattctt

SEQ ID NO: 3325857 - DNA, 18 bp, Homo sapiens
atcattgattgtcagcta

SEQ ID NO: 3325858 - DNA, 13 bp, Homo sapiens
atcattgatttta

SEQ ID NO: 3325859 - DNA, 22 bp, Homo sapiens
atcattgcactctagcctgggc

SEQ ID NO: 3325860 - DNA, 19 bp, Homo sapiens
atcattgcttcctcctccc

SEQ ID NO: 3325861 - DNA, 19 bp, Homo sapiens
atcattggaacaactgata

SEQ ID NO: 3325862 - DNA, 18 bp, Homo sapiens
atcattgttttgaatatt

SEQ ID NO: 3325863 - DNA, 19 bp, Homo sapiens
atcatttattttttacatt

SEQ ID NO: 3325864 - DNA, 23 bp, Homo sapiens
atcatttcagtatcatctccatc

SEQ ID NO: 3325865 - DNA, 23 bp, Homo sapiens
atcatttctgtctttaagaacta

SEQ ID NO: 3325866 - DNA, 19 bp, Homo sapiens
atcatttgatttaaacaat

SEQ ID NO: 3325867 - DNA, 15 bp, Homo sapiens
atcatttgcccttaa

SEQ ID NO: 3325868 - DNA, 15 bp, Homo sapiens
atcattttacagtga

SEQ ID NO: 3325869 - DNA, 22 bp, Homo sapiens
atcattttacagtgaccttttc

SEQ ID NO: 3325870 - DNA, 11 bp, Homo sapiens
atcattttcat

SEQ ID NO: 3325871 - DNA, 15 bp, Homo sapiens
atcattttcccccca

SEQ ID NO: 3325872 - DNA, 17 bp, Homo sapiens
atcattttccccccact

SEQ ID NO: 3325873 - DNA, 22 bp, Homo sapiens
atcattttctccccttggcagt

SEQ ID NO: 3325874 - DNA, 17 bp, Homo sapiens
atcatttttatattata

SEQ ID NO: 3325875 - DNA, 15 bp, Homo sapiens
atcatttttgtacag

SEQ ID NO: 3325876 - DNA, 20 bp, Homo sapiens
atccaaaatgaatgcaaaat

SEQ ID NO: 3325877 - DNA, 14 bp, Homo sapiens
atccaaaatgtgta

SEQ ID NO: 3325878 - DNA, 19 bp, Homo sapiens
atccaaaatgtgtatttct

SEQ ID NO: 3325879 - DNA, 18 bp, Homo sapiens
atccaaagactgtactgg

SEQ ID NO: 3325880 - DNA, 21 bp, Homo sapiens
atccaaatatcatataaacat

SEQ ID NO: 3325881 - DNA, 18 bp, Homo sapiens
atccaaatcttgaatttc

SEQ ID NO: 3325882 - DNA, 15 bp, Homo sapiens
atccaaccattttca

SEQ ID NO: 3325883 - DNA, 17 bp, Homo sapiens
atccaactctctgagag

SEQ ID NO: 3325884 - DNA, 14 bp, Homo sapiens
atatacatatgtag

SEQ ID NO: 3325885 - DNA, 19 bp, Homo sapiens
atatacatgaaaattttaa

SEQ ID NO: 3325886 - DNA, 13 bp, Homo sapiens
atatacatgtgtg

SEQ ID NO: 3325887 - DNA, 16 bp, Homo sapiens
atatacatgtgtgtat

SEQ ID NO: 3325888 - DNA, 23 bp, Homo sapiens
atatacatgtgtgtatatatgtg

SEQ ID NO: 3325889 - DNA, 20 bp, Homo sapiens
atataccactctttaccttt

SEQ ID NO: 3325890 - DNA, 14 bp, Homo sapiens
atataccatttatc

SEQ ID NO: 3325891 - DNA, 18 bp, Homo sapiens
atatacctataatgtgtg

SEQ ID NO: 3325892 - DNA, 19 bp, Homo sapiens
atatacctataatgtgtgt

SEQ ID NO: 3325893 - DNA, 20 bp, Homo sapiens
atatacctataatgtgtgta

SEQ ID NO: 3325894 - DNA, 22 bp, Homo sapiens
atatacctggcttttactttat

SEQ ID NO: 3325895 - DNA, 22 bp, Homo sapiens
atatactctagatgaagtttta

SEQ ID NO: 3325896 - DNA, 21 bp, Homo sapiens
atatactgattttgaaaagta

SEQ ID NO: 3325897 - DNA, 13 bp, Homo sapiens
atatactgcagct

SEQ ID NO: 3325898 - DNA, 15 bp, Homo sapiens
atatactgcagcttt

SEQ ID NO: 3325899 - DNA, 15 bp, Homo sapiens
atatacttgactcta

SEQ ID NO: 3325900 - DNA, 13 bp, Homo sapiens
atatacttttaaa

SEQ ID NO: 3325901 - DNA, 17 bp, Homo sapiens
atatacttttaaattat

SEQ ID NO: 3325902 - DNA, 18 bp, Homo sapiens
atatagaattcagaaaat

SEQ ID NO: 3325903 - DNA, 13 bp, Homo sapiens
atatagattagaa

SEQ ID NO: 3325904 - DNA, 20 bp, Homo sapiens
atatagcagcaaaaatataa

SEQ ID NO: 3325905 - DNA, 17 bp, Homo sapiens
atatagcattgataatc

SEQ ID NO: 3325906 - DNA, 20 bp, Homo sapiens
atatagcattgataatcttc

SEQ ID NO: 3325907 - DNA, 12 bp, Homo sapiens
atatagcctgcc

SEQ ID NO: 3325908 - DNA, 15 bp, Homo sapiens
atatagcctgcctca

SEQ ID NO: 3325909 - DNA, 23 bp, Homo sapiens
atatagcgtgggttatcagttaa

SEQ ID NO: 3325910 - DNA, 22 bp, Homo sapiens
atataggtctcttctcccagaa

SEQ ID NO: 3325911 - DNA, 18 bp, Homo sapiens
atatagtgctatatatat

SEQ ID NO: 3325912 - DNA, 13 bp, Homo sapiens
atatagttttact

SEQ ID NO: 3325913 - DNA, 15 bp, Homo sapiens
atatataaaaatata

SEQ ID NO: 3325914 - DNA, 15 bp, Homo sapiens
atatataaagaatat

SEQ ID NO: 3325915 - DNA, 17 bp, Homo sapiens
atatataaagaatatat

SEQ ID NO: 3325916 - DNA, 14 bp, Homo sapiens
atatataaagatat

SEQ ID NO: 3325917 - DNA, 18 bp, Homo sapiens
atatataaagatatatag

SEQ ID NO: 3325918 - DNA, 18 bp, Homo sapiens
atatataaagtatagaga

SEQ ID NO: 3325919 - DNA, 15 bp, Homo sapiens
atatataaatgtata

SEQ ID NO: 3325920 - DNA, 21 bp, Homo sapiens
atatataagtttacaccttta

SEQ ID NO: 3325921 - DNA, 17 bp, Homo sapiens
atatataatatactaaa

SEQ ID NO: 3325922 - DNA, 19 bp, Homo sapiens
atatataattctgtacata

SEQ ID NO: 3325923 - DNA, 18 bp, Homo sapiens
atatatacatacacttgt

SEQ ID NO: 3325924 - DNA, 13 bp, Homo sapiens
atatatacatatg

SEQ ID NO: 3325925 - DNA, 17 bp, Homo sapiens
atatatagtccagacac

SEQ ID NO: 3325926 - DNA, 14 bp, Homo sapiens
atatatagtgctat

SEQ ID NO: 3325927 - DNA, 13 bp, Homo sapiens
atatatataaaat

SEQ ID NO: 3325928 - DNA, 12 bp, Homo sapiens
atatatataaag

SEQ ID NO: 3325929 - DNA, 14 bp, Homo sapiens
atatatataaatat

SEQ ID NO: 3325930 - DNA, 15 bp, Homo sapiens
atatatataaatgta

SEQ ID NO: 3325931 - DNA, 10 bp, Homo sapiens
atatatatat

SEQ ID NO: 3325932 - DNA, 20 bp, Homo sapiens
atatatatgcctttttccta

SEQ ID NO: 3325933 - DNA, 23 bp, Homo sapiens
atatatattctattacattttca

SEQ ID NO: 3325934 - DNA, 17 bp, Homo sapiens
atatatctctatttgag

SEQ ID NO: 3325935 - DNA, 17 bp, Homo sapiens
atatatctgcttcagtg

SEQ ID NO: 3325936 - DNA, 12 bp, Homo sapiens
atatatcttatg

SEQ ID NO: 3325937 - DNA, 13 bp, Homo sapiens
atatatgatcatt

SEQ ID NO: 3325938 - DNA, 19 bp, Homo sapiens
atatatgtattatttataa

SEQ ID NO: 3325939 - DNA, 21 bp, Homo sapiens
atatatgtgtatatatacata

SEQ ID NO: 3325940 - DNA, 23 bp, Homo sapiens
atatatgtgtatatatacataca

SEQ ID NO: 3325941 - DNA, 21 bp, Homo sapiens
atatatgttttaagaggcagg

SEQ ID NO: 3325942 - DNA, 16 bp, Homo sapiens
atatattaaaattcca

SEQ ID NO: 3325943 - DNA, 14 bp, Homo sapiens
atatattatgtgaa

SEQ ID NO: 3325944 - DNA, 16 bp, Homo sapiens
atatattatgtgaaga

SEQ ID NO: 3325945 - DNA, 17 bp, Homo sapiens
atatattatgtgaagaa

SEQ ID NO: 3325946 - DNA, 18 bp, Homo sapiens
atatattatgtgaagaat

SEQ ID NO: 3325947 - DNA, 16 bp, Homo sapiens
atatattattgtaagt

SEQ ID NO: 3325948 - DNA, 17 bp, Homo sapiens
atatattcttataaaaa

SEQ ID NO: 3325949 - DNA, 14 bp, Homo sapiens
atatattgaataaa

SEQ ID NO: 3325950 - DNA, 13 bp, Homo sapiens
atatattgaatta

SEQ ID NO: 3325951 - DNA, 16 bp, Homo sapiens
atatattgtacaaatg

SEQ ID NO: 3325952 - DNA, 12 bp, Homo sapiens
atatatttaaaa

SEQ ID NO: 3325953 - DNA, 14 bp, Homo sapiens
atatatttaagcct

SEQ ID NO: 3325954 - DNA, 18 bp, Homo sapiens
atatatttaatatattga

SEQ ID NO: 3325955 - DNA, 13 bp, Homo sapiens
atatatttaatga

SEQ ID NO: 3325956 - DNA, 16 bp, Homo sapiens
atatatttaatgataa

SEQ ID NO: 3325957 - DNA, 22 bp, Homo sapiens
atatatttcacgtgttccctct

SEQ ID NO: 3325958 - DNA, 23 bp, Homo sapiens
atatatttcacttttgttctgct

SEQ ID NO: 3325959 - DNA, 12 bp, Homo sapiens
atatattttaaa

SEQ ID NO: 3325960 - DNA, 16 bp, Homo sapiens
atatattttgtgtgaa

SEQ ID NO: 3325961 - DNA, 22 bp, Homo sapiens
atatattttgtgtgaaattgca

SEQ ID NO: 3325962 - DNA, 20 bp, Homo sapiens
atatatttttggttgtcaat

SEQ ID NO: 3325963 - DNA, 20 bp, Homo sapiens
atatattttttaatttgatg

SEQ ID NO: 3325964 - DNA, 17 bp, Homo sapiens
atatattttttgctttt

SEQ ID NO: 3325965 - DNA, 14 bp, Homo sapiens
atatattttttgta

SEQ ID NO: 3325966 - DNA, 18 bp, Homo sapiens
atatcaaaataggatttc

SEQ ID NO: 3325967 - DNA, 15 bp, Homo sapiens
atatcaaaattctag

SEQ ID NO: 3325968 - DNA, 15 bp, Homo sapiens
atatcaagatgattc

SEQ ID NO: 3325969 - DNA, 20 bp, Homo sapiens
atatcagacaagcactattt

SEQ ID NO: 3325970 - DNA, 21 bp, Homo sapiens
atatcagagctcttaatgttg

SEQ ID NO: 3325971 - DNA, 22 bp, Homo sapiens
atatcagcctgagtctcctgtg

SEQ ID NO: 3325972 - DNA, 22 bp, Homo sapiens
atatcatactgatttttaagtc

SEQ ID NO: 3325973 - DNA, 19 bp, Homo sapiens
atatcatactgttcaatgg

SEQ ID NO: 3325974 - DNA, 14 bp, Homo sapiens
atatcatatgtata

SEQ ID NO: 3325975 - DNA, 19 bp, Homo sapiens
atatcatattggtattcac

SEQ ID NO: 3325976 - DNA, 23 bp, Homo sapiens
atatcatcaatgtgacatttaca

SEQ ID NO: 3325977 - DNA, 14 bp, Homo sapiens
atatcatctgtcat

SEQ ID NO: 3325978 - DNA, 20 bp, Homo sapiens
atatcatctgtcattatatt

SEQ ID NO: 3325979 - DNA, 21 bp, Homo sapiens
atatcatctgtcattatattc

SEQ ID NO: 3325980 - DNA, 13 bp, Homo sapiens
atatcatgcaaaa

SEQ ID NO: 3325981 - DNA, 20 bp, Homo sapiens
atatcatgcttggttttctt

SEQ ID NO: 3325982 - DNA, 17 bp, Homo sapiens
atatcattttaaaaact

SEQ ID NO: 3325983 - DNA, 22 bp, Homo sapiens
atatcattttaaaaactttatt

SEQ ID NO: 3325984 - DNA, 16 bp, Homo sapiens
atatccaaagactgta

SEQ ID NO: 3325985 - DNA, 20 bp, Homo sapiens
atatccaaagactgtactgg

SEQ ID NO: 3325986 - DNA, 15 bp, Homo sapiens
atatccaagtaccaa

SEQ ID NO: 3325987 - DNA, 22 bp, Homo sapiens
atatccaagtaccaatgctgtt

SEQ ID NO: 3325988 - DNA, 16 bp, Homo sapiens
atatccacatctttaa

SEQ ID NO: 3325989 - DNA, 15 bp, Homo sapiens
atatccatgtactgt

SEQ ID NO: 3325990 - DNA, 17 bp, Homo sapiens
atatccatgtactgtag

SEQ ID NO: 3325991 - DNA, 17 bp, Homo sapiens
atatccccactactcaa

SEQ ID NO: 3325992 - DNA, 19 bp, Homo sapiens
atatcctgtattcttgttt

SEQ ID NO: 3325993 - DNA, 17 bp, Homo sapiens
atatcgacttgtttttg

SEQ ID NO: 3325994 - DNA, 15 bp, Homo sapiens
atatcgctgacttca

SEQ ID NO: 3325995 - DNA, 14 bp, Homo sapiens
atatctaatatata

SEQ ID NO: 3325996 - DNA, 16 bp, Homo sapiens
atatctatatataatt

SEQ ID NO: 3325997 - DNA, 21 bp, Homo sapiens
atatctatatataattctgta

SEQ ID NO: 3325998 - DNA, 22 bp, Homo sapiens
atatctatatttttatttctac

SEQ ID NO: 3325999 - DNA, 14 bp, Homo sapiens
atatctctatttga

SEQ ID NO: 3326000 - DNA, 14 bp, Homo sapiens
atatctcttggaaa

SEQ ID NO: 3326001 - DNA, 22 bp, Homo sapiens
atatctcttggaaaataagaca

SEQ ID NO: 3326002 - DNA, 20 bp, Homo sapiens
atatctgaagagtatccttc

SEQ ID NO: 3326003 - DNA, 20 bp, Homo sapiens
atatctggcctaaaatcttg

SEQ ID NO: 3326004 - DNA, 17 bp, Homo sapiens
atatctgggattctact

SEQ ID NO: 3326005 - DNA, 21 bp, Homo sapiens
atatctgggattctactttaa

SEQ ID NO: 3326006 - DNA, 16 bp, Homo sapiens
atatctgtaatggtac

SEQ ID NO: 3326007 - DNA, 16 bp, Homo sapiens
atatcttaaagaaaca

SEQ ID NO: 3326008 - DNA, 20 bp, Homo sapiens
atatcttaattctttgttct

SEQ ID NO: 3326009 - DNA, 22 bp, Homo sapiens
atatcttaattctttgttctgt

SEQ ID NO: 3326010 - DNA, 18 bp, Homo sapiens
atattcaaagcagcagcc

SEQ ID NO: 3326011 - DNA, 12 bp, Homo sapiens
atattcacagtt

SEQ ID NO: 3326012 - DNA, 16 bp, Homo sapiens
atattcaggagttgga

SEQ ID NO: 3326013 - DNA, 22 bp, Homo sapiens
atattcagtgctgtggcctggg

SEQ ID NO: 3326014 - DNA, 23 bp, Homo sapiens
atattcagtgctgtggcctgggc

SEQ ID NO: 3326015 - DNA, 14 bp, Homo sapiens
atattcatgtaaac

SEQ ID NO: 3326016 - DNA, 19 bp, Homo sapiens
atattcattggttaacaat

SEQ ID NO: 3326017 - DNA, 15 bp, Homo sapiens
atattcatttacatg

SEQ ID NO: 3326018 - DNA, 15 bp, Homo sapiens
atattcctgaatgaa

SEQ ID NO: 3326019 - DNA, 17 bp, Homo sapiens
atattcctgaatgaaat

SEQ ID NO: 3326020 - DNA, 23 bp, Homo sapiens
atattcctgaatgaaatatcaga

SEQ ID NO: 3326021 - DNA, 21 bp, Homo sapiens
atattcctgcatttgtgaaat

SEQ ID NO: 3326022 - DNA, 14 bp, Homo sapiens
atattctaagactt

SEQ ID NO: 3326023 - DNA, 23 bp, Homo sapiens
atattctaagacttactctaaga

SEQ ID NO: 3326024 - DNA, 14 bp, Homo sapiens
atattctaattaaa

SEQ ID NO: 3326025 - DNA, 18 bp, Homo sapiens
atattctatacacaccct

SEQ ID NO: 3326026 - DNA, 15 bp, Homo sapiens
atattctattgtatt

SEQ ID NO: 3326027 - DNA, 14 bp, Homo sapiens
atattctccccacc

SEQ ID NO: 3326028 - DNA, 14 bp, Homo sapiens
atattctccttcct

SEQ ID NO: 3326029 - DNA, 23 bp, Homo sapiens
atattctgaaaggaaatacactt

SEQ ID NO: 3326030 - DNA, 16 bp, Homo sapiens
atattctgttggccag

SEQ ID NO: 3326031 - DNA, 18 bp, Homo sapiens
atattcttctcttgcttt

SEQ ID NO: 3326032 - DNA, 21 bp, Homo sapiens
atattgaaaattgaaaagtac

SEQ ID NO: 3326033 - DNA, 13 bp, Homo sapiens
atattgaataaaa

SEQ ID NO: 3326034 - DNA, 15 bp, Homo sapiens
atattgacttgtata

SEQ ID NO: 3326035 - DNA, 16 bp, Homo sapiens
atattgacttgtatat

SEQ ID NO: 3326036 - DNA, 15 bp, Homo sapiens
agttataaaattaaa

SEQ ID NO: 3326037 - DNA, 13 bp, Homo sapiens
agttataacagat

SEQ ID NO: 3326038 - DNA, 14 bp, Homo sapiens
agttataacagatg

SEQ ID NO: 3326039 - DNA, 17 bp, Homo sapiens
agttataacagatgtga

SEQ ID NO: 3326040 - DNA, 12 bp, Homo sapiens
agttataagaag

SEQ ID NO: 3326041 - DNA, 14 bp, Homo sapiens
agttataagaagaa

SEQ ID NO: 3326042 - DNA, 18 bp, Homo sapiens
agttatacagttataaaa

SEQ ID NO: 3326043 - DNA, 20 bp, Homo sapiens
agttatacagttataaaatt

SEQ ID NO: 3326044 - DNA, 21 bp, Homo sapiens
agttatacagttataaaatta

SEQ ID NO: 3326045 - DNA, 19 bp, Homo sapiens
agttatagtatatctggac

SEQ ID NO: 3326046 - DNA, 15 bp, Homo sapiens
agttatagtgaatac

SEQ ID NO: 3326047 - DNA, 13 bp, Homo sapiens
agttatagtttca

SEQ ID NO: 3326048 - DNA, 20 bp, Homo sapiens
agttatcatgaattttaaag

SEQ ID NO: 3326049 - DNA, 17 bp, Homo sapiens
agttatctaaaagaaat

SEQ ID NO: 3326050 - DNA, 10 bp, Homo sapiens
agttatctta

SEQ ID NO: 3326051 - DNA, 12 bp, Homo sapiens
agttatgaatca

SEQ ID NO: 3326052 - DNA, 14 bp, Homo sapiens
agttattaacttta

SEQ ID NO: 3326053 - DNA, 21 bp, Homo sapiens
agttattgaatcttaattttt

SEQ ID NO: 3326054 - DNA, 19 bp, Homo sapiens
agttattttaattatcttt

SEQ ID NO: 3326055 - DNA, 11 bp, Homo sapiens
agttattttat

SEQ ID NO: 3326056 - DNA, 24 bp, Homo sapiens
agttattttatgacatgaaaagtt

SEQ ID NO: 3326057 - DNA, 12 bp, Homo sapiens
agttattttcag

SEQ ID NO: 3326058 - DNA, 23 bp, Homo sapiens
agttattttctacagtggtttta

SEQ ID NO: 3326059 - DNA, 15 bp, Homo sapiens
agttattttggatat

SEQ ID NO: 3326060 - DNA, 21 bp, Homo sapiens
agttatttttatttatttaaa

SEQ ID NO: 3326061 - DNA, 16 bp, Homo sapiens
agttatttttgtacat

SEQ ID NO: 3326062 - DNA, 16 bp, Homo sapiens
agttcaaagtgtatat

SEQ ID NO: 3326063 - DNA, 22 bp, Homo sapiens
agttcaacctggtggcaccaga

SEQ ID NO: 3326064 - DNA, 16 bp, Homo sapiens
agttcaagcctgtggg

SEQ ID NO: 3326065 - DNA, 13 bp, Homo sapiens
agttcaatacagt

SEQ ID NO: 3326066 - DNA, 17 bp, Homo sapiens
agttcacaccctgcaag

SEQ ID NO: 3326067 - DNA, 18 bp, Homo sapiens
agttcacaccctgcaagg

SEQ ID NO: 3326068 - DNA, 14 bp, Homo sapiens
agttcacaggaggc

SEQ ID NO: 3326069 - DNA, 17 bp, Homo sapiens
agttcacaggaggccag

SEQ ID NO: 3326070 - DNA, 21 bp, Homo sapiens
agttcactataaatggtgttt

SEQ ID NO: 3326071 - DNA, 20 bp, Homo sapiens
agttcagagtccttaaaatg

SEQ ID NO: 3326072 - DNA, 18 bp, Homo sapiens
agttcagtagaattacca

SEQ ID NO: 3326073 - DNA, 20 bp, Homo sapiens
agttcagtagaattaccatt

SEQ ID NO: 3326074 - DNA, 19 bp, Homo sapiens
agttcagtggcagggctca

SEQ ID NO: 3326075 - DNA, 21 bp, Homo sapiens
agttcagtggcagggctcagg

SEQ ID NO: 3326076 - DNA, 22 bp, Homo sapiens
agttcagtggcagggctcagga

SEQ ID NO: 3326077 - DNA, 14 bp, Homo sapiens
agttcataccctgt

SEQ ID NO: 3326078 - DNA, 20 bp, Homo sapiens
agttcatacctaagtactgt

SEQ ID NO: 3326079 - DNA, 22 bp, Homo sapiens
agttcatacctaagtactgtaa

SEQ ID NO: 3326080 - DNA, 20 bp, Homo sapiens
agttcatagggtctcttcag

SEQ ID NO: 3326081 - DNA, 13 bp, Homo sapiens
agttcatatatac

SEQ ID NO: 3326082 - DNA, 16 bp, Homo sapiens
agttcatatatacata

SEQ ID NO: 3326083 - DNA, 20 bp, Homo sapiens
agttcatattccatatttat

SEQ ID NO: 3326084 - DNA, 22 bp, Homo sapiens
agttcatccaatcctcactggg

SEQ ID NO: 3326085 - DNA, 22 bp, Homo sapiens
agttcatgcagctgtggcagag

SEQ ID NO: 3326086 - DNA, 22 bp, Homo sapiens
agttcatgtgtggaaatgggac

SEQ ID NO: 3326087 - DNA, 23 bp, Homo sapiens
agttcatgtttgcttcataaatg

SEQ ID NO: 3326088 - DNA, 20 bp, Homo sapiens
agttcattattttgtggttc

SEQ ID NO: 3326089 - DNA, 15 bp, Homo sapiens
agttcattgcaatta

SEQ ID NO: 3326090 - DNA, 19 bp, Homo sapiens
agttccaagagtctaaaga

SEQ ID NO: 3326091 - DNA, 20 bp, Homo sapiens
agttccaagagtctaaagat

SEQ ID NO: 3326092 - DNA, 14 bp, Homo sapiens
agttccacagattg

SEQ ID NO: 3326093 - DNA, 17 bp, Homo sapiens
agttcccaaaagattgc

SEQ ID NO: 3326094 - DNA, 14 bp, Homo sapiens
agttcccagctccc

SEQ ID NO: 3326095 - DNA, 23 bp, Homo sapiens
agttcccggagcacagccctggg

SEQ ID NO: 3326096 - DNA, 17 bp, Homo sapiens
agttccctctgctcagc

SEQ ID NO: 3326097 - DNA, 15 bp, Homo sapiens
agttccctgaaacac

SEQ ID NO: 3326098 - DNA, 17 bp, Homo sapiens
agttccctgaaacacga

SEQ ID NO: 3326099 - DNA, 21 bp, Homo sapiens
agttccctgtctcttgaaaaa

SEQ ID NO: 3326100 - DNA, 15 bp, Homo sapiens
agttcccttggcctc

SEQ ID NO: 3326101 - DNA, 17 bp, Homo sapiens
agttcccttggcctcag

SEQ ID NO: 3326102 - DNA, 20 bp, Homo sapiens
agttcctaagaagcttctaa

SEQ ID NO: 3326103 - DNA, 18 bp, Homo sapiens
agttcctctagtgccctc

SEQ ID NO: 3326104 - DNA, 14 bp, Homo sapiens
agttcctcttttgt

SEQ ID NO: 3326105 - DNA, 22 bp, Homo sapiens
agttcctcttttgtgctgcttc

SEQ ID NO: 3326106 - DNA, 21 bp, Homo sapiens
agttcctgtcccttctcttaa

SEQ ID NO: 3326107 - DNA, 14 bp, Homo sapiens
agttcctttagaaa

SEQ ID NO: 3326108 - DNA, 15 bp, Homo sapiens
agttcgaacatgttt

SEQ ID NO: 3326109 - DNA, 18 bp, Homo sapiens
agttcgagaccagcctgg

SEQ ID NO: 3326110 - DNA, 17 bp, Homo sapiens
agttcggctctgggtgg

SEQ ID NO: 3326111 - DNA, 19 bp, Homo sapiens
agttcgtaccgcttcctta

SEQ ID NO: 3326112 - DNA, 18 bp, Homo sapiens
agttctaagactcaaatg

SEQ ID NO: 3326113 - DNA, 16 bp, Homo sapiens
agttctaagattctaa

SEQ ID NO: 3326114 - DNA, 16 bp, Homo sapiens
agttctaagattctga

SEQ ID NO: 3326115 - DNA, 17 bp, Homo sapiens
agttctaagattctgat

SEQ ID NO: 3326116 - DNA, 20 bp, Homo sapiens
agttctaataatttctaatg

SEQ ID NO: 3326117 - DNA, 15 bp, Homo sapiens
agttctacataagta

SEQ ID NO: 3326118 - DNA, 20 bp, Homo sapiens
agttctagaaccacttcctg

SEQ ID NO: 3326119 - DNA, 21 bp, Homo sapiens
agttctagaaccacttcctgc

SEQ ID NO: 3326120 - DNA, 10 bp, Homo sapiens
agttctagac

SEQ ID NO: 3326121 - DNA, 10 bp, Homo sapiens
agttctaggc

SEQ ID NO: 3326122 - DNA, 22 bp, Homo sapiens
agttctaggcactgtagttcta

SEQ ID NO: 3326123 - DNA, 21 bp, Homo sapiens
agttctaggggagaagagccc

SEQ ID NO: 3326124 - DNA, 23 bp, Homo sapiens
agttctatcagttatcctttgtg

SEQ ID NO: 3326125 - DNA, 19 bp, Homo sapiens
agttctcactgttccctct

SEQ ID NO: 3326126 - DNA, 20 bp, Homo sapiens
agttctcactgttccctctg

SEQ ID NO: 3326127 - DNA, 12 bp, Homo sapiens
agttctcagggc

SEQ ID NO: 3326128 - DNA, 16 bp, Homo sapiens
agttctctagggtctg

SEQ ID NO: 3326129 - DNA, 15 bp, Homo sapiens
agttctgccaggcaa

SEQ ID NO: 3326130 - DNA, 23 bp, Homo sapiens
agttctgccaggcaacttttaaa

SEQ ID NO: 3326131 - DNA, 18 bp, Homo sapiens
agttctgctcctctccag

SEQ ID NO: 3326132 - DNA, 12 bp, Homo sapiens
agttctgctcta

SEQ ID NO: 3326133 - DNA, 20 bp, Homo sapiens
agttctgctttagctttcca

SEQ ID NO: 3326134 - DNA, 14 bp, Homo sapiens
agttctgtgaagag

SEQ ID NO: 3326135 - DNA, 23 bp, Homo sapiens
agttctgtggtttcatgttagtt

SEQ ID NO: 3326136 - DNA, 16 bp, Homo sapiens
agttctgtgtatttaa

SEQ ID NO: 3326137 - DNA, 18 bp, Homo sapiens
agttctgtgtttaatttc

SEQ ID NO: 3326138 - DNA, 18 bp, Homo sapiens
atctgcctggcctggctc

SEQ ID NO: 3326139 - DNA, 15 bp, Homo sapiens
atctgcctgggcctg

SEQ ID NO: 3326140 - DNA, 17 bp, Homo sapiens
atctgcctgggcctgtg

SEQ ID NO: 3326141 - DNA, 18 bp, Homo sapiens
atctgcctgggcctgtgc

SEQ ID NO: 3326142 - DNA, 17 bp, Homo sapiens
atctgccttaaaaccaa

SEQ ID NO: 3326143 - DNA, 18 bp, Homo sapiens
atctgccttaaaaccaaa

SEQ ID NO: 3326144 - DNA, 19 bp, Homo sapiens
atctgccttaaaaccaaag

SEQ ID NO: 3326145 - DNA, 13 bp, Homo sapiens
atctgctcacttt

SEQ ID NO: 3326146 - DNA, 23 bp, Homo sapiens
atctgctgcatagctctatttta

SEQ ID NO: 3326147 - DNA, 19 bp, Homo sapiens
atctgctgttgccatagcc

SEQ ID NO: 3326148 - DNA, 20 bp, Homo sapiens
atctgctgttgccatagccc

SEQ ID NO: 3326149 - DNA, 19 bp, Homo sapiens
atctggacttcctataata

SEQ ID NO: 3326150 - DNA, 22 bp, Homo sapiens
atctggagaccagggagccttt

SEQ ID NO: 3326151 - DNA, 13 bp, Homo sapiens
atctggcactgtt

SEQ ID NO: 3326152 - DNA, 20 bp, Homo sapiens
atctggccctcgacactcac

SEQ ID NO: 3326153 - DNA, 21 bp, Homo sapiens
atctggccctcgacactcacc

SEQ ID NO: 3326154 - DNA, 17 bp, Homo sapiens
atctggcctaaaatctt

SEQ ID NO: 3326155 - DNA, 18 bp, Homo sapiens
atctggcctaaaatcttg

SEQ ID NO: 3326156 - DNA, 19 bp, Homo sapiens
atctggcctaaaatcttgg

SEQ ID NO: 3326157 - DNA, 23 bp, Homo sapiens
atctggcctaaaatcttggaagt

SEQ ID NO: 3326158 - DNA, 17 bp, Homo sapiens
atctggcctggcctggc

SEQ ID NO: 3326159 - DNA, 13 bp, Homo sapiens
atctggctgttta

SEQ ID NO: 3326160 - DNA, 23 bp, Homo sapiens
atctggcttagtgccacccacct

SEQ ID NO: 3326161 - DNA, 19 bp, Homo sapiens
atctggcttattttaatgt

SEQ ID NO: 3326162 - DNA, 21 bp, Homo sapiens
atctgggaggcagaacaggct

SEQ ID NO: 3326163 - DNA, 20 bp, Homo sapiens
atctgggagtccccttttct

SEQ ID NO: 3326164 - DNA, 13 bp, Homo sapiens
atctgggcctggg

SEQ ID NO: 3326165 - DNA, 14 bp, Homo sapiens
atctggggagctcc

SEQ ID NO: 3326166 - DNA, 19 bp, Homo sapiens
atctggggttggcaacagg

SEQ ID NO: 3326167 - DNA, 16 bp, Homo sapiens
atctgggtaagaagaa

SEQ ID NO: 3326168 - DNA, 17 bp, Homo sapiens
atctgggtaagaagaaa

SEQ ID NO: 3326169 - DNA, 23 bp, Homo sapiens
atctgggtaagaagaaagcaaaa

SEQ ID NO: 3326170 - DNA, 14 bp, Homo sapiens
atctgggtccttgc

SEQ ID NO: 3326171 - DNA, 17 bp, Homo sapiens
atctggtagatttttaa

SEQ ID NO: 3326172 - DNA, 16 bp, Homo sapiens
atctggtctaatttat

SEQ ID NO: 3326173 - DNA, 21 bp, Homo sapiens
atctggtcttgttagaaaaca

SEQ ID NO: 3326174 - DNA, 17 bp, Homo sapiens
atctggtgcctcctcaa

SEQ ID NO: 3326175 - DNA, 15 bp, Homo sapiens
atctggtgttgggga

SEQ ID NO: 3326176 - DNA, 14 bp, Homo sapiens
atctgtaaactgtg

SEQ ID NO: 3326177 - DNA, 17 bp, Homo sapiens
atctgtaaactgtgtat

SEQ ID NO: 3326178 - DNA, 11 bp, Homo sapiens
atctgtacatt

SEQ ID NO: 3326179 - DNA, 23 bp, Homo sapiens
atctgtacattttgttgtaaaaa

SEQ ID NO: 3326180 - DNA, 12 bp, Homo sapiens
atctgtagatac

SEQ ID NO: 3326181 - DNA, 15 bp, Homo sapiens
atctgtagggctgga

SEQ ID NO: 3326182 - DNA, 17 bp, Homo sapiens
atctgtagggctggacc

SEQ ID NO: 3326183 - DNA, 22 bp, Homo sapiens
atctgtagtaatttattgtctg

SEQ ID NO: 3326184 - DNA, 13 bp, Homo sapiens
atctgtatctctc

SEQ ID NO: 3326185 - DNA, 22 bp, Homo sapiens
atctgtatttaatggtttttat

SEQ ID NO: 3326186 - DNA, 16 bp, Homo sapiens
atctgtcaaaacactg

SEQ ID NO: 3326187 - DNA, 17 bp, Homo sapiens
atctgtcaaaacactgt

SEQ ID NO: 3326188 - DNA, 19 bp, Homo sapiens
atctgtcaaaacactgtgg

SEQ ID NO: 3326189 - DNA, 20 bp, Homo sapiens
atctgtcacacctgtgcctc

SEQ ID NO: 3326190 - DNA, 17 bp, Homo sapiens
atctgtcattatattct

SEQ ID NO: 3326191 - DNA, 19 bp, Homo sapiens
atctgtccaaaggaggctg

SEQ ID NO: 3326192 - DNA, 22 bp, Homo sapiens
atctgtccatggcctttctaat

SEQ ID NO: 3326193 - DNA, 21 bp, Homo sapiens
atctgtgaaatgctggcattt

SEQ ID NO: 3326194 - DNA, 13 bp, Homo sapiens
atctgtgaattaa

SEQ ID NO: 3326195 - DNA, 19 bp, Homo sapiens
atctgtgatgacattccct

SEQ ID NO: 3326196 - DNA, 14 bp, Homo sapiens
atctgtgatgggag

SEQ ID NO: 3326197 - DNA, 12 bp, Homo sapiens
atctgtgcagga

SEQ ID NO: 3326198 - DNA, 15 bp, Homo sapiens
atctgtggagctgcc

SEQ ID NO: 3326199 - DNA, 23 bp, Homo sapiens
atctgtgggtctgggagtcacac

SEQ ID NO: 3326200 - DNA, 21 bp, Homo sapiens
atctgtgtatattatttggca

SEQ ID NO: 3326201 - DNA, 13 bp, Homo sapiens
atctgtgtcctgg

SEQ ID NO: 3326202 - DNA, 15 bp, Homo sapiens
atctgtgtgaaactt

SEQ ID NO: 3326203 - DNA, 16 bp, Homo sapiens
atctgtgtttttgaaa

SEQ ID NO: 3326204 - DNA, 21 bp, Homo sapiens
atctgtgtttttgaaatatta

SEQ ID NO: 3326205 - DNA, 22 bp, Homo sapiens
atctgttttaaatttatttcaa

SEQ ID NO: 3326206 - DNA, 15 bp, Homo sapiens
atcttaaaaatattg

SEQ ID NO: 3326207 - DNA, 18 bp, Homo sapiens
atcttaaagaaacagctt

SEQ ID NO: 3326208 - DNA, 22 bp, Homo sapiens
atcttaaagaaacagctttcaa

SEQ ID NO: 3326209 - DNA, 19 bp, Homo sapiens
atcttaaagtgtgtttcta

SEQ ID NO: 3326210 - DNA, 21 bp, Homo sapiens
atcttaagagtgctaaatttt

SEQ ID NO: 3326211 - DNA, 15 bp, Homo sapiens
atcttaccagatgct

SEQ ID NO: 3326212 - DNA, 16 bp, Homo sapiens
atcttaccagatgcta

SEQ ID NO: 3326213 - DNA, 16 bp, Homo sapiens
atcttacctgtaaagt

SEQ ID NO: 3326214 - DNA, 15 bp, Homo sapiens
atcttagattctctg

SEQ ID NO: 3326215 - DNA, 19 bp, Homo sapiens
atcttagcatagcttatta

SEQ ID NO: 3326216 - DNA, 20 bp, Homo sapiens
atcttaggggagagctttct

SEQ ID NO: 3326217 - DNA, 18 bp, Homo sapiens
atcttagggtgaaccact

SEQ ID NO: 3326218 - DNA, 14 bp, Homo sapiens
atcttagtgtatga

SEQ ID NO: 3326219 - DNA, 15 bp, Homo sapiens
atcttagtgtatgat

SEQ ID NO: 3326220 - DNA, 16 bp, Homo sapiens
atcttagtgtatgatt

SEQ ID NO: 3326221 - DNA, 19 bp, Homo sapiens
atcttagtgtatgattact

SEQ ID NO: 3326222 - DNA, 23 bp, Homo sapiens
atcttagtttggattcttatgta

SEQ ID NO: 3326223 - DNA, 18 bp, Homo sapiens
atcttatagcactttgaa

SEQ ID NO: 3326224 - DNA, 14 bp, Homo sapiens
atcttattataaaa

SEQ ID NO: 3326225 - DNA, 23 bp, Homo sapiens
atcttattccgagcattccagta

SEQ ID NO: 3326226 - DNA, 15 bp, Homo sapiens
atcttcacattgtgt

SEQ ID NO: 3326227 - DNA, 19 bp, Homo sapiens
atcttcagaactgcccttg

SEQ ID NO: 3326228 - DNA, 14 bp, Homo sapiens
atcttcagttttat

SEQ ID NO: 3326229 - DNA, 23 bp, Homo sapiens
atcttccacctgtgccctcacca

SEQ ID NO: 3326230 - DNA, 23 bp, Homo sapiens
atcttccgtggtcagagtgccac

SEQ ID NO: 3326231 - DNA, 12 bp, Homo sapiens
atcttcctgctg

SEQ ID NO: 3326232 - DNA, 15 bp, Homo sapiens
atcttcctgctgctg

SEQ ID NO: 3326233 - DNA, 16 bp, Homo sapiens
atcttcctgctgctgt

SEQ ID NO: 3326234 - DNA, 12 bp, Homo sapiens
atcttcctttct

SEQ ID NO: 3326235 - DNA, 13 bp, Homo sapiens
atcttcctttctt

SEQ ID NO: 3326236 - DNA, 22 bp, Homo sapiens
atcttcctttcttgtctttcct

SEQ ID NO: 3326237 - DNA, 22 bp, Homo sapiens
atcttcgtcttcactcttaggc

SEQ ID NO: 3326238 - DNA, 15 bp, Homo sapiens
atcttctatttttat

SEQ ID NO: 3326239 - DNA, 19 bp, Homo sapiens
atcttctatttttatcatg

SEQ ID NO: 3326240 - DNA, 23 bp, Homo sapiens
atcttctatttttatcatgaatt

SEQ ID NO: 3326241 - DNA, 18 bp, Homo sapiens
atcttctcaagttctaag

SEQ ID NO: 3326242 - DNA, 20 bp, Homo sapiens
atcttctcaagttctaagat

SEQ ID NO: 3326243 - DNA, 23 bp, Homo sapiens
atcttctcaagttctaagattct

SEQ ID NO: 3326244 - DNA, 20 bp, Homo sapiens
atcttctcatcttttatcta

SEQ ID NO: 3326245 - DNA, 18 bp, Homo sapiens
atcttctgccttctcatg

SEQ ID NO: 3326246 - DNA, 13 bp, Homo sapiens
atcttctggaata

SEQ ID NO: 3326247 - DNA, 15 bp, Homo sapiens
atcttctggaatatt

SEQ ID NO: 3326248 - DNA, 12 bp, Homo sapiens
atcttctggctt

SEQ ID NO: 3326249 - DNA, 14 bp, Homo sapiens
atcttctggcttga

SEQ ID NO: 3326250 - DNA, 22 bp, Homo sapiens
atcttctggtttaaacttgttt

SEQ ID NO: 3326251 - DNA, 16 bp, Homo sapiens
atcttctgtgaaatat

SEQ ID NO: 3326252 - DNA, 16 bp, Homo sapiens
atcttcttactaagct

SEQ ID NO: 3326253 - DNA, 17 bp, Homo sapiens
atcttcttatgcaattt

SEQ ID NO: 3326254 - DNA, 16 bp, Homo sapiens
atcttcttcaaataca

SEQ ID NO: 3326255 - DNA, 23 bp, Homo sapiens
atcttcttcatccaacttccaag

SEQ ID NO: 3326256 - DNA, 14 bp, Homo sapiens
atcttgaatgtggt

SEQ ID NO: 3326257 - DNA, 19 bp, Homo sapiens
atcttgaatgtggtctcag

SEQ ID NO: 3326258 - DNA, 15 bp, Homo sapiens
atcttgaatttctgc

SEQ ID NO: 3326259 - DNA, 17 bp, Homo sapiens
atcttgaggaataaatg

SEQ ID NO: 3326260 - DNA, 11 bp, Homo sapiens
atcttgcattc

SEQ ID NO: 3326261 - DNA, 16 bp, Homo sapiens
atcttgcattcatttt

SEQ ID NO: 3326262 - DNA, 12 bp, Homo sapiens
atcttgccacat

SEQ ID NO: 3326263 - DNA, 17 bp, Homo sapiens
atcttgccacatttctg

SEQ ID NO: 3326264 - DNA, 22 bp, Homo sapiens
atgaaggttaggatttaacagt

SEQ ID NO: 3326265 - DNA, 19 bp, Homo sapiens
atgaagtaaattatgtaac

SEQ ID NO: 3326266 - DNA, 16 bp, Homo sapiens
atgaagtatacttttc

SEQ ID NO: 3326267 - DNA, 18 bp, Homo sapiens
atgaagtgttagatagaa

SEQ ID NO: 3326268 - DNA, 19 bp, Homo sapiens
atgaagtttgaacttcata

SEQ ID NO: 3326269 - DNA, 14 bp, Homo sapiens
atgaagttttacat

SEQ ID NO: 3326270 - DNA, 12 bp, Homo sapiens
atgaataaaata

SEQ ID NO: 3326271 - DNA, 17 bp, Homo sapiens
atgaataaactgaatat

SEQ ID NO: 3326272 - DNA, 21 bp, Homo sapiens
atgaataaactgaatattttg

SEQ ID NO: 3326273 - DNA, 21 bp, Homo sapiens
atgaatacagggcatgcattt

SEQ ID NO: 3326274 - DNA, 12 bp, Homo sapiens
atgaatatcatt

SEQ ID NO: 3326275 - DNA, 22 bp, Homo sapiens
atgaatatcattgattttataa

SEQ ID NO: 3326276 - DNA, 14 bp, Homo sapiens
atgaatatgatgac

SEQ ID NO: 3326277 - DNA, 13 bp, Homo sapiens
atgaatattgatg

SEQ ID NO: 3326278 - DNA, 12 bp, Homo sapiens
atgaatatttat

SEQ ID NO: 3326279 - DNA, 12 bp, Homo sapiens
atgaatattttg

SEQ ID NO: 3326280 - DNA, 14 bp, Homo sapiens
atgaatcaatgaaa

SEQ ID NO: 3326281 - DNA, 17 bp, Homo sapiens
atgaatcactgttttta

SEQ ID NO: 3326282 - DNA, 16 bp, Homo sapiens
atgaatccaactgctt

SEQ ID NO: 3326283 - DNA, 20 bp, Homo sapiens
atgaatctcgttcccaaaga

SEQ ID NO: 3326284 - DNA, 15 bp, Homo sapiens
atgaatctgattttt

SEQ ID NO: 3326285 - DNA, 17 bp, Homo sapiens
atgaatgaaacattttg

SEQ ID NO: 3326286 - DNA, 20 bp, Homo sapiens
atgaatgcaaaattgttttc

SEQ ID NO: 3326287 - DNA, 15 bp, Homo sapiens
atgaatgcacactag

SEQ ID NO: 3326288 - DNA, 13 bp, Homo sapiens
atgaatgcccagt

SEQ ID NO: 3326289 - DNA, 21 bp, Homo sapiens
atgaatgcccagtgagactgt

SEQ ID NO: 3326290 - DNA, 16 bp, Homo sapiens
atgaatgtaatctaat

SEQ ID NO: 3326291 - DNA, 16 bp, Homo sapiens
atgaatgtatcaggaa

SEQ ID NO: 3326292 - DNA, 18 bp, Homo sapiens
atgaatgtatgtgcactg

SEQ ID NO: 3326293 - DNA, 19 bp, Homo sapiens
atgaatgtatgtgcactgt

SEQ ID NO: 3326294 - DNA, 20 bp, Homo sapiens
atgaattaaatattgaaaca

SEQ ID NO: 3326295 - DNA, 13 bp, Homo sapiens
atgaattaaattt

SEQ ID NO: 3326296 - DNA, 17 bp, Homo sapiens
atgaattcaagaaagga

SEQ ID NO: 3326297 - DNA, 17 bp, Homo sapiens
atgaattcctatatacc

SEQ ID NO: 3326298 - DNA, 14 bp, Homo sapiens
atgaatttaaatat

SEQ ID NO: 3326299 - DNA, 20 bp, Homo sapiens
atgaatttggagactctgtg

SEQ ID NO: 3326300 - DNA, 20 bp, Homo sapiens
atgaatttgtcgcaaagacg

SEQ ID NO: 3326301 - DNA, 22 bp, Homo sapiens
atgaattttcaagtaattgtga

SEQ ID NO: 3326302 - DNA, 13 bp, Homo sapiens
atgacaacactta

SEQ ID NO: 3326303 - DNA, 16 bp, Homo sapiens
atgacaacagaaaaac

SEQ ID NO: 3326304 - DNA, 14 bp, Homo sapiens
atgacaacagaagc

SEQ ID NO: 3326305 - DNA, 19 bp, Homo sapiens
atgacaacagaagcttcag

SEQ ID NO: 3326306 - DNA, 23 bp, Homo sapiens
atgacaacctgtgtgagagaatt

SEQ ID NO: 3326307 - DNA, 15 bp, Homo sapiens
atgacaactttgcca

SEQ ID NO: 3326308 - DNA, 13 bp, Homo sapiens
atgacaagcattt

SEQ ID NO: 3326309 - DNA, 15 bp, Homo sapiens
atgacaatgactgtg

SEQ ID NO: 3326310 - DNA, 20 bp, Homo sapiens
atgacaccatcttttattct

SEQ ID NO: 3326311 - DNA, 13 bp, Homo sapiens
atgacaccctggc

SEQ ID NO: 3326312 - DNA, 16 bp, Homo sapiens
atgacaccctggcctg

SEQ ID NO: 3326313 - DNA, 16 bp, Homo sapiens
atgacactagaaaact

SEQ ID NO: 3326314 - DNA, 23 bp, Homo sapiens
atgacagatatatttaagcctta

SEQ ID NO: 3326315 - DNA, 15 bp, Homo sapiens
atgacagatggtgaa

SEQ ID NO: 3326316 - DNA, 14 bp, Homo sapiens
atgacagattctga

SEQ ID NO: 3326317 - DNA, 24 bp, Homo sapiens
atgacaggcctgaagatattacta

SEQ ID NO: 3326318 - DNA, 16 bp, Homo sapiens
atgacatctcaggggc

SEQ ID NO: 3326319 - DNA, 24 bp, Homo sapiens
atgacatcttcaaagcttgaagat

SEQ ID NO: 3326320 - DNA, 18 bp, Homo sapiens
atgacatgcactgaccct

SEQ ID NO: 3326321 - DNA, 19 bp, Homo sapiens
atgacatgcactgaccctt

SEQ ID NO: 3326322 - DNA, 22 bp, Homo sapiens
atgacatgcactgacccttcca

SEQ ID NO: 3326323 - DNA, 23 bp, Homo sapiens
atgacatgcactgacccttccag

SEQ ID NO: 3326324 - DNA, 22 bp, Homo sapiens
atgacattaaagaagggttgag

SEQ ID NO: 3326325 - DNA, 18 bp, Homo sapiens
atgaccaaaccagccttc

SEQ ID NO: 3326326 - DNA, 23 bp, Homo sapiens
atgaccaatattatactaagaaa

SEQ ID NO: 3326327 - DNA, 22 bp, Homo sapiens
atgaccagggatgctgggctgg

SEQ ID NO: 3326328 - DNA, 23 bp, Homo sapiens
atgaccagggatgctgggctggg

SEQ ID NO: 3326329 - DNA, 18 bp, Homo sapiens
atgacctagttttccatg

SEQ ID NO: 3326330 - DNA, 14 bp, Homo sapiens
atcctgtataagca

SEQ ID NO: 3326331 - DNA, 16 bp, Homo sapiens
atcctgtattcttcaa

SEQ ID NO: 3326332 - DNA, 16 bp, Homo sapiens
atcctgtattcttgtt

SEQ ID NO: 3326333 - DNA, 21 bp, Homo sapiens
atcctgtattcttgttttaca

SEQ ID NO: 3326334 - DNA, 18 bp, Homo sapiens
atcctgtctttctgagca

SEQ ID NO: 3326335 - DNA, 11 bp, Homo sapiens
atcctgtgact

SEQ ID NO: 3326336 - DNA, 21 bp, Homo sapiens
atcctgtgactgtctcactta

SEQ ID NO: 3326337 - DNA, 19 bp, Homo sapiens
atcctgtgtcagaaaccct

SEQ ID NO: 3326338 - DNA, 14 bp, Homo sapiens
atcctgtttataat

SEQ ID NO: 3326339 - DNA, 22 bp, Homo sapiens
atcctgtttataatctgaagat

SEQ ID NO: 3326340 - DNA, 18 bp, Homo sapiens
atccttagaggtcctctg

SEQ ID NO: 3326341 - DNA, 16 bp, Homo sapiens
atccttatcccaagct

SEQ ID NO: 3326342 - DNA, 17 bp, Homo sapiens
atccttcacaggcagtg

SEQ ID NO: 3326343 - DNA, 18 bp, Homo sapiens
atccttccaaaaaattaa

SEQ ID NO: 3326344 - DNA, 23 bp, Homo sapiens
atccttccaaaaattattataag

SEQ ID NO: 3326345 - DNA, 14 bp, Homo sapiens
atccttccaaagaa

SEQ ID NO: 3326346 - DNA, 12 bp, Homo sapiens
atccttccctgt

SEQ ID NO: 3326347 - DNA, 17 bp, Homo sapiens
atccttccctttggaga

SEQ ID NO: 3326348 - DNA, 14 bp, Homo sapiens
atccttcctataac

SEQ ID NO: 3326349 - DNA, 22 bp, Homo sapiens
atccttcctataacttgatgca

SEQ ID NO: 3326350 - DNA, 21 bp, Homo sapiens
atccttcggggcgatgctccc

SEQ ID NO: 3326351 - DNA, 23 bp, Homo sapiens
atccttcgtgaacatcccctccc

SEQ ID NO: 3326352 - DNA, 19 bp, Homo sapiens
atccttcttatgtttgctt

SEQ ID NO: 3326353 - DNA, 20 bp, Homo sapiens
atccttcttatgtttgcttt

SEQ ID NO: 3326354 - DNA, 15 bp, Homo sapiens
atccttggcaccaaa

SEQ ID NO: 3326355 - DNA, 16 bp, Homo sapiens
atccttggcaccaaag

SEQ ID NO: 3326356 - DNA, 17 bp, Homo sapiens
atccttggtctttgtat

SEQ ID NO: 3326357 - DNA, 22 bp, Homo sapiens
atcctttcaaaagaagagtttt

SEQ ID NO: 3326358 - DNA, 15 bp, Homo sapiens
atcctttctgccgac

SEQ ID NO: 3326359 - DNA, 22 bp, Homo sapiens
atcctttgagttatagtttgct

SEQ ID NO: 3326360 - DNA, 20 bp, Homo sapiens
atcctttgcagggcagcccc

SEQ ID NO: 3326361 - DNA, 18 bp, Homo sapiens
atcctttgcctgcctggt

SEQ ID NO: 3326362 - DNA, 20 bp, Homo sapiens
atcctttgtgagcctatgat

SEQ ID NO: 3326363 - DNA, 14 bp, Homo sapiens
atcctttgttctga

SEQ ID NO: 3326364 - DNA, 19 bp, Homo sapiens
atcctttgttctgagcatt

SEQ ID NO: 3326365 - DNA, 13 bp, Homo sapiens
atcctttttccat

SEQ ID NO: 3326366 - DNA, 16 bp, Homo sapiens
atcctttttccatcat

SEQ ID NO: 3326367 - DNA, 19 bp, Homo sapiens
atcctttttccatcatttt

SEQ ID NO: 3326368 - DNA, 21 bp, Homo sapiens
atcctttttccatcattttac

SEQ ID NO: 3326369 - DNA, 18 bp, Homo sapiens
atccttttttgtcatttt

SEQ ID NO: 3326370 - DNA, 13 bp, Homo sapiens
atcgaaaaaataa

SEQ ID NO: 3326371 - DNA, 13 bp, Homo sapiens
atcgaaataacaa

SEQ ID NO: 3326372 - DNA, 19 bp, Homo sapiens
atcgaaataacaatgttaa

SEQ ID NO: 3326373 - DNA, 20 bp, Homo sapiens
atcgaatctactaattccac

SEQ ID NO: 3326374 - DNA, 21 bp, Homo sapiens
atcgacttgtttttgcacatg

SEQ ID NO: 3326375 - DNA, 17 bp, Homo sapiens
atcgagaccatcctggc

SEQ ID NO: 3326376 - DNA, 21 bp, Homo sapiens
atcgagtgagacaaaatttta

SEQ ID NO: 3326377 - DNA, 17 bp, Homo sapiens
atcgagttggcaaaatg

SEQ ID NO: 3326378 - DNA, 20 bp, Homo sapiens
atcgcaccactgtgtattta

SEQ ID NO: 3326379 - DNA, 17 bp, Homo sapiens
atcgcaccattctgact

SEQ ID NO: 3326380 - DNA, 21 bp, Homo sapiens
atcgcaggagtctctgccacc

SEQ ID NO: 3326381 - DNA, 23 bp, Homo sapiens
atcgcgccactacactccagcct

SEQ ID NO: 3326382 - DNA, 18 bp, Homo sapiens
atcgctaagctggctctg

SEQ ID NO: 3326383 - DNA, 16 bp, Homo sapiens
atcgctcgtgtgttct

SEQ ID NO: 3326384 - DNA, 23 bp, Homo sapiens
atcgctcgtgtgttctatccaaa

SEQ ID NO: 3326385 - DNA, 15 bp, Homo sapiens
atcgctgacttcatg

SEQ ID NO: 3326386 - DNA, 17 bp, Homo sapiens
atcgcttgagcccagga

SEQ ID NO: 3326387 - DNA, 23 bp, Homo sapiens
atcggactaaactatctgtattt

SEQ ID NO: 3326388 - DNA, 13 bp, Homo sapiens
atcggcctcctct

SEQ ID NO: 3326389 - DNA, 14 bp, Homo sapiens
atcggcctcctctt

SEQ ID NO: 3326390 - DNA, 17 bp, Homo sapiens
atcgggaacagtgtttc

SEQ ID NO: 3326391 - DNA, 18 bp, Homo sapiens
atcgggagcacccagagc

SEQ ID NO: 3326392 - DNA, 16 bp, Homo sapiens
atcgggagcagtgtct

SEQ ID NO: 3326393 - DNA, 18 bp, Homo sapiens
atcgggagcagtgtcttc

SEQ ID NO: 3326394 - DNA, 19 bp, Homo sapiens
atcggtgaaactaacagat

SEQ ID NO: 3326395 - DNA, 13 bp, Homo sapiens
atcgtagaaaatt

SEQ ID NO: 3326396 - DNA, 14 bp, Homo sapiens
atcgtagaaaattt

SEQ ID NO: 3326397 - DNA, 13 bp, Homo sapiens
atcgtagaagaga

SEQ ID NO: 3326398 - DNA, 19 bp, Homo sapiens
atcgtccagcgaccttcct

SEQ ID NO: 3326399 - DNA, 15 bp, Homo sapiens
atcgtgctaaatttt

SEQ ID NO: 3326400 - DNA, 16 bp, Homo sapiens
atcgtgctaaattttc

SEQ ID NO: 3326401 - DNA, 21 bp, Homo sapiens
atcgtgtattgagatttctta

SEQ ID NO: 3326402 - DNA, 15 bp, Homo sapiens
atcgtttttgtattt

SEQ ID NO: 3326403 - DNA, 21 bp, Homo sapiens
atctaaaacaaaatctgaact

SEQ ID NO: 3326404 - DNA, 16 bp, Homo sapiens
atctaaacgtggtcac

SEQ ID NO: 3326405 - DNA, 15 bp, Homo sapiens
atctaaagtgtgttg

SEQ ID NO: 3326406 - DNA, 20 bp, Homo sapiens
atctaaagtgtgttgttgct

SEQ ID NO: 3326407 - DNA, 14 bp, Homo sapiens
atctaaagttgctc

SEQ ID NO: 3326408 - DNA, 13 bp, Homo sapiens
atctaaagtttgt

SEQ ID NO: 3326409 - DNA, 20 bp, Homo sapiens
atctaaatctatttattaat

SEQ ID NO: 3326410 - DNA, 14 bp, Homo sapiens
atctaaatgatgag

SEQ ID NO: 3326411 - DNA, 15 bp, Homo sapiens
atctaaatgttgaaa

SEQ ID NO: 3326412 - DNA, 14 bp, Homo sapiens
atctaaatttaatt

SEQ ID NO: 3326413 - DNA, 14 bp, Homo sapiens
atctaaatttcttt

SEQ ID NO: 3326414 - DNA, 15 bp, Homo sapiens
atctaacaataatat

SEQ ID NO: 3326415 - DNA, 22 bp, Homo sapiens
atctaacaataatatttcaagt

SEQ ID NO: 3326416 - DNA, 15 bp, Homo sapiens
atctaaccctcccat

SEQ ID NO: 3326417 - DNA, 12 bp, Homo sapiens
atctaagaataa

SEQ ID NO: 3326418 - DNA, 16 bp, Homo sapiens
atctaagaataataaa

SEQ ID NO: 3326419 - DNA, 18 bp, Homo sapiens
atctaagaataataaaat

SEQ ID NO: 3326420 - DNA, 14 bp, Homo sapiens
atctaagtgatata

SEQ ID NO: 3326421 - DNA, 19 bp, Homo sapiens
atctaagttataagactct

SEQ ID NO: 3326422 - DNA, 22 bp, Homo sapiens
atctaatagcgggttactttca

SEQ ID NO: 3326423 - DNA, 17 bp, Homo sapiens
atctaattcagatggat

SEQ ID NO: 3326424 - DNA, 23 bp, Homo sapiens
atctacaatctctttttgtttgc

SEQ ID NO: 3326425 - DNA, 22 bp, Homo sapiens
atctacagatagagagttgttg

SEQ ID NO: 3326426 - DNA, 22 bp, Homo sapiens
atctacagatcctttttccatc

SEQ ID NO: 3326427 - DNA, 16 bp, Homo sapiens
atctacagctcacctc

SEQ ID NO: 3326428 - DNA, 23 bp, Homo sapiens
atctacaggacaaagggagggag

SEQ ID NO: 3326429 - DNA, 15 bp, Homo sapiens
atctactaattccac

SEQ ID NO: 3326430 - DNA, 17 bp, Homo sapiens
atctagaaagaaaagac

SEQ ID NO: 3326431 - DNA, 21 bp, Homo sapiens
atctagaacacaggcaaaatc

SEQ ID NO: 3326432 - DNA, 16 bp, Homo sapiens
atctagtcacaaagac

SEQ ID NO: 3326433 - DNA, 17 bp, Homo sapiens
atctagtcacaaagact

SEQ ID NO: 3326434 - DNA, 13 bp, Homo sapiens
atctagtgcagct

SEQ ID NO: 3326435 - DNA, 15 bp, Homo sapiens
atctagtgcagctga

SEQ ID NO: 3326436 - DNA, 15 bp, Homo sapiens
atctataaactataa

SEQ ID NO: 3326437 - DNA, 16 bp, Homo sapiens
atctataaagaagaac

SEQ ID NO: 3326438 - DNA, 11 bp, Homo sapiens
atctataattt

SEQ ID NO: 3326439 - DNA, 16 bp, Homo sapiens
atctataatttaccta

SEQ ID NO: 3326440 - DNA, 12 bp, Homo sapiens
atctatataaaa

SEQ ID NO: 3326441 - DNA, 14 bp, Homo sapiens
atctatataaaata

SEQ ID NO: 3326442 - DNA, 14 bp, Homo sapiens
atctatatataatt

SEQ ID NO: 3326443 - DNA, 15 bp, Homo sapiens
atctatatatgtgta

SEQ ID NO: 3326444 - DNA, 18 bp, Homo sapiens
atctatatatgtgtatgt

SEQ ID NO: 3326445 - DNA, 19 bp, Homo sapiens
atctatatatgtgtatgta

SEQ ID NO: 3326446 - DNA, 19 bp, Homo sapiens
atctatatttttgtactga

SEQ ID NO: 3326447 - DNA, 13 bp, Homo sapiens
atctatccctgcg

SEQ ID NO: 3326448 - DNA, 14 bp, Homo sapiens
atctatctgccttt

SEQ ID NO: 3326449 - DNA, 22 bp, Homo sapiens
atctatgatgaaggtaattaaa

SEQ ID NO: 3326450 - DNA, 12 bp, Homo sapiens
atctattaatat

SEQ ID NO: 3326451 - DNA, 15 bp, Homo sapiens
atctattaatatatg

SEQ ID NO: 3326452 - DNA, 21 bp, Homo sapiens
atctattacttttgcaaactg

SEQ ID NO: 3326453 - DNA, 22 bp, Homo sapiens
atctattcagacaagcaacagg

SEQ ID NO: 3326454 - DNA, 13 bp, Homo sapiens
atctattctcaaa

SEQ ID NO: 3326455 - DNA, 22 bp, Homo sapiens
atctattgggttcattattgga

SEQ ID NO: 3326456 - DNA, 19 bp, Homo sapiens
atctatttcatgtttttga

SEQ ID NO: 3326457 - DNA, 16 bp, Homo sapiens
atctatttgagattga

SEQ ID NO: 3326458 - DNA, 21 bp, Homo sapiens
atctatttgtagattaggatt

SEQ ID NO: 3326459 - DNA, 14 bp, Homo sapiens
atctattttggatt

SEQ ID NO: 3326460 - DNA, 14 bp, Homo sapiens
atctcaaaggagaa

SEQ ID NO: 3326461 - DNA, 14 bp, Homo sapiens
atctcaaataacta

SEQ ID NO: 3326462 - DNA, 21 bp, Homo sapiens
atctcaaataactaaaaggta

SEQ ID NO: 3326463 - DNA, 20 bp, Homo sapiens
atctcaaataggctattaaa

SEQ ID NO: 3326464 - DNA, 23 bp, Homo sapiens
atctcaaataggctattaaaaaa

SEQ ID NO: 3326465 - DNA, 14 bp, Homo sapiens
atctcaccccatcc

SEQ ID NO: 3326466 - DNA, 16 bp, Homo sapiens
atctcacttagtcctt

SEQ ID NO: 3326467 - DNA, 12 bp, Homo sapiens
atctcagaaagt

SEQ ID NO: 3326468 - DNA, 18 bp, Homo sapiens
atctcagagtccactgtg

SEQ ID NO: 3326469 - DNA, 19 bp, Homo sapiens
atctcagagtccactgtgg

SEQ ID NO: 3326470 - DNA, 18 bp, Homo sapiens
atctcagatgttaaaata

SEQ ID NO: 3326471 - DNA, 14 bp, Homo sapiens
atctcagcctcctg

SEQ ID NO: 3326472 - DNA, 16 bp, Homo sapiens
atctcagcctcctgag

SEQ ID NO: 3326473 - DNA, 19 bp, Homo sapiens
atctcaggaagtccagcca

SEQ ID NO: 3326474 - DNA, 16 bp, Homo sapiens
atctcaggggccagag

SEQ ID NO: 3326475 - DNA, 23 bp, Homo sapiens
atctcaggggccagaggaactgt

SEQ ID NO: 3326476 - DNA, 15 bp, Homo sapiens
atctcaggtgccact

SEQ ID NO: 3326477 - DNA, 16 bp, Homo sapiens
atctcaggtgccactc

SEQ ID NO: 3326478 - DNA, 24 bp, Homo sapiens
atctcaggtgccactccctgagct

SEQ ID NO: 3326479 - DNA, 18 bp, Homo sapiens
atctcagtcatgcataaa

SEQ ID NO: 3326480 - DNA, 20 bp, Homo sapiens
atctcagtcatgcataaata

SEQ ID NO: 3326481 - DNA, 15 bp, Homo sapiens
atctcagtgctttcc

SEQ ID NO: 3326482 - DNA, 15 bp, Homo sapiens
atctcatacctctga

SEQ ID NO: 3326483 - DNA, 15 bp, Homo sapiens
atctcatctatctca

SEQ ID NO: 3326484 - DNA, 19 bp, Homo sapiens
atctccaagataagcctga

SEQ ID NO: 3326485 - DNA, 22 bp, Homo sapiens
atctccaagataagcctgagcc

SEQ ID NO: 3326486 - DNA, 18 bp, Homo sapiens
atctccaaggatcctctc

SEQ ID NO: 3326487 - DNA, 20 bp, Homo sapiens
atctcccaagctatctaaag

SEQ ID NO: 3326488 - DNA, 19 bp, Homo sapiens
atctcccccaacccacctc

SEQ ID NO: 3326489 - DNA, 22 bp, Homo sapiens
atctcccccaacccacctctgg

SEQ ID NO: 3326490 - DNA, 20 bp, Homo sapiens
atctccctgcctggccccca

SEQ ID NO: 3326491 - DNA, 18 bp, Homo sapiens
atctcccttagaagagag

SEQ ID NO: 3326492 - DNA, 17 bp, Homo sapiens
atctcctataatctgtc

SEQ ID NO: 3326493 - DNA, 14 bp, Homo sapiens
atctcctatttttt

SEQ ID NO: 3326494 - DNA, 18 bp, Homo sapiens
atctcctatttttttaaa

SEQ ID NO: 3326495 - DNA, 22 bp, Homo sapiens
atctcctatttttttaaaatca

SEQ ID NO: 3326496 - DNA, 15 bp, Homo sapiens
atctcctgacagaag

SEQ ID NO: 3326497 - DNA, 18 bp, Homo sapiens
atctcctgacagaaggtg

SEQ ID NO: 3326498 - DNA, 22 bp, Homo sapiens
atctcctgtcctgggccaggga

SEQ ID NO: 3326499 - DNA, 14 bp, Homo sapiens
atctcctgtgcatg

SEQ ID NO: 3326500 - DNA, 15 bp, Homo sapiens
atctccttactgtgt

SEQ ID NO: 3326501 - DNA, 17 bp, Homo sapiens
atctccttcccctacac

SEQ ID NO: 3326502 - DNA, 18 bp, Homo sapiens
atctcggatgaccaaacc

SEQ ID NO: 3326503 - DNA, 18 bp, Homo sapiens
atctcgggagtcctctag

SEQ ID NO: 3326504 - DNA, 14 bp, Homo sapiens
atctcgtgggagag

SEQ ID NO: 3326505 - DNA, 15 bp, Homo sapiens
atctcgttcccaaag

SEQ ID NO: 3326506 - DNA, 23 bp, Homo sapiens
atctcgtttttcttcttaagact

SEQ ID NO: 3326507 - DNA, 13 bp, Homo sapiens
atctctaatatgg

SEQ ID NO: 3326508 - DNA, 15 bp, Homo sapiens
atctctaattttgga

SEQ ID NO: 3326509 - DNA, 17 bp, Homo sapiens
attccatatttattcaa

SEQ ID NO: 3326510 - DNA, 18 bp, Homo sapiens
attccatcaataaatgct

SEQ ID NO: 3326511 - DNA, 18 bp, Homo sapiens
attccatgaatgtatcag

SEQ ID NO: 3326512 - DNA, 23 bp, Homo sapiens
attccatgaatgtatcaggaaat

SEQ ID NO: 3326513 - DNA, 16 bp, Homo sapiens
attccattggtccaag

SEQ ID NO: 3326514 - DNA, 17 bp, Homo sapiens
attcccaactagacatt

SEQ ID NO: 3326515 - DNA, 15 bp, Homo sapiens
attcccaagctctgc

SEQ ID NO: 3326516 - DNA, 19 bp, Homo sapiens
attcccaagctctgctcct

SEQ ID NO: 3326517 - DNA, 12 bp, Homo sapiens
attcccagccca

SEQ ID NO: 3326518 - DNA, 15 bp, Homo sapiens
attccccattcttcc

SEQ ID NO: 3326519 - DNA, 20 bp, Homo sapiens
attcccccccctttcctaaa

SEQ ID NO: 3326520 - DNA, 13 bp, Homo sapiens
attcccccttcct

SEQ ID NO: 3326521 - DNA, 16 bp, Homo sapiens
attcccccttcctagt

SEQ ID NO: 3326522 - DNA, 15 bp, Homo sapiens
attcccctcccacct

SEQ ID NO: 3326523 - DNA, 21 bp, Homo sapiens
attcccctcccacctctcctt

SEQ ID NO: 3326524 - DNA, 22 bp, Homo sapiens
attcccctcccacctctccttt

SEQ ID NO: 3326525 - DNA, 22 bp, Homo sapiens
attcccctccccactcctctcc

SEQ ID NO: 3326526 - DNA, 16 bp, Homo sapiens
attcccgttttgtcac

SEQ ID NO: 3326527 - DNA, 17 bp, Homo sapiens
attccctagatctttct

SEQ ID NO: 3326528 - DNA, 21 bp, Homo sapiens
attccctatcttttagtttta

SEQ ID NO: 3326529 - DNA, 22 bp, Homo sapiens
attccctatcttttagttttag

SEQ ID NO: 3326530 - DNA, 13 bp, Homo sapiens
attccctctcctg

SEQ ID NO: 3326531 - DNA, 18 bp, Homo sapiens
attccctctcctgcccag

SEQ ID NO: 3326532 - DNA, 23 bp, Homo sapiens
attccctgcccaaacccttaact

SEQ ID NO: 3326533 - DNA, 15 bp, Homo sapiens
attccgaagagggaa

SEQ ID NO: 3326534 - DNA, 16 bp, Homo sapiens
attccgagcattccag

SEQ ID NO: 3326535 - DNA, 13 bp, Homo sapiens
attccggatccta

SEQ ID NO: 3326536 - DNA, 16 bp, Homo sapiens
attccggatcctaagc

SEQ ID NO: 3326537 - DNA, 14 bp, Homo sapiens
attcctaactagaa

SEQ ID NO: 3326538 - DNA, 18 bp, Homo sapiens
attcctaactagaattag

SEQ ID NO: 3326539 - DNA, 14 bp, Homo sapiens
attcctacaactta

SEQ ID NO: 3326540 - DNA, 18 bp, Homo sapiens
attcctactccctcttcc

SEQ ID NO: 3326541 - DNA, 14 bp, Homo sapiens
attcctacttgcag

SEQ ID NO: 3326542 - DNA, 21 bp, Homo sapiens
attcctagataaaaagatggc

SEQ ID NO: 3326543 - DNA, 19 bp, Homo sapiens
attcctagtggatgactgt

SEQ ID NO: 3326544 - DNA, 11 bp, Homo sapiens
attcctatgaa

SEQ ID NO: 3326545 - DNA, 20 bp, Homo sapiens
attcctatgaagttggcaca

SEQ ID NO: 3326546 - DNA, 22 bp, Homo sapiens
attcctccaaatctcttgcttg

SEQ ID NO: 3326547 - DNA, 16 bp, Homo sapiens
attcctccctccggcc

SEQ ID NO: 3326548 - DNA, 13 bp, Homo sapiens
attcctcctgctc

SEQ ID NO: 3326549 - DNA, 15 bp, Homo sapiens
attcctcctgctcat

SEQ ID NO: 3326550 - DNA, 16 bp, Homo sapiens
attcctcctgctcata

SEQ ID NO: 3326551 - DNA, 20 bp, Homo sapiens
attcctcctgctcatattgt

SEQ ID NO: 3326552 - DNA, 13 bp, Homo sapiens
attcctcttattg

SEQ ID NO: 3326553 - DNA, 14 bp, Homo sapiens
attcctcttcattg

SEQ ID NO: 3326554 - DNA, 17 bp, Homo sapiens
attcctcttgcctctct

SEQ ID NO: 3326555 - DNA, 19 bp, Homo sapiens
attcctcttgcctctctca

SEQ ID NO: 3326556 - DNA, 17 bp, Homo sapiens
attcctgaatgaaatat

SEQ ID NO: 3326557 - DNA, 11 bp, Homo sapiens
attcctgaccc

SEQ ID NO: 3326558 - DNA, 15 bp, Homo sapiens
attcctgacccaggc

SEQ ID NO: 3326559 - DNA, 22 bp, Homo sapiens
attcctgacccaggccgcagct

SEQ ID NO: 3326560 - DNA, 22 bp, Homo sapiens
attcctgagatttcctcctggc

SEQ ID NO: 3326561 - DNA, 18 bp, Homo sapiens
attcctggaaaccacagt

SEQ ID NO: 3326562 - DNA, 16 bp, Homo sapiens
attcctgggcctgtcc

SEQ ID NO: 3326563 - DNA, 23 bp, Homo sapiens
attcctgtaacttttaatcccta

SEQ ID NO: 3326564 - DNA, 16 bp, Homo sapiens
attcctgtatgttgtc

SEQ ID NO: 3326565 - DNA, 16 bp, Homo sapiens
attccttaaataaact

SEQ ID NO: 3326566 - DNA, 13 bp, Homo sapiens
attccttcactca

SEQ ID NO: 3326567 - DNA, 17 bp, Homo sapiens
attccttcactcatcca

SEQ ID NO: 3326568 - DNA, 11 bp, Homo sapiens
attccttctct

SEQ ID NO: 3326569 - DNA, 16 bp, Homo sapiens
attccttctctgaaca

SEQ ID NO: 3326570 - DNA, 16 bp, Homo sapiens
attccttctggccttt

SEQ ID NO: 3326571 - DNA, 22 bp, Homo sapiens
attccttctggcctttcctctc

SEQ ID NO: 3326572 - DNA, 15 bp, Homo sapiens
attccttctttgata

SEQ ID NO: 3326573 - DNA, 17 bp, Homo sapiens
attccttctttgataat

SEQ ID NO: 3326574 - DNA, 18 bp, Homo sapiens
attccttctttttaaaat

SEQ ID NO: 3326575 - DNA, 20 bp, Homo sapiens
attccttgagtcaggagctt

SEQ ID NO: 3326576 - DNA, 15 bp, Homo sapiens
attccttgccccaca

SEQ ID NO: 3326577 - DNA, 19 bp, Homo sapiens
attcgatctcattcagtat

SEQ ID NO: 3326578 - DNA, 21 bp, Homo sapiens
attcgctgtaccctttaagat

SEQ ID NO: 3326579 - DNA, 16 bp, Homo sapiens
attcgggccacagggc

SEQ ID NO: 3326580 - DNA, 15 bp, Homo sapiens
attcggggctgacga

SEQ ID NO: 3326581 - DNA, 17 bp, Homo sapiens
attcgtgaatagtcttt

SEQ ID NO: 3326582 - DNA, 20 bp, Homo sapiens
attcgtgcatttttggatca

SEQ ID NO: 3326583 - DNA, 20 bp, Homo sapiens
attctaaaatgtgatgttct

SEQ ID NO: 3326584 - DNA, 22 bp, Homo sapiens
attctaaaatgtgatgttctaa

SEQ ID NO: 3326585 - DNA, 23 bp, Homo sapiens
attctaaagagcacttactgtaa

SEQ ID NO: 3326586 - DNA, 20 bp, Homo sapiens
attctaaagattctatagtt

SEQ ID NO: 3326587 - DNA, 14 bp, Homo sapiens
attctaaaggtcca

SEQ ID NO: 3326588 - DNA, 20 bp, Homo sapiens
attctaagacttactctaag

SEQ ID NO: 3326589 - DNA, 23 bp, Homo sapiens
attctaagacttactctaagatc

SEQ ID NO: 3326590 - DNA, 18 bp, Homo sapiens
attctaagccagttttca

SEQ ID NO: 3326591 - DNA, 14 bp, Homo sapiens
attctaatcatctg

SEQ ID NO: 3326592 - DNA, 16 bp, Homo sapiens
attctaattaaaattg

SEQ ID NO: 3326593 - DNA, 21 bp, Homo sapiens
attctaattgtcagtgatttt

SEQ ID NO: 3326594 - DNA, 13 bp, Homo sapiens
attctacacagag

SEQ ID NO: 3326595 - DNA, 14 bp, Homo sapiens
attctacagaataa

SEQ ID NO: 3326596 - DNA, 15 bp, Homo sapiens
attctacagaataat

SEQ ID NO: 3326597 - DNA, 21 bp, Homo sapiens
attctactaagttattttatg

SEQ ID NO: 3326598 - DNA, 23 bp, Homo sapiens
attctactaagttattttatgac

SEQ ID NO: 3326599 - DNA, 14 bp, Homo sapiens
attctactcttgtc

SEQ ID NO: 3326600 - DNA, 16 bp, Homo sapiens
attctactcttgtcat

SEQ ID NO: 3326601 - DNA, 17 bp, Homo sapiens
attctactcttgtcatt

SEQ ID NO: 3326602 - DNA, 22 bp, Homo sapiens
attctacttgcttattacattt

SEQ ID NO: 3326603 - DNA, 13 bp, Homo sapiens
attctactttgag

SEQ ID NO: 3326604 - DNA, 16 bp, Homo sapiens
attctactttgagtgc

SEQ ID NO: 3326605 - DNA, 22 bp, Homo sapiens
attctagatcagatgctccaag

SEQ ID NO: 3326606 - DNA, 18 bp, Homo sapiens
attctagctgtatgattt

SEQ ID NO: 3326607 - DNA, 19 bp, Homo sapiens
attctagctgtatgatttg

SEQ ID NO: 3326608 - DNA, 17 bp, Homo sapiens
attctagttttgtcaaa

SEQ ID NO: 3326609 - DNA, 13 bp, Homo sapiens
attctataaaact

SEQ ID NO: 3326610 - DNA, 24 bp, Homo sapiens
attctataaaactctgcatgtaga

SEQ ID NO: 3326611 - DNA, 20 bp, Homo sapiens
attctatacacaccctgccc

SEQ ID NO: 3326612 - DNA, 21 bp, Homo sapiens
attctatacacaccctgcccc

SEQ ID NO: 3326613 - DNA, 15 bp, Homo sapiens
attctatagttctag

SEQ ID NO: 3326614 - DNA, 17 bp, Homo sapiens
attctatagttctagac

SEQ ID NO: 3326615 - DNA, 14 bp, Homo sapiens
attctatccccaat

SEQ ID NO: 3326616 - DNA, 22 bp, Homo sapiens
attctatccccaatcagctcct

SEQ ID NO: 3326617 - DNA, 15 bp, Homo sapiens
attctatgagaacaa

SEQ ID NO: 3326618 - DNA, 21 bp, Homo sapiens
attctatgtatgttaatttat

SEQ ID NO: 3326619 - DNA, 14 bp, Homo sapiens
attctatgttaaat

SEQ ID NO: 3326620 - DNA, 18 bp, Homo sapiens
attctattacattttcag

SEQ ID NO: 3326621 - DNA, 20 bp, Homo sapiens
attctattacattttcagtg

SEQ ID NO: 3326622 - DNA, 23 bp, Homo sapiens
attctattgtattatttggagtt

SEQ ID NO: 3326623 - DNA, 18 bp, Homo sapiens
attctatttgctgggctt

SEQ ID NO: 3326624 - DNA, 13 bp, Homo sapiens
attctcaaagcag

SEQ ID NO: 3326625 - DNA, 21 bp, Homo sapiens
attctcaaagttaaaagtaaa

SEQ ID NO: 3326626 - DNA, 15 bp, Homo sapiens
attctcaaagtttta

SEQ ID NO: 3326627 - DNA, 19 bp, Homo sapiens
attctcaaagttttattat

SEQ ID NO: 3326628 - DNA, 16 bp, Homo sapiens
attctcattgcagaat

SEQ ID NO: 3326629 - DNA, 18 bp, Homo sapiens
attctcattgcagaataa

SEQ ID NO: 3326630 - DNA, 17 bp, Homo sapiens
attctcatttgtcacac

SEQ ID NO: 3326631 - DNA, 23 bp, Homo sapiens
attactgggccttagtgggccag

SEQ ID NO: 3326632 - DNA, 17 bp, Homo sapiens
attactgtcaataaaca

SEQ ID NO: 3326633 - DNA, 18 bp, Homo sapiens
attactgtctctggcatt

SEQ ID NO: 3326634 - DNA, 19 bp, Homo sapiens
attactgtctttattctta

SEQ ID NO: 3326635 - DNA, 17 bp, Homo sapiens
attactgtgtaaatata

SEQ ID NO: 3326636 - DNA, 19 bp, Homo sapiens
attactgttccagattcct

SEQ ID NO: 3326637 - DNA, 20 bp, Homo sapiens
attacttaggttattttgct

SEQ ID NO: 3326638 - DNA, 21 bp, Homo sapiens
attacttaggttattttgctt

SEQ ID NO: 3326639 - DNA, 12 bp, Homo sapiens
atgttgatttat

SEQ ID NO: 3326640 - DNA, 22 bp, Homo sapiens
atgttgccatcctaccgtcttt

SEQ ID NO: 3326641 - DNA, 12 bp, Homo sapiens
atgttgcccagg

SEQ ID NO: 3326642 - DNA, 16 bp, Homo sapiens
atgttgcccaggcagg

SEQ ID NO: 3326643 - DNA, 17 bp, Homo sapiens
atgttgcccaggcaggt

SEQ ID NO: 3326644 - DNA, 20 bp, Homo sapiens
atgttgcccaggcaggtctt

SEQ ID NO: 3326645 - DNA, 17 bp, Homo sapiens
atgttgcttaggatgtg

SEQ ID NO: 3326646 - DNA, 16 bp, Homo sapiens
atgttggccaggctgg

SEQ ID NO: 3326647 - DNA, 17 bp, Homo sapiens
atgttggccaggctggt

SEQ ID NO: 3326648 - DNA, 19 bp, Homo sapiens
atgttgggaaacttggctc

SEQ ID NO: 3326649 - DNA, 14 bp, Homo sapiens
atgttgtaatattt

SEQ ID NO: 3326650 - DNA, 15 bp, Homo sapiens
atgttgtaatgctgc

SEQ ID NO: 3326651 - DNA, 16 bp, Homo sapiens
atgttgtaatgctgca

SEQ ID NO: 3326652 - DNA, 22 bp, Homo sapiens
atgttgtccaacaataaacagg

SEQ ID NO: 3326653 - DNA, 15 bp, Homo sapiens
atgttgtgatgtatt

SEQ ID NO: 3326654 - DNA, 15 bp, Homo sapiens
atgttgtgtttttaa

SEQ ID NO: 3326655 - DNA, 13 bp, Homo sapiens
atgttgttattta

SEQ ID NO: 3326656 - DNA, 15 bp, Homo sapiens
atgttgttatttaaa

SEQ ID NO: 3326657 - DNA, 14 bp, Homo sapiens
atgttgttgaaagg

SEQ ID NO: 3326658 - DNA, 17 bp, Homo sapiens
atgtttaaatataaatg

SEQ ID NO: 3326659 - DNA, 18 bp, Homo sapiens
atgtttaaatcatgtatg

SEQ ID NO: 3326660 - DNA, 16 bp, Homo sapiens
atgtttaacaaatcta

SEQ ID NO: 3326661 - DNA, 22 bp, Homo sapiens
atgtttaacaaatctaatctct

SEQ ID NO: 3326662 - DNA, 20 bp, Homo sapiens
atgtttaagtattaacttac

SEQ ID NO: 3326663 - DNA, 17 bp, Homo sapiens
atgtttaatctgttatg

SEQ ID NO: 3326664 - DNA, 14 bp, Homo sapiens
atgtttacacaatt

SEQ ID NO: 3326665 - DNA, 16 bp, Homo sapiens
atgtttacactctttg

SEQ ID NO: 3326666 - DNA, 21 bp, Homo sapiens
atgtttacagggagcctcctg

SEQ ID NO: 3326667 - DNA, 18 bp, Homo sapiens
atgtttacaggtttgaat

SEQ ID NO: 3326668 - DNA, 19 bp, Homo sapiens
atgtttacaggtttgaatt

SEQ ID NO: 3326669 - DNA, 21 bp, Homo sapiens
atgtttaggttactaaaacag

SEQ ID NO: 3326670 - DNA, 14 bp, Homo sapiens
atgtttatatactg

SEQ ID NO: 3326671 - DNA, 13 bp, Homo sapiens
atgtttatgaaaa

SEQ ID NO: 3326672 - DNA, 20 bp, Homo sapiens
atgtttatgagccagacaaa

SEQ ID NO: 3326673 - DNA, 19 bp, Homo sapiens
atgtttattaaatgcttca

SEQ ID NO: 3326674 - DNA, 14 bp, Homo sapiens
atgtttattcctga

SEQ ID NO: 3326675 - DNA, 14 bp, Homo sapiens
atgtttattccttg

SEQ ID NO: 3326676 - DNA, 18 bp, Homo sapiens
atgtttattcttctagag

SEQ ID NO: 3326677 - DNA, 19 bp, Homo sapiens
atgtttattcttctagagt

SEQ ID NO: 3326678 - DNA, 13 bp, Homo sapiens
atgtttatttata

SEQ ID NO: 3326679 - DNA, 21 bp, Homo sapiens
atgtttcacaccggaaggttt

SEQ ID NO: 3326680 - DNA, 14 bp, Homo sapiens
atgtttcttaacta

SEQ ID NO: 3326681 - DNA, 22 bp, Homo sapiens
atgtttcttctaggttctaaaa

SEQ ID NO: 3326682 - DNA, 21 bp, Homo sapiens
atgtttcttttgtttggtaaa

SEQ ID NO: 3326683 - DNA, 19 bp, Homo sapiens
atgtttgaagagttccaag

SEQ ID NO: 3326684 - DNA, 20 bp, Homo sapiens
atgtttgaatttttctcttc

SEQ ID NO: 3326685 - DNA, 19 bp, Homo sapiens
atgtttgaggagcatgttt

SEQ ID NO: 3326686 - DNA, 22 bp, Homo sapiens
atgtttgaggagcatgttttgt

SEQ ID NO: 3326687 - DNA, 12 bp, Homo sapiens
atgtttgatgtc

SEQ ID NO: 3326688 - DNA, 13 bp, Homo sapiens
atgtttgcagggg

SEQ ID NO: 3326689 - DNA, 14 bp, Homo sapiens
atgtttgcctctgc

SEQ ID NO: 3326690 - DNA, 19 bp, Homo sapiens
atgtttgcctctgcctctg

SEQ ID NO: 3326691 - DNA, 20 bp, Homo sapiens
atgtttgcttcataaatgaa

SEQ ID NO: 3326692 - DNA, 13 bp, Homo sapiens
atgtttggtaaga

SEQ ID NO: 3326693 - DNA, 23 bp, Homo sapiens
atgtttgtcctgaacacttttgt

SEQ ID NO: 3326694 - DNA, 14 bp, Homo sapiens
atgtttgtctcact

SEQ ID NO: 3326695 - DNA, 14 bp, Homo sapiens
atgttttaaacaca

SEQ ID NO: 3326696 - DNA, 13 bp, Homo sapiens
atgttttaaagaa

SEQ ID NO: 3326697 - DNA, 20 bp, Homo sapiens
atgttttaccgtaataatta

SEQ ID NO: 3326698 - DNA, 16 bp, Homo sapiens
atgttttataattcat

SEQ ID NO: 3326699 - DNA, 19 bp, Homo sapiens
atgttttcattatgttcat

SEQ ID NO: 3326700 - DNA, 16 bp, Homo sapiens
atgttttctttgtttc

SEQ ID NO: 3326701 - DNA, 17 bp, Homo sapiens
atgttttgtacaattac

SEQ ID NO: 3326702 - DNA, 14 bp, Homo sapiens
atgttttgtataca

SEQ ID NO: 3326703 - DNA, 22 bp, Homo sapiens
atgttttgtatacaaatatatt

SEQ ID NO: 3326704 - DNA, 19 bp, Homo sapiens
atgttttgtatatacagtt

SEQ ID NO: 3326705 - DNA, 22 bp, Homo sapiens
atgttttgtgcatttgtaaatg

SEQ ID NO: 3326706 - DNA, 23 bp, Homo sapiens
atgttttgtgcatttgtaaatgc

SEQ ID NO: 3326707 - DNA, 14 bp, Homo sapiens
atgttttgtttctg

SEQ ID NO: 3326708 - DNA, 20 bp, Homo sapiens
atgtttttaaaagtttcaat

SEQ ID NO: 3326709 - DNA, 23 bp, Homo sapiens
atgtttttaaaagtttcaatgtg

SEQ ID NO: 3326710 - DNA, 16 bp, Homo sapiens
atgtttttatatgtct

SEQ ID NO: 3326711 - DNA, 16 bp, Homo sapiens
atgtttttatgatatc

SEQ ID NO: 3326712 - DNA, 17 bp, Homo sapiens
atgtttttcctttctta

SEQ ID NO: 3326713 - DNA, 21 bp, Homo sapiens
atgtttttctgccagggagct

SEQ ID NO: 3326714 - DNA, 22 bp, Homo sapiens
atgtttttgatcaaaaactatt

SEQ ID NO: 3326715 - DNA, 13 bp, Homo sapiens
atgtttttttaat

SEQ ID NO: 3326716 - DNA, 15 bp, Homo sapiens
attaaaaaaaaattg

SEQ ID NO: 3326717 - DNA, 22 bp, Homo sapiens
attaaaaaacttcatgtaattt

SEQ ID NO: 3326718 - DNA, 20 bp, Homo sapiens
attaaaaagaattcttccac

SEQ ID NO: 3326719 - DNA, 14 bp, Homo sapiens
attaaaaatgttct

SEQ ID NO: 3326720 - DNA, 20 bp, Homo sapiens
attaaaaatgttctcaaata

SEQ ID NO: 3326721 - DNA, 16 bp, Homo sapiens
attaaaactaaatttc

SEQ ID NO: 3326722 - DNA, 19 bp, Homo sapiens
attaaaactaggtaatgtt

SEQ ID NO: 3326723 - DNA, 20 bp, Homo sapiens
attaaaactaggtaatgttt

SEQ ID NO: 3326724 - DNA, 14 bp, Homo sapiens
attaaaactcaaca

SEQ ID NO: 3326725 - DNA, 13 bp, Homo sapiens
attaaaactgctt

SEQ ID NO: 3326726 - DNA, 16 bp, Homo sapiens
attaaaactgcttttt

SEQ ID NO: 3326727 - DNA, 16 bp, Homo sapiens
attaaaaggaaagtca

SEQ ID NO: 3326728 - DNA, 17 bp, Homo sapiens
attaaaagttgcatttg

SEQ ID NO: 3326729 - DNA, 15 bp, Homo sapiens
attaaaagtttgaaa

SEQ ID NO: 3326730 - DNA, 20 bp, Homo sapiens
attaaaatgattgtaaaata

SEQ ID NO: 3326731 - DNA, 16 bp, Homo sapiens
attaaaatgcatggtg

SEQ ID NO: 3326732 - DNA, 14 bp, Homo sapiens
attaaaatgcttcc

SEQ ID NO: 3326733 - DNA, 20 bp, Homo sapiens
attaaaatggatttaatcca

SEQ ID NO: 3326734 - DNA, 22 bp, Homo sapiens
attaaaatggatttaatccatt

SEQ ID NO: 3326735 - DNA, 22 bp, Homo sapiens
attaaaatgtcggatttatctt

SEQ ID NO: 3326736 - DNA, 14 bp, Homo sapiens
attaaaattgtgca

SEQ ID NO: 3326737 - DNA, 22 bp, Homo sapiens
attaaaattgtgcataatgctt

SEQ ID NO: 3326738 - DNA, 12 bp, Homo sapiens
attaaacagatg

SEQ ID NO: 3326739 - DNA, 21 bp, Homo sapiens
attaaacagatgatgagaatt

SEQ ID NO: 3326740 - DNA, 19 bp, Homo sapiens
attaaacagatgtgaatat

SEQ ID NO: 3326741 - DNA, 15 bp, Homo sapiens
attaaaccaattata

SEQ ID NO: 3326742 - DNA, 16 bp, Homo sapiens
attaaacctgtctcca

SEQ ID NO: 3326743 - DNA, 22 bp, Homo sapiens
attaaacctgtctccactgtgc

SEQ ID NO: 3326744 - DNA, 17 bp, Homo sapiens
attaaacttccaaagaa

SEQ ID NO: 3326745 - DNA, 18 bp, Homo sapiens
attaaacttcttttctct

SEQ ID NO: 3326746 - DNA, 13 bp, Homo sapiens
attaaacttgaag

SEQ ID NO: 3326747 - DNA, 20 bp, Homo sapiens
attaaagaagggttgagctg

SEQ ID NO: 3326748 - DNA, 13 bp, Homo sapiens
attaaagacagag

SEQ ID NO: 3326749 - DNA, 16 bp, Homo sapiens
attaaaggaaggaaaa

SEQ ID NO: 3326750 - DNA, 13 bp, Homo sapiens
attaaagtcagaa

SEQ ID NO: 3326751 - DNA, 17 bp, Homo sapiens
attaaagtgctaaggtt

SEQ ID NO: 3326752 - DNA, 19 bp, Homo sapiens
attaaagtgctaaggttct

SEQ ID NO: 3326753 - DNA, 21 bp, Homo sapiens
attaaagtgctaaggttctaa

SEQ ID NO: 3326754 - DNA, 14 bp, Homo sapiens
attaaataaaatca

SEQ ID NO: 3326755 - DNA, 15 bp, Homo sapiens
attaaataagattct

SEQ ID NO: 3326756 - DNA, 19 bp, Homo sapiens
attaaataagattctaacg

SEQ ID NO: 3326757 - DNA, 17 bp, Homo sapiens
attaaatacaaaacttc

SEQ ID NO: 3326758 - DNA, 18 bp, Homo sapiens
attaaatctcaaatttat

SEQ ID NO: 3326759 - DNA, 11 bp, Homo sapiens
attaaatctgt

SEQ ID NO: 3326760 - DNA, 18 bp, Homo sapiens
attaaatcttaaacaatg

SEQ ID NO: 3326761 - DNA, 15 bp, Homo sapiens
attaaatgccttgta

SEQ ID NO: 3326762 - DNA, 11 bp, Homo sapiens
attaaatgttt

SEQ ID NO: 3326763 - DNA, 20 bp, Homo sapiens
attaaattacagcttttatg

SEQ ID NO: 3326764 - DNA, 13 bp, Homo sapiens
attaaattcacaa

SEQ ID NO: 3326765 - DNA, 16 bp, Homo sapiens
attaaattcacaaact

SEQ ID NO: 3326766 - DNA, 17 bp, Homo sapiens
attaaattcacaaactt

SEQ ID NO: 3326767 - DNA, 18 bp, Homo sapiens
attaaattcacaaacttt

SEQ ID NO: 3326768 - DNA, 14 bp, Homo sapiens
attaaattctcaaa

SEQ ID NO: 3326769 - DNA, 15 bp, Homo sapiens
attaaattctcaaag

SEQ ID NO: 3326770 - DNA, 20 bp, Homo sapiens
attaaattctcaaagtttta

SEQ ID NO: 3326771 - DNA, 22 bp, Homo sapiens
attaaattctcaaagttttatt

SEQ ID NO: 3326772 - DNA, 15 bp, Homo sapiens
attaaatttaattag

SEQ ID NO: 3326773 - DNA, 17 bp, Homo sapiens
attaaatttcacaatat

SEQ ID NO: 3326774 - DNA, 14 bp, Homo sapiens
attaacaaattatg

SEQ ID NO: 3326775 - DNA, 18 bp, Homo sapiens
attaacaacaataacact

SEQ ID NO: 3326776 - DNA, 18 bp, Homo sapiens
attaacactaattatcac

SEQ ID NO: 3326777 - DNA, 22 bp, Homo sapiens
attaacactaattatcacgtct

SEQ ID NO: 3326778 - DNA, 24 bp, Homo sapiens
attaacactaattatcacgtctga

SEQ ID NO: 3326779 - DNA, 16 bp, Homo sapiens
attaacagttttccat

SEQ ID NO: 3326780 - DNA, 18 bp, Homo sapiens
attaacagttttccatga

SEQ ID NO: 3326781 - DNA, 23 bp, Homo sapiens
attaacagttttccatgaaaacg

SEQ ID NO: 3326782 - DNA, 19 bp, Homo sapiens
attaaccttgccttagaaa

SEQ ID NO: 3326783 - DNA, 22 bp, Homo sapiens
attaaccttttttgtcttattg

SEQ ID NO: 3326784 - DNA, 15 bp, Homo sapiens
attaacgatgtccaa

SEQ ID NO: 3326785 - DNA, 13 bp, Homo sapiens
attaactgtatgt

SEQ ID NO: 3326786 - DNA, 18 bp, Homo sapiens
attaacttatttagagat

SEQ ID NO: 3326787 - DNA, 18 bp, Homo sapiens
attaacttgaaaattttt

SEQ ID NO: 3326788 - DNA, 15 bp, Homo sapiens
attaagaaggcaaaa

SEQ ID NO: 3326789 - DNA, 20 bp, Homo sapiens
attaagaatatgtttccttg

SEQ ID NO: 3326790 - DNA, 21 bp, Homo sapiens
attaagaatatgtttccttgt

SEQ ID NO: 3326791 - DNA, 21 bp, Homo sapiens
attaagaatgttggtttactt

SEQ ID NO: 3326792 - DNA, 23 bp, Homo sapiens
attaagaatgttggtttactttc

SEQ ID NO: 3326793 - DNA, 13 bp, Homo sapiens
attaagacagtgt

SEQ ID NO: 3326794 - DNA, 16 bp, Homo sapiens
attaagacagtgtaca

SEQ ID NO: 3326795 - DNA, 18 bp, Homo sapiens
attaagattttacaaaag

SEQ ID NO: 3326796 - DNA, 14 bp, Homo sapiens
attaagcaaatgtt

SEQ ID NO: 3326797 - DNA, 21 bp, Homo sapiens
attaagcactttaagctcctt

SEQ ID NO: 3326798 - DNA, 16 bp, Homo sapiens
attaaggcagtatgat

SEQ ID NO: 3326799 - DNA, 15 bp, Homo sapiens
attaaggtgatgtga

SEQ ID NO: 3326800 - DNA, 16 bp, Homo sapiens
attaagtactatgtat

SEQ ID NO: 3326801 - DNA, 19 bp, Homo sapiens
attaagtactatgtatcaa

SEQ ID NO: 3326802 - DNA, 12 bp, Homo sapiens
attaagttacaa

SEQ ID NO: 3326803 - DNA, 21 bp, Homo sapiens
attaagttacaattacatctc

SEQ ID NO: 3326804 - DNA, 22 bp, Homo sapiens
attaataaaaaatggaaagaat

SEQ ID NO: 3326805 - DNA, 21 bp, Homo sapiens
attaataaaactttatgtact

SEQ ID NO: 3326806 - DNA, 12 bp, Homo sapiens
attaataaagca

SEQ ID NO: 3326807 - DNA, 13 bp, Homo sapiens
attaataaagcat

SEQ ID NO: 3326808 - DNA, 13 bp, Homo sapiens
attaatactaaaa

SEQ ID NO: 3326809 - DNA, 13 bp, Homo sapiens
attaatagctttt

SEQ ID NO: 3326810 - DNA, 22 bp, Homo sapiens
attaatatatagtccagacact

SEQ ID NO: 3326811 - DNA, 22 bp, Homo sapiens
attaatatatgtattatttata

SEQ ID NO: 3326812 - DNA, 18 bp, Homo sapiens
attaatatccctacatgt

SEQ ID NO: 3326813 - DNA, 19 bp, Homo sapiens
attaatatccctacatgta

SEQ ID NO: 3326814 - DNA, 14 bp, Homo sapiens
attaatatgaaaac

SEQ ID NO: 3326815 - DNA, 13 bp, Homo sapiens
attaatattatta

SEQ ID NO: 3326816 - DNA, 23 bp, Homo sapiens
attaatattcagggtaaatagga

SEQ ID NO: 3326817 - DNA, 23 bp, Homo sapiens
attaatatttaacattatttata

SEQ ID NO: 3326818 - DNA, 18 bp, Homo sapiens
attaatcacctctctgta

SEQ ID NO: 3326819 - DNA, 20 bp, Homo sapiens
attaatcaccttctttgtaa

SEQ ID NO: 3326820 - DNA, 13 bp, Homo sapiens
attaatcactatt

SEQ ID NO: 3326821 - DNA, 19 bp, Homo sapiens
attaatcatctataaagaa

SEQ ID NO: 3326822 - DNA, 16 bp, Homo sapiens
attaatcttagtgtat

SEQ ID NO: 3326823 - DNA, 17 bp, Homo sapiens
attaatcttagtgtatg

SEQ ID NO: 3326824 - DNA, 19 bp, Homo sapiens
attaatcttagtgtatgat

SEQ ID NO: 3326825 - DNA, 21 bp, Homo sapiens
attaatcttagtgtatgatta

SEQ ID NO: 3326826 - DNA, 22 bp, Homo sapiens
attaatcttagtgtatgattac

SEQ ID NO: 3326827 - DNA, 16 bp, Homo sapiens
attaatgtacttgttt

SEQ ID NO: 3326828 - DNA, 20 bp, Homo sapiens
attaatgtcagtatttcaac

SEQ ID NO: 3326829 - DNA, 12 bp, Homo sapiens
attaatgtttct

SEQ ID NO: 3326830 - DNA, 14 bp, Homo sapiens
attaatgtttctta

SEQ ID NO: 3326831 - DNA, 15 bp, Homo sapiens
attaatgtttcttaa

SEQ ID NO: 3326832 - DNA, 15 bp, Homo sapiens
attaatgttttcatt

SEQ ID NO: 3326833 - DNA, 20 bp, Homo sapiens
attaatgttttcattatgtt

SEQ ID NO: 3326834 - DNA, 16 bp, Homo sapiens
attaatgttttgtaca

SEQ ID NO: 3326835 - DNA, 18 bp, Homo sapiens
attaatgttttgtacaat

SEQ ID NO: 3326836 - DNA, 15 bp, Homo sapiens
attaattaattaaag

SEQ ID NO: 3326837 - DNA, 15 bp, Homo sapiens
attaattaatttgga

SEQ ID NO: 3326838 - DNA, 14 bp, Homo sapiens
attaattacataca

SEQ ID NO: 3326839 - DNA, 19 bp, Homo sapiens
attaattcaccttccagtg

SEQ ID NO: 3326840 - DNA, 13 bp, Homo sapiens
attaattctataa

SEQ ID NO: 3326841 - DNA, 18 bp, Homo sapiens
attaattgttttgcactt

SEQ ID NO: 3326842 - DNA, 21 bp, Homo sapiens
attaatttggagcacaaaatt

SEQ ID NO: 3326843 - DNA, 13 bp, Homo sapiens
attaattttactc

SEQ ID NO: 3326844 - DNA, 14 bp, Homo sapiens
attaattttgtgca

SEQ ID NO: 3326845 - DNA, 20 bp, Homo sapiens
attaattttgtgcattcttt

SEQ ID NO: 3326846 - DNA, 12 bp, Homo sapiens
attacaaacaag

SEQ ID NO: 3326847 - DNA, 16 bp, Homo sapiens
attacaaacaagtgga

SEQ ID NO: 3326848 - DNA, 11 bp, Homo sapiens
attacaaagcc

SEQ ID NO: 3326849 - DNA, 20 bp, Homo sapiens
attacaaaggaatctaatta

SEQ ID NO: 3326850 - DNA, 22 bp, Homo sapiens
attacaaatcagaagtcatctt

SEQ ID NO: 3326851 - DNA, 17 bp, Homo sapiens
attacaactctatttaa

SEQ ID NO: 3326852 - DNA, 12 bp, Homo sapiens
attacaatggaa

SEQ ID NO: 3326853 - DNA, 13 bp, Homo sapiens
attacaattttat

SEQ ID NO: 3326854 - DNA, 14 bp, Homo sapiens
attacaattttatc

SEQ ID NO: 3326855 - DNA, 20 bp, Homo sapiens
attacacagtcaaatttaca

SEQ ID NO: 3326856 - DNA, 18 bp, Homo sapiens
attacacatttgtacaga

SEQ ID NO: 3326857 - DNA, 20 bp, Homo sapiens
attacactgtgccttttccc

SEQ ID NO: 3326858 - DNA, 13 bp, Homo sapiens
attacagaaactg

SEQ ID NO: 3326859 - DNA, 18 bp, Homo sapiens
attacagaaactgatgcc

SEQ ID NO: 3326860 - DNA, 12 bp, Homo sapiens
attacagagagg

SEQ ID NO: 3326861 - DNA, 21 bp, Homo sapiens
attacagaggtattaaaacta

SEQ ID NO: 3326862 - DNA, 13 bp, Homo sapiens
attacagatgtga

SEQ ID NO: 3326863 - DNA, 15 bp, Homo sapiens
attacagatgtgaaa

SEQ ID NO: 3326864 - DNA, 19 bp, Homo sapiens
attacagatgtgaaaataa

SEQ ID NO: 3326865 - DNA, 13 bp, Homo sapiens
attacagcttcac

SEQ ID NO: 3326866 - DNA, 14 bp, Homo sapiens
attacagcttttat

SEQ ID NO: 3326867 - DNA, 15 bp, Homo sapiens
attacagcttttatg

SEQ ID NO: 3326868 - DNA, 16 bp, Homo sapiens
attacaggaatgaaga

SEQ ID NO: 3326869 - DNA, 17 bp, Homo sapiens
attacaggaatgaagaa

SEQ ID NO: 3326870 - DNA, 19 bp, Homo sapiens
attacaggagggaacattt

SEQ ID NO: 3326871 - DNA, 20 bp, Homo sapiens
attacaggagggaacatttc

SEQ ID NO: 3326872 - DNA, 21 bp, Homo sapiens
attacaggagggaacatttcc

SEQ ID NO: 3326873 - DNA, 23 bp, Homo sapiens
attacaggagggaacatttccga

SEQ ID NO: 3326874 - DNA, 22 bp, Homo sapiens
attacaggtgggatatgctaga

SEQ ID NO: 3326875 - DNA, 12 bp, Homo sapiens
attacagtgaaa

SEQ ID NO: 3326876 - DNA, 12 bp, Homo sapiens
attacatacaga

SEQ ID NO: 3326877 - DNA, 14 bp, Homo sapiens
attacatacagatt

SEQ ID NO: 3326878 - DNA, 19 bp, Homo sapiens
attacatgtaaaacattat

SEQ ID NO: 3326879 - DNA, 14 bp, Homo sapiens
attaccaacctgtt

SEQ ID NO: 3326880 - DNA, 19 bp, Homo sapiens
attaccaataggcaaatta

SEQ ID NO: 3326881 - DNA, 20 bp, Homo sapiens
attaccaataggcaaattaa

SEQ ID NO: 3326882 - DNA, 18 bp, Homo sapiens
attaccagcaagaataaa

SEQ ID NO: 3326883 - DNA, 19 bp, Homo sapiens
attaccccctccttcagac

SEQ ID NO: 3326884 - DNA, 20 bp, Homo sapiens
attaccccctccttcagaca

SEQ ID NO: 3326885 - DNA, 15 bp, Homo sapiens
attacctagaaatct

SEQ ID NO: 3326886 - DNA, 13 bp, Homo sapiens
attacctctgata

SEQ ID NO: 3326887 - DNA, 20 bp, Homo sapiens
attacctgccaattgctacc

SEQ ID NO: 3326888 - DNA, 15 bp, Homo sapiens
attacctgtggatat

SEQ ID NO: 3326889 - DNA, 22 bp, Homo sapiens
attaccttattggatatttgat

SEQ ID NO: 3326890 - DNA, 21 bp, Homo sapiens
attacgtatgcaagtctgtga

SEQ ID NO: 3326891 - DNA, 23 bp, Homo sapiens
attacgtatgcaagtctgtgagt

SEQ ID NO: 3326892 - DNA, 12 bp, Homo sapiens
attactaatttt

SEQ ID NO: 3326893 - DNA, 15 bp, Homo sapiens
attactaattttaca

SEQ ID NO: 3326894 - DNA, 14 bp, Homo sapiens
attactcctatttt

SEQ ID NO: 3326895 - DNA, 19 bp, Homo sapiens
attactcctatttttgtaa

SEQ ID NO: 3326896 - DNA, 21 bp, Homo sapiens
attactcctatttttgtaaac

SEQ ID NO: 3326897 - DNA, 18 bp, Homo sapiens
attactgctttaatcaga

SEQ ID NO: 3326898 - DNA, 15 bp, Homo sapiens
atgtgctagtggcaa

SEQ ID NO: 3326899 - DNA, 16 bp, Homo sapiens
atgtgctatacacaca

SEQ ID NO: 3326900 - DNA, 17 bp, Homo sapiens
atgtgctatacacacac

SEQ ID NO: 3326901 - DNA, 19 bp, Homo sapiens
atgtgctatacacacacac

SEQ ID NO: 3326902 - DNA, 12 bp, Homo sapiens
atgtgctcagaa

SEQ ID NO: 3326903 - DNA, 14 bp, Homo sapiens
atgtgctcagaaga

SEQ ID NO: 3326904 - DNA, 18 bp, Homo sapiens
atgtgctgtgaccattta

SEQ ID NO: 3326905 - DNA, 16 bp, Homo sapiens
atgtggaaagtgaatt

SEQ ID NO: 3326906 - DNA, 17 bp, Homo sapiens
atgtggaaagtgaattt

SEQ ID NO: 3326907 - DNA, 17 bp, Homo sapiens
atgtggcaaagtgctgt

SEQ ID NO: 3326908 - DNA, 20 bp, Homo sapiens
atgtggcaaagtgctgtacc

SEQ ID NO: 3326909 - DNA, 10 bp, Homo sapiens
atgtggctga

SEQ ID NO: 3326910 - DNA, 11 bp, Homo sapiens
atgtggctgaa

SEQ ID NO: 3326911 - DNA, 14 bp, Homo sapiens
atgtggctgaagac

SEQ ID NO: 3326912 - DNA, 20 bp, Homo sapiens
atgtggctggaagatcctgc

SEQ ID NO: 3326913 - DNA, 16 bp, Homo sapiens
atgtggcttgagaaat

SEQ ID NO: 3326914 - DNA, 11 bp, Homo sapiens
atgtgggaggg

SEQ ID NO: 3326915 - DNA, 19 bp, Homo sapiens
atgtgggatattgaatgtt

SEQ ID NO: 3326916 - DNA, 16 bp, Homo sapiens
atgtggggccaggtca

SEQ ID NO: 3326917 - DNA, 21 bp, Homo sapiens
atgtggggtccccatcatccc

SEQ ID NO: 3326918 - DNA, 20 bp, Homo sapiens
atgtgggtcttatgcttcca

SEQ ID NO: 3326919 - DNA, 23 bp, Homo sapiens
atgtgggtcttatgcttccatta

SEQ ID NO: 3326920 - DNA, 16 bp, Homo sapiens
atgtgggttgcctggt

SEQ ID NO: 3326921 - DNA, 21 bp, Homo sapiens
atgtggtttggttcctctctg

SEQ ID NO: 3326922 - DNA, 22 bp, Homo sapiens
atgtggtttggttcctctctgg

SEQ ID NO: 3326923 - DNA, 22 bp, Homo sapiens
atgtaatgaagtaaagccatta

SEQ ID NO: 3326924 - DNA, 21 bp, Homo sapiens
atgtaatgtgtggtggcctca

SEQ ID NO: 3326925 - DNA, 18 bp, Homo sapiens
atgtaatgttaatgttat

SEQ ID NO: 3326926 - DNA, 15 bp, Homo sapiens
atgtaattaagtact

SEQ ID NO: 3326927 - DNA, 17 bp, Homo sapiens
atgtaattaagtactat

SEQ ID NO: 3326928 - DNA, 14 bp, Homo sapiens
atgtaattagctct

SEQ ID NO: 3326929 - DNA, 15 bp, Homo sapiens
atgtaattagctctg

SEQ ID NO: 3326930 - DNA, 18 bp, Homo sapiens
atgtaattagctctgggg

SEQ ID NO: 3326931 - DNA, 12 bp, Homo sapiens
atgtaatttaaa

SEQ ID NO: 3326932 - DNA, 17 bp, Homo sapiens
atgtaatttaaatgaaa

SEQ ID NO: 3326933 - DNA, 14 bp, Homo sapiens
atgtaatttagaaa

SEQ ID NO: 3326934 - DNA, 21 bp, Homo sapiens
atgtacaaaatcgattggctt

SEQ ID NO: 3326935 - DNA, 21 bp, Homo sapiens
atgtacaagttttgtataaat

SEQ ID NO: 3326936 - DNA, 23 bp, Homo sapiens
atgtacaattgtgggcataaact

SEQ ID NO: 3326937 - DNA, 17 bp, Homo sapiens
atgtacagctggtgctt

SEQ ID NO: 3326938 - DNA, 16 bp, Homo sapiens
atgtacagttgaaata

SEQ ID NO: 3326939 - DNA, 16 bp, Homo sapiens
atgtacatttgtcttt

SEQ ID NO: 3326940 - DNA, 18 bp, Homo sapiens
atgtaccatttgcatggc

SEQ ID NO: 3326941 - DNA, 15 bp, Homo sapiens
atgtaccttgaccat

SEQ ID NO: 3326942 - DNA, 18 bp, Homo sapiens
atgtactagtgttctgtt

SEQ ID NO: 3326943 - DNA, 20 bp, Homo sapiens
atgtactagtgttctgtttg

SEQ ID NO: 3326944 - DNA, 18 bp, Homo sapiens
atgtactgagccttgtaa

SEQ ID NO: 3326945 - DNA, 17 bp, Homo sapiens
atgtactgatttcagta

SEQ ID NO: 3326946 - DNA, 13 bp, Homo sapiens
atgtactgtacta

SEQ ID NO: 3326947 - DNA, 18 bp, Homo sapiens
atgtactgtactaattct

SEQ ID NO: 3326948 - DNA, 20 bp, Homo sapiens
atgtactgtactaattctta

SEQ ID NO: 3326949 - DNA, 15 bp, Homo sapiens
atgtacttagctgta

SEQ ID NO: 3326950 - DNA, 19 bp, Homo sapiens
atgtacttagctgtactat

SEQ ID NO: 3326951 - DNA, 22 bp, Homo sapiens
atgtactttggcatcttttgga

SEQ ID NO: 3326952 - DNA, 17 bp, Homo sapiens
atgtagaaacatttaga

SEQ ID NO: 3326953 - DNA, 23 bp, Homo sapiens
atgtagaacttcaagaagtaaga

SEQ ID NO: 3326954 - DNA, 19 bp, Homo sapiens
atgtagactatatacatgt

SEQ ID NO: 3326955 - DNA, 19 bp, Homo sapiens
atgtagataacaagacctc

SEQ ID NO: 3326956 - DNA, 15 bp, Homo sapiens
atgtagatatttggc

SEQ ID NO: 3326957 - DNA, 20 bp, Homo sapiens
atgtagcaaaacgcatggag

SEQ ID NO: 3326958 - DNA, 15 bp, Homo sapiens
atgtagcacataaac

SEQ ID NO: 3326959 - DNA, 19 bp, Homo sapiens
atgtagcacataaactttg

SEQ ID NO: 3326960 - DNA, 16 bp, Homo sapiens
atgtagcgtgtttaca

SEQ ID NO: 3326961 - DNA, 22 bp, Homo sapiens
atgtagctctgcatctcctgtc

SEQ ID NO: 3326962 - DNA, 14 bp, Homo sapiens
atgtagctggtttc

SEQ ID NO: 3326963 - DNA, 15 bp, Homo sapiens
atgtagcttgacaat

SEQ ID NO: 3326964 - DNA, 16 bp, Homo sapiens
atgtagcttgacaatt

SEQ ID NO: 3326965 - DNA, 16 bp, Homo sapiens
atgtaggactgtatag

SEQ ID NO: 3326966 - DNA, 23 bp, Homo sapiens
atgtaggggttaacttggtcaga

SEQ ID NO: 3326967 - DNA, 16 bp, Homo sapiens
atgtaggtaagactgt

SEQ ID NO: 3326968 - DNA, 16 bp, Homo sapiens
atgtaggtatgaataa

SEQ ID NO: 3326969 - DNA, 17 bp, Homo sapiens
atgtaggtatgaataag

SEQ ID NO: 3326970 - DNA, 16 bp, Homo sapiens
atgtagtaattgacat

SEQ ID NO: 3326971 - DNA, 18 bp, Homo sapiens
atgtagtaattgacatgt

SEQ ID NO: 3326972 - DNA, 14 bp, Homo sapiens
atgtagtagtactt

SEQ ID NO: 3326973 - DNA, 18 bp, Homo sapiens
atgtagtattaaaagttg

SEQ ID NO: 3326974 - DNA, 13 bp, Homo sapiens
atgtagtctgtag

SEQ ID NO: 3326975 - DNA, 21 bp, Homo sapiens
atgtagttgtcacactaaaat

SEQ ID NO: 3326976 - DNA, 20 bp, Homo sapiens
atgtagtttttatatgttgt

SEQ ID NO: 3326977 - DNA, 21 bp, Homo sapiens
atgtagtttttatatgttgta

SEQ ID NO: 3326978 - DNA, 18 bp, Homo sapiens
atgtataaagattgtact

SEQ ID NO: 3326979 - DNA, 19 bp, Homo sapiens
atgtataaagattgtactt

SEQ ID NO: 3326980 - DNA, 14 bp, Homo sapiens
atgtataaatatac

SEQ ID NO: 3326981 - DNA, 13 bp, Homo sapiens
atgtatataaaaa

SEQ ID NO: 3326982 - DNA, 15 bp, Homo sapiens
atgtatataaaaatg

SEQ ID NO: 3326983 - DNA, 13 bp, Homo sapiens
atgtatatacaca

SEQ ID NO: 3326984 - DNA, 19 bp, Homo sapiens
atgtatatatatatatgca

SEQ ID NO: 3326985 - DNA, 14 bp, Homo sapiens
atgtatatatttag

SEQ ID NO: 3326986 - DNA, 16 bp, Homo sapiens
atgtatatgtttatat

SEQ ID NO: 3326987 - DNA, 20 bp, Homo sapiens
atgtatatttttttaattta

SEQ ID NO: 3326988 - DNA, 12 bp, Homo sapiens
atgtatcaatga

SEQ ID NO: 3326989 - DNA, 21 bp, Homo sapiens
atgtatcccttctcacagcac

SEQ ID NO: 3326990 - DNA, 17 bp, Homo sapiens
atgtatctgagttgcca

SEQ ID NO: 3326991 - DNA, 14 bp, Homo sapiens
atgtatgcattcac

SEQ ID NO: 3326992 - DNA, 21 bp, Homo sapiens
atgtatggaatacagtgttat

SEQ ID NO: 3326993 - DNA, 22 bp, Homo sapiens
atgtatggaatcccactgtatg

SEQ ID NO: 3326994 - DNA, 17 bp, Homo sapiens
atgtatgtgaaagtgta

SEQ ID NO: 3326995 - DNA, 22 bp, Homo sapiens
atgtatgtgaaagtgtaaaata

SEQ ID NO: 3326996 - DNA, 15 bp, Homo sapiens
atgtatgtgcactgt

SEQ ID NO: 3326997 - DNA, 17 bp, Homo sapiens
atgtatgtgcactgtca

SEQ ID NO: 3326998 - DNA, 15 bp, Homo sapiens
atgtatgtgtaagta

SEQ ID NO: 3326999 - DNA, 12 bp, Homo sapiens
atgtatgttaat

SEQ ID NO: 3327000 - DNA, 12 bp, Homo sapiens
atgtatgtttac

SEQ ID NO: 3327001 - DNA, 16 bp, Homo sapiens
atgtatgtttacatat

SEQ ID NO: 3327002 - DNA, 18 bp, Homo sapiens
atgtattagtatggttca

SEQ ID NO: 3327003 - DNA, 15 bp, Homo sapiens
atgtattataacttt

SEQ ID NO: 3327004 - DNA, 14 bp, Homo sapiens
atgtattattctgc

SEQ ID NO: 3327005 - DNA, 14 bp, Homo sapiens
atgtattcctgaaa

SEQ ID NO: 3327006 - DNA, 19 bp, Homo sapiens
atgtattctagctaatgta

SEQ ID NO: 3327007 - DNA, 20 bp, Homo sapiens
atgtattctagctaatgtaa

SEQ ID NO: 3327008 - DNA, 19 bp, Homo sapiens
atgtattgtaaacatgtgt

SEQ ID NO: 3327009 - DNA, 17 bp, Homo sapiens
atgtatttataaatata

SEQ ID NO: 3327010 - DNA, 18 bp, Homo sapiens
atgtatttatgtgtatat

SEQ ID NO: 3327011 - DNA, 23 bp, Homo sapiens
atgtatttatgtgtatatttgta

SEQ ID NO: 3327012 - DNA, 13 bp, Homo sapiens
atgtatttgttca

SEQ ID NO: 3327013 - DNA, 14 bp, Homo sapiens
atgtatttgttcat

SEQ ID NO: 3327014 - DNA, 14 bp, Homo sapiens
atgtattttgaaga

SEQ ID NO: 3327015 - DNA, 19 bp, Homo sapiens
atgtattttgaagaatatt

SEQ ID NO: 3327016 - DNA, 19 bp, Homo sapiens
atgtatttttctacattat

SEQ ID NO: 3327017 - DNA, 23 bp, Homo sapiens
atgtatttttctacattattgct

SEQ ID NO: 3327018 - DNA, 14 bp, Homo sapiens
atgtatttttctat

SEQ ID NO: 3327019 - DNA, 16 bp, Homo sapiens
atgtatttttctatgt

SEQ ID NO: 3327020 - DNA, 24 bp, Homo sapiens
atgtcaacagccataataataatt

SEQ ID NO: 3327021 - DNA, 21 bp, Homo sapiens
atgtcaactgtgtctctgaat

SEQ ID NO: 3327022 - DNA, 14 bp, Homo sapiens
atgtcaacttctgg

SEQ ID NO: 3327023 - DNA, 18 bp, Homo sapiens
atgtcaacttctggctcc

SEQ ID NO: 3327024 - DNA, 15 bp, Homo sapiens
atgtcaagaggctga

SEQ ID NO: 3327025 - DNA, 18 bp, Homo sapiens
atgtcacaaattgatcaa

SEQ ID NO: 3327026 - DNA, 19 bp, Homo sapiens
atgtcacaaattgatcaag

SEQ ID NO: 3327027 - DNA, 22 bp, Homo sapiens
atgtcacaacctctctgatctt

SEQ ID NO: 3327028 - DNA, 13 bp, Homo sapiens
atgtcacaggcag

SEQ ID NO: 3327029 - DNA, 16 bp, Homo sapiens
atgtcacaggcaggtc

SEQ ID NO: 3327030 - DNA, 17 bp, Homo sapiens
atgtcacaggcaggtcc

SEQ ID NO: 3327031 - DNA, 13 bp, Homo sapiens
atgtcacagggcc

SEQ ID NO: 3327032 - DNA, 19 bp, Homo sapiens
atgtcaccggtcagtgcct

SEQ ID NO: 3327033 - DNA, 19 bp, Homo sapiens
atgtcacgtactgtctgat

SEQ ID NO: 3327034 - DNA, 23 bp, Homo sapiens
atgtcagacatccatgtttgtaa

SEQ ID NO: 3327035 - DNA, 19 bp, Homo sapiens
atgtcagccgagccgggcc

SEQ ID NO: 3327036 - DNA, 23 bp, Homo sapiens
atgtcagccgagccgggcctggg

SEQ ID NO: 3327037 - DNA, 13 bp, Homo sapiens
atgtcagcttccc

SEQ ID NO: 3327038 - DNA, 16 bp, Homo sapiens
atgtcaggcctgtgtg

SEQ ID NO: 3327039 - DNA, 21 bp, Homo sapiens
atgtcagtatttcaactgctg

SEQ ID NO: 3327040 - DNA, 18 bp, Homo sapiens
atgtcatggccttgaaac

SEQ ID NO: 3327041 - DNA, 13 bp, Homo sapiens
atgtcattaaatg

SEQ ID NO: 3327042 - DNA, 15 bp, Homo sapiens
atgtcattaatatat

SEQ ID NO: 3327043 - DNA, 16 bp, Homo sapiens
atgtcattaatgtgtt

SEQ ID NO: 3327044 - DNA, 16 bp, Homo sapiens
atgtccaacccgtctg

SEQ ID NO: 3327045 - DNA, 23 bp, Homo sapiens
atgtccagaagaatattcaggac

SEQ ID NO: 3327046 - DNA, 21 bp, Homo sapiens
atgtccatagccataattcca

SEQ ID NO: 3327047 - DNA, 19 bp, Homo sapiens
atgtccatcccttttcctg

SEQ ID NO: 3327048 - DNA, 14 bp, Homo sapiens
atgtcccacccacc

SEQ ID NO: 3327049 - DNA, 21 bp, Homo sapiens
atgaggaaaattcttaaaagg

SEQ ID NO: 3327050 - DNA, 15 bp, Homo sapiens
atgaggacagagtgg

SEQ ID NO: 3327051 - DNA, 12 bp, Homo sapiens
atgaggagacag

SEQ ID NO: 3327052 - DNA, 14 bp, Homo sapiens
atgaggcacttctg

SEQ ID NO: 3327053 - DNA, 14 bp, Homo sapiens
atgagggtgactgt

SEQ ID NO: 3327054 - DNA, 23 bp, Homo sapiens
atgagggtgtgagaagtgccttc

SEQ ID NO: 3327055 - DNA, 15 bp, Homo sapiens
atgagggtgtttcct

SEQ ID NO: 3327056 - DNA, 20 bp, Homo sapiens
atgagggtgtttcctctaaa

SEQ ID NO: 3327057 - DNA, 13 bp, Homo sapiens
atgaggttctgag

SEQ ID NO: 3327058 - DNA, 21 bp, Homo sapiens
atgaggttctgagaccagtgt

SEQ ID NO: 3327059 - DNA, 22 bp, Homo sapiens
atgaggttctgagaccagtgta

SEQ ID NO: 3327060 - DNA, 21 bp, Homo sapiens
atgagtatacaatatataaaa

SEQ ID NO: 3327061 - DNA, 23 bp, Homo sapiens
atgagtatacaatatataaaaat

SEQ ID NO: 3327062 - DNA, 23 bp, Homo sapiens
atgagtatttggtccaaaaaaag

SEQ ID NO: 3327063 - DNA, 17 bp, Homo sapiens
atgagtcaatgtgcagt

SEQ ID NO: 3327064 - DNA, 17 bp, Homo sapiens
atgagtgaataaatgtc

SEQ ID NO: 3327065 - DNA, 12 bp, Homo sapiens
atgagtgtgcat

SEQ ID NO: 3327066 - DNA, 17 bp, Homo sapiens
atgagttaactgtgaaa

SEQ ID NO: 3327067 - DNA, 17 bp, Homo sapiens
atgagttatgagttatt

SEQ ID NO: 3327068 - DNA, 14 bp, Homo sapiens
atgagttggacttc

SEQ ID NO: 3327069 - DNA, 18 bp, Homo sapiens
atgagttggacttcagtc

SEQ ID NO: 3327070 - DNA, 20 bp, Homo sapiens
atgagttgtgaaagttttga

SEQ ID NO: 3327071 - DNA, 20 bp, Homo sapiens
atgagttgtgatgaatcaat

SEQ ID NO: 3327072 - DNA, 21 bp, Homo sapiens
atgagtttttatggttccaat

SEQ ID NO: 3327073 - DNA, 20 bp, Homo sapiens
atgagtttttgatagcttta

SEQ ID NO: 3327074 - DNA, 14 bp, Homo sapiens
atgataaagagaca

SEQ ID NO: 3327075 - DNA, 15 bp, Homo sapiens
atgataatagattct

SEQ ID NO: 3327076 - DNA, 17 bp, Homo sapiens
atgatacaatgaacact

SEQ ID NO: 3327077 - DNA, 14 bp, Homo sapiens
atgatactgattat

SEQ ID NO: 3327078 - DNA, 14 bp, Homo sapiens
atgatagcccagaa

SEQ ID NO: 3327079 - DNA, 21 bp, Homo sapiens
atgatatgtaaacataattct

SEQ ID NO: 3327080 - DNA, 20 bp, Homo sapiens
atgatattccccatttcctg

SEQ ID NO: 3327081 - DNA, 14 bp, Homo sapiens
atgatattgtttaa

SEQ ID NO: 3327082 - DNA, 15 bp, Homo sapiens
atgatattgtttaaa

SEQ ID NO: 3327083 - DNA, 19 bp, Homo sapiens
atgatattgtttaaaattc

SEQ ID NO: 3327084 - DNA, 21 bp, Homo sapiens
atgatattgtttaaaattcag

SEQ ID NO: 3327085 - DNA, 15 bp, Homo sapiens
atgatatttcttgct

SEQ ID NO: 3327086 - DNA, 18 bp, Homo sapiens
atgatatttcttgctttc

SEQ ID NO: 3327087 - DNA, 15 bp, Homo sapiens
atgatcaacaattta

SEQ ID NO: 3327088 - DNA, 20 bp, Homo sapiens
atgatcaattatagtttctg

SEQ ID NO: 3327089 - DNA, 19 bp, Homo sapiens
atgatcacggctcactgca

SEQ ID NO: 3327090 - DNA, 17 bp, Homo sapiens
atgatcagtgttactgc

SEQ ID NO: 3327091 - DNA, 22 bp, Homo sapiens
atgatcatttgcccttaaggac

SEQ ID NO: 3327092 - DNA, 18 bp, Homo sapiens
atgatccctgtgttgtct

SEQ ID NO: 3327093 - DNA, 15 bp, Homo sapiens
atgatccttttttgt

SEQ ID NO: 3327094 - DNA, 22 bp, Homo sapiens
atgatccttttttgtcatttta

SEQ ID NO: 3327095 - DNA, 14 bp, Homo sapiens
atgatctactcaga

SEQ ID NO: 3327096 - DNA, 15 bp, Homo sapiens
atgatctactcagaa

SEQ ID NO: 3327097 - DNA, 14 bp, Homo sapiens
atgatctatttgta

SEQ ID NO: 3327098 - DNA, 18 bp, Homo sapiens
atgatctcggatgaccaa

SEQ ID NO: 3327099 - DNA, 20 bp, Homo sapiens
atgatctcggatgaccaaac

SEQ ID NO: 3327100 - DNA, 22 bp, Homo sapiens
atgatctcggatgaccaaacca

SEQ ID NO: 3327101 - DNA, 14 bp, Homo sapiens
atgatctctctgaa

SEQ ID NO: 3327102 - DNA, 22 bp, Homo sapiens
atgatctcttcttttggcttcc

SEQ ID NO: 3327103 - DNA, 17 bp, Homo sapiens
atgatctgcctctaaaa

SEQ ID NO: 3327104 - DNA, 18 bp, Homo sapiens
atgatctggacttcctat

SEQ ID NO: 3327105 - DNA, 22 bp, Homo sapiens
atgatctgtatttaatggtttt

SEQ ID NO: 3327106 - DNA, 18 bp, Homo sapiens
atgatcttctttataatt

SEQ ID NO: 3327107 - DNA, 18 bp, Homo sapiens
atgatctttgcagacagg

SEQ ID NO: 3327108 - DNA, 12 bp, Homo sapiens
atgatgaaaatt

SEQ ID NO: 3327109 - DNA, 23 bp, Homo sapiens
atgatgaaatgaggtcagagcct

SEQ ID NO: 3327110 - DNA, 15 bp, Homo sapiens
atgatgatctgcctc

SEQ ID NO: 3327111 - DNA, 14 bp, Homo sapiens
atgatgatgaaaac

SEQ ID NO: 3327112 - DNA, 21 bp, Homo sapiens
atgatgattccttgagcattt

SEQ ID NO: 3327113 - DNA, 15 bp, Homo sapiens
atgatgcatacagtt

SEQ ID NO: 3327114 - DNA, 17 bp, Homo sapiens
atgatgccaacctctgg

SEQ ID NO: 3327115 - DNA, 18 bp, Homo sapiens
atgatgccaacctctgga

SEQ ID NO: 3327116 - DNA, 22 bp, Homo sapiens
atgatgcttctataattttgcc

SEQ ID NO: 3327117 - DNA, 13 bp, Homo sapiens
atgatggcagagg

SEQ ID NO: 3327118 - DNA, 15 bp, Homo sapiens
atgatgggaaaatat

SEQ ID NO: 3327119 - DNA, 17 bp, Homo sapiens
atgatgggaaaatattt

SEQ ID NO: 3327120 - DNA, 21 bp, Homo sapiens
atgatgggaaaatatttcctg

SEQ ID NO: 3327121 - DNA, 21 bp, Homo sapiens
atgatgggaatagggagacag

SEQ ID NO: 3327122 - DNA, 15 bp, Homo sapiens
atgatgtctcttgta

SEQ ID NO: 3327123 - DNA, 19 bp, Homo sapiens
atgatgtctcttgtagaag

SEQ ID NO: 3327124 - DNA, 17 bp, Homo sapiens
atgatgtgaaacacttt

SEQ ID NO: 3327125 - DNA, 17 bp, Homo sapiens
atgatgtgggtgtcctg

SEQ ID NO: 3327126 - DNA, 23 bp, Homo sapiens
atgatgtggtgcctgaggtctgt

SEQ ID NO: 3327127 - DNA, 15 bp, Homo sapiens
atgatgtttcacata

SEQ ID NO: 3327128 - DNA, 14 bp, Homo sapiens
atgattactggcct

SEQ ID NO: 3327129 - DNA, 23 bp, Homo sapiens
atgattagaaattacctgtggat

SEQ ID NO: 3327130 - DNA, 23 bp, Homo sapiens
atgattagcaagttacagtgatg

SEQ ID NO: 3327131 - DNA, 13 bp, Homo sapiens
atgattatttgta

SEQ ID NO: 3327132 - DNA, 14 bp, Homo sapiens
atgattcagaaatt

SEQ ID NO: 3327133 - DNA, 14 bp, Homo sapiens
atgattcataacaa

SEQ ID NO: 3327134 - DNA, 13 bp, Homo sapiens
atgattctctgag

SEQ ID NO: 3327135 - DNA, 24 bp, Homo sapiens
atgattctctgagtggtggttcct

SEQ ID NO: 3327136 - DNA, 20 bp, Homo sapiens
atgattcttccttttattaa

SEQ ID NO: 3327137 - DNA, 20 bp, Homo sapiens
atgattctttgttacaggca

SEQ ID NO: 3327138 - DNA, 14 bp, Homo sapiens
atgattggattatt

SEQ ID NO: 3327139 - DNA, 15 bp, Homo sapiens
atgattggattattc

SEQ ID NO: 3327140 - DNA, 15 bp, Homo sapiens
atgattgtactttga

SEQ ID NO: 3327141 - DNA, 18 bp, Homo sapiens
atgatttaataaaataat

SEQ ID NO: 3327142 - DNA, 22 bp, Homo sapiens
atgatttaataaaataattcta

SEQ ID NO: 3327143 - DNA, 20 bp, Homo sapiens
atgatttatagtttgtacat

SEQ ID NO: 3327144 - DNA, 13 bp, Homo sapiens
atgatttcatatt

SEQ ID NO: 3327145 - DNA, 21 bp, Homo sapiens
atgatttcatgctatctctgt

SEQ ID NO: 3327146 - DNA, 14 bp, Homo sapiens
atgatttcatttca

SEQ ID NO: 3327147 - DNA, 23 bp, Homo sapiens
atgatttgtcccagcctggggct

SEQ ID NO: 3327148 - DNA, 17 bp, Homo sapiens
atgatttgttttgaatt

SEQ ID NO: 3327149 - DNA, 11 bp, Homo sapiens
atgatttttag

SEQ ID NO: 3327150 - DNA, 22 bp, Homo sapiens
atgatttttagatgagattgtt

SEQ ID NO: 3327151 - DNA, 17 bp, Homo sapiens
atgattttttaaaagaa

SEQ ID NO: 3327152 - DNA, 20 bp, Homo sapiens
atgattttttaaaagaaatt

SEQ ID NO: 3327153 - DNA, 22 bp, Homo sapiens
atgattttttaaaagaaattta

SEQ ID NO: 3327154 - DNA, 17 bp, Homo sapiens
atgattttttgaaagtt

SEQ ID NO: 3327155 - DNA, 23 bp, Homo sapiens
atgattttttgaaagttaacatt

SEQ ID NO: 3327156 - DNA, 15 bp, Homo sapiens
atgatttttttttcc

SEQ ID NO: 3327157 - DNA, 17 bp, Homo sapiens
atgatttttttttccaa

SEQ ID NO: 3327158 - DNA, 23 bp, Homo sapiens
atgcaaaaagaaatgactaatta

SEQ ID NO: 3327159 - DNA, 17 bp, Homo sapiens
atgcaaaatatgtttaa

SEQ ID NO: 3327160 - DNA, 22 bp, Homo sapiens
atgcaaaattgttttcacttgt

SEQ ID NO: 3327161 - DNA, 24 bp, Homo sapiens
atgcaaaattgttttcacttgtat

SEQ ID NO: 3327162 - DNA, 15 bp, Homo sapiens
atgcaaagaaaatca

SEQ ID NO: 3327163 - DNA, 18 bp, Homo sapiens
atgcaaagtacaatgtgt

SEQ ID NO: 3327164 - DNA, 17 bp, Homo sapiens
atgcaaagttctgtgtt

SEQ ID NO: 3327165 - DNA, 21 bp, Homo sapiens
atgcaaagttctgtgtttaat

SEQ ID NO: 3327166 - DNA, 14 bp, Homo sapiens
atgcaaatgagctc

SEQ ID NO: 3327167 - DNA, 19 bp, Homo sapiens
atgcaaatgagctctgaaa

SEQ ID NO: 3327168 - DNA, 21 bp, Homo sapiens
atgcaaatgagctctgaaatc

SEQ ID NO: 3327169 - DNA, 16 bp, Homo sapiens
atgcaaattaaaacat

SEQ ID NO: 3327170 - DNA, 18 bp, Homo sapiens
atgcaaattaaaacatat

SEQ ID NO: 3327171 - DNA, 16 bp, Homo sapiens
atgcaacaaatattta

SEQ ID NO: 3327172 - DNA, 20 bp, Homo sapiens
atgcaaccagaattgtcctc

SEQ ID NO: 3327173 - DNA, 23 bp, Homo sapiens
atgcaagctagtggcttcaaaat

SEQ ID NO: 3327174 - DNA, 13 bp, Homo sapiens
atgcttaatttct

SEQ ID NO: 3327175 - DNA, 14 bp, Homo sapiens
atgcttaatttcta

SEQ ID NO: 3327176 - DNA, 16 bp, Homo sapiens
atgcttaatttctaaa

SEQ ID NO: 3327177 - DNA, 19 bp, Homo sapiens
atgcttaatttctaaagat

SEQ ID NO: 3327178 - DNA, 23 bp, Homo sapiens
atgcttacgtgatcctctcacct

SEQ ID NO: 3327179 - DNA, 15 bp, Homo sapiens
atgcttagtccctca

SEQ ID NO: 3327180 - DNA, 15 bp, Homo sapiens
atgcttatgacaatg

SEQ ID NO: 3327181 - DNA, 19 bp, Homo sapiens
atgcttcaagtgttgctct

SEQ ID NO: 3327182 - DNA, 21 bp, Homo sapiens
atgcttcatttgtatgtcaaa

SEQ ID NO: 3327183 - DNA, 12 bp, Homo sapiens
atgcttcccaga

SEQ ID NO: 3327184 - DNA, 14 bp, Homo sapiens
atgcttcccagagg

SEQ ID NO: 3327185 - DNA, 20 bp, Homo sapiens
atgcttcccagagggagcag

SEQ ID NO: 3327186 - DNA, 15 bp, Homo sapiens
atgcttcctcccagc

SEQ ID NO: 3327187 - DNA, 22 bp, Homo sapiens
atgcttcctgacaatcaactct

SEQ ID NO: 3327188 - DNA, 20 bp, Homo sapiens
atgcttctcatcttgtgaaa

SEQ ID NO: 3327189 - DNA, 21 bp, Homo sapiens
atgcttctcatcttgtgaaat

SEQ ID NO: 3327190 - DNA, 11 bp, Homo sapiens
atgcttctgta

SEQ ID NO: 3327191 - DNA, 15 bp, Homo sapiens
atgcttcttccttac

SEQ ID NO: 3327192 - DNA, 22 bp, Homo sapiens
atgcttgacaaatattttcatg

SEQ ID NO: 3327193 - DNA, 15 bp, Homo sapiens
atgcttggttttctt

SEQ ID NO: 3327194 - DNA, 12 bp, Homo sapiens
atgcttgtttat

SEQ ID NO: 3327195 - DNA, 22 bp, Homo sapiens
atgctttattaatgttttcaaa

SEQ ID NO: 3327196 - DNA, 14 bp, Homo sapiens
atgctttgctgcta

SEQ ID NO: 3327197 - DNA, 23 bp, Homo sapiens
atgctttggaaaaatgggtcttt

SEQ ID NO: 3327198 - DNA, 21 bp, Homo sapiens
atgctttgggaggccaaggca

SEQ ID NO: 3327199 - DNA, 20 bp, Homo sapiens
atgcttttagttttaaaagt

SEQ ID NO: 3327200 - DNA, 19 bp, Homo sapiens
atgctttttatttctgcat

SEQ ID NO: 3327201 - DNA, 23 bp, Homo sapiens
atgctttttatttctgcatatgt

SEQ ID NO: 3327202 - DNA, 21 bp, Homo sapiens
atggaaaaaccatttgaagtg

SEQ ID NO: 3327203 - DNA, 16 bp, Homo sapiens
atggaaaaataacaac

SEQ ID NO: 3327204 - DNA, 14 bp, Homo sapiens
atggaaaaatgtga

SEQ ID NO: 3327205 - DNA, 12 bp, Homo sapiens
atggaaaataaa

SEQ ID NO: 3327206 - DNA, 20 bp, Homo sapiens
atggaaaatgccatgaatta

SEQ ID NO: 3327207 - DNA, 13 bp, Homo sapiens
atggaaacctcac

SEQ ID NO: 3327208 - DNA, 11 bp, Homo sapiens
atggaaagaat

SEQ ID NO: 3327209 - DNA, 17 bp, Homo sapiens
atggaaagaatctaata

SEQ ID NO: 3327210 - DNA, 19 bp, Homo sapiens
atggaaagaggtgaaaatg

SEQ ID NO: 3327211 - DNA, 19 bp, Homo sapiens
atggaaccttccctccaaa

SEQ ID NO: 3327212 - DNA, 17 bp, Homo sapiens
atggaactactgtactt

SEQ ID NO: 3327213 - DNA, 18 bp, Homo sapiens
atggaactactgtacttt

SEQ ID NO: 3327214 - DNA, 19 bp, Homo sapiens
atggaactactgtactttg

SEQ ID NO: 3327215 - DNA, 19 bp, Homo sapiens
atggaacttctaatatatt

SEQ ID NO: 3327216 - DNA, 12 bp, Homo sapiens
atggaagagaaa

SEQ ID NO: 3327217 - DNA, 14 bp, Homo sapiens
atggaagagaaatc

SEQ ID NO: 3327218 - DNA, 15 bp, Homo sapiens
atggaagagaaatct

SEQ ID NO: 3327219 - DNA, 17 bp, Homo sapiens
atggaagagaaatctca

SEQ ID NO: 3327220 - DNA, 18 bp, Homo sapiens
atggaagcaattgctcat

SEQ ID NO: 3327221 - DNA, 22 bp, Homo sapiens
atggaaggtttgtatattgtca

SEQ ID NO: 3327222 - DNA, 15 bp, Homo sapiens
atggaataacatgta

SEQ ID NO: 3327223 - DNA, 15 bp, Homo sapiens
atggaatacagtgtt

SEQ ID NO: 3327224 - DNA, 22 bp, Homo sapiens
atggaatacagtgttattttct

SEQ ID NO: 3327225 - DNA, 20 bp, Homo sapiens
atggaatatcatctgtcatt

SEQ ID NO: 3327226 - DNA, 13 bp, Homo sapiens
atggaatcttctc

SEQ ID NO: 3327227 - DNA, 16 bp, Homo sapiens
atggaatgctgtgtta

SEQ ID NO: 3327228 - DNA, 17 bp, Homo sapiens
atggaatgctgtgttaa

SEQ ID NO: 3327229 - DNA, 21 bp, Homo sapiens
atggaatgctgtgttaaataa

SEQ ID NO: 3327230 - DNA, 14 bp, Homo sapiens
atggaatgtgcccc

SEQ ID NO: 3327231 - DNA, 21 bp, Homo sapiens
atggaatgtgcccctggccca

SEQ ID NO: 3327232 - DNA, 14 bp, Homo sapiens
atggaattattttg

SEQ ID NO: 3327233 - DNA, 13 bp, Homo sapiens
atggaattgattt

SEQ ID NO: 3327234 - DNA, 13 bp, Homo sapiens
atggaatttcata

SEQ ID NO: 3327235 - DNA, 17 bp, Homo sapiens
atggacaacttatttaa

SEQ ID NO: 3327236 - DNA, 20 bp, Homo sapiens
atggacaacttatttaaaaa

SEQ ID NO: 3327237 - DNA, 21 bp, Homo sapiens
atggacaacttatttaaaaat

SEQ ID NO: 3327238 - DNA, 15 bp, Homo sapiens
atggacacaaatttt

SEQ ID NO: 3327239 - DNA, 11 bp, Homo sapiens
atggacactcc

SEQ ID NO: 3327240 - DNA, 12 bp, Homo sapiens
atggaccacttt

SEQ ID NO: 3327241 - DNA, 20 bp, Homo sapiens
atggacccaagataaaagaa

SEQ ID NO: 3327242 - DNA, 19 bp, Homo sapiens
atggaccgggtgggcctgg

SEQ ID NO: 3327243 - DNA, 22 bp, Homo sapiens
atggaccgggtgggcctggcct

SEQ ID NO: 3327244 - DNA, 21 bp, Homo sapiens
atggactaaccccaacgcaca

SEQ ID NO: 3327245 - DNA, 19 bp, Homo sapiens
atggactaattgacttgca

SEQ ID NO: 3327246 - DNA, 17 bp, Homo sapiens
atggactatctgtctgg

SEQ ID NO: 3327247 - DNA, 22 bp, Homo sapiens
atggactatctgtctggtggcc

SEQ ID NO: 3327248 - DNA, 13 bp, Homo sapiens
atggactcttctc

SEQ ID NO: 3327249 - DNA, 18 bp, Homo sapiens
atggactcttctcggctc

SEQ ID NO: 3327250 - DNA, 21 bp, Homo sapiens
atggactcttctcggctcagg

SEQ ID NO: 3327251 - DNA, 16 bp, Homo sapiens
atggacttgtatattt

SEQ ID NO: 3327252 - DNA, 17 bp, Homo sapiens
atggacttgtatatttg

SEQ ID NO: 3327253 - DNA, 13 bp, Homo sapiens
atggagaaagaag

SEQ ID NO: 3327254 - DNA, 14 bp, Homo sapiens
atggagaaagaagt

SEQ ID NO: 3327255 - DNA, 22 bp, Homo sapiens
atggagaaagaagtggagacag

SEQ ID NO: 3327256 - DNA, 21 bp, Homo sapiens
atggagaatggtgttccattg

SEQ ID NO: 3327257 - DNA, 18 bp, Homo sapiens
atggagactgtctcaaga

SEQ ID NO: 3327258 - DNA, 14 bp, Homo sapiens
atggagagagggga

SEQ ID NO: 3327259 - DNA, 16 bp, Homo sapiens
atggagaggacagagc

SEQ ID NO: 3327260 - DNA, 16 bp, Homo sapiens
atggagaggcggcctc

SEQ ID NO: 3327261 - DNA, 11 bp, Homo sapiens
atggagccagc

SEQ ID NO: 3327262 - DNA, 23 bp, Homo sapiens
atggagccagctccctctattta

SEQ ID NO: 3327263 - DNA, 12 bp, Homo sapiens
atggagcccagg

SEQ ID NO: 3327264 - DNA, 24 bp, Homo sapiens
atggagcccccagatagagctggg

SEQ ID NO: 3327265 - DNA, 15 bp, Homo sapiens
atggagcctcttctg

SEQ ID NO: 3327266 - DNA, 20 bp, Homo sapiens
atggagcctggcacaggact

SEQ ID NO: 3327267 - DNA, 21 bp, Homo sapiens
atggagcctggcacaggactg

SEQ ID NO: 3327268 - DNA, 23 bp, Homo sapiens
atggagcctggcacaggactgat

SEQ ID NO: 3327269 - DNA, 17 bp, Homo sapiens
atggagcgcacctgccc

SEQ ID NO: 3327270 - DNA, 16 bp, Homo sapiens
atggaggaaaaccaag

SEQ ID NO: 3327271 - DNA, 18 bp, Homo sapiens
atggagggcttggcccag

SEQ ID NO: 3327272 - DNA, 17 bp, Homo sapiens
atggaggggagtgttgg

SEQ ID NO: 3327273 - DNA, 15 bp, Homo sapiens
atggaggttctaagg

SEQ ID NO: 3327274 - DNA, 16 bp, Homo sapiens
atggaggttctaaggc

SEQ ID NO: 3327275 - DNA, 15 bp, Homo sapiens
atggaggttctcaga

SEQ ID NO: 3327276 - DNA, 18 bp, Homo sapiens
atggaggttctcagagcc

SEQ ID NO: 3327277 - DNA, 16 bp, Homo sapiens
atggagtgtacaagta

SEQ ID NO: 3327278 - DNA, 21 bp, Homo sapiens
atggagtgtgtattgttccca

SEQ ID NO: 3327279 - DNA, 15 bp, Homo sapiens
atggagttcttgtgc

SEQ ID NO: 3327280 - DNA, 13 bp, Homo sapiens
atggagtttctaa

SEQ ID NO: 3327281 - DNA, 13 bp, Homo sapiens
atggataaactga

SEQ ID NO: 3327282 - DNA, 17 bp, Homo sapiens
atggatacttcctgggt

SEQ ID NO: 3327283 - DNA, 13 bp, Homo sapiens
atggatatttctc

SEQ ID NO: 3327284 - DNA, 14 bp, Homo sapiens
atggatcccgaaga

SEQ ID NO: 3327285 - DNA, 20 bp, Homo sapiens
atggatgaatctcccactcc

SEQ ID NO: 3327286 - DNA, 15 bp, Homo sapiens
atggatgattaaatt

SEQ ID NO: 3327287 - DNA, 12 bp, Homo sapiens
atggatgcattt

SEQ ID NO: 3327288 - DNA, 14 bp, Homo sapiens
atggatgcatttca

SEQ ID NO: 3327289 - DNA, 15 bp, Homo sapiens
atggatgcatttcaa

SEQ ID NO: 3327290 - DNA, 22 bp, Homo sapiens
atggatgccaatattaaatctg

SEQ ID NO: 3327291 - DNA, 16 bp, Homo sapiens
atggatgcgaggacca

SEQ ID NO: 3327292 - DNA, 21 bp, Homo sapiens
atggatggcacaatgaatgta

SEQ ID NO: 3327293 - DNA, 14 bp, Homo sapiens
atggatggcttcta

SEQ ID NO: 3327294 - DNA, 12 bp, Homo sapiens
atggatgtgctt

SEQ ID NO: 3327295 - DNA, 20 bp, Homo sapiens
atggatgtggggtccccatc

SEQ ID NO: 3327296 - DNA, 21 bp, Homo sapiens
atggattcccccccctttcct

SEQ ID NO: 3327297 - DNA, 17 bp, Homo sapiens
atggattctcagatatt

SEQ ID NO: 3327298 - DNA, 22 bp, Homo sapiens
atggattggattatttaataac

SEQ ID NO: 3327299 - DNA, 20 bp, Homo sapiens
atggatttctgtcttctcta

SEQ ID NO: 3327300 - DNA, 12 bp, Homo sapiens
atggggcctccc

SEQ ID NO: 3327301 - DNA, 18 bp, Homo sapiens
atggggcctccctccttg

SEQ ID NO: 3327302 - DNA, 19 bp, Homo sapiens
atggggctggcatgttttc

SEQ ID NO: 3327303 - DNA, 20 bp, Homo sapiens
atggggctggcatgttttct

SEQ ID NO: 3327304 - DNA, 13 bp, Homo sapiens
atgggggagaggg

SEQ ID NO: 3327305 - DNA, 14 bp, Homo sapiens
atgggggcaagaag

SEQ ID NO: 3327306 - DNA, 17 bp, Homo sapiens
atgggggtagcagctgg

SEQ ID NO: 3327307 - DNA, 17 bp, Homo sapiens
atgggggtgaccccacg

SEQ ID NO: 3327308 - DNA, 11 bp, Homo sapiens
atgggggtggc

SEQ ID NO: 3327309 - DNA, 14 bp, Homo sapiens
atggggtagaaaca

SEQ ID NO: 3327310 - DNA, 21 bp, Homo sapiens
atggggtttgggcccctcaga

SEQ ID NO: 3327311 - DNA, 12 bp, Homo sapiens
atgggtagggta

SEQ ID NO: 3327312 - DNA, 17 bp, Homo sapiens
atgggtagtacctgtac

SEQ ID NO: 3327313 - DNA, 16 bp, Homo sapiens
atgggtccaagagaca

SEQ ID NO: 3327314 - DNA, 20 bp, Homo sapiens
atgggtcccttgaaggaaga

SEQ ID NO: 3327315 - DNA, 19 bp, Homo sapiens
atgggtctgatattaatca

SEQ ID NO: 3327316 - DNA, 22 bp, Homo sapiens
atgggtgaagggagagccagct

SEQ ID NO: 3327317 - DNA, 13 bp, Homo sapiens
atgggtggaaagg

SEQ ID NO: 3327318 - DNA, 13 bp, Homo sapiens
atgggtgggggct

SEQ ID NO: 3327319 - DNA, 22 bp, Homo sapiens
atgggtgggggctcctggtggc

SEQ ID NO: 3327320 - DNA, 13 bp, Homo sapiens
atgggtgtgccct

SEQ ID NO: 3327321 - DNA, 16 bp, Homo sapiens
atgggttggtgcttct

SEQ ID NO: 3327322 - DNA, 14 bp, Homo sapiens
atggtaactgcttt

SEQ ID NO: 3327323 - DNA, 20 bp, Homo sapiens
atggtaactgctttctgttc

SEQ ID NO: 3327324 - DNA, 23 bp, Homo sapiens
atggtaactgctttctgttccaa

SEQ ID NO: 3327325 - DNA, 16 bp, Homo sapiens
atggtaagagaaaaga

SEQ ID NO: 3327326 - DNA, 13 bp, Homo sapiens
atggtaataagca

SEQ ID NO: 3327327 - DNA, 20 bp, Homo sapiens
atggtaatcagttttgtata

SEQ ID NO: 3327328 - DNA, 14 bp, Homo sapiens
atggtaattgttgc

SEQ ID NO: 3327329 - DNA, 13 bp, Homo sapiens
atggtagaccttt

SEQ ID NO: 3327330 - DNA, 18 bp, Homo sapiens
atggtaggcatttcctat

SEQ ID NO: 3327331 - DNA, 21 bp, Homo sapiens
atggtatgattctattatata

SEQ ID NO: 3327332 - DNA, 17 bp, Homo sapiens
atggtatgctggccagc

SEQ ID NO: 3327333 - DNA, 16 bp, Homo sapiens
atggtattgaaggaat

SEQ ID NO: 3327334 - DNA, 15 bp, Homo sapiens
atggtatttctttct

SEQ ID NO: 3327335 - DNA, 16 bp, Homo sapiens
atggtatttctttctc

SEQ ID NO: 3327336 - DNA, 20 bp, Homo sapiens
atggtcacacactgatgctt

SEQ ID NO: 3327337 - DNA, 23 bp, Homo sapiens
atggtcacgaggtccagacccac

SEQ ID NO: 3327338 - DNA, 14 bp, Homo sapiens
atggtcccatccag

SEQ ID NO: 3327339 - DNA, 19 bp, Homo sapiens
atggtcccatccaggcagt

SEQ ID NO: 3327340 - DNA, 23 bp, Homo sapiens
atggtcctcatggtgcatataaa

SEQ ID NO: 3327341 - DNA, 16 bp, Homo sapiens
atggtcttgagccagt

SEQ ID NO: 3327342 - DNA, 24 bp, Homo sapiens
atggtgaaaccccgtctctactaa

SEQ ID NO: 3327343 - DNA, 15 bp, Homo sapiens
atggtgaacatttta

SEQ ID NO: 3327344 - DNA, 16 bp, Homo sapiens
atggtgagctgggaag

SEQ ID NO: 3327345 - DNA, 17 bp, Homo sapiens
atggtgaggctgtcagt

SEQ ID NO: 3327346 - DNA, 19 bp, Homo sapiens
atggtgcagagaagctgga

SEQ ID NO: 3327347 - DNA, 15 bp, Homo sapiens
atggtgcattgtata

SEQ ID NO: 3327348 - DNA, 15 bp, Homo sapiens
atggtgcctgagagg

SEQ ID NO: 3327349 - DNA, 17 bp, Homo sapiens
atggtgcctgagaggca

SEQ ID NO: 3327350 - DNA, 22 bp, Homo sapiens
atggtgctcaccatgcttccag

SEQ ID NO: 3327351 - DNA, 15 bp, Homo sapiens
atggtggactaagca

SEQ ID NO: 3327352 - DNA, 17 bp, Homo sapiens
atggtggactaagcaat

SEQ ID NO: 3327353 - DNA, 18 bp, Homo sapiens
atggtggactacaaaata

SEQ ID NO: 3327354 - DNA, 17 bp, Homo sapiens
atggtggctcatgcctg

SEQ ID NO: 3327355 - DNA, 12 bp, Homo sapiens
atggtggctggg

SEQ ID NO: 3327356 - DNA, 19 bp, Homo sapiens
atggtggggatatttttaa

SEQ ID NO: 3327357 - DNA, 16 bp, Homo sapiens
atggtggttattttaa

SEQ ID NO: 3327358 - DNA, 16 bp, Homo sapiens
atggtgtaataagaca

SEQ ID NO: 3327359 - DNA, 20 bp, Homo sapiens
atggtgtaataagacataac

SEQ ID NO: 3327360 - DNA, 13 bp, Homo sapiens
atggtgtacataa

SEQ ID NO: 3327361 - DNA, 18 bp, Homo sapiens
atggtgtctcttctttag

SEQ ID NO: 3327362 - DNA, 13 bp, Homo sapiens
atggtgttccatt

SEQ ID NO: 3327363 - DNA, 14 bp, Homo sapiens
atggttaaaaaggc

SEQ ID NO: 3327364 - DNA, 18 bp, Homo sapiens
atggttaaaaaggccaaa

SEQ ID NO: 3327365 - DNA, 13 bp, Homo sapiens
atggttaaacatt

SEQ ID NO: 3327366 - DNA, 21 bp, Homo sapiens
atggttaataaaactgcacag

SEQ ID NO: 3327367 - DNA, 13 bp, Homo sapiens
atggttacactgt

SEQ ID NO: 3327368 - DNA, 20 bp, Homo sapiens
atggttcagaattaaacttt

SEQ ID NO: 3327369 - DNA, 17 bp, Homo sapiens
atggttccatgcctgag

SEQ ID NO: 3327370 - DNA, 20 bp, Homo sapiens
atggttccatgcctgagggt

SEQ ID NO: 3327371 - DNA, 19 bp, Homo sapiens
atggttccttccctgggaa

SEQ ID NO: 3327372 - DNA, 19 bp, Homo sapiens
atggttgagaaatgaataa

SEQ ID NO: 3327373 - DNA, 17 bp, Homo sapiens
atggtttccatttacta

SEQ ID NO: 3327374 - DNA, 15 bp, Homo sapiens
atggttttcaaaata

SEQ ID NO: 3327375 - DNA, 16 bp, Homo sapiens
atggttttcaaaataa

SEQ ID NO: 3327376 - DNA, 16 bp, Homo sapiens
atggttttgttttgca

SEQ ID NO: 3327377 - DNA, 18 bp, Homo sapiens
atgtaaaaaacaaaaaca

SEQ ID NO: 3327378 - DNA, 13 bp, Homo sapiens
atgtaaaaaagaa

SEQ ID NO: 3327379 - DNA, 19 bp, Homo sapiens
atgtaaaaatacactaatg

SEQ ID NO: 3327380 - DNA, 16 bp, Homo sapiens
atgtaaaactcgcttt

SEQ ID NO: 3327381 - DNA, 17 bp, Homo sapiens
atgtaaaagaaaatcca

SEQ ID NO: 3327382 - DNA, 22 bp, Homo sapiens
atgtaaaagaacttactgatta

SEQ ID NO: 3327383 - DNA, 21 bp, Homo sapiens
atgtaaaaggtattaaattga

SEQ ID NO: 3327384 - DNA, 16 bp, Homo sapiens
atgtaaaatgttgaat

SEQ ID NO: 3327385 - DNA, 20 bp, Homo sapiens
atgtaaaattgaaaatatgt

SEQ ID NO: 3327386 - DNA, 14 bp, Homo sapiens
atgtaaacaggaga

SEQ ID NO: 3327387 - DNA, 15 bp, Homo sapiens
atgtaaactttgtca

SEQ ID NO: 3327388 - DNA, 21 bp, Homo sapiens
atgtaaactttgtcatggttt

SEQ ID NO: 3327389 - DNA, 17 bp, Homo sapiens
atgtaaagaacttaaat

SEQ ID NO: 3327390 - DNA, 14 bp, Homo sapiens
atgtaaagatattt

SEQ ID NO: 3327391 - DNA, 18 bp, Homo sapiens
ttctaggggagaagagcc

SEQ ID NO: 3327392 - DNA, 13 bp, Homo sapiens
ttctaggtttcaa

SEQ ID NO: 3327393 - DNA, 21 bp, Homo sapiens
ttctaggtttcaaagatgctg

SEQ ID NO: 3327394 - DNA, 22 bp, Homo sapiens
ttctagtctcctttgcactgag

SEQ ID NO: 3327395 - DNA, 17 bp, Homo sapiens
ttctagtggtctttgta

SEQ ID NO: 3327396 - DNA, 21 bp, Homo sapiens
ttctagtggtctttgtaagag

SEQ ID NO: 3327397 - DNA, 12 bp, Homo sapiens
ttctagttcaat

SEQ ID NO: 3327398 - DNA, 13 bp, Homo sapiens
ttctagttttgtc

SEQ ID NO: 3327399 - DNA, 15 bp, Homo sapiens
ttctagtttttaatt

SEQ ID NO: 3327400 - DNA, 12 bp, Homo sapiens
ttctataaatca

SEQ ID NO: 3327401 - DNA, 13 bp, Homo sapiens
ttctataaatcag

SEQ ID NO: 3327402 - DNA, 15 bp, Homo sapiens
ttctataacagatat

SEQ ID NO: 3327403 - DNA, 21 bp, Homo sapiens
ttctataaggccataaaacag

SEQ ID NO: 3327404 - DNA, 21 bp, Homo sapiens
ttctatacacaccctgcccct

SEQ ID NO: 3327405 - DNA, 22 bp, Homo sapiens
ttctatacacaccctgcccctg

SEQ ID NO: 3327406 - DNA, 15 bp, Homo sapiens
ttctatagttctaga

SEQ ID NO: 3327407 - DNA, 19 bp, Homo sapiens
ttctatataaaatgtattc

SEQ ID NO: 3327408 - DNA, 15 bp, Homo sapiens
ttctatatttatttt

SEQ ID NO: 3327409 - DNA, 16 bp, Homo sapiens
ttctatattttaatag

SEQ ID NO: 3327410 - DNA, 17 bp, Homo sapiens
ttctatctctaagctgt

SEQ ID NO: 3327411 - DNA, 16 bp, Homo sapiens
ttctatggctttcaaa

SEQ ID NO: 3327412 - DNA, 16 bp, Homo sapiens
ttctatggttatgaaa

SEQ ID NO: 3327413 - DNA, 23 bp, Homo sapiens
ttctatggttatgaaagaatata

SEQ ID NO: 3327414 - DNA, 12 bp, Homo sapiens
ttctatgtatgt

SEQ ID NO: 3327415 - DNA, 17 bp, Homo sapiens
ttctatgtccattctca

SEQ ID NO: 3327416 - DNA, 22 bp, Homo sapiens
ttctatgtgacaattttgtaca

SEQ ID NO: 3327417 - DNA, 18 bp, Homo sapiens
ttctatgttaaatactgt

SEQ ID NO: 3327418 - DNA, 12 bp, Homo sapiens
ttctattaaagt

SEQ ID NO: 3327419 - DNA, 20 bp, Homo sapiens
ttctattacattttcagtga

SEQ ID NO: 3327420 - DNA, 18 bp, Homo sapiens
ttctattccttctggcct

SEQ ID NO: 3327421 - DNA, 18 bp, Homo sapiens
ttctattgcagttataga

SEQ ID NO: 3327422 - DNA, 17 bp, Homo sapiens
ttctattgttactctgg

SEQ ID NO: 3327423 - DNA, 15 bp, Homo sapiens
ttctatttatttact

SEQ ID NO: 3327424 - DNA, 16 bp, Homo sapiens
ttctattttactttgt

SEQ ID NO: 3327425 - DNA, 15 bp, Homo sapiens
ttctattttcacaat

SEQ ID NO: 3327426 - DNA, 16 bp, Homo sapiens
ttctatttttcaatca

SEQ ID NO: 3327427 - DNA, 17 bp, Homo sapiens
ttctatttttcaatcat

SEQ ID NO: 3327428 - DNA, 15 bp, Homo sapiens
ttctattttttgttt

SEQ ID NO: 3327429 - DNA, 23 bp, Homo sapiens
ttctattttttgttttgtttcct

SEQ ID NO: 3327430 - DNA, 15 bp, Homo sapiens
ttctcaaaagcattt

SEQ ID NO: 3327431 - DNA, 19 bp, Homo sapiens
ttctcaaagatctgaatta

SEQ ID NO: 3327432 - DNA, 18 bp, Homo sapiens
ttctcaaaggccctcagt

SEQ ID NO: 3327433 - DNA, 19 bp, Homo sapiens
ttctcaaaggccctcagtg

SEQ ID NO: 3327434 - DNA, 20 bp, Homo sapiens
ttctcaaagttaaaagtaaa

SEQ ID NO: 3327435 - DNA, 12 bp, Homo sapiens
ttctcaaagttt

SEQ ID NO: 3327436 - DNA, 23 bp, Homo sapiens
ttctcaaagttttattataaatt

SEQ ID NO: 3327437 - DNA, 15 bp, Homo sapiens
ttctcaaagttttga

SEQ ID NO: 3327438 - DNA, 17 bp, Homo sapiens
ttctcaaagttttgaaa

SEQ ID NO: 3327439 - DNA, 18 bp, Homo sapiens
ttctcaaagttttgaaaa

SEQ ID NO: 3327440 - DNA, 21 bp, Homo sapiens
ttctcaaagttttgaaaagct

SEQ ID NO: 3327441 - DNA, 22 bp, Homo sapiens
ttctcaaagttttgaaaagcta

SEQ ID NO: 3327442 - DNA, 21 bp, Homo sapiens
ttctcaacaaagcacagtgtt

SEQ ID NO: 3327443 - DNA, 23 bp, Homo sapiens
ttctcaagctggtggcctctgca

SEQ ID NO: 3327444 - DNA, 11 bp, Homo sapiens
ttctcaagtgc

SEQ ID NO: 3327445 - DNA, 16 bp, Homo sapiens
ttctcaagttctaaga

SEQ ID NO: 3327446 - DNA, 18 bp, Homo sapiens
ttctcaagttctaagatt

SEQ ID NO: 3327447 - DNA, 20 bp, Homo sapiens
ttctcaagttctaagattct

SEQ ID NO: 3327448 - DNA, 18 bp, Homo sapiens
ttctcacacccaccgtcc

SEQ ID NO: 3327449 - DNA, 22 bp, Homo sapiens
ttctcacacccaccgtccgccc

SEQ ID NO: 3327450 - DNA, 21 bp, Homo sapiens
ttctcacagcacatgctggcc

SEQ ID NO: 3327451 - DNA, 15 bp, Homo sapiens
ttctcactaatttgt

SEQ ID NO: 3327452 - DNA, 16 bp, Homo sapiens
ttctcactcctacctg

SEQ ID NO: 3327453 - DNA, 19 bp, Homo sapiens
ttctcactccttttggtgt

SEQ ID NO: 3327454 - DNA, 18 bp, Homo sapiens
ttctcacttcaattaatg

SEQ ID NO: 3327455 - DNA, 17 bp, Homo sapiens
ttctcagaacagctgaa

SEQ ID NO: 3327456 - DNA, 19 bp, Homo sapiens
ttctcagaatctcaaataa

SEQ ID NO: 3327457 - DNA, 23 bp, Homo sapiens
ttctcagaatctcaaataactaa

SEQ ID NO: 3327458 - DNA, 16 bp, Homo sapiens
ttctcagagcatgtgt

SEQ ID NO: 3327459 - DNA, 14 bp, Homo sapiens
ttctcagatttctg

SEQ ID NO: 3327460 - DNA, 17 bp, Homo sapiens
ttctcagctccccctgt

SEQ ID NO: 3327461 - DNA, 12 bp, Homo sapiens
ttctcagggctc

SEQ ID NO: 3327462 - DNA, 17 bp, Homo sapiens
ttctcagggggtcagca

SEQ ID NO: 3327463 - DNA, 22 bp, Homo sapiens
ttctcagtcagtaattgccaaa

SEQ ID NO: 3327464 - DNA, 15 bp, Homo sapiens
ttctcagttttcata

SEQ ID NO: 3327465 - DNA, 18 bp, Homo sapiens
ttctcataaatcttttta

SEQ ID NO: 3327466 - DNA, 21 bp, Homo sapiens
ttctcatagcattaactaatc

SEQ ID NO: 3327467 - DNA, 16 bp, Homo sapiens
ttctcatagccccggt

SEQ ID NO: 3327468 - DNA, 22 bp, Homo sapiens
ttctcataggaaaagtacattt

SEQ ID NO: 3327469 - DNA, 17 bp, Homo sapiens
ttctcatcttaaaaata

SEQ ID NO: 3327470 - DNA, 15 bp, Homo sapiens
ttctcatcttgtgaa

SEQ ID NO: 3327471 - DNA, 17 bp, Homo sapiens
ttctcatcttttatcta

SEQ ID NO: 3327472 - DNA, 13 bp, Homo sapiens
ttctcatgcctca

SEQ ID NO: 3327473 - DNA, 14 bp, Homo sapiens
ttctcatgcctcag

SEQ ID NO: 3327474 - DNA, 22 bp, Homo sapiens
ttctccaaataaaaattagatg

SEQ ID NO: 3327475 - DNA, 16 bp, Homo sapiens
ttctccaccctgctct

SEQ ID NO: 3327476 - DNA, 21 bp, Homo sapiens
ttctccacctagactgtaaac

SEQ ID NO: 3327477 - DNA, 12 bp, Homo sapiens
ttctccactgga

SEQ ID NO: 3327478 - DNA, 23 bp, Homo sapiens
ttctccagatttttcggaggccc

SEQ ID NO: 3327479 - DNA, 22 bp, Homo sapiens
ttctccagcctggacccccagc

SEQ ID NO: 3327480 - DNA, 14 bp, Homo sapiens
ttctccagctcaga

SEQ ID NO: 3327481 - DNA, 20 bp, Homo sapiens
ttctccagctgggctctgca

SEQ ID NO: 3327482 - DNA, 12 bp, Homo sapiens
ttctccatcttt

SEQ ID NO: 3327483 - DNA, 17 bp, Homo sapiens
ttctcccagaatcccag

SEQ ID NO: 3327484 - DNA, 12 bp, Homo sapiens
ttctcccagcac

SEQ ID NO: 3327485 - DNA, 13 bp, Homo sapiens
ttctccccacagc

SEQ ID NO: 3327486 - DNA, 14 bp, Homo sapiens
ttctccccctgggc

SEQ ID NO: 3327487 - DNA, 18 bp, Homo sapiens
ttctccctcccaccttaa

SEQ ID NO: 3327488 - DNA, 24 bp, Homo sapiens
ttctccctttctctctcctctctg

SEQ ID NO: 3327489 - DNA, 13 bp, Homo sapiens
ttctccgccagcc

SEQ ID NO: 3327490 - DNA, 18 bp, Homo sapiens
ttctccgccagcctcctc

SEQ ID NO: 3327491 - DNA, 19 bp, Homo sapiens
ttctccgccagcctcctct

SEQ ID NO: 3327492 - DNA, 20 bp, Homo sapiens
ttctccggggtctgtgctgt

SEQ ID NO: 3327493 - DNA, 17 bp, Homo sapiens
ttctccgttagctcctg

SEQ ID NO: 3327494 - DNA, 18 bp, Homo sapiens
ttctccgttagctcctgt

SEQ ID NO: 3327495 - DNA, 14 bp, Homo sapiens
ttctcctctctggg

SEQ ID NO: 3327496 - DNA, 15 bp, Homo sapiens
ttctcctctctgggc

SEQ ID NO: 3327497 - DNA, 13 bp, Homo sapiens
ttctcctgcctca

SEQ ID NO: 3327498 - DNA, 16 bp, Homo sapiens
ttctcctgtgaatgga

SEQ ID NO: 3327499 - DNA, 20 bp, Homo sapiens
ttctccttagtcttctcata

SEQ ID NO: 3327500 - DNA, 17 bp, Homo sapiens
ttctccttccccaggat

SEQ ID NO: 3327501 - DNA, 21 bp, Homo sapiens
ttctccttgttgttggttgtt

SEQ ID NO: 3327502 - DNA, 18 bp, Homo sapiens
ttctcctttcacaacctt

SEQ ID NO: 3327503 - DNA, 14 bp, Homo sapiens
ttctcctttgcaat

SEQ ID NO: 3327504 - DNA, 17 bp, Homo sapiens
ttctcgattttatcttt

SEQ ID NO: 3327505 - DNA, 17 bp, Homo sapiens
ttctctaactcctgcca

SEQ ID NO: 3327506 - DNA, 21 bp, Homo sapiens
ttctctaacttcaaggcccat

SEQ ID NO: 3327507 - DNA, 22 bp, Homo sapiens
ttctctagtgtattatcactgt

SEQ ID NO: 3327508 - DNA, 20 bp, Homo sapiens
ttctctcatctgatcacttc

SEQ ID NO: 3327509 - DNA, 24 bp, Homo sapiens
ttctctcatctgatcacttcatgt

SEQ ID NO: 3327510 - DNA, 19 bp, Homo sapiens
ttctctccagctgactaaa

SEQ ID NO: 3327511 - DNA, 10 bp, Homo sapiens
ttctctctcc

SEQ ID NO: 3327512 - DNA, 14 bp, Homo sapiens
ttctctctcctctc

SEQ ID NO: 3327513 - DNA, 15 bp, Homo sapiens
ttctctctgctgagc

SEQ ID NO: 3327514 - DNA, 16 bp, Homo sapiens
ttctctcttccctcag

SEQ ID NO: 3327515 - DNA, 18 bp, Homo sapiens
ttctctctttatacagct

SEQ ID NO: 3327516 - DNA, 14 bp, Homo sapiens
ttctctgaggacac

SEQ ID NO: 3327517 - DNA, 23 bp, Homo sapiens
ttctctgagtggtggttcctttg

SEQ ID NO: 3327518 - DNA, 14 bp, Homo sapiens
ttctctgcaatgct

SEQ ID NO: 3327519 - DNA, 16 bp, Homo sapiens
ttctctgcaatgcttc

SEQ ID NO: 3327520 - DNA, 17 bp, Homo sapiens
ttccttgtactcttagg

SEQ ID NO: 3327521 - DNA, 16 bp, Homo sapiens
ttccttgtcactggta

SEQ ID NO: 3327522 - DNA, 13 bp, Homo sapiens
ttccttgtctctg

SEQ ID NO: 3327523 - DNA, 14 bp, Homo sapiens
ttccttgtttatca

SEQ ID NO: 3327524 - DNA, 13 bp, Homo sapiens
ttcctttaaaaaa

SEQ ID NO: 3327525 - DNA, 23 bp, Homo sapiens
ttcctttaaaaaaatttaagtgc

SEQ ID NO: 3327526 - DNA, 15 bp, Homo sapiens
ttcctttaaaaaact

SEQ ID NO: 3327527 - DNA, 17 bp, Homo sapiens
ttcctttccccagccca

SEQ ID NO: 3327528 - DNA, 23 bp, Homo sapiens
ttcctttcctgtgtgtactctgt

SEQ ID NO: 3327529 - DNA, 13 bp, Homo sapiens
ttcctttctcacc

SEQ ID NO: 3327530 - DNA, 19 bp, Homo sapiens
ttcctttctccaggaccaa

SEQ ID NO: 3327531 - DNA, 17 bp, Homo sapiens
ttcctttctctttctct

SEQ ID NO: 3327532 - DNA, 22 bp, Homo sapiens
ttcctttgtaatcactcccatt

SEQ ID NO: 3327533 - DNA, 17 bp, Homo sapiens
ttcctttgtcttcaaac

SEQ ID NO: 3327534 - DNA, 13 bp, Homo sapiens
ttcctttgtgtgt

SEQ ID NO: 3327535 - DNA, 18 bp, Homo sapiens
ttcctttgtgtttctatt

SEQ ID NO: 3327536 - DNA, 21 bp, Homo sapiens
ttccttttaaaacacttccat

SEQ ID NO: 3327537 - DNA, 17 bp, Homo sapiens
ttccttttccctgcttc

SEQ ID NO: 3327538 - DNA, 21 bp, Homo sapiens
ttccttttctattccttctgg

SEQ ID NO: 3327539 - DNA, 16 bp, Homo sapiens
ttccttttggaacatt

SEQ ID NO: 3327540 - DNA, 18 bp, Homo sapiens
ttccttttggaacatttc

SEQ ID NO: 3327541 - DNA, 20 bp, Homo sapiens
ttccttttggaacatttctt

SEQ ID NO: 3327542 - DNA, 18 bp, Homo sapiens
ttcctttttatgaggcaa

SEQ ID NO: 3327543 - DNA, 23 bp, Homo sapiens
ttccttttttcaatatgcaagca

SEQ ID NO: 3327544 - DNA, 21 bp, Homo sapiens
ttcgaagaaacccttgctgct

SEQ ID NO: 3327545 - DNA, 23 bp, Homo sapiens
ttcgaatcttaatttattatttt

SEQ ID NO: 3327546 - DNA, 18 bp, Homo sapiens
ttcgaatggggtagaaac

SEQ ID NO: 3327547 - DNA, 22 bp, Homo sapiens
ttcgaattcgggtggcatcctc

SEQ ID NO: 3327548 - DNA, 22 bp, Homo sapiens
ttcgacatccgtcattgctgct

SEQ ID NO: 3327549 - DNA, 13 bp, Homo sapiens
ttcgactggtcca

SEQ ID NO: 3327550 - DNA, 21 bp, Homo sapiens
ttcgactggtccagctctgac

SEQ ID NO: 3327551 - DNA, 14 bp, Homo sapiens
ttcgagaccagcct

SEQ ID NO: 3327552 - DNA, 18 bp, Homo sapiens
ttcgagtagagaggcccg

SEQ ID NO: 3327553 - DNA, 16 bp, Homo sapiens
ttcgatgaaggctgcc

SEQ ID NO: 3327554 - DNA, 17 bp, Homo sapiens
ttcgatttctacctcag

SEQ ID NO: 3327555 - DNA, 14 bp, Homo sapiens
ttcgcacagcagtt

SEQ ID NO: 3327556 - DNA, 18 bp, Homo sapiens
ttcgcaccattctcctgc

SEQ ID NO: 3327557 - DNA, 14 bp, Homo sapiens
ttcgcctttgtctt

SEQ ID NO: 3327558 - DNA, 21 bp, Homo sapiens
ttcgcctttgtcttgtacttc

SEQ ID NO: 3327559 - DNA, 14 bp, Homo sapiens
ttcgctgctctagc

SEQ ID NO: 3327560 - DNA, 22 bp, Homo sapiens
ttcgcttcttgcctctgtgctg

SEQ ID NO: 3327561 - DNA, 17 bp, Homo sapiens
ttcgcttggctccatgc

SEQ ID NO: 3327562 - DNA, 17 bp, Homo sapiens
ttcggagcgttctctgt

SEQ ID NO: 3327563 - DNA, 18 bp, Homo sapiens
ttcggcctccatcctgag

SEQ ID NO: 3327564 - DNA, 22 bp, Homo sapiens
ttcggcctccatcctgaggctc

SEQ ID NO: 3327565 - DNA, 18 bp, Homo sapiens
ttcggctctgggtgggca

SEQ ID NO: 3327566 - DNA, 14 bp, Homo sapiens
ttcgggctgtgccc

SEQ ID NO: 3327567 - DNA, 17 bp, Homo sapiens
ttcgggtgtgcaatgtc

SEQ ID NO: 3327568 - DNA, 14 bp, Homo sapiens
ttcgtcttctaatt

SEQ ID NO: 3327569 - DNA, 16 bp, Homo sapiens
ttcgtcttctaatttc

SEQ ID NO: 3327570 - DNA, 13 bp, Homo sapiens
ttcgtgagctggg

SEQ ID NO: 3327571 - DNA, 13 bp, Homo sapiens
ttcgtgcattttt

SEQ ID NO: 3327572 - DNA, 12 bp, Homo sapiens
ttcgttccctga

SEQ ID NO: 3327573 - DNA, 17 bp, Homo sapiens
ttcgttccctgattatt

SEQ ID NO: 3327574 - DNA, 14 bp, Homo sapiens
ttctaaaaagatta

SEQ ID NO: 3327575 - DNA, 14 bp, Homo sapiens
ttctaaaagaatat

SEQ ID NO: 3327576 - DNA, 20 bp, Homo sapiens
ttctaaaatgtgatgttcta

SEQ ID NO: 3327577 - DNA, 16 bp, Homo sapiens
ttctaaaattgaagag

SEQ ID NO: 3327578 - DNA, 23 bp, Homo sapiens
ttctaaagataatattactgttt

SEQ ID NO: 3327579 - DNA, 13 bp, Homo sapiens
ttctaaagattct

SEQ ID NO: 3327580 - DNA, 16 bp, Homo sapiens
ttctaaagctctgaca

SEQ ID NO: 3327581 - DNA, 17 bp, Homo sapiens
ttctaaagctctgacat

SEQ ID NO: 3327582 - DNA, 19 bp, Homo sapiens
ttctaaagggatctgctta

SEQ ID NO: 3327583 - DNA, 16 bp, Homo sapiens
ttctaaaggtccacag

SEQ ID NO: 3327584 - DNA, 13 bp, Homo sapiens
ttctaaagtgttg

SEQ ID NO: 3327585 - DNA, 14 bp, Homo sapiens
ttctaaagttctaa

SEQ ID NO: 3327586 - DNA, 18 bp, Homo sapiens
ttctaagaagttgtttga

SEQ ID NO: 3327587 - DNA, 21 bp, Homo sapiens
ttctaagacttactctaagat

SEQ ID NO: 3327588 - DNA, 13 bp, Homo sapiens
ttctaagagaagt

SEQ ID NO: 3327589 - DNA, 18 bp, Homo sapiens
ttctaagagaagttattt

SEQ ID NO: 3327590 - DNA, 20 bp, Homo sapiens
ttctaagatgtgatattcta

SEQ ID NO: 3327591 - DNA, 15 bp, Homo sapiens
ttctaagattctaaa

SEQ ID NO: 3327592 - DNA, 17 bp, Homo sapiens
ttctaagattctaaagg

SEQ ID NO: 3327593 - DNA, 15 bp, Homo sapiens
ttctaagattctaat

SEQ ID NO: 3327594 - DNA, 13 bp, Homo sapiens
ttctaagattctg

SEQ ID NO: 3327595 - DNA, 21 bp, Homo sapiens
ttctaaggacctgaaattcca

SEQ ID NO: 3327596 - DNA, 22 bp, Homo sapiens
ttctaaggacctgaaattccaa

SEQ ID NO: 3327597 - DNA, 17 bp, Homo sapiens
ttctaaggcctaggatt

SEQ ID NO: 3327598 - DNA, 19 bp, Homo sapiens
ttctaaggcctaggattct

SEQ ID NO: 3327599 - DNA, 20 bp, Homo sapiens
ttctaaggtccggtgttcta

SEQ ID NO: 3327600 - DNA, 19 bp, Homo sapiens
ttctaagttatttactttt

SEQ ID NO: 3327601 - DNA, 12 bp, Homo sapiens
ttctaagtttct

SEQ ID NO: 3327602 - DNA, 14 bp, Homo sapiens
ttctaagtttctaa

SEQ ID NO: 3327603 - DNA, 16 bp, Homo sapiens
ttctaataaatatact

SEQ ID NO: 3327604 - DNA, 18 bp, Homo sapiens
ttctaataaatatactat

SEQ ID NO: 3327605 - DNA, 18 bp, Homo sapiens
ttctaataaattatacaa

SEQ ID NO: 3327606 - DNA, 16 bp, Homo sapiens
ttctaataatttctaa

SEQ ID NO: 3327607 - DNA, 16 bp, Homo sapiens
ttctaatactttgttt

SEQ ID NO: 3327608 - DNA, 12 bp, Homo sapiens
ttctaatagaac

SEQ ID NO: 3327609 - DNA, 18 bp, Homo sapiens
ttctaatagaactcagtt

SEQ ID NO: 3327610 - DNA, 22 bp, Homo sapiens
ttctaatatccaacacaactat

SEQ ID NO: 3327611 - DNA, 13 bp, Homo sapiens
ttctaatcaaaag

SEQ ID NO: 3327612 - DNA, 13 bp, Homo sapiens
ttctaatgatgat

SEQ ID NO: 3327613 - DNA, 16 bp, Homo sapiens
ttctaatgtcttcatt

SEQ ID NO: 3327614 - DNA, 23 bp, Homo sapiens
ttctaattgtcagtgattttgta

SEQ ID NO: 3327615 - DNA, 17 bp, Homo sapiens
ttctaattttggatgga

SEQ ID NO: 3327616 - DNA, 21 bp, Homo sapiens
ttctacaaagcactagagaat

SEQ ID NO: 3327617 - DNA, 18 bp, Homo sapiens
ttctacaatgtgaacttt

SEQ ID NO: 3327618 - DNA, 19 bp, Homo sapiens
ttctacacagtgggaactc

SEQ ID NO: 3327619 - DNA, 22 bp, Homo sapiens
ttctacacagtgggaactctga

SEQ ID NO: 3327620 - DNA, 15 bp, Homo sapiens
ttctacagtggtttt

SEQ ID NO: 3327621 - DNA, 15 bp, Homo sapiens
ttctacatagatgct

SEQ ID NO: 3327622 - DNA, 18 bp, Homo sapiens
ttctacattattgcttat

SEQ ID NO: 3327623 - DNA, 22 bp, Homo sapiens
ttctacatttcacctactttgt

SEQ ID NO: 3327624 - DNA, 17 bp, Homo sapiens
ttctacatttcttagac

SEQ ID NO: 3327625 - DNA, 17 bp, Homo sapiens
ttctaccaggcaaattc

SEQ ID NO: 3327626 - DNA, 20 bp, Homo sapiens
ttctacccagcgagccctgg

SEQ ID NO: 3327627 - DNA, 13 bp, Homo sapiens
ttctacctgccct

SEQ ID NO: 3327628 - DNA, 23 bp, Homo sapiens
ttctacctgtacacattcctgca

SEQ ID NO: 3327629 - DNA, 20 bp, Homo sapiens
ttctactaaaaatacaaaaa

SEQ ID NO: 3327630 - DNA, 15 bp, Homo sapiens
ttctactaagttatt

SEQ ID NO: 3327631 - DNA, 17 bp, Homo sapiens
ttctactctgtcttaaa

SEQ ID NO: 3327632 - DNA, 10 bp, Homo sapiens
ttctactgta

SEQ ID NO: 3327633 - DNA, 21 bp, Homo sapiens
ttctacttgcttattacattt

SEQ ID NO: 3327634 - DNA, 18 bp, Homo sapiens
ttctactttaagcactac

SEQ ID NO: 3327635 - DNA, 22 bp, Homo sapiens
ttctagaaagagaaacagttgg

SEQ ID NO: 3327636 - DNA, 17 bp, Homo sapiens
ttctagaaagcctgttc

SEQ ID NO: 3327637 - DNA, 12 bp, Homo sapiens
ttctagaaccac

SEQ ID NO: 3327638 - DNA, 13 bp, Homo sapiens
ttctagaaccact

SEQ ID NO: 3327639 - DNA, 20 bp, Homo sapiens
ttctagaacctgggctgtgc

SEQ ID NO: 3327640 - DNA, 23 bp, Homo sapiens
ttctagaacctgggctgtgctgc

SEQ ID NO: 3327641 - DNA, 17 bp, Homo sapiens
ttctagaagataacatt

SEQ ID NO: 3327642 - DNA, 23 bp, Homo sapiens
ttctagaagataacattttcaat

SEQ ID NO: 3327643 - DNA, 20 bp, Homo sapiens
ttctagaagtttcccttcct

SEQ ID NO: 3327644 - DNA, 21 bp, Homo sapiens
ttctagaagtttcccttcctc

SEQ ID NO: 3327645 - DNA, 15 bp, Homo sapiens
ttctagactttctgt

SEQ ID NO: 3327646 - DNA, 19 bp, Homo sapiens
ttctagagttcagagtcct

SEQ ID NO: 3327647 - DNA, 16 bp, Homo sapiens
ttctagctagaaatat

SEQ ID NO: 3327648 - DNA, 16 bp, Homo sapiens
ttctagggacatgaaa

SEQ ID NO: 3327649 - DNA, 24 bp, Homo sapiens
ttcctaactagaattagtatgtct

SEQ ID NO: 3327650 - DNA, 14 bp, Homo sapiens
ttcctaacttttca

SEQ ID NO: 3327651 - DNA, 13 bp, Homo sapiens
ttcctaagccact

SEQ ID NO: 3327652 - DNA, 21 bp, Homo sapiens
ttcctaagccacttgaaatgt

SEQ ID NO: 3327653 - DNA, 22 bp, Homo sapiens
ttcctaagccacttgaaatgtt

SEQ ID NO: 3327654 - DNA, 21 bp, Homo sapiens
ttcctaagtttttttcatttt

SEQ ID NO: 3327655 - DNA, 20 bp, Homo sapiens
ttcctaatcagaaattttta

SEQ ID NO: 3327656 - DNA, 23 bp, Homo sapiens
ttcctaatcagaaatttttatca

SEQ ID NO: 3327657 - DNA, 17 bp, Homo sapiens
ttcctaattaaaataag

SEQ ID NO: 3327658 - DNA, 19 bp, Homo sapiens
ttcctacaacttaatggaa

SEQ ID NO: 3327659 - DNA, 20 bp, Homo sapiens
ttcctacaacttaatggaaa

SEQ ID NO: 3327660 - DNA, 22 bp, Homo sapiens
ttcctacaagagcagcctgtgg

SEQ ID NO: 3327661 - DNA, 23 bp, Homo sapiens
ttcctacagagccaaaatgccat

SEQ ID NO: 3327662 - DNA, 19 bp, Homo sapiens
ttcctaccaagtcaaactt

SEQ ID NO: 3327663 - DNA, 18 bp, Homo sapiens
ttcctaccctccttccac

SEQ ID NO: 3327664 - DNA, 22 bp, Homo sapiens
ttcctaccctccttccacatgt

SEQ ID NO: 3327665 - DNA, 18 bp, Homo sapiens
ttcctactccctcttcca

SEQ ID NO: 3327666 - DNA, 15 bp, Homo sapiens
ttcctactgtcctca

SEQ ID NO: 3327667 - DNA, 17 bp, Homo sapiens
ttcctaggtccaagccc

SEQ ID NO: 3327668 - DNA, 17 bp, Homo sapiens
ttcctagtggatgactg

SEQ ID NO: 3327669 - DNA, 16 bp, Homo sapiens
ttcctataacttcttc

SEQ ID NO: 3327670 - DNA, 21 bp, Homo sapiens
ttcctataacttgatgcatgt

SEQ ID NO: 3327671 - DNA, 20 bp, Homo sapiens
ttcctataatataataaata

SEQ ID NO: 3327672 - DNA, 15 bp, Homo sapiens
ttcctatcatgttaa

SEQ ID NO: 3327673 - DNA, 20 bp, Homo sapiens
ttcctatgaagttggcacat

SEQ ID NO: 3327674 - DNA, 13 bp, Homo sapiens
ttcctatgcccag

SEQ ID NO: 3327675 - DNA, 18 bp, Homo sapiens
ttcctatttgccatgggc

SEQ ID NO: 3327676 - DNA, 20 bp, Homo sapiens
ttcctatttgccatgggctt

SEQ ID NO: 3327677 - DNA, 22 bp, Homo sapiens
ttcctcaacagtgttttcagaa

SEQ ID NO: 3327678 - DNA, 13 bp, Homo sapiens
ttcctcacttcca

SEQ ID NO: 3327679 - DNA, 23 bp, Homo sapiens
ttcctcagctggttactcagggt

SEQ ID NO: 3327680 - DNA, 12 bp, Homo sapiens
ttcctcagctta

SEQ ID NO: 3327681 - DNA, 19 bp, Homo sapiens
ttcctcatccaccccatcc

SEQ ID NO: 3327682 - DNA, 20 bp, Homo sapiens
ttcctcatcccctcgtcctg

SEQ ID NO: 3327683 - DNA, 15 bp, Homo sapiens
ttcctcatgtaacat

SEQ ID NO: 3327684 - DNA, 16 bp, Homo sapiens
ttcctccagctgcacc

SEQ ID NO: 3327685 - DNA, 13 bp, Homo sapiens
ttcctccatccta

SEQ ID NO: 3327686 - DNA, 14 bp, Homo sapiens
ttcctccccctgca

SEQ ID NO: 3327687 - DNA, 10 bp, Homo sapiens
ttcctccctc

SEQ ID NO: 3327688 - DNA, 12 bp, Homo sapiens
ttcctccctgtc

SEQ ID NO: 3327689 - DNA, 19 bp, Homo sapiens
ttcctccgtccacccaggc

SEQ ID NO: 3327690 - DNA, 20 bp, Homo sapiens
ttcctcctcaggcacacagc

SEQ ID NO: 3327691 - DNA, 21 bp, Homo sapiens
ttcctcctccacagtgctgct

SEQ ID NO: 3327692 - DNA, 11 bp, Homo sapiens
ttcctcctgct

SEQ ID NO: 3327693 - DNA, 23 bp, Homo sapiens
ttcctcctgctgtagtcctttct

SEQ ID NO: 3327694 - DNA, 21 bp, Homo sapiens
ttcctccttcactgtttcatc

SEQ ID NO: 3327695 - DNA, 15 bp, Homo sapiens
ttcctcgctctggga

SEQ ID NO: 3327696 - DNA, 17 bp, Homo sapiens
ttcctcgctctgggatg

SEQ ID NO: 3327697 - DNA, 17 bp, Homo sapiens
ttcctctagttctttgt

SEQ ID NO: 3327698 - DNA, 17 bp, Homo sapiens
ttcctctattgatgtac

SEQ ID NO: 3327699 - DNA, 13 bp, Homo sapiens
ttcctctcactcc

SEQ ID NO: 3327700 - DNA, 14 bp, Homo sapiens
ttcctctcactcct

SEQ ID NO: 3327701 - DNA, 18 bp, Homo sapiens
ttcctctccactgccttc

SEQ ID NO: 3327702 - DNA, 22 bp, Homo sapiens
ttcctctccttcgtatcccgag

SEQ ID NO: 3327703 - DNA, 15 bp, Homo sapiens
ttcctctctccagat

SEQ ID NO: 3327704 - DNA, 21 bp, Homo sapiens
ttcctctctttgttctcagct

SEQ ID NO: 3327705 - DNA, 22 bp, Homo sapiens
ttcctctctttgttctcagctc

SEQ ID NO: 3327706 - DNA, 11 bp, Homo sapiens
ttcctctgagc

SEQ ID NO: 3327707 - DNA, 16 bp, Homo sapiens
ttcctctgagcccagc

SEQ ID NO: 3327708 - DNA, 23 bp, Homo sapiens
ttcctctgagcccagctgcctgg

SEQ ID NO: 3327709 - DNA, 20 bp, Homo sapiens
ttcctctgcccttcctgcag

SEQ ID NO: 3327710 - DNA, 14 bp, Homo sapiens
ttcctctgctcacc

SEQ ID NO: 3327711 - DNA, 21 bp, Homo sapiens
ttcctctgtttctccttctga

SEQ ID NO: 3327712 - DNA, 19 bp, Homo sapiens
ttcctcttgcctctctcag

SEQ ID NO: 3327713 - DNA, 12 bp, Homo sapiens
ttcctgaaagaa

SEQ ID NO: 3327714 - DNA, 19 bp, Homo sapiens
ttcctgaaataaacactgg

SEQ ID NO: 3327715 - DNA, 15 bp, Homo sapiens
ttcctgaaatgcagt

SEQ ID NO: 3327716 - DNA, 20 bp, Homo sapiens
ttcctgaattctatttgctg

SEQ ID NO: 3327717 - DNA, 22 bp, Homo sapiens
ttcctgacactttaattaccaa

SEQ ID NO: 3327718 - DNA, 17 bp, Homo sapiens
ttcctgacatcacagca

SEQ ID NO: 3327719 - DNA, 19 bp, Homo sapiens
ttcctgacatcacagcagc

SEQ ID NO: 3327720 - DNA, 20 bp, Homo sapiens
ttcctgacatcacagcagcc

SEQ ID NO: 3327721 - DNA, 15 bp, Homo sapiens
ttcctgacattgtct

SEQ ID NO: 3327722 - DNA, 14 bp, Homo sapiens
ttcctgactggcaa

SEQ ID NO: 3327723 - DNA, 23 bp, Homo sapiens
ttcctgacttgagtgttcctttt

SEQ ID NO: 3327724 - DNA, 18 bp, Homo sapiens
ttcctgagatttcctcct

SEQ ID NO: 3327725 - DNA, 19 bp, Homo sapiens
ttcctgataataattgatc

SEQ ID NO: 3327726 - DNA, 18 bp, Homo sapiens
ttcctgattgtttacagt

SEQ ID NO: 3327727 - DNA, 20 bp, Homo sapiens
ttcctgcaactcaaggactt

SEQ ID NO: 3327728 - DNA, 17 bp, Homo sapiens
ttcctgcagccccagaa

SEQ ID NO: 3327729 - DNA, 20 bp, Homo sapiens
ttcctgcagccccagaagaa

SEQ ID NO: 3327730 - DNA, 16 bp, Homo sapiens
ttcctgcatttgtgaa

SEQ ID NO: 3327731 - DNA, 21 bp, Homo sapiens
ttcctgccttggcctcccaag

SEQ ID NO: 3327732 - DNA, 19 bp, Homo sapiens
ttcctgcggagtgaagagg

SEQ ID NO: 3327733 - DNA, 17 bp, Homo sapiens
ttcctggaaacagcatg

SEQ ID NO: 3327734 - DNA, 18 bp, Homo sapiens
ttcctggaaacagcatga

SEQ ID NO: 3327735 - DNA, 20 bp, Homo sapiens
ttcctggaaacagcatgaat

SEQ ID NO: 3327736 - DNA, 21 bp, Homo sapiens
ttcctggaaacagcatgaata

SEQ ID NO: 3327737 - DNA, 15 bp, Homo sapiens
ttcctggacatcacc

SEQ ID NO: 3327738 - DNA, 22 bp, Homo sapiens
ttcctggcaatagtgtgttctg

SEQ ID NO: 3327739 - DNA, 17 bp, Homo sapiens
ttcctggcccactctgt

SEQ ID NO: 3327740 - DNA, 16 bp, Homo sapiens
ttcctggccctccact

SEQ ID NO: 3327741 - DNA, 20 bp, Homo sapiens
ttcctggcctcactggctgg

SEQ ID NO: 3327742 - DNA, 22 bp, Homo sapiens
ttcctggcctcactggctgggg

SEQ ID NO: 3327743 - DNA, 16 bp, Homo sapiens
ttcctgggcctgtccc

SEQ ID NO: 3327744 - DNA, 17 bp, Homo sapiens
ttcctgggtttcctgca

SEQ ID NO: 3327745 - DNA, 20 bp, Homo sapiens
ttcctggtgccaatttcaag

SEQ ID NO: 3327746 - DNA, 15 bp, Homo sapiens
ttcctgtaactttta

SEQ ID NO: 3327747 - DNA, 16 bp, Homo sapiens
ttcctgtatgttgtcc

SEQ ID NO: 3327748 - DNA, 20 bp, Homo sapiens
ttcctgtcagtgtttttgaa

SEQ ID NO: 3327749 - DNA, 21 bp, Homo sapiens
ttcctgtcagtgtttttgaaa

SEQ ID NO: 3327750 - DNA, 16 bp, Homo sapiens
ttcctgtcttccaaat

SEQ ID NO: 3327751 - DNA, 22 bp, Homo sapiens
ttcctgtgatccacccaaccct

SEQ ID NO: 3327752 - DNA, 14 bp, Homo sapiens
ttcctgtggccagg

SEQ ID NO: 3327753 - DNA, 19 bp, Homo sapiens
ttcctgtggccaggaggtt

SEQ ID NO: 3327754 - DNA, 11 bp, Homo sapiens
ttcctgtgtct

SEQ ID NO: 3327755 - DNA, 21 bp, Homo sapiens
ttcctgtgtgtactctgtcca

SEQ ID NO: 3327756 - DNA, 22 bp, Homo sapiens
ttcctgtgtgtccaaaactgcc

SEQ ID NO: 3327757 - DNA, 14 bp, Homo sapiens
ttcctgttcagcat

SEQ ID NO: 3327758 - DNA, 19 bp, Homo sapiens
ttcctgtttttcacatttt

SEQ ID NO: 3327759 - DNA, 23 bp, Homo sapiens
ttcctgtttttcacattttcctt

SEQ ID NO: 3327760 - DNA, 13 bp, Homo sapiens
ttccttaaactgt

SEQ ID NO: 3327761 - DNA, 14 bp, Homo sapiens
ttccttaataaatt

SEQ ID NO: 3327762 - DNA, 22 bp, Homo sapiens
ttccttagactcttttccttcc

SEQ ID NO: 3327763 - DNA, 15 bp, Homo sapiens
ttccttcattcatag

SEQ ID NO: 3327764 - DNA, 16 bp, Homo sapiens
ttccttcattcatagg

SEQ ID NO: 3327765 - DNA, 19 bp, Homo sapiens
ttccttccacagttatctt

SEQ ID NO: 3327766 - DNA, 20 bp, Homo sapiens
ttccttccatccctaccccc

SEQ ID NO: 3327767 - DNA, 22 bp, Homo sapiens
ttccttcccgccagagggcttg

SEQ ID NO: 3327768 - DNA, 17 bp, Homo sapiens
ttccttcctaaaataat

SEQ ID NO: 3327769 - DNA, 19 bp, Homo sapiens
ttccttcggtcttttgtat

SEQ ID NO: 3327770 - DNA, 14 bp, Homo sapiens
ttccttctttgata

SEQ ID NO: 3327771 - DNA, 22 bp, Homo sapiens
ttccttgagacacggagcccag

SEQ ID NO: 3327772 - DNA, 16 bp, Homo sapiens
ttccttgatcattttg

SEQ ID NO: 3327773 - DNA, 15 bp, Homo sapiens
ttccttgccccacag

SEQ ID NO: 3327774 - DNA, 16 bp, Homo sapiens
ttccttgccccacagt

SEQ ID NO: 3327775 - DNA, 15 bp, Homo sapiens
ttccttgctcaacca

SEQ ID NO: 3327776 - DNA, 14 bp, Homo sapiens
ttccttgctctccc

SEQ ID NO: 3327777 - DNA, 18 bp, Homo sapiens
ttccatgattctatttat

SEQ ID NO: 3327778 - DNA, 15 bp, Homo sapiens
ttccatgcagccttg

SEQ ID NO: 3327779 - DNA, 16 bp, Homo sapiens
ttccatgcctgagggt

SEQ ID NO: 3327780 - DNA, 22 bp, Homo sapiens
ttccatgcctgagggtggagac

SEQ ID NO: 3327781 - DNA, 14 bp, Homo sapiens
ttccattaacaaat

SEQ ID NO: 3327782 - DNA, 15 bp, Homo sapiens
ttccattatgattct

SEQ ID NO: 3327783 - DNA, 16 bp, Homo sapiens
ttccattccagaatat

SEQ ID NO: 3327784 - DNA, 23 bp, Homo sapiens
ttccattgccgccgcgggtgtgc

SEQ ID NO: 3327785 - DNA, 13 bp, Homo sapiens
ttccattgcttat

SEQ ID NO: 3327786 - DNA, 12 bp, Homo sapiens
ttccatttacta

SEQ ID NO: 3327787 - DNA, 18 bp, Homo sapiens
ttccattttaattttaaa

SEQ ID NO: 3327788 - DNA, 14 bp, Homo sapiens
ttccattttccccc

SEQ ID NO: 3327789 - DNA, 17 bp, Homo sapiens
ttccatttttcctctgt

SEQ ID NO: 3327790 - DNA, 21 bp, Homo sapiens
ttccatttttcctctgttcac

SEQ ID NO: 3327791 - DNA, 22 bp, Homo sapiens
ttccatttttcctctgttcaca

SEQ ID NO: 3327792 - DNA, 23 bp, Homo sapiens
ttccatttttcctctgttcacaa

SEQ ID NO: 3327793 - DNA, 14 bp, Homo sapiens
ttcccaagaaatgc

SEQ ID NO: 3327794 - DNA, 15 bp, Homo sapiens
ttcccaatcagcact

SEQ ID NO: 3327795 - DNA, 20 bp, Homo sapiens
ttcccaatcagcactgaaaa

SEQ ID NO: 3327796 - DNA, 17 bp, Homo sapiens
ttcccacacctccacag

SEQ ID NO: 3327797 - DNA, 21 bp, Homo sapiens
ttcccacacctccacagttca

SEQ ID NO: 3327798 - DNA, 19 bp, Homo sapiens
ttcccacacgattagcttt

SEQ ID NO: 3327799 - DNA, 13 bp, Homo sapiens
ttcccacatcttt

SEQ ID NO: 3327800 - DNA, 22 bp, Homo sapiens
ttcccacatctttcctcaagta

SEQ ID NO: 3327801 - DNA, 16 bp, Homo sapiens
ttcccacctccctgcc

SEQ ID NO: 3327802 - DNA, 23 bp, Homo sapiens
ttcccagagcaaaataattttaa

SEQ ID NO: 3327803 - DNA, 14 bp, Homo sapiens
ttcccagagggagc

SEQ ID NO: 3327804 - DNA, 16 bp, Homo sapiens
ttcccagccatgccca

SEQ ID NO: 3327805 - DNA, 18 bp, Homo sapiens
ttcccagcttctgccaca

SEQ ID NO: 3327806 - DNA, 14 bp, Homo sapiens
ttcccaggctgccc

SEQ ID NO: 3327807 - DNA, 20 bp, Homo sapiens
ttcccagtcttctgacaaac

SEQ ID NO: 3327808 - DNA, 15 bp, Homo sapiens
ttcccataattttct

SEQ ID NO: 3327809 - DNA, 14 bp, Homo sapiens
ttcccatcctaccc

SEQ ID NO: 3327810 - DNA, 12 bp, Homo sapiens
ttcccatctgca

SEQ ID NO: 3327811 - DNA, 14 bp, Homo sapiens
ttcccatctgcacc

SEQ ID NO: 3327812 - DNA, 16 bp, Homo sapiens
ttcccatctttactcc

SEQ ID NO: 3327813 - DNA, 15 bp, Homo sapiens
ttcccatgactgcac

SEQ ID NO: 3327814 - DNA, 19 bp, Homo sapiens
ttcccatgcctgtctctgt

SEQ ID NO: 3327815 - DNA, 15 bp, Homo sapiens
ttcccatggggaggg

SEQ ID NO: 3327816 - DNA, 23 bp, Homo sapiens
ttcccatggggagggattctggt

SEQ ID NO: 3327817 - DNA, 17 bp, Homo sapiens
ttcccatgtagccccct

SEQ ID NO: 3327818 - DNA, 20 bp, Homo sapiens
ttcccatttgtgccagagga

SEQ ID NO: 3327819 - DNA, 17 bp, Homo sapiens
ttcccattttgcaaaat

SEQ ID NO: 3327820 - DNA, 14 bp, Homo sapiens
ttccccaaatacaa

SEQ ID NO: 3327821 - DNA, 23 bp, Homo sapiens
ttccccaattacagggtgactca

SEQ ID NO: 3327822 - DNA, 13 bp, Homo sapiens
ttccccaccgcag

SEQ ID NO: 3327823 - DNA, 19 bp, Homo sapiens
ttccccaccgcagtcacca

SEQ ID NO: 3327824 - DNA, 14 bp, Homo sapiens
ttccccagcccagg

SEQ ID NO: 3327825 - DNA, 11 bp, Homo sapiens
ttccccaggat

SEQ ID NO: 3327826 - DNA, 15 bp, Homo sapiens
ttccccaggcccacc

SEQ ID NO: 3327827 - DNA, 18 bp, Homo sapiens
ttccccaggggaaaatga

SEQ ID NO: 3327828 - DNA, 23 bp, Homo sapiens
ttccccataactcaatggcctaa

SEQ ID NO: 3327829 - DNA, 15 bp, Homo sapiens
ttccccatctgggtc

SEQ ID NO: 3327830 - DNA, 18 bp, Homo sapiens
ttcccccaccagctaagg

SEQ ID NO: 3327831 - DNA, 18 bp, Homo sapiens
ttcccccaccggtccagc

SEQ ID NO: 3327832 - DNA, 18 bp, Homo sapiens
ttcccccactactgcagc

SEQ ID NO: 3327833 - DNA, 13 bp, Homo sapiens
ttcccccagccca

SEQ ID NO: 3327834 - DNA, 16 bp, Homo sapiens
ttcccccaggcgcctg

SEQ ID NO: 3327835 - DNA, 14 bp, Homo sapiens
ttcccccatagcca

SEQ ID NO: 3327836 - DNA, 15 bp, Homo sapiens
ttcccccatagccac

SEQ ID NO: 3327837 - DNA, 21 bp, Homo sapiens
ttccccccactctccccacac

SEQ ID NO: 3327838 - DNA, 15 bp, Homo sapiens
ttccccctcccaggg

SEQ ID NO: 3327839 - DNA, 21 bp, Homo sapiens
ttccccctcttcttctgaaga

SEQ ID NO: 3327840 - DNA, 21 bp, Homo sapiens
ttccccgatgtcccctgcggg

SEQ ID NO: 3327841 - DNA, 16 bp, Homo sapiens
ttccccgggggaggaa

SEQ ID NO: 3327842 - DNA, 13 bp, Homo sapiens
ttcccctacagaa

SEQ ID NO: 3327843 - DNA, 15 bp, Homo sapiens
ttcccctcccacctc

SEQ ID NO: 3327844 - DNA, 12 bp, Homo sapiens
ttcccctcccct

SEQ ID NO: 3327845 - DNA, 17 bp, Homo sapiens
ttcccctccttctccct

SEQ ID NO: 3327846 - DNA, 13 bp, Homo sapiens
ttcccctctctgc

SEQ ID NO: 3327847 - DNA, 13 bp, Homo sapiens
ttcccctgtcctg

SEQ ID NO: 3327848 - DNA, 18 bp, Homo sapiens
ttcccctgtcctgtgaat

SEQ ID NO: 3327849 - DNA, 22 bp, Homo sapiens
ttcccctgtcttcacctgccac

SEQ ID NO: 3327850 - DNA, 14 bp, Homo sapiens
ttcccgctcagccc

SEQ ID NO: 3327851 - DNA, 21 bp, Homo sapiens
ttcccgctcagccctccctgc

SEQ ID NO: 3327852 - DNA, 22 bp, Homo sapiens
ttcccgctcagccctccctgcc

SEQ ID NO: 3327853 - DNA, 17 bp, Homo sapiens
ttcccggagcacagccc

SEQ ID NO: 3327854 - DNA, 19 bp, Homo sapiens
ttcccggagcacagccctg

SEQ ID NO: 3327855 - DNA, 14 bp, Homo sapiens
ttcccggtcccgag

SEQ ID NO: 3327856 - DNA, 15 bp, Homo sapiens
ttcccggtcccgagt

SEQ ID NO: 3327857 - DNA, 13 bp, Homo sapiens
ttcccgtctcaga

SEQ ID NO: 3327858 - DNA, 15 bp, Homo sapiens
ttccctacctcaggc

SEQ ID NO: 3327859 - DNA, 16 bp, Homo sapiens
ttccctacttcctgtg

SEQ ID NO: 3327860 - DNA, 19 bp, Homo sapiens
ttccctacttgataatatt

SEQ ID NO: 3327861 - DNA, 11 bp, Homo sapiens
ttccctcaggc

SEQ ID NO: 3327862 - DNA, 13 bp, Homo sapiens
ttccctcctgaca

SEQ ID NO: 3327863 - DNA, 14 bp, Homo sapiens
ttccctctccctgt

SEQ ID NO: 3327864 - DNA, 12 bp, Homo sapiens
ttccctctctag

SEQ ID NO: 3327865 - DNA, 14 bp, Homo sapiens
ttccctcttcccag

SEQ ID NO: 3327866 - DNA, 21 bp, Homo sapiens
ttccctcttgtccctttccct

SEQ ID NO: 3327867 - DNA, 14 bp, Homo sapiens
ttccctctttggct

SEQ ID NO: 3327868 - DNA, 16 bp, Homo sapiens
ttccctgattatttat

SEQ ID NO: 3327869 - DNA, 19 bp, Homo sapiens
ttccctgattgacctgctc

SEQ ID NO: 3327870 - DNA, 15 bp, Homo sapiens
ttccctgcaccctgg

SEQ ID NO: 3327871 - DNA, 19 bp, Homo sapiens
ttccctgcatttctgagtt

SEQ ID NO: 3327872 - DNA, 12 bp, Homo sapiens
ttccctgcctgg

SEQ ID NO: 3327873 - DNA, 11 bp, Homo sapiens
ttccctgctga

SEQ ID NO: 3327874 - DNA, 13 bp, Homo sapiens
ttccctgcttcca

SEQ ID NO: 3327875 - DNA, 15 bp, Homo sapiens
ttccctggagaaaaa

SEQ ID NO: 3327876 - DNA, 15 bp, Homo sapiens
ttcccttaaatacag

SEQ ID NO: 3327877 - DNA, 13 bp, Homo sapiens
ttcccttaacttt

SEQ ID NO: 3327878 - DNA, 22 bp, Homo sapiens
ttcccttaaggggtatcatgta

SEQ ID NO: 3327879 - DNA, 19 bp, Homo sapiens
ttcccttcagtaccctctc

SEQ ID NO: 3327880 - DNA, 15 bp, Homo sapiens
ttcccttcccttcca

SEQ ID NO: 3327881 - DNA, 17 bp, Homo sapiens
ttcccttcctccatcct

SEQ ID NO: 3327882 - DNA, 20 bp, Homo sapiens
ttcccttgcaggggtccccc

SEQ ID NO: 3327883 - DNA, 12 bp, Homo sapiens
ttcccttggcct

SEQ ID NO: 3327884 - DNA, 23 bp, Homo sapiens
ttcccttgtgtcaagacatttct

SEQ ID NO: 3327885 - DNA, 21 bp, Homo sapiens
ttccctttagcacgtttaaag

SEQ ID NO: 3327886 - DNA, 23 bp, Homo sapiens
ttccctttagcacgtttaaagtt

SEQ ID NO: 3327887 - DNA, 17 bp, Homo sapiens
ttccctttatttcacat

SEQ ID NO: 3327888 - DNA, 15 bp, Homo sapiens
ttccctttccttcca

SEQ ID NO: 3327889 - DNA, 17 bp, Homo sapiens
ttccctttggagatgct

SEQ ID NO: 3327890 - DNA, 19 bp, Homo sapiens
ttcccttttaatcaactgt

SEQ ID NO: 3327891 - DNA, 16 bp, Homo sapiens
ttccgaagatgctgta

SEQ ID NO: 3327892 - DNA, 16 bp, Homo sapiens
ttccgaccctctggga

SEQ ID NO: 3327893 - DNA, 16 bp, Homo sapiens
ttccgccactcagcca

SEQ ID NO: 3327894 - DNA, 14 bp, Homo sapiens
ttccgccccttccc

SEQ ID NO: 3327895 - DNA, 15 bp, Homo sapiens
ttccgccccttccct

SEQ ID NO: 3327896 - DNA, 16 bp, Homo sapiens
ttccggcacactgcca

SEQ ID NO: 3327897 - DNA, 21 bp, Homo sapiens
ttccggtagggaggcagcctc

SEQ ID NO: 3327898 - DNA, 21 bp, Homo sapiens
ttccgtaataacacccttcct

SEQ ID NO: 3327899 - DNA, 20 bp, Homo sapiens
ttccgtaggtagatgtgtaa

SEQ ID NO: 3327900 - DNA, 21 bp, Homo sapiens
ttccgtcaccacgactggcca

SEQ ID NO: 3327901 - DNA, 19 bp, Homo sapiens
ttccgtggtcagagtgcca

SEQ ID NO: 3327902 - DNA, 16 bp, Homo sapiens
ttccgttctgttctgc

SEQ ID NO: 3327903 - DNA, 15 bp, Homo sapiens
ttcctaaacataatt

SEQ ID NO: 3327904 - DNA, 18 bp, Homo sapiens
ttcctaaacataattgtg

SEQ ID NO: 3327905 - DNA, 14 bp, Homo sapiens
ttcctaaatgcagt

SEQ ID NO: 3327906 - DNA, 15 bp, Homo sapiens
ttcctaactagaatt

SEQ ID NO: 3327907 - DNA, 21 bp, Homo sapiens
ttcctaactagaattagtatg

SEQ ID NO: 3327908 - DNA, 15 bp, Homo sapiens
ttcattcccccttcc

SEQ ID NO: 3327909 - DNA, 21 bp, Homo sapiens
ttcattcccccttcctagtga

SEQ ID NO: 3327910 - DNA, 18 bp, Homo sapiens
ttcattcctaacacagca

SEQ ID NO: 3327911 - DNA, 18 bp, Homo sapiens
ttcattctccctttcact

SEQ ID NO: 3327912 - DNA, 15 bp, Homo sapiens
ttcattctgcagggt

SEQ ID NO: 3327913 - DNA, 19 bp, Homo sapiens
ttcattctgctacttcact

SEQ ID NO: 3327914 - DNA, 18 bp, Homo sapiens
ttcattcttctctagctg

SEQ ID NO: 3327915 - DNA, 13 bp, Homo sapiens
ttcattcttgaaa

SEQ ID NO: 3327916 - DNA, 20 bp, Homo sapiens
ttcattgatggatgtcttct

SEQ ID NO: 3327917 - DNA, 16 bp, Homo sapiens
ttcattgcaattaaac

SEQ ID NO: 3327918 - DNA, 19 bp, Homo sapiens
ttcattgccagtgtctttc

SEQ ID NO: 3327919 - DNA, 21 bp, Homo sapiens
ttcattggatttttgttaatt

SEQ ID NO: 3327920 - DNA, 15 bp, Homo sapiens
ttcattgtccctctt

SEQ ID NO: 3327921 - DNA, 12 bp, Homo sapiens
ttcattgtctct

SEQ ID NO: 3327922 - DNA, 17 bp, Homo sapiens
ttcatttaaaatgatta

SEQ ID NO: 3327923 - DNA, 20 bp, Homo sapiens
ttcatttagataatttgaaa

SEQ ID NO: 3327924 - DNA, 19 bp, Homo sapiens
ttcatttagtcatgtgacc

SEQ ID NO: 3327925 - DNA, 15 bp, Homo sapiens
ttcatttcaactgtt

SEQ ID NO: 3327926 - DNA, 16 bp, Homo sapiens
ttcatttcaatcattg

SEQ ID NO: 3327927 - DNA, 21 bp, Homo sapiens
ttcatttcacacagtgaaacg

SEQ ID NO: 3327928 - DNA, 12 bp, Homo sapiens
ttcatttcattg

SEQ ID NO: 3327929 - DNA, 18 bp, Homo sapiens
ttcatttgagaagtaaac

SEQ ID NO: 3327930 - DNA, 16 bp, Homo sapiens
ttcatttgatgctaaa

SEQ ID NO: 3327931 - DNA, 12 bp, Homo sapiens
ttcatttgtaca

SEQ ID NO: 3327932 - DNA, 11 bp, Homo sapiens
ttcatttgtat

SEQ ID NO: 3327933 - DNA, 18 bp, Homo sapiens
ttcatttgtatgtcaaag

SEQ ID NO: 3327934 - DNA, 18 bp, Homo sapiens
ttcattttatatttaaaa

SEQ ID NO: 3327935 - DNA, 23 bp, Homo sapiens
ttcattttctgacatgcattgtt

SEQ ID NO: 3327936 - DNA, 11 bp, Homo sapiens
ttcatttttgg

SEQ ID NO: 3327937 - DNA, 19 bp, Homo sapiens
ttcatttttttttcaatca

SEQ ID NO: 3327938 - DNA, 18 bp, Homo sapiens
ttccaaaaaggttgctgt

SEQ ID NO: 3327939 - DNA, 14 bp, Homo sapiens
ttccaaagaaagtt

SEQ ID NO: 3327940 - DNA, 16 bp, Homo sapiens
ttccaaagaattctta

SEQ ID NO: 3327941 - DNA, 22 bp, Homo sapiens
ttccaaagagtagaattgcatt

SEQ ID NO: 3327942 - DNA, 20 bp, Homo sapiens
ttccaaagcacattgaaaga

SEQ ID NO: 3327943 - DNA, 16 bp, Homo sapiens
ttccaaagccagtgaa

SEQ ID NO: 3327944 - DNA, 21 bp, Homo sapiens
ttccaaagccagtgaaatgtg

SEQ ID NO: 3327945 - DNA, 14 bp, Homo sapiens
ttccaaagttaaca

SEQ ID NO: 3327946 - DNA, 15 bp, Homo sapiens
ttccaaataaaatga

SEQ ID NO: 3327947 - DNA, 16 bp, Homo sapiens
ttccaaatgtgtataa

SEQ ID NO: 3327948 - DNA, 18 bp, Homo sapiens
ttccaaattatttcttaa

SEQ ID NO: 3327949 - DNA, 19 bp, Homo sapiens
ttccaaattatttcttaat

SEQ ID NO: 3327950 - DNA, 19 bp, Homo sapiens
ttccaaattcagtttcata

SEQ ID NO: 3327951 - DNA, 20 bp, Homo sapiens
ttccaaattcagtttcataa

SEQ ID NO: 3327952 - DNA, 13 bp, Homo sapiens
ttccaaattcatg

SEQ ID NO: 3327953 - DNA, 17 bp, Homo sapiens
ttccaacaccacagaca

SEQ ID NO: 3327954 - DNA, 21 bp, Homo sapiens
ttccaacaccacagacacaca

SEQ ID NO: 3327955 - DNA, 16 bp, Homo sapiens
ttccaaccaggcagta

SEQ ID NO: 3327956 - DNA, 13 bp, Homo sapiens
ttccaagaaagat

SEQ ID NO: 3327957 - DNA, 16 bp, Homo sapiens
ttccaagacatgtctg

SEQ ID NO: 3327958 - DNA, 21 bp, Homo sapiens
ttccaagacatgtctgttcta

SEQ ID NO: 3327959 - DNA, 22 bp, Homo sapiens
ttccaagactctagagtccaag

SEQ ID NO: 3327960 - DNA, 13 bp, Homo sapiens
ttccaagagtcta

SEQ ID NO: 3327961 - DNA, 15 bp, Homo sapiens
ttccaagagtctaaa

SEQ ID NO: 3327962 - DNA, 14 bp, Homo sapiens
ttccaagctgcggg

SEQ ID NO: 3327963 - DNA, 13 bp, Homo sapiens
ttccaataaacca

SEQ ID NO: 3327964 - DNA, 13 bp, Homo sapiens
ttccaatatttct

SEQ ID NO: 3327965 - DNA, 15 bp, Homo sapiens
ttccaatatttctgc

SEQ ID NO: 3327966 - DNA, 12 bp, Homo sapiens
ttccaatgaaat

SEQ ID NO: 3327967 - DNA, 16 bp, Homo sapiens
ttccaatgaaatatgt

SEQ ID NO: 3327968 - DNA, 20 bp, Homo sapiens
ttccacacaattatttattt

SEQ ID NO: 3327969 - DNA, 15 bp, Homo sapiens
ttccacaccttttat

SEQ ID NO: 3327970 - DNA, 12 bp, Homo sapiens
ttccacagattg

SEQ ID NO: 3327971 - DNA, 16 bp, Homo sapiens
ttccacagcagcagaa

SEQ ID NO: 3327972 - DNA, 21 bp, Homo sapiens
ttccacagcctgcaagtcagt

SEQ ID NO: 3327973 - DNA, 16 bp, Homo sapiens
ttccacagttatctta

SEQ ID NO: 3327974 - DNA, 18 bp, Homo sapiens
ttccacagttgccaccac

SEQ ID NO: 3327975 - DNA, 16 bp, Homo sapiens
ttccacatgctctgag

SEQ ID NO: 3327976 - DNA, 15 bp, Homo sapiens
ttccaccacagccag

SEQ ID NO: 3327977 - DNA, 22 bp, Homo sapiens
ttccaccacagccagcacctgg

SEQ ID NO: 3327978 - DNA, 14 bp, Homo sapiens
ttccacccattccc

SEQ ID NO: 3327979 - DNA, 14 bp, Homo sapiens
ttccacctccacca

SEQ ID NO: 3327980 - DNA, 23 bp, Homo sapiens
ttccacctccaccacatctgcca

SEQ ID NO: 3327981 - DNA, 15 bp, Homo sapiens
ttccacctccctccc

SEQ ID NO: 3327982 - DNA, 18 bp, Homo sapiens
ttccacctgtgccctcac

SEQ ID NO: 3327983 - DNA, 19 bp, Homo sapiens
ttccacctgtgccctcacc

SEQ ID NO: 3327984 - DNA, 14 bp, Homo sapiens
ttccacgatgaaaa

SEQ ID NO: 3327985 - DNA, 19 bp, Homo sapiens
ttccacgatgaaaaacttc

SEQ ID NO: 3327986 - DNA, 19 bp, Homo sapiens
ttccacgtccccctggggc

SEQ ID NO: 3327987 - DNA, 14 bp, Homo sapiens
ttccactaaaaata

SEQ ID NO: 3327988 - DNA, 16 bp, Homo sapiens
ttccactccattgtcg

SEQ ID NO: 3327989 - DNA, 13 bp, Homo sapiens
ttccactgcctct

SEQ ID NO: 3327990 - DNA, 17 bp, Homo sapiens
ttccactgcctctgcct

SEQ ID NO: 3327991 - DNA, 22 bp, Homo sapiens
ttccactggacttgagcttggc

SEQ ID NO: 3327992 - DNA, 20 bp, Homo sapiens
ttccactgtcaagaaagagc

SEQ ID NO: 3327993 - DNA, 20 bp, Homo sapiens
ttccacttctaactccactg

SEQ ID NO: 3327994 - DNA, 15 bp, Homo sapiens
ttccacttcttcctt

SEQ ID NO: 3327995 - DNA, 20 bp, Homo sapiens
ttccacttcttcctttctct

SEQ ID NO: 3327996 - DNA, 23 bp, Homo sapiens
ttccactttgttctttaggagat

SEQ ID NO: 3327997 - DNA, 21 bp, Homo sapiens
ttccagaaccacacttgaaac

SEQ ID NO: 3327998 - DNA, 19 bp, Homo sapiens
ttccagaatatctgggatt

SEQ ID NO: 3327999 - DNA, 14 bp, Homo sapiens
ttccagaatgctgt

SEQ ID NO: 3328000 - DNA, 15 bp, Homo sapiens
ttccagaatgctgta

SEQ ID NO: 3328001 - DNA, 16 bp, Homo sapiens
ttccagaatgctgtac

SEQ ID NO: 3328002 - DNA, 15 bp, Homo sapiens
ttccagacctgcttc

SEQ ID NO: 3328003 - DNA, 23 bp, Homo sapiens
ttccagactgcttccaattttct

SEQ ID NO: 3328004 - DNA, 20 bp, Homo sapiens
ttccagacttccttgagaca

SEQ ID NO: 3328005 - DNA, 20 bp, Homo sapiens
ttccagatctttcagaaata

SEQ ID NO: 3328006 - DNA, 14 bp, Homo sapiens
ttccagattcctat

SEQ ID NO: 3328007 - DNA, 14 bp, Homo sapiens
ttccagcaattctc

SEQ ID NO: 3328008 - DNA, 16 bp, Homo sapiens
ttccagcagaagacaa

SEQ ID NO: 3328009 - DNA, 16 bp, Homo sapiens
ttccagcccctctggt

SEQ ID NO: 3328010 - DNA, 12 bp, Homo sapiens
ttccagcttcag

SEQ ID NO: 3328011 - DNA, 18 bp, Homo sapiens
ttccagcttcaggcacca

SEQ ID NO: 3328012 - DNA, 21 bp, Homo sapiens
ttccaggcccctgaggactgg

SEQ ID NO: 3328013 - DNA, 11 bp, Homo sapiens
ttccaggctct

SEQ ID NO: 3328014 - DNA, 23 bp, Homo sapiens
ttccaggcttccctgacttgctt

SEQ ID NO: 3328015 - DNA, 17 bp, Homo sapiens
ttccaggggaacctgcc

SEQ ID NO: 3328016 - DNA, 19 bp, Homo sapiens
ttccagtacctttgtcaca

SEQ ID NO: 3328017 - DNA, 19 bp, Homo sapiens
ttccagtattgaaaacttc

SEQ ID NO: 3328018 - DNA, 21 bp, Homo sapiens
ttccagtattgaaaacttcaa

SEQ ID NO: 3328019 - DNA, 19 bp, Homo sapiens
ttccagtctcaaaaataca

SEQ ID NO: 3328020 - DNA, 23 bp, Homo sapiens
ttccataatctggactcctctgt

SEQ ID NO: 3328021 - DNA, 19 bp, Homo sapiens
ttccataatgtataaagaa

SEQ ID NO: 3328022 - DNA, 13 bp, Homo sapiens
ttccataattatg

SEQ ID NO: 3328023 - DNA, 13 bp, Homo sapiens
ttccatagcaaca

SEQ ID NO: 3328024 - DNA, 21 bp, Homo sapiens
ttccatatcttgcgaatccaa

SEQ ID NO: 3328025 - DNA, 15 bp, Homo sapiens
ttccatatggatttt

SEQ ID NO: 3328026 - DNA, 20 bp, Homo sapiens
ttccatatggattttctatt

SEQ ID NO: 3328027 - DNA, 14 bp, Homo sapiens
ttccatattcatgt

SEQ ID NO: 3328028 - DNA, 15 bp, Homo sapiens
ttccatattcatgta

SEQ ID NO: 3328029 - DNA, 14 bp, Homo sapiens
ttccatcaataaat

SEQ ID NO: 3328030 - DNA, 15 bp, Homo sapiens
ttccatcaataaatg

SEQ ID NO: 3328031 - DNA, 20 bp, Homo sapiens
ttccatcataattctaatct

SEQ ID NO: 3328032 - DNA, 14 bp, Homo sapiens
ttccatcatttctg

SEQ ID NO: 3328033 - DNA, 19 bp, Homo sapiens
ttccatcattttacagtga

SEQ ID NO: 3328034 - DNA, 19 bp, Homo sapiens
ttccatccacctttcccaa

SEQ ID NO: 3328035 - DNA, 23 bp, Homo sapiens
ttccatccataaatccagttcta

SEQ ID NO: 3328036 - DNA, 20 bp, Homo sapiens
ttccatcccaaccagtgcca

SEQ ID NO: 3328037 - DNA, 16 bp, Homo sapiens
ttccatgaaggcagag

SEQ ID NO: 3328038 - DNA, 22 bp, Homo sapiens
ttatttcactatcttcttcaaa

SEQ ID NO: 3328039 - DNA, 14 bp, Homo sapiens
ttatttcacttgat

SEQ ID NO: 3328040 - DNA, 20 bp, Homo sapiens
ttatttcactttagatgctg

SEQ ID NO: 3328041 - DNA, 21 bp, Homo sapiens
ttatttcactttagatgctga

SEQ ID NO: 3328042 - DNA, 19 bp, Homo sapiens
ttatttcatgattagaaat

SEQ ID NO: 3328043 - DNA, 17 bp, Homo sapiens
ttatttccaaataaaat

SEQ ID NO: 3328044 - DNA, 15 bp, Homo sapiens
ttatttccactaaaa

SEQ ID NO: 3328045 - DNA, 20 bp, Homo sapiens
ttatttccagtgttctatga

SEQ ID NO: 3328046 - DNA, 18 bp, Homo sapiens
ttatttctagtccaaaat

SEQ ID NO: 3328047 - DNA, 19 bp, Homo sapiens
ttatttctcgggtgcattt

SEQ ID NO: 3328048 - DNA, 12 bp, Homo sapiens
ttatttctgcat

SEQ ID NO: 3328049 - DNA, 14 bp, Homo sapiens
ttatttcttaacct

SEQ ID NO: 3328050 - DNA, 12 bp, Homo sapiens
ttatttcttcaa

SEQ ID NO: 3328051 - DNA, 15 bp, Homo sapiens
ttatttcttttactt

SEQ ID NO: 3328052 - DNA, 18 bp, Homo sapiens
ttatttggaaccttgttt

SEQ ID NO: 3328053 - DNA, 23 bp, Homo sapiens
ttatttggaaccttgttttggac

SEQ ID NO: 3328054 - DNA, 16 bp, Homo sapiens
ttatttgtaattttaa

SEQ ID NO: 3328055 - DNA, 16 bp, Homo sapiens
ttatttgtgtaataga

SEQ ID NO: 3328056 - DNA, 22 bp, Homo sapiens
ttatttgtgttttaatttaaac

SEQ ID NO: 3328057 - DNA, 17 bp, Homo sapiens
ttattttaaacaaaata

SEQ ID NO: 3328058 - DNA, 13 bp, Homo sapiens
ttattttaatgtg

SEQ ID NO: 3328059 - DNA, 14 bp, Homo sapiens
ttattttaatgtga

SEQ ID NO: 3328060 - DNA, 23 bp, Homo sapiens
ttattttaggcactgttcaatac

SEQ ID NO: 3328061 - DNA, 13 bp, Homo sapiens
ttattttatttgt

SEQ ID NO: 3328062 - DNA, 12 bp, Homo sapiens
ttattttcaaga

SEQ ID NO: 3328063 - DNA, 13 bp, Homo sapiens
ttattttcaagaa

SEQ ID NO: 3328064 - DNA, 18 bp, Homo sapiens
ttattttcaagaaactga

SEQ ID NO: 3328065 - DNA, 12 bp, Homo sapiens
ttattttcactg

SEQ ID NO: 3328066 - DNA, 14 bp, Homo sapiens
ttattttctccaaa

SEQ ID NO: 3328067 - DNA, 21 bp, Homo sapiens
ttattttgaaaagcttcttaa

SEQ ID NO: 3328068 - DNA, 13 bp, Homo sapiens
ttcaggcaccagc

SEQ ID NO: 3328069 - DNA, 16 bp, Homo sapiens
ttcaggctgcttggga

SEQ ID NO: 3328070 - DNA, 22 bp, Homo sapiens
ttcaggcttcctgcaattttct

SEQ ID NO: 3328071 - DNA, 15 bp, Homo sapiens
ttcagggccagtcct

SEQ ID NO: 3328072 - DNA, 17 bp, Homo sapiens
ttcagggttggcccctg

SEQ ID NO: 3328073 - DNA, 22 bp, Homo sapiens
ttcagggttggcccctgcccgg

SEQ ID NO: 3328074 - DNA, 17 bp, Homo sapiens
ttcaggtaacaggcaga

SEQ ID NO: 3328075 - DNA, 14 bp, Homo sapiens
ttcaggtaggccct

SEQ ID NO: 3328076 - DNA, 16 bp, Homo sapiens
ttcaggtgacatgtga

SEQ ID NO: 3328077 - DNA, 18 bp, Homo sapiens
ttcaggtgacatgtgaaa

SEQ ID NO: 3328078 - DNA, 22 bp, Homo sapiens
ttcaggtgacatgtgaaacctt

SEQ ID NO: 3328079 - DNA, 24 bp, Homo sapiens
ttcaggttatcgaaataacaatgt

SEQ ID NO: 3328080 - DNA, 22 bp, Homo sapiens
ttcagtacacttggtgtactgg

SEQ ID NO: 3328081 - DNA, 14 bp, Homo sapiens
ttcagtactttttt

SEQ ID NO: 3328082 - DNA, 21 bp, Homo sapiens
ttcagtacttttttaaatatt

SEQ ID NO: 3328083 - DNA, 15 bp, Homo sapiens
ttcagtatactgtgt

SEQ ID NO: 3328084 - DNA, 13 bp, Homo sapiens
ttcagtatttaat

SEQ ID NO: 3328085 - DNA, 17 bp, Homo sapiens
ttcagtattttggagaa

SEQ ID NO: 3328086 - DNA, 19 bp, Homo sapiens
ttcagtattttggagaaat

SEQ ID NO: 3328087 - DNA, 19 bp, Homo sapiens
ttcagtgactcctgctggt

SEQ ID NO: 3328088 - DNA, 20 bp, Homo sapiens
ttcagtgagggtcttcttac

SEQ ID NO: 3328089 - DNA, 23 bp, Homo sapiens
ttcagtgcatcattactgttcca

SEQ ID NO: 3328090 - DNA, 15 bp, Homo sapiens
ttcagtgccttcaac

SEQ ID NO: 3328091 - DNA, 14 bp, Homo sapiens
ttcagtggcagctg

SEQ ID NO: 3328092 - DNA, 19 bp, Homo sapiens
ttcagtgtagttaatttat

SEQ ID NO: 3328093 - DNA, 20 bp, Homo sapiens
ttcagtgtatggaaataaat

SEQ ID NO: 3328094 - DNA, 18 bp, Homo sapiens
ttcagtgtcccaggcagc

SEQ ID NO: 3328095 - DNA, 19 bp, Homo sapiens
ttcagttacaagattgtaa

SEQ ID NO: 3328096 - DNA, 14 bp, Homo sapiens
ttcagttccaagaa

SEQ ID NO: 3328097 - DNA, 18 bp, Homo sapiens
ttcagttctgtgtacatt

SEQ ID NO: 3328098 - DNA, 20 bp, Homo sapiens
ttcagttctgtgtacatttt

SEQ ID NO: 3328099 - DNA, 14 bp, Homo sapiens
ttcagttctttgga

SEQ ID NO: 3328100 - DNA, 18 bp, Homo sapiens
ttcagttgcttgtcttct

SEQ ID NO: 3328101 - DNA, 17 bp, Homo sapiens
ttcagttgttcttttta

SEQ ID NO: 3328102 - DNA, 13 bp, Homo sapiens
ttcagtttcataa

SEQ ID NO: 3328103 - DNA, 15 bp, Homo sapiens
ttcagtttttcattt

SEQ ID NO: 3328104 - DNA, 18 bp, Homo sapiens
ttcagtttttcatttgtt

SEQ ID NO: 3328105 - DNA, 21 bp, Homo sapiens
ttcagtttttcatttgttttg

SEQ ID NO: 3328106 - DNA, 23 bp, Homo sapiens
ttcagtttttcatttgttttgct

SEQ ID NO: 3328107 - DNA, 13 bp, Homo sapiens
ttcagtttttgta

SEQ ID NO: 3328108 - DNA, 12 bp, Homo sapiens
ttcataaatgaa

SEQ ID NO: 3328109 - DNA, 18 bp, Homo sapiens
ttcataacagtgccattg

SEQ ID NO: 3328110 - DNA, 12 bp, Homo sapiens
ttcataagtatt

SEQ ID NO: 3328111 - DNA, 14 bp, Homo sapiens
ttcataatgaatta

SEQ ID NO: 3328112 - DNA, 18 bp, Homo sapiens
ttcatacctaagtactgt

SEQ ID NO: 3328113 - DNA, 15 bp, Homo sapiens
ttcatactacccttt

SEQ ID NO: 3328114 - DNA, 13 bp, Homo sapiens
ttcatagcccagt

SEQ ID NO: 3328115 - DNA, 18 bp, Homo sapiens
ttcatagctgtacttctt

SEQ ID NO: 3328116 - DNA, 23 bp, Homo sapiens
ttcatagggaaaggttttgtatt

SEQ ID NO: 3328117 - DNA, 22 bp, Homo sapiens
ttcatatagcattgataatctt

SEQ ID NO: 3328118 - DNA, 20 bp, Homo sapiens
ttcatatagtcaatgtaaaa

SEQ ID NO: 3328119 - DNA, 21 bp, Homo sapiens
ttcatatatgaggacttgtgt

SEQ ID NO: 3328120 - DNA, 14 bp, Homo sapiens
ttcatatgttgctc

SEQ ID NO: 3328121 - DNA, 18 bp, Homo sapiens
ttcatatgttgctcagtc

SEQ ID NO: 3328122 - DNA, 12 bp, Homo sapiens
ttcatattgtgc

SEQ ID NO: 3328123 - DNA, 22 bp, Homo sapiens
ttcatattgtgccaatatgtat

SEQ ID NO: 3328124 - DNA, 20 bp, Homo sapiens
ttcatcaatatccctcttgt

SEQ ID NO: 3328125 - DNA, 21 bp, Homo sapiens
ttcatcaatatccctcttgta

SEQ ID NO: 3328126 - DNA, 16 bp, Homo sapiens
ttcatcagtgttaaaa

SEQ ID NO: 3328127 - DNA, 18 bp, Homo sapiens
ttcatcatcctaagctat

SEQ ID NO: 3328128 - DNA, 17 bp, Homo sapiens
ttcatcattccctctca

SEQ ID NO: 3328129 - DNA, 23 bp, Homo sapiens
ttcatcattgtttctgcatgaat

SEQ ID NO: 3328130 - DNA, 18 bp, Homo sapiens
ttcatccaacttccaaga

SEQ ID NO: 3328131 - DNA, 19 bp, Homo sapiens
ttcatcccaactgtctttt

SEQ ID NO: 3328132 - DNA, 14 bp, Homo sapiens
ttcatcccagcccc

SEQ ID NO: 3328133 - DNA, 20 bp, Homo sapiens
ttcatcctcattgcctcctg

SEQ ID NO: 3328134 - DNA, 15 bp, Homo sapiens
ttcatccttccccaa

SEQ ID NO: 3328135 - DNA, 20 bp, Homo sapiens
ttcatcgaatctactaattc

SEQ ID NO: 3328136 - DNA, 23 bp, Homo sapiens
ttcatctatgagggtgtttcctc

SEQ ID NO: 3328137 - DNA, 18 bp, Homo sapiens
ttcatctgttgttttgtt

SEQ ID NO: 3328138 - DNA, 13 bp, Homo sapiens
ttcatcttctgga

SEQ ID NO: 3328139 - DNA, 15 bp, Homo sapiens
ttcatcttctggaat

SEQ ID NO: 3328140 - DNA, 17 bp, Homo sapiens
ttcatgaaaataccatt

SEQ ID NO: 3328141 - DNA, 21 bp, Homo sapiens
ttcatgaaatgattggaatat

SEQ ID NO: 3328142 - DNA, 15 bp, Homo sapiens
ttcatgacagcctcc

SEQ ID NO: 3328143 - DNA, 23 bp, Homo sapiens
ttcatgattagaaattacctgtg

SEQ ID NO: 3328144 - DNA, 17 bp, Homo sapiens
ttcatgatttcatttca

SEQ ID NO: 3328145 - DNA, 15 bp, Homo sapiens
ttcatgcaatgacat

SEQ ID NO: 3328146 - DNA, 21 bp, Homo sapiens
ttcatgcaatgacatcttcaa

SEQ ID NO: 3328147 - DNA, 13 bp, Homo sapiens
ttcatgcagctgt

SEQ ID NO: 3328148 - DNA, 16 bp, Homo sapiens
ttcatgcccttctgat

SEQ ID NO: 3328149 - DNA, 18 bp, Homo sapiens
ttcatgctgaatccacct

SEQ ID NO: 3328150 - DNA, 20 bp, Homo sapiens
ttcatgctgaatccacctcg

SEQ ID NO: 3328151 - DNA, 19 bp, Homo sapiens
ttcatggaatggacatcct

SEQ ID NO: 3328152 - DNA, 19 bp, Homo sapiens
ttcatggctgctgttgctt

SEQ ID NO: 3328153 - DNA, 19 bp, Homo sapiens
ttcatgtaaacaaaattta

SEQ ID NO: 3328154 - DNA, 21 bp, Homo sapiens
ttcatgtaattttattttaaa

SEQ ID NO: 3328155 - DNA, 17 bp, Homo sapiens
ttcatgtacaagatgaa

SEQ ID NO: 3328156 - DNA, 15 bp, Homo sapiens
ttcatgtagaactca

SEQ ID NO: 3328157 - DNA, 20 bp, Homo sapiens
ttcatgtagagaaaagcaca

SEQ ID NO: 3328158 - DNA, 23 bp, Homo sapiens
ttcatgtattttacacaaatgtg

SEQ ID NO: 3328159 - DNA, 16 bp, Homo sapiens
ttcatgtcccagaact

SEQ ID NO: 3328160 - DNA, 17 bp, Homo sapiens
ttcatgtgcctctgcgg

SEQ ID NO: 3328161 - DNA, 14 bp, Homo sapiens
ttcatgtggctgta

SEQ ID NO: 3328162 - DNA, 13 bp, Homo sapiens
ttcatgttagtta

SEQ ID NO: 3328163 - DNA, 18 bp, Homo sapiens
ttcatgttagttacctta

SEQ ID NO: 3328164 - DNA, 22 bp, Homo sapiens
ttcatgtttggtgcatagaact

SEQ ID NO: 3328165 - DNA, 15 bp, Homo sapiens
ttcatgtttgtaaat

SEQ ID NO: 3328166 - DNA, 14 bp, Homo sapiens
ttcattaaacttga

SEQ ID NO: 3328167 - DNA, 15 bp, Homo sapiens
ttcattaaacttgaa

SEQ ID NO: 3328168 - DNA, 16 bp, Homo sapiens
ttcattaattcaggca

SEQ ID NO: 3328169 - DNA, 20 bp, Homo sapiens
ttcattacaatggaaacaat

SEQ ID NO: 3328170 - DNA, 17 bp, Homo sapiens
ttcattatctgagttgc

SEQ ID NO: 3328171 - DNA, 19 bp, Homo sapiens
ttcattatctgagttgcat

SEQ ID NO: 3328172 - DNA, 13 bp, Homo sapiens
ttcattatgttca

SEQ ID NO: 3328173 - DNA, 18 bp, Homo sapiens
ttcattatgttcatgtaa

SEQ ID NO: 3328174 - DNA, 18 bp, Homo sapiens
ttcattattggaattaac

SEQ ID NO: 3328175 - DNA, 13 bp, Homo sapiens
ttcattcaagcta

SEQ ID NO: 3328176 - DNA, 15 bp, Homo sapiens
ttcattcacttctct

SEQ ID NO: 3328177 - DNA, 12 bp, Homo sapiens
ttcattcatccc

SEQ ID NO: 3328178 - DNA, 15 bp, Homo sapiens
ttatgttgaaaaaat

SEQ ID NO: 3328179 - DNA, 18 bp, Homo sapiens
ttatgttgaaaaaattta

SEQ ID NO: 3328180 - DNA, 16 bp, Homo sapiens
ttatgttgtatgattc

SEQ ID NO: 3328181 - DNA, 16 bp, Homo sapiens
ttatgtttattacaat

SEQ ID NO: 3328182 - DNA, 19 bp, Homo sapiens
ttatgtttattacaatttt

SEQ ID NO: 3328183 - DNA, 12 bp, Homo sapiens
ttatgtttttct

SEQ ID NO: 3328184 - DNA, 16 bp, Homo sapiens
ttattaaaaatgttct

SEQ ID NO: 3328185 - DNA, 21 bp, Homo sapiens
ttattaaacagatttttacaa

SEQ ID NO: 3328186 - DNA, 17 bp, Homo sapiens
ttattaaacattttcat

SEQ ID NO: 3328187 - DNA, 21 bp, Homo sapiens
ttattaaataaaatcaatttt

SEQ ID NO: 3328188 - DNA, 18 bp, Homo sapiens
ttattaaatacaaaactt

SEQ ID NO: 3328189 - DNA, 17 bp, Homo sapiens
ttattaaatgcttcatt

SEQ ID NO: 3328190 - DNA, 14 bp, Homo sapiens
ttattaaattgtgt

SEQ ID NO: 3328191 - DNA, 18 bp, Homo sapiens
ttattaactacatttatg

SEQ ID NO: 3328192 - DNA, 21 bp, Homo sapiens
ttattaagatggattctcaga

SEQ ID NO: 3328193 - DNA, 19 bp, Homo sapiens
ttattaagctttttggaat

SEQ ID NO: 3328194 - DNA, 23 bp, Homo sapiens
ttattaagtctgggatgtagaac

SEQ ID NO: 3328195 - DNA, 20 bp, Homo sapiens
ttattaatatgagttactga

SEQ ID NO: 3328196 - DNA, 13 bp, Homo sapiens
ttattaatgtttt

SEQ ID NO: 3328197 - DNA, 22 bp, Homo sapiens
ttattaattgttttgcactttt

SEQ ID NO: 3328198 - DNA, 18 bp, Homo sapiens
ttattaatttttaaggat

SEQ ID NO: 3328199 - DNA, 16 bp, Homo sapiens
ttattacaatttgtat

SEQ ID NO: 3328200 - DNA, 13 bp, Homo sapiens
ttattacatgtaa

SEQ ID NO: 3328201 - DNA, 15 bp, Homo sapiens
ttattacatgtaatt

SEQ ID NO: 3328202 - DNA, 22 bp, Homo sapiens
ttattaccccctccttcagaca

SEQ ID NO: 3328203 - DNA, 15 bp, Homo sapiens
ttattacctctgata

SEQ ID NO: 3328204 - DNA, 15 bp, Homo sapiens
ttattacttctgttt

SEQ ID NO: 3328205 - DNA, 16 bp, Homo sapiens
ttattagggagaaaat

SEQ ID NO: 3328206 - DNA, 19 bp, Homo sapiens
ttattagggagaaaattca

SEQ ID NO: 3328207 - DNA, 15 bp, Homo sapiens
ttattagttaatata

SEQ ID NO: 3328208 - DNA, 15 bp, Homo sapiens
ttattatcattgaaa

SEQ ID NO: 3328209 - DNA, 21 bp, Homo sapiens
ttattatggcttgtgaactgc

SEQ ID NO: 3328210 - DNA, 15 bp, Homo sapiens
ttattattgaaattg

SEQ ID NO: 3328211 - DNA, 11 bp, Homo sapiens
ttattattgtg

SEQ ID NO: 3328212 - DNA, 16 bp, Homo sapiens
ttattcaaacttttat

SEQ ID NO: 3328213 - DNA, 15 bp, Homo sapiens
ttattcagcttcatt

SEQ ID NO: 3328214 - DNA, 20 bp, Homo sapiens
ttattcagcttcatttgtgt

SEQ ID NO: 3328215 - DNA, 19 bp, Homo sapiens
ttattcaggaagataaaaa

SEQ ID NO: 3328216 - DNA, 12 bp, Homo sapiens
ttattcataaag

SEQ ID NO: 3328217 - DNA, 14 bp, Homo sapiens
ttattcataatgaa

SEQ ID NO: 3328218 - DNA, 23 bp, Homo sapiens
ttattcattctgtgatcatttat

SEQ ID NO: 3328219 - DNA, 18 bp, Homo sapiens
ttattcatttaaaatgat

SEQ ID NO: 3328220 - DNA, 15 bp, Homo sapiens
ttattccacagatat

SEQ ID NO: 3328221 - DNA, 20 bp, Homo sapiens
ttattccagaatgctgtaca

SEQ ID NO: 3328222 - DNA, 20 bp, Homo sapiens
ttattccatattcatgtaaa

SEQ ID NO: 3328223 - DNA, 18 bp, Homo sapiens
ttattccatcaataaatg

SEQ ID NO: 3328224 - DNA, 20 bp, Homo sapiens
ttattccatcaataaatgct

SEQ ID NO: 3328225 - DNA, 17 bp, Homo sapiens
ttattccgagcattcca

SEQ ID NO: 3328226 - DNA, 21 bp, Homo sapiens
ttattcctagtggatgactgt

SEQ ID NO: 3328227 - DNA, 20 bp, Homo sapiens
ttattcctcctgctcatatt

SEQ ID NO: 3328228 - DNA, 20 bp, Homo sapiens
ttattcctgataataattga

SEQ ID NO: 3328229 - DNA, 21 bp, Homo sapiens
ttattcctgataataattgat

SEQ ID NO: 3328230 - DNA, 17 bp, Homo sapiens
ttattcctgtatgttgt

SEQ ID NO: 3328231 - DNA, 21 bp, Homo sapiens
ttattctaagccctttgccat

SEQ ID NO: 3328232 - DNA, 14 bp, Homo sapiens
ttattctaataaat

SEQ ID NO: 3328233 - DNA, 13 bp, Homo sapiens
ttattctagatta

SEQ ID NO: 3328234 - DNA, 13 bp, Homo sapiens
ttattctgattct

SEQ ID NO: 3328235 - DNA, 15 bp, Homo sapiens
ttattcttctcataa

SEQ ID NO: 3328236 - DNA, 21 bp, Homo sapiens
ttattcttgctgggcatactt

SEQ ID NO: 3328237 - DNA, 15 bp, Homo sapiens
ttattctttgaaaac

SEQ ID NO: 3328238 - DNA, 22 bp, Homo sapiens
ttattctttgaaaacagatgac

SEQ ID NO: 3328239 - DNA, 16 bp, Homo sapiens
ttattctttttaaagt

SEQ ID NO: 3328240 - DNA, 24 bp, Homo sapiens
ttattgaaaaaaaaaatgttgaga

SEQ ID NO: 3328241 - DNA, 13 bp, Homo sapiens
ttattgaagaaac

SEQ ID NO: 3328242 - DNA, 22 bp, Homo sapiens
ttattgaagaaacagataccat

SEQ ID NO: 3328243 - DNA, 19 bp, Homo sapiens
ttattgagaattttaaatt

SEQ ID NO: 3328244 - DNA, 14 bp, Homo sapiens
ttattgagtttgta

SEQ ID NO: 3328245 - DNA, 17 bp, Homo sapiens
ttattgcaataaagtat

SEQ ID NO: 3328246 - DNA, 18 bp, Homo sapiens
ttattgcccatgggatat

SEQ ID NO: 3328247 - DNA, 15 bp, Homo sapiens
ttattgcttagtaaa

SEQ ID NO: 3328248 - DNA, 20 bp, Homo sapiens
ttattggaaatgtacttttg

SEQ ID NO: 3328249 - DNA, 15 bp, Homo sapiens
ttattggctgagata

SEQ ID NO: 3328250 - DNA, 22 bp, Homo sapiens
ttattggctgagatatgaacat

SEQ ID NO: 3328251 - DNA, 19 bp, Homo sapiens
ttattgggatatcatttta

SEQ ID NO: 3328252 - DNA, 14 bp, Homo sapiens
ttattgtattttga

SEQ ID NO: 3328253 - DNA, 18 bp, Homo sapiens
ttattgtccttcagagct

SEQ ID NO: 3328254 - DNA, 20 bp, Homo sapiens
ttattgtggtaggcctttta

SEQ ID NO: 3328255 - DNA, 19 bp, Homo sapiens
ttattgttccaagacattg

SEQ ID NO: 3328256 - DNA, 23 bp, Homo sapiens
ttattgttccaagacattgtcaa

SEQ ID NO: 3328257 - DNA, 21 bp, Homo sapiens
ttattgttcccctaagtggat

SEQ ID NO: 3328258 - DNA, 21 bp, Homo sapiens
ttatttaaaaatatttcagat

SEQ ID NO: 3328259 - DNA, 10 bp, Homo sapiens
ttatttaata

SEQ ID NO: 3328260 - DNA, 13 bp, Homo sapiens
ttatttaataaca

SEQ ID NO: 3328261 - DNA, 14 bp, Homo sapiens
ttatttaataacat

SEQ ID NO: 3328262 - DNA, 15 bp, Homo sapiens
ttatttaccttttaa

SEQ ID NO: 3328263 - DNA, 21 bp, Homo sapiens
ttatttactgagcttctctgt

SEQ ID NO: 3328264 - DNA, 18 bp, Homo sapiens
ttatttagactcatctta

SEQ ID NO: 3328265 - DNA, 20 bp, Homo sapiens
ttatttagttgaaaaatcta

SEQ ID NO: 3328266 - DNA, 22 bp, Homo sapiens
ttatttagttgaaaaatctagt

SEQ ID NO: 3328267 - DNA, 12 bp, Homo sapiens
ttatttataaac

SEQ ID NO: 3328268 - DNA, 14 bp, Homo sapiens
ttatttattaagat

SEQ ID NO: 3328269 - DNA, 15 bp, Homo sapiens
ttatttattaagatg

SEQ ID NO: 3328270 - DNA, 22 bp, Homo sapiens
ttatttattcagcttcatttgt

SEQ ID NO: 3328271 - DNA, 15 bp, Homo sapiens
ttatttatttatgga

SEQ ID NO: 3328272 - DNA, 20 bp, Homo sapiens
ttatcagatacatcactgct

SEQ ID NO: 3328273 - DNA, 14 bp, Homo sapiens
ttatcagtcaatat

SEQ ID NO: 3328274 - DNA, 16 bp, Homo sapiens
ttatcagtgacagagt

SEQ ID NO: 3328275 - DNA, 19 bp, Homo sapiens
ttatcagttatattttgct

SEQ ID NO: 3328276 - DNA, 14 bp, Homo sapiens
ttatcatgaatttt

SEQ ID NO: 3328277 - DNA, 22 bp, Homo sapiens
ttatcatggaatttaatgctga

SEQ ID NO: 3328278 - DNA, 16 bp, Homo sapiens
ttatccaaaatgtgta

SEQ ID NO: 3328279 - DNA, 18 bp, Homo sapiens
ttatccaaaatgtgtatt

SEQ ID NO: 3328280 - DNA, 15 bp, Homo sapiens
ttatccaaatcttga

SEQ ID NO: 3328281 - DNA, 22 bp, Homo sapiens
ttatccaaggtgtaactctaat

SEQ ID NO: 3328282 - DNA, 17 bp, Homo sapiens
ttatccatgacaggcct

SEQ ID NO: 3328283 - DNA, 15 bp, Homo sapiens
ttatccatttgtaat

SEQ ID NO: 3328284 - DNA, 19 bp, Homo sapiens
ttatcccccccagcctggc

SEQ ID NO: 3328285 - DNA, 18 bp, Homo sapiens
ttatcctacagtacaatc

SEQ ID NO: 3328286 - DNA, 16 bp, Homo sapiens
ttatcctctggtttaa

SEQ ID NO: 3328287 - DNA, 14 bp, Homo sapiens
ttatcctctttgta

SEQ ID NO: 3328288 - DNA, 16 bp, Homo sapiens
ttatcctgaaatttca

SEQ ID NO: 3328289 - DNA, 23 bp, Homo sapiens
ttatccttgtctgaatgtattta

SEQ ID NO: 3328290 - DNA, 22 bp, Homo sapiens
ttatcctttgtgagcctatgat

SEQ ID NO: 3328291 - DNA, 19 bp, Homo sapiens
ttatcgaaataacaatgtt

SEQ ID NO: 3328292 - DNA, 21 bp, Homo sapiens
ttatcgaaataacaatgttaa

SEQ ID NO: 3328293 - DNA, 22 bp, Homo sapiens
ttatcgaaataacaatgttaag

SEQ ID NO: 3328294 - DNA, 15 bp, Homo sapiens
ttatcggaagcagtg

SEQ ID NO: 3328295 - DNA, 16 bp, Homo sapiens
ttatcgggaacagtgt

SEQ ID NO: 3328296 - DNA, 16 bp, Homo sapiens
ttatcgggagcagtgt

SEQ ID NO: 3328297 - DNA, 18 bp, Homo sapiens
ttatcgggagcagtgtct

SEQ ID NO: 3328298 - DNA, 21 bp, Homo sapiens
ttatcgggagcagtgtcttcc

SEQ ID NO: 3328299 - DNA, 22 bp, Homo sapiens
ttatcgtttttgtattttcatg

SEQ ID NO: 3328300 - DNA, 20 bp, Homo sapiens
ttatctaactatatgtacag

SEQ ID NO: 3328301 - DNA, 17 bp, Homo sapiens
ttatctaatttataaaa

SEQ ID NO: 3328302 - DNA, 14 bp, Homo sapiens
ttatctataattta

SEQ ID NO: 3328303 - DNA, 22 bp, Homo sapiens
ttatctataatttacctaagat

SEQ ID NO: 3328304 - DNA, 17 bp, Homo sapiens
ttatctatacatatctt

SEQ ID NO: 3328305 - DNA, 13 bp, Homo sapiens
ttatctatataaa

SEQ ID NO: 3328306 - DNA, 19 bp, Homo sapiens
ttatctattaaaattgcca

SEQ ID NO: 3328307 - DNA, 22 bp, Homo sapiens
ttatctcagatgttaaaataaa

SEQ ID NO: 3328308 - DNA, 21 bp, Homo sapiens
ttatctcagtcatgcataaat

SEQ ID NO: 3328309 - DNA, 22 bp, Homo sapiens
ttatctcagtcatgcataaata

SEQ ID NO: 3328310 - DNA, 22 bp, Homo sapiens
ttatctcctaattgtatgttag

SEQ ID NO: 3328311 - DNA, 14 bp, Homo sapiens
ttatctcctgtgat

SEQ ID NO: 3328312 - DNA, 15 bp, Homo sapiens
ttatctctatttaat

SEQ ID NO: 3328313 - DNA, 19 bp, Homo sapiens
ttatctgcctggcctggct

SEQ ID NO: 3328314 - DNA, 20 bp, Homo sapiens
ttatctgcctggcctggctc

SEQ ID NO: 3328315 - DNA, 16 bp, Homo sapiens
ttatctggtgcctcct

SEQ ID NO: 3328316 - DNA, 12 bp, Homo sapiens
ttatctgtcaca

SEQ ID NO: 3328317 - DNA, 17 bp, Homo sapiens
ttatctgtgaattcaga

SEQ ID NO: 3328318 - DNA, 22 bp, Homo sapiens
ttatctgtttcctgacattgtc

SEQ ID NO: 3328319 - DNA, 15 bp, Homo sapiens
ttatcttacaatatt

SEQ ID NO: 3328320 - DNA, 16 bp, Homo sapiens
ttatcttagctggata

SEQ ID NO: 3328321 - DNA, 19 bp, Homo sapiens
ttatcttctcaagttctaa

SEQ ID NO: 3328322 - DNA, 22 bp, Homo sapiens
ttatcttctcaagttctaagat

SEQ ID NO: 3328323 - DNA, 19 bp, Homo sapiens
ttatcttgggactgggttt

SEQ ID NO: 3328324 - DNA, 17 bp, Homo sapiens
ttatcttggttgaaaat

SEQ ID NO: 3328325 - DNA, 12 bp, Homo sapiens
ttatctttatat

SEQ ID NO: 3328326 - DNA, 14 bp, Homo sapiens
ttatctttccctct

SEQ ID NO: 3328327 - DNA, 15 bp, Homo sapiens
ttatctttcgcacag

SEQ ID NO: 3328328 - DNA, 23 bp, Homo sapiens
ttatgaaaaaatatgaacctatt

SEQ ID NO: 3328329 - DNA, 15 bp, Homo sapiens
ttatgaaagaatata

SEQ ID NO: 3328330 - DNA, 18 bp, Homo sapiens
ttatgaaaggtttacatt

SEQ ID NO: 3328331 - DNA, 17 bp, Homo sapiens
ttatgaatatttataac

SEQ ID NO: 3328332 - DNA, 12 bp, Homo sapiens
ttatgaatctga

SEQ ID NO: 3328333 - DNA, 21 bp, Homo sapiens
ttatgacatcacttgtacaaa

SEQ ID NO: 3328334 - DNA, 18 bp, Homo sapiens
ttatgagatctaatgtga

SEQ ID NO: 3328335 - DNA, 19 bp, Homo sapiens
ttatgagatctaatgtgaa

SEQ ID NO: 3328336 - DNA, 22 bp, Homo sapiens
ttatgagatctaatgtgaaaat

SEQ ID NO: 3328337 - DNA, 16 bp, Homo sapiens
ttatgagcagaaggaa

SEQ ID NO: 3328338 - DNA, 18 bp, Homo sapiens
ttatgagctacaacaaaa

SEQ ID NO: 3328339 - DNA, 15 bp, Homo sapiens
ttatgagtttttgat

SEQ ID NO: 3328340 - DNA, 21 bp, Homo sapiens
ttatgagtttttgatagcttt

SEQ ID NO: 3328341 - DNA, 15 bp, Homo sapiens
ttatgatcagtgttg

SEQ ID NO: 3328342 - DNA, 14 bp, Homo sapiens
ttatgatctatttg

SEQ ID NO: 3328343 - DNA, 15 bp, Homo sapiens
ttatgatctatttgt

SEQ ID NO: 3328344 - DNA, 13 bp, Homo sapiens
ttatgatgatgaa

SEQ ID NO: 3328345 - DNA, 23 bp, Homo sapiens
ttatgatgatgaaaattttacca

SEQ ID NO: 3328346 - DNA, 20 bp, Homo sapiens
ttatgatgcatacagttttc

SEQ ID NO: 3328347 - DNA, 21 bp, Homo sapiens
ttatgatgcatacagttttct

SEQ ID NO: 3328348 - DNA, 13 bp, Homo sapiens
ttatgatttaata

SEQ ID NO: 3328349 - DNA, 15 bp, Homo sapiens
ttatgatttaataaa

SEQ ID NO: 3328350 - DNA, 17 bp, Homo sapiens
ttatgatttaataaaat

SEQ ID NO: 3328351 - DNA, 20 bp, Homo sapiens
ttatgatttaataaaataat

SEQ ID NO: 3328352 - DNA, 18 bp, Homo sapiens
ttatgcagatagaatcaa

SEQ ID NO: 3328353 - DNA, 14 bp, Homo sapiens
ttatgcatttcatt

SEQ ID NO: 3328354 - DNA, 15 bp, Homo sapiens
ttatgcatttcattc

SEQ ID NO: 3328355 - DNA, 17 bp, Homo sapiens
ttatgcctttctctcct

SEQ ID NO: 3328356 - DNA, 21 bp, Homo sapiens
ttatgctgtattttaacactt

SEQ ID NO: 3328357 - DNA, 22 bp, Homo sapiens
ttatgctgtattttaacacttt

SEQ ID NO: 3328358 - DNA, 24 bp, Homo sapiens
ttatgctgtattttaacactttgt

SEQ ID NO: 3328359 - DNA, 22 bp, Homo sapiens
ttagactcaaagaatataatct

SEQ ID NO: 3328360 - DNA, 20 bp, Homo sapiens
ttagactgtagcctggatat

SEQ ID NO: 3328361 - DNA, 16 bp, Homo sapiens
ttagagaaaataaatt

SEQ ID NO: 3328362 - DNA, 16 bp, Homo sapiens
ttagagaagctgaaag

SEQ ID NO: 3328363 - DNA, 19 bp, Homo sapiens
ttagagagggaccatgtgt

SEQ ID NO: 3328364 - DNA, 13 bp, Homo sapiens
ttagagatgaatt

SEQ ID NO: 3328365 - DNA, 19 bp, Homo sapiens
ttagaggaaaaaaatgact

SEQ ID NO: 3328366 - DNA, 13 bp, Homo sapiens
ttagaggaaaagg

SEQ ID NO: 3328367 - DNA, 15 bp, Homo sapiens
ttagaggcattgtta

SEQ ID NO: 3328368 - DNA, 18 bp, Homo sapiens
ttagagggaggagaatga

SEQ ID NO: 3328369 - DNA, 19 bp, Homo sapiens
ttagaggttttaaagtgat

SEQ ID NO: 3328370 - DNA, 20 bp, Homo sapiens
ttagagtaaataaactgttt

SEQ ID NO: 3328371 - DNA, 23 bp, Homo sapiens
ttagagtaaataaactgtttata

SEQ ID NO: 3328372 - DNA, 22 bp, Homo sapiens
ttagagtcaactacacaaagca

SEQ ID NO: 3328373 - DNA, 16 bp, Homo sapiens
ttagataatttgaaaa

SEQ ID NO: 3328374 - DNA, 17 bp, Homo sapiens
ttagatataacactatg

SEQ ID NO: 3328375 - DNA, 18 bp, Homo sapiens
ttagatcaaggcaaaaat

SEQ ID NO: 3328376 - DNA, 19 bp, Homo sapiens
ttagatcaaggcaaaaata

SEQ ID NO: 3328377 - DNA, 14 bp, Homo sapiens
ttagatcttatatt

SEQ ID NO: 3328378 - DNA, 17 bp, Homo sapiens
ttagatgagggtgactg

SEQ ID NO: 3328379 - DNA, 19 bp, Homo sapiens
ttagattctctgtgtctaa

SEQ ID NO: 3328380 - DNA, 20 bp, Homo sapiens
ttagattctctgtgtctaag

SEQ ID NO: 3328381 - DNA, 15 bp, Homo sapiens
ttagattgagaaatg

SEQ ID NO: 3328382 - DNA, 19 bp, Homo sapiens
ttagattgagaaatgtgta

SEQ ID NO: 3328383 - DNA, 19 bp, Homo sapiens
ttagatttcaagaaaaaat

SEQ ID NO: 3328384 - DNA, 14 bp, Homo sapiens
ttagatttcatagt

SEQ ID NO: 3328385 - DNA, 20 bp, Homo sapiens
ttagatttcatagttcagaa

SEQ ID NO: 3328386 - DNA, 21 bp, Homo sapiens
ttagattttattttactattg

SEQ ID NO: 3328387 - DNA, 17 bp, Homo sapiens
ttagcacaaaaaaaatt

SEQ ID NO: 3328388 - DNA, 21 bp, Homo sapiens
ttagcacagattttaattgtc

SEQ ID NO: 3328389 - DNA, 12 bp, Homo sapiens
ttagcactgttg

SEQ ID NO: 3328390 - DNA, 23 bp, Homo sapiens
ttagcataattttgtgttgtaca

SEQ ID NO: 3328391 - DNA, 18 bp, Homo sapiens
ttagcatagcttattatt

SEQ ID NO: 3328392 - DNA, 21 bp, Homo sapiens
ttagcatgatgaaactgtcat

SEQ ID NO: 3328393 - DNA, 15 bp, Homo sapiens
ttagcatgcacaaag

SEQ ID NO: 3328394 - DNA, 21 bp, Homo sapiens
ttagccaactgtttccctgct

SEQ ID NO: 3328395 - DNA, 19 bp, Homo sapiens
ttagccaggtaatgtgaat

SEQ ID NO: 3328396 - DNA, 17 bp, Homo sapiens
ttagcccaagaggtctg

SEQ ID NO: 3328397 - DNA, 14 bp, Homo sapiens
ttagccccataatt

SEQ ID NO: 3328398 - DNA, 18 bp, Homo sapiens
ttagccttgtgccctgcc

SEQ ID NO: 3328399 - DNA, 18 bp, Homo sapiens
ttagcctttgccctgtca

SEQ ID NO: 3328400 - DNA, 21 bp, Homo sapiens
ttagcgtagctaagtgaaaag

SEQ ID NO: 3328401 - DNA, 14 bp, Homo sapiens
ttagctcctgtggc

SEQ ID NO: 3328402 - DNA, 11 bp, Homo sapiens
ttagctctggg

SEQ ID NO: 3328403 - DNA, 13 bp, Homo sapiens
ttagctgtactat

SEQ ID NO: 3328404 - DNA, 17 bp, Homo sapiens
ttagctgtctgctcaga

SEQ ID NO: 3328405 - DNA, 22 bp, Homo sapiens
ttagctttattatggcttgtga

SEQ ID NO: 3328406 - DNA, 17 bp, Homo sapiens
ttagctttccctgtgcc

SEQ ID NO: 3328407 - DNA, 18 bp, Homo sapiens
ttagctttccctgtgcca

SEQ ID NO: 3328408 - DNA, 13 bp, Homo sapiens
ttagctttctcag

SEQ ID NO: 3328409 - DNA, 18 bp, Homo sapiens
ttagctttttaattgttg

SEQ ID NO: 3328410 - DNA, 16 bp, Homo sapiens
ttaggaaaggagatca

SEQ ID NO: 3328411 - DNA, 18 bp, Homo sapiens
ttaggaaataaaaccttt

SEQ ID NO: 3328412 - DNA, 19 bp, Homo sapiens
ttaggaaataaaacctttc

SEQ ID NO: 3328413 - DNA, 20 bp, Homo sapiens
ttaggaaataaaacctttca

SEQ ID NO: 3328414 - DNA, 21 bp, Homo sapiens
ttaggaaataaaacctttcaa

SEQ ID NO: 3328415 - DNA, 15 bp, Homo sapiens
ttaggaagagaaacc

SEQ ID NO: 3328416 - DNA, 17 bp, Homo sapiens
ttaggaagttttctgta

SEQ ID NO: 3328417 - DNA, 23 bp, Homo sapiens
ttaggaattaagttatctttaaa

SEQ ID NO: 3328418 - DNA, 18 bp, Homo sapiens
ttaggaggctcaacaata

SEQ ID NO: 3328419 - DNA, 19 bp, Homo sapiens
ttaggagggagttatctaa

SEQ ID NO: 3328420 - DNA, 20 bp, Homo sapiens
ttaggcaaggctatgtgatt

SEQ ID NO: 3328421 - DNA, 17 bp, Homo sapiens
ttaggcatgtcccaccc

SEQ ID NO: 3328422 - DNA, 16 bp, Homo sapiens
ttaggctatttgtaaa

SEQ ID NO: 3328423 - DNA, 20 bp, Homo sapiens
ttaggctgtaactactttat

SEQ ID NO: 3328424 - DNA, 15 bp, Homo sapiens
ttaggctgttccttg

SEQ ID NO: 3328425 - DNA, 17 bp, Homo sapiens
ttagggagaaaattcaa

SEQ ID NO: 3328426 - DNA, 18 bp, Homo sapiens
ttagggagagtcatattt

SEQ ID NO: 3328427 - DNA, 19 bp, Homo sapiens
ttaggggaaggagaagtaa

SEQ ID NO: 3328428 - DNA, 14 bp, Homo sapiens
ttaggggtgaagga

SEQ ID NO: 3328429 - DNA, 16 bp, Homo sapiens
ttaggggtgaaggagg

SEQ ID NO: 3328430 - DNA, 11 bp, Homo sapiens
ttagggtacag

SEQ ID NO: 3328431 - DNA, 15 bp, Homo sapiens
ttagggtgaaccact

SEQ ID NO: 3328432 - DNA, 21 bp, Homo sapiens
ttagggtgaaccacttcattc

SEQ ID NO: 3328433 - DNA, 23 bp, Homo sapiens
ttaggtccctcactccacagagt

SEQ ID NO: 3328434 - DNA, 13 bp, Homo sapiens
ttaacaacatggc

SEQ ID NO: 3328435 - DNA, 20 bp, Homo sapiens
ttaacaaggaatgcctgtgc

SEQ ID NO: 3328436 - DNA, 21 bp, Homo sapiens
ttaacaataactactgtgttc

SEQ ID NO: 3328437 - DNA, 15 bp, Homo sapiens
ttaacaatctaacaa

SEQ ID NO: 3328438 - DNA, 14 bp, Homo sapiens
ttaacaatgcaact

SEQ ID NO: 3328439 - DNA, 16 bp, Homo sapiens
ttaacaattccaaagg

SEQ ID NO: 3328440 - DNA, 15 bp, Homo sapiens
ttaacaatttctgtc

SEQ ID NO: 3328441 - DNA, 16 bp, Homo sapiens
ttaacaccttcatcca

SEQ ID NO: 3328442 - DNA, 17 bp, Homo sapiens
ttaacactttgtattac

SEQ ID NO: 3328443 - DNA, 18 bp, Homo sapiens
ttaacagcagtcctttgt

SEQ ID NO: 3328444 - DNA, 14 bp, Homo sapiens
ttaacagttttcca

SEQ ID NO: 3328445 - DNA, 17 bp, Homo sapiens
ttaacagttttccatga

SEQ ID NO: 3328446 - DNA, 19 bp, Homo sapiens
ttaacagttttccatgaaa

SEQ ID NO: 3328447 - DNA, 21 bp, Homo sapiens
ttaacagttttccatgaaaac

SEQ ID NO: 3328448 - DNA, 18 bp, Homo sapiens
ttaacatagtaattctta

SEQ ID NO: 3328449 - DNA, 19 bp, Homo sapiens
ttaacatcagaactgaaat

SEQ ID NO: 3328450 - DNA, 22 bp, Homo sapiens
ttaacatcagaactgaaataaa

SEQ ID NO: 3328451 - DNA, 20 bp, Homo sapiens
ttaacatgggctcttcacta

SEQ ID NO: 3328452 - DNA, 22 bp, Homo sapiens
ttaacatgggctcttcactagt

SEQ ID NO: 3328453 - DNA, 13 bp, Homo sapiens
ttaacattattta

SEQ ID NO: 3328454 - DNA, 14 bp, Homo sapiens
ttaacattccaaga

SEQ ID NO: 3328455 - DNA, 23 bp, Homo sapiens
ttaacattgaccaagaactgcat

SEQ ID NO: 3328456 - DNA, 12 bp, Homo sapiens
ttaacatttgcc

SEQ ID NO: 3328457 - DNA, 23 bp, Homo sapiens
ttaacatttgccttgcagaactg

SEQ ID NO: 3328458 - DNA, 14 bp, Homo sapiens
ttaacattttgttc

SEQ ID NO: 3328459 - DNA, 17 bp, Homo sapiens
ttaaccaaacaattatt

SEQ ID NO: 3328460 - DNA, 21 bp, Homo sapiens
ttaaccaaacaattatttaaa

SEQ ID NO: 3328461 - DNA, 13 bp, Homo sapiens
ttaaccagaataa

SEQ ID NO: 3328462 - DNA, 13 bp, Homo sapiens
ttaaccattgtct

SEQ ID NO: 3328463 - DNA, 14 bp, Homo sapiens
ttaaccatttaagt

SEQ ID NO: 3328464 - DNA, 20 bp, Homo sapiens
ttaacctatgatattttctg

SEQ ID NO: 3328465 - DNA, 21 bp, Homo sapiens
ttaacctatgatattttctgt

SEQ ID NO: 3328466 - DNA, 17 bp, Homo sapiens
ttaacctgttttgttaa

SEQ ID NO: 3328467 - DNA, 21 bp, Homo sapiens
ttaacctttgctatgtaaggg

SEQ ID NO: 3328468 - DNA, 14 bp, Homo sapiens
ttaacctttttgta

SEQ ID NO: 3328469 - DNA, 17 bp, Homo sapiens
ttaactaaattttaaag

SEQ ID NO: 3328470 - DNA, 18 bp, Homo sapiens
ttaactaaattttaaagc

SEQ ID NO: 3328471 - DNA, 23 bp, Homo sapiens
ttaactaatctattgggttcatt

SEQ ID NO: 3328472 - DNA, 15 bp, Homo sapiens
ttaactaatttgaat

SEQ ID NO: 3328473 - DNA, 20 bp, Homo sapiens
ttaactaatttgaatgtggt

SEQ ID NO: 3328474 - DNA, 18 bp, Homo sapiens
ttaactactatattgatt

SEQ ID NO: 3328475 - DNA, 12 bp, Homo sapiens
ttaactagaatt

SEQ ID NO: 3328476 - DNA, 16 bp, Homo sapiens
ttaactagaatttatt

SEQ ID NO: 3328477 - DNA, 13 bp, Homo sapiens
ttaactgtggata

SEQ ID NO: 3328478 - DNA, 19 bp, Homo sapiens
ttaactgtgtatgtacata

SEQ ID NO: 3328479 - DNA, 14 bp, Homo sapiens
ttaacttcttgctt

SEQ ID NO: 3328480 - DNA, 21 bp, Homo sapiens
ttaacttcttgcttctttcta

SEQ ID NO: 3328481 - DNA, 16 bp, Homo sapiens
ttaacttggtcagagc

SEQ ID NO: 3328482 - DNA, 18 bp, Homo sapiens
ttaactttatcacattat

SEQ ID NO: 3328483 - DNA, 23 bp, Homo sapiens
ttaactttatcacattatttgca

SEQ ID NO: 3328484 - DNA, 17 bp, Homo sapiens
ttaactttttatttcta

SEQ ID NO: 3328485 - DNA, 18 bp, Homo sapiens
ttaactttttatttctaa

SEQ ID NO: 3328486 - DNA, 13 bp, Homo sapiens
ttaagaaaagcac

SEQ ID NO: 3328487 - DNA, 17 bp, Homo sapiens
ttaagaaaatacaataa

SEQ ID NO: 3328488 - DNA, 22 bp, Homo sapiens
ttaagaaagactatctaaatgt

SEQ ID NO: 3328489 - DNA, 18 bp, Homo sapiens
ttaagaactgcttcatgt

SEQ ID NO: 3328490 - DNA, 16 bp, Homo sapiens
ttaagaagctgttgta

SEQ ID NO: 3328491 - DNA, 22 bp, Homo sapiens
ttaagaagctgttgtacattta

SEQ ID NO: 3328492 - DNA, 18 bp, Homo sapiens
ttaagaaggcaaaaatgt

SEQ ID NO: 3328493 - DNA, 10 bp, Homo sapiens
ttaagaatat

SEQ ID NO: 3328494 - DNA, 20 bp, Homo sapiens
ttaagaatatgtttccttgt

SEQ ID NO: 3328495 - DNA, 20 bp, Homo sapiens
ttaagacctactgttctaaa

SEQ ID NO: 3328496 - DNA, 21 bp, Homo sapiens
ttaagacctactgttctaaag

SEQ ID NO: 3328497 - DNA, 22 bp, Homo sapiens
ttaagacctactgttctaaagc

SEQ ID NO: 3328498 - DNA, 12 bp, Homo sapiens
ttaagagaaatg

SEQ ID NO: 3328499 - DNA, 14 bp, Homo sapiens
ttaagagactcact

SEQ ID NO: 3328500 - DNA, 23 bp, Homo sapiens
ttaagagcagaacagatctttta

SEQ ID NO: 3328501 - DNA, 22 bp, Homo sapiens
ttaagagccatataagtttgaa

SEQ ID NO: 3328502 - DNA, 17 bp, Homo sapiens
ttaagagctaaccagtt

SEQ ID NO: 3328503 - DNA, 14 bp, Homo sapiens
ttaagagtccaaga

SEQ ID NO: 3328504 - DNA, 19 bp, Homo sapiens
ttaagagtccaagaatcca

SEQ ID NO: 3328505 - DNA, 18 bp, Homo sapiens
ttaagagtgctaaatttt

SEQ ID NO: 3328506 - DNA, 21 bp, Homo sapiens
ttaagataatagtttacatgt

SEQ ID NO: 3328507 - DNA, 14 bp, Homo sapiens
ttaagataattata

SEQ ID NO: 3328508 - DNA, 14 bp, Homo sapiens
ttaagatacaaatt

SEQ ID NO: 3328509 - DNA, 19 bp, Homo sapiens
ttaagatacttagattaga

SEQ ID NO: 3328510 - DNA, 19 bp, Homo sapiens
ttaagatagacttattctt

SEQ ID NO: 3328511 - DNA, 22 bp, Homo sapiens
ttaagatatccatctttttctt

SEQ ID NO: 3328512 - DNA, 17 bp, Homo sapiens
ttaagatggattctcag

SEQ ID NO: 3328513 - DNA, 14 bp, Homo sapiens
ttaagatttttctc

SEQ ID NO: 3328514 - DNA, 17 bp, Homo sapiens
ttaagatttttctcaaa

SEQ ID NO: 3328515 - DNA, 21 bp, Homo sapiens
ttaagatttttctcaaagttt

SEQ ID NO: 3328516 - DNA, 20 bp, Homo sapiens
ttaagcactacataaactga

SEQ ID NO: 3328517 - DNA, 22 bp, Homo sapiens
ttaagcactacataaactgact

SEQ ID NO: 3328518 - DNA, 21 bp, Homo sapiens
ttaagcagatggaatgctgtg

SEQ ID NO: 3328519 - DNA, 22 bp, Homo sapiens
ttaagcagcatggaaaaatggt

SEQ ID NO: 3328520 - DNA, 20 bp, Homo sapiens
ttaagcagctcttgctaatc

SEQ ID NO: 3328521 - DNA, 18 bp, Homo sapiens
ttaagcagtaaaaactgt

SEQ ID NO: 3328522 - DNA, 22 bp, Homo sapiens
ttaagcatctggctctaattca

SEQ ID NO: 3328523 - DNA, 20 bp, Homo sapiens
ttaagcattgggtgggtaaa

SEQ ID NO: 3328524 - DNA, 14 bp, Homo sapiens
ttaagcattgtttg

SEQ ID NO: 3328525 - DNA, 19 bp, Homo sapiens
ttaagcattgtttgcttat

SEQ ID NO: 3328526 - DNA, 23 bp, Homo sapiens
ttaagccaaagaaacaagctgtg

SEQ ID NO: 3328527 - DNA, 21 bp, Homo sapiens
ttaagccttataaaccaatct

SEQ ID NO: 3328528 - DNA, 16 bp, Homo sapiens
ttaagccttcaaaact

SEQ ID NO: 3328529 - DNA, 15 bp, Homo sapiens
ttaagctatcagcaa

SEQ ID NO: 3328530 - DNA, 23 bp, Homo sapiens
ttaagctgcagagatttctcatt

SEQ ID NO: 3328531 - DNA, 14 bp, Homo sapiens
ttaagctttttgga

SEQ ID NO: 3328532 - DNA, 16 bp, Homo sapiens
ttaagctttttggaat

SEQ ID NO: 3328533 - DNA, 12 bp, Homo sapiens
ttaaggaaacaa

SEQ ID NO: 3328534 - DNA, 14 bp, Homo sapiens
ttaaggaaacaata

SEQ ID NO: 3328535 - DNA, 17 bp, Homo sapiens
ttaaggcacagtgggag

SEQ ID NO: 3328536 - DNA, 21 bp, Homo sapiens
ttaaggcacagtgggagctga

SEQ ID NO: 3328537 - DNA, 16 bp, Homo sapiens
ttaaggctaaaaagta

SEQ ID NO: 3328538 - DNA, 20 bp, Homo sapiens
ttaaggctgtgtgaattttt

SEQ ID NO: 3328539 - DNA, 12 bp, Homo sapiens
ttaagggcagag

SEQ ID NO: 3328540 - DNA, 16 bp, Homo sapiens
ttaagggcatgccttg

SEQ ID NO: 3328541 - DNA, 19 bp, Homo sapiens
ttaagggcatgccttgtgc

SEQ ID NO: 3328542 - DNA, 20 bp, Homo sapiens
ttaaggggaagaatgaaagc

SEQ ID NO: 3328543 - DNA, 19 bp, Homo sapiens
ttaagggggaaaactgttc

SEQ ID NO: 3328544 - DNA, 22 bp, Homo sapiens
ttaaggggggcagggagtgatg

SEQ ID NO: 3328545 - DNA, 18 bp, Homo sapiens
ttaaggggtatcatgtat

SEQ ID NO: 3328546 - DNA, 19 bp, Homo sapiens
ttaaggtgagcataaatca

SEQ ID NO: 3328547 - DNA, 14 bp, Homo sapiens
ttaaggttgaactt

SEQ ID NO: 3328548 - DNA, 21 bp, Homo sapiens
ttaaggttgaactttgccaaa

SEQ ID NO: 3328549 - DNA, 11 bp, Homo sapiens
ttaagtaactt

SEQ ID NO: 3328550 - DNA, 17 bp, Homo sapiens
ttaagtaagacttttat

SEQ ID NO: 3328551 - DNA, 17 bp, Homo sapiens
ttaagtactatgtatca

SEQ ID NO: 3328552 - DNA, 22 bp, Homo sapiens
ttaagtagaaaagttgcagatg

SEQ ID NO: 3328553 - DNA, 14 bp, Homo sapiens
ttaagtatgtgtaa

SEQ ID NO: 3328554 - DNA, 17 bp, Homo sapiens
ttaagtcttttgtctga

SEQ ID NO: 3328555 - DNA, 16 bp, Homo sapiens
ttaagtgctttgtaat

SEQ ID NO: 3328556 - DNA, 19 bp, Homo sapiens
ttacaacataatctagttt

SEQ ID NO: 3328557 - DNA, 19 bp, Homo sapiens
ttacaactgaccaagtttc

SEQ ID NO: 3328558 - DNA, 13 bp, Homo sapiens
ttacaacttgtat

SEQ ID NO: 3328559 - DNA, 21 bp, Homo sapiens
ttacaagaagtttattctcat

SEQ ID NO: 3328560 - DNA, 21 bp, Homo sapiens
ttacaagcgtgagccactgca

SEQ ID NO: 3328561 - DNA, 14 bp, Homo sapiens
ttacaagtgtatat

SEQ ID NO: 3328562 - DNA, 12 bp, Homo sapiens
ttacaatcaaag

SEQ ID NO: 3328563 - DNA, 14 bp, Homo sapiens
ttacaatggaaaca

SEQ ID NO: 3328564 - DNA, 13 bp, Homo sapiens
ttacaatgtgaat

SEQ ID NO: 3328565 - DNA, 14 bp, Homo sapiens
ttacaatgtgaata

SEQ ID NO: 3328566 - DNA, 13 bp, Homo sapiens
ttacaattgtcat

SEQ ID NO: 3328567 - DNA, 18 bp, Homo sapiens
ttacaattttatctgttt

SEQ ID NO: 3328568 - DNA, 17 bp, Homo sapiens
ttacaattttttatcat

SEQ ID NO: 3328569 - DNA, 18 bp, Homo sapiens
ttacaattttttatcatg

SEQ ID NO: 3328570 - DNA, 20 bp, Homo sapiens
ttacaattttttatcatgca

SEQ ID NO: 3328571 - DNA, 16 bp, Homo sapiens
ttacacacacagatgt

SEQ ID NO: 3328572 - DNA, 15 bp, Homo sapiens
ttacacagcccaaga

SEQ ID NO: 3328573 - DNA, 17 bp, Homo sapiens
ttacacagcccaagagg

SEQ ID NO: 3328574 - DNA, 23 bp, Homo sapiens
ttacacagtcaaatttacattta

SEQ ID NO: 3328575 - DNA, 14 bp, Homo sapiens
ttacacatacagtt

SEQ ID NO: 3328576 - DNA, 17 bp, Homo sapiens
ttacacatcttcaacag

SEQ ID NO: 3328577 - DNA, 17 bp, Homo sapiens
ttacacatttgtacaga

SEQ ID NO: 3328578 - DNA, 17 bp, Homo sapiens
ttacaccaactcctaat

SEQ ID NO: 3328579 - DNA, 14 bp, Homo sapiens
ttacactgccatct

SEQ ID NO: 3328580 - DNA, 22 bp, Homo sapiens
ttacactgcctgtatactttag

SEQ ID NO: 3328581 - DNA, 17 bp, Homo sapiens
ttacactgttagaacac

SEQ ID NO: 3328582 - DNA, 19 bp, Homo sapiens
ttacactgttagaacacta

SEQ ID NO: 3328583 - DNA, 20 bp, Homo sapiens
ttacactgttagaacactat

SEQ ID NO: 3328584 - DNA, 15 bp, Homo sapiens
ttacacttggagccc

SEQ ID NO: 3328585 - DNA, 13 bp, Homo sapiens
ttacactttatgc

SEQ ID NO: 3328586 - DNA, 14 bp, Homo sapiens
ttacacttttgaga

SEQ ID NO: 3328587 - DNA, 16 bp, Homo sapiens
ttacagaaactgatgc

SEQ ID NO: 3328588 - DNA, 15 bp, Homo sapiens
ttacagaaatactat

SEQ ID NO: 3328589 - DNA, 15 bp, Homo sapiens
ttacagaaatggact

SEQ ID NO: 3328590 - DNA, 21 bp, Homo sapiens
ttacagaggtattaaaactaa

SEQ ID NO: 3328591 - DNA, 20 bp, Homo sapiens
ttacagatgaatgtatttat

SEQ ID NO: 3328592 - DNA, 12 bp, Homo sapiens
ttacagatgtga

SEQ ID NO: 3328593 - DNA, 13 bp, Homo sapiens
ttacagatgtgaa

SEQ ID NO: 3328594 - DNA, 16 bp, Homo sapiens
ttacagattgcctcct

SEQ ID NO: 3328595 - DNA, 15 bp, Homo sapiens
ttacagcattgtctt

SEQ ID NO: 3328596 - DNA, 21 bp, Homo sapiens
ttacagcattgtctttgctgt

SEQ ID NO: 3328597 - DNA, 14 bp, Homo sapiens
ttacagctgcctgc

SEQ ID NO: 3328598 - DNA, 22 bp, Homo sapiens
ttacagctttacacacacagat

SEQ ID NO: 3328599 - DNA, 18 bp, Homo sapiens
ttacaggaatgaagaact

SEQ ID NO: 3328600 - DNA, 19 bp, Homo sapiens
ttacaggaatgaagaactg

SEQ ID NO: 3328601 - DNA, 18 bp, Homo sapiens
ttacaggcaccgagaatg

SEQ ID NO: 3328602 - DNA, 24 bp, Homo sapiens
ttacaggcaccgagaatgttgtat

SEQ ID NO: 3328603 - DNA, 15 bp, Homo sapiens
ttacagggagcctcc

SEQ ID NO: 3328604 - DNA, 21 bp, Homo sapiens
ttacagggagcctcctgccca

SEQ ID NO: 3328605 - DNA, 22 bp, Homo sapiens
ttacagggtaactgtgctgaat

SEQ ID NO: 3328606 - DNA, 14 bp, Homo sapiens
ttacagggtgactc

SEQ ID NO: 3328607 - DNA, 19 bp, Homo sapiens
ttacagtgaaaatgtaagc

SEQ ID NO: 3328608 - DNA, 11 bp, Homo sapiens
ttacagttctg

SEQ ID NO: 3328609 - DNA, 14 bp, Homo sapiens
ttacataatcagta

SEQ ID NO: 3328610 - DNA, 21 bp, Homo sapiens
ttacatactttatcaatgtgt

SEQ ID NO: 3328611 - DNA, 22 bp, Homo sapiens
ttacatagttttaaactcattt

SEQ ID NO: 3328612 - DNA, 13 bp, Homo sapiens
ttacatctaatgc

SEQ ID NO: 3328613 - DNA, 16 bp, Homo sapiens
ttacatctaatgcttc

SEQ ID NO: 3328614 - DNA, 16 bp, Homo sapiens
ttacatctctaatttt

SEQ ID NO: 3328615 - DNA, 20 bp, Homo sapiens
ttacatctctaattttggat

SEQ ID NO: 3328616 - DNA, 18 bp, Homo sapiens
ttacatctgttttaaatt

SEQ ID NO: 3328617 - DNA, 21 bp, Homo sapiens
ttacatcttctgtgaaatata

SEQ ID NO: 3328618 - DNA, 22 bp, Homo sapiens
ttacatgcaatttattaaaatg

SEQ ID NO: 3328619 - DNA, 14 bp, Homo sapiens
tgtttgcaagcagg

SEQ ID NO: 3328620 - DNA, 13 bp, Homo sapiens
tgtttgccaggac

SEQ ID NO: 3328621 - DNA, 18 bp, Homo sapiens
tgtttgccaggacatgca

SEQ ID NO: 3328622 - DNA, 15 bp, Homo sapiens
tgtttgccatacttt

SEQ ID NO: 3328623 - DNA, 14 bp, Homo sapiens
tgtttgctgtgaac

SEQ ID NO: 3328624 - DNA, 16 bp, Homo sapiens
tgtttgcttgaatgct

SEQ ID NO: 3328625 - DNA, 20 bp, Homo sapiens
tgtttgcttgaatgctggta

SEQ ID NO: 3328626 - DNA, 19 bp, Homo sapiens
tgtttggagacgtttataa

SEQ ID NO: 3328627 - DNA, 17 bp, Homo sapiens
tgtttggcaaggaaagg

SEQ ID NO: 3328628 - DNA, 16 bp, Homo sapiens
tgtttggcacttgtat

SEQ ID NO: 3328629 - DNA, 19 bp, Homo sapiens
tgtttggcacttgtattta

SEQ ID NO: 3328630 - DNA, 17 bp, Homo sapiens
tgtttggcttggccttg

SEQ ID NO: 3328631 - DNA, 15 bp, Homo sapiens
tgtttggggatgaga

SEQ ID NO: 3328632 - DNA, 20 bp, Homo sapiens
tgtttgggggacgtttctca

SEQ ID NO: 3328633 - DNA, 19 bp, Homo sapiens
tgtttggtttactttcaaa

SEQ ID NO: 3328634 - DNA, 15 bp, Homo sapiens
tgtttgtaaataaga

SEQ ID NO: 3328635 - DNA, 18 bp, Homo sapiens
tgtttgtaaataagagat

SEQ ID NO: 3328636 - DNA, 14 bp, Homo sapiens
tgtttgtaaatgcc

SEQ ID NO: 3328637 - DNA, 15 bp, Homo sapiens
tgtttgtaaattaat

SEQ ID NO: 3328638 - DNA, 19 bp, Homo sapiens
tgtttgtctctccttttct

SEQ ID NO: 3328639 - DNA, 19 bp, Homo sapiens
tgtttgtctgtcttcatag

SEQ ID NO: 3328640 - DNA, 12 bp, Homo sapiens
tgtttgtggcct

SEQ ID NO: 3328641 - DNA, 21 bp, Homo sapiens
tgttttaaactctcctagtca

SEQ ID NO: 3328642 - DNA, 19 bp, Homo sapiens
tgttttaaagaatatgact

SEQ ID NO: 3328643 - DNA, 14 bp, Homo sapiens
tgttttaaattctg

SEQ ID NO: 3328644 - DNA, 17 bp, Homo sapiens
tgttttaaattctgaga

SEQ ID NO: 3328645 - DNA, 20 bp, Homo sapiens
tgttttaagaggcagggtct

SEQ ID NO: 3328646 - DNA, 22 bp, Homo sapiens
tgttttaagaggcagggtctca

SEQ ID NO: 3328647 - DNA, 16 bp, Homo sapiens
tgttttaataacttat

SEQ ID NO: 3328648 - DNA, 18 bp, Homo sapiens
tgttttaattgtagttct

SEQ ID NO: 3328649 - DNA, 13 bp, Homo sapiens
tgttttactcttt

SEQ ID NO: 3328650 - DNA, 15 bp, Homo sapiens
tgttttactgtcaga

SEQ ID NO: 3328651 - DNA, 12 bp, Homo sapiens
tgttttagcatt

SEQ ID NO: 3328652 - DNA, 22 bp, Homo sapiens
tgttttataagttcacaaaatg

SEQ ID NO: 3328653 - DNA, 15 bp, Homo sapiens
tgttttatatacctg

SEQ ID NO: 3328654 - DNA, 12 bp, Homo sapiens
tgttttatcatg

SEQ ID NO: 3328655 - DNA, 23 bp, Homo sapiens
tgttttatcatgacatgttatat

SEQ ID NO: 3328656 - DNA, 23 bp, Homo sapiens
tgttttattatttctattaaata

SEQ ID NO: 3328657 - DNA, 14 bp, Homo sapiens
tgttttattcctgt

SEQ ID NO: 3328658 - DNA, 15 bp, Homo sapiens
tgttttcacttgtat

SEQ ID NO: 3328659 - DNA, 15 bp, Homo sapiens
tgtcttcatagcaga

SEQ ID NO: 3328660 - DNA, 21 bp, Homo sapiens
tgttggcaggctggccagtcc

SEQ ID NO: 3328661 - DNA, 11 bp, Homo sapiens
tgttggccagg

SEQ ID NO: 3328662 - DNA, 14 bp, Homo sapiens
tgttggctatttga

SEQ ID NO: 3328663 - DNA, 20 bp, Homo sapiens
tgttggctatttgaaatact

SEQ ID NO: 3328664 - DNA, 14 bp, Homo sapiens
tgttggctttgttt

SEQ ID NO: 3328665 - DNA, 13 bp, Homo sapiens
tgttggtcagagg

SEQ ID NO: 3328666 - DNA, 17 bp, Homo sapiens
tgttggtcagaggagtg

SEQ ID NO: 3328667 - DNA, 16 bp, Homo sapiens
tgttggttccaagccc

SEQ ID NO: 3328668 - DNA, 19 bp, Homo sapiens
tgttggttccaagccctgg

SEQ ID NO: 3328669 - DNA, 16 bp, Homo sapiens
tgttggttgttttttc

SEQ ID NO: 3328670 - DNA, 19 bp, Homo sapiens
tgttggttgttttttcctt

SEQ ID NO: 3328671 - DNA, 20 bp, Homo sapiens
tgttggtttactttcaaatc

SEQ ID NO: 3328672 - DNA, 15 bp, Homo sapiens
tgttgtaaaaagaaa

SEQ ID NO: 3328673 - DNA, 22 bp, Homo sapiens
tgttgtaaaacaaaatttgact

SEQ ID NO: 3328674 - DNA, 13 bp, Homo sapiens
tgttgtaaattag

SEQ ID NO: 3328675 - DNA, 19 bp, Homo sapiens
tgttgtaacttatgtagat

SEQ ID NO: 3328676 - DNA, 18 bp, Homo sapiens
tgttgtaagaattctgat

SEQ ID NO: 3328677 - DNA, 22 bp, Homo sapiens
tgttgtaatgctgcacttcctg

SEQ ID NO: 3328678 - DNA, 13 bp, Homo sapiens
tgttgtacattta

SEQ ID NO: 3328679 - DNA, 14 bp, Homo sapiens
tgttgtacatttat

SEQ ID NO: 3328680 - DNA, 15 bp, Homo sapiens
tgttgtacatttatg

SEQ ID NO: 3328681 - DNA, 18 bp, Homo sapiens
tgttgtacatttatgatt

SEQ ID NO: 3328682 - DNA, 20 bp, Homo sapiens
tgttgtacatttatgattta

SEQ ID NO: 3328683 - DNA, 22 bp, Homo sapiens
tgttgtacatttatgatttaat

SEQ ID NO: 3328684 - DNA, 23 bp, Homo sapiens
tgttgtacatttatgatttaata

SEQ ID NO: 3328685 - DNA, 22 bp, Homo sapiens
tgttgtagatgctaacgtgtca

SEQ ID NO: 3328686 - DNA, 17 bp, Homo sapiens
tgttgtcagcctgtgct

SEQ ID NO: 3328687 - DNA, 17 bp, Homo sapiens
tgttgtccaacaataaa

SEQ ID NO: 3328688 - DNA, 23 bp, Homo sapiens
tgttgtccaacaataaacaggaa

SEQ ID NO: 3328689 - DNA, 12 bp, Homo sapiens
tgttgtcttgaa

SEQ ID NO: 3328690 - DNA, 12 bp, Homo sapiens
tgttgtgaatgt

SEQ ID NO: 3328691 - DNA, 14 bp, Homo sapiens
tgttgtggctctta

SEQ ID NO: 3328692 - DNA, 16 bp, Homo sapiens
tgttgtggctcttatt

SEQ ID NO: 3328693 - DNA, 22 bp, Homo sapiens
tgttgtgggcgctgcttccagg

SEQ ID NO: 3328694 - DNA, 24 bp, Homo sapiens
tgggaggaagcaggttgaggggct

SEQ ID NO: 3328695 - DNA, 14 bp, Homo sapiens
tgggaggacaggca

SEQ ID NO: 3328696 - DNA, 15 bp, Homo sapiens
tgggaggacaggcag

SEQ ID NO: 3328697 - DNA, 17 bp, Homo sapiens
tgggaggacaggcaggc

SEQ ID NO: 3328698 - DNA, 18 bp, Homo sapiens
tgggaggaggaaaagaaa

SEQ ID NO: 3328699 - DNA, 15 bp, Homo sapiens
tgggaggcaagaaaa

SEQ ID NO: 3328700 - DNA, 18 bp, Homo sapiens
tgggaggcaagaggggtg

SEQ ID NO: 3328701 - DNA, 20 bp, Homo sapiens
tgggaggcagaggttgcagt

SEQ ID NO: 3328702 - DNA, 18 bp, Homo sapiens
tgggaggcatggccctgg

SEQ ID NO: 3328703 - DNA, 16 bp, Homo sapiens
tgggaggccaaggcag

SEQ ID NO: 3328704 - DNA, 18 bp, Homo sapiens
tgggaggctgaggcagga

SEQ ID NO: 3328705 - DNA, 14 bp, Homo sapiens
tgggaggggcaggc

SEQ ID NO: 3328706 - DNA, 15 bp, Homo sapiens
tgggaggggcaggct

SEQ ID NO: 3328707 - DNA, 19 bp, Homo sapiens
tgggaggggcaggctgaca

SEQ ID NO: 3328708 - DNA, 23 bp, Homo sapiens
tgggaggggcgcccacctcccca

SEQ ID NO: 3328709 - DNA, 23 bp, Homo sapiens
tgggagggggcttgaagccaaag

SEQ ID NO: 3328710 - DNA, 15 bp, Homo sapiens
tgggagggttcccct

SEQ ID NO: 3328711 - DNA, 18 bp, Homo sapiens
tgggaggtggaagaaggg

SEQ ID NO: 3328712 - DNA, 23 bp, Homo sapiens
tgggagtcacacagtgttggagg

SEQ ID NO: 3328713 - DNA, 14 bp, Homo sapiens
tgggagtcagagcc

SEQ ID NO: 3328714 - DNA, 18 bp, Homo sapiens
tgggagtcagagccctgg

SEQ ID NO: 3328715 - DNA, 20 bp, Homo sapiens
tgggagtccccttttctttt

SEQ ID NO: 3328716 - DNA, 18 bp, Homo sapiens
tgggagtgggcacctcag

SEQ ID NO: 3328717 - DNA, 18 bp, Homo sapiens
tgggagtgggcagaggtg

SEQ ID NO: 3328718 - DNA, 19 bp, Homo sapiens
tgggagttctagaaccact

SEQ ID NO: 3328719 - DNA, 19 bp, Homo sapiens
tgggataactgatttctat

SEQ ID NO: 3328720 - DNA, 12 bp, Homo sapiens
tgggatacaacc

SEQ ID NO: 3328721 - DNA, 16 bp, Homo sapiens
tgggatactgcagggc

SEQ ID NO: 3328722 - DNA, 22 bp, Homo sapiens
tgggatacttagtggtatgtct

SEQ ID NO: 3328723 - DNA, 12 bp, Homo sapiens
tgggatatcatt

SEQ ID NO: 3328724 - DNA, 14 bp, Homo sapiens
tgggatatggtctt

SEQ ID NO: 3328725 - DNA, 16 bp, Homo sapiens
tgggatatgtggtgta

SEQ ID NO: 3328726 - DNA, 16 bp, Homo sapiens
tgggatcagagcagga

SEQ ID NO: 3328727 - DNA, 14 bp, Homo sapiens
tgggatcccaccct

SEQ ID NO: 3328728 - DNA, 13 bp, Homo sapiens
tgggatcctccct

SEQ ID NO: 3328729 - DNA, 14 bp, Homo sapiens
tgggatcctccctc

SEQ ID NO: 3328730 - DNA, 15 bp, Homo sapiens
tgggatcctccctca

SEQ ID NO: 3328731 - DNA, 16 bp, Homo sapiens
tgggatgagccgctgt

SEQ ID NO: 3328732 - DNA, 17 bp, Homo sapiens
tgggatgctagccccag

SEQ ID NO: 3328733 - DNA, 22 bp, Homo sapiens
tgggatgtcctctttactccct

SEQ ID NO: 3328734 - DNA, 14 bp, Homo sapiens
tgggatgtgagccc

SEQ ID NO: 3328735 - DNA, 16 bp, Homo sapiens
tgggatgttcagcact

SEQ ID NO: 3328736 - DNA, 21 bp, Homo sapiens
tgggatgttcagcactgtccc

SEQ ID NO: 3328737 - DNA, 12 bp, Homo sapiens
tgggattattct

SEQ ID NO: 3328738 - DNA, 15 bp, Homo sapiens
tgggattcctgaccc

SEQ ID NO: 3328739 - DNA, 24 bp, Homo sapiens
tgggattcctgacccaggccgcag

SEQ ID NO: 3328740 - DNA, 15 bp, Homo sapiens
tgggattggtgggct

SEQ ID NO: 3328741 - DNA, 15 bp, Homo sapiens
tgggatttcttcgct

SEQ ID NO: 3328742 - DNA, 18 bp, Homo sapiens
tgggatttcttcgctgct

SEQ ID NO: 3328743 - DNA, 14 bp, Homo sapiens
tgggatttgctgtg

SEQ ID NO: 3328744 - DNA, 14 bp, Homo sapiens
tgggcaaacaggca

SEQ ID NO: 3328745 - DNA, 21 bp, Homo sapiens
tgggcaaagccacaaggctgg

SEQ ID NO: 3328746 - DNA, 16 bp, Homo sapiens
tgggcaacccccagcc

SEQ ID NO: 3328747 - DNA, 21 bp, Homo sapiens
tgggcacctcagaaagtcacc

SEQ ID NO: 3328748 - DNA, 22 bp, Homo sapiens
tgggcactgggatgagccgctg

SEQ ID NO: 3328749 - DNA, 15 bp, Homo sapiens
tgggcactttttaat

SEQ ID NO: 3328750 - DNA, 16 bp, Homo sapiens
tgggcagagctgcatc

SEQ ID NO: 3328751 - DNA, 14 bp, Homo sapiens
tgggcagagctggc

SEQ ID NO: 3328752 - DNA, 12 bp, Homo sapiens
tgggcagaggtg

SEQ ID NO: 3328753 - DNA, 17 bp, Homo sapiens
tgggcagcaccctcccc

SEQ ID NO: 3328754 - DNA, 22 bp, Homo sapiens
tgggcagcaccctcccccgcag

SEQ ID NO: 3328755 - DNA, 15 bp, Homo sapiens
tgggcagccaggctg

SEQ ID NO: 3328756 - DNA, 16 bp, Homo sapiens
tgggcagccccagaga

SEQ ID NO: 3328757 - DNA, 18 bp, Homo sapiens
tgggcagccccagagaga

SEQ ID NO: 3328758 - DNA, 20 bp, Homo sapiens
tgggcagccccagagagagg

SEQ ID NO: 3328759 - DNA, 23 bp, Homo sapiens
tgggcagctaccacgggtctgcc

SEQ ID NO: 3328760 - DNA, 13 bp, Homo sapiens
tgggcagctgagg

SEQ ID NO: 3328761 - DNA, 14 bp, Homo sapiens
tgggcagctgggcc

SEQ ID NO: 3328762 - DNA, 18 bp, Homo sapiens
tgggcaggcaagcccttc

SEQ ID NO: 3328763 - DNA, 22 bp, Homo sapiens
tgggcaggcggtccccatcccc

SEQ ID NO: 3328764 - DNA, 17 bp, Homo sapiens
tgggcaggtggtggcac

SEQ ID NO: 3328765 - DNA, 16 bp, Homo sapiens
tgggcagttttttgaa

SEQ ID NO: 3328766 - DNA, 15 bp, Homo sapiens
tgggcatcagcagca

SEQ ID NO: 3328767 - DNA, 19 bp, Homo sapiens
tgggcatccacccagtgct

SEQ ID NO: 3328768 - DNA, 23 bp, Homo sapiens
tgggcatccacccagtgctgcca

SEQ ID NO: 3328769 - DNA, 17 bp, Homo sapiens
tgggcatctgttctggt

SEQ ID NO: 3328770 - DNA, 22 bp, Homo sapiens
tgggcatgccaccctcacacac

SEQ ID NO: 3328771 - DNA, 15 bp, Homo sapiens
tgggcattgggctga

SEQ ID NO: 3328772 - DNA, 14 bp, Homo sapiens
tggggatctcaggg

SEQ ID NO: 3328773 - DNA, 15 bp, Homo sapiens
tggggatgtgggagg

SEQ ID NO: 3328774 - DNA, 19 bp, Homo sapiens
tggggcaagtccctgactc

SEQ ID NO: 3328775 - DNA, 18 bp, Homo sapiens
tggggcacggactgtcca

SEQ ID NO: 3328776 - DNA, 21 bp, Homo sapiens
tggggcagaggggcagccgct

SEQ ID NO: 3328777 - DNA, 17 bp, Homo sapiens
tggggcaggctggctgg

SEQ ID NO: 3328778 - DNA, 15 bp, Homo sapiens
tggggcaggctgggc

SEQ ID NO: 3328779 - DNA, 16 bp, Homo sapiens
tggggcaggctgggcc

SEQ ID NO: 3328780 - DNA, 15 bp, Homo sapiens
tggggcatcctggat

SEQ ID NO: 3328781 - DNA, 17 bp, Homo sapiens
tggggcatcctggatga

SEQ ID NO: 3328782 - DNA, 17 bp, Homo sapiens
tggggcatcctgtgcca

SEQ ID NO: 3328783 - DNA, 23 bp, Homo sapiens
tggggcatggttccttccctggg

SEQ ID NO: 3328784 - DNA, 15 bp, Homo sapiens
tggggcatgtgtgcc

SEQ ID NO: 3328785 - DNA, 22 bp, Homo sapiens
tggggcatgtgtgcctgtggca

SEQ ID NO: 3328786 - DNA, 12 bp, Homo sapiens
tggggccaggcc

SEQ ID NO: 3328787 - DNA, 15 bp, Homo sapiens
tggggccaggccagg

SEQ ID NO: 3328788 - DNA, 16 bp, Homo sapiens
tggggccaggccagga

SEQ ID NO: 3328789 - DNA, 20 bp, Homo sapiens
tggggccaggccaggaccac

SEQ ID NO: 3328790 - DNA, 19 bp, Homo sapiens
tggggccctgcccctagga

SEQ ID NO: 3328791 - DNA, 12 bp, Homo sapiens
tggggccctggg

SEQ ID NO: 3328792 - DNA, 15 bp, Homo sapiens
tggggccctgggcct

SEQ ID NO: 3328793 - DNA, 17 bp, Homo sapiens
tggggccctgggcctca

SEQ ID NO: 3328794 - DNA, 18 bp, Homo sapiens
tggggcctacagctttga

SEQ ID NO: 3328795 - DNA, 18 bp, Homo sapiens
tggggcctagatccacac

SEQ ID NO: 3328796 - DNA, 21 bp, Homo sapiens
tggggcctagcgatctctcct

SEQ ID NO: 3328797 - DNA, 18 bp, Homo sapiens
tggggcctccctccttgg

SEQ ID NO: 3328798 - DNA, 13 bp, Homo sapiens
tggggcctgagag

SEQ ID NO: 3328799 - DNA, 14 bp, Homo sapiens
tggggcctgagaga

SEQ ID NO: 3328800 - DNA, 18 bp, Homo sapiens
tggggcctgagagaattg

SEQ ID NO: 3328801 - DNA, 12 bp, Homo sapiens
tggggcctggca

SEQ ID NO: 3328802 - DNA, 13 bp, Homo sapiens
tggggcctggctt

SEQ ID NO: 3328803 - DNA, 22 bp, Homo sapiens
tggggcctgggagggttcccct

SEQ ID NO: 3328804 - DNA, 13 bp, Homo sapiens
tggggcctgtgga

SEQ ID NO: 3328805 - DNA, 16 bp, Homo sapiens
tggggcctgtggaatg

SEQ ID NO: 3328806 - DNA, 14 bp, Homo sapiens
tggggcgaggcagg

SEQ ID NO: 3328807 - DNA, 19 bp, Homo sapiens
tggggcgggtggggccata

SEQ ID NO: 3328808 - DNA, 18 bp, Homo sapiens
tggggcggtgagagggga

SEQ ID NO: 3328809 - DNA, 13 bp, Homo sapiens
tggggctcccagc

SEQ ID NO: 3328810 - DNA, 14 bp, Homo sapiens
tggggctccctctc

SEQ ID NO: 3328811 - DNA, 13 bp, Homo sapiens
tggggctcgccat

SEQ ID NO: 3328812 - DNA, 17 bp, Homo sapiens
tggggctcgccatgccg

SEQ ID NO: 3328813 - DNA, 21 bp, Homo sapiens
tggggctcgtggccttcccct

SEQ ID NO: 3328814 - DNA, 23 bp, Homo sapiens
tggggctctagggttgctggagc

SEQ ID NO: 3328815 - DNA, 17 bp, Homo sapiens
tggggctctgtgcaggg

SEQ ID NO: 3328816 - DNA, 15 bp, Homo sapiens
tggggcttcaccagt

SEQ ID NO: 3328817 - DNA, 22 bp, Homo sapiens
tggggcttcaccagtctgtcta

SEQ ID NO: 3328818 - DNA, 16 bp, Homo sapiens
tggggcttctcctgac

SEQ ID NO: 3328819 - DNA, 18 bp, Homo sapiens
tggggcttctcctgaccc

SEQ ID NO: 3328820 - DNA, 15 bp, Homo sapiens
tgggggactgggagt

SEQ ID NO: 3328821 - DNA, 13 bp, Homo sapiens
tgggggagagcag

SEQ ID NO: 3328822 - DNA, 14 bp, Homo sapiens
tgggggagagggtg

SEQ ID NO: 3328823 - DNA, 20 bp, Homo sapiens
tgggggaggggggggtgggg

SEQ ID NO: 3328824 - DNA, 23 bp, Homo sapiens
tgggggcaagaagatcacgctcc

SEQ ID NO: 3328825 - DNA, 23 bp, Homo sapiens
tgggggcactcagccacgaccag

SEQ ID NO: 3328826 - DNA, 20 bp, Homo sapiens
tgggggcgccctctctgctc

SEQ ID NO: 3328827 - DNA, 19 bp, Homo sapiens
tggcttataaacacattga

SEQ ID NO: 3328828 - DNA, 19 bp, Homo sapiens
tggcttatttaatatgctt

SEQ ID NO: 3328829 - DNA, 14 bp, Homo sapiens
tggcttattttaat

SEQ ID NO: 3328830 - DNA, 17 bp, Homo sapiens
tggcttcaaaatagaga

SEQ ID NO: 3328831 - DNA, 12 bp, Homo sapiens
tggcttcatttc

SEQ ID NO: 3328832 - DNA, 19 bp, Homo sapiens
tggcttccagcttcaggca

SEQ ID NO: 3328833 - DNA, 23 bp, Homo sapiens
tggcttccagcttcaggcaccag

SEQ ID NO: 3328834 - DNA, 22 bp, Homo sapiens
tggcttcccgctcagccctccc

SEQ ID NO: 3328835 - DNA, 16 bp, Homo sapiens
tggcttcctccgtcca

SEQ ID NO: 3328836 - DNA, 23 bp, Homo sapiens
tggcttcctccgtccacccaggc

SEQ ID NO: 3328837 - DNA, 14 bp, Homo sapiens
tggcttcctcctga

SEQ ID NO: 3328838 - DNA, 20 bp, Homo sapiens
tggcttcggacaaaatatct

SEQ ID NO: 3328839 - DNA, 14 bp, Homo sapiens
tggcttctgggaga

SEQ ID NO: 3328840 - DNA, 15 bp, Homo sapiens
tggcttctgtttcta

SEQ ID NO: 3328841 - DNA, 16 bp, Homo sapiens
tggcttctgtttctag

SEQ ID NO: 3328842 - DNA, 12 bp, Homo sapiens
tggcttgacatg

SEQ ID NO: 3328843 - DNA, 12 bp, Homo sapiens
tggcttgctcca

SEQ ID NO: 3328844 - DNA, 13 bp, Homo sapiens
tggcttgctccag

SEQ ID NO: 3328845 - DNA, 16 bp, Homo sapiens
tggcttgctccagggt

SEQ ID NO: 3328846 - DNA, 17 bp, Homo sapiens
tggcttgctccagggtc

SEQ ID NO: 3328847 - DNA, 18 bp, Homo sapiens
tggcttgctccagggtct

SEQ ID NO: 3328848 - DNA, 19 bp, Homo sapiens
tggcttgctccagggtctt

SEQ ID NO: 3328849 - DNA, 23 bp, Homo sapiens
tggcttggggtcaagaaacagcc

SEQ ID NO: 3328850 - DNA, 12 bp, Homo sapiens
tggcttgtagaa

SEQ ID NO: 3328851 - DNA, 17 bp, Homo sapiens
tggcttgtgaactgctg

SEQ ID NO: 3328852 - DNA, 14 bp, Homo sapiens
tggcttgtgtgttt

SEQ ID NO: 3328853 - DNA, 23 bp, Homo sapiens
tggctttacctttttgtatgtga

SEQ ID NO: 3328854 - DNA, 20 bp, Homo sapiens
tggctttccttgtggcagag

SEQ ID NO: 3328855 - DNA, 20 bp, Homo sapiens
tggctttctcccactgagtt

SEQ ID NO: 3328856 - DNA, 21 bp, Homo sapiens
tggctttgggaaagcccagac

SEQ ID NO: 3328857 - DNA, 16 bp, Homo sapiens
tggcttttcactgctg

SEQ ID NO: 3328858 - DNA, 21 bp, Homo sapiens
tggcttttcactgctggctgc

SEQ ID NO: 3328859 - DNA, 18 bp, Homo sapiens
tggctttttcctctgagc

SEQ ID NO: 3328860 - DNA, 22 bp, Homo sapiens
tggcttttttaaaaaagcaaca

SEQ ID NO: 3328861 - DNA, 21 bp, Homo sapiens
tgggaaaaaaacttggcactt

SEQ ID NO: 3328862 - DNA, 19 bp, Homo sapiens
tgggaaaaaaatgaatgag

SEQ ID NO: 3328863 - DNA, 16 bp, Homo sapiens
tgggaaaacactgcca

SEQ ID NO: 3328864 - DNA, 21 bp, Homo sapiens
tgggaaaacatgttaatgaca

SEQ ID NO: 3328865 - DNA, 19 bp, Homo sapiens
tgggaaacagagtccaatt

SEQ ID NO: 3328866 - DNA, 19 bp, Homo sapiens
tgggaaactgttgtgggcg

SEQ ID NO: 3328867 - DNA, 15 bp, Homo sapiens
tgggaaagcataaag

SEQ ID NO: 3328868 - DNA, 14 bp, Homo sapiens
tgggaaagcccaga

SEQ ID NO: 3328869 - DNA, 17 bp, Homo sapiens
tgggaaagcccagactt

SEQ ID NO: 3328870 - DNA, 21 bp, Homo sapiens
tgggaaattaaatccaataaa

SEQ ID NO: 3328871 - DNA, 18 bp, Homo sapiens
tgggaaccactcccacca

SEQ ID NO: 3328872 - DNA, 17 bp, Homo sapiens
tgggaacctcccagagg

SEQ ID NO: 3328873 - DNA, 22 bp, Homo sapiens
tgggaacctcccagaggtccag

SEQ ID NO: 3328874 - DNA, 21 bp, Homo sapiens
tgggaacgcagatgatccatg

SEQ ID NO: 3328875 - DNA, 19 bp, Homo sapiens
tgggaactccactctcctt

SEQ ID NO: 3328876 - DNA, 13 bp, Homo sapiens
tgggaactctgac

SEQ ID NO: 3328877 - DNA, 13 bp, Homo sapiens
tgggaagacatga

SEQ ID NO: 3328878 - DNA, 18 bp, Homo sapiens
tgggaagacgcctgagct

SEQ ID NO: 3328879 - DNA, 23 bp, Homo sapiens
tgggaagagaagagggcccagcc

SEQ ID NO: 3328880 - DNA, 22 bp, Homo sapiens
tgggaagataggctctgcacag

SEQ ID NO: 3328881 - DNA, 17 bp, Homo sapiens
tgggaagcttgagcctc

SEQ ID NO: 3328882 - DNA, 18 bp, Homo sapiens
tgggaagcttgagcctcc

SEQ ID NO: 3328883 - DNA, 17 bp, Homo sapiens
tgggaaggcttgggatt

SEQ ID NO: 3328884 - DNA, 15 bp, Homo sapiens
tgggaatagggagac

SEQ ID NO: 3328885 - DNA, 19 bp, Homo sapiens
tgggaatgaaattaacaca

SEQ ID NO: 3328886 - DNA, 14 bp, Homo sapiens
tgggaatgaggtgg

SEQ ID NO: 3328887 - DNA, 13 bp, Homo sapiens
tgggaatgggaga

SEQ ID NO: 3328888 - DNA, 15 bp, Homo sapiens
tgggaatgggagagg

SEQ ID NO: 3328889 - DNA, 23 bp, Homo sapiens
tgggaattggaatcaaaagagtt

SEQ ID NO: 3328890 - DNA, 13 bp, Homo sapiens
tgggaattgtgtg

SEQ ID NO: 3328891 - DNA, 13 bp, Homo sapiens
tgggaatttcaat

SEQ ID NO: 3328892 - DNA, 16 bp, Homo sapiens
tgggacaattgtttta

SEQ ID NO: 3328893 - DNA, 18 bp, Homo sapiens
tgggacaccagggaagaa

SEQ ID NO: 3328894 - DNA, 18 bp, Homo sapiens
tgggacagaggagcaagg

SEQ ID NO: 3328895 - DNA, 12 bp, Homo sapiens
tgggacagccag

SEQ ID NO: 3328896 - DNA, 16 bp, Homo sapiens
tgggacagccagagct

SEQ ID NO: 3328897 - DNA, 18 bp, Homo sapiens
tgggacagcccagagcct

SEQ ID NO: 3328898 - DNA, 14 bp, Homo sapiens
tgggacagggagga

SEQ ID NO: 3328899 - DNA, 12 bp, Homo sapiens
tgggaccagagc

SEQ ID NO: 3328900 - DNA, 13 bp, Homo sapiens
tgggaccagagcc

SEQ ID NO: 3328901 - DNA, 14 bp, Homo sapiens
tgggaccagagcca

SEQ ID NO: 3328902 - DNA, 15 bp, Homo sapiens
tgggaccagagccag

SEQ ID NO: 3328903 - DNA, 18 bp, Homo sapiens
tgggacccagctactctg

SEQ ID NO: 3328904 - DNA, 20 bp, Homo sapiens
tgggacccagctactctgtc

SEQ ID NO: 3328905 - DNA, 23 bp, Homo sapiens
tgggacccagctactctgtccag

SEQ ID NO: 3328906 - DNA, 14 bp, Homo sapiens
tgggaccccgagct

SEQ ID NO: 3328907 - DNA, 22 bp, Homo sapiens
tgggaccctgtccggcccagtg

SEQ ID NO: 3328908 - DNA, 23 bp, Homo sapiens
tgggacctcagttttatcatttt

SEQ ID NO: 3328909 - DNA, 17 bp, Homo sapiens
tgggacctgccaggcag

SEQ ID NO: 3328910 - DNA, 18 bp, Homo sapiens
tgggactcaatgcactga

SEQ ID NO: 3328911 - DNA, 19 bp, Homo sapiens
tgggactcctggtgcccct

SEQ ID NO: 3328912 - DNA, 20 bp, Homo sapiens
tgggactcctggtgcccctc

SEQ ID NO: 3328913 - DNA, 24 bp, Homo sapiens
tgggactcctggtgcccctcgcca

SEQ ID NO: 3328914 - DNA, 22 bp, Homo sapiens
tgggactggacagctttgctcc

SEQ ID NO: 3328915 - DNA, 12 bp, Homo sapiens
tgggactggagt

SEQ ID NO: 3328916 - DNA, 19 bp, Homo sapiens
tgggactgggtttggaccc

SEQ ID NO: 3328917 - DNA, 14 bp, Homo sapiens
tgggactgtacaca

SEQ ID NO: 3328918 - DNA, 17 bp, Homo sapiens
tgggactgtacacactt

SEQ ID NO: 3328919 - DNA, 20 bp, Homo sapiens
tgggacttccttgctctccc

SEQ ID NO: 3328920 - DNA, 14 bp, Homo sapiens
tgggacttctaccc

SEQ ID NO: 3328921 - DNA, 23 bp, Homo sapiens
tgggacttctacccagatggaaa

SEQ ID NO: 3328922 - DNA, 14 bp, Homo sapiens
tgggacttcttacc

SEQ ID NO: 3328923 - DNA, 20 bp, Homo sapiens
tgggacttcttacccaaagc

SEQ ID NO: 3328924 - DNA, 16 bp, Homo sapiens
tgggacttgggagctg

SEQ ID NO: 3328925 - DNA, 18 bp, Homo sapiens
tgggagaaggactatcaa

SEQ ID NO: 3328926 - DNA, 20 bp, Homo sapiens
tgggagacaactggacaaga

SEQ ID NO: 3328927 - DNA, 21 bp, Homo sapiens
tgggagacaagaaatccctgt

SEQ ID NO: 3328928 - DNA, 19 bp, Homo sapiens
tgggagacacccaaagggt

SEQ ID NO: 3328929 - DNA, 12 bp, Homo sapiens
tgggagacagac

SEQ ID NO: 3328930 - DNA, 13 bp, Homo sapiens
tgggagacagacc

SEQ ID NO: 3328931 - DNA, 15 bp, Homo sapiens
tgggagacatgtgac

SEQ ID NO: 3328932 - DNA, 16 bp, Homo sapiens
tgggagagcccctggg

SEQ ID NO: 3328933 - DNA, 21 bp, Homo sapiens
tgggagcaaaataaggaagag

SEQ ID NO: 3328934 - DNA, 23 bp, Homo sapiens
tgggagcactggagtgcagggag

SEQ ID NO: 3328935 - DNA, 12 bp, Homo sapiens
tgggagcagaaa

SEQ ID NO: 3328936 - DNA, 15 bp, Homo sapiens
tgggagcagaaacag

SEQ ID NO: 3328937 - DNA, 21 bp, Homo sapiens
tgggagcagaaacagccattg

SEQ ID NO: 3328938 - DNA, 21 bp, Homo sapiens
tgggagcagcggtttggggag

SEQ ID NO: 3328939 - DNA, 23 bp, Homo sapiens
tgggagcaggagattgagaagga

SEQ ID NO: 3328940 - DNA, 17 bp, Homo sapiens
tgggagccacttctccc

SEQ ID NO: 3328941 - DNA, 22 bp, Homo sapiens
tgggagccccagggtcttccct

SEQ ID NO: 3328942 - DNA, 12 bp, Homo sapiens
tgggagcctagc

SEQ ID NO: 3328943 - DNA, 13 bp, Homo sapiens
tgggagcctagct

SEQ ID NO: 3328944 - DNA, 20 bp, Homo sapiens
tgggagcctgcaaactcact

SEQ ID NO: 3328945 - DNA, 22 bp, Homo sapiens
tgggagcgtcagggttggtgtg

SEQ ID NO: 3328946 - DNA, 16 bp, Homo sapiens
tgggagctccactctg

SEQ ID NO: 3328947 - DNA, 22 bp, Homo sapiens
tgggagctccactctgcttctc

SEQ ID NO: 3328948 - DNA, 14 bp, Homo sapiens
tgggagctgagctg

SEQ ID NO: 3328949 - DNA, 15 bp, Homo sapiens
tgggagctgagctgg

SEQ ID NO: 3328950 - DNA, 13 bp, Homo sapiens
tgggagctgcctg

SEQ ID NO: 3328951 - DNA, 22 bp, Homo sapiens
tgggagctgcctgttcagctcc

SEQ ID NO: 3328952 - DNA, 18 bp, Homo sapiens
tgggagctggttagaaat

SEQ ID NO: 3328953 - DNA, 19 bp, Homo sapiens
tgggagctggttagaaatg

SEQ ID NO: 3328954 - DNA, 18 bp, Homo sapiens
tgggagcttccgctttga

SEQ ID NO: 3328955 - DNA, 16 bp, Homo sapiens
tgggagcttggggaga

SEQ ID NO: 3328956 - DNA, 13 bp, Homo sapiens
tggtccctgcctt

SEQ ID NO: 3328957 - DNA, 13 bp, Homo sapiens
tggtccctgggag

SEQ ID NO: 3328958 - DNA, 11 bp, Homo sapiens
tggtccctggt

SEQ ID NO: 3328959 - DNA, 22 bp, Homo sapiens
tggtccctgttttcccacgagg

SEQ ID NO: 3328960 - DNA, 18 bp, Homo sapiens
tggtccgagctgaggact

SEQ ID NO: 3328961 - DNA, 17 bp, Homo sapiens
tggtcctagtaagaaga

SEQ ID NO: 3328962 - DNA, 12 bp, Homo sapiens
tggtcctgactc

SEQ ID NO: 3328963 - DNA, 11 bp, Homo sapiens
tggtcctttct

SEQ ID NO: 3328964 - DNA, 15 bp, Homo sapiens
tggtcctttctggaa

SEQ ID NO: 3328965 - DNA, 15 bp, Homo sapiens
tggtcgctcctgccc

SEQ ID NO: 3328966 - DNA, 18 bp, Homo sapiens
tggtctattttctgcaga

SEQ ID NO: 3328967 - DNA, 16 bp, Homo sapiens
tggtctcaaactcttg

SEQ ID NO: 3328968 - DNA, 17 bp, Homo sapiens
tggtctcaaactcttga

SEQ ID NO: 3328969 - DNA, 20 bp, Homo sapiens
tggtctcgaactcctggcct

SEQ ID NO: 3328970 - DNA, 14 bp, Homo sapiens
tggtctgaatgttc

SEQ ID NO: 3328971 - DNA, 19 bp, Homo sapiens
tggtctgaatgttctgaca

SEQ ID NO: 3328972 - DNA, 17 bp, Homo sapiens
tggtctgggacttcctt

SEQ ID NO: 3328973 - DNA, 22 bp, Homo sapiens
tggtctgtgagatgctagaact

SEQ ID NO: 3328974 - DNA, 14 bp, Homo sapiens
tggtctgttggcag

SEQ ID NO: 3328975 - DNA, 16 bp, Homo sapiens
tggtcttgtggaattg

SEQ ID NO: 3328976 - DNA, 17 bp, Homo sapiens
tggtctttctggagagg

SEQ ID NO: 3328977 - DNA, 14 bp, Homo sapiens
tggtctttgtaaga

SEQ ID NO: 3328978 - DNA, 15 bp, Homo sapiens
tggtctttgtaagag

SEQ ID NO: 3328979 - DNA, 21 bp, Homo sapiens
tggtctttgtaagagtgtaga

SEQ ID NO: 3328980 - DNA, 23 bp, Homo sapiens
tggtctttgtaagagtgtagaag

SEQ ID NO: 3328981 - DNA, 18 bp, Homo sapiens
tggtgaaatttattagtt

SEQ ID NO: 3328982 - DNA, 21 bp, Homo sapiens
tggtgaactgagctgggcagg

SEQ ID NO: 3328983 - DNA, 13 bp, Homo sapiens
tggtgaagagtag

SEQ ID NO: 3328984 - DNA, 18 bp, Homo sapiens
tggtgaataactatgcca

SEQ ID NO: 3328985 - DNA, 19 bp, Homo sapiens
tggtgaatggccttccttc

SEQ ID NO: 3328986 - DNA, 19 bp, Homo sapiens
tggtgacaggccaaaggcc

SEQ ID NO: 3328987 - DNA, 14 bp, Homo sapiens
tggtgacgccccgg

SEQ ID NO: 3328988 - DNA, 13 bp, Homo sapiens
tggtgactgtccc

SEQ ID NO: 3328989 - DNA, 19 bp, Homo sapiens
tggtgactgtcccaccggg

SEQ ID NO: 3328990 - DNA, 19 bp, Homo sapiens
tggtgagagtcaaagctga

SEQ ID NO: 3328991 - DNA, 20 bp, Homo sapiens
tggtgagtcttggcggcagc

SEQ ID NO: 3328992 - DNA, 22 bp, Homo sapiens
tggtgagtcttggcggcagcag

SEQ ID NO: 3328993 - DNA, 13 bp, Homo sapiens
tggtgataagtgg

SEQ ID NO: 3328994 - DNA, 18 bp, Homo sapiens
tggtgatcaattaaatgt

SEQ ID NO: 3328995 - DNA, 15 bp, Homo sapiens
tggtgatctgtagac

SEQ ID NO: 3328996 - DNA, 18 bp, Homo sapiens
tggtgatctgtagacttc

SEQ ID NO: 3328997 - DNA, 19 bp, Homo sapiens
tggtgatttgaaaaatata

SEQ ID NO: 3328998 - DNA, 21 bp, Homo sapiens
tggtgatttgaaaaatataaa

SEQ ID NO: 3328999 - DNA, 14 bp, Homo sapiens
tggtgcaaatccta

SEQ ID NO: 3329000 - DNA, 15 bp, Homo sapiens
tggtgcagacagaag

SEQ ID NO: 3329001 - DNA, 22 bp, Homo sapiens
tggtgcagacagaagtctcctc

SEQ ID NO: 3329002 - DNA, 17 bp, Homo sapiens
tggtgcagagaagctgg

SEQ ID NO: 3329003 - DNA, 18 bp, Homo sapiens
tggtgcatagaactgggt

SEQ ID NO: 3329004 - DNA, 17 bp, Homo sapiens
tggtgcatagcagatgg

SEQ ID NO: 3329005 - DNA, 16 bp, Homo sapiens
tggtgcattacagaga

SEQ ID NO: 3329006 - DNA, 15 bp, Homo sapiens
tggtgccaatttcaa

SEQ ID NO: 3329007 - DNA, 23 bp, Homo sapiens
tggtgccacttcttaaaggcctg

SEQ ID NO: 3329008 - DNA, 17 bp, Homo sapiens
tggtgcccatcctcccg

SEQ ID NO: 3329009 - DNA, 14 bp, Homo sapiens
tggtgcctgagagg

SEQ ID NO: 3329010 - DNA, 17 bp, Homo sapiens
tggtgcctgagaggcag

SEQ ID NO: 3329011 - DNA, 14 bp, Homo sapiens
tggtgcctggcctg

SEQ ID NO: 3329012 - DNA, 18 bp, Homo sapiens
tggtgcctggcctggcac

SEQ ID NO: 3329013 - DNA, 18 bp, Homo sapiens
tggtgcgggcacaataaa

SEQ ID NO: 3329014 - DNA, 15 bp, Homo sapiens
tggtgctatttgaag

SEQ ID NO: 3329015 - DNA, 17 bp, Homo sapiens
tggtgctatttgaagaa

SEQ ID NO: 3329016 - DNA, 20 bp, Homo sapiens
tggtgctatttgaagaaaaa

SEQ ID NO: 3329017 - DNA, 13 bp, Homo sapiens
tggtgctgatgga

SEQ ID NO: 3329018 - DNA, 14 bp, Homo sapiens
tggtgctgatggag

SEQ ID NO: 3329019 - DNA, 18 bp, Homo sapiens
tggtgctgccacacttca

SEQ ID NO: 3329020 - DNA, 18 bp, Homo sapiens
tggtgctggatattttca

SEQ ID NO: 3329021 - DNA, 21 bp, Homo sapiens
tggtgctggatattttcaaat

SEQ ID NO: 3329022 - DNA, 16 bp, Homo sapiens
tggtgcttaagttcca

SEQ ID NO: 3329023 - DNA, 19 bp, Homo sapiens
tggtgcttaagttccagca

SEQ ID NO: 3329024 - DNA, 19 bp, Homo sapiens
tggtgcttccaaatattgt

SEQ ID NO: 3329025 - DNA, 21 bp, Homo sapiens
tggtggaaagcgattcactgt

SEQ ID NO: 3329026 - DNA, 17 bp, Homo sapiens
tggtggacagtcctggg

SEQ ID NO: 3329027 - DNA, 15 bp, Homo sapiens
tggtggatgtaaata

SEQ ID NO: 3329028 - DNA, 17 bp, Homo sapiens
tggtggcactgagcccc

SEQ ID NO: 3329029 - DNA, 19 bp, Homo sapiens
tggtggcactgagcccccc

SEQ ID NO: 3329030 - DNA, 19 bp, Homo sapiens
tggtggcagattttacaaa

SEQ ID NO: 3329031 - DNA, 12 bp, Homo sapiens
tggtggcagctg

SEQ ID NO: 3329032 - DNA, 19 bp, Homo sapiens
tggtggcagtggaggtggg

SEQ ID NO: 3329033 - DNA, 15 bp, Homo sapiens
tggtggcctggtccc

SEQ ID NO: 3329034 - DNA, 13 bp, Homo sapiens
tggtggctgggtt

SEQ ID NO: 3329035 - DNA, 13 bp, Homo sapiens
tggtggctttcct

SEQ ID NO: 3329036 - DNA, 21 bp, Homo sapiens
tggtgggaggggcgcccacct

SEQ ID NO: 3329037 - DNA, 22 bp, Homo sapiens
tggtgggaggggcgcccacctc

SEQ ID NO: 3329038 - DNA, 13 bp, Homo sapiens
tggtggggagggg

SEQ ID NO: 3329039 - DNA, 15 bp, Homo sapiens
tggtggggaggggcg

SEQ ID NO: 3329040 - DNA, 21 bp, Homo sapiens
tggtggggaggggcgctggcc

SEQ ID NO: 3329041 - DNA, 22 bp, Homo sapiens
tggtggggaggggcgctggccc

SEQ ID NO: 3329042 - DNA, 15 bp, Homo sapiens
tggttatgaaagaat

SEQ ID NO: 3329043 - DNA, 12 bp, Homo sapiens
tggttatgaact

SEQ ID NO: 3329044 - DNA, 13 bp, Homo sapiens
tggttattctaag

SEQ ID NO: 3329045 - DNA, 13 bp, Homo sapiens
tggttatttaatc

SEQ ID NO: 3329046 - DNA, 20 bp, Homo sapiens
tggttcagaattaaactttt

SEQ ID NO: 3329047 - DNA, 21 bp, Homo sapiens
tggttcagaattaaactttta

SEQ ID NO: 3329048 - DNA, 19 bp, Homo sapiens
tggttcagctactttccat

SEQ ID NO: 3329049 - DNA, 20 bp, Homo sapiens
tggttcagggttggcccctg

SEQ ID NO: 3329050 - DNA, 23 bp, Homo sapiens
tggttcagggttggcccctgccc

SEQ ID NO: 3329051 - DNA, 19 bp, Homo sapiens
tggttcatatttatacttt

SEQ ID NO: 3329052 - DNA, 16 bp, Homo sapiens
tggttcatcagtgtta

SEQ ID NO: 3329053 - DNA, 12 bp, Homo sapiens
tggttccagggt

SEQ ID NO: 3329054 - DNA, 20 bp, Homo sapiens
tggttcccctgttcactcta

SEQ ID NO: 3329055 - DNA, 23 bp, Homo sapiens
tggttcccctgttcactctactt

SEQ ID NO: 3329056 - DNA, 11 bp, Homo sapiens
tggttcctaag

SEQ ID NO: 3329057 - DNA, 14 bp, Homo sapiens
tggttccttccctg

SEQ ID NO: 3329058 - DNA, 16 bp, Homo sapiens
tggttctatttaatgg

SEQ ID NO: 3329059 - DNA, 12 bp, Homo sapiens
tggttctggcca

SEQ ID NO: 3329060 - DNA, 14 bp, Homo sapiens
tggttcttaaatgt

SEQ ID NO: 3329061 - DNA, 15 bp, Homo sapiens
tggttgatggaaaat

SEQ ID NO: 3329062 - DNA, 18 bp, Homo sapiens
tggttgatggaaaataaa

SEQ ID NO: 3329063 - DNA, 15 bp, Homo sapiens
tggttgatgggttct

SEQ ID NO: 3329064 - DNA, 15 bp, Homo sapiens
tggttgccaccccaa

SEQ ID NO: 3329065 - DNA, 17 bp, Homo sapiens
tggttgccttaaagaaa

SEQ ID NO: 3329066 - DNA, 13 bp, Homo sapiens
tggttgctgtgtg

SEQ ID NO: 3329067 - DNA, 17 bp, Homo sapiens
tggttggaagcctcccc

SEQ ID NO: 3329068 - DNA, 19 bp, Homo sapiens
tggttggggccctgccctg

SEQ ID NO: 3329069 - DNA, 19 bp, Homo sapiens
tggttgggtggcaattcca

SEQ ID NO: 3329070 - DNA, 15 bp, Homo sapiens
tggttgtcaatatta

SEQ ID NO: 3329071 - DNA, 15 bp, Homo sapiens
tggttgtgcacatgc

SEQ ID NO: 3329072 - DNA, 15 bp, Homo sapiens
tggttgtgttgaggt

SEQ ID NO: 3329073 - DNA, 21 bp, Homo sapiens
tggttgttagttatagatgtc

SEQ ID NO: 3329074 - DNA, 16 bp, Homo sapiens
tggtttaaaaagtttc

SEQ ID NO: 3329075 - DNA, 20 bp, Homo sapiens
tggtttaaaaatacatgttc

SEQ ID NO: 3329076 - DNA, 16 bp, Homo sapiens
tggtttaaagaaagtg

SEQ ID NO: 3329077 - DNA, 13 bp, Homo sapiens
tggtttaaataca

SEQ ID NO: 3329078 - DNA, 18 bp, Homo sapiens
tggtttatttttgtaatg

SEQ ID NO: 3329079 - DNA, 22 bp, Homo sapiens
tggtttcaaagtaaaggcctcc

SEQ ID NO: 3329080 - DNA, 21 bp, Homo sapiens
tggtttcacggtgccaggttt

SEQ ID NO: 3329081 - DNA, 16 bp, Homo sapiens
tggtttcactggccca

SEQ ID NO: 3329082 - DNA, 18 bp, Homo sapiens
tggtttcactggcccaag

SEQ ID NO: 3329083 - DNA, 15 bp, Homo sapiens
tggtttcgaactcct

SEQ ID NO: 3329084 - DNA, 16 bp, Homo sapiens
tggtttctagacttgt

SEQ ID NO: 3329085 - DNA, 17 bp, Homo sapiens
tggtttctgaaaatgtt

SEQ ID NO: 3329086 - DNA, 16 bp, Homo sapiens
tggtttgaaagattat

SEQ ID NO: 3329087 - DNA, 13 bp, Homo sapiens
tggtttgccatgt

SEQ ID NO: 3329088 - DNA, 22 bp, Homo sapiens
tggtttgccatgtcgcttttgg

SEQ ID NO: 3329089 - DNA, 11 bp, Homo sapiens
tggtttggaat

SEQ ID NO: 3329090 - DNA, 17 bp, Homo sapiens
tggtttggaatattaaa

SEQ ID NO: 3329091 - DNA, 20 bp, Homo sapiens
tggtttggaatattaaaaaa

SEQ ID NO: 3329092 - DNA, 16 bp, Homo sapiens
tggtttgggaaagatg

SEQ ID NO: 3329093 - DNA, 18 bp, Homo sapiens
tggttttaacaatttcct

SEQ ID NO: 3329094 - DNA, 16 bp, Homo sapiens
tggttttatactgaag

SEQ ID NO: 3329095 - DNA, 17 bp, Homo sapiens
tggttttcaaaataaaa

SEQ ID NO: 3329096 - DNA, 16 bp, Homo sapiens
tggttttcctaaatgc

SEQ ID NO: 3329097 - DNA, 22 bp, Homo sapiens
tggttttcctaaatgcagtgaa

SEQ ID NO: 3329098 - DNA, 13 bp, Homo sapiens
tggttttctgcca

SEQ ID NO: 3329099 - DNA, 18 bp, Homo sapiens
tggttttctgccaatgac

SEQ ID NO: 3329100 - DNA, 21 bp, Homo sapiens
tggttttctgccaatgaccaa

SEQ ID NO: 3329101 - DNA, 18 bp, Homo sapiens
tggttttgtaagatgctg

SEQ ID NO: 3329102 - DNA, 16 bp, Homo sapiens
tggttttgtacactgc

SEQ ID NO: 3329103 - DNA, 20 bp, Homo sapiens
tggttttgtacactgctgta

SEQ ID NO: 3329104 - DNA, 21 bp, Homo sapiens
tggttttgtacactgctgtac

SEQ ID NO: 3329105 - DNA, 15 bp, Homo sapiens
tggtttttttaagta

SEQ ID NO: 3329106 - DNA, 17 bp, Homo sapiens
tgtaaaaaagaaaaaca

SEQ ID NO: 3329107 - DNA, 16 bp, Homo sapiens
tgtaaaaacactgaaa

SEQ ID NO: 3329108 - DNA, 12 bp, Homo sapiens
tgtaaaaagaaa

SEQ ID NO: 3329109 - DNA, 23 bp, Homo sapiens
tgtaaaaatatactgattttgaa

SEQ ID NO: 3329110 - DNA, 12 bp, Homo sapiens
tgtaaaaatctt

SEQ ID NO: 3329111 - DNA, 23 bp, Homo sapiens
tgtaaaaatcttttgaagcatag

SEQ ID NO: 3329112 - DNA, 14 bp, Homo sapiens
tgtaaaactcgctt

SEQ ID NO: 3329113 - DNA, 17 bp, Homo sapiens
tgtaaaagtagtaaatt

SEQ ID NO: 3329114 - DNA, 15 bp, Homo sapiens
tgtaaaatgaaatta

SEQ ID NO: 3329115 - DNA, 17 bp, Homo sapiens
tgtaaaatgttgaataa

SEQ ID NO: 3329116 - DNA, 19 bp, Homo sapiens
tgtaaaattataaactttt

SEQ ID NO: 3329117 - DNA, 15 bp, Homo sapiens
tgtaaacaaactctt

SEQ ID NO: 3329118 - DNA, 18 bp, Homo sapiens
tgtaaacacagtcaaaat

SEQ ID NO: 3329119 - DNA, 16 bp, Homo sapiens
tgtaaaccattgtaac

SEQ ID NO: 3329120 - DNA, 21 bp, Homo sapiens
tgtaaaccattgtaactatta

SEQ ID NO: 3329121 - DNA, 19 bp, Homo sapiens
tgtaaacctgagtcgtaca

SEQ ID NO: 3329122 - DNA, 13 bp, Homo sapiens
tgtaaactgccat

SEQ ID NO: 3329123 - DNA, 19 bp, Homo sapiens
tgtaaactgtactagtctg

SEQ ID NO: 3329124 - DNA, 21 bp, Homo sapiens
tgtaaactgtactagtctgtg

SEQ ID NO: 3329125 - DNA, 23 bp, Homo sapiens
tgtaaactgtactagtctgtgtg

SEQ ID NO: 3329126 - DNA, 22 bp, Homo sapiens
tgtaaactgtgtattccaagac

SEQ ID NO: 3329127 - DNA, 15 bp, Homo sapiens
tgtaaacttctgaag

SEQ ID NO: 3329128 - DNA, 12 bp, Homo sapiens
tgtaaagactgg

SEQ ID NO: 3329129 - DNA, 11 bp, Homo sapiens
tgtaaagatgt

SEQ ID NO: 3329130 - DNA, 12 bp, Homo sapiens
tgtaaagctggc

SEQ ID NO: 3329131 - DNA, 13 bp, Homo sapiens
tgtaaagctggcc

SEQ ID NO: 3329132 - DNA, 14 bp, Homo sapiens
tgtaaagctggccc

SEQ ID NO: 3329133 - DNA, 14 bp, Homo sapiens
tgtaaaggagggag

SEQ ID NO: 3329134 - DNA, 16 bp, Homo sapiens
tgtaaaggagtcaaaa

SEQ ID NO: 3329135 - DNA, 15 bp, Homo sapiens
tgtatgactaaagag

SEQ ID NO: 3329136 - DNA, 20 bp, Homo sapiens
tgtatgactaaagagagaat

SEQ ID NO: 3329137 - DNA, 18 bp, Homo sapiens
tgtatgagatggttaaaa

SEQ ID NO: 3329138 - DNA, 20 bp, Homo sapiens
tgtatgagatggttaaaaag

SEQ ID NO: 3329139 - DNA, 16 bp, Homo sapiens
tgtatgagtagccagg

SEQ ID NO: 3329140 - DNA, 12 bp, Homo sapiens
tgtatgattact

SEQ ID NO: 3329141 - DNA, 16 bp, Homo sapiens
tgtatgccaagtgaga

SEQ ID NO: 3329142 - DNA, 19 bp, Homo sapiens
tgtatgccacacctggcct

SEQ ID NO: 3329143 - DNA, 22 bp, Homo sapiens
tgtatgcctttaaatctgtgat

SEQ ID NO: 3329144 - DNA, 14 bp, Homo sapiens
tgtatgctgatcat

SEQ ID NO: 3329145 - DNA, 20 bp, Homo sapiens
tgtatgctgatgatcaaaac

SEQ ID NO: 3329146 - DNA, 15 bp, Homo sapiens
tgtatggaaacactg

SEQ ID NO: 3329147 - DNA, 20 bp, Homo sapiens
tgtatggaaacactgatttt

SEQ ID NO: 3329148 - DNA, 13 bp, Homo sapiens
tgtatggggaggc

SEQ ID NO: 3329149 - DNA, 22 bp, Homo sapiens
tgtatgggtagggtaaatcagt

SEQ ID NO: 3329150 - DNA, 17 bp, Homo sapiens
tgtatgtacttagctgt

SEQ ID NO: 3329151 - DNA, 21 bp, Homo sapiens
tgtatgtacttagctgtacta

SEQ ID NO: 3329152 - DNA, 20 bp, Homo sapiens
tgtcagcgttctaccaggca

SEQ ID NO: 3329153 - DNA, 18 bp, Homo sapiens
tgtcagctactaatgatg

SEQ ID NO: 3329154 - DNA, 21 bp, Homo sapiens
tgtcagctactaatgatgttt

SEQ ID NO: 3329155 - DNA, 22 bp, Homo sapiens
tgtcagctgcaaggtactctgg

SEQ ID NO: 3329156 - DNA, 14 bp, Homo sapiens
tgtcaggagagcag

SEQ ID NO: 3329157 - DNA, 21 bp, Homo sapiens
tgtcaggcctctgagcccaag

SEQ ID NO: 3329158 - DNA, 12 bp, Homo sapiens
tgtcaggctctg

SEQ ID NO: 3329159 - DNA, 17 bp, Homo sapiens
tgtcagtatttcaactg

SEQ ID NO: 3329160 - DNA, 20 bp, Homo sapiens
tgtcagtatttcaactgctg

SEQ ID NO: 3329161 - DNA, 21 bp, Homo sapiens
tgtcataaacagatgaataaa

SEQ ID NO: 3329162 - DNA, 16 bp, Homo sapiens
tgtcataagaatgaat

SEQ ID NO: 3329163 - DNA, 16 bp, Homo sapiens
tgtcataagtaaacct

SEQ ID NO: 3329164 - DNA, 16 bp, Homo sapiens
tgtcatatactgccat

SEQ ID NO: 3329165 - DNA, 17 bp, Homo sapiens
tgtcatatactgccatg

SEQ ID NO: 3329166 - DNA, 14 bp, Homo sapiens
tgtcatcaaatatt

SEQ ID NO: 3329167 - DNA, 19 bp, Homo sapiens
tgtcatcaaatattaccaa

SEQ ID NO: 3329168 - DNA, 22 bp, Homo sapiens
tgtcatcaattgaatggtcagc

SEQ ID NO: 3329169 - DNA, 17 bp, Homo sapiens
tgtcatcactccctgga

SEQ ID NO: 3329170 - DNA, 20 bp, Homo sapiens
tgtcatcactccctggatgt

SEQ ID NO: 3329171 - DNA, 15 bp, Homo sapiens
tgtcatcagaagata

SEQ ID NO: 3329172 - DNA, 18 bp, Homo sapiens
tgtcatcagagctcctct

SEQ ID NO: 3329173 - DNA, 20 bp, Homo sapiens
tgtcatcagagctcctctgt

SEQ ID NO: 3329174 - DNA, 22 bp, Homo sapiens
tgtcatcctcaaagaaagtgta

SEQ ID NO: 3329175 - DNA, 23 bp, Homo sapiens
tgtcatccttggtctttgtatct

SEQ ID NO: 3329176 - DNA, 13 bp, Homo sapiens
tgtcatctgagga

SEQ ID NO: 3329177 - DNA, 16 bp, Homo sapiens
tgtcatgaacatgttc

SEQ ID NO: 3329178 - DNA, 19 bp, Homo sapiens
tgtcatgaattcttatgct

SEQ ID NO: 3329179 - DNA, 21 bp, Homo sapiens
tgtcatgaattcttatgctta

SEQ ID NO: 3329180 - DNA, 15 bp, Homo sapiens
tgtcatgcccccctc

SEQ ID NO: 3329181 - DNA, 16 bp, Homo sapiens
tgtcatgcccccctca

SEQ ID NO: 3329182 - DNA, 17 bp, Homo sapiens
tgtcatgcttcatcatt

SEQ ID NO: 3329183 - DNA, 20 bp, Homo sapiens
tgtcatggtcctttctggaa

SEQ ID NO: 3329184 - DNA, 18 bp, Homo sapiens
tgtcatgtttattctaat

SEQ ID NO: 3329185 - DNA, 12 bp, Homo sapiens
tgtcattatatt

SEQ ID NO: 3329186 - DNA, 16 bp, Homo sapiens
tgtcattatattctaa

SEQ ID NO: 3329187 - DNA, 14 bp, Homo sapiens
tgtcattggaagcc

SEQ ID NO: 3329188 - DNA, 20 bp, Homo sapiens
tgtccaagttcttcacctct

SEQ ID NO: 3329189 - DNA, 21 bp, Homo sapiens
tgtccaagttcttcacctcta

SEQ ID NO: 3329190 - DNA, 15 bp, Homo sapiens
tgtccacacccagct

SEQ ID NO: 3329191 - DNA, 18 bp, Homo sapiens
tgtccacacccagctcag

SEQ ID NO: 3329192 - DNA, 20 bp, Homo sapiens
tgtccacagagtttttcagg

SEQ ID NO: 3329193 - DNA, 18 bp, Homo sapiens
tgtccactctcggggccc

SEQ ID NO: 3329194 - DNA, 20 bp, Homo sapiens
tgtccagaagaatattcagg

SEQ ID NO: 3329195 - DNA, 13 bp, Homo sapiens
tgtccagcagctg

SEQ ID NO: 3329196 - DNA, 15 bp, Homo sapiens
tgtccagcagctgcg

SEQ ID NO: 3329197 - DNA, 12 bp, Homo sapiens
tgtccagcctgg

SEQ ID NO: 3329198 - DNA, 21 bp, Homo sapiens
tgtccaggccactgtggccag

SEQ ID NO: 3329199 - DNA, 11 bp, Homo sapiens
tgtccatccct

SEQ ID NO: 3329200 - DNA, 20 bp, Homo sapiens
tgtccatcccttttcctgtc

SEQ ID NO: 3329201 - DNA, 18 bp, Homo sapiens
tgtccatgcgctcagggc

SEQ ID NO: 3329202 - DNA, 20 bp, Homo sapiens
tgtccatgcgctcagggcca

SEQ ID NO: 3329203 - DNA, 22 bp, Homo sapiens
tgtccatgcgctcagggccatg

SEQ ID NO: 3329204 - DNA, 15 bp, Homo sapiens
tgtccatggcctttc

SEQ ID NO: 3329205 - DNA, 17 bp, Homo sapiens
tgtccatggcctttcta

SEQ ID NO: 3329206 - DNA, 20 bp, Homo sapiens
tgtccatgtggttcttcaaa

SEQ ID NO: 3329207 - DNA, 16 bp, Homo sapiens
tgtcccaacttgtaaa

SEQ ID NO: 3329208 - DNA, 15 bp, Homo sapiens
tgtcccaaggagctg

SEQ ID NO: 3329209 - DNA, 18 bp, Homo sapiens
tgtcccacccccaccccc

SEQ ID NO: 3329210 - DNA, 22 bp, Homo sapiens
tgtcccacccccacccccagct

SEQ ID NO: 3329211 - DNA, 20 bp, Homo sapiens
tgtcccacccccttccccca

SEQ ID NO: 3329212 - DNA, 16 bp, Homo sapiens
tgtcccaccttgacca

SEQ ID NO: 3329213 - DNA, 17 bp, Homo sapiens
tgtcccacgtgtcttcc

SEQ ID NO: 3329214 - DNA, 21 bp, Homo sapiens
tgtcccacgtgtcttccactt

SEQ ID NO: 3329215 - DNA, 19 bp, Homo sapiens
tgtcccacttctcatctta

SEQ ID NO: 3329216 - DNA, 15 bp, Homo sapiens
tgtcccagcctgggg

SEQ ID NO: 3329217 - DNA, 23 bp, Homo sapiens
tgtcccagcctggggctccctct

SEQ ID NO: 3329218 - DNA, 12 bp, Homo sapiens
tgtcccaggcag

SEQ ID NO: 3329219 - DNA, 20 bp, Homo sapiens
tgtcccaggcagcacagtgt

SEQ ID NO: 3329220 - DNA, 18 bp, Homo sapiens
tgtcccagggccctggat

SEQ ID NO: 3329221 - DNA, 16 bp, Homo sapiens
tgtcccaggtcctcac

SEQ ID NO: 3329222 - DNA, 19 bp, Homo sapiens
tgtcccatgacccacccct

SEQ ID NO: 3329223 - DNA, 16 bp, Homo sapiens
tgtcccatgatccctg

SEQ ID NO: 3329224 - DNA, 17 bp, Homo sapiens
tgtcccatgatccctgt

SEQ ID NO: 3329225 - DNA, 17 bp, Homo sapiens
tgtcccatgcaggccct

SEQ ID NO: 3329226 - DNA, 18 bp, Homo sapiens
tgtcccatggacactcca

SEQ ID NO: 3329227 - DNA, 15 bp, Homo sapiens
tgtccccagccctgt

SEQ ID NO: 3329228 - DNA, 21 bp, Homo sapiens
tgtccccagccctgtcctggt

SEQ ID NO: 3329229 - DNA, 12 bp, Homo sapiens
tgtccccagggc

SEQ ID NO: 3329230 - DNA, 13 bp, Homo sapiens
tgtcccccaaggt

SEQ ID NO: 3329231 - DNA, 13 bp, Homo sapiens
tgtcccccagctc

SEQ ID NO: 3329232 - DNA, 18 bp, Homo sapiens
tgtccccctcccctccca

SEQ ID NO: 3329233 - DNA, 15 bp, Homo sapiens
tgtcccctcactctg

SEQ ID NO: 3329234 - DNA, 23 bp, Homo sapiens
tgtcccctcactctgtcagccag

SEQ ID NO: 3329235 - DNA, 14 bp, Homo sapiens
tgtcccctctgtca

SEQ ID NO: 3329236 - DNA, 19 bp, Homo sapiens
tgtcccggggtcctgtggc

SEQ ID NO: 3329237 - DNA, 21 bp, Homo sapiens
tgtcccggggtcctgtggcag

SEQ ID NO: 3329238 - DNA, 22 bp, Homo sapiens
tgtccctaagtaagtttcttcc

SEQ ID NO: 3329239 - DNA, 17 bp, Homo sapiens
tgtccctatgcatatca

SEQ ID NO: 3329240 - DNA, 16 bp, Homo sapiens
tgtccctcccacctct

SEQ ID NO: 3329241 - DNA, 17 bp, Homo sapiens
tgtccctcccacctctg

SEQ ID NO: 3329242 - DNA, 20 bp, Homo sapiens
tgtccctcccacctctgtga

SEQ ID NO: 3329243 - DNA, 21 bp, Homo sapiens
tgtccctctcggaaggctggc

SEQ ID NO: 3329244 - DNA, 20 bp, Homo sapiens
tgtccctgcacttgcagact

SEQ ID NO: 3329245 - DNA, 22 bp, Homo sapiens
tgtccctgcacttgcagactct

SEQ ID NO: 3329246 - DNA, 23 bp, Homo sapiens
tgtccctgcacttgcagactcta

SEQ ID NO: 3329247 - DNA, 14 bp, Homo sapiens
tgtccctgcagggc

SEQ ID NO: 3329248 - DNA, 15 bp, Homo sapiens
tgtccctggacacag

SEQ ID NO: 3329249 - DNA, 21 bp, Homo sapiens
tgtccctggacacagctcttc

SEQ ID NO: 3329250 - DNA, 22 bp, Homo sapiens
tgtccctggacacagctcttca

SEQ ID NO: 3329251 - DNA, 19 bp, Homo sapiens
tgtccctgtccccctcccc

SEQ ID NO: 3329252 - DNA, 22 bp, Homo sapiens
tgtcccttgcctcaatgccagt

SEQ ID NO: 3329253 - DNA, 12 bp, Homo sapiens
tgtcccttgctg

SEQ ID NO: 3329254 - DNA, 17 bp, Homo sapiens
tgtccctttccctacct

SEQ ID NO: 3329255 - DNA, 19 bp, Homo sapiens
tgtcccttttaatataaaa

SEQ ID NO: 3329256 - DNA, 21 bp, Homo sapiens
tgtcccttttgcataagatta

SEQ ID NO: 3329257 - DNA, 13 bp, Homo sapiens
tgtccgagaacta

SEQ ID NO: 3329258 - DNA, 20 bp, Homo sapiens
tgtccgctgggtggtaccct

SEQ ID NO: 3329259 - DNA, 23 bp, Homo sapiens
tgtccgctgggtggtaccctctg

SEQ ID NO: 3329260 - DNA, 19 bp, Homo sapiens
tgtccggcccagtgccact

SEQ ID NO: 3329261 - DNA, 22 bp, Homo sapiens
tgtcctaaaacacctggtagga

SEQ ID NO: 3329262 - DNA, 16 bp, Homo sapiens
tgtcctaagagattta

SEQ ID NO: 3329263 - DNA, 16 bp, Homo sapiens
tgtcctaaggacacac

SEQ ID NO: 3329264 - DNA, 20 bp, Homo sapiens
tgtcctaaggacacactaat

SEQ ID NO: 3329265 - DNA, 20 bp, Homo sapiens
tgtcctaattcttctgtcct

SEQ ID NO: 3329266 - DNA, 20 bp, Homo sapiens
tgtcctaccagttgccctag

SEQ ID NO: 3329267 - DNA, 20 bp, Homo sapiens
tgtcctacccaccctccttt

SEQ ID NO: 3329268 - DNA, 22 bp, Homo sapiens
tgtacaagagtccctttgaaga

SEQ ID NO: 3329269 - DNA, 15 bp, Homo sapiens
tgtacaaggatgaaa

SEQ ID NO: 3329270 - DNA, 17 bp, Homo sapiens
tgtacaaggatgaaaga

SEQ ID NO: 3329271 - DNA, 23 bp, Homo sapiens
tgtacaagttgttattgttgaac

SEQ ID NO: 3329272 - DNA, 22 bp, Homo sapiens
tgtacaatcatgaacagctctg

SEQ ID NO: 3329273 - DNA, 14 bp, Homo sapiens
tgtacaattaagtt

SEQ ID NO: 3329274 - DNA, 19 bp, Homo sapiens
tgtacaattactaaattgt

SEQ ID NO: 3329275 - DNA, 22 bp, Homo sapiens
tgtacaattactaaattgtata

SEQ ID NO: 3329276 - DNA, 14 bp, Homo sapiens
tgtacacactttat

SEQ ID NO: 3329277 - DNA, 20 bp, Homo sapiens
tgtacacattcctgcattca

SEQ ID NO: 3329278 - DNA, 16 bp, Homo sapiens
tgtacacgtgtcctgt

SEQ ID NO: 3329279 - DNA, 15 bp, Homo sapiens
tgtacactaacattt

SEQ ID NO: 3329280 - DNA, 14 bp, Homo sapiens
tgtacactgctgta

SEQ ID NO: 3329281 - DNA, 20 bp, Homo sapiens
tgtacactgctgtacccaga

SEQ ID NO: 3329282 - DNA, 21 bp, Homo sapiens
tgtacagaaaagggcggcttc

SEQ ID NO: 3329283 - DNA, 23 bp, Homo sapiens
tgtacagaatatttctattgaat

SEQ ID NO: 3329284 - DNA, 18 bp, Homo sapiens
tgtacagaccacctttca

SEQ ID NO: 3329285 - DNA, 20 bp, Homo sapiens
tgtacagaccacctttcaca

SEQ ID NO: 3329286 - DNA, 21 bp, Homo sapiens
tgtacagaccacctttcacaa

SEQ ID NO: 3329287 - DNA, 19 bp, Homo sapiens
tgtacagattctttcagtt

SEQ ID NO: 3329288 - DNA, 17 bp, Homo sapiens
tgtacagcgttttaaaa

SEQ ID NO: 3329289 - DNA, 15 bp, Homo sapiens
tgtacagctctcccc

SEQ ID NO: 3329290 - DNA, 16 bp, Homo sapiens
tgtacagctggtgctt

SEQ ID NO: 3329291 - DNA, 17 bp, Homo sapiens
tgtacaggactgtaaag

SEQ ID NO: 3329292 - DNA, 18 bp, Homo sapiens
tgtacagtagattttcca

SEQ ID NO: 3329293 - DNA, 18 bp, Homo sapiens
tgtacagtctgtcatgaa

SEQ ID NO: 3329294 - DNA, 23 bp, Homo sapiens
tgctcatattgtgattctgcctt

SEQ ID NO: 3329295 - DNA, 13 bp, Homo sapiens
tgctcatctgctg

SEQ ID NO: 3329296 - DNA, 15 bp, Homo sapiens
tgctcatctgctggt

SEQ ID NO: 3329297 - DNA, 16 bp, Homo sapiens
tgctccaagattctag

SEQ ID NO: 3329298 - DNA, 17 bp, Homo sapiens
tgctccaagattctaga

SEQ ID NO: 3329299 - DNA, 16 bp, Homo sapiens
tgctgagctgggccca

SEQ ID NO: 3329300 - DNA, 14 bp, Homo sapiens
tgctgagcttagcc

SEQ ID NO: 3329301 - DNA, 15 bp, Homo sapiens
tgctgagcttagcct

SEQ ID NO: 3329302 - DNA, 18 bp, Homo sapiens
tgctgagcttagccttgt

SEQ ID NO: 3329303 - DNA, 21 bp, Homo sapiens
tgctgagcttagccttgtgcc

SEQ ID NO: 3329304 - DNA, 24 bp, Homo sapiens
tgctgagcttagccttgtgccctg

SEQ ID NO: 3329305 - DNA, 20 bp, Homo sapiens
tgctgaggatataagctttt

SEQ ID NO: 3329306 - DNA, 12 bp, Homo sapiens
tgctgagggtgt

SEQ ID NO: 3329307 - DNA, 22 bp, Homo sapiens
tgctgagggtgtttcttcctgc

SEQ ID NO: 3329308 - DNA, 17 bp, Homo sapiens
tgctgagggtttgaata

SEQ ID NO: 3329309 - DNA, 21 bp, Homo sapiens
tgctgagtatgttaagctctt

SEQ ID NO: 3329310 - DNA, 15 bp, Homo sapiens
tgctgagtctcccaa

SEQ ID NO: 3329311 - DNA, 16 bp, Homo sapiens
tgctgagttgttctaa

SEQ ID NO: 3329312 - DNA, 13 bp, Homo sapiens
tgctgataaaata

SEQ ID NO: 3329313 - DNA, 21 bp, Homo sapiens
tgctgatcatcgccagaggtg

SEQ ID NO: 3329314 - DNA, 23 bp, Homo sapiens
tgctgatcatcgccagaggtgct

SEQ ID NO: 3329315 - DNA, 15 bp, Homo sapiens
tgctgatcgtagaaa

SEQ ID NO: 3329316 - DNA, 14 bp, Homo sapiens
tgctgatgaatcac

SEQ ID NO: 3329317 - DNA, 20 bp, Homo sapiens
tgctgatgacctcaagtagc

SEQ ID NO: 3329318 - DNA, 17 bp, Homo sapiens
tgctgatggagccttcc

SEQ ID NO: 3329319 - DNA, 16 bp, Homo sapiens
tgctgatggagggagg

SEQ ID NO: 3329320 - DNA, 23 bp, Homo sapiens
tgctgatggcttgacatgtgcaa

SEQ ID NO: 3329321 - DNA, 15 bp, Homo sapiens
tgctgatgtcaaagt

SEQ ID NO: 3329322 - DNA, 22 bp, Homo sapiens
tgctgatgtcaaagtgtaacag

SEQ ID NO: 3329323 - DNA, 19 bp, Homo sapiens
tgctgatttcccctcttcc

SEQ ID NO: 3329324 - DNA, 19 bp, Homo sapiens
tgctgcaagcacagccctt

SEQ ID NO: 3329325 - DNA, 14 bp, Homo sapiens
tgctgcaccagagt

SEQ ID NO: 3329326 - DNA, 14 bp, Homo sapiens
tgctgcacccaact

SEQ ID NO: 3329327 - DNA, 19 bp, Homo sapiens
tgctgcacccaactactga

SEQ ID NO: 3329328 - DNA, 24 bp, Homo sapiens
tgctgcacccaactactgagctga

SEQ ID NO: 3329329 - DNA, 17 bp, Homo sapiens
tgctgcaggggctctgg

SEQ ID NO: 3329330 - DNA, 19 bp, Homo sapiens
tgctgcaggggctctggag

SEQ ID NO: 3329331 - DNA, 18 bp, Homo sapiens
tgctgcagtcatctactt

SEQ ID NO: 3329332 - DNA, 23 bp, Homo sapiens
tgctgcatcttatagcactttga

SEQ ID NO: 3329333 - DNA, 19 bp, Homo sapiens
tgctgccacacttcaggct

SEQ ID NO: 3329334 - DNA, 14 bp, Homo sapiens
tgctgccatccagg

SEQ ID NO: 3329335 - DNA, 15 bp, Homo sapiens
tgctgccatgccact

SEQ ID NO: 3329336 - DNA, 21 bp, Homo sapiens
tgctgccatgccactgccagg

SEQ ID NO: 3329337 - DNA, 19 bp, Homo sapiens
tgctgccattacagaggta

SEQ ID NO: 3329338 - DNA, 16 bp, Homo sapiens
tgctgcccagcctcca

SEQ ID NO: 3329339 - DNA, 14 bp, Homo sapiens
tgctgcccaggcca

SEQ ID NO: 3329340 - DNA, 16 bp, Homo sapiens
tgctgcccaggccaca

SEQ ID NO: 3329341 - DNA, 18 bp, Homo sapiens
tgctgcccaggccacagc

SEQ ID NO: 3329342 - DNA, 15 bp, Homo sapiens
tgctgccccagctga

SEQ ID NO: 3329343 - DNA, 20 bp, Homo sapiens
tgctgccccgttccctgtca

SEQ ID NO: 3329344 - DNA, 23 bp, Homo sapiens
tgctgcccgcgggagacagcttc

SEQ ID NO: 3329345 - DNA, 17 bp, Homo sapiens
tgctgccgcctcccagc

SEQ ID NO: 3329346 - DNA, 14 bp, Homo sapiens
tgctgcctgaatcc

SEQ ID NO: 3329347 - DNA, 21 bp, Homo sapiens
tgctgcctgcccgcacagcag

SEQ ID NO: 3329348 - DNA, 20 bp, Homo sapiens
tgctgccttgctcctagcag

SEQ ID NO: 3329349 - DNA, 17 bp, Homo sapiens
tgctgcgcaccaatgcc

SEQ ID NO: 3329350 - DNA, 22 bp, Homo sapiens
tgctgcgcaccaatgcccagca

SEQ ID NO: 3329351 - DNA, 14 bp, Homo sapiens
tgctgcgtccccac

SEQ ID NO: 3329352 - DNA, 18 bp, Homo sapiens
tgctgctaccgccctggg

SEQ ID NO: 3329353 - DNA, 22 bp, Homo sapiens
tgctgctaccgccctgggctgg

SEQ ID NO: 3329354 - DNA, 14 bp, Homo sapiens
tgctgctactgtct

SEQ ID NO: 3329355 - DNA, 15 bp, Homo sapiens
tgctgctagaacttt

SEQ ID NO: 3329356 - DNA, 16 bp, Homo sapiens
tgctgctccaccctcc

SEQ ID NO: 3329357 - DNA, 21 bp, Homo sapiens
tgctgctccaccctcccccag

SEQ ID NO: 3329358 - DNA, 19 bp, Homo sapiens
tgctgctctcccctcccag

SEQ ID NO: 3329359 - DNA, 22 bp, Homo sapiens
tgctgctctcccctcccagtct

SEQ ID NO: 3329360 - DNA, 22 bp, Homo sapiens
tgctgctgcacccaactactga

SEQ ID NO: 3329361 - DNA, 14 bp, Homo sapiens
tgctgctgctgcac

SEQ ID NO: 3329362 - DNA, 14 bp, Homo sapiens
tgctgctgtaaata

SEQ ID NO: 3329363 - DNA, 16 bp, Homo sapiens
tgctgctgtaaataca

SEQ ID NO: 3329364 - DNA, 11 bp, Homo sapiens
tgctgcttctc

SEQ ID NO: 3329365 - DNA, 20 bp, Homo sapiens
tgctgcttctcctcccagcg

SEQ ID NO: 3329366 - DNA, 22 bp, Homo sapiens
tgctgcttctcctcccagcgtg

SEQ ID NO: 3329367 - DNA, 18 bp, Homo sapiens
tgctgctttcccctgtgg

SEQ ID NO: 3329368 - DNA, 21 bp, Homo sapiens
tgctgctttcccctgtgggga

SEQ ID NO: 3329369 - DNA, 17 bp, Homo sapiens
tgctggaattctaacaa

SEQ ID NO: 3329370 - DNA, 15 bp, Homo sapiens
tgctggacagagact

SEQ ID NO: 3329371 - DNA, 20 bp, Homo sapiens
tgctggacggggactgggga

SEQ ID NO: 3329372 - DNA, 14 bp, Homo sapiens
tgctggactgtcat

SEQ ID NO: 3329373 - DNA, 15 bp, Homo sapiens
tgctggactgtcata

SEQ ID NO: 3329374 - DNA, 22 bp, Homo sapiens
tgctggactgttccaggccctc

SEQ ID NO: 3329375 - DNA, 14 bp, Homo sapiens
tgctggagaggtta

SEQ ID NO: 3329376 - DNA, 16 bp, Homo sapiens
tgctggaggtgggagc

SEQ ID NO: 3329377 - DNA, 22 bp, Homo sapiens
tgctggaggtgggagcaggaga

SEQ ID NO: 3329378 - DNA, 23 bp, Homo sapiens
tgctggaggtgggagcaggagat

SEQ ID NO: 3329379 - DNA, 17 bp, Homo sapiens
tgctggataaaatgagg

SEQ ID NO: 3329380 - DNA, 16 bp, Homo sapiens
tgctggatattttcaa

SEQ ID NO: 3329381 - DNA, 22 bp, Homo sapiens
tgctggatattttcaaattgta

SEQ ID NO: 3329382 - DNA, 19 bp, Homo sapiens
tgctggatccggtctgcct

SEQ ID NO: 3329383 - DNA, 15 bp, Homo sapiens
tgctggattaatgtt

SEQ ID NO: 3329384 - DNA, 22 bp, Homo sapiens
tgctggattgtccttggaggaa

SEQ ID NO: 3329385 - DNA, 18 bp, Homo sapiens
tgctggcatcaagaggtg

SEQ ID NO: 3329386 - DNA, 15 bp, Homo sapiens
tgctggccagcaccc

SEQ ID NO: 3329387 - DNA, 16 bp, Homo sapiens
tgctggccagcaccct

SEQ ID NO: 3329388 - DNA, 13 bp, Homo sapiens
tgctggccccagc

SEQ ID NO: 3329389 - DNA, 19 bp, Homo sapiens
tgctggccccagccctgct

SEQ ID NO: 3329390 - DNA, 21 bp, Homo sapiens
tgctggccccagccctgctgg

SEQ ID NO: 3329391 - DNA, 11 bp, Homo sapiens
tgctggccccc

SEQ ID NO: 3329392 - DNA, 16 bp, Homo sapiens
tgctggcctggatctc

SEQ ID NO: 3329393 - DNA, 14 bp, Homo sapiens
tgctggcctttgct

SEQ ID NO: 3329394 - DNA, 17 bp, Homo sapiens
tgctggctctgagaatc

SEQ ID NO: 3329395 - DNA, 13 bp, Homo sapiens
tgctggctgccca

SEQ ID NO: 3329396 - DNA, 21 bp, Homo sapiens
tgctggctgcccagacccctc

SEQ ID NO: 3329397 - DNA, 20 bp, Homo sapiens
tgctgggaaccccgcagccc

SEQ ID NO: 3329398 - DNA, 21 bp, Homo sapiens
tgctgggaaccccgcagcccg

SEQ ID NO: 3329399 - DNA, 17 bp, Homo sapiens
tgctgggaccagagcca

SEQ ID NO: 3329400 - DNA, 19 bp, Homo sapiens
tgctgggaccagagccaga

SEQ ID NO: 3329401 - DNA, 22 bp, Homo sapiens
tgctgggaccagagccagatgc

SEQ ID NO: 3329402 - DNA, 22 bp, Homo sapiens
tgctgggactcagccttcagac

SEQ ID NO: 3329403 - DNA, 23 bp, Homo sapiens
tgctgggactcagccttcagaca

SEQ ID NO: 3329404 - DNA, 17 bp, Homo sapiens
tgctgggactggccagg

SEQ ID NO: 3329405 - DNA, 18 bp, Homo sapiens
tgctgggaggactggacc

SEQ ID NO: 3329406 - DNA, 17 bp, Homo sapiens
tgctgggaggagggaga

SEQ ID NO: 3329407 - DNA, 17 bp, Homo sapiens
tgctgggagttctagaa

SEQ ID NO: 3329408 - DNA, 21 bp, Homo sapiens
tgctgggatgtgtgctttccc

SEQ ID NO: 3329409 - DNA, 19 bp, Homo sapiens
tgctgggattacaagcgtg

SEQ ID NO: 3329410 - DNA, 21 bp, Homo sapiens
tgctgggattacaagcgtgag

SEQ ID NO: 3329411 - DNA, 17 bp, Homo sapiens
tgctgggattacaggtg

SEQ ID NO: 3329412 - DNA, 14 bp, Homo sapiens
tgctgggatttcca

SEQ ID NO: 3329413 - DNA, 17 bp, Homo sapiens
tgctgggccactgggga

SEQ ID NO: 3329414 - DNA, 14 bp, Homo sapiens
tgctgggctgggcc

SEQ ID NO: 3329415 - DNA, 23 bp, Homo sapiens
tgctggggcaagtccctgactct

SEQ ID NO: 3329416 - DNA, 20 bp, Homo sapiens
tgctggggcatgtgtgcctg

SEQ ID NO: 3329417 - DNA, 17 bp, Homo sapiens
tgctggggcctcagacg

SEQ ID NO: 3329418 - DNA, 15 bp, Homo sapiens
tgctgggggaatgag

SEQ ID NO: 3329419 - DNA, 23 bp, Homo sapiens
tgctgggggaatgagcccagaga

SEQ ID NO: 3329420 - DNA, 16 bp, Homo sapiens
tgctgggttggtgcac

SEQ ID NO: 3329421 - DNA, 19 bp, Homo sapiens
tgctgggttggtgcacagt

SEQ ID NO: 3329422 - DNA, 23 bp, Homo sapiens
tgctgggttggtgcacagtgatt

SEQ ID NO: 3329423 - DNA, 16 bp, Homo sapiens
tgctggtaacagtggc

SEQ ID NO: 3329424 - DNA, 19 bp, Homo sapiens
tggcagtgtcccagggccc

SEQ ID NO: 3329425 - DNA, 11 bp, Homo sapiens
tggcagtgttt

SEQ ID NO: 3329426 - DNA, 21 bp, Homo sapiens
tggcagtgttttggttcagac

SEQ ID NO: 3329427 - DNA, 17 bp, Homo sapiens
tggcagttgaacagagg

SEQ ID NO: 3329428 - DNA, 13 bp, Homo sapiens
tggcagttgcagt

SEQ ID NO: 3329429 - DNA, 20 bp, Homo sapiens
tggcataatagtcaatttct

SEQ ID NO: 3329430 - DNA, 21 bp, Homo sapiens
tggcatataattttcacttct

SEQ ID NO: 3329431 - DNA, 22 bp, Homo sapiens
tggcatcaagaggtgggagggc

SEQ ID NO: 3329432 - DNA, 18 bp, Homo sapiens
tggcatcacagggcagag

SEQ ID NO: 3329433 - DNA, 16 bp, Homo sapiens
tggcatcctccggaga

SEQ ID NO: 3329434 - DNA, 13 bp, Homo sapiens
tggcatctcctgt

SEQ ID NO: 3329435 - DNA, 16 bp, Homo sapiens
tggcatctcctgtcct

SEQ ID NO: 3329436 - DNA, 20 bp, Homo sapiens
tggcatcttagacctccaca

SEQ ID NO: 3329437 - DNA, 15 bp, Homo sapiens
tggcatgaggaggtc

SEQ ID NO: 3329438 - DNA, 20 bp, Homo sapiens
tggcatgggcgcaggcccag

SEQ ID NO: 3329439 - DNA, 20 bp, Homo sapiens
tggcatgtgctgtgaccatt

SEQ ID NO: 3329440 - DNA, 17 bp, Homo sapiens
tggcatgttttctttgt

SEQ ID NO: 3329441 - DNA, 21 bp, Homo sapiens
tggcattaccctctgcagaac

SEQ ID NO: 3329442 - DNA, 17 bp, Homo sapiens
tggcattagaattattt

SEQ ID NO: 3329443 - DNA, 13 bp, Homo sapiens
tggcattatgtcc

SEQ ID NO: 3329444 - DNA, 23 bp, Homo sapiens
tggcattatgtccactgtgtata

SEQ ID NO: 3329445 - DNA, 17 bp, Homo sapiens
tggcatttctatacttt

SEQ ID NO: 3329446 - DNA, 14 bp, Homo sapiens
tggccaaaaagaat

SEQ ID NO: 3329447 - DNA, 22 bp, Homo sapiens
tggccaaaaagaatctgcattt

SEQ ID NO: 3329448 - DNA, 19 bp, Homo sapiens
tggccaaacatcagacctg

SEQ ID NO: 3329449 - DNA, 21 bp, Homo sapiens
tggccaaagccaaagctaggc

SEQ ID NO: 3329450 - DNA, 13 bp, Homo sapiens
tggccaactgcaa

SEQ ID NO: 3329451 - DNA, 14 bp, Homo sapiens
tggccaactgcaaa

SEQ ID NO: 3329452 - DNA, 15 bp, Homo sapiens
tggccaagaaaattg

SEQ ID NO: 3329453 - DNA, 23 bp, Homo sapiens
tggccacagcccatccatagtaa

SEQ ID NO: 3329454 - DNA, 23 bp, Homo sapiens
tggccacagcccccttgccctcc

SEQ ID NO: 3329455 - DNA, 19 bp, Homo sapiens
tggccacccctccccagta

SEQ ID NO: 3329456 - DNA, 23 bp, Homo sapiens
tggaccccagctgggaggcaaga

SEQ ID NO: 3329457 - DNA, 21 bp, Homo sapiens
tggaccctactattcatgttt

SEQ ID NO: 3329458 - DNA, 18 bp, Homo sapiens
tggaccctgtcttctggg

SEQ ID NO: 3329459 - DNA, 18 bp, Homo sapiens
tggaccgggtgggcctgg

SEQ ID NO: 3329460 - DNA, 21 bp, Homo sapiens
tggaccgggtgggcctggcct

SEQ ID NO: 3329461 - DNA, 16 bp, Homo sapiens
tggaccgtggacaggc

SEQ ID NO: 3329462 - DNA, 17 bp, Homo sapiens
tggaccgtggacaggcc

SEQ ID NO: 3329463 - DNA, 20 bp, Homo sapiens
tggaccgtggacaggcccag

SEQ ID NO: 3329464 - DNA, 14 bp, Homo sapiens
tggaccgtttccaa

SEQ ID NO: 3329465 - DNA, 17 bp, Homo sapiens
tggacctaaatggcctc

SEQ ID NO: 3329466 - DNA, 21 bp, Homo sapiens
tggacctaaatggcctcatgt

SEQ ID NO: 3329467 - DNA, 13 bp, Homo sapiens
tggacctaacatt

SEQ ID NO: 3329468 - DNA, 17 bp, Homo sapiens
tggacctaacattcgat

SEQ ID NO: 3329469 - DNA, 16 bp, Homo sapiens
tggacctctcagcaga

SEQ ID NO: 3329470 - DNA, 15 bp, Homo sapiens
tggaccttaggcctt

SEQ ID NO: 3329471 - DNA, 17 bp, Homo sapiens
tggaccttaggccttcc

SEQ ID NO: 3329472 - DNA, 21 bp, Homo sapiens
tggaccttaggccttcctctc

SEQ ID NO: 3329473 - DNA, 18 bp, Homo sapiens
tggacggcaggctcactg

SEQ ID NO: 3329474 - DNA, 16 bp, Homo sapiens
tggacggggactgggg

SEQ ID NO: 3329475 - DNA, 19 bp, Homo sapiens
tggactaaatatctgtcat

SEQ ID NO: 3329476 - DNA, 14 bp, Homo sapiens
tggactacaaaata

SEQ ID NO: 3329477 - DNA, 14 bp, Homo sapiens
tggactatctgtct

SEQ ID NO: 3329478 - DNA, 22 bp, Homo sapiens
tggactatctgtctggtggccc

SEQ ID NO: 3329479 - DNA, 23 bp, Homo sapiens
tggactatctgtctggtggcccc

SEQ ID NO: 3329480 - DNA, 19 bp, Homo sapiens
tggactcaatccctagggc

SEQ ID NO: 3329481 - DNA, 13 bp, Homo sapiens
tggactcagccca

SEQ ID NO: 3329482 - DNA, 14 bp, Homo sapiens
tggactcagcccac

SEQ ID NO: 3329483 - DNA, 16 bp, Homo sapiens
tggactctaaagacca

SEQ ID NO: 3329484 - DNA, 12 bp, Homo sapiens
tggactctcagg

SEQ ID NO: 3329485 - DNA, 16 bp, Homo sapiens
tggactctgcacatga

SEQ ID NO: 3329486 - DNA, 17 bp, Homo sapiens
tggactctgcacatgtc

SEQ ID NO: 3329487 - DNA, 18 bp, Homo sapiens
tggactctgcacatgtct

SEQ ID NO: 3329488 - DNA, 13 bp, Homo sapiens
tggactctgcatc

SEQ ID NO: 3329489 - DNA, 12 bp, Homo sapiens
tggactcttgct

SEQ ID NO: 3329490 - DNA, 14 bp, Homo sapiens
tggactcttgctct

SEQ ID NO: 3329491 - DNA, 18 bp, Homo sapiens
tggactgaagcctgcagg

SEQ ID NO: 3329492 - DNA, 23 bp, Homo sapiens
tggactgagccaaggaggcctgg

SEQ ID NO: 3329493 - DNA, 13 bp, Homo sapiens
tggactgcagaag

SEQ ID NO: 3329494 - DNA, 22 bp, Homo sapiens
tggactggaggtgggcatgcca

SEQ ID NO: 3329495 - DNA, 18 bp, Homo sapiens
tggactgttccaggccct

SEQ ID NO: 3329496 - DNA, 15 bp, Homo sapiens
tggacttaaagaaaa

SEQ ID NO: 3329497 - DNA, 16 bp, Homo sapiens
tggacttaaagaaaaa

SEQ ID NO: 3329498 - DNA, 20 bp, Homo sapiens
tggacttagaaagcaggggc

SEQ ID NO: 3329499 - DNA, 17 bp, Homo sapiens
tggacttatttcttcaa

SEQ ID NO: 3329500 - DNA, 17 bp, Homo sapiens
tggacttctacctgccc

SEQ ID NO: 3329501 - DNA, 17 bp, Homo sapiens
tggacttgagcttggca

SEQ ID NO: 3329502 - DNA, 13 bp, Homo sapiens
tggacttgtatat

SEQ ID NO: 3329503 - DNA, 17 bp, Homo sapiens
tggacttgtatatttgt

SEQ ID NO: 3329504 - DNA, 19 bp, Homo sapiens
tggactttcctgcaactca

SEQ ID NO: 3329505 - DNA, 18 bp, Homo sapiens
tggacttttcgttaacat

SEQ ID NO: 3329506 - DNA, 20 bp, Homo sapiens
tggacttttcgttaacattg

SEQ ID NO: 3329507 - DNA, 21 bp, Homo sapiens
tggacttttcgttaacattga

SEQ ID NO: 3329508 - DNA, 22 bp, Homo sapiens
tggacttttcgttaacattgac

SEQ ID NO: 3329509 - DNA, 13 bp, Homo sapiens
tggagaaaatggg

SEQ ID NO: 3329510 - DNA, 15 bp, Homo sapiens
tggagaaagaagtgg

SEQ ID NO: 3329511 - DNA, 18 bp, Homo sapiens
tggagaaagaagtggaga

SEQ ID NO: 3329512 - DNA, 19 bp, Homo sapiens
tggagaaagaagtggagac

SEQ ID NO: 3329513 - DNA, 21 bp, Homo sapiens
tggagaaagagctgcctggat

SEQ ID NO: 3329514 - DNA, 23 bp, Homo sapiens
tggagaaagagctgcctggatga

SEQ ID NO: 3329515 - DNA, 14 bp, Homo sapiens
tggagaaagcactg

SEQ ID NO: 3329516 - DNA, 17 bp, Homo sapiens
tggagaaagcactgacc

SEQ ID NO: 3329517 - DNA, 15 bp, Homo sapiens
tggagaaaggagtga

SEQ ID NO: 3329518 - DNA, 14 bp, Homo sapiens
tggagaagagagga

SEQ ID NO: 3329519 - DNA, 21 bp, Homo sapiens
tggagaaggtattagcaaagc

SEQ ID NO: 3329520 - DNA, 15 bp, Homo sapiens
tggagaatggtgttc

SEQ ID NO: 3329521 - DNA, 14 bp, Homo sapiens
tggagaattatata

SEQ ID NO: 3329522 - DNA, 17 bp, Homo sapiens
tggagaattgctgaagg

SEQ ID NO: 3329523 - DNA, 17 bp, Homo sapiens
tggagacagccccagag

SEQ ID NO: 3329524 - DNA, 19 bp, Homo sapiens
tggagaccagggagccttt

SEQ ID NO: 3329525 - DNA, 18 bp, Homo sapiens
tggagaccatgcagagcg

SEQ ID NO: 3329526 - DNA, 15 bp, Homo sapiens
tggagacccacaaag

SEQ ID NO: 3329527 - DNA, 22 bp, Homo sapiens
tggagacccaccccacctgcag

SEQ ID NO: 3329528 - DNA, 20 bp, Homo sapiens
tggagaccgcttcacccctg

SEQ ID NO: 3329529 - DNA, 12 bp, Homo sapiens
tggagacgtgga

SEQ ID NO: 3329530 - DNA, 22 bp, Homo sapiens
tggagacgtggaacctctgtct

SEQ ID NO: 3329531 - DNA, 22 bp, Homo sapiens
tggagacgtttataaacagaaa

SEQ ID NO: 3329532 - DNA, 18 bp, Homo sapiens
tggagactcctgccctgt

SEQ ID NO: 3329533 - DNA, 19 bp, Homo sapiens
tggagactgcttcccatcc

SEQ ID NO: 3329534 - DNA, 16 bp, Homo sapiens
tggagactggcaggcg

SEQ ID NO: 3329535 - DNA, 14 bp, Homo sapiens
tggagactggggtg

SEQ ID NO: 3329536 - DNA, 22 bp, Homo sapiens
tggagactggggtggcctcaag

SEQ ID NO: 3329537 - DNA, 17 bp, Homo sapiens
tggagactgtctcaaga

SEQ ID NO: 3329538 - DNA, 15 bp, Homo sapiens
tggagagaaggcctc

SEQ ID NO: 3329539 - DNA, 21 bp, Homo sapiens
tggagagaaggcctccctagc

SEQ ID NO: 3329540 - DNA, 12 bp, Homo sapiens
tggagagagggg

SEQ ID NO: 3329541 - DNA, 12 bp, Homo sapiens
tggagaggaaca

SEQ ID NO: 3329542 - DNA, 21 bp, Homo sapiens
tggagaggagggatgctgcct

SEQ ID NO: 3329543 - DNA, 13 bp, Homo sapiens
tggagagggtctc

SEQ ID NO: 3329544 - DNA, 20 bp, Homo sapiens
tggagagtcttgggcctggc

SEQ ID NO: 3329545 - DNA, 16 bp, Homo sapiens
tggagagtgagctaca

SEQ ID NO: 3329546 - DNA, 15 bp, Homo sapiens
tggagagtggaagga

SEQ ID NO: 3329547 - DNA, 22 bp, Homo sapiens
tggagatattataagggagagc

SEQ ID NO: 3329548 - DNA, 22 bp, Homo sapiens
tggagatcaggtaccaaggaaa

SEQ ID NO: 3329549 - DNA, 18 bp, Homo sapiens
tggagatcctcctgcaga

SEQ ID NO: 3329550 - DNA, 18 bp, Homo sapiens
tggagatgctgagggtgt

SEQ ID NO: 3329551 - DNA, 15 bp, Homo sapiens
tggagcaaaaggcag

SEQ ID NO: 3329552 - DNA, 16 bp, Homo sapiens
tggagcaaaaggcagc

SEQ ID NO: 3329553 - DNA, 20 bp, Homo sapiens
tggagcaaaaggcagctcac

SEQ ID NO: 3329554 - DNA, 14 bp, Homo sapiens
tggagcaaaccatt

SEQ ID NO: 3329555 - DNA, 15 bp, Homo sapiens
tggagcacaaaattc

SEQ ID NO: 3329556 - DNA, 20 bp, Homo sapiens
tggagcactagtttgattat

SEQ ID NO: 3329557 - DNA, 21 bp, Homo sapiens
tggagcactctgagtttacca

SEQ ID NO: 3329558 - DNA, 22 bp, Homo sapiens
tggagcactctgagtttaccat

SEQ ID NO: 3329559 - DNA, 22 bp, Homo sapiens
tggagcaggcggtggggagaga

SEQ ID NO: 3329560 - DNA, 15 bp, Homo sapiens
tggagcatgcagagg

SEQ ID NO: 3329561 - DNA, 17 bp, Homo sapiens
tggagccaatggagact

SEQ ID NO: 3329562 - DNA, 11 bp, Homo sapiens
tggagccactc

SEQ ID NO: 3329563 - DNA, 14 bp, Homo sapiens
tggagccactcctg

SEQ ID NO: 3329564 - DNA, 16 bp, Homo sapiens
tggaacttctaatata

SEQ ID NO: 3329565 - DNA, 18 bp, Homo sapiens
tggaacttctaatatatt

SEQ ID NO: 3329566 - DNA, 21 bp, Homo sapiens
tggaacttttattagataaca

SEQ ID NO: 3329567 - DNA, 18 bp, Homo sapiens
tggaagaaaaaaatcttc

SEQ ID NO: 3329568 - DNA, 22 bp, Homo sapiens
tggaagaaaatggtttattttg

SEQ ID NO: 3329569 - DNA, 12 bp, Homo sapiens
tggaagaaacac

SEQ ID NO: 3329570 - DNA, 13 bp, Homo sapiens
tggaagaaagtaa

SEQ ID NO: 3329571 - DNA, 12 bp, Homo sapiens
tggaagaaggga

SEQ ID NO: 3329572 - DNA, 13 bp, Homo sapiens
tggaagaagggag

SEQ ID NO: 3329573 - DNA, 13 bp, Homo sapiens
tggaagacacttc

SEQ ID NO: 3329574 - DNA, 16 bp, Homo sapiens
tggaagagcagcctga

SEQ ID NO: 3329575 - DNA, 18 bp, Homo sapiens
tggaagagcagcctgatg

SEQ ID NO: 3329576 - DNA, 23 bp, Homo sapiens
tggaagaggaacagcactgggga

SEQ ID NO: 3329577 - DNA, 23 bp, Homo sapiens
tggaagatttgcccatttacact

SEQ ID NO: 3329578 - DNA, 14 bp, Homo sapiens
tggaagcaaagtat

SEQ ID NO: 3329579 - DNA, 18 bp, Homo sapiens
tggaagcaattgctcatg

SEQ ID NO: 3329580 - DNA, 13 bp, Homo sapiens
tggaagcaggtgc

SEQ ID NO: 3329581 - DNA, 15 bp, Homo sapiens
tggaagccagctttc

SEQ ID NO: 3329582 - DNA, 16 bp, Homo sapiens
tggaagccagctttcc

SEQ ID NO: 3329583 - DNA, 18 bp, Homo sapiens
tggaagccaggtacagga

SEQ ID NO: 3329584 - DNA, 22 bp, Homo sapiens
tggaagccaggtacaggagagg

SEQ ID NO: 3329585 - DNA, 16 bp, Homo sapiens
tggaagccctggagac

SEQ ID NO: 3329586 - DNA, 17 bp, Homo sapiens
tggaagccggagggtgt

SEQ ID NO: 3329587 - DNA, 16 bp, Homo sapiens
tggaagctaatttgca

SEQ ID NO: 3329588 - DNA, 17 bp, Homo sapiens
tggaagctgtttggaaa

SEQ ID NO: 3329589 - DNA, 18 bp, Homo sapiens
tggaagctgtttggaaaa

SEQ ID NO: 3329590 - DNA, 23 bp, Homo sapiens
tggaagctgtttggaaaagacag

SEQ ID NO: 3329591 - DNA, 20 bp, Homo sapiens
tggaaggactgtggctgcag

SEQ ID NO: 3329592 - DNA, 14 bp, Homo sapiens
tggaaggcagacag

SEQ ID NO: 3329593 - DNA, 15 bp, Homo sapiens
tggaaggcagagaaa

SEQ ID NO: 3329594 - DNA, 18 bp, Homo sapiens
tggaaggcagagaaatct

SEQ ID NO: 3329595 - DNA, 15 bp, Homo sapiens
tggaaggcagggcag

SEQ ID NO: 3329596 - DNA, 15 bp, Homo sapiens
tggaaggctggctga

SEQ ID NO: 3329597 - DNA, 14 bp, Homo sapiens
tggaaggggccttg

SEQ ID NO: 3329598 - DNA, 22 bp, Homo sapiens
tggaaggggccttgctgagtgg

SEQ ID NO: 3329599 - DNA, 15 bp, Homo sapiens
tggaagggtttgtgg

SEQ ID NO: 3329600 - DNA, 19 bp, Homo sapiens
tggaaggtctattggccaa

SEQ ID NO: 3329601 - DNA, 14 bp, Homo sapiens
tggaagtcatgagc

SEQ ID NO: 3329602 - DNA, 17 bp, Homo sapiens
tggaagtccaatgtggc

SEQ ID NO: 3329603 - DNA, 20 bp, Homo sapiens
tggaagtctacctgctggac

SEQ ID NO: 3329604 - DNA, 23 bp, Homo sapiens
tggaagtctacctgctggacagc

SEQ ID NO: 3329605 - DNA, 22 bp, Homo sapiens
tggaagtgtttcaaaaaattat

SEQ ID NO: 3329606 - DNA, 23 bp, Homo sapiens
tggaagttcatacctaagtactg

SEQ ID NO: 3329607 - DNA, 23 bp, Homo sapiens
tggaagtttgtgttctgtttgtt

SEQ ID NO: 3329608 - DNA, 15 bp, Homo sapiens
tggaagttttcagga

SEQ ID NO: 3329609 - DNA, 19 bp, Homo sapiens
tggaagttttcctacactt

SEQ ID NO: 3329610 - DNA, 18 bp, Homo sapiens
tggaataaaaggcttgaa

SEQ ID NO: 3329611 - DNA, 13 bp, Homo sapiens
tggaataaacatt

SEQ ID NO: 3329612 - DNA, 14 bp, Homo sapiens
tggaataaacatta

SEQ ID NO: 3329613 - DNA, 15 bp, Homo sapiens
tggaataaacattaa

SEQ ID NO: 3329614 - DNA, 20 bp, Homo sapiens
tggaataaacattaattttg

SEQ ID NO: 3329615 - DNA, 21 bp, Homo sapiens
tggaataaagttctgttttct

SEQ ID NO: 3329616 - DNA, 18 bp, Homo sapiens
tggaataaagttgcagat

SEQ ID NO: 3329617 - DNA, 15 bp, Homo sapiens
tggaataacatgtaa

SEQ ID NO: 3329618 - DNA, 18 bp, Homo sapiens
tggaataaggcatggctc

SEQ ID NO: 3329619 - DNA, 15 bp, Homo sapiens
tggaatacagtgtta

SEQ ID NO: 3329620 - DNA, 15 bp, Homo sapiens
tggaatacatgaaat

SEQ ID NO: 3329621 - DNA, 17 bp, Homo sapiens
tggaataggaataagct

SEQ ID NO: 3329622 - DNA, 14 bp, Homo sapiens
tggaatataaggaa

SEQ ID NO: 3329623 - DNA, 15 bp, Homo sapiens
tggaatatcatctgt

SEQ ID NO: 3329624 - DNA, 13 bp, Homo sapiens
tggaatattaaaa

SEQ ID NO: 3329625 - DNA, 14 bp, Homo sapiens
tggaatatttgaat

SEQ ID NO: 3329626 - DNA, 21 bp, Homo sapiens
tggaatcaggaatattttcca

SEQ ID NO: 3329627 - DNA, 22 bp, Homo sapiens
tggaatcaggaatattttccaa

SEQ ID NO: 3329628 - DNA, 23 bp, Homo sapiens
tggaatcaggaatattttccaaa

SEQ ID NO: 3329629 - DNA, 23 bp, Homo sapiens
tggaatcgatttcctcccacctc

SEQ ID NO: 3329630 - DNA, 17 bp, Homo sapiens
tggaatctggagaccag

SEQ ID NO: 3329631 - DNA, 18 bp, Homo sapiens
tggaatctggagaccagg

SEQ ID NO: 3329632 - DNA, 20 bp, Homo sapiens
tggaatcttctctttgacaa

SEQ ID NO: 3329633 - DNA, 22 bp, Homo sapiens
tggaatcttctctttgacaatt

SEQ ID NO: 3329634 - DNA, 18 bp, Homo sapiens
tggaatgaattaaataaa

SEQ ID NO: 3329635 - DNA, 16 bp, Homo sapiens
tggaatgctgtgttaa

SEQ ID NO: 3329636 - DNA, 20 bp, Homo sapiens
tggaatggaactactgtact

SEQ ID NO: 3329637 - DNA, 21 bp, Homo sapiens
tggaatggaactactgtactt

SEQ ID NO: 3329638 - DNA, 14 bp, Homo sapiens
tggaatgtaatcaa

SEQ ID NO: 3329639 - DNA, 21 bp, Homo sapiens
tggaatgtggcccctgaacaa

SEQ ID NO: 3329640 - DNA, 19 bp, Homo sapiens
tggaattacaagccctggg

SEQ ID NO: 3329641 - DNA, 23 bp, Homo sapiens
tggaattattttgaatgtcacaa

SEQ ID NO: 3329642 - DNA, 18 bp, Homo sapiens
tggaattcagcaccctgg

SEQ ID NO: 3329643 - DNA, 19 bp, Homo sapiens
tggaattcagcaccctggg

SEQ ID NO: 3329644 - DNA, 20 bp, Homo sapiens
tggaattcagcaccctgggt

SEQ ID NO: 3329645 - DNA, 19 bp, Homo sapiens
tggaattgatttgcattga

SEQ ID NO: 3329646 - DNA, 23 bp, Homo sapiens
tggaattgatttgcattgaacac

SEQ ID NO: 3329647 - DNA, 16 bp, Homo sapiens
tggaattgcttaccaa

SEQ ID NO: 3329648 - DNA, 23 bp, Homo sapiens
tggaattgcttaccaaaggatag

SEQ ID NO: 3329649 - DNA, 19 bp, Homo sapiens
tggaatttaccagttaatt

SEQ ID NO: 3329650 - DNA, 16 bp, Homo sapiens
tggaatttgcctgctg

SEQ ID NO: 3329651 - DNA, 13 bp, Homo sapiens
tggaattttctta

SEQ ID NO: 3329652 - DNA, 21 bp, Homo sapiens
tggacaaacctagaattttct

SEQ ID NO: 3329653 - DNA, 18 bp, Homo sapiens
tggacaaactggagtctg

SEQ ID NO: 3329654 - DNA, 20 bp, Homo sapiens
tggacaaactggagtctgga

SEQ ID NO: 3329655 - DNA, 21 bp, Homo sapiens
tggacaacttatttaaaaata

SEQ ID NO: 3329656 - DNA, 22 bp, Homo sapiens
tggacaagcagaggtggccaga

SEQ ID NO: 3329657 - DNA, 17 bp, Homo sapiens
tggacaagccaacttgt

SEQ ID NO: 3329658 - DNA, 21 bp, Homo sapiens
tggacaataaacatctgagca

SEQ ID NO: 3329659 - DNA, 22 bp, Homo sapiens
tggacacaacagcagtctcctt

SEQ ID NO: 3329660 - DNA, 12 bp, Homo sapiens
tggacacagctc

SEQ ID NO: 3329661 - DNA, 13 bp, Homo sapiens
tggacacagctct

SEQ ID NO: 3329662 - DNA, 22 bp, Homo sapiens
tggacacagctcttctccaggc

SEQ ID NO: 3329663 - DNA, 18 bp, Homo sapiens
tggacacctttaggttct

SEQ ID NO: 3329664 - DNA, 21 bp, Homo sapiens
tggacactccagtgccagcaa

SEQ ID NO: 3329665 - DNA, 14 bp, Homo sapiens
tggacagagactca

SEQ ID NO: 3329666 - DNA, 17 bp, Homo sapiens
tggacagagactcagcg

SEQ ID NO: 3329667 - DNA, 20 bp, Homo sapiens
tggacagagactcagcgctc

SEQ ID NO: 3329668 - DNA, 13 bp, Homo sapiens
tggacagcctccg

SEQ ID NO: 3329669 - DNA, 22 bp, Homo sapiens
tggacagctttgctccgctccc

SEQ ID NO: 3329670 - DNA, 14 bp, Homo sapiens
tggacaggagtcag

SEQ ID NO: 3329671 - DNA, 16 bp, Homo sapiens
tggacaggagtcagtg

SEQ ID NO: 3329672 - DNA, 23 bp, Homo sapiens
tggacaggcatgttctctgagga

SEQ ID NO: 3329673 - DNA, 12 bp, Homo sapiens
tggacagtcctg

SEQ ID NO: 3329674 - DNA, 13 bp, Homo sapiens
tggacagtcctgg

SEQ ID NO: 3329675 - DNA, 18 bp, Homo sapiens
tgctggtatatggcttca

SEQ ID NO: 3329676 - DNA, 13 bp, Homo sapiens
tgctggtccgtgg

SEQ ID NO: 3329677 - DNA, 16 bp, Homo sapiens
tgctggtgtcctgacc

SEQ ID NO: 3329678 - DNA, 17 bp, Homo sapiens
tgctggttcctgactgg

SEQ ID NO: 3329679 - DNA, 17 bp, Homo sapiens
tgctggttgctgtgtgg

SEQ ID NO: 3329680 - DNA, 14 bp, Homo sapiens
tgctggttttccta

SEQ ID NO: 3329681 - DNA, 13 bp, Homo sapiens
tgctggttttcta

SEQ ID NO: 3329682 - DNA, 20 bp, Homo sapiens
tgctgtaaaattataaactt

SEQ ID NO: 3329683 - DNA, 16 bp, Homo sapiens
tgctgtaactgctgag

SEQ ID NO: 3329684 - DNA, 18 bp, Homo sapiens
tgctgtaactgctgagcc

SEQ ID NO: 3329685 - DNA, 19 bp, Homo sapiens
tgctgtaactgctgagcca

SEQ ID NO: 3329686 - DNA, 16 bp, Homo sapiens
tgctgtacatctattt

SEQ ID NO: 3329687 - DNA, 19 bp, Homo sapiens
tgctgtactagagatctgg

SEQ ID NO: 3329688 - DNA, 16 bp, Homo sapiens
tgctgtagtcctttct

SEQ ID NO: 3329689 - DNA, 19 bp, Homo sapiens
tgctgtagtcctttctgcc

SEQ ID NO: 3329690 - DNA, 21 bp, Homo sapiens
tgctgtattttaacactttgt

SEQ ID NO: 3329691 - DNA, 23 bp, Homo sapiens
tgctgtattttaacactttgtat

SEQ ID NO: 3329692 - DNA, 22 bp, Homo sapiens
tgctgtcatgaaatcagcaaga

SEQ ID NO: 3329693 - DNA, 23 bp, Homo sapiens
tgctgtcatggtcctttctggaa

SEQ ID NO: 3329694 - DNA, 20 bp, Homo sapiens
tgctgtccccttggcaggtc

SEQ ID NO: 3329695 - DNA, 13 bp, Homo sapiens
tgctgtccctccc

SEQ ID NO: 3329696 - DNA, 16 bp, Homo sapiens
tgctgtccctccccct

SEQ ID NO: 3329697 - DNA, 17 bp, Homo sapiens
tgctgtccctccccctt

SEQ ID NO: 3329698 - DNA, 16 bp, Homo sapiens
tgctgtcctaggccac

SEQ ID NO: 3329699 - DNA, 14 bp, Homo sapiens
tgctgtcctgatct

SEQ ID NO: 3329700 - DNA, 16 bp, Homo sapiens
tgctgtcttccccacc

SEQ ID NO: 3329701 - DNA, 17 bp, Homo sapiens
tgctgtcttctggtctg

SEQ ID NO: 3329702 - DNA, 16 bp, Homo sapiens
tgctgtgaggctgtcc

SEQ ID NO: 3329703 - DNA, 19 bp, Homo sapiens
tgctgtgaggctgtcctgt

SEQ ID NO: 3329704 - DNA, 22 bp, Homo sapiens
tgctgtgcattagatattaggg

SEQ ID NO: 3329705 - DNA, 23 bp, Homo sapiens
tgctgtgccatgctgggccactg

SEQ ID NO: 3329706 - DNA, 14 bp, Homo sapiens
tgctgtgctgctca

SEQ ID NO: 3329707 - DNA, 10 bp, Homo sapiens
tgctgtgggc

SEQ ID NO: 3329708 - DNA, 18 bp, Homo sapiens
tgctgtgggcagcaccct

SEQ ID NO: 3329709 - DNA, 12 bp, Homo sapiens
tgctgtgtaaaa

SEQ ID NO: 3329710 - DNA, 16 bp, Homo sapiens
tgctgtgtgtgagcag

SEQ ID NO: 3329711 - DNA, 16 bp, Homo sapiens
tgctgtgtttaatttg

SEQ ID NO: 3329712 - DNA, 22 bp, Homo sapiens
tgctgttaactgcaaccttgtt

SEQ ID NO: 3329713 - DNA, 20 bp, Homo sapiens
tgctgttactgttaaccatt

SEQ ID NO: 3329714 - DNA, 17 bp, Homo sapiens
tgctgttcctgctccat

SEQ ID NO: 3329715 - DNA, 20 bp, Homo sapiens
tgctgttgagatggtaacag

SEQ ID NO: 3329716 - DNA, 17 bp, Homo sapiens
tgctgttgccatagccc

SEQ ID NO: 3329717 - DNA, 22 bp, Homo sapiens
tgctgtttagagtaaataaact

SEQ ID NO: 3329718 - DNA, 13 bp, Homo sapiens
tgctgtttcacaa

SEQ ID NO: 3329719 - DNA, 14 bp, Homo sapiens
tgcttaaaaaagag

SEQ ID NO: 3329720 - DNA, 15 bp, Homo sapiens
tgcttaaaaaagagt

SEQ ID NO: 3329721 - DNA, 19 bp, Homo sapiens
tgcttaaaaggtataatta

SEQ ID NO: 3329722 - DNA, 16 bp, Homo sapiens
tgcttaaacaaagtga

SEQ ID NO: 3329723 - DNA, 14 bp, Homo sapiens
tgcttaaaccactt

SEQ ID NO: 3329724 - DNA, 22 bp, Homo sapiens
tgcttaaagttggtattaataa

SEQ ID NO: 3329725 - DNA, 16 bp, Homo sapiens
tgcttaagcagaagca

SEQ ID NO: 3329726 - DNA, 14 bp, Homo sapiens
tgcttaagttccag

SEQ ID NO: 3329727 - DNA, 20 bp, Homo sapiens
tgcttaatcttcaaagcctt

SEQ ID NO: 3329728 - DNA, 15 bp, Homo sapiens
tgcttaatttctaaa

SEQ ID NO: 3329729 - DNA, 19 bp, Homo sapiens
tgcttaatttctaaagata

SEQ ID NO: 3329730 - DNA, 16 bp, Homo sapiens
tgcttacaatctttat

SEQ ID NO: 3329731 - DNA, 15 bp, Homo sapiens
tgcttacacatctca

SEQ ID NO: 3329732 - DNA, 17 bp, Homo sapiens
tgcttacacatctcaga

SEQ ID NO: 3329733 - DNA, 11 bp, Homo sapiens
tgcttacagta

SEQ ID NO: 3329734 - DNA, 16 bp, Homo sapiens
tgcttacagtaactaa

SEQ ID NO: 3329735 - DNA, 20 bp, Homo sapiens
tgcttacatttttacaataa

SEQ ID NO: 3329736 - DNA, 17 bp, Homo sapiens
tgcttacctactttctt

SEQ ID NO: 3329737 - DNA, 14 bp, Homo sapiens
tgcttacttatgcc

SEQ ID NO: 3329738 - DNA, 19 bp, Homo sapiens
tgcttagaatccaaacttg

SEQ ID NO: 3329739 - DNA, 16 bp, Homo sapiens
tgcttagctgccttga

SEQ ID NO: 3329740 - DNA, 19 bp, Homo sapiens
tgcttagctgccttgagct

SEQ ID NO: 3329741 - DNA, 23 bp, Homo sapiens
tgcttagtcacttatttcataaa

SEQ ID NO: 3329742 - DNA, 20 bp, Homo sapiens
tgcttagtgtacttggagta

SEQ ID NO: 3329743 - DNA, 19 bp, Homo sapiens
tgcttataacctagttaaa

SEQ ID NO: 3329744 - DNA, 20 bp, Homo sapiens
tgcttatgaatatttataac

SEQ ID NO: 3329745 - DNA, 16 bp, Homo sapiens
tgcttattacatttaa

SEQ ID NO: 3329746 - DNA, 19 bp, Homo sapiens
tgcttattacatttaaatc

SEQ ID NO: 3329747 - DNA, 17 bp, Homo sapiens
tgcttattgcttagtaa

SEQ ID NO: 3329748 - DNA, 14 bp, Homo sapiens
tgcttattgttcca

SEQ ID NO: 3329749 - DNA, 23 bp, Homo sapiens
tgcttatttgacaacgtttcagc

SEQ ID NO: 3329750 - DNA, 23 bp, Homo sapiens
tgcttcaagagaaaatgcggtta

SEQ ID NO: 3329751 - DNA, 16 bp, Homo sapiens
tgcttcaataaatctt

SEQ ID NO: 3329752 - DNA, 15 bp, Homo sapiens
tgcttcaattaataa

SEQ ID NO: 3329753 - DNA, 23 bp, Homo sapiens
tgcttcaattaataaaaaatgga

SEQ ID NO: 3329754 - DNA, 14 bp, Homo sapiens
tgcttcacaatgtt

SEQ ID NO: 3329755 - DNA, 13 bp, Homo sapiens
tgcttcacagtag

SEQ ID NO: 3329756 - DNA, 13 bp, Homo sapiens
tgcttcagagttt

SEQ ID NO: 3329757 - DNA, 14 bp, Homo sapiens
tgcttcagagtttg

SEQ ID NO: 3329758 - DNA, 17 bp, Homo sapiens
tgcttcagagtttgtgt

SEQ ID NO: 3329759 - DNA, 14 bp, Homo sapiens
tgcttcagcctccc

SEQ ID NO: 3329760 - DNA, 17 bp, Homo sapiens
tgcttcagcctgaggct

SEQ ID NO: 3329761 - DNA, 21 bp, Homo sapiens
tgcttcagtcatcagccagca

SEQ ID NO: 3329762 - DNA, 18 bp, Homo sapiens
tgcttcagtggagaatta

SEQ ID NO: 3329763 - DNA, 23 bp, Homo sapiens
tgcttcatcattccctctcatct

SEQ ID NO: 3329764 - DNA, 18 bp, Homo sapiens
tgcttccaggtaaaaaca

SEQ ID NO: 3329765 - DNA, 21 bp, Homo sapiens
tgcttccattaacaaatgctc

SEQ ID NO: 3329766 - DNA, 17 bp, Homo sapiens
tgcttcccacctccctg

SEQ ID NO: 3329767 - DNA, 19 bp, Homo sapiens
tgcttcccacctccctgcc

SEQ ID NO: 3329768 - DNA, 23 bp, Homo sapiens
tgcttcccacctccctgcccagg

SEQ ID NO: 3329769 - DNA, 23 bp, Homo sapiens
tgcttcccattgtggctcctatc

SEQ ID NO: 3329770 - DNA, 15 bp, Homo sapiens
tgcttccctaatcta

SEQ ID NO: 3329771 - DNA, 21 bp, Homo sapiens
tgcttccggtagggaggcagc

SEQ ID NO: 3329772 - DNA, 13 bp, Homo sapiens
tgcttcctcctgg

SEQ ID NO: 3329773 - DNA, 16 bp, Homo sapiens
tgcttcctgaaataaa

SEQ ID NO: 3329774 - DNA, 23 bp, Homo sapiens
tgcttcctgaaataaacactggt

SEQ ID NO: 3329775 - DNA, 19 bp, Homo sapiens
tgcttctataattttgcct

SEQ ID NO: 3329776 - DNA, 18 bp, Homo sapiens
tgcttctcatcttgtgaa

SEQ ID NO: 3329777 - DNA, 17 bp, Homo sapiens
tgcttctccatgagaca

SEQ ID NO: 3329778 - DNA, 22 bp, Homo sapiens
tgcttctctagctctctaggcc

SEQ ID NO: 3329779 - DNA, 12 bp, Homo sapiens
tgcttctctgac

SEQ ID NO: 3329780 - DNA, 13 bp, Homo sapiens
tgcttctctgact

SEQ ID NO: 3329781 - DNA, 21 bp, Homo sapiens
tgcttctctgacttctgcctg

SEQ ID NO: 3329782 - DNA, 22 bp, Homo sapiens
tgcttctcttgggaactccact

SEQ ID NO: 3329783 - DNA, 16 bp, Homo sapiens
tgcttctgcccacacc

SEQ ID NO: 3329784 - DNA, 13 bp, Homo sapiens
tgcttctggaaac

SEQ ID NO: 3329785 - DNA, 20 bp, Homo sapiens
tgcttctgtagtactcctta

SEQ ID NO: 3329786 - DNA, 14 bp, Homo sapiens
tgcttctttctaga

SEQ ID NO: 3329787 - DNA, 15 bp, Homo sapiens
tgcttctttctagaa

SEQ ID NO: 3329788 - DNA, 12 bp, Homo sapiens
tgcttgaacaca

SEQ ID NO: 3329789 - DNA, 14 bp, Homo sapiens
tgcttgaacacagt

SEQ ID NO: 3329790 - DNA, 17 bp, Homo sapiens
tgcttgaacccaggaga

SEQ ID NO: 3329791 - DNA, 21 bp, Homo sapiens
tgcttgatatgtaagtacttc

SEQ ID NO: 3329792 - DNA, 18 bp, Homo sapiens
tgcttgatgaagcaagga

SEQ ID NO: 3329793 - DNA, 19 bp, Homo sapiens
tgcttgatgaagcaaggaa

SEQ ID NO: 3329794 - DNA, 17 bp, Homo sapiens
tgcttgcataagagctt

SEQ ID NO: 3329795 - DNA, 14 bp, Homo sapiens
tgcttgccaaagta

SEQ ID NO: 3329796 - DNA, 18 bp, Homo sapiens
tgcttgcggcaaaaggaa

SEQ ID NO: 3329797 - DNA, 16 bp, Homo sapiens
gtggctcacacctgca

SEQ ID NO: 3329798 - DNA, 18 bp, Homo sapiens
gtggctcctatctgtgtt

SEQ ID NO: 3329799 - DNA, 20 bp, Homo sapiens
gtggctcctcccggtgccca

SEQ ID NO: 3329800 - DNA, 21 bp, Homo sapiens
gtggctctgaggtgcctgtcc

SEQ ID NO: 3329801 - DNA, 23 bp, Homo sapiens
gtggctctgggaatgggagaggg

SEQ ID NO: 3329802 - DNA, 20 bp, Homo sapiens
gtggctgaaaatgcaaagct

SEQ ID NO: 3329803 - DNA, 12 bp, Homo sapiens
gtggctggaaga

SEQ ID NO: 3329804 - DNA, 15 bp, Homo sapiens
gtggctgggactcct

SEQ ID NO: 3329805 - DNA, 17 bp, Homo sapiens
gtggctgggggcaggag

SEQ ID NO: 3329806 - DNA, 22 bp, Homo sapiens
gtggctgggggcaggagggccc

SEQ ID NO: 3329807 - DNA, 19 bp, Homo sapiens
gtggctgggtgggcccaga

SEQ ID NO: 3329808 - DNA, 22 bp, Homo sapiens
gtggctgggtgggcccagaact

SEQ ID NO: 3329809 - DNA, 17 bp, Homo sapiens
gtggctggtccagggct

SEQ ID NO: 3329810 - DNA, 16 bp, Homo sapiens
gtggctgtccctgtgg

SEQ ID NO: 3329811 - DNA, 16 bp, Homo sapiens
gtggctgtggcacaga

SEQ ID NO: 3329812 - DNA, 19 bp, Homo sapiens
gtggcttcccgctcagccc

SEQ ID NO: 3329813 - DNA, 18 bp, Homo sapiens
gtggcttcttttgaactg

SEQ ID NO: 3329814 - DNA, 18 bp, Homo sapiens
gtggctttaattgtataa

SEQ ID NO: 3329815 - DNA, 20 bp, Homo sapiens
gtggctttccttgtggcaga

SEQ ID NO: 3329816 - DNA, 18 bp, Homo sapiens
gtggctttggcagtgttt

SEQ ID NO: 3329817 - DNA, 22 bp, Homo sapiens
gtgggaagaccaaaggaaggaa

SEQ ID NO: 3329818 - DNA, 15 bp, Homo sapiens
gtgggaaggacttgg

SEQ ID NO: 3329819 - DNA, 13 bp, Homo sapiens
gtgggaaggccag

SEQ ID NO: 3329820 - DNA, 17 bp, Homo sapiens
gtgggacagaggagcaa

SEQ ID NO: 3329821 - DNA, 22 bp, Homo sapiens
gtgggacccatagatcttctga

SEQ ID NO: 3329822 - DNA, 15 bp, Homo sapiens
gtgggactgtacaca

SEQ ID NO: 3329823 - DNA, 15 bp, Homo sapiens
gtgggagaaggcagt

SEQ ID NO: 3329824 - DNA, 15 bp, Homo sapiens
gtgggagagcccagc

SEQ ID NO: 3329825 - DNA, 12 bp, Homo sapiens
gtgggagcagga

SEQ ID NO: 3329826 - DNA, 15 bp, Homo sapiens
gtgggagcaggagat

SEQ ID NO: 3329827 - DNA, 13 bp, Homo sapiens
gtgggagggagca

SEQ ID NO: 3329828 - DNA, 17 bp, Homo sapiens
gtgggaggggcaggctg

SEQ ID NO: 3329829 - DNA, 21 bp, Homo sapiens
gtgggaggggcgcccacctcc

SEQ ID NO: 3329830 - DNA, 13 bp, Homo sapiens
gtgggaggtcagg

SEQ ID NO: 3329831 - DNA, 15 bp, Homo sapiens
gtgggatcctccctc

SEQ ID NO: 3329832 - DNA, 20 bp, Homo sapiens
gtgggatcctccctcatggc

SEQ ID NO: 3329833 - DNA, 23 bp, Homo sapiens
gtgggatgttcagcactgtccct

SEQ ID NO: 3329834 - DNA, 16 bp, Homo sapiens
gtgggcactggcccag

SEQ ID NO: 3329835 - DNA, 16 bp, Homo sapiens
gtgggcagcaccctcc

SEQ ID NO: 3329836 - DNA, 18 bp, Homo sapiens
gtgggcaggcaagccctt

SEQ ID NO: 3329837 - DNA, 18 bp, Homo sapiens
gtgggcaggtggtggcac

SEQ ID NO: 3329838 - DNA, 19 bp, Homo sapiens
gtgggcatgccaccctcac

SEQ ID NO: 3329839 - DNA, 13 bp, Homo sapiens
gtgggccagggct

SEQ ID NO: 3329840 - DNA, 16 bp, Homo sapiens
gtgggccagtctgtgg

SEQ ID NO: 3329841 - DNA, 22 bp, Homo sapiens
gtgggcccagaactgcccccac

SEQ ID NO: 3329842 - DNA, 20 bp, Homo sapiens
gtgggccccgggctggagaa

SEQ ID NO: 3329843 - DNA, 18 bp, Homo sapiens
gtgggccccttagcaatg

SEQ ID NO: 3329844 - DNA, 17 bp, Homo sapiens
gtgggcctggcctgagc

SEQ ID NO: 3329845 - DNA, 19 bp, Homo sapiens
gtgggcctggcctgagctg

SEQ ID NO: 3329846 - DNA, 20 bp, Homo sapiens
gtgggcctggcctgagctgg

SEQ ID NO: 3329847 - DNA, 22 bp, Homo sapiens
gtgggcctggcctgagctgggg

SEQ ID NO: 3329848 - DNA, 17 bp, Homo sapiens
gtgggcctgtcgtgcca

SEQ ID NO: 3329849 - DNA, 16 bp, Homo sapiens
gtgggctacatgctgg

SEQ ID NO: 3329850 - DNA, 18 bp, Homo sapiens
gtgggctctgtgcagtca

SEQ ID NO: 3329851 - DNA, 15 bp, Homo sapiens
gtgggctgagccctg

SEQ ID NO: 3329852 - DNA, 12 bp, Homo sapiens
gtgggctggtgc

SEQ ID NO: 3329853 - DNA, 21 bp, Homo sapiens
gtggggagcagttttcccctg

SEQ ID NO: 3329854 - DNA, 13 bp, Homo sapiens
gtggggaggggcg

SEQ ID NO: 3329855 - DNA, 18 bp, Homo sapiens
gtggggatctcaggggct

SEQ ID NO: 3329856 - DNA, 11 bp, Homo sapiens
gtggggccagg

SEQ ID NO: 3329857 - DNA, 15 bp, Homo sapiens
gtggggccaggccag

SEQ ID NO: 3329858 - DNA, 18 bp, Homo sapiens
gtggggccaggccaggac

SEQ ID NO: 3329859 - DNA, 22 bp, Homo sapiens
gtggggccaggccaggaccaca

SEQ ID NO: 3329860 - DNA, 16 bp, Homo sapiens
gtggggccctgcccct

SEQ ID NO: 3329861 - DNA, 17 bp, Homo sapiens
gtggggccgccgcctct

SEQ ID NO: 3329862 - DNA, 14 bp, Homo sapiens
gtggggcctgggag

SEQ ID NO: 3329863 - DNA, 21 bp, Homo sapiens
gtggggcctgggagggttccc

SEQ ID NO: 3329864 - DNA, 13 bp, Homo sapiens
gtggggcctgtgg

SEQ ID NO: 3329865 - DNA, 14 bp, Homo sapiens
gtggggcgaggcag

SEQ ID NO: 3329866 - DNA, 21 bp, Homo sapiens
gtggggctcacttttcatcct

SEQ ID NO: 3329867 - DNA, 19 bp, Homo sapiens
gttgccaactaagccctcg

SEQ ID NO: 3329868 - DNA, 17 bp, Homo sapiens
gttgccaagacaaatca

SEQ ID NO: 3329869 - DNA, 15 bp, Homo sapiens
gttgccaagctccaa

SEQ ID NO: 3329870 - DNA, 17 bp, Homo sapiens
gttgccacaggcctccc

SEQ ID NO: 3329871 - DNA, 19 bp, Homo sapiens
gttgccaccacctctgtgg

SEQ ID NO: 3329872 - DNA, 12 bp, Homo sapiens
gttgcccagagc

SEQ ID NO: 3329873 - DNA, 13 bp, Homo sapiens
gttgcccagagca

SEQ ID NO: 3329874 - DNA, 12 bp, Homo sapiens
gttgcccaggca

SEQ ID NO: 3329875 - DNA, 12 bp, Homo sapiens
gttgcccaggct

SEQ ID NO: 3329876 - DNA, 16 bp, Homo sapiens
gttgcccaggctggcg

SEQ ID NO: 3329877 - DNA, 18 bp, Homo sapiens
gttgccctagcccagact

SEQ ID NO: 3329878 - DNA, 22 bp, Homo sapiens
gttgcctaattggaaagtgcca

SEQ ID NO: 3329879 - DNA, 21 bp, Homo sapiens
gttgctggttggattaatctt

SEQ ID NO: 3329880 - DNA, 12 bp, Homo sapiens
gttgctgtttag

SEQ ID NO: 3329881 - DNA, 15 bp, Homo sapiens
gttgctgtttcacaa

SEQ ID NO: 3329882 - DNA, 23 bp, Homo sapiens
gttgcttaggatgtgtgcatgtg

SEQ ID NO: 3329883 - DNA, 15 bp, Homo sapiens
gttggaaaaaatttg

SEQ ID NO: 3329884 - DNA, 21 bp, Homo sapiens
gttggaactatacccgggacc

SEQ ID NO: 3329885 - DNA, 17 bp, Homo sapiens
gttggaatggatttttc

SEQ ID NO: 3329886 - DNA, 22 bp, Homo sapiens
gttggaatggatttttctttaa

SEQ ID NO: 3329887 - DNA, 21 bp, Homo sapiens
gttggacacctttaggttctt

SEQ ID NO: 3329888 - DNA, 15 bp, Homo sapiens
gttggacagccccct

SEQ ID NO: 3329889 - DNA, 20 bp, Homo sapiens
gttggacatttttttcgaat

SEQ ID NO: 3329890 - DNA, 18 bp, Homo sapiens
gttggactaaatgcctag

SEQ ID NO: 3329891 - DNA, 14 bp, Homo sapiens
gttggactctcagg

SEQ ID NO: 3329892 - DNA, 17 bp, Homo sapiens
gttggacttttcgttaa

SEQ ID NO: 3329893 - DNA, 16 bp, Homo sapiens
gttggagctcattctg

SEQ ID NO: 3329894 - DNA, 14 bp, Homo sapiens
gttggatgtagcat

SEQ ID NO: 3329895 - DNA, 13 bp, Homo sapiens
gttggcacagaac

SEQ ID NO: 3329896 - DNA, 15 bp, Homo sapiens
gttggcaccccagct

SEQ ID NO: 3329897 - DNA, 18 bp, Homo sapiens
gttggcagagaaggcctc

SEQ ID NO: 3329898 - DNA, 13 bp, Homo sapiens
gttggcaggctgg

SEQ ID NO: 3329899 - DNA, 15 bp, Homo sapiens
gttggcatagctctg

SEQ ID NO: 3329900 - DNA, 18 bp, Homo sapiens
gttggcatagctctgggg

SEQ ID NO: 3329901 - DNA, 14 bp, Homo sapiens
gttggccaggctgg

SEQ ID NO: 3329902 - DNA, 17 bp, Homo sapiens
gttggccaggctggtct

SEQ ID NO: 3329903 - DNA, 20 bp, Homo sapiens
gttggcccctgcccggctgc

SEQ ID NO: 3329904 - DNA, 15 bp, Homo sapiens
gttggcctcagggcc

SEQ ID NO: 3329905 - DNA, 21 bp, Homo sapiens
gttggcctcagggccaggaag

SEQ ID NO: 3329906 - DNA, 16 bp, Homo sapiens
gttggctatttgaaat

SEQ ID NO: 3329907 - DNA, 19 bp, Homo sapiens
gttggctgggggcctcagt

SEQ ID NO: 3329908 - DNA, 13 bp, Homo sapiens
gttggcttctgtt

SEQ ID NO: 3329909 - DNA, 14 bp, Homo sapiens
gttgggagcactgg

SEQ ID NO: 3329910 - DNA, 13 bp, Homo sapiens
gttgggagctgat

SEQ ID NO: 3329911 - DNA, 18 bp, Homo sapiens
gttgggatactgcagggc

SEQ ID NO: 3329912 - DNA, 18 bp, Homo sapiens
gttgggattcctgaccca

SEQ ID NO: 3329913 - DNA, 19 bp, Homo sapiens
gttgggattcctgacccag

SEQ ID NO: 3329914 - DNA, 20 bp, Homo sapiens
gttgggattcctgacccagg

SEQ ID NO: 3329915 - DNA, 22 bp, Homo sapiens
gttgggattcctgacccaggcc

SEQ ID NO: 3329916 - DNA, 12 bp, Homo sapiens
gttgggcatgtg

SEQ ID NO: 3329917 - DNA, 15 bp, Homo sapiens
gttgggcccagatct

SEQ ID NO: 3329918 - DNA, 13 bp, Homo sapiens
gttgggctggtgt

SEQ ID NO: 3329919 - DNA, 15 bp, Homo sapiens
gttgggctggtgtca

SEQ ID NO: 3329920 - DNA, 17 bp, Homo sapiens
gttggggagggatgaag

SEQ ID NO: 3329921 - DNA, 15 bp, Homo sapiens
gttggggcccttaac

SEQ ID NO: 3329922 - DNA, 13 bp, Homo sapiens
gttgggtggatgc

SEQ ID NO: 3329923 - DNA, 19 bp, Homo sapiens
gttgggtggcaattccaat

SEQ ID NO: 3329924 - DNA, 14 bp, Homo sapiens
gttggtaaacagtt

SEQ ID NO: 3329925 - DNA, 12 bp, Homo sapiens
gttggtcagagg

SEQ ID NO: 3329926 - DNA, 14 bp, Homo sapiens
gttggtccagagcg

SEQ ID NO: 3329927 - DNA, 16 bp, Homo sapiens
gttggtcggtgggttg

SEQ ID NO: 3329928 - DNA, 11 bp, Homo sapiens
gttggtgactg

SEQ ID NO: 3329929 - DNA, 13 bp, Homo sapiens
gttggtgccactt

SEQ ID NO: 3329930 - DNA, 16 bp, Homo sapiens
gttggtgctgatggag

SEQ ID NO: 3329931 - DNA, 15 bp, Homo sapiens
gttggtttactttca

SEQ ID NO: 3329932 - DNA, 16 bp, Homo sapiens
gttggtttgtatgaga

SEQ ID NO: 3329933 - DNA, 16 bp, Homo sapiens
gttgtaagaattctga

SEQ ID NO: 3329934 - DNA, 17 bp, Homo sapiens
gttgtaatatttcttca

SEQ ID NO: 3329935 - DNA, 14 bp, Homo sapiens
gttgtaatgctgca

SEQ ID NO: 3329936 - DNA, 18 bp, Homo sapiens
gttgtacatttatgattt

SEQ ID NO: 3329937 - DNA, 20 bp, Homo sapiens
gttgtacatttatgatttaa

SEQ ID NO: 3329938 - DNA, 15 bp, Homo sapiens
gttgtacttaaatgg

SEQ ID NO: 3329939 - DNA, 16 bp, Homo sapiens
gttgtataaaaacatg

SEQ ID NO: 3329940 - DNA, 16 bp, Homo sapiens
gttgtatgattccaat

SEQ ID NO: 3329941 - DNA, 13 bp, Homo sapiens
gttgtattcttct

SEQ ID NO: 3329942 - DNA, 21 bp, Homo sapiens
gttgtattgatcaatgcatgt

SEQ ID NO: 3329943 - DNA, 22 bp, Homo sapiens
gttgtcaagtctctgctggccc

SEQ ID NO: 3329944 - DNA, 16 bp, Homo sapiens
gttgtcaatattaaat

SEQ ID NO: 3329945 - DNA, 17 bp, Homo sapiens
gttgtcaatattaaata

SEQ ID NO: 3329946 - DNA, 19 bp, Homo sapiens
gttgtcaatattaaataca

SEQ ID NO: 3329947 - DNA, 21 bp, Homo sapiens
gttgtcaatattaaatacaga

SEQ ID NO: 3329948 - DNA, 19 bp, Homo sapiens
gttgtcctatggacaactt

SEQ ID NO: 3329949 - DNA, 23 bp, Homo sapiens
gttgtcctatggacaacttattt

SEQ ID NO: 3329950 - DNA, 18 bp, Homo sapiens
gttgtctctagagcaggg

SEQ ID NO: 3329951 - DNA, 19 bp, Homo sapiens
gttgtctgaagtcactgca

SEQ ID NO: 3329952 - DNA, 19 bp, Homo sapiens
gttgtgaaagttttgagta

SEQ ID NO: 3329953 - DNA, 20 bp, Homo sapiens
gttgtgagtttaccttgtat

SEQ ID NO: 3329954 - DNA, 20 bp, Homo sapiens
gttgtgatcttgcattcatt

SEQ ID NO: 3329955 - DNA, 17 bp, Homo sapiens
gttgtgcaaattaacag

SEQ ID NO: 3329956 - DNA, 18 bp, Homo sapiens
gttgtggctcttatttct

SEQ ID NO: 3329957 - DNA, 14 bp, Homo sapiens
gttgtgtaagagaa

SEQ ID NO: 3329958 - DNA, 21 bp, Homo sapiens
gttgtgtaagagaatgttgaa

SEQ ID NO: 3329959 - DNA, 23 bp, Homo sapiens
gttgtgtctgtgccctccaaaga

SEQ ID NO: 3329960 - DNA, 16 bp, Homo sapiens
gttgtgttcatgctga

SEQ ID NO: 3329961 - DNA, 17 bp, Homo sapiens
gttgttaatgaaaatgt

SEQ ID NO: 3329962 - DNA, 17 bp, Homo sapiens
gttgttatgtgatcatg

SEQ ID NO: 3329963 - DNA, 22 bp, Homo sapiens
gttgttgccaactaagccctcg

SEQ ID NO: 3329964 - DNA, 15 bp, Homo sapiens
gttgtttctgaccca

SEQ ID NO: 3329965 - DNA, 13 bp, Homo sapiens
gttgtttctgttc

SEQ ID NO: 3329966 - DNA, 11 bp, Homo sapiens
gttgtttcttt

SEQ ID NO: 3329967 - DNA, 15 bp, Homo sapiens
gttgtttctttctag

SEQ ID NO: 3329968 - DNA, 15 bp, Homo sapiens
gttgtttgtaaataa

SEQ ID NO: 3329969 - DNA, 20 bp, Homo sapiens
gttgttttttcctttgctct

SEQ ID NO: 3329970 - DNA, 14 bp, Homo sapiens
gtttaaaaagtaag

SEQ ID NO: 3329971 - DNA, 19 bp, Homo sapiens
gtttaaaaagtaagttaat

SEQ ID NO: 3329972 - DNA, 23 bp, Homo sapiens
gtttaaaaagtaagttaataatg

SEQ ID NO: 3329973 - DNA, 22 bp, Homo sapiens
gtttaaaactcagaatataaca

SEQ ID NO: 3329974 - DNA, 14 bp, Homo sapiens
gtttaaaagaaaaa

SEQ ID NO: 3329975 - DNA, 20 bp, Homo sapiens
gtttaaaatgtaatttaaat

SEQ ID NO: 3329976 - DNA, 13 bp, Homo sapiens
gtttaaaattcag

SEQ ID NO: 3329977 - DNA, 14 bp, Homo sapiens
gtttaaaattcagt

SEQ ID NO: 3329978 - DNA, 20 bp, Homo sapiens
gtttaaaattcagtttttgt

SEQ ID NO: 3329979 - DNA, 16 bp, Homo sapiens
gtttaaagaaagtgta

SEQ ID NO: 3329980 - DNA, 15 bp, Homo sapiens
gtttaaagagaggtt

SEQ ID NO: 3329981 - DNA, 15 bp, Homo sapiens
gtttaacaaatctaa

SEQ ID NO: 3329982 - DNA, 13 bp, Homo sapiens
gtttaacatttgc

SEQ ID NO: 3329983 - DNA, 23 bp, Homo sapiens
gtttaactgcagttgactttctc

SEQ ID NO: 3329984 - DNA, 17 bp, Homo sapiens
gtttaagaccagcctgg

SEQ ID NO: 3329985 - DNA, 15 bp, Homo sapiens
gtttaatattgagaa

SEQ ID NO: 3329986 - DNA, 19 bp, Homo sapiens
gtttaatattgagaaagaa

SEQ ID NO: 3329987 - DNA, 12 bp, Homo sapiens
gtttaatattta

SEQ ID NO: 3329988 - DNA, 19 bp, Homo sapiens
gtttaattgtttgtcctca

SEQ ID NO: 3329989 - DNA, 14 bp, Homo sapiens
gtttaatttacaca

SEQ ID NO: 3329990 - DNA, 18 bp, Homo sapiens
gtttacagaaaaatcttg

SEQ ID NO: 3329991 - DNA, 18 bp, Homo sapiens
gtttacaggccctgctcc

SEQ ID NO: 3329992 - DNA, 16 bp, Homo sapiens
gtttacagggagcctc

SEQ ID NO: 3329993 - DNA, 20 bp, Homo sapiens
gtttacagggagcctcctgc

SEQ ID NO: 3329994 - DNA, 21 bp, Homo sapiens
tattttttgaactttgtagga

SEQ ID NO: 3329995 - DNA, 13 bp, Homo sapiens
tattttttgcaag

SEQ ID NO: 3329996 - DNA, 16 bp, Homo sapiens
tattttttgtataatt

SEQ ID NO: 3329997 - DNA, 17 bp, Homo sapiens
tattttttgtataattg

SEQ ID NO: 3329998 - DNA, 23 bp, Homo sapiens
tatttttttaaaatcactaacat

SEQ ID NO: 3329999 - DNA, 16 bp, Homo sapiens
tatttttttaaaattt

SEQ ID NO: 3330000 - DNA, 15 bp, Homo sapiens
tatttttttaagcgt

SEQ ID NO: 3330001 - DNA, 16 bp, Homo sapiens
tatttttttaatttaa

SEQ ID NO: 3330002 - DNA, 18 bp, Homo sapiens
tatttttttaatttaaca

SEQ ID NO: 3330003 - DNA, 20 bp, Homo sapiens
tattttttttggcctgtttg

SEQ ID NO: 3330004 - DNA, 21 bp, Homo sapiens
tattttttttggcctgtttga

SEQ ID NO: 3330005 - DNA, 16 bp, Homo sapiens
tatttttttttctaag

SEQ ID NO: 3330006 - DNA, 19 bp, Homo sapiens
tatttttttttctaagaga

SEQ ID NO: 3330007 - DNA, 17 bp, Homo sapiens
tattttttttttcttct

SEQ ID NO: 3330008 - DNA, 16 bp, Homo sapiens
tcaaaaaaacactagt

SEQ ID NO: 3330009 - DNA, 17 bp, Homo sapiens
tcaaaaactaaaatcat

SEQ ID NO: 3330010 - DNA, 17 bp, Homo sapiens
tcaaaaactttggagtc

SEQ ID NO: 3330011 - DNA, 17 bp, Homo sapiens
tcaaaaagaaaaatcaa

SEQ ID NO: 3330012 - DNA, 17 bp, Homo sapiens
tcaaaaagaaatcaata

SEQ ID NO: 3330013 - DNA, 20 bp, Homo sapiens
tcaaaaagggaagtaagcaa

SEQ ID NO: 3330014 - DNA, 15 bp, Homo sapiens
tcaaaaagtgtttat

SEQ ID NO: 3330015 - DNA, 15 bp, Homo sapiens
tcaaaaataagtcat

SEQ ID NO: 3330016 - DNA, 14 bp, Homo sapiens
tcaaaaatgctgtt

SEQ ID NO: 3330017 - DNA, 20 bp, Homo sapiens
tcaaaacacactactacctc

SEQ ID NO: 3330018 - DNA, 15 bp, Homo sapiens
tcaaaacactgtgga

SEQ ID NO: 3330019 - DNA, 16 bp, Homo sapiens
tcaaaacactgtggaa

SEQ ID NO: 3330020 - DNA, 16 bp, Homo sapiens
tcaaaacagagggctg

SEQ ID NO: 3330021 - DNA, 16 bp, Homo sapiens
tcaaaacattccaaga

SEQ ID NO: 3330022 - DNA, 16 bp, Homo sapiens
tcaaaacctgcagtta

SEQ ID NO: 3330023 - DNA, 18 bp, Homo sapiens
tcaaaacctgcagttaac

SEQ ID NO: 3330024 - DNA, 16 bp, Homo sapiens
tcaaaactacaaatca

SEQ ID NO: 3330025 - DNA, 19 bp, Homo sapiens
tcaaaagacaaacatgcaa

SEQ ID NO: 3330026 - DNA, 13 bp, Homo sapiens
tcaaaagacatgt

SEQ ID NO: 3330027 - DNA, 17 bp, Homo sapiens
tcaaaagacatgttgta

SEQ ID NO: 3330028 - DNA, 18 bp, Homo sapiens
tcaaaagcaaatgagatc

SEQ ID NO: 3330029 - DNA, 17 bp, Homo sapiens
tcaaaagcatttatcat

SEQ ID NO: 3330030 - DNA, 18 bp, Homo sapiens
tcaaaagccataacttga

SEQ ID NO: 3330031 - DNA, 17 bp, Homo sapiens
tcaaaaggaaaccaagt

SEQ ID NO: 3330032 - DNA, 15 bp, Homo sapiens
tcaaaagttccaaga

SEQ ID NO: 3330033 - DNA, 17 bp, Homo sapiens
tcaaaagttggactaaa

SEQ ID NO: 3330034 - DNA, 18 bp, Homo sapiens
tcaaaagttggactaaat

SEQ ID NO: 3330035 - DNA, 20 bp, Homo sapiens
tcaaaataaaaagtgacaca

SEQ ID NO: 3330036 - DNA, 21 bp, Homo sapiens
tcaaaataaaaagtgacacag

SEQ ID NO: 3330037 - DNA, 23 bp, Homo sapiens
tcaaaataaaaagtgacacagca

SEQ ID NO: 3330038 - DNA, 11 bp, Homo sapiens
tcaaaatacta

SEQ ID NO: 3330039 - DNA, 17 bp, Homo sapiens
tcaaaatatttgtacat

SEQ ID NO: 3330040 - DNA, 21 bp, Homo sapiens
tcaaaatcagtttttcatact

SEQ ID NO: 3330041 - DNA, 18 bp, Homo sapiens
tcaaaatctttgtataaa

SEQ ID NO: 3330042 - DNA, 19 bp, Homo sapiens
tcaaaatgctttttatttc

SEQ ID NO: 3330043 - DNA, 22 bp, Homo sapiens
tcaaaatgtatatatttagtgc

SEQ ID NO: 3330044 - DNA, 14 bp, Homo sapiens
tcaaaatgtctgta

SEQ ID NO: 3330045 - DNA, 20 bp, Homo sapiens
tcaaaatgttatcttctcaa

SEQ ID NO: 3330046 - DNA, 21 bp, Homo sapiens
tcaaaatgttatcttctcaag

SEQ ID NO: 3330047 - DNA, 15 bp, Homo sapiens
tcaaaattaaatctg

SEQ ID NO: 3330048 - DNA, 22 bp, Homo sapiens
tcaaacaacctgcccaaagatt

SEQ ID NO: 3330049 - DNA, 22 bp, Homo sapiens
tcaaacacaatggagtgtgtaa

SEQ ID NO: 3330050 - DNA, 16 bp, Homo sapiens
tcaaacagaattttaa

SEQ ID NO: 3330051 - DNA, 18 bp, Homo sapiens
tcaaaccaatttcttcct

SEQ ID NO: 3330052 - DNA, 19 bp, Homo sapiens
tcaaaccccgaccacctgc

SEQ ID NO: 3330053 - DNA, 23 bp, Homo sapiens
tcaaaccccgaccacctgcccaa

SEQ ID NO: 3330054 - DNA, 20 bp, Homo sapiens
tcaaaccctagccttgcttg

SEQ ID NO: 3330055 - DNA, 15 bp, Homo sapiens
tcaaactcattgcag

SEQ ID NO: 3330056 - DNA, 20 bp, Homo sapiens
tcaaactcattgcagcagat

SEQ ID NO: 3330057 - DNA, 19 bp, Homo sapiens
tcaaactccctagtctcca

SEQ ID NO: 3330058 - DNA, 20 bp, Homo sapiens
tcaaactcctgacctcaggt

SEQ ID NO: 3330059 - DNA, 22 bp, Homo sapiens
tcaaactcttgacctcaggtga

SEQ ID NO: 3330060 - DNA, 22 bp, Homo sapiens
tcaaactggggcctccagaact

SEQ ID NO: 3330061 - DNA, 17 bp, Homo sapiens
tcaaactgtagaaatga

SEQ ID NO: 3330062 - DNA, 20 bp, Homo sapiens
tcaaactgtagaaatgatga

SEQ ID NO: 3330063 - DNA, 14 bp, Homo sapiens
tcaaacttccagtc

SEQ ID NO: 3330064 - DNA, 16 bp, Homo sapiens
tcaaagaaacttgaag

SEQ ID NO: 3330065 - DNA, 20 bp, Homo sapiens
tcaaagaaacttgaagcttt

SEQ ID NO: 3330066 - DNA, 12 bp, Homo sapiens
tcaaagaaagtg

SEQ ID NO: 3330067 - DNA, 16 bp, Homo sapiens
tcaaagaaagtgtatt

SEQ ID NO: 3330068 - DNA, 16 bp, Homo sapiens
tcaaagaaatgctgat

SEQ ID NO: 3330069 - DNA, 15 bp, Homo sapiens
tcaaagagagaaaat

SEQ ID NO: 3330070 - DNA, 23 bp, Homo sapiens
tcaaagagatgggccttttcttg

SEQ ID NO: 3330071 - DNA, 12 bp, Homo sapiens
tcaaagatgctg

SEQ ID NO: 3330072 - DNA, 14 bp, Homo sapiens
tcaaagcatagatg

SEQ ID NO: 3330073 - DNA, 15 bp, Homo sapiens
tcaaagccacattat

SEQ ID NO: 3330074 - DNA, 17 bp, Homo sapiens
tcaaagccacattattt

SEQ ID NO: 3330075 - DNA, 18 bp, Homo sapiens
tcaaagccacattatttc

SEQ ID NO: 3330076 - DNA, 21 bp, Homo sapiens
tcaaagccacattatttctag

SEQ ID NO: 3330077 - DNA, 15 bp, Homo sapiens
tcaaagcctggccta

SEQ ID NO: 3330078 - DNA, 11 bp, Homo sapiens
tcaaagccttc

SEQ ID NO: 3330079 - DNA, 23 bp, Homo sapiens
tcaaagcggtttaaccacattaa

SEQ ID NO: 3330080 - DNA, 13 bp, Homo sapiens
tcaaagctgaata

SEQ ID NO: 3330081 - DNA, 17 bp, Homo sapiens
tcaaagctgaatatttt

SEQ ID NO: 3330082 - DNA, 16 bp, Homo sapiens
tcaaagcttgtgaaaa

SEQ ID NO: 3330083 - DNA, 13 bp, Homo sapiens
tcaaaggagaaaa

SEQ ID NO: 3330084 - DNA, 16 bp, Homo sapiens
tcaaaggttctaggtt

SEQ ID NO: 3330085 - DNA, 21 bp, Homo sapiens
tcaaaggttctaggtttcaaa

SEQ ID NO: 3330086 - DNA, 16 bp, Homo sapiens
tcaaagtataatcttt

SEQ ID NO: 3330087 - DNA, 22 bp, Homo sapiens
tcaaagtgagaaaatgcctcaa

SEQ ID NO: 3330088 - DNA, 22 bp, Homo sapiens
tcaaagtgtaacagatatcagt

SEQ ID NO: 3330089 - DNA, 19 bp, Homo sapiens
tcaaagtgtatatttattc

SEQ ID NO: 3330090 - DNA, 20 bp, Homo sapiens
tcaaagtgtatatttattca

SEQ ID NO: 3330091 - DNA, 13 bp, Homo sapiens
tcaaagttttgaa

SEQ ID NO: 3330092 - DNA, 14 bp, Homo sapiens
tcacagcctccagg

SEQ ID NO: 3330093 - DNA, 16 bp, Homo sapiens
tcacagccttggctcc

SEQ ID NO: 3330094 - DNA, 13 bp, Homo sapiens
tcacagcggaggt

SEQ ID NO: 3330095 - DNA, 11 bp, Homo sapiens
tcacagctcct

SEQ ID NO: 3330096 - DNA, 11 bp, Homo sapiens
tcacagctgca

SEQ ID NO: 3330097 - DNA, 18 bp, Homo sapiens
tcacagctgcagctgggc

SEQ ID NO: 3330098 - DNA, 19 bp, Homo sapiens
tcacagctgcagctgggcc

SEQ ID NO: 3330099 - DNA, 20 bp, Homo sapiens
tcacagctgcagctgggccc

SEQ ID NO: 3330100 - DNA, 17 bp, Homo sapiens
tcacaggactctgcctc

SEQ ID NO: 3330101 - DNA, 19 bp, Homo sapiens
tcacaggactctgcctcct

SEQ ID NO: 3330102 - DNA, 23 bp, Homo sapiens
tcacaggactctgcctcctcttc

SEQ ID NO: 3330103 - DNA, 11 bp, Homo sapiens
tcacaggaggc

SEQ ID NO: 3330104 - DNA, 20 bp, Homo sapiens
tcacgcctgtaatcccagca

SEQ ID NO: 3330105 - DNA, 21 bp, Homo sapiens
tcacgctcccccgcagtcccc

SEQ ID NO: 3330106 - DNA, 12 bp, Homo sapiens
tcacgctccccg

SEQ ID NO: 3330107 - DNA, 17 bp, Homo sapiens
tcacgctggggctctct

SEQ ID NO: 3330108 - DNA, 17 bp, Homo sapiens
tcacgctttcctgaatc

SEQ ID NO: 3330109 - DNA, 19 bp, Homo sapiens
tcacgggcatgggcactcc

SEQ ID NO: 3330110 - DNA, 13 bp, Homo sapiens
tcacggggcctcc

SEQ ID NO: 3330111 - DNA, 22 bp, Homo sapiens
tcacgtaagatacaagtttcag

SEQ ID NO: 3330112 - DNA, 18 bp, Homo sapiens
tcacgtaccccactgggc

SEQ ID NO: 3330113 - DNA, 20 bp, Homo sapiens
tcacgtctgacaaatgtgta

SEQ ID NO: 3330114 - DNA, 15 bp, Homo sapiens
tcactaaactttatt

SEQ ID NO: 3330115 - DNA, 21 bp, Homo sapiens
tcactaaactttatttgtaaa

SEQ ID NO: 3330116 - DNA, 12 bp, Homo sapiens
tcactaacatta

SEQ ID NO: 3330117 - DNA, 15 bp, Homo sapiens
tcactaacattatat

SEQ ID NO: 3330118 - DNA, 16 bp, Homo sapiens
tcactaatttttgtat

SEQ ID NO: 3330119 - DNA, 18 bp, Homo sapiens
tcactacaagtcagctcc

SEQ ID NO: 3330120 - DNA, 19 bp, Homo sapiens
tcactactcacagtctctt

SEQ ID NO: 3330121 - DNA, 19 bp, Homo sapiens
tcactaggcccccacttgc

SEQ ID NO: 3330122 - DNA, 23 bp, Homo sapiens
tcactaggcccccacttgcctct

SEQ ID NO: 3330123 - DNA, 20 bp, Homo sapiens
tcactagtgaccccttccct

SEQ ID NO: 3330124 - DNA, 21 bp, Homo sapiens
tcactatcttcttcaaataca

SEQ ID NO: 3330125 - DNA, 23 bp, Homo sapiens
tcactatcttcttcaaatacaaa

SEQ ID NO: 3330126 - DNA, 23 bp, Homo sapiens
tcactatggtatgctggccagca

SEQ ID NO: 3330127 - DNA, 19 bp, Homo sapiens
tcactatgttgcccaggca

SEQ ID NO: 3330128 - DNA, 20 bp, Homo sapiens
tcactatgttgcccaggcag

SEQ ID NO: 3330129 - DNA, 21 bp, Homo sapiens
tcactatgttgcccaggcagg

SEQ ID NO: 3330130 - DNA, 14 bp, Homo sapiens
tcactcaagcactg

SEQ ID NO: 3330131 - DNA, 13 bp, Homo sapiens
tcactcacatttt

SEQ ID NO: 3330132 - DNA, 15 bp, Homo sapiens
tcactcactcattcc

SEQ ID NO: 3330133 - DNA, 16 bp, Homo sapiens
tcactcactcattcct

SEQ ID NO: 3330134 - DNA, 17 bp, Homo sapiens
tcactcattgctgagcc

SEQ ID NO: 3330135 - DNA, 18 bp, Homo sapiens
tcactcattgctgagcct

SEQ ID NO: 3330136 - DNA, 13 bp, Homo sapiens
tcactccacagag

SEQ ID NO: 3330137 - DNA, 14 bp, Homo sapiens
tcactccacagagt

SEQ ID NO: 3330138 - DNA, 14 bp, Homo sapiens
tcactccaccatcc

SEQ ID NO: 3330139 - DNA, 17 bp, Homo sapiens
tcactccaccatcccca

SEQ ID NO: 3330140 - DNA, 21 bp, Homo sapiens
tcactccaccatccccacccc

SEQ ID NO: 3330141 - DNA, 14 bp, Homo sapiens
tcactcccagcact

SEQ ID NO: 3330142 - DNA, 16 bp, Homo sapiens
tcactcccagcactcc

SEQ ID NO: 3330143 - DNA, 20 bp, Homo sapiens
tcactcccagcactcccctt

SEQ ID NO: 3330144 - DNA, 18 bp, Homo sapiens
tcactccccaaggaagag

SEQ ID NO: 3330145 - DNA, 12 bp, Homo sapiens
tcactccctgga

SEQ ID NO: 3330146 - DNA, 21 bp, Homo sapiens
tcactccggtgtgcctgcagc

SEQ ID NO: 3330147 - DNA, 23 bp, Homo sapiens
tcactccggtgtgcctgcagccc

SEQ ID NO: 3330148 - DNA, 18 bp, Homo sapiens
tcactcctaggagagcca

SEQ ID NO: 3330149 - DNA, 22 bp, Homo sapiens
tcactcctaggagagccaacct

SEQ ID NO: 3330150 - DNA, 12 bp, Homo sapiens
tcactcctgcct

SEQ ID NO: 3330151 - DNA, 22 bp, Homo sapiens
tcactcctgcctccgctggctt

SEQ ID NO: 3330152 - DNA, 20 bp, Homo sapiens
tcactcctggggcctcttgg

SEQ ID NO: 3330153 - DNA, 20 bp, Homo sapiens
tcactctacttagcatgtcc

SEQ ID NO: 3330154 - DNA, 23 bp, Homo sapiens
tcactctctattgtcatggggat

SEQ ID NO: 3330155 - DNA, 14 bp, Homo sapiens
tcactctgctgctt

SEQ ID NO: 3330156 - DNA, 21 bp, Homo sapiens
tcactctgggcacactctgcc

SEQ ID NO: 3330157 - DNA, 12 bp, Homo sapiens
tcactctgggct

SEQ ID NO: 3330158 - DNA, 18 bp, Homo sapiens
tcactctgtcagccagcc

SEQ ID NO: 3330159 - DNA, 23 bp, Homo sapiens
tcactctgtcagccagccgccct

SEQ ID NO: 3330160 - DNA, 18 bp, Homo sapiens
tcactctgtccctgtcct

SEQ ID NO: 3330161 - DNA, 12 bp, Homo sapiens
tcactgaaacaa

SEQ ID NO: 3330162 - DNA, 18 bp, Homo sapiens
tcactgaaacctctgcct

SEQ ID NO: 3330163 - DNA, 12 bp, Homo sapiens
tcactgaagacg

SEQ ID NO: 3330164 - DNA, 14 bp, Homo sapiens
tcactgaatttata

SEQ ID NO: 3330165 - DNA, 12 bp, Homo sapiens
tcactgacacaa

SEQ ID NO: 3330166 - DNA, 16 bp, Homo sapiens
tcactgacacaaagga

SEQ ID NO: 3330167 - DNA, 19 bp, Homo sapiens
tcactgacacaaaggaagt

SEQ ID NO: 3330168 - DNA, 20 bp, Homo sapiens
tcactgaccctaactgcaga

SEQ ID NO: 3330169 - DNA, 19 bp, Homo sapiens
tcactgagaggcctggagc

SEQ ID NO: 3330170 - DNA, 22 bp, Homo sapiens
tcactgagctccccagatctcc

SEQ ID NO: 3330171 - DNA, 16 bp, Homo sapiens
tcactgatgggaaaac

SEQ ID NO: 3330172 - DNA, 17 bp, Homo sapiens
tcactgatgtacaatta

SEQ ID NO: 3330173 - DNA, 14 bp, Homo sapiens
tcactgcaacctcc

SEQ ID NO: 3330174 - DNA, 18 bp, Homo sapiens
tcactgcaacctctgcct

SEQ ID NO: 3330175 - DNA, 18 bp, Homo sapiens
tcactgcaagctccgcct

SEQ ID NO: 3330176 - DNA, 15 bp, Homo sapiens
tcactgcacagtgca

SEQ ID NO: 3330177 - DNA, 18 bp, Homo sapiens
tcactgcagcccaggagg

SEQ ID NO: 3330178 - DNA, 13 bp, Homo sapiens
tcactgcagcctc

SEQ ID NO: 3330179 - DNA, 17 bp, Homo sapiens
tcactgcagtcttattt

SEQ ID NO: 3330180 - DNA, 15 bp, Homo sapiens
tcactgccacactct

SEQ ID NO: 3330181 - DNA, 20 bp, Homo sapiens
tcactgccacactctccatc

SEQ ID NO: 3330182 - DNA, 15 bp, Homo sapiens
tcactgccactttgc

SEQ ID NO: 3330183 - DNA, 19 bp, Homo sapiens
tcactgccactttgcacat

SEQ ID NO: 3330184 - DNA, 20 bp, Homo sapiens
tcactgccactttgcacatt

SEQ ID NO: 3330185 - DNA, 11 bp, Homo sapiens
tcactgccagg

SEQ ID NO: 3330186 - DNA, 14 bp, Homo sapiens
tcactgccaggcca

SEQ ID NO: 3330187 - DNA, 19 bp, Homo sapiens
tcactgccaggccagcctc

SEQ ID NO: 3330188 - DNA, 15 bp, Homo sapiens
tcactgccatgatag

SEQ ID NO: 3330189 - DNA, 22 bp, Homo sapiens
tcactgcccgcacaccctcact

SEQ ID NO: 3330190 - DNA, 18 bp, Homo sapiens
tcactgcgaagaccctct

SEQ ID NO: 3330191 - DNA, 18 bp, Homo sapiens
tcactgctccctgaagcc

SEQ ID NO: 3330192 - DNA, 19 bp, Homo sapiens
tcactgctccctgaagcca

SEQ ID NO: 3330193 - DNA, 18 bp, Homo sapiens
tcactgctggctgcctta

SEQ ID NO: 3330194 - DNA, 11 bp, Homo sapiens
tcactgctgtc

SEQ ID NO: 3330195 - DNA, 12 bp, Homo sapiens
tcactgctgtca

SEQ ID NO: 3330196 - DNA, 15 bp, Homo sapiens
tcactgctgtcatca

SEQ ID NO: 3330197 - DNA, 15 bp, Homo sapiens
tcactgcttgatgaa

SEQ ID NO: 3330198 - DNA, 17 bp, Homo sapiens
tcactggaaaggggaga

SEQ ID NO: 3330199 - DNA, 14 bp, Homo sapiens
tcactggagcccag

SEQ ID NO: 3330200 - DNA, 15 bp, Homo sapiens
tcactggagcccagg

SEQ ID NO: 3330201 - DNA, 19 bp, Homo sapiens
tcactggagttacattaat

SEQ ID NO: 3330202 - DNA, 13 bp, Homo sapiens
tcactggatgaaa

SEQ ID NO: 3330203 - DNA, 22 bp, Homo sapiens
tcactggctctccaagtgccag

SEQ ID NO: 3330204 - DNA, 18 bp, Homo sapiens
tcactggctggctcctag

SEQ ID NO: 3330205 - DNA, 13 bp, Homo sapiens
tcactggctgggg

SEQ ID NO: 3330206 - DNA, 19 bp, Homo sapiens
tcactggctggggcagagg

SEQ ID NO: 3330207 - DNA, 15 bp, Homo sapiens
tcactgggagaggtt

SEQ ID NO: 3330208 - DNA, 20 bp, Homo sapiens
tcactgggtggggtgaggac

SEQ ID NO: 3330209 - DNA, 17 bp, Homo sapiens
tcactgtcgcccaggct

SEQ ID NO: 3330210 - DNA, 20 bp, Homo sapiens
tcactgtcgcccaggctgga

SEQ ID NO: 3330211 - DNA, 19 bp, Homo sapiens
tcactgtctttaattctgt

SEQ ID NO: 3330212 - DNA, 15 bp, Homo sapiens
tcactgtgcactgcc

SEQ ID NO: 3330213 - DNA, 13 bp, Homo sapiens
tcactgtgcttcg

SEQ ID NO: 3330214 - DNA, 17 bp, Homo sapiens
tcactgtggtcctatgc

SEQ ID NO: 3330215 - DNA, 22 bp, Homo sapiens
tcactgtgtcacccagactgga

SEQ ID NO: 3330216 - DNA, 23 bp, Homo sapiens
tcactgttagctttttaaaacat

SEQ ID NO: 3330217 - DNA, 15 bp, Homo sapiens
tcactgttccctctg

SEQ ID NO: 3330218 - DNA, 16 bp, Homo sapiens
tcactgttccctctgc

SEQ ID NO: 3330219 - DNA, 18 bp, Homo sapiens
tcactgttccctctgctc

SEQ ID NO: 3330220 - DNA, 19 bp, Homo sapiens
tcactgttccctctgctcc

SEQ ID NO: 3330221 - DNA, 20 bp, Homo sapiens
tcactgttccctctgctcct

SEQ ID NO: 3330222 - DNA, 18 bp, Homo sapiens
tcactgttccctctggct

SEQ ID NO: 3330223 - DNA, 13 bp, Homo sapiens
tcactgttctgca

SEQ ID NO: 3330224 - DNA, 15 bp, Homo sapiens
tcactgttgaaaatt

SEQ ID NO: 3330225 - DNA, 15 bp, Homo sapiens
tcactgttgcccagg

SEQ ID NO: 3330226 - DNA, 17 bp, Homo sapiens
tcactgttgcccaggct

SEQ ID NO: 3330227 - DNA, 18 bp, Homo sapiens
tcactgttgcccaggctg

SEQ ID NO: 3330228 - DNA, 11 bp, Homo sapiens
tcactgttgtg

SEQ ID NO: 3330229 - DNA, 14 bp, Homo sapiens
tcactgttgtgaat

SEQ ID NO: 3330230 - DNA, 21 bp, Homo sapiens
tcactgttgtgaatcaccaaa

SEQ ID NO: 3330231 - DNA, 14 bp, Homo sapiens
tcactgtttcatct

SEQ ID NO: 3330232 - DNA, 14 bp, Homo sapiens
tcactgtttctctg

SEQ ID NO: 3330233 - DNA, 15 bp, Homo sapiens
tcacttactgtttct

SEQ ID NO: 3330234 - DNA, 22 bp, Homo sapiens
tcacttactgtttctgtcagga

SEQ ID NO: 3330235 - DNA, 12 bp, Homo sapiens
tcacttagtcct

SEQ ID NO: 3330236 - DNA, 17 bp, Homo sapiens
tcacttagtcctttatc

SEQ ID NO: 3330237 - DNA, 16 bp, Homo sapiens
tcacttcataatccag

SEQ ID NO: 3330238 - DNA, 19 bp, Homo sapiens
tcacttccatacagctcta

SEQ ID NO: 3330239 - DNA, 22 bp, Homo sapiens
tcacttctgcattcctgtaact

SEQ ID NO: 3330240 - DNA, 23 bp, Homo sapiens
tcacttgaaagattttattgtat

SEQ ID NO: 3330241 - DNA, 14 bp, Homo sapiens
tcacttgagcccag

SEQ ID NO: 3330242 - DNA, 22 bp, Homo sapiens
tcacttgaggccagtgagctgt

SEQ ID NO: 3330243 - DNA, 14 bp, Homo sapiens
tcacttgtacaaaa

SEQ ID NO: 3330244 - DNA, 17 bp, Homo sapiens
tcacttgtacaaaataa

SEQ ID NO: 3330245 - DNA, 18 bp, Homo sapiens
tcacttgtattgacttta

SEQ ID NO: 3330246 - DNA, 20 bp, Homo sapiens
tcacttgtattgactttatg

SEQ ID NO: 3330247 - DNA, 17 bp, Homo sapiens
tcacttgtgcagtgttg

SEQ ID NO: 3330248 - DNA, 19 bp, Homo sapiens
tcacttgtgctttgctctt

SEQ ID NO: 3330249 - DNA, 20 bp, Homo sapiens
tcacttgtgctttgctcttg

SEQ ID NO: 3330250 - DNA, 23 bp, Homo sapiens
tcactttaaagcaattgcataat

SEQ ID NO: 3330251 - DNA, 14 bp, Homo sapiens
tcactttagatgct

SEQ ID NO: 3330252 - DNA, 17 bp, Homo sapiens
tcactttagatgctgat

SEQ ID NO: 3330253 - DNA, 18 bp, Homo sapiens
tcactttcacatagatgt

SEQ ID NO: 3330254 - DNA, 19 bp, Homo sapiens
tcactttcacatagatgtc

SEQ ID NO: 3330255 - DNA, 16 bp, Homo sapiens
tcactttgctctgggt

SEQ ID NO: 3330256 - DNA, 17 bp, Homo sapiens
tcactttgctctgggtg

SEQ ID NO: 3330257 - DNA, 14 bp, Homo sapiens
tcacttttcagtga

SEQ ID NO: 3330258 - DNA, 16 bp, Homo sapiens
tcacttttcagtgatg

SEQ ID NO: 3330259 - DNA, 19 bp, Homo sapiens
tcacttttcatccttcccc

SEQ ID NO: 3330260 - DNA, 22 bp, Homo sapiens
tcacttttcatccttccccaac

SEQ ID NO: 3330261 - DNA, 18 bp, Homo sapiens
tcacttttgaatctataa

SEQ ID NO: 3330262 - DNA, 20 bp, Homo sapiens
tcacttttgaatctataaaa

SEQ ID NO: 3330263 - DNA, 16 bp, Homo sapiens
tcacttttgttctgct

SEQ ID NO: 3330264 - DNA, 19 bp, Homo sapiens
tcacttttgttctgcttta

SEQ ID NO: 3330265 - DNA, 20 bp, Homo sapiens
tcacttttgttctgctttat

SEQ ID NO: 3330266 - DNA, 17 bp, Homo sapiens
tcactttttacccagaa

SEQ ID NO: 3330267 - DNA, 14 bp, Homo sapiens
tcactttttctgat

SEQ ID NO: 3330268 - DNA, 16 bp, Homo sapiens
tcactttttctgataa

SEQ ID NO: 3330269 - DNA, 17 bp, Homo sapiens
tcactttttctgataaa

SEQ ID NO: 3330270 - DNA, 21 bp, Homo sapiens
tcactttttgaactaagaaac

SEQ ID NO: 3330271 - DNA, 21 bp, Homo sapiens
tcagaaaacaacttggcattt

SEQ ID NO: 3330272 - DNA, 15 bp, Homo sapiens
tcagaaaatgttctg

SEQ ID NO: 3330273 - DNA, 19 bp, Homo sapiens
tcagaaaatgttctgtttg

SEQ ID NO: 3330274 - DNA, 16 bp, Homo sapiens
tcagaaaattggcagt

SEQ ID NO: 3330275 - DNA, 19 bp, Homo sapiens
tcagaaacatgaaatgctt

SEQ ID NO: 3330276 - DNA, 18 bp, Homo sapiens
tcagaaaccaaacagttt

SEQ ID NO: 3330277 - DNA, 21 bp, Homo sapiens
tcagaaaccctcattgtgttt

SEQ ID NO: 3330278 - DNA, 17 bp, Homo sapiens
tcagaaaccctggtctc

SEQ ID NO: 3330279 - DNA, 15 bp, Homo sapiens
tcagaaactacagac

SEQ ID NO: 3330280 - DNA, 15 bp, Homo sapiens
tcagaaacttgtgaa

SEQ ID NO: 3330281 - DNA, 16 bp, Homo sapiens
tcagaaacttgtgaag

SEQ ID NO: 3330282 - DNA, 17 bp, Homo sapiens
tcagaaacttgtgaagt

SEQ ID NO: 3330283 - DNA, 20 bp, Homo sapiens
tcagaaagtcaccaggactt

SEQ ID NO: 3330284 - DNA, 15 bp, Homo sapiens
tcagaaagtgcctga

SEQ ID NO: 3330285 - DNA, 21 bp, Homo sapiens
tcagaaattggaacagaatgt

SEQ ID NO: 3330286 - DNA, 17 bp, Homo sapiens
tcagaaatttttatcag

SEQ ID NO: 3330287 - DNA, 19 bp, Homo sapiens
tcagaaatttttatcagtt

SEQ ID NO: 3330288 - DNA, 22 bp, Homo sapiens
tcagaaatttttatcagtttcc

SEQ ID NO: 3330289 - DNA, 13 bp, Homo sapiens
tcagaacatgtta

SEQ ID NO: 3330290 - DNA, 19 bp, Homo sapiens
tcagaacattcagctctgg

SEQ ID NO: 3330291 - DNA, 21 bp, Homo sapiens
tcagaacattcagctctggag

SEQ ID NO: 3330292 - DNA, 23 bp, Homo sapiens
tcagaacattcagctctggagaa

SEQ ID NO: 3330293 - DNA, 22 bp, Homo sapiens
tcagaaccatccatagtagtat

SEQ ID NO: 3330294 - DNA, 14 bp, Homo sapiens
tcagaacccagggc

SEQ ID NO: 3330295 - DNA, 23 bp, Homo sapiens
tcagaacccagggctctgcccca

SEQ ID NO: 3330296 - DNA, 17 bp, Homo sapiens
tcagaacctcttcccca

SEQ ID NO: 3330297 - DNA, 21 bp, Homo sapiens
tcagaactgaaataaaaaatt

SEQ ID NO: 3330298 - DNA, 23 bp, Homo sapiens
tcagaactgaaataaaaaattat

SEQ ID NO: 3330299 - DNA, 12 bp, Homo sapiens
tcagaagagact

SEQ ID NO: 3330300 - DNA, 20 bp, Homo sapiens
tcagaagagactgatccaaa

SEQ ID NO: 3330301 - DNA, 15 bp, Homo sapiens
tcagaagcctgaggc

SEQ ID NO: 3330302 - DNA, 20 bp, Homo sapiens
tcagaagcctgaggctggga

SEQ ID NO: 3330303 - DNA, 15 bp, Homo sapiens
tcagaagctattttt

SEQ ID NO: 3330304 - DNA, 17 bp, Homo sapiens
tcagaagtttggcaata

SEQ ID NO: 3330305 - DNA, 21 bp, Homo sapiens
tcagaataaggcaggcattga

SEQ ID NO: 3330306 - DNA, 22 bp, Homo sapiens
tcagaatagccacatttggaat

SEQ ID NO: 3330307 - DNA, 22 bp, Homo sapiens
tcagaatagcttccaataaagc

SEQ ID NO: 3330308 - DNA, 22 bp, Homo sapiens
tcagaatatgattcactattta

SEQ ID NO: 3330309 - DNA, 14 bp, Homo sapiens
tcagaatattgtct

SEQ ID NO: 3330310 - DNA, 18 bp, Homo sapiens
tcagaatctaaacgtggt

SEQ ID NO: 3330311 - DNA, 19 bp, Homo sapiens
tcagaatctcaaataacta

SEQ ID NO: 3330312 - DNA, 17 bp, Homo sapiens
tcagaatctgaatgtaa

SEQ ID NO: 3330313 - DNA, 22 bp, Homo sapiens
tcagaattagagcatgggaggt

SEQ ID NO: 3330314 - DNA, 17 bp, Homo sapiens
tcagaattcagaatcta

SEQ ID NO: 3330315 - DNA, 20 bp, Homo sapiens
tcagaattctcagaatctca

SEQ ID NO: 3330316 - DNA, 14 bp, Homo sapiens
tcagaatttagtgt

SEQ ID NO: 3330317 - DNA, 21 bp, Homo sapiens
tcagaatttagtgtatccata

SEQ ID NO: 3330318 - DNA, 18 bp, Homo sapiens
tcagacaagcactatttt

SEQ ID NO: 3330319 - DNA, 20 bp, Homo sapiens
tcagacaagcactattttat

SEQ ID NO: 3330320 - DNA, 22 bp, Homo sapiens
tcagacaagcactattttatat

SEQ ID NO: 3330321 - DNA, 21 bp, Homo sapiens
tcagacactgccgacatcagc

SEQ ID NO: 3330322 - DNA, 23 bp, Homo sapiens
tcagacactgccgacatcagcat

SEQ ID NO: 3330323 - DNA, 16 bp, Homo sapiens
tcagacagaacttgaa

SEQ ID NO: 3330324 - DNA, 13 bp, Homo sapiens
tcagacagatgtc

SEQ ID NO: 3330325 - DNA, 22 bp, Homo sapiens
tcagacagggtctgaaggactg

SEQ ID NO: 3330326 - DNA, 14 bp, Homo sapiens
tcagacatgttttc

SEQ ID NO: 3330327 - DNA, 15 bp, Homo sapiens
tcagaccccagttct

SEQ ID NO: 3330328 - DNA, 13 bp, Homo sapiens
tcagacccctgcc

SEQ ID NO: 3330329 - DNA, 15 bp, Homo sapiens
tcagacccctgcctg

SEQ ID NO: 3330330 - DNA, 13 bp, Homo sapiens
tcagaccctttag

SEQ ID NO: 3330331 - DNA, 16 bp, Homo sapiens
tcagacctgtcttcca

SEQ ID NO: 3330332 - DNA, 17 bp, Homo sapiens
tcagacctgtcttccaa

SEQ ID NO: 3330333 - DNA, 14 bp, Homo sapiens
tcagacggcggcca

SEQ ID NO: 3330334 - DNA, 19 bp, Homo sapiens
tcagactctcagcccagaa

SEQ ID NO: 3330335 - DNA, 15 bp, Homo sapiens
tcagactgcagaggg

SEQ ID NO: 3330336 - DNA, 23 bp, Homo sapiens
tcagactgctgggactggccagg

SEQ ID NO: 3330337 - DNA, 13 bp, Homo sapiens
tcagactggctgg

SEQ ID NO: 3330338 - DNA, 14 bp, Homo sapiens
tcagactggctggc

SEQ ID NO: 3330339 - DNA, 17 bp, Homo sapiens
tcagactttaaagaata

SEQ ID NO: 3330340 - DNA, 13 bp, Homo sapiens
tcagactttgctt

SEQ ID NO: 3330341 - DNA, 15 bp, Homo sapiens
tcagacttttgtaca

SEQ ID NO: 3330342 - DNA, 20 bp, Homo sapiens
tcagagacaggaagtcttca

SEQ ID NO: 3330343 - DNA, 23 bp, Homo sapiens
tcagagacaggaagtcttcaggg

SEQ ID NO: 3330344 - DNA, 20 bp, Homo sapiens
tcagagaccttaatttatat

SEQ ID NO: 3330345 - DNA, 15 bp, Homo sapiens
tcagagagcaaggca

SEQ ID NO: 3330346 - DNA, 13 bp, Homo sapiens
tcagagagctggt

SEQ ID NO: 3330347 - DNA, 21 bp, Homo sapiens
tcagagaggccttttggaatg

SEQ ID NO: 3330348 - DNA, 17 bp, Homo sapiens
tcagagaggtctcaggt

SEQ ID NO: 3330349 - DNA, 18 bp, Homo sapiens
tcagagatgaacatctaa

SEQ ID NO: 3330350 - DNA, 22 bp, Homo sapiens
tcagagatgcaccaccaagcca

SEQ ID NO: 3330351 - DNA, 15 bp, Homo sapiens
tcagagcatgtgtca

SEQ ID NO: 3330352 - DNA, 18 bp, Homo sapiens
tcagagcatttaaggaaa

SEQ ID NO: 3330353 - DNA, 21 bp, Homo sapiens
tcagagccacccctaaagaga

SEQ ID NO: 3330354 - DNA, 14 bp, Homo sapiens
tcagagccagtgaa

SEQ ID NO: 3330355 - DNA, 16 bp, Homo sapiens
tcagagcccccagccc

SEQ ID NO: 3330356 - DNA, 15 bp, Homo sapiens
tcatgccagtatttt

SEQ ID NO: 3330357 - DNA, 17 bp, Homo sapiens
tcatgcccaagccctga

SEQ ID NO: 3330358 - DNA, 13 bp, Homo sapiens
tcatgcccccctc

SEQ ID NO: 3330359 - DNA, 15 bp, Homo sapiens
tcatgccccctttca

SEQ ID NO: 3330360 - DNA, 18 bp, Homo sapiens
tcatgccccctttcagat

SEQ ID NO: 3330361 - DNA, 16 bp, Homo sapiens
tcatgcccttctgatt

SEQ ID NO: 3330362 - DNA, 14 bp, Homo sapiens
tcatgcctgtaatc

SEQ ID NO: 3330363 - DNA, 14 bp, Homo sapiens
tcatgcctttgtaa

SEQ ID NO: 3330364 - DNA, 17 bp, Homo sapiens
tcatgcctttgtaagtt

SEQ ID NO: 3330365 - DNA, 21 bp, Homo sapiens
tcatgctctcatatatatttt

SEQ ID NO: 3330366 - DNA, 13 bp, Homo sapiens
tcatgctgaatcc

SEQ ID NO: 3330367 - DNA, 20 bp, Homo sapiens
tcatgctggagggaggctgg

SEQ ID NO: 3330368 - DNA, 21 bp, Homo sapiens
tcatgcttccaggtaaaaaca

SEQ ID NO: 3330369 - DNA, 17 bp, Homo sapiens
tcatgcttcttccttac

SEQ ID NO: 3330370 - DNA, 20 bp, Homo sapiens
tcatggaatggacatcctgt

SEQ ID NO: 3330371 - DNA, 18 bp, Homo sapiens
tcatggcccccaggggca

SEQ ID NO: 3330372 - DNA, 19 bp, Homo sapiens
tcatggcgtaatgggcctg

SEQ ID NO: 3330373 - DNA, 14 bp, Homo sapiens
tcatggcttaatgt

SEQ ID NO: 3330374 - DNA, 18 bp, Homo sapiens
tcatggcttaatgtttat

SEQ ID NO: 3330375 - DNA, 21 bp, Homo sapiens
tcatgggaatgatagcccaga

SEQ ID NO: 3330376 - DNA, 20 bp, Homo sapiens
tcatgggagtaagttcttca

SEQ ID NO: 3330377 - DNA, 17 bp, Homo sapiens
tcatggggatcaatttt

SEQ ID NO: 3330378 - DNA, 14 bp, Homo sapiens
tcatggggtccaag

SEQ ID NO: 3330379 - DNA, 15 bp, Homo sapiens
tcatggtcctttctg

SEQ ID NO: 3330380 - DNA, 14 bp, Homo sapiens
tcatggtgaaaatg

SEQ ID NO: 3330381 - DNA, 16 bp, Homo sapiens
tcatggtgcatataaa

SEQ ID NO: 3330382 - DNA, 22 bp, Homo sapiens
tcatggtggatatggtgcagag

SEQ ID NO: 3330383 - DNA, 22 bp, Homo sapiens
tcatggtgtaataagacataac

SEQ ID NO: 3330384 - DNA, 13 bp, Homo sapiens
tcatgtaatttta

SEQ ID NO: 3330385 - DNA, 21 bp, Homo sapiens
tcatgtagccagcagaactga

SEQ ID NO: 3330386 - DNA, 18 bp, Homo sapiens
tcatgtatttgagcatat

SEQ ID NO: 3330387 - DNA, 14 bp, Homo sapiens
tcatgtcaggcctg

SEQ ID NO: 3330388 - DNA, 16 bp, Homo sapiens
tcatgtcaggcctgtg

SEQ ID NO: 3330389 - DNA, 19 bp, Homo sapiens
tcatgtcaggcctgtgtgt

SEQ ID NO: 3330390 - DNA, 13 bp, Homo sapiens
tcatgtcctgctg

SEQ ID NO: 3330391 - DNA, 22 bp, Homo sapiens
tcatgtcctgctggcttccagc

SEQ ID NO: 3330392 - DNA, 16 bp, Homo sapiens
tcatgtcgatcctggg

SEQ ID NO: 3330393 - DNA, 16 bp, Homo sapiens
tcatgtcgtaggtaaa

SEQ ID NO: 3330394 - DNA, 14 bp, Homo sapiens
tcatgtgctcagaa

SEQ ID NO: 3330395 - DNA, 13 bp, Homo sapiens
tcatgtggctgga

SEQ ID NO: 3330396 - DNA, 16 bp, Homo sapiens
tcatgtgggtgagcca

SEQ ID NO: 3330397 - DNA, 20 bp, Homo sapiens
tcatgtgggtgagccagtgg

SEQ ID NO: 3330398 - DNA, 22 bp, Homo sapiens
tcatgtgggtgagccagtggaa

SEQ ID NO: 3330399 - DNA, 13 bp, Homo sapiens
tcatgtgtgaaca

SEQ ID NO: 3330400 - DNA, 15 bp, Homo sapiens
tcatgttaacctctg

SEQ ID NO: 3330401 - DNA, 21 bp, Homo sapiens
tcatgttaacctctgctttta

SEQ ID NO: 3330402 - DNA, 19 bp, Homo sapiens
tcatgttagttaccttata

SEQ ID NO: 3330403 - DNA, 22 bp, Homo sapiens
tcatgttatatttaatgcatta

SEQ ID NO: 3330404 - DNA, 15 bp, Homo sapiens
tcatgttatgatttg

SEQ ID NO: 3330405 - DNA, 19 bp, Homo sapiens
tcatgttgatcatgtactt

SEQ ID NO: 3330406 - DNA, 21 bp, Homo sapiens
tcatgttgatcatgtactttt

SEQ ID NO: 3330407 - DNA, 16 bp, Homo sapiens
tcatgtttatgaaaat

SEQ ID NO: 3330408 - DNA, 15 bp, Homo sapiens
tcatgtttgcttcat

SEQ ID NO: 3330409 - DNA, 21 bp, Homo sapiens
tcatgtttgcttcataaatga

SEQ ID NO: 3330410 - DNA, 19 bp, Homo sapiens
tcatgtttggtgcatagaa

SEQ ID NO: 3330411 - DNA, 21 bp, Homo sapiens
tcatgtttggtgcatagaact

SEQ ID NO: 3330412 - DNA, 22 bp, Homo sapiens
tcatgtttggtgcatagaactg

SEQ ID NO: 3330413 - DNA, 12 bp, Homo sapiens
tcatgtttttga

SEQ ID NO: 3330414 - DNA, 15 bp, Homo sapiens
tcattaaatggggct

SEQ ID NO: 3330415 - DNA, 16 bp, Homo sapiens
tcattaaatgtttgac

SEQ ID NO: 3330416 - DNA, 14 bp, Homo sapiens
tcattaacacattg

SEQ ID NO: 3330417 - DNA, 15 bp, Homo sapiens
tcattacccttccct

SEQ ID NO: 3330418 - DNA, 21 bp, Homo sapiens
tcattacccttccctgcacta

SEQ ID NO: 3330419 - DNA, 20 bp, Homo sapiens
tcattacttttaaaaatgta

SEQ ID NO: 3330420 - DNA, 15 bp, Homo sapiens
tcattagctgctctg

SEQ ID NO: 3330421 - DNA, 15 bp, Homo sapiens
tcattataaacgtga

SEQ ID NO: 3330422 - DNA, 17 bp, Homo sapiens
tcattataatctcaaag

SEQ ID NO: 3330423 - DNA, 22 bp, Homo sapiens
tcattataatgtcattaaacat

SEQ ID NO: 3330424 - DNA, 20 bp, Homo sapiens
tcattatatcattggaacaa

SEQ ID NO: 3330425 - DNA, 17 bp, Homo sapiens
tcattatcatcaagcag

SEQ ID NO: 3330426 - DNA, 15 bp, Homo sapiens
tcattattctcataa

SEQ ID NO: 3330427 - DNA, 20 bp, Homo sapiens
tcattattctcataatcctt

SEQ ID NO: 3330428 - DNA, 17 bp, Homo sapiens
tcattattggaattaac

SEQ ID NO: 3330429 - DNA, 14 bp, Homo sapiens
tcattattggaggg

SEQ ID NO: 3330430 - DNA, 15 bp, Homo sapiens
tcattattttgtggt

SEQ ID NO: 3330431 - DNA, 17 bp, Homo sapiens
tcattatttttccactt

SEQ ID NO: 3330432 - DNA, 20 bp, Homo sapiens
tcattatttttgttagcaaa

SEQ ID NO: 3330433 - DNA, 19 bp, Homo sapiens
tcattcaaatcagtgatct

SEQ ID NO: 3330434 - DNA, 21 bp, Homo sapiens
tcattcaaatcagtgatctat

SEQ ID NO: 3330435 - DNA, 16 bp, Homo sapiens
tcattcaatacaagtg

SEQ ID NO: 3330436 - DNA, 23 bp, Homo sapiens
tcattccaccttcccatgccctg

SEQ ID NO: 3330437 - DNA, 18 bp, Homo sapiens
tcattccagtgctagaaa

SEQ ID NO: 3330438 - DNA, 20 bp, Homo sapiens
tcattccagtgctagaaaat

SEQ ID NO: 3330439 - DNA, 14 bp, Homo sapiens
tcattccattgact

SEQ ID NO: 3330440 - DNA, 18 bp, Homo sapiens
tcattccctctcatctca

SEQ ID NO: 3330441 - DNA, 16 bp, Homo sapiens
tcattccgttgtctgt

SEQ ID NO: 3330442 - DNA, 17 bp, Homo sapiens
tcattcctaacacagca

SEQ ID NO: 3330443 - DNA, 16 bp, Homo sapiens
tcattcctgaaagaaa

SEQ ID NO: 3330444 - DNA, 20 bp, Homo sapiens
tcattcctgaaagaaacagt

SEQ ID NO: 3330445 - DNA, 14 bp, Homo sapiens
tcattcgcctttgt

SEQ ID NO: 3330446 - DNA, 16 bp, Homo sapiens
tcattcgcctttgtct

SEQ ID NO: 3330447 - DNA, 16 bp, Homo sapiens
tcattctcctgcctgt

SEQ ID NO: 3330448 - DNA, 16 bp, Homo sapiens
tcattctgctacttca

SEQ ID NO: 3330449 - DNA, 16 bp, Homo sapiens
tcattctgtgatcatt

SEQ ID NO: 3330450 - DNA, 21 bp, Homo sapiens
tcattcttccaagctgagagt

SEQ ID NO: 3330451 - DNA, 17 bp, Homo sapiens
tcattcttgaaagctgt

SEQ ID NO: 3330452 - DNA, 15 bp, Homo sapiens
tcattcttgttttct

SEQ ID NO: 3330453 - DNA, 11 bp, Homo sapiens
tcattgaaatg

SEQ ID NO: 3330454 - DNA, 21 bp, Homo sapiens
tcattgacctctcagggcctg

SEQ ID NO: 3330455 - DNA, 23 bp, Homo sapiens
tcattgacctctcagggcctggc

SEQ ID NO: 3330456 - DNA, 18 bp, Homo sapiens
tcattgactcttgcgtgt

SEQ ID NO: 3330457 - DNA, 14 bp, Homo sapiens
tcattgacttcatt

SEQ ID NO: 3330458 - DNA, 21 bp, Homo sapiens
tcattgacttcattttatatt

SEQ ID NO: 3330459 - DNA, 12 bp, Homo sapiens
tcattgactttt

SEQ ID NO: 3330460 - DNA, 14 bp, Homo sapiens
tcattgacttttat

SEQ ID NO: 3330461 - DNA, 20 bp, Homo sapiens
tcattgattttataattggt

SEQ ID NO: 3330462 - DNA, 17 bp, Homo sapiens
tcattgcacataagctt

SEQ ID NO: 3330463 - DNA, 23 bp, Homo sapiens
tcattgcacataagcttccattt

SEQ ID NO: 3330464 - DNA, 17 bp, Homo sapiens
tcattgcagcagataac

SEQ ID NO: 3330465 - DNA, 16 bp, Homo sapiens
tcattgccagtgtctt

SEQ ID NO: 3330466 - DNA, 18 bp, Homo sapiens
tcattgccagtgtctttc

SEQ ID NO: 3330467 - DNA, 20 bp, Homo sapiens
tcattgccagtgtctttctt

SEQ ID NO: 3330468 - DNA, 17 bp, Homo sapiens
tcattgcccccacctct

SEQ ID NO: 3330469 - DNA, 23 bp, Homo sapiens
tcattgcccccacctctggtcca

SEQ ID NO: 3330470 - DNA, 18 bp, Homo sapiens
tcattgcctcctgttctg

SEQ ID NO: 3330471 - DNA, 16 bp, Homo sapiens
tcattgcctgtgtatg

SEQ ID NO: 3330472 - DNA, 15 bp, Homo sapiens
tcattgctgagcctc

SEQ ID NO: 3330473 - DNA, 16 bp, Homo sapiens
tcattgctgagcctct

SEQ ID NO: 3330474 - DNA, 22 bp, Homo sapiens
tcattgctgagcctctgctccc

SEQ ID NO: 3330475 - DNA, 19 bp, Homo sapiens
tcattgctgtaccacatct

SEQ ID NO: 3330476 - DNA, 18 bp, Homo sapiens
tcattggttaacaataaa

SEQ ID NO: 3330477 - DNA, 16 bp, Homo sapiens
tcattgtaaacaaact

SEQ ID NO: 3330478 - DNA, 17 bp, Homo sapiens
tcattgtagaaacacag

SEQ ID NO: 3330479 - DNA, 15 bp, Homo sapiens
tcattgtatgttatt

SEQ ID NO: 3330480 - DNA, 22 bp, Homo sapiens
tcattgttatttatacaagatt

SEQ ID NO: 3330481 - DNA, 22 bp, Homo sapiens
tcattgtttaggggtgaaggag

SEQ ID NO: 3330482 - DNA, 12 bp, Homo sapiens
tcattgttttga

SEQ ID NO: 3330483 - DNA, 14 bp, Homo sapiens
tcatttaaaatgat

SEQ ID NO: 3330484 - DNA, 16 bp, Homo sapiens
tcatttactaaacata

SEQ ID NO: 3330485 - DNA, 15 bp, Homo sapiens
tcaggtatgttgcct

SEQ ID NO: 3330486 - DNA, 16 bp, Homo sapiens
tcaggtatgttgcctt

SEQ ID NO: 3330487 - DNA, 16 bp, Homo sapiens
tcaggtcagggacttg

SEQ ID NO: 3330488 - DNA, 12 bp, Homo sapiens
tcaggtccctgc

SEQ ID NO: 3330489 - DNA, 16 bp, Homo sapiens
tcaggtgacatgtgaa

SEQ ID NO: 3330490 - DNA, 21 bp, Homo sapiens
tcaggtgccactccctgagct

SEQ ID NO: 3330491 - DNA, 20 bp, Homo sapiens
tcaggtgctgccatccaggt

SEQ ID NO: 3330492 - DNA, 19 bp, Homo sapiens
tcaggtggggcagcttgag

SEQ ID NO: 3330493 - DNA, 18 bp, Homo sapiens
tcaggtgtccctgcactt

SEQ ID NO: 3330494 - DNA, 22 bp, Homo sapiens
tcaggtgttttttatgaagtgc

SEQ ID NO: 3330495 - DNA, 19 bp, Homo sapiens
tcaggttatcgaaataaca

SEQ ID NO: 3330496 - DNA, 20 bp, Homo sapiens
tcaggttatcgaaataacaa

SEQ ID NO: 3330497 - DNA, 21 bp, Homo sapiens
tcaggttatcgaaataacaat

SEQ ID NO: 3330498 - DNA, 17 bp, Homo sapiens
tcaggttctattttctt

SEQ ID NO: 3330499 - DNA, 17 bp, Homo sapiens
tcaggttgctggttgct

SEQ ID NO: 3330500 - DNA, 20 bp, Homo sapiens
tcaggttgctggttgctgtg

SEQ ID NO: 3330501 - DNA, 19 bp, Homo sapiens
tcaggtttaacatttgcct

SEQ ID NO: 3330502 - DNA, 23 bp, Homo sapiens
tcaggtttaacatttgccttgca

SEQ ID NO: 3330503 - DNA, 21 bp, Homo sapiens
tcaggtttccattctgcagaa

SEQ ID NO: 3330504 - DNA, 21 bp, Homo sapiens
tcagtaaacgggaacatgccc

SEQ ID NO: 3330505 - DNA, 22 bp, Homo sapiens
tcagtaaacgggaacatgcccc

SEQ ID NO: 3330506 - DNA, 16 bp, Homo sapiens
tcagtaaataatgaaa

SEQ ID NO: 3330507 - DNA, 12 bp, Homo sapiens
tcagtaagaggt

SEQ ID NO: 3330508 - DNA, 14 bp, Homo sapiens
tcagtaatttgagg

SEQ ID NO: 3330509 - DNA, 15 bp, Homo sapiens
tcagtaatttgagga

SEQ ID NO: 3330510 - DNA, 17 bp, Homo sapiens
tcagtactcaaattcaa

SEQ ID NO: 3330511 - DNA, 22 bp, Homo sapiens
tcagtacttgtgaaacacagct

SEQ ID NO: 3330512 - DNA, 23 bp, Homo sapiens
tcagtacttttttaaatattttc

SEQ ID NO: 3330513 - DNA, 13 bp, Homo sapiens
tcagtagaattac

SEQ ID NO: 3330514 - DNA, 17 bp, Homo sapiens
tcagtagattgcagaaa

SEQ ID NO: 3330515 - DNA, 15 bp, Homo sapiens
tcagtataaacaaag

SEQ ID NO: 3330516 - DNA, 13 bp, Homo sapiens
tcagtatactgtg

SEQ ID NO: 3330517 - DNA, 24 bp, Homo sapiens
tcagtatctgtatctctctctctt

SEQ ID NO: 3330518 - DNA, 21 bp, Homo sapiens
tcagtattaaaggggggaggg

SEQ ID NO: 3330519 - DNA, 16 bp, Homo sapiens
tcagtatttaatgaaa

SEQ ID NO: 3330520 - DNA, 14 bp, Homo sapiens
tcagtatttcaact

SEQ ID NO: 3330521 - DNA, 20 bp, Homo sapiens
tcagtatttcaactgctgta

SEQ ID NO: 3330522 - DNA, 23 bp, Homo sapiens
tcagtattttggagaaattattt

SEQ ID NO: 3330523 - DNA, 14 bp, Homo sapiens
tcagtcaaaacttt

SEQ ID NO: 3330524 - DNA, 23 bp, Homo sapiens
tcagtcagaaaactttaaaaaat

SEQ ID NO: 3330525 - DNA, 13 bp, Homo sapiens
tcagtcagttccc

SEQ ID NO: 3330526 - DNA, 17 bp, Homo sapiens
tcagtcatgcataaata

SEQ ID NO: 3330527 - DNA, 14 bp, Homo sapiens
tcagtcatgtgtaa

SEQ ID NO: 3330528 - DNA, 15 bp, Homo sapiens
tcagtccatagcaga

SEQ ID NO: 3330529 - DNA, 15 bp, Homo sapiens
tcagtcccctcccat

SEQ ID NO: 3330530 - DNA, 23 bp, Homo sapiens
tcagtcccctcccatctgggagt

SEQ ID NO: 3330531 - DNA, 13 bp, Homo sapiens
tcagtccctatgt

SEQ ID NO: 3330532 - DNA, 23 bp, Homo sapiens
tcagtccctatgtatttgcagtt

SEQ ID NO: 3330533 - DNA, 13 bp, Homo sapiens
tcagtcctcccct

SEQ ID NO: 3330534 - DNA, 17 bp, Homo sapiens
tcagtcctcccctcaca

SEQ ID NO: 3330535 - DNA, 19 bp, Homo sapiens
tcagtcctcccctcacagc

SEQ ID NO: 3330536 - DNA, 16 bp, Homo sapiens
tcagtcctgggcaaag

SEQ ID NO: 3330537 - DNA, 18 bp, Homo sapiens
tcagtctatccacagaga

SEQ ID NO: 3330538 - DNA, 17 bp, Homo sapiens
tcagtctccctttccct

SEQ ID NO: 3330539 - DNA, 20 bp, Homo sapiens
tcagtctccctttcccttct

SEQ ID NO: 3330540 - DNA, 12 bp, Homo sapiens
tcagtctctttc

SEQ ID NO: 3330541 - DNA, 22 bp, Homo sapiens
tcagtctgattcccaagctctg

SEQ ID NO: 3330542 - DNA, 24 bp, Homo sapiens
tcagtctgattcccaagctctgct

SEQ ID NO: 3330543 - DNA, 12 bp, Homo sapiens
tcagtctttttc

SEQ ID NO: 3330544 - DNA, 15 bp, Homo sapiens
tcagtctttttctgt

SEQ ID NO: 3330545 - DNA, 20 bp, Homo sapiens
tcagtctttttctgttgtaa

SEQ ID NO: 3330546 - DNA, 21 bp, Homo sapiens
tcagtctttttctgttgtaac

SEQ ID NO: 3330547 - DNA, 21 bp, Homo sapiens
tcagtgacatcaaagcctggc

SEQ ID NO: 3330548 - DNA, 13 bp, Homo sapiens
tcagtgactcctg

SEQ ID NO: 3330549 - DNA, 15 bp, Homo sapiens
tcagtgactcctgct

SEQ ID NO: 3330550 - DNA, 14 bp, Homo sapiens
tcagtgatctatgt

SEQ ID NO: 3330551 - DNA, 17 bp, Homo sapiens
tcagtgatctatgtttg

SEQ ID NO: 3330552 - DNA, 21 bp, Homo sapiens
tcagtgatctatgtttgtgtg

SEQ ID NO: 3330553 - DNA, 19 bp, Homo sapiens
tcagtgcaaattgtatctt

SEQ ID NO: 3330554 - DNA, 12 bp, Homo sapiens
tcagtgcatcat

SEQ ID NO: 3330555 - DNA, 16 bp, Homo sapiens
tcagtgcatttgtgct

SEQ ID NO: 3330556 - DNA, 12 bp, Homo sapiens
tcagtgctgtgg

SEQ ID NO: 3330557 - DNA, 19 bp, Homo sapiens
tcagtgctgtggcctgggc

SEQ ID NO: 3330558 - DNA, 21 bp, Homo sapiens
tcagtggaagccccaacggga

SEQ ID NO: 3330559 - DNA, 11 bp, Homo sapiens
tcagtggcagc

SEQ ID NO: 3330560 - DNA, 14 bp, Homo sapiens
tcagtggcagctgc

SEQ ID NO: 3330561 - DNA, 16 bp, Homo sapiens
tcagtggcagctgctt

SEQ ID NO: 3330562 - DNA, 14 bp, Homo sapiens
tcagtggcagggct

SEQ ID NO: 3330563 - DNA, 15 bp, Homo sapiens
tcagtggcagggctc

SEQ ID NO: 3330564 - DNA, 16 bp, Homo sapiens
tcagtggcagggctca

SEQ ID NO: 3330565 - DNA, 19 bp, Homo sapiens
tcagtggcagggctcagga

SEQ ID NO: 3330566 - DNA, 11 bp, Homo sapiens
tcagtgtacat

SEQ ID NO: 3330567 - DNA, 20 bp, Homo sapiens
tcagtgtacatggaataaca

SEQ ID NO: 3330568 - DNA, 14 bp, Homo sapiens
tcagtgtcccaggc

SEQ ID NO: 3330569 - DNA, 16 bp, Homo sapiens
tcagtgtcccaggcag

SEQ ID NO: 3330570 - DNA, 14 bp, Homo sapiens
tcagtgtctcacac

SEQ ID NO: 3330571 - DNA, 19 bp, Homo sapiens
tcagtgtctccccgtgtcc

SEQ ID NO: 3330572 - DNA, 23 bp, Homo sapiens
tcagtgtggagaggggtgcaccc

SEQ ID NO: 3330573 - DNA, 15 bp, Homo sapiens
tcagtgttaaaaaat

SEQ ID NO: 3330574 - DNA, 16 bp, Homo sapiens
tcagtgttaaaaaatt

SEQ ID NO: 3330575 - DNA, 20 bp, Homo sapiens
tcagtgttccctttcctact

SEQ ID NO: 3330576 - DNA, 15 bp, Homo sapiens
tcagtgttggtatat

SEQ ID NO: 3330577 - DNA, 14 bp, Homo sapiens
tcagtgtttttgaa

SEQ ID NO: 3330578 - DNA, 23 bp, Homo sapiens
tcagttaattcaatgtgaacact

SEQ ID NO: 3330579 - DNA, 20 bp, Homo sapiens
tcagttacaagattgtaagt

SEQ ID NO: 3330580 - DNA, 16 bp, Homo sapiens
tcagttatattttgct

SEQ ID NO: 3330581 - DNA, 13 bp, Homo sapiens
tcagttattcatt

SEQ ID NO: 3330582 - DNA, 17 bp, Homo sapiens
tcagttcaacctggtgg

SEQ ID NO: 3330583 - DNA, 20 bp, Homo sapiens
tcagttcaactttcagaagt

SEQ ID NO: 3330584 - DNA, 19 bp, Homo sapiens
tcagttcccagctcccccc

SEQ ID NO: 3330585 - DNA, 22 bp, Homo sapiens
tcagttcccggagcacagccct

SEQ ID NO: 3330586 - DNA, 17 bp, Homo sapiens
tcagttcccttggcctc

SEQ ID NO: 3330587 - DNA, 20 bp, Homo sapiens
tcagttcccttggcctcaga

SEQ ID NO: 3330588 - DNA, 22 bp, Homo sapiens
tcagttcctttgtgtgtactca

SEQ ID NO: 3330589 - DNA, 18 bp, Homo sapiens
tcagttctctcccttcct

SEQ ID NO: 3330590 - DNA, 13 bp, Homo sapiens
tcagttctgtgta

SEQ ID NO: 3330591 - DNA, 18 bp, Homo sapiens
tcagttctgtgtacattt

SEQ ID NO: 3330592 - DNA, 20 bp, Homo sapiens
tcagttctgtgtacatttta

SEQ ID NO: 3330593 - DNA, 18 bp, Homo sapiens
tcagttcttggtgctctg

SEQ ID NO: 3330594 - DNA, 18 bp, Homo sapiens
tcagttgctcaaaaagaa

SEQ ID NO: 3330595 - DNA, 15 bp, Homo sapiens
tcagttgcttgtctt

SEQ ID NO: 3330596 - DNA, 20 bp, Homo sapiens
tcagttggtgtgtttttggg

SEQ ID NO: 3330597 - DNA, 13 bp, Homo sapiens
tcagttgtgtttt

SEQ ID NO: 3330598 - DNA, 14 bp, Homo sapiens
tcagttgtgttttt

SEQ ID NO: 3330599 - DNA, 16 bp, Homo sapiens
tcagttgtgtttttta

SEQ ID NO: 3330600 - DNA, 22 bp, Homo sapiens
tcataagtttgtttaaacactt

SEQ ID NO: 3330601 - DNA, 15 bp, Homo sapiens
tcataataggtagtt

SEQ ID NO: 3330602 - DNA, 19 bp, Homo sapiens
tcataatgaattataacag

SEQ ID NO: 3330603 - DNA, 19 bp, Homo sapiens
tcataattacattcctaac

SEQ ID NO: 3330604 - DNA, 16 bp, Homo sapiens
tcataatttgtttcca

SEQ ID NO: 3330605 - DNA, 19 bp, Homo sapiens
tcatacctaagtactgtaa

SEQ ID NO: 3330606 - DNA, 18 bp, Homo sapiens
tcatacctcagaatgtaa

SEQ ID NO: 3330607 - DNA, 20 bp, Homo sapiens
tcatactactgaaacagatt

SEQ ID NO: 3330608 - DNA, 18 bp, Homo sapiens
tcatactatttagatttt

SEQ ID NO: 3330609 - DNA, 23 bp, Homo sapiens
tcatagaaatgtaacttttgtaa

SEQ ID NO: 3330610 - DNA, 14 bp, Homo sapiens
tcatagagatttgt

SEQ ID NO: 3330611 - DNA, 15 bp, Homo sapiens
tcatagatagataag

SEQ ID NO: 3330612 - DNA, 18 bp, Homo sapiens
tcatagcagattttaatt

SEQ ID NO: 3330613 - DNA, 21 bp, Homo sapiens
tcataggaagggaccaaggca

SEQ ID NO: 3330614 - DNA, 21 bp, Homo sapiens
tcatagggaaaggttttgtat

SEQ ID NO: 3330615 - DNA, 17 bp, Homo sapiens
tcatagggtctcttcag

SEQ ID NO: 3330616 - DNA, 20 bp, Homo sapiens
tcatagggtctcttcaggtt

SEQ ID NO: 3330617 - DNA, 18 bp, Homo sapiens
tcataggtcactggctct

SEQ ID NO: 3330618 - DNA, 15 bp, Homo sapiens
tcataggttaaaaaa

SEQ ID NO: 3330619 - DNA, 20 bp, Homo sapiens
tcataggttaaaaaaaaaag

SEQ ID NO: 3330620 - DNA, 14 bp, Homo sapiens
tcatagtaacttct

SEQ ID NO: 3330621 - DNA, 16 bp, Homo sapiens
tcatagtaacttctta

SEQ ID NO: 3330622 - DNA, 21 bp, Homo sapiens
tcatagtaacttcttatggaa

SEQ ID NO: 3330623 - DNA, 22 bp, Homo sapiens
tcatagtactctttgtagcaaa

SEQ ID NO: 3330624 - DNA, 18 bp, Homo sapiens
tcatagtagtttttacag

SEQ ID NO: 3330625 - DNA, 15 bp, Homo sapiens
tcatagtatggtggc

SEQ ID NO: 3330626 - DNA, 19 bp, Homo sapiens
tcatagtatggtggctggg

SEQ ID NO: 3330627 - DNA, 16 bp, Homo sapiens
tcatagttcagaattt

SEQ ID NO: 3330628 - DNA, 16 bp, Homo sapiens
tcatataataaatgta

SEQ ID NO: 3330629 - DNA, 22 bp, Homo sapiens
tcatatagcattgataatcttc

SEQ ID NO: 3330630 - DNA, 23 bp, Homo sapiens
tcatatagcattgataatcttca

SEQ ID NO: 3330631 - DNA, 16 bp, Homo sapiens
tcatatatacatacat

SEQ ID NO: 3330632 - DNA, 17 bp, Homo sapiens
tcatatggcccagtgtc

SEQ ID NO: 3330633 - DNA, 18 bp, Homo sapiens
tcatatgtgtctttatag

SEQ ID NO: 3330634 - DNA, 14 bp, Homo sapiens
tcatatgttgctca

SEQ ID NO: 3330635 - DNA, 21 bp, Homo sapiens
tcatattaaaattacagatgt

SEQ ID NO: 3330636 - DNA, 15 bp, Homo sapiens
tcatattaagacagt

SEQ ID NO: 3330637 - DNA, 16 bp, Homo sapiens
tcatattctgtctgga

SEQ ID NO: 3330638 - DNA, 18 bp, Homo sapiens
tcatattgatgaaaagat

SEQ ID NO: 3330639 - DNA, 19 bp, Homo sapiens
tcatattgatgaaaagatt

SEQ ID NO: 3330640 - DNA, 15 bp, Homo sapiens
tcatatttacttctt

SEQ ID NO: 3330641 - DNA, 21 bp, Homo sapiens
tcatatttacttcttatacat

SEQ ID NO: 3330642 - DNA, 23 bp, Homo sapiens
tcatattttgtatatatctgctt

SEQ ID NO: 3330643 - DNA, 15 bp, Homo sapiens
tcatcaaaaagaaaa

SEQ ID NO: 3330644 - DNA, 13 bp, Homo sapiens
tcatcaacaagat

SEQ ID NO: 3330645 - DNA, 12 bp, Homo sapiens
tcatcaattccc

SEQ ID NO: 3330646 - DNA, 14 bp, Homo sapiens
tcatcacactgggt

SEQ ID NO: 3330647 - DNA, 19 bp, Homo sapiens
tcatcactccctggatgtg

SEQ ID NO: 3330648 - DNA, 20 bp, Homo sapiens
tcatcactccctggatgtgt

SEQ ID NO: 3330649 - DNA, 15 bp, Homo sapiens
tcatcacttttcagt

SEQ ID NO: 3330650 - DNA, 17 bp, Homo sapiens
tcatcacttttcagtga

SEQ ID NO: 3330651 - DNA, 14 bp, Homo sapiens
tcatcagagcagct

SEQ ID NO: 3330652 - DNA, 18 bp, Homo sapiens
tcatcagatggaaatatt

SEQ ID NO: 3330653 - DNA, 16 bp, Homo sapiens
tcatcagccaccatcc

SEQ ID NO: 3330654 - DNA, 13 bp, Homo sapiens
tcatcaggatgaa

SEQ ID NO: 3330655 - DNA, 23 bp, Homo sapiens
tcatcagggcctggggcctgaga

SEQ ID NO: 3330656 - DNA, 19 bp, Homo sapiens
tcatcagtgcctctttgaa

SEQ ID NO: 3330657 - DNA, 16 bp, Homo sapiens
tcatcagtgttaaaaa

SEQ ID NO: 3330658 - DNA, 13 bp, Homo sapiens
tcatcataaaata

SEQ ID NO: 3330659 - DNA, 19 bp, Homo sapiens
tcatcataaaataaagtat

SEQ ID NO: 3330660 - DNA, 11 bp, Homo sapiens
tcatcatcagg

SEQ ID NO: 3330661 - DNA, 14 bp, Homo sapiens
tcatcatgtagaat

SEQ ID NO: 3330662 - DNA, 12 bp, Homo sapiens
tcatcattgttt

SEQ ID NO: 3330663 - DNA, 17 bp, Homo sapiens
tcatccaacttatgttt

SEQ ID NO: 3330664 - DNA, 15 bp, Homo sapiens
tcatccaacttccaa

SEQ ID NO: 3330665 - DNA, 18 bp, Homo sapiens
tcatccaatcctcactgg

SEQ ID NO: 3330666 - DNA, 22 bp, Homo sapiens
tcatccaatcctcactgggtgg

SEQ ID NO: 3330667 - DNA, 20 bp, Homo sapiens
tcatccaccccatccctccc

SEQ ID NO: 3330668 - DNA, 23 bp, Homo sapiens
tcatccactgtgccatgtgccag

SEQ ID NO: 3330669 - DNA, 20 bp, Homo sapiens
tcatccaggcccaactgtga

SEQ ID NO: 3330670 - DNA, 22 bp, Homo sapiens
tcatccagtttgttctccgggt

SEQ ID NO: 3330671 - DNA, 17 bp, Homo sapiens
tcatcccatgagaccct

SEQ ID NO: 3330672 - DNA, 17 bp, Homo sapiens
tcatccccacaatctgg

SEQ ID NO: 3330673 - DNA, 12 bp, Homo sapiens
tcatccccaggg

SEQ ID NO: 3330674 - DNA, 20 bp, Homo sapiens
tcatccccaggggtcccagc

SEQ ID NO: 3330675 - DNA, 14 bp, Homo sapiens
tcatccccagtccc

SEQ ID NO: 3330676 - DNA, 15 bp, Homo sapiens
tcatccccagtccca

SEQ ID NO: 3330677 - DNA, 19 bp, Homo sapiens
tcatccctttctcccagtg

SEQ ID NO: 3330678 - DNA, 14 bp, Homo sapiens
tcatcctcaaagaa

SEQ ID NO: 3330679 - DNA, 17 bp, Homo sapiens
tcatcctcaaagaaagt

SEQ ID NO: 3330680 - DNA, 21 bp, Homo sapiens
tcatcctcaaagaaagtgtat

SEQ ID NO: 3330681 - DNA, 14 bp, Homo sapiens
tcatcctcctggaa

SEQ ID NO: 3330682 - DNA, 22 bp, Homo sapiens
tcatcctcctggaaccttgctg

SEQ ID NO: 3330683 - DNA, 19 bp, Homo sapiens
tcatcctctggaagggatg

SEQ ID NO: 3330684 - DNA, 20 bp, Homo sapiens
tcatcctggcacgccctact

SEQ ID NO: 3330685 - DNA, 22 bp, Homo sapiens
tcatcctggcacgccctactcc

SEQ ID NO: 3330686 - DNA, 14 bp, Homo sapiens
tcatcctgttttct

SEQ ID NO: 3330687 - DNA, 20 bp, Homo sapiens
tcatcctttgttctgagcat

SEQ ID NO: 3330688 - DNA, 21 bp, Homo sapiens
tcatcgccagaggtgcttcac

SEQ ID NO: 3330689 - DNA, 16 bp, Homo sapiens
tcatcggaggctgggc

SEQ ID NO: 3330690 - DNA, 23 bp, Homo sapiens
tcatcggaggctgggcccctggg

SEQ ID NO: 3330691 - DNA, 22 bp, Homo sapiens
tcatctccaaggatcctctcca

SEQ ID NO: 3330692 - DNA, 21 bp, Homo sapiens
tcatctctctggggccctggg

SEQ ID NO: 3330693 - DNA, 11 bp, Homo sapiens
tcatctgagga

SEQ ID NO: 3330694 - DNA, 12 bp, Homo sapiens
tcatctgaggag

SEQ ID NO: 3330695 - DNA, 12 bp, Homo sapiens
tcatctgcaaaa

SEQ ID NO: 3330696 - DNA, 13 bp, Homo sapiens
tcatctgcaaaag

SEQ ID NO: 3330697 - DNA, 13 bp, Homo sapiens
tcatctgctggtc

SEQ ID NO: 3330698 - DNA, 14 bp, Homo sapiens
tcatctgctggtcc

SEQ ID NO: 3330699 - DNA, 19 bp, Homo sapiens
tcatctgctggtccgtggg

SEQ ID NO: 3330700 - DNA, 20 bp, Homo sapiens
tcatctggggttggcaacag

SEQ ID NO: 3330701 - DNA, 13 bp, Homo sapiens
tcatctgtagata

SEQ ID NO: 3330702 - DNA, 16 bp, Homo sapiens
tcatctgtcattatat

SEQ ID NO: 3330703 - DNA, 21 bp, Homo sapiens
tcatctgtcattatattctaa

SEQ ID NO: 3330704 - DNA, 15 bp, Homo sapiens
tcatctgtggagctg

SEQ ID NO: 3330705 - DNA, 14 bp, Homo sapiens
tcatcttaaaaata

SEQ ID NO: 3330706 - DNA, 12 bp, Homo sapiens
tcatcttactgt

SEQ ID NO: 3330707 - DNA, 11 bp, Homo sapiens
tcatcttctct

SEQ ID NO: 3330708 - DNA, 18 bp, Homo sapiens
tcatcttgctaccagtat

SEQ ID NO: 3330709 - DNA, 22 bp, Homo sapiens
tcatcttggtactactagatgt

SEQ ID NO: 3330710 - DNA, 13 bp, Homo sapiens
tcatcttgtgaaa

SEQ ID NO: 3330711 - DNA, 14 bp, Homo sapiens
tcatcttttatcta

SEQ ID NO: 3330712 - DNA, 19 bp, Homo sapiens
tcccatctgcaccccttct

SEQ ID NO: 3330713 - DNA, 15 bp, Homo sapiens
tcccatcttccaagg

SEQ ID NO: 3330714 - DNA, 18 bp, Homo sapiens
tcccatgacccacccctg

SEQ ID NO: 3330715 - DNA, 19 bp, Homo sapiens
tcccatgactgcacccagc

SEQ ID NO: 3330716 - DNA, 19 bp, Homo sapiens
tcccatgagcctcagcatc

SEQ ID NO: 3330717 - DNA, 15 bp, Homo sapiens
tcccatgcaggccct

SEQ ID NO: 3330718 - DNA, 12 bp, Homo sapiens
tcccatgccctg

SEQ ID NO: 3330719 - DNA, 19 bp, Homo sapiens
tcccatgcctggtcccaag

SEQ ID NO: 3330720 - DNA, 15 bp, Homo sapiens
tcccatgcctgtctc

SEQ ID NO: 3330721 - DNA, 13 bp, Homo sapiens
tcccatgtagccc

SEQ ID NO: 3330722 - DNA, 21 bp, Homo sapiens
tcccattaatcatttccccat

SEQ ID NO: 3330723 - DNA, 18 bp, Homo sapiens
tcccattcacttctgcat

SEQ ID NO: 3330724 - DNA, 21 bp, Homo sapiens
tcccattcatattaagacagt

SEQ ID NO: 3330725 - DNA, 15 bp, Homo sapiens
tcccattcttggccc

SEQ ID NO: 3330726 - DNA, 16 bp, Homo sapiens
tcccattgtggctcct

SEQ ID NO: 3330727 - DNA, 16 bp, Homo sapiens
tcccatttcaggaatt

SEQ ID NO: 3330728 - DNA, 22 bp, Homo sapiens
tcccattttccccttcctcatt

SEQ ID NO: 3330729 - DNA, 22 bp, Homo sapiens
tcccattttgcaaaatttccag

SEQ ID NO: 3330730 - DNA, 18 bp, Homo sapiens
tcccattttggaagtttt

SEQ ID NO: 3330731 - DNA, 20 bp, Homo sapiens
tcccattttggaagttttca

SEQ ID NO: 3330732 - DNA, 14 bp, Homo sapiens
tcccatttttactt

SEQ ID NO: 3330733 - DNA, 15 bp, Homo sapiens
tcccatttttactta

SEQ ID NO: 3330734 - DNA, 13 bp, Homo sapiens
tccccaaccacag

SEQ ID NO: 3330735 - DNA, 16 bp, Homo sapiens
tccccaaccacagaga

SEQ ID NO: 3330736 - DNA, 17 bp, Homo sapiens
tccccaaccacagagaa

SEQ ID NO: 3330737 - DNA, 20 bp, Homo sapiens
tccccaaccctaggttccct

SEQ ID NO: 3330738 - DNA, 19 bp, Homo sapiens
tccccaacttccctagtcc

SEQ ID NO: 3330739 - DNA, 13 bp, Homo sapiens
tccccaagggccc

SEQ ID NO: 3330740 - DNA, 17 bp, Homo sapiens
tccccaagggccctggc

SEQ ID NO: 3330741 - DNA, 19 bp, Homo sapiens
tccccaagggccctggcac

SEQ ID NO: 3330742 - DNA, 12 bp, Homo sapiens
tccccacagcct

SEQ ID NO: 3330743 - DNA, 15 bp, Homo sapiens
tccccacagcctctg

SEQ ID NO: 3330744 - DNA, 20 bp, Homo sapiens
tccccacagcctctggctcc

SEQ ID NO: 3330745 - DNA, 21 bp, Homo sapiens
tccccacagcctctggctcca

SEQ ID NO: 3330746 - DNA, 13 bp, Homo sapiens
tccccacccctgc

SEQ ID NO: 3330747 - DNA, 16 bp, Homo sapiens
tccccacccctgcccc

SEQ ID NO: 3330748 - DNA, 18 bp, Homo sapiens
tccccacccctgccccca

SEQ ID NO: 3330749 - DNA, 13 bp, Homo sapiens
tccccaccctcca

SEQ ID NO: 3330750 - DNA, 17 bp, Homo sapiens
tccccaccctcctcttg

SEQ ID NO: 3330751 - DNA, 13 bp, Homo sapiens
tccccacctggga

SEQ ID NO: 3330752 - DNA, 14 bp, Homo sapiens
tccccacctgggac

SEQ ID NO: 3330753 - DNA, 15 bp, Homo sapiens
tccccacgagggctg

SEQ ID NO: 3330754 - DNA, 20 bp, Homo sapiens
tccccacgagggctggctgg

SEQ ID NO: 3330755 - DNA, 18 bp, Homo sapiens
tccccacgagtcacctgc

SEQ ID NO: 3330756 - DNA, 23 bp, Homo sapiens
tccccacgagtcacctgcaagcc

SEQ ID NO: 3330757 - DNA, 14 bp, Homo sapiens
tccccacgccctcc

SEQ ID NO: 3330758 - DNA, 21 bp, Homo sapiens
tccccactaggttcttttcca

SEQ ID NO: 3330759 - DNA, 22 bp, Homo sapiens
tccccactccctggctctcaga

SEQ ID NO: 3330760 - DNA, 16 bp, Homo sapiens
tccccactgacagcct

SEQ ID NO: 3330761 - DNA, 21 bp, Homo sapiens
tccccagagctgtgccagcag

SEQ ID NO: 3330762 - DNA, 13 bp, Homo sapiens
tccccagcccagg

SEQ ID NO: 3330763 - DNA, 14 bp, Homo sapiens
tccccagcccaggg

SEQ ID NO: 3330764 - DNA, 15 bp, Homo sapiens
tccccagcccagggt

SEQ ID NO: 3330765 - DNA, 13 bp, Homo sapiens
tccccagccctgg

SEQ ID NO: 3330766 - DNA, 15 bp, Homo sapiens
tccccagccctggct

SEQ ID NO: 3330767 - DNA, 18 bp, Homo sapiens
tccccagccctgtcctgg

SEQ ID NO: 3330768 - DNA, 22 bp, Homo sapiens
tccccagcccttctgcctttct

SEQ ID NO: 3330769 - DNA, 16 bp, Homo sapiens
tccccaggatggactc

SEQ ID NO: 3330770 - DNA, 15 bp, Homo sapiens
tccccaggcccacca

SEQ ID NO: 3330771 - DNA, 12 bp, Homo sapiens
tccccaggcctc

SEQ ID NO: 3330772 - DNA, 18 bp, Homo sapiens
tccccaggcctccagcct

SEQ ID NO: 3330773 - DNA, 22 bp, Homo sapiens
tccccaggcctccagcctctcc

SEQ ID NO: 3330774 - DNA, 16 bp, Homo sapiens
tccccagggaaggaaa

SEQ ID NO: 3330775 - DNA, 16 bp, Homo sapiens
tccccagggctccctt

SEQ ID NO: 3330776 - DNA, 17 bp, Homo sapiens
tccccagggctccctta

SEQ ID NO: 3330777 - DNA, 19 bp, Homo sapiens
tccccaggggaaaatgaag

SEQ ID NO: 3330778 - DNA, 18 bp, Homo sapiens
tccccaggggtcccagcc

SEQ ID NO: 3330779 - DNA, 22 bp, Homo sapiens
tccccaggggtcccagccaccc

SEQ ID NO: 3330780 - DNA, 16 bp, Homo sapiens
tccccaggtccagctc

SEQ ID NO: 3330781 - DNA, 23 bp, Homo sapiens
tccccaggtccagctctggaggg

SEQ ID NO: 3330782 - DNA, 16 bp, Homo sapiens
tccccagttgccgtct

SEQ ID NO: 3330783 - DNA, 17 bp, Homo sapiens
tccccataactcaatgg

SEQ ID NO: 3330784 - DNA, 14 bp, Homo sapiens
tccccatcatccca

SEQ ID NO: 3330785 - DNA, 19 bp, Homo sapiens
tccccatcatcccagctgc

SEQ ID NO: 3330786 - DNA, 14 bp, Homo sapiens
tccccatccccacc

SEQ ID NO: 3330787 - DNA, 15 bp, Homo sapiens
tccccatccccacca

SEQ ID NO: 3330788 - DNA, 16 bp, Homo sapiens
tccccatccccaccag

SEQ ID NO: 3330789 - DNA, 18 bp, Homo sapiens
tccccatccccttcctaa

SEQ ID NO: 3330790 - DNA, 19 bp, Homo sapiens
tccccatccctgtcatttt

SEQ ID NO: 3330791 - DNA, 17 bp, Homo sapiens
tccccatcctccagctt

SEQ ID NO: 3330792 - DNA, 19 bp, Homo sapiens
tccccatcctccagcttct

SEQ ID NO: 3330793 - DNA, 16 bp, Homo sapiens
tccccatctccctgcc

SEQ ID NO: 3330794 - DNA, 19 bp, Homo sapiens
tccccatctccctgcctgg

SEQ ID NO: 3330795 - DNA, 20 bp, Homo sapiens
tccccatctccctgcctggc

SEQ ID NO: 3330796 - DNA, 18 bp, Homo sapiens
tccccatctgccacaggc

SEQ ID NO: 3330797 - DNA, 19 bp, Homo sapiens
tccccatctgccacaggcc

SEQ ID NO: 3330798 - DNA, 15 bp, Homo sapiens
tccccatggagccag

SEQ ID NO: 3330799 - DNA, 20 bp, Homo sapiens
tccccatgtgcctgcaccag

SEQ ID NO: 3330800 - DNA, 21 bp, Homo sapiens
tccccattagagtcagccttc

SEQ ID NO: 3330801 - DNA, 13 bp, Homo sapiens
tcccccaacccac

SEQ ID NO: 3330802 - DNA, 16 bp, Homo sapiens
tcccccaacccacctc

SEQ ID NO: 3330803 - DNA, 22 bp, Homo sapiens
tcccccaacccacctctggccc

SEQ ID NO: 3330804 - DNA, 14 bp, Homo sapiens
tcccccaaccccca

SEQ ID NO: 3330805 - DNA, 16 bp, Homo sapiens
tcccccaacccccacc

SEQ ID NO: 3330806 - DNA, 20 bp, Homo sapiens
tcccccaacccccaccccac

SEQ ID NO: 3330807 - DNA, 23 bp, Homo sapiens
tcccccaccccttaggccccgtg

SEQ ID NO: 3330808 - DNA, 21 bp, Homo sapiens
tcccccaccggtccagctggc

SEQ ID NO: 3330809 - DNA, 22 bp, Homo sapiens
tcccccaccggtccagctggcc

SEQ ID NO: 3330810 - DNA, 15 bp, Homo sapiens
tcccccacctgacaa

SEQ ID NO: 3330811 - DNA, 22 bp, Homo sapiens
tcccccacctgacaatggcagc

SEQ ID NO: 3330812 - DNA, 24 bp, Homo sapiens
tcccccactactgcagcacctcca

SEQ ID NO: 3330813 - DNA, 16 bp, Homo sapiens
tcccccacttcccctc

SEQ ID NO: 3330814 - DNA, 13 bp, Homo sapiens
tcccccagcaagc

SEQ ID NO: 3330815 - DNA, 14 bp, Homo sapiens
tcccccatagccac

SEQ ID NO: 3330816 - DNA, 15 bp, Homo sapiens
tcccccatagccacc

SEQ ID NO: 3330817 - DNA, 15 bp, Homo sapiens
tcccccatctcccac

SEQ ID NO: 3330818 - DNA, 22 bp, Homo sapiens
tccccccacaagtgccctccag

SEQ ID NO: 3330819 - DNA, 16 bp, Homo sapiens
tcccccccagcctggc

SEQ ID NO: 3330820 - DNA, 14 bp, Homo sapiens
tcccccccctttcc

SEQ ID NO: 3330821 - DNA, 21 bp, Homo sapiens
tcccccgacactgctgcacca

SEQ ID NO: 3330822 - DNA, 24 bp, Homo sapiens
tcccccgagctcttggcctttgca

SEQ ID NO: 3330823 - DNA, 17 bp, Homo sapiens
tcccccgcagtccccag

SEQ ID NO: 3330824 - DNA, 14 bp, Homo sapiens
tcccccgccactcc

SEQ ID NO: 3330825 - DNA, 17 bp, Homo sapiens
tccccctatccttggca

SEQ ID NO: 3330826 - DNA, 17 bp, Homo sapiens
tccccctcccctcccag

SEQ ID NO: 3330827 - DNA, 17 bp, Homo sapiens
tccccctcttcttctga

SEQ ID NO: 3330828 - DNA, 15 bp, Homo sapiens
tccccctgccctcgt

SEQ ID NO: 3330829 - DNA, 14 bp, Homo sapiens
tccccctgggctct

SEQ ID NO: 3330830 - DNA, 23 bp, Homo sapiens
tccccctgggctctgccccagct

SEQ ID NO: 3330831 - DNA, 20 bp, Homo sapiens
tccccctggggcttctcctg

SEQ ID NO: 3330832 - DNA, 18 bp, Homo sapiens
tccccctgtagactagtg

SEQ ID NO: 3330833 - DNA, 16 bp, Homo sapiens
tccccctgtcccctca

SEQ ID NO: 3330834 - DNA, 13 bp, Homo sapiens
tccccctgttctg

SEQ ID NO: 3330835 - DNA, 14 bp, Homo sapiens
tcccccttcctagt

SEQ ID NO: 3330836 - DNA, 21 bp, Homo sapiens
tcccccttcctttggtgcctc

SEQ ID NO: 3330837 - DNA, 24 bp, Homo sapiens
tccccgaaacaggctactctcctc

SEQ ID NO: 3330838 - DNA, 18 bp, Homo sapiens
tccccgaggagctgggcc

SEQ ID NO: 3330839 - DNA, 23 bp, Homo sapiens
tccccgaggagctgggcccctgc

SEQ ID NO: 3330840 - DNA, 21 bp, Homo sapiens
tccccgcaccccccaagctgt

SEQ ID NO: 3330841 - DNA, 17 bp, Homo sapiens
tcccagctgtgctctgg

SEQ ID NO: 3330842 - DNA, 22 bp, Homo sapiens
tcccagctgtgctctggacagg

SEQ ID NO: 3330843 - DNA, 16 bp, Homo sapiens
tcccagctgtgctgtg

SEQ ID NO: 3330844 - DNA, 18 bp, Homo sapiens
tcccagcttgtaggagct

SEQ ID NO: 3330845 - DNA, 15 bp, Homo sapiens
tcccaggacaccaca

SEQ ID NO: 3330846 - DNA, 23 bp, Homo sapiens
tcccaggacaccacacccagcct

SEQ ID NO: 3330847 - DNA, 15 bp, Homo sapiens
tcccaggagacagtt

SEQ ID NO: 3330848 - DNA, 16 bp, Homo sapiens
tcccaggagacagttc

SEQ ID NO: 3330849 - DNA, 23 bp, Homo sapiens
tcccaggcagcacagtgtgtgaa

SEQ ID NO: 3330850 - DNA, 18 bp, Homo sapiens
tcccaggcgccccttccc

SEQ ID NO: 3330851 - DNA, 21 bp, Homo sapiens
tcccaggcgccccttccccct

SEQ ID NO: 3330852 - DNA, 16 bp, Homo sapiens
tcccaggctgccccca

SEQ ID NO: 3330853 - DNA, 15 bp, Homo sapiens
tcccaggcttcaccc

SEQ ID NO: 3330854 - DNA, 16 bp, Homo sapiens
tcccagggaaggactt

SEQ ID NO: 3330855 - DNA, 12 bp, Homo sapiens
tcccagggctgg

SEQ ID NO: 3330856 - DNA, 15 bp, Homo sapiens
tcccagggctggctc

SEQ ID NO: 3330857 - DNA, 17 bp, Homo sapiens
tcccaggggtctccctg

SEQ ID NO: 3330858 - DNA, 21 bp, Homo sapiens
tcccaggggtctccctggctc

SEQ ID NO: 3330859 - DNA, 16 bp, Homo sapiens
tcccaggtaccagctg

SEQ ID NO: 3330860 - DNA, 15 bp, Homo sapiens
tcccaggtgttaaca

SEQ ID NO: 3330861 - DNA, 23 bp, Homo sapiens
tcccaggtgttaacattccaaga

SEQ ID NO: 3330862 - DNA, 21 bp, Homo sapiens
tcccagtaggcttttaccatt

SEQ ID NO: 3330863 - DNA, 15 bp, Homo sapiens
tcccagtcctccaga

SEQ ID NO: 3330864 - DNA, 15 bp, Homo sapiens
tcccagtgaattctt

SEQ ID NO: 3330865 - DNA, 19 bp, Homo sapiens
tcccagtgagtctctgggg

SEQ ID NO: 3330866 - DNA, 15 bp, Homo sapiens
tcccagtgggagggg

SEQ ID NO: 3330867 - DNA, 20 bp, Homo sapiens
tcccagttggggaagccagg

SEQ ID NO: 3330868 - DNA, 22 bp, Homo sapiens
tcccataattgctttgccaaaa

SEQ ID NO: 3330869 - DNA, 17 bp, Homo sapiens
tcccatagccaggaaac

SEQ ID NO: 3330870 - DNA, 21 bp, Homo sapiens
tcccatattggcatggatttc

SEQ ID NO: 3330871 - DNA, 12 bp, Homo sapiens
tcccatccaggc

SEQ ID NO: 3330872 - DNA, 13 bp, Homo sapiens
tcccatccaggca

SEQ ID NO: 3330873 - DNA, 14 bp, Homo sapiens
tcccatccaggcag

SEQ ID NO: 3330874 - DNA, 13 bp, Homo sapiens
tcccatcccctgg

SEQ ID NO: 3330875 - DNA, 18 bp, Homo sapiens
tcccatcctaccctcggg

SEQ ID NO: 3330876 - DNA, 20 bp, Homo sapiens
tcccatcctaccctcgggcc

SEQ ID NO: 3330877 - DNA, 14 bp, Homo sapiens
tcccatcctggggc

SEQ ID NO: 3330878 - DNA, 18 bp, Homo sapiens
tcccatcctggggcagca

SEQ ID NO: 3330879 - DNA, 13 bp, Homo sapiens
tcccatcgctgtc

SEQ ID NO: 3330880 - DNA, 14 bp, Homo sapiens
tcccatcggaagtt

SEQ ID NO: 3330881 - DNA, 13 bp, Homo sapiens
tcccatctgcacc

SEQ ID NO: 3330882 - DNA, 19 bp, Homo sapiens
tcctctctccagatgtttc

SEQ ID NO: 3330883 - DNA, 11 bp, Homo sapiens
tcctctctgct

SEQ ID NO: 3330884 - DNA, 13 bp, Homo sapiens
tcctctctgcttc

SEQ ID NO: 3330885 - DNA, 14 bp, Homo sapiens
tcctctctgcttca

SEQ ID NO: 3330886 - DNA, 17 bp, Homo sapiens
tcctctctttgttctca

SEQ ID NO: 3330887 - DNA, 20 bp, Homo sapiens
tcctctctttgttctcagct

SEQ ID NO: 3330888 - DNA, 18 bp, Homo sapiens
tcctctgagttctgtact

SEQ ID NO: 3330889 - DNA, 12 bp, Homo sapiens
tcctctgcactc

SEQ ID NO: 3330890 - DNA, 18 bp, Homo sapiens
tcctctgctggttcctga

SEQ ID NO: 3330891 - DNA, 19 bp, Homo sapiens
tcctctgcttgcctggaga

SEQ ID NO: 3330892 - DNA, 17 bp, Homo sapiens
tcctctggacggcaggc

SEQ ID NO: 3330893 - DNA, 24 bp, Homo sapiens
tcctctggacggcaggctcactgc

SEQ ID NO: 3330894 - DNA, 12 bp, Homo sapiens
tcctctggagcc

SEQ ID NO: 3330895 - DNA, 17 bp, Homo sapiens
tcctctgtccaggcact

SEQ ID NO: 3330896 - DNA, 17 bp, Homo sapiens
tcctctgtcctgcttct

SEQ ID NO: 3330897 - DNA, 13 bp, Homo sapiens
tcctctgttcaca

SEQ ID NO: 3330898 - DNA, 20 bp, Homo sapiens
tcctcttcaccccggcaggc

SEQ ID NO: 3330899 - DNA, 11 bp, Homo sapiens
tcctcttcaga

SEQ ID NO: 3330900 - DNA, 19 bp, Homo sapiens
tcctcttcagaacttgtca

SEQ ID NO: 3330901 - DNA, 17 bp, Homo sapiens
tcctcttctgacgtgcc

SEQ ID NO: 3330902 - DNA, 17 bp, Homo sapiens
tcctcttctgggcctga

SEQ ID NO: 3330903 - DNA, 13 bp, Homo sapiens
tcctcttctttat

SEQ ID NO: 3330904 - DNA, 19 bp, Homo sapiens
tcctcttgccactgcctct

SEQ ID NO: 3330905 - DNA, 12 bp, Homo sapiens
tcctctttgtaa

SEQ ID NO: 3330906 - DNA, 22 bp, Homo sapiens
tcctgaaaagctgcatttaaat

SEQ ID NO: 3330907 - DNA, 20 bp, Homo sapiens
tcctgaaacccaaagccctg

SEQ ID NO: 3330908 - DNA, 21 bp, Homo sapiens
tcctgaaacccaaagccctgg

SEQ ID NO: 3330909 - DNA, 22 bp, Homo sapiens
tcctgaaacccaaagccctggt

SEQ ID NO: 3330910 - DNA, 14 bp, Homo sapiens
tcctgaaataaaca

SEQ ID NO: 3330911 - DNA, 17 bp, Homo sapiens
tcctgaaataaacactg

SEQ ID NO: 3330912 - DNA, 14 bp, Homo sapiens
tcctgaaatttcag

SEQ ID NO: 3330913 - DNA, 15 bp, Homo sapiens
tcctgaaatttcaga

SEQ ID NO: 3330914 - DNA, 20 bp, Homo sapiens
tcctgaaccgcacagctcag

SEQ ID NO: 3330915 - DNA, 14 bp, Homo sapiens
tcctgaagaggcgg

SEQ ID NO: 3330916 - DNA, 17 bp, Homo sapiens
tcctgaagaggcgggcc

SEQ ID NO: 3330917 - DNA, 22 bp, Homo sapiens
tcctgaagaggcgggccagcca

SEQ ID NO: 3330918 - DNA, 23 bp, Homo sapiens
tcctgaagaggcgggccagccag

SEQ ID NO: 3330919 - DNA, 13 bp, Homo sapiens
tcctgaagtgagt

SEQ ID NO: 3330920 - DNA, 19 bp, Homo sapiens
tcctgaatgaaatatcaga

SEQ ID NO: 3330921 - DNA, 13 bp, Homo sapiens
tcctgacaaatat

SEQ ID NO: 3330922 - DNA, 13 bp, Homo sapiens
tcctgacacttta

SEQ ID NO: 3330923 - DNA, 18 bp, Homo sapiens
tcctgacatcacagcagc

SEQ ID NO: 3330924 - DNA, 16 bp, Homo sapiens
tcctgaccaccctccc

SEQ ID NO: 3330925 - DNA, 19 bp, Homo sapiens
tcctgaccaccctcccctc

SEQ ID NO: 3330926 - DNA, 20 bp, Homo sapiens
tcctgaccaccctcccctct

SEQ ID NO: 3330927 - DNA, 12 bp, Homo sapiens
tcctgacccagg

SEQ ID NO: 3330928 - DNA, 15 bp, Homo sapiens
tcctgacccaggccg

SEQ ID NO: 3330929 - DNA, 16 bp, Homo sapiens
tcctgacccaggccgc

SEQ ID NO: 3330930 - DNA, 17 bp, Homo sapiens
tcctgacccaggccgca

SEQ ID NO: 3330931 - DNA, 14 bp, Homo sapiens
tcctgacgccctgc

SEQ ID NO: 3330932 - DNA, 15 bp, Homo sapiens
tcctgacgccctgcg

SEQ ID NO: 3330933 - DNA, 21 bp, Homo sapiens
tcctgacggcgcccccagtgt

SEQ ID NO: 3330934 - DNA, 23 bp, Homo sapiens
tcctgactcctacctgccctgga

SEQ ID NO: 3330935 - DNA, 13 bp, Homo sapiens
tcctgactgtaac

SEQ ID NO: 3330936 - DNA, 12 bp, Homo sapiens
tcctgacttgag

SEQ ID NO: 3330937 - DNA, 17 bp, Homo sapiens
tcctgacttgagtgttc

SEQ ID NO: 3330938 - DNA, 18 bp, Homo sapiens
tcctgagaaaggtgagga

SEQ ID NO: 3330939 - DNA, 22 bp, Homo sapiens
tcctgggggttctttcttcctc

SEQ ID NO: 3330940 - DNA, 14 bp, Homo sapiens
tcctgggtatttat

SEQ ID NO: 3330941 - DNA, 21 bp, Homo sapiens
tcctgggtgtgtttggcttgg

SEQ ID NO: 3330942 - DNA, 18 bp, Homo sapiens
tcctgggttcaagtgatt

SEQ ID NO: 3330943 - DNA, 14 bp, Homo sapiens
tcctgggtttcctg

SEQ ID NO: 3330944 - DNA, 17 bp, Homo sapiens
tcctgggtttcctgcag

SEQ ID NO: 3330945 - DNA, 13 bp, Homo sapiens
tcctggtctgtga

SEQ ID NO: 3330946 - DNA, 17 bp, Homo sapiens
tcctggtcttgagatgt

SEQ ID NO: 3330947 - DNA, 17 bp, Homo sapiens
tcctggtgcccctcgcc

SEQ ID NO: 3330948 - DNA, 19 bp, Homo sapiens
tcctggtggccttctgctg

SEQ ID NO: 3330949 - DNA, 22 bp, Homo sapiens
tcctggtggccttctgctgccc

SEQ ID NO: 3330950 - DNA, 21 bp, Homo sapiens
tcctggttcccgtttctccac

SEQ ID NO: 3330951 - DNA, 23 bp, Homo sapiens
tcctggttttgtacactgctgta

SEQ ID NO: 3330952 - DNA, 16 bp, Homo sapiens
tcctgtaagccaaaga

SEQ ID NO: 3330953 - DNA, 21 bp, Homo sapiens
tcctgtacactgaatatttat

SEQ ID NO: 3330954 - DNA, 14 bp, Homo sapiens
tcctgtacattgtg

SEQ ID NO: 3330955 - DNA, 20 bp, Homo sapiens
tcctgtacattgtgggatgt

SEQ ID NO: 3330956 - DNA, 15 bp, Homo sapiens
tcctgtaccaaatct

SEQ ID NO: 3330957 - DNA, 23 bp, Homo sapiens
tcctgtaccaaatctgacatatt

SEQ ID NO: 3330958 - DNA, 15 bp, Homo sapiens
tcctgtacctcagtg

SEQ ID NO: 3330959 - DNA, 17 bp, Homo sapiens
tcctgtacctcagtgga

SEQ ID NO: 3330960 - DNA, 23 bp, Homo sapiens
tcctgtagacctagggaggacct

SEQ ID NO: 3330961 - DNA, 21 bp, Homo sapiens
tcctgtagaggttttgttgtt

SEQ ID NO: 3330962 - DNA, 22 bp, Homo sapiens
tcctgtagttgcgtggactctg

SEQ ID NO: 3330963 - DNA, 14 bp, Homo sapiens
tcctgtataagcac

SEQ ID NO: 3330964 - DNA, 13 bp, Homo sapiens
tcctgtatgttgt

SEQ ID NO: 3330965 - DNA, 13 bp, Homo sapiens
tcctgtcagtgtt

SEQ ID NO: 3330966 - DNA, 17 bp, Homo sapiens
tcctgtccacacccagc

SEQ ID NO: 3330967 - DNA, 22 bp, Homo sapiens
tcctgtccacacccagctcagc

SEQ ID NO: 3330968 - DNA, 22 bp, Homo sapiens
tcctgtccactctcggggccct

SEQ ID NO: 3330969 - DNA, 18 bp, Homo sapiens
tcctgtcccgccttcctc

SEQ ID NO: 3330970 - DNA, 17 bp, Homo sapiens
tcctgtcccttgacctt

SEQ ID NO: 3330971 - DNA, 18 bp, Homo sapiens
tcctgtctgccctctggg

SEQ ID NO: 3330972 - DNA, 20 bp, Homo sapiens
tcctgtctgccctctgggtc

SEQ ID NO: 3330973 - DNA, 16 bp, Homo sapiens
tcctgtcttttcaggt

SEQ ID NO: 3330974 - DNA, 22 bp, Homo sapiens
tcctgtgaatgccactgccttc

SEQ ID NO: 3330975 - DNA, 18 bp, Homo sapiens
tcctgtgaatggaagcaa

SEQ ID NO: 3330976 - DNA, 20 bp, Homo sapiens
tcctgtgaatggaggcagag

SEQ ID NO: 3330977 - DNA, 24 bp, Homo sapiens
tcctgtgaatggaggcagagacct

SEQ ID NO: 3330978 - DNA, 17 bp, Homo sapiens
tcctgtggaacccagca

SEQ ID NO: 3330979 - DNA, 23 bp, Homo sapiens
tcctgtggaaggcagagaaatct

SEQ ID NO: 3330980 - DNA, 14 bp, Homo sapiens
tcctgtggcaggca

SEQ ID NO: 3330981 - DNA, 15 bp, Homo sapiens
tcctgtggcaggcag

SEQ ID NO: 3330982 - DNA, 20 bp, Homo sapiens
tcctgtggcaggcagcgcca

SEQ ID NO: 3330983 - DNA, 19 bp, Homo sapiens
tcctgtggcataaattgca

SEQ ID NO: 3330984 - DNA, 20 bp, Homo sapiens
tcctgtggcataaattgcat

SEQ ID NO: 3330985 - DNA, 23 bp, Homo sapiens
tcctgtggccccaccctgggccc

SEQ ID NO: 3330986 - DNA, 15 bp, Homo sapiens
tcctgtggggaaagg

SEQ ID NO: 3330987 - DNA, 17 bp, Homo sapiens
tcctgtgtactgtgtca

SEQ ID NO: 3330988 - DNA, 21 bp, Homo sapiens
tcctgttaatgtatttgttca

SEQ ID NO: 3330989 - DNA, 18 bp, Homo sapiens
tcctgttcagcattctta

SEQ ID NO: 3330990 - DNA, 15 bp, Homo sapiens
tcctgtttccagggt

SEQ ID NO: 3330991 - DNA, 22 bp, Homo sapiens
tcctgtttcccttcccttccac

SEQ ID NO: 3330992 - DNA, 20 bp, Homo sapiens
tcctgttttatatattatgt

SEQ ID NO: 3330993 - DNA, 17 bp, Homo sapiens
tcctgttttctctgtga

SEQ ID NO: 3330994 - DNA, 19 bp, Homo sapiens
tccttaaaaatcacactgt

SEQ ID NO: 3330995 - DNA, 16 bp, Homo sapiens
tccttaaactgtgtgg

SEQ ID NO: 3330996 - DNA, 17 bp, Homo sapiens
tccttaaactgtgtgga

SEQ ID NO: 3330997 - DNA, 22 bp, Homo sapiens
tccttaaaggcaccatctaata

SEQ ID NO: 3330998 - DNA, 23 bp, Homo sapiens
tccttaaataaactcaatgagct

SEQ ID NO: 3330999 - DNA, 17 bp, Homo sapiens
tccttaatccagctgat

SEQ ID NO: 3331000 - DNA, 21 bp, Homo sapiens
tccttacaagttagaaaacat

SEQ ID NO: 3331001 - DNA, 15 bp, Homo sapiens
tccttacctttttat

SEQ ID NO: 3331002 - DNA, 20 bp, Homo sapiens
tccttactctgagcccaggc

SEQ ID NO: 3331003 - DNA, 20 bp, Homo sapiens
tccttactgtgtttcagcat

SEQ ID NO: 3331004 - DNA, 21 bp, Homo sapiens
tccttaggagacgctgcactt

SEQ ID NO: 3331005 - DNA, 22 bp, Homo sapiens
tccttaggagacgctgcacttg

SEQ ID NO: 3331006 - DNA, 18 bp, Homo sapiens
tccttagtcttctcatag

SEQ ID NO: 3331007 - DNA, 18 bp, Homo sapiens
tccttatagacacttgct

SEQ ID NO: 3331008 - DNA, 14 bp, Homo sapiens
tccttatcagagct

SEQ ID NO: 3331009 - DNA, 15 bp, Homo sapiens
tccttatcagagcta

SEQ ID NO: 3331010 - DNA, 22 bp, Homo sapiens
tccttatcagagctaagggtgg

SEQ ID NO: 3331011 - DNA, 14 bp, Homo sapiens
tccttattccacag

SEQ ID NO: 3331012 - DNA, 13 bp, Homo sapiens
tccttattttgta

SEQ ID NO: 3331013 - DNA, 20 bp, Homo sapiens
tccttcacaggcagtgcatg

SEQ ID NO: 3331014 - DNA, 18 bp, Homo sapiens
tccttcactcatccagcc

SEQ ID NO: 3331015 - DNA, 12 bp, Homo sapiens
tccttcactgtt

SEQ ID NO: 3331016 - DNA, 13 bp, Homo sapiens
tccttcactgttt

SEQ ID NO: 3331017 - DNA, 12 bp, Homo sapiens
tccttcagcacg

SEQ ID NO: 3331018 - DNA, 13 bp, Homo sapiens
tccttcagggatt

SEQ ID NO: 3331019 - DNA, 14 bp, Homo sapiens
tccttcattcatag

SEQ ID NO: 3331020 - DNA, 15 bp, Homo sapiens
tccttcattcatagg

SEQ ID NO: 3331021 - DNA, 18 bp, Homo sapiens
tccttccaaaaaattaaa

SEQ ID NO: 3331022 - DNA, 15 bp, Homo sapiens
tccttccaaagaatt

SEQ ID NO: 3331023 - DNA, 17 bp, Homo sapiens
tccttccacagttatct

SEQ ID NO: 3331024 - DNA, 17 bp, Homo sapiens
tccttccatccctaccc

SEQ ID NO: 3331025 - DNA, 18 bp, Homo sapiens
tccttcccatttctctac

SEQ ID NO: 3331026 - DNA, 12 bp, Homo sapiens
tccttccccagg

SEQ ID NO: 3331027 - DNA, 15 bp, Homo sapiens
tccttccctgggaag

SEQ ID NO: 3331028 - DNA, 18 bp, Homo sapiens
tccttccctgggaaggct

SEQ ID NO: 3331029 - DNA, 16 bp, Homo sapiens
tccttcccttttctgt

SEQ ID NO: 3331030 - DNA, 16 bp, Homo sapiens
tccttcctatgcccag

SEQ ID NO: 3331031 - DNA, 14 bp, Homo sapiens
tccttcctctcaag

SEQ ID NO: 3331032 - DNA, 15 bp, Homo sapiens
tccttcctgattgtt

SEQ ID NO: 3331033 - DNA, 21 bp, Homo sapiens
tccttcggggcgatgctccct

SEQ ID NO: 3331034 - DNA, 17 bp, Homo sapiens
tccttcgtatcccgagt

SEQ ID NO: 3331035 - DNA, 20 bp, Homo sapiens
tccttcgtccccagttgccg

SEQ ID NO: 3331036 - DNA, 23 bp, Homo sapiens
tccttcgtgaacatcccctccca

SEQ ID NO: 3331037 - DNA, 16 bp, Homo sapiens
tccttcgtgtctctcc

SEQ ID NO: 3331038 - DNA, 23 bp, Homo sapiens
tccttctctgaacacaggcagct

SEQ ID NO: 3331039 - DNA, 19 bp, Homo sapiens
tccttctgcaactgaaatt

SEQ ID NO: 3331040 - DNA, 12 bp, Homo sapiens
tccttctggcct

SEQ ID NO: 3331041 - DNA, 12 bp, Homo sapiens
tccttctgtcct

SEQ ID NO: 3331042 - DNA, 16 bp, Homo sapiens
tccttcttgtagtagt

SEQ ID NO: 3331043 - DNA, 20 bp, Homo sapiens
tccttctttgataatgttaa

SEQ ID NO: 3331044 - DNA, 22 bp, Homo sapiens
tccttctttgataatgttaaat

SEQ ID NO: 3331045 - DNA, 19 bp, Homo sapiens
tccttgaagaactgcaggc

SEQ ID NO: 3331046 - DNA, 17 bp, Homo sapiens
tccttgagacacggagc

SEQ ID NO: 3331047 - DNA, 21 bp, Homo sapiens
tccttgagacacggagcccag

SEQ ID NO: 3331048 - DNA, 23 bp, Homo sapiens
tccttgagacacggagcccagcc

SEQ ID NO: 3331049 - DNA, 17 bp, Homo sapiens
tccttgataatatattg

SEQ ID NO: 3331050 - DNA, 14 bp, Homo sapiens
tccttgatcatttt

SEQ ID NO: 3331051 - DNA, 15 bp, Homo sapiens
tccttgccccacagt

SEQ ID NO: 3331052 - DNA, 23 bp, Homo sapiens
tccttgccccacagttgtgttca

SEQ ID NO: 3331053 - DNA, 13 bp, Homo sapiens
tccttgctctccc

SEQ ID NO: 3331054 - DNA, 14 bp, Homo sapiens
tccttgctctccct

SEQ ID NO: 3331055 - DNA, 19 bp, Homo sapiens
tccttgctgtcctaggcca

SEQ ID NO: 3331056 - DNA, 12 bp, Homo sapiens
tccttggcacca

SEQ ID NO: 3331057 - DNA, 20 bp, Homo sapiens
tccttggcatcacagggcag

SEQ ID NO: 3331058 - DNA, 20 bp, Homo sapiens
tccttggcttacctgacctc

SEQ ID NO: 3331059 - DNA, 17 bp, Homo sapiens
tccttgggctcctggct

SEQ ID NO: 3331060 - DNA, 19 bp, Homo sapiens
tccttgggctcctggctgc

SEQ ID NO: 3331061 - DNA, 22 bp, Homo sapiens
tccttgggctcctggctgccag

SEQ ID NO: 3331062 - DNA, 20 bp, Homo sapiens
tccttgggtcattgacctct

SEQ ID NO: 3331063 - DNA, 18 bp, Homo sapiens
tccttggtgcctggcctg

SEQ ID NO: 3331064 - DNA, 14 bp, Homo sapiens
tccttgtactctta

SEQ ID NO: 3331065 - DNA, 15 bp, Homo sapiens
tccttgtatgttctt

SEQ ID NO: 3331066 - DNA, 12 bp, Homo sapiens
tccttgtctctg

SEQ ID NO: 3331067 - DNA, 12 bp, Homo sapiens
tccttgtgcaaa

SEQ ID NO: 3331068 - DNA, 14 bp, Homo sapiens
tccttgtggcagag

SEQ ID NO: 3331069 - DNA, 20 bp, Homo sapiens
tccttgtttatcagatacat

SEQ ID NO: 3331070 - DNA, 23 bp, Homo sapiens
tccttgtttatcagatacatcac

SEQ ID NO: 3331071 - DNA, 16 bp, Homo sapiens
tcctttaaaaaaattt

SEQ ID NO: 3331072 - DNA, 21 bp, Homo sapiens
tcctttaaaaaaatttaagtg

SEQ ID NO: 3331073 - DNA, 16 bp, Homo sapiens
tcctttaaagatgaac

SEQ ID NO: 3331074 - DNA, 21 bp, Homo sapiens
tcctttaattaagactgaaaa

SEQ ID NO: 3331075 - DNA, 15 bp, Homo sapiens
tcctttacaaaagaa

SEQ ID NO: 3331076 - DNA, 14 bp, Homo sapiens
tcctttacgtgttt

SEQ ID NO: 3331077 - DNA, 16 bp, Homo sapiens
tcctttacgtgtttaa

SEQ ID NO: 3331078 - DNA, 16 bp, Homo sapiens
tcctttaggtaagaag

SEQ ID NO: 3331079 - DNA, 16 bp, Homo sapiens
tcctttcacaaccttc

SEQ ID NO: 3331080 - DNA, 18 bp, Homo sapiens
tcctttcacaaccttctg

SEQ ID NO: 3331081 - DNA, 20 bp, Homo sapiens
tcctttcacaaccttctgtg

SEQ ID NO: 3331082 - DNA, 22 bp, Homo sapiens
tcctttcagggaatttcaggaa

SEQ ID NO: 3331083 - DNA, 17 bp, Homo sapiens
tcctttccaaggcttct

SEQ ID NO: 3331084 - DNA, 11 bp, Homo sapiens
tcctttcccct

SEQ ID NO: 3331085 - DNA, 19 bp, Homo sapiens
tcctttcccctctctgccc

SEQ ID NO: 3331086 - DNA, 11 bp, Homo sapiens
tcctttctatc

SEQ ID NO: 3331087 - DNA, 17 bp, Homo sapiens
tcctttctccagccagc

SEQ ID NO: 3331088 - DNA, 13 bp, Homo sapiens
tcctttctccagg

SEQ ID NO: 3331089 - DNA, 15 bp, Homo sapiens
tcctttctccaggac

SEQ ID NO: 3331090 - DNA, 13 bp, Homo sapiens
tcctttctctttc

SEQ ID NO: 3331091 - DNA, 15 bp, Homo sapiens
tcctttctctttctc

SEQ ID NO: 3331092 - DNA, 13 bp, Homo sapiens
tcctttctgcctt

SEQ ID NO: 3331093 - DNA, 19 bp, Homo sapiens
tcctttctggaagtttctg

SEQ ID NO: 3331094 - DNA, 13 bp, Homo sapiens
tcctttcttgtct

SEQ ID NO: 3331095 - DNA, 12 bp, Homo sapiens
tcctttcttttc

SEQ ID NO: 3331096 - DNA, 15 bp, Homo sapiens
tcctttgagtgtctt

SEQ ID NO: 3331097 - DNA, 19 bp, Homo sapiens
tcctttgcaatagcagtta

SEQ ID NO: 3331098 - DNA, 14 bp, Homo sapiens
tcctttgcaccctg

SEQ ID NO: 3331099 - DNA, 16 bp, Homo sapiens
tcctttgcagggcagc

SEQ ID NO: 3331100 - DNA, 22 bp, Homo sapiens
tcctttggagggagggctgacc

SEQ ID NO: 3331101 - DNA, 23 bp, Homo sapiens
tcctttgggtgactcgccataaa

SEQ ID NO: 3331102 - DNA, 19 bp, Homo sapiens
tcctttgtgagcctatgat

SEQ ID NO: 3331103 - DNA, 17 bp, Homo sapiens
tcctttgtgcttagtta

SEQ ID NO: 3331104 - DNA, 20 bp, Homo sapiens
tcctttgtgtttctattgac

SEQ ID NO: 3331105 - DNA, 14 bp, Homo sapiens
tccttttagcctag

SEQ ID NO: 3331106 - DNA, 15 bp, Homo sapiens
tccttttagcctagt

SEQ ID NO: 3331107 - DNA, 22 bp, Homo sapiens
tccttttatctggtgcctcctc

SEQ ID NO: 3331108 - DNA, 20 bp, Homo sapiens
tccttttcccctacagaatt

SEQ ID NO: 3331109 - DNA, 22 bp, Homo sapiens
tccttttcccctacagaatttt

SEQ ID NO: 3331110 - DNA, 13 bp, Homo sapiens
tccttttccctgc

SEQ ID NO: 3331111 - DNA, 14 bp, Homo sapiens
tccttttccctgct

SEQ ID NO: 3331112 - DNA, 15 bp, Homo sapiens
tccttttccgttctg

SEQ ID NO: 3331113 - DNA, 10 bp, Homo sapiens
tccttttctt

SEQ ID NO: 3331114 - DNA, 13 bp, Homo sapiens
tccttttctttaa

SEQ ID NO: 3331115 - DNA, 17 bp, Homo sapiens
tccttttcttttgttac

SEQ ID NO: 3331116 - DNA, 20 bp, Homo sapiens
tccttttcttttgttactgt

SEQ ID NO: 3331117 - DNA, 23 bp, Homo sapiens
tccttttcttttgttactgttct

SEQ ID NO: 3331118 - DNA, 14 bp, Homo sapiens
tccttttgacactg

SEQ ID NO: 3331119 - DNA, 20 bp, Homo sapiens
tccttttgacactgctctaa

SEQ ID NO: 3331120 - DNA, 14 bp, Homo sapiens
tccttttgaggctt

SEQ ID NO: 3331121 - DNA, 19 bp, Homo sapiens
tccttttggaacatttctt

SEQ ID NO: 3331122 - DNA, 14 bp, Homo sapiens
tccttttgtcttct

SEQ ID NO: 3331123 - DNA, 14 bp, Homo sapiens
tcctttttaaatgt

SEQ ID NO: 3331124 - DNA, 12 bp, Homo sapiens
tcctttttaata

SEQ ID NO: 3331125 - DNA, 14 bp, Homo sapiens
tcctttttccatca

SEQ ID NO: 3331126 - DNA, 18 bp, Homo sapiens
tcctttttcccaataaat

SEQ ID NO: 3331127 - DNA, 19 bp, Homo sapiens
tcctttttctttataaact

SEQ ID NO: 3331128 - DNA, 14 bp, Homo sapiens
tccttttttataca

SEQ ID NO: 3331129 - DNA, 17 bp, Homo sapiens
tccttttttatacagga

SEQ ID NO: 3331130 - DNA, 19 bp, Homo sapiens
tccttttttcaatatgcaa

SEQ ID NO: 3331131 - DNA, 13 bp, Homo sapiens
tccttttttgtca

SEQ ID NO: 3331132 - DNA, 13 bp, Homo sapiens
tccttttttgtct

SEQ ID NO: 3331133 - DNA, 13 bp, Homo sapiens
tcgaaaaaataat

SEQ ID NO: 3331134 - DNA, 18 bp, Homo sapiens
tcgaaaaaataattattt

SEQ ID NO: 3331135 - DNA, 19 bp, Homo sapiens
tcgaaaattcatttcacat

SEQ ID NO: 3331136 - DNA, 18 bp, Homo sapiens
tcgaaacacagaaacctt

SEQ ID NO: 3331137 - DNA, 16 bp, Homo sapiens
tcgaaagctctagaat

SEQ ID NO: 3331138 - DNA, 12 bp, Homo sapiens
tcgaaataacaa

SEQ ID NO: 3331139 - DNA, 18 bp, Homo sapiens
tcgaaataacaatgttaa

SEQ ID NO: 3331140 - DNA, 20 bp, Homo sapiens
tcgaaataacaatgttaagg

SEQ ID NO: 3331141 - DNA, 18 bp, Homo sapiens
tcgaacatgtttcactta

SEQ ID NO: 3331142 - DNA, 18 bp, Homo sapiens
tcgaaccaaggcagcctc

SEQ ID NO: 3331143 - DNA, 15 bp, Homo sapiens
tcgaactggctgcaa

SEQ ID NO: 3331144 - DNA, 12 bp, Homo sapiens
tcgaaggatgct

SEQ ID NO: 3331145 - DNA, 19 bp, Homo sapiens
tcgaaggatgctctttccc

SEQ ID NO: 3331146 - DNA, 20 bp, Homo sapiens
tcgaaggatgctctttccct

SEQ ID NO: 3331147 - DNA, 22 bp, Homo sapiens
tcgaaggatgctctttcccttt

SEQ ID NO: 3331148 - DNA, 13 bp, Homo sapiens
tccctcctcacct

SEQ ID NO: 3331149 - DNA, 14 bp, Homo sapiens
tccctcctcacctc

SEQ ID NO: 3331150 - DNA, 18 bp, Homo sapiens
tccctcctcacctctgga

SEQ ID NO: 3331151 - DNA, 17 bp, Homo sapiens
tccctcctccaggcctg

SEQ ID NO: 3331152 - DNA, 16 bp, Homo sapiens
tccctcctgacaaata

SEQ ID NO: 3331153 - DNA, 18 bp, Homo sapiens
tccctcctgacaaatatt

SEQ ID NO: 3331154 - DNA, 22 bp, Homo sapiens
tccctcgatcatatttcccctt

SEQ ID NO: 3331155 - DNA, 19 bp, Homo sapiens
tccctcgctgcacaaatac

SEQ ID NO: 3331156 - DNA, 15 bp, Homo sapiens
tccctcgtccacagg

SEQ ID NO: 3331157 - DNA, 19 bp, Homo sapiens
tccctcgtccacaggggca

SEQ ID NO: 3331158 - DNA, 16 bp, Homo sapiens
tccctctcactcccca

SEQ ID NO: 3331159 - DNA, 17 bp, Homo sapiens
tccctctcccaggcccg

SEQ ID NO: 3331160 - DNA, 21 bp, Homo sapiens
tccctctctcccatttcagga

SEQ ID NO: 3331161 - DNA, 12 bp, Homo sapiens
tccctctctctt

SEQ ID NO: 3331162 - DNA, 19 bp, Homo sapiens
tccctctctcttctgctcc

SEQ ID NO: 3331163 - DNA, 12 bp, Homo sapiens
tccctctgctca

SEQ ID NO: 3331164 - DNA, 13 bp, Homo sapiens
tccctctgctcag

SEQ ID NO: 3331165 - DNA, 18 bp, Homo sapiens
tccctctgctcagccaag

SEQ ID NO: 3331166 - DNA, 21 bp, Homo sapiens
tccctctgctcagccaagctt

SEQ ID NO: 3331167 - DNA, 15 bp, Homo sapiens
tccctctgctcctgg

SEQ ID NO: 3331168 - DNA, 12 bp, Homo sapiens
tccctcttcact

SEQ ID NO: 3331169 - DNA, 15 bp, Homo sapiens
tccctcttcactccc

SEQ ID NO: 3331170 - DNA, 16 bp, Homo sapiens
tccctcttcactcccc

SEQ ID NO: 3331171 - DNA, 22 bp, Homo sapiens
tccctcttgtaagtcatctact

SEQ ID NO: 3331172 - DNA, 20 bp, Homo sapiens
tccctcttgttttgtttgtc

SEQ ID NO: 3331173 - DNA, 16 bp, Homo sapiens
tccctgaagccagcct

SEQ ID NO: 3331174 - DNA, 16 bp, Homo sapiens
tccctgacctccctct

SEQ ID NO: 3331175 - DNA, 17 bp, Homo sapiens
tccctgacctccctcta

SEQ ID NO: 3331176 - DNA, 14 bp, Homo sapiens
tccctgactggcca

SEQ ID NO: 3331177 - DNA, 14 bp, Homo sapiens
tccctgagctttgg

SEQ ID NO: 3331178 - DNA, 21 bp, Homo sapiens
tccctgaggactgatttcaga

SEQ ID NO: 3331179 - DNA, 20 bp, Homo sapiens
tccctgatgacacccaccct

SEQ ID NO: 3331180 - DNA, 23 bp, Homo sapiens
tccctgattgacctgctccgctg

SEQ ID NO: 3331181 - DNA, 15 bp, Homo sapiens
tccctgcacccatga

SEQ ID NO: 3331182 - DNA, 13 bp, Homo sapiens
tccctgcaccctg

SEQ ID NO: 3331183 - DNA, 17 bp, Homo sapiens
tccctgcaccctggaaa

SEQ ID NO: 3331184 - DNA, 23 bp, Homo sapiens
tccctgcactaaagccagcctga

SEQ ID NO: 3331185 - DNA, 13 bp, Homo sapiens
tccctgcacttgc

SEQ ID NO: 3331186 - DNA, 20 bp, Homo sapiens
tccctgcacttgcagactct

SEQ ID NO: 3331187 - DNA, 15 bp, Homo sapiens
tccctgcagggccat

SEQ ID NO: 3331188 - DNA, 17 bp, Homo sapiens
tccctgcatttctgagt

SEQ ID NO: 3331189 - DNA, 21 bp, Homo sapiens
tccctgccacatacaggtgct

SEQ ID NO: 3331190 - DNA, 22 bp, Homo sapiens
tccctgccacatacaggtgctc

SEQ ID NO: 3331191 - DNA, 11 bp, Homo sapiens
tccctgcccaa

SEQ ID NO: 3331192 - DNA, 13 bp, Homo sapiens
tccctgcccaggc

SEQ ID NO: 3331193 - DNA, 23 bp, Homo sapiens
tccctgcctctcatcaactgaat

SEQ ID NO: 3331194 - DNA, 11 bp, Homo sapiens
tccctgcctgg

SEQ ID NO: 3331195 - DNA, 12 bp, Homo sapiens
tccctgcctggc

SEQ ID NO: 3331196 - DNA, 15 bp, Homo sapiens
tccctgcctggtcac

SEQ ID NO: 3331197 - DNA, 20 bp, Homo sapiens
tccctgccttaggcctacct

SEQ ID NO: 3331198 - DNA, 15 bp, Homo sapiens
tccctgcgagacgca

SEQ ID NO: 3331199 - DNA, 22 bp, Homo sapiens
tccctgcggcctccacacctga

SEQ ID NO: 3331200 - DNA, 12 bp, Homo sapiens
tccctgctcagt

SEQ ID NO: 3331201 - DNA, 22 bp, Homo sapiens
tccctgctctaacacctgccta

SEQ ID NO: 3331202 - DNA, 11 bp, Homo sapiens
tccctgctgaa

SEQ ID NO: 3331203 - DNA, 14 bp, Homo sapiens
tccctgcttccagg

SEQ ID NO: 3331204 - DNA, 20 bp, Homo sapiens
tccctgctttggctgagggg

SEQ ID NO: 3331205 - DNA, 23 bp, Homo sapiens
tccctgctttggctgaggggctt

SEQ ID NO: 3331206 - DNA, 16 bp, Homo sapiens
tccctggagcaggagc

SEQ ID NO: 3331207 - DNA, 17 bp, Homo sapiens
tccctggagcaggagcc

SEQ ID NO: 3331208 - DNA, 18 bp, Homo sapiens
tccctggagcaggagccc

SEQ ID NO: 3331209 - DNA, 21 bp, Homo sapiens
tccctggagcctccactgcct

SEQ ID NO: 3331210 - DNA, 20 bp, Homo sapiens
tccctggccccctccctgga

SEQ ID NO: 3331211 - DNA, 21 bp, Homo sapiens
tccctggcgcaggtgggctgg

SEQ ID NO: 3331212 - DNA, 21 bp, Homo sapiens
tccctggctgccctggccctg

SEQ ID NO: 3331213 - DNA, 16 bp, Homo sapiens
tccctgggcagaaagt

SEQ ID NO: 3331214 - DNA, 24 bp, Homo sapiens
tccctgggccagggtctgtgtgaa

SEQ ID NO: 3331215 - DNA, 15 bp, Homo sapiens
tccctgggcccctcc

SEQ ID NO: 3331216 - DNA, 19 bp, Homo sapiens
tccctgggcccctccacgc

SEQ ID NO: 3331217 - DNA, 21 bp, Homo sapiens
tccctggggccaacggcaaca

SEQ ID NO: 3331218 - DNA, 21 bp, Homo sapiens
tccctgggggccttgggtgag

SEQ ID NO: 3331219 - DNA, 16 bp, Homo sapiens
tcgaatctctgtgcct

SEQ ID NO: 3331220 - DNA, 22 bp, Homo sapiens
tcgaatctctgtgccttcgtct

SEQ ID NO: 3331221 - DNA, 17 bp, Homo sapiens
tcgaatcttaatttatt

SEQ ID NO: 3331222 - DNA, 15 bp, Homo sapiens
tcgaattaatagctt

SEQ ID NO: 3331223 - DNA, 21 bp, Homo sapiens
tcgaattaatagcttttattg

SEQ ID NO: 3331224 - DNA, 19 bp, Homo sapiens
tcgacactcaccatgaagc

SEQ ID NO: 3331225 - DNA, 18 bp, Homo sapiens
tcgacagcgcccctgctg

SEQ ID NO: 3331226 - DNA, 20 bp, Homo sapiens
tcgacagcgcccctgctgtc

SEQ ID NO: 3331227 - DNA, 14 bp, Homo sapiens
tcgacccagaatgg

SEQ ID NO: 3331228 - DNA, 19 bp, Homo sapiens
tcgaccccaaagccccttg

SEQ ID NO: 3331229 - DNA, 21 bp, Homo sapiens
tcgactcaggatccagtccct

SEQ ID NO: 3331230 - DNA, 12 bp, Homo sapiens
tcgactggtcca

SEQ ID NO: 3331231 - DNA, 14 bp, Homo sapiens
tcgactggtccagc

SEQ ID NO: 3331232 - DNA, 16 bp, Homo sapiens
tcgactggtccagctc

SEQ ID NO: 3331233 - DNA, 13 bp, Homo sapiens
tcgagaccagcct

SEQ ID NO: 3331234 - DNA, 15 bp, Homo sapiens
tcgagaccagcctcg

SEQ ID NO: 3331235 - DNA, 16 bp, Homo sapiens
tcgagaccagcctggc

SEQ ID NO: 3331236 - DNA, 17 bp, Homo sapiens
tcgagatttgggagctg

SEQ ID NO: 3331237 - DNA, 17 bp, Homo sapiens
tcgagcagcattttatt

SEQ ID NO: 3331238 - DNA, 21 bp, Homo sapiens
tcgagcagtcctgcctcagcc

SEQ ID NO: 3331239 - DNA, 13 bp, Homo sapiens
tcgagcccagatg

SEQ ID NO: 3331240 - DNA, 16 bp, Homo sapiens
tcgagcccagatggaa

SEQ ID NO: 3331241 - DNA, 13 bp, Homo sapiens
tcgaggacaggga

SEQ ID NO: 3331242 - DNA, 13 bp, Homo sapiens
tcgaggctggtgc

SEQ ID NO: 3331243 - DNA, 14 bp, Homo sapiens
tcgaggctggtgcc

SEQ ID NO: 3331244 - DNA, 20 bp, Homo sapiens
tcgaggggtgggctggtatc

SEQ ID NO: 3331245 - DNA, 16 bp, Homo sapiens
tcgagtgaatttctaa

SEQ ID NO: 3331246 - DNA, 14 bp, Homo sapiens
tcgatactgcgact

SEQ ID NO: 3331247 - DNA, 17 bp, Homo sapiens
tcgatcatatttcccct

SEQ ID NO: 3331248 - DNA, 18 bp, Homo sapiens
tcgatcatatttcccctt

SEQ ID NO: 3331249 - DNA, 21 bp, Homo sapiens
tcgatccaaattgtgcttctc

SEQ ID NO: 3331250 - DNA, 20 bp, Homo sapiens
tcgatctcattcagtattaa

SEQ ID NO: 3331251 - DNA, 23 bp, Homo sapiens
tcgatgaagcccaataaacctct

SEQ ID NO: 3331252 - DNA, 12 bp, Homo sapiens
tcgatgcacagt

SEQ ID NO: 3331253 - DNA, 20 bp, Homo sapiens
tcgatttctacctcagcagc

SEQ ID NO: 3331254 - DNA, 13 bp, Homo sapiens
tcgcacagtctct

SEQ ID NO: 3331255 - DNA, 14 bp, Homo sapiens
tcgcacagtctctc

SEQ ID NO: 3331256 - DNA, 17 bp, Homo sapiens
tcgcaccattctcctgc

SEQ ID NO: 3331257 - DNA, 19 bp, Homo sapiens
tcgcagaccagagctgtct

SEQ ID NO: 3331258 - DNA, 21 bp, Homo sapiens
tcgcagaccagagctgtctga

SEQ ID NO: 3331259 - DNA, 21 bp, Homo sapiens
tcgcaggagtctctgccaccc

SEQ ID NO: 3331260 - DNA, 20 bp, Homo sapiens
tccctttttatatcccattt

SEQ ID NO: 3331261 - DNA, 17 bp, Homo sapiens
tccgaccagacaccttg

SEQ ID NO: 3331262 - DNA, 15 bp, Homo sapiens
tccgaccctcatggc

SEQ ID NO: 3331263 - DNA, 17 bp, Homo sapiens
tccgaccctctgggaac

SEQ ID NO: 3331264 - DNA, 18 bp, Homo sapiens
tccgaccctctgggaacc

SEQ ID NO: 3331265 - DNA, 21 bp, Homo sapiens
tccgaccctctgggaacctcc

SEQ ID NO: 3331266 - DNA, 14 bp, Homo sapiens
tccgactctaagct

SEQ ID NO: 3331267 - DNA, 20 bp, Homo sapiens
tccgactctaagctgtgtgc

SEQ ID NO: 3331268 - DNA, 12 bp, Homo sapiens
tccgactgcttt

SEQ ID NO: 3331269 - DNA, 13 bp, Homo sapiens
tccgagagggaga

SEQ ID NO: 3331270 - DNA, 16 bp, Homo sapiens
tccgagaggtgggcca

SEQ ID NO: 3331271 - DNA, 15 bp, Homo sapiens
tccgagcattccagt

SEQ ID NO: 3331272 - DNA, 21 bp, Homo sapiens
tccgagcattccagtaacttt

SEQ ID NO: 3331273 - DNA, 18 bp, Homo sapiens
tccgagctgaggactctg

SEQ ID NO: 3331274 - DNA, 15 bp, Homo sapiens
tccgatgaattctta

SEQ ID NO: 3331275 - DNA, 20 bp, Homo sapiens
tccgatggatgaatctccca

SEQ ID NO: 3331276 - DNA, 15 bp, Homo sapiens
tccgcaccagctgct

SEQ ID NO: 3331277 - DNA, 23 bp, Homo sapiens
tccgcactttccacttcttcctt

SEQ ID NO: 3331278 - DNA, 22 bp, Homo sapiens
tccgccaagatctacaggacaa

SEQ ID NO: 3331279 - DNA, 14 bp, Homo sapiens
tccgccactcagcc

SEQ ID NO: 3331280 - DNA, 15 bp, Homo sapiens
tccgccagcctcctc

SEQ ID NO: 3331281 - DNA, 16 bp, Homo sapiens
tccgccagcctcctct

SEQ ID NO: 3331282 - DNA, 18 bp, Homo sapiens
tccgccagcctcctctgg

SEQ ID NO: 3331283 - DNA, 20 bp, Homo sapiens
tccgccagcctcctctggac

SEQ ID NO: 3331284 - DNA, 16 bp, Homo sapiens
tccgcccccagcctat

SEQ ID NO: 3331285 - DNA, 12 bp, Homo sapiens
tccgccctcctc

SEQ ID NO: 3331286 - DNA, 14 bp, Homo sapiens
tccgccctgctcct

SEQ ID NO: 3331287 - DNA, 19 bp, Homo sapiens
tccgcccttagtcccccaa

SEQ ID NO: 3331288 - DNA, 17 bp, Homo sapiens
tccgcctcccccatggc

SEQ ID NO: 3331289 - DNA, 16 bp, Homo sapiens
tccgccttctcccaca

SEQ ID NO: 3331290 - DNA, 14 bp, Homo sapiens
tccgccttttgtat

SEQ ID NO: 3331291 - DNA, 18 bp, Homo sapiens
tccgccttttgtatacat

SEQ ID NO: 3331292 - DNA, 14 bp, Homo sapiens
tccgcggagccctt

SEQ ID NO: 3331293 - DNA, 14 bp, Homo sapiens
tccgcggctggagc

SEQ ID NO: 3331294 - DNA, 12 bp, Homo sapiens
tccgctcccacc

SEQ ID NO: 3331295 - DNA, 14 bp, Homo sapiens
tccgctcccaccgc

SEQ ID NO: 3331296 - DNA, 15 bp, Homo sapiens
tccgctcccaccgcc

SEQ ID NO: 3331297 - DNA, 23 bp, Homo sapiens
tccgctcccaccgcccccacccc

SEQ ID NO: 3331298 - DNA, 19 bp, Homo sapiens
tccgctgaggggtctcgga

SEQ ID NO: 3331299 - DNA, 14 bp, Homo sapiens
tccgctgccaccac

SEQ ID NO: 3331300 - DNA, 23 bp, Homo sapiens
tccgctgccaccacgtctgccag

SEQ ID NO: 3331301 - DNA, 16 bp, Homo sapiens
tccgctgccagccttg

SEQ ID NO: 3331302 - DNA, 16 bp, Homo sapiens
tccgctgctccttggc

SEQ ID NO: 3331303 - DNA, 23 bp, Homo sapiens
tccgctggctttgggaaagccca

SEQ ID NO: 3331304 - DNA, 16 bp, Homo sapiens
tccgctgtcgccccag

SEQ ID NO: 3331305 - DNA, 20 bp, Homo sapiens
tccgctgtcgccccaggccc

SEQ ID NO: 3331306 - DNA, 21 bp, Homo sapiens
tccgctgtcgccccaggccct

SEQ ID NO: 3331307 - DNA, 20 bp, Homo sapiens
tccgctttctacccagcgag

SEQ ID NO: 3331308 - DNA, 12 bp, Homo sapiens
tccggaaagaag

SEQ ID NO: 3331309 - DNA, 12 bp, Homo sapiens
tccggactggtg

SEQ ID NO: 3331310 - DNA, 16 bp, Homo sapiens
tccggactggtgccct

SEQ ID NO: 3331311 - DNA, 15 bp, Homo sapiens
tccggagatgtagca

SEQ ID NO: 3331312 - DNA, 14 bp, Homo sapiens
tccggcacactgcc

SEQ ID NO: 3331313 - DNA, 12 bp, Homo sapiens
tccgggcagaaa

SEQ ID NO: 3331314 - DNA, 15 bp, Homo sapiens
tccggggtctgtgct

SEQ ID NO: 3331315 - DNA, 16 bp, Homo sapiens
tccggggtctgtgctg

SEQ ID NO: 3331316 - DNA, 21 bp, Homo sapiens
tccggggtctgtgctgtgcct

SEQ ID NO: 3331317 - DNA, 16 bp, Homo sapiens
tccgggtgtggcctca

SEQ ID NO: 3331318 - DNA, 17 bp, Homo sapiens
tccgggtgtggcctcag

SEQ ID NO: 3331319 - DNA, 18 bp, Homo sapiens
tccgggtgtggcctcagc

SEQ ID NO: 3331320 - DNA, 18 bp, Homo sapiens
tccggtagggaggcagcc

SEQ ID NO: 3331321 - DNA, 12 bp, Homo sapiens
tccggtgtgcct

SEQ ID NO: 3331322 - DNA, 17 bp, Homo sapiens
tccggtgtgcctgcagc

SEQ ID NO: 3331323 - DNA, 18 bp, Homo sapiens
tccggtgtgcctgcagcc

SEQ ID NO: 3331324 - DNA, 14 bp, Homo sapiens
tccggtttgccatg

SEQ ID NO: 3331325 - DNA, 18 bp, Homo sapiens
tccgtcattgctgctgct

SEQ ID NO: 3331326 - DNA, 14 bp, Homo sapiens
tccgtccacccagg

SEQ ID NO: 3331327 - DNA, 15 bp, Homo sapiens
tcgtacagaaagctg

SEQ ID NO: 3331328 - DNA, 21 bp, Homo sapiens
tcgtataacacaatatgaata

SEQ ID NO: 3331329 - DNA, 14 bp, Homo sapiens
tcgtatatttctca

SEQ ID NO: 3331330 - DNA, 16 bp, Homo sapiens
tcgtatatttctcata

SEQ ID NO: 3331331 - DNA, 13 bp, Homo sapiens
tcgtatgaaaatg

SEQ ID NO: 3331332 - DNA, 21 bp, Homo sapiens
tcgtcctgggactcggagact

SEQ ID NO: 3331333 - DNA, 13 bp, Homo sapiens
tcgtcctgtccca

SEQ ID NO: 3331334 - DNA, 13 bp, Homo sapiens
tcgtccttttggt

SEQ ID NO: 3331335 - DNA, 11 bp, Homo sapiens
tcgtctgtgaa

SEQ ID NO: 3331336 - DNA, 18 bp, Homo sapiens
tcgtgaaaccctgtctct

SEQ ID NO: 3331337 - DNA, 14 bp, Homo sapiens
tcgtgaacatcccc

SEQ ID NO: 3331338 - DNA, 21 bp, Homo sapiens
tcgtgaccaactagacattct

SEQ ID NO: 3331339 - DNA, 20 bp, Homo sapiens
tcgtgacccttcagggccag

SEQ ID NO: 3331340 - DNA, 13 bp, Homo sapiens
tcgtgatggggca

SEQ ID NO: 3331341 - DNA, 15 bp, Homo sapiens
tcgtgcactctgcta

SEQ ID NO: 3331342 - DNA, 20 bp, Homo sapiens
tcgtgcctccttccacctcc

SEQ ID NO: 3331343 - DNA, 12 bp, Homo sapiens
tcgtgcctgtgt

SEQ ID NO: 3331344 - DNA, 20 bp, Homo sapiens
tcgtggcagataatcagcct

SEQ ID NO: 3331345 - DNA, 12 bp, Homo sapiens
tcgtggccagcc

SEQ ID NO: 3331346 - DNA, 19 bp, Homo sapiens
tcgtgggtctgttttcctt

SEQ ID NO: 3331347 - DNA, 23 bp, Homo sapiens
tcgtgtacagctcccttccctgc

SEQ ID NO: 3331348 - DNA, 23 bp, Homo sapiens
tcgtgtagtggaagagcagcctg

SEQ ID NO: 3331349 - DNA, 13 bp, Homo sapiens
tcgtgtggatctt

SEQ ID NO: 3331350 - DNA, 17 bp, Homo sapiens
tcgttaaaaagttgttt

SEQ ID NO: 3331351 - DNA, 14 bp, Homo sapiens
tcgttaacattgac

SEQ ID NO: 3331352 - DNA, 17 bp, Homo sapiens
tcgttaacattgaccaa

SEQ ID NO: 3331353 - DNA, 14 bp, Homo sapiens
tcgttaactgtgta

SEQ ID NO: 3331354 - DNA, 15 bp, Homo sapiens
tcgttaactgtgtat

SEQ ID NO: 3331355 - DNA, 23 bp, Homo sapiens
tcgttagaccgctctcttttctg

SEQ ID NO: 3331356 - DNA, 19 bp, Homo sapiens
tcgttagtatctaacatgt

SEQ ID NO: 3331357 - DNA, 19 bp, Homo sapiens
tcgttcaaaacattccaag

SEQ ID NO: 3331358 - DNA, 19 bp, Homo sapiens
tcgtttattttcaagaata

SEQ ID NO: 3331359 - DNA, 13 bp, Homo sapiens
tcgttttccaaac

SEQ ID NO: 3331360 - DNA, 18 bp, Homo sapiens
tcgtttttatattaatgt

SEQ ID NO: 3331361 - DNA, 16 bp, Homo sapiens
tcgtttttcagcaccc

SEQ ID NO: 3331362 - DNA, 15 bp, Homo sapiens
tctaaaaaacatttt

SEQ ID NO: 3331363 - DNA, 18 bp, Homo sapiens
tctaaaaagattagcaag

SEQ ID NO: 3331364 - DNA, 13 bp, Homo sapiens
tctaaaacaaaat

SEQ ID NO: 3331365 - DNA, 16 bp, Homo sapiens
tctaaaacattcccct

SEQ ID NO: 3331366 - DNA, 11 bp, Homo sapiens
tctaaaactcc

SEQ ID NO: 3331367 - DNA, 11 bp, Homo sapiens
tctaaaagaaa

SEQ ID NO: 3331368 - DNA, 23 bp, Homo sapiens
tctaaaaggttcagggaaccgtt

SEQ ID NO: 3331369 - DNA, 22 bp, Homo sapiens
tctaaaatcttatagttctagg

SEQ ID NO: 3331370 - DNA, 18 bp, Homo sapiens
tctaaaatgtgatgttct

SEQ ID NO: 3331371 - DNA, 17 bp, Homo sapiens
tctaaacattaatcaat

SEQ ID NO: 3331372 - DNA, 16 bp, Homo sapiens
tctaaacccaatccaa

SEQ ID NO: 3331373 - DNA, 19 bp, Homo sapiens
tctaaacccaatccaaatg

SEQ ID NO: 3331374 - DNA, 20 bp, Homo sapiens
tctaaaccttacatgtgtaa

SEQ ID NO: 3331375 - DNA, 15 bp, Homo sapiens
tctaaactggtacaa

SEQ ID NO: 3331376 - DNA, 16 bp, Homo sapiens
tctaaactggtacaat

SEQ ID NO: 3331377 - DNA, 19 bp, Homo sapiens
tctaaactggtacaatttt

SEQ ID NO: 3331378 - DNA, 13 bp, Homo sapiens
tctaaagaccaaa

SEQ ID NO: 3331379 - DNA, 18 bp, Homo sapiens
tctaaagataatattact

SEQ ID NO: 3331380 - DNA, 23 bp, Homo sapiens
tctaaagatggagtttctaaggt

SEQ ID NO: 3331381 - DNA, 13 bp, Homo sapiens
tctaaagattcta

SEQ ID NO: 3331382 - DNA, 16 bp, Homo sapiens
tctaaagattctatag

SEQ ID NO: 3331383 - DNA, 17 bp, Homo sapiens
tctaaagcagcaggtct

SEQ ID NO: 3331384 - DNA, 16 bp, Homo sapiens
tctaaaggatgctgct

SEQ ID NO: 3331385 - DNA, 19 bp, Homo sapiens
tctaaagggatctgcttaa

SEQ ID NO: 3331386 - DNA, 23 bp, Homo sapiens
tctaaaggtccacaggtctagac

SEQ ID NO: 3331387 - DNA, 12 bp, Homo sapiens
tctaaagttcta

SEQ ID NO: 3331388 - DNA, 15 bp, Homo sapiens
tctaaagttctaaga

SEQ ID NO: 3331389 - DNA, 16 bp, Homo sapiens
tctaaagttctaagat

SEQ ID NO: 3331390 - DNA, 18 bp, Homo sapiens
tctaaagttctaagattc

SEQ ID NO: 3331391 - DNA, 20 bp, Homo sapiens
tctaaagttctaagattctg

SEQ ID NO: 3331392 - DNA, 19 bp, Homo sapiens
tctaaatctatttattaat

SEQ ID NO: 3331393 - DNA, 23 bp, Homo sapiens
tctaaatgcatatcctgagccat

SEQ ID NO: 3331394 - DNA, 18 bp, Homo sapiens
tctaaatgttggaatgtt

SEQ ID NO: 3331395 - DNA, 20 bp, Homo sapiens
tctaaattaaagcctttagt

SEQ ID NO: 3331396 - DNA, 17 bp, Homo sapiens
tctaaattctttatttc

SEQ ID NO: 3331397 - DNA, 17 bp, Homo sapiens
tctaaatttgaatgtta

SEQ ID NO: 3331398 - DNA, 22 bp, Homo sapiens
tctaaatttgaatgttaagcag

SEQ ID NO: 3331399 - DNA, 23 bp, Homo sapiens
tctaaatttgaatgttaagcaga

SEQ ID NO: 3331400 - DNA, 12 bp, Homo sapiens
tctaacaagtca

SEQ ID NO: 3331401 - DNA, 23 bp, Homo sapiens
tctaacaagtcataggttaatat

SEQ ID NO: 3331402 - DNA, 14 bp, Homo sapiens
tctaacaataatat

SEQ ID NO: 3331403 - DNA, 15 bp, Homo sapiens
tctaacaataatatt

SEQ ID NO: 3331404 - DNA, 23 bp, Homo sapiens
tctaacaataatatttcaagtgc

SEQ ID NO: 3331405 - DNA, 22 bp, Homo sapiens
tctaacagtgaagttttactgt

SEQ ID NO: 3331406 - DNA, 19 bp, Homo sapiens
tctaaccctatactgtagt

SEQ ID NO: 3331407 - DNA, 15 bp, Homo sapiens
tctaaccctcccatg

SEQ ID NO: 3331408 - DNA, 21 bp, Homo sapiens
tctaaccctcccatggcacct

SEQ ID NO: 3331409 - DNA, 22 bp, Homo sapiens
tctaacggtctgttctgtttca

SEQ ID NO: 3331410 - DNA, 22 bp, Homo sapiens
tctaactatatgtacagctctc

SEQ ID NO: 3331411 - DNA, 15 bp, Homo sapiens
tctaactttattctt

SEQ ID NO: 3331412 - DNA, 15 bp, Homo sapiens
tctaactttctttac

SEQ ID NO: 3331413 - DNA, 13 bp, Homo sapiens
tctaagaaatcaa

SEQ ID NO: 3331414 - DNA, 22 bp, Homo sapiens
tctaagactcaaatgttctaag

SEQ ID NO: 3331415 - DNA, 19 bp, Homo sapiens
tctaagacttactctaaga

SEQ ID NO: 3331416 - DNA, 12 bp, Homo sapiens
tctaagagaagt

SEQ ID NO: 3331417 - DNA, 15 bp, Homo sapiens
tctaagatcttagat

SEQ ID NO: 3331418 - DNA, 21 bp, Homo sapiens
tctaagatcttagattctctg

SEQ ID NO: 3331419 - DNA, 13 bp, Homo sapiens
tctaagatgtgat

SEQ ID NO: 3331420 - DNA, 18 bp, Homo sapiens
tctaagatgtgatattct

SEQ ID NO: 3331421 - DNA, 12 bp, Homo sapiens
tctaagattcta

SEQ ID NO: 3331422 - DNA, 14 bp, Homo sapiens
tctaagattctaaa

SEQ ID NO: 3331423 - DNA, 15 bp, Homo sapiens
tctaagattctaaag

SEQ ID NO: 3331424 - DNA, 17 bp, Homo sapiens
tctaagattctaaaggt

SEQ ID NO: 3331425 - DNA, 14 bp, Homo sapiens
tctaagattctaat

SEQ ID NO: 3331426 - DNA, 19 bp, Homo sapiens
tctaagattctaatgatga

SEQ ID NO: 3331427 - DNA, 13 bp, Homo sapiens
tctaagattctag

SEQ ID NO: 3331428 - DNA, 16 bp, Homo sapiens
tctaagattctagatc

SEQ ID NO: 3331429 - DNA, 16 bp, Homo sapiens
tctaagcaatttcttg

SEQ ID NO: 3331430 - DNA, 18 bp, Homo sapiens
tctaagcctttccataag

SEQ ID NO: 3331431 - DNA, 15 bp, Homo sapiens
tctaagctgtgtgca

SEQ ID NO: 3331432 - DNA, 16 bp, Homo sapiens
tctaagctgtgtgcag

SEQ ID NO: 3331433 - DNA, 17 bp, Homo sapiens
tctaagctgtgtgcagg

SEQ ID NO: 3331434 - DNA, 13 bp, Homo sapiens
tctaaggaatgca

SEQ ID NO: 3331435 - DNA, 17 bp, Homo sapiens
tctaaggacctgaaatt

SEQ ID NO: 3331436 - DNA, 21 bp, Homo sapiens
tctaaggacctgaaattccaa

SEQ ID NO: 3331437 - DNA, 23 bp, Homo sapiens
tctaaggacctgaaattccaaag

SEQ ID NO: 3331438 - DNA, 17 bp, Homo sapiens
tctaaggataatgaaat

SEQ ID NO: 3331439 - DNA, 19 bp, Homo sapiens
tctaaggatgtcacagggc

SEQ ID NO: 3331440 - DNA, 18 bp, Homo sapiens
tctaaggcctaggattct

SEQ ID NO: 3331441 - DNA, 15 bp, Homo sapiens
tctaaggctctgaga

SEQ ID NO: 3331442 - DNA, 14 bp, Homo sapiens
tctaagggggaggg

SEQ ID NO: 3331443 - DNA, 22 bp, Homo sapiens
tctaaggtccggtgttctaaga

SEQ ID NO: 3331444 - DNA, 23 bp, Homo sapiens
tctaaggtccggtgttctaagat

SEQ ID NO: 3331445 - DNA, 12 bp, Homo sapiens
tctaagtattta

SEQ ID NO: 3331446 - DNA, 14 bp, Homo sapiens
tctaagtatttaaa

SEQ ID NO: 3331447 - DNA, 19 bp, Homo sapiens
tctaagtatttaaatgttc

SEQ ID NO: 3331448 - DNA, 21 bp, Homo sapiens
tctaagtatttaaatgttcta

SEQ ID NO: 3331449 - DNA, 16 bp, Homo sapiens
tctaagtatttgaaac

SEQ ID NO: 3331450 - DNA, 22 bp, Homo sapiens
tctaagtgtaaaagtagtaaat

SEQ ID NO: 3331451 - DNA, 17 bp, Homo sapiens
tctaagttataagactc

SEQ ID NO: 3331452 - DNA, 16 bp, Homo sapiens
tctaagtttctaagat

SEQ ID NO: 3331453 - DNA, 17 bp, Homo sapiens
tctaagtttctaagatt

SEQ ID NO: 3331454 - DNA, 22 bp, Homo sapiens
tctaagtttctaagattctaaa

SEQ ID NO: 3331455 - DNA, 11 bp, Homo sapiens
tctaataaact

SEQ ID NO: 3331456 - DNA, 14 bp, Homo sapiens
tctaataaattata

SEQ ID NO: 3331457 - DNA, 14 bp, Homo sapiens
tctaatacctctgt

SEQ ID NO: 3331458 - DNA, 17 bp, Homo sapiens
tctaatactttgtttat

SEQ ID NO: 3331459 - DNA, 22 bp, Homo sapiens
tctaatagaactcagttttaac

SEQ ID NO: 3331460 - DNA, 15 bp, Homo sapiens
tctaatatatatgaa

SEQ ID NO: 3331461 - DNA, 17 bp, Homo sapiens
tctaatattcacatgtt

SEQ ID NO: 3331462 - DNA, 19 bp, Homo sapiens
tctaatattcacatgttct

SEQ ID NO: 3331463 - DNA, 20 bp, Homo sapiens
tctaatattcacatgttcta

SEQ ID NO: 3331464 - DNA, 14 bp, Homo sapiens
tctaatattgcttc

SEQ ID NO: 3331465 - DNA, 12 bp, Homo sapiens
tctaatcaaaag

SEQ ID NO: 3331466 - DNA, 20 bp, Homo sapiens
tctaatcatctgcagttctt

SEQ ID NO: 3331467 - DNA, 20 bp, Homo sapiens
tctaatcgaaagaaaatggg

SEQ ID NO: 3331468 - DNA, 13 bp, Homo sapiens
tctaatctcttat

SEQ ID NO: 3331469 - DNA, 21 bp, Homo sapiens
tctaatctcttattctaataa

SEQ ID NO: 3331470 - DNA, 18 bp, Homo sapiens
tctaatgatcaaaacatg

SEQ ID NO: 3331471 - DNA, 14 bp, Homo sapiens
tctaatgcttgttt

SEQ ID NO: 3331472 - DNA, 20 bp, Homo sapiens
tctaatgcttgtttatgata

SEQ ID NO: 3331473 - DNA, 20 bp, Homo sapiens
tctaatgggtatttaaacaa

SEQ ID NO: 3331474 - DNA, 14 bp, Homo sapiens
tctaatgtagctat

SEQ ID NO: 3331475 - DNA, 17 bp, Homo sapiens
tctaatgtagctatttt

SEQ ID NO: 3331476 - DNA, 14 bp, Homo sapiens
tctaatgtcttcat

SEQ ID NO: 3331477 - DNA, 15 bp, Homo sapiens
tctaatgttccccgt

SEQ ID NO: 3331478 - DNA, 19 bp, Homo sapiens
tctaatgttccccgtggct

SEQ ID NO: 3331479 - DNA, 14 bp, Homo sapiens
tctaattaaaattg

SEQ ID NO: 3331480 - DNA, 15 bp, Homo sapiens
tctaattaaaattgt

SEQ ID NO: 3331481 - DNA, 23 bp, Homo sapiens
tctaattatttaaataaaatcac

SEQ ID NO: 3331482 - DNA, 21 bp, Homo sapiens
tctaattctattaaagtgcta

SEQ ID NO: 3331483 - DNA, 14 bp, Homo sapiens
tctaattctgattc

SEQ ID NO: 3331484 - DNA, 18 bp, Homo sapiens
tctaattgtcagtgattt

SEQ ID NO: 3331485 - DNA, 14 bp, Homo sapiens
tctaatttattaat

SEQ ID NO: 3331486 - DNA, 15 bp, Homo sapiens
tctaatttattaatc

SEQ ID NO: 3331487 - DNA, 22 bp, Homo sapiens
tctaatttcaaaaatataactt

SEQ ID NO: 3331488 - DNA, 19 bp, Homo sapiens
tctagtaagatgcactgaa

SEQ ID NO: 3331489 - DNA, 16 bp, Homo sapiens
tctagtacttattaca

SEQ ID NO: 3331490 - DNA, 17 bp, Homo sapiens
tctagtacttgaaaaag

SEQ ID NO: 3331491 - DNA, 22 bp, Homo sapiens
tctagtacttgggagacctgta

SEQ ID NO: 3331492 - DNA, 19 bp, Homo sapiens
tctagtcctattctattgc

SEQ ID NO: 3331493 - DNA, 22 bp, Homo sapiens
tctagtctcctttgcactgagg

SEQ ID NO: 3331494 - DNA, 14 bp, Homo sapiens
tctagtgcagctga

SEQ ID NO: 3331495 - DNA, 12 bp, Homo sapiens
tctagtgggaag

SEQ ID NO: 3331496 - DNA, 23 bp, Homo sapiens
tctagtggtctttgtaagagtgt

SEQ ID NO: 3331497 - DNA, 13 bp, Homo sapiens
tctagttttgtca

SEQ ID NO: 3331498 - DNA, 20 bp, Homo sapiens
tctataaagcgatatacaga

SEQ ID NO: 3331499 - DNA, 22 bp, Homo sapiens
tctataaagcgatatacagatg

SEQ ID NO: 3331500 - DNA, 13 bp, Homo sapiens
tctataaatcagt

SEQ ID NO: 3331501 - DNA, 16 bp, Homo sapiens
tctataaatcagtatt

SEQ ID NO: 3331502 - DNA, 16 bp, Homo sapiens
tctataaattgtccgt

SEQ ID NO: 3331503 - DNA, 16 bp, Homo sapiens
tctataacagaaagtt

SEQ ID NO: 3331504 - DNA, 15 bp, Homo sapiens
tctataagagaatta

SEQ ID NO: 3331505 - DNA, 19 bp, Homo sapiens
tctataatcccagcacttt

SEQ ID NO: 3331506 - DNA, 20 bp, Homo sapiens
tctataatcccagcactttg

SEQ ID NO: 3331507 - DNA, 21 bp, Homo sapiens
tctataatcccagcactttgg

SEQ ID NO: 3331508 - DNA, 12 bp, Homo sapiens
tctataatttac

SEQ ID NO: 3331509 - DNA, 18 bp, Homo sapiens
tctatacacaccctgccc

SEQ ID NO: 3331510 - DNA, 23 bp, Homo sapiens
tctatacacaccctgcccctgca

SEQ ID NO: 3331511 - DNA, 18 bp, Homo sapiens
tctatacatatctttatt

SEQ ID NO: 3331512 - DNA, 13 bp, Homo sapiens
tctatagagaaaa

SEQ ID NO: 3331513 - DNA, 23 bp, Homo sapiens
tctatagccaactgctaatgcaa

SEQ ID NO: 3331514 - DNA, 12 bp, Homo sapiens
tctatagttcta

SEQ ID NO: 3331515 - DNA, 15 bp, Homo sapiens
tctatagttctagac

SEQ ID NO: 3331516 - DNA, 18 bp, Homo sapiens
tctatatataattctgta

SEQ ID NO: 3331517 - DNA, 19 bp, Homo sapiens
tctatatataattctgtac

SEQ ID NO: 3331518 - DNA, 21 bp, Homo sapiens
tctatatataattctgtacat

SEQ ID NO: 3331519 - DNA, 14 bp, Homo sapiens
tctatatgaattta

SEQ ID NO: 3331520 - DNA, 21 bp, Homo sapiens
tctatatgaatttaaatataa

SEQ ID NO: 3331521 - DNA, 19 bp, Homo sapiens
tctatattattatatatat

SEQ ID NO: 3331522 - DNA, 16 bp, Homo sapiens
tctatatttattttca

SEQ ID NO: 3331523 - DNA, 14 bp, Homo sapiens
tctatcaagcccag

SEQ ID NO: 3331524 - DNA, 18 bp, Homo sapiens
tctatcaagtcaatcatt

SEQ ID NO: 3331525 - DNA, 22 bp, Homo sapiens
tctatcaagtcaatcatttctc

SEQ ID NO: 3331526 - DNA, 23 bp, Homo sapiens
tctatcaagtcaatcatttctca

SEQ ID NO: 3331527 - DNA, 21 bp, Homo sapiens
tctatcatggaatatttatag

SEQ ID NO: 3331528 - DNA, 23 bp, Homo sapiens
tctatcatttttgtacagtttgc

SEQ ID NO: 3331529 - DNA, 14 bp, Homo sapiens
tctatccacagaga

SEQ ID NO: 3331530 - DNA, 17 bp, Homo sapiens
tctatccacagagagtc

SEQ ID NO: 3331531 - DNA, 13 bp, Homo sapiens
tctatctaaatga

SEQ ID NO: 3331532 - DNA, 12 bp, Homo sapiens
tctatctgggcc

SEQ ID NO: 3331533 - DNA, 16 bp, Homo sapiens
tctatctgggcctggg

SEQ ID NO: 3331534 - DNA, 17 bp, Homo sapiens
tctatctgggcctgggc

SEQ ID NO: 3331535 - DNA, 17 bp, Homo sapiens
tctatcttccaaatgca

SEQ ID NO: 3331536 - DNA, 19 bp, Homo sapiens
tctatgaagttgctgttta

SEQ ID NO: 3331537 - DNA, 18 bp, Homo sapiens
tctatgagtctagatgtt

SEQ ID NO: 3331538 - DNA, 22 bp, Homo sapiens
tctatgatgaaggtaattaaag

SEQ ID NO: 3331539 - DNA, 22 bp, Homo sapiens
tctatgcaaatgcctccaagcc

SEQ ID NO: 3331540 - DNA, 15 bp, Homo sapiens
tctatgcagcctgct

SEQ ID NO: 3331541 - DNA, 16 bp, Homo sapiens
tctatggctttcaaag

SEQ ID NO: 3331542 - DNA, 19 bp, Homo sapiens
tctatggggagaggaactc

SEQ ID NO: 3331543 - DNA, 13 bp, Homo sapiens
tctatgtatgtta

SEQ ID NO: 3331544 - DNA, 15 bp, Homo sapiens
tctatgttaaatact

SEQ ID NO: 3331545 - DNA, 12 bp, Homo sapiens
tctatgtttgta

SEQ ID NO: 3331546 - DNA, 19 bp, Homo sapiens
tctatgtttgtatttggaa

SEQ ID NO: 3331547 - DNA, 15 bp, Homo sapiens
tctatgtttgtgtga

SEQ ID NO: 3331548 - DNA, 18 bp, Homo sapiens
tctatgtttgtgtgattt

SEQ ID NO: 3331549 - DNA, 21 bp, Homo sapiens
tctatgtttgtgtgatttcct

SEQ ID NO: 3331550 - DNA, 22 bp, Homo sapiens
tctatgtttgtgtgatttccta

SEQ ID NO: 3331551 - DNA, 21 bp, Homo sapiens
tctattaaaattgccatttta

SEQ ID NO: 3331552 - DNA, 23 bp, Homo sapiens
tctattaaagtgctaaggttcta

SEQ ID NO: 3331553 - DNA, 21 bp, Homo sapiens
tctattaatatatgtattatt

SEQ ID NO: 3331554 - DNA, 19 bp, Homo sapiens
tctattaatcacctctctg

SEQ ID NO: 3331555 - DNA, 13 bp, Homo sapiens
tctattaatcatt

SEQ ID NO: 3331556 - DNA, 17 bp, Homo sapiens
tctattacattttcagt

SEQ ID NO: 3331557 - DNA, 14 bp, Homo sapiens
tctattagacttta

SEQ ID NO: 3331558 - DNA, 18 bp, Homo sapiens
tctattagactttagaaa

SEQ ID NO: 3331559 - DNA, 15 bp, Homo sapiens
tctattatggaaaac

SEQ ID NO: 3331560 - DNA, 20 bp, Homo sapiens
tctattatggaaaactgtgt

SEQ ID NO: 3331561 - DNA, 16 bp, Homo sapiens
tctattccttctggcc

SEQ ID NO: 3331562 - DNA, 18 bp, Homo sapiens
tctattctgtcagtgtta

SEQ ID NO: 3331563 - DNA, 20 bp, Homo sapiens
tctattgatgtacagtctgt

SEQ ID NO: 3331564 - DNA, 19 bp, Homo sapiens
tctattgtagcatttcttg

SEQ ID NO: 3331565 - DNA, 16 bp, Homo sapiens
tctattgttactctgg

SEQ ID NO: 3331566 - DNA, 14 bp, Homo sapiens
tctatttaaattct

SEQ ID NO: 3331567 - DNA, 17 bp, Homo sapiens
tctatttaaattctttt

SEQ ID NO: 3331568 - DNA, 13 bp, Homo sapiens
tctatttaatatt

SEQ ID NO: 3331569 - DNA, 15 bp, Homo sapiens
tctatttatgtttgc

SEQ ID NO: 3331570 - DNA, 14 bp, Homo sapiens
tctatttcatgttt

SEQ ID NO: 3331571 - DNA, 21 bp, Homo sapiens
tctatttctggatgaatgccc

SEQ ID NO: 3331572 - DNA, 18 bp, Homo sapiens
tctatttgaattatttct

SEQ ID NO: 3331573 - DNA, 12 bp, Homo sapiens
tctattttaaga

SEQ ID NO: 3331574 - DNA, 13 bp, Homo sapiens
tctattttacttt

SEQ ID NO: 3331575 - DNA, 16 bp, Homo sapiens
tctattttactttgta

SEQ ID NO: 3331576 - DNA, 14 bp, Homo sapiens
tctattttcttaaa

SEQ ID NO: 3331577 - DNA, 15 bp, Homo sapiens
tctattttgtgatga

SEQ ID NO: 3331578 - DNA, 13 bp, Homo sapiens
tctatttttacat

SEQ ID NO: 3331579 - DNA, 16 bp, Homo sapiens
tctatttttacattta

SEQ ID NO: 3331580 - DNA, 20 bp, Homo sapiens
tctatttttatcatgaattc

SEQ ID NO: 3331581 - DNA, 18 bp, Homo sapiens
tctattttttctctcctt

SEQ ID NO: 3331582 - DNA, 16 bp, Homo sapiens
tctatttttttaactg

SEQ ID NO: 3331583 - DNA, 18 bp, Homo sapiens
tctatttttttaactgaa

SEQ ID NO: 3331584 - DNA, 20 bp, Homo sapiens
tctatttttttaactgaaaa

SEQ ID NO: 3331585 - DNA, 23 bp, Homo sapiens
tctcaaaacagagggctgcattc

SEQ ID NO: 3331586 - DNA, 18 bp, Homo sapiens
tctcaaaagcatttatca

SEQ ID NO: 3331587 - DNA, 21 bp, Homo sapiens
tctcaaaagcatttatcattc

SEQ ID NO: 3331588 - DNA, 17 bp, Homo sapiens
tctcaaaagtctatttt

SEQ ID NO: 3331589 - DNA, 15 bp, Homo sapiens
tctcaaaatctttgt

SEQ ID NO: 3331590 - DNA, 14 bp, Homo sapiens
tctcaaactggggc

SEQ ID NO: 3331591 - DNA, 15 bp, Homo sapiens
tctcaaaggccctca

SEQ ID NO: 3331592 - DNA, 23 bp, Homo sapiens
tctcaaagttttgaaaagctatt

SEQ ID NO: 3331593 - DNA, 17 bp, Homo sapiens
tctcaaataactaaaag

SEQ ID NO: 3331594 - DNA, 21 bp, Homo sapiens
tctcaaatttggattgctaat

SEQ ID NO: 3331595 - DNA, 18 bp, Homo sapiens
tctcaagagggcactggt

SEQ ID NO: 3331596 - DNA, 15 bp, Homo sapiens
tctcaagttctaaga

SEQ ID NO: 3331597 - DNA, 16 bp, Homo sapiens
tctcaagttctaagat

SEQ ID NO: 3331598 - DNA, 21 bp, Homo sapiens
tctcaagttctaagattctaa

SEQ ID NO: 3331599 - DNA, 22 bp, Homo sapiens
tctcaatcctaatttctcctcc

SEQ ID NO: 3331600 - DNA, 21 bp, Homo sapiens
tctcaatgaaccataaattca

SEQ ID NO: 3331601 - DNA, 12 bp, Homo sapiens
tctcacacacat

SEQ ID NO: 3331602 - DNA, 15 bp, Homo sapiens
tctcacacacataga

SEQ ID NO: 3331603 - DNA, 20 bp, Homo sapiens
tctcacagcacatgctggcc

SEQ ID NO: 3331604 - DNA, 14 bp, Homo sapiens
tctcacatgtggca

SEQ ID NO: 3331605 - DNA, 15 bp, Homo sapiens
tctcaccccatccca

SEQ ID NO: 3331606 - DNA, 21 bp, Homo sapiens
tctcaccccatcccacaccct

SEQ ID NO: 3331607 - DNA, 16 bp, Homo sapiens
tctcaccgcagtcgtc

SEQ ID NO: 3331608 - DNA, 21 bp, Homo sapiens
tctcacgggcatgggcactcc

SEQ ID NO: 3331609 - DNA, 23 bp, Homo sapiens
tctcacgggcatgggcactccct

SEQ ID NO: 3331610 - DNA, 15 bp, Homo sapiens
tctcactaaacttta

SEQ ID NO: 3331611 - DNA, 17 bp, Homo sapiens
tctcactaaactttacc

SEQ ID NO: 3331612 - DNA, 22 bp, Homo sapiens
tctcactatgttgcccaggcag

SEQ ID NO: 3331613 - DNA, 13 bp, Homo sapiens
tctcactccccag

SEQ ID NO: 3331614 - DNA, 14 bp, Homo sapiens
tctctgtgaataca

SEQ ID NO: 3331615 - DNA, 18 bp, Homo sapiens
tctctgtgaatacaatta

SEQ ID NO: 3331616 - DNA, 17 bp, Homo sapiens
tctctgtgccttcgtct

SEQ ID NO: 3331617 - DNA, 16 bp, Homo sapiens
tctctgtgtctaagat

SEQ ID NO: 3331618 - DNA, 20 bp, Homo sapiens
tctctgtgtctaagattcta

SEQ ID NO: 3331619 - DNA, 19 bp, Homo sapiens
tctctgttcagatgtgcat

SEQ ID NO: 3331620 - DNA, 21 bp, Homo sapiens
tctctgttcagatgtgcattt

SEQ ID NO: 3331621 - DNA, 13 bp, Homo sapiens
tctctgttcttca

SEQ ID NO: 3331622 - DNA, 16 bp, Homo sapiens
tctctgttcttcatct

SEQ ID NO: 3331623 - DNA, 17 bp, Homo sapiens
tctctgttcttcatctg

SEQ ID NO: 3331624 - DNA, 23 bp, Homo sapiens
tctctgttcttcatctgctatta

SEQ ID NO: 3331625 - DNA, 18 bp, Homo sapiens
tctcttaaacttgtgaat

SEQ ID NO: 3331626 - DNA, 13 bp, Homo sapiens
tcttcctgacact

SEQ ID NO: 3331627 - DNA, 15 bp, Homo sapiens
tcttcctgacacttt

SEQ ID NO: 3331628 - DNA, 11 bp, Homo sapiens
tcttcctgacg

SEQ ID NO: 3331629 - DNA, 15 bp, Homo sapiens
tcttcctgctccttt

SEQ ID NO: 3331630 - DNA, 12 bp, Homo sapiens
tcttcctgctgg

SEQ ID NO: 3331631 - DNA, 13 bp, Homo sapiens
tcttcctgctgga

SEQ ID NO: 3331632 - DNA, 18 bp, Homo sapiens
tcttcctggacctgagtc

SEQ ID NO: 3331633 - DNA, 22 bp, Homo sapiens
tcttcctggctttttaactccc

SEQ ID NO: 3331634 - DNA, 17 bp, Homo sapiens
tcttcctgttaatgtat

SEQ ID NO: 3331635 - DNA, 18 bp, Homo sapiens
tcttcctgttttgtacat

SEQ ID NO: 3331636 - DNA, 21 bp, Homo sapiens
tcttccttcagggatttccaa

SEQ ID NO: 3331637 - DNA, 18 bp, Homo sapiens
tcttccttggagggggga

SEQ ID NO: 3331638 - DNA, 14 bp, Homo sapiens
tcttccttgtctct

SEQ ID NO: 3331639 - DNA, 16 bp, Homo sapiens
tcttcctttctctttc

SEQ ID NO: 3331640 - DNA, 13 bp, Homo sapiens
tcttcgctgctct

SEQ ID NO: 3331641 - DNA, 22 bp, Homo sapiens
tcttcgctgctctagctggcag

SEQ ID NO: 3331642 - DNA, 15 bp, Homo sapiens
tcttcggtgttcttc

SEQ ID NO: 3331643 - DNA, 22 bp, Homo sapiens
tcttctaaacttccccatcttc

SEQ ID NO: 3331644 - DNA, 12 bp, Homo sapiens
tcttctaaatgg

SEQ ID NO: 3331645 - DNA, 20 bp, Homo sapiens
tcttctaatttcaaaaatat

SEQ ID NO: 3331646 - DNA, 18 bp, Homo sapiens
tcttctagaagataacat

SEQ ID NO: 3331647 - DNA, 20 bp, Homo sapiens
tcttctagaagataacattt

SEQ ID NO: 3331648 - DNA, 15 bp, Homo sapiens
tcttctcaagttcta

SEQ ID NO: 3331649 - DNA, 18 bp, Homo sapiens
tcttctcaagttctaaga

SEQ ID NO: 3331650 - DNA, 19 bp, Homo sapiens
tcttctcaagttctaagat

SEQ ID NO: 3331651 - DNA, 23 bp, Homo sapiens
tcttctcaagttctaagattcta

SEQ ID NO: 3331652 - DNA, 21 bp, Homo sapiens
tcttctcataaatctttttac

SEQ ID NO: 3331653 - DNA, 17 bp, Homo sapiens
tcttctcatagcattaa

SEQ ID NO: 3331654 - DNA, 16 bp, Homo sapiens
tcttctccactggatg

SEQ ID NO: 3331655 - DNA, 13 bp, Homo sapiens
tcttctccaggct

SEQ ID NO: 3331656 - DNA, 14 bp, Homo sapiens
tcttctccaggctg

SEQ ID NO: 3331657 - DNA, 15 bp, Homo sapiens
tcttctccaggctgt

SEQ ID NO: 3331658 - DNA, 18 bp, Homo sapiens
tcttctcggctcaggctc

SEQ ID NO: 3331659 - DNA, 12 bp, Homo sapiens
tcttctctgcaa

SEQ ID NO: 3331660 - DNA, 21 bp, Homo sapiens
tcttctctgcaatgcttctgt

SEQ ID NO: 3331661 - DNA, 22 bp, Homo sapiens
tcttctctgcaatgcttctgta

SEQ ID NO: 3331662 - DNA, 12 bp, Homo sapiens
tcttctctgtct

SEQ ID NO: 3331663 - DNA, 17 bp, Homo sapiens
tcttctcttctctgcaa

SEQ ID NO: 3331664 - DNA, 20 bp, Homo sapiens
tcttctgaagatcagaacat

SEQ ID NO: 3331665 - DNA, 14 bp, Homo sapiens
tcttctgacaaact

SEQ ID NO: 3331666 - DNA, 21 bp, Homo sapiens
tcttctgagctatttcatcta

SEQ ID NO: 3331667 - DNA, 17 bp, Homo sapiens
tcttctgcgcctcaggc

SEQ ID NO: 3331668 - DNA, 15 bp, Homo sapiens
tcttctgctccaccc

SEQ ID NO: 3331669 - DNA, 17 bp, Homo sapiens
tcttctgctccaccctt

SEQ ID NO: 3331670 - DNA, 18 bp, Homo sapiens
tcttctggctcaaaaaga

SEQ ID NO: 3331671 - DNA, 21 bp, Homo sapiens
tcttctggctcaaaaagagaa

SEQ ID NO: 3331672 - DNA, 11 bp, Homo sapiens
tcttctggctt

SEQ ID NO: 3331673 - DNA, 17 bp, Homo sapiens
tcttctgggcacagtgg

SEQ ID NO: 3331674 - DNA, 18 bp, Homo sapiens
tcttctggggcaggctgg

SEQ ID NO: 3331675 - DNA, 17 bp, Homo sapiens
tcttctggtctgtgtgt

SEQ ID NO: 3331676 - DNA, 20 bp, Homo sapiens
tcttctgtacgtctgacagg

SEQ ID NO: 3331677 - DNA, 21 bp, Homo sapiens
tcttctgtacgtctgacaggc

SEQ ID NO: 3331678 - DNA, 16 bp, Homo sapiens
tcttctgtatttctag

SEQ ID NO: 3331679 - DNA, 19 bp, Homo sapiens
tcttctgtatttctaggca

SEQ ID NO: 3331680 - DNA, 13 bp, Homo sapiens
tcttctgtggacc

SEQ ID NO: 3331681 - DNA, 15 bp, Homo sapiens
tcttcttacacttct

SEQ ID NO: 3331682 - DNA, 23 bp, Homo sapiens
tcttcttcatccaacttccaaga

SEQ ID NO: 3331683 - DNA, 14 bp, Homo sapiens
tcttcttcttcaga

SEQ ID NO: 3331684 - DNA, 17 bp, Homo sapiens
tcttcttgaaattttaa

SEQ ID NO: 3331685 - DNA, 15 bp, Homo sapiens
tcttcttgtttctcc

SEQ ID NO: 3331686 - DNA, 12 bp, Homo sapiens
tcttctttcctt

SEQ ID NO: 3331687 - DNA, 15 bp, Homo sapiens
tcttctttttctttt

SEQ ID NO: 3331688 - DNA, 15 bp, Homo sapiens
tcttctttttgctgt

SEQ ID NO: 3331689 - DNA, 23 bp, Homo sapiens
tcttgaaagattcaggtatgttg

SEQ ID NO: 3331690 - DNA, 14 bp, Homo sapiens
tcttgaaagctgtg

SEQ ID NO: 3331691 - DNA, 22 bp, Homo sapiens
tcttgaaattaagaaggcaaaa

SEQ ID NO: 3331692 - DNA, 15 bp, Homo sapiens
tcttgaactcctggc

SEQ ID NO: 3331693 - DNA, 23 bp, Homo sapiens
tcttgaataaagtattctagtgt

SEQ ID NO: 3331694 - DNA, 15 bp, Homo sapiens
tcttgaatataaaaa

SEQ ID NO: 3331695 - DNA, 14 bp, Homo sapiens
tcttgaatgtcttt

SEQ ID NO: 3331696 - DNA, 19 bp, Homo sapiens
tcttgacattcaaggcatt

SEQ ID NO: 3331697 - DNA, 17 bp, Homo sapiens
tcttgagctggcctctc

SEQ ID NO: 3331698 - DNA, 23 bp, Homo sapiens
tcttgagtactagaatttgtatt

SEQ ID NO: 3331699 - DNA, 22 bp, Homo sapiens
tcttgagtttgtcgctcatgtg

SEQ ID NO: 3331700 - DNA, 17 bp, Homo sapiens
tcttgatacccccctct

SEQ ID NO: 3331701 - DNA, 21 bp, Homo sapiens
tcttgatacccccctctgtct

SEQ ID NO: 3331702 - DNA, 13 bp, Homo sapiens
tcttgatcttaaa

SEQ ID NO: 3331703 - DNA, 16 bp, Homo sapiens
tcttgatcttaaagat

SEQ ID NO: 3331704 - DNA, 12 bp, Homo sapiens
tcttgatgacca

SEQ ID NO: 3331705 - DNA, 12 bp, Homo sapiens
tcttgatgtgaa

SEQ ID NO: 3331706 - DNA, 14 bp, Homo sapiens
tcttgattatccat

SEQ ID NO: 3331707 - DNA, 23 bp, Homo sapiens
tcttgattatccatattgagtca

SEQ ID NO: 3331708 - DNA, 13 bp, Homo sapiens
tcttgcaatggca

SEQ ID NO: 3331709 - DNA, 17 bp, Homo sapiens
tcttgcaatggcagcct

SEQ ID NO: 3331710 - DNA, 23 bp, Homo sapiens
tcttgcaccccaaagctttcctg

SEQ ID NO: 3331711 - DNA, 15 bp, Homo sapiens
tcttgcacccgcctc

SEQ ID NO: 3331712 - DNA, 20 bp, Homo sapiens
tcttgcacccgcctctcccg

SEQ ID NO: 3331713 - DNA, 20 bp, Homo sapiens
tcttgcagtggcttttcatg

SEQ ID NO: 3331714 - DNA, 21 bp, Homo sapiens
tcttgcataggctcttaagca

SEQ ID NO: 3331715 - DNA, 22 bp, Homo sapiens
tcttgcatccttcctataactt

SEQ ID NO: 3331716 - DNA, 23 bp, Homo sapiens
tcttgcatccttcctataacttg

SEQ ID NO: 3331717 - DNA, 17 bp, Homo sapiens
tcttgcattcattttct

SEQ ID NO: 3331718 - DNA, 10 bp, Homo sapiens
tcttgccaca

SEQ ID NO: 3331719 - DNA, 16 bp, Homo sapiens
tcttgccacatttctg

SEQ ID NO: 3331720 - DNA, 17 bp, Homo sapiens
tcttgccactgcctctt

SEQ ID NO: 3331721 - DNA, 13 bp, Homo sapiens
tcttgcccatcct

SEQ ID NO: 3331722 - DNA, 14 bp, Homo sapiens
tcttgcccatcctg

SEQ ID NO: 3331723 - DNA, 15 bp, Homo sapiens
tcttgcccatcctga

SEQ ID NO: 3331724 - DNA, 13 bp, Homo sapiens
tcttgcccttccc

SEQ ID NO: 3331725 - DNA, 16 bp, Homo sapiens
tcttgcccttccctgt

SEQ ID NO: 3331726 - DNA, 20 bp, Homo sapiens
tcttgcccttccctgtccct

SEQ ID NO: 3331727 - DNA, 19 bp, Homo sapiens
tcttgccgaggagccaggc

SEQ ID NO: 3331728 - DNA, 16 bp, Homo sapiens
tcttgcctaggccaaa

SEQ ID NO: 3331729 - DNA, 13 bp, Homo sapiens
tcttgcctctgtg

SEQ ID NO: 3331730 - DNA, 14 bp, Homo sapiens
tcttgcctctgtgc

SEQ ID NO: 3331731 - DNA, 17 bp, Homo sapiens
tcttgcgaatccaagct

SEQ ID NO: 3331732 - DNA, 22 bp, Homo sapiens
tcttgcgtgtcaatttccctca

SEQ ID NO: 3331733 - DNA, 16 bp, Homo sapiens
tcttgctaatcagtgt

SEQ ID NO: 3331734 - DNA, 20 bp, Homo sapiens
tcttgctaatcagtgtctca

SEQ ID NO: 3331735 - DNA, 22 bp, Homo sapiens
tcttgctaatcagtgtctcaca

SEQ ID NO: 3331736 - DNA, 23 bp, Homo sapiens
tcttgctaatcagtgtctcacac

SEQ ID NO: 3331737 - DNA, 20 bp, Homo sapiens
tcttgctaccagtatttaga

SEQ ID NO: 3331738 - DNA, 13 bp, Homo sapiens
tcttgctagtatt

SEQ ID NO: 3331739 - DNA, 17 bp, Homo sapiens
tcttgctcccttcagcc

SEQ ID NO: 3331740 - DNA, 23 bp, Homo sapiens
tcttaaagctgcctgtagttagg

SEQ ID NO: 3331741 - DNA, 19 bp, Homo sapiens
tcttaaataatgcttcaga

SEQ ID NO: 3331742 - DNA, 12 bp, Homo sapiens
tcttaaatatat

SEQ ID NO: 3331743 - DNA, 13 bp, Homo sapiens
tcttaaatctttc

SEQ ID NO: 3331744 - DNA, 23 bp, Homo sapiens
tcttaaatggaattattttgaat

SEQ ID NO: 3331745 - DNA, 19 bp, Homo sapiens
tcttaacaatttctgtcct

SEQ ID NO: 3331746 - DNA, 23 bp, Homo sapiens
tcttaacacatgtccttgtgtgt

SEQ ID NO: 3331747 - DNA, 20 bp, Homo sapiens
tcttaacctttgctatgtaa

SEQ ID NO: 3331748 - DNA, 23 bp, Homo sapiens
tcttaactggcctaaatttcttc

SEQ ID NO: 3331749 - DNA, 17 bp, Homo sapiens
tctgtccaaaggaggct

SEQ ID NO: 3331750 - DNA, 14 bp, Homo sapiens
tctgtccaccagcc

SEQ ID NO: 3331751 - DNA, 19 bp, Homo sapiens
tctgtccatggcctttcta

SEQ ID NO: 3331752 - DNA, 19 bp, Homo sapiens
tctgtccatttatccacag

SEQ ID NO: 3331753 - DNA, 19 bp, Homo sapiens
tgaaaatgagcatcagaga

SEQ ID NO: 3331754 - DNA, 17 bp, Homo sapiens
tgaaaatgagttgtgaa

SEQ ID NO: 3331755 - DNA, 13 bp, Homo sapiens
tgaaaatgcaaag

SEQ ID NO: 3331756 - DNA, 16 bp, Homo sapiens
tgaaaatgggctcaac

SEQ ID NO: 3331757 - DNA, 21 bp, Homo sapiens
tgaaaatgggttggtgcttct

SEQ ID NO: 3331758 - DNA, 14 bp, Homo sapiens
tgaaaatggtttca

SEQ ID NO: 3331759 - DNA, 22 bp, Homo sapiens
tgaaaatggtttcaagttattc

SEQ ID NO: 3331760 - DNA, 13 bp, Homo sapiens
tgaaaatgtgaat

SEQ ID NO: 3331761 - DNA, 19 bp, Homo sapiens
tgaaaatgtgctatactgc

SEQ ID NO: 3331762 - DNA, 22 bp, Homo sapiens
tgaaaatgtttaagtattaact

SEQ ID NO: 3331763 - DNA, 15 bp, Homo sapiens
tgaaaattattttaa

SEQ ID NO: 3331764 - DNA, 18 bp, Homo sapiens
tgaaaattattttaaaca

SEQ ID NO: 3331765 - DNA, 19 bp, Homo sapiens
tgaaaattcaaaaagtgtt

SEQ ID NO: 3331766 - DNA, 21 bp, Homo sapiens
tgaaaattcgcccgagctgtt

SEQ ID NO: 3331767 - DNA, 22 bp, Homo sapiens
tgaaaattcgcccgagctgttt

SEQ ID NO: 3331768 - DNA, 13 bp, Homo sapiens
tgaaaattgtatt

SEQ ID NO: 3331769 - DNA, 20 bp, Homo sapiens
tgaaaattttaaaaatacat

SEQ ID NO: 3331770 - DNA, 21 bp, Homo sapiens
tgaaaattttaaaaatacata

SEQ ID NO: 3331771 - DNA, 22 bp, Homo sapiens
tgaaaattttaaaaatacatat

SEQ ID NO: 3331772 - DNA, 13 bp, Homo sapiens
tgaaaattttact

SEQ ID NO: 3331773 - DNA, 18 bp, Homo sapiens
tgaaaattttacttccat

SEQ ID NO: 3331774 - DNA, 18 bp, Homo sapiens
tgaaaatttttacattca

SEQ ID NO: 3331775 - DNA, 17 bp, Homo sapiens
tgaaacaaaaattgtct

SEQ ID NO: 3331776 - DNA, 22 bp, Homo sapiens
tgaaacaaataatcacattgac

SEQ ID NO: 3331777 - DNA, 18 bp, Homo sapiens
tgaaacacaccaggctgt

SEQ ID NO: 3331778 - DNA, 13 bp, Homo sapiens
tgaaacacagctg

SEQ ID NO: 3331779 - DNA, 23 bp, Homo sapiens
tgaaacactcagttgttcaataa

SEQ ID NO: 3331780 - DNA, 14 bp, Homo sapiens
tgaaacacttgctt

SEQ ID NO: 3331781 - DNA, 23 bp, Homo sapiens
tgaaacactttgcctcctgtgta

SEQ ID NO: 3331782 - DNA, 14 bp, Homo sapiens
tgaaacagaaacaa

SEQ ID NO: 3331783 - DNA, 11 bp, Homo sapiens
tgaaaccaaaa

SEQ ID NO: 3331784 - DNA, 17 bp, Homo sapiens
tgaaacccacagtttta

SEQ ID NO: 3331785 - DNA, 23 bp, Homo sapiens
tgaaaccctgtctctactaaaaa

SEQ ID NO: 3331786 - DNA, 20 bp, Homo sapiens
tgaaacctacacactgtcat

SEQ ID NO: 3331787 - DNA, 21 bp, Homo sapiens
tgaaacctttagggcagcttg

SEQ ID NO: 3331788 - DNA, 22 bp, Homo sapiens
tgaaacctttagggcagcttgc

SEQ ID NO: 3331789 - DNA, 19 bp, Homo sapiens
tgaaaccttttttaagatt

SEQ ID NO: 3331790 - DNA, 22 bp, Homo sapiens
tgaaactcctgattttgtagtt

SEQ ID NO: 3331791 - DNA, 13 bp, Homo sapiens
tgaaactggtttt

SEQ ID NO: 3331792 - DNA, 14 bp, Homo sapiens
tgaaactttcattc

SEQ ID NO: 3331793 - DNA, 23 bp, Homo sapiens
tgaaactttcattccttcagatt

SEQ ID NO: 3331794 - DNA, 16 bp, Homo sapiens
tgaaactttgggaaaa

SEQ ID NO: 3331795 - DNA, 20 bp, Homo sapiens
tgaaagaaacagttaacttt

SEQ ID NO: 3331796 - DNA, 22 bp, Homo sapiens
tgaaagaaacagttaactttca

SEQ ID NO: 3331797 - DNA, 20 bp, Homo sapiens
tgaaagaatagaacacagtt

SEQ ID NO: 3331798 - DNA, 12 bp, Homo sapiens
tgaaagaccttc

SEQ ID NO: 3331799 - DNA, 13 bp, Homo sapiens
tgaaagactgtac

SEQ ID NO: 3331800 - DNA, 16 bp, Homo sapiens
tgaaagactgtacaaa

SEQ ID NO: 3331801 - DNA, 18 bp, Homo sapiens
tgaaagactgtacaaagt

SEQ ID NO: 3331802 - DNA, 22 bp, Homo sapiens
tgaaagactgtacaaagtagaa

SEQ ID NO: 3331803 - DNA, 13 bp, Homo sapiens
tgaaagagaacca

SEQ ID NO: 3331804 - DNA, 18 bp, Homo sapiens
tgaaagatggctgtgcct

SEQ ID NO: 3331805 - DNA, 21 bp, Homo sapiens
tgaaagatggctgtgcctctg

SEQ ID NO: 3331806 - DNA, 23 bp, Homo sapiens
tgaaagatggctgtgcctctgcc

SEQ ID NO: 3331807 - DNA, 21 bp, Homo sapiens
tgaaagattcaggtatgttgc

SEQ ID NO: 3331808 - DNA, 22 bp, Homo sapiens
tgaaagattgtgggggaaaaat

SEQ ID NO: 3331809 - DNA, 14 bp, Homo sapiens
tgaaagattttatt

SEQ ID NO: 3331810 - DNA, 20 bp, Homo sapiens
tgaaagattttattgtataa

SEQ ID NO: 3331811 - DNA, 11 bp, Homo sapiens
tgaaagcacag

SEQ ID NO: 3331812 - DNA, 16 bp, Homo sapiens
tgaaagcagcagctag

SEQ ID NO: 3331813 - DNA, 17 bp, Homo sapiens
tgaaagcagcagctagg

SEQ ID NO: 3331814 - DNA, 22 bp, Homo sapiens
tgaaagcagcagctaggactga

SEQ ID NO: 3331815 - DNA, 20 bp, Homo sapiens
tgaaagcagggaatttctat

SEQ ID NO: 3331816 - DNA, 15 bp, Homo sapiens
tgaaagcatccatgt

SEQ ID NO: 3331817 - DNA, 17 bp, Homo sapiens
tgaaagccttagggaag

SEQ ID NO: 3331818 - DNA, 15 bp, Homo sapiens
tgaaagctactcata

SEQ ID NO: 3331819 - DNA, 19 bp, Homo sapiens
tgaaagctgagaactcctg

SEQ ID NO: 3331820 - DNA, 21 bp, Homo sapiens
tgaaagctgagaactcctgac

SEQ ID NO: 3331821 - DNA, 18 bp, Homo sapiens
tgaaaggaaatacacttc

SEQ ID NO: 3331822 - DNA, 18 bp, Homo sapiens
tgaaaggatgtggaagag

SEQ ID NO: 3331823 - DNA, 13 bp, Homo sapiens
tgaaagggcactt

SEQ ID NO: 3331824 - DNA, 19 bp, Homo sapiens
tgaaagggcacttaatttg

SEQ ID NO: 3331825 - DNA, 22 bp, Homo sapiens
tgaaagggcacttaatttgtaa

SEQ ID NO: 3331826 - DNA, 16 bp, Homo sapiens
tgaaagggctatggca

SEQ ID NO: 3331827 - DNA, 22 bp, Homo sapiens
tgaaagggctatggcaaggggg

SEQ ID NO: 3331828 - DNA, 15 bp, Homo sapiens
tgaaaggtttacatt

SEQ ID NO: 3331829 - DNA, 11 bp, Homo sapiens
tgaaagtgact

SEQ ID NO: 3331830 - DNA, 16 bp, Homo sapiens
tgaaagtgactttaaa

SEQ ID NO: 3331831 - DNA, 18 bp, Homo sapiens
tgaaagtgactttaaaag

SEQ ID NO: 3331832 - DNA, 22 bp, Homo sapiens
tgaaagtgttttactctttttc

SEQ ID NO: 3331833 - DNA, 22 bp, Homo sapiens
tgaaagttacccactgaagccc

SEQ ID NO: 3331834 - DNA, 18 bp, Homo sapiens
tgaaagttttccagtatt

SEQ ID NO: 3331835 - DNA, 19 bp, Homo sapiens
tgaaagttttccagtattg

SEQ ID NO: 3331836 - DNA, 22 bp, Homo sapiens
tgaaagttttgagtagatatta

SEQ ID NO: 3331837 - DNA, 23 bp, Homo sapiens
tgaaataaaaaaaaaaggatgaa

SEQ ID NO: 3331838 - DNA, 13 bp, Homo sapiens
tgaaataaacact

SEQ ID NO: 3331839 - DNA, 14 bp, Homo sapiens
tgaaataaacactg

SEQ ID NO: 3331840 - DNA, 21 bp, Homo sapiens
tgaaataaagaaattgcaata

SEQ ID NO: 3331841 - DNA, 21 bp, Homo sapiens
tgaaataatcagtgactgaaa

SEQ ID NO: 3331842 - DNA, 18 bp, Homo sapiens
tgaaataattaaaaacca

SEQ ID NO: 3331843 - DNA, 14 bp, Homo sapiens
tgaaataccagtgt

SEQ ID NO: 3331844 - DNA, 11 bp, Homo sapiens
tgaaatacctc

SEQ ID NO: 3331845 - DNA, 17 bp, Homo sapiens
tgaaatacctcatgttt

SEQ ID NO: 3331846 - DNA, 19 bp, Homo sapiens
tgaaatacctcatgtttat

SEQ ID NO: 3331847 - DNA, 21 bp, Homo sapiens
tgaaatacctcatgtttatga

SEQ ID NO: 3331848 - DNA, 15 bp, Homo sapiens
tgaaatacctttgta

SEQ ID NO: 3331849 - DNA, 19 bp, Homo sapiens
tgaaatacctttgtagtta

SEQ ID NO: 3331850 - DNA, 16 bp, Homo sapiens
tgaaatactaaaagca

SEQ ID NO: 3331851 - DNA, 16 bp, Homo sapiens
tgaaatagtctgtgtg

SEQ ID NO: 3331852 - DNA, 17 bp, Homo sapiens
tgaaatagtctgtgtga

SEQ ID NO: 3331853 - DNA, 19 bp, Homo sapiens
tgaaatagttcaaactgca

SEQ ID NO: 3331854 - DNA, 12 bp, Homo sapiens
tgaaatataatt

SEQ ID NO: 3331855 - DNA, 15 bp, Homo sapiens
tgaaatataattgta

SEQ ID NO: 3331856 - DNA, 13 bp, Homo sapiens
tgaaatcatcaaa

SEQ ID NO: 3331857 - DNA, 16 bp, Homo sapiens
tgaaatctcagaattc

SEQ ID NO: 3331858 - DNA, 21 bp, Homo sapiens
tgaaatgaaacaaataatcac

SEQ ID NO: 3331859 - DNA, 14 bp, Homo sapiens
tgaaatgaaattta

SEQ ID NO: 3331860 - DNA, 15 bp, Homo sapiens
tgaaatgaaatttaa

SEQ ID NO: 3331861 - DNA, 21 bp, Homo sapiens
tgaaatgagcacctccattaa

SEQ ID NO: 3331862 - DNA, 20 bp, Homo sapiens
tgaaatgagcatgcattttc

SEQ ID NO: 3331863 - DNA, 15 bp, Homo sapiens
tgaaatgattggaat

SEQ ID NO: 3331864 - DNA, 15 bp, Homo sapiens
tgaaatgggagatgg

SEQ ID NO: 3331865 - DNA, 22 bp, Homo sapiens
tgaaatgtcacgtactgtctga

SEQ ID NO: 3331866 - DNA, 23 bp, Homo sapiens
tgaaatgtcccctcaaactcatt

SEQ ID NO: 3331867 - DNA, 21 bp, Homo sapiens
tgaaatgttagtcattgttat

SEQ ID NO: 3331868 - DNA, 20 bp, Homo sapiens
tgaaattaacacaaaggaag

SEQ ID NO: 3331869 - DNA, 19 bp, Homo sapiens
tgaaattaagaaggcaaaa

SEQ ID NO: 3331870 - DNA, 23 bp, Homo sapiens
tgaaattagggcccaattaataa

SEQ ID NO: 3331871 - DNA, 21 bp, Homo sapiens
tgaaattatagtttcaagcca

SEQ ID NO: 3331872 - DNA, 17 bp, Homo sapiens
tgaaattatgtatgttt

SEQ ID NO: 3331873 - DNA, 23 bp, Homo sapiens
tgaaattatgtatgtttacatat

SEQ ID NO: 3331874 - DNA, 17 bp, Homo sapiens
tgaaattattttctcca

SEQ ID NO: 3331875 - DNA, 12 bp, Homo sapiens
tgaaattccaaa

SEQ ID NO: 3331876 - DNA, 16 bp, Homo sapiens
tgaaattccaaagtct

SEQ ID NO: 3331877 - DNA, 16 bp, Homo sapiens
tgaaattcttgaagtt

SEQ ID NO: 3331878 - DNA, 14 bp, Homo sapiens
tgaaattgtacata

SEQ ID NO: 3331879 - DNA, 23 bp, Homo sapiens
tgaaattgtacatatttgtggaa

SEQ ID NO: 3331880 - DNA, 18 bp, Homo sapiens
tgaaattgtgaactcatt

SEQ ID NO: 3331881 - DNA, 15 bp, Homo sapiens
tctttctctgccagt

SEQ ID NO: 3331882 - DNA, 17 bp, Homo sapiens
tctttctctgccagtga

SEQ ID NO: 3331883 - DNA, 18 bp, Homo sapiens
tctttctgagcacacttt

SEQ ID NO: 3331884 - DNA, 13 bp, Homo sapiens
tctttctgctttg

SEQ ID NO: 3331885 - DNA, 12 bp, Homo sapiens
tctttctggact

SEQ ID NO: 3331886 - DNA, 16 bp, Homo sapiens
tctttctggcctgcct

SEQ ID NO: 3331887 - DNA, 18 bp, Homo sapiens
tctttctggcctgccttc

SEQ ID NO: 3331888 - DNA, 14 bp, Homo sapiens
tctttctgttgaga

SEQ ID NO: 3331889 - DNA, 15 bp, Homo sapiens
tctttcttccctcgt

SEQ ID NO: 3331890 - DNA, 12 bp, Homo sapiens
tctttcttcctt

SEQ ID NO: 3331891 - DNA, 15 bp, Homo sapiens
tctttcttcctttct

SEQ ID NO: 3331892 - DNA, 12 bp, Homo sapiens
tctttctttcca

SEQ ID NO: 3331893 - DNA, 18 bp, Homo sapiens
tctttctttgcaccaaag

SEQ ID NO: 3331894 - DNA, 18 bp, Homo sapiens
tctttctttggtgccttt

SEQ ID NO: 3331895 - DNA, 14 bp, Homo sapiens
tctttgaaacaact

SEQ ID NO: 3331896 - DNA, 16 bp, Homo sapiens
tctttgaaacaacttt

SEQ ID NO: 3331897 - DNA, 16 bp, Homo sapiens
tctttgcacttaaaaa

SEQ ID NO: 3331898 - DNA, 17 bp, Homo sapiens
tctttgcacttaaaaat

SEQ ID NO: 3331899 - DNA, 13 bp, Homo sapiens
tctttgcagacag

SEQ ID NO: 3331900 - DNA, 14 bp, Homo sapiens
tctttgccttctct

SEQ ID NO: 3331901 - DNA, 14 bp, Homo sapiens
tctttgccttgggc

SEQ ID NO: 3331902 - DNA, 20 bp, Homo sapiens
tctttgccttgggctgctcc

SEQ ID NO: 3331903 - DNA, 21 bp, Homo sapiens
tctttgccttgggctgctcct

SEQ ID NO: 3331904 - DNA, 15 bp, Homo sapiens
tctttgcttgaacac

SEQ ID NO: 3331905 - DNA, 16 bp, Homo sapiens
tctttggggtgcccct

SEQ ID NO: 3331906 - DNA, 22 bp, Homo sapiens
tctttggtctattttctgcaga

SEQ ID NO: 3331907 - DNA, 15 bp, Homo sapiens
tctttggttctaagg

SEQ ID NO: 3331908 - DNA, 18 bp, Homo sapiens
tctttgtaagagtgtaga

SEQ ID NO: 3331909 - DNA, 13 bp, Homo sapiens
tctttgtataaat

SEQ ID NO: 3331910 - DNA, 14 bp, Homo sapiens
tctttgtgataatt

SEQ ID NO: 3331911 - DNA, 14 bp, Homo sapiens
tctttgtggcttcc

SEQ ID NO: 3331912 - DNA, 18 bp, Homo sapiens
tctttgtggggcttggcg

SEQ ID NO: 3331913 - DNA, 15 bp, Homo sapiens
tctttgtgtagcttt

SEQ ID NO: 3331914 - DNA, 18 bp, Homo sapiens
tctttgttctcagctccc

SEQ ID NO: 3331915 - DNA, 19 bp, Homo sapiens
tctttgtttcctggcaata

SEQ ID NO: 3331916 - DNA, 23 bp, Homo sapiens
tctttgtttctttttacagcatt

SEQ ID NO: 3331917 - DNA, 18 bp, Homo sapiens
tcttttaaagaccctcct

SEQ ID NO: 3331918 - DNA, 14 bp, Homo sapiens
tcttttagacaact

SEQ ID NO: 3331919 - DNA, 13 bp, Homo sapiens
tcttttataataa

SEQ ID NO: 3331920 - DNA, 14 bp, Homo sapiens
tcttttatagagca

SEQ ID NO: 3331921 - DNA, 18 bp, Homo sapiens
tcttttatatttgtatcg

SEQ ID NO: 3331922 - DNA, 22 bp, Homo sapiens
tcttttatatttgtatcgatgt

SEQ ID NO: 3331923 - DNA, 12 bp, Homo sapiens
tcttttattctt

SEQ ID NO: 3331924 - DNA, 22 bp, Homo sapiens
tcttttcacatagctgtctaga

SEQ ID NO: 3331925 - DNA, 23 bp, Homo sapiens
tcttttcataaagggttgaaaat

SEQ ID NO: 3331926 - DNA, 24 bp, Homo sapiens
tcttttccccctttgtgcacattt

SEQ ID NO: 3331927 - DNA, 15 bp, Homo sapiens
tcttttccctctcta

SEQ ID NO: 3331928 - DNA, 14 bp, Homo sapiens
tcttttcccttaaa

SEQ ID NO: 3331929 - DNA, 19 bp, Homo sapiens
tcttttcccttaaatacag

SEQ ID NO: 3331930 - DNA, 15 bp, Homo sapiens
tcttttcctgttgta

SEQ ID NO: 3331931 - DNA, 12 bp, Homo sapiens
tcttttctaccc

SEQ ID NO: 3331932 - DNA, 18 bp, Homo sapiens
tcttttctaccctagcca

SEQ ID NO: 3331933 - DNA, 13 bp, Homo sapiens
tcttttctctgtg

SEQ ID NO: 3331934 - DNA, 16 bp, Homo sapiens
tcttttctctttttag

SEQ ID NO: 3331935 - DNA, 19 bp, Homo sapiens
tcttttctggaatgtaatc

SEQ ID NO: 3331936 - DNA, 16 bp, Homo sapiens
tcttttctgtacttcc

SEQ ID NO: 3331937 - DNA, 12 bp, Homo sapiens
tcttttcttatt

SEQ ID NO: 3331938 - DNA, 15 bp, Homo sapiens
tcttttcttcctggc

SEQ ID NO: 3331939 - DNA, 16 bp, Homo sapiens
tcttttctttagagca

SEQ ID NO: 3331940 - DNA, 17 bp, Homo sapiens
tcttttgacatgtggaa

SEQ ID NO: 3331941 - DNA, 20 bp, Homo sapiens
tcttttgagttaggttaata

SEQ ID NO: 3331942 - DNA, 14 bp, Homo sapiens
tcttttgattttgt

SEQ ID NO: 3331943 - DNA, 21 bp, Homo sapiens
tcttttgcatgtcgcacaatg

SEQ ID NO: 3331944 - DNA, 17 bp, Homo sapiens
tcttttgctactaagtt

SEQ ID NO: 3331945 - DNA, 19 bp, Homo sapiens
tcttttgctactaagttca

SEQ ID NO: 3331946 - DNA, 12 bp, Homo sapiens
tcttttggttat

SEQ ID NO: 3331947 - DNA, 13 bp, Homo sapiens
tcttttgtaattg

SEQ ID NO: 3331948 - DNA, 14 bp, Homo sapiens
tcttttgtctccca

SEQ ID NO: 3331949 - DNA, 13 bp, Homo sapiens
tcttttgttactg

SEQ ID NO: 3331950 - DNA, 19 bp, Homo sapiens
tcttttgttactgttcttg

SEQ ID NO: 3331951 - DNA, 23 bp, Homo sapiens
tcttttgttactgttcttgctgc

SEQ ID NO: 3331952 - DNA, 20 bp, Homo sapiens
tcttttgttcgcatggtcac

SEQ ID NO: 3331953 - DNA, 12 bp, Homo sapiens
tcttttgtttgg

SEQ ID NO: 3331954 - DNA, 16 bp, Homo sapiens
tcttttgtttggtaaa

SEQ ID NO: 3331955 - DNA, 15 bp, Homo sapiens
tctttttaaaaatga

SEQ ID NO: 3331956 - DNA, 23 bp, Homo sapiens
tctttttaaagtgtttctgttat

SEQ ID NO: 3331957 - DNA, 14 bp, Homo sapiens
tctttttacagcat

SEQ ID NO: 3331958 - DNA, 17 bp, Homo sapiens
tctttttacagcattgt

SEQ ID NO: 3331959 - DNA, 19 bp, Homo sapiens
tctttttacagcattgtct

SEQ ID NO: 3331960 - DNA, 12 bp, Homo sapiens
tctttttagttt

SEQ ID NO: 3331961 - DNA, 14 bp, Homo sapiens
tctttttatgcatt

SEQ ID NO: 3331962 - DNA, 15 bp, Homo sapiens
tctttttctgttgta

SEQ ID NO: 3331963 - DNA, 15 bp, Homo sapiens
tctttttgttgtaaa

SEQ ID NO: 3331964 - DNA, 14 bp, Homo sapiens
tcttttttaaatga

SEQ ID NO: 3331965 - DNA, 16 bp, Homo sapiens
tcttttttaaatgaat

SEQ ID NO: 3331966 - DNA, 12 bp, Homo sapiens
tcttttttaacc

SEQ ID NO: 3331967 - DNA, 16 bp, Homo sapiens
tcttttttattaccag

SEQ ID NO: 3331968 - DNA, 13 bp, Homo sapiens
tcttttttcaaaa

SEQ ID NO: 3331969 - DNA, 12 bp, Homo sapiens
tctttttttatg

SEQ ID NO: 3331970 - DNA, 16 bp, Homo sapiens
tctttttttcttttct

SEQ ID NO: 3331971 - DNA, 13 bp, Homo sapiens
tctttttttttcc

SEQ ID NO: 3331972 - DNA, 19 bp, Homo sapiens
tcttttttttttctgttga

SEQ ID NO: 3331973 - DNA, 21 bp, Homo sapiens
tgaaaaaaaaaaagaagaaga

SEQ ID NO: 3331974 - DNA, 17 bp, Homo sapiens
tgaaaaaaaaaatgttg

SEQ ID NO: 3331975 - DNA, 16 bp, Homo sapiens
tgaaaaaaaagtttca

SEQ ID NO: 3331976 - DNA, 23 bp, Homo sapiens
tgaaaaaaccgttcaaattctct

SEQ ID NO: 3331977 - DNA, 20 bp, Homo sapiens
tgaaaaaatttaaaagtaaa

SEQ ID NO: 3331978 - DNA, 17 bp, Homo sapiens
tgaaaaacaacaacaca

SEQ ID NO: 3331979 - DNA, 12 bp, Homo sapiens
tgaaaaactgct

SEQ ID NO: 3331980 - DNA, 19 bp, Homo sapiens
tgaaaaactgctgtaaaca

SEQ ID NO: 3331981 - DNA, 21 bp, Homo sapiens
tgaaaaagcagctaccaggtg

SEQ ID NO: 3331982 - DNA, 17 bp, Homo sapiens
tgaaaaatataaaatta

SEQ ID NO: 3331983 - DNA, 12 bp, Homo sapiens
tgaaaaatatag

SEQ ID NO: 3331984 - DNA, 16 bp, Homo sapiens
tgaaaaattatcagtt

SEQ ID NO: 3331985 - DNA, 13 bp, Homo sapiens
tgaaaaattctca

SEQ ID NO: 3331986 - DNA, 19 bp, Homo sapiens
tgaaaacatttcaaagctg

SEQ ID NO: 3331987 - DNA, 22 bp, Homo sapiens
tgaaaaccatattttattgtat

SEQ ID NO: 3331988 - DNA, 20 bp, Homo sapiens
tgaaaacggagctgaacaat

SEQ ID NO: 3331989 - DNA, 16 bp, Homo sapiens
tgaaaactaaggattt

SEQ ID NO: 3331990 - DNA, 17 bp, Homo sapiens
tgaaaactctttgctgc

SEQ ID NO: 3331991 - DNA, 18 bp, Homo sapiens
tgaaaactctttgctgct

SEQ ID NO: 3331992 - DNA, 23 bp, Homo sapiens
tgaaaagaggggaccagaagcca

SEQ ID NO: 3331993 - DNA, 22 bp, Homo sapiens
tgaaaagagtatgtagtggctt

SEQ ID NO: 3331994 - DNA, 17 bp, Homo sapiens
tgaaaagctattagcca

SEQ ID NO: 3331995 - DNA, 20 bp, Homo sapiens
tgaaaagggtgttgggaggg

SEQ ID NO: 3331996 - DNA, 16 bp, Homo sapiens
tgaaaaggtgaccttg

SEQ ID NO: 3331997 - DNA, 21 bp, Homo sapiens
tgaaaaggttcttcatccctt

SEQ ID NO: 3331998 - DNA, 20 bp, Homo sapiens
tgaaaagtatcactctaaaa

SEQ ID NO: 3331999 - DNA, 12 bp, Homo sapiens
tgaaaagttatt

SEQ ID NO: 3332000 - DNA, 21 bp, Homo sapiens
tgaaaataactgaatttggag

SEQ ID NO: 3332001 - DNA, 16 bp, Homo sapiens
tgaaaataagaataga

SEQ ID NO: 3332002 - DNA, 13 bp, Homo sapiens
tgaaaataattgt

SEQ ID NO: 3332003 - DNA, 23 bp, Homo sapiens
tgaaaatacaacttaaataataa

SEQ ID NO: 3332004 - DNA, 20 bp, Homo sapiens
tgaaaatatacttgactcta

SEQ ID NO: 3332005 - DNA, 15 bp, Homo sapiens
tgaaaatatctcttg

SEQ ID NO: 3332006 - DNA, 22 bp, Homo sapiens
tgaaaatatgttggaaaaaaga

SEQ ID NO: 3332007 - DNA, 20 bp, Homo sapiens
tgaaaatcatcactcaagat

SEQ ID NO: 3332008 - DNA, 14 bp, Homo sapiens
tgaaaatctaatat

SEQ ID NO: 3332009 - DNA, 15 bp, Homo sapiens
tgaaaatctaatatt

SEQ ID NO: 3332010 - DNA, 11 bp, Homo sapiens
tgaaaatgaag

SEQ ID NO: 3332011 - DNA, 16 bp, Homo sapiens
tgaaaatgaagaagga

SEQ ID NO: 3332012 - DNA, 14 bp, Homo sapiens
tcttgctttatact

SEQ ID NO: 3332013 - DNA, 19 bp, Homo sapiens
tcttggaagctgtttggaa

SEQ ID NO: 3332014 - DNA, 20 bp, Homo sapiens
tcttggaagctgtttggaaa

SEQ ID NO: 3332015 - DNA, 16 bp, Homo sapiens
tcttggacactgtaca

SEQ ID NO: 3332016 - DNA, 23 bp, Homo sapiens
tcttggagctgtgagttctccct

SEQ ID NO: 3332017 - DNA, 21 bp, Homo sapiens
tcttggcaaaagccttgtgta

SEQ ID NO: 3332018 - DNA, 13 bp, Homo sapiens
tcttggcctttgc

SEQ ID NO: 3332019 - DNA, 19 bp, Homo sapiens
tcttggcggcagcagccat

SEQ ID NO: 3332020 - DNA, 19 bp, Homo sapiens
tcttggcttaatcattttc

SEQ ID NO: 3332021 - DNA, 19 bp, Homo sapiens
tcttggcttactgcagcct

SEQ ID NO: 3332022 - DNA, 21 bp, Homo sapiens
tcttgggaactccactctcct

SEQ ID NO: 3332023 - DNA, 22 bp, Homo sapiens
tcttgggactgggtttggaccc

SEQ ID NO: 3332024 - DNA, 15 bp, Homo sapiens
tcttgggccccagac

SEQ ID NO: 3332025 - DNA, 16 bp, Homo sapiens
tcttgggccccagacc

SEQ ID NO: 3332026 - DNA, 20 bp, Homo sapiens
tcttgggccccagaccccag

SEQ ID NO: 3332027 - DNA, 14 bp, Homo sapiens
tcttgggcctggcc

SEQ ID NO: 3332028 - DNA, 14 bp, Homo sapiens
tcttgggctactgg

SEQ ID NO: 3332029 - DNA, 18 bp, Homo sapiens
tcttgggctactggcagc

SEQ ID NO: 3332030 - DNA, 19 bp, Homo sapiens
tcttgggctactggcagct

SEQ ID NO: 3332031 - DNA, 16 bp, Homo sapiens
tcttggggcaagactg

SEQ ID NO: 3332032 - DNA, 20 bp, Homo sapiens
tcttggggcaagactgcaaa

SEQ ID NO: 3332033 - DNA, 21 bp, Homo sapiens
tcttggggccactttcagagc

SEQ ID NO: 3332034 - DNA, 23 bp, Homo sapiens
tcttggggccactttcagagccc

SEQ ID NO: 3332035 - DNA, 19 bp, Homo sapiens
tcttgggggggtggccgct

SEQ ID NO: 3332036 - DNA, 16 bp, Homo sapiens
tcttgggtctatgcct

SEQ ID NO: 3332037 - DNA, 17 bp, Homo sapiens
tcttgggtggttcctaa

SEQ ID NO: 3332038 - DNA, 15 bp, Homo sapiens
tcttggtagagattc

SEQ ID NO: 3332039 - DNA, 14 bp, Homo sapiens
tcttggtattctta

SEQ ID NO: 3332040 - DNA, 17 bp, Homo sapiens
tcttggtcagatttgaa

SEQ ID NO: 3332041 - DNA, 16 bp, Homo sapiens
tcttggtgactgtccc

SEQ ID NO: 3332042 - DNA, 14 bp, Homo sapiens
tcttgtaaagactg

SEQ ID NO: 3332043 - DNA, 12 bp, Homo sapiens
tcttgtaaatgt

SEQ ID NO: 3332044 - DNA, 16 bp, Homo sapiens
tcttgtaaatgtttct

SEQ ID NO: 3332045 - DNA, 22 bp, Homo sapiens
tcttgtaagtcatctacttaat

SEQ ID NO: 3332046 - DNA, 21 bp, Homo sapiens
tcttgtaatttccagctttct

SEQ ID NO: 3332047 - DNA, 22 bp, Homo sapiens
tcttgtacttctgtgttcattt

SEQ ID NO: 3332048 - DNA, 21 bp, Homo sapiens
tcttgtagaagatggactctg

SEQ ID NO: 3332049 - DNA, 16 bp, Homo sapiens
tcttgtagtagtctca

SEQ ID NO: 3332050 - DNA, 21 bp, Homo sapiens
tcttgtataagatcctagatc

SEQ ID NO: 3332051 - DNA, 16 bp, Homo sapiens
tcttgtattaaactct

SEQ ID NO: 3332052 - DNA, 14 bp, Homo sapiens
tcttgtcagacata

SEQ ID NO: 3332053 - DNA, 20 bp, Homo sapiens
tcttgtcagacataaagcca

SEQ ID NO: 3332054 - DNA, 23 bp, Homo sapiens
tcttgtcagacataaagccatgt

SEQ ID NO: 3332055 - DNA, 20 bp, Homo sapiens
tcttgtccctttccctacct

SEQ ID NO: 3332056 - DNA, 16 bp, Homo sapiens
tcttgtctgatttctt

SEQ ID NO: 3332057 - DNA, 14 bp, Homo sapiens
tcttgtctttcctc

SEQ ID NO: 3332058 - DNA, 21 bp, Homo sapiens
tcttgtgctagaatacttttt

SEQ ID NO: 3332059 - DNA, 15 bp, Homo sapiens
tcttgtgctcacgct

SEQ ID NO: 3332060 - DNA, 17 bp, Homo sapiens
tcttgtgcttttttgat

SEQ ID NO: 3332061 - DNA, 18 bp, Homo sapiens
tcttgtggaggatgaata

SEQ ID NO: 3332062 - DNA, 22 bp, Homo sapiens
tcttgtggtgtaaagctggccc

SEQ ID NO: 3332063 - DNA, 23 bp, Homo sapiens
tcttgtggtgtaaagctggccct

SEQ ID NO: 3332064 - DNA, 24 bp, Homo sapiens
tcttgtggtgtaaagctggccctg

SEQ ID NO: 3332065 - DNA, 15 bp, Homo sapiens
tcttgtgttgtcctt

SEQ ID NO: 3332066 - DNA, 22 bp, Homo sapiens
tcttgtgtttccacagcctgca

SEQ ID NO: 3332067 - DNA, 15 bp, Homo sapiens
tcttgttagaaaaca

SEQ ID NO: 3332068 - DNA, 15 bp, Homo sapiens
tcttgttctgtccct

SEQ ID NO: 3332069 - DNA, 21 bp, Homo sapiens
tcttgttgctcaaaaaatgag

SEQ ID NO: 3332070 - DNA, 22 bp, Homo sapiens
tcttgttgctcaaaaaatgagc

SEQ ID NO: 3332071 - DNA, 16 bp, Homo sapiens
tcttgttttgtttgtc

SEQ ID NO: 3332072 - DNA, 15 bp, Homo sapiens
tcttgtttttattaa

SEQ ID NO: 3332073 - DNA, 17 bp, Homo sapiens
tcttgtttttattaatt

SEQ ID NO: 3332074 - DNA, 21 bp, Homo sapiens
tcttgtttttattaatttata

SEQ ID NO: 3332075 - DNA, 15 bp, Homo sapiens
tctttaaaaactgtt

SEQ ID NO: 3332076 - DNA, 14 bp, Homo sapiens
tctttaaaagagag

SEQ ID NO: 3332077 - DNA, 16 bp, Homo sapiens
tctttaaaagagagag

SEQ ID NO: 3332078 - DNA, 21 bp, Homo sapiens
tctttaaaggcccagccccta

SEQ ID NO: 3332079 - DNA, 16 bp, Homo sapiens
tctttaaatgttttat

SEQ ID NO: 3332080 - DNA, 21 bp, Homo sapiens
tctttaactgccgtaatttaa

SEQ ID NO: 3332081 - DNA, 10 bp, Homo sapiens
tctttaagag

SEQ ID NO: 3332082 - DNA, 12 bp, Homo sapiens
tctttaagagac

SEQ ID NO: 3332083 - DNA, 13 bp, Homo sapiens
tctttaattctgt

SEQ ID NO: 3332084 - DNA, 22 bp, Homo sapiens
tctttaatttctgtcagaatgc

SEQ ID NO: 3332085 - DNA, 13 bp, Homo sapiens
tctttacctgaga

SEQ ID NO: 3332086 - DNA, 18 bp, Homo sapiens
tctttacctttattgata

SEQ ID NO: 3332087 - DNA, 22 bp, Homo sapiens
tctttactcccttcctggcctc

SEQ ID NO: 3332088 - DNA, 17 bp, Homo sapiens
tctttactggacctgaa

SEQ ID NO: 3332089 - DNA, 15 bp, Homo sapiens
tctttacttcatgga

SEQ ID NO: 3332090 - DNA, 15 bp, Homo sapiens
tctttagaccctcgg

SEQ ID NO: 3332091 - DNA, 11 bp, Homo sapiens
tctttagtata

SEQ ID NO: 3332092 - DNA, 12 bp, Homo sapiens
tctttagttttt

SEQ ID NO: 3332093 - DNA, 23 bp, Homo sapiens
tctttagtttttggttgggaatg

SEQ ID NO: 3332094 - DNA, 20 bp, Homo sapiens
tctttataattctactttga

SEQ ID NO: 3332095 - DNA, 15 bp, Homo sapiens
tctttatacagctgt

SEQ ID NO: 3332096 - DNA, 16 bp, Homo sapiens
tctttatacagctgta

SEQ ID NO: 3332097 - DNA, 16 bp, Homo sapiens
tctttatactgtaatt

SEQ ID NO: 3332098 - DNA, 15 bp, Homo sapiens
tctttatatgaagaa

SEQ ID NO: 3332099 - DNA, 15 bp, Homo sapiens
tctttatgactgttt

SEQ ID NO: 3332100 - DNA, 23 bp, Homo sapiens
tctttatgagctaaaaatatgca

SEQ ID NO: 3332101 - DNA, 21 bp, Homo sapiens
tctttattcaccttttcttca

SEQ ID NO: 3332102 - DNA, 23 bp, Homo sapiens
tctttattttaacctttgataga

SEQ ID NO: 3332103 - DNA, 20 bp, Homo sapiens
tctttcaagcagtcgtgcct

SEQ ID NO: 3332104 - DNA, 20 bp, Homo sapiens
tctttcacaaggtataataa

SEQ ID NO: 3332105 - DNA, 18 bp, Homo sapiens
tctttcacagctcctccc

SEQ ID NO: 3332106 - DNA, 20 bp, Homo sapiens
tctttcacagctcctcccac

SEQ ID NO: 3332107 - DNA, 22 bp, Homo sapiens
tctttcacattgtttgctgcta

SEQ ID NO: 3332108 - DNA, 12 bp, Homo sapiens
tctttcaccttt

SEQ ID NO: 3332109 - DNA, 23 bp, Homo sapiens
tctttcagtacttttttaaatat

SEQ ID NO: 3332110 - DNA, 19 bp, Homo sapiens
tctttccaaattatttctt

SEQ ID NO: 3332111 - DNA, 14 bp, Homo sapiens
tctttcccaggccg

SEQ ID NO: 3332112 - DNA, 18 bp, Homo sapiens
tctttcccatggggaggg

SEQ ID NO: 3332113 - DNA, 13 bp, Homo sapiens
tctttcccttttc

SEQ ID NO: 3332114 - DNA, 15 bp, Homo sapiens
tctttcccttttctg

SEQ ID NO: 3332115 - DNA, 16 bp, Homo sapiens
tctttcccttttctgt

SEQ ID NO: 3332116 - DNA, 22 bp, Homo sapiens
tctttcccttttctgtttagga

SEQ ID NO: 3332117 - DNA, 22 bp, Homo sapiens
tctttcctcttccccttgccct

SEQ ID NO: 3332118 - DNA, 23 bp, Homo sapiens
tctttcctcttccccttgccctt

SEQ ID NO: 3332119 - DNA, 16 bp, Homo sapiens
tctttcctgccttctt

SEQ ID NO: 3332120 - DNA, 15 bp, Homo sapiens
tctttcgtcaccctt

SEQ ID NO: 3332121 - DNA, 16 bp, Homo sapiens
tctttctaactttctt

SEQ ID NO: 3332122 - DNA, 10 bp, Homo sapiens
tctttctaat

SEQ ID NO: 3332123 - DNA, 15 bp, Homo sapiens
tctttctacagagat

SEQ ID NO: 3332124 - DNA, 16 bp, Homo sapiens
tctttctactctgaac

SEQ ID NO: 3332125 - DNA, 15 bp, Homo sapiens
tctttctagtggtct

SEQ ID NO: 3332126 - DNA, 21 bp, Homo sapiens
tctttctagtggtctttgtaa

SEQ ID NO: 3332127 - DNA, 10 bp, Homo sapiens
tctttctata

SEQ ID NO: 3332128 - DNA, 17 bp, Homo sapiens
tctttctatataaaatg

SEQ ID NO: 3332129 - DNA, 15 bp, Homo sapiens
tctttctattccaaa

SEQ ID NO: 3332130 - DNA, 15 bp, Homo sapiens
tctttctattttcac

SEQ ID NO: 3332131 - DNA, 20 bp, Homo sapiens
tctttctccttcattaatga

SEQ ID NO: 3332132 - DNA, 12 bp, Homo sapiens
tctttctctcag

SEQ ID NO: 3332133 - DNA, 21 bp, Homo sapiens
tctttctctcagccttacatt

SEQ ID NO: 3332134 - DNA, 15 bp, Homo sapiens
tctttctctcagtga

SEQ ID NO: 3332135 - DNA, 16 bp, Homo sapiens
tctttctctcagtgaa

SEQ ID NO: 3332136 - DNA, 12 bp, Homo sapiens
tctttctctcct

SEQ ID NO: 3332137 - DNA, 14 bp, Homo sapiens
tctttctctcttcc

SEQ ID NO: 3332138 - DNA, 18 bp, Homo sapiens
tctttctctcttccctca

SEQ ID NO: 3332139 - DNA, 11 bp, Homo sapiens
tctttctctgc

SEQ ID NO: 3332140 - DNA, 13 bp, Homo sapiens
tctttctctgcca

SEQ ID NO: 3332141 - DNA, 21 bp, Homo sapiens
gatgatctttgcagacaggca

SEQ ID NO: 3332142 - DNA, 16 bp, Homo sapiens
gatgatgaaaactaag

SEQ ID NO: 3332143 - DNA, 19 bp, Homo sapiens
gatgatgccaacctctgga

SEQ ID NO: 3332144 - DNA, 18 bp, Homo sapiens
gatgatttcatcttctgg

SEQ ID NO: 3332145 - DNA, 20 bp, Homo sapiens
gatgatttcatcttctggaa

SEQ ID NO: 3332146 - DNA, 15 bp, Homo sapiens
gatgatttgggggag

SEQ ID NO: 3332147 - DNA, 18 bp, Homo sapiens
gatgatttgggggaggct

SEQ ID NO: 3332148 - DNA, 18 bp, Homo sapiens
gatgatttttaacttttt

SEQ ID NO: 3332149 - DNA, 18 bp, Homo sapiens
gatgattttttgaaagtt

SEQ ID NO: 3332150 - DNA, 18 bp, Homo sapiens
gatgcaaagtacaatgtg

SEQ ID NO: 3332151 - DNA, 20 bp, Homo sapiens
gatgcaacaagccctgcttt

SEQ ID NO: 3332152 - DNA, 18 bp, Homo sapiens
gatgcaaggattacagaa

SEQ ID NO: 3332153 - DNA, 19 bp, Homo sapiens
gatgcaaggattacagaaa

SEQ ID NO: 3332154 - DNA, 18 bp, Homo sapiens
gatgcaatgtgctactga

SEQ ID NO: 3332155 - DNA, 22 bp, Homo sapiens
gatgcagcgccgtgtcctctct

SEQ ID NO: 3332156 - DNA, 22 bp, Homo sapiens
gatgcaggcacttattgtaaat

SEQ ID NO: 3332157 - DNA, 18 bp, Homo sapiens
gatgcatacagttttcta

SEQ ID NO: 3332158 - DNA, 16 bp, Homo sapiens
gatgcatcactgggtg

SEQ ID NO: 3332159 - DNA, 20 bp, Homo sapiens
gatgcatcgggaaagaagaa

SEQ ID NO: 3332160 - DNA, 23 bp, Homo sapiens
gatgcatcgggaaagaagaaact

SEQ ID NO: 3332161 - DNA, 22 bp, Homo sapiens
gatgcatgtcttttaaaatgca

SEQ ID NO: 3332162 - DNA, 11 bp, Homo sapiens
gatgcatttca

SEQ ID NO: 3332163 - DNA, 13 bp, Homo sapiens
gatgcatttcaaa

SEQ ID NO: 3332164 - DNA, 17 bp, Homo sapiens
gatgccaaggagcccct

SEQ ID NO: 3332165 - DNA, 17 bp, Homo sapiens
gatgccacacagagtgg

SEQ ID NO: 3332166 - DNA, 17 bp, Homo sapiens
gatgccactcctccctc

SEQ ID NO: 3332167 - DNA, 19 bp, Homo sapiens
gatgccactcctccctccg

SEQ ID NO: 3332168 - DNA, 12 bp, Homo sapiens
gatgccagcccc

SEQ ID NO: 3332169 - DNA, 12 bp, Homo sapiens
gatgccagccct

SEQ ID NO: 3332170 - DNA, 13 bp, Homo sapiens
gatgccagccctt

SEQ ID NO: 3332171 - DNA, 18 bp, Homo sapiens
gatgccatctgtgtcctg

SEQ ID NO: 3332172 - DNA, 20 bp, Homo sapiens
gatgccatctgtgtcctggt

SEQ ID NO: 3332173 - DNA, 22 bp, Homo sapiens
gatgcccagagggcccaggcag

SEQ ID NO: 3332174 - DNA, 23 bp, Homo sapiens
gatgcccagagggcccaggcagg

SEQ ID NO: 3332175 - DNA, 17 bp, Homo sapiens
gatgccgagacctcaag

SEQ ID NO: 3332176 - DNA, 22 bp, Homo sapiens
gatgccgagacctcaagccctg

SEQ ID NO: 3332177 - DNA, 22 bp, Homo sapiens
gatgcgagcgctatcttcacat

SEQ ID NO: 3332178 - DNA, 18 bp, Homo sapiens
gatgcggatcctgctggg

SEQ ID NO: 3332179 - DNA, 16 bp, Homo sapiens
gatgcggtggctcacg

SEQ ID NO: 3332180 - DNA, 14 bp, Homo sapiens
gatgctaatcttgt

SEQ ID NO: 3332181 - DNA, 20 bp, Homo sapiens
gatgctagaaaaatgttctt

SEQ ID NO: 3332182 - DNA, 20 bp, Homo sapiens
gatgctagaactccctttca

SEQ ID NO: 3332183 - DNA, 14 bp, Homo sapiens
gatgctccctcagc

SEQ ID NO: 3332184 - DNA, 16 bp, Homo sapiens
gatgctccctcagcct

SEQ ID NO: 3332185 - DNA, 17 bp, Homo sapiens
gatgctccctcagcctc

SEQ ID NO: 3332186 - DNA, 18 bp, Homo sapiens
gatgctccctcagcctca

SEQ ID NO: 3332187 - DNA, 23 bp, Homo sapiens
gatgctccctcagcctcagagga

SEQ ID NO: 3332188 - DNA, 21 bp, Homo sapiens
gatgctccctcccctgccctg

SEQ ID NO: 3332189 - DNA, 15 bp, Homo sapiens
gatgctcttctgtgg

SEQ ID NO: 3332190 - DNA, 14 bp, Homo sapiens
gatgctctttccct

SEQ ID NO: 3332191 - DNA, 15 bp, Homo sapiens
gatgctctttccctt

SEQ ID NO: 3332192 - DNA, 21 bp, Homo sapiens
gatgctctttcccttttctgt

SEQ ID NO: 3332193 - DNA, 16 bp, Homo sapiens
gatgctgcagcagagt

SEQ ID NO: 3332194 - DNA, 12 bp, Homo sapiens
gatgctgcctga

SEQ ID NO: 3332195 - DNA, 22 bp, Homo sapiens
gatgctgcttccggtagggagg

SEQ ID NO: 3332196 - DNA, 11 bp, Homo sapiens
gatgctgcttt

SEQ ID NO: 3332197 - DNA, 15 bp, Homo sapiens
gatgctgctttcccc

SEQ ID NO: 3332198 - DNA, 21 bp, Homo sapiens
gatgctgggcacttcatctga

SEQ ID NO: 3332199 - DNA, 19 bp, Homo sapiens
gatgctgggttggtgcaca

SEQ ID NO: 3332200 - DNA, 17 bp, Homo sapiens
gatgctggtaatggcca

SEQ ID NO: 3332201 - DNA, 14 bp, Homo sapiens
gatgctgtttgaca

SEQ ID NO: 3332202 - DNA, 20 bp, Homo sapiens
gatgcttgcggcaaaaggaa

SEQ ID NO: 3332203 - DNA, 23 bp, Homo sapiens
gatgcttgcggcaaaaggaaagc

SEQ ID NO: 3332204 - DNA, 20 bp, Homo sapiens
gatgcttgtaacaagaaaac

SEQ ID NO: 3332205 - DNA, 21 bp, Homo sapiens
gatgcttgtaacaagaaaaca

SEQ ID NO: 3332206 - DNA, 18 bp, Homo sapiens
gatggaaaagtgtccttc

SEQ ID NO: 3332207 - DNA, 17 bp, Homo sapiens
gatggaaaataaacatc

SEQ ID NO: 3332208 - DNA, 13 bp, Homo sapiens
gatggaaaggtga

SEQ ID NO: 3332209 - DNA, 15 bp, Homo sapiens
gatggaccgggtggg

SEQ ID NO: 3332210 - DNA, 18 bp, Homo sapiens
gatggaccgggtgggcct

SEQ ID NO: 3332211 - DNA, 21 bp, Homo sapiens
gatggaccgggtgggcctggc

SEQ ID NO: 3332212 - DNA, 23 bp, Homo sapiens
gatggaccgggtgggcctggcct

SEQ ID NO: 3332213 - DNA, 22 bp, Homo sapiens
gatggagactggtcctgtgtgc

SEQ ID NO: 3332214 - DNA, 14 bp, Homo sapiens
gatggagagagggg

SEQ ID NO: 3332215 - DNA, 16 bp, Homo sapiens
gatggagagaggggaa

SEQ ID NO: 3332216 - DNA, 15 bp, Homo sapiens
gatggagaggacaga

SEQ ID NO: 3332217 - DNA, 21 bp, Homo sapiens
gatggagaggcggcctcgtgc

SEQ ID NO: 3332218 - DNA, 17 bp, Homo sapiens
gatggagcccaggcggg

SEQ ID NO: 3332219 - DNA, 18 bp, Homo sapiens
gatggagggcttggccca

SEQ ID NO: 3332220 - DNA, 16 bp, Homo sapiens
gatggaggggagtgtt

SEQ ID NO: 3332221 - DNA, 21 bp, Homo sapiens
gatggaggggtggtcctgact

SEQ ID NO: 3332222 - DNA, 22 bp, Homo sapiens
gatggaggggtggtcctgactc

SEQ ID NO: 3332223 - DNA, 17 bp, Homo sapiens
gatggagtttctaaggt

SEQ ID NO: 3332224 - DNA, 14 bp, Homo sapiens
gatggatcaccatt

SEQ ID NO: 3332225 - DNA, 23 bp, Homo sapiens
gatggatgccaatattaaatctg

SEQ ID NO: 3332226 - DNA, 16 bp, Homo sapiens
gatggatggcacaatg

SEQ ID NO: 3332227 - DNA, 21 bp, Homo sapiens
gatggattcccccccctttcc

SEQ ID NO: 3332228 - DNA, 22 bp, Homo sapiens
gatggattcccccccctttcct

SEQ ID NO: 3332229 - DNA, 23 bp, Homo sapiens
gatggattcccccccctttccta

SEQ ID NO: 3332230 - DNA, 16 bp, Homo sapiens
gatggattctcagata

SEQ ID NO: 3332231 - DNA, 16 bp, Homo sapiens
gatggccaagagcatc

SEQ ID NO: 3332232 - DNA, 15 bp, Homo sapiens
gatggccccagcaca

SEQ ID NO: 3332233 - DNA, 22 bp, Homo sapiens
gatggcgcgggaggcaccagct

SEQ ID NO: 3332234 - DNA, 21 bp, Homo sapiens
gatggctgctagattttaatt

SEQ ID NO: 3332235 - DNA, 19 bp, Homo sapiens
gatggctggaaggggtcca

SEQ ID NO: 3332236 - DNA, 18 bp, Homo sapiens
gatggctgtgcctctgcc

SEQ ID NO: 3332237 - DNA, 15 bp, Homo sapiens
gatggcttgtctata

SEQ ID NO: 3332238 - DNA, 19 bp, Homo sapiens
gatgggaacactggtgggc

SEQ ID NO: 3332239 - DNA, 21 bp, Homo sapiens
gatgggaacgcagatgatcca

SEQ ID NO: 3332240 - DNA, 18 bp, Homo sapiens
gatgggagtgggcacctc

SEQ ID NO: 3332241 - DNA, 20 bp, Homo sapiens
gatgggatcccaggccaggg

SEQ ID NO: 3332242 - DNA, 22 bp, Homo sapiens
gatgggcaacccccagcctgct

SEQ ID NO: 3332243 - DNA, 18 bp, Homo sapiens
gatgggcttgttttcttg

SEQ ID NO: 3332244 - DNA, 18 bp, Homo sapiens
gatggggatagaggaaag

SEQ ID NO: 3332245 - DNA, 14 bp, Homo sapiens
gatggggcctccct

SEQ ID NO: 3332246 - DNA, 16 bp, Homo sapiens
gatgggggatgggcca

SEQ ID NO: 3332247 - DNA, 23 bp, Homo sapiens
gatggggtctcacagtgttgccc

SEQ ID NO: 3332248 - DNA, 12 bp, Homo sapiens
gatgggtggggg

SEQ ID NO: 3332249 - DNA, 20 bp, Homo sapiens
gatgggtgggggctcctggt

SEQ ID NO: 3332250 - DNA, 23 bp, Homo sapiens
gatgggttctaattttggatgga

SEQ ID NO: 3332251 - DNA, 18 bp, Homo sapiens
gatggtaagagaaaagag

SEQ ID NO: 3332252 - DNA, 15 bp, Homo sapiens
gatggtcagctccct

SEQ ID NO: 3332253 - DNA, 15 bp, Homo sapiens
gattttaacaataac

SEQ ID NO: 3332254 - DNA, 19 bp, Homo sapiens
gccctgttggcagctctag

SEQ ID NO: 3332255 - DNA, 17 bp, Homo sapiens
gccctgttgtgtataga

SEQ ID NO: 3332256 - DNA, 17 bp, Homo sapiens
gcccttagtcccccaac

SEQ ID NO: 3332257 - DNA, 19 bp, Homo sapiens
gcccttatgcccggcgccg

SEQ ID NO: 3332258 - DNA, 18 bp, Homo sapiens
gcccttattttcaagaaa

SEQ ID NO: 3332259 - DNA, 22 bp, Homo sapiens
gcccttcacattttttatgggc

SEQ ID NO: 3332260 - DNA, 14 bp, Homo sapiens
gcccttcaggaagc

SEQ ID NO: 3332261 - DNA, 12 bp, Homo sapiens
gcccttccatgt

SEQ ID NO: 3332262 - DNA, 15 bp, Homo sapiens
gcccttccctgtccc

SEQ ID NO: 3332263 - DNA, 19 bp, Homo sapiens
gcccttcctccctgtctct

SEQ ID NO: 3332264 - DNA, 12 bp, Homo sapiens
gcccttcctctc

SEQ ID NO: 3332265 - DNA, 17 bp, Homo sapiens
gcccttcctctccactg

SEQ ID NO: 3332266 - DNA, 22 bp, Homo sapiens
gcccttcctctccactgccttc

SEQ ID NO: 3332267 - DNA, 19 bp, Homo sapiens
gcccttctgattcccctcc

SEQ ID NO: 3332268 - DNA, 21 bp, Homo sapiens
gcccttgcagttcagcaccac

SEQ ID NO: 3332269 - DNA, 16 bp, Homo sapiens
gcccttgccctgacct

SEQ ID NO: 3332270 - DNA, 18 bp, Homo sapiens
gcccttgccctgacctcc

SEQ ID NO: 3332271 - DNA, 21 bp, Homo sapiens
gcccttgccctgacctcccag

SEQ ID NO: 3332272 - DNA, 13 bp, Homo sapiens
gcccttgcctccc

SEQ ID NO: 3332273 - DNA, 14 bp, Homo sapiens
gcccttgcctcccc

SEQ ID NO: 3332274 - DNA, 21 bp, Homo sapiens
gcccttgcctttgtggccttc

SEQ ID NO: 3332275 - DNA, 17 bp, Homo sapiens
gcccttggaataaagtt

SEQ ID NO: 3332276 - DNA, 16 bp, Homo sapiens
gcccttggccatgggt

SEQ ID NO: 3332277 - DNA, 17 bp, Homo sapiens
gcccttgggacagccag

SEQ ID NO: 3332278 - DNA, 21 bp, Homo sapiens
gcccttgggacagccagagct

SEQ ID NO: 3332279 - DNA, 17 bp, Homo sapiens
gcccttggggctggggg

SEQ ID NO: 3332280 - DNA, 13 bp, Homo sapiens
gcccttgtccctt

SEQ ID NO: 3332281 - DNA, 13 bp, Homo sapiens
gcccttgtcctgc

SEQ ID NO: 3332282 - DNA, 16 bp, Homo sapiens
gcccttgtcctgccag

SEQ ID NO: 3332283 - DNA, 11 bp, Homo sapiens
gccctttccat

SEQ ID NO: 3332284 - DNA, 21 bp, Homo sapiens
gccctttccccttcccctccc

SEQ ID NO: 3332285 - DNA, 20 bp, Homo sapiens
gccctttcctaggcccaggc

SEQ ID NO: 3332286 - DNA, 12 bp, Homo sapiens
gccctttctgtg

SEQ ID NO: 3332287 - DNA, 13 bp, Homo sapiens
gccctttctgtgt

SEQ ID NO: 3332288 - DNA, 16 bp, Homo sapiens
gccctttgaagcctca

SEQ ID NO: 3332289 - DNA, 18 bp, Homo sapiens
gccctttgaagcctcagc

SEQ ID NO: 3332290 - DNA, 13 bp, Homo sapiens
gccctttggagaa

SEQ ID NO: 3332291 - DNA, 15 bp, Homo sapiens
gccgaaccaaaagaa

SEQ ID NO: 3332292 - DNA, 12 bp, Homo sapiens
gccgaagctctg

SEQ ID NO: 3332293 - DNA, 20 bp, Homo sapiens
gccgaagctgcaggggcagg

SEQ ID NO: 3332294 - DNA, 17 bp, Homo sapiens
gccgaaggtgcctcaga

SEQ ID NO: 3332295 - DNA, 19 bp, Homo sapiens
gccgaaggtgcctcagact

SEQ ID NO: 3332296 - DNA, 15 bp, Homo sapiens
gccgaatcccccagg

SEQ ID NO: 3332297 - DNA, 14 bp, Homo sapiens
gccgaatgtgcagg

SEQ ID NO: 3332298 - DNA, 12 bp, Homo sapiens
gccgactctggc

SEQ ID NO: 3332299 - DNA, 16 bp, Homo sapiens
gccgactctggccctg

SEQ ID NO: 3332300 - DNA, 21 bp, Homo sapiens
gccgactttgtaccccccaac

SEQ ID NO: 3332301 - DNA, 19 bp, Homo sapiens
gccgagatcacgccactgc

SEQ ID NO: 3332302 - DNA, 20 bp, Homo sapiens
gccgagattgcgccactgca

SEQ ID NO: 3332303 - DNA, 22 bp, Homo sapiens
gccgagccaggttcacactcag

SEQ ID NO: 3332304 - DNA, 16 bp, Homo sapiens
gccgagccgggcctgg

SEQ ID NO: 3332305 - DNA, 17 bp, Homo sapiens
gccgagccgggcctggg

SEQ ID NO: 3332306 - DNA, 20 bp, Homo sapiens
gccgagcgttcccagcaggg

SEQ ID NO: 3332307 - DNA, 12 bp, Homo sapiens
gccgagcttagg

SEQ ID NO: 3332308 - DNA, 13 bp, Homo sapiens
gcctggctcccca

SEQ ID NO: 3332309 - DNA, 21 bp, Homo sapiens
gcctggctcttgtgctggatg

SEQ ID NO: 3332310 - DNA, 18 bp, Homo sapiens
gcctggctggaagagggt

SEQ ID NO: 3332311 - DNA, 14 bp, Homo sapiens
gcctggctggtggg

SEQ ID NO: 3332312 - DNA, 24 bp, Homo sapiens
gcctggctgtggaggcctgatgct

SEQ ID NO: 3332313 - DNA, 18 bp, Homo sapiens
gcctggcttctggagccc

SEQ ID NO: 3332314 - DNA, 20 bp, Homo sapiens
gcctggcttctttctctcag

SEQ ID NO: 3332315 - DNA, 14 bp, Homo sapiens
gcctggcttgctcc

SEQ ID NO: 3332316 - DNA, 15 bp, Homo sapiens
gcctggcttgctcca

SEQ ID NO: 3332317 - DNA, 15 bp, Homo sapiens
gcctgggactcccag

SEQ ID NO: 3332318 - DNA, 17 bp, Homo sapiens
gcctgggactcccagtg

SEQ ID NO: 3332319 - DNA, 21 bp, Homo sapiens
gcctgggagggttcccctggc

SEQ ID NO: 3332320 - DNA, 20 bp, Homo sapiens
gcctgggatgctagccccag

SEQ ID NO: 3332321 - DNA, 17 bp, Homo sapiens
gcctgggcagccaggct

SEQ ID NO: 3332322 - DNA, 16 bp, Homo sapiens
gcctgggccagagaag

SEQ ID NO: 3332323 - DNA, 12 bp, Homo sapiens
gcctgggcctgc

SEQ ID NO: 3332324 - DNA, 17 bp, Homo sapiens
gcctgggcctgcttttc

SEQ ID NO: 3332325 - DNA, 22 bp, Homo sapiens
gcctgggcctgcttttccagga

SEQ ID NO: 3332326 - DNA, 19 bp, Homo sapiens
gcctgggcctgtgcagcag

SEQ ID NO: 3332327 - DNA, 21 bp, Homo sapiens
gcctgggcgtacagagcacat

SEQ ID NO: 3332328 - DNA, 18 bp, Homo sapiens
gcctgggctgttggcact

SEQ ID NO: 3332329 - DNA, 20 bp, Homo sapiens
gcctgggcttgagctgcaga

SEQ ID NO: 3332330 - DNA, 14 bp, Homo sapiens
gcctggggcctgag

SEQ ID NO: 3332331 - DNA, 17 bp, Homo sapiens
gcctggggcctgagaga

SEQ ID NO: 3332332 - DNA, 14 bp, Homo sapiens
gcctgggggagaga

SEQ ID NO: 3332333 - DNA, 18 bp, Homo sapiens
gcctgggggcagtgactg

SEQ ID NO: 3332334 - DNA, 22 bp, Homo sapiens
gcctggggtgcatcctcctcag

SEQ ID NO: 3332335 - DNA, 12 bp, Homo sapiens
gcctgggtgctg

SEQ ID NO: 3332336 - DNA, 15 bp, Homo sapiens
gcctgggtgctggct

SEQ ID NO: 3332337 - DNA, 17 bp, Homo sapiens
gcctgggtgctggctgc

SEQ ID NO: 3332338 - DNA, 21 bp, Homo sapiens
gcctgggtgctggctgcccag

SEQ ID NO: 3332339 - DNA, 12 bp, Homo sapiens
gcctgggtggga

SEQ ID NO: 3332340 - DNA, 19 bp, Homo sapiens
gcctgggtgggacagcctc

SEQ ID NO: 3332341 - DNA, 18 bp, Homo sapiens
gcctgggttgggggcact

SEQ ID NO: 3332342 - DNA, 21 bp, Homo sapiens
gcctgggttgggggcactcag

SEQ ID NO: 3332343 - DNA, 15 bp, Homo sapiens
gcctggtagaaacta

SEQ ID NO: 3332344 - DNA, 23 bp, Homo sapiens
gccttggggaggacaaaacttct

SEQ ID NO: 3332345 - DNA, 19 bp, Homo sapiens
gccttggttcatcagtgtt

SEQ ID NO: 3332346 - DNA, 18 bp, Homo sapiens
gccttggttcccttgtgt

SEQ ID NO: 3332347 - DNA, 17 bp, Homo sapiens
gccttgtaattctaaat

SEQ ID NO: 3332348 - DNA, 23 bp, Homo sapiens
gccttgtctcctactcctgactc

SEQ ID NO: 3332349 - DNA, 20 bp, Homo sapiens
gccttgtgagatccttcaca

SEQ ID NO: 3332350 - DNA, 15 bp, Homo sapiens
gccttgtgccctgcc

SEQ ID NO: 3332351 - DNA, 16 bp, Homo sapiens
gccttgtgccctgccc

SEQ ID NO: 3332352 - DNA, 17 bp, Homo sapiens
gccttgtgctgttaata

SEQ ID NO: 3332353 - DNA, 13 bp, Homo sapiens
gccttgtgtatat

SEQ ID NO: 3332354 - DNA, 14 bp, Homo sapiens
gccttgttttctct

SEQ ID NO: 3332355 - DNA, 19 bp, Homo sapiens
gcctttaaatctgtgatga

SEQ ID NO: 3332356 - DNA, 14 bp, Homo sapiens
gcctttaacagaaa

SEQ ID NO: 3332357 - DNA, 14 bp, Homo sapiens
gcctttaagaacct

SEQ ID NO: 3332358 - DNA, 16 bp, Homo sapiens
gcctttaagccaaaga

SEQ ID NO: 3332359 - DNA, 22 bp, Homo sapiens
gcctttatgttttttgtaagat

SEQ ID NO: 3332360 - DNA, 18 bp, Homo sapiens
gcctttcctctctcctgt

SEQ ID NO: 3332361 - DNA, 15 bp, Homo sapiens
gcctttcctgttcag

SEQ ID NO: 3332362 - DNA, 19 bp, Homo sapiens
gcctttcctgttcagcatt

SEQ ID NO: 3332363 - DNA, 23 bp, Homo sapiens
gcctttctaagactcacttacat

SEQ ID NO: 3332364 - DNA, 14 bp, Homo sapiens
gcctttctgcagtt

SEQ ID NO: 3332365 - DNA, 12 bp, Homo sapiens
gcctttctggga

SEQ ID NO: 3332366 - DNA, 15 bp, Homo sapiens
gcctttgacatttaa

SEQ ID NO: 3332367 - DNA, 23 bp, Homo sapiens
gcctttgagacagtttcttagct

SEQ ID NO: 3332368 - DNA, 15 bp, Homo sapiens
gcctttgcaaatcag

SEQ ID NO: 3332369 - DNA, 19 bp, Homo sapiens
gcctttgcaagatgcttgg

SEQ ID NO: 3332370 - DNA, 15 bp, Homo sapiens
gcctttggctctgga

SEQ ID NO: 3332371 - DNA, 16 bp, Homo sapiens
gcctttggctctggag

SEQ ID NO: 3332372 - DNA, 19 bp, Homo sapiens
gcctttgggttccatcttg

SEQ ID NO: 3332373 - DNA, 18 bp, Homo sapiens
gcctttgtcttgtacttc

SEQ ID NO: 3332374 - DNA, 20 bp, Homo sapiens
gcctttgtcttgtacttctg

SEQ ID NO: 3332375 - DNA, 13 bp, Homo sapiens
gcctttgtggcct

SEQ ID NO: 3332376 - DNA, 13 bp, Homo sapiens
gccttttaacatt

SEQ ID NO: 3332377 - DNA, 16 bp, Homo sapiens
gccttttaacattttg

SEQ ID NO: 3332378 - DNA, 20 bp, Homo sapiens
gccttttccctctttggctc

SEQ ID NO: 3332379 - DNA, 14 bp, Homo sapiens
gccttttgcacccc

SEQ ID NO: 3332380 - DNA, 16 bp, Homo sapiens
gccttttgcacccctc

SEQ ID NO: 3332381 - DNA, 18 bp, Homo sapiens
gccttttgcacccctccc

SEQ ID NO: 3332382 - DNA, 17 bp, Homo sapiens
gccttttgctgcgcacc

SEQ ID NO: 3332383 - DNA, 12 bp, Homo sapiens
gccttttgtata

SEQ ID NO: 3332384 - DNA, 14 bp, Homo sapiens
gccttttgtataca

SEQ ID NO: 3332385 - DNA, 22 bp, Homo sapiens
gccttttgttaaacccttctgt

SEQ ID NO: 3332386 - DNA, 14 bp, Homo sapiens
gcctttttcattta

SEQ ID NO: 3332387 - DNA, 19 bp, Homo sapiens
gcctttttcatttatctat

SEQ ID NO: 3332388 - DNA, 19 bp, Homo sapiens
gcgaaaatagtttgtttaa

SEQ ID NO: 3332389 - DNA, 17 bp, Homo sapiens
gcgaagacccggccagg

SEQ ID NO: 3332390 - DNA, 15 bp, Homo sapiens
gcgaagccttctgca

SEQ ID NO: 3332391 - DNA, 20 bp, Homo sapiens
gcgaagtctttgccttctct

SEQ ID NO: 3332392 - DNA, 13 bp, Homo sapiens
gcgaatccaagct

SEQ ID NO: 3332393 - DNA, 17 bp, Homo sapiens
gcgacatagcccatccc

SEQ ID NO: 3332394 - DNA, 13 bp, Homo sapiens
gcgaccgccccct

SEQ ID NO: 3332395 - DNA, 13 bp, Homo sapiens
gcgaccgggcctc

SEQ ID NO: 3332396 - DNA, 22 bp, Homo sapiens
gcgaccttcctcatccacccca

SEQ ID NO: 3332397 - DNA, 21 bp, Homo sapiens
gcgactaatttcaaaatgctt

SEQ ID NO: 3332398 - DNA, 21 bp, Homo sapiens
gcgactctatagactctagga

SEQ ID NO: 3332399 - DNA, 19 bp, Homo sapiens
gcgacttccacagcagcag

SEQ ID NO: 3332400 - DNA, 12 bp, Homo sapiens
gcgactttctgc

SEQ ID NO: 3332401 - DNA, 14 bp, Homo sapiens
gcgactttctgcct

SEQ ID NO: 3332402 - DNA, 16 bp, Homo sapiens
gcgactttctgcctgg

SEQ ID NO: 3332403 - DNA, 22 bp, Homo sapiens
gcgagacgcacacagctgagca

SEQ ID NO: 3332404 - DNA, 19 bp, Homo sapiens
gcgagagatcaaagatgaa

SEQ ID NO: 3332405 - DNA, 15 bp, Homo sapiens
gcgagccctggtggc

SEQ ID NO: 3332406 - DNA, 17 bp, Homo sapiens
gcgagccctggtggcag

SEQ ID NO: 3332407 - DNA, 13 bp, Homo sapiens
gcgaggaccactt

SEQ ID NO: 3332408 - DNA, 14 bp, Homo sapiens
gcgaggaggcgcgg

SEQ ID NO: 3332409 - DNA, 22 bp, Homo sapiens
gcgaggaggcgcggcctcccga

SEQ ID NO: 3332410 - DNA, 12 bp, Homo sapiens
gcgagggcagct

SEQ ID NO: 3332411 - DNA, 13 bp, Homo sapiens
gcgagggcagctg

SEQ ID NO: 3332412 - DNA, 15 bp, Homo sapiens
gcgagggcagctgct

SEQ ID NO: 3332413 - DNA, 17 bp, Homo sapiens
gcgatccacctgtctca

SEQ ID NO: 3332414 - DNA, 20 bp, Homo sapiens
gcgatcccacacaggctggc

SEQ ID NO: 3332415 - DNA, 18 bp, Homo sapiens
gcgatctctcctggccta

SEQ ID NO: 3332416 - DNA, 21 bp, Homo sapiens
gcgatgccctgggggccgtgc

SEQ ID NO: 3332417 - DNA, 16 bp, Homo sapiens
gcgatgctccctcagc

SEQ ID NO: 3332418 - DNA, 23 bp, Homo sapiens
gcgatgctccctcagcctcagag

SEQ ID NO: 3332419 - DNA, 22 bp, Homo sapiens
gcgattcttctgcttcagcctc

SEQ ID NO: 3332420 - DNA, 15 bp, Homo sapiens
gcgattttgtctacc

SEQ ID NO: 3332421 - DNA, 19 bp, Homo sapiens
gcgcaaaactgcctgaaag

SEQ ID NO: 3332422 - DNA, 16 bp, Homo sapiens
gcgcaggcccagtgac

SEQ ID NO: 3332423 - DNA, 18 bp, Homo sapiens
gcgcagtgcttctctaca

SEQ ID NO: 3332424 - DNA, 14 bp, Homo sapiens
gcgccaccatcctg

SEQ ID NO: 3332425 - DNA, 22 bp, Homo sapiens
gcgccactacactccagcctga

SEQ ID NO: 3332426 - DNA, 19 bp, Homo sapiens
gcgccacttcctttgtgtt

SEQ ID NO: 3332427 - DNA, 17 bp, Homo sapiens
gcgcccacctccccacg

SEQ ID NO: 3332428 - DNA, 19 bp, Homo sapiens
gcgccccaccgccgtggag

SEQ ID NO: 3332429 - DNA, 15 bp, Homo sapiens
gcgccccgcccacac

SEQ ID NO: 3332430 - DNA, 14 bp, Homo sapiens
gcgcccctgggaga

SEQ ID NO: 3332431 - DNA, 16 bp, Homo sapiens
gcgccctggacttggt

SEQ ID NO: 3332432 - DNA, 20 bp, Homo sapiens
gcgccgtgagttctcagggc

SEQ ID NO: 3332433 - DNA, 18 bp, Homo sapiens
gcgcctacaggagtgagc

SEQ ID NO: 3332434 - DNA, 21 bp, Homo sapiens
gcgcctacaggagtgagcact

SEQ ID NO: 3332435 - DNA, 15 bp, Homo sapiens
gcgcctagagcgcgg

SEQ ID NO: 3332436 - DNA, 21 bp, Homo sapiens
gcgcctagagcgcggctggct

SEQ ID NO: 3332437 - DNA, 12 bp, Homo sapiens
gcgcctggagag

SEQ ID NO: 3332438 - DNA, 15 bp, Homo sapiens
gcgcctggagagcga

SEQ ID NO: 3332439 - DNA, 13 bp, Homo sapiens
gcgcctggcacat

SEQ ID NO: 3332440 - DNA, 20 bp, Homo sapiens
gccctaggcccctcctagac

SEQ ID NO: 3332441 - DNA, 17 bp, Homo sapiens
gccctatttttgcaatg

SEQ ID NO: 3332442 - DNA, 16 bp, Homo sapiens
gccctcaacaggccca

SEQ ID NO: 3332443 - DNA, 18 bp, Homo sapiens
gccctcaacaggcccagg

SEQ ID NO: 3332444 - DNA, 23 bp, Homo sapiens
gccctcagtcagttcccggagca

SEQ ID NO: 3332445 - DNA, 16 bp, Homo sapiens
gccctcatggcccctc

SEQ ID NO: 3332446 - DNA, 18 bp, Homo sapiens
gccctcattactgggcct

SEQ ID NO: 3332447 - DNA, 19 bp, Homo sapiens
gccctcattactgggcctt

SEQ ID NO: 3332448 - DNA, 21 bp, Homo sapiens
gccctcattactgggccttag

SEQ ID NO: 3332449 - DNA, 12 bp, Homo sapiens
gccctccaaaga

SEQ ID NO: 3332450 - DNA, 14 bp, Homo sapiens
gccctccaggcttt

SEQ ID NO: 3332451 - DNA, 15 bp, Homo sapiens
gccctccccagagca

SEQ ID NO: 3332452 - DNA, 17 bp, Homo sapiens
gccctccccctcaacct

SEQ ID NO: 3332453 - DNA, 22 bp, Homo sapiens
gccctccccctcaacctcacca

SEQ ID NO: 3332454 - DNA, 12 bp, Homo sapiens
gccctcccctcc

SEQ ID NO: 3332455 - DNA, 18 bp, Homo sapiens
gccctcccctcccctgct

SEQ ID NO: 3332456 - DNA, 21 bp, Homo sapiens
gccctcccctcccctgctgca

SEQ ID NO: 3332457 - DNA, 13 bp, Homo sapiens
gccctccctatgt

SEQ ID NO: 3332458 - DNA, 21 bp, Homo sapiens
gccctccctgcccctcccttc

SEQ ID NO: 3332459 - DNA, 14 bp, Homo sapiens
gccctccgacagcc

SEQ ID NO: 3332460 - DNA, 22 bp, Homo sapiens
gccctccgacagccccctctgc

SEQ ID NO: 3332461 - DNA, 18 bp, Homo sapiens
gccctccgaccctcatgg

SEQ ID NO: 3332462 - DNA, 13 bp, Homo sapiens
gccctccgcctgg

SEQ ID NO: 3332463 - DNA, 16 bp, Homo sapiens
gccctccgcctgggat

SEQ ID NO: 3332464 - DNA, 17 bp, Homo sapiens
gccctccgcctgggatc

SEQ ID NO: 3332465 - DNA, 23 bp, Homo sapiens
gccctcctcgggccgaggcccag

SEQ ID NO: 3332466 - DNA, 14 bp, Homo sapiens
gccctcctctccca

SEQ ID NO: 3332467 - DNA, 10 bp, Homo sapiens
gccctcctgg

SEQ ID NO: 3332468 - DNA, 17 bp, Homo sapiens
gccctcgaaccaaggca

SEQ ID NO: 3332469 - DNA, 20 bp, Homo sapiens
gccctcgaaccaaggcagcc

SEQ ID NO: 3332470 - DNA, 23 bp, Homo sapiens
gccctcgaaccaaggcagcctcc

SEQ ID NO: 3332471 - DNA, 19 bp, Homo sapiens
gccctcggtggctgcacag

SEQ ID NO: 3332472 - DNA, 14 bp, Homo sapiens
gccctcgtggccag

SEQ ID NO: 3332473 - DNA, 16 bp, Homo sapiens
gccctcgtggccagcc

SEQ ID NO: 3332474 - DNA, 17 bp, Homo sapiens
gccctctatttattagc

SEQ ID NO: 3332475 - DNA, 14 bp, Homo sapiens
gccctctctgctcc

SEQ ID NO: 3332476 - DNA, 13 bp, Homo sapiens
gccctctgggtcc

SEQ ID NO: 3332477 - DNA, 19 bp, Homo sapiens
gccctctgggtccctcctc

SEQ ID NO: 3332478 - DNA, 15 bp, Homo sapiens
gccctctttccctgc

SEQ ID NO: 3332479 - DNA, 17 bp, Homo sapiens
gccctgacctcccagcc

SEQ ID NO: 3332480 - DNA, 19 bp, Homo sapiens
gccctgacctcccagccct

SEQ ID NO: 3332481 - DNA, 15 bp, Homo sapiens
gccctgaccttggct

SEQ ID NO: 3332482 - DNA, 20 bp, Homo sapiens
gccctgaggcctagactctg

SEQ ID NO: 3332483 - DNA, 16 bp, Homo sapiens
gccctgaggcctgagg

SEQ ID NO: 3332484 - DNA, 22 bp, Homo sapiens
gccctgatgtgtcctcagggag

SEQ ID NO: 3332485 - DNA, 16 bp, Homo sapiens
gccctgcacctgtgca

SEQ ID NO: 3332486 - DNA, 13 bp, Homo sapiens
gccctgcagaggg

SEQ ID NO: 3332487 - DNA, 16 bp, Homo sapiens
gccctgcagagggacc

SEQ ID NO: 3332488 - DNA, 14 bp, Homo sapiens
gccctgcagccagc

SEQ ID NO: 3332489 - DNA, 15 bp, Homo sapiens
gccctgcagccagct

SEQ ID NO: 3332490 - DNA, 11 bp, Homo sapiens
gccctgccact

SEQ ID NO: 3332491 - DNA, 13 bp, Homo sapiens
gccctgccactca

SEQ ID NO: 3332492 - DNA, 20 bp, Homo sapiens
gccctgccactcactaggcc

SEQ ID NO: 3332493 - DNA, 22 bp, Homo sapiens
gccctgccccctcccactcttg

SEQ ID NO: 3332494 - DNA, 16 bp, Homo sapiens
gccctgccccctggct

SEQ ID NO: 3332495 - DNA, 12 bp, Homo sapiens
gccctgccccta

SEQ ID NO: 3332496 - DNA, 15 bp, Homo sapiens
gccctgcccctagga

SEQ ID NO: 3332497 - DNA, 15 bp, Homo sapiens
gccctgccctgagga

SEQ ID NO: 3332498 - DNA, 16 bp, Homo sapiens
gccgtccatggcacca

SEQ ID NO: 3332499 - DNA, 17 bp, Homo sapiens
gccgtccatggcaccag

SEQ ID NO: 3332500 - DNA, 18 bp, Homo sapiens
gccgtccatggcaccagc

SEQ ID NO: 3332501 - DNA, 21 bp, Homo sapiens
gccgtccatggcaccagcccc

SEQ ID NO: 3332502 - DNA, 23 bp, Homo sapiens
gccgtccatggcaccagccccct

SEQ ID NO: 3332503 - DNA, 21 bp, Homo sapiens
gccgtctccaggggctgcttc

SEQ ID NO: 3332504 - DNA, 17 bp, Homo sapiens
gccgtctcctccctcag

SEQ ID NO: 3332505 - DNA, 19 bp, Homo sapiens
gccgtctgactccagagtc

SEQ ID NO: 3332506 - DNA, 15 bp, Homo sapiens
gccgtgaactgtgca

SEQ ID NO: 3332507 - DNA, 16 bp, Homo sapiens
gccgtgcattagcaca

SEQ ID NO: 3332508 - DNA, 14 bp, Homo sapiens
gccgtgccttcagc

SEQ ID NO: 3332509 - DNA, 21 bp, Homo sapiens
gccgtggattgcacgtggcct

SEQ ID NO: 3332510 - DNA, 11 bp, Homo sapiens
gccgtggcttc

SEQ ID NO: 3332511 - DNA, 13 bp, Homo sapiens
gccgtggcttccc

SEQ ID NO: 3332512 - DNA, 15 bp, Homo sapiens
gccgtggcttcccgc

SEQ ID NO: 3332513 - DNA, 19 bp, Homo sapiens
gccgtggcttcccgctcag

SEQ ID NO: 3332514 - DNA, 22 bp, Homo sapiens
gccgtggcttcccgctcagccc

SEQ ID NO: 3332515 - DNA, 15 bp, Homo sapiens
gccgtgtctctgagg

SEQ ID NO: 3332516 - DNA, 19 bp, Homo sapiens
gccgtgtgagtgtgacagg

SEQ ID NO: 3332517 - DNA, 21 bp, Homo sapiens
gccgtgttactgttgcactga

SEQ ID NO: 3332518 - DNA, 16 bp, Homo sapiens
gccgttccccttggct

SEQ ID NO: 3332519 - DNA, 20 bp, Homo sapiens
gcctaaaatcttggaagtac

SEQ ID NO: 3332520 - DNA, 20 bp, Homo sapiens
gcctaaaattgtatgaaaat

SEQ ID NO: 3332521 - DNA, 13 bp, Homo sapiens
gcctaaagggcag

SEQ ID NO: 3332522 - DNA, 19 bp, Homo sapiens
gcctaaatttaatgctgcc

SEQ ID NO: 3332523 - DNA, 14 bp, Homo sapiens
gcctaaccaggccc

SEQ ID NO: 3332524 - DNA, 19 bp, Homo sapiens
gcctaagacatgtgaggag

SEQ ID NO: 3332525 - DNA, 18 bp, Homo sapiens
gcctaagcattgcctggc

SEQ ID NO: 3332526 - DNA, 23 bp, Homo sapiens
gcctaagggatcctgcctgcccc

SEQ ID NO: 3332527 - DNA, 21 bp, Homo sapiens
gcctaattggaaagtgccagc

SEQ ID NO: 3332528 - DNA, 14 bp, Homo sapiens
gcctacaagctggc

SEQ ID NO: 3332529 - DNA, 20 bp, Homo sapiens
gcctacagaacttcagaaag

SEQ ID NO: 3332530 - DNA, 21 bp, Homo sapiens
gcctacagaacttcagaaaga

SEQ ID NO: 3332531 - DNA, 14 bp, Homo sapiens
gcctacagatgaac

SEQ ID NO: 3332532 - DNA, 22 bp, Homo sapiens
gcctacagctttgatccctgac

SEQ ID NO: 3332533 - DNA, 18 bp, Homo sapiens
gcctaccaatctctgctc

SEQ ID NO: 3332534 - DNA, 14 bp, Homo sapiens
gcctaccatttcac

SEQ ID NO: 3332535 - DNA, 16 bp, Homo sapiens
gcctacctcagcctcc

SEQ ID NO: 3332536 - DNA, 17 bp, Homo sapiens
gcctactccaaaatgtt

SEQ ID NO: 3332537 - DNA, 15 bp, Homo sapiens
gcctactcttcaggg

SEQ ID NO: 3332538 - DNA, 13 bp, Homo sapiens
gcctagaagctgg

SEQ ID NO: 3332539 - DNA, 20 bp, Homo sapiens
gcctagagcgcggctggctc

SEQ ID NO: 3332540 - DNA, 22 bp, Homo sapiens
gcctagagcgcggctggctctg

SEQ ID NO: 3332541 - DNA, 15 bp, Homo sapiens
gcctagagtgtagcc

SEQ ID NO: 3332542 - DNA, 17 bp, Homo sapiens
gcctagatccacacaca

SEQ ID NO: 3332543 - DNA, 12 bp, Homo sapiens
gcctagcaagct

SEQ ID NO: 3332544 - DNA, 19 bp, Homo sapiens
gcctagcaagctggcctct

SEQ ID NO: 3332545 - DNA, 20 bp, Homo sapiens
gctccagcaccttctttctg

SEQ ID NO: 3332546 - DNA, 14 bp, Homo sapiens
gctccagcatccag

SEQ ID NO: 3332547 - DNA, 17 bp, Homo sapiens
gctccagctttctgcca

SEQ ID NO: 3332548 - DNA, 18 bp, Homo sapiens
gctccaggactccactgg

SEQ ID NO: 3332549 - DNA, 19 bp, Homo sapiens
gctccaggactccactgga

SEQ ID NO: 3332550 - DNA, 20 bp, Homo sapiens
gctccaggactccactggac

SEQ ID NO: 3332551 - DNA, 16 bp, Homo sapiens
gctccaggctccttta

SEQ ID NO: 3332552 - DNA, 23 bp, Homo sapiens
gctccaggctcctttagcgccca

SEQ ID NO: 3332553 - DNA, 14 bp, Homo sapiens
gctccaggctggct

SEQ ID NO: 3332554 - DNA, 21 bp, Homo sapiens
gctccagggaatccaagcctc

SEQ ID NO: 3332555 - DNA, 18 bp, Homo sapiens
gctccagggagattttga

SEQ ID NO: 3332556 - DNA, 18 bp, Homo sapiens
gctccagggtcttgggct

SEQ ID NO: 3332557 - DNA, 16 bp, Homo sapiens
gctccaggtggctctg

SEQ ID NO: 3332558 - DNA, 18 bp, Homo sapiens
gctccatgactggctgtc

SEQ ID NO: 3332559 - DNA, 16 bp, Homo sapiens
gctccatgattctctg

SEQ ID NO: 3332560 - DNA, 19 bp, Homo sapiens
gctccatgattctctgagt

SEQ ID NO: 3332561 - DNA, 15 bp, Homo sapiens
gctccatgcctctgg

SEQ ID NO: 3332562 - DNA, 20 bp, Homo sapiens
gctccatgcctctggaggcc

SEQ ID NO: 3332563 - DNA, 22 bp, Homo sapiens
gctccattttcttattgcgctg

SEQ ID NO: 3332564 - DNA, 20 bp, Homo sapiens
gctcccaacccccctcctgc

SEQ ID NO: 3332565 - DNA, 23 bp, Homo sapiens
gctcccaacccccctcctgctcc

SEQ ID NO: 3332566 - DNA, 12 bp, Homo sapiens
gctcccaagggt

SEQ ID NO: 3332567 - DNA, 17 bp, Homo sapiens
gctcccacaggcccttc

SEQ ID NO: 3332568 - DNA, 15 bp, Homo sapiens
gctcccaccgccccc

SEQ ID NO: 3332569 - DNA, 16 bp, Homo sapiens
gctcccaccgccccca

SEQ ID NO: 3332570 - DNA, 23 bp, Homo sapiens
gctcccaccgcccccaccccttc

SEQ ID NO: 3332571 - DNA, 14 bp, Homo sapiens
gctcccagcctgcc

SEQ ID NO: 3332572 - DNA, 16 bp, Homo sapiens
gctcccagcctgccct

SEQ ID NO: 3332573 - DNA, 18 bp, Homo sapiens
gctcccagcctgccctcc

SEQ ID NO: 3332574 - DNA, 21 bp, Homo sapiens
gctcccagcctgccctccagc

SEQ ID NO: 3332575 - DNA, 19 bp, Homo sapiens
gctcccaggggtctccctg

SEQ ID NO: 3332576 - DNA, 15 bp, Homo sapiens
gctcccattcctccc

SEQ ID NO: 3332577 - DNA, 16 bp, Homo sapiens
gctcccattcctccct

SEQ ID NO: 3332578 - DNA, 23 bp, Homo sapiens
gctccccacaccttccagggccc

SEQ ID NO: 3332579 - DNA, 20 bp, Homo sapiens
gctccccacagcgtccctgg

SEQ ID NO: 3332580 - DNA, 22 bp, Homo sapiens
gctccccacagcgtccctggcg

SEQ ID NO: 3332581 - DNA, 12 bp, Homo sapiens
gctccccacgag

SEQ ID NO: 3332582 - DNA, 16 bp, Homo sapiens
gctccccagccctggc

SEQ ID NO: 3332583 - DNA, 20 bp, Homo sapiens
gctccccagccctggctctg

SEQ ID NO: 3332584 - DNA, 21 bp, Homo sapiens
gctccccagccctggctctgc

SEQ ID NO: 3332585 - DNA, 13 bp, Homo sapiens
gctccccagggct

SEQ ID NO: 3332586 - DNA, 22 bp, Homo sapiens
gctccccccgcccacccacgca

SEQ ID NO: 3332587 - DNA, 15 bp, Homo sapiens
gctcccccgcagtcc

SEQ ID NO: 3332588 - DNA, 16 bp, Homo sapiens
gctcccccgcagtccc

SEQ ID NO: 3332589 - DNA, 19 bp, Homo sapiens
gctcccccgcagtccccag

SEQ ID NO: 3332590 - DNA, 15 bp, Homo sapiens
gctcccgcagggctg

SEQ ID NO: 3332591 - DNA, 14 bp, Homo sapiens
gctcccgctcccag

SEQ ID NO: 3332592 - DNA, 16 bp, Homo sapiens
gctccctagactgcat

SEQ ID NO: 3332593 - DNA, 11 bp, Homo sapiens
gctccctcagc

SEQ ID NO: 3332594 - DNA, 13 bp, Homo sapiens
gctccctcagcct

SEQ ID NO: 3332595 - DNA, 16 bp, Homo sapiens
gctccctcagcctcag

SEQ ID NO: 3332596 - DNA, 17 bp, Homo sapiens
gctccctcccctgccct

SEQ ID NO: 3332597 - DNA, 21 bp, Homo sapiens
gctccctcccgtagtctcctg

SEQ ID NO: 3332598 - DNA, 23 bp, Homo sapiens
gctccctcccgtagtctcctggg

SEQ ID NO: 3332599 - DNA, 14 bp, Homo sapiens
gctccctcctccag

SEQ ID NO: 3332600 - DNA, 16 bp, Homo sapiens
gctccctcctccaggc

SEQ ID NO: 3332601 - DNA, 22 bp, Homo sapiens
gctccctcctccaggcctgcct

SEQ ID NO: 3332602 - DNA, 17 bp, Homo sapiens
gctccctctctggtttc

SEQ ID NO: 3332603 - DNA, 12 bp, Homo sapiens
gctccctgaagc

SEQ ID NO: 3332604 - DNA, 13 bp, Homo sapiens
gctccctgaagcc

SEQ ID NO: 3332605 - DNA, 14 bp, Homo sapiens
gctccctgaagcca

SEQ ID NO: 3332606 - DNA, 17 bp, Homo sapiens
gctccctgaagccagcc

SEQ ID NO: 3332607 - DNA, 20 bp, Homo sapiens
gctccctgaagccagccttc

SEQ ID NO: 3332608 - DNA, 16 bp, Homo sapiens
gctccctgatgacacc

SEQ ID NO: 3332609 - DNA, 15 bp, Homo sapiens
gctccctgccccaaa

SEQ ID NO: 3332610 - DNA, 16 bp, Homo sapiens
gctccctgctttggct

SEQ ID NO: 3332611 - DNA, 21 bp, Homo sapiens
gctccctgctttggctgaggg

SEQ ID NO: 3332612 - DNA, 14 bp, Homo sapiens
gctccctggagccc

SEQ ID NO: 3332613 - DNA, 19 bp, Homo sapiens
gctccctggagccctgttg

SEQ ID NO: 3332614 - DNA, 19 bp, Homo sapiens
gctccctggcaggatgctg

SEQ ID NO: 3332615 - DNA, 19 bp, Homo sapiens
gctccctgtagctctgcct

SEQ ID NO: 3332616 - DNA, 23 bp, Homo sapiens
gctccctgtagctctgcctccct

SEQ ID NO: 3332617 - DNA, 16 bp, Homo sapiens
gctccctgtggcactc

SEQ ID NO: 3332618 - DNA, 22 bp, Homo sapiens
gctcccttcaagacgaggggca

SEQ ID NO: 3332619 - DNA, 13 bp, Homo sapiens
gctcccttcagcc

SEQ ID NO: 3332620 - DNA, 20 bp, Homo sapiens
gctcccttcagcccccagcc

SEQ ID NO: 3332621 - DNA, 12 bp, Homo sapiens
gctcccttccct

SEQ ID NO: 3332622 - DNA, 23 bp, Homo sapiens
gctccgcccgctcctgccgcaga

SEQ ID NO: 3332623 - DNA, 17 bp, Homo sapiens
gctccgctcccaccgcc

SEQ ID NO: 3332624 - DNA, 14 bp, Homo sapiens
gctccgctgctcct

SEQ ID NO: 3332625 - DNA, 19 bp, Homo sapiens
gctccgctgctccttggct

SEQ ID NO: 3332626 - DNA, 22 bp, Homo sapiens
gctccgctgctccttggcttac

SEQ ID NO: 3332627 - DNA, 23 bp, Homo sapiens
gctccgtccaggagcctgtgcct

SEQ ID NO: 3332628 - DNA, 13 bp, Homo sapiens
gctccgtgcctcc

SEQ ID NO: 3332629 - DNA, 18 bp, Homo sapiens
gctcctaactccaccgcc

SEQ ID NO: 3332630 - DNA, 15 bp, Homo sapiens
gctcctaagcttcaa

SEQ ID NO: 3332631 - DNA, 19 bp, Homo sapiens
gctcctagcagacagaaac

SEQ ID NO: 3332632 - DNA, 14 bp, Homo sapiens
gctcctatctgtgt

SEQ ID NO: 3332633 - DNA, 22 bp, Homo sapiens
gctcctcaacccctcccctcca

SEQ ID NO: 3332634 - DNA, 15 bp, Homo sapiens
gctcctcacctgtct

SEQ ID NO: 3332635 - DNA, 14 bp, Homo sapiens
gctcctcactgccc

SEQ ID NO: 3332636 - DNA, 16 bp, Homo sapiens
gctcctcactgcccgc

SEQ ID NO: 3332637 - DNA, 18 bp, Homo sapiens
gctcctcactgcccgcac

SEQ ID NO: 3332638 - DNA, 14 bp, Homo sapiens
gctcctcactggag

SEQ ID NO: 3332639 - DNA, 23 bp, Homo sapiens
gctcctcactggtatactatcat

SEQ ID NO: 3332640 - DNA, 16 bp, Homo sapiens
gctcctcccctcttga

SEQ ID NO: 3332641 - DNA, 14 bp, Homo sapiens
gctcctcccggtgc

SEQ ID NO: 3332642 - DNA, 16 bp, Homo sapiens
gctcctccctggctgc

SEQ ID NO: 3332643 - DNA, 17 bp, Homo sapiens
gctcctccctggctgcc

SEQ ID NO: 3332644 - DNA, 20 bp, Homo sapiens
gctcctccctggctgccctg

SEQ ID NO: 3332645 - DNA, 21 bp, Homo sapiens
gctcctccctggctgccctgg

SEQ ID NO: 3332646 - DNA, 22 bp, Homo sapiens
gctcctccctggctgccctggc

SEQ ID NO: 3332647 - DNA, 11 bp, Homo sapiens
gctcctcctgt

SEQ ID NO: 3332648 - DNA, 13 bp, Homo sapiens
gctcctctccagg

SEQ ID NO: 3332649 - DNA, 15 bp, Homo sapiens
gctcctctccaggca

SEQ ID NO: 3332650 - DNA, 22 bp, Homo sapiens
gctcctctccaggcacccttct

SEQ ID NO: 3332651 - DNA, 18 bp, Homo sapiens
gctcctctccttgggctc

SEQ ID NO: 3332652 - DNA, 21 bp, Homo sapiens
gctcctctccttgggctcctg

SEQ ID NO: 3332653 - DNA, 22 bp, Homo sapiens
gctcctctccttgggctcctgg

SEQ ID NO: 3332654 - DNA, 23 bp, Homo sapiens
gctcctctccttgggctcctggc

SEQ ID NO: 3332655 - DNA, 17 bp, Homo sapiens
gctcctctgtcctgctt

SEQ ID NO: 3332656 - DNA, 20 bp, Homo sapiens
gctcctctgtcctgcttctg

SEQ ID NO: 3332657 - DNA, 18 bp, Homo sapiens
gctcctcttaccgtagcc

SEQ ID NO: 3332658 - DNA, 20 bp, Homo sapiens
gctcctcttaccgtagcctc

SEQ ID NO: 3332659 - DNA, 22 bp, Homo sapiens
gctcctgaaagaaacgctagaa

SEQ ID NO: 3332660 - DNA, 22 bp, Homo sapiens
gctcctgaggggcatctgcccc

SEQ ID NO: 3332661 - DNA, 20 bp, Homo sapiens
gctcctgcacttacttgctt

SEQ ID NO: 3332662 - DNA, 21 bp, Homo sapiens
gctcctgcagcatggtccctg

SEQ ID NO: 3332663 - DNA, 19 bp, Homo sapiens
gctcctgccgcagacgggc

SEQ ID NO: 3332664 - DNA, 15 bp, Homo sapiens
gctcctgccttctgt

SEQ ID NO: 3332665 - DNA, 17 bp, Homo sapiens
gctcctgccttctgtcc

SEQ ID NO: 3332666 - DNA, 18 bp, Homo sapiens
gctcctgccttctgtcct

SEQ ID NO: 3332667 - DNA, 16 bp, Homo sapiens
gctcctggctgccagg

SEQ ID NO: 3332668 - DNA, 12 bp, Homo sapiens
gctcctggtggc

SEQ ID NO: 3332669 - DNA, 15 bp, Homo sapiens
gctcctgtcctccca

SEQ ID NO: 3332670 - DNA, 22 bp, Homo sapiens
gctcctgtcctcccatcccctg

SEQ ID NO: 3332671 - DNA, 16 bp, Homo sapiens
gctccttcactgttcc

SEQ ID NO: 3332672 - DNA, 13 bp, Homo sapiens
gctccttctgtcc

SEQ ID NO: 3332673 - DNA, 17 bp, Homo sapiens
gctccttggagcaggca

SEQ ID NO: 3332674 - DNA, 23 bp, Homo sapiens
gctcctttacaaaagaaatacct

SEQ ID NO: 3332675 - DNA, 17 bp, Homo sapiens
gctcctttagcgcccag

SEQ ID NO: 3332676 - DNA, 14 bp, Homo sapiens
gctcctttctccag

SEQ ID NO: 3332677 - DNA, 17 bp, Homo sapiens
gctcctttctcctgtga

SEQ ID NO: 3332678 - DNA, 18 bp, Homo sapiens
gctccttttgtccccagg

SEQ ID NO: 3332679 - DNA, 22 bp, Homo sapiens
gctccttttgtccccagggccc

SEQ ID NO: 3332680 - DNA, 19 bp, Homo sapiens
gctcgaggctggtgccagg

SEQ ID NO: 3332681 - DNA, 20 bp, Homo sapiens
gctcgatccaaattgtgctt

SEQ ID NO: 3332682 - DNA, 15 bp, Homo sapiens
gctcgcccaggaagg

SEQ ID NO: 3332683 - DNA, 13 bp, Homo sapiens
gctcgccccacct

SEQ ID NO: 3332684 - DNA, 16 bp, Homo sapiens
gctcgccccacctcca

SEQ ID NO: 3332685 - DNA, 13 bp, Homo sapiens
gctcgcgggcagc

SEQ ID NO: 3332686 - DNA, 21 bp, Homo sapiens
gctcgcgggcagcgggccagg

SEQ ID NO: 3332687 - DNA, 18 bp, Homo sapiens
gctcggaggccccaaagg

SEQ ID NO: 3332688 - DNA, 21 bp, Homo sapiens
gctcggaggccccaaaggaaa

SEQ ID NO: 3332689 - DNA, 15 bp, Homo sapiens
gctcggcaggaagga

SEQ ID NO: 3332690 - DNA, 13 bp, Homo sapiens
gctcggcgcccac

SEQ ID NO: 3332691 - DNA, 22 bp, Homo sapiens
gctcgtggccttccccttttgc

SEQ ID NO: 3332692 - DNA, 16 bp, Homo sapiens
gctctaattcacagtg

SEQ ID NO: 3332693 - DNA, 18 bp, Homo sapiens
gctctacccatgagcctg

SEQ ID NO: 3332694 - DNA, 13 bp, Homo sapiens
gctctaccctgct

SEQ ID NO: 3332695 - DNA, 21 bp, Homo sapiens
gctctactggtcttgtggaat

SEQ ID NO: 3332696 - DNA, 13 bp, Homo sapiens
gctctagaatctg

SEQ ID NO: 3332697 - DNA, 20 bp, Homo sapiens
gctctagatcataaggcttc

SEQ ID NO: 3332698 - DNA, 15 bp, Homo sapiens
gctctagccaggagt

SEQ ID NO: 3332699 - DNA, 16 bp, Homo sapiens
gctctagccaggagtc

SEQ ID NO: 3332700 - DNA, 20 bp, Homo sapiens
gctctagccaggagtctgtg

SEQ ID NO: 3332701 - DNA, 16 bp, Homo sapiens
gctctagctggcagga

SEQ ID NO: 3332702 - DNA, 19 bp, Homo sapiens
gctctagctggcaggacac

SEQ ID NO: 3332703 - DNA, 20 bp, Homo sapiens
gctctagctggcaggacaca

SEQ ID NO: 3332704 - DNA, 20 bp, Homo sapiens
gctctagggaatctggatta

SEQ ID NO: 3332705 - DNA, 21 bp, Homo sapiens
gctctagggttgctggagcct

SEQ ID NO: 3332706 - DNA, 23 bp, Homo sapiens
gctctagggttgctggagcctga

SEQ ID NO: 3332707 - DNA, 22 bp, Homo sapiens
gctctagttttcagccttggga

SEQ ID NO: 3332708 - DNA, 19 bp, Homo sapiens
gctctatcgcccaggctgg

SEQ ID NO: 3332709 - DNA, 14 bp, Homo sapiens
gctctatctctcaa

SEQ ID NO: 3332710 - DNA, 18 bp, Homo sapiens
gctctatctctcaaaact

SEQ ID NO: 3332711 - DNA, 17 bp, Homo sapiens
gctctattgtagcattt

SEQ ID NO: 3332712 - DNA, 15 bp, Homo sapiens
gctctcaattaaagt

SEQ ID NO: 3332713 - DNA, 14 bp, Homo sapiens
gctctcacccccat

SEQ ID NO: 3332714 - DNA, 16 bp, Homo sapiens
gctctcacccccatcc

SEQ ID NO: 3332715 - DNA, 18 bp, Homo sapiens
gctctcacccccatccct

SEQ ID NO: 3332716 - DNA, 11 bp, Homo sapiens
gctctcagaag

SEQ ID NO: 3332717 - DNA, 16 bp, Homo sapiens
gctctcagctcagcgc

SEQ ID NO: 3332718 - DNA, 18 bp, Homo sapiens
gctctcagctcagcgcca

SEQ ID NO: 3332719 - DNA, 17 bp, Homo sapiens
gctctccaaaggggctg

SEQ ID NO: 3332720 - DNA, 21 bp, Homo sapiens
gctctccaaaggggctgctgg

SEQ ID NO: 3332721 - DNA, 13 bp, Homo sapiens
gctctccaccacc

SEQ ID NO: 3332722 - DNA, 15 bp, Homo sapiens
gctctccagctccaa

SEQ ID NO: 3332723 - DNA, 20 bp, Homo sapiens
gctctccagtcaggaggcat

SEQ ID NO: 3332724 - DNA, 14 bp, Homo sapiens
gctctccctcttct

SEQ ID NO: 3332725 - DNA, 15 bp, Homo sapiens
gctctccctcttctc

SEQ ID NO: 3332726 - DNA, 16 bp, Homo sapiens
gctctccctcttctca

SEQ ID NO: 3332727 - DNA, 21 bp, Homo sapiens
gctctccctcttctcaagtgc

SEQ ID NO: 3332728 - DNA, 17 bp, Homo sapiens
gctctccgaccagacac

SEQ ID NO: 3332729 - DNA, 19 bp, Homo sapiens
gctctccgaccagacacct

SEQ ID NO: 3332730 - DNA, 19 bp, Homo sapiens
gctctcctcagaagaaaga

SEQ ID NO: 3332731 - DNA, 15 bp, Homo sapiens
gctctcctcttgcca

SEQ ID NO: 3332732 - DNA, 19 bp, Homo sapiens
gctctcgggttgtgtgtct

SEQ ID NO: 3332733 - DNA, 15 bp, Homo sapiens
gctctctaggcctct

SEQ ID NO: 3332734 - DNA, 22 bp, Homo sapiens
gctctctcatcttgttcttccc

SEQ ID NO: 3332735 - DNA, 15 bp, Homo sapiens
gctctctggccttcg

SEQ ID NO: 3332736 - DNA, 11 bp, Homo sapiens
gctctctggga

SEQ ID NO: 3332737 - DNA, 21 bp, Homo sapiens
gctctgaaggtccaaagagtt

SEQ ID NO: 3332738 - DNA, 14 bp, Homo sapiens
gctctgacatccct

SEQ ID NO: 3332739 - DNA, 15 bp, Homo sapiens
gctctgacatccctt

SEQ ID NO: 3332740 - DNA, 20 bp, Homo sapiens
gctctgacatcccttcctgg

SEQ ID NO: 3332741 - DNA, 15 bp, Homo sapiens
gctctgacccagtga

SEQ ID NO: 3332742 - DNA, 14 bp, Homo sapiens
gctctgagagtcta

SEQ ID NO: 3332743 - DNA, 20 bp, Homo sapiens
gctctgagagtctagattct

SEQ ID NO: 3332744 - DNA, 13 bp, Homo sapiens
gctctgagccaga

SEQ ID NO: 3332745 - DNA, 14 bp, Homo sapiens
gctctgagccagat

SEQ ID NO: 3332746 - DNA, 16 bp, Homo sapiens
gctctgagccagatta
